United States Patent 7,374,927 (METHODS OF ANALYSIS OF DEGRADED NUCLEIC ACID SAMPLES) - sequence listing, part 11

SEQ ID NO: 400907 - DNA, 25 bp, Homo sapien
ggatgaatccccatctgtgcctcga

SEQ ID NO: 400908 - DNA, 25 bp, Homo sapien
tgtgcctcgaccatcaaagccggag

SEQ ID NO: 400909 - DNA, 25 bp, Homo sapien
gaccatcaaagccggagctccaggg

SEQ ID NO: 400910 - DNA, 25 bp, Homo sapien
aaaggctttgtgcaattgcctggtc

SEQ ID NO: 400911 - DNA, 25 bp, Homo sapien
ctttgtgcaattgcctggtcttttt

SEQ ID NO: 400912 - DNA, 25 bp, Homo sapien
caaatctctgcaccaaagctcattg

SEQ ID NO: 400913 - DNA, 25 bp, Homo sapien
aatctctgcaccaaagctcattgca

SEQ ID NO: 400914 - DNA, 25 bp, Homo sapien
caggctgcaggctttcagaggccca

SEQ ID NO: 400915 - DNA, 25 bp, Homo sapien
gcaggctttcagaggcccacctggg

SEQ ID NO: 400916 - DNA, 25 bp, Homo sapien
gggctcccagcgcaactgcaggcat

SEQ ID NO: 400917 - DNA, 25 bp, Homo sapien
gcaactgcaggcatcctctagtggg

SEQ ID NO: 400918 - DNA, 25 bp, Homo sapien
gggcctctggtaaccctagcagatg

SEQ ID NO: 400919 - DNA, 25 bp, Homo sapien
taaccctagcagatggtggtgaccc

SEQ ID NO: 400920 - DNA, 25 bp, Homo sapien
tggtgacccccctgagatgaggaag

SEQ ID NO: 400921 - DNA, 25 bp, Homo sapien
agactgagcagcagcctatgggctc

SEQ ID NO: 400922 - DNA, 25 bp, Homo sapien
atgggctccgggtcaagtgctattc

SEQ ID NO: 400923 - DNA, 25 bp, Homo sapien
ggtcaagtgctattcccagcggatg

SEQ ID NO: 400924 - DNA, 25 bp, Homo sapien
agtgctattcccagcggatgccctt

SEQ ID NO: 400925 - DNA, 25 bp, Homo sapien
actggtcaggattcagatttcccag

SEQ ID NO: 400926 - DNA, 25 bp, Homo sapien
tcagatttcccagttactgctgctt

SEQ ID NO: 400927 - DNA, 25 bp, Homo sapien
cagttactgctgcttctacagtgga

SEQ ID NO: 400928 - DNA, 25 bp, Homo sapien
actgctgcttctacagtggactttc

SEQ ID NO: 400929 - DNA, 25 bp, Homo sapien
gtgaagaaaacgtatgcagatcttt

SEQ ID NO: 400930 - DNA, 25 bp, Homo sapien
aagactgtgaaatggaaaagtgtcc

SEQ ID NO: 400931 - DNA, 25 bp, Homo sapien
aaaagtgtccagactcttgtgccca

SEQ ID NO: 400932 - DNA, 25 bp, Homo sapien
gactcttgtgcccatgagatggagt

SEQ ID NO: 400933 - DNA, 25 bp, Homo sapien
ttgtgcccatgagatggagtctgtt

SEQ ID NO: 400934 - DNA, 25 bp, Homo sapien
tggagtctgttgcagatcatgaacc

SEQ ID NO: 400935 - DNA, 25 bp, Homo sapien
gtctgttgcagatcatgaaccaaat

SEQ ID NO: 400936 - DNA, 25 bp, Homo sapien
ttcactttttacctatccctaatgc

SEQ ID NO: 400937 - DNA, 25 bp, Homo sapien
tcactttttacctatccctaatgct

SEQ ID NO: 400938 - DNA, 25 bp, Homo sapien
cactttttacctatccctaatgctt

SEQ ID NO: 400939 - DNA, 25 bp, Homo sapien
tttaaaatcaacgtgtaaacacaat

SEQ ID NO: 400940 - DNA, 25 bp, Homo sapien
aaaaatcaatgtgtaagctgaactt

SEQ ID NO: 400941 - DNA, 25 bp, Homo sapien
aaaatcaatgtgtaagctgaacttt

SEQ ID NO: 400942 - DNA, 25 bp, Homo sapien
aaatcaatgtgtaagctgaacttta

SEQ ID NO: 400943 - DNA, 25 bp, Homo sapien
aatcaatgtgtaagctgaactttaa

SEQ ID NO: 400944 - DNA, 25 bp, Homo sapien
atcaatgtgtaagctgaactttaaa

SEQ ID NO: 400945 - DNA, 25 bp, Homo sapien
tcaatgtgtaagctgaactttaaaa

SEQ ID NO: 400946 - DNA, 25 bp, Homo sapien
atgaattagggataggtacaaataa

SEQ ID NO: 400947 - DNA, 25 bp, Homo sapien
tttatctctggccactcaaaaatgc

SEQ ID NO: 400948 - DNA, 25 bp, Homo sapien
aatgcagtgccaggagtgctaaacc

SEQ ID NO: 400949 - DNA, 25 bp, Homo sapien
ggagtgctaaacctagaggccaata

SEQ ID NO: 400950 - DNA, 25 bp, Homo sapien
agaggccaatactgatgacctggaa

SEQ ID NO: 400951 - DNA, 25 bp, Homo sapien
tgatccatatgattgtcaccacaaa

SEQ ID NO: 400952 - DNA, 25 bp, Homo sapien
gattgtcaccacaaagtgcttttac

SEQ ID NO: 400953 - DNA, 25 bp, Homo sapien
ttgtgctgtatacaaattacatggg

SEQ ID NO: 400954 - DNA, 25 bp, Homo sapien
ggagtgagatccttctgtgataaaa

SEQ ID NO: 400955 - DNA, 25 bp, Homo sapien
gataaaatgaattcaccactctggt

SEQ ID NO: 400956 - DNA, 25 bp, Homo sapien
tgaattcaccactctggttacccaa

SEQ ID NO: 400957 - DNA, 25 bp, Homo sapien
accactctggttacccaactacaga

SEQ ID NO: 400958 - DNA, 25 bp, Homo sapien
gttttaggaagctcatattttaaga

SEQ ID NO: 400959 - DNA, 25 bp, Homo sapien
actaaaatatattctcatggttgag

SEQ ID NO: 400960 - DNA, 25 bp, Homo sapien
ctcatggttgaggacataagacatt

SEQ ID NO: 400961 - DNA, 25 bp, Homo sapien
gaaactaggtcaacttctcaatacc

SEQ ID NO: 400962 - DNA, 25 bp, Homo sapien
gtcaacttctcaatacctttatcaa

SEQ ID NO: 400963 - DNA, 25 bp, Homo sapien
gaaatcgcgcactgatctagcctgg

SEQ ID NO: 400964 - DNA, 25 bp, Homo sapien
tttatcaaagcacctgcagttccca

SEQ ID NO: 400965 - DNA, 25 bp, Homo sapien
ctgcagttcccatttcattgcaagt

SEQ ID NO: 400966 - DNA, 25 bp, Homo sapien
aagtagctggtgtatattcagtaca

SEQ ID NO: 400967 - DNA, 25 bp, Homo sapien
tcagtacacttttaaaatagcctat

SEQ ID NO: 400968 - DNA, 25 bp, Homo sapien
actgatctagcctgggagtgagtga

SEQ ID NO: 400969 - DNA, 25 bp, Homo sapien
ggaagccagcagacctgcagaactt

SEQ ID NO: 400970 - DNA, 25 bp, Homo sapien
tgcagaacttggctcccgggaccca

SEQ ID NO: 400971 - DNA, 25 bp, Homo sapien
tcccaagtacttaaagctttcacca

SEQ ID NO: 400972 - DNA, 25 bp, Homo sapien
taaagctttcaccaaaacacccaga

SEQ ID NO: 400973 - DNA, 25 bp, Homo sapien
ctttcaccaaaacacccagaatcaa

SEQ ID NO: 400974 - DNA, 25 bp, Homo sapien
gaatcaaatactgctggaatggaca

SEQ ID NO: 400975 - DNA, 25 bp, Homo sapien
gctggaatggacatctttgccaaat

SEQ ID NO: 400976 - DNA, 25 bp, Homo sapien
gccaaattctctgcatatatcaaga

SEQ ID NO: 400977 - DNA, 25 bp, Homo sapien
cagaggctaatgaagcactggagag

SEQ ID NO: 400978 - DNA, 25 bp, Homo sapien
gggtctcctgaaaaccctgcagaaa

SEQ ID NO: 400979 - DNA, 25 bp, Homo sapien
cctgaaaaccctgcagaaactggat

SEQ ID NO: 400980 - DNA, 25 bp, Homo sapien
gggtttcctgtgttcttaatctcct

SEQ ID NO: 400981 - DNA, 25 bp, Homo sapien
gtgttcttaatctcctgaaacttga

SEQ ID NO: 400982 - DNA, 25 bp, Homo sapien
ttgaggacctcatggttacaccctg

SEQ ID NO: 400983 - DNA, 25 bp, Homo sapien
ttacaccctgccctacaagttttct

SEQ ID NO: 400984 - DNA, 25 bp, Homo sapien
tttctcttacccgtttattcaggat

SEQ ID NO: 400985 - DNA, 25 bp, Homo sapien
acccgtttattcaggatgtcacaca

SEQ ID NO: 400986 - DNA, 25 bp, Homo sapien
tttgaaaggtctacccctgagtaag

SEQ ID NO: 400987 - DNA, 25 bp, Homo sapien
atagctctctgtgcttgaatcttgt

SEQ ID NO: 400988 - DNA, 25 bp, Homo sapien
gaatcttgtaacaggctgctcttat

SEQ ID NO: 400989 - DNA, 25 bp, Homo sapien
tgctcttataagcagtgccccagat

SEQ ID NO: 400990 - DNA, 25 bp, Homo sapien
cagtgccccagatccttctaatggg

SEQ ID NO: 400991 - DNA, 25 bp, Homo sapien
accagagcacagaccggctgacggc

SEQ ID NO: 400992 - DNA, 25 bp, Homo sapien
gcacagaccggctgacggcagagat

SEQ ID NO: 400993 - DNA, 25 bp, Homo sapien
tgacggcagagatctggaaagacgt

SEQ ID NO: 400994 - DNA, 25 bp, Homo sapien
tggaacaggtgagcagcctgggcga

SEQ ID NO: 400995 - DNA, 25 bp, Homo sapien
tatgttccggacagtgggacagctc

SEQ ID NO: 400996 - DNA, 25 bp, Homo sapien
gttccggacagtgggacagctctac

SEQ ID NO: 400997 - DNA, 25 bp, Homo sapien
ccggacagtgggacagctctacaag

SEQ ID NO: 400998 - DNA, 25 bp, Homo sapien
aaggagtccctgagccgcctcatgg

SEQ ID NO: 400999 - DNA, 25 bp, Homo sapien
tcagcaacaccaaccccagttttgt

SEQ ID NO: 401000 - DNA, 25 bp, Homo sapien
accccagttttgtccgctgcattgt

SEQ ID NO: 401001 - DNA, 25 bp, Homo sapien
aagagggccgggaagctggagccgc

SEQ ID NO: 401002 - DNA, 25 bp, Homo sapien
agaggttccacacactctctgaagc

SEQ ID NO: 401003 - DNA, 25 bp, Homo sapien
tgcacctactccttgaggctgaact

SEQ ID NO: 401004 - DNA, 25 bp, Homo sapien
gaactggtcacagacaaactgggat

SEQ ID NO: 401005 - DNA, 25 bp, Homo sapien
aaactgggatccagcacagtccagc

SEQ ID NO: 401006 - DNA, 25 bp, Homo sapien
cagcacagtccagcagttctcaaaa

SEQ ID NO: 401007 - DNA, 25 bp, Homo sapien
aaatgaggtcctcaggccacagtgc

SEQ ID NO: 401008 - DNA, 25 bp, Homo sapien
ggccacagtgcgtgagaacttgctt

SEQ ID NO: 401009 - DNA, 25 bp, Homo sapien
cttgcttggctgtttgttaaatgct

SEQ ID NO: 401010 - DNA, 25 bp, Homo sapien
tgttaaatgctaattcttgggcccc

SEQ ID NO: 401011 - DNA, 25 bp, Homo sapien
gccccatcagagctactgcatcgaa

SEQ ID NO: 401012 - DNA, 25 bp, Homo sapien
cagagctactgcatcgaaacctggg

SEQ ID NO: 401013 - DNA, 25 bp, Homo sapien
tttctcagaagcctagcagtactta

SEQ ID NO: 401014 - DNA, 25 bp, Homo sapien
agaagcctagcagtacttactcctc

SEQ ID NO: 401015 - DNA, 25 bp, Homo sapien
gaactcttaaggattaatgctcttg

SEQ ID NO: 401016 - DNA, 25 bp, Homo sapien
cttaaggattaatgctcttgagtta

SEQ ID NO: 401017 - DNA, 25 bp, Homo sapien
ctcttgagttatgagatatccctac

SEQ ID NO: 401018 - DNA, 25 bp, Homo sapien
gttatgagatatccctacattccaa

SEQ ID NO: 401019 - DNA, 25 bp, Homo sapien
tacattccaataactctaccttcta

SEQ ID NO: 401020 - DNA, 25 bp, Homo sapien
tccaataactctaccttctattttt

SEQ ID NO: 401021 - DNA, 25 bp, Homo sapien
gtttgagtagtttctgttcctttct

SEQ ID NO: 401022 - DNA, 25 bp, Homo sapien
tccaaaacaacccactgagaacttg

SEQ ID NO: 401023 - DNA, 25 bp, Homo sapien
acaacccactgagaacttggaaata

SEQ ID NO: 401024 - DNA, 25 bp, Homo sapien
gtctgcagcatcttctttatgtcta

SEQ ID NO: 401025 - DNA, 25 bp, Homo sapien
gtctaccttgactgttacaaactta

SEQ ID NO: 401026 - DNA, 25 bp, Homo sapien
aaaagagttacatgaagcacaccct

SEQ ID NO: 401027 - DNA, 25 bp, Homo sapien
atgaagcacacccttggtttgaatt

SEQ ID NO: 401028 - DNA, 25 bp, Homo sapien
gttgccagtaacttaacagatccca

SEQ ID NO: 401029 - DNA, 25 bp, Homo sapien
atcccaaactgatcttccaggctag

SEQ ID NO: 401030 - DNA, 25 bp, Homo sapien
caggctagccttgcaaatgctcaga

SEQ ID NO: 401031 - DNA, 25 bp, Homo sapien
gcaaatgctcagattttgattccca

SEQ ID NO: 401032 - DNA, 25 bp, Homo sapien
ttttgattcccaccaatcaggccag

SEQ ID NO: 401033 - DNA, 25 bp, Homo sapien
atcaggccagtgtaagcagtatgct

SEQ ID NO: 401034 - DNA, 25 bp, Homo sapien
tattggaaggacataccctcctggc

SEQ ID NO: 401035 - DNA, 25 bp, Homo sapien
gtagcttttaatgttgcgcctcttc

SEQ ID NO: 401036 - DNA, 25 bp, Homo sapien
agcttttaatgttgcgcctcttcag

SEQ ID NO: 401037 - DNA, 25 bp, Homo sapien
ttaatgttgcgcctcttcaggttct

SEQ ID NO: 401038 - DNA, 25 bp, Homo sapien
atgttgcgcctcttcaggttcttaa

SEQ ID NO: 401039 - DNA, 25 bp, Homo sapien
gcgcctcttcaggttcttaagggat

SEQ ID NO: 401040 - DNA, 25 bp, Homo sapien
tcttcaggttcttaagggattctcc

SEQ ID NO: 401041 - DNA, 25 bp, Homo sapien
gtacacgtttggaaaataatctgca

SEQ ID NO: 401042 - DNA, 25 bp, Homo sapien
taatctgcagaaacgagctgtgctt

SEQ ID NO: 401043 - DNA, 25 bp, Homo sapien
gaaacgagctgtgcttgcaaagact

SEQ ID NO: 401044 - DNA, 25 bp, Homo sapien
cgagctgtgcttgcaaagacttcat

SEQ ID NO: 401045 - DNA, 25 bp, Homo sapien
ctgtgcttgcaaagacttcatagtt

SEQ ID NO: 401046 - DNA, 25 bp, Homo sapien
aatttgggtcaaaatattggtatat

SEQ ID NO: 401047 - DNA, 25 bp, Homo sapien
tctgacttaatgtgttagaaattag

SEQ ID NO: 401048 - DNA, 25 bp, Homo sapien
aatacagtgggaggatttttagaca

SEQ ID NO: 401049 - DNA, 25 bp, Homo sapien
tacagtgggaggatttttagacatt

SEQ ID NO: 401050 - DNA, 25 bp, Homo sapien
gctgttacccaaggtattttagata

SEQ ID NO: 401051 - DNA, 25 bp, Homo sapien
atttaaagtggaacatttagcctgt

SEQ ID NO: 401052 - DNA, 25 bp, Homo sapien
aaagtggaacatttagcctgttcat

SEQ ID NO: 401053 - DNA, 25 bp, Homo sapien
aagtggaacatttagcctgttcatt

SEQ ID NO: 401054 - DNA, 25 bp, Homo sapien
ggaacatttagcctgttcattttaa

SEQ ID NO: 401055 - DNA, 25 bp, Homo sapien
acatttagcctgttcattttaatct

SEQ ID NO: 401056 - DNA, 25 bp, Homo sapien
atttagcctgttcattttaatctaa

SEQ ID NO: 401057 - DNA, 25 bp, Homo sapien
ggaaaaaactataccatctactgca

SEQ ID NO: 401058 - DNA, 25 bp, Homo sapien
atctactgcaattattcaaccactt

SEQ ID NO: 401059 - DNA, 25 bp, Homo sapien
tattcaaccacttcagacagactgt

SEQ ID NO: 401060 - DNA, 25 bp, Homo sapien
attggtacaggcaggatcctgggaa

SEQ ID NO: 401061 - DNA, 25 bp, Homo sapien
atcctgggaaaagtctggaatctct

SEQ ID NO: 401062 - DNA, 25 bp, Homo sapien
tggaatctctgtttgtgttgctatc

SEQ ID NO: 401063 - DNA, 25 bp, Homo sapien
gggacgattaatggcctcacttgat

SEQ ID NO: 401064 - DNA, 25 bp, Homo sapien
tcacttgataccaaagcccgtctca

SEQ ID NO: 401065 - DNA, 25 bp, Homo sapien
ctgtggcttcaactagaccggttaa

SEQ ID NO: 401066 - DNA, 25 bp, Homo sapien
agaccggttaagtggagagctgaaa

SEQ ID NO: 401067 - DNA, 25 bp, Homo sapien
ggaacaaaaccctctgttcctgagc

SEQ ID NO: 401068 - DNA, 25 bp, Homo sapien
gaaaattctctattgtgtcatccta

SEQ ID NO: 401069 - DNA, 25 bp, Homo sapien
ttctctattgtgtcatcctaacagc

SEQ ID NO: 401070 - DNA, 25 bp, Homo sapien
tattgtgtcatcctaacagctaaca

SEQ ID NO: 401071 - DNA, 25 bp, Homo sapien
gtcatcctaacagctaacacagagt

SEQ ID NO: 401072 - DNA, 25 bp, Homo sapien
aacagctaacacagagttcctcttc

SEQ ID NO: 401073 - DNA, 25 bp, Homo sapien
gctaacacagagttcctcttcgaag

SEQ ID NO: 401074 - DNA, 25 bp, Homo sapien
cagagttcctcttcgaagaaacttt

SEQ ID NO: 401075 - DNA, 25 bp, Homo sapien
cgccgccccatctgggaagtaagga

SEQ ID NO: 401076 - DNA, 25 bp, Homo sapien
aggagtgcctctgcgcgactgctgt

SEQ ID NO: 401077 - DNA, 25 bp, Homo sapien
gactgctgtgcaaccatccaagtat

SEQ ID NO: 401078 - DNA, 25 bp, Homo sapien
actgctgtgcaaccatccaagtatg

SEQ ID NO: 401079 - DNA, 25 bp, Homo sapien
tcaaatcaataaagcttcaccaaga

SEQ ID NO: 401080 - DNA, 25 bp, Homo sapien
aaagcttcaccaagaaggttgccca

SEQ ID NO: 401081 - DNA, 25 bp, Homo sapien
agcttcaccaagaaggttgcccagg

SEQ ID NO: 401082 - DNA, 25 bp, Homo sapien
cttcaccaagaaggttgcccaggaa

SEQ ID NO: 401083 - DNA, 25 bp, Homo sapien
ttcaccaagaaggttgcccaggaaa

SEQ ID NO: 401084 - DNA, 25 bp, Homo sapien
caccaagaaggttgcccaggaaacg

SEQ ID NO: 401085 - DNA, 25 bp, Homo sapien
gaaggttgcccaggaaacgggcaca

SEQ ID NO: 401086 - DNA, 25 bp, Homo sapien
ggttgcccaggaaacgggcacagaa

SEQ ID NO: 401087 - DNA, 25 bp, Homo sapien
caggaaacgggcacagaagagatca

SEQ ID NO: 401088 - DNA, 25 bp, Homo sapien
ggaaacgggcacagaagagatcagt

SEQ ID NO: 401089 - DNA, 25 bp, Homo sapien
gagatcagtgggatctgatgagtaa

SEQ ID NO: 401090 - DNA, 25 bp, Homo sapien
gagagtagcagtcttaactgcagtt

SEQ ID NO: 401091 - DNA, 25 bp, Homo sapien
tagcagtcttaactgcagttacaca

SEQ ID NO: 401092 - DNA, 25 bp, Homo sapien
tgttggagtgtgcattcatagtctt

SEQ ID NO: 401093 - DNA, 25 bp, Homo sapien
gagtgtgcattcatagtcttgtggc

SEQ ID NO: 401094 - DNA, 25 bp, Homo sapien
gtgcattcatagtcttgtggcttca

SEQ ID NO: 401095 - DNA, 25 bp, Homo sapien
gcattcatagtcttgtggcttcagc

SEQ ID NO: 401096 - DNA, 25 bp, Homo sapien
ttcatagtcttgtggcttcagcttg

SEQ ID NO: 401097 - DNA, 25 bp, Homo sapien
atagtcttgtggcttcagcttggct

SEQ ID NO: 401098 - DNA, 25 bp, Homo sapien
aagaccaggtgacgcagagtcccga

SEQ ID NO: 401099 - DNA, 25 bp, Homo sapien
aggtgacgcagagtcccgaggccct

SEQ ID NO: 401100 - DNA, 25 bp, Homo sapien
gtcccgaggccctgagactccagga

SEQ ID NO: 401101 - DNA, 25 bp, Homo sapien
gtttcttcaatatgtcttgatatac

SEQ ID NO: 401102 - DNA, 25 bp, Homo sapien
atgtcttgatatactttgtgcaatt

SEQ ID NO: 401103 - DNA, 25 bp, Homo sapien
gtgcaattaatattacacatgtaag

SEQ ID NO: 401104 - DNA, 25 bp, Homo sapien
cacatgtaagttgtatggcagttta

SEQ ID NO: 401105 - DNA, 25 bp, Homo sapien
gttgtatggcagtttacagaactca

SEQ ID NO: 401106 - DNA, 25 bp, Homo sapien
ggcagtttacagaactcaatgactt

SEQ ID NO: 401107 - DNA, 25 bp, Homo sapien
caatgacttgtcatgaggttttcat

SEQ ID NO: 401108 - DNA, 25 bp, Homo sapien
ggttttcatatgagctacacattgt

SEQ ID NO: 401109 - DNA, 25 bp, Homo sapien
tacacattgtgtacattgattgttt

SEQ ID NO: 401110 - DNA, 25 bp, Homo sapien
tttacataaatccattctgtcattt

SEQ ID NO: 401111 - DNA, 25 bp, Homo sapien
ataaatctccaatgttatgggaaac

SEQ ID NO: 401112 - DNA, 25 bp, Homo sapien
aaacatcatgtataggcagtctgca

SEQ ID NO: 401113 - DNA, 25 bp, Homo sapien
acatcatgtataggcagtctgcatc

SEQ ID NO: 401114 - DNA, 25 bp, Homo sapien
actttacttttaatgtagcacagaa

SEQ ID NO: 401115 - DNA, 25 bp, Homo sapien
aatgtagcacagaatagttttaatg

SEQ ID NO: 401116 - DNA, 25 bp, Homo sapien
taactatagcaagctctaggtactc

SEQ ID NO: 401117 - DNA, 25 bp, Homo sapien
tatagcaagctctaggtactccaat

SEQ ID NO: 401118 - DNA, 25 bp, Homo sapien
tagcaagctctaggtactccaatgg

SEQ ID NO: 401119 - DNA, 25 bp, Homo sapien
gcaagctctaggtactccaatggtg

SEQ ID NO: 401120 - DNA, 25 bp, Homo sapien
aagctctaggtactccaatggtgta

SEQ ID NO: 401121 - DNA, 25 bp, Homo sapien
tctaggtactccaatggtgtacaat

SEQ ID NO: 401122 - DNA, 25 bp, Homo sapien
caatgtcttttgcacaaactttgta

SEQ ID NO: 401123 - DNA, 25 bp, Homo sapien
ctgtgtcacctgcactgtcaccagt

SEQ ID NO: 401124 - DNA, 25 bp, Homo sapien
gggtttcagccgctgctcaatggaa

SEQ ID NO: 401125 - DNA, 25 bp, Homo sapien
gccgctgctcaatggaagcttggtt

SEQ ID NO: 401126 - DNA, 25 bp, Homo sapien
aatggaagcttggttcccgtgccgc

SEQ ID NO: 401127 - DNA, 25 bp, Homo sapien
tgcagctggacgtggaggctctcat

SEQ ID NO: 401128 - DNA, 25 bp, Homo sapien
cgcacgatgagcagggccggcccat

SEQ ID NO: 401129 - DNA, 25 bp, Homo sapien
gggccggcccatccccgagtggaag

SEQ ID NO: 401130 - DNA, 25 bp, Homo sapien
ccggcccatccccgagtggaagcgc

SEQ ID NO: 401131 - DNA, 25 bp, Homo sapien
tgatggtgcgcaagatgcagctgaa

SEQ ID NO: 401132 - DNA, 25 bp, Homo sapien
aagaggaggagcgacagaagcagga

SEQ ID NO: 401133 - DNA, 25 bp, Homo sapien
aggagcgacagaagcaggaggagct

SEQ ID NO: 401134 - DNA, 25 bp, Homo sapien
ttttttaggaaaagcatctgccaca

SEQ ID NO: 401135 - DNA, 25 bp, Homo sapien
ctgccacaaaaatgttcacttcgaa

SEQ ID NO: 401136 - DNA, 25 bp, Homo sapien
gagttcctggaatggcacgttgctg

SEQ ID NO: 401137 - DNA, 25 bp, Homo sapien
tggaatggcacgttgctgccagtgc

SEQ ID NO: 401138 - DNA, 25 bp, Homo sapien
agtgccccagacagttcttttctac

SEQ ID NO: 401139 - DNA, 25 bp, Homo sapien
agacagttcttttctaccctgcggg

SEQ ID NO: 401140 - DNA, 25 bp, Homo sapien
gggcccgcacgttttatgaggttga

SEQ ID NO: 401141 - DNA, 25 bp, Homo sapien
atgaggttgatatcggtgctatgtg

SEQ ID NO: 401142 - DNA, 25 bp, Homo sapien
tatcggtgctatgtgtttggtttat

SEQ ID NO: 401143 - DNA, 25 bp, Homo sapien
caagaaattctgctgttacgacaaa

SEQ ID NO: 401144 - DNA, 25 bp, Homo sapien
gacaaagaaacattttacgctagat

SEQ ID NO: 401145 - DNA, 25 bp, Homo sapien
agttctgctgttggactctggactg

SEQ ID NO: 401146 - DNA, 25 bp, Homo sapien
ttctgctgttggactctggactgtt

SEQ ID NO: 401147 - DNA, 25 bp, Homo sapien
ctgctgttggactctggactgtttc

SEQ ID NO: 401148 - DNA, 25 bp, Homo sapien
ccctctcagcatcgcttttgctggg

SEQ ID NO: 401149 - DNA, 25 bp, Homo sapien
gccattgccgccactatctgtgtaa

SEQ ID NO: 401150 - DNA, 25 bp, Homo sapien
cattgccgccactatctgtgtaata

SEQ ID NO: 401151 - DNA, 25 bp, Homo sapien
ttgccgccactatctgtgtaataaa

SEQ ID NO: 401152 - DNA, 25 bp, Homo sapien
aggaggttattgacgcattcatctc

SEQ ID NO: 401153 - DNA, 25 bp, Homo sapien
aggttattgacgcattcatctctga

SEQ ID NO: 401154 - DNA, 25 bp, Homo sapien
ggttattgacgcattcatctctgag

SEQ ID NO: 401155 - DNA, 25 bp, Homo sapien
gttattgacgcattcatctctgaga

SEQ ID NO: 401156 - DNA, 25 bp, Homo sapien
ggactttgaggcctacacgaagatt

SEQ ID NO: 401157 - DNA, 25 bp, Homo sapien
gaagatttgtgatccaggcctcact

SEQ ID NO: 401158 - DNA, 25 bp, Homo sapien
tcacttcctttgagcctgaggccct

SEQ ID NO: 401159 - DNA, 25 bp, Homo sapien
tgaggcccttggtaacctcgtggag

SEQ ID NO: 401160 - DNA, 25 bp, Homo sapien
gatggatttccataagttttacttt

SEQ ID NO: 401161 - DNA, 25 bp, Homo sapien
gttttactttgagaatctcctgtcc

SEQ ID NO: 401162 - DNA, 25 bp, Homo sapien
gagaatctcctgtccaagaacagca

SEQ ID NO: 401163 - DNA, 25 bp, Homo sapien
agaacagcaagcctatccataccac

SEQ ID NO: 401164 - DNA, 25 bp, Homo sapien
taaacccacacgtccacgtgattgg

SEQ ID NO: 401165 - DNA, 25 bp, Homo sapien
gaggacgcagcgtgcatcgcctaca

SEQ ID NO: 401166 - DNA, 25 bp, Homo sapien
cacccagtacatcgacgggcagggt

SEQ ID NO: 401167 - DNA, 25 bp, Homo sapien
tcgaggacttcactgaaatttcgtg

SEQ ID NO: 401168 - DNA, 25 bp, Homo sapien
tgaaatttcgtgactcatcctcccg

SEQ ID NO: 401169 - DNA, 25 bp, Homo sapien
tgaagatgctctttccttgatacct

SEQ ID NO: 401170 - DNA, 25 bp, Homo sapien
atgctctttccttgatacctcctga

SEQ ID NO: 401171 - DNA, 25 bp, Homo sapien
tgatacctcctgactcatcaccaag

SEQ ID NO: 401172 - DNA, 25 bp, Homo sapien
ctcctgactcatcaccaagatgaat

SEQ ID NO: 401173 - DNA, 25 bp, Homo sapien
tcaccaagatgaattactccaaatg

SEQ ID NO: 401174 - DNA, 25 bp, Homo sapien
gaattactccaaatgtagccaacgg

SEQ ID NO: 401175 - DNA, 25 bp, Homo sapien
tccaaatgtagccaacggtggtttt

SEQ ID NO: 401176 - DNA, 25 bp, Homo sapien
taaaaataaagagccaccccgagag

SEQ ID NO: 401177 - DNA, 25 bp, Homo sapien
gagccaccccgagagtggtacagaa

SEQ ID NO: 401178 - DNA, 25 bp, Homo sapien
gctggaggctaggatgcagatttta

SEQ ID NO: 401179 - DNA, 25 bp, Homo sapien
tggagcagcctgaatctgattcccg

SEQ ID NO: 401180 - DNA, 25 bp, Homo sapien
gattcccgaatcaatggtgtttccc

SEQ ID NO: 401181 - DNA, 25 bp, Homo sapien
atcaatggtgtttccccatgggctt

SEQ ID NO: 401182 - DNA, 25 bp, Homo sapien
tcagcattctgcactgagctactcg

SEQ ID NO: 401183 - DNA, 25 bp, Homo sapien
tgagctactcgcttgatccagatgc

SEQ ID NO: 401184 - DNA, 25 bp, Homo sapien
ggttcaccgccagagtcgattatat

SEQ ID NO: 401185 - DNA, 25 bp, Homo sapien
agagtcgattatatctccccatcac

SEQ ID NO: 401186 - DNA, 25 bp, Homo sapien
ccccatcacacgtctgaggattcag

SEQ ID NO: 401187 - DNA, 25 bp, Homo sapien
tagcagaagcaaaactcctcaggca

SEQ ID NO: 401188 - DNA, 25 bp, Homo sapien
tcctcaggcagcacaaaggtcggct

SEQ ID NO: 401189 - DNA, 25 bp, Homo sapien
tatggaagcatttgacgtggtgaat

SEQ ID NO: 401190 - DNA, 25 bp, Homo sapien
agtgagtctctattttggccaccat

SEQ ID NO: 401191 - DNA, 25 bp, Homo sapien
tgtaacttgggcagattatcgagca

SEQ ID NO: 401192 - DNA, 25 bp, Homo sapien
gccttccctaagtaagactgacatg

SEQ ID NO: 401193 - DNA, 25 bp, Homo sapien
ggcacccagcaacctgaatgtgtat

SEQ ID NO: 401194 - DNA, 25 bp, Homo sapien
attccatctgatggcataggcccag

SEQ ID NO: 401195 - DNA, 25 bp, Homo sapien
ggcataggcccagaaagaactgttc

SEQ ID NO: 401196 - DNA, 25 bp, Homo sapien
gagcagggtttaattctcctcgttt

SEQ ID NO: 401197 - DNA, 25 bp, Homo sapien
aattctcctcgtttgtggaactggc

SEQ ID NO: 401198 - DNA, 25 bp, Homo sapien
gaactggcccagtcactgtgggact

SEQ ID NO: 401199 - DNA, 25 bp, Homo sapien
tgggactgcgacaagtaacaggtat

SEQ ID NO: 401200 - DNA, 25 bp, Homo sapien
ccgggcgcgggtgcagggaagccag

SEQ ID NO: 401201 - DNA, 25 bp, Homo sapien
aggctcctccgcacggtgccggcga

SEQ ID NO: 401202 - DNA, 25 bp, Homo sapien
acagcgggcggaagcctccgaagct

SEQ ID NO: 401203 - DNA, 25 bp, Homo sapien
gaagcctccgaagctgcggccggga

SEQ ID NO: 401204 - DNA, 25 bp, Homo sapien
gggtccctccaaccaacagcccatt

SEQ ID NO: 401205 - DNA, 25 bp, Homo sapien
aacagcccattctcttcctgcgtgg

SEQ ID NO: 401206 - DNA, 25 bp, Homo sapien
cattctcttcctgcgtggcggtcga

SEQ ID NO: 401207 - DNA, 25 bp, Homo sapien
ttctcttcctgcgtggcggtcgatc

SEQ ID NO: 401208 - DNA, 25 bp, Homo sapien
ctcttcctgcgtggcggtcgatctt

SEQ ID NO: 401209 - DNA, 25 bp, Homo sapien
cctgcgtggcggtcgatcttgcctg

SEQ ID NO: 401210 - DNA, 25 bp, Homo sapien
cgtggcggtcgatcttgcctgggcc

SEQ ID NO: 401211 - DNA, 25 bp, Homo sapien
agaaacaagaattccacccacgcac

SEQ ID NO: 401212 - DNA, 25 bp, Homo sapien
acacctctctcatcgaaaaaccggg

SEQ ID NO: 401213 - DNA, 25 bp, Homo sapien
caacgagcggagaactctggctgaa

SEQ ID NO: 401214 - DNA, 25 bp, Homo sapien
tctggctgaattaacggtggctccc

SEQ ID NO: 401215 - DNA, 25 bp, Homo sapien
aattaacggtggctcccagaagctc

SEQ ID NO: 401216 - DNA, 25 bp, Homo sapien
tgcccctctgacagctgtcgcttgg

SEQ ID NO: 401217 - DNA, 25 bp, Homo sapien
ggcagcccgagagaagaattgtcct

SEQ ID NO: 401218 - DNA, 25 bp, Homo sapien
ctggtgccagaggacgcaggaaatt

SEQ ID NO: 401219 - DNA, 25 bp, Homo sapien
cgtactcgtaggacgcccggttgca

SEQ ID NO: 401220 - DNA, 25 bp, Homo sapien
ttgcaggccaggaccgagttggact

SEQ ID NO: 401221 - DNA, 25 bp, Homo sapien
ccgagttggactgttggtagaaaca

SEQ ID NO: 401222 - DNA, 25 bp, Homo sapien
gggctcatggtttccctctactttg

SEQ ID NO: 401223 - DNA, 25 bp, Homo sapien
atggtttccctctactttgggagag

SEQ ID NO: 401224 - DNA, 25 bp, Homo sapien
tctactttgggagagggcacagatt

SEQ ID NO: 401225 - DNA, 25 bp, Homo sapien
tactttgggagagggcacagattgc

SEQ ID NO: 401226 - DNA, 25 bp, Homo sapien
agagggcacagattgcagaggtaat

SEQ ID NO: 401227 - DNA, 25 bp, Homo sapien
gattgcagaggtaatgctgtggcat

SEQ ID NO: 401228 - DNA, 25 bp, Homo sapien
tgcagaggtaatgctgtggcatatt

SEQ ID NO: 401229 - DNA, 25 bp, Homo sapien
tgcttctgcctcagtgtatcactgg

SEQ ID NO: 401230 - DNA, 25 bp, Homo sapien
ttctgcctcagtgtatcactggagt

SEQ ID NO: 401231 - DNA, 25 bp, Homo sapien
gtatcactggagtcacaggaccctg

SEQ ID NO: 401232 - DNA, 25 bp, Homo sapien
cccttctgaggctgctttcccaaaa

SEQ ID NO: 401233 - DNA, 25 bp, Homo sapien
gcacacaccctgtggtttatttggt

SEQ ID NO: 401234 - DNA, 25 bp, Homo sapien
tttggtggtcagtaaggaacgtctt

SEQ ID NO: 401235 - DNA, 25 bp, Homo sapien
agtaaggaacgtctttgctgctaag

SEQ ID NO: 401236 - DNA, 25 bp, Homo sapien
tggaccctggcagaggccctcttgt

SEQ ID NO: 401237 - DNA, 25 bp, Homo sapien
acactgtgattctgcctgtacctga

SEQ ID NO: 401238 - DNA, 25 bp, Homo sapien
attctgcctgtacctgagcatctgt

SEQ ID NO: 401239 - DNA, 25 bp, Homo sapien
tgtacctgagcatctgtcctgtgct

SEQ ID NO: 401240 - DNA, 25 bp, Homo sapien
tgtcctgtgctcctaggccggagac

SEQ ID NO: 401241 - DNA, 25 bp, Homo sapien
gcggttggctgagtcccagagaaaa

SEQ ID NO: 401242 - DNA, 25 bp, Homo sapien
aaacactcctcactgggcactcttg

SEQ ID NO: 401243 - DNA, 25 bp, Homo sapien
tgggcactcttgatgcttgcacaca

SEQ ID NO: 401244 - DNA, 25 bp, Homo sapien
gctggtgagcagtccaggtgcccaa

SEQ ID NO: 401245 - DNA, 25 bp, Homo sapien
gagcagtccaggtgcccaagggcca

SEQ ID NO: 401246 - DNA, 25 bp, Homo sapien
aggaagccgggctggctgagggtcc

SEQ ID NO: 401247 - DNA, 25 bp, Homo sapien
cccggcgagccccaggaagagcctc

SEQ ID NO: 401248 - DNA, 25 bp, Homo sapien
cagggagggtttcccacctcagagt

SEQ ID NO: 401249 - DNA, 25 bp, Homo sapien
ggagggtttcccacctcagagtaca

SEQ ID NO: 401250 - DNA, 25 bp, Homo sapien
gagggtttcccacctcagagtacac

SEQ ID NO: 401251 - DNA, 25 bp, Homo sapien
gtttcccacctcagagtacaccgag

SEQ ID NO: 401252 - DNA, 25 bp, Homo sapien
ttcccacctcagagtacaccgaggg

SEQ ID NO: 401253 - DNA, 25 bp, Homo sapien
gtcgggacagcgtggaataaacatt

SEQ ID NO: 401254 - DNA, 25 bp, Homo sapien
gggacagcgtggaataaacattatt

SEQ ID NO: 401255 - DNA, 25 bp, Homo sapien
aggagcctgggcatctgttgacttt

SEQ ID NO: 401256 - DNA, 25 bp, Homo sapien
tcccagtgttctaggttaatgtttt

SEQ ID NO: 401257 - DNA, 25 bp, Homo sapien
tatttggttgcctgcataatccctg

SEQ ID NO: 401258 - DNA, 25 bp, Homo sapien
ataatccctgttctgtttcactgat

SEQ ID NO: 401259 - DNA, 25 bp, Homo sapien
gtgtttgcagcaccactgttcatgg

SEQ ID NO: 401260 - DNA, 25 bp, Homo sapien
atggtggtccactgttatcctatgc

SEQ ID NO: 401261 - DNA, 25 bp, Homo sapien
gttatcctatgccagggtgctaaga

SEQ ID NO: 401262 - DNA, 25 bp, Homo sapien
ttgcatgatattcatcttccctgct

SEQ ID NO: 401263 - DNA, 25 bp, Homo sapien
tcatcttccctgctctatttaaatt

SEQ ID NO: 401264 - DNA, 25 bp, Homo sapien
gagtcatcttgacattaacactgaa

SEQ ID NO: 401265 - DNA, 25 bp, Homo sapien
cactgaaatgtgatctaggtcctta

SEQ ID NO: 401266 - DNA, 25 bp, Homo sapien
gagtgctacccggtgtactggaacc

SEQ ID NO: 401267 - DNA, 25 bp, Homo sapien
ctacccggtgtactggaaccaggct

SEQ ID NO: 401268 - DNA, 25 bp, Homo sapien
ggaaccaggctgataaaataccagt

SEQ ID NO: 401269 - DNA, 25 bp, Homo sapien
aaataccagtaatgcgtggacagtg

SEQ ID NO: 401270 - DNA, 25 bp, Homo sapien
aatgcgtggacagtggtttattgac

SEQ ID NO: 401271 - DNA, 25 bp, Homo sapien
gtttattgacggcacttggcagcct

SEQ ID NO: 401272 - DNA, 25 bp, Homo sapien
ttgacggcacttggcagcctctaga

SEQ ID NO: 401273 - DNA, 25 bp, Homo sapien
tgagcaagaacatctcaattgtttt

SEQ ID NO: 401274 - DNA, 25 bp, Homo sapien
gcagatgcaggaaaatttcgatatt

SEQ ID NO: 401275 - DNA, 25 bp, Homo sapien
gatattgaagtgtcaaaatccatag

SEQ ID NO: 401276 - DNA, 25 bp, Homo sapien
tatattctacaaaccaagtaagttg

SEQ ID NO: 401277 - DNA, 25 bp, Homo sapien
gttgtcaatagataagtgtccctgt

SEQ ID NO: 401278 - DNA, 25 bp, Homo sapien
agataagtgtccctgttttgtggca

SEQ ID NO: 401279 - DNA, 25 bp, Homo sapien
gtggcataatataactgaatttcat

SEQ ID NO: 401280 - DNA, 25 bp, Homo sapien
catgagaagatttattccaccaggg

SEQ ID NO: 401281 - DNA, 25 bp, Homo sapien
ccaccaggggtatttcagctttgaa

SEQ ID NO: 401282 - DNA, 25 bp, Homo sapien
tcagctttgaaaccaaatctgtgta

SEQ ID NO: 401283 - DNA, 25 bp, Homo sapien
gaaaccaaatctgtgtatctaatac

SEQ ID NO: 401284 - DNA, 25 bp, Homo sapien
gtatctaatactaaccaatctgttg

SEQ ID NO: 401285 - DNA, 25 bp, Homo sapien
atactaaccaatctgttggatgtgg

SEQ ID NO: 401286 - DNA, 25 bp, Homo sapien
gtttgctaaactacccaagtaagat

SEQ ID NO: 401287 - DNA, 25 bp, Homo sapien
actacccaagtaagatttactgtat

SEQ ID NO: 401288 - DNA, 25 bp, Homo sapien
actcactctgctagacaattatttc

SEQ ID NO: 401289 - DNA, 25 bp, Homo sapien
tagacaattatttcatcttttcctc

SEQ ID NO: 401290 - DNA, 25 bp, Homo sapien
cttccatttttgctctataacaatg

SEQ ID NO: 401291 - DNA, 25 bp, Homo sapien
gtatatacactctacaggccatcat

SEQ ID NO: 401292 - DNA, 25 bp, Homo sapien
atacactctacaggccatcattcta

SEQ ID NO: 401293 - DNA, 25 bp, Homo sapien
ggccatcattctatacctcatttaa

SEQ ID NO: 401294 - DNA, 25 bp, Homo sapien
tctatacctcatttaagccattgtt

SEQ ID NO: 401295 - DNA, 25 bp, Homo sapien
gccattgttatcaagggtttaccct

SEQ ID NO: 401296 - DNA, 25 bp, Homo sapien
ggtttacccttaaagatcattgttg

SEQ ID NO: 401297 - DNA, 25 bp, Homo sapien
ttgttgagtaatcacctgggcctgt

SEQ ID NO: 401298 - DNA, 25 bp, Homo sapien
gagtaatcacctgggcctgtcgtgg

SEQ ID NO: 401299 - DNA, 25 bp, Homo sapien
aaacatcatgtataggcagtctgca

SEQ ID NO: 401300 - DNA, 25 bp, Homo sapien
acatcatgtataggcagtctgcatc

SEQ ID NO: 401301 - DNA, 25 bp, Homo sapien
ggcagtctgcatcttcagatttcag

SEQ ID NO: 401302 - DNA, 25 bp, Homo sapien
actttacttttaatgtagcacagaa

SEQ ID NO: 401303 - DNA, 25 bp, Homo sapien
aatgtagcacagaatagttttaatg

SEQ ID NO: 401304 - DNA, 25 bp, Homo sapien
tgagaaatgcagctttatgtataaa

SEQ ID NO: 401305 - DNA, 25 bp, Homo sapien
tatagcaagctctaggtactccaat

SEQ ID NO: 401306 - DNA, 25 bp, Homo sapien
agcaagctctaggtactccaatggt

SEQ ID NO: 401307 - DNA, 25 bp, Homo sapien
aagctctaggtactccaatggtgta

SEQ ID NO: 401308 - DNA, 25 bp, Homo sapien
tctaggtactccaatggtgtacaat

SEQ ID NO: 401309 - DNA, 25 bp, Homo sapien
caatgtcttttgcacaaactttgta

SEQ ID NO: 401310 - DNA, 25 bp, Homo sapien
acatttaggcatttgtaatacagca

SEQ ID NO: 401311 - DNA, 25 bp, Homo sapien
gtaatacagcatatagaagcaaaga

SEQ ID NO: 401312 - DNA, 25 bp, Homo sapien
tctgtaatgccccaaagtagtggaa

SEQ ID NO: 401313 - DNA, 25 bp, Homo sapien
ggccagtcagtgtgtactggagtca

SEQ ID NO: 401314 - DNA, 25 bp, Homo sapien
cagtcagtgtgtactggagtcattg

SEQ ID NO: 401315 - DNA, 25 bp, Homo sapien
gaagttttcatcttgggaatggtcc

SEQ ID NO: 401316 - DNA, 25 bp, Homo sapien
agttttcatcttgggaatggtcctt

SEQ ID NO: 401317 - DNA, 25 bp, Homo sapien
ttcatcttgggaatggtccttgaag

SEQ ID NO: 401318 - DNA, 25 bp, Homo sapien
tcttgggaatggtccttgaagagtg

SEQ ID NO: 401319 - DNA, 25 bp, Homo sapien
aaagtagtggaataggccctgcccg

SEQ ID NO: 401320 - DNA, 25 bp, Homo sapien
agtagtggaataggccctgcccgct

SEQ ID NO: 401321 - DNA, 25 bp, Homo sapien
ggaaagttcgatgtgactgcagtat

SEQ ID NO: 401322 - DNA, 25 bp, Homo sapien
gactgcagtatgagattaaagccac

SEQ ID NO: 401323 - DNA, 25 bp, Homo sapien
gtatgagattaaagccacaactatt

SEQ ID NO: 401324 - DNA, 25 bp, Homo sapien
agccacaactattgtttattttggg

SEQ ID NO: 401325 - DNA, 25 bp, Homo sapien
gggactctaggccaccaagtattag

SEQ ID NO: 401326 - DNA, 25 bp, Homo sapien
agtattagcacacatacttatgttt

SEQ ID NO: 401327 - DNA, 25 bp, Homo sapien
catacttatgttttctctactaatc

SEQ ID NO: 401328 - DNA, 25 bp, Homo sapien
tctactaatctggtccaggtcctca

SEQ ID NO: 401329 - DNA, 25 bp, Homo sapien
taatctggtccaggtcctcatggac

SEQ ID NO: 401330 - DNA, 25 bp, Homo sapien
caggtcctcatggaccacaggacaa

SEQ ID NO: 401331 - DNA, 25 bp, Homo sapien
cctcatggaccacaggacaaagctt

SEQ ID NO: 401332 - DNA, 25 bp, Homo sapien
cttgcggtcgtaggtgatgccactg

SEQ ID NO: 401333 - DNA, 25 bp, Homo sapien
atgccactgggcgtgatgcacggct

SEQ ID NO: 401334 - DNA, 25 bp, Homo sapien
tgggcgtgatgcacggctcccgcat

SEQ ID NO: 401335 - DNA, 25 bp, Homo sapien
agctcaaagctgatcttgccacaca

SEQ ID NO: 401336 - DNA, 25 bp, Homo sapien
ggatgtctcgcttctgtggcacagg

SEQ ID NO: 401337 - DNA, 25 bp, Homo sapien
agccatcggcagcaagcgacacaca

SEQ ID NO: 401338 - DNA, 25 bp, Homo sapien
tcctcttctcatccacctgagaaaa

SEQ ID NO: 401339 - DNA, 25 bp, Homo sapien
agaaaaaagctcgtccatgtccgcc

SEQ ID NO: 401340 - DNA, 25 bp, Homo sapien
aaagctcgtccatgtccgccatgta

SEQ ID NO: 401341 - DNA, 25 bp, Homo sapien
tccgccatgtacttgtcctgtgaag

SEQ ID NO: 401342 - DNA, 25 bp, Homo sapien
tcctgtgaagagttgagtgctgtgc

SEQ ID NO: 401343 - DNA, 25 bp, Homo sapien
tgaatggaaacatttctgtcaagtt

SEQ ID NO: 401344 - DNA, 25 bp, Homo sapien
aacatttctgtcaagttgtaagttt

SEQ ID NO: 401345 - DNA, 25 bp, Homo sapien
aatacagtattgcatgtgttcgtgt

SEQ ID NO: 401346 - DNA, 25 bp, Homo sapien
cagtattgcatgtgttcgtgtgtat

SEQ ID NO: 401347 - DNA, 25 bp, Homo sapien
gcatgtgttcgtgtgtatagattgt

SEQ ID NO: 401348 - DNA, 25 bp, Homo sapien
tgtatagattgtggttcgaggattg

SEQ ID NO: 401349 - DNA, 25 bp, Homo sapien
gcagagtactacatcaaaattgttt

SEQ ID NO: 401350 - DNA, 25 bp, Homo sapien
tatggaaatggcttgtgctttgaga

SEQ ID NO: 401351 - DNA, 25 bp, Homo sapien
gcttgtgctttgagaagcccagttt

SEQ ID NO: 401352 - DNA, 25 bp, Homo sapien
gagaagcccagttttattctgtctt

SEQ ID NO: 401353 - DNA, 25 bp, Homo sapien
gtcttatgaaactaatttccacttt

SEQ ID NO: 401354 - DNA, 25 bp, Homo sapien
aaaaattggcctcactactctagct

SEQ ID NO: 401355 - DNA, 25 bp, Homo sapien
gcctcactactctagcttatttgca

SEQ ID NO: 401356 - DNA, 25 bp, Homo sapien
ttcagagtcaccttgtcagttccta

SEQ ID NO: 401357 - DNA, 25 bp, Homo sapien
cagttcctaccaaaaagcctgtcgg

SEQ ID NO: 401358 - DNA, 25 bp, Homo sapien
agcctgtcggtattataattgagat

SEQ ID NO: 401359 - DNA, 25 bp, Homo sapien
aattgagattgcatgaagtctgtag

SEQ ID NO: 401360 - DNA, 25 bp, Homo sapien
gaattgacacttaacagcagtgact

SEQ ID NO: 401361 - DNA, 25 bp, Homo sapien
gtgacttccagtctgtaaccttagc

SEQ ID NO: 401362 - DNA, 25 bp, Homo sapien
tccagtctgtaaccttagcataagt

SEQ ID NO: 401363 - DNA, 25 bp, Homo sapien
gcataagttctatttgtctccttta

SEQ ID NO: 401364 - DNA, 25 bp, Homo sapien
gaaatacctgtagttttctgtatag

SEQ ID NO: 401365 - DNA, 25 bp, Homo sapien
aggaaaaacaaagagcagcccgcaa

SEQ ID NO: 401366 - DNA, 25 bp, Homo sapien
gcagcccgcaaaaacaggtccaagt

SEQ ID NO: 401367 - DNA, 25 bp, Homo sapien
gacgaggtggttccatcaaggtcct

SEQ ID NO: 401368 - DNA, 25 bp, Homo sapien
ggtggttccatcaaggtcctaatcc

SEQ ID NO: 401369 - DNA, 25 bp, Homo sapien
caaggtcctaatccctacaatggag

SEQ ID NO: 401370 - DNA, 25 bp, Homo sapien
aatccctacaatggagcacaggact

SEQ ID NO: 401371 - DNA, 25 bp, Homo sapien
gcacaggactggatttactctggca

SEQ ID NO: 401372 - DNA, 25 bp, Homo sapien
actggatttactctggcagctactg

SEQ ID NO: 401373 - DNA, 25 bp, Homo sapien
gcagctactgggacagaaattactt

SEQ ID NO: 401374 - DNA, 25 bp, Homo sapien
attacttcaatttgcctgacattta

SEQ ID NO: 401375 - DNA, 25 bp, Homo sapien
aagtcagggtgtttggctaatctac

SEQ ID NO: 401376 - DNA, 25 bp, Homo sapien
agatggaaaatcaacccttacagga

SEQ ID NO: 401377 - DNA, 25 bp, Homo sapien
gaaggacatcaccaattccggaaag

SEQ ID NO: 401378 - DNA, 25 bp, Homo sapien
ttccggaaaggatgctgcgccagtc

SEQ ID NO: 401379 - DNA, 25 bp, Homo sapien
atgctgcgccagtcatgtttccgca

SEQ ID NO: 401380 - DNA, 25 bp, Homo sapien
gtttccgcactctgtgagacgttga

SEQ ID NO: 401381 - DNA, 25 bp, Homo sapien
tgaaatctccagaagttgcccaagg

SEQ ID NO: 401382 - DNA, 25 bp, Homo sapien
gactctggatctctgaggactgttt

SEQ ID NO: 401383 - DNA, 25 bp, Homo sapien
aggactgttttcctcaataaggagc

SEQ ID NO: 401384 - DNA, 25 bp, Homo sapien
tcaataaggagctgcaatcttggct

SEQ ID NO: 401385 - DNA, 25 bp, Homo sapien
gtatctggttatattgtggcctgac

SEQ ID NO: 401386 - DNA, 25 bp, Homo sapien
ttgtggcctgacagagaagtttctt

SEQ ID NO: 401387 - DNA, 25 bp, Homo sapien
tgattgacatcatgtaaccaacact

SEQ ID NO: 401388 - DNA, 25 bp, Homo sapien
attttccattcagatgttcagtgta

SEQ ID NO: 401389 - DNA, 25 bp, Homo sapien
attgactgtcagtacctccagatgc

SEQ ID NO: 401390 - DNA, 25 bp, Homo sapien
cagtacctccagatgctattatagt

SEQ ID NO: 401391 - DNA, 25 bp, Homo sapien
atattacttattttggaatccatag

SEQ ID NO: 401392 - DNA, 25 bp, Homo sapien
gaatccataggctgaatatgttgga

SEQ ID NO: 401393 - DNA, 25 bp, Homo sapien
gaagctctagtctattcattctaaa

SEQ ID NO: 401394 - DNA, 25 bp, Homo sapien
aatgaatggttactttttctagcca

SEQ ID NO: 401395 - DNA, 25 bp, Homo sapien
actttttctagccatgtacacacaa

SEQ ID NO: 401396 - DNA, 25 bp, Homo sapien
acaaatacacacagactttcagaaa

SEQ ID NO: 401397 - DNA, 25 bp, Homo sapien
gaaaaactccacatgattgacatca

SEQ ID NO: 401398 - DNA, 25 bp, Homo sapien
gggtaatcacgatgcatccatcttc

SEQ ID NO: 401399 - DNA, 25 bp, Homo sapien
gtaatcacgatgcatccatcttcct

SEQ ID NO: 401400 - DNA, 25 bp, Homo sapien
aatcacgatgcatccatcttcctcg

SEQ ID NO: 401401 - DNA, 25 bp, Homo sapien
acgatgcatccatcttcctcggcgt

SEQ ID NO: 401402 - DNA, 25 bp, Homo sapien
gtcgcagccctcagtagccagaagg

SEQ ID NO: 401403 - DNA, 25 bp, Homo sapien
gcagccctcagtagccagaaggcag

SEQ ID NO: 401404 - DNA, 25 bp, Homo sapien
ccctcagtagccagaaggcagtctc

SEQ ID NO: 401405 - DNA, 25 bp, Homo sapien
ttgccccgctcccgcggtggatgaa

SEQ ID NO: 401406 - DNA, 25 bp, Homo sapien
ccgcggtggatgaacctcaaccctt

SEQ ID NO: 401407 - DNA, 25 bp, Homo sapien
gcggtggatgaacctcaacccttcc

SEQ ID NO: 401408 - DNA, 25 bp, Homo sapien
gtggatgaacctcaacccttcccag

SEQ ID NO: 401409 - DNA, 25 bp, Homo sapien
agcacaaactcttcacaaaccaaaa

SEQ ID NO: 401410 - DNA, 25 bp, Homo sapien
gctagatgttgcagatacggagatg

SEQ ID NO: 401411 - DNA, 25 bp, Homo sapien
tagtaagtctgagaagaggctgcac

SEQ ID NO: 401412 - DNA, 25 bp, Homo sapien
gagagggagaaatgagcccgtccaa

SEQ ID NO: 401413 - DNA, 25 bp, Homo sapien
aatgagcccgtccaaggtgaattcc

SEQ ID NO: 401414 - DNA, 25 bp, Homo sapien
ggtgaattccttgattctccattgt

SEQ ID NO: 401415 - DNA, 25 bp, Homo sapien
gattctccattgtgagtgcaccaag

SEQ ID NO: 401416 - DNA, 25 bp, Homo sapien
tacggagatgaatagagacacctct

SEQ ID NO: 401417 - DNA, 25 bp, Homo sapien
gagacacctctaattaattaaagcg

SEQ ID NO: 401418 - DNA, 25 bp, Homo sapien
ttaattaaagcggatgccctcccca

SEQ ID NO: 401419 - DNA, 25 bp, Homo sapien
ggatttgactcggagcacaaactct

SEQ ID NO: 401420 - DNA, 25 bp, Homo sapien
tttgtgttcacagtatatttcgtat

SEQ ID NO: 401421 - DNA, 25 bp, Homo sapien
gtatatttcgtatttagatccttct

SEQ ID NO: 401422 - DNA, 25 bp, Homo sapien
tatttagatccttctaggtgacttg

SEQ ID NO: 401423 - DNA, 25 bp, Homo sapien
cttgaagcaaatttgaagtctcttt

SEQ ID NO: 401424 - DNA, 25 bp, Homo sapien
gttgtataaaagcaaaacagtccaa

SEQ ID NO: 401425 - DNA, 25 bp, Homo sapien
aacagtccaaggttgaacattctat

SEQ ID NO: 401426 - DNA, 25 bp, Homo sapien
tgaacattctatgttaactttgctg

SEQ ID NO: 401427 - DNA, 25 bp, Homo sapien
gaaagcagattttaagtgactgagt

SEQ ID NO: 401428 - DNA, 25 bp, Homo sapien
actgagtgaaggttgggtaagacct

SEQ ID NO: 401429 - DNA, 25 bp, Homo sapien
ttttttgccctagatcacattacag

SEQ ID NO: 401430 - DNA, 25 bp, Homo sapien
gccctagatcacattacaggtaagt

SEQ ID NO: 401431 - DNA, 25 bp, Homo sapien
acccagcccatgtgtcttggtcttt

SEQ ID NO: 401432 - DNA, 25 bp, Homo sapien
agcccatgtgtcttggtctttttta

SEQ ID NO: 401433 - DNA, 25 bp, Homo sapien
catgtgtcttggtcttttttactaa

SEQ ID NO: 401434 - DNA, 25 bp, Homo sapien
gtcttggtcttttttactaatattg

SEQ ID NO: 401435 - DNA, 25 bp, Homo sapien
actttggataaaatttctgcgttag

SEQ ID NO: 401436 - DNA, 25 bp, Homo sapien
ttctttttatatctgtcctaaagct

SEQ ID NO: 401437 - DNA, 25 bp, Homo sapien
atatctgtcctaaagcttgtaacta

SEQ ID NO: 401438 - DNA, 25 bp, Homo sapien
aaagcttgtaactacttgctcatga

SEQ ID NO: 401439 - DNA, 25 bp, Homo sapien
gtatgtttagcaatgtgcatgtcat

SEQ ID NO: 401440 - DNA, 25 bp, Homo sapien
tcattgatggcctttgtaaagtatg

SEQ ID NO: 401441 - DNA, 25 bp, Homo sapien
gtatgttcaattgagttgtggagac

SEQ ID NO: 401442 - DNA, 25 bp, Homo sapien
gatgacctcagacaggttacttccc

SEQ ID NO: 401443 - DNA, 25 bp, Homo sapien
gcagagagtggtgcctacctcattt

SEQ ID NO: 401444 - DNA, 25 bp, Homo sapien
ggtgcctacctcatttaatcattgt

SEQ ID NO: 401445 - DNA, 25 bp, Homo sapien
gtgcttagcaaatgggaggcagttt

SEQ ID NO: 401446 - DNA, 25 bp, Homo sapien
gaggcagttttgtatttaagcatta

SEQ ID NO: 401447 - DNA, 25 bp, Homo sapien
ttaagcattagcttcacccactttc

SEQ ID NO: 401448 - DNA, 25 bp, Homo sapien
gttatgcttggaaatcagacagact

SEQ ID NO: 401449 - DNA, 25 bp, Homo sapien
gacagactagggtctggctccgtga

SEQ ID NO: 401450 - DNA, 25 bp, Homo sapien
tagggtctggctccgtgactccaaa

SEQ ID NO: 401451 - DNA, 25 bp, Homo sapien
tggctccgtgactccaaattggatg

SEQ ID NO: 401452 - DNA, 25 bp, Homo sapien
gtgactccaaattggatgacctcag

SEQ ID NO: 401453 - DNA, 25 bp, Homo sapien
gaagattcacgtatccatctggaga

SEQ ID NO: 401454 - DNA, 25 bp, Homo sapien
aagtgattgggttcctctggttctt

SEQ ID NO: 401455 - DNA, 25 bp, Homo sapien
ttgcctgcttcactgtggatgggaa

SEQ ID NO: 401456 - DNA, 25 bp, Homo sapien
aagaggtgacaacctcagtctccct

SEQ ID NO: 401457 - DNA, 25 bp, Homo sapien
ggacctgtccaagggtaggcaacca

SEQ ID NO: 401458 - DNA, 25 bp, Homo sapien
accttcaccttcacacagattgagg

SEQ ID NO: 401459 - DNA, 25 bp, Homo sapien
ggagacactggactttttacccatt

SEQ ID NO: 401460 - DNA, 25 bp, Homo sapien
ttacccattttctttaatcttcaat

SEQ ID NO: 401461 - DNA, 25 bp, Homo sapien
agaacaagagttaatgccctaccct

SEQ ID NO: 401462 - DNA, 25 bp, Homo sapien
gctgggctgtttgtattgagttgca

SEQ ID NO: 401463 - DNA, 25 bp, Homo sapien
attgagttgcaatgtgaccagcgaa

SEQ ID NO: 401464 - DNA, 25 bp, Homo sapien
ttctcttctcttgtaagaagttcct

SEQ ID NO: 401465 - DNA, 25 bp, Homo sapien
gaagttccttttgttattgccatct

SEQ ID NO: 401466 - DNA, 25 bp, Homo sapien
ttttgttattgccatcttcgctttg

SEQ ID NO: 401467 - DNA, 25 bp, Homo sapien
atcttcgctttgctggaaatgtcaa

SEQ ID NO: 401468 - DNA, 25 bp, Homo sapien
gatgacctggaagagaaacttgccc

SEQ ID NO: 401469 - DNA, 25 bp, Homo sapien
tggaagagaaacttgcccaggccaa

SEQ ID NO: 401470 - DNA, 25 bp, Homo sapien
gccaaagaagagaacgtgggcttac

SEQ ID NO: 401471 - DNA, 25 bp, Homo sapien
acgtgggcttacatcagacactgga

SEQ ID NO: 401472 - DNA, 25 bp, Homo sapien
actggatcagacactaaacgaactt

SEQ ID NO: 401473 - DNA, 25 bp, Homo sapien
acagaaactctggagctccgtgggt

SEQ ID NO: 401474 - DNA, 25 bp, Homo sapien
ggagctccgtgggtctttctcttct

SEQ ID NO: 401475 - DNA, 25 bp, Homo sapien
tacattcaactgctgatcatatggg

SEQ ID NO: 401476 - DNA, 25 bp, Homo sapien
caactgctgatcatatgggaaaaat

SEQ ID NO: 401477 - DNA, 25 bp, Homo sapien
aaaagtacattctatttgaactact

SEQ ID NO: 401478 - DNA, 25 bp, Homo sapien
gaactacttgtctaatatatcagaa

SEQ ID NO: 401479 - DNA, 25 bp, Homo sapien
tttccccacaattcagttatcttaa

SEQ ID NO: 401480 - DNA, 25 bp, Homo sapien
agaatattgtttatctgggaagtat

SEQ ID NO: 401481 - DNA, 25 bp, Homo sapien
gtatccaaacaacagaggtgttcta

SEQ ID NO: 401482 - DNA, 25 bp, Homo sapien
cagaggtgttctaagagcactttaa

SEQ ID NO: 401483 - DNA, 25 bp, Homo sapien
aggtcgttcgaaaacatcactttat

SEQ ID NO: 401484 - DNA, 25 bp, Homo sapien
taatcgaacatgatttgctctaaat

SEQ ID NO: 401485 - DNA, 25 bp, Homo sapien
aacaattttctgatgcaagctatat

SEQ ID NO: 401486 - DNA, 25 bp, Homo sapien
ttctgaggctgctttcccaaaactc

SEQ ID NO: 401487 - DNA, 25 bp, Homo sapien
catctttatctcttcatctatccca

SEQ ID NO: 401488 - DNA, 25 bp, Homo sapien
tctatcccacctcttgtctgaacat

SEQ ID NO: 401489 - DNA, 25 bp, Homo sapien
tgaacatcccacctttatcctgtgt

SEQ ID NO: 401490 - DNA, 25 bp, Homo sapien
ccacctttatcctgtgttctgcctt

SEQ ID NO: 401491 - DNA, 25 bp, Homo sapien
ctgtgttctgcctttgttttaattt

SEQ ID NO: 401492 - DNA, 25 bp, Homo sapien
tgtgttctgcctttgttttaatttt

SEQ ID NO: 401493 - DNA, 25 bp, Homo sapien
atggtttccctctactttgggagag

SEQ ID NO: 401494 - DNA, 25 bp, Homo sapien
tgcttctgcctcagtgtatcactgg

SEQ ID NO: 401495 - DNA, 25 bp, Homo sapien
tatcactggagtcacaggaccctgc

SEQ ID NO: 401496 - DNA, 25 bp, Homo sapien
tgcccacctgagttcccaataaaga

SEQ ID NO: 401497 - DNA, 25 bp, Homo sapien
atctgggcctggaacctttggttca

SEQ ID NO: 401498 - DNA, 25 bp, Homo sapien
acagtcattgccttcaacacagagc

SEQ ID NO: 401499 - DNA, 25 bp, Homo sapien
acagcaatagtcatgcccttgtcca

SEQ ID NO: 401500 - DNA, 25 bp, Homo sapien
cccttgtccaggctgggatctaatt

SEQ ID NO: 401501 - DNA, 25 bp, Homo sapien
acaataggtcgttgactccctccta

SEQ ID NO: 401502 - DNA, 25 bp, Homo sapien
gactccctcctagtagagctatcta

SEQ ID NO: 401503 - DNA, 25 bp, Homo sapien
tctaggtttgtctggaaagtttccg

SEQ ID NO: 401504 - DNA, 25 bp, Homo sapien
gaaagtttccgaccctggcttatag

SEQ ID NO: 401505 - DNA, 25 bp, Homo sapien
ttataggcaccacacctcatgtact

SEQ ID NO: 401506 - DNA, 25 bp, Homo sapien
atgtactcctcatggcttggatctc

SEQ ID NO: 401507 - DNA, 25 bp, Homo sapien
ttggatctctgtattcagcctttgt

SEQ ID NO: 401508 - DNA, 25 bp, Homo sapien
accacatgggacagcgcaggtccag

SEQ ID NO: 401509 - DNA, 25 bp, Homo sapien
ggacagcgcaggtccagtggcctcc

SEQ ID NO: 401510 - DNA, 25 bp, Homo sapien
ccagctgaccgcaggcagggaacaa

SEQ ID NO: 401511 - DNA, 25 bp, Homo sapien
aggcagaccctagagggccaggcca

SEQ ID NO: 401512 - DNA, 25 bp, Homo sapien
tgccagaattcacgcatgaggctct

SEQ ID NO: 401513 - DNA, 25 bp, Homo sapien
aattcacgcatgaggctctgaacag

SEQ ID NO: 401514 - DNA, 25 bp, Homo sapien
aggctctgaacagggctgggaaaac

SEQ ID NO: 401515 - DNA, 25 bp, Homo sapien
aagggaagctcatgtcttggtgcac

SEQ ID NO: 401516 - DNA, 25 bp, Homo sapien
agctcatgtcttggtgcactttgtg

SEQ ID NO: 401517 - DNA, 25 bp, Homo sapien
cactttgtgatgatgcttcaacagc

SEQ ID NO: 401518 - DNA, 25 bp, Homo sapien
gatgcttcaacagcaggactgagat

SEQ ID NO: 401519 - DNA, 25 bp, Homo sapien
caatccacccgcctctgtaatccca

SEQ ID NO: 401520 - DNA, 25 bp, Homo sapien
aatccacccgcctctgtaatcccag

SEQ ID NO: 401521 - DNA, 25 bp, Homo sapien
ggagaatctctagatcccgggagtt

SEQ ID NO: 401522 - DNA, 25 bp, Homo sapien
gagaatctctagatcccgggagttg

SEQ ID NO: 401523 - DNA, 25 bp, Homo sapien
agaatctctagatcccgggagttgg

SEQ ID NO: 401524 - DNA, 25 bp, Homo sapien
gaatctctagatcccgggagttgga

SEQ ID NO: 401525 - DNA, 25 bp, Homo sapien
aatctctagatcccgggagttggag

SEQ ID NO: 401526 - DNA, 25 bp, Homo sapien
atctctagatcccgggagttggagg

SEQ ID NO: 401527 - DNA, 25 bp, Homo sapien
tctctagatcccgggagttggaggt

SEQ ID NO: 401528 - DNA, 25 bp, Homo sapien
ctctagatcccgggagttggaggtt

SEQ ID NO: 401529 - DNA, 25 bp, Homo sapien
tctagatcccgggagttggaggttg

SEQ ID NO: 401530 - DNA, 25 bp, Homo sapien
tgtgcccaggcctgagttactatat

SEQ ID NO: 401531 - DNA, 25 bp, Homo sapien
gcccaggcctgagttactatattta

SEQ ID NO: 401532 - DNA, 25 bp, Homo sapien
aacataatgaggtaaactgccaaaa

SEQ ID NO: 401533 - DNA, 25 bp, Homo sapien
attttaccatatttgaaggcattta

SEQ ID NO: 401534 - DNA, 25 bp, Homo sapien
ttaatttcatgtactggaatcagtc

SEQ ID NO: 401535 - DNA, 25 bp, Homo sapien
ggaatcagtctttttgcatatgtaa

SEQ ID NO: 401536 - DNA, 25 bp, Homo sapien
gtaattttcataccaaaaatctctc

SEQ ID NO: 401537 - DNA, 25 bp, Homo sapien
aaaatctctcttcagttgactcctg

SEQ ID NO: 401538 - DNA, 25 bp, Homo sapien
atctctcttcagttgactcctggaa

SEQ ID NO: 401539 - DNA, 25 bp, Homo sapien
gactcctggaactctctcatgataa

SEQ ID NO: 401540 - DNA, 25 bp, Homo sapien
cctggaactctctcatgataaaata

SEQ ID NO: 401541 - DNA, 25 bp, Homo sapien
tgttaatctttgcatacctgatggc

SEQ ID NO: 401542 - DNA, 25 bp, Homo sapien
tctttgcatacctgatggcatctat

SEQ ID NO: 401543 - DNA, 25 bp, Homo sapien
gatggcatctatgtcaatgctgatt

SEQ ID NO: 401544 - DNA, 25 bp, Homo sapien
ttgcctcttaaggtgattgtcctct

SEQ ID NO: 401545 - DNA, 25 bp, Homo sapien
ttgtcctctgagtaatgattgtagt

SEQ ID NO: 401546 - DNA, 25 bp, Homo sapien
agcttgcaactatactatcacatgg

SEQ ID NO: 401547 - DNA, 25 bp, Homo sapien
gcaactatactatcacatgggtcgt

SEQ ID NO: 401548 - DNA, 25 bp, Homo sapien
ctatcacatgggtcgttaagtaaaa

SEQ ID NO: 401549 - DNA, 25 bp, Homo sapien
gtctgagacaggctaagatcaatct

SEQ ID NO: 401550 - DNA, 25 bp, Homo sapien
aagatcaatcttctcatcaaaccaa

SEQ ID NO: 401551 - DNA, 25 bp, Homo sapien
tcatcaaaccaatttttctctaaga

SEQ ID NO: 401552 - DNA, 25 bp, Homo sapien
ttacccccagattctgtgccaacaa

SEQ ID NO: 401553 - DNA, 25 bp, Homo sapien
gaaatacagtccttgggaaatgagt

SEQ ID NO: 401554 - DNA, 25 bp, Homo sapien
attgtcatagatggtagggctttga

SEQ ID NO: 401555 - DNA, 25 bp, Homo sapien
gctttgaaaatgcagggtatcagct

SEQ ID NO: 401556 - DNA, 25 bp, Homo sapien
aacacattgagtcactgcctagacg

SEQ ID NO: 401557 - DNA, 25 bp, Homo sapien
ttgagtcactgcctagacggttctc

SEQ ID NO: 401558 - DNA, 25 bp, Homo sapien
tagacggttctcttggtcttattcc

SEQ ID NO: 401559 - DNA, 25 bp, Homo sapien
tctcttggtcttattcccatcctgg

SEQ ID NO: 401560 - DNA, 25 bp, Homo sapien
agatttcagctacctcccttccagg

SEQ ID NO: 401561 - DNA, 25 bp, Homo sapien
tcccttccaggttcgatttaacttg

SEQ ID NO: 401562 - DNA, 25 bp, Homo sapien
tccaggttcgatttaacttggttgt

SEQ ID NO: 401563 - DNA, 25 bp, Homo sapien
gagacatgttttgtcaggacagata

SEQ ID NO: 401564 - DNA, 25 bp, Homo sapien
taatgcaggcttttgaacagatgtt

SEQ ID NO: 401565 - DNA, 25 bp, Homo sapien
ttttttcttctagccaaatcattgt

SEQ ID NO: 401566 - DNA, 25 bp, Homo sapien
gccaaatcattgtacaggagtttca

SEQ ID NO: 401567 - DNA, 25 bp, Homo sapien
ggagaacccctaccattgtgagcag

SEQ ID NO: 401568 - DNA, 25 bp, Homo sapien
acccctaccattgtgagcagttact

SEQ ID NO: 401569 - DNA, 25 bp, Homo sapien
agcagttactgtcactctggctgaa

SEQ ID NO: 401570 - DNA, 25 bp, Homo sapien
gtcactctggctgaatggacaaata

SEQ ID NO: 401571 - DNA, 25 bp, Homo sapien
atagctgtgtaaatagcttctcata

SEQ ID NO: 401572 - DNA, 25 bp, Homo sapien
gcttctcataaaacgcttctactga

SEQ ID NO: 401573 - DNA, 25 bp, Homo sapien
gctaggacaatagagctgctttaga

SEQ ID NO: 401574 - DNA, 25 bp, Homo sapien
cagactttgctttgcagcatttttg

SEQ ID NO: 401575 - DNA, 25 bp, Homo sapien
taatccaggtatcaaaaggcatgct

SEQ ID NO: 401576 - DNA, 25 bp, Homo sapien
aaggcatgctgtgaggcgttgttcc

SEQ ID NO: 401577 - DNA, 25 bp, Homo sapien
ctgtgaggcgttgttccaggaaata

SEQ ID NO: 401578 - DNA, 25 bp, Homo sapien
ggaaatagtttccaatttgcctcta

SEQ ID NO: 401579 - DNA, 25 bp, Homo sapien
ttccaatttgcctctaaaactctag

SEQ ID NO: 401580 - DNA, 25 bp, Homo sapien
aaactctaggacaagtctctgaagc

SEQ ID NO: 401581 - DNA, 25 bp, Homo sapien
ttgcagcatttttgtggtttcttct

SEQ ID NO: 401582 - DNA, 25 bp, Homo sapien
catgtgaaatgtacagcgttttggg

SEQ ID NO: 401583 - DNA, 25 bp, Homo sapien
gtggtttcttctttgtgacaggcaa

SEQ ID NO: 401584 - DNA, 25 bp, Homo sapien
ccggaaacagctcagcatcaaaaat

SEQ ID NO: 401585 - DNA, 25 bp, Homo sapien
aacaagtccagaagactctcctctg

SEQ ID NO: 401586 - DNA, 25 bp, Homo sapien
gactctcctctgactgttacctttg

SEQ ID NO: 401587 - DNA, 25 bp, Homo sapien
tgactgttacctttgccccaagcca

SEQ ID NO: 401588 - DNA, 25 bp, Homo sapien
ccaccccaaacttttatgctcatgt

SEQ ID NO: 401589 - DNA, 25 bp, Homo sapien
atctctgggacatttttgaggcatt

SEQ ID NO: 401590 - DNA, 25 bp, Homo sapien
gagtggtctcatctccttccttaat

SEQ ID NO: 401591 - DNA, 25 bp, Homo sapien
tctccttccttaatcttcctggtgg

SEQ ID NO: 401592 - DNA, 25 bp, Homo sapien
ttattacagatatgctccactgttt

SEQ ID NO: 401593 - DNA, 25 bp, Homo sapien
aatgtgaacttgtgcgcaaatgtgc

SEQ ID NO: 401594 - DNA, 25 bp, Homo sapien
tgcgcaaatgtgcagattcaatgtt

SEQ ID NO: 401595 - DNA, 25 bp, Homo sapien
gcagattcaatgttcttgttacaga

SEQ ID NO: 401596 - DNA, 25 bp, Homo sapien
tccctggagcagaaaatgacatttg

SEQ ID NO: 401597 - DNA, 25 bp, Homo sapien
attttcttgggcattctcattgtcc

SEQ ID NO: 401598 - DNA, 25 bp, Homo sapien
tgggcattctcattgtccggtgctt

SEQ ID NO: 401599 - DNA, 25 bp, Homo sapien
gtgcttccggattcttttggatcca

SEQ ID NO: 401600 - DNA, 25 bp, Homo sapien
gatccatatcgaagcatgccaacct

SEQ ID NO: 401601 - DNA, 25 bp, Homo sapien
ctgatggacttgaaggcctggagaa

SEQ ID NO: 401602 - DNA, 25 bp, Homo sapien
aaagggcagttcgaccatgcccttg

SEQ ID NO: 401603 - DNA, 25 bp, Homo sapien
catgcccttgcttaggagggatggt

SEQ ID NO: 401604 - DNA, 25 bp, Homo sapien
gggatggtgtgggatctcctcctga

SEQ ID NO: 401605 - DNA, 25 bp, Homo sapien
cctcctgaggagatgaagtgctttg

SEQ ID NO: 401606 - DNA, 25 bp, Homo sapien
gatgaagtgctttgtgtcttggtga

SEQ ID NO: 401607 - DNA, 25 bp, Homo sapien
gtggcccctggataatcctgacgtg

SEQ ID NO: 401608 - DNA, 25 bp, Homo sapien
actgggccatctatgggaaagaaca

SEQ ID NO: 401609 - DNA, 25 bp, Homo sapien
aaagaacacgggtcgagtgcagtcg

SEQ ID NO: 401610 - DNA, 25 bp, Homo sapien
gagtgcagtcgagttgtctggccat

SEQ ID NO: 401611 - DNA, 25 bp, Homo sapien
agtcgagttgtctggccatctgtat

SEQ ID NO: 401612 - DNA, 25 bp, Homo sapien
ggccatctgtatttggatctataac

SEQ ID NO: 401613 - DNA, 25 bp, Homo sapien
tctataactgtactttgcctggcgc

SEQ ID NO: 401614 - DNA, 25 bp, Homo sapien
ggcgctgtgcgcaaggtcagaaaac

SEQ ID NO: 401615 - DNA, 25 bp, Homo sapien
gaaaacttactgctagtacctagaa

SEQ ID NO: 401616 - DNA, 25 bp, Homo sapien
ggctgcccagccaaatcttaatgta

SEQ ID NO: 401617 - DNA, 25 bp, Homo sapien
gtagctagagccatggaagtacagt

SEQ ID NO: 401618 - DNA, 25 bp, Homo sapien
gggtcgtggtttgacatttgtctgc

SEQ ID NO: 401619 - DNA, 25 bp, Homo sapien
ttgacatttgtctgcctggtgcaaa

SEQ ID NO: 401620 - DNA, 25 bp, Homo sapien
atttgtctgcctggtgcaaacaagg

SEQ ID NO: 401621 - DNA, 25 bp, Homo sapien
tgcctggtgcaaacaaggaatcctt

SEQ ID NO: 401622 - DNA, 25 bp, Homo sapien
ggtgcaaacaaggaatccttgcctt

SEQ ID NO: 401623 - DNA, 25 bp, Homo sapien
caaaaccaacagttagtggagtcaa

SEQ ID NO: 401624 - DNA, 25 bp, Homo sapien
agtggagtcaaagcccagacactgt

SEQ ID NO: 401625 - DNA, 25 bp, Homo sapien
gagtcaaagcccagacactgtaaat

SEQ ID NO: 401626 - DNA, 25 bp, Homo sapien
gcccagacactgtaaatagaacccc

SEQ ID NO: 401627 - DNA, 25 bp, Homo sapien
tggactgcggtgctacgagggcctg

SEQ ID NO: 401628 - DNA, 25 bp, Homo sapien
tgccaccctccctgtaagtctattt

SEQ ID NO: 401629 - DNA, 25 bp, Homo sapien
ttattcactttgcttattcactttt

SEQ ID NO: 401630 - DNA, 25 bp, Homo sapien
ttcactttttacctatccctaatgc

SEQ ID NO: 401631 - DNA, 25 bp, Homo sapien
tcactttttacctatccctaatgct

SEQ ID NO: 401632 - DNA, 25 bp, Homo sapien
cactttttacctatccctaatgctt

SEQ ID NO: 401633 - DNA, 25 bp, Homo sapien
tttacctatccctaatgcttacatt

SEQ ID NO: 401634 - DNA, 25 bp, Homo sapien
acctatccctaatgcttacatttta

SEQ ID NO: 401635 - DNA, 25 bp, Homo sapien
tttaaaatcaacgtgtaaacacaat

SEQ ID NO: 401636 - DNA, 25 bp, Homo sapien
aaaatcaatgtgtaagctgaacttt

SEQ ID NO: 401637 - DNA, 25 bp, Homo sapien
aatcaatgtgtaagctgaactttaa

SEQ ID NO: 401638 - DNA, 25 bp, Homo sapien
tcaatgtgtaagctgaactttaaaa

SEQ ID NO: 401639 - DNA, 25 bp, Homo sapien
atgaattagggataggtacaaataa

SEQ ID NO: 401640 - DNA, 25 bp, Homo sapien
ccaggttcagggtcttacagagctc

SEQ ID NO: 401641 - DNA, 25 bp, Homo sapien
gttcagggtcttacagagctccacc

SEQ ID NO: 401642 - DNA, 25 bp, Homo sapien
ttgaagacaagccaacaaaccctgc

SEQ ID NO: 401643 - DNA, 25 bp, Homo sapien
aagacaagccaacaaaccctgcact

SEQ ID NO: 401644 - DNA, 25 bp, Homo sapien
ttttgtgccaaaaactgtggacatg

SEQ ID NO: 401645 - DNA, 25 bp, Homo sapien
tggacatgctggctcagcatcctca

SEQ ID NO: 401646 - DNA, 25 bp, Homo sapien
gctggctcagcatcctcaggaccaa

SEQ ID NO: 401647 - DNA, 25 bp, Homo sapien
cctcaggaccaagttgttgcttaat

SEQ ID NO: 401648 - DNA, 25 bp, Homo sapien
aggaccaagttgttgcttaatttat

SEQ ID NO: 401649 - DNA, 25 bp, Homo sapien
gtgacctgggcccaaaggttctgaa

SEQ ID NO: 401650 - DNA, 25 bp, Homo sapien
aaaggttctgaagggcagttcctgg

SEQ ID NO: 401651 - DNA, 25 bp, Homo sapien
accagagcacagaccggctgacggc

SEQ ID NO: 401652 - DNA, 25 bp, Homo sapien
gcacagaccggctgacggcagagat

SEQ ID NO: 401653 - DNA, 25 bp, Homo sapien
tgacggcagagatctggaaagacgt

SEQ ID NO: 401654 - DNA, 25 bp, Homo sapien
tatgttccggacagtgggacagctc

SEQ ID NO: 401655 - DNA, 25 bp, Homo sapien
ccggacagtgggacagctctacaag

SEQ ID NO: 401656 - DNA, 25 bp, Homo sapien
aaggagtccctgagccgcctcatgg

SEQ ID NO: 401657 - DNA, 25 bp, Homo sapien
tcagcaacaccaaccccagttttgt

SEQ ID NO: 401658 - DNA, 25 bp, Homo sapien
accccagttttgtccgctgcattgt

SEQ ID NO: 401659 - DNA, 25 bp, Homo sapien
cattgtccccaaccacgagaagagg

SEQ ID NO: 401660 - DNA, 25 bp, Homo sapien
aagagggccgggaagctggagccgc

SEQ ID NO: 401661 - DNA, 25 bp, Homo sapien
tggtgctggaccagcttcgctgcaa

SEQ ID NO: 401662 - DNA, 25 bp, Homo sapien
accgaattgactgaatctgtggctt

SEQ ID NO: 401663 - DNA, 25 bp, Homo sapien
tcatgcgctgaagaagctgggtcct

SEQ ID NO: 401664 - DNA, 25 bp, Homo sapien
gatgctaaacatggcacttaaatat

SEQ ID NO: 401665 - DNA, 25 bp, Homo sapien
gcaaatcttagtatctttcttccag

SEQ ID NO: 401666 - DNA, 25 bp, Homo sapien
atctttcttccagtaatatggcctg

SEQ ID NO: 401667 - DNA, 25 bp, Homo sapien
tatggcctggctgagggtcagacca

SEQ ID NO: 401668 - DNA, 25 bp, Homo sapien
tcagaccacaggacaggagcgacct

SEQ ID NO: 401669 - DNA, 25 bp, Homo sapien
gccttgactgtctgggaagcttgat

SEQ ID NO: 401670 - DNA, 25 bp, Homo sapien
ggattataaaacttcctcctgcctg

SEQ ID NO: 401671 - DNA, 25 bp, Homo sapien
caagcagcagcatcatttccaggac

SEQ ID NO: 401672 - DNA, 25 bp, Homo sapien
gcatcatttccaggacccaacaaag

SEQ ID NO: 401673 - DNA, 25 bp, Homo sapien
accactgattggtatgttcaacaaa

SEQ ID NO: 401674 - DNA, 25 bp, Homo sapien
gaaatggataaatcactgctatata

SEQ ID NO: 401675 - DNA, 25 bp, Homo sapien
tcactgctatataagggaaactacc

SEQ ID NO: 401676 - DNA, 25 bp, Homo sapien
atatattggtcattcttacaactac

SEQ ID NO: 401677 - DNA, 25 bp, Homo sapien
tggtcattcttacaactactattta

SEQ ID NO: 401678 - DNA, 25 bp, Homo sapien
aactactatttaaagtcagcaactt

SEQ ID NO: 401679 - DNA, 25 bp, Homo sapien
atgtttggccatatcttcatgctca

SEQ ID NO: 401680 - DNA, 25 bp, Homo sapien
gccatatcttcatgctcacatttga

SEQ ID NO: 401681 - DNA, 25 bp, Homo sapien
tcttcatgctcacatttgatttctg

SEQ ID NO: 401682 - DNA, 25 bp, Homo sapien
gatttctgaagacctcctacataca

SEQ ID NO: 401683 - DNA, 25 bp, Homo sapien
gacctcctacatacacttcaataaa

SEQ ID NO: 401684 - DNA, 25 bp, Homo sapien
ctttatttccaacactagccgtggt

SEQ ID NO: 401685 - DNA, 25 bp, Homo sapien
actagccgtggtcctgtgcagtcaa

SEQ ID NO: 401686 - DNA, 25 bp, Homo sapien
gtgcagtcaagctctcagctagtgt

SEQ ID NO: 401687 - DNA, 25 bp, Homo sapien
agctagtgtttagggctgtctgtca

SEQ ID NO: 401688 - DNA, 25 bp, Homo sapien
ctgtctgtcagaaatggttatacgt

SEQ ID NO: 401689 - DNA, 25 bp, Homo sapien
agatctgacagctcctatatacctt

SEQ ID NO: 401690 - DNA, 25 bp, Homo sapien
cagctcctatataccttatcttact

SEQ ID NO: 401691 - DNA, 25 bp, Homo sapien
gttcttccacttactgacttgttac

SEQ ID NO: 401692 - DNA, 25 bp, Homo sapien
ttactgacttgttaccactgctgac

SEQ ID NO: 401693 - DNA, 25 bp, Homo sapien
gttaccactgctgactttctgaaaa

SEQ ID NO: 401694 - DNA, 25 bp, Homo sapien
gaatgtttagtcctacttagtaaga

SEQ ID NO: 401695 - DNA, 25 bp, Homo sapien
accaatcctggtggttatcatgaac

SEQ ID NO: 401696 - DNA, 25 bp, Homo sapien
gttatcatgaaccagtacactcatt

SEQ ID NO: 401697 - DNA, 25 bp, Homo sapien
gtacactcattaactattgcaaagg

SEQ ID NO: 401698 - DNA, 25 bp, Homo sapien
ttgcaaaggcaatttgtcagcacag

SEQ ID NO: 401699 - DNA, 25 bp, Homo sapien
gaaaagacccaaggcgggtctgtag

SEQ ID NO: 401700 - DNA, 25 bp, Homo sapien
gggaacaaaatatccaacgtgccag

SEQ ID NO: 401701 - DNA, 25 bp, Homo sapien
aacgtgccaggataagaattagaac

SEQ ID NO: 401702 - DNA, 25 bp, Homo sapien
ggagtactaaatatcctgagtatct

SEQ ID NO: 401703 - DNA, 25 bp, Homo sapien
gagtatcttaaatctccaacattaa

SEQ ID NO: 401704 - DNA, 25 bp, Homo sapien
acacataaagtgtctggaaggatac

SEQ ID NO: 401705 - DNA, 25 bp, Homo sapien
gatacacgagaaattggtaaccatg

SEQ ID NO: 401706 - DNA, 25 bp, Homo sapien
acggatgtaggaagtggtatgtata

SEQ ID NO: 401707 - DNA, 25 bp, Homo sapien
atatctattaaattatcttactgga

SEQ ID NO: 401708 - DNA, 25 bp, Homo sapien
atcttactggaaatcacatctttgc

SEQ ID NO: 401709 - DNA, 25 bp, Homo sapien
tactggaaatcacatctttgcacat

SEQ ID NO: 401710 - DNA, 25 bp, Homo sapien
aatcacatctttgcacatgtccttg

SEQ ID NO: 401711 - DNA, 25 bp, Homo sapien
acatctttgcacatgtccttgtttg

SEQ ID NO: 401712 - DNA, 25 bp, Homo sapien
tctttgcacatgtccttgtttgtat

SEQ ID NO: 401713 - DNA, 25 bp, Homo sapien
atcagagttgctgaatctaattgta

SEQ ID NO: 401714 - DNA, 25 bp, Homo sapien
ttgtaatttctttaacgattcatga

SEQ ID NO: 401715 - DNA, 25 bp, Homo sapien
acgattcatgaaatcacatgttttt

SEQ ID NO: 401716 - DNA, 25 bp, Homo sapien
ttagtgttcacagaggatggatatt

SEQ ID NO: 401717 - DNA, 25 bp, Homo sapien
taggcataataagcattatcaacct

SEQ ID NO: 401718 - DNA, 25 bp, Homo sapien
ggaagttcctcctcaaatcttccca

SEQ ID NO: 401719 - DNA, 25 bp, Homo sapien
cctcctcaaatcttcccaatgttgg

SEQ ID NO: 401720 - DNA, 25 bp, Homo sapien
agcctctttctcagagccttttata

SEQ ID NO: 401721 - DNA, 25 bp, Homo sapien
ttccatctctatctgtttatgacat

SEQ ID NO: 401722 - DNA, 25 bp, Homo sapien
ttctcagagccttttatacatcatt

SEQ ID NO: 401723 - DNA, 25 bp, Homo sapien
cagagccttttatacatcatttaaa

SEQ ID NO: 401724 - DNA, 25 bp, Homo sapien
ttagttattagtattgtgacaatct

SEQ ID NO: 401725 - DNA, 25 bp, Homo sapien
gacatagaatgtctccccagtatct

SEQ ID NO: 401726 - DNA, 25 bp, Homo sapien
acatagaatgtctccccagtatctc

SEQ ID NO: 401727 - DNA, 25 bp, Homo sapien
cagtatctcatctgttttgcttctc

SEQ ID NO: 401728 - DNA, 25 bp, Homo sapien
aatggccccgcagcgccaaggagat

SEQ ID NO: 401729 - DNA, 25 bp, Homo sapien
gcagcgccaaggagatcttcgcagt

SEQ ID NO: 401730 - DNA, 25 bp, Homo sapien
caaggagatcttcgcagtcctgcag

SEQ ID NO: 401731 - DNA, 25 bp, Homo sapien
ggagatcttcgcagtcctgcaggtg

SEQ ID NO: 401732 - DNA, 25 bp, Homo sapien
atcttcgcagtcctgcaggtgccag

SEQ ID NO: 401733 - DNA, 25 bp, Homo sapien
tcgcagtcctgcaggtgccagcaga

SEQ ID NO: 401734 - DNA, 25 bp, Homo sapien
ctgacttcaagggtaagactaattt

SEQ ID NO: 401735 - DNA, 25 bp, Homo sapien
gactaatttctttcaacgacagaca

SEQ ID NO: 401736 - DNA, 25 bp, Homo sapien
ttctttcaacgacagacactttaaa

SEQ ID NO: 401737 - DNA, 25 bp, Homo sapien
ttttttaaagcatccggcctgggtg

SEQ ID NO: 401738 - DNA, 25 bp, Homo sapien
catccggcctgggtggtggaagacg

SEQ ID NO: 401739 - DNA, 25 bp, Homo sapien
gaaaatctaataacactggcttaag

SEQ ID NO: 401740 - DNA, 25 bp, Homo sapien
acactggcttaagtgctgacttgaa

SEQ ID NO: 401741 - DNA, 25 bp, Homo sapien
agtgctgacttgaaatgctattttg

SEQ ID NO: 401742 - DNA, 25 bp, Homo sapien
gctattttgtaaggtttggatgtaa

SEQ ID NO: 401743 - DNA, 25 bp, Homo sapien
gtaagtaatcaattgaggtcagcag

SEQ ID NO: 401744 - DNA, 25 bp, Homo sapien
gaggtcagcagtttgtatgagacat

SEQ ID NO: 401745 - DNA, 25 bp, Homo sapien
tatgagacatagcttcctccattgc

SEQ ID NO: 401746 - DNA, 25 bp, Homo sapien
agtttgagatgcttcctgtgttttt

SEQ ID NO: 401747 - DNA, 25 bp, Homo sapien
gttagaattgttgttctccttcttt

SEQ ID NO: 401748 - DNA, 25 bp, Homo sapien
ttcctatacctcatcacgtttgttt

SEQ ID NO: 401749 - DNA, 25 bp, Homo sapien
tacctcatcacgtttgttttaaata

SEQ ID NO: 401750 - DNA, 25 bp, Homo sapien
agtacagctcccagaagtccgtgga

SEQ ID NO: 401751 - DNA, 25 bp, Homo sapien
agctcccagaagtccgtggaagaaa

SEQ ID NO: 401752 - DNA, 25 bp, Homo sapien
aagaaaggtccttgaggcatcctct

SEQ ID NO: 401753 - DNA, 25 bp, Homo sapien
cggagagggctcactacacgcacag

SEQ ID NO: 401754 - DNA, 25 bp, Homo sapien
acacgcacagcgattaccagtacag

SEQ ID NO: 401755 - DNA, 25 bp, Homo sapien
gcacagcgattaccagtacagccag

SEQ ID NO: 401756 - DNA, 25 bp, Homo sapien
tagtgccaccgagatatgctcgttc

SEQ ID NO: 401757 - DNA, 25 bp, Homo sapien
agatatgctcgttccgagatcgtgg

SEQ ID NO: 401758 - DNA, 25 bp, Homo sapien
ggtcagccgtgctggcaccacaagc

SEQ ID NO: 401759 - DNA, 25 bp, Homo sapien
gcgccactttgacacataccacaga

SEQ ID NO: 401760 - DNA, 25 bp, Homo sapien
taccacagacagtaccagcatggct

SEQ ID NO: 401761 - DNA, 25 bp, Homo sapien
ctaagttaaatcttttggcaatata

SEQ ID NO: 401762 - DNA, 25 bp, Homo sapien
ctatacagttttaaatactcagaca

SEQ ID NO: 401763 - DNA, 25 bp, Homo sapien
atttttatcctgttctcatggattt

SEQ ID NO: 401764 - DNA, 25 bp, Homo sapien
ctgttctcatggatttgttttccca

SEQ ID NO: 401765 - DNA, 25 bp, Homo sapien
ttttctctgatctcaattacaggtt

SEQ ID NO: 401766 - DNA, 25 bp, Homo sapien
ctctgatctcaattacaggttggat

SEQ ID NO: 401767 - DNA, 25 bp, Homo sapien
ctcaattacaggttggatctcacaa

SEQ ID NO: 401768 - DNA, 25 bp, Homo sapien
acaggttggatctcacaaataataa

SEQ ID NO: 401769 - DNA, 25 bp, Homo sapien
gagacagaaatattttgccactgtt

SEQ ID NO: 401770 - DNA, 25 bp, Homo sapien
aatattttgccactgttgattacta

SEQ ID NO: 401771 - DNA, 25 bp, Homo sapien
tgccactgttgattactatacttta

SEQ ID NO: 401772 - DNA, 25 bp, Homo sapien
aattttggtggatttagtcataaga

SEQ ID NO: 401773 - DNA, 25 bp, Homo sapien
gactggtgaatcttttattacaaaa

SEQ ID NO: 401774 - DNA, 25 bp, Homo sapien
aaatgtttctgttaaaatgggatca

SEQ ID NO: 401775 - DNA, 25 bp, Homo sapien
ggaggaggagtaaaagcccgattat

SEQ ID NO: 401776 - DNA, 25 bp, Homo sapien
aaagcccgattataatggtgatcaa

SEQ ID NO: 401777 - DNA, 25 bp, Homo sapien
atggtgatcaattcaagtcagtgtt

SEQ ID NO: 401778 - DNA, 25 bp, Homo sapien
aagtcagtgttgactattctgtgaa

SEQ ID NO: 401779 - DNA, 25 bp, Homo sapien
gtgaaatatatttggccagtggaaa

SEQ ID NO: 401780 - DNA, 25 bp, Homo sapien
ttggccagtggaaatgataatcaga

SEQ ID NO: 401781 - DNA, 25 bp, Homo sapien
aagactgtaaatagatccatccaaa

SEQ ID NO: 401782 - DNA, 25 bp, Homo sapien
tgatttctctgtacaaatgaatgat

SEQ ID NO: 401783 - DNA, 25 bp, Homo sapien
attttgagatttgagggtgtggcgc

SEQ ID NO: 401784 - DNA, 25 bp, Homo sapien
atttgagggtgtggcgcatggcgct

SEQ ID NO: 401785 - DNA, 25 bp, Homo sapien
gggctgtctttcctgcacggctgtt

SEQ ID NO: 401786 - DNA, 25 bp, Homo sapien
ctgtctttcctgcacggctgttgtg

SEQ ID NO: 401787 - DNA, 25 bp, Homo sapien
gtctttcctgcacggctgttgtgtg

SEQ ID NO: 401788 - DNA, 25 bp, Homo sapien
tcctgcacggctgttgtgtgcttcg

SEQ ID NO: 401789 - DNA, 25 bp, Homo sapien
gtgcttcgctgagtgtgggtggtcc

SEQ ID NO: 401790 - DNA, 25 bp, Homo sapien
cgctgagtgtgggtggtcctgcttg

SEQ ID NO: 401791 - DNA, 25 bp, Homo sapien
gtcctgcttgtgtcatggtcatggc

SEQ ID NO: 401792 - DNA, 25 bp, Homo sapien
tcctgcttgtgtcatggtcatggcc

SEQ ID NO: 401793 - DNA, 25 bp, Homo sapien
cctgcttgtgtcatggtcatggcct

SEQ ID NO: 401794 - DNA, 25 bp, Homo sapien
gaatctcaccataaactgcacgtca

SEQ ID NO: 401795 - DNA, 25 bp, Homo sapien
aactgcacgtcatcaaagacgttat

SEQ ID NO: 401796 - DNA, 25 bp, Homo sapien
gacgttatatggcttatactggtat

SEQ ID NO: 401797 - DNA, 25 bp, Homo sapien
ggtcttatcttcttgatgatgctac

SEQ ID NO: 401798 - DNA, 25 bp, Homo sapien
ctgttctgcaagtactcctagggat

SEQ ID NO: 401799 - DNA, 25 bp, Homo sapien
agcaaagttccctgcatatcacagc

SEQ ID NO: 401800 - DNA, 25 bp, Homo sapien
gggttccaagcagcctgggtcagta

SEQ ID NO: 401801 - DNA, 25 bp, Homo sapien
agcagcctgggtcagtagccaagaa

SEQ ID NO: 401802 - DNA, 25 bp, Homo sapien
agccaagaactggagcagagtcctc

SEQ ID NO: 401803 - DNA, 25 bp, Homo sapien
agagtcctcagtccttgatcgtcca

SEQ ID NO: 401804 - DNA, 25 bp, Homo sapien
cagtccttgatcgtccaagagggaa

SEQ ID NO: 401805 - DNA, 25 bp, Homo sapien
gaagatgctgtcatcaactgcagtt

SEQ ID NO: 401806 - DNA, 25 bp, Homo sapien
aactgcagttcctccaaggctttat

SEQ ID NO: 401807 - DNA, 25 bp, Homo sapien
aaggctttatattctgtacactggt

SEQ ID NO: 401808 - DNA, 25 bp, Homo sapien
tgtacactggtacaggcagaagcat

SEQ ID NO: 401809 - DNA, 25 bp, Homo sapien
gaagcatggtgaagcacccgtcttc

SEQ ID NO: 401810 - DNA, 25 bp, Homo sapien
acccgtcttcctgatgatattactg

SEQ ID NO: 401811 - DNA, 25 bp, Homo sapien
tttcaggcaccttgttgtggcagtt

SEQ ID NO: 401812 - DNA, 25 bp, Homo sapien
gacctgggtgagaagccaacaacca

SEQ ID NO: 401813 - DNA, 25 bp, Homo sapien
caacaaccagtgcagagtcctcaag

SEQ ID NO: 401814 - DNA, 25 bp, Homo sapien
agtgcagagtcctcaagccgtgatc

SEQ ID NO: 401815 - DNA, 25 bp, Homo sapien
tcaagccgtgatcctccgagaaggg

SEQ ID NO: 401816 - DNA, 25 bp, Homo sapien
attaatttcagcttgattatcaacc

SEQ ID NO: 401817 - DNA, 25 bp, Homo sapien
cagcttgattatcaacctgtatcaa

SEQ ID NO: 401818 - DNA, 25 bp, Homo sapien
gattatcaacctgtatcaagaacaa

SEQ ID NO: 401819 - DNA, 25 bp, Homo sapien
gaggaggtgtccacatttatggtgt

SEQ ID NO: 401820 - DNA, 25 bp, Homo sapien
aggtgtccacatttatggtgtgtat

SEQ ID NO: 401821 - DNA, 25 bp, Homo sapien
acatttatggtgtgtataggtaaca

SEQ ID NO: 401822 - DNA, 25 bp, Homo sapien
gtgatttgggcagctaaatagtaag

SEQ ID NO: 401823 - DNA, 25 bp, Homo sapien
gggcagctaaatagtaagtactttt

SEQ ID NO: 401824 - DNA, 25 bp, Homo sapien
ttgcatcatcatcttcctatttaat

SEQ ID NO: 401825 - DNA, 25 bp, Homo sapien
tgcatcatcatcttcctatttaatg

SEQ ID NO: 401826 - DNA, 25 bp, Homo sapien
aagatcctggatacaaattaagaat

SEQ ID NO: 401827 - DNA, 25 bp, Homo sapien
ggagccaatagtaagctgacatttg

SEQ ID NO: 401828 - DNA, 25 bp, Homo sapien
gagccaatagtaagctgacatttgg

SEQ ID NO: 401829 - DNA, 25 bp, Homo sapien
agccaatagtaagctgacatttgga

SEQ ID NO: 401830 - DNA, 25 bp, Homo sapien
gccaatagtaagctgacatttggaa

SEQ ID NO: 401831 - DNA, 25 bp, Homo sapien
ttggaaaaggaataactctgagtgt

SEQ ID NO: 401832 - DNA, 25 bp, Homo sapien
ggaaaaggaataactctgagtgtta

SEQ ID NO: 401833 - DNA, 25 bp, Homo sapien
aaggaataactctgagtgttagacc

SEQ ID NO: 401834 - DNA, 25 bp, Homo sapien
aggaataactctgagtgttagacca

SEQ ID NO: 401835 - DNA, 25 bp, Homo sapien
ggaataactctgagtgttagaccag

SEQ ID NO: 401836 - DNA, 25 bp, Homo sapien
gaataactctgagtgttagaccaga

SEQ ID NO: 401837 - DNA, 25 bp, Homo sapien
aataactctgagtgttagaccagat

SEQ ID NO: 401838 - DNA, 25 bp, Homo sapien
tatgactttaccagggtagattaga

SEQ ID NO: 401839 - DNA, 25 bp, Homo sapien
attagaaatacacatcctcctgctg

SEQ ID NO: 401840 - DNA, 25 bp, Homo sapien
tgaccctctgccttcaatagctatc

SEQ ID NO: 401841 - DNA, 25 bp, Homo sapien
ctgccttcaatagctatctatctta

SEQ ID NO: 401842 - DNA, 25 bp, Homo sapien
gaagtttgaactgcagcatctgctt

SEQ ID NO: 401843 - DNA, 25 bp, Homo sapien
gggacgatcactctatatatcttcc

SEQ ID NO: 401844 - DNA, 25 bp, Homo sapien
atcactctatatatcttccgttgcc

SEQ ID NO: 401845 - DNA, 25 bp, Homo sapien
atatatcttccgttgcctcagattc

SEQ ID NO: 401846 - DNA, 25 bp, Homo sapien
ctcagattcctgtggcccaaggatc

SEQ ID NO: 401847 - DNA, 25 bp, Homo sapien
aaacatgctaacaaaaatcccttat

SEQ ID NO: 401848 - DNA, 25 bp, Homo sapien
gtatgcatatttatgtgctcctttt

SEQ ID NO: 401849 - DNA, 25 bp, Homo sapien
aatgaacatgattttattctatgcc

SEQ ID NO: 401850 - DNA, 25 bp, Homo sapien
catttgggcctctgaatgtatctgt

SEQ ID NO: 401851 - DNA, 25 bp, Homo sapien
gaatgtatctgttatttgaatttaa

SEQ ID NO: 401852 - DNA, 25 bp, Homo sapien
tcctggactatgtggttttatgact

SEQ ID NO: 401853 - DNA, 25 bp, Homo sapien
atgactaaagtcacatgtatgtatt

SEQ ID NO: 401854 - DNA, 25 bp, Homo sapien
tgtattaaacattgaggctctgtag

SEQ ID NO: 401855 - DNA, 25 bp, Homo sapien
agagaggatgtacctctctggtgct

SEQ ID NO: 401856 - DNA, 25 bp, Homo sapien
gttacagtacattctgtacctgcca

SEQ ID NO: 401857 - DNA, 25 bp, Homo sapien
gtacattctgtacctgccatacagg

SEQ ID NO: 401858 - DNA, 25 bp, Homo sapien
gccatacaggctcattttcatgcaa

SEQ ID NO: 401859 - DNA, 25 bp, Homo sapien
acaggctcattttcatgcaaattct

SEQ ID NO: 401860 - DNA, 25 bp, Homo sapien
ctacacccatatgccatcttgataa

SEQ ID NO: 401861 - DNA, 25 bp, Homo sapien
atatgccatcttgataaacagcagg

SEQ ID NO: 401862 - DNA, 25 bp, Homo sapien
aataccaagtcttcccatagggaca

SEQ ID NO: 401863 - DNA, 25 bp, Homo sapien
ttcccatagggacagtgttacctcc

SEQ ID NO: 401864 - DNA, 25 bp, Homo sapien
ggacagtgttacctcccaaaaactg

SEQ ID NO: 401865 - DNA, 25 bp, Homo sapien
atgtgcccagagacaaggtggacag

SEQ ID NO: 401866 - DNA, 25 bp, Homo sapien
gaataattggcttgaactggatttt

SEQ ID NO: 401867 - DNA, 25 bp, Homo sapien
gaactaatgctattgttttgtgggt

SEQ ID NO: 401868 - DNA, 25 bp, Homo sapien
ttttcttcctactgagtagagtagt

SEQ ID NO: 401869 - DNA, 25 bp, Homo sapien
tacagggacctggatagatggctcc

SEQ ID NO: 401870 - DNA, 25 bp, Homo sapien
acctggatagatggctccagcacct

SEQ ID NO: 401871 - DNA, 25 bp, Homo sapien
tgcatcctgagcactggcgtccatg

SEQ ID NO: 401872 - DNA, 25 bp, Homo sapien
actggcgtccatgctgatttctatt

SEQ ID NO: 401873 - DNA, 25 bp, Homo sapien
gcgtccatgctgatttctattggat

SEQ ID NO: 401874 - DNA, 25 bp, Homo sapien
tctcctgagccactaccaaaatgta

SEQ ID NO: 401875 - DNA, 25 bp, Homo sapien
gaccagggctccagggtcccgagct

SEQ ID NO: 401876 - DNA, 25 bp, Homo sapien
gagctgctcctctggattgatggaa

SEQ ID NO: 401877 - DNA, 25 bp, Homo sapien
ctggattgatggaaggctggtccaa

SEQ ID NO: 401878 - DNA, 25 bp, Homo sapien
ggctggtccaataaagggcttttgc

SEQ ID NO: 401879 - DNA, 25 bp, Homo sapien
caataaagggcttttgctcatatct

SEQ ID NO: 401880 - DNA, 25 bp, Homo sapien
ctctctgcatctctggaagcaccag

SEQ ID NO: 401881 - DNA, 25 bp, Homo sapien
atctctggaagcaccagccgcactt

SEQ ID NO: 401882 - DNA, 25 bp, Homo sapien
agtcactgcatgttcaggagggaga

SEQ ID NO: 401883 - DNA, 25 bp, Homo sapien
gggagacagcaccaatttcacctgc

SEQ ID NO: 401884 - DNA, 25 bp, Homo sapien
acagcaccaatttcacctgcagctt

SEQ ID NO: 401885 - DNA, 25 bp, Homo sapien
agcttcccttccagcaatttttatg

SEQ ID NO: 401886 - DNA, 25 bp, Homo sapien
tttttatgccttacactggtacaga

SEQ ID NO: 401887 - DNA, 25 bp, Homo sapien
tttggcagccccattactaatcctc

SEQ ID NO: 401888 - DNA, 25 bp, Homo sapien
actaatcctctggtttcatcttgac

SEQ ID NO: 401889 - DNA, 25 bp, Homo sapien
ggtttcatcttgactgcgtgagcag

SEQ ID NO: 401890 - DNA, 25 bp, Homo sapien
gcgtgagcagcatactgaacgtgga

SEQ ID NO: 401891 - DNA, 25 bp, Homo sapien
tgaacgtggaacaaagtcctcagtc

SEQ ID NO: 401892 - DNA, 25 bp, Homo sapien
aagtcctcagtcactgcatgttcag

SEQ ID NO: 401893 - DNA, 25 bp, Homo sapien
tcatttttcgctagcaaaactgctt

SEQ ID NO: 401894 - DNA, 25 bp, Homo sapien
tggcactaaatacactaacatactg

SEQ ID NO: 401895 - DNA, 25 bp, Homo sapien
cagagtactctcaggaaatccgcaa

SEQ ID NO: 401896 - DNA, 25 bp, Homo sapien
aggaaatccgcaagctgagtaaatt

SEQ ID NO: 401897 - DNA, 25 bp, Homo sapien
agaagatcttgtaaccacccttcca

SEQ ID NO: 401898 - DNA, 25 bp, Homo sapien
ccacccttccaatcgacttatgtag

SEQ ID NO: 401899 - DNA, 25 bp, Homo sapien
ccaatcgacttatgtagggttctat

SEQ ID NO: 401900 - DNA, 25 bp, Homo sapien
aactttagcactcaagtccaaaggg

SEQ ID NO: 401901 - DNA, 25 bp, Homo sapien
aactcagtctcaggcttcaatttcg

SEQ ID NO: 401902 - DNA, 25 bp, Homo sapien
ctcaggcttcaatttcgcatctggg

SEQ ID NO: 401903 - DNA, 25 bp, Homo sapien
aaaagggagatgctgcctccttggc

SEQ ID NO: 401904 - DNA, 25 bp, Homo sapien
aaaaaatcacctgcagactgcctat

SEQ ID NO: 401905 - DNA, 25 bp, Homo sapien
cctgcagactgcctatagctttaac

SEQ ID NO: 401906 - DNA, 25 bp, Homo sapien
tgcctatagctttaacagtctctgt

SEQ ID NO: 401907 - DNA, 25 bp, Homo sapien
atagctttaacagtctctgtctccc

SEQ ID NO: 401908 - DNA, 25 bp, Homo sapien
tcttcacatccttccggtggagaaa

SEQ ID NO: 401909 - DNA, 25 bp, Homo sapien
catccttccggtggagaaaagtttg

SEQ ID NO: 401910 - DNA, 25 bp, Homo sapien
ataatgagacttacacagtgattta

SEQ ID NO: 401911 - DNA, 25 bp, Homo sapien
attatatacaggatgctcagccagc

SEQ ID NO: 401912 - DNA, 25 bp, Homo sapien
atatacaggatgctcagccagcaca

SEQ ID NO: 401913 - DNA, 25 bp, Homo sapien
gagatttgggcccaagtctccgact

SEQ ID NO: 401914 - DNA, 25 bp, Homo sapien
gggcccaagtctccgactccagatt

SEQ ID NO: 401915 - DNA, 25 bp, Homo sapien
acaaaactgtgctaaaaatgaggtt

SEQ ID NO: 401916 - DNA, 25 bp, Homo sapien
aactgtgctaaaaatgaggtttatg

SEQ ID NO: 401917 - DNA, 25 bp, Homo sapien
gctaaaaatgaggtttatggactta

SEQ ID NO: 401918 - DNA, 25 bp, Homo sapien
atgaggtttatggacttaaagaaca

SEQ ID NO: 401919 - DNA, 25 bp, Homo sapien
ggtttatggacttaaagaacaacag

SEQ ID NO: 401920 - DNA, 25 bp, Homo sapien
tttatggacttaaagaacaacagtg

SEQ ID NO: 401921 - DNA, 25 bp, Homo sapien
aacaacagtgttggggcttgagcca

SEQ ID NO: 401922 - DNA, 25 bp, Homo sapien
gggcttgagccaacaaattgacttt

SEQ ID NO: 401923 - DNA, 25 bp, Homo sapien
ggcttgagccaacaaattgactttg

SEQ ID NO: 401924 - DNA, 25 bp, Homo sapien
gcttgagccaacaaattgactttgc

SEQ ID NO: 401925 - DNA, 25 bp, Homo sapien
ttgagccaacaaattgactttgctg

SEQ ID NO: 401926 - DNA, 25 bp, Homo sapien
gcgtgtgcctcaagcactaccaggc

SEQ ID NO: 401927 - DNA, 25 bp, Homo sapien
tcaagcactaccaggccagcgtgtc

SEQ ID NO: 401928 - DNA, 25 bp, Homo sapien
cgtgctgggcgtcgactccttcagt

SEQ ID NO: 401929 - DNA, 25 bp, Homo sapien
tgggcgtcgactccttcagtctgcc

SEQ ID NO: 401930 - DNA, 25 bp, Homo sapien
gggcaccttctctctgattattgaa

SEQ ID NO: 401931 - DNA, 25 bp, Homo sapien
cttctctctgattattgaagctctc

SEQ ID NO: 401932 - DNA, 25 bp, Homo sapien
cacacagattctcctgatgacctcg

SEQ ID NO: 401933 - DNA, 25 bp, Homo sapien
agattctcctgatgacctcgcaaca

SEQ ID NO: 401934 - DNA, 25 bp, Homo sapien
tctcctgatgacctcgcaacagaaa

SEQ ID NO: 401935 - DNA, 25 bp, Homo sapien
gatgacctcgcaacagaaaacccag

SEQ ID NO: 401936 - DNA, 25 bp, Homo sapien
cagaaagactcatcagccgcctggc

SEQ ID NO: 401937 - DNA, 25 bp, Homo sapien
tgcaggcacaccaggctatggagca

SEQ ID NO: 401938 - DNA, 25 bp, Homo sapien
tatggagcagccgaaggcgtacatg

SEQ ID NO: 401939 - DNA, 25 bp, Homo sapien
gaaggcgtacatgcactgaaaccag

SEQ ID NO: 401940 - DNA, 25 bp, Homo sapien
tccatggctgccaaaaggacagtgt

SEQ ID NO: 401941 - DNA, 25 bp, Homo sapien
aggacagtgtttctggctctcagcc

SEQ ID NO: 401942 - DNA, 25 bp, Homo sapien
tgtttctggctctcagccctaaggc

SEQ ID NO: 401943 - DNA, 25 bp, Homo sapien
aggccctgcaaactctaacttattt

SEQ ID NO: 401944 - DNA, 25 bp, Homo sapien
cttatttcccaattagtctgtatct

SEQ ID NO: 401945 - DNA, 25 bp, Homo sapien
gtctgtatctatacttgggctctgt

SEQ ID NO: 401946 - DNA, 25 bp, Homo sapien
aatgaaggttggtcacccatccagc

SEQ ID NO: 401947 - DNA, 25 bp, Homo sapien
atccagcctattaccttttgctttg

SEQ ID NO: 401948 - DNA, 25 bp, Homo sapien
tggaatgcaactcccatgtaaatcg

SEQ ID NO: 401949 - DNA, 25 bp, Homo sapien
agattgtgctttgtttgtttcggaa

SEQ ID NO: 401950 - DNA, 25 bp, Homo sapien
tatcaagaattgttcagcgcttcga

SEQ ID NO: 401951 - DNA, 25 bp, Homo sapien
cagcgcttcgaaatattccttcatc

SEQ ID NO: 401952 - DNA, 25 bp, Homo sapien
tattccttcatcaatgacaacgcag

SEQ ID NO: 401953 - DNA, 25 bp, Homo sapien
acgcagcttctggtatttgagtcaa

SEQ ID NO: 401954 - DNA, 25 bp, Homo sapien
aggcaacacatgtttatcagctttg

SEQ ID NO: 401955 - DNA, 25 bp, Homo sapien
atcagctttgcatttgcagttgtca

SEQ ID NO: 401956 - DNA, 25 bp, Homo sapien
gcagttgtcacagtcacattgattg

SEQ ID NO: 401957 - DNA, 25 bp, Homo sapien
ttgattgtacttgtatacgcacaca

SEQ ID NO: 401958 - DNA, 25 bp, Homo sapien
gtatacgcacacaaatacactcatt

SEQ ID NO: 401959 - DNA, 25 bp, Homo sapien
ggaatagctcaaatttcaattgatg

SEQ ID NO: 401960 - DNA, 25 bp, Homo sapien
ttcaattgatggcacaaatcagcat

SEQ ID NO: 401961 - DNA, 25 bp, Homo sapien
gttgttactgtattacaattagtat

SEQ ID NO: 401962 - DNA, 25 bp, Homo sapien
attagtattctaaaggcagaagcag

SEQ ID NO: 401963 - DNA, 25 bp, Homo sapien
cagaagtagctgctttttagcaata

SEQ ID NO: 401964 - DNA, 25 bp, Homo sapien
ttgctgctgtttaatgcgcatcttc

SEQ ID NO: 401965 - DNA, 25 bp, Homo sapien
ctgctgtttaatgcgcatcttcaga

SEQ ID NO: 401966 - DNA, 25 bp, Homo sapien
gggatctctctggcaacaaattgtg

SEQ ID NO: 401967 - DNA, 25 bp, Homo sapien
aacatgaaatttctgctgactttaa

SEQ ID NO: 401968 - DNA, 25 bp, Homo sapien
aatttctgctgactttaatatatga

SEQ ID NO: 401969 - DNA, 25 bp, Homo sapien
taatatatgaaacctaatcctaccc

SEQ ID NO: 401970 - DNA, 25 bp, Homo sapien
gaacagtgtatctgaggtcaccaac

SEQ ID NO: 401971 - DNA, 25 bp, Homo sapien
ggtcaccaacgaaagaggcatctgt

SEQ ID NO: 401972 - DNA, 25 bp, Homo sapien
aagtttccaggacaatcttaggttg

SEQ ID NO: 401973 - DNA, 25 bp, Homo sapien
gacaatcttaggttggaagtcccct

SEQ ID NO: 401974 - DNA, 25 bp, Homo sapien
ggaagtcccctaatcagtctatata

SEQ ID NO: 401975 - DNA, 25 bp, Homo sapien
tagctggtgcttttggtgactgaga

SEQ ID NO: 401976 - DNA, 25 bp, Homo sapien
gagctggctctgatattaactggtt

SEQ ID NO: 401977 - DNA, 25 bp, Homo sapien
ttgggcaatccaccgagtctatgca

SEQ ID NO: 401978 - DNA, 25 bp, Homo sapien
tccaccgagtctatgcagaatcaag

SEQ ID NO: 401979 - DNA, 25 bp, Homo sapien
tcaaggttgagagcttcagacaaac

SEQ ID NO: 401980 - DNA, 25 bp, Homo sapien
gacaaaccaacagaccttttgttca

SEQ ID NO: 401981 - DNA, 25 bp, Homo sapien
taagtcctaggtatttgaattctcc

SEQ ID NO: 401982 - DNA, 25 bp, Homo sapien
ggtatttgaattctcctcttgcctt

SEQ ID NO: 401983 - DNA, 25 bp, Homo sapien
tttcccagcatgttgaaggcaggtc

SEQ ID NO: 401984 - DNA, 25 bp, Homo sapien
aggcaggtcataggaccataggcaa

SEQ ID NO: 401985 - DNA, 25 bp, Homo sapien
aatacttaattgagcacccactagg

SEQ ID NO: 401986 - DNA, 25 bp, Homo sapien
attgagcacccactaggtatgcctg

SEQ ID NO: 401987 - DNA, 25 bp, Homo sapien
ctaggtatgcctgctctgtgaacat

SEQ ID NO: 401988 - DNA, 25 bp, Homo sapien
gctctgtgaacataccctgtggaga

SEQ ID NO: 401989 - DNA, 25 bp, Homo sapien
tatcctaataagtctcatagctagt

SEQ ID NO: 401990 - DNA, 25 bp, Homo sapien
gtaaaaggcagaaccaggcacaaaa

SEQ ID NO: 401991 - DNA, 25 bp, Homo sapien
aggaaccaaccaggattcacatgtt

SEQ ID NO: 401992 - DNA, 25 bp, Homo sapien
cttttgaattcagacctggaatgta

SEQ ID NO: 401993 - DNA, 25 bp, Homo sapien
tatggaaagccagttagttagaatt

SEQ ID NO: 401994 - DNA, 25 bp, Homo sapien
gttagaattggaaatctgtcttgtc

SEQ ID NO: 401995 - DNA, 25 bp, Homo sapien
agcattagattcctttcctgtgtga

SEQ ID NO: 401996 - DNA, 25 bp, Homo sapien
gaaagcctcagtgaaacaggtcttt

SEQ ID NO: 401997 - DNA, 25 bp, Homo sapien
gaaacaggtctttgccataacttta

SEQ ID NO: 401998 - DNA, 25 bp, Homo sapien
atgttcatcaatacctgctgagagt

SEQ ID NO: 401999 - DNA, 25 bp, Homo sapien
atacctgctgagagtactgtcccag

SEQ ID NO: 402000 - DNA, 25 bp, Homo sapien
gtactgtcccaggaatatccagtgg

SEQ ID NO: 402001 - DNA, 25 bp, Homo sapien
tatccagtggatggattcatcatcc

SEQ ID NO: 402002 - DNA, 25 bp, Homo sapien
catcatccaggaggttcaaaagtaa

SEQ ID NO: 402003 - DNA, 25 bp, Homo sapien
acaggtatggccccttgccagggta

SEQ ID NO: 402004 - DNA, 25 bp, Homo sapien
gtatggccccttgccagggtaggag

SEQ ID NO: 402005 - DNA, 25 bp, Homo sapien
ccagggtaggaggacattcatcacc

SEQ ID NO: 402006 - DNA, 25 bp, Homo sapien
ttgcctttttctcccgattgcggat

SEQ ID NO: 402007 - DNA, 25 bp, Homo sapien
tttttctcccgattgcggatttggg

SEQ ID NO: 402008 - DNA, 25 bp, Homo sapien
atttgggggccacctctaagatgcc

SEQ ID NO: 402009 - DNA, 25 bp, Homo sapien
gggccacctctaagatgcctctctc

SEQ ID NO: 402010 - DNA, 25 bp, Homo sapien
catactccaaattagtgccaaccca

SEQ ID NO: 402011 - DNA, 25 bp, Homo sapien
tactccaaattagtgccaacccagg

SEQ ID NO: 402012 - DNA, 25 bp, Homo sapien
actccaaattagtgccaacccaggg

SEQ ID NO: 402013 - DNA, 25 bp, Homo sapien
tcccacatcatccattgtcttgctg

SEQ ID NO: 402014 - DNA, 25 bp, Homo sapien
tgttgtctggccgtcgtcaacccca

SEQ ID NO: 402015 - DNA, 25 bp, Homo sapien
caccttgactgagtgttgagcccgt

SEQ ID NO: 402016 - DNA, 25 bp, Homo sapien
ttgactgagtgttgagcccgtcctt

SEQ ID NO: 402017 - DNA, 25 bp, Homo sapien
actgagtgttgagcccgtccttggg

SEQ ID NO: 402018 - DNA, 25 bp, Homo sapien
ttgagcccgtccttgggctctggtc

SEQ ID NO: 402019 - DNA, 25 bp, Homo sapien
gggcggacgctgcataccaatttgc

SEQ ID NO: 402020 - DNA, 25 bp, Homo sapien
ggacgctgcataccaatttgccctg

SEQ ID NO: 402021 - DNA, 25 bp, Homo sapien
acgctgcataccaatttgccctgca

SEQ ID NO: 402022 - DNA, 25 bp, Homo sapien
tgcaccgcctgtcccggagacggag

SEQ ID NO: 402023 - DNA, 25 bp, Homo sapien
ggagacggagcccgaaggcctgcca

SEQ ID NO: 402024 - DNA, 25 bp, Homo sapien
cccgactctgaatcccgggcgggag

SEQ ID NO: 402025 - DNA, 25 bp, Homo sapien
ctgtccaggtaggaaacaattcttt

SEQ ID NO: 402026 - DNA, 25 bp, Homo sapien
acaattctttcaactgggttttcag

SEQ ID NO: 402027 - DNA, 25 bp, Homo sapien
gatttagcccttctaggcaaaagaa

SEQ ID NO: 402028 - DNA, 25 bp, Homo sapien
gctcagttgggtttcacgagtgttc

SEQ ID NO: 402029 - DNA, 25 bp, Homo sapien
acgagtgttcctgtgcttatattca

SEQ ID NO: 402030 - DNA, 25 bp, Homo sapien
gcttatattcagtctgtgcctacat

SEQ ID NO: 402031 - DNA, 25 bp, Homo sapien
tctgtgcctacatgttctcatgcat

SEQ ID NO: 402032 - DNA, 25 bp, Homo sapien
gttctcatgcatgtctaacctgatt

SEQ ID NO: 402033 - DNA, 25 bp, Homo sapien
taacctgatttacctcttacctgta

SEQ ID NO: 402034 - DNA, 25 bp, Homo sapien
tacctgtaacctaccttatcatgtg

SEQ ID NO: 402035 - DNA, 25 bp, Homo sapien
acctaccttatcatgtggcttttaa

SEQ ID NO: 402036 - DNA, 25 bp, Homo sapien
ggagccaatagtaagctgacatttg

SEQ ID NO: 402037 - DNA, 25 bp, Homo sapien
tgagtgttagaccagatatccagaa

SEQ ID NO: 402038 - DNA, 25 bp, Homo sapien
acaaaactgtgctaaaaatgaggtt

SEQ ID NO: 402039 - DNA, 25 bp, Homo sapien
aactgtgctaaaaatgaggtttatg

SEQ ID NO: 402040 - DNA, 25 bp, Homo sapien
atgaggtttatggacttaaagaaca

SEQ ID NO: 402041 - DNA, 25 bp, Homo sapien
gtttatggacttaaagaacaacagt

SEQ ID NO: 402042 - DNA, 25 bp, Homo sapien
aacaacagtgttggggcttgagcca

SEQ ID NO: 402043 - DNA, 25 bp, Homo sapien
gggcttgagccaacaaattgacttt

SEQ ID NO: 402044 - DNA, 25 bp, Homo sapien
ggcttgagccaacaaattgactttg

SEQ ID NO: 402045 - DNA, 25 bp, Homo sapien
gcttgagccaacaaattgactttgc

SEQ ID NO: 402046 - DNA, 25 bp, Homo sapien
ttgagccaacaaattgactttgctg

SEQ ID NO: 402047 - DNA, 25 bp, Homo sapien
atccgtgtcagctttaccctctgaa

SEQ ID NO: 402048 - DNA, 25 bp, Homo sapien
tttaccctctgaacttctgatcgaa

SEQ ID NO: 402049 - DNA, 25 bp, Homo sapien
aacttctgatcgaaggtcatccctc

SEQ ID NO: 402050 - DNA, 25 bp, Homo sapien
aaggtcatccctctccagcttgagt

SEQ ID NO: 402051 - DNA, 25 bp, Homo sapien
ggccaatggaaccaagtttgagtct

SEQ ID NO: 402052 - DNA, 25 bp, Homo sapien
tttgagtcttgccaggtcaatactt

SEQ ID NO: 402053 - DNA, 25 bp, Homo sapien
cttgccaggtcaatacttgggtcct

SEQ ID NO: 402054 - DNA, 25 bp, Homo sapien
acttgggtcctgagtatggtgacta

SEQ ID NO: 402055 - DNA, 25 bp, Homo sapien
gactagtatctgttttgttatgtgt

SEQ ID NO: 402056 - DNA, 25 bp, Homo sapien
ttccagccagaatgggaaatgctaa

SEQ ID NO: 402057 - DNA, 25 bp, Homo sapien
gaaatgctaattcagctcctccagg

SEQ ID NO: 402058 - DNA, 25 bp, Homo sapien
agaattggaagatcctccccttttg

SEQ ID NO: 402059 - DNA, 25 bp, Homo sapien
tttccctgtggccttttgaactgta

SEQ ID NO: 402060 - DNA, 25 bp, Homo sapien
ggccttttgaactgtacatctcaca

SEQ ID NO: 402061 - DNA, 25 bp, Homo sapien
acatctcacatgttgggaaacgctg

SEQ ID NO: 402062 - DNA, 25 bp, Homo sapien
gaaacgctggccactgggaaatcat

SEQ ID NO: 402063 - DNA, 25 bp, Homo sapien
gctgtagaatatttgccgagcctct

SEQ ID NO: 402064 - DNA, 25 bp, Homo sapien
gccgagcctctactgtataccaggg

SEQ ID NO: 402065 - DNA, 25 bp, Homo sapien
actcaccaagcacattctaggaatt

SEQ ID NO: 402066 - DNA, 25 bp, Homo sapien
cacattctaggaattgggccctgct

SEQ ID NO: 402067 - DNA, 25 bp, Homo sapien
gggccctgctcatgaggagccttag

SEQ ID NO: 402068 - DNA, 25 bp, Homo sapien
gagccttagtggagattccaggtga

SEQ ID NO: 402069 - DNA, 25 bp, Homo sapien
gagcatctgtgactatgaactgcac

SEQ ID NO: 402070 - DNA, 25 bp, Homo sapien
tgaactgcacatacacatccacggg

SEQ ID NO: 402071 - DNA, 25 bp, Homo sapien
tggtatgtggaataccccagcaaac

SEQ ID NO: 402072 - DNA, 25 bp, Homo sapien
ctctctggactttctaattctgatc

SEQ ID NO: 402073 - DNA, 25 bp, Homo sapien
cagcaaaaacttcggaggcggaaat

SEQ ID NO: 402074 - DNA, 25 bp, Homo sapien
gtgaaatattcagtccaggtatcag

SEQ ID NO: 402075 - DNA, 25 bp, Homo sapien
aattctgatcttaatgtttggagga

SEQ ID NO: 402076 - DNA, 25 bp, Homo sapien
ggaggaaccagcagcaattcagtca

SEQ ID NO: 402077 - DNA, 25 bp, Homo sapien
aattcagtcaagcagacgggccaaa

SEQ ID NO: 402078 - DNA, 25 bp, Homo sapien
gacgggccaaataaccgtctcggag

SEQ ID NO: 402079 - DNA, 25 bp, Homo sapien
taaccgtctcggagggagcatctgt

SEQ ID NO: 402080 - DNA, 25 bp, Homo sapien
tgtctgtctgatcagcatcactgca

SEQ ID NO: 402081 - DNA, 25 bp, Homo sapien
agcatcactgcacacggaggtctag

SEQ ID NO: 402082 - DNA, 25 bp, Homo sapien
ggaggtctagtgagcctcttgctaa

SEQ ID NO: 402083 - DNA, 25 bp, Homo sapien
agcctcttgctaagtgtcacacaca

SEQ ID NO: 402084 - DNA, 25 bp, Homo sapien
acactcttcccaaagacgtgatgag

SEQ ID NO: 402085 - DNA, 25 bp, Homo sapien
ctgaaatcatgaagccagagcctgt

SEQ ID NO: 402086 - DNA, 25 bp, Homo sapien
agaccttctgctacctctcatagaa

SEQ ID NO: 402087 - DNA, 25 bp, Homo sapien
gctacctctcatagaattgctctgt

SEQ ID NO: 402088 - DNA, 25 bp, Homo sapien
agagagagataagccatcgcccctt

SEQ ID NO: 402089 - DNA, 25 bp, Homo sapien
tcgcccctttgcctctgagaattgg

SEQ ID NO: 402090 - DNA, 25 bp, Homo sapien
gaattggctgctgtttctaatataa

SEQ ID NO: 402091 - DNA, 25 bp, Homo sapien
gaaatctcatttgagttgccctgct

SEQ ID NO: 402092 - DNA, 25 bp, Homo sapien
ctcatttgagttgccctgctaatat

SEQ ID NO: 402093 - DNA, 25 bp, Homo sapien
tgctaatatttgcagctcgctggtg

SEQ ID NO: 402094 - DNA, 25 bp, Homo sapien
aatatttgcagctcgctggtgggtg

SEQ ID NO: 402095 - DNA, 25 bp, Homo sapien
gtggaggccagtactcaccgtcagg

SEQ ID NO: 402096 - DNA, 25 bp, Homo sapien
ctcaccgtcaggctgtggcaggtac

SEQ ID NO: 402097 - DNA, 25 bp, Homo sapien
gaaaaactccatgagagaacggtgg

SEQ ID NO: 402098 - DNA, 25 bp, Homo sapien
aacggtggaaagttcacctgagagt

SEQ ID NO: 402099 - DNA, 25 bp, Homo sapien
cctgagagtgaaacgcatgccagtt

SEQ ID NO: 402100 - DNA, 25 bp, Homo sapien
aacgcatgccagttagagtggctga

SEQ ID NO: 402101 - DNA, 25 bp, Homo sapien
agcatggacaacaccagctagtgaa

SEQ ID NO: 402102 - DNA, 25 bp, Homo sapien
gaaggaactcctaaaggctcaagac

SEQ ID NO: 402103 - DNA, 25 bp, Homo sapien
aggctcaagaccacctttaatccta

SEQ ID NO: 402104 - DNA, 25 bp, Homo sapien
cctttaatcctacaatctcagtctc

SEQ ID NO: 402105 - DNA, 25 bp, Homo sapien
atctcagtctctaccttgttcatca

SEQ ID NO: 402106 - DNA, 25 bp, Homo sapien
tgttcatcacctcgagatgttccac

SEQ ID NO: 402107 - DNA, 25 bp, Homo sapien
gatgttccaccagatatcttgctag

SEQ ID NO: 402108 - DNA, 25 bp, Homo sapien
gacatggttcaagtgaggactacct

SEQ ID NO: 402109 - DNA, 25 bp, Homo sapien
gaggactacctacacatggtgcaca

SEQ ID NO: 402110 - DNA, 25 bp, Homo sapien
tacacatggtgcacaggctaagtag

SEQ ID NO: 402111 - DNA, 25 bp, Homo sapien
gtagtgacgatggagattcttcaac

SEQ ID NO: 402112 - DNA, 25 bp, Homo sapien
ttcttcaacaatgaggaatgctgca

SEQ ID NO: 402113 - DNA, 25 bp, Homo sapien
gtgccaagctagtccgggatgcctt

SEQ ID NO: 402114 - DNA, 25 bp, Homo sapien
aagctagtccgggatgcctttgccc

SEQ ID NO: 402115 - DNA, 25 bp, Homo sapien
ccgggatgcctttgccctggccaag

SEQ ID NO: 402116 - DNA, 25 bp, Homo sapien
ggagaaagcgccctctatcatcttc

SEQ ID NO: 402117 - DNA, 25 bp, Homo sapien
agcgccctctatcatcttcattgat

SEQ ID NO: 402118 - DNA, 25 bp, Homo sapien
tgatgagttggatgccatcggcacc

SEQ ID NO: 402119 - DNA, 25 bp, Homo sapien
agttggatgccatcggcaccaagcg

SEQ ID NO: 402120 - DNA, 25 bp, Homo sapien
cacagactaaggccaccttcctaaa

SEQ ID NO: 402121 - DNA, 25 bp, Homo sapien
cagctggtgcagatgttcattggag

SEQ ID NO: 402122 - DNA, 25 bp, Homo sapien
gctggtgcagatgttcattggagat

SEQ ID NO: 402123 - DNA, 25 bp, Homo sapien
gcagatgttcattggagatggtgcc

SEQ ID NO: 402124 - DNA, 25 bp, Homo sapien
caggtttgcaccctgtgcgcctgtc

SEQ ID NO: 402125 - DNA, 25 bp, Homo sapien
tcaggacccagcaggctcagacttg

SEQ ID NO: 402126 - DNA, 25 bp, Homo sapien
gctcagacttgcctgcgatcaaaga

SEQ ID NO: 402127 - DNA, 25 bp, Homo sapien
cctgcgatcaaagaaagccctgtgt

SEQ ID NO: 402128 - DNA, 25 bp, Homo sapien
aacacgacaccgctgcgtgactttc

SEQ ID NO: 402129 - DNA, 25 bp, Homo sapien
cgtgactttcctgctgttactagag

SEQ ID NO: 402130 - DNA, 25 bp, Homo sapien
ttcctgctgttactagaggtcggca

SEQ ID NO: 402131 - DNA, 25 bp, Homo sapien
gaggtcggcaggtacttttccctag

SEQ ID NO: 402132 - DNA, 25 bp, Homo sapien
taggaaactgggtgtgcacgtctca

SEQ ID NO: 402133 - DNA, 25 bp, Homo sapien
gtgtccatcatggtaagagcctcgt

SEQ ID NO: 402134 - DNA, 25 bp, Homo sapien
gagcctcgtaaagggtacttatcag

SEQ ID NO: 402135 - DNA, 25 bp, Homo sapien
ttatttgcactctgaccatgttggt

SEQ ID NO: 402136 - DNA, 25 bp, Homo sapien
gaccatgttggtgctcactagagtg

SEQ ID NO: 402137 - DNA, 25 bp, Homo sapien
gagtggtgatatttcacctgaagaa

SEQ ID NO: 402138 - DNA, 25 bp, Homo sapien
atagaatatccccaaaacagagcaa

SEQ ID NO: 402139 - DNA, 25 bp, Homo sapien
ttatgtacaaggcaataccaaggtg

SEQ ID NO: 402140 - DNA, 25 bp, Homo sapien
taatagggaactttctttctctctt

SEQ ID NO: 402141 - DNA, 25 bp, Homo sapien
aataccaaggtgatctcagcaataa

SEQ ID NO: 402142 - DNA, 25 bp, Homo sapien
tcagcaataatcaggcttcccttct

SEQ ID NO: 402143 - DNA, 25 bp, Homo sapien
gcttcccttcttattcacttcgaag

SEQ ID NO: 402144 - DNA, 25 bp, Homo sapien
ttcacttcgaagtatccatcacagt

SEQ ID NO: 402145 - DNA, 25 bp, Homo sapien
aagtatccatcacagttatttgcac

SEQ ID NO: 402146 - DNA, 25 bp, Homo sapien
gattttgcatgcagagcggatcctg

SEQ ID NO: 402147 - DNA, 25 bp, Homo sapien
atgcagagcggatcctgccttgtca

SEQ ID NO: 402148 - DNA, 25 bp, Homo sapien
gccttgtcactgacttcatctggga

SEQ ID NO: 402149 - DNA, 25 bp, Homo sapien
tcactgacttcatctgggattgctt

SEQ ID NO: 402150 - DNA, 25 bp, Homo sapien
gcttagagaacaaagagcccggttc

SEQ ID NO: 402151 - DNA, 25 bp, Homo sapien
agagcccggttcacaggcagagact

SEQ ID NO: 402152 - DNA, 25 bp, Homo sapien
tggctacacctgcttaacttcagtt

SEQ ID NO: 402153 - DNA, 25 bp, Homo sapien
cacctgcttaacttcagttcctttt

SEQ ID NO: 402154 - DNA, 25 bp, Homo sapien
tttctgtcaatatgtccttgcccac

SEQ ID NO: 402155 - DNA, 25 bp, Homo sapien
actgcctctcggtgttgccttcata

SEQ ID NO: 402156 - DNA, 25 bp, Homo sapien
gttgccttcataatgtcttgtgtgt

SEQ ID NO: 402157 - DNA, 25 bp, Homo sapien
tcaggccgtattccggatccctaga

SEQ ID NO: 402158 - DNA, 25 bp, Homo sapien
ggatccctagatcccgtgggagatt

SEQ ID NO: 402159 - DNA, 25 bp, Homo sapien
gtgggagattctccgattccgaacg

SEQ ID NO: 402160 - DNA, 25 bp, Homo sapien
gattccgaacggattccagatccca

SEQ ID NO: 402161 - DNA, 25 bp, Homo sapien
gattccagatcccaagattcctgat

SEQ ID NO: 402162 - DNA, 25 bp, Homo sapien
aagattcctgatctgccggcccagg

SEQ ID NO: 402163 - DNA, 25 bp, Homo sapien
ccggatttcagaacctcaggacctt

SEQ ID NO: 402164 - DNA, 25 bp, Homo sapien
tcaggaccttgcaagtccgagctag

SEQ ID NO: 402165 - DNA, 25 bp, Homo sapien
gtccgagctaggatttctccctgga

SEQ ID NO: 402166 - DNA, 25 bp, Homo sapien
cctggactttagattcctggaacgg

SEQ ID NO: 402167 - DNA, 25 bp, Homo sapien
tcctggaacgggacgtcaggccgta

SEQ ID NO: 402168 - DNA, 25 bp, Homo sapien
ggatgaatccaggaggtttcactca

SEQ ID NO: 402169 - DNA, 25 bp, Homo sapien
atccaggaggtttcactcaacctga

SEQ ID NO: 402170 - DNA, 25 bp, Homo sapien
ggaggtttcactcaacctgagaccc

SEQ ID NO: 402171 - DNA, 25 bp, Homo sapien
gggcatcctgcagggcattgtgtcc

SEQ ID NO: 402172 - DNA, 25 bp, Homo sapien
ggtgacgtcccttgtgacaacacca

SEQ ID NO: 402173 - DNA, 25 bp, Homo sapien
accaagcctggtgtctataccaaag

SEQ ID NO: 402174 - DNA, 25 bp, Homo sapien
tgtctataccaaagtctgccactac

SEQ ID NO: 402175 - DNA, 25 bp, Homo sapien
accaaagtctgccactacttggagt

SEQ ID NO: 402176 - DNA, 25 bp, Homo sapien
actacttggagtggatcagggaaac

SEQ ID NO: 402177 - DNA, 25 bp, Homo sapien
gaggaactgactattctagcctatc

SEQ ID NO: 402178 - DNA, 25 bp, Homo sapien
gactattctagcctatctcctgtgc

SEQ ID NO: 402179 - DNA, 25 bp, Homo sapien
gtagcggcatctaaaggctgggacc

SEQ ID NO: 402180 - DNA, 25 bp, Homo sapien
ggcatctaaaggctgggaccctccc

SEQ ID NO: 402181 - DNA, 25 bp, Homo sapien
agctgcaaacgctctcctcgaggat

SEQ ID NO: 402182 - DNA, 25 bp, Homo sapien
aacgctctcctcgaggattctgcag

SEQ ID NO: 402183 - DNA, 25 bp, Homo sapien
actatcccgtggctggtttgcaccg

SEQ ID NO: 402184 - DNA, 25 bp, Homo sapien
gtggctggtttgcaccggtcctcta

SEQ ID NO: 402185 - DNA, 25 bp, Homo sapien
gaagcccttacgaccctacgactgg

SEQ ID NO: 402186 - DNA, 25 bp, Homo sapien
ttacgaccctacgactggcaggacg

SEQ ID NO: 402187 - DNA, 25 bp, Homo sapien
acgaccctacgactggcaggacgcg

SEQ ID NO: 402188 - DNA, 25 bp, Homo sapien
ctcacagcacattccgttctaggaa

SEQ ID NO: 402189 - DNA, 25 bp, Homo sapien
agcacattccgttctaggaacccca

SEQ ID NO: 402190 - DNA, 25 bp, Homo sapien
aaacaggtaaatccaggtgatggct

SEQ ID NO: 402191 - DNA, 25 bp, Homo sapien
aaatccaggtgatggctgggatgca

SEQ ID NO: 402192 - DNA, 25 bp, Homo sapien
gatgcagagaagactcaacgaggca

SEQ ID NO: 402193 - DNA, 25 bp, Homo sapien
gaggcagccaagaatttccgtctcc

SEQ ID NO: 402194 - DNA, 25 bp, Homo sapien
agcatcctctcagaagtggcaatcc

SEQ ID NO: 402195 - DNA, 25 bp, Homo sapien
cagaagtggcaatccctaatcccag

SEQ ID NO: 402196 - DNA, 25 bp, Homo sapien
agcgccgtttctctgtccggagcat

SEQ ID NO: 402197 - DNA, 25 bp, Homo sapien
gtccggagcatgaagtcctcggcct

SEQ ID NO: 402198 - DNA, 25 bp, Homo sapien
ggcctccctcataatactctcttgg

SEQ ID NO: 402199 - DNA, 25 bp, Homo sapien
ataatactctcttggccgtgactgc

SEQ ID NO: 402200 - DNA, 25 bp, Homo sapien
ttggccgtgactgccgccaggcaga

SEQ ID NO: 402201 - DNA, 25 bp, Homo sapien
gaatactagggttctgtgagtttga

SEQ ID NO: 402202 - DNA, 25 bp, Homo sapien
aaccgtgtggaatataacacctaag

SEQ ID NO: 402203 - DNA, 25 bp, Homo sapien
gtgagtttgattaaggtacggtgat

SEQ ID NO: 402204 - DNA, 25 bp, Homo sapien
gtacggtgatcaatataagctatgt

SEQ ID NO: 402205 - DNA, 25 bp, Homo sapien
gggctatactactgaatgaaaaatg

SEQ ID NO: 402206 - DNA, 25 bp, Homo sapien
aaacacgttgaaacataacatgcaa

SEQ ID NO: 402207 - DNA, 25 bp, Homo sapien
aacatgcaacaggttcacgattctt

SEQ ID NO: 402208 - DNA, 25 bp, Homo sapien
ggttcacgattctttattcctgggc

SEQ ID NO: 402209 - DNA, 25 bp, Homo sapien
cacgattctttattcctgggcaatg

SEQ ID NO: 402210 - DNA, 25 bp, Homo sapien
cacctaagaatatgtctgttaccca

SEQ ID NO: 402211 - DNA, 25 bp, Homo sapien
gtctgttacccatgatatgatgctt

SEQ ID NO: 402212 - DNA, 25 bp, Homo sapien
gggtgttgaattcagatttagccat

SEQ ID NO: 402213 - DNA, 25 bp, Homo sapien
agatttagccatgtctgtttgatga

SEQ ID NO: 402214 - DNA, 25 bp, Homo sapien
agccatgtctgtttgatgagtctga

SEQ ID NO: 402215 - DNA, 25 bp, Homo sapien
atgtctgtttgatgagtctgagtga

SEQ ID NO: 402216 - DNA, 25 bp, Homo sapien
gggacatagagatatctatttagac

SEQ ID NO: 402217 - DNA, 25 bp, Homo sapien
gtaatatgttctattctaaatggaa

SEQ ID NO: 402218 - DNA, 25 bp, Homo sapien
gttttttcttacactaatgattttg

SEQ ID NO: 402219 - DNA, 25 bp, Homo sapien
taatgattttgttttacggctgaaa

SEQ ID NO: 402220 - DNA, 25 bp, Homo sapien
gtaaaatggccaacttgagaagcct

SEQ ID NO: 402221 - DNA, 25 bp, Homo sapien
gccaacttgagaagcctaggtataa

SEQ ID NO: 402222 - DNA, 25 bp, Homo sapien
gaagcctaggtataatatgccttag

SEQ ID NO: 402223 - DNA, 25 bp, Homo sapien
aaaaactgcccatctaggctgtggc

SEQ ID NO: 402224 - DNA, 25 bp, Homo sapien
tggcaggcctactagggaatggaca

SEQ ID NO: 402225 - DNA, 25 bp, Homo sapien
gaatggacaaaaagttccggcacgt

SEQ ID NO: 402226 - DNA, 25 bp, Homo sapien
aaagttccggcacgttccactggct

SEQ ID NO: 402227 - DNA, 25 bp, Homo sapien
gcacgttccactggctgagggagca

SEQ ID NO: 402228 - DNA, 25 bp, Homo sapien
gcatgggacacggacagctcagctg

SEQ ID NO: 402229 - DNA, 25 bp, Homo sapien
ggacacggacagctcagctgcacgt

SEQ ID NO: 402230 - DNA, 25 bp, Homo sapien
ccagtgggaaaacatcaagaggtct

SEQ ID NO: 402231 - DNA, 25 bp, Homo sapien
gaggtctaacgtctgagtcactgga

SEQ ID NO: 402232 - DNA, 25 bp, Homo sapien
aacgtctgagtcactggagtcacag

SEQ ID NO: 402233 - DNA, 25 bp, Homo sapien
gagtcactggagtcacagaaggaga

SEQ ID NO: 402234 - DNA, 25 bp, Homo sapien
tccaggagggtgaaaatgccaccat

SEQ ID NO: 402235 - DNA, 25 bp, Homo sapien
gaaaatgccaccatgaactgcagtt

SEQ ID NO: 402236 - DNA, 25 bp, Homo sapien
atgccaccatgaactgcagttacaa

SEQ ID NO: 402237 - DNA, 25 bp, Homo sapien
tgaactgcagttacaaaactagtat

SEQ ID NO: 402238 - DNA, 25 bp, Homo sapien
ctcctgggagtgtctttggtgattc

SEQ ID NO: 402239 - DNA, 25 bp, Homo sapien
gtgtctttggtgattctatggcttc

SEQ ID NO: 402240 - DNA, 25 bp, Homo sapien
gtgattctatggcttcaactggcta

SEQ ID NO: 402241 - DNA, 25 bp, Homo sapien
ctatggcttcaactggctagggtga

SEQ ID NO: 402242 - DNA, 25 bp, Homo sapien
ctagggtgaacagtcaacagggaga

SEQ ID NO: 402243 - DNA, 25 bp, Homo sapien
gatcctcaggccttgagcatccagg

SEQ ID NO: 402244 - DNA, 25 bp, Homo sapien
ctcaggccttgagcatccaggaggg

SEQ ID NO: 402245 - DNA, 25 bp, Homo sapien
tcccttacagtcttttgtcacttaa

SEQ ID NO: 402246 - DNA, 25 bp, Homo sapien
gaactcataggcaatcgtccatcca

SEQ ID NO: 402247 - DNA, 25 bp, Homo sapien
gtccatccaaaacaagtctttctcc

SEQ ID NO: 402248 - DNA, 25 bp, Homo sapien
agcagcgaatcgtggcttaagcaaa

SEQ ID NO: 402249 - DNA, 25 bp, Homo sapien
ccatctttggaaactccagctggtt

SEQ ID NO: 402250 - DNA, 25 bp, Homo sapien
ttcctgtgcagtgcttatggtgcca

SEQ ID NO: 402251 - DNA, 25 bp, Homo sapien
gtgccacctctcgttatatttagaa

SEQ ID NO: 402252 - DNA, 25 bp, Homo sapien
gaaaaatggtctcacgtaacttgag

SEQ ID NO: 402253 - DNA, 25 bp, Homo sapien
aatccttaaaactggccaggctctg

SEQ ID NO: 402254 - DNA, 25 bp, Homo sapien
ggctctggagctgagttcaatttga

SEQ ID NO: 402255 - DNA, 25 bp, Homo sapien
gacatgtctaaactttcttcttgag

SEQ ID NO: 402256 - DNA, 25 bp, Homo sapien
aggatccggagctggtgctgataac

SEQ ID NO: 402257 - DNA, 25 bp, Homo sapien
tggtgctgataacagcggaatcccc

SEQ ID NO: 402258 - DNA, 25 bp, Homo sapien
gtctacctctctccttggtcctgga

SEQ ID NO: 402259 - DNA, 25 bp, Homo sapien
ttggtcctggaacagcgctactgat

SEQ ID NO: 402260 - DNA, 25 bp, Homo sapien
ggaacagcgctactgatcaccaagt

SEQ ID NO: 402261 - DNA, 25 bp, Homo sapien
tcaccaagtagccacaaaatataat

SEQ ID NO: 402262 - DNA, 25 bp, Homo sapien
tataataaaccctcagcacttgctc

SEQ ID NO: 402263 - DNA, 25 bp, Homo sapien
taaaccctcagcacttgctcagtag

SEQ ID NO: 402264 - DNA, 25 bp, Homo sapien
ctcagcacttgctcagtagttttgt

SEQ ID NO: 402265 - DNA, 25 bp, Homo sapien
gcacttgctcagtagttttgtgaaa

SEQ ID NO: 402266 - DNA, 25 bp, Homo sapien
gtagttttgtgaaagtctcaagtaa

SEQ ID NO: 402267 - DNA, 25 bp, Homo sapien
cctctagttcagtctgtgttattta

SEQ ID NO: 402268 - DNA, 25 bp, Homo sapien
gggccacgttgttgtatgtattgat

SEQ ID NO: 402269 - DNA, 25 bp, Homo sapien
gtattgatgtacagccttgaatgtg

SEQ ID NO: 402270 - DNA, 25 bp, Homo sapien
ataaattttctattgggtcagtgat

SEQ ID NO: 402271 - DNA, 25 bp, Homo sapien
ctattgggtcagtgatttaatcata

SEQ ID NO: 402272 - DNA, 25 bp, Homo sapien
atttaatgaatctgtttatcctttt

SEQ ID NO: 402273 - DNA, 25 bp, Homo sapien
tttttccaaatacttgtgctttagg

SEQ ID NO: 402274 - DNA, 25 bp, Homo sapien
tgtgctttaggtgtagttaccagat

SEQ ID NO: 402275 - DNA, 25 bp, Homo sapien
gttaccagatgatgaattttcctcg

SEQ ID NO: 402276 - DNA, 25 bp, Homo sapien
aattttcctcgtatggtcagtagtc

SEQ ID NO: 402277 - DNA, 25 bp, Homo sapien
cctcgtatggtcagtagtcttgtaa

SEQ ID NO: 402278 - DNA, 25 bp, Homo sapien
tatcaccagcaacagaaggtgcaga

SEQ ID NO: 402279 - DNA, 25 bp, Homo sapien
gtgttggtggcggtaattttgtcca

SEQ ID NO: 402280 - DNA, 25 bp, Homo sapien
gttggtggcggtaattttgtccatc

SEQ ID NO: 402281 - DNA, 25 bp, Homo sapien
ttggtggcggtaattttgtccatca

SEQ ID NO: 402282 - DNA, 25 bp, Homo sapien
tggtggcggtaattttgtccatcaa

SEQ ID NO: 402283 - DNA, 25 bp, Homo sapien
ggtggcggtaattttgtccatcaaa

SEQ ID NO: 402284 - DNA, 25 bp, Homo sapien
gtggcggtaattttgtccatcaaat

SEQ ID NO: 402285 - DNA, 25 bp, Homo sapien
ggcggtaattttgtccatcaaatga

SEQ ID NO: 402286 - DNA, 25 bp, Homo sapien
gcggtaattttgtccatcaaatgaa

SEQ ID NO: 402287 - DNA, 25 bp, Homo sapien
tttgtccatcaaatgaatatgtgtg

SEQ ID NO: 402288 - DNA, 25 bp, Homo sapien
gtccatcaaatgaatatgtgtgaaa

SEQ ID NO: 402289 - DNA, 25 bp, Homo sapien
ggagctggccggtttcctctcagga

SEQ ID NO: 402290 - DNA, 25 bp, Homo sapien
gccggtttcctctcaggagtctcca

SEQ ID NO: 402291 - DNA, 25 bp, Homo sapien
gggctcactgtagtgcatccgtggc

SEQ ID NO: 402292 - DNA, 25 bp, Homo sapien
actgtagtgcatccgtggccctgtc

SEQ ID NO: 402293 - DNA, 25 bp, Homo sapien
tggccctgtccttcttcatattcga

SEQ ID NO: 402294 - DNA, 25 bp, Homo sapien
gtccttcttcatattcgagcgttgg

SEQ ID NO: 402295 - DNA, 25 bp, Homo sapien
tattcgagcgttgggagtgcactac

SEQ ID NO: 402296 - DNA, 25 bp, Homo sapien
gagcgttgggagtgcactacgtatt

SEQ ID NO: 402297 - DNA, 25 bp, Homo sapien
ggagtgcactacgtattggtacatt

SEQ ID NO: 402298 - DNA, 25 bp, Homo sapien
acgtattggtacatttttgtcttct

SEQ ID NO: 402299 - DNA, 25 bp, Homo sapien
atttttgtcttctgcagtgcccttc

SEQ ID NO: 402300 - DNA, 25 bp, Homo sapien
tcttttgtgtctagcagttgagaga

SEQ ID NO: 402301 - DNA, 25 bp, Homo sapien
agcagttgagagaatgatatgacca

SEQ ID NO: 402302 - DNA, 25 bp, Homo sapien
gatatgaccatcatatcactggatt

SEQ ID NO: 402303 - DNA, 25 bp, Homo sapien
tcactggattatgggaatgaatgcc

SEQ ID NO: 402304 - DNA, 25 bp, Homo sapien
tatgggaatgaatgcccttttcaaa

SEQ ID NO: 402305 - DNA, 25 bp, Homo sapien
gaaaatgagccatttgtccccatgc

SEQ ID NO: 402306 - DNA, 25 bp, Homo sapien
aaatgagccatttgtccccatgctc

SEQ ID NO: 402307 - DNA, 25 bp, Homo sapien
catgctcccaaattacaatgattta

SEQ ID NO: 402308 - DNA, 25 bp, Homo sapien
aaggactaactttgtgcattcatat

SEQ ID NO: 402309 - DNA, 25 bp, Homo sapien
gactaactttgtgcattcatataac

SEQ ID NO: 402310 - DNA, 25 bp, Homo sapien
aactttgtgcattcatataacaaca

SEQ ID NO: 402311 - DNA, 25 bp, Homo sapien
agggagctcaggaatttttattact

SEQ ID NO: 402312 - DNA, 25 bp, Homo sapien
ttgaaggaatttgtaaatgccactg

SEQ ID NO: 402313 - DNA, 25 bp, Homo sapien
atttttaaggtgacacatttgctcc

SEQ ID NO: 402314 - DNA, 25 bp, Homo sapien
acacatttgctccttataaagttat

SEQ ID NO: 402315 - DNA, 25 bp, Homo sapien
gtaagcttaaatgacgtttgccagt

SEQ ID NO: 402316 - DNA, 25 bp, Homo sapien
aatgacgtttgccagtagttttact

SEQ ID NO: 402317 - DNA, 25 bp, Homo sapien
gatattgttgctgaactatgtaact

SEQ ID NO: 402318 - DNA, 25 bp, Homo sapien
tgatgcatttttcagtcccttttca

SEQ ID NO: 402319 - DNA, 25 bp, Homo sapien
atttttcagtcccttttcagagcaa

SEQ ID NO: 402320 - DNA, 25 bp, Homo sapien
agtcccttttcagagcaaatgcttt

SEQ ID NO: 402321 - DNA, 25 bp, Homo sapien
gcttttgcaatggtagtaatgttta

SEQ ID NO: 402322 - DNA, 25 bp, Homo sapien
aatggcagcaacatcaatacctcag

SEQ ID NO: 402323 - DNA, 25 bp, Homo sapien
agcaacatcaatacctcagcttctt

SEQ ID NO: 402324 - DNA, 25 bp, Homo sapien
aacttcatcaagtaaggctgccatg

SEQ ID NO: 402325 - DNA, 25 bp, Homo sapien
gctgccatgaggaagtgggcctaaa

SEQ ID NO: 402326 - DNA, 25 bp, Homo sapien
gtgggcctaaaggagagttttctag

SEQ ID NO: 402327 - DNA, 25 bp, Homo sapien
gcaaaggagtggcttgaaactgcaa

SEQ ID NO: 402328 - DNA, 25 bp, Homo sapien
ggagtggcttgaaactgcaaaaagt

SEQ ID NO: 402329 - DNA, 25 bp, Homo sapien
gaggagaggtctagcaaaatgatta

SEQ ID NO: 402330 - DNA, 25 bp, Homo sapien
gattaaaaatttggacttagcatca

SEQ ID NO: 402331 - DNA, 25 bp, Homo sapien
tagcatcaaagtcaaacagatccat

SEQ ID NO: 402332 - DNA, 25 bp, Homo sapien
aaagtcaaacagatccatattcaaa

SEQ ID NO: 402333 - DNA, 25 bp, Homo sapien
agtccgcctcagtcgcagagggtcc

SEQ ID NO: 402334 - DNA, 25 bp, Homo sapien
agtcgcagagggtccctcggcaagc

SEQ ID NO: 402335 - DNA, 25 bp, Homo sapien
aagcgccctgtgagtgggccattcg

SEQ ID NO: 402336 - DNA, 25 bp, Homo sapien
gggccattcggaacattggacagaa

SEQ ID NO: 402337 - DNA, 25 bp, Homo sapien
gcccaaagagccaaattgtcacaat

SEQ ID NO: 402338 - DNA, 25 bp, Homo sapien
tgtggaacccacattggcctgagat

SEQ ID NO: 402339 - DNA, 25 bp, Homo sapien
ggcctgagatccaaaacgcttcgag

SEQ ID NO: 402340 - DNA, 25 bp, Homo sapien
caaaacgcttcgaggcaccccaaat

SEQ ID NO: 402341 - DNA, 25 bp, Homo sapien
aaattacctgcccattcgtcaggac

SEQ ID NO: 402342 - DNA, 25 bp, Homo sapien
ccacccagtgttatattctgcctcg

SEQ ID NO: 402343 - DNA, 25 bp, Homo sapien
tatattctgcctcgccggagtgggt

SEQ ID NO: 402344 - DNA, 25 bp, Homo sapien
agggctgcgacatcaacttcaagga

SEQ ID NO: 402345 - DNA, 25 bp, Homo sapien
gggctgcgacatcaacttcaaggag

SEQ ID NO: 402346 - DNA, 25 bp, Homo sapien
ggctgcgacatcaacttcaaggagg

SEQ ID NO: 402347 - DNA, 25 bp, Homo sapien
tggaggacatgctgcgctcgctgca

SEQ ID NO: 402348 - DNA, 25 bp, Homo sapien
ggaggacatgctgcgctcgctgcac

SEQ ID NO: 402349 - DNA, 25 bp, Homo sapien
gtcccgagcggcagagcgtgatcca

SEQ ID NO: 402350 - DNA, 25 bp, Homo sapien
ccgagcggcagagcgtgatccagtt

SEQ ID NO: 402351 - DNA, 25 bp, Homo sapien
gagcggcagagcgtgatccagttca

SEQ ID NO: 402352 - DNA, 25 bp, Homo sapien
agcggcagagcgtgatccagttcag

SEQ ID NO: 402353 - DNA, 25 bp, Homo sapien
gcggcagagcgtgatccagttcagc

SEQ ID NO: 402354 - DNA, 25 bp, Homo sapien
gcagagcgtgatccagttcagccca

SEQ ID NO: 402355 - DNA, 25 bp, Homo sapien
taaaatgcctggaatttgcttcaga

SEQ ID NO: 402356 - DNA, 25 bp, Homo sapien
acaagactggctctgattttggtaa

SEQ ID NO: 402357 - DNA, 25 bp, Homo sapien
tttggtaaatttgaagctgactgat

SEQ ID NO: 402358 - DNA, 25 bp, Homo sapien
gctgactgatggaatacttgtacta

SEQ ID NO: 402359 - DNA, 25 bp, Homo sapien
tacttgtactattctgttttttaat

SEQ ID NO: 402360 - DNA, 25 bp, Homo sapien
atatgcaatctaggtgtagtggctt

SEQ ID NO: 402361 - DNA, 25 bp, Homo sapien
aatctaggtgtagtggcttgtgcct

SEQ ID NO: 402362 - DNA, 25 bp, Homo sapien
gtggcttgtgcctgaatcctggtta

SEQ ID NO: 402363 - DNA, 25 bp, Homo sapien
tgtgcctgaatcctggttacataga

SEQ ID NO: 402364 - DNA, 25 bp, Homo sapien
ctggttacatagaaggatcccctga

SEQ ID NO: 402365 - DNA, 25 bp, Homo sapien
tcccctgagcctagtaattcaaggc

SEQ ID NO: 402366 - DNA, 25 bp, Homo sapien
agaccctcgtcttaaaggactgtcg

SEQ ID NO: 402367 - DNA, 25 bp, Homo sapien
ttaaaggactgtcggatccaggacc

SEQ ID NO: 402368 - DNA, 25 bp, Homo sapien
aatgagacctccatgaatgctctga

SEQ ID NO: 402369 - DNA, 25 bp, Homo sapien
cctccatgaatgctctgaaagacct

SEQ ID NO: 402370 - DNA, 25 bp, Homo sapien
tgaaagacctgctgcgtcacacagg

SEQ ID NO: 402371 - DNA, 25 bp, Homo sapien
ctgcgtcacacaggcgggctgagca

SEQ ID NO: 402372 - DNA, 25 bp, Homo sapien
gcaagttaggcctggagttgtatcc

SEQ ID NO: 402373 - DNA, 25 bp, Homo sapien
gttaggcctggagttgtatcctgcc

SEQ ID NO: 402374 - DNA, 25 bp, Homo sapien
cccctctggagagtcttgactacaa

SEQ ID NO: 402375 - DNA, 25 bp, Homo sapien
gagtcttgactacaagggtcatgtc

SEQ ID NO: 402376 - DNA, 25 bp, Homo sapien
acaagggtcatgtcaattgggagat

SEQ ID NO: 402377 - DNA, 25 bp, Homo sapien
gaaaaacgtaacactgtcagccaga

SEQ ID NO: 402378 - DNA, 25 bp, Homo sapien
aacgtaacactgtcagccagaggaa

SEQ ID NO: 402379 - DNA, 25 bp, Homo sapien
actgtcagccagaggaagtaatata

SEQ ID NO: 402380 - DNA, 25 bp, Homo sapien
ctagggaatgggaaactcatgcttc

SEQ ID NO: 402381 - DNA, 25 bp, Homo sapien
aatgggaaactcatgcttcctgtga

SEQ ID NO: 402382 - DNA, 25 bp, Homo sapien
ggaaactcatgcttcctgtgagtct

SEQ ID NO: 402383 - DNA, 25 bp, Homo sapien
ttcctgtgagtctttaaactgtcca

SEQ ID NO: 402384 - DNA, 25 bp, Homo sapien
gagtctttaaactgtccattgtcca

SEQ ID NO: 402385 - DNA, 25 bp, Homo sapien
taaactgtccattgtccatcttggc

SEQ ID NO: 402386 - DNA, 25 bp, Homo sapien
tgtccattgtccatcttggcaacat

SEQ ID NO: 402387 - DNA, 25 bp, Homo sapien
ggctatagccccagcttctcaggtg

SEQ ID NO: 402388 - DNA, 25 bp, Homo sapien
agcagataaccgcaagataactcct

SEQ ID NO: 402389 - DNA, 25 bp, Homo sapien
agataactcctcttatggcagcatt

SEQ ID NO: 402390 - DNA, 25 bp, Homo sapien
gaaggtggtgcgctacttagtcaaa

SEQ ID NO: 402391 - DNA, 25 bp, Homo sapien
gtcaaagaagtcaatcagtttccat

SEQ ID NO: 402392 - DNA, 25 bp, Homo sapien
atcagtttccatcagattctgaatg

SEQ ID NO: 402393 - DNA, 25 bp, Homo sapien
gagatacatagcaaccatcactgat

SEQ ID NO: 402394 - DNA, 25 bp, Homo sapien
gatgctgaagaagtgtcatctttgt

SEQ ID NO: 402395 - DNA, 25 bp, Homo sapien
gtcatctttgtatggagtcaatagt

SEQ ID NO: 402396 - DNA, 25 bp, Homo sapien
ggagtcaatagtacaagccaaagat

SEQ ID NO: 402397 - DNA, 25 bp, Homo sapien
agatagacaggctgctgaagcaaac

SEQ ID NO: 402398 - DNA, 25 bp, Homo sapien
aaaacgccagcattttgttagagga

SEQ ID NO: 402399 - DNA, 25 bp, Homo sapien
gtctcattgggaagcccctctttat

SEQ ID NO: 402400 - DNA, 25 bp, Homo sapien
tatattacttggaatggcttggtca

SEQ ID NO: 402401 - DNA, 25 bp, Homo sapien
ggaatggcttggtcaactgtgttca

SEQ ID NO: 402402 - DNA, 25 bp, Homo sapien
aatggcttggtcaactgtgttcagt

SEQ ID NO: 402403 - DNA, 25 bp, Homo sapien
gcttggtcaactgtgttcagttcat

SEQ ID NO: 402404 - DNA, 25 bp, Homo sapien
ggtcaactgtgttcagttcataaat

SEQ ID NO: 402405 - DNA, 25 bp, Homo sapien
tttacatttttatctgcctgttata

SEQ ID NO: 402406 - DNA, 25 bp, Homo sapien
ttttatctgcctgttataaagatga

SEQ ID NO: 402407 - DNA, 25 bp, Homo sapien
gaaagatcacagatacgtaataatt

SEQ ID NO: 402408 - DNA, 25 bp, Homo sapien
taaagtctgtagttgaatttcctaa

SEQ ID NO: 402409 - DNA, 25 bp, Homo sapien
gtctgtagttgaatttcctaactta

SEQ ID NO: 402410 - DNA, 25 bp, Homo sapien
cagccgacctcagggtactttggtt

SEQ ID NO: 402411 - DNA, 25 bp, Homo sapien
aggagagtagtatacccatcgccca

SEQ ID NO: 402412 - DNA, 25 bp, Homo sapien
gagtagtatacccatcgcccagctt

SEQ ID NO: 402413 - DNA, 25 bp, Homo sapien
taagctgttaatggtgtggtggact

SEQ ID NO: 402414 - DNA, 25 bp, Homo sapien
cacaaatcttatccctttcctgctt

SEQ ID NO: 402415 - DNA, 25 bp, Homo sapien
gcttccccagagctaagcctaaaca

SEQ ID NO: 402416 - DNA, 25 bp, Homo sapien
gagctaagcctaaacagtccctctt

SEQ ID NO: 402417 - DNA, 25 bp, Homo sapien
aaacagtccctcttgtttggtgtgt

SEQ ID NO: 402418 - DNA, 25 bp, Homo sapien
agtccctcttgtttggtgtgtagat

SEQ ID NO: 402419 - DNA, 25 bp, Homo sapien
ctcttgtttggtgtgtagatttccc

SEQ ID NO: 402420 - DNA, 25 bp, Homo sapien
gtgtagatttcccatgcacattttt

SEQ ID NO: 402421 - DNA, 25 bp, Homo sapien
tgcagtttcggctccagccaggagg

SEQ ID NO: 402422 - DNA, 25 bp, Homo sapien
gtagtcctgctgcacgcctgttgct

SEQ ID NO: 402423 - DNA, 25 bp, Homo sapien
tgcacgcctgttgctggagttggaa

SEQ ID NO: 402424 - DNA, 25 bp, Homo sapien
aagagcgcgcgctactacgcgaggc

SEQ ID NO: 402425 - DNA, 25 bp, Homo sapien
cgctactacgcgaggcccgactggg

SEQ ID NO: 402426 - DNA, 25 bp, Homo sapien
gttgcccctactgcaaaggcaagtt

SEQ ID NO: 402427 - DNA, 25 bp, Homo sapien
tgcaaaggcaagtttcgcacctcgg

SEQ ID NO: 402428 - DNA, 25 bp, Homo sapien
aaaggcaagtttcgcacctcggcgg

SEQ ID NO: 402429 - DNA, 25 bp, Homo sapien
aagtttcgcacctcggcggagcgcg

SEQ ID NO: 402430 - DNA, 25 bp, Homo sapien
tgcataggccctggaagtgcggcct

SEQ ID NO: 402431 - DNA, 25 bp, Homo sapien
tgcggcctgtgcagtttcggctcca

SEQ ID NO: 402432 - DNA, 25 bp, Homo sapien
atgctattctaccactggctgtgtc

SEQ ID NO: 402433 - DNA, 25 bp, Homo sapien
tggctgtgtcttagaaggcctcaga

SEQ ID NO: 402434 - DNA, 25 bp, Homo sapien
aggccactccaaaaacaatgctctg

SEQ ID NO: 402435 - DNA, 25 bp, Homo sapien
ggtacatgaatgtttccagacatca

SEQ ID NO: 402436 - DNA, 25 bp, Homo sapien
ttaatgtccctggttatatcagtaa

SEQ ID NO: 402437 - DNA, 25 bp, Homo sapien
acattcacatattttgtgctgcatc

SEQ ID NO: 402438 - DNA, 25 bp, Homo sapien
gtgctgcatcttacaggtcttctag

SEQ ID NO: 402439 - DNA, 25 bp, Homo sapien
acaggtcttctagtaccttctatcc

SEQ ID NO: 402440 - DNA, 25 bp, Homo sapien
tgcactttgaatgggaagcaagctt

SEQ ID NO: 402441 - DNA, 25 bp, Homo sapien
aagcaagctttctggttaataaaca

SEQ ID NO: 402442 - DNA, 25 bp, Homo sapien
aaacacagtccatgctattctacca

SEQ ID NO: 402443 - DNA, 25 bp, Homo sapien
gaagatctgcccgaagggccccgag

SEQ ID NO: 402444 - DNA, 25 bp, Homo sapien
acggagtccatggtgccgggctcca

SEQ ID NO: 402445 - DNA, 25 bp, Homo sapien
tccagatccacgagcacggcgcggg

SEQ ID NO: 402446 - DNA, 25 bp, Homo sapien
cggtggcctcattgtagtacacgtt

SEQ ID NO: 402447 - DNA, 25 bp, Homo sapien
agtacacgttgatgcgttccagctg

SEQ ID NO: 402448 - DNA, 25 bp, Homo sapien
atgcgttccagctgcaggtcgctgt

SEQ ID NO: 402449 - DNA, 25 bp, Homo sapien
ggtcgatgccgtgctcatcgctgat

SEQ ID NO: 402450 - DNA, 25 bp, Homo sapien
tcgctgatcacctcccaaaacttgg

SEQ ID NO: 402451 - DNA, 25 bp, Homo sapien
aaacttggcgccgatttggttgccg

SEQ ID NO: 402452 - DNA, 25 bp, Homo sapien
tgcaagtgcacgttttccctcatga

SEQ ID NO: 402453 - DNA, 25 bp, Homo sapien
tttccctcatgatggcggcggcggc

SEQ ID NO: 402454 - DNA, 25 bp, Homo sapien
ctggcgcatctggtggtcgtcatca

SEQ ID NO: 402455 - DNA, 25 bp, Homo sapien
tggtcgtcatcaccttattctggtc

SEQ ID NO: 402456 - DNA, 25 bp, Homo sapien
gaaatggctttattcgtcaccgtct

SEQ ID NO: 402457 - DNA, 25 bp, Homo sapien
tattcgtcaccgtctttgggctgaa

SEQ ID NO: 402458 - DNA, 25 bp, Homo sapien
agaaacccttctgattaccttcatg

SEQ ID NO: 402459 - DNA, 25 bp, Homo sapien
gattaccttcatgacgggaacctaa

SEQ ID NO: 402460 - DNA, 25 bp, Homo sapien
gggaacctaaggacgaagcctacag

SEQ ID NO: 402461 - DNA, 25 bp, Homo sapien
aagggccgcttcgtattcctggaag

SEQ ID NO: 402462 - DNA, 25 bp, Homo sapien
gcataggcttcggttttcccctcgg

SEQ ID NO: 402463 - DNA, 25 bp, Homo sapien
gaataattacgtcttgagtctggga

SEQ ID NO: 402464 - DNA, 25 bp, Homo sapien
cgtcttgagtctgggattatccgca

SEQ ID NO: 402465 - DNA, 25 bp, Homo sapien
aagagcctgttcacttgccttgtaa

SEQ ID NO: 402466 - DNA, 25 bp, Homo sapien
tgccttgtaaccactccacaatcag

SEQ ID NO: 402467 - DNA, 25 bp, Homo sapien
catacattggtatcgacagcttccc

SEQ ID NO: 402468 - DNA, 25 bp, Homo sapien
cccagggtccagagtacgtgattca

SEQ ID NO: 402469 - DNA, 25 bp, Homo sapien
acgtgattcatggtcttacaagcaa

SEQ ID NO: 402470 - DNA, 25 bp, Homo sapien
ggtgacaagcattactgtactccta

SEQ ID NO: 402471 - DNA, 25 bp, Homo sapien
atgtgaacaacagaatggcctctct

SEQ ID NO: 402472 - DNA, 25 bp, Homo sapien
tggcctctctggcaatcgctgaaga

SEQ ID NO: 402473 - DNA, 25 bp, Homo sapien
cctgcaccgtgctaccttgagagat

SEQ ID NO: 402474 - DNA, 25 bp, Homo sapien
actgtactcctatctttgggtatta

SEQ ID NO: 402475 - DNA, 25 bp, Homo sapien
ggtgatgctaagaccacacagccaa

SEQ ID NO: 402476 - DNA, 25 bp, Homo sapien
gctgatgttggcacaatgcaacgta

SEQ ID NO: 402477 - DNA, 25 bp, Homo sapien
atgcaacgtatctgggagactcact

SEQ ID NO: 402478 - DNA, 25 bp, Homo sapien
gacagtggacttggagcagatccat

SEQ ID NO: 402479 - DNA, 25 bp, Homo sapien
agcagatccataaattccggccctt

SEQ ID NO: 402480 - DNA, 25 bp, Homo sapien
gagccctggagcaataggattcctt

SEQ ID NO: 402481 - DNA, 25 bp, Homo sapien
tgatggcccctctaggctctgacct

SEQ ID NO: 402482 - DNA, 25 bp, Homo sapien
gctctgacctcacaggattctgcgc

SEQ ID NO: 402483 - DNA, 25 bp, Homo sapien
gcgcctgcacacaccatggtgtttg

SEQ ID NO: 402484 - DNA, 25 bp, Homo sapien
gccctgggtagctcttgtcacaaga

SEQ ID NO: 402485 - DNA, 25 bp, Homo sapien
ctcttgtcacaagatgtgtccgaga

SEQ ID NO: 402486 - DNA, 25 bp, Homo sapien
gatgtgtccgagataatgctgatgt

SEQ ID NO: 402487 - DNA, 25 bp, Homo sapien
attctgcatttcttacatatctatc

SEQ ID NO: 402488 - DNA, 25 bp, Homo sapien
gcatttcttacatatctatcgcttg

SEQ ID NO: 402489 - DNA, 25 bp, Homo sapien
tatctatcgcttgtcagtatacccg

SEQ ID NO: 402490 - DNA, 25 bp, Homo sapien
atcgcttgtcagtatacccgttttg

SEQ ID NO: 402491 - DNA, 25 bp, Homo sapien
gcttgtcagtatacccgttttggta

SEQ ID NO: 402492 - DNA, 25 bp, Homo sapien
ggtatatattgcctctgcacatcta

SEQ ID NO: 402493 - DNA, 25 bp, Homo sapien
catttgtatatgcaacagtgagctt

SEQ ID NO: 402494 - DNA, 25 bp, Homo sapien
aacagtgagctttatatctacataa

SEQ ID NO: 402495 - DNA, 25 bp, Homo sapien
aactgtaaataatcctttctgtgaa

SEQ ID NO: 402496 - DNA, 25 bp, Homo sapien
atatttcatggtaagattagcagtc

SEQ ID NO: 402497 - DNA, 25 bp, Homo sapien
gattagcagtcaataaagttacttt

SEQ ID NO: 402498 - DNA, 25 bp, Homo sapien
tgaggtacatctgagttgttctaga

SEQ ID NO: 402499 - DNA, 25 bp, Homo sapien
acatctgagttgttctagatgctag

SEQ ID NO: 402500 - DNA, 25 bp, Homo sapien
gtataacaggaaaaagcccctgctc

SEQ ID NO: 402501 - DNA, 25 bp, Homo sapien
aaaagcccctgctctcatggtgaga

SEQ ID NO: 402502 - DNA, 25 bp, Homo sapien
ccctgctctcatggtgagacagata

SEQ ID NO: 402503 - DNA, 25 bp, Homo sapien
agctgaggtttgatagaatggtcat

SEQ ID NO: 402504 - DNA, 25 bp, Homo sapien
gaatggtcatggaagatcccattaa

SEQ ID NO: 402505 - DNA, 25 bp, Homo sapien
gatcccattaatgagatgtacttta

SEQ ID NO: 402506 - DNA, 25 bp, Homo sapien
tgtactttaagtagagacctaaatg

SEQ ID NO: 402507 - DNA, 25 bp, Homo sapien
gataattttttctctagtactgaac

SEQ ID NO: 402508 - DNA, 25 bp, Homo sapien
ctagcactgtacaagtggattgcat

SEQ ID NO: 402509 - DNA, 25 bp, Homo sapien
aatggccccgcagcgccaaggagat

SEQ ID NO: 402510 - DNA, 25 bp, Homo sapien
gcagcgccaaggagatcttcgcagt

SEQ ID NO: 402511 - DNA, 25 bp, Homo sapien
agcgccaaggagatcttcgcagtcc

SEQ ID NO: 402512 - DNA, 25 bp, Homo sapien
caaggagatcttcgcagtcctgcag

SEQ ID NO: 402513 - DNA, 25 bp, Homo sapien
ggagatcttcgcagtcctgcaggtg

SEQ ID NO: 402514 - DNA, 25 bp, Homo sapien
atcttcgcagtcctgcaggtgccag

SEQ ID NO: 402515 - DNA, 25 bp, Homo sapien
ctgacttcaagggtaagactaattt

SEQ ID NO: 402516 - DNA, 25 bp, Homo sapien
gactaatttctttcaacgacagaca

SEQ ID NO: 402517 - DNA, 25 bp, Homo sapien
atttctttcaacgacagacacttta

SEQ ID NO: 402518 - DNA, 25 bp, Homo sapien
tctttcaacgacagacactttaaaa

SEQ ID NO: 402519 - DNA, 25 bp, Homo sapien
catccggcctgggtggtggaagacg

SEQ ID NO: 402520 - DNA, 25 bp, Homo sapien
gaccgaaccattaggacgtgccaca

SEQ ID NO: 402521 - DNA, 25 bp, Homo sapien
acgtgccacagtaacagctacgctg

SEQ ID NO: 402522 - DNA, 25 bp, Homo sapien
agctacgctgctcagaaggcccgaa

SEQ ID NO: 402523 - DNA, 25 bp, Homo sapien
tcccctattggttgcattgccgaga

SEQ ID NO: 402524 - DNA, 25 bp, Homo sapien
agaaggcccgaagggtcttcctcag

SEQ ID NO: 402525 - DNA, 25 bp, Homo sapien
gacttacagagccagtgtgcggatc

SEQ ID NO: 402526 - DNA, 25 bp, Homo sapien
tcagagttccttaggagcggctgct

SEQ ID NO: 402527 - DNA, 25 bp, Homo sapien
agcagcttggctatcctgagttgaa

SEQ ID NO: 402528 - DNA, 25 bp, Homo sapien
gttgaactagctgttggtcatccta

SEQ ID NO: 402529 - DNA, 25 bp, Homo sapien
ttggtcatcctaagggcaggcggtc

SEQ ID NO: 402530 - DNA, 25 bp, Homo sapien
gtctcctgaagttggaccgaaccat

SEQ ID NO: 402531 - DNA, 25 bp, Homo sapien
ctcagcctctgcaactgcaagaaag

SEQ ID NO: 402532 - DNA, 25 bp, Homo sapien
ggacccaggaaaccaaagtctgccg

SEQ ID NO: 402533 - DNA, 25 bp, Homo sapien
ctctggaatcttccccaagggccaa

SEQ ID NO: 402534 - DNA, 25 bp, Homo sapien
agggtagatttctcttgggcaggca

SEQ ID NO: 402535 - DNA, 25 bp, Homo sapien
ggtagatttctcttgggcaggcaga

SEQ ID NO: 402536 - DNA, 25 bp, Homo sapien
cttgggcaggcagagagtacagact

SEQ ID NO: 402537 - DNA, 25 bp, Homo sapien
gagtacagactgcagacattctcaa

SEQ ID NO: 402538 - DNA, 25 bp, Homo sapien
cagactgcagacattctcaaagcct

SEQ ID NO: 402539 - DNA, 25 bp, Homo sapien
aagcctcttatttttctagcgaacg

SEQ ID NO: 402540 - DNA, 25 bp, Homo sapien
tctagcgaacgtatttctccagacc

SEQ ID NO: 402541 - DNA, 25 bp, Homo sapien
gcgaacgtatttctccagacccaga

SEQ ID NO: 402542 - DNA, 25 bp, Homo sapien
atgaccaaattttattatgaccaat

SEQ ID NO: 402543 - DNA, 25 bp, Homo sapien
atgaccaataatgatctttccatat

SEQ ID NO: 402544 - DNA, 25 bp, Homo sapien
aatgatctttccatatttgtgttaa

SEQ ID NO: 402545 - DNA, 25 bp, Homo sapien
aaatattcctgtttgtagcttatac

SEQ ID NO: 402546 - DNA, 25 bp, Homo sapien
tcctgtttgtagcttatacatatat

SEQ ID NO: 402547 - DNA, 25 bp, Homo sapien
tttttctaacctataatgcttttag

SEQ ID NO: 402548 - DNA, 25 bp, Homo sapien
ctataatgcttttagaagttatcct

SEQ ID NO: 402549 - DNA, 25 bp, Homo sapien
agaagttatcctaaaatccaattgg

SEQ ID NO: 402550 - DNA, 25 bp, Homo sapien
taatcctagcaattgggaaggtgag

SEQ ID NO: 402551 - DNA, 25 bp, Homo sapien
cacttgacggcaggagttcggcgca

SEQ ID NO: 402552 - DNA, 25 bp, Homo sapien
acggcaggagttcggcgcagctggg

SEQ ID NO: 402553 - DNA, 25 bp, Homo sapien
aataaaactgtgatctcgtctagag

SEQ ID NO: 402554 - DNA, 25 bp, Homo sapien
aactgtgatctcgtctagagaaaat

SEQ ID NO: 402555 - DNA, 25 bp, Homo sapien
tattacaaactgctcttccatattt

SEQ ID NO: 402556 - DNA, 25 bp, Homo sapien
tacaaactgctcttccatatttatg

SEQ ID NO: 402557 - DNA, 25 bp, Homo sapien
ttatgtaccatattataccttttta

SEQ ID NO: 402558 - DNA, 25 bp, Homo sapien
gatgttgaaacctgtttggcacctt

SEQ ID NO: 402559 - DNA, 25 bp, Homo sapien
aaacctgtttggcaccttctggaag

SEQ ID NO: 402560 - DNA, 25 bp, Homo sapien
gtttggcaccttctggaagctacca

SEQ ID NO: 402561 - DNA, 25 bp, Homo sapien
ggcaccttctggaagctaccaaaaa

SEQ ID NO: 402562 - DNA, 25 bp, Homo sapien
aaatgacactccattgaagtgctta

SEQ ID NO: 402563 - DNA, 25 bp, Homo sapien
gacactccattgaagtgcttaaaag

SEQ ID NO: 402564 - DNA, 25 bp, Homo sapien
ttttgggtgcctgagggagctatca

SEQ ID NO: 402565 - DNA, 25 bp, Homo sapien
tcagggttttgttggtaatttacat

SEQ ID NO: 402566 - DNA, 25 bp, Homo sapien
aacgttgtcgtatttactaatgagg

SEQ ID NO: 402567 - DNA, 25 bp, Homo sapien
tgaggatgtgtttctgacattccac

SEQ ID NO: 402568 - DNA, 25 bp, Homo sapien
gacattccacagtattcctcagtga

SEQ ID NO: 402569 - DNA, 25 bp, Homo sapien
tattcctcagtgagcagttctgtga

SEQ ID NO: 402570 - DNA, 25 bp, Homo sapien
agttctgtgaggcatttccatctta

SEQ ID NO: 402571 - DNA, 25 bp, Homo sapien
gtgaggcatttccatcttatctctg

SEQ ID NO: 402572 - DNA, 25 bp, Homo sapien
gacattggttgtcatatcttatgta

SEQ ID NO: 402573 - DNA, 25 bp, Homo sapien
gaatctttcaggctaggaatttgga

SEQ ID NO: 402574 - DNA, 25 bp, Homo sapien
atttcagaagggttttgggtgcctg

SEQ ID NO: 402575 - DNA, 25 bp, Homo sapien
ttcaccggcgactactgcgagacgg

SEQ ID NO: 402576 - DNA, 25 bp, Homo sapien
accggcgactactgcgagacggaga

SEQ ID NO: 402577 - DNA, 25 bp, Homo sapien
gcgactactgcgagacggagatcga

SEQ ID NO: 402578 - DNA, 25 bp, Homo sapien
gactactgcgagacggagatcgacc

SEQ ID NO: 402579 - DNA, 25 bp, Homo sapien
tactgcgagacggagatcgacctct

SEQ ID NO: 402580 - DNA, 25 bp, Homo sapien
ctgcgagacggagatcgacctctgc

SEQ ID NO: 402581 - DNA, 25 bp, Homo sapien
ggcggctacacctgcgagtgcttcg

SEQ ID NO: 402582 - DNA, 25 bp, Homo sapien
gctacacctgcgagtgcttcgagga

SEQ ID NO: 402583 - DNA, 25 bp, Homo sapien
tacacctgcgagtgcttcgaggact

SEQ ID NO: 402584 - DNA, 25 bp, Homo sapien
acacctgcgagtgcttcgaggactt

SEQ ID NO: 402585 - DNA, 25 bp, Homo sapien
acctgcgagtgcttcgaggacttca

SEQ ID NO: 402586 - DNA, 25 bp, Homo sapien
gttccatagagttctgtggtcacaa

SEQ ID NO: 402587 - DNA, 25 bp, Homo sapien
tgtatggaagtatctcagtctctgc

SEQ ID NO: 402588 - DNA, 25 bp, Homo sapien
tctcagtctctgcataagaggatta

SEQ ID NO: 402589 - DNA, 25 bp, Homo sapien
gtcattaagtaatccaccatttctt

SEQ ID NO: 402590 - DNA, 25 bp, Homo sapien
gtaatccaccatttcttatggatga

SEQ ID NO: 402591 - DNA, 25 bp, Homo sapien
tatggatgatgcttaagcctggtga

SEQ ID NO: 402592 - DNA, 25 bp, Homo sapien
aagcctggtgaggtttgtactctaa

SEQ ID NO: 402593 - DNA, 25 bp, Homo sapien
ttgtactctaaggagcccagatcat

SEQ ID NO: 402594 - DNA, 25 bp, Homo sapien
ctaaggagcccagatcataatgcag

SEQ ID NO: 402595 - DNA, 25 bp, Homo sapien
ccttagcccttagagtttcttgcaa

SEQ ID NO: 402596 - DNA, 25 bp, Homo sapien
gcccttagagtttcttgcaaacatt

SEQ ID NO: 402597 - DNA, 25 bp, Homo sapien
gatggtggttttggacaattgtaca

SEQ ID NO: 402598 - DNA, 25 bp, Homo sapien
ggaacagaatctctaataacctata

SEQ ID NO: 402599 - DNA, 25 bp, Homo sapien
aactcagagttattgcctttcatac

SEQ ID NO: 402600 - DNA, 25 bp, Homo sapien
attgatgtatctttctttcatcttc

SEQ ID NO: 402601 - DNA, 25 bp, Homo sapien
cagaatttttgcatcttttcagaaa

SEQ ID NO: 402602 - DNA, 25 bp, Homo sapien
gttattgcctttcatactgctttcc

SEQ ID NO: 402603 - DNA, 25 bp, Homo sapien
aaattactatttttctgttgcactc

SEQ ID NO: 402604 - DNA, 25 bp, Homo sapien
actatttttctgttgcactcagcaa

SEQ ID NO: 402605 - DNA, 25 bp, Homo sapien
gcactcagcaattgtgactatactt

SEQ ID NO: 402606 - DNA, 25 bp, Homo sapien
atactgctttccctctgctgttggc

SEQ ID NO: 402607 - DNA, 25 bp, Homo sapien
acccttcttgactgcaaagccagaa

SEQ ID NO: 402608 - DNA, 25 bp, Homo sapien
tgacttctggctcatggtccatgag

SEQ ID NO: 402609 - DNA, 25 bp, Homo sapien
tcatggtccatgagcagaaagtgtc

SEQ ID NO: 402610 - DNA, 25 bp, Homo sapien
agaaagtgtcagtcattgtcatgct

SEQ ID NO: 402611 - DNA, 25 bp, Homo sapien
cattgtcatgctggtttctgaggct

SEQ ID NO: 402612 - DNA, 25 bp, Homo sapien
agcaaaaagtggcacgctacttccc

SEQ ID NO: 402613 - DNA, 25 bp, Homo sapien
tgagcctggcattgagcagcgtccg

SEQ ID NO: 402614 - DNA, 25 bp, Homo sapien
attgagcagcgtccgcagcaccgaa

SEQ ID NO: 402615 - DNA, 25 bp, Homo sapien
gaaacccatgtggagcgcgtgctga

SEQ ID NO: 402616 - DNA, 25 bp, Homo sapien
tgagcctgcagttccgagaccagag

SEQ ID NO: 402617 - DNA, 25 bp, Homo sapien
agttccgagaccagagcctcaagcg

SEQ ID NO: 402618 - DNA, 25 bp, Homo sapien
tcaagcgctctcttgtgcacctgca

SEQ ID NO: 402619 - DNA, 25 bp, Homo sapien
atttcacttaatgtctttcaagctc

SEQ ID NO: 402620 - DNA, 25 bp, Homo sapien
atgtctttcaagctcattcatgttg

SEQ ID NO: 402621 - DNA, 25 bp, Homo sapien
tctttcaagctcattcatgttgctg

SEQ ID NO: 402622 - DNA, 25 bp, Homo sapien
ttcatgttgctgtgaatgacaggtt

SEQ ID NO: 402623 - DNA, 25 bp, Homo sapien
aatgacaggtttatttttcatggct

SEQ ID NO: 402624 - DNA, 25 bp, Homo sapien
cttcattcatctgataatggacact

SEQ ID NO: 402625 - DNA, 25 bp, Homo sapien
gataatggacacttagactgatttc

SEQ ID NO: 402626 - DNA, 25 bp, Homo sapien
ggacacttagactgatttcttagct

SEQ ID NO: 402627 - DNA, 25 bp, Homo sapien
agactgatttcttagctattatgaa

SEQ ID NO: 402628 - DNA, 25 bp, Homo sapien
gtgcttcaataaacataggagtgta

SEQ ID NO: 402629 - DNA, 25 bp, Homo sapien
acataggagtgtagatctctctttg

SEQ ID NO: 402630 - DNA, 25 bp, Homo sapien
cagacctccagggtgcggaatcaaa

SEQ ID NO: 402631 - DNA, 25 bp, Homo sapien
gcggaatcaaataggaagcatgcag

SEQ ID NO: 402632 - DNA, 25 bp, Homo sapien
ggaagcatgcagagactcggcagct

SEQ ID NO: 402633 - DNA, 25 bp, Homo sapien
gcatgcagagactcggcagcttttc

SEQ ID NO: 402634 - DNA, 25 bp, Homo sapien
agactcggcagcttttcctctgatg

SEQ ID NO: 402635 - DNA, 25 bp, Homo sapien
tttcctctgatgtgtaagttatttg

SEQ ID NO: 402636 - DNA, 25 bp, Homo sapien
agttatttggaacgcgtgctgtgtc

SEQ ID NO: 402637 - DNA, 25 bp, Homo sapien
ttgtgtgaccctccccataaaggca

SEQ ID NO: 402638 - DNA, 25 bp, Homo sapien
tgaccctccccataaaggcacttta

SEQ ID NO: 402639 - DNA, 25 bp, Homo sapien
tttattgtatggatgacgtttgaat

SEQ ID NO: 402640 - DNA, 25 bp, Homo sapien
gtttgaataaatatcagcaactcct

SEQ ID NO: 402641 - DNA, 25 bp, Homo sapien
atgtggtaagggtcatgcagttcag

SEQ ID NO: 402642 - DNA, 25 bp, Homo sapien
agcaagtgtggctgatgaacatcac

SEQ ID NO: 402643 - DNA, 25 bp, Homo sapien
gaacatcacggagcagtgaccttca

SEQ ID NO: 402644 - DNA, 25 bp, Homo sapien
gtgaccttcatggacagacagaatt

SEQ ID NO: 402645 - DNA, 25 bp, Homo sapien
ttgagctggccctttaaccaatgag

SEQ ID NO: 402646 - DNA, 25 bp, Homo sapien
gagaggtgtttccagttcttctcaa

SEQ ID NO: 402647 - DNA, 25 bp, Homo sapien
gttcttctcaagtacttacccttgg

SEQ ID NO: 402648 - DNA, 25 bp, Homo sapien
gaaatccaagctaacagaagtccta

SEQ ID NO: 402649 - DNA, 25 bp, Homo sapien
ggagatgcgcaggacacgatcccag

SEQ ID NO: 402650 - DNA, 25 bp, Homo sapien
atcccagcaatccaggtgcttacag

SEQ ID NO: 402651 - DNA, 25 bp, Homo sapien
atgcacacagagtgccacgatgcaa

SEQ ID NO: 402652 - DNA, 25 bp, Homo sapien
cactgtctgagctcggaaggcacaa

SEQ ID NO: 402653 - DNA, 25 bp, Homo sapien
tctgagctcggaaggcacaatccac

SEQ ID NO: 402654 - DNA, 25 bp, Homo sapien
agctgccgggctctcttctgaagca

SEQ ID NO: 402655 - DNA, 25 bp, Homo sapien
gggctctcttctgaagcagacagga

SEQ ID NO: 402656 - DNA, 25 bp, Homo sapien
cttctgaagcagacaggatctcact

SEQ ID NO: 402657 - DNA, 25 bp, Homo sapien
gaggcagcgaccacgtctcctctat

SEQ ID NO: 402658 - DNA, 25 bp, Homo sapien
acgtctcctctatggaggcattcaa

SEQ ID NO: 402659 - DNA, 25 bp, Homo sapien
aggcattcaagagccgtccagctga

SEQ ID NO: 402660 - DNA, 25 bp, Homo sapien
attcaagagccgtccagctgaagca

SEQ ID NO: 402661 - DNA, 25 bp, Homo sapien
agctgaagcagcatcactgtctgag

SEQ ID NO: 402662 - DNA, 25 bp, Homo sapien
gcagcatcactgtctgagctcggaa

SEQ ID NO: 402663 - DNA, 25 bp, Homo sapien
tcgctatcctcacatttgcttgtaa

SEQ ID NO: 402664 - DNA, 25 bp, Homo sapien
aaatcgatactaacagtggacgtac

SEQ ID NO: 402665 - DNA, 25 bp, Homo sapien
gtggacgtacttctctttgaataag

SEQ ID NO: 402666 - DNA, 25 bp, Homo sapien
gaataagtttattctatttccttct

SEQ ID NO: 402667 - DNA, 25 bp, Homo sapien
tgttaaccattttccccgtctggca

SEQ ID NO: 402668 - DNA, 25 bp, Homo sapien
gtctggcacggttcttttgcacagc

SEQ ID NO: 402669 - DNA, 25 bp, Homo sapien
acggttcttttgcacagcactggat

SEQ ID NO: 402670 - DNA, 25 bp, Homo sapien
ttttgcacagcactggattaggcca

SEQ ID NO: 402671 - DNA, 25 bp, Homo sapien
gggactggcctaaccctgcaaatat

SEQ ID NO: 402672 - DNA, 25 bp, Homo sapien
atatcaggaaaggactcttctaggg

SEQ ID NO: 402673 - DNA, 25 bp, Homo sapien
gactcttctagggaaagtcgtacta

SEQ ID NO: 402674 - DNA, 25 bp, Homo sapien
ttttgaacaggtttgtgtgcctctg

SEQ ID NO: 402675 - DNA, 25 bp, Homo sapien
gtgtgcctctgattcaaagtacaat

SEQ ID NO: 402676 - DNA, 25 bp, Homo sapien
attgattctaatgcctcacctcagg

SEQ ID NO: 402677 - DNA, 25 bp, Homo sapien
acctcagggcaattcgtgtcatgta

SEQ ID NO: 402678 - DNA, 25 bp, Homo sapien
agggcaattcgtgtcatgtagctac

SEQ ID NO: 402679 - DNA, 25 bp, Homo sapien
atgtagctacatctccaggtttaaa

SEQ ID NO: 402680 - DNA, 25 bp, Homo sapien
ggtttaaatcctatgactcctgtac

SEQ ID NO: 402681 - DNA, 25 bp, Homo sapien
actcctgtacacaaaggtgcttcct

SEQ ID NO: 402682 - DNA, 25 bp, Homo sapien
gggaactccccgaatgaacctgagt

SEQ ID NO: 402683 - DNA, 25 bp, Homo sapien
gaacctgagttcgaatttaggtgga

SEQ ID NO: 402684 - DNA, 25 bp, Homo sapien
cacaatcccatccattcaacttttg

SEQ ID NO: 402685 - DNA, 25 bp, Homo sapien
tgcctttttggcagtatcctttctg

SEQ ID NO: 402686 - DNA, 25 bp, Homo sapien
agtatcctttctggcttcatcatgc

SEQ ID NO: 402687 - DNA, 25 bp, Homo sapien
ttcatcatgctatatccccattgtc

SEQ ID NO: 402688 - DNA, 25 bp, Homo sapien
atatccccattgtccacaacattga

SEQ ID NO: 402689 - DNA, 25 bp, Homo sapien
ttgtccacaacattgactggtgctt

SEQ ID NO: 402690 - DNA, 25 bp, Homo sapien
gactggtgcttagtaaggtgctcaa

SEQ ID NO: 402691 - DNA, 25 bp, Homo sapien
tagtaaggtgctcaaggacgcatca

SEQ ID NO: 402692 - DNA, 25 bp, Homo sapien
actagagacagagttgcctggcctt

SEQ ID NO: 402693 - DNA, 25 bp, Homo sapien
gagttgcctggccttattctttaaa

SEQ ID NO: 402694 - DNA, 25 bp, Homo sapien
aaatacccacactataggactgcaa

SEQ ID NO: 402695 - DNA, 25 bp, Homo sapien
gtggtagcaaagaaggatcctgtat

SEQ ID NO: 402696 - DNA, 25 bp, Homo sapien
cattttgccatatttactttatttc

SEQ ID NO: 402697 - DNA, 25 bp, Homo sapien
gccatatttactttatttctctctt

SEQ ID NO: 402698 - DNA, 25 bp, Homo sapien
ttttttggttgatcaattgaaagta

SEQ ID NO: 402699 - DNA, 25 bp, Homo sapien
gtaagtttcaggctttgtaacactt

SEQ ID NO: 402700 - DNA, 25 bp, Homo sapien
agtttcaggctttgtaacacttcac

SEQ ID NO: 402701 - DNA, 25 bp, Homo sapien
tttcaggctttgtaacacttcaccc

SEQ ID NO: 402702 - DNA, 25 bp, Homo sapien
tcaggctttgtaacacttcaccctt

SEQ ID NO: 402703 - DNA, 25 bp, Homo sapien
caggctttgtaacacttcaccctta

SEQ ID NO: 402704 - DNA, 25 bp, Homo sapien
gctttgtaacacttcacccttaaat

SEQ ID NO: 402705 - DNA, 25 bp, Homo sapien
ttgtaacacttcacccttaaatatt

SEQ ID NO: 402706 - DNA, 25 bp, Homo sapien
taacacttcacccttaaatattaag

SEQ ID NO: 402707 - DNA, 25 bp, Homo sapien
tgagaacttaccctacctctcggac

SEQ ID NO: 402708 - DNA, 25 bp, Homo sapien
taccctacctctcggacaaagatgg

SEQ ID NO: 402709 - DNA, 25 bp, Homo sapien
tcggacaaagatggcagctccagcc

SEQ ID NO: 402710 - DNA, 25 bp, Homo sapien
cgtcgaaagccgagtgccccaatct

SEQ ID NO: 402711 - DNA, 25 bp, Homo sapien
gtgccccaatctctgttttgaagga

SEQ ID NO: 402712 - DNA, 25 bp, Homo sapien
aaagcttctacactctgacttagct

SEQ ID NO: 402713 - DNA, 25 bp, Homo sapien
actctgacttagctcctactctgct

SEQ ID NO: 402714 - DNA, 25 bp, Homo sapien
gctcctactctgctggagtgaaaat

SEQ ID NO: 402715 - DNA, 25 bp, Homo sapien
gagtgaaaatctacccacgacgctc

SEQ ID NO: 402716 - DNA, 25 bp, Homo sapien
ccacgacgctcacaaacttataatt

SEQ ID NO: 402717 - DNA, 25 bp, Homo sapien
aagggcttccacactgaccccaatg

SEQ ID NO: 402718 - DNA, 25 bp, Homo sapien
gccacccgtgggactgatgaattac

SEQ ID NO: 402719 - DNA, 25 bp, Homo sapien
atgaattacatagcccaagtagtcc

SEQ ID NO: 402720 - DNA, 25 bp, Homo sapien
gtcccagggccaggaaaagctgctt

SEQ ID NO: 402721 - DNA, 25 bp, Homo sapien
gcttataagactcacgggcacagaa

SEQ ID NO: 402722 - DNA, 25 bp, Homo sapien
tcattgttatgttgcagctcttgct

SEQ ID NO: 402723 - DNA, 25 bp, Homo sapien
agctcttgctgctcatacaactttt

SEQ ID NO: 402724 - DNA, 25 bp, Homo sapien
tacaacttttctggaacaacccaag

SEQ ID NO: 402725 - DNA, 25 bp, Homo sapien
agctttcgcccttcccagtggataa

SEQ ID NO: 402726 - DNA, 25 bp, Homo sapien
aaaaccttctcattgaacatcccag

SEQ ID NO: 402727 - DNA, 25 bp, Homo sapien
gcatgtctgtctatgctgtgcataa

SEQ ID NO: 402728 - DNA, 25 bp, Homo sapien
ataactcctgccctggtctcagtga

SEQ ID NO: 402729 - DNA, 25 bp, Homo sapien
aatcctggataaatgagccccacag

SEQ ID NO: 402730 - DNA, 25 bp, Homo sapien
cttgctgtggcctactggaagcctt

SEQ ID NO: 402731 - DNA, 25 bp, Homo sapien
gaagccttcctaactctatagctgg

SEQ ID NO: 402732 - DNA, 25 bp, Homo sapien
gctaaatccctatagcattccattt

SEQ ID NO: 402733 - DNA, 25 bp, Homo sapien
agcattccattttctgctcttgcct

SEQ ID NO: 402734 - DNA, 25 bp, Homo sapien
tgctcttgcctcttgaacttagaag

SEQ ID NO: 402735 - DNA, 25 bp, Homo sapien
aaggcttgcccatatatcctaacaa

SEQ ID NO: 402736 - DNA, 25 bp, Homo sapien
atatcctaacaatctgttctctgag

SEQ ID NO: 402737 - DNA, 25 bp, Homo sapien
ctgttctctgagctgttaggccaat

SEQ ID NO: 402738 - DNA, 25 bp, Homo sapien
tgttaggccaatccctggcaagaga

SEQ ID NO: 402739 - DNA, 25 bp, Homo sapien
gtagtcactgaatctatggctcaca

SEQ ID NO: 402740 - DNA, 25 bp, Homo sapien
ttcctccactttgctgacgaagatg

SEQ ID NO: 402741 - DNA, 25 bp, Homo sapien
ctttgctgacgaagatgcccaggcc

SEQ ID NO: 402742 - DNA, 25 bp, Homo sapien
ttctccacccggactgaatggatga

SEQ ID NO: 402743 - DNA, 25 bp, Homo sapien
aatggatgatgtcactttcatcact

SEQ ID NO: 402744 - DNA, 25 bp, Homo sapien
tcactttcatcactgttggcttcga

SEQ ID NO: 402745 - DNA, 25 bp, Homo sapien
tttcatcactgttggcttcgatggg

SEQ ID NO: 402746 - DNA, 25 bp, Homo sapien
gttgatgaggatgacgcgtcccatg

SEQ ID NO: 402747 - DNA, 25 bp, Homo sapien
tcccatgggcgatgaggctcggatt

SEQ ID NO: 402748 - DNA, 25 bp, Homo sapien
ttcagcagccgttgttgcttcctta

SEQ ID NO: 402749 - DNA, 25 bp, Homo sapien
ttgttgcttccttagcaggtatcgc

SEQ ID NO: 402750 - DNA, 25 bp, Homo sapien
tccttagcaggtatcgcgttgcggt

SEQ ID NO: 402751 - DNA, 25 bp, Homo sapien
acacacagctgtgagggtagcagga

SEQ ID NO: 402752 - DNA, 25 bp, Homo sapien
tcaggaccaagggtgggtccaccct

SEQ ID NO: 402753 - DNA, 25 bp, Homo sapien
gtgggtccaccctgcttggaaagaa

SEQ ID NO: 402754 - DNA, 25 bp, Homo sapien
ggtccaccctgcttggaaagaagct

SEQ ID NO: 402755 - DNA, 25 bp, Homo sapien
accctgcttggaaagaagctgtcct

SEQ ID NO: 402756 - DNA, 25 bp, Homo sapien
gcttggaaagaagctgtcctggctt

SEQ ID NO: 402757 - DNA, 25 bp, Homo sapien
tggaaagaagctgtcctggcttttg

SEQ ID NO: 402758 - DNA, 25 bp, Homo sapien
aaagaagctgtcctggcttttggag

SEQ ID NO: 402759 - DNA, 25 bp, Homo sapien
gggagtagggagcagccgagccaca

SEQ ID NO: 402760 - DNA, 25 bp, Homo sapien
tagggagcagccgagccacaggctg

SEQ ID NO: 402761 - DNA, 25 bp, Homo sapien
gttggtgttgaagggagagcccagc

SEQ ID NO: 402762 - DNA, 25 bp, Homo sapien
tctcggccacagagcgcccagattt

SEQ ID NO: 402763 - DNA, 25 bp, Homo sapien
agagcgcccagatttcggctggcaa

SEQ ID NO: 402764 - DNA, 25 bp, Homo sapien
agcgcccagatttcggctggcaaca

SEQ ID NO: 402765 - DNA, 25 bp, Homo sapien
gatttcggctggcaacacctcagaa

SEQ ID NO: 402766 - DNA, 25 bp, Homo sapien
ttcggctggcaacacctcagaaaga

SEQ ID NO: 402767 - DNA, 25 bp, Homo sapien
ggctggcaacacctcagaaagatag

SEQ ID NO: 402768 - DNA, 25 bp, Homo sapien
tcagaaagatagaccttcctccgag

SEQ ID NO: 402769 - DNA, 25 bp, Homo sapien
gaaagatagaccttcctccgagggc

SEQ ID NO: 402770 - DNA, 25 bp, Homo sapien
aagatagaccttcctccgagggccg

SEQ ID NO: 402771 - DNA, 25 bp, Homo sapien
atagaccttcctccgagggccgtct

SEQ ID NO: 402772 - DNA, 25 bp, Homo sapien
cagtgagcggaggtgtaaataaaca

SEQ ID NO: 402773 - DNA, 25 bp, Homo sapien
tcataacccatttgaaaccaaacct

SEQ ID NO: 402774 - DNA, 25 bp, Homo sapien
gaacttacactgataggaagctatg

SEQ ID NO: 402775 - DNA, 25 bp, Homo sapien
agctatgggtaattatgatgtgttc

SEQ ID NO: 402776 - DNA, 25 bp, Homo sapien
gatgtgttccttttagtgtgattct

SEQ ID NO: 402777 - DNA, 25 bp, Homo sapien
gtgattctttgttgcagaaatgtca

SEQ ID NO: 402778 - DNA, 25 bp, Homo sapien
tttatgacatggttccctactaggg

SEQ ID NO: 402779 - DNA, 25 bp, Homo sapien
ttccctactagggattatacagtat

SEQ ID NO: 402780 - DNA, 25 bp, Homo sapien
gtatttgctgactacttcctaagag

SEQ ID NO: 402781 - DNA, 25 bp, Homo sapien
gctgactacttcctaagagccaaaa

SEQ ID NO: 402782 - DNA, 25 bp, Homo sapien
gttgggataagaaatgtggacctac

SEQ ID NO: 402783 - DNA, 25 bp, Homo sapien
aaatgtggacctacaggctgggtgc

SEQ ID NO: 402784 - DNA, 25 bp, Homo sapien
ggattgctggatcatgtggcacctc

SEQ ID NO: 402785 - DNA, 25 bp, Homo sapien
tgctggatcatgtggcacctctatt

SEQ ID NO: 402786 - DNA, 25 bp, Homo sapien
atcatgtggcacctctattttcagt

SEQ ID NO: 402787 - DNA, 25 bp, Homo sapien
tgtggcacctctattttcagtgttt

SEQ ID NO: 402788 - DNA, 25 bp, Homo sapien
ttttcagtgtttagaggaacctcca

SEQ ID NO: 402789 - DNA, 25 bp, Homo sapien
ttgaaagagtaaccacttacttaat

SEQ ID NO: 402790 - DNA, 25 bp, Homo sapien
taaaagcgcaatattccttcctttg

SEQ ID NO: 402791 - DNA, 25 bp, Homo sapien
aagcgcaatattccttcctttgcat

SEQ ID NO: 402792 - DNA, 25 bp, Homo sapien
aatattccttcctttgcatggcatg

SEQ ID NO: 402793 - DNA, 25 bp, Homo sapien
attccttcctttgcatggcatgcag

SEQ ID NO: 402794 - DNA, 25 bp, Homo sapien
tggcatgcaggaatggtgaaagcaa

SEQ ID NO: 402795 - DNA, 25 bp, Homo sapien
actctccctcaagcctgtgctcagg

SEQ ID NO: 402796 - DNA, 25 bp, Homo sapien
ctcaggttgccttgaatgtggactc

SEQ ID NO: 402797 - DNA, 25 bp, Homo sapien
ggttgccttgaatgtggactctgga

SEQ ID NO: 402798 - DNA, 25 bp, Homo sapien
ccttgaatgtggactctggaagagc

SEQ ID NO: 402799 - DNA, 25 bp, Homo sapien
ttgaatgtggactctggaagagcca

SEQ ID NO: 402800 - DNA, 25 bp, Homo sapien
gtggcactcatggaacaccgtccct

SEQ ID NO: 402801 - DNA, 25 bp, Homo sapien
cctgcctccagtgtcagggaatgga

SEQ ID NO: 402802 - DNA, 25 bp, Homo sapien
agggaatggaggctgggctgcgaga

SEQ ID NO: 402803 - DNA, 25 bp, Homo sapien
ggctgggctgcgagagtgttgctgc

SEQ ID NO: 402804 - DNA, 25 bp, Homo sapien
tgcgagagtgttgctgccccctgtg

SEQ ID NO: 402805 - DNA, 25 bp, Homo sapien
tctaatccaatgtagaaattgtacg

SEQ ID NO: 402806 - DNA, 25 bp, Homo sapien
aaggcacatagcaggatcactccct

SEQ ID NO: 402807 - DNA, 25 bp, Homo sapien
tagcttctctgagcacacctagttg

SEQ ID NO: 402808 - DNA, 25 bp, Homo sapien
cacctagttggtttcatgtatgtta

SEQ ID NO: 402809 - DNA, 25 bp, Homo sapien
atgtatgttacacatgcttccactc

SEQ ID NO: 402810 - DNA, 25 bp, Homo sapien
actccacagtacctaatttctctct

SEQ ID NO: 402811 - DNA, 25 bp, Homo sapien
ctgagatctgaaggctaccttggga

SEQ ID NO: 402812 - DNA, 25 bp, Homo sapien
gacaaggtgctcacaccatgagaat

SEQ ID NO: 402813 - DNA, 25 bp, Homo sapien
agaggcatcagccatcttgcttgag

SEQ ID NO: 402814 - DNA, 25 bp, Homo sapien
agccatcttgcttgagaaccaccaa

SEQ ID NO: 402815 - DNA, 25 bp, Homo sapien
gcttttatctatgatctcttgctgt

SEQ ID NO: 402816 - DNA, 25 bp, Homo sapien
gggaagatgcaccttgatctcaccc

SEQ ID NO: 402817 - DNA, 25 bp, Homo sapien
agccacgggcctgattccagaggag

SEQ ID NO: 402818 - DNA, 25 bp, Homo sapien
ggcctgattccagaggagccgaact

SEQ ID NO: 402819 - DNA, 25 bp, Homo sapien
gagccgaactgacaggacacagcag

SEQ ID NO: 402820 - DNA, 25 bp, Homo sapien
gctggagttggtgttagattgcttc

SEQ ID NO: 402821 - DNA, 25 bp, Homo sapien
gtgttagattgcttcacattctgtt

SEQ ID NO: 402822 - DNA, 25 bp, Homo sapien
attctgttgtcaccaccaagaactc

SEQ ID NO: 402823 - DNA, 25 bp, Homo sapien
gtcaccaccaagaactccaagtttt

SEQ ID NO: 402824 - DNA, 25 bp, Homo sapien
cattgttctttgtggtctgactcta

SEQ ID NO: 402825 - DNA, 25 bp, Homo sapien
ggtctgactctatgatcgatcacag

SEQ ID NO: 402826 - DNA, 25 bp, Homo sapien
tcgatcacagtgacttagattcagg

SEQ ID NO: 402827 - DNA, 25 bp, Homo sapien
taacgtcacaagttctaagtagttt

SEQ ID NO: 402828 - DNA, 25 bp, Homo sapien
aagtagtttgaagcttgaataacat

SEQ ID NO: 402829 - DNA, 25 bp, Homo sapien
atttcccacgtgaagaacgcctgta

SEQ ID NO: 402830 - DNA, 25 bp, Homo sapien
tcccacgtgaagaacgcctgtaaac

SEQ ID NO: 402831 - DNA, 25 bp, Homo sapien
actccgggagtaaggtcagtcgctg

SEQ ID NO: 402832 - DNA, 25 bp, Homo sapien
aaggtcagtcgctgaaggtcttttt

SEQ ID NO: 402833 - DNA, 25 bp, Homo sapien
gaaggtctttttgtactgattagca

SEQ ID NO: 402834 - DNA, 25 bp, Homo sapien
tgtactgattagcaatcacattttg

SEQ ID NO: 402835 - DNA, 25 bp, Homo sapien
ctgcagtgtctaaaattactctgtg

SEQ ID NO: 402836 - DNA, 25 bp, Homo sapien
agtgtctaaaattactctgtggcca

SEQ ID NO: 402837 - DNA, 25 bp, Homo sapien
cccctgctttatcgctttctatagt

SEQ ID NO: 402838 - DNA, 25 bp, Homo sapien
ctgctttatcgctttctatagtttt

SEQ ID NO: 402839 - DNA, 25 bp, Homo sapien
gaaacaaagacatcacgcgttgcaa

SEQ ID NO: 402840 - DNA, 25 bp, Homo sapien
aacaaagacatcacgcgttgcaagt

SEQ ID NO: 402841 - DNA, 25 bp, Homo sapien
aagacatcacgcgttgcaagtggct

SEQ ID NO: 402842 - DNA, 25 bp, Homo sapien
acatcacgcgttgcaagtggctgga

SEQ ID NO: 402843 - DNA, 25 bp, Homo sapien
tcacgcgttgcaagtggctggactt

SEQ ID NO: 402844 - DNA, 25 bp, Homo sapien
acgcgttgcaagtggctggactttt

SEQ ID NO: 402845 - DNA, 25 bp, Homo sapien
gttgcaagtggctggacttttaaaa

SEQ ID NO: 402846 - DNA, 25 bp, Homo sapien
cccctcatcctatttaagacctgat

SEQ ID NO: 402847 - DNA, 25 bp, Homo sapien
atttaagacctgatgcagtctcccc

SEQ ID NO: 402848 - DNA, 25 bp, Homo sapien
aagacctgatgcagtctccccactg

SEQ ID NO: 402849 - DNA, 25 bp, Homo sapien
tccccactggttctcccagggaaag

SEQ ID NO: 402850 - DNA, 25 bp, Homo sapien
gcttctcgattataggttgcacacc

SEQ ID NO: 402851 - DNA, 25 bp, Homo sapien
ataggttgcacaccaccatgagcca

SEQ ID NO: 402852 - DNA, 25 bp, Homo sapien
acaaggtgtcgcttgtcatcctggc

SEQ ID NO: 402853 - DNA, 25 bp, Homo sapien
cgcccagcctgatgttttatttata

SEQ ID NO: 402854 - DNA, 25 bp, Homo sapien
ttatttatagggtgcactcttcatt

SEQ ID NO: 402855 - DNA, 25 bp, Homo sapien
gatagacctttgtaggtagtttcac

SEQ ID NO: 402856 - DNA, 25 bp, Homo sapien
gtaggtagtttcacccctgtctttg

SEQ ID NO: 402857 - DNA, 25 bp, Homo sapien
actgtttgccccatatcattctaaa

SEQ ID NO: 402858 - DNA, 25 bp, Homo sapien
gtttgccccatatcattctaaattt

SEQ ID NO: 402859 - DNA, 25 bp, Homo sapien
aagcgatcctcatgcttctcgatta

SEQ ID NO: 402860 - DNA, 25 bp, Homo sapien
gatcctcatgcttctcgattatagg

SEQ ID NO: 402861 - DNA, 25 bp, Homo sapien
tgtgtcccgcgatgtccctgatgta

SEQ ID NO: 402862 - DNA, 25 bp, Homo sapien
gcgatgtccctgatgtactgtgcag

SEQ ID NO: 402863 - DNA, 25 bp, Homo sapien
atgtccctgatgtactgtgcaggcg

SEQ ID NO: 402864 - DNA, 25 bp, Homo sapien
ccctgatgtactgtgcaggcgcggt

SEQ ID NO: 402865 - DNA, 25 bp, Homo sapien
ataaaggcactttacagcttcatgt

SEQ ID NO: 402866 - DNA, 25 bp, Homo sapien
aaggcactttacagcttcatgtttc

SEQ ID NO: 402867 - DNA, 25 bp, Homo sapien
ggcactttacagcttcatgtttcat

SEQ ID NO: 402868 - DNA, 25 bp, Homo sapien
ctttacagcttcatgtttcatccac

SEQ ID NO: 402869 - DNA, 25 bp, Homo sapien
ttacagcttcatgtttcatccactg

SEQ ID NO: 402870 - DNA, 25 bp, Homo sapien
agcttcatgtttcatccactgtcac

SEQ ID NO: 402871 - DNA, 25 bp, Homo sapien
tcatgtttcatccactgtcactttt

SEQ ID NO: 402872 - DNA, 25 bp, Homo sapien
actccgcagtggggcatcgtggacc

SEQ ID NO: 402873 - DNA, 25 bp, Homo sapien
gcatcgtggacctctcggggcacca

SEQ ID NO: 402874 - DNA, 25 bp, Homo sapien
gacctctcggggcaccagcacttgt

SEQ ID NO: 402875 - DNA, 25 bp, Homo sapien
ggaacctgaagcgaggagggcccgc

SEQ ID NO: 402876 - DNA, 25 bp, Homo sapien
aacctgaagcgaggagggcccgcgt

SEQ ID NO: 402877 - DNA, 25 bp, Homo sapien
ctgaagcgaggagggcccgcgtccg

SEQ ID NO: 402878 - DNA, 25 bp, Homo sapien
ccaagccaagaagcccgatccgccc

SEQ ID NO: 402879 - DNA, 25 bp, Homo sapien
caagaagcccgatccgcccctgccg

SEQ ID NO: 402880 - DNA, 25 bp, Homo sapien
ggcctgcgaccccaccaaggacgac

SEQ ID NO: 402881 - DNA, 25 bp, Homo sapien
tcctcccctctttgacgctgctttc

SEQ ID NO: 402882 - DNA, 25 bp, Homo sapien
gctgctttccccactccgcagtggg

SEQ ID NO: 402883 - DNA, 25 bp, Homo sapien
tttcttcccctcaagtcaacttttg

SEQ ID NO: 402884 - DNA, 25 bp, Homo sapien
ttcccctcaagtcaacttttgtgct

SEQ ID NO: 402885 - DNA, 25 bp, Homo sapien
cttttgtgctccagaaaattttcta

SEQ ID NO: 402886 - DNA, 25 bp, Homo sapien
aattttctattctgtaagtctgagc

SEQ ID NO: 402887 - DNA, 25 bp, Homo sapien
ttctattctgtaagtctgagcgtaa

SEQ ID NO: 402888 - DNA, 25 bp, Homo sapien
tattctgtaagtctgagcgtaaaac

SEQ ID NO: 402889 - DNA, 25 bp, Homo sapien
gtaagtctgagcgtaaaacttcaag

SEQ ID NO: 402890 - DNA, 25 bp, Homo sapien
gtctgagcgtaaaacttcaagtatt

SEQ ID NO: 402891 - DNA, 25 bp, Homo sapien
gggcagctgccaaattgatgtatta

SEQ ID NO: 402892 - DNA, 25 bp, Homo sapien
gcagctgccaaattgatgtattata

SEQ ID NO: 402893 - DNA, 25 bp, Homo sapien
tattatatattgtggtttctgtttc

SEQ ID NO: 402894 - DNA, 25 bp, Homo sapien
ttatgccttacccattccacaaaag

SEQ ID NO: 402895 - DNA, 25 bp, Homo sapien
gccttacccattccacaaaagaatt

SEQ ID NO: 402896 - DNA, 25 bp, Homo sapien
agtgctgatcaaatttttagataat

SEQ ID NO: 402897 - DNA, 25 bp, Homo sapien
ttaggatccaaacaaataccattac

SEQ ID NO: 402898 - DNA, 25 bp, Homo sapien
gagcagaatctaaatgtaacatttc

SEQ ID NO: 402899 - DNA, 25 bp, Homo sapien
agttgaggactatagagtactgtgc

SEQ ID NO: 402900 - DNA, 25 bp, Homo sapien
actatagagtactgtgctgtcacta

SEQ ID NO: 402901 - DNA, 25 bp, Homo sapien
agagtactgtgctgtcactaacagt

SEQ ID NO: 402902 - DNA, 25 bp, Homo sapien
gtcactaacagtattgtgtgctact

SEQ ID NO: 402903 - DNA, 25 bp, Homo sapien
aacagtattgtgtgctactaagagt

SEQ ID NO: 402904 - DNA, 25 bp, Homo sapien
gctactaagagtttaatggctgggt

SEQ ID NO: 402905 - DNA, 25 bp, Homo sapien
ttgttcaaggagaccagccaggccc

SEQ ID NO: 402906 - DNA, 25 bp, Homo sapien
caggccctccttttgggataagagc

SEQ ID NO: 402907 - DNA, 25 bp, Homo sapien
tttgcttctaacaatgactttgatt

SEQ ID NO: 402908 - DNA, 25 bp, Homo sapien
gagccaagagcttctgagtaccttt

SEQ ID NO: 402909 - DNA, 25 bp, Homo sapien
ttctgagtacctttcaccaagaaat

SEQ ID NO: 402910 - DNA, 25 bp, Homo sapien
ttcaccaagaaatgagaaccccatg

SEQ ID NO: 402911 - DNA, 25 bp, Homo sapien
ctgtccctgagcagagctacttatt

SEQ ID NO: 402912 - DNA, 25 bp, Homo sapien
acttatttcattcctgggcagaata

SEQ ID NO: 402913 - DNA, 25 bp, Homo sapien
tgggcagaatatgctcaagctttct

SEQ ID NO: 402914 - DNA, 25 bp, Homo sapien
cacatctctctcaagggcacttaat

SEQ ID NO: 402915 - DNA, 25 bp, Homo sapien
taataaactccctgtcccttgttca

SEQ ID NO: 402916 - DNA, 25 bp, Homo sapien
taaagacgcccactcttggcgttaa

SEQ ID NO: 402917 - DNA, 25 bp, Homo sapien
ttggcgttaattacagcccaacgta

SEQ ID NO: 402918 - DNA, 25 bp, Homo sapien
attacagcccaacgtacatttcttg

SEQ ID NO: 402919 - DNA, 25 bp, Homo sapien
gggagattttcctgtgacaagtgaa

SEQ ID NO: 402920 - DNA, 25 bp, Homo sapien
gtgacaagtgaataccctctacatt

SEQ ID NO: 402921 - DNA, 25 bp, Homo sapien
caagtgaataccctctacattttct

SEQ ID NO: 402922 - DNA, 25 bp, Homo sapien
ctacattttcttaactggatgggaa

SEQ ID NO: 402923 - DNA, 25 bp, Homo sapien
ttttaatggccccattacaatcttg

SEQ ID NO: 402924 - DNA, 25 bp, Homo sapien
aaaaaagtcaatgctcttgagctct

SEQ ID NO: 402925 - DNA, 25 bp, Homo sapien
atgctcttgagctctttacagtaaa

SEQ ID NO: 402926 - DNA, 25 bp, Homo sapien
taggttgtgtttactcataggatac

SEQ ID NO: 402927 - DNA, 25 bp, Homo sapien
gctatactcttaaagggttgttgat

SEQ ID NO: 402928 - DNA, 25 bp, Homo sapien
gatgaagcatagaaacaaagtccct

SEQ ID NO: 402929 - DNA, 25 bp, Homo sapien
cttgatccttgcataatagctatag

SEQ ID NO: 402930 - DNA, 25 bp, Homo sapien
caaagtcccttcacaacacattatt

SEQ ID NO: 402931 - DNA, 25 bp, Homo sapien
tagtttcctgaatttgcatgacaag

SEQ ID NO: 402932 - DNA, 25 bp, Homo sapien
gacaagaacacttctagtttgccta

SEQ ID NO: 402933 - DNA, 25 bp, Homo sapien
agtttgcctaattctgttgcctaat

SEQ ID NO: 402934 - DNA, 25 bp, Homo sapien
tctgttgcctaatacgtaattcttt

SEQ ID NO: 402935 - DNA, 25 bp, Homo sapien
atagtcattaacttggccaggtagt

SEQ ID NO: 402936 - DNA, 25 bp, Homo sapien
ggccaggtagtaagtctgtttcaaa

SEQ ID NO: 402937 - DNA, 25 bp, Homo sapien
gtctgtttcaaagcaggtgatgcta

SEQ ID NO: 402938 - DNA, 25 bp, Homo sapien
taaagctggttggtgtagtgctatt

SEQ ID NO: 402939 - DNA, 25 bp, Homo sapien
gtagtgctattaaaatttcgttcag

SEQ ID NO: 402940 - DNA, 25 bp, Homo sapien
ttccttttgaaaacttgttcgcacg

SEQ ID NO: 402941 - DNA, 25 bp, Homo sapien
tgaaaacttgttcgcacgttgttta

SEQ ID NO: 402942 - DNA, 25 bp, Homo sapien
tgttcgcacgttgtttagggtgccc

SEQ ID NO: 402943 - DNA, 25 bp, Homo sapien
tttagggtgcccttacttcagcaaa

SEQ ID NO: 402944 - DNA, 25 bp, Homo sapien
gtgcccttacttcagcaaaggagaa

SEQ ID NO: 402945 - DNA, 25 bp, Homo sapien
gtaggagagccttagaatttttgag

SEQ ID NO: 402946 - DNA, 25 bp, Homo sapien
aaacctataacatacaatgtactgt

SEQ ID NO: 402947 - DNA, 25 bp, Homo sapien
gtactgtatcaaactattttacatg

SEQ ID NO: 402948 - DNA, 25 bp, Homo sapien
tacatgaatgacacaagtattctga

SEQ ID NO: 402949 - DNA, 25 bp, Homo sapien
acaatctggaactcacatttacata

SEQ ID NO: 402950 - DNA, 25 bp, Homo sapien
ttcacttatccagttgggacctaga

SEQ ID NO: 402951 - DNA, 25 bp, Homo sapien
agttgggacctagatggcaaatcaa

SEQ ID NO: 402952 - DNA, 25 bp, Homo sapien
gaaaggtcataagtccatgagctac

SEQ ID NO: 402953 - DNA, 25 bp, Homo sapien
gtccatgagctacagtttatgaatt

SEQ ID NO: 402954 - DNA, 25 bp, Homo sapien
attttataccctctttcaggcctct

SEQ ID NO: 402955 - DNA, 25 bp, Homo sapien
aggcctctgcatttacttcaagttt

SEQ ID NO: 402956 - DNA, 25 bp, Homo sapien
aagaggcttggttattagtttgtca

SEQ ID NO: 402957 - DNA, 25 bp, Homo sapien
ttagtttgtcaaatgcacctagcaa

SEQ ID NO: 402958 - DNA, 25 bp, Homo sapien
gcaaattggaagcaactgatactgt

SEQ ID NO: 402959 - DNA, 25 bp, Homo sapien
aaagctcttttatcaagtatcagta

SEQ ID NO: 402960 - DNA, 25 bp, Homo sapien
tcccaagtgacttcatgtgctgtgc

SEQ ID NO: 402961 - DNA, 25 bp, Homo sapien
gtgctgtgctctttataactttcta

SEQ ID NO: 402962 - DNA, 25 bp, Homo sapien
taactttctatcaccattttcattt

SEQ ID NO: 402963 - DNA, 25 bp, Homo sapien
tttcactttcaaatgccctaaatag

SEQ ID NO: 402964 - DNA, 25 bp, Homo sapien
gtattctcccaaggatgtgagttct

SEQ ID NO: 402965 - DNA, 25 bp, Homo sapien
caagaatgatgatgtgccagtcact

SEQ ID NO: 402966 - DNA, 25 bp, Homo sapien
ataagtgtgattccattggattctc

SEQ ID NO: 402967 - DNA, 25 bp, Homo sapien
attggattctcatcacgattctgtg

SEQ ID NO: 402968 - DNA, 25 bp, Homo sapien
gaaataggtatcattatggtcccca

SEQ ID NO: 402969 - DNA, 25 bp, Homo sapien
gagttctgagttcacattatttagg

SEQ ID NO: 402970 - DNA, 25 bp, Homo sapien
aatctttacttcacatagtttctca

SEQ ID NO: 402971 - DNA, 25 bp, Homo sapien
tccagagtcctcacggctttctgca

SEQ ID NO: 402972 - DNA, 25 bp, Homo sapien
ctgcaggcccctgaattgatgatgc

SEQ ID NO: 402973 - DNA, 25 bp, Homo sapien
attgatgatgcagccaccgttgtca

SEQ ID NO: 402974 - DNA, 25 bp, Homo sapien
tgtcattctgacatttccccatgga

SEQ ID NO: 402975 - DNA, 25 bp, Homo sapien
atggatcctgtatgctgcacggcca

SEQ ID NO: 402976 - DNA, 25 bp, Homo sapien
aacacgattgtgcagtcggtggcca

SEQ ID NO: 402977 - DNA, 25 bp, Homo sapien
acgcaggcctgcacttcggaatgtc

SEQ ID NO: 402978 - DNA, 25 bp, Homo sapien
ggaatgtctccgtgctgttggctca

SEQ ID NO: 402979 - DNA, 25 bp, Homo sapien
gctgttggctcacttctacatggcg

SEQ ID NO: 402980 - DNA, 25 bp, Homo sapien
ctacatggcgcctcaaaccttaaaa

SEQ ID NO: 402981 - DNA, 25 bp, Homo sapien
gctccgactttgaggtatgcttcca

SEQ ID NO: 402982 - DNA, 25 bp, Homo sapien
ctgccaaatgtttgtgaccagacaa

SEQ ID NO: 402983 - DNA, 25 bp, Homo sapien
gtgaccagacaagcgattttactac

SEQ ID NO: 402984 - DNA, 25 bp, Homo sapien
agacaagcgattttactacaccacc

SEQ ID NO: 402985 - DNA, 25 bp, Homo sapien
tttactacaccaccctcgagtcaat

SEQ ID NO: 402986 - DNA, 25 bp, Homo sapien
cctcgagtcaatcatctagaaagta

SEQ ID NO: 402987 - DNA, 25 bp, Homo sapien
aaaatcatgttctatactgtcatac

SEQ ID NO: 402988 - DNA, 25 bp, Homo sapien
gggaagtgtgcttcaaagcctgctt

SEQ ID NO: 402989 - DNA, 25 bp, Homo sapien
gtgcttcaaagcctgcttactgatg

SEQ ID NO: 402990 - DNA, 25 bp, Homo sapien
gatggaaatcagcaatcaaagttct

SEQ ID NO: 402991 - DNA, 25 bp, Homo sapien
aatcaaagttctgttgtccgctgct

SEQ ID NO: 402992 - DNA, 25 bp, Homo sapien
aaagttctgttgtccgctgctgtag

SEQ ID NO: 402993 - DNA, 25 bp, Homo sapien
agacagaggctctgcacagtccctg

SEQ ID NO: 402994 - DNA, 25 bp, Homo sapien
cagaggctctgcacagtccctgtct

SEQ ID NO: 402995 - DNA, 25 bp, Homo sapien
tgcacagtccctgtctcagacattg

SEQ ID NO: 402996 - DNA, 25 bp, Homo sapien
acagtccctgtctcagacattgtct

SEQ ID NO: 402997 - DNA, 25 bp, Homo sapien
attgtctcctccttagaagatacct

SEQ ID NO: 402998 - DNA, 25 bp, Homo sapien
gtctcctccttagaagatacctaac

SEQ ID NO: 402999 - DNA, 25 bp, Homo sapien
gaagatacctaacaacagcactgtg

SEQ ID NO: 403000 - DNA, 25 bp, Homo sapien
agatacctaacaacagcactgtggg

SEQ ID NO: 403001 - DNA, 25 bp, Homo sapien
atacctaacaacagcactgtgggag

SEQ ID NO: 403002 - DNA, 25 bp, Homo sapien
caagaccatccttgatctttagtag

SEQ ID NO: 403003 - DNA, 25 bp, Homo sapien
gaccatccttgatctttagtagaga

SEQ ID NO: 403004 - DNA, 25 bp, Homo sapien
accagtggacactttggaaccttgg

SEQ ID NO: 403005 - DNA, 25 bp, Homo sapien
gaggaaactgcccatccagtaaacc

SEQ ID NO: 403006 - DNA, 25 bp, Homo sapien
aaagccatttgttctgcactacgta

SEQ ID NO: 403007 - DNA, 25 bp, Homo sapien
gttctgcactacgtatattgcttat

SEQ ID NO: 403008 - DNA, 25 bp, Homo sapien
atattgcttattctttctggtctta

SEQ ID NO: 403009 - DNA, 25 bp, Homo sapien
ctggtcttaagtacttgcctctcaa

SEQ ID NO: 403010 - DNA, 25 bp, Homo sapien
agaggcgggactatcaacattgtga

SEQ ID NO: 403011 - DNA, 25 bp, Homo sapien
tgaatttacttgaaacccagtgccc

SEQ ID NO: 403012 - DNA, 25 bp, Homo sapien
aacccagtgcccaaaatcaatgtag

SEQ ID NO: 403013 - DNA, 25 bp, Homo sapien
gtagccaagtccaaaaacctgttct

SEQ ID NO: 403014 - DNA, 25 bp, Homo sapien
aaacctgttctagtccaactagtga

SEQ ID NO: 403015 - DNA, 25 bp, Homo sapien
aagataatgcacatttgttatatgc

SEQ ID NO: 403016 - DNA, 25 bp, Homo sapien
taaaacctttgggatttatattgtg

SEQ ID NO: 403017 - DNA, 25 bp, Homo sapien
tatattgtggtagggcagctggact

SEQ ID NO: 403018 - DNA, 25 bp, Homo sapien
gtagggcagctggacttgtgcacaa

SEQ ID NO: 403019 - DNA, 25 bp, Homo sapien
ggcagctggacttgtgcacaaatac

SEQ ID NO: 403020 - DNA, 25 bp, Homo sapien
gtgcacaaatacctgtactataatc

SEQ ID NO: 403021 - DNA, 25 bp, Homo sapien
ctgtgagtcacaaatataccaaata

SEQ ID NO: 403022 - DNA, 25 bp, Homo sapien
aatgcatttgattaggagaaaacct

SEQ ID NO: 403023 - DNA, 25 bp, Homo sapien
ctgagacagaactttaaaggcataa

SEQ ID NO: 403024 - DNA, 25 bp, Homo sapien
gaattttagctagtctttgaaggga

SEQ ID NO: 403025 - DNA, 25 bp, Homo sapien
tggaatgagctttatttaacaagat

SEQ ID NO: 403026 - DNA, 25 bp, Homo sapien
tatcatgagggagcaccattttgtg

SEQ ID NO: 403027 - DNA, 25 bp, Homo sapien
ggattgtcttttttgcatgtttgtt

SEQ ID NO: 403028 - DNA, 25 bp, Homo sapien
gtttttgaaggcctatctcccattt

SEQ ID NO: 403029 - DNA, 25 bp, Homo sapien
tctcccattttgttaattcagttaa

SEQ ID NO: 403030 - DNA, 25 bp, Homo sapien
ggctctctaagcttccaaaacagga

SEQ ID NO: 403031 - DNA, 25 bp, Homo sapien
acaggaatctgctacattttactaa

SEQ ID NO: 403032 - DNA, 25 bp, Homo sapien
aagggccttactattgttcattcag

SEQ ID NO: 403033 - DNA, 25 bp, Homo sapien
gttcttttcggaggctaagcttcca

SEQ ID NO: 403034 - DNA, 25 bp, Homo sapien
ttccaaatgaggaatctgctgcatt

SEQ ID NO: 403035 - DNA, 25 bp, Homo sapien
gctgcattttactaaagtgccttgc

SEQ ID NO: 403036 - DNA, 25 bp, Homo sapien
aagtgccttgctaagtggtaactgt

SEQ ID NO: 403037 - DNA, 25 bp, Homo sapien
tctccagccagatcagccccagggt

SEQ ID NO: 403038 - DNA, 25 bp, Homo sapien
agggtcccgagcttccattcagtgt

SEQ ID NO: 403039 - DNA, 25 bp, Homo sapien
gagcttccattcagtgttccctcta

SEQ ID NO: 403040 - DNA, 25 bp, Homo sapien
ttcagtgttccctctagcccataag

SEQ ID NO: 403041 - DNA, 25 bp, Homo sapien
ataagcccgactcctgccattcatg

SEQ ID NO: 403042 - DNA, 25 bp, Homo sapien
gactcctgccattcatgcagtcagc

SEQ ID NO: 403043 - DNA, 25 bp, Homo sapien
ccagatccattaaggcccacctctt

SEQ ID NO: 403044 - DNA, 25 bp, Homo sapien
caaatcccgccccagatctatttaa

SEQ ID NO: 403045 - DNA, 25 bp, Homo sapien
taagagccactaagtcctgccccta

SEQ ID NO: 403046 - DNA, 25 bp, Homo sapien
agtcctgcccctaactcaaggacag

SEQ ID NO: 403047 - DNA, 25 bp, Homo sapien
attccagagctctctccagccagat

SEQ ID NO: 403048 - DNA, 25 bp, Homo sapien
tctcttaacaagactttttgtactg

SEQ ID NO: 403049 - DNA, 25 bp, Homo sapien
gtagcctaaaagacaattttccttg

SEQ ID NO: 403050 - DNA, 25 bp, Homo sapien
aagacaattttccttggaacacata

SEQ ID NO: 403051 - DNA, 25 bp, Homo sapien
tttccttggaacacataagaactgt

SEQ ID NO: 403052 - DNA, 25 bp, Homo sapien
gaactgtgcagtagccgtttgtggt

SEQ ID NO: 403053 - DNA, 25 bp, Homo sapien
gtgcagtagccgtttgtggtttaaa

SEQ ID NO: 403054 - DNA, 25 bp, Homo sapien
cagtagccgtttgtggtttaaagca

SEQ ID NO: 403055 - DNA, 25 bp, Homo sapien
aacatgcaagatgaacctgagggat

SEQ ID NO: 403056 - DNA, 25 bp, Homo sapien
gaacctgagggatgatagaatacaa

SEQ ID NO: 403057 - DNA, 25 bp, Homo sapien
ggctggttaccaccagcctttcttc

SEQ ID NO: 403058 - DNA, 25 bp, Homo sapien
tgtgtgtgtggttcaagtgtgcact

SEQ ID NO: 403059 - DNA, 25 bp, Homo sapien
gtatgcttgaattccttccgtatgg

SEQ ID NO: 403060 - DNA, 25 bp, Homo sapien
aaggtagggtgcaggtgactcaaca

SEQ ID NO: 403061 - DNA, 25 bp, Homo sapien
ggtgactcaacagctgtacatgatt

SEQ ID NO: 403062 - DNA, 25 bp, Homo sapien
gatttcagcaccttggacaggagca

SEQ ID NO: 403063 - DNA, 25 bp, Homo sapien
attccttccgtatggctgtgagcaa

SEQ ID NO: 403064 - DNA, 25 bp, Homo sapien
ggttggactctcttctggagaccca

SEQ ID NO: 403065 - DNA, 25 bp, Homo sapien
ctggagacccagacaattcagtctc

SEQ ID NO: 403066 - DNA, 25 bp, Homo sapien
ctccagatttctggcagtggctgtc

SEQ ID NO: 403067 - DNA, 25 bp, Homo sapien
cagtggctgtcttttgagggcccca

SEQ ID NO: 403068 - DNA, 25 bp, Homo sapien
caacttgggttggagacatatctaa

SEQ ID NO: 403069 - DNA, 25 bp, Homo sapien
ttttacttccactccctatatatag

SEQ ID NO: 403070 - DNA, 25 bp, Homo sapien
gaagcttctcacaagtgatgcactt

SEQ ID NO: 403071 - DNA, 25 bp, Homo sapien
aatctgcatgccattgagacacctg

SEQ ID NO: 403072 - DNA, 25 bp, Homo sapien
ctgcatgtctggtgtttgtggttca

SEQ ID NO: 403073 - DNA, 25 bp, Homo sapien
tttgtggttcaagtgtcttgccgcc

SEQ ID NO: 403074 - DNA, 25 bp, Homo sapien
ggccttcggatgtaaacccactgat

SEQ ID NO: 403075 - DNA, 25 bp, Homo sapien
gtaaacccactgataacggacagaa

SEQ ID NO: 403076 - DNA, 25 bp, Homo sapien
atgcccacaagtgggtcttctgtgg

SEQ ID NO: 403077 - DNA, 25 bp, Homo sapien
gaagttagtgcttacattttagtct

SEQ ID NO: 403078 - DNA, 25 bp, Homo sapien
aggttaagtttcagtgccagctaga

SEQ ID NO: 403079 - DNA, 25 bp, Homo sapien
gtgccagctagaaaatactgctttc

SEQ ID NO: 403080 - DNA, 25 bp, Homo sapien
aatactgctttctgccatcgattgg

SEQ ID NO: 403081 - DNA, 25 bp, Homo sapien
tcccccctctgaattttactgatga

SEQ ID NO: 403082 - DNA, 25 bp, Homo sapien
gaggccacagagctaaagtgacttt

SEQ ID NO: 403083 - DNA, 25 bp, Homo sapien
gagctaaagtgacttttcccaaggt

SEQ ID NO: 403084 - DNA, 25 bp, Homo sapien
ttttcccaaggtcgcccagcgagga

SEQ ID NO: 403085 - DNA, 25 bp, Homo sapien
ccagcgaggacgtgggacttctcag

SEQ ID NO: 403086 - DNA, 25 bp, Homo sapien
acgtgggacttctcagacgtcagga

SEQ ID NO: 403087 - DNA, 25 bp, Homo sapien
tgagggagctgtgtgaccatagaaa

SEQ ID NO: 403088 - DNA, 25 bp, Homo sapien
gtgtgaccatagaaagtgacgtgtt

SEQ ID NO: 403089 - DNA, 25 bp, Homo sapien
acgtgttaaaaaccagcgctgccct

SEQ ID NO: 403090 - DNA, 25 bp, Homo sapien
tgaaagccagggagcatcattcatt

SEQ ID NO: 403091 - DNA, 25 bp, Homo sapien
cagcagtgaggagacagccagaagc

SEQ ID NO: 403092 - DNA, 25 bp, Homo sapien
cttccagctctcctcttaaatagtg

SEQ ID NO: 403093 - DNA, 25 bp, Homo sapien
agctctcctcttaaatagtgggtat

SEQ ID NO: 403094 - DNA, 25 bp, Homo sapien
tagtgggtatagtctgcacaacagg

SEQ ID NO: 403095 - DNA, 25 bp, Homo sapien
gcacaacaggaaccatggcaggaat

SEQ ID NO: 403096 - DNA, 25 bp, Homo sapien
gaaccatggcaggaatatacacttt

SEQ ID NO: 403097 - DNA, 25 bp, Homo sapien
ggcaggaatatacactttcccatag

SEQ ID NO: 403098 - DNA, 25 bp, Homo sapien
cactttcccatagcaaatagcatac

SEQ ID NO: 403099 - DNA, 25 bp, Homo sapien
gcaaatagcatacctgactctctgt

SEQ ID NO: 403100 - DNA, 25 bp, Homo sapien
catacctgactctctgtgctaatat

SEQ ID NO: 403101 - DNA, 25 bp, Homo sapien
acctgactctctgtgctaatattgc

SEQ ID NO: 403102 - DNA, 25 bp, Homo sapien
gctaatattgcacatttgttaaaca

SEQ ID NO: 403103 - DNA, 25 bp, Homo sapien
aagctcactctcatggttggaacag

SEQ ID NO: 403104 - DNA, 25 bp, Homo sapien
cactcctcatgtgtcttcagatgaa

SEQ ID NO: 403105 - DNA, 25 bp, Homo sapien
aaatcattctttccaataatcccag

SEQ ID NO: 403106 - DNA, 25 bp, Homo sapien
ctctcctctctcaagcatgtgaaaa

SEQ ID NO: 403107 - DNA, 25 bp, Homo sapien
gaaaaggtccagagctctgcagtgt

SEQ ID NO: 403108 - DNA, 25 bp, Homo sapien
ctttctactgaaatggcccttggac

SEQ ID NO: 403109 - DNA, 25 bp, Homo sapien
gcccttggactttgtggttcattca

SEQ ID NO: 403110 - DNA, 25 bp, Homo sapien
ggttcattcatactcagtggtctag

SEQ ID NO: 403111 - DNA, 25 bp, Homo sapien
gtggtctagcttgtactacttttga

SEQ ID NO: 403112 - DNA, 25 bp, Homo sapien
aatgcaaagcttaactgtggacgga

SEQ ID NO: 403113 - DNA, 25 bp, Homo sapien
tgtggacggattccaatcctggcca

SEQ ID NO: 403114 - DNA, 25 bp, Homo sapien
gcaaccacggtgaaattggcttcca

SEQ ID NO: 403115 - DNA, 25 bp, Homo sapien
gatcaggccctcaggccagataggt

SEQ ID NO: 403116 - DNA, 25 bp, Homo sapien
taggtttggccttgatggaaagacc

SEQ ID NO: 403117 - DNA, 25 bp, Homo sapien
gaaagtatccaaagctgccattata

SEQ ID NO: 403118 - DNA, 25 bp, Homo sapien
aaagctgccattatagccttaatca

SEQ ID NO: 403119 - DNA, 25 bp, Homo sapien
taatcatatgacctatccatcctca

SEQ ID NO: 403120 - DNA, 25 bp, Homo sapien
atccatcctcagtttctaacttggt

SEQ ID NO: 403121 - DNA, 25 bp, Homo sapien
aacttctgaaatctcttccatcttc

SEQ ID NO: 403122 - DNA, 25 bp, Homo sapien
aatctcttccatcttcaaagtctga

SEQ ID NO: 403123 - DNA, 25 bp, Homo sapien
caaagtctgaattttgccctgaatg

SEQ ID NO: 403124 - DNA, 25 bp, Homo sapien
gaaaactactgaaggcaaccacggt

SEQ ID NO: 403125 - DNA, 25 bp, Homo sapien
gccacggcgggcaggaccactctgt

SEQ ID NO: 403126 - DNA, 25 bp, Homo sapien
tgtacccagacgaccaaccaggcat

SEQ ID NO: 403127 - DNA, 25 bp, Homo sapien
gacgaccaaccaggcatgggtttgt

SEQ ID NO: 403128 - DNA, 25 bp, Homo sapien
aaccaggcatgggtttgtgaagcat

SEQ ID NO: 403129 - DNA, 25 bp, Homo sapien
catgagaaggccacactcaggtggg

SEQ ID NO: 403130 - DNA, 25 bp, Homo sapien
aggtggggtccagacacacttggca

SEQ ID NO: 403131 - DNA, 25 bp, Homo sapien
caccaccgaggctgcccagggaagg

SEQ ID NO: 403132 - DNA, 25 bp, Homo sapien
caggagtgtcgtgcaggtgtcccca

SEQ ID NO: 403133 - DNA, 25 bp, Homo sapien
agtgtcgtgcaggtgtccccatgca

SEQ ID NO: 403134 - DNA, 25 bp, Homo sapien
gtcgtgcaggtgtccccatgcacgg

SEQ ID NO: 403135 - DNA, 25 bp, Homo sapien
ttgtctccacaccaacagctgcttt

SEQ ID NO: 403136 - DNA, 25 bp, Homo sapien
aaatgagcaggatggagacttggaa

SEQ ID NO: 403137 - DNA, 25 bp, Homo sapien
gatggagacttggaaggccctgtga

SEQ ID NO: 403138 - DNA, 25 bp, Homo sapien
cgatgagtctgtactttcaacgaag

SEQ ID NO: 403139 - DNA, 25 bp, Homo sapien
atgagtctgtactttcaacgaagga

SEQ ID NO: 403140 - DNA, 25 bp, Homo sapien
gactgaagagagactgcattgacag

SEQ ID NO: 403141 - DNA, 25 bp, Homo sapien
gaagagagactgcattgacaggcta

SEQ ID NO: 403142 - DNA, 25 bp, Homo sapien
agagagactgcattgacaggctaaa

SEQ ID NO: 403143 - DNA, 25 bp, Homo sapien
cacctgcagactctgtgatgtttta

SEQ ID NO: 403144 - DNA, 25 bp, Homo sapien
ctgcagactctgtgatgttttaatt

SEQ ID NO: 403145 - DNA, 25 bp, Homo sapien
gcagactctgtgatgttttaattga

SEQ ID NO: 403146 - DNA, 25 bp, Homo sapien
ctctgtgatgttttaattgaatcca

SEQ ID NO: 403147 - DNA, 25 bp, Homo sapien
tgagtagctaggcacttacaaggtt

SEQ ID NO: 403148 - DNA, 25 bp, Homo sapien
gtagctaggcacttacaaggttcat

SEQ ID NO: 403149 - DNA, 25 bp, Homo sapien
gctaggcacttacaaggttcatgct

SEQ ID NO: 403150 - DNA, 25 bp, Homo sapien
aggcacttacaaggttcatgcttat

SEQ ID NO: 403151 - DNA, 25 bp, Homo sapien
acttacaaggttcatgcttatggcc

SEQ ID NO: 403152 - DNA, 25 bp, Homo sapien
acaaggttcatgcttatggcctgaa

SEQ ID NO: 403153 - DNA, 25 bp, Homo sapien
aaggttcatgcttatggcctgaaaa

SEQ ID NO: 403154 - DNA, 25 bp, Homo sapien
tgaaaataaccacatcccaggctga

SEQ ID NO: 403155 - DNA, 25 bp, Homo sapien
gaaaataaccacatcccaggctgac

SEQ ID NO: 403156 - DNA, 25 bp, Homo sapien
aaataaccacatcccaggctgacca

SEQ ID NO: 403157 - DNA, 25 bp, Homo sapien
cacatcccaggctgaccaccaatta

SEQ ID NO: 403158 - DNA, 25 bp, Homo sapien
gttgctggagaatttcatgaaggtc

SEQ ID NO: 403159 - DNA, 25 bp, Homo sapien
gctgcgggaaatgctttattaatct

SEQ ID NO: 403160 - DNA, 25 bp, Homo sapien
aggacaatttggttcagttaggtgc

SEQ ID NO: 403161 - DNA, 25 bp, Homo sapien
aggtgctttgcacactgaggaacat

SEQ ID NO: 403162 - DNA, 25 bp, Homo sapien
acatgcagagaaatcacttgcttta

SEQ ID NO: 403163 - DNA, 25 bp, Homo sapien
tgtaatcacactgctttgaaaggga

SEQ ID NO: 403164 - DNA, 25 bp, Homo sapien
gctttattaatcttgcagtcctgtg

SEQ ID NO: 403165 - DNA, 25 bp, Homo sapien
taactccagtaaagactagattgtc

SEQ ID NO: 403166 - DNA, 25 bp, Homo sapien
tgcagtcctgtgtccatgtggagat

SEQ ID NO: 403167 - DNA, 25 bp, Homo sapien
gtccatgtggagatgtggttctgcc

SEQ ID NO: 403168 - DNA, 25 bp, Homo sapien
ggttctgccatccaaccagatagga

SEQ ID NO: 403169 - DNA, 25 bp, Homo sapien
gaaagaggagttacactgaatacct

SEQ ID NO: 403170 - DNA, 25 bp, Homo sapien
tgaatacctgtacattttgccatat

SEQ ID NO: 403171 - DNA, 25 bp, Homo sapien
cattttgccatatttactttatttc

SEQ ID NO: 403172 - DNA, 25 bp, Homo sapien
gccatatttactttatttctctctt

SEQ ID NO: 403173 - DNA, 25 bp, Homo sapien
gtaagtttcaggctttgtaacactt

SEQ ID NO: 403174 - DNA, 25 bp, Homo sapien
tttcaggctttgtaacacttcaccc

SEQ ID NO: 403175 - DNA, 25 bp, Homo sapien
tcaggctttgtaacacttcaccctt

SEQ ID NO: 403176 - DNA, 25 bp, Homo sapien
gctttgtaacacttcacccttaaat

SEQ ID NO: 403177 - DNA, 25 bp, Homo sapien
ttgtaacacttcacccttaaatatt

SEQ ID NO: 403178 - DNA, 25 bp, Homo sapien
taacacttcacccttaaatattaag

SEQ ID NO: 403179 - DNA, 25 bp, Homo sapien
gtcaaggaaatgaaacccttctgaa

SEQ ID NO: 403180 - DNA, 25 bp, Homo sapien
aacacacatgctgagaaggcaatag

SEQ ID NO: 403181 - DNA, 25 bp, Homo sapien
atgactatcaaagttcaccctctgg

SEQ ID NO: 403182 - DNA, 25 bp, Homo sapien
cctctggcctctaacgattttttat

SEQ ID NO: 403183 - DNA, 25 bp, Homo sapien
tttatttccctaccaaatgtgaaat

SEQ ID NO: 403184 - DNA, 25 bp, Homo sapien
atgtgaaataactcctctcaaggtt

SEQ ID NO: 403185 - DNA, 25 bp, Homo sapien
tctcaaggttctcagacgtctcatt

SEQ ID NO: 403186 - DNA, 25 bp, Homo sapien
ctcagacgtctcattccattataac

SEQ ID NO: 403187 - DNA, 25 bp, Homo sapien
gaagtatagaatcctcatcgttaaa

SEQ ID NO: 403188 - DNA, 25 bp, Homo sapien
ggcaatagagagagcctactagcaa

SEQ ID NO: 403189 - DNA, 25 bp, Homo sapien
gagcctactagcaagacagaagtct

SEQ ID NO: 403190 - DNA, 25 bp, Homo sapien
aaacctaatcgtggaaaatgacatt

SEQ ID NO: 403191 - DNA, 25 bp, Homo sapien
tgtggattacagagggccaaagaat

SEQ ID NO: 403192 - DNA, 25 bp, Homo sapien
tgcagcatccttcaggagtaagaca

SEQ ID NO: 403193 - DNA, 25 bp, Homo sapien
ggagtaagacaacatgcgttctcta

SEQ ID NO: 403194 - DNA, 25 bp, Homo sapien
gacaacatgcgttctctagtcattc

SEQ ID NO: 403195 - DNA, 25 bp, Homo sapien
gttctctagtcattcttcagggtca

SEQ ID NO: 403196 - DNA, 25 bp, Homo sapien
cattcttcagggtcacagtctcaga

SEQ ID NO: 403197 - DNA, 25 bp, Homo sapien
acagtctcagaaattctccagtgag

SEQ ID NO: 403198 - DNA, 25 bp, Homo sapien
tgagcacaaaaatcttagccggaca

SEQ ID NO: 403199 - DNA, 25 bp, Homo sapien
atcttagccggacaccttcacagat

SEQ ID NO: 403200 - DNA, 25 bp, Homo sapien
gatgaaaaaaccttccacttctgga

SEQ ID NO: 403201 - DNA, 25 bp, Homo sapien
aaatttccattctgatgtggattac

SEQ ID NO: 403202 - DNA, 25 bp, Homo sapien
ctgattactcatgtccttggaactt

SEQ ID NO: 403203 - DNA, 25 bp, Homo sapien
gtccttggaacttgcacatcttgtg

SEQ ID NO: 403204 - DNA, 25 bp, Homo sapien
agctcttagaaattgatcttcattc

SEQ ID NO: 403205 - DNA, 25 bp, Homo sapien
atatgctcagcactgtgctggaccc

SEQ ID NO: 403206 - DNA, 25 bp, Homo sapien
tggaccctgggacacaaagatgaat

SEQ ID NO: 403207 - DNA, 25 bp, Homo sapien
atgacaagtctctgctttcaaggga

SEQ ID NO: 403208 - DNA, 25 bp, Homo sapien
tgctttcaagggactcaatattcag

SEQ ID NO: 403209 - DNA, 25 bp, Homo sapien
atattcagtgagtcatatagaccag

SEQ ID NO: 403210 - DNA, 25 bp, Homo sapien
tagaccagcaaacatgctcgtaatt

SEQ ID NO: 403211 - DNA, 25 bp, Homo sapien
tataatttgttgtcacagttgccag

SEQ ID NO: 403212 - DNA, 25 bp, Homo sapien
gttgacaacatctgattactcatgt

SEQ ID NO: 403213 - DNA, 25 bp, Homo sapien
ttgtgtcttacgaaatactattgct

SEQ ID NO: 403214 - DNA, 25 bp, Homo sapien
attatcttaatcaacctagggtgcg

SEQ ID NO: 403215 - DNA, 25 bp, Homo sapien
gggtgcgtactaaacagctactaat

SEQ ID NO: 403216 - DNA, 25 bp, Homo sapien
ctaattgtacatctagcctcaggta

SEQ ID NO: 403217 - DNA, 25 bp, Homo sapien
gcctcaggtatcttttgcagcttag

SEQ ID NO: 403218 - DNA, 25 bp, Homo sapien
gcttagacattttccattggcaaat

SEQ ID NO: 403219 - DNA, 25 bp, Homo sapien
tggcaaattcagacaagggcgatct

SEQ ID NO: 403220 - DNA, 25 bp, Homo sapien
gacaagggcgatcttaatcaggaat

SEQ ID NO: 403221 - DNA, 25 bp, Homo sapien
atactattgcttagacttcctacat

SEQ ID NO: 403222 - DNA, 25 bp, Homo sapien
agacttcctacatcaagacattgaa

SEQ ID NO: 403223 - DNA, 25 bp, Homo sapien
ggtgtatgcctatatttcaaaggga

SEQ ID NO: 403224 - DNA, 25 bp, Homo sapien
gcccatttccgtgagtcagatgttc

SEQ ID NO: 403225 - DNA, 25 bp, Homo sapien
tccgtgagtcagatgttccagccta

SEQ ID NO: 403226 - DNA, 25 bp, Homo sapien
cagcctatcattttacttattctca

SEQ ID NO: 403227 - DNA, 25 bp, Homo sapien
ctcattcttgtattattttcatcac

SEQ ID NO: 403228 - DNA, 25 bp, Homo sapien
ttttcatcactttcttacacaacaa

SEQ ID NO: 403229 - DNA, 25 bp, Homo sapien
acactgttttttgtactgtaaatct

SEQ ID NO: 403230 - DNA, 25 bp, Homo sapien
atctttcatcatttaccattcattg

SEQ ID NO: 403231 - DNA, 25 bp, Homo sapien
tttattttgttcacccttcaagaca

SEQ ID NO: 403232 - DNA, 25 bp, Homo sapien
gtataatttctgtagtaaccaatgc

SEQ ID NO: 403233 - DNA, 25 bp, Homo sapien
aacactgaagactgcttatttcttt

SEQ ID NO: 403234 - DNA, 25 bp, Homo sapien
gatacaactcatcttaccaagacca

SEQ ID NO: 403235 - DNA, 25 bp, Homo sapien
tgagacctcgtctccaacttatcaa

SEQ ID NO: 403236 - DNA, 25 bp, Homo sapien
ctcgtctccaacttatcaacagaag

SEQ ID NO: 403237 - DNA, 25 bp, Homo sapien
gttgctattgtaatgactgatctct

SEQ ID NO: 403238 - DNA, 25 bp, Homo sapien
gtaatgactgatctcttgtagtctt

SEQ ID NO: 403239 - DNA, 25 bp, Homo sapien
aatatattgagcactgaaacttgag

SEQ ID NO: 403240 - DNA, 25 bp, Homo sapien
ccatttttgtcaagaagagctgctt

SEQ ID NO: 403241 - DNA, 25 bp, Homo sapien
gagctgcttttgctatgttctcaac

SEQ ID NO: 403242 - DNA, 25 bp, Homo sapien
ttcttccggcttctgaaacgtttag

SEQ ID NO: 403243 - DNA, 25 bp, Homo sapien
agtaaacaggcagccaaacggagcc

SEQ ID NO: 403244 - DNA, 25 bp, Homo sapien
aacggagccccactctggaagaaga

SEQ ID NO: 403245 - DNA, 25 bp, Homo sapien
ggaggctcgtgagacagcaagaatt

SEQ ID NO: 403246 - DNA, 25 bp, Homo sapien
gtagtaattgtagtttttatggctg

SEQ ID NO: 403247 - DNA, 25 bp, Homo sapien
gctttggagaagagagatctagtct

SEQ ID NO: 403248 - DNA, 25 bp, Homo sapien
gatctagtctttattatctgctttg

SEQ ID NO: 403249 - DNA, 25 bp, Homo sapien
gaggaggaattctggtgtctgtact

SEQ ID NO: 403250 - DNA, 25 bp, Homo sapien
aagatgagagagatccaggttctga

SEQ ID NO: 403251 - DNA, 25 bp, Homo sapien
gagatccaggttctgaggctgcttc

SEQ ID NO: 403252 - DNA, 25 bp, Homo sapien
tgaggctgcttctgataccttccag

SEQ ID NO: 403253 - DNA, 25 bp, Homo sapien
ctgcttctgataccttccagtgcaa

SEQ ID NO: 403254 - DNA, 25 bp, Homo sapien
accttccagtgcaaagtactttgtg

SEQ ID NO: 403255 - DNA, 25 bp, Homo sapien
agaatttctgtctaggccagttcct

SEQ ID NO: 403256 - DNA, 25 bp, Homo sapien
ggccagttcctagacagaaaggtga

SEQ ID NO: 403257 - DNA, 25 bp, Homo sapien
tattttttccagttattacattgag

SEQ ID NO: 403258 - DNA, 25 bp, Homo sapien
tccagtttttaataatcgctttaat

SEQ ID NO: 403259 - DNA, 25 bp, Homo sapien
tcgctttaatataaggtatacccaa

SEQ ID NO: 403260 - DNA, 25 bp, Homo sapien
attgaccatgaaagtacgttatagc

SEQ ID NO: 403261 - DNA, 25 bp, Homo sapien
gaaagtacgttatagcagatgccca

SEQ ID NO: 403262 - DNA, 25 bp, Homo sapien
gttatagcagatgcccactcatcag

SEQ ID NO: 403263 - DNA, 25 bp, Homo sapien
gcccactcatcagtatgccttgaaa

SEQ ID NO: 403264 - DNA, 25 bp, Homo sapien
ggtttataaggtgcataagggcaaa

SEQ ID NO: 403265 - DNA, 25 bp, Homo sapien
aactatccctaaaactgattctcag

SEQ ID NO: 403266 - DNA, 25 bp, Homo sapien
tcagtgactcccttgatctacatat

SEQ ID NO: 403267 - DNA, 25 bp, Homo sapien
gactcccttgatctacatatgttaa

SEQ ID NO: 403268 - DNA, 25 bp, Homo sapien
gccactcacatctgaccacatttat

SEQ ID NO: 403269 - DNA, 25 bp, Homo sapien
ttctgtactcgtatcttgtgccagt

SEQ ID NO: 403270 - DNA, 25 bp, Homo sapien
ttgtgccagtagtctgctagtccag

SEQ ID NO: 403271 - DNA, 25 bp, Homo sapien
gctagtccagattcatgttcctttt

SEQ ID NO: 403272 - DNA, 25 bp, Homo sapien
gaaattaaactcatagcctccaaaa

SEQ ID NO: 403273 - DNA, 25 bp, Homo sapien
aaaatttgcatttgccctgttttga

SEQ ID NO: 403274 - DNA, 25 bp, Homo sapien
aagtggagactattcatgatgctca

SEQ ID NO: 403275 - DNA, 25 bp, Homo sapien
aaatgatgacagtcgtgtggcctgc

SEQ ID NO: 403276 - DNA, 25 bp, Homo sapien
gtggcctgcggatagcactatgatt

SEQ ID NO: 403277 - DNA, 25 bp, Homo sapien
ttctcacagtgagttgaacctggca

SEQ ID NO: 403278 - DNA, 25 bp, Homo sapien
gaacctggcaggtgttgccactcac

SEQ ID NO: 403279 - DNA, 25 bp, Homo sapien
gaaaatcaagtccacaaatccctcc

SEQ ID NO: 403280 - DNA, 25 bp, Homo sapien
tatcatctgggtcctgtgcagcact

SEQ ID NO: 403281 - DNA, 25 bp, Homo sapien
caaatccctccgtcagaatttttat

SEQ ID NO: 403282 - DNA, 25 bp, Homo sapien
agaatttttatcttgggaagcgcaa

SEQ ID NO: 403283 - DNA, 25 bp, Homo sapien
ggaagcgcaaggtcaaaagcatcaa

SEQ ID NO: 403284 - DNA, 25 bp, Homo sapien
agtacgctttgagacaattctggct

SEQ ID NO: 403285 - DNA, 25 bp, Homo sapien
aattctggctctgtagaacctgagg

SEQ ID NO: 403286 - DNA, 25 bp, Homo sapien
tagctagcgcatgaccctacctttt

SEQ ID NO: 403287 - DNA, 25 bp, Homo sapien
atgaccctaccttttctactcaaag

SEQ ID NO: 403288 - DNA, 25 bp, Homo sapien
tactcaaagccctcgaggcttgtaa

SEQ ID NO: 403289 - DNA, 25 bp, Homo sapien
aggcttgtaaacacctcgcaggcct

SEQ ID NO: 403290 - DNA, 25 bp, Homo sapien
ccattcttaagttgacattgaacat

SEQ ID NO: 403291 - DNA, 25 bp, Homo sapien
gacattgaacattttcatcagaatt

SEQ ID NO: 403292 - DNA, 25 bp, Homo sapien
atcagaattataagtcaagccaggc

SEQ ID NO: 403293 - DNA, 25 bp, Homo sapien
gaattataagtcaagccaggctcag

SEQ ID NO: 403294 - DNA, 25 bp, Homo sapien
aattataagtcaagccaggctcagt

SEQ ID NO: 403295 - DNA, 25 bp, Homo sapien
ataagtcaagccaggctcagtacct

SEQ ID NO: 403296 - DNA, 25 bp, Homo sapien
taagtcaagccaggctcagtacctc

SEQ ID NO: 403297 - DNA, 25 bp, Homo sapien
gtcaagccaggctcagtacctcatg

SEQ ID NO: 403298 - DNA, 25 bp, Homo sapien
tcaagccaggctcagtacctcatgc

SEQ ID NO: 403299 - DNA, 25 bp, Homo sapien
gacgtggtgccatgtgcctatagtc

SEQ ID NO: 403300 - DNA, 25 bp, Homo sapien
agccgagatagatccactgcacctc

SEQ ID NO: 403301 - DNA, 25 bp, Homo sapien
ctgtgggtccttgtccttttgaggg

SEQ ID NO: 403302 - DNA, 25 bp, Homo sapien
gggacacatgatagccatcactgcc

SEQ ID NO: 403303 - DNA, 25 bp, Homo sapien
atgatagccatcactgcccagtgat

SEQ ID NO: 403304 - DNA, 25 bp, Homo sapien
tgcccagtgatgaatccggactctg

SEQ ID NO: 403305 - DNA, 25 bp, Homo sapien
atccggactctgctgatttctagtg

SEQ ID NO: 403306 - DNA, 25 bp, Homo sapien
tagtgttgagaccttggcctctgca

SEQ ID NO: 403307 - DNA, 25 bp, Homo sapien
gcacctcagtttgctcattcataga

SEQ ID NO: 403308 - DNA, 25 bp, Homo sapien
attcatagagtgctcgtccttacct

SEQ ID NO: 403309 - DNA, 25 bp, Homo sapien
gtccttacctccagggttatgggag

SEQ ID NO: 403310 - DNA, 25 bp, Homo sapien
attccagctgtgacttagcaagtgc

SEQ ID NO: 403311 - DNA, 25 bp, Homo sapien
attgggatttcaccagaggcggcca

SEQ ID NO: 403312 - DNA, 25 bp, Homo sapien
ccgctcacatgtcttagctgactta

SEQ ID NO: 403313 - DNA, 25 bp, Homo sapien
acttataacatcagacggtcaggaa

SEQ ID NO: 403314 - DNA, 25 bp, Homo sapien
ctcacttctgagtcacaatcttagc

SEQ ID NO: 403315 - DNA, 25 bp, Homo sapien
gtctactgctctgaagtgggagccg

SEQ ID NO: 403316 - DNA, 25 bp, Homo sapien
gtcacaatcttagctctattttctc

SEQ ID NO: 403317 - DNA, 25 bp, Homo sapien
tagctctattttctcataattttca

SEQ ID NO: 403318 - DNA, 25 bp, Homo sapien
gggaaatttctccttacccacacag

SEQ ID NO: 403319 - DNA, 25 bp, Homo sapien
cccacacaggacagatcagattaga

SEQ ID NO: 403320 - DNA, 25 bp, Homo sapien
gatcagattagagaaagccaagctt

SEQ ID NO: 403321 - DNA, 25 bp, Homo sapien
aaagccaagcttagatgagatccag

SEQ ID NO: 403322 - DNA, 25 bp, Homo sapien
gttgtggtccacaaagaatgcctag

SEQ ID NO: 403323 - DNA, 25 bp, Homo sapien
gggaagatttgaattccattgaatt

SEQ ID NO: 403324 - DNA, 25 bp, Homo sapien
attgaattcatggaagcaggaatcc

SEQ ID NO: 403325 - DNA, 25 bp, Homo sapien
attcatggaagcaggaatccatctg

SEQ ID NO: 403326 - DNA, 25 bp, Homo sapien
tggaagcaggaatccatctggtcat

SEQ ID NO: 403327 - DNA, 25 bp, Homo sapien
ggaagcaggaatccatctggtcata

SEQ ID NO: 403328 - DNA, 25 bp, Homo sapien
gaagcaggaatccatctggtcatat

SEQ ID NO: 403329 - DNA, 25 bp, Homo sapien
aagcaggaatccatctggtcatatt

SEQ ID NO: 403330 - DNA, 25 bp, Homo sapien
agcaggaatccatctggtcatattt

SEQ ID NO: 403331 - DNA, 25 bp, Homo sapien
gcaggaatccatctggtcatatttt

SEQ ID NO: 403332 - DNA, 25 bp, Homo sapien
caggaatccatctggtcatatttta

SEQ ID NO: 403333 - DNA, 25 bp, Homo sapien
ggaatccatctggtcatattttaaa

SEQ ID NO: 403334 - DNA, 25 bp, Homo sapien
gccaccatcacagtctggcggtaaa

SEQ ID NO: 403335 - DNA, 25 bp, Homo sapien
cagtctggcggtaaaccacccacag

SEQ ID NO: 403336 - DNA, 25 bp, Homo sapien
ggaagatcaccttggagcctgtcag

SEQ ID NO: 403337 - DNA, 25 bp, Homo sapien
agatcaccttggagcctgtcagtcc

SEQ ID NO: 403338 - DNA, 25 bp, Homo sapien
gtattacggtggagagcgctgctca

SEQ ID NO: 403339 - DNA, 25 bp, Homo sapien
agagcgctgctcagcaagtcggaag

SEQ ID NO: 403340 - DNA, 25 bp, Homo sapien
tgctcagcaagtcggaagcccaggt

SEQ ID NO: 403341 - DNA, 25 bp, Homo sapien
agcaagtcggaagcccaggtttcag

SEQ ID NO: 403342 - DNA, 25 bp, Homo sapien
tttcagaccccaccgttcgttagtg

SEQ ID NO: 403343 - DNA, 25 bp, Homo sapien
accgttcgttagtgggtggcattct

SEQ ID NO: 403344 - DNA, 25 bp, Homo sapien
ttcgttagtgggtggcattctgagt

SEQ ID NO: 403345 - DNA, 25 bp, Homo sapien
tgtgcttcctgtcagttaatggtga

SEQ ID NO: 403346 - DNA, 25 bp, Homo sapien
cttcctgtcagttaatggtgactgt

SEQ ID NO: 403347 - DNA, 25 bp, Homo sapien
gactgtgtttggacctattcatacc

SEQ ID NO: 403348 - DNA, 25 bp, Homo sapien
cacttgggtgctagtttcttcataa

SEQ ID NO: 403349 - DNA, 25 bp, Homo sapien
gtaagcaactccctagtaatgaata

SEQ ID NO: 403350 - DNA, 25 bp, Homo sapien
gggtgctagtttcttcataagaatc

SEQ ID NO: 403351 - DNA, 25 bp, Homo sapien
tgtgaacaccttacctctactcgta

SEQ ID NO: 403352 - DNA, 25 bp, Homo sapien
cttacctctactcgtatctacaaat

SEQ ID NO: 403353 - DNA, 25 bp, Homo sapien
tctacaaattctggatcagggaaat

SEQ ID NO: 403354 - DNA, 25 bp, Homo sapien
ataaaataatgtcttggccaaaact

SEQ ID NO: 403355 - DNA, 25 bp, Homo sapien
aatgtcttggccaaaactaaatgga

SEQ ID NO: 403356 - DNA, 25 bp, Homo sapien
gtcattgtcttgaggaatcttgtgt

SEQ ID NO: 403357 - DNA, 25 bp, Homo sapien
agagctaatttctggaaagctgtat

SEQ ID NO: 403358 - DNA, 25 bp, Homo sapien
agctgtattaaatgctaaggcttca

SEQ ID NO: 403359 - DNA, 25 bp, Homo sapien
attccactgggtgtgccgtcatcta

SEQ ID NO: 403360 - DNA, 25 bp, Homo sapien
gggtgtgccgtcatctaacataaaa

SEQ ID NO: 403361 - DNA, 25 bp, Homo sapien
cattttgtgagaagcgtatggtaaa

SEQ ID NO: 403362 - DNA, 25 bp, Homo sapien
gaaataatcgagttgtagcacccac

SEQ ID NO: 403363 - DNA, 25 bp, Homo sapien
gtagcacccacagattgagatcatc

SEQ ID NO: 403364 - DNA, 25 bp, Homo sapien
ggaattaacaccaacactaaagtat

SEQ ID NO: 403365 - DNA, 25 bp, Homo sapien
taaagtattcttgctgtcttggaaa

SEQ ID NO: 403366 - DNA, 25 bp, Homo sapien
gtcttggaaagggaagtcattgtct

SEQ ID NO: 403367 - DNA, 25 bp, Homo sapien
agaactaatagctatttttccatat

SEQ ID NO: 403368 - DNA, 25 bp, Homo sapien
actaatagctatttttccatatata

SEQ ID NO: 403369 - DNA, 25 bp, Homo sapien
aggatgatatattctgtgactaccc

SEQ ID NO: 403370 - DNA, 25 bp, Homo sapien
ggatgatatattctgtgactaccca

SEQ ID NO: 403371 - DNA, 25 bp, Homo sapien
gatgatatattctgtgactacccag

SEQ ID NO: 403372 - DNA, 25 bp, Homo sapien
tgatatattctgtgactacccagat

SEQ ID NO: 403373 - DNA, 25 bp, Homo sapien
gatatattctgtgactacccagatt

SEQ ID NO: 403374 - DNA, 25 bp, Homo sapien
atattctgtgactacccagattaga

SEQ ID NO: 403375 - DNA, 25 bp, Homo sapien
attctgtgactacccagattagaaa

SEQ ID NO: 403376 - DNA, 25 bp, Homo sapien
ctgtgactacccagattagaaaaag

SEQ ID NO: 403377 - DNA, 25 bp, Homo sapien
gactacccagattagaaaaagaact

SEQ ID NO: 403378 - DNA, 25 bp, Homo sapien
cctcagtgttgtggcgagaggaata

SEQ ID NO: 403379 - DNA, 25 bp, Homo sapien
cagtgttgtggcgagaggaataaaa

SEQ ID NO: 403380 - DNA, 25 bp, Homo sapien
gtggcgagaggaataaaagcctccc

SEQ ID NO: 403381 - DNA, 25 bp, Homo sapien
gaggaacttcttagaagcacatgct

SEQ ID NO: 403382 - DNA, 25 bp, Homo sapien
gaacttcttagaagcacatgctctg

SEQ ID NO: 403383 - DNA, 25 bp, Homo sapien
acttcttagaagcacatgctctggg

SEQ ID NO: 403384 - DNA, 25 bp, Homo sapien
tcttagaagcacatgctctgggcaa

SEQ ID NO: 403385 - DNA, 25 bp, Homo sapien
tagaagcacatgctctgggcaacat

SEQ ID NO: 403386 - DNA, 25 bp, Homo sapien
gaagcacatgctctgggcaacatgc

SEQ ID NO: 403387 - DNA, 25 bp, Homo sapien
aagcacatgctctgggcaacatgcc

SEQ ID NO: 403388 - DNA, 25 bp, Homo sapien
aacatctcccacgttcaagctgcta

SEQ ID NO: 403389 - DNA, 25 bp, Homo sapien
gattctgcatctcctaagatgtcgc

SEQ ID NO: 403390 - DNA, 25 bp, Homo sapien
tctcctaagatgtcgcttgctattc

SEQ ID NO: 403391 - DNA, 25 bp, Homo sapien
gtcgcttgctattctgacatcatat

SEQ ID NO: 403392 - DNA, 25 bp, Homo sapien
atcatatcttggtctcttttgttta

SEQ ID NO: 403393 - DNA, 25 bp, Homo sapien
attctctgcaaaatgccgctgttct

SEQ ID NO: 403394 - DNA, 25 bp, Homo sapien
aaaatgccgctgttctcatcatcct

SEQ ID NO: 403395 - DNA, 25 bp, Homo sapien
agttctgaatctgagagcgggacac

SEQ ID NO: 403396 - DNA, 25 bp, Homo sapien
ggacaccagcccgaagccaaaggtg

SEQ ID NO: 403397 - DNA, 25 bp, Homo sapien
gaagccaaaggtgagctcttcacat

SEQ ID NO: 403398 - DNA, 25 bp, Homo sapien
gagctcttcacatgggaaaaccagc

SEQ ID NO: 403399 - DNA, 25 bp, Homo sapien
tgcagctataccagccagcctgctg

SEQ ID NO: 403400 - DNA, 25 bp, Homo sapien
ttggatattgtattagagtcctcct

SEQ ID NO: 403401 - DNA, 25 bp, Homo sapien
tagagtcctccttacaagaaatgaa

SEQ ID NO: 403402 - DNA, 25 bp, Homo sapien
gaaatagtttttagcactcttagca

SEQ ID NO: 403403 - DNA, 25 bp, Homo sapien
agtttttagcactcttagcattaga

SEQ ID NO: 403404 - DNA, 25 bp, Homo sapien
gcactcttagcattagagttcctag

SEQ ID NO: 403405 - DNA, 25 bp, Homo sapien
gagttcctagattggtgttgatagc

SEQ ID NO: 403406 - DNA, 25 bp, Homo sapien
ttggtgttgatagctacagttttaa

SEQ ID NO: 403407 - DNA, 25 bp, Homo sapien
aaggttaattttgcattgtaagagc

SEQ ID NO: 403408 - DNA, 25 bp, Homo sapien
gtaagagcacatttgatctatgtaa

SEQ ID NO: 403409 - DNA, 25 bp, Homo sapien
ctatgtaaaaagtgtccatttggtg

SEQ ID NO: 403410 - DNA, 25 bp, Homo sapien
gaaagcactttcatattaagtagca

SEQ ID NO: 403411 - DNA, 25 bp, Homo sapien
accctaggcccctgtgccaagtttg

SEQ ID NO: 403412 - DNA, 25 bp, Homo sapien
aggcccctgtgccaagtttgtctgc

SEQ ID NO: 403413 - DNA, 25 bp, Homo sapien
tgtgccaagtttgtctgccgcttct

SEQ ID NO: 403414 - DNA, 25 bp, Homo sapien
tgccaagtttgtctgccgcttcttg

SEQ ID NO: 403415 - DNA, 25 bp, Homo sapien
ttgtctgccgcttcttgcccaggat

SEQ ID NO: 403416 - DNA, 25 bp, Homo sapien
tccttgctgctcctgtcatagtgag

SEQ ID NO: 403417 - DNA, 25 bp, Homo sapien
ttgctgctcctgtcatagtgagctt

SEQ ID NO: 403418 - DNA, 25 bp, Homo sapien
tgctcctgtcatagtgagcttgtgc

SEQ ID NO: 403419 - DNA, 25 bp, Homo sapien
agcttgtgccgtccccctaggatgg

SEQ ID NO: 403420 - DNA, 25 bp, Homo sapien
catggccctggctgccagatgccca

SEQ ID NO: 403421 - DNA, 25 bp, Homo sapien
gatgcccacagcaccctggcatgac

SEQ ID NO: 403422 - DNA, 25 bp, Homo sapien
gtgtgtctgtgagagctagctgcct

SEQ ID NO: 403423 - DNA, 25 bp, Homo sapien
gtgtctgtgagagctagctgcctta

SEQ ID NO: 403424 - DNA, 25 bp, Homo sapien
gtctgtgagagctagctgccttacc

SEQ ID NO: 403425 - DNA, 25 bp, Homo sapien
tgtgagagctagctgccttacccct

SEQ ID NO: 403426 - DNA, 25 bp, Homo sapien
cttacccctccttggcacatagtag

SEQ ID NO: 403427 - DNA, 25 bp, Homo sapien
tagtaggccttccataaatgttgga

SEQ ID NO: 403428 - DNA, 25 bp, Homo sapien
ggccttccataaatgttggatggat

SEQ ID NO: 403429 - DNA, 25 bp, Homo sapien
aatagattgggaccatcagaccatg

SEQ ID NO: 403430 - DNA, 25 bp, Homo sapien
ctgaccatgtgtgtaagtgcacaaa

SEQ ID NO: 403431 - DNA, 25 bp, Homo sapien
aaaaatgtggttgtagatgttgctc

SEQ ID NO: 403432 - DNA, 25 bp, Homo sapien
agatgttgctctacattcaaacctt

SEQ ID NO: 403433 - DNA, 25 bp, Homo sapien
gaacatagatgatctcaaccctcac

SEQ ID NO: 403434 - DNA, 25 bp, Homo sapien
gggtaggtactattaagagctccat

SEQ ID NO: 403435 - DNA, 25 bp, Homo sapien
gtactattaagagctccatttccgt

SEQ ID NO: 403436 - DNA, 25 bp, Homo sapien
taagagctccatttccgtaatgaga

SEQ ID NO: 403437 - DNA, 25 bp, Homo sapien
ttccgtaatgagaactctgagactt

SEQ ID NO: 403438 - DNA, 25 bp, Homo sapien
gaactctgagacttaaggaggttaa

SEQ ID NO: 403439 - DNA, 25 bp, Homo sapien
gacttgtccaatgtcatccataaac

SEQ ID NO: 403440 - DNA, 25 bp, Homo sapien
tgtccaatgtcatccataaacactg

SEQ ID NO: 403441 - DNA, 25 bp, Homo sapien
taaatccaggtctatatgacagcga

SEQ ID NO: 403442 - DNA, 25 bp, Homo sapien
ggtctatatgacagcgaagtccaca

SEQ ID NO: 403443 - DNA, 25 bp, Homo sapien
ttcatcacaatgccagtctcctatt

SEQ ID NO: 403444 - DNA, 25 bp, Homo sapien
tgggagccccggcttgcctcgttct

SEQ ID NO: 403445 - DNA, 25 bp, Homo sapien
ctcttgcaggctggcattcgaagga

SEQ ID NO: 403446 - DNA, 25 bp, Homo sapien
ttgcaggctggcattcgaaggagca

SEQ ID NO: 403447 - DNA, 25 bp, Homo sapien
tggcattcgaaggagcagcacactt

SEQ ID NO: 403448 - DNA, 25 bp, Homo sapien
attcgaaggagcagcacacttgctc

SEQ ID NO: 403449 - DNA, 25 bp, Homo sapien
tttttgatcatgtccacgatggtgt

SEQ ID NO: 403450 - DNA, 25 bp, Homo sapien
gatcatgtccacgatggtgtcgatg

SEQ ID NO: 403451 - DNA, 25 bp, Homo sapien
atgtccacgatggtgtcgatggtct

SEQ ID NO: 403452 - DNA, 25 bp, Homo sapien
tccacgatggtgtcgatggtctggc

SEQ ID NO: 403453 - DNA, 25 bp, Homo sapien
tgtcgatggtctggctgatggcctc

SEQ ID NO: 403454 - DNA, 25 bp, Homo sapien
gatggtctggctgatggcctcctct

SEQ ID NO: 403455 - DNA, 25 bp, Homo sapien
aaaggttctgtcactgttcagtggt

SEQ ID NO: 403456 - DNA, 25 bp, Homo sapien
cactgttcagtggtctgacttctga

SEQ ID NO: 403457 - DNA, 25 bp, Homo sapien
gtctgacttctgagttctgtgcaca

SEQ ID NO: 403458 - DNA, 25 bp, Homo sapien
ttctgagttctgtgcacaccctgag

SEQ ID NO: 403459 - DNA, 25 bp, Homo sapien
ggccaccagtccttgtctgagtgcc

SEQ ID NO: 403460 - DNA, 25 bp, Homo sapien
gtctgagtgccccaggtctggttat

SEQ ID NO: 403461 - DNA, 25 bp, Homo sapien
gccccaggtctggttatgacttcag

SEQ ID NO: 403462 - DNA, 25 bp, Homo sapien
tggttatgacttcaggcctcagcac

SEQ ID NO: 403463 - DNA, 25 bp, Homo sapien
acctggttgtctcttctgcaaagaa

SEQ ID NO: 403464 - DNA, 25 bp, Homo sapien
catccaggtactggctctgagcagg

SEQ ID NO: 403465 - DNA, 25 bp, Homo sapien
ttgccaatgggctgaaaggttctgt

SEQ ID NO: 403466 - DNA, 25 bp, Homo sapien
tgaggaccaaacaggtgctactgct

SEQ ID NO: 403467 - DNA, 25 bp, Homo sapien
atttctttgcattgcatcaccacct

SEQ ID NO: 403468 - DNA, 25 bp, Homo sapien
accacctccagagtgtgcctaattg

SEQ ID NO: 403469 - DNA, 25 bp, Homo sapien
gagtgtgcctaattggcaccccgct

SEQ ID NO: 403470 - DNA, 25 bp, Homo sapien
accccgctgcttctgatgcaaaact

SEQ ID NO: 403471 - DNA, 25 bp, Homo sapien
ctgatgcaaaactccaagctgtact

SEQ ID NO: 403472 - DNA, 25 bp, Homo sapien
acaggtgctactgctgaaagctaga

SEQ ID NO: 403473 - DNA, 25 bp, Homo sapien
ccaagctgtactgggcaaacgcgca

SEQ ID NO: 403474 - DNA, 25 bp, Homo sapien
tgggcaaacgcgcagcctctggcac

SEQ ID NO: 403475 - DNA, 25 bp, Homo sapien
gtgctgctgagcatacagacctgag

SEQ ID NO: 403476 - DNA, 25 bp, Homo sapien
ctgagcatacagacctgagcacagc

SEQ ID NO: 403477 - DNA, 25 bp, Homo sapien
agaaaaattggatgctccggaagga

SEQ ID NO: 403478 - DNA, 25 bp, Homo sapien
gagagaggtctgtctcacgaagaga

SEQ ID NO: 403479 - DNA, 25 bp, Homo sapien
catagagattttgtgaagctgtccc

SEQ ID NO: 403480 - DNA, 25 bp, Homo sapien
tttgtgaagctgtcccattcaaagc

SEQ ID NO: 403481 - DNA, 25 bp, Homo sapien
ccagaggcccggaggagaccacaaa

SEQ ID NO: 403482 - DNA, 25 bp, Homo sapien
ggcccggaggagaccacaaagctgc

SEQ ID NO: 403483 - DNA, 25 bp, Homo sapien
aaagctgcgaacacagccgggacct

SEQ ID NO: 403484 - DNA, 25 bp, Homo sapien
acctgcccactgacacactgaagag

SEQ ID NO: 403485 - DNA, 25 bp, Homo sapien
gtcaacacgattcaggaaagcactt

SEQ ID NO: 403486 - DNA, 25 bp, Homo sapien
tgagcccagacctctgaacagaaga

SEQ ID NO: 403487 - DNA, 25 bp, Homo sapien
gaaggagtcatggagaaacccagaa

SEQ ID NO: 403488 - DNA, 25 bp, Homo sapien
aataacatctctattcttacagcaa

SEQ ID NO: 403489 - DNA, 25 bp, Homo sapien
gattatctaacagacatacctgcag

SEQ ID NO: 403490 - DNA, 25 bp, Homo sapien
agacatacctgcagctttggctctt

SEQ ID NO: 403491 - DNA, 25 bp, Homo sapien
tgcagctttggctctttggtattgc

SEQ ID NO: 403492 - DNA, 25 bp, Homo sapien
ggctctttggtattgccaaacattg

SEQ ID NO: 403493 - DNA, 25 bp, Homo sapien
ggtccttgtgaatggtaaccaatcc

SEQ ID NO: 403494 - DNA, 25 bp, Homo sapien
ggtaaccaatccaaatatatcagat

SEQ ID NO: 403495 - DNA, 25 bp, Homo sapien
gcaggtaatttatttgcaactatac

SEQ ID NO: 403496 - DNA, 25 bp, Homo sapien
gcaactatactagcacatgaaggat

SEQ ID NO: 403497 - DNA, 25 bp, Homo sapien
tttcctttttaagtgtggccagcac

SEQ ID NO: 403498 - DNA, 25 bp, Homo sapien
taagtgtggccagcacatttttcca

SEQ ID NO: 403499 - DNA, 25 bp, Homo sapien
cagatgacctagaatcacagatgat

SEQ ID NO: 403500 - DNA, 25 bp, Homo sapien
ttctctcagtgatgtccaaaatgtc

SEQ ID NO: 403501 - DNA, 25 bp, Homo sapien
aagatacctaggatgacctgcttgc

SEQ ID NO: 403502 - DNA, 25 bp, Homo sapien
attgtgggtcatttacccaaggcaa

SEQ ID NO: 403503 - DNA, 25 bp, Homo sapien
cccaaggcaacctggatggaagtgg

SEQ ID NO: 403504 - DNA, 25 bp, Homo sapien
gtggtgagccttggactagacccag

SEQ ID NO: 403505 - DNA, 25 bp, Homo sapien
tagacccaggtctttcaacttaaag

SEQ ID NO: 403506 - DNA, 25 bp, Homo sapien
gtccaaaatgtcatgggttgccctg

SEQ ID NO: 403507 - DNA, 25 bp, Homo sapien
aggccaatgttctttgctctgtatt

SEQ ID NO: 403508 - DNA, 25 bp, Homo sapien
catgggttgccctgtaagtccggtt

SEQ ID NO: 403509 - DNA, 25 bp, Homo sapien
taatctacttggcagtcacaacaga

SEQ ID NO: 403510 - DNA, 25 bp, Homo sapien
atacagaaccttatctagccttctc

SEQ ID NO: 403511 - DNA, 25 bp, Homo sapien
ctagccttctcagtaccttttagag

SEQ ID NO: 403512 - DNA, 25 bp, Homo sapien
tcctatgtgggccagaaagctgtgt

SEQ ID NO: 403513 - DNA, 25 bp, Homo sapien
gaagtgttgtactcagtgttaccca

SEQ ID NO: 403514 - DNA, 25 bp, Homo sapien
tactcagtgttacccagctagaaag

SEQ ID NO: 403515 - DNA, 25 bp, Homo sapien
aatgaaacccacttgctatctgact

SEQ ID NO: 403516 - DNA, 25 bp, Homo sapien
atcccagcacgcagtagaggaatct

SEQ ID NO: 403517 - DNA, 25 bp, Homo sapien
agaaagctgtgtatgttaccgcccc

SEQ ID NO: 403518 - DNA, 25 bp, Homo sapien
ccatgtgttcccaggatctgtgcct

SEQ ID NO: 403519 - DNA, 25 bp, Homo sapien
gtgcctggagaaatgacacatctgt

SEQ ID NO: 403520 - DNA, 25 bp, Homo sapien
gacacatctgtaggttatgagtata

SEQ ID NO: 403521 - DNA, 25 bp, Homo sapien
tcttctgacaccacagactgcacgg

SEQ ID NO: 403522 - DNA, 25 bp, Homo sapien
agactgcacggaccacgtttaacag

SEQ ID NO: 403523 - DNA, 25 bp, Homo sapien
gcacggaccacgtttaacagacttt

SEQ ID NO: 403524 - DNA, 25 bp, Homo sapien
tgaacccaagaaaaacttctcagga

SEQ ID NO: 403525 - DNA, 25 bp, Homo sapien
acttctcaggaaaacggaaagaatg

SEQ ID NO: 403526 - DNA, 25 bp, Homo sapien
gaaagaatgcgaaacatctccagcc

SEQ ID NO: 403527 - DNA, 25 bp, Homo sapien
ttcctattcccagggagggcctcgc

SEQ ID NO: 403528 - DNA, 25 bp, Homo sapien
agggcctcgcgcaggaagcgctcgg

SEQ ID NO: 403529 - DNA, 25 bp, Homo sapien
gcgctcggcgggacacggcctttct

SEQ ID NO: 403530 - DNA, 25 bp, Homo sapien
cgcacgcatgctaaggggtccagac

SEQ ID NO: 403531 - DNA, 25 bp, Homo sapien
gggtccagacccactctagggctgc

SEQ ID NO: 403532 - DNA, 25 bp, Homo sapien
gcctgcctttgctgaccgttttggg

SEQ ID NO: 403533 - DNA, 25 bp, Homo sapien
cctaaaaccaacagtgtcccactga

SEQ ID NO: 403534 - DNA, 25 bp, Homo sapien
tgacctccccaagtgtttgctgcgt

SEQ ID NO: 403535 - DNA, 25 bp, Homo sapien
cccaagtgtttgctgcgtggcagat

SEQ ID NO: 403536 - DNA, 25 bp, Homo sapien
tgtttgctgcgtggcagatttcctg

SEQ ID NO: 403537 - DNA, 25 bp, Homo sapien
agatttcctgttcttgttcgcagtt

SEQ ID NO: 403538 - DNA, 25 bp, Homo sapien
tcttgttcgcagtttgccgactgaa

SEQ ID NO: 403539 - DNA, 25 bp, Homo sapien
tttgccgactgaagagtgtgggatt

SEQ ID NO: 403540 - DNA, 25 bp, Homo sapien
caggtgagcacgtccatctcaggag

SEQ ID NO: 403541 - DNA, 25 bp, Homo sapien
cacgtccatctcaggaggcgtggag

SEQ ID NO: 403542 - DNA, 25 bp, Homo sapien
cgtggagggaaaagacatgtcatga

SEQ ID NO: 403543 - DNA, 25 bp, Homo sapien
attccaagacagagggcaagttcac

SEQ ID NO: 403544 - DNA, 25 bp, Homo sapien
caagttcacctaccccacaggagag

SEQ ID NO: 403545 - DNA, 25 bp, Homo sapien
aggagagtccctggtctattccaac

SEQ ID NO: 403546 - DNA, 25 bp, Homo sapien
ggtctattccaactgggccccaggg

SEQ ID NO: 403547 - DNA, 25 bp, Homo sapien
agcccaacgatgatggcgggtcaga

SEQ ID NO: 403548 - DNA, 25 bp, Homo sapien
ggactgtgtggagatcttcaccaat

SEQ ID NO: 403549 - DNA, 25 bp, Homo sapien
gatcttcaccaatggcaagtggaat

SEQ ID NO: 403550 - DNA, 25 bp, Homo sapien
aaaagcgtcttgtggtctgcgagtt

SEQ ID NO: 403551 - DNA, 25 bp, Homo sapien
gtctgcgagttctgagccaactggg

SEQ ID NO: 403552 - DNA, 25 bp, Homo sapien
aagtcaaggcttagaccctcatgct

SEQ ID NO: 403553 - DNA, 25 bp, Homo sapien
gctttcctgagcatgactgattcca

SEQ ID NO: 403554 - DNA, 25 bp, Homo sapien
actgtggtggctgcagggctccaca

SEQ ID NO: 403555 - DNA, 25 bp, Homo sapien
tgcagggctccacaggtgtcatttg

SEQ ID NO: 403556 - DNA, 25 bp, Homo sapien
acaggtgtcatttgccctacagctg

SEQ ID NO: 403557 - DNA, 25 bp, Homo sapien
gtcatttgccctacagctggctggg

SEQ ID NO: 403558 - DNA, 25 bp, Homo sapien
gttctgttgaaaggttcagaggctt

SEQ ID NO: 403559 - DNA, 25 bp, Homo sapien
agaggcttcatgcagctgcctgctg

SEQ ID NO: 403560 - DNA, 25 bp, Homo sapien
gaggggcttcatgtagtcttctctg

SEQ ID NO: 403561 - DNA, 25 bp, Homo sapien
agccactccatgtgagctgcagcac

SEQ ID NO: 403562 - DNA, 25 bp, Homo sapien
gagctgcagcacttgttctcaaaat

SEQ ID NO: 403563 - DNA, 25 bp, Homo sapien
agcacttgttctcaaaatggtcttt

SEQ ID NO: 403564 - DNA, 25 bp, Homo sapien
atctgccctttgcactctgggcatc

SEQ ID NO: 403565 - DNA, 25 bp, Homo sapien
cgcagtggggcatcgtggacctctc

SEQ ID NO: 403566 - DNA, 25 bp, Homo sapien
gcatcgtggacctctcggggcacca

SEQ ID NO: 403567 - DNA, 25 bp, Homo sapien
gacctctcggggcaccagcacttgt

SEQ ID NO: 403568 - DNA, 25 bp, Homo sapien
aacctgaagcgaggagggcccgcgt

SEQ ID NO: 403569 - DNA, 25 bp, Homo sapien
ctgaagcgaggagggcccgcgtccg

SEQ ID NO: 403570 - DNA, 25 bp, Homo sapien
ccaagccaagaagcccgatccgccc

SEQ ID NO: 403571 - DNA, 25 bp, Homo sapien
tgcgaccccaccaaggacgacaagg

SEQ ID NO: 403572 - DNA, 25 bp, Homo sapien
gcgaccccaccaaggacgacaaggg

SEQ ID NO: 403573 - DNA, 25 bp, Homo sapien
caaggacgacaagggctacttccgg

SEQ ID NO: 403574 - DNA, 25 bp, Homo sapien
tcctcccctctttgacgctgctttc

SEQ ID NO: 403575 - DNA, 25 bp, Homo sapien
gctgctttccccactccgcagtggg

SEQ ID NO: 403576 - DNA, 25 bp, Homo sapien
cgagggcggcgcgtacacggatggc

SEQ ID NO: 403577 - DNA, 25 bp, Homo sapien
tacacggatggcgagggctacacag

SEQ ID NO: 403578 - DNA, 25 bp, Homo sapien
cacggatggcgagggctacacagac

SEQ ID NO: 403579 - DNA, 25 bp, Homo sapien
ggccctacacggatgtggatgatga

SEQ ID NO: 403580 - DNA, 25 bp, Homo sapien
tacacggatgtggatgatgagcccc

SEQ ID NO: 403581 - DNA, 25 bp, Homo sapien
agcccgtgcaggcagatgagtccca

SEQ ID NO: 403582 - DNA, 25 bp, Homo sapien
cgtgcaggcagatgagtcccagagc

SEQ ID NO: 403583 - DNA, 25 bp, Homo sapien
agatgagtcccagagcccgagggat

SEQ ID NO: 403584 - DNA, 25 bp, Homo sapien
atgagtcccagagcccgagggatcg

SEQ ID NO: 403585 - DNA, 25 bp, Homo sapien
ggatcgtgggagaatctcggctcat

SEQ ID NO: 403586 - DNA, 25 bp, Homo sapien
cgtgggagaatctcggctcatcagg

SEQ ID NO: 403587 - DNA, 25 bp, Homo sapien
gaattggagccttccacatgcctaa

SEQ ID NO: 403588 - DNA, 25 bp, Homo sapien
ccttccacatgcctaacttgttagg

SEQ ID NO: 403589 - DNA, 25 bp, Homo sapien
cttgttagggcgttcatgatgtcac

SEQ ID NO: 403590 - DNA, 25 bp, Homo sapien
ggcgttcatgatgtcacaattagga

SEQ ID NO: 403591 - DNA, 25 bp, Homo sapien
aagcaaagtgtatttcctagggtca

SEQ ID NO: 403592 - DNA, 25 bp, Homo sapien
tgcggaatccctccaggaattactc

SEQ ID NO: 403593 - DNA, 25 bp, Homo sapien
aggaattactccctggtcctctcac

SEQ ID NO: 403594 - DNA, 25 bp, Homo sapien
gtatttcctagggtcacacagccta

SEQ ID NO: 403595 - DNA, 25 bp, Homo sapien
acacagcctaggtctccagactgga

SEQ ID NO: 403596 - DNA, 25 bp, Homo sapien
actggatgtccttctttctgcaggt

SEQ ID NO: 403597 - DNA, 25 bp, Homo sapien
ctgcaggtctgggtcagtatctgta

SEQ ID NO: 403598 - DNA, 25 bp, Homo sapien
agagatgctgcccatccaacaagcc

SEQ ID NO: 403599 - DNA, 25 bp, Homo sapien
ggaaccaaggccagctgagaagaac

SEQ ID NO: 403600 - DNA, 25 bp, Homo sapien
tacctggaggactcggcggtgaagc

SEQ ID NO: 403601 - DNA, 25 bp, Homo sapien
aggccagctgagaagaacccatttg

SEQ ID NO: 403602 - DNA, 25 bp, Homo sapien
gaggaccccattgacgaagggcact

SEQ ID NO: 403603 - DNA, 25 bp, Homo sapien
gaggagagctcctcgagctcgaagt

SEQ ID NO: 403604 - DNA, 25 bp, Homo sapien
gagctcgaagtccaccttaaactta

SEQ ID NO: 403605 - DNA, 25 bp, Homo sapien
gaagaacccatttgcaaagcacttt

SEQ ID NO: 403606 - DNA, 25 bp, Homo sapien
aaattcgactgattttagagcggtc

SEQ ID NO: 403607 - DNA, 25 bp, Homo sapien
actgattttagagcggtccctaggg

SEQ ID NO: 403608 - DNA, 25 bp, Homo sapien
ggtccctagggaaaggcgagcaaat

SEQ ID NO: 403609 - DNA, 25 bp, Homo sapien
gtattggagatgtgtctactattgg

SEQ ID NO: 403610 - DNA, 25 bp, Homo sapien
gaagaggttctcgtaatcgctcggt

SEQ ID NO: 403611 - DNA, 25 bp, Homo sapien
ttctcgtaatcgctcggtgggaaat

SEQ ID NO: 403612 - DNA, 25 bp, Homo sapien
ggtgggaaatcatggctctgccgtc

SEQ ID NO: 403613 - DNA, 25 bp, Homo sapien
gttcacgtggcctctgcggtgagtc

SEQ ID NO: 403614 - DNA, 25 bp, Homo sapien
ctgcggtgagtctccaagtttctgc

SEQ ID NO: 403615 - DNA, 25 bp, Homo sapien
aagtttctgcctaggcgcctgtgcg

SEQ ID NO: 403616 - DNA, 25 bp, Homo sapien
aggcgcctgtgcgtttcctttctgt

SEQ ID NO: 403617 - DNA, 25 bp, Homo sapien
ttcctttctgtgacgggattagctt

SEQ ID NO: 403618 - DNA, 25 bp, Homo sapien
gattagcttagacatccttgcaaag

SEQ ID NO: 403619 - DNA, 25 bp, Homo sapien
gacatccttgcaaagcgatcacttt

SEQ ID NO: 403620 - DNA, 25 bp, Homo sapien
tttaggctaagcacgtttgattatt

SEQ ID NO: 403621 - DNA, 25 bp, Homo sapien
gtctgtctcctatatagatctgttt

SEQ ID NO: 403622 - DNA, 25 bp, Homo sapien
gaagtttttattctatatgcccctt

SEQ ID NO: 403623 - DNA, 25 bp, Homo sapien
tatgccccttaatagactgtggttc

SEQ ID NO: 403624 - DNA, 25 bp, Homo sapien
atagactgtggttcctgacgcacac

SEQ ID NO: 403625 - DNA, 25 bp, Homo sapien
acgcacactgttaggtcattatttt

SEQ ID NO: 403626 - DNA, 25 bp, Homo sapien
ttgttgtaccaaagttctagtggct

SEQ ID NO: 403627 - DNA, 25 bp, Homo sapien
gtggcttcagaaatcatagcatcca

SEQ ID NO: 403628 - DNA, 25 bp, Homo sapien
tccaatgattttttggtgtctggct

SEQ ID NO: 403629 - DNA, 25 bp, Homo sapien
gtgtctggctatgaatactatggtt

SEQ ID NO: 403630 - DNA, 25 bp, Homo sapien
gattgtttctgcacacttttcaaat

SEQ ID NO: 403631 - DNA, 25 bp, Homo sapien
tgcccaacctttcctgataatcgtg

SEQ ID NO: 403632 - DNA, 25 bp, Homo sapien
tttcctgataatcgtggcatgcgcc

SEQ ID NO: 403633 - DNA, 25 bp, Homo sapien
ataatcgtggcatgcgccctttcct

SEQ ID NO: 403634 - DNA, 25 bp, Homo sapien
caggccagcactgcagagtttgggt

SEQ ID NO: 403635 - DNA, 25 bp, Homo sapien
tgtggccgtgatgtcgatgatactc

SEQ ID NO: 403636 - DNA, 25 bp, Homo sapien
tcgatgatactcgttttccctgatc

SEQ ID NO: 403637 - DNA, 25 bp, Homo sapien
gttttccctgatccgtggtgttgca

SEQ ID NO: 403638 - DNA, 25 bp, Homo sapien
tccgtggtgttgcagtccgttgtca

SEQ ID NO: 403639 - DNA, 25 bp, Homo sapien
ttgcagtccgttgtcaccagccttg

SEQ ID NO: 403640 - DNA, 25 bp, Homo sapien
accagccttgtttctagtgtgtata

SEQ ID NO: 403641 - DNA, 25 bp, Homo sapien
agtgtgtatatatgtcgcccccgtg

SEQ ID NO: 403642 - DNA, 25 bp, Homo sapien
tctttgcagaagagacaaccaggtg

SEQ ID NO: 403643 - DNA, 25 bp, Homo sapien
gcagaagagacaaccaggtgctgag

SEQ ID NO: 403644 - DNA, 25 bp, Homo sapien
gaggcctgaagtcataaccagacct

SEQ ID NO: 403645 - DNA, 25 bp, Homo sapien
gcctgaagtcataaccagacctggg

SEQ ID NO: 403646 - DNA, 25 bp, Homo sapien
gcactcagacaaggactggtggcca

SEQ ID NO: 403647 - DNA, 25 bp, Homo sapien
cagacaaggactggtggccaggcca

SEQ ID NO: 403648 - DNA, 25 bp, Homo sapien
aggagcagagctcagggtgtgcaca

SEQ ID NO: 403649 - DNA, 25 bp, Homo sapien
gcacagaactcagaagtcagaccac

SEQ ID NO: 403650 - DNA, 25 bp, Homo sapien
gaactcagaagtcagaccactgaac

SEQ ID NO: 403651 - DNA, 25 bp, Homo sapien
acctttcagcccattggcaatgagg

SEQ ID NO: 403652 - DNA, 25 bp, Homo sapien
agcccattggcaatgaggctgccca

SEQ ID NO: 403653 - DNA, 25 bp, Homo sapien
ggcaagtggacgagaacgttcttca

SEQ ID NO: 403654 - DNA, 25 bp, Homo sapien
gaacgttcttcagaagtgttggtgt

SEQ ID NO: 403655 - DNA, 25 bp, Homo sapien
gttggtgttggcacagaagccctgt

SEQ ID NO: 403656 - DNA, 25 bp, Homo sapien
gttggcacagaagccctgtttcctg

SEQ ID NO: 403657 - DNA, 25 bp, Homo sapien
agggtgcagtgctaggacctccctc

SEQ ID NO: 403658 - DNA, 25 bp, Homo sapien
agtgctaggacctccctctggagcg

SEQ ID NO: 403659 - DNA, 25 bp, Homo sapien
tggagcgctgccagcataccaggcc

SEQ ID NO: 403660 - DNA, 25 bp, Homo sapien
agaagggcacggatcgccggcggaa

SEQ ID NO: 403661 - DNA, 25 bp, Homo sapien
aacgctccgagccaggtcgagtaca

SEQ ID NO: 403662 - DNA, 25 bp, Homo sapien
ggtcgagtacagatgttttcccatt

SEQ ID NO: 403663 - DNA, 25 bp, Homo sapien
gatgttttcccattggcaagtggac

SEQ ID NO: 403664 - DNA, 25 bp, Homo sapien
aatgttgcagttggcttaggtcgga

SEQ ID NO: 403665 - DNA, 25 bp, Homo sapien
gttagacgctgtagacctgtgctat

SEQ ID NO: 403666 - DNA, 25 bp, Homo sapien
gaagccttctaaacctattattaca

SEQ ID NO: 403667 - DNA, 25 bp, Homo sapien
gtctctggctcacactatcgattaa

SEQ ID NO: 403668 - DNA, 25 bp, Homo sapien
aaacacacatatacgctctgtccag

SEQ ID NO: 403669 - DNA, 25 bp, Homo sapien
gacctgtgctattacggatttctcg

SEQ ID NO: 403670 - DNA, 25 bp, Homo sapien
tacgctctgtccagtagcagatact

SEQ ID NO: 403671 - DNA, 25 bp, Homo sapien
agatactgtgctcccaaggtcggca

SEQ ID NO: 403672 - DNA, 25 bp, Homo sapien
tattacggatttctcggtttcccat

SEQ ID NO: 403673 - DNA, 25 bp, Homo sapien
ggtttcccatttttacagggctgct

SEQ ID NO: 403674 - DNA, 25 bp, Homo sapien
tgaccttttgcagggattttgttcc

SEQ ID NO: 403675 - DNA, 25 bp, Homo sapien
tctatgatccgaaaaatatttgcaa

SEQ ID NO: 403676 - DNA, 25 bp, Homo sapien
tcaaagcttgatgaagttcctaaag

SEQ ID NO: 403677 - DNA, 25 bp, Homo sapien
gttcctaaagtatatagttgtctga

SEQ ID NO: 403678 - DNA, 25 bp, Homo sapien
ctactgggagaaattattgcttgtc

SEQ ID NO: 403679 - DNA, 25 bp, Homo sapien
tgcttgtctgcaattcagctacacc

SEQ ID NO: 403680 - DNA, 25 bp, Homo sapien
tgtctgcaattcagctacaccggaa

SEQ ID NO: 403681 - DNA, 25 bp, Homo sapien
gcaattcagctacaccggaacttat

SEQ ID NO: 403682 - DNA, 25 bp, Homo sapien
tcagctacaccggaacttatgatag

SEQ ID NO: 403683 - DNA, 25 bp, Homo sapien
accggaacttatgatagtgaacttc

SEQ ID NO: 403684 - DNA, 25 bp, Homo sapien
agtgaacttcttgaacaactctccc

SEQ ID NO: 403685 - DNA, 25 bp, Homo sapien
tcttgaacaactctccccactatta

SEQ ID NO: 403686 - DNA, 25 bp, Homo sapien
gaaagccaccctgtacagtttggaa

SEQ ID NO: 403687 - DNA, 25 bp, Homo sapien
gtgatgcattgccttatcttaggga

SEQ ID NO: 403688 - DNA, 25 bp, Homo sapien
atcttagggatggagctctgccgag

SEQ ID NO: 403689 - DNA, 25 bp, Homo sapien
tctgccgaggacaaccagttgctga

SEQ ID NO: 403690 - DNA, 25 bp, Homo sapien
gttgctgagaggcaaagctcatcat

SEQ ID NO: 403691 - DNA, 25 bp, Homo sapien
acaaggcacctgtgtaaacagcccc

SEQ ID NO: 403692 - DNA, 25 bp, Homo sapien
gctcatcattttgaagggctaggtg

SEQ ID NO: 403693 - DNA, 25 bp, Homo sapien
aaatgtcaccaccaccattggtaag

SEQ ID NO: 403694 - DNA, 25 bp, Homo sapien
tcaaaaggctgctgtctggactctc

SEQ ID NO: 403695 - DNA, 25 bp, Homo sapien
tggactctctccacaaacactcaga

SEQ ID NO: 403696 - DNA, 25 bp, Homo sapien
gaggctccagccagcaagggaaagc

SEQ ID NO: 403697 - DNA, 25 bp, Homo sapien
ggccctttcatcaaaaatctcacag

SEQ ID NO: 403698 - DNA, 25 bp, Homo sapien
aatctcacagccatttctaaatata

SEQ ID NO: 403699 - DNA, 25 bp, Homo sapien
acttctgtcagagggtgtttgtgat

SEQ ID NO: 403700 - DNA, 25 bp, Homo sapien
tagactttccatcctgcgtatttgc

SEQ ID NO: 403701 - DNA, 25 bp, Homo sapien
atcctgcgtatttgccatttggagc

SEQ ID NO: 403702 - DNA, 25 bp, Homo sapien
atttggagcgtggatggaacatttc

SEQ ID NO: 403703 - DNA, 25 bp, Homo sapien
gaacatttcgtaatctactcagcat

SEQ ID NO: 403704 - DNA, 25 bp, Homo sapien
gtttagaattccaacttttcgatgg

SEQ ID NO: 403705 - DNA, 25 bp, Homo sapien
tttgtgatggccgtctgttatcagc

SEQ ID NO: 403706 - DNA, 25 bp, Homo sapien
gccgtctgttatcagccgtgatcaa

SEQ ID NO: 403707 - DNA, 25 bp, Homo sapien
ttttatacttatgaaggccctttca

SEQ ID NO: 403708 - DNA, 25 bp, Homo sapien
gctgactgagatgtgctgaaaatac

SEQ ID NO: 403709 - DNA, 25 bp, Homo sapien
gcactgcagctaacacagtccagag

SEQ ID NO: 403710 - DNA, 25 bp, Homo sapien
agctaacacagtccagagcaaacgg

SEQ ID NO: 403711 - DNA, 25 bp, Homo sapien
gagcaaacggaatctgtctttttat

SEQ ID NO: 403712 - DNA, 25 bp, Homo sapien
gaatctcagctaagcttcactgtct

SEQ ID NO: 403713 - DNA, 25 bp, Homo sapien
aaacgtaacactgacatgctctctc

SEQ ID NO: 403714 - DNA, 25 bp, Homo sapien
gacatgctctctcaaagactgtttt

SEQ ID NO: 403715 - DNA, 25 bp, Homo sapien
ttttgtgcaaaaagttagctctata

SEQ ID NO: 403716 - DNA, 25 bp, Homo sapien
gttagctctataatctgcatttacc

SEQ ID NO: 403717 - DNA, 25 bp, Homo sapien
gcatttaccatgagcatcttcagac

SEQ ID NO: 403718 - DNA, 25 bp, Homo sapien
gagcatcttcagactctaaataata

SEQ ID NO: 403719 - DNA, 25 bp, Homo sapien
caaggcttcccaacacttacttgac

SEQ ID NO: 403720 - DNA, 25 bp, Homo sapien
acttacttgacctctgttgatgaaa

SEQ ID NO: 403721 - DNA, 25 bp, Homo sapien
agagcagctgtatgtggccagtccc

SEQ ID NO: 403722 - DNA, 25 bp, Homo sapien
gtgggactgaattgcgtggatctta

SEQ ID NO: 403723 - DNA, 25 bp, Homo sapien
gatcttattggccactggtagctga

SEQ ID NO: 403724 - DNA, 25 bp, Homo sapien
aagagtgaccgtatcagaaactgaa

SEQ ID NO: 403725 - DNA, 25 bp, Homo sapien
agaggtgctgtagtacgtgaattca

SEQ ID NO: 403726 - DNA, 25 bp, Homo sapien
aggttggttactctaccagcatctt

SEQ ID NO: 403727 - DNA, 25 bp, Homo sapien
agtccctgattttgctttagcctgg

SEQ ID NO: 403728 - DNA, 25 bp, Homo sapien
ggcttggctgaaataccactgcttc

SEQ ID NO: 403729 - DNA, 25 bp, Homo sapien
ttggcttgcgcagctcttagctatt

SEQ ID NO: 403730 - DNA, 25 bp, Homo sapien
acagccatggtggagaacagtttgg

SEQ ID NO: 403731 - DNA, 25 bp, Homo sapien
ttggaggttcctctaaacactgaaa

SEQ ID NO: 403732 - DNA, 25 bp, Homo sapien
aacactgaaaatagaggtgccacat

SEQ ID NO: 403733 - DNA, 25 bp, Homo sapien
aatagaggtgccacatgatccagca

SEQ ID NO: 403734 - DNA, 25 bp, Homo sapien
cccactgttggatatataccccaga

SEQ ID NO: 403735 - DNA, 25 bp, Homo sapien
tcgaagaaattatctgcactcccat

SEQ ID NO: 403736 - DNA, 25 bp, Homo sapien
tcccatgttggttgcaccactgttg

SEQ ID NO: 403737 - DNA, 25 bp, Homo sapien
catgttggttgcaccactgttgaca

SEQ ID NO: 403738 - DNA, 25 bp, Homo sapien
gttggttgcaccactgttgacaata

SEQ ID NO: 403739 - DNA, 25 bp, Homo sapien
ggttgcaccactgttgacaatagct

SEQ ID NO: 403740 - DNA, 25 bp, Homo sapien
gtccatcaacagattaatgtattaa

SEQ ID NO: 403741 - DNA, 25 bp, Homo sapien
gagtgagtatgctttccgagttgga

SEQ ID NO: 403742 - DNA, 25 bp, Homo sapien
gttggaaacacctgcgtctgaatca

SEQ ID NO: 403743 - DNA, 25 bp, Homo sapien
gaatcaacttactagctgtcacctc

SEQ ID NO: 403744 - DNA, 25 bp, Homo sapien
cggcaagtcacttcaactctgagat

SEQ ID NO: 403745 - DNA, 25 bp, Homo sapien
aaatagtactccttacctcatgacg

SEQ ID NO: 403746 - DNA, 25 bp, Homo sapien
gttactcttcatttgtgagggccca

SEQ ID NO: 403747 - DNA, 25 bp, Homo sapien
agcagccaagcagggtgagccatga

SEQ ID NO: 403748 - DNA, 25 bp, Homo sapien
aagctggtatacactgggccttcga

SEQ ID NO: 403749 - DNA, 25 bp, Homo sapien
gggccttcgatcattggtgacttca

SEQ ID NO: 403750 - DNA, 25 bp, Homo sapien
ggtgacttcatcaaggttagcattt

SEQ ID NO: 403751 - DNA, 25 bp, Homo sapien
atttgccttaggattctctgagtgt

SEQ ID NO: 403752 - DNA, 25 bp, Homo sapien
ctgtgctcgacctgagctttcaaaa

SEQ ID NO: 403753 - DNA, 25 bp, Homo sapien
gttatggaccaaatcccatagcgag

SEQ ID NO: 403754 - DNA, 25 bp, Homo sapien
aaatcccatagcgagcccctagtga

SEQ ID NO: 403755 - DNA, 25 bp, Homo sapien
cgagcccctagtgactttctgtagg

SEQ ID NO: 403756 - DNA, 25 bp, Homo sapien
agataatatatgtgctgtgtgtaat

SEQ ID NO: 403757 - DNA, 25 bp, Homo sapien
tttaaatttctccaaccgtgctgta

SEQ ID NO: 403758 - DNA, 25 bp, Homo sapien
ttctccaaccgtgctgtacaaatgt

SEQ ID NO: 403759 - DNA, 25 bp, Homo sapien
caaccgtgctgtacaaatgtgtgga

SEQ ID NO: 403760 - DNA, 25 bp, Homo sapien
ggatttgtaatcaggctattttgtt

SEQ ID NO: 403761 - DNA, 25 bp, Homo sapien
gggacgcagcccaacaaaatgagta

SEQ ID NO: 403762 - DNA, 25 bp, Homo sapien
accaggacggctgtgctgtgctcga

SEQ ID NO: 403763 - DNA, 25 bp, Homo sapien
caggtgatgcctgaaatctaagata

SEQ ID NO: 403764 - DNA, 25 bp, Homo sapien
atacactatattccttcaatccgat

SEQ ID NO: 403765 - DNA, 25 bp, Homo sapien
ttcaatccgataacctagagggcta

SEQ ID NO: 403766 - DNA, 25 bp, Homo sapien
tagagggctactaagtggtcagtgt

SEQ ID NO: 403767 - DNA, 25 bp, Homo sapien
ataagttgattcacatccagggcag

SEQ ID NO: 403768 - DNA, 25 bp, Homo sapien
gattcacatccagggcagaacagag

SEQ ID NO: 403769 - DNA, 25 bp, Homo sapien
gtaggatggtgcaagatttcatcat

SEQ ID NO: 403770 - DNA, 25 bp, Homo sapien
attttgggtgtctgttgagatctcc

SEQ ID NO: 403771 - DNA, 25 bp, Homo sapien
gatttcatcatgctacttagaatgg

SEQ ID NO: 403772 - DNA, 25 bp, Homo sapien
gctacttagaatggcctgcaaattt

SEQ ID NO: 403773 - DNA, 25 bp, Homo sapien
aatattgtagttctgccttatcctc

SEQ ID NO: 403774 - DNA, 25 bp, Homo sapien
aacaactctgttgatcagaacctgt

SEQ ID NO: 403775 - DNA, 25 bp, Homo sapien
tgatcagaacctgtggaaaacctct

SEQ ID NO: 403776 - DNA, 25 bp, Homo sapien
tgtggaaaacctctggcctctgttc

SEQ ID NO: 403777 - DNA, 25 bp, Homo sapien
aaacctctggcctctgttcagaatg

SEQ ID NO: 403778 - DNA, 25 bp, Homo sapien
tggcctctgttcagaatgagtccca

SEQ ID NO: 403779 - DNA, 25 bp, Homo sapien
gaatgagtcccatgggattccccgg

SEQ ID NO: 403780 - DNA, 25 bp, Homo sapien
gggattccccggctgtgacactcta

SEQ ID NO: 403781 - DNA, 25 bp, Homo sapien
agaacctgacgactgggccatgtga

SEQ ID NO: 403782 - DNA, 25 bp, Homo sapien
gtgacccaaggagggatccttacca

SEQ ID NO: 403783 - DNA, 25 bp, Homo sapien
ttgaacttcactcctccctcagtgg

SEQ ID NO: 403784 - DNA, 25 bp, Homo sapien
ctcagtggtagtgtccaggtgccgt

SEQ ID NO: 403785 - DNA, 25 bp, Homo sapien
ggacagccgcgcaggatgagccgga

SEQ ID NO: 403786 - DNA, 25 bp, Homo sapien
atgagccggagaccccgagggccgt

SEQ ID NO: 403787 - DNA, 25 bp, Homo sapien
gtggacctgttctttgtgctggaca

SEQ ID NO: 403788 - DNA, 25 bp, Homo sapien
tggacacctctgagagcgtggccct

SEQ ID NO: 403789 - DNA, 25 bp, Homo sapien
acacctctgagagcgtggccctgag

SEQ ID NO: 403790 - DNA, 25 bp, Homo sapien
tcgtggacaaagtcaagtccttcac

SEQ ID NO: 403791 - DNA, 25 bp, Homo sapien
tcaagtccttcaccaagcgcttcat

SEQ ID NO: 403792 - DNA, 25 bp, Homo sapien
cctgagggacaggtactaccgctgt

SEQ ID NO: 403793 - DNA, 25 bp, Homo sapien
ggacaggtactaccgctgtgaccga

SEQ ID NO: 403794 - DNA, 25 bp, Homo sapien
gtactaccgctgtgaccgaaacctg

SEQ ID NO: 403795 - DNA, 25 bp, Homo sapien
ctgtgaccgaaacctggtgtggaac

SEQ ID NO: 403796 - DNA, 25 bp, Homo sapien
cgggcaacaggggcgctcccgggat

SEQ ID NO: 403797 - DNA, 25 bp, Homo sapien
gggcaacaggggcgctcccgggata

SEQ ID NO: 403798 - DNA, 25 bp, Homo sapien
ggcaacaggggcgctcccgggataa

SEQ ID NO: 403799 - DNA, 25 bp, Homo sapien
gcaacaggggcgctcccgggataaa

SEQ ID NO: 403800 - DNA, 25 bp, Homo sapien
gggcgctcccgggataaacggcacg

SEQ ID NO: 403801 - DNA, 25 bp, Homo sapien
ggcgctcccgggataaacggcacga

SEQ ID NO: 403802 - DNA, 25 bp, Homo sapien
gcgctcccgggataaacggcacgaa

SEQ ID NO: 403803 - DNA, 25 bp, Homo sapien
cgctcccgggataaacggcacgaag

SEQ ID NO: 403804 - DNA, 25 bp, Homo sapien
gctcccgggataaacggcacgaagg

SEQ ID NO: 403805 - DNA, 25 bp, Homo sapien
gaattccataagaaccccttgcatt

SEQ ID NO: 403806 - DNA, 25 bp, Homo sapien
agaaccccttgcattgtgtggacgg

SEQ ID NO: 403807 - DNA, 25 bp, Homo sapien
gtgtggacggttaactctgaagatc

SEQ ID NO: 403808 - DNA, 25 bp, Homo sapien
gagaactcacgcaactttcctgaga

SEQ ID NO: 403809 - DNA, 25 bp, Homo sapien
gcacagcggctgagaagcagtcact

SEQ ID NO: 403810 - DNA, 25 bp, Homo sapien
gaagcagtcactgccaaccagcgtt

SEQ ID NO: 403811 - DNA, 25 bp, Homo sapien
cagcgttccataagcccctaacagg

SEQ ID NO: 403812 - DNA, 25 bp, Homo sapien
tcccgggcactggtcggaacacaaa

SEQ ID NO: 403813 - DNA, 25 bp, Homo sapien
gaatctgggttggtccttcaaggca

SEQ ID NO: 403814 - DNA, 25 bp, Homo sapien
taccatttattgatcacctgccctg

SEQ ID NO: 403815 - DNA, 25 bp, Homo sapien
gtttacactcatgatctgatttctt

SEQ ID NO: 403816 - DNA, 25 bp, Homo sapien
gataattgctaatctggaatggaca

SEQ ID NO: 403817 - DNA, 25 bp, Homo sapien
ctggaatggacatacttcttgatct

SEQ ID NO: 403818 - DNA, 25 bp, Homo sapien
gatgaagacactttttatagccctg

SEQ ID NO: 403819 - DNA, 25 bp, Homo sapien
gacactttttatagccctgttcaga

SEQ ID NO: 403820 - DNA, 25 bp, Homo sapien
gttcagaatacagaaggagacctac

SEQ ID NO: 403821 - DNA, 25 bp, Homo sapien
aaggagacctactcttctttgatca

SEQ ID NO: 403822 - DNA, 25 bp, Homo sapien
gacctactcttctttgatcacaatc

SEQ ID NO: 403823 - DNA, 25 bp, Homo sapien
gaaagatctgtcatggattaaatat

SEQ ID NO: 403824 - DNA, 25 bp, Homo sapien
gaaacaaaactagtctttcaatgaa

SEQ ID NO: 403825 - DNA, 25 bp, Homo sapien
aaatcagaccaggatcacttggcgt

SEQ ID NO: 403826 - DNA, 25 bp, Homo sapien
agaccaggatcacttggcgtaccat

SEQ ID NO: 403827 - DNA, 25 bp, Homo sapien
tgtggcgtcccagttcattgagagc

SEQ ID NO: 403828 - DNA, 25 bp, Homo sapien
agttcattgagagcgcgtgccttgc

SEQ ID NO: 403829 - DNA, 25 bp, Homo sapien
gtgccttgcggaacaacgcccggat

SEQ ID NO: 403830 - DNA, 25 bp, Homo sapien
ccttctcatacaggcccatggtgaa

SEQ ID NO: 403831 - DNA, 25 bp, Homo sapien
catggtgaagtagcaggcggcccta

SEQ ID NO: 403832 - DNA, 25 bp, Homo sapien
aggcggccctattgacatgcagctt

SEQ ID NO: 403833 - DNA, 25 bp, Homo sapien
agaggcagcgtagtcggccacgttc

SEQ ID NO: 403834 - DNA, 25 bp, Homo sapien
agcccttccatgtactgcaccagag

SEQ ID NO: 403835 - DNA, 25 bp, Homo sapien
accagagcctgcttatagtccttct

SEQ ID NO: 403836 - DNA, 25 bp, Homo sapien
ggaacagatcattgccctcagcaaa

SEQ ID NO: 403837 - DNA, 25 bp, Homo sapien
tgccctcagcaaacagattctgcac

SEQ ID NO: 403838 - DNA, 25 bp, Homo sapien
gtttgtctttgcctccaagttgagg

SEQ ID NO: 403839 - DNA, 25 bp, Homo sapien
tttgcctccaagttgaggaagagca

SEQ ID NO: 403840 - DNA, 25 bp, Homo sapien
tgtgcaggtcctggcttgtggccct

SEQ ID NO: 403841 - DNA, 25 bp, Homo sapien
gaagtaggcacagacccctagaggc

SEQ ID NO: 403842 - DNA, 25 bp, Homo sapien
ctaggacagcccctgacctttgtct

SEQ ID NO: 403843 - DNA, 25 bp, Homo sapien
ctgacctttgtctctctggttttcc

SEQ ID NO: 403844 - DNA, 25 bp, Homo sapien
gcacagacccctagaggcgactctg

SEQ ID NO: 403845 - DNA, 25 bp, Homo sapien
ccaagggtggcctgcctcggtgcaa

SEQ ID NO: 403846 - DNA, 25 bp, Homo sapien
ctgcctcggtgcaagcagctgcttc

SEQ ID NO: 403847 - DNA, 25 bp, Homo sapien
agctgcttctctatggtggcaaaat

SEQ ID NO: 403848 - DNA, 25 bp, Homo sapien
gcttctctatggtggcaaaatttgg

SEQ ID NO: 403849 - DNA, 25 bp, Homo sapien
ttctgcatcagcacagatgcttatc

SEQ ID NO: 403850 - DNA, 25 bp, Homo sapien
atgcttatccattgacttccagtca

SEQ ID NO: 403851 - DNA, 25 bp, Homo sapien
gcttcaggagctgtagtgtttatca

SEQ ID NO: 403852 - DNA, 25 bp, Homo sapien
taagaaaacctcaggctcagttttt

SEQ ID NO: 403853 - DNA, 25 bp, Homo sapien
tatgttgcatggaatacagtttcat

SEQ ID NO: 403854 - DNA, 25 bp, Homo sapien
acagtttcatgggttgtcataggtc

SEQ ID NO: 403855 - DNA, 25 bp, Homo sapien
gggttgtcataggtcttctgcaaaa

SEQ ID NO: 403856 - DNA, 25 bp, Homo sapien
ataaaggagtttcgtgaacagacac

SEQ ID NO: 403857 - DNA, 25 bp, Homo sapien
gtgtttatcagatctgctccatggg

SEQ ID NO: 403858 - DNA, 25 bp, Homo sapien
cagatctgctccatgggtggccaaa

SEQ ID NO: 403859 - DNA, 25 bp, Homo sapien
gtctcaatggccaggactgggcgcc

SEQ ID NO: 403860 - DNA, 25 bp, Homo sapien
agccatggcgcccaaccatcttttg

SEQ ID NO: 403861 - DNA, 25 bp, Homo sapien
atggcgcccaaccatcttttgcaaa

SEQ ID NO: 403862 - DNA, 25 bp, Homo sapien
tggcgcccaaccatcttttgcaaat

SEQ ID NO: 403863 - DNA, 25 bp, Homo sapien
gacaatgctaaaaggaagtgacaac

SEQ ID NO: 403864 - DNA, 25 bp, Homo sapien
aatgctaaaaggaagtgacaactga

SEQ ID NO: 403865 - DNA, 25 bp, Homo sapien
actaatggtcacagtcagtcaagac

SEQ ID NO: 403866 - DNA, 25 bp, Homo sapien
ctaatggtcacagtcagtcaagact

SEQ ID NO: 403867 - DNA, 25 bp, Homo sapien
taatggtcacagtcagtcaagactt

SEQ ID NO: 403868 - DNA, 25 bp, Homo sapien
aatggtcacagtcagtcaagacttc

SEQ ID NO: 403869 - DNA, 25 bp, Homo sapien
atggtcacagtcagtcaagacttcc

SEQ ID NO: 403870 - DNA, 25 bp, Homo sapien
tggtcacagtcagtcaagacttccc

SEQ ID NO: 403871 - DNA, 25 bp, Homo sapien
gatgttgctccaagaggcattctgt

SEQ ID NO: 403872 - DNA, 25 bp, Homo sapien
gaggcattctgtagttcacatactg

SEQ ID NO: 403873 - DNA, 25 bp, Homo sapien
gttcacatactgcatttgtctgcca

SEQ ID NO: 403874 - DNA, 25 bp, Homo sapien
gcatttgtctgccagtgtttctgga

SEQ ID NO: 403875 - DNA, 25 bp, Homo sapien
gtgtttctggaaatcactgagtaaa

SEQ ID NO: 403876 - DNA, 25 bp, Homo sapien
agaacttacatagcgaatcctcata

SEQ ID NO: 403877 - DNA, 25 bp, Homo sapien
attaccaaatcttcagttatctcta

SEQ ID NO: 403878 - DNA, 25 bp, Homo sapien
gttatctctatttatgatttcatct

SEQ ID NO: 403879 - DNA, 25 bp, Homo sapien
gatttcatcttagatataggtgtct

SEQ ID NO: 403880 - DNA, 25 bp, Homo sapien
atataggtgtctacaaactaacgga

SEQ ID NO: 403881 - DNA, 25 bp, Homo sapien
gcactttgcttatatctaagaggct

SEQ ID NO: 403882 - DNA, 25 bp, Homo sapien
aattcggatctagattttactttct

SEQ ID NO: 403883 - DNA, 25 bp, Homo sapien
tactttctagatgattgactcgagg

SEQ ID NO: 403884 - DNA, 25 bp, Homo sapien
gtagtaaaatcgcttgtctggtcac

SEQ ID NO: 403885 - DNA, 25 bp, Homo sapien
gtctggtcacaaacatttggcagca

SEQ ID NO: 403886 - DNA, 25 bp, Homo sapien
ggcagcagagcttttgattaggttc

SEQ ID NO: 403887 - DNA, 25 bp, Homo sapien
ttgattaggttctttgacaaagcct

SEQ ID NO: 403888 - DNA, 25 bp, Homo sapien
acaaagccttcagcacgttagagtg

SEQ ID NO: 403889 - DNA, 25 bp, Homo sapien
agcacgttagagtggttttcactaa

SEQ ID NO: 403890 - DNA, 25 bp, Homo sapien
aaaaggttgtccatagttctctagt

SEQ ID NO: 403891 - DNA, 25 bp, Homo sapien
tgtccatagttctctagtttgctaa

SEQ ID NO: 403892 - DNA, 25 bp, Homo sapien
gaacgtggagtaacttcctcttgtt

SEQ ID NO: 403893 - DNA, 25 bp, Homo sapien
atgaagtgcttcttttatatgttaa

SEQ ID NO: 403894 - DNA, 25 bp, Homo sapien
gttaagtttaggttgccagtactca

SEQ ID NO: 403895 - DNA, 25 bp, Homo sapien
ggttgccagtactcataatttttat

SEQ ID NO: 403896 - DNA, 25 bp, Homo sapien
taatgagttgtttgcatgcctactt

SEQ ID NO: 403897 - DNA, 25 bp, Homo sapien
gtttgcatgcctacttaacccaagt

SEQ ID NO: 403898 - DNA, 25 bp, Homo sapien
cttaacccaagtaaaacgatgctgt

SEQ ID NO: 403899 - DNA, 25 bp, Homo sapien
aaaacgatgctgtttgctctggaat

SEQ ID NO: 403900 - DNA, 25 bp, Homo sapien
ttgctctggaatgttcatcttttag

SEQ ID NO: 403901 - DNA, 25 bp, Homo sapien
catcttttagacaggttttggctca

SEQ ID NO: 403902 - DNA, 25 bp, Homo sapien
tttggctcatttccaatcatggtgc

SEQ ID NO: 403903 - DNA, 25 bp, Homo sapien
tggtgcaatatagtgtaacattcat

SEQ ID NO: 403904 - DNA, 25 bp, Homo sapien
tttcaccatagaaattgtgccctaa

SEQ ID NO: 403905 - DNA, 25 bp, Homo sapien
gaaattgtgccctaatagtgattaa

SEQ ID NO: 403906 - DNA, 25 bp, Homo sapien
gtgattaagtgctttaccactgtta

SEQ ID NO: 403907 - DNA, 25 bp, Homo sapien
ggaaaacataaattgcctgcagtta

SEQ ID NO: 403908 - DNA, 25 bp, Homo sapien
aaccatgtgctttgttgacaaaatt

SEQ ID NO: 403909 - DNA, 25 bp, Homo sapien
aaaattttgatcctctgtgttgccc

SEQ ID NO: 403910 - DNA, 25 bp, Homo sapien
tgtgttgccccattttcagatactc

SEQ ID NO: 403911 - DNA, 25 bp, Homo sapien
ttgccccattttcagatactctttt

SEQ ID NO: 403912 - DNA, 25 bp, Homo sapien
tgaataccgttctcaccagttggca

SEQ ID NO: 403913 - DNA, 25 bp, Homo sapien
accagttggcataggttggaactca

SEQ ID NO: 403914 - DNA, 25 bp, Homo sapien
ggaactcagaattaatttcaccata

SEQ ID NO: 403915 - DNA, 25 bp, Homo sapien
ggattgctggatcatgtggcacctc

SEQ ID NO: 403916 - DNA, 25 bp, Homo sapien
ggatcatgtggcacctctattttca

SEQ ID NO: 403917 - DNA, 25 bp, Homo sapien
tgtggcacctctattttcagtgttt

SEQ ID NO: 403918 - DNA, 25 bp, Homo sapien
ttttcagtgtttagaggaacctcca

SEQ ID NO: 403919 - DNA, 25 bp, Homo sapien
aaactgttctccaccatggctgtac

SEQ ID NO: 403920 - DNA, 25 bp, Homo sapien
ttgaaagagtaaccacttacttaat

SEQ ID NO: 403921 - DNA, 25 bp, Homo sapien
aagcgcaatattccttcctttgcat

SEQ ID NO: 403922 - DNA, 25 bp, Homo sapien
aatattccttcctttgcatggcatg

SEQ ID NO: 403923 - DNA, 25 bp, Homo sapien
attccttcctttgcatggcatgcag

SEQ ID NO: 403924 - DNA, 25 bp, Homo sapien
tggcatgcaggaatggtgaaagcaa

SEQ ID NO: 403925 - DNA, 25 bp, Homo sapien
agcaaagaaacagtcatcccttctc

SEQ ID NO: 403926 - DNA, 25 bp, Homo sapien
gatcacaggtgtgagttaccactcg

SEQ ID NO: 403927 - DNA, 25 bp, Homo sapien
gctggagtgtgatagtgtgaccaca

SEQ ID NO: 403928 - DNA, 25 bp, Homo sapien
ctggagtgtgatagtgtgaccacag

SEQ ID NO: 403929 - DNA, 25 bp, Homo sapien
tggagtgtgatagtgtgaccacagc

SEQ ID NO: 403930 - DNA, 25 bp, Homo sapien
ggagtgtgatagtgtgaccacagct

SEQ ID NO: 403931 - DNA, 25 bp, Homo sapien
gagtgtgatagtgtgaccacagctc

SEQ ID NO: 403932 - DNA, 25 bp, Homo sapien
agtgtgatagtgtgaccacagctca

SEQ ID NO: 403933 - DNA, 25 bp, Homo sapien
gtgtgatagtgtgaccacagctcac

SEQ ID NO: 403934 - DNA, 25 bp, Homo sapien
tgtgatagtgtgaccacagctcact

SEQ ID NO: 403935 - DNA, 25 bp, Homo sapien
gtgatagtgtgaccacagctcactg

SEQ ID NO: 403936 - DNA, 25 bp, Homo sapien
tgatagtgtgaccacagctcactgc

SEQ ID NO: 403937 - DNA, 25 bp, Homo sapien
gattgcagcccagttatattttgct

SEQ ID NO: 403938 - DNA, 25 bp, Homo sapien
agtttcatggatggcagatgctgga

SEQ ID NO: 403939 - DNA, 25 bp, Homo sapien
tttctgtgcttaattgatccatcct

SEQ ID NO: 403940 - DNA, 25 bp, Homo sapien
tctgtgcttaattgatccatcctct

SEQ ID NO: 403941 - DNA, 25 bp, Homo sapien
acttcaatgcaatgtgtatatccat

SEQ ID NO: 403942 - DNA, 25 bp, Homo sapien
caatgtgtatatccatgtattgcag

SEQ ID NO: 403943 - DNA, 25 bp, Homo sapien
atgctggagaaaggcagatatgtga

SEQ ID NO: 403944 - DNA, 25 bp, Homo sapien
atgtgagcttatatcaaaccctagg

SEQ ID NO: 403945 - DNA, 25 bp, Homo sapien
gagcttatatcaaaccctaggagat

SEQ ID NO: 403946 - DNA, 25 bp, Homo sapien
tcaaaccctaggagattcaacttta

SEQ ID NO: 403947 - DNA, 25 bp, Homo sapien
aaaacctggctctttactcactggg

SEQ ID NO: 403948 - DNA, 25 bp, Homo sapien
gaagaacttctccatgttccagagg

SEQ ID NO: 403949 - DNA, 25 bp, Homo sapien
gtgcctgcattttccccgaattgtt

SEQ ID NO: 403950 - DNA, 25 bp, Homo sapien
agaggcgcgttcttactgcagatgg

SEQ ID NO: 403951 - DNA, 25 bp, Homo sapien
actgcagatggcgacactgaggccc

SEQ ID NO: 403952 - DNA, 25 bp, Homo sapien
agacatcatgaccagcctcaggtcc

SEQ ID NO: 403953 - DNA, 25 bp, Homo sapien
tgcagcctgctgctctgtagcctaa

SEQ ID NO: 403954 - DNA, 25 bp, Homo sapien
gtagcctaaatcagatcactgtccc

SEQ ID NO: 403955 - DNA, 25 bp, Homo sapien
tcactgtcccagctttcaggtcaag

SEQ ID NO: 403956 - DNA, 25 bp, Homo sapien
aaggctctggttgtgacacctgggc

SEQ ID NO: 403957 - DNA, 25 bp, Homo sapien
cgaattgtttaaccctcatgcttca

SEQ ID NO: 403958 - DNA, 25 bp, Homo sapien
ggtgaacagagatccctttaagaag

SEQ ID NO: 403959 - DNA, 25 bp, Homo sapien
atccacatttcttactatcccttta

SEQ ID NO: 403960 - DNA, 25 bp, Homo sapien
ttcttactatccctttagcttatcc

SEQ ID NO: 403961 - DNA, 25 bp, Homo sapien
atccctttagcttatccttcagtga

SEQ ID NO: 403962 - DNA, 25 bp, Homo sapien
atccttcagtgacttaggtttttgt

SEQ ID NO: 403963 - DNA, 25 bp, Homo sapien
tgtttgatggcaatccttaccattt

SEQ ID NO: 403964 - DNA, 25 bp, Homo sapien
ggttctgttgaagtatgtaatgtga

SEQ ID NO: 403965 - DNA, 25 bp, Homo sapien
cctctagtctccatccttaacaaga

SEQ ID NO: 403966 - DNA, 25 bp, Homo sapien
gtctccatccttaacaagagtcttg

SEQ ID NO: 403967 - DNA, 25 bp, Homo sapien
gatatgtgactcatagatgaaccat

SEQ ID NO: 403968 - DNA, 25 bp, Homo sapien
agatgaaccataatgacactgtaga

SEQ ID NO: 403969 - DNA, 25 bp, Homo sapien
acttttccaccatccacatttctta

SEQ ID NO: 403970 - DNA, 25 bp, Homo sapien
gaaccccgagagacagagctgacac

SEQ ID NO: 403971 - DNA, 25 bp, Homo sapien
gggtatttattcaccaagtctatca

SEQ ID NO: 403972 - DNA, 25 bp, Homo sapien
attcaccaagtctatcacttatgaa

SEQ ID NO: 403973 - DNA, 25 bp, Homo sapien
ctggaaacaatttctgactggccct

SEQ ID NO: 403974 - DNA, 25 bp, Homo sapien
tgcacacacctgagcatacttccta

SEQ ID NO: 403975 - DNA, 25 bp, Homo sapien
acctgagcatacttcctaagccggg

SEQ ID NO: 403976 - DNA, 25 bp, Homo sapien
tccctgagctgagacaggcgttcgt

SEQ ID NO: 403977 - DNA, 25 bp, Homo sapien
gacaggcgttcgtgacaagcagact

SEQ ID NO: 403978 - DNA, 25 bp, Homo sapien
cgtgacaagcagacttcgagtggaa

SEQ ID NO: 403979 - DNA, 25 bp, Homo sapien
gacttcgagtggaaggcaggcatca

SEQ ID NO: 403980 - DNA, 25 bp, Homo sapien
gagtggaaggcaggcatcagaacca

SEQ ID NO: 403981 - DNA, 25 bp, Homo sapien
gttgctactgtgtgaataatttggc

SEQ ID NO: 403982 - DNA, 25 bp, Homo sapien
ataatttggcatgtctatctagcta

SEQ ID NO: 403983 - DNA, 25 bp, Homo sapien
ggcatgtctatctagctatatgagc

SEQ ID NO: 403984 - DNA, 25 bp, Homo sapien
tctagctatatgagcattgtgctta

SEQ ID NO: 403985 - DNA, 25 bp, Homo sapien
agtatgggctatacaatgtaggcat

SEQ ID NO: 403986 - DNA, 25 bp, Homo sapien
gtaggcataatgtgtatctgaaaaa

SEQ ID NO: 403987 - DNA, 25 bp, Homo sapien
agatggaaagtgtgctgactcagct

SEQ ID NO: 403988 - DNA, 25 bp, Homo sapien
ctgactcagctggttcagtttctgg

SEQ ID NO: 403989 - DNA, 25 bp, Homo sapien
agcagcttaaccacttctctcaagt

SEQ ID NO: 403990 - DNA, 25 bp, Homo sapien
gtaaaaagccctccagtacacaata

SEQ ID NO: 403991 - DNA, 25 bp, Homo sapien
gccctccagtacacaataaaatctt

SEQ ID NO: 403992 - DNA, 25 bp, Homo sapien
gctagaaaattcatgtagttacttt

SEQ ID NO: 403993 - DNA, 25 bp, Homo sapien
tattgatttttgtatctgccacagt

SEQ ID NO: 403994 - DNA, 25 bp, Homo sapien
gatttttgtatctgccacagtaaat

SEQ ID NO: 403995 - DNA, 25 bp, Homo sapien
gccacagtaaattaaagcattacac

SEQ ID NO: 403996 - DNA, 25 bp, Homo sapien
ttacacagtatttatcagtattttt

SEQ ID NO: 403997 - DNA, 25 bp, Homo sapien
ttaaaatctttgcttagtcagtcat

SEQ ID NO: 403998 - DNA, 25 bp, Homo sapien
aatctttgcttagtcagtcatattt

SEQ ID NO: 403999 - DNA, 25 bp, Homo sapien
tgcttagtcagtcatatttttgtct

SEQ ID NO: 404000 - DNA, 25 bp, Homo sapien
gtatgattagaagtttttacgtcct

SEQ ID NO: 404001 - DNA, 25 bp, Homo sapien
ctgtattgtattaatttctggatgc

SEQ ID NO: 404002 - DNA, 25 bp, Homo sapien
tattaatttctggatgcaatttttc

SEQ ID NO: 404003 - DNA, 25 bp, Homo sapien
gacagctctgagctattcgtgatgc

SEQ ID NO: 404004 - DNA, 25 bp, Homo sapien
tgagctattcgtgatgctggccact

SEQ ID NO: 404005 - DNA, 25 bp, Homo sapien
tattcgtgatgctggccactcttct

SEQ ID NO: 404006 - DNA, 25 bp, Homo sapien
tcccacctctgccttggagtgggtg

SEQ ID NO: 404007 - DNA, 25 bp, Homo sapien
ccttggagtgggtggtatttcagtt

SEQ ID NO: 404008 - DNA, 25 bp, Homo sapien
aagggacttgttctaggctatgcag

SEQ ID NO: 404009 - DNA, 25 bp, Homo sapien
taggctatgcagctaacaggtagta

SEQ ID NO: 404010 - DNA, 25 bp, Homo sapien
actgagatggataagcctgggtgct

SEQ ID NO: 404011 - DNA, 25 bp, Homo sapien
cccattaggctgtgaactccttgaa

SEQ ID NO: 404012 - DNA, 25 bp, Homo sapien
actccttgaagtcaggaactgtgtg

SEQ ID NO: 404013 - DNA, 25 bp, Homo sapien
gtgtgttactcatcgttcagtcacc

SEQ ID NO: 404014 - DNA, 25 bp, Homo sapien
tgtcctgcagctgttgtgttttata

SEQ ID NO: 404015 - DNA, 25 bp, Homo sapien
gcagctgttgtgttttatataagac

SEQ ID NO: 404016 - DNA, 25 bp, Homo sapien
tgttaacatagtgaccaataagtac

SEQ ID NO: 404017 - DNA, 25 bp, Homo sapien
tttggcatctaaaaatctcactgta

SEQ ID NO: 404018 - DNA, 25 bp, Homo sapien
aatctcactgtagcacaactctttg

SEQ ID NO: 404019 - DNA, 25 bp, Homo sapien
cactgtagcacaactctttgcacct

SEQ ID NO: 404020 - DNA, 25 bp, Homo sapien
ttttgcttcaaatatgccagtcatg

SEQ ID NO: 404021 - DNA, 25 bp, Homo sapien
caaatatgccagtcatgagtcaatt

SEQ ID NO: 404022 - DNA, 25 bp, Homo sapien
gatacaaacaaaacagagctcttta

SEQ ID NO: 404023 - DNA, 25 bp, Homo sapien
gagctctttaataagcttcactatt

SEQ ID NO: 404024 - DNA, 25 bp, Homo sapien
cactattaagtgcaactgagccatt

SEQ ID NO: 404025 - DNA, 25 bp, Homo sapien
gaatgatacacccatatgctatata

SEQ ID NO: 404026 - DNA, 25 bp, Homo sapien
tacacccatatgctatatacagctt

SEQ ID NO: 404027 - DNA, 25 bp, Homo sapien
gctatatacagcttaactcacagaa

SEQ ID NO: 404028 - DNA, 25 bp, Homo sapien
tgtccatctttttagtgataataaa

SEQ ID NO: 404029 - DNA, 25 bp, Homo sapien
gaaagcatggtattaaactatcata

SEQ ID NO: 404030 - DNA, 25 bp, Homo sapien
atagatgttccttttgtgaagcacc

SEQ ID NO: 404031 - DNA, 25 bp, Homo sapien
gttccttttgtgaagcaccttgatt

SEQ ID NO: 404032 - DNA, 25 bp, Homo sapien
gtgaagcaccttgattccttgattt

SEQ ID NO: 404033 - DNA, 25 bp, Homo sapien
gcaccttgattccttgattttgatt

SEQ ID NO: 404034 - DNA, 25 bp, Homo sapien
ttttgcaaagttagacaatggcaca

SEQ ID NO: 404035 - DNA, 25 bp, Homo sapien
caatggcacaaagtcaaaatgaaat

SEQ ID NO: 404036 - DNA, 25 bp, Homo sapien
aatttgggattccacagtgccttgc

SEQ ID NO: 404037 - DNA, 25 bp, Homo sapien
tgggattccacagtgccttgcatat

SEQ ID NO: 404038 - DNA, 25 bp, Homo sapien
cttgcatatagtaggcgcccagtaa

SEQ ID NO: 404039 - DNA, 25 bp, Homo sapien
gcaaaccaagtttcccaagtcctca

SEQ ID NO: 404040 - DNA, 25 bp, Homo sapien
tttcccaagtcctcatctcttatag

SEQ ID NO: 404041 - DNA, 25 bp, Homo sapien
caagtcctcatctcttatagtgacc

SEQ ID NO: 404042 - DNA, 25 bp, Homo sapien
aagggcttggcagttgtggctaaaa

SEQ ID NO: 404043 - DNA, 25 bp, Homo sapien
aaataagcagtatcattatttgctt

SEQ ID NO: 404044 - DNA, 25 bp, Homo sapien
gcttgaaatcatatatacagtttgt

SEQ ID NO: 404045 - DNA, 25 bp, Homo sapien
gccaagacatgattttttcttattg

SEQ ID NO: 404046 - DNA, 25 bp, Homo sapien
atttctggcactgaactgtaaagta

SEQ ID NO: 404047 - DNA, 25 bp, Homo sapien
aaggctgactctgtcaggatgccct

SEQ ID NO: 404048 - DNA, 25 bp, Homo sapien
cctggcctctggacaaagggaaatg

SEQ ID NO: 404049 - DNA, 25 bp, Homo sapien
aaatggtgaaacagtggaccctcag

SEQ ID NO: 404050 - DNA, 25 bp, Homo sapien
tggtgaaacagtggaccctcaggga

SEQ ID NO: 404051 - DNA, 25 bp, Homo sapien
cagggagcttctgagcctctgctga

SEQ ID NO: 404052 - DNA, 25 bp, Homo sapien
ttctgagcctctgctgacaagggaa

SEQ ID NO: 404053 - DNA, 25 bp, Homo sapien
gcctctgctgacaagggaagggcac

SEQ ID NO: 404054 - DNA, 25 bp, Homo sapien
agggaagggcacagatcctacccac

SEQ ID NO: 404055 - DNA, 25 bp, Homo sapien
ggcacagatcctacccactcatatt

SEQ ID NO: 404056 - DNA, 25 bp, Homo sapien
tgtgccggacatcctgggcaggagt

SEQ ID NO: 404057 - DNA, 25 bp, Homo sapien
ctgggcaggagtgtggtcctcctta

SEQ ID NO: 404058 - DNA, 25 bp, Homo sapien
gtctgatgagatatgaatagccaca

SEQ ID NO: 404059 - DNA, 25 bp, Homo sapien
gagatatgaatagccacaacaataa

SEQ ID NO: 404060 - DNA, 25 bp, Homo sapien
gccacaacaataaaactgtgtgcta

SEQ ID NO: 404061 - DNA, 25 bp, Homo sapien
ctgtgtgctaagattaacgtctgag

SEQ ID NO: 404062 - DNA, 25 bp, Homo sapien
gattaacgtctgagtagctttaaag

SEQ ID NO: 404063 - DNA, 25 bp, Homo sapien
tttagttcttttaatctgaaatggt

SEQ ID NO: 404064 - DNA, 25 bp, Homo sapien
atctgaaatggtttagactatcttc

SEQ ID NO: 404065 - DNA, 25 bp, Homo sapien
tactggaaatagttgaaaagcttta

SEQ ID NO: 404066 - DNA, 25 bp, Homo sapien
gctttataaggccaaggttacccag

SEQ ID NO: 404067 - DNA, 25 bp, Homo sapien
tataaggccaaggttacccaggcag

SEQ ID NO: 404068 - DNA, 25 bp, Homo sapien
gagagctttgcagagaaataacaga

SEQ ID NO: 404069 - DNA, 25 bp, Homo sapien
gacagtttactttggtaggttattg

SEQ ID NO: 404070 - DNA, 25 bp, Homo sapien
tactttggtaggttattgtgaatcc

SEQ ID NO: 404071 - DNA, 25 bp, Homo sapien
gtgaatcctgaatactatgcctcct

SEQ ID NO: 404072 - DNA, 25 bp, Homo sapien
tgaatactatgcctccttcactgta

SEQ ID NO: 404073 - DNA, 25 bp, Homo sapien
actatgcctccttcactgtaaagtg

SEQ ID NO: 404074 - DNA, 25 bp, Homo sapien
attagtataaactgctggcatacac

SEQ ID NO: 404075 - DNA, 25 bp, Homo sapien
acatacatactgagtagtcttgaga

SEQ ID NO: 404076 - DNA, 25 bp, Homo sapien
gaagggatgcaactagatacccatg

SEQ ID NO: 404077 - DNA, 25 bp, Homo sapien
tgcaactagatacccatggcatcag

SEQ ID NO: 404078 - DNA, 25 bp, Homo sapien
acctgaaagccttgctttttccttg

SEQ ID NO: 404079 - DNA, 25 bp, Homo sapien
ttccttgtgccttaggaatttcctc

SEQ ID NO: 404080 - DNA, 25 bp, Homo sapien
agcacccgccctgagtggacaccgc

SEQ ID NO: 404081 - DNA, 25 bp, Homo sapien
cacccagagcgtcacagaagggcaa

SEQ ID NO: 404082 - DNA, 25 bp, Homo sapien
acctgaccctgcacccaggtgggtg

SEQ ID NO: 404083 - DNA, 25 bp, Homo sapien
cacccaggtgggtgttcgctcctgc

SEQ ID NO: 404084 - DNA, 25 bp, Homo sapien
ccctttctgccacggggagagttgc

SEQ ID NO: 404085 - DNA, 25 bp, Homo sapien
gggaaacaggctccgtttgtgcctc

SEQ ID NO: 404086 - DNA, 25 bp, Homo sapien
gaaacaggctccgtttgtgcctcgc

SEQ ID NO: 404087 - DNA, 25 bp, Homo sapien
tgtgcctcgccttcctgacttgtga

SEQ ID NO: 404088 - DNA, 25 bp, Homo sapien
gcctcgccttcctgacttgtgacaa

SEQ ID NO: 404089 - DNA, 25 bp, Homo sapien
ctgacttgtgacaatgacaaacagt

SEQ ID NO: 404090 - DNA, 25 bp, Homo sapien
gtgacaatgacaaacagtctcagct

SEQ ID NO: 404091 - DNA, 25 bp, Homo sapien
aactgtggtgccaaattgctggtgt

SEQ ID NO: 404092 - DNA, 25 bp, Homo sapien
ctgtggtgccaaattgctggtgtct

SEQ ID NO: 404093 - DNA, 25 bp, Homo sapien
gtggtgccaaattgctggtgtctct

SEQ ID NO: 404094 - DNA, 25 bp, Homo sapien
tggtgccaaattgctggtgtctctc

SEQ ID NO: 404095 - DNA, 25 bp, Homo sapien
tggagaaaccaaccagatacatctg

SEQ ID NO: 404096 - DNA, 25 bp, Homo sapien
gaaaccaaccagatacatctgctgg

SEQ ID NO: 404097 - DNA, 25 bp, Homo sapien
aaccaaccagatacatctgctggag

SEQ ID NO: 404098 - DNA, 25 bp, Homo sapien
aaccagatacatctgctggagagcc

SEQ ID NO: 404099 - DNA, 25 bp, Homo sapien
cagatacatctgctggagagcccag

SEQ ID NO: 404100 - DNA, 25 bp, Homo sapien
gatacatctgctggagagcccaggt

SEQ ID NO: 404101 - DNA, 25 bp, Homo sapien
atacatctgctggagagcccaggtg

SEQ ID NO: 404102 - DNA, 25 bp, Homo sapien
gggtcatcgggagacttgaagtcca

SEQ ID NO: 404103 - DNA, 25 bp, Homo sapien
ggtcatacttcccagacctgaagaa

SEQ ID NO: 404104 - DNA, 25 bp, Homo sapien
gacctgaagaactcggaggccgcta

SEQ ID NO: 404105 - DNA, 25 bp, Homo sapien
gccgatgaccaccttatcagtgtag

SEQ ID NO: 404106 - DNA, 25 bp, Homo sapien
tttcccaatagcagtcttcagcagc

SEQ ID NO: 404107 - DNA, 25 bp, Homo sapien
aggccttctttattctccaggatgt

SEQ ID NO: 404108 - DNA, 25 bp, Homo sapien
aggatgttgggagcaaacccgcctt

SEQ ID NO: 404109 - DNA, 25 bp, Homo sapien
acattggtggcatctttcccatatt

SEQ ID NO: 404110 - DNA, 25 bp, Homo sapien
tctttcccatatttctccttgatga

SEQ ID NO: 404111 - DNA, 25 bp, Homo sapien
gttgtggtaaacctctgctccaatg

SEQ ID NO: 404112 - DNA, 25 bp, Homo sapien
caatgcgcatggcttccctgaagtt

SEQ ID NO: 404113 - DNA, 25 bp, Homo sapien
agcttctctcccagacagaggatct

SEQ ID NO: 404114 - DNA, 25 bp, Homo sapien
ttctctcccagacagaggatctcag

SEQ ID NO: 404115 - DNA, 25 bp, Homo sapien
tctcccagacagaggatctcaggct

SEQ ID NO: 404116 - DNA, 25 bp, Homo sapien
tcccagacagaggatctcaggcttc

SEQ ID NO: 404117 - DNA, 25 bp, Homo sapien
cagacagaggatctcaggcttccca

SEQ ID NO: 404118 - DNA, 25 bp, Homo sapien
agggtgaagaggtcagctgtcctcc

SEQ ID NO: 404119 - DNA, 25 bp, Homo sapien
gtgaagaggtcagctgtcctcctgt

SEQ ID NO: 404120 - DNA, 25 bp, Homo sapien
ccagcccctaaacaagatacttctt

SEQ ID NO: 404121 - DNA, 25 bp, Homo sapien
gatacttcttggttaaggccctccg

SEQ ID NO: 404122 - DNA, 25 bp, Homo sapien
ggctacggggcatgtgcctcatcac

SEQ ID NO: 404123 - DNA, 25 bp, Homo sapien
gcctcatcacaccatccatcctgga

SEQ ID NO: 404124 - DNA, 25 bp, Homo sapien
gcatatatgcccagtagtggtatag

SEQ ID NO: 404125 - DNA, 25 bp, Homo sapien
tatatgcccagtagtggtatagatc

SEQ ID NO: 404126 - DNA, 25 bp, Homo sapien
tatgcccagtagtggtatagatcat

SEQ ID NO: 404127 - DNA, 25 bp, Homo sapien
gcccagtagtggtatagatcattac

SEQ ID NO: 404128 - DNA, 25 bp, Homo sapien
ggtatagatcattaccagtggatca

SEQ ID NO: 404129 - DNA, 25 bp, Homo sapien
gatcattaccagtggatcatatggt

SEQ ID NO: 404130 - DNA, 25 bp, Homo sapien
tcattaccagtggatcatatggtag

SEQ ID NO: 404131 - DNA, 25 bp, Homo sapien
gtagatctctctttgacgtatagat

SEQ ID NO: 404132 - DNA, 25 bp, Homo sapien
gatctctctttgacgtatagatata

SEQ ID NO: 404133 - DNA, 25 bp, Homo sapien
tctctctttgacgtatagatatatt

SEQ ID NO: 404134 - DNA, 25 bp, Homo sapien
ctctttgacgtatagatatatttgt

SEQ ID NO: 404135 - DNA, 25 bp, Homo sapien
ggctttgtcactggatttgtggctt

SEQ ID NO: 404136 - DNA, 25 bp, Homo sapien
tagtgctgtcacgtttcctatctga

SEQ ID NO: 404137 - DNA, 25 bp, Homo sapien
aaatgccatatatgtttagaccagc

SEQ ID NO: 404138 - DNA, 25 bp, Homo sapien
cagcctttctcaattgtggcacttt

SEQ ID NO: 404139 - DNA, 25 bp, Homo sapien
gtatgtcaaatgtctaactccctgt

SEQ ID NO: 404140 - DNA, 25 bp, Homo sapien
ttgtggcacttttgccatttttggc

SEQ ID NO: 404141 - DNA, 25 bp, Homo sapien
tttggccagttaaattctgttgtgg

SEQ ID NO: 404142 - DNA, 25 bp, Homo sapien
atgtctaactccctgtcttaaaaag

SEQ ID NO: 404143 - DNA, 25 bp, Homo sapien
gggagttcccaaatgactgttcata

SEQ ID NO: 404144 - DNA, 25 bp, Homo sapien
aaccatatgtgtttcttgtggagac

SEQ ID NO: 404145 - DNA, 25 bp, Homo sapien
ggagactgtctgtattcttggcttt

SEQ ID NO: 404146 - DNA, 25 bp, Homo sapien
atcagaattataagtcaagccaggc

SEQ ID NO: 404147 - DNA, 25 bp, Homo sapien
cagaattataagtcaagccaggctc

SEQ ID NO: 404148 - DNA, 25 bp, Homo sapien
agaattataagtcaagccaggctca

SEQ ID NO: 404149 - DNA, 25 bp, Homo sapien
gaattataagtcaagccaggctcag

SEQ ID NO: 404150 - DNA, 25 bp, Homo sapien
aattataagtcaagccaggctcagt

SEQ ID NO: 404151 - DNA, 25 bp, Homo sapien
ataagtcaagccaggctcagtacct

SEQ ID NO: 404152 - DNA, 25 bp, Homo sapien
taagtcaagccaggctcagtacctc

SEQ ID NO: 404153 - DNA, 25 bp, Homo sapien
agtcaagccaggctcagtacctcat

SEQ ID NO: 404154 - DNA, 25 bp, Homo sapien
gtcaagccaggctcagtacctcatg

SEQ ID NO: 404155 - DNA, 25 bp, Homo sapien
tcaagccaggctcagtacctcatgc

SEQ ID NO: 404156 - DNA, 25 bp, Homo sapien
agccgagatagatccactgcacctc

SEQ ID NO: 404157 - DNA, 25 bp, Homo sapien
ggctttctggtgaggcagactgtaa

SEQ ID NO: 404158 - DNA, 25 bp, Homo sapien
actggaaagtgactcctacagtccc

SEQ ID NO: 404159 - DNA, 25 bp, Homo sapien
atgtccgccggaaacagaaaatcac

SEQ ID NO: 404160 - DNA, 25 bp, Homo sapien
gaaaatcaccgacattgtcaacaag

SEQ ID NO: 404161 - DNA, 25 bp, Homo sapien
acaagtaccggaacaagcagctgga

SEQ ID NO: 404162 - DNA, 25 bp, Homo sapien
ggagccagagttttatacttcactt

SEQ ID NO: 404163 - DNA, 25 bp, Homo sapien
cttcacttttccaggaggttggact

SEQ ID NO: 404164 - DNA, 25 bp, Homo sapien
aggaggttggactcaagaactgcag

SEQ ID NO: 404165 - DNA, 25 bp, Homo sapien
gaactgcagttcttagaccactgaa

SEQ ID NO: 404166 - DNA, 25 bp, Homo sapien
gaatttctaagactgttgaactcca

SEQ ID NO: 404167 - DNA, 25 bp, Homo sapien
ttgggaactataacacagcagaaca

SEQ ID NO: 404168 - DNA, 25 bp, Homo sapien
tttgctgagagtaaagatgtcgccg

SEQ ID NO: 404169 - DNA, 25 bp, Homo sapien
agatgtcgccgaactttttgaaggg

SEQ ID NO: 404170 - DNA, 25 bp, Homo sapien
tcgccgaactttttgaagggatttg

SEQ ID NO: 404171 - DNA, 25 bp, Homo sapien
aaactgttaaatcaactttgccgat

SEQ ID NO: 404172 - DNA, 25 bp, Homo sapien
cagtcacaggacttattccagatga

SEQ ID NO: 404173 - DNA, 25 bp, Homo sapien
gacttattccagatgaacttttctt

SEQ ID NO: 404174 - DNA, 25 bp, Homo sapien
attagaatgcccttgtggaagccaa

SEQ ID NO: 404175 - DNA, 25 bp, Homo sapien
tcaactttgccgatttcccttggga

SEQ ID NO: 404176 - DNA, 25 bp, Homo sapien
tgccgatttcccttgggaatccctg

SEQ ID NO: 404177 - DNA, 25 bp, Homo sapien
cctggaggccactctaagtggtaat

SEQ ID NO: 404178 - DNA, 25 bp, Homo sapien
cactctaagtggtaatcccaagttt

SEQ ID NO: 404179 - DNA, 25 bp, Homo sapien
tacaagccactcctgaaggacgggt

SEQ ID NO: 404180 - DNA, 25 bp, Homo sapien
agaacatgcgggttttgtctcgcct

SEQ ID NO: 404181 - DNA, 25 bp, Homo sapien
gttttgtctcgcctcttaatgagga

SEQ ID NO: 404182 - DNA, 25 bp, Homo sapien
agggcgtccatcctctgctgaaagt

SEQ ID NO: 404183 - DNA, 25 bp, Homo sapien
gatgtggccagcattaatagcctga

SEQ ID NO: 404184 - DNA, 25 bp, Homo sapien
gaaagatctgctcgtctgtcatggg

SEQ ID NO: 404185 - DNA, 25 bp, Homo sapien
agaatcggaagtgccctctcaaagg

SEQ ID NO: 404186 - DNA, 25 bp, Homo sapien
gaagtgccctctcaaaggcggactg

SEQ ID NO: 404187 - DNA, 25 bp, Homo sapien
aggcggactgggtcatgaacttcat

SEQ ID NO: 404188 - DNA, 25 bp, Homo sapien
gaacttcatgttgcactgaagcaaa

SEQ ID NO: 404189 - DNA, 25 bp, Homo sapien
tcagagagagacacgggcaccacct

SEQ ID NO: 404190 - DNA, 25 bp, Homo sapien
ctcagtcctgcgtgcggcacgtagt

SEQ ID NO: 404191 - DNA, 25 bp, Homo sapien
tgcgtgcggcacgtagtgctcactg

SEQ ID NO: 404192 - DNA, 25 bp, Homo sapien
cacgtagtgctcactgggcgtctgt

SEQ ID NO: 404193 - DNA, 25 bp, Homo sapien
aagggcgtggcggtcgcaggctcca

SEQ ID NO: 404194 - DNA, 25 bp, Homo sapien
aggctccagggcacgacggtccttc

SEQ ID NO: 404195 - DNA, 25 bp, Homo sapien
cgctgtccttggtgctgacgcggtt

SEQ ID NO: 404196 - DNA, 25 bp, Homo sapien
tccttggtgctgacgcggttctgga

SEQ ID NO: 404197 - DNA, 25 bp, Homo sapien
acgcggttctggaagtgcggtgcca

SEQ ID NO: 404198 - DNA, 25 bp, Homo sapien
gggctactgccctctgaatcaatac

SEQ ID NO: 404199 - DNA, 25 bp, Homo sapien
tctgaatcaatacctccagggaccc

SEQ ID NO: 404200 - DNA, 25 bp, Homo sapien
agggaccctacgttgacacccatgg

SEQ ID NO: 404201 - DNA, 25 bp, Homo sapien
tctgggtccttctgtccagttttca

SEQ ID NO: 404202 - DNA, 25 bp, Homo sapien
ctgtccagttttcagcactagtctt

SEQ ID NO: 404203 - DNA, 25 bp, Homo sapien
gtccagttttcagcactagtcttac

SEQ ID NO: 404204 - DNA, 25 bp, Homo sapien
gttttcagcactagtcttactcagc

SEQ ID NO: 404205 - DNA, 25 bp, Homo sapien
tcagcactagtcttactcagctatc

SEQ ID NO: 404206 - DNA, 25 bp, Homo sapien
gcactagtcttactcagctatccat

SEQ ID NO: 404207 - DNA, 25 bp, Homo sapien
agtcttactcagctatccattatag

SEQ ID NO: 404208 - DNA, 25 bp, Homo sapien
agctatccattatagttttgccctt

SEQ ID NO: 404209 - DNA, 25 bp, Homo sapien
atccattatagttttgcccttaaga

SEQ ID NO: 404210 - DNA, 25 bp, Homo sapien
agttttgcccttaagaagtcatgat

SEQ ID NO: 404211 - DNA, 25 bp, Homo sapien
tttgcccttaagaagtcatgattaa

SEQ ID NO: 404212 - DNA, 25 bp, Homo sapien
tttttgctcagataagaagcctgac

SEQ ID NO: 404213 - DNA, 25 bp, Homo sapien
tttctccacatttcaaaaagttgtc

SEQ ID NO: 404214 - DNA, 25 bp, Homo sapien
ttcaaaaagttgtccttctcatcac

SEQ ID NO: 404215 - DNA, 25 bp, Homo sapien
tctcatcactgcacagatctgtctg

SEQ ID NO: 404216 - DNA, 25 bp, Homo sapien
gcacagatctgtctgaaagcctcag

SEQ ID NO: 404217 - DNA, 25 bp, Homo sapien
tgacccaggaacagatcagaaatgg

SEQ ID NO: 404218 - DNA, 25 bp, Homo sapien
gaaatggagcatggccttgtccttt

SEQ ID NO: 404219 - DNA, 25 bp, Homo sapien
gagcatggccttgtcctttaatggg

SEQ ID NO: 404220 - DNA, 25 bp, Homo sapien
taagacagcagtgataccccactct

SEQ ID NO: 404221 - DNA, 25 bp, Homo sapien
gtgataccccactctctccattatt

SEQ ID NO: 404222 - DNA, 25 bp, Homo sapien
ggtgacataatgacaggttaaatat

SEQ ID NO: 404223 - DNA, 25 bp, Homo sapien
agattggaattcttcatatgtaaaa

SEQ ID NO: 404224 - DNA, 25 bp, Homo sapien
gagaagagaaagacattcttgattt

SEQ ID NO: 404225 - DNA, 25 bp, Homo sapien
ttggtgactagagttgtagatgctg

SEQ ID NO: 404226 - DNA, 25 bp, Homo sapien
tgtagatgctggaagctttgccact

SEQ ID NO: 404227 - DNA, 25 bp, Homo sapien
atgctggaagctttgccactaacat

SEQ ID NO: 404228 - DNA, 25 bp, Homo sapien
ggaagctttgccactaacattgatg

SEQ ID NO: 404229 - DNA, 25 bp, Homo sapien
gctttgccactaacattgatgaacc

SEQ ID NO: 404230 - DNA, 25 bp, Homo sapien
tgccactaacattgatgaaccagat

SEQ ID NO: 404231 - DNA, 25 bp, Homo sapien
atgaaccagatgcatgtcaccagcc

SEQ ID NO: 404232 - DNA, 25 bp, Homo sapien
gaaccagatgcatgtcaccagccca

SEQ ID NO: 404233 - DNA, 25 bp, Homo sapien
agatgcatgtcaccagcccatcacg

SEQ ID NO: 404234 - DNA, 25 bp, Homo sapien
agggacaaccttagctgtactctgg

SEQ ID NO: 404235 - DNA, 25 bp, Homo sapien
tgggtgtggcatccccagctcagaa

SEQ ID NO: 404236 - DNA, 25 bp, Homo sapien
tgtggcatccccagctcagaaggca

SEQ ID NO: 404237 - DNA, 25 bp, Homo sapien
tcagtgctttgggaatttggacagc

SEQ ID NO: 404238 - DNA, 25 bp, Homo sapien
gaatttggacagcaaggaaggaccc

SEQ ID NO: 404239 - DNA, 25 bp, Homo sapien
tgcccacgggtgtccagtgggactc

SEQ ID NO: 404240 - DNA, 25 bp, Homo sapien
cttctcctgggcttaccagattgaa

SEQ ID NO: 404241 - DNA, 25 bp, Homo sapien
gggcttaccagattgaactggcgga

SEQ ID NO: 404242 - DNA, 25 bp, Homo sapien
aactggcggaacaccgtgattccat

SEQ ID NO: 404243 - DNA, 25 bp, Homo sapien
aacaccgtgattccatgagatgagc

SEQ ID NO: 404244 - DNA, 25 bp, Homo sapien
tccatgagatgagcagttctgggct

SEQ ID NO: 404245 - DNA, 25 bp, Homo sapien
agctttgccagagtgctggcttcag

SEQ ID NO: 404246 - DNA, 25 bp, Homo sapien
tcagcagccgtctagaggagcctca

SEQ ID NO: 404247 - DNA, 25 bp, Homo sapien
gcaagagactgctgggcaccctaac

SEQ ID NO: 404248 - DNA, 25 bp, Homo sapien
gcaccctaacattctccagagttga

SEQ ID NO: 404249 - DNA, 25 bp, Homo sapien
tgagagttcaaagcccagattgtgc

SEQ ID NO: 404250 - DNA, 25 bp, Homo sapien
gattgtgccctaacttgctctgagt

SEQ ID NO: 404251 - DNA, 25 bp, Homo sapien
aacttgctctgagttacgtggtcag

SEQ ID NO: 404252 - DNA, 25 bp, Homo sapien
tttttctgtgcattcgccctgcagc

SEQ ID NO: 404253 - DNA, 25 bp, Homo sapien
tgcagcctccatagagcacctgctg

SEQ ID NO: 404254 - DNA, 25 bp, Homo sapien
gtgcatgcagtcactctgtggaggt

SEQ ID NO: 404255 - DNA, 25 bp, Homo sapien
gtggaggtcacaaggccaagcagac

SEQ ID NO: 404256 - DNA, 25 bp, Homo sapien
cagagctggcttacctggaaaccaa

SEQ ID NO: 404257 - DNA, 25 bp, Homo sapien
tggaaaccaagcttattctgtagtg

SEQ ID NO: 404258 - DNA, 25 bp, Homo sapien
tgtagtggcagacctcacgccatct

SEQ ID NO: 404259 - DNA, 25 bp, Homo sapien
ctcacgccatcttgcttaatagcct

SEQ ID NO: 404260 - DNA, 25 bp, Homo sapien
gattatgcaagacctactctgctag

SEQ ID NO: 404261 - DNA, 25 bp, Homo sapien
gcaagacctactctgctaggcactg

SEQ ID NO: 404262 - DNA, 25 bp, Homo sapien
ggaatgatctctgactttaaaatgc

SEQ ID NO: 404263 - DNA, 25 bp, Homo sapien
tgcccaacactaccatgcatggctg

SEQ ID NO: 404264 - DNA, 25 bp, Homo sapien
gcatggctgatagggcactgttctg

SEQ ID NO: 404265 - DNA, 25 bp, Homo sapien
gatagggcactgttctgccccatat

SEQ ID NO: 404266 - DNA, 25 bp, Homo sapien
ggttctacttaacccagagctggct

SEQ ID NO: 404267 - DNA, 25 bp, Homo sapien
ggagtgactgataaatctaagattc

SEQ ID NO: 404268 - DNA, 25 bp, Homo sapien
agattattgctttggagctttctat

SEQ ID NO: 404269 - DNA, 25 bp, Homo sapien
gctttggagctttctataggtacta

SEQ ID NO: 404270 - DNA, 25 bp, Homo sapien
tttctataggtactagccatcccgt

SEQ ID NO: 404271 - DNA, 25 bp, Homo sapien
ctagccatcccgtcgttaaatgttt

SEQ ID NO: 404272 - DNA, 25 bp, Homo sapien
ccatcccgtcgttaaatgttttcat

SEQ ID NO: 404273 - DNA, 25 bp, Homo sapien
gaccatgtacctttaataactgttc

SEQ ID NO: 404274 - DNA, 25 bp, Homo sapien
aactgttcttttctcgagtttctgc

SEQ ID NO: 404275 - DNA, 25 bp, Homo sapien
ttttctcgagtttctgcctcgtgct

SEQ ID NO: 404276 - DNA, 25 bp, Homo sapien
ctgcctcgtgctttgacctggattg

SEQ ID NO: 404277 - DNA, 25 bp, Homo sapien
aagcacaagcttttcctgtatatta

SEQ ID NO: 404278 - DNA, 25 bp, Homo sapien
tgaggaatgaaagcacttctttgct

SEQ ID NO: 404279 - DNA, 25 bp, Homo sapien
aatcattttcagaccactatgtgtt

SEQ ID NO: 404280 - DNA, 25 bp, Homo sapien
gaccactatgtgtttgaatcctctg

SEQ ID NO: 404281 - DNA, 25 bp, Homo sapien
gaatcctctggtatcaatacgtatt

SEQ ID NO: 404282 - DNA, 25 bp, Homo sapien
ggttttagagatctgtgggtcaaat

SEQ ID NO: 404283 - DNA, 25 bp, Homo sapien
ggtcaaatgatgtccctcaaaactt

SEQ ID NO: 404284 - DNA, 25 bp, Homo sapien
tttactaaagcacagctgtatgtat

SEQ ID NO: 404285 - DNA, 25 bp, Homo sapien
atgactttatgcagttgtataggga

SEQ ID NO: 404286 - DNA, 25 bp, Homo sapien
gtatagggattatgccctttcagtt

SEQ ID NO: 404287 - DNA, 25 bp, Homo sapien
tttcagttctatagggattatgccc

SEQ ID NO: 404288 - DNA, 25 bp, Homo sapien
gggattatgcccttttataatacat

SEQ ID NO: 404289 - DNA, 25 bp, Homo sapien
tgacccattcctcctggcagagagt

SEQ ID NO: 404290 - DNA, 25 bp, Homo sapien
acccattcctcctggcagagagtga

SEQ ID NO: 404291 - DNA, 25 bp, Homo sapien
attcctcctggcagagagtgatgag

SEQ ID NO: 404292 - DNA, 25 bp, Homo sapien
tcctggcagagagtgatgaggccaa

SEQ ID NO: 404293 - DNA, 25 bp, Homo sapien
tgaggccaaagtgcagcgggcagca

SEQ ID NO: 404294 - DNA, 25 bp, Homo sapien
gggcccaggtggagcgattgcgggt

SEQ ID NO: 404295 - DNA, 25 bp, Homo sapien
gagcgattgcgggtggagctgcagc

SEQ ID NO: 404296 - DNA, 25 bp, Homo sapien
gggtgaggagcagcgggacagcttt

SEQ ID NO: 404297 - DNA, 25 bp, Homo sapien
aactacatccagatgtaccggcgca

SEQ ID NO: 404298 - DNA, 25 bp, Homo sapien
acatccagatgtaccggcgcaaccg

SEQ ID NO: 404299 - DNA, 25 bp, Homo sapien
tgtaccggcgcaaccggcagctaga

SEQ ID NO: 404300 - DNA, 25 bp, Homo sapien
ttctcacagttggaggcctgaagtc

SEQ ID NO: 404301 - DNA, 25 bp, Homo sapien
aaggttaaggcacatccatcctgct

SEQ ID NO: 404302 - DNA, 25 bp, Homo sapien
ggcacatccatcctgctgatagatg

SEQ ID NO: 404303 - DNA, 25 bp, Homo sapien
tgggttgttgtttgtcttagccctt

SEQ ID NO: 404304 - DNA, 25 bp, Homo sapien
agcctctcctccaagggcctttgat

SEQ ID NO: 404305 - DNA, 25 bp, Homo sapien
caagggcctttgatccctttcaaag

SEQ ID NO: 404306 - DNA, 25 bp, Homo sapien
agggaggagttctcacagcctagtc

SEQ ID NO: 404307 - DNA, 25 bp, Homo sapien
agttctcacagcctagtccggtctt

SEQ ID NO: 404308 - DNA, 25 bp, Homo sapien
gtccggtcttcatactaacacactg

SEQ ID NO: 404309 - DNA, 25 bp, Homo sapien
ttgtcttagccctttttatgctgca

SEQ ID NO: 404310 - DNA, 25 bp, Homo sapien
agaatactgtagactgggcgactta

SEQ ID NO: 404311 - DNA, 25 bp, Homo sapien
ttggcgctaccaactggcaagctgt

SEQ ID NO: 404312 - DNA, 25 bp, Homo sapien
aagctgtgcaggttcctggcatcca

SEQ ID NO: 404313 - DNA, 25 bp, Homo sapien
ctggcatccatttcattagcttcaa

SEQ ID NO: 404314 - DNA, 25 bp, Homo sapien
acgcgaccacgaatagttgattgaa

SEQ ID NO: 404315 - DNA, 25 bp, Homo sapien
gttgattgaattttagaccccacgt

SEQ ID NO: 404316 - DNA, 25 bp, Homo sapien
aaattcttctggacctcacttattg

SEQ ID NO: 404317 - DNA, 25 bp, Homo sapien
gggcagggatttactgttctttcaa

SEQ ID NO: 404318 - DNA, 25 bp, Homo sapien
gttctttcaattcacttggtcttta

SEQ ID NO: 404319 - DNA, 25 bp, Homo sapien
tgcttcctgttcattgcgaggtgta

SEQ ID NO: 404320 - DNA, 25 bp, Homo sapien
taaactgacgctgggagtggccact

SEQ ID NO: 404321 - DNA, 25 bp, Homo sapien
gatggcggcaaactcagccaagttt

SEQ ID NO: 404322 - DNA, 25 bp, Homo sapien
gatgctggaaaatatcagtcacctg

SEQ ID NO: 404323 - DNA, 25 bp, Homo sapien
aaatatcagtcacctggtgtccctc

SEQ ID NO: 404324 - DNA, 25 bp, Homo sapien
gtgtccctcgggtaccagataagca

SEQ ID NO: 404325 - DNA, 25 bp, Homo sapien
gggtaccagataagcaaatcctata

SEQ ID NO: 404326 - DNA, 25 bp, Homo sapien
gagtatttcttcaagaccagaatcc

SEQ ID NO: 404327 - DNA, 25 bp, Homo sapien
ttcaagaccagaatccaaacaggga

SEQ ID NO: 404328 - DNA, 25 bp, Homo sapien
gaaagtgcccttaagaaaacacaca

SEQ ID NO: 404329 - DNA, 25 bp, Homo sapien
atgatatccatgcatcctatcacca

SEQ ID NO: 404330 - DNA, 25 bp, Homo sapien
tccatgcatcctatcaccagaaaag

SEQ ID NO: 404331 - DNA, 25 bp, Homo sapien
ccagaaaagacgcatccaccagtat

SEQ ID NO: 404332 - DNA, 25 bp, Homo sapien
catccaagagaaagctgtacagaga

SEQ ID NO: 404333 - DNA, 25 bp, Homo sapien
ctgcaacatatacctcattttctcc

SEQ ID NO: 404334 - DNA, 25 bp, Homo sapien
gagctctcagccaccaggagacaga

SEQ ID NO: 404335 - DNA, 25 bp, Homo sapien
tcagccaccaggagacagacggaag

SEQ ID NO: 404336 - DNA, 25 bp, Homo sapien
ttctgggctgtgttgggagcgggca

SEQ ID NO: 404337 - DNA, 25 bp, Homo sapien
ccttgaattttccttcgcgagtttg

SEQ ID NO: 404338 - DNA, 25 bp, Homo sapien
tttccttcgcgagtttggagaccag

SEQ ID NO: 404339 - DNA, 25 bp, Homo sapien
tggagaccagccgatttttcatgaa

SEQ ID NO: 404340 - DNA, 25 bp, Homo sapien
gaccagccgatttttcatgaagcaa

SEQ ID NO: 404341 - DNA, 25 bp, Homo sapien
atgaagcaagcaagggccgcggtcc

SEQ ID NO: 404342 - DNA, 25 bp, Homo sapien
gcggtcccggatcctgcaacatata

SEQ ID NO: 404343 - DNA, 25 bp, Homo sapien
ggatcctgcaacatatacctcattt

SEQ ID NO: 404344 - DNA, 25 bp, Homo sapien
ctggctggcctctggtttttaataa

SEQ ID NO: 404345 - DNA, 25 bp, Homo sapien
ataaaacatgactagagtgactcca

SEQ ID NO: 404346 - DNA, 25 bp, Homo sapien
tgagtagctaggcacttacaaggtt

SEQ ID NO: 404347 - DNA, 25 bp, Homo sapien
gtagctaggcacttacaaggttcat

SEQ ID NO: 404348 - DNA, 25 bp, Homo sapien
gctaggcacttacaaggttcatgct

SEQ ID NO: 404349 - DNA, 25 bp, Homo sapien
ggcacttacaaggttcatgcttatg

SEQ ID NO: 404350 - DNA, 25 bp, Homo sapien
acaaggttcatgcttatggcctgaa

SEQ ID NO: 404351 - DNA, 25 bp, Homo sapien
aaggttcatgcttatggcctgaaaa

SEQ ID NO: 404352 - DNA, 25 bp, Homo sapien
tgaaaataaccacatcccaggctga

SEQ ID NO: 404353 - DNA, 25 bp, Homo sapien
aaataaccacatcccaggctgacca

SEQ ID NO: 404354 - DNA, 25 bp, Homo sapien
tcccaggctgaccaccaattataat

SEQ ID NO: 404355 - DNA, 25 bp, Homo sapien
gtggaatgcccttccccaagtgtgt

SEQ ID NO: 404356 - DNA, 25 bp, Homo sapien
tccccaagtgtgtctgcctggaaaa

SEQ ID NO: 404357 - DNA, 25 bp, Homo sapien
gtgtctgcctggaaaacttttactt

SEQ ID NO: 404358 - DNA, 25 bp, Homo sapien
ttttactttactcaggtgccatcct

SEQ ID NO: 404359 - DNA, 25 bp, Homo sapien
tcctgtccatgaagtctcgagattt

SEQ ID NO: 404360 - DNA, 25 bp, Homo sapien
attgccccatgaccaggtgttcatt

SEQ ID NO: 404361 - DNA, 25 bp, Homo sapien
gaccaggtgttcattttagggagca

SEQ ID NO: 404362 - DNA, 25 bp, Homo sapien
ccttgcactgacgttgttggttagc

SEQ ID NO: 404363 - DNA, 25 bp, Homo sapien
gataaggcttatgcgtcttcacacc

SEQ ID NO: 404364 - DNA, 25 bp, Homo sapien
tggtacctgccatggctccactgtg

SEQ ID NO: 404365 - DNA, 25 bp, Homo sapien
tccactgtgctcaggagctgtttgt

SEQ ID NO: 404366 - DNA, 25 bp, Homo sapien
atcatgccactgtgtgaccagaaac

SEQ ID NO: 404367 - DNA, 25 bp, Homo sapien
gccactgtgtgaccagaaaccagat

SEQ ID NO: 404368 - DNA, 25 bp, Homo sapien
aaaccagatgtagccatttcaagca

SEQ ID NO: 404369 - DNA, 25 bp, Homo sapien
gtagccatttcaagcataaaacatg

SEQ ID NO: 404370 - DNA, 25 bp, Homo sapien
gatatttttgttttccttggactga

SEQ ID NO: 404371 - DNA, 25 bp, Homo sapien
gttttccttggactgaaacatagtc

SEQ ID NO: 404372 - DNA, 25 bp, Homo sapien
gaaacatagtctgggtcctcaacgt

SEQ ID NO: 404373 - DNA, 25 bp, Homo sapien
atagtctgggtcctcaacgttgccg

SEQ ID NO: 404374 - DNA, 25 bp, Homo sapien
gtcctcaacgttgccggtgatgatg

SEQ ID NO: 404375 - DNA, 25 bp, Homo sapien
caacgttgccggtgatgatggttga

SEQ ID NO: 404376 - DNA, 25 bp, Homo sapien
gatggttgaacatcatgttttttat

SEQ ID NO: 404377 - DNA, 25 bp, Homo sapien
acctggcaccgttgactgcagaaca

SEQ ID NO: 404378 - DNA, 25 bp, Homo sapien
gggcccctctgtctgtggtgatctt

SEQ ID NO: 404379 - DNA, 25 bp, Homo sapien
ccctctgtctgtggtgatcttgtga

SEQ ID NO: 404380 - DNA, 25 bp, Homo sapien
accctctgtggaagagcctcatgct

SEQ ID NO: 404381 - DNA, 25 bp, Homo sapien
ctctgtggaagagcctcatgctcca

SEQ ID NO: 404382 - DNA, 25 bp, Homo sapien
tctgtctgtggtgatcttgtgatga

SEQ ID NO: 404383 - DNA, 25 bp, Homo sapien
tggtgatcttgtgatgaaccaggcc

SEQ ID NO: 404384 - DNA, 25 bp, Homo sapien
gatgaaccaggccaggtcagcgctc

SEQ ID NO: 404385 - DNA, 25 bp, Homo sapien
agctgaggagagcagttctgtcctt

SEQ ID NO: 404386 - DNA, 25 bp, Homo sapien
gagagcagttctgtccttagggaca

SEQ ID NO: 404387 - DNA, 25 bp, Homo sapien
agttctgtccttagggacacgagcc

SEQ ID NO: 404388 - DNA, 25 bp, Homo sapien
ttctaactctgatggaacacggcca

SEQ ID NO: 404389 - DNA, 25 bp, Homo sapien
tggaacacggccagttggcatgctg

SEQ ID NO: 404390 - DNA, 25 bp, Homo sapien
agccacatctaccagtgacatgctg

SEQ ID NO: 404391 - DNA, 25 bp, Homo sapien
gacatgctgctcaaactggcccgga

SEQ ID NO: 404392 - DNA, 25 bp, Homo sapien
gaccacaccctactacaaaaggaat

SEQ ID NO: 404393 - DNA, 25 bp, Homo sapien
aaaaggaatcgaccccacatttgct

SEQ ID NO: 404394 - DNA, 25 bp, Homo sapien
tttgctccttctgggtgaaaggaga

SEQ ID NO: 404395 - DNA, 25 bp, Homo sapien
gagaggaatgtccatacagacatga

SEQ ID NO: 404396 - DNA, 25 bp, Homo sapien
gaagcctacagatccagatgacccc

SEQ ID NO: 404397 - DNA, 25 bp, Homo sapien
atgacccccttgctgatcagaatat

SEQ ID NO: 404398 - DNA, 25 bp, Homo sapien
tcaatgatcctgtagctgacaagct

SEQ ID NO: 404399 - DNA, 25 bp, Homo sapien
catccggctttcaggctttgtgaag

SEQ ID NO: 404400 - DNA, 25 bp, Homo sapien
ggtgaattttaatctgggctccagc

SEQ ID NO: 404401 - DNA, 25 bp, Homo sapien
atctgggctccagcagagtacaggg

SEQ ID NO: 404402 - DNA, 25 bp, Homo sapien
gcttcctgctactgagattggactt

SEQ ID NO: 404403 - DNA, 25 bp, Homo sapien
ctgctactgagattggactttgaga

SEQ ID NO: 404404 - DNA, 25 bp, Homo sapien
tggactttgagaagggtaaacagaa

SEQ ID NO: 404405 - DNA, 25 bp, Homo sapien
acagaagagggagcactgtgagaca

SEQ ID NO: 404406 - DNA, 25 bp, Homo sapien
cactgtgagacaggtgggcttgcct

SEQ ID NO: 404407 - DNA, 25 bp, Homo sapien
gatatcagcacaaatatactgggaa

SEQ ID NO: 404408 - DNA, 25 bp, Homo sapien
tgatactttgaaacatacacatagt

SEQ ID NO: 404409 - DNA, 25 bp, Homo sapien
cacatagtttggatattattctgta

SEQ ID NO: 404410 - DNA, 25 bp, Homo sapien
actatctatgatcctgcctgcaacc

SEQ ID NO: 404411 - DNA, 25 bp, Homo sapien
tctccccagcttggcgcagtcgagg

SEQ ID NO: 404412 - DNA, 25 bp, Homo sapien
tgctccagggatgtgagcacccact

SEQ ID NO: 404413 - DNA, 25 bp, Homo sapien
gggatgtgagcacccactccctgtg

SEQ ID NO: 404414 - DNA, 25 bp, Homo sapien
actccctgtgctagttagtgcctga

SEQ ID NO: 404415 - DNA, 25 bp, Homo sapien
gtgctagttagtgcctgattctctg

SEQ ID NO: 404416 - DNA, 25 bp, Homo sapien
aacccctttctctggtacagtgctg

SEQ ID NO: 404417 - DNA, 25 bp, Homo sapien
ccctttctctggtacagtgctgtct

SEQ ID NO: 404418 - DNA, 25 bp, Homo sapien
ttaaccctgacttctaagccatcaa

SEQ ID NO: 404419 - DNA, 25 bp, Homo sapien
gacttctaagccatcaatttcatgt

SEQ ID NO: 404420 - DNA, 25 bp, Homo sapien
gttatttattattgccctatgtggg

SEQ ID NO: 404421 - DNA, 25 bp, Homo sapien
cactgggtttcaattcagtatccaa

SEQ ID NO: 404422 - DNA, 25 bp, Homo sapien
gcataaaaactcaaggcacctttgt

SEQ ID NO: 404423 - DNA, 25 bp, Homo sapien
gcacctttgtaaaattaagccttct

SEQ ID NO: 404424 - DNA, 25 bp, Homo sapien
ccatgctgtgctacatttctgtgaa

SEQ ID NO: 404425 - DNA, 25 bp, Homo sapien
gaatcctaaagttgatgcatggcat

SEQ ID NO: 404426 - DNA, 25 bp, Homo sapien
tgcaaattggtccagcagtctacgc

SEQ ID NO: 404427 - DNA, 25 bp, Homo sapien
attacctcagtcttatatttttgga

SEQ ID NO: 404428 - DNA, 25 bp, Homo sapien
aattctaacttcctccagacaaatg

SEQ ID NO: 404429 - DNA, 25 bp, Homo sapien
cagtctacgctaccttattgttgag

SEQ ID NO: 404430 - DNA, 25 bp, Homo sapien
gagtcaactcattctgctattgtag

SEQ ID NO: 404431 - DNA, 25 bp, Homo sapien
taggcctatgacaatccactgggtt

SEQ ID NO: 404432 - DNA, 25 bp, Homo sapien
ttcaaagatagtgacccttctgccc

SEQ ID NO: 404433 - DNA, 25 bp, Homo sapien
gactcctgcccatctaaggacttga

SEQ ID NO: 404434 - DNA, 25 bp, Homo sapien
ccatctaaggacttgatttgctgct

SEQ ID NO: 404435 - DNA, 25 bp, Homo sapien
aaaacttcaaaatcagggcctggca

SEQ ID NO: 404436 - DNA, 25 bp, Homo sapien
ttcgccaaggtcagcccaccaggag

SEQ ID NO: 404437 - DNA, 25 bp, Homo sapien
gccctgccttcgtctccataggaag

SEQ ID NO: 404438 - DNA, 25 bp, Homo sapien
gaaggacacatgtacagcccttgcc

SEQ ID NO: 404439 - DNA, 25 bp, Homo sapien
attcccacttctgcttggcaatgct

SEQ ID NO: 404440 - DNA, 25 bp, Homo sapien
atctcccttatgtggactcttgttc

SEQ ID NO: 404441 - DNA, 25 bp, Homo sapien
atgtggactcttgttcttgtctgat

SEQ ID NO: 404442 - DNA, 25 bp, Homo sapien
gttcttgtctgatctcttgtcaaat

SEQ ID NO: 404443 - DNA, 25 bp, Homo sapien
aagcaagcttagatctgtatttact

SEQ ID NO: 404444 - DNA, 25 bp, Homo sapien
gcttagatctgtatttactgacttc

SEQ ID NO: 404445 - DNA, 25 bp, Homo sapien
tactgacttctagaaatgcccacaa

SEQ ID NO: 404446 - DNA, 25 bp, Homo sapien
gaaatgcccacaatatattgacatg

SEQ ID NO: 404447 - DNA, 25 bp, Homo sapien
aagttcatttcagcactaacaatca

SEQ ID NO: 404448 - DNA, 25 bp, Homo sapien
tcagcactaacaatcaaccaaccaa

SEQ ID NO: 404449 - DNA, 25 bp, Homo sapien
caaacccctttagataatatgctat

SEQ ID NO: 404450 - DNA, 25 bp, Homo sapien
attcatttcaacaaggagataggta

SEQ ID NO: 404451 - DNA, 25 bp, Homo sapien
gtatgaaggtacataccagaccact

SEQ ID NO: 404452 - DNA, 25 bp, Homo sapien
gtttgcttttgtctacctcaggaag

SEQ ID NO: 404453 - DNA, 25 bp, Homo sapien
gtctacctcaggaagttagtaaagc

SEQ ID NO: 404454 - DNA, 25 bp, Homo sapien
ggaaacagtgttaccagagcccagt

SEQ ID NO: 404455 - DNA, 25 bp, Homo sapien
gggccaccttgtaagagacatcatt

SEQ ID NO: 404456 - DNA, 25 bp, Homo sapien
aactgtggtgccaaattgctggtgt

SEQ ID NO: 404457 - DNA, 25 bp, Homo sapien
tgtggtgccaaattgctggtgtctc

SEQ ID NO: 404458 - DNA, 25 bp, Homo sapien
tggtgccaaattgctggtgtctctc

SEQ ID NO: 404459 - DNA, 25 bp, Homo sapien
tgccaaattgctggtgtctctcttt

SEQ ID NO: 404460 - DNA, 25 bp, Homo sapien
ggtgtctctctttggagaaaccaac

SEQ ID NO: 404461 - DNA, 25 bp, Homo sapien
tggagaaaccaaccagatacatctg

SEQ ID NO: 404462 - DNA, 25 bp, Homo sapien
gaaaccaaccagatacatctgctgg

SEQ ID NO: 404463 - DNA, 25 bp, Homo sapien
cagatacatctgctggagagcccag

SEQ ID NO: 404464 - DNA, 25 bp, Homo sapien
atacatctgctggagagcccaggtg

SEQ ID NO: 404465 - DNA, 25 bp, Homo sapien
tggcggtgtctcagcctgaaacata

SEQ ID NO: 404466 - DNA, 25 bp, Homo sapien
agcctgaaacataaaccccacatgc

SEQ ID NO: 404467 - DNA, 25 bp, Homo sapien
gagcgatgtgctccctgaaacagac

SEQ ID NO: 404468 - DNA, 25 bp, Homo sapien
gaaacagacaaccacacgctgttgg

SEQ ID NO: 404469 - DNA, 25 bp, Homo sapien
gataggatggagatgtggctcttct

SEQ ID NO: 404470 - DNA, 25 bp, Homo sapien
gtggctcttctcatctttgaagcca

SEQ ID NO: 404471 - DNA, 25 bp, Homo sapien
tttgaagccagcagggcatcccgga

SEQ ID NO: 404472 - DNA, 25 bp, Homo sapien
caagcgaaggcgttggtgtctgtca

SEQ ID NO: 404473 - DNA, 25 bp, Homo sapien
ggtgtctgtcattaggtgtgtgtta

SEQ ID NO: 404474 - DNA, 25 bp, Homo sapien
cacaggatgctgataagcgcgctga

SEQ ID NO: 404475 - DNA, 25 bp, Homo sapien
cgcgctgagaggtggatgaaacacc

SEQ ID NO: 404476 - DNA, 25 bp, Homo sapien
gatgggactgtctattgattgcaca

SEQ ID NO: 404477 - DNA, 25 bp, Homo sapien
gggactgtctattgattgcacactg

SEQ ID NO: 404478 - DNA, 25 bp, Homo sapien
tgtctattgattgcacactgtggat

SEQ ID NO: 404479 - DNA, 25 bp, Homo sapien
attgcacactgtggataggtggtca

SEQ ID NO: 404480 - DNA, 25 bp, Homo sapien
cactgtggataggtggtcagttcta

SEQ ID NO: 404481 - DNA, 25 bp, Homo sapien
cgctggtcttctggccaggtgtaga

SEQ ID NO: 404482 - DNA, 25 bp, Homo sapien
gcagtggatgccttcgcttttacaa

SEQ ID NO: 404483 - DNA, 25 bp, Homo sapien
tggatgccttcgcttttacaaagtt

SEQ ID NO: 404484 - DNA, 25 bp, Homo sapien
gccttcgcttttacaaagtttcagt

SEQ ID NO: 404485 - DNA, 25 bp, Homo sapien
gtgttgctgatgtctgcaccgccat

SEQ ID NO: 404486 - DNA, 25 bp, Homo sapien
ttgctgatgtctgcaccgccatgct

SEQ ID NO: 404487 - DNA, 25 bp, Homo sapien
gaagatcagctggatggctccttgg

SEQ ID NO: 404488 - DNA, 25 bp, Homo sapien
agatcagctggatggctccttggag

SEQ ID NO: 404489 - DNA, 25 bp, Homo sapien
tccttggaggacaacctagacctcc

SEQ ID NO: 404490 - DNA, 25 bp, Homo sapien
tggaggacaacctagacctccctca

SEQ ID NO: 404491 - DNA, 25 bp, Homo sapien
acggcctggccgacagctccgctga

SEQ ID NO: 404492 - DNA, 25 bp, Homo sapien
agctccgctgacctcagctgcgaca

SEQ ID NO: 404493 - DNA, 25 bp, Homo sapien
tgcgacagccgcgttaacagcgact

SEQ ID NO: 404494 - DNA, 25 bp, Homo sapien
gacagccgcgttaacagcgactacg

SEQ ID NO: 404495 - DNA, 25 bp, Homo sapien
agccgcgttaacagcgactacgaga

SEQ ID NO: 404496 - DNA, 25 bp, Homo sapien
gcgttaacagcgactacgagacgga

SEQ ID NO: 404497 - DNA, 25 bp, Homo sapien
ttaacagcgactacgagacggacgg

SEQ ID NO: 404498 - DNA, 25 bp, Homo sapien
agcggtcctcagagcgacctcgagt

SEQ ID NO: 404499 - DNA, 25 bp, Homo sapien
tcagagcgacctcgagtgccttctt

SEQ ID NO: 404500 - DNA, 25 bp, Homo sapien
ttcttcccccgtgagtgaggcttct

SEQ ID NO: 404501 - DNA, 25 bp, Homo sapien
cgtgagtgaggcttctgccctcacc

SEQ ID NO: 404502 - DNA, 25 bp, Homo sapien
tgtcccagcctttcaattcggcaaa

SEQ ID NO: 404503 - DNA, 25 bp, Homo sapien
ccagcctttcaattcggcaaacata

SEQ ID NO: 404504 - DNA, 25 bp, Homo sapien
agcctttcaattcggcaaacatacg

SEQ ID NO: 404505 - DNA, 25 bp, Homo sapien
attcggcaaacatacgttgcgcgcc

SEQ ID NO: 404506 - DNA, 25 bp, Homo sapien
gcaaacatacgttgcgcgcccactg

SEQ ID NO: 404507 - DNA, 25 bp, Homo sapien
ggtggggtccaaaccgtcctgcctg

SEQ ID NO: 404508 - DNA, 25 bp, Homo sapien
tgtcccattctgtcttgttctttac

SEQ ID NO: 404509 - DNA, 25 bp, Homo sapien
gggtagtttcaaagctatatatatt

SEQ ID NO: 404510 - DNA, 25 bp, Homo sapien
gaaggatatattctttatgaacaaa

SEQ ID NO: 404511 - DNA, 25 bp, Homo sapien
atactaaggtcatctggtaactgtg

SEQ ID NO: 404512 - DNA, 25 bp, Homo sapien
ctgtgggattaatatggtcgaaaac

SEQ ID NO: 404513 - DNA, 25 bp, Homo sapien
gaagctgtcccaagcaaactaaatt

SEQ ID NO: 404514 - DNA, 25 bp, Homo sapien
gtcccaagcaaactaaattacctgt

SEQ ID NO: 404515 - DNA, 25 bp, Homo sapien
cccatttcaagggaagaggcaacca

SEQ ID NO: 404516 - DNA, 25 bp, Homo sapien
gaggcaaccacatgaagcaatactt

SEQ ID NO: 404517 - DNA, 25 bp, Homo sapien
aatacttcttacacatgcctaagaa

SEQ ID NO: 404518 - DNA, 25 bp, Homo sapien
acatgcctaagaacgttcattgaaa

SEQ ID NO: 404519 - DNA, 25 bp, Homo sapien
tttaaaaggcatgtgtttcctatgc

SEQ ID NO: 404520 - DNA, 25 bp, Homo sapien
aataacttccaacaacacaggttgg

SEQ ID NO: 404521 - DNA, 25 bp, Homo sapien
caacacaggttggagctgaaggagt

SEQ ID NO: 404522 - DNA, 25 bp, Homo sapien
gagctgaaggagtgcccaggctgcg

SEQ ID NO: 404523 - DNA, 25 bp, Homo sapien
agtgcccaggctgcggatggaggaa

SEQ ID NO: 404524 - DNA, 25 bp, Homo sapien
tggaggaaggacgtgctcgggagaa

SEQ ID NO: 404525 - DNA, 25 bp, Homo sapien
gagagaagcaagatcttctgtgttt

SEQ ID NO: 404526 - DNA, 25 bp, Homo sapien
tcttctgtgtttggaccaaggacac

SEQ ID NO: 404527 - DNA, 25 bp, Homo sapien
gtttggaccaaggacacatttcctt

SEQ ID NO: 404528 - DNA, 25 bp, Homo sapien
caaggacacatttccttactccata

SEQ ID NO: 404529 - DNA, 25 bp, Homo sapien
gacacatttccttactccatagcag

SEQ ID NO: 404530 - DNA, 25 bp, Homo sapien
atttccttactccatagcagctgtg

SEQ ID NO: 404531 - DNA, 25 bp, Homo sapien
gaagaatctcaatgtctgtgaatct

SEQ ID NO: 404532 - DNA, 25 bp, Homo sapien
tctcaatgtctgtgaatctcagtca

SEQ ID NO: 404533 - DNA, 25 bp, Homo sapien
aatctcagtcacttgattctggatc

SEQ ID NO: 404534 - DNA, 25 bp, Homo sapien
gattctggatcatgcagtgctctcc

SEQ ID NO: 404535 - DNA, 25 bp, Homo sapien
tctggatcatgcagtgctctccaaa

SEQ ID NO: 404536 - DNA, 25 bp, Homo sapien
gagtttgtgagtgagaagcttccta

SEQ ID NO: 404537 - DNA, 25 bp, Homo sapien
gtgagaagcttcctaaacaaagatt

SEQ ID NO: 404538 - DNA, 25 bp, Homo sapien
ggttcaggagaaagaagaccttctt

SEQ ID NO: 404539 - DNA, 25 bp, Homo sapien
gaaagaagaccttcttcggaggcta

SEQ ID NO: 404540 - DNA, 25 bp, Homo sapien
gaccttcttcggaggctaaaactag

SEQ ID NO: 404541 - DNA, 25 bp, Homo sapien
cttcttcggaggctaaaactagtca

SEQ ID NO: 404542 - DNA, 25 bp, Homo sapien
gtcccttccacaaaacaatattttg

SEQ ID NO: 404543 - DNA, 25 bp, Homo sapien
ttgaaagatgattacctattaggtt

SEQ ID NO: 404544 - DNA, 25 bp, Homo sapien
acctattaggttgtaatactgtcag

SEQ ID NO: 404545 - DNA, 25 bp, Homo sapien
aatactgtcagtttaggcagcttct

SEQ ID NO: 404546 - DNA, 25 bp, Homo sapien
actgtcagtttaggcagcttcttcc

SEQ ID NO: 404547 - DNA, 25 bp, Homo sapien
aagccttaacctcttaacctgatag

SEQ ID NO: 404548 - DNA, 25 bp, Homo sapien
ttaacctcttaacctgatagttcag

SEQ ID NO: 404549 - DNA, 25 bp, Homo sapien
ttaacctgatagttcagacagacag

SEQ ID NO: 404550 - DNA, 25 bp, Homo sapien
agattttgcaaaggtttcgctggga

SEQ ID NO: 404551 - DNA, 25 bp, Homo sapien
gaagcatatttggtttgactgtctc

SEQ ID NO: 404552 - DNA, 25 bp, Homo sapien
gcatatttggtttgactgtctcttt

SEQ ID NO: 404553 - DNA, 25 bp, Homo sapien
gagcctagccaatagtttgactgcg

SEQ ID NO: 404554 - DNA, 25 bp, Homo sapien
gactgcgatttcatgggagacctca

SEQ ID NO: 404555 - DNA, 25 bp, Homo sapien
agacctcaaggcagagtgatccaga

SEQ ID NO: 404556 - DNA, 25 bp, Homo sapien
accacagtctggaggctatgaagtc

SEQ ID NO: 404557 - DNA, 25 bp, Homo sapien
gaagtccatgattaagaagccagca

SEQ ID NO: 404558 - DNA, 25 bp, Homo sapien
aagaagccagcacgtttgctttctg

SEQ ID NO: 404559 - DNA, 25 bp, Homo sapien
cacgtttgctttctggttccaagat

SEQ ID NO: 404560 - DNA, 25 bp, Homo sapien
aagatggcacacctttttgctgctt

SEQ ID NO: 404561 - DNA, 25 bp, Homo sapien
ggaacactgtgttctcacatagtag

SEQ ID NO: 404562 - DNA, 25 bp, Homo sapien
cacacatgtaaatttccacctcagt

SEQ ID NO: 404563 - DNA, 25 bp, Homo sapien
ggaaacagatactgcaatcccagaa

SEQ ID NO: 404564 - DNA, 25 bp, Homo sapien
gatgaattacttccaggctgctgtt

SEQ ID NO: 404565 - DNA, 25 bp, Homo sapien
tgggtagaggctgcggtcactcccc

SEQ ID NO: 404566 - DNA, 25 bp, Homo sapien
gtcaatgctggttcctgttcctgag

SEQ ID NO: 404567 - DNA, 25 bp, Homo sapien
gttcctgttcctgaggccgagagaa

SEQ ID NO: 404568 - DNA, 25 bp, Homo sapien
gaggccgagagaactcctgacagca

SEQ ID NO: 404569 - DNA, 25 bp, Homo sapien
tcctgacagcagagtgggcatatct

SEQ ID NO: 404570 - DNA, 25 bp, Homo sapien
gcagagtgggcatatcttggtagtt

SEQ ID NO: 404571 - DNA, 25 bp, Homo sapien
cagcttttcaagacagtgtggccca

SEQ ID NO: 404572 - DNA, 25 bp, Homo sapien
tttgtggccccgtggtcactgaaaa

SEQ ID NO: 404573 - DNA, 25 bp, Homo sapien
gccccgtggtcactgaaaagccaga

SEQ ID NO: 404574 - DNA, 25 bp, Homo sapien
gaatgaatattcttcctttcggaat

SEQ ID NO: 404575 - DNA, 25 bp, Homo sapien
agacagaggctctgcacagtccctg

SEQ ID NO: 404576 - DNA, 25 bp, Homo sapien
tgcacagtccctgtctcagacattg

SEQ ID NO: 404577 - DNA, 25 bp, Homo sapien
acagtccctgtctcagacattgtct

SEQ ID NO: 404578 - DNA, 25 bp, Homo sapien
tcagacattgtctcctccttagaag

SEQ ID NO: 404579 - DNA, 25 bp, Homo sapien
attgtctcctccttagaagatacct

SEQ ID NO: 404580 - DNA, 25 bp, Homo sapien
gtctcctccttagaagatacctaac

SEQ ID NO: 404581 - DNA, 25 bp, Homo sapien
gaagatacctaacaacagcactgtg

SEQ ID NO: 404582 - DNA, 25 bp, Homo sapien
atacctaacaacagcactgtgggag

SEQ ID NO: 404583 - DNA, 25 bp, Homo sapien
caagaccatccttgatctttagtag

SEQ ID NO: 404584 - DNA, 25 bp, Homo sapien
gaccatccttgatctttagtagaga

SEQ ID NO: 404585 - DNA, 25 bp, Homo sapien
aaaaattagctagccgtggcggcgg

SEQ ID NO: 404586 - DNA, 25 bp, Homo sapien
tcaacaggttcttgagctggcaggg

SEQ ID NO: 404587 - DNA, 25 bp, Homo sapien
gagagacattcaaacaccaaggatt

SEQ ID NO: 404588 - DNA, 25 bp, Homo sapien
ataccattacaggtttaaagacaga

SEQ ID NO: 404589 - DNA, 25 bp, Homo sapien
gacagaggcctataagggtcccctg

SEQ ID NO: 404590 - DNA, 25 bp, Homo sapien
aggcctataagggtcccctggcagt

SEQ ID NO: 404591 - DNA, 25 bp, Homo sapien
catggtcggctgtacctgtagaggt

SEQ ID NO: 404592 - DNA, 25 bp, Homo sapien
tcggctgtacctgtagaggtgtcta

SEQ ID NO: 404593 - DNA, 25 bp, Homo sapien
aaagggaggcttgcaagctgcccct

SEQ ID NO: 404594 - DNA, 25 bp, Homo sapien
caagctgccccttgaaggacgagca

SEQ ID NO: 404595 - DNA, 25 bp, Homo sapien
gccccttgaaggacgagcagaaaat

SEQ ID NO: 404596 - DNA, 25 bp, Homo sapien
aaggcatggaggttgtccatagaat

SEQ ID NO: 404597 - DNA, 25 bp, Homo sapien
aatggccctggttttcaatgctgcc

SEQ ID NO: 404598 - DNA, 25 bp, Homo sapien
ccctggttttcaatgctgccaaagt

SEQ ID NO: 404599 - DNA, 25 bp, Homo sapien
ggttttcaatgctgccaaagttaag

SEQ ID NO: 404600 - DNA, 25 bp, Homo sapien
taaagtgccatgtgtttaaccgcag

SEQ ID NO: 404601 - DNA, 25 bp, Homo sapien
gccatgtgtttaaccgcaggaaaaa

SEQ ID NO: 404602 - DNA, 25 bp, Homo sapien
ggtctttttaactattgagaagtag

SEQ ID NO: 404603 - DNA, 25 bp, Homo sapien
tactctgtgattaacttccttctcc

SEQ ID NO: 404604 - DNA, 25 bp, Homo sapien
aaccaggagactcgtgaggactgca

SEQ ID NO: 404605 - DNA, 25 bp, Homo sapien
gagtgaaatctctgaccagaaagtt

SEQ ID NO: 404606 - DNA, 25 bp, Homo sapien
atctctgaccagaaagttcctggca

SEQ ID NO: 404607 - DNA, 25 bp, Homo sapien
tcctggcacctaccttgggttctgt

SEQ ID NO: 404608 - DNA, 25 bp, Homo sapien
gcttttgcagtcgtgtaatgggccc

SEQ ID NO: 404609 - DNA, 25 bp, Homo sapien
ttttgcagtcgtgtaatgggcccaa

SEQ ID NO: 404610 - DNA, 25 bp, Homo sapien
tgtaatgggcccaagtcattgtttt

SEQ ID NO: 404611 - DNA, 25 bp, Homo sapien
tcactttccaccaagtgtctagagt

SEQ ID NO: 404612 - DNA, 25 bp, Homo sapien
tcagtgacccatgagacggagatct

SEQ ID NO: 404613 - DNA, 25 bp, Homo sapien
tgacccatgagacggagatctcgcc

SEQ ID NO: 404614 - DNA, 25 bp, Homo sapien
tgagacggagatctcgccggcttta

SEQ ID NO: 404615 - DNA, 25 bp, Homo sapien
agatctcgccggctttacgttcacc

SEQ ID NO: 404616 - DNA, 25 bp, Homo sapien
ggctttacgttcacctcggtgtctg

SEQ ID NO: 404617 - DNA, 25 bp, Homo sapien
ttacgttcacctcggtgtctgcagc

SEQ ID NO: 404618 - DNA, 25 bp, Homo sapien
ttctacagaagccaagctccctgga

SEQ ID NO: 404619 - DNA, 25 bp, Homo sapien
gaaaacttactttcttgactcaaag

SEQ ID NO: 404620 - DNA, 25 bp, Homo sapien
tgactcaaagtcagctgtcaatgac

SEQ ID NO: 404621 - DNA, 25 bp, Homo sapien
gctgtcaatgactaggctgccaaag

SEQ ID NO: 404622 - DNA, 25 bp, Homo sapien
atgaggacacctagctgtgaagctt

SEQ ID NO: 404623 - DNA, 25 bp, Homo sapien
gaagcttagtattgcatgcctgctc

SEQ ID NO: 404624 - DNA, 25 bp, Homo sapien
atgcctgctctattagcgcagccaa

SEQ ID NO: 404625 - DNA, 25 bp, Homo sapien
attagcgcagccaaatagggaagag

SEQ ID NO: 404626 - DNA, 25 bp, Homo sapien
gttaatttctaagttctcaggagag

SEQ ID NO: 404627 - DNA, 25 bp, Homo sapien
aatatggagttagctctgagcacat

SEQ ID NO: 404628 - DNA, 25 bp, Homo sapien
aagtggccttcataagtatccctca

SEQ ID NO: 404629 - DNA, 25 bp, Homo sapien
gtatccctcataaggaatctcccta

SEQ ID NO: 404630 - DNA, 25 bp, Homo sapien
tagcttttgcagtcgtgtaatgggc

SEQ ID NO: 404631 - DNA, 25 bp, Homo sapien
gcttttgcagtcgtgtaatgggccc

SEQ ID NO: 404632 - DNA, 25 bp, Homo sapien
cttttgcagtcgtgtaatgggccca

SEQ ID NO: 404633 - DNA, 25 bp, Homo sapien
ttttgcagtcgtgtaatgggcccaa

SEQ ID NO: 404634 - DNA, 25 bp, Homo sapien
agatctcgccggctttacgttcacc

SEQ ID NO: 404635 - DNA, 25 bp, Homo sapien
gatctcgccggctttacgttcacct

SEQ ID NO: 404636 - DNA, 25 bp, Homo sapien
gccggctttacgttcacctcggtgt

SEQ ID NO: 404637 - DNA, 25 bp, Homo sapien
ggctttacgttcacctcggtgtctg

SEQ ID NO: 404638 - DNA, 25 bp, Homo sapien
tttacgttcacctcggtgtctgcag

SEQ ID NO: 404639 - DNA, 25 bp, Homo sapien
ttacgttcacctcggtgtctgcagc

SEQ ID NO: 404640 - DNA, 25 bp, Homo sapien
acgttcacctcggtgtctgcagcac

SEQ ID NO: 404641 - DNA, 25 bp, Homo sapien
tttaccttaatggagcctgggattt

SEQ ID NO: 404642 - DNA, 25 bp, Homo sapien
gaagaagagctagttcgaattgact

SEQ ID NO: 404643 - DNA, 25 bp, Homo sapien
gagctagttcgaattgactcaatga

SEQ ID NO: 404644 - DNA, 25 bp, Homo sapien
gaattgactcaatgacagtgataca

SEQ ID NO: 404645 - DNA, 25 bp, Homo sapien
gacagtgatacagtaagttagtaac

SEQ ID NO: 404646 - DNA, 25 bp, Homo sapien
agtaactgacaattgaactctactg

SEQ ID NO: 404647 - DNA, 25 bp, Homo sapien
ttcagattttgaactttcacattag

SEQ ID NO: 404648 - DNA, 25 bp, Homo sapien
gaactctactgtaatactaatatat

SEQ ID NO: 404649 - DNA, 25 bp, Homo sapien
gaactttcacattagggatgctcaa

SEQ ID NO: 404650 - DNA, 25 bp, Homo sapien
taacatcatactgtatttccatatg

SEQ ID NO: 404651 - DNA, 25 bp, Homo sapien
gtatttccatatgtacttattattg

SEQ ID NO: 404652 - DNA, 25 bp, Homo sapien
aagctgtgaggtatctgatctggcc

SEQ ID NO: 404653 - DNA, 25 bp, Homo sapien
aggtatctgatctggcctctgtaga

SEQ ID NO: 404654 - DNA, 25 bp, Homo sapien
gatctggcctctgtagatgaacaat

SEQ ID NO: 404655 - DNA, 25 bp, Homo sapien
tagatgaacaattgagccacaccct

SEQ ID NO: 404656 - DNA, 25 bp, Homo sapien
tgagccacaccctgaagttttctca

SEQ ID NO: 404657 - DNA, 25 bp, Homo sapien
tcacctccccaatgtattgccatga

SEQ ID NO: 404658 - DNA, 25 bp, Homo sapien
atgtattgccatgaggataaggaca

SEQ ID NO: 404659 - DNA, 25 bp, Homo sapien
aaggacaggtccctattggtcatga

SEQ ID NO: 404660 - DNA, 25 bp, Homo sapien
tattggtcatgacatcccttgctgc

SEQ ID NO: 404661 - DNA, 25 bp, Homo sapien
cagagagagcctaaagtcctagcta

SEQ ID NO: 404662 - DNA, 25 bp, Homo sapien
taaagagttgaactagcctgggcaa

SEQ ID NO: 404663 - DNA, 25 bp, Homo sapien
gtggtaatggagtgattctttttct

SEQ ID NO: 404664 - DNA, 25 bp, Homo sapien
aatgatctttctccacatgtgaagc

SEQ ID NO: 404665 - DNA, 25 bp, Homo sapien
tctccacatgtgaagctagttgcaa

SEQ ID NO: 404666 - DNA, 25 bp, Homo sapien
ttcagaacagtccagtgacaccagt

SEQ ID NO: 404667 - DNA, 25 bp, Homo sapien
ccagttctgtgttggcagttgagta

SEQ ID NO: 404668 - DNA, 25 bp, Homo sapien
agaattcaatcctaatcctgctgca

SEQ ID NO: 404669 - DNA, 25 bp, Homo sapien
ctaatcctgctgcaagtgctggttt

SEQ ID NO: 404670 - DNA, 25 bp, Homo sapien
gtgctggttttactgggtcatatct

SEQ ID NO: 404671 - DNA, 25 bp, Homo sapien
gggtcatatcttggtagtcagaaaa

SEQ ID NO: 404672 - DNA, 25 bp, Homo sapien
acagccccacagttttacagatcca

SEQ ID NO: 404673 - DNA, 25 bp, Homo sapien
ttttacagatccaatatccgcccat

SEQ ID NO: 404674 - DNA, 25 bp, Homo sapien
ggtgcccgtcggtcaccacaatcag

SEQ ID NO: 404675 - DNA, 25 bp, Homo sapien
gtcggtcaccacaatcaggtactta

SEQ ID NO: 404676 - DNA, 25 bp, Homo sapien
ccacaatcaggtacttattctcctt

SEQ ID NO: 404677 - DNA, 25 bp, Homo sapien
agccccttcttgatagcgcagtcgg

SEQ ID NO: 404678 - DNA, 25 bp, Homo sapien
cccttcttgatagcgcagtcggtgt

SEQ ID NO: 404679 - DNA, 25 bp, Homo sapien
atagcgcagtcggtgtaggtgccct

SEQ ID NO: 404680 - DNA, 25 bp, Homo sapien
gtcggtgtaggtgcccttcccaaag

SEQ ID NO: 404681 - DNA, 25 bp, Homo sapien
tgtaggtgcccttcccaaagtactt

SEQ ID NO: 404682 - DNA, 25 bp, Homo sapien
caaagtacttgaccgcgtccacgct

SEQ ID NO: 404683 - DNA, 25 bp, Homo sapien
gcgtccacgctgcttttgagtgcgt

SEQ ID NO: 404684 - DNA, 25 bp, Homo sapien
acgctgcttttgagtgcgtcgcggc

SEQ ID NO: 404685 - DNA, 25 bp, Homo sapien
gaatgcccaagtataccctgctgga

SEQ ID NO: 404686 - DNA, 25 bp, Homo sapien
tgtctggacatgctttaataccgtc

SEQ ID NO: 404687 - DNA, 25 bp, Homo sapien
taataccgtccatttctactgttgc

SEQ ID NO: 404688 - DNA, 25 bp, Homo sapien
tactgttgccataccaagccgctac

SEQ ID NO: 404689 - DNA, 25 bp, Homo sapien
aagccgctactggtcaccactgtaa

SEQ ID NO: 404690 - DNA, 25 bp, Homo sapien
actggtcaccactgtaaatctttct

SEQ ID NO: 404691 - DNA, 25 bp, Homo sapien
agtatagcacaatttctgtctgctt

SEQ ID NO: 404692 - DNA, 25 bp, Homo sapien
gtaatttcccttaagttactgatcg

SEQ ID NO: 404693 - DNA, 25 bp, Homo sapien
aagttactgatcgtggagcctctcc

SEQ ID NO: 404694 - DNA, 25 bp, Homo sapien
gtggagcctctccaggactacaggc

SEQ ID NO: 404695 - DNA, 25 bp, Homo sapien
aggactacaggctcttcctcagcgg

SEQ ID NO: 404696 - DNA, 25 bp, Homo sapien
atagcattggtggtttgtactggga

SEQ ID NO: 404697 - DNA, 25 bp, Homo sapien
agatgctccatatgggatctcatgc

SEQ ID NO: 404698 - DNA, 25 bp, Homo sapien
atatgggatctcatgccggcagcta

SEQ ID NO: 404699 - DNA, 25 bp, Homo sapien
gctagcatggcattgtgatcgcgac

SEQ ID NO: 404700 - DNA, 25 bp, Homo sapien
attgtgatcgcgacacccagggtga

SEQ ID NO: 404701 - DNA, 25 bp, Homo sapien
acacccagggtgagtcccagctttg

SEQ ID NO: 404702 - DNA, 25 bp, Homo sapien
atgctacccacctatgtctggcagg

SEQ ID NO: 404703 - DNA, 25 bp, Homo sapien
taactcaaattctttggccccttct

SEQ ID NO: 404704 - DNA, 25 bp, Homo sapien
gccccttctttaattcagagccata

SEQ ID NO: 404705 - DNA, 25 bp, Homo sapien
agagccataggccaatcaccgtact

SEQ ID NO: 404706 - DNA, 25 bp, Homo sapien
caatcaccgtactttcttcatttac

SEQ ID NO: 404707 - DNA, 25 bp, Homo sapien
ctgccatgcccggaatgcatttaag

SEQ ID NO: 404708 - DNA, 25 bp, Homo sapien
gtggtttgtaccatgcatgaactta

SEQ ID NO: 404709 - DNA, 25 bp, Homo sapien
ttacaagcaatgctggcccactgcc

SEQ ID NO: 404710 - DNA, 25 bp, Homo sapien
tgccttgaggtctctgcaggactct

SEQ ID NO: 404711 - DNA, 25 bp, Homo sapien
gcaggactcttccagggcagtgaaa

SEQ ID NO: 404712 - DNA, 25 bp, Homo sapien
gtcagatttgggattcgggcaagaa

SEQ ID NO: 404713 - DNA, 25 bp, Homo sapien
cctgttggctcaagggtaggacaca

SEQ ID NO: 404714 - DNA, 25 bp, Homo sapien
gtaggacacagccaggccgatgcct

SEQ ID NO: 404715 - DNA, 25 bp, Homo sapien
ctcttctaatcttgaccacaggcag

SEQ ID NO: 404716 - DNA, 25 bp, Homo sapien
ttgaccacaggcagctctaggaagt

SEQ ID NO: 404717 - DNA, 25 bp, Homo sapien
gaagtctgatgggtctcctgccatg

SEQ ID NO: 404718 - DNA, 25 bp, Homo sapien
tattcagatagtccaaatttaggtt

SEQ ID NO: 404719 - DNA, 25 bp, Homo sapien
gacacattaactaaatgcccagttt

SEQ ID NO: 404720 - DNA, 25 bp, Homo sapien
aaaatatatccatcaattcacgctg

SEQ ID NO: 404721 - DNA, 25 bp, Homo sapien
atcaattcacgctgaaatgtgcttc

SEQ ID NO: 404722 - DNA, 25 bp, Homo sapien
gaaatgtgcttctttgtgctatcaa

SEQ ID NO: 404723 - DNA, 25 bp, Homo sapien
aacaatcccagaatactgtgtgtag

SEQ ID NO: 404724 - DNA, 25 bp, Homo sapien
ctgtgtgtagacttttgttgtgctc

SEQ ID NO: 404725 - DNA, 25 bp, Homo sapien
tgtttacttatcttacaaagctcaa

SEQ ID NO: 404726 - DNA, 25 bp, Homo sapien
caaagctcaaatactggattgtaac

SEQ ID NO: 404727 - DNA, 25 bp, Homo sapien
gatgaagttatctatgttgtaccta

SEQ ID NO: 404728 - DNA, 25 bp, Homo sapien
gttgtacctaacattgcaaattaat

SEQ ID NO: 404729 - DNA, 25 bp, Homo sapien
tcaccactaaccaaaatgagcgcag

SEQ ID NO: 404730 - DNA, 25 bp, Homo sapien
accactaaccaaaatgagcgcagaa

SEQ ID NO: 404731 - DNA, 25 bp, Homo sapien
gagcgcagaaaacgagtaccgcccg

SEQ ID NO: 404732 - DNA, 25 bp, Homo sapien
gcagaaaacgagtaccgcccgccgt

SEQ ID NO: 404733 - DNA, 25 bp, Homo sapien
cgtcgccaccgaagctggctgcgga

SEQ ID NO: 404734 - DNA, 25 bp, Homo sapien
aagctggctgcggagcgcgacaagc

SEQ ID NO: 404735 - DNA, 25 bp, Homo sapien
gtgcgcccggcatagcccaggacag

SEQ ID NO: 404736 - DNA, 25 bp, Homo sapien
cggcatagcccaggacagttcccag

SEQ ID NO: 404737 - DNA, 25 bp, Homo sapien
gttcgcgcctcgctccaggagcaag

SEQ ID NO: 404738 - DNA, 25 bp, Homo sapien
tcgcgcctcgctccaggagcaagag

SEQ ID NO: 404739 - DNA, 25 bp, Homo sapien
cgcggtcgcaagtgcgcccggaggc

SEQ ID NO: 404740 - DNA, 25 bp, Homo sapien
aattgttgtaatgaagttcctgtga

SEQ ID NO: 404741 - DNA, 25 bp, Homo sapien
gttcctgtgaacatcattatggttt

SEQ ID NO: 404742 - DNA, 25 bp, Homo sapien
aaataggaacctctgatgtcattct

SEQ ID NO: 404743 - DNA, 25 bp, Homo sapien
gatgtcattcttcaacgtttgttcc

SEQ ID NO: 404744 - DNA, 25 bp, Homo sapien
cttcaacgtttgttcctgtgtgtac

SEQ ID NO: 404745 - DNA, 25 bp, Homo sapien
gtactttgtatgaacagctttatca

SEQ ID NO: 404746 - DNA, 25 bp, Homo sapien
ttatcatttttataggctttccatg

SEQ ID NO: 404747 - DNA, 25 bp, Homo sapien
ggctttccatgagttttgctgtaac

SEQ ID NO: 404748 - DNA, 25 bp, Homo sapien
atttgtgaaagtcttactcctttgt

SEQ ID NO: 404749 - DNA, 25 bp, Homo sapien
gtttctgcacaactactgtactttt

SEQ ID NO: 404750 - DNA, 25 bp, Homo sapien
aactactgtacttttccatatggaa

SEQ ID NO: 404751 - DNA, 25 bp, Homo sapien
ttttttgagctcatgatgcctgtat

SEQ ID NO: 404752 - DNA, 25 bp, Homo sapien
gctcatgatgcctgtattaccattt

SEQ ID NO: 404753 - DNA, 25 bp, Homo sapien
gcctgtattaccatttgctgaactc

SEQ ID NO: 404754 - DNA, 25 bp, Homo sapien
tgctgaactcaaaatactccaatgg

SEQ ID NO: 404755 - DNA, 25 bp, Homo sapien
aaatactccaatggtttcctgccaa

SEQ ID NO: 404756 - DNA, 25 bp, Homo sapien
ggtttcctgccaaaatgtaatcatg

SEQ ID NO: 404757 - DNA, 25 bp, Homo sapien
atcatgttatgattgtccaccaaga

SEQ ID NO: 404758 - DNA, 25 bp, Homo sapien
tgtccaccaagaccatttctaaggt

SEQ ID NO: 404759 - DNA, 25 bp, Homo sapien
ggtagaaaccttacatcagaagatg

SEQ ID NO: 404760 - DNA, 25 bp, Homo sapien
actgtgtgggtatatggttcacctt

SEQ ID NO: 404761 - DNA, 25 bp, Homo sapien
ggttcaccttaaaatccatgcctta

SEQ ID NO: 404762 - DNA, 25 bp, Homo sapien
attcaggtaaactatattcatgcat

SEQ ID NO: 404763 - DNA, 25 bp, Homo sapien
attcatgcataagatgactgtggtg

SEQ ID NO: 404764 - DNA, 25 bp, Homo sapien
ttacatgtgaacctcaagtcgcctg

SEQ ID NO: 404765 - DNA, 25 bp, Homo sapien
aagtcgcctgtgacccaagtgagat

SEQ ID NO: 404766 - DNA, 25 bp, Homo sapien
gcctgtgacccaagtgagattgtta

SEQ ID NO: 404767 - DNA, 25 bp, Homo sapien
gtgagattgttagtgttctgaatac

SEQ ID NO: 404768 - DNA, 25 bp, Homo sapien
gtatcatttttagcctttgtgtatc

SEQ ID NO: 404769 - DNA, 25 bp, Homo sapien
ttatggttatgatcctggtagctaa

SEQ ID NO: 404770 - DNA, 25 bp, Homo sapien
gttatgatcctggtagctaattttt

SEQ ID NO: 404771 - DNA, 25 bp, Homo sapien
aacccttcatacctactgttaatca

SEQ ID NO: 404772 - DNA, 25 bp, Homo sapien
atacctactgttaatcattgttttt

SEQ ID NO: 404773 - DNA, 25 bp, Homo sapien
agcccagcgaacgtgtgaaggctgc

SEQ ID NO: 404774 - DNA, 25 bp, Homo sapien
aacgtgtgaaggctgccccctgctg

SEQ ID NO: 404775 - DNA, 25 bp, Homo sapien
acactcaagtcactgccgcccaggg

SEQ ID NO: 404776 - DNA, 25 bp, Homo sapien
tgctgggaaagtgtaggctggtgcc

SEQ ID NO: 404777 - DNA, 25 bp, Homo sapien
actgcttcttactccctccctagag

SEQ ID NO: 404778 - DNA, 25 bp, Homo sapien
acaaaaagtgcctgcctgtgctctc

SEQ ID NO: 404779 - DNA, 25 bp, Homo sapien
tgagctccctgcaacacagtggaag

SEQ ID NO: 404780 - DNA, 25 bp, Homo sapien
gctccctgcaacacagtggaagggt

SEQ ID NO: 404781 - DNA, 25 bp, Homo sapien
ggaagggtagagagccacagtcccc

SEQ ID NO: 404782 - DNA, 25 bp, Homo sapien
acagtccccaaatcctatgcaataa

SEQ ID NO: 404783 - DNA, 25 bp, Homo sapien
gtccccaaatcctatgcaataaagt

SEQ ID NO: 404784 - DNA, 25 bp, Homo sapien
aggagccagtctatggccccaaaag

SEQ ID NO: 404785 - DNA, 25 bp, Homo sapien
atggccccaaaagcatagtgtgtag

SEQ ID NO: 404786 - DNA, 25 bp, Homo sapien
gtgtagggttttagcctggaatcca

SEQ ID NO: 404787 - DNA, 25 bp, Homo sapien
aagcagttcagactaggctggccat

SEQ ID NO: 404788 - DNA, 25 bp, Homo sapien
ccaaccagttcctctagactgatgt

SEQ ID NO: 404789 - DNA, 25 bp, Homo sapien
agttcctctagactgatgttctcct

SEQ ID NO: 404790 - DNA, 25 bp, Homo sapien
atgttctcctctctcctatgacttt

SEQ ID NO: 404791 - DNA, 25 bp, Homo sapien
tctcctatgactttctaccctaggg

SEQ ID NO: 404792 - DNA, 25 bp, Homo sapien
taggctggccatagaggagatgaca

SEQ ID NO: 404793 - DNA, 25 bp, Homo sapien
gatgacaggcctggtgcagattcac

SEQ ID NO: 404794 - DNA, 25 bp, Homo sapien
ggcctggtgcagattcacctgggaa

SEQ ID NO: 404795 - DNA, 25 bp, Homo sapien
aagacggccccgctggaaatggcac

SEQ ID NO: 404796 - DNA, 25 bp, Homo sapien
gctggaaatggcaccgagggcttcc

SEQ ID NO: 404797 - DNA, 25 bp, Homo sapien
gcttccccgggtatccgggcaacag

SEQ ID NO: 404798 - DNA, 25 bp, Homo sapien
accccggagacgataacaacgacat

SEQ ID NO: 404799 - DNA, 25 bp, Homo sapien
gataacaacgacattgcaccccgag

SEQ ID NO: 404800 - DNA, 25 bp, Homo sapien
acaacgacattgcaccccgaggagt

SEQ ID NO: 404801 - DNA, 25 bp, Homo sapien
cattgcaccccgaggagtcaaagga

SEQ ID NO: 404802 - DNA, 25 bp, Homo sapien
caccccgaggagtcaaaggagcaaa

SEQ ID NO: 404803 - DNA, 25 bp, Homo sapien
aggacaccaaggaccgcctgggccg

SEQ ID NO: 404804 - DNA, 25 bp, Homo sapien
caaggaccgcctgggccggacgaat

SEQ ID NO: 404805 - DNA, 25 bp, Homo sapien
ctgggccggacgaatgcgagatttt

SEQ ID NO: 404806 - DNA, 25 bp, Homo sapien
actctggcccctgctcagcctgatg

SEQ ID NO: 404807 - DNA, 25 bp, Homo sapien
tgctcagcctgatgggcgttctggt

SEQ ID NO: 404808 - DNA, 25 bp, Homo sapien
ctgatgggcgttctggtgcagtgga

SEQ ID NO: 404809 - DNA, 25 bp, Homo sapien
cgttctggtgcagtggagggtgaca

SEQ ID NO: 404810 - DNA, 25 bp, Homo sapien
acagctgagggggactcccacacgg

SEQ ID NO: 404811 - DNA, 25 bp, Homo sapien
actcccacacggaagtggtcatcag

SEQ ID NO: 404812 - DNA, 25 bp, Homo sapien
ctcccacacggaagtggtcatcagc

SEQ ID NO: 404813 - DNA, 25 bp, Homo sapien
agcgccgacgcgtgcaactgatgcg

SEQ ID NO: 404814 - DNA, 25 bp, Homo sapien
gcgtgcaactgatgcggattcggca

SEQ ID NO: 404815 - DNA, 25 bp, Homo sapien
acgcttcaatggagacgtcctctcc

SEQ ID NO: 404816 - DNA, 25 bp, Homo sapien
tcaatggagacgtcctctccccgag

SEQ ID NO: 404817 - DNA, 25 bp, Homo sapien
acgctgcagcattaaggaatgtgat

SEQ ID NO: 404818 - DNA, 25 bp, Homo sapien
cgctgcagcattaaggaatgtgata

SEQ ID NO: 404819 - DNA, 25 bp, Homo sapien
gctgcagcattaaggaatgtgatag

SEQ ID NO: 404820 - DNA, 25 bp, Homo sapien
ctgcagcattaaggaatgtgataga

SEQ ID NO: 404821 - DNA, 25 bp, Homo sapien
gaaaagattctgaatataggccagg

SEQ ID NO: 404822 - DNA, 25 bp, Homo sapien
aaaagattctgaatataggccaggc

SEQ ID NO: 404823 - DNA, 25 bp, Homo sapien
aaagattctgaatataggccaggcg

SEQ ID NO: 404824 - DNA, 25 bp, Homo sapien
aagattctgaatataggccaggcgc

SEQ ID NO: 404825 - DNA, 25 bp, Homo sapien
agattctgaatataggccaggcgca

SEQ ID NO: 404826 - DNA, 25 bp, Homo sapien
ggaacttgcactgggctgagatcgc

SEQ ID NO: 404827 - DNA, 25 bp, Homo sapien
gaacttgcactgggctgagatcgcg

SEQ ID NO: 404828 - DNA, 25 bp, Homo sapien
cttgcccggagcctgagaggattat

SEQ ID NO: 404829 - DNA, 25 bp, Homo sapien
attatgaaaacgtggcgagcgaaat

SEQ ID NO: 404830 - DNA, 25 bp, Homo sapien
ggctagggcgctttcgggtccccat

SEQ ID NO: 404831 - DNA, 25 bp, Homo sapien
tctgccgcgggcactgtgagtcctg

SEQ ID NO: 404832 - DNA, 25 bp, Homo sapien
actgtgagtcctggccgatgatgac

SEQ ID NO: 404833 - DNA, 25 bp, Homo sapien
gatgatgacgagaccactgcgcaat

SEQ ID NO: 404834 - DNA, 25 bp, Homo sapien
agaccactgcgcaatctgagttctg

SEQ ID NO: 404835 - DNA, 25 bp, Homo sapien
tgcgcaatctgagttctgggaacca

SEQ ID NO: 404836 - DNA, 25 bp, Homo sapien
ggatgagcccgcagtattttcctta

SEQ ID NO: 404837 - DNA, 25 bp, Homo sapien
tgagcccgcagtattttccttatat

SEQ ID NO: 404838 - DNA, 25 bp, Homo sapien
tatatgatcaggtcccattgcgggc

SEQ ID NO: 404839 - DNA, 25 bp, Homo sapien
gctggcctctcgagctcctgtgtga

SEQ ID NO: 404840 - DNA, 25 bp, Homo sapien
cacggccaacagaccgatgggtgct

SEQ ID NO: 404841 - DNA, 25 bp, Homo sapien
ccaacagaccgatgggtgctggcga

SEQ ID NO: 404842 - DNA, 25 bp, Homo sapien
agagtgctggagtgcctggcgtcgg

SEQ ID NO: 404843 - DNA, 25 bp, Homo sapien
gggcatcgtgatgccagatggttct

SEQ ID NO: 404844 - DNA, 25 bp, Homo sapien
cccggacgttctggacaggcagaaa

SEQ ID NO: 404845 - DNA, 25 bp, Homo sapien
caggccagagccaacgggctgaagt

SEQ ID NO: 404846 - DNA, 25 bp, Homo sapien
caacgggctgaagtcttgtgtcatt

SEQ ID NO: 404847 - DNA, 25 bp, Homo sapien
ctgaagtcttgtgtcattgtgatcc

SEQ ID NO: 404848 - DNA, 25 bp, Homo sapien
ttgtgatccgggtcttgagggacct

SEQ ID NO: 404849 - DNA, 25 bp, Homo sapien
ttgagggacctgtgcactcgcgtgc

SEQ ID NO: 404850 - DNA, 25 bp, Homo sapien
caggcagcacagaggagctgtgaac

SEQ ID NO: 404851 - DNA, 25 bp, Homo sapien
agcacagaggagctgtgaacccgct

SEQ ID NO: 404852 - DNA, 25 bp, Homo sapien
acagaggagctgtgaacccgctcca

SEQ ID NO: 404853 - DNA, 25 bp, Homo sapien
agaggagctgtgaacccgctccaca

SEQ ID NO: 404854 - DNA, 25 bp, Homo sapien
gaggagctgtgaacccgctccacac

SEQ ID NO: 404855 - DNA, 25 bp, Homo sapien
tggcactcacagcaggccggtgcta

SEQ ID NO: 404856 - DNA, 25 bp, Homo sapien
gcactcacagcaggccggtgctaag

SEQ ID NO: 404857 - DNA, 25 bp, Homo sapien
ggtgctaaggagtgtggcgcgggct

SEQ ID NO: 404858 - DNA, 25 bp, Homo sapien
tgtggcgcgggctcgactcccactg

SEQ ID NO: 404859 - DNA, 25 bp, Homo sapien
gccggcctcccgagtgactctgttt

SEQ ID NO: 404860 - DNA, 25 bp, Homo sapien
gcctcccgagtgactctgttttcca

SEQ ID NO: 404861 - DNA, 25 bp, Homo sapien
atgcttatatgtggtaattattcta

SEQ ID NO: 404862 - DNA, 25 bp, Homo sapien
gtttagaagtactcacttgccccta

SEQ ID NO: 404863 - DNA, 25 bp, Homo sapien
tagaagtactcacttgcccctatta

SEQ ID NO: 404864 - DNA, 25 bp, Homo sapien
actcacttgcccctattactatatg

SEQ ID NO: 404865 - DNA, 25 bp, Homo sapien
ttgcccctattactatatgccctac

SEQ ID NO: 404866 - DNA, 25 bp, Homo sapien
ctattactatatgccctacccaaga

SEQ ID NO: 404867 - DNA, 25 bp, Homo sapien
ctatatgccctacccaagaaatggt

SEQ ID NO: 404868 - DNA, 25 bp, Homo sapien
gtagacgataccatttgaaaaatat

SEQ ID NO: 404869 - DNA, 25 bp, Homo sapien
aaatatgtttgattgtggactgtga

SEQ ID NO: 404870 - DNA, 25 bp, Homo sapien
ttgtggactgtgattaggaacttac

SEQ ID NO: 404871 - DNA, 25 bp, Homo sapien
gactgtgattaggaacttacattat

SEQ ID NO: 404872 - DNA, 25 bp, Homo sapien
cccacctaataaacataactctaat

SEQ ID NO: 404873 - DNA, 25 bp, Homo sapien
tacctttcacactatatgacactac

SEQ ID NO: 404874 - DNA, 25 bp, Homo sapien
cctttcacactatatgacactacat

SEQ ID NO: 404875 - DNA, 25 bp, Homo sapien
ttcacactatatgacactacataag

SEQ ID NO: 404876 - DNA, 25 bp, Homo sapien
ttatagtttttcttattcacacagc

SEQ ID NO: 404877 - DNA, 25 bp, Homo sapien
tagtttttcttattcacacagcttg

SEQ ID NO: 404878 - DNA, 25 bp, Homo sapien
gtttttcttattcacacagcttgac

SEQ ID NO: 404879 - DNA, 25 bp, Homo sapien
ttttcttattcacacagcttgactt

SEQ ID NO: 404880 - DNA, 25 bp, Homo sapien
ttatccatgtgtatttcttccaagc

SEQ ID NO: 404881 - DNA, 25 bp, Homo sapien
atccatgtgtatttcttccaagctc

SEQ ID NO: 404882 - DNA, 25 bp, Homo sapien
tccatgtgtatttcttccaagctca

SEQ ID NO: 404883 - DNA, 25 bp, Homo sapien
ggatctgcaatttctaacatagact

SEQ ID NO: 404884 - DNA, 25 bp, Homo sapien
gcaagaatgcccgatgaacaacctg

SEQ ID NO: 404885 - DNA, 25 bp, Homo sapien
tgaacaacctgcagttctatcagcc

SEQ ID NO: 404886 - DNA, 25 bp, Homo sapien
gttctatcagcccagtctgcactgc

SEQ ID NO: 404887 - DNA, 25 bp, Homo sapien
tgcactgccaggattaacagcgtta

SEQ ID NO: 404888 - DNA, 25 bp, Homo sapien
taacagcgttactccttctgtcatg

SEQ ID NO: 404889 - DNA, 25 bp, Homo sapien
tgtcatgccccgattcatggcagga

SEQ ID NO: 404890 - DNA, 25 bp, Homo sapien
cccgattcatggcaggatcattcat

SEQ ID NO: 404891 - DNA, 25 bp, Homo sapien
gaaagctcgataaccctgcaagtaa

SEQ ID NO: 404892 - DNA, 25 bp, Homo sapien
agtgtgagaacacccaaggcaacaa

SEQ ID NO: 404893 - DNA, 25 bp, Homo sapien
agagagtaaggagtgctgcagcatt

SEQ ID NO: 404894 - DNA, 25 bp, Homo sapien
tatgtcgtgagatttgtattggcaa

SEQ ID NO: 404895 - DNA, 25 bp, Homo sapien
tgtattggcaagaagcagttaattt

SEQ ID NO: 404896 - DNA, 25 bp, Homo sapien
tatctgtggatgtgttggtaactcc

SEQ ID NO: 404897 - DNA, 25 bp, Homo sapien
gatgtgttggtaactccgagttgta

SEQ ID NO: 404898 - DNA, 25 bp, Homo sapien
gtaactccgagttgtaatgagttca

SEQ ID NO: 404899 - DNA, 25 bp, Homo sapien
gaagaggatgcagaactgttcagtg

SEQ ID NO: 404900 - DNA, 25 bp, Homo sapien
agaactgttcagtggtattacatga

SEQ ID NO: 404901 - DNA, 25 bp, Homo sapien
aaatgcattgtgagatgtttctaaa

SEQ ID NO: 404902 - DNA, 25 bp, Homo sapien
gatgtttctaaaataccttcttcaa

SEQ ID NO: 404903 - DNA, 25 bp, Homo sapien
caattcaaaatgatccctgacttta

SEQ ID NO: 404904 - DNA, 25 bp, Homo sapien
taatctcacccattaattccaaaga

SEQ ID NO: 404905 - DNA, 25 bp, Homo sapien
ctcacccagcctacatacaatttta

SEQ ID NO: 404906 - DNA, 25 bp, Homo sapien
cacccagcctacatacaattttaac

SEQ ID NO: 404907 - DNA, 25 bp, Homo sapien
cagcctacatacaattttaaccctt

SEQ ID NO: 404908 - DNA, 25 bp, Homo sapien
tatatataagccaaactcagaaatg

SEQ ID NO: 404909 - DNA, 25 bp, Homo sapien
gaaatgaacattaagatctgataaa

SEQ ID NO: 404910 - DNA, 25 bp, Homo sapien
atgtcttaaaatcgctttccaaaag

SEQ ID NO: 404911 - DNA, 25 bp, Homo sapien
atcgctttccaaaaggattgaacac

SEQ ID NO: 404912 - DNA, 25 bp, Homo sapien
ggattgaacacccttacccgatata

SEQ ID NO: 404913 - DNA, 25 bp, Homo sapien
ttgaacacccttacccgatatataa

SEQ ID NO: 404914 - DNA, 25 bp, Homo sapien
cacccttacccgatatataaatgag

SEQ ID NO: 404915 - DNA, 25 bp, Homo sapien
attttttctgcacacataatgctta

SEQ ID NO: 404916 - DNA, 25 bp, Homo sapien
atagtttttatctgcctttctctta

SEQ ID NO: 404917 - DNA, 25 bp, Homo sapien
ttctcttaacagtgagttcccttag

SEQ ID NO: 404918 - DNA, 25 bp, Homo sapien
ttcccttagagtaggaaccattcat

SEQ ID NO: 404919 - DNA, 25 bp, Homo sapien
tgtttataaccccacactgaagagg

SEQ ID NO: 404920 - DNA, 25 bp, Homo sapien
gccaaaacgacttgcaatttcacat

SEQ ID NO: 404921 - DNA, 25 bp, Homo sapien
atgtgctatgggtctgtttactatc

SEQ ID NO: 404922 - DNA, 25 bp, Homo sapien
tatcagggaaatcactaacacctcc

SEQ ID NO: 404923 - DNA, 25 bp, Homo sapien
taacacctccctcagagtaatgcct

SEQ ID NO: 404924 - DNA, 25 bp, Homo sapien
ttctctcccttacgttcctgcagga

SEQ ID NO: 404925 - DNA, 25 bp, Homo sapien
gttcctgcaggatcttatgttccta

SEQ ID NO: 404926 - DNA, 25 bp, Homo sapien
ttatgttcctaatgtttatctcaaa

SEQ ID NO: 404927 - DNA, 25 bp, Homo sapien
cacttatattgtcactgataggcag

SEQ ID NO: 404928 - DNA, 25 bp, Homo sapien
tgataggcagtcacgctgtgctgat

SEQ ID NO: 404929 - DNA, 25 bp, Homo sapien
ctgtgctgatagaatgtggcctgac

SEQ ID NO: 404930 - DNA, 25 bp, Homo sapien
gaatgtggcctgacacttgatggag

SEQ ID NO: 404931 - DNA, 25 bp, Homo sapien
cctgacacttgatggagtgcagcat

SEQ ID NO: 404932 - DNA, 25 bp, Homo sapien
cagatatatacggtcccgagtttaa

SEQ ID NO: 404933 - DNA, 25 bp, Homo sapien
accagtgcacagctatagtattcct

SEQ ID NO: 404934 - DNA, 25 bp, Homo sapien
gaatttcacattctacaaatggaga

SEQ ID NO: 404935 - DNA, 25 bp, Homo sapien
gaagccttattttaagtcctgcact

SEQ ID NO: 404936 - DNA, 25 bp, Homo sapien
gcactaaggcaggttaacctcatgg

SEQ ID NO: 404937 - DNA, 25 bp, Homo sapien
acctcatgggtgtaattacctggac

SEQ ID NO: 404938 - DNA, 25 bp, Homo sapien
tctgtggccatttttgtcagtgctt

SEQ ID NO: 404939 - DNA, 25 bp, Homo sapien
caatttactagaaagctggatgctg

SEQ ID NO: 404940 - DNA, 25 bp, Homo sapien
agacacagaaagcagagaacatcaa

SEQ ID NO: 404941 - DNA, 25 bp, Homo sapien
cagtgctttatatgtcttaaaggag

SEQ ID NO: 404942 - DNA, 25 bp, Homo sapien
atgtcttaaaggaggaggctttctt

SEQ ID NO: 404943 - DNA, 25 bp, Homo sapien
ggaggaggctttctttagcttttct

SEQ ID NO: 404944 - DNA, 25 bp, Homo sapien
gaggaggctttctttagcttttctg

SEQ ID NO: 404945 - DNA, 25 bp, Homo sapien
tttctgtctttccaggacaatgccg

SEQ ID NO: 404946 - DNA, 25 bp, Homo sapien
ttctgtctttccaggacaatgccgt

SEQ ID NO: 404947 - DNA, 25 bp, Homo sapien
tctgtctttccaggacaatgccgtc

SEQ ID NO: 404948 - DNA, 25 bp, Homo sapien
ctgtctttccaggacaatgccgtct

SEQ ID NO: 404949 - DNA, 25 bp, Homo sapien
ttagggctttaacatgggaatttga

SEQ ID NO: 404950 - DNA, 25 bp, Homo sapien
agaccattcccccagtaaatcactt

SEQ ID NO: 404951 - DNA, 25 bp, Homo sapien
attcccccagtaaatcactttcaca

SEQ ID NO: 404952 - DNA, 25 bp, Homo sapien
aggacacgcagactccaccctcttg

SEQ ID NO: 404953 - DNA, 25 bp, Homo sapien
tccctctgggcaagcaggcccctgg

SEQ ID NO: 404954 - DNA, 25 bp, Homo sapien
tgtcctctcctcctgttcttataag

SEQ ID NO: 404955 - DNA, 25 bp, Homo sapien
tggatctgggcccaccctagtgacc

SEQ ID NO: 404956 - DNA, 25 bp, Homo sapien
tcatttaccttaatcacctctgaaa

SEQ ID NO: 404957 - DNA, 25 bp, Homo sapien
aatcacctctgaaagaccttgtctc

SEQ ID NO: 404958 - DNA, 25 bp, Homo sapien
tcacctctgaaagaccttgtctcaa

SEQ ID NO: 404959 - DNA, 25 bp, Homo sapien
aaacagccacattctggggcactga

SEQ ID NO: 404960 - DNA, 25 bp, Homo sapien
tgcagcagcttctgttcacttctca

SEQ ID NO: 404961 - DNA, 25 bp, Homo sapien
cttctgttcacttctcagcgggctg

SEQ ID NO: 404962 - DNA, 25 bp, Homo sapien
gggtaccacagatcatgatgtgacc

SEQ ID NO: 404963 - DNA, 25 bp, Homo sapien
gaggccaggtggcacaggactgacc

SEQ ID NO: 404964 - DNA, 25 bp, Homo sapien
gcacaggactgaccccagtggatgc

SEQ ID NO: 404965 - DNA, 25 bp, Homo sapien
acctcatcaccctgttggtgagaga

SEQ ID NO: 404966 - DNA, 25 bp, Homo sapien
tcatcaccctgttggtgagagagca

SEQ ID NO: 404967 - DNA, 25 bp, Homo sapien
gaggctctggcagaaacctctgtgc

SEQ ID NO: 404968 - DNA, 25 bp, Homo sapien
tctggcagaaacctctgtgccaacc

SEQ ID NO: 404969 - DNA, 25 bp, Homo sapien
gatgtgaccaaggagcctcagtcac

SEQ ID NO: 404970 - DNA, 25 bp, Homo sapien
gaccaaggagcctcagtcacgtggg

SEQ ID NO: 404971 - DNA, 25 bp, Homo sapien
gacaaggcggccttcgtgatgcccc

SEQ ID NO: 404972 - DNA, 25 bp, Homo sapien
acctgggcggcgcagctgtgtgcct

SEQ ID NO: 404973 - DNA, 25 bp, Homo sapien
agcacttcctggcagcgcccaaggg

SEQ ID NO: 404974 - DNA, 25 bp, Homo sapien
aagggcgccctgagcctgcaagagc

SEQ ID NO: 404975 - DNA, 25 bp, Homo sapien
cctgcaagagctggagcggcagttc

SEQ ID NO: 404976 - DNA, 25 bp, Homo sapien
gcagttcgaggagacgcacgatgaa

SEQ ID NO: 404977 - DNA, 25 bp, Homo sapien
gaggagacgcacgatgaagctgttc

SEQ ID NO: 404978 - DNA, 25 bp, Homo sapien
acgcacgatgaagctgttcgggcgc

SEQ ID NO: 404979 - DNA, 25 bp, Homo sapien
cgatgaagctgttcgggcgcgcgca

SEQ ID NO: 404980 - DNA, 25 bp, Homo sapien
ggcgcgcgcagcttggaggctgaga

SEQ ID NO: 404981 - DNA, 25 bp, Homo sapien
gccttcgccgctggccgagaaccgt

SEQ ID NO: 404982 - DNA, 25 bp, Homo sapien
attcacagtgacttagactaaagca

SEQ ID NO: 404983 - DNA, 25 bp, Homo sapien
gtactgttataagctgaactactaa

SEQ ID NO: 404984 - DNA, 25 bp, Homo sapien
gaactactaactcagaggaggaacc

SEQ ID NO: 404985 - DNA, 25 bp, Homo sapien
aggaggaaccactggcaagcccata

SEQ ID NO: 404986 - DNA, 25 bp, Homo sapien
gaaccactggcaagcccataaaact

SEQ ID NO: 404987 - DNA, 25 bp, Homo sapien
taaacaggtgcttttttatttgtag

SEQ ID NO: 404988 - DNA, 25 bp, Homo sapien
aaacagcaacagataacctttgaaa

SEQ ID NO: 404989 - DNA, 25 bp, Homo sapien
gataacctttgaaaactactggaag

SEQ ID NO: 404990 - DNA, 25 bp, Homo sapien
tggaaggtgaatcatctctcccatt

SEQ ID NO: 404991 - DNA, 25 bp, Homo sapien
gtgaatcatctctcccattcaacat

SEQ ID NO: 404992 - DNA, 25 bp, Homo sapien
gaatgacttcaattcacagtgactt

SEQ ID NO: 404993 - DNA, 25 bp, Homo sapien
taaataggtccaagaaagcgtcatg

SEQ ID NO: 404994 - DNA, 25 bp, Homo sapien
taggtccaagaaagcgtcatgaatg

SEQ ID NO: 404995 - DNA, 25 bp, Homo sapien
taagctgtcccactcctgctcaaaa

SEQ ID NO: 404996 - DNA, 25 bp, Homo sapien
ctcctgctcaaaatcagtgctgtga

SEQ ID NO: 404997 - DNA, 25 bp, Homo sapien
atcagtgctgtgattagctggcagt

SEQ ID NO: 404998 - DNA, 25 bp, Homo sapien
ctgtgattagctggcagtgcttgct

SEQ ID NO: 404999 - DNA, 25 bp, Homo sapien
tcctatttgactgggagacctatga

SEQ ID NO: 405000 - DNA, 25 bp, Homo sapien
tttgactgggagacctatgacggca

SEQ ID NO: 405001 - DNA, 25 bp, Homo sapien
tgggagacctatgacggcaggtcca

SEQ ID NO: 405002 - DNA, 25 bp, Homo sapien
ctatgcctcctagggagagaagacg

SEQ ID NO: 405003 - DNA, 25 bp, Homo sapien
ctcctagggagagaagacggtcagt

SEQ ID NO: 405004 - DNA, 25 bp, Homo sapien
gtcagctagcaggaagaaacatttg

SEQ ID NO: 405005 - DNA, 25 bp, Homo sapien
gaacgaagggtagaccacggcctag

SEQ ID NO: 405006 - DNA, 25 bp, Homo sapien
gtggatgaagacacccgtccgtttg

SEQ ID NO: 405007 - DNA, 25 bp, Homo sapien
gtccgtttgcctactgaagcaagat

SEQ ID NO: 405008 - DNA, 25 bp, Homo sapien
tgaggcgctcaagggcctattggct

SEQ ID NO: 405009 - DNA, 25 bp, Homo sapien
tcaagggcctattggctgcccagaa

SEQ ID NO: 405010 - DNA, 25 bp, Homo sapien
agaagcctttgcagcgccgcctgaa

SEQ ID NO: 405011 - DNA, 25 bp, Homo sapien
agcgccgcctgaatacagcgaggat

SEQ ID NO: 405012 - DNA, 25 bp, Homo sapien
tacagcgaggatgacccagggttca

SEQ ID NO: 405013 - DNA, 25 bp, Homo sapien
cgccacttcctgcatgattagttga

SEQ ID NO: 405014 - DNA, 25 bp, Homo sapien
ccagggttcaccttcagcgttgaag

SEQ ID NO: 405015 - DNA, 25 bp, Homo sapien
acaatgttgttcatatggaaccaga

SEQ ID NO: 405016 - DNA, 25 bp, Homo sapien
atatggaaccagaacttgttatgta

SEQ ID NO: 405017 - DNA, 25 bp, Homo sapien
ggaaccagaacttgttatgtataaa

SEQ ID NO: 405018 - DNA, 25 bp, Homo sapien
tgggatgagaatttacatgtttatt

SEQ ID NO: 405019 - DNA, 25 bp, Homo sapien
gaagttttctgatatttataggcca

SEQ ID NO: 405020 - DNA, 25 bp, Homo sapien
gttttctgatatttataggccaata

SEQ ID NO: 405021 - DNA, 25 bp, Homo sapien
ggaaacatttaaactgtcaaagagt

SEQ ID NO: 405022 - DNA, 25 bp, Homo sapien
aatgatggtattactctgagagact

SEQ ID NO: 405023 - DNA, 25 bp, Homo sapien
actctgagagactatagtacataca

SEQ ID NO: 405024 - DNA, 25 bp, Homo sapien
gaagtagtacacacttgaccaaaga

SEQ ID NO: 405025 - DNA, 25 bp, Homo sapien
attttttactatgagattttgcatc

SEQ ID NO: 405026 - DNA, 25 bp, Homo sapien
tttggttaacagcaatttcagtgaa

SEQ ID NO: 405027 - DNA, 25 bp, Homo sapien
ctatcaggtctattttgtttacatt

SEQ ID NO: 405028 - DNA, 25 bp, Homo sapien
gtgaattacaacattttgctactaa

SEQ ID NO: 405029 - DNA, 25 bp, Homo sapien
taatggaatagcctccctagctctt

SEQ ID NO: 405030 - DNA, 25 bp, Homo sapien
ctagctctttttcagcccttcaagg

SEQ ID NO: 405031 - DNA, 25 bp, Homo sapien
gaatgaacaatatagccgacaccat

SEQ ID NO: 405032 - DNA, 25 bp, Homo sapien
atagccgacaccatgaaacacagga

SEQ ID NO: 405033 - DNA, 25 bp, Homo sapien
gagaacatttaagaagtagcccttt

SEQ ID NO: 405034 - DNA, 25 bp, Homo sapien
agggctgtttcatttgtcaacccac

SEQ ID NO: 405035 - DNA, 25 bp, Homo sapien
tgtcaacccacacaaactgcatgtt

SEQ ID NO: 405036 - DNA, 25 bp, Homo sapien
acaaactgcatgttgtattacttat

SEQ ID NO: 405037 - DNA, 25 bp, Homo sapien
gggaagagctgctatcttgcctgag

SEQ ID NO: 405038 - DNA, 25 bp, Homo sapien
gagctgctatcttgcctgagcagat

SEQ ID NO: 405039 - DNA, 25 bp, Homo sapien
tatcttgcctgagcagatcaggagg

SEQ ID NO: 405040 - DNA, 25 bp, Homo sapien
ggagacatcacccaaagtccagttt

SEQ ID NO: 405041 - DNA, 25 bp, Homo sapien
catcacccaaagtccagtttagcaa

SEQ ID NO: 405042 - DNA, 25 bp, Homo sapien
aaagtccagtttagcaagttgttga

SEQ ID NO: 405043 - DNA, 25 bp, Homo sapien
ttagcaagttgttgattcttctggt

SEQ ID NO: 405044 - DNA, 25 bp, Homo sapien
tgttgattcttctggtgtgccagcc

SEQ ID NO: 405045 - DNA, 25 bp, Homo sapien
attcttctggtgtgccagcccgtta

SEQ ID NO: 405046 - DNA, 25 bp, Homo sapien
aggagtaagtagctttccacagact

SEQ ID NO: 405047 - DNA, 25 bp, Homo sapien
agtagctttccacagactcccaggt

SEQ ID NO: 405048 - DNA, 25 bp, Homo sapien
acaactctcctgaccttggaagcag

SEQ ID NO: 405049 - DNA, 25 bp, Homo sapien
ggtacggaggcgtgtgtcctaaaat

SEQ ID NO: 405050 - DNA, 25 bp, Homo sapien
ggcgtgtgtcctaaaataaagcatt

SEQ ID NO: 405051 - DNA, 25 bp, Homo sapien
gcatttgagctgctgctacagagga

SEQ ID NO: 405052 - DNA, 25 bp, Homo sapien
gctgctacagaggaacaatcaccag

SEQ ID NO: 405053 - DNA, 25 bp, Homo sapien
accagatattgtgaccctttcagat

SEQ ID NO: 405054 - DNA, 25 bp, Homo sapien
gggcaggtgttattatcccttcttt

SEQ ID NO: 405055 - DNA, 25 bp, Homo sapien
ttatcccttctttataaatgaggac

SEQ ID NO: 405056 - DNA, 25 bp, Homo sapien
atgaggacacagaatgaggcagtac

SEQ ID NO: 405057 - DNA, 25 bp, Homo sapien
tgaggcagtacaagtgactctaaac

SEQ ID NO: 405058 - DNA, 25 bp, Homo sapien
agtgactctaaacacccccttagtg

SEQ ID NO: 405059 - DNA, 25 bp, Homo sapien
actcgtgggatgagcaaatgactct

SEQ ID NO: 405060 - DNA, 25 bp, Homo sapien
ttggccgtggacaccttcgcggtgc

SEQ ID NO: 405061 - DNA, 25 bp, Homo sapien
tccccatctgccactggaagatgct

SEQ ID NO: 405062 - DNA, 25 bp, Homo sapien
gggcgacccggctccaggtttagca

SEQ ID NO: 405063 - DNA, 25 bp, Homo sapien
ggctccaggtttagcaggacactga

SEQ ID NO: 405064 - DNA, 25 bp, Homo sapien
aatgactctgaaacggtcccatgcg

SEQ ID NO: 405065 - DNA, 25 bp, Homo sapien
actctgaaacggtcccatgcgggaa

SEQ ID NO: 405066 - DNA, 25 bp, Homo sapien
ggtcccatgcgggaaatgtccatga

SEQ ID NO: 405067 - DNA, 25 bp, Homo sapien
ggaaatgtccatgaagtcctggatt

SEQ ID NO: 405068 - DNA, 25 bp, Homo sapien
ccatgaagtcctggattttatctaa

SEQ ID NO: 405069 - DNA, 25 bp, Homo sapien
ttttatctaaaaagcccaggcaggg

SEQ ID NO: 405070 - DNA, 25 bp, Homo sapien
cgacccgcactaagttggccaactg

SEQ ID NO: 405071 - DNA, 25 bp, Homo sapien
taagttggccaactgcactctggag

SEQ ID NO: 405072 - DNA, 25 bp, Homo sapien
ttggccaactgcactctggaggcgg

SEQ ID NO: 405073 - DNA, 25 bp, Homo sapien
gctcggcctcaaggacagggtgctc

SEQ ID NO: 405074 - DNA, 25 bp, Homo sapien
ctcaaggacagggtgctcggctgaa

SEQ ID NO: 405075 - DNA, 25 bp, Homo sapien
aggacagggtgctcggctgaaaaaa

SEQ ID NO: 405076 - DNA, 25 bp, Homo sapien
aaagctagcggcgatcaccggtgcc

SEQ ID NO: 405077 - DNA, 25 bp, Homo sapien
agctagcggcgatcaccggtgccag

SEQ ID NO: 405078 - DNA, 25 bp, Homo sapien
agggctctccagaaacggagcccat

SEQ ID NO: 405079 - DNA, 25 bp, Homo sapien
agaaacggagcccatctaaccaatg

SEQ ID NO: 405080 - DNA, 25 bp, Homo sapien
aaacggagcccatctaaccaatgcc

SEQ ID NO: 405081 - DNA, 25 bp, Homo sapien
ttacagggcttggagtcccatttct

SEQ ID NO: 405082 - DNA, 25 bp, Homo sapien
tattggaagtttgcggcatcctttc

SEQ ID NO: 405083 - DNA, 25 bp, Homo sapien
tctaccatccaccatgtcaatgcta

SEQ ID NO: 405084 - DNA, 25 bp, Homo sapien
atcctttccgcattgttcattgctg

SEQ ID NO: 405085 - DNA, 25 bp, Homo sapien
tgttcattgctgttcagagtgttgc

SEQ ID NO: 405086 - DNA, 25 bp, Homo sapien
ggtgctataaatgctcccagcagct

SEQ ID NO: 405087 - DNA, 25 bp, Homo sapien
tataaatgctcccagcagctctcag

SEQ ID NO: 405088 - DNA, 25 bp, Homo sapien
atgtcaatgctaccctgtcacaatg

SEQ ID NO: 405089 - DNA, 25 bp, Homo sapien
ttttccttactgtattctcacgtag

SEQ ID NO: 405090 - DNA, 25 bp, Homo sapien
tgtattctcacgtagagcccagtag

SEQ ID NO: 405091 - DNA, 25 bp, Homo sapien
tcacgtagagcccagtagaataatt

SEQ ID NO: 405092 - DNA, 25 bp, Homo sapien
gaagtcacctgttatgacacctgta

SEQ ID NO: 405093 - DNA, 25 bp, Homo sapien
agtcacctgttatgacacctgtaag

SEQ ID NO: 405094 - DNA, 25 bp, Homo sapien
tcacctgttatgacacctgtaagtc

SEQ ID NO: 405095 - DNA, 25 bp, Homo sapien
acctgttatgacacctgtaagtcac

SEQ ID NO: 405096 - DNA, 25 bp, Homo sapien
tgttatgacacctgtaagtcactca

SEQ ID NO: 405097 - DNA, 25 bp, Homo sapien
tcactcattttaaggaataagatta

SEQ ID NO: 405098 - DNA, 25 bp, Homo sapien
taatttataacatttgattggctca

SEQ ID NO: 405099 - DNA, 25 bp, Homo sapien
gattggctcaaagagtattcaggcc

SEQ ID NO: 405100 - DNA, 25 bp, Homo sapien
gctcaaagagtattcaggccgggtg

SEQ ID NO: 405101 - DNA, 25 bp, Homo sapien
ctcaaagagtattcaggccgggtgc

SEQ ID NO: 405102 - DNA, 25 bp, Homo sapien
tgtggtggcaccgagatcgtgtcac

SEQ ID NO: 405103 - DNA, 25 bp, Homo sapien
ggtgtaaggtctaccctgaggagaa

SEQ ID NO: 405104 - DNA, 25 bp, Homo sapien
gcacagattctgaaagagggccttt

SEQ ID NO: 405105 - DNA, 25 bp, Homo sapien
gacttattttccctgatgcatgctg

SEQ ID NO: 405106 - DNA, 25 bp, Homo sapien
gatgcatgctgtattacattttctg

SEQ ID NO: 405107 - DNA, 25 bp, Homo sapien
gggcttgagaccatttagttataga

SEQ ID NO: 405108 - DNA, 25 bp, Homo sapien
tttgtatgcctgaggtcgtggccac

SEQ ID NO: 405109 - DNA, 25 bp, Homo sapien
ggtcgtggccactacaataaatact

SEQ ID NO: 405110 - DNA, 25 bp, Homo sapien
tgaatttttcagcttacgtgacaat

SEQ ID NO: 405111 - DNA, 25 bp, Homo sapien
acgtgacaattttcgattctgcaga

SEQ ID NO: 405112 - DNA, 25 bp, Homo sapien
ccccaaggttccatgtgaagcttga

SEQ ID NO: 405113 - DNA, 25 bp, Homo sapien
aagcttgaggtgtaaggtctaccct

SEQ ID NO: 405114 - DNA, 25 bp, Homo sapien
ctccataatgcttccctggtgcttt

SEQ ID NO: 405115 - DNA, 25 bp, Homo sapien
atttgtgacttgtttgtctgcttca

SEQ ID NO: 405116 - DNA, 25 bp, Homo sapien
gacttgtttgtctgcttcagctaga

SEQ ID NO: 405117 - DNA, 25 bp, Homo sapien
gtttgtctgcttcagctagactgtg

SEQ ID NO: 405118 - DNA, 25 bp, Homo sapien
tctgcttcagctagactgtgagctc

SEQ ID NO: 405119 - DNA, 25 bp, Homo sapien
ttttttgcttttgcacacggtaggt

SEQ ID NO: 405120 - DNA, 25 bp, Homo sapien
ttgcttttgcacacggtaggtactt

SEQ ID NO: 405121 - DNA, 25 bp, Homo sapien
cttttgcacacggtaggtacttaat

SEQ ID NO: 405122 - DNA, 25 bp, Homo sapien
gtttatttgatttaccatccacctc

SEQ ID NO: 405123 - DNA, 25 bp, Homo sapien
gatttaccatccacctcattctaga

SEQ ID NO: 405124 - DNA, 25 bp, Homo sapien
cacctcattctagaagtgtatagtg

SEQ ID NO: 405125 - DNA, 25 bp, Homo sapien
gcctttgcgctcacctgggcaggag

SEQ ID NO: 405126 - DNA, 25 bp, Homo sapien
tgggcaggagcctcatctgagcaca

SEQ ID NO: 405127 - DNA, 25 bp, Homo sapien
agcctcatctgagcacagtggcaga

SEQ ID NO: 405128 - DNA, 25 bp, Homo sapien
ccaggcttgagtgtgcaggctgcat

SEQ ID NO: 405129 - DNA, 25 bp, Homo sapien
tgagtgtgcaggctgcatgtcacct

SEQ ID NO: 405130 - DNA, 25 bp, Homo sapien
acctcccacacatggtgacttcaga

SEQ ID NO: 405131 - DNA, 25 bp, Homo sapien
tggtgacttcagagcccctttgagg

SEQ ID NO: 405132 - DNA, 25 bp, Homo sapien
aaaaggatccatgatgaggaccatc

SEQ ID NO: 405133 - DNA, 25 bp, Homo sapien
aaagaatggctgaggcctggctcct

SEQ ID NO: 405134 - DNA, 25 bp, Homo sapien
tttctcagccactgtgttgggattc

SEQ ID NO: 405135 - DNA, 25 bp, Homo sapien
cagccactgtgttgggattcccagc

SEQ ID NO: 405136 - DNA, 25 bp, Homo sapien
atttaatctctgaccgaaaccacgg

SEQ ID NO: 405137 - DNA, 25 bp, Homo sapien
ggaaaactgcgcctgtaaacttcgt

SEQ ID NO: 405138 - DNA, 25 bp, Homo sapien
actgcgcctgtaaacttcgtggagt

SEQ ID NO: 405139 - DNA, 25 bp, Homo sapien
gggactgatcgaaaagtgcgttcct

SEQ ID NO: 405140 - DNA, 25 bp, Homo sapien
gtgcgttcctaataggcgtgatcat

SEQ ID NO: 405141 - DNA, 25 bp, Homo sapien
aggcgtgatcattattggttttata

SEQ ID NO: 405142 - DNA, 25 bp, Homo sapien
tgaccgaaaccacggtgccacagag

SEQ ID NO: 405143 - DNA, 25 bp, Homo sapien
tagtcctcatttagaaacctctccc

SEQ ID NO: 405144 - DNA, 25 bp, Homo sapien
caacctctgctgtgatatccttaat

SEQ ID NO: 405145 - DNA, 25 bp, Homo sapien
cagaagtcttatgctcaagtcccgc

SEQ ID NO: 405146 - DNA, 25 bp, Homo sapien
tgcactggccggagtccctaggcaa

SEQ ID NO: 405147 - DNA, 25 bp, Homo sapien
agaccccacagtgtgggcctctgga

SEQ ID NO: 405148 - DNA, 25 bp, Homo sapien
gggcctctggagctgtgtctttact

SEQ ID NO: 405149 - DNA, 25 bp, Homo sapien
tgtctttactcttgctgccgatcaa

SEQ ID NO: 405150 - DNA, 25 bp, Homo sapien
gccgatcaatcccatgctctgaaat

SEQ ID NO: 405151 - DNA, 25 bp, Homo sapien
atgctctgaaatgcgcacactctgg

SEQ ID NO: 405152 - DNA, 25 bp, Homo sapien
gcacactctggctccttagtagatg

SEQ ID NO: 405153 - DNA, 25 bp, Homo sapien
agatgccataggtgggctcatgact

SEQ ID NO: 405154 - DNA, 25 bp, Homo sapien
aggtgggctcatgactgtccctgta

SEQ ID NO: 405155 - DNA, 25 bp, Homo sapien
actgtccctgtaccggtccaggtag

SEQ ID NO: 405156 - DNA, 25 bp, Homo sapien
atcatgtttattcacattccccacc

SEQ ID NO: 405157 - DNA, 25 bp, Homo sapien
agagtcactttcactccaagccctg

SEQ ID NO: 405158 - DNA, 25 bp, Homo sapien
tccctcaggcatcgcgcaagagtga

SEQ ID NO: 405159 - DNA, 25 bp, Homo sapien
caggcatcgcgcaagagtgacggca

SEQ ID NO: 405160 - DNA, 25 bp, Homo sapien
gcatcgcgcaagagtgacggcagac

SEQ ID NO: 405161 - DNA, 25 bp, Homo sapien
catcgcgcaagagtgacggcagacc

SEQ ID NO: 405162 - DNA, 25 bp, Homo sapien
atcgcgcaagagtgacggcagaccc

SEQ ID NO: 405163 - DNA, 25 bp, Homo sapien
aagagtgacggcagaccccctcatc

SEQ ID NO: 405164 - DNA, 25 bp, Homo sapien
gtctcagacgttgggggacacactg

SEQ ID NO: 405165 - DNA, 25 bp, Homo sapien
acacactgctgggtgggtgatttcc

SEQ ID NO: 405166 - DNA, 25 bp, Homo sapien
cacactgctgggtgggtgatttccc

SEQ ID NO: 405167 - DNA, 25 bp, Homo sapien
acactgctgggtgggtgatttcccc

SEQ ID NO: 405168 - DNA, 25 bp, Homo sapien
gctgggtgggtgatttccccccaag

SEQ ID NO: 405169 - DNA, 25 bp, Homo sapien
gggaagtaccatctttgctgaattc

SEQ ID NO: 405170 - DNA, 25 bp, Homo sapien
agtaccatctttgctgaattcttga

SEQ ID NO: 405171 - DNA, 25 bp, Homo sapien
gaggcataccctctggccagggccc

SEQ ID NO: 405172 - DNA, 25 bp, Homo sapien
tcagctttaacagagttttgctcat

SEQ ID NO: 405173 - DNA, 25 bp, Homo sapien
tcatttccattgcacagctaagcgc

SEQ ID NO: 405174 - DNA, 25 bp, Homo sapien
tttccattgcacagctaagcgcctt

SEQ ID NO: 405175 - DNA, 25 bp, Homo sapien
attgcacagctaagcgcctttgtta

SEQ ID NO: 405176 - DNA, 25 bp, Homo sapien
acagctaagcgcctttgttaaattt

SEQ ID NO: 405177 - DNA, 25 bp, Homo sapien
agctaagcgcctttgttaaattttg

SEQ ID NO: 405178 - DNA, 25 bp, Homo sapien
ctttttgttgtcagcagtttattct

SEQ ID NO: 405179 - DNA, 25 bp, Homo sapien
gatataaatccattagggtgagaga

SEQ ID NO: 405180 - DNA, 25 bp, Homo sapien
gtccgggccagagcgcaaggtccaa

SEQ ID NO: 405181 - DNA, 25 bp, Homo sapien
gccagagcgcaaggtccaaagccgg

SEQ ID NO: 405182 - DNA, 25 bp, Homo sapien
gcgcaaggtccaaagccggcggctt

SEQ ID NO: 405183 - DNA, 25 bp, Homo sapien
ataccagggcgggatgcgtgctgcg

SEQ ID NO: 405184 - DNA, 25 bp, Homo sapien
ctcttctgggaagcatgggctggga

SEQ ID NO: 405185 - DNA, 25 bp, Homo sapien
aggcgccggttttctgcatcccaaa

SEQ ID NO: 405186 - DNA, 25 bp, Homo sapien
ggttttctgcatcccaaatgtcctg

SEQ ID NO: 405187 - DNA, 25 bp, Homo sapien
ttttctgcatcccaaatgtcctggg

SEQ ID NO: 405188 - DNA, 25 bp, Homo sapien
aatgtcctggggcatgtgtcccttc

SEQ ID NO: 405189 - DNA, 25 bp, Homo sapien
ccttccttgctgaccgtgggtccgg

SEQ ID NO: 405190 - DNA, 25 bp, Homo sapien
ccttgctgaccgtgggtccgggcca

SEQ ID NO: 405191 - DNA, 25 bp, Homo sapien
gaagtcacctgttatgacacctgta

SEQ ID NO: 405192 - DNA, 25 bp, Homo sapien
agtcacctgttatgacacctgtaag

SEQ ID NO: 405193 - DNA, 25 bp, Homo sapien
tcacctgttatgacacctgtaagtc

SEQ ID NO: 405194 - DNA, 25 bp, Homo sapien
tgttatgacacctgtaagtcactca

SEQ ID NO: 405195 - DNA, 25 bp, Homo sapien
ctgtaagtcactcattttaaggaat

SEQ ID NO: 405196 - DNA, 25 bp, Homo sapien
taatttataacatttgattggctca

SEQ ID NO: 405197 - DNA, 25 bp, Homo sapien
gattggctcaaagagtattcaggcc

SEQ ID NO: 405198 - DNA, 25 bp, Homo sapien
gctcaaagagtattcaggccgggtg

SEQ ID NO: 405199 - DNA, 25 bp, Homo sapien
ctcaaagagtattcaggccgggtgc

SEQ ID NO: 405200 - DNA, 25 bp, Homo sapien
ggtgttcaagatcaggctgactaac

SEQ ID NO: 405201 - DNA, 25 bp, Homo sapien
tgtggtggcaccgagatcgtgtcac

SEQ ID NO: 405202 - DNA, 25 bp, Homo sapien
gttttataaagtgcttctgaaagct

SEQ ID NO: 405203 - DNA, 25 bp, Homo sapien
gcttctgaaagctaagatttgaaag

SEQ ID NO: 405204 - DNA, 25 bp, Homo sapien
atcaaagtatttggcagcataactc

SEQ ID NO: 405205 - DNA, 25 bp, Homo sapien
ggcagcataactccttaaaggtagt

SEQ ID NO: 405206 - DNA, 25 bp, Homo sapien
ctccttaaaggtagtggcgttgata

SEQ ID NO: 405207 - DNA, 25 bp, Homo sapien
ggcgttgatagaccattttcagaca

SEQ ID NO: 405208 - DNA, 25 bp, Homo sapien
gatagaccattttcagacagaattt

SEQ ID NO: 405209 - DNA, 25 bp, Homo sapien
agaatctgaaaaggcaggtctgtga

SEQ ID NO: 405210 - DNA, 25 bp, Homo sapien
aaaggcaggtctgtgatagagaaat

SEQ ID NO: 405211 - DNA, 25 bp, Homo sapien
atagagaaatggacctgcattcaga

SEQ ID NO: 405212 - DNA, 25 bp, Homo sapien
gggtttcacaaacctctggatatat

SEQ ID NO: 405213 - DNA, 25 bp, Homo sapien
ctctgggcacattcgaatcttccca

SEQ ID NO: 405214 - DNA, 25 bp, Homo sapien
tctgggcacattcgaatcttcccaa

SEQ ID NO: 405215 - DNA, 25 bp, Homo sapien
gcttcctttgccctggtttccatcc

SEQ ID NO: 405216 - DNA, 25 bp, Homo sapien
tatggttgttgggcgtaggacaggt

SEQ ID NO: 405217 - DNA, 25 bp, Homo sapien
ttgttgggcgtaggacaggtttcgg

SEQ ID NO: 405218 - DNA, 25 bp, Homo sapien
tttgccctggtttccatcccctctc

SEQ ID NO: 405219 - DNA, 25 bp, Homo sapien
ccctgccagagttccaaggctgtgg

SEQ ID NO: 405220 - DNA, 25 bp, Homo sapien
cctgccagagttccaaggctgtgga

SEQ ID NO: 405221 - DNA, 25 bp, Homo sapien
tgccagagttccaaggctgtggacc

SEQ ID NO: 405222 - DNA, 25 bp, Homo sapien
gctgtggaccccagagaaggtggca

SEQ ID NO: 405223 - DNA, 25 bp, Homo sapien
gtggaccccagagaaggtggcaggt

SEQ ID NO: 405224 - DNA, 25 bp, Homo sapien
tttgtgaaggcttcctggttggcct

SEQ ID NO: 405225 - DNA, 25 bp, Homo sapien
tggttggcctgaatttcctgctccc

SEQ ID NO: 405226 - DNA, 25 bp, Homo sapien
cggtctctatgtcggactacgatca

SEQ ID NO: 405227 - DNA, 25 bp, Homo sapien
ggttgcctaagaaaatgccctgctg

SEQ ID NO: 405228 - DNA, 25 bp, Homo sapien
gccctgctggaaaacacaaacccga

SEQ ID NO: 405229 - DNA, 25 bp, Homo sapien
agtttgggctgtaactctggtggca

SEQ ID NO: 405230 - DNA, 25 bp, Homo sapien
cggactacgatcagtctgagacctt

SEQ ID NO: 405231 - DNA, 25 bp, Homo sapien
gcagggtgaccaagcgcagctgctt

SEQ ID NO: 405232 - DNA, 25 bp, Homo sapien
gagaccttcgcccagatagaactga

SEQ ID NO: 405233 - DNA, 25 bp, Homo sapien
tagaactgaccccaaactaacaaag

SEQ ID NO: 405234 - DNA, 25 bp, Homo sapien
gaaggtcaatgccagcctttgtgaa

SEQ ID NO: 405235 - DNA, 25 bp, Homo sapien
tatggcaaacaccaatggaaatgta

SEQ ID NO: 405236 - DNA, 25 bp, Homo sapien
tttcctgagcaagtgtgatttgttt

SEQ ID NO: 405237 - DNA, 25 bp, Homo sapien
gtgatttgttttatggctgttcaag

SEQ ID NO: 405238 - DNA, 25 bp, Homo sapien
ggtcactgtaacttaaggttcaaat

SEQ ID NO: 405239 - DNA, 25 bp, Homo sapien
aaggttcaaatttctggcacagttt

SEQ ID NO: 405240 - DNA, 25 bp, Homo sapien
ctggcacagttttattagtattcac

SEQ ID NO: 405241 - DNA, 25 bp, Homo sapien
ttattagtattcacttcggaagcta

SEQ ID NO: 405242 - DNA, 25 bp, Homo sapien
ggaagctaataagataccatggttt

SEQ ID NO: 405243 - DNA, 25 bp, Homo sapien
gataccatggttttctatgttactc

SEQ ID NO: 405244 - DNA, 25 bp, Homo sapien
ggttttctatgttactcccattgta

SEQ ID NO: 405245 - DNA, 25 bp, Homo sapien
gttactcccattgtaacattagtaa

SEQ ID NO: 405246 - DNA, 25 bp, Homo sapien
aggtccgcgcctacaaaacgcgtgg

SEQ ID NO: 405247 - DNA, 25 bp, Homo sapien
accacaaggagacaccccgagaatg

SEQ ID NO: 405248 - DNA, 25 bp, Homo sapien
agacaccccgagaatgcggtcaggg

SEQ ID NO: 405249 - DNA, 25 bp, Homo sapien
gctcggcgctgcacgcctggagaac

SEQ ID NO: 405250 - DNA, 25 bp, Homo sapien
ctgcacgcctggagaacgcccggtg

SEQ ID NO: 405251 - DNA, 25 bp, Homo sapien
ttgggcccggttcgaatcccgactg

SEQ ID NO: 405252 - DNA, 25 bp, Homo sapien
gttcgaatcccgactgcgccactga

SEQ ID NO: 405253 - DNA, 25 bp, Homo sapien
gggagcttggaaagccggccggatc

SEQ ID NO: 405254 - DNA, 25 bp, Homo sapien
acgctggcgctgagctacgtggtaa

SEQ ID NO: 405255 - DNA, 25 bp, Homo sapien
tggcgctgagctacgtggtaaaccc

SEQ ID NO: 405256 - DNA, 25 bp, Homo sapien
gctgagctacgtggtaaacccggga

SEQ ID NO: 405257 - DNA, 25 bp, Homo sapien
aagaacgcaacaaaatggtgacaga

SEQ ID NO: 405258 - DNA, 25 bp, Homo sapien
ttcaactcttctccgaaacccttat

SEQ ID NO: 405259 - DNA, 25 bp, Homo sapien
ttatcaccattctttgccctttagt

SEQ ID NO: 405260 - DNA, 25 bp, Homo sapien
ttctttgccctttagtatacctgtg

SEQ ID NO: 405261 - DNA, 25 bp, Homo sapien
gtatacctgtgcacttcatgaatgg

SEQ ID NO: 405262 - DNA, 25 bp, Homo sapien
ccaggtagttggttttgacgcatct

SEQ ID NO: 405263 - DNA, 25 bp, Homo sapien
ttttgacgcatctaccacagtggaa

SEQ ID NO: 405264 - DNA, 25 bp, Homo sapien
ctcaggcttcacctaaagaggaatg

SEQ ID NO: 405265 - DNA, 25 bp, Homo sapien
gaatgcagattccaggacagaattt

SEQ ID NO: 405266 - DNA, 25 bp, Homo sapien
aaatatgccatttactgccagcgtt

SEQ ID NO: 405267 - DNA, 25 bp, Homo sapien
actgccagcgttgtgtagaaagaac

SEQ ID NO: 405268 - DNA, 25 bp, Homo sapien
aaggagaatctcaaggctttcctgt

SEQ ID NO: 405269 - DNA, 25 bp, Homo sapien
ggctttcctgtgacaaaagaatgct

SEQ ID NO: 405270 - DNA, 25 bp, Homo sapien
aaagaatgctcacacctagcgggag

SEQ ID NO: 405271 - DNA, 25 bp, Homo sapien
acacctagcgggagatccctgagga

SEQ ID NO: 405272 - DNA, 25 bp, Homo sapien
accttgttaacgaagtggatctgcc

SEQ ID NO: 405273 - DNA, 25 bp, Homo sapien
agtggatctgccttttcgggtcatc

SEQ ID NO: 405274 - DNA, 25 bp, Homo sapien
tcctgaccatgcctcttgtacacat

SEQ ID NO: 405275 - DNA, 25 bp, Homo sapien
gtacacattctctggaaagcgctgt

SEQ ID NO: 405276 - DNA, 25 bp, Homo sapien
cattctctggaaagcgctgtgcaaa

SEQ ID NO: 405277 - DNA, 25 bp, Homo sapien
taggcagggagctcccaaccttagg

SEQ ID NO: 405278 - DNA, 25 bp, Homo sapien
caaccttagggacgtctttgactgg

SEQ ID NO: 405279 - DNA, 25 bp, Homo sapien
tacactcgcgctgttgtgcaaccat

SEQ ID NO: 405280 - DNA, 25 bp, Homo sapien
ctatccatcgccagaactcttgcat

SEQ ID NO: 405281 - DNA, 25 bp, Homo sapien
tgaagctctgtctccatcaaacaac

SEQ ID NO: 405282 - DNA, 25 bp, Homo sapien
gtctctatgaatctggctgttctag

SEQ ID NO: 405283 - DNA, 25 bp, Homo sapien
gaatctggctgttctagggacctca

SEQ ID NO: 405284 - DNA, 25 bp, Homo sapien
gctgttctagggacctcacagatgt

SEQ ID NO: 405285 - DNA, 25 bp, Homo sapien
gggacctcacagatgtggaatcatg

SEQ ID NO: 405286 - DNA, 25 bp, Homo sapien
tggaatcatgtggaatttgtctttt

SEQ ID NO: 405287 - DNA, 25 bp, Homo sapien
taccattttaactatctgtaaacgt

SEQ ID NO: 405288 - DNA, 25 bp, Homo sapien
aaacgtatcgtttggtggcattaag

SEQ ID NO: 405289 - DNA, 25 bp, Homo sapien
gcattaagtacactcgcgctgttgt

SEQ ID NO: 405290 - DNA, 25 bp, Homo sapien
agacagtgaggctgcacccacccag

SEQ ID NO: 405291 - DNA, 25 bp, Homo sapien
gctggcactgactgggcatagctcc

SEQ ID NO: 405292 - DNA, 25 bp, Homo sapien
acccctgcagtttgagacaggagac

SEQ ID NO: 405293 - DNA, 25 bp, Homo sapien
ttgagacaggagacctggcactgga

SEQ ID NO: 405294 - DNA, 25 bp, Homo sapien
gacaggagacctggcactggatgca

SEQ ID NO: 405295 - DNA, 25 bp, Homo sapien
ggcactggatgcagaaacagttcac

SEQ ID NO: 405296 - DNA, 25 bp, Homo sapien
ggatgcagaaacagttcaccttgaa

SEQ ID NO: 405297 - DNA, 25 bp, Homo sapien
atgcagaaacagttcaccttgaaga

SEQ ID NO: 405298 - DNA, 25 bp, Homo sapien
gaaacagttcaccttgaagaacctc

SEQ ID NO: 405299 - DNA, 25 bp, Homo sapien
agttcaccttgaagaacctctcact

SEQ ID NO: 405300 - DNA, 25 bp, Homo sapien
tcaccttgaagaacctctcacttca

SEQ ID NO: 405301 - DNA, 25 bp, Homo sapien
tcacttccagatatccacataaatg

SEQ ID NO: 405302 - DNA, 25 bp, Homo sapien
acataaatgctccttgtggcctttt

SEQ ID NO: 405303 - DNA, 25 bp, Homo sapien
aatgctccttgtggccttttttata

SEQ ID NO: 405304 - DNA, 25 bp, Homo sapien
gtttatctgaaggaccccaggtaag

SEQ ID NO: 405305 - DNA, 25 bp, Homo sapien
aggtaagatgttaatctcccagccc

SEQ ID NO: 405306 - DNA, 25 bp, Homo sapien
gaggctactcttgacttagacctat

SEQ ID NO: 405307 - DNA, 25 bp, Homo sapien
tatactgaaagatctctgtcacatc

SEQ ID NO: 405308 - DNA, 25 bp, Homo sapien
tgtcacatccaactggaaattccag

SEQ ID NO: 405309 - DNA, 25 bp, Homo sapien
ccaaaaagagcatccctatgggctt

SEQ ID NO: 405310 - DNA, 25 bp, Homo sapien
tatgggcttggaccacttacagtgt

SEQ ID NO: 405311 - DNA, 25 bp, Homo sapien
tacagtgtgataaggcctactatac

SEQ ID NO: 405312 - DNA, 25 bp, Homo sapien
gacatataccagatatgctcactgt

SEQ ID NO: 405313 - DNA, 25 bp, Homo sapien
ccagatatgctcactgtttattcca

SEQ ID NO: 405314 - DNA, 25 bp, Homo sapien
ccagtactcagccaaaaacctaaat

SEQ ID NO: 405315 - DNA, 25 bp, Homo sapien
aaatgtctaaagtgcaaccaaatca

SEQ ID NO: 405316 - DNA, 25 bp, Homo sapien
gaatcatgcaaactggtctaggtca

SEQ ID NO: 405317 - DNA, 25 bp, Homo sapien
atgcaaactggtctaggtcagcccc

SEQ ID NO: 405318 - DNA, 25 bp, Homo sapien
aaataacttgcatctgtcattacca

SEQ ID NO: 405319 - DNA, 25 bp, Homo sapien
aacttgcatctgtcattaccatgat

SEQ ID NO: 405320 - DNA, 25 bp, Homo sapien
gcatctgtcattaccatgatatgtt

SEQ ID NO: 405321 - DNA, 25 bp, Homo sapien
accatgatatgtttcataaccttta

SEQ ID NO: 405322 - DNA, 25 bp, Homo sapien
acctttatatgcacatggagcttaa

SEQ ID NO: 405323 - DNA, 25 bp, Homo sapien
tcattgtattgggaagggctctcag

SEQ ID NO: 405324 - DNA, 25 bp, Homo sapien
aagggctctcaggacatatgaaacc

SEQ ID NO: 405325 - DNA, 25 bp, Homo sapien
tcaacaatcttgtagctgctgtgaa

SEQ ID NO: 405326 - DNA, 25 bp, Homo sapien
tgaatgcaacagctgtcatgcccca

SEQ ID NO: 405327 - DNA, 25 bp, Homo sapien
caaccagggcatgctttgatgctaa

SEQ ID NO: 405328 - DNA, 25 bp, Homo sapien
tgaatcacagaacagccttcctcca

SEQ ID NO: 405329 - DNA, 25 bp, Homo sapien
taagactggatgtttcacaggcaaa

SEQ ID NO: 405330 - DNA, 25 bp, Homo sapien
aaaggatttggctacttgttagcta

SEQ ID NO: 405331 - DNA, 25 bp, Homo sapien
gttagctattaacccagcttggagt

SEQ ID NO: 405332 - DNA, 25 bp, Homo sapien
ggagtgcaacagtctaataaccttc

SEQ ID NO: 405333 - DNA, 25 bp, Homo sapien
gaaagcaccttattgtcctcattgt

SEQ ID NO: 405334 - DNA, 25 bp, Homo sapien
aggccattttgtgttagaaaataat

SEQ ID NO: 405335 - DNA, 25 bp, Homo sapien
ggccattttgtgttagaaaataatg

SEQ ID NO: 405336 - DNA, 25 bp, Homo sapien
gaaaataatgaagtcaaggccgggt

SEQ ID NO: 405337 - DNA, 25 bp, Homo sapien
aaaataatgaagtcaaggccgggtg

SEQ ID NO: 405338 - DNA, 25 bp, Homo sapien
aaataatgaagtcaaggccgggtgt

SEQ ID NO: 405339 - DNA, 25 bp, Homo sapien
aataatgaagtcaaggccgggtgtg

SEQ ID NO: 405340 - DNA, 25 bp, Homo sapien
acatggcgataccttgtctctgctg

SEQ ID NO: 405341 - DNA, 25 bp, Homo sapien
catggcgataccttgtctctgctga

SEQ ID NO: 405342 - DNA, 25 bp, Homo sapien
atggcgataccttgtctctgctgaa

SEQ ID NO: 405343 - DNA, 25 bp, Homo sapien
tggcgataccttgtctctgctgaaa

SEQ ID NO: 405344 - DNA, 25 bp, Homo sapien
ggcgataccttgtctctgctgaaaa

SEQ ID NO: 405345 - DNA, 25 bp, Homo sapien
tattcagattatactttgttcttga

SEQ ID NO: 405346 - DNA, 25 bp, Homo sapien
tcagattatactttgttcttgaaaa

SEQ ID NO: 405347 - DNA, 25 bp, Homo sapien
aagcaaatgatgtaactcaactcat

SEQ ID NO: 405348 - DNA, 25 bp, Homo sapien
taactcaactcattattttctgctg

SEQ ID NO: 405349 - DNA, 25 bp, Homo sapien
aactcaactcattattttctgctgt

SEQ ID NO: 405350 - DNA, 25 bp, Homo sapien
caactcattattttctgctgtttct

SEQ ID NO: 405351 - DNA, 25 bp, Homo sapien
gctgtttcttcattcttattcactt

SEQ ID NO: 405352 - DNA, 25 bp, Homo sapien
cacttgtgaaagcttgtgatcattt

SEQ ID NO: 405353 - DNA, 25 bp, Homo sapien
ttgtgaaagcttgtgatcatttgtt

SEQ ID NO: 405354 - DNA, 25 bp, Homo sapien
tgagagattcttcttcattagatgg

SEQ ID NO: 405355 - DNA, 25 bp, Homo sapien
atcttttctatggatgagtaagaat

SEQ ID NO: 405356 - DNA, 25 bp, Homo sapien
aaatatgcacgtagatgtatacatg

SEQ ID NO: 405357 - DNA, 25 bp, Homo sapien
atatgcacgtagatgtatacatgta

SEQ ID NO: 405358 - DNA, 25 bp, Homo sapien
gcacgtagatgtatacatgtataga

SEQ ID NO: 405359 - DNA, 25 bp, Homo sapien
gtatacatgtatagaaaaagcctgg

SEQ ID NO: 405360 - DNA, 25 bp, Homo sapien
acatgtatagaaaaagcctggaaaa

SEQ ID NO: 405361 - DNA, 25 bp, Homo sapien
gcctggaaaaatgcacctgaaactt

SEQ ID NO: 405362 - DNA, 25 bp, Homo sapien
cctggaaaaatgcacctgaaacttt

SEQ ID NO: 405363 - DNA, 25 bp, Homo sapien
ctggaaaaatgcacctgaaactttt

SEQ ID NO: 405364 - DNA, 25 bp, Homo sapien
acctgaaacttttacagtgatcttc

SEQ ID NO: 405365 - DNA, 25 bp, Homo sapien
cctgaaacttttacagtgatcttct

SEQ ID NO: 405366 - DNA, 25 bp, Homo sapien
tgaaacttttacagtgatcttctgg

SEQ ID NO: 405367 - DNA, 25 bp, Homo sapien
gtatgactgtatgtgtggtcccctt

SEQ ID NO: 405368 - DNA, 25 bp, Homo sapien
tggtccccttgtactttggagacag

SEQ ID NO: 405369 - DNA, 25 bp, Homo sapien
gtgtagcattcggagattatttctg

SEQ ID NO: 405370 - DNA, 25 bp, Homo sapien
taagagactttcaagggttagccag

SEQ ID NO: 405371 - DNA, 25 bp, Homo sapien
tggattatctttgctacctgtgtta

SEQ ID NO: 405372 - DNA, 25 bp, Homo sapien
gatctgaaagtgatgacggtgtctc

SEQ ID NO: 405373 - DNA, 25 bp, Homo sapien
tgacggtgtctctaggaaaggaatt

SEQ ID NO: 405374 - DNA, 25 bp, Homo sapien
gaaaggaattgatcatagccaagtg

SEQ ID NO: 405375 - DNA, 25 bp, Homo sapien
agccaagtgactgacattctctcgg

SEQ ID NO: 405376 - DNA, 25 bp, Homo sapien
gtgactgacattctctcggtcagga

SEQ ID NO: 405377 - DNA, 25 bp, Homo sapien
tctcggtcaggaaaagagcttgctt

SEQ ID NO: 405378 - DNA, 25 bp, Homo sapien
tagaaatcccaaacgacaggctctt

SEQ ID NO: 405379 - DNA, 25 bp, Homo sapien
caaacgacaggctcttcaaactcaa

SEQ ID NO: 405380 - DNA, 25 bp, Homo sapien
gagacctcatcagagtattctcctg

SEQ ID NO: 405381 - DNA, 25 bp, Homo sapien
gtattctcctgatccagtagagtgt

SEQ ID NO: 405382 - DNA, 25 bp, Homo sapien
gtgtgtggagtcaaagcctaggttt

SEQ ID NO: 405383 - DNA, 25 bp, Homo sapien
agcctaggtttttgtccatccactc

SEQ ID NO: 405384 - DNA, 25 bp, Homo sapien
ttttgtccatccactcctagttgga

SEQ ID NO: 405385 - DNA, 25 bp, Homo sapien
cactcctagttggatgttacctaac

SEQ ID NO: 405386 - DNA, 25 bp, Homo sapien
gagtatggttttttcgctggtgata

SEQ ID NO: 405387 - DNA, 25 bp, Homo sapien
gtatgtattttgctgcgttattgtg

SEQ ID NO: 405388 - DNA, 25 bp, Homo sapien
gctgcgttattgtggagcttgaata

SEQ ID NO: 405389 - DNA, 25 bp, Homo sapien
ttttgtgcccaaaaacttcagagtt

SEQ ID NO: 405390 - DNA, 25 bp, Homo sapien
cagagtttgtagcatttcacatttc

SEQ ID NO: 405391 - DNA, 25 bp, Homo sapien
gggatactcaacttatgtctctttt

SEQ ID NO: 405392 - DNA, 25 bp, Homo sapien
atgtctcttttctatggaagccctt

SEQ ID NO: 405393 - DNA, 25 bp, Homo sapien
cttttctatggaagccctttctgga

SEQ ID NO: 405394 - DNA, 25 bp, Homo sapien
gaggtcctcgagttcaggccaggcc

SEQ ID NO: 405395 - DNA, 25 bp, Homo sapien
ttcagattttagacgtttttggatt

SEQ ID NO: 405396 - DNA, 25 bp, Homo sapien
caggccctgtgcttttttgaggcag

SEQ ID NO: 405397 - DNA, 25 bp, Homo sapien
tgtgcttttttgaggcagccctgcc

SEQ ID NO: 405398 - DNA, 25 bp, Homo sapien
gttaacatttcagcatcactaatct

SEQ ID NO: 405399 - DNA, 25 bp, Homo sapien
gatatccgaaaatcactgttgatga

SEQ ID NO: 405400 - DNA, 25 bp, Homo sapien
tgccatttccttcctggaattggcc

SEQ ID NO: 405401 - DNA, 25 bp, Homo sapien
ggaattggccaggaacttgattttc

SEQ ID NO: 405402 - DNA, 25 bp, Homo sapien
ggaacttgattttctgggctattgc

SEQ ID NO: 405403 - DNA, 25 bp, Homo sapien
tctgggctattgcttgctagtgtcc

SEQ ID NO: 405404 - DNA, 25 bp, Homo sapien
tgctagtgtcccctgatgcatgaag

SEQ ID NO: 405405 - DNA, 25 bp, Homo sapien
tgtcccctgatgcatgaaggatccc

SEQ ID NO: 405406 - DNA, 25 bp, Homo sapien
ttctccaggtgcacttgtcccaggt

SEQ ID NO: 405407 - DNA, 25 bp, Homo sapien
agctgcaggtgcactgcctcgcgga

SEQ ID NO: 405408 - DNA, 25 bp, Homo sapien
actgcctcgcggacaggttaggata

SEQ ID NO: 405409 - DNA, 25 bp, Homo sapien
caggttaggatatggccacgcagcc

SEQ ID NO: 405410 - DNA, 25 bp, Homo sapien
cagtcaatatgtctctctccgatgg

SEQ ID NO: 405411 - DNA, 25 bp, Homo sapien
gtggtaaagtctgggtcatggagct

SEQ ID NO: 405412 - DNA, 25 bp, Homo sapien
ttcctcacactctagcgtgttctta

SEQ ID NO: 405413 - DNA, 25 bp, Homo sapien
tcacactctagcgtgttcttaccag

SEQ ID NO: 405414 - DNA, 25 bp, Homo sapien
actctagcgtgttcttaccagcatc

SEQ ID NO: 405415 - DNA, 25 bp, Homo sapien
tagcgtgttcttaccagcatccagc

SEQ ID NO: 405416 - DNA, 25 bp, Homo sapien
gttcttaccagcatccagccggcag

SEQ ID NO: 405417 - DNA, 25 bp, Homo sapien
gtaatccttgaagtggaacccactt

SEQ ID NO: 405418 - DNA, 25 bp, Homo sapien
cttgaagtggaacccacttggcatg

SEQ ID NO: 405419 - DNA, 25 bp, Homo sapien
acttggcatgtagaagtacacatgt

SEQ ID NO: 405420 - DNA, 25 bp, Homo sapien
gtaacatcatgactcttaacatatg

SEQ ID NO: 405421 - DNA, 25 bp, Homo sapien
tcttaacatatgttgtgtgatctct

SEQ ID NO: 405422 - DNA, 25 bp, Homo sapien
aatcttatgtgtccttgaagtgttt

SEQ ID NO: 405423 - DNA, 25 bp, Homo sapien
aatttctcttcttgcaactttctct

SEQ ID NO: 405424 - DNA, 25 bp, Homo sapien
ttactccatgtccaatatcatctag

SEQ ID NO: 405425 - DNA, 25 bp, Homo sapien
aagattccatccttcgtagctggga

SEQ ID NO: 405426 - DNA, 25 bp, Homo sapien
ttcgtagctgggatgcctggatatc

SEQ ID NO: 405427 - DNA, 25 bp, Homo sapien
atatccagcatctgcaggacattgt

SEQ ID NO: 405428 - DNA, 25 bp, Homo sapien
gcatctgcaggacattgttggccaa

SEQ ID NO: 405429 - DNA, 25 bp, Homo sapien
tgttggccaaggtgtttatcagata

SEQ ID NO: 405430 - DNA, 25 bp, Homo sapien
gtttatcagataggcaacacttgct

SEQ ID NO: 405431 - DNA, 25 bp, Homo sapien
aactggtcgttcaaggttggctgga

SEQ ID NO: 405432 - DNA, 25 bp, Homo sapien
gttggctggagcaataatcttatgt

SEQ ID NO: 405433 - DNA, 25 bp, Homo sapien
aagcagatcctttcccattggagcc

SEQ ID NO: 405434 - DNA, 25 bp, Homo sapien
atcctttcccattggagccttgaga

SEQ ID NO: 405435 - DNA, 25 bp, Homo sapien
tttcccattggagccttgagattaa

SEQ ID NO: 405436 - DNA, 25 bp, Homo sapien
ggagccttgagattaaagccacctt

SEQ ID NO: 405437 - DNA, 25 bp, Homo sapien
tgagattaaagccaccttacctgac

SEQ ID NO: 405438 - DNA, 25 bp, Homo sapien
ccaccttacctgacaacttgatagg

SEQ ID NO: 405439 - DNA, 25 bp, Homo sapien
ctgacaacttgataggagccttatg

SEQ ID NO: 405440 - DNA, 25 bp, Homo sapien
cctggcatgaacagaggccttgcgg

SEQ ID NO: 405441 - DNA, 25 bp, Homo sapien
ccacatctcttcttacaggtcaact

SEQ ID NO: 405442 - DNA, 25 bp, Homo sapien
atgaacagaggccttgcggagaact

SEQ ID NO: 405443 - DNA, 25 bp, Homo sapien
gccttgcggagaactgaagccttca

SEQ ID NO: 405444 - DNA, 25 bp, Homo sapien
ctgctggcactctggcccctgctca

SEQ ID NO: 405445 - DNA, 25 bp, Homo sapien
ctctggcccctgctcagcctgatgg

SEQ ID NO: 405446 - DNA, 25 bp, Homo sapien
gcctgatgggcgttctggtgcagtg

SEQ ID NO: 405447 - DNA, 25 bp, Homo sapien
ctgatgggcgttctggtgcagtgga

SEQ ID NO: 405448 - DNA, 25 bp, Homo sapien
tgatgggcgttctggtgcagtggag

SEQ ID NO: 405449 - DNA, 25 bp, Homo sapien
tgggcgttctggtgcagtggagggt

SEQ ID NO: 405450 - DNA, 25 bp, Homo sapien
cgttctggtgcagtggagggtgaca

SEQ ID NO: 405451 - DNA, 25 bp, Homo sapien
ttctggtgcagtggagggtgacagc

SEQ ID NO: 405452 - DNA, 25 bp, Homo sapien
acagctgagggggactcccacacgg

SEQ ID NO: 405453 - DNA, 25 bp, Homo sapien
actcccacacggaagtggtcatcag

SEQ ID NO: 405454 - DNA, 25 bp, Homo sapien
ctcccacacggaagtggtcatcagc

SEQ ID NO: 405455 - DNA, 25 bp, Homo sapien
agagtgcaaacaaagcgagaattaa

SEQ ID NO: 405456 - DNA, 25 bp, Homo sapien
gcgagaattaaggtcattccattta

SEQ ID NO: 405457 - DNA, 25 bp, Homo sapien
attccatttaaatccttcagagagg

SEQ ID NO: 405458 - DNA, 25 bp, Homo sapien
gggctaagttattgctgaggactac

SEQ ID NO: 405459 - DNA, 25 bp, Homo sapien
agggctggaggaatccaggattaaa

SEQ ID NO: 405460 - DNA, 25 bp, Homo sapien
attgtttattatttgccagcctcag

SEQ ID NO: 405461 - DNA, 25 bp, Homo sapien
ttattatttgccagcctcagagcag

SEQ ID NO: 405462 - DNA, 25 bp, Homo sapien
aggaactaatcagccttataaaagg

SEQ ID NO: 405463 - DNA, 25 bp, Homo sapien
tttgtgaagggattaccctcccatc

SEQ ID NO: 405464 - DNA, 25 bp, Homo sapien
ttataaaaggtagcactgttaatct

SEQ ID NO: 405465 - DNA, 25 bp, Homo sapien
tcatcacagctccttaagagataga

SEQ ID NO: 405466 - DNA, 25 bp, Homo sapien
attgaatgcatgaaagaagctattt

SEQ ID NO: 405467 - DNA, 25 bp, Homo sapien
atgaagatttgaccgtccagaggct

SEQ ID NO: 405468 - DNA, 25 bp, Homo sapien
acaaactaatgatcctagattctca

SEQ ID NO: 405469 - DNA, 25 bp, Homo sapien
tgatcctagattctcataaaacaca

SEQ ID NO: 405470 - DNA, 25 bp, Homo sapien
aacacaatacggaatgggtcaactg

SEQ ID NO: 405471 - DNA, 25 bp, Homo sapien
atgggtcaactgaatttacatgtca

SEQ ID NO: 405472 - DNA, 25 bp, Homo sapien
tttacatgtcagtagaattgccttt

SEQ ID NO: 405473 - DNA, 25 bp, Homo sapien
gtagaattgcctttttactggtcaa

SEQ ID NO: 405474 - DNA, 25 bp, Homo sapien
gaattgcctttttactggtcaactt

SEQ ID NO: 405475 - DNA, 25 bp, Homo sapien
gcctttttactggtcaacttgtcta

SEQ ID NO: 405476 - DNA, 25 bp, Homo sapien
ggtcaacttgtctaaaagatttcca

SEQ ID NO: 405477 - DNA, 25 bp, Homo sapien
cacaactctcctgaccttggaagca

SEQ ID NO: 405478 - DNA, 25 bp, Homo sapien
ggtacggaggcgtgtgtcctaaaat

SEQ ID NO: 405479 - DNA, 25 bp, Homo sapien
ggcgtgtgtcctaaaataaagcatt

SEQ ID NO: 405480 - DNA, 25 bp, Homo sapien
tcctaaaataaagcatttgagctgc

SEQ ID NO: 405481 - DNA, 25 bp, Homo sapien
gctgctacagaggaacaatcaccag

SEQ ID NO: 405482 - DNA, 25 bp, Homo sapien
gggcaggtgttattatcccttcttt

SEQ ID NO: 405483 - DNA, 25 bp, Homo sapien
caggtgttattatcccttctttata

SEQ ID NO: 405484 - DNA, 25 bp, Homo sapien
ttatcccttctttataaatgaggac

SEQ ID NO: 405485 - DNA, 25 bp, Homo sapien
atgaggacacagaatgaggcagtac

SEQ ID NO: 405486 - DNA, 25 bp, Homo sapien
tgaggcagtacaagtgactctaaac

SEQ ID NO: 405487 - DNA, 25 bp, Homo sapien
agtgactctaaacacccccttagtg

SEQ ID NO: 405488 - DNA, 25 bp, Homo sapien
aaccttgtgcttttcaagatcttaa

SEQ ID NO: 405489 - DNA, 25 bp, Homo sapien
gtgcttttcaagatcttaagacaca

SEQ ID NO: 405490 - DNA, 25 bp, Homo sapien
cttaagacacatctgctaagttgca

SEQ ID NO: 405491 - DNA, 25 bp, Homo sapien
acttatgttgccaaattctcacagg

SEQ ID NO: 405492 - DNA, 25 bp, Homo sapien
tgccaaattctcacaggcacactac

SEQ ID NO: 405493 - DNA, 25 bp, Homo sapien
taccttccgagccatcactatataa

SEQ ID NO: 405494 - DNA, 25 bp, Homo sapien
gagccatcactatataaccagagac

SEQ ID NO: 405495 - DNA, 25 bp, Homo sapien
aaccagagacaattacgttctcagt

SEQ ID NO: 405496 - DNA, 25 bp, Homo sapien
gacaattacgttctcagtactattc

SEQ ID NO: 405497 - DNA, 25 bp, Homo sapien
acgttctcagtactattctatattg

SEQ ID NO: 405498 - DNA, 25 bp, Homo sapien
tcagtactattctatattgttgcaa

SEQ ID NO: 405499 - DNA, 25 bp, Homo sapien
gccgtgagcagcttggcagactgtc

SEQ ID NO: 405500 - DNA, 25 bp, Homo sapien
agcttggcagactgtccctcagtgt

SEQ ID NO: 405501 - DNA, 25 bp, Homo sapien
tgtccctcagtgtcacagtacaaaa

SEQ ID NO: 405502 - DNA, 25 bp, Homo sapien
gtcacagtacaaaaacctcgggcgt

SEQ ID NO: 405503 - DNA, 25 bp, Homo sapien
aacctcgggcgtagtggtacaggca

SEQ ID NO: 405504 - DNA, 25 bp, Homo sapien
caggagaatcttgcatgtagcagct

SEQ ID NO: 405505 - DNA, 25 bp, Homo sapien
gaatcttgcatgtagcagcttctca

SEQ ID NO: 405506 - DNA, 25 bp, Homo sapien
tgcatgtagcagcttctcaataagt

SEQ ID NO: 405507 - DNA, 25 bp, Homo sapien
gtagcagcttctcaataagtattta

SEQ ID NO: 405508 - DNA, 25 bp, Homo sapien
aggagtcctaggaccatctgggctc

SEQ ID NO: 405509 - DNA, 25 bp, Homo sapien
ttgatttgtgatgcagtaaaggtct

SEQ ID NO: 405510 - DNA, 25 bp, Homo sapien
aaggcgcactgcacttctcctttga

SEQ ID NO: 405511 - DNA, 25 bp, Homo sapien
gcgcactgcacttctcctttgacgg

SEQ ID NO: 405512 - DNA, 25 bp, Homo sapien
ccaccttcgggcctgattcagctcg

SEQ ID NO: 405513 - DNA, 25 bp, Homo sapien
gggaggcccaagaacttccaccaag

SEQ ID NO: 405514 - DNA, 25 bp, Homo sapien
aacttccaccaagggttctgctggc

SEQ ID NO: 405515 - DNA, 25 bp, Homo sapien
tccaccaagggttctgctggctgag

SEQ ID NO: 405516 - DNA, 25 bp, Homo sapien
tagattgcactcagctctaaatgcg

SEQ ID NO: 405517 - DNA, 25 bp, Homo sapien
gattgcactcagctctaaatgcgag

SEQ ID NO: 405518 - DNA, 25 bp, Homo sapien
ttgcactcagctctaaatgcgagct

SEQ ID NO: 405519 - DNA, 25 bp, Homo sapien
gctctaaatgcgagctgtcaacggg

SEQ ID NO: 405520 - DNA, 25 bp, Homo sapien
taaatgcgagctgtcaacggggtca

SEQ ID NO: 405521 - DNA, 25 bp, Homo sapien
gttttccttgaatatgtatccatcc

SEQ ID NO: 405522 - DNA, 25 bp, Homo sapien
gaatatgtatccatccttcttaagg

SEQ ID NO: 405523 - DNA, 25 bp, Homo sapien
taaggataatccagctatgttcagc

SEQ ID NO: 405524 - DNA, 25 bp, Homo sapien
atccagctatgttcagctttacaga

SEQ ID NO: 405525 - DNA, 25 bp, Homo sapien
gtgatacgtgaatattttccttgag

SEQ ID NO: 405526 - DNA, 25 bp, Homo sapien
tgagaagttagtgctgtttcagttt

SEQ ID NO: 405527 - DNA, 25 bp, Homo sapien
atagcttttcaatatctcacacaat

SEQ ID NO: 405528 - DNA, 25 bp, Homo sapien
agtttttctctgacggtatgcctta

SEQ ID NO: 405529 - DNA, 25 bp, Homo sapien
ctgacggtatgccttatcaataaac

SEQ ID NO: 405530 - DNA, 25 bp, Homo sapien
ataatgagacacatgaccggttcct

SEQ ID NO: 405531 - DNA, 25 bp, Homo sapien
agtgcttcatgaaagttttccttga

SEQ ID NO: 405532 - DNA, 25 bp, Homo sapien
gtttgttcaaagtggggcatagctg

SEQ ID NO: 405533 - DNA, 25 bp, Homo sapien
tttgttcaaagtggggcatagctgg

SEQ ID NO: 405534 - DNA, 25 bp, Homo sapien
ttgttcaaagtggggcatagctggc

SEQ ID NO: 405535 - DNA, 25 bp, Homo sapien
gttcaaagtggggcatagctggcca

SEQ ID NO: 405536 - DNA, 25 bp, Homo sapien
caaagtggggcatagctggccaggt

SEQ ID NO: 405537 - DNA, 25 bp, Homo sapien
aaagtggggcatagctggccaggtg

SEQ ID NO: 405538 - DNA, 25 bp, Homo sapien
aagtggggcatagctggccaggtgt

SEQ ID NO: 405539 - DNA, 25 bp, Homo sapien
agtggggcatagctggccaggtgta

SEQ ID NO: 405540 - DNA, 25 bp, Homo sapien
gtggggcatagctggccaggtgtag

SEQ ID NO: 405541 - DNA, 25 bp, Homo sapien
tggggcatagctggccaggtgtagt

SEQ ID NO: 405542 - DNA, 25 bp, Homo sapien
ggggcatagctggccaggtgtagtg

SEQ ID NO: 405543 - DNA, 25 bp, Homo sapien
gaaatattgcagatttccccaaatc

SEQ ID NO: 405544 - DNA, 25 bp, Homo sapien
gatttccccaaatctagggcttatg

SEQ ID NO: 405545 - DNA, 25 bp, Homo sapien
ggaattatgtttaacaactccacag

SEQ ID NO: 405546 - DNA, 25 bp, Homo sapien
caaaatcttctggttcatgcaaaat

SEQ ID NO: 405547 - DNA, 25 bp, Homo sapien
actccacagtttccaactgtactag

SEQ ID NO: 405548 - DNA, 25 bp, Homo sapien
ctgtactagaaagtgagctccattt

SEQ ID NO: 405549 - DNA, 25 bp, Homo sapien
gaaggaatgcatcatttcttattgg

SEQ ID NO: 405550 - DNA, 25 bp, Homo sapien
gtgacttgagttttttgctctggaa

SEQ ID NO: 405551 - DNA, 25 bp, Homo sapien
aaatgaggtcatttctccttgatat

SEQ ID NO: 405552 - DNA, 25 bp, Homo sapien
gaagattgctgagaaagccaatttc

SEQ ID NO: 405553 - DNA, 25 bp, Homo sapien
catttgcaatggctggagtaaccag

SEQ ID NO: 405554 - DNA, 25 bp, Homo sapien
tttgtacctcaaaagacctcatacc

SEQ ID NO: 405555 - DNA, 25 bp, Homo sapien
aagacctcataccatacctgtaata

SEQ ID NO: 405556 - DNA, 25 bp, Homo sapien
gataaattttttgccgcactcttag

SEQ ID NO: 405557 - DNA, 25 bp, Homo sapien
gcactcttagtttttttgcccgact

SEQ ID NO: 405558 - DNA, 25 bp, Homo sapien
tttgcccgactccagttgcaggtag

SEQ ID NO: 405559 - DNA, 25 bp, Homo sapien
gtcagaacccataacaacaggccag

SEQ ID NO: 405560 - DNA, 25 bp, Homo sapien
cagttgcaggtagctactctggaaa

SEQ ID NO: 405561 - DNA, 25 bp, Homo sapien
tcttcttagccaaatacttctcctt

SEQ ID NO: 405562 - DNA, 25 bp, Homo sapien
tgataattttcgtcttagtcccctt

SEQ ID NO: 405563 - DNA, 25 bp, Homo sapien
gtcttagtccccttaatggtagtag

SEQ ID NO: 405564 - DNA, 25 bp, Homo sapien
ttttctatcagcaatttgtacctca

SEQ ID NO: 405565 - DNA, 25 bp, Homo sapien
gagaagctccgagagagtaagtcat

SEQ ID NO: 405566 - DNA, 25 bp, Homo sapien
tccgagagagtaagtcatgtgcccc

SEQ ID NO: 405567 - DNA, 25 bp, Homo sapien
gagagtaagtcatgtgcccccaaac

SEQ ID NO: 405568 - DNA, 25 bp, Homo sapien
actcagctcctaagtggcaggacag

SEQ ID NO: 405569 - DNA, 25 bp, Homo sapien
aggcaagtggccaggttgggccgcc

SEQ ID NO: 405570 - DNA, 25 bp, Homo sapien
tcactacagcactcccagaagaagg

SEQ ID NO: 405571 - DNA, 25 bp, Homo sapien
aaggagcagaatcgcatgcagccca

SEQ ID NO: 405572 - DNA, 25 bp, Homo sapien
cagaatcgcatgcagcccagagcag

SEQ ID NO: 405573 - DNA, 25 bp, Homo sapien
gtcctcacccctcaggagtaatagg

SEQ ID NO: 405574 - DNA, 25 bp, Homo sapien
gtttagtgatacaatcccacctgtg

SEQ ID NO: 405575 - DNA, 25 bp, Homo sapien
tagtgatacaatcccacctgtgtct

SEQ ID NO: 405576 - DNA, 25 bp, Homo sapien
aatgagaatttgaaggaggctgtat

SEQ ID NO: 405577 - DNA, 25 bp, Homo sapien
ccgtgcatggtcatgagcagcccag

SEQ ID NO: 405578 - DNA, 25 bp, Homo sapien
tgcatggtcatgagcagcccaggga

SEQ ID NO: 405579 - DNA, 25 bp, Homo sapien
agatcacagaaatcatgaggccctg

SEQ ID NO: 405580 - DNA, 25 bp, Homo sapien
atcacagaaatcatgaggccctgaa

SEQ ID NO: 405581 - DNA, 25 bp, Homo sapien
aagtgaagatcccgccctcactttc

SEQ ID NO: 405582 - DNA, 25 bp, Homo sapien
cctcactttctcactttcctgatgc

SEQ ID NO: 405583 - DNA, 25 bp, Homo sapien
ctgatgcagtcatgtgaaatttgtc

SEQ ID NO: 405584 - DNA, 25 bp, Homo sapien
gtcatgtgaaatttgtctttacttc

SEQ ID NO: 405585 - DNA, 25 bp, Homo sapien
ttgtctttacttccatttacttcct

SEQ ID NO: 405586 - DNA, 25 bp, Homo sapien
tgtctttacttccatttacttcctt

SEQ ID NO: 405587 - DNA, 25 bp, Homo sapien
cagctacttgggagggtaaggcatg

SEQ ID NO: 405588 - DNA, 25 bp, Homo sapien
atcatgccactgcaccactgcactc

SEQ ID NO: 405589 - DNA, 25 bp, Homo sapien
aataaaataaaggccaggcacggtg

SEQ ID NO: 405590 - DNA, 25 bp, Homo sapien
acggtggctcacacaggagaatcac

SEQ ID NO: 405591 - DNA, 25 bp, Homo sapien
ggtggctcacacaggagaatcactt

SEQ ID NO: 405592 - DNA, 25 bp, Homo sapien
agtgatctgagatcacaccagtaca

SEQ ID NO: 405593 - DNA, 25 bp, Homo sapien
gtgatctgagatcacaccagtacac

SEQ ID NO: 405594 - DNA, 25 bp, Homo sapien
tgatctgagatcacaccagtacact

SEQ ID NO: 405595 - DNA, 25 bp, Homo sapien
gccaaagatcaagactaccacaagg

SEQ ID NO: 405596 - DNA, 25 bp, Homo sapien
ccaaagatcaagactaccacaagga

SEQ ID NO: 405597 - DNA, 25 bp, Homo sapien
caaagatcaagactaccacaaggag

SEQ ID NO: 405598 - DNA, 25 bp, Homo sapien
aaagatcaagactaccacaaggaga

SEQ ID NO: 405599 - DNA, 25 bp, Homo sapien
aagatcaagactaccacaaggagaa

SEQ ID NO: 405600 - DNA, 25 bp, Homo sapien
gatcaagactaccacaaggagaaat

SEQ ID NO: 405601 - DNA, 25 bp, Homo sapien
tgccacaggcatatgagaggataag

SEQ ID NO: 405602 - DNA, 25 bp, Homo sapien
gccacaggcatatgagaggataaga

SEQ ID NO: 405603 - DNA, 25 bp, Homo sapien
ccacaggcatatgagaggataagaa

SEQ ID NO: 405604 - DNA, 25 bp, Homo sapien
cacaggcatatgagaggataagaaa

SEQ ID NO: 405605 - DNA, 25 bp, Homo sapien
acaggcatatgagaggataagaaac

SEQ ID NO: 405606 - DNA, 25 bp, Homo sapien
gcccgccaggtgaggccggtttcga

SEQ ID NO: 405607 - DNA, 25 bp, Homo sapien
gtggagaggcttggccggccgcgct

SEQ ID NO: 405608 - DNA, 25 bp, Homo sapien
ggtcctcaaggactcgcagtgatgt

SEQ ID NO: 405609 - DNA, 25 bp, Homo sapien
gggaccaaggcgctgcggccactcg

SEQ ID NO: 405610 - DNA, 25 bp, Homo sapien
tcaaggactcgcagtgatgtcacct

SEQ ID NO: 405611 - DNA, 25 bp, Homo sapien
cgtgcagccgcctggtttcgaactg

SEQ ID NO: 405612 - DNA, 25 bp, Homo sapien
ctggtttcgaactgctcgctgccag

SEQ ID NO: 405613 - DNA, 25 bp, Homo sapien
gccaggcttcggctccgctagggcg

SEQ ID NO: 405614 - DNA, 25 bp, Homo sapien
agtgatgtcacctccgtcaggctca

SEQ ID NO: 405615 - DNA, 25 bp, Homo sapien
atgtcacctccgtcaggctcaaaga

SEQ ID NO: 405616 - DNA, 25 bp, Homo sapien
tcacctccgtcaggctcaaagaggg

SEQ ID NO: 405617 - DNA, 25 bp, Homo sapien
tctgtggccatttttgtcagtgctt

SEQ ID NO: 405618 - DNA, 25 bp, Homo sapien
caatttactagaaagctggatgctg

SEQ ID NO: 405619 - DNA, 25 bp, Homo sapien
ctggatgctgtgaaagcaagacaca

SEQ ID NO: 405620 - DNA, 25 bp, Homo sapien
agacacagaaagcagagaacatcaa

SEQ ID NO: 405621 - DNA, 25 bp, Homo sapien
gcagagaacatcaagcagtgggagt

SEQ ID NO: 405622 - DNA, 25 bp, Homo sapien
tttgtcagtgctttatatgtcttaa

SEQ ID NO: 405623 - DNA, 25 bp, Homo sapien
tatgtcttaaaggaggaggctttct

SEQ ID NO: 405624 - DNA, 25 bp, Homo sapien
gaggaggctttctttagcttttctg

SEQ ID NO: 405625 - DNA, 25 bp, Homo sapien
aggctttctttagcttttctgtctt

SEQ ID NO: 405626 - DNA, 25 bp, Homo sapien
tttctgtctttccaggacaatgccg

SEQ ID NO: 405627 - DNA, 25 bp, Homo sapien
ctgtctttccaggacaatgccgtct

SEQ ID NO: 405628 - DNA, 25 bp, Homo sapien
gagatgtggccatggtcttgtgcta

SEQ ID NO: 405629 - DNA, 25 bp, Homo sapien
gtggccatggtcttgtgctagagat

SEQ ID NO: 405630 - DNA, 25 bp, Homo sapien
gtcttgtgctagagatggcggtaca

SEQ ID NO: 405631 - DNA, 25 bp, Homo sapien
agatggcggtacaagagtctgttat

SEQ ID NO: 405632 - DNA, 25 bp, Homo sapien
gagtctgttatgcaagcccgtgtgc

SEQ ID NO: 405633 - DNA, 25 bp, Homo sapien
ccaggaaaggcacagctgaggcact

SEQ ID NO: 405634 - DNA, 25 bp, Homo sapien
cacagctgaggcactgtggctggct

SEQ ID NO: 405635 - DNA, 25 bp, Homo sapien
agccttggagctctgcagacatgat

SEQ ID NO: 405636 - DNA, 25 bp, Homo sapien
agctctgcagacatgataggaagga

SEQ ID NO: 405637 - DNA, 25 bp, Homo sapien
aggaaggaaactgtcatctgcaggg

SEQ ID NO: 405638 - DNA, 25 bp, Homo sapien
agggttagatttttatgctgctgct

SEQ ID NO: 405639 - DNA, 25 bp, Homo sapien
atccccatttctgacctgtttcata

SEQ ID NO: 405640 - DNA, 25 bp, Homo sapien
tccccatttctgacctgtttcataa

SEQ ID NO: 405641 - DNA, 25 bp, Homo sapien
ccccatttctgacctgtttcataag

SEQ ID NO: 405642 - DNA, 25 bp, Homo sapien
acctgtttcataagcattccaagca

SEQ ID NO: 405643 - DNA, 25 bp, Homo sapien
aagcattccaagcaaaattatagtt

SEQ ID NO: 405644 - DNA, 25 bp, Homo sapien
aaattatagttttacctctgctctc

SEQ ID NO: 405645 - DNA, 25 bp, Homo sapien
ttcttctttaatttgaattcgtggt

SEQ ID NO: 405646 - DNA, 25 bp, Homo sapien
attcgtggttaagttattagaggca

SEQ ID NO: 405647 - DNA, 25 bp, Homo sapien
gtggttaagttattagaggcagttt

SEQ ID NO: 405648 - DNA, 25 bp, Homo sapien
ctaaaatgcatgtgatagattgtga

SEQ ID NO: 405649 - DNA, 25 bp, Homo sapien
aatgcatgtgatagattgtgaaaaa

SEQ ID NO: 405650 - DNA, 25 bp, Homo sapien
ctcgctttgtgccaatgtggagtgc

SEQ ID NO: 405651 - DNA, 25 bp, Homo sapien
cgctttgtgccaatgtggagtgccc

SEQ ID NO: 405652 - DNA, 25 bp, Homo sapien
gctttgtgccaatgtggagtgcccg

SEQ ID NO: 405653 - DNA, 25 bp, Homo sapien
ctttgtgccaatgtggagtgcccgc

SEQ ID NO: 405654 - DNA, 25 bp, Homo sapien
gcctgctcacacatgtcgatgcgga

SEQ ID NO: 405655 - DNA, 25 bp, Homo sapien
ctgctcacacatgtcgatgcggagt

SEQ ID NO: 405656 - DNA, 25 bp, Homo sapien
tgctcacacatgtcgatgcggagtg

SEQ ID NO: 405657 - DNA, 25 bp, Homo sapien
gctcacacatgtcgatgcggagtgc

SEQ ID NO: 405658 - DNA, 25 bp, Homo sapien
tcacacatgtcgatgcggagtgccc

SEQ ID NO: 405659 - DNA, 25 bp, Homo sapien
acctgctcacatgtgccgatgtgga

SEQ ID NO: 405660 - DNA, 25 bp, Homo sapien
acatgtgccgatgtggagtgccacc

SEQ ID NO: 405661 - DNA, 25 bp, Homo sapien
acaggtggcctttttgcttgtgctt

SEQ ID NO: 405662 - DNA, 25 bp, Homo sapien
ggcctttttgcttgtgctttcaaat

SEQ ID NO: 405663 - DNA, 25 bp, Homo sapien
tttaccactctaaaaggcattcaca

SEQ ID NO: 405664 - DNA, 25 bp, Homo sapien
ctgagttcagagttcttagaaggct

SEQ ID NO: 405665 - DNA, 25 bp, Homo sapien
gagaaaaagtatggttcagtacctg

SEQ ID NO: 405666 - DNA, 25 bp, Homo sapien
tcagtacctgcattttatttcgaag

SEQ ID NO: 405667 - DNA, 25 bp, Homo sapien
gagtatgagtcatctgcagtgaatg

SEQ ID NO: 405668 - DNA, 25 bp, Homo sapien
ggctttatgagcaaaggccgattca

SEQ ID NO: 405669 - DNA, 25 bp, Homo sapien
ggccgattcaaaactgccgtttcct

SEQ ID NO: 405670 - DNA, 25 bp, Homo sapien
ttccttacaccaacccatcatgtga

SEQ ID NO: 405671 - DNA, 25 bp, Homo sapien
catcatgtgatgacaggtggccttt

SEQ ID NO: 405672 - DNA, 25 bp, Homo sapien
acatcatcacgtcgcagaacatctg

SEQ ID NO: 405673 - DNA, 25 bp, Homo sapien
atcacgtcgcagaacatctgggagg

SEQ ID NO: 405674 - DNA, 25 bp, Homo sapien
ccgccttcgggctgctagtggcgct

SEQ ID NO: 405675 - DNA, 25 bp, Homo sapien
gcccagtgcaccaactgcgtgcagg

SEQ ID NO: 405676 - DNA, 25 bp, Homo sapien
tgcaggacgacacggccaaggccaa

SEQ ID NO: 405677 - DNA, 25 bp, Homo sapien
ggacgacacggccaaggccaagatc

SEQ ID NO: 405678 - DNA, 25 bp, Homo sapien
aaggccaagatcaccatcgtggcag

SEQ ID NO: 405679 - DNA, 25 bp, Homo sapien
aagatcaccatcgtggcaggcgtgc

SEQ ID NO: 405680 - DNA, 25 bp, Homo sapien
tcaccatcgtggcaggcgtgctgtt

SEQ ID NO: 405681 - DNA, 25 bp, Homo sapien
atcgtggcaggcgtgctgttccttc

SEQ ID NO: 405682 - DNA, 25 bp, Homo sapien
tggcaggcgtgctgttccttctcgc

SEQ ID NO: 405683 - DNA, 25 bp, Homo sapien
accacgtcgtacaggtatgggctgg

SEQ ID NO: 405684 - DNA, 25 bp, Homo sapien
aacgagtccccaccctgtagcgtgg

SEQ ID NO: 405685 - DNA, 25 bp, Homo sapien
agtccccaccctgtagcgtggagga

SEQ ID NO: 405686 - DNA, 25 bp, Homo sapien
caccctgtagcgtggaggacgcgga

SEQ ID NO: 405687 - DNA, 25 bp, Homo sapien
agctctctccggtcactgcctagtg

SEQ ID NO: 405688 - DNA, 25 bp, Homo sapien
tctccggtcactgcctagtgtgcgg

SEQ ID NO: 405689 - DNA, 25 bp, Homo sapien
gtcactgcctagtgtgcgggcgttg

SEQ ID NO: 405690 - DNA, 25 bp, Homo sapien
gtgtgcgggcgttggtggtgaggac

SEQ ID NO: 405691 - DNA, 25 bp, Homo sapien
cgttggtggtgaggaccgagcgcag

SEQ ID NO: 405692 - DNA, 25 bp, Homo sapien
accgagcgcagggtcccgtgtgggt

SEQ ID NO: 405693 - DNA, 25 bp, Homo sapien
gcgcagggtcccgtgtgggtgagcc

SEQ ID NO: 405694 - DNA, 25 bp, Homo sapien
acgctgcagcattaaggaatgtgat

SEQ ID NO: 405695 - DNA, 25 bp, Homo sapien
cgctgcagcattaaggaatgtgata

SEQ ID NO: 405696 - DNA, 25 bp, Homo sapien
gctgcagcattaaggaatgtgatag

SEQ ID NO: 405697 - DNA, 25 bp, Homo sapien
ctgcagcattaaggaatgtgataga

SEQ ID NO: 405698 - DNA, 25 bp, Homo sapien
aaaagattctgaatataggccaggc

SEQ ID NO: 405699 - DNA, 25 bp, Homo sapien
aaagattctgaatataggccaggcg

SEQ ID NO: 405700 - DNA, 25 bp, Homo sapien
aagattctgaatataggccaggcgc

SEQ ID NO: 405701 - DNA, 25 bp, Homo sapien
agattctgaatataggccaggcgca

SEQ ID NO: 405702 - DNA, 25 bp, Homo sapien
gattctgaatataggccaggcgcag

SEQ ID NO: 405703 - DNA, 25 bp, Homo sapien
ggaacttgcactgggctgagatcgc

SEQ ID NO: 405704 - DNA, 25 bp, Homo sapien
gaacttgcactgggctgagatcgcg

SEQ ID NO: 405705 - DNA, 25 bp, Homo sapien
gtaagaagatatataaatcggcggg

SEQ ID NO: 405706 - DNA, 25 bp, Homo sapien
agatatataaatcggcggggcacag

SEQ ID NO: 405707 - DNA, 25 bp, Homo sapien
aagaagatcgcttgagcttaagagt

SEQ ID NO: 405708 - DNA, 25 bp, Homo sapien
ttgggtaacattgggagaccctatc

SEQ ID NO: 405709 - DNA, 25 bp, Homo sapien
ccagaagtttgaggtaatgagcgat

SEQ ID NO: 405710 - DNA, 25 bp, Homo sapien
gaggtaatgagcgatattaacgcca

SEQ ID NO: 405711 - DNA, 25 bp, Homo sapien
ggtaatgagcgatattaacgccatt

SEQ ID NO: 405712 - DNA, 25 bp, Homo sapien
taatgagcgatattaacgccattgc

SEQ ID NO: 405713 - DNA, 25 bp, Homo sapien
aatgagcgatattaacgccattgca

SEQ ID NO: 405714 - DNA, 25 bp, Homo sapien
tgagcgatattaacgccattgcact

SEQ ID NO: 405715 - DNA, 25 bp, Homo sapien
gagcgatattaacgccattgcactc

SEQ ID NO: 405716 - DNA, 25 bp, Homo sapien
actatattcagattatactttgttc

SEQ ID NO: 405717 - DNA, 25 bp, Homo sapien
atattcagattatactttgttcttg

SEQ ID NO: 405718 - DNA, 25 bp, Homo sapien
tattcagattatactttgttcttga

SEQ ID NO: 405719 - DNA, 25 bp, Homo sapien
tcagattatactttgttcttgaaaa

SEQ ID NO: 405720 - DNA, 25 bp, Homo sapien
aagcaaatgatgtaactcaactcat

SEQ ID NO: 405721 - DNA, 25 bp, Homo sapien
gcaaatgatgtaactcaactcatta

SEQ ID NO: 405722 - DNA, 25 bp, Homo sapien
atgatgtaactcaactcattatttt

SEQ ID NO: 405723 - DNA, 25 bp, Homo sapien
taactcaactcattattttctgctg

SEQ ID NO: 405724 - DNA, 25 bp, Homo sapien
aactcaactcattattttctgctgt

SEQ ID NO: 405725 - DNA, 25 bp, Homo sapien
actcaactcattattttctgctgtt

SEQ ID NO: 405726 - DNA, 25 bp, Homo sapien
atcttttctatggatgagtaagaat

SEQ ID NO: 405727 - DNA, 25 bp, Homo sapien
agagccccaggaactgaaaaggcct

SEQ ID NO: 405728 - DNA, 25 bp, Homo sapien
tgaaaaggcctgtgagagactctga

SEQ ID NO: 405729 - DNA, 25 bp, Homo sapien
aaaaggcctgtgagagactctgagc

SEQ ID NO: 405730 - DNA, 25 bp, Homo sapien
aggcctgtgagagactctgagcttc

SEQ ID NO: 405731 - DNA, 25 bp, Homo sapien
gcctgtgagagactctgagcttcct

SEQ ID NO: 405732 - DNA, 25 bp, Homo sapien
cctgtgagagactctgagcttcctg

SEQ ID NO: 405733 - DNA, 25 bp, Homo sapien
tgtgagagactctgagcttcctggg

SEQ ID NO: 405734 - DNA, 25 bp, Homo sapien
gtgagagactctgagcttcctggga

SEQ ID NO: 405735 - DNA, 25 bp, Homo sapien
tgagagactctgagcttcctgggaa

SEQ ID NO: 405736 - DNA, 25 bp, Homo sapien
gagagactctgagcttcctgggaac

SEQ ID NO: 405737 - DNA, 25 bp, Homo sapien
agcttcctgggaacaggcgcagtgg

SEQ ID NO: 405738 - DNA, 25 bp, Homo sapien
cacttgcagaacaggatgggaccga

SEQ ID NO: 405739 - DNA, 25 bp, Homo sapien
gatgggaccgagatttcagcgagcc

SEQ ID NO: 405740 - DNA, 25 bp, Homo sapien
gagatttcagcgagccctcctggcg

SEQ ID NO: 405741 - DNA, 25 bp, Homo sapien
cagccctcttggtagctggtgtgga

SEQ ID NO: 405742 - DNA, 25 bp, Homo sapien
ttggctgccacggagggatttgatc

SEQ ID NO: 405743 - DNA, 25 bp, Homo sapien
gggatttgatcaccgaagcagccac

SEQ ID NO: 405744 - DNA, 25 bp, Homo sapien
cctgctgtagttggacctgaggtca

SEQ ID NO: 405745 - DNA, 25 bp, Homo sapien
catcagaggctcaaggtgctgagaa

SEQ ID NO: 405746 - DNA, 25 bp, Homo sapien
caaggtgctgagaagccaccgggaa

SEQ ID NO: 405747 - DNA, 25 bp, Homo sapien
agaagccaccgggaaagcagccagc

SEQ ID NO: 405748 - DNA, 25 bp, Homo sapien
agcagccagcacaaagggcccagga

SEQ ID NO: 405749 - DNA, 25 bp, Homo sapien
tatccaacaatgcagttaagaggcc

SEQ ID NO: 405750 - DNA, 25 bp, Homo sapien
gaggccagatgactttatgcatgaa

SEQ ID NO: 405751 - DNA, 25 bp, Homo sapien
cattgttaagatgaggaattttccc

SEQ ID NO: 405752 - DNA, 25 bp, Homo sapien
gaattttcccatagaaaggtgacca

SEQ ID NO: 405753 - DNA, 25 bp, Homo sapien
aaaggtgaccagatttgaggaaatt

SEQ ID NO: 405754 - DNA, 25 bp, Homo sapien
cagattttactttcaggctttccta

SEQ ID NO: 405755 - DNA, 25 bp, Homo sapien
taataaagtttctaacagacctgga

SEQ ID NO: 405756 - DNA, 25 bp, Homo sapien
gtaacatctgttgcaaaaccccagt

SEQ ID NO: 405757 - DNA, 25 bp, Homo sapien
gttgcaaaaccccagttacgtgtag

SEQ ID NO: 405758 - DNA, 25 bp, Homo sapien
cccagttacgtgtaggacaaataag

SEQ ID NO: 405759 - DNA, 25 bp, Homo sapien
gacttgcccaagtgacacaccgatt

SEQ ID NO: 405760 - DNA, 25 bp, Homo sapien
aaacatattcttattcacaacccta

SEQ ID NO: 405761 - DNA, 25 bp, Homo sapien
ttattcacaaccctatgcaacttct

SEQ ID NO: 405762 - DNA, 25 bp, Homo sapien
caaccctatgcaacttctctaattt

SEQ ID NO: 405763 - DNA, 25 bp, Homo sapien
gcaacttctctaatttttaactgga

SEQ ID NO: 405764 - DNA, 25 bp, Homo sapien
agtgttgtatctaactctctcacca

SEQ ID NO: 405765 - DNA, 25 bp, Homo sapien
tatctaactctctcaccagatggtt

SEQ ID NO: 405766 - DNA, 25 bp, Homo sapien
accagatggttaatgggctatgcac

SEQ ID NO: 405767 - DNA, 25 bp, Homo sapien
tgggctatgcactggaactttggat

SEQ ID NO: 405768 - DNA, 25 bp, Homo sapien
gcactggaactttggatacatgata

SEQ ID NO: 405769 - DNA, 25 bp, Homo sapien
gatgacacagctagggagcagcaga

SEQ ID NO: 405770 - DNA, 25 bp, Homo sapien
accaggattcaaaccagactgactt

SEQ ID NO: 405771 - DNA, 25 bp, Homo sapien
gagccagatgctgagtacctccact

SEQ ID NO: 405772 - DNA, 25 bp, Homo sapien
gctgagtacctccactggctgctaa

SEQ ID NO: 405773 - DNA, 25 bp, Homo sapien
ggctgctaaccaacatcccgggtaa

SEQ ID NO: 405774 - DNA, 25 bp, Homo sapien
aaggacaggtgacgtgtccctacct

SEQ ID NO: 405775 - DNA, 25 bp, Homo sapien
caagcaggaccagccgattgacttc

SEQ ID NO: 405776 - DNA, 25 bp, Homo sapien
agccgattgacttctctgaggacgc

SEQ ID NO: 405777 - DNA, 25 bp, Homo sapien
gattgacttctctgaggacgcacgc

SEQ ID NO: 405778 - DNA, 25 bp, Homo sapien
ggaccttccgcacttttgatttcta

SEQ ID NO: 405779 - DNA, 25 bp, Homo sapien
tccgcacttttgatttctacaagaa

SEQ ID NO: 405780 - DNA, 25 bp, Homo sapien
aacaccaagaaaccatgactccagc

SEQ ID NO: 405781 - DNA, 25 bp, Homo sapien
gaaaccatgactccagccggcttgt

SEQ ID NO: 405782 - DNA, 25 bp, Homo sapien
tacactgccaaaaatcaggctttga

SEQ ID NO: 405783 - DNA, 25 bp, Homo sapien
aatcaggctttgactaaatacagag

SEQ ID NO: 405784 - DNA, 25 bp, Homo sapien
aaatacagagtaactttttgcagag

SEQ ID NO: 405785 - DNA, 25 bp, Homo sapien
gagatagtatttcttctagctgtaa

SEQ ID NO: 405786 - DNA, 25 bp, Homo sapien
ggaaattcaatatggatcccaaggg

SEQ ID NO: 405787 - DNA, 25 bp, Homo sapien
gatcccaagggatgtgtcaaattct

SEQ ID NO: 405788 - DNA, 25 bp, Homo sapien
gtgtcaaattctaggcattagtggt

SEQ ID NO: 405789 - DNA, 25 bp, Homo sapien
gcattagtggtgttaactggactct

SEQ ID NO: 405790 - DNA, 25 bp, Homo sapien
acatgttcatgtatctctttccaaa

SEQ ID NO: 405791 - DNA, 25 bp, Homo sapien
ggtgttaactggactctaaagatac

SEQ ID NO: 405792 - DNA, 25 bp, Homo sapien
gtatctctttccaaatgtatatatg

SEQ ID NO: 405793 - DNA, 25 bp, Homo sapien
tcctgcctcttggtatgactgctca

SEQ ID NO: 405794 - DNA, 25 bp, Homo sapien
tgcctcttggtatgactgctcagct

SEQ ID NO: 405795 - DNA, 25 bp, Homo sapien
tggtatgactgctcagctcaggagt

SEQ ID NO: 405796 - DNA, 25 bp, Homo sapien
ttgggtgctttagggcccctaccat

SEQ ID NO: 405797 - DNA, 25 bp, Homo sapien
ttagggcccctaccatgcagtgcgg

SEQ ID NO: 405798 - DNA, 25 bp, Homo sapien
gcccctaccatgcagtgcggtgaag

SEQ ID NO: 405799 - DNA, 25 bp, Homo sapien
cctaccatgcagtgcggtgaagccc

SEQ ID NO: 405800 - DNA, 25 bp, Homo sapien
gtctgcacgtaggagggaacaagcc

SEQ ID NO: 405801 - DNA, 25 bp, Homo sapien
ctgcagtaccttcggtggcctctga

SEQ ID NO: 405802 - DNA, 25 bp, Homo sapien
ttctgtccatagacaaagctcctgg

SEQ ID NO: 405803 - DNA, 25 bp, Homo sapien
ggactttgttaaagaagctgttggg

SEQ ID NO: 405804 - DNA, 25 bp, Homo sapien
ggataatgtccccagaaggaacaca

SEQ ID NO: 405805 - DNA, 25 bp, Homo sapien
tgctacagcccccaagactgaaaaa

SEQ ID NO: 405806 - DNA, 25 bp, Homo sapien
caagactgaaaaacctcccgcacgg

SEQ ID NO: 405807 - DNA, 25 bp, Homo sapien
gactgaaaaacctcccgcacggaag

SEQ ID NO: 405808 - DNA, 25 bp, Homo sapien
accctgccccgagtagcatgaggag

SEQ ID NO: 405809 - DNA, 25 bp, Homo sapien
ctgccccgagtagcatgaggagccg

SEQ ID NO: 405810 - DNA, 25 bp, Homo sapien
gggagtctggagatgagccccccta

SEQ ID NO: 405811 - DNA, 25 bp, Homo sapien
tctctcctctttgttctctcattgt

SEQ ID NO: 405812 - DNA, 25 bp, Homo sapien
tctcctctttgttctctcattgttg

SEQ ID NO: 405813 - DNA, 25 bp, Homo sapien
cctctttgttctctcattgttgtta

SEQ ID NO: 405814 - DNA, 25 bp, Homo sapien
ctctttgttctctcattgttgttat

SEQ ID NO: 405815 - DNA, 25 bp, Homo sapien
aatggaaatgctcaggtcaatggac

SEQ ID NO: 405816 - DNA, 25 bp, Homo sapien
gacctgtgatatccacggttattca

SEQ ID NO: 405817 - DNA, 25 bp, Homo sapien
gatagagtcaaacctgagccagcct

SEQ ID NO: 405818 - DNA, 25 bp, Homo sapien
aaacctgagccagcctcattgtgtg

SEQ ID NO: 405819 - DNA, 25 bp, Homo sapien
tgggatttcagtcatttgcagtgga

SEQ ID NO: 405820 - DNA, 25 bp, Homo sapien
agtggaacgatgcaggctgccacct

SEQ ID NO: 405821 - DNA, 25 bp, Homo sapien
gcaggctgccacctagtgaatgaaa

SEQ ID NO: 405822 - DNA, 25 bp, Homo sapien
aaactcaagacatcgtgacgtgcca

SEQ ID NO: 405823 - DNA, 25 bp, Homo sapien
tgacgtgccaatgtactcacttgac

SEQ ID NO: 405824 - DNA, 25 bp, Homo sapien
ttgacctccttctccatattgatgt

SEQ ID NO: 405825 - DNA, 25 bp, Homo sapien
atattgatgtcaccttttgtcccct

SEQ ID NO: 405826 - DNA, 25 bp, Homo sapien
cttgaactcactatccagacttgag

SEQ ID NO: 405827 - DNA, 25 bp, Homo sapien
ctttcagaagcaccaccatcatata

SEQ ID NO: 405828 - DNA, 25 bp, Homo sapien
gcaccaccatcatatattttttcta

SEQ ID NO: 405829 - DNA, 25 bp, Homo sapien
ctcactatccagacttgaggttttg

SEQ ID NO: 405830 - DNA, 25 bp, Homo sapien
tggataacattataaggcttcagtg

SEQ ID NO: 405831 - DNA, 25 bp, Homo sapien
attataaggcttcagtgcattttaa

SEQ ID NO: 405832 - DNA, 25 bp, Homo sapien
gaggtccaatggttatgatataatt

SEQ ID NO: 405833 - DNA, 25 bp, Homo sapien
ataactttagttttccatcgcacat

SEQ ID NO: 405834 - DNA, 25 bp, Homo sapien
ttagttttccatcgcacatttttaa

SEQ ID NO: 405835 - DNA, 25 bp, Homo sapien
gacttgaggttttgttaagttactg

SEQ ID NO: 405836 - DNA, 25 bp, Homo sapien
aacaggtcattacagataaagttga

SEQ ID NO: 405837 - DNA, 25 bp, Homo sapien
tgcttcatttccatagctcctgaga

SEQ ID NO: 405838 - DNA, 25 bp, Homo sapien
gctcctgagaatctgctgacaaaga

SEQ ID NO: 405839 - DNA, 25 bp, Homo sapien
gacaaagaattagccctggcccagc

SEQ ID NO: 405840 - DNA, 25 bp, Homo sapien
tgcccagaaccccactgtgatcaat

SEQ ID NO: 405841 - DNA, 25 bp, Homo sapien
tgaggacgccttggcttccagcatt

SEQ ID NO: 405842 - DNA, 25 bp, Homo sapien
cagcattacagctcattaggtggag

SEQ ID NO: 405843 - DNA, 25 bp, Homo sapien
tttctcccagctagcaaattccaag

SEQ ID NO: 405844 - DNA, 25 bp, Homo sapien
gctagcaaattccaagccgagactg

SEQ ID NO: 405845 - DNA, 25 bp, Homo sapien
actgggcctctcttgattatctgct

SEQ ID NO: 405846 - DNA, 25 bp, Homo sapien
gattatctgctgtacaccaagctgc

SEQ ID NO: 405847 - DNA, 25 bp, Homo sapien
tgctgtacaccaagctgcttcattt

SEQ ID NO: 405848 - DNA, 25 bp, Homo sapien
acctctcagatgttttaaagcaatg

SEQ ID NO: 405849 - DNA, 25 bp, Homo sapien
gcaatcaggactagagggccaagat

SEQ ID NO: 405850 - DNA, 25 bp, Homo sapien
ggccaagatcccaggtagaacagaa

SEQ ID NO: 405851 - DNA, 25 bp, Homo sapien
aactcagcagatgggaatttacact

SEQ ID NO: 405852 - DNA, 25 bp, Homo sapien
ataaggtgagccatggccactcttt

SEQ ID NO: 405853 - DNA, 25 bp, Homo sapien
cactcttttcccttagcgtatttgt

SEQ ID NO: 405854 - DNA, 25 bp, Homo sapien
gcgtatttgtcaattctagtggtga

SEQ ID NO: 405855 - DNA, 25 bp, Homo sapien
ctagtggtgaggtacatgggctaaa

SEQ ID NO: 405856 - DNA, 25 bp, Homo sapien
gatgggaatttacacttctatctgt

SEQ ID NO: 405857 - DNA, 25 bp, Homo sapien
tgtaaagacgactcaactctcctgc

SEQ ID NO: 405858 - DNA, 25 bp, Homo sapien
actcaactctcctgctgaaaacaaa

SEQ ID NO: 405859 - DNA, 25 bp, Homo sapien
gtattacttcagaagataggctatg

SEQ ID NO: 405860 - DNA, 25 bp, Homo sapien
tattacttcagaagataggctatgc

SEQ ID NO: 405861 - DNA, 25 bp, Homo sapien
attacttcagaagataggctatgcc

SEQ ID NO: 405862 - DNA, 25 bp, Homo sapien
ttacttcagaagataggctatgcct

SEQ ID NO: 405863 - DNA, 25 bp, Homo sapien
ttctttaacgactttggtatataat

SEQ ID NO: 405864 - DNA, 25 bp, Homo sapien
tctttaacgactttggtatataatt

SEQ ID NO: 405865 - DNA, 25 bp, Homo sapien
ttagtacattcacagcgttgtgtga

SEQ ID NO: 405866 - DNA, 25 bp, Homo sapien
tagtacattcacagcgttgtgtgac

SEQ ID NO: 405867 - DNA, 25 bp, Homo sapien
attccctaccctttactggtcattg

SEQ ID NO: 405868 - DNA, 25 bp, Homo sapien
ttccctaccctttactggtcattgg

SEQ ID NO: 405869 - DNA, 25 bp, Homo sapien
tccctaccctttactggtcattggg

SEQ ID NO: 405870 - DNA, 25 bp, Homo sapien
aaattctaggaaccactgcccaggc

SEQ ID NO: 405871 - DNA, 25 bp, Homo sapien
caccgccagtgctgcagagatcaaa

SEQ ID NO: 405872 - DNA, 25 bp, Homo sapien
tatgatgggaactgcccttttcacc

SEQ ID NO: 405873 - DNA, 25 bp, Homo sapien
gatcaaagaaatccacagccacagg

SEQ ID NO: 405874 - DNA, 25 bp, Homo sapien
aaggagcttctttggacatgcccag

SEQ ID NO: 405875 - DNA, 25 bp, Homo sapien
ttggacatgcccagctccaaactgt

SEQ ID NO: 405876 - DNA, 25 bp, Homo sapien
ctcaccgtggcctggaaattggcca

SEQ ID NO: 405877 - DNA, 25 bp, Homo sapien
aaattggccagagggtccacatcct

SEQ ID NO: 405878 - DNA, 25 bp, Homo sapien
tttcacctgccagggagttcctaaa

SEQ ID NO: 405879 - DNA, 25 bp, Homo sapien
agttcctaaagctgatcttcctggg

SEQ ID NO: 405880 - DNA, 25 bp, Homo sapien
ggttctgaaggttgcgacctaggtt

SEQ ID NO: 405881 - DNA, 25 bp, Homo sapien
gatgcttcttggtagtagaggcagt

SEQ ID NO: 405882 - DNA, 25 bp, Homo sapien
gtagtagaggcagtggcttcccagc

SEQ ID NO: 405883 - DNA, 25 bp, Homo sapien
ggcttgtagggtgaattggaacttt

SEQ ID NO: 405884 - DNA, 25 bp, Homo sapien
gaagggaccttctaacattccttgg

SEQ ID NO: 405885 - DNA, 25 bp, Homo sapien
gaccttctaacattccttggatgga

SEQ ID NO: 405886 - DNA, 25 bp, Homo sapien
gacattttcccatttacagctactt

SEQ ID NO: 405887 - DNA, 25 bp, Homo sapien
attttctacaagtgtcactgtgacc

SEQ ID NO: 405888 - DNA, 25 bp, Homo sapien
gtgtcactgtgaccaacttatgtac

SEQ ID NO: 405889 - DNA, 25 bp, Homo sapien
gtgaccaacttatgtacacatactt

SEQ ID NO: 405890 - DNA, 25 bp, Homo sapien
cacatactttttcttgcttagttat

SEQ ID NO: 405891 - DNA, 25 bp, Homo sapien
gcttagttataataatctgttctta

SEQ ID NO: 405892 - DNA, 25 bp, Homo sapien
aagcagatcctggacggcgttcact

SEQ ID NO: 405893 - DNA, 25 bp, Homo sapien
gcgttcactacctgcactctaagcg

SEQ ID NO: 405894 - DNA, 25 bp, Homo sapien
actctaagcgcatcgcacactttga

SEQ ID NO: 405895 - DNA, 25 bp, Homo sapien
tcgcacactttgacctgaagccgga

SEQ ID NO: 405896 - DNA, 25 bp, Homo sapien
gaagccggaaaacatcatgctgctg

SEQ ID NO: 405897 - DNA, 25 bp, Homo sapien
catgctgctggacaagaacgtgccc

SEQ ID NO: 405898 - DNA, 25 bp, Homo sapien
gaacgtgcccaacccacgaatcaag

SEQ ID NO: 405899 - DNA, 25 bp, Homo sapien
atcgacttcggcatcgcgcacaaga

SEQ ID NO: 405900 - DNA, 25 bp, Homo sapien
ttcggcatcgcgcacaagatcgagg

SEQ ID NO: 405901 - DNA, 25 bp, Homo sapien
gggaacgagttcaagaacatcttcg

SEQ ID NO: 405902 - DNA, 25 bp, Homo sapien
aacatcttcggcaccccggagtttg

SEQ ID NO: 405903 - DNA, 25 bp, Homo sapien
gggaaagcttagcacctaagagtaa

SEQ ID NO: 405904 - DNA, 25 bp, Homo sapien
tctttttaaggacccgtgtgacaag

SEQ ID NO: 405905 - DNA, 25 bp, Homo sapien
ttaaggacccgtgtgacaaggtgct

SEQ ID NO: 405906 - DNA, 25 bp, Homo sapien
aggacccgtgtgacaaggtgctgat

SEQ ID NO: 405907 - DNA, 25 bp, Homo sapien
ccgtgtgacaaggtgctgatgaatc

SEQ ID NO: 405908 - DNA, 25 bp, Homo sapien
ggtgctgatgaatcaacgttatcac

SEQ ID NO: 405909 - DNA, 25 bp, Homo sapien
acttcctacttacttcattagcaga

SEQ ID NO: 405910 - DNA, 25 bp, Homo sapien
tcaacgttatcacctctgtcaggaa

SEQ ID NO: 405911 - DNA, 25 bp, Homo sapien
acctctgtcaggaataataagtaaa

SEQ ID NO: 405912 - DNA, 25 bp, Homo sapien
tttttgagagtttatgaaatgctgg

SEQ ID NO: 405913 - DNA, 25 bp, Homo sapien
ttgtcaggggagatgtgtcagctat

SEQ ID NO: 405914 - DNA, 25 bp, Homo sapien
ctttctgtatcataggacactccct

SEQ ID NO: 405915 - DNA, 25 bp, Homo sapien
gtatcataggacactccctcatgga

SEQ ID NO: 405916 - DNA, 25 bp, Homo sapien
taggacactccctcatggaatccag

SEQ ID NO: 405917 - DNA, 25 bp, Homo sapien
aatccagccgccacactgcgaggat

SEQ ID NO: 405918 - DNA, 25 bp, Homo sapien
cccggactaatattggctgtgtgac

SEQ ID NO: 405919 - DNA, 25 bp, Homo sapien
ctgtgtgactgctggaccaagacgt

SEQ ID NO: 405920 - DNA, 25 bp, Homo sapien
gaccaagacgtggaagtggccctgt

SEQ ID NO: 405921 - DNA, 25 bp, Homo sapien
aagacgtggaagtggccctgtgcca

SEQ ID NO: 405922 - DNA, 25 bp, Homo sapien
aggatctgcatctaggccggcatat

SEQ ID NO: 405923 - DNA, 25 bp, Homo sapien
atctaggccggcatatgccactttc

SEQ ID NO: 405924 - DNA, 25 bp, Homo sapien
ggcatatgccactttctgtatcata

SEQ ID NO: 405925 - DNA, 25 bp, Homo sapien
gtttttacttgtactgattcacagc

SEQ ID NO: 405926 - DNA, 25 bp, Homo sapien
gtactgattcacagctgatgagcat

SEQ ID NO: 405927 - DNA, 25 bp, Homo sapien
agatgtatgtgctgtaggacttgac

SEQ ID NO: 405928 - DNA, 25 bp, Homo sapien
gcacttaaactcttgtttgagtggg

SEQ ID NO: 405929 - DNA, 25 bp, Homo sapien
tagagttacctttcagctacaggca

SEQ ID NO: 405930 - DNA, 25 bp, Homo sapien
ctttcagctacaggcagtgtttctt

SEQ ID NO: 405931 - DNA, 25 bp, Homo sapien
tcttgctgaactgcttaggctcagg

SEQ ID NO: 405932 - DNA, 25 bp, Homo sapien
ttaggctcaggtttagcgctgtcac

SEQ ID NO: 405933 - DNA, 25 bp, Homo sapien
agcgctgtcactaatgcagcagtac

SEQ ID NO: 405934 - DNA, 25 bp, Homo sapien
accgaaatgggtctgcagtgatatt

SEQ ID NO: 405935 - DNA, 25 bp, Homo sapien
gatggctacaaggttatgtttttac

SEQ ID NO: 405936 - DNA, 25 bp, Homo sapien
gccagctcgctgctcaggcgaattt

SEQ ID NO: 405937 - DNA, 25 bp, Homo sapien
gctgctcaggcgaatttctcatttc

SEQ ID NO: 405938 - DNA, 25 bp, Homo sapien
gaatttctcatttcaagccactggg

SEQ ID NO: 405939 - DNA, 25 bp, Homo sapien
aactgaggcaaaaccatacttagtc

SEQ ID NO: 405940 - DNA, 25 bp, Homo sapien
catacttagtcatcaccaacaagct

SEQ ID NO: 405941 - DNA, 25 bp, Homo sapien
aacaagctggactgcttagctgggc

SEQ ID NO: 405942 - DNA, 25 bp, Homo sapien
gcttagctgggctgttttatcttcc

SEQ ID NO: 405943 - DNA, 25 bp, Homo sapien
agactgctcctccaggctgtataga

SEQ ID NO: 405944 - DNA, 25 bp, Homo sapien
tatagacctgccctcttgcattaaa

SEQ ID NO: 405945 - DNA, 25 bp, Homo sapien
cctgccctcttgcattaaacaactt

SEQ ID NO: 405946 - DNA, 25 bp, Homo sapien
ttaaacaacttctcttgagctgcaa

SEQ ID NO: 405947 - DNA, 25 bp, Homo sapien
tgcagcagtgaccacgtcgtacagg

SEQ ID NO: 405948 - DNA, 25 bp, Homo sapien
accacgtcgtacaggtatgggctgg

SEQ ID NO: 405949 - DNA, 25 bp, Homo sapien
aacgagtccccaccctgtagcgtgg

SEQ ID NO: 405950 - DNA, 25 bp, Homo sapien
agtccccaccctgtagcgtggagga

SEQ ID NO: 405951 - DNA, 25 bp, Homo sapien
caccctgtagcgtggaggacgcgga

SEQ ID NO: 405952 - DNA, 25 bp, Homo sapien
agctctctccggtcactgcctagtg

SEQ ID NO: 405953 - DNA, 25 bp, Homo sapien
tctccggtcactgcctagtgtgcgg

SEQ ID NO: 405954 - DNA, 25 bp, Homo sapien
gtgtgcgggcgttggtggtgaggac

SEQ ID NO: 405955 - DNA, 25 bp, Homo sapien
gaggaccgagcgcagggtcccgtgt

SEQ ID NO: 405956 - DNA, 25 bp, Homo sapien
gtcccgtgtgggtgagcccttcaga

SEQ ID NO: 405957 - DNA, 25 bp, Homo sapien
acgcggacgcgctgcagcagtgacc

SEQ ID NO: 405958 - DNA, 25 bp, Homo sapien
aggcaaaaagcctccggacatgctt

SEQ ID NO: 405959 - DNA, 25 bp, Homo sapien
cctccggacatgcttctttgggaaa

SEQ ID NO: 405960 - DNA, 25 bp, Homo sapien
gaaaggactttttctgtagctgcag

SEQ ID NO: 405961 - DNA, 25 bp, Homo sapien
tgagaccccggcaggacaatggaaa

SEQ ID NO: 405962 - DNA, 25 bp, Homo sapien
cgagctgatgtttcctcacctatca

SEQ ID NO: 405963 - DNA, 25 bp, Homo sapien
tttcctcacctatcactgcttatag

SEQ ID NO: 405964 - DNA, 25 bp, Homo sapien
ctatcactgcttataggacagcatc

SEQ ID NO: 405965 - DNA, 25 bp, Homo sapien
tctctatcgctaatctctctcctat

SEQ ID NO: 405966 - DNA, 25 bp, Homo sapien
ctaatctctctcctattcttatttc

SEQ ID NO: 405967 - DNA, 25 bp, Homo sapien
tatttctctaccaactaatctcaag

SEQ ID NO: 405968 - DNA, 25 bp, Homo sapien
ctcaagtaacaataccccaggcttt

SEQ ID NO: 405969 - DNA, 25 bp, Homo sapien
tggagccggagcttgcgcctccgcg

SEQ ID NO: 405970 - DNA, 25 bp, Homo sapien
ggagccggagcttgcgcctccgcgg

SEQ ID NO: 405971 - DNA, 25 bp, Homo sapien
gagccggagcttgcgcctccgcggc

SEQ ID NO: 405972 - DNA, 25 bp, Homo sapien
agccggagcttgcgcctccgcggct

SEQ ID NO: 405973 - DNA, 25 bp, Homo sapien
gccggagcttgcgcctccgcggctc

SEQ ID NO: 405974 - DNA, 25 bp, Homo sapien
ggagcttgcgcctccgcggctcgcc

SEQ ID NO: 405975 - DNA, 25 bp, Homo sapien
gagcttgcgcctccgcggctcgcct

SEQ ID NO: 405976 - DNA, 25 bp, Homo sapien
agcttgcgcctccgcggctcgcctc

SEQ ID NO: 405977 - DNA, 25 bp, Homo sapien
gtggtaaagtctgggtcatggagct

SEQ ID NO: 405978 - DNA, 25 bp, Homo sapien
ttcctcacactctagcgtgttctta

SEQ ID NO: 405979 - DNA, 25 bp, Homo sapien
cactctagcgtgttcttaccagcat

SEQ ID NO: 405980 - DNA, 25 bp, Homo sapien
tagcgtgttcttaccagcatccagc

SEQ ID NO: 405981 - DNA, 25 bp, Homo sapien
gttcttaccagcatccagccggcag

SEQ ID NO: 405982 - DNA, 25 bp, Homo sapien
gtaatccttgaagtggaacccactt

SEQ ID NO: 405983 - DNA, 25 bp, Homo sapien
cttgaagtggaacccacttggcatg

SEQ ID NO: 405984 - DNA, 25 bp, Homo sapien
acttggcatgtagaagtacacatgt

SEQ ID NO: 405985 - DNA, 25 bp, Homo sapien
gtaacatcatgactcttaacatatg

SEQ ID NO: 405986 - DNA, 25 bp, Homo sapien
ttaacatatgttgtgtgatctctct

SEQ ID NO: 405987 - DNA, 25 bp, Homo sapien
aatccattccatcgagtactgtctg

SEQ ID NO: 405988 - DNA, 25 bp, Homo sapien
agggaagttttagctgatctcagag

SEQ ID NO: 405989 - DNA, 25 bp, Homo sapien
gtcaggtacagtccccatggaattt

SEQ ID NO: 405990 - DNA, 25 bp, Homo sapien
gaatttctcttcaggagcactccag

SEQ ID NO: 405991 - DNA, 25 bp, Homo sapien
agagctctcttgagtactggtccca

SEQ ID NO: 405992 - DNA, 25 bp, Homo sapien
agccattggcattcttacacaggag

SEQ ID NO: 405993 - DNA, 25 bp, Homo sapien
agcgcagtcagagctcagagtgatg

SEQ ID NO: 405994 - DNA, 25 bp, Homo sapien
gacacagtcagggatgattcctctg

SEQ ID NO: 405995 - DNA, 25 bp, Homo sapien
gattcctctgaagaaccagcctgtg

SEQ ID NO: 405996 - DNA, 25 bp, Homo sapien
acacaggagagctggtcgatgccga

SEQ ID NO: 405997 - DNA, 25 bp, Homo sapien
tgtggctctcctagatcgtcttctt

SEQ ID NO: 405998 - DNA, 25 bp, Homo sapien
ttcttttccggaagctgcaatcagg

SEQ ID NO: 405999 - DNA, 25 bp, Homo sapien
cggcagggtcgcaacccaagagatg

SEQ ID NO: 406000 - DNA, 25 bp, Homo sapien
ggtcgcaacccaagagatgaacccc

SEQ ID NO: 406001 - DNA, 25 bp, Homo sapien
gcaacccaagagatgaacccccagt

SEQ ID NO: 406002 - DNA, 25 bp, Homo sapien
gtcacgagctcccaacggaagggat

SEQ ID NO: 406003 - DNA, 25 bp, Homo sapien
gagctcccaacggaagggatgtcct

SEQ ID NO: 406004 - DNA, 25 bp, Homo sapien
ccaacggaagggatgtcctagtgca

SEQ ID NO: 406005 - DNA, 25 bp, Homo sapien
ggatgtcctagtgcagaggcagcca

SEQ ID NO: 406006 - DNA, 25 bp, Homo sapien
atgtcctagtgcagaggcagccacc

SEQ ID NO: 406007 - DNA, 25 bp, Homo sapien
gtcctagtgcagaggcagccaccac

SEQ ID NO: 406008 - DNA, 25 bp, Homo sapien
tagtgcagaggcagccaccacgctc

SEQ ID NO: 406009 - DNA, 25 bp, Homo sapien
ggcagtggtggaagatgctcctcct

SEQ ID NO: 406010 - DNA, 25 bp, Homo sapien
cccacctaataaacataactctaat

SEQ ID NO: 406011 - DNA, 25 bp, Homo sapien
tacctttcacactatatgacactac

SEQ ID NO: 406012 - DNA, 25 bp, Homo sapien
ttcacactatatgacactacataag

SEQ ID NO: 406013 - DNA, 25 bp, Homo sapien
ttatagtttttcttattcacacagc

SEQ ID NO: 406014 - DNA, 25 bp, Homo sapien
tagtttttcttattcacacagcttg

SEQ ID NO: 406015 - DNA, 25 bp, Homo sapien
gtttttcttattcacacagcttgac

SEQ ID NO: 406016 - DNA, 25 bp, Homo sapien
ttttcttattcacacagcttgactt

SEQ ID NO: 406017 - DNA, 25 bp, Homo sapien
ttatccatgtgtatttcttccaagc

SEQ ID NO: 406018 - DNA, 25 bp, Homo sapien
tccatgtgtatttcttccaagctca

SEQ ID NO: 406019 - DNA, 25 bp, Homo sapien
taagctactcttttcaggtcacact

SEQ ID NO: 406020 - DNA, 25 bp, Homo sapien
actcttttcaggtcacacttgtgca

SEQ ID NO: 406021 - DNA, 25 bp, Homo sapien
tcaagcagagagtgccgatcttact

SEQ ID NO: 406022 - DNA, 25 bp, Homo sapien
gtgccgatcttactcaagtacctag

SEQ ID NO: 406023 - DNA, 25 bp, Homo sapien
tcaagtacctagactcagatacaga

SEQ ID NO: 406024 - DNA, 25 bp, Homo sapien
ggaactgcaagcactttatgcacta

SEQ ID NO: 406025 - DNA, 25 bp, Homo sapien
tatgcactacaagcatcgatagtaa

SEQ ID NO: 406026 - DNA, 25 bp, Homo sapien
gtaaaacttgatcaacctgccaatt

SEQ ID NO: 406027 - DNA, 25 bp, Homo sapien
aacctgccaatttgctgcggatgtt

SEQ ID NO: 406028 - DNA, 25 bp, Homo sapien
atttgctgcggatgttttttgattg

SEQ ID NO: 406029 - DNA, 25 bp, Homo sapien
aggtgatctccgaggatgccttcta

SEQ ID NO: 406030 - DNA, 25 bp, Homo sapien
tctgaaatctgtcacggcattcttc

SEQ ID NO: 406031 - DNA, 25 bp, Homo sapien
ggcattcttcacgtggctgcgggaa

SEQ ID NO: 406032 - DNA, 25 bp, Homo sapien
gccagttggatctgatgttcgtcag

SEQ ID NO: 406033 - DNA, 25 bp, Homo sapien
gtgtaagtttgctaacggatgggtt

SEQ ID NO: 406034 - DNA, 25 bp, Homo sapien
agaactataggatttatgggaccaa

SEQ ID NO: 406035 - DNA, 25 bp, Homo sapien
gggaccaagtctagcgagtccagat

SEQ ID NO: 406036 - DNA, 25 bp, Homo sapien
gcgagtccagatatcaaaatcatta

SEQ ID NO: 406037 - DNA, 25 bp, Homo sapien
gatgttcgtcagttctttacttcta

SEQ ID NO: 406038 - DNA, 25 bp, Homo sapien
cgtcagttctttacttctatttcct

SEQ ID NO: 406039 - DNA, 25 bp, Homo sapien
gggtactcaggagggcacacactat

SEQ ID NO: 406040 - DNA, 25 bp, Homo sapien
gagggcacacactatagataacttg

SEQ ID NO: 406041 - DNA, 25 bp, Homo sapien
agataacttgggttagctgcataaa

SEQ ID NO: 406042 - DNA, 25 bp, Homo sapien
gctgcataaaattcaatgtctcatt

SEQ ID NO: 406043 - DNA, 25 bp, Homo sapien
tgcctggctgatgctggagctttta

SEQ ID NO: 406044 - DNA, 25 bp, Homo sapien
gcctggctgatgctggagcttttat

SEQ ID NO: 406045 - DNA, 25 bp, Homo sapien
cctggctgatgctggagcttttatg

SEQ ID NO: 406046 - DNA, 25 bp, Homo sapien
ctggctgatgctggagcttttatgt

SEQ ID NO: 406047 - DNA, 25 bp, Homo sapien
gctgatgctggagcttttatgtgac

SEQ ID NO: 406048 - DNA, 25 bp, Homo sapien
gatgctggagcttttatgtgacatg

SEQ ID NO: 406049 - DNA, 25 bp, Homo sapien
tgctggagcttttatgtgacatggt

SEQ ID NO: 406050 - DNA, 25 bp, Homo sapien
gctggagcttttatgtgacatggtg

SEQ ID NO: 406051 - DNA, 25 bp, Homo sapien
gagcttttatgtgacatggtgactc

SEQ ID NO: 406052 - DNA, 25 bp, Homo sapien
gcttttatgtgacatggtgactctt

SEQ ID NO: 406053 - DNA, 25 bp, Homo sapien
ttttatgtgacatggtgactcttaa

SEQ ID NO: 406054 - DNA, 25 bp, Homo sapien
ggaattgaaattctgcttgttggtt

SEQ ID NO: 406055 - DNA, 25 bp, Homo sapien
ctgcttgttggttttatacgtatat

SEQ ID NO: 406056 - DNA, 25 bp, Homo sapien
atattgaaaccttgttattatcaga

SEQ ID NO: 406057 - DNA, 25 bp, Homo sapien
gttattatcagaatagccacctggt

SEQ ID NO: 406058 - DNA, 25 bp, Homo sapien
aatagccacctggttattctctttt

SEQ ID NO: 406059 - DNA, 25 bp, Homo sapien
agtatctagattcagcagttctcag

SEQ ID NO: 406060 - DNA, 25 bp, Homo sapien
gtaaatctcataatgtcatgcactt

SEQ ID NO: 406061 - DNA, 25 bp, Homo sapien
tgtcatgcactttcatccctctgta

SEQ ID NO: 406062 - DNA, 25 bp, Homo sapien
tcatccctctgtacttcagtgtgca

SEQ ID NO: 406063 - DNA, 25 bp, Homo sapien
tctgtacttcagtgtgcatcttttg

SEQ ID NO: 406064 - DNA, 25 bp, Homo sapien
tcagtgtgcatcttttgaaaagtgg

SEQ ID NO: 406065 - DNA, 25 bp, Homo sapien
ggagttacttcctaagagcctgacg

SEQ ID NO: 406066 - DNA, 25 bp, Homo sapien
gttacttcctaagagcctgacgctc

SEQ ID NO: 406067 - DNA, 25 bp, Homo sapien
ttatatgccgcaaaggtttggttgg

SEQ ID NO: 406068 - DNA, 25 bp, Homo sapien
acacatagtgacacagatccttctg

SEQ ID NO: 406069 - DNA, 25 bp, Homo sapien
tagtgacacagatccttctggtctt

SEQ ID NO: 406070 - DNA, 25 bp, Homo sapien
gtgacacagatccttctggtctttc

SEQ ID NO: 406071 - DNA, 25 bp, Homo sapien
agatccttctggtctttcccaggag

SEQ ID NO: 406072 - DNA, 25 bp, Homo sapien
tctggtctttcccaggaggtgtgac

SEQ ID NO: 406073 - DNA, 25 bp, Homo sapien
ccaggaggtgtgacctaatgaggtt

SEQ ID NO: 406074 - DNA, 25 bp, Homo sapien
gacctaatgaggtttgttgtgagaa

SEQ ID NO: 406075 - DNA, 25 bp, Homo sapien
tcacatatattatctatcataggct

SEQ ID NO: 406076 - DNA, 25 bp, Homo sapien
gggaaagcttagcacctaagagtaa

SEQ ID NO: 406077 - DNA, 25 bp, Homo sapien
tctttttaaggacccgtgtgacaag

SEQ ID NO: 406078 - DNA, 25 bp, Homo sapien
aggacccgtgtgacaaggtgctgat

SEQ ID NO: 406079 - DNA, 25 bp, Homo sapien
ccgtgtgacaaggtgctgatgaatc

SEQ ID NO: 406080 - DNA, 25 bp, Homo sapien
ggtgctgatgaatcaacgttatcac

SEQ ID NO: 406081 - DNA, 25 bp, Homo sapien
acttcctacttacttcattagcaga

SEQ ID NO: 406082 - DNA, 25 bp, Homo sapien
tcaacgttatcacctctgtcaggaa

SEQ ID NO: 406083 - DNA, 25 bp, Homo sapien
acctctgtcaggaataataagtaaa

SEQ ID NO: 406084 - DNA, 25 bp, Homo sapien
ttacttcattagcagattgtcaggg

SEQ ID NO: 406085 - DNA, 25 bp, Homo sapien
gagatgtgtcagctatcctgggacc

SEQ ID NO: 406086 - DNA, 25 bp, Homo sapien
agctatcctgggaccccttggcggg

SEQ ID NO: 406087 - DNA, 25 bp, Homo sapien
gggacacagccaaaatatatctggc

SEQ ID NO: 406088 - DNA, 25 bp, Homo sapien
tatatctggcatatgcaatctgatc

SEQ ID NO: 406089 - DNA, 25 bp, Homo sapien
tatgcaatctgatcaccccttccaa

SEQ ID NO: 406090 - DNA, 25 bp, Homo sapien
atgcaatctgatcaccccttccaaa

SEQ ID NO: 406091 - DNA, 25 bp, Homo sapien
tctctcttaaaaatgcaacattctg

SEQ ID NO: 406092 - DNA, 25 bp, Homo sapien
cttaaaaatgcaacattctgacagc

SEQ ID NO: 406093 - DNA, 25 bp, Homo sapien
catgtggaggcttggatggaaacac

SEQ ID NO: 406094 - DNA, 25 bp, Homo sapien
gaggcttggatggaaacacggtaaa

SEQ ID NO: 406095 - DNA, 25 bp, Homo sapien
gcttggatggaaacacggtaaaaat

SEQ ID NO: 406096 - DNA, 25 bp, Homo sapien
tacaacattgtttctcacacttttg

SEQ ID NO: 406097 - DNA, 25 bp, Homo sapien
ctcacacttttgcaccaaagtgata

SEQ ID NO: 406098 - DNA, 25 bp, Homo sapien
ttgttaaccaagaacatctttgagc

SEQ ID NO: 406099 - DNA, 25 bp, Homo sapien
gaacatctttgagcaatgtctcttt

SEQ ID NO: 406100 - DNA, 25 bp, Homo sapien
atgtctcttttgatgttgctactaa

SEQ ID NO: 406101 - DNA, 25 bp, Homo sapien
gcatggcatttaaagtggagatact

SEQ ID NO: 406102 - DNA, 25 bp, Homo sapien
gttatgtaaaactttgttgggcaat

SEQ ID NO: 406103 - DNA, 25 bp, Homo sapien
ataatgttctacttttgtatgatac

SEQ ID NO: 406104 - DNA, 25 bp, Homo sapien
tgagtcgggagcttcctgaactttg

SEQ ID NO: 406105 - DNA, 25 bp, Homo sapien
ggagcttcctgaactttgtgtttta

SEQ ID NO: 406106 - DNA, 25 bp, Homo sapien
gtgttttatgataccttttgagaga

SEQ ID NO: 406107 - DNA, 25 bp, Homo sapien
gactgtaatttttcatgacacatga

SEQ ID NO: 406108 - DNA, 25 bp, Homo sapien
catgacacatgagatttaacgaaat

SEQ ID NO: 406109 - DNA, 25 bp, Homo sapien
aatcttttaggcatctgaaaatctt

SEQ ID NO: 406110 - DNA, 25 bp, Homo sapien
ggcatctgaaaatcttactggtatt

SEQ ID NO: 406111 - DNA, 25 bp, Homo sapien
ccagaataattgtccagattgaact

SEQ ID NO: 406112 - DNA, 25 bp, Homo sapien
tgtccagattgaactatgtcttaga

SEQ ID NO: 406113 - DNA, 25 bp, Homo sapien
tatgtcttagatatagtctcttctt

SEQ ID NO: 406114 - DNA, 25 bp, Homo sapien
ttagatatagtctcttcttttgctg

SEQ ID NO: 406115 - DNA, 25 bp, Homo sapien
aatgacagcaaatatcttaggtttt

SEQ ID NO: 406116 - DNA, 25 bp, Homo sapien
aggttttgttttatgtgtagcattc

SEQ ID NO: 406117 - DNA, 25 bp, Homo sapien
gtgtagcattcaaatgtcagtggat

SEQ ID NO: 406118 - DNA, 25 bp, Homo sapien
tgaagattcaaagcttcagttttgg

SEQ ID NO: 406119 - DNA, 25 bp, Homo sapien
agaacaccagttagattagaagagt

SEQ ID NO: 406120 - DNA, 25 bp, Homo sapien
gccaaagatcaagactaccacaagg

SEQ ID NO: 406121 - DNA, 25 bp, Homo sapien
aaagatcaagactaccacaaggaga

SEQ ID NO: 406122 - DNA, 25 bp, Homo sapien
gatcaagactaccacaaggagaaat

SEQ ID NO: 406123 - DNA, 25 bp, Homo sapien
ggagaaatatcttcctgccacaggc

SEQ ID NO: 406124 - DNA, 25 bp, Homo sapien
gagaaatatcttcctgccacaggca

SEQ ID NO: 406125 - DNA, 25 bp, Homo sapien
gaaatatcttcctgccacaggcata

SEQ ID NO: 406126 - DNA, 25 bp, Homo sapien
atatcttcctgccacaggcatatga

SEQ ID NO: 406127 - DNA, 25 bp, Homo sapien
atcttcctgccacaggcatatgaga

SEQ ID NO: 406128 - DNA, 25 bp, Homo sapien
tgccacaggcatatgagaggataag

SEQ ID NO: 406129 - DNA, 25 bp, Homo sapien
gccacaggcatatgagaggataaga

SEQ ID NO: 406130 - DNA, 25 bp, Homo sapien
agaggataagaaactctccctatca

SEQ ID NO: 406131 - DNA, 25 bp, Homo sapien
tagttggaatatagtgatttttgtc

SEQ ID NO: 406132 - DNA, 25 bp, Homo sapien
agttggaatatagtgatttttgtct

SEQ ID NO: 406133 - DNA, 25 bp, Homo sapien
gttggaatatagtgatttttgtctg

SEQ ID NO: 406134 - DNA, 25 bp, Homo sapien
ttggaatatagtgatttttgtctgt

SEQ ID NO: 406135 - DNA, 25 bp, Homo sapien
tggaatatagtgatttttgtctgtt

SEQ ID NO: 406136 - DNA, 25 bp, Homo sapien
tgagataggtcaaaattttaattct

SEQ ID NO: 406137 - DNA, 25 bp, Homo sapien
gagataggtcaaaattttaattctc

SEQ ID NO: 406138 - DNA, 25 bp, Homo sapien
ttttaattctcccactattaatcct

SEQ ID NO: 406139 - DNA, 25 bp, Homo sapien
tttaattctcccactattaatcctc

SEQ ID NO: 406140 - DNA, 25 bp, Homo sapien
ttaattctcccactattaatcctca

SEQ ID NO: 406141 - DNA, 25 bp, Homo sapien
taattctcccactattaatcctcaa

SEQ ID NO: 406142 - DNA, 25 bp, Homo sapien
aatgagaatttgaaggaggctgtat

SEQ ID NO: 406143 - DNA, 25 bp, Homo sapien
ccgtgcatggtcatgagcagcccag

SEQ ID NO: 406144 - DNA, 25 bp, Homo sapien
tgcatggtcatgagcagcccaggga

SEQ ID NO: 406145 - DNA, 25 bp, Homo sapien
gatcacagaaatcatgaggccctga

SEQ ID NO: 406146 - DNA, 25 bp, Homo sapien
ctgaaaagtgaagatcccgccctca

SEQ ID NO: 406147 - DNA, 25 bp, Homo sapien
tcactttctcactttcctgatgcag

SEQ ID NO: 406148 - DNA, 25 bp, Homo sapien
cactttcctgatgcagtcatgtgaa

SEQ ID NO: 406149 - DNA, 25 bp, Homo sapien
ctgatgcagtcatgtgaaatttgtc

SEQ ID NO: 406150 - DNA, 25 bp, Homo sapien
gtcatgtgaaatttgtctttacttc

SEQ ID NO: 406151 - DNA, 25 bp, Homo sapien
ttgtctttacttccatttacttcct

SEQ ID NO: 406152 - DNA, 25 bp, Homo sapien
tgtctttacttccatttacttcctt

SEQ ID NO: 406153 - DNA, 25 bp, Homo sapien
agacattctgtgtgtgattatgcat

SEQ ID NO: 406154 - DNA, 25 bp, Homo sapien
gattatgcatgagactgtactggta

SEQ ID NO: 406155 - DNA, 25 bp, Homo sapien
actggtaagacttgtatctccatcc

SEQ ID NO: 406156 - DNA, 25 bp, Homo sapien
ttgtatctccatccacctgaaggag

SEQ ID NO: 406157 - DNA, 25 bp, Homo sapien
aaggagaattgctggctcattttca

SEQ ID NO: 406158 - DNA, 25 bp, Homo sapien
tgtggaaacccggtcaggtaatgat

SEQ ID NO: 406159 - DNA, 25 bp, Homo sapien
gtggcaggaggcagtcaaatgccca

SEQ ID NO: 406160 - DNA, 25 bp, Homo sapien
gtgaaacccaaccttaaagctgaag

SEQ ID NO: 406161 - DNA, 25 bp, Homo sapien
aaagctgaagacagtcccggctaaa

SEQ ID NO: 406162 - DNA, 25 bp, Homo sapien
tcccggctaaatcctcatactgaat

SEQ ID NO: 406163 - DNA, 25 bp, Homo sapien
agaacctgtcttcccatttggtgtg

SEQ ID NO: 406164 - DNA, 25 bp, Homo sapien
gggaattcggcttcctgtcgtctgg

SEQ ID NO: 406165 - DNA, 25 bp, Homo sapien
aattcggcttcctgtcgtctgggtt

SEQ ID NO: 406166 - DNA, 25 bp, Homo sapien
gcttcctgtcgtctgggttttgatt

SEQ ID NO: 406167 - DNA, 25 bp, Homo sapien
ttttgagttgcactagaggagtctt

SEQ ID NO: 406168 - DNA, 25 bp, Homo sapien
gttgcactagaggagtctttatgtc

SEQ ID NO: 406169 - DNA, 25 bp, Homo sapien
ggagtctttatgtctggaatgctga

SEQ ID NO: 406170 - DNA, 25 bp, Homo sapien
ccaggcgggctgtgagggcaggatt

SEQ ID NO: 406171 - DNA, 25 bp, Homo sapien
agtttcttaaactctatagtctgga

SEQ ID NO: 406172 - DNA, 25 bp, Homo sapien
aaactctatagtctggattccggtg

SEQ ID NO: 406173 - DNA, 25 bp, Homo sapien
tatagtctggattccggtgtcaggg

SEQ ID NO: 406174 - DNA, 25 bp, Homo sapien
tgtcaggggcctgagccattttcct

SEQ ID NO: 406175 - DNA, 25 bp, Homo sapien
ctctgcatcattctgggcttggcct

SEQ ID NO: 406176 - DNA, 25 bp, Homo sapien
ctgcatcattctgggcttggcctgg

SEQ ID NO: 406177 - DNA, 25 bp, Homo sapien
ggcctggacagcacccgccagtgag

SEQ ID NO: 406178 - DNA, 25 bp, Homo sapien
cagcacccgccagtgagagctgtgg

SEQ ID NO: 406179 - DNA, 25 bp, Homo sapien
tgagagctgtgggcctcaccctctg

SEQ ID NO: 406180 - DNA, 25 bp, Homo sapien
ggcagctgagccaagcactgtcatt

SEQ ID NO: 406181 - DNA, 25 bp, Homo sapien
agcactgtcattcttggtgccatct

SEQ ID NO: 406182 - DNA, 25 bp, Homo sapien
actgtcattcttggtgccatcttcc

SEQ ID NO: 406183 - DNA, 25 bp, Homo sapien
gtaggttgggctcccaagcaacaca

SEQ ID NO: 406184 - DNA, 25 bp, Homo sapien
cccagagggacttgactttctttct

SEQ ID NO: 406185 - DNA, 25 bp, Homo sapien
gagggacttgactttctttctggac

SEQ ID NO: 406186 - DNA, 25 bp, Homo sapien
tgcaaggtctatctctcccatcagg

SEQ ID NO: 406187 - DNA, 25 bp, Homo sapien
aaggtctatctctcccatcagggct

SEQ ID NO: 406188 - DNA, 25 bp, Homo sapien
gaatgatgccattctcacaaaccaa

SEQ ID NO: 406189 - DNA, 25 bp, Homo sapien
gatgccattctcacaaaccaatgct

SEQ ID NO: 406190 - DNA, 25 bp, Homo sapien
ccattctcacaaaccaatgctctat

SEQ ID NO: 406191 - DNA, 25 bp, Homo sapien
aaaccaatgctctatattgcttgaa

SEQ ID NO: 406192 - DNA, 25 bp, Homo sapien
ctatattgcttgaagtctgcatcta

SEQ ID NO: 406193 - DNA, 25 bp, Homo sapien
gcttgaagtctgcatctaaatattg

SEQ ID NO: 406194 - DNA, 25 bp, Homo sapien
ttctcttaaattacaattgtgccca

SEQ ID NO: 406195 - DNA, 25 bp, Homo sapien
caattgtgcccaatgcagggtggct

SEQ ID NO: 406196 - DNA, 25 bp, Homo sapien
attgtgcccaatgcagggtggctct

SEQ ID NO: 406197 - DNA, 25 bp, Homo sapien
atcttgattcaagtggtcccaggac

SEQ ID NO: 406198 - DNA, 25 bp, Homo sapien
tggtcccaggaccaccctcagagaa

SEQ ID NO: 406199 - DNA, 25 bp, Homo sapien
agagaaccacacagccgacagacag

SEQ ID NO: 406200 - DNA, 25 bp, Homo sapien
ggcacatcaggcagaagaaccatct

SEQ ID NO: 406201 - DNA, 25 bp, Homo sapien
gaaccatctgtgagaccagagtagg

SEQ ID NO: 406202 - DNA, 25 bp, Homo sapien
aaacacagagtccaatactgctttc

SEQ ID NO: 406203 - DNA, 25 bp, Homo sapien
aactggagggtgacaatcttagaca

SEQ ID NO: 406204 - DNA, 25 bp, Homo sapien
gacatgcaggcagatgtctgatcat

SEQ ID NO: 406205 - DNA, 25 bp, Homo sapien
gaattataagcagcgtatctcagat

SEQ ID NO: 406206 - DNA, 25 bp, Homo sapien
gtatctcagatgtgacccagagcct

SEQ ID NO: 406207 - DNA, 25 bp, Homo sapien
ttgaataagcttccatctgatcttg

SEQ ID NO: 406208 - DNA, 25 bp, Homo sapien
cagggcagacatcacctagatgaaa

SEQ ID NO: 406209 - DNA, 25 bp, Homo sapien
agggcagacatcacctagatgaaac

SEQ ID NO: 406210 - DNA, 25 bp, Homo sapien
gggcagacatcacctagatgaaaca

SEQ ID NO: 406211 - DNA, 25 bp, Homo sapien
ggcagacatcacctagatgaaacac

SEQ ID NO: 406212 - DNA, 25 bp, Homo sapien
gacatcacctagatgaaacaccttt

SEQ ID NO: 406213 - DNA, 25 bp, Homo sapien
catcacctagatgaaacacctttac

SEQ ID NO: 406214 - DNA, 25 bp, Homo sapien
cacctagatgaaacacctttaccct

SEQ ID NO: 406215 - DNA, 25 bp, Homo sapien
acctagatgaaacacctttaccctg

SEQ ID NO: 406216 - DNA, 25 bp, Homo sapien
taccctgtcctgtaaaacactaaag

SEQ ID NO: 406217 - DNA, 25 bp, Homo sapien
gtcctgtaaaacactaaagttacat

SEQ ID NO: 406218 - DNA, 25 bp, Homo sapien
tttcaccaacttaattggaaagaag

SEQ ID NO: 406219 - DNA, 25 bp, Homo sapien
ggaatgaaacatcgtgcccagcctg

SEQ ID NO: 406220 - DNA, 25 bp, Homo sapien
atgaaacatcgtgcccagcctgtaa

SEQ ID NO: 406221 - DNA, 25 bp, Homo sapien
cccagcctgtaatttgcctattgat

SEQ ID NO: 406222 - DNA, 25 bp, Homo sapien
gtaatttgcctattgattatagcat

SEQ ID NO: 406223 - DNA, 25 bp, Homo sapien
gattatagcatttcaagtggttgtt

SEQ ID NO: 406224 - DNA, 25 bp, Homo sapien
gcatttcaagtggttgtttctgctt

SEQ ID NO: 406225 - DNA, 25 bp, Homo sapien
tcaagtggttgtttctgcttttctt

SEQ ID NO: 406226 - DNA, 25 bp, Homo sapien
tttctgcttttcttttatactattc

SEQ ID NO: 406227 - DNA, 25 bp, Homo sapien
gcttttcttttatactattctgttg

SEQ ID NO: 406228 - DNA, 25 bp, Homo sapien
tgtttcatcttaatgatcaggagaa

SEQ ID NO: 406229 - DNA, 25 bp, Homo sapien
taggaagggaaaccattaatgtaat

SEQ ID NO: 406230 - DNA, 25 bp, Homo sapien
taagcaacttggacaggcattttaa

SEQ ID NO: 406231 - DNA, 25 bp, Homo sapien
agtgacattattttagctagtggtt

SEQ ID NO: 406232 - DNA, 25 bp, Homo sapien
ttatgatatcaacttgggtccaaga

SEQ ID NO: 406233 - DNA, 25 bp, Homo sapien
gggtccaagatgatagttttagcta

SEQ ID NO: 406234 - DNA, 25 bp, Homo sapien
tagctagcttatgaacattgggttc

SEQ ID NO: 406235 - DNA, 25 bp, Homo sapien
cattgggttcacaaggcattgggta

SEQ ID NO: 406236 - DNA, 25 bp, Homo sapien
aatagcatatactttctctgcaggg

SEQ ID NO: 406237 - DNA, 25 bp, Homo sapien
atactttctctgcagggtaggtaag

SEQ ID NO: 406238 - DNA, 25 bp, Homo sapien
gtaggtaagataggtcagtcaagtt

SEQ ID NO: 406239 - DNA, 25 bp, Homo sapien
agtcaagttggtaatgcctgtccat

SEQ ID NO: 406240 - DNA, 25 bp, Homo sapien
gcctgtccattaaccatttatgcat

SEQ ID NO: 406241 - DNA, 25 bp, Homo sapien
gttctagaaatttctcttagattga

SEQ ID NO: 406242 - DNA, 25 bp, Homo sapien
gattgagctatttgttttcctgaac

SEQ ID NO: 406243 - DNA, 25 bp, Homo sapien
agctatttgttttcctgaacacctc

SEQ ID NO: 406244 - DNA, 25 bp, Homo sapien
cacctcaccttttatgatgcaataa

SEQ ID NO: 406245 - DNA, 25 bp, Homo sapien
gatgcaataagttactctgagtttc

SEQ ID NO: 406246 - DNA, 25 bp, Homo sapien
aagttactctgagtttcttggcaga

SEQ ID NO: 406247 - DNA, 25 bp, Homo sapien
tcttggcagagtttttgacagctgt

SEQ ID NO: 406248 - DNA, 25 bp, Homo sapien
ctgttgctttcaatggattccattc

SEQ ID NO: 406249 - DNA, 25 bp, Homo sapien
atggattccattcctgtattcctta

SEQ ID NO: 406250 - DNA, 25 bp, Homo sapien
cctgtattccttatgggaggttgtt

SEQ ID NO: 406251 - DNA, 25 bp, Homo sapien
aaatagactactgcgattgaaatga

SEQ ID NO: 406252 - DNA, 25 bp, Homo sapien
gaaaatgaaatccacagcctcagta

SEQ ID NO: 406253 - DNA, 25 bp, Homo sapien
acagcctcagtaccatcagtgatgc

SEQ ID NO: 406254 - DNA, 25 bp, Homo sapien
gtgatgctatactgttagtttactt

SEQ ID NO: 406255 - DNA, 25 bp, Homo sapien
aatgtgtttattattgtctctccca

SEQ ID NO: 406256 - DNA, 25 bp, Homo sapien
gtctctcccattggaatgcgagttc

SEQ ID NO: 406257 - DNA, 25 bp, Homo sapien
gagttctaccaggaactgcttgttc

SEQ ID NO: 406258 - DNA, 25 bp, Homo sapien
caagacagggacaccaggaagcagc

SEQ ID NO: 406259 - DNA, 25 bp, Homo sapien
ggaagcagctgatctttgctcagat

SEQ ID NO: 406260 - DNA, 25 bp, Homo sapien
tttgctcagatgtcactttctcagt

SEQ ID NO: 406261 - DNA, 25 bp, Homo sapien
gtcactttctcagtaaggacttctc

SEQ ID NO: 406262 - DNA, 25 bp, Homo sapien
aggacttctctaactttccgatttg

SEQ ID NO: 406263 - DNA, 25 bp, Homo sapien
tccatatttgcatagacatttgtag

SEQ ID NO: 406264 - DNA, 25 bp, Homo sapien
ttctttttagaacttcaccattggc

SEQ ID NO: 406265 - DNA, 25 bp, Homo sapien
gaacttcaccattggcttaagaatg

SEQ ID NO: 406266 - DNA, 25 bp, Homo sapien
gcttaagaatgtagttcccaaaaca

SEQ ID NO: 406267 - DNA, 25 bp, Homo sapien
tgcaaagtactttccttacacctct

SEQ ID NO: 406268 - DNA, 25 bp, Homo sapien
cttacacctcttggctacagggtgg

SEQ ID NO: 406269 - DNA, 25 bp, Homo sapien
cagggtgggccaaattaaacatata

SEQ ID NO: 406270 - DNA, 25 bp, Homo sapien
gtgcagtttggtttatcatcttaag

SEQ ID NO: 406271 - DNA, 25 bp, Homo sapien
catcttaagatggtggtgctgcccc

SEQ ID NO: 406272 - DNA, 25 bp, Homo sapien
tgtgtacacaaagaccaatgcatgg

SEQ ID NO: 406273 - DNA, 25 bp, Homo sapien
caatgcatggtctgtattgctacca

SEQ ID NO: 406274 - DNA, 25 bp, Homo sapien
ggccccctttgtaagatgctgaaca

SEQ ID NO: 406275 - DNA, 25 bp, Homo sapien
gatatcattgaccaagggcctggca

SEQ ID NO: 406276 - DNA, 25 bp, Homo sapien
aggaccggcagccagggtccccatt

SEQ ID NO: 406277 - DNA, 25 bp, Homo sapien
atttgctcttgcagccctagggact

SEQ ID NO: 406278 - DNA, 25 bp, Homo sapien
agccctagggactgtgcaggtagaa

SEQ ID NO: 406279 - DNA, 25 bp, Homo sapien
tggcgtttggtgttggcccacagac

SEQ ID NO: 406280 - DNA, 25 bp, Homo sapien
tggcccacagacacccgtgaagggt

SEQ ID NO: 406281 - DNA, 25 bp, Homo sapien
acccgtgaagggtcatggccgaatc

SEQ ID NO: 406282 - DNA, 25 bp, Homo sapien
catggccgaatcaggcagctgtcca

SEQ ID NO: 406283 - DNA, 25 bp, Homo sapien
tctccacccttccagaattggtgat

SEQ ID NO: 406284 - DNA, 25 bp, Homo sapien
tccagaattggtgatcagcgaagac

SEQ ID NO: 406285 - DNA, 25 bp, Homo sapien
tcctgcctcttggtatgactgctca

SEQ ID NO: 406286 - DNA, 25 bp, Homo sapien
tggtatgactgctcagctcaggagt

SEQ ID NO: 406287 - DNA, 25 bp, Homo sapien
ttgggtgctttagggcccctaccat

SEQ ID NO: 406288 - DNA, 25 bp, Homo sapien
ggcccctaccatgcagtgcggtgaa

SEQ ID NO: 406289 - DNA, 25 bp, Homo sapien
cctaccatgcagtgcggtgaagccc

SEQ ID NO: 406290 - DNA, 25 bp, Homo sapien
gtctgcacgtaggagggaacaagcc

SEQ ID NO: 406291 - DNA, 25 bp, Homo sapien
ggaacaagccggctgcagtaccttc

SEQ ID NO: 406292 - DNA, 25 bp, Homo sapien
ctgcagtaccttcggtggcctctga

SEQ ID NO: 406293 - DNA, 25 bp, Homo sapien
ttctgtccatagacaaagctcctgg

SEQ ID NO: 406294 - DNA, 25 bp, Homo sapien
cacttgggactttgttaaagaagct

SEQ ID NO: 406295 - DNA, 25 bp, Homo sapien
tgatgtgcagcatctgctgggcctt

SEQ ID NO: 406296 - DNA, 25 bp, Homo sapien
gcgtaaaagggatctgaaaacattc

SEQ ID NO: 406297 - DNA, 25 bp, Homo sapien
gaaaacattctaaatgcacaggtag

SEQ ID NO: 406298 - DNA, 25 bp, Homo sapien
gcacaggtaggaattagcacaaata

SEQ ID NO: 406299 - DNA, 25 bp, Homo sapien
aataagctgaccaagagttaagttc

SEQ ID NO: 406300 - DNA, 25 bp, Homo sapien
agagttaagttctcagccgctctta

SEQ ID NO: 406301 - DNA, 25 bp, Homo sapien
gctcttatcttgactcttaaccagg

SEQ ID NO: 406302 - DNA, 25 bp, Homo sapien
cttgactcttaaccaggatctgttt

SEQ ID NO: 406303 - DNA, 25 bp, Homo sapien
atgtacctagtaattcatactctgt

SEQ ID NO: 406304 - DNA, 25 bp, Homo sapien
tcatactctgtatccagcaaggtgt

SEQ ID NO: 406305 - DNA, 25 bp, Homo sapien
ccagcaaggtgttcagaggacctat

SEQ ID NO: 406306 - DNA, 25 bp, Homo sapien
accatagatagatttagtagcgtaa

SEQ ID NO: 406307 - DNA, 25 bp, Homo sapien
attttctttggttttcgatctgcct

SEQ ID NO: 406308 - DNA, 25 bp, Homo sapien
ttttcgatctgccttcaaactacat

SEQ ID NO: 406309 - DNA, 25 bp, Homo sapien
tgccttcaaactacatcctcaaatt

SEQ ID NO: 406310 - DNA, 25 bp, Homo sapien
gacaaatgataggttttctccctgt

SEQ ID NO: 406311 - DNA, 25 bp, Homo sapien
gataggttttctccctgtgaagcaa

SEQ ID NO: 406312 - DNA, 25 bp, Homo sapien
gactaattcagcttgggacatggga

SEQ ID NO: 406313 - DNA, 25 bp, Homo sapien
atgccatttacccacatggtgtgta

SEQ ID NO: 406314 - DNA, 25 bp, Homo sapien
gtgaagcaaaccacttttatttctt

SEQ ID NO: 406315 - DNA, 25 bp, Homo sapien
tatttcttaggccatttatccctcc

SEQ ID NO: 406316 - DNA, 25 bp, Homo sapien
cctccttctgagtatcacttatacc

SEQ ID NO: 406317 - DNA, 25 bp, Homo sapien
tatcacttataccaatcagcatttt

SEQ ID NO: 406318 - DNA, 25 bp, Homo sapien
gatgcttcttggtagtagaggcagt

SEQ ID NO: 406319 - DNA, 25 bp, Homo sapien
gtagtagaggcagtggcttcccagc

SEQ ID NO: 406320 - DNA, 25 bp, Homo sapien
agtagaggcagtggcttcccagcct

SEQ ID NO: 406321 - DNA, 25 bp, Homo sapien
ggcttgtagggtgaattggaacttt

SEQ ID NO: 406322 - DNA, 25 bp, Homo sapien
tttcagatgagcaaggcaaagaagg

SEQ ID NO: 406323 - DNA, 25 bp, Homo sapien
gaagggaccttctaacattccttgg

SEQ ID NO: 406324 - DNA, 25 bp, Homo sapien
gaccttctaacattccttggatgga

SEQ ID NO: 406325 - DNA, 25 bp, Homo sapien
attttctacaagtgtcactgtgacc

SEQ ID NO: 406326 - DNA, 25 bp, Homo sapien
gtgtcactgtgaccaacttatgtac

SEQ ID NO: 406327 - DNA, 25 bp, Homo sapien
gtgaccaacttatgtacacatactt

SEQ ID NO: 406328 - DNA, 25 bp, Homo sapien
tactttttcttgcttagttataata

SEQ ID NO: 406329 - DNA, 25 bp, Homo sapien
attggttgttacagacattgagact

SEQ ID NO: 406330 - DNA, 25 bp, Homo sapien
aacacaaggtagcattatttaggat

SEQ ID NO: 406331 - DNA, 25 bp, Homo sapien
gcattatttaggatgaactgtccaa

SEQ ID NO: 406332 - DNA, 25 bp, Homo sapien
gatgaactgtccaaaaacccaacgt

SEQ ID NO: 406333 - DNA, 25 bp, Homo sapien
acccaacgtacaacacgaggactag

SEQ ID NO: 406334 - DNA, 25 bp, Homo sapien
acaacacgaggactagagcggacaa

SEQ ID NO: 406335 - DNA, 25 bp, Homo sapien
gcggacaagagcgtgctgggctcag

SEQ ID NO: 406336 - DNA, 25 bp, Homo sapien
tgggctcagagtttttgccgcactg

SEQ ID NO: 406337 - DNA, 25 bp, Homo sapien
gagtttttgccgcactgagtggaca

SEQ ID NO: 406338 - DNA, 25 bp, Homo sapien
gtttttgccgcactgagtggacaag

SEQ ID NO: 406339 - DNA, 25 bp, Homo sapien
tgttaacctgaggtaattggttgtt

SEQ ID NO: 406340 - DNA, 25 bp, Homo sapien
tagccacttaccttctccatctttt

SEQ ID NO: 406341 - DNA, 25 bp, Homo sapien
cttcctcaaggatagcagctgcttc

SEQ ID NO: 406342 - DNA, 25 bp, Homo sapien
tgcttcccacagatacaccaacagg

SEQ ID NO: 406343 - DNA, 25 bp, Homo sapien
gaaggagatactttgcgaacctcaa

SEQ ID NO: 406344 - DNA, 25 bp, Homo sapien
ctaccacacttaccatttgcaggtg

SEQ ID NO: 406345 - DNA, 25 bp, Homo sapien
tgcaggtgcctgtggcttgtctatt

SEQ ID NO: 406346 - DNA, 25 bp, Homo sapien
gtctatttacaaccttgtccctaca

SEQ ID NO: 406347 - DNA, 25 bp, Homo sapien
ttgtccctacacagcagaagcggaa

SEQ ID NO: 406348 - DNA, 25 bp, Homo sapien
gaagcggaacccttcaggaagttct

SEQ ID NO: 406349 - DNA, 25 bp, Homo sapien
gcgaacctcaatgactgccaggttt

SEQ ID NO: 406350 - DNA, 25 bp, Homo sapien
aagagtacaacttcacagaatgtgt

SEQ ID NO: 406351 - DNA, 25 bp, Homo sapien
caggtcctggtcatcctgatggatg

SEQ ID NO: 406352 - DNA, 25 bp, Homo sapien
gtggagatcttctgtgacattctag

SEQ ID NO: 406353 - DNA, 25 bp, Homo sapien
tgttcgtttgtgtgctcctggacca

SEQ ID NO: 406354 - DNA, 25 bp, Homo sapien
accagggaggtgtgaagctcttcca

SEQ ID NO: 406355 - DNA, 25 bp, Homo sapien
ctcttccaggagatgtgtgacaaag

SEQ ID NO: 406356 - DNA, 25 bp, Homo sapien
aagtccagatctctgacagtcacct

SEQ ID NO: 406357 - DNA, 25 bp, Homo sapien
tctctgacagtcacctcaagaacat

SEQ ID NO: 406358 - DNA, 25 bp, Homo sapien
cctcaagaacatttccatccggagt

SEQ ID NO: 406359 - DNA, 25 bp, Homo sapien
aggagagatatactgtgccaagtca

SEQ ID NO: 406360 - DNA, 25 bp, Homo sapien
gccaagtcaggcaggaaattcgctg

SEQ ID NO: 406361 - DNA, 25 bp, Homo sapien
aaattcgctggccaaatccgggaga

SEQ ID NO: 406362 - DNA, 25 bp, Homo sapien
ggtggtaatatgtcttgtccccagc

SEQ ID NO: 406363 - DNA, 25 bp, Homo sapien
taatatgtcttgtccccagctgtgt

SEQ ID NO: 406364 - DNA, 25 bp, Homo sapien
accattcaacctcagctctgtctaa

SEQ ID NO: 406365 - DNA, 25 bp, Homo sapien
tgatcccagcccagaacctggtata

SEQ ID NO: 406366 - DNA, 25 bp, Homo sapien
cagaacctggtataggacaggcagt

SEQ ID NO: 406367 - DNA, 25 bp, Homo sapien
aggtggtgtcttagtgggccttgaa

SEQ ID NO: 406368 - DNA, 25 bp, Homo sapien
tttggatgtgtttcagtgagatggt

SEQ ID NO: 406369 - DNA, 25 bp, Homo sapien
ggagcagcagtcatgaagccatcaa

SEQ ID NO: 406370 - DNA, 25 bp, Homo sapien
cacgtctcgctcctaactagtgtgc

SEQ ID NO: 406371 - DNA, 25 bp, Homo sapien
gctcctaactagtgtgccctgctgc

SEQ ID NO: 406372 - DNA, 25 bp, Homo sapien
gccttcttgtgggtggtaatatgtc

SEQ ID NO: 406373 - DNA, 25 bp, Homo sapien
acctagtcagggtcttgggagctac

SEQ ID NO: 406374 - DNA, 25 bp, Homo sapien
tagtcagggtcttgggagctacctt

SEQ ID NO: 406375 - DNA, 25 bp, Homo sapien
agggtcttgggagctaccttgtcgt

SEQ ID NO: 406376 - DNA, 25 bp, Homo sapien
ttgggagctaccttgtcgttgggac

SEQ ID NO: 406377 - DNA, 25 bp, Homo sapien
gagctaccttgtcgttgggaccaga

SEQ ID NO: 406378 - DNA, 25 bp, Homo sapien
taccttgtcgttgggaccagagcaa

SEQ ID NO: 406379 - DNA, 25 bp, Homo sapien
tcgttgggaccagagcaaaatagtg

SEQ ID NO: 406380 - DNA, 25 bp, Homo sapien
agtggcagtttgcatggcgaacccc

SEQ ID NO: 406381 - DNA, 25 bp, Homo sapien
tgatcccctcttctgtatcaggttt

SEQ ID NO: 406382 - DNA, 25 bp, Homo sapien
tcccctcttctgtatcaggtttatt

SEQ ID NO: 406383 - DNA, 25 bp, Homo sapien
gtatcaggtttattggttgtacata

SEQ ID NO: 406384 - DNA, 25 bp, Homo sapien
ttttattctattcttccgatttggg

SEQ ID NO: 406385 - DNA, 25 bp, Homo sapien
ccccaataagtttgcagaatattct

SEQ ID NO: 406386 - DNA, 25 bp, Homo sapien
gaatattctgattactactgcttag

SEQ ID NO: 406387 - DNA, 25 bp, Homo sapien
actactgcttaggtgatatatttca

SEQ ID NO: 406388 - DNA, 25 bp, Homo sapien
atatggtaaccacttcattcatcag

SEQ ID NO: 406389 - DNA, 25 bp, Homo sapien
ggtaaccacttcattcatcagagaa

SEQ ID NO: 406390 - DNA, 25 bp, Homo sapien
catcagagaagttgtgttttgttta

SEQ ID NO: 406391 - DNA, 25 bp, Homo sapien
ttacttgtattttgtttgctaaatg

SEQ ID NO: 406392 - DNA, 25 bp, Homo sapien
ggttatttagactcatggcatgctt

SEQ ID NO: 406393 - DNA, 25 bp, Homo sapien
ggagatttaaaagtcatttccaatg

SEQ ID NO: 406394 - DNA, 25 bp, Homo sapien
atttccaatgtccttctaacttctg

SEQ ID NO: 406395 - DNA, 25 bp, Homo sapien
agctctaagcttttttctctcattg

SEQ ID NO: 406396 - DNA, 25 bp, Homo sapien
agcagaagtccttttgtgtactttt

SEQ ID NO: 406397 - DNA, 25 bp, Homo sapien
aaattgtatctttccaggagcccct

SEQ ID NO: 406398 - DNA, 25 bp, Homo sapien
gattgtaccttgctttctcaccaat

SEQ ID NO: 406399 - DNA, 25 bp, Homo sapien
ttgctttctcaccaatagacacctt

SEQ ID NO: 406400 - DNA, 25 bp, Homo sapien
caatagacaccttcccgacactttt

SEQ ID NO: 406401 - DNA, 25 bp, Homo sapien
gtagctgagcactttaacaagttga

SEQ ID NO: 406402 - DNA, 25 bp, Homo sapien
gagcattccatgtttcattcttaga

SEQ ID NO: 406403 - DNA, 25 bp, Homo sapien
aatagagggtcttccctcaacagcc

SEQ ID NO: 406404 - DNA, 25 bp, Homo sapien
tgtgcctctggtctacctttgacca

SEQ ID NO: 406405 - DNA, 25 bp, Homo sapien
acctttgaccaccactgataactaa

SEQ ID NO: 406406 - DNA, 25 bp, Homo sapien
ctctgggcacattcgaatcttccca

SEQ ID NO: 406407 - DNA, 25 bp, Homo sapien
tctgggcacattcgaatcttcccaa

SEQ ID NO: 406408 - DNA, 25 bp, Homo sapien
gcttcctttgccctggtttccatcc

SEQ ID NO: 406409 - DNA, 25 bp, Homo sapien
tatggttgttgggcgtaggacaggt

SEQ ID NO: 406410 - DNA, 25 bp, Homo sapien
tttgccctggtttccatcccctctc

SEQ ID NO: 406411 - DNA, 25 bp, Homo sapien
ccctgccagagttccaaggctgtgg

SEQ ID NO: 406412 - DNA, 25 bp, Homo sapien
cctgccagagttccaaggctgtgga

SEQ ID NO: 406413 - DNA, 25 bp, Homo sapien
ggctgtggaccccagagaaggtggc

SEQ ID NO: 406414 - DNA, 25 bp, Homo sapien
gctgtggaccccagagaaggtggca

SEQ ID NO: 406415 - DNA, 25 bp, Homo sapien
ctgtggaccccagagaaggtggcag

SEQ ID NO: 406416 - DNA, 25 bp, Homo sapien
gtggaccccagagaaggtggcaggt

SEQ ID NO: 406417 - DNA, 25 bp, Homo sapien
tggaggtgtctgtgttagaccgaac

SEQ ID NO: 406418 - DNA, 25 bp, Homo sapien
gttagaccgaacaagtgcctctgta

SEQ ID NO: 406419 - DNA, 25 bp, Homo sapien
gaccgaacaagtgcctctgtaaaaa

SEQ ID NO: 406420 - DNA, 25 bp, Homo sapien
gtgcctctgtaaaaaaggatatctt

SEQ ID NO: 406421 - DNA, 25 bp, Homo sapien
aaggatatcttggtcctcaatgtga

SEQ ID NO: 406422 - DNA, 25 bp, Homo sapien
atatcttggtcctcaatgtgaacaa

SEQ ID NO: 406423 - DNA, 25 bp, Homo sapien
ttggtcctcaatgtgaacaagtgga

SEQ ID NO: 406424 - DNA, 25 bp, Homo sapien
acaagtggacagaaacatccgcaga

SEQ ID NO: 406425 - DNA, 25 bp, Homo sapien
gaaacatccgcagagtgaccagggc

SEQ ID NO: 406426 - DNA, 25 bp, Homo sapien
aacatccgcagagtgaccagggcag

SEQ ID NO: 406427 - DNA, 25 bp, Homo sapien
aatgtgagccagcatgtcgtcatgg

SEQ ID NO: 406428 - DNA, 25 bp, Homo sapien
gatgcgtcggatgttctaaccgatc

SEQ ID NO: 406429 - DNA, 25 bp, Homo sapien
tgttctaaccgatcacattgtgttg

SEQ ID NO: 406430 - DNA, 25 bp, Homo sapien
gacagtgtctgtcgattttcaggcc

SEQ ID NO: 406431 - DNA, 25 bp, Homo sapien
gtctgtcgattttcaggcctggaaa

SEQ ID NO: 406432 - DNA, 25 bp, Homo sapien
ggaatcaatccaggagtagccccac

SEQ ID NO: 406433 - DNA, 25 bp, Homo sapien
ttctgctctgtttggcttctagggc

SEQ ID NO: 406434 - DNA, 25 bp, Homo sapien
acatctgtatattctgaaggcttct

SEQ ID NO: 406435 - DNA, 25 bp, Homo sapien
gaaggcttctgtgtgacaggaaacc

SEQ ID NO: 406436 - DNA, 25 bp, Homo sapien
acaattaagtggttctcatctctaa

SEQ ID NO: 406437 - DNA, 25 bp, Homo sapien
ggttctcatctctaattaactgtga

SEQ ID NO: 406438 - DNA, 25 bp, Homo sapien
aagcacacactcacttattaagtca

SEQ ID NO: 406439 - DNA, 25 bp, Homo sapien
ctttcaaccgccctcaataggatgg

SEQ ID NO: 406440 - DNA, 25 bp, Homo sapien
cacaacctatttccctttcagtggc

SEQ ID NO: 406441 - DNA, 25 bp, Homo sapien
gccaaggccccttatttaagagatc

SEQ ID NO: 406442 - DNA, 25 bp, Homo sapien
gatctttgtgcgctctgaaaaccat

SEQ ID NO: 406443 - DNA, 25 bp, Homo sapien
tgcatatgccagaactaggtgctct

SEQ ID NO: 406444 - DNA, 25 bp, Homo sapien
actaggtgctctgtttcatgaaggc

SEQ ID NO: 406445 - DNA, 25 bp, Homo sapien
tggactttggaagtgcccagtgttt

SEQ ID NO: 406446 - DNA, 25 bp, Homo sapien
agtgcccagtgtttgactattaccc

SEQ ID NO: 406447 - DNA, 25 bp, Homo sapien
ttgactattaccctggtgcgatgat

SEQ ID NO: 406448 - DNA, 25 bp, Homo sapien
gtgcgatgatcacactgggcgtatc

SEQ ID NO: 406449 - DNA, 25 bp, Homo sapien
ggcgtatcattgtcacatgatccca

SEQ ID NO: 406450 - DNA, 25 bp, Homo sapien
aaggcgcactgcacttctcctttga

SEQ ID NO: 406451 - DNA, 25 bp, Homo sapien
gcgcactgcacttctcctttgacgg

SEQ ID NO: 406452 - DNA, 25 bp, Homo sapien
tcctttgacggccaggccattccgg

SEQ ID NO: 406453 - DNA, 25 bp, Homo sapien
gggaggcccaagaacttccaccaag

SEQ ID NO: 406454 - DNA, 25 bp, Homo sapien
aacttccaccaagggttctgctggc

SEQ ID NO: 406455 - DNA, 25 bp, Homo sapien
tccaccaagggttctgctggctgag

SEQ ID NO: 406456 - DNA, 25 bp, Homo sapien
aagggttctgctggctgaggcctct

SEQ ID NO: 406457 - DNA, 25 bp, Homo sapien
ttcgggcctgattcagctcggcagc

SEQ ID NO: 406458 - DNA, 25 bp, Homo sapien
tagattgcactcagctctaaatgcg

SEQ ID NO: 406459 - DNA, 25 bp, Homo sapien
gattgcactcagctctaaatgcgag

SEQ ID NO: 406460 - DNA, 25 bp, Homo sapien
gctctaaatgcgagctgtcaacggg

SEQ ID NO: 406461 - DNA, 25 bp, Homo sapien
aagtctgttgctttggttctcagtc

SEQ ID NO: 406462 - DNA, 25 bp, Homo sapien
ggttctcagtcctgggtattctagg

SEQ ID NO: 406463 - DNA, 25 bp, Homo sapien
tattctaggagcttggacacgggat

SEQ ID NO: 406464 - DNA, 25 bp, Homo sapien
cgggattgcgtttcctgtgctaaaa

SEQ ID NO: 406465 - DNA, 25 bp, Homo sapien
tgtgctaaaattctctctcctggct

SEQ ID NO: 406466 - DNA, 25 bp, Homo sapien
cctggctgggctccggtaaactgaa

SEQ ID NO: 406467 - DNA, 25 bp, Homo sapien
aagctgctcgagaaatcacctggga

SEQ ID NO: 406468 - DNA, 25 bp, Homo sapien
tgggaactctcatagccgtttgtca

SEQ ID NO: 406469 - DNA, 25 bp, Homo sapien
cagggtgtacttgccaggacctctc

SEQ ID NO: 406470 - DNA, 25 bp, Homo sapien
tgctactcttcccaaagtcgggagg

SEQ ID NO: 406471 - DNA, 25 bp, Homo sapien
accagagcctgaccatactgacgct

SEQ ID NO: 406472 - DNA, 25 bp, Homo sapien
tcttaccctgaactgtctgtctaaa

SEQ ID NO: 406473 - DNA, 25 bp, Homo sapien
gtacatttttaaggctcgtttcaca

SEQ ID NO: 406474 - DNA, 25 bp, Homo sapien
ttaaggctcgtttcacatttattta

SEQ ID NO: 406475 - DNA, 25 bp, Homo sapien
agaccaatactgaaatgaaccccaa

SEQ ID NO: 406476 - DNA, 25 bp, Homo sapien
atgaaccccaaatgcttatattttt

SEQ ID NO: 406477 - DNA, 25 bp, Homo sapien
gtgtgacatctactgtcatgttgtg

SEQ ID NO: 406478 - DNA, 25 bp, Homo sapien
atgttgtgttggcaacgcatcccaa

SEQ ID NO: 406479 - DNA, 25 bp, Homo sapien
ggcaacgcatcccaagattgaagat

SEQ ID NO: 406480 - DNA, 25 bp, Homo sapien
tctcttttttagacctagtcagttg

SEQ ID NO: 406481 - DNA, 25 bp, Homo sapien
cagttgttttcaggactttctactt

SEQ ID NO: 406482 - DNA, 25 bp, Homo sapien
acttaaacatgttgccatcatttga

SEQ ID NO: 406483 - DNA, 25 bp, Homo sapien
ccgttggcgcctcagtggaagtcgg

SEQ ID NO: 406484 - DNA, 25 bp, Homo sapien
tggaagtcggccagccgcctccgtg

SEQ ID NO: 406485 - DNA, 25 bp, Homo sapien
cagccgcctccgtgggagagaggca

SEQ ID NO: 406486 - DNA, 25 bp, Homo sapien
gagaggcaggaaatcggaccaattc

SEQ ID NO: 406487 - DNA, 25 bp, Homo sapien
aaatcggaccaattcagtagcagtg

SEQ ID NO: 406488 - DNA, 25 bp, Homo sapien
atcggaccaattcagtagcagtggg

SEQ ID NO: 406489 - DNA, 25 bp, Homo sapien
gcagtggggcttaaggtttatgaac

SEQ ID NO: 406490 - DNA, 25 bp, Homo sapien
tgagcggaggcctgagcgtacaaac

SEQ ID NO: 406491 - DNA, 25 bp, Homo sapien
ggaggcctgagcgtacaaacagctt

SEQ ID NO: 406492 - DNA, 25 bp, Homo sapien
ggcctgagcgtacaaacagcttccc

SEQ ID NO: 406493 - DNA, 25 bp, Homo sapien
tgagttattgaaaagggcatggcga

SEQ ID NO: 406494 - DNA, 25 bp, Homo sapien
actcaaattgggaggccaacccaca

SEQ ID NO: 406495 - DNA, 25 bp, Homo sapien
agtgatgatactctccccttacctt

SEQ ID NO: 406496 - DNA, 25 bp, Homo sapien
tttcctctctccattcaagcattca

SEQ ID NO: 406497 - DNA, 25 bp, Homo sapien
accttgcagcaagggaccttagata

SEQ ID NO: 406498 - DNA, 25 bp, Homo sapien
gggaccttagataggcttattctga

SEQ ID NO: 406499 - DNA, 25 bp, Homo sapien
taggcttattctgactgtatgcttt

SEQ ID NO: 406500 - DNA, 25 bp, Homo sapien
gcttattctgactgtatgctttacc

SEQ ID NO: 406501 - DNA, 25 bp, Homo sapien
attctgactgtatgctttaccaatg

SEQ ID NO: 406502 - DNA, 25 bp, Homo sapien
gactgtatgctttaccaatgagaga

SEQ ID NO: 406503 - DNA, 25 bp, Homo sapien
gtatgctttaccaatgagagaaaaa

SEQ ID NO: 406504 - DNA, 25 bp, Homo sapien
aaaatgcatttcctgtatcatcctt

SEQ ID NO: 406505 - DNA, 25 bp, Homo sapien
tctgtaccagacactgggctgagcc

SEQ ID NO: 406506 - DNA, 25 bp, Homo sapien
gacactgggctgagccccagaagga

SEQ ID NO: 406507 - DNA, 25 bp, Homo sapien
agtaaggctgacttgatgcccgtct

SEQ ID NO: 406508 - DNA, 25 bp, Homo sapien
tgcatggtgcttgcagaagcctgct

SEQ ID NO: 406509 - DNA, 25 bp, Homo sapien
agcctgctaggctctcagaagccaa

SEQ ID NO: 406510 - DNA, 25 bp, Homo sapien
gaagccaaggctctcagaaagtgtc

SEQ ID NO: 406511 - DNA, 25 bp, Homo sapien
ggctctcagaaagtgtctgctgaat

SEQ ID NO: 406512 - DNA, 25 bp, Homo sapien
gagcttgtgtaagaggtggccatca

SEQ ID NO: 406513 - DNA, 25 bp, Homo sapien
tgccttgtaactctatctgcagttt

SEQ ID NO: 406514 - DNA, 25 bp, Homo sapien
catcatctggctgagacttcattta

SEQ ID NO: 406515 - DNA, 25 bp, Homo sapien
tacaatttactcctctgtaccagac

SEQ ID NO: 406516 - DNA, 25 bp, Homo sapien
gattatttgaagcaaccttacatcc

SEQ ID NO: 406517 - DNA, 25 bp, Homo sapien
ttatttgaagcaaccttacatccat

SEQ ID NO: 406518 - DNA, 25 bp, Homo sapien
aactgtcatggaagaaaaatttcaa

SEQ ID NO: 406519 - DNA, 25 bp, Homo sapien
taaaatcatgcttccgaggaacagc

SEQ ID NO: 406520 - DNA, 25 bp, Homo sapien
atcatgcttccgaggaacagcgtgc

SEQ ID NO: 406521 - DNA, 25 bp, Homo sapien
atgcttccgaggaacagcgtgcttt

SEQ ID NO: 406522 - DNA, 25 bp, Homo sapien
gcttccgaggaacagcgtgctttaa

SEQ ID NO: 406523 - DNA, 25 bp, Homo sapien
ttccgaggaacagcgtgctttaagt

SEQ ID NO: 406524 - DNA, 25 bp, Homo sapien
ggaacagcgtgctttaagttctcaa

SEQ ID NO: 406525 - DNA, 25 bp, Homo sapien
aacagcgtgctttaagttctcaaag

SEQ ID NO: 406526 - DNA, 25 bp, Homo sapien
agcgtgctttaagttctcaaagtaa

SEQ ID NO: 406527 - DNA, 25 bp, Homo sapien
tcccaattccctttcaagaatcgac

SEQ ID NO: 406528 - DNA, 25 bp, Homo sapien
gaatcgacaaaacgtcacactccac

SEQ ID NO: 406529 - DNA, 25 bp, Homo sapien
aaacgtcacactccaccttgaatgg

SEQ ID NO: 406530 - DNA, 25 bp, Homo sapien
actccaccttgaatggtcctcaaag

SEQ ID NO: 406531 - DNA, 25 bp, Homo sapien
ttggagccactcctcggctactcag

SEQ ID NO: 406532 - DNA, 25 bp, Homo sapien
tactcagcaacttctcaggttccag

SEQ ID NO: 406533 - DNA, 25 bp, Homo sapien
aggttccagcgcacactgcagtgga

SEQ ID NO: 406534 - DNA, 25 bp, Homo sapien
gcacactgcagtggagctgacttga

SEQ ID NO: 406535 - DNA, 25 bp, Homo sapien
tgacttgagggcacgtgctccgaca

SEQ ID NO: 406536 - DNA, 25 bp, Homo sapien
ttgagggcacgtgctccgacaaagg

SEQ ID NO: 406537 - DNA, 25 bp, Homo sapien
ctctgacagagagctggcctttcac

SEQ ID NO: 406538 - DNA, 25 bp, Homo sapien
agacttcctgagttcagatctctca

SEQ ID NO: 406539 - DNA, 25 bp, Homo sapien
taactagctatctgaccttggccaa

SEQ ID NO: 406540 - DNA, 25 bp, Homo sapien
tggccaagtatgctcaaagtcacaa

SEQ ID NO: 406541 - DNA, 25 bp, Homo sapien
aaccttagtttccttatgtgcatga

SEQ ID NO: 406542 - DNA, 25 bp, Homo sapien
ggaaacttagacaatgcctgtgttg

SEQ ID NO: 406543 - DNA, 25 bp, Homo sapien
gcctgtgttgtatggtaagcgtttt

SEQ ID NO: 406544 - DNA, 25 bp, Homo sapien
gcgttttcataaatgctgcctacct

SEQ ID NO: 406545 - DNA, 25 bp, Homo sapien
gctgcctacctgtaagtagcattat

SEQ ID NO: 406546 - DNA, 25 bp, Homo sapien
tgggttttgcccagcctttatacaa

SEQ ID NO: 406547 - DNA, 25 bp, Homo sapien
tgcccagcctttatacaacttcagt

SEQ ID NO: 406548 - DNA, 25 bp, Homo sapien
gggtacaacctgtgaagtcagactt

SEQ ID NO: 406549 - DNA, 25 bp, Homo sapien
gaaaacttcaggaacttgttacaga

SEQ ID NO: 406550 - DNA, 25 bp, Homo sapien
caggaacttgttacagaatattcat

SEQ ID NO: 406551 - DNA, 25 bp, Homo sapien
gaaaacaagctgatatgtgcctgtt

SEQ ID NO: 406552 - DNA, 25 bp, Homo sapien
caagctgatatgtgcctgtttctgg

SEQ ID NO: 406553 - DNA, 25 bp, Homo sapien
ctgatatgtgcctgtttctggacaa

SEQ ID NO: 406554 - DNA, 25 bp, Homo sapien
gtttctggacaatggaggcgaaaga

SEQ ID NO: 406555 - DNA, 25 bp, Homo sapien
ggcgaaagagtggaatttcattcaa

SEQ ID NO: 406556 - DNA, 25 bp, Homo sapien
aggcataatagcaatgacagtctta

SEQ ID NO: 406557 - DNA, 25 bp, Homo sapien
tgacagtcttaagccaaacatttta

SEQ ID NO: 406558 - DNA, 25 bp, Homo sapien
cagtcttaagccaaacattttatat

SEQ ID NO: 406559 - DNA, 25 bp, Homo sapien
attgtgttaagtctatgtataatac

SEQ ID NO: 406560 - DNA, 25 bp, Homo sapien
aaggtgggaagccattgtcatgcaa

SEQ ID NO: 406561 - DNA, 25 bp, Homo sapien
ggaagccattgtcatgcaagccgtc

SEQ ID NO: 406562 - DNA, 25 bp, Homo sapien
gtcatgcaagccgtccagtggcaaa

SEQ ID NO: 406563 - DNA, 25 bp, Homo sapien
gtccagtggcaaacacgtctacaaa

SEQ ID NO: 406564 - DNA, 25 bp, Homo sapien
gtgaaatcaagcaacgacgtcgagg

SEQ ID NO: 406565 - DNA, 25 bp, Homo sapien
aacgacgtcgaggagttgcctccat

SEQ ID NO: 406566 - DNA, 25 bp, Homo sapien
ttgcctccattctgcgactatgcca

SEQ ID NO: 406567 - DNA, 25 bp, Homo sapien
gcgactatgccagcatcttttggat

SEQ ID NO: 406568 - DNA, 25 bp, Homo sapien
gccagcatcttttggatgaccggga

SEQ ID NO: 406569 - DNA, 25 bp, Homo sapien
gatgaccgggagacttgcaatctga

SEQ ID NO: 406570 - DNA, 25 bp, Homo sapien
gggagacttgcaatctgaatgcaga

SEQ ID NO: 406571 - DNA, 25 bp, Homo sapien
atccccatttctgacctgtttcata

SEQ ID NO: 406572 - DNA, 25 bp, Homo sapien
ccccatttctgacctgtttcataag

SEQ ID NO: 406573 - DNA, 25 bp, Homo sapien
acctgtttcataagcattccaagca

SEQ ID NO: 406574 - DNA, 25 bp, Homo sapien
aagcattccaagcaaaattatagtt

SEQ ID NO: 406575 - DNA, 25 bp, Homo sapien
aaattatagttttacctctgctctc

SEQ ID NO: 406576 - DNA, 25 bp, Homo sapien
ctctgctctcttttattcttcttta

SEQ ID NO: 406577 - DNA, 25 bp, Homo sapien
ttcttctttaatttgaattcgtggt

SEQ ID NO: 406578 - DNA, 25 bp, Homo sapien
attcgtggttaagttattagaggca

SEQ ID NO: 406579 - DNA, 25 bp, Homo sapien
gtggttaagttattagaggcagttt

SEQ ID NO: 406580 - DNA, 25 bp, Homo sapien
ctaaaatgcatgtgatagattgtga

SEQ ID NO: 406581 - DNA, 25 bp, Homo sapien
gattgtgaaaaaatggctgcccatc

SEQ ID NO: 406582 - DNA, 25 bp, Homo sapien
gtattaaagtctgcttacatctcca

SEQ ID NO: 406583 - DNA, 25 bp, Homo sapien
taaagtctgcttacatctccacagc

SEQ ID NO: 406584 - DNA, 25 bp, Homo sapien
agtctgcttacatctccacagcaaa

SEQ ID NO: 406585 - DNA, 25 bp, Homo sapien
accagtatcagggtggaaagagaca

SEQ ID NO: 406586 - DNA, 25 bp, Homo sapien
gtccaaagtaggtcactgactaatt

SEQ ID NO: 406587 - DNA, 25 bp, Homo sapien
tcaaagaatgtagcgttttcaaaga

SEQ ID NO: 406588 - DNA, 25 bp, Homo sapien
aaaagttgtttctgactgatcatac

SEQ ID NO: 406589 - DNA, 25 bp, Homo sapien
gtttctgactgatcatacttctaat

SEQ ID NO: 406590 - DNA, 25 bp, Homo sapien
ctgatcatacttctaatgtggacct

SEQ ID NO: 406591 - DNA, 25 bp, Homo sapien
gagaaactcaagtatcacctaaaaa

SEQ ID NO: 406592 - DNA, 25 bp, Homo sapien
atacttaagcgaaaatgctgctgct

SEQ ID NO: 406593 - DNA, 25 bp, Homo sapien
agagagttctagtttccatgaggac

SEQ ID NO: 406594 - DNA, 25 bp, Homo sapien
gaggactctgacaatgctgcatttt

SEQ ID NO: 406595 - DNA, 25 bp, Homo sapien
taatgtgcacattggtacatgttta

SEQ ID NO: 406596 - DNA, 25 bp, Homo sapien
catgtttaactactctactcctgtt

SEQ ID NO: 406597 - DNA, 25 bp, Homo sapien
actcctgttcaaaatgtacttctct

SEQ ID NO: 406598 - DNA, 25 bp, Homo sapien
gtacttctctgttctgcaatgaatg

SEQ ID NO: 406599 - DNA, 25 bp, Homo sapien
tgctttttaagggtgcgagccccag

SEQ ID NO: 406600 - DNA, 25 bp, Homo sapien
agccccagggcgtgaaatgaatgtg

SEQ ID NO: 406601 - DNA, 25 bp, Homo sapien
tgaatgtggtagaactggcctctac

SEQ ID NO: 406602 - DNA, 25 bp, Homo sapien
atttcttttgggtgtgtctcctcct

SEQ ID NO: 406603 - DNA, 25 bp, Homo sapien
gtgtgtctcctcctgcaaggcctgg

SEQ ID NO: 406604 - DNA, 25 bp, Homo sapien
gtaagaagatatataaatcggcggg

SEQ ID NO: 406605 - DNA, 25 bp, Homo sapien
agatatataaatcggcggggcacag

SEQ ID NO: 406606 - DNA, 25 bp, Homo sapien
ccagaagtttgaggtaatgagcgat

SEQ ID NO: 406607 - DNA, 25 bp, Homo sapien
agaagtttgaggtaatgagcgatat

SEQ ID NO: 406608 - DNA, 25 bp, Homo sapien
gaggtaatgagcgatattaacgcca

SEQ ID NO: 406609 - DNA, 25 bp, Homo sapien
ggtaatgagcgatattaacgccatt

SEQ ID NO: 406610 - DNA, 25 bp, Homo sapien
taatgagcgatattaacgccattgc

SEQ ID NO: 406611 - DNA, 25 bp, Homo sapien
aatgagcgatattaacgccattgca

SEQ ID NO: 406612 - DNA, 25 bp, Homo sapien
atgagcgatattaacgccattgcac

SEQ ID NO: 406613 - DNA, 25 bp, Homo sapien
tgagcgatattaacgccattgcact

SEQ ID NO: 406614 - DNA, 25 bp, Homo sapien
gagcgatattaacgccattgcactc

SEQ ID NO: 406615 - DNA, 25 bp, Homo sapien
ttttttcagcctgcacgtgtacatc

SEQ ID NO: 406616 - DNA, 25 bp, Homo sapien
acgtgtacatccatgcattgcacat

SEQ ID NO: 406617 - DNA, 25 bp, Homo sapien
ccatgcattgcacattcctttctgt

SEQ ID NO: 406618 - DNA, 25 bp, Homo sapien
tgccctccctgtcattgtgaggata

SEQ ID NO: 406619 - DNA, 25 bp, Homo sapien
tgaaaagttggtcttcctgtctctg

SEQ ID NO: 406620 - DNA, 25 bp, Homo sapien
ctgtctctgggaaggcaatttagtc

SEQ ID NO: 406621 - DNA, 25 bp, Homo sapien
gtaaaatgtctcaaattccctgtcc

SEQ ID NO: 406622 - DNA, 25 bp, Homo sapien
tgtcctgtcacatggctcatgaact

SEQ ID NO: 406623 - DNA, 25 bp, Homo sapien
tgaactgcctctggcttctgaagga

SEQ ID NO: 406624 - DNA, 25 bp, Homo sapien
ggagttgtcaaacctgccgcagagt

SEQ ID NO: 406625 - DNA, 25 bp, Homo sapien
tcatcaccttgcatagagcatatgt

SEQ ID NO: 406626 - DNA, 25 bp, Homo sapien
aagtgaacaggctgtctcaggttca

SEQ ID NO: 406627 - DNA, 25 bp, Homo sapien
gattgagagatgcttcttggctatt

SEQ ID NO: 406628 - DNA, 25 bp, Homo sapien
gagatgcttcttggctattcactgc

SEQ ID NO: 406629 - DNA, 25 bp, Homo sapien
ttggctattcactgcttcaattgtt

SEQ ID NO: 406630 - DNA, 25 bp, Homo sapien
ttcactgcttcaattgttattctcc

SEQ ID NO: 406631 - DNA, 25 bp, Homo sapien
gttattctccattttatggctgctc

SEQ ID NO: 406632 - DNA, 25 bp, Homo sapien
tctccattttatggctgctccatga

SEQ ID NO: 406633 - DNA, 25 bp, Homo sapien
atggctgctccatgaaaatgaacaa

SEQ ID NO: 406634 - DNA, 25 bp, Homo sapien
gaacaagaaaggcacggagatgata

SEQ ID NO: 406635 - DNA, 25 bp, Homo sapien
gagagcaagtttacatgatagagga

SEQ ID NO: 406636 - DNA, 25 bp, Homo sapien
gggtagatggttccagattaaacat

SEQ ID NO: 406637 - DNA, 25 bp, Homo sapien
ggctgcttaactgctgtataggaca

SEQ ID NO: 406638 - DNA, 25 bp, Homo sapien
tgctgtataggacaagccccttacc

SEQ ID NO: 406639 - DNA, 25 bp, Homo sapien
gcccatgaattcctggcttggttta

SEQ ID NO: 406640 - DNA, 25 bp, Homo sapien
ggcttggtttatgttctgatttgac

SEQ ID NO: 406641 - DNA, 25 bp, Homo sapien
gacacactgattttaatcttcgaat

SEQ ID NO: 406642 - DNA, 25 bp, Homo sapien
atcttcgaatcatgacactgagtgc

SEQ ID NO: 406643 - DNA, 25 bp, Homo sapien
ggtggcattccgacagcaggacata

SEQ ID NO: 406644 - DNA, 25 bp, Homo sapien
ggacatacatgttggtgtgaagact

SEQ ID NO: 406645 - DNA, 25 bp, Homo sapien
aagactgggacgacactgggtagaa

SEQ ID NO: 406646 - DNA, 25 bp, Homo sapien
agttctgtgctgtctatgtggacac

SEQ ID NO: 406647 - DNA, 25 bp, Homo sapien
ctatgtggacactttggtaaaatgc

SEQ ID NO: 406648 - DNA, 25 bp, Homo sapien
ggaaaacaagcctgcttctggctaa

SEQ ID NO: 406649 - DNA, 25 bp, Homo sapien
aaacaagcctgcttctggctaatcc

SEQ ID NO: 406650 - DNA, 25 bp, Homo sapien
gtcctcaggaattagcactattatc

SEQ ID NO: 406651 - DNA, 25 bp, Homo sapien
gaattagcactattatccatgggag

SEQ ID NO: 406652 - DNA, 25 bp, Homo sapien
tagcactattatccatgggagggaa

SEQ ID NO: 406653 - DNA, 25 bp, Homo sapien
aaggtttattgggtctgcaggccaa

SEQ ID NO: 406654 - DNA, 25 bp, Homo sapien
tttattgggtctgcaggccaaggcc

SEQ ID NO: 406655 - DNA, 25 bp, Homo sapien
attgggtctgcaggccaaggcccat

SEQ ID NO: 406656 - DNA, 25 bp, Homo sapien
ggtctgcaggccaaggcccattttt

SEQ ID NO: 406657 - DNA, 25 bp, Homo sapien
ggcccatttttctcaggatgatcaa

SEQ ID NO: 406658 - DNA, 25 bp, Homo sapien
tgatcaaaactcatctcagcacggg

SEQ ID NO: 406659 - DNA, 25 bp, Homo sapien
aaaaccctgaaacatctctgagatg

SEQ ID NO: 406660 - DNA, 25 bp, Homo sapien
catctctgagatggtacatttactt

SEQ ID NO: 406661 - DNA, 25 bp, Homo sapien
ttactttccattgttactcttgtat

SEQ ID NO: 406662 - DNA, 25 bp, Homo sapien
gcaacaggtgagtttgctctcatag

SEQ ID NO: 406663 - DNA, 25 bp, Homo sapien
gagtttgctctcatagtggaaatta

SEQ ID NO: 406664 - DNA, 25 bp, Homo sapien
atatttccttccaagattgtgtaca

SEQ ID NO: 406665 - DNA, 25 bp, Homo sapien
gaaagcctaacccatggtggctgat

SEQ ID NO: 406666 - DNA, 25 bp, Homo sapien
ttgaaagccttttatttctaggtct

SEQ ID NO: 406667 - DNA, 25 bp, Homo sapien
atttctaggtctgtctcatgtcttt

SEQ ID NO: 406668 - DNA, 25 bp, Homo sapien
ggtctgtctcatgtctttaataaat

SEQ ID NO: 406669 - DNA, 25 bp, Homo sapien
atgagtctcatttagttcttaagct

SEQ ID NO: 406670 - DNA, 25 bp, Homo sapien
tggcactcacagcaggccggtgcta

SEQ ID NO: 406671 - DNA, 25 bp, Homo sapien
gcactcacagcaggccggtgctaag

SEQ ID NO: 406672 - DNA, 25 bp, Homo sapien
ggtgctaaggagtgtggcgcgggct

SEQ ID NO: 406673 - DNA, 25 bp, Homo sapien
tgtggcgcgggctcgactcccactg

SEQ ID NO: 406674 - DNA, 25 bp, Homo sapien
gccggcctcccgagtgactctgttt

SEQ ID NO: 406675 - DNA, 25 bp, Homo sapien
gagtgactctgttttccactgctgc

SEQ ID NO: 406676 - DNA, 25 bp, Homo sapien
tgactctgttttccactgctgcagg

SEQ ID NO: 406677 - DNA, 25 bp, Homo sapien
tgttttccactgctgcaggcgagaa

SEQ ID NO: 406678 - DNA, 25 bp, Homo sapien
tccactgctgcaggcgagaagaggc

SEQ ID NO: 406679 - DNA, 25 bp, Homo sapien
agcacagaggagctgtgaacccgct

SEQ ID NO: 406680 - DNA, 25 bp, Homo sapien
agaggagctgtgaacccgctccaca

SEQ ID NO: 406681 - DNA, 25 bp, Homo sapien
gtgggctatctctacatggttgtca

SEQ ID NO: 406682 - DNA, 25 bp, Homo sapien
attgatgtcagtctaccagtatcct

SEQ ID NO: 406683 - DNA, 25 bp, Homo sapien
accagtatcctgaaaagtctcagca

SEQ ID NO: 406684 - DNA, 25 bp, Homo sapien
gtctcagcaggcagtactcacgcca

SEQ ID NO: 406685 - DNA, 25 bp, Homo sapien
ttttgcacgtcattacaagtaacaa

SEQ ID NO: 406686 - DNA, 25 bp, Homo sapien
agtaacaacctgcagtgtttcactg

SEQ ID NO: 406687 - DNA, 25 bp, Homo sapien
agtgtttcactgtgcggtgcagtgc

SEQ ID NO: 406688 - DNA, 25 bp, Homo sapien
gcagctcgtgaggaggacccgtaca

SEQ ID NO: 406689 - DNA, 25 bp, Homo sapien
gaggaggacccgtacatggacacca

SEQ ID NO: 406690 - DNA, 25 bp, Homo sapien
tacagcttttcatagcgcttgaaag

SEQ ID NO: 406691 - DNA, 25 bp, Homo sapien
gcgcttgaaagccatctgtcacttt

SEQ ID NO: 406692 - DNA, 25 bp, Homo sapien
tccagggcgcgcacgaggtcctgca

SEQ ID NO: 406693 - DNA, 25 bp, Homo sapien
gcacgaggtcctgcacgaagcgcat

SEQ ID NO: 406694 - DNA, 25 bp, Homo sapien
gaggtcctgcacgaagcgcatctcg

SEQ ID NO: 406695 - DNA, 25 bp, Homo sapien
tgcacgaagcgcatctcggaggcta

SEQ ID NO: 406696 - DNA, 25 bp, Homo sapien
aagcgcatctcggaggctacttgct

SEQ ID NO: 406697 - DNA, 25 bp, Homo sapien
atctcggaggctacttgcttggcca

SEQ ID NO: 406698 - DNA, 25 bp, Homo sapien
tcggaggctacttgcttggccagcg

SEQ ID NO: 406699 - DNA, 25 bp, Homo sapien
tacttgcttggccagcgcctcgtag

SEQ ID NO: 406700 - DNA, 25 bp, Homo sapien
ttggccagcgcctcgtagcggttct

SEQ ID NO: 406701 - DNA, 25 bp, Homo sapien
tagcggttctccaggcggctgaagc

SEQ ID NO: 406702 - DNA, 25 bp, Homo sapien
gcttgaggccgctggtccccagcag

SEQ ID NO: 406703 - DNA, 25 bp, Homo sapien
agacacatggtcttctttctgttgt

SEQ ID NO: 406704 - DNA, 25 bp, Homo sapien
ttctgttgtcaaatggcattcttgt

SEQ ID NO: 406705 - DNA, 25 bp, Homo sapien
ggatttgtcaactaggttcctgcag

SEQ ID NO: 406706 - DNA, 25 bp, Homo sapien
agctaatgatgggtacttggcaaga

SEQ ID NO: 406707 - DNA, 25 bp, Homo sapien
gagttaggaccatctttatgttttt

SEQ ID NO: 406708 - DNA, 25 bp, Homo sapien
aactaggttcctgcaggcaacactt

SEQ ID NO: 406709 - DNA, 25 bp, Homo sapien
ggtagtgacacttaaccaagcagaa

SEQ ID NO: 406710 - DNA, 25 bp, Homo sapien
ggcaacactttgcagttttctaagc

SEQ ID NO: 406711 - DNA, 25 bp, Homo sapien
ttgcagttttctaagccaagctagt

SEQ ID NO: 406712 - DNA, 25 bp, Homo sapien
ccaagctagtagaagggatcccaat

SEQ ID NO: 406713 - DNA, 25 bp, Homo sapien
gtctctccttaaaaattttccatag

SEQ ID NO: 406714 - DNA, 25 bp, Homo sapien
agatgcctcctgcgtcccggaagcg

SEQ ID NO: 406715 - DNA, 25 bp, Homo sapien
tgcaggccgggctgtgatccaggcg

SEQ ID NO: 406716 - DNA, 25 bp, Homo sapien
gatccaggcgcctgggcagagccac

SEQ ID NO: 406717 - DNA, 25 bp, Homo sapien
tgtctgccctgcactttgaagggtt

SEQ ID NO: 406718 - DNA, 25 bp, Homo sapien
cctgcactttgaagggttgtcgtgg

SEQ ID NO: 406719 - DNA, 25 bp, Homo sapien
gattgaaatgaaccaactgccggct

SEQ ID NO: 406720 - DNA, 25 bp, Homo sapien
aatgaaccaactgccggctgagcgg

SEQ ID NO: 406721 - DNA, 25 bp, Homo sapien
aactgccggctgagcggaggctccc

SEQ ID NO: 406722 - DNA, 25 bp, Homo sapien
ggctccctgggagtgacaagttccg

SEQ ID NO: 406723 - DNA, 25 bp, Homo sapien
ccctgggagtgacaagttccgtatt

SEQ ID NO: 406724 - DNA, 25 bp, Homo sapien
ggagtgacaagttccgtattaaaat

SEQ ID NO: 406725 - DNA, 25 bp, Homo sapien
agcccttctgcacacaataacagaa

SEQ ID NO: 406726 - DNA, 25 bp, Homo sapien
agaaacctggaagccacccagatgc

SEQ ID NO: 406727 - DNA, 25 bp, Homo sapien
gaagacacgatcacacaatggaata

SEQ ID NO: 406728 - DNA, 25 bp, Homo sapien
tattatacagctgtccaaacacatt

SEQ ID NO: 406729 - DNA, 25 bp, Homo sapien
gtccaaacacattaactgcagcata

SEQ ID NO: 406730 - DNA, 25 bp, Homo sapien
ctgcagcataacttcagtgatgtag

SEQ ID NO: 406731 - DNA, 25 bp, Homo sapien
aaatagcatgttcccaatgatgact

SEQ ID NO: 406732 - DNA, 25 bp, Homo sapien
gttcccaatgatgacttacagcact

SEQ ID NO: 406733 - DNA, 25 bp, Homo sapien
gacttacagcactatgccttttaaa

SEQ ID NO: 406734 - DNA, 25 bp, Homo sapien
gcaactacaatgactgtactctcta

SEQ ID NO: 406735 - DNA, 25 bp, Homo sapien
acaatgactgtactctctaggaaaa

SEQ ID NO: 406736 - DNA, 25 bp, Homo sapien
acccctgcattctgtagcatggcct

SEQ ID NO: 406737 - DNA, 25 bp, Homo sapien
tgcattctgtagcatggcctttcct

SEQ ID NO: 406738 - DNA, 25 bp, Homo sapien
tagcatggcctttcctccctgcaga

SEQ ID NO: 406739 - DNA, 25 bp, Homo sapien
tctccacgtgcatttcctcagtggg

SEQ ID NO: 406740 - DNA, 25 bp, Homo sapien
ggaattgagaggatctgacgctgat

SEQ ID NO: 406741 - DNA, 25 bp, Homo sapien
gagaggatctgacgctgatttcttc

SEQ ID NO: 406742 - DNA, 25 bp, Homo sapien
ggatctgacgctgatttcttcctct

SEQ ID NO: 406743 - DNA, 25 bp, Homo sapien
gactgaaaaacctcccgcacggaag

SEQ ID NO: 406744 - DNA, 25 bp, Homo sapien
accctgccccgagtagcatgaggag

SEQ ID NO: 406745 - DNA, 25 bp, Homo sapien
gggagtctggagatgagccccccta

SEQ ID NO: 406746 - DNA, 25 bp, Homo sapien
tctctcctctttgttctctcattgt

SEQ ID NO: 406747 - DNA, 25 bp, Homo sapien
atggcagatgagattgccaaggctc

SEQ ID NO: 406748 - DNA, 25 bp, Homo sapien
tcgctcggcctggtggcgacacgat

SEQ ID NO: 406749 - DNA, 25 bp, Homo sapien
cctggtggcgacacgatctttggga

SEQ ID NO: 406750 - DNA, 25 bp, Homo sapien
gtggcgacacgatctttgggaagat

SEQ ID NO: 406751 - DNA, 25 bp, Homo sapien
catttttgaggatgaccggtgcctt

SEQ ID NO: 406752 - DNA, 25 bp, Homo sapien
tgaggatgaccggtgccttgctttc

SEQ ID NO: 406753 - DNA, 25 bp, Homo sapien
ggtgccttgctttccatgacatttc

SEQ ID NO: 406754 - DNA, 25 bp, Homo sapien
ctcaagcaccaacacattttctggt

SEQ ID NO: 406755 - DNA, 25 bp, Homo sapien
acacattttctggtgatacccaaga

SEQ ID NO: 406756 - DNA, 25 bp, Homo sapien
ctggtgatacccaagaaacatatat

SEQ ID NO: 406757 - DNA, 25 bp, Homo sapien
agaaacatatatcccagatttctgt

SEQ ID NO: 406758 - DNA, 25 bp, Homo sapien
gcaggtctgccttcctccatcggaa

SEQ ID NO: 406759 - DNA, 25 bp, Homo sapien
ccatcggaaaggaacgtagcgtctc

SEQ ID NO: 406760 - DNA, 25 bp, Homo sapien
aaggaacgtagcgtctcttcgcacc

SEQ ID NO: 406761 - DNA, 25 bp, Homo sapien
cagggcggcagagtccatcggaatt

SEQ ID NO: 406762 - DNA, 25 bp, Homo sapien
gagtccatcggaattgaaatcccgt

SEQ ID NO: 406763 - DNA, 25 bp, Homo sapien
attgaaatcccgttactggtgtgta

SEQ ID NO: 406764 - DNA, 25 bp, Homo sapien
atcccgttactggtgtgtagagaat

SEQ ID NO: 406765 - DNA, 25 bp, Homo sapien
agaattctacgtgggtgtcaagagc

SEQ ID NO: 406766 - DNA, 25 bp, Homo sapien
gcaccaggtacacgcactcgtgcaa

SEQ ID NO: 406767 - DNA, 25 bp, Homo sapien
gcactcgtgcaagcacacgtgtgac

SEQ ID NO: 406768 - DNA, 25 bp, Homo sapien
agcacacgtgtgacggcaggtctgc

SEQ ID NO: 406769 - DNA, 25 bp, Homo sapien
taggcaggactgttagcataaacca

SEQ ID NO: 406770 - DNA, 25 bp, Homo sapien
gcataaaccagaccagggacctgaa

SEQ ID NO: 406771 - DNA, 25 bp, Homo sapien
accagggacctgaaaagattaatat

SEQ ID NO: 406772 - DNA, 25 bp, Homo sapien
ttaatattttccatggtcagatgaa

SEQ ID NO: 406773 - DNA, 25 bp, Homo sapien
atgcaaaatggctcactgtacatta

SEQ ID NO: 406774 - DNA, 25 bp, Homo sapien
ggctcactgtacattattacatttc

SEQ ID NO: 406775 - DNA, 25 bp, Homo sapien
gttatagagtgacattttgactgtt

SEQ ID NO: 406776 - DNA, 25 bp, Homo sapien
gactgtttcctctgggtaattctca

SEQ ID NO: 406777 - DNA, 25 bp, Homo sapien
aaatctgaggagctattgtacaaac

SEQ ID NO: 406778 - DNA, 25 bp, Homo sapien
gtaattctcataactccacctgtct

SEQ ID NO: 406779 - DNA, 25 bp, Homo sapien
ataagtcagttactccttctttgcc

SEQ ID NO: 406780 - DNA, 25 bp, Homo sapien
gaaattggcaaaaagcggcctgata

SEQ ID NO: 406781 - DNA, 25 bp, Homo sapien
gcggcctgatagttccaagtgggac

SEQ ID NO: 406782 - DNA, 25 bp, Homo sapien
gacaaaagtcttatacactaatggg

SEQ ID NO: 406783 - DNA, 25 bp, Homo sapien
aaacatgggtggcattatctcgtaa

SEQ ID NO: 406784 - DNA, 25 bp, Homo sapien
gggtggcattatctcgtaaacttga

SEQ ID NO: 406785 - DNA, 25 bp, Homo sapien
gtattgtataccctatggaccagca

SEQ ID NO: 406786 - DNA, 25 bp, Homo sapien
tggaccagcaataccactctgagat

SEQ ID NO: 406787 - DNA, 25 bp, Homo sapien
actctgagatttatacacagtctag

SEQ ID NO: 406788 - DNA, 25 bp, Homo sapien
tagataaacttttgcacatgtgtgc

SEQ ID NO: 406789 - DNA, 25 bp, Homo sapien
gaagtataggttaagcctccaggga

SEQ ID NO: 406790 - DNA, 25 bp, Homo sapien
gttaagcctccagggaagtgcaaat

SEQ ID NO: 406791 - DNA, 25 bp, Homo sapien
ggaaaggaatctgtgagtgatgctt

SEQ ID NO: 406792 - DNA, 25 bp, Homo sapien
gaaaggaatctgtgagtgatgcttt

SEQ ID NO: 406793 - DNA, 25 bp, Homo sapien
ttttttaagcataattgtctgtcat

SEQ ID NO: 406794 - DNA, 25 bp, Homo sapien
ttttaagcataattgtctgtcattt

SEQ ID NO: 406795 - DNA, 25 bp, Homo sapien
ttaagcataattgtctgtcattttc

SEQ ID NO: 406796 - DNA, 25 bp, Homo sapien
aataattctttcaggcttggaaacg

SEQ ID NO: 406797 - DNA, 25 bp, Homo sapien
ataattctttcaggcttggaaacgg

SEQ ID NO: 406798 - DNA, 25 bp, Homo sapien
aattctttcaggcttggaaacggtg

SEQ ID NO: 406799 - DNA, 25 bp, Homo sapien
attctttcaggcttggaaacggtgt

SEQ ID NO: 406800 - DNA, 25 bp, Homo sapien
ttctttcaggcttggaaacggtgtt

SEQ ID NO: 406801 - DNA, 25 bp, Homo sapien
tctttcaggcttggaaacggtgttc

SEQ ID NO: 406802 - DNA, 25 bp, Homo sapien
gttggaatatagtgatttttgtctg

SEQ ID NO: 406803 - DNA, 25 bp, Homo sapien
ttggaatatagtgatttttgtctgt

SEQ ID NO: 406804 - DNA, 25 bp, Homo sapien
tggaatatagtgatttttgtctgtt

SEQ ID NO: 406805 - DNA, 25 bp, Homo sapien
ggaatatagtgatttttgtctgttc

SEQ ID NO: 406806 - DNA, 25 bp, Homo sapien
aatatagtgatttttgtctgttctt

SEQ ID NO: 406807 - DNA, 25 bp, Homo sapien
gtgatttttgtctgttcttttactg

SEQ ID NO: 406808 - DNA, 25 bp, Homo sapien
tgagataggtcaaaattttaattct

SEQ ID NO: 406809 - DNA, 25 bp, Homo sapien
ttttaattctcccactattaatcct

SEQ ID NO: 406810 - DNA, 25 bp, Homo sapien
tttaattctcccactattaatcctc

SEQ ID NO: 406811 - DNA, 25 bp, Homo sapien
ttaattctcccactattaatcctca

SEQ ID NO: 406812 - DNA, 25 bp, Homo sapien
taattctcccactattaatcctcaa

SEQ ID NO: 406813 - DNA, 25 bp, Homo sapien
tgtggtttgtcagctatgcccaagg

SEQ ID NO: 406814 - DNA, 25 bp, Homo sapien
ctatgcccaagggtagggtcacata

SEQ ID NO: 406815 - DNA, 25 bp, Homo sapien
gggtcacatagtacagaggactttt

SEQ ID NO: 406816 - DNA, 25 bp, Homo sapien
ggacttttcgttccaagggctacag

SEQ ID NO: 406817 - DNA, 25 bp, Homo sapien
aagggctacaggcaggactgtttat

SEQ ID NO: 406818 - DNA, 25 bp, Homo sapien
gcaggaaaaggttcctcaacaagga

SEQ ID NO: 406819 - DNA, 25 bp, Homo sapien
agacaaacaatactgctggtgcaaa

SEQ ID NO: 406820 - DNA, 25 bp, Homo sapien
ggtaaaactcctctatgtgggcaga

SEQ ID NO: 406821 - DNA, 25 bp, Homo sapien
tttgctactagccagtcttttgatt

SEQ ID NO: 406822 - DNA, 25 bp, Homo sapien
cagtcttttgattgcatcctcacaa

SEQ ID NO: 406823 - DNA, 25 bp, Homo sapien
ttgattgcatcctcacaagttaggg

SEQ ID NO: 406824 - DNA, 25 bp, Homo sapien
ggaaaacaagcctgcttctggctaa

SEQ ID NO: 406825 - DNA, 25 bp, Homo sapien
aaacaagcctgcttctggctaatcc

SEQ ID NO: 406826 - DNA, 25 bp, Homo sapien
gtcctcaggaattagcactattatc

SEQ ID NO: 406827 - DNA, 25 bp, Homo sapien
gaattagcactattatccatgggag

SEQ ID NO: 406828 - DNA, 25 bp, Homo sapien
attagcactattatccatgggaggg

SEQ ID NO: 406829 - DNA, 25 bp, Homo sapien
tagcactattatccatgggagggaa

SEQ ID NO: 406830 - DNA, 25 bp, Homo sapien
aaggtttattgggtctgcaggccaa

SEQ ID NO: 406831 - DNA, 25 bp, Homo sapien
tttattgggtctgcaggccaaggcc

SEQ ID NO: 406832 - DNA, 25 bp, Homo sapien
attgggtctgcaggccaaggcccat

SEQ ID NO: 406833 - DNA, 25 bp, Homo sapien
ggtctgcaggccaaggcccattttt

SEQ ID NO: 406834 - DNA, 25 bp, Homo sapien
caaaactcatctcagcacggggatg

SEQ ID NO: 406835 - DNA, 25 bp, Homo sapien
tttctgcttgacctcgagttacaga

SEQ ID NO: 406836 - DNA, 25 bp, Homo sapien
tgagcttcacaccttgggtcagatg

SEQ ID NO: 406837 - DNA, 25 bp, Homo sapien
cacgtacgtctgagcgggcccagca

SEQ ID NO: 406838 - DNA, 25 bp, Homo sapien
tgagcgggcccagcacagctgttct

SEQ ID NO: 406839 - DNA, 25 bp, Homo sapien
tctccagggcaaggcttggccatgg

SEQ ID NO: 406840 - DNA, 25 bp, Homo sapien
cagtccagtccgtggtgctcagatc

SEQ ID NO: 406841 - DNA, 25 bp, Homo sapien
atgtgtgttgtcagctgagaaactg

SEQ ID NO: 406842 - DNA, 25 bp, Homo sapien
gaaactgagctgcattcttgagcat

SEQ ID NO: 406843 - DNA, 25 bp, Homo sapien
attcttgagcatgagccagacgcct

SEQ ID NO: 406844 - DNA, 25 bp, Homo sapien
gcatgagccagacgccttgacagat

SEQ ID NO: 406845 - DNA, 25 bp, Homo sapien
gccttgacagatggttattcttttc

SEQ ID NO: 406846 - DNA, 25 bp, Homo sapien
caacggcgctggtggaggacacact

SEQ ID NO: 406847 - DNA, 25 bp, Homo sapien
aggacacactcacggaaatctcgga

SEQ ID NO: 406848 - DNA, 25 bp, Homo sapien
ctcacggaaatctcggagtggctgg

SEQ ID NO: 406849 - DNA, 25 bp, Homo sapien
ggcatccacgcgaggtggtcatcct

SEQ ID NO: 406850 - DNA, 25 bp, Homo sapien
aggtggtcatcctggcctgcagaaa

SEQ ID NO: 406851 - DNA, 25 bp, Homo sapien
tgagcgaggacctgcacgagtacct

SEQ ID NO: 406852 - DNA, 25 bp, Homo sapien
gtacctggtcgcctgtatcaagaac

SEQ ID NO: 406853 - DNA, 25 bp, Homo sapien
cgacactgcggcagctgtggtcccg

SEQ ID NO: 406854 - DNA, 25 bp, Homo sapien
aacaggtcatcgtctcctatgaaga

SEQ ID NO: 406855 - DNA, 25 bp, Homo sapien
atgaagacgagagctccttgcgccg

SEQ ID NO: 406856 - DNA, 25 bp, Homo sapien
acgagctgtggccaggagtccccta

SEQ ID NO: 406857 - DNA, 25 bp, Homo sapien
aagtgcctaagtttaaggctctcat

SEQ ID NO: 406858 - DNA, 25 bp, Homo sapien
aggctctcatataataactcttaat

SEQ ID NO: 406859 - DNA, 25 bp, Homo sapien
agaacaaactcttgccttgaattaa

SEQ ID NO: 406860 - DNA, 25 bp, Homo sapien
cttgccttgaattaaccagttattt

SEQ ID NO: 406861 - DNA, 25 bp, Homo sapien
atagacttctgtcattagaggaaac

SEQ ID NO: 406862 - DNA, 25 bp, Homo sapien
gaggaaacggcctgaactccattac

SEQ ID NO: 406863 - DNA, 25 bp, Homo sapien
gaactccattaccaggtgacttttt

SEQ ID NO: 406864 - DNA, 25 bp, Homo sapien
ccattaccaggtgactttttagctt

SEQ ID NO: 406865 - DNA, 25 bp, Homo sapien
ctttttagctttagtgggtggcaca

SEQ ID NO: 406866 - DNA, 25 bp, Homo sapien
cacatgggactgtctgtggtgtgcc

SEQ ID NO: 406867 - DNA, 25 bp, Homo sapien
actgtctgtggtgtgccatctgcag

SEQ ID NO: 406868 - DNA, 25 bp, Homo sapien
aataacatgcttttatctggagcta

SEQ ID NO: 406869 - DNA, 25 bp, Homo sapien
tgcttttatctggagctatttaatt

SEQ ID NO: 406870 - DNA, 25 bp, Homo sapien
tttactgctcagtcaataactcaac

SEQ ID NO: 406871 - DNA, 25 bp, Homo sapien
gctcagtcaataactcaacacttaa

SEQ ID NO: 406872 - DNA, 25 bp, Homo sapien
caacacttaatgtgattattgacaa

SEQ ID NO: 406873 - DNA, 25 bp, Homo sapien
tttgcatttgtatatggagtcctta

SEQ ID NO: 406874 - DNA, 25 bp, Homo sapien
atatggagtccttagagttgaggaa

SEQ ID NO: 406875 - DNA, 25 bp, Homo sapien
gttgaggaagatattttctggattt

SEQ ID NO: 406876 - DNA, 25 bp, Homo sapien
aacttttcaaggttgatcttggcat

SEQ ID NO: 406877 - DNA, 25 bp, Homo sapien
tgatcttggcatgttgttttgcaga

SEQ ID NO: 406878 - DNA, 25 bp, Homo sapien
gaattgtgtttgtatttagcttgta

SEQ ID NO: 406879 - DNA, 25 bp, Homo sapien
actaagccttaaagttgagcagaaa

SEQ ID NO: 406880 - DNA, 25 bp, Homo sapien
gatggttatacgacttcagtgctct

SEQ ID NO: 406881 - DNA, 25 bp, Homo sapien
gatttctctctctagtgatctctgc

SEQ ID NO: 406882 - DNA, 25 bp, Homo sapien
ctctagtgatctctgcttaatgcaa

SEQ ID NO: 406883 - DNA, 25 bp, Homo sapien
tctgcttaatgcaaaaactgccatg

SEQ ID NO: 406884 - DNA, 25 bp, Homo sapien
atacgacttcagtgctctggtacag

SEQ ID NO: 406885 - DNA, 25 bp, Homo sapien
ttcagtgctctggtacagtgagaat

SEQ ID NO: 406886 - DNA, 25 bp, Homo sapien
aaatagtttgttctgtattttgcag

SEQ ID NO: 406887 - DNA, 25 bp, Homo sapien
ctttggctcaggataggagtgtaca

SEQ ID NO: 406888 - DNA, 25 bp, Homo sapien
ataggagtgtacagttataaccaac

SEQ ID NO: 406889 - DNA, 25 bp, Homo sapien
gtacagttataaccaactaagcctt

SEQ ID NO: 406890 - DNA, 25 bp, Homo sapien
agcgccgacgcgtgcaactgatgcg

SEQ ID NO: 406891 - DNA, 25 bp, Homo sapien
gcgccgacgcgtgcaactgatgcgg

SEQ ID NO: 406892 - DNA, 25 bp, Homo sapien
cgccgacgcgtgcaactgatgcgga

SEQ ID NO: 406893 - DNA, 25 bp, Homo sapien
gccgacgcgtgcaactgatgcggat

SEQ ID NO: 406894 - DNA, 25 bp, Homo sapien
ccgacgcgtgcaactgatgcggatt

SEQ ID NO: 406895 - DNA, 25 bp, Homo sapien
cgacgcgtgcaactgatgcggattc

SEQ ID NO: 406896 - DNA, 25 bp, Homo sapien
gacgcgtgcaactgatgcggattcg

SEQ ID NO: 406897 - DNA, 25 bp, Homo sapien
acgcgtgcaactgatgcggattcgg

SEQ ID NO: 406898 - DNA, 25 bp, Homo sapien
cgcgtgcaactgatgcggattcggc

SEQ ID NO: 406899 - DNA, 25 bp, Homo sapien
gcgtgcaactgatgcggattcggca

SEQ ID NO: 406900 - DNA, 25 bp, Homo sapien
cgtgcaactgatgcggattcggcag

SEQ ID NO: 406901 - DNA, 25 bp, Homo sapien
ttagggctttaacatgggaatttga

SEQ ID NO: 406902 - DNA, 25 bp, Homo sapien
agaccattcccccagtaaatcactt

SEQ ID NO: 406903 - DNA, 25 bp, Homo sapien
attcccccagtaaatcactttcaca

SEQ ID NO: 406904 - DNA, 25 bp, Homo sapien
aggacacgcagactccaccctcttg

SEQ ID NO: 406905 - DNA, 25 bp, Homo sapien
tccctctgggcaagcaggcccctgg

SEQ ID NO: 406906 - DNA, 25 bp, Homo sapien
tcatttaccttaatcacctctgaaa

SEQ ID NO: 406907 - DNA, 25 bp, Homo sapien
tttaccttaatcacctctgaaagac

SEQ ID NO: 406908 - DNA, 25 bp, Homo sapien
cttaatcacctctgaaagaccttgt

SEQ ID NO: 406909 - DNA, 25 bp, Homo sapien
aatcacctctgaaagaccttgtctc

SEQ ID NO: 406910 - DNA, 25 bp, Homo sapien
tcacctctgaaagaccttgtctcaa

SEQ ID NO: 406911 - DNA, 25 bp, Homo sapien
aaacagccacattctggggcactga

SEQ ID NO: 406912 - DNA, 25 bp, Homo sapien
acatggccacccatggagggcctgt

SEQ ID NO: 406913 - DNA, 25 bp, Homo sapien
actgtatacaagcaccaagaagaat

SEQ ID NO: 406914 - DNA, 25 bp, Homo sapien
ttagcgtgggcactcacacggagct

SEQ ID NO: 406915 - DNA, 25 bp, Homo sapien
tcacacggagctgccacttgtagtt

SEQ ID NO: 406916 - DNA, 25 bp, Homo sapien
gccacttgtagtttctacgaagctc

SEQ ID NO: 406917 - DNA, 25 bp, Homo sapien
gggctctccgctctgttttaaaaag

SEQ ID NO: 406918 - DNA, 25 bp, Homo sapien
gcaatatcagtcacaatggtaacaa

SEQ ID NO: 406919 - DNA, 25 bp, Homo sapien
caagagaatttctaaagcatctgct

SEQ ID NO: 406920 - DNA, 25 bp, Homo sapien
gccagagtcctcagatgaatgccct

SEQ ID NO: 406921 - DNA, 25 bp, Homo sapien
gaatgccctggctgtaatgagcagt

SEQ ID NO: 406922 - DNA, 25 bp, Homo sapien
agcagtaggcactgtcacatggcca

SEQ ID NO: 406923 - DNA, 25 bp, Homo sapien
tcatccaagacccagcttcattgtc

SEQ ID NO: 406924 - DNA, 25 bp, Homo sapien
catccaagacccagcttcattgtct

SEQ ID NO: 406925 - DNA, 25 bp, Homo sapien
agcttcattgtctccatctctggga

SEQ ID NO: 406926 - DNA, 25 bp, Homo sapien
gcttcattgtctccatctctgggaa

SEQ ID NO: 406927 - DNA, 25 bp, Homo sapien
ttcattgtctccatctctgggaagc

SEQ ID NO: 406928 - DNA, 25 bp, Homo sapien
cctgcatactccaggcagaaccaat

SEQ ID NO: 406929 - DNA, 25 bp, Homo sapien
gcatactccaggcagaaccaatcct

SEQ ID NO: 406930 - DNA, 25 bp, Homo sapien
atactccaggcagaaccaatccttt

SEQ ID NO: 406931 - DNA, 25 bp, Homo sapien
tactccaggcagaaccaatcctttc

SEQ ID NO: 406932 - DNA, 25 bp, Homo sapien
aggcagaaccaatcctttcctccat

SEQ ID NO: 406933 - DNA, 25 bp, Homo sapien
gcagaaccaatcctttcctccataa

SEQ ID NO: 406934 - DNA, 25 bp, Homo sapien
gtgccagattatttggccctagcca

SEQ ID NO: 406935 - DNA, 25 bp, Homo sapien
aaaagcaagccagcgtttcttccct

SEQ ID NO: 406936 - DNA, 25 bp, Homo sapien
tctgcactgacttcctaaggtttct

SEQ ID NO: 406937 - DNA, 25 bp, Homo sapien
ttctccccatttgcacatctaggtg

SEQ ID NO: 406938 - DNA, 25 bp, Homo sapien
ttgcacatctaggtgctgggtctct

SEQ ID NO: 406939 - DNA, 25 bp, Homo sapien
ggccttgtgacctttccacataata

SEQ ID NO: 406940 - DNA, 25 bp, Homo sapien
caggtacttgaaaccctaacaggat

SEQ ID NO: 406941 - DNA, 25 bp, Homo sapien
aggatgagcagaggccacactccag

SEQ ID NO: 406942 - DNA, 25 bp, Homo sapien
ggatggcctgacagcttacagtcgt

SEQ ID NO: 406943 - DNA, 25 bp, Homo sapien
gacagcttacagtcgtttctgcctg

SEQ ID NO: 406944 - DNA, 25 bp, Homo sapien
agtgcttttgaaatgcaccttcttc

SEQ ID NO: 406945 - DNA, 25 bp, Homo sapien
atattcctatgcagttaactacatt

SEQ ID NO: 406946 - DNA, 25 bp, Homo sapien
tgcagttaactacattctacaatat

SEQ ID NO: 406947 - DNA, 25 bp, Homo sapien
gtatgaattgccacaactattttaa

SEQ ID NO: 406948 - DNA, 25 bp, Homo sapien
aagttttatgccatccagcttttta

SEQ ID NO: 406949 - DNA, 25 bp, Homo sapien
tgtatctttcagtacaccctgtggt

SEQ ID NO: 406950 - DNA, 25 bp, Homo sapien
acaccctgtggtttaatacaagact

SEQ ID NO: 406951 - DNA, 25 bp, Homo sapien
gactaagtaactgctgtctgtgtta

SEQ ID NO: 406952 - DNA, 25 bp, Homo sapien
gctgtctgtgttagtttatcctaca

SEQ ID NO: 406953 - DNA, 25 bp, Homo sapien
aactaagaatggcttctacagttct

SEQ ID NO: 406954 - DNA, 25 bp, Homo sapien
gggtgggacgtcaacaaagaatatt

SEQ ID NO: 406955 - DNA, 25 bp, Homo sapien
gaaattcagatatcagtgcctatga

SEQ ID NO: 406956 - DNA, 25 bp, Homo sapien
actgtctgagtctccatagtgagga

SEQ ID NO: 406957 - DNA, 25 bp, Homo sapien
atagtgaggaatggtcttccctggg

SEQ ID NO: 406958 - DNA, 25 bp, Homo sapien
tttccctggcttgcccaattatcaa

SEQ ID NO: 406959 - DNA, 25 bp, Homo sapien
gcatcaccctagaaggatgggctca

SEQ ID NO: 406960 - DNA, 25 bp, Homo sapien
aaagtcgccctccacgtgggtgcac

SEQ ID NO: 406961 - DNA, 25 bp, Homo sapien
tgcacaggagcccagattctcaagc

SEQ ID NO: 406962 - DNA, 25 bp, Homo sapien
tctcaagccccagttgcagaattag

SEQ ID NO: 406963 - DNA, 25 bp, Homo sapien
aagagtcctcctaaaagtccatcac

SEQ ID NO: 406964 - DNA, 25 bp, Homo sapien
tggttagcaacccttgccacatgat

SEQ ID NO: 406965 - DNA, 25 bp, Homo sapien
aacccagtctttgacactcctgtgt

SEQ ID NO: 406966 - DNA, 25 bp, Homo sapien
ggagcagcgtgcactgtctgagtct

SEQ ID NO: 406967 - DNA, 25 bp, Homo sapien
acagtcttcctcctggttctaactt

SEQ ID NO: 406968 - DNA, 25 bp, Homo sapien
tcttcctcctggttctaacttttct

SEQ ID NO: 406969 - DNA, 25 bp, Homo sapien
tctaacttttctatgacagcaggag

SEQ ID NO: 406970 - DNA, 25 bp, Homo sapien
ttctatgacagcaggagattttcaa

SEQ ID NO: 406971 - DNA, 25 bp, Homo sapien
ggagattttcaagagatttattcag

SEQ ID NO: 406972 - DNA, 25 bp, Homo sapien
tattcagaatgcaatacctgggact

SEQ ID NO: 406973 - DNA, 25 bp, Homo sapien
gtttcttcatagacacagctcacaa

SEQ ID NO: 406974 - DNA, 25 bp, Homo sapien
atagacacagctcacaatgtaattg

SEQ ID NO: 406975 - DNA, 25 bp, Homo sapien
aatataaactttatccttggatcca

SEQ ID NO: 406976 - DNA, 25 bp, Homo sapien
tccttggatccatcagtttagcaat

SEQ ID NO: 406977 - DNA, 25 bp, Homo sapien
gatccatcagtttagcaataaccgg

SEQ ID NO: 406978 - DNA, 25 bp, Homo sapien
gggatacacggtatctcacttctcc

SEQ ID NO: 406979 - DNA, 25 bp, Homo sapien
tatcaacagtcatggagggcttacc

SEQ ID NO: 406980 - DNA, 25 bp, Homo sapien
caacagtcatggagggcttaccatc

SEQ ID NO: 406981 - DNA, 25 bp, Homo sapien
gagggcttaccatctttgggacatt

SEQ ID NO: 406982 - DNA, 25 bp, Homo sapien
gggcttaccatctttgggacattca

SEQ ID NO: 406983 - DNA, 25 bp, Homo sapien
ggcttaccatctttgggacattcat

SEQ ID NO: 406984 - DNA, 25 bp, Homo sapien
tttgggacattcatttaggatctga

SEQ ID NO: 406985 - DNA, 25 bp, Homo sapien
gggacattcatttaggatctgaaga

SEQ ID NO: 406986 - DNA, 25 bp, Homo sapien
gatctgaagataaaaaggctgcttg

SEQ ID NO: 406987 - DNA, 25 bp, Homo sapien
aaaaaggctgcttgttagaggcgtt

SEQ ID NO: 406988 - DNA, 25 bp, Homo sapien
ctgcttgttagaggcgttggctttc

SEQ ID NO: 406989 - DNA, 25 bp, Homo sapien
gaaagagacttcttcaagaccagat

SEQ ID NO: 406990 - DNA, 25 bp, Homo sapien
gagattgcagagatattgtgtaaca

SEQ ID NO: 406991 - DNA, 25 bp, Homo sapien
aacattggtgtcaaactgtctgatg

SEQ ID NO: 406992 - DNA, 25 bp, Homo sapien
aaatgtatggaatcttgcatcaaaa

SEQ ID NO: 406993 - DNA, 25 bp, Homo sapien
gcatcaaaaaagcatcacagaggag

SEQ ID NO: 406994 - DNA, 25 bp, Homo sapien
ccgaattcgtcgcatcagtgacaga

SEQ ID NO: 406995 - DNA, 25 bp, Homo sapien
gaaatgttctagatgagctacggca

SEQ ID NO: 406996 - DNA, 25 bp, Homo sapien
agctacggcatgcagaccggatcaa

SEQ ID NO: 406997 - DNA, 25 bp, Homo sapien
tcgtcgcatcagtgacagaactaat

SEQ ID NO: 406998 - DNA, 25 bp, Homo sapien
actactatatcctaccatttttgcc

SEQ ID NO: 406999 - DNA, 25 bp, Homo sapien
tatatcctaccatttttgcccggaa

SEQ ID NO: 407000 - DNA, 25 bp, Homo sapien
ataagtagccgcctggttactgtgt

SEQ ID NO: 407001 - DNA, 25 bp, Homo sapien
cgcctggttactgtgtcctgtaaaa

SEQ ID NO: 407002 - DNA, 25 bp, Homo sapien
aaaatacagacacttgacccttggt

SEQ ID NO: 407003 - DNA, 25 bp, Homo sapien
gacccttggtgtagcttctgttcaa

SEQ ID NO: 407004 - DNA, 25 bp, Homo sapien
ttggtgtagcttctgttcaacttta

SEQ ID NO: 407005 - DNA, 25 bp, Homo sapien
gttcaactttatatcacgggaatgg

SEQ ID NO: 407006 - DNA, 25 bp, Homo sapien
aatggatgggtctgatttcttggcc

SEQ ID NO: 407007 - DNA, 25 bp, Homo sapien
atttcttggccctcttcttgaattg

SEQ ID NO: 407008 - DNA, 25 bp, Homo sapien
gaattggccatatacagggtccctg

SEQ ID NO: 407009 - DNA, 25 bp, Homo sapien
gtggactgaaggctttgtctaagat

SEQ ID NO: 407010 - DNA, 25 bp, Homo sapien
gtctaagatgacaagggtcagctca

SEQ ID NO: 407011 - DNA, 25 bp, Homo sapien
ttttggccaggtgtagggggcacgc

SEQ ID NO: 407012 - DNA, 25 bp, Homo sapien
ttggccaggtgtagggggcacgcca

SEQ ID NO: 407013 - DNA, 25 bp, Homo sapien
tggccaggtgtagggggcacgccag

SEQ ID NO: 407014 - DNA, 25 bp, Homo sapien
ggccaggtgtagggggcacgccagt

SEQ ID NO: 407015 - DNA, 25 bp, Homo sapien
gccaggtgtagggggcacgccagta

SEQ ID NO: 407016 - DNA, 25 bp, Homo sapien
ccaggtgtagggggcacgccagtaa

SEQ ID NO: 407017 - DNA, 25 bp, Homo sapien
caggtgtagggggcacgccagtaat

SEQ ID NO: 407018 - DNA, 25 bp, Homo sapien
aggtgtagggggcacgccagtaatc

SEQ ID NO: 407019 - DNA, 25 bp, Homo sapien
ggtgtagggggcacgccagtaatcc

SEQ ID NO: 407020 - DNA, 25 bp, Homo sapien
gtgtagggggcacgccagtaatccc

SEQ ID NO: 407021 - DNA, 25 bp, Homo sapien
ggaatgttccgttgatgctgcgcac

SEQ ID NO: 407022 - DNA, 25 bp, Homo sapien
ttgatgctgcgcactgcagggagcc

SEQ ID NO: 407023 - DNA, 25 bp, Homo sapien
cagggagcctacgttcatgggcctc

SEQ ID NO: 407024 - DNA, 25 bp, Homo sapien
cccttccctggatagatggtacatg

SEQ ID NO: 407025 - DNA, 25 bp, Homo sapien
ggtacatgtcataggagctccggga

SEQ ID NO: 407026 - DNA, 25 bp, Homo sapien
aaggtcacattctctcctgcctgaa

SEQ ID NO: 407027 - DNA, 25 bp, Homo sapien
gacagaaacaagcagtggatcactc

SEQ ID NO: 407028 - DNA, 25 bp, Homo sapien
ggatcactcgagtttgaccactcgt

SEQ ID NO: 407029 - DNA, 25 bp, Homo sapien
accactcgtagggagcgtcacggaa

SEQ ID NO: 407030 - DNA, 25 bp, Homo sapien
gtcacggaaagagccgaagcatctg

SEQ ID NO: 407031 - DNA, 25 bp, Homo sapien
gaagcatctgtaggtccctccgtgg

SEQ ID NO: 407032 - DNA, 25 bp, Homo sapien
aacaaagccataggccagagggcgg

SEQ ID NO: 407033 - DNA, 25 bp, Homo sapien
ggcactgtgggtggctcaccctaga

SEQ ID NO: 407034 - DNA, 25 bp, Homo sapien
tgtgggtggctcaccctagattgtg

SEQ ID NO: 407035 - DNA, 25 bp, Homo sapien
gtggctcaccctagattgtggccca

SEQ ID NO: 407036 - DNA, 25 bp, Homo sapien
gctcaccctagattgtggcccagat

SEQ ID NO: 407037 - DNA, 25 bp, Homo sapien
tcaccctagattgtggcccagatct

SEQ ID NO: 407038 - DNA, 25 bp, Homo sapien
accctagattgtggcccagatctca

SEQ ID NO: 407039 - DNA, 25 bp, Homo sapien
ctgccttcagggtcatccaaaagtg

SEQ ID NO: 407040 - DNA, 25 bp, Homo sapien
gccttcagggtcatccaaaagtgga

SEQ ID NO: 407041 - DNA, 25 bp, Homo sapien
agggtcatccaaaagtggaccttgg

SEQ ID NO: 407042 - DNA, 25 bp, Homo sapien
gtgtctgtggagtgcatgactcagc

SEQ ID NO: 407043 - DNA, 25 bp, Homo sapien
gatactgccattatctcctgatgaa

SEQ ID NO: 407044 - DNA, 25 bp, Homo sapien
ttaccccatcatacgatttctgcag

SEQ ID NO: 407045 - DNA, 25 bp, Homo sapien
gatttctgcagatcttacaggagca

SEQ ID NO: 407046 - DNA, 25 bp, Homo sapien
gaatttacttctttgtcatttggag

SEQ ID NO: 407047 - DNA, 25 bp, Homo sapien
acaggagcaatctgagctcaagcaa

SEQ ID NO: 407048 - DNA, 25 bp, Homo sapien
ttaattactgtttcatttgtccatt

SEQ ID NO: 407049 - DNA, 25 bp, Homo sapien
tccatttgtctgtgtataatcatgt

SEQ ID NO: 407050 - DNA, 25 bp, Homo sapien
atgatcttctattttctatggtttg

SEQ ID NO: 407051 - DNA, 25 bp, Homo sapien
gtgcacagtattattatgaacagag

SEQ ID NO: 407052 - DNA, 25 bp, Homo sapien
gagaagagctgtatgaaaactgatc

SEQ ID NO: 407053 - DNA, 25 bp, Homo sapien
aactgatcttccagcatctatcatc

SEQ ID NO: 407054 - DNA, 25 bp, Homo sapien
agctggtccccagagtgtaaaggag

SEQ ID NO: 407055 - DNA, 25 bp, Homo sapien
gctggtccccagagtgtaaaggagt

SEQ ID NO: 407056 - DNA, 25 bp, Homo sapien
ctggtccccagagtgtaaaggagtt

SEQ ID NO: 407057 - DNA, 25 bp, Homo sapien
tggtccccagagtgtaaaggagtta

SEQ ID NO: 407058 - DNA, 25 bp, Homo sapien
ggtccccagagtgtaaaggagttag

SEQ ID NO: 407059 - DNA, 25 bp, Homo sapien
gtccccagagtgtaaaggagttagg

SEQ ID NO: 407060 - DNA, 25 bp, Homo sapien
taaaggagttaggatgttggcagga

SEQ ID NO: 407061 - DNA, 25 bp, Homo sapien
caggaggaaggatgtgtcgccggat

SEQ ID NO: 407062 - DNA, 25 bp, Homo sapien
gaggaaggatgtgtcgccggatgag

SEQ ID NO: 407063 - DNA, 25 bp, Homo sapien
atgtgtcgccggatgaggaaaagaa

SEQ ID NO: 407064 - DNA, 25 bp, Homo sapien
gaaagaatagggaaatttggatgca

SEQ ID NO: 407065 - DNA, 25 bp, Homo sapien
ggagctgctacctgtccttctagaa

SEQ ID NO: 407066 - DNA, 25 bp, Homo sapien
tgtccttctagaagccacggtctgg

SEQ ID NO: 407067 - DNA, 25 bp, Homo sapien
agccacggtctggacaaactttctc

SEQ ID NO: 407068 - DNA, 25 bp, Homo sapien
agtttcacctccacaggcatcgctt

SEQ ID NO: 407069 - DNA, 25 bp, Homo sapien
aggcatcgcttcatactcctcactg

SEQ ID NO: 407070 - DNA, 25 bp, Homo sapien
tcactgtcaatgctaaaagagcccc

SEQ ID NO: 407071 - DNA, 25 bp, Homo sapien
agaacagctcaaacacatcagtggc

SEQ ID NO: 407072 - DNA, 25 bp, Homo sapien
aaacacatcagtggcctactggagt

SEQ ID NO: 407073 - DNA, 25 bp, Homo sapien
gcctactggagttggaggtctcaca

SEQ ID NO: 407074 - DNA, 25 bp, Homo sapien
tcacagcagcaccagaagaagttca

SEQ ID NO: 407075 - DNA, 25 bp, Homo sapien
ttatggaaaacaacatcctctcttg

SEQ ID NO: 407076 - DNA, 25 bp, Homo sapien
tgggaaacaaatttcgtgttgccct

SEQ ID NO: 407077 - DNA, 25 bp, Homo sapien
ggaaacaaatttcgtgttgccctag

SEQ ID NO: 407078 - DNA, 25 bp, Homo sapien
gaaacaaatttcgtgttgccctagg

SEQ ID NO: 407079 - DNA, 25 bp, Homo sapien
acaaatttcgtgttgccctaggtct

SEQ ID NO: 407080 - DNA, 25 bp, Homo sapien
caaatttcgtgttgccctaggtctt

SEQ ID NO: 407081 - DNA, 25 bp, Homo sapien
atttcgtgttgccctaggtcttcct

SEQ ID NO: 407082 - DNA, 25 bp, Homo sapien
aggtcttcctgggatatggggacaa

SEQ ID NO: 407083 - DNA, 25 bp, Homo sapien
aatacagtaagaataatccttccca

SEQ ID NO: 407084 - DNA, 25 bp, Homo sapien
tacagtaagaataatccttcccaat

SEQ ID NO: 407085 - DNA, 25 bp, Homo sapien
cttcttgccccaaataaagatgaac

SEQ ID NO: 407086 - DNA, 25 bp, Homo sapien
ttcttgccccaaataaagatgaact

SEQ ID NO: 407087 - DNA, 25 bp, Homo sapien
acaggacatctcttgtagggtgttt

SEQ ID NO: 407088 - DNA, 25 bp, Homo sapien
tctcttgtagggtgttttgatcttc

SEQ ID NO: 407089 - DNA, 25 bp, Homo sapien
tagggtgttttgatcttcccgggca

SEQ ID NO: 407090 - DNA, 25 bp, Homo sapien
gggtgttttgatcttcccgggcatc

SEQ ID NO: 407091 - DNA, 25 bp, Homo sapien
aatgctcagaaagcaaccacctgct

SEQ ID NO: 407092 - DNA, 25 bp, Homo sapien
tcccgggcatctttattgctaccaa

SEQ ID NO: 407093 - DNA, 25 bp, Homo sapien
attgctaccaacttaatagtgtttc

SEQ ID NO: 407094 - DNA, 25 bp, Homo sapien
accaacttaatagtgtttcagcaaa

SEQ ID NO: 407095 - DNA, 25 bp, Homo sapien
aatgtttatgaagctccatctgtag

SEQ ID NO: 407096 - DNA, 25 bp, Homo sapien
atgaagctccatctgtaggtgccag

SEQ ID NO: 407097 - DNA, 25 bp, Homo sapien
agaaagcaaccacctgctaggcaac

SEQ ID NO: 407098 - DNA, 25 bp, Homo sapien
tatatggctatatccaagaatatcc

SEQ ID NO: 407099 - DNA, 25 bp, Homo sapien
ggctatatccaagaatatccaagat

SEQ ID NO: 407100 - DNA, 25 bp, Homo sapien
gtatgtttactcctatcactgtgca

SEQ ID NO: 407101 - DNA, 25 bp, Homo sapien
atgtttactcctatcactgtgcatg

SEQ ID NO: 407102 - DNA, 25 bp, Homo sapien
gtttactcctatcactgtgcatgca

SEQ ID NO: 407103 - DNA, 25 bp, Homo sapien
actcctatcactgtgcatgcataga

SEQ ID NO: 407104 - DNA, 25 bp, Homo sapien
gtgcatgcatagatgatttcccgaa

SEQ ID NO: 407105 - DNA, 25 bp, Homo sapien
gatttcccgaaagatattcaaacaa

SEQ ID NO: 407106 - DNA, 25 bp, Homo sapien
ggaaataatctagatgttcatcaat

SEQ ID NO: 407107 - DNA, 25 bp, Homo sapien
gatgttcatcaataatagtctgttt

SEQ ID NO: 407108 - DNA, 25 bp, Homo sapien
gaattaaatacaacgcagacatttt

SEQ ID NO: 407109 - DNA, 25 bp, Homo sapien
gattgcttctaatattcctttgcag

SEQ ID NO: 407110 - DNA, 25 bp, Homo sapien
tcctttgcagttttaacacagctta

SEQ ID NO: 407111 - DNA, 25 bp, Homo sapien
acagcttataagttcacctgacata

SEQ ID NO: 407112 - DNA, 25 bp, Homo sapien
cctgacatattttttggtgctgatt

SEQ ID NO: 407113 - DNA, 25 bp, Homo sapien
ggtgctgattttgtcacttaacatg

SEQ ID NO: 407114 - DNA, 25 bp, Homo sapien
ttaacatgacttcaccaaatggttt

SEQ ID NO: 407115 - DNA, 25 bp, Homo sapien
ggtttcatcagatagtttccctctg

SEQ ID NO: 407116 - DNA, 25 bp, Homo sapien
atcagatagtttccctctgtccatc

SEQ ID NO: 407117 - DNA, 25 bp, Homo sapien
atttcattctgttactcttccttac

SEQ ID NO: 407118 - DNA, 25 bp, Homo sapien
tcttccttaccgtaccataatctga

SEQ ID NO: 407119 - DNA, 25 bp, Homo sapien
atcatcaccgtcgttactgttatat

SEQ ID NO: 407120 - DNA, 25 bp, Homo sapien
cagaggagctgaactgtgccctgta

SEQ ID NO: 407121 - DNA, 25 bp, Homo sapien
gagctgaactgtgccctgtagagac

SEQ ID NO: 407122 - DNA, 25 bp, Homo sapien
aactgtgccctgtagagaccagttc

SEQ ID NO: 407123 - DNA, 25 bp, Homo sapien
ttctcgcctccgaccggtctgtgtg

SEQ ID NO: 407124 - DNA, 25 bp, Homo sapien
gatggtcccttttgagaagagggtt

SEQ ID NO: 407125 - DNA, 25 bp, Homo sapien
gttgttttcgagtcgggccacagtc

SEQ ID NO: 407126 - DNA, 25 bp, Homo sapien
gggaaggccatgtcctttctcccct

SEQ ID NO: 407127 - DNA, 25 bp, Homo sapien
gaattattcccaagtgcacaaggga

SEQ ID NO: 407128 - DNA, 25 bp, Homo sapien
agtgcacaagggacaggctcgattt

SEQ ID NO: 407129 - DNA, 25 bp, Homo sapien
gggacaggctcgatttcttggaaat

SEQ ID NO: 407130 - DNA, 25 bp, Homo sapien
caggctcgatttcttggaaatcctg

SEQ ID NO: 407131 - DNA, 25 bp, Homo sapien
tggttttatcctgaaaaaggtgtat

SEQ ID NO: 407132 - DNA, 25 bp, Homo sapien
ttagggcactgttaacaatgcgagt

SEQ ID NO: 407133 - DNA, 25 bp, Homo sapien
aaccaagatggtgcaagttcccttt

SEQ ID NO: 407134 - DNA, 25 bp, Homo sapien
aagatggtgcaagttccctttgcag

SEQ ID NO: 407135 - DNA, 25 bp, Homo sapien
gatggtgcaagttccctttgcagat

SEQ ID NO: 407136 - DNA, 25 bp, Homo sapien
ggtgcaagttccctttgcagatggc

SEQ ID NO: 407137 - DNA, 25 bp, Homo sapien
gcaagttccctttgcagatggcgtg

SEQ ID NO: 407138 - DNA, 25 bp, Homo sapien
attatgagtgaatgtaatctttctg

SEQ ID NO: 407139 - DNA, 25 bp, Homo sapien
cagagttacagcaattacctgaaaa

SEQ ID NO: 407140 - DNA, 25 bp, Homo sapien
cagcaattacctgaaaagtttccta

SEQ ID NO: 407141 - DNA, 25 bp, Homo sapien
agttgtcctcaagagacaacaggtt

SEQ ID NO: 407142 - DNA, 25 bp, Homo sapien
aaaatggtgcgttctgcttcttgta

SEQ ID NO: 407143 - DNA, 25 bp, Homo sapien
tctgcttcttgtaattcatctctgc

SEQ ID NO: 407144 - DNA, 25 bp, Homo sapien
ggatggtttctataaacaagggact

SEQ ID NO: 407145 - DNA, 25 bp, Homo sapien
aagggactataattcttgtacatta

SEQ ID NO: 407146 - DNA, 25 bp, Homo sapien
gtttctttgagcagtctaatgtgcc

SEQ ID NO: 407147 - DNA, 25 bp, Homo sapien
tgagcagtctaatgtgccacacaat

SEQ ID NO: 407148 - DNA, 25 bp, Homo sapien
gtgccacacaattatctaaggtatt

SEQ ID NO: 407149 - DNA, 25 bp, Homo sapien
tatctaaggtatttgttttctataa

SEQ ID NO: 407150 - DNA, 25 bp, Homo sapien
aaagtattcttgttaccagagtagt

SEQ ID NO: 407151 - DNA, 25 bp, Homo sapien
accagagtagttgtattatatttca

SEQ ID NO: 407152 - DNA, 25 bp, Homo sapien
tgatttttaaaagcctgagtactga

SEQ ID NO: 407153 - DNA, 25 bp, Homo sapien
gagtgataaaagcacatcttctaga

SEQ ID NO: 407154 - DNA, 25 bp, Homo sapien
gcacatcttctagaaagagatttgt

SEQ ID NO: 407155 - DNA, 25 bp, Homo sapien
aacagataaatccttcctcaaaatg

SEQ ID NO: 407156 - DNA, 25 bp, Homo sapien
taaatccttcctcaaaatgggcctt

SEQ ID NO: 407157 - DNA, 25 bp, Homo sapien
atgggcctttttgactatagttctc

SEQ ID NO: 407158 - DNA, 25 bp, Homo sapien
gactatagttctcatttctgcactt

SEQ ID NO: 407159 - DNA, 25 bp, Homo sapien
gttctcatttctgcacttatattct

SEQ ID NO: 407160 - DNA, 25 bp, Homo sapien
cttatattctcatcgcttcttcaaa

SEQ ID NO: 407161 - DNA, 25 bp, Homo sapien
tctcatcgcttcttcaaaggattgt

SEQ ID NO: 407162 - DNA, 25 bp, Homo sapien
acagatattgtattaatcacagcta

SEQ ID NO: 407163 - DNA, 25 bp, Homo sapien
attaatcacagctaagtaactggca

SEQ ID NO: 407164 - DNA, 25 bp, Homo sapien
ccttggctcgctgggaatgaactca

SEQ ID NO: 407165 - DNA, 25 bp, Homo sapien
atgaactcaccgtagcagacgtggt

SEQ ID NO: 407166 - DNA, 25 bp, Homo sapien
tgctgtggtctgtactccagcagat

SEQ ID NO: 407167 - DNA, 25 bp, Homo sapien
gtactccagcagatcggaggctgca

SEQ ID NO: 407168 - DNA, 25 bp, Homo sapien
ctgcagtgtgacagtgccagccaat

SEQ ID NO: 407169 - DNA, 25 bp, Homo sapien
tgaaaacctggctccttttaacacg

SEQ ID NO: 407170 - DNA, 25 bp, Homo sapien
ggccctcaagctccttaagtgaatt

SEQ ID NO: 407171 - DNA, 25 bp, Homo sapien
agtgaattgccgtaactgattttaa

SEQ ID NO: 407172 - DNA, 25 bp, Homo sapien
gtgctctttcatgcctattatcagt

SEQ ID NO: 407173 - DNA, 25 bp, Homo sapien
agtcagagtctttttatttaggcca

SEQ ID NO: 407174 - DNA, 25 bp, Homo sapien
tttaggccagttgtcaagtgtcaat

SEQ ID NO: 407175 - DNA, 25 bp, Homo sapien
ctcagcctggcccaatttaaggcat

SEQ ID NO: 407176 - DNA, 25 bp, Homo sapien
cctggcccaatttaaggcatagcgt

SEQ ID NO: 407177 - DNA, 25 bp, Homo sapien
gggcgtgaccgactgcggccggcgc

SEQ ID NO: 407178 - DNA, 25 bp, Homo sapien
cggccggcgccagaggaaagagcaa

SEQ ID NO: 407179 - DNA, 25 bp, Homo sapien
aaagagcaatggatcgccgaggagc

SEQ ID NO: 407180 - DNA, 25 bp, Homo sapien
ttcctgagcgcagcaggccgaggct

SEQ ID NO: 407181 - DNA, 25 bp, Homo sapien
gatttcggtgcacacgatttcagac

SEQ ID NO: 407182 - DNA, 25 bp, Homo sapien
cggtgcacacgatttcagacagaat

SEQ ID NO: 407183 - DNA, 25 bp, Homo sapien
tcagacagaatatgcccgcgacttc

SEQ ID NO: 407184 - DNA, 25 bp, Homo sapien
gaatatgcccgcgacttcggaccgg

SEQ ID NO: 407185 - DNA, 25 bp, Homo sapien
atgcccgcgacttcggaccgggttg

SEQ ID NO: 407186 - DNA, 25 bp, Homo sapien
ttgatcagtctgaaagtcgattact

SEQ ID NO: 407187 - DNA, 25 bp, Homo sapien
agtcgattactaacagctgaagctg

SEQ ID NO: 407188 - DNA, 25 bp, Homo sapien
tacagagaggatgacacagccacag

SEQ ID NO: 407189 - DNA, 25 bp, Homo sapien
catccagtcagctggaaaccagaaa

SEQ ID NO: 407190 - DNA, 25 bp, Homo sapien
ttggcgttcatgaggatatccagtc

SEQ ID NO: 407191 - DNA, 25 bp, Homo sapien
gcgttcatgaggatatccagtcatt

SEQ ID NO: 407192 - DNA, 25 bp, Homo sapien
tccagtcattttgtgctctggctgg

SEQ ID NO: 407193 - DNA, 25 bp, Homo sapien
agtcattttgtgctctggctgggaa

SEQ ID NO: 407194 - DNA, 25 bp, Homo sapien
cattttgtgctctggctgggaatat

SEQ ID NO: 407195 - DNA, 25 bp, Homo sapien
ggagaaattcacttgcttcaatcat

SEQ ID NO: 407196 - DNA, 25 bp, Homo sapien
ttcacttgcttcaatcattgctgct

SEQ ID NO: 407197 - DNA, 25 bp, Homo sapien
tggttgatccactgtgtaggcttca

SEQ ID NO: 407198 - DNA, 25 bp, Homo sapien
gttgatccactgtgtaggcttcaaa

SEQ ID NO: 407199 - DNA, 25 bp, Homo sapien
tgatccactgtgtaggcttcaaagg

SEQ ID NO: 407200 - DNA, 25 bp, Homo sapien
atccactgtgtaggcttcaaaggaa

SEQ ID NO: 407201 - DNA, 25 bp, Homo sapien
ccactgtgtaggcttcaaaggaatt

SEQ ID NO: 407202 - DNA, 25 bp, Homo sapien
ctgtgtaggcttcaaaggaattaaa

SEQ ID NO: 407203 - DNA, 25 bp, Homo sapien
aaatgggacagaatatttcactgct

SEQ ID NO: 407204 - DNA, 25 bp, Homo sapien
atatttcactgctaacgtattctaa

SEQ ID NO: 407205 - DNA, 25 bp, Homo sapien
ttcactgctaacgtattctaactca

SEQ ID NO: 407206 - DNA, 25 bp, Homo sapien
cactgctaacgtattctaactcact

SEQ ID NO: 407207 - DNA, 25 bp, Homo sapien
tgccatttaagaaaactccgtaatc

SEQ ID NO: 407208 - DNA, 25 bp, Homo sapien
tttagagctttgagaattgtcatcc

SEQ ID NO: 407209 - DNA, 25 bp, Homo sapien
gtcatcctgttggtcaactttgaaa

SEQ ID NO: 407210 - DNA, 25 bp, Homo sapien
tcttcagctgtgtatatacggatct

SEQ ID NO: 407211 - DNA, 25 bp, Homo sapien
gctgtgtatatacggatctggcttt

SEQ ID NO: 407212 - DNA, 25 bp, Homo sapien
acttctacagaaacttttgcaggga

SEQ ID NO: 407213 - DNA, 25 bp, Homo sapien
aacttttgcagggacagtgttgatg

SEQ ID NO: 407214 - DNA, 25 bp, Homo sapien
gttgatgaggcagtttagcttgcca

SEQ ID NO: 407215 - DNA, 25 bp, Homo sapien
gtttagcttgccagggtgatgataa

SEQ ID NO: 407216 - DNA, 25 bp, Homo sapien
aggtccctgcatgtatagtgctctt

SEQ ID NO: 407217 - DNA, 25 bp, Homo sapien
ctgcatgtatagtgctcttctaaag

SEQ ID NO: 407218 - DNA, 25 bp, Homo sapien
gcattcttgaactacttaacttttt

SEQ ID NO: 407219 - DNA, 25 bp, Homo sapien
tgacttgaacaccttctacagcaaa

SEQ ID NO: 407220 - DNA, 25 bp, Homo sapien
gaacaccttctacagcaaactcttg

SEQ ID NO: 407221 - DNA, 25 bp, Homo sapien
tgcaagtccagtttcatccctgtaa

SEQ ID NO: 407222 - DNA, 25 bp, Homo sapien
tcatccctgtaaggcaaatgtcttt

SEQ ID NO: 407223 - DNA, 25 bp, Homo sapien
gcagaaagtgccatatagacgagat

SEQ ID NO: 407224 - DNA, 25 bp, Homo sapien
aaaggcagctaaaacgagggcagta

SEQ ID NO: 407225 - DNA, 25 bp, Homo sapien
ggcagtagagagcacttacccgacc

SEQ ID NO: 407226 - DNA, 25 bp, Homo sapien
ttacccgaccccaaggtgccagaga

SEQ ID NO: 407227 - DNA, 25 bp, Homo sapien
gaaatgtacacacagattcctgtcc

SEQ ID NO: 407228 - DNA, 25 bp, Homo sapien
acttgcacacagtaactaccagctc

SEQ ID NO: 407229 - DNA, 25 bp, Homo sapien
ttctctcaaacttgtatttctcctg

SEQ ID NO: 407230 - DNA, 25 bp, Homo sapien
cttcgttgtgttgaatatatcaaat

SEQ ID NO: 407231 - DNA, 25 bp, Homo sapien
aaatgaacgaactatgaaccagagc

SEQ ID NO: 407232 - DNA, 25 bp, Homo sapien
atgaacgaactatgaaccagagctt

SEQ ID NO: 407233 - DNA, 25 bp, Homo sapien
tgaacgaactatgaaccagagcttt

SEQ ID NO: 407234 - DNA, 25 bp, Homo sapien
gaacgaactatgaaccagagcttta

SEQ ID NO: 407235 - DNA, 25 bp, Homo sapien
aacgaactatgaaccagagctttaa

SEQ ID NO: 407236 - DNA, 25 bp, Homo sapien
acgaactatgaaccagagctttaaa

SEQ ID NO: 407237 - DNA, 25 bp, Homo sapien
cgaactatgaaccagagctttaaaa

SEQ ID NO: 407238 - DNA, 25 bp, Homo sapien
gaactatgaaccagagctttaaaat

SEQ ID NO: 407239 - DNA, 25 bp, Homo sapien
tatgaaccagagctttaaaatagtg

SEQ ID NO: 407240 - DNA, 25 bp, Homo sapien
cagagctttaaaatagtgatttgta

SEQ ID NO: 407241 - DNA, 25 bp, Homo sapien
cattcagagttccagcactgtcggg

SEQ ID NO: 407242 - DNA, 25 bp, Homo sapien
tgtccaccgccataggcctagcatt

SEQ ID NO: 407243 - DNA, 25 bp, Homo sapien
ataggcctagcattgtcaccaacgg

SEQ ID NO: 407244 - DNA, 25 bp, Homo sapien
tagcattgtcaccaacggagccata

SEQ ID NO: 407245 - DNA, 25 bp, Homo sapien
ttgtcaccaacggagccatagaggg

SEQ ID NO: 407246 - DNA, 25 bp, Homo sapien
aacggagccatagagggacctcggc

SEQ ID NO: 407247 - DNA, 25 bp, Homo sapien
catagagggacctcggcccaagctg

SEQ ID NO: 407248 - DNA, 25 bp, Homo sapien
gggcctcttcattgtcgaagaaggc

SEQ ID NO: 407249 - DNA, 25 bp, Homo sapien
attgtcgaagaaggcctcttgccag

SEQ ID NO: 407250 - DNA, 25 bp, Homo sapien
aaggcctcttgccagaccaggatct

SEQ ID NO: 407251 - DNA, 25 bp, Homo sapien
cctcttgccagaccaggatctgtgg

SEQ ID NO: 407252 - DNA, 25 bp, Homo sapien
ataaggcacagaatacctgtagcat

SEQ ID NO: 407253 - DNA, 25 bp, Homo sapien
atacctgtagcataggtcagcctta

SEQ ID NO: 407254 - DNA, 25 bp, Homo sapien
ataggtcagccttacgatgtccatg

SEQ ID NO: 407255 - DNA, 25 bp, Homo sapien
agccttacgatgtccatgaattaca

SEQ ID NO: 407256 - DNA, 25 bp, Homo sapien
tacatattcagacgttttagagcct

SEQ ID NO: 407257 - DNA, 25 bp, Homo sapien
agacgttttagagcctgatacattt

SEQ ID NO: 407258 - DNA, 25 bp, Homo sapien
aaacaacttctacacctattctaca

SEQ ID NO: 407259 - DNA, 25 bp, Homo sapien
cacctattctacagtccgcatttaa

SEQ ID NO: 407260 - DNA, 25 bp, Homo sapien
taaagccgggtttgcttgcgtgcca

SEQ ID NO: 407261 - DNA, 25 bp, Homo sapien
gtttgcttgcgtgccacagggaata

SEQ ID NO: 407262 - DNA, 25 bp, Homo sapien
gtgccacagggaatatatccaggaa

SEQ ID NO: 407263 - DNA, 25 bp, Homo sapien
atggaagtcggtttcttggccatct

SEQ ID NO: 407264 - DNA, 25 bp, Homo sapien
gtttcttggccatctacatagtttt

SEQ ID NO: 407265 - DNA, 25 bp, Homo sapien
acatagttttctgggcagcgccaag

SEQ ID NO: 407266 - DNA, 25 bp, Homo sapien
ggaggtgtctccagttgtgagtcct

SEQ ID NO: 407267 - DNA, 25 bp, Homo sapien
agttgtgagtcctcggacaggctgc

SEQ ID NO: 407268 - DNA, 25 bp, Homo sapien
acaggctgctgcatgggtgcacata

SEQ ID NO: 407269 - DNA, 25 bp, Homo sapien
gcatgggtgcacatactcacgttat

SEQ ID NO: 407270 - DNA, 25 bp, Homo sapien
gcacatactcacgttattggtggaa

SEQ ID NO: 407271 - DNA, 25 bp, Homo sapien
gaaggaggcctaggtggcacaatca

SEQ ID NO: 407272 - DNA, 25 bp, Homo sapien
ggcacaatcagggaggaatatacat

SEQ ID NO: 407273 - DNA, 25 bp, Homo sapien
atctttttcctggtacacacagaaa

SEQ ID NO: 407274 - DNA, 25 bp, Homo sapien
agcagaccaactccatcagaaacta

SEQ ID NO: 407275 - DNA, 25 bp, Homo sapien
tcagaaactactttcagccgtctac

SEQ ID NO: 407276 - DNA, 25 bp, Homo sapien
agaaatgtcttcatgcaaatcagca

SEQ ID NO: 407277 - DNA, 25 bp, Homo sapien
tagaaacgtcttgttctcttttaga

SEQ ID NO: 407278 - DNA, 25 bp, Homo sapien
tagaacaaacacaacctgctacacc

SEQ ID NO: 407279 - DNA, 25 bp, Homo sapien
cctgctacaccctcattgtggaaaa

SEQ ID NO: 407280 - DNA, 25 bp, Homo sapien
gaaaaataaggagcagcatctatct

SEQ ID NO: 407281 - DNA, 25 bp, Homo sapien
agcatctatctgagaatgagcctgt

SEQ ID NO: 407282 - DNA, 25 bp, Homo sapien
gcctgtggacacaaactcagacaat

SEQ ID NO: 407283 - DNA, 25 bp, Homo sapien
aaattctgccagtaaatctcatgct

SEQ ID NO: 407284 - DNA, 25 bp, Homo sapien
aatctcatgctgcagaaaagctaag

SEQ ID NO: 407285 - DNA, 25 bp, Homo sapien
ccggtttcaggatggctgagctgac

SEQ ID NO: 407286 - DNA, 25 bp, Homo sapien
tttcaggatggctgagctgacggtc

SEQ ID NO: 407287 - DNA, 25 bp, Homo sapien
tcaggatggctgagctgacggtcaa

SEQ ID NO: 407288 - DNA, 25 bp, Homo sapien
atttagacttgtgatttggtatgac

SEQ ID NO: 407289 - DNA, 25 bp, Homo sapien
ttggtatgacaatatatggcttttt

SEQ ID NO: 407290 - DNA, 25 bp, Homo sapien
atatggctttttgtgattgttaaca

SEQ ID NO: 407291 - DNA, 25 bp, Homo sapien
ttagagtaaggcaaaagaacatatt

SEQ ID NO: 407292 - DNA, 25 bp, Homo sapien
agaaatgtcaataagaacccatgga

SEQ ID NO: 407293 - DNA, 25 bp, Homo sapien
agaacccatggacattttttataag

SEQ ID NO: 407294 - DNA, 25 bp, Homo sapien
acccatggacattttttataaggag

SEQ ID NO: 407295 - DNA, 25 bp, Homo sapien
ttataaggagactttatctgttctg

SEQ ID NO: 407296 - DNA, 25 bp, Homo sapien
tacataatggcgttttttttctagt

SEQ ID NO: 407297 - DNA, 25 bp, Homo sapien
agtaccttagatgtgagctttgcaa

SEQ ID NO: 407298 - DNA, 25 bp, Homo sapien
tttgcaatttcacttactactttta

SEQ ID NO: 407299 - DNA, 25 bp, Homo sapien
ttcacttactacttttatccttcaa

SEQ ID NO: 407300 - DNA, 25 bp, Homo sapien
gattggttccaaatgggtactgaaa

SEQ ID NO: 407301 - DNA, 25 bp, Homo sapien
aatagattcaactaggctgtagaag

SEQ ID NO: 407302 - DNA, 25 bp, Homo sapien
gaagagaaatgttcaccatgtaggg

SEQ ID NO: 407303 - DNA, 25 bp, Homo sapien
gttcaccatgtagggaatgttattt

SEQ ID NO: 407304 - DNA, 25 bp, Homo sapien
gttattttgtgttccacatctgcaa

SEQ ID NO: 407305 - DNA, 25 bp, Homo sapien
ttgtgttccacatctgcaatttact

SEQ ID NO: 407306 - DNA, 25 bp, Homo sapien
caaactaaagtcctagctgattatt

SEQ ID NO: 407307 - DNA, 25 bp, Homo sapien
aaccgtcggcgctcgcagggcgttg

SEQ ID NO: 407308 - DNA, 25 bp, Homo sapien
cagggcgttgagagtgcggaatgtg

SEQ ID NO: 407309 - DNA, 25 bp, Homo sapien
tgcggaatgtgcacgcgcagcgaac

SEQ ID NO: 407310 - DNA, 25 bp, Homo sapien
aatgtgcacgcgcagcgaacgcctc

SEQ ID NO: 407311 - DNA, 25 bp, Homo sapien
atgtgcacgcgcagcgaacgcctct

SEQ ID NO: 407312 - DNA, 25 bp, Homo sapien
gcgcagcgaacgcctcttctggctg

SEQ ID NO: 407313 - DNA, 25 bp, Homo sapien
ggctggcatttttcttgccgccgct

SEQ ID NO: 407314 - DNA, 25 bp, Homo sapien
tttgaaatgaccctcaattccacat

SEQ ID NO: 407315 - DNA, 25 bp, Homo sapien
gaaatgaccctcaattccacattgg

SEQ ID NO: 407316 - DNA, 25 bp, Homo sapien
aaatgaccctcaattccacattggg

SEQ ID NO: 407317 - DNA, 25 bp, Homo sapien
cctcaattccacattggggtcaatt

SEQ ID NO: 407318 - DNA, 25 bp, Homo sapien
tcctggcccgcgactgtaagaccgg

SEQ ID NO: 407319 - DNA, 25 bp, Homo sapien
gcgactgtaagaccggacccacatc

SEQ ID NO: 407320 - DNA, 25 bp, Homo sapien
tgtaagaccggacccacatccagac

SEQ ID NO: 407321 - DNA, 25 bp, Homo sapien
agaccaatcttcctgtccgggctgc

SEQ ID NO: 407322 - DNA, 25 bp, Homo sapien
acgcgggctccgcaggttgcaggcg

SEQ ID NO: 407323 - DNA, 25 bp, Homo sapien
ggcgcctgaaggttaccgagtgcat

SEQ ID NO: 407324 - DNA, 25 bp, Homo sapien
aaggttaccgagtgcatgagcgcct

SEQ ID NO: 407325 - DNA, 25 bp, Homo sapien
gttaccgagtgcatgagcgcctagc

SEQ ID NO: 407326 - DNA, 25 bp, Homo sapien
accgagtgcatgagcgcctagcgct

SEQ ID NO: 407327 - DNA, 25 bp, Homo sapien
gtgcatgagcgcctagcgcttcccg

SEQ ID NO: 407328 - DNA, 25 bp, Homo sapien
caggaggtgccgtctgcctcccagg

SEQ ID NO: 407329 - DNA, 25 bp, Homo sapien
ctggtttctccctggtatttgagga

SEQ ID NO: 407330 - DNA, 25 bp, Homo sapien
tttgaggatcctccaattgccttct

SEQ ID NO: 407331 - DNA, 25 bp, Homo sapien
tgccttctggtcttacagacgggag

SEQ ID NO: 407332 - DNA, 25 bp, Homo sapien
gaaaaatggcatcgtttccacctta

SEQ ID NO: 407333 - DNA, 25 bp, Homo sapien
gttacaagcacttcaccagatggta

SEQ ID NO: 407334 - DNA, 25 bp, Homo sapien
tttgtaaaacaaatgcccgcccact

SEQ ID NO: 407335 - DNA, 25 bp, Homo sapien
tccacctcagcaaagcattttagca

SEQ ID NO: 407336 - DNA, 25 bp, Homo sapien
aaagctgacccagagcagtagctcc

SEQ ID NO: 407337 - DNA, 25 bp, Homo sapien
gtagctccctgctataatcctagca

SEQ ID NO: 407338 - DNA, 25 bp, Homo sapien
aagtcaggagtatctctttagccca

SEQ ID NO: 407339 - DNA, 25 bp, Homo sapien
atctctttagcccagaagttcaata

SEQ ID NO: 407340 - DNA, 25 bp, Homo sapien
cgccctggctgaaatggactccgga

SEQ ID NO: 407341 - DNA, 25 bp, Homo sapien
ggctgaaatggactccggacccaac

SEQ ID NO: 407342 - DNA, 25 bp, Homo sapien
actcagggaacaaggccaggaccgt

SEQ ID NO: 407343 - DNA, 25 bp, Homo sapien
aggccaggaccgtggcggccaccaa

SEQ ID NO: 407344 - DNA, 25 bp, Homo sapien
acccagaagcgccatgacgcagaga

SEQ ID NO: 407345 - DNA, 25 bp, Homo sapien
gcgccatgacgcagagaccaatatc

SEQ ID NO: 407346 - DNA, 25 bp, Homo sapien
gcagagaccaatatcaccacggaga

SEQ ID NO: 407347 - DNA, 25 bp, Homo sapien
acggagaaggtgagcaaaatcagcc

SEQ ID NO: 407348 - DNA, 25 bp, Homo sapien
tgactccacgggagccaagggcacg

SEQ ID NO: 407349 - DNA, 25 bp, Homo sapien
atcaacaagtcgctgaccaccctgg

SEQ ID NO: 407350 - DNA, 25 bp, Homo sapien
gggcaaggtcatctccgccctggct

SEQ ID NO: 407351 - DNA, 25 bp, Homo sapien
tacataacatcctatctttatatgg

SEQ ID NO: 407352 - DNA, 25 bp, Homo sapien
agaagataacttcagtgtccctatg

SEQ ID NO: 407353 - DNA, 25 bp, Homo sapien
ataacttcagtgtccctatgatggt

SEQ ID NO: 407354 - DNA, 25 bp, Homo sapien
cagtgtccctatgatggtaagttct

SEQ ID NO: 407355 - DNA, 25 bp, Homo sapien
cactcagagaccctaaattttgcag

SEQ ID NO: 407356 - DNA, 25 bp, Homo sapien
ttttgcagacgaacaagggcatctt

SEQ ID NO: 407357 - DNA, 25 bp, Homo sapien
acaagggcatctttgcgttgcttca

SEQ ID NO: 407358 - DNA, 25 bp, Homo sapien
catctttgcgttgcttcatctctgc

SEQ ID NO: 407359 - DNA, 25 bp, Homo sapien
tcccacaggctttctagacttagaa

SEQ ID NO: 407360 - DNA, 25 bp, Homo sapien
agacttagaatatctgacctgatgc

SEQ ID NO: 407361 - DNA, 25 bp, Homo sapien
gaatatctgacctgatgcaaatcgc

SEQ ID NO: 407362 - DNA, 25 bp, Homo sapien
cacaaaaatgtccccaccattttct

SEQ ID NO: 407363 - DNA, 25 bp, Homo sapien
tagttttgccttgtatgtttaatcc

SEQ ID NO: 407364 - DNA, 25 bp, Homo sapien
ttgccttgtatgtttaatcctttaa

SEQ ID NO: 407365 - DNA, 25 bp, Homo sapien
gtttaatcctttaaggcatgtgtag

SEQ ID NO: 407366 - DNA, 25 bp, Homo sapien
ggtgtgaaatagttcttattcattt

SEQ ID NO: 407367 - DNA, 25 bp, Homo sapien
ttcaacacatattggtggagtgcct

SEQ ID NO: 407368 - DNA, 25 bp, Homo sapien
acatattggtggagtgcctgctgaa

SEQ ID NO: 407369 - DNA, 25 bp, Homo sapien
agtgcctgctgaaggtagtactctt

SEQ ID NO: 407370 - DNA, 25 bp, Homo sapien
ggtagtactcttcagagtactttgt

SEQ ID NO: 407371 - DNA, 25 bp, Homo sapien
gtgaacacatattcttgccctggaa

SEQ ID NO: 407372 - DNA, 25 bp, Homo sapien
ttatgtaatcagatttttctcctta

SEQ ID NO: 407373 - DNA, 25 bp, Homo sapien
gggaagttggcccatatcttactaa

SEQ ID NO: 407374 - DNA, 25 bp, Homo sapien
gttggcccatatcttactaagttga

SEQ ID NO: 407375 - DNA, 25 bp, Homo sapien
agttgatcagatttctcgttgggct

SEQ ID NO: 407376 - DNA, 25 bp, Homo sapien
ctcgttgggctggaaatgtttcgct

SEQ ID NO: 407377 - DNA, 25 bp, Homo sapien
aatgtttcgctgttgtatattttaa

SEQ ID NO: 407378 - DNA, 25 bp, Homo sapien
gtaaattgcacctttgtaacatatt

SEQ ID NO: 407379 - DNA, 25 bp, Homo sapien
gacgaatgatcactaagattagcta

SEQ ID NO: 407380 - DNA, 25 bp, Homo sapien
gattagctatatctatacagtcatt

SEQ ID NO: 407381 - DNA, 25 bp, Homo sapien
cctgtcagatgccaaagagtgggat

SEQ ID NO: 407382 - DNA, 25 bp, Homo sapien
atttattgacaatttaccctgtgga

SEQ ID NO: 407383 - DNA, 25 bp, Homo sapien
accctgtggaactgtattatttcta

SEQ ID NO: 407384 - DNA, 25 bp, Homo sapien
tgtttcccctgcctggtgacaaggc

SEQ ID NO: 407385 - DNA, 25 bp, Homo sapien
ccctgcctggtgacaaggccggtgt

SEQ ID NO: 407386 - DNA, 25 bp, Homo sapien
gcagaggagggagcttcttccgcca

SEQ ID NO: 407387 - DNA, 25 bp, Homo sapien
agggagcttcttccgccacacggtg

SEQ ID NO: 407388 - DNA, 25 bp, Homo sapien
aataactggttatccctcaggtcct

SEQ ID NO: 407389 - DNA, 25 bp, Homo sapien
gtggcgcgcgcgagcctcccaaaga

SEQ ID NO: 407390 - DNA, 25 bp, Homo sapien
actggttatccctcaggtcctgcta

SEQ ID NO: 407391 - DNA, 25 bp, Homo sapien
ctccaaatacgaagcacctcgcatt

SEQ ID NO: 407392 - DNA, 25 bp, Homo sapien
agcacctcgcatttgggtcagcagc

SEQ ID NO: 407393 - DNA, 25 bp, Homo sapien
ctcgcatttgggtcagcagctgttt

SEQ ID NO: 407394 - DNA, 25 bp, Homo sapien
atttgggtcagcagctgtttcccct

SEQ ID NO: 407395 - DNA, 25 bp, Homo sapien
ggtgctgtgctgtacttggattatc

SEQ ID NO: 407396 - DNA, 25 bp, Homo sapien
tagctgtatctaaaccacctttccc

SEQ ID NO: 407397 - DNA, 25 bp, Homo sapien
ctctttcctcctttgaactgtttga

SEQ ID NO: 407398 - DNA, 25 bp, Homo sapien
ttgaaacggatttgttcccttctgt

SEQ ID NO: 407399 - DNA, 25 bp, Homo sapien
gttcccttctgtctcttatttttca

SEQ ID NO: 407400 - DNA, 25 bp, Homo sapien
gctgttaacacacatgagactgtct

SEQ ID NO: 407401 - DNA, 25 bp, Homo sapien
gagactgtcttcactaccaaaccaa

SEQ ID NO: 407402 - DNA, 25 bp, Homo sapien
agtctcctaaagctcacttgaatgt

SEQ ID NO: 407403 - DNA, 25 bp, Homo sapien
tgaatgtctgcttattcgtgtctct

SEQ ID NO: 407404 - DNA, 25 bp, Homo sapien
attcgtgtctcttactaggttcaat

SEQ ID NO: 407405 - DNA, 25 bp, Homo sapien
gttcaatttcttggaggccgtgatt

SEQ ID NO: 407406 - DNA, 25 bp, Homo sapien
cactgcctcggtcggtagacaagta

SEQ ID NO: 407407 - DNA, 25 bp, Homo sapien
attagaagttatcaccagcacgggt

SEQ ID NO: 407408 - DNA, 25 bp, Homo sapien
cacgggtgcgaaggcagtgcattaa

SEQ ID NO: 407409 - DNA, 25 bp, Homo sapien
gagacgctggtgacaaccgcccttt

SEQ ID NO: 407410 - DNA, 25 bp, Homo sapien
aacactcattttagagcgccccaga

SEQ ID NO: 407411 - DNA, 25 bp, Homo sapien
aggagatcagagctgtcaaagcaca

SEQ ID NO: 407412 - DNA, 25 bp, Homo sapien
gagccccaaaccacaaaggcttaat

SEQ ID NO: 407413 - DNA, 25 bp, Homo sapien
tgacaaccgccctttgggactacct

SEQ ID NO: 407414 - DNA, 25 bp, Homo sapien
atgaaattcaacttcctgagccagg

SEQ ID NO: 407415 - DNA, 25 bp, Homo sapien
gggactacctgccaaacaaggagaa

SEQ ID NO: 407416 - DNA, 25 bp, Homo sapien
ttccctaagagggaggcactgcctc

SEQ ID NO: 407417 - DNA, 25 bp, Homo sapien
gaaatcactcacataactgacaagt

SEQ ID NO: 407418 - DNA, 25 bp, Homo sapien
acaagtgaagttctgaagtctccat

SEQ ID NO: 407419 - DNA, 25 bp, Homo sapien
gaagttctgaagtctccattgtatc

SEQ ID NO: 407420 - DNA, 25 bp, Homo sapien
tgaagtctccattgtatcactttca

SEQ ID NO: 407421 - DNA, 25 bp, Homo sapien
aatgcagattcattacattgtaaat

SEQ ID NO: 407422 - DNA, 25 bp, Homo sapien
ccattagtggctttggagtacagca

SEQ ID NO: 407423 - DNA, 25 bp, Homo sapien
gtggctttggagtacagcagaaatt

SEQ ID NO: 407424 - DNA, 25 bp, Homo sapien
gaatcaggtgactaatttacaatac

SEQ ID NO: 407425 - DNA, 25 bp, Homo sapien
aaatgaatcttcttccaccatccca

SEQ ID NO: 407426 - DNA, 25 bp, Homo sapien
ttcttccaccatcccaaagttacta

SEQ ID NO: 407427 - DNA, 25 bp, Homo sapien
tccaccatcccaaagttactaaaca

SEQ ID NO: 407428 - DNA, 25 bp, Homo sapien
gaagccttcgtgctgaatcatgacc

SEQ ID NO: 407429 - DNA, 25 bp, Homo sapien
atgaccactcaccatgctggaaaga

SEQ ID NO: 407430 - DNA, 25 bp, Homo sapien
agaaggtctgatgccatttaacttt

SEQ ID NO: 407431 - DNA, 25 bp, Homo sapien
ggtaattcacctgtttctaataaca

SEQ ID NO: 407432 - DNA, 25 bp, Homo sapien
taataacagctacacctgtgtcccg

SEQ ID NO: 407433 - DNA, 25 bp, Homo sapien
ctgtgtcccgagcattggactggat

SEQ ID NO: 407434 - DNA, 25 bp, Homo sapien
ggactggatgctgccatatagcagc

SEQ ID NO: 407435 - DNA, 25 bp, Homo sapien
catatagcagctcatttaacctttg

SEQ ID NO: 407436 - DNA, 25 bp, Homo sapien
ggctactggtggagccaggattcaa

SEQ ID NO: 407437 - DNA, 25 bp, Homo sapien
gccaggattcaagtctgggttgatt

SEQ ID NO: 407438 - DNA, 25 bp, Homo sapien
ctgggttgattgacttggattttgt

SEQ ID NO: 407439 - DNA, 25 bp, Homo sapien
gtcccaggcacataaatatccagat

SEQ ID NO: 407440 - DNA, 25 bp, Homo sapien
atttgacattgccataacattgtta

SEQ ID NO: 407441 - DNA, 25 bp, Homo sapien
tgacattgccataacattgttattc

SEQ ID NO: 407442 - DNA, 25 bp, Homo sapien
aaatactgtggattgaggtccttca

SEQ ID NO: 407443 - DNA, 25 bp, Homo sapien
atactgtggattgaggtccttcatg

SEQ ID NO: 407444 - DNA, 25 bp, Homo sapien
actgtggattgaggtccttcatgaa

SEQ ID NO: 407445 - DNA, 25 bp, Homo sapien
gtggattgaggtccttcatgaaaaa

SEQ ID NO: 407446 - DNA, 25 bp, Homo sapien
tatatcattaagcaaaacagttttt

SEQ ID NO: 407447 - DNA, 25 bp, Homo sapien
ttgaggtggagtttctttcgccagg

SEQ ID NO: 407448 - DNA, 25 bp, Homo sapien
tgaggtggagtttctttcgccaggc

SEQ ID NO: 407449 - DNA, 25 bp, Homo sapien
aggtggagtttctttcgccaggctg

SEQ ID NO: 407450 - DNA, 25 bp, Homo sapien
cccagaccctgcattataacggcta

SEQ ID NO: 407451 - DNA, 25 bp, Homo sapien
agaccctgcattataacggctattt

SEQ ID NO: 407452 - DNA, 25 bp, Homo sapien
agagtggagtgtgtagccctgcttt

SEQ ID NO: 407453 - DNA, 25 bp, Homo sapien
agtggagtgtgtagccctgctttgt

SEQ ID NO: 407454 - DNA, 25 bp, Homo sapien
gagtgtgtagccctgctttgtgctt

SEQ ID NO: 407455 - DNA, 25 bp, Homo sapien
agtgtgtagccctgctttgtgcttt

SEQ ID NO: 407456 - DNA, 25 bp, Homo sapien
tgtgtagccctgctttgtgcttttt

SEQ ID NO: 407457 - DNA, 25 bp, Homo sapien
ttttttctctaacagagggttgtga

SEQ ID NO: 407458 - DNA, 25 bp, Homo sapien
gaggctcagcagtattttataactt

SEQ ID NO: 407459 - DNA, 25 bp, Homo sapien
tttctctaacagagggttgtgagag

SEQ ID NO: 407460 - DNA, 25 bp, Homo sapien
gctcagcagtattttataacttaac

SEQ ID NO: 407461 - DNA, 25 bp, Homo sapien
atatgaaaacactgcatgacaatgt

SEQ ID NO: 407462 - DNA, 25 bp, Homo sapien
cactgcatgacaatgtgttaaaaca

SEQ ID NO: 407463 - DNA, 25 bp, Homo sapien
aaaacattatgacatcagtgctcat

SEQ ID NO: 407464 - DNA, 25 bp, Homo sapien
aacattatgacatcagtgctcattt

SEQ ID NO: 407465 - DNA, 25 bp, Homo sapien
attttattgacatcactgtagcttt

SEQ ID NO: 407466 - DNA, 25 bp, Homo sapien
tattgacatcactgtagctttcagg

SEQ ID NO: 407467 - DNA, 25 bp, Homo sapien
tgacatcactgtagctttcaggaga

SEQ ID NO: 407468 - DNA, 25 bp, Homo sapien
acatcactgtagctttcaggagaaa

SEQ ID NO: 407469 - DNA, 25 bp, Homo sapien
gttattttttcttgaactctaatag

SEQ ID NO: 407470 - DNA, 25 bp, Homo sapien
tatgttttgtgaaattgcttaggaa

SEQ ID NO: 407471 - DNA, 25 bp, Homo sapien
ttatgccatgtgaataaaaatgcct

SEQ ID NO: 407472 - DNA, 25 bp, Homo sapien
gacatatgttgtacttgaaccttaa

SEQ ID NO: 407473 - DNA, 25 bp, Homo sapien
gaaccttaatgtacttgaacttgaa

SEQ ID NO: 407474 - DNA, 25 bp, Homo sapien
ggctgcagcagctatagccatctta

SEQ ID NO: 407475 - DNA, 25 bp, Homo sapien
ctatagccatcttacttccatgtga

SEQ ID NO: 407476 - DNA, 25 bp, Homo sapien
atcttacttccatgtgaagcctaag

SEQ ID NO: 407477 - DNA, 25 bp, Homo sapien
gaagcctaagaattaagcaacacat

SEQ ID NO: 407478 - DNA, 25 bp, Homo sapien
taagcaacacatggaagggaacaca

SEQ ID NO: 407479 - DNA, 25 bp, Homo sapien
gggaacacatcttttgagccccaat

SEQ ID NO: 407480 - DNA, 25 bp, Homo sapien
tttgagccccaatttggccatgagt

SEQ ID NO: 407481 - DNA, 25 bp, Homo sapien
aatttggccatgagttgcccttaga

SEQ ID NO: 407482 - DNA, 25 bp, Homo sapien
tggccatgagttgcccttagatttt

SEQ ID NO: 407483 - DNA, 25 bp, Homo sapien
aagatccagtcccaatatgtcacct

SEQ ID NO: 407484 - DNA, 25 bp, Homo sapien
gtgcttcatctttggactatatctc

SEQ ID NO: 407485 - DNA, 25 bp, Homo sapien
atatctcaggtgtttacgtgtcaac

SEQ ID NO: 407486 - DNA, 25 bp, Homo sapien
acgtgtcaactaatgggagcttact

SEQ ID NO: 407487 - DNA, 25 bp, Homo sapien
gagtttcaatcctcacttagtagtc

SEQ ID NO: 407488 - DNA, 25 bp, Homo sapien
acttagtagtctgtggccctctttg

SEQ ID NO: 407489 - DNA, 25 bp, Homo sapien
gtggccctctttggcacattaacct

SEQ ID NO: 407490 - DNA, 25 bp, Homo sapien
ggctgcacctctggcaaatgggaga

SEQ ID NO: 407491 - DNA, 25 bp, Homo sapien
gatgcccagattccagtcctggagt

SEQ ID NO: 407492 - DNA, 25 bp, Homo sapien
gtcctggagttttattctctcagct

SEQ ID NO: 407493 - DNA, 25 bp, Homo sapien
tctctcagcttgatcctttgaccaa

SEQ ID NO: 407494 - DNA, 25 bp, Homo sapien
aaagatttgctatattggcaatagt

SEQ ID NO: 407495 - DNA, 25 bp, Homo sapien
ggcaatagtaaatcaacctccaaac

SEQ ID NO: 407496 - DNA, 25 bp, Homo sapien
gaggcttctaagaaaaggttctctt

SEQ ID NO: 407497 - DNA, 25 bp, Homo sapien
aaggttctcttatgggtataaagat

SEQ ID NO: 407498 - DNA, 25 bp, Homo sapien
ttgtagtcctagctgaggccagagg

SEQ ID NO: 407499 - DNA, 25 bp, Homo sapien
gccagaggattattcgagcccaaga

SEQ ID NO: 407500 - DNA, 25 bp, Homo sapien
agaggattattcgagcccaagagct

SEQ ID NO: 407501 - DNA, 25 bp, Homo sapien
gttgtggtgagcttggttgcatcac

SEQ ID NO: 407502 - DNA, 25 bp, Homo sapien
gtgagcttggttgcatcactgtgct

SEQ ID NO: 407503 - DNA, 25 bp, Homo sapien
agcttggttgcatcactgtgctcca

SEQ ID NO: 407504 - DNA, 25 bp, Homo sapien
cttggttgcatcactgtgctccagc

SEQ ID NO: 407505 - DNA, 25 bp, Homo sapien
gaaatcattaagaatgtgcccctga

SEQ ID NO: 407506 - DNA, 25 bp, Homo sapien
tcattaagaatgtgcccctgaagaa

SEQ ID NO: 407507 - DNA, 25 bp, Homo sapien
agaagatggccgaccggatcaggaa

SEQ ID NO: 407508 - DNA, 25 bp, Homo sapien
tggccgaccggatcaggaagtatca

SEQ ID NO: 407509 - DNA, 25 bp, Homo sapien
ggaagtatcagatcttgaacaatga

SEQ ID NO: 407510 - DNA, 25 bp, Homo sapien
gaacaatgaggtttttgccatcctg

SEQ ID NO: 407511 - DNA, 25 bp, Homo sapien
tttgccatcctgaacaaatacatga

SEQ ID NO: 407512 - DNA, 25 bp, Homo sapien
acaaatacatgaagtccgtggagac

SEQ ID NO: 407513 - DNA, 25 bp, Homo sapien
gtccgtggagacagacagttccact

SEQ ID NO: 407514 - DNA, 25 bp, Homo sapien
gacagacagttccactgtggagcat

SEQ ID NO: 407515 - DNA, 25 bp, Homo sapien
ccttggccaccacttgctaagcaga

SEQ ID NO: 407516 - DNA, 25 bp, Homo sapien
ggatttggggatcagaactccttct

SEQ ID NO: 407517 - DNA, 25 bp, Homo sapien
gatttggggatcagaactccttctg

SEQ ID NO: 407518 - DNA, 25 bp, Homo sapien
atttggggatcagaactccttctga

SEQ ID NO: 407519 - DNA, 25 bp, Homo sapien
tttggggatcagaactccttctgat

SEQ ID NO: 407520 - DNA, 25 bp, Homo sapien
ggggatcagaactccttctgatcaa

SEQ ID NO: 407521 - DNA, 25 bp, Homo sapien
acatatgattttgcatgagctatct

SEQ ID NO: 407522 - DNA, 25 bp, Homo sapien
catatgattttgcatgagctatctg

SEQ ID NO: 407523 - DNA, 25 bp, Homo sapien
atatgattttgcatgagctatctgg

SEQ ID NO: 407524 - DNA, 25 bp, Homo sapien
tatgattttgcatgagctatctgga

SEQ ID NO: 407525 - DNA, 25 bp, Homo sapien
atgattttgcatgagctatctggaa

SEQ ID NO: 407526 - DNA, 25 bp, Homo sapien
tgattttgcatgagctatctggaaa

SEQ ID NO: 407527 - DNA, 25 bp, Homo sapien
atatgagaatctggagtttaggaaa

SEQ ID NO: 407528 - DNA, 25 bp, Homo sapien
ttttgtagataatctaccctttctt

SEQ ID NO: 407529 - DNA, 25 bp, Homo sapien
gtaaatgtttagaagcatgatgtct

SEQ ID NO: 407530 - DNA, 25 bp, Homo sapien
agaagcatgatgtctatgtgtgtat

SEQ ID NO: 407531 - DNA, 25 bp, Homo sapien
taaggagtagtcttggaggaagaaa

SEQ ID NO: 407532 - DNA, 25 bp, Homo sapien
gaagaaaaccaagagtactgttttg

SEQ ID NO: 407533 - DNA, 25 bp, Homo sapien
ccaagagtactgttttgaacaaaat

SEQ ID NO: 407534 - DNA, 25 bp, Homo sapien
aatgttgaagactcctggtaaatat

SEQ ID NO: 407535 - DNA, 25 bp, Homo sapien
gttgaagactcctggtaaatatcga

SEQ ID NO: 407536 - DNA, 25 bp, Homo sapien
gaagactcctggtaaatatcgaagt

SEQ ID NO: 407537 - DNA, 25 bp, Homo sapien
ctcctggtaaatatcgaagtgtaaa

SEQ ID NO: 407538 - DNA, 25 bp, Homo sapien
gaaatgcaaacaggtcctttttgaa

SEQ ID NO: 407539 - DNA, 25 bp, Homo sapien
aagctgcttatcagtgacattatca

SEQ ID NO: 407540 - DNA, 25 bp, Homo sapien
tttcctccaacgacagaaaaacact

SEQ ID NO: 407541 - DNA, 25 bp, Homo sapien
gaaaaacactgcagtaagctttggc

SEQ ID NO: 407542 - DNA, 25 bp, Homo sapien
taagctttggcagcgtgtcctttga

SEQ ID NO: 407543 - DNA, 25 bp, Homo sapien
gcagcgtgtcctttgaagaggcaga

SEQ ID NO: 407544 - DNA, 25 bp, Homo sapien
aggcagagactcgtttatccagcta

SEQ ID NO: 407545 - DNA, 25 bp, Homo sapien
gagactcgtttatccagctatcaaa

SEQ ID NO: 407546 - DNA, 25 bp, Homo sapien
attagaggaggcacaccctgggcga

SEQ ID NO: 407547 - DNA, 25 bp, Homo sapien
acaccctgggcgaagcatgaggaca

SEQ ID NO: 407548 - DNA, 25 bp, Homo sapien
ggacaagtcattaaacactagtttc

SEQ ID NO: 407549 - DNA, 25 bp, Homo sapien
ggataaacccatagactacaacaac

SEQ ID NO: 407550 - DNA, 25 bp, Homo sapien
gactacaacaactataggatggctt

SEQ ID NO: 407551 - DNA, 25 bp, Homo sapien
tacaacaactataggatggcttttg

SEQ ID NO: 407552 - DNA, 25 bp, Homo sapien
actataggatggcttttgttaggaa

SEQ ID NO: 407553 - DNA, 25 bp, Homo sapien
gttaggaagtgatattctgttgaat

SEQ ID NO: 407554 - DNA, 25 bp, Homo sapien
atcagatggttaatactggcataaa

SEQ ID NO: 407555 - DNA, 25 bp, Homo sapien
ttttggcaaaactacaaataggatt

SEQ ID NO: 407556 - DNA, 25 bp, Homo sapien
aataggattatgttagcgtttacac

SEQ ID NO: 407557 - DNA, 25 bp, Homo sapien
aggattatgttagcgtttacactga

SEQ ID NO: 407558 - DNA, 25 bp, Homo sapien
gttagcgtttacactgaggagaaaa

SEQ ID NO: 407559 - DNA, 25 bp, Homo sapien
gttataaaggtacctaacaataatg

SEQ ID NO: 407560 - DNA, 25 bp, Homo sapien
atagcatctatgtctctttcaaggg

SEQ ID NO: 407561 - DNA, 25 bp, Homo sapien
tctatgtctctttcaagggaatttg

SEQ ID NO: 407562 - DNA, 25 bp, Homo sapien
aatgctgtttagctaattgttgcaa

SEQ ID NO: 407563 - DNA, 25 bp, Homo sapien
gcaattgcatattaacagctgtgat

SEQ ID NO: 407564 - DNA, 25 bp, Homo sapien
tgtgattttgttggacagcaagtat

SEQ ID NO: 407565 - DNA, 25 bp, Homo sapien
gacagcaagtattatggccaaagcc

SEQ ID NO: 407566 - DNA, 25 bp, Homo sapien
ggccaaagccagtttcttggcattt

SEQ ID NO: 407567 - DNA, 25 bp, Homo sapien
aactagttgaggttagctgaggctg

SEQ ID NO: 407568 - DNA, 25 bp, Homo sapien
tcatggtaaatgattcacttctata

SEQ ID NO: 407569 - DNA, 25 bp, Homo sapien
ttggttttcatcctggattcatccc

SEQ ID NO: 407570 - DNA, 25 bp, Homo sapien
ggattcatcccctgatcttaaatca

SEQ ID NO: 407571 - DNA, 25 bp, Homo sapien
ggcaatgccactcctccagagagaa

SEQ ID NO: 407572 - DNA, 25 bp, Homo sapien
gcaatgccactcctccagagagaat

SEQ ID NO: 407573 - DNA, 25 bp, Homo sapien
aatgccactcctccagagagaattc

SEQ ID NO: 407574 - DNA, 25 bp, Homo sapien
atgccactcctccagagagaattct

SEQ ID NO: 407575 - DNA, 25 bp, Homo sapien
tatggccacatctctaaattgcaat

SEQ ID NO: 407576 - DNA, 25 bp, Homo sapien
tggccacatctctaaattgcaatgg

SEQ ID NO: 407577 - DNA, 25 bp, Homo sapien
ggccacatctctaaattgcaatggt

SEQ ID NO: 407578 - DNA, 25 bp, Homo sapien
acatctctaaattgcaatggtccca

SEQ ID NO: 407579 - DNA, 25 bp, Homo sapien
atctctaaattgcaatggtcccatt

SEQ ID NO: 407580 - DNA, 25 bp, Homo sapien
tctctaaattgcaatggtcccattt

SEQ ID NO: 407581 - DNA, 25 bp, Homo sapien
tctaaattgcaatggtcccatttct

SEQ ID NO: 407582 - DNA, 25 bp, Homo sapien
ctctacatgacatattgagattttt

SEQ ID NO: 407583 - DNA, 25 bp, Homo sapien
gatagtgatgttctgttctaaactg

SEQ ID NO: 407584 - DNA, 25 bp, Homo sapien
actgttctgttttagtgaaggtaga

SEQ ID NO: 407585 - DNA, 25 bp, Homo sapien
gcatggggattcttttctaaggtaa

SEQ ID NO: 407586 - DNA, 25 bp, Homo sapien
agctctttgttgaagcctgtggtag

SEQ ID NO: 407587 - DNA, 25 bp, Homo sapien
tttgttgaagcctgtggtagcacat

SEQ ID NO: 407588 - DNA, 25 bp, Homo sapien
aagcctgtggtagcacattatgttt

SEQ ID NO: 407589 - DNA, 25 bp, Homo sapien
atgtttataattgcacatgtgcaca

SEQ ID NO: 407590 - DNA, 25 bp, Homo sapien
gcacatgtgcacataatctattatg

SEQ ID NO: 407591 - DNA, 25 bp, Homo sapien
taatctattatgatccaatgcaaat

SEQ ID NO: 407592 - DNA, 25 bp, Homo sapien
gatccaatgcaaatacagctccaaa

SEQ ID NO: 407593 - DNA, 25 bp, Homo sapien
ggaatagttgctgaacaccccaggc

SEQ ID NO: 407594 - DNA, 25 bp, Homo sapien
tgaggtccctccttgagtctcatgt

SEQ ID NO: 407595 - DNA, 25 bp, Homo sapien
atgttcaagcagtctttgtccatga

SEQ ID NO: 407596 - DNA, 25 bp, Homo sapien
aaactgggaggcgaccgtgttagct

SEQ ID NO: 407597 - DNA, 25 bp, Homo sapien
aggcgaccgtgttagctgccagttc

SEQ ID NO: 407598 - DNA, 25 bp, Homo sapien
cagtggcttcactctgtgtccctga

SEQ ID NO: 407599 - DNA, 25 bp, Homo sapien
aagagtgcctgccatccgtcagtgt

SEQ ID NO: 407600 - DNA, 25 bp, Homo sapien
gtttctacagcagcaatcccaagat

SEQ ID NO: 407601 - DNA, 25 bp, Homo sapien
ggacctgacctgagagaagatacct

SEQ ID NO: 407602 - DNA, 25 bp, Homo sapien
gaagataccttcagtggctgccagg

SEQ ID NO: 407603 - DNA, 25 bp, Homo sapien
ggctgccaggctgttccttggaacc

SEQ ID NO: 407604 - DNA, 25 bp, Homo sapien
gattgaactggagggacattcttcc

SEQ ID NO: 407605 - DNA, 25 bp, Homo sapien
tggagggacattcttccagtcctct

SEQ ID NO: 407606 - DNA, 25 bp, Homo sapien
attcttccagtcctcttagtaacat

SEQ ID NO: 407607 - DNA, 25 bp, Homo sapien
ttccagtcctcttagtaacataaac

SEQ ID NO: 407608 - DNA, 25 bp, Homo sapien
ccaagtttgacctgtcattaaaaat

SEQ ID NO: 407609 - DNA, 25 bp, Homo sapien
aaaattccatactccagtgggttag

SEQ ID NO: 407610 - DNA, 25 bp, Homo sapien
tactccagtgggttagaagctagat

SEQ ID NO: 407611 - DNA, 25 bp, Homo sapien
gaagctagattccaatgaaggcggt

SEQ ID NO: 407612 - DNA, 25 bp, Homo sapien
gattccaatgaaggcggttggtttt

SEQ ID NO: 407613 - DNA, 25 bp, Homo sapien
ttttctatttacaaccattcttagt

SEQ ID NO: 407614 - DNA, 25 bp, Homo sapien
gtttaccattaacactatcctttat

SEQ ID NO: 407615 - DNA, 25 bp, Homo sapien
gttaacatcatagttgtgaatccat

SEQ ID NO: 407616 - DNA, 25 bp, Homo sapien
agttgtgaatccattctaaggcaga

SEQ ID NO: 407617 - DNA, 25 bp, Homo sapien
gtgaatccattctaaggcagaaatt

SEQ ID NO: 407618 - DNA, 25 bp, Homo sapien
gcttcgtcttttgaggaagaccgta

SEQ ID NO: 407619 - DNA, 25 bp, Homo sapien
gaccgtaataaaagataatccttct

SEQ ID NO: 407620 - DNA, 25 bp, Homo sapien
gttaccttgcattatagttaatatt

SEQ ID NO: 407621 - DNA, 25 bp, Homo sapien
taataatgtaggattcagaaagtct

SEQ ID NO: 407622 - DNA, 25 bp, Homo sapien
agaaagtctatagtgtctccctctt

SEQ ID NO: 407623 - DNA, 25 bp, Homo sapien
aagtctatagtgtctccctctttgt

SEQ ID NO: 407624 - DNA, 25 bp, Homo sapien
tatagtgtctccctctttgtgggta

SEQ ID NO: 407625 - DNA, 25 bp, Homo sapien
tagtgtctccctctttgtgggtagg

SEQ ID NO: 407626 - DNA, 25 bp, Homo sapien
ataattgtccggaaactggccagat

SEQ ID NO: 407627 - DNA, 25 bp, Homo sapien
tgtccggaaactggccagataatgt

SEQ ID NO: 407628 - DNA, 25 bp, Homo sapien
aatgtagaacgcacaagttgttgag

SEQ ID NO: 407629 - DNA, 25 bp, Homo sapien
tgttgagaagcccttttgtttcctg

SEQ ID NO: 407630 - DNA, 25 bp, Homo sapien
tgagaagcccttttgtttcctgata

SEQ ID NO: 407631 - DNA, 25 bp, Homo sapien
gatagttacatgtaattccagcagt

SEQ ID NO: 407632 - DNA, 25 bp, Homo sapien
gtaattccagcagtatttggaaata

SEQ ID NO: 407633 - DNA, 25 bp, Homo sapien
tatctttggctaatgggtagtacac

SEQ ID NO: 407634 - DNA, 25 bp, Homo sapien
gggtagtacacatcttagtctgttt

SEQ ID NO: 407635 - DNA, 25 bp, Homo sapien
atcttagtctgtttaatatgccttt

SEQ ID NO: 407636 - DNA, 25 bp, Homo sapien
aactgtgtctgttgagaattggtgt

SEQ ID NO: 407637 - DNA, 25 bp, Homo sapien
ttctctgtgccttaggtttttaagt

SEQ ID NO: 407638 - DNA, 25 bp, Homo sapien
tacaatcagtgtacccttcaaacct

SEQ ID NO: 407639 - DNA, 25 bp, Homo sapien
agtgtacccttcaaacctcacaaga

SEQ ID NO: 407640 - DNA, 25 bp, Homo sapien
aaacctcacaagatgaaactcagaa

SEQ ID NO: 407641 - DNA, 25 bp, Homo sapien
tggaagcattttgcgtggcttatat

SEQ ID NO: 407642 - DNA, 25 bp, Homo sapien
ggcttatattatgccacgccagtgt

SEQ ID NO: 407643 - DNA, 25 bp, Homo sapien
gttgttttctgtacagagcgttcag

SEQ ID NO: 407644 - DNA, 25 bp, Homo sapien
agagcgttcagtttactcaggctga

SEQ ID NO: 407645 - DNA, 25 bp, Homo sapien
actcaggctgaatgttttctgacat

SEQ ID NO: 407646 - DNA, 25 bp, Homo sapien
ttctgacatatatctccagtatgaa

SEQ ID NO: 407647 - DNA, 25 bp, Homo sapien
ctccagtatgaatttgtttatgtaa

SEQ ID NO: 407648 - DNA, 25 bp, Homo sapien
gtctgttttattcactattgtatct

SEQ ID NO: 407649 - DNA, 25 bp, Homo sapien
actattgtatcttcagtactggaac

SEQ ID NO: 407650 - DNA, 25 bp, Homo sapien
tattctcccaaagtacatcgcacta

SEQ ID NO: 407651 - DNA, 25 bp, Homo sapien
gtacgtggcacttagatattcaatt

SEQ ID NO: 407652 - DNA, 25 bp, Homo sapien
ttactgaatgtttacaccactcctg

SEQ ID NO: 407653 - DNA, 25 bp, Homo sapien
gaatgtttacaccactcctgagaag

SEQ ID NO: 407654 - DNA, 25 bp, Homo sapien
ccactcctgagaagaataagcgtaa

SEQ ID NO: 407655 - DNA, 25 bp, Homo sapien
aataagtcgccttcatctagagtgc

SEQ ID NO: 407656 - DNA, 25 bp, Homo sapien
gccttcatctagagtgctcttcaga

SEQ ID NO: 407657 - DNA, 25 bp, Homo sapien
atcgcactacttaatattttttggc

SEQ ID NO: 407658 - DNA, 25 bp, Homo sapien
tattttttgtctcttctactagaat

SEQ ID NO: 407659 - DNA, 25 bp, Homo sapien
caagatggaaacttggtttgaccta

SEQ ID NO: 407660 - DNA, 25 bp, Homo sapien
aacttggtttgacctaaaacatctg

SEQ ID NO: 407661 - DNA, 25 bp, Homo sapien
acttggtttgacctaaaacatctga

SEQ ID NO: 407662 - DNA, 25 bp, Homo sapien
cttggtttgacctaaaacatctgat

SEQ ID NO: 407663 - DNA, 25 bp, Homo sapien
ttggtttgacctaaaacatctgatt

SEQ ID NO: 407664 - DNA, 25 bp, Homo sapien
ggtttgacctaaaacatctgattaa

SEQ ID NO: 407665 - DNA, 25 bp, Homo sapien
tttgacctaaaacatctgattaata

SEQ ID NO: 407666 - DNA, 25 bp, Homo sapien
aaaacatctgattaatataggctag

SEQ ID NO: 407667 - DNA, 25 bp, Homo sapien
gatttcttaaaaattcgttgcattg

SEQ ID NO: 407668 - DNA, 25 bp, Homo sapien
atttcttaaaaattcgttgcattga

SEQ ID NO: 407669 - DNA, 25 bp, Homo sapien
ttcttaaaaattcgttgcattgaag

SEQ ID NO: 407670 - DNA, 25 bp, Homo sapien
aagccgccaagctgagccaccaaag

SEQ ID NO: 407671 - DNA, 25 bp, Homo sapien
gggccgcaggtgaagagagcagatg

SEQ ID NO: 407672 - DNA, 25 bp, Homo sapien
gtggaaggacccttggcgccgatcc

SEQ ID NO: 407673 - DNA, 25 bp, Homo sapien
ggcgccgatccaagtctcccaagaa

SEQ ID NO: 407674 - DNA, 25 bp, Homo sapien
gggctcgaaggcgtcggaaaacatc

SEQ ID NO: 407675 - DNA, 25 bp, Homo sapien
cgaaggcgtcggaaaacatcagcct

SEQ ID NO: 407676 - DNA, 25 bp, Homo sapien
aaaacatcagcctcgtcagcctctg

SEQ ID NO: 407677 - DNA, 25 bp, Homo sapien
taattcctccaggtcgtcttcgcgg

SEQ ID NO: 407678 - DNA, 25 bp, Homo sapien
tccaggtcgtcttcgcggtcatcgt

SEQ ID NO: 407679 - DNA, 25 bp, Homo sapien
cttcgcggtcatcgtcctactctgg

SEQ ID NO: 407680 - DNA, 25 bp, Homo sapien
ggtcttcatcctacagctcctactc

SEQ ID NO: 407681 - DNA, 25 bp, Homo sapien
gccacatccttgttggtttagtcca

SEQ ID NO: 407682 - DNA, 25 bp, Homo sapien
ggtttagtccaagagatcatttgca

SEQ ID NO: 407683 - DNA, 25 bp, Homo sapien
ttgcaacaacagtagatgtccgggt

SEQ ID NO: 407684 - DNA, 25 bp, Homo sapien
gtagatgtccgggttttgtttctgt

SEQ ID NO: 407685 - DNA, 25 bp, Homo sapien
ggtaaccagaggaatccctagcctt

SEQ ID NO: 407686 - DNA, 25 bp, Homo sapien
gaggaatccctagccttgttttcct

SEQ ID NO: 407687 - DNA, 25 bp, Homo sapien
tgttttccttagaagacttgtttag

SEQ ID NO: 407688 - DNA, 25 bp, Homo sapien
gtttagtgttttatcagacgtctgt

SEQ ID NO: 407689 - DNA, 25 bp, Homo sapien
gaaaaacaccacatggagcctgtaa

SEQ ID NO: 407690 - DNA, 25 bp, Homo sapien
gtaaatgtttttgcacaacctgtaa

SEQ ID NO: 407691 - DNA, 25 bp, Homo sapien
gcacaacctgtaaagcattcttgga

SEQ ID NO: 407692 - DNA, 25 bp, Homo sapien
aagggaatatctgacagcgcccacc

SEQ ID NO: 407693 - DNA, 25 bp, Homo sapien
ccaaggacaggaatgaggagatgct

SEQ ID NO: 407694 - DNA, 25 bp, Homo sapien
atgctggtgaactagccatccatca

SEQ ID NO: 407695 - DNA, 25 bp, Homo sapien
tgaactagccatccatcagtacctg

SEQ ID NO: 407696 - DNA, 25 bp, Homo sapien
gagttttctaggttctgagagccac

SEQ ID NO: 407697 - DNA, 25 bp, Homo sapien
taggttctgagagccacgttgtcat

SEQ ID NO: 407698 - DNA, 25 bp, Homo sapien
tgagagccacgttgtcatccctggg

SEQ ID NO: 407699 - DNA, 25 bp, Homo sapien
gttgtcatccctgggctttgaagtt

SEQ ID NO: 407700 - DNA, 25 bp, Homo sapien
gggctttgaagttaaacatcacaca

SEQ ID NO: 407701 - DNA, 25 bp, Homo sapien
gccaatgaaagcagggtcaaggaca

SEQ ID NO: 407702 - DNA, 25 bp, Homo sapien
gacaggaccagcgcaggccaaggaa

SEQ ID NO: 407703 - DNA, 25 bp, Homo sapien
aattaatctgatagtagttatggaa

SEQ ID NO: 407704 - DNA, 25 bp, Homo sapien
gaacttaaaaagactattctagtga

SEQ ID NO: 407705 - DNA, 25 bp, Homo sapien
attctagtgattttactatcctgct

SEQ ID NO: 407706 - DNA, 25 bp, Homo sapien
ctagtgattttactatcctgctcag

SEQ ID NO: 407707 - DNA, 25 bp, Homo sapien
agtgattttactatcctgctcagat

SEQ ID NO: 407708 - DNA, 25 bp, Homo sapien
gtgattttactatcctgctcagatg

SEQ ID NO: 407709 - DNA, 25 bp, Homo sapien
gattttactatcctgctcagatggc

SEQ ID NO: 407710 - DNA, 25 bp, Homo sapien
ttttactatcctgctcagatggcat

SEQ ID NO: 407711 - DNA, 25 bp, Homo sapien
ttactatcctgctcagatggcattc

SEQ ID NO: 407712 - DNA, 25 bp, Homo sapien
actatcctgctcagatggcattcaa

SEQ ID NO: 407713 - DNA, 25 bp, Homo sapien
tatcctgctcagatggcattcaaaa

SEQ ID NO: 407714 - DNA, 25 bp, Homo sapien
gttctcaggagtggttgaggacaca

SEQ ID NO: 407715 - DNA, 25 bp, Homo sapien
ttctcaggagtggttgaggacacag

SEQ ID NO: 407716 - DNA, 25 bp, Homo sapien
tctcaggagtggttgaggacacagg

SEQ ID NO: 407717 - DNA, 25 bp, Homo sapien
ctcaggagtggttgaggacacaggg

SEQ ID NO: 407718 - DNA, 25 bp, Homo sapien
tcaggagtggttgaggacacagggc

SEQ ID NO: 407719 - DNA, 25 bp, Homo sapien
tcttgtcctctcactccttcccaga

SEQ ID NO: 407720 - DNA, 25 bp, Homo sapien
ttgtcctctcactccttcccagaag

SEQ ID NO: 407721 - DNA, 25 bp, Homo sapien
tgtcctctcactccttcccagaagt

SEQ ID NO: 407722 - DNA, 25 bp, Homo sapien
gtcctctcactccttcccagaagtt

SEQ ID NO: 407723 - DNA, 25 bp, Homo sapien
tcctctcactccttcccagaagttt

SEQ ID NO: 407724 - DNA, 25 bp, Homo sapien
cctctcactccttcccagaagtttt

SEQ ID NO: 407725 - DNA, 25 bp, Homo sapien
gaaccgttggtggtgtttgttgaca

SEQ ID NO: 407726 - DNA, 25 bp, Homo sapien
gacaactacatcaaacttctcacag

SEQ ID NO: 407727 - DNA, 25 bp, Homo sapien
tcaaacttctcacagactgcaacac

SEQ ID NO: 407728 - DNA, 25 bp, Homo sapien
gaaacctttcagaagatactggaca

SEQ ID NO: 407729 - DNA, 25 bp, Homo sapien
agagcagcatgctggaactcctgcg

SEQ ID NO: 407730 - DNA, 25 bp, Homo sapien
gggcagaaagctccggctcactgtc

SEQ ID NO: 407731 - DNA, 25 bp, Homo sapien
ctgacggcgccaacaccagagcaag

SEQ ID NO: 407732 - DNA, 25 bp, Homo sapien
aagatcgttgtcaaaggcatgaccc

SEQ ID NO: 407733 - DNA, 25 bp, Homo sapien
tgacccgggctgagatgatcctcaa

SEQ ID NO: 407734 - DNA, 25 bp, Homo sapien
gatcctcaaggtagtgatggcccct

SEQ ID NO: 407735 - DNA, 25 bp, Homo sapien
tgatggcccctcatgaaccgttggt

SEQ ID NO: 407736 - DNA, 25 bp, Homo sapien
gaggtaaggatttcaaatttcgaca

SEQ ID NO: 407737 - DNA, 25 bp, Homo sapien
tcaaatttcgacattttcccaaagt

SEQ ID NO: 407738 - DNA, 25 bp, Homo sapien
tcgacattttcccaaagtctttatt

SEQ ID NO: 407739 - DNA, 25 bp, Homo sapien
tttatttatgccactctgcatgcct

SEQ ID NO: 407740 - DNA, 25 bp, Homo sapien
actctgcatgccttcatggagcgat

SEQ ID NO: 407741 - DNA, 25 bp, Homo sapien
catgccttcatggagcgatctttga

SEQ ID NO: 407742 - DNA, 25 bp, Homo sapien
cgatctttgagagtccgtgctgtat

SEQ ID NO: 407743 - DNA, 25 bp, Homo sapien
agtccgtgctgtatggcaaatttag

SEQ ID NO: 407744 - DNA, 25 bp, Homo sapien
tgctgtatggcaaatttaggattaa

SEQ ID NO: 407745 - DNA, 25 bp, Homo sapien
ggattaaatcacatgagtgaagccc

SEQ ID NO: 407746 - DNA, 25 bp, Homo sapien
agcccttcatttattggaagagaaa

SEQ ID NO: 407747 - DNA, 25 bp, Homo sapien
gacatagccatggtccttgcccagg

SEQ ID NO: 407748 - DNA, 25 bp, Homo sapien
agtggatgccaagccggagctcctg

SEQ ID NO: 407749 - DNA, 25 bp, Homo sapien
aagccggagctcctggacactcgga

SEQ ID NO: 407750 - DNA, 25 bp, Homo sapien
actcggatccccagtgcataaggat

SEQ ID NO: 407751 - DNA, 25 bp, Homo sapien
agacattatacgtgggcttggccca

SEQ ID NO: 407752 - DNA, 25 bp, Homo sapien
gcccacgcctgggtagtagcagtgc

SEQ ID NO: 407753 - DNA, 25 bp, Homo sapien
tagtagcagtgcctccctcaagggc

SEQ ID NO: 407754 - DNA, 25 bp, Homo sapien
actcctagggatctcttgaacctta

SEQ ID NO: 407755 - DNA, 25 bp, Homo sapien
aaaccttcaccatcatctgtggagg

SEQ ID NO: 407756 - DNA, 25 bp, Homo sapien
tcaccatcatctgtggagggcctga

SEQ ID NO: 407757 - DNA, 25 bp, Homo sapien
gagggcctgacatagccatggtcct

SEQ ID NO: 407758 - DNA, 25 bp, Homo sapien
ttagttcacttctagatgcatattt

SEQ ID NO: 407759 - DNA, 25 bp, Homo sapien
aagcatctgacattatcctcctttc

SEQ ID NO: 407760 - DNA, 25 bp, Homo sapien
tatttctaaaacaggcacattggtg

SEQ ID NO: 407761 - DNA, 25 bp, Homo sapien
gtgagatgcacctttttagttaata

SEQ ID NO: 407762 - DNA, 25 bp, Homo sapien
attcaccattttgaagctcacccta

SEQ ID NO: 407763 - DNA, 25 bp, Homo sapien
gaagctcaccctagactatgaaaat

SEQ ID NO: 407764 - DNA, 25 bp, Homo sapien
aattatattcactgcagagcaatta

SEQ ID NO: 407765 - DNA, 25 bp, Homo sapien
attacttctgtcattacctgaagtg

SEQ ID NO: 407766 - DNA, 25 bp, Homo sapien
gtgatcagtatctatcttccttgtc

SEQ ID NO: 407767 - DNA, 25 bp, Homo sapien
atcttccttgtcatagcatgcatct

SEQ ID NO: 407768 - DNA, 25 bp, Homo sapien
gtcatagcatgcatctctcaaaaag

SEQ ID NO: 407769 - DNA, 25 bp, Homo sapien
aaaatgagaccctgtacccaaagca

SEQ ID NO: 407770 - DNA, 25 bp, Homo sapien
aaatgagaccctgtacccaaagcaa

SEQ ID NO: 407771 - DNA, 25 bp, Homo sapien
aatgagaccctgtacccaaagcaaa

SEQ ID NO: 407772 - DNA, 25 bp, Homo sapien
atgagaccctgtacccaaagcaaaa

SEQ ID NO: 407773 - DNA, 25 bp, Homo sapien
tgagaccctgtacccaaagcaaaaa

SEQ ID NO: 407774 - DNA, 25 bp, Homo sapien
aaagaagcctatgtaaaaatatact

SEQ ID NO: 407775 - DNA, 25 bp, Homo sapien
aagaagcctatgtaaaaatatactg

SEQ ID NO: 407776 - DNA, 25 bp, Homo sapien
agaagcctatgtaaaaatatactgt

SEQ ID NO: 407777 - DNA, 25 bp, Homo sapien
gaagcctatgtaaaaatatactgtt

SEQ ID NO: 407778 - DNA, 25 bp, Homo sapien
aaaatgagtctataaaatattcttc

SEQ ID NO: 407779 - DNA, 25 bp, Homo sapien
tgcttaaaacacaagctacctttgt

SEQ ID NO: 407780 - DNA, 25 bp, Homo sapien
tcatctgatcagaagtgtgtcatgc

SEQ ID NO: 407781 - DNA, 25 bp, Homo sapien
tgtgtcatgcttgtttgagatggag

SEQ ID NO: 407782 - DNA, 25 bp, Homo sapien
agatggagttgctgcattttaggac

SEQ ID NO: 407783 - DNA, 25 bp, Homo sapien
ctgcattttaggactattgatacct

SEQ ID NO: 407784 - DNA, 25 bp, Homo sapien
ctctctactctttcatagactgaag

SEQ ID NO: 407785 - DNA, 25 bp, Homo sapien
gaaataggccttaaccatcatgttg

SEQ ID NO: 407786 - DNA, 25 bp, Homo sapien
catcatgttgactctcctgtcagaa

SEQ ID NO: 407787 - DNA, 25 bp, Homo sapien
ggttttattctttcatgtaattgct

SEQ ID NO: 407788 - DNA, 25 bp, Homo sapien
gtaattgcttatttgaacagatcac

SEQ ID NO: 407789 - DNA, 25 bp, Homo sapien
gaacagatcacttactaaagcttta

SEQ ID NO: 407790 - DNA, 25 bp, Homo sapien
aaagtgggcatccaggactgcttct

SEQ ID NO: 407791 - DNA, 25 bp, Homo sapien
aggactgcttctcttgctcgggaca

SEQ ID NO: 407792 - DNA, 25 bp, Homo sapien
ttgctcgggacacttcattaaacag

SEQ ID NO: 407793 - DNA, 25 bp, Homo sapien
gagtgttagcctcttcaaggacctc

SEQ ID NO: 407794 - DNA, 25 bp, Homo sapien
gttaatttgtcaccggcattcagta

SEQ ID NO: 407795 - DNA, 25 bp, Homo sapien
ctcacggttttgttggacggagttg

SEQ ID NO: 407796 - DNA, 25 bp, Homo sapien
acggagttgatgagcgcccggtact

SEQ ID NO: 407797 - DNA, 25 bp, Homo sapien
tactgatggcggatctggcggcaca

SEQ ID NO: 407798 - DNA, 25 bp, Homo sapien
aacatgtcaaaggagctcaggtctg

SEQ ID NO: 407799 - DNA, 25 bp, Homo sapien
aggtctgagcgcagctgctttgctt

SEQ ID NO: 407800 - DNA, 25 bp, Homo sapien
tttctctttgcccaaatctgaagcc

SEQ ID NO: 407801 - DNA, 25 bp, Homo sapien
catgtgtcagtgtcagtggtcgaga

SEQ ID NO: 407802 - DNA, 25 bp, Homo sapien
aaaagtgattgagccggtacctgtt

SEQ ID NO: 407803 - DNA, 25 bp, Homo sapien
ccggtacctgttactgtgggtgcaa

SEQ ID NO: 407804 - DNA, 25 bp, Homo sapien
aaaggctgcgatacacgtgggattt

SEQ ID NO: 407805 - DNA, 25 bp, Homo sapien
tacacgtgggatttggctcgctgaa

SEQ ID NO: 407806 - DNA, 25 bp, Homo sapien
ggattcttgtggagcactctgacct

SEQ ID NO: 407807 - DNA, 25 bp, Homo sapien
taactctctctatcatctctctagg

SEQ ID NO: 407808 - DNA, 25 bp, Homo sapien
taggaaaccgtatcacccaaaactg

SEQ ID NO: 407809 - DNA, 25 bp, Homo sapien
ggaagctttcattagtcacatgtca

SEQ ID NO: 407810 - DNA, 25 bp, Homo sapien
gtcacatgtcaaaaggatccggagc

SEQ ID NO: 407811 - DNA, 25 bp, Homo sapien
aggatccggagcctctttcgaaagc

SEQ ID NO: 407812 - DNA, 25 bp, Homo sapien
gggcgtggtggaaccccgattcact

SEQ ID NO: 407813 - DNA, 25 bp, Homo sapien
gattcactgctatctcccgaatcag

SEQ ID NO: 407814 - DNA, 25 bp, Homo sapien
gctatctcccgaatcagcaacttga

SEQ ID NO: 407815 - DNA, 25 bp, Homo sapien
ttggaagccttccattccgagctgg

SEQ ID NO: 407816 - DNA, 25 bp, Homo sapien
cttccattccgagctggctgggtgg

SEQ ID NO: 407817 - DNA, 25 bp, Homo sapien
agaggtaacgcctattaggatcgga

SEQ ID NO: 407818 - DNA, 25 bp, Homo sapien
gtgggactcaggttttacggtatgc

SEQ ID NO: 407819 - DNA, 25 bp, Homo sapien
caggttttacggtatgctggacttt

SEQ ID NO: 407820 - DNA, 25 bp, Homo sapien
tccccgtgagttaaaacacatttat

SEQ ID NO: 407821 - DNA, 25 bp, Homo sapien
acgcctattaggatcggaagtgatt

SEQ ID NO: 407822 - DNA, 25 bp, Homo sapien
ccaaaagggagaacggtcaatgaca

SEQ ID NO: 407823 - DNA, 25 bp, Homo sapien
tatgtccctgggttctaattctttc

SEQ ID NO: 407824 - DNA, 25 bp, Homo sapien
taattctttccctctaggtttctgt

SEQ ID NO: 407825 - DNA, 25 bp, Homo sapien
tttccctctaggtttctgtactcag

SEQ ID NO: 407826 - DNA, 25 bp, Homo sapien
gtttctgtactcagctcagagtcta

SEQ ID NO: 407827 - DNA, 25 bp, Homo sapien
ctcagagtctagaatggtagctttt

SEQ ID NO: 407828 - DNA, 25 bp, Homo sapien
ttcagtggaaaaactaatacccaga

SEQ ID NO: 407829 - DNA, 25 bp, Homo sapien
ttaacccaaaaattacatctagtga

SEQ ID NO: 407830 - DNA, 25 bp, Homo sapien
aattacatctagtgaattgtctgat

SEQ ID NO: 407831 - DNA, 25 bp, Homo sapien
tagtgaattgtctgattagctttac

SEQ ID NO: 407832 - DNA, 25 bp, Homo sapien
ctgattagctttacaattgaggcat

SEQ ID NO: 407833 - DNA, 25 bp, Homo sapien
ggttgttgcagtttgaagtctggaa

SEQ ID NO: 407834 - DNA, 25 bp, Homo sapien
aaagatttacttctgccatcaccgt

SEQ ID NO: 407835 - DNA, 25 bp, Homo sapien
accgtcaactacgtcagggacctgg

SEQ ID NO: 407836 - DNA, 25 bp, Homo sapien
gggctgcttacctcatgggatgctc

SEQ ID NO: 407837 - DNA, 25 bp, Homo sapien
ttacctcatgggatgctcagacaaa

SEQ ID NO: 407838 - DNA, 25 bp, Homo sapien
tgctcagacaaacatcttcttttct

SEQ ID NO: 407839 - DNA, 25 bp, Homo sapien
cttttcttttgggattcagatatga

SEQ ID NO: 407840 - DNA, 25 bp, Homo sapien
acaatgtctttcagcagtagagtct

SEQ ID NO: 407841 - DNA, 25 bp, Homo sapien
gaaaattcagtgtgggttccctcct

SEQ ID NO: 407842 - DNA, 25 bp, Homo sapien
tgcctattttccctcaattctggtt

SEQ ID NO: 407843 - DNA, 25 bp, Homo sapien
ttccctcaattctggttcatatcac

SEQ ID NO: 407844 - DNA, 25 bp, Homo sapien
ttctggttcatatcacaagaggagg

SEQ ID NO: 407845 - DNA, 25 bp, Homo sapien
taacccgtaacaaacaccaggcttg

SEQ ID NO: 407846 - DNA, 25 bp, Homo sapien
caggcttgggtgtaagttctttcct

SEQ ID NO: 407847 - DNA, 25 bp, Homo sapien
ataatctgcaagatgtcgccaggtc

SEQ ID NO: 407848 - DNA, 25 bp, Homo sapien
aagatgtcgccaggtcggcaacgcg

SEQ ID NO: 407849 - DNA, 25 bp, Homo sapien
ggtcggcaacgcgaactgactttga

SEQ ID NO: 407850 - DNA, 25 bp, Homo sapien
gcaacgcgaactgactttgactggg

SEQ ID NO: 407851 - DNA, 25 bp, Homo sapien
gaccgcaggtttagcgcggtcccgc

SEQ ID NO: 407852 - DNA, 25 bp, Homo sapien
aaaagttatttcctcctgagattga

SEQ ID NO: 407853 - DNA, 25 bp, Homo sapien
gagattgatggcacaaccttgtcag

SEQ ID NO: 407854 - DNA, 25 bp, Homo sapien
ggcacaaccttgtcagcaaattgct

SEQ ID NO: 407855 - DNA, 25 bp, Homo sapien
agcaaattgctgttgcctctctcag

SEQ ID NO: 407856 - DNA, 25 bp, Homo sapien
tgcgggcaggatccctggacactta

SEQ ID NO: 407857 - DNA, 25 bp, Homo sapien
gatccctggacacttacgtacaatg

SEQ ID NO: 407858 - DNA, 25 bp, Homo sapien
acttacgtacaatgcttcgtgctgc

SEQ ID NO: 407859 - DNA, 25 bp, Homo sapien
cagccgccagcgtacaagggttgtg

SEQ ID NO: 407860 - DNA, 25 bp, Homo sapien
gtacaagggttgtgcgacgcagcct

SEQ ID NO: 407861 - DNA, 25 bp, Homo sapien
aagggttgtgcgacgcagcctcagc

SEQ ID NO: 407862 - DNA, 25 bp, Homo sapien
agccctgtgttcaatcacaccatgg

SEQ ID NO: 407863 - DNA, 25 bp, Homo sapien
tgtgttcaatcacaccatggtgtac

SEQ ID NO: 407864 - DNA, 25 bp, Homo sapien
catggtgtacgatggctttgggcct

SEQ ID NO: 407865 - DNA, 25 bp, Homo sapien
gtacgatggctttgggcctgctgac

SEQ ID NO: 407866 - DNA, 25 bp, Homo sapien
tttgggcctgctgacctgcgccagg

SEQ ID NO: 407867 - DNA, 25 bp, Homo sapien
gaacaagtgagttttttccttccat

SEQ ID NO: 407868 - DNA, 25 bp, Homo sapien
tgagttttttccttccatacccaag

SEQ ID NO: 407869 - DNA, 25 bp, Homo sapien
atacccaaggacaaggagcaaccgg

SEQ ID NO: 407870 - DNA, 25 bp, Homo sapien
aagtttcagacagtagcgggtcaga

SEQ ID NO: 407871 - DNA, 25 bp, Homo sapien
ggtcagaaacgagcgaaagccacct

SEQ ID NO: 407872 - DNA, 25 bp, Homo sapien
aaagccacctcgctcttctgagcta

SEQ ID NO: 407873 - DNA, 25 bp, Homo sapien
caagggtccggcctacacagactga

SEQ ID NO: 407874 - DNA, 25 bp, Homo sapien
tacacagactgacccgggcgtttca

SEQ ID NO: 407875 - DNA, 25 bp, Homo sapien
gggcgtttcacctggtgcccgacca

SEQ ID NO: 407876 - DNA, 25 bp, Homo sapien
gctaaagacgaatgccagcaccact

SEQ ID NO: 407877 - DNA, 25 bp, Homo sapien
atgccagcaccacttttcctcattt

SEQ ID NO: 407878 - DNA, 25 bp, Homo sapien
atttcccatgttagcattattgctt

SEQ ID NO: 407879 - DNA, 25 bp, Homo sapien
ttatgattgttattgacctaattca

SEQ ID NO: 407880 - DNA, 25 bp, Homo sapien
tttactgaatcccttccatggatgg

SEQ ID NO: 407881 - DNA, 25 bp, Homo sapien
actgaatcccttccatggatggtgc

SEQ ID NO: 407882 - DNA, 25 bp, Homo sapien
attacaagggtaacagggcagaatt

SEQ ID NO: 407883 - DNA, 25 bp, Homo sapien
gggcagaattatctacccattacac

SEQ ID NO: 407884 - DNA, 25 bp, Homo sapien
gcagaattatctacccattacactg

SEQ ID NO: 407885 - DNA, 25 bp, Homo sapien
attgcttctgtttagagatgcccct

SEQ ID NO: 407886 - DNA, 25 bp, Homo sapien
ttctgtttagagatgcccctcattc

SEQ ID NO: 407887 - DNA, 25 bp, Homo sapien
tagagatgcccctcattcataggac

SEQ ID NO: 407888 - DNA, 25 bp, Homo sapien
atgcccctcattcataggactgtta

SEQ ID NO: 407889 - DNA, 25 bp, Homo sapien
ttaggcagatttgaaagcatggttt

SEQ ID NO: 407890 - DNA, 25 bp, Homo sapien
gaaattcaaaatgatcaaggctatt

SEQ ID NO: 407891 - DNA, 25 bp, Homo sapien
gatcaaggctattaacatgttatcc

SEQ ID NO: 407892 - DNA, 25 bp, Homo sapien
aaggctattaacatgttatcccaca

SEQ ID NO: 407893 - DNA, 25 bp, Homo sapien
ggctattaacatgttatcccacaca

SEQ ID NO: 407894 - DNA, 25 bp, Homo sapien
attaacatgttatcccacacaccag

SEQ ID NO: 407895 - DNA, 25 bp, Homo sapien
ttaacatgttatcccacacaccaga

SEQ ID NO: 407896 - DNA, 25 bp, Homo sapien
aacatgttatcccacacaccagaac

SEQ ID NO: 407897 - DNA, 25 bp, Homo sapien
gtaagttacaaatagataatcctga

SEQ ID NO: 407898 - DNA, 25 bp, Homo sapien
gataatcctgaatacaaggactctg

SEQ ID NO: 407899 - DNA, 25 bp, Homo sapien
ctgaagctataattgttaggcagat

SEQ ID NO: 407900 - DNA, 25 bp, Homo sapien
cttttcaggaatctttcaaaatggg

SEQ ID NO: 407901 - DNA, 25 bp, Homo sapien
ggatttggggatcagaactccttct

SEQ ID NO: 407902 - DNA, 25 bp, Homo sapien
tcagaactccttctgatcaaatgga

SEQ ID NO: 407903 - DNA, 25 bp, Homo sapien
accattattgggaagcatgcctccc

SEQ ID NO: 407904 - DNA, 25 bp, Homo sapien
acatatgattttgcatgagctatct

SEQ ID NO: 407905 - DNA, 25 bp, Homo sapien
atatgattttgcatgagctatctgg

SEQ ID NO: 407906 - DNA, 25 bp, Homo sapien
tatgattttgcatgagctatctgga

SEQ ID NO: 407907 - DNA, 25 bp, Homo sapien
atgattttgcatgagctatctggaa

SEQ ID NO: 407908 - DNA, 25 bp, Homo sapien
tgattttgcatgagctatctggaaa

SEQ ID NO: 407909 - DNA, 25 bp, Homo sapien
caggaatgcatttttggatataaaa

SEQ ID NO: 407910 - DNA, 25 bp, Homo sapien
aataaactttgtctgcggcttcgag

SEQ ID NO: 407911 - DNA, 25 bp, Homo sapien
tactatttcactgagcccaagatgg

SEQ ID NO: 407912 - DNA, 25 bp, Homo sapien
tttgcatgtctgtaacacctgtcaa

SEQ ID NO: 407913 - DNA, 25 bp, Homo sapien
gtaacacctgtcaatacttgtttgt

SEQ ID NO: 407914 - DNA, 25 bp, Homo sapien
gatttctgatattcttgcagctgac

SEQ ID NO: 407915 - DNA, 25 bp, Homo sapien
attcttgcagctgactacgtgtaat

SEQ ID NO: 407916 - DNA, 25 bp, Homo sapien
gactacgtgtaattgggcagatcag

SEQ ID NO: 407917 - DNA, 25 bp, Homo sapien
gggcagatcagctttgcagtagatt

SEQ ID NO: 407918 - DNA, 25 bp, Homo sapien
tagattatgctgcatcctcgtggca

SEQ ID NO: 407919 - DNA, 25 bp, Homo sapien
cctcgtggcaaaattctgtattctt

SEQ ID NO: 407920 - DNA, 25 bp, Homo sapien
gtgattgttacaaacccctttattg

SEQ ID NO: 407921 - DNA, 25 bp, Homo sapien
aacccctttattgctgtctgagaaa

SEQ ID NO: 407922 - DNA, 25 bp, Homo sapien
atggacctaaatattttcctatatg

SEQ ID NO: 407923 - DNA, 25 bp, Homo sapien
ttcctatatgatttgtggttgatta

SEQ ID NO: 407924 - DNA, 25 bp, Homo sapien
gaatattttagtctccttattacat

SEQ ID NO: 407925 - DNA, 25 bp, Homo sapien
tagtctccttattacatatatgttc

SEQ ID NO: 407926 - DNA, 25 bp, Homo sapien
atatgttcatggtgaactttatcaa

SEQ ID NO: 407927 - DNA, 25 bp, Homo sapien
gaactttatcaatagtatggatctt

SEQ ID NO: 407928 - DNA, 25 bp, Homo sapien
cttgtttaatctgtgcaatcagaag

SEQ ID NO: 407929 - DNA, 25 bp, Homo sapien
tgtgcaatcagaaggtgtcttgacc

SEQ ID NO: 407930 - DNA, 25 bp, Homo sapien
ggtgtcttgaccttcaattcaattg

SEQ ID NO: 407931 - DNA, 25 bp, Homo sapien
gtcttgaccttcaattcaattggtt

SEQ ID NO: 407932 - DNA, 25 bp, Homo sapien
gaccttcaattcaattggtttcttt

SEQ ID NO: 407933 - DNA, 25 bp, Homo sapien
taattctttccctctaggtttctgt

SEQ ID NO: 407934 - DNA, 25 bp, Homo sapien
tttccctctaggtttctgtactcag

SEQ ID NO: 407935 - DNA, 25 bp, Homo sapien
ctcagagtctagaatggtagctttt

SEQ ID NO: 407936 - DNA, 25 bp, Homo sapien
tagcttttaggattggaaaagacca

SEQ ID NO: 407937 - DNA, 25 bp, Homo sapien
ttcagtggaaaaactaatacccaga

SEQ ID NO: 407938 - DNA, 25 bp, Homo sapien
ttaacccaaaaattacatctagtga

SEQ ID NO: 407939 - DNA, 25 bp, Homo sapien
aattacatctagtgaattgtctgat

SEQ ID NO: 407940 - DNA, 25 bp, Homo sapien
tagtgaattgtctgattagctttac

SEQ ID NO: 407941 - DNA, 25 bp, Homo sapien
gtctgattagctttacaattgaggc

SEQ ID NO: 407942 - DNA, 25 bp, Homo sapien
ctgattagctttacaattgaggcat

SEQ ID NO: 407943 - DNA, 25 bp, Homo sapien
ggttgttgcagtttgaagtctggaa

SEQ ID NO: 407944 - DNA, 25 bp, Homo sapien
aatttatgtgtgtgtactcttccta

SEQ ID NO: 407945 - DNA, 25 bp, Homo sapien
tatgtgtgtgtactcttcctagacg

SEQ ID NO: 407946 - DNA, 25 bp, Homo sapien
gtgtgtgtactcttcctagacgtac

SEQ ID NO: 407947 - DNA, 25 bp, Homo sapien
gtgtactcttcctagacgtacaaga

SEQ ID NO: 407948 - DNA, 25 bp, Homo sapien
ttcctagacgtacaagagacttttt

SEQ ID NO: 407949 - DNA, 25 bp, Homo sapien
tacaagagactttttaatgctaaat

SEQ ID NO: 407950 - DNA, 25 bp, Homo sapien
tgctaaatatttgtcagtgcttaac

SEQ ID NO: 407951 - DNA, 25 bp, Homo sapien
tgtcagtgcttaacaaaaactcaat

SEQ ID NO: 407952 - DNA, 25 bp, Homo sapien
ggaatgttatgtatgccattaacac

SEQ ID NO: 407953 - DNA, 25 bp, Homo sapien
tatgtatgccattaacactattagg

SEQ ID NO: 407954 - DNA, 25 bp, Homo sapien
atgtgtgacatatatcagtaccttc

SEQ ID NO: 407955 - DNA, 25 bp, Homo sapien
catgtgaagatggatcagagacaga

SEQ ID NO: 407956 - DNA, 25 bp, Homo sapien
gacagaagtgatgcggctgcaagcc

SEQ ID NO: 407957 - DNA, 25 bp, Homo sapien
gaagaatggccagccaccaccggaa

SEQ ID NO: 407958 - DNA, 25 bp, Homo sapien
tggccagccaccaccggaagctagg

SEQ ID NO: 407959 - DNA, 25 bp, Homo sapien
ggagacgccagcacagattctccct

SEQ ID NO: 407960 - DNA, 25 bp, Homo sapien
gccagcacagattctccctgagagt

SEQ ID NO: 407961 - DNA, 25 bp, Homo sapien
agcacagattctccctgagagtatc

SEQ ID NO: 407962 - DNA, 25 bp, Homo sapien
acagattctccctgagagtatccag

SEQ ID NO: 407963 - DNA, 25 bp, Homo sapien
gattctccctgagagtatccagaag

SEQ ID NO: 407964 - DNA, 25 bp, Homo sapien
ttctccctgagagtatccagaagaa

SEQ ID NO: 407965 - DNA, 25 bp, Homo sapien
tccctgagagtatccagaagaaacc

SEQ ID NO: 407966 - DNA, 25 bp, Homo sapien
gatctaatagctcatcatgctcgaa

SEQ ID NO: 407967 - DNA, 25 bp, Homo sapien
gctcatcatgctcgaaagaatacag

SEQ ID NO: 407968 - DNA, 25 bp, Homo sapien
aactagaagagtggctaaggcagga

SEQ ID NO: 407969 - DNA, 25 bp, Homo sapien
gctaaggcaggaaatggaggtacaa

SEQ ID NO: 407970 - DNA, 25 bp, Homo sapien
ggaggtacaaaatcaacatgcaaaa

SEQ ID NO: 407971 - DNA, 25 bp, Homo sapien
aaagaagagtctcttgctgatgatc

SEQ ID NO: 407972 - DNA, 25 bp, Homo sapien
gatctttttagatacaatccttatt

SEQ ID NO: 407973 - DNA, 25 bp, Homo sapien
ggaaaaacttcctagtaagcatcta

SEQ ID NO: 407974 - DNA, 25 bp, Homo sapien
aagcatctacttcaggccaacaagg

SEQ ID NO: 407975 - DNA, 25 bp, Homo sapien
acttcaggccaacaaggttatatga

SEQ ID NO: 407976 - DNA, 25 bp, Homo sapien
agaagcgatttaagttacaatgttt

SEQ ID NO: 407977 - DNA, 25 bp, Homo sapien
aagcccagtgcctaaatgttcatta

SEQ ID NO: 407978 - DNA, 25 bp, Homo sapien
aatgttcattattgtctgccaggag

SEQ ID NO: 407979 - DNA, 25 bp, Homo sapien
tcattattgtctgccaggagattgt

SEQ ID NO: 407980 - DNA, 25 bp, Homo sapien
agacctttgagatttcagagcctgt

SEQ ID NO: 407981 - DNA, 25 bp, Homo sapien
gattactccaagtcagaggcagcag

SEQ ID NO: 407982 - DNA, 25 bp, Homo sapien
gaggcagcagaagccaagtgcttga

SEQ ID NO: 407983 - DNA, 25 bp, Homo sapien
agccaagtgcttgatgctagctgaa

SEQ ID NO: 407984 - DNA, 25 bp, Homo sapien
tgatgctagctgaaggactcaaatg

SEQ ID NO: 407985 - DNA, 25 bp, Homo sapien
acggaaagcggcatgtattgtacat

SEQ ID NO: 407986 - DNA, 25 bp, Homo sapien
atttgtcatggttgtctttgattaa

SEQ ID NO: 407987 - DNA, 25 bp, Homo sapien
aaaggaaactcaccgccatattcac

SEQ ID NO: 407988 - DNA, 25 bp, Homo sapien
atcctctgccagtcagattccaata

SEQ ID NO: 407989 - DNA, 25 bp, Homo sapien
tcctctgccagtcagattccaatag

SEQ ID NO: 407990 - DNA, 25 bp, Homo sapien
cctctgccagtcagattccaatagg

SEQ ID NO: 407991 - DNA, 25 bp, Homo sapien
cagattccaataggccgccctccac

SEQ ID NO: 407992 - DNA, 25 bp, Homo sapien
tggaccccgcaagcccagggacatc

SEQ ID NO: 407993 - DNA, 25 bp, Homo sapien
agggacatccaagagcacccctcct

SEQ ID NO: 407994 - DNA, 25 bp, Homo sapien
gagaccccagactcagaagcagcga

SEQ ID NO: 407995 - DNA, 25 bp, Homo sapien
gaccccagactcagaagcagcgaga

SEQ ID NO: 407996 - DNA, 25 bp, Homo sapien
agactcagaagcagcgagaaggcca

SEQ ID NO: 407997 - DNA, 25 bp, Homo sapien
ctccacagcctgtcaataaattttt

SEQ ID NO: 407998 - DNA, 25 bp, Homo sapien
cacagcctgtcaataaattttttgt

SEQ ID NO: 407999 - DNA, 25 bp, Homo sapien
atgcctggcgtctcagtcagggctg

SEQ ID NO: 408000 - DNA, 25 bp, Homo sapien
tggcgtctcagtcagggctgggctc

SEQ ID NO: 408001 - DNA, 25 bp, Homo sapien
gaaggaggcttagtggagcccacgt

SEQ ID NO: 408002 - DNA, 25 bp, Homo sapien
ttagtggagcccacgtgggcctctg

SEQ ID NO: 408003 - DNA, 25 bp, Homo sapien
gtgacacaggccacggtggctccag

SEQ ID NO: 408004 - DNA, 25 bp, Homo sapien
gtggctccagccaggaccagccaga

SEQ ID NO: 408005 - DNA, 25 bp, Homo sapien
agaccagcagagcagggagccactt

SEQ ID NO: 408006 - DNA, 25 bp, Homo sapien
gagcagggagccacttgccagggtg

SEQ ID NO: 408007 - DNA, 25 bp, Homo sapien
ggagcattgtccaggcatggcctgt

SEQ ID NO: 408008 - DNA, 25 bp, Homo sapien
gagcattgtccaggcatggcctgtg

SEQ ID NO: 408009 - DNA, 25 bp, Homo sapien
ggcccgagggccaaccaccgagcag

SEQ ID NO: 408010 - DNA, 25 bp, Homo sapien
taacaccagcacaatatgctgggaa

SEQ ID NO: 408011 - DNA, 25 bp, Homo sapien
tgaaaggatttctggtctcggtgct

SEQ ID NO: 408012 - DNA, 25 bp, Homo sapien
tggtctcggtgctgtaggtcacata

SEQ ID NO: 408013 - DNA, 25 bp, Homo sapien
gtgctgtaggtcacatagccactct

SEQ ID NO: 408014 - DNA, 25 bp, Homo sapien
atagccactctttcctggattgagg

SEQ ID NO: 408015 - DNA, 25 bp, Homo sapien
cactctttcctggattgaggctttc

SEQ ID NO: 408016 - DNA, 25 bp, Homo sapien
tggattgaggctttccagcaaaggg

SEQ ID NO: 408017 - DNA, 25 bp, Homo sapien
ggctgggacgtaaggctggcctgct

SEQ ID NO: 408018 - DNA, 25 bp, Homo sapien
ttgcctattccactgtgcacagttt

SEQ ID NO: 408019 - DNA, 25 bp, Homo sapien
cagtttgaatttggagccatgaaaa

SEQ ID NO: 408020 - DNA, 25 bp, Homo sapien
gagccatgaaaagtattgcttggtt

SEQ ID NO: 408021 - DNA, 25 bp, Homo sapien
taaagggtgccagataaaagtagtt

SEQ ID NO: 408022 - DNA, 25 bp, Homo sapien
agtagtttaggctttgcagaccata

SEQ ID NO: 408023 - DNA, 25 bp, Homo sapien
gcagaccatatagactctgtcacaa

SEQ ID NO: 408024 - DNA, 25 bp, Homo sapien
tagactctgtcacaaatgcaaaagc

SEQ ID NO: 408025 - DNA, 25 bp, Homo sapien
gcagtcgtagacagtacattaacaa

SEQ ID NO: 408026 - DNA, 25 bp, Homo sapien
tgagcatggctatgtctggtaaaag

SEQ ID NO: 408027 - DNA, 25 bp, Homo sapien
aagtttatttacaaagccaggtgtg

SEQ ID NO: 408028 - DNA, 25 bp, Homo sapien
ggtgtgaaggccagtttgtttacat

SEQ ID NO: 408029 - DNA, 25 bp, Homo sapien
aaataaactctgtaaaggcaggttg

SEQ ID NO: 408030 - DNA, 25 bp, Homo sapien
aggcaggttggagtttgctgaccct

SEQ ID NO: 408031 - DNA, 25 bp, Homo sapien
gttggagtttgctgaccctgaatta

SEQ ID NO: 408032 - DNA, 25 bp, Homo sapien
gaaggagtatcttttcctgtgtccc

SEQ ID NO: 408033 - DNA, 25 bp, Homo sapien
acagggtgcagttcaatgccaggca

SEQ ID NO: 408034 - DNA, 25 bp, Homo sapien
ttcagaggcacctattctttctgcc

SEQ ID NO: 408035 - DNA, 25 bp, Homo sapien
acagaatcagacctttgtcctcact

SEQ ID NO: 408036 - DNA, 25 bp, Homo sapien
tttgtcctcactgccagctttgtcg

SEQ ID NO: 408037 - DNA, 25 bp, Homo sapien
agctttgtcgacctgctgacaaggg

SEQ ID NO: 408038 - DNA, 25 bp, Homo sapien
atccacccagggtgcttttcaaaat

SEQ ID NO: 408039 - DNA, 25 bp, Homo sapien
atttagggagccacttgagtacttt

SEQ ID NO: 408040 - DNA, 25 bp, Homo sapien
gcctttaatttgctttggctttgtt

SEQ ID NO: 408041 - DNA, 25 bp, Homo sapien
ctttgttttatgtgtggccttgttt

SEQ ID NO: 408042 - DNA, 25 bp, Homo sapien
tgacttgagggcgacatccaggaag

SEQ ID NO: 408043 - DNA, 25 bp, Homo sapien
catgggacagtactcaataacttgt

SEQ ID NO: 408044 - DNA, 25 bp, Homo sapien
taacttgttaacatccaccatctct

SEQ ID NO: 408045 - DNA, 25 bp, Homo sapien
taacatccaccatctcttgacattt

SEQ ID NO: 408046 - DNA, 25 bp, Homo sapien
tgacatttcctactgcatttagaag

SEQ ID NO: 408047 - DNA, 25 bp, Homo sapien
gaccagggctggagtttatgataag

SEQ ID NO: 408048 - DNA, 25 bp, Homo sapien
tgagtaagtataccactcccagcac

SEQ ID NO: 408049 - DNA, 25 bp, Homo sapien
tgggtctgaccaccacctaaactgt

SEQ ID NO: 408050 - DNA, 25 bp, Homo sapien
taaactgtccttgggtttgaattct

SEQ ID NO: 408051 - DNA, 25 bp, Homo sapien
aggttttcaggaatgcacgctctgt

SEQ ID NO: 408052 - DNA, 25 bp, Homo sapien
atgcacgctctgtagtactccagaa

SEQ ID NO: 408053 - DNA, 25 bp, Homo sapien
acatcttgacagaactgtctcccaa

SEQ ID NO: 408054 - DNA, 25 bp, Homo sapien
ttgaaggccacaccatgcaccggct

SEQ ID NO: 408055 - DNA, 25 bp, Homo sapien
ggcgggtggaggacacgaggtcata

SEQ ID NO: 408056 - DNA, 25 bp, Homo sapien
aaggctgatgtctgccccacgctgc

SEQ ID NO: 408057 - DNA, 25 bp, Homo sapien
acagggcgagggtgcggccatcgtg

SEQ ID NO: 408058 - DNA, 25 bp, Homo sapien
atcgtggtcccccagtgtgacaaga

SEQ ID NO: 408059 - DNA, 25 bp, Homo sapien
ccccagtgtgacaagaagcctgtca

SEQ ID NO: 408060 - DNA, 25 bp, Homo sapien
aagaagcctgtcatctggtgagaag

SEQ ID NO: 408061 - DNA, 25 bp, Homo sapien
gcctgtcatctggtgagaaggccag

SEQ ID NO: 408062 - DNA, 25 bp, Homo sapien
gatgctggcagaggccgccagacac

SEQ ID NO: 408063 - DNA, 25 bp, Homo sapien
gaggccgccagacacgtcccagacg

SEQ ID NO: 408064 - DNA, 25 bp, Homo sapien
gggttgaaggccacaccatgcaccg

SEQ ID NO: 408065 - DNA, 25 bp, Homo sapien
agatcgacccctcggatcgaataac

SEQ ID NO: 408066 - DNA, 25 bp, Homo sapien
ataacgataaagtgagctcagggtc

SEQ ID NO: 408067 - DNA, 25 bp, Homo sapien
taacctgtggatttatctttcaaca

SEQ ID NO: 408068 - DNA, 25 bp, Homo sapien
tggatttatctttcaacatctctcc

SEQ ID NO: 408069 - DNA, 25 bp, Homo sapien
tccaccctaatacaagcacagctag

SEQ ID NO: 408070 - DNA, 25 bp, Homo sapien
agcacagctagttggctttgtaacg

SEQ ID NO: 408071 - DNA, 25 bp, Homo sapien
gctagttggctttgtaacgcctcaa

SEQ ID NO: 408072 - DNA, 25 bp, Homo sapien
gctttgtaacgcctcaaagaactcc

SEQ ID NO: 408073 - DNA, 25 bp, Homo sapien
aaagaactccatcacagatgccctg

SEQ ID NO: 408074 - DNA, 25 bp, Homo sapien
acagatgccctgattatccctgcac

SEQ ID NO: 408075 - DNA, 25 bp, Homo sapien
agcctgaaggccgtcctgaagacaa

SEQ ID NO: 408076 - DNA, 25 bp, Homo sapien
gccctgcgctggatacctaagcctt

SEQ ID NO: 408077 - DNA, 25 bp, Homo sapien
ccctgcgctggatacctaagccttg

SEQ ID NO: 408078 - DNA, 25 bp, Homo sapien
ctgcgctggatacctaagccttggg

SEQ ID NO: 408079 - DNA, 25 bp, Homo sapien
gcgctggatacctaagccttgggag

SEQ ID NO: 408080 - DNA, 25 bp, Homo sapien
atacctaagccttgggagcggacag

SEQ ID NO: 408081 - DNA, 25 bp, Homo sapien
ggacagggccgccacctcgagaagg

SEQ ID NO: 408082 - DNA, 25 bp, Homo sapien
acagggccgccacctcgagaagggc

SEQ ID NO: 408083 - DNA, 25 bp, Homo sapien
gagaagggccctcccgacgggcaga

SEQ ID NO: 408084 - DNA, 25 bp, Homo sapien
agggccctcccgacgggcagaggag

SEQ ID NO: 408085 - DNA, 25 bp, Homo sapien
tcccgacgggcagaggagcctgggt

SEQ ID NO: 408086 - DNA, 25 bp, Homo sapien
accccgctgagggagttcctcttgc

SEQ ID NO: 408087 - DNA, 25 bp, Homo sapien
aggcattcagcctatggcccttgac

SEQ ID NO: 408088 - DNA, 25 bp, Homo sapien
atggcccttgacatttggctgcagg

SEQ ID NO: 408089 - DNA, 25 bp, Homo sapien
gacatttggctgcaggttaccgtca

SEQ ID NO: 408090 - DNA, 25 bp, Homo sapien
ggttaccgtcagaatcaacaccata

SEQ ID NO: 408091 - DNA, 25 bp, Homo sapien
aatcaacaccatatcctgaggaagc

SEQ ID NO: 408092 - DNA, 25 bp, Homo sapien
tgaggaagccctggtatttccccaa

SEQ ID NO: 408093 - DNA, 25 bp, Homo sapien
tatttccccaagtctgcctatgtat

SEQ ID NO: 408094 - DNA, 25 bp, Homo sapien
tctgcctatgtattagacactctaa

SEQ ID NO: 408095 - DNA, 25 bp, Homo sapien
taacacagttcagtttttgagggaa

SEQ ID NO: 408096 - DNA, 25 bp, Homo sapien
tttgtcataatactacacccctcta

SEQ ID NO: 408097 - DNA, 25 bp, Homo sapien
gtccgtgttggcctgatgctttaag

SEQ ID NO: 408098 - DNA, 25 bp, Homo sapien
aacaattgtctgcactgggagtcgt

SEQ ID NO: 408099 - DNA, 25 bp, Homo sapien
tctgcactgggagtcgtacgaggta

SEQ ID NO: 408100 - DNA, 25 bp, Homo sapien
acctctgatcctctcattagtgatt

SEQ ID NO: 408101 - DNA, 25 bp, Homo sapien
ttaccagtcagctgagtaattcact

SEQ ID NO: 408102 - DNA, 25 bp, Homo sapien
gtaaacatttggcactgacagaggt

SEQ ID NO: 408103 - DNA, 25 bp, Homo sapien
ggcactgacagaggttagacggata

SEQ ID NO: 408104 - DNA, 25 bp, Homo sapien
gacggataactatttgtatcaccat

SEQ ID NO: 408105 - DNA, 25 bp, Homo sapien
gtatcaccatattcatgaagctgga

SEQ ID NO: 408106 - DNA, 25 bp, Homo sapien
gataagaagcacagcagaagctatt

SEQ ID NO: 408107 - DNA, 25 bp, Homo sapien
attctaggcaggaagtcaatccatt

SEQ ID NO: 408108 - DNA, 25 bp, Homo sapien
aagtcaatccattcaactgtctgtg

SEQ ID NO: 408109 - DNA, 25 bp, Homo sapien
gcagcaaagcatgaacacataacaa

SEQ ID NO: 408110 - DNA, 25 bp, Homo sapien
tgtcccgtaatctatttaaccaatc

SEQ ID NO: 408111 - DNA, 25 bp, Homo sapien
tcacattatgtgcaatggcttaaag

SEQ ID NO: 408112 - DNA, 25 bp, Homo sapien
gtgcaatggcttaaagagtgaacaa

SEQ ID NO: 408113 - DNA, 25 bp, Homo sapien
aatctatttaaccaatccctgtcac

SEQ ID NO: 408114 - DNA, 25 bp, Homo sapien
tatttaaccaatccctgtcactgga

SEQ ID NO: 408115 - DNA, 25 bp, Homo sapien
gcttgcatctccatcactgcagtaa

SEQ ID NO: 408116 - DNA, 25 bp, Homo sapien
ctgtcactggaattaaggcgggatt

SEQ ID NO: 408117 - DNA, 25 bp, Homo sapien
attaaggcgggattcacattctcac

SEQ ID NO: 408118 - DNA, 25 bp, Homo sapien
aaggcgggattcacattctcactat

SEQ ID NO: 408119 - DNA, 25 bp, Homo sapien
atgatatgttgcagtgcccatcttt

SEQ ID NO: 408120 - DNA, 25 bp, Homo sapien
aacaaacttgctaatcactttacca

SEQ ID NO: 408121 - DNA, 25 bp, Homo sapien
ttgctaatcactttaccaatgttat

SEQ ID NO: 408122 - DNA, 25 bp, Homo sapien
ggattttagctggataacttactgc

SEQ ID NO: 408123 - DNA, 25 bp, Homo sapien
aacttactgcttttatctgacccaa

SEQ ID NO: 408124 - DNA, 25 bp, Homo sapien
tctgacccaagcaagtactacatgt

SEQ ID NO: 408125 - DNA, 25 bp, Homo sapien
tgccctatgtagctcctaactgttg

SEQ ID NO: 408126 - DNA, 25 bp, Homo sapien
ctaactgttgtgtgatttggacggc

SEQ ID NO: 408127 - DNA, 25 bp, Homo sapien
ttttgcatatttgtgtcagtttgat

SEQ ID NO: 408128 - DNA, 25 bp, Homo sapien
gtttgatgttaaccacaagtgccag

SEQ ID NO: 408129 - DNA, 25 bp, Homo sapien
cacaagtgccagactgatttttcag

SEQ ID NO: 408130 - DNA, 25 bp, Homo sapien
actgatttttcagacggagcctatt

SEQ ID NO: 408131 - DNA, 25 bp, Homo sapien
atatgaaaacactgcatgacaatgt

SEQ ID NO: 408132 - DNA, 25 bp, Homo sapien
cactgcatgacaatgtgttaaaaca

SEQ ID NO: 408133 - DNA, 25 bp, Homo sapien
aacattatgacatcagtgctcattt

SEQ ID NO: 408134 - DNA, 25 bp, Homo sapien
gacatcagtgctcattttattgaca

SEQ ID NO: 408135 - DNA, 25 bp, Homo sapien
tttattgacatcactgtagctttca

SEQ ID NO: 408136 - DNA, 25 bp, Homo sapien
ttgacatcactgtagctttcaggag

SEQ ID NO: 408137 - DNA, 25 bp, Homo sapien
acatcactgtagctttcaggagaaa

SEQ ID NO: 408138 - DNA, 25 bp, Homo sapien
gttattttttcttgaactctaatag

SEQ ID NO: 408139 - DNA, 25 bp, Homo sapien
tatgttttgtgaaattgcttaggaa

SEQ ID NO: 408140 - DNA, 25 bp, Homo sapien
ttatgccatgtgaataaaaatgcct

SEQ ID NO: 408141 - DNA, 25 bp, Homo sapien
aaatgcctgcttctctttcacttta

SEQ ID NO: 408142 - DNA, 25 bp, Homo sapien
atgccaagaaactggctttggccat

SEQ ID NO: 408143 - DNA, 25 bp, Homo sapien
ggctttggccataatacttgctgtc

SEQ ID NO: 408144 - DNA, 25 bp, Homo sapien
ggccataatacttgctgtccaacaa

SEQ ID NO: 408145 - DNA, 25 bp, Homo sapien
tgtccaacaaaatcacagctgttaa

SEQ ID NO: 408146 - DNA, 25 bp, Homo sapien
cagctgttaatatgcaattgcttgc

SEQ ID NO: 408147 - DNA, 25 bp, Homo sapien
ttgcttgcaacaattagctaaacag

SEQ ID NO: 408148 - DNA, 25 bp, Homo sapien
gctaaacagcattatttgacaaatt

SEQ ID NO: 408149 - DNA, 25 bp, Homo sapien
ttgacaaattcccttgaaagagaca

SEQ ID NO: 408150 - DNA, 25 bp, Homo sapien
gatgctatttaagtgtctagcacac

SEQ ID NO: 408151 - DNA, 25 bp, Homo sapien
gtctagcacactgaatcaagtaact

SEQ ID NO: 408152 - DNA, 25 bp, Homo sapien
tcaagtaactatcagttaggctggg

SEQ ID NO: 408153 - DNA, 25 bp, Homo sapien
gggtgtgtaatgagggactcctatc

SEQ ID NO: 408154 - DNA, 25 bp, Homo sapien
gggactcctatcgaagtcagctgta

SEQ ID NO: 408155 - DNA, 25 bp, Homo sapien
gtcagctgtaagtctatcttgccta

SEQ ID NO: 408156 - DNA, 25 bp, Homo sapien
gtctatcttgcctattcattataca

SEQ ID NO: 408157 - DNA, 25 bp, Homo sapien
tcattatacaggctgtcgtcttcgc

SEQ ID NO: 408158 - DNA, 25 bp, Homo sapien
tactatcatctctacttttgaaatg

SEQ ID NO: 408159 - DNA, 25 bp, Homo sapien
gtcgtcttcgcgcagtaaggataat

SEQ ID NO: 408160 - DNA, 25 bp, Homo sapien
gattcaaagaccatccagcttgcac

SEQ ID NO: 408161 - DNA, 25 bp, Homo sapien
ggcaagggcaagtcttatttacctt

SEQ ID NO: 408162 - DNA, 25 bp, Homo sapien
acaaatgtgtctcttctagggaacc

SEQ ID NO: 408163 - DNA, 25 bp, Homo sapien
tagggaaccacactaccttattctc

SEQ ID NO: 408164 - DNA, 25 bp, Homo sapien
tggagccccagagtgtgccacttct

SEQ ID NO: 408165 - DNA, 25 bp, Homo sapien
cccagagtgtgccacttctggccag

SEQ ID NO: 408166 - DNA, 25 bp, Homo sapien
caagcaccaacaggaaatacccacc

SEQ ID NO: 408167 - DNA, 25 bp, Homo sapien
acccctgcccgtggacaagctggaa

SEQ ID NO: 408168 - DNA, 25 bp, Homo sapien
aattaaccggagaatggcagacgac

SEQ ID NO: 408169 - DNA, 25 bp, Homo sapien
gaatggcagacgacaataagctctt

SEQ ID NO: 408170 - DNA, 25 bp, Homo sapien
ggcagacgacaataagctcttcagg

SEQ ID NO: 408171 - DNA, 25 bp, Homo sapien
agacgacaataagctcttcagggag

SEQ ID NO: 408172 - DNA, 25 bp, Homo sapien
aataagctcttcagggaggaattca

SEQ ID NO: 408173 - DNA, 25 bp, Homo sapien
atgtcctatccaggccacctgtgag

SEQ ID NO: 408174 - DNA, 25 bp, Homo sapien
cctatccaggccacctgtgaggctg

SEQ ID NO: 408175 - DNA, 25 bp, Homo sapien
ggaagttggacatgcatattcccaa

SEQ ID NO: 408176 - DNA, 25 bp, Homo sapien
gaagttggacatgcatattcccaaa

SEQ ID NO: 408177 - DNA, 25 bp, Homo sapien
aagttggacatgcatattcccaaag

SEQ ID NO: 408178 - DNA, 25 bp, Homo sapien
agttggacatgcatattcccaaaga

SEQ ID NO: 408179 - DNA, 25 bp, Homo sapien
gttggacatgcatattcccaaagag

SEQ ID NO: 408180 - DNA, 25 bp, Homo sapien
ttggacatgcatattcccaaagaga

SEQ ID NO: 408181 - DNA, 25 bp, Homo sapien
aagagaacagtgttggaaggagaca

SEQ ID NO: 408182 - DNA, 25 bp, Homo sapien
agagaacagtgttggaaggagacag

SEQ ID NO: 408183 - DNA, 25 bp, Homo sapien
ttttggccaggtgtagggggcacgc

SEQ ID NO: 408184 - DNA, 25 bp, Homo sapien
ttggccaggtgtagggggcacgcca

SEQ ID NO: 408185 - DNA, 25 bp, Homo sapien
ggccaggtgtagggggcacgccagt

SEQ ID NO: 408186 - DNA, 25 bp, Homo sapien
gccaggtgtagggggcacgccagta

SEQ ID NO: 408187 - DNA, 25 bp, Homo sapien
ccaggtgtagggggcacgccagtaa

SEQ ID NO: 408188 - DNA, 25 bp, Homo sapien
cacaagaattgtttgaacccgggtg

SEQ ID NO: 408189 - DNA, 25 bp, Homo sapien
aggtgtagggggcacgccagtaatc

SEQ ID NO: 408190 - DNA, 25 bp, Homo sapien
gtgtagggggcacgccagtaatccc

SEQ ID NO: 408191 - DNA, 25 bp, Homo sapien
agatcatgccactgcgctcctagcc

SEQ ID NO: 408192 - DNA, 25 bp, Homo sapien
gatcatgccactgcgctcctagcct

SEQ ID NO: 408193 - DNA, 25 bp, Homo sapien
aagactccatctcaatttaaaacaa

SEQ ID NO: 408194 - DNA, 25 bp, Homo sapien
ccaagctatcatgcttaagctatgt

SEQ ID NO: 408195 - DNA, 25 bp, Homo sapien
atcatgcttaagctatgtcaacagc

SEQ ID NO: 408196 - DNA, 25 bp, Homo sapien
gtcaacagcatttatttgtactaat

SEQ ID NO: 408197 - DNA, 25 bp, Homo sapien
tatttgtactaatgctaatatttcc

SEQ ID NO: 408198 - DNA, 25 bp, Homo sapien
tatttccatcaaaatttgcctgtgg

SEQ ID NO: 408199 - DNA, 25 bp, Homo sapien
atcaaaatttgcctgtggaatatat

SEQ ID NO: 408200 - DNA, 25 bp, Homo sapien
tgtcagttcttgagatataccgtgt

SEQ ID NO: 408201 - DNA, 25 bp, Homo sapien
atataccgtgtgaagctattgtcag

SEQ ID NO: 408202 - DNA, 25 bp, Homo sapien
gctattgtcagcttctctatttcaa

SEQ ID NO: 408203 - DNA, 25 bp, Homo sapien
gtcagcttctctatttcaaaatgca

SEQ ID NO: 408204 - DNA, 25 bp, Homo sapien
aatttgtgaatgcatatgtatgtgt

SEQ ID NO: 408205 - DNA, 25 bp, Homo sapien
gggttcggcttcattcctacctgcc

SEQ ID NO: 408206 - DNA, 25 bp, Homo sapien
cagcctcgaaaacaaagcgactggt

SEQ ID NO: 408207 - DNA, 25 bp, Homo sapien
aacaaagcgactggtctgacgtggg

SEQ ID NO: 408208 - DNA, 25 bp, Homo sapien
gagccagtacccgtgggatgtcacc

SEQ ID NO: 408209 - DNA, 25 bp, Homo sapien
tgggtttcggcctctgcgaaagtga

SEQ ID NO: 408210 - DNA, 25 bp, Homo sapien
tgcgaaagtgaaatgcccaagcctc

SEQ ID NO: 408211 - DNA, 25 bp, Homo sapien
gtgaaatgcccaagcctccggccaa

SEQ ID NO: 408212 - DNA, 25 bp, Homo sapien
gccaaagcccagaccagtacagtat

SEQ ID NO: 408213 - DNA, 25 bp, Homo sapien
aagcccagaccagtacagtatgaat

SEQ ID NO: 408214 - DNA, 25 bp, Homo sapien
gaccagtacagtatgaattgtccta

SEQ ID NO: 408215 - DNA, 25 bp, Homo sapien
atgaattgtcctatgagactgaggg

SEQ ID NO: 408216 - DNA, 25 bp, Homo sapien
ggaacaaagcctccttgcagagaaa

SEQ ID NO: 408217 - DNA, 25 bp, Homo sapien
ctccttgcagagaaatcttgtactt

SEQ ID NO: 408218 - DNA, 25 bp, Homo sapien
tgtactttggtgtttcatcatctgt

SEQ ID NO: 408219 - DNA, 25 bp, Homo sapien
ttggtgtttcatcatctgtttgtgt

SEQ ID NO: 408220 - DNA, 25 bp, Homo sapien
gcagcccggttgagcctgaggacca

SEQ ID NO: 408221 - DNA, 25 bp, Homo sapien
cctgaggaccagacttgaggcagtt

SEQ ID NO: 408222 - DNA, 25 bp, Homo sapien
aggcagttggcagtccgcgcctcgt

SEQ ID NO: 408223 - DNA, 25 bp, Homo sapien
cccgttcagaggtaactggcatcct

SEQ ID NO: 408224 - DNA, 25 bp, Homo sapien
catcctggttttcatgttgatcagt

SEQ ID NO: 408225 - DNA, 25 bp, Homo sapien
ttcatgttgatcagtggtgtttaaa

SEQ ID NO: 408226 - DNA, 25 bp, Homo sapien
gtgtttaaagtacacctgtaggaag

SEQ ID NO: 408227 - DNA, 25 bp, Homo sapien
gcttcagtccaaagtttgaggctgc

SEQ ID NO: 408228 - DNA, 25 bp, Homo sapien
cagaattgtccaggacatttttccc

SEQ ID NO: 408229 - DNA, 25 bp, Homo sapien
cttctgggtatctccaattcttcta

SEQ ID NO: 408230 - DNA, 25 bp, Homo sapien
ctgggtatctccaattcttctatcc

SEQ ID NO: 408231 - DNA, 25 bp, Homo sapien
gtatctccaattcttctatccctgg

SEQ ID NO: 408232 - DNA, 25 bp, Homo sapien
tatccctggttcacctcagagtatt

SEQ ID NO: 408233 - DNA, 25 bp, Homo sapien
ctggttcacctcagagtattgcagt

SEQ ID NO: 408234 - DNA, 25 bp, Homo sapien
gttcacctcagagtattgcagttct

SEQ ID NO: 408235 - DNA, 25 bp, Homo sapien
tcagagtattgcagttctgagaacc

SEQ ID NO: 408236 - DNA, 25 bp, Homo sapien
aagtgcggttgtggtgatgtacacc

SEQ ID NO: 408237 - DNA, 25 bp, Homo sapien
ttgtggtgatgtacaccagtagtcc

SEQ ID NO: 408238 - DNA, 25 bp, Homo sapien
gaatacttagatgttttcataagat

SEQ ID NO: 408239 - DNA, 25 bp, Homo sapien
aaaacctgaattgtgatttctacat

SEQ ID NO: 408240 - DNA, 25 bp, Homo sapien
aacctgaattgtgatttctacataa

SEQ ID NO: 408241 - DNA, 25 bp, Homo sapien
gaattgtgatttctacataatgtga

SEQ ID NO: 408242 - DNA, 25 bp, Homo sapien
cataatgtgataattagggttcaaa

SEQ ID NO: 408243 - DNA, 25 bp, Homo sapien
aattatgactcatcatttaattgat

SEQ ID NO: 408244 - DNA, 25 bp, Homo sapien
gtatatttctgaactctttattgcc

SEQ ID NO: 408245 - DNA, 25 bp, Homo sapien
atatttctgaactctttattgcctc

SEQ ID NO: 408246 - DNA, 25 bp, Homo sapien
atttctgaactctttattgcctcca

SEQ ID NO: 408247 - DNA, 25 bp, Homo sapien
tttctgaactctttattgcctccat

SEQ ID NO: 408248 - DNA, 25 bp, Homo sapien
ttctgaactctttattgcctccatt

SEQ ID NO: 408249 - DNA, 25 bp, Homo sapien
gggtagaaggtactccaaataccat

SEQ ID NO: 408250 - DNA, 25 bp, Homo sapien
ccaaataccattcccggtagctggg

SEQ ID NO: 408251 - DNA, 25 bp, Homo sapien
accattcccggtagctgggtcggag

SEQ ID NO: 408252 - DNA, 25 bp, Homo sapien
acaccgctgcgagtgcggttgtctg

SEQ ID NO: 408253 - DNA, 25 bp, Homo sapien
ttgtctgcgtgctcgtgagagctag

SEQ ID NO: 408254 - DNA, 25 bp, Homo sapien
gctcgtgagagctagaattctgcag

SEQ ID NO: 408255 - DNA, 25 bp, Homo sapien
gaattctgcagccaggaacagcccc

SEQ ID NO: 408256 - DNA, 25 bp, Homo sapien
ccttgtgtgaatgaaatggcagttt

SEQ ID NO: 408257 - DNA, 25 bp, Homo sapien
aatggcagtttccaaagttgcggac

SEQ ID NO: 408258 - DNA, 25 bp, Homo sapien
agtttccaaagttgcggacgcctcg

SEQ ID NO: 408259 - DNA, 25 bp, Homo sapien
ctgtcgtagacagcttgtacacaaa

SEQ ID NO: 408260 - DNA, 25 bp, Homo sapien
gggtaatctagcaggtgagctgcta

SEQ ID NO: 408261 - DNA, 25 bp, Homo sapien
gtgagctgctagattaacgctgtct

SEQ ID NO: 408262 - DNA, 25 bp, Homo sapien
gctagattaacgctgtctccataaa

SEQ ID NO: 408263 - DNA, 25 bp, Homo sapien
gctgtctccataaagcgtcaaagat

SEQ ID NO: 408264 - DNA, 25 bp, Homo sapien
acagaaattcagcacatgttttgtt

SEQ ID NO: 408265 - DNA, 25 bp, Homo sapien
tttctgtgcgttagccaagagggag

SEQ ID NO: 408266 - DNA, 25 bp, Homo sapien
tgtgcgttagccaagagggagacat

SEQ ID NO: 408267 - DNA, 25 bp, Homo sapien
aaatacagtctcatcccttaggaag

SEQ ID NO: 408268 - DNA, 25 bp, Homo sapien
gtctcatcccttaggaaggcagttt

SEQ ID NO: 408269 - DNA, 25 bp, Homo sapien
ttaggaaggcagtttaccattcaaa

SEQ ID NO: 408270 - DNA, 25 bp, Homo sapien
tacaaggcagaaggctataggtatc

SEQ ID NO: 408271 - DNA, 25 bp, Homo sapien
gtattattattgctgtcgcctaaac

SEQ ID NO: 408272 - DNA, 25 bp, Homo sapien
attgctgtcgcctaaacaatgttag

SEQ ID NO: 408273 - DNA, 25 bp, Homo sapien
aaaatcattagcttatccttatata

SEQ ID NO: 408274 - DNA, 25 bp, Homo sapien
aattgctataagtacatgccagacg

SEQ ID NO: 408275 - DNA, 25 bp, Homo sapien
gtacatgccagacgtccatgacatt

SEQ ID NO: 408276 - DNA, 25 bp, Homo sapien
gccagacgtccatgacattatcttc

SEQ ID NO: 408277 - DNA, 25 bp, Homo sapien
cattatcttcaaactcacaggtcaa

SEQ ID NO: 408278 - DNA, 25 bp, Homo sapien
ctcacaggtcaactaaaattatcgt

SEQ ID NO: 408279 - DNA, 25 bp, Homo sapien
gtagaaatgagaagactgccagatc

SEQ ID NO: 408280 - DNA, 25 bp, Homo sapien
gactgccagatcaagaaagtctaaa

SEQ ID NO: 408281 - DNA, 25 bp, Homo sapien
aaaggacaacagaccattcctgaaa

SEQ ID NO: 408282 - DNA, 25 bp, Homo sapien
ggcaattctgatgtagcagcccatg

SEQ ID NO: 408283 - DNA, 25 bp, Homo sapien
gaaagaacccccttgaagccagctg

SEQ ID NO: 408284 - DNA, 25 bp, Homo sapien
agctgtcctctcttgcagcatgatt

SEQ ID NO: 408285 - DNA, 25 bp, Homo sapien
gtcctctcttgcagcatgattttaa

SEQ ID NO: 408286 - DNA, 25 bp, Homo sapien
gcatgttgatcaagaacccttcata

SEQ ID NO: 408287 - DNA, 25 bp, Homo sapien
caagaacccttcataccatcttaag

SEQ ID NO: 408288 - DNA, 25 bp, Homo sapien
ccatcttaagggttctagtttgcaa

SEQ ID NO: 408289 - DNA, 25 bp, Homo sapien
taagggttctagtttgcaagtacgg

SEQ ID NO: 408290 - DNA, 25 bp, Homo sapien
ttgcaagtacgggaagagcccttcc

SEQ ID NO: 408291 - DNA, 25 bp, Homo sapien
gaagagcccttcctatggcaaagga

SEQ ID NO: 408292 - DNA, 25 bp, Homo sapien
ggaaagatccccttagttgcaatta

SEQ ID NO: 408293 - DNA, 25 bp, Homo sapien
gccaacctctacaacattctttaag

SEQ ID NO: 408294 - DNA, 25 bp, Homo sapien
gtgaaccttgtattcagcaaaaaat

SEQ ID NO: 408295 - DNA, 25 bp, Homo sapien
gtcatcaataccagtacacctttgg

SEQ ID NO: 408296 - DNA, 25 bp, Homo sapien
cacctttggcacctggtactcagat

SEQ ID NO: 408297 - DNA, 25 bp, Homo sapien
ggtttattgttccaccacaaggtct

SEQ ID NO: 408298 - DNA, 25 bp, Homo sapien
gttccaccacaaggtcttggagctg

SEQ ID NO: 408299 - DNA, 25 bp, Homo sapien
gccatgttctccttatatctactaa

SEQ ID NO: 408300 - DNA, 25 bp, Homo sapien
caaggcattcaatctacaccaatag

SEQ ID NO: 408301 - DNA, 25 bp, Homo sapien
tacaccaatagataactctgcccag

SEQ ID NO: 408302 - DNA, 25 bp, Homo sapien
ataactctgcccagaagatcacact

SEQ ID NO: 408303 - DNA, 25 bp, Homo sapien
ttaagtgggccaacctctacaacat

SEQ ID NO: 408304 - DNA, 25 bp, Homo sapien
tttggcctactaagttcattcctag

SEQ ID NO: 408305 - DNA, 25 bp, Homo sapien
ctgcctaatgggaatgatctgacaa

SEQ ID NO: 408306 - DNA, 25 bp, Homo sapien
gcaccatgatttgaacaagcacttc

SEQ ID NO: 408307 - DNA, 25 bp, Homo sapien
agcaaagtcattgcacctttgttct

SEQ ID NO: 408308 - DNA, 25 bp, Homo sapien
ttaaaactagcccaaatgccctgtc

SEQ ID NO: 408309 - DNA, 25 bp, Homo sapien
atgccctgtcagtaagggactggtt

SEQ ID NO: 408310 - DNA, 25 bp, Homo sapien
gatggtacctttatgcaatttgttt

SEQ ID NO: 408311 - DNA, 25 bp, Homo sapien
aagcacttccaattacattacccat

SEQ ID NO: 408312 - DNA, 25 bp, Homo sapien
cattacccatcttgtatgccatagg

SEQ ID NO: 408313 - DNA, 25 bp, Homo sapien
gggagtataattgtcacagccttta

SEQ ID NO: 408314 - DNA, 25 bp, Homo sapien
acagcctttaggaatgtagttttct

SEQ ID NO: 408315 - DNA, 25 bp, Homo sapien
gaaaaggtgcttgaggaccccactg

SEQ ID NO: 408316 - DNA, 25 bp, Homo sapien
tgaggaccccactgcctaaggacct

SEQ ID NO: 408317 - DNA, 25 bp, Homo sapien
cagtcaacccttaaggacctcaaat

SEQ ID NO: 408318 - DNA, 25 bp, Homo sapien
agagttgaaagtgccaagtcctagt

SEQ ID NO: 408319 - DNA, 25 bp, Homo sapien
aagtgccaagtcctagtggttttga

SEQ ID NO: 408320 - DNA, 25 bp, Homo sapien
tggttttgagaagcctctggtctgc

SEQ ID NO: 408321 - DNA, 25 bp, Homo sapien
agaagcctctggtctgctctttctg

SEQ ID NO: 408322 - DNA, 25 bp, Homo sapien
gctctttctgctctgtaaagtctta

SEQ ID NO: 408323 - DNA, 25 bp, Homo sapien
taaagtcttagttgccagagtcccc

SEQ ID NO: 408324 - DNA, 25 bp, Homo sapien
ttagttgccagagtcccctatagcc

SEQ ID NO: 408325 - DNA, 25 bp, Homo sapien
gttccccaaaggatgacatgcactg

SEQ ID NO: 408326 - DNA, 25 bp, Homo sapien
aaggtttcgatgttatgagttttca

SEQ ID NO: 408327 - DNA, 25 bp, Homo sapien
gttttcaagaaactgttcctctcat

SEQ ID NO: 408328 - DNA, 25 bp, Homo sapien
gaaactgttcctctcatgtccgtaa

SEQ ID NO: 408329 - DNA, 25 bp, Homo sapien
tcatgtccgtaacccggttctacct

SEQ ID NO: 408330 - DNA, 25 bp, Homo sapien
gttctacctcgtagtccccattcaa

SEQ ID NO: 408331 - DNA, 25 bp, Homo sapien
gtagtccccattcaagcacgctagg

SEQ ID NO: 408332 - DNA, 25 bp, Homo sapien
aagcacgctagggtcgtctttgtga

SEQ ID NO: 408333 - DNA, 25 bp, Homo sapien
cgtctttgtgatatgaaccttccct

SEQ ID NO: 408334 - DNA, 25 bp, Homo sapien
ggccaaggtcacatcattggaccac

SEQ ID NO: 408335 - DNA, 25 bp, Homo sapien
acatcattggaccacacgtcgtact

SEQ ID NO: 408336 - DNA, 25 bp, Homo sapien
acagaggaccctgcccgtgtgcaga

SEQ ID NO: 408337 - DNA, 25 bp, Homo sapien
tataccactgggacacgactaaaag

SEQ ID NO: 408338 - DNA, 25 bp, Homo sapien
acgactaaaagtcttacagcaatga

SEQ ID NO: 408339 - DNA, 25 bp, Homo sapien
tacagcaatgagaatggaacctcgt

SEQ ID NO: 408340 - DNA, 25 bp, Homo sapien
ttacactgctctattctgaattgaa

SEQ ID NO: 408341 - DNA, 25 bp, Homo sapien
ctctattctgaattgaagttgcatt

SEQ ID NO: 408342 - DNA, 25 bp, Homo sapien
ggaggctgggtcacatgcctgcatt

SEQ ID NO: 408343 - DNA, 25 bp, Homo sapien
tgggtcacatgcctgcattctggtt

SEQ ID NO: 408344 - DNA, 25 bp, Homo sapien
cacatgcctgcattctggttttaag

SEQ ID NO: 408345 - DNA, 25 bp, Homo sapien
gatagacagccatggatatggcagt

SEQ ID NO: 408346 - DNA, 25 bp, Homo sapien
ccatggatatggcagttgtcaacta

SEQ ID NO: 408347 - DNA, 25 bp, Homo sapien
tatggcagttgtcaactatagcagt

SEQ ID NO: 408348 - DNA, 25 bp, Homo sapien
gtggttgcacaaatgtacttcgttt

SEQ ID NO: 408349 - DNA, 25 bp, Homo sapien
gtacttcgttttgacctgaaaatgc

SEQ ID NO: 408350 - DNA, 25 bp, Homo sapien
ctgagactctgcaaccttaaaggaa

SEQ ID NO: 408351 - DNA, 25 bp, Homo sapien
gggtcatgggtaacaatgtctactg

SEQ ID NO: 408352 - DNA, 25 bp, Homo sapien
aatgtctactgtgtacttcctttcc

SEQ ID NO: 408353 - DNA, 25 bp, Homo sapien
aagtccctgtctaccgtcagcattt

SEQ ID NO: 408354 - DNA, 25 bp, Homo sapien
gtctaccgtcagcatttccaaaatt

SEQ ID NO: 408355 - DNA, 25 bp, Homo sapien
tttgtggaggtgctagaactacttc

SEQ ID NO: 408356 - DNA, 25 bp, Homo sapien
gtgctagaactacttctgtcttgtg

SEQ ID NO: 408357 - DNA, 25 bp, Homo sapien
ttcaagaaacctttgcatgggcatt

SEQ ID NO: 408358 - DNA, 25 bp, Homo sapien
gcatgggcattatgtggttgcacaa

SEQ ID NO: 408359 - DNA, 25 bp, Homo sapien
cccggtgcaaggatgtaatctctct

SEQ ID NO: 408360 - DNA, 25 bp, Homo sapien
ggatgtaatctctcttggagctgta

SEQ ID NO: 408361 - DNA, 25 bp, Homo sapien
tctctcttggagctgtaaaatctgg

SEQ ID NO: 408362 - DNA, 25 bp, Homo sapien
ttggagctgtaaaatctgggaggtt

SEQ ID NO: 408363 - DNA, 25 bp, Homo sapien
gaggttggagggaactccagctcct

SEQ ID NO: 408364 - DNA, 25 bp, Homo sapien
ggagggaactccagctcctcagcat

SEQ ID NO: 408365 - DNA, 25 bp, Homo sapien
tgggctgctgctgcaagcaaggcat

SEQ ID NO: 408366 - DNA, 25 bp, Homo sapien
tgctgcaagcaaggcattgaggcaa

SEQ ID NO: 408367 - DNA, 25 bp, Homo sapien
gcaagcaaggcattgaggcaaatat

SEQ ID NO: 408368 - DNA, 25 bp, Homo sapien
gagaaataaagtccatcatcacatg

SEQ ID NO: 408369 - DNA, 25 bp, Homo sapien
tcacatgaaaagtcagtcacttgaa

SEQ ID NO: 408370 - DNA, 25 bp, Homo sapien
gggaggaattcaacgctctccctgc

SEQ ID NO: 408371 - DNA, 25 bp, Homo sapien
ggaggaattcaacgctctccctgca

SEQ ID NO: 408372 - DNA, 25 bp, Homo sapien
aggaattcaacgctctccctgcatg

SEQ ID NO: 408373 - DNA, 25 bp, Homo sapien
ggaattcaacgctctccctgcatgt

SEQ ID NO: 408374 - DNA, 25 bp, Homo sapien
gaattcaacgctctccctgcatgtc

SEQ ID NO: 408375 - DNA, 25 bp, Homo sapien
aattcaacgctctccctgcatgtcc

SEQ ID NO: 408376 - DNA, 25 bp, Homo sapien
agtgatcgtgtttattatcatagtt

SEQ ID NO: 408377 - DNA, 25 bp, Homo sapien
gtgatcgtgtttattatcatagttt

SEQ ID NO: 408378 - DNA, 25 bp, Homo sapien
gatcgtgtttattatcatagttttg

SEQ ID NO: 408379 - DNA, 25 bp, Homo sapien
atcatagttttgtacatgttaaggt

SEQ ID NO: 408380 - DNA, 25 bp, Homo sapien
catagttttgtacatgttaaggttt

SEQ ID NO: 408381 - DNA, 25 bp, Homo sapien
aaggtacgggcgtctgccgtcgcta

SEQ ID NO: 408382 - DNA, 25 bp, Homo sapien
gtacgggcgtctgccgtcgctaagt

SEQ ID NO: 408383 - DNA, 25 bp, Homo sapien
gggcgtctgccgtcgctaagtgccc

SEQ ID NO: 408384 - DNA, 25 bp, Homo sapien
ttaaggcacaccttcgcctccgatt

SEQ ID NO: 408385 - DNA, 25 bp, Homo sapien
ggaggtgaggagtcgatacccccca

SEQ ID NO: 408386 - DNA, 25 bp, Homo sapien
aaactaggatttggagcctcacgtt

SEQ ID NO: 408387 - DNA, 25 bp, Homo sapien
actaggatttggagcctcacgttct

SEQ ID NO: 408388 - DNA, 25 bp, Homo sapien
aggatttggagcctcacgttctccc

SEQ ID NO: 408389 - DNA, 25 bp, Homo sapien
tttggagcctcacgttctcccgcaa

SEQ ID NO: 408390 - DNA, 25 bp, Homo sapien
ttctcccgcaaaacgagccctgtgg

SEQ ID NO: 408391 - DNA, 25 bp, Homo sapien
caaaacgagccctgtgggtgccagg

SEQ ID NO: 408392 - DNA, 25 bp, Homo sapien
gggttctctcacaggtttatggcct

SEQ ID NO: 408393 - DNA, 25 bp, Homo sapien
tatggcctgtggtcagtgtgatctc

SEQ ID NO: 408394 - DNA, 25 bp, Homo sapien
tgatctctcatctccaacagggtaa

SEQ ID NO: 408395 - DNA, 25 bp, Homo sapien
acagggtaacttgggcttgttcaca

SEQ ID NO: 408396 - DNA, 25 bp, Homo sapien
aaagcagaagtgttcaagccctctt

SEQ ID NO: 408397 - DNA, 25 bp, Homo sapien
caagccctcttgaacgaaggactat

SEQ ID NO: 408398 - DNA, 25 bp, Homo sapien
gaaggactatgaatctgtgtaccat

SEQ ID NO: 408399 - DNA, 25 bp, Homo sapien
gtgtaccattacttctgctatattc

SEQ ID NO: 408400 - DNA, 25 bp, Homo sapien
gctatattcttttggccagtgcaag

SEQ ID NO: 408401 - DNA, 25 bp, Homo sapien
gccagtgcaagctaagccacagtct

SEQ ID NO: 408402 - DNA, 25 bp, Homo sapien
acagtctaggccagattcaaagggt

SEQ ID NO: 408403 - DNA, 25 bp, Homo sapien
ctgttgctgaagtcaggcctccctc

SEQ ID NO: 408404 - DNA, 25 bp, Homo sapien
tccccagcactggtatctgagtaac

SEQ ID NO: 408405 - DNA, 25 bp, Homo sapien
gcactggtatctgagtaacggctaa

SEQ ID NO: 408406 - DNA, 25 bp, Homo sapien
tgagtaacggctaagaacctccttc

SEQ ID NO: 408407 - DNA, 25 bp, Homo sapien
ctccttcctctggttttgaaaagca

SEQ ID NO: 408408 - DNA, 25 bp, Homo sapien
aaagcagttcgggttgtccaattct

SEQ ID NO: 408409 - DNA, 25 bp, Homo sapien
gttcgggttgtccaattctgtaaca

SEQ ID NO: 408410 - DNA, 25 bp, Homo sapien
cgtcgtgttgcatgagcctgggccc

SEQ ID NO: 408411 - DNA, 25 bp, Homo sapien
atcctctgcgtttcatttgcagtcg

SEQ ID NO: 408412 - DNA, 25 bp, Homo sapien
gcgtttcatttgcagtcgactgtac

SEQ ID NO: 408413 - DNA, 25 bp, Homo sapien
ttgcagtcgactgtacagaaggcac

SEQ ID NO: 408414 - DNA, 25 bp, Homo sapien
acgacatggcccgaaatgcctatca

SEQ ID NO: 408415 - DNA, 25 bp, Homo sapien
ggcccgaaatgcctatcacttcaag

SEQ ID NO: 408416 - DNA, 25 bp, Homo sapien
aatgcctatcacttcaagcgtgtgc

SEQ ID NO: 408417 - DNA, 25 bp, Homo sapien
atcacttcaagcgtgtgctcaaggg

SEQ ID NO: 408418 - DNA, 25 bp, Homo sapien
agaagcccagcacgtccaaggtgat

SEQ ID NO: 408419 - DNA, 25 bp, Homo sapien
ctccaagtccaagctcaaggtcaag

SEQ ID NO: 408420 - DNA, 25 bp, Homo sapien
aagtccaagctcaaggtcaagaggc

SEQ ID NO: 408421 - DNA, 25 bp, Homo sapien
aaggtcaagaggcaacgacagcaga

SEQ ID NO: 408422 - DNA, 25 bp, Homo sapien
gcaacgacagcagaggtggcgctct

SEQ ID NO: 408423 - DNA, 25 bp, Homo sapien
cagcacgtccaaggtgatcctgagg

SEQ ID NO: 408424 - DNA, 25 bp, Homo sapien
cgtccaaggtgatcctgagggctgt

SEQ ID NO: 408425 - DNA, 25 bp, Homo sapien
taattgtaaggctttgagtgcctct

SEQ ID NO: 408426 - DNA, 25 bp, Homo sapien
cctactggatagttgttggcttcaa

SEQ ID NO: 408427 - DNA, 25 bp, Homo sapien
tagcttctgaggtcatagtattcca

SEQ ID NO: 408428 - DNA, 25 bp, Homo sapien
gaggtcatagtattccatcagtggc

SEQ ID NO: 408429 - DNA, 25 bp, Homo sapien
tattccatcagtggcattgctacag

SEQ ID NO: 408430 - DNA, 25 bp, Homo sapien
attgctacagcctgctaactgactt

SEQ ID NO: 408431 - DNA, 25 bp, Homo sapien
tgctaactgactttcattgcccaca

SEQ ID NO: 408432 - DNA, 25 bp, Homo sapien
attgcccacacgctaacatttgttc

SEQ ID NO: 408433 - DNA, 25 bp, Homo sapien
ttgagccacgcaggcatggagtgct

SEQ ID NO: 408434 - DNA, 25 bp, Homo sapien
catggagtgctagatgtcttctgca

SEQ ID NO: 408435 - DNA, 25 bp, Homo sapien
agatgtcttctgcatgccagaagag

SEQ ID NO: 408436 - DNA, 25 bp, Homo sapien
caatttgacattgccataacattgt

SEQ ID NO: 408437 - DNA, 25 bp, Homo sapien
tttgacattgccataacattgttat

SEQ ID NO: 408438 - DNA, 25 bp, Homo sapien
tgacattgccataacattgttattc

SEQ ID NO: 408439 - DNA, 25 bp, Homo sapien
aaaatactgtggattgaggtccttc

SEQ ID NO: 408440 - DNA, 25 bp, Homo sapien
aatactgtggattgaggtccttcat

SEQ ID NO: 408441 - DNA, 25 bp, Homo sapien
tactgtggattgaggtccttcatga

SEQ ID NO: 408442 - DNA, 25 bp, Homo sapien
ctgtggattgaggtccttcatgaaa

SEQ ID NO: 408443 - DNA, 25 bp, Homo sapien
gtggattgaggtccttcatgaaaaa

SEQ ID NO: 408444 - DNA, 25 bp, Homo sapien
tatatcattaagcaaaacagttttt

SEQ ID NO: 408445 - DNA, 25 bp, Homo sapien
ttgaggtggagtttctttcgccagg

SEQ ID NO: 408446 - DNA, 25 bp, Homo sapien
tgaggtggagtttctttcgccaggc

SEQ ID NO: 408447 - DNA, 25 bp, Homo sapien
taccaaaaagagaacctgggcatgg

SEQ ID NO: 408448 - DNA, 25 bp, Homo sapien
agctcttctgggaactgtgagtgca

SEQ ID NO: 408449 - DNA, 25 bp, Homo sapien
actgtgagtgcaccagaggcagctc

SEQ ID NO: 408450 - DNA, 25 bp, Homo sapien
cagaggcagctccttgggcactgtc

SEQ ID NO: 408451 - DNA, 25 bp, Homo sapien
ttgggcactgtctgggagggaacct

SEQ ID NO: 408452 - DNA, 25 bp, Homo sapien
ggagggaacctgaaccacaggtgaa

SEQ ID NO: 408453 - DNA, 25 bp, Homo sapien
tgaaccacaggtgaagaccgactcc

SEQ ID NO: 408454 - DNA, 25 bp, Homo sapien
cacaggtgaagaccgactcccctgt

SEQ ID NO: 408455 - DNA, 25 bp, Homo sapien
gggacctgacactgggtttgtgtct

SEQ ID NO: 408456 - DNA, 25 bp, Homo sapien
ctgacactgggtttgtgtctgtgct

SEQ ID NO: 408457 - DNA, 25 bp, Homo sapien
gtctgtgctctagccgtgcctgtag

SEQ ID NO: 408458 - DNA, 25 bp, Homo sapien
caccctcccaagatgttcacaaaag

SEQ ID NO: 408459 - DNA, 25 bp, Homo sapien
ttcaggtacgaaaccatcaatggac

SEQ ID NO: 408460 - DNA, 25 bp, Homo sapien
aatgcatgttcctcaggcctatgca

SEQ ID NO: 408461 - DNA, 25 bp, Homo sapien
tcaggcctatgcagttcccagagac

SEQ ID NO: 408462 - DNA, 25 bp, Homo sapien
gttcccagagactcttgacaccggt

SEQ ID NO: 408463 - DNA, 25 bp, Homo sapien
tgtgctgctcttcaggtccccacag

SEQ ID NO: 408464 - DNA, 25 bp, Homo sapien
tgcctttggttcctggacatttggt

SEQ ID NO: 408465 - DNA, 25 bp, Homo sapien
tggacatttggtattctgccctcca

SEQ ID NO: 408466 - DNA, 25 bp, Homo sapien
tgccctccactctggtactatcaga

SEQ ID NO: 408467 - DNA, 25 bp, Homo sapien
gtactatcagagtagggcaggctct

SEQ ID NO: 408468 - DNA, 25 bp, Homo sapien
gctctggattaaagcttttagccgg

SEQ ID NO: 408469 - DNA, 25 bp, Homo sapien
ttccttggcctttcaaatatctaat

SEQ ID NO: 408470 - DNA, 25 bp, Homo sapien
gtagaagagttctctatacattgta

SEQ ID NO: 408471 - DNA, 25 bp, Homo sapien
cctgtgttttgggattagccgtact

SEQ ID NO: 408472 - DNA, 25 bp, Homo sapien
tagccgtacttggaagcctggtgga

SEQ ID NO: 408473 - DNA, 25 bp, Homo sapien
tggaagctgcttttctatttatgag

SEQ ID NO: 408474 - DNA, 25 bp, Homo sapien
gctgcttttctatttatgagtcaaa

SEQ ID NO: 408475 - DNA, 25 bp, Homo sapien
gtcaaattctctttcactctgaatg

SEQ ID NO: 408476 - DNA, 25 bp, Homo sapien
ataattgccaagcagctgtatctta

SEQ ID NO: 408477 - DNA, 25 bp, Homo sapien
gctgtatcttaatttagggtcttga

SEQ ID NO: 408478 - DNA, 25 bp, Homo sapien
tcttaatttagggtcttgaatcggt

SEQ ID NO: 408479 - DNA, 25 bp, Homo sapien
tgaatcggtaacgtttcctaaggct

SEQ ID NO: 408480 - DNA, 25 bp, Homo sapien
tgggtccaggcaaaaattatctaag

SEQ ID NO: 408481 - DNA, 25 bp, Homo sapien
atctaagggtgctacaatttttaag

SEQ ID NO: 408482 - DNA, 25 bp, Homo sapien
gatagatggatcaggcttaaaacac

SEQ ID NO: 408483 - DNA, 25 bp, Homo sapien
gcttaaaacacttgaacccactgat

SEQ ID NO: 408484 - DNA, 25 bp, Homo sapien
gaacccactgatcaatcttagcatt

SEQ ID NO: 408485 - DNA, 25 bp, Homo sapien
gtagaggagccagtcttcatgtacc

SEQ ID NO: 408486 - DNA, 25 bp, Homo sapien
agtcttcatgtacctcccgatggga

SEQ ID NO: 408487 - DNA, 25 bp, Homo sapien
tcccgatgggatgcaataggcagtt

SEQ ID NO: 408488 - DNA, 25 bp, Homo sapien
taggcagttatatgctgctcttgaa

SEQ ID NO: 408489 - DNA, 25 bp, Homo sapien
tcaaactaataaactcaggaccaga

SEQ ID NO: 408490 - DNA, 25 bp, Homo sapien
aaaatgctagattgggtccaggcaa

SEQ ID NO: 408491 - DNA, 25 bp, Homo sapien
tgatgtaattaatcttgctgctgag

SEQ ID NO: 408492 - DNA, 25 bp, Homo sapien
atcttgctgctgagaaaacatacaa

SEQ ID NO: 408493 - DNA, 25 bp, Homo sapien
ataacctagatatcacggtgaccca

SEQ ID NO: 408494 - DNA, 25 bp, Homo sapien
tagatatcacggtgacccaggccct

SEQ ID NO: 408495 - DNA, 25 bp, Homo sapien
cttcagcaccgttcacagtattttg

SEQ ID NO: 408496 - DNA, 25 bp, Homo sapien
ggaaatactggagaccatcgtggac

SEQ ID NO: 408497 - DNA, 25 bp, Homo sapien
agaccatcgtggacagaatagtaag

SEQ ID NO: 408498 - DNA, 25 bp, Homo sapien
aatagtaagagctgaggtccatcgg

SEQ ID NO: 408499 - DNA, 25 bp, Homo sapien
gtgggtattatttccctgtcggaca

SEQ ID NO: 408500 - DNA, 25 bp, Homo sapien
atttccctgtcggacattctgcaag

SEQ ID NO: 408501 - DNA, 25 bp, Homo sapien
ggacattctgcaagccctgatcctc

SEQ ID NO: 408502 - DNA, 25 bp, Homo sapien
atttcccctctgcagctgcggacag

SEQ ID NO: 408503 - DNA, 25 bp, Homo sapien
cagagcaccccaaggacactgtgat

SEQ ID NO: 408504 - DNA, 25 bp, Homo sapien
aaggacactgtgatcaacccgagaa

SEQ ID NO: 408505 - DNA, 25 bp, Homo sapien
tgtgatcaacccgagaatgttctgg

SEQ ID NO: 408506 - DNA, 25 bp, Homo sapien
ccgagaatgttctgggttcaactca

SEQ ID NO: 408507 - DNA, 25 bp, Homo sapien
tgttctgggttcaactcaagcatct

SEQ ID NO: 408508 - DNA, 25 bp, Homo sapien
ctccagggtcctgcgtggactctgg

SEQ ID NO: 408509 - DNA, 25 bp, Homo sapien
tggactctgggttccatcccacctg

SEQ ID NO: 408510 - DNA, 25 bp, Homo sapien
tacatgctcaccaggtctccattga

SEQ ID NO: 408511 - DNA, 25 bp, Homo sapien
tgctcaccaggtctccattgaggaa

SEQ ID NO: 408512 - DNA, 25 bp, Homo sapien
accaggtctccattgaggaagaaca

SEQ ID NO: 408513 - DNA, 25 bp, Homo sapien
gaatttctgaaactactgagtgcaa

SEQ ID NO: 408514 - DNA, 25 bp, Homo sapien
actgagtgcaacgtgtgtcttcctg

SEQ ID NO: 408515 - DNA, 25 bp, Homo sapien
ggaatctgcccctgtgtaactttac

SEQ ID NO: 408516 - DNA, 25 bp, Homo sapien
gtaactttacagacctctacactgg

SEQ ID NO: 408517 - DNA, 25 bp, Homo sapien
caaagaagctcccttgcagcagcag

SEQ ID NO: 408518 - DNA, 25 bp, Homo sapien
gcagcagcagaattacccatttcaa

SEQ ID NO: 408519 - DNA, 25 bp, Homo sapien
tgaaaggtctcctaaccgctgcaga

SEQ ID NO: 408520 - DNA, 25 bp, Homo sapien
ctgcagagagtgctttcttccagag

SEQ ID NO: 408521 - DNA, 25 bp, Homo sapien
tgctgtgtgtttgcttactgtagta

SEQ ID NO: 408522 - DNA, 25 bp, Homo sapien
tagtagccctggattctaggacagt

SEQ ID NO: 408523 - DNA, 25 bp, Homo sapien
aggacagtacctggcttaagaagct

SEQ ID NO: 408524 - DNA, 25 bp, Homo sapien
gcctcctggagtaaagccacctgaa

SEQ ID NO: 408525 - DNA, 25 bp, Homo sapien
taaagccacctgaaagccatgtgtg

SEQ ID NO: 408526 - DNA, 25 bp, Homo sapien
agaggtcggcgtgggctatccatcc

SEQ ID NO: 408527 - DNA, 25 bp, Homo sapien
gggctatccatccactgaaaggcac

SEQ ID NO: 408528 - DNA, 25 bp, Homo sapien
ggctttcaacttcaccctacaggaa

SEQ ID NO: 408529 - DNA, 25 bp, Homo sapien
gcacatcagagatcgccttggacgc

SEQ ID NO: 408530 - DNA, 25 bp, Homo sapien
ccttggacgcaaaccctgtgaatat

SEQ ID NO: 408531 - DNA, 25 bp, Homo sapien
agaaggcatatacatgtaagccatg

SEQ ID NO: 408532 - DNA, 25 bp, Homo sapien
gtgggaatgcctttcgttttcacca

SEQ ID NO: 408533 - DNA, 25 bp, Homo sapien
accactcctttcacatacacgaaag

SEQ ID NO: 408534 - DNA, 25 bp, Homo sapien
tctgaataagaaaacgcctcctgga

SEQ ID NO: 408535 - DNA, 25 bp, Homo sapien
taaaaagtaggtttctgatgtgcca

SEQ ID NO: 408536 - DNA, 25 bp, Homo sapien
ctgatgtgccatgaaatatttctgt

SEQ ID NO: 408537 - DNA, 25 bp, Homo sapien
tgaatctgtgtttttgaccaaggaa

SEQ ID NO: 408538 - DNA, 25 bp, Homo sapien
accatgtggttgttccacggttcat

SEQ ID NO: 408539 - DNA, 25 bp, Homo sapien
ggttcatctggctaccgttctgggt

SEQ ID NO: 408540 - DNA, 25 bp, Homo sapien
ttaaatcaagcttgacctcctcttt

SEQ ID NO: 408541 - DNA, 25 bp, Homo sapien
aagcttgacctcctcttttaatgag

SEQ ID NO: 408542 - DNA, 25 bp, Homo sapien
aatgaggaactttcacgttgacttc

SEQ ID NO: 408543 - DNA, 25 bp, Homo sapien
tcacgttgacttcctatctcaggat

SEQ ID NO: 408544 - DNA, 25 bp, Homo sapien
atctcaggatattcttcagtttcat

SEQ ID NO: 408545 - DNA, 25 bp, Homo sapien
ccctcctttctaatccaagatcata

SEQ ID NO: 408546 - DNA, 25 bp, Homo sapien
gaagcttcagaattagaggtccctc

SEQ ID NO: 408547 - DNA, 25 bp, Homo sapien
gagggaagtagatgttttgccaaaa

SEQ ID NO: 408548 - DNA, 25 bp, Homo sapien
gccaaaatacttcttcattccttta

SEQ ID NO: 408549 - DNA, 25 bp, Homo sapien
atctttcctatgcaagagtgtctca

SEQ ID NO: 408550 - DNA, 25 bp, Homo sapien
gagtgtctcacatgtgcttaaccga

SEQ ID NO: 408551 - DNA, 25 bp, Homo sapien
gtgcttaaccgaggtgcttctagtt

SEQ ID NO: 408552 - DNA, 25 bp, Homo sapien
cttctagttggtgagcagtgttgag

SEQ ID NO: 408553 - DNA, 25 bp, Homo sapien
agaagtggtgtgtgctctgtctgtc

SEQ ID NO: 408554 - DNA, 25 bp, Homo sapien
tctgtctttgtctgtctgttgtata

SEQ ID NO: 408555 - DNA, 25 bp, Homo sapien
ctgttgtatacagtgggtgccatat

SEQ ID NO: 408556 - DNA, 25 bp, Homo sapien
tgggtgccatataaagctgatcaat

SEQ ID NO: 408557 - DNA, 25 bp, Homo sapien
aatctagatgatgagggtagactgg

SEQ ID NO: 408558 - DNA, 25 bp, Homo sapien
tgagggtagactgggtgcggtagct

SEQ ID NO: 408559 - DNA, 25 bp, Homo sapien
aattccagctactcataggatattg

SEQ ID NO: 408560 - DNA, 25 bp, Homo sapien
attccagctactcataggatattga

SEQ ID NO: 408561 - DNA, 25 bp, Homo sapien
ttccagctactcataggatattgag

SEQ ID NO: 408562 - DNA, 25 bp, Homo sapien
tccagctactcataggatattgagg

SEQ ID NO: 408563 - DNA, 25 bp, Homo sapien
ccagctactcataggatattgaggc

SEQ ID NO: 408564 - DNA, 25 bp, Homo sapien
cagctactcataggatattgaggca

SEQ ID NO: 408565 - DNA, 25 bp, Homo sapien
gctactcataggatattgaggcagg

SEQ ID NO: 408566 - DNA, 25 bp, Homo sapien
tactcataggatattgaggcaggag

SEQ ID NO: 408567 - DNA, 25 bp, Homo sapien
ctcataggatattgaggcaggagaa

SEQ ID NO: 408568 - DNA, 25 bp, Homo sapien
ggaaatggtaagaagaactctactt

SEQ ID NO: 408569 - DNA, 25 bp, Homo sapien
agaactctacttttctaaataatat

SEQ ID NO: 408570 - DNA, 25 bp, Homo sapien
taatcttgtgtttctgtgcaaggtg

SEQ ID NO: 408571 - DNA, 25 bp, Homo sapien
ttctgtgcaaggtgttacagtttac

SEQ ID NO: 408572 - DNA, 25 bp, Homo sapien
gcaaggtgttacagtttacaaaccg

SEQ ID NO: 408573 - DNA, 25 bp, Homo sapien
acggagttttggtcttgttgcactc

SEQ ID NO: 408574 - DNA, 25 bp, Homo sapien
gggagatggtcttctgattgattag

SEQ ID NO: 408575 - DNA, 25 bp, Homo sapien
gagatggtcttctgattgattagat

SEQ ID NO: 408576 - DNA, 25 bp, Homo sapien
gatggtcttctgattgattagataa

SEQ ID NO: 408577 - DNA, 25 bp, Homo sapien
gataagtgtaggcatttgttttctt

SEQ ID NO: 408578 - DNA, 25 bp, Homo sapien
tttgtctggaataatatgatttcgg

SEQ ID NO: 408579 - DNA, 25 bp, Homo sapien
tgaaatctctgattgtctccatcct

SEQ ID NO: 408580 - DNA, 25 bp, Homo sapien
aatctctgattgtctccatcctgaa

SEQ ID NO: 408581 - DNA, 25 bp, Homo sapien
tctgattgtctccatcctgaatata

SEQ ID NO: 408582 - DNA, 25 bp, Homo sapien
gattgtctccatcctgaatatacaa

SEQ ID NO: 408583 - DNA, 25 bp, Homo sapien
gtctccatcctgaatatacaacaga

SEQ ID NO: 408584 - DNA, 25 bp, Homo sapien
gaatatacaacagaaagtgccaaag

SEQ ID NO: 408585 - DNA, 25 bp, Homo sapien
ttttctaagggtcaggatcccatga

SEQ ID NO: 408586 - DNA, 25 bp, Homo sapien
taaaaggttaaagagcgagtcaggc

SEQ ID NO: 408587 - DNA, 25 bp, Homo sapien
cctgttgctgctgtagtaatcactg

SEQ ID NO: 408588 - DNA, 25 bp, Homo sapien
gctgctgtagtaatcactggagaat

SEQ ID NO: 408589 - DNA, 25 bp, Homo sapien
cactggagaattgttgggaatggtc

SEQ ID NO: 408590 - DNA, 25 bp, Homo sapien
cagtccccgggagccggcgccgcca

SEQ ID NO: 408591 - DNA, 25 bp, Homo sapien
cacccggccgccgagtgcgtggatc

SEQ ID NO: 408592 - DNA, 25 bp, Homo sapien
gccgagtgcgtggatcccgccgtgg

SEQ ID NO: 408593 - DNA, 25 bp, Homo sapien
gagtgcgtggatcccgccgtggtct

SEQ ID NO: 408594 - DNA, 25 bp, Homo sapien
tggatcccgccgtggtcttcccctt

SEQ ID NO: 408595 - DNA, 25 bp, Homo sapien
ctttcccgtgaacaagcgcgagcca

SEQ ID NO: 408596 - DNA, 25 bp, Homo sapien
tttcccgtgaacaagcgcgagccag

SEQ ID NO: 408597 - DNA, 25 bp, Homo sapien
ttcccgtgaacaagcgcgagccagc

SEQ ID NO: 408598 - DNA, 25 bp, Homo sapien
tgaacaagcgcgagccagcgcccgt

SEQ ID NO: 408599 - DNA, 25 bp, Homo sapien
aagcgcgagccagcgcccgtgcccg

SEQ ID NO: 408600 - DNA, 25 bp, Homo sapien
ggcgggtattgccgccccagccggg

SEQ ID NO: 408601 - DNA, 25 bp, Homo sapien
aaaatgagaccctgtacccaaagca

SEQ ID NO: 408602 - DNA, 25 bp, Homo sapien
aaatgagaccctgtacccaaagcaa

SEQ ID NO: 408603 - DNA, 25 bp, Homo sapien
aatgagaccctgtacccaaagcaaa

SEQ ID NO: 408604 - DNA, 25 bp, Homo sapien
atgagaccctgtacccaaagcaaaa

SEQ ID NO: 408605 - DNA, 25 bp, Homo sapien
tgagaccctgtacccaaagcaaaaa

SEQ ID NO: 408606 - DNA, 25 bp, Homo sapien
tgtacccaaagcaaaaaagaagcct

SEQ ID NO: 408607 - DNA, 25 bp, Homo sapien
tacccaaagcaaaaaagaagcctat

SEQ ID NO: 408608 - DNA, 25 bp, Homo sapien
agaagcctatgtaaaaatatactgt

SEQ ID NO: 408609 - DNA, 25 bp, Homo sapien
gaagcctatgtaaaaatatactgtt

SEQ ID NO: 408610 - DNA, 25 bp, Homo sapien
aaaatgagtctataaaatattcttc

SEQ ID NO: 408611 - DNA, 25 bp, Homo sapien
gacccccatctctacgaagatttta

SEQ ID NO: 408612 - DNA, 25 bp, Homo sapien
gcccaacgggcacattaactttaag

SEQ ID NO: 408613 - DNA, 25 bp, Homo sapien
agatctccagacagatccatgagtt

SEQ ID NO: 408614 - DNA, 25 bp, Homo sapien
ggtagagtgtcctttcgagaaggac

SEQ ID NO: 408615 - DNA, 25 bp, Homo sapien
gaggaagctctcttcgtcgcctcct

SEQ ID NO: 408616 - DNA, 25 bp, Homo sapien
gtcgcctcctttgaaagtgagggtc

SEQ ID NO: 408617 - DNA, 25 bp, Homo sapien
tcctttgaaagtgagggtcccgaga

SEQ ID NO: 408618 - DNA, 25 bp, Homo sapien
ggtcccgagaaccacatggaaaaag

SEQ ID NO: 408619 - DNA, 25 bp, Homo sapien
aagacagctggaagaccctcaggac

SEQ ID NO: 408620 - DNA, 25 bp, Homo sapien
tcaggaccacccttctgaacagagc

SEQ ID NO: 408621 - DNA, 25 bp, Homo sapien
ccttctgaacagagcctgaggcgga

SEQ ID NO: 408622 - DNA, 25 bp, Homo sapien
aacagagcctgaggcggatgcagcc

SEQ ID NO: 408623 - DNA, 25 bp, Homo sapien
aaaggttcccagctccggggcatca

SEQ ID NO: 408624 - DNA, 25 bp, Homo sapien
gggcatcagcctgagtgcgcttgag

SEQ ID NO: 408625 - DNA, 25 bp, Homo sapien
gagtgcgcttgagctgctccaaacc

SEQ ID NO: 408626 - DNA, 25 bp, Homo sapien
ttgagctgctccaaacctggccctt

SEQ ID NO: 408627 - DNA, 25 bp, Homo sapien
accgcaggtgggactcaggttcgcc

SEQ ID NO: 408628 - DNA, 25 bp, Homo sapien
aggtgggactcaggttcgccctctg

SEQ ID NO: 408629 - DNA, 25 bp, Homo sapien
tgggactcaggttcgccctctgggc

SEQ ID NO: 408630 - DNA, 25 bp, Homo sapien
ctctgggccaggtccttcacgagga

SEQ ID NO: 408631 - DNA, 25 bp, Homo sapien
caggtccttcacgaggagggagcta

SEQ ID NO: 408632 - DNA, 25 bp, Homo sapien
tccttcacgaggagggagctaccct

SEQ ID NO: 408633 - DNA, 25 bp, Homo sapien
aggagggagctacccttcgccagaa

SEQ ID NO: 408634 - DNA, 25 bp, Homo sapien
tccaatctctgcttggtcctgccta

SEQ ID NO: 408635 - DNA, 25 bp, Homo sapien
aatctctgcttggtcctgcctagca

SEQ ID NO: 408636 - DNA, 25 bp, Homo sapien
atctctgcttggtcctgcctagcaa

SEQ ID NO: 408637 - DNA, 25 bp, Homo sapien
tctctgcttggtcctgcctagcaag

SEQ ID NO: 408638 - DNA, 25 bp, Homo sapien
tctgcttggtcctgcctagcaagga

SEQ ID NO: 408639 - DNA, 25 bp, Homo sapien
ctgcttggtcctgcctagcaaggaa

SEQ ID NO: 408640 - DNA, 25 bp, Homo sapien
gcttggtcctgcctagcaaggaatc

SEQ ID NO: 408641 - DNA, 25 bp, Homo sapien
cttggtcctgcctagcaaggaatcc

SEQ ID NO: 408642 - DNA, 25 bp, Homo sapien
ttggtcctgcctagcaaggaatccc

SEQ ID NO: 408643 - DNA, 25 bp, Homo sapien
ggtcctgcctagcaaggaatcccag

SEQ ID NO: 408644 - DNA, 25 bp, Homo sapien
tcctgcctagcaaggaatcccagca

SEQ ID NO: 408645 - DNA, 25 bp, Homo sapien
ttcttgactccatctgccttctgtc

SEQ ID NO: 408646 - DNA, 25 bp, Homo sapien
gggccttggttccagaaaccagctc

SEQ ID NO: 408647 - DNA, 25 bp, Homo sapien
aaaccagctcccttctgatcaggta

SEQ ID NO: 408648 - DNA, 25 bp, Homo sapien
cccttctgatcaggtattgtcatta

SEQ ID NO: 408649 - DNA, 25 bp, Homo sapien
aaatgatgggtgttgcttaaaatgc

SEQ ID NO: 408650 - DNA, 25 bp, Homo sapien
ctgtgtggtaccagtccagtttaat

SEQ ID NO: 408651 - DNA, 25 bp, Homo sapien
gaagggtcatggacgccctaagctg

SEQ ID NO: 408652 - DNA, 25 bp, Homo sapien
gacgccctaagctgagcatcttgtt

SEQ ID NO: 408653 - DNA, 25 bp, Homo sapien
gagcatcttgtttagtaccaggtac

SEQ ID NO: 408654 - DNA, 25 bp, Homo sapien
tagtaccaggtactttcatcccttc

SEQ ID NO: 408655 - DNA, 25 bp, Homo sapien
aggtactttcatcccttcttgactc

SEQ ID NO: 408656 - DNA, 25 bp, Homo sapien
ttgaatggcctcagcagtgctctca

SEQ ID NO: 408657 - DNA, 25 bp, Homo sapien
agggttttatcattccgagaggcac

SEQ ID NO: 408658 - DNA, 25 bp, Homo sapien
agaggcactggtgggctcctctact

SEQ ID NO: 408659 - DNA, 25 bp, Homo sapien
gctcctctactttcagttaggtgga

SEQ ID NO: 408660 - DNA, 25 bp, Homo sapien
tacctcttcaccagtgttgcacagc

SEQ ID NO: 408661 - DNA, 25 bp, Homo sapien
gttgcacagctgacccttggagagg

SEQ ID NO: 408662 - DNA, 25 bp, Homo sapien
gggtcagcatttccagcacacacca

SEQ ID NO: 408663 - DNA, 25 bp, Homo sapien
accagccctggtgttagcttgaatc

SEQ ID NO: 408664 - DNA, 25 bp, Homo sapien
gcttgaatctgtgcgacttatgcca

SEQ ID NO: 408665 - DNA, 25 bp, Homo sapien
gcgacttatgccacacagttagagg

SEQ ID NO: 408666 - DNA, 25 bp, Homo sapien
acagttagaggagaggcctgcagtt

SEQ ID NO: 408667 - DNA, 25 bp, Homo sapien
ggtttggtagtgaagacagtctcat

SEQ ID NO: 408668 - DNA, 25 bp, Homo sapien
gacagtctcatgtgtgttaacagct

SEQ ID NO: 408669 - DNA, 25 bp, Homo sapien
gtgttaacagcttacagcactgaaa

SEQ ID NO: 408670 - DNA, 25 bp, Homo sapien
atccgtttcaaacagttcaaaggag

SEQ ID NO: 408671 - DNA, 25 bp, Homo sapien
gggaaaggtggtttagatacagcta

SEQ ID NO: 408672 - DNA, 25 bp, Homo sapien
aatagcctgataatctaaccctgtg

SEQ ID NO: 408673 - DNA, 25 bp, Homo sapien
aatctaaccctgtgataatccaagt

SEQ ID NO: 408674 - DNA, 25 bp, Homo sapien
ataatccaagtacagcacagcacct

SEQ ID NO: 408675 - DNA, 25 bp, Homo sapien
caagtacagcacagcacctgctcag

SEQ ID NO: 408676 - DNA, 25 bp, Homo sapien
aaggcttgtgaggagtaaaaacgca

SEQ ID NO: 408677 - DNA, 25 bp, Homo sapien
aaacgcagattcatacctactgaaa

SEQ ID NO: 408678 - DNA, 25 bp, Homo sapien
agcagtagctgccagggcaacctga

SEQ ID NO: 408679 - DNA, 25 bp, Homo sapien
aaacgccctcatcgcaagttaggag

SEQ ID NO: 408680 - DNA, 25 bp, Homo sapien
tgcttgcagggttcgctgagccaaa

SEQ ID NO: 408681 - DNA, 25 bp, Homo sapien
aaagcatcaggtggcgtgacatcta

SEQ ID NO: 408682 - DNA, 25 bp, Homo sapien
catctatgggagcatctgggaaagc

SEQ ID NO: 408683 - DNA, 25 bp, Homo sapien
gctgccagcctgttgctagaagggt

SEQ ID NO: 408684 - DNA, 25 bp, Homo sapien
ctagaagggttgcagttatgctttc

SEQ ID NO: 408685 - DNA, 25 bp, Homo sapien
ggaaatgttcactcccagaaagtca

SEQ ID NO: 408686 - DNA, 25 bp, Homo sapien
agaaagtcaagccacccacatgcag

SEQ ID NO: 408687 - DNA, 25 bp, Homo sapien
atgcagacagcacttatcccaagac

SEQ ID NO: 408688 - DNA, 25 bp, Homo sapien
aaacctccagcaggacttcagtata

SEQ ID NO: 408689 - DNA, 25 bp, Homo sapien
gaagagatccaaaatcatttctagg

SEQ ID NO: 408690 - DNA, 25 bp, Homo sapien
tcatttctaggtacacagtgtgtca

SEQ ID NO: 408691 - DNA, 25 bp, Homo sapien
gtacacagtgtgtcagctagatctg

SEQ ID NO: 408692 - DNA, 25 bp, Homo sapien
cagtgtgtcagctagatctgtttct

SEQ ID NO: 408693 - DNA, 25 bp, Homo sapien
gatctgtttctatataactttggga

SEQ ID NO: 408694 - DNA, 25 bp, Homo sapien
gatcttttctgttaaactttcacta

SEQ ID NO: 408695 - DNA, 25 bp, Homo sapien
actttcactactattaatgctgtat

SEQ ID NO: 408696 - DNA, 25 bp, Homo sapien
actactattaatgctgtatacacca

SEQ ID NO: 408697 - DNA, 25 bp, Homo sapien
gctgtatacaccaatagactttcat

SEQ ID NO: 408698 - DNA, 25 bp, Homo sapien
tagactttcatatattttctgttgt

SEQ ID NO: 408699 - DNA, 25 bp, Homo sapien
tttcgaagttaaatttacagctaat

SEQ ID NO: 408700 - DNA, 25 bp, Homo sapien
aggatgcgactcctggttggatcta

SEQ ID NO: 408701 - DNA, 25 bp, Homo sapien
atgcgactcctggttggatctataa

SEQ ID NO: 408702 - DNA, 25 bp, Homo sapien
gactcctggttggatctataaacta

SEQ ID NO: 408703 - DNA, 25 bp, Homo sapien
tataaactaatgtctttggaacgaa

SEQ ID NO: 408704 - DNA, 25 bp, Homo sapien
tggaacgaaagcacatgcaaccttt

SEQ ID NO: 408705 - DNA, 25 bp, Homo sapien
acgaaagcacatgcaaccttttgaa

SEQ ID NO: 408706 - DNA, 25 bp, Homo sapien
ggtgataatgaaagaccattccaga

SEQ ID NO: 408707 - DNA, 25 bp, Homo sapien
gaccattccagagaagaaacaccat

SEQ ID NO: 408708 - DNA, 25 bp, Homo sapien
aacaccatggtgcaaaggctcaaga

SEQ ID NO: 408709 - DNA, 25 bp, Homo sapien
ggctcaagaggcatactggaagtac

SEQ ID NO: 408710 - DNA, 25 bp, Homo sapien
caatgaagagagcaatctaactgaa

SEQ ID NO: 408711 - DNA, 25 bp, Homo sapien
tgtgtgcactgtggcattgtctttc

SEQ ID NO: 408712 - DNA, 25 bp, Homo sapien
gatgaagtgatgtatgctttgcata

SEQ ID NO: 408713 - DNA, 25 bp, Homo sapien
tttgcatatgagttgccatggtgac

SEQ ID NO: 408714 - DNA, 25 bp, Homo sapien
ccagtgcagcatatgccagcatctt

SEQ ID NO: 408715 - DNA, 25 bp, Homo sapien
tatgccagcatctttgcacggacaa

SEQ ID NO: 408716 - DNA, 25 bp, Homo sapien
ttgcacggacaaatatgacttcaca

SEQ ID NO: 408717 - DNA, 25 bp, Homo sapien
tgacttcacaacacatatccagagg

SEQ ID NO: 408718 - DNA, 25 bp, Homo sapien
gggcctgcataggaacaatgcacaa

SEQ ID NO: 408719 - DNA, 25 bp, Homo sapien
gtaaaaccttagcacttagcacaat

SEQ ID NO: 408720 - DNA, 25 bp, Homo sapien
ataggttttcttgatgggaattcaa

SEQ ID NO: 408721 - DNA, 25 bp, Homo sapien
gggaattcaatagcttgtaatgtct

SEQ ID NO: 408722 - DNA, 25 bp, Homo sapien
taaatagctttgtgtgtcagagatc

SEQ ID NO: 408723 - DNA, 25 bp, Homo sapien
tagctttgtgtgtcagagatcagaa

SEQ ID NO: 408724 - DNA, 25 bp, Homo sapien
gtgtgtcagagatcagaacgctcat

SEQ ID NO: 408725 - DNA, 25 bp, Homo sapien
gtcagagatcagaacgctcatttta

SEQ ID NO: 408726 - DNA, 25 bp, Homo sapien
gatcagaacgctcattttacatgat

SEQ ID NO: 408727 - DNA, 25 bp, Homo sapien
ctagatagctagaatggttgttaac

SEQ ID NO: 408728 - DNA, 25 bp, Homo sapien
tagaatggttgttaacttcctagat

SEQ ID NO: 408729 - DNA, 25 bp, Homo sapien
gagatagccaaagatttgaagctct

SEQ ID NO: 408730 - DNA, 25 bp, Homo sapien
agatttgaagctctttacccattaa

SEQ ID NO: 408731 - DNA, 25 bp, Homo sapien
tgaagctctttacccattaacatga

SEQ ID NO: 408732 - DNA, 25 bp, Homo sapien
gctctttacccattaacatgataat

SEQ ID NO: 408733 - DNA, 25 bp, Homo sapien
atactaccctagagcctgggacctg

SEQ ID NO: 408734 - DNA, 25 bp, Homo sapien
atcctctgccagtcagattccaata

SEQ ID NO: 408735 - DNA, 25 bp, Homo sapien
cctctgccagtcagattccaatagg

SEQ ID NO: 408736 - DNA, 25 bp, Homo sapien
gcaagcccagggacatccaagagca

SEQ ID NO: 408737 - DNA, 25 bp, Homo sapien
acatccaagagcacccctcctgaga

SEQ ID NO: 408738 - DNA, 25 bp, Homo sapien
gagaccccagactcagaagcagcga

SEQ ID NO: 408739 - DNA, 25 bp, Homo sapien
gaccccagactcagaagcagcgaga

SEQ ID NO: 408740 - DNA, 25 bp, Homo sapien
agactcagaagcagcgagaaggcca

SEQ ID NO: 408741 - DNA, 25 bp, Homo sapien
agcgagaaggccaggccagccctca

SEQ ID NO: 408742 - DNA, 25 bp, Homo sapien
ctccacagcctgtcaataaattttt

SEQ ID NO: 408743 - DNA, 25 bp, Homo sapien
cacagcctgtcaataaattttttgt

SEQ ID NO: 408744 - DNA, 25 bp, Homo sapien
tgcttcttgaaggatggcgtgttaa

SEQ ID NO: 408745 - DNA, 25 bp, Homo sapien
atggcgtgttaatcttctaagtatg

SEQ ID NO: 408746 - DNA, 25 bp, Homo sapien
ctaagtatgttctggttgcgaggat

SEQ ID NO: 408747 - DNA, 25 bp, Homo sapien
gagcactgtcacagctacagctata

SEQ ID NO: 408748 - DNA, 25 bp, Homo sapien
aaagtattgcaaacctgcttctctt

SEQ ID NO: 408749 - DNA, 25 bp, Homo sapien
tacagctatacctgtgcaaagccag

SEQ ID NO: 408750 - DNA, 25 bp, Homo sapien
aggaataacacgctccctaggagag

SEQ ID NO: 408751 - DNA, 25 bp, Homo sapien
ggagagtctctagccttaatctgta

SEQ ID NO: 408752 - DNA, 25 bp, Homo sapien
gggtctgtaccaatgttcattgaac

SEQ ID NO: 408753 - DNA, 25 bp, Homo sapien
ttgaaccaaacaaggtccctatctt

SEQ ID NO: 408754 - DNA, 25 bp, Homo sapien
ggtccctatcttacagaagatgctt

SEQ ID NO: 408755 - DNA, 25 bp, Homo sapien
tcgttaatgttgatctctttccctt

SEQ ID NO: 408756 - DNA, 25 bp, Homo sapien
caaggccgcttcgttctgaacggag

SEQ ID NO: 408757 - DNA, 25 bp, Homo sapien
ctgaacggagcctgcaaagtcataa

SEQ ID NO: 408758 - DNA, 25 bp, Homo sapien
aaagctcttgaatccgaagcaagtg

SEQ ID NO: 408759 - DNA, 25 bp, Homo sapien
attccaacacgttctggcctcagac

SEQ ID NO: 408760 - DNA, 25 bp, Homo sapien
tctgggcaaagtgaagctggccttt

SEQ ID NO: 408761 - DNA, 25 bp, Homo sapien
gctggcctttatgctccaaggaagg

SEQ ID NO: 408762 - DNA, 25 bp, Homo sapien
tcgagagcaggcctgcattggctct

SEQ ID NO: 408763 - DNA, 25 bp, Homo sapien
attggctctcggactaattcgcgat

SEQ ID NO: 408764 - DNA, 25 bp, Homo sapien
ttcgcgatcatctttcatacagcag

SEQ ID NO: 408765 - DNA, 25 bp, Homo sapien
gtacacttcagcaaacctcgttaat

SEQ ID NO: 408766 - DNA, 25 bp, Homo sapien
tgtattaacatcaggactataggtg

SEQ ID NO: 408767 - DNA, 25 bp, Homo sapien
gggacagatgtttaccataccttaa

SEQ ID NO: 408768 - DNA, 25 bp, Homo sapien
gtttaccataccttaatatctacag

SEQ ID NO: 408769 - DNA, 25 bp, Homo sapien
ttgcactttggcacaatagaggaaa

SEQ ID NO: 408770 - DNA, 25 bp, Homo sapien
aacaaatgcaatactgtcctttcta

SEQ ID NO: 408771 - DNA, 25 bp, Homo sapien
tgcaatactgtcctttctattcacc

SEQ ID NO: 408772 - DNA, 25 bp, Homo sapien
tttctattcaccacgcatatgcagc

SEQ ID NO: 408773 - DNA, 25 bp, Homo sapien
attcaccacgcatatgcagcttcta

SEQ ID NO: 408774 - DNA, 25 bp, Homo sapien
accacgcatatgcagcttctaatgt

SEQ ID NO: 408775 - DNA, 25 bp, Homo sapien
gcttctaatgtgacattaactcttt

SEQ ID NO: 408776 - DNA, 25 bp, Homo sapien
agcctatttgacatccagaccatag

SEQ ID NO: 408777 - DNA, 25 bp, Homo sapien
ttttgaaagctggtggtctaggagt

SEQ ID NO: 408778 - DNA, 25 bp, Homo sapien
gctggtggtctaggagtatagtttt

SEQ ID NO: 408779 - DNA, 25 bp, Homo sapien
agtattagatgccagtctaatttaa

SEQ ID NO: 408780 - DNA, 25 bp, Homo sapien
tctaatttaaatgcagtctgactgt

SEQ ID NO: 408781 - DNA, 25 bp, Homo sapien
tgcagtctgactgtagcgagtaact

SEQ ID NO: 408782 - DNA, 25 bp, Homo sapien
gtagcgagtaactgacctgggcaat

SEQ ID NO: 408783 - DNA, 25 bp, Homo sapien
gagtaactgacctgggcaatgaaaa

SEQ ID NO: 408784 - DNA, 25 bp, Homo sapien
tgggcaatgaaaaagcagttgtatt

SEQ ID NO: 408785 - DNA, 25 bp, Homo sapien
gaaaatatcctttttatacagattt

SEQ ID NO: 408786 - DNA, 25 bp, Homo sapien
tggctatatcgaagttgattgtgac

SEQ ID NO: 408787 - DNA, 25 bp, Homo sapien
gattgtgactaatttgttaatacag

SEQ ID NO: 408788 - DNA, 25 bp, Homo sapien
ctgtactctgctgcatctaaggaga

SEQ ID NO: 408789 - DNA, 25 bp, Homo sapien
agctgctgcgcgtagggaactcctg

SEQ ID NO: 408790 - DNA, 25 bp, Homo sapien
ggaactcctgaaggaccccaaagtg

SEQ ID NO: 408791 - DNA, 25 bp, Homo sapien
ccaaagtgtctctggctgttctgaa

SEQ ID NO: 408792 - DNA, 25 bp, Homo sapien
tgttctgaatccctacatcaagcgc

SEQ ID NO: 408793 - DNA, 25 bp, Homo sapien
tcaagcgcacccgtcaaagtgaaaa

SEQ ID NO: 408794 - DNA, 25 bp, Homo sapien
ccgctgacggccaacctcatgaatt

SEQ ID NO: 408795 - DNA, 25 bp, Homo sapien
gaaaatggtcgcctaggcaacaccc

SEQ ID NO: 408796 - DNA, 25 bp, Homo sapien
gcctaggcaacacccagggtatcat

SEQ ID NO: 408797 - DNA, 25 bp, Homo sapien
gggtatcatctctgccttttccacc

SEQ ID NO: 408798 - DNA, 25 bp, Homo sapien
ttttccaccatcatgagtgtccacc

SEQ ID NO: 408799 - DNA, 25 bp, Homo sapien
agcgattccggtatggctggtgcaa

SEQ ID NO: 408800 - DNA, 25 bp, Homo sapien
cgattccggtatggctggtgcaaaa

SEQ ID NO: 408801 - DNA, 25 bp, Homo sapien
tccggtatggctggtgcaaaagcta

SEQ ID NO: 408802 - DNA, 25 bp, Homo sapien
gctggtgcaaaagctacagacctgt

SEQ ID NO: 408803 - DNA, 25 bp, Homo sapien
tgcaaaagctacagacctgtctctg

SEQ ID NO: 408804 - DNA, 25 bp, Homo sapien
tgtctctgtggcagtgatccaccat

SEQ ID NO: 408805 - DNA, 25 bp, Homo sapien
tggcagtgatccaccatccactcta

SEQ ID NO: 408806 - DNA, 25 bp, Homo sapien
tgacctaggcaccagcatggccact

SEQ ID NO: 408807 - DNA, 25 bp, Homo sapien
taggcaccagcatggccactggtac

SEQ ID NO: 408808 - DNA, 25 bp, Homo sapien
atctggcgctctgagagccccacag

SEQ ID NO: 408809 - DNA, 25 bp, Homo sapien
tgagagccccacagggaagggtcag

SEQ ID NO: 408810 - DNA, 25 bp, Homo sapien
aaacattagacttagctgaattgat

SEQ ID NO: 408811 - DNA, 25 bp, Homo sapien
aatattgccctgctcgagggcatct

SEQ ID NO: 408812 - DNA, 25 bp, Homo sapien
gagggcatctggagccctacagtta

SEQ ID NO: 408813 - DNA, 25 bp, Homo sapien
ggagccctacagttaccattactaa

SEQ ID NO: 408814 - DNA, 25 bp, Homo sapien
gccctacagttaccattactaaagt

SEQ ID NO: 408815 - DNA, 25 bp, Homo sapien
aagtctgtgagtatgtctattttga

SEQ ID NO: 408816 - DNA, 25 bp, Homo sapien
agtgtcataaaaatatctagtccat

SEQ ID NO: 408817 - DNA, 25 bp, Homo sapien
gtccataaatcattataggttcagt

SEQ ID NO: 408818 - DNA, 25 bp, Homo sapien
taggttcagtaatacatcattttga

SEQ ID NO: 408819 - DNA, 25 bp, Homo sapien
gattctatcttctgtgaaattctag

SEQ ID NO: 408820 - DNA, 25 bp, Homo sapien
gagatatgttatctttaggtagcat

SEQ ID NO: 408821 - DNA, 25 bp, Homo sapien
acctggccctgttttcatggctttt

SEQ ID NO: 408822 - DNA, 25 bp, Homo sapien
tttatttcctttcatcccacacatt

SEQ ID NO: 408823 - DNA, 25 bp, Homo sapien
cccacacatttgtctgcagtactag

SEQ ID NO: 408824 - DNA, 25 bp, Homo sapien
tctgcagtactagacatgttttaca

SEQ ID NO: 408825 - DNA, 25 bp, Homo sapien
tctgtgtggatttgtgcctcttaat

SEQ ID NO: 408826 - DNA, 25 bp, Homo sapien
ggatttgtgcctcttaattgtgttt

SEQ ID NO: 408827 - DNA, 25 bp, Homo sapien
gtttctagtctctaaggtgaccctt

SEQ ID NO: 408828 - DNA, 25 bp, Homo sapien
gtgaccctttaacctactcaagatg

SEQ ID NO: 408829 - DNA, 25 bp, Homo sapien
gcccagagaagtggcctgcgttaca

SEQ ID NO: 408830 - DNA, 25 bp, Homo sapien
gtggcctgcgttacagatttatttt

SEQ ID NO: 408831 - DNA, 25 bp, Homo sapien
tgtactaagttccattttctcttta

SEQ ID NO: 408832 - DNA, 25 bp, Homo sapien
tatgaagtaccagatcctctccaga

SEQ ID NO: 408833 - DNA, 25 bp, Homo sapien
gagccttctatggatggctggccta

SEQ ID NO: 408834 - DNA, 25 bp, Homo sapien
tgcagacacctgtccaccgtgagaa

SEQ ID NO: 408835 - DNA, 25 bp, Homo sapien
tatcagccctggtcaatcacatgat

SEQ ID NO: 408836 - DNA, 25 bp, Homo sapien
atcacatgatcgtgtctccagactt

SEQ ID NO: 408837 - DNA, 25 bp, Homo sapien
ctgcgatgctggacagggactgaca

SEQ ID NO: 408838 - DNA, 25 bp, Homo sapien
atctgggagcagtaccttcacgaca

SEQ ID NO: 408839 - DNA, 25 bp, Homo sapien
tcctgttcatcctgttcacagagtg

SEQ ID NO: 408840 - DNA, 25 bp, Homo sapien
tcacagagtggctcggctgatggta

SEQ ID NO: 408841 - DNA, 25 bp, Homo sapien
gatggtagctcgaccaatggctgca

SEQ ID NO: 408842 - DNA, 25 bp, Homo sapien
tggctgcaaccatgagagggctccc

SEQ ID NO: 408843 - DNA, 25 bp, Homo sapien
tagactacaacaactataggatggc

SEQ ID NO: 408844 - DNA, 25 bp, Homo sapien
gactacaacaactataggatggctt

SEQ ID NO: 408845 - DNA, 25 bp, Homo sapien
ctacaacaactataggatggctttt

SEQ ID NO: 408846 - DNA, 25 bp, Homo sapien
acaacaactataggatggcttttgt

SEQ ID NO: 408847 - DNA, 25 bp, Homo sapien
caactataggatggcttttgttagg

SEQ ID NO: 408848 - DNA, 25 bp, Homo sapien
ctataggatggcttttgttaggaag

SEQ ID NO: 408849 - DNA, 25 bp, Homo sapien
ttttggcaaaactacaaataggatt

SEQ ID NO: 408850 - DNA, 25 bp, Homo sapien
caaataggattatgttagcgtttac

SEQ ID NO: 408851 - DNA, 25 bp, Homo sapien
ataggattatgttagcgtttacact

SEQ ID NO: 408852 - DNA, 25 bp, Homo sapien
aggattatgttagcgtttacactga

SEQ ID NO: 408853 - DNA, 25 bp, Homo sapien
gttataaaggtacctaacaataatg

SEQ ID NO: 408854 - DNA, 25 bp, Homo sapien
gacagcagctgtggcgacctgcgtt

SEQ ID NO: 408855 - DNA, 25 bp, Homo sapien
gcctgtgcttcctgtagttagtccg

SEQ ID NO: 408856 - DNA, 25 bp, Homo sapien
tcctgtagttagtccgtcccctggt

SEQ ID NO: 408857 - DNA, 25 bp, Homo sapien
tcagaggccgcgtccctggcttgta

SEQ ID NO: 408858 - DNA, 25 bp, Homo sapien
cgtccctggcttgtacatatgtgat

SEQ ID NO: 408859 - DNA, 25 bp, Homo sapien
atgtgattgctgtgggcacacccca

SEQ ID NO: 408860 - DNA, 25 bp, Homo sapien
gtcccgatgtcttacacccgagtgt

SEQ ID NO: 408861 - DNA, 25 bp, Homo sapien
tacacccgagtgttagccctaggct

SEQ ID NO: 408862 - DNA, 25 bp, Homo sapien
gagtgttagccctaggctcctgtac

SEQ ID NO: 408863 - DNA, 25 bp, Homo sapien
taggctcctgtactgtgcgtgcact

SEQ ID NO: 408864 - DNA, 25 bp, Homo sapien
tgcgtgcacttgaggctctgtccaa

SEQ ID NO: 408865 - DNA, 25 bp, Homo sapien
agtcatctgcccctcccaggtgatt

SEQ ID NO: 408866 - DNA, 25 bp, Homo sapien
ggtgattctgtaagttgtccctcaa

SEQ ID NO: 408867 - DNA, 25 bp, Homo sapien
gttgtccctcaactgtacttggaga

SEQ ID NO: 408868 - DNA, 25 bp, Homo sapien
actgtacttggagaaatcgtgtttt

SEQ ID NO: 408869 - DNA, 25 bp, Homo sapien
aatcgtgttttaaagcagtagtcca

SEQ ID NO: 408870 - DNA, 25 bp, Homo sapien
aaagcagtagtccacaaagtattct

SEQ ID NO: 408871 - DNA, 25 bp, Homo sapien
gaaaaatcatgtataccctcaccca

SEQ ID NO: 408872 - DNA, 25 bp, Homo sapien
taccctcacccacctaagttgatat

SEQ ID NO: 408873 - DNA, 25 bp, Homo sapien
cacccacctaagttgatatctaaaa

SEQ ID NO: 408874 - DNA, 25 bp, Homo sapien
gtatgtatttgctggtgtcgtgtaa

SEQ ID NO: 408875 - DNA, 25 bp, Homo sapien
tttgctggtgtcgtgtaaatattgg

SEQ ID NO: 408876 - DNA, 25 bp, Homo sapien
gggattggttctgttccccctgctc

SEQ ID NO: 408877 - DNA, 25 bp, Homo sapien
cccctgctcccgtgtagagaaaagc

SEQ ID NO: 408878 - DNA, 25 bp, Homo sapien
ccctgctcccgtgtagagaaaagct

SEQ ID NO: 408879 - DNA, 25 bp, Homo sapien
cctgctcccgtgtagagaaaagcta

SEQ ID NO: 408880 - DNA, 25 bp, Homo sapien
ctgctcccgtgtagagaaaagctat

SEQ ID NO: 408881 - DNA, 25 bp, Homo sapien
tgctcccgtgtagagaaaagctata

SEQ ID NO: 408882 - DNA, 25 bp, Homo sapien
gctcccgtgtagagaaaagctatat

SEQ ID NO: 408883 - DNA, 25 bp, Homo sapien
ctcccgtgtagagaaaagctatatt

SEQ ID NO: 408884 - DNA, 25 bp, Homo sapien
tcccgtgtagagaaaagctatattt

SEQ ID NO: 408885 - DNA, 25 bp, Homo sapien
gaaaagctatatttatactgcattc

SEQ ID NO: 408886 - DNA, 25 bp, Homo sapien
aaagctatatttatactgcattctt

SEQ ID NO: 408887 - DNA, 25 bp, Homo sapien
ataacgataaagtgagctcagggtc

SEQ ID NO: 408888 - DNA, 25 bp, Homo sapien
tattttaacctgtggatttatcttt

SEQ ID NO: 408889 - DNA, 25 bp, Homo sapien
taacctgtggatttatctttcaaca

SEQ ID NO: 408890 - DNA, 25 bp, Homo sapien
tggatttatctttcaacatctctcc

SEQ ID NO: 408891 - DNA, 25 bp, Homo sapien
tccaccctaatacaagcacagctag

SEQ ID NO: 408892 - DNA, 25 bp, Homo sapien
agcacagctagttggctttgtaacg

SEQ ID NO: 408893 - DNA, 25 bp, Homo sapien
gctagttggctttgtaacgcctcaa

SEQ ID NO: 408894 - DNA, 25 bp, Homo sapien
gctttgtaacgcctcaaagaactcc

SEQ ID NO: 408895 - DNA, 25 bp, Homo sapien
aaagaactccatcacagatgccctg

SEQ ID NO: 408896 - DNA, 25 bp, Homo sapien
tcacagatgccctgattatccctgc

SEQ ID NO: 408897 - DNA, 25 bp, Homo sapien
acagatgccctgattatccctgcac

SEQ ID NO: 408898 - DNA, 25 bp, Homo sapien
gaagccttgaggatagatctcgggt

SEQ ID NO: 408899 - DNA, 25 bp, Homo sapien
agatctcgggtgacgtgggattttc

SEQ ID NO: 408900 - DNA, 25 bp, Homo sapien
gacgtgggattttctaagcctgaga

SEQ ID NO: 408901 - DNA, 25 bp, Homo sapien
cttctgcacacccttgtaacaatta

SEQ ID NO: 408902 - DNA, 25 bp, Homo sapien
tgccacatgactccagaagtctctg

SEQ ID NO: 408903 - DNA, 25 bp, Homo sapien
cagaagtctctgaccccatttgttt

SEQ ID NO: 408904 - DNA, 25 bp, Homo sapien
cagccaatgagttatcacccttttc

SEQ ID NO: 408905 - DNA, 25 bp, Homo sapien
atcttctgttgatttacacctttga

SEQ ID NO: 408906 - DNA, 25 bp, Homo sapien
gacatttgtattcgtcaaccctgtg

SEQ ID NO: 408907 - DNA, 25 bp, Homo sapien
aaccctgtggcttgttagcatcaga

SEQ ID NO: 408908 - DNA, 25 bp, Homo sapien
caaacttccctgtgtggccagcaga

SEQ ID NO: 408909 - DNA, 25 bp, Homo sapien
gcaactccatcaaatgacactgtct

SEQ ID NO: 408910 - DNA, 25 bp, Homo sapien
ggaagttggacatgcatattcccaa

SEQ ID NO: 408911 - DNA, 25 bp, Homo sapien
gaagttggacatgcatattcccaaa

SEQ ID NO: 408912 - DNA, 25 bp, Homo sapien
aagttggacatgcatattcccaaag

SEQ ID NO: 408913 - DNA, 25 bp, Homo sapien
agttggacatgcatattcccaaaga

SEQ ID NO: 408914 - DNA, 25 bp, Homo sapien
gttggacatgcatattcccaaagag

SEQ ID NO: 408915 - DNA, 25 bp, Homo sapien
ttggacatgcatattcccaaagaga

SEQ ID NO: 408916 - DNA, 25 bp, Homo sapien
gacatgcatattcccaaagagaaca

SEQ ID NO: 408917 - DNA, 25 bp, Homo sapien
atgcatattcccaaagagaacagtg

SEQ ID NO: 408918 - DNA, 25 bp, Homo sapien
aagagaacagtgttggaaggagaca

SEQ ID NO: 408919 - DNA, 25 bp, Homo sapien
taagagccggtccaaggcaacacaa

SEQ ID NO: 408920 - DNA, 25 bp, Homo sapien
agcttcccaaacaccagtgttggat

SEQ ID NO: 408921 - DNA, 25 bp, Homo sapien
tctgtgattgattttggtcctcctc

SEQ ID NO: 408922 - DNA, 25 bp, Homo sapien
tgggaatctggcttggttcgagata

SEQ ID NO: 408923 - DNA, 25 bp, Homo sapien
ttcgagataggagcttttctgtgtc

SEQ ID NO: 408924 - DNA, 25 bp, Homo sapien
ttttctgtgtcctaagccctttcat

SEQ ID NO: 408925 - DNA, 25 bp, Homo sapien
taagccctttcatgctagcaggaag

SEQ ID NO: 408926 - DNA, 25 bp, Homo sapien
caggaagactgaaagcaaggtggcc

SEQ ID NO: 408927 - DNA, 25 bp, Homo sapien
tagggcttgatagacctggcactgc

SEQ ID NO: 408928 - DNA, 25 bp, Homo sapien
atagacctggcactgcctatctgca

SEQ ID NO: 408929 - DNA, 25 bp, Homo sapien
aggtgccccacctatttatctgagc

SEQ ID NO: 408930 - DNA, 25 bp, Homo sapien
ctatttatctgagcccacaggtgga

SEQ ID NO: 408931 - DNA, 25 bp, Homo sapien
tgtcctcatggaatttgcagcccta

SEQ ID NO: 408932 - DNA, 25 bp, Homo sapien
tcctcatggaatttgcagccctagt

SEQ ID NO: 408933 - DNA, 25 bp, Homo sapien
atggaatttgcagccctagtgagga

SEQ ID NO: 408934 - DNA, 25 bp, Homo sapien
gatcagagctgaggaaggtgcctct

SEQ ID NO: 408935 - DNA, 25 bp, Homo sapien
tcagagctgaggaaggtgcctctgt

SEQ ID NO: 408936 - DNA, 25 bp, Homo sapien
tctgtgtgtcccgtggccgctgtga

SEQ ID NO: 408937 - DNA, 25 bp, Homo sapien
tgtgtgtcccgtggccgctgtgaca

SEQ ID NO: 408938 - DNA, 25 bp, Homo sapien
tagtgaggaaagatcctccccaagt

SEQ ID NO: 408939 - DNA, 25 bp, Homo sapien
aggaaagatcctccccaagtcaaat

SEQ ID NO: 408940 - DNA, 25 bp, Homo sapien
agatcctccccaagtcaaataacca

SEQ ID NO: 408941 - DNA, 25 bp, Homo sapien
tccccaagtcaaataaccacaaggt

SEQ ID NO: 408942 - DNA, 25 bp, Homo sapien
gggccacgaatcctccatgaaaaag

SEQ ID NO: 408943 - DNA, 25 bp, Homo sapien
cacgaatcctccatgaaaaagctca

SEQ ID NO: 408944 - DNA, 25 bp, Homo sapien
gaaaaagctcatggcctgtgtgagt

SEQ ID NO: 408945 - DNA, 25 bp, Homo sapien
ctcatggcctgtgtgagtcaggata

SEQ ID NO: 408946 - DNA, 25 bp, Homo sapien
gtgtgagtcaggataacttctcctt

SEQ ID NO: 408947 - DNA, 25 bp, Homo sapien
gtgagtcaggataacttctccttgt

SEQ ID NO: 408948 - DNA, 25 bp, Homo sapien
gtcaggataacttctccttgtcatc

SEQ ID NO: 408949 - DNA, 25 bp, Homo sapien
ttctccttgtcatcagcgggcgagg

SEQ ID NO: 408950 - DNA, 25 bp, Homo sapien
tccttgtcatcagcgggcgaggaag

SEQ ID NO: 408951 - DNA, 25 bp, Homo sapien
aagagctgccggtgcagggcaagct

SEQ ID NO: 408952 - DNA, 25 bp, Homo sapien
gaagggacgcccactgctgctccgg

SEQ ID NO: 408953 - DNA, 25 bp, Homo sapien
aggagtcaacaaaccccggctgagg

SEQ ID NO: 408954 - DNA, 25 bp, Homo sapien
aacaaaccccggctgaggctgagct

SEQ ID NO: 408955 - DNA, 25 bp, Homo sapien
aaaccccggctgaggctgagctcac

SEQ ID NO: 408956 - DNA, 25 bp, Homo sapien
aagcccaagaggacacggcgggcac

SEQ ID NO: 408957 - DNA, 25 bp, Homo sapien
gacacggcgggcacagtcctgtgac

SEQ ID NO: 408958 - DNA, 25 bp, Homo sapien
acaagctggaacctgatagaagacg

SEQ ID NO: 408959 - DNA, 25 bp, Homo sapien
gaacctgatagaagacggcctcctg

SEQ ID NO: 408960 - DNA, 25 bp, Homo sapien
acctgatagaagacggcctcctgac

SEQ ID NO: 408961 - DNA, 25 bp, Homo sapien
gagccaggaacagactgacaactgc

SEQ ID NO: 408962 - DNA, 25 bp, Homo sapien
aggaacagactgacaactgccacaa

SEQ ID NO: 408963 - DNA, 25 bp, Homo sapien
aacagactgacaactgccacaacac

SEQ ID NO: 408964 - DNA, 25 bp, Homo sapien
ttagagacaacaataccaaggaaga

SEQ ID NO: 408965 - DNA, 25 bp, Homo sapien
ggcaatgccactcctccagagagaa

SEQ ID NO: 408966 - DNA, 25 bp, Homo sapien
caatgccactcctccagagagaatt

SEQ ID NO: 408967 - DNA, 25 bp, Homo sapien
atgccactcctccagagagaattct

SEQ ID NO: 408968 - DNA, 25 bp, Homo sapien
tatggccacatctctaaattgcaat

SEQ ID NO: 408969 - DNA, 25 bp, Homo sapien
ggccacatctctaaattgcaatggt

SEQ ID NO: 408970 - DNA, 25 bp, Homo sapien
atctctaaattgcaatggtcccatt

SEQ ID NO: 408971 - DNA, 25 bp, Homo sapien
ctctaaattgcaatggtcccatttc

SEQ ID NO: 408972 - DNA, 25 bp, Homo sapien
tgcaatggtcccatttctaggcttc

SEQ ID NO: 408973 - DNA, 25 bp, Homo sapien
tggtcccatttctaggcttccaggg

SEQ ID NO: 408974 - DNA, 25 bp, Homo sapien
tacctgcaggtcacagggccacaga

SEQ ID NO: 408975 - DNA, 25 bp, Homo sapien
gcctcacgtaattcatgctttttaa

SEQ ID NO: 408976 - DNA, 25 bp, Homo sapien
tgtaaataatttgtgttccctgatc

SEQ ID NO: 408977 - DNA, 25 bp, Homo sapien
ttgtgttccctgatcactcgtttaa

SEQ ID NO: 408978 - DNA, 25 bp, Homo sapien
gatcactcgtttaagttcttagttg

SEQ ID NO: 408979 - DNA, 25 bp, Homo sapien
agttgtatgtcatctcttctctagc

SEQ ID NO: 408980 - DNA, 25 bp, Homo sapien
atctcttctctagcaggaattggca

SEQ ID NO: 408981 - DNA, 25 bp, Homo sapien
tttgcaggccatatagcctctgctg

SEQ ID NO: 408982 - DNA, 25 bp, Homo sapien
tatagcctctgctgcaaatgctcag

SEQ ID NO: 408983 - DNA, 25 bp, Homo sapien
aaatgctcagccctgctgttgtaat

SEQ ID NO: 408984 - DNA, 25 bp, Homo sapien
tcagccctgctgttgtaatgtaaaa

SEQ ID NO: 408985 - DNA, 25 bp, Homo sapien
gctgccacagacactacatgaacac

SEQ ID NO: 408986 - DNA, 25 bp, Homo sapien
gaagctgtctcagtgattcagtcca

SEQ ID NO: 408987 - DNA, 25 bp, Homo sapien
gattcagtccattccaatattcaat

SEQ ID NO: 408988 - DNA, 25 bp, Homo sapien
gagaccggacgattcagtttcacat

SEQ ID NO: 408989 - DNA, 25 bp, Homo sapien
tcagtttcacattgccatatccagt

SEQ ID NO: 408990 - DNA, 25 bp, Homo sapien
ttcgtcacctttataaacagcgcag

SEQ ID NO: 408991 - DNA, 25 bp, Homo sapien
caggtactctttctacatgctgacg

SEQ ID NO: 408992 - DNA, 25 bp, Homo sapien
tgctgacgtgcattgacatggattg

SEQ ID NO: 408993 - DNA, 25 bp, Homo sapien
gacatggattggaaggtgctcacat

SEQ ID NO: 408994 - DNA, 25 bp, Homo sapien
aaggtgctcacatggcttcgttaca

SEQ ID NO: 408995 - DNA, 25 bp, Homo sapien
acatggcttcgttacactctgtgga

SEQ ID NO: 408996 - DNA, 25 bp, Homo sapien
gttacactctgtggattcccttata

SEQ ID NO: 408997 - DNA, 25 bp, Homo sapien
tttgggcattacagaagagcatatt

SEQ ID NO: 408998 - DNA, 25 bp, Homo sapien
accaagggagagatgctcgcagctc

SEQ ID NO: 408999 - DNA, 25 bp, Homo sapien
agatgctcgcagctcaatcacaggg

SEQ ID NO: 409000 - DNA, 25 bp, Homo sapien
aaggctttggaaagtgtcccagtca

SEQ ID NO: 409001 - DNA, 25 bp, Homo sapien
aaagtgtcccagtcatgatgctacc

SEQ ID NO: 409002 - DNA, 25 bp, Homo sapien
tgatgctaccagaccctaaagaaag

SEQ ID NO: 409003 - DNA, 25 bp, Homo sapien
ggtgccataccctacacctttggaa

SEQ ID NO: 409004 - DNA, 25 bp, Homo sapien
tggaacctttccaactggatcccaa

SEQ ID NO: 409005 - DNA, 25 bp, Homo sapien
aactggatcccaaacatttgtcgga

SEQ ID NO: 409006 - DNA, 25 bp, Homo sapien
atttgtcggaaaccagcactctcaa

SEQ ID NO: 409007 - DNA, 25 bp, Homo sapien
ggaaaccagcactctcaaggaagaa

SEQ ID NO: 409008 - DNA, 25 bp, Homo sapien
agacattagggcatttagttacatc

SEQ ID NO: 409009 - DNA, 25 bp, Homo sapien
gggcatttagttacatctctcaatt

SEQ ID NO: 409010 - DNA, 25 bp, Homo sapien
ttagttacatctctcaatttgtgac

SEQ ID NO: 409011 - DNA, 25 bp, Homo sapien
aaatgagttttgtctgaagtttcca

SEQ ID NO: 409012 - DNA, 25 bp, Homo sapien
gagttttgtctgaagtttccaagta

SEQ ID NO: 409013 - DNA, 25 bp, Homo sapien
tttctttctgtcactgagtgatttc

SEQ ID NO: 409014 - DNA, 25 bp, Homo sapien
cactgagtgatttcatgtagaacat

SEQ ID NO: 409015 - DNA, 25 bp, Homo sapien
gaagtttccaagtatgacctatgct

SEQ ID NO: 409016 - DNA, 25 bp, Homo sapien
gtttccaagtatgacctatgctttt

SEQ ID NO: 409017 - DNA, 25 bp, Homo sapien
aagtatgacctatgctttttcttag

SEQ ID NO: 409018 - DNA, 25 bp, Homo sapien
gatgagggctaaaaattgagacatt

SEQ ID NO: 409019 - DNA, 25 bp, Homo sapien
tgaccctctggacatggtgatcata

SEQ ID NO: 409020 - DNA, 25 bp, Homo sapien
gaccctctggacatggtgatcatag

SEQ ID NO: 409021 - DNA, 25 bp, Homo sapien
accctctggacatggtgatcatagg

SEQ ID NO: 409022 - DNA, 25 bp, Homo sapien
ccctctggacatggtgatcataggt

SEQ ID NO: 409023 - DNA, 25 bp, Homo sapien
cctctggacatggtgatcataggtc

SEQ ID NO: 409024 - DNA, 25 bp, Homo sapien
ctctggacatggtgatcataggtct

SEQ ID NO: 409025 - DNA, 25 bp, Homo sapien
tctggacatggtgatcataggtcta

SEQ ID NO: 409026 - DNA, 25 bp, Homo sapien
ctgcagtgcgcagcatcaacggaac

SEQ ID NO: 409027 - DNA, 25 bp, Homo sapien
gcagtgcgcagcatcaacggaacat

SEQ ID NO: 409028 - DNA, 25 bp, Homo sapien
cagtgcgcagcatcaacggaacatt

SEQ ID NO: 409029 - DNA, 25 bp, Homo sapien
gtgcgcagcatcaacggaacattcc

SEQ ID NO: 409030 - DNA, 25 bp, Homo sapien
tccaatctctgcttggtcctgccta

SEQ ID NO: 409031 - DNA, 25 bp, Homo sapien
ccaatctctgcttggtcctgcctag

SEQ ID NO: 409032 - DNA, 25 bp, Homo sapien
aatctctgcttggtcctgcctagca

SEQ ID NO: 409033 - DNA, 25 bp, Homo sapien
atctctgcttggtcctgcctagcaa

SEQ ID NO: 409034 - DNA, 25 bp, Homo sapien
tctctgcttggtcctgcctagcaag

SEQ ID NO: 409035 - DNA, 25 bp, Homo sapien
ctctgcttggtcctgcctagcaagg

SEQ ID NO: 409036 - DNA, 25 bp, Homo sapien
tctgcttggtcctgcctagcaagga

SEQ ID NO: 409037 - DNA, 25 bp, Homo sapien
ctgcttggtcctgcctagcaaggaa

SEQ ID NO: 409038 - DNA, 25 bp, Homo sapien
gcttggtcctgcctagcaaggaatc

SEQ ID NO: 409039 - DNA, 25 bp, Homo sapien
cttggtcctgcctagcaaggaatcc

SEQ ID NO: 409040 - DNA, 25 bp, Homo sapien
ttggtcctgcctagcaaggaatccc

SEQ ID NO: 409041 - DNA, 25 bp, Homo sapien
tgagcccgagctctgttacctgcag

SEQ ID NO: 409042 - DNA, 25 bp, Homo sapien
ttacctgcagcgaactcctcgatgg

SEQ ID NO: 409043 - DNA, 25 bp, Homo sapien
aactcctcgatggtcatgagcggga

SEQ ID NO: 409044 - DNA, 25 bp, Homo sapien
atctgccaggctttccgcagtgaac

SEQ ID NO: 409045 - DNA, 25 bp, Homo sapien
agaaccttccgcctgttctctggcg

SEQ ID NO: 409046 - DNA, 25 bp, Homo sapien
tgacactcggcctcggaccagcgga

SEQ ID NO: 409047 - DNA, 25 bp, Homo sapien
ggaccagcggacaacggcattgaac

SEQ ID NO: 409048 - DNA, 25 bp, Homo sapien
attgaacagccgcacctcacggatg

SEQ ID NO: 409049 - DNA, 25 bp, Homo sapien
tcacggatgcccagtgtgtcgcgct

SEQ ID NO: 409050 - DNA, 25 bp, Homo sapien
cagtgtgtcgcgctccaggacagcc

SEQ ID NO: 409051 - DNA, 25 bp, Homo sapien
gggcactatcctcggtacccagatg

SEQ ID NO: 409052 - DNA, 25 bp, Homo sapien
atttggtagctgcaaggacttggtt

SEQ ID NO: 409053 - DNA, 25 bp, Homo sapien
caaggacttggttaatgaatatgca

SEQ ID NO: 409054 - DNA, 25 bp, Homo sapien
tatgcaaataataaagacccccttt

SEQ ID NO: 409055 - DNA, 25 bp, Homo sapien
gttttaataatgtacatgccctttg

SEQ ID NO: 409056 - DNA, 25 bp, Homo sapien
aataatgtacatgccctttgaactt

SEQ ID NO: 409057 - DNA, 25 bp, Homo sapien
aatgtacatgccctttgaacttagc

SEQ ID NO: 409058 - DNA, 25 bp, Homo sapien
gtacatgccctttgaacttagcatt

SEQ ID NO: 409059 - DNA, 25 bp, Homo sapien
gccctttgaacttagcatttacact

SEQ ID NO: 409060 - DNA, 25 bp, Homo sapien
ttgaacttagcatttacacttctca

SEQ ID NO: 409061 - DNA, 25 bp, Homo sapien
acttctcagaagtcttcagcctgag

SEQ ID NO: 409062 - DNA, 25 bp, Homo sapien
aacatagctggggactcttgactct

SEQ ID NO: 409063 - DNA, 25 bp, Homo sapien
ggtgccgccaaaggtctcctgctgt

SEQ ID NO: 409064 - DNA, 25 bp, Homo sapien
aaaggtctcctgctgttagcggtga

SEQ ID NO: 409065 - DNA, 25 bp, Homo sapien
ctgctgttagcggtgactcacattc

SEQ ID NO: 409066 - DNA, 25 bp, Homo sapien
ggtgactcacattcccagtgattta

SEQ ID NO: 409067 - DNA, 25 bp, Homo sapien
acattcccagtgatttagaaaaact

SEQ ID NO: 409068 - DNA, 25 bp, Homo sapien
agaaaaactgtggtgccgagtgaaa

SEQ ID NO: 409069 - DNA, 25 bp, Homo sapien
aaaggtttggttcagcaagtgatgc

SEQ ID NO: 409070 - DNA, 25 bp, Homo sapien
gcaagtgatgctatttcagtgaatc

SEQ ID NO: 409071 - DNA, 25 bp, Homo sapien
ttcagtgccggatcccctagacaat

SEQ ID NO: 409072 - DNA, 25 bp, Homo sapien
gtgccggatcccctagacaatcagg

SEQ ID NO: 409073 - DNA, 25 bp, Homo sapien
tagacaatcagggtgggctccccgc

SEQ ID NO: 409074 - DNA, 25 bp, Homo sapien
gataaacacaaaatccattccaggt

SEQ ID NO: 409075 - DNA, 25 bp, Homo sapien
aacacaaaatccattccaggtagct

SEQ ID NO: 409076 - DNA, 25 bp, Homo sapien
caaaatccattccaggtagctcggc

SEQ ID NO: 409077 - DNA, 25 bp, Homo sapien
aaatccattccaggtagctcggcac

SEQ ID NO: 409078 - DNA, 25 bp, Homo sapien
attccaggtagctcggcaccaacta

SEQ ID NO: 409079 - DNA, 25 bp, Homo sapien
caggtagctcggcaccaactaagaa

SEQ ID NO: 409080 - DNA, 25 bp, Homo sapien
aggtagctcggcaccaactaagaaa

SEQ ID NO: 409081 - DNA, 25 bp, Homo sapien
gtagctcggcaccaactaagaaaaa

SEQ ID NO: 409082 - DNA, 25 bp, Homo sapien
ccgtaccaccatgcactgtaaatat

SEQ ID NO: 409083 - DNA, 25 bp, Homo sapien
agagcggtatctctggcaccacact

SEQ ID NO: 409084 - DNA, 25 bp, Homo sapien
agcggtatctctggcaccacactag

SEQ ID NO: 409085 - DNA, 25 bp, Homo sapien
ggaagggactcatgctagagcttaa

SEQ ID NO: 409086 - DNA, 25 bp, Homo sapien
gagcttaaaaaaccactggacataa

SEQ ID NO: 409087 - DNA, 25 bp, Homo sapien
accactggacataattagagatttt

SEQ ID NO: 409088 - DNA, 25 bp, Homo sapien
aaagtaggtatcagaaacatctcag

SEQ ID NO: 409089 - DNA, 25 bp, Homo sapien
aaagatataaatccatacctctaaa

SEQ ID NO: 409090 - DNA, 25 bp, Homo sapien
acaaaagagcattcctgttctgaac

SEQ ID NO: 409091 - DNA, 25 bp, Homo sapien
aagagcattcctgttctgaacttaa

SEQ ID NO: 409092 - DNA, 25 bp, Homo sapien
gttctgaacttaattgtttccaata

SEQ ID NO: 409093 - DNA, 25 bp, Homo sapien
taaagaagagctagttggtgacata

SEQ ID NO: 409094 - DNA, 25 bp, Homo sapien
gctagttggtgacatagaagtgaca

SEQ ID NO: 409095 - DNA, 25 bp, Homo sapien
gaagtgacaagaaccttatgaggaa

SEQ ID NO: 409096 - DNA, 25 bp, Homo sapien
ttaccaaaaaggctgcatcctcact

SEQ ID NO: 409097 - DNA, 25 bp, Homo sapien
ggctgcatcctcactaatatacagt

SEQ ID NO: 409098 - DNA, 25 bp, Homo sapien
tatacagtaggaaactttacccagg

SEQ ID NO: 409099 - DNA, 25 bp, Homo sapien
tttacccagggtctctgggtctgga

SEQ ID NO: 409100 - DNA, 25 bp, Homo sapien
gaaaattgaactctgggagttccaa

SEQ ID NO: 409101 - DNA, 25 bp, Homo sapien
ttccctgaagttccttcttttcttg

SEQ ID NO: 409102 - DNA, 25 bp, Homo sapien
cttttcttggccactgggacgtgta

SEQ ID NO: 409103 - DNA, 25 bp, Homo sapien
tgggacgtgtatcatccacttgctt

SEQ ID NO: 409104 - DNA, 25 bp, Homo sapien
cctgttctcaggtgagtgcaggaga

SEQ ID NO: 409105 - DNA, 25 bp, Homo sapien
gagcctggtgtggaaaatctactgc

SEQ ID NO: 409106 - DNA, 25 bp, Homo sapien
gagagagcggagcttttaccaaaaa

SEQ ID NO: 409107 - DNA, 25 bp, Homo sapien
agtactagcaaggtgcacccaggta

SEQ ID NO: 409108 - DNA, 25 bp, Homo sapien
cacccaggtagaggacaacaggaat

SEQ ID NO: 409109 - DNA, 25 bp, Homo sapien
ggaatagttatcctacttgctcagg

SEQ ID NO: 409110 - DNA, 25 bp, Homo sapien
tatcctacttgctcaggcttacatt

SEQ ID NO: 409111 - DNA, 25 bp, Homo sapien
tcaggcttacatttttacacatgaa

SEQ ID NO: 409112 - DNA, 25 bp, Homo sapien
tttacttatttgttctcaggaagac

SEQ ID NO: 409113 - DNA, 25 bp, Homo sapien
aagactgacagctgggtgatgtgaa

SEQ ID NO: 409114 - DNA, 25 bp, Homo sapien
agagaaatcctaaattgctgttaat

SEQ ID NO: 409115 - DNA, 25 bp, Homo sapien
tgggccttgttgctcaccatgtaac

SEQ ID NO: 409116 - DNA, 25 bp, Homo sapien
tcaccatgtaacaacatcctcttac

SEQ ID NO: 409117 - DNA, 25 bp, Homo sapien
gggaaagtaccctgtagtactagca

SEQ ID NO: 409118 - DNA, 25 bp, Homo sapien
tcgagaagggccctcccgacgggca

SEQ ID NO: 409119 - DNA, 25 bp, Homo sapien
cgagaagggccctcccgacgggcag

SEQ ID NO: 409120 - DNA, 25 bp, Homo sapien
gagaagggccctcccgacgggcaga

SEQ ID NO: 409121 - DNA, 25 bp, Homo sapien
agggccctcccgacgggcagaggag

SEQ ID NO: 409122 - DNA, 25 bp, Homo sapien
gcctcaattcccgtctcaaggccac

SEQ ID NO: 409123 - DNA, 25 bp, Homo sapien
cctcaattcccgtctcaaggccacg

SEQ ID NO: 409124 - DNA, 25 bp, Homo sapien
ctcaattcccgtctcaaggccacgc

SEQ ID NO: 409125 - DNA, 25 bp, Homo sapien
tcaattcccgtctcaaggccacgcc

SEQ ID NO: 409126 - DNA, 25 bp, Homo sapien
aattcccgtctcaaggccacgcctt

SEQ ID NO: 409127 - DNA, 25 bp, Homo sapien
attcccgtctcaaggccacgccttc

SEQ ID NO: 409128 - DNA, 25 bp, Homo sapien
ccgtctcaaggccacgccttccacc

SEQ ID NO: 409129 - DNA, 25 bp, Homo sapien
ggcttagtctttgaaatccagtgtg

SEQ ID NO: 409130 - DNA, 25 bp, Homo sapien
tgtgtttgacacttgcagcatacct

SEQ ID NO: 409131 - DNA, 25 bp, Homo sapien
gacacttgcagcatacctgacattg

SEQ ID NO: 409132 - DNA, 25 bp, Homo sapien
tacctgacattggactagccacttt

SEQ ID NO: 409133 - DNA, 25 bp, Homo sapien
tagccactttggaagtccttagcag

SEQ ID NO: 409134 - DNA, 25 bp, Homo sapien
ggaagtccttagcagtcacgcatgg

SEQ ID NO: 409135 - DNA, 25 bp, Homo sapien
tccttagcagtcacgcatggctatt

SEQ ID NO: 409136 - DNA, 25 bp, Homo sapien
gcatggctattgaactggacagcac

SEQ ID NO: 409137 - DNA, 25 bp, Homo sapien
cctgccttagtaaattgactttaat

SEQ ID NO: 409138 - DNA, 25 bp, Homo sapien
gaaaaccaaattcggaccagtcatt

SEQ ID NO: 409139 - DNA, 25 bp, Homo sapien
aaattcggaccagtcattatttact

SEQ ID NO: 409140 - DNA, 25 bp, Homo sapien
ggacagcaagaagtgatgaggacct

SEQ ID NO: 409141 - DNA, 25 bp, Homo sapien
gatgaggacctttaagaccacggta

SEQ ID NO: 409142 - DNA, 25 bp, Homo sapien
gaggacctttaagaccacggtagtg

SEQ ID NO: 409143 - DNA, 25 bp, Homo sapien
gaggcaagagcagatttgagaacta

SEQ ID NO: 409144 - DNA, 25 bp, Homo sapien
gagcagatttgagaactattaagaa

SEQ ID NO: 409145 - DNA, 25 bp, Homo sapien
ttaagaagacagactcatcagccct

SEQ ID NO: 409146 - DNA, 25 bp, Homo sapien
agaagacagactcatcagccctgta

SEQ ID NO: 409147 - DNA, 25 bp, Homo sapien
atgagggacctatgtaagataacgt

SEQ ID NO: 409148 - DNA, 25 bp, Homo sapien
acctatgtaagataacgtggagttc

SEQ ID NO: 409149 - DNA, 25 bp, Homo sapien
tggctaggtggctcatggtaccatt

SEQ ID NO: 409150 - DNA, 25 bp, Homo sapien
ggctaggtggctcatggtaccattc

SEQ ID NO: 409151 - DNA, 25 bp, Homo sapien
atgcctggcgtctcagtcagggctg

SEQ ID NO: 409152 - DNA, 25 bp, Homo sapien
tggcgtctcagtcagggctgggctc

SEQ ID NO: 409153 - DNA, 25 bp, Homo sapien
ccaggccagtacctgccctctgcag

SEQ ID NO: 409154 - DNA, 25 bp, Homo sapien
gaaggaggcttagtggagcccacgt

SEQ ID NO: 409155 - DNA, 25 bp, Homo sapien
ttagtggagcccacgtgggcctctg

SEQ ID NO: 409156 - DNA, 25 bp, Homo sapien
ccagccaggaccagccagaccagca

SEQ ID NO: 409157 - DNA, 25 bp, Homo sapien
agagcagggagccacttgccagggt

SEQ ID NO: 409158 - DNA, 25 bp, Homo sapien
ggagccacttgccagggtggaggag

SEQ ID NO: 409159 - DNA, 25 bp, Homo sapien
ggagcattgtccaggcatggcctgt

SEQ ID NO: 409160 - DNA, 25 bp, Homo sapien
gagcattgtccaggcatggcctgtg

SEQ ID NO: 409161 - DNA, 25 bp, Homo sapien
ggcccgagggccaaccaccgagcag

SEQ ID NO: 409162 - DNA, 25 bp, Homo sapien
tagtaacgtgtcaatattggttcat

SEQ ID NO: 409163 - DNA, 25 bp, Homo sapien
agttgtatcaaatgtaccacactga

SEQ ID NO: 409164 - DNA, 25 bp, Homo sapien
tcaaatgtaccacactgatgccaga

SEQ ID NO: 409165 - DNA, 25 bp, Homo sapien
gctgaagagtacgtgggagctctct

SEQ ID NO: 409166 - DNA, 25 bp, Homo sapien
gtacgtgggagctctctgtgctatc

SEQ ID NO: 409167 - DNA, 25 bp, Homo sapien
tgacattgggcattggtcaaaaccc

SEQ ID NO: 409168 - DNA, 25 bp, Homo sapien
gggcattggtcaaaacccatagcat

SEQ ID NO: 409169 - DNA, 25 bp, Homo sapien
ggtcaaaacccatagcatgtacagc

SEQ ID NO: 409170 - DNA, 25 bp, Homo sapien
tagcatgtacagcacaaagcgtttg

SEQ ID NO: 409171 - DNA, 25 bp, Homo sapien
gtacagcacaaagcgtttgctctaa

SEQ ID NO: 409172 - DNA, 25 bp, Homo sapien
aagcgtttgctctaatgtgagctat

SEQ ID NO: 409173 - DNA, 25 bp, Homo sapien
ccaggtgcgcgcttcgctcccggag

SEQ ID NO: 409174 - DNA, 25 bp, Homo sapien
caggtgcgcgcttcgctcccggagc

SEQ ID NO: 409175 - DNA, 25 bp, Homo sapien
aggtgcgcgcttcgctcccggagcc

SEQ ID NO: 409176 - DNA, 25 bp, Homo sapien
ggtgcgcgcttcgctcccggagccg

SEQ ID NO: 409177 - DNA, 25 bp, Homo sapien
gtgcgcgcttcgctcccggagccgc

SEQ ID NO: 409178 - DNA, 25 bp, Homo sapien
tgcgcgcttcgctcccggagccgcg

SEQ ID NO: 409179 - DNA, 25 bp, Homo sapien
gcgcgcttcgctcccggagccgcgg

SEQ ID NO: 409180 - DNA, 25 bp, Homo sapien
gcttcgctcccggagccgcggaact

SEQ ID NO: 409181 - DNA, 25 bp, Homo sapien
cttcgctcccggagccgcggaactc

SEQ ID NO: 409182 - DNA, 25 bp, Homo sapien
ttcgctcccggagccgcggaactcg

SEQ ID NO: 409183 - DNA, 25 bp, Homo sapien
tcgctcccggagccgcggaactcgg

SEQ ID NO: 409184 - DNA, 25 bp, Homo sapien
aaccaacaacaaaagcccctgactg

SEQ ID NO: 409185 - DNA, 25 bp, Homo sapien
tgactgtccgtcaagcaggcagcgg

SEQ ID NO: 409186 - DNA, 25 bp, Homo sapien
ctgccctgggcaagaatagcacttc

SEQ ID NO: 409187 - DNA, 25 bp, Homo sapien
atagcacttcccgttaaaagccagc

SEQ ID NO: 409188 - DNA, 25 bp, Homo sapien
ttaaaagccagcagccggcgtcagt

SEQ ID NO: 409189 - DNA, 25 bp, Homo sapien
tcagtccctatcagagccagctaga

SEQ ID NO: 409190 - DNA, 25 bp, Homo sapien
agctagatcatgcactgttgaccac

SEQ ID NO: 409191 - DNA, 25 bp, Homo sapien
gagcaatctgtgttacactagagtt

SEQ ID NO: 409192 - DNA, 25 bp, Homo sapien
ttacactagagttcacagggcattt

SEQ ID NO: 409193 - DNA, 25 bp, Homo sapien
gtagacgtgagtgcttaaacatatt

SEQ ID NO: 409194 - DNA, 25 bp, Homo sapien
ttaaacatatttgggtttctctctc

SEQ ID NO: 409195 - DNA, 25 bp, Homo sapien
gaatcaacagttctgggcaaaccag

SEQ ID NO: 409196 - DNA, 25 bp, Homo sapien
ttattcactcaagactaaaaactaa

SEQ ID NO: 409197 - DNA, 25 bp, Homo sapien
aggcctgggcctgagaactgaatca

SEQ ID NO: 409198 - DNA, 25 bp, Homo sapien
tgaatcaggtcagaaagcaacattg

SEQ ID NO: 409199 - DNA, 25 bp, Homo sapien
aggtcagaaagcaacattgaatgca

SEQ ID NO: 409200 - DNA, 25 bp, Homo sapien
ttgaatgcagaagaaatggcggact

SEQ ID NO: 409201 - DNA, 25 bp, Homo sapien
gaaatggcggacttctacaaggaat

SEQ ID NO: 409202 - DNA, 25 bp, Homo sapien
tggcggacttctacaaggaattttt

SEQ ID NO: 409203 - DNA, 25 bp, Homo sapien
aaattttcagaagcacatgtattat

SEQ ID NO: 409204 - DNA, 25 bp, Homo sapien
ataacagagattggtacaagcgcaa

SEQ ID NO: 409205 - DNA, 25 bp, Homo sapien
gagattggtacaagcgcaattttgc

SEQ ID NO: 409206 - DNA, 25 bp, Homo sapien
tatgaaccactataagtaaccttac

SEQ ID NO: 409207 - DNA, 25 bp, Homo sapien
acaaatagagttaatccaagacaat

SEQ ID NO: 409208 - DNA, 25 bp, Homo sapien
attaacaaactgtgctttgtcttta

SEQ ID NO: 409209 - DNA, 25 bp, Homo sapien
taacaaactgtgctttgtctttaat

SEQ ID NO: 409210 - DNA, 25 bp, Homo sapien
aacaaacatattgatggcataacct

SEQ ID NO: 409211 - DNA, 25 bp, Homo sapien
ttgatggcataacctattcagctat

SEQ ID NO: 409212 - DNA, 25 bp, Homo sapien
gatggcataacctattcagctatgt

SEQ ID NO: 409213 - DNA, 25 bp, Homo sapien
tggcataacctattcagctatgtcc

SEQ ID NO: 409214 - DNA, 25 bp, Homo sapien
tatttttgcaataatgtaacctcaa

SEQ ID NO: 409215 - DNA, 25 bp, Homo sapien
aataatgtaacctcaaatattggat

SEQ ID NO: 409216 - DNA, 25 bp, Homo sapien
ttgaaccaacaatggctgtgttaaa

SEQ ID NO: 409217 - DNA, 25 bp, Homo sapien
aaaatgatctctgatttccctagca

SEQ ID NO: 409218 - DNA, 25 bp, Homo sapien
tgatctctgatttccctagcaatga

SEQ ID NO: 409219 - DNA, 25 bp, Homo sapien
tctgatttccctagcaatgattctg

SEQ ID NO: 409220 - DNA, 25 bp, Homo sapien
acaatattcattggtgtgtcaaaat

SEQ ID NO: 409221 - DNA, 25 bp, Homo sapien
aatacacttgtgcattttctgcagt

SEQ ID NO: 409222 - DNA, 25 bp, Homo sapien
aaagatatctttgggcttaaaatat

SEQ ID NO: 409223 - DNA, 25 bp, Homo sapien
gtgtttcgtattactttcttggtgt

SEQ ID NO: 409224 - DNA, 25 bp, Homo sapien
tactttcttggtgtagattcccaac

SEQ ID NO: 409225 - DNA, 25 bp, Homo sapien
ggtgtagattcccaactaagttaag

SEQ ID NO: 409226 - DNA, 25 bp, Homo sapien
tataaacataacgaaagactccatg

SEQ ID NO: 409227 - DNA, 25 bp, Homo sapien
cgaaagactccatgttagagtgtgt

SEQ ID NO: 409228 - DNA, 25 bp, Homo sapien
gtttatggagtgttgttttcttaga

SEQ ID NO: 409229 - DNA, 25 bp, Homo sapien
gataccatagtcaaggtaccgcctt

SEQ ID NO: 409230 - DNA, 25 bp, Homo sapien
ggtaccgccttgctgaagtatttat

SEQ ID NO: 409231 - DNA, 25 bp, Homo sapien
aaagaatattctgtagaacctctac

SEQ ID NO: 409232 - DNA, 25 bp, Homo sapien
gaacctctactaccagctatatttt

SEQ ID NO: 409233 - DNA, 25 bp, Homo sapien
gtaaagctaatatgctcctcaatgt

SEQ ID NO: 409234 - DNA, 25 bp, Homo sapien
atatgctcctcaatgtaattattaa

SEQ ID NO: 409235 - DNA, 25 bp, Homo sapien
attctcaagtcacagctaaacttac

SEQ ID NO: 409236 - DNA, 25 bp, Homo sapien
cagctaaacttactaattctgattt

SEQ ID NO: 409237 - DNA, 25 bp, Homo sapien
aattctgattttagtgtagccccta

SEQ ID NO: 409238 - DNA, 25 bp, Homo sapien
atggcttccatatgccactctgtac

SEQ ID NO: 409239 - DNA, 25 bp, Homo sapien
gttttgttcaaaaaggctgacagtc

SEQ ID NO: 409240 - DNA, 25 bp, Homo sapien
aatatgatagattgccaaggcttgc

SEQ ID NO: 409241 - DNA, 25 bp, Homo sapien
gattgccaaggcttgccaatgataa

SEQ ID NO: 409242 - DNA, 25 bp, Homo sapien
atgaatcctgaaatgaatccaagca

SEQ ID NO: 409243 - DNA, 25 bp, Homo sapien
tgaatccaagcatttgcaggaaatt

SEQ ID NO: 409244 - DNA, 25 bp, Homo sapien
caggaaattctagttgatgcataca

SEQ ID NO: 409245 - DNA, 25 bp, Homo sapien
gttgatgcatacatacaccaagcag

SEQ ID NO: 409246 - DNA, 25 bp, Homo sapien
aaacttactaatcaactggcttatg

SEQ ID NO: 409247 - DNA, 25 bp, Homo sapien
tcaactggcttatgaatggatttca

SEQ ID NO: 409248 - DNA, 25 bp, Homo sapien
tggatttcatttgataccattttaa

SEQ ID NO: 409249 - DNA, 25 bp, Homo sapien
atgctaattagcctgtatgtttaaa

SEQ ID NO: 409250 - DNA, 25 bp, Homo sapien
actgtccttacctgacaccctgggt

SEQ ID NO: 409251 - DNA, 25 bp, Homo sapien
tgtccttacctgacaccctgggtgg

SEQ ID NO: 409252 - DNA, 25 bp, Homo sapien
gtccttacctgacaccctgggtggg

SEQ ID NO: 409253 - DNA, 25 bp, Homo sapien
gggtggttatattctgcagatcatc

SEQ ID NO: 409254 - DNA, 25 bp, Homo sapien
ggtggttatattctgcagatcatcg

SEQ ID NO: 409255 - DNA, 25 bp, Homo sapien
gtggttatattctgcagatcatcgg

SEQ ID NO: 409256 - DNA, 25 bp, Homo sapien
ggttatattctgcagatcatcggga

SEQ ID NO: 409257 - DNA, 25 bp, Homo sapien
gttatattctgcagatcatcgggaa

SEQ ID NO: 409258 - DNA, 25 bp, Homo sapien
tatattctgcagatcatcgggaaag

SEQ ID NO: 409259 - DNA, 25 bp, Homo sapien
atattctgcagatcatcgggaaaga

SEQ ID NO: 409260 - DNA, 25 bp, Homo sapien
tgtcctcaccagcactacgggccac

SEQ ID NO: 409261 - DNA, 25 bp, Homo sapien
gacttagtagctagaaaccctgtaa

SEQ ID NO: 409262 - DNA, 25 bp, Homo sapien
accctgtaaatatggtcttagcaga

SEQ ID NO: 409263 - DNA, 25 bp, Homo sapien
tgcaatttctaccaatccactaagc

SEQ ID NO: 409264 - DNA, 25 bp, Homo sapien
tttctaccaatccactaagctatca

SEQ ID NO: 409265 - DNA, 25 bp, Homo sapien
aagctatcaggcctagttagtccat

SEQ ID NO: 409266 - DNA, 25 bp, Homo sapien
aggcctagttagtccatcattccta

SEQ ID NO: 409267 - DNA, 25 bp, Homo sapien
gtccatcattcctaactttgacatt

SEQ ID NO: 409268 - DNA, 25 bp, Homo sapien
gacatttctgaacgactggcatttt

SEQ ID NO: 409269 - DNA, 25 bp, Homo sapien
gactggcattttctgacagttttgt

SEQ ID NO: 409270 - DNA, 25 bp, Homo sapien
aatggctccaggctgaagtccaatc

SEQ ID NO: 409271 - DNA, 25 bp, Homo sapien
gaagtccaatctcagcattacagtt

SEQ ID NO: 409272 - DNA, 25 bp, Homo sapien
atataggatgaagtgccagttgaat

SEQ ID NO: 409273 - DNA, 25 bp, Homo sapien
gccagttgaatgtaggcctatcctg

SEQ ID NO: 409274 - DNA, 25 bp, Homo sapien
gaatgtaggcctatcctgtaagtgc

SEQ ID NO: 409275 - DNA, 25 bp, Homo sapien
tgtaggcctatcctgtaagtgctgt

SEQ ID NO: 409276 - DNA, 25 bp, Homo sapien
gaatgtacagaatggagagatcctt

SEQ ID NO: 409277 - DNA, 25 bp, Homo sapien
aatggagagatccttgtgaactgga

SEQ ID NO: 409278 - DNA, 25 bp, Homo sapien
tgaactggagggtcaagaaagcctt

SEQ ID NO: 409279 - DNA, 25 bp, Homo sapien
gagggtcaagaaagcctttgggcca

SEQ ID NO: 409280 - DNA, 25 bp, Homo sapien
agaacagtctgaacaacatagctag

SEQ ID NO: 409281 - DNA, 25 bp, Homo sapien
agtctgaacaacatagctagacccc

SEQ ID NO: 409282 - DNA, 25 bp, Homo sapien
aaaaaattagtctgatgaggtggct

SEQ ID NO: 409283 - DNA, 25 bp, Homo sapien
tcatttctaacaaccagatggcccc

SEQ ID NO: 409284 - DNA, 25 bp, Homo sapien
ctgactcagcagaagagaacagctt

SEQ ID NO: 409285 - DNA, 25 bp, Homo sapien
agaacagcttcgattccccatgctt

SEQ ID NO: 409286 - DNA, 25 bp, Homo sapien
ccccatgcttttactcaccaaatta

SEQ ID NO: 409287 - DNA, 25 bp, Homo sapien
aactctgatccccaagttttctgag

SEQ ID NO: 409288 - DNA, 25 bp, Homo sapien
ctgatccccaagttttctgagactg

SEQ ID NO: 409289 - DNA, 25 bp, Homo sapien
caatgaggtggtcctaaagttgctc

SEQ ID NO: 409290 - DNA, 25 bp, Homo sapien
aaagttgctcaaggctggatggtcc

SEQ ID NO: 409291 - DNA, 25 bp, Homo sapien
aaattacgatggaacacctggagcc

SEQ ID NO: 409292 - DNA, 25 bp, Homo sapien
ccaggcggagattgtggagaccata

SEQ ID NO: 409293 - DNA, 25 bp, Homo sapien
gagaccataggtttttcatttctaa

SEQ ID NO: 409294 - DNA, 25 bp, Homo sapien
tgaactttagtttcccttttctgct

SEQ ID NO: 409295 - DNA, 25 bp, Homo sapien
tagtttcccttttctgctatgtcaa

SEQ ID NO: 409296 - DNA, 25 bp, Homo sapien
tttccataatcatcctgagtcccta

SEQ ID NO: 409297 - DNA, 25 bp, Homo sapien
tgagtccctatccaacaacctttac

SEQ ID NO: 409298 - DNA, 25 bp, Homo sapien
agcctcactttctgttagataactt

SEQ ID NO: 409299 - DNA, 25 bp, Homo sapien
ttcagccaggtggatagttgcccat

SEQ ID NO: 409300 - DNA, 25 bp, Homo sapien
gcagtctcactaaaacgtgcttttg

SEQ ID NO: 409301 - DNA, 25 bp, Homo sapien
gtgaatgagccagtccactaaaaat

SEQ ID NO: 409302 - DNA, 25 bp, Homo sapien
tagttgcccataagtctgttgtttg

SEQ ID NO: 409303 - DNA, 25 bp, Homo sapien
gggctctgtctgtatcccatgtgac

SEQ ID NO: 409304 - DNA, 25 bp, Homo sapien
atgtgaccagcttctaaccattttg

SEQ ID NO: 409305 - DNA, 25 bp, Homo sapien
ttaacactaattatcacgtctgaca

SEQ ID NO: 409306 - DNA, 25 bp, Homo sapien
gtgtggtttcagttctgtgtacatt

SEQ ID NO: 409307 - DNA, 25 bp, Homo sapien
tgaacattttaatgggtttcccttg

SEQ ID NO: 409308 - DNA, 25 bp, Homo sapien
cttgccctttccatatttaacctat

SEQ ID NO: 409309 - DNA, 25 bp, Homo sapien
atttaacctatttccacattctctc

SEQ ID NO: 409310 - DNA, 25 bp, Homo sapien
actcacattttctcagtgtgccctt

SEQ ID NO: 409311 - DNA, 25 bp, Homo sapien
ttatctgccatgtccatagccataa

SEQ ID NO: 409312 - DNA, 25 bp, Homo sapien
tagccataattccaccatcatacag

SEQ ID NO: 409313 - DNA, 25 bp, Homo sapien
ccatcatacagatcaggcagtgttt

SEQ ID NO: 409314 - DNA, 25 bp, Homo sapien
aatgatggtaggtagcacagtggac

SEQ ID NO: 409315 - DNA, 25 bp, Homo sapien
cacagtggacagtctttgatcatca

SEQ ID NO: 409316 - DNA, 25 bp, Homo sapien
aagggagaggtatcagcctcttagg

SEQ ID NO: 409317 - DNA, 25 bp, Homo sapien
tgaaccagatggaaggctctcgatc

SEQ ID NO: 409318 - DNA, 25 bp, Homo sapien
gaaggctctcgatctttagaggtta

SEQ ID NO: 409319 - DNA, 25 bp, Homo sapien
taatcagtgtttgttcgttcaattt

SEQ ID NO: 409320 - DNA, 25 bp, Homo sapien
tgttcgttcaatttttaaccagtca

SEQ ID NO: 409321 - DNA, 25 bp, Homo sapien
taaccagtcaccttgctgttaagag

SEQ ID NO: 409322 - DNA, 25 bp, Homo sapien
gtcaccttgctgttaagagcagaac

SEQ ID NO: 409323 - DNA, 25 bp, Homo sapien
taccctgatcaagtaatttaccaag

SEQ ID NO: 409324 - DNA, 25 bp, Homo sapien
accaagaagctactttttgtgacac

SEQ ID NO: 409325 - DNA, 25 bp, Homo sapien
tttgtgacacagctccgtctcctga

SEQ ID NO: 409326 - DNA, 25 bp, Homo sapien
tgaccgcggttccagacttcaccat

SEQ ID NO: 409327 - DNA, 25 bp, Homo sapien
atgggataacccttccccatataag

SEQ ID NO: 409328 - DNA, 25 bp, Homo sapien
taacccttccccatataagcagtag

SEQ ID NO: 409329 - DNA, 25 bp, Homo sapien
acccttccccatataagcagtagga

SEQ ID NO: 409330 - DNA, 25 bp, Homo sapien
atataagcagtaggatggcgtcccc

SEQ ID NO: 409331 - DNA, 25 bp, Homo sapien
cagtaggatggcgtcccccctggtg

SEQ ID NO: 409332 - DNA, 25 bp, Homo sapien
gagccgggggtctccaagcaccttc

SEQ ID NO: 409333 - DNA, 25 bp, Homo sapien
ttctcctggacatgccagccttgaa

SEQ ID NO: 409334 - DNA, 25 bp, Homo sapien
cctggacatgccagccttgaatggg

SEQ ID NO: 409335 - DNA, 25 bp, Homo sapien
gcagtgcggtttgaggctctgtacc

SEQ ID NO: 409336 - DNA, 25 bp, Homo sapien
agtgcggtttgaggctctgtacccc

SEQ ID NO: 409337 - DNA, 25 bp, Homo sapien
ggtttgaggctctgtacccctggcc

SEQ ID NO: 409338 - DNA, 25 bp, Homo sapien
gtttctcagtaatctcaggggcgat

SEQ ID NO: 409339 - DNA, 25 bp, Homo sapien
gcgatataatcaatgaggtggtcct

SEQ ID NO: 409340 - DNA, 25 bp, Homo sapien
caatgaggtggtcctaaagttgctc

SEQ ID NO: 409341 - DNA, 25 bp, Homo sapien
gaggtggtcctaaagttgctcaagg

SEQ ID NO: 409342 - DNA, 25 bp, Homo sapien
gtggtcctaaagttgctcaaggctg

SEQ ID NO: 409343 - DNA, 25 bp, Homo sapien
gtcctaaagttgctcaaggctggat

SEQ ID NO: 409344 - DNA, 25 bp, Homo sapien
aaagttgctcaaggctggatggtcc

SEQ ID NO: 409345 - DNA, 25 bp, Homo sapien
caaggctggatggtcccgggaagaa

SEQ ID NO: 409346 - DNA, 25 bp, Homo sapien
ggaagaaattacgatggaacacctg

SEQ ID NO: 409347 - DNA, 25 bp, Homo sapien
aaattacgatggaacacctggagcc

SEQ ID NO: 409348 - DNA, 25 bp, Homo sapien
ccaggcggagattgtggagaccata

SEQ ID NO: 409349 - DNA, 25 bp, Homo sapien
atgagagctattatcatctgtggtg

SEQ ID NO: 409350 - DNA, 25 bp, Homo sapien
gagctattatcatctgtggtgggaa

SEQ ID NO: 409351 - DNA, 25 bp, Homo sapien
tatcatctgtggtgggaaaagctat

SEQ ID NO: 409352 - DNA, 25 bp, Homo sapien
gagagactatcttgtgttgtgcctg

SEQ ID NO: 409353 - DNA, 25 bp, Homo sapien
gtgttgtgcctgtatgaatttttaa

SEQ ID NO: 409354 - DNA, 25 bp, Homo sapien
tgttgactggattttgcaaaaggat

SEQ ID NO: 409355 - DNA, 25 bp, Homo sapien
ggatgtataatatttctgtctgctc

SEQ ID NO: 409356 - DNA, 25 bp, Homo sapien
ctgtctgctcagaatattaatttgt

SEQ ID NO: 409357 - DNA, 25 bp, Homo sapien
taatttgtaaattctgcaagtttaa

SEQ ID NO: 409358 - DNA, 25 bp, Homo sapien
tttcccctgaaaatatttgcttgta

SEQ ID NO: 409359 - DNA, 25 bp, Homo sapien
cttagctagggcttaaataaacatg

SEQ ID NO: 409360 - DNA, 25 bp, Homo sapien
aaccttgaagtgactgttgtaccat

SEQ ID NO: 409361 - DNA, 25 bp, Homo sapien
gactgttgtaccatggttgtgcaca

SEQ ID NO: 409362 - DNA, 25 bp, Homo sapien
ggttgtgcacatgcttcagaatcct

SEQ ID NO: 409363 - DNA, 25 bp, Homo sapien
gcacatgcttcagaatcctatggaa

SEQ ID NO: 409364 - DNA, 25 bp, Homo sapien
gaatattcctacttgcagtacatca

SEQ ID NO: 409365 - DNA, 25 bp, Homo sapien
aggaatggatggtggaccctactat

SEQ ID NO: 409366 - DNA, 25 bp, Homo sapien
gtggaccctactattcatgttttga

SEQ ID NO: 409367 - DNA, 25 bp, Homo sapien
aatgttcactttaaagcaattgcat

SEQ ID NO: 409368 - DNA, 25 bp, Homo sapien
gataaaaacctgaactttcattgga

SEQ ID NO: 409369 - DNA, 25 bp, Homo sapien
tcattttgaattatgtgcactacca

SEQ ID NO: 409370 - DNA, 25 bp, Homo sapien
gtgcactaccatagctacatcagtt

SEQ ID NO: 409371 - DNA, 25 bp, Homo sapien
tgaccattttgcttgcctagttctc

SEQ ID NO: 409372 - DNA, 25 bp, Homo sapien
cctagttctcagctctccggtaaga

SEQ ID NO: 409373 - DNA, 25 bp, Homo sapien
aacctcaggctctctgatactgtcc

SEQ ID NO: 409374 - DNA, 25 bp, Homo sapien
cggtaagaaaagacagccatgcctg

SEQ ID NO: 409375 - DNA, 25 bp, Homo sapien
gccatgcctgacttctgttgtgaaa

SEQ ID NO: 409376 - DNA, 25 bp, Homo sapien
ggagcttgcccattggacttggagc

SEQ ID NO: 409377 - DNA, 25 bp, Homo sapien
gatactgtccactgcaacacagatc

SEQ ID NO: 409378 - DNA, 25 bp, Homo sapien
agacagccggtctttatagcctgga

SEQ ID NO: 409379 - DNA, 25 bp, Homo sapien
aacacagatctcaaacaccggttta

SEQ ID NO: 409380 - DNA, 25 bp, Homo sapien
gtttaccccacacccaaatatggtg

SEQ ID NO: 409381 - DNA, 25 bp, Homo sapien
gttacttctagactttgaccatttt

SEQ ID NO: 409382 - DNA, 25 bp, Homo sapien
gcaacacagggcttgagctgccatg

SEQ ID NO: 409383 - DNA, 25 bp, Homo sapien
gcatatgggagtttgttctagtttt

SEQ ID NO: 409384 - DNA, 25 bp, Homo sapien
catgctcggcctaaattttaaaatt

SEQ ID NO: 409385 - DNA, 25 bp, Homo sapien
tttttgttacacaacttcattgttt

SEQ ID NO: 409386 - DNA, 25 bp, Homo sapien
gttacacaacttcattgttttagta

SEQ ID NO: 409387 - DNA, 25 bp, Homo sapien
caacttcattgttttagtaggactg

SEQ ID NO: 409388 - DNA, 25 bp, Homo sapien
tagtaggactgtattgcattttacc

SEQ ID NO: 409389 - DNA, 25 bp, Homo sapien
aggactgtattgcattttacctgtt

SEQ ID NO: 409390 - DNA, 25 bp, Homo sapien
gactgtattgcattttacctgttaa

SEQ ID NO: 409391 - DNA, 25 bp, Homo sapien
actgtattgcattttacctgttaaa

SEQ ID NO: 409392 - DNA, 25 bp, Homo sapien
tttacctgttaaaaatttggcatct

SEQ ID NO: 409393 - DNA, 25 bp, Homo sapien
acctccacccggaatgggtatgcct

SEQ ID NO: 409394 - DNA, 25 bp, Homo sapien
acccggaatgggtatgcctccacct

SEQ ID NO: 409395 - DNA, 25 bp, Homo sapien
ccatttggatttggagttcctgcag

SEQ ID NO: 409396 - DNA, 25 bp, Homo sapien
gtgcagctccggaggccaaactggt

SEQ ID NO: 409397 - DNA, 25 bp, Homo sapien
ggaggccaaactggtccaagcttgt

SEQ ID NO: 409398 - DNA, 25 bp, Homo sapien
aaactggtccaagcttgtggctgag

SEQ ID NO: 409399 - DNA, 25 bp, Homo sapien
gtccaagcttgtggctgaggacctc

SEQ ID NO: 409400 - DNA, 25 bp, Homo sapien
aggactgcttctggacaaaggtgaa

SEQ ID NO: 409401 - DNA, 25 bp, Homo sapien
gacaaaggtgaaggaggaccgcttt

SEQ ID NO: 409402 - DNA, 25 bp, Homo sapien
gaaggaggaccgctttgagaacaat

SEQ ID NO: 409403 - DNA, 25 bp, Homo sapien
tgagaacaatgaacttttcgccaaa

SEQ ID NO: 409404 - DNA, 25 bp, Homo sapien
ttccttcatgggtcctctcaacttc

SEQ ID NO: 409405 - DNA, 25 bp, Homo sapien
tctcaacttctctgcgctgagatcc

SEQ ID NO: 409406 - DNA, 25 bp, Homo sapien
aggcagatcgcggtggagtgttggt

SEQ ID NO: 409407 - DNA, 25 bp, Homo sapien
tgttggtgcgatggtgcttgacccc

SEQ ID NO: 409408 - DNA, 25 bp, Homo sapien
cagcttcccctgctattgggtttct

SEQ ID NO: 409409 - DNA, 25 bp, Homo sapien
gctattgggtttctccaacgaggag

SEQ ID NO: 409410 - DNA, 25 bp, Homo sapien
acgaggagacatggtcttcgcttct

SEQ ID NO: 409411 - DNA, 25 bp, Homo sapien
agacatggtcttcgcttctcagagt

SEQ ID NO: 409412 - DNA, 25 bp, Homo sapien
gtcttcgcttctcagagtctgtggg

SEQ ID NO: 409413 - DNA, 25 bp, Homo sapien
taccctggacgctgtccttgtagct

SEQ ID NO: 409414 - DNA, 25 bp, Homo sapien
ctgtccttgtagctctccgactcga

SEQ ID NO: 409415 - DNA, 25 bp, Homo sapien
gtagacattgtatgcttatggtttc

SEQ ID NO: 409416 - DNA, 25 bp, Homo sapien
gacattgtatgcttatggtttctca

SEQ ID NO: 409417 - DNA, 25 bp, Homo sapien
ttgtatgcttatggtttctcattat

SEQ ID NO: 409418 - DNA, 25 bp, Homo sapien
tggtttctcattatgaaggtgcagc

SEQ ID NO: 409419 - DNA, 25 bp, Homo sapien
ttctcattatgaaggtgcagcttgt

SEQ ID NO: 409420 - DNA, 25 bp, Homo sapien
cattatgaaggtgcagcttgtagga

SEQ ID NO: 409421 - DNA, 25 bp, Homo sapien
cagcttgtaggaggtttgtacggat

SEQ ID NO: 409422 - DNA, 25 bp, Homo sapien
taggaggtttgtacggatgtgcttt

SEQ ID NO: 409423 - DNA, 25 bp, Homo sapien
gaggtttgtacggatgtgctttgaa

SEQ ID NO: 409424 - DNA, 25 bp, Homo sapien
gtttgtacggatgtgctttgaagtt

SEQ ID NO: 409425 - DNA, 25 bp, Homo sapien
tgtacggatgtgctttgaagttatg

SEQ ID NO: 409426 - DNA, 25 bp, Homo sapien
gatcaattgaccttgtgacaataca

SEQ ID NO: 409427 - DNA, 25 bp, Homo sapien
accttgtgacaatacaccttcccca

SEQ ID NO: 409428 - DNA, 25 bp, Homo sapien
attttgtaatattctctccgccatt

SEQ ID NO: 409429 - DNA, 25 bp, Homo sapien
ttttgtaatattctctccgccattg

SEQ ID NO: 409430 - DNA, 25 bp, Homo sapien
tttgtaatattctctccgccattga

SEQ ID NO: 409431 - DNA, 25 bp, Homo sapien
ttgtaatattctctccgccattgag

SEQ ID NO: 409432 - DNA, 25 bp, Homo sapien
tgtaatattctctccgccattgaga

SEQ ID NO: 409433 - DNA, 25 bp, Homo sapien
gtaatattctctccgccattgagaa

SEQ ID NO: 409434 - DNA, 25 bp, Homo sapien
tctctccgccattgagaatgtgctt

SEQ ID NO: 409435 - DNA, 25 bp, Homo sapien
gccattgagaatgtgctttgtaaga

SEQ ID NO: 409436 - DNA, 25 bp, Homo sapien
aatgtgctttgtaagatccaccccc

SEQ ID NO: 409437 - DNA, 25 bp, Homo sapien
gtatggctgtgtgattaaagtcaga

SEQ ID NO: 409438 - DNA, 25 bp, Homo sapien
cagagaagtgagttgggccactttt

SEQ ID NO: 409439 - DNA, 25 bp, Homo sapien
ggccacttttgggcctggattttag

SEQ ID NO: 409440 - DNA, 25 bp, Homo sapien
ttaggacttaggtgtggcccttcca

SEQ ID NO: 409441 - DNA, 25 bp, Homo sapien
gggcaacatcctttcgtgtttgata

SEQ ID NO: 409442 - DNA, 25 bp, Homo sapien
cagcctgggacaggcttcttgccag

SEQ ID NO: 409443 - DNA, 25 bp, Homo sapien
aagaaacttgctgggaccacagtgc

SEQ ID NO: 409444 - DNA, 25 bp, Homo sapien
acttgctgggaccacagtgcaggat

SEQ ID NO: 409445 - DNA, 25 bp, Homo sapien
acagtgcaggatgggcactccgtga

SEQ ID NO: 409446 - DNA, 25 bp, Homo sapien
caggatgggcactccgtgatggccc

SEQ ID NO: 409447 - DNA, 25 bp, Homo sapien
actcctttgccaccaggtatggctg

SEQ ID NO: 409448 - DNA, 25 bp, Homo sapien
gaattctcaggaaacatggacagta

SEQ ID NO: 409449 - DNA, 25 bp, Homo sapien
atggacagtagactctctagggcta

SEQ ID NO: 409450 - DNA, 25 bp, Homo sapien
gtagactctctagggctaacagtga

SEQ ID NO: 409451 - DNA, 25 bp, Homo sapien
ctagggctaacagtgagttgactct

SEQ ID NO: 409452 - DNA, 25 bp, Homo sapien
acagtgagttgactctggactgcta

SEQ ID NO: 409453 - DNA, 25 bp, Homo sapien
aaaattgacatgaaatcctgagttc

SEQ ID NO: 409454 - DNA, 25 bp, Homo sapien
atgttcaacacagacatgtgctttc

SEQ ID NO: 409455 - DNA, 25 bp, Homo sapien
ctttcagagagaatagaaacccttt

SEQ ID NO: 409456 - DNA, 25 bp, Homo sapien
cctttttcacagtttatatacctca

SEQ ID NO: 409457 - DNA, 25 bp, Homo sapien
ctagttgaagtgtcctcagagccaa

SEQ ID NO: 409458 - DNA, 25 bp, Homo sapien
ttaaaaagctcccacacatcccgga

SEQ ID NO: 409459 - DNA, 25 bp, Homo sapien
aagctaagcagcctgtggctcaggg

SEQ ID NO: 409460 - DNA, 25 bp, Homo sapien
agaggcacacctgggaagtgtcaga

SEQ ID NO: 409461 - DNA, 25 bp, Homo sapien
cacctgggaagtgtcagagcctgac

SEQ ID NO: 409462 - DNA, 25 bp, Homo sapien
tgtcagagcctgacaggcgtgagct

SEQ ID NO: 409463 - DNA, 25 bp, Homo sapien
gcctggcaggagagtgctctcacca

SEQ ID NO: 409464 - DNA, 25 bp, Homo sapien
aggagagtgctctcaccacctgacc

SEQ ID NO: 409465 - DNA, 25 bp, Homo sapien
cacctgaccatcctggaaagctgtc

SEQ ID NO: 409466 - DNA, 25 bp, Homo sapien
tgtcaaagtcccagtgcccatgcca

SEQ ID NO: 409467 - DNA, 25 bp, Homo sapien
gggactaccttgcaactgcttgaat

SEQ ID NO: 409468 - DNA, 25 bp, Homo sapien
accttgcaactgcttgaatgtaaag

SEQ ID NO: 409469 - DNA, 25 bp, Homo sapien
gtaaagcaggcagagaaatcctcct

SEQ ID NO: 409470 - DNA, 25 bp, Homo sapien
aggagggctcctagggaacaacttg

SEQ ID NO: 409471 - DNA, 25 bp, Homo sapien
gctgaatgccagcagaaaatctgga

SEQ ID NO: 409472 - DNA, 25 bp, Homo sapien
gcagagccagtataattcagcatta

SEQ ID NO: 409473 - DNA, 25 bp, Homo sapien
attcagcattactgagcccactgag

SEQ ID NO: 409474 - DNA, 25 bp, Homo sapien
attactgagcccactgagctctcca

SEQ ID NO: 409475 - DNA, 25 bp, Homo sapien
tccagggaagtataaattgagcaca

SEQ ID NO: 409476 - DNA, 25 bp, Homo sapien
agaagctctgaaatggattgtaacc

SEQ ID NO: 409477 - DNA, 25 bp, Homo sapien
ggattgtaaccacaacatcagaggt

SEQ ID NO: 409478 - DNA, 25 bp, Homo sapien
aaggcctcctctaattgctggcttg

SEQ ID NO: 409479 - DNA, 25 bp, Homo sapien
tcctctaattgctggcttgggaaga

SEQ ID NO: 409480 - DNA, 25 bp, Homo sapien
gaactggagataactcagcaatgga

SEQ ID NO: 409481 - DNA, 25 bp, Homo sapien
ttttctgtctcggctccctcctccc

SEQ ID NO: 409482 - DNA, 25 bp, Homo sapien
tttctgtctcggctccctcctcccc

SEQ ID NO: 409483 - DNA, 25 bp, Homo sapien
tctgtgtcctggtccttctgagggc

SEQ ID NO: 409484 - DNA, 25 bp, Homo sapien
ctgtgtcctggtccttctgagggcc

SEQ ID NO: 409485 - DNA, 25 bp, Homo sapien
tgtgtcctggtccttctgagggcca

SEQ ID NO: 409486 - DNA, 25 bp, Homo sapien
gtgtcctggtccttctgagggccac

SEQ ID NO: 409487 - DNA, 25 bp, Homo sapien
tgtcctggtccttctgagggccact

SEQ ID NO: 409488 - DNA, 25 bp, Homo sapien
gtcctggtccttctgagggccactg

SEQ ID NO: 409489 - DNA, 25 bp, Homo sapien
aatttgctaacagagtagctctcaa

SEQ ID NO: 409490 - DNA, 25 bp, Homo sapien
caaatgttatcacacaaaatggtaa

SEQ ID NO: 409491 - DNA, 25 bp, Homo sapien
aatggtaactagatacagtgatcag

SEQ ID NO: 409492 - DNA, 25 bp, Homo sapien
gatacagtgatcagtgtgtgttaac

SEQ ID NO: 409493 - DNA, 25 bp, Homo sapien
gtgtgttaactgacttgattgtggt

SEQ ID NO: 409494 - DNA, 25 bp, Homo sapien
aactcatcacattatatatcttaca

SEQ ID NO: 409495 - DNA, 25 bp, Homo sapien
gttgttcaaagggtacacactttca

SEQ ID NO: 409496 - DNA, 25 bp, Homo sapien
tcaaagggtacacactttcacttat

SEQ ID NO: 409497 - DNA, 25 bp, Homo sapien
gggtctaatgtagcacatggcaact

SEQ ID NO: 409498 - DNA, 25 bp, Homo sapien
gtagcacatggcaactatggttaac

SEQ ID NO: 409499 - DNA, 25 bp, Homo sapien
tggcaactatggttaacaatactgt

SEQ ID NO: 409500 - DNA, 25 bp, Homo sapien
ggatcttttccatctgagggtacag

SEQ ID NO: 409501 - DNA, 25 bp, Homo sapien
gtacaggaagtaccaggacctgttt

SEQ ID NO: 409502 - DNA, 25 bp, Homo sapien
agtttttgaatcctgcaagcacatt

SEQ ID NO: 409503 - DNA, 25 bp, Homo sapien
atcctgcaagcacattccaagactg

SEQ ID NO: 409504 - DNA, 25 bp, Homo sapien
aactgcatgagcaacatcactcgaa

SEQ ID NO: 409505 - DNA, 25 bp, Homo sapien
gcaccttaacaaccaattgcgatgc

SEQ ID NO: 409506 - DNA, 25 bp, Homo sapien
aaccaattgcgatgctgtcctgttc

SEQ ID NO: 409507 - DNA, 25 bp, Homo sapien
tgtcctgttcctttttactcacacc

SEQ ID NO: 409508 - DNA, 25 bp, Homo sapien
agtgctccgtgctgtatgcgtgtgc

SEQ ID NO: 409509 - DNA, 25 bp, Homo sapien
tatgcgtgtgctctctgttcttgta

SEQ ID NO: 409510 - DNA, 25 bp, Homo sapien
gtgctctctgttcttgtatactcaa

SEQ ID NO: 409511 - DNA, 25 bp, Homo sapien
acggcccagggaggagcatgcacac

SEQ ID NO: 409512 - DNA, 25 bp, Homo sapien
gatggtgtttaattacggttctgac

SEQ ID NO: 409513 - DNA, 25 bp, Homo sapien
taattacggttctgactcactgtgt

SEQ ID NO: 409514 - DNA, 25 bp, Homo sapien
gactcactgtgttctctattagagc

SEQ ID NO: 409515 - DNA, 25 bp, Homo sapien
tattagagcctatcttttggcctgt

SEQ ID NO: 409516 - DNA, 25 bp, Homo sapien
agagcctatcttttggcctgttggg

SEQ ID NO: 409517 - DNA, 25 bp, Homo sapien
ggcctgttgggtgaactcccaaatt

SEQ ID NO: 409518 - DNA, 25 bp, Homo sapien
tgaactcccaaattagggaagggca

SEQ ID NO: 409519 - DNA, 25 bp, Homo sapien
ggaaaggcaatattaggagagcata

SEQ ID NO: 409520 - DNA, 25 bp, Homo sapien
ggagagcatatgattttaggactgt

SEQ ID NO: 409521 - DNA, 25 bp, Homo sapien
agagccgccccaaggtacgtggctg

SEQ ID NO: 409522 - DNA, 25 bp, Homo sapien
gatgagtaatccaacttctatgtta

SEQ ID NO: 409523 - DNA, 25 bp, Homo sapien
tccaacttctatgttatgtaggatg

SEQ ID NO: 409524 - DNA, 25 bp, Homo sapien
ggatggagcacacaaattcttgcaa

SEQ ID NO: 409525 - DNA, 25 bp, Homo sapien
taaaatctcaactattttccaagtt

SEQ ID NO: 409526 - DNA, 25 bp, Homo sapien
agtgtgctgctcttaaccctgtgag

SEQ ID NO: 409527 - DNA, 25 bp, Homo sapien
aaccctgtgagatgaaatcttccca

SEQ ID NO: 409528 - DNA, 25 bp, Homo sapien
aaatcttcccatttggattacatat

SEQ ID NO: 409529 - DNA, 25 bp, Homo sapien
gtagttctatatcgacatcagcaga

SEQ ID NO: 409530 - DNA, 25 bp, Homo sapien
tcagcagatggcaatagtatacaaa

SEQ ID NO: 409531 - DNA, 25 bp, Homo sapien
tagtatacagcatgagccttccatt

SEQ ID NO: 409532 - DNA, 25 bp, Homo sapien
acagcatgagccttccattgctttt

SEQ ID NO: 409533 - DNA, 25 bp, Homo sapien
tggcaaccactaatccacgttatat

SEQ ID NO: 409534 - DNA, 25 bp, Homo sapien
gcaaccactaatccacgttatatgt

SEQ ID NO: 409535 - DNA, 25 bp, Homo sapien
accactaatccacgttatatgtcta

SEQ ID NO: 409536 - DNA, 25 bp, Homo sapien
actaatccacgttatatgtctagat

SEQ ID NO: 409537 - DNA, 25 bp, Homo sapien
ccacgttatatgtctagatttgcct

SEQ ID NO: 409538 - DNA, 25 bp, Homo sapien
cgttatatgtctagatttgcctctt

SEQ ID NO: 409539 - DNA, 25 bp, Homo sapien
tgtgtctggctttttaccactgaac

SEQ ID NO: 409540 - DNA, 25 bp, Homo sapien
tgtctggctttttaccactgaacgt

SEQ ID NO: 409541 - DNA, 25 bp, Homo sapien
tctggctttttaccactgaacgttt

SEQ ID NO: 409542 - DNA, 25 bp, Homo sapien
gctttttaccactgaacgttttcag

SEQ ID NO: 409543 - DNA, 25 bp, Homo sapien
accactgaacgttttcagagttcat

SEQ ID NO: 409544 - DNA, 25 bp, Homo sapien
acggacgctggctccccaaagggtg

SEQ ID NO: 409545 - DNA, 25 bp, Homo sapien
gctggctccccaaagggtgtgccct

SEQ ID NO: 409546 - DNA, 25 bp, Homo sapien
gtctttatcaaaggagagtcacaga

SEQ ID NO: 409547 - DNA, 25 bp, Homo sapien
ggagagtcacagaacaaatgtttgt

SEQ ID NO: 409548 - DNA, 25 bp, Homo sapien
tttgtttgtaaagcgttccaagtat

SEQ ID NO: 409549 - DNA, 25 bp, Homo sapien
gtaaagcgttccaagtattttgcca

SEQ ID NO: 409550 - DNA, 25 bp, Homo sapien
aagcgttccaagtattttgccacgt

SEQ ID NO: 409551 - DNA, 25 bp, Homo sapien
tttgccacgttctggactgtcttct

SEQ ID NO: 409552 - DNA, 25 bp, Homo sapien
gtcttctccctgcacaagccagggt

SEQ ID NO: 409553 - DNA, 25 bp, Homo sapien
gcacaagccagggtgtgtctcggta

SEQ ID NO: 409554 - DNA, 25 bp, Homo sapien
caagccagggtgtgtctcggtagct

SEQ ID NO: 409555 - DNA, 25 bp, Homo sapien
actgtccttacctgacaccctgggt

SEQ ID NO: 409556 - DNA, 25 bp, Homo sapien
gtccttacctgacaccctgggtggg

SEQ ID NO: 409557 - DNA, 25 bp, Homo sapien
gggtggttatattctgcagatcatc

SEQ ID NO: 409558 - DNA, 25 bp, Homo sapien
gtggttatattctgcagatcatcgg

SEQ ID NO: 409559 - DNA, 25 bp, Homo sapien
ggttatattctgcagatcatcggga

SEQ ID NO: 409560 - DNA, 25 bp, Homo sapien
ttatattctgcagatcatcgggaaa

SEQ ID NO: 409561 - DNA, 25 bp, Homo sapien
atattctgcagatcatcgggaaaga

SEQ ID NO: 409562 - DNA, 25 bp, Homo sapien
gaaagatgtcctcaccagcactacg

SEQ ID NO: 409563 - DNA, 25 bp, Homo sapien
agcactacgggccactgcagatgac

SEQ ID NO: 409564 - DNA, 25 bp, Homo sapien
gccactgcagatgactctcctttga

SEQ ID NO: 409565 - DNA, 25 bp, Homo sapien
ctgcagatgactctcctttgaaatg

SEQ ID NO: 409566 - DNA, 25 bp, Homo sapien
gtattatcatgccataattcaacta

SEQ ID NO: 409567 - DNA, 25 bp, Homo sapien
atcatgccataattcaactattcca

SEQ ID NO: 409568 - DNA, 25 bp, Homo sapien
gccataattcaactattccacctta

SEQ ID NO: 409569 - DNA, 25 bp, Homo sapien
ccataattcaactattccaccttac

SEQ ID NO: 409570 - DNA, 25 bp, Homo sapien
cataattcaactattccaccttact

SEQ ID NO: 409571 - DNA, 25 bp, Homo sapien
agtaaccaatgtactattaataaca

SEQ ID NO: 409572 - DNA, 25 bp, Homo sapien
tactattaataacagagtggctaac

SEQ ID NO: 409573 - DNA, 25 bp, Homo sapien
ctattaataacagagtggctaacat

SEQ ID NO: 409574 - DNA, 25 bp, Homo sapien
aattctcttgcaaggactttaacta

SEQ ID NO: 409575 - DNA, 25 bp, Homo sapien
ttctcttgcaaggactttaactaag

SEQ ID NO: 409576 - DNA, 25 bp, Homo sapien
ttgcaaggactttaactaagaactt

SEQ ID NO: 409577 - DNA, 25 bp, Homo sapien
tgtccactcatcactgcatgttagg

SEQ ID NO: 409578 - DNA, 25 bp, Homo sapien
catgttaggaactgctgtctctttg

SEQ ID NO: 409579 - DNA, 25 bp, Homo sapien
tgctgtctctttgggacacgagtta

SEQ ID NO: 409580 - DNA, 25 bp, Homo sapien
cactaatttctggagtgtgcctgca

SEQ ID NO: 409581 - DNA, 25 bp, Homo sapien
tggagtgtgcctgcagcttcacggc

SEQ ID NO: 409582 - DNA, 25 bp, Homo sapien
cttcacggccttcattttgttacta

SEQ ID NO: 409583 - DNA, 25 bp, Homo sapien
aacagaactttccaagtgctactga

SEQ ID NO: 409584 - DNA, 25 bp, Homo sapien
aagtgctactgaaattccgcagaga

SEQ ID NO: 409585 - DNA, 25 bp, Homo sapien
aattacgctgcgatggtgggtttct

SEQ ID NO: 409586 - DNA, 25 bp, Homo sapien
gcgatggtgggtttcttaccctaga

SEQ ID NO: 409587 - DNA, 25 bp, Homo sapien
gaaacatcctaacctgtatccacag

SEQ ID NO: 409588 - DNA, 25 bp, Homo sapien
gcactcctggctgcaatgcttcggg

SEQ ID NO: 409589 - DNA, 25 bp, Homo sapien
tgaatggagaggcacctcctagcct

SEQ ID NO: 409590 - DNA, 25 bp, Homo sapien
tggagaggcacctcctagcctaggc

SEQ ID NO: 409591 - DNA, 25 bp, Homo sapien
ccagaggacgtccaggccctgatgt

SEQ ID NO: 409592 - DNA, 25 bp, Homo sapien
gtccaggccctgatgtacctgagag

SEQ ID NO: 409593 - DNA, 25 bp, Homo sapien
aggccctgatgtacctgagagggca

SEQ ID NO: 409594 - DNA, 25 bp, Homo sapien
agctggagcctcagtggaagatgtt

SEQ ID NO: 409595 - DNA, 25 bp, Homo sapien
gagcctcagtggaagatgttgcagt

SEQ ID NO: 409596 - DNA, 25 bp, Homo sapien
tggaagatgttgcagtgccatcctc

SEQ ID NO: 409597 - DNA, 25 bp, Homo sapien
ctcacctggtggcttgaaatcggcc

SEQ ID NO: 409598 - DNA, 25 bp, Homo sapien
ctggtggcttgaaatcggccaaggt

SEQ ID NO: 409599 - DNA, 25 bp, Homo sapien
gacgcaggtactttcatgcagtctg

SEQ ID NO: 409600 - DNA, 25 bp, Homo sapien
aggtactttcatgcagtctgcttca

SEQ ID NO: 409601 - DNA, 25 bp, Homo sapien
tgcagtctgcttcatttaaatcttc

SEQ ID NO: 409602 - DNA, 25 bp, Homo sapien
tcttcaaaaaccactgttaaagtag

SEQ ID NO: 409603 - DNA, 25 bp, Homo sapien
gcataagattcctgccagttagaat

SEQ ID NO: 409604 - DNA, 25 bp, Homo sapien
ttcctgccagttagaataaattcgt

SEQ ID NO: 409605 - DNA, 25 bp, Homo sapien
tcgtacattcattcgttgattccaa

SEQ ID NO: 409606 - DNA, 25 bp, Homo sapien
gttgattccaaagtatttccaaaga

SEQ ID NO: 409607 - DNA, 25 bp, Homo sapien
gaactgtttatgtgcaaaatcctga

SEQ ID NO: 409608 - DNA, 25 bp, Homo sapien
ttatgtgcaaaatcctgacgcaggt

SEQ ID NO: 409609 - DNA, 25 bp, Homo sapien
atcctgacgcaggtactttcatgca

SEQ ID NO: 409610 - DNA, 25 bp, Homo sapien
gggagcttccaagtaacaggccatt

SEQ ID NO: 409611 - DNA, 25 bp, Homo sapien
gtaacaggccatttcttacctccct

SEQ ID NO: 409612 - DNA, 25 bp, Homo sapien
tccctccaggaacagtgggcactgc

SEQ ID NO: 409613 - DNA, 25 bp, Homo sapien
acctcgtgtctgctcataggatgac

SEQ ID NO: 409614 - DNA, 25 bp, Homo sapien
taggatgacgctggagatccccaca

SEQ ID NO: 409615 - DNA, 25 bp, Homo sapien
gctggagatccccacacttactcta

SEQ ID NO: 409616 - DNA, 25 bp, Homo sapien
ttactctaccctcttggcaaattgg

SEQ ID NO: 409617 - DNA, 25 bp, Homo sapien
caaattggcattccggtggtggttt

SEQ ID NO: 409618 - DNA, 25 bp, Homo sapien
gggtgagaacaactagctgtagcat

SEQ ID NO: 409619 - DNA, 25 bp, Homo sapien
caactagctgtagcatgtgtaggct

SEQ ID NO: 409620 - DNA, 25 bp, Homo sapien
tgtgtaggctatatactttaccatt

SEQ ID NO: 409621 - DNA, 25 bp, Homo sapien
ccaaatgcttgtattggtaacattt

SEQ ID NO: 409622 - DNA, 25 bp, Homo sapien
aatgcttgtattggtaacattttct

SEQ ID NO: 409623 - DNA, 25 bp, Homo sapien
tggtaacattttctgtattaccttt

SEQ ID NO: 409624 - DNA, 25 bp, Homo sapien
gtattacctttttatgtccagacaa

SEQ ID NO: 409625 - DNA, 25 bp, Homo sapien
attacctttttatgtccagacaatc

SEQ ID NO: 409626 - DNA, 25 bp, Homo sapien
ttacctttttatgtccagacaatca

SEQ ID NO: 409627 - DNA, 25 bp, Homo sapien
tacctttttatgtccagacaatcaa

SEQ ID NO: 409628 - DNA, 25 bp, Homo sapien
acctttttatgtccagacaatcaac

SEQ ID NO: 409629 - DNA, 25 bp, Homo sapien
cctttttatgtccagacaatcaaca

SEQ ID NO: 409630 - DNA, 25 bp, Homo sapien
ctttttatgtccagacaatcaacaa

SEQ ID NO: 409631 - DNA, 25 bp, Homo sapien
ttttatgtccagacaatcaacaaaa

SEQ ID NO: 409632 - DNA, 25 bp, Homo sapien
caaaaatcaaccaggcatgacggtg

SEQ ID NO: 409633 - DNA, 25 bp, Homo sapien
aaaaatcaaccaggcatgacggtgc

SEQ ID NO: 409634 - DNA, 25 bp, Homo sapien
aaaatcaaccaggcatgacggtgca

SEQ ID NO: 409635 - DNA, 25 bp, Homo sapien
aaatcaaccaggcatgacggtgcac

SEQ ID NO: 409636 - DNA, 25 bp, Homo sapien
aatcaaccaggcatgacggtgcacg

SEQ ID NO: 409637 - DNA, 25 bp, Homo sapien
atcaaccaggcatgacggtgcacgc

SEQ ID NO: 409638 - DNA, 25 bp, Homo sapien
tcaaccaggcatgacggtgcacgcc

SEQ ID NO: 409639 - DNA, 25 bp, Homo sapien
caaccaggcatgacggtgcacgcct

SEQ ID NO: 409640 - DNA, 25 bp, Homo sapien
agacaataatacgaacccctctctg

SEQ ID NO: 409641 - DNA, 25 bp, Homo sapien
tctggctgcacggtcgcttatggca

SEQ ID NO: 409642 - DNA, 25 bp, Homo sapien
ggtcgcttatggcagttccacacag

SEQ ID NO: 409643 - DNA, 25 bp, Homo sapien
agttccacacagtagttggcgccca

SEQ ID NO: 409644 - DNA, 25 bp, Homo sapien
cacacagtagttggcgcccaatggg

SEQ ID NO: 409645 - DNA, 25 bp, Homo sapien
aactagtctagatgtcttctttttt

SEQ ID NO: 409646 - DNA, 25 bp, Homo sapien
gtgcatgtaaagcatcattgaatca

SEQ ID NO: 409647 - DNA, 25 bp, Homo sapien
aatcaatggatctgttgaagaactc

SEQ ID NO: 409648 - DNA, 25 bp, Homo sapien
aactcagctgctggaaaccatgcaa

SEQ ID NO: 409649 - DNA, 25 bp, Homo sapien
tttgaattgcccttaaaatatggaa

SEQ ID NO: 409650 - DNA, 25 bp, Homo sapien
ctttatattctttctgctgtaaatt

SEQ ID NO: 409651 - DNA, 25 bp, Homo sapien
caatatccactctacccagctgggc

SEQ ID NO: 409652 - DNA, 25 bp, Homo sapien
gggagcctgaggaaccagccatgtc

SEQ ID NO: 409653 - DNA, 25 bp, Homo sapien
tgaggaaccagccatgtctctgctg

SEQ ID NO: 409654 - DNA, 25 bp, Homo sapien
aggaaccagccatgtctctgctgcc

SEQ ID NO: 409655 - DNA, 25 bp, Homo sapien
tgatgccaaccttgggagatgccct

SEQ ID NO: 409656 - DNA, 25 bp, Homo sapien
tgccaaccttgggagatgccctcat

SEQ ID NO: 409657 - DNA, 25 bp, Homo sapien
aaccttgggagatgccctcatcctg

SEQ ID NO: 409658 - DNA, 25 bp, Homo sapien
tgggagatgccctcatcctgtacct

SEQ ID NO: 409659 - DNA, 25 bp, Homo sapien
tcctgtacctgcatctggtcctggg

SEQ ID NO: 409660 - DNA, 25 bp, Homo sapien
tggcaggagtcctccagccaccagg

SEQ ID NO: 409661 - DNA, 25 bp, Homo sapien
gccccagggaagtggaacaggagct

SEQ ID NO: 409662 - DNA, 25 bp, Homo sapien
ggagagacggccaagcagcaccagc

SEQ ID NO: 409663 - DNA, 25 bp, Homo sapien
gcaccagcgtgcctttgggtgataa

SEQ ID NO: 409664 - DNA, 25 bp, Homo sapien
acacacctgggagcttcagacgtgg

SEQ ID NO: 409665 - DNA, 25 bp, Homo sapien
ttcagacgtggcctggacgactcca

SEQ ID NO: 409666 - DNA, 25 bp, Homo sapien
cggatatcagccctcaacattgtgg

SEQ ID NO: 409667 - DNA, 25 bp, Homo sapien
aacattgtgggagacctactgcgga

SEQ ID NO: 409668 - DNA, 25 bp, Homo sapien
tgtgggagacctactgcggaaagtc

SEQ ID NO: 409669 - DNA, 25 bp, Homo sapien
gggcactggagtccaaactcgcttc

SEQ ID NO: 409670 - DNA, 25 bp, Homo sapien
ggaacctcgtgtacgatcagtcccc

SEQ ID NO: 409671 - DNA, 25 bp, Homo sapien
tcagtccccaaaccgaacaggtggc

SEQ ID NO: 409672 - DNA, 25 bp, Homo sapien
agcctctgggcggagcagcaagaac

SEQ ID NO: 409673 - DNA, 25 bp, Homo sapien
tagaggcggggcttcaccgtgttgg

SEQ ID NO: 409674 - DNA, 25 bp, Homo sapien
agaggcggggcttcaccgtgttggc

SEQ ID NO: 409675 - DNA, 25 bp, Homo sapien
gaggcggggcttcaccgtgttggcc

SEQ ID NO: 409676 - DNA, 25 bp, Homo sapien
aggcggggcttcaccgtgttggcca

SEQ ID NO: 409677 - DNA, 25 bp, Homo sapien
ggcggggcttcaccgtgttggccag

SEQ ID NO: 409678 - DNA, 25 bp, Homo sapien
gcggggcttcaccgtgttggccagg

SEQ ID NO: 409679 - DNA, 25 bp, Homo sapien
tttttttttggagacgctctgtcgc

SEQ ID NO: 409680 - DNA, 25 bp, Homo sapien
ttttttttggagacgctctgtcgcc

SEQ ID NO: 409681 - DNA, 25 bp, Homo sapien
tttttttggagacgctctgtcgccc

SEQ ID NO: 409682 - DNA, 25 bp, Homo sapien
ccaaatctttggtaccctaggcaga

SEQ ID NO: 409683 - DNA, 25 bp, Homo sapien
ggtaccctaggcagatgtgtcatat

SEQ ID NO: 409684 - DNA, 25 bp, Homo sapien
gtcatatttatcctgggctttatgt

SEQ ID NO: 409685 - DNA, 25 bp, Homo sapien
tatcctgggctttatgtacctctgg

SEQ ID NO: 409686 - DNA, 25 bp, Homo sapien
tgtacctctggtttgagggactctt

SEQ ID NO: 409687 - DNA, 25 bp, Homo sapien
gagggactcttgaacttcattttaa

SEQ ID NO: 409688 - DNA, 25 bp, Homo sapien
acttcattttaagaaacatggccca

SEQ ID NO: 409689 - DNA, 25 bp, Homo sapien
acatggcccaatgagtacacagtca

SEQ ID NO: 409690 - DNA, 25 bp, Homo sapien
tacacagtcaagtcttcatgtccct

SEQ ID NO: 409691 - DNA, 25 bp, Homo sapien
tgcaattttttgcatcctaattaat

SEQ ID NO: 409692 - DNA, 25 bp, Homo sapien
aatatatctgtgtgttttagtgtaa

SEQ ID NO: 409693 - DNA, 25 bp, Homo sapien
aattggcccaggaagcaaatcccct

SEQ ID NO: 409694 - DNA, 25 bp, Homo sapien
aatcccctgcctttagtatgaacca

SEQ ID NO: 409695 - DNA, 25 bp, Homo sapien
tatgaaccactataagtaaccttac

SEQ ID NO: 409696 - DNA, 25 bp, Homo sapien
acaaatagagttaatccaagacaat

SEQ ID NO: 409697 - DNA, 25 bp, Homo sapien
taacaaactgtgctttgtctttaat

SEQ ID NO: 409698 - DNA, 25 bp, Homo sapien
aacaaacatattgatggcataacct

SEQ ID NO: 409699 - DNA, 25 bp, Homo sapien
ttgatggcataacctattcagctat

SEQ ID NO: 409700 - DNA, 25 bp, Homo sapien
tggcataacctattcagctatgtcc

SEQ ID NO: 409701 - DNA, 25 bp, Homo sapien
tatttttgcaataatgtaacctcaa

SEQ ID NO: 409702 - DNA, 25 bp, Homo sapien
aataatgtaacctcaaatattggat

SEQ ID NO: 409703 - DNA, 25 bp, Homo sapien
ttgaaccaacaatggctgtgttaaa

SEQ ID NO: 409704 - DNA, 25 bp, Homo sapien
ggcccggatatcagccctcaacatt

SEQ ID NO: 409705 - DNA, 25 bp, Homo sapien
cggatatcagccctcaacattgtgg

SEQ ID NO: 409706 - DNA, 25 bp, Homo sapien
ggatatcagccctcaacattgtggg

SEQ ID NO: 409707 - DNA, 25 bp, Homo sapien
atatcagccctcaacattgtgggag

SEQ ID NO: 409708 - DNA, 25 bp, Homo sapien
agccctcaacattgtgggagaccta

SEQ ID NO: 409709 - DNA, 25 bp, Homo sapien
tcaacattgtgggagacctactgcg

SEQ ID NO: 409710 - DNA, 25 bp, Homo sapien
aacattgtgggagacctactgcgga

SEQ ID NO: 409711 - DNA, 25 bp, Homo sapien
acattgtgggagacctactgcggaa

SEQ ID NO: 409712 - DNA, 25 bp, Homo sapien
gaaagtcggggcactggagtccaaa

SEQ ID NO: 409713 - DNA, 25 bp, Homo sapien
ggggcactggagtccaaactcgctt

SEQ ID NO: 409714 - DNA, 25 bp, Homo sapien
tcagtccccaaaccgaacaggtggc

SEQ ID NO: 409715 - DNA, 25 bp, Homo sapien
atagcactgtataaacacagcatag

SEQ ID NO: 409716 - DNA, 25 bp, Homo sapien
tgaagatcccagaatgtggaaacaa

SEQ ID NO: 409717 - DNA, 25 bp, Homo sapien
gaatgtggaaacaaaaagctgacaa

SEQ ID NO: 409718 - DNA, 25 bp, Homo sapien
gaagacacaggttctgaggactgct

SEQ ID NO: 409719 - DNA, 25 bp, Homo sapien
caggttctgaggactgctggacagc

SEQ ID NO: 409720 - DNA, 25 bp, Homo sapien
taaagaaaagctctcttatcatgag

SEQ ID NO: 409721 - DNA, 25 bp, Homo sapien
gaaaagctctcttatcatgagagaa

SEQ ID NO: 409722 - DNA, 25 bp, Homo sapien
caaaaggtttctgcatttaattcgt

SEQ ID NO: 409723 - DNA, 25 bp, Homo sapien
ggtttctgcatttaattcgttattt

SEQ ID NO: 409724 - DNA, 25 bp, Homo sapien
ttcgttatttagagggctgaattta

SEQ ID NO: 409725 - DNA, 25 bp, Homo sapien
gaaaacataattaagaccgcaaaat

SEQ ID NO: 409726 - DNA, 25 bp, Homo sapien
ggtcgaaatgccaaaggtctacttt

SEQ ID NO: 409727 - DNA, 25 bp, Homo sapien
tactttccagaatcaagtgccttct

SEQ ID NO: 409728 - DNA, 25 bp, Homo sapien
gtgccttctgcaaatcatgttggaa

SEQ ID NO: 409729 - DNA, 25 bp, Homo sapien
cccttttccttcagctgtgttagga

SEQ ID NO: 409730 - DNA, 25 bp, Homo sapien
gaagttttcagaaccctctaggctg

SEQ ID NO: 409731 - DNA, 25 bp, Homo sapien
ctaggctggtggctttcaaacttca

SEQ ID NO: 409732 - DNA, 25 bp, Homo sapien
aacttcagaccatgatctgcagcaa

SEQ ID NO: 409733 - DNA, 25 bp, Homo sapien
tgcagcaagaaacgtgccttccatc

SEQ ID NO: 409734 - DNA, 25 bp, Homo sapien
gccttccatcataaatcagtccatt

SEQ ID NO: 409735 - DNA, 25 bp, Homo sapien
atttgtttacaactgtgttccaagc

SEQ ID NO: 409736 - DNA, 25 bp, Homo sapien
gtgttccaagcaggtttcataaaga

SEQ ID NO: 409737 - DNA, 25 bp, Homo sapien
agaagttgactcaacaatgcttggt

SEQ ID NO: 409738 - DNA, 25 bp, Homo sapien
aacaatgcttggtttcttgtggcag

SEQ ID NO: 409739 - DNA, 25 bp, Homo sapien
ggcagtgagttttttccctatgata

SEQ ID NO: 409740 - DNA, 25 bp, Homo sapien
gttttttccctatgatatcatcagt

SEQ ID NO: 409741 - DNA, 25 bp, Homo sapien
gatatcatcagttgttgctgctatt

SEQ ID NO: 409742 - DNA, 25 bp, Homo sapien
cagttgttgctgctattttggcaaa

SEQ ID NO: 409743 - DNA, 25 bp, Homo sapien
gatgtacacataaagcagaccaggc

SEQ ID NO: 409744 - DNA, 25 bp, Homo sapien
cagaccaggctggaaagcttgtgga

SEQ ID NO: 409745 - DNA, 25 bp, Homo sapien
gctggaaagcttgtggatagacatc

SEQ ID NO: 409746 - DNA, 25 bp, Homo sapien
ggatagacatccactgacagaatca

SEQ ID NO: 409747 - DNA, 25 bp, Homo sapien
tgacagaatcatttaagagcagttt

SEQ ID NO: 409748 - DNA, 25 bp, Homo sapien
tcggcacgaggtgttaccaatttga

SEQ ID NO: 409749 - DNA, 25 bp, Homo sapien
cggcacgaggtgttaccaatttgaa

SEQ ID NO: 409750 - DNA, 25 bp, Homo sapien
gcacgaggtgttaccaatttgaagt

SEQ ID NO: 409751 - DNA, 25 bp, Homo sapien
acgaggtgttaccaatttgaagtgg

SEQ ID NO: 409752 - DNA, 25 bp, Homo sapien
ggtgttaccaatttgaagtgggagc

SEQ ID NO: 409753 - DNA, 25 bp, Homo sapien
ccaatttgaagtgggagcagccgct

SEQ ID NO: 409754 - DNA, 25 bp, Homo sapien
aatttgaagtgggagcagccgctca

SEQ ID NO: 409755 - DNA, 25 bp, Homo sapien
atttgaagtgggagcagccgctcat

SEQ ID NO: 409756 - DNA, 25 bp, Homo sapien
tttgaagtgggagcagccgctcatt

SEQ ID NO: 409757 - DNA, 25 bp, Homo sapien
ttgaagtgggagcagccgctcattt

SEQ ID NO: 409758 - DNA, 25 bp, Homo sapien
taaatcatgaatcccgccaggtacg

SEQ ID NO: 409759 - DNA, 25 bp, Homo sapien
tgcctctgaagtctgacatctctgc

SEQ ID NO: 409760 - DNA, 25 bp, Homo sapien
tgacatctctgcttagccctaggag

SEQ ID NO: 409761 - DNA, 25 bp, Homo sapien
ttagccctaggagtctggttccctg

SEQ ID NO: 409762 - DNA, 25 bp, Homo sapien
gtcattgttgatgtcacctcctaaa

SEQ ID NO: 409763 - DNA, 25 bp, Homo sapien
tcacctcctaaaaagaccttcactt

SEQ ID NO: 409764 - DNA, 25 bp, Homo sapien
accttcactttctggctgccacaaa

SEQ ID NO: 409765 - DNA, 25 bp, Homo sapien
ggctgccacaaagccatatgtgttg

SEQ ID NO: 409766 - DNA, 25 bp, Homo sapien
atatgtgttgctccccatatacagc

SEQ ID NO: 409767 - DNA, 25 bp, Homo sapien
tccccatatacagcctgacagagta

SEQ ID NO: 409768 - DNA, 25 bp, Homo sapien
gtgtatcactggctatcagttcctc

SEQ ID NO: 409769 - DNA, 25 bp, Homo sapien
atcactggctatcagttcctcatgt

SEQ ID NO: 409770 - DNA, 25 bp, Homo sapien
cagcctggaggcacttttccagtga

SEQ ID NO: 409771 - DNA, 25 bp, Homo sapien
aggcacttttccagtgaaagcaggc

SEQ ID NO: 409772 - DNA, 25 bp, Homo sapien
caaaaatcaaccaggcatgacggtg

SEQ ID NO: 409773 - DNA, 25 bp, Homo sapien
aaaaatcaaccaggcatgacggtgc

SEQ ID NO: 409774 - DNA, 25 bp, Homo sapien
aaatcaaccaggcatgacggtgcac

SEQ ID NO: 409775 - DNA, 25 bp, Homo sapien
aatcaaccaggcatgacggtgcacg

SEQ ID NO: 409776 - DNA, 25 bp, Homo sapien
atcaaccaggcatgacggtgcacgc

SEQ ID NO: 409777 - DNA, 25 bp, Homo sapien
caaccaggcatgacggtgcacgcct

SEQ ID NO: 409778 - DNA, 25 bp, Homo sapien
gcatgacggtgcacgcctgttatca

SEQ ID NO: 409779 - DNA, 25 bp, Homo sapien
catgacggtgcacgcctgttatcac

SEQ ID NO: 409780 - DNA, 25 bp, Homo sapien
cggtgcacgcctgttatcacagcta

SEQ ID NO: 409781 - DNA, 25 bp, Homo sapien
gtactaaatgtcaagcctaactgtg

SEQ ID NO: 409782 - DNA, 25 bp, Homo sapien
gcctaactgtgaattttgttctgta

SEQ ID NO: 409783 - DNA, 25 bp, Homo sapien
gaattttgttctgtatcttaagtaa

SEQ ID NO: 409784 - DNA, 25 bp, Homo sapien
aaatttatgataatgttctcgagct

SEQ ID NO: 409785 - DNA, 25 bp, Homo sapien
gataatgttctcgagctatcaacaa

SEQ ID NO: 409786 - DNA, 25 bp, Homo sapien
aatgttctcgagctatcaacaaaat

SEQ ID NO: 409787 - DNA, 25 bp, Homo sapien
tatatgtacttttgtgagctatgaa

SEQ ID NO: 409788 - DNA, 25 bp, Homo sapien
acttttgtgagctatgaattttcta

SEQ ID NO: 409789 - DNA, 25 bp, Homo sapien
gatttttacatgaatgatactttgt

SEQ ID NO: 409790 - DNA, 25 bp, Homo sapien
ctatcaaatgtcagtattttactac

SEQ ID NO: 409791 - DNA, 25 bp, Homo sapien
attatcactaaatgaacttcgattt

SEQ ID NO: 409792 - DNA, 25 bp, Homo sapien
agtggagcacgctgcaggctcgcct

SEQ ID NO: 409793 - DNA, 25 bp, Homo sapien
ggagcacgctgcaggctcgcctcag

SEQ ID NO: 409794 - DNA, 25 bp, Homo sapien
gtcgcccgtaggtgcctgcacgcgt

SEQ ID NO: 409795 - DNA, 25 bp, Homo sapien
cggctggcctggacgaacgggaagc

SEQ ID NO: 409796 - DNA, 25 bp, Homo sapien
gcaagaagactgaggagccgccccg

SEQ ID NO: 409797 - DNA, 25 bp, Homo sapien
agaagactgaggagccgccccgcga

SEQ ID NO: 409798 - DNA, 25 bp, Homo sapien
gacttcgatccggcgctgctggagt

SEQ ID NO: 409799 - DNA, 25 bp, Homo sapien
gagttcctggtgtgcccgctctcca

SEQ ID NO: 409800 - DNA, 25 bp, Homo sapien
gctctccaagaagccgctcagatat

SEQ ID NO: 409801 - DNA, 25 bp, Homo sapien
ggaagccgggagctcggccacgggt

SEQ ID NO: 409802 - DNA, 25 bp, Homo sapien
tctccggctgccagaccatgctgag

SEQ ID NO: 409803 - DNA, 25 bp, Homo sapien
tgaaacactggatttacttaagaaa

SEQ ID NO: 409804 - DNA, 25 bp, Homo sapien
aagtgtaacacagttcttacaaggt

SEQ ID NO: 409805 - DNA, 25 bp, Homo sapien
aacacagttcttacaaggtatggta

SEQ ID NO: 409806 - DNA, 25 bp, Homo sapien
ccattttgatggagttgatactttt

SEQ ID NO: 409807 - DNA, 25 bp, Homo sapien
tactttttcttgtaagttcttcctg

SEQ ID NO: 409808 - DNA, 25 bp, Homo sapien
tcttgtaagttcttcctgtagtgaa

SEQ ID NO: 409809 - DNA, 25 bp, Homo sapien
agaaagtgaggtgtcattgccgaaa

SEQ ID NO: 409810 - DNA, 25 bp, Homo sapien
gtcattgccgaaaggacacactaat

SEQ ID NO: 409811 - DNA, 25 bp, Homo sapien
ggacacactaataacctcttggtag

SEQ ID NO: 409812 - DNA, 25 bp, Homo sapien
ataacctcttggtagtttattgcag

SEQ ID NO: 409813 - DNA, 25 bp, Homo sapien
ctcttggtagtttattgcaggtaaa

SEQ ID NO: 409814 - DNA, 25 bp, Homo sapien
gccactgcactggatgtttgggcaa

SEQ ID NO: 409815 - DNA, 25 bp, Homo sapien
cactggatgtttgggcaaggctgct

SEQ ID NO: 409816 - DNA, 25 bp, Homo sapien
atgtttgggcaaggctgcttacttc

SEQ ID NO: 409817 - DNA, 25 bp, Homo sapien
ttgggcaaggctgcttacttccaac

SEQ ID NO: 409818 - DNA, 25 bp, Homo sapien
gcaaggctgcttacttccaaccgtt

SEQ ID NO: 409819 - DNA, 25 bp, Homo sapien
ggctgcttacttccaaccgttcgat

SEQ ID NO: 409820 - DNA, 25 bp, Homo sapien
caatggcagcctttgtgcgctgagg

SEQ ID NO: 409821 - DNA, 25 bp, Homo sapien
gcgctgagggtctggtgttccatcc

SEQ ID NO: 409822 - DNA, 25 bp, Homo sapien
ctgagggtctggtgttccatccaca

SEQ ID NO: 409823 - DNA, 25 bp, Homo sapien
atgctgccatcggtactggaggcca

SEQ ID NO: 409824 - DNA, 25 bp, Homo sapien
catcggtactggaggccactgcact

SEQ ID NO: 409825 - DNA, 25 bp, Homo sapien
gatttaaagtatacatttaggcagg

SEQ ID NO: 409826 - DNA, 25 bp, Homo sapien
atttaaagtatacatttaggcaggg

SEQ ID NO: 409827 - DNA, 25 bp, Homo sapien
tttaaagtatacatttaggcagggt

SEQ ID NO: 409828 - DNA, 25 bp, Homo sapien
ttaaagtatacatttaggcagggtg

SEQ ID NO: 409829 - DNA, 25 bp, Homo sapien
taaagtatacatttaggcagggtgc

SEQ ID NO: 409830 - DNA, 25 bp, Homo sapien
aaagtatacatttaggcagggtgca

SEQ ID NO: 409831 - DNA, 25 bp, Homo sapien
aagtatacatttaggcagggtgcag

SEQ ID NO: 409832 - DNA, 25 bp, Homo sapien
agtatacatttaggcagggtgcagt

SEQ ID NO: 409833 - DNA, 25 bp, Homo sapien
gtatacatttaggcagggtgcagtg

SEQ ID NO: 409834 - DNA, 25 bp, Homo sapien
aagaccagcctagagaacatatgga

SEQ ID NO: 409835 - DNA, 25 bp, Homo sapien
atcaaagaacaagcaaatggacccc

SEQ ID NO: 409836 - DNA, 25 bp, Homo sapien
ctgcaggcgcccatagccatcgggt

SEQ ID NO: 409837 - DNA, 25 bp, Homo sapien
atagccatcgggtctctaaagctga

SEQ ID NO: 409838 - DNA, 25 bp, Homo sapien
tcgggtctctaaagctgagtggcta

SEQ ID NO: 409839 - DNA, 25 bp, Homo sapien
gagtggctagcagcgtttgtttgtt

SEQ ID NO: 409840 - DNA, 25 bp, Homo sapien
ctgaaggtgggacagtcacttcctc

SEQ ID NO: 409841 - DNA, 25 bp, Homo sapien
cacgtgcgacctggaggactggtca

SEQ ID NO: 409842 - DNA, 25 bp, Homo sapien
ggactggtcagaaccgttactgtga

SEQ ID NO: 409843 - DNA, 25 bp, Homo sapien
gaatgagtgaagatcctggaggacc

SEQ ID NO: 409844 - DNA, 25 bp, Homo sapien
acggtgaacggccatgtgttaatgt

SEQ ID NO: 409845 - DNA, 25 bp, Homo sapien
aacggccatgtgttaatgttacgat

SEQ ID NO: 409846 - DNA, 25 bp, Homo sapien
ggagatgaacatccctaattgacat

SEQ ID NO: 409847 - DNA, 25 bp, Homo sapien
gtgatgactatttcttattccattc

SEQ ID NO: 409848 - DNA, 25 bp, Homo sapien
atgatagctcttgggcatcgatctc

SEQ ID NO: 409849 - DNA, 25 bp, Homo sapien
ttgggcatcgatctctgaaagctca

SEQ ID NO: 409850 - DNA, 25 bp, Homo sapien
ttagtttgcgggaaagaggctttgc

SEQ ID NO: 409851 - DNA, 25 bp, Homo sapien
aagaggctttgctttgcgcatatca

SEQ ID NO: 409852 - DNA, 25 bp, Homo sapien
gctttgcgcatatcaggcttaggac

SEQ ID NO: 409853 - DNA, 25 bp, Homo sapien
ggaggcttaagttgcagatgcttct

SEQ ID NO: 409854 - DNA, 25 bp, Homo sapien
ttgttttttgaaggctctgacttat

SEQ ID NO: 409855 - DNA, 25 bp, Homo sapien
ggctctgacttataactgctgtatc

SEQ ID NO: 409856 - DNA, 25 bp, Homo sapien
gacagtgtcttggttggagatgaac

SEQ ID NO: 409857 - DNA, 25 bp, Homo sapien
tgtcactactccatagtacataccc

SEQ ID NO: 409858 - DNA, 25 bp, Homo sapien
tcactactccatagtacataccctt

SEQ ID NO: 409859 - DNA, 25 bp, Homo sapien
gttacagctgtttcacaaatacagg

SEQ ID NO: 409860 - DNA, 25 bp, Homo sapien
gctgtttcacaaatacaggttgaat

SEQ ID NO: 409861 - DNA, 25 bp, Homo sapien
tgtttgggactaaaagtttcagatt

SEQ ID NO: 409862 - DNA, 25 bp, Homo sapien
atactcttagagttgggacccaagt

SEQ ID NO: 409863 - DNA, 25 bp, Homo sapien
actcttagagttgggacccaagtct

SEQ ID NO: 409864 - DNA, 25 bp, Homo sapien
tgaatagactatatgttgtgcacct

SEQ ID NO: 409865 - DNA, 25 bp, Homo sapien
atagactatatgttgtgcacctaca

SEQ ID NO: 409866 - DNA, 25 bp, Homo sapien
gactatatgttgtgcacctacattt

SEQ ID NO: 409867 - DNA, 25 bp, Homo sapien
ctatatgttgtgcacctacattttg

SEQ ID NO: 409868 - DNA, 25 bp, Homo sapien
aatcaataaacataatccatcacag

SEQ ID NO: 409869 - DNA, 25 bp, Homo sapien
acataatccatcacagaaacagaac

SEQ ID NO: 409870 - DNA, 25 bp, Homo sapien
gaaccaatgacaaaaaccgcttgat

SEQ ID NO: 409871 - DNA, 25 bp, Homo sapien
caatgacaaaaaccgcttgattatc

SEQ ID NO: 409872 - DNA, 25 bp, Homo sapien
tgacaaaaaccgcttgattatctca

SEQ ID NO: 409873 - DNA, 25 bp, Homo sapien
gccgtcgacaaaattcaaaagccct

SEQ ID NO: 409874 - DNA, 25 bp, Homo sapien
gtcgacaaaattcaaaagcccttca

SEQ ID NO: 409875 - DNA, 25 bp, Homo sapien
aattcaaaagcccttcatgctaaaa

SEQ ID NO: 409876 - DNA, 25 bp, Homo sapien
ttcaaaagcccttcatgctaaaaac

SEQ ID NO: 409877 - DNA, 25 bp, Homo sapien
actaggtattgatagaacgtttctc

SEQ ID NO: 409878 - DNA, 25 bp, Homo sapien
ggtattgatagaacgtttctcaaaa

SEQ ID NO: 409879 - DNA, 25 bp, Homo sapien
ttagctaatatctagccaggagagc

SEQ ID NO: 409880 - DNA, 25 bp, Homo sapien
aattttacacaatacacatggctta

SEQ ID NO: 409881 - DNA, 25 bp, Homo sapien
ataagtcatatacctgttttcagtc

SEQ ID NO: 409882 - DNA, 25 bp, Homo sapien
atacctgttttcagtcctaacattt

SEQ ID NO: 409883 - DNA, 25 bp, Homo sapien
aaggattcttgagtcccaatcacat

SEQ ID NO: 409884 - DNA, 25 bp, Homo sapien
ttgagtcccaatcacataactgtgg

SEQ ID NO: 409885 - DNA, 25 bp, Homo sapien
acataactgtggtgttactctgtca

SEQ ID NO: 409886 - DNA, 25 bp, Homo sapien
tactctgtcatttatatggtgtcaa

SEQ ID NO: 409887 - DNA, 25 bp, Homo sapien
aaagcacttgatgagtaaacccagt

SEQ ID NO: 409888 - DNA, 25 bp, Homo sapien
gagtaaacccagtagcatctttttg

SEQ ID NO: 409889 - DNA, 25 bp, Homo sapien
cagtagcatctttttgagtgtttca

SEQ ID NO: 409890 - DNA, 25 bp, Homo sapien
tccaaaattgtgattgttctaactc

SEQ ID NO: 409891 - DNA, 25 bp, Homo sapien
aattgtgattgttctaactctatta

SEQ ID NO: 409892 - DNA, 25 bp, Homo sapien
gtgattgttctaactctattattat

SEQ ID NO: 409893 - DNA, 25 bp, Homo sapien
ttctgtattaattagtcatcattct

SEQ ID NO: 409894 - DNA, 25 bp, Homo sapien
aattagtcatcattctactgtaagg

SEQ ID NO: 409895 - DNA, 25 bp, Homo sapien
taaggaagaggtttccctttatcat

SEQ ID NO: 409896 - DNA, 25 bp, Homo sapien
aggaagaggtttccctttatcatca

SEQ ID NO: 409897 - DNA, 25 bp, Homo sapien
gaagaggtttccctttatcatcaac

SEQ ID NO: 409898 - DNA, 25 bp, Homo sapien
aagaggtttccctttatcatcaact

SEQ ID NO: 409899 - DNA, 25 bp, Homo sapien
gaggtttccctttatcatcaacttc

SEQ ID NO: 409900 - DNA, 25 bp, Homo sapien
aggtttccctttatcatcaacttcg

SEQ ID NO: 409901 - DNA, 25 bp, Homo sapien
atgtcaccaccaccgtaatcgagat

SEQ ID NO: 409902 - DNA, 25 bp, Homo sapien
atcgagattcagaatgttgcatcaa

SEQ ID NO: 409903 - DNA, 25 bp, Homo sapien
cctcatgctccttgtttatagtcac

SEQ ID NO: 409904 - DNA, 25 bp, Homo sapien
tgtttatagtcacaacctctcctca

SEQ ID NO: 409905 - DNA, 25 bp, Homo sapien
agccctaacccttggcaatcagaaa

SEQ ID NO: 409906 - DNA, 25 bp, Homo sapien
acccttggcaatcagaaatcttttc

SEQ ID NO: 409907 - DNA, 25 bp, Homo sapien
atcatacagcatgtacccttttggt

SEQ ID NO: 409908 - DNA, 25 bp, Homo sapien
tacccttttggtattggctatttca

SEQ ID NO: 409909 - DNA, 25 bp, Homo sapien
gattaacctgaaatccatccaagtt

SEQ ID NO: 409910 - DNA, 25 bp, Homo sapien
catccaagttgttctgcatatcatt

SEQ ID NO: 409911 - DNA, 25 bp, Homo sapien
ttggccactaataatctatgatacg

SEQ ID NO: 409912 - DNA, 25 bp, Homo sapien
accttttgatcacagttggagttgt

SEQ ID NO: 409913 - DNA, 25 bp, Homo sapien
tatgtcaagtcatttcctcagtcca

SEQ ID NO: 409914 - DNA, 25 bp, Homo sapien
aaatgtgccgtggtgtgcaacatcc

SEQ ID NO: 409915 - DNA, 25 bp, Homo sapien
ccgtggtgtgcaacatcccttgagg

SEQ ID NO: 409916 - DNA, 25 bp, Homo sapien
gtctgtttcttcgaaattaccttct

SEQ ID NO: 409917 - DNA, 25 bp, Homo sapien
aattaccttcttcagtgtaccagaa

SEQ ID NO: 409918 - DNA, 25 bp, Homo sapien
ctggtgacatcagtgattccatgga

SEQ ID NO: 409919 - DNA, 25 bp, Homo sapien
attccatggattttgtactgctcaa

SEQ ID NO: 409920 - DNA, 25 bp, Homo sapien
ggattttgtactgctcaactttgca

SEQ ID NO: 409921 - DNA, 25 bp, Homo sapien
caagctctgggtgcgaatgcagcat

SEQ ID NO: 409922 - DNA, 25 bp, Homo sapien
gcagcatcagggacatagccgagat

SEQ ID NO: 409923 - DNA, 25 bp, Homo sapien
tttgcctgtaagttaacatgtttcc

SEQ ID NO: 409924 - DNA, 25 bp, Homo sapien
gcctgtaagttaacatgtttccaaa

SEQ ID NO: 409925 - DNA, 25 bp, Homo sapien
tgtaagttaacatgtttccaaaatt

SEQ ID NO: 409926 - DNA, 25 bp, Homo sapien
gcctgggtccccaaaagaatgtgga

SEQ ID NO: 409927 - DNA, 25 bp, Homo sapien
ctgggtccccaaaagaatgtggaag

SEQ ID NO: 409928 - DNA, 25 bp, Homo sapien
ggtccccaaaagaatgtggaagtat

SEQ ID NO: 409929 - DNA, 25 bp, Homo sapien
gtaattatgcaaacattttaatgct

SEQ ID NO: 409930 - DNA, 25 bp, Homo sapien
ctattttctgcacttatttctttta

SEQ ID NO: 409931 - DNA, 25 bp, Homo sapien
tattttctgcacttatttcttttaa

SEQ ID NO: 409932 - DNA, 25 bp, Homo sapien
cttaatgcttttgttatgaatcaat

SEQ ID NO: 409933 - DNA, 25 bp, Homo sapien
gataatacagaaatagagattgcca

SEQ ID NO: 409934 - DNA, 25 bp, Homo sapien
taggtttaacatttacaccagcgaa

SEQ ID NO: 409935 - DNA, 25 bp, Homo sapien
tacaccagcgaaaatgtttatgaat

SEQ ID NO: 409936 - DNA, 25 bp, Homo sapien
gatttcttttgagcacatttacatg

SEQ ID NO: 409937 - DNA, 25 bp, Homo sapien
catttacatgctgcgtgctgattaa

SEQ ID NO: 409938 - DNA, 25 bp, Homo sapien
atgctgcgtgctgattaataaatta

SEQ ID NO: 409939 - DNA, 25 bp, Homo sapien
ataaattaggcaccaatcatgtgta

SEQ ID NO: 409940 - DNA, 25 bp, Homo sapien
ggcaccaatcatgtgtaaatcaatg

SEQ ID NO: 409941 - DNA, 25 bp, Homo sapien
gtaaatcactagtttatgtacataa

SEQ ID NO: 409942 - DNA, 25 bp, Homo sapien
gtaaacttcatttttcatgcagtgc

SEQ ID NO: 409943 - DNA, 25 bp, Homo sapien
gcccaactactgctaaggtttacta

SEQ ID NO: 409944 - DNA, 25 bp, Homo sapien
tactgctaaggtttactatgattct

SEQ ID NO: 409945 - DNA, 25 bp, Homo sapien
ttacgtagaacctcttgcaatcctg

SEQ ID NO: 409946 - DNA, 25 bp, Homo sapien
gcaatcctgtttggagagtgcaact

SEQ ID NO: 409947 - DNA, 25 bp, Homo sapien
ggagagtgcaacttacgatcttagt

SEQ ID NO: 409948 - DNA, 25 bp, Homo sapien
ggagacctctgaataaagactaact

SEQ ID NO: 409949 - DNA, 25 bp, Homo sapien
ctaactccccaatacatccataaga

SEQ ID NO: 409950 - DNA, 25 bp, Homo sapien
gaatttttctatgagcctgtcattt

SEQ ID NO: 409951 - DNA, 25 bp, Homo sapien
gtcttgtagaaattgagttgccatc

SEQ ID NO: 409952 - DNA, 25 bp, Homo sapien
tgccatcacatagaggatttcttgt

SEQ ID NO: 409953 - DNA, 25 bp, Homo sapien
cttgtcctctgcattgtttaaagga

SEQ ID NO: 409954 - DNA, 25 bp, Homo sapien
aggacaactacaaatcatgctggat

SEQ ID NO: 409955 - DNA, 25 bp, Homo sapien
gagtactcattcaatcttttaggat

SEQ ID NO: 409956 - DNA, 25 bp, Homo sapien
gggattcttcttgcagttttaacac

SEQ ID NO: 409957 - DNA, 25 bp, Homo sapien
cttcttgcagttttaacacttgtac

SEQ ID NO: 409958 - DNA, 25 bp, Homo sapien
taacacttgtactatggtctgaatg

SEQ ID NO: 409959 - DNA, 25 bp, Homo sapien
aattcacatgttggcatttaacccc

SEQ ID NO: 409960 - DNA, 25 bp, Homo sapien
gcatttaacccccaaagtgatgatc

SEQ ID NO: 409961 - DNA, 25 bp, Homo sapien
gtcataaagatgaaaccctcgtgaa

SEQ ID NO: 409962 - DNA, 25 bp, Homo sapien
gaaaagaacctctgcaagaactatg

SEQ ID NO: 409963 - DNA, 25 bp, Homo sapien
gaactatgagaattcccaacaattg

SEQ ID NO: 409964 - DNA, 25 bp, Homo sapien
caacaattgggttggattgattcat

SEQ ID NO: 409965 - DNA, 25 bp, Homo sapien
gattcatattagtctattacttggg

SEQ ID NO: 409966 - DNA, 25 bp, Homo sapien
attacttgggttaccttgagtgtgg

SEQ ID NO: 409967 - DNA, 25 bp, Homo sapien
tgtcgcatccacgtgcgacctggag

SEQ ID NO: 409968 - DNA, 25 bp, Homo sapien
catccacgtgcgacctggaggactg

SEQ ID NO: 409969 - DNA, 25 bp, Homo sapien
cacgtgcgacctggaggactggtca

SEQ ID NO: 409970 - DNA, 25 bp, Homo sapien
gaggactggtcagaaccgttactgt

SEQ ID NO: 409971 - DNA, 25 bp, Homo sapien
gactggtcagaaccgttactgtgaa

SEQ ID NO: 409972 - DNA, 25 bp, Homo sapien
gttactgtgaatgagtgaagatcct

SEQ ID NO: 409973 - DNA, 25 bp, Homo sapien
tgaatgagtgaagatcctggaggac

SEQ ID NO: 409974 - DNA, 25 bp, Homo sapien
acggtgaacggccatgtgttaatgt

SEQ ID NO: 409975 - DNA, 25 bp, Homo sapien
gtgaacggccatgtgttaatgttac

SEQ ID NO: 409976 - DNA, 25 bp, Homo sapien
aacggccatgtgttaatgttacgat

SEQ ID NO: 409977 - DNA, 25 bp, Homo sapien
gccatgtgttaatgttacgatgttt

SEQ ID NO: 409978 - DNA, 25 bp, Homo sapien
ttgagctggtttcttgtcgctagga

SEQ ID NO: 409979 - DNA, 25 bp, Homo sapien
gtcgctaggatggtttattccagga

SEQ ID NO: 409980 - DNA, 25 bp, Homo sapien
attccaggaaattcaggtctcacgt

SEQ ID NO: 409981 - DNA, 25 bp, Homo sapien
gaaattcaggtctcacgttactagg

SEQ ID NO: 409982 - DNA, 25 bp, Homo sapien
gtctcacgttactaggaaggctcat

SEQ ID NO: 409983 - DNA, 25 bp, Homo sapien
ctcattcctaggaagtcatgttcca

SEQ ID NO: 409984 - DNA, 25 bp, Homo sapien
gaagtcatgttccatgttgctagga

SEQ ID NO: 409985 - DNA, 25 bp, Homo sapien
tccatgttgctaggaaggctcattc

SEQ ID NO: 409986 - DNA, 25 bp, Homo sapien
attcctagaagtcatgtcccacaaa

SEQ ID NO: 409987 - DNA, 25 bp, Homo sapien
gaagtcatgtcccacaaagattaaa

SEQ ID NO: 409988 - DNA, 25 bp, Homo sapien
ttcctccttttttgagctggtttct

SEQ ID NO: 409989 - DNA, 25 bp, Homo sapien
aattttaataacaggttcaccagct

SEQ ID NO: 409990 - DNA, 25 bp, Homo sapien
tcaccagctggtagaaaatagagac

SEQ ID NO: 409991 - DNA, 25 bp, Homo sapien
gagacacatgatgatttgcattgta

SEQ ID NO: 409992 - DNA, 25 bp, Homo sapien
aagaaaagtgtgtttgtacccatga

SEQ ID NO: 409993 - DNA, 25 bp, Homo sapien
agtgtgtttgtacccatgagttcag

SEQ ID NO: 409994 - DNA, 25 bp, Homo sapien
gtacccatgagttcagcatttctgc

SEQ ID NO: 409995 - DNA, 25 bp, Homo sapien
gagttcagcatttctgccatcttgc

SEQ ID NO: 409996 - DNA, 25 bp, Homo sapien
tgccatcttgctattttcattttcc

SEQ ID NO: 409997 - DNA, 25 bp, Homo sapien
tttccctgtggaagatgcatggttg

SEQ ID NO: 409998 - DNA, 25 bp, Homo sapien
atgcatggttgcatccttttccttc

SEQ ID NO: 409999 - DNA, 25 bp, Homo sapien
tttccttctgaccaacacttagtct

SEQ ID NO: 410000 - DNA, 25 bp, Homo sapien
aggatgaaggtgaagcggaggaaaa

SEQ ID NO: 410001 - DNA, 25 bp, Homo sapien
ggatgaaggtgaagcggaggaaaag

SEQ ID NO: 410002 - DNA, 25 bp, Homo sapien
tgaaggtgaagcggaggaaaaggaa

SEQ ID NO: 410003 - DNA, 25 bp, Homo sapien
tgggtgtgatgatgcacaccttaag

SEQ ID NO: 410004 - DNA, 25 bp, Homo sapien
gggtgtgatgatgcacaccttaagt

SEQ ID NO: 410005 - DNA, 25 bp, Homo sapien
ggtgtgatgatgcacaccttaagtc

SEQ ID NO: 410006 - DNA, 25 bp, Homo sapien
gtgtgatgatgcacaccttaagtct

SEQ ID NO: 410007 - DNA, 25 bp, Homo sapien
tgtgatgatgcacaccttaagtctc

SEQ ID NO: 410008 - DNA, 25 bp, Homo sapien
gtgatgatgcacaccttaagtctca

SEQ ID NO: 410009 - DNA, 25 bp, Homo sapien
tgaccccaagtagtcatggcaccat

SEQ ID NO: 410010 - DNA, 25 bp, Homo sapien
gaccccaagtagtcatggcaccatc

SEQ ID NO: 410011 - DNA, 25 bp, Homo sapien
aacaatgtcgtcatctaagccctga

SEQ ID NO: 410012 - DNA, 25 bp, Homo sapien
tgtcgtcatctaagccctgacccta

SEQ ID NO: 410013 - DNA, 25 bp, Homo sapien
ggactcccatgctgctgttggctcc

SEQ ID NO: 410014 - DNA, 25 bp, Homo sapien
cactctggagttttcaaatgtcaca

SEQ ID NO: 410015 - DNA, 25 bp, Homo sapien
tcaaatgtcacattagcctcaccct

SEQ ID NO: 410016 - DNA, 25 bp, Homo sapien
agcctcaccctgcatgctaggagat

SEQ ID NO: 410017 - DNA, 25 bp, Homo sapien
tgctaggagatggacctgtctctat

SEQ ID NO: 410018 - DNA, 25 bp, Homo sapien
gatggacctgtctctatacagcagt

SEQ ID NO: 410019 - DNA, 25 bp, Homo sapien
gacctgtctctatacagcagtagat

SEQ ID NO: 410020 - DNA, 25 bp, Homo sapien
ctgaggcttacagaggttgaagacc

SEQ ID NO: 410021 - DNA, 25 bp, Homo sapien
acagaggttgaagaccaacaagcta

SEQ ID NO: 410022 - DNA, 25 bp, Homo sapien
aattctaagatattgctcttctctt

SEQ ID NO: 410023 - DNA, 25 bp, Homo sapien
tcttctcttacctgcctagaggcag

SEQ ID NO: 410024 - DNA, 25 bp, Homo sapien
ggcagcgggatggactacatgacct

SEQ ID NO: 410025 - DNA, 25 bp, Homo sapien
gatggactacatgacctcctggagt

SEQ ID NO: 410026 - DNA, 25 bp, Homo sapien
gccagttctgggagtctgttaagtc

SEQ ID NO: 410027 - DNA, 25 bp, Homo sapien
ttttaaggactgatcattggctctg

SEQ ID NO: 410028 - DNA, 25 bp, Homo sapien
attggctctgaggacacttcaacta

SEQ ID NO: 410029 - DNA, 25 bp, Homo sapien
ggacacttcaactagttagccttct

SEQ ID NO: 410030 - DNA, 25 bp, Homo sapien
gttagccttctatcttgaggtatat

SEQ ID NO: 410031 - DNA, 25 bp, Homo sapien
ttctattctctctgaaagcacatgt

SEQ ID NO: 410032 - DNA, 25 bp, Homo sapien
gaaagcacatgtctgtgttgaacat

SEQ ID NO: 410033 - DNA, 25 bp, Homo sapien
aatcagtgagatgggattcaagccc

SEQ ID NO: 410034 - DNA, 25 bp, Homo sapien
attcaagcccgagatgtgtctgcag

SEQ ID NO: 410035 - DNA, 25 bp, Homo sapien
gtccgagaggccacccagtagagca

SEQ ID NO: 410036 - DNA, 25 bp, Homo sapien
gcagtggacgcctactgtgactctg

SEQ ID NO: 410037 - DNA, 25 bp, Homo sapien
gaactgtcactcactaagcttattt

SEQ ID NO: 410038 - DNA, 25 bp, Homo sapien
tcactcactaagcttatttcctcat

SEQ ID NO: 410039 - DNA, 25 bp, Homo sapien
atcctgagctccctacttggcaagc

SEQ ID NO: 410040 - DNA, 25 bp, Homo sapien
ttggcaagcctcatgggttcacagc

SEQ ID NO: 410041 - DNA, 25 bp, Homo sapien
cagctacctccaagggtttccttcg

SEQ ID NO: 410042 - DNA, 25 bp, Homo sapien
gggtttccttcgcaaactcaaatca

SEQ ID NO: 410043 - DNA, 25 bp, Homo sapien
aaactcaaatcagactgctccttac

SEQ ID NO: 410044 - DNA, 25 bp, Homo sapien
cataccatattgttggttcagtacc

SEQ ID NO: 410045 - DNA, 25 bp, Homo sapien
ggttcagtaccacaaagagatcaat

SEQ ID NO: 410046 - DNA, 25 bp, Homo sapien
catatatgctgtacatgttttaaag

SEQ ID NO: 410047 - DNA, 25 bp, Homo sapien
tagttactcaccactatagatccaa

SEQ ID NO: 410048 - DNA, 25 bp, Homo sapien
caagtgtgatttcaccttccgttac

SEQ ID NO: 410049 - DNA, 25 bp, Homo sapien
gcggagatattttgagagatgtgtt

SEQ ID NO: 410050 - DNA, 25 bp, Homo sapien
gtttgtctgatgtaggatgccaaga

SEQ ID NO: 410051 - DNA, 25 bp, Homo sapien
ggatgccaagaaacaggacccaagg

SEQ ID NO: 410052 - DNA, 25 bp, Homo sapien
ggacccaaggcaaaactgctcaact

SEQ ID NO: 410053 - DNA, 25 bp, Homo sapien
aactgctcaactctgttaacttctg

SEQ ID NO: 410054 - DNA, 25 bp, Homo sapien
aactctgttaacttctgttactata

SEQ ID NO: 410055 - DNA, 25 bp, Homo sapien
tgtattttattaagagtgtcttttc

SEQ ID NO: 410056 - DNA, 25 bp, Homo sapien
agagtgtcttttcttatgtgatttt

SEQ ID NO: 410057 - DNA, 25 bp, Homo sapien
gagtgtcttttcttatgtgattttt

SEQ ID NO: 410058 - DNA, 25 bp, Homo sapien
ttggatcacgggggcagttgtcccc

SEQ ID NO: 410059 - DNA, 25 bp, Homo sapien
tggatcacgggggcagttgtcccca

SEQ ID NO: 410060 - DNA, 25 bp, Homo sapien
ggatcacgggggcagttgtccccat

SEQ ID NO: 410061 - DNA, 25 bp, Homo sapien
gatcacgggggcagttgtccccatg

SEQ ID NO: 410062 - DNA, 25 bp, Homo sapien
atcacgggggcagttgtccccatgc

SEQ ID NO: 410063 - DNA, 25 bp, Homo sapien
gacagagaatgagcatcgtgctgtt

SEQ ID NO: 410064 - DNA, 25 bp, Homo sapien
atcgtgctgttgaagcacctccaca

SEQ ID NO: 410065 - DNA, 25 bp, Homo sapien
ttgaagcacctccacagacctgagg

SEQ ID NO: 410066 - DNA, 25 bp, Homo sapien
tgggactgctcctagatggatctca

SEQ ID NO: 410067 - DNA, 25 bp, Homo sapien
cctagatggatctcagcggcattaa

SEQ ID NO: 410068 - DNA, 25 bp, Homo sapien
atctcagcggcattaagctgtgcct

SEQ ID NO: 410069 - DNA, 25 bp, Homo sapien
gcattaagctgtgcctgagcgagtt

SEQ ID NO: 410070 - DNA, 25 bp, Homo sapien
gtgcctgagcgagtttgtagtgact

SEQ ID NO: 410071 - DNA, 25 bp, Homo sapien
ccccagactagcatgtggttctata

SEQ ID NO: 410072 - DNA, 25 bp, Homo sapien
agcatgtggttctatatttgtaaag

SEQ ID NO: 410073 - DNA, 25 bp, Homo sapien
agaaagtatatggagacactacgga

SEQ ID NO: 410074 - DNA, 25 bp, Homo sapien
tgggttcaggtgatcctcatacctc

SEQ ID NO: 410075 - DNA, 25 bp, Homo sapien
ttttaaatctctaaggtgattttat

SEQ ID NO: 410076 - DNA, 25 bp, Homo sapien
tttaaatctctaaggtgattttatt

SEQ ID NO: 410077 - DNA, 25 bp, Homo sapien
aatctctaaggtgattttattttat

SEQ ID NO: 410078 - DNA, 25 bp, Homo sapien
ggttttactatgttgaccagattgg

SEQ ID NO: 410079 - DNA, 25 bp, Homo sapien
gttttactatgttgaccagattggt

SEQ ID NO: 410080 - DNA, 25 bp, Homo sapien
tactatgttgaccagattggtctta

SEQ ID NO: 410081 - DNA, 25 bp, Homo sapien
actatgttgaccagattggtcttaa

SEQ ID NO: 410082 - DNA, 25 bp, Homo sapien
ctatgttgaccagattggtcttaaa

SEQ ID NO: 410083 - DNA, 25 bp, Homo sapien
tatgttgaccagattggtcttaaac

SEQ ID NO: 410084 - DNA, 25 bp, Homo sapien
gttgaccagattggtcttaaactcc

SEQ ID NO: 410085 - DNA, 25 bp, Homo sapien
ttagtggtatagagttttagtgttt

SEQ ID NO: 410086 - DNA, 25 bp, Homo sapien
agagatctgttgcaaccatgtgaat

SEQ ID NO: 410087 - DNA, 25 bp, Homo sapien
agatctgttgcaaccatgtgaatat

SEQ ID NO: 410088 - DNA, 25 bp, Homo sapien
atctgttgcaaccatgtgaatatac

SEQ ID NO: 410089 - DNA, 25 bp, Homo sapien
ttaacactaccgtactgtacactga

SEQ ID NO: 410090 - DNA, 25 bp, Homo sapien
aacactaccgtactgtacactgaaa

SEQ ID NO: 410091 - DNA, 25 bp, Homo sapien
gaggataatgttgttttgttaccac

SEQ ID NO: 410092 - DNA, 25 bp, Homo sapien
ggataatgttgttttgttaccacag

SEQ ID NO: 410093 - DNA, 25 bp, Homo sapien
ataatgttgttttgttaccacagta

SEQ ID NO: 410094 - DNA, 25 bp, Homo sapien
taaaaaccctcatgtatgttctttc

SEQ ID NO: 410095 - DNA, 25 bp, Homo sapien
atccatagacacagacagtagaaag

SEQ ID NO: 410096 - DNA, 25 bp, Homo sapien
gtgtggccccaatctggcatgtgag

SEQ ID NO: 410097 - DNA, 25 bp, Homo sapien
atgtgaggagctctcagctgctttc

SEQ ID NO: 410098 - DNA, 25 bp, Homo sapien
ttccagaaacacctgcaggagggcc

SEQ ID NO: 410099 - DNA, 25 bp, Homo sapien
acctgcaagcacctgatgcaccatt

SEQ ID NO: 410100 - DNA, 25 bp, Homo sapien
agcacctgatgcaccatttcccaga

SEQ ID NO: 410101 - DNA, 25 bp, Homo sapien
acctgcctgttctacttcaagagca

SEQ ID NO: 410102 - DNA, 25 bp, Homo sapien
gttctacttcaagagcagctgggag

SEQ ID NO: 410103 - DNA, 25 bp, Homo sapien
cagctgggagaacgtccgagctgct

SEQ ID NO: 410104 - DNA, 25 bp, Homo sapien
gttcaccgggttcctggtgctgcac

SEQ ID NO: 410105 - DNA, 25 bp, Homo sapien
tgctgcactcggagcccaggcagca

SEQ ID NO: 410106 - DNA, 25 bp, Homo sapien
agcagccgcaggtggacctggacca

SEQ ID NO: 410107 - DNA, 25 bp, Homo sapien
aactgcagcatccagaatacattca

SEQ ID NO: 410108 - DNA, 25 bp, Homo sapien
gaatacattcatacctaacacctca

SEQ ID NO: 410109 - DNA, 25 bp, Homo sapien
acctaacacctcaatagatgacatg

SEQ ID NO: 410110 - DNA, 25 bp, Homo sapien
agatgacatgttatccatggaatcg

SEQ ID NO: 410111 - DNA, 25 bp, Homo sapien
tccatggaatcgagttcaaagccct

SEQ ID NO: 410112 - DNA, 25 bp, Homo sapien
ggaatcgagttcaaagccctctgta

SEQ ID NO: 410113 - DNA, 25 bp, Homo sapien
caaagccctctgtaacgtggctata

SEQ ID NO: 410114 - DNA, 25 bp, Homo sapien
gtaacgtggctatatcccatctact

SEQ ID NO: 410115 - DNA, 25 bp, Homo sapien
tatatcccatctactctgagctgat

SEQ ID NO: 410116 - DNA, 25 bp, Homo sapien
catctactctgagctgatgttcagc

SEQ ID NO: 410117 - DNA, 25 bp, Homo sapien
tgatgttcagcaggtgatggccaca

SEQ ID NO: 410118 - DNA, 25 bp, Homo sapien
ggcggaatggtgtatctaccaatga

SEQ ID NO: 410119 - DNA, 25 bp, Homo sapien
aaattcgcaaacgtcccacaggatt

SEQ ID NO: 410120 - DNA, 25 bp, Homo sapien
gtattgtcaaatgaagacgccagga

SEQ ID NO: 410121 - DNA, 25 bp, Homo sapien
agacgccaggaagtattgagtttct

SEQ ID NO: 410122 - DNA, 25 bp, Homo sapien
gtttctgggtacataatactgtcct

SEQ ID NO: 410123 - DNA, 25 bp, Homo sapien
gtatctaccaatgaacagatggact

SEQ ID NO: 410124 - DNA, 25 bp, Homo sapien
acataatactgtcctgagtgttgaa

SEQ ID NO: 410125 - DNA, 25 bp, Homo sapien
ggaagaggactaatacgagatttta

SEQ ID NO: 410126 - DNA, 25 bp, Homo sapien
gatggactgggtgggcctcgggtac

SEQ ID NO: 410127 - DNA, 25 bp, Homo sapien
tacgggtggcttgagatgcaaatgc

SEQ ID NO: 410128 - DNA, 25 bp, Homo sapien
atgcaagggtaggaaggcaccttcc

SEQ ID NO: 410129 - DNA, 25 bp, Homo sapien
ctgaagtcagcgggcccaggcctac

SEQ ID NO: 410130 - DNA, 25 bp, Homo sapien
tcactctctcccttggcagagaagc

SEQ ID NO: 410131 - DNA, 25 bp, Homo sapien
actctctcccttggcagagaagcag

SEQ ID NO: 410132 - DNA, 25 bp, Homo sapien
ctcccttggcagagaagcagacgtc

SEQ ID NO: 410133 - DNA, 25 bp, Homo sapien
tcccttggcagagaagcagacgtcc

SEQ ID NO: 410134 - DNA, 25 bp, Homo sapien
cttggcagagaagcagacgtccata

SEQ ID NO: 410135 - DNA, 25 bp, Homo sapien
ggcagagaagcagacgtccatagct

SEQ ID NO: 410136 - DNA, 25 bp, Homo sapien
cagtctctactcactgggatgaggt

SEQ ID NO: 410137 - DNA, 25 bp, Homo sapien
gtctctactcactgggatgaggtta

SEQ ID NO: 410138 - DNA, 25 bp, Homo sapien
actcactgggatgaggttaggtcat

SEQ ID NO: 410139 - DNA, 25 bp, Homo sapien
gatgaggttaggtcatgaggacacc

SEQ ID NO: 410140 - DNA, 25 bp, Homo sapien
ttgtacatctcatgacatccgcagt

SEQ ID NO: 410141 - DNA, 25 bp, Homo sapien
tgacatccgcagtcaatgaacatgt

SEQ ID NO: 410142 - DNA, 25 bp, Homo sapien
gtcaatgaacatgtctattttagtc

SEQ ID NO: 410143 - DNA, 25 bp, Homo sapien
tattttagtctctgaataggcctgg

SEQ ID NO: 410144 - DNA, 25 bp, Homo sapien
atgtttgcaatttgggtacatacca

SEQ ID NO: 410145 - DNA, 25 bp, Homo sapien
caataccttccttctgtttattaat

SEQ ID NO: 410146 - DNA, 25 bp, Homo sapien
taccttccttctgtttattaattgt

SEQ ID NO: 410147 - DNA, 25 bp, Homo sapien
gttgtatgcaactaaatcatgttta

SEQ ID NO: 410148 - DNA, 25 bp, Homo sapien
tcatgtttatggtatgcctgtgttc

SEQ ID NO: 410149 - DNA, 25 bp, Homo sapien
gttctgttttttgcaattatttgac

SEQ ID NO: 410150 - DNA, 25 bp, Homo sapien
atttgacataaatacactggttttg

SEQ ID NO: 410151 - DNA, 25 bp, Homo sapien
gggttacccctgtctgcttctggtt

SEQ ID NO: 410152 - DNA, 25 bp, Homo sapien
ggagatctataggtccttttcctgc

SEQ ID NO: 410153 - DNA, 25 bp, Homo sapien
gccacaacacatcagtgtcatttgg

SEQ ID NO: 410154 - DNA, 25 bp, Homo sapien
gtcatttgggtgttttggcaactca

SEQ ID NO: 410155 - DNA, 25 bp, Homo sapien
gggccttcggatgatcttaaacctt

SEQ ID NO: 410156 - DNA, 25 bp, Homo sapien
gatgatcttaaacctttgtgttcag

SEQ ID NO: 410157 - DNA, 25 bp, Homo sapien
agccagagcccctgtgccctggtag

SEQ ID NO: 410158 - DNA, 25 bp, Homo sapien
ggttagtatctctcgggtgccctca

SEQ ID NO: 410159 - DNA, 25 bp, Homo sapien
acctctgcctgtgatcgtctgatga

SEQ ID NO: 410160 - DNA, 25 bp, Homo sapien
tgtgatcgtctgatgaggctccctc

SEQ ID NO: 410161 - DNA, 25 bp, Homo sapien
caacctgatccaaaagccagtctca

SEQ ID NO: 410162 - DNA, 25 bp, Homo sapien
cagtcgtcagagaaaccatgaggtg

SEQ ID NO: 410163 - DNA, 25 bp, Homo sapien
gaaaccatgaggtggtgtcctgcac

SEQ ID NO: 410164 - DNA, 25 bp, Homo sapien
catgaggtggtgtcctgcacggaat

SEQ ID NO: 410165 - DNA, 25 bp, Homo sapien
aggtggtgtcctgcacggaatagaa

SEQ ID NO: 410166 - DNA, 25 bp, Homo sapien
ggctgtgacccgtccaagggcacct

SEQ ID NO: 410167 - DNA, 25 bp, Homo sapien
tgtgacccgtccaagggcacctggc

SEQ ID NO: 410168 - DNA, 25 bp, Homo sapien
gttaataacagaacctacctcgaag

SEQ ID NO: 410169 - DNA, 25 bp, Homo sapien
taacagaacctacctcgaagagttg

SEQ ID NO: 410170 - DNA, 25 bp, Homo sapien
acctacctcgaagagttgtgaggct

SEQ ID NO: 410171 - DNA, 25 bp, Homo sapien
ggctaaaaagggttcatatgtgtca

SEQ ID NO: 410172 - DNA, 25 bp, Homo sapien
agggttcatatgtgtcaagtggtta

SEQ ID NO: 410173 - DNA, 25 bp, Homo sapien
taatttggagttcaaccaggttggt

SEQ ID NO: 410174 - DNA, 25 bp, Homo sapien
tggagttcaaccaggttggtacctg

SEQ ID NO: 410175 - DNA, 25 bp, Homo sapien
tgggtacctggtactgtcccctcag

SEQ ID NO: 410176 - DNA, 25 bp, Homo sapien
aggtgtcatatgactaatcatgaaa

SEQ ID NO: 410177 - DNA, 25 bp, Homo sapien
taagtcgtttccttcctagaagtct

SEQ ID NO: 410178 - DNA, 25 bp, Homo sapien
tgaaagtcctttggttcacggttca

SEQ ID NO: 410179 - DNA, 25 bp, Homo sapien
gttcacggttcacaaccttttcata

SEQ ID NO: 410180 - DNA, 25 bp, Homo sapien
cgtttccttcctagaagtctttgag

SEQ ID NO: 410181 - DNA, 25 bp, Homo sapien
gatattatgtagcaagttaacctta

SEQ ID NO: 410182 - DNA, 25 bp, Homo sapien
gcaagttaaccttaaggacacatac

SEQ ID NO: 410183 - DNA, 25 bp, Homo sapien
aatgtcttgagtcagatatcactaa

SEQ ID NO: 410184 - DNA, 25 bp, Homo sapien
gctctctaaaactgagtatcttcat

SEQ ID NO: 410185 - DNA, 25 bp, Homo sapien
gtatagaggctaagccgtgtgctat

SEQ ID NO: 410186 - DNA, 25 bp, Homo sapien
gtgtgctatagcactggagctatct

SEQ ID NO: 410187 - DNA, 25 bp, Homo sapien
tggagctatcttacccaggtttgaa

SEQ ID NO: 410188 - DNA, 25 bp, Homo sapien
caggtttgaatctagcttggccatt

SEQ ID NO: 410189 - DNA, 25 bp, Homo sapien
tgtggccttgggtatgtttaacctt

SEQ ID NO: 410190 - DNA, 25 bp, Homo sapien
gtttaaccttactttgcttcatctt

SEQ ID NO: 410191 - DNA, 25 bp, Homo sapien
ttgcttcatcttgctcatttgtaca

SEQ ID NO: 410192 - DNA, 25 bp, Homo sapien
tgctcatttgtacaagcactgctcg

SEQ ID NO: 410193 - DNA, 25 bp, Homo sapien
actggatttaaatattggatgcacc

SEQ ID NO: 410194 - DNA, 25 bp, Homo sapien
tggatgcaccattcagctctctaaa

SEQ ID NO: 410195 - DNA, 25 bp, Homo sapien
tgacctcaggtgtgtgagtatccct

SEQ ID NO: 410196 - DNA, 25 bp, Homo sapien
aggtgtgtgagtatccctcataccc

SEQ ID NO: 410197 - DNA, 25 bp, Homo sapien
ataccccttatcatcactgcctatt

SEQ ID NO: 410198 - DNA, 25 bp, Homo sapien
tatcatcactgcctattcgctcttc

SEQ ID NO: 410199 - DNA, 25 bp, Homo sapien
atttctgcattcgtcgtccttcgtt

SEQ ID NO: 410200 - DNA, 25 bp, Homo sapien
tcgtccttcgttcggtccagaagca

SEQ ID NO: 410201 - DNA, 25 bp, Homo sapien
ttcggtccagaagcaaccgcgacag

SEQ ID NO: 410202 - DNA, 25 bp, Homo sapien
agaagcaaccgcgacagtcctgcat

SEQ ID NO: 410203 - DNA, 25 bp, Homo sapien
aaccgcgacagtcctgcatgtgttg

SEQ ID NO: 410204 - DNA, 25 bp, Homo sapien
acagtcctgcatgtgttgatgccac

SEQ ID NO: 410205 - DNA, 25 bp, Homo sapien
gtgttgatgccacctgtatgtgcag

SEQ ID NO: 410206 - DNA, 25 bp, Homo sapien
gattgttctgacattaaatacctac

SEQ ID NO: 410207 - DNA, 25 bp, Homo sapien
gacattaaatacctacagttactac

SEQ ID NO: 410208 - DNA, 25 bp, Homo sapien
tacctacagttactactgaacctct

SEQ ID NO: 410209 - DNA, 25 bp, Homo sapien
gatttgtcaaggatagagtacagtt

SEQ ID NO: 410210 - DNA, 25 bp, Homo sapien
gggaagtattttatgtatgcattct

SEQ ID NO: 410211 - DNA, 25 bp, Homo sapien
gtatgcattcttagagcaaaaagtt

SEQ ID NO: 410212 - DNA, 25 bp, Homo sapien
ctagaattgaaggtactgatcttat

SEQ ID NO: 410213 - DNA, 25 bp, Homo sapien
aaactcaaatattcctcctatctgc

SEQ ID NO: 410214 - DNA, 25 bp, Homo sapien
aaatattcctcctatctgcaccaaa

SEQ ID NO: 410215 - DNA, 25 bp, Homo sapien
ttcctcctatctgcaccaaaaagtt

SEQ ID NO: 410216 - DNA, 25 bp, Homo sapien
cctatctgcaccaaaaagtttattt

SEQ ID NO: 410217 - DNA, 25 bp, Homo sapien
aatatttcccacaacaattttcata

SEQ ID NO: 410218 - DNA, 25 bp, Homo sapien
tcaaagactaatttcttgactgaag

SEQ ID NO: 410219 - DNA, 25 bp, Homo sapien
cttgactgaagatattttgctaggg

SEQ ID NO: 410220 - DNA, 25 bp, Homo sapien
tattttgctagggaagtgaaacttt

SEQ ID NO: 410221 - DNA, 25 bp, Homo sapien
gttgaatggtgtcatgcaaaggatt

SEQ ID NO: 410222 - DNA, 25 bp, Homo sapien
aaggatttatatagtgtgctcccac

SEQ ID NO: 410223 - DNA, 25 bp, Homo sapien
gtacagatcaggacacatattttta

SEQ ID NO: 410224 - DNA, 25 bp, Homo sapien
tagacatctaagtctgtagcttaaa

SEQ ID NO: 410225 - DNA, 25 bp, Homo sapien
gtctgtagcttaaatggaggttact

SEQ ID NO: 410226 - DNA, 25 bp, Homo sapien
gaggttactcttccatcatctagaa

SEQ ID NO: 410227 - DNA, 25 bp, Homo sapien
tccatcatctagaattgtttactta

SEQ ID NO: 410228 - DNA, 25 bp, Homo sapien
aaaagcaaattcattcactgactaa

SEQ ID NO: 410229 - DNA, 25 bp, Homo sapien
agcagctgacaggtcagcagtgccc

SEQ ID NO: 410230 - DNA, 25 bp, Homo sapien
ggtctgggacgtgggctggatggca

SEQ ID NO: 410231 - DNA, 25 bp, Homo sapien
cagcccagggtcacaggcataggat

SEQ ID NO: 410232 - DNA, 25 bp, Homo sapien
gcccagggtcacaggcataggataa

SEQ ID NO: 410233 - DNA, 25 bp, Homo sapien
ggataacatgtgctttggacctgac

SEQ ID NO: 410234 - DNA, 25 bp, Homo sapien
taacatgtgctttggacctgacaag

SEQ ID NO: 410235 - DNA, 25 bp, Homo sapien
catgtgctttggacctgacaaggga

SEQ ID NO: 410236 - DNA, 25 bp, Homo sapien
tttggacctgacaagggagtacctt

SEQ ID NO: 410237 - DNA, 25 bp, Homo sapien
gggtcatggccagccgagcctctgt

SEQ ID NO: 410238 - DNA, 25 bp, Homo sapien
gcctctgtagagatggaggctacag

SEQ ID NO: 410239 - DNA, 25 bp, Homo sapien
ttaccatcacataatttcacatcag

SEQ ID NO: 410240 - DNA, 25 bp, Homo sapien
tcacatcagatgtcactacaagtgt

SEQ ID NO: 410241 - DNA, 25 bp, Homo sapien
gtcactacaagtgtatctgacctta

SEQ ID NO: 410242 - DNA, 25 bp, Homo sapien
gtgtatctgaccttaattgtatctt

SEQ ID NO: 410243 - DNA, 25 bp, Homo sapien
gaccttaattgtatcttctgactaa

SEQ ID NO: 410244 - DNA, 25 bp, Homo sapien
ctgactaaagctgagaaccaaatga

SEQ ID NO: 410245 - DNA, 25 bp, Homo sapien
gaattgcataagctccttcagaagg

SEQ ID NO: 410246 - DNA, 25 bp, Homo sapien
gacaatcatatgtgaggtgaatctc

SEQ ID NO: 410247 - DNA, 25 bp, Homo sapien
ggtgaatctcaacatgtccacagat

SEQ ID NO: 410248 - DNA, 25 bp, Homo sapien
catgtccacagattaggtaaagatc

SEQ ID NO: 410249 - DNA, 25 bp, Homo sapien
ctggaacaaaacaagagtgccctct

SEQ ID NO: 410250 - DNA, 25 bp, Homo sapien
gggacagagcgctcaaagctatgaa

SEQ ID NO: 410251 - DNA, 25 bp, Homo sapien
gctatgaaaagttttgggccaccca

SEQ ID NO: 410252 - DNA, 25 bp, Homo sapien
tgggccacccatgaatatgagataa

SEQ ID NO: 410253 - DNA, 25 bp, Homo sapien
ggctttccatgcatttccaattgta

SEQ ID NO: 410254 - DNA, 25 bp, Homo sapien
gtatgaattaccattgaaggctagt

SEQ ID NO: 410255 - DNA, 25 bp, Homo sapien
gtgatgaaatgttactctctaggag

SEQ ID NO: 410256 - DNA, 25 bp, Homo sapien
ctctctaggagtcagtgttttcaca

SEQ ID NO: 410257 - DNA, 25 bp, Homo sapien
ggagtcagtgttttcacatctaaaa

SEQ ID NO: 410258 - DNA, 25 bp, Homo sapien
aaagcttatctgtctactgccaaaa

SEQ ID NO: 410259 - DNA, 25 bp, Homo sapien
ggtaatagcacgtattgagcaccta

SEQ ID NO: 410260 - DNA, 25 bp, Homo sapien
gagcacctactgtatattcagatga

SEQ ID NO: 410261 - DNA, 25 bp, Homo sapien
aattttctgaattgacatctggatg

SEQ ID NO: 410262 - DNA, 25 bp, Homo sapien
gacgcagaagctgcttcaaaacccc

SEQ ID NO: 410263 - DNA, 25 bp, Homo sapien
gggcacatgcaagtcaccaaagtgg

SEQ ID NO: 410264 - DNA, 25 bp, Homo sapien
agtcaccaaagtgggaagccttcac

SEQ ID NO: 410265 - DNA, 25 bp, Homo sapien
aaggccacacccaaagtctactgat

SEQ ID NO: 410266 - DNA, 25 bp, Homo sapien
gccacacccaaagtctactgattgt

SEQ ID NO: 410267 - DNA, 25 bp, Homo sapien
aagtctactgattgtctgtccaaag

SEQ ID NO: 410268 - DNA, 25 bp, Homo sapien
gattgtctgtccaaagttcgttgat

SEQ ID NO: 410269 - DNA, 25 bp, Homo sapien
gtctgtccaaagttcgttgattcct

SEQ ID NO: 410270 - DNA, 25 bp, Homo sapien
caaagttcgttgattcctggccatg

SEQ ID NO: 410271 - DNA, 25 bp, Homo sapien
ttcgttgattcctggccatgaacaa

SEQ ID NO: 410272 - DNA, 25 bp, Homo sapien
gctgctgtggcatgctcgggaccta

SEQ ID NO: 410273 - DNA, 25 bp, Homo sapien
ctgctgtggcatgctcgggacctag

SEQ ID NO: 410274 - DNA, 25 bp, Homo sapien
catgctcgggacctagagggaacct

SEQ ID NO: 410275 - DNA, 25 bp, Homo sapien
ctcgggacctagagggaacctgcct

SEQ ID NO: 410276 - DNA, 25 bp, Homo sapien
gggacctagagggaacctgcctcat

SEQ ID NO: 410277 - DNA, 25 bp, Homo sapien
gacctagagggaacctgcctcattg

SEQ ID NO: 410278 - DNA, 25 bp, Homo sapien
tagagggaacctgcctcattgacag

SEQ ID NO: 410279 - DNA, 25 bp, Homo sapien
cagcagctgcacagctccagacaat

SEQ ID NO: 410280 - DNA, 25 bp, Homo sapien
agctccagacaatcgttgtcaagga

SEQ ID NO: 410281 - DNA, 25 bp, Homo sapien
gacaatcgttgtcaaggacgggaat

SEQ ID NO: 410282 - DNA, 25 bp, Homo sapien
tcgttgtcaaggacgggaatgagat

SEQ ID NO: 410283 - DNA, 25 bp, Homo sapien
cttcacactgttgattaggaggaca

SEQ ID NO: 410284 - DNA, 25 bp, Homo sapien
cacactgttgattaggaggacaaga

SEQ ID NO: 410285 - DNA, 25 bp, Homo sapien
cactgttgattaggaggacaagaat

SEQ ID NO: 410286 - DNA, 25 bp, Homo sapien
gtgggtcattgatgccatctgagcc

SEQ ID NO: 410287 - DNA, 25 bp, Homo sapien
tgggtcattgatgccatctgagcca

SEQ ID NO: 410288 - DNA, 25 bp, Homo sapien
ggtcattgatgccatctgagccatc

SEQ ID NO: 410289 - DNA, 25 bp, Homo sapien
gtcattgatgccatctgagccatcc

SEQ ID NO: 410290 - DNA, 25 bp, Homo sapien
tcattgatgccatctgagccatcct

SEQ ID NO: 410291 - DNA, 25 bp, Homo sapien
attgatgccatctgagccatccttt

SEQ ID NO: 410292 - DNA, 25 bp, Homo sapien
ttgatgccatctgagccatcctttc

SEQ ID NO: 410293 - DNA, 25 bp, Homo sapien
tgatgccatctgagccatcctttcc

SEQ ID NO: 410294 - DNA, 25 bp, Homo sapien
agaaccatggttccctcaaacagtg

SEQ ID NO: 410295 - DNA, 25 bp, Homo sapien
catggttccctcaaacagtggtacc

SEQ ID NO: 410296 - DNA, 25 bp, Homo sapien
gttccctcaaacagtggtaccagca

SEQ ID NO: 410297 - DNA, 25 bp, Homo sapien
gtggtaccagcaataaaactatgat

SEQ ID NO: 410298 - DNA, 25 bp, Homo sapien
gaaatattcatagtaataccgagtg

SEQ ID NO: 410299 - DNA, 25 bp, Homo sapien
agtaataccgagtgtctttcagttc

SEQ ID NO: 410300 - DNA, 25 bp, Homo sapien
taataccgagtgtctttcagttcaa

SEQ ID NO: 410301 - DNA, 25 bp, Homo sapien
ggccctatttcatttgtagtcaaga

SEQ ID NO: 410302 - DNA, 25 bp, Homo sapien
tcatttgtagtcaagagctctctct

SEQ ID NO: 410303 - DNA, 25 bp, Homo sapien
aagagctctctctgtaaagaaccat

SEQ ID NO: 410304 - DNA, 25 bp, Homo sapien
gctctctctgtaaagaaccatggtt

SEQ ID NO: 410305 - DNA, 25 bp, Homo sapien
tgcgaacaggacaagcaaggaggct

SEQ ID NO: 410306 - DNA, 25 bp, Homo sapien
ggacaaggcttgcaaccctgctgta

SEQ ID NO: 410307 - DNA, 25 bp, Homo sapien
gcttgcaaccctgctgtagggctgc

SEQ ID NO: 410308 - DNA, 25 bp, Homo sapien
aggctcagaggcttgctcaaggcta

SEQ ID NO: 410309 - DNA, 25 bp, Homo sapien
gctcaaggctacacagctgacagaa

SEQ ID NO: 410310 - DNA, 25 bp, Homo sapien
gaaattgacaaggtgatcctaacat

SEQ ID NO: 410311 - DNA, 25 bp, Homo sapien
aaggtgatcctaacattcatatggg

SEQ ID NO: 410312 - DNA, 25 bp, Homo sapien
agggacccagaatatccaacaccac

SEQ ID NO: 410313 - DNA, 25 bp, Homo sapien
gaatatccaacaccaccttgaaaaa

SEQ ID NO: 410314 - DNA, 25 bp, Homo sapien
atcgcggcactctctgaggacaaag

SEQ ID NO: 410315 - DNA, 25 bp, Homo sapien
gaggacaaagtacttccgaggaagt

SEQ ID NO: 410316 - DNA, 25 bp, Homo sapien
ggtcggacccacaaaagacttcagt

SEQ ID NO: 410317 - DNA, 25 bp, Homo sapien
ggacccacaaaagacttcagttatc

SEQ ID NO: 410318 - DNA, 25 bp, Homo sapien
gacttcagttatcatcacaaacatg

SEQ ID NO: 410319 - DNA, 25 bp, Homo sapien
gttatcatcacaaacatgagccaaa

SEQ ID NO: 410320 - DNA, 25 bp, Homo sapien
atgagccaaaagcacatacctaccc

SEQ ID NO: 410321 - DNA, 25 bp, Homo sapien
acattttgtccacaacttcacggga

SEQ ID NO: 410322 - DNA, 25 bp, Homo sapien
tttgtccacaacttcacgggacgtg

SEQ ID NO: 410323 - DNA, 25 bp, Homo sapien
aacttcacgggacgtggccagactg

SEQ ID NO: 410324 - DNA, 25 bp, Homo sapien
tggccagactgggtttgcgttccaa

SEQ ID NO: 410325 - DNA, 25 bp, Homo sapien
tgggtttgcgttccaacctgcaaaa

SEQ ID NO: 410326 - DNA, 25 bp, Homo sapien
gcgttccaacctgcaaaacacaaat

SEQ ID NO: 410327 - DNA, 25 bp, Homo sapien
ccagtggacacttccgggtggcgct

SEQ ID NO: 410328 - DNA, 25 bp, Homo sapien
tcaggacctcccacatgtacagttc

SEQ ID NO: 410329 - DNA, 25 bp, Homo sapien
tgccccggctagtttccctggagag

SEQ ID NO: 410330 - DNA, 25 bp, Homo sapien
tggagagaggcctagccaacaacga

SEQ ID NO: 410331 - DNA, 25 bp, Homo sapien
tagccaacaacgaagggacggattt

SEQ ID NO: 410332 - DNA, 25 bp, Homo sapien
gacggattttaaaacagcgagaact

SEQ ID NO: 410333 - DNA, 25 bp, Homo sapien
aacagcgagaactgggtgccaagaa

SEQ ID NO: 410334 - DNA, 25 bp, Homo sapien
aactgggtgccaagaaacacttcat

SEQ ID NO: 410335 - DNA, 25 bp, Homo sapien
aacttttctggatgttgtgcgaacc

SEQ ID NO: 410336 - DNA, 25 bp, Homo sapien
gatgttgtgcgaacctgttgtattt

SEQ ID NO: 410337 - DNA, 25 bp, Homo sapien
tttcctgtattttggttctgaggga

SEQ ID NO: 410338 - DNA, 25 bp, Homo sapien
catctcttcctctggagccagagcc

SEQ ID NO: 410339 - DNA, 25 bp, Homo sapien
cagagcctgcggtggaatcaagtcc

SEQ ID NO: 410340 - DNA, 25 bp, Homo sapien
gaatagaatgaatgaccccaaaata

SEQ ID NO: 410341 - DNA, 25 bp, Homo sapien
aatagggttttcttgggcgaggatg

SEQ ID NO: 410342 - DNA, 25 bp, Homo sapien
ggcacccaccacagaatacagtgtg

SEQ ID NO: 410343 - DNA, 25 bp, Homo sapien
cacagaatacagtgtgtgttattac

SEQ ID NO: 410344 - DNA, 25 bp, Homo sapien
gtgttattacgaggagccagcagtt

SEQ ID NO: 410345 - DNA, 25 bp, Homo sapien
agcagttgagcctaaggtccttcta

SEQ ID NO: 410346 - DNA, 25 bp, Homo sapien
tctactgccccataagccaggaaaa

SEQ ID NO: 410347 - DNA, 25 bp, Homo sapien
tactgccccataagccaggaaaagt

SEQ ID NO: 410348 - DNA, 25 bp, Homo sapien
tgccccataagccaggaaaagtgaa

SEQ ID NO: 410349 - DNA, 25 bp, Homo sapien
tgtattttattaagagtgtcttttc

SEQ ID NO: 410350 - DNA, 25 bp, Homo sapien
agagtgtcttttcttatgtgatttt

SEQ ID NO: 410351 - DNA, 25 bp, Homo sapien
gagtgtcttttcttatgtgattttt

SEQ ID NO: 410352 - DNA, 25 bp, Homo sapien
agtgtcttttcttatgtgatttttt

SEQ ID NO: 410353 - DNA, 25 bp, Homo sapien
agttgcttgataatagttactagta

SEQ ID NO: 410354 - DNA, 25 bp, Homo sapien
gttgcttgataatagttactagtag

SEQ ID NO: 410355 - DNA, 25 bp, Homo sapien
tttaattgctatttgatatggtttg

SEQ ID NO: 410356 - DNA, 25 bp, Homo sapien
gcttgataatagttactagtagtag

SEQ ID NO: 410357 - DNA, 25 bp, Homo sapien
atcacgggggcagttgtccccatgc

SEQ ID NO: 410358 - DNA, 25 bp, Homo sapien
acgggggcagttgtccccatgctgt

SEQ ID NO: 410359 - DNA, 25 bp, Homo sapien
tgctgttcttgggatagtgagttag

SEQ ID NO: 410360 - DNA, 25 bp, Homo sapien
cctcattctctttttgcccttcttt

SEQ ID NO: 410361 - DNA, 25 bp, Homo sapien
ccctcatgaatagatcaatgctatt

SEQ ID NO: 410362 - DNA, 25 bp, Homo sapien
agatcaatgctattatcgtggaagt

SEQ ID NO: 410363 - DNA, 25 bp, Homo sapien
atgctattatcgtggaagtgggctt

SEQ ID NO: 410364 - DNA, 25 bp, Homo sapien
ctattatcgtggaagtgggcttgtt

SEQ ID NO: 410365 - DNA, 25 bp, Homo sapien
aagtgggcttgttattgcaggagta

SEQ ID NO: 410366 - DNA, 25 bp, Homo sapien
ttacaaaaggatgagttcagcctcc

SEQ ID NO: 410367 - DNA, 25 bp, Homo sapien
aaggatgagttcagcctccttttgc

SEQ ID NO: 410368 - DNA, 25 bp, Homo sapien
aggatgagttcagcctccttttgcc

SEQ ID NO: 410369 - DNA, 25 bp, Homo sapien
gatgagttcagcctccttttgcctc

SEQ ID NO: 410370 - DNA, 25 bp, Homo sapien
tgagttcagcctccttttgcctctt

SEQ ID NO: 410371 - DNA, 25 bp, Homo sapien
attgcccaagctgtatattcggaaa

SEQ ID NO: 410372 - DNA, 25 bp, Homo sapien
atggcttatgtataactcctagcat

SEQ ID NO: 410373 - DNA, 25 bp, Homo sapien
cctgtttgaccatccctgaatggga

SEQ ID NO: 410374 - DNA, 25 bp, Homo sapien
gggtttaccatttacagccacacac

SEQ ID NO: 410375 - DNA, 25 bp, Homo sapien
gacgtactttcgaagatcctctgta

SEQ ID NO: 410376 - DNA, 25 bp, Homo sapien
attcctgtgtagcatcaagtgggtc

SEQ ID NO: 410377 - DNA, 25 bp, Homo sapien
aagtgggtcaatccagacagtaaca

SEQ ID NO: 410378 - DNA, 25 bp, Homo sapien
acagtaacactttctgctggtacct

SEQ ID NO: 410379 - DNA, 25 bp, Homo sapien
ttctgctggtacctctttaggagta

SEQ ID NO: 410380 - DNA, 25 bp, Homo sapien
ggaacgagacacaacgatccttggg

SEQ ID NO: 410381 - DNA, 25 bp, Homo sapien
gaagagctggctttcacatttgaac

SEQ ID NO: 410382 - DNA, 25 bp, Homo sapien
caactgacaacatttgggctcaaat

SEQ ID NO: 410383 - DNA, 25 bp, Homo sapien
agcaggctgggtgcccaacacagtg

SEQ ID NO: 410384 - DNA, 25 bp, Homo sapien
aacacagtgcctggcgagtggtagc

SEQ ID NO: 410385 - DNA, 25 bp, Homo sapien
gagtggtagcgcttacgtttctttt

SEQ ID NO: 410386 - DNA, 25 bp, Homo sapien
tgtaaccaatgacaagccttgatgt

SEQ ID NO: 410387 - DNA, 25 bp, Homo sapien
gctcttcatggacctgttaacaacc

SEQ ID NO: 410388 - DNA, 25 bp, Homo sapien
accaccatattgtatcttacggacg

SEQ ID NO: 410389 - DNA, 25 bp, Homo sapien
tacggacgtttgtatgccacgtttg

SEQ ID NO: 410390 - DNA, 25 bp, Homo sapien
gccacgtttgaagagcaggagcctt

SEQ ID NO: 410391 - DNA, 25 bp, Homo sapien
agcaggagccttgtttcggcgtcat

SEQ ID NO: 410392 - DNA, 25 bp, Homo sapien
tttcggcgtcatgttgatggaactt

SEQ ID NO: 410393 - DNA, 25 bp, Homo sapien
gggcggcgttggtggtcttcgcggc

SEQ ID NO: 410394 - DNA, 25 bp, Homo sapien
ctcgcggccgtaggctaacgtggaa

SEQ ID NO: 410395 - DNA, 25 bp, Homo sapien
gggcgccagtgtagcccgcgcggcg

SEQ ID NO: 410396 - DNA, 25 bp, Homo sapien
gtaggctaacgtggaagtcggacca

SEQ ID NO: 410397 - DNA, 25 bp, Homo sapien
tgtgagagccgcagcccggagcgcc

SEQ ID NO: 410398 - DNA, 25 bp, Homo sapien
aggctaacgtggaagtcggaccagc

SEQ ID NO: 410399 - DNA, 25 bp, Homo sapien
ctaacgtggaagtcggaccagccgg

SEQ ID NO: 410400 - DNA, 25 bp, Homo sapien
gaagtcggaccagccggccggcgga

SEQ ID NO: 410401 - DNA, 25 bp, Homo sapien
cggaagaacctagagcgcgctgcct

SEQ ID NO: 410402 - DNA, 25 bp, Homo sapien
gaagaacctagagcgcgctgcctgg

SEQ ID NO: 410403 - DNA, 25 bp, Homo sapien
ctagagcgcgctgcctggcgagtca

SEQ ID NO: 410404 - DNA, 25 bp, Homo sapien
actccagctctactggctgtatgtc

SEQ ID NO: 410405 - DNA, 25 bp, Homo sapien
atgtctctctcctaatttttctact

SEQ ID NO: 410406 - DNA, 25 bp, Homo sapien
catacatttaataggttcccaaaag

SEQ ID NO: 410407 - DNA, 25 bp, Homo sapien
tctgcctggtagacttatccatgct

SEQ ID NO: 410408 - DNA, 25 bp, Homo sapien
ggtagacttatccatgctccttagg

SEQ ID NO: 410409 - DNA, 25 bp, Homo sapien
acttatccatgctccttagggaagc

SEQ ID NO: 410410 - DNA, 25 bp, Homo sapien
ttagggaagcctttcgtggctcctc

SEQ ID NO: 410411 - DNA, 25 bp, Homo sapien
cctggttatttacacttgggcatca

SEQ ID NO: 410412 - DNA, 25 bp, Homo sapien
ttacacttgggcatcatgtgccttc

SEQ ID NO: 410413 - DNA, 25 bp, Homo sapien
ttgggcatcatgtgccttccctttg

SEQ ID NO: 410414 - DNA, 25 bp, Homo sapien
tgtgccttccctttgctgcatcatt

SEQ ID NO: 410415 - DNA, 25 bp, Homo sapien
ggatgagacaagctggactacttac

SEQ ID NO: 410416 - DNA, 25 bp, Homo sapien
gactacttactactgatccacgtgt

SEQ ID NO: 410417 - DNA, 25 bp, Homo sapien
actactgatccacgtgtgagggaac

SEQ ID NO: 410418 - DNA, 25 bp, Homo sapien
caggccaagagggagcccgcagaaa

SEQ ID NO: 410419 - DNA, 25 bp, Homo sapien
gagcccgcagaaagtttacgtggaa

SEQ ID NO: 410420 - DNA, 25 bp, Homo sapien
gaaacgctaagggtttgctcccagg

SEQ ID NO: 410421 - DNA, 25 bp, Homo sapien
gagctatatatatgtgccgacatgt

SEQ ID NO: 410422 - DNA, 25 bp, Homo sapien
gccgacatgtggcagacacacagta

SEQ ID NO: 410423 - DNA, 25 bp, Homo sapien
ggctgaccagcatgagggcagtact

SEQ ID NO: 410424 - DNA, 25 bp, Homo sapien
atgctactttgtaaaggtgaccttt

SEQ ID NO: 410425 - DNA, 25 bp, Homo sapien
gctttgtcaccgaggacgaggtcga

SEQ ID NO: 410426 - DNA, 25 bp, Homo sapien
gagtgggccagacctccgacggcca

SEQ ID NO: 410427 - DNA, 25 bp, Homo sapien
acacctcccaagatgaagctcaatg

SEQ ID NO: 410428 - DNA, 25 bp, Homo sapien
tgaagctcaatgaaacttccttttg

SEQ ID NO: 410429 - DNA, 25 bp, Homo sapien
acttccttttgaacaacgcagctgc

SEQ ID NO: 410430 - DNA, 25 bp, Homo sapien
tccttttgaacaacgcagctgccat

SEQ ID NO: 410431 - DNA, 25 bp, Homo sapien
tgaacaacgcagctgccatgatgcc

SEQ ID NO: 410432 - DNA, 25 bp, Homo sapien
tgccatgatgccttgggatgccctg

SEQ ID NO: 410433 - DNA, 25 bp, Homo sapien
tgatgccttgggatgccctggtcct

SEQ ID NO: 410434 - DNA, 25 bp, Homo sapien
caggtgcctccctgattcctgtggg

SEQ ID NO: 410435 - DNA, 25 bp, Homo sapien
gggccagggcctccttggaataaat

SEQ ID NO: 410436 - DNA, 25 bp, Homo sapien
ggcctccttggaataaatggttatt

SEQ ID NO: 410437 - DNA, 25 bp, Homo sapien
tcatttctaacaaccagatggcccc

SEQ ID NO: 410438 - DNA, 25 bp, Homo sapien
atttctaacaaccagatggccccac

SEQ ID NO: 410439 - DNA, 25 bp, Homo sapien
ctgactcagcagaagagaacagctt

SEQ ID NO: 410440 - DNA, 25 bp, Homo sapien
agaacagcttcgattccccatgctt

SEQ ID NO: 410441 - DNA, 25 bp, Homo sapien
acagcttcgattccccatgctttta

SEQ ID NO: 410442 - DNA, 25 bp, Homo sapien
tccccatgcttttactcaccaaatt

SEQ ID NO: 410443 - DNA, 25 bp, Homo sapien
tgcttttactcaccaaattatcctt

SEQ ID NO: 410444 - DNA, 25 bp, Homo sapien
aactctgatccccaagttttctgag

SEQ ID NO: 410445 - DNA, 25 bp, Homo sapien
ctgatccccaagttttctgagactg

SEQ ID NO: 410446 - DNA, 25 bp, Homo sapien
gtggagaccataggtttttcatttc

SEQ ID NO: 410447 - DNA, 25 bp, Homo sapien
gaccataggtttttcatttctaaca

SEQ ID NO: 410448 - DNA, 25 bp, Homo sapien
gtatggctgtgtgattaaagtcaga

SEQ ID NO: 410449 - DNA, 25 bp, Homo sapien
cagagaagtgagttgggccactttt

SEQ ID NO: 410450 - DNA, 25 bp, Homo sapien
ggccacttttgggcctggattttag

SEQ ID NO: 410451 - DNA, 25 bp, Homo sapien
gattttaggacttaggtgtggccct

SEQ ID NO: 410452 - DNA, 25 bp, Homo sapien
ttaggacttaggtgtggcccttcca

SEQ ID NO: 410453 - DNA, 25 bp, Homo sapien
aggacttaggtgtggcccttccaca

SEQ ID NO: 410454 - DNA, 25 bp, Homo sapien
cagcctgggacaggcttcttgccag

SEQ ID NO: 410455 - DNA, 25 bp, Homo sapien
aagaaacttgctgggaccacagtgc

SEQ ID NO: 410456 - DNA, 25 bp, Homo sapien
acttgctgggaccacagtgcaggat

SEQ ID NO: 410457 - DNA, 25 bp, Homo sapien
acagtgcaggatgggcactccgtga

SEQ ID NO: 410458 - DNA, 25 bp, Homo sapien
caggatgggcactccgtgatggccc

SEQ ID NO: 410459 - DNA, 25 bp, Homo sapien
tgctgtcattttctgtctcggctcc

SEQ ID NO: 410460 - DNA, 25 bp, Homo sapien
tctgtgtcctggtccttctgagggc

SEQ ID NO: 410461 - DNA, 25 bp, Homo sapien
tgtgtcctggtccttctgagggcca

SEQ ID NO: 410462 - DNA, 25 bp, Homo sapien
gtgtcctggtccttctgagggccac

SEQ ID NO: 410463 - DNA, 25 bp, Homo sapien
gtcctggtccttctgagggccactg

SEQ ID NO: 410464 - DNA, 25 bp, Homo sapien
gggccactgcagatgactctccttt

SEQ ID NO: 410465 - DNA, 25 bp, Homo sapien
gccactgcagatgactctcctttga

SEQ ID NO: 410466 - DNA, 25 bp, Homo sapien
ctgcagatgactctcctttgaaatg

SEQ ID NO: 410467 - DNA, 25 bp, Homo sapien
gacattgtatgcttatggtttctca

SEQ ID NO: 410468 - DNA, 25 bp, Homo sapien
ttctcattatgaaggtgcagcttgt

SEQ ID NO: 410469 - DNA, 25 bp, Homo sapien
gaggtttgtacggatgtgctttgaa

SEQ ID NO: 410470 - DNA, 25 bp, Homo sapien
ctctccagtggaacaataggcaata

SEQ ID NO: 410471 - DNA, 25 bp, Homo sapien
tttgtaaaccggcatgctgggatta

SEQ ID NO: 410472 - DNA, 25 bp, Homo sapien
aaccggcatgctgggattaaatcct

SEQ ID NO: 410473 - DNA, 25 bp, Homo sapien
ggattaaatcctggctcaatttctc

SEQ ID NO: 410474 - DNA, 25 bp, Homo sapien
agggcacaaatcctctgtccataga

SEQ ID NO: 410475 - DNA, 25 bp, Homo sapien
gtccatagatgaattccttcaccct

SEQ ID NO: 410476 - DNA, 25 bp, Homo sapien
agatgaattccttcacccttcctag

SEQ ID NO: 410477 - DNA, 25 bp, Homo sapien
tgggcataatactggtacctctctc

SEQ ID NO: 410478 - DNA, 25 bp, Homo sapien
ggtacctctctcatatggttgtttt

SEQ ID NO: 410479 - DNA, 25 bp, Homo sapien
aaatcggtggtacaatgtgtgtaac

SEQ ID NO: 410480 - DNA, 25 bp, Homo sapien
aaaaataggtctctccagtggaaca

SEQ ID NO: 410481 - DNA, 25 bp, Homo sapien
gcaggataaggtcccctgacagtga

SEQ ID NO: 410482 - DNA, 25 bp, Homo sapien
gcctctgcctcaaaaattcaccaag

SEQ ID NO: 410483 - DNA, 25 bp, Homo sapien
attcaccaagcagaatgcctctcag

SEQ ID NO: 410484 - DNA, 25 bp, Homo sapien
ctctcagcctcatgtgttggtcctc

SEQ ID NO: 410485 - DNA, 25 bp, Homo sapien
acccagcttgtctcggcagctaaga

SEQ ID NO: 410486 - DNA, 25 bp, Homo sapien
agctaagaagcagtgaccaggatgt

SEQ ID NO: 410487 - DNA, 25 bp, Homo sapien
accaggatgtggattttggcgacct

SEQ ID NO: 410488 - DNA, 25 bp, Homo sapien
tgtgtggtggccttgagctgctttc

SEQ ID NO: 410489 - DNA, 25 bp, Homo sapien
ccttgagctgctttctgtgtttgtg

SEQ ID NO: 410490 - DNA, 25 bp, Homo sapien
gtgtttgtgaggactgactcccatt

SEQ ID NO: 410491 - DNA, 25 bp, Homo sapien
gactgactcccatttcctaaaggaa

SEQ ID NO: 410492 - DNA, 25 bp, Homo sapien
actaacgaacatacagggcagctgt

SEQ ID NO: 410493 - DNA, 25 bp, Homo sapien
gggcagctgtgattcaagaagtttt

SEQ ID NO: 410494 - DNA, 25 bp, Homo sapien
aatatgaggaacacagtggccagcc

SEQ ID NO: 410495 - DNA, 25 bp, Homo sapien
agtggccagccattggatgcttcac

SEQ ID NO: 410496 - DNA, 25 bp, Homo sapien
gccattggatgcttcacttcttgaa

SEQ ID NO: 410497 - DNA, 25 bp, Homo sapien
gcatcttgacagctttttgcaggtg

SEQ ID NO: 410498 - DNA, 25 bp, Homo sapien
gctttttgcaggtgaaatgcttcca

SEQ ID NO: 410499 - DNA, 25 bp, Homo sapien
aagagtttgttgaatccagaagcat

SEQ ID NO: 410500 - DNA, 25 bp, Homo sapien
gcatggatgtttatgctgcaggaat

SEQ ID NO: 410501 - DNA, 25 bp, Homo sapien
aaatgggtcataacgcagcagagat

SEQ ID NO: 410502 - DNA, 25 bp, Homo sapien
gaaacatgaacagcgcatttggccc

SEQ ID NO: 410503 - DNA, 25 bp, Homo sapien
gtggacggaggcctcaccaacgctc

SEQ ID NO: 410504 - DNA, 25 bp, Homo sapien
ttcagtggacgactggacatctccc

SEQ ID NO: 410505 - DNA, 25 bp, Homo sapien
ctccccgcaggacaaagggcagcta

SEQ ID NO: 410506 - DNA, 25 bp, Homo sapien
caaagggcagctagatctgtatgtt

SEQ ID NO: 410507 - DNA, 25 bp, Homo sapien
atctgtatgttaatatcgccaagca

SEQ ID NO: 410508 - DNA, 25 bp, Homo sapien
atcgccaagcaggatatcatgttgt

SEQ ID NO: 410509 - DNA, 25 bp, Homo sapien
atatcatgttgtccctggcaaacct

SEQ ID NO: 410510 - DNA, 25 bp, Homo sapien
ggcaaacctggtgagactcaaccaa

SEQ ID NO: 410511 - DNA, 25 bp, Homo sapien
atggaatctttgtatcagtgtggtt

SEQ ID NO: 410512 - DNA, 25 bp, Homo sapien
gtatcagtgtggttttgatgacact

SEQ ID NO: 410513 - DNA, 25 bp, Homo sapien
tgatgacactgttaagtttttactt

SEQ ID NO: 410514 - DNA, 25 bp, Homo sapien
aattcatggactcaaaatcggcaca

SEQ ID NO: 410515 - DNA, 25 bp, Homo sapien
gtggcgcattgaacccgtggctatt

SEQ ID NO: 410516 - DNA, 25 bp, Homo sapien
aatcggcacatagtattgttgagaa

SEQ ID NO: 410517 - DNA, 25 bp, Homo sapien
ggaggcaaacctccctttgtgaatg

SEQ ID NO: 410518 - DNA, 25 bp, Homo sapien
gaatgtcaacttggcatgtgttctc

SEQ ID NO: 410519 - DNA, 25 bp, Homo sapien
gaacccgtggctatttacctgtgat

SEQ ID NO: 410520 - DNA, 25 bp, Homo sapien
ggctatttacctgtgatgttcgttt

SEQ ID NO: 410521 - DNA, 25 bp, Homo sapien
gttcgttttcatattcctggtagca

SEQ ID NO: 410522 - DNA, 25 bp, Homo sapien
tattcctggtagcagaatcttctgt

SEQ ID NO: 410523 - DNA, 25 bp, Homo sapien
gaatcttctgtttactgcagcagct

SEQ ID NO: 410524 - DNA, 25 bp, Homo sapien
ctgcagcagcttacaaaagtgggat

SEQ ID NO: 410525 - DNA, 25 bp, Homo sapien
cagcctcagggcaccatttttaatc

SEQ ID NO: 410526 - DNA, 25 bp, Homo sapien
ggcaccatttttaatcccagaacac

SEQ ID NO: 410527 - DNA, 25 bp, Homo sapien
ttcaaagagcacgtatctagacctg

SEQ ID NO: 410528 - DNA, 25 bp, Homo sapien
gtatctagacctgctggactctgca

SEQ ID NO: 410529 - DNA, 25 bp, Homo sapien
acagcgagagcttgggtaatgatta

SEQ ID NO: 410530 - DNA, 25 bp, Homo sapien
ggaaccagtggagatttccatcctt

SEQ ID NO: 410531 - DNA, 25 bp, Homo sapien
gtggagatttccatccttgccagca

SEQ ID NO: 410532 - DNA, 25 bp, Homo sapien
ttgccagcacgtctgtacttctgtt

SEQ ID NO: 410533 - DNA, 25 bp, Homo sapien
gcacgtctgtacttctgttcattaa

SEQ ID NO: 410534 - DNA, 25 bp, Homo sapien
aggagggcccacctgactgctaata

SEQ ID NO: 410535 - DNA, 25 bp, Homo sapien
cccaaggcccgtgtgtgcatgtgtc

SEQ ID NO: 410536 - DNA, 25 bp, Homo sapien
aactctattaaatatgcccctatga

SEQ ID NO: 410537 - DNA, 25 bp, Homo sapien
atatgcccctatgatatctcttaga

SEQ ID NO: 410538 - DNA, 25 bp, Homo sapien
tctcttagataaaagttggccgtaa

SEQ ID NO: 410539 - DNA, 25 bp, Homo sapien
aagttggccgtaatagagaaaatga

SEQ ID NO: 410540 - DNA, 25 bp, Homo sapien
ttggtgactggcagattctgggtct

SEQ ID NO: 410541 - DNA, 25 bp, Homo sapien
ctggcagattctgggtctacgatga

SEQ ID NO: 410542 - DNA, 25 bp, Homo sapien
ctgggtctacgatgaatcagagaag

SEQ ID NO: 410543 - DNA, 25 bp, Homo sapien
gagaaggatggttttcactttgttt

SEQ ID NO: 410544 - DNA, 25 bp, Homo sapien
ttttaatgcttgatgttgacttggt

SEQ ID NO: 410545 - DNA, 25 bp, Homo sapien
atgcttgatgttgacttggtagaaa

SEQ ID NO: 410546 - DNA, 25 bp, Homo sapien
cttttagattactcatgtggactga

SEQ ID NO: 410547 - DNA, 25 bp, Homo sapien
aaaagggacgattgccgtcttcaat

SEQ ID NO: 410548 - DNA, 25 bp, Homo sapien
gattgccgtcttcaatatccagttc

SEQ ID NO: 410549 - DNA, 25 bp, Homo sapien
gtcttcaatatccagttccttaacc

SEQ ID NO: 410550 - DNA, 25 bp, Homo sapien
ttaacctttttcttagcattctagc

SEQ ID NO: 410551 - DNA, 25 bp, Homo sapien
atgtgtgaaaattctggagctttcc

SEQ ID NO: 410552 - DNA, 25 bp, Homo sapien
gctttcctctcccagggataactgg

SEQ ID NO: 410553 - DNA, 25 bp, Homo sapien
tctcccagggataactggaggcctt

SEQ ID NO: 410554 - DNA, 25 bp, Homo sapien
aactggaggccttgaggattgaaag

SEQ ID NO: 410555 - DNA, 25 bp, Homo sapien
gattgaaagagaaagcgtcggtttt

SEQ ID NO: 410556 - DNA, 25 bp, Homo sapien
gaggtgacactccagacagcattag

SEQ ID NO: 410557 - DNA, 25 bp, Homo sapien
gacagcattagtgtttcctcctaaa

SEQ ID NO: 410558 - DNA, 25 bp, Homo sapien
gacaaatatactgttgtttcttatt

SEQ ID NO: 410559 - DNA, 25 bp, Homo sapien
gaaaacaaaagcttaccaaatacat

SEQ ID NO: 410560 - DNA, 25 bp, Homo sapien
aagcttaccaaatacatgtgattat

SEQ ID NO: 410561 - DNA, 25 bp, Homo sapien
accaaatacatgtgattatgggaag

SEQ ID NO: 410562 - DNA, 25 bp, Homo sapien
gggccagaaagttacactgcaagta

SEQ ID NO: 410563 - DNA, 25 bp, Homo sapien
gttacactgcaagtaaaaatatcag

SEQ ID NO: 410564 - DNA, 25 bp, Homo sapien
taactatgtttactgggtggcgatg

SEQ ID NO: 410565 - DNA, 25 bp, Homo sapien
tatgtttactgggtggcgatggcaa

SEQ ID NO: 410566 - DNA, 25 bp, Homo sapien
tgtttactgggtggcgatggcaaaa

SEQ ID NO: 410567 - DNA, 25 bp, Homo sapien
tactgggtggcgatggcaaaaacaa

SEQ ID NO: 410568 - DNA, 25 bp, Homo sapien
gtggcgatggcaaaaacaatagttt

SEQ ID NO: 410569 - DNA, 25 bp, Homo sapien
tttagccaacactgatgttcccatc

SEQ ID NO: 410570 - DNA, 25 bp, Homo sapien
ccatcccaacacactactttgtggt

SEQ ID NO: 410571 - DNA, 25 bp, Homo sapien
aacacactactttgtggtgctgacc

SEQ ID NO: 410572 - DNA, 25 bp, Homo sapien
cactactttgtggtgctgaccagtt

SEQ ID NO: 410573 - DNA, 25 bp, Homo sapien
gtggtgctgaccagttgtaaaaaca

SEQ ID NO: 410574 - DNA, 25 bp, Homo sapien
gtaaaaacaagagccacacaccgga

SEQ ID NO: 410575 - DNA, 25 bp, Homo sapien
aagagccacacaccggaaaactgcc

SEQ ID NO: 410576 - DNA, 25 bp, Homo sapien
aaactgccctgggtggctggatgtc

SEQ ID NO: 410577 - DNA, 25 bp, Homo sapien
tggctggatgtcctaccctttatca

SEQ ID NO: 410578 - DNA, 25 bp, Homo sapien
ggatgtcctaccctttatcatccct

SEQ ID NO: 410579 - DNA, 25 bp, Homo sapien
cctcaccgacctaccaacgtggaga

SEQ ID NO: 410580 - DNA, 25 bp, Homo sapien
gaagtgctgctgtggaaagaaatgt

SEQ ID NO: 410581 - DNA, 25 bp, Homo sapien
aagtgctgctgtggaaagaaatgta

SEQ ID NO: 410582 - DNA, 25 bp, Homo sapien
agtgctgctgtggaaagaaatgtac

SEQ ID NO: 410583 - DNA, 25 bp, Homo sapien
gtgctgctgtggaaagaaatgtaca

SEQ ID NO: 410584 - DNA, 25 bp, Homo sapien
tgctgctgtggaaagaaatgtacat

SEQ ID NO: 410585 - DNA, 25 bp, Homo sapien
agaaatgtacatatactatttctgt

SEQ ID NO: 410586 - DNA, 25 bp, Homo sapien
acatatactatttctgtatcattaa

SEQ ID NO: 410587 - DNA, 25 bp, Homo sapien
catatactatttctgtatcattaaa

SEQ ID NO: 410588 - DNA, 25 bp, Homo sapien
atatactatttctgtatcattaaaa

SEQ ID NO: 410589 - DNA, 25 bp, Homo sapien
gacaactaattcctgctggagagaa

SEQ ID NO: 410590 - DNA, 25 bp, Homo sapien
gatgatgggctgtctccagatccta

SEQ ID NO: 410591 - DNA, 25 bp, Homo sapien
atcctatcttatcttcatgccattg

SEQ ID NO: 410592 - DNA, 25 bp, Homo sapien
attgtatgggctataacctctgcct

SEQ ID NO: 410593 - DNA, 25 bp, Homo sapien
tataacctctgcctgtaactctctc

SEQ ID NO: 410594 - DNA, 25 bp, Homo sapien
aattaacccacaattgctgagggca

SEQ ID NO: 410595 - DNA, 25 bp, Homo sapien
gaaagtttgattcctcttctaagat

SEQ ID NO: 410596 - DNA, 25 bp, Homo sapien
gattcctcttctaagatatcctagg

SEQ ID NO: 410597 - DNA, 25 bp, Homo sapien
gatatcctaggtagtgtcatttcta

SEQ ID NO: 410598 - DNA, 25 bp, Homo sapien
taaagaagacttggtgatcactgct

SEQ ID NO: 410599 - DNA, 25 bp, Homo sapien
gtgctatgaagatactacctgatac

SEQ ID NO: 410600 - DNA, 25 bp, Homo sapien
cttcaaccaggaccccacccatagg

SEQ ID NO: 410601 - DNA, 25 bp, Homo sapien
aggaccccacccataggtacacaca

SEQ ID NO: 410602 - DNA, 25 bp, Homo sapien
ccacccataggtacacacaaaaaag

SEQ ID NO: 410603 - DNA, 25 bp, Homo sapien
cacccataggtacacacaaaaaagg

SEQ ID NO: 410604 - DNA, 25 bp, Homo sapien
aggggggatcgaggccagacacggt

SEQ ID NO: 410605 - DNA, 25 bp, Homo sapien
acccagcagccgaggcaaaagggtt

SEQ ID NO: 410606 - DNA, 25 bp, Homo sapien
cccagcagccgaggcaaaagggttc

SEQ ID NO: 410607 - DNA, 25 bp, Homo sapien
cagcagccgaggcaaaagggttccc

SEQ ID NO: 410608 - DNA, 25 bp, Homo sapien
agcagccgaggcaaaagggttccca

SEQ ID NO: 410609 - DNA, 25 bp, Homo sapien
gcagccgaggcaaaagggttcccaa

SEQ ID NO: 410610 - DNA, 25 bp, Homo sapien
aaagtggagaggagtaagagatccc

SEQ ID NO: 410611 - DNA, 25 bp, Homo sapien
tttcctataggtgacaatcagagat

SEQ ID NO: 410612 - DNA, 25 bp, Homo sapien
atataataggtttttctcctgattg

SEQ ID NO: 410613 - DNA, 25 bp, Homo sapien
tctcctgattgtgaattgtaagtgt

SEQ ID NO: 410614 - DNA, 25 bp, Homo sapien
tgagaaagtataaaccacccccaat

SEQ ID NO: 410615 - DNA, 25 bp, Homo sapien
aatcccaatgcccatagaaacgttg

SEQ ID NO: 410616 - DNA, 25 bp, Homo sapien
cccaatgcccatagaaacgttgtta

SEQ ID NO: 410617 - DNA, 25 bp, Homo sapien
gcccatagaaacgttgttaacattt

SEQ ID NO: 410618 - DNA, 25 bp, Homo sapien
gttaacattttggagtactttctat

SEQ ID NO: 410619 - DNA, 25 bp, Homo sapien
aacattttggagtactttctattag

SEQ ID NO: 410620 - DNA, 25 bp, Homo sapien
gagtactttctattagtgtttattt

SEQ ID NO: 410621 - DNA, 25 bp, Homo sapien
tatacttcaaccgtttattattaga

SEQ ID NO: 410622 - DNA, 25 bp, Homo sapien
cccagcctattcattcttaacacga

SEQ ID NO: 410623 - DNA, 25 bp, Homo sapien
attcttaacacgatttcaaaatgct

SEQ ID NO: 410624 - DNA, 25 bp, Homo sapien
gggaccactggagtcaggcattgtt

SEQ ID NO: 410625 - DNA, 25 bp, Homo sapien
gcagcagcagatccgttcatctttc

SEQ ID NO: 410626 - DNA, 25 bp, Homo sapien
cagcagatccgttcatctttcagaa

SEQ ID NO: 410627 - DNA, 25 bp, Homo sapien
aatgagcatcaacactaatccaaac

SEQ ID NO: 410628 - DNA, 25 bp, Homo sapien
acactaatccaaacaccgcactttg

SEQ ID NO: 410629 - DNA, 25 bp, Homo sapien
ggccatttagggtagaattaaacag

SEQ ID NO: 410630 - DNA, 25 bp, Homo sapien
taaacagcctgatatacctcgaatg

SEQ ID NO: 410631 - DNA, 25 bp, Homo sapien
gcctgatatacctcgaatgacctaa

SEQ ID NO: 410632 - DNA, 25 bp, Homo sapien
gacctaaaagatgtcaccgaattat

SEQ ID NO: 410633 - DNA, 25 bp, Homo sapien
ctgtggcttgtgtctggacaggaat

SEQ ID NO: 410634 - DNA, 25 bp, Homo sapien
gtctggacaggaatgtgtcatttcc

SEQ ID NO: 410635 - DNA, 25 bp, Homo sapien
acatcttctagagggctgccagctg

SEQ ID NO: 410636 - DNA, 25 bp, Homo sapien
gggaagacagttatcagggcaagct

SEQ ID NO: 410637 - DNA, 25 bp, Homo sapien
cagggcaagctgtgctctgagtttc

SEQ ID NO: 410638 - DNA, 25 bp, Homo sapien
aagctgtgctctgagtttcgggttc

SEQ ID NO: 410639 - DNA, 25 bp, Homo sapien
tttcgggttctgctcctacaaagaa

SEQ ID NO: 410640 - DNA, 25 bp, Homo sapien
gctcctacaaagaacgtgcggtgct

SEQ ID NO: 410641 - DNA, 25 bp, Homo sapien
gccactgcagagtgtgtttctgctc

SEQ ID NO: 410642 - DNA, 25 bp, Homo sapien
gagtgtgtttctgctcgtcagctgc

SEQ ID NO: 410643 - DNA, 25 bp, Homo sapien
ctgggcgatgcagctggatgcacat

SEQ ID NO: 410644 - DNA, 25 bp, Homo sapien
tgacaagaacaacgtctgcacatgt

SEQ ID NO: 410645 - DNA, 25 bp, Homo sapien
caagaacaacgtctgcacatgttca

SEQ ID NO: 410646 - DNA, 25 bp, Homo sapien
gttggctgaatccacagttgcagag

SEQ ID NO: 410647 - DNA, 25 bp, Homo sapien
tgaatccacagttgcagagctccca

SEQ ID NO: 410648 - DNA, 25 bp, Homo sapien
aatccacagttgcagagctcccaga

SEQ ID NO: 410649 - DNA, 25 bp, Homo sapien
acgagggccaagtgctttgagagta

SEQ ID NO: 410650 - DNA, 25 bp, Homo sapien
gtgggtgaggttgctaatgagtaca

SEQ ID NO: 410651 - DNA, 25 bp, Homo sapien
ggaccctgcactgggcatctggacg

SEQ ID NO: 410652 - DNA, 25 bp, Homo sapien
tgcactgggcatctggacgccctgt

SEQ ID NO: 410653 - DNA, 25 bp, Homo sapien
ggacgccctgtctcaggacttgaga

SEQ ID NO: 410654 - DNA, 25 bp, Homo sapien
gtctcaggacttgagactccgtttg

SEQ ID NO: 410655 - DNA, 25 bp, Homo sapien
ataacttcaaagcacatccgtacaa

SEQ ID NO: 410656 - DNA, 25 bp, Homo sapien
ttcaaagcacatccgtacaaacctc

SEQ ID NO: 410657 - DNA, 25 bp, Homo sapien
atccgtacaaacctcctacaagctg

SEQ ID NO: 410658 - DNA, 25 bp, Homo sapien
cctacaagctgcaccttcataatga

SEQ ID NO: 410659 - DNA, 25 bp, Homo sapien
gctgcaccttcataatgagaaacca

SEQ ID NO: 410660 - DNA, 25 bp, Homo sapien
gaaaccataagcatacaatgtctac

SEQ ID NO: 410661 - DNA, 25 bp, Homo sapien
aaaggagagtcatctgcagtggccc

SEQ ID NO: 410662 - DNA, 25 bp, Homo sapien
agagtcatctgcagtggcccgtagt

SEQ ID NO: 410663 - DNA, 25 bp, Homo sapien
gtcatctgcagtggcccgtagtgct

SEQ ID NO: 410664 - DNA, 25 bp, Homo sapien
tgctggtgaggacatctttcccgat

SEQ ID NO: 410665 - DNA, 25 bp, Homo sapien
ttcatacttaccagcactgtttatt

SEQ ID NO: 410666 - DNA, 25 bp, Homo sapien
tgaaaaagcccagccttgtagcatt

SEQ ID NO: 410667 - DNA, 25 bp, Homo sapien
tagcatttgccagttattgtgtaaa

SEQ ID NO: 410668 - DNA, 25 bp, Homo sapien
ttgccagttattgtgtaaatgtccc

SEQ ID NO: 410669 - DNA, 25 bp, Homo sapien
gtaaatgtccccactatggtggatt

SEQ ID NO: 410670 - DNA, 25 bp, Homo sapien
ccactatggtggatttcaggttacc

SEQ ID NO: 410671 - DNA, 25 bp, Homo sapien
caggttaccactatgatatcacaga

SEQ ID NO: 410672 - DNA, 25 bp, Homo sapien
ggaaggagattcacagcagcacccc

SEQ ID NO: 410673 - DNA, 25 bp, Homo sapien
agcagcaccccattatactatattt

SEQ ID NO: 410674 - DNA, 25 bp, Homo sapien
tactatattttcaccatacagatgc

SEQ ID NO: 410675 - DNA, 25 bp, Homo sapien
ttcaccatacagatgcagtcgatgt

SEQ ID NO: 410676 - DNA, 25 bp, Homo sapien
gatgcagtcgatgtaaattacctga

SEQ ID NO: 410677 - DNA, 25 bp, Homo sapien
gccagccatgtaaagtgattcacct

SEQ ID NO: 410678 - DNA, 25 bp, Homo sapien
agccaagccttcagatgcaacctca

SEQ ID NO: 410679 - DNA, 25 bp, Homo sapien
agccttcagatgcaacctcatgaca

SEQ ID NO: 410680 - DNA, 25 bp, Homo sapien
aagctgctgacccacagactttgtg

SEQ ID NO: 410681 - DNA, 25 bp, Homo sapien
ctgctgacccacagactttgtgaga

SEQ ID NO: 410682 - DNA, 25 bp, Homo sapien
gaggacgtgcaagcagccctgtgaa

SEQ ID NO: 410683 - DNA, 25 bp, Homo sapien
gatcataaacatttactgttgttct

SEQ ID NO: 410684 - DNA, 25 bp, Homo sapien
ttactgttgttctaagacactgttt

SEQ ID NO: 410685 - DNA, 25 bp, Homo sapien
ttagggtgctttgttgtacaacaat

SEQ ID NO: 410686 - DNA, 25 bp, Homo sapien
gttgtacaacaatagcttactgaaa

SEQ ID NO: 410687 - DNA, 25 bp, Homo sapien
agcagccctgtgaagaggtcaacac

SEQ ID NO: 410688 - DNA, 25 bp, Homo sapien
agttgggattcttagtagattggta

SEQ ID NO: 410689 - DNA, 25 bp, Homo sapien
aaaggggctcattttctactgcatt

SEQ ID NO: 410690 - DNA, 25 bp, Homo sapien
tgcatttcccatttttggtatcttg

SEQ ID NO: 410691 - DNA, 25 bp, Homo sapien
ccatttttggtatcttgttcagcat

SEQ ID NO: 410692 - DNA, 25 bp, Homo sapien
ttggtatcttgttcagcatgtttta

SEQ ID NO: 410693 - DNA, 25 bp, Homo sapien
atttcttgtctgcagaacatcctat

SEQ ID NO: 410694 - DNA, 25 bp, Homo sapien
gtctgcagaacatcctatatttatg

SEQ ID NO: 410695 - DNA, 25 bp, Homo sapien
acattctttaagaagaccaccacat

SEQ ID NO: 410696 - DNA, 25 bp, Homo sapien
gaagaccaccacatagaatacccct

SEQ ID NO: 410697 - DNA, 25 bp, Homo sapien
atcagctcgctctgatttagcctta

SEQ ID NO: 410698 - DNA, 25 bp, Homo sapien
gctcgctctgatttagccttaattt

SEQ ID NO: 410699 - DNA, 25 bp, Homo sapien
atgccttccctgagctttggtgcat

SEQ ID NO: 410700 - DNA, 25 bp, Homo sapien
cttccctgagctttggtgcatctca

SEQ ID NO: 410701 - DNA, 25 bp, Homo sapien
cctcaccctctgtctacaaggaaat

SEQ ID NO: 410702 - DNA, 25 bp, Homo sapien
tcaccctctgtctacaaggaaatgg

SEQ ID NO: 410703 - DNA, 25 bp, Homo sapien
tgagaaattgttttgcaaatggatc

SEQ ID NO: 410704 - DNA, 25 bp, Homo sapien
ggcaggcagggcatagcgacagtgt

SEQ ID NO: 410705 - DNA, 25 bp, Homo sapien
gcttctgccacgctttatgcccttg

SEQ ID NO: 410706 - DNA, 25 bp, Homo sapien
acgctttatgcccttgcctctctgg

SEQ ID NO: 410707 - DNA, 25 bp, Homo sapien
ttatgcccttgcctctctggacgct

SEQ ID NO: 410708 - DNA, 25 bp, Homo sapien
tgcctctctggacgctctgcaccaa

SEQ ID NO: 410709 - DNA, 25 bp, Homo sapien
caaccccaggctactgagccacctt

SEQ ID NO: 410710 - DNA, 25 bp, Homo sapien
tagtaattgtggtttactggaaaat

SEQ ID NO: 410711 - DNA, 25 bp, Homo sapien
aattcaatgaatagggtgttaaagg

SEQ ID NO: 410712 - DNA, 25 bp, Homo sapien
gggtgttaaaggaagcaattcatta

SEQ ID NO: 410713 - DNA, 25 bp, Homo sapien
ttgcagcgagtcaggatcgcagcac

SEQ ID NO: 410714 - DNA, 25 bp, Homo sapien
tgcagcgagtcaggatcgcagcact

SEQ ID NO: 410715 - DNA, 25 bp, Homo sapien
gcagcgagtcaggatcgcagcacta

SEQ ID NO: 410716 - DNA, 25 bp, Homo sapien
cagcgagtcaggatcgcagcactac

SEQ ID NO: 410717 - DNA, 25 bp, Homo sapien
agcgagtcaggatcgcagcactaca

SEQ ID NO: 410718 - DNA, 25 bp, Homo sapien
gcgagtcaggatcgcagcactacac

SEQ ID NO: 410719 - DNA, 25 bp, Homo sapien
gagtcaggatcgcagcactacactc

SEQ ID NO: 410720 - DNA, 25 bp, Homo sapien
agtcaggatcgcagcactacactcc

SEQ ID NO: 410721 - DNA, 25 bp, Homo sapien
aggatcagttgaacccagtggttct

SEQ ID NO: 410722 - DNA, 25 bp, Homo sapien
ggatcagttgaacccagtggttctg

SEQ ID NO: 410723 - DNA, 25 bp, Homo sapien
atcagttgaacccagtggttctggg

SEQ ID NO: 410724 - DNA, 25 bp, Homo sapien
tcagttgaacccagtggttctgggt

SEQ ID NO: 410725 - DNA, 25 bp, Homo sapien
agttgaacccagtggttctgggttg

SEQ ID NO: 410726 - DNA, 25 bp, Homo sapien
ttgaacccagtggttctgggttgca

SEQ ID NO: 410727 - DNA, 25 bp, Homo sapien
taaatctataatatggctggaggca

SEQ ID NO: 410728 - DNA, 25 bp, Homo sapien
aaatctataatatggctggaggcag

SEQ ID NO: 410729 - DNA, 25 bp, Homo sapien
aatctataatatggctggaggcagt

SEQ ID NO: 410730 - DNA, 25 bp, Homo sapien
aatatggctggaggcagtgggcagt

SEQ ID NO: 410731 - DNA, 25 bp, Homo sapien
gctggaggcagtgggcagtggttca

SEQ ID NO: 410732 - DNA, 25 bp, Homo sapien
tgttttatgtaagtacagcagcagc

SEQ ID NO: 410733 - DNA, 25 bp, Homo sapien
aaatactgtatttctatggtgattg

SEQ ID NO: 410734 - DNA, 25 bp, Homo sapien
atactgtatttctatggtgattgaa

SEQ ID NO: 410735 - DNA, 25 bp, Homo sapien
actgtatttctatggtgattgaaaa

SEQ ID NO: 410736 - DNA, 25 bp, Homo sapien
tatggtgattgaaaattagtaggca

SEQ ID NO: 410737 - DNA, 25 bp, Homo sapien
gtatgagtttcaggtatgtacatgt

SEQ ID NO: 410738 - DNA, 25 bp, Homo sapien
aattagtaggcagagaatttttgta

SEQ ID NO: 410739 - DNA, 25 bp, Homo sapien
atgagtttcaggtatgtacatgtta

SEQ ID NO: 410740 - DNA, 25 bp, Homo sapien
gagtttcaggtatgtacatgttatg

SEQ ID NO: 410741 - DNA, 25 bp, Homo sapien
tttatgtttaagctcaatattcaaa

SEQ ID NO: 410742 - DNA, 25 bp, Homo sapien
atgtttaagctcaatattcaaacac

SEQ ID NO: 410743 - DNA, 25 bp, Homo sapien
gtatgagatgattgcttttacatgt

SEQ ID NO: 410744 - DNA, 25 bp, Homo sapien
aatgttctgaagttgaggcatcacc

SEQ ID NO: 410745 - DNA, 25 bp, Homo sapien
ttgaggcatcaccaaacaagtctga

SEQ ID NO: 410746 - DNA, 25 bp, Homo sapien
acaagtctgaacaattctttatgtg

SEQ ID NO: 410747 - DNA, 25 bp, Homo sapien
aaagtagaccttttgaagagatcta

SEQ ID NO: 410748 - DNA, 25 bp, Homo sapien
aaagcaattttcagtgttacaggtt

SEQ ID NO: 410749 - DNA, 25 bp, Homo sapien
gtgttacaggttttcttcttcttct

SEQ ID NO: 410750 - DNA, 25 bp, Homo sapien
aaaactgtttgctgtaagtaactgc

SEQ ID NO: 410751 - DNA, 25 bp, Homo sapien
aagtaactgcaatcagtacttacta

SEQ ID NO: 410752 - DNA, 25 bp, Homo sapien
gtacttactactttccatttgctta

SEQ ID NO: 410753 - DNA, 25 bp, Homo sapien
ccatttgcttatgagtttcttgaca

SEQ ID NO: 410754 - DNA, 25 bp, Homo sapien
aattcagaaaaatgtgggactactt

SEQ ID NO: 410755 - DNA, 25 bp, Homo sapien
ttcagaaaaatgtgggactacttcc

SEQ ID NO: 410756 - DNA, 25 bp, Homo sapien
tcagaaaaatgtgggactacttcca

SEQ ID NO: 410757 - DNA, 25 bp, Homo sapien
agaaaaatgtgggactacttccaca

SEQ ID NO: 410758 - DNA, 25 bp, Homo sapien
gaaaaatgtgggactacttccacag

SEQ ID NO: 410759 - DNA, 25 bp, Homo sapien
aaaaatgtgggactacttccacagt

SEQ ID NO: 410760 - DNA, 25 bp, Homo sapien
aaaatgtgggactacttccacagtg

SEQ ID NO: 410761 - DNA, 25 bp, Homo sapien
aaatgtgggactacttccacagtgt

SEQ ID NO: 410762 - DNA, 25 bp, Homo sapien
aatgtgggactacttccacagtgtt

SEQ ID NO: 410763 - DNA, 25 bp, Homo sapien
atgtgggactacttccacagtgttc

SEQ ID NO: 410764 - DNA, 25 bp, Homo sapien
tgtgggactacttccacagtgttct

SEQ ID NO: 410765 - DNA, 25 bp, Homo sapien
cttcaaccaggaccccacccatagg

SEQ ID NO: 410766 - DNA, 25 bp, Homo sapien
ccacccataggtacacacaaaaaag

SEQ ID NO: 410767 - DNA, 25 bp, Homo sapien
cacccataggtacacacaaaaaagg

SEQ ID NO: 410768 - DNA, 25 bp, Homo sapien
aggggggatcgaggccagacacggt

SEQ ID NO: 410769 - DNA, 25 bp, Homo sapien
acccagcagccgaggcaaaagggtt

SEQ ID NO: 410770 - DNA, 25 bp, Homo sapien
cccagcagccgaggcaaaagggttc

SEQ ID NO: 410771 - DNA, 25 bp, Homo sapien
cagcagccgaggcaaaagggttccc

SEQ ID NO: 410772 - DNA, 25 bp, Homo sapien
agcagccgaggcaaaagggttccca

SEQ ID NO: 410773 - DNA, 25 bp, Homo sapien
gcagccgaggcaaaagggttcccaa

SEQ ID NO: 410774 - DNA, 25 bp, Homo sapien
gttcccaaagtggagaggagtaaga

SEQ ID NO: 410775 - DNA, 25 bp, Homo sapien
aaagtggagaggagtaagagatccc

SEQ ID NO: 410776 - DNA, 25 bp, Homo sapien
ttcagtatacactgcgctgtgacat

SEQ ID NO: 410777 - DNA, 25 bp, Homo sapien
gctgtgacatgaagcggtctctgtt

SEQ ID NO: 410778 - DNA, 25 bp, Homo sapien
gtctctgttggccaaggacttgaca

SEQ ID NO: 410779 - DNA, 25 bp, Homo sapien
ggacttgacaaagacctgtgaattt

SEQ ID NO: 410780 - DNA, 25 bp, Homo sapien
tgtgaatttatcgttcactccgctc

SEQ ID NO: 410781 - DNA, 25 bp, Homo sapien
tttactcccagtcccgtggacttca

SEQ ID NO: 410782 - DNA, 25 bp, Homo sapien
ggacatctcaactcaacaaactgtg

SEQ ID NO: 410783 - DNA, 25 bp, Homo sapien
aacaaactgtgtcatcacgcagcca

SEQ ID NO: 410784 - DNA, 25 bp, Homo sapien
atcacgcagccactaacgggagagc

SEQ ID NO: 410785 - DNA, 25 bp, Homo sapien
gtggagagctcggaagccgccatca

SEQ ID NO: 410786 - DNA, 25 bp, Homo sapien
aagccgccatcagaagcgtggagct

SEQ ID NO: 410787 - DNA, 25 bp, Homo sapien
ggaagatggctgtgttagggatgaa

SEQ ID NO: 410788 - DNA, 25 bp, Homo sapien
tgcgaggagctgatctgcgagccct

SEQ ID NO: 410789 - DNA, 25 bp, Homo sapien
aggagctgatctgcgagccctgtgt

SEQ ID NO: 410790 - DNA, 25 bp, Homo sapien
gcgagccctgtgtgcctgtgagtcc

SEQ ID NO: 410791 - DNA, 25 bp, Homo sapien
tgtaagccagggagtggtgtcacct

SEQ ID NO: 410792 - DNA, 25 bp, Homo sapien
ccctgtgtgcctgtgagtcctggcg

SEQ ID NO: 410793 - DNA, 25 bp, Homo sapien
gcggagtggccgtgcgtggtgacag

SEQ ID NO: 410794 - DNA, 25 bp, Homo sapien
gttcccgcctgaggcacatgagggt

SEQ ID NO: 410795 - DNA, 25 bp, Homo sapien
gtggtgtcacctgtactgtagcaaa

SEQ ID NO: 410796 - DNA, 25 bp, Homo sapien
tgtcacctgtactgtagcaaaagca

SEQ ID NO: 410797 - DNA, 25 bp, Homo sapien
caaaagcaccttttctaaatgtgaa

SEQ ID NO: 410798 - DNA, 25 bp, Homo sapien
aggatgaaggtgaagcggaggaaaa

SEQ ID NO: 410799 - DNA, 25 bp, Homo sapien
gtgatgatgcacaccttaagtctca

SEQ ID NO: 410800 - DNA, 25 bp, Homo sapien
gatgatgcacaccttaagtctcagc

SEQ ID NO: 410801 - DNA, 25 bp, Homo sapien
tgatgcacaccttaagtctcagcta

SEQ ID NO: 410802 - DNA, 25 bp, Homo sapien
gggaggatcgcctgaccccaagtag

SEQ ID NO: 410803 - DNA, 25 bp, Homo sapien
gaggatcgcctgaccccaagtagtc

SEQ ID NO: 410804 - DNA, 25 bp, Homo sapien
aggatcgcctgaccccaagtagtca

SEQ ID NO: 410805 - DNA, 25 bp, Homo sapien
atcgcctgaccccaagtagtcatgg

SEQ ID NO: 410806 - DNA, 25 bp, Homo sapien
tgaccccaagtagtcatggcaccat

SEQ ID NO: 410807 - DNA, 25 bp, Homo sapien
gaccccaagtagtcatggcaccatc

SEQ ID NO: 410808 - DNA, 25 bp, Homo sapien
ccaagtagtcatggcaccatcatgc

SEQ ID NO: 410809 - DNA, 25 bp, Homo sapien
aaatgtgtgaggtgactccccggag

SEQ ID NO: 410810 - DNA, 25 bp, Homo sapien
aagaatgatgtctggaagggcttaa

SEQ ID NO: 410811 - DNA, 25 bp, Homo sapien
tctggaagggcttaagggacacagt

SEQ ID NO: 410812 - DNA, 25 bp, Homo sapien
gagagtcctcatctgctggcatttt

SEQ ID NO: 410813 - DNA, 25 bp, Homo sapien
gggtgttagtgccaaacttgaatag

SEQ ID NO: 410814 - DNA, 25 bp, Homo sapien
tgctgtcttccactgacacccaaat

SEQ ID NO: 410815 - DNA, 25 bp, Homo sapien
tgacacccaaatccagaatccctgg

SEQ ID NO: 410816 - DNA, 25 bp, Homo sapien
gaatccctggtcttgagtccccaga

SEQ ID NO: 410817 - DNA, 25 bp, Homo sapien
ttgagtccccagaactttgcctctt

SEQ ID NO: 410818 - DNA, 25 bp, Homo sapien
aactttgcctcttgactgtcccttc

SEQ ID NO: 410819 - DNA, 25 bp, Homo sapien
cttcctacctccatccatggaaaat

SEQ ID NO: 410820 - DNA, 25 bp, Homo sapien
gtaaaggtaggtgcatgccttcata

SEQ ID NO: 410821 - DNA, 25 bp, Homo sapien
aaacattaattgaggcttacagtag

SEQ ID NO: 410822 - DNA, 25 bp, Homo sapien
ggcttacagtaggagtgagaaattt

SEQ ID NO: 410823 - DNA, 25 bp, Homo sapien
tttccagaattgagagatgttttgt

SEQ ID NO: 410824 - DNA, 25 bp, Homo sapien
tgttgatattggttctatttattta

SEQ ID NO: 410825 - DNA, 25 bp, Homo sapien
aatgagttttatccaagaccttaca

SEQ ID NO: 410826 - DNA, 25 bp, Homo sapien
atccaagaccttacaaccacatttc

SEQ ID NO: 410827 - DNA, 25 bp, Homo sapien
tttctggccatttaactagcacttt

SEQ ID NO: 410828 - DNA, 25 bp, Homo sapien
ggccatttaactagcactttataag

SEQ ID NO: 410829 - DNA, 25 bp, Homo sapien
agcactttataagccaatgaagcaa

SEQ ID NO: 410830 - DNA, 25 bp, Homo sapien
aatgaagcaaacacacagactctgt

SEQ ID NO: 410831 - DNA, 25 bp, Homo sapien
accttgtaagccagggagtggtgtc

SEQ ID NO: 410832 - DNA, 25 bp, Homo sapien
tgtaagccagggagtggtgtcacct

SEQ ID NO: 410833 - DNA, 25 bp, Homo sapien
taagccagggagtggtgtcacctgt

SEQ ID NO: 410834 - DNA, 25 bp, Homo sapien
gagtggtgtcacctgtactgtagca

SEQ ID NO: 410835 - DNA, 25 bp, Homo sapien
agtggtgtcacctgtactgtagcaa

SEQ ID NO: 410836 - DNA, 25 bp, Homo sapien
gtggtgtcacctgtactgtagcaaa

SEQ ID NO: 410837 - DNA, 25 bp, Homo sapien
ggtgtcacctgtactgtagcaaaag

SEQ ID NO: 410838 - DNA, 25 bp, Homo sapien
tgtcacctgtactgtagcaaaagca

SEQ ID NO: 410839 - DNA, 25 bp, Homo sapien
gtagcaaaagcaccttttctaaatg

SEQ ID NO: 410840 - DNA, 25 bp, Homo sapien
caaaagcaccttttctaaatgtgaa

SEQ ID NO: 410841 - DNA, 25 bp, Homo sapien
aaatgtgaagtatggcttgaagaga

SEQ ID NO: 410842 - DNA, 25 bp, Homo sapien
ctcatttaactttacaaccttgcga

SEQ ID NO: 410843 - DNA, 25 bp, Homo sapien
acaaccttgcgaagtgggtccagga

SEQ ID NO: 410844 - DNA, 25 bp, Homo sapien
agtaatgggcattgtcctgcattcc

SEQ ID NO: 410845 - DNA, 25 bp, Homo sapien
ttcatggtttgcctcgatcctctct

SEQ ID NO: 410846 - DNA, 25 bp, Homo sapien
gatcctctctaagcttctatcctgg

SEQ ID NO: 410847 - DNA, 25 bp, Homo sapien
ttctatcctggcctgaataactcaa

SEQ ID NO: 410848 - DNA, 25 bp, Homo sapien
ggtctcagagatcaagccatatcct

SEQ ID NO: 410849 - DNA, 25 bp, Homo sapien
atatcctcaggccttatttccatct

SEQ ID NO: 410850 - DNA, 25 bp, Homo sapien
ttctcatgattctgccatcatacct

SEQ ID NO: 410851 - DNA, 25 bp, Homo sapien
tacctttgcttctccgctaatgaaa

SEQ ID NO: 410852 - DNA, 25 bp, Homo sapien
ctggcaagacctctgttcattgtga

SEQ ID NO: 410853 - DNA, 25 bp, Homo sapien
accataaatgctgctattctgagag

SEQ ID NO: 410854 - DNA, 25 bp, Homo sapien
gagccattttaaactgcactgctcc

SEQ ID NO: 410855 - DNA, 25 bp, Homo sapien
tcatcaccaggacagcaggtcgaga

SEQ ID NO: 410856 - DNA, 25 bp, Homo sapien
acagcaggtcgagaaaatgtctttc

SEQ ID NO: 410857 - DNA, 25 bp, Homo sapien
aaatgtctttcctttcacttgcttc

SEQ ID NO: 410858 - DNA, 25 bp, Homo sapien
gggtttgtgattattcaagacaatt

SEQ ID NO: 410859 - DNA, 25 bp, Homo sapien
tcaagacaattttttccccttgctg

SEQ ID NO: 410860 - DNA, 25 bp, Homo sapien
cgttttgagatacagaggcaaaggc

SEQ ID NO: 410861 - DNA, 25 bp, Homo sapien
gggaagggcaaagtattattggact

SEQ ID NO: 410862 - DNA, 25 bp, Homo sapien
gtattattggacttaaggaagctga

SEQ ID NO: 410863 - DNA, 25 bp, Homo sapien
aggaagctgaaatggtaccataaat

SEQ ID NO: 410864 - DNA, 25 bp, Homo sapien
tttgctttcaccattaaggttgcat

SEQ ID NO: 410865 - DNA, 25 bp, Homo sapien
gaggctttagaaccctttattgaat

SEQ ID NO: 410866 - DNA, 25 bp, Homo sapien
tagaaccctttattgaatggcatgg

SEQ ID NO: 410867 - DNA, 25 bp, Homo sapien
attgaatggcatggcaaacttttaa

SEQ ID NO: 410868 - DNA, 25 bp, Homo sapien
aaaactgcttttgctatttcactag

SEQ ID NO: 410869 - DNA, 25 bp, Homo sapien
gctatttcactagaactatctttga

SEQ ID NO: 410870 - DNA, 25 bp, Homo sapien
aaatgtcagcccaaactgtgtgtaa

SEQ ID NO: 410871 - DNA, 25 bp, Homo sapien
actgtgtgtaattagggttgtttat

SEQ ID NO: 410872 - DNA, 25 bp, Homo sapien
aaaattttctctaaatgtcatacag

SEQ ID NO: 410873 - DNA, 25 bp, Homo sapien
aaatgtcatacagaggcttaagatc

SEQ ID NO: 410874 - DNA, 25 bp, Homo sapien
aagatctgtgtatgctgttgggtcg

SEQ ID NO: 410875 - DNA, 25 bp, Homo sapien
accataaatgctgctattctgagag

SEQ ID NO: 410876 - DNA, 25 bp, Homo sapien
gagccattttaaactgcactgctcc

SEQ ID NO: 410877 - DNA, 25 bp, Homo sapien
tcatcaccaggacagcaggtcgaga

SEQ ID NO: 410878 - DNA, 25 bp, Homo sapien
atcaccaggacagcaggtcgagaaa

SEQ ID NO: 410879 - DNA, 25 bp, Homo sapien
caccaggacagcaggtcgagaaaat

SEQ ID NO: 410880 - DNA, 25 bp, Homo sapien
acagcaggtcgagaaaatgtctttc

SEQ ID NO: 410881 - DNA, 25 bp, Homo sapien
gggtttgtgattattcaagacaatt

SEQ ID NO: 410882 - DNA, 25 bp, Homo sapien
cgttttgagatacagaggcaaaggc

SEQ ID NO: 410883 - DNA, 25 bp, Homo sapien
gggaagggcaaagtattattggact

SEQ ID NO: 410884 - DNA, 25 bp, Homo sapien
gtattattggacttaaggaagctga

SEQ ID NO: 410885 - DNA, 25 bp, Homo sapien
aggaagctgaaatggtaccataaat

SEQ ID NO: 410886 - DNA, 25 bp, Homo sapien
aaatcccagcaatagcttccctttc

SEQ ID NO: 410887 - DNA, 25 bp, Homo sapien
aatcccagcaatagcttccctttct

SEQ ID NO: 410888 - DNA, 25 bp, Homo sapien
tcccagcaatagcttccctttcttt

SEQ ID NO: 410889 - DNA, 25 bp, Homo sapien
cccagcaatagcttccctttctttg

SEQ ID NO: 410890 - DNA, 25 bp, Homo sapien
cagcaatagcttccctttctttgca

SEQ ID NO: 410891 - DNA, 25 bp, Homo sapien
tccctttctttgcataggtgaggat

SEQ ID NO: 410892 - DNA, 25 bp, Homo sapien
ccctttctttgcataggtgaggatg

SEQ ID NO: 410893 - DNA, 25 bp, Homo sapien
ctttctttgcataggtgaggatgaa

SEQ ID NO: 410894 - DNA, 25 bp, Homo sapien
ttctttgcataggtgaggatgaaca

SEQ ID NO: 410895 - DNA, 25 bp, Homo sapien
ctttgcataggtgaggatgaacagt

SEQ ID NO: 410896 - DNA, 25 bp, Homo sapien
taggtgaggatgaacagttgtaatc

SEQ ID NO: 410897 - DNA, 25 bp, Homo sapien
cagaatggttgggtacttgaaatac

SEQ ID NO: 410898 - DNA, 25 bp, Homo sapien
ggttgggtacttgaaatacagcttc

SEQ ID NO: 410899 - DNA, 25 bp, Homo sapien
gaaatacagcttctactgaatgaat

SEQ ID NO: 410900 - DNA, 25 bp, Homo sapien
gtaagaaccatcataagtctgtttc

SEQ ID NO: 410901 - DNA, 25 bp, Homo sapien
gaaccatcataagtctgtttcttct

SEQ ID NO: 410902 - DNA, 25 bp, Homo sapien
gtctgtttcttctagtaaaggtgaa

SEQ ID NO: 410903 - DNA, 25 bp, Homo sapien
gatgaaagaatgcttttttcccacc

SEQ ID NO: 410904 - DNA, 25 bp, Homo sapien
ccacccaaaaaactatgctctataa

SEQ ID NO: 410905 - DNA, 25 bp, Homo sapien
gctctataaatgcagattagctagt

SEQ ID NO: 410906 - DNA, 25 bp, Homo sapien
gcagattagctagtttctgcctgtt

SEQ ID NO: 410907 - DNA, 25 bp, Homo sapien
tctgcctgtttaaatggtattattt

SEQ ID NO: 410908 - DNA, 25 bp, Homo sapien
gtgtggccccaatctggcatgtgag

SEQ ID NO: 410909 - DNA, 25 bp, Homo sapien
acctgcaagcacctgatgcaccatt

SEQ ID NO: 410910 - DNA, 25 bp, Homo sapien
tgcaagcacctgatgcaccatttcc

SEQ ID NO: 410911 - DNA, 25 bp, Homo sapien
agcacctgatgcaccatttcccaga

SEQ ID NO: 410912 - DNA, 25 bp, Homo sapien
acctgcctgttctacttcaagagca

SEQ ID NO: 410913 - DNA, 25 bp, Homo sapien
cctgcctgttctacttcaagagcag

SEQ ID NO: 410914 - DNA, 25 bp, Homo sapien
cagctgggagaacgtccgagctgct

SEQ ID NO: 410915 - DNA, 25 bp, Homo sapien
gcacccctgttcaccgggttcctgg

SEQ ID NO: 410916 - DNA, 25 bp, Homo sapien
tgctgcactcggagcccaggcagca

SEQ ID NO: 410917 - DNA, 25 bp, Homo sapien
agcagccgcaggtggacctggacca

SEQ ID NO: 410918 - DNA, 25 bp, Homo sapien
agccgcaggtggacctggaccagct

SEQ ID NO: 410919 - DNA, 25 bp, Homo sapien
gaatagtctggtgaaattactcaaa

SEQ ID NO: 410920 - DNA, 25 bp, Homo sapien
tgattatattctcccttctcctaat

SEQ ID NO: 410921 - DNA, 25 bp, Homo sapien
gagctaaaatgaactagagaccatc

SEQ ID NO: 410922 - DNA, 25 bp, Homo sapien
gagaccatctagtactttagtgtaa

SEQ ID NO: 410923 - DNA, 25 bp, Homo sapien
tgtttaatacaagtcgttaagtcct

SEQ ID NO: 410924 - DNA, 25 bp, Homo sapien
tattctcccttctcctaatgtagaa

SEQ ID NO: 410925 - DNA, 25 bp, Homo sapien
agtcgttaagtccttgtaagtgact

SEQ ID NO: 410926 - DNA, 25 bp, Homo sapien
gtgactattccaatgtttattcttt

SEQ ID NO: 410927 - DNA, 25 bp, Homo sapien
gccatctttctgtctgcactgttta

SEQ ID NO: 410928 - DNA, 25 bp, Homo sapien
gcactgtttaattaggcttactgat

SEQ ID NO: 410929 - DNA, 25 bp, Homo sapien
ggcttactgataacaactttaattc

SEQ ID NO: 410930 - DNA, 25 bp, Homo sapien
tgggcatctggatcattaaagtatg

SEQ ID NO: 410931 - DNA, 25 bp, Homo sapien
taaagtatgtccttgtttagaaact

SEQ ID NO: 410932 - DNA, 25 bp, Homo sapien
gaaactttggcagtcctagtattta

SEQ ID NO: 410933 - DNA, 25 bp, Homo sapien
tcaaatttttggttgcccttaagat

SEQ ID NO: 410934 - DNA, 25 bp, Homo sapien
gttgcccttaagatactttgtcaca

SEQ ID NO: 410935 - DNA, 25 bp, Homo sapien
gtttttatgtttgctatactgccga

SEQ ID NO: 410936 - DNA, 25 bp, Homo sapien
gtttgctatactgccgaatgaattt

SEQ ID NO: 410937 - DNA, 25 bp, Homo sapien
tactgccgaatgaatttatatctcc

SEQ ID NO: 410938 - DNA, 25 bp, Homo sapien
gcaactatgtatgctttgtctgtga

SEQ ID NO: 410939 - DNA, 25 bp, Homo sapien
atgctttgtctgtgaattgttccac

SEQ ID NO: 410940 - DNA, 25 bp, Homo sapien
tgttccacagactgatagattttgt

SEQ ID NO: 410941 - DNA, 25 bp, Homo sapien
gactcataaattattaattggcctt

SEQ ID NO: 410942 - DNA, 25 bp, Homo sapien
ttaattggcctttgtttatgtttca

SEQ ID NO: 410943 - DNA, 25 bp, Homo sapien
taattggcctttgtttatgtttcaa

SEQ ID NO: 410944 - DNA, 25 bp, Homo sapien
attggcctttgtttatgtttcaaag

SEQ ID NO: 410945 - DNA, 25 bp, Homo sapien
tggcctttgtttatgtttcaaagta

SEQ ID NO: 410946 - DNA, 25 bp, Homo sapien
gtaaatggtcgttttctttatgcta

SEQ ID NO: 410947 - DNA, 25 bp, Homo sapien
ttctttatgctaagtctttgtacct

SEQ ID NO: 410948 - DNA, 25 bp, Homo sapien
tctttatgctaagtctttgtacctg

SEQ ID NO: 410949 - DNA, 25 bp, Homo sapien
taggttagatgtggttaaaaatgac

SEQ ID NO: 410950 - DNA, 25 bp, Homo sapien
taaaaatgacagtaaacccaccagc

SEQ ID NO: 410951 - DNA, 25 bp, Homo sapien
aacccaccagcaagcaaaaataatc

SEQ ID NO: 410952 - DNA, 25 bp, Homo sapien
atagctgtattgtttagaatcttaa

SEQ ID NO: 410953 - DNA, 25 bp, Homo sapien
attagcatatgtattcacaatattc

SEQ ID NO: 410954 - DNA, 25 bp, Homo sapien
atgtattcacaatattcattcagac

SEQ ID NO: 410955 - DNA, 25 bp, Homo sapien
attcattcagacatcattcccagac

SEQ ID NO: 410956 - DNA, 25 bp, Homo sapien
tcattcagacatcattcccagacag

SEQ ID NO: 410957 - DNA, 25 bp, Homo sapien
attcccagacagcagggatttattt

SEQ ID NO: 410958 - DNA, 25 bp, Homo sapien
aaatgttagctgtctgagtttttaa

SEQ ID NO: 410959 - DNA, 25 bp, Homo sapien
taaatagctaatacgaccgggtaca

SEQ ID NO: 410960 - DNA, 25 bp, Homo sapien
aatagctaatacgaccgggtacagt

SEQ ID NO: 410961 - DNA, 25 bp, Homo sapien
aatacgaccgggtacagtggttcat

SEQ ID NO: 410962 - DNA, 25 bp, Homo sapien
acgaccgggtacagtggttcatgcc

SEQ ID NO: 410963 - DNA, 25 bp, Homo sapien
aatgctatattatgctcttgaacta

SEQ ID NO: 410964 - DNA, 25 bp, Homo sapien
gatgattatacgtggctaggtgaca

SEQ ID NO: 410965 - DNA, 25 bp, Homo sapien
acgtggctaggtgacagacattaat

SEQ ID NO: 410966 - DNA, 25 bp, Homo sapien
gacattaatgactgactctggagag

SEQ ID NO: 410967 - DNA, 25 bp, Homo sapien
tctggagagtaagtcatacctgcac

SEQ ID NO: 410968 - DNA, 25 bp, Homo sapien
gtaagtcatacctgcactctgtgga

SEQ ID NO: 410969 - DNA, 25 bp, Homo sapien
actctgtggacttgatggttctttt

SEQ ID NO: 410970 - DNA, 25 bp, Homo sapien
gatggttctttttctagagcaaaca

SEQ ID NO: 410971 - DNA, 25 bp, Homo sapien
tagagcaaacagagcgtggcatttt

SEQ ID NO: 410972 - DNA, 25 bp, Homo sapien
gagcgtggcattttgttttgacttg

SEQ ID NO: 410973 - DNA, 25 bp, Homo sapien
ttgggcgaccaagatctaataatta

SEQ ID NO: 410974 - DNA, 25 bp, Homo sapien
ccgtgcctaggctggtgaagctctt

SEQ ID NO: 410975 - DNA, 25 bp, Homo sapien
ttcaaccacgccaaccaggaagtgc

SEQ ID NO: 410976 - DNA, 25 bp, Homo sapien
agcgccatgccacaggtgccatgcg

SEQ ID NO: 410977 - DNA, 25 bp, Homo sapien
acctcatctacgacaacgctgacaa

SEQ ID NO: 410978 - DNA, 25 bp, Homo sapien
ctgacaacaagctggccctggtgga

SEQ ID NO: 410979 - DNA, 25 bp, Homo sapien
gagaacgggatcttcgagctgctgc

SEQ ID NO: 410980 - DNA, 25 bp, Homo sapien
ggagcaggatgatgagcttcgcaaa

SEQ ID NO: 410981 - DNA, 25 bp, Homo sapien
gagcttcgcaaaaatgtcacaggga

SEQ ID NO: 410982 - DNA, 25 bp, Homo sapien
gatcctgtggaacctttcatccagc

SEQ ID NO: 410983 - DNA, 25 bp, Homo sapien
gaaggaccgcctggccagagacacg

SEQ ID NO: 410984 - DNA, 25 bp, Homo sapien
gagcagctcacagacctggtgttga

SEQ ID NO: 410985 - DNA, 25 bp, Homo sapien
gtcagttctctaatttcaggcttgg

SEQ ID NO: 410986 - DNA, 25 bp, Homo sapien
gttctctaatttcaggcttggtagc

SEQ ID NO: 410987 - DNA, 25 bp, Homo sapien
gcttgtaggaactgaaattgcaatt

SEQ ID NO: 410988 - DNA, 25 bp, Homo sapien
agtccattcttccaaaacttgatgt

SEQ ID NO: 410989 - DNA, 25 bp, Homo sapien
aaacttgatgttaccacacttacaa

SEQ ID NO: 410990 - DNA, 25 bp, Homo sapien
tgatgttaccacacttacaagttta

SEQ ID NO: 410991 - DNA, 25 bp, Homo sapien
gtttaaaatatgaagtcgactgttt

SEQ ID NO: 410992 - DNA, 25 bp, Homo sapien
gtcgactgtttaaaggattctgcat

SEQ ID NO: 410993 - DNA, 25 bp, Homo sapien
gcatatattctagtgtgcacattca

SEQ ID NO: 410994 - DNA, 25 bp, Homo sapien
tctagtgtgcacattcagaaacatt

SEQ ID NO: 410995 - DNA, 25 bp, Homo sapien
gtgtgcacattcagaaacatttttc

SEQ ID NO: 410996 - DNA, 25 bp, Homo sapien
tagatgtcaaaagctcttcctccag

SEQ ID NO: 410997 - DNA, 25 bp, Homo sapien
aagctcttcctccagtccagacttt

SEQ ID NO: 410998 - DNA, 25 bp, Homo sapien
agccccagttcaacatcgatctact

SEQ ID NO: 410999 - DNA, 25 bp, Homo sapien
tcgatctacttgctacttctatggg

SEQ ID NO: 411000 - DNA, 25 bp, Homo sapien
ctatggggtcaactttttcagatca

SEQ ID NO: 411001 - DNA, 25 bp, Homo sapien
tttcagatcaacacttccaggacat

SEQ ID NO: 411002 - DNA, 25 bp, Homo sapien
aggacatcatgtggaattggtctct

SEQ ID NO: 411003 - DNA, 25 bp, Homo sapien
atttcctcattccacggtgcacaca

SEQ ID NO: 411004 - DNA, 25 bp, Homo sapien
ggtgcacacatctatcgaatcctca

SEQ ID NO: 411005 - DNA, 25 bp, Homo sapien
atctatcgaatcctcacattgtacc

SEQ ID NO: 411006 - DNA, 25 bp, Homo sapien
gtaccccataagtgtacaagcatga

SEQ ID NO: 411007 - DNA, 25 bp, Homo sapien
gacctactaccctgagaagcagtga

SEQ ID NO: 411008 - DNA, 25 bp, Homo sapien
tctaaaaaaggcggtggctcctcct

SEQ ID NO: 411009 - DNA, 25 bp, Homo sapien
ggatggccttgctccagctactgct

SEQ ID NO: 411010 - DNA, 25 bp, Homo sapien
gccttgctccagctactgctcagat

SEQ ID NO: 411011 - DNA, 25 bp, Homo sapien
ttgctccagctactgctcagatcac

SEQ ID NO: 411012 - DNA, 25 bp, Homo sapien
tccagctactgctcagatcaccttt

SEQ ID NO: 411013 - DNA, 25 bp, Homo sapien
tcacctttgcaagatgacattgtgt

SEQ ID NO: 411014 - DNA, 25 bp, Homo sapien
gcaagatgacattgtgttgggagat

SEQ ID NO: 411015 - DNA, 25 bp, Homo sapien
gatggtcatcagagccagggccatg

SEQ ID NO: 411016 - DNA, 25 bp, Homo sapien
tggaagatgctgtcaggaggcacga

SEQ ID NO: 411017 - DNA, 25 bp, Homo sapien
ctgtcaggaggcacgaggaaaggct

SEQ ID NO: 411018 - DNA, 25 bp, Homo sapien
aaaataggtctatgggccgggcgtg

SEQ ID NO: 411019 - DNA, 25 bp, Homo sapien
aaataggtctatgggccgggcgtgg

SEQ ID NO: 411020 - DNA, 25 bp, Homo sapien
aataggtctatgggccgggcgtggt

SEQ ID NO: 411021 - DNA, 25 bp, Homo sapien
ataggtctatgggccgggcgtggtg

SEQ ID NO: 411022 - DNA, 25 bp, Homo sapien
ctgagggaggtagattgcctgagct

SEQ ID NO: 411023 - DNA, 25 bp, Homo sapien
tgagggaggtagattgcctgagctc

SEQ ID NO: 411024 - DNA, 25 bp, Homo sapien
gagggaggtagattgcctgagctca

SEQ ID NO: 411025 - DNA, 25 bp, Homo sapien
ggcaacacggtgaggccccatctgt

SEQ ID NO: 411026 - DNA, 25 bp, Homo sapien
gcaacacggtgaggccccatctgta

SEQ ID NO: 411027 - DNA, 25 bp, Homo sapien
caacacggtgaggccccatctgtac

SEQ ID NO: 411028 - DNA, 25 bp, Homo sapien
cacggtgaggccccatctgtactaa

SEQ ID NO: 411029 - DNA, 25 bp, Homo sapien
catctcttcctctggagccagagcc

SEQ ID NO: 411030 - DNA, 25 bp, Homo sapien
aagaatagaatgaatgaccccaaaa

SEQ ID NO: 411031 - DNA, 25 bp, Homo sapien
atagaatgaatgaccccaaaatagg

SEQ ID NO: 411032 - DNA, 25 bp, Homo sapien
aatagggttttcttgggcgaggatg

SEQ ID NO: 411033 - DNA, 25 bp, Homo sapien
ggcacccaccacagaatacagtgtg

SEQ ID NO: 411034 - DNA, 25 bp, Homo sapien
cacagaatacagtgtgtgttattac

SEQ ID NO: 411035 - DNA, 25 bp, Homo sapien
gtgttattacgaggagccagcagtt

SEQ ID NO: 411036 - DNA, 25 bp, Homo sapien
tgttattacgaggagccagcagttg

SEQ ID NO: 411037 - DNA, 25 bp, Homo sapien
tctactgccccataagccaggaaaa

SEQ ID NO: 411038 - DNA, 25 bp, Homo sapien
tactgccccataagccaggaaaagt

SEQ ID NO: 411039 - DNA, 25 bp, Homo sapien
tgccccataagccaggaaaagtgaa

SEQ ID NO: 411040 - DNA, 25 bp, Homo sapien
gaatgtactttgtacgatacaccct

SEQ ID NO: 411041 - DNA, 25 bp, Homo sapien
atgtactttgtacgatacaccctcc

SEQ ID NO: 411042 - DNA, 25 bp, Homo sapien
ggtactttgtaatatcctctccgcc

SEQ ID NO: 411043 - DNA, 25 bp, Homo sapien
tactttgtaatatcctctccgccct

SEQ ID NO: 411044 - DNA, 25 bp, Homo sapien
tgtaatatcctctccgcccttgaga

SEQ ID NO: 411045 - DNA, 25 bp, Homo sapien
gtactttgtaagatccacttcctgc

SEQ ID NO: 411046 - DNA, 25 bp, Homo sapien
ttgtaagatccacttcctgcctgca

SEQ ID NO: 411047 - DNA, 25 bp, Homo sapien
ctgcaaaaaattgctccgaactcca

SEQ ID NO: 411048 - DNA, 25 bp, Homo sapien
cctccccacccttgcaataatgtac

SEQ ID NO: 411049 - DNA, 25 bp, Homo sapien
ccccacccttgcaataatgtacttt

SEQ ID NO: 411050 - DNA, 25 bp, Homo sapien
cccacccttgcaataatgtactttg

SEQ ID NO: 411051 - DNA, 25 bp, Homo sapien
cttttgccaagttgtggtcttcaaa

SEQ ID NO: 411052 - DNA, 25 bp, Homo sapien
ttatgtttactcttcctattggcag

SEQ ID NO: 411053 - DNA, 25 bp, Homo sapien
gtttactcttcctattggcagaata

SEQ ID NO: 411054 - DNA, 25 bp, Homo sapien
aaggataagcagagggagtccctat

SEQ ID NO: 411055 - DNA, 25 bp, Homo sapien
gagggagtccctataaccaaagatg

SEQ ID NO: 411056 - DNA, 25 bp, Homo sapien
aaagatggacagcatagccctggat

SEQ ID NO: 411057 - DNA, 25 bp, Homo sapien
gacagcatagccctggatagccaga

SEQ ID NO: 411058 - DNA, 25 bp, Homo sapien
ggatagccagataaaccactctttg

SEQ ID NO: 411059 - DNA, 25 bp, Homo sapien
gccagataaaccactctttgtatta

SEQ ID NO: 411060 - DNA, 25 bp, Homo sapien
gtgggtaactgtgaaagagctttat

SEQ ID NO: 411061 - DNA, 25 bp, Homo sapien
gtctattcatggtattatagctgta

SEQ ID NO: 411062 - DNA, 25 bp, Homo sapien
cctcattctctttttgcccttcttt

SEQ ID NO: 411063 - DNA, 25 bp, Homo sapien
tttttgcccttctttcatgggatga

SEQ ID NO: 411064 - DNA, 25 bp, Homo sapien
cttgccagatgccagcaacttgata

SEQ ID NO: 411065 - DNA, 25 bp, Homo sapien
atcctccagaatggtgatggccaca

SEQ ID NO: 411066 - DNA, 25 bp, Homo sapien
ccctcatgaatagatcaatgctatt

SEQ ID NO: 411067 - DNA, 25 bp, Homo sapien
agatcaatgctattatcgtggaagt

SEQ ID NO: 411068 - DNA, 25 bp, Homo sapien
atgctattatcgtggaagtgggctt

SEQ ID NO: 411069 - DNA, 25 bp, Homo sapien
aagtgggcttgttattgcaggagta

SEQ ID NO: 411070 - DNA, 25 bp, Homo sapien
ttacaaaaggatgagttcagcctcc

SEQ ID NO: 411071 - DNA, 25 bp, Homo sapien
aaggatgagttcagcctccttttgc

SEQ ID NO: 411072 - DNA, 25 bp, Homo sapien
tgagttcagcctccttttgcctctt

SEQ ID NO: 411073 - DNA, 25 bp, Homo sapien
ttgtatagtctgcatctctcaggct

SEQ ID NO: 411074 - DNA, 25 bp, Homo sapien
tcaggctgccccagaatgttgtaca

SEQ ID NO: 411075 - DNA, 25 bp, Homo sapien
gaaagcagcaggtacacacagaaat

SEQ ID NO: 411076 - DNA, 25 bp, Homo sapien
agaaatgcagcctttcctggttaac

SEQ ID NO: 411077 - DNA, 25 bp, Homo sapien
tggttaaccctgcttggatctgagt

SEQ ID NO: 411078 - DNA, 25 bp, Homo sapien
gatctgagttacactttgtttcctg

SEQ ID NO: 411079 - DNA, 25 bp, Homo sapien
ttgtttcctgacttcttgggactta

SEQ ID NO: 411080 - DNA, 25 bp, Homo sapien
ggtaatcagtttgccttctactcta

SEQ ID NO: 411081 - DNA, 25 bp, Homo sapien
actctatctcattttgtactcgctt

SEQ ID NO: 411082 - DNA, 25 bp, Homo sapien
gtgtttacactttggcttccatgcc

SEQ ID NO: 411083 - DNA, 25 bp, Homo sapien
gcctctggaatgtttgtgctttggt

SEQ ID NO: 411084 - DNA, 25 bp, Homo sapien
tctaaaaaaggcggtggctcctcct

SEQ ID NO: 411085 - DNA, 25 bp, Homo sapien
ggatggccttgctccagctactgct

SEQ ID NO: 411086 - DNA, 25 bp, Homo sapien
atggccttgctccagctactgctca

SEQ ID NO: 411087 - DNA, 25 bp, Homo sapien
gccttgctccagctactgctcagat

SEQ ID NO: 411088 - DNA, 25 bp, Homo sapien
ttgctccagctactgctcagatcac

SEQ ID NO: 411089 - DNA, 25 bp, Homo sapien
tccagctactgctcagatcaccttt

SEQ ID NO: 411090 - DNA, 25 bp, Homo sapien
tcacctttgcaagatgacattgtgt

SEQ ID NO: 411091 - DNA, 25 bp, Homo sapien
cacctttgcaagatgacattgtgtt

SEQ ID NO: 411092 - DNA, 25 bp, Homo sapien
gcaagatgacattgtgttgggagat

SEQ ID NO: 411093 - DNA, 25 bp, Homo sapien
tggaagatgctgtcaggaggcacga

SEQ ID NO: 411094 - DNA, 25 bp, Homo sapien
ctgtcaggaggcacgaggaaaggct

SEQ ID NO: 411095 - DNA, 25 bp, Homo sapien
gaaaattttttccagcatgggcact

SEQ ID NO: 411096 - DNA, 25 bp, Homo sapien
gcatgggcacttagaaaaagcacat

SEQ ID NO: 411097 - DNA, 25 bp, Homo sapien
agtagaacctggcattctcctttca

SEQ ID NO: 411098 - DNA, 25 bp, Homo sapien
gatccatctaagtctcagatctgga

SEQ ID NO: 411099 - DNA, 25 bp, Homo sapien
cagatctggaaacgttttgtaccga

SEQ ID NO: 411100 - DNA, 25 bp, Homo sapien
gttttgtaccgattatccacagcaa

SEQ ID NO: 411101 - DNA, 25 bp, Homo sapien
gtaccgattatccacagcaaaacaa

SEQ ID NO: 411102 - DNA, 25 bp, Homo sapien
aatttcgttcctcttgtgcccaatc

SEQ ID NO: 411103 - DNA, 25 bp, Homo sapien
gtgcccaatcaaatcttttaggaac

SEQ ID NO: 411104 - DNA, 25 bp, Homo sapien
gagtgaactaaatacagacattgct

SEQ ID NO: 411105 - DNA, 25 bp, Homo sapien
tacagacattgcttacttgttttga

SEQ ID NO: 411106 - DNA, 25 bp, Homo sapien
agaactttccactatagaattcttt

SEQ ID NO: 411107 - DNA, 25 bp, Homo sapien
aaaactcaactggtgacttgtgatt

SEQ ID NO: 411108 - DNA, 25 bp, Homo sapien
aactggtgacttgtgattgtgaaat

SEQ ID NO: 411109 - DNA, 25 bp, Homo sapien
gataacacttggatgcattcttgct

SEQ ID NO: 411110 - DNA, 25 bp, Homo sapien
ttggatgcattcttgctctcacaga

SEQ ID NO: 411111 - DNA, 25 bp, Homo sapien
cttgctctcacagaattggtgacat

SEQ ID NO: 411112 - DNA, 25 bp, Homo sapien
ttggtgacatgctttgagagttttg

SEQ ID NO: 411113 - DNA, 25 bp, Homo sapien
gttttgtcacatgttgacatgccaa

SEQ ID NO: 411114 - DNA, 25 bp, Homo sapien
gacatgccaatgttcttataaacct

SEQ ID NO: 411115 - DNA, 25 bp, Homo sapien
gtactgtgaacttgtagggtgcttt

SEQ ID NO: 411116 - DNA, 25 bp, Homo sapien
aacttgtagggtgcttttcaacagt

SEQ ID NO: 411117 - DNA, 25 bp, Homo sapien
ttttgagctgttatatggactgctt

SEQ ID NO: 411118 - DNA, 25 bp, Homo sapien
gctgttatatggactgcttttgagt

SEQ ID NO: 411119 - DNA, 25 bp, Homo sapien
gcttttgagtctgcgtttctctcca

SEQ ID NO: 411120 - DNA, 25 bp, Homo sapien
ttgagtctgcgtttctctccacttg

SEQ ID NO: 411121 - DNA, 25 bp, Homo sapien
gagaccccaggcttggttcgggctc

SEQ ID NO: 411122 - DNA, 25 bp, Homo sapien
ttcgggctctctttgggcacgggtt

SEQ ID NO: 411123 - DNA, 25 bp, Homo sapien
gggcgtgtgacttgatgtttgtacc

SEQ ID NO: 411124 - DNA, 25 bp, Homo sapien
gtgacttgatgtttgtaccgcgatt

SEQ ID NO: 411125 - DNA, 25 bp, Homo sapien
acttgatgtttgtaccgcgattttg

SEQ ID NO: 411126 - DNA, 25 bp, Homo sapien
gtaccgcgattttggtaataccaag

SEQ ID NO: 411127 - DNA, 25 bp, Homo sapien
tggtaataccaagctttattaaaca

SEQ ID NO: 411128 - DNA, 25 bp, Homo sapien
aagtattatttgaccacttcaggta

SEQ ID NO: 411129 - DNA, 25 bp, Homo sapien
tgaccacttcaggtatacattcaat

SEQ ID NO: 411130 - DNA, 25 bp, Homo sapien
caggtatacattcaatactgggtaa

SEQ ID NO: 411131 - DNA, 25 bp, Homo sapien
gtaaaaatttcagacctatctcagg

SEQ ID NO: 411132 - DNA, 25 bp, Homo sapien
tttcagacctatctcaggaacacag

SEQ ID NO: 411133 - DNA, 25 bp, Homo sapien
tttggtgtcctgataagcactttct

SEQ ID NO: 411134 - DNA, 25 bp, Homo sapien
taagcactttctagactattgatgt

SEQ ID NO: 411135 - DNA, 25 bp, Homo sapien
ctagactattgatgtggccaggaat

SEQ ID NO: 411136 - DNA, 25 bp, Homo sapien
tttggaaagacgacacacgcacgca

SEQ ID NO: 411137 - DNA, 25 bp, Homo sapien
gaaaaccttaaagtatttgcttgct

SEQ ID NO: 411138 - DNA, 25 bp, Homo sapien
gtgtacaacctcaaatttgctgcca

SEQ ID NO: 411139 - DNA, 25 bp, Homo sapien
tagtaattgtggtttactggaaaat

SEQ ID NO: 411140 - DNA, 25 bp, Homo sapien
aattcaatgaatagggtgttaaagg

SEQ ID NO: 411141 - DNA, 25 bp, Homo sapien
gggtgttaaaggaagcaattcatta

SEQ ID NO: 411142 - DNA, 25 bp, Homo sapien
aatatatgtaatctattgggagact

SEQ ID NO: 411143 - DNA, 25 bp, Homo sapien
tgcattcctgtattcccaggtactc

SEQ ID NO: 411144 - DNA, 25 bp, Homo sapien
ttgcagcgagtcaggatcgcagcac

SEQ ID NO: 411145 - DNA, 25 bp, Homo sapien
gcagcgagtcaggatcgcagcacta

SEQ ID NO: 411146 - DNA, 25 bp, Homo sapien
agcgagtcaggatcgcagcactaca

SEQ ID NO: 411147 - DNA, 25 bp, Homo sapien
gcgagtcaggatcgcagcactacac

SEQ ID NO: 411148 - DNA, 25 bp, Homo sapien
gagtcaggatcgcagcactacactc

SEQ ID NO: 411149 - DNA, 25 bp, Homo sapien
agtcaggatcgcagcactacactcc

SEQ ID NO: 411150 - DNA, 25 bp, Homo sapien
taattaagtgctttaaacggtcttg

SEQ ID NO: 411151 - DNA, 25 bp, Homo sapien
acaaagctgaatctttctccctgga

SEQ ID NO: 411152 - DNA, 25 bp, Homo sapien
agctgaatctttctccctggagtaa

SEQ ID NO: 411153 - DNA, 25 bp, Homo sapien
tttctccctggagtaaggccgaaga

SEQ ID NO: 411154 - DNA, 25 bp, Homo sapien
aaggccgaagactggattactacac

SEQ ID NO: 411155 - DNA, 25 bp, Homo sapien
gactggattactacacgcctagacg

SEQ ID NO: 411156 - DNA, 25 bp, Homo sapien
ttactacacgcctagacgtgacact

SEQ ID NO: 411157 - DNA, 25 bp, Homo sapien
tagacgtgacactacacccatagat

SEQ ID NO: 411158 - DNA, 25 bp, Homo sapien
tgacactacacccatagatctcatg

SEQ ID NO: 411159 - DNA, 25 bp, Homo sapien
agatctcatgcatcattaatgccat

SEQ ID NO: 411160 - DNA, 25 bp, Homo sapien
gccatatgacattgccattttcttt

SEQ ID NO: 411161 - DNA, 25 bp, Homo sapien
ggcttcacagagacaaccatttatg

SEQ ID NO: 411162 - DNA, 25 bp, Homo sapien
accatttatgatttgctgttctgta

SEQ ID NO: 411163 - DNA, 25 bp, Homo sapien
tgctgttctgtaagagtgtggattc

SEQ ID NO: 411164 - DNA, 25 bp, Homo sapien
gtgtggattctttctatcaactgct

SEQ ID NO: 411165 - DNA, 25 bp, Homo sapien
tggattctttctatcaactgctgat

SEQ ID NO: 411166 - DNA, 25 bp, Homo sapien
tatcaactgctgatatcatcttcag

SEQ ID NO: 411167 - DNA, 25 bp, Homo sapien
ttctttcccttggtttcatcatttt

SEQ ID NO: 411168 - DNA, 25 bp, Homo sapien
catatcttaaaccaaattacttcgg

SEQ ID NO: 411169 - DNA, 25 bp, Homo sapien
attacttcggtatctgacaacagca

SEQ ID NO: 411170 - DNA, 25 bp, Homo sapien
acaacagcatcatctacctcagtca

SEQ ID NO: 411171 - DNA, 25 bp, Homo sapien
acctcagtcattaggatttcttaat

SEQ ID NO: 411172 - DNA, 25 bp, Homo sapien
gtaagtgtccctgtaaaggccaggt

SEQ ID NO: 411173 - DNA, 25 bp, Homo sapien
aaggccaggtgaaactgccattctt

SEQ ID NO: 411174 - DNA, 25 bp, Homo sapien
actgccattctttaacctgttactc

SEQ ID NO: 411175 - DNA, 25 bp, Homo sapien
acctgttactcggtgtacttgactg

SEQ ID NO: 411176 - DNA, 25 bp, Homo sapien
tactcggtgtacttgactgcggaaa

SEQ ID NO: 411177 - DNA, 25 bp, Homo sapien
tcggtgtacttgactgcggaaagaa

SEQ ID NO: 411178 - DNA, 25 bp, Homo sapien
gtactgaatagttaatggttccctt

SEQ ID NO: 411179 - DNA, 25 bp, Homo sapien
tggttcccttaatagactcttgtcc

SEQ ID NO: 411180 - DNA, 25 bp, Homo sapien
cccttaatagactcttgtccttgga

SEQ ID NO: 411181 - DNA, 25 bp, Homo sapien
aaaactctaaaacctactcatgaga

SEQ ID NO: 411182 - DNA, 25 bp, Homo sapien
aaagccgacttaatgacttctgaaa

SEQ ID NO: 411183 - DNA, 25 bp, Homo sapien
atgagagctattatcatctgtggtg

SEQ ID NO: 411184 - DNA, 25 bp, Homo sapien
ggtagattgtatagagagactatct

SEQ ID NO: 411185 - DNA, 25 bp, Homo sapien
gagagactatcttgtgttgtgcctg

SEQ ID NO: 411186 - DNA, 25 bp, Homo sapien
ttgtgttgtgcctgtatgaattttt

SEQ ID NO: 411187 - DNA, 25 bp, Homo sapien
tgttgtgcctgtatgaatttttaaa

SEQ ID NO: 411188 - DNA, 25 bp, Homo sapien
tgttgactggattttgcaaaaggat

SEQ ID NO: 411189 - DNA, 25 bp, Homo sapien
gactggattttgcaaaaggatgtat

SEQ ID NO: 411190 - DNA, 25 bp, Homo sapien
ggatgtataatatttctgtctgctc

SEQ ID NO: 411191 - DNA, 25 bp, Homo sapien
ctgtctgctcagaatattaatttgt

SEQ ID NO: 411192 - DNA, 25 bp, Homo sapien
taatttgtaaattctgcaagtttaa

SEQ ID NO: 411193 - DNA, 25 bp, Homo sapien
cttagctagggcttaaataaacatg

SEQ ID NO: 411194 - DNA, 25 bp, Homo sapien
ggctgagatggatcatctgagcctc

SEQ ID NO: 411195 - DNA, 25 bp, Homo sapien
gctgagatggatcatctgagcctca

SEQ ID NO: 411196 - DNA, 25 bp, Homo sapien
gagatggatcatctgagcctcagga

SEQ ID NO: 411197 - DNA, 25 bp, Homo sapien
aagctgtcctacaaagttgagcttt

SEQ ID NO: 411198 - DNA, 25 bp, Homo sapien
agctgtcctacaaagttgagctttg

SEQ ID NO: 411199 - DNA, 25 bp, Homo sapien
gctgtcctacaaagttgagctttgt

SEQ ID NO: 411200 - DNA, 25 bp, Homo sapien
ctgtcctacaaagttgagctttgtt

SEQ ID NO: 411201 - DNA, 25 bp, Homo sapien
gtcctacaaagttgagctttgttag

SEQ ID NO: 411202 - DNA, 25 bp, Homo sapien
gctttgttagtttttcatgtgtaat

SEQ ID NO: 411203 - DNA, 25 bp, Homo sapien
ctttgttagtttttcatgtgtaata

SEQ ID NO: 411204 - DNA, 25 bp, Homo sapien
tgttagtttttcatgtgtaatatat

SEQ ID NO: 411205 - DNA, 25 bp, Homo sapien
catttcttcccacctaacattctta

SEQ ID NO: 411206 - DNA, 25 bp, Homo sapien
gattagagtctaaactttgtcattc

SEQ ID NO: 411207 - DNA, 25 bp, Homo sapien
ctttgtcattcattcctaattctgg

SEQ ID NO: 411208 - DNA, 25 bp, Homo sapien
cctaattctggagctctgaggttga

SEQ ID NO: 411209 - DNA, 25 bp, Homo sapien
aaggcctgacaataggttgcaatac

SEQ ID NO: 411210 - DNA, 25 bp, Homo sapien
gttgcaatacccatgcattgggact

SEQ ID NO: 411211 - DNA, 25 bp, Homo sapien
atgcattgggactcatacccagcat

SEQ ID NO: 411212 - DNA, 25 bp, Homo sapien
gggactcatacccagcataaatggt

SEQ ID NO: 411213 - DNA, 25 bp, Homo sapien
ggactgaacattagtgctttgagca

SEQ ID NO: 411214 - DNA, 25 bp, Homo sapien
gtgctttgagcaagaattggttaac

SEQ ID NO: 411215 - DNA, 25 bp, Homo sapien
ttggttaactacctgagatctctaa

SEQ ID NO: 411216 - DNA, 25 bp, Homo sapien
gtgggctgacagagatatgatcctt

SEQ ID NO: 411217 - DNA, 25 bp, Homo sapien
cagagatatgatccttttctcccct

SEQ ID NO: 411218 - DNA, 25 bp, Homo sapien
aagtattacaatctgatgccgtgtt

SEQ ID NO: 411219 - DNA, 25 bp, Homo sapien
atgccgtgttaagttgcatctcctt

SEQ ID NO: 411220 - DNA, 25 bp, Homo sapien
ttaagttgcatctccttttgacctc

SEQ ID NO: 411221 - DNA, 25 bp, Homo sapien
tgcatctccttttgacctctactta

SEQ ID NO: 411222 - DNA, 25 bp, Homo sapien
ggctatataaactgtaatgctgaga

SEQ ID NO: 411223 - DNA, 25 bp, Homo sapien
tgagattggacttcagcctggagcc

SEQ ID NO: 411224 - DNA, 25 bp, Homo sapien
ggacttcagcctggagccattagat

SEQ ID NO: 411225 - DNA, 25 bp, Homo sapien
cagcctggagccattagatagataa

SEQ ID NO: 411226 - DNA, 25 bp, Homo sapien
gatagataagctgtaagactgataa

SEQ ID NO: 411227 - DNA, 25 bp, Homo sapien
gacctgtggaatgattccatgcctg

SEQ ID NO: 411228 - DNA, 25 bp, Homo sapien
gactcataaattattaattggcctt

SEQ ID NO: 411229 - DNA, 25 bp, Homo sapien
ttaattggcctttgtttatgtttca

SEQ ID NO: 411230 - DNA, 25 bp, Homo sapien
taattggcctttgtttatgtttcaa

SEQ ID NO: 411231 - DNA, 25 bp, Homo sapien
tggcctttgtttatgtttcaaagta

SEQ ID NO: 411232 - DNA, 25 bp, Homo sapien
gtaaatggtcgttttctttatgcta

SEQ ID NO: 411233 - DNA, 25 bp, Homo sapien
tctttatgctaagtctttgtacctg

SEQ ID NO: 411234 - DNA, 25 bp, Homo sapien
tgctaagtctttgtacctggcaccc

SEQ ID NO: 411235 - DNA, 25 bp, Homo sapien
taaaaatgacagtaaacccaccagc

SEQ ID NO: 411236 - DNA, 25 bp, Homo sapien
aacccaccagcaagcaaaaataatc

SEQ ID NO: 411237 - DNA, 25 bp, Homo sapien
gagccaggtgagtttgggatccaca

SEQ ID NO: 411238 - DNA, 25 bp, Homo sapien
acatctaaactctaagtacagactt

SEQ ID NO: 411239 - DNA, 25 bp, Homo sapien
gtacagacttcttatgcttaaaact

SEQ ID NO: 411240 - DNA, 25 bp, Homo sapien
tatgcttaaaactcttacacagtgt

SEQ ID NO: 411241 - DNA, 25 bp, Homo sapien
ttacacagtgttaaccccaagacag

SEQ ID NO: 411242 - DNA, 25 bp, Homo sapien
gttaaccccaagacagatttgcaat

SEQ ID NO: 411243 - DNA, 25 bp, Homo sapien
aatgtggtagactttgctgttttgc

SEQ ID NO: 411244 - DNA, 25 bp, Homo sapien
tttgctgttttgctgaagctaagca

SEQ ID NO: 411245 - DNA, 25 bp, Homo sapien
gaagctaagcaaggaaccagttttt

SEQ ID NO: 411246 - DNA, 25 bp, Homo sapien
ccagtttttaaatcagcaatccgtt

SEQ ID NO: 411247 - DNA, 25 bp, Homo sapien
gagcaatttaatagtgcacctcaaa

SEQ ID NO: 411248 - DNA, 25 bp, Homo sapien
taatagtgcacctcaaaggtcaatg

SEQ ID NO: 411249 - DNA, 25 bp, Homo sapien
aaagtatacatttaggcagggtgca

SEQ ID NO: 411250 - DNA, 25 bp, Homo sapien
aagtatacatttaggcagggtgcag

SEQ ID NO: 411251 - DNA, 25 bp, Homo sapien
agtatacatttaggcagggtgcagt

SEQ ID NO: 411252 - DNA, 25 bp, Homo sapien
gtatacatttaggcagggtgcagtg

SEQ ID NO: 411253 - DNA, 25 bp, Homo sapien
aagaccagcctagagaacatatgga

SEQ ID NO: 411254 - DNA, 25 bp, Homo sapien
agcctagagaacatatggagaccct

SEQ ID NO: 411255 - DNA, 25 bp, Homo sapien
tagagaacatatggagaccctgtct

SEQ ID NO: 411256 - DNA, 25 bp, Homo sapien
agaacatatggagaccctgtcttca

SEQ ID NO: 411257 - DNA, 25 bp, Homo sapien
ataaaaaagtcagccaagcgtggtg

SEQ ID NO: 411258 - DNA, 25 bp, Homo sapien
tgtgtgcctgtagttacttaggagg

SEQ ID NO: 411259 - DNA, 25 bp, Homo sapien
ctgtggtgagctacaattgcgccac

SEQ ID NO: 411260 - DNA, 25 bp, Homo sapien
tcacacaaagccctggcatggtggt

SEQ ID NO: 411261 - DNA, 25 bp, Homo sapien
gagtcagacgctgttaccgtacatt

SEQ ID NO: 411262 - DNA, 25 bp, Homo sapien
agtcagacgctgttaccgtacattc

SEQ ID NO: 411263 - DNA, 25 bp, Homo sapien
gtcagacgctgttaccgtacattct

SEQ ID NO: 411264 - DNA, 25 bp, Homo sapien
cagacgctgttaccgtacattctac

SEQ ID NO: 411265 - DNA, 25 bp, Homo sapien
gacgctgttaccgtacattctactc

SEQ ID NO: 411266 - DNA, 25 bp, Homo sapien
acgctgttaccgtacattctactca

SEQ ID NO: 411267 - DNA, 25 bp, Homo sapien
gctgttaccgtacattctactcatg

SEQ ID NO: 411268 - DNA, 25 bp, Homo sapien
ctgttaccgtacattctactcatgg

SEQ ID NO: 411269 - DNA, 25 bp, Homo sapien
gttaccgtacattctactcatggtg

SEQ ID NO: 411270 - DNA, 25 bp, Homo sapien
taccgtacattctactcatggtggc

SEQ ID NO: 411271 - DNA, 25 bp, Homo sapien
aggtgcccagtctaatgtatttgat

SEQ ID NO: 411272 - DNA, 25 bp, Homo sapien
attatcaccattaatccatgccagt

SEQ ID NO: 411273 - DNA, 25 bp, Homo sapien
tttgatatctgtccttagagcctcc

SEQ ID NO: 411274 - DNA, 25 bp, Homo sapien
tagagcctccgtatctgtgaagact

SEQ ID NO: 411275 - DNA, 25 bp, Homo sapien
gagtcatgcacttcatcacatttca

SEQ ID NO: 411276 - DNA, 25 bp, Homo sapien
acatttcagtaacgatgggccgcat

SEQ ID NO: 411277 - DNA, 25 bp, Homo sapien
aacgatgggccgcatgtaccacagt

SEQ ID NO: 411278 - DNA, 25 bp, Homo sapien
atgtaccacagtcccatgagatgat

SEQ ID NO: 411279 - DNA, 25 bp, Homo sapien
ggtgcagaaaaattcctgtcatcta

SEQ ID NO: 411280 - DNA, 25 bp, Homo sapien
gtcatctagtgacatcgtagccatc

SEQ ID NO: 411281 - DNA, 25 bp, Homo sapien
atccatgccagttatgtacagtttt

SEQ ID NO: 411282 - DNA, 25 bp, Homo sapien
gtctgcttactccactagagcaaag

SEQ ID NO: 411283 - DNA, 25 bp, Homo sapien
gcttactccactagagcaaagttct

SEQ ID NO: 411284 - DNA, 25 bp, Homo sapien
agcaaagttctctatagtcagcaag

SEQ ID NO: 411285 - DNA, 25 bp, Homo sapien
aaagttctctatagtcagcaagtat

SEQ ID NO: 411286 - DNA, 25 bp, Homo sapien
gtcagcaagtatatctttatcactc

SEQ ID NO: 411287 - DNA, 25 bp, Homo sapien
cagcaagtatatctttatcactctt

SEQ ID NO: 411288 - DNA, 25 bp, Homo sapien
aaacattagtgtttaggctgggcgc

SEQ ID NO: 411289 - DNA, 25 bp, Homo sapien
acggagtttttaatagatgtctgct

SEQ ID NO: 411290 - DNA, 25 bp, Homo sapien
aatagatgtctgcttactccactag

SEQ ID NO: 411291 - DNA, 25 bp, Homo sapien
tagatgtctgcttactccactagag

SEQ ID NO: 411292 - DNA, 25 bp, Homo sapien
atgtctgcttactccactagagcaa

SEQ ID NO: 411293 - DNA, 25 bp, Homo sapien
ggtattgtgcaatggcctagcctag

SEQ ID NO: 411294 - DNA, 25 bp, Homo sapien
gtgcaatggcctagcctagtagaaa

SEQ ID NO: 411295 - DNA, 25 bp, Homo sapien
aaaagcattgctgtggaccattgtt

SEQ ID NO: 411296 - DNA, 25 bp, Homo sapien
tgacaggagttgtagggttacccct

SEQ ID NO: 411297 - DNA, 25 bp, Homo sapien
gttacccctttgacaagcttccata

SEQ ID NO: 411298 - DNA, 25 bp, Homo sapien
tttgacaagcttccatagtcttcag

SEQ ID NO: 411299 - DNA, 25 bp, Homo sapien
tagtcttcagacacgcacattgatg

SEQ ID NO: 411300 - DNA, 25 bp, Homo sapien
acgcacattgatggcatccctacag

SEQ ID NO: 411301 - DNA, 25 bp, Homo sapien
ttcacttgaactttgtaaaactgca

SEQ ID NO: 411302 - DNA, 25 bp, Homo sapien
gtaaaactgcatatggacctgtaat

SEQ ID NO: 411303 - DNA, 25 bp, Homo sapien
atatggacctgtaatcaacttttga

SEQ ID NO: 411304 - DNA, 25 bp, Homo sapien
agtggagcacgctgcaggctcgcct

SEQ ID NO: 411305 - DNA, 25 bp, Homo sapien
gtcgcccgtaggtgcctgcacgcgt

SEQ ID NO: 411306 - DNA, 25 bp, Homo sapien
cggctggcctggacgaacgggaagc

SEQ ID NO: 411307 - DNA, 25 bp, Homo sapien
gcaagaagactgaggagccgccccg

SEQ ID NO: 411308 - DNA, 25 bp, Homo sapien
agaagactgaggagccgccccgcga

SEQ ID NO: 411309 - DNA, 25 bp, Homo sapien
ttcgatccggcgctgctggagttcc

SEQ ID NO: 411310 - DNA, 25 bp, Homo sapien
gagttcctggtgtgcccgctctcca

SEQ ID NO: 411311 - DNA, 25 bp, Homo sapien
gctctccaagaagccgctcagatat

SEQ ID NO: 411312 - DNA, 25 bp, Homo sapien
tgaggcctggtctccggctgccaga

SEQ ID NO: 411313 - DNA, 25 bp, Homo sapien
tctccggctgccagaccatgctgag

SEQ ID NO: 411314 - DNA, 25 bp, Homo sapien
gaccatgctgagtggagcacgctgc

SEQ ID NO: 411315 - DNA, 25 bp, Homo sapien
agatccgggaggactaccgagccct

SEQ ID NO: 411316 - DNA, 25 bp, Homo sapien
agaacgctggcctcctaggccgggt

SEQ ID NO: 411317 - DNA, 25 bp, Homo sapien
aggagccgccggcagaggtctctcc

SEQ ID NO: 411318 - DNA, 25 bp, Homo sapien
caagcacatgccctagctacttcct

SEQ ID NO: 411319 - DNA, 25 bp, Homo sapien
atccagaccatcgaggacacaggca

SEQ ID NO: 411320 - DNA, 25 bp, Homo sapien
gacacaggcaccatcatgcgggagg

SEQ ID NO: 411321 - DNA, 25 bp, Homo sapien
aggcaccatcatgcgggaggttcga

SEQ ID NO: 411322 - DNA, 25 bp, Homo sapien
ccatcatgcgggaggttcgagacct

SEQ ID NO: 411323 - DNA, 25 bp, Homo sapien
tcatgcgggaggttcgagacctcga

SEQ ID NO: 411324 - DNA, 25 bp, Homo sapien
tcgaggagcagatcgagacagagct

SEQ ID NO: 411325 - DNA, 25 bp, Homo sapien
agatcgagacagagctgggcaagaa

SEQ ID NO: 411326 - DNA, 25 bp, Homo sapien
atggctataatatggctataaatct

SEQ ID NO: 411327 - DNA, 25 bp, Homo sapien
aggatcagttgaacccagtggttct

SEQ ID NO: 411328 - DNA, 25 bp, Homo sapien
ggatcagttgaacccagtggttctg

SEQ ID NO: 411329 - DNA, 25 bp, Homo sapien
atcagttgaacccagtggttctggg

SEQ ID NO: 411330 - DNA, 25 bp, Homo sapien
cagttgaacccagtggttctgggtt

SEQ ID NO: 411331 - DNA, 25 bp, Homo sapien
ttgaacccagtggttctgggttgca

SEQ ID NO: 411332 - DNA, 25 bp, Homo sapien
acccagtggttctgggttgcagtga

SEQ ID NO: 411333 - DNA, 25 bp, Homo sapien
taaatctataatatggctggaggca

SEQ ID NO: 411334 - DNA, 25 bp, Homo sapien
aatctataatatggctggaggcagt

SEQ ID NO: 411335 - DNA, 25 bp, Homo sapien
aatatggctggaggcagtgggcagt

SEQ ID NO: 411336 - DNA, 25 bp, Homo sapien
gctggaggcagtgggcagtggttca

SEQ ID NO: 411337 - DNA, 25 bp, Homo sapien
gcatatgggagtttgttctagtttt

SEQ ID NO: 411338 - DNA, 25 bp, Homo sapien
catatgggagtttgttctagtttta

SEQ ID NO: 411339 - DNA, 25 bp, Homo sapien
tttttgttacacaacttcattgttt

SEQ ID NO: 411340 - DNA, 25 bp, Homo sapien
gttacacaacttcattgttttagta

SEQ ID NO: 411341 - DNA, 25 bp, Homo sapien
caacttcattgttttagtaggactg

SEQ ID NO: 411342 - DNA, 25 bp, Homo sapien
acttcattgttttagtaggactgta

SEQ ID NO: 411343 - DNA, 25 bp, Homo sapien
tagtaggactgtattgcattttacc

SEQ ID NO: 411344 - DNA, 25 bp, Homo sapien
aggactgtattgcattttacctgtt

SEQ ID NO: 411345 - DNA, 25 bp, Homo sapien
gactgtattgcattttacctgttaa

SEQ ID NO: 411346 - DNA, 25 bp, Homo sapien
actgtattgcattttacctgttaaa

SEQ ID NO: 411347 - DNA, 25 bp, Homo sapien
tttacctgttaaaaatttggcatct

SEQ ID NO: 411348 - DNA, 25 bp, Homo sapien
tgtttttagccaaagggatttcata

SEQ ID NO: 411349 - DNA, 25 bp, Homo sapien
gccaaagggatttcatactggttta

SEQ ID NO: 411350 - DNA, 25 bp, Homo sapien
attatgttcatccttgagaattttt

SEQ ID NO: 411351 - DNA, 25 bp, Homo sapien
gagaagtttccaacagatttgtagt

SEQ ID NO: 411352 - DNA, 25 bp, Homo sapien
gatttgtagttcattttgctgttgt

SEQ ID NO: 411353 - DNA, 25 bp, Homo sapien
tttgctgttgttacaatgtaaagct

SEQ ID NO: 411354 - DNA, 25 bp, Homo sapien
atgtaaagctatatatagttgaccc

SEQ ID NO: 411355 - DNA, 25 bp, Homo sapien
acaacacaggttggaactgcaagga

SEQ ID NO: 411356 - DNA, 25 bp, Homo sapien
ggaactgcaaggatccacttataca

SEQ ID NO: 411357 - DNA, 25 bp, Homo sapien
ccacccttgagacggcaagaccagg

SEQ ID NO: 411358 - DNA, 25 bp, Homo sapien
cttgagacggcaagaccaggccctc

SEQ ID NO: 411359 - DNA, 25 bp, Homo sapien
aactatcctcccactatcacagaat

SEQ ID NO: 411360 - DNA, 25 bp, Homo sapien
gagcaatgaagccaccacaggacga

SEQ ID NO: 411361 - DNA, 25 bp, Homo sapien
acaggacgacaagcttcactcaaat

SEQ ID NO: 411362 - DNA, 25 bp, Homo sapien
actcaaatgtgaggcctcggcagtg

SEQ ID NO: 411363 - DNA, 25 bp, Homo sapien
tgcctgcacctgactttgagtggta

SEQ ID NO: 411364 - DNA, 25 bp, Homo sapien
gtggtaccgggatgacactaggata

SEQ ID NO: 411365 - DNA, 25 bp, Homo sapien
ttaagagcacggagggccagtcttc

SEQ ID NO: 411366 - DNA, 25 bp, Homo sapien
tgacggtgaccaacgtcactgagga

SEQ ID NO: 411367 - DNA, 25 bp, Homo sapien
gtcactgaggagcactacggcaact

SEQ ID NO: 411368 - DNA, 25 bp, Homo sapien
agcactacggcaactacacctgtgt

SEQ ID NO: 411369 - DNA, 25 bp, Homo sapien
agcctagtccttttcagacctgggt

SEQ ID NO: 411370 - DNA, 25 bp, Homo sapien
tcggcacgaggtgttaccaatttga

SEQ ID NO: 411371 - DNA, 25 bp, Homo sapien
cggcacgaggtgttaccaatttgaa

SEQ ID NO: 411372 - DNA, 25 bp, Homo sapien
ggcacgaggtgttaccaatttgaag

SEQ ID NO: 411373 - DNA, 25 bp, Homo sapien
gcacgaggtgttaccaatttgaagt

SEQ ID NO: 411374 - DNA, 25 bp, Homo sapien
acgaggtgttaccaatttgaagtgg

SEQ ID NO: 411375 - DNA, 25 bp, Homo sapien
ggtgttaccaatttgaagtgggagc

SEQ ID NO: 411376 - DNA, 25 bp, Homo sapien
ccaatttgaagtgggagcagccgct

SEQ ID NO: 411377 - DNA, 25 bp, Homo sapien
aatttgaagtgggagcagccgctca

SEQ ID NO: 411378 - DNA, 25 bp, Homo sapien
atttgaagtgggagcagccgctcat

SEQ ID NO: 411379 - DNA, 25 bp, Homo sapien
tttgaagtgggagcagccgctcatt

SEQ ID NO: 411380 - DNA, 25 bp, Homo sapien
ttgaagtgggagcagccgctcattt

SEQ ID NO: 411381 - DNA, 25 bp, Homo sapien
agagtcacactgacactgtctgaaa

SEQ ID NO: 411382 - DNA, 25 bp, Homo sapien
aaatttatttcacccagctttcaca

SEQ ID NO: 411383 - DNA, 25 bp, Homo sapien
ttatttcacccagctttcacaatta

SEQ ID NO: 411384 - DNA, 25 bp, Homo sapien
ccagctttcacaattaagtctgtat

SEQ ID NO: 411385 - DNA, 25 bp, Homo sapien
agtctgtataaaatgtggtaccttt

SEQ ID NO: 411386 - DNA, 25 bp, Homo sapien
gtaccttttggtacctatccagaga

SEQ ID NO: 411387 - DNA, 25 bp, Homo sapien
ttggtacctatccagagaaacctgt

SEQ ID NO: 411388 - DNA, 25 bp, Homo sapien
aacctgtacatattcaatgttatct

SEQ ID NO: 411389 - DNA, 25 bp, Homo sapien
caatgttatctagatgtgattggat

SEQ ID NO: 411390 - DNA, 25 bp, Homo sapien
atgattttgcaatggcatcaataac

SEQ ID NO: 411391 - DNA, 25 bp, Homo sapien
ttactaccctataaaatgaatcgaa

SEQ ID NO: 411392 - DNA, 25 bp, Homo sapien
gggttagctgcggtcagcgcacttt

SEQ ID NO: 411393 - DNA, 25 bp, Homo sapien
gtcagcgcactttccacttgggact

SEQ ID NO: 411394 - DNA, 25 bp, Homo sapien
ccacttgggactcccggccagaaat

SEQ ID NO: 411395 - DNA, 25 bp, Homo sapien
aatttctcgggaatggagcggtcac

SEQ ID NO: 411396 - DNA, 25 bp, Homo sapien
ttctcgggaatggagcggtcacagt

SEQ ID NO: 411397 - DNA, 25 bp, Homo sapien
tcacagtgtggcagcagagaccgag

SEQ ID NO: 411398 - DNA, 25 bp, Homo sapien
agaccgaggcgttagcggccgacct

SEQ ID NO: 411399 - DNA, 25 bp, Homo sapien
gtcccaactccttccgagtggaaag

SEQ ID NO: 411400 - DNA, 25 bp, Homo sapien
actccttccgagtggaaagagtgta

SEQ ID NO: 411401 - DNA, 25 bp, Homo sapien
taaaacttttgtccgtgcgcgggtg

SEQ ID NO: 411402 - DNA, 25 bp, Homo sapien
gagctcagtaggaccacggcgcgtc

SEQ ID NO: 411403 - DNA, 25 bp, Homo sapien
acatactgccaatttcaccgacagc

SEQ ID NO: 411404 - DNA, 25 bp, Homo sapien
tactgccaatttcaccgacagcttg

SEQ ID NO: 411405 - DNA, 25 bp, Homo sapien
gccaatttcaccgacagcttgagga

SEQ ID NO: 411406 - DNA, 25 bp, Homo sapien
atttcaccgacagcttgaggagttt

SEQ ID NO: 411407 - DNA, 25 bp, Homo sapien
tttcatgaacttgccatcatctggt

SEQ ID NO: 411408 - DNA, 25 bp, Homo sapien
atgaacttgccatcatctggtggtc

SEQ ID NO: 411409 - DNA, 25 bp, Homo sapien
ttgccatcatctggtggtccctagt

SEQ ID NO: 411410 - DNA, 25 bp, Homo sapien
atcatctggtggtccctagtctgaa

SEQ ID NO: 411411 - DNA, 25 bp, Homo sapien
atctggtggtccctagtctgaattc

SEQ ID NO: 411412 - DNA, 25 bp, Homo sapien
ggtggtccctagtctgaattcttga

SEQ ID NO: 411413 - DNA, 25 bp, Homo sapien
ataacctagtatgttcatgtataca

SEQ ID NO: 411414 - DNA, 25 bp, Homo sapien
agctacaagtgaaggcgttctggca

SEQ ID NO: 411415 - DNA, 25 bp, Homo sapien
gtgaaggcgttctggcaaatttctt

SEQ ID NO: 411416 - DNA, 25 bp, Homo sapien
taaaaagactggctctccaggaggc

SEQ ID NO: 411417 - DNA, 25 bp, Homo sapien
tggtgtgagtggtggtagccctgca

SEQ ID NO: 411418 - DNA, 25 bp, Homo sapien
gaagcagtggtttaccaccatccac

SEQ ID NO: 411419 - DNA, 25 bp, Homo sapien
gaagcctgtcttagatgttcatgca

SEQ ID NO: 411420 - DNA, 25 bp, Homo sapien
gcagaactagacagaattacacgaa

SEQ ID NO: 411421 - DNA, 25 bp, Homo sapien
gaattacacgaaaaccagttacagt

SEQ ID NO: 411422 - DNA, 25 bp, Homo sapien
agttacagtttctcccacaacacct

SEQ ID NO: 411423 - DNA, 25 bp, Homo sapien
aacacctacatctcctacggaagga

SEQ ID NO: 411424 - DNA, 25 bp, Homo sapien
tcctacggaaggagaagcttcttga

SEQ ID NO: 411425 - DNA, 25 bp, Homo sapien
agggcagtttatcagtcactaaatt

SEQ ID NO: 411426 - DNA, 25 bp, Homo sapien
taaaccctttgtctcaccaaacctg

SEQ ID NO: 411427 - DNA, 25 bp, Homo sapien
tttgtctcaccaaacctgctgggaa

SEQ ID NO: 411428 - DNA, 25 bp, Homo sapien
gtctcaccaaacctgctgggaatga

SEQ ID NO: 411429 - DNA, 25 bp, Homo sapien
aacctgctgggaatgaatcctacat

SEQ ID NO: 411430 - DNA, 25 bp, Homo sapien
ggaatgaatcctacatatatattta

SEQ ID NO: 411431 - DNA, 25 bp, Homo sapien
atatttatatgtgtgcaggctacat

SEQ ID NO: 411432 - DNA, 25 bp, Homo sapien
tgtgtgcaggctacatggttttcat

SEQ ID NO: 411433 - DNA, 25 bp, Homo sapien
tgtgcaggctacatggttttcatta

SEQ ID NO: 411434 - DNA, 25 bp, Homo sapien
ttggaaagaacctccatgtccacca

SEQ ID NO: 411435 - DNA, 25 bp, Homo sapien
aaagaacctccatgtccaccatggg

SEQ ID NO: 411436 - DNA, 25 bp, Homo sapien
tggacatctgtgtcattgaagtcac

SEQ ID NO: 411437 - DNA, 25 bp, Homo sapien
atctgtgtcattgaagtcacaggag

SEQ ID NO: 411438 - DNA, 25 bp, Homo sapien
gaggaggcttcaagaatcttcgagg

SEQ ID NO: 411439 - DNA, 25 bp, Homo sapien
gccttaggaaaatcggctgtggttt

SEQ ID NO: 411440 - DNA, 25 bp, Homo sapien
aaatcggctgtggtttaataaactg

SEQ ID NO: 411441 - DNA, 25 bp, Homo sapien
ttcccgctgctttgagccggagcct

SEQ ID NO: 411442 - DNA, 25 bp, Homo sapien
ggcacggctgtgagcgcacagtcca

SEQ ID NO: 411443 - DNA, 25 bp, Homo sapien
tgagcgcacagtccagccacagaag

SEQ ID NO: 411444 - DNA, 25 bp, Homo sapien
gcgcacagtccagccacagaaggag

SEQ ID NO: 411445 - DNA, 25 bp, Homo sapien
cagtccagccacagaaggaggcttc

SEQ ID NO: 411446 - DNA, 25 bp, Homo sapien
gaaggaggcttcaagaatctttgcg

SEQ ID NO: 411447 - DNA, 25 bp, Homo sapien
catctgctggcagggtctgatcagg

SEQ ID NO: 411448 - DNA, 25 bp, Homo sapien
gggtctgatcaggtctagagtattt

SEQ ID NO: 411449 - DNA, 25 bp, Homo sapien
tcctgtcttctatctccactagaag

SEQ ID NO: 411450 - DNA, 25 bp, Homo sapien
atctccactagaagtactgcagctt

SEQ ID NO: 411451 - DNA, 25 bp, Homo sapien
aatgttatccagtcttcacttagcc

SEQ ID NO: 411452 - DNA, 25 bp, Homo sapien
agtcttcacttagcccatttttatc

SEQ ID NO: 411453 - DNA, 25 bp, Homo sapien
gcccatttttatcggcattaggaaa

SEQ ID NO: 411454 - DNA, 25 bp, Homo sapien
ggaaatagggttcagcaatggttat

SEQ ID NO: 411455 - DNA, 25 bp, Homo sapien
gttattgatttagcagtctggtctt

SEQ ID NO: 411456 - DNA, 25 bp, Homo sapien
gtctggtcttatatgatctgctttc

SEQ ID NO: 411457 - DNA, 25 bp, Homo sapien
aacttctgggttatcatctgctggc

SEQ ID NO: 411458 - DNA, 25 bp, Homo sapien
gaaattctatatacgttgtgtctgt

SEQ ID NO: 411459 - DNA, 25 bp, Homo sapien
atatacgttgtgtctgttacaaatg

SEQ ID NO: 411460 - DNA, 25 bp, Homo sapien
gtcgtagaagaaatcatgcagctaa

SEQ ID NO: 411461 - DNA, 25 bp, Homo sapien
taaacgatgaagaagcccaactgga

SEQ ID NO: 411462 - DNA, 25 bp, Homo sapien
agcccaactggagtgttgctttgaa

SEQ ID NO: 411463 - DNA, 25 bp, Homo sapien
gccttcttatattttcatagcaaat

SEQ ID NO: 411464 - DNA, 25 bp, Homo sapien
agcaaatgggtggtatcaaaatcag

SEQ ID NO: 411465 - DNA, 25 bp, Homo sapien
tcaaaatcagacattgcttcttgct

SEQ ID NO: 411466 - DNA, 25 bp, Homo sapien
ataagtgaaactacatctatgggaa

SEQ ID NO: 411467 - DNA, 25 bp, Homo sapien
gagaagtgcaaatgttcgcatcctt

SEQ ID NO: 411468 - DNA, 25 bp, Homo sapien
gcaaatgttcgcatccttttgtttt

SEQ ID NO: 411469 - DNA, 25 bp, Homo sapien
tgtgagaaagagctctaagatagtt

SEQ ID NO: 411470 - DNA, 25 bp, Homo sapien
gaaagagctctaagatagttaagta

SEQ ID NO: 411471 - DNA, 25 bp, Homo sapien
agagctctaagatagttaagtagat

SEQ ID NO: 411472 - DNA, 25 bp, Homo sapien
ataaaagcaaggtgtcaaactgtag

SEQ ID NO: 411473 - DNA, 25 bp, Homo sapien
aaagcaaggtgtcaaactgtagagt

SEQ ID NO: 411474 - DNA, 25 bp, Homo sapien
agcaaggtgtcaaactgtagagtat

SEQ ID NO: 411475 - DNA, 25 bp, Homo sapien
caaggtgtcaaactgtagagtatgt

SEQ ID NO: 411476 - DNA, 25 bp, Homo sapien
ggtgtcaaactgtagagtatgtttc

SEQ ID NO: 411477 - DNA, 25 bp, Homo sapien
gtcaaactgtagagtatgtttccat

SEQ ID NO: 411478 - DNA, 25 bp, Homo sapien
caaactgtagagtatgtttccattt

SEQ ID NO: 411479 - DNA, 25 bp, Homo sapien
aaactgtagagtatgtttccattta

SEQ ID NO: 411480 - DNA, 25 bp, Homo sapien
gaatcattgaccactttttgcttga

SEQ ID NO: 411481 - DNA, 25 bp, Homo sapien
tgcttgaagttctcagctcatgctg

SEQ ID NO: 411482 - DNA, 25 bp, Homo sapien
agctcatgctgctttctgttgagtg

SEQ ID NO: 411483 - DNA, 25 bp, Homo sapien
tgttgagtgcttctcatgctacctc

SEQ ID NO: 411484 - DNA, 25 bp, Homo sapien
atgctacctcagtggtacttgttaa

SEQ ID NO: 411485 - DNA, 25 bp, Homo sapien
tttccctccatttagtcgcacaaag

SEQ ID NO: 411486 - DNA, 25 bp, Homo sapien
tatactcgtctctgcctatttaaca

SEQ ID NO: 411487 - DNA, 25 bp, Homo sapien
taacagatcctacctatgctctaag

SEQ ID NO: 411488 - DNA, 25 bp, Homo sapien
acctatgctctaaggcctggttcat

SEQ ID NO: 411489 - DNA, 25 bp, Homo sapien
ataggccatcttccctttaaatctt

SEQ ID NO: 411490 - DNA, 25 bp, Homo sapien
gcacttttaggatgactgttgcctt

SEQ ID NO: 411491 - DNA, 25 bp, Homo sapien
aatggctggagcaactgtcatataa

SEQ ID NO: 411492 - DNA, 25 bp, Homo sapien
gagcaactgtcatataagctgttat

SEQ ID NO: 411493 - DNA, 25 bp, Homo sapien
gtgcagaaactacacagacatttgt

SEQ ID NO: 411494 - DNA, 25 bp, Homo sapien
acagacatttgtgcgggttcagacc

SEQ ID NO: 411495 - DNA, 25 bp, Homo sapien
gggttcagaccagcgcaattagaga

SEQ ID NO: 411496 - DNA, 25 bp, Homo sapien
cagcgcaattagagatgggcagagt

SEQ ID NO: 411497 - DNA, 25 bp, Homo sapien
taaggtgcttgaaatttgcctgggt

SEQ ID NO: 411498 - DNA, 25 bp, Homo sapien
cttgaaatttgcctgggtgggaatt

SEQ ID NO: 411499 - DNA, 25 bp, Homo sapien
gatagaattattcaacttagcattt

SEQ ID NO: 411500 - DNA, 25 bp, Homo sapien
acatctaccagatgatagacattag

SEQ ID NO: 411501 - DNA, 25 bp, Homo sapien
taaaatgactagcaagacctggccc

SEQ ID NO: 411502 - DNA, 25 bp, Homo sapien
cagccctttggacgatgaagtttac

SEQ ID NO: 411503 - DNA, 25 bp, Homo sapien
gccctttggacgatgaagtttacct

SEQ ID NO: 411504 - DNA, 25 bp, Homo sapien
tttggacgatgaagtttacctgcat

SEQ ID NO: 411505 - DNA, 25 bp, Homo sapien
ggacgatgaagtttacctgcatatt

SEQ ID NO: 411506 - DNA, 25 bp, Homo sapien
tgaagtttacctgcatattaggatt

SEQ ID NO: 411507 - DNA, 25 bp, Homo sapien
ggcctcaccaagtgattcttttcta

SEQ ID NO: 411508 - DNA, 25 bp, Homo sapien
tcaccaagtgattcttttctattgc

SEQ ID NO: 411509 - DNA, 25 bp, Homo sapien
caagtgattcttttctattgcagag

SEQ ID NO: 411510 - DNA, 25 bp, Homo sapien
tgcagagagcactttactcacctac

SEQ ID NO: 411511 - DNA, 25 bp, Homo sapien
agagagcactttactcacctacctg

SEQ ID NO: 411512 - DNA, 25 bp, Homo sapien
gagcactttactcacctacctgtta

SEQ ID NO: 411513 - DNA, 25 bp, Homo sapien
gatattcatacacactcttacaact

SEQ ID NO: 411514 - DNA, 25 bp, Homo sapien
acaacttgttacatctccagagctc

SEQ ID NO: 411515 - DNA, 25 bp, Homo sapien
cagagctcagactggctggctttac

SEQ ID NO: 411516 - DNA, 25 bp, Homo sapien
ccagcatgtcttcacattggcagaa

SEQ ID NO: 411517 - DNA, 25 bp, Homo sapien
ctggctggctttacaaatagctggc

SEQ ID NO: 411518 - DNA, 25 bp, Homo sapien
aatagctggctttacaatttgcaca

SEQ ID NO: 411519 - DNA, 25 bp, Homo sapien
tgcacagggataattgaagttcatt

SEQ ID NO: 411520 - DNA, 25 bp, Homo sapien
gaagttcatttcttctagaatcatt

SEQ ID NO: 411521 - DNA, 25 bp, Homo sapien
agattcaatattctgtgctttggtg

SEQ ID NO: 411522 - DNA, 25 bp, Homo sapien
ggaccgaaggtcatatatcactgtg

SEQ ID NO: 411523 - DNA, 25 bp, Homo sapien
gatgctcagaaggtttgatattcat

SEQ ID NO: 411524 - DNA, 25 bp, Homo sapien
ggtatgttcaagtcataagtaggta

SEQ ID NO: 411525 - DNA, 25 bp, Homo sapien
gaaccattatgattcaagttagatt

SEQ ID NO: 411526 - DNA, 25 bp, Homo sapien
aagttagattttcctctggagagac

SEQ ID NO: 411527 - DNA, 25 bp, Homo sapien
ctggagagacagatctgaatgttca

SEQ ID NO: 411528 - DNA, 25 bp, Homo sapien
gaatgttcagttctagccaaggtag

SEQ ID NO: 411529 - DNA, 25 bp, Homo sapien
tcagttctagccaaggtagatttta

SEQ ID NO: 411530 - DNA, 25 bp, Homo sapien
atcagtatcactttctgtgcttaac

SEQ ID NO: 411531 - DNA, 25 bp, Homo sapien
tctgtgcttaactatttggtgttac

SEQ ID NO: 411532 - DNA, 25 bp, Homo sapien
ttcatttgtctaaaattctgcagag

SEQ ID NO: 411533 - DNA, 25 bp, Homo sapien
gattgttaaggtaactttcagttga

SEQ ID NO: 411534 - DNA, 25 bp, Homo sapien
gttgaagattaaagcaagatgccat

SEQ ID NO: 411535 - DNA, 25 bp, Homo sapien
tcccggcctttgaacattttgccta

SEQ ID NO: 411536 - DNA, 25 bp, Homo sapien
aacattttgcctatgagagttttgc

SEQ ID NO: 411537 - DNA, 25 bp, Homo sapien
taatccatatttatactatcgcaga

SEQ ID NO: 411538 - DNA, 25 bp, Homo sapien
ctatcgcagaagtaagcatttggca

SEQ ID NO: 411539 - DNA, 25 bp, Homo sapien
agcatttggcaaacgttcagccatt

SEQ ID NO: 411540 - DNA, 25 bp, Homo sapien
cgttcagccattagcactcatttaa

SEQ ID NO: 411541 - DNA, 25 bp, Homo sapien
ttagcactcatttaaccctgttagc

SEQ ID NO: 411542 - DNA, 25 bp, Homo sapien
taaccctgttagcaatattcttttg

SEQ ID NO: 411543 - DNA, 25 bp, Homo sapien
agtgccagtccttatgtgataaact

SEQ ID NO: 411544 - DNA, 25 bp, Homo sapien
gaagcccattgaatataaaagtgta

SEQ ID NO: 411545 - DNA, 25 bp, Homo sapien
ggactgaaacagtgaccttatatta

SEQ ID NO: 411546 - DNA, 25 bp, Homo sapien
ggcaggatgacctaagaggcagttt

SEQ ID NO: 411547 - DNA, 25 bp, Homo sapien
ctaagaggcagtttacttccctgag

SEQ ID NO: 411548 - DNA, 25 bp, Homo sapien
tgggctgttctggaaacacatctgt

SEQ ID NO: 411549 - DNA, 25 bp, Homo sapien
tctgtgaatcatagccaattgccac

SEQ ID NO: 411550 - DNA, 25 bp, Homo sapien
aaacagaaccaagcctccggtgagg

SEQ ID NO: 411551 - DNA, 25 bp, Homo sapien
gtctgcagaattccaaggactcgga

SEQ ID NO: 411552 - DNA, 25 bp, Homo sapien
aaggactcggattggatgttcagaa

SEQ ID NO: 411553 - DNA, 25 bp, Homo sapien
gattggatgttcagaattcagcaac

SEQ ID NO: 411554 - DNA, 25 bp, Homo sapien
ggccaaaccaaatcaatattgctgt

SEQ ID NO: 411555 - DNA, 25 bp, Homo sapien
tattgctgtttctagatgtcccttc

SEQ ID NO: 411556 - DNA, 25 bp, Homo sapien
tcccttctgtggttgagctagtttt

SEQ ID NO: 411557 - DNA, 25 bp, Homo sapien
cacagctgggcagggtgagaagcta

SEQ ID NO: 411558 - DNA, 25 bp, Homo sapien
gtgagaagctagatgcccctgcagt

SEQ ID NO: 411559 - DNA, 25 bp, Homo sapien
agctagatgcccctgcagtttggcc

SEQ ID NO: 411560 - DNA, 25 bp, Homo sapien
tagatgcccctgcagtttggccctg

SEQ ID NO: 411561 - DNA, 25 bp, Homo sapien
cagaggaatgtagggcctgcatgga

SEQ ID NO: 411562 - DNA, 25 bp, Homo sapien
aagggttctgccctgcctgaggagg

SEQ ID NO: 411563 - DNA, 25 bp, Homo sapien
aggaggaggacacagcacaagggca

SEQ ID NO: 411564 - DNA, 25 bp, Homo sapien
gcacaagggcacattgcccatggct

SEQ ID NO: 411565 - DNA, 25 bp, Homo sapien
ggcacattgcccatggctgggaaca

SEQ ID NO: 411566 - DNA, 25 bp, Homo sapien
ttgcccatggctgggaacatgaccc

SEQ ID NO: 411567 - DNA, 25 bp, Homo sapien
gggaacatgacccagcctgaaagat

SEQ ID NO: 411568 - DNA, 25 bp, Homo sapien
tcattacaatcacagaattccagag

SEQ ID NO: 411569 - DNA, 25 bp, Homo sapien
acagaattccagagctagaaatgat

SEQ ID NO: 411570 - DNA, 25 bp, Homo sapien
taatgttaccttttatcctacttca

SEQ ID NO: 411571 - DNA, 25 bp, Homo sapien
taccttttatcctacttcaaacctg

SEQ ID NO: 411572 - DNA, 25 bp, Homo sapien
aaaatttgcataaagaagcatcttt

SEQ ID NO: 411573 - DNA, 25 bp, Homo sapien
aagaagcatctttaattcgtatgta

SEQ ID NO: 411574 - DNA, 25 bp, Homo sapien
agaagcatctttaattcgtatgtaa

SEQ ID NO: 411575 - DNA, 25 bp, Homo sapien
gaagcatctttaattcgtatgtaaa

SEQ ID NO: 411576 - DNA, 25 bp, Homo sapien
aagcatctttaattcgtatgtaaaa

SEQ ID NO: 411577 - DNA, 25 bp, Homo sapien
agcatctttaattcgtatgtaaaaa

SEQ ID NO: 411578 - DNA, 25 bp, Homo sapien
gcatctttaattcgtatgtaaaaaa

SEQ ID NO: 411579 - DNA, 25 bp, Homo sapien
tatagtccaatgagattaaggccag

SEQ ID NO: 411580 - DNA, 25 bp, Homo sapien
cacattggtgtgaaacagatcttca

SEQ ID NO: 411581 - DNA, 25 bp, Homo sapien
ttggtgtgaaacagatcttcagaag

SEQ ID NO: 411582 - DNA, 25 bp, Homo sapien
catctggcaaatctgggactctata

SEQ ID NO: 411583 - DNA, 25 bp, Homo sapien
tctggcaaatctgggactctatacc

SEQ ID NO: 411584 - DNA, 25 bp, Homo sapien
ggcaaatctgggactctatacccat

SEQ ID NO: 411585 - DNA, 25 bp, Homo sapien
caaatctgggactctatacccatta

SEQ ID NO: 411586 - DNA, 25 bp, Homo sapien
catccatattgtagaatgtgatagg

SEQ ID NO: 411587 - DNA, 25 bp, Homo sapien
atgtgataggatttcctgccatttt

SEQ ID NO: 411588 - DNA, 25 bp, Homo sapien
gataggatttcctgccattttaagg

SEQ ID NO: 411589 - DNA, 25 bp, Homo sapien
ataggatttcctgccattttaaggc

SEQ ID NO: 411590 - DNA, 25 bp, Homo sapien
aactggtaactgtgctagaagtcta

SEQ ID NO: 411591 - DNA, 25 bp, Homo sapien
gctagaagtctattaatgatgtaac

SEQ ID NO: 411592 - DNA, 25 bp, Homo sapien
ttttgccattttgatgcaggagggt

SEQ ID NO: 411593 - DNA, 25 bp, Homo sapien
gatgcaggagggtaacaagacttat

SEQ ID NO: 411594 - DNA, 25 bp, Homo sapien
agacttatggttcgtcttgtgcctt

SEQ ID NO: 411595 - DNA, 25 bp, Homo sapien
atggttcgtcttgtgcctttgtagc

SEQ ID NO: 411596 - DNA, 25 bp, Homo sapien
gtcttgtgcctttgtagcctttgaa

SEQ ID NO: 411597 - DNA, 25 bp, Homo sapien
tgtgcctttgtagcctttgaatttc

SEQ ID NO: 411598 - DNA, 25 bp, Homo sapien
gtcagtgctcgtttttcggtggaca

SEQ ID NO: 411599 - DNA, 25 bp, Homo sapien
ctcgtttttcggtggacagtcagta

SEQ ID NO: 411600 - DNA, 25 bp, Homo sapien
ggacagtcagtagataacaagcata

SEQ ID NO: 411601 - DNA, 25 bp, Homo sapien
gagagaccctctgatgcatgagcca

SEQ ID NO: 411602 - DNA, 25 bp, Homo sapien
cctgcatccaggtgtgtttccaccg

SEQ ID NO: 411603 - DNA, 25 bp, Homo sapien
aaatgcctccacacaatgagcgact

SEQ ID NO: 411604 - DNA, 25 bp, Homo sapien
acaatgagcgactttggccctgcgt

SEQ ID NO: 411605 - DNA, 25 bp, Homo sapien
tttggccctgcgtgggtcagcatgt

SEQ ID NO: 411606 - DNA, 25 bp, Homo sapien
gcatgtggtctgaggtaaccctcaa

SEQ ID NO: 411607 - DNA, 25 bp, Homo sapien
tgaggtaaccctcaaatgcctccac

SEQ ID NO: 411608 - DNA, 25 bp, Homo sapien
atctgtccacctgcacgggttcaag

SEQ ID NO: 411609 - DNA, 25 bp, Homo sapien
acgggttcaaggtgagcacttgccc

SEQ ID NO: 411610 - DNA, 25 bp, Homo sapien
ctggccacctgaccagagaccagga

SEQ ID NO: 411611 - DNA, 25 bp, Homo sapien
gagagaggccacagctccagaccct

SEQ ID NO: 411612 - DNA, 25 bp, Homo sapien
gaggtgtatactgatgattcttccc

SEQ ID NO: 411613 - DNA, 25 bp, Homo sapien
aggtgtatactgatgattcttccca

SEQ ID NO: 411614 - DNA, 25 bp, Homo sapien
tgtatactgatgattcttcccactc

SEQ ID NO: 411615 - DNA, 25 bp, Homo sapien
gtatactgatgattcttcccactca

SEQ ID NO: 411616 - DNA, 25 bp, Homo sapien
tatactgatgattcttcccactcat

SEQ ID NO: 411617 - DNA, 25 bp, Homo sapien
ctgatgattcttcccactcatttgt

SEQ ID NO: 411618 - DNA, 25 bp, Homo sapien
gattcttcccactcatttgtttgtc

SEQ ID NO: 411619 - DNA, 25 bp, Homo sapien
tcccactcatttgtttgtccagaag

SEQ ID NO: 411620 - DNA, 25 bp, Homo sapien
gtttgtccagaagtaaataaatgtc

SEQ ID NO: 411621 - DNA, 25 bp, Homo sapien
cagaagtaaataaatgtcggaagtt

SEQ ID NO: 411622 - DNA, 25 bp, Homo sapien
tgtcggaagttttccaagtaactat

SEQ ID NO: 411623 - DNA, 25 bp, Homo sapien
gaaaacttcctttatcatctagcag

SEQ ID NO: 411624 - DNA, 25 bp, Homo sapien
tgatgactgatagaaagccctcttt

SEQ ID NO: 411625 - DNA, 25 bp, Homo sapien
tctgattacccactcactacatgaa

SEQ ID NO: 411626 - DNA, 25 bp, Homo sapien
cccactcactacatgaagtcctgaa

SEQ ID NO: 411627 - DNA, 25 bp, Homo sapien
agagaaactgttatatctttttaat

SEQ ID NO: 411628 - DNA, 25 bp, Homo sapien
gcaagtattgagatttgacctgaaa

SEQ ID NO: 411629 - DNA, 25 bp, Homo sapien
ttccgattttctcctcgctgattag

SEQ ID NO: 411630 - DNA, 25 bp, Homo sapien
tcgctgattagcttcctgcctgctg

SEQ ID NO: 411631 - DNA, 25 bp, Homo sapien
cctgctgtcagtgctggacgaagtg

SEQ ID NO: 411632 - DNA, 25 bp, Homo sapien
gtgctggacgaagtgctataactac

SEQ ID NO: 411633 - DNA, 25 bp, Homo sapien
gacgaagtgctataactactttatg

SEQ ID NO: 411634 - DNA, 25 bp, Homo sapien
aaaaggaaacggaactgcaggagag

SEQ ID NO: 411635 - DNA, 25 bp, Homo sapien
aaccaaacatgcaagtatatctaag

SEQ ID NO: 411636 - DNA, 25 bp, Homo sapien
ccaaacatgcaagtatatctaagac

SEQ ID NO: 411637 - DNA, 25 bp, Homo sapien
aaatacattctggtgttaattcaag

SEQ ID NO: 411638 - DNA, 25 bp, Homo sapien
atacattctggtgttaattcaagga

SEQ ID NO: 411639 - DNA, 25 bp, Homo sapien
tacattctggtgttaattcaaggaa

SEQ ID NO: 411640 - DNA, 25 bp, Homo sapien
cattctggtgttaattcaaggaaaa

SEQ ID NO: 411641 - DNA, 25 bp, Homo sapien
agtaatccataggaagtattcagtt

SEQ ID NO: 411642 - DNA, 25 bp, Homo sapien
aatccataggaagtattcagttata

SEQ ID NO: 411643 - DNA, 25 bp, Homo sapien
ccataggaagtattcagttataaga

SEQ ID NO: 411644 - DNA, 25 bp, Homo sapien
ataagaaaaattctgggccaggtgt

SEQ ID NO: 411645 - DNA, 25 bp, Homo sapien
ttggagtgtttctttgattgattta

SEQ ID NO: 411646 - DNA, 25 bp, Homo sapien
tggagtgtttctttgattgatttaa

SEQ ID NO: 411647 - DNA, 25 bp, Homo sapien
ggagtgtttctttgattgatttaac

SEQ ID NO: 411648 - DNA, 25 bp, Homo sapien
gagtgtttctttgattgatttaaca

SEQ ID NO: 411649 - DNA, 25 bp, Homo sapien
agtgtttctttgattgatttaacaa

SEQ ID NO: 411650 - DNA, 25 bp, Homo sapien
gtgtttctttgattgatttaacaat

SEQ ID NO: 411651 - DNA, 25 bp, Homo sapien
tgtttctttgattgatttaacaatg

SEQ ID NO: 411652 - DNA, 25 bp, Homo sapien
gtttctttgattgatttaacaatgt

SEQ ID NO: 411653 - DNA, 25 bp, Homo sapien
ttctttgattgatttaacaatgtat

SEQ ID NO: 411654 - DNA, 25 bp, Homo sapien
caatgtattttttttggctgggcat

SEQ ID NO: 411655 - DNA, 25 bp, Homo sapien
aatgtattttttttggctgggcatg

SEQ ID NO: 411656 - DNA, 25 bp, Homo sapien
cagtagctcaatgcaaccgacgttt

SEQ ID NO: 411657 - DNA, 25 bp, Homo sapien
agctcaatgcaaccgacgtttctga

SEQ ID NO: 411658 - DNA, 25 bp, Homo sapien
caatgcaaccgacgtttctgagccc

SEQ ID NO: 411659 - DNA, 25 bp, Homo sapien
gaatctgatccagatcccggacata

SEQ ID NO: 411660 - DNA, 25 bp, Homo sapien
agatcccggacatataaaccacgcc

SEQ ID NO: 411661 - DNA, 25 bp, Homo sapien
tcccggacatataaaccacgccaag

SEQ ID NO: 411662 - DNA, 25 bp, Homo sapien
tataaaccacgccaagaagacaggg

SEQ ID NO: 411663 - DNA, 25 bp, Homo sapien
gggctgtctctagcacattctctcg

SEQ ID NO: 411664 - DNA, 25 bp, Homo sapien
tctctagcacattctctcgagggag

SEQ ID NO: 411665 - DNA, 25 bp, Homo sapien
gcacattctctcgagggagtccggg

SEQ ID NO: 411666 - DNA, 25 bp, Homo sapien
cttcccagacgcaactgcaaaagga

SEQ ID NO: 411667 - DNA, 25 bp, Homo sapien
aactaataataatccaccactcttt

SEQ ID NO: 411668 - DNA, 25 bp, Homo sapien
actaataataatccaccactctttg

SEQ ID NO: 411669 - DNA, 25 bp, Homo sapien
aataataatccaccactctttgctg

SEQ ID NO: 411670 - DNA, 25 bp, Homo sapien
ataataatccaccactctttgctga

SEQ ID NO: 411671 - DNA, 25 bp, Homo sapien
taataatccaccactctttgctgac

SEQ ID NO: 411672 - DNA, 25 bp, Homo sapien
aataatccaccactctttgctgact

SEQ ID NO: 411673 - DNA, 25 bp, Homo sapien
caccactctttgctgactctctgtt

SEQ ID NO: 411674 - DNA, 25 bp, Homo sapien
accactctttgctgactctctgttt

SEQ ID NO: 411675 - DNA, 25 bp, Homo sapien
ccactctttgctgactctctgtttg

SEQ ID NO: 411676 - DNA, 25 bp, Homo sapien
cactctttgctgactctctgtttgg

SEQ ID NO: 411677 - DNA, 25 bp, Homo sapien
actctttgctgactctctgtttgga

SEQ ID NO: 411678 - DNA, 25 bp, Homo sapien
aaatctctgatgtatgggctctttt

SEQ ID NO: 411679 - DNA, 25 bp, Homo sapien
gggatccgcttttaaacagtgtaca

SEQ ID NO: 411680 - DNA, 25 bp, Homo sapien
aaacagtgtacatattggaccacac

SEQ ID NO: 411681 - DNA, 25 bp, Homo sapien
tggaccacactgaaatgtcatatat

SEQ ID NO: 411682 - DNA, 25 bp, Homo sapien
atgtcatatatcctttctctactta

SEQ ID NO: 411683 - DNA, 25 bp, Homo sapien
atatcctttctctacttaaaattgg

SEQ ID NO: 411684 - DNA, 25 bp, Homo sapien
aaattggttatttactgtgagttca

SEQ ID NO: 411685 - DNA, 25 bp, Homo sapien
tgtgagttcatttccgatgtgttct

SEQ ID NO: 411686 - DNA, 25 bp, Homo sapien
gctgttttctgcctgaagacgtgta

SEQ ID NO: 411687 - DNA, 25 bp, Homo sapien
gaagacgtgtatcataaagagctac

SEQ ID NO: 411688 - DNA, 25 bp, Homo sapien
gagctacatggtatggactatttat

SEQ ID NO: 411689 - DNA, 25 bp, Homo sapien
gactccgaaggaaggcagatgcctt

SEQ ID NO: 411690 - DNA, 25 bp, Homo sapien
gcagatgccttgagcatggacaact

SEQ ID NO: 411691 - DNA, 25 bp, Homo sapien
attagagcggcttaccagtctttat

SEQ ID NO: 411692 - DNA, 25 bp, Homo sapien
gcggcttaccagtctttataaagga

SEQ ID NO: 411693 - DNA, 25 bp, Homo sapien
ttataccttttagcgtactctttat

SEQ ID NO: 411694 - DNA, 25 bp, Homo sapien
ttctgtaagtaagtttggtttcatc

SEQ ID NO: 411695 - DNA, 25 bp, Homo sapien
gtaagtttggtttcatcatgaggga

SEQ ID NO: 411696 - DNA, 25 bp, Homo sapien
aaactgaatagttggttcctgaaat

SEQ ID NO: 411697 - DNA, 25 bp, Homo sapien
tggttcctgaaatcttggactgttt

SEQ ID NO: 411698 - DNA, 25 bp, Homo sapien
tggactgtttatgacctactggctc

SEQ ID NO: 411699 - DNA, 25 bp, Homo sapien
atattttagttaacgcttctacaag

SEQ ID NO: 411700 - DNA, 25 bp, Homo sapien
tggtgggcagagacccagaccagcc

SEQ ID NO: 411701 - DNA, 25 bp, Homo sapien
cagagacccagaccagccttgctga

SEQ ID NO: 411702 - DNA, 25 bp, Homo sapien
agttgctctggacataaatgttgga

SEQ ID NO: 411703 - DNA, 25 bp, Homo sapien
gacataaatgttggaactcctaccc

SEQ ID NO: 411704 - DNA, 25 bp, Homo sapien
ctgcaaaaggaagggctaacgccat

SEQ ID NO: 411705 - DNA, 25 bp, Homo sapien
aaaaggaagggctaacgccatggcg

SEQ ID NO: 411706 - DNA, 25 bp, Homo sapien
ataaatccgcactgagggagatgtc

SEQ ID NO: 411707 - DNA, 25 bp, Homo sapien
aatccgcactgagggagatgtcttt

SEQ ID NO: 411708 - DNA, 25 bp, Homo sapien
ccgcactgagggagatgtctttgaa

SEQ ID NO: 411709 - DNA, 25 bp, Homo sapien
cactgagggagatgtctttgaacac

SEQ ID NO: 411710 - DNA, 25 bp, Homo sapien
ctgagggagatgtctttgaacacct

SEQ ID NO: 411711 - DNA, 25 bp, Homo sapien
tttcagttttgcagcacagaacact

SEQ ID NO: 411712 - DNA, 25 bp, Homo sapien
aacctaattcaggtgtcctttgcat

SEQ ID NO: 411713 - DNA, 25 bp, Homo sapien
ggtgtcctttgcatctcttaaatgt

SEQ ID NO: 411714 - DNA, 25 bp, Homo sapien
gggtcagagccagttatccggcttc

SEQ ID NO: 411715 - DNA, 25 bp, Homo sapien
agttatccggcttctgttttgtcga

SEQ ID NO: 411716 - DNA, 25 bp, Homo sapien
cggcttctgttttgtcgattgctta

SEQ ID NO: 411717 - DNA, 25 bp, Homo sapien
gtcgattgcttagatttgttcctgt

SEQ ID NO: 411718 - DNA, 25 bp, Homo sapien
gcttagatttgttcctgttgtcaaa

SEQ ID NO: 411719 - DNA, 25 bp, Homo sapien
ttggtgtgacacatgctcatgcata

SEQ ID NO: 411720 - DNA, 25 bp, Homo sapien
gagtacatccttgtatttgtatttg

SEQ ID NO: 411721 - DNA, 25 bp, Homo sapien
cgccaaggtgctatgggaaattaac

SEQ ID NO: 411722 - DNA, 25 bp, Homo sapien
gggttcccttcacaaacaggtgagg

SEQ ID NO: 411723 - DNA, 25 bp, Homo sapien
ggttcccttcacaaacaggtgaggc

SEQ ID NO: 411724 - DNA, 25 bp, Homo sapien
gttcccttcacaaacaggtgaggca

SEQ ID NO: 411725 - DNA, 25 bp, Homo sapien
ttcccttcacaaacaggtgaggcag

SEQ ID NO: 411726 - DNA, 25 bp, Homo sapien
tcccttcacaaacaggtgaggcagc

SEQ ID NO: 411727 - DNA, 25 bp, Homo sapien
cccttcacaaacaggtgaggcagct

SEQ ID NO: 411728 - DNA, 25 bp, Homo sapien
ccttcacaaacaggtgaggcagctt

SEQ ID NO: 411729 - DNA, 25 bp, Homo sapien
cttcacaaacaggtgaggcagcttt

SEQ ID NO: 411730 - DNA, 25 bp, Homo sapien
ttcacaaacaggtgaggcagctttt

SEQ ID NO: 411731 - DNA, 25 bp, Homo sapien
cacaaacaggtgaggcagctttttc

SEQ ID NO: 411732 - DNA, 25 bp, Homo sapien
acaaacaggtgaggcagctttttca

SEQ ID NO: 411733 - DNA, 25 bp, Homo sapien
tgcttggcccaaagagaccctcttg

SEQ ID NO: 411734 - DNA, 25 bp, Homo sapien
tggcccaaagagaccctcttggaaa

SEQ ID NO: 411735 - DNA, 25 bp, Homo sapien
agaccctcttggaaagtgagacgca

SEQ ID NO: 411736 - DNA, 25 bp, Homo sapien
agtgagacgcagagagcgccttcca

SEQ ID NO: 411737 - DNA, 25 bp, Homo sapien
gagagcgccttccagtgatctcatt

SEQ ID NO: 411738 - DNA, 25 bp, Homo sapien
agcgccttccagtgatctcattgac

SEQ ID NO: 411739 - DNA, 25 bp, Homo sapien
gccttccagtgatctcattgactga

SEQ ID NO: 411740 - DNA, 25 bp, Homo sapien
cttccagtgatctcattgactgatt

SEQ ID NO: 411741 - DNA, 25 bp, Homo sapien
tcattgactgatttagagacggcat

SEQ ID NO: 411742 - DNA, 25 bp, Homo sapien
ttgactgatttagagacggcatctc

SEQ ID NO: 411743 - DNA, 25 bp, Homo sapien
gtcaccccggcagtggtgccgtcgt

SEQ ID NO: 411744 - DNA, 25 bp, Homo sapien
gggtgtattctcatcccagattttt

SEQ ID NO: 411745 - DNA, 25 bp, Homo sapien
atcccagatttttctcatttagatc

SEQ ID NO: 411746 - DNA, 25 bp, Homo sapien
gaaagggctagaattgcaatcttgt

SEQ ID NO: 411747 - DNA, 25 bp, Homo sapien
gaattgcaatcttgtgtaacttaaa

SEQ ID NO: 411748 - DNA, 25 bp, Homo sapien
ttatttcctaggttcgttccaccag

SEQ ID NO: 411749 - DNA, 25 bp, Homo sapien
ttcgttccaccagtcataaaccaga

SEQ ID NO: 411750 - DNA, 25 bp, Homo sapien
ggtgtcaaaggaaatccccaaggct

SEQ ID NO: 411751 - DNA, 25 bp, Homo sapien
cccaaggcttcaaccagggtctgga

SEQ ID NO: 411752 - DNA, 25 bp, Homo sapien
accagggtctggattgtgatgtgat

SEQ ID NO: 411753 - DNA, 25 bp, Homo sapien
atcgtagctgaggtatgtgcttccc

SEQ ID NO: 411754 - DNA, 25 bp, Homo sapien
aggtatgtgcttcccaggcctccaa

SEQ ID NO: 411755 - DNA, 25 bp, Homo sapien
aaccaaacatgcaagtatatctaag

SEQ ID NO: 411756 - DNA, 25 bp, Homo sapien
ccaaacatgcaagtatatctaagac

SEQ ID NO: 411757 - DNA, 25 bp, Homo sapien
aaatacattctggtgttaattcaag

SEQ ID NO: 411758 - DNA, 25 bp, Homo sapien
atacattctggtgttaattcaagga

SEQ ID NO: 411759 - DNA, 25 bp, Homo sapien
tacattctggtgttaattcaaggaa

SEQ ID NO: 411760 - DNA, 25 bp, Homo sapien
cattctggtgttaattcaaggaaaa

SEQ ID NO: 411761 - DNA, 25 bp, Homo sapien
ttctggtgttaattcaaggaaaata

SEQ ID NO: 411762 - DNA, 25 bp, Homo sapien
gaaaataaagtaatccataggaagt

SEQ ID NO: 411763 - DNA, 25 bp, Homo sapien
agtaatccataggaagtattcagtt

SEQ ID NO: 411764 - DNA, 25 bp, Homo sapien
aatccataggaagtattcagttata

SEQ ID NO: 411765 - DNA, 25 bp, Homo sapien
ccataggaagtattcagttataaga

SEQ ID NO: 411766 - DNA, 25 bp, Homo sapien
gatgctcagattcaaaatgtgtgtt

SEQ ID NO: 411767 - DNA, 25 bp, Homo sapien
gattcaaaatgtgtgttctacactg

SEQ ID NO: 411768 - DNA, 25 bp, Homo sapien
gtgttctacactgttacaggcttct

SEQ ID NO: 411769 - DNA, 25 bp, Homo sapien
cactgttacaggcttctcttttgtt

SEQ ID NO: 411770 - DNA, 25 bp, Homo sapien
agattttagtcctacttttgtatgg

SEQ ID NO: 411771 - DNA, 25 bp, Homo sapien
gtatggacacattagaatattcaga

SEQ ID NO: 411772 - DNA, 25 bp, Homo sapien
attcatttaagcagttcagagagta

SEQ ID NO: 411773 - DNA, 25 bp, Homo sapien
agcagttcagagagtagactactca

SEQ ID NO: 411774 - DNA, 25 bp, Homo sapien
tttcacgtaattgtctaagaggtca

SEQ ID NO: 411775 - DNA, 25 bp, Homo sapien
ttgtctaagaggtcaatatttttta

SEQ ID NO: 411776 - DNA, 25 bp, Homo sapien
ttgaatcaaataaagtgctctaaag

SEQ ID NO: 411777 - DNA, 25 bp, Homo sapien
ataaaatagaagcagccttgtaact

SEQ ID NO: 411778 - DNA, 25 bp, Homo sapien
taaaatagaagcagccttgtaactg

SEQ ID NO: 411779 - DNA, 25 bp, Homo sapien
aaaatagaagcagccttgtaactgt

SEQ ID NO: 411780 - DNA, 25 bp, Homo sapien
aaatagaagcagccttgtaactgta

SEQ ID NO: 411781 - DNA, 25 bp, Homo sapien
aatagaagcagccttgtaactgtat

SEQ ID NO: 411782 - DNA, 25 bp, Homo sapien
atagaagcagccttgtaactgtatt

SEQ ID NO: 411783 - DNA, 25 bp, Homo sapien
tagaagcagccttgtaactgtattt

SEQ ID NO: 411784 - DNA, 25 bp, Homo sapien
cagccttgtaactgtatttaccatg

SEQ ID NO: 411785 - DNA, 25 bp, Homo sapien
agccttgtaactgtatttaccatga

SEQ ID NO: 411786 - DNA, 25 bp, Homo sapien
gccttgtaactgtatttaccatgat

SEQ ID NO: 411787 - DNA, 25 bp, Homo sapien
ccttgtaactgtatttaccatgata

SEQ ID NO: 411788 - DNA, 25 bp, Homo sapien
cctcctccttactggagggtgtaga

SEQ ID NO: 411789 - DNA, 25 bp, Homo sapien
ggtgtagaggaatgcagttttttgt

SEQ ID NO: 411790 - DNA, 25 bp, Homo sapien
gagaaacgggactttatggcagcac

SEQ ID NO: 411791 - DNA, 25 bp, Homo sapien
aacgggactttatggcagcactgac

SEQ ID NO: 411792 - DNA, 25 bp, Homo sapien
tttatggcagcactgacctcactgt

SEQ ID NO: 411793 - DNA, 25 bp, Homo sapien
tcactgtcctcaatatgacctatta

SEQ ID NO: 411794 - DNA, 25 bp, Homo sapien
gaacaagcattctgagcattctgta

SEQ ID NO: 411795 - DNA, 25 bp, Homo sapien
gcattctgtaatattggttccaggt

SEQ ID NO: 411796 - DNA, 25 bp, Homo sapien
attggttccaggtatcaattacaac

SEQ ID NO: 411797 - DNA, 25 bp, Homo sapien
ggtatcaattacaacctatcatgat

SEQ ID NO: 411798 - DNA, 25 bp, Homo sapien
aacctatcatgatcatggtgaccct

SEQ ID NO: 411799 - DNA, 25 bp, Homo sapien
ggttcgttccaccagtcataaacca

SEQ ID NO: 411800 - DNA, 25 bp, Homo sapien
ttcgttccaccagtcataaaccaga

SEQ ID NO: 411801 - DNA, 25 bp, Homo sapien
cgttccaccagtcataaaccagatg

SEQ ID NO: 411802 - DNA, 25 bp, Homo sapien
ttccaccagtcataaaccagatgaa

SEQ ID NO: 411803 - DNA, 25 bp, Homo sapien
gttggtgtcaaaggaaatccccaag

SEQ ID NO: 411804 - DNA, 25 bp, Homo sapien
ggtgtcaaaggaaatccccaaggct

SEQ ID NO: 411805 - DNA, 25 bp, Homo sapien
atccccaaggcttcaaccagggtct

SEQ ID NO: 411806 - DNA, 25 bp, Homo sapien
cccaaggcttcaaccagggtctgga

SEQ ID NO: 411807 - DNA, 25 bp, Homo sapien
accagggtctggattgtgatgtgat

SEQ ID NO: 411808 - DNA, 25 bp, Homo sapien
tctggattgtgatgtgatcgtagct

SEQ ID NO: 411809 - DNA, 25 bp, Homo sapien
attgtgatgtgatcgtagctgaggt

SEQ ID NO: 411810 - DNA, 25 bp, Homo sapien
tttttgcacatagttaactgccctt

SEQ ID NO: 411811 - DNA, 25 bp, Homo sapien
aactgcccttcaatatgattcttaa

SEQ ID NO: 411812 - DNA, 25 bp, Homo sapien
gctgtttctgtggtatcgtattctc

SEQ ID NO: 411813 - DNA, 25 bp, Homo sapien
ttctgtggtatcgtattctctaaat

SEQ ID NO: 411814 - DNA, 25 bp, Homo sapien
acaaggttgcagtttctaattgttt

SEQ ID NO: 411815 - DNA, 25 bp, Homo sapien
tctaattgtttcgttcctgtgtttt

SEQ ID NO: 411816 - DNA, 25 bp, Homo sapien
tgtgtttttgctggtgtgtaataaa

SEQ ID NO: 411817 - DNA, 25 bp, Homo sapien
ggttatttaatacattagctgcctg

SEQ ID NO: 411818 - DNA, 25 bp, Homo sapien
tagctgcctgtaaataattcttgtt

SEQ ID NO: 411819 - DNA, 25 bp, Homo sapien
taattcttgttataatgctctggaa

SEQ ID NO: 411820 - DNA, 25 bp, Homo sapien
aatgctctggaatgtgttgtagaag

SEQ ID NO: 411821 - DNA, 25 bp, Homo sapien
gcgcgctggcagcttggcgcaggag

SEQ ID NO: 411822 - DNA, 25 bp, Homo sapien
aggaggccgccttctatgcacgcta

SEQ ID NO: 411823 - DNA, 25 bp, Homo sapien
tctatgcacgctaccgcgtggacga

SEQ ID NO: 411824 - DNA, 25 bp, Homo sapien
taccgcgtggacgaggactggtgcc

SEQ ID NO: 411825 - DNA, 25 bp, Homo sapien
gctcctaccgtgcacgctgcgaaga

SEQ ID NO: 411826 - DNA, 25 bp, Homo sapien
accgtgcacgctgcgaagaggagct

SEQ ID NO: 411827 - DNA, 25 bp, Homo sapien
tcgcactgttcctggctcggaagca

SEQ ID NO: 411828 - DNA, 25 bp, Homo sapien
tggctcggaagcacctcaagaacgt

SEQ ID NO: 411829 - DNA, 25 bp, Homo sapien
tcaagaacgtggaggcgactcactt

SEQ ID NO: 411830 - DNA, 25 bp, Homo sapien
gaacgtggaggcgactcacttcagc

SEQ ID NO: 411831 - DNA, 25 bp, Homo sapien
aggcgactcacttcagccctctgga

SEQ ID NO: 411832 - DNA, 25 bp, Homo sapien
tctgtattatctccttctgtagctt

SEQ ID NO: 411833 - DNA, 25 bp, Homo sapien
tgacagatgtggtatgctagtagat

SEQ ID NO: 411834 - DNA, 25 bp, Homo sapien
gtatgctagtagatgaactgcctaa

SEQ ID NO: 411835 - DNA, 25 bp, Homo sapien
gtattatctccttctgtagctttag

SEQ ID NO: 411836 - DNA, 25 bp, Homo sapien
ttaagagttctaccccatgtagtct

SEQ ID NO: 411837 - DNA, 25 bp, Homo sapien
taccccatgtagtctctgtcgcagt

SEQ ID NO: 411838 - DNA, 25 bp, Homo sapien
tgtagtctctgtcgcagttctggag

SEQ ID NO: 411839 - DNA, 25 bp, Homo sapien
gagcaaacagtttcttgatctttgg

SEQ ID NO: 411840 - DNA, 25 bp, Homo sapien
tccagtttccaagtggcttttgcaa

SEQ ID NO: 411841 - DNA, 25 bp, Homo sapien
agtggcttttgcaacttggctgagg

SEQ ID NO: 411842 - DNA, 25 bp, Homo sapien
aacttggctgaggtggtgtactaac

SEQ ID NO: 411843 - DNA, 25 bp, Homo sapien
agagctgtaccagacaggttccaca

SEQ ID NO: 411844 - DNA, 25 bp, Homo sapien
gtaccagacaggttccacagagcca

SEQ ID NO: 411845 - DNA, 25 bp, Homo sapien
gagccagtggaggtaccccctgaac

SEQ ID NO: 411846 - DNA, 25 bp, Homo sapien
cccctgaactatgtcatgggattca

SEQ ID NO: 411847 - DNA, 25 bp, Homo sapien
ctatgtcatgggattcaaggaaagt

SEQ ID NO: 411848 - DNA, 25 bp, Homo sapien
ttggatgaagaagccattcttccag

SEQ ID NO: 411849 - DNA, 25 bp, Homo sapien
gaagccattcttccagatcaaatag

SEQ ID NO: 411850 - DNA, 25 bp, Homo sapien
aagggatctgacacagaacactgta

SEQ ID NO: 411851 - DNA, 25 bp, Homo sapien
gacacagaacactgtagtcagtatt

SEQ ID NO: 411852 - DNA, 25 bp, Homo sapien
agacccacagtttgctgaagattac

SEQ ID NO: 411853 - DNA, 25 bp, Homo sapien
cagtttgctgaagattacattttta

SEQ ID NO: 411854 - DNA, 25 bp, Homo sapien
ggagacaacaactacttgactatgc

SEQ ID NO: 411855 - DNA, 25 bp, Homo sapien
tgactatgcaacagacaactgcctt

SEQ ID NO: 411856 - DNA, 25 bp, Homo sapien
cagacaactgccttgcccacatggg

SEQ ID NO: 411857 - DNA, 25 bp, Homo sapien
caccagtaggttcgcaagaaggccc

SEQ ID NO: 411858 - DNA, 25 bp, Homo sapien
aagaaggccctaaagatcctgaagc

SEQ ID NO: 411859 - DNA, 25 bp, Homo sapien
gagcaggccacagggttggtataat

SEQ ID NO: 411860 - DNA, 25 bp, Homo sapien
gggaaataaagcaccttccaagctt

SEQ ID NO: 411861 - DNA, 25 bp, Homo sapien
gcttgcctccaagagttacgagtta

SEQ ID NO: 411862 - DNA, 25 bp, Homo sapien
gttaaggaagagtgccaccccttga

SEQ ID NO: 411863 - DNA, 25 bp, Homo sapien
tgacttccttctagggcagtctggc

SEQ ID NO: 411864 - DNA, 25 bp, Homo sapien
tggcctgcccacaaactgactttgt

SEQ ID NO: 411865 - DNA, 25 bp, Homo sapien
gcctctggagcttacattgcctagt

SEQ ID NO: 411866 - DNA, 25 bp, Homo sapien
cattgcctagtgtgcacttgggaga

SEQ ID NO: 411867 - DNA, 25 bp, Homo sapien
gtatctgggtatattttctcttttc

SEQ ID NO: 411868 - DNA, 25 bp, Homo sapien
tttcatctattctgcagacaagcca

SEQ ID NO: 411869 - DNA, 25 bp, Homo sapien
aaatctatcacaaagttgcctgcta

SEQ ID NO: 411870 - DNA, 25 bp, Homo sapien
aaagttgcctgctaacatcgcttag

SEQ ID NO: 411871 - DNA, 25 bp, Homo sapien
acatcgcttagcctgcttgctgcaa

SEQ ID NO: 411872 - DNA, 25 bp, Homo sapien
gcttgctgcaacattctagcaaatg

SEQ ID NO: 411873 - DNA, 25 bp, Homo sapien
aaaagctcttctcagatgttctgca

SEQ ID NO: 411874 - DNA, 25 bp, Homo sapien
tctcagatgttctgcactgcagata

SEQ ID NO: 411875 - DNA, 25 bp, Homo sapien
gcagatatttcaggacccattttaa

SEQ ID NO: 411876 - DNA, 25 bp, Homo sapien
atgtttttgcatttcatgaactcct

SEQ ID NO: 411877 - DNA, 25 bp, Homo sapien
ttcatgaactccttaacgcctaagc

SEQ ID NO: 411878 - DNA, 25 bp, Homo sapien
aacgcctaagcccagttcttatttg

SEQ ID NO: 411879 - DNA, 25 bp, Homo sapien
gcccagttcttatttgcccttatat

SEQ ID NO: 411880 - DNA, 25 bp, Homo sapien
atttgcccttatatcattgcagata

SEQ ID NO: 411881 - DNA, 25 bp, Homo sapien
attgcagataacctcagtgccttga

SEQ ID NO: 411882 - DNA, 25 bp, Homo sapien
gataacctcagtgccttgagcataa

SEQ ID NO: 411883 - DNA, 25 bp, Homo sapien
actatggatctcgacaggaccctga

SEQ ID NO: 411884 - DNA, 25 bp, Homo sapien
aggaccctgaacaaaactccattgt

SEQ ID NO: 411885 - DNA, 25 bp, Homo sapien
cattgttgatcctattttgcaccta

SEQ ID NO: 411886 - DNA, 25 bp, Homo sapien
gcacctagacacaattattctttgg

SEQ ID NO: 411887 - DNA, 25 bp, Homo sapien
tactatccaattaccatgtttaggc

SEQ ID NO: 411888 - DNA, 25 bp, Homo sapien
ctaagtatagctataggccccatcc

SEQ ID NO: 411889 - DNA, 25 bp, Homo sapien
ataggccccatccagcagggaaatt

SEQ ID NO: 411890 - DNA, 25 bp, Homo sapien
gccctgaatccagagtaccattaga

SEQ ID NO: 411891 - DNA, 25 bp, Homo sapien
cagggaaatttgcaaaaactctagt

SEQ ID NO: 411892 - DNA, 25 bp, Homo sapien
actctagtcccttctaataagttgt

SEQ ID NO: 411893 - DNA, 25 bp, Homo sapien
aagttgtctatggatgttatcatga

SEQ ID NO: 411894 - DNA, 25 bp, Homo sapien
gagtaccattagacaacatgattat

SEQ ID NO: 411895 - DNA, 25 bp, Homo sapien
tatttcctaattcttccccatttgg

SEQ ID NO: 411896 - DNA, 25 bp, Homo sapien
aattcttccccatttggtacaggat

SEQ ID NO: 411897 - DNA, 25 bp, Homo sapien
ccccatttggtacaggattatctat

SEQ ID NO: 411898 - DNA, 25 bp, Homo sapien
ggaatttgcaaatagggcctgtatg

SEQ ID NO: 411899 - DNA, 25 bp, Homo sapien
agggcctgtatgacttatttcctag

SEQ ID NO: 411900 - DNA, 25 bp, Homo sapien
tatttcctaggacacgggaagcttt

SEQ ID NO: 411901 - DNA, 25 bp, Homo sapien
actcccaagtttcttctcctgaagg

SEQ ID NO: 411902 - DNA, 25 bp, Homo sapien
ttctcctgaaggtctttgcactata

SEQ ID NO: 411903 - DNA, 25 bp, Homo sapien
aggtctttgcactataagcgccaag

SEQ ID NO: 411904 - DNA, 25 bp, Homo sapien
tataagcgccaaggagcccgtgtgc

SEQ ID NO: 411905 - DNA, 25 bp, Homo sapien
caaggacaggctggttggtttcgtt

SEQ ID NO: 411906 - DNA, 25 bp, Homo sapien
attttatatactcatgccctaaccc

SEQ ID NO: 411907 - DNA, 25 bp, Homo sapien
taaccctgtgttcctggtttctata

SEQ ID NO: 411908 - DNA, 25 bp, Homo sapien
tgttcctggtttctataaggccccg

SEQ ID NO: 411909 - DNA, 25 bp, Homo sapien
cttgaaaccttgtaggcagctccat

SEQ ID NO: 411910 - DNA, 25 bp, Homo sapien
gtaggcagctccataaaagcatgag

SEQ ID NO: 411911 - DNA, 25 bp, Homo sapien
aaagcatgagccctagccagaggtt

SEQ ID NO: 411912 - DNA, 25 bp, Homo sapien
ctagccagaggttgttactgaccct

SEQ ID NO: 411913 - DNA, 25 bp, Homo sapien
gggcagcttttatccctaaagctgg

SEQ ID NO: 411914 - DNA, 25 bp, Homo sapien
ctgaccctcctctctaggaaatgta

SEQ ID NO: 411915 - DNA, 25 bp, Homo sapien
aaatgtagctcctgccagaattgac

SEQ ID NO: 411916 - DNA, 25 bp, Homo sapien
gctcctgccagaattgaccgatcag

SEQ ID NO: 411917 - DNA, 25 bp, Homo sapien
aaagctgggcagaacatgcaccaag

SEQ ID NO: 411918 - DNA, 25 bp, Homo sapien
atgcaccaaggttggcagcctctgc

SEQ ID NO: 411919 - DNA, 25 bp, Homo sapien
tccacccaggaccatacttgaggtt

SEQ ID NO: 411920 - DNA, 25 bp, Homo sapien
aactttgaaggggatacatttagag

SEQ ID NO: 411921 - DNA, 25 bp, Homo sapien
gaaggggatacatttagagagtttt

SEQ ID NO: 411922 - DNA, 25 bp, Homo sapien
atatttttttttttggctgggcatg

SEQ ID NO: 411923 - DNA, 25 bp, Homo sapien
tatttttttttttggctgggcatgg

SEQ ID NO: 411924 - DNA, 25 bp, Homo sapien
tagctgagcgagcatggtggcatat

SEQ ID NO: 411925 - DNA, 25 bp, Homo sapien
agctgagcgagcatggtggcatatg

SEQ ID NO: 411926 - DNA, 25 bp, Homo sapien
ctgagcgagcatggtggcatatgcc

SEQ ID NO: 411927 - DNA, 25 bp, Homo sapien
tgagcgagcatggtggcatatgcct

SEQ ID NO: 411928 - DNA, 25 bp, Homo sapien
gagcgagcatggtggcatatgcctg

SEQ ID NO: 411929 - DNA, 25 bp, Homo sapien
agcatggtggcatatgcctgttatc

SEQ ID NO: 411930 - DNA, 25 bp, Homo sapien
atggtggcatatgcctgttatccca

SEQ ID NO: 411931 - DNA, 25 bp, Homo sapien
accaggtattacatttccacaaggg

SEQ ID NO: 411932 - DNA, 25 bp, Homo sapien
ggaatagccacatgatacttaccga

SEQ ID NO: 411933 - DNA, 25 bp, Homo sapien
tgatacttaccgaaagcttcacttt

SEQ ID NO: 411934 - DNA, 25 bp, Homo sapien
aaagcttcactttccctatagagaa

SEQ ID NO: 411935 - DNA, 25 bp, Homo sapien
gaaagcaagcaacatgaatcttctg

SEQ ID NO: 411936 - DNA, 25 bp, Homo sapien
cagcctgctgctgtatacagaggtt

SEQ ID NO: 411937 - DNA, 25 bp, Homo sapien
acagaggttggcattattggtgata

SEQ ID NO: 411938 - DNA, 25 bp, Homo sapien
gaaatgtctgataggagtcttttaa

SEQ ID NO: 411939 - DNA, 25 bp, Homo sapien
aggtggagtgcaaggctgcttcctt

SEQ ID NO: 411940 - DNA, 25 bp, Homo sapien
ggctgcttcctttattactgcaagt

SEQ ID NO: 411941 - DNA, 25 bp, Homo sapien
attatctcaggtttcgttttgtgta

SEQ ID NO: 411942 - DNA, 25 bp, Homo sapien
gaatgaccattcagaggtgtggctt

SEQ ID NO: 411943 - DNA, 25 bp, Homo sapien
tcagaggtgtggctttttccacgtc

SEQ ID NO: 411944 - DNA, 25 bp, Homo sapien
tgtggctttttccacgtctttttct

SEQ ID NO: 411945 - DNA, 25 bp, Homo sapien
tgcaatgaactgctcccacgtcctg

SEQ ID NO: 411946 - DNA, 25 bp, Homo sapien
gtcctgcactgcaataccagtctaa

SEQ ID NO: 411947 - DNA, 25 bp, Homo sapien
accagtctaatgaacactttgtgaa

SEQ ID NO: 411948 - DNA, 25 bp, Homo sapien
caaatcgtaagtatgtacgcacgca

SEQ ID NO: 411949 - DNA, 25 bp, Homo sapien
atgtacgcacgcatatcaaactatg

SEQ ID NO: 411950 - DNA, 25 bp, Homo sapien
gcacgcatatcaaactatgctctga

SEQ ID NO: 411951 - DNA, 25 bp, Homo sapien
ctgaggataaagcaagttctaattt

SEQ ID NO: 411952 - DNA, 25 bp, Homo sapien
taaagcaagttctaatttgtggaaa

SEQ ID NO: 411953 - DNA, 25 bp, Homo sapien
caggaagtgaagagacccctctccc

SEQ ID NO: 411954 - DNA, 25 bp, Homo sapien
atctttctctgggagacactcgcgc

SEQ ID NO: 411955 - DNA, 25 bp, Homo sapien
cccctatcctggccagtgatggagg

SEQ ID NO: 411956 - DNA, 25 bp, Homo sapien
gggtatctctacaggggtcctcggt

SEQ ID NO: 411957 - DNA, 25 bp, Homo sapien
atctacttccctttcttcatgtgtt

SEQ ID NO: 411958 - DNA, 25 bp, Homo sapien
tggtggtcccgttgtctctgctgaa

SEQ ID NO: 411959 - DNA, 25 bp, Homo sapien
tggtcccgttgtctctgctgaatca

SEQ ID NO: 411960 - DNA, 25 bp, Homo sapien
gaatcagagctgagaacggtgccaa

SEQ ID NO: 411961 - DNA, 25 bp, Homo sapien
tcagagctgagaacggtgccaaaat

SEQ ID NO: 411962 - DNA, 25 bp, Homo sapien
gagaacggtgccaaaatccaacgat

SEQ ID NO: 411963 - DNA, 25 bp, Homo sapien
acggtgccaaaatccaacgatgccc

SEQ ID NO: 411964 - DNA, 25 bp, Homo sapien
aacatgaaagtaatgctctgcacaa

SEQ ID NO: 411965 - DNA, 25 bp, Homo sapien
gaaagtaatgctctgcacaaggatg

SEQ ID NO: 411966 - DNA, 25 bp, Homo sapien
tctgcacaaggatgtctgagtgtcc

SEQ ID NO: 411967 - DNA, 25 bp, Homo sapien
gatgtctgagtgtccttgattccaa

SEQ ID NO: 411968 - DNA, 25 bp, Homo sapien
gtgtccttgattccaagggcattta

SEQ ID NO: 411969 - DNA, 25 bp, Homo sapien
aattagccactggatgagaaccatg

SEQ ID NO: 411970 - DNA, 25 bp, Homo sapien
ctggatgagaaccatgaaatgccat

SEQ ID NO: 411971 - DNA, 25 bp, Homo sapien
gaaatgccatgactcttacagctcc

SEQ ID NO: 411972 - DNA, 25 bp, Homo sapien
ttacagctcccatgaaagacattgg

SEQ ID NO: 411973 - DNA, 25 bp, Homo sapien
aagacattggatggaacttatccta

SEQ ID NO: 411974 - DNA, 25 bp, Homo sapien
ttggatggaacttatcctaactgga

SEQ ID NO: 411975 - DNA, 25 bp, Homo sapien
tgctgttgttatttttcgcgtgtcc

SEQ ID NO: 411976 - DNA, 25 bp, Homo sapien
tgttgttatttttcgcgtgtcctcc

SEQ ID NO: 411977 - DNA, 25 bp, Homo sapien
ttcgcgtgtcctccgaaaccaaggg

SEQ ID NO: 411978 - DNA, 25 bp, Homo sapien
gaaaccaagggaaatgcggctctgt

SEQ ID NO: 411979 - DNA, 25 bp, Homo sapien
aaatgcggctctgtgggttctgtta

SEQ ID NO: 411980 - DNA, 25 bp, Homo sapien
ggctctgtgggttctgttaacgtca

SEQ ID NO: 411981 - DNA, 25 bp, Homo sapien
gggttctgttaacgtcagcatttaa

SEQ ID NO: 411982 - DNA, 25 bp, Homo sapien
cagctcttgcaacgtagctagttga

SEQ ID NO: 411983 - DNA, 25 bp, Homo sapien
gtagctagttgataaccctcgaaat

SEQ ID NO: 411984 - DNA, 25 bp, Homo sapien
gataaccctcgaaatatagcgaatt

SEQ ID NO: 411985 - DNA, 25 bp, Homo sapien
gtgctatattgtaaaatacgggact

SEQ ID NO: 411986 - DNA, 25 bp, Homo sapien
taatgttaccttttatcctacttca

SEQ ID NO: 411987 - DNA, 25 bp, Homo sapien
taccttttatcctacttcaaacctg

SEQ ID NO: 411988 - DNA, 25 bp, Homo sapien
aaaatttgcataaagaagcatcttt

SEQ ID NO: 411989 - DNA, 25 bp, Homo sapien
gcataaagaagcatctttaattcgt

SEQ ID NO: 411990 - DNA, 25 bp, Homo sapien
aaagaagcatctttaattcgtatgt

SEQ ID NO: 411991 - DNA, 25 bp, Homo sapien
aagaagcatctttaattcgtatgta

SEQ ID NO: 411992 - DNA, 25 bp, Homo sapien
agaagcatctttaattcgtatgtaa

SEQ ID NO: 411993 - DNA, 25 bp, Homo sapien
gaagcatctttaattcgtatgtaaa

SEQ ID NO: 411994 - DNA, 25 bp, Homo sapien
aagcatctttaattcgtatgtaaaa

SEQ ID NO: 411995 - DNA, 25 bp, Homo sapien
agcatctttaattcgtatgtaaaaa

SEQ ID NO: 411996 - DNA, 25 bp, Homo sapien
gcatctttaattcgtatgtaaaaaa

SEQ ID NO: 411997 - DNA, 25 bp, Homo sapien
taaatggtagttacagtgatgataa

SEQ ID NO: 411998 - DNA, 25 bp, Homo sapien
ctcaaaagctaacccatttaattat

SEQ ID NO: 411999 - DNA, 25 bp, Homo sapien
agctaacccatttaattattgtact

SEQ ID NO: 412000 - DNA, 25 bp, Homo sapien
aacccatttaattattgtactactg

SEQ ID NO: 412001 - DNA, 25 bp, Homo sapien
ttattgtactactggacttttatga

SEQ ID NO: 412002 - DNA, 25 bp, Homo sapien
attgtactactggacttttatgata

SEQ ID NO: 412003 - DNA, 25 bp, Homo sapien
tgtactactggacttttatgatagt

SEQ ID NO: 412004 - DNA, 25 bp, Homo sapien
actactggacttttatgatagtaag

SEQ ID NO: 412005 - DNA, 25 bp, Homo sapien
tgatagtaagtagaaatctgttgct

SEQ ID NO: 412006 - DNA, 25 bp, Homo sapien
aagtttctttggtggtgtgcgtcta

SEQ ID NO: 412007 - DNA, 25 bp, Homo sapien
gtttctttggtggtgtgcgtctata

SEQ ID NO: 412008 - DNA, 25 bp, Homo sapien
caaagagccgccttgtcgctgtggg

SEQ ID NO: 412009 - DNA, 25 bp, Homo sapien
aaagagccgccttgtcgctgtgggc

SEQ ID NO: 412010 - DNA, 25 bp, Homo sapien
tcgctgtgggcgtcagggcttggct

SEQ ID NO: 412011 - DNA, 25 bp, Homo sapien
ggcttggctggctcagtgcacaacc

SEQ ID NO: 412012 - DNA, 25 bp, Homo sapien
tggctcagtgcacaacccacagtgg

SEQ ID NO: 412013 - DNA, 25 bp, Homo sapien
acagtggccttcagaggctcctcct

SEQ ID NO: 412014 - DNA, 25 bp, Homo sapien
agtggccttcagaggctcctcctgg

SEQ ID NO: 412015 - DNA, 25 bp, Homo sapien
caggacagaccagccttgtttctca

SEQ ID NO: 412016 - DNA, 25 bp, Homo sapien
gtttctcatgtaatgcagtgacgct

SEQ ID NO: 412017 - DNA, 25 bp, Homo sapien
ctcatgtaatgcagtgacgctgtca

SEQ ID NO: 412018 - DNA, 25 bp, Homo sapien
gacgctgtcattaaacacgtggatt

SEQ ID NO: 412019 - DNA, 25 bp, Homo sapien
agagctttgaattcacttaagtgtt

SEQ ID NO: 412020 - DNA, 25 bp, Homo sapien
gtgttaataaggatctactgaggct

SEQ ID NO: 412021 - DNA, 25 bp, Homo sapien
gatctactgaggctagtctcgttta

SEQ ID NO: 412022 - DNA, 25 bp, Homo sapien
gctagtctcgtttaatttgtggaaa

SEQ ID NO: 412023 - DNA, 25 bp, Homo sapien
tgtggaaagtccttttttactgctt

SEQ ID NO: 412024 - DNA, 25 bp, Homo sapien
ttttttactgctttgcccattggag

SEQ ID NO: 412025 - DNA, 25 bp, Homo sapien
actgctttgcccattggaggtgtct

SEQ ID NO: 412026 - DNA, 25 bp, Homo sapien
ggaggtgtctccttttattagaaag

SEQ ID NO: 412027 - DNA, 25 bp, Homo sapien
gaaagtaaccatcttattccaattc

SEQ ID NO: 412028 - DNA, 25 bp, Homo sapien
tattccaattctatgcatgttactg

SEQ ID NO: 412029 - DNA, 25 bp, Homo sapien
attctatgcatgttactggtattta

SEQ ID NO: 412030 - DNA, 25 bp, Homo sapien
tatccatctaatccaggattccctc

SEQ ID NO: 412031 - DNA, 25 bp, Homo sapien
atccaggattccctcactctttttt

SEQ ID NO: 412032 - DNA, 25 bp, Homo sapien
agaacggaaatgctgtcttgtgagc

SEQ ID NO: 412033 - DNA, 25 bp, Homo sapien
gagcatgaagtgaacgggctgtttt

SEQ ID NO: 412034 - DNA, 25 bp, Homo sapien
agtgaacgggctgttttgctccagc

SEQ ID NO: 412035 - DNA, 25 bp, Homo sapien
ttttgctccagccacttttcttgta

SEQ ID NO: 412036 - DNA, 25 bp, Homo sapien
agccacttttcttgtacaaccacat

SEQ ID NO: 412037 - DNA, 25 bp, Homo sapien
cttttcttgtacaaccacatggatg

SEQ ID NO: 412038 - DNA, 25 bp, Homo sapien
gatggattagatgtcctcaggtctt

SEQ ID NO: 412039 - DNA, 25 bp, Homo sapien
cctcaggtcttttccatcttcagtt

SEQ ID NO: 412040 - DNA, 25 bp, Homo sapien
cttcagtttctatgactgtggaata

SEQ ID NO: 412041 - DNA, 25 bp, Homo sapien
gttaggccatgaacagaaggaagat

SEQ ID NO: 412042 - DNA, 25 bp, Homo sapien
atagccttaggtagctttctggaag

SEQ ID NO: 412043 - DNA, 25 bp, Homo sapien
ggaaggcctgtgtagactacctctg

SEQ ID NO: 412044 - DNA, 25 bp, Homo sapien
aggcctgtgtagactacctctgaaa

SEQ ID NO: 412045 - DNA, 25 bp, Homo sapien
ctgaaaaagctttgaagggccaaga

SEQ ID NO: 412046 - DNA, 25 bp, Homo sapien
gggataatgtctcaattgttacatc

SEQ ID NO: 412047 - DNA, 25 bp, Homo sapien
gtctcaattgttacatcatgacctt

SEQ ID NO: 412048 - DNA, 25 bp, Homo sapien
tgttacatcatgaccttttattaag

SEQ ID NO: 412049 - DNA, 25 bp, Homo sapien
ggaaagctaactgcattatagtctg

SEQ ID NO: 412050 - DNA, 25 bp, Homo sapien
attatagtctgctagagtctgggaa

SEQ ID NO: 412051 - DNA, 25 bp, Homo sapien
ccaggtgggaatcctaagaatgtca

SEQ ID NO: 412052 - DNA, 25 bp, Homo sapien
atgagtgtataatgaggtccttggt

SEQ ID NO: 412053 - DNA, 25 bp, Homo sapien
gtgtataatgaggtccttggtgaaa

SEQ ID NO: 412054 - DNA, 25 bp, Homo sapien
acatcaaatccagcaccgtgttggg

SEQ ID NO: 412055 - DNA, 25 bp, Homo sapien
tcttattggccccttacttctgcag

SEQ ID NO: 412056 - DNA, 25 bp, Homo sapien
gccccttacttctgcagcaaaagtt

SEQ ID NO: 412057 - DNA, 25 bp, Homo sapien
gtcatgtgaaactgccacctggaat

SEQ ID NO: 412058 - DNA, 25 bp, Homo sapien
gaaactgccacctggaattttctat

SEQ ID NO: 412059 - DNA, 25 bp, Homo sapien
gccacctggaattttctattctcta

SEQ ID NO: 412060 - DNA, 25 bp, Homo sapien
tctattctctagtgaccaccctgta

SEQ ID NO: 412061 - DNA, 25 bp, Homo sapien
caccatgcccaatgggtgtgggatt

SEQ ID NO: 412062 - DNA, 25 bp, Homo sapien
caatgggtgtgggatttagtatatt

SEQ ID NO: 412063 - DNA, 25 bp, Homo sapien
tcctgtggaaggaccataatcactt

SEQ ID NO: 412064 - DNA, 25 bp, Homo sapien
gagtcacaactcttgattccatcca

SEQ ID NO: 412065 - DNA, 25 bp, Homo sapien
attctcattctttcacaactccaca

SEQ ID NO: 412066 - DNA, 25 bp, Homo sapien
tttcacaactccacatatatccata

SEQ ID NO: 412067 - DNA, 25 bp, Homo sapien
tgggccctagtcttttccattggaa

SEQ ID NO: 412068 - DNA, 25 bp, Homo sapien
tatatccatatcctcattatctcag

SEQ ID NO: 412069 - DNA, 25 bp, Homo sapien
aggacaacgtgaccatttcttgcca

SEQ ID NO: 412070 - DNA, 25 bp, Homo sapien
ggaactaactctagaggtgacctct

SEQ ID NO: 412071 - DNA, 25 bp, Homo sapien
gaggtgacctcttccagcccaataa

SEQ ID NO: 412072 - DNA, 25 bp, Homo sapien
tttaaagcccacctatttgcccata

SEQ ID NO: 412073 - DNA, 25 bp, Homo sapien
tatttgcccataggtgtctccagcc

SEQ ID NO: 412074 - DNA, 25 bp, Homo sapien
gacatccccttaaatactcagtttc

SEQ ID NO: 412075 - DNA, 25 bp, Homo sapien
tactcagtttctttggagagagcaa

SEQ ID NO: 412076 - DNA, 25 bp, Homo sapien
agcaaagcatatctctctgtggaaa

SEQ ID NO: 412077 - DNA, 25 bp, Homo sapien
aatgcctggtattttacactcaaag

SEQ ID NO: 412078 - DNA, 25 bp, Homo sapien
actagtctaagtgtcattttgagcc

SEQ ID NO: 412079 - DNA, 25 bp, Homo sapien
gtcattttgagcctagtagcactac

SEQ ID NO: 412080 - DNA, 25 bp, Homo sapien
gtagcactaccttccaagtgagtca

SEQ ID NO: 412081 - DNA, 25 bp, Homo sapien
gagtcacaacaaatttgatcctatt

SEQ ID NO: 412082 - DNA, 25 bp, Homo sapien
gtttttgtccactgttatgattcat

SEQ ID NO: 412083 - DNA, 25 bp, Homo sapien
atgtatcttacaagagccactcaag

SEQ ID NO: 412084 - DNA, 25 bp, Homo sapien
gagccactcaagcaagactctgctt

SEQ ID NO: 412085 - DNA, 25 bp, Homo sapien
taggcccttttccacaatttctgat

SEQ ID NO: 412086 - DNA, 25 bp, Homo sapien
tgatggaaatacagaaaccttgcca

SEQ ID NO: 412087 - DNA, 25 bp, Homo sapien
gccatcattcttactgctggtttgc

SEQ ID NO: 412088 - DNA, 25 bp, Homo sapien
cttactgctggtttgcatctcattt

SEQ ID NO: 412089 - DNA, 25 bp, Homo sapien
gcatctcatttatggtgtatctggg

SEQ ID NO: 412090 - DNA, 25 bp, Homo sapien
gattcagtggctgttatatgccttg

SEQ ID NO: 412091 - DNA, 25 bp, Homo sapien
gctgttatatgccttgtcaatttaa

SEQ ID NO: 412092 - DNA, 25 bp, Homo sapien
atttaatgtattgccctatcctctt

SEQ ID NO: 412093 - DNA, 25 bp, Homo sapien
gtattgccctatcctctttttgatc

SEQ ID NO: 412094 - DNA, 25 bp, Homo sapien
gatagagactaagactgggaattat

SEQ ID NO: 412095 - DNA, 25 bp, Homo sapien
taggccaatatgagtcaaagtgcaa

SEQ ID NO: 412096 - DNA, 25 bp, Homo sapien
cagaaatttcccgtgagcatcaaaa

SEQ ID NO: 412097 - DNA, 25 bp, Homo sapien
tttcccgtgagcatcaaaaggcgtc

SEQ ID NO: 412098 - DNA, 25 bp, Homo sapien
aaaaggcgtcagtcaggccgcagct

SEQ ID NO: 412099 - DNA, 25 bp, Homo sapien
aggcgtcagtcaggccgcagctctg

SEQ ID NO: 412100 - DNA, 25 bp, Homo sapien
tctggctccagttcccgaggtttgt

SEQ ID NO: 412101 - DNA, 25 bp, Homo sapien
gttcccgaggtttgttgtctcctca

SEQ ID NO: 412102 - DNA, 25 bp, Homo sapien
gggtcccgcagttaggctccctgag

SEQ ID NO: 412103 - DNA, 25 bp, Homo sapien
gagccctcggcttataaatacaggt

SEQ ID NO: 412104 - DNA, 25 bp, Homo sapien
tataaatacaggtcttgctttgtgg

SEQ ID NO: 412105 - DNA, 25 bp, Homo sapien
tgccagagtcctcatgtggcttgga

SEQ ID NO: 412106 - DNA, 25 bp, Homo sapien
agagtcctcatgtggcttggaggaa

SEQ ID NO: 412107 - DNA, 25 bp, Homo sapien
tacagggctgggagaacccctagct

SEQ ID NO: 412108 - DNA, 25 bp, Homo sapien
agggctgggagaacccctagctctc

SEQ ID NO: 412109 - DNA, 25 bp, Homo sapien
tgggagaacccctagctctcccggg

SEQ ID NO: 412110 - DNA, 25 bp, Homo sapien
ggaagccccgagtgagagtccccca

SEQ ID NO: 412111 - DNA, 25 bp, Homo sapien
cagcaactacatgtgactgatagct

SEQ ID NO: 412112 - DNA, 25 bp, Homo sapien
acatgtgactgatagcttttcccaa

SEQ ID NO: 412113 - DNA, 25 bp, Homo sapien
atgtgactgatagcttttcccaaag

SEQ ID NO: 412114 - DNA, 25 bp, Homo sapien
gtgactgatagcttttcccaaaggc

SEQ ID NO: 412115 - DNA, 25 bp, Homo sapien
gagcagattgtaatgctgccgagtc

SEQ ID NO: 412116 - DNA, 25 bp, Homo sapien
ggtgaccacgcgttgtccctcggct

SEQ ID NO: 412117 - DNA, 25 bp, Homo sapien
ttgtccctcggctttcagccatggg

SEQ ID NO: 412118 - DNA, 25 bp, Homo sapien
gacaattttaaaatcctgggaccat

SEQ ID NO: 412119 - DNA, 25 bp, Homo sapien
taaaatcctgggaccatatttattt

SEQ ID NO: 412120 - DNA, 25 bp, Homo sapien
acattagaaaaggagtcaggccatt

SEQ ID NO: 412121 - DNA, 25 bp, Homo sapien
aaggagtcaggccattaggttattt

SEQ ID NO: 412122 - DNA, 25 bp, Homo sapien
gtcaggccattaggttatttatcca

SEQ ID NO: 412123 - DNA, 25 bp, Homo sapien
ggttatttatccaaatctctaagca

SEQ ID NO: 412124 - DNA, 25 bp, Homo sapien
aaatctctaagcaattaggttgaag

SEQ ID NO: 412125 - DNA, 25 bp, Homo sapien
gaagttattaagtcaagcctagaaa

SEQ ID NO: 412126 - DNA, 25 bp, Homo sapien
ttaagtcaagcctagaaaagctgcc

SEQ ID NO: 412127 - DNA, 25 bp, Homo sapien
aaaagctgcctccttgtaaggcttt

SEQ ID NO: 412128 - DNA, 25 bp, Homo sapien
gctgcctccttgtaaggctttcatg

SEQ ID NO: 412129 - DNA, 25 bp, Homo sapien
aattttaccaatgtgtgaactataa

SEQ ID NO: 412130 - DNA, 25 bp, Homo sapien
gaactataaaagctttttgcctaca

SEQ ID NO: 412131 - DNA, 25 bp, Homo sapien
aagctttttgcctacagattttaca

SEQ ID NO: 412132 - DNA, 25 bp, Homo sapien
gctttttgcctacagattttacatt

SEQ ID NO: 412133 - DNA, 25 bp, Homo sapien
atctatggctgttttaaattgtcta

SEQ ID NO: 412134 - DNA, 25 bp, Homo sapien
attgtctagcaatttatatggttgt

SEQ ID NO: 412135 - DNA, 25 bp, Homo sapien
tatggttgtggttaactcatttaag

SEQ ID NO: 412136 - DNA, 25 bp, Homo sapien
tagcaagacagtgcttgtctttttt

SEQ ID NO: 412137 - DNA, 25 bp, Homo sapien
gttattacactaactgcaattcagt

SEQ ID NO: 412138 - DNA, 25 bp, Homo sapien
actgcaattcagtaagctgcatgac

SEQ ID NO: 412139 - DNA, 25 bp, Homo sapien
cagtaagctgcatgacaaaatatgt

SEQ ID NO: 412140 - DNA, 25 bp, Homo sapien
actgatggccctaatatcggttatc

SEQ ID NO: 412141 - DNA, 25 bp, Homo sapien
ggttatctctatctgaagacctgca

SEQ ID NO: 412142 - DNA, 25 bp, Homo sapien
tgaagacctgcagtttagcttttct

SEQ ID NO: 412143 - DNA, 25 bp, Homo sapien
ttagcttttcttcacctctacttaa

SEQ ID NO: 412144 - DNA, 25 bp, Homo sapien
acctctacttaattgggcagtcttt

SEQ ID NO: 412145 - DNA, 25 bp, Homo sapien
ttccctggtgaactctggcttttta

SEQ ID NO: 412146 - DNA, 25 bp, Homo sapien
aaaacagcccacaggactgggtcct

SEQ ID NO: 412147 - DNA, 25 bp, Homo sapien
tcctccttatccgtcttgcttttaa

SEQ ID NO: 412148 - DNA, 25 bp, Homo sapien
atccgtcttgcttttaacctatgta

SEQ ID NO: 412149 - DNA, 25 bp, Homo sapien
cctatgtaaatttctgtggttgcta

SEQ ID NO: 412150 - DNA, 25 bp, Homo sapien
ttctgtggttgctatcttatgtaaa

SEQ ID NO: 412151 - DNA, 25 bp, Homo sapien
tgggcggctctatggcttaggcaca

SEQ ID NO: 412152 - DNA, 25 bp, Homo sapien
gcttaggcacaggagtggcccagaa

SEQ ID NO: 412153 - DNA, 25 bp, Homo sapien
atgaggatgtggactctgcccagga

SEQ ID NO: 412154 - DNA, 25 bp, Homo sapien
gaagatgagcatcctggcgattatc

SEQ ID NO: 412155 - DNA, 25 bp, Homo sapien
ggcgattatcaacaacatgcagcag

SEQ ID NO: 412156 - DNA, 25 bp, Homo sapien
tgcagcagtgatggcgccaggctct

SEQ ID NO: 412157 - DNA, 25 bp, Homo sapien
gggcctgatcccagagtggtgctta

SEQ ID NO: 412158 - DNA, 25 bp, Homo sapien
aagttgctgatcagttggatttgca

SEQ ID NO: 412159 - DNA, 25 bp, Homo sapien
ggctcagactcactgctgacaggaa

SEQ ID NO: 412160 - DNA, 25 bp, Homo sapien
actgctgacaggaatggctttcttt

SEQ ID NO: 412161 - DNA, 25 bp, Homo sapien
aagagttgttttttgaggacagcat

SEQ ID NO: 412162 - DNA, 25 bp, Homo sapien
cctggtatgcgggaggaacagagtg

SEQ ID NO: 412163 - DNA, 25 bp, Homo sapien
gagggcagggcgtgcagggccttgt

SEQ ID NO: 412164 - DNA, 25 bp, Homo sapien
tcagggaggacttgggcacctaccc

SEQ ID NO: 412165 - DNA, 25 bp, Homo sapien
gaggacttgggcacctaccccgagg

SEQ ID NO: 412166 - DNA, 25 bp, Homo sapien
gacttgggcacctaccccgagggag

SEQ ID NO: 412167 - DNA, 25 bp, Homo sapien
cacctaccccgagggagtggagctc

SEQ ID NO: 412168 - DNA, 25 bp, Homo sapien
cctgggtgcgtgtccagatgggaaa

SEQ ID NO: 412169 - DNA, 25 bp, Homo sapien
ggaaaggcagggtcgtatctgtggg

SEQ ID NO: 412170 - DNA, 25 bp, Homo sapien
ggtcgtatctgtggggacctgacaa

SEQ ID NO: 412171 - DNA, 25 bp, Homo sapien
tttctggatgtttgttgggtttggt

SEQ ID NO: 412172 - DNA, 25 bp, Homo sapien
tctggatgtttgttgggtttggttt

SEQ ID NO: 412173 - DNA, 25 bp, Homo sapien
agaacagaaccccacagctggataa

SEQ ID NO: 412174 - DNA, 25 bp, Homo sapien
ccacagctggataaggcccgtatat

SEQ ID NO: 412175 - DNA, 25 bp, Homo sapien
ggataaggcccgtatatatatattt

SEQ ID NO: 412176 - DNA, 25 bp, Homo sapien
atttgtaagccttgcaatgtgacag

SEQ ID NO: 412177 - DNA, 25 bp, Homo sapien
tgcaatgtgacaggtagcatcacta

SEQ ID NO: 412178 - DNA, 25 bp, Homo sapien
aggttttccttaatgatttcacgca

SEQ ID NO: 412179 - DNA, 25 bp, Homo sapien
tgatttcacgcagccaaattcttga

SEQ ID NO: 412180 - DNA, 25 bp, Homo sapien
gcagccaaattcttgaatcagttga

SEQ ID NO: 412181 - DNA, 25 bp, Homo sapien
aatcagttgaactaacctgtatgtt

SEQ ID NO: 412182 - DNA, 25 bp, Homo sapien
taatgtttactctgcagtctgaacc

SEQ ID NO: 412183 - DNA, 25 bp, Homo sapien
ggagattactggaattgttttccaa

SEQ ID NO: 412184 - DNA, 25 bp, Homo sapien
gtcggccgctctgtgactggagtta

SEQ ID NO: 412185 - DNA, 25 bp, Homo sapien
tttgaaatgtcacaaggccgcctcc

SEQ ID NO: 412186 - DNA, 25 bp, Homo sapien
gggcattgtacaagttcttccctct

SEQ ID NO: 412187 - DNA, 25 bp, Homo sapien
tttcctgctttcttcgtggtaggtt

SEQ ID NO: 412188 - DNA, 25 bp, Homo sapien
gctttcttcgtggtaggttctagca

SEQ ID NO: 412189 - DNA, 25 bp, Homo sapien
cgtggtaggttctagcacattcctc

SEQ ID NO: 412190 - DNA, 25 bp, Homo sapien
tagcacattcctctagcttcctgga

SEQ ID NO: 412191 - DNA, 25 bp, Homo sapien
acattcctctagcttcctggaggac

SEQ ID NO: 412192 - DNA, 25 bp, Homo sapien
ggccccgagtctgcgtccattagag

SEQ ID NO: 412193 - DNA, 25 bp, Homo sapien
gagtctgcgtccattagagcacagt

SEQ ID NO: 412194 - DNA, 25 bp, Homo sapien
tctgcgtccattagagcacagtcca

SEQ ID NO: 412195 - DNA, 25 bp, Homo sapien
acaaattggcctcttcctaagtata

SEQ ID NO: 412196 - DNA, 25 bp, Homo sapien
tggcctcttcctaagtatattaata

SEQ ID NO: 412197 - DNA, 25 bp, Homo sapien
ttatccttacattttatgcctcccc

SEQ ID NO: 412198 - DNA, 25 bp, Homo sapien
cccctaaattaatgactgagttggt

SEQ ID NO: 412199 - DNA, 25 bp, Homo sapien
aagcggctaggttttattcatactg

SEQ ID NO: 412200 - DNA, 25 bp, Homo sapien
tactgttttttgttctcaacttcaa

SEQ ID NO: 412201 - DNA, 25 bp, Homo sapien
aacttcaaaagtaatctacctctga

SEQ ID NO: 412202 - DNA, 25 bp, Homo sapien
gtgaatttgtgccactttaatcctt

SEQ ID NO: 412203 - DNA, 25 bp, Homo sapien
actttaatccttccactatcattcc

SEQ ID NO: 412204 - DNA, 25 bp, Homo sapien
tccactatcattcccattttgttac

SEQ ID NO: 412205 - DNA, 25 bp, Homo sapien
atcattcccattttgttacatttct

SEQ ID NO: 412206 - DNA, 25 bp, Homo sapien
tgttttcctatgtataattgtctcc

SEQ ID NO: 412207 - DNA, 25 bp, Homo sapien
gttttcctatgtataattgtctcct

SEQ ID NO: 412208 - DNA, 25 bp, Homo sapien
ttttcctatgtataattgtctcctc

SEQ ID NO: 412209 - DNA, 25 bp, Homo sapien
tttcctatgtataattgtctcctcc

SEQ ID NO: 412210 - DNA, 25 bp, Homo sapien
ttcctatgtataattgtctcctccc

SEQ ID NO: 412211 - DNA, 25 bp, Homo sapien
tcctatgtataattgtctcctccca

SEQ ID NO: 412212 - DNA, 25 bp, Homo sapien
cctatgtataattgtctcctcccac

SEQ ID NO: 412213 - DNA, 25 bp, Homo sapien
tatgtataattgtctcctcccaccc

SEQ ID NO: 412214 - DNA, 25 bp, Homo sapien
actcaccccagctgctttccacatt

SEQ ID NO: 412215 - DNA, 25 bp, Homo sapien
ctttgcattcatcttggctggggct

SEQ ID NO: 412216 - DNA, 25 bp, Homo sapien
tgcattcatcttggctggggctcac

SEQ ID NO: 412217 - DNA, 25 bp, Homo sapien
accaccccaataaatctgattcttt

SEQ ID NO: 412218 - DNA, 25 bp, Homo sapien
ccaccccaataaatctgattcttta

SEQ ID NO: 412219 - DNA, 25 bp, Homo sapien
ccccaataaatctgattctttattt

SEQ ID NO: 412220 - DNA, 25 bp, Homo sapien
cccaataaatctgattctttatttt

SEQ ID NO: 412221 - DNA, 25 bp, Homo sapien
tgcacatatgcataagtacttttac

SEQ ID NO: 412222 - DNA, 25 bp, Homo sapien
gcacatatgcataagtacttttaca

SEQ ID NO: 412223 - DNA, 25 bp, Homo sapien
cacatatgcataagtacttttacaa

SEQ ID NO: 412224 - DNA, 25 bp, Homo sapien
acatatgcataagtacttttacaag

SEQ ID NO: 412225 - DNA, 25 bp, Homo sapien
catatgcataagtacttttacaagt

SEQ ID NO: 412226 - DNA, 25 bp, Homo sapien
taatgtagttaggtgagtgtaaata

SEQ ID NO: 412227 - DNA, 25 bp, Homo sapien
gtagttaggtgagtgtaaataaatt

SEQ ID NO: 412228 - DNA, 25 bp, Homo sapien
cagaggctgcggtttgactttttaa

SEQ ID NO: 412229 - DNA, 25 bp, Homo sapien
ttatttgtatttgctagtctctgat

SEQ ID NO: 412230 - DNA, 25 bp, Homo sapien
gtatttgctagtctctgatttcctc

SEQ ID NO: 412231 - DNA, 25 bp, Homo sapien
tttgctagtctctgatttcctcaaa

SEQ ID NO: 412232 - DNA, 25 bp, Homo sapien
gatttcctcaaaacgaagtggaatt

SEQ ID NO: 412233 - DNA, 25 bp, Homo sapien
gaatttactactgttgtcagtatcg

SEQ ID NO: 412234 - DNA, 25 bp, Homo sapien
actgttgtcagtatcggtgttttga

SEQ ID NO: 412235 - DNA, 25 bp, Homo sapien
ggtgttttgaattggtgcctgccta

SEQ ID NO: 412236 - DNA, 25 bp, Homo sapien
gaattggtgcctgcctatagagata

SEQ ID NO: 412237 - DNA, 25 bp, Homo sapien
gtgcctgcctatagagatatattca

SEQ ID NO: 412238 - DNA, 25 bp, Homo sapien
cacagttcaaaagtcaggtgctgag

SEQ ID NO: 412239 - DNA, 25 bp, Homo sapien
gaaatttccagtgtcctaagagcct

SEQ ID NO: 412240 - DNA, 25 bp, Homo sapien
ctaagagcctctcatgaagcccagt

SEQ ID NO: 412241 - DNA, 25 bp, Homo sapien
agttctaataagtggcaagctgctc

SEQ ID NO: 412242 - DNA, 25 bp, Homo sapien
tcatctcctgggtcatcggactgat

SEQ ID NO: 412243 - DNA, 25 bp, Homo sapien
atcggactgattgctcaagttctgc

SEQ ID NO: 412244 - DNA, 25 bp, Homo sapien
agaacaactccatcagaacagctcc

SEQ ID NO: 412245 - DNA, 25 bp, Homo sapien
agaacagctccaccgggacttgtgg

SEQ ID NO: 412246 - DNA, 25 bp, Homo sapien
gacttgtgggcctaaattttcctgg

SEQ ID NO: 412247 - DNA, 25 bp, Homo sapien
tggcctaacgggtctgtctccaaac

SEQ ID NO: 412248 - DNA, 25 bp, Homo sapien
aaaccctctttcctaagagctgagc

SEQ ID NO: 412249 - DNA, 25 bp, Homo sapien
agagctgagcaaaccaaccataata

SEQ ID NO: 412250 - DNA, 25 bp, Homo sapien
gtacaggcagttaggtgctgaatga

SEQ ID NO: 412251 - DNA, 25 bp, Homo sapien
gtgctgaatgaagctgccatccttg

SEQ ID NO: 412252 - DNA, 25 bp, Homo sapien
tgctgcagcttctaactggtaaaaa

SEQ ID NO: 412253 - DNA, 25 bp, Homo sapien
tgggaaggttagaaaggcagccctc

SEQ ID NO: 412254 - DNA, 25 bp, Homo sapien
tgggcgcaaaggtgcctcatagcat

SEQ ID NO: 412255 - DNA, 25 bp, Homo sapien
agcattcagcacacacaaacctact

SEQ ID NO: 412256 - DNA, 25 bp, Homo sapien
acacaaacctactgcccacatttgg

SEQ ID NO: 412257 - DNA, 25 bp, Homo sapien
actgcccacatttgggctcagggtt

SEQ ID NO: 412258 - DNA, 25 bp, Homo sapien
atttgctagttctgctgccctctta

SEQ ID NO: 412259 - DNA, 25 bp, Homo sapien
gccctcttaagatctgactgccaaa

SEQ ID NO: 412260 - DNA, 25 bp, Homo sapien
gatctgactgccaaataaatcatcc

SEQ ID NO: 412261 - DNA, 25 bp, Homo sapien
caaagagccgccttgtcgctgtggg

SEQ ID NO: 412262 - DNA, 25 bp, Homo sapien
aaagagccgccttgtcgctgtgggc

SEQ ID NO: 412263 - DNA, 25 bp, Homo sapien
tcgctgtgggcgtcagggcttggct

SEQ ID NO: 412264 - DNA, 25 bp, Homo sapien
ggcttggctggctcagtgcacaacc

SEQ ID NO: 412265 - DNA, 25 bp, Homo sapien
tggctggctcagtgcacaacccaca

SEQ ID NO: 412266 - DNA, 25 bp, Homo sapien
tggctcagtgcacaacccacagtgg

SEQ ID NO: 412267 - DNA, 25 bp, Homo sapien
acagtggccttcagaggctcctcct

SEQ ID NO: 412268 - DNA, 25 bp, Homo sapien
agtggccttcagaggctcctcctgg

SEQ ID NO: 412269 - DNA, 25 bp, Homo sapien
gtttctcatgtaatgcagtgacgct

SEQ ID NO: 412270 - DNA, 25 bp, Homo sapien
ttctcatgtaatgcagtgacgctgt

SEQ ID NO: 412271 - DNA, 25 bp, Homo sapien
ctcatgtaatgcagtgacgctgtca

SEQ ID NO: 412272 - DNA, 25 bp, Homo sapien
acaatgacccaacacagcagttagt

SEQ ID NO: 412273 - DNA, 25 bp, Homo sapien
gttagtgcaagtacagtctctcaag

SEQ ID NO: 412274 - DNA, 25 bp, Homo sapien
aggagaattgattttgtggcacaaa

SEQ ID NO: 412275 - DNA, 25 bp, Homo sapien
tttactctttgcacgaaactttcat

SEQ ID NO: 412276 - DNA, 25 bp, Homo sapien
aactgttggatgttcatgtgtttga

SEQ ID NO: 412277 - DNA, 25 bp, Homo sapien
tgtttgaacttttgcgcaccggata

SEQ ID NO: 412278 - DNA, 25 bp, Homo sapien
gcaccggatagaccccttgtatata

SEQ ID NO: 412279 - DNA, 25 bp, Homo sapien
gttgcacatgtattatgtcgtctga

SEQ ID NO: 412280 - DNA, 25 bp, Homo sapien
gtcgtctgatactaaaatggtctta

SEQ ID NO: 412281 - DNA, 25 bp, Homo sapien
acaagtggacttgggccctattcag

SEQ ID NO: 412282 - DNA, 25 bp, Homo sapien
gacttgggccctattcaggcaagat

SEQ ID NO: 412283 - DNA, 25 bp, Homo sapien
ccccggcatagatgtgcacatcggt

SEQ ID NO: 412284 - DNA, 25 bp, Homo sapien
agatgtgcacatcggttttccagtg

SEQ ID NO: 412285 - DNA, 25 bp, Homo sapien
gtgcacatcggttttccagtgtgaa

SEQ ID NO: 412286 - DNA, 25 bp, Homo sapien
gtgaacaaaagattacgaaacctag

SEQ ID NO: 412287 - DNA, 25 bp, Homo sapien
ttggttccgtgtaagtagttgacta

SEQ ID NO: 412288 - DNA, 25 bp, Homo sapien
gactacgtgttttagaactgtgctg

SEQ ID NO: 412289 - DNA, 25 bp, Homo sapien
gtgctgaagacatctgtaagactat

SEQ ID NO: 412290 - DNA, 25 bp, Homo sapien
gacatctgtaagactattttgtggg

SEQ ID NO: 412291 - DNA, 25 bp, Homo sapien
agcattttatatgatccttagcaca

SEQ ID NO: 412292 - DNA, 25 bp, Homo sapien
tatatgatccttagcacatttttaa

SEQ ID NO: 412293 - DNA, 25 bp, Homo sapien
taagttttatcttaagggagacgcg

SEQ ID NO: 412294 - DNA, 25 bp, Homo sapien
ttagtgagcattaacatttggagtc

SEQ ID NO: 412295 - DNA, 25 bp, Homo sapien
taacatttggagtcatctatgacaa

SEQ ID NO: 412296 - DNA, 25 bp, Homo sapien
gtcatctatgacaaaactccacagt

SEQ ID NO: 412297 - DNA, 25 bp, Homo sapien
aaaactccacagtagcccatggtgt

SEQ ID NO: 412298 - DNA, 25 bp, Homo sapien
gtcatttaccaagaacatgtcaact

SEQ ID NO: 412299 - DNA, 25 bp, Homo sapien
taccaagaacatgtcaactcaaatt

SEQ ID NO: 412300 - DNA, 25 bp, Homo sapien
ctcaaattgtttttcagggttcact

SEQ ID NO: 412301 - DNA, 25 bp, Homo sapien
tttagcttaggaaaatcaatggtta

SEQ ID NO: 412302 - DNA, 25 bp, Homo sapien
ttctgtaaaagttatcacctggtta

SEQ ID NO: 412303 - DNA, 25 bp, Homo sapien
gcagaacttttacaagatgtgaatt

SEQ ID NO: 412304 - DNA, 25 bp, Homo sapien
acaagatgtgaatttttagtgagca

SEQ ID NO: 412305 - DNA, 25 bp, Homo sapien
ttcggatttttattgactcaaaata

SEQ ID NO: 412306 - DNA, 25 bp, Homo sapien
tcaaaatagtgccattccccttaat

SEQ ID NO: 412307 - DNA, 25 bp, Homo sapien
aatagtgccattccccttaatgaaa

SEQ ID NO: 412308 - DNA, 25 bp, Homo sapien
gtgccattccccttaatgaaataga

SEQ ID NO: 412309 - DNA, 25 bp, Homo sapien
tttttcattgtaacccccaaatgag

SEQ ID NO: 412310 - DNA, 25 bp, Homo sapien
cccaaatgagaatcatctacctgat

SEQ ID NO: 412311 - DNA, 25 bp, Homo sapien
tcatctacctgattcttgtaccaaa

SEQ ID NO: 412312 - DNA, 25 bp, Homo sapien
tctacctgattcttgtaccaaaaaa

SEQ ID NO: 412313 - DNA, 25 bp, Homo sapien
agagagggtctcttgtcaacgcaag

SEQ ID NO: 412314 - DNA, 25 bp, Homo sapien
gggtctcttgtcaacgcaagactgg

SEQ ID NO: 412315 - DNA, 25 bp, Homo sapien
tcaacgcaagactgggagtggcagt

SEQ ID NO: 412316 - DNA, 25 bp, Homo sapien
tccgctgggagaccttccaaaagca

SEQ ID NO: 412317 - DNA, 25 bp, Homo sapien
tgccgtccacggagatctccatgta

SEQ ID NO: 412318 - DNA, 25 bp, Homo sapien
gccacctacaactccgacagggata

SEQ ID NO: 412319 - DNA, 25 bp, Homo sapien
actccgacagggataacagcttcct

SEQ ID NO: 412320 - DNA, 25 bp, Homo sapien
gacagggataacagcttcctccagg

SEQ ID NO: 412321 - DNA, 25 bp, Homo sapien
agggataacagcttcctccaggttc

SEQ ID NO: 412322 - DNA, 25 bp, Homo sapien
ctccaggttcacaactgtatccaga

SEQ ID NO: 412323 - DNA, 25 bp, Homo sapien
aggagaacaaggactctctccactc

SEQ ID NO: 412324 - DNA, 25 bp, Homo sapien
agaacaaggactctctccactccaa

SEQ ID NO: 412325 - DNA, 25 bp, Homo sapien
aagaccgcgggcctcgccagaagac

SEQ ID NO: 412326 - DNA, 25 bp, Homo sapien
gcctcgccagaagaccgcgggagga

SEQ ID NO: 412327 - DNA, 25 bp, Homo sapien
gtgccttcctgcaggtgtgccagag

SEQ ID NO: 412328 - DNA, 25 bp, Homo sapien
ggtaatgagccattatgctccgtca

SEQ ID NO: 412329 - DNA, 25 bp, Homo sapien
aatgagccattatgctccgtcagtc

SEQ ID NO: 412330 - DNA, 25 bp, Homo sapien
tgagccattatgctccgtcagtcat

SEQ ID NO: 412331 - DNA, 25 bp, Homo sapien
ctgtaaccatgcatagtcatcctgt

SEQ ID NO: 412332 - DNA, 25 bp, Homo sapien
gtaaccatgcatagtcatcctgttt

SEQ ID NO: 412333 - DNA, 25 bp, Homo sapien
tttctgccccgggtttccagaatgg

SEQ ID NO: 412334 - DNA, 25 bp, Homo sapien
taatatccacttcagcagctacact

SEQ ID NO: 412335 - DNA, 25 bp, Homo sapien
aatatccacttcagcagctacacta

SEQ ID NO: 412336 - DNA, 25 bp, Homo sapien
ctgatcatggtgtattccatggtgc

SEQ ID NO: 412337 - DNA, 25 bp, Homo sapien
gtgtattccatggtgcataacagac

SEQ ID NO: 412338 - DNA, 25 bp, Homo sapien
tttccctgaaactttgcgtggcatg

SEQ ID NO: 412339 - DNA, 25 bp, Homo sapien
gttgcagaaactggtgtctacacat

SEQ ID NO: 412340 - DNA, 25 bp, Homo sapien
agtgtactgtttacacctatttgtg

SEQ ID NO: 412341 - DNA, 25 bp, Homo sapien
tacacctatttgtgatgcacccatc

SEQ ID NO: 412342 - DNA, 25 bp, Homo sapien
atttgtgatgcacccatcgtgtttt

SEQ ID NO: 412343 - DNA, 25 bp, Homo sapien
acccatcgtgtttttctccatggac

SEQ ID NO: 412344 - DNA, 25 bp, Homo sapien
tttttctccatggaccacctattaa

SEQ ID NO: 412345 - DNA, 25 bp, Homo sapien
atggaccacctattaagcttcctgc

SEQ ID NO: 412346 - DNA, 25 bp, Homo sapien
taagcttcctgctggagcgctcttg

SEQ ID NO: 412347 - DNA, 25 bp, Homo sapien
tgggccacatcctgttgtaaatcgg

SEQ ID NO: 412348 - DNA, 25 bp, Homo sapien
gttgtaaatcggtgctacttgtggg

SEQ ID NO: 412349 - DNA, 25 bp, Homo sapien
ggcctcgccatgaggctcttcctgt

SEQ ID NO: 412350 - DNA, 25 bp, Homo sapien
tcgccatgaggctcttcctgtcgct

SEQ ID NO: 412351 - DNA, 25 bp, Homo sapien
tcccggtcctggtggtggttctgtc

SEQ ID NO: 412352 - DNA, 25 bp, Homo sapien
gagatcgcaccatttgacacagcaa

SEQ ID NO: 412353 - DNA, 25 bp, Homo sapien
agatcgcaccatttgacacagcaag

SEQ ID NO: 412354 - DNA, 25 bp, Homo sapien
gatcgcaccatttgacacagcaagt

SEQ ID NO: 412355 - DNA, 25 bp, Homo sapien
tcgcaccatttgacacagcaagtct

SEQ ID NO: 412356 - DNA, 25 bp, Homo sapien
gcaccatttgacacagcaagtctcc

SEQ ID NO: 412357 - DNA, 25 bp, Homo sapien
accatttgacacagcaagtctccgt

SEQ ID NO: 412358 - DNA, 25 bp, Homo sapien
tttgacacagcaagtctccgtctca

SEQ ID NO: 412359 - DNA, 25 bp, Homo sapien
acaacaaccaaattttgcacccctg

SEQ ID NO: 412360 - DNA, 25 bp, Homo sapien
tagatggaatggagtaactgctaat

SEQ ID NO: 412361 - DNA, 25 bp, Homo sapien
aactgctaatgggtgtagggttcct

SEQ ID NO: 412362 - DNA, 25 bp, Homo sapien
gggtgatgaaaatatcctacagtta

SEQ ID NO: 412363 - DNA, 25 bp, Homo sapien
atatcctacagttagcttgtggtgt

SEQ ID NO: 412364 - DNA, 25 bp, Homo sapien
gtggtgtaggctgcacaactcttga

SEQ ID NO: 412365 - DNA, 25 bp, Homo sapien
ggtgtaggctgcacaactcttgaat

SEQ ID NO: 412366 - DNA, 25 bp, Homo sapien
tgtaggctgcacaactcttgaatat

SEQ ID NO: 412367 - DNA, 25 bp, Homo sapien
ttcaaatccactgaactgtacattt

SEQ ID NO: 412368 - DNA, 25 bp, Homo sapien
aaatgtaaggtatgaattgtatctc

SEQ ID NO: 412369 - DNA, 25 bp, Homo sapien
aaaactcttgaggtgtaggactgaa

SEQ ID NO: 412370 - DNA, 25 bp, Homo sapien
ttgcctaggctggctgtagatggaa

SEQ ID NO: 412371 - DNA, 25 bp, Homo sapien
ttcctgtgtaaaactaaacctgtag

SEQ ID NO: 412372 - DNA, 25 bp, Homo sapien
agcccctttagaattaatctggatt

SEQ ID NO: 412373 - DNA, 25 bp, Homo sapien
aatcctgtttgcattagagctcact

SEQ ID NO: 412374 - DNA, 25 bp, Homo sapien
gcattagagctcactgtctttttgt

SEQ ID NO: 412375 - DNA, 25 bp, Homo sapien
tttcaaattacaattgctgatggac

SEQ ID NO: 412376 - DNA, 25 bp, Homo sapien
gatggacaatttgtattgcagcgag

SEQ ID NO: 412377 - DNA, 25 bp, Homo sapien
tgtattgcagcgagaacaacagaat

SEQ ID NO: 412378 - DNA, 25 bp, Homo sapien
aagaaatgtatctctgtgcggctat

SEQ ID NO: 412379 - DNA, 25 bp, Homo sapien
atctctgtgcggctatacatataca

SEQ ID NO: 412380 - DNA, 25 bp, Homo sapien
atctggatttgtttcctcaagttcc

SEQ ID NO: 412381 - DNA, 25 bp, Homo sapien
gatttgtttcctcaagttcctgcct

SEQ ID NO: 412382 - DNA, 25 bp, Homo sapien
ggcctcgccatgaggctcttcctgt

SEQ ID NO: 412383 - DNA, 25 bp, Homo sapien
gcctcgccatgaggctcttcctgtc

SEQ ID NO: 412384 - DNA, 25 bp, Homo sapien
tcgccatgaggctcttcctgtcgct

SEQ ID NO: 412385 - DNA, 25 bp, Homo sapien
tcctgtcgctcccggtcctggtggt

SEQ ID NO: 412386 - DNA, 25 bp, Homo sapien
ctgtcgctcccggtcctggtggtgg

SEQ ID NO: 412387 - DNA, 25 bp, Homo sapien
gtcgctcccggtcctggtggtggtt

SEQ ID NO: 412388 - DNA, 25 bp, Homo sapien
tcgctcccggtcctggtggtggttc

SEQ ID NO: 412389 - DNA, 25 bp, Homo sapien
cgctcccggtcctggtggtggttct

SEQ ID NO: 412390 - DNA, 25 bp, Homo sapien
ctcccggtcctggtggtggttctgt

SEQ ID NO: 412391 - DNA, 25 bp, Homo sapien
tcccggtcctggtggtggttctgtc

SEQ ID NO: 412392 - DNA, 25 bp, Homo sapien
cccggtcctggtggtggttctgtcg

SEQ ID NO: 412393 - DNA, 25 bp, Homo sapien
gacaactgtgttgtttgctttgaca

SEQ ID NO: 412394 - DNA, 25 bp, Homo sapien
tgctttgacacatacaaaccccaag

SEQ ID NO: 412395 - DNA, 25 bp, Homo sapien
aaaccccaagatgtagtacgcattt

SEQ ID NO: 412396 - DNA, 25 bp, Homo sapien
aaacattttttccataaggcatgca

SEQ ID NO: 412397 - DNA, 25 bp, Homo sapien
tccataaggcatgcattgacccctg

SEQ ID NO: 412398 - DNA, 25 bp, Homo sapien
attgacccctggcttttagcccata

SEQ ID NO: 412399 - DNA, 25 bp, Homo sapien
ggcttttagcccataggacatgtcc

SEQ ID NO: 412400 - DNA, 25 bp, Homo sapien
gtcccatgtgcaagtgtgacatcct

SEQ ID NO: 412401 - DNA, 25 bp, Homo sapien
agatgtaaccagatctttccaaata

SEQ ID NO: 412402 - DNA, 25 bp, Homo sapien
gaaagctattgaccagcttcaactg

SEQ ID NO: 412403 - DNA, 25 bp, Homo sapien
agcttcaactgcgagttctcaaaga

SEQ ID NO: 412404 - DNA, 25 bp, Homo sapien
agattccactagaaggaaaccaaag

SEQ ID NO: 412405 - DNA, 25 bp, Homo sapien
gctcagctgatggaccgggatgata

SEQ ID NO: 412406 - DNA, 25 bp, Homo sapien
actgggaggaaatgaggtgaaacac

SEQ ID NO: 412407 - DNA, 25 bp, Homo sapien
ctgatggaccgggatgatattggaa

SEQ ID NO: 412408 - DNA, 25 bp, Homo sapien
tagggaatgaaaaccgtacagagta

SEQ ID NO: 412409 - DNA, 25 bp, Homo sapien
aaaccgtacagagtagaaacacctg

SEQ ID NO: 412410 - DNA, 25 bp, Homo sapien
gaaacacctgaaagcagttctggaa

SEQ ID NO: 412411 - DNA, 25 bp, Homo sapien
ggaaactccacatgctcctgctgta

SEQ ID NO: 412412 - DNA, 25 bp, Homo sapien
aggctgccagcctgaagacttacct

SEQ ID NO: 412413 - DNA, 25 bp, Homo sapien
agcctgaagacttacctggaaacat

SEQ ID NO: 412414 - DNA, 25 bp, Homo sapien
ggaaacattttctcgttggtctggt

SEQ ID NO: 412415 - DNA, 25 bp, Homo sapien
agaaccctatgtgggtgtggtcact

SEQ ID NO: 412416 - DNA, 25 bp, Homo sapien
tgtggtcactggtagatggtaagca

SEQ ID NO: 412417 - DNA, 25 bp, Homo sapien
taagcagggtgctcacacaggtgtt

SEQ ID NO: 412418 - DNA, 25 bp, Homo sapien
tataacctagcctacttcttttcag

SEQ ID NO: 412419 - DNA, 25 bp, Homo sapien
caggtacggtggcttacacaagtaa

SEQ ID NO: 412420 - DNA, 25 bp, Homo sapien
ttcttttcagcagagatccatcagt

SEQ ID NO: 412421 - DNA, 25 bp, Homo sapien
cttggtaggttttccatcacagcta

SEQ ID NO: 412422 - DNA, 25 bp, Homo sapien
aggttttccatcacagctaactagt

SEQ ID NO: 412423 - DNA, 25 bp, Homo sapien
atcacagctaactagtgcactttgt

SEQ ID NO: 412424 - DNA, 25 bp, Homo sapien
actagtgcactttgttggctctgta

SEQ ID NO: 412425 - DNA, 25 bp, Homo sapien
tgttggctctgtagtctcactgaaa

SEQ ID NO: 412426 - DNA, 25 bp, Homo sapien
gatacatggcaggtaactgtttatg

SEQ ID NO: 412427 - DNA, 25 bp, Homo sapien
aaaagtacagtgctgttacgtggca

SEQ ID NO: 412428 - DNA, 25 bp, Homo sapien
gttacgtggcactgtacagtcatgt

SEQ ID NO: 412429 - DNA, 25 bp, Homo sapien
agtcatgtgccacgtaacagcgtct

SEQ ID NO: 412430 - DNA, 25 bp, Homo sapien
acagcgtctgggtcagtgacggaca

SEQ ID NO: 412431 - DNA, 25 bp, Homo sapien
gacggacacttacctgacagcggat

SEQ ID NO: 412432 - DNA, 25 bp, Homo sapien
gacagcggatccacaatattctcgt

SEQ ID NO: 412433 - DNA, 25 bp, Homo sapien
gatccacaatattctcgtgcagtgt

SEQ ID NO: 412434 - DNA, 25 bp, Homo sapien
tctcgtgcagtgtgtttggaatcct

SEQ ID NO: 412435 - DNA, 25 bp, Homo sapien
tttggaatcctggtctgggctctcg

SEQ ID NO: 412436 - DNA, 25 bp, Homo sapien
gtgagtgatgttcagtcatgctgct

SEQ ID NO: 412437 - DNA, 25 bp, Homo sapien
cgagctcgagcaactattatccact

SEQ ID NO: 412438 - DNA, 25 bp, Homo sapien
gagcaactattatccacttcgctcg

SEQ ID NO: 412439 - DNA, 25 bp, Homo sapien
tattatccacttcgctcgcattact

SEQ ID NO: 412440 - DNA, 25 bp, Homo sapien
gcgcactcgcaaaacgcggactgga

SEQ ID NO: 412441 - DNA, 25 bp, Homo sapien
tcgcaaaacgcggactggactcgtc

SEQ ID NO: 412442 - DNA, 25 bp, Homo sapien
ttttcctctctagcccggatatggg

SEQ ID NO: 412443 - DNA, 25 bp, Homo sapien
ctctctagcccggatatgggtaaat

SEQ ID NO: 412444 - DNA, 25 bp, Homo sapien
tgggtaaataaacgactagctgagc

SEQ ID NO: 412445 - DNA, 25 bp, Homo sapien
aaacgactagctgagcctatcgggc

SEQ ID NO: 412446 - DNA, 25 bp, Homo sapien
tagctgagcctatcgggcccagcat

SEQ ID NO: 412447 - DNA, 25 bp, Homo sapien
cctatcgggcccagcatggcttgag

SEQ ID NO: 412448 - DNA, 25 bp, Homo sapien
cgagatcgcaccatttgacacagca

SEQ ID NO: 412449 - DNA, 25 bp, Homo sapien
gagatcgcaccatttgacacagcaa

SEQ ID NO: 412450 - DNA, 25 bp, Homo sapien
agatcgcaccatttgacacagcaag

SEQ ID NO: 412451 - DNA, 25 bp, Homo sapien
gatcgcaccatttgacacagcaagt

SEQ ID NO: 412452 - DNA, 25 bp, Homo sapien
atcgcaccatttgacacagcaagtc

SEQ ID NO: 412453 - DNA, 25 bp, Homo sapien
tcgcaccatttgacacagcaagtct

SEQ ID NO: 412454 - DNA, 25 bp, Homo sapien
cgcaccatttgacacagcaagtctc

SEQ ID NO: 412455 - DNA, 25 bp, Homo sapien
gcaccatttgacacagcaagtctcc

SEQ ID NO: 412456 - DNA, 25 bp, Homo sapien
accatttgacacagcaagtctccgt

SEQ ID NO: 412457 - DNA, 25 bp, Homo sapien
caacaaccaaattttgcacccctgc

SEQ ID NO: 412458 - DNA, 25 bp, Homo sapien
acaaccaaattttgcacccctgcct

SEQ ID NO: 412459 - DNA, 25 bp, Homo sapien
atgttcacgtaatagacatctttac

SEQ ID NO: 412460 - DNA, 25 bp, Homo sapien
aatagacatctttacatatcagtac

SEQ ID NO: 412461 - DNA, 25 bp, Homo sapien
tcagtacatatagatatcggtatca

SEQ ID NO: 412462 - DNA, 25 bp, Homo sapien
gtaaatatctgtaaacagacctgtt

SEQ ID NO: 412463 - DNA, 25 bp, Homo sapien
agacctgttttggatgcaccaccta

SEQ ID NO: 412464 - DNA, 25 bp, Homo sapien
ttggatgcaccacctacagaattca

SEQ ID NO: 412465 - DNA, 25 bp, Homo sapien
tgcaccacctacagaattcatcctt

SEQ ID NO: 412466 - DNA, 25 bp, Homo sapien
aattcatccttcactccatcagaaa

SEQ ID NO: 412467 - DNA, 25 bp, Homo sapien
atccttcactccatcagaaatattg

SEQ ID NO: 412468 - DNA, 25 bp, Homo sapien
agaaatattgaccttaaccgtcagt

SEQ ID NO: 412469 - DNA, 25 bp, Homo sapien
tgaccttaaccgtcagtaccttcaa

SEQ ID NO: 412470 - DNA, 25 bp, Homo sapien
tggaagcagaagctgtgacaagttt

SEQ ID NO: 412471 - DNA, 25 bp, Homo sapien
gctgtgacaagtttagtagtcccaa

SEQ ID NO: 412472 - DNA, 25 bp, Homo sapien
gacaagtttagtagtcccaaaatgg

SEQ ID NO: 412473 - DNA, 25 bp, Homo sapien
tagtcccaaaatgggttatatccct

SEQ ID NO: 412474 - DNA, 25 bp, Homo sapien
agatagctgatctcacatgcttccc

SEQ ID NO: 412475 - DNA, 25 bp, Homo sapien
gatctcacatgcttcccaggcaggg

SEQ ID NO: 412476 - DNA, 25 bp, Homo sapien
ggtgggagtcaaacccgggtgacag

SEQ ID NO: 412477 - DNA, 25 bp, Homo sapien
cctgtttgaggttgtggctgatccc

SEQ ID NO: 412478 - DNA, 25 bp, Homo sapien
ctgatccctctctggtattagtttt

SEQ ID NO: 412479 - DNA, 25 bp, Homo sapien
gtattagtttttcccctgggagcag

SEQ ID NO: 412480 - DNA, 25 bp, Homo sapien
ttcccctgggagcaggaagccctag

SEQ ID NO: 412481 - DNA, 25 bp, Homo sapien
agctcactatgaacgctgacagaag

SEQ ID NO: 412482 - DNA, 25 bp, Homo sapien
acagaagagtgttttcatgtctata

SEQ ID NO: 412483 - DNA, 25 bp, Homo sapien
gatacattccttttactgaaccttg

SEQ ID NO: 412484 - DNA, 25 bp, Homo sapien
ctgaaccttgaattgatcctaagat

SEQ ID NO: 412485 - DNA, 25 bp, Homo sapien
gttacctcctaacagcactacaaag

SEQ ID NO: 412486 - DNA, 25 bp, Homo sapien
attttaccattaggactcaatttga

SEQ ID NO: 412487 - DNA, 25 bp, Homo sapien
taatgcttctcaagttctccactat

SEQ ID NO: 412488 - DNA, 25 bp, Homo sapien
ttcccagaaactgcctagggctttg

SEQ ID NO: 412489 - DNA, 25 bp, Homo sapien
ctgcctagggctttgagtcatttta

SEQ ID NO: 412490 - DNA, 25 bp, Homo sapien
gaagctaggtcttaatgcgtaggca

SEQ ID NO: 412491 - DNA, 25 bp, Homo sapien
ttaatgcgtaggcaacctcccagct

SEQ ID NO: 412492 - DNA, 25 bp, Homo sapien
agctacttgacaggctgaagatggg

SEQ ID NO: 412493 - DNA, 25 bp, Homo sapien
gctacttgacaggctgaagatggga

SEQ ID NO: 412494 - DNA, 25 bp, Homo sapien
tacttgacaggctgaagatgggagg

SEQ ID NO: 412495 - DNA, 25 bp, Homo sapien
cttgacaggctgaagatgggaggat

SEQ ID NO: 412496 - DNA, 25 bp, Homo sapien
tggtcacccttaaaggtgggaagag

SEQ ID NO: 412497 - DNA, 25 bp, Homo sapien
tcacccttaaaggtgggaagagttg

SEQ ID NO: 412498 - DNA, 25 bp, Homo sapien
gaagagttgaggtataagtagtaga

SEQ ID NO: 412499 - DNA, 25 bp, Homo sapien
aagagttgaggtataagtagtagat

SEQ ID NO: 412500 - DNA, 25 bp, Homo sapien
atgatttaatagttattcttcttgg

SEQ ID NO: 412501 - DNA, 25 bp, Homo sapien
tgatttaatagttattcttcttgga

SEQ ID NO: 412502 - DNA, 25 bp, Homo sapien
gatttaatagttattcttcttggaa

SEQ ID NO: 412503 - DNA, 25 bp, Homo sapien
tgggactgacactggcagatccatc

SEQ ID NO: 412504 - DNA, 25 bp, Homo sapien
ccgttccattgtttgctgacttgca

SEQ ID NO: 412505 - DNA, 25 bp, Homo sapien
gttttcctatgtataattgtctcct

SEQ ID NO: 412506 - DNA, 25 bp, Homo sapien
ttcctatgtataattgtctcctccc

SEQ ID NO: 412507 - DNA, 25 bp, Homo sapien
tcctatgtataattgtctcctccca

SEQ ID NO: 412508 - DNA, 25 bp, Homo sapien
cctatgtataattgtctcctcccac

SEQ ID NO: 412509 - DNA, 25 bp, Homo sapien
tatgtataattgtctcctcccaccc

SEQ ID NO: 412510 - DNA, 25 bp, Homo sapien
actcaccccagctgctttccacatt

SEQ ID NO: 412511 - DNA, 25 bp, Homo sapien
ctttgattttcagcagtctgcccat

SEQ ID NO: 412512 - DNA, 25 bp, Homo sapien
aataggactttctttgcattcatct

SEQ ID NO: 412513 - DNA, 25 bp, Homo sapien
ttgcattcatcttggctggggctca

SEQ ID NO: 412514 - DNA, 25 bp, Homo sapien
gttatgataggttcttcttagtgca

SEQ ID NO: 412515 - DNA, 25 bp, Homo sapien
gataggttcttcttagtgcaactta

SEQ ID NO: 412516 - DNA, 25 bp, Homo sapien
ggttcttcttagtgcaacttatcac

SEQ ID NO: 412517 - DNA, 25 bp, Homo sapien
gtgcaacttatcacgatacacatga

SEQ ID NO: 412518 - DNA, 25 bp, Homo sapien
atacacatgatgtctgtttgtccca

SEQ ID NO: 412519 - DNA, 25 bp, Homo sapien
acacatgatgtctgtttgtcccatt

SEQ ID NO: 412520 - DNA, 25 bp, Homo sapien
ggtgatgttaacttccgtaacttgc

SEQ ID NO: 412521 - DNA, 25 bp, Homo sapien
ttaacttccgtaacttgctccattg

SEQ ID NO: 412522 - DNA, 25 bp, Homo sapien
acttccgtaacttgctccattgaaa

SEQ ID NO: 412523 - DNA, 25 bp, Homo sapien
taacttgctccattgaaaagtaccc

SEQ ID NO: 412524 - DNA, 25 bp, Homo sapien
cttcctttctgtaattaagtaatct

SEQ ID NO: 412525 - DNA, 25 bp, Homo sapien
gagattcttcatttcaggatttaaa

SEQ ID NO: 412526 - DNA, 25 bp, Homo sapien
aaaactatagcagtccatcttaagg

SEQ ID NO: 412527 - DNA, 25 bp, Homo sapien
gaaagtgtaactgccatggccacaa

SEQ ID NO: 412528 - DNA, 25 bp, Homo sapien
atggccacaagtctgctagttgcac

SEQ ID NO: 412529 - DNA, 25 bp, Homo sapien
tgctagttgcacttgaatgctctat

SEQ ID NO: 412530 - DNA, 25 bp, Homo sapien
gaatgctctatcagggttgtttatt

SEQ ID NO: 412531 - DNA, 25 bp, Homo sapien
tattaccctttctacgttctggact

SEQ ID NO: 412532 - DNA, 25 bp, Homo sapien
tacgttctggactccttgccgagac

SEQ ID NO: 412533 - DNA, 25 bp, Homo sapien
tccttgccgagactgtttaacttga

SEQ ID NO: 412534 - DNA, 25 bp, Homo sapien
atgccagtgcatcagaacctaagag

SEQ ID NO: 412535 - DNA, 25 bp, Homo sapien
gagtggtcaaatattatgtgcaatt

SEQ ID NO: 412536 - DNA, 25 bp, Homo sapien
ggccttttatcccagtgacggatga

SEQ ID NO: 412537 - DNA, 25 bp, Homo sapien
tgcagaaaccatgaccaaaaccaaa

SEQ ID NO: 412538 - DNA, 25 bp, Homo sapien
aataaagcagcaggtccggagcctc

SEQ ID NO: 412539 - DNA, 25 bp, Homo sapien
gagcctcaggccttggatgagttca

SEQ ID NO: 412540 - DNA, 25 bp, Homo sapien
ggatgagttcaccagtctgctgatt

SEQ ID NO: 412541 - DNA, 25 bp, Homo sapien
tgctgattgcggatgacactcgtgt

SEQ ID NO: 412542 - DNA, 25 bp, Homo sapien
acactcgtgtggtggtagacctgct

SEQ ID NO: 412543 - DNA, 25 bp, Homo sapien
tggtggtagacctgctcaagctgtc

SEQ ID NO: 412544 - DNA, 25 bp, Homo sapien
tcaagctgtcagtgtgcagccgggc

SEQ ID NO: 412545 - DNA, 25 bp, Homo sapien
agggatgtgctctccgcggtgcttt

SEQ ID NO: 412546 - DNA, 25 bp, Homo sapien
gaccgcctacccacaggtggcagat

SEQ ID NO: 412547 - DNA, 25 bp, Homo sapien
gtgtaaatactgcaggtaaccgcaa

SEQ ID NO: 412548 - DNA, 25 bp, Homo sapien
ggtaaccgcaatctaagttagccaa

SEQ ID NO: 412549 - DNA, 25 bp, Homo sapien
ctaagttagccaaaaagcagctttt

SEQ ID NO: 412550 - DNA, 25 bp, Homo sapien
agctttttttcccatactgtatgta

SEQ ID NO: 412551 - DNA, 25 bp, Homo sapien
ggtactggaatctaattaatatctc

SEQ ID NO: 412552 - DNA, 25 bp, Homo sapien
taatatctcttaggtatcaacaaaa

SEQ ID NO: 412553 - DNA, 25 bp, Homo sapien
ggaatgagaatttaggccttagctt

SEQ ID NO: 412554 - DNA, 25 bp, Homo sapien
aggccttagcttccatggtgatttt

SEQ ID NO: 412555 - DNA, 25 bp, Homo sapien
cttagcttccatggtgatttttagt

SEQ ID NO: 412556 - DNA, 25 bp, Homo sapien
aattgtgatgctatttgtcaactgg

SEQ ID NO: 412557 - DNA, 25 bp, Homo sapien
gatgctatttgtcaactggatataa

SEQ ID NO: 412558 - DNA, 25 bp, Homo sapien
aagcatctagttgaacactctgtta

SEQ ID NO: 412559 - DNA, 25 bp, Homo sapien
gaaaccagcattcactggctgttcc

SEQ ID NO: 412560 - DNA, 25 bp, Homo sapien
ggaactcaggtggattcataatttg

SEQ ID NO: 412561 - DNA, 25 bp, Homo sapien
ctcaggtggattcataatttgttct

SEQ ID NO: 412562 - DNA, 25 bp, Homo sapien
gttctgtttccttgctcttaggaaa

SEQ ID NO: 412563 - DNA, 25 bp, Homo sapien
gacagctcataattggttgtatttc

SEQ ID NO: 412564 - DNA, 25 bp, Homo sapien
cataattggttgtatttcttaggat

SEQ ID NO: 412565 - DNA, 25 bp, Homo sapien
ggttgtatttcttaggatatttgca

SEQ ID NO: 412566 - DNA, 25 bp, Homo sapien
caatgctttcttttcttggtataat

SEQ ID NO: 412567 - DNA, 25 bp, Homo sapien
aattgtctataattctactactcat

SEQ ID NO: 412568 - DNA, 25 bp, Homo sapien
ataattctactactcatataaaacc

SEQ ID NO: 412569 - DNA, 25 bp, Homo sapien
ctcagccaagttgcaaaagccactt

SEQ ID NO: 412570 - DNA, 25 bp, Homo sapien
agccacttggaaactggaaccaaag

SEQ ID NO: 412571 - DNA, 25 bp, Homo sapien
ccaaagatcaagaaactgtttgctc

SEQ ID NO: 412572 - DNA, 25 bp, Homo sapien
ctaaagctacagaaggagataatac

SEQ ID NO: 412573 - DNA, 25 bp, Homo sapien
ttggagcatttgtaggacacagaga

SEQ ID NO: 412574 - DNA, 25 bp, Homo sapien
tgtaggacacagagatagcatggat

SEQ ID NO: 412575 - DNA, 25 bp, Homo sapien
atactatccaataacaatacttctg

SEQ ID NO: 412576 - DNA, 25 bp, Homo sapien
atacttctgaaaacactttgaaacg

SEQ ID NO: 412577 - DNA, 25 bp, Homo sapien
gagttctcttgctggatttactgac

SEQ ID NO: 412578 - DNA, 25 bp, Homo sapien
tgctggatttactgactgtcacaga

SEQ ID NO: 412579 - DNA, 25 bp, Homo sapien
tactgactgtcacagaacttccatt

SEQ ID NO: 412580 - DNA, 25 bp, Homo sapien
ggaggcggaggaggcagaccacctg

SEQ ID NO: 412581 - DNA, 25 bp, Homo sapien
cagaccacctgaggtttggcagttc

SEQ ID NO: 412582 - DNA, 25 bp, Homo sapien
gaccacctgaggtttggcagttcaa

SEQ ID NO: 412583 - DNA, 25 bp, Homo sapien
ctgaggtttggcagttcaagatcca

SEQ ID NO: 412584 - DNA, 25 bp, Homo sapien
gaggtttggcagttcaagatccagc

SEQ ID NO: 412585 - DNA, 25 bp, Homo sapien
ggtttggcagttcaagatccagcct

SEQ ID NO: 412586 - DNA, 25 bp, Homo sapien
tgtaatcccacgtactcggacgctg

SEQ ID NO: 412587 - DNA, 25 bp, Homo sapien
taatcccacgtactcggacgctgag

SEQ ID NO: 412588 - DNA, 25 bp, Homo sapien
aatcccacgtactcggacgctgagg

SEQ ID NO: 412589 - DNA, 25 bp, Homo sapien
atcccacgtactcggacgctgaggc

SEQ ID NO: 412590 - DNA, 25 bp, Homo sapien
ccacgtactcggacgctgaggcagg

SEQ ID NO: 412591 - DNA, 25 bp, Homo sapien
tggtaatgagccattatgctccgtc

SEQ ID NO: 412592 - DNA, 25 bp, Homo sapien
ggtaatgagccattatgctccgtca

SEQ ID NO: 412593 - DNA, 25 bp, Homo sapien
taatgagccattatgctccgtcagt

SEQ ID NO: 412594 - DNA, 25 bp, Homo sapien
atgagccattatgctccgtcagtca

SEQ ID NO: 412595 - DNA, 25 bp, Homo sapien
tgagccattatgctccgtcagtcat

SEQ ID NO: 412596 - DNA, 25 bp, Homo sapien
ctgtaaccatgcatagtcatcctgt

SEQ ID NO: 412597 - DNA, 25 bp, Homo sapien
gtaaccatgcatagtcatcctgttt

SEQ ID NO: 412598 - DNA, 25 bp, Homo sapien
tttctgccccgggtttccagaatgg

SEQ ID NO: 412599 - DNA, 25 bp, Homo sapien
taatatccacttcagcagctacact

SEQ ID NO: 412600 - DNA, 25 bp, Homo sapien
aatatccacttcagcagctacacta

SEQ ID NO: 412601 - DNA, 25 bp, Homo sapien
ctgatcatggtgtattccatggtgc

SEQ ID NO: 412602 - DNA, 25 bp, Homo sapien
tggtcacccttaaaggtgggaagag

SEQ ID NO: 412603 - DNA, 25 bp, Homo sapien
tcacccttaaaggtgggaagagttg

SEQ ID NO: 412604 - DNA, 25 bp, Homo sapien
aggtgggaagagttgaggtataagt

SEQ ID NO: 412605 - DNA, 25 bp, Homo sapien
gaagagttgaggtataagtagtaga

SEQ ID NO: 412606 - DNA, 25 bp, Homo sapien
aagagttgaggtataagtagtagat

SEQ ID NO: 412607 - DNA, 25 bp, Homo sapien
gatatgatttaatagttattcttct

SEQ ID NO: 412608 - DNA, 25 bp, Homo sapien
atatgatttaatagttattcttctt

SEQ ID NO: 412609 - DNA, 25 bp, Homo sapien
tatgatttaatagttattcttcttg

SEQ ID NO: 412610 - DNA, 25 bp, Homo sapien
atgatttaatagttattcttcttgg

SEQ ID NO: 412611 - DNA, 25 bp, Homo sapien
tgatttaatagttattcttcttgga

SEQ ID NO: 412612 - DNA, 25 bp, Homo sapien
gatttaatagttattcttcttggaa

SEQ ID NO: 412613 - DNA, 25 bp, Homo sapien
acttcctgaattatctcctttacag

SEQ ID NO: 412614 - DNA, 25 bp, Homo sapien
tatctcctttacaggaattcccttt

SEQ ID NO: 412615 - DNA, 25 bp, Homo sapien
atatgaagtgtgtcagtcccttgga

SEQ ID NO: 412616 - DNA, 25 bp, Homo sapien
aagtgtgtcagtcccttggaggaat

SEQ ID NO: 412617 - DNA, 25 bp, Homo sapien
gtcagtcccttggaggaattagttt

SEQ ID NO: 412618 - DNA, 25 bp, Homo sapien
tttaacttcgttgtagatggaccag

SEQ ID NO: 412619 - DNA, 25 bp, Homo sapien
acttcgttgtagatggaccagattt

SEQ ID NO: 412620 - DNA, 25 bp, Homo sapien
gtagatggaccagatttgaaatgag

SEQ ID NO: 412621 - DNA, 25 bp, Homo sapien
gagcaaaaagtctatgcctaaattt

SEQ ID NO: 412622 - DNA, 25 bp, Homo sapien
aagtctatgcctaaatttttcaaat

SEQ ID NO: 412623 - DNA, 25 bp, Homo sapien
atcctagtaggattgtgctttcaat

SEQ ID NO: 412624 - DNA, 25 bp, Homo sapien
tctggaaaatgaggctaatactttg

SEQ ID NO: 412625 - DNA, 25 bp, Homo sapien
ggaaaatgaggctaatactttggca

SEQ ID NO: 412626 - DNA, 25 bp, Homo sapien
gaaaatgaggctaatactttggcaa

SEQ ID NO: 412627 - DNA, 25 bp, Homo sapien
aaaatgaggctaatactttggcaaa

SEQ ID NO: 412628 - DNA, 25 bp, Homo sapien
aaatgaggctaatactttggcaaat

SEQ ID NO: 412629 - DNA, 25 bp, Homo sapien
aatgaggctaatactttggcaaatt

SEQ ID NO: 412630 - DNA, 25 bp, Homo sapien
atgaggctaatactttggcaaattg

SEQ ID NO: 412631 - DNA, 25 bp, Homo sapien
tgaggctaatactttggcaaattgt

SEQ ID NO: 412632 - DNA, 25 bp, Homo sapien
gaggctaatactttggcaaattgtc

SEQ ID NO: 412633 - DNA, 25 bp, Homo sapien
tttggcaaattgtcagaaaggttaa

SEQ ID NO: 412634 - DNA, 25 bp, Homo sapien
ggcaaattgtcagaaaggttaaaga

SEQ ID NO: 412635 - DNA, 25 bp, Homo sapien
aagctgctattttacggaaagattt

SEQ ID NO: 412636 - DNA, 25 bp, Homo sapien
gtaagaatcggttgttacacaagct

SEQ ID NO: 412637 - DNA, 25 bp, Homo sapien
gttgttacacaagctgttctttccc

SEQ ID NO: 412638 - DNA, 25 bp, Homo sapien
gctgttctttcccagttacaaaatc

SEQ ID NO: 412639 - DNA, 25 bp, Homo sapien
aaatcctgtgttcggttgtaacctg

SEQ ID NO: 412640 - DNA, 25 bp, Homo sapien
ttcggttgtaacctgaactcattaa

SEQ ID NO: 412641 - DNA, 25 bp, Homo sapien
agacttgttttcaggtttatcaact

SEQ ID NO: 412642 - DNA, 25 bp, Homo sapien
ttttcactgacatttgagcatgtta

SEQ ID NO: 412643 - DNA, 25 bp, Homo sapien
gcaagacaaaaggactcggaagaaa

SEQ ID NO: 412644 - DNA, 25 bp, Homo sapien
atatgcctacagagcatacaactct

SEQ ID NO: 412645 - DNA, 25 bp, Homo sapien
gagcatacaactctgtggaactaaa

SEQ ID NO: 412646 - DNA, 25 bp, Homo sapien
aaatctactttcttcggtcaacatc

SEQ ID NO: 412647 - DNA, 25 bp, Homo sapien
ggtcaacatcctaacattgagcaat

SEQ ID NO: 412648 - DNA, 25 bp, Homo sapien
ttgagcaatttcttcacatcttaaa

SEQ ID NO: 412649 - DNA, 25 bp, Homo sapien
ccaaccagtcatcttgcacaaacag

SEQ ID NO: 412650 - DNA, 25 bp, Homo sapien
agggactgtcctggcgtcagattaa

SEQ ID NO: 412651 - DNA, 25 bp, Homo sapien
agttagtgaactccctattgatcaa

SEQ ID NO: 412652 - DNA, 25 bp, Homo sapien
ggaactagtagtaaccagagtcaga

SEQ ID NO: 412653 - DNA, 25 bp, Homo sapien
gaattccgagattacaaacacttgt

SEQ ID NO: 412654 - DNA, 25 bp, Homo sapien
acacttgttccgtaatcatttcccg

SEQ ID NO: 412655 - DNA, 25 bp, Homo sapien
cagtaaactccctcaaaactttctg

SEQ ID NO: 412656 - DNA, 25 bp, Homo sapien
ttctgttcccatgggacccttgaga

SEQ ID NO: 412657 - DNA, 25 bp, Homo sapien
tggaagcagtcataccactcaggct

SEQ ID NO: 412658 - DNA, 25 bp, Homo sapien
cactcaggctggaaaatcgctctag

SEQ ID NO: 412659 - DNA, 25 bp, Homo sapien
tctaggaatggcaagaagggctctt

SEQ ID NO: 412660 - DNA, 25 bp, Homo sapien
gcagagcttacatggccagggatcc

SEQ ID NO: 412661 - DNA, 25 bp, Homo sapien
aagggctctttctcacttggatggt

SEQ ID NO: 412662 - DNA, 25 bp, Homo sapien
ttctcacttggatggtctccagaaa

SEQ ID NO: 412663 - DNA, 25 bp, Homo sapien
tcagctgccatgtcacgaagtgccc

SEQ ID NO: 412664 - DNA, 25 bp, Homo sapien
gtgccctgtgagaaggacctgtaag

SEQ ID NO: 412665 - DNA, 25 bp, Homo sapien
tacatggccagggatcccggaggac

SEQ ID NO: 412666 - DNA, 25 bp, Homo sapien
gagggaggcctctaaatgacagcct

SEQ ID NO: 412667 - DNA, 25 bp, Homo sapien
gaatcaaagtgaactgccagggaca

SEQ ID NO: 412668 - DNA, 25 bp, Homo sapien
tcagcagcgttgcatgtacgggcct

SEQ ID NO: 412669 - DNA, 25 bp, Homo sapien
gggcctcgtactgcctcatggaaaa

SEQ ID NO: 412670 - DNA, 25 bp, Homo sapien
tcatggaaaatcctccggagccgcc

SEQ ID NO: 412671 - DNA, 25 bp, Homo sapien
gccgccctccattgtgggttcctga

SEQ ID NO: 412672 - DNA, 25 bp, Homo sapien
agagtaggacacattgccatggttt

SEQ ID NO: 412673 - DNA, 25 bp, Homo sapien
atggttttgtgggaatcacgcgccc

SEQ ID NO: 412674 - DNA, 25 bp, Homo sapien
aatcacgcgcccctgatggaacttt

SEQ ID NO: 412675 - DNA, 25 bp, Homo sapien
gatggaacttttctgctgttgtgaa

SEQ ID NO: 412676 - DNA, 25 bp, Homo sapien
gctgttgtgaagtacttttatccat

SEQ ID NO: 412677 - DNA, 25 bp, Homo sapien
agtacttttatccatttgcttctct

SEQ ID NO: 412678 - DNA, 25 bp, Homo sapien
tgctgaccttgccaagttgttcgag

SEQ ID NO: 412679 - DNA, 25 bp, Homo sapien
aagactgttttaattgctccactcc

SEQ ID NO: 412680 - DNA, 25 bp, Homo sapien
tgttttaattgctccactccgtaat

SEQ ID NO: 412681 - DNA, 25 bp, Homo sapien
aattgctccactccgtaattttgaa

SEQ ID NO: 412682 - DNA, 25 bp, Homo sapien
ctccactccgtaattttgaagcacc

SEQ ID NO: 412683 - DNA, 25 bp, Homo sapien
cactccgtaattttgaagcaccctt

SEQ ID NO: 412684 - DNA, 25 bp, Homo sapien
tccccaagccaccaattggatggat

SEQ ID NO: 412685 - DNA, 25 bp, Homo sapien
gagtggatcgatggatgtattgata

SEQ ID NO: 412686 - DNA, 25 bp, Homo sapien
gaagcaacttaagaattgtagcctt

SEQ ID NO: 412687 - DNA, 25 bp, Homo sapien
agaattgtagccttgactccttgag

SEQ ID NO: 412688 - DNA, 25 bp, Homo sapien
attgtagccttgactccttgagact

SEQ ID NO: 412689 - DNA, 25 bp, Homo sapien
agccttgactccttgagactgtaga

SEQ ID NO: 412690 - DNA, 25 bp, Homo sapien
aggacgaggtgctgcgccgcttcct

SEQ ID NO: 412691 - DNA, 25 bp, Homo sapien
tggacaacttcgactcctctgagaa

SEQ ID NO: 412692 - DNA, 25 bp, Homo sapien
aacttcgactcctctgagaaggacg

SEQ ID NO: 412693 - DNA, 25 bp, Homo sapien
cctctgagaaggacgggcaggtcac

SEQ ID NO: 412694 - DNA, 25 bp, Homo sapien
gtcacactggcggaattccaggact

SEQ ID NO: 412695 - DNA, 25 bp, Homo sapien
gaattccaggactactacagcggcg

SEQ ID NO: 412696 - DNA, 25 bp, Homo sapien
tacagcggcgtgagtgcctccatga

SEQ ID NO: 412697 - DNA, 25 bp, Homo sapien
gtgagtgcctccatgaacacggatg

SEQ ID NO: 412698 - DNA, 25 bp, Homo sapien
aacacggatgaggagttcgtggcca

SEQ ID NO: 412699 - DNA, 25 bp, Homo sapien
ttcgtggccatgatgaccagtgcct

SEQ ID NO: 412700 - DNA, 25 bp, Homo sapien
tgcttgccctggctgttaatcccca

SEQ ID NO: 412701 - DNA, 25 bp, Homo sapien
tcttttttgtcagtattgtttggga

SEQ ID NO: 412702 - DNA, 25 bp, Homo sapien
gagacatgccgggatgtgtcatcgt

SEQ ID NO: 412703 - DNA, 25 bp, Homo sapien
ggatgtgtcatcgtgccaaatacca

SEQ ID NO: 412704 - DNA, 25 bp, Homo sapien
aataccacatttcctgttggcacag

SEQ ID NO: 412705 - DNA, 25 bp, Homo sapien
gttggcacagtttcacagaagtaaa

SEQ ID NO: 412706 - DNA, 25 bp, Homo sapien
ttatttatttaacccgccattgtgt

SEQ ID NO: 412707 - DNA, 25 bp, Homo sapien
taacccgccattgtgtgtttttaag

SEQ ID NO: 412708 - DNA, 25 bp, Homo sapien
gcttgtcacaatctaactggctatg

SEQ ID NO: 412709 - DNA, 25 bp, Homo sapien
tatgttttgcaacttagaaaccagc

SEQ ID NO: 412710 - DNA, 25 bp, Homo sapien
gaaaccagctacagtatggcccact

SEQ ID NO: 412711 - DNA, 25 bp, Homo sapien
cagctacagtatggcccacttaata

SEQ ID NO: 412712 - DNA, 25 bp, Homo sapien
aagttcagactcataaaaagcgatt

SEQ ID NO: 412713 - DNA, 25 bp, Homo sapien
aaaagcgattaagaggcctatgcct

SEQ ID NO: 412714 - DNA, 25 bp, Homo sapien
cactaagtcagtatttctgttaata

SEQ ID NO: 412715 - DNA, 25 bp, Homo sapien
ggctagtggctgtgtagcatcctca

SEQ ID NO: 412716 - DNA, 25 bp, Homo sapien
tgtagcatcctcagtgcaaaaccca

SEQ ID NO: 412717 - DNA, 25 bp, Homo sapien
aaacccagctccagaattttcacct

SEQ ID NO: 412718 - DNA, 25 bp, Homo sapien
tttcacctggtaacgaatttcaact

SEQ ID NO: 412719 - DNA, 25 bp, Homo sapien
ggtaacgaatttcaactgacagtga

SEQ ID NO: 412720 - DNA, 25 bp, Homo sapien
ggcctttaaactttataacattgca

SEQ ID NO: 412721 - DNA, 25 bp, Homo sapien
gcaattgtgatgttatctctaggtt

SEQ ID NO: 412722 - DNA, 25 bp, Homo sapien
atctctaggtttttgtgtgaagtca

SEQ ID NO: 412723 - DNA, 25 bp, Homo sapien
ggctgtaccgcattacattatgcct

SEQ ID NO: 412724 - DNA, 25 bp, Homo sapien
atgaaaaaccagtctcttatccctc

SEQ ID NO: 412725 - DNA, 25 bp, Homo sapien
ctctgctcttggaagcccgtgcaga

SEQ ID NO: 412726 - DNA, 25 bp, Homo sapien
ccgtgcagaccccacaataaagaat

SEQ ID NO: 412727 - DNA, 25 bp, Homo sapien
gagagctcactggatattgcacgga

SEQ ID NO: 412728 - DNA, 25 bp, Homo sapien
aggaaagcattgtaatccttgtgac

SEQ ID NO: 412729 - DNA, 25 bp, Homo sapien
cttgtgaccacaccgatggagatac

SEQ ID NO: 412730 - DNA, 25 bp, Homo sapien
gttaacgactggattctatcttcat

SEQ ID NO: 412731 - DNA, 25 bp, Homo sapien
ctatcttcattttagacttttggtc

SEQ ID NO: 412732 - DNA, 25 bp, Homo sapien
agacttttggtctgtgggccattta

SEQ ID NO: 412733 - DNA, 25 bp, Homo sapien
tctgtgggccatttaacctggatgc

SEQ ID NO: 412734 - DNA, 25 bp, Homo sapien
tcacatgtttagttggtatgtaaac

SEQ ID NO: 412735 - DNA, 25 bp, Homo sapien
ccagaagattggaagagggataaga

SEQ ID NO: 412736 - DNA, 25 bp, Homo sapien
gaaatgaaagatcctgatactttag

SEQ ID NO: 412737 - DNA, 25 bp, Homo sapien
attgtgaagaaggaccagctgctgt

SEQ ID NO: 412738 - DNA, 25 bp, Homo sapien
cactattgatgacttaattgataag

SEQ ID NO: 412739 - DNA, 25 bp, Homo sapien
taattgataagctctcaactatagt

SEQ ID NO: 412740 - DNA, 25 bp, Homo sapien
tgataagctctcaactatagttaac

SEQ ID NO: 412741 - DNA, 25 bp, Homo sapien
agctctcaactatagttaactagta

SEQ ID NO: 412742 - DNA, 25 bp, Homo sapien
tagttaactagtatcacatgtttag

SEQ ID NO: 412743 - DNA, 25 bp, Homo sapien
ctagtatcacatgtttagttggtat

SEQ ID NO: 412744 - DNA, 25 bp, Homo sapien
gtatcacatgtttagttggtatgta

SEQ ID NO: 412745 - DNA, 25 bp, Homo sapien
gtcacactggcggaattccaggact

SEQ ID NO: 412746 - DNA, 25 bp, Homo sapien
tggcggaattccaggactactacag

SEQ ID NO: 412747 - DNA, 25 bp, Homo sapien
aggactactacagcggcgtgagtgc

SEQ ID NO: 412748 - DNA, 25 bp, Homo sapien
tacagcggcgtgagtgcctccatga

SEQ ID NO: 412749 - DNA, 25 bp, Homo sapien
agcggcgtgagtgcctccatgaaca

SEQ ID NO: 412750 - DNA, 25 bp, Homo sapien
gtgagtgcctccatgaacacggatg

SEQ ID NO: 412751 - DNA, 25 bp, Homo sapien
gagtgcctccatgaacacggatgag

SEQ ID NO: 412752 - DNA, 25 bp, Homo sapien
acacggatgaggagttcgtggccat

SEQ ID NO: 412753 - DNA, 25 bp, Homo sapien
gagttcgtggccatgatgaccagtg

SEQ ID NO: 412754 - DNA, 25 bp, Homo sapien
cgtggccatgatgaccagtgcctgg

SEQ ID NO: 412755 - DNA, 25 bp, Homo sapien
gccatgatgaccagtgcctggcagc

SEQ ID NO: 412756 - DNA, 25 bp, Homo sapien
taatagtaagaactgtcccatatgt

SEQ ID NO: 412757 - DNA, 25 bp, Homo sapien
gaactgtcccatatgttagtaaatt

SEQ ID NO: 412758 - DNA, 25 bp, Homo sapien
aattgtgaacactggaaagcaccat

SEQ ID NO: 412759 - DNA, 25 bp, Homo sapien
ggtggttaaaattacattactgtga

SEQ ID NO: 412760 - DNA, 25 bp, Homo sapien
actgtgaaattcatcttccaactct

SEQ ID NO: 412761 - DNA, 25 bp, Homo sapien
catcttccaactctaagttaagctt

SEQ ID NO: 412762 - DNA, 25 bp, Homo sapien
gatacatgttagtggttaactgtta

SEQ ID NO: 412763 - DNA, 25 bp, Homo sapien
taagagctttgaaaacactgcacat

SEQ ID NO: 412764 - DNA, 25 bp, Homo sapien
aacactgcacatatctgtacaagcc

SEQ ID NO: 412765 - DNA, 25 bp, Homo sapien
gtacaagccagaattactatttctt

SEQ ID NO: 412766 - DNA, 25 bp, Homo sapien
cttattattagcttggcagttgctt

SEQ ID NO: 412767 - DNA, 25 bp, Homo sapien
agatgggccttcttctcaaacacat

SEQ ID NO: 412768 - DNA, 25 bp, Homo sapien
gggccttcttctcaaacacatgcag

SEQ ID NO: 412769 - DNA, 25 bp, Homo sapien
ttcttctcaaacacatgcaggatgt

SEQ ID NO: 412770 - DNA, 25 bp, Homo sapien
ggatgtgagagtcctcctcggtcac

SEQ ID NO: 412771 - DNA, 25 bp, Homo sapien
ctcctcggtcacctgctcatggagt

SEQ ID NO: 412772 - DNA, 25 bp, Homo sapien
gagttgagggaattatctggccacc

SEQ ID NO: 412773 - DNA, 25 bp, Homo sapien
ctgggaccacaaaggctactgctga

SEQ ID NO: 412774 - DNA, 25 bp, Homo sapien
ggaccacaaaggctactgctgaata

SEQ ID NO: 412775 - DNA, 25 bp, Homo sapien
caaaggctactgctgaatagaagta

SEQ ID NO: 412776 - DNA, 25 bp, Homo sapien
agttcatccatgatctcacttaacc

SEQ ID NO: 412777 - DNA, 25 bp, Homo sapien
tcatctgtatcaccagatgggcctt

SEQ ID NO: 412778 - DNA, 25 bp, Homo sapien
ttgaccctcaaaacaaccctctttg

SEQ ID NO: 412779 - DNA, 25 bp, Homo sapien
acaaccctctttgtttacttatgca

SEQ ID NO: 412780 - DNA, 25 bp, Homo sapien
accctctttgtttacttatgcatat

SEQ ID NO: 412781 - DNA, 25 bp, Homo sapien
cctctttgtttacttatgcatatgt

SEQ ID NO: 412782 - DNA, 25 bp, Homo sapien
tgaggaaaccaaaacttggctgggc

SEQ ID NO: 412783 - DNA, 25 bp, Homo sapien
ggtggatcctgggacctcacttaga

SEQ ID NO: 412784 - DNA, 25 bp, Homo sapien
tggatcctgggacctcacttagaat

SEQ ID NO: 412785 - DNA, 25 bp, Homo sapien
gatcctgggacctcacttagaataa

SEQ ID NO: 412786 - DNA, 25 bp, Homo sapien
tcctgggacctcacttagaataact

SEQ ID NO: 412787 - DNA, 25 bp, Homo sapien
ctgggacctcacttagaataactaa

SEQ ID NO: 412788 - DNA, 25 bp, Homo sapien
tagaataactaagcacggtgctcgc

SEQ ID NO: 412789 - DNA, 25 bp, Homo sapien
aggcacccgccgctgctaatttttg

SEQ ID NO: 412790 - DNA, 25 bp, Homo sapien
ggcacccgccgctgctaatttttgt

SEQ ID NO: 412791 - DNA, 25 bp, Homo sapien
gcacccgccgctgctaatttttgta

SEQ ID NO: 412792 - DNA, 25 bp, Homo sapien
ccaccttggcctccctaaatgccgg

SEQ ID NO: 412793 - DNA, 25 bp, Homo sapien
caccttggcctccctaaatgccggg

SEQ ID NO: 412794 - DNA, 25 bp, Homo sapien
tccctaaatgccgggattacaggca

SEQ ID NO: 412795 - DNA, 25 bp, Homo sapien
ccctaaatgccgggattacaggcat

SEQ ID NO: 412796 - DNA, 25 bp, Homo sapien
cctaaatgccgggattacaggcatg

SEQ ID NO: 412797 - DNA, 25 bp, Homo sapien
taatagtaagaactgtcccatatgt

SEQ ID NO: 412798 - DNA, 25 bp, Homo sapien
ggtggttaaaattacattactgtga

SEQ ID NO: 412799 - DNA, 25 bp, Homo sapien
attactgtgaaattcatcttccaac

SEQ ID NO: 412800 - DNA, 25 bp, Homo sapien
actgtgaaattcatcttccaactct

SEQ ID NO: 412801 - DNA, 25 bp, Homo sapien
catcttccaactctaagttaagctt

SEQ ID NO: 412802 - DNA, 25 bp, Homo sapien
ggagatacatgttagtggttaactg

SEQ ID NO: 412803 - DNA, 25 bp, Homo sapien
gatacatgttagtggttaactgtta

SEQ ID NO: 412804 - DNA, 25 bp, Homo sapien
gttagtggttaactgttaagagctt

SEQ ID NO: 412805 - DNA, 25 bp, Homo sapien
gtacaagccagaattactatttctt

SEQ ID NO: 412806 - DNA, 25 bp, Homo sapien
acttattattagcttggcagttgct

SEQ ID NO: 412807 - DNA, 25 bp, Homo sapien
tattattagcttggcagttgctttt

SEQ ID NO: 412808 - DNA, 25 bp, Homo sapien
tctgcttaggctgggtgagcttgtc

SEQ ID NO: 412809 - DNA, 25 bp, Homo sapien
tgcttaggctgggtgagcttgtcca

SEQ ID NO: 412810 - DNA, 25 bp, Homo sapien
cttaggctgggtgagcttgtccagg

SEQ ID NO: 412811 - DNA, 25 bp, Homo sapien
taggctgggtgagcttgtccaggcc

SEQ ID NO: 412812 - DNA, 25 bp, Homo sapien
aggctgggtgagcttgtccaggcct

SEQ ID NO: 412813 - DNA, 25 bp, Homo sapien
gctgggtgagcttgtccaggcctgt

SEQ ID NO: 412814 - DNA, 25 bp, Homo sapien
tgggtgagcttgtccaggcctgtgc

SEQ ID NO: 412815 - DNA, 25 bp, Homo sapien
ccttctctcttctaggctcagtgta

SEQ ID NO: 412816 - DNA, 25 bp, Homo sapien
cttctctcttctaggctcagtgtat

SEQ ID NO: 412817 - DNA, 25 bp, Homo sapien
ttctctcttctaggctcagtgtatg

SEQ ID NO: 412818 - DNA, 25 bp, Homo sapien
ctctcttctaggctcagtgtatgct

SEQ ID NO: 412819 - DNA, 25 bp, Homo sapien
gagcaatataccgttcatctgaaaa

SEQ ID NO: 412820 - DNA, 25 bp, Homo sapien
gaaaatagtagcacacagccatata

SEQ ID NO: 412821 - DNA, 25 bp, Homo sapien
cattttctaaggactgtttcttcac

SEQ ID NO: 412822 - DNA, 25 bp, Homo sapien
gtttcttcacattgagcagagcagg

SEQ ID NO: 412823 - DNA, 25 bp, Homo sapien
gcagagcaggcataaatggtggtta

SEQ ID NO: 412824 - DNA, 25 bp, Homo sapien
aatggtggttatttagtctaagtct

SEQ ID NO: 412825 - DNA, 25 bp, Homo sapien
acctgattttcaacataacacgcaa

SEQ ID NO: 412826 - DNA, 25 bp, Homo sapien
acacgcaatgtggatgtcgagtagt

SEQ ID NO: 412827 - DNA, 25 bp, Homo sapien
gttaagaatggtgctgctcctgaca

SEQ ID NO: 412828 - DNA, 25 bp, Homo sapien
gtgctgctcctgacaagtgtatgtt

SEQ ID NO: 412829 - DNA, 25 bp, Homo sapien
tctctattactgaacttttcctaag

SEQ ID NO: 412830 - DNA, 25 bp, Homo sapien
ttgtttatccctcttaagcctgcgt

SEQ ID NO: 412831 - DNA, 25 bp, Homo sapien
agcctgcgtgcaggaaggcacatta

SEQ ID NO: 412832 - DNA, 25 bp, Homo sapien
gtgttgggtgcccttacctaccttg

SEQ ID NO: 412833 - DNA, 25 bp, Homo sapien
tgccctttttcttgtaccgtaggct

SEQ ID NO: 412834 - DNA, 25 bp, Homo sapien
gtaccgtaggctgtgccgtttatga

SEQ ID NO: 412835 - DNA, 25 bp, Homo sapien
ggctgtgccgtttatgagtaagtga

SEQ ID NO: 412836 - DNA, 25 bp, Homo sapien
tagaagtgctgcactcaccttgtgt

SEQ ID NO: 412837 - DNA, 25 bp, Homo sapien
gctgcactcaccttgtgttattgga

SEQ ID NO: 412838 - DNA, 25 bp, Homo sapien
ccctagctttgagcctggtctcaga

SEQ ID NO: 412839 - DNA, 25 bp, Homo sapien
agatgttccttttccgttctctgtc

SEQ ID NO: 412840 - DNA, 25 bp, Homo sapien
tctgtaataaaagcctatcagccgt

SEQ ID NO: 412841 - DNA, 25 bp, Homo sapien
aacatatgtgttgctatcttcatca

SEQ ID NO: 412842 - DNA, 25 bp, Homo sapien
atgtgttgctatcttcatcattaac

SEQ ID NO: 412843 - DNA, 25 bp, Homo sapien
tcttcatcattaacatccttctttt

SEQ ID NO: 412844 - DNA, 25 bp, Homo sapien
ttcttttctattgcttggctgtaat

SEQ ID NO: 412845 - DNA, 25 bp, Homo sapien
gtgtgtttgtagtatatgttcagaa

SEQ ID NO: 412846 - DNA, 25 bp, Homo sapien
gttcagaaggcaagcatcttcattt

SEQ ID NO: 412847 - DNA, 25 bp, Homo sapien
gcagaatcttaaaatgtgtactcgt

SEQ ID NO: 412848 - DNA, 25 bp, Homo sapien
gtgtactcgttatttctaatgatgt

SEQ ID NO: 412849 - DNA, 25 bp, Homo sapien
aaaaatccctagtcctgtttagcat

SEQ ID NO: 412850 - DNA, 25 bp, Homo sapien
atccctagtcctgtttagcatttga

SEQ ID NO: 412851 - DNA, 25 bp, Homo sapien
tgtttgccaaacttatacaataaat

SEQ ID NO: 412852 - DNA, 25 bp, Homo sapien
atctctcctgcttctttaacttgat

SEQ ID NO: 412853 - DNA, 25 bp, Homo sapien
ctctcctgcttctttaacttgataa

SEQ ID NO: 412854 - DNA, 25 bp, Homo sapien
gataatgcatacttgatttttctat

SEQ ID NO: 412855 - DNA, 25 bp, Homo sapien
atgcatacttgatttttctatttgt

SEQ ID NO: 412856 - DNA, 25 bp, Homo sapien
ttcataaaccaattaatacacagat

SEQ ID NO: 412857 - DNA, 25 bp, Homo sapien
aaaaatggattttggatgcctctca

SEQ ID NO: 412858 - DNA, 25 bp, Homo sapien
atggattttggatgcctctcatatg

SEQ ID NO: 412859 - DNA, 25 bp, Homo sapien
gattttggatgcctctcatatgtaa

SEQ ID NO: 412860 - DNA, 25 bp, Homo sapien
gatgcctctcatatgtaattagttc

SEQ ID NO: 412861 - DNA, 25 bp, Homo sapien
gcctctcatatgtaattagttctat

SEQ ID NO: 412862 - DNA, 25 bp, Homo sapien
gtcaggtttttgacagaattttgtt

SEQ ID NO: 412863 - DNA, 25 bp, Homo sapien
aaaggagtgagcagttctcctcccc

SEQ ID NO: 412864 - DNA, 25 bp, Homo sapien
acagccttaggccaacacaaactgc

SEQ ID NO: 412865 - DNA, 25 bp, Homo sapien
agcagcaccttaatacctcttgtga

SEQ ID NO: 412866 - DNA, 25 bp, Homo sapien
cttgtgacagttacggctgaagtgg

SEQ ID NO: 412867 - DNA, 25 bp, Homo sapien
caagcttgtaggtgttggcatcccc

SEQ ID NO: 412868 - DNA, 25 bp, Homo sapien
tttttatatcggtcccggaagacat

SEQ ID NO: 412869 - DNA, 25 bp, Homo sapien
gaagacatagatgctcccgttacag

SEQ ID NO: 412870 - DNA, 25 bp, Homo sapien
agatgctcccgttacagctggcaat

SEQ ID NO: 412871 - DNA, 25 bp, Homo sapien
acagctggcaatcttccagagggat

SEQ ID NO: 412872 - DNA, 25 bp, Homo sapien
gtgaagctgtctagcaagggattgt

SEQ ID NO: 412873 - DNA, 25 bp, Homo sapien
gcaagggattgtagcacaccaggga

SEQ ID NO: 412874 - DNA, 25 bp, Homo sapien
aatctttgcggtgctgccatctgga

SEQ ID NO: 412875 - DNA, 25 bp, Homo sapien
ggacatctgtgtcattgaagtcaca

SEQ ID NO: 412876 - DNA, 25 bp, Homo sapien
gaggaggcttcaagaatcttcgagg

SEQ ID NO: 412877 - DNA, 25 bp, Homo sapien
aagaatcttcgaggtgctgccatct

SEQ ID NO: 412878 - DNA, 25 bp, Homo sapien
tgctgccatctggacatctgtgtca

SEQ ID NO: 412879 - DNA, 25 bp, Homo sapien
gccttaggaaaatcggctgtggttt

SEQ ID NO: 412880 - DNA, 25 bp, Homo sapien
aaatcggctgtggtttaataaactg

SEQ ID NO: 412881 - DNA, 25 bp, Homo sapien
ttcccgctgctttgagccggagcct

SEQ ID NO: 412882 - DNA, 25 bp, Homo sapien
ggcacggctgtgagcgcacagtcca

SEQ ID NO: 412883 - DNA, 25 bp, Homo sapien
gagcgcacagtccagccacagaagg

SEQ ID NO: 412884 - DNA, 25 bp, Homo sapien
gaaggaggcttcaagaatctttgcg

SEQ ID NO: 412885 - DNA, 25 bp, Homo sapien
tttctaagcctggttttcttctctg

SEQ ID NO: 412886 - DNA, 25 bp, Homo sapien
agcctggttttcttctctggaaaat

SEQ ID NO: 412887 - DNA, 25 bp, Homo sapien
ctggttttcttctctggaaaatgag

SEQ ID NO: 412888 - DNA, 25 bp, Homo sapien
ggaaaatgaggctaatactttggca

SEQ ID NO: 412889 - DNA, 25 bp, Homo sapien
aaaatgaggctaatactttggcaaa

SEQ ID NO: 412890 - DNA, 25 bp, Homo sapien
aatgaggctaatactttggcaaatt

SEQ ID NO: 412891 - DNA, 25 bp, Homo sapien
tgaggctaatactttggcaaattgt

SEQ ID NO: 412892 - DNA, 25 bp, Homo sapien
gaggctaatactttggcaaattgtc

SEQ ID NO: 412893 - DNA, 25 bp, Homo sapien
tttggcaaattgtcagaaaggttaa

SEQ ID NO: 412894 - DNA, 25 bp, Homo sapien
gcctggcaatacagtgagatcccat

SEQ ID NO: 412895 - DNA, 25 bp, Homo sapien
ggtggtgcactcctataaaaattga

SEQ ID NO: 412896 - DNA, 25 bp, Homo sapien
gaagtcttaacccttggtaccacag

SEQ ID NO: 412897 - DNA, 25 bp, Homo sapien
cttggtaccacagaatatcactgta

SEQ ID NO: 412898 - DNA, 25 bp, Homo sapien
aaatgagctcactgatatgggcccc

SEQ ID NO: 412899 - DNA, 25 bp, Homo sapien
gagctcactgatatgggccccgatg

SEQ ID NO: 412900 - DNA, 25 bp, Homo sapien
tatgggccccgatgcaatataattg

SEQ ID NO: 412901 - DNA, 25 bp, Homo sapien
gccccgatgcaatataattggtgtc

SEQ ID NO: 412902 - DNA, 25 bp, Homo sapien
gttaggacacgcaggaaagaccaca

SEQ ID NO: 412903 - DNA, 25 bp, Homo sapien
ggaaagaccacatgaaggcccagga

SEQ ID NO: 412904 - DNA, 25 bp, Homo sapien
tgctgacacctcaatcttagactct

SEQ ID NO: 412905 - DNA, 25 bp, Homo sapien
ctcaatcttagactctggcctcaaa

SEQ ID NO: 412906 - DNA, 25 bp, Homo sapien
atcttagactctggcctcaaaaatt

SEQ ID NO: 412907 - DNA, 25 bp, Homo sapien
aaacacgccagtttggttgggatgt

SEQ ID NO: 412908 - DNA, 25 bp, Homo sapien
aacgtttatgtttacccagctcatg

SEQ ID NO: 412909 - DNA, 25 bp, Homo sapien
tatgtttacccagctcatgagtcag

SEQ ID NO: 412910 - DNA, 25 bp, Homo sapien
ttacccagctcatgagtcagaagtt

SEQ ID NO: 412911 - DNA, 25 bp, Homo sapien
ctcatgagtcagaagttattttgct

SEQ ID NO: 412912 - DNA, 25 bp, Homo sapien
gcttataaattcattttgccatagt

SEQ ID NO: 412913 - DNA, 25 bp, Homo sapien
ttaatgttgtaagcaaatagggcat

SEQ ID NO: 412914 - DNA, 25 bp, Homo sapien
aatagggcattggatagcagcacta

SEQ ID NO: 412915 - DNA, 25 bp, Homo sapien
gcattggatagcagcactaagtcat

SEQ ID NO: 412916 - DNA, 25 bp, Homo sapien
agcagcactaagtcattgaaaacaa

SEQ ID NO: 412917 - DNA, 25 bp, Homo sapien
aggattttagataacatgccaagca

SEQ ID NO: 412918 - DNA, 25 bp, Homo sapien
atcatcccccatcatactatggtaa

SEQ ID NO: 412919 - DNA, 25 bp, Homo sapien
catcatactatggtaaggagtgctt

SEQ ID NO: 412920 - DNA, 25 bp, Homo sapien
atactatggtaaggagtgcttggtt

SEQ ID NO: 412921 - DNA, 25 bp, Homo sapien
atagtctttgtctgctggatgatac

SEQ ID NO: 412922 - DNA, 25 bp, Homo sapien
gtctttgtctgctggatgatacgtc

SEQ ID NO: 412923 - DNA, 25 bp, Homo sapien
tttgtctgctggatgatacgtcgcc

SEQ ID NO: 412924 - DNA, 25 bp, Homo sapien
gtctgctggatgatacgtcgccaag

SEQ ID NO: 412925 - DNA, 25 bp, Homo sapien
tgctggatgatacgtcgccaagatg

SEQ ID NO: 412926 - DNA, 25 bp, Homo sapien
ttcggccgacgccaccatagaggaa

SEQ ID NO: 412927 - DNA, 25 bp, Homo sapien
ttcaagatccccttgatgggccggt

SEQ ID NO: 412928 - DNA, 25 bp, Homo sapien
agatccccttgatgggccggtgcga

SEQ ID NO: 412929 - DNA, 25 bp, Homo sapien
gaataggagttctcctggagcaact

SEQ ID NO: 412930 - DNA, 25 bp, Homo sapien
agttctcctggagcaacttgagggt

SEQ ID NO: 412931 - DNA, 25 bp, Homo sapien
ctcctggagcaacttgagggtaata

SEQ ID NO: 412932 - DNA, 25 bp, Homo sapien
gagtgtttactgtttcttatcccta

SEQ ID NO: 412933 - DNA, 25 bp, Homo sapien
ccagctgatctaaggaccccagttt

SEQ ID NO: 412934 - DNA, 25 bp, Homo sapien
taaggaccccagtttgggaactcat

SEQ ID NO: 412935 - DNA, 25 bp, Homo sapien
accccagtttgggaactcatcaaat

SEQ ID NO: 412936 - DNA, 25 bp, Homo sapien
ataatcacaaaatcacaattctctg

SEQ ID NO: 412937 - DNA, 25 bp, Homo sapien
gattttgagctcaatctctgcagga

SEQ ID NO: 412938 - DNA, 25 bp, Homo sapien
agctcaatctctgcaggatgggtga

SEQ ID NO: 412939 - DNA, 25 bp, Homo sapien
tctctgcaggatgggtgaaaccaca

SEQ ID NO: 412940 - DNA, 25 bp, Homo sapien
ggaagctctaggcattgttctcttt

SEQ ID NO: 412941 - DNA, 25 bp, Homo sapien
gcattgttctctttggatccaggga

SEQ ID NO: 412942 - DNA, 25 bp, Homo sapien
tggatccagggatgctaagtagaaa

SEQ ID NO: 412943 - DNA, 25 bp, Homo sapien
agaaactgcatgagccaccagtgcc

SEQ ID NO: 412944 - DNA, 25 bp, Homo sapien
ggcaccctttaacaccaccagatgg

SEQ ID NO: 412945 - DNA, 25 bp, Homo sapien
catcactgtgctccttttttcccgg

SEQ ID NO: 412946 - DNA, 25 bp, Homo sapien
ttttttcccggcctacgaggcagct

SEQ ID NO: 412947 - DNA, 25 bp, Homo sapien
gcagctcctgccactatctttagag

SEQ ID NO: 412948 - DNA, 25 bp, Homo sapien
tcctgccactatctttagagccaat

SEQ ID NO: 412949 - DNA, 25 bp, Homo sapien
ttaaatacactagccattctcttgc

SEQ ID NO: 412950 - DNA, 25 bp, Homo sapien
gccattctcttgctttacaaaaaca

SEQ ID NO: 412951 - DNA, 25 bp, Homo sapien
agacctccaatatttgctacttgcc

SEQ ID NO: 412952 - DNA, 25 bp, Homo sapien
aatatttgctacttgccaatcctaa

SEQ ID NO: 412953 - DNA, 25 bp, Homo sapien
gctacttgccaatcctaatttagtt

SEQ ID NO: 412954 - DNA, 25 bp, Homo sapien
gttacaagaattggtaggcaatcct

SEQ ID NO: 412955 - DNA, 25 bp, Homo sapien
aggcaatcctacttaattttggcaa

SEQ ID NO: 412956 - DNA, 25 bp, Homo sapien
aaaagccccgtcatctaaatggcag

SEQ ID NO: 412957 - DNA, 25 bp, Homo sapien
tggcagaataactcagagcatgtct

SEQ ID NO: 412958 - DNA, 25 bp, Homo sapien
gtctttgaagatgctgggcgtctac

SEQ ID NO: 412959 - DNA, 25 bp, Homo sapien
tgggcgtctaccaccaccttatgtc

SEQ ID NO: 412960 - DNA, 25 bp, Homo sapien
tctacaaatttgtggcatgctcaaa

SEQ ID NO: 412961 - DNA, 25 bp, Homo sapien
gcaagaggatacttcatgaataata

SEQ ID NO: 412962 - DNA, 25 bp, Homo sapien
ctataatgcacagggcagtacccca

SEQ ID NO: 412963 - DNA, 25 bp, Homo sapien
gcagtaccccacaacgaaaaataat

SEQ ID NO: 412964 - DNA, 25 bp, Homo sapien
gagtttgagaaaccccagcctaatg

SEQ ID NO: 412965 - DNA, 25 bp, Homo sapien
gaaaccctaggtgttgggctctgga

SEQ ID NO: 412966 - DNA, 25 bp, Homo sapien
ttgggctctggaatgggactttgtc

SEQ ID NO: 412967 - DNA, 25 bp, Homo sapien
ttgtcccttctaattattatctctt

SEQ ID NO: 412968 - DNA, 25 bp, Homo sapien
ttattatctctttccagcctcattc

SEQ ID NO: 412969 - DNA, 25 bp, Homo sapien
cagcctcattcagctattcttactg

SEQ ID NO: 412970 - DNA, 25 bp, Homo sapien
ttcttactgacataccagtctttag

SEQ ID NO: 412971 - DNA, 25 bp, Homo sapien
cagtctttagctggtgctatggtct

SEQ ID NO: 412972 - DNA, 25 bp, Homo sapien
gctatggtctgttctttagttctag

SEQ ID NO: 412973 - DNA, 25 bp, Homo sapien
acccctgttcttcctggtcagagaa

SEQ ID NO: 412974 - DNA, 25 bp, Homo sapien
accagtcagtcattctagtcttcta

SEQ ID NO: 412975 - DNA, 25 bp, Homo sapien
gtcattctagtcttctagtccttaa

SEQ ID NO: 412976 - DNA, 25 bp, Homo sapien
gtcttctagtccttaaactgatctg

SEQ ID NO: 412977 - DNA, 25 bp, Homo sapien
aactgatctgatgacttggaacata

SEQ ID NO: 412978 - DNA, 25 bp, Homo sapien
cataggatttcactgcaagtctggc

SEQ ID NO: 412979 - DNA, 25 bp, Homo sapien
caagtctggctttttagtctggaaa

SEQ ID NO: 412980 - DNA, 25 bp, Homo sapien
gtctggaaatacatttgaggtctgt

SEQ ID NO: 412981 - DNA, 25 bp, Homo sapien
tttgaggtctgttttcgcacagctg

SEQ ID NO: 412982 - DNA, 25 bp, Homo sapien
tgttttcgcacagctggatcacctg

SEQ ID NO: 412983 - DNA, 25 bp, Homo sapien
ggttttattacacaattcagaaggc

SEQ ID NO: 412984 - DNA, 25 bp, Homo sapien
tactggcatggcaagagcccagctt

SEQ ID NO: 412985 - DNA, 25 bp, Homo sapien
agcttcctgacggagcgcaacattt

SEQ ID NO: 412986 - DNA, 25 bp, Homo sapien
ggagcgcaacatttctccactgcac

SEQ ID NO: 412987 - DNA, 25 bp, Homo sapien
tccactgcactgtgctagcagctca

SEQ ID NO: 412988 - DNA, 25 bp, Homo sapien
gctagcagctcagcagggcctctaa

SEQ ID NO: 412989 - DNA, 25 bp, Homo sapien
agggcctctaacctgtgatgtcaca

SEQ ID NO: 412990 - DNA, 25 bp, Homo sapien
actcaagaggccttggcagctccta

SEQ ID NO: 412991 - DNA, 25 bp, Homo sapien
ttggcagctcctagccatagagctt

SEQ ID NO: 412992 - DNA, 25 bp, Homo sapien
atagagcttcctttccagaaccctt

SEQ ID NO: 412993 - DNA, 25 bp, Homo sapien
gaacccttccactgcccaatgtgga

SEQ ID NO: 412994 - DNA, 25 bp, Homo sapien
tcttggtgttagtgatgctggagaa

SEQ ID NO: 412995 - DNA, 25 bp, Homo sapien
cgcggccgcgtcgaccccttctctt

SEQ ID NO: 412996 - DNA, 25 bp, Homo sapien
tcttcccctctttctttcctgcctt

SEQ ID NO: 412997 - DNA, 25 bp, Homo sapien
tttcctgccttcctgcctttcttct

SEQ ID NO: 412998 - DNA, 25 bp, Homo sapien
ttcctgccttcctgcctttcttctt

SEQ ID NO: 412999 - DNA, 25 bp, Homo sapien
tcctgccttcctgcctttcttcttt

SEQ ID NO: 413000 - DNA, 25 bp, Homo sapien
tgccttcctgcctttcttcttttct

SEQ ID NO: 413001 - DNA, 25 bp, Homo sapien
gccttcctgcctttcttcttttctt

SEQ ID NO: 413002 - DNA, 25 bp, Homo sapien
cttcctgcctttcttcttttcttct

SEQ ID NO: 413003 - DNA, 25 bp, Homo sapien
ccttccttctttcctcccgcctcag

SEQ ID NO: 413004 - DNA, 25 bp, Homo sapien
cttccttctttcctcccgcctcagc

SEQ ID NO: 413005 - DNA, 25 bp, Homo sapien
agcggccgcctactactactaaatt

SEQ ID NO: 413006 - DNA, 25 bp, Homo sapien
gtacattttcaacagtttgaggact

SEQ ID NO: 413007 - DNA, 25 bp, Homo sapien
acagtttgaggactaagcctttcta

SEQ ID NO: 413008 - DNA, 25 bp, Homo sapien
ggactaagcctttctaaaataacat

SEQ ID NO: 413009 - DNA, 25 bp, Homo sapien
atttttactgagattgcaacgtttt

SEQ ID NO: 413010 - DNA, 25 bp, Homo sapien
gagattgcaacgttttgcactgata

SEQ ID NO: 413011 - DNA, 25 bp, Homo sapien
tgcactgataaacatgagaatctgg

SEQ ID NO: 413012 - DNA, 25 bp, Homo sapien
atagcacaggatttaatttctcaat

SEQ ID NO: 413013 - DNA, 25 bp, Homo sapien
atttctcaatctgttgcatgtgcta

SEQ ID NO: 413014 - DNA, 25 bp, Homo sapien
ctgttgcatgtgctaattatgagta

SEQ ID NO: 413015 - DNA, 25 bp, Homo sapien
gataatcagttttgtctaggtcata

SEQ ID NO: 413016 - DNA, 25 bp, Homo sapien
cagttttgtctaggtcataacatac

SEQ ID NO: 413017 - DNA, 25 bp, Homo sapien
gtagaaggattgaggccagcacaga

SEQ ID NO: 413018 - DNA, 25 bp, Homo sapien
gaaatgtaagggttgtcctcatcta

SEQ ID NO: 413019 - DNA, 25 bp, Homo sapien
tcctcatctaatccgtcagtaccag

SEQ ID NO: 413020 - DNA, 25 bp, Homo sapien
aatccgtcagtaccagacagtgaac

SEQ ID NO: 413021 - DNA, 25 bp, Homo sapien
agtaccagacagtgaacatctctcc

SEQ ID NO: 413022 - DNA, 25 bp, Homo sapien
atctctcccccaggatgctgaggga

SEQ ID NO: 413023 - DNA, 25 bp, Homo sapien
aggatgtggaactacagcctctgct

SEQ ID NO: 413024 - DNA, 25 bp, Homo sapien
gaactacagcctctgctctcaagaa

SEQ ID NO: 413025 - DNA, 25 bp, Homo sapien
gcctctgctctcaagaagctcagat

SEQ ID NO: 413026 - DNA, 25 bp, Homo sapien
aagaagctcagatctgggcagggaa

SEQ ID NO: 413027 - DNA, 25 bp, Homo sapien
aggagcttttacctgctcttcggca

SEQ ID NO: 413028 - DNA, 25 bp, Homo sapien
cagagaccacattaattccctttgc

SEQ ID NO: 413029 - DNA, 25 bp, Homo sapien
gagaccacattaattccctttgcta

SEQ ID NO: 413030 - DNA, 25 bp, Homo sapien
cattaattccctttgctatactgtg

SEQ ID NO: 413031 - DNA, 25 bp, Homo sapien
aattccctttgctatactgtgatcc

SEQ ID NO: 413032 - DNA, 25 bp, Homo sapien
tccctttgctatactgtgatcctta

SEQ ID NO: 413033 - DNA, 25 bp, Homo sapien
gtgatccttagtatgttaattctta

SEQ ID NO: 413034 - DNA, 25 bp, Homo sapien
ttcttaagaaaccaacatatcactg

SEQ ID NO: 413035 - DNA, 25 bp, Homo sapien
acatatcactgaaagaaggctggca

SEQ ID NO: 413036 - DNA, 25 bp, Homo sapien
aaggctggcagaacgcaagtgcatt

SEQ ID NO: 413037 - DNA, 25 bp, Homo sapien
gcagaacgcaagtgcattttttcac

SEQ ID NO: 413038 - DNA, 25 bp, Homo sapien
aagtgcattttttcactgtgggaag

SEQ ID NO: 413039 - DNA, 25 bp, Homo sapien
accctctcacagacgtaccaatgtt

SEQ ID NO: 413040 - DNA, 25 bp, Homo sapien
ctctcacagacgtaccaatgttatt

SEQ ID NO: 413041 - DNA, 25 bp, Homo sapien
cagacgtaccaatgttatttttata

SEQ ID NO: 413042 - DNA, 25 bp, Homo sapien
ttagttatacataccttaatagttt

SEQ ID NO: 413043 - DNA, 25 bp, Homo sapien
ttcaggcaaatttggccaatattat

SEQ ID NO: 413044 - DNA, 25 bp, Homo sapien
ggcaaatttggccaatattatcatt

SEQ ID NO: 413045 - DNA, 25 bp, Homo sapien
tttctgtgttggatttcctctagga

SEQ ID NO: 413046 - DNA, 25 bp, Homo sapien
ggatttcctctaggatttcgccagt

SEQ ID NO: 413047 - DNA, 25 bp, Homo sapien
taggatttcgccagttcctacaacg

SEQ ID NO: 413048 - DNA, 25 bp, Homo sapien
tcgccagttcctacaacgtgcagta

SEQ ID NO: 413049 - DNA, 25 bp, Homo sapien
ttcctacaacgtgcagtagggcggc

SEQ ID NO: 413050 - DNA, 25 bp, Homo sapien
ttagtaaaagatgtgcaaaggccag

SEQ ID NO: 413051 - DNA, 25 bp, Homo sapien
gcaaaggccagagagggccgaaaat

SEQ ID NO: 413052 - DNA, 25 bp, Homo sapien
gggccgaaaatgaagctttcttgct

SEQ ID NO: 413053 - DNA, 25 bp, Homo sapien
gctttcttgctacacatatttctga

SEQ ID NO: 413054 - DNA, 25 bp, Homo sapien
atttctgatgactccttgggctatc

SEQ ID NO: 413055 - DNA, 25 bp, Homo sapien
gactccttgggctatctgattaagt

SEQ ID NO: 413056 - DNA, 25 bp, Homo sapien
gggctatctgattaagtgtttcctt

SEQ ID NO: 413057 - DNA, 25 bp, Homo sapien
aaatagactggtgggtactcacaga

SEQ ID NO: 413058 - DNA, 25 bp, Homo sapien
gtgggtactcacagaaaagttgtat

SEQ ID NO: 413059 - DNA, 25 bp, Homo sapien
aagttgtataagtccccctgttgct

SEQ ID NO: 413060 - DNA, 25 bp, Homo sapien
cctgttgctatttttgatgatagag

SEQ ID NO: 413061 - DNA, 25 bp, Homo sapien
acccgttcttcccttcactgtgtgg

SEQ ID NO: 413062 - DNA, 25 bp, Homo sapien
aaggaagaggactccgagattggat

SEQ ID NO: 413063 - DNA, 25 bp, Homo sapien
ggactccgagattggattggagcaa

SEQ ID NO: 413064 - DNA, 25 bp, Homo sapien
attggagcaagaaagtgtgggtatc

SEQ ID NO: 413065 - DNA, 25 bp, Homo sapien
tatcgtgtgttgtgactgtgtcttc

SEQ ID NO: 413066 - DNA, 25 bp, Homo sapien
gtgtgttgtgactgtgtcttctccg

SEQ ID NO: 413067 - DNA, 25 bp, Homo sapien
gggtgctgcttcactggaggtctcc

SEQ ID NO: 413068 - DNA, 25 bp, Homo sapien
ttcagggtctggccctcatgcctgg

SEQ ID NO: 413069 - DNA, 25 bp, Homo sapien
ccccaggtgctcgtgtgcacgtgag

SEQ ID NO: 413070 - DNA, 25 bp, Homo sapien
gtgtgcacgtgagcggctcttcctg

SEQ ID NO: 413071 - DNA, 25 bp, Homo sapien
tcctgctgactgactacagctaatt

SEQ ID NO: 413072 - DNA, 25 bp, Homo sapien
tagggtcctaacagtgctccttgtc

SEQ ID NO: 413073 - DNA, 25 bp, Homo sapien
gtgctccttgtccatcccttggagc

SEQ ID NO: 413074 - DNA, 25 bp, Homo sapien
tggcagctcccacagtgatgctgct

SEQ ID NO: 413075 - DNA, 25 bp, Homo sapien
gctgctaagggcttccaaacattgc

SEQ ID NO: 413076 - DNA, 25 bp, Homo sapien
cccaggctcctctgtgctttactaa

SEQ ID NO: 413077 - DNA, 25 bp, Homo sapien
gtgctttactaagatggcctcagtc

SEQ ID NO: 413078 - DNA, 25 bp, Homo sapien
tactaagatggcctcagtctccact

SEQ ID NO: 413079 - DNA, 25 bp, Homo sapien
actgtgggcttgagtggcatacact

SEQ ID NO: 413080 - DNA, 25 bp, Homo sapien
gtggcatacactgttattcatggtt

SEQ ID NO: 413081 - DNA, 25 bp, Homo sapien
acactgttattcatggttaaggtaa

SEQ ID NO: 413082 - DNA, 25 bp, Homo sapien
gtaaagcaggtcaagggatggcatt

SEQ ID NO: 413083 - DNA, 25 bp, Homo sapien
tttctctttattcgtcctttctcaa

SEQ ID NO: 413084 - DNA, 25 bp, Homo sapien
tattcgtcctttctcaaagatggga

SEQ ID NO: 413085 - DNA, 25 bp, Homo sapien
tcctttctcaaagatgggatactga

SEQ ID NO: 413086 - DNA, 25 bp, Homo sapien
gggatactgatcagaattgctctgt

SEQ ID NO: 413087 - DNA, 25 bp, Homo sapien
ctgatcagaattgctctgtatatgc

SEQ ID NO: 413088 - DNA, 25 bp, Homo sapien
gggacaccgacaaccaaacagacgt

SEQ ID NO: 413089 - DNA, 25 bp, Homo sapien
aaccaaacagacgtgctggctccag

SEQ ID NO: 413090 - DNA, 25 bp, Homo sapien
tgctggctccagtcctgtttttact

SEQ ID NO: 413091 - DNA, 25 bp, Homo sapien
ggagggtgctcatggccccactcac

SEQ ID NO: 413092 - DNA, 25 bp, Homo sapien
tcaccccacggaaacctttgtgtct

SEQ ID NO: 413093 - DNA, 25 bp, Homo sapien
gaaacctttgtgtcttgccctggaa

SEQ ID NO: 413094 - DNA, 25 bp, Homo sapien
gaaccgggaaggcacgaagtctcta

SEQ ID NO: 413095 - DNA, 25 bp, Homo sapien
ccgggaaggcacgaagtctctaaag

SEQ ID NO: 413096 - DNA, 25 bp, Homo sapien
cgggaaggcacgaagtctctaaagc

SEQ ID NO: 413097 - DNA, 25 bp, Homo sapien
ggaaggcacgaagtctctaaagcat

SEQ ID NO: 413098 - DNA, 25 bp, Homo sapien
gaaggcacgaagtctctaaagcatc

SEQ ID NO: 413099 - DNA, 25 bp, Homo sapien
aaggcacgaagtctctaaagcatcc

SEQ ID NO: 413100 - DNA, 25 bp, Homo sapien
aggcacgaagtctctaaagcatcca

SEQ ID NO: 413101 - DNA, 25 bp, Homo sapien
ggcacgaagtctctaaagcatccag

SEQ ID NO: 413102 - DNA, 25 bp, Homo sapien
gcacgaagtctctaaagcatccaga

SEQ ID NO: 413103 - DNA, 25 bp, Homo sapien
cacgaagtctctaaagcatccagaa

SEQ ID NO: 413104 - DNA, 25 bp, Homo sapien
acgaagtctctaaagcatccagaag

SEQ ID NO: 413105 - DNA, 25 bp, Homo sapien
ggctcagtgtatgcttaatcaggca

SEQ ID NO: 413106 - DNA, 25 bp, Homo sapien
gtgtatgcttaatcaggcatggtgc

SEQ ID NO: 413107 - DNA, 25 bp, Homo sapien
tcaggcatggtgcatcagagcggga

SEQ ID NO: 413108 - DNA, 25 bp, Homo sapien
gcatcagagcgggaaggagccatca

SEQ ID NO: 413109 - DNA, 25 bp, Homo sapien
atcagagcgggaaggagccatcaac

SEQ ID NO: 413110 - DNA, 25 bp, Homo sapien
agagcgggaaggagccatcaacagt

SEQ ID NO: 413111 - DNA, 25 bp, Homo sapien
cgggaaggagccatcaacagtgtat

SEQ ID NO: 413112 - DNA, 25 bp, Homo sapien
atcaacagtgtatacttctggagcc

SEQ ID NO: 413113 - DNA, 25 bp, Homo sapien
aggtgtgtctgagtcacaactcttc

SEQ ID NO: 413114 - DNA, 25 bp, Homo sapien
tgtgtctgagtcacaactcttcggg

SEQ ID NO: 413115 - DNA, 25 bp, Homo sapien
gagtcacaactcttcggggatgccg

SEQ ID NO: 413116 - DNA, 25 bp, Homo sapien
tgcctcagccccatgatcaggtatg

SEQ ID NO: 413117 - DNA, 25 bp, Homo sapien
ctcagccccatgatcaggtatgtgg

SEQ ID NO: 413118 - DNA, 25 bp, Homo sapien
cagccccatgatcaggtatgtggca

SEQ ID NO: 413119 - DNA, 25 bp, Homo sapien
gccccatgatcaggtatgtggcatc

SEQ ID NO: 413120 - DNA, 25 bp, Homo sapien
ccatgatcaggtatgtggcatccag

SEQ ID NO: 413121 - DNA, 25 bp, Homo sapien
tgatcaggtatgtggcatccaggcc

SEQ ID NO: 413122 - DNA, 25 bp, Homo sapien
tcaggtatgtggcatccaggccagc

SEQ ID NO: 413123 - DNA, 25 bp, Homo sapien
aggtatgtggcatccaggccagcct

SEQ ID NO: 413124 - DNA, 25 bp, Homo sapien
tatgtggcatccaggccagccttgg

SEQ ID NO: 413125 - DNA, 25 bp, Homo sapien
gcagccctcctgagttcccagctgt

SEQ ID NO: 413126 - DNA, 25 bp, Homo sapien
gtctgagtccccagctttggcgcca

SEQ ID NO: 413127 - DNA, 25 bp, Homo sapien
catgtatgatcttggtttcatgtgt

SEQ ID NO: 413128 - DNA, 25 bp, Homo sapien
gcatatctgctaaagagctgtcagt

SEQ ID NO: 413129 - DNA, 25 bp, Homo sapien
cagttttcattactgactctgtaaa

SEQ ID NO: 413130 - DNA, 25 bp, Homo sapien
gactctgtaaaatacactgttcttt

SEQ ID NO: 413131 - DNA, 25 bp, Homo sapien
aaaatacactgttctttgtgtactg

SEQ ID NO: 413132 - DNA, 25 bp, Homo sapien
gtgtactgtgtgttattttgccagc

SEQ ID NO: 413133 - DNA, 25 bp, Homo sapien
gttattttgccagctgctgcattag

SEQ ID NO: 413134 - DNA, 25 bp, Homo sapien
gctgcattagccttcaaaagtattt

SEQ ID NO: 413135 - DNA, 25 bp, Homo sapien
gcaaagtacattcctttctgtggta

SEQ ID NO: 413136 - DNA, 25 bp, Homo sapien
tcctttctgtggtattttgtcctgt

SEQ ID NO: 413137 - DNA, 25 bp, Homo sapien
ggtattttgtcctgtaactgaagta

SEQ ID NO: 413138 - DNA, 25 bp, Homo sapien
gaggagatgttacggcagctgggcc

SEQ ID NO: 413139 - DNA, 25 bp, Homo sapien
gggaacgtctcagccaaacctggag

SEQ ID NO: 413140 - DNA, 25 bp, Homo sapien
aacgtctcagccaaacctggagcgc

SEQ ID NO: 413141 - DNA, 25 bp, Homo sapien
cgccagaggcggctttccaaaggat

SEQ ID NO: 413142 - DNA, 25 bp, Homo sapien
gcggctttccaaaggatgctggcga

SEQ ID NO: 413143 - DNA, 25 bp, Homo sapien
tccaaaggatgctggcgatggagct

SEQ ID NO: 413144 - DNA, 25 bp, Homo sapien
atccccgagcagaataccctgactt

SEQ ID NO: 413145 - DNA, 25 bp, Homo sapien
gagcagaataccctgacttctctcc

SEQ ID NO: 413146 - DNA, 25 bp, Homo sapien
ggccggtggctggactctgaacaac

SEQ ID NO: 413147 - DNA, 25 bp, Homo sapien
gactctgaacaactcccttcagtaa

SEQ ID NO: 413148 - DNA, 25 bp, Homo sapien
ttcactggcagtggctggtacttgg

SEQ ID NO: 413149 - DNA, 25 bp, Homo sapien
attactagccaacagagttttacta

SEQ ID NO: 413150 - DNA, 25 bp, Homo sapien
tactattttgattgtctggttggtt

SEQ ID NO: 413151 - DNA, 25 bp, Homo sapien
ggttggtttaacaaagagcctagct

SEQ ID NO: 413152 - DNA, 25 bp, Homo sapien
aagagcctagctgactttccttctg

SEQ ID NO: 413153 - DNA, 25 bp, Homo sapien
tttccttctgtaaagtcctccttgt

SEQ ID NO: 413154 - DNA, 25 bp, Homo sapien
tgtaaagtcctccttgtaggctttt

SEQ ID NO: 413155 - DNA, 25 bp, Homo sapien
atcacattgtgcatagattcttaat

SEQ ID NO: 413156 - DNA, 25 bp, Homo sapien
gatatgatttcttttgtcaggctac

SEQ ID NO: 413157 - DNA, 25 bp, Homo sapien
ttgtcaggctacaacaatgaactgc

SEQ ID NO: 413158 - DNA, 25 bp, Homo sapien
tgaactgcagattccttgtttgtaa

SEQ ID NO: 413159 - DNA, 25 bp, Homo sapien
gtttttattcctatgttttgctatt

SEQ ID NO: 413160 - DNA, 25 bp, Homo sapien
cttagcttgagcttatgcaatgatt

SEQ ID NO: 413161 - DNA, 25 bp, Homo sapien
gcttgagcttatgcaatgattggtt

SEQ ID NO: 413162 - DNA, 25 bp, Homo sapien
gattggttaagattttggcattgta

SEQ ID NO: 413163 - DNA, 25 bp, Homo sapien
ataaattgtttttgctgagttgtaa

SEQ ID NO: 413164 - DNA, 25 bp, Homo sapien
ttgagatacaatgtattccttgtac

SEQ ID NO: 413165 - DNA, 25 bp, Homo sapien
attccttgtactgaaagaatgaaaa

SEQ ID NO: 413166 - DNA, 25 bp, Homo sapien
cagcatttgaggtaagttctttaac

SEQ ID NO: 413167 - DNA, 25 bp, Homo sapien
tgaggtaagttctttaacgtttcat

SEQ ID NO: 413168 - DNA, 25 bp, Homo sapien
aatattttgtacatgcacttgcagt

SEQ ID NO: 413169 - DNA, 25 bp, Homo sapien
ttgtacatgcacttgcagtattgag

SEQ ID NO: 413170 - DNA, 25 bp, Homo sapien
gcacttgcagtattgaggttaatca

SEQ ID NO: 413171 - DNA, 25 bp, Homo sapien
ttgtccatttactagattcaatcgt

SEQ ID NO: 413172 - DNA, 25 bp, Homo sapien
actagattcaatcgtctctgagtat

SEQ ID NO: 413173 - DNA, 25 bp, Homo sapien
atcgtctctgagtatatagggctga

SEQ ID NO: 413174 - DNA, 25 bp, Homo sapien
gtctctgagtatatagggctgatgt

SEQ ID NO: 413175 - DNA, 25 bp, Homo sapien
gggctgatgttagcaagaccctaaa

SEQ ID NO: 413176 - DNA, 25 bp, Homo sapien
aaaaatgtccattgaaccctgcttc

SEQ ID NO: 413177 - DNA, 25 bp, Homo sapien
atgtccattgaaccctgcttcaaaa

SEQ ID NO: 413178 - DNA, 25 bp, Homo sapien
atgaaaacacacctctataaaatgt

SEQ ID NO: 413179 - DNA, 25 bp, Homo sapien
aatgtgtactgggaataagctttgt

SEQ ID NO: 413180 - DNA, 25 bp, Homo sapien
agctttgtatttacatacattaggg

SEQ ID NO: 413181 - DNA, 25 bp, Homo sapien
gtttggacaaacagatgatattact

SEQ ID NO: 413182 - DNA, 25 bp, Homo sapien
ggcgtctcagaggattcaggtaatt

SEQ ID NO: 413183 - DNA, 25 bp, Homo sapien
gatcattcattccacatgtcagaga

SEQ ID NO: 413184 - DNA, 25 bp, Homo sapien
aatagacttcatacggaatctcaac

SEQ ID NO: 413185 - DNA, 25 bp, Homo sapien
tacggaatctcaactctcctctggt

SEQ ID NO: 413186 - DNA, 25 bp, Homo sapien
attcattccacatgtcagagacaaa

SEQ ID NO: 413187 - DNA, 25 bp, Homo sapien
ctcctctggtcagcaatatcagatg

SEQ ID NO: 413188 - DNA, 25 bp, Homo sapien
ggtcagcaatatcagatgtacttct

SEQ ID NO: 413189 - DNA, 25 bp, Homo sapien
gtgaataataaaccagactgcctgg

SEQ ID NO: 413190 - DNA, 25 bp, Homo sapien
agactgcctggatgcgggagcacac

SEQ ID NO: 413191 - DNA, 25 bp, Homo sapien
atgcgggagcacacgcctggaatcc

SEQ ID NO: 413192 - DNA, 25 bp, Homo sapien
aaccactgtgaatactgggcaactg

SEQ ID NO: 413193 - DNA, 25 bp, Homo sapien
tgcacatcctcaagtatactttata

SEQ ID NO: 413194 - DNA, 25 bp, Homo sapien
caagtatactttatatcatctctaa

SEQ ID NO: 413195 - DNA, 25 bp, Homo sapien
cctgtttagtacagacactactctg

SEQ ID NO: 413196 - DNA, 25 bp, Homo sapien
agacactactctgtactgatttttt

SEQ ID NO: 413197 - DNA, 25 bp, Homo sapien
tgagtattttccatccagggttggt

SEQ ID NO: 413198 - DNA, 25 bp, Homo sapien
tattttccatccagggttggttgaa

SEQ ID NO: 413199 - DNA, 25 bp, Homo sapien
gaatccacagatgtgtaactcacaa

SEQ ID NO: 413200 - DNA, 25 bp, Homo sapien
cacaaatatgaagggctgacggtac

SEQ ID NO: 413201 - DNA, 25 bp, Homo sapien
gttaattcagatttatcgcagtgat

SEQ ID NO: 413202 - DNA, 25 bp, Homo sapien
cagatttatcgcagtgatctaaagt

SEQ ID NO: 413203 - DNA, 25 bp, Homo sapien
cagtgatctaaagtaattttgcagt

SEQ ID NO: 413204 - DNA, 25 bp, Homo sapien
gtgataccaaaatttcgtatattca

SEQ ID NO: 413205 - DNA, 25 bp, Homo sapien
cgtatattcaaatcaatcttatagt

SEQ ID NO: 413206 - DNA, 25 bp, Homo sapien
ttgtattttgggttgcaattactca

SEQ ID NO: 413207 - DNA, 25 bp, Homo sapien
attttgggttgcaattactcatggc

SEQ ID NO: 413208 - DNA, 25 bp, Homo sapien
tttgggttgcaattactcatggcag

SEQ ID NO: 413209 - DNA, 25 bp, Homo sapien
tgggttgcaattactcatggcagat

SEQ ID NO: 413210 - DNA, 25 bp, Homo sapien
gttgcaattactcatggcagatgaa

SEQ ID NO: 413211 - DNA, 25 bp, Homo sapien
aattactcatggcagatgaaagcca

SEQ ID NO: 413212 - DNA, 25 bp, Homo sapien
gaaagccatggcttctttttctaga

SEQ ID NO: 413213 - DNA, 25 bp, Homo sapien
aaagccatggcttctttttctagaa

SEQ ID NO: 413214 - DNA, 25 bp, Homo sapien
ataaatgcacacatactgccaattt

SEQ ID NO: 413215 - DNA, 25 bp, Homo sapien
tatagtccaatgagattaaggccag

SEQ ID NO: 413216 - DNA, 25 bp, Homo sapien
cacattggtgtgaaacagatcttca

SEQ ID NO: 413217 - DNA, 25 bp, Homo sapien
ttggtgtgaaacagatcttcagaag

SEQ ID NO: 413218 - DNA, 25 bp, Homo sapien
catctggcaaatctgggactctata

SEQ ID NO: 413219 - DNA, 25 bp, Homo sapien
ggcaaatctgggactctatacccat

SEQ ID NO: 413220 - DNA, 25 bp, Homo sapien
caaatctgggactctatacccatta

SEQ ID NO: 413221 - DNA, 25 bp, Homo sapien
caaccatcattctacttttctctat

SEQ ID NO: 413222 - DNA, 25 bp, Homo sapien
caggatttgtccttttgtagctgac

SEQ ID NO: 413223 - DNA, 25 bp, Homo sapien
catccatattgtagaatgtgatagg

SEQ ID NO: 413224 - DNA, 25 bp, Homo sapien
atgtgataggatttcctgccatttt

SEQ ID NO: 413225 - DNA, 25 bp, Homo sapien
ataggatttcctgccattttaaggc

SEQ ID NO: 413226 - DNA, 25 bp, Homo sapien
attctctatgaatttggctatccta

SEQ ID NO: 413227 - DNA, 25 bp, Homo sapien
gaatttggctatcctactgaatctt

SEQ ID NO: 413228 - DNA, 25 bp, Homo sapien
aaagcacttcgattatctattgatc

SEQ ID NO: 413229 - DNA, 25 bp, Homo sapien
gattatctattgatctgcccagttt

SEQ ID NO: 413230 - DNA, 25 bp, Homo sapien
tctgcccagttttcaagtcatgcga

SEQ ID NO: 413231 - DNA, 25 bp, Homo sapien
ctaaaaaggttacatcatctggatc

SEQ ID NO: 413232 - DNA, 25 bp, Homo sapien
catctggatctgtaccttggctata

SEQ ID NO: 413233 - DNA, 25 bp, Homo sapien
ttggctatataagcatgttttcccc

SEQ ID NO: 413234 - DNA, 25 bp, Homo sapien
tgttttccccctattctatgtttct

SEQ ID NO: 413235 - DNA, 25 bp, Homo sapien
aggaggtgacttattactgttaatt

SEQ ID NO: 413236 - DNA, 25 bp, Homo sapien
gtcaagtctttaaaacagtgagctt

SEQ ID NO: 413237 - DNA, 25 bp, Homo sapien
aagaattccctgagtgggccaggct

SEQ ID NO: 413238 - DNA, 25 bp, Homo sapien
tcctaccctggcttttctgagtgag

SEQ ID NO: 413239 - DNA, 25 bp, Homo sapien
gcttttctgagtgagctgcctggag

SEQ ID NO: 413240 - DNA, 25 bp, Homo sapien
actgtgacctgacccgaccttgtgc

SEQ ID NO: 413241 - DNA, 25 bp, Homo sapien
gccctggtgtcctgggttttcgtga

SEQ ID NO: 413242 - DNA, 25 bp, Homo sapien
gtcctgggttttcgtgatgatcttt

SEQ ID NO: 413243 - DNA, 25 bp, Homo sapien
gatgatctttgctctgtttccagtg

SEQ ID NO: 413244 - DNA, 25 bp, Homo sapien
tttgaagcagagttcagggaaccct

SEQ ID NO: 413245 - DNA, 25 bp, Homo sapien
ttcagggaaccctgcccaaggtcct

SEQ ID NO: 413246 - DNA, 25 bp, Homo sapien
aaggtcctcctgttcagacattcct

SEQ ID NO: 413247 - DNA, 25 bp, Homo sapien
tcctgttcagacattcctatgttga

SEQ ID NO: 413248 - DNA, 25 bp, Homo sapien
ccaagatcatgccacatcactccaa

SEQ ID NO: 413249 - DNA, 25 bp, Homo sapien
caagatcatgccacatcactccaac

SEQ ID NO: 413250 - DNA, 25 bp, Homo sapien
aagatcatgccacatcactccaacc

SEQ ID NO: 413251 - DNA, 25 bp, Homo sapien
catgccacatcactccaacctgggc

SEQ ID NO: 413252 - DNA, 25 bp, Homo sapien
acagaacaagaacccatctcaaaca

SEQ ID NO: 413253 - DNA, 25 bp, Homo sapien
cagaacaagaacccatctcaaacaa

SEQ ID NO: 413254 - DNA, 25 bp, Homo sapien
agaacaagaacccatctcaaacaaa

SEQ ID NO: 413255 - DNA, 25 bp, Homo sapien
gaacaagaacccatctcaaacaaac

SEQ ID NO: 413256 - DNA, 25 bp, Homo sapien
aacaagaacccatctcaaacaaaca

SEQ ID NO: 413257 - DNA, 25 bp, Homo sapien
acaagaacccatctcaaacaaacaa

SEQ ID NO: 413258 - DNA, 25 bp, Homo sapien
caagaacccatctcaaacaaacaaa

SEQ ID NO: 413259 - DNA, 25 bp, Homo sapien
ttctgtctttattgtggtgtgagag

SEQ ID NO: 413260 - DNA, 25 bp, Homo sapien
ttgttttttccgctcagactttgtt

SEQ ID NO: 413261 - DNA, 25 bp, Homo sapien
ttttccgctcagactttgttttaag

SEQ ID NO: 413262 - DNA, 25 bp, Homo sapien
ctcagactttgttttaaggaacagg

SEQ ID NO: 413263 - DNA, 25 bp, Homo sapien
tcaatctgtgggatcaaatgccatc

SEQ ID NO: 413264 - DNA, 25 bp, Homo sapien
gtggtttttgaagttcttagatacg

SEQ ID NO: 413265 - DNA, 25 bp, Homo sapien
gttcttagatacgtgtgtgtagctt

SEQ ID NO: 413266 - DNA, 25 bp, Homo sapien
gtgtgtgtagctttgtgtggcatta

SEQ ID NO: 413267 - DNA, 25 bp, Homo sapien
gtgggatcaaatgccatctctaggg

SEQ ID NO: 413268 - DNA, 25 bp, Homo sapien
tgtgtggcattatatatagcattat

SEQ ID NO: 413269 - DNA, 25 bp, Homo sapien
atagcatgggaaactggaggacacc

SEQ ID NO: 413270 - DNA, 25 bp, Homo sapien
aaccaggttgaatcttccaatttga

SEQ ID NO: 413271 - DNA, 25 bp, Homo sapien
gaatcttccaatttgagaacccatg

SEQ ID NO: 413272 - DNA, 25 bp, Homo sapien
cttccaatttgagaacccatgtatg

SEQ ID NO: 413273 - DNA, 25 bp, Homo sapien
agaacccatgtatgggttgcagtga

SEQ ID NO: 413274 - DNA, 25 bp, Homo sapien
aaaccatgtatgtggttaggaataa

SEQ ID NO: 413275 - DNA, 25 bp, Homo sapien
aattcaaattcaccagtctccaatg

SEQ ID NO: 413276 - DNA, 25 bp, Homo sapien
accagtctccaatggtgattacttt

SEQ ID NO: 413277 - DNA, 25 bp, Homo sapien
aaaacattttagtgacttacagagg

SEQ ID NO: 413278 - DNA, 25 bp, Homo sapien
tttagtgacttacagaggattttta

SEQ ID NO: 413279 - DNA, 25 bp, Homo sapien
gttgattgttgataacactgttcat

SEQ ID NO: 413280 - DNA, 25 bp, Homo sapien
gttgataacactgttcatctactga

SEQ ID NO: 413281 - DNA, 25 bp, Homo sapien
tctgcttaggctgggtgagcttgtc

SEQ ID NO: 413282 - DNA, 25 bp, Homo sapien
tgcttaggctgggtgagcttgtcca

SEQ ID NO: 413283 - DNA, 25 bp, Homo sapien
taggctgggtgagcttgtccaggcc

SEQ ID NO: 413284 - DNA, 25 bp, Homo sapien
tgagcttgtccaggcctgtgcctca

SEQ ID NO: 413285 - DNA, 25 bp, Homo sapien
cttctctcttctaggctcagtgtat

SEQ ID NO: 413286 - DNA, 25 bp, Homo sapien
ttctctcttctaggctcagtgtatg

SEQ ID NO: 413287 - DNA, 25 bp, Homo sapien
ctctcttctaggctcagtgtatgct

SEQ ID NO: 413288 - DNA, 25 bp, Homo sapien
taggctcagtgtatgcttaatcagg

SEQ ID NO: 413289 - DNA, 25 bp, Homo sapien
cgggaaggagccatcaacagtgtat

SEQ ID NO: 413290 - DNA, 25 bp, Homo sapien
gggacttaaacccaggtgtgtctga

SEQ ID NO: 413291 - DNA, 25 bp, Homo sapien
tgtgtctgagtcacaactcttcggg

SEQ ID NO: 413292 - DNA, 25 bp, Homo sapien
aaagctggtctgataccatggctat

SEQ ID NO: 413293 - DNA, 25 bp, Homo sapien
tgataccatggctataattacagag

SEQ ID NO: 413294 - DNA, 25 bp, Homo sapien
acagagctttagttcaattaggatt

SEQ ID NO: 413295 - DNA, 25 bp, Homo sapien
tttccagtgccccttgtaatagtta

SEQ ID NO: 413296 - DNA, 25 bp, Homo sapien
atatgagtccatgcaatcttgtgat

SEQ ID NO: 413297 - DNA, 25 bp, Homo sapien
catgcaatcttgtgatgccattctc

SEQ ID NO: 413298 - DNA, 25 bp, Homo sapien
gccattctcctgaaggtgttgattt

SEQ ID NO: 413299 - DNA, 25 bp, Homo sapien
gtgttgatttctggtacccagccag

SEQ ID NO: 413300 - DNA, 25 bp, Homo sapien
cagcttagctttggctgctggaagc

SEQ ID NO: 413301 - DNA, 25 bp, Homo sapien
ggtactgatgattacttcctggaaa

SEQ ID NO: 413302 - DNA, 25 bp, Homo sapien
gattacttcctggaaatcttgacag

SEQ ID NO: 413303 - DNA, 25 bp, Homo sapien
aatgccttccgacgaatgggacagc

SEQ ID NO: 413304 - DNA, 25 bp, Homo sapien
tgggacagcccaaaaggcttaactt

SEQ ID NO: 413305 - DNA, 25 bp, Homo sapien
ttaactttagtgttgagctcagcaa

SEQ ID NO: 413306 - DNA, 25 bp, Homo sapien
agctcagcaaaatgtcgtcgaataa

SEQ ID NO: 413307 - DNA, 25 bp, Homo sapien
atgtcgtcgaataagctcaaattaa

SEQ ID NO: 413308 - DNA, 25 bp, Homo sapien
tctgcaaagcagaaggccgacttga

SEQ ID NO: 413309 - DNA, 25 bp, Homo sapien
aaaatgcttgtgagtcatcctctca

SEQ ID NO: 413310 - DNA, 25 bp, Homo sapien
tcacatctgcccttactgtaatcga

SEQ ID NO: 413311 - DNA, 25 bp, Homo sapien
gcccttactgtaatcgagagttcac

SEQ ID NO: 413312 - DNA, 25 bp, Homo sapien
gagagttcacttacattggaagcct

SEQ ID NO: 413313 - DNA, 25 bp, Homo sapien
ggaagcctgaataaacacgccgcct

SEQ ID NO: 413314 - DNA, 25 bp, Homo sapien
aatttcctgcaatgttgagctcgcc

SEQ ID NO: 413315 - DNA, 25 bp, Homo sapien
gcaatgttgagctcgccttgactca

SEQ ID NO: 413316 - DNA, 25 bp, Homo sapien
tgactcacaccgagcacatttcttg

SEQ ID NO: 413317 - DNA, 25 bp, Homo sapien
gttaagtttttgattgagcctgagg

SEQ ID NO: 413318 - DNA, 25 bp, Homo sapien
aggttttatctgcatcagaagtcac

SEQ ID NO: 413319 - DNA, 25 bp, Homo sapien
ggctgccttgtgttgtacccacttg

SEQ ID NO: 413320 - DNA, 25 bp, Homo sapien
tgttgtacccacttgccggtcagta

SEQ ID NO: 413321 - DNA, 25 bp, Homo sapien
taattagtttcttctcacaccagct

SEQ ID NO: 413322 - DNA, 25 bp, Homo sapien
cacaccagctcgaagatcttaaaat

SEQ ID NO: 413323 - DNA, 25 bp, Homo sapien
ttaaaataacagcactctccttcct

SEQ ID NO: 413324 - DNA, 25 bp, Homo sapien
tccttagtaattttcttgcaaaagc

SEQ ID NO: 413325 - DNA, 25 bp, Homo sapien
agctgtcactgagccctgcatgttt

SEQ ID NO: 413326 - DNA, 25 bp, Homo sapien
cactgtactcggcacatggtttatt

SEQ ID NO: 413327 - DNA, 25 bp, Homo sapien
atggtttattattgctatctcagac

SEQ ID NO: 413328 - DNA, 25 bp, Homo sapien
tgctatctcagacaaaacccaacct

SEQ ID NO: 413329 - DNA, 25 bp, Homo sapien
aacccaacctagatgtgtgagtttg

SEQ ID NO: 413330 - DNA, 25 bp, Homo sapien
ggattccgattttaatacgcctcac

SEQ ID NO: 413331 - DNA, 25 bp, Homo sapien
taatttattccaagttacgtcaagg

SEQ ID NO: 413332 - DNA, 25 bp, Homo sapien
aaggaagataaggtcccggtgagat

SEQ ID NO: 413333 - DNA, 25 bp, Homo sapien
cagtctgaggtcttgtttggtagct

SEQ ID NO: 413334 - DNA, 25 bp, Homo sapien
tgggcacgagggttaattagtagct

SEQ ID NO: 413335 - DNA, 25 bp, Homo sapien
taattagtagctggagctgtcactg

SEQ ID NO: 413336 - DNA, 25 bp, Homo sapien
attttcaaaactgttcgtgtcttca

SEQ ID NO: 413337 - DNA, 25 bp, Homo sapien
cgtgtcttcagttcattctgtcata

SEQ ID NO: 413338 - DNA, 25 bp, Homo sapien
ttctgtcataactttgctattgtaa

SEQ ID NO: 413339 - DNA, 25 bp, Homo sapien
gtgaataccagtttatttaagctgt

SEQ ID NO: 413340 - DNA, 25 bp, Homo sapien
agctgttctcttttatactgtatta

SEQ ID NO: 413341 - DNA, 25 bp, Homo sapien
atctgcgtttagtaccatttttgtt

SEQ ID NO: 413342 - DNA, 25 bp, Homo sapien
aactggcatttaccgtttttcacat

SEQ ID NO: 413343 - DNA, 25 bp, Homo sapien
gtttttcacattaacccaccttgca

SEQ ID NO: 413344 - DNA, 25 bp, Homo sapien
tctccacttttctatgcattctatc

SEQ ID NO: 413345 - DNA, 25 bp, Homo sapien
atcattgatttgacacacttcatag

SEQ ID NO: 413346 - DNA, 25 bp, Homo sapien
taaatactctacgtttggttcaatt

SEQ ID NO: 413347 - DNA, 25 bp, Homo sapien
acatggctttaatggaagggcttag

SEQ ID NO: 413348 - DNA, 25 bp, Homo sapien
aagggcttagggagttctgcttcaa

SEQ ID NO: 413349 - DNA, 25 bp, Homo sapien
agttctgcttcaagctggctgatca

SEQ ID NO: 413350 - DNA, 25 bp, Homo sapien
atctgtacatgcacccaggaagcac

SEQ ID NO: 413351 - DNA, 25 bp, Homo sapien
gaagcacagctttagtgtcaatgga

SEQ ID NO: 413352 - DNA, 25 bp, Homo sapien
gtttcgaatagcaaaattctccact

SEQ ID NO: 413353 - DNA, 25 bp, Homo sapien
tctccactgaacttgctgaaagcac

SEQ ID NO: 413354 - DNA, 25 bp, Homo sapien
gagaggactgtgcattgcttttcaa

SEQ ID NO: 413355 - DNA, 25 bp, Homo sapien
tgttctagaaatgggtaccaactct

SEQ ID NO: 413356 - DNA, 25 bp, Homo sapien
gggtaccaactctcaaaatgtttca

SEQ ID NO: 413357 - DNA, 25 bp, Homo sapien
caaaatgtttcacgtactcatggaa

SEQ ID NO: 413358 - DNA, 25 bp, Homo sapien
cagatttttattgaagcattcatca

SEQ ID NO: 413359 - DNA, 25 bp, Homo sapien
agatttttattgaagcattcatcag

SEQ ID NO: 413360 - DNA, 25 bp, Homo sapien
gatttttattgaagcattcatcagc

SEQ ID NO: 413361 - DNA, 25 bp, Homo sapien
atttttattgaagcattcatcagca

SEQ ID NO: 413362 - DNA, 25 bp, Homo sapien
tttttattgaagcattcatcagcag

SEQ ID NO: 413363 - DNA, 25 bp, Homo sapien
ttttattgaagcattcatcagcagc

SEQ ID NO: 413364 - DNA, 25 bp, Homo sapien
tttattgaagcattcatcagcagcc

SEQ ID NO: 413365 - DNA, 25 bp, Homo sapien
ttattgaagcattcatcagcagcct

SEQ ID NO: 413366 - DNA, 25 bp, Homo sapien
tattgaagcattcatcagcagcctc

SEQ ID NO: 413367 - DNA, 25 bp, Homo sapien
atatgtttgagatacctggccactg

SEQ ID NO: 413368 - DNA, 25 bp, Homo sapien
agatacctggccactggaggtcatc

SEQ ID NO: 413369 - DNA, 25 bp, Homo sapien
gaggtcatctcgtctactatattca

SEQ ID NO: 413370 - DNA, 25 bp, Homo sapien
gtctactatattcaccgcagataaa

SEQ ID NO: 413371 - DNA, 25 bp, Homo sapien
acacaaccttgtgattgctagcagt

SEQ ID NO: 413372 - DNA, 25 bp, Homo sapien
tgattgctagcagtgaaagctcaga

SEQ ID NO: 413373 - DNA, 25 bp, Homo sapien
ttattgttgcatcctgaagcttccc

SEQ ID NO: 413374 - DNA, 25 bp, Homo sapien
ccatgctgggctcagtgtgaacaaa

SEQ ID NO: 413375 - DNA, 25 bp, Homo sapien
cagtgtgaacaaacagcgcgggaga

SEQ ID NO: 413376 - DNA, 25 bp, Homo sapien
agcgcgggagaatgcaaccactgca

SEQ ID NO: 413377 - DNA, 25 bp, Homo sapien
ccactgcagaggcatatgtttgaga

SEQ ID NO: 413378 - DNA, 25 bp, Homo sapien
ccccaactgatcaatttctccaatt

SEQ ID NO: 413379 - DNA, 25 bp, Homo sapien
ggatcccatgagaaggtgagtcacc

SEQ ID NO: 413380 - DNA, 25 bp, Homo sapien
gatcccatgagaaggtgagtcacca

SEQ ID NO: 413381 - DNA, 25 bp, Homo sapien
cccatgagaaggtgagtcaccagaa

SEQ ID NO: 413382 - DNA, 25 bp, Homo sapien
ccatgagaaggtgagtcaccagaaa

SEQ ID NO: 413383 - DNA, 25 bp, Homo sapien
gtcaccagaaaatgcagtttccaca

SEQ ID NO: 413384 - DNA, 25 bp, Homo sapien
atctccctaccccaactgatcaatt

SEQ ID NO: 413385 - DNA, 25 bp, Homo sapien
tctccctaccccaactgatcaattt

SEQ ID NO: 413386 - DNA, 25 bp, Homo sapien
tccctaccccaactgatcaatttct

SEQ ID NO: 413387 - DNA, 25 bp, Homo sapien
taccccaactgatcaatttctccaa

SEQ ID NO: 413388 - DNA, 25 bp, Homo sapien
accccaactgatcaatttctccaat

SEQ ID NO: 413389 - DNA, 25 bp, Homo sapien
ttagcccttccttttgcagttgcgt

SEQ ID NO: 413390 - DNA, 25 bp, Homo sapien
tccttttgcagttgcgtctgggaag

SEQ ID NO: 413391 - DNA, 25 bp, Homo sapien
cggactccctcgagagaatgtgcta

SEQ ID NO: 413392 - DNA, 25 bp, Homo sapien
gacagcccctgtcttcttggcgtgg

SEQ ID NO: 413393 - DNA, 25 bp, Homo sapien
gtcttcttggcgtggtttatatgtc

SEQ ID NO: 413394 - DNA, 25 bp, Homo sapien
ggcgtggtttatatgtccgggatct

SEQ ID NO: 413395 - DNA, 25 bp, Homo sapien
atgtccgggatctggatcagattct

SEQ ID NO: 413396 - DNA, 25 bp, Homo sapien
gggctcagaaacgtcggttgcattg

SEQ ID NO: 413397 - DNA, 25 bp, Homo sapien
gaaacgtcggttgcattgagctact

SEQ ID NO: 413398 - DNA, 25 bp, Homo sapien
acgtcggttgcattgagctactggg

SEQ ID NO: 413399 - DNA, 25 bp, Homo sapien
cagcaaggctggtctgggtctctgc

SEQ ID NO: 413400 - DNA, 25 bp, Homo sapien
atctcttcttttgatcactgttcct

SEQ ID NO: 413401 - DNA, 25 bp, Homo sapien
ctcttcttttgatcactgttcctga

SEQ ID NO: 413402 - DNA, 25 bp, Homo sapien
cttcttttgatcactgttcctgatt

SEQ ID NO: 413403 - DNA, 25 bp, Homo sapien
cttttgatcactgttcctgattgtg

SEQ ID NO: 413404 - DNA, 25 bp, Homo sapien
gatcactgttcctgattgtgacatt

SEQ ID NO: 413405 - DNA, 25 bp, Homo sapien
actgttcctgattgtgacattgtgc

SEQ ID NO: 413406 - DNA, 25 bp, Homo sapien
gttcctgattgtgacattgtgcaag

SEQ ID NO: 413407 - DNA, 25 bp, Homo sapien
cctgattgtgacattgtgcaagtgt

SEQ ID NO: 413408 - DNA, 25 bp, Homo sapien
gattgtgacattgtgcaagtgttaa

SEQ ID NO: 413409 - DNA, 25 bp, Homo sapien
tgtgcaagtgttaaattgtgtgcct

SEQ ID NO: 413410 - DNA, 25 bp, Homo sapien
tgtgccttttgttcctgaagaaaga

SEQ ID NO: 413411 - DNA, 25 bp, Homo sapien
tccacaatccccttaaaaactgtag

SEQ ID NO: 413412 - DNA, 25 bp, Homo sapien
aatttgaaggtttgctcctgtctcc

SEQ ID NO: 413413 - DNA, 25 bp, Homo sapien
ttgaaggtttgctcctgtctcctca

SEQ ID NO: 413414 - DNA, 25 bp, Homo sapien
ctcagaagcctgtaatcattaaact

SEQ ID NO: 413415 - DNA, 25 bp, Homo sapien
caggtcctgcatgccagtaaaacta

SEQ ID NO: 413416 - DNA, 25 bp, Homo sapien
gtcctgcatgccagtaaaactactc

SEQ ID NO: 413417 - DNA, 25 bp, Homo sapien
aaactactcatgtcagctgttctgc

SEQ ID NO: 413418 - DNA, 25 bp, Homo sapien
tactcatgtcagctgttctgcagga

SEQ ID NO: 413419 - DNA, 25 bp, Homo sapien
atgtcagctgttctgcaggatccca

SEQ ID NO: 413420 - DNA, 25 bp, Homo sapien
agctgttctgcaggatcccatgaga

SEQ ID NO: 413421 - DNA, 25 bp, Homo sapien
ctgttctgcaggatcccatgagaag

SEQ ID NO: 413422 - DNA, 25 bp, Homo sapien
gaggtgtatactgatgattcttccc

SEQ ID NO: 413423 - DNA, 25 bp, Homo sapien
aggtgtatactgatgattcttccca

SEQ ID NO: 413424 - DNA, 25 bp, Homo sapien
ggtgtatactgatgattcttcccac

SEQ ID NO: 413425 - DNA, 25 bp, Homo sapien
gtgtatactgatgattcttcccact

SEQ ID NO: 413426 - DNA, 25 bp, Homo sapien
tgtatactgatgattcttcccactc

SEQ ID NO: 413427 - DNA, 25 bp, Homo sapien
gtatactgatgattcttcccactca

SEQ ID NO: 413428 - DNA, 25 bp, Homo sapien
tatactgatgattcttcccactcat

SEQ ID NO: 413429 - DNA, 25 bp, Homo sapien
tttgtttgtccagaagtaaataaat

SEQ ID NO: 413430 - DNA, 25 bp, Homo sapien
gtttgtccagaagtaaataaatgtc

SEQ ID NO: 413431 - DNA, 25 bp, Homo sapien
ttgtccagaagtaaataaatgtcgg

SEQ ID NO: 413432 - DNA, 25 bp, Homo sapien
cagaagtaaataaatgtcggaagtt

SEQ ID NO: 413433 - DNA, 25 bp, Homo sapien
cttggtcttcatttccagatatcat

SEQ ID NO: 413434 - DNA, 25 bp, Homo sapien
ttggtcttcatttccagatatcatc

SEQ ID NO: 413435 - DNA, 25 bp, Homo sapien
tggtcttcatttccagatatcatct

SEQ ID NO: 413436 - DNA, 25 bp, Homo sapien
ggtcttcatttccagatatcatctc

SEQ ID NO: 413437 - DNA, 25 bp, Homo sapien
gtcttcatttccagatatcatctct

SEQ ID NO: 413438 - DNA, 25 bp, Homo sapien
tcttcatttccagatatcatctctt

SEQ ID NO: 413439 - DNA, 25 bp, Homo sapien
atactggagtatatagtctattaag

SEQ ID NO: 413440 - DNA, 25 bp, Homo sapien
gtctattaagtagtaagttggtatg

SEQ ID NO: 413441 - DNA, 25 bp, Homo sapien
gtatgttttaatattggactaaata

SEQ ID NO: 413442 - DNA, 25 bp, Homo sapien
aaatccagaatgcaaaattttttga

SEQ ID NO: 413443 - DNA, 25 bp, Homo sapien
cagaatgcaaaattttttgagtgct

SEQ ID NO: 413444 - DNA, 25 bp, Homo sapien
atctccatctccatggaatcacact

SEQ ID NO: 413445 - DNA, 25 bp, Homo sapien
gaatcacacttgagcttccttagag

SEQ ID NO: 413446 - DNA, 25 bp, Homo sapien
acacttgagcttccttagagaaaac

SEQ ID NO: 413447 - DNA, 25 bp, Homo sapien
gagaaaacaaactagtatccactac

SEQ ID NO: 413448 - DNA, 25 bp, Homo sapien
attaattttctttatgagtccattt

SEQ ID NO: 413449 - DNA, 25 bp, Homo sapien
atgagtccatttcatttgaactgat

SEQ ID NO: 413450 - DNA, 25 bp, Homo sapien
gataatgttgtatacaccatagtta

SEQ ID NO: 413451 - DNA, 25 bp, Homo sapien
atgttctctcatgtatactgcctaa

SEQ ID NO: 413452 - DNA, 25 bp, Homo sapien
ctcatgtatactgcctaaatcactt

SEQ ID NO: 413453 - DNA, 25 bp, Homo sapien
tccacaatttatctacttttaccct

SEQ ID NO: 413454 - DNA, 25 bp, Homo sapien
tctacttttacccttggataaatca

SEQ ID NO: 413455 - DNA, 25 bp, Homo sapien
tgtggacaactcgaataagtttgac

SEQ ID NO: 413456 - DNA, 25 bp, Homo sapien
tggacaactcgaataagtttgactt

SEQ ID NO: 413457 - DNA, 25 bp, Homo sapien
gacaactcgaataagtttgacttgt

SEQ ID NO: 413458 - DNA, 25 bp, Homo sapien
caactcgaataagtttgacttgtgt

SEQ ID NO: 413459 - DNA, 25 bp, Homo sapien
actcgaataagtttgacttgtgttt

SEQ ID NO: 413460 - DNA, 25 bp, Homo sapien
taaccaccagatcattccttctgta

SEQ ID NO: 413461 - DNA, 25 bp, Homo sapien
aaccaccagatcattccttctgtag

SEQ ID NO: 413462 - DNA, 25 bp, Homo sapien
accaccagatcattccttctgtagc

SEQ ID NO: 413463 - DNA, 25 bp, Homo sapien
ccaccagatcattccttctgtagct

SEQ ID NO: 413464 - DNA, 25 bp, Homo sapien
caccagatcattccttctgtagctc

SEQ ID NO: 413465 - DNA, 25 bp, Homo sapien
accagatcattccttctgtagctca

SEQ ID NO: 413466 - DNA, 25 bp, Homo sapien
gatcacagcagaatacccttggatt

SEQ ID NO: 413467 - DNA, 25 bp, Homo sapien
aagttcgtaccttgcatttctctga

SEQ ID NO: 413468 - DNA, 25 bp, Homo sapien
gcatttctctgaattctagtctctc

SEQ ID NO: 413469 - DNA, 25 bp, Homo sapien
ctagtctctcataagcactgctttg

SEQ ID NO: 413470 - DNA, 25 bp, Homo sapien
tgctggatgattttcactgctttgt

SEQ ID NO: 413471 - DNA, 25 bp, Homo sapien
gactttgagcgatctctcacatgat

SEQ ID NO: 413472 - DNA, 25 bp, Homo sapien
atgtcatcttacacacctagcattg

SEQ ID NO: 413473 - DNA, 25 bp, Homo sapien
gtgaatgctgtagtgacatccttta

SEQ ID NO: 413474 - DNA, 25 bp, Homo sapien
agtgacatcctttataggcacctta

SEQ ID NO: 413475 - DNA, 25 bp, Homo sapien
aggcaccttacagctcaaaactttt

SEQ ID NO: 413476 - DNA, 25 bp, Homo sapien
gtttcatttcatgccttacttatca

SEQ ID NO: 413477 - DNA, 25 bp, Homo sapien
agagcagaattcatcaatatttatc

SEQ ID NO: 413478 - DNA, 25 bp, Homo sapien
gagcagaattcatcaatatttatca

SEQ ID NO: 413479 - DNA, 25 bp, Homo sapien
gcagaattcatcaatatttatcagc

SEQ ID NO: 413480 - DNA, 25 bp, Homo sapien
gaattcatcaatatttatcagcacc

SEQ ID NO: 413481 - DNA, 25 bp, Homo sapien
aattcatcaatatttatcagcacca

SEQ ID NO: 413482 - DNA, 25 bp, Homo sapien
attcatcaatatttatcagcaccaa

SEQ ID NO: 413483 - DNA, 25 bp, Homo sapien
ttcatcaatatttatcagcaccaat

SEQ ID NO: 413484 - DNA, 25 bp, Homo sapien
tcatcaatatttatcagcaccaatt

SEQ ID NO: 413485 - DNA, 25 bp, Homo sapien
catcaatatttatcagcaccaattt

SEQ ID NO: 413486 - DNA, 25 bp, Homo sapien
atcaatatttatcagcaccaatttt

SEQ ID NO: 413487 - DNA, 25 bp, Homo sapien
caatatttatcagcaccaatttttt

SEQ ID NO: 413488 - DNA, 25 bp, Homo sapien
gtgcaccctaggagaaggcattacc

SEQ ID NO: 413489 - DNA, 25 bp, Homo sapien
acaggtgtcgctttggtctaaggca

SEQ ID NO: 413490 - DNA, 25 bp, Homo sapien
gctttggtctaaggcagttgggaac

SEQ ID NO: 413491 - DNA, 25 bp, Homo sapien
ggaacagtttgtgagttctctttac

SEQ ID NO: 413492 - DNA, 25 bp, Homo sapien
gttctctttactctctttatcatca

SEQ ID NO: 413493 - DNA, 25 bp, Homo sapien
ctctctttatcatcactgtgactgg

SEQ ID NO: 413494 - DNA, 25 bp, Homo sapien
tgactggaagggaaacaccgagatg

SEQ ID NO: 413495 - DNA, 25 bp, Homo sapien
caagatggaagctgcctggatctgt

SEQ ID NO: 413496 - DNA, 25 bp, Homo sapien
gctgcctggatctgtgagctgctgt

SEQ ID NO: 413497 - DNA, 25 bp, Homo sapien
ggcattacccctctgtggcagaggt

SEQ ID NO: 413498 - DNA, 25 bp, Homo sapien
tggcagaggtggtcgtgttcatcaa

SEQ ID NO: 413499 - DNA, 25 bp, Homo sapien
aggcctctgaggtctgcgagttttc

SEQ ID NO: 413500 - DNA, 25 bp, Homo sapien
tgaggtctgcgagttttcctccacc

SEQ ID NO: 413501 - DNA, 25 bp, Homo sapien
tttgcacatcctattgactcagctc

SEQ ID NO: 413502 - DNA, 25 bp, Homo sapien
acatcctattgactcagctccaaat

SEQ ID NO: 413503 - DNA, 25 bp, Homo sapien
tattgactcagctccaaatagcggg

SEQ ID NO: 413504 - DNA, 25 bp, Homo sapien
gggcctgtcaggagcctgactctgt

SEQ ID NO: 413505 - DNA, 25 bp, Homo sapien
gactctgttcagacaccagggaaac

SEQ ID NO: 413506 - DNA, 25 bp, Homo sapien
gggaaacaacagcacaccaggcaga

SEQ ID NO: 413507 - DNA, 25 bp, Homo sapien
aacagcacaccaggcagatgcagtt

SEQ ID NO: 413508 - DNA, 25 bp, Homo sapien
ggcagatgcagttatgtccatcggg

SEQ ID NO: 413509 - DNA, 25 bp, Homo sapien
tgtccatcggggaacttacagccta

SEQ ID NO: 413510 - DNA, 25 bp, Homo sapien
ggaactcaggtggattcataatttg

SEQ ID NO: 413511 - DNA, 25 bp, Homo sapien
gaactcaggtggattcataatttgt

SEQ ID NO: 413512 - DNA, 25 bp, Homo sapien
actcaggtggattcataatttgttc

SEQ ID NO: 413513 - DNA, 25 bp, Homo sapien
ctcaggtggattcataatttgttct

SEQ ID NO: 413514 - DNA, 25 bp, Homo sapien
cataattggttgtatttcttaggat

SEQ ID NO: 413515 - DNA, 25 bp, Homo sapien
taattggttgtatttcttaggatat

SEQ ID NO: 413516 - DNA, 25 bp, Homo sapien
attggttgtatttcttaggatattt

SEQ ID NO: 413517 - DNA, 25 bp, Homo sapien
ggttgtatttcttaggatatttgca

SEQ ID NO: 413518 - DNA, 25 bp, Homo sapien
aaaattgtctataattctactactc

SEQ ID NO: 413519 - DNA, 25 bp, Homo sapien
aattgtctataattctactactcat

SEQ ID NO: 413520 - DNA, 25 bp, Homo sapien
ataattctactactcatataaaacc

SEQ ID NO: 413521 - DNA, 25 bp, Homo sapien
tcatggcggacgtgactgtgggaag

SEQ ID NO: 413522 - DNA, 25 bp, Homo sapien
ttcacttaaaaacagatcccacttg

SEQ ID NO: 413523 - DNA, 25 bp, Homo sapien
gacagtgaccagcaacaaggtggat

SEQ ID NO: 413524 - DNA, 25 bp, Homo sapien
tgaccagcaacaaggtggatggtgt

SEQ ID NO: 413525 - DNA, 25 bp, Homo sapien
cacttaaaaacagatcccacttggg

SEQ ID NO: 413526 - DNA, 25 bp, Homo sapien
atggtgtggccggttactgagatgg

SEQ ID NO: 413527 - DNA, 25 bp, Homo sapien
aaatgtggttgcagaggcagtaatt

SEQ ID NO: 413528 - DNA, 25 bp, Homo sapien
tgcagaggcagtaatttgaggtatc

SEQ ID NO: 413529 - DNA, 25 bp, Homo sapien
atttgaggtatctgtgtgacatcca

SEQ ID NO: 413530 - DNA, 25 bp, Homo sapien
gaggtatctgtgtgacatccaaaca

SEQ ID NO: 413531 - DNA, 25 bp, Homo sapien
ggtatctgtgtgacatccaaacaga

SEQ ID NO: 413532 - DNA, 25 bp, Homo sapien
cctccaaaccatgcattgtctgtga

SEQ ID NO: 413533 - DNA, 25 bp, Homo sapien
ttgtctgtgatgtatctgcccagcc

SEQ ID NO: 413534 - DNA, 25 bp, Homo sapien
agccttctcagaactcaatgttgta

SEQ ID NO: 413535 - DNA, 25 bp, Homo sapien
ttttccctctaggacctgaattggt

SEQ ID NO: 413536 - DNA, 25 bp, Homo sapien
cctgaattggtcttggaggcagctt

SEQ ID NO: 413537 - DNA, 25 bp, Homo sapien
gttcctgtccacatgcactatatat

SEQ ID NO: 413538 - DNA, 25 bp, Homo sapien
tttctcctctcatgaatctgctcgt

SEQ ID NO: 413539 - DNA, 25 bp, Homo sapien
atgaatctgctcgtttctctacttc

SEQ ID NO: 413540 - DNA, 25 bp, Homo sapien
gtttctctacttctgtctacgtaga

SEQ ID NO: 413541 - DNA, 25 bp, Homo sapien
gtctacgtagaagcactcagcaact

SEQ ID NO: 413542 - DNA, 25 bp, Homo sapien
gcactcagcaactagtttctgctca

SEQ ID NO: 413543 - DNA, 25 bp, Homo sapien
ttcctccaagccacatgaggactct

SEQ ID NO: 413544 - DNA, 25 bp, Homo sapien
ccaagccacatgaggactctggcac

SEQ ID NO: 413545 - DNA, 25 bp, Homo sapien
ccacccacaaagcaagacctgtatt

SEQ ID NO: 413546 - DNA, 25 bp, Homo sapien
gcaagacctgtatttataagccgag

SEQ ID NO: 413547 - DNA, 25 bp, Homo sapien
aggagacaacaaacctcgggaactg

SEQ ID NO: 413548 - DNA, 25 bp, Homo sapien
aaacctcgggaactggagccagagc

SEQ ID NO: 413549 - DNA, 25 bp, Homo sapien
agagctgcggcctgactgacgcctt

SEQ ID NO: 413550 - DNA, 25 bp, Homo sapien
tgactgacgccttttgatgctcacg

SEQ ID NO: 413551 - DNA, 25 bp, Homo sapien
gatgctcacgggaaatttctgccca

SEQ ID NO: 413552 - DNA, 25 bp, Homo sapien
acgggaaatttctgcccaggatctc

SEQ ID NO: 413553 - DNA, 25 bp, Homo sapien
gaaatttctgcccaggatctcagcc

SEQ ID NO: 413554 - DNA, 25 bp, Homo sapien
ttactgtacattctgtggcttatag

SEQ ID NO: 413555 - DNA, 25 bp, Homo sapien
tgtacattctgtggcttatagttct

SEQ ID NO: 413556 - DNA, 25 bp, Homo sapien
acattctgtggcttatagttctgaa

SEQ ID NO: 413557 - DNA, 25 bp, Homo sapien
tctgtggcttatagttctgaatctc

SEQ ID NO: 413558 - DNA, 25 bp, Homo sapien
gtggcttatagttctgaatctcccc

SEQ ID NO: 413559 - DNA, 25 bp, Homo sapien
tgaatctccccatgaaaattctgtt

SEQ ID NO: 413560 - DNA, 25 bp, Homo sapien
gcctggtactcatgatagaccccta

SEQ ID NO: 413561 - DNA, 25 bp, Homo sapien
ctggtactcatgatagacccctaat

SEQ ID NO: 413562 - DNA, 25 bp, Homo sapien
gtactcatgatagacccctaattat

SEQ ID NO: 413563 - DNA, 25 bp, Homo sapien
actcatgatagacccctaattattt

SEQ ID NO: 413564 - DNA, 25 bp, Homo sapien
tagacccctaattattttgtatctt

SEQ ID NO: 413565 - DNA, 25 bp, Homo sapien
ccccatggtatacaggcggatgact

SEQ ID NO: 413566 - DNA, 25 bp, Homo sapien
caggcggatgactatatattcttat

SEQ ID NO: 413567 - DNA, 25 bp, Homo sapien
atactgttgcttgacttaattccgt

SEQ ID NO: 413568 - DNA, 25 bp, Homo sapien
gcttgacttaattccgtgcaaaata

SEQ ID NO: 413569 - DNA, 25 bp, Homo sapien
gattatgtgcaaacactgcaccatt

SEQ ID NO: 413570 - DNA, 25 bp, Homo sapien
agtagtaactgtaggctaatgcttt

SEQ ID NO: 413571 - DNA, 25 bp, Homo sapien
ttcagtttttcctaaggtgatttat

SEQ ID NO: 413572 - DNA, 25 bp, Homo sapien
gatttattttcccaagtgagaaagg

SEQ ID NO: 413573 - DNA, 25 bp, Homo sapien
atccgtggattatggtatctgcaga

SEQ ID NO: 413574 - DNA, 25 bp, Homo sapien
ttatggtatctgcagagagagtcct

SEQ ID NO: 413575 - DNA, 25 bp, Homo sapien
agagagagtcctgtaaccaatcccc

SEQ ID NO: 413576 - DNA, 25 bp, Homo sapien
caataaaatgaccagcaagtaaact

SEQ ID NO: 413577 - DNA, 25 bp, Homo sapien
aataaaatgaccagcaagtaaactt

SEQ ID NO: 413578 - DNA, 25 bp, Homo sapien
ataaaatgaccagcaagtaaacttg

SEQ ID NO: 413579 - DNA, 25 bp, Homo sapien
taaaatgaccagcaagtaaacttga

SEQ ID NO: 413580 - DNA, 25 bp, Homo sapien
aaaatgaccagcaagtaaacttgaa

SEQ ID NO: 413581 - DNA, 25 bp, Homo sapien
aaatgaccagcaagtaaacttgaaa

SEQ ID NO: 413582 - DNA, 25 bp, Homo sapien
aatgaccagcaagtaaacttgaaac

SEQ ID NO: 413583 - DNA, 25 bp, Homo sapien
aatacttgtatatattgtttacaac

SEQ ID NO: 413584 - DNA, 25 bp, Homo sapien
acttgtatatattgtttacaacttg

SEQ ID NO: 413585 - DNA, 25 bp, Homo sapien
ttgtatatattgtttacaacttgtt

SEQ ID NO: 413586 - DNA, 25 bp, Homo sapien
caacttgttttaaagtatgaataca

SEQ ID NO: 413587 - DNA, 25 bp, Homo sapien
attggctgtgtagaggttttaaggt

SEQ ID NO: 413588 - DNA, 25 bp, Homo sapien
tcgtatcagagaagttagttgcaat

SEQ ID NO: 413589 - DNA, 25 bp, Homo sapien
gtaggagtactcacacagtttattt

SEQ ID NO: 413590 - DNA, 25 bp, Homo sapien
gatttcttatgtatggtctccggtt

SEQ ID NO: 413591 - DNA, 25 bp, Homo sapien
gtctccggttttccataccgattga

SEQ ID NO: 413592 - DNA, 25 bp, Homo sapien
taccgattgatagttcagggctgct

SEQ ID NO: 413593 - DNA, 25 bp, Homo sapien
attgatagttcagggctgctttgac

SEQ ID NO: 413594 - DNA, 25 bp, Homo sapien
aaatactgtgcttctactgccacct

SEQ ID NO: 413595 - DNA, 25 bp, Homo sapien
tactgccacctacagatgattagtg

SEQ ID NO: 413596 - DNA, 25 bp, Homo sapien
gattagtgggtcttggagctcttca

SEQ ID NO: 413597 - DNA, 25 bp, Homo sapien
gtgggtcttggagctcttcaccttt

SEQ ID NO: 413598 - DNA, 25 bp, Homo sapien
caaatgctttcccaacaatcacgac

SEQ ID NO: 413599 - DNA, 25 bp, Homo sapien
ttcccaacaatcacgaccacaagag

SEQ ID NO: 413600 - DNA, 25 bp, Homo sapien
gaccacaagagtcaacagtctgttt

SEQ ID NO: 413601 - DNA, 25 bp, Homo sapien
ggatgactgaaaacacacaggttta

SEQ ID NO: 413602 - DNA, 25 bp, Homo sapien
aacacacaggtttacgatctgtaaa

SEQ ID NO: 413603 - DNA, 25 bp, Homo sapien
taatcttgttgtataggtaggccag

SEQ ID NO: 413604 - DNA, 25 bp, Homo sapien
ataggtaggccagagggcactcgca

SEQ ID NO: 413605 - DNA, 25 bp, Homo sapien
cactcgcagccttctgattgattta

SEQ ID NO: 413606 - DNA, 25 bp, Homo sapien
gaggatgccagggtagtctgctccc

SEQ ID NO: 413607 - DNA, 25 bp, Homo sapien
tctgctccctgtctggctgtgttgg

SEQ ID NO: 413608 - DNA, 25 bp, Homo sapien
gaaagcctaagactctgttacccag

SEQ ID NO: 413609 - DNA, 25 bp, Homo sapien
gatgaaactagggatctaccttaaa

SEQ ID NO: 413610 - DNA, 25 bp, Homo sapien
atatatagtgcagttcagttttagt

SEQ ID NO: 413611 - DNA, 25 bp, Homo sapien
ctgcagcatggtttggaaacaaaag

SEQ ID NO: 413612 - DNA, 25 bp, Homo sapien
gatacataggatttaaactcgattt

SEQ ID NO: 413613 - DNA, 25 bp, Homo sapien
tttttacaagcccacaacatcatag

SEQ ID NO: 413614 - DNA, 25 bp, Homo sapien
agtaaatgctcttgtggcttgaatc

SEQ ID NO: 413615 - DNA, 25 bp, Homo sapien
gcccacaacatcatagctttgcagt

SEQ ID NO: 413616 - DNA, 25 bp, Homo sapien
tagctttgcagtttttaaccaggag

SEQ ID NO: 413617 - DNA, 25 bp, Homo sapien
gagctggtggagatctttgaaatca

SEQ ID NO: 413618 - DNA, 25 bp, Homo sapien
agatctttgaaatcatttaggccaa

SEQ ID NO: 413619 - DNA, 25 bp, Homo sapien
tttaggccaattcttttagttacat

SEQ ID NO: 413620 - DNA, 25 bp, Homo sapien
ctggaggagcgggttgtaggccctt

SEQ ID NO: 413621 - DNA, 25 bp, Homo sapien
gagcgggttgtaggcccttccgcct

SEQ ID NO: 413622 - DNA, 25 bp, Homo sapien
ggttgtaggcccttccgcctctggt

SEQ ID NO: 413623 - DNA, 25 bp, Homo sapien
ctggtgttcagctatattctacaaa

SEQ ID NO: 413624 - DNA, 25 bp, Homo sapien
ggtgttcagctatattctacaaaga

SEQ ID NO: 413625 - DNA, 25 bp, Homo sapien
gatcctgagaggcaagggtgggact

SEQ ID NO: 413626 - DNA, 25 bp, Homo sapien
gcaagggtgggactgaggcctagtt

SEQ ID NO: 413627 - DNA, 25 bp, Homo sapien
gactgaggcctagttacaggtggtc

SEQ ID NO: 413628 - DNA, 25 bp, Homo sapien
actgaggcctagttacaggtggtcg

SEQ ID NO: 413629 - DNA, 25 bp, Homo sapien
gaggcctagttacaggtggtcggga

SEQ ID NO: 413630 - DNA, 25 bp, Homo sapien
ctagttacaggtggtcgggaaggag

SEQ ID NO: 413631 - DNA, 25 bp, Homo sapien
acaaacaattgcatacagtagatta

SEQ ID NO: 413632 - DNA, 25 bp, Homo sapien
ttcacctttggtaattcttataaat

SEQ ID NO: 413633 - DNA, 25 bp, Homo sapien
ggtaattcttataaatgccttcatt

SEQ ID NO: 413634 - DNA, 25 bp, Homo sapien
aaatgccttcatttggatgaaatta

SEQ ID NO: 413635 - DNA, 25 bp, Homo sapien
gaaattagctctgaaaagcaagcag

SEQ ID NO: 413636 - DNA, 25 bp, Homo sapien
gcactattatttaacctttttgacg

SEQ ID NO: 413637 - DNA, 25 bp, Homo sapien
tttgacggtgctttttattaattat

SEQ ID NO: 413638 - DNA, 25 bp, Homo sapien
gagatacttagctccttaaatggaa

SEQ ID NO: 413639 - DNA, 25 bp, Homo sapien
gctccttaaatggaagtgtcagttt

SEQ ID NO: 413640 - DNA, 25 bp, Homo sapien
gaagtgtcagtttggttttgagaga

SEQ ID NO: 413641 - DNA, 25 bp, Homo sapien
aaatttatccactatctttgtttag

SEQ ID NO: 413642 - DNA, 25 bp, Homo sapien
ctgcagaagcctgcagtggctgctg

SEQ ID NO: 413643 - DNA, 25 bp, Homo sapien
gaaacatgaattgagaagacgattt

SEQ ID NO: 413644 - DNA, 25 bp, Homo sapien
aggccccaactcagaggctccgcgg

SEQ ID NO: 413645 - DNA, 25 bp, Homo sapien
ctcagctgctcacaaccgattcagt

SEQ ID NO: 413646 - DNA, 25 bp, Homo sapien
tcagctgctcacaaccgattcagtc

SEQ ID NO: 413647 - DNA, 25 bp, Homo sapien
agctgctcacaaccgattcagtctc

SEQ ID NO: 413648 - DNA, 25 bp, Homo sapien
cacagcagggatgcgcggcaagaat

SEQ ID NO: 413649 - DNA, 25 bp, Homo sapien
gcgcggcaagaatgtacctgtagat

SEQ ID NO: 413650 - DNA, 25 bp, Homo sapien
atgtacctgtagatgtgtacatacc

SEQ ID NO: 413651 - DNA, 25 bp, Homo sapien
aagacgatttgagaaccgagaaggg

SEQ ID NO: 413652 - DNA, 25 bp, Homo sapien
tgggaaggccgagtgtcagagctgg

SEQ ID NO: 413653 - DNA, 25 bp, Homo sapien
ctcagtcttcctggcttatgtctta

SEQ ID NO: 413654 - DNA, 25 bp, Homo sapien
gttcattttcagtctgcttttgtgc

SEQ ID NO: 413655 - DNA, 25 bp, Homo sapien
cagtctgcttttgtgcttgtttgat

SEQ ID NO: 413656 - DNA, 25 bp, Homo sapien
gtgcttgtttgatgtagtctctgta

SEQ ID NO: 413657 - DNA, 25 bp, Homo sapien
gtctctgtacaaggtatagtcacca

SEQ ID NO: 413658 - DNA, 25 bp, Homo sapien
gtcaccatgtagttgcatgttcact

SEQ ID NO: 413659 - DNA, 25 bp, Homo sapien
agattattacttgatatcctgtagt

SEQ ID NO: 413660 - DNA, 25 bp, Homo sapien
aaaatgtagtgccatcaggaggctg

SEQ ID NO: 413661 - DNA, 25 bp, Homo sapien
agatgaggtccagattctaatcagg

SEQ ID NO: 413662 - DNA, 25 bp, Homo sapien
tctaatcaggagatgagtcaagctc

SEQ ID NO: 413663 - DNA, 25 bp, Homo sapien
ggaaatctgatttagagttctctca

SEQ ID NO: 413664 - DNA, 25 bp, Homo sapien
acactcactgcctcaaagactagac

SEQ ID NO: 413665 - DNA, 25 bp, Homo sapien
gaagacttagatctagaagcagcta

SEQ ID NO: 413666 - DNA, 25 bp, Homo sapien
gaagcagctatgttagatgatcaga

SEQ ID NO: 413667 - DNA, 25 bp, Homo sapien
gatgatcagacctcatacactgcca

SEQ ID NO: 413668 - DNA, 25 bp, Homo sapien
acctcatacactgccacttggaaga

SEQ ID NO: 413669 - DNA, 25 bp, Homo sapien
atgtgttctctctgttgatcgtttc

SEQ ID NO: 413670 - DNA, 25 bp, Homo sapien
ctctctgttgatcgtttctggagga

SEQ ID NO: 413671 - DNA, 25 bp, Homo sapien
gagggaggatatgccagctacttat

SEQ ID NO: 413672 - DNA, 25 bp, Homo sapien
gccagctacttatcataggaagtct

SEQ ID NO: 413673 - DNA, 25 bp, Homo sapien
ggaagtctagaaaaggcagccatag

SEQ ID NO: 413674 - DNA, 25 bp, Homo sapien
aaaggcagccatagtgaggtcacta

SEQ ID NO: 413675 - DNA, 25 bp, Homo sapien
actgaggagagacgtatgaactatt

SEQ ID NO: 413676 - DNA, 25 bp, Homo sapien
gagagacgtatgaactattttcttc

SEQ ID NO: 413677 - DNA, 25 bp, Homo sapien
aatgcaaaatgtaatcctaaccagt

SEQ ID NO: 413678 - DNA, 25 bp, Homo sapien
gcaaaatgtaatcctaaccagttga

SEQ ID NO: 413679 - DNA, 25 bp, Homo sapien
gtaatcctaaccagttgattttcta

SEQ ID NO: 413680 - DNA, 25 bp, Homo sapien
tcctaaccagttgattttctataat

SEQ ID NO: 413681 - DNA, 25 bp, Homo sapien
ttttctataattggtatcttagtac

SEQ ID NO: 413682 - DNA, 25 bp, Homo sapien
gaggagtatcacatgaggaaagatt

SEQ ID NO: 413683 - DNA, 25 bp, Homo sapien
agtatcacatgaggaaagatttttc

SEQ ID NO: 413684 - DNA, 25 bp, Homo sapien
tttttcaaagcatgtcagctgaggc

SEQ ID NO: 413685 - DNA, 25 bp, Homo sapien
tcaaagcatgtcagctgaggcacaa

SEQ ID NO: 413686 - DNA, 25 bp, Homo sapien
aagtccaggtgtttagtaagtatca

SEQ ID NO: 413687 - DNA, 25 bp, Homo sapien
gttgaacacacagttggtatctgga

SEQ ID NO: 413688 - DNA, 25 bp, Homo sapien
ggagaatcagttgactgccagtatt

SEQ ID NO: 413689 - DNA, 25 bp, Homo sapien
aaggcacccaaatgtgtgatcacag

SEQ ID NO: 413690 - DNA, 25 bp, Homo sapien
gatcacagttgggtacctgagcttt

SEQ ID NO: 413691 - DNA, 25 bp, Homo sapien
ttgggtacctgagctttggcaggca

SEQ ID NO: 413692 - DNA, 25 bp, Homo sapien
ttggcaggcaggcagtcatgtcacc

SEQ ID NO: 413693 - DNA, 25 bp, Homo sapien
gtcaccaggtgcacatgacaaatgt

SEQ ID NO: 413694 - DNA, 25 bp, Homo sapien
tggacttgcgactggcatcgaaaaa

SEQ ID NO: 413695 - DNA, 25 bp, Homo sapien
ttatgggattgagactttaacctgt

SEQ ID NO: 413696 - DNA, 25 bp, Homo sapien
acctgtgttgtctgcaataagtcca

SEQ ID NO: 413697 - DNA, 25 bp, Homo sapien
agttctggttattctggttattgga

SEQ ID NO: 413698 - DNA, 25 bp, Homo sapien
ctggttattggatctgaaagcatat

SEQ ID NO: 413699 - DNA, 25 bp, Homo sapien
ttattaaagtatcgtctagatttcc

SEQ ID NO: 413700 - DNA, 25 bp, Homo sapien
tctaatattctttcccattgttttt

SEQ ID NO: 413701 - DNA, 25 bp, Homo sapien
ataatacatgtctgatttgccctaa

SEQ ID NO: 413702 - DNA, 25 bp, Homo sapien
acatgtctgatttgccctaattttt

SEQ ID NO: 413703 - DNA, 25 bp, Homo sapien
acttgactgaagaagctctcttgct

SEQ ID NO: 413704 - DNA, 25 bp, Homo sapien
aagctctcttgctttccaactttgt

SEQ ID NO: 413705 - DNA, 25 bp, Homo sapien
gctttccaactttgtgtttgtgtat

SEQ ID NO: 413706 - DNA, 25 bp, Homo sapien
atgaaggaggattagctgttcacca

SEQ ID NO: 413707 - DNA, 25 bp, Homo sapien
tagctgttcaccagaagttctggtt

SEQ ID NO: 413708 - DNA, 25 bp, Homo sapien
aatcggagttgatgctgcttcctgt

SEQ ID NO: 413709 - DNA, 25 bp, Homo sapien
gtgttccctgataattttacacaac

SEQ ID NO: 413710 - DNA, 25 bp, Homo sapien
aattttacacaacactgaggcggga

SEQ ID NO: 413711 - DNA, 25 bp, Homo sapien
cactgaggcgggaagaacgtaaatt

SEQ ID NO: 413712 - DNA, 25 bp, Homo sapien
ccaggaatgcatttatggttaatct

SEQ ID NO: 413713 - DNA, 25 bp, Homo sapien
gttaatctgttgttgaggtttagtc

SEQ ID NO: 413714 - DNA, 25 bp, Homo sapien
gtttagtcagacagccagtgtttta

SEQ ID NO: 413715 - DNA, 25 bp, Homo sapien
agataattaccacttgctctccatt

SEQ ID NO: 413716 - DNA, 25 bp, Homo sapien
gctctccattaactcagcccttgtg

SEQ ID NO: 413717 - DNA, 25 bp, Homo sapien
ttccttttggccagcaaaattggag

SEQ ID NO: 413718 - DNA, 25 bp, Homo sapien
gcaaaattggagtggctttgtcatg

SEQ ID NO: 413719 - DNA, 25 bp, Homo sapien
agctgcagtccgagtgcagatccca

SEQ ID NO: 413720 - DNA, 25 bp, Homo sapien
gtccgagtgcagatcccatggcgag

SEQ ID NO: 413721 - DNA, 25 bp, Homo sapien
catggcgagcgtgggatccagccca

SEQ ID NO: 413722 - DNA, 25 bp, Homo sapien
acagcccgcccaggttgagtgggca

SEQ ID NO: 413723 - DNA, 25 bp, Homo sapien
tccagatttttcaggcgcccaccat

SEQ ID NO: 413724 - DNA, 25 bp, Homo sapien
agccgtgaggccttgcgcagggcgt

SEQ ID NO: 413725 - DNA, 25 bp, Homo sapien
gcgttgccggccgtggaggtctctg

SEQ ID NO: 413726 - DNA, 25 bp, Homo sapien
atgttcctctcatccaaacgtcggc

SEQ ID NO: 413727 - DNA, 25 bp, Homo sapien
tccaaacgtcggcacccaaggtgga

SEQ ID NO: 413728 - DNA, 25 bp, Homo sapien
tggaagccaggttcatggcatgccc

SEQ ID NO: 413729 - DNA, 25 bp, Homo sapien
caggttcatggcatgcccggcccag

SEQ ID NO: 413730 - DNA, 25 bp, Homo sapien
aacaacaaatcatcatcctttcctt

SEQ ID NO: 413731 - DNA, 25 bp, Homo sapien
acaattttcccacaaacggtctgat

SEQ ID NO: 413732 - DNA, 25 bp, Homo sapien
aacggtctgatttaactccatgaaa

SEQ ID NO: 413733 - DNA, 25 bp, Homo sapien
gaaatcctctatttagactgcctta

SEQ ID NO: 413734 - DNA, 25 bp, Homo sapien
gtgaaataactgttggtgaaccata

SEQ ID NO: 413735 - DNA, 25 bp, Homo sapien
ttggtgaaccataacgacattttac

SEQ ID NO: 413736 - DNA, 25 bp, Homo sapien
aacgacattttaccagctgtgtagt

SEQ ID NO: 413737 - DNA, 25 bp, Homo sapien
accagctgtgtagtgattagtccaa

SEQ ID NO: 413738 - DNA, 25 bp, Homo sapien
tagtccaaatatgtctcaagaagtt

SEQ ID NO: 413739 - DNA, 25 bp, Homo sapien
gtctcaagaagttagcaccaagcat

SEQ ID NO: 413740 - DNA, 25 bp, Homo sapien
gcaccaagcattctcatccatttaa

SEQ ID NO: 413741 - DNA, 25 bp, Homo sapien
gccactggccgagctggcagctgat

SEQ ID NO: 413742 - DNA, 25 bp, Homo sapien
cactgactcaaatgtggcaacaccc

SEQ ID NO: 413743 - DNA, 25 bp, Homo sapien
actgactcaaatgtggcaacaccct

SEQ ID NO: 413744 - DNA, 25 bp, Homo sapien
ctgactcaaatgtggcaacaccctc

SEQ ID NO: 413745 - DNA, 25 bp, Homo sapien
tgactcaaatgtggcaacaccctca

SEQ ID NO: 413746 - DNA, 25 bp, Homo sapien
gactcaaatgtggcaacaccctcac

SEQ ID NO: 413747 - DNA, 25 bp, Homo sapien
gaacaatactttgcctccttcagtg

SEQ ID NO: 413748 - DNA, 25 bp, Homo sapien
tgcctccttcagtgcaatcaagttg

SEQ ID NO: 413749 - DNA, 25 bp, Homo sapien
gcctccttcagtgcaatcaagttga

SEQ ID NO: 413750 - DNA, 25 bp, Homo sapien
ctccttcagtgcaatcaagttgaca

SEQ ID NO: 413751 - DNA, 25 bp, Homo sapien
cacaacctccttccttatacaacct

SEQ ID NO: 413752 - DNA, 25 bp, Homo sapien
gattggacaggagccagatctgcct

SEQ ID NO: 413753 - DNA, 25 bp, Homo sapien
tctttccattactctcggcttttgg

SEQ ID NO: 413754 - DNA, 25 bp, Homo sapien
tactctcggcttttgggtgatgcca

SEQ ID NO: 413755 - DNA, 25 bp, Homo sapien
tgatgccacacaacttgcaggcggc

SEQ ID NO: 413756 - DNA, 25 bp, Homo sapien
ttgcaggcggcatatgcccgtagat

SEQ ID NO: 413757 - DNA, 25 bp, Homo sapien
ggcatatgcccgtagatttactgat

SEQ ID NO: 413758 - DNA, 25 bp, Homo sapien
gtagatttactgatatgcacctaaa

SEQ ID NO: 413759 - DNA, 25 bp, Homo sapien
taaaccctgaaattctatagccaaa

SEQ ID NO: 413760 - DNA, 25 bp, Homo sapien
ttctatagccaaatgcttctgtgat

SEQ ID NO: 413761 - DNA, 25 bp, Homo sapien
aataatcagccctcaatatctgcta

SEQ ID NO: 413762 - DNA, 25 bp, Homo sapien
tctgctaagcgtaaattttttccct

SEQ ID NO: 413763 - DNA, 25 bp, Homo sapien
ggagcacagtgctacttggaatgtt

SEQ ID NO: 413764 - DNA, 25 bp, Homo sapien
tacttggaatgttcagctctgactc

SEQ ID NO: 413765 - DNA, 25 bp, Homo sapien
gaatgttcagctctgactcagaaag

SEQ ID NO: 413766 - DNA, 25 bp, Homo sapien
actcagaaaggtctcaaagcggttt

SEQ ID NO: 413767 - DNA, 25 bp, Homo sapien
gaaaggtctcaaagcggtttttgat

SEQ ID NO: 413768 - DNA, 25 bp, Homo sapien
ggtttttgatgaagcaatcctcacc

SEQ ID NO: 413769 - DNA, 25 bp, Homo sapien
gatgaagcaatcctcaccattttcc

SEQ ID NO: 413770 - DNA, 25 bp, Homo sapien
aagaaacgctgttctgagggtcaca

SEQ ID NO: 413771 - DNA, 25 bp, Homo sapien
gttctgagggtcacagctgctgttc

SEQ ID NO: 413772 - DNA, 25 bp, Homo sapien
gagggtcacagctgctgttcaatta

SEQ ID NO: 413773 - DNA, 25 bp, Homo sapien
acagctgctgttcaattatctgagg

SEQ ID NO: 413774 - DNA, 25 bp, Homo sapien
agctggcgtccagggtctcagaact

SEQ ID NO: 413775 - DNA, 25 bp, Homo sapien
cagggtctcagaactatccatggct

SEQ ID NO: 413776 - DNA, 25 bp, Homo sapien
tatccatggctgcaaactcttgctg

SEQ ID NO: 413777 - DNA, 25 bp, Homo sapien
acggccagctaagcctgtcaggcaa

SEQ ID NO: 413778 - DNA, 25 bp, Homo sapien
atctggtgccacctctgagctgaat

SEQ ID NO: 413779 - DNA, 25 bp, Homo sapien
gagctgaatcccaaagtgcgccgag

SEQ ID NO: 413780 - DNA, 25 bp, Homo sapien
gaggttcctctcacagaggtcacag

SEQ ID NO: 413781 - DNA, 25 bp, Homo sapien
gggctgctgcactcttggaaacagg

SEQ ID NO: 413782 - DNA, 25 bp, Homo sapien
tggaaacagggctccggaccaagag

SEQ ID NO: 413783 - DNA, 25 bp, Homo sapien
ggaccaagaggcctctcgagtcaag

SEQ ID NO: 413784 - DNA, 25 bp, Homo sapien
gagtggtgggactcctcgccagaca

SEQ ID NO: 413785 - DNA, 25 bp, Homo sapien
gccaagaatagtgcccgggtgccat

SEQ ID NO: 413786 - DNA, 25 bp, Homo sapien
tgcccgggtgccatgagactctgcc

SEQ ID NO: 413787 - DNA, 25 bp, Homo sapien
aacagcctaccatagaggtgttaca

SEQ ID NO: 413788 - DNA, 25 bp, Homo sapien
atacggctgtcatccaagccaggga

SEQ ID NO: 413789 - DNA, 25 bp, Homo sapien
agccagggagcctttgagccagtgc

SEQ ID NO: 413790 - DNA, 25 bp, Homo sapien
agggagcctttgagccagtgctgct

SEQ ID NO: 413791 - DNA, 25 bp, Homo sapien
cagtgctgctgagaaaattgggaaa

SEQ ID NO: 413792 - DNA, 25 bp, Homo sapien
agcacatcttcactgttcctcgggc

SEQ ID NO: 413793 - DNA, 25 bp, Homo sapien
agaggtgttacagcttccaccattt

SEQ ID NO: 413794 - DNA, 25 bp, Homo sapien
cagcttccaccattttacacaggag

SEQ ID NO: 413795 - DNA, 25 bp, Homo sapien
tcagagaggttgagttttccaagaa

SEQ ID NO: 413796 - DNA, 25 bp, Homo sapien
tcttttttgggcagacggggcaaca

SEQ ID NO: 413797 - DNA, 25 bp, Homo sapien
ttttttgggcagacggggcaacaag

SEQ ID NO: 413798 - DNA, 25 bp, Homo sapien
ggcagacggggcaacaagtaatata

SEQ ID NO: 413799 - DNA, 25 bp, Homo sapien
gcagacggggcaacaagtaatatat

SEQ ID NO: 413800 - DNA, 25 bp, Homo sapien
cagacggggcaacaagtaatatata

SEQ ID NO: 413801 - DNA, 25 bp, Homo sapien
gggcaacaagtaatatatactagta

SEQ ID NO: 413802 - DNA, 25 bp, Homo sapien
ggcaacaagtaatatatactagtaa

SEQ ID NO: 413803 - DNA, 25 bp, Homo sapien
actagtaataagataatacacgtta

SEQ ID NO: 413804 - DNA, 25 bp, Homo sapien
gataatacacgttaaaaacagcctg

SEQ ID NO: 413805 - DNA, 25 bp, Homo sapien
ataatacacgttaaaaacagcctgt

SEQ ID NO: 413806 - DNA, 25 bp, Homo sapien
taatacacgttaaaaacagcctgta

SEQ ID NO: 413807 - DNA, 25 bp, Homo sapien
ggttgttttgtagaactgtcccaca

SEQ ID NO: 413808 - DNA, 25 bp, Homo sapien
tctgattgtttccttatggtgtgat

SEQ ID NO: 413809 - DNA, 25 bp, Homo sapien
ccttatggtgtgatttaccttggtc

SEQ ID NO: 413810 - DNA, 25 bp, Homo sapien
taccttggtcttctgttagctgatt

SEQ ID NO: 413811 - DNA, 25 bp, Homo sapien
gttagctgattgtctcaggaactag

SEQ ID NO: 413812 - DNA, 25 bp, Homo sapien
aacatttttcccaagagcacttcag

SEQ ID NO: 413813 - DNA, 25 bp, Homo sapien
acttcagaggtgatgccgcgtacct

SEQ ID NO: 413814 - DNA, 25 bp, Homo sapien
gtgatgccgcgtacctcatgtggca

SEQ ID NO: 413815 - DNA, 25 bp, Homo sapien
aggcttataccttgcactgtttttt

SEQ ID NO: 413816 - DNA, 25 bp, Homo sapien
agtgccttttgaccccatagttttg

SEQ ID NO: 413817 - DNA, 25 bp, Homo sapien
gaccccatagttttgatcttttgag

SEQ ID NO: 413818 - DNA, 25 bp, Homo sapien
cacagtgctgcctctatgtcttttg

SEQ ID NO: 413819 - DNA, 25 bp, Homo sapien
agtgctgcctctatgtcttttgcaa

SEQ ID NO: 413820 - DNA, 25 bp, Homo sapien
gctgcctctatgtcttttgcaagct

SEQ ID NO: 413821 - DNA, 25 bp, Homo sapien
gcctctatgtcttttgcaagctggg

SEQ ID NO: 413822 - DNA, 25 bp, Homo sapien
aagctggggtcttccttactcagaa

SEQ ID NO: 413823 - DNA, 25 bp, Homo sapien
agatgctgccttccggactggctgc

SEQ ID NO: 413824 - DNA, 25 bp, Homo sapien
ttccggactggctgcccgctgcagt

SEQ ID NO: 413825 - DNA, 25 bp, Homo sapien
cgctgcagtgttttcacgggagcca

SEQ ID NO: 413826 - DNA, 25 bp, Homo sapien
tgcagtgttttcacgggagccaagc

SEQ ID NO: 413827 - DNA, 25 bp, Homo sapien
tgttttcacgggagccaagccagcc

SEQ ID NO: 413828 - DNA, 25 bp, Homo sapien
cgggcctgtagcctcccatgtgaca

SEQ ID NO: 413829 - DNA, 25 bp, Homo sapien
aagtttacaccagtgtgggcatcca

SEQ ID NO: 413830 - DNA, 25 bp, Homo sapien
ttacaccagtgtgggcatccagtga

SEQ ID NO: 413831 - DNA, 25 bp, Homo sapien
aactggcctgtgatgcggtggtcct

SEQ ID NO: 413832 - DNA, 25 bp, Homo sapien
atgcggtggtccttgtgacatgtca

SEQ ID NO: 413833 - DNA, 25 bp, Homo sapien
gtccttgtgacatgtcaggcagttt

SEQ ID NO: 413834 - DNA, 25 bp, Homo sapien
tgacatgtcaggcagttttagagta

SEQ ID NO: 413835 - DNA, 25 bp, Homo sapien
gtcaggcagttttagagtagggttt

SEQ ID NO: 413836 - DNA, 25 bp, Homo sapien
ccattcaggagaagcgcgaggcatg

SEQ ID NO: 413837 - DNA, 25 bp, Homo sapien
cgaggcatgggtgcgcgaaaattct

SEQ ID NO: 413838 - DNA, 25 bp, Homo sapien
gcgaaaattctgagtctgccttcca

SEQ ID NO: 413839 - DNA, 25 bp, Homo sapien
ctctggaaggtctgaccacgggctg

SEQ ID NO: 413840 - DNA, 25 bp, Homo sapien
gggaggaaccttgcggtggtgccct

SEQ ID NO: 413841 - DNA, 25 bp, Homo sapien
gggtcatcggcatccagacgattct

SEQ ID NO: 413842 - DNA, 25 bp, Homo sapien
ggcatccagacgattctagaacctt

SEQ ID NO: 413843 - DNA, 25 bp, Homo sapien
gacgattctagaaccttgctaggat

SEQ ID NO: 413844 - DNA, 25 bp, Homo sapien
tgctaggattctttcctgggaacca

SEQ ID NO: 413845 - DNA, 25 bp, Homo sapien
ttcctgggaaccagtttcatctgct

SEQ ID NO: 413846 - DNA, 25 bp, Homo sapien
ttaaacaactttagctctgcccttt

SEQ ID NO: 413847 - DNA, 25 bp, Homo sapien
aactttagctctgccctttactggg

SEQ ID NO: 413848 - DNA, 25 bp, Homo sapien
ggtcaggaatcggaggtacttgcac

SEQ ID NO: 413849 - DNA, 25 bp, Homo sapien
atcggaggtacttgcacgcggccag

SEQ ID NO: 413850 - DNA, 25 bp, Homo sapien
acgcggccaggcagtgtgtaatgaa

SEQ ID NO: 413851 - DNA, 25 bp, Homo sapien
aagtgataacttatgtcgttcttaa

SEQ ID NO: 413852 - DNA, 25 bp, Homo sapien
tatgtcgttcttaagtggagtgaaa

SEQ ID NO: 413853 - DNA, 25 bp, Homo sapien
agtgttgcccaccaggtctcccttt

SEQ ID NO: 413854 - DNA, 25 bp, Homo sapien
gctgaggaatctgctagtaatcgtt

SEQ ID NO: 413855 - DNA, 25 bp, Homo sapien
tagtaatcgttacctgcctctagtg

SEQ ID NO: 413856 - DNA, 25 bp, Homo sapien
atcgttacctgcctctagtgctgtg

SEQ ID NO: 413857 - DNA, 25 bp, Homo sapien
tctagtgctgtggtgaacttgcgac

SEQ ID NO: 413858 - DNA, 25 bp, Homo sapien
ctgtggtgaacttgcgacagggtct

SEQ ID NO: 413859 - DNA, 25 bp, Homo sapien
gagaagctttaaaatactcatgcct

SEQ ID NO: 413860 - DNA, 25 bp, Homo sapien
gggtacagcctagttattgggaatt

SEQ ID NO: 413861 - DNA, 25 bp, Homo sapien
tctttaaaagagttcctgggattct

SEQ ID NO: 413862 - DNA, 25 bp, Homo sapien
tggagaggagtttgtttcagacgac

SEQ ID NO: 413863 - DNA, 25 bp, Homo sapien
ttgtttcagacgaccttcaaggtta

SEQ ID NO: 413864 - DNA, 25 bp, Homo sapien
gaccttcaaggttatggctcattct

SEQ ID NO: 413865 - DNA, 25 bp, Homo sapien
ggctcattctagatccaatcattct

SEQ ID NO: 413866 - DNA, 25 bp, Homo sapien
gatccaatcattctagcaaataagt

SEQ ID NO: 413867 - DNA, 25 bp, Homo sapien
agtaggttacacttgtccacaatta

SEQ ID NO: 413868 - DNA, 25 bp, Homo sapien
ttcaatcagttcttttcagcattct

SEQ ID NO: 413869 - DNA, 25 bp, Homo sapien
tcagcattctgcttctgcctagttc

SEQ ID NO: 413870 - DNA, 25 bp, Homo sapien
tgcttctgcctagttctgcacttgc

SEQ ID NO: 413871 - DNA, 25 bp, Homo sapien
tcgcagagcactctcacttgcatac

SEQ ID NO: 413872 - DNA, 25 bp, Homo sapien
acttgcatactcctcgcttaaagaa

SEQ ID NO: 413873 - DNA, 25 bp, Homo sapien
agcggctcgggcagcggtgatggct

SEQ ID NO: 413874 - DNA, 25 bp, Homo sapien
tggctgtctggatgacctctgcggc

SEQ ID NO: 413875 - DNA, 25 bp, Homo sapien
gtctggatgacctctgcggccggaa

SEQ ID NO: 413876 - DNA, 25 bp, Homo sapien
cggaaggtcagcaggaagagctcca

SEQ ID NO: 413877 - DNA, 25 bp, Homo sapien
aggaagagctccagctcccggacgc

SEQ ID NO: 413878 - DNA, 25 bp, Homo sapien
ccaggcctgtcagagcaggaaggac

SEQ ID NO: 413879 - DNA, 25 bp, Homo sapien
gaaggacagaagacctcggctgcca

SEQ ID NO: 413880 - DNA, 25 bp, Homo sapien
tcttcctggcccttacagtagccag

SEQ ID NO: 413881 - DNA, 25 bp, Homo sapien
ttacagtagccaggccccggtggcg

SEQ ID NO: 413882 - DNA, 25 bp, Homo sapien
gaggccaaggactgactttgccaaa

SEQ ID NO: 413883 - DNA, 25 bp, Homo sapien
gccaaaaatacaacacagacgatat

SEQ ID NO: 413884 - DNA, 25 bp, Homo sapien
gcaacaaaatataattctcctagat

SEQ ID NO: 413885 - DNA, 25 bp, Homo sapien
ctagatgactaggatatcctccaat

SEQ ID NO: 413886 - DNA, 25 bp, Homo sapien
actaggatatcctccaatctggtat

SEQ ID NO: 413887 - DNA, 25 bp, Homo sapien
ggatatcctccaatctggtatcatg

SEQ ID NO: 413888 - DNA, 25 bp, Homo sapien
atcctccaatctggtatcatgccaa

SEQ ID NO: 413889 - DNA, 25 bp, Homo sapien
ggtatcatgccaaacaacactatgt

SEQ ID NO: 413890 - DNA, 25 bp, Homo sapien
ggaacagcacccgaaatgctgctaa

SEQ ID NO: 413891 - DNA, 25 bp, Homo sapien
agcacccgaaatgctgctaaaaagc

SEQ ID NO: 413892 - DNA, 25 bp, Homo sapien
tttcaaaaaatatctggcacagtgg

SEQ ID NO: 413893 - DNA, 25 bp, Homo sapien
cccactgcattagtatatctagaac

SEQ ID NO: 413894 - DNA, 25 bp, Homo sapien
tagtatatctagaacagcaccttca

SEQ ID NO: 413895 - DNA, 25 bp, Homo sapien
ttcctctccaatgatcttgcagttg

SEQ ID NO: 413896 - DNA, 25 bp, Homo sapien
aacgttgaaaaaatgctgcgtcttt

SEQ ID NO: 413897 - DNA, 25 bp, Homo sapien
aatgctgcgtctttctttaagcctt

SEQ ID NO: 413898 - DNA, 25 bp, Homo sapien
tttaagccttcccagtaacttcctg

SEQ ID NO: 413899 - DNA, 25 bp, Homo sapien
tccccgtgggcttttaagtgaagct

SEQ ID NO: 413900 - DNA, 25 bp, Homo sapien
gtgaagctgcaggattttatctttc

SEQ ID NO: 413901 - DNA, 25 bp, Homo sapien
tttatctttcaatctgccctttcta

SEQ ID NO: 413902 - DNA, 25 bp, Homo sapien
tattgaaaggatgccctcttccctt

SEQ ID NO: 413903 - DNA, 25 bp, Homo sapien
ttgcttttttggtctagggcctgtt

SEQ ID NO: 413904 - DNA, 25 bp, Homo sapien
tctagggcctgtttggagctaacta

SEQ ID NO: 413905 - DNA, 25 bp, Homo sapien
agctaactaggcttggctgagtccg

SEQ ID NO: 413906 - DNA, 25 bp, Homo sapien
agctaacttaactggccacatgtga

SEQ ID NO: 413907 - DNA, 25 bp, Homo sapien
tggccacatgtgacgaaaacaacaa

SEQ ID NO: 413908 - DNA, 25 bp, Homo sapien
agcttcttttttgagcatcttaaat

SEQ ID NO: 413909 - DNA, 25 bp, Homo sapien
tttcaatgaaacatccaaccctcac

SEQ ID NO: 413910 - DNA, 25 bp, Homo sapien
cactgtcatcccttggatatacgtt

SEQ ID NO: 413911 - DNA, 25 bp, Homo sapien
catcccttggatatacgtttttatt

SEQ ID NO: 413912 - DNA, 25 bp, Homo sapien
tacgtttttatttaggtgactgaat

SEQ ID NO: 413913 - DNA, 25 bp, Homo sapien
cttgaataaatcttagtctctgttt

SEQ ID NO: 413914 - DNA, 25 bp, Homo sapien
tttttcaacctttatggcttgtgat

SEQ ID NO: 413915 - DNA, 25 bp, Homo sapien
caacctttatggcttgtgatagaaa

SEQ ID NO: 413916 - DNA, 25 bp, Homo sapien
cttcttgtcctgttctcagctaact

SEQ ID NO: 413917 - DNA, 25 bp, Homo sapien
aacttagcatcacatacctcattct

SEQ ID NO: 413918 - DNA, 25 bp, Homo sapien
tcacatacctcattctagaggcatt

SEQ ID NO: 413919 - DNA, 25 bp, Homo sapien
tagaggcatttatttcccattagaa

SEQ ID NO: 413920 - DNA, 25 bp, Homo sapien
atttcccattagaaagagctttata

SEQ ID NO: 413921 - DNA, 25 bp, Homo sapien
tctgcttttgtagtattacttttaa

SEQ ID NO: 413922 - DNA, 25 bp, Homo sapien
taaaaccaatactttccacactgtc

SEQ ID NO: 413923 - DNA, 25 bp, Homo sapien
ttccacactgtccagaattgcctga

SEQ ID NO: 413924 - DNA, 25 bp, Homo sapien
actgtccagaattgcctgaaattgt

SEQ ID NO: 413925 - DNA, 25 bp, Homo sapien
gcctgaaattgttatgaactgtttg

SEQ ID NO: 413926 - DNA, 25 bp, Homo sapien
gaactgtttgtttatatacgtgact

SEQ ID NO: 413927 - DNA, 25 bp, Homo sapien
gtttgtttatatacgtgacttgatt

SEQ ID NO: 413928 - DNA, 25 bp, Homo sapien
gtggctaatgccagagttgcacaca

SEQ ID NO: 413929 - DNA, 25 bp, Homo sapien
cctgagcattctgcctgaggagctg

SEQ ID NO: 413930 - DNA, 25 bp, Homo sapien
gagctgcagatctgggttcagcaac

SEQ ID NO: 413931 - DNA, 25 bp, Homo sapien
tgggttcagcaacataatccagaaa

SEQ ID NO: 413932 - DNA, 25 bp, Homo sapien
acataatccagaaagcggcgaggaa

SEQ ID NO: 413933 - DNA, 25 bp, Homo sapien
gcaggtcccagctagtccacaggga

SEQ ID NO: 413934 - DNA, 25 bp, Homo sapien
agctagtccacagggaccagcagtg

SEQ ID NO: 413935 - DNA, 25 bp, Homo sapien
aaggatttaacatgtctcagagcat

SEQ ID NO: 413936 - DNA, 25 bp, Homo sapien
atgtctcagagcatcccaagagtca

SEQ ID NO: 413937 - DNA, 25 bp, Homo sapien
gagcatcccaagagtcaacagacat

SEQ ID NO: 413938 - DNA, 25 bp, Homo sapien
aagagtcaacagacatccacctcca

SEQ ID NO: 413939 - DNA, 25 bp, Homo sapien
gggatagaaaacatcactctgttta

SEQ ID NO: 413940 - DNA, 25 bp, Homo sapien
acaagtgttgcctaatctacctaaa

SEQ ID NO: 413941 - DNA, 25 bp, Homo sapien
agtcattttgaaacttctgtttgga

SEQ ID NO: 413942 - DNA, 25 bp, Homo sapien
aacttctgtttggaagctatatcaa

SEQ ID NO: 413943 - DNA, 25 bp, Homo sapien
gaagaatggcatggtcatctaaaaa

SEQ ID NO: 413944 - DNA, 25 bp, Homo sapien
gttgcctaatctacctaaagagtta

SEQ ID NO: 413945 - DNA, 25 bp, Homo sapien
agttaataaactctcttaggatctg

SEQ ID NO: 413946 - DNA, 25 bp, Homo sapien
tcttaggatctgctgtctgtcatga

SEQ ID NO: 413947 - DNA, 25 bp, Homo sapien
atctgctgtctgtcatgattcttgc

SEQ ID NO: 413948 - DNA, 25 bp, Homo sapien
ctgtcatgattcttgcctctgtgtg

SEQ ID NO: 413949 - DNA, 25 bp, Homo sapien
gtgtgtgctttaaccttccgaaaat

SEQ ID NO: 413950 - DNA, 25 bp, Homo sapien
tggtgttaaggttttgtggtgttca

SEQ ID NO: 413951 - DNA, 25 bp, Homo sapien
taaggttttgtggtgttcaaagata

SEQ ID NO: 413952 - DNA, 25 bp, Homo sapien
ctaaaattggatagaggtcttacaa

SEQ ID NO: 413953 - DNA, 25 bp, Homo sapien
gaggtcttacaatatatcgtctttg

SEQ ID NO: 413954 - DNA, 25 bp, Homo sapien
tacaatatatcgtctttggccaggc

SEQ ID NO: 413955 - DNA, 25 bp, Homo sapien
aatatatcgtctttggccaggcatg

SEQ ID NO: 413956 - DNA, 25 bp, Homo sapien
cagtgcagtatatgctgtttgtctc

SEQ ID NO: 413957 - DNA, 25 bp, Homo sapien
cagtatatgctgtttgtctcattag

SEQ ID NO: 413958 - DNA, 25 bp, Homo sapien
atatgctgtttgtctcattaggtta

SEQ ID NO: 413959 - DNA, 25 bp, Homo sapien
gctgtttgtctcattaggttattaa

SEQ ID NO: 413960 - DNA, 25 bp, Homo sapien
gtttgtctcattaggttattaacta

SEQ ID NO: 413961 - DNA, 25 bp, Homo sapien
aaaaaagtgccagcgtatgaggtaa

SEQ ID NO: 413962 - DNA, 25 bp, Homo sapien
aaagtgccagcgtatgaggtaatta

SEQ ID NO: 413963 - DNA, 25 bp, Homo sapien
aagtgccagcgtatgaggtaattag

SEQ ID NO: 413964 - DNA, 25 bp, Homo sapien
gtgccagcgtatgaggtaattagat

SEQ ID NO: 413965 - DNA, 25 bp, Homo sapien
gccagcgtatgaggtaattagattg

SEQ ID NO: 413966 - DNA, 25 bp, Homo sapien
gcgtatgaggtaattagattggttc

SEQ ID NO: 413967 - DNA, 25 bp, Homo sapien
gtaattagattggttctctccagag

SEQ ID NO: 413968 - DNA, 25 bp, Homo sapien
tccagaggtaacctgccaagaagag

SEQ ID NO: 413969 - DNA, 25 bp, Homo sapien
gaggtaacctgccaagaagagatgc

SEQ ID NO: 413970 - DNA, 25 bp, Homo sapien
gtaacctgccaagaagagatgctat

SEQ ID NO: 413971 - DNA, 25 bp, Homo sapien
agagatgctatagatgttactccta

SEQ ID NO: 413972 - DNA, 25 bp, Homo sapien
tttcaagttgtccttaaatgagtgg

SEQ ID NO: 413973 - DNA, 25 bp, Homo sapien
ttcaagttgtccttaaatgagtggg

SEQ ID NO: 413974 - DNA, 25 bp, Homo sapien
tcaagttgtccttaaatgagtgggt

SEQ ID NO: 413975 - DNA, 25 bp, Homo sapien
aagttgtccttaaatgagtgggtgc

SEQ ID NO: 413976 - DNA, 25 bp, Homo sapien
agttgtccttaaatgagtgggtgca

SEQ ID NO: 413977 - DNA, 25 bp, Homo sapien
gttgtccttaaatgagtgggtgcag

SEQ ID NO: 413978 - DNA, 25 bp, Homo sapien
ttgtccttaaatgagtgggtgcagt

SEQ ID NO: 413979 - DNA, 25 bp, Homo sapien
tgtccttaaatgagtgggtgcagtg

SEQ ID NO: 413980 - DNA, 25 bp, Homo sapien
gtccttaaatgagtgggtgcagtgg

SEQ ID NO: 413981 - DNA, 25 bp, Homo sapien
tagtgccagctactcggggtaggag

SEQ ID NO: 413982 - DNA, 25 bp, Homo sapien
tgccagctactcggggtaggagtgg

SEQ ID NO: 413983 - DNA, 25 bp, Homo sapien
tcaattatctgaggttgtctgggac

SEQ ID NO: 413984 - DNA, 25 bp, Homo sapien
ttatctgaggttgtctgggacctgc

SEQ ID NO: 413985 - DNA, 25 bp, Homo sapien
atctgaggttgtctgggacctgcct

SEQ ID NO: 413986 - DNA, 25 bp, Homo sapien
gaggttgtctgggacctgcctccac

SEQ ID NO: 413987 - DNA, 25 bp, Homo sapien
accccatccagggatgagaatggca

SEQ ID NO: 413988 - DNA, 25 bp, Homo sapien
cagaaaggaactccctttgcacgga

SEQ ID NO: 413989 - DNA, 25 bp, Homo sapien
gaaaggaactccctttgcacggagg

SEQ ID NO: 413990 - DNA, 25 bp, Homo sapien
aaggaactccctttgcacggaggct

SEQ ID NO: 413991 - DNA, 25 bp, Homo sapien
ggaactccctttgcacggaggcttg

SEQ ID NO: 413992 - DNA, 25 bp, Homo sapien
aactccctttgcacggaggcttgcc

SEQ ID NO: 413993 - DNA, 25 bp, Homo sapien
tttgcacggaggcttgccccatcac

SEQ ID NO: 413994 - DNA, 25 bp, Homo sapien
gtgtgagccaccatctggaactttt

SEQ ID NO: 413995 - DNA, 25 bp, Homo sapien
gtgagccaccatctggaactttttt

SEQ ID NO: 413996 - DNA, 25 bp, Homo sapien
tttatatactgtttcctgtatccat

SEQ ID NO: 413997 - DNA, 25 bp, Homo sapien
atatactgtttcctgtatccatagc

SEQ ID NO: 413998 - DNA, 25 bp, Homo sapien
tactgtttcctgtatccatagcact

SEQ ID NO: 413999 - DNA, 25 bp, Homo sapien
ctgtttcctgtatccatagcactct

SEQ ID NO: 414000 - DNA, 25 bp, Homo sapien
catggtgatgttcatctgtggtctc

SEQ ID NO: 414001 - DNA, 25 bp, Homo sapien
gcaagcctagcctttttctcatcct

SEQ ID NO: 414002 - DNA, 25 bp, Homo sapien
tttttctcatccttcaggatatttg

SEQ ID NO: 414003 - DNA, 25 bp, Homo sapien
tggtgatgttcatctgtggtctcag

SEQ ID NO: 414004 - DNA, 25 bp, Homo sapien
catccttcaggatatttgttgaatg

SEQ ID NO: 414005 - DNA, 25 bp, Homo sapien
gcccagactcttctcaatgcttcag

SEQ ID NO: 414006 - DNA, 25 bp, Homo sapien
ttctcaatgcttcagcctcacgtat

SEQ ID NO: 414007 - DNA, 25 bp, Homo sapien
tcacgtatccaactacctactgatt

SEQ ID NO: 414008 - DNA, 25 bp, Homo sapien
actacctactgattattctgcttgg

SEQ ID NO: 414009 - DNA, 25 bp, Homo sapien
ttctgcttggacatacatcagccat

SEQ ID NO: 414010 - DNA, 25 bp, Homo sapien
ggacatacatcagccattttaaatt

SEQ ID NO: 414011 - DNA, 25 bp, Homo sapien
tttaaatttggcctgagttgaactc

SEQ ID NO: 414012 - DNA, 25 bp, Homo sapien
ggcctgagttgaactcattctcttt

SEQ ID NO: 414013 - DNA, 25 bp, Homo sapien
ttctctcccacattcattgtgtttt

SEQ ID NO: 414014 - DNA, 25 bp, Homo sapien
gaaatctcctggttaagtcagttca

SEQ ID NO: 414015 - DNA, 25 bp, Homo sapien
ggttaagtcagttcaggttgctata

SEQ ID NO: 414016 - DNA, 25 bp, Homo sapien
atccctggctctattcactagatac

SEQ ID NO: 414017 - DNA, 25 bp, Homo sapien
tcttgtctccttacaccagtatttt

SEQ ID NO: 414018 - DNA, 25 bp, Homo sapien
cattgccaaatgtccagtggttggg

SEQ ID NO: 414019 - DNA, 25 bp, Homo sapien
gagaagagcatgtcaaaaatcactg

SEQ ID NO: 414020 - DNA, 25 bp, Homo sapien
aaaatcactgcttgaagcccctgtt

SEQ ID NO: 414021 - DNA, 25 bp, Homo sapien
tgaagcccctgtttaagagccactg

SEQ ID NO: 414022 - DNA, 25 bp, Homo sapien
gagccactgcctgacgaataacatt

SEQ ID NO: 414023 - DNA, 25 bp, Homo sapien
taacattattaaggccactcaggaa

SEQ ID NO: 414024 - DNA, 25 bp, Homo sapien
caccagtatttttcaacctcagcaa

SEQ ID NO: 414025 - DNA, 25 bp, Homo sapien
atttttgggccagatgattctttgt

SEQ ID NO: 414026 - DNA, 25 bp, Homo sapien
tgattctttgtgtggagagctgccc

SEQ ID NO: 414027 - DNA, 25 bp, Homo sapien
ccagcgtgggcaatagagagatgtc

SEQ ID NO: 414028 - DNA, 25 bp, Homo sapien
cgtgggcaatagagagatgtcctgc

SEQ ID NO: 414029 - DNA, 25 bp, Homo sapien
aagaatcatgttaaagtgacactaa

SEQ ID NO: 414030 - DNA, 25 bp, Homo sapien
aaagtgacactaacttcaaccagat

SEQ ID NO: 414031 - DNA, 25 bp, Homo sapien
gtgacactaacttcaaccagatcat

SEQ ID NO: 414032 - DNA, 25 bp, Homo sapien
gacactaacttcaaccagatcatat

SEQ ID NO: 414033 - DNA, 25 bp, Homo sapien
taacttcaaccagatcatattgcag

SEQ ID NO: 414034 - DNA, 25 bp, Homo sapien
cttcaaccagatcatattgcagttt

SEQ ID NO: 414035 - DNA, 25 bp, Homo sapien
tcaaccagatcatattgcagtttta

SEQ ID NO: 414036 - DNA, 25 bp, Homo sapien
aacctgggtaaaatagtgagatctc

SEQ ID NO: 414037 - DNA, 25 bp, Homo sapien
acctgggtaaaatagtgagatctca

SEQ ID NO: 414038 - DNA, 25 bp, Homo sapien
gattattttccctatattaatgact

SEQ ID NO: 414039 - DNA, 25 bp, Homo sapien
aatgacttcttcagctgaattgagg

SEQ ID NO: 414040 - DNA, 25 bp, Homo sapien
ccagctcttttcttggagtttaaca

SEQ ID NO: 414041 - DNA, 25 bp, Homo sapien
tatgaataacacctcaataaccaca

SEQ ID NO: 414042 - DNA, 25 bp, Homo sapien
gtatctttcctgaattaccttttgg

SEQ ID NO: 414043 - DNA, 25 bp, Homo sapien
accaccttgtttgtccgtttcagag

SEQ ID NO: 414044 - DNA, 25 bp, Homo sapien
ttgtctttctgtaaaatcatgggaa

SEQ ID NO: 414045 - DNA, 25 bp, Homo sapien
tcatgggaaggcatctgattacttt

SEQ ID NO: 414046 - DNA, 25 bp, Homo sapien
tcttgatgtacctgagtaatgcgaa

SEQ ID NO: 414047 - DNA, 25 bp, Homo sapien
gtacctgagtaatgcgaacatctga

SEQ ID NO: 414048 - DNA, 25 bp, Homo sapien
aatgcgaacatctgaataattgaac

SEQ ID NO: 414049 - DNA, 25 bp, Homo sapien
gtgaggctatcattacccttttacc

SEQ ID NO: 414050 - DNA, 25 bp, Homo sapien
gaggctatcattacccttttaccaa

SEQ ID NO: 414051 - DNA, 25 bp, Homo sapien
gctatcattacccttttaccaaagt

SEQ ID NO: 414052 - DNA, 25 bp, Homo sapien
tatcattacccttttaccaaagttg

SEQ ID NO: 414053 - DNA, 25 bp, Homo sapien
ccaaagttggaaaaggacagcatcc

SEQ ID NO: 414054 - DNA, 25 bp, Homo sapien
gagctataccacataatttctctag

SEQ ID NO: 414055 - DNA, 25 bp, Homo sapien
agattatcttacagtcttctacctc

SEQ ID NO: 414056 - DNA, 25 bp, Homo sapien
gtcttctacctcttcaagatacaaa

SEQ ID NO: 414057 - DNA, 25 bp, Homo sapien
atacaaaagtcatggctgtgaggct

SEQ ID NO: 414058 - DNA, 25 bp, Homo sapien
aagtcatggctgtgaggctatcatt

SEQ ID NO: 414059 - DNA, 25 bp, Homo sapien
tggctgtgaggctatcattaccctt

SEQ ID NO: 414060 - DNA, 25 bp, Homo sapien
gctgaattgggtagatactgctttt

SEQ ID NO: 414061 - DNA, 25 bp, Homo sapien
agatactgcttttctaagttgaacc

SEQ ID NO: 414062 - DNA, 25 bp, Homo sapien
gttgaacctaacttaagctgatgca

SEQ ID NO: 414063 - DNA, 25 bp, Homo sapien
gaaactgagtcagaaaagttgctat

SEQ ID NO: 414064 - DNA, 25 bp, Homo sapien
aagtgaaatcttatgtagcatcttt

SEQ ID NO: 414065 - DNA, 25 bp, Homo sapien
gtagcatctttatctcattttggtt

SEQ ID NO: 414066 - DNA, 25 bp, Homo sapien
aagtttctgatttcctttaagctct

SEQ ID NO: 414067 - DNA, 25 bp, Homo sapien
taagctctttacttttagaaacgtg

SEQ ID NO: 414068 - DNA, 25 bp, Homo sapien
gaaacgtgaatttacaatcccttat

SEQ ID NO: 414069 - DNA, 25 bp, Homo sapien
gtgaatttacaatcccttatccaaa

SEQ ID NO: 414070 - DNA, 25 bp, Homo sapien
gccagatgattttccaaattcagaa

SEQ ID NO: 414071 - DNA, 25 bp, Homo sapien
aagcagatggagttaaaggtgtgac

SEQ ID NO: 414072 - DNA, 25 bp, Homo sapien
gttaaaggtgtgacaggatggccat

SEQ ID NO: 414073 - DNA, 25 bp, Homo sapien
ttaaaggtgtgacaggatggccatg

SEQ ID NO: 414074 - DNA, 25 bp, Homo sapien
taaaggtgtgacaggatggccatgg

SEQ ID NO: 414075 - DNA, 25 bp, Homo sapien
aaggtgtgacaggatggccatgggc

SEQ ID NO: 414076 - DNA, 25 bp, Homo sapien
aggtgtgacaggatggccatgggcc

SEQ ID NO: 414077 - DNA, 25 bp, Homo sapien
ggtgtgacaggatggccatgggcca

SEQ ID NO: 414078 - DNA, 25 bp, Homo sapien
gtgtgacaggatggccatgggccag

SEQ ID NO: 414079 - DNA, 25 bp, Homo sapien
attatctgggcatagcggcaggtgc

SEQ ID NO: 414080 - DNA, 25 bp, Homo sapien
ttatctgggcatagcggcaggtgcc

SEQ ID NO: 414081 - DNA, 25 bp, Homo sapien
tatctgggcatagcggcaggtgcct

SEQ ID NO: 414082 - DNA, 25 bp, Homo sapien
tttcaagttgtccttaaatgagtgg

SEQ ID NO: 414083 - DNA, 25 bp, Homo sapien
ttcaagttgtccttaaatgagtggg

SEQ ID NO: 414084 - DNA, 25 bp, Homo sapien
tcaagttgtccttaaatgagtgggt

SEQ ID NO: 414085 - DNA, 25 bp, Homo sapien
aagttgtccttaaatgagtgggtgc

SEQ ID NO: 414086 - DNA, 25 bp, Homo sapien
agttgtccttaaatgagtgggtgca

SEQ ID NO: 414087 - DNA, 25 bp, Homo sapien
gttgtccttaaatgagtgggtgcag

SEQ ID NO: 414088 - DNA, 25 bp, Homo sapien
ttgtccttaaatgagtgggtgcagt

SEQ ID NO: 414089 - DNA, 25 bp, Homo sapien
tgtccttaaatgagtgggtgcagtg

SEQ ID NO: 414090 - DNA, 25 bp, Homo sapien
gtccttaaatgagtgggtgcagtgg

SEQ ID NO: 414091 - DNA, 25 bp, Homo sapien
tgccagctactcggggtaggagtgg

SEQ ID NO: 414092 - DNA, 25 bp, Homo sapien
tgggtggatcactggagtttgagac

SEQ ID NO: 414093 - DNA, 25 bp, Homo sapien
gggtggatcactggagtttgagacc

SEQ ID NO: 414094 - DNA, 25 bp, Homo sapien
gtggatcactggagtttgagaccac

SEQ ID NO: 414095 - DNA, 25 bp, Homo sapien
tggatcactggagtttgagaccacc

SEQ ID NO: 414096 - DNA, 25 bp, Homo sapien
ggatcactggagtttgagaccaccc

SEQ ID NO: 414097 - DNA, 25 bp, Homo sapien
gatcactggagtttgagaccaccct

SEQ ID NO: 414098 - DNA, 25 bp, Homo sapien
atcactggagtttgagaccaccctg

SEQ ID NO: 414099 - DNA, 25 bp, Homo sapien
tcactggagtttgagaccaccctgg

SEQ ID NO: 414100 - DNA, 25 bp, Homo sapien
aaaagaactgctagtgacaagcatt

SEQ ID NO: 414101 - DNA, 25 bp, Homo sapien
aagaactgctagtgacaagcatttt

SEQ ID NO: 414102 - DNA, 25 bp, Homo sapien
cttattgtgtagaatgaggagctat

SEQ ID NO: 414103 - DNA, 25 bp, Homo sapien
caagtagattttgcttctgtttggg

SEQ ID NO: 414104 - DNA, 25 bp, Homo sapien
aagtagattttgcttctgtttggga

SEQ ID NO: 414105 - DNA, 25 bp, Homo sapien
gtttgggaaaatgatctaagacgga

SEQ ID NO: 414106 - DNA, 25 bp, Homo sapien
aatgatctaagacggatgctggtat

SEQ ID NO: 414107 - DNA, 25 bp, Homo sapien
gtattttgggcaggtggagactaat

SEQ ID NO: 414108 - DNA, 25 bp, Homo sapien
tttgggcaggtggagactaatgttt

SEQ ID NO: 414109 - DNA, 25 bp, Homo sapien
tgggcaggtggagactaatgtttta

SEQ ID NO: 414110 - DNA, 25 bp, Homo sapien
ttatgaagccaatattgtgaaatgt

SEQ ID NO: 414111 - DNA, 25 bp, Homo sapien
gattcagggacagacagggtcttac

SEQ ID NO: 414112 - DNA, 25 bp, Homo sapien
gtcttactcttcctgatctccagat

SEQ ID NO: 414113 - DNA, 25 bp, Homo sapien
gatctccagattactctttgtagct

SEQ ID NO: 414114 - DNA, 25 bp, Homo sapien
tttgtagctggaaagctcctccgct

SEQ ID NO: 414115 - DNA, 25 bp, Homo sapien
tccgctttcatctctactttactag

SEQ ID NO: 414116 - DNA, 25 bp, Homo sapien
tttactagaatcttaccatcccctt

SEQ ID NO: 414117 - DNA, 25 bp, Homo sapien
tagaatcttaccatcccctttaagg

SEQ ID NO: 414118 - DNA, 25 bp, Homo sapien
aggcccagctaaaatgtcactttct

SEQ ID NO: 414119 - DNA, 25 bp, Homo sapien
aatgtcactttctttcagaagacca

SEQ ID NO: 414120 - DNA, 25 bp, Homo sapien
tgattgactgactgagacaaggcct

SEQ ID NO: 414121 - DNA, 25 bp, Homo sapien
tctggtgcatcctctcacttcagtc

SEQ ID NO: 414122 - DNA, 25 bp, Homo sapien
cctactgtgtgtatggctctgggat

SEQ ID NO: 414123 - DNA, 25 bp, Homo sapien
gtatggctctgggatgctgtaataa

SEQ ID NO: 414124 - DNA, 25 bp, Homo sapien
atggctctgggatgctgtaataagc

SEQ ID NO: 414125 - DNA, 25 bp, Homo sapien
ggcgtatgtgtctcgtgcatactgg

SEQ ID NO: 414126 - DNA, 25 bp, Homo sapien
tatgtgtctcgtgcatactgggagg

SEQ ID NO: 414127 - DNA, 25 bp, Homo sapien
atagcccgagtgattcacacatttg

SEQ ID NO: 414128 - DNA, 25 bp, Homo sapien
agggtctccatccatttctgcattc

SEQ ID NO: 414129 - DNA, 25 bp, Homo sapien
catccatttctgcattccaatgcca

SEQ ID NO: 414130 - DNA, 25 bp, Homo sapien
gcccgagtgattcacacatttgcat

SEQ ID NO: 414131 - DNA, 25 bp, Homo sapien
gcattccaatgccaagagggtgtca

SEQ ID NO: 414132 - DNA, 25 bp, Homo sapien
agggtgtcagatctgggtgggtcga

SEQ ID NO: 414133 - DNA, 25 bp, Homo sapien
cccaggcttgtctggtaaagagcag

SEQ ID NO: 414134 - DNA, 25 bp, Homo sapien
aggtctttagctctgctctctgaat

SEQ ID NO: 414135 - DNA, 25 bp, Homo sapien
ggtctttagctctgctctctgaatt

SEQ ID NO: 414136 - DNA, 25 bp, Homo sapien
tgattctcgggttcttgacctgagc

SEQ ID NO: 414137 - DNA, 25 bp, Homo sapien
ctcgggttcttgacctgagcagggt

SEQ ID NO: 414138 - DNA, 25 bp, Homo sapien
cctgagcagggtctcaccactgaga

SEQ ID NO: 414139 - DNA, 25 bp, Homo sapien
agggtctcaccactgagacacagcc

SEQ ID NO: 414140 - DNA, 25 bp, Homo sapien
tctctgaattactccggggtcaaca

SEQ ID NO: 414141 - DNA, 25 bp, Homo sapien
ttttcatatctattttgggcccagg

SEQ ID NO: 414142 - DNA, 25 bp, Homo sapien
ttcatatctattttgggcccaggct

SEQ ID NO: 414143 - DNA, 25 bp, Homo sapien
catatctattttgggcccaggcttg

SEQ ID NO: 414144 - DNA, 25 bp, Homo sapien
tgttgaaagggaaagcctctccaag

SEQ ID NO: 414145 - DNA, 25 bp, Homo sapien
agggaaagcctctccaagaactgga

SEQ ID NO: 414146 - DNA, 25 bp, Homo sapien
agaactggaggtgatcaggcatcat

SEQ ID NO: 414147 - DNA, 25 bp, Homo sapien
tcaggcatcatgagaggagaacaat

SEQ ID NO: 414148 - DNA, 25 bp, Homo sapien
acagggaaggagagatctcctctaa

SEQ ID NO: 414149 - DNA, 25 bp, Homo sapien
aggcggctccctttctgcaacttgt

SEQ ID NO: 414150 - DNA, 25 bp, Homo sapien
acttgttctcttccacatctgtgtt

SEQ ID NO: 414151 - DNA, 25 bp, Homo sapien
ctttgccctacctaataccacttgg

SEQ ID NO: 414152 - DNA, 25 bp, Homo sapien
tacctaataccacttggctaacgaa

SEQ ID NO: 414153 - DNA, 25 bp, Homo sapien
aggtatccttcttcccacaaggccg

SEQ ID NO: 414154 - DNA, 25 bp, Homo sapien
aaggccgcacccgattgttgaaagg

SEQ ID NO: 414155 - DNA, 25 bp, Homo sapien
agtaactagttgcagtgactcacac

SEQ ID NO: 414156 - DNA, 25 bp, Homo sapien
gtaactagttgcagtgactcacacc

SEQ ID NO: 414157 - DNA, 25 bp, Homo sapien
gcactttggcaagctgaggaggggg

SEQ ID NO: 414158 - DNA, 25 bp, Homo sapien
cactttggcaagctgaggagggggg

SEQ ID NO: 414159 - DNA, 25 bp, Homo sapien
actttggcaagctgaggagggggga

SEQ ID NO: 414160 - DNA, 25 bp, Homo sapien
ttgagcccaggagaccagtctggtc

SEQ ID NO: 414161 - DNA, 25 bp, Homo sapien
agcccaggagaccagtctggtcaac

SEQ ID NO: 414162 - DNA, 25 bp, Homo sapien
ggcaagagaatagatcgcttgagtc

SEQ ID NO: 414163 - DNA, 25 bp, Homo sapien
gcaagagaatagatcgcttgagtcc

SEQ ID NO: 414164 - DNA, 25 bp, Homo sapien
caagagaatagatcgcttgagtcca

SEQ ID NO: 414165 - DNA, 25 bp, Homo sapien
agctgggatggagccattgcactcc

SEQ ID NO: 414166 - DNA, 25 bp, Homo sapien
taatgacctggtcactccattcttt

SEQ ID NO: 414167 - DNA, 25 bp, Homo sapien
ctttgtcgtcttcctctcagaatat

SEQ ID NO: 414168 - DNA, 25 bp, Homo sapien
gatgtggagaactttgacgtgacca

SEQ ID NO: 414169 - DNA, 25 bp, Homo sapien
ttgtctcaagacatgctgcgaagca

SEQ ID NO: 414170 - DNA, 25 bp, Homo sapien
atgctgcgaagcattgaggctgaca

SEQ ID NO: 414171 - DNA, 25 bp, Homo sapien
gaggctgacagcttttggtgcatga

SEQ ID NO: 414172 - DNA, 25 bp, Homo sapien
ggataactacacctttgcacaacca

SEQ ID NO: 414173 - DNA, 25 bp, Homo sapien
ctttgcacaaccaggaatccagaag

SEQ ID NO: 414174 - DNA, 25 bp, Homo sapien
actggaagagcttgtcagccggatt

SEQ ID NO: 414175 - DNA, 25 bp, Homo sapien
gagcaggtacataatcacttcagga

SEQ ID NO: 414176 - DNA, 25 bp, Homo sapien
aatcacttcaggaggtacgaggtag

SEQ ID NO: 414177 - DNA, 25 bp, Homo sapien
gcttctcgagtagctaagccacaga

SEQ ID NO: 414178 - DNA, 25 bp, Homo sapien
taggcatggtatacatgttcttaac

SEQ ID NO: 414179 - DNA, 25 bp, Homo sapien
ggtatacatgttcttaactgacata

SEQ ID NO: 414180 - DNA, 25 bp, Homo sapien
tgttcttaactgacatatatacata

SEQ ID NO: 414181 - DNA, 25 bp, Homo sapien
tacatacttttgtcagcatattctg

SEQ ID NO: 414182 - DNA, 25 bp, Homo sapien
gtagctaagccacagacacgcacca

SEQ ID NO: 414183 - DNA, 25 bp, Homo sapien
gtcagcatattctgtttttgtgcat

SEQ ID NO: 414184 - DNA, 25 bp, Homo sapien
gcatattctgtttttgtgcatgcat

SEQ ID NO: 414185 - DNA, 25 bp, Homo sapien
tgtggaaacatgtagccttaagttc

SEQ ID NO: 414186 - DNA, 25 bp, Homo sapien
acatgtagccttaagttcaagaaca

SEQ ID NO: 414187 - DNA, 25 bp, Homo sapien
ttttatcatactgcccaggttggtc

SEQ ID NO: 414188 - DNA, 25 bp, Homo sapien
ttatatgtgtggcttaggaccctcc

SEQ ID NO: 414189 - DNA, 25 bp, Homo sapien
ttaggaccctccgtgaacagatgat

SEQ ID NO: 414190 - DNA, 25 bp, Homo sapien
ggaccctccgtgaacagatgataga

SEQ ID NO: 414191 - DNA, 25 bp, Homo sapien
atgatagagggcatctctcccaggt

SEQ ID NO: 414192 - DNA, 25 bp, Homo sapien
atagagggcatctctcccaggtgac

SEQ ID NO: 414193 - DNA, 25 bp, Homo sapien
ccttcttttctgtcccaggagggtg

SEQ ID NO: 414194 - DNA, 25 bp, Homo sapien
tttctgtcccaggagggtgggtaat

SEQ ID NO: 414195 - DNA, 25 bp, Homo sapien
agcaccagtgtctgcctctgagaat

SEQ ID NO: 414196 - DNA, 25 bp, Homo sapien
gcctctgagaatgttggcagctcac

SEQ ID NO: 414197 - DNA, 25 bp, Homo sapien
gagaatgttggcagctcacagagag

SEQ ID NO: 414198 - DNA, 25 bp, Homo sapien
cagctcacagagagcagggccggcc

SEQ ID NO: 414199 - DNA, 25 bp, Homo sapien
gaacataaaactcttccagcataga

SEQ ID NO: 414200 - DNA, 25 bp, Homo sapien
aatgggtactgttaacattcagatg

SEQ ID NO: 414201 - DNA, 25 bp, Homo sapien
taacattcagatggttatgggacca

SEQ ID NO: 414202 - DNA, 25 bp, Homo sapien
tatgggaccatcataacagtttgat

SEQ ID NO: 414203 - DNA, 25 bp, Homo sapien
ggagtataaacagtacttgactttt

SEQ ID NO: 414204 - DNA, 25 bp, Homo sapien
acagtacttgactttttcacacatt

SEQ ID NO: 414205 - DNA, 25 bp, Homo sapien
ttcacacatttgctaatacccttct

SEQ ID NO: 414206 - DNA, 25 bp, Homo sapien
catttgctaatacccttctcataag

SEQ ID NO: 414207 - DNA, 25 bp, Homo sapien
ttctcataagttttatttctttctg

SEQ ID NO: 414208 - DNA, 25 bp, Homo sapien
tgatgtttcagctaacactgagtta

SEQ ID NO: 414209 - DNA, 25 bp, Homo sapien
gctaacactgagttaacagaagcta

SEQ ID NO: 414210 - DNA, 25 bp, Homo sapien
aataagcctagaatctcacacacag

SEQ ID NO: 414211 - DNA, 25 bp, Homo sapien
agcctagaatctcacacacagctgt

SEQ ID NO: 414212 - DNA, 25 bp, Homo sapien
acacacagctgtgacttctaagtga

SEQ ID NO: 414213 - DNA, 25 bp, Homo sapien
cagctgtgacttctaagtgaaactc

SEQ ID NO: 414214 - DNA, 25 bp, Homo sapien
tttctccctcatgtccttaaatagt

SEQ ID NO: 414215 - DNA, 25 bp, Homo sapien
atagtcacagaatcacacacagcct

SEQ ID NO: 414216 - DNA, 25 bp, Homo sapien
gaatcacacacagcctgacttttaa

SEQ ID NO: 414217 - DNA, 25 bp, Homo sapien
acagcctgacttttaaagacaagct

SEQ ID NO: 414218 - DNA, 25 bp, Homo sapien
acaagcttggctacaggaaatgaac

SEQ ID NO: 414219 - DNA, 25 bp, Homo sapien
aaagactcttctaacctgtctcctg

SEQ ID NO: 414220 - DNA, 25 bp, Homo sapien
tcttctaacctgtctcctgactggg

SEQ ID NO: 414221 - DNA, 25 bp, Homo sapien
atagtatctacctcagtgtcgtgaa

SEQ ID NO: 414222 - DNA, 25 bp, Homo sapien
tctacctcagtgtcgtgaagactaa

SEQ ID NO: 414223 - DNA, 25 bp, Homo sapien
gaagtaccacttgtaaagagtttat

SEQ ID NO: 414224 - DNA, 25 bp, Homo sapien
aaagagtttattacagtgcctgaca

SEQ ID NO: 414225 - DNA, 25 bp, Homo sapien
agtgcctgacatatactgtatggtt

SEQ ID NO: 414226 - DNA, 25 bp, Homo sapien
tatactgtatggttagtactgctaa

SEQ ID NO: 414227 - DNA, 25 bp, Homo sapien
gtactgctaaaatgacttcttaagg

SEQ ID NO: 414228 - DNA, 25 bp, Homo sapien
ggaaaattccacaagctgaccacct

SEQ ID NO: 414229 - DNA, 25 bp, Homo sapien
ctgaccacctttcctattgtgatgg

SEQ ID NO: 414230 - DNA, 25 bp, Homo sapien
gtgatggtcactggtatttcagcta

SEQ ID NO: 414231 - DNA, 25 bp, Homo sapien
gtatttcagctatgatcctttgttg

SEQ ID NO: 414232 - DNA, 25 bp, Homo sapien
tgcctggagctctgggaggcattct

SEQ ID NO: 414233 - DNA, 25 bp, Homo sapien
tggagctctgggaggcattctgaac

SEQ ID NO: 414234 - DNA, 25 bp, Homo sapien
aggcattctgaacggggtctactac

SEQ ID NO: 414235 - DNA, 25 bp, Homo sapien
gggtctactactgatctcaggtgag

SEQ ID NO: 414236 - DNA, 25 bp, Homo sapien
tctgccctcctctgaaagtcacttt

SEQ ID NO: 414237 - DNA, 25 bp, Homo sapien
tcctctgaaagtcacttttctcatc

SEQ ID NO: 414238 - DNA, 25 bp, Homo sapien
ggtccgtggtccgaccaaggtcttg

SEQ ID NO: 414239 - DNA, 25 bp, Homo sapien
gaccaaggtcttggcttcacagaca

SEQ ID NO: 414240 - DNA, 25 bp, Homo sapien
ttcacagacatcaccaggagcctgc

SEQ ID NO: 414241 - DNA, 25 bp, Homo sapien
gctcctggcctgatactctagggat

SEQ ID NO: 414242 - DNA, 25 bp, Homo sapien
ctggcctgatactctagggatgcag

SEQ ID NO: 414243 - DNA, 25 bp, Homo sapien
atttgtatcaatatgactggcttct

SEQ ID NO: 414244 - DNA, 25 bp, Homo sapien
tatgactggcttctttgtctgtagt

SEQ ID NO: 414245 - DNA, 25 bp, Homo sapien
actggcttctttgtctgtagtgtgt

SEQ ID NO: 414246 - DNA, 25 bp, Homo sapien
ctgtagtgtgtggtaatattagttc

SEQ ID NO: 414247 - DNA, 25 bp, Homo sapien
attagttctgtaaactgtcagttgc

SEQ ID NO: 414248 - DNA, 25 bp, Homo sapien
taccttgaactatagtatatgttga

SEQ ID NO: 414249 - DNA, 25 bp, Homo sapien
tagccataataatttcttagttaat

SEQ ID NO: 414250 - DNA, 25 bp, Homo sapien
aaacttacagtttatatctgatgaa

SEQ ID NO: 414251 - DNA, 25 bp, Homo sapien
ggaaatgtatgcatgtacttcactc

SEQ ID NO: 414252 - DNA, 25 bp, Homo sapien
atgtatgcatgtacttcactctggt

SEQ ID NO: 414253 - DNA, 25 bp, Homo sapien
tatgcatgtacttcactctggtttc

SEQ ID NO: 414254 - DNA, 25 bp, Homo sapien
tccaatgcaggtaggaataacagca

SEQ ID NO: 414255 - DNA, 25 bp, Homo sapien
aacagcaaatccttcaatttcttga

SEQ ID NO: 414256 - DNA, 25 bp, Homo sapien
aatccttcaatttcttgattctgct

SEQ ID NO: 414257 - DNA, 25 bp, Homo sapien
gtgtcctttcgctggatttctcaac

SEQ ID NO: 414258 - DNA, 25 bp, Homo sapien
ccttcaatttcttgattctgctctt

SEQ ID NO: 414259 - DNA, 25 bp, Homo sapien
tcttaaaaatcttaacagaggccgg

SEQ ID NO: 414260 - DNA, 25 bp, Homo sapien
tcctttcgctggatttctcaaccct

SEQ ID NO: 414261 - DNA, 25 bp, Homo sapien
ccacatagagaaacagtaacagatt

SEQ ID NO: 414262 - DNA, 25 bp, Homo sapien
agtaacagattgctactcacccaac

SEQ ID NO: 414263 - DNA, 25 bp, Homo sapien
caacacccaggtcaagtccaatgca

SEQ ID NO: 414264 - DNA, 25 bp, Homo sapien
tcaagtccaatgcaggtaggaataa

SEQ ID NO: 414265 - DNA, 25 bp, Homo sapien
gtgggaggaggcaactacattgaat

SEQ ID NO: 414266 - DNA, 25 bp, Homo sapien
atcagaatcttgttgactacataaa

SEQ ID NO: 414267 - DNA, 25 bp, Homo sapien
gggaaacaaggcaaacacattttat

SEQ ID NO: 414268 - DNA, 25 bp, Homo sapien
cattttatatggctgcagtgagctt

SEQ ID NO: 414269 - DNA, 25 bp, Homo sapien
aatgctacacagttcataaaacagt

SEQ ID NO: 414270 - DNA, 25 bp, Homo sapien
aaaacagttgtcacaacttggacaa

SEQ ID NO: 414271 - DNA, 25 bp, Homo sapien
gaaccttactatgataatctacttg

SEQ ID NO: 414272 - DNA, 25 bp, Homo sapien
gataatctacttggaatgtggataa

SEQ ID NO: 414273 - DNA, 25 bp, Homo sapien
aagttagaagagcaatatgtttcct

SEQ ID NO: 414274 - DNA, 25 bp, Homo sapien
ctctgtaacagtgtcctaacagtga

SEQ ID NO: 414275 - DNA, 25 bp, Homo sapien
gtgtcctaacagtgaaaatcagagt

SEQ ID NO: 414276 - DNA, 25 bp, Homo sapien
atatttgtatgggttctcttataca

SEQ ID NO: 414277 - DNA, 25 bp, Homo sapien
gtatgggttctcttatacatattga

SEQ ID NO: 414278 - DNA, 25 bp, Homo sapien
tgggttctcttatacatattgatgt

SEQ ID NO: 414279 - DNA, 25 bp, Homo sapien
acatattgatgttctctgcccagtg

SEQ ID NO: 414280 - DNA, 25 bp, Homo sapien
atattgatgttctctgcccagtgag

SEQ ID NO: 414281 - DNA, 25 bp, Homo sapien
attgatgttctctgcccagtgagaa

SEQ ID NO: 414282 - DNA, 25 bp, Homo sapien
ttctctgcccagtgagaacacaggg

SEQ ID NO: 414283 - DNA, 25 bp, Homo sapien
tgcccagtgagaacacagggtgtgt

SEQ ID NO: 414284 - DNA, 25 bp, Homo sapien
ggtgtgtggtagattgatgtcaaaa

SEQ ID NO: 414285 - DNA, 25 bp, Homo sapien
ggttggatcagtcttatcaggcaga

SEQ ID NO: 414286 - DNA, 25 bp, Homo sapien
ggcagaattggaagtttctgtgtca

SEQ ID NO: 414287 - DNA, 25 bp, Homo sapien
tgggtacttgtcagcagcagttgtt

SEQ ID NO: 414288 - DNA, 25 bp, Homo sapien
tacaaatgagcgtcttagcctctgg

SEQ ID NO: 414289 - DNA, 25 bp, Homo sapien
agcgtcttagcctctggattactgc

SEQ ID NO: 414290 - DNA, 25 bp, Homo sapien
atcagtatttgccatatgtgctagc

SEQ ID NO: 414291 - DNA, 25 bp, Homo sapien
catatgtgctagcagcatcagcatc

SEQ ID NO: 414292 - DNA, 25 bp, Homo sapien
catcagcatcagttgggagattatg

SEQ ID NO: 414293 - DNA, 25 bp, Homo sapien
gattatggtggcctccatgtcagac

SEQ ID NO: 414294 - DNA, 25 bp, Homo sapien
catgtcagacctcctaaatcggaat

SEQ ID NO: 414295 - DNA, 25 bp, Homo sapien
gaagtactattgttatctccgttta

SEQ ID NO: 414296 - DNA, 25 bp, Homo sapien
actgaggcacagatatgctcttggg

SEQ ID NO: 414297 - DNA, 25 bp, Homo sapien
agatatgctcttgggtacttgtcag

SEQ ID NO: 414298 - DNA, 25 bp, Homo sapien
aaaaataagatggatgtttctgcat

SEQ ID NO: 414299 - DNA, 25 bp, Homo sapien
gcattaaaattagggagttgtcgta

SEQ ID NO: 414300 - DNA, 25 bp, Homo sapien
gggagttgtcgtataatgtagttgc

SEQ ID NO: 414301 - DNA, 25 bp, Homo sapien
tgtcgtataatgtagttgcataaac

SEQ ID NO: 414302 - DNA, 25 bp, Homo sapien
gaaaccagaaggtccaggctgcagg

SEQ ID NO: 414303 - DNA, 25 bp, Homo sapien
tagtattctgtgcttgtgtggttaa

SEQ ID NO: 414304 - DNA, 25 bp, Homo sapien
agtattctgtgcttgtgtggttaaa

SEQ ID NO: 414305 - DNA, 25 bp, Homo sapien
ttgtgtggttaaagagccttcgtag

SEQ ID NO: 414306 - DNA, 25 bp, Homo sapien
tgtggttaaagagccttcgtagaaa

SEQ ID NO: 414307 - DNA, 25 bp, Homo sapien
gagccttcgtagaaaaaatcccaca

SEQ ID NO: 414308 - DNA, 25 bp, Homo sapien
ccaggctgcagggaactgtgactgc

SEQ ID NO: 414309 - DNA, 25 bp, Homo sapien
agacccactgtgctgttttctgtca

SEQ ID NO: 414310 - DNA, 25 bp, Homo sapien
ttttctgtcagtctgtggcacagca

SEQ ID NO: 414311 - DNA, 25 bp, Homo sapien
gtggcacagcaccaagctctgccag

SEQ ID NO: 414312 - DNA, 25 bp, Homo sapien
agcctggtcagcagggctgcagtcc

SEQ ID NO: 414313 - DNA, 25 bp, Homo sapien
gtcaagggatgtaagtggagtcatt

SEQ ID NO: 414314 - DNA, 25 bp, Homo sapien
agtggagtcattgcacagagacaga

SEQ ID NO: 414315 - DNA, 25 bp, Homo sapien
gtcattgcacagagacagaccagtc

SEQ ID NO: 414316 - DNA, 25 bp, Homo sapien
gacagaccagtcaggagaaggagct

SEQ ID NO: 414317 - DNA, 25 bp, Homo sapien
gaaggagctggaatctggcctcttg

SEQ ID NO: 414318 - DNA, 25 bp, Homo sapien
aggagctggaatctggcctcttgtc

SEQ ID NO: 414319 - DNA, 25 bp, Homo sapien
tggataaactgccttttctcacatc

SEQ ID NO: 414320 - DNA, 25 bp, Homo sapien
ggaccaatttttgatcacttgtctc

SEQ ID NO: 414321 - DNA, 25 bp, Homo sapien
tcacttgtctcttgattagtcacag

SEQ ID NO: 414322 - DNA, 25 bp, Homo sapien
ttagtcacaggcatgatcacagtcc

SEQ ID NO: 414323 - DNA, 25 bp, Homo sapien
gatcacagtcctattactcttgcat

SEQ ID NO: 414324 - DNA, 25 bp, Homo sapien
tgcatatctaggcacatggctctca

SEQ ID NO: 414325 - DNA, 25 bp, Homo sapien
atggctctcatgcatactctagatc

SEQ ID NO: 414326 - DNA, 25 bp, Homo sapien
tgcatactctagatccagaacacat

SEQ ID NO: 414327 - DNA, 25 bp, Homo sapien
attatgggtatgatgcgtttggtta

SEQ ID NO: 414328 - DNA, 25 bp, Homo sapien
ggttatacttatacccataatctca

SEQ ID NO: 414329 - DNA, 25 bp, Homo sapien
gtcacatggcacataacagtagttt

SEQ ID NO: 414330 - DNA, 25 bp, Homo sapien
aatttccctgaataaactgcctttg

SEQ ID NO: 414331 - DNA, 25 bp, Homo sapien
gtcatcaggatctttttaccacaaa

SEQ ID NO: 414332 - DNA, 25 bp, Homo sapien
atcatacggagtcaatttgtctttt

SEQ ID NO: 414333 - DNA, 25 bp, Homo sapien
gcataaaacttggttcagtcttcac

SEQ ID NO: 414334 - DNA, 25 bp, Homo sapien
aaacttggttcagtcttcacatttc

SEQ ID NO: 414335 - DNA, 25 bp, Homo sapien
ggagtcaatttgtctttttctataa

SEQ ID NO: 414336 - DNA, 25 bp, Homo sapien
gatatctttatctcaaagccaactg

SEQ ID NO: 414337 - DNA, 25 bp, Homo sapien
gccaactgttgttgacttttccagt

SEQ ID NO: 414338 - DNA, 25 bp, Homo sapien
gttgttgacttttccagtggcaggg

SEQ ID NO: 414339 - DNA, 25 bp, Homo sapien
atgattagttgcttaactgctttaa

SEQ ID NO: 414340 - DNA, 25 bp, Homo sapien
ctgctttaatttcttctaggtacct

SEQ ID NO: 414341 - DNA, 25 bp, Homo sapien
ctaggtaccttacctgtcatcagga

SEQ ID NO: 414342 - DNA, 25 bp, Homo sapien
ggagaattctgccttaatctgttgg

SEQ ID NO: 414343 - DNA, 25 bp, Homo sapien
aatctgttgggctccagtctccggg

SEQ ID NO: 414344 - DNA, 25 bp, Homo sapien
tccagtctccgggttgaattccagt

SEQ ID NO: 414345 - DNA, 25 bp, Homo sapien
gaattccagtgtatcccactgggag

SEQ ID NO: 414346 - DNA, 25 bp, Homo sapien
atcccactgggagtgaatggatcat

SEQ ID NO: 414347 - DNA, 25 bp, Homo sapien
ggatgttctgcagatccccacatgg

SEQ ID NO: 414348 - DNA, 25 bp, Homo sapien
atccccacatgggaggagattccca

SEQ ID NO: 414349 - DNA, 25 bp, Homo sapien
gagattcccaagtagaggcagccag

SEQ ID NO: 414350 - DNA, 25 bp, Homo sapien
agaattctgactccctggcagcagc

SEQ ID NO: 414351 - DNA, 25 bp, Homo sapien
gcagggctttcaggcaccagtgtct

SEQ ID NO: 414352 - DNA, 25 bp, Homo sapien
accagtgtctgtgttgttagaactc

SEQ ID NO: 414353 - DNA, 25 bp, Homo sapien
ggtcaagactgcaacgagctatgac

SEQ ID NO: 414354 - DNA, 25 bp, Homo sapien
gtcaagactgcaacgagctatgact

SEQ ID NO: 414355 - DNA, 25 bp, Homo sapien
agcctatgtgacagagcaagcctgt

SEQ ID NO: 414356 - DNA, 25 bp, Homo sapien
tcagcttactatagcctctgcctgc

SEQ ID NO: 414357 - DNA, 25 bp, Homo sapien
gcttactatagcctctgcctgcaag

SEQ ID NO: 414358 - DNA, 25 bp, Homo sapien
cttactatagcctctgcctgcaagc

SEQ ID NO: 414359 - DNA, 25 bp, Homo sapien
ttactatagcctctgcctgcaagca

SEQ ID NO: 414360 - DNA, 25 bp, Homo sapien
tactatagcctctgcctgcaagcaa

SEQ ID NO: 414361 - DNA, 25 bp, Homo sapien
actatagcctctgcctgcaagcaat

SEQ ID NO: 414362 - DNA, 25 bp, Homo sapien
tatagcctctgcctgcaagcaattc

SEQ ID NO: 414363 - DNA, 25 bp, Homo sapien
atagcctctgcctgcaagcaattct

SEQ ID NO: 414364 - DNA, 25 bp, Homo sapien
gttgcttgtctggagatggagccac

SEQ ID NO: 414365 - DNA, 25 bp, Homo sapien
agatggagccactacaggcgggcct

SEQ ID NO: 414366 - DNA, 25 bp, Homo sapien
ctggagtcgggcatgaaagaaaata

SEQ ID NO: 414367 - DNA, 25 bp, Homo sapien
agaaaatagcgcctcatcgctctta

SEQ ID NO: 414368 - DNA, 25 bp, Homo sapien
tcatcgctcttatctaagcccagag

SEQ ID NO: 414369 - DNA, 25 bp, Homo sapien
tctaagcccagaggtagacttcgct

SEQ ID NO: 414370 - DNA, 25 bp, Homo sapien
ggtagacttcgcttgaaaagatcga

SEQ ID NO: 414371 - DNA, 25 bp, Homo sapien
gggatcggcactcacttgcagacat

SEQ ID NO: 414372 - DNA, 25 bp, Homo sapien
ttgcagacatcaacagtttccagaa

SEQ ID NO: 414373 - DNA, 25 bp, Homo sapien
cagaaaattcggttcaattccttca

SEQ ID NO: 414374 - DNA, 25 bp, Homo sapien
ttcggttcaattccttcaccacgga

SEQ ID NO: 414375 - DNA, 25 bp, Homo sapien
caggaacggaaattacgacggtgtg

SEQ ID NO: 414376 - DNA, 25 bp, Homo sapien
tacgacggtgtggttccttaaggat

SEQ ID NO: 414377 - DNA, 25 bp, Homo sapien
tggttccttaaggatttggccccag

SEQ ID NO: 414378 - DNA, 25 bp, Homo sapien
taaggatttggccccagtcccacta

SEQ ID NO: 414379 - DNA, 25 bp, Homo sapien
gggccaatattcaaacgctgcagca

SEQ ID NO: 414380 - DNA, 25 bp, Homo sapien
aatcatatttaggtagacttcgctt

SEQ ID NO: 414381 - DNA, 25 bp, Homo sapien
gccaatattcaaacgctgcagcaga

SEQ ID NO: 414382 - DNA, 25 bp, Homo sapien
agcagaggcgcatagcctagccctg

SEQ ID NO: 414383 - DNA, 25 bp, Homo sapien
gaggcgcatagcctagccctggcca

SEQ ID NO: 414384 - DNA, 25 bp, Homo sapien
gaaggaggtcgagttaagccggtgt

SEQ ID NO: 414385 - DNA, 25 bp, Homo sapien
ttaagccggtgtggagggtccaaca

SEQ ID NO: 414386 - DNA, 25 bp, Homo sapien
gtaacaatggtgataccctgtcttt

SEQ ID NO: 414387 - DNA, 25 bp, Homo sapien
acaatggtgataccctgtctttaca

SEQ ID NO: 414388 - DNA, 25 bp, Homo sapien
ggaagatcactgagatcacactatt

SEQ ID NO: 414389 - DNA, 25 bp, Homo sapien
gatcactgagatcacactattaagc

SEQ ID NO: 414390 - DNA, 25 bp, Homo sapien
agatcacactattaagctccggcct

SEQ ID NO: 414391 - DNA, 25 bp, Homo sapien
atcacactattaagctccggccttg

SEQ ID NO: 414392 - DNA, 25 bp, Homo sapien
cacactattaagctccggccttggt

SEQ ID NO: 414393 - DNA, 25 bp, Homo sapien
attagaaggatttgttttgagatca

SEQ ID NO: 414394 - DNA, 25 bp, Homo sapien
ttttgagagacagaaatgggcggat

SEQ ID NO: 414395 - DNA, 25 bp, Homo sapien
agagacagaaatgggcggatagctt

SEQ ID NO: 414396 - DNA, 25 bp, Homo sapien
ccaggagtttggagtttaagaccag

SEQ ID NO: 414397 - DNA, 25 bp, Homo sapien
aagaaatgcttgctttctgtgtagt

SEQ ID NO: 414398 - DNA, 25 bp, Homo sapien
gaaatgcttgctttctgtgtagttt

SEQ ID NO: 414399 - DNA, 25 bp, Homo sapien
tgtgtagttttttaacttaggtcag

SEQ ID NO: 414400 - DNA, 25 bp, Homo sapien
gttttttaacttaggtcagtgccat

SEQ ID NO: 414401 - DNA, 25 bp, Homo sapien
tttttaacttaggtcagtgccatag

SEQ ID NO: 414402 - DNA, 25 bp, Homo sapien
ttttaacttaggtcagtgccatagg

SEQ ID NO: 414403 - DNA, 25 bp, Homo sapien
tttaacttaggtcagtgccatagga

SEQ ID NO: 414404 - DNA, 25 bp, Homo sapien
taacttaggtcagtgccataggact

SEQ ID NO: 414405 - DNA, 25 bp, Homo sapien
aacttaggtcagtgccataggactg

SEQ ID NO: 414406 - DNA, 25 bp, Homo sapien
acttaggtcagtgccataggactga

SEQ ID NO: 414407 - DNA, 25 bp, Homo sapien
gtcagtgccataggactgaccaaat

SEQ ID NO: 414408 - DNA, 25 bp, Homo sapien
gccctgggaaaattggtctcagcat

SEQ ID NO: 414409 - DNA, 25 bp, Homo sapien
tcagcatgctgccaagctttctcat

SEQ ID NO: 414410 - DNA, 25 bp, Homo sapien
aagctttctcatggacgtcagcgaa

SEQ ID NO: 414411 - DNA, 25 bp, Homo sapien
atggacgtcagcgaatcccaacaca

SEQ ID NO: 414412 - DNA, 25 bp, Homo sapien
gaatcccaacacactgtcggtcaaa

SEQ ID NO: 414413 - DNA, 25 bp, Homo sapien
actgtcggtcaaagccgtgctggaa

SEQ ID NO: 414414 - DNA, 25 bp, Homo sapien
gttctccctcggtagaactgagagg

SEQ ID NO: 414415 - DNA, 25 bp, Homo sapien
gccgataccaaaatccaggttgctc

SEQ ID NO: 414416 - DNA, 25 bp, Homo sapien
caggttgctcaagtctctcatagaa

SEQ ID NO: 414417 - DNA, 25 bp, Homo sapien
ttgcacataactatgcacatcctcc

SEQ ID NO: 414418 - DNA, 25 bp, Homo sapien
attacttcgtaacacctaatccagt

SEQ ID NO: 414419 - DNA, 25 bp, Homo sapien
agactgggatttcaagctcgtcctc

SEQ ID NO: 414420 - DNA, 25 bp, Homo sapien
gtcctcacactaagcctgtgatctt

SEQ ID NO: 414421 - DNA, 25 bp, Homo sapien
tgatcttaagcgagtgtctctgcct

SEQ ID NO: 414422 - DNA, 25 bp, Homo sapien
tctgggcctaattgcctttcctcag

SEQ ID NO: 414423 - DNA, 25 bp, Homo sapien
ctttcctcagctgtcagttgaggct

SEQ ID NO: 414424 - DNA, 25 bp, Homo sapien
ttgggccagatggtttcggagctac

SEQ ID NO: 414425 - DNA, 25 bp, Homo sapien
tttcggagctacctctgcaagattt

SEQ ID NO: 414426 - DNA, 25 bp, Homo sapien
tgcaagatttctcggcatcctgcca

SEQ ID NO: 414427 - DNA, 25 bp, Homo sapien
agactgctgtctaaagccgtttctt

SEQ ID NO: 414428 - DNA, 25 bp, Homo sapien
aaaagccagaacgaccccagtagag

SEQ ID NO: 414429 - DNA, 25 bp, Homo sapien
attctatggtggacagaccctggcc

SEQ ID NO: 414430 - DNA, 25 bp, Homo sapien
tgctgtgagtatgaaagcgggccct

SEQ ID NO: 414431 - DNA, 25 bp, Homo sapien
tgacttggtaactggtgttaacgac

SEQ ID NO: 414432 - DNA, 25 bp, Homo sapien
gtaactggtgttaacgacgagaatc

SEQ ID NO: 414433 - DNA, 25 bp, Homo sapien
taacgacgagaatcccattggccat

SEQ ID NO: 414434 - DNA, 25 bp, Homo sapien
gagaatcccattggccattttgatt

SEQ ID NO: 414435 - DNA, 25 bp, Homo sapien
attggccattttgattcccctcagg

SEQ ID NO: 414436 - DNA, 25 bp, Homo sapien
attttgattcccctcaggctctctc

SEQ ID NO: 414437 - DNA, 25 bp, Homo sapien
aggctctctctctgagggctgatgg

SEQ ID NO: 414438 - DNA, 25 bp, Homo sapien
ggctgatggctctagactgtgtcat

SEQ ID NO: 414439 - DNA, 25 bp, Homo sapien
gctctagactgtgtcatggccagga

SEQ ID NO: 414440 - DNA, 25 bp, Homo sapien
ctggtggtgatgaaggcacaagcac

SEQ ID NO: 414441 - DNA, 25 bp, Homo sapien
aggccccaactcagaggctccgcgg

SEQ ID NO: 414442 - DNA, 25 bp, Homo sapien
ctcagctgctcacaaccgattcagt

SEQ ID NO: 414443 - DNA, 25 bp, Homo sapien
tcagctgctcacaaccgattcagtc

SEQ ID NO: 414444 - DNA, 25 bp, Homo sapien
cagctgctcacaaccgattcagtct

SEQ ID NO: 414445 - DNA, 25 bp, Homo sapien
agctgctcacaaccgattcagtctc

SEQ ID NO: 414446 - DNA, 25 bp, Homo sapien
tgctcacaaccgattcagtctccct

SEQ ID NO: 414447 - DNA, 25 bp, Homo sapien
gaaagcacagcagggatgcgcggca

SEQ ID NO: 414448 - DNA, 25 bp, Homo sapien
aaagcacagcagggatgcgcggcaa

SEQ ID NO: 414449 - DNA, 25 bp, Homo sapien
cacagcagggatgcgcggcaagaat

SEQ ID NO: 414450 - DNA, 25 bp, Homo sapien
gaatgtacctgtagatgtgtacata

SEQ ID NO: 414451 - DNA, 25 bp, Homo sapien
atgtacctgtagatgtgtacatacc

SEQ ID NO: 414452 - DNA, 25 bp, Homo sapien
tcaaagtcatactccattgattggg

SEQ ID NO: 414453 - DNA, 25 bp, Homo sapien
tatttgatatgtgacagaagtgctg

SEQ ID NO: 414454 - DNA, 25 bp, Homo sapien
taaaaacgttaccaagctccagcac

SEQ ID NO: 414455 - DNA, 25 bp, Homo sapien
gttaccaagctccagcacttatgtg

SEQ ID NO: 414456 - DNA, 25 bp, Homo sapien
gctccagcacttatgtgatgggttt

SEQ ID NO: 414457 - DNA, 25 bp, Homo sapien
aaacagaaagtggtatgacgctgtg

SEQ ID NO: 414458 - DNA, 25 bp, Homo sapien
tgaaaatgacagtggcagggactga

SEQ ID NO: 414459 - DNA, 25 bp, Homo sapien
tggtcctgccttagatctcagcttt

SEQ ID NO: 414460 - DNA, 25 bp, Homo sapien
gccttagatctcagcttttggctta

SEQ ID NO: 414461 - DNA, 25 bp, Homo sapien
ctcagcttttggcttataggttccc

SEQ ID NO: 414462 - DNA, 25 bp, Homo sapien
tataggttccctggctttggatgtc

SEQ ID NO: 414463 - DNA, 25 bp, Homo sapien
aggaccacagtcaagtctgtatcca

SEQ ID NO: 414464 - DNA, 25 bp, Homo sapien
ccaggccgagcgacaggtgggcttg

SEQ ID NO: 414465 - DNA, 25 bp, Homo sapien
tgggcttgggaaccatctcactccc

SEQ ID NO: 414466 - DNA, 25 bp, Homo sapien
ttcgtcctgctctggtttcctgact

SEQ ID NO: 414467 - DNA, 25 bp, Homo sapien
cctgctctggtttcctgactgccag

SEQ ID NO: 414468 - DNA, 25 bp, Homo sapien
gcacttcttttggaagccactggaa

SEQ ID NO: 414469 - DNA, 25 bp, Homo sapien
cttcttttggaagccactggaaatt

SEQ ID NO: 414470 - DNA, 25 bp, Homo sapien
gaagccactggaaattgagggatga

SEQ ID NO: 414471 - DNA, 25 bp, Homo sapien
aaccaaagcaacagagaagcgctca

SEQ ID NO: 414472 - DNA, 25 bp, Homo sapien
gaagcgctcaagtgtggaaatgtcc

SEQ ID NO: 414473 - DNA, 25 bp, Homo sapien
agcgctcaagtgtggaaatgtcccc

SEQ ID NO: 414474 - DNA, 25 bp, Homo sapien
taagaaatgttgatgtgactggcct

SEQ ID NO: 414475 - DNA, 25 bp, Homo sapien
agaaatgttgatgtgactggcctga

SEQ ID NO: 414476 - DNA, 25 bp, Homo sapien
gaaatgttgatgtgactggcctgag

SEQ ID NO: 414477 - DNA, 25 bp, Homo sapien
aaatgttgatgtgactggcctgagt

SEQ ID NO: 414478 - DNA, 25 bp, Homo sapien
gtttcagtctgaaaactttgggtgc

SEQ ID NO: 414479 - DNA, 25 bp, Homo sapien
ttcagtctgaaaactttgggtgcta

SEQ ID NO: 414480 - DNA, 25 bp, Homo sapien
cagtctgaaaactttgggtgctaaa

SEQ ID NO: 414481 - DNA, 25 bp, Homo sapien
gtctgaaaactttgggtgctaaata

SEQ ID NO: 414482 - DNA, 25 bp, Homo sapien
gaaaactttgggtgctaaatagtga

SEQ ID NO: 414483 - DNA, 25 bp, Homo sapien
aactttgggtgctaaatagtgaaca

SEQ ID NO: 414484 - DNA, 25 bp, Homo sapien
tgggtgctaaatagtgaacatagtt

SEQ ID NO: 414485 - DNA, 25 bp, Homo sapien
tatacattttcgcattcttcctagg

SEQ ID NO: 414486 - DNA, 25 bp, Homo sapien
attttcgcattcttcctaggtgtat

SEQ ID NO: 414487 - DNA, 25 bp, Homo sapien
gcattcttcctaggtgtatactact

SEQ ID NO: 414488 - DNA, 25 bp, Homo sapien
cctaggtgtatactactttttgtct

SEQ ID NO: 414489 - DNA, 25 bp, Homo sapien
cattaatactgactttgtggcagcc

SEQ ID NO: 414490 - DNA, 25 bp, Homo sapien
actttgtggcagccatttctgtagc

SEQ ID NO: 414491 - DNA, 25 bp, Homo sapien
ctgtagctgccatgagaattagttt

SEQ ID NO: 414492 - DNA, 25 bp, Homo sapien
aattttacattgctcttaggaacat

SEQ ID NO: 414493 - DNA, 25 bp, Homo sapien
gctcttaggaacatcaaacctgcct

SEQ ID NO: 414494 - DNA, 25 bp, Homo sapien
ggaacatcaaacctgcctggaaaat

SEQ ID NO: 414495 - DNA, 25 bp, Homo sapien
atcaaacctgcctggaaaatggaaa

SEQ ID NO: 414496 - DNA, 25 bp, Homo sapien
ccatgtgtcttttgtacgttcaatg

SEQ ID NO: 414497 - DNA, 25 bp, Homo sapien
tgtacgttcaatgaattccctgcag

SEQ ID NO: 414498 - DNA, 25 bp, Homo sapien
tgaattccctgcaggttgtctggga

SEQ ID NO: 414499 - DNA, 25 bp, Homo sapien
caggttgtctgggatatctttgttt

SEQ ID NO: 414500 - DNA, 25 bp, Homo sapien
atctttgtttaattctggagcacat

SEQ ID NO: 414501 - DNA, 25 bp, Homo sapien
gtatccatgggatatgtatagactt

SEQ ID NO: 414502 - DNA, 25 bp, Homo sapien
attctggagcacatgaagggaacat

SEQ ID NO: 414503 - DNA, 25 bp, Homo sapien
gggaacatcaaagtgccatggaagt

SEQ ID NO: 414504 - DNA, 25 bp, Homo sapien
ggaagtaaatctaggcccaatctgg

SEQ ID NO: 414505 - DNA, 25 bp, Homo sapien
atgtatagacttattggtagcaaag

SEQ ID NO: 414506 - DNA, 25 bp, Homo sapien
gggttggttcaattatttgagtctt

SEQ ID NO: 414507 - DNA, 25 bp, Homo sapien
agttctcaggtagcctccttctttt

SEQ ID NO: 414508 - DNA, 25 bp, Homo sapien
aaataaattgaacccgctgtctgca

SEQ ID NO: 414509 - DNA, 25 bp, Homo sapien
gacctaatcagttggctctgtttct

SEQ ID NO: 414510 - DNA, 25 bp, Homo sapien
aattgaacccgctgtctgcaattcc

SEQ ID NO: 414511 - DNA, 25 bp, Homo sapien
ggctctgtttctcattggagttttc

SEQ ID NO: 414512 - DNA, 25 bp, Homo sapien
ttggagttttccttggttcttctca

SEQ ID NO: 414513 - DNA, 25 bp, Homo sapien
tttccttggttcttctcatttataa

SEQ ID NO: 414514 - DNA, 25 bp, Homo sapien
tgcaattcccttacattccctgcaa

SEQ ID NO: 414515 - DNA, 25 bp, Homo sapien
tgcaacacacaatctcatcaactct

SEQ ID NO: 414516 - DNA, 25 bp, Homo sapien
acacaatctcatcaactcttcaagg

SEQ ID NO: 414517 - DNA, 25 bp, Homo sapien
ggaaagactatacaagctctagaaa

SEQ ID NO: 414518 - DNA, 25 bp, Homo sapien
gtgtgggaatccaagctcttctatc

SEQ ID NO: 414519 - DNA, 25 bp, Homo sapien
aagctcttctatcaactggcagtaa

SEQ ID NO: 414520 - DNA, 25 bp, Homo sapien
aaggcgtatgagtcgtcttaccaac

SEQ ID NO: 414521 - DNA, 25 bp, Homo sapien
gagtcgtcttaccaacaagtaatta

SEQ ID NO: 414522 - DNA, 25 bp, Homo sapien
atttgaactatctctcttgtttgta

SEQ ID NO: 414523 - DNA, 25 bp, Homo sapien
gtaatggtgtgttaagcgcagtgca

SEQ ID NO: 414524 - DNA, 25 bp, Homo sapien
taagcgcagtgcaccaaaatgtaac

SEQ ID NO: 414525 - DNA, 25 bp, Homo sapien
taagacttagtagcacctaggactc

SEQ ID NO: 414526 - DNA, 25 bp, Homo sapien
gtagcacctaggactcagatcttgg

SEQ ID NO: 414527 - DNA, 25 bp, Homo sapien
tggtttttcttacaacattcgcact

SEQ ID NO: 414528 - DNA, 25 bp, Homo sapien
ttcgcactgaaaggaaccctggctc

SEQ ID NO: 414529 - DNA, 25 bp, Homo sapien
tgggagctggacacttgggtaccct

SEQ ID NO: 414530 - DNA, 25 bp, Homo sapien
taggatagtgagaaccctccccaaa

SEQ ID NO: 414531 - DNA, 25 bp, Homo sapien
gatgccagccaagggacagttttgt

SEQ ID NO: 414532 - DNA, 25 bp, Homo sapien
gacagttttgtaatcaggcctttca

SEQ ID NO: 414533 - DNA, 25 bp, Homo sapien
aggatggcagtcaggcctgctatgt

SEQ ID NO: 414534 - DNA, 25 bp, Homo sapien
tgctatgttaactctgcataccagt

SEQ ID NO: 414535 - DNA, 25 bp, Homo sapien
ctctgcataccagtacatgtgcgtg

SEQ ID NO: 414536 - DNA, 25 bp, Homo sapien
acatgtgcgtgaagaattctgtgaa

SEQ ID NO: 414537 - DNA, 25 bp, Homo sapien
ttgggtaccctctgcctggcatata

SEQ ID NO: 414538 - DNA, 25 bp, Homo sapien
tactaaaatcctagattcccagaag

SEQ ID NO: 414539 - DNA, 25 bp, Homo sapien
gtcagctgttgagcataaaccacat

SEQ ID NO: 414540 - DNA, 25 bp, Homo sapien
ctgagtgggtccaggattctgtgtt

SEQ ID NO: 414541 - DNA, 25 bp, Homo sapien
tgggtccaggattctgtgtttctca

SEQ ID NO: 414542 - DNA, 25 bp, Homo sapien
gggtcagtctatgaaccacactgga

SEQ ID NO: 414543 - DNA, 25 bp, Homo sapien
tgaaccacactggagcaaccaggtt

SEQ ID NO: 414544 - DNA, 25 bp, Homo sapien
actggagcaaccaggttctaggact

SEQ ID NO: 414545 - DNA, 25 bp, Homo sapien
aggttctaggactttctcaatattc

SEQ ID NO: 414546 - DNA, 25 bp, Homo sapien
tttctcaatattctagtactttctg

SEQ ID NO: 414547 - DNA, 25 bp, Homo sapien
ctagtactttctgaacattctggaa

SEQ ID NO: 414548 - DNA, 25 bp, Homo sapien
ttctgaacattctggaatcctcccc

SEQ ID NO: 414549 - DNA, 25 bp, Homo sapien
tggaatcctccccacattctagaat

SEQ ID NO: 414550 - DNA, 25 bp, Homo sapien
aatcctccccacattctagaattct

SEQ ID NO: 414551 - DNA, 25 bp, Homo sapien
tgcctaagcctgtagaagtgctaga

SEQ ID NO: 414552 - DNA, 25 bp, Homo sapien
gcctaagcctgtagaagtgctagat

SEQ ID NO: 414553 - DNA, 25 bp, Homo sapien
cctaagcctgtagaagtgctagatt

SEQ ID NO: 414554 - DNA, 25 bp, Homo sapien
ctaagcctgtagaagtgctagatta

SEQ ID NO: 414555 - DNA, 25 bp, Homo sapien
aagcctgtagaagtgctagattata

SEQ ID NO: 414556 - DNA, 25 bp, Homo sapien
tggcccttttaataagctagaataa

SEQ ID NO: 414557 - DNA, 25 bp, Homo sapien
ggcccttttaataagctagaataag

SEQ ID NO: 414558 - DNA, 25 bp, Homo sapien
gcccttttaataagctagaataaga

SEQ ID NO: 414559 - DNA, 25 bp, Homo sapien
aaatgttatgattcattgtatttat

SEQ ID NO: 414560 - DNA, 25 bp, Homo sapien
tgggacaggtgtgtgtcaccacatc

SEQ ID NO: 414561 - DNA, 25 bp, Homo sapien
ggacaggtgtgtgtcaccacatcca

SEQ ID NO: 414562 - DNA, 25 bp, Homo sapien
gaaaagacagtagcatatgttcatg

SEQ ID NO: 414563 - DNA, 25 bp, Homo sapien
acagtagcatatgttcatgtcaagc

SEQ ID NO: 414564 - DNA, 25 bp, Homo sapien
gtagcatatgttcatgtcaagcacc

SEQ ID NO: 414565 - DNA, 25 bp, Homo sapien
gcatatgttcatgtcaagcacctct

SEQ ID NO: 414566 - DNA, 25 bp, Homo sapien
catatgttcatgtcaagcacctctc

SEQ ID NO: 414567 - DNA, 25 bp, Homo sapien
atatgttcatgtcaagcacctctca

SEQ ID NO: 414568 - DNA, 25 bp, Homo sapien
tatgttcatgtcaagcacctctcat

SEQ ID NO: 414569 - DNA, 25 bp, Homo sapien
atgttcatgtcaagcacctctcatc

SEQ ID NO: 414570 - DNA, 25 bp, Homo sapien
tgttcatgtcaagcacctctcatca

SEQ ID NO: 414571 - DNA, 25 bp, Homo sapien
gttcatgtcaagcacctctcatcac

SEQ ID NO: 414572 - DNA, 25 bp, Homo sapien
atgtcaagcacctctcatcacagtc

SEQ ID NO: 414573 - DNA, 25 bp, Homo sapien
tcactgttctacctcctggccaggt

SEQ ID NO: 414574 - DNA, 25 bp, Homo sapien
tcctggccaggtctcagcttagctt

SEQ ID NO: 414575 - DNA, 25 bp, Homo sapien
tctcagcttagcttccctggtgtgg

SEQ ID NO: 414576 - DNA, 25 bp, Homo sapien
gggtgtttttcaagccttccagcca

SEQ ID NO: 414577 - DNA, 25 bp, Homo sapien
gtgacagggcttcaccctctgcctg

SEQ ID NO: 414578 - DNA, 25 bp, Homo sapien
gcctgcagacccctggtgggcacat

SEQ ID NO: 414579 - DNA, 25 bp, Homo sapien
ggtgggcacatctcacaggcttccg

SEQ ID NO: 414580 - DNA, 25 bp, Homo sapien
acaggcttccgtcttgctgagttgg

SEQ ID NO: 414581 - DNA, 25 bp, Homo sapien
gcttccgtcttgctgagttgggtac

SEQ ID NO: 414582 - DNA, 25 bp, Homo sapien
aagtcagagggaaatctgcttcaga

SEQ ID NO: 414583 - DNA, 25 bp, Homo sapien
atctgcttcagaaaggaagggtctt

SEQ ID NO: 414584 - DNA, 25 bp, Homo sapien
cagataaccttgaactagggttgaa

SEQ ID NO: 414585 - DNA, 25 bp, Homo sapien
gttttgagagtgctgtgaactttgc

SEQ ID NO: 414586 - DNA, 25 bp, Homo sapien
gagtgctgtgaactttgcacagaaa

SEQ ID NO: 414587 - DNA, 25 bp, Homo sapien
gagtttaagttcagcattgggagtt

SEQ ID NO: 414588 - DNA, 25 bp, Homo sapien
gaaggcctgagctggaaatgaaaaa

SEQ ID NO: 414589 - DNA, 25 bp, Homo sapien
gaaacagacctgtgtccgggtgcag

SEQ ID NO: 414590 - DNA, 25 bp, Homo sapien
aacagacctgtgtccgggtgcagtg

SEQ ID NO: 414591 - DNA, 25 bp, Homo sapien
agaaatagtccctgcccacagtgaa

SEQ ID NO: 414592 - DNA, 25 bp, Homo sapien
gtccctgcccacagtgaacttaaaa

SEQ ID NO: 414593 - DNA, 25 bp, Homo sapien
atttgcttacggaagagcagcttta

SEQ ID NO: 414594 - DNA, 25 bp, Homo sapien
gagcagctttatacacagataacct

SEQ ID NO: 414595 - DNA, 25 bp, Homo sapien
gttctggcgggagacagcgtccaca

SEQ ID NO: 414596 - DNA, 25 bp, Homo sapien
gagacagcgtccacagcctgctcag

SEQ ID NO: 414597 - DNA, 25 bp, Homo sapien
ggccatgctgcaccttacaaaacgg

SEQ ID NO: 414598 - DNA, 25 bp, Homo sapien
tgcaccttacaaaacggtctccgtc

SEQ ID NO: 414599 - DNA, 25 bp, Homo sapien
tacaaaacggtctccgtccgcgcgg

SEQ ID NO: 414600 - DNA, 25 bp, Homo sapien
ttccagctgcggcttttcatggagt

SEQ ID NO: 414601 - DNA, 25 bp, Homo sapien
agctgcggcttttcatggagttttt

SEQ ID NO: 414602 - DNA, 25 bp, Homo sapien
tgcggcttttcatggagtttttgag

SEQ ID NO: 414603 - DNA, 25 bp, Homo sapien
tggtgcagatcatcatggtgcggct

SEQ ID NO: 414604 - DNA, 25 bp, Homo sapien
tggaggtctgcatccaggacactga

SEQ ID NO: 414605 - DNA, 25 bp, Homo sapien
tccaggacactgacggcaccgaggt

SEQ ID NO: 414606 - DNA, 25 bp, Homo sapien
attaggtcacattctaaggcactgg

SEQ ID NO: 414607 - DNA, 25 bp, Homo sapien
aaggcactggtggttagacttcaac

SEQ ID NO: 414608 - DNA, 25 bp, Homo sapien
ggtggttagacttcaacaacgttat

SEQ ID NO: 414609 - DNA, 25 bp, Homo sapien
acaacgttattagagggcacagttc

SEQ ID NO: 414610 - DNA, 25 bp, Homo sapien
ggcacagttcaacccatagcatgaa

SEQ ID NO: 414611 - DNA, 25 bp, Homo sapien
gaagtgatgctttctagaccattct

SEQ ID NO: 414612 - DNA, 25 bp, Homo sapien
agaccattcttctttagatagtcat

SEQ ID NO: 414613 - DNA, 25 bp, Homo sapien
tagatagtcatcctttttgttattg

SEQ ID NO: 414614 - DNA, 25 bp, Homo sapien
tgatgtaacgttttccagctttggc

SEQ ID NO: 414615 - DNA, 25 bp, Homo sapien
cagctttggctagttgtggtttcag

SEQ ID NO: 414616 - DNA, 25 bp, Homo sapien
aaaccaaaatgtccctgactgtgtt

SEQ ID NO: 414617 - DNA, 25 bp, Homo sapien
gttgcttgtctggagatggagccac

SEQ ID NO: 414618 - DNA, 25 bp, Homo sapien
gcttgtctggagatggagccactac

SEQ ID NO: 414619 - DNA, 25 bp, Homo sapien
agatggagccactacaggcgggcct

SEQ ID NO: 414620 - DNA, 25 bp, Homo sapien
tgggcgcctggagtcgggcatgaaa

SEQ ID NO: 414621 - DNA, 25 bp, Homo sapien
gggcatgaaagaaaatagcgcctca

SEQ ID NO: 414622 - DNA, 25 bp, Homo sapien
agaaaatagcgcctcatcgctctta

SEQ ID NO: 414623 - DNA, 25 bp, Homo sapien
atagcgcctcatcgctcttatctaa

SEQ ID NO: 414624 - DNA, 25 bp, Homo sapien
tcatcgctcttatctaagcccagag

SEQ ID NO: 414625 - DNA, 25 bp, Homo sapien
atcgctcttatctaagcccagaggt

SEQ ID NO: 414626 - DNA, 25 bp, Homo sapien
gctcttatctaagcccagaggtaga

SEQ ID NO: 414627 - DNA, 25 bp, Homo sapien
ctaagcccagaggtagacttcgctt

SEQ ID NO: 414628 - DNA, 25 bp, Homo sapien
cagtagatgaagtcctgcattttaa

SEQ ID NO: 414629 - DNA, 25 bp, Homo sapien
attgggattgattcacttagaacta

SEQ ID NO: 414630 - DNA, 25 bp, Homo sapien
gggccatctttgttgctagttgaac

SEQ ID NO: 414631 - DNA, 25 bp, Homo sapien
acaagtcttggtcgtttttaacatg

SEQ ID NO: 414632 - DNA, 25 bp, Homo sapien
gtcgtttttaacatggctccttagg

SEQ ID NO: 414633 - DNA, 25 bp, Homo sapien
ggctccttagggtattttctgaagt

SEQ ID NO: 414634 - DNA, 25 bp, Homo sapien
aagttctgtctacttcattggaaag

SEQ ID NO: 414635 - DNA, 25 bp, Homo sapien
gaaagtgtttgcactacgcaggagt

SEQ ID NO: 414636 - DNA, 25 bp, Homo sapien
ctacgcaggagtgacagcaatatga

SEQ ID NO: 414637 - DNA, 25 bp, Homo sapien
aaatgctttgtattcaaggcagcag

SEQ ID NO: 414638 - DNA, 25 bp, Homo sapien
tctggacagacagtacatgtgcttt

SEQ ID NO: 414639 - DNA, 25 bp, Homo sapien
agcaggttgatgtgggttaatgtgg

SEQ ID NO: 414640 - DNA, 25 bp, Homo sapien
taatgtgggttatgtgggctaagca

SEQ ID NO: 414641 - DNA, 25 bp, Homo sapien
ggctaagcaggttgatgtggttaat

SEQ ID NO: 414642 - DNA, 25 bp, Homo sapien
gcaggttgatgtggttaatttttaa

SEQ ID NO: 414643 - DNA, 25 bp, Homo sapien
agttattatgagtagactttttgga

SEQ ID NO: 414644 - DNA, 25 bp, Homo sapien
ggaataaaggtttcctcatattgca

SEQ ID NO: 414645 - DNA, 25 bp, Homo sapien
taaaggtttcctcatattgcagtat

SEQ ID NO: 414646 - DNA, 25 bp, Homo sapien
aaggtttcctcatattgcagtattt

SEQ ID NO: 414647 - DNA, 25 bp, Homo sapien
ggtttcctcatattgcagtattttg

SEQ ID NO: 414648 - DNA, 25 bp, Homo sapien
gtttcctcatattgcagtattttgg

SEQ ID NO: 414649 - DNA, 25 bp, Homo sapien
aaaaataatacgggccaggcatgtg

SEQ ID NO: 414650 - DNA, 25 bp, Homo sapien
tactgcagatgcacactgaggctct

SEQ ID NO: 414651 - DNA, 25 bp, Homo sapien
cagagcgtggcgtctgcagttcatg

SEQ ID NO: 414652 - DNA, 25 bp, Homo sapien
aacggtgtgtgcacgtccccggaga

SEQ ID NO: 414653 - DNA, 25 bp, Homo sapien
tgcacgtccccggagagtgacagag

SEQ ID NO: 414654 - DNA, 25 bp, Homo sapien
tgggttgtagactccaggcacagtc

SEQ ID NO: 414655 - DNA, 25 bp, Homo sapien
aggagagtggctaaatgtcagtcat

SEQ ID NO: 414656 - DNA, 25 bp, Homo sapien
atctagagcacaggtgggcacgctt

SEQ ID NO: 414657 - DNA, 25 bp, Homo sapien
gcacgcttctccgatgaagggtcag

SEQ ID NO: 414658 - DNA, 25 bp, Homo sapien
aggaaatattcttggcactgcagcc

SEQ ID NO: 414659 - DNA, 25 bp, Homo sapien
aggcacagtcaactgcaggcacagt

SEQ ID NO: 414660 - DNA, 25 bp, Homo sapien
acagtcagcaccagcgcagcaggga

SEQ ID NO: 414661 - DNA, 25 bp, Homo sapien
attgactcagaataggacccagtac

SEQ ID NO: 414662 - DNA, 25 bp, Homo sapien
gaatccactgttatctatgggtgtc

SEQ ID NO: 414663 - DNA, 25 bp, Homo sapien
tttatgggtcagcattgcccctaag

SEQ ID NO: 414664 - DNA, 25 bp, Homo sapien
tatgggtgtcattccttcagaaaga

SEQ ID NO: 414665 - DNA, 25 bp, Homo sapien
aaattggctatttcatgctatgcaa

SEQ ID NO: 414666 - DNA, 25 bp, Homo sapien
ttgaagttgcaaagtgtctcccctc

SEQ ID NO: 414667 - DNA, 25 bp, Homo sapien
agcattgcccctaagtccaaggaag

SEQ ID NO: 414668 - DNA, 25 bp, Homo sapien
tgcgcccacgtagtcatccaagaag

SEQ ID NO: 414669 - DNA, 25 bp, Homo sapien
gcaagctcaacctcatgtgattcac

SEQ ID NO: 414670 - DNA, 25 bp, Homo sapien
gtgattcacaaagggtttctttctg

SEQ ID NO: 414671 - DNA, 25 bp, Homo sapien
ttctttctgcatttgtattgactca

SEQ ID NO: 414672 - DNA, 25 bp, Homo sapien
ttcatctctcatcgcatctcatttg

SEQ ID NO: 414673 - DNA, 25 bp, Homo sapien
atcgcatctcatttgtctcacacgt

SEQ ID NO: 414674 - DNA, 25 bp, Homo sapien
atctcatttgtctcacacgtgtcgg

SEQ ID NO: 414675 - DNA, 25 bp, Homo sapien
ggagtgcactctgcaggttagcttt

SEQ ID NO: 414676 - DNA, 25 bp, Homo sapien
cactctgcaggttagctttatgaag

SEQ ID NO: 414677 - DNA, 25 bp, Homo sapien
aatttggtgagctttgaggagtccc

SEQ ID NO: 414678 - DNA, 25 bp, Homo sapien
gagctttgaggagtcccaggattac

SEQ ID NO: 414679 - DNA, 25 bp, Homo sapien
tcccaggattacaagttctttgtct

SEQ ID NO: 414680 - DNA, 25 bp, Homo sapien
aagttctttgtcttggttcacaaca

SEQ ID NO: 414681 - DNA, 25 bp, Homo sapien
gtcttggttcacaacaagctgtgca

SEQ ID NO: 414682 - DNA, 25 bp, Homo sapien
cacaacaagctgtgcagtccccttt

SEQ ID NO: 414683 - DNA, 25 bp, Homo sapien
tcttttcttctgtctatacctttgg

SEQ ID NO: 414684 - DNA, 25 bp, Homo sapien
ctgtctatacctttggtccttaaga

SEQ ID NO: 414685 - DNA, 25 bp, Homo sapien
aagaaccaaagcttgctacctccta

SEQ ID NO: 414686 - DNA, 25 bp, Homo sapien
gagcccttttttgtacttgcaaaat

SEQ ID NO: 414687 - DNA, 25 bp, Homo sapien
ttttctgttaagaactgccatgcag

SEQ ID NO: 414688 - DNA, 25 bp, Homo sapien
gcagaagtctacattcacactgaga

SEQ ID NO: 414689 - DNA, 25 bp, Homo sapien
tacatcagagctcttaacccagaca

SEQ ID NO: 414690 - DNA, 25 bp, Homo sapien
gagctcttaacccagacacgtgaat

SEQ ID NO: 414691 - DNA, 25 bp, Homo sapien
taacccagacacgtgaattatgtac

SEQ ID NO: 414692 - DNA, 25 bp, Homo sapien
aattatgtacgttgtgttccagcca

SEQ ID NO: 414693 - DNA, 25 bp, Homo sapien
tgttccagccactccaagttctttt

SEQ ID NO: 414694 - DNA, 25 bp, Homo sapien
tttctagaaaaagcctaacaaacag

SEQ ID NO: 414695 - DNA, 25 bp, Homo sapien
acaaacagataaggtaggactcaac

SEQ ID NO: 414696 - DNA, 25 bp, Homo sapien
gataaggtaggactcaaccaactga

SEQ ID NO: 414697 - DNA, 25 bp, Homo sapien
taaggtaggactcaaccaactgaaa

SEQ ID NO: 414698 - DNA, 25 bp, Homo sapien
gtaggactcaaccaactgaaacctg

SEQ ID NO: 414699 - DNA, 25 bp, Homo sapien
gcccctgtgcaggtagtaacctctt

SEQ ID NO: 414700 - DNA, 25 bp, Homo sapien
cctgtgcaggtagtaacctcttgag

SEQ ID NO: 414701 - DNA, 25 bp, Homo sapien
cttgagacctctccctgaccaggga

SEQ ID NO: 414702 - DNA, 25 bp, Homo sapien
ccctgaccagggaccaagcacaggg

SEQ ID NO: 414703 - DNA, 25 bp, Homo sapien
caagcacagggcatttagagctttt

SEQ ID NO: 414704 - DNA, 25 bp, Homo sapien
gcacagggcatttagagctttttag

SEQ ID NO: 414705 - DNA, 25 bp, Homo sapien
acacacccaggttggcggtgcgcta

SEQ ID NO: 414706 - DNA, 25 bp, Homo sapien
aaacccaagctgcttgaaatgtgtg

SEQ ID NO: 414707 - DNA, 25 bp, Homo sapien
gctgcttgaaatgtgtgggcttatt

SEQ ID NO: 414708 - DNA, 25 bp, Homo sapien
aaatgtgtgggcttatttgcactct

SEQ ID NO: 414709 - DNA, 25 bp, Homo sapien
tgtgtgggcttatttgcactctgaa

SEQ ID NO: 414710 - DNA, 25 bp, Homo sapien
gtgggcttatttgcactctgaaggt

SEQ ID NO: 414711 - DNA, 25 bp, Homo sapien
gggcttatttgcactctgaaggtta

SEQ ID NO: 414712 - DNA, 25 bp, Homo sapien
gcttatttgcactctgaaggttaaa

SEQ ID NO: 414713 - DNA, 25 bp, Homo sapien
ttgcactctgaaggttaaatatgtc

SEQ ID NO: 414714 - DNA, 25 bp, Homo sapien
gttaaatatgtcttttggtcttata

SEQ ID NO: 414715 - DNA, 25 bp, Homo sapien
ttagtcatctatgttgaaattaagg

SEQ ID NO: 414716 - DNA, 25 bp, Homo sapien
gaaagcattgtacgtttaaacatat

SEQ ID NO: 414717 - DNA, 25 bp, Homo sapien
cattgtacgtttaaacatatgcaaa

SEQ ID NO: 414718 - DNA, 25 bp, Homo sapien
tgtacgtttaaacatatgcaaataa

SEQ ID NO: 414719 - DNA, 25 bp, Homo sapien
aacagtatgttttagggagtataat

SEQ ID NO: 414720 - DNA, 25 bp, Homo sapien
gggtggaagactatattgccaacaa

SEQ ID NO: 414721 - DNA, 25 bp, Homo sapien
ggaagactatattgccaacaaaatg

SEQ ID NO: 414722 - DNA, 25 bp, Homo sapien
tattgccaacaaaatgaaagctttt

SEQ ID NO: 414723 - DNA, 25 bp, Homo sapien
tgaaagcttttaccccctaaacatg

SEQ ID NO: 414724 - DNA, 25 bp, Homo sapien
aacatgtcaaacaattcagcagctg

SEQ ID NO: 414725 - DNA, 25 bp, Homo sapien
aaatgttgatgtgactggcctgagt

SEQ ID NO: 414726 - DNA, 25 bp, Homo sapien
ttcagtctgaaaactttgggtgcta

SEQ ID NO: 414727 - DNA, 25 bp, Homo sapien
acatatcagacactcaggacatatt

SEQ ID NO: 414728 - DNA, 25 bp, Homo sapien
gacactcaggacatatttgtgaatg

SEQ ID NO: 414729 - DNA, 25 bp, Homo sapien
tgtgaatgagtgaatcttagtgtac

SEQ ID NO: 414730 - DNA, 25 bp, Homo sapien
tcttagtgtactgggagattcttct

SEQ ID NO: 414731 - DNA, 25 bp, Homo sapien
agtgtactgggagattcttctaatc

SEQ ID NO: 414732 - DNA, 25 bp, Homo sapien
ttcttctaatcatcctgtggttaat

SEQ ID NO: 414733 - DNA, 25 bp, Homo sapien
cttctaatcatcctgtggttaatat

SEQ ID NO: 414734 - DNA, 25 bp, Homo sapien
tcattgtctgatttgtagtccctct

SEQ ID NO: 414735 - DNA, 25 bp, Homo sapien
attgtctgatttgtagtccctctcc

SEQ ID NO: 414736 - DNA, 25 bp, Homo sapien
tctgatttgtagtccctctccttac

SEQ ID NO: 414737 - DNA, 25 bp, Homo sapien
gaaacattagcggaggctttatttt

SEQ ID NO: 414738 - DNA, 25 bp, Homo sapien
agaaactccagaagtcctgcatttg

SEQ ID NO: 414739 - DNA, 25 bp, Homo sapien
ggccaaggatcacaacagcctaaac

SEQ ID NO: 414740 - DNA, 25 bp, Homo sapien
aacctaagagaaactttgctctcag

SEQ ID NO: 414741 - DNA, 25 bp, Homo sapien
gcagctgtggtggtcattataagca

SEQ ID NO: 414742 - DNA, 25 bp, Homo sapien
gctgtcagttttccttccggatgta

SEQ ID NO: 414743 - DNA, 25 bp, Homo sapien
tcagttttccttccggatgtaccag

SEQ ID NO: 414744 - DNA, 25 bp, Homo sapien
gaaactgagagctagtgagggttca

SEQ ID NO: 414745 - DNA, 25 bp, Homo sapien
agggttcagagaagccccatcctaa

SEQ ID NO: 414746 - DNA, 25 bp, Homo sapien
gagaagccccatcctaagccagaca

SEQ ID NO: 414747 - DNA, 25 bp, Homo sapien
gaagaagcatccaggcaagcagaaa

SEQ ID NO: 414748 - DNA, 25 bp, Homo sapien
aagaaaagatgcagccaccagaaaa

SEQ ID NO: 414749 - DNA, 25 bp, Homo sapien
gccccccatggtaaattctcatttc

SEQ ID NO: 414750 - DNA, 25 bp, Homo sapien
atttcctgtgtacatgcacctggac

SEQ ID NO: 414751 - DNA, 25 bp, Homo sapien
aaaatcccttctatgctatctatat

SEQ ID NO: 414752 - DNA, 25 bp, Homo sapien
accttccttagtcactcacgcttag

SEQ ID NO: 414753 - DNA, 25 bp, Homo sapien
gctatctatattctgcaaacaaatt

SEQ ID NO: 414754 - DNA, 25 bp, Homo sapien
tcacgcttagcactctgtcaagatc

SEQ ID NO: 414755 - DNA, 25 bp, Homo sapien
tagcactctgtcaagatctctgcct

SEQ ID NO: 414756 - DNA, 25 bp, Homo sapien
atctctgcctcatctgctagcataa

SEQ ID NO: 414757 - DNA, 25 bp, Homo sapien
catctgctagcataacatgtggatt

SEQ ID NO: 414758 - DNA, 25 bp, Homo sapien
catgtggattgcttgttggagctta

SEQ ID NO: 414759 - DNA, 25 bp, Homo sapien
tgcttgttggagcttatttccccgc

SEQ ID NO: 414760 - DNA, 25 bp, Homo sapien
aaaaagattgctgatctctcggtat

SEQ ID NO: 414761 - DNA, 25 bp, Homo sapien
gattgctgatctctcggtatagaaa

SEQ ID NO: 414762 - DNA, 25 bp, Homo sapien
aattttctcagttctagtagtttgc

SEQ ID NO: 414763 - DNA, 25 bp, Homo sapien
agttctagtagtttgctgttttgga

SEQ ID NO: 414764 - DNA, 25 bp, Homo sapien
ttcttatcttctcctcttacttaaa

SEQ ID NO: 414765 - DNA, 25 bp, Homo sapien
ctcctcttacttaaattgtgctcaa

SEQ ID NO: 414766 - DNA, 25 bp, Homo sapien
ttgtgctcaaaatttctcaatgaaa

SEQ ID NO: 414767 - DNA, 25 bp, Homo sapien
gaaatgtaacttttgctatagactt

SEQ ID NO: 414768 - DNA, 25 bp, Homo sapien
gctatagacttgaggtgcacaggat

SEQ ID NO: 414769 - DNA, 25 bp, Homo sapien
gaggtgcacaggatgtatcaagtta

SEQ ID NO: 414770 - DNA, 25 bp, Homo sapien
gtatcaagttagaatttccctttat

SEQ ID NO: 414771 - DNA, 25 bp, Homo sapien
gggcttgggtctagacctggactta

SEQ ID NO: 414772 - DNA, 25 bp, Homo sapien
agatatgttgccctcaaccctgagt

SEQ ID NO: 414773 - DNA, 25 bp, Homo sapien
agatgaggtcaagatttgccattct

SEQ ID NO: 414774 - DNA, 25 bp, Homo sapien
gggaggctgatattccagagaatca

SEQ ID NO: 414775 - DNA, 25 bp, Homo sapien
accaaagctttatggctgctacaga

SEQ ID NO: 414776 - DNA, 25 bp, Homo sapien
tgctacagagacatgtcacatttct

SEQ ID NO: 414777 - DNA, 25 bp, Homo sapien
gtcacatttctgagacttgtcacca

SEQ ID NO: 414778 - DNA, 25 bp, Homo sapien
tgtcaccaagagtttgtccctcaga

SEQ ID NO: 414779 - DNA, 25 bp, Homo sapien
aagagtttgtccctcagactttggc

SEQ ID NO: 414780 - DNA, 25 bp, Homo sapien
cagactttggcgctgttgaatgcaa

SEQ ID NO: 414781 - DNA, 25 bp, Homo sapien
gcaaagacaaggatggccaccttct

SEQ ID NO: 414782 - DNA, 25 bp, Homo sapien
tacctacatgcagatacattgtgag

SEQ ID NO: 414783 - DNA, 25 bp, Homo sapien
acatgcagatacattgtgaggtctc

SEQ ID NO: 414784 - DNA, 25 bp, Homo sapien
gcagatacattgtgaggtctcagtg

SEQ ID NO: 414785 - DNA, 25 bp, Homo sapien
gatacattgtgaggtctcagtgaaa

SEQ ID NO: 414786 - DNA, 25 bp, Homo sapien
cattgtgaggtctcagtgaaataga

SEQ ID NO: 414787 - DNA, 25 bp, Homo sapien
aatagaatcatccagtgtggtgcct

SEQ ID NO: 414788 - DNA, 25 bp, Homo sapien
agaatcatccagtgtggtgcctaaa

SEQ ID NO: 414789 - DNA, 25 bp, Homo sapien
aatcatccagtgtggtgcctaaaga

SEQ ID NO: 414790 - DNA, 25 bp, Homo sapien
atccagtgtggtgcctaaagagggt

SEQ ID NO: 414791 - DNA, 25 bp, Homo sapien
tgtggtgcctaaagagggttttgtt

SEQ ID NO: 414792 - DNA, 25 bp, Homo sapien
ccagcacctaggatggtacctggca

SEQ ID NO: 414793 - DNA, 25 bp, Homo sapien
cccatgacatctgtataatctcatt

SEQ ID NO: 414794 - DNA, 25 bp, Homo sapien
ccatgacatctgtataatctcattg

SEQ ID NO: 414795 - DNA, 25 bp, Homo sapien
gacatctgtataatctcattggcca

SEQ ID NO: 414796 - DNA, 25 bp, Homo sapien
tataatctcattggccagaacttgg

SEQ ID NO: 414797 - DNA, 25 bp, Homo sapien
gccagaacttggtcacacaaccatt

SEQ ID NO: 414798 - DNA, 25 bp, Homo sapien
cagaacttggtcacacaaccattcc

SEQ ID NO: 414799 - DNA, 25 bp, Homo sapien
gaacttggtcacacaaccattcctg

SEQ ID NO: 414800 - DNA, 25 bp, Homo sapien
ttggtcacacaaccattcctgctgc

SEQ ID NO: 414801 - DNA, 25 bp, Homo sapien
tcacacaaccattcctgctgctgtg

SEQ ID NO: 414802 - DNA, 25 bp, Homo sapien
tcctgctgctgtggagccttatgaa

SEQ ID NO: 414803 - DNA, 25 bp, Homo sapien
tggagccttatgaagttaaaaatca

SEQ ID NO: 414804 - DNA, 25 bp, Homo sapien
cagggaggatggtctctccactgta

SEQ ID NO: 414805 - DNA, 25 bp, Homo sapien
gaggatggtctctccactgtagaaa

SEQ ID NO: 414806 - DNA, 25 bp, Homo sapien
ctccactgtagaaagtagagtagga

SEQ ID NO: 414807 - DNA, 25 bp, Homo sapien
agagtaggattgtggtcagacttaa

SEQ ID NO: 414808 - DNA, 25 bp, Homo sapien
ggtcagacttaatttgaggcatcta

SEQ ID NO: 414809 - DNA, 25 bp, Homo sapien
tttgaggcatctagtgaagacacgt

SEQ ID NO: 414810 - DNA, 25 bp, Homo sapien
gaagacacgtacaaatccaccaagg

SEQ ID NO: 414811 - DNA, 25 bp, Homo sapien
agacacgtacaaatccaccaaggaa

SEQ ID NO: 414812 - DNA, 25 bp, Homo sapien
aaaacagacccaagaataatcaagt

SEQ ID NO: 414813 - DNA, 25 bp, Homo sapien
aatcaagtcaaagtgatgttgcaca

SEQ ID NO: 414814 - DNA, 25 bp, Homo sapien
gtgatgttgcacaaaatgcagagaa

SEQ ID NO: 414815 - DNA, 25 bp, Homo sapien
tcaggaatgattggtcagagacagc

SEQ ID NO: 414816 - DNA, 25 bp, Homo sapien
gtcagagacagcaatatacccatat

SEQ ID NO: 414817 - DNA, 25 bp, Homo sapien
tctgcacatgtaccttctgtatcta

SEQ ID NO: 414818 - DNA, 25 bp, Homo sapien
tggcagacatgcactggaaagtcat

SEQ ID NO: 414819 - DNA, 25 bp, Homo sapien
aaaagaaatgccacagccacccaat

SEQ ID NO: 414820 - DNA, 25 bp, Homo sapien
gaaagtcatgtgtctgcatgtcctg

SEQ ID NO: 414821 - DNA, 25 bp, Homo sapien
tgtctgcatgtcctgacacggataa

SEQ ID NO: 414822 - DNA, 25 bp, Homo sapien
tgtcctgacacggataaaggcatat

SEQ ID NO: 414823 - DNA, 25 bp, Homo sapien
taaaggcatatagtcaggtgggtga

SEQ ID NO: 414824 - DNA, 25 bp, Homo sapien
agtcaggtgggtgatagactatcct

SEQ ID NO: 414825 - DNA, 25 bp, Homo sapien
gactatcctgaaagattttttggtc

SEQ ID NO: 414826 - DNA, 25 bp, Homo sapien
cccaggcttgtctggtaaagagcag

SEQ ID NO: 414827 - DNA, 25 bp, Homo sapien
aggcttgtctggtaaagagcagagt

SEQ ID NO: 414828 - DNA, 25 bp, Homo sapien
aggtctttagctctgctctctgaat

SEQ ID NO: 414829 - DNA, 25 bp, Homo sapien
ggtctttagctctgctctctgaatt

SEQ ID NO: 414830 - DNA, 25 bp, Homo sapien
gctctctgaattactccggggtcaa

SEQ ID NO: 414831 - DNA, 25 bp, Homo sapien
ctctgaattactccggggtcaacaa

SEQ ID NO: 414832 - DNA, 25 bp, Homo sapien
ttttcatatctattttgggcccagg

SEQ ID NO: 414833 - DNA, 25 bp, Homo sapien
tttcatatctattttgggcccaggc

SEQ ID NO: 414834 - DNA, 25 bp, Homo sapien
ttcatatctattttgggcccaggct

SEQ ID NO: 414835 - DNA, 25 bp, Homo sapien
tcatatctattttgggcccaggctt

SEQ ID NO: 414836 - DNA, 25 bp, Homo sapien
catatctattttgggcccaggcttg

SEQ ID NO: 414837 - DNA, 25 bp, Homo sapien
agaaagtcacctcgccgcaggaaag

SEQ ID NO: 414838 - DNA, 25 bp, Homo sapien
tcacctcgccgcaggaaagctataa

SEQ ID NO: 414839 - DNA, 25 bp, Homo sapien
agctgctccagaggcgccgaaagag

SEQ ID NO: 414840 - DNA, 25 bp, Homo sapien
cgccgaaagagggtagacttcgctt

SEQ ID NO: 414841 - DNA, 25 bp, Homo sapien
ggccaaggaccttctagggctggct

SEQ ID NO: 414842 - DNA, 25 bp, Homo sapien
tctagggctggctccctcagggcct

SEQ ID NO: 414843 - DNA, 25 bp, Homo sapien
agggcctcctatagagcagctcctt

SEQ ID NO: 414844 - DNA, 25 bp, Homo sapien
tatagagcagctccttgagtcgggc

SEQ ID NO: 414845 - DNA, 25 bp, Homo sapien
cagctccttgagtcgggccttatag

SEQ ID NO: 414846 - DNA, 25 bp, Homo sapien
gagtcgggccttatagccaccagaa

SEQ ID NO: 414847 - DNA, 25 bp, Homo sapien
gggccttatagccaccagaaagtca

SEQ ID NO: 414848 - DNA, 25 bp, Homo sapien
gttgaatttttgtgtcttagctgtc

SEQ ID NO: 414849 - DNA, 25 bp, Homo sapien
ttgtgtcttagctgtcttcatattc

SEQ ID NO: 414850 - DNA, 25 bp, Homo sapien
aaagaaaaccatgcctgctcagggt

SEQ ID NO: 414851 - DNA, 25 bp, Homo sapien
tggcttcatctctggcaatatacag

SEQ ID NO: 414852 - DNA, 25 bp, Homo sapien
ggcaatatacagaccaactgtgctt

SEQ ID NO: 414853 - DNA, 25 bp, Homo sapien
gaccaactgtgcttaaattcctggc

SEQ ID NO: 414854 - DNA, 25 bp, Homo sapien
aattcctggcaaatggatggcagaa

SEQ ID NO: 414855 - DNA, 25 bp, Homo sapien
aactctcctatataacactgccaat

SEQ ID NO: 414856 - DNA, 25 bp, Homo sapien
actgccaattactcatcagaatttg

SEQ ID NO: 414857 - DNA, 25 bp, Homo sapien
gccagcacatacattcaacatcatc

SEQ ID NO: 414858 - DNA, 25 bp, Homo sapien
ctggctctccttcatcttacatctt

SEQ ID NO: 414859 - DNA, 25 bp, Homo sapien
gacaagcatacgaatctaaccttat

SEQ ID NO: 414860 - DNA, 25 bp, Homo sapien
gccctggccacatcttagtcataga

SEQ ID NO: 414861 - DNA, 25 bp, Homo sapien
ctggccacatcttagtcatagactg

SEQ ID NO: 414862 - DNA, 25 bp, Homo sapien
cacatcttagtcatagactgggaga

SEQ ID NO: 414863 - DNA, 25 bp, Homo sapien
gcatacgaatctaaccttatctgtc

SEQ ID NO: 414864 - DNA, 25 bp, Homo sapien
gagaggagtcaatcaaaatctgcat

SEQ ID NO: 414865 - DNA, 25 bp, Homo sapien
gaatctaaccttatctgtcatggcc

SEQ ID NO: 414866 - DNA, 25 bp, Homo sapien
gcagatcttttttaatagccaacga

SEQ ID NO: 414867 - DNA, 25 bp, Homo sapien
aatagccaacgaattttacaatgaa

SEQ ID NO: 414868 - DNA, 25 bp, Homo sapien
atctaaccttatctgtcatggcctg

SEQ ID NO: 414869 - DNA, 25 bp, Homo sapien
taaccttatctgtcatggcctgcag

SEQ ID NO: 414870 - DNA, 25 bp, Homo sapien
ggctaaatcaggacattggtactca

SEQ ID NO: 414871 - DNA, 25 bp, Homo sapien
atcaggacattggtactcacagcta

SEQ ID NO: 414872 - DNA, 25 bp, Homo sapien
ggacattggtactcacagctataac

SEQ ID NO: 414873 - DNA, 25 bp, Homo sapien
cattggtactcacagctataactga

SEQ ID NO: 414874 - DNA, 25 bp, Homo sapien
cccatgattttgcatttgcttatat

SEQ ID NO: 414875 - DNA, 25 bp, Homo sapien
actttgcagatgaaagggctgaggt

SEQ ID NO: 414876 - DNA, 25 bp, Homo sapien
agagagatagagtaacttgcccact

SEQ ID NO: 414877 - DNA, 25 bp, Homo sapien
atagagtaacttgcccactctcaca

SEQ ID NO: 414878 - DNA, 25 bp, Homo sapien
actctcacactgcttcttagtggtg

SEQ ID NO: 414879 - DNA, 25 bp, Homo sapien
cacactgcttcttagtggtgggatt

SEQ ID NO: 414880 - DNA, 25 bp, Homo sapien
gcttcttagtggtgggattggatat

SEQ ID NO: 414881 - DNA, 25 bp, Homo sapien
tcagcttactatagcctctgcctgc

SEQ ID NO: 414882 - DNA, 25 bp, Homo sapien
cagcttactatagcctctgcctgca

SEQ ID NO: 414883 - DNA, 25 bp, Homo sapien
agcttactatagcctctgcctgcaa

SEQ ID NO: 414884 - DNA, 25 bp, Homo sapien
gcttactatagcctctgcctgcaag

SEQ ID NO: 414885 - DNA, 25 bp, Homo sapien
cttactatagcctctgcctgcaagc

SEQ ID NO: 414886 - DNA, 25 bp, Homo sapien
ttactatagcctctgcctgcaagca

SEQ ID NO: 414887 - DNA, 25 bp, Homo sapien
tactatagcctctgcctgcaagcaa

SEQ ID NO: 414888 - DNA, 25 bp, Homo sapien
actatagcctctgcctgcaagcaat

SEQ ID NO: 414889 - DNA, 25 bp, Homo sapien
ctatagcctctgcctgcaagcaatt

SEQ ID NO: 414890 - DNA, 25 bp, Homo sapien
tatagcctctgcctgcaagcaattc

SEQ ID NO: 414891 - DNA, 25 bp, Homo sapien
atagcctctgcctgcaagcaattct

SEQ ID NO: 414892 - DNA, 25 bp, Homo sapien
agaatggtgacacctgctaccacaa

SEQ ID NO: 414893 - DNA, 25 bp, Homo sapien
tacacataagcacatagcccacaga

SEQ ID NO: 414894 - DNA, 25 bp, Homo sapien
agcaactacacaatccaaactacag

SEQ ID NO: 414895 - DNA, 25 bp, Homo sapien
aatccaaactacagagcaaccagct

SEQ ID NO: 414896 - DNA, 25 bp, Homo sapien
aaccagctaatgacaccatgttagg

SEQ ID NO: 414897 - DNA, 25 bp, Homo sapien
caccatgttaggaataaagcctcat

SEQ ID NO: 414898 - DNA, 25 bp, Homo sapien
aagcctcatgtctcaatattaacct

SEQ ID NO: 414899 - DNA, 25 bp, Homo sapien
caccccacctaaaagacttggagtg

SEQ ID NO: 414900 - DNA, 25 bp, Homo sapien
ttaaaaacaagacccagccttctgc

SEQ ID NO: 414901 - DNA, 25 bp, Homo sapien
gagacctctctcacatgtaacagga

SEQ ID NO: 414902 - DNA, 25 bp, Homo sapien
atgtaacaggactcataggttcaaa

SEQ ID NO: 414903 - DNA, 25 bp, Homo sapien
ttgtttgtcctttgatcttcagcca

SEQ ID NO: 414904 - DNA, 25 bp, Homo sapien
gccatcagacctgggtagggagcca

SEQ ID NO: 414905 - DNA, 25 bp, Homo sapien
agccagtgccccaccggatttcttt

SEQ ID NO: 414906 - DNA, 25 bp, Homo sapien
ggatttctttgtctggttccactgg

SEQ ID NO: 414907 - DNA, 25 bp, Homo sapien
tcaacagagaccaaccccatatata

SEQ ID NO: 414908 - DNA, 25 bp, Homo sapien
gcgtaatgagtaccctttatcccct

SEQ ID NO: 414909 - DNA, 25 bp, Homo sapien
tccccttccatctcattaggcagaa

SEQ ID NO: 414910 - DNA, 25 bp, Homo sapien
ttaggcagaattcttcccctagatc

SEQ ID NO: 414911 - DNA, 25 bp, Homo sapien
tttaagacctctagcactgccctag

SEQ ID NO: 414912 - DNA, 25 bp, Homo sapien
ctgccctagcttactttagccaaga

SEQ ID NO: 414913 - DNA, 25 bp, Homo sapien
gcttggtttcctttgattcttgttt

SEQ ID NO: 414914 - DNA, 25 bp, Homo sapien
tctcctgtgagatggtctaggaata

SEQ ID NO: 414915 - DNA, 25 bp, Homo sapien
gatggtctaggaataccggaacctt

SEQ ID NO: 414916 - DNA, 25 bp, Homo sapien
ccttttgaaaggtagattctgtaga

SEQ ID NO: 414917 - DNA, 25 bp, Homo sapien
tgaaaggtagattctgtagacacag

SEQ ID NO: 414918 - DNA, 25 bp, Homo sapien
gtagattctgtagacacagtcatct

SEQ ID NO: 414919 - DNA, 25 bp, Homo sapien
gattctgtagacacagtcatctaca

SEQ ID NO: 414920 - DNA, 25 bp, Homo sapien
gtagacacagtcatctacacagctg

SEQ ID NO: 414921 - DNA, 25 bp, Homo sapien
agacacagtcatctacacagctgct

SEQ ID NO: 414922 - DNA, 25 bp, Homo sapien
gacacagtcatctacacagctgctc

SEQ ID NO: 414923 - DNA, 25 bp, Homo sapien
acagtcatctacacagctgctcatg

SEQ ID NO: 414924 - DNA, 25 bp, Homo sapien
agtcatctacacagctgctcatgcc

SEQ ID NO: 414925 - DNA, 25 bp, Homo sapien
tgtgctagtaacatgcatgtgtcaa

SEQ ID NO: 414926 - DNA, 25 bp, Homo sapien
agtaacatgcatgtgtcaaattgaa

SEQ ID NO: 414927 - DNA, 25 bp, Homo sapien
attttagagttcaactccacccagc

SEQ ID NO: 414928 - DNA, 25 bp, Homo sapien
ttagagttcaactccacccagcttt

SEQ ID NO: 414929 - DNA, 25 bp, Homo sapien
cagctttcagtgaaggaacctttca

SEQ ID NO: 414930 - DNA, 25 bp, Homo sapien
gaaggaacctttcaaataatagatt

SEQ ID NO: 414931 - DNA, 25 bp, Homo sapien
atagatttttgcttaccatagagaa

SEQ ID NO: 414932 - DNA, 25 bp, Homo sapien
gcaaatattgaccattaagctggaa

SEQ ID NO: 414933 - DNA, 25 bp, Homo sapien
tatggtgataattgaacagttgtat

SEQ ID NO: 414934 - DNA, 25 bp, Homo sapien
tgtacacatacaatgggtgaatttt

SEQ ID NO: 414935 - DNA, 25 bp, Homo sapien
atggcatgtcaaagtatacctcaat

SEQ ID NO: 414936 - DNA, 25 bp, Homo sapien
aaacccaagctgcttgaaatgtgtg

SEQ ID NO: 414937 - DNA, 25 bp, Homo sapien
ccaagctgcttgaaatgtgtgggct

SEQ ID NO: 414938 - DNA, 25 bp, Homo sapien
gctgcttgaaatgtgtgggcttatt

SEQ ID NO: 414939 - DNA, 25 bp, Homo sapien
aaatgtgtgggcttatttgcactct

SEQ ID NO: 414940 - DNA, 25 bp, Homo sapien
atgtgtgggcttatttgcactctga

SEQ ID NO: 414941 - DNA, 25 bp, Homo sapien
tgtgtgggcttatttgcactctgaa

SEQ ID NO: 414942 - DNA, 25 bp, Homo sapien
gtgggcttatttgcactctgaaggt

SEQ ID NO: 414943 - DNA, 25 bp, Homo sapien
gggcttatttgcactctgaaggtta

SEQ ID NO: 414944 - DNA, 25 bp, Homo sapien
gcttatttgcactctgaaggttaaa

SEQ ID NO: 414945 - DNA, 25 bp, Homo sapien
ttgcactctgaaggttaaatatgtc

SEQ ID NO: 414946 - DNA, 25 bp, Homo sapien
ttagtcatctatgttgaaattaagg

SEQ ID NO: 414947 - DNA, 25 bp, Homo sapien
ggatgtttccatggcgatattttca

SEQ ID NO: 414948 - DNA, 25 bp, Homo sapien
aacagaaagttcacggccgatggcg

SEQ ID NO: 414949 - DNA, 25 bp, Homo sapien
gccgatggcggttacagctcatgga

SEQ ID NO: 414950 - DNA, 25 bp, Homo sapien
tacagctcatggaactgatgggcag

SEQ ID NO: 414951 - DNA, 25 bp, Homo sapien
ggtgcagctttgtagcacggctgct

SEQ ID NO: 414952 - DNA, 25 bp, Homo sapien
acggctgctgctcacagattctctt

SEQ ID NO: 414953 - DNA, 25 bp, Homo sapien
acagattctcttccatttgactaaa

SEQ ID NO: 414954 - DNA, 25 bp, Homo sapien
taaaaaccatgctgtccacaccaaa

SEQ ID NO: 414955 - DNA, 25 bp, Homo sapien
aaacatctggcctcatccggatgtt

SEQ ID NO: 414956 - DNA, 25 bp, Homo sapien
cctcatccggatgttcaaagccatg

SEQ ID NO: 414957 - DNA, 25 bp, Homo sapien
aaagccatgaaatacagcacttctg

SEQ ID NO: 414958 - DNA, 25 bp, Homo sapien
ataacaacctcttgtgtggccgtca

SEQ ID NO: 414959 - DNA, 25 bp, Homo sapien
aacaacctcttgtgtggccgtcaga

SEQ ID NO: 414960 - DNA, 25 bp, Homo sapien
tcttgtgtggccgtcagagctgact

SEQ ID NO: 414961 - DNA, 25 bp, Homo sapien
tgtggccgtcagagctgactaagca

SEQ ID NO: 414962 - DNA, 25 bp, Homo sapien
gtcagagctgactaagcagaaacta

SEQ ID NO: 414963 - DNA, 25 bp, Homo sapien
agaaactatgatcctctgaatttag

SEQ ID NO: 414964 - DNA, 25 bp, Homo sapien
gatcctctgaatttagtatttttcc

SEQ ID NO: 414965 - DNA, 25 bp, Homo sapien
gtcattagtgacgaagttattctta

SEQ ID NO: 414966 - DNA, 25 bp, Homo sapien
tgacgaagttattcttaaagttcct

SEQ ID NO: 414967 - DNA, 25 bp, Homo sapien
tatcaaataacaatggcttggaggg

SEQ ID NO: 414968 - DNA, 25 bp, Homo sapien
gattattcttcctaacaaatctatt

SEQ ID NO: 414969 - DNA, 25 bp, Homo sapien
cctaaacctcaagtctatgttaaag

SEQ ID NO: 414970 - DNA, 25 bp, Homo sapien
tatgttaaagttgctttcctgctgt

SEQ ID NO: 414971 - DNA, 25 bp, Homo sapien
gctttcctgctgttaaataagctat

SEQ ID NO: 414972 - DNA, 25 bp, Homo sapien
agatattctgacttgctccagtgtc

SEQ ID NO: 414973 - DNA, 25 bp, Homo sapien
tgctccagtgtcaagggaccttctg

SEQ ID NO: 414974 - DNA, 25 bp, Homo sapien
ggagcaggtgctaacatagtgttca

SEQ ID NO: 414975 - DNA, 25 bp, Homo sapien
aggatcccctccaggaggatcctga

SEQ ID NO: 414976 - DNA, 25 bp, Homo sapien
taagtttacagcgttgttccctttg

SEQ ID NO: 414977 - DNA, 25 bp, Homo sapien
gttccctttgcgtttgcagtgcgtt

SEQ ID NO: 414978 - DNA, 25 bp, Homo sapien
gcagtgcgttttactcaagtagcca

SEQ ID NO: 414979 - DNA, 25 bp, Homo sapien
gaaacaccccacgtttctgaatttg

SEQ ID NO: 414980 - DNA, 25 bp, Homo sapien
tgacttttagatattccacagaacc

SEQ ID NO: 414981 - DNA, 25 bp, Homo sapien
tccacagaaccagacttatttgatg

SEQ ID NO: 414982 - DNA, 25 bp, Homo sapien
attttttactcttcccatgtacatg

SEQ ID NO: 414983 - DNA, 25 bp, Homo sapien
gtggcgtgtagagatcagctgatcc

SEQ ID NO: 414984 - DNA, 25 bp, Homo sapien
gagatcagctgatccttgttttatg

SEQ ID NO: 414985 - DNA, 25 bp, Homo sapien
tggttaattgaactactttgtatcc

SEQ ID NO: 414986 - DNA, 25 bp, Homo sapien
tactttgtatccagggtttctgcaa

SEQ ID NO: 414987 - DNA, 25 bp, Homo sapien
gtatccagggtttctgcaaatccaa

SEQ ID NO: 414988 - DNA, 25 bp, Homo sapien
gtgatttttcatctaggatctattc

SEQ ID NO: 414989 - DNA, 25 bp, Homo sapien
gatctattcctaacagtctactcca

SEQ ID NO: 414990 - DNA, 25 bp, Homo sapien
gtctactccaatcccactttagttt

SEQ ID NO: 414991 - DNA, 25 bp, Homo sapien
tctgctgtcttgctggcgcaagttg

SEQ ID NO: 414992 - DNA, 25 bp, Homo sapien
gtcttgctggcgcaagttgctgccc

SEQ ID NO: 414993 - DNA, 25 bp, Homo sapien
aagttgctgccccaagttgcacctt

SEQ ID NO: 414994 - DNA, 25 bp, Homo sapien
tgctgccccaagttgcaccttggaa

SEQ ID NO: 414995 - DNA, 25 bp, Homo sapien
ggggagaatcttacaagcacttcat

SEQ ID NO: 414996 - DNA, 25 bp, Homo sapien
tgctatggtgatttattcatgtgct

SEQ ID NO: 414997 - DNA, 25 bp, Homo sapien
ggtgatttattcatgtgctgacatt

SEQ ID NO: 414998 - DNA, 25 bp, Homo sapien
cattgtatagcttctttattgtatt

SEQ ID NO: 414999 - DNA, 25 bp, Homo sapien
gcctctttctcagtctttaggagta

SEQ ID NO: 415000 - DNA, 25 bp, Homo sapien
ttaggagtacttgtcttcaggcgga

SEQ ID NO: 415001 - DNA, 25 bp, Homo sapien
tacttgtcttcaggcggactctctt

SEQ ID NO: 415002 - DNA, 25 bp, Homo sapien
gggctgtgaactctttgaagctatg

SEQ ID NO: 415003 - DNA, 25 bp, Homo sapien
gaactctttgaagctatgcaaggta

SEQ ID NO: 415004 - DNA, 25 bp, Homo sapien
tgcaaggtaaggatgggtccacagt

SEQ ID NO: 415005 - DNA, 25 bp, Homo sapien
ggtccacagttttcatcattctcaa

SEQ ID NO: 415006 - DNA, 25 bp, Homo sapien
atcattctcaagtctatgacccaaa

SEQ ID NO: 415007 - DNA, 25 bp, Homo sapien
gtctatgacccaaatatgttgcaag

SEQ ID NO: 415008 - DNA, 25 bp, Homo sapien
atatgttgcaagacctgggaataaa

SEQ ID NO: 415009 - DNA, 25 bp, Homo sapien
gacctgggaataaatctggacaaag

SEQ ID NO: 415010 - DNA, 25 bp, Homo sapien
gaagagttcctcagttagttgccct

SEQ ID NO: 415011 - DNA, 25 bp, Homo sapien
agttcctcagttagttgccctgtgt

SEQ ID NO: 415012 - DNA, 25 bp, Homo sapien
gatgggaaagggtggccgtctactt

SEQ ID NO: 415013 - DNA, 25 bp, Homo sapien
gcagaagagcaatagggacttagga

SEQ ID NO: 415014 - DNA, 25 bp, Homo sapien
aggaatgtcatgctggtagacttca

SEQ ID NO: 415015 - DNA, 25 bp, Homo sapien
atgtcatgctggtagacttcaggga

SEQ ID NO: 415016 - DNA, 25 bp, Homo sapien
gacttcagggaagtttcataaaagg

SEQ ID NO: 415017 - DNA, 25 bp, Homo sapien
ggaagaattttaactcagcgtagaa

SEQ ID NO: 415018 - DNA, 25 bp, Homo sapien
aactcagcgtagaaagatgggtaaa

SEQ ID NO: 415019 - DNA, 25 bp, Homo sapien
gatgggtaaattttcctcatgtgaa

SEQ ID NO: 415020 - DNA, 25 bp, Homo sapien
tcctcatgtgaaggtgtactgcctg

SEQ ID NO: 415021 - DNA, 25 bp, Homo sapien
tgctgcaggctggagatgagtatta

SEQ ID NO: 415022 - DNA, 25 bp, Homo sapien
aaagcaacttgtgactaggtgccaa

SEQ ID NO: 415023 - DNA, 25 bp, Homo sapien
tgactaggtgccaaatgtgtgggat

SEQ ID NO: 415024 - DNA, 25 bp, Homo sapien
taggaagtattgcaccttgacttta

SEQ ID NO: 415025 - DNA, 25 bp, Homo sapien
gcaccttgactttaattcctgtatt

SEQ ID NO: 415026 - DNA, 25 bp, Homo sapien
ttgactttaattcctgtattccttc

SEQ ID NO: 415027 - DNA, 25 bp, Homo sapien
tcctgtattccttcattcaaagaaa

SEQ ID NO: 415028 - DNA, 25 bp, Homo sapien
catatttgatgactgctgcgtgcca

SEQ ID NO: 415029 - DNA, 25 bp, Homo sapien
atgactgctgcgtgccagcctgtgt

SEQ ID NO: 415030 - DNA, 25 bp, Homo sapien
aaagagtgaattcccaagtcatttg

SEQ ID NO: 415031 - DNA, 25 bp, Homo sapien
acacaagtgaactaataggcaagat

SEQ ID NO: 415032 - DNA, 25 bp, Homo sapien
atttactaggaatcccaatggtcca

SEQ ID NO: 415033 - DNA, 25 bp, Homo sapien
gaatcccaatggtccactgtcagaa

SEQ ID NO: 415034 - DNA, 25 bp, Homo sapien
aatggtccactgtcagaagacaaaa

SEQ ID NO: 415035 - DNA, 25 bp, Homo sapien
ggctgagttctgtggtcgcctgcac

SEQ ID NO: 415036 - DNA, 25 bp, Homo sapien
cttcccccggaggatggatcatgaa

SEQ ID NO: 415037 - DNA, 25 bp, Homo sapien
atcgtcctctagaccccagtaggag

SEQ ID NO: 415038 - DNA, 25 bp, Homo sapien
tgaagagtggaattgcttttcctct

SEQ ID NO: 415039 - DNA, 25 bp, Homo sapien
aacagtgtatgtgaggcccctgctc

SEQ ID NO: 415040 - DNA, 25 bp, Homo sapien
ccccaggctggccagtactttgggc

SEQ ID NO: 415041 - DNA, 25 bp, Homo sapien
gaccccagtaggagtctaagcacca

SEQ ID NO: 415042 - DNA, 25 bp, Homo sapien
atctgctagacccaaaaatgttaat

SEQ ID NO: 415043 - DNA, 25 bp, Homo sapien
gtaggagtctaagcaccagcgtggt

SEQ ID NO: 415044 - DNA, 25 bp, Homo sapien
agcagccttggacccctgaagcctt

SEQ ID NO: 415045 - DNA, 25 bp, Homo sapien
gaagccttgagcaccaaagcacaca

SEQ ID NO: 415046 - DNA, 25 bp, Homo sapien
agctgcagtccgagtgcagatccca

SEQ ID NO: 415047 - DNA, 25 bp, Homo sapien
gtccgagtgcagatcccatggcgag

SEQ ID NO: 415048 - DNA, 25 bp, Homo sapien
catggcgagcgtgggatccagccca

SEQ ID NO: 415049 - DNA, 25 bp, Homo sapien
acagcccgcccaggttgagtgggca

SEQ ID NO: 415050 - DNA, 25 bp, Homo sapien
tccagatttttcaggcgcccaccat

SEQ ID NO: 415051 - DNA, 25 bp, Homo sapien
ttgagtgggcaggtacctccaacag

SEQ ID NO: 415052 - DNA, 25 bp, Homo sapien
caacagcctggagccgtgaggcctt

SEQ ID NO: 415053 - DNA, 25 bp, Homo sapien
aggtctctggctggcaaagtggcac

SEQ ID NO: 415054 - DNA, 25 bp, Homo sapien
atgttcctctcatccaaacgtcggc

SEQ ID NO: 415055 - DNA, 25 bp, Homo sapien
tccaaacgtcggcacccaaggtgga

SEQ ID NO: 415056 - DNA, 25 bp, Homo sapien
gaagccaggttcatggcatgcccgg

SEQ ID NO: 415057 - DNA, 25 bp, Homo sapien
tttggccggaattttgaatcagcat

SEQ ID NO: 415058 - DNA, 25 bp, Homo sapien
gctaaatgactgacattcattccat

SEQ ID NO: 415059 - DNA, 25 bp, Homo sapien
ggaacaaaaggcctcaggtaaggat

SEQ ID NO: 415060 - DNA, 25 bp, Homo sapien
gagcggtgttaatttttatggtctg

SEQ ID NO: 415061 - DNA, 25 bp, Homo sapien
ttatggtctgtgatcgtagctgtga

SEQ ID NO: 415062 - DNA, 25 bp, Homo sapien
gatcgtagctgtgataagggactga

SEQ ID NO: 415063 - DNA, 25 bp, Homo sapien
aattgtgctctttgtcatggcaacc

SEQ ID NO: 415064 - DNA, 25 bp, Homo sapien
tgtcatggcaaccagcttctgaaaa

SEQ ID NO: 415065 - DNA, 25 bp, Homo sapien
aaaagcccactgaaaattgcctgtc

SEQ ID NO: 415066 - DNA, 25 bp, Homo sapien
ctgtcctgctggtaactgctacggg

SEQ ID NO: 415067 - DNA, 25 bp, Homo sapien
ttaacagtactattttctcgccacc

SEQ ID NO: 415068 - DNA, 25 bp, Homo sapien
agaattggtgtgcactcacctgaga

SEQ ID NO: 415069 - DNA, 25 bp, Homo sapien
gtgcactcacctgagagatctggca

SEQ ID NO: 415070 - DNA, 25 bp, Homo sapien
gtatttctccacagtgcttgctttg

SEQ ID NO: 415071 - DNA, 25 bp, Homo sapien
taaccatgctcaaaagagctgttct

SEQ ID NO: 415072 - DNA, 25 bp, Homo sapien
gagctgttctaatctgcgttttgca

SEQ ID NO: 415073 - DNA, 25 bp, Homo sapien
ctgcgttttgcatgttaagtgttaa

SEQ ID NO: 415074 - DNA, 25 bp, Homo sapien
tcaaacattctttacgtgctcgagg

SEQ ID NO: 415075 - DNA, 25 bp, Homo sapien
acgtgctcgaggtattgcttttaac

SEQ ID NO: 415076 - DNA, 25 bp, Homo sapien
gcttttaacattctactttgccagt

SEQ ID NO: 415077 - DNA, 25 bp, Homo sapien
tactttgccagtttcttcattagat

SEQ ID NO: 415078 - DNA, 25 bp, Homo sapien
gaccagtgatgctttgtgcaattat

SEQ ID NO: 415079 - DNA, 25 bp, Homo sapien
tagagcagtcgcactcgtccatgga

SEQ ID NO: 415080 - DNA, 25 bp, Homo sapien
agtcgcactcgtccatggagcgcgc

SEQ ID NO: 415081 - DNA, 25 bp, Homo sapien
agcgcgccttcgaggccgactacgg

SEQ ID NO: 415082 - DNA, 25 bp, Homo sapien
tacgggcgctcctgcgactacaagg

SEQ ID NO: 415083 - DNA, 25 bp, Homo sapien
gtcgccgtcctacctggacaagctg

SEQ ID NO: 415084 - DNA, 25 bp, Homo sapien
ggacaagctgctgtggcgcgacaac

SEQ ID NO: 415085 - DNA, 25 bp, Homo sapien
tgtggcgcgacaacaagccgcacca

SEQ ID NO: 415086 - DNA, 25 bp, Homo sapien
tcatcctggacctgtcgcactggaa

SEQ ID NO: 415087 - DNA, 25 bp, Homo sapien
acctgtcgcactggaagcaggcggc

SEQ ID NO: 415088 - DNA, 25 bp, Homo sapien
gcctcttcctggagatcgcgcagtg

SEQ ID NO: 415089 - DNA, 25 bp, Homo sapien
agatcgcgcagtgggtcaagagcac

SEQ ID NO: 415090 - DNA, 25 bp, Homo sapien
aaaaataagatggatgtttctgcat

SEQ ID NO: 415091 - DNA, 25 bp, Homo sapien
gcattaaaattagggagttgtcgta

SEQ ID NO: 415092 - DNA, 25 bp, Homo sapien
gggagttgtcgtataatgtagttgc

SEQ ID NO: 415093 - DNA, 25 bp, Homo sapien
gagttgtcgtataatgtagttgcat

SEQ ID NO: 415094 - DNA, 25 bp, Homo sapien
tgtcgtataatgtagttgcataaac

SEQ ID NO: 415095 - DNA, 25 bp, Homo sapien
gaaaccagaaggtccaggctgcagg

SEQ ID NO: 415096 - DNA, 25 bp, Homo sapien
tagtattctgtgcttgtgtggttaa

SEQ ID NO: 415097 - DNA, 25 bp, Homo sapien
agtattctgtgcttgtgtggttaaa

SEQ ID NO: 415098 - DNA, 25 bp, Homo sapien
gtattctgtgcttgtgtggttaaag

SEQ ID NO: 415099 - DNA, 25 bp, Homo sapien
ttgtgtggttaaagagccttcgtag

SEQ ID NO: 415100 - DNA, 25 bp, Homo sapien
tgtggttaaagagccttcgtagaaa

SEQ ID NO: 415101 - DNA, 25 bp, Homo sapien
atgagcaaccacacctgtccccttt

SEQ ID NO: 415102 - DNA, 25 bp, Homo sapien
gaagagttttcatgaccatttgctt

SEQ ID NO: 415103 - DNA, 25 bp, Homo sapien
gagttttcatgaccatttgcttttc

SEQ ID NO: 415104 - DNA, 25 bp, Homo sapien
gttttcatgaccatttgcttttctt

SEQ ID NO: 415105 - DNA, 25 bp, Homo sapien
ttgcttttcttccaactgaccaata

SEQ ID NO: 415106 - DNA, 25 bp, Homo sapien
gcttttcttccaactgaccaatatg

SEQ ID NO: 415107 - DNA, 25 bp, Homo sapien
ttttcttccaactgaccaatatgtt

SEQ ID NO: 415108 - DNA, 25 bp, Homo sapien
aactgaccaatatgttaaacttagc

SEQ ID NO: 415109 - DNA, 25 bp, Homo sapien
gggattaaaagcgtgcgccccaaat

SEQ ID NO: 415110 - DNA, 25 bp, Homo sapien
gattaaaagcgtgcgccccaaatgt

SEQ ID NO: 415111 - DNA, 25 bp, Homo sapien
gcgccccaaatgtccgcctaatttt

SEQ ID NO: 415112 - DNA, 25 bp, Homo sapien
ataatgtacatgaaaggtcttcctt

SEQ ID NO: 415113 - DNA, 25 bp, Homo sapien
gtcttccttgataaacgataaacct

SEQ ID NO: 415114 - DNA, 25 bp, Homo sapien
aacgataaaccttgtgattttgcca

SEQ ID NO: 415115 - DNA, 25 bp, Homo sapien
gattttgccacacaagaatttagct

SEQ ID NO: 415116 - DNA, 25 bp, Homo sapien
agctaaaccctttcctaatgtcatt

SEQ ID NO: 415117 - DNA, 25 bp, Homo sapien
aaaccctttcctaatgtcattgtat

SEQ ID NO: 415118 - DNA, 25 bp, Homo sapien
gagtagtacagattccatgtgtttg

SEQ ID NO: 415119 - DNA, 25 bp, Homo sapien
aaacgcttgataggattacctttct

SEQ ID NO: 415120 - DNA, 25 bp, Homo sapien
gataggattacctttctagagagac

SEQ ID NO: 415121 - DNA, 25 bp, Homo sapien
tctgtgtatggccacacttatccac

SEQ ID NO: 415122 - DNA, 25 bp, Homo sapien
cacttatccaccacagtttttgttt

SEQ ID NO: 415123 - DNA, 25 bp, Homo sapien
tcttaagcttcctgtttcatgcatt

SEQ ID NO: 415124 - DNA, 25 bp, Homo sapien
ttcctgtttcatgcattctatttaa

SEQ ID NO: 415125 - DNA, 25 bp, Homo sapien
catgcattctatttaattgtggtca

SEQ ID NO: 415126 - DNA, 25 bp, Homo sapien
aattgtggtcattgcttattagcat

SEQ ID NO: 415127 - DNA, 25 bp, Homo sapien
agcattttttggagacttagctatg

SEQ ID NO: 415128 - DNA, 25 bp, Homo sapien
gacttagctatgtatcattttctga

SEQ ID NO: 415129 - DNA, 25 bp, Homo sapien
gaaagctcttacatacagacttgga

SEQ ID NO: 415130 - DNA, 25 bp, Homo sapien
acagacttggattattttcatagaa

SEQ ID NO: 415131 - DNA, 25 bp, Homo sapien
tagaatactgccaaaagggtgtagt

SEQ ID NO: 415132 - DNA, 25 bp, Homo sapien
aaagggtgtagtgaacagcaatcat

SEQ ID NO: 415133 - DNA, 25 bp, Homo sapien
acagcaatcatgttggcttttcaat

SEQ ID NO: 415134 - DNA, 25 bp, Homo sapien
ttgcacaccacctaacactttgtgt

SEQ ID NO: 415135 - DNA, 25 bp, Homo sapien
acactttgtgtagcactggtggcac

SEQ ID NO: 415136 - DNA, 25 bp, Homo sapien
ggacgcgtgggttagtatctataac

SEQ ID NO: 415137 - DNA, 25 bp, Homo sapien
tgtgtagcactggtggcacacaccc

SEQ ID NO: 415138 - DNA, 25 bp, Homo sapien
gttctttcgcacagtgttgaattca

SEQ ID NO: 415139 - DNA, 25 bp, Homo sapien
cgcacagtgttgaattcatgcttgt

SEQ ID NO: 415140 - DNA, 25 bp, Homo sapien
gaattcatgcttgtgaacacctaca

SEQ ID NO: 415141 - DNA, 25 bp, Homo sapien
atgcttgtgaacacctacagagctg

SEQ ID NO: 415142 - DNA, 25 bp, Homo sapien
gcggcagaaaataagcagaagtctc

SEQ ID NO: 415143 - DNA, 25 bp, Homo sapien
taagcagaagtctctaggctggtgt

SEQ ID NO: 415144 - DNA, 25 bp, Homo sapien
gtatctataacacctttgttgtctt

SEQ ID NO: 415145 - DNA, 25 bp, Homo sapien
catgcctttggagatgaaactggac

SEQ ID NO: 415146 - DNA, 25 bp, Homo sapien
tggagatgaaactggacttgtgtgt

SEQ ID NO: 415147 - DNA, 25 bp, Homo sapien
acttgtgtgtgggcgctgagcatta

SEQ ID NO: 415148 - DNA, 25 bp, Homo sapien
agggtgtgtgcagttggatattata

SEQ ID NO: 415149 - DNA, 25 bp, Homo sapien
gttggatattataataacctcagta

SEQ ID NO: 415150 - DNA, 25 bp, Homo sapien
taacctcagtaatgattcacacatg

SEQ ID NO: 415151 - DNA, 25 bp, Homo sapien
gtaatgattcacacatgtaaggcaa

SEQ ID NO: 415152 - DNA, 25 bp, Homo sapien
aagaagctcaattcttcctgttaaa

SEQ ID NO: 415153 - DNA, 25 bp, Homo sapien
taaaaataaaggatgccgggcatgg

SEQ ID NO: 415154 - DNA, 25 bp, Homo sapien
ggatgaaactgcatgcctttggaga

SEQ ID NO: 415155 - DNA, 25 bp, Homo sapien
gaaactgcatgcctttggagatgaa

SEQ ID NO: 415156 - DNA, 25 bp, Homo sapien
cttttctgtcttctatggagacggg

SEQ ID NO: 415157 - DNA, 25 bp, Homo sapien
gagtcactgtgactggccaacatta

SEQ ID NO: 415158 - DNA, 25 bp, Homo sapien
actgtgactggccaacattatgtga

SEQ ID NO: 415159 - DNA, 25 bp, Homo sapien
tgtgactggccaacattatgtgatt

SEQ ID NO: 415160 - DNA, 25 bp, Homo sapien
gactggccaacattatgtgatttat

SEQ ID NO: 415161 - DNA, 25 bp, Homo sapien
cattatgtgatttatgtgtgaacta

SEQ ID NO: 415162 - DNA, 25 bp, Homo sapien
gaactatataacacaaatcatcccc

SEQ ID NO: 415163 - DNA, 25 bp, Homo sapien
tataacacaaatcatccccaaaacc

SEQ ID NO: 415164 - DNA, 25 bp, Homo sapien
atcatgatctgtaaagcagctgcaa

SEQ ID NO: 415165 - DNA, 25 bp, Homo sapien
agttgtaaagatgagtttccaccta

SEQ ID NO: 415166 - DNA, 25 bp, Homo sapien
taaagatgagtttccacctacttat

SEQ ID NO: 415167 - DNA, 25 bp, Homo sapien
atgtgtcaaaatgtagtgattatct

SEQ ID NO: 415168 - DNA, 25 bp, Homo sapien
aggatgattgtgacttttttgcttc

SEQ ID NO: 415169 - DNA, 25 bp, Homo sapien
tgattgtgacttttttgcttctatt

SEQ ID NO: 415170 - DNA, 25 bp, Homo sapien
aaatatttctaccacgaatacgtat

SEQ ID NO: 415171 - DNA, 25 bp, Homo sapien
tttctaccacgaatacgtattactt

SEQ ID NO: 415172 - DNA, 25 bp, Homo sapien
cacgaatacgtattacttatatgac

SEQ ID NO: 415173 - DNA, 25 bp, Homo sapien
tatttaaaactcacagcaggccagg

SEQ ID NO: 415174 - DNA, 25 bp, Homo sapien
aaatgcttaacatagtgcctacaga

SEQ ID NO: 415175 - DNA, 25 bp, Homo sapien
gcttaacatagtgcctacagatagt

SEQ ID NO: 415176 - DNA, 25 bp, Homo sapien
agtgcctacagatagtaataagtgt

SEQ ID NO: 415177 - DNA, 25 bp, Homo sapien
aaaactctagaattatatgtgtcaa

SEQ ID NO: 415178 - DNA, 25 bp, Homo sapien
attacttttgcccagtttggagatg

SEQ ID NO: 415179 - DNA, 25 bp, Homo sapien
gatgatgatccagcatggtgtgacc

SEQ ID NO: 415180 - DNA, 25 bp, Homo sapien
cagcatggtgtgaccaacagtgttt

SEQ ID NO: 415181 - DNA, 25 bp, Homo sapien
ccaggacctgaacacaagtggtata

SEQ ID NO: 415182 - DNA, 25 bp, Homo sapien
atcaacaccataagtaattctgcaa

SEQ ID NO: 415183 - DNA, 25 bp, Homo sapien
aaggacatgctgtacactttgccca

SEQ ID NO: 415184 - DNA, 25 bp, Homo sapien
gtacactttgcccagatttgtgatt

SEQ ID NO: 415185 - DNA, 25 bp, Homo sapien
ctgggctaaagggagttaacatctt

SEQ ID NO: 415186 - DNA, 25 bp, Homo sapien
ggtataaattattcccactcctgga

SEQ ID NO: 415187 - DNA, 25 bp, Homo sapien
attattcccactcctggataaaaat

SEQ ID NO: 415188 - DNA, 25 bp, Homo sapien
tttgttccaggaaagcaggtaaatt

SEQ ID NO: 415189 - DNA, 25 bp, Homo sapien
agtcgcgctgctgtgatttcagcac

SEQ ID NO: 415190 - DNA, 25 bp, Homo sapien
atttcagcactcacccttgttggaa

SEQ ID NO: 415191 - DNA, 25 bp, Homo sapien
ctttttcttcatgcacatggctgtt

SEQ ID NO: 415192 - DNA, 25 bp, Homo sapien
ggctgttttttcaaaagtgctgcag

SEQ ID NO: 415193 - DNA, 25 bp, Homo sapien
agtgctgcagaaatgtggccaagac

SEQ ID NO: 415194 - DNA, 25 bp, Homo sapien
gcatccctggctacaaacgtatttg

SEQ ID NO: 415195 - DNA, 25 bp, Homo sapien
cagcagttgctacagaaacgtgatt

SEQ ID NO: 415196 - DNA, 25 bp, Homo sapien
acgtgattttcaaagcatctgcatc

SEQ ID NO: 415197 - DNA, 25 bp, Homo sapien
ataaatggagatcgttaagcctgga

SEQ ID NO: 415198 - DNA, 25 bp, Homo sapien
agctccatcaggtcacggactcgtg

SEQ ID NO: 415199 - DNA, 25 bp, Homo sapien
tcacggactcgtggccttgggtaga

SEQ ID NO: 415200 - DNA, 25 bp, Homo sapien
taagagtacagcaagttttctggat

SEQ ID NO: 415201 - DNA, 25 bp, Homo sapien
agttttctggatctatgatcaggca

SEQ ID NO: 415202 - DNA, 25 bp, Homo sapien
ggatctatgatcaggcaaaggccgg

SEQ ID NO: 415203 - DNA, 25 bp, Homo sapien
ctatgatcaggcaaaggccgggagc

SEQ ID NO: 415204 - DNA, 25 bp, Homo sapien
aaaacatttggagtcctcattacta

SEQ ID NO: 415205 - DNA, 25 bp, Homo sapien
aacatttggagtcctcattactaat

SEQ ID NO: 415206 - DNA, 25 bp, Homo sapien
atttggagtcctcattactaataga

SEQ ID NO: 415207 - DNA, 25 bp, Homo sapien
ggagtcctcattactaatagagaaa

SEQ ID NO: 415208 - DNA, 25 bp, Homo sapien
gaaagtttctatttacaggtaacat

SEQ ID NO: 415209 - DNA, 25 bp, Homo sapien
gtttctatttacaggtaacatgatt

SEQ ID NO: 415210 - DNA, 25 bp, Homo sapien
gattgttatgcttgtcaggcaagaa

SEQ ID NO: 415211 - DNA, 25 bp, Homo sapien
agccgcccggcgatggtgcgtttga

SEQ ID NO: 415212 - DNA, 25 bp, Homo sapien
tggtgtctgcaccactcacatcaca

SEQ ID NO: 415213 - DNA, 25 bp, Homo sapien
cactcacatcacacaggtcaggctt

SEQ ID NO: 415214 - DNA, 25 bp, Homo sapien
acacaggtcaggcttctttgattta

SEQ ID NO: 415215 - DNA, 25 bp, Homo sapien
gtgtgcttgcaagtcaagagccaag

SEQ ID NO: 415216 - DNA, 25 bp, Homo sapien
aaagaggagaccgtgcagtttcgca

SEQ ID NO: 415217 - DNA, 25 bp, Homo sapien
gagaccgtgcagtttcgcagagtcc

SEQ ID NO: 415218 - DNA, 25 bp, Homo sapien
agtttcgcagagtcctggtccattg

SEQ ID NO: 415219 - DNA, 25 bp, Homo sapien
tcctggtccattgctgctcctgtaa

SEQ ID NO: 415220 - DNA, 25 bp, Homo sapien
taccttagactggagggccgggcac

SEQ ID NO: 415221 - DNA, 25 bp, Homo sapien
tggctgaggtttcctggtgggccaa

SEQ ID NO: 415222 - DNA, 25 bp, Homo sapien
gagatgaagaactaggcgtgatgta

SEQ ID NO: 415223 - DNA, 25 bp, Homo sapien
actaggcgtgatgtagttccagcgc

SEQ ID NO: 415224 - DNA, 25 bp, Homo sapien
gcgtgatgtagttccagcgctttgg

SEQ ID NO: 415225 - DNA, 25 bp, Homo sapien
gagaggatctcttgggcgcgggagt

SEQ ID NO: 415226 - DNA, 25 bp, Homo sapien
gacggggagagactttgtttctaca

SEQ ID NO: 415227 - DNA, 25 bp, Homo sapien
aaggcaattccttgtctgttctgaa

SEQ ID NO: 415228 - DNA, 25 bp, Homo sapien
ggcaattccttgtctgttctgaaaa

SEQ ID NO: 415229 - DNA, 25 bp, Homo sapien
tccttgtctgttctgaaaaatgcta

SEQ ID NO: 415230 - DNA, 25 bp, Homo sapien
ttcctttccctgagactatgaattt

SEQ ID NO: 415231 - DNA, 25 bp, Homo sapien
tccctgagactatgaatttgaccat

SEQ ID NO: 415232 - DNA, 25 bp, Homo sapien
gaatttgaccatgtttagagatgaa

SEQ ID NO: 415233 - DNA, 25 bp, Homo sapien
gagacagcgtccacagcctgctcag

SEQ ID NO: 415234 - DNA, 25 bp, Homo sapien
ggccatgctgcaccttacaaaacgg

SEQ ID NO: 415235 - DNA, 25 bp, Homo sapien
atgctgcaccttacaaaacggtctc

SEQ ID NO: 415236 - DNA, 25 bp, Homo sapien
tgcaccttacaaaacggtctccgtc

SEQ ID NO: 415237 - DNA, 25 bp, Homo sapien
tacaaaacggtctccgtccgcgcgg

SEQ ID NO: 415238 - DNA, 25 bp, Homo sapien
ttccagctgcggcttttcatggagt

SEQ ID NO: 415239 - DNA, 25 bp, Homo sapien
agctgcggcttttcatggagttttt

SEQ ID NO: 415240 - DNA, 25 bp, Homo sapien
tgcggcttttcatggagtttttgag

SEQ ID NO: 415241 - DNA, 25 bp, Homo sapien
aggacgggcggctggaggtctgcat

SEQ ID NO: 415242 - DNA, 25 bp, Homo sapien
tggaggtctgcatccaggacactga

SEQ ID NO: 415243 - DNA, 25 bp, Homo sapien
tccaggacactgacggcaccgaggt

SEQ ID NO: 415244 - DNA, 25 bp, Homo sapien
aagtcctcgataatccttggtaatg

SEQ ID NO: 415245 - DNA, 25 bp, Homo sapien
ttcaatgtgtgcttatctgtgctct

SEQ ID NO: 415246 - DNA, 25 bp, Homo sapien
cttccctgttataaattctgagagg

SEQ ID NO: 415247 - DNA, 25 bp, Homo sapien
gtgcttatctgtgctctatctcata

SEQ ID NO: 415248 - DNA, 25 bp, Homo sapien
tctgtgctctatctcataaactaag

SEQ ID NO: 415249 - DNA, 25 bp, Homo sapien
cagactgagggcagcaggtccagcc

SEQ ID NO: 415250 - DNA, 25 bp, Homo sapien
agagtatgccctataaatccattag

SEQ ID NO: 415251 - DNA, 25 bp, Homo sapien
atccattaggaattataggccaggc

SEQ ID NO: 415252 - DNA, 25 bp, Homo sapien
agggcagaggccaatgtctgcttct

SEQ ID NO: 415253 - DNA, 25 bp, Homo sapien
aacacagtgccttcatgtgctttac

SEQ ID NO: 415254 - DNA, 25 bp, Homo sapien
gtgctttacatgtaccaagtcctcg

SEQ ID NO: 415255 - DNA, 25 bp, Homo sapien
gttttagtagcgacattcttttatt

SEQ ID NO: 415256 - DNA, 25 bp, Homo sapien
tttagtagcgacattcttttattac

SEQ ID NO: 415257 - DNA, 25 bp, Homo sapien
ttagtagcgacattcttttattact

SEQ ID NO: 415258 - DNA, 25 bp, Homo sapien
tttattacttctaattgccttgtaa

SEQ ID NO: 415259 - DNA, 25 bp, Homo sapien
ttattacttctaattgccttgtaaa

SEQ ID NO: 415260 - DNA, 25 bp, Homo sapien
cttctaattgccttgtaaaatgcat

SEQ ID NO: 415261 - DNA, 25 bp, Homo sapien
taaaatgcattgttatggcccggca

SEQ ID NO: 415262 - DNA, 25 bp, Homo sapien
aaaatgcattgttatggcccggcac

SEQ ID NO: 415263 - DNA, 25 bp, Homo sapien
aaatgcattgttatggcccggcacg

SEQ ID NO: 415264 - DNA, 25 bp, Homo sapien
aatgcattgttatggcccggcacgg

SEQ ID NO: 415265 - DNA, 25 bp, Homo sapien
atgcattgttatggcccggcacggt

SEQ ID NO: 415266 - DNA, 25 bp, Homo sapien
gggcactgccgtaagagcattgcat

SEQ ID NO: 415267 - DNA, 25 bp, Homo sapien
attgcatccatcctttcgtcggtac

SEQ ID NO: 415268 - DNA, 25 bp, Homo sapien
tcgtcggtactctgctgcacacgga

SEQ ID NO: 415269 - DNA, 25 bp, Homo sapien
ttgagcccttattgggaggaattat

SEQ ID NO: 415270 - DNA, 25 bp, Homo sapien
tgctcttgcacatacattatcaggc

SEQ ID NO: 415271 - DNA, 25 bp, Homo sapien
gcacatacattatcaggccaacatg

SEQ ID NO: 415272 - DNA, 25 bp, Homo sapien
aattatagtcgaatggaaaatccag

SEQ ID NO: 415273 - DNA, 25 bp, Homo sapien
gaaaatccagtttgggacgtggtgt

SEQ ID NO: 415274 - DNA, 25 bp, Homo sapien
gacgtggtgtaaactggaattgctt

SEQ ID NO: 415275 - DNA, 25 bp, Homo sapien
gaattgctttcgtggtttttccttg

SEQ ID NO: 415276 - DNA, 25 bp, Homo sapien
gctttcgtggtttttccttgtgcct

SEQ ID NO: 415277 - DNA, 25 bp, Homo sapien
tgggccaacccttccatgggtgaag

SEQ ID NO: 415278 - DNA, 25 bp, Homo sapien
acccttccatgggtgaagacaagca

SEQ ID NO: 415279 - DNA, 25 bp, Homo sapien
gaagacaagcaagtccccctggagg

SEQ ID NO: 415280 - DNA, 25 bp, Homo sapien
ggcccagaaagccatctacagggtt

SEQ ID NO: 415281 - DNA, 25 bp, Homo sapien
gaaagccatctacagggttccctag

SEQ ID NO: 415282 - DNA, 25 bp, Homo sapien
atctacagggttccctaggccaggt

SEQ ID NO: 415283 - DNA, 25 bp, Homo sapien
taagccccccagctgtaaataggct

SEQ ID NO: 415284 - DNA, 25 bp, Homo sapien
tgtggccagtgcctggtcatcagaa

SEQ ID NO: 415285 - DNA, 25 bp, Homo sapien
cagtgcctggtcatcagaagaggga

SEQ ID NO: 415286 - DNA, 25 bp, Homo sapien
aggaggagcccaggcgtctgtttat

SEQ ID NO: 415287 - DNA, 25 bp, Homo sapien
cccaggcgtctgtttatgtatttat

SEQ ID NO: 415288 - DNA, 25 bp, Homo sapien
gagagaattgtttataccatttcag

SEQ ID NO: 415289 - DNA, 25 bp, Homo sapien
tgtttataccatttcagttccaata

SEQ ID NO: 415290 - DNA, 25 bp, Homo sapien
tctttccaagaatactgtagctttg

SEQ ID NO: 415291 - DNA, 25 bp, Homo sapien
tgtagctttgagtttgcaccgttcc

SEQ ID NO: 415292 - DNA, 25 bp, Homo sapien
tttgagtttgcaccgttccttgtcc

SEQ ID NO: 415293 - DNA, 25 bp, Homo sapien
tcagcagcttcacttctaggcgaag

SEQ ID NO: 415294 - DNA, 25 bp, Homo sapien
gcttcacttctaggcgaaggcttca

SEQ ID NO: 415295 - DNA, 25 bp, Homo sapien
gaaggcttcatgaaccaagtgacgt

SEQ ID NO: 415296 - DNA, 25 bp, Homo sapien
atgaaccaagtgacgtcaaccaaca

SEQ ID NO: 415297 - DNA, 25 bp, Homo sapien
tgacgtcaaccaacaaggcttctct

SEQ ID NO: 415298 - DNA, 25 bp, Homo sapien
tctctcctctctctaacaatgaaag

SEQ ID NO: 415299 - DNA, 25 bp, Homo sapien
tgcctaagcctgtagaagtgctaga

SEQ ID NO: 415300 - DNA, 25 bp, Homo sapien
gcctaagcctgtagaagtgctagat

SEQ ID NO: 415301 - DNA, 25 bp, Homo sapien
cctaagcctgtagaagtgctagatt

SEQ ID NO: 415302 - DNA, 25 bp, Homo sapien
ctaagcctgtagaagtgctagatta

SEQ ID NO: 415303 - DNA, 25 bp, Homo sapien
taagcctgtagaagtgctagattat

SEQ ID NO: 415304 - DNA, 25 bp, Homo sapien
aagcctgtagaagtgctagattata

SEQ ID NO: 415305 - DNA, 25 bp, Homo sapien
tggcccttttaataagctagaataa

SEQ ID NO: 415306 - DNA, 25 bp, Homo sapien
ggcccttttaataagctagaataag

SEQ ID NO: 415307 - DNA, 25 bp, Homo sapien
gcccttttaataagctagaataaga

SEQ ID NO: 415308 - DNA, 25 bp, Homo sapien
cccttttaataagctagaataagag

SEQ ID NO: 415309 - DNA, 25 bp, Homo sapien
aaatgttatgattcattgtatttat

SEQ ID NO: 415310 - DNA, 25 bp, Homo sapien
ttctaagaatggttgtgaacccctt

SEQ ID NO: 415311 - DNA, 25 bp, Homo sapien
gttgtgaaccccttatagaatctga

SEQ ID NO: 415312 - DNA, 25 bp, Homo sapien
atctgatgaaagctgtggattttgt

SEQ ID NO: 415313 - DNA, 25 bp, Homo sapien
aaatctcacttgtccattttcacac

SEQ ID NO: 415314 - DNA, 25 bp, Homo sapien
gtccattttcacacggtttagcata

SEQ ID NO: 415315 - DNA, 25 bp, Homo sapien
gcataaagtttagtctgtttagcct

SEQ ID NO: 415316 - DNA, 25 bp, Homo sapien
ctgtttagcctaaagcattgttggg

SEQ ID NO: 415317 - DNA, 25 bp, Homo sapien
gcctaaagcattgttgggcttacag

SEQ ID NO: 415318 - DNA, 25 bp, Homo sapien
ctccagctcctgagaggtctgcttc

SEQ ID NO: 415319 - DNA, 25 bp, Homo sapien
tgagaggtctgcttcccgcttgatc

SEQ ID NO: 415320 - DNA, 25 bp, Homo sapien
ttcccgcttgatccttttatctgtt

SEQ ID NO: 415321 - DNA, 25 bp, Homo sapien
gtcgaggctgcatttagtggtgatg

SEQ ID NO: 415322 - DNA, 25 bp, Homo sapien
gctgcatttagtggtgatggtgcca

SEQ ID NO: 415323 - DNA, 25 bp, Homo sapien
ctgcatttagtggtgatggtgccac

SEQ ID NO: 415324 - DNA, 25 bp, Homo sapien
tgcatttagtggtgatggtgccaca

SEQ ID NO: 415325 - DNA, 25 bp, Homo sapien
catttagtggtgatggtgccacagt

SEQ ID NO: 415326 - DNA, 25 bp, Homo sapien
tttagtggtgatggtgccacagtcc

SEQ ID NO: 415327 - DNA, 25 bp, Homo sapien
ttagtggtgatggtgccacagtcct

SEQ ID NO: 415328 - DNA, 25 bp, Homo sapien
tagtggtgatggtgccacagtcctc

SEQ ID NO: 415329 - DNA, 25 bp, Homo sapien
agtggtgatggtgccacagtcctct

SEQ ID NO: 415330 - DNA, 25 bp, Homo sapien
ggtgatggtgccacagtcctctggc

SEQ ID NO: 415331 - DNA, 25 bp, Homo sapien
gtgatggtgccacagtcctctggcc

SEQ ID NO: 415332 - DNA, 25 bp, Homo sapien
cagaagggttcatgtgttcgttttt

SEQ ID NO: 415333 - DNA, 25 bp, Homo sapien
gaatagagaaacaccaagcccaaga

SEQ ID NO: 415334 - DNA, 25 bp, Homo sapien
gcagaaggatctgtctatagctaat

SEQ ID NO: 415335 - DNA, 25 bp, Homo sapien
ggatctgtctatagctaatgagtga

SEQ ID NO: 415336 - DNA, 25 bp, Homo sapien
agtgagaaactaactgtgggatggt

SEQ ID NO: 415337 - DNA, 25 bp, Homo sapien
tgggatggtttatggtctctggctc

SEQ ID NO: 415338 - DNA, 25 bp, Homo sapien
gtttatggtctctggctctttgaaa

SEQ ID NO: 415339 - DNA, 25 bp, Homo sapien
aaaagccaacttgactgggcacagt

SEQ ID NO: 415340 - DNA, 25 bp, Homo sapien
agtttagtctacacactgattcctt

SEQ ID NO: 415341 - DNA, 25 bp, Homo sapien
actgattccttcctgttcgcagaag

SEQ ID NO: 415342 - DNA, 25 bp, Homo sapien
ttcctgttcgcagaagggttcatgt

SEQ ID NO: 415343 - DNA, 25 bp, Homo sapien
atctgttttagtggtacaggtactc

SEQ ID NO: 415344 - DNA, 25 bp, Homo sapien
tagtggtacaggtactcatgcacat

SEQ ID NO: 415345 - DNA, 25 bp, Homo sapien
gtggtacaggtactcatgcacatga

SEQ ID NO: 415346 - DNA, 25 bp, Homo sapien
tcatgcacatgagtaccgctcctgg

SEQ ID NO: 415347 - DNA, 25 bp, Homo sapien
atgcacatgagtaccgctcctggcc

SEQ ID NO: 415348 - DNA, 25 bp, Homo sapien
acatgagtaccgctcctggccttgg

SEQ ID NO: 415349 - DNA, 25 bp, Homo sapien
ctggccttggcactctttatacgtt

SEQ ID NO: 415350 - DNA, 25 bp, Homo sapien
gccttggcactctttatacgttgta

SEQ ID NO: 415351 - DNA, 25 bp, Homo sapien
cttggcactctttatacgttgtaaa

SEQ ID NO: 415352 - DNA, 25 bp, Homo sapien
ggcactctttatacgttgtaaacat

SEQ ID NO: 415353 - DNA, 25 bp, Homo sapien
ttatacgttgtaaacattgattgtt

SEQ ID NO: 415354 - DNA, 25 bp, Homo sapien
aagaaagcattgtacgtttaaacat

SEQ ID NO: 415355 - DNA, 25 bp, Homo sapien
gaaagcattgtacgtttaaacatat

SEQ ID NO: 415356 - DNA, 25 bp, Homo sapien
cattgtacgtttaaacatatgcaaa

SEQ ID NO: 415357 - DNA, 25 bp, Homo sapien
tgtacgtttaaacatatgcaaataa

SEQ ID NO: 415358 - DNA, 25 bp, Homo sapien
aacagtatgttttagggagtataat

SEQ ID NO: 415359 - DNA, 25 bp, Homo sapien
cagtatgttttagggagtataattt

SEQ ID NO: 415360 - DNA, 25 bp, Homo sapien
ggaagactatattgccaacaaaatg

SEQ ID NO: 415361 - DNA, 25 bp, Homo sapien
gaagactatattgccaacaaaatga

SEQ ID NO: 415362 - DNA, 25 bp, Homo sapien
tattgccaacaaaatgaaagctttt

SEQ ID NO: 415363 - DNA, 25 bp, Homo sapien
ttgccaacaaaatgaaagcttttac

SEQ ID NO: 415364 - DNA, 25 bp, Homo sapien
tgaaagcttttaccccctaaacatg

SEQ ID NO: 415365 - DNA, 25 bp, Homo sapien
ggatgcaaaaatccttggacaggaa

SEQ ID NO: 415366 - DNA, 25 bp, Homo sapien
gacaggaaggccaactgtgcttaac

SEQ ID NO: 415367 - DNA, 25 bp, Homo sapien
aaggccaactgtgcttaacagaaga

SEQ ID NO: 415368 - DNA, 25 bp, Homo sapien
gagcaaaatgctcccaacttgtatt

SEQ ID NO: 415369 - DNA, 25 bp, Homo sapien
gctcccaacttgtattcattacgtt

SEQ ID NO: 415370 - DNA, 25 bp, Homo sapien
gtattcattacgttatggtagaaca

SEQ ID NO: 415371 - DNA, 25 bp, Homo sapien
atgatccaaaatgtcttattcttag

SEQ ID NO: 415372 - DNA, 25 bp, Homo sapien
aaaggtatagctgtcggctgcctca

SEQ ID NO: 415373 - DNA, 25 bp, Homo sapien
tgtcggctgcctcaaaacacttaaa

SEQ ID NO: 415374 - DNA, 25 bp, Homo sapien
ggctgcctcaaaacacttaaacctt

SEQ ID NO: 415375 - DNA, 25 bp, Homo sapien
tttccatctgaggttagttgaattc

SEQ ID NO: 415376 - DNA, 25 bp, Homo sapien
tgaatactgggtggcaaaattaagc

SEQ ID NO: 415377 - DNA, 25 bp, Homo sapien
tggcaaaattaagcacctacaaatt

SEQ ID NO: 415378 - DNA, 25 bp, Homo sapien
gaatattctattacatcctctttac

SEQ ID NO: 415379 - DNA, 25 bp, Homo sapien
attctattacatcctctttactaag

SEQ ID NO: 415380 - DNA, 25 bp, Homo sapien
attacatcctctttactaagcatgg

SEQ ID NO: 415381 - DNA, 25 bp, Homo sapien
acatcctctttactaagcatggtac

SEQ ID NO: 415382 - DNA, 25 bp, Homo sapien
cctctttactaagcatggtactagg

SEQ ID NO: 415383 - DNA, 25 bp, Homo sapien
actaagcatggtactaggtaggtaa

SEQ ID NO: 415384 - DNA, 25 bp, Homo sapien
tgttaaaatctatatgccaccacta

SEQ ID NO: 415385 - DNA, 25 bp, Homo sapien
atctatatgccaccactaatttttt

SEQ ID NO: 415386 - DNA, 25 bp, Homo sapien
attttttatccatgaatactgggtg

SEQ ID NO: 415387 - DNA, 25 bp, Homo sapien
gaagctcagcttgcccaagaagtca

SEQ ID NO: 415388 - DNA, 25 bp, Homo sapien
agtcaaagtaaacatcattcaggag

SEQ ID NO: 415389 - DNA, 25 bp, Homo sapien
ggaatatcaagaatatcgccaaaca

SEQ ID NO: 415390 - DNA, 25 bp, Homo sapien
aaggagcctatacacacttctagag

SEQ ID NO: 415391 - DNA, 25 bp, Homo sapien
acacttctagaggagatacgggacc

SEQ ID NO: 415392 - DNA, 25 bp, Homo sapien
agatacgggacctagctctcctgga

SEQ ID NO: 415393 - DNA, 25 bp, Homo sapien
gggacctagctctcctggatgtttc

SEQ ID NO: 415394 - DNA, 25 bp, Homo sapien
caattatggaatatgagaggctctt

SEQ ID NO: 415395 - DNA, 25 bp, Homo sapien
atttaatgtgtgtcactcagtgctc

SEQ ID NO: 415396 - DNA, 25 bp, Homo sapien
actcagtgctctagtcgatcaggac

SEQ ID NO: 415397 - DNA, 25 bp, Homo sapien
tcaggactgggtagctatttcgcat

SEQ ID NO: 415398 - DNA, 25 bp, Homo sapien
aaggttcaacacattatgagtcagc

SEQ ID NO: 415399 - DNA, 25 bp, Homo sapien
tatgagtcagcatctcccaaaactt

SEQ ID NO: 415400 - DNA, 25 bp, Homo sapien
gtcagcatctcccaaaacttgtgaa

SEQ ID NO: 415401 - DNA, 25 bp, Homo sapien
ttacagccaagccacaaaaggttaa

SEQ ID NO: 415402 - DNA, 25 bp, Homo sapien
taagtcattgagatgggaagttcct

SEQ ID NO: 415403 - DNA, 25 bp, Homo sapien
gaagttcctcttctgattatcagca

SEQ ID NO: 415404 - DNA, 25 bp, Homo sapien
tattgagtctcattgccactatgct

SEQ ID NO: 415405 - DNA, 25 bp, Homo sapien
aagcaaaattctgcagttgattgga

SEQ ID NO: 415406 - DNA, 25 bp, Homo sapien
gaaaaagacctgaattgcctccaaa

SEQ ID NO: 415407 - DNA, 25 bp, Homo sapien
aagacctgaattgcctccaaataac

SEQ ID NO: 415408 - DNA, 25 bp, Homo sapien
tgttccttgatgagcttttttaggg

SEQ ID NO: 415409 - DNA, 25 bp, Homo sapien
taatgggccaccatcagtctagggc

SEQ ID NO: 415410 - DNA, 25 bp, Homo sapien
accatcagtctagggctgtgttttt

SEQ ID NO: 415411 - DNA, 25 bp, Homo sapien
tgacgtgtggaccttgaagccttca

SEQ ID NO: 415412 - DNA, 25 bp, Homo sapien
tcctcaagatgctttcagctggtcc

SEQ ID NO: 415413 - DNA, 25 bp, Homo sapien
gttttcacagtgatactgagacatc

SEQ ID NO: 415414 - DNA, 25 bp, Homo sapien
gagacatcatttgccttttcactat

SEQ ID NO: 415415 - DNA, 25 bp, Homo sapien
taggtaaatccactagcacctcact

SEQ ID NO: 415416 - DNA, 25 bp, Homo sapien
gcacctcactgagagtaaggcaatg

SEQ ID NO: 415417 - DNA, 25 bp, Homo sapien
gcaatgacacagaaagttacctact

SEQ ID NO: 415418 - DNA, 25 bp, Homo sapien
gttacctactagtgaccatcatgtt

SEQ ID NO: 415419 - DNA, 25 bp, Homo sapien
gaccatcatgttcttcatcacaatg

SEQ ID NO: 415420 - DNA, 25 bp, Homo sapien
gttgtatactatttagcccagcatg

SEQ ID NO: 415421 - DNA, 25 bp, Homo sapien
tagcccagcatgaagccatcgccga

SEQ ID NO: 415422 - DNA, 25 bp, Homo sapien
gccatcgccgactgtaaggagtgat

SEQ ID NO: 415423 - DNA, 25 bp, Homo sapien
tttctcctaaggctgtctcccctgt

SEQ ID NO: 415424 - DNA, 25 bp, Homo sapien
gaagtgtttacttggtttgtgaggc

SEQ ID NO: 415425 - DNA, 25 bp, Homo sapien
ctctaaagggtaacagtctgacaag

SEQ ID NO: 415426 - DNA, 25 bp, Homo sapien
aacatttcaaagagccctgaccagg

SEQ ID NO: 415427 - DNA, 25 bp, Homo sapien
accaggcctggcttggtaactcact

SEQ ID NO: 415428 - DNA, 25 bp, Homo sapien
cctgggttctggaaagactcattgt

SEQ ID NO: 415429 - DNA, 25 bp, Homo sapien
aaagactcattgtccttcagggaag

SEQ ID NO: 415430 - DNA, 25 bp, Homo sapien
tcactgccattgctgagccttttct

SEQ ID NO: 415431 - DNA, 25 bp, Homo sapien
ggtcatgttacctgtcagtactcaa

SEQ ID NO: 415432 - DNA, 25 bp, Homo sapien
acctgtcagtactcaatcatcatgt

SEQ ID NO: 415433 - DNA, 25 bp, Homo sapien
caatggattatttcatcacaatgtt

SEQ ID NO: 415434 - DNA, 25 bp, Homo sapien
aatgttaagtgcaaggtgtcggtac

SEQ ID NO: 415435 - DNA, 25 bp, Homo sapien
gtgtcggtacagcaagataatccta

SEQ ID NO: 415436 - DNA, 25 bp, Homo sapien
cctagatatttatttgaccttggaa

SEQ ID NO: 415437 - DNA, 25 bp, Homo sapien
tgaccttggaatgccgttaggcata

SEQ ID NO: 415438 - DNA, 25 bp, Homo sapien
aagcaatcgggagtcttcacttctt

SEQ ID NO: 415439 - DNA, 25 bp, Homo sapien
ggagtcttcacttcttaatctgtct

SEQ ID NO: 415440 - DNA, 25 bp, Homo sapien
tctgtctctgacattgttagctaat

SEQ ID NO: 415441 - DNA, 25 bp, Homo sapien
gttagctaatgtcaagtgacttctt

SEQ ID NO: 415442 - DNA, 25 bp, Homo sapien
aaatgagcaattgtagagcaggtga

SEQ ID NO: 415443 - DNA, 25 bp, Homo sapien
ttgtagagcaggtgaaaacgctggc

SEQ ID NO: 415444 - DNA, 25 bp, Homo sapien
agcaagaaaggacagtggacaccct

SEQ ID NO: 415445 - DNA, 25 bp, Homo sapien
agcaccccgtggctcattgctgcag

SEQ ID NO: 415446 - DNA, 25 bp, Homo sapien
gtggctcattgctgcagtcagctgg

SEQ ID NO: 415447 - DNA, 25 bp, Homo sapien
ggttgcagagccaggtcatctcgga

SEQ ID NO: 415448 - DNA, 25 bp, Homo sapien
tgcagagccaggtcatctcggagct

SEQ ID NO: 415449 - DNA, 25 bp, Homo sapien
caggtcatctcggagctggatgctt

SEQ ID NO: 415450 - DNA, 25 bp, Homo sapien
tcatctcggagctggatgcttgtaa

SEQ ID NO: 415451 - DNA, 25 bp, Homo sapien
gatgcttgtaaggaatgcacgcagg

SEQ ID NO: 415452 - DNA, 25 bp, Homo sapien
gggtccagagggaggtctccatggt

SEQ ID NO: 415453 - DNA, 25 bp, Homo sapien
atttatggagtatggtttgagagga

SEQ ID NO: 415454 - DNA, 25 bp, Homo sapien
gggcaaattgggactttttatatct

SEQ ID NO: 415455 - DNA, 25 bp, Homo sapien
gcaaattgggactttttatatctct

SEQ ID NO: 415456 - DNA, 25 bp, Homo sapien
atttaaataaagacttgttggctgg

SEQ ID NO: 415457 - DNA, 25 bp, Homo sapien
tgagatgagtatttccctgttgtca

SEQ ID NO: 415458 - DNA, 25 bp, Homo sapien
gagtatttccctgttgtcataaccc

SEQ ID NO: 415459 - DNA, 25 bp, Homo sapien
tatttccctgttgtcataacccctt

SEQ ID NO: 415460 - DNA, 25 bp, Homo sapien
ttccctgttgtcataaccccttagg

SEQ ID NO: 415461 - DNA, 25 bp, Homo sapien
cctgttgtcataaccccttagggtg

SEQ ID NO: 415462 - DNA, 25 bp, Homo sapien
ttgtcataaccccttagggtgagga

SEQ ID NO: 415463 - DNA, 25 bp, Homo sapien
ccttagggtgaggagtgtatccttg

SEQ ID NO: 415464 - DNA, 25 bp, Homo sapien
agcagattccattcattcgcttcag

SEQ ID NO: 415465 - DNA, 25 bp, Homo sapien
cattcgcttcagctggagactaaga

SEQ ID NO: 415466 - DNA, 25 bp, Homo sapien
gagagggcaagtatttcctgccata

SEQ ID NO: 415467 - DNA, 25 bp, Homo sapien
tttcctgccatatatcagacagtga

SEQ ID NO: 415468 - DNA, 25 bp, Homo sapien
gatgaattataatggcacacacaaa

SEQ ID NO: 415469 - DNA, 25 bp, Homo sapien
acacacaaagcacaagctgccttga

SEQ ID NO: 415470 - DNA, 25 bp, Homo sapien
gcacaagctgccttgattcaacaaa

SEQ ID NO: 415471 - DNA, 25 bp, Homo sapien
acagaagccgctctgatcagtgagg

SEQ ID NO: 415472 - DNA, 25 bp, Homo sapien
agttatgtatttgctctgatttcag

SEQ ID NO: 415473 - DNA, 25 bp, Homo sapien
ctctgatttcagacactccgaatgt

SEQ ID NO: 415474 - DNA, 25 bp, Homo sapien
gacactccgaatgtatttgttctgt

SEQ ID NO: 415475 - DNA, 25 bp, Homo sapien
aaatgtcagagcaaccttttatcta

SEQ ID NO: 415476 - DNA, 25 bp, Homo sapien
cagagcaaccttttatctagacgtt

SEQ ID NO: 415477 - DNA, 25 bp, Homo sapien
tcttatctacgctacaactgtcatc

SEQ ID NO: 415478 - DNA, 25 bp, Homo sapien
tctacgctacaactgtcatcttgtg

SEQ ID NO: 415479 - DNA, 25 bp, Homo sapien
gtcatcttgtgagggacatgggaaa

SEQ ID NO: 415480 - DNA, 25 bp, Homo sapien
ggaggacctttgttagtgtctctct

SEQ ID NO: 415481 - DNA, 25 bp, Homo sapien
gttagtgtctctctggtgatataat

SEQ ID NO: 415482 - DNA, 25 bp, Homo sapien
ctaggcatggtaaagatcctgtctt

SEQ ID NO: 415483 - DNA, 25 bp, Homo sapien
tgcttcagcccacccaaagagttgg

SEQ ID NO: 415484 - DNA, 25 bp, Homo sapien
atgagacaccatgcttggccgaaaa

SEQ ID NO: 415485 - DNA, 25 bp, Homo sapien
gcttggccgaaaatcattattaatt

SEQ ID NO: 415486 - DNA, 25 bp, Homo sapien
aaaaaagtgccagcgtatgaggtaa

SEQ ID NO: 415487 - DNA, 25 bp, Homo sapien
aaaagtgccagcgtatgaggtaatt

SEQ ID NO: 415488 - DNA, 25 bp, Homo sapien
aaagtgccagcgtatgaggtaatta

SEQ ID NO: 415489 - DNA, 25 bp, Homo sapien
aagtgccagcgtatgaggtaattag

SEQ ID NO: 415490 - DNA, 25 bp, Homo sapien
agtgccagcgtatgaggtaattaga

SEQ ID NO: 415491 - DNA, 25 bp, Homo sapien
gtgccagcgtatgaggtaattagat

SEQ ID NO: 415492 - DNA, 25 bp, Homo sapien
gccagcgtatgaggtaattagattg

SEQ ID NO: 415493 - DNA, 25 bp, Homo sapien
gcgtatgaggtaattagattggttc

SEQ ID NO: 415494 - DNA, 25 bp, Homo sapien
tccagaggtaacctgccaagaagag

SEQ ID NO: 415495 - DNA, 25 bp, Homo sapien
cagaggtaacctgccaagaagagat

SEQ ID NO: 415496 - DNA, 25 bp, Homo sapien
gaggtaacctgccaagaagagatgc

SEQ ID NO: 415497 - DNA, 25 bp, Homo sapien
ggtaccttagacctcctgaattaga

SEQ ID NO: 415498 - DNA, 25 bp, Homo sapien
cttagacctcctgaattagaaactc

SEQ ID NO: 415499 - DNA, 25 bp, Homo sapien
tgttttaaacaagccctccaagtgg

SEQ ID NO: 415500 - DNA, 25 bp, Homo sapien
aagccctccaagtggtttcaatgca

SEQ ID NO: 415501 - DNA, 25 bp, Homo sapien
gtggtttcaatgcacattcaaagtt

SEQ ID NO: 415502 - DNA, 25 bp, Homo sapien
agttgagaaccaatcactgatagag

SEQ ID NO: 415503 - DNA, 25 bp, Homo sapien
gcagcttgggtagaaacagttgatt

SEQ ID NO: 415504 - DNA, 25 bp, Homo sapien
gtaagctctttataattcaacaatg

SEQ ID NO: 415505 - DNA, 25 bp, Homo sapien
aacaatgtgatctttactcctaccc

SEQ ID NO: 415506 - DNA, 25 bp, Homo sapien
tttagtgtgtggtagctggatcgaa

SEQ ID NO: 415507 - DNA, 25 bp, Homo sapien
gtggtagctggatcgaaaacataat

SEQ ID NO: 415508 - DNA, 25 bp, Homo sapien
gcacccggcctgaatcatggttttt

SEQ ID NO: 415509 - DNA, 25 bp, Homo sapien
acccggcctgaatcatggttttttg

SEQ ID NO: 415510 - DNA, 25 bp, Homo sapien
cccggcctgaatcatggttttttga

SEQ ID NO: 415511 - DNA, 25 bp, Homo sapien
ggttttttgaaaccattggcatctg

SEQ ID NO: 415512 - DNA, 25 bp, Homo sapien
ttttttgaaaccattggcatctgaa

SEQ ID NO: 415513 - DNA, 25 bp, Homo sapien
attggcatctgaacctgtagctctc

SEQ ID NO: 415514 - DNA, 25 bp, Homo sapien
ttggcatctgaacctgtagctctct

SEQ ID NO: 415515 - DNA, 25 bp, Homo sapien
tggcatctgaacctgtagctctctc

SEQ ID NO: 415516 - DNA, 25 bp, Homo sapien
gcatctgaacctgtagctctctctg

SEQ ID NO: 415517 - DNA, 25 bp, Homo sapien
atctgaacctgtagctctctctggt

SEQ ID NO: 415518 - DNA, 25 bp, Homo sapien
ctgaacctgtagctctctctggtag

SEQ ID NO: 415519 - DNA, 25 bp, Homo sapien
agtcagttacagattacctaatggc

SEQ ID NO: 415520 - DNA, 25 bp, Homo sapien
agaggccctggaagaagtaagacat

SEQ ID NO: 415521 - DNA, 25 bp, Homo sapien
agacatacttgctttgttaatctat

SEQ ID NO: 415522 - DNA, 25 bp, Homo sapien
atctattttctgtgcttatttcttg

SEQ ID NO: 415523 - DNA, 25 bp, Homo sapien
gaaagcctcttaagattcagtgcaa

SEQ ID NO: 415524 - DNA, 25 bp, Homo sapien
tcacatttttagtcagtagaacacc

SEQ ID NO: 415525 - DNA, 25 bp, Homo sapien
gtagaacacctgaaacacaacccca

SEQ ID NO: 415526 - DNA, 25 bp, Homo sapien
aggactcagataaccgaagcccaaa

SEQ ID NO: 415527 - DNA, 25 bp, Homo sapien
aagcccaaacctaggcatttaatgc

SEQ ID NO: 415528 - DNA, 25 bp, Homo sapien
aatgcatttcacacatctggtttgt

SEQ ID NO: 415529 - DNA, 25 bp, Homo sapien
acatctggtttgtggctcagttcca

SEQ ID NO: 415530 - DNA, 25 bp, Homo sapien
tcttttttgggcagacggggcaaca

SEQ ID NO: 415531 - DNA, 25 bp, Homo sapien
ggcagacggggcaacaagtaatata

SEQ ID NO: 415532 - DNA, 25 bp, Homo sapien
gggcaacaagtaatatatactagta

SEQ ID NO: 415533 - DNA, 25 bp, Homo sapien
actagtaataagataatacacgtta

SEQ ID NO: 415534 - DNA, 25 bp, Homo sapien
gataatacacgttaaaaacagcctg

SEQ ID NO: 415535 - DNA, 25 bp, Homo sapien
ataatacacgttaaaaacagcctgt

SEQ ID NO: 415536 - DNA, 25 bp, Homo sapien
taatacacgttaaaaacagcctgta

SEQ ID NO: 415537 - DNA, 25 bp, Homo sapien
tacacgttaaaaacagcctgtaatc

SEQ ID NO: 415538 - DNA, 25 bp, Homo sapien
gctgcatttagtggtgatggtgcca

SEQ ID NO: 415539 - DNA, 25 bp, Homo sapien
tagtggtgatggtgccacagtcctc

SEQ ID NO: 415540 - DNA, 25 bp, Homo sapien
gtgatggtgccacagtcctctggcc

SEQ ID NO: 415541 - DNA, 25 bp, Homo sapien
aatcattagtaagctattgccataa

SEQ ID NO: 415542 - DNA, 25 bp, Homo sapien
gctattgccataatctaggctgaag

SEQ ID NO: 415543 - DNA, 25 bp, Homo sapien
ggctgaagataacatcatgaactaa

SEQ ID NO: 415544 - DNA, 25 bp, Homo sapien
agatcttacttgataactatcttga

SEQ ID NO: 415545 - DNA, 25 bp, Homo sapien
cttgataactatcttgattctgaga

SEQ ID NO: 415546 - DNA, 25 bp, Homo sapien
atgagatcctggtttatggctttca

SEQ ID NO: 415547 - DNA, 25 bp, Homo sapien
gatcctggtttatggctttcagtta

SEQ ID NO: 415548 - DNA, 25 bp, Homo sapien
ggctttcagttatggcttgctatta

SEQ ID NO: 415549 - DNA, 25 bp, Homo sapien
gagacaagtttcagttttggacgca

SEQ ID NO: 415550 - DNA, 25 bp, Homo sapien
gtttcagttttggacgcatgacatg

SEQ ID NO: 415551 - DNA, 25 bp, Homo sapien
gacgcatgacatgagatatccaagt

SEQ ID NO: 415552 - DNA, 25 bp, Homo sapien
attcttttttctggatgaagcctgg

SEQ ID NO: 415553 - DNA, 25 bp, Homo sapien
ttcttttttctggatgaagcctggc

SEQ ID NO: 415554 - DNA, 25 bp, Homo sapien
tcttttttctggatgaagcctggct

SEQ ID NO: 415555 - DNA, 25 bp, Homo sapien
cttttttctggatgaagcctggctt

SEQ ID NO: 415556 - DNA, 25 bp, Homo sapien
ttttttctggatgaagcctggcttg

SEQ ID NO: 415557 - DNA, 25 bp, Homo sapien
tttttctggatgaagcctggcttga

SEQ ID NO: 415558 - DNA, 25 bp, Homo sapien
ttttctggatgaagcctggcttgaa

SEQ ID NO: 415559 - DNA, 25 bp, Homo sapien
tttctggatgaagcctggcttgaaa

SEQ ID NO: 415560 - DNA, 25 bp, Homo sapien
ttctggatgaagcctggcttgaaaa

SEQ ID NO: 415561 - DNA, 25 bp, Homo sapien
tctggatgaagcctggcttgaaaaa

SEQ ID NO: 415562 - DNA, 25 bp, Homo sapien
aaattaggcatggtagcaggcgcct

SEQ ID NO: 415563 - DNA, 25 bp, Homo sapien
ccaagcagctggctctattcattta

SEQ ID NO: 415564 - DNA, 25 bp, Homo sapien
gctggctctattcatttagcagaac

SEQ ID NO: 415565 - DNA, 25 bp, Homo sapien
ttcatttagcagaaccgctgcccca

SEQ ID NO: 415566 - DNA, 25 bp, Homo sapien
ccaacttctattttgttttcgccag

SEQ ID NO: 415567 - DNA, 25 bp, Homo sapien
tctattttgttttcgccagagccgc

SEQ ID NO: 415568 - DNA, 25 bp, Homo sapien
tccctcttcacattttatgtcaact

SEQ ID NO: 415569 - DNA, 25 bp, Homo sapien
ccctgctggctgaaagtgagttctg

SEQ ID NO: 415570 - DNA, 25 bp, Homo sapien
aagtgagttctgttttccggcagcc

SEQ ID NO: 415571 - DNA, 25 bp, Homo sapien
tgttttccggcagccctgtggcttt

SEQ ID NO: 415572 - DNA, 25 bp, Homo sapien
gtggcttttggactcggccttgaaa

SEQ ID NO: 415573 - DNA, 25 bp, Homo sapien
ggactcggccttgaaattagttcat

SEQ ID NO: 415574 - DNA, 25 bp, Homo sapien
gcccagggcaacagtcagtggtgac

SEQ ID NO: 415575 - DNA, 25 bp, Homo sapien
ggtgactcagggtttggtgtttcca

SEQ ID NO: 415576 - DNA, 25 bp, Homo sapien
actcagggtttggtgtttccacact

SEQ ID NO: 415577 - DNA, 25 bp, Homo sapien
tttggtgtttccacactccacaggg

SEQ ID NO: 415578 - DNA, 25 bp, Homo sapien
tgtgctccgtgccactcaagatgaa

SEQ ID NO: 415579 - DNA, 25 bp, Homo sapien
gctccgtgccactcaagatgaagca

SEQ ID NO: 415580 - DNA, 25 bp, Homo sapien
gatgaagcaagtgccacaacacctg

SEQ ID NO: 415581 - DNA, 25 bp, Homo sapien
aagcaagtgccacaacacctgtgct

SEQ ID NO: 415582 - DNA, 25 bp, Homo sapien
gagcaaataagccaagtgtgacaac

SEQ ID NO: 415583 - DNA, 25 bp, Homo sapien
tgacaacaagcatgacacactggtg

SEQ ID NO: 415584 - DNA, 25 bp, Homo sapien
atgacacactggtgtccctgcccag

SEQ ID NO: 415585 - DNA, 25 bp, Homo sapien
cctttctgatgtcctaatctaaaac

SEQ ID NO: 415586 - DNA, 25 bp, Homo sapien
taatctaaaacatccagtactcctg

SEQ ID NO: 415587 - DNA, 25 bp, Homo sapien
aaacatccagtactcctggaggatt

SEQ ID NO: 415588 - DNA, 25 bp, Homo sapien
actcctggaggatttgaacttgtgc

SEQ ID NO: 415589 - DNA, 25 bp, Homo sapien
ggaggatttgaacttgtgcccaatg

SEQ ID NO: 415590 - DNA, 25 bp, Homo sapien
gatttgaacttgtgcccaatggctg

SEQ ID NO: 415591 - DNA, 25 bp, Homo sapien
aacttgtgcccaatggctggtcaga

SEQ ID NO: 415592 - DNA, 25 bp, Homo sapien
tgtgcccaatggctggtcagactct

SEQ ID NO: 415593 - DNA, 25 bp, Homo sapien
ggtcagactctcttggattgagaat

SEQ ID NO: 415594 - DNA, 25 bp, Homo sapien
gaatgttggattgccattcctcaga

SEQ ID NO: 415595 - DNA, 25 bp, Homo sapien
acaggggtatcttgattccttctga

SEQ ID NO: 415596 - DNA, 25 bp, Homo sapien
gaaacatgaattgagaagacgattt

SEQ ID NO: 415597 - DNA, 25 bp, Homo sapien
acatgaattgagaagacgatttgag

SEQ ID NO: 415598 - DNA, 25 bp, Homo sapien
gaattgagaagacgatttgagaacc

SEQ ID NO: 415599 - DNA, 25 bp, Homo sapien
aattgagaagacgatttgagaaccg

SEQ ID NO: 415600 - DNA, 25 bp, Homo sapien
attgagaagacgatttgagaaccga

SEQ ID NO: 415601 - DNA, 25 bp, Homo sapien
ttgagaagacgatttgagaaccgag

SEQ ID NO: 415602 - DNA, 25 bp, Homo sapien
tgagaagacgatttgagaaccgaga

SEQ ID NO: 415603 - DNA, 25 bp, Homo sapien
gagaagacgatttgagaaccgagaa

SEQ ID NO: 415604 - DNA, 25 bp, Homo sapien
agaagacgatttgagaaccgagaag

SEQ ID NO: 415605 - DNA, 25 bp, Homo sapien
aagacgatttgagaaccgagaaggg

SEQ ID NO: 415606 - DNA, 25 bp, Homo sapien
tgggaaggccgagtgtcagagctgg

SEQ ID NO: 415607 - DNA, 25 bp, Homo sapien
aatgtgcctttaactctagggacct

SEQ ID NO: 415608 - DNA, 25 bp, Homo sapien
taactctagggacctgcctcacgga

SEQ ID NO: 415609 - DNA, 25 bp, Homo sapien
ggacctgcctcacggaccttaggga

SEQ ID NO: 415610 - DNA, 25 bp, Homo sapien
aacctcaacctgaaagatctcttcc

SEQ ID NO: 415611 - DNA, 25 bp, Homo sapien
aaagatctcttcctttctggagctc

SEQ ID NO: 415612 - DNA, 25 bp, Homo sapien
tctcttcctttctggagctccttta

SEQ ID NO: 415613 - DNA, 25 bp, Homo sapien
ttaatcttcccagcaggtttttgcc

SEQ ID NO: 415614 - DNA, 25 bp, Homo sapien
aggtttttgccttagacgtgctggc

SEQ ID NO: 415615 - DNA, 25 bp, Homo sapien
gtccctgttattgagggattatccc

SEQ ID NO: 415616 - DNA, 25 bp, Homo sapien
agggattatcccttagccaacattc

SEQ ID NO: 415617 - DNA, 25 bp, Homo sapien
agccaacattcctatctgtgggtgg

SEQ ID NO: 415618 - DNA, 25 bp, Homo sapien
ggcgtggcactaggagtgcacatct

SEQ ID NO: 415619 - DNA, 25 bp, Homo sapien
gtgcacatctgtgagcatgacaagc

SEQ ID NO: 415620 - DNA, 25 bp, Homo sapien
tgagcatgacaagcttatcctccca

SEQ ID NO: 415621 - DNA, 25 bp, Homo sapien
caagcttatcctcccatggtaacag

SEQ ID NO: 415622 - DNA, 25 bp, Homo sapien
gctgaggctgattctggacgctgtc

SEQ ID NO: 415623 - DNA, 25 bp, Homo sapien
gattctggacgctgtcctttcagca

SEQ ID NO: 415624 - DNA, 25 bp, Homo sapien
gtcctttcagcacacgcagagcaaa

SEQ ID NO: 415625 - DNA, 25 bp, Homo sapien
gagcaaagatcgttggaagccccag

SEQ ID NO: 415626 - DNA, 25 bp, Homo sapien
aagatcgttggaagccccagtgtgg

SEQ ID NO: 415627 - DNA, 25 bp, Homo sapien
ttctaaggagtgactcctgtcccgg

SEQ ID NO: 415628 - DNA, 25 bp, Homo sapien
gggcagtgtaataaagtgtctttct

SEQ ID NO: 415629 - DNA, 25 bp, Homo sapien
tgcccatttcattgcacgctttcta

SEQ ID NO: 415630 - DNA, 25 bp, Homo sapien
ccatttcattgcacgctttctaaca

SEQ ID NO: 415631 - DNA, 25 bp, Homo sapien
tcattgcacgctttctaacatttat

SEQ ID NO: 415632 - DNA, 25 bp, Homo sapien
tgcacgctttctaacatttatacca

SEQ ID NO: 415633 - DNA, 25 bp, Homo sapien
gaagaggttaggcaagtttctagaa

SEQ ID NO: 415634 - DNA, 25 bp, Homo sapien
gcaagtttctagaatgccagactgc

SEQ ID NO: 415635 - DNA, 25 bp, Homo sapien
agtttctagaatgccagactgcttt

SEQ ID NO: 415636 - DNA, 25 bp, Homo sapien
tttctagaatgccagactgctttct

SEQ ID NO: 415637 - DNA, 25 bp, Homo sapien
agaatgccagactgctttctagaaa

SEQ ID NO: 415638 - DNA, 25 bp, Homo sapien
aatgccagactgctttctagaaagt

SEQ ID NO: 415639 - DNA, 25 bp, Homo sapien
gccagactgctttctagaaagtcaa

SEQ ID NO: 415640 - DNA, 25 bp, Homo sapien
ttaacaataaaatgaccagcaagta

SEQ ID NO: 415641 - DNA, 25 bp, Homo sapien
caataaaatgaccagcaagtaaact

SEQ ID NO: 415642 - DNA, 25 bp, Homo sapien
aataaaatgaccagcaagtaaactt

SEQ ID NO: 415643 - DNA, 25 bp, Homo sapien
ataaaatgaccagcaagtaaacttg

SEQ ID NO: 415644 - DNA, 25 bp, Homo sapien
taaaatgaccagcaagtaaacttga

SEQ ID NO: 415645 - DNA, 25 bp, Homo sapien
aaaatgaccagcaagtaaacttgaa

SEQ ID NO: 415646 - DNA, 25 bp, Homo sapien
aatgaccagcaagtaaacttgaaac

SEQ ID NO: 415647 - DNA, 25 bp, Homo sapien
aatacttgtatatattgtttacaac

SEQ ID NO: 415648 - DNA, 25 bp, Homo sapien
acttgtatatattgtttacaacttg

SEQ ID NO: 415649 - DNA, 25 bp, Homo sapien
ttgtatatattgtttacaacttgtt

SEQ ID NO: 415650 - DNA, 25 bp, Homo sapien
caacttgttttaaagtatgaataca

SEQ ID NO: 415651 - DNA, 25 bp, Homo sapien
caggaacggaaattacgacggtgtg

SEQ ID NO: 415652 - DNA, 25 bp, Homo sapien
tacgacggtgtggttccttaaggat

SEQ ID NO: 415653 - DNA, 25 bp, Homo sapien
tggttccttaaggatttggccccag

SEQ ID NO: 415654 - DNA, 25 bp, Homo sapien
gggccaatattcaaacgctgcagca

SEQ ID NO: 415655 - DNA, 25 bp, Homo sapien
aatcatatttaggtagacttcgctt

SEQ ID NO: 415656 - DNA, 25 bp, Homo sapien
ggtagacttcgcttgaaaagatcga

SEQ ID NO: 415657 - DNA, 25 bp, Homo sapien
acttgcagacatcaacagtttccag

SEQ ID NO: 415658 - DNA, 25 bp, Homo sapien
aattcggttcaattccttcaccacg

SEQ ID NO: 415659 - DNA, 25 bp, Homo sapien
agcagaggcgcatagcctagccctg

SEQ ID NO: 415660 - DNA, 25 bp, Homo sapien
gaggcgcatagcctagccctggcca

SEQ ID NO: 415661 - DNA, 25 bp, Homo sapien
ttaagccggtgtggagggtccaaca

SEQ ID NO: 415662 - DNA, 25 bp, Homo sapien
acaaatggtctgtgtatagttttca

SEQ ID NO: 415663 - DNA, 25 bp, Homo sapien
atggtctgtgtatagttttcattat

SEQ ID NO: 415664 - DNA, 25 bp, Homo sapien
gttttcattatatatctaccaccac

SEQ ID NO: 415665 - DNA, 25 bp, Homo sapien
ttatatatctaccaccacagataag

SEQ ID NO: 415666 - DNA, 25 bp, Homo sapien
tgcactgccccattcagagggtctt

SEQ ID NO: 415667 - DNA, 25 bp, Homo sapien
tgccccattcagagggtctttcaaa

SEQ ID NO: 415668 - DNA, 25 bp, Homo sapien
cccattcagagggtctttcaaaatc

SEQ ID NO: 415669 - DNA, 25 bp, Homo sapien
ttcagagggtctttcaaaatcattg

SEQ ID NO: 415670 - DNA, 25 bp, Homo sapien
gggtctttcaaaatcattgaacagg

SEQ ID NO: 415671 - DNA, 25 bp, Homo sapien
attgaacaggttccaagtttgcaat

SEQ ID NO: 415672 - DNA, 25 bp, Homo sapien
actagtggggtacttgacattgttt

SEQ ID NO: 415673 - DNA, 25 bp, Homo sapien
acagtaacatgtggctctcagaagg

SEQ ID NO: 415674 - DNA, 25 bp, Homo sapien
tgtggctctcagaaggtggcatccc

SEQ ID NO: 415675 - DNA, 25 bp, Homo sapien
ctggtgcacccaaagaggagcccga

SEQ ID NO: 415676 - DNA, 25 bp, Homo sapien
aagaggagcccgacattttctcagc

SEQ ID NO: 415677 - DNA, 25 bp, Homo sapien
tgaatcacaggcacattctgctgcg

SEQ ID NO: 415678 - DNA, 25 bp, Homo sapien
gcacattctgctgcggttctgagag

SEQ ID NO: 415679 - DNA, 25 bp, Homo sapien
tgcggttctgagaggcatctggcca

SEQ ID NO: 415680 - DNA, 25 bp, Homo sapien
gcatctggccagtgttatagacttt

SEQ ID NO: 415681 - DNA, 25 bp, Homo sapien
atagacttttcatgtgtcctgttgg

SEQ ID NO: 415682 - DNA, 25 bp, Homo sapien
tttcatgtgtcctgttggttgtgat

SEQ ID NO: 415683 - DNA, 25 bp, Homo sapien
ggcagggttgaagacacagtaacat

SEQ ID NO: 415684 - DNA, 25 bp, Homo sapien
ggtagacttcgcttgaaaagatcga

SEQ ID NO: 415685 - DNA, 25 bp, Homo sapien
gacttcgcttgaaaagatcgagaat

SEQ ID NO: 415686 - DNA, 25 bp, Homo sapien
ctcacttgcagacatcaacagtttc

SEQ ID NO: 415687 - DNA, 25 bp, Homo sapien
acttgcagacatcaacagtttccag

SEQ ID NO: 415688 - DNA, 25 bp, Homo sapien
ttgcagacatcaacagtttccagaa

SEQ ID NO: 415689 - DNA, 25 bp, Homo sapien
gcagacatcaacagtttccagaaaa

SEQ ID NO: 415690 - DNA, 25 bp, Homo sapien
ttccagaaaattcggttcaattcct

SEQ ID NO: 415691 - DNA, 25 bp, Homo sapien
cagaaaattcggttcaattccttca

SEQ ID NO: 415692 - DNA, 25 bp, Homo sapien
aattcggttcaattccttcaccacg

SEQ ID NO: 415693 - DNA, 25 bp, Homo sapien
ttcggttcaattccttcaccacgga

SEQ ID NO: 415694 - DNA, 25 bp, Homo sapien
tcggttcaattccttcaccacggac

SEQ ID NO: 415695 - DNA, 25 bp, Homo sapien
gacactgttttctttggcagccagc

SEQ ID NO: 415696 - DNA, 25 bp, Homo sapien
agccagctggtctaggtcacttgaa

SEQ ID NO: 415697 - DNA, 25 bp, Homo sapien
gtctaggtcacttgaattcctttga

SEQ ID NO: 415698 - DNA, 25 bp, Homo sapien
atacagggagcggtagccactgcct

SEQ ID NO: 415699 - DNA, 25 bp, Homo sapien
gcattccttactcaggaggcaggca

SEQ ID NO: 415700 - DNA, 25 bp, Homo sapien
ggtctgccattgcttacctgccaga

SEQ ID NO: 415701 - DNA, 25 bp, Homo sapien
gccagagaaccaggccttcattaga

SEQ ID NO: 415702 - DNA, 25 bp, Homo sapien
ccaggccttcattagaaaggtcatt

SEQ ID NO: 415703 - DNA, 25 bp, Homo sapien
aagtgggattttgtgctgattcagc

SEQ ID NO: 415704 - DNA, 25 bp, Homo sapien
ttatctctggccagggagtccttgg

SEQ ID NO: 415705 - DNA, 25 bp, Homo sapien
gccagggagtccttggacactgttt

SEQ ID NO: 415706 - DNA, 25 bp, Homo sapien
tagttggctggcatgtttacttgct

SEQ ID NO: 415707 - DNA, 25 bp, Homo sapien
tttacttgctgctgtagccagccaa

SEQ ID NO: 415708 - DNA, 25 bp, Homo sapien
agccagccaagatgagtgcacctag

SEQ ID NO: 415709 - DNA, 25 bp, Homo sapien
tgcacctaggccctcaaaaaggatt

SEQ ID NO: 415710 - DNA, 25 bp, Homo sapien
gttgcctctgagacgaacatccatg

SEQ ID NO: 415711 - DNA, 25 bp, Homo sapien
gagacgaacatccatgctagtataa

SEQ ID NO: 415712 - DNA, 25 bp, Homo sapien
aaaatagttaggaatgcccttggca

SEQ ID NO: 415713 - DNA, 25 bp, Homo sapien
tgcccttggcagaactgaagctctt

SEQ ID NO: 415714 - DNA, 25 bp, Homo sapien
ctgaagctcttattaaatggtggac

SEQ ID NO: 415715 - DNA, 25 bp, Homo sapien
tattaaatggtggacagagctcttg

SEQ ID NO: 415716 - DNA, 25 bp, Homo sapien
agcccctcagtctcggagttatggg

SEQ ID NO: 415717 - DNA, 25 bp, Homo sapien
taaaggtttccttgtgccaaataag

SEQ ID NO: 415718 - DNA, 25 bp, Homo sapien
gtttccttgtgccaaataagtgcaa

SEQ ID NO: 415719 - DNA, 25 bp, Homo sapien
gcatatgttatagttccagaagaat

SEQ ID NO: 415720 - DNA, 25 bp, Homo sapien
aaatgaggacaacaggataatatct

SEQ ID NO: 415721 - DNA, 25 bp, Homo sapien
ggataatatctttgatgacttctga

SEQ ID NO: 415722 - DNA, 25 bp, Homo sapien
gatgacttctgaaagttatgcttcc

SEQ ID NO: 415723 - DNA, 25 bp, Homo sapien
gttatgcttcccttcatgttatatg

SEQ ID NO: 415724 - DNA, 25 bp, Homo sapien
gcttcccttcatgttatatgcacat

SEQ ID NO: 415725 - DNA, 25 bp, Homo sapien
tcatgttatatgcacattgccaaga

SEQ ID NO: 415726 - DNA, 25 bp, Homo sapien
gcacattgccaagaattactgtcaa

SEQ ID NO: 415727 - DNA, 25 bp, Homo sapien
gccaagaattactgtcaagagaaat

SEQ ID NO: 415728 - DNA, 25 bp, Homo sapien
ctgctaccaccattttactacatat

SEQ ID NO: 415729 - DNA, 25 bp, Homo sapien
actacatattagtgttttcagaatg

SEQ ID NO: 415730 - DNA, 25 bp, Homo sapien
gggtgggtcatgaaatccatttaat

SEQ ID NO: 415731 - DNA, 25 bp, Homo sapien
tccatttaatgggtcatgttacaaa

SEQ ID NO: 415732 - DNA, 25 bp, Homo sapien
cagtgatgatggtagaacttgtgca

SEQ ID NO: 415733 - DNA, 25 bp, Homo sapien
gtaggtgtatactgtgttgcaatgt

SEQ ID NO: 415734 - DNA, 25 bp, Homo sapien
tagaacttgtgcatcaggatttcct

SEQ ID NO: 415735 - DNA, 25 bp, Homo sapien
tcaggatttcctgctacaaggccaa

SEQ ID NO: 415736 - DNA, 25 bp, Homo sapien
ttcctgctacaaggccaaaagcctg

SEQ ID NO: 415737 - DNA, 25 bp, Homo sapien
ggccaaaagcctgattgtggaactt

SEQ ID NO: 415738 - DNA, 25 bp, Homo sapien
tttctgctaccaccattttactaca

SEQ ID NO: 415739 - DNA, 25 bp, Homo sapien
agttaaaggtgtgacaggatggcca

SEQ ID NO: 415740 - DNA, 25 bp, Homo sapien
gttaaaggtgtgacaggatggccat

SEQ ID NO: 415741 - DNA, 25 bp, Homo sapien
ttaaaggtgtgacaggatggccatg

SEQ ID NO: 415742 - DNA, 25 bp, Homo sapien
taaaggtgtgacaggatggccatgg

SEQ ID NO: 415743 - DNA, 25 bp, Homo sapien
aaggtgtgacaggatggccatgggc

SEQ ID NO: 415744 - DNA, 25 bp, Homo sapien
aggtgtgacaggatggccatgggcc

SEQ ID NO: 415745 - DNA, 25 bp, Homo sapien
ggtgtgacaggatggccatgggcca

SEQ ID NO: 415746 - DNA, 25 bp, Homo sapien
gtgtgacaggatggccatgggccag

SEQ ID NO: 415747 - DNA, 25 bp, Homo sapien
attatctgggcatagcggcaggtgc

SEQ ID NO: 415748 - DNA, 25 bp, Homo sapien
ttatctgggcatagcggcaggtgcc

SEQ ID NO: 415749 - DNA, 25 bp, Homo sapien
tatctgggcatagcggcaggtgcct

SEQ ID NO: 415750 - DNA, 25 bp, Homo sapien
ggcttcctgggcctacagccaagca

SEQ ID NO: 415751 - DNA, 25 bp, Homo sapien
gctcacccacattctatgactggaa

SEQ ID NO: 415752 - DNA, 25 bp, Homo sapien
tgactggaatgctgcaagcctcttc

SEQ ID NO: 415753 - DNA, 25 bp, Homo sapien
gggaagtcatatccgtggaccattt

SEQ ID NO: 415754 - DNA, 25 bp, Homo sapien
tggaccatttgtaggtttccctctg

SEQ ID NO: 415755 - DNA, 25 bp, Homo sapien
ctgcaaacttcctgaactgggtggt

SEQ ID NO: 415756 - DNA, 25 bp, Homo sapien
acttcctgaactgggtggtgatttt

SEQ ID NO: 415757 - DNA, 25 bp, Homo sapien
ggtgatttttctggcgagttaagtc

SEQ ID NO: 415758 - DNA, 25 bp, Homo sapien
gagttaagtccagcaggttctgcgt

SEQ ID NO: 415759 - DNA, 25 bp, Homo sapien
ggccttccagtgatctggaccagga

SEQ ID NO: 415760 - DNA, 25 bp, Homo sapien
tggaccaggaagacggattgctgct

SEQ ID NO: 415761 - DNA, 25 bp, Homo sapien
gggctgtgaactctttgaagctatg

SEQ ID NO: 415762 - DNA, 25 bp, Homo sapien
gaactctttgaagctatgcaaggta

SEQ ID NO: 415763 - DNA, 25 bp, Homo sapien
tgcaaggtaaggatgggtccacagt

SEQ ID NO: 415764 - DNA, 25 bp, Homo sapien
tcatcattctcaagtctatgaccca

SEQ ID NO: 415765 - DNA, 25 bp, Homo sapien
aagtctatgacccaaatatgttgca

SEQ ID NO: 415766 - DNA, 25 bp, Homo sapien
tgacccaaatatgttgcaagacctg

SEQ ID NO: 415767 - DNA, 25 bp, Homo sapien
atatgttgcaagacctgggaataaa

SEQ ID NO: 415768 - DNA, 25 bp, Homo sapien
gacctgggaataaatctggacaaag

SEQ ID NO: 415769 - DNA, 25 bp, Homo sapien
tctggacaaagaggcaaatgggaaa

SEQ ID NO: 415770 - DNA, 25 bp, Homo sapien
gaagagttcctcagttagttgccct

SEQ ID NO: 415771 - DNA, 25 bp, Homo sapien
gatgggaaagggtggccgtctactt

SEQ ID NO: 415772 - DNA, 25 bp, Homo sapien
gaagtttcattacctgatccatggg

SEQ ID NO: 415773 - DNA, 25 bp, Homo sapien
ggctttgttggttttggcatcacac

SEQ ID NO: 415774 - DNA, 25 bp, Homo sapien
tccattctctggatttgaagatgtc

SEQ ID NO: 415775 - DNA, 25 bp, Homo sapien
agatgtccattggagcctgcagtgc

SEQ ID NO: 415776 - DNA, 25 bp, Homo sapien
ctgcagtgcctggacagggttcaga

SEQ ID NO: 415777 - DNA, 25 bp, Homo sapien
gagcggaaccttttgaagagtgtca

SEQ ID NO: 415778 - DNA, 25 bp, Homo sapien
acagttcagctgttaggaagacaaa

SEQ ID NO: 415779 - DNA, 25 bp, Homo sapien
atggaggagctcattaatccgcttt

SEQ ID NO: 415780 - DNA, 25 bp, Homo sapien
tcattaatccgcttttggctctcag

SEQ ID NO: 415781 - DNA, 25 bp, Homo sapien
tttggctctcagtgccttttgccct

SEQ ID NO: 415782 - DNA, 25 bp, Homo sapien
cttttgcccttttatcacagcctta

SEQ ID NO: 415783 - DNA, 25 bp, Homo sapien
gcctcctttcaccttggagttggat

SEQ ID NO: 415784 - DNA, 25 bp, Homo sapien
gagttggatacaaggcagccctgct

SEQ ID NO: 415785 - DNA, 25 bp, Homo sapien
agggttgctgttacgttttctatca

SEQ ID NO: 415786 - DNA, 25 bp, Homo sapien
acgttttctatcagtatccatcatg

SEQ ID NO: 415787 - DNA, 25 bp, Homo sapien
ctatcagtatccatcatgaagcctg

SEQ ID NO: 415788 - DNA, 25 bp, Homo sapien
atgaagcctggcagaattccctcca

SEQ ID NO: 415789 - DNA, 25 bp, Homo sapien
aattccctccacaagtgtttgctgg

SEQ ID NO: 415790 - DNA, 25 bp, Homo sapien
gaatagcaagctaccctcgatcggg

SEQ ID NO: 415791 - DNA, 25 bp, Homo sapien
gtggctagaactggaacatggcaat

SEQ ID NO: 415792 - DNA, 25 bp, Homo sapien
atggcaatgaagtccattcactcaa

SEQ ID NO: 415793 - DNA, 25 bp, Homo sapien
gaagtccattcactcaacgtgtatt

SEQ ID NO: 415794 - DNA, 25 bp, Homo sapien
aataggattactacttctacttaag

SEQ ID NO: 415795 - DNA, 25 bp, Homo sapien
gattcctcactcttactgaggcaag

SEQ ID NO: 415796 - DNA, 25 bp, Homo sapien
gaaaagatgctttttattctgcaca

SEQ ID NO: 415797 - DNA, 25 bp, Homo sapien
gctttttattctgcacatatactgt

SEQ ID NO: 415798 - DNA, 25 bp, Homo sapien
ttttgtatcacaacgcagttcattt

SEQ ID NO: 415799 - DNA, 25 bp, Homo sapien
cacaacgcagttcattttaatgtta

SEQ ID NO: 415800 - DNA, 25 bp, Homo sapien
cactcttactgaggcaaggtaactt

SEQ ID NO: 415801 - DNA, 25 bp, Homo sapien
atgaatatccattgtttttcctgat

SEQ ID NO: 415802 - DNA, 25 bp, Homo sapien
aaaactgtaggctcattttggtgaa

SEQ ID NO: 415803 - DNA, 25 bp, Homo sapien
gcaaggtaactttgtcagatggtga

SEQ ID NO: 415804 - DNA, 25 bp, Homo sapien
gatggtgagtgttattttttcgttt

SEQ ID NO: 415805 - DNA, 25 bp, Homo sapien
ctggatttggtgctggaaccagctc

SEQ ID NO: 415806 - DNA, 25 bp, Homo sapien
tctctcctaatattccacgtttgtg

SEQ ID NO: 415807 - DNA, 25 bp, Homo sapien
gtttgtgccccacactaacgtgtgt

SEQ ID NO: 415808 - DNA, 25 bp, Homo sapien
aacgtgtgtgtcttacattgccaag

SEQ ID NO: 415809 - DNA, 25 bp, Homo sapien
cagatggtacggacttcctttagga

SEQ ID NO: 415810 - DNA, 25 bp, Homo sapien
tcctttaggatctcaggcttctgca

SEQ ID NO: 415811 - DNA, 25 bp, Homo sapien
gcttctgcagttctcatgactccta

SEQ ID NO: 415812 - DNA, 25 bp, Homo sapien
atgactcctacttttcatcctagtc

SEQ ID NO: 415813 - DNA, 25 bp, Homo sapien
atcctagtctagcattctgcaacat

SEQ ID NO: 415814 - DNA, 25 bp, Homo sapien
tgcataataactacttccatccctg

SEQ ID NO: 415815 - DNA, 25 bp, Homo sapien
ataaagtgttgccaccatacctcct

SEQ ID NO: 415816 - DNA, 25 bp, Homo sapien
ccagaatcattatgtttggttcatg

SEQ ID NO: 415817 - DNA, 25 bp, Homo sapien
tcattatgtttggttcatggaacgg

SEQ ID NO: 415818 - DNA, 25 bp, Homo sapien
gtgcagggtcgagactgtcgtggcg

SEQ ID NO: 415819 - DNA, 25 bp, Homo sapien
tgtcgtggcggaagccgcagcaccc

SEQ ID NO: 415820 - DNA, 25 bp, Homo sapien
ggaagccgcagcacccgggaggcag

SEQ ID NO: 415821 - DNA, 25 bp, Homo sapien
ctgcctcagcccttgggtcctgaga

SEQ ID NO: 415822 - DNA, 25 bp, Homo sapien
cttgggtcctgagagtcgcgtttct

SEQ ID NO: 415823 - DNA, 25 bp, Homo sapien
gggtcctgagagtcgcgtttcttct

SEQ ID NO: 415824 - DNA, 25 bp, Homo sapien
tgagagtcgcgtttcttctcccctt

SEQ ID NO: 415825 - DNA, 25 bp, Homo sapien
ttctccccttcgcttaaatatgtaa

SEQ ID NO: 415826 - DNA, 25 bp, Homo sapien
ccttcgcttaaatatgtaaaccaga

SEQ ID NO: 415827 - DNA, 25 bp, Homo sapien
gcaaaacatggctaccttgcctgcg

SEQ ID NO: 415828 - DNA, 25 bp, Homo sapien
aaaacatggctaccttgcctgcgga

SEQ ID NO: 415829 - DNA, 25 bp, Homo sapien
aaacatggctaccttgcctgcggag

SEQ ID NO: 415830 - DNA, 25 bp, Homo sapien
aggaagcgcgccagctcttgcagac

SEQ ID NO: 415831 - DNA, 25 bp, Homo sapien
gaagcgcgccagctcttgcagactt

SEQ ID NO: 415832 - DNA, 25 bp, Homo sapien
agcgcgccagctcttgcagactttg

SEQ ID NO: 415833 - DNA, 25 bp, Homo sapien
gcgccagctcttgcagactttgcag

SEQ ID NO: 415834 - DNA, 25 bp, Homo sapien
gccagctcttgcagactttgcaggc

SEQ ID NO: 415835 - DNA, 25 bp, Homo sapien
agctcttgcagactttgcaggcggc

SEQ ID NO: 415836 - DNA, 25 bp, Homo sapien
tcttgcagactttgcaggcggccga

SEQ ID NO: 415837 - DNA, 25 bp, Homo sapien
cttgcagactttgcaggcggccgag

SEQ ID NO: 415838 - DNA, 25 bp, Homo sapien
ctgagccctgggttagtaggttaat

SEQ ID NO: 415839 - DNA, 25 bp, Homo sapien
catcaaaatcaaccctaaccacatg

SEQ ID NO: 415840 - DNA, 25 bp, Homo sapien
taaccacatggaccctgaccaaaag

SEQ ID NO: 415841 - DNA, 25 bp, Homo sapien
gaccctgaccaaaagcatgttgctt

SEQ ID NO: 415842 - DNA, 25 bp, Homo sapien
catgttgcttccctatttattggct

SEQ ID NO: 415843 - DNA, 25 bp, Homo sapien
ttgcttccctatttattggctgtgg

SEQ ID NO: 415844 - DNA, 25 bp, Homo sapien
ctgcaaatatttcagctcccctgaa

SEQ ID NO: 415845 - DNA, 25 bp, Homo sapien
tcagctcccctgaaaatggacccta

SEQ ID NO: 415846 - DNA, 25 bp, Homo sapien
gaaaatggaccctacttgtcctaga

SEQ ID NO: 415847 - DNA, 25 bp, Homo sapien
ggaccctacttgtcctagacagaaa

SEQ ID NO: 415848 - DNA, 25 bp, Homo sapien
ggttaatcacaccatgcaacactgc

SEQ ID NO: 415849 - DNA, 25 bp, Homo sapien
aggcattatgctcatatcactttga

SEQ ID NO: 415850 - DNA, 25 bp, Homo sapien
ggtagaccacagtctgacggactta

SEQ ID NO: 415851 - DNA, 25 bp, Homo sapien
acattctgaatcgtgagggctccct

SEQ ID NO: 415852 - DNA, 25 bp, Homo sapien
gagacccagttaagtattcgcccag

SEQ ID NO: 415853 - DNA, 25 bp, Homo sapien
taagtattcgcccagtgaggttttt

SEQ ID NO: 415854 - DNA, 25 bp, Homo sapien
agtgaggtttttggccttctcctgt

SEQ ID NO: 415855 - DNA, 25 bp, Homo sapien
ttagctctctctcattggttggtga

SEQ ID NO: 415856 - DNA, 25 bp, Homo sapien
tggtgagtcaagttgatccttgcaa

SEQ ID NO: 415857 - DNA, 25 bp, Homo sapien
tgatccttgcaagagctgctgttta

SEQ ID NO: 415858 - DNA, 25 bp, Homo sapien
gctgctgtttattgtgtgctcatga

SEQ ID NO: 415859 - DNA, 25 bp, Homo sapien
tgctcatgattcagccaggcactaa

SEQ ID NO: 415860 - DNA, 25 bp, Homo sapien
ggacagcaagggagagaaatgaaaa

SEQ ID NO: 415861 - DNA, 25 bp, Homo sapien
gacagcaagggagagaaatgaaaat

SEQ ID NO: 415862 - DNA, 25 bp, Homo sapien
acagcaagggagagaaatgaaaatg

SEQ ID NO: 415863 - DNA, 25 bp, Homo sapien
aaaatgatacagtgtgcagctgggc

SEQ ID NO: 415864 - DNA, 25 bp, Homo sapien
aaatgatacagtgtgcagctgggcg

SEQ ID NO: 415865 - DNA, 25 bp, Homo sapien
aatgatacagtgtgcagctgggcgc

SEQ ID NO: 415866 - DNA, 25 bp, Homo sapien
atgatacagtgtgcagctgggcgcg

SEQ ID NO: 415867 - DNA, 25 bp, Homo sapien
tgatacagtgtgcagctgggcgcgg

SEQ ID NO: 415868 - DNA, 25 bp, Homo sapien
gatacagtgtgcagctgggcgcggt

SEQ ID NO: 415869 - DNA, 25 bp, Homo sapien
atacagtgtgcagctgggcgcggtg

SEQ ID NO: 415870 - DNA, 25 bp, Homo sapien
tacagtgtgcagctgggcgcggtgg

SEQ ID NO: 415871 - DNA, 25 bp, Homo sapien
gttgtgaatttgatgtaagcttagg

SEQ ID NO: 415872 - DNA, 25 bp, Homo sapien
gaataaaatttataggcatctgtat

SEQ ID NO: 415873 - DNA, 25 bp, Homo sapien
ataggcatctgtataatgtacaact

SEQ ID NO: 415874 - DNA, 25 bp, Homo sapien
tcttttatccttagtttctttcacg

SEQ ID NO: 415875 - DNA, 25 bp, Homo sapien
atccttagtttctttcacggactct

SEQ ID NO: 415876 - DNA, 25 bp, Homo sapien
cttagtttctttcacggactctaga

SEQ ID NO: 415877 - DNA, 25 bp, Homo sapien
gtttctttcacggactctagaactt

SEQ ID NO: 415878 - DNA, 25 bp, Homo sapien
tcacggactctagaacttttatcag

SEQ ID NO: 415879 - DNA, 25 bp, Homo sapien
ggactctagaacttttatcagaata

SEQ ID NO: 415880 - DNA, 25 bp, Homo sapien
atcctgagtaggtgattgggtcaga

SEQ ID NO: 415881 - DNA, 25 bp, Homo sapien
gggtcagaaagatgccttcagtttt

SEQ ID NO: 415882 - DNA, 25 bp, Homo sapien
tgctggctgtcagtgagcggttcct

SEQ ID NO: 415883 - DNA, 25 bp, Homo sapien
gtcagtgagcggttcctcctggagc

SEQ ID NO: 415884 - DNA, 25 bp, Homo sapien
gaggagaacatcgtcatctctgacg

SEQ ID NO: 415885 - DNA, 25 bp, Homo sapien
gaacatcgtcatctctgacgtgtgt

SEQ ID NO: 415886 - DNA, 25 bp, Homo sapien
tcatctctgacgtgtgtgacatcgt

SEQ ID NO: 415887 - DNA, 25 bp, Homo sapien
gacgtgtgtgacatcgtgtaccgtt

SEQ ID NO: 415888 - DNA, 25 bp, Homo sapien
gtgacatcgtgtaccgttatgcggc

SEQ ID NO: 415889 - DNA, 25 bp, Homo sapien
acatcgtgtaccgttatgcggccga

SEQ ID NO: 415890 - DNA, 25 bp, Homo sapien
gtgtaccgttatgcggccgaccact

SEQ ID NO: 415891 - DNA, 25 bp, Homo sapien
atgcggccgaccacttctctgtcta

SEQ ID NO: 415892 - DNA, 25 bp, Homo sapien
tgtctacatcacctacgtcagcaat

SEQ ID NO: 415893 - DNA, 25 bp, Homo sapien
gtaactatatgcaacattcccttca

SEQ ID NO: 415894 - DNA, 25 bp, Homo sapien
aactatatgcaacattcccttcatt

SEQ ID NO: 415895 - DNA, 25 bp, Homo sapien
tcattataaatcttgactgttttaa

SEQ ID NO: 415896 - DNA, 25 bp, Homo sapien
acagaatatttgcatcagttttttc

SEQ ID NO: 415897 - DNA, 25 bp, Homo sapien
aaactacgattgaagtacacaaaca

SEQ ID NO: 415898 - DNA, 25 bp, Homo sapien
gaagtacacaaacagtatcaaatgt

SEQ ID NO: 415899 - DNA, 25 bp, Homo sapien
cagtatcaaatgttctactttgggc

SEQ ID NO: 415900 - DNA, 25 bp, Homo sapien
caaatgttctactttgggcaaaact

SEQ ID NO: 415901 - DNA, 25 bp, Homo sapien
gggaatctttcaagtctaacacaca

SEQ ID NO: 415902 - DNA, 25 bp, Homo sapien
gaatctttcaagtctaacacacatg

SEQ ID NO: 415903 - DNA, 25 bp, Homo sapien
ttcaagtctaacacacatgataaat

SEQ ID NO: 415904 - DNA, 25 bp, Homo sapien
acaagcacaggagtgttcctcggta

SEQ ID NO: 415905 - DNA, 25 bp, Homo sapien
gtgttcctcggtagcagtggacaaa

SEQ ID NO: 415906 - DNA, 25 bp, Homo sapien
aatgccaatgagaaggactccaggt

SEQ ID NO: 415907 - DNA, 25 bp, Homo sapien
atgggcataatcacctcgatcacag

SEQ ID NO: 415908 - DNA, 25 bp, Homo sapien
tacacctgcactgtctcaagaagac

SEQ ID NO: 415909 - DNA, 25 bp, Homo sapien
gacccagtgggttttagctttgcat

SEQ ID NO: 415910 - DNA, 25 bp, Homo sapien
tagctttgcatgacattgcacctgg

SEQ ID NO: 415911 - DNA, 25 bp, Homo sapien
cactctctgtggatgctggtcttgg

SEQ ID NO: 415912 - DNA, 25 bp, Homo sapien
gctggtcttggctaaacggttcatc

SEQ ID NO: 415913 - DNA, 25 bp, Homo sapien
tcatccgggttttccttattgactt

SEQ ID NO: 415914 - DNA, 25 bp, Homo sapien
ggagatgatgagtaccaagcccttg

SEQ ID NO: 415915 - DNA, 25 bp, Homo sapien
gcattgtgcttgcagtgaggctcca

SEQ ID NO: 415916 - DNA, 25 bp, Homo sapien
tattctagttctccaggaattcccc

SEQ ID NO: 415917 - DNA, 25 bp, Homo sapien
gaattcccctctgttgtgagtgatg

SEQ ID NO: 415918 - DNA, 25 bp, Homo sapien
gaagtaggcacaggctgtaccagaa

SEQ ID NO: 415919 - DNA, 25 bp, Homo sapien
aaggacagacagcacgtggctcact

SEQ ID NO: 415920 - DNA, 25 bp, Homo sapien
gaaggccaggaacactgcttgtgat

SEQ ID NO: 415921 - DNA, 25 bp, Homo sapien
cactggacggtgaaggtgcctaaca

SEQ ID NO: 415922 - DNA, 25 bp, Homo sapien
tgaaggtgcctaacagccattccag

SEQ ID NO: 415923 - DNA, 25 bp, Homo sapien
agcacgtggctcactcgataggtgg

SEQ ID NO: 415924 - DNA, 25 bp, Homo sapien
gagatgctcacttagtgcctactat

SEQ ID NO: 415925 - DNA, 25 bp, Homo sapien
tgcctactatgcaccaagcattgtg

SEQ ID NO: 415926 - DNA, 25 bp, Homo sapien
aaggtagaagcgagttcccttcatg

SEQ ID NO: 415927 - DNA, 25 bp, Homo sapien
gttcccttcatggttgattctgcct

SEQ ID NO: 415928 - DNA, 25 bp, Homo sapien
ttcccttcatggttgattctgcctt

SEQ ID NO: 415929 - DNA, 25 bp, Homo sapien
cccttcatggttgattctgccttta

SEQ ID NO: 415930 - DNA, 25 bp, Homo sapien
ccttcatggttgattctgcctttaa

SEQ ID NO: 415931 - DNA, 25 bp, Homo sapien
ttcatggttgattctgcctttaaag

SEQ ID NO: 415932 - DNA, 25 bp, Homo sapien
catggttgattctgcctttaaagga

SEQ ID NO: 415933 - DNA, 25 bp, Homo sapien
atggttgattctgcctttaaaggag

SEQ ID NO: 415934 - DNA, 25 bp, Homo sapien
gttgattctgcctttaaaggagcct

SEQ ID NO: 415935 - DNA, 25 bp, Homo sapien
gcctttaaaggagcctgctactgaa

SEQ ID NO: 415936 - DNA, 25 bp, Homo sapien
cacttttctcaaattgaagtttaat

SEQ ID NO: 415937 - DNA, 25 bp, Homo sapien
taatatgtttgaggtacctggccta

SEQ ID NO: 415938 - DNA, 25 bp, Homo sapien
atatgtttgaggtacctggcctagt

SEQ ID NO: 415939 - DNA, 25 bp, Homo sapien
atgtttgaggtacctggcctagtaa

SEQ ID NO: 415940 - DNA, 25 bp, Homo sapien
tttgaggtacctggcctagtaagca

SEQ ID NO: 415941 - DNA, 25 bp, Homo sapien
gaggtacctggcctagtaagcacca

SEQ ID NO: 415942 - DNA, 25 bp, Homo sapien
ggtacctggcctagtaagcaccata

SEQ ID NO: 415943 - DNA, 25 bp, Homo sapien
acctggcctagtaagcaccatacaa

SEQ ID NO: 415944 - DNA, 25 bp, Homo sapien
tggcctagtaagcaccatacaagtg

SEQ ID NO: 415945 - DNA, 25 bp, Homo sapien
caccatacaagtgctattatttcta

SEQ ID NO: 415946 - DNA, 25 bp, Homo sapien
tttatcaagataaaagacaccagcc

SEQ ID NO: 415947 - DNA, 25 bp, Homo sapien
gcgagtccccatctatgcaaaaaat

SEQ ID NO: 415948 - DNA, 25 bp, Homo sapien
attcctgatttatccaccaattatt

SEQ ID NO: 415949 - DNA, 25 bp, Homo sapien
ttcctgatttatccaccaattattt

SEQ ID NO: 415950 - DNA, 25 bp, Homo sapien
tcctgatttatccaccaattatttt

SEQ ID NO: 415951 - DNA, 25 bp, Homo sapien
cctgatttatccaccaattattttt

SEQ ID NO: 415952 - DNA, 25 bp, Homo sapien
ctgatttatccaccaattatttttt

SEQ ID NO: 415953 - DNA, 25 bp, Homo sapien
tgatttatccaccaattatttttta

SEQ ID NO: 415954 - DNA, 25 bp, Homo sapien
atgtatttaaacctgaattcagaga

SEQ ID NO: 415955 - DNA, 25 bp, Homo sapien
tgtatttaaacctgaattcagagat

SEQ ID NO: 415956 - DNA, 25 bp, Homo sapien
gtatttaaacctgaattcagagata

SEQ ID NO: 415957 - DNA, 25 bp, Homo sapien
aacctgaattcagagataaaactag

SEQ ID NO: 415958 - DNA, 25 bp, Homo sapien
gagataaaactagtaaatagctccc

SEQ ID NO: 415959 - DNA, 25 bp, Homo sapien
catagggaatagtttttcattttat

SEQ ID NO: 415960 - DNA, 25 bp, Homo sapien
ttctgttttattagctagtgaaacc

SEQ ID NO: 415961 - DNA, 25 bp, Homo sapien
ttttattagctagtgaaaccaatgt

SEQ ID NO: 415962 - DNA, 25 bp, Homo sapien
tattagctagtgaaaccaatgttgg

SEQ ID NO: 415963 - DNA, 25 bp, Homo sapien
ttagctagtgaaaccaatgttggta

SEQ ID NO: 415964 - DNA, 25 bp, Homo sapien
gctagtgaaaccaatgttggtaaaa

SEQ ID NO: 415965 - DNA, 25 bp, Homo sapien
aacaattttagagtttgtgctagaa

SEQ ID NO: 415966 - DNA, 25 bp, Homo sapien
agagtttgtgctagaaaagatattc

SEQ ID NO: 415967 - DNA, 25 bp, Homo sapien
gaaaagatattctgaggccggatgt

SEQ ID NO: 415968 - DNA, 25 bp, Homo sapien
aaaagatattctgaggccggatgtg

SEQ ID NO: 415969 - DNA, 25 bp, Homo sapien
aaagatattctgaggccggatgtgg

SEQ ID NO: 415970 - DNA, 25 bp, Homo sapien
tattttttagcaaacgtgtctgcat

SEQ ID NO: 415971 - DNA, 25 bp, Homo sapien
agcaaacgtgtctgcatgttccaat

SEQ ID NO: 415972 - DNA, 25 bp, Homo sapien
aacgtgtctgcatgttccaatgaga

SEQ ID NO: 415973 - DNA, 25 bp, Homo sapien
gtctgcatgttccaatgagagtagg

SEQ ID NO: 415974 - DNA, 25 bp, Homo sapien
tgggatgtgggacccactgccctat

SEQ ID NO: 415975 - DNA, 25 bp, Homo sapien
gacccactgccctattttcttggga

SEQ ID NO: 415976 - DNA, 25 bp, Homo sapien
cactgccctattttcttgggaatca

SEQ ID NO: 415977 - DNA, 25 bp, Homo sapien
tgccctattttcttgggaatcaaaa

SEQ ID NO: 415978 - DNA, 25 bp, Homo sapien
ttttcttgggaatcaaaacatcaaa

SEQ ID NO: 415979 - DNA, 25 bp, Homo sapien
gaaagcaaaatttgtagctgggtgt

SEQ ID NO: 415980 - DNA, 25 bp, Homo sapien
gagactgttggtataataatattta

SEQ ID NO: 415981 - DNA, 25 bp, Homo sapien
ccagacatttggaattgcatattaa

SEQ ID NO: 415982 - DNA, 25 bp, Homo sapien
ttgcatattaaggaagcccagaact

SEQ ID NO: 415983 - DNA, 25 bp, Homo sapien
agcccagaactggaagcttggagga

SEQ ID NO: 415984 - DNA, 25 bp, Homo sapien
cttggaggaaagcatactggagaat

SEQ ID NO: 415985 - DNA, 25 bp, Homo sapien
gaataagctacaaagagcctgggct

SEQ ID NO: 415986 - DNA, 25 bp, Homo sapien
aagagcctgggcttaagaatccaag

SEQ ID NO: 415987 - DNA, 25 bp, Homo sapien
accagtcctgaatcctaaggagcct

SEQ ID NO: 415988 - DNA, 25 bp, Homo sapien
agtcctgaatcctaaggagcctggg

SEQ ID NO: 415989 - DNA, 25 bp, Homo sapien
aagttaagagctccccatctctagc

SEQ ID NO: 415990 - DNA, 25 bp, Homo sapien
agctccccatctctagctggaaaat

SEQ ID NO: 415991 - DNA, 25 bp, Homo sapien
ccccatctctagctggaaaatccag

SEQ ID NO: 415992 - DNA, 25 bp, Homo sapien
ggaaacatcaaagcaagttacaagg

SEQ ID NO: 415993 - DNA, 25 bp, Homo sapien
caggtatcacttaacttttcttcaa

SEQ ID NO: 415994 - DNA, 25 bp, Homo sapien
tatcacttaacttttcttcaagaag

SEQ ID NO: 415995 - DNA, 25 bp, Homo sapien
gaaggtctatgagttacattttact

SEQ ID NO: 415996 - DNA, 25 bp, Homo sapien
ggtatcccaggcatcaaggagtgta

SEQ ID NO: 415997 - DNA, 25 bp, Homo sapien
cccaggcatcaaggagtgtaacttt

SEQ ID NO: 415998 - DNA, 25 bp, Homo sapien
ggcatcaaggagtgtaactttcaat

SEQ ID NO: 415999 - DNA, 25 bp, Homo sapien
aggagtgtaactttcaatgaatcaa

SEQ ID NO: 416000 - DNA, 25 bp, Homo sapien
agcctctgtttaaagaaggatctta

SEQ ID NO: 416001 - DNA, 25 bp, Homo sapien
ggagaaattaaccacctgacccagg

SEQ ID NO: 416002 - DNA, 25 bp, Homo sapien
gagaaattaaccacctgacccaggg

SEQ ID NO: 416003 - DNA, 25 bp, Homo sapien
ctctgtatctggttaagtcggttgc

SEQ ID NO: 416004 - DNA, 25 bp, Homo sapien
taagtcggttgctgggatgcaccct

SEQ ID NO: 416005 - DNA, 25 bp, Homo sapien
caccctgcactagagctgaaaggaa

SEQ ID NO: 416006 - DNA, 25 bp, Homo sapien
aggaaatttgacctccaagcagccc

SEQ ID NO: 416007 - DNA, 25 bp, Homo sapien
aagcagccctgacaggttctgggcc

SEQ ID NO: 416008 - DNA, 25 bp, Homo sapien
ttgcgccctttataaggccatccta

SEQ ID NO: 416009 - DNA, 25 bp, Homo sapien
tataaggccatcctagtccctgctg

SEQ ID NO: 416010 - DNA, 25 bp, Homo sapien
tactgagtgattgcagagtgcttta

SEQ ID NO: 416011 - DNA, 25 bp, Homo sapien
tatcaccttattttatcgaaaccca

SEQ ID NO: 416012 - DNA, 25 bp, Homo sapien
tatcgaaacccatctgtgaaacttt

SEQ ID NO: 416013 - DNA, 25 bp, Homo sapien
aggaaaaggccttgcagcggtagaa

SEQ ID NO: 416014 - DNA, 25 bp, Homo sapien
gaaaacactattactttagactttg

SEQ ID NO: 416015 - DNA, 25 bp, Homo sapien
ggtggaatgctggataagtgatatt

SEQ ID NO: 416016 - DNA, 25 bp, Homo sapien
tgatatttttcactagctttcctcc

SEQ ID NO: 416017 - DNA, 25 bp, Homo sapien
atatttttcactagctttcctccga

SEQ ID NO: 416018 - DNA, 25 bp, Homo sapien
atttttcactagctttcctccgatt

SEQ ID NO: 416019 - DNA, 25 bp, Homo sapien
ttttcactagctttcctccgatttt

SEQ ID NO: 416020 - DNA, 25 bp, Homo sapien
ttcactagctttcctccgattttaa

SEQ ID NO: 416021 - DNA, 25 bp, Homo sapien
cactagctttcctccgattttaaag

SEQ ID NO: 416022 - DNA, 25 bp, Homo sapien
tagctttcctccgattttaaaggag

SEQ ID NO: 416023 - DNA, 25 bp, Homo sapien
tttcctccgattttaaaggagccat

SEQ ID NO: 416024 - DNA, 25 bp, Homo sapien
cctccgattttaaaggagccatatt

SEQ ID NO: 416025 - DNA, 25 bp, Homo sapien
gtttgaagctgtcaccttagggtag

SEQ ID NO: 416026 - DNA, 25 bp, Homo sapien
gtcaccttagggtagactgcaagac

SEQ ID NO: 416027 - DNA, 25 bp, Homo sapien
gtagactgcaagacaatgtactgat

SEQ ID NO: 416028 - DNA, 25 bp, Homo sapien
acaatgtactgattagatttggcac

SEQ ID NO: 416029 - DNA, 25 bp, Homo sapien
cacaatttgttagtataaacggcct

SEQ ID NO: 416030 - DNA, 25 bp, Homo sapien
taaacggcctacttgttgtcttcat

SEQ ID NO: 416031 - DNA, 25 bp, Homo sapien
ttttccccatcttctgtcttatgaa

SEQ ID NO: 416032 - DNA, 25 bp, Homo sapien
ctgtcttatgaaattccagtgtctt

SEQ ID NO: 416033 - DNA, 25 bp, Homo sapien
attccagtgtcttaagtgactaaaa

SEQ ID NO: 416034 - DNA, 25 bp, Homo sapien
ctttgagggcagatagtagtatttt

SEQ ID NO: 416035 - DNA, 25 bp, Homo sapien
tatctttcacagttcctagtatata

SEQ ID NO: 416036 - DNA, 25 bp, Homo sapien
gatgtgggacaaacaacttgttgtt

SEQ ID NO: 416037 - DNA, 25 bp, Homo sapien
acttgttgttgtgtctcgaggcaga

SEQ ID NO: 416038 - DNA, 25 bp, Homo sapien
aaccctgctaacagttggctctgaa

SEQ ID NO: 416039 - DNA, 25 bp, Homo sapien
gctaacagttggctctgaaccccag

SEQ ID NO: 416040 - DNA, 25 bp, Homo sapien
cccagcttcctcatcaaggaaacag

SEQ ID NO: 416041 - DNA, 25 bp, Homo sapien
gaaacagagttaataatatccactt

SEQ ID NO: 416042 - DNA, 25 bp, Homo sapien
atatccacttatcagggaccgcacg

SEQ ID NO: 416043 - DNA, 25 bp, Homo sapien
cacttatcagggaccgcacggtttt

SEQ ID NO: 416044 - DNA, 25 bp, Homo sapien
tcagggaccgcacggttttgtaaga

SEQ ID NO: 416045 - DNA, 25 bp, Homo sapien
ttttgtaagaatgccttttgggccg

SEQ ID NO: 416046 - DNA, 25 bp, Homo sapien
agccaccccagcatgatgtgggaca

SEQ ID NO: 416047 - DNA, 25 bp, Homo sapien
gttagggactgtttctctctgtttc

SEQ ID NO: 416048 - DNA, 25 bp, Homo sapien
tgtttctgggctctgccatccatat

SEQ ID NO: 416049 - DNA, 25 bp, Homo sapien
ggctctgccatccatattgttagca

SEQ ID NO: 416050 - DNA, 25 bp, Homo sapien
agcattatcctaattctggctctgc

SEQ ID NO: 416051 - DNA, 25 bp, Homo sapien
aattctggctctgcattatggtggg

SEQ ID NO: 416052 - DNA, 25 bp, Homo sapien
attatggtgggctgttcactgtcca

SEQ ID NO: 416053 - DNA, 25 bp, Homo sapien
ctgttcactgtccacagcagggaat

SEQ ID NO: 416054 - DNA, 25 bp, Homo sapien
actgtccacagcagggaatgtttgg

SEQ ID NO: 416055 - DNA, 25 bp, Homo sapien
gaatgtttggaagaactttctcaga

SEQ ID NO: 416056 - DNA, 25 bp, Homo sapien
gggttccgcttctcaagacggttag

SEQ ID NO: 416057 - DNA, 25 bp, Homo sapien
agacggttagggactgtttctctct

SEQ ID NO: 416058 - DNA, 25 bp, Homo sapien
agagccccagaacccacatctaatt

SEQ ID NO: 416059 - DNA, 25 bp, Homo sapien
gaacccacatctaattggctttgtt

SEQ ID NO: 416060 - DNA, 25 bp, Homo sapien
aattggctttgttgcttattctggc

SEQ ID NO: 416061 - DNA, 25 bp, Homo sapien
ttgttgcttattctggcccttccca

SEQ ID NO: 416062 - DNA, 25 bp, Homo sapien
gccacacaaatactggctgctcctt

SEQ ID NO: 416063 - DNA, 25 bp, Homo sapien
gccgcatctgttgtgtggtggccac

SEQ ID NO: 416064 - DNA, 25 bp, Homo sapien
ttgtgtggtggccacaagcactcag

SEQ ID NO: 416065 - DNA, 25 bp, Homo sapien
aagcactcaggcatctgagtttact

SEQ ID NO: 416066 - DNA, 25 bp, Homo sapien
gaacattggctgtcaatctctgtgg

SEQ ID NO: 416067 - DNA, 25 bp, Homo sapien
gtcaatctctgtgggcaggcggttt

SEQ ID NO: 416068 - DNA, 25 bp, Homo sapien
ggcggtttggcctctagtgggaatg

SEQ ID NO: 416069 - DNA, 25 bp, Homo sapien
accttgggatctgccgctgcctttg

SEQ ID NO: 416070 - DNA, 25 bp, Homo sapien
cgctgcctttgcactggcgaaggga

SEQ ID NO: 416071 - DNA, 25 bp, Homo sapien
gggcactggttatgttgtttccatt

SEQ ID NO: 416072 - DNA, 25 bp, Homo sapien
ggttatgttgtttccattcgacagt

SEQ ID NO: 416073 - DNA, 25 bp, Homo sapien
atgttgtttccattcgacagtcctt

SEQ ID NO: 416074 - DNA, 25 bp, Homo sapien
tttccattcgacagtccttccaaag

SEQ ID NO: 416075 - DNA, 25 bp, Homo sapien
attcgacagtccttccaaaggcttc

SEQ ID NO: 416076 - DNA, 25 bp, Homo sapien
cagaaaagcgtcctcctccagaagg

SEQ ID NO: 416077 - DNA, 25 bp, Homo sapien
tcctccagaaggtaccaccaaacct

SEQ ID NO: 416078 - DNA, 25 bp, Homo sapien
tttactggaagcaaggccagaggag

SEQ ID NO: 416079 - DNA, 25 bp, Homo sapien
aggaggagggctgctgactgtcccc

SEQ ID NO: 416080 - DNA, 25 bp, Homo sapien
atggtttgattttagggttgagtga

SEQ ID NO: 416081 - DNA, 25 bp, Homo sapien
tttagggttgagtgacatgacatat

SEQ ID NO: 416082 - DNA, 25 bp, Homo sapien
gagtgacatgacatatgtgaggatg

SEQ ID NO: 416083 - DNA, 25 bp, Homo sapien
gtagtgagacatacagtcatgactc

SEQ ID NO: 416084 - DNA, 25 bp, Homo sapien
gtcatgactcattatgtttggataa

SEQ ID NO: 416085 - DNA, 25 bp, Homo sapien
atgtaatttcattccggactcaccc

SEQ ID NO: 416086 - DNA, 25 bp, Homo sapien
atttcattccggactcaccctcaaa

SEQ ID NO: 416087 - DNA, 25 bp, Homo sapien
taaatagctgttcattagcaatttt

SEQ ID NO: 416088 - DNA, 25 bp, Homo sapien
aacaaaaggctctgaaacacaagaa

SEQ ID NO: 416089 - DNA, 25 bp, Homo sapien
ctttatctttgttacggtgttggtg

SEQ ID NO: 416090 - DNA, 25 bp, Homo sapien
atctttgttacggtgttggtgaata

SEQ ID NO: 416091 - DNA, 25 bp, Homo sapien
aaatgtcactcctgttttttctgct

SEQ ID NO: 416092 - DNA, 25 bp, Homo sapien
gctattttggcttaacagcttcttt

SEQ ID NO: 416093 - DNA, 25 bp, Homo sapien
acagcttctttctcatcttaggcct

SEQ ID NO: 416094 - DNA, 25 bp, Homo sapien
taaaatggagatacacccctctcag

SEQ ID NO: 416095 - DNA, 25 bp, Homo sapien
ttaggcctgcctgaaaacgttatag

SEQ ID NO: 416096 - DNA, 25 bp, Homo sapien
aacgttatagttccctttctggcag

SEQ ID NO: 416097 - DNA, 25 bp, Homo sapien
ttctggcaggcggtggtttcaatga

SEQ ID NO: 416098 - DNA, 25 bp, Homo sapien
acacccctctcagaggatggttgtg

SEQ ID NO: 416099 - DNA, 25 bp, Homo sapien
gaggtcgtggctgtgaaagcccctt

SEQ ID NO: 416100 - DNA, 25 bp, Homo sapien
aaagcccctttagacaatacctgca

SEQ ID NO: 416101 - DNA, 25 bp, Homo sapien
aatacctgcacagagtcggtgtaaa

SEQ ID NO: 416102 - DNA, 25 bp, Homo sapien
tcagcaacagcttaagatttacttt

SEQ ID NO: 416103 - DNA, 25 bp, Homo sapien
gatttactttgttattcttgaaact

SEQ ID NO: 416104 - DNA, 25 bp, Homo sapien
cttgaaacttgactgatttttgtga

SEQ ID NO: 416105 - DNA, 25 bp, Homo sapien
gtgaagtctttgcagaattcccttg

SEQ ID NO: 416106 - DNA, 25 bp, Homo sapien
tgcagaattcccttgcttttcagaa

SEQ ID NO: 416107 - DNA, 25 bp, Homo sapien
tactatttacatgtctatctttttg

SEQ ID NO: 416108 - DNA, 25 bp, Homo sapien
tctatctttttgtggattcttgaca

SEQ ID NO: 416109 - DNA, 25 bp, Homo sapien
gattcttgacattttctgcttgctg

SEQ ID NO: 416110 - DNA, 25 bp, Homo sapien
ctgcttgctgcattgtggtacctga

SEQ ID NO: 416111 - DNA, 25 bp, Homo sapien
aataggtttattctgctagctaagc

SEQ ID NO: 416112 - DNA, 25 bp, Homo sapien
tagctaagcacttcagcaacagctt

SEQ ID NO: 416113 - DNA, 25 bp, Homo sapien
aaggaaacctggacacaggcacgta

SEQ ID NO: 416114 - DNA, 25 bp, Homo sapien
gaaacctggacacaggcacgtatga

SEQ ID NO: 416115 - DNA, 25 bp, Homo sapien
ctggacacaggcacgtatgagggaa

SEQ ID NO: 416116 - DNA, 25 bp, Homo sapien
acacaggcacgtatgagggaagaca

SEQ ID NO: 416117 - DNA, 25 bp, Homo sapien
aggcacgtatgagggaagacaatgt

SEQ ID NO: 416118 - DNA, 25 bp, Homo sapien
gagaggcctggaacacactcttact

SEQ ID NO: 416119 - DNA, 25 bp, Homo sapien
agaggcctggaacacactcttactt

SEQ ID NO: 416120 - DNA, 25 bp, Homo sapien
aggcctggaacacactcttacttca

SEQ ID NO: 416121 - DNA, 25 bp, Homo sapien
cctggaacacactcttacttcatgg

SEQ ID NO: 416122 - DNA, 25 bp, Homo sapien
tggaacacactcttacttcatggcc

SEQ ID NO: 416123 - DNA, 25 bp, Homo sapien
ggaacacactcttacttcatggccc

SEQ ID NO: 416124 - DNA, 25 bp, Homo sapien
tcccagcttcagcaggttggaacgt

SEQ ID NO: 416125 - DNA, 25 bp, Homo sapien
aaggccttccagatcactgtaagac

SEQ ID NO: 416126 - DNA, 25 bp, Homo sapien
aagacagtactgcatttagtcccct

SEQ ID NO: 416127 - DNA, 25 bp, Homo sapien
tttctgctgtgttcagagccaccca

SEQ ID NO: 416128 - DNA, 25 bp, Homo sapien
agagccacccaacatacagcaaatg

SEQ ID NO: 416129 - DNA, 25 bp, Homo sapien
gggcctggtgacctcttagacttgt

SEQ ID NO: 416130 - DNA, 25 bp, Homo sapien
ggtgacctcttagacttgttttgct

SEQ ID NO: 416131 - DNA, 25 bp, Homo sapien
tgttttgcttatcctcttggcttga

SEQ ID NO: 416132 - DNA, 25 bp, Homo sapien
ttatcctcttggcttgagcttgctt

SEQ ID NO: 416133 - DNA, 25 bp, Homo sapien
gcttgagcttgcttccaagcacaga

SEQ ID NO: 416134 - DNA, 25 bp, Homo sapien
ttattcatgtacattggccagttcc

SEQ ID NO: 416135 - DNA, 25 bp, Homo sapien
actagccaatggtgaaaaattcctc

SEQ ID NO: 416136 - DNA, 25 bp, Homo sapien
gatatcctcagttgcaatcacatta

SEQ ID NO: 416137 - DNA, 25 bp, Homo sapien
taggctggtcttaatttttgatgga

SEQ ID NO: 416138 - DNA, 25 bp, Homo sapien
gaaatattctgttgtcccgtacttg

SEQ ID NO: 416139 - DNA, 25 bp, Homo sapien
gttgtcccgtacttgccattggatt

SEQ ID NO: 416140 - DNA, 25 bp, Homo sapien
gggacttgccaatatatttgtgggt

SEQ ID NO: 416141 - DNA, 25 bp, Homo sapien
tagcttatacccctaggatttcttg

SEQ ID NO: 416142 - DNA, 25 bp, Homo sapien
gcgggacgagcagttttggccactt

SEQ ID NO: 416143 - DNA, 25 bp, Homo sapien
gttttggccacttccatcaggacaa

SEQ ID NO: 416144 - DNA, 25 bp, Homo sapien
caggacaagactttttaggtcactt

SEQ ID NO: 416145 - DNA, 25 bp, Homo sapien
ggtcacttagtgcaggttttagttt

SEQ ID NO: 416146 - DNA, 25 bp, Homo sapien
gaattttgacttaaacagtgttgtc

SEQ ID NO: 416147 - DNA, 25 bp, Homo sapien
ttgaagttttcagggataacatacc

SEQ ID NO: 416148 - DNA, 25 bp, Homo sapien
gaaagtctttagttatagtcatggc

SEQ ID NO: 416149 - DNA, 25 bp, Homo sapien
ttagttatagtcatggcagctcctc

SEQ ID NO: 416150 - DNA, 25 bp, Homo sapien
ttatagtcatggcagctcctcaacc

SEQ ID NO: 416151 - DNA, 25 bp, Homo sapien
ctcctcaaccccatgattgtgatga

SEQ ID NO: 416152 - DNA, 25 bp, Homo sapien
gattgtgatgagattgggaagccca

SEQ ID NO: 416153 - DNA, 25 bp, Homo sapien
gattgggaagcccactgtaacactg

SEQ ID NO: 416154 - DNA, 25 bp, Homo sapien
tttggttggttttggctttggcaca

SEQ ID NO: 416155 - DNA, 25 bp, Homo sapien
ttttggctttggcacacctgaatta

SEQ ID NO: 416156 - DNA, 25 bp, Homo sapien
acctgaattaggttttcttgccttg

SEQ ID NO: 416157 - DNA, 25 bp, Homo sapien
agctcactgcttgaatttggtgtta

SEQ ID NO: 416158 - DNA, 25 bp, Homo sapien
ggaaacatgtaaagccacatactac

SEQ ID NO: 416159 - DNA, 25 bp, Homo sapien
aaagccacatactactgaaagcaca

SEQ ID NO: 416160 - DNA, 25 bp, Homo sapien
actactgaaagcacaatgcccagga

SEQ ID NO: 416161 - DNA, 25 bp, Homo sapien
caatgcccaggaaagttgtcactct

SEQ ID NO: 416162 - DNA, 25 bp, Homo sapien
gcccaggaaagttgtcactcttcac

SEQ ID NO: 416163 - DNA, 25 bp, Homo sapien
gttgtcactcttcacttaagggagt

SEQ ID NO: 416164 - DNA, 25 bp, Homo sapien
ctcttcacttaagggagtggttgcc

SEQ ID NO: 416165 - DNA, 25 bp, Homo sapien
ctttgggcgatgatgagaatgttct

SEQ ID NO: 416166 - DNA, 25 bp, Homo sapien
aaaggatatttcataatctcagaat

SEQ ID NO: 416167 - DNA, 25 bp, Homo sapien
atctcagaatagttacaaagctcac

SEQ ID NO: 416168 - DNA, 25 bp, Homo sapien
cagtgtggaaacttgtgcctcttct

SEQ ID NO: 416169 - DNA, 25 bp, Homo sapien
gaaacttgtgcctcttcttagtata

SEQ ID NO: 416170 - DNA, 25 bp, Homo sapien
attgtgtgtgttaaggctttccagt

SEQ ID NO: 416171 - DNA, 25 bp, Homo sapien
aacatgtttcttttagcccagagat

SEQ ID NO: 416172 - DNA, 25 bp, Homo sapien
gtgttaaggctttccagtattttct

SEQ ID NO: 416173 - DNA, 25 bp, Homo sapien
tagtgcttttattggtgagtatatt

SEQ ID NO: 416174 - DNA, 25 bp, Homo sapien
ccagtattttctgagcattggaatg

SEQ ID NO: 416175 - DNA, 25 bp, Homo sapien
gagcattggaatgtagtcagtccct

SEQ ID NO: 416176 - DNA, 25 bp, Homo sapien
tggaatgtagtcagtccctacctct

SEQ ID NO: 416177 - DNA, 25 bp, Homo sapien
cccatcctctgcttttagggagaac

SEQ ID NO: 416178 - DNA, 25 bp, Homo sapien
tgcttttagggagaacagtgtggaa

SEQ ID NO: 416179 - DNA, 25 bp, Homo sapien
tcaaacactgtcagaattgctgaaa

SEQ ID NO: 416180 - DNA, 25 bp, Homo sapien
aattgctgaaatcaatacacaaaga

SEQ ID NO: 416181 - DNA, 25 bp, Homo sapien
ttctttttactattcaatattgaac

SEQ ID NO: 416182 - DNA, 25 bp, Homo sapien
tattgagatgaaatgctgttggatt

SEQ ID NO: 416183 - DNA, 25 bp, Homo sapien
tgaaatgctgttggatttgatacat

SEQ ID NO: 416184 - DNA, 25 bp, Homo sapien
atgctgttggatttgatacattaaa

SEQ ID NO: 416185 - DNA, 25 bp, Homo sapien
aatgtaatattgtaagacttttgag

SEQ ID NO: 416186 - DNA, 25 bp, Homo sapien
gacttttgagaatatacttgattaa

SEQ ID NO: 416187 - DNA, 25 bp, Homo sapien
gaagggattgttaacttattgctat

SEQ ID NO: 416188 - DNA, 25 bp, Homo sapien
gttaacttattgctattttggtata

SEQ ID NO: 416189 - DNA, 25 bp, Homo sapien
atgttaatttattgactagtttgaa

SEQ ID NO: 416190 - DNA, 25 bp, Homo sapien
gaggtgcttgaggtatggtctttac

SEQ ID NO: 416191 - DNA, 25 bp, Homo sapien
ggtatggtctttacctacgtgaaat

SEQ ID NO: 416192 - DNA, 25 bp, Homo sapien
ggtctttacctacgtgaaatgttgg

SEQ ID NO: 416193 - DNA, 25 bp, Homo sapien
ctacgtgaaatgttggaggttgaga

SEQ ID NO: 416194 - DNA, 25 bp, Homo sapien
gaggttgagatgaaaactcttgctt

SEQ ID NO: 416195 - DNA, 25 bp, Homo sapien
aaaactcttgctttgaattcttcat

SEQ ID NO: 416196 - DNA, 25 bp, Homo sapien
gaattcttcatggaggactacatca

SEQ ID NO: 416197 - DNA, 25 bp, Homo sapien
ggactacatcatttcaatcctgaat

SEQ ID NO: 416198 - DNA, 25 bp, Homo sapien
caatcctgaatctggctcaattcta

SEQ ID NO: 416199 - DNA, 25 bp, Homo sapien
atctggctcaattctattattcact

SEQ ID NO: 416200 - DNA, 25 bp, Homo sapien
attctattattcacttattactgta

SEQ ID NO: 416201 - DNA, 25 bp, Homo sapien
gtgatgccatctctttaatgaccaa

SEQ ID NO: 416202 - DNA, 25 bp, Homo sapien
agtcaccatgtctctactatcttgc

SEQ ID NO: 416203 - DNA, 25 bp, Homo sapien
tgtctctactatcttgcctttgtga

SEQ ID NO: 416204 - DNA, 25 bp, Homo sapien
ttgtgaggctctgcttacattgggc

SEQ ID NO: 416205 - DNA, 25 bp, Homo sapien
tgccatgctaacctgaaaactcttg

SEQ ID NO: 416206 - DNA, 25 bp, Homo sapien
gaggcagactttatgctcagggaga

SEQ ID NO: 416207 - DNA, 25 bp, Homo sapien
aaactcttgggcatttctgcatatc

SEQ ID NO: 416208 - DNA, 25 bp, Homo sapien
gggcatttctgcatatcctaatatc

SEQ ID NO: 416209 - DNA, 25 bp, Homo sapien
attaggttggtagccatctgccagc

SEQ ID NO: 416210 - DNA, 25 bp, Homo sapien
atctgccagctcaactatttttggt

SEQ ID NO: 416211 - DNA, 25 bp, Homo sapien
ggtaccagaacttagtgatgccatc

SEQ ID NO: 416212 - DNA, 25 bp, Homo sapien
tttccacagttagtcttcgcttctt

SEQ ID NO: 416213 - DNA, 25 bp, Homo sapien
agagctaaattattcataccaatga

SEQ ID NO: 416214 - DNA, 25 bp, Homo sapien
tatctatttttgcttaatggactca

SEQ ID NO: 416215 - DNA, 25 bp, Homo sapien
aatggactcatgtggcattgttcac

SEQ ID NO: 416216 - DNA, 25 bp, Homo sapien
gtggcattgttcactatcatgcctt

SEQ ID NO: 416217 - DNA, 25 bp, Homo sapien
actatcatgcctttccatacttgta

SEQ ID NO: 416218 - DNA, 25 bp, Homo sapien
catgcctttccatacttgtaatatt

SEQ ID NO: 416219 - DNA, 25 bp, Homo sapien
ttgtaatatttctgagtcacttatt

SEQ ID NO: 416220 - DNA, 25 bp, Homo sapien
tgtgccacatggtagttgtcaagct

SEQ ID NO: 416221 - DNA, 25 bp, Homo sapien
agttgtcaagctgtggtagtcatgt

SEQ ID NO: 416222 - DNA, 25 bp, Homo sapien
aagctgtggtagtcatgtacacttt

SEQ ID NO: 416223 - DNA, 25 bp, Homo sapien
tttcctgtcttgaataatcccaaca

SEQ ID NO: 416224 - DNA, 25 bp, Homo sapien
tcctgtcttgaataatcccaacaaa

SEQ ID NO: 416225 - DNA, 25 bp, Homo sapien
tgtcttgaataatcccaacaaaacc

SEQ ID NO: 416226 - DNA, 25 bp, Homo sapien
caaaaccatttgaatcctcaagtaa

SEQ ID NO: 416227 - DNA, 25 bp, Homo sapien
accatttgaatcctcaagtaaaaat

SEQ ID NO: 416228 - DNA, 25 bp, Homo sapien
gaaagaattatcttctacttccata

SEQ ID NO: 416229 - DNA, 25 bp, Homo sapien
gaattatcttctacttccataaata

SEQ ID NO: 416230 - DNA, 25 bp, Homo sapien
tatcttctacttccataaatatatt

SEQ ID NO: 416231 - DNA, 25 bp, Homo sapien
tctattttcacttaaacagagaact

SEQ ID NO: 416232 - DNA, 25 bp, Homo sapien
ttcacttaaacagagaactatgact

SEQ ID NO: 416233 - DNA, 25 bp, Homo sapien
atgcatgataagtatatttctaagt

SEQ ID NO: 416234 - DNA, 25 bp, Homo sapien
tttcctgagactttaaatacgcaag

SEQ ID NO: 416235 - DNA, 25 bp, Homo sapien
gagactttaaatacgcaagacaaat

SEQ ID NO: 416236 - DNA, 25 bp, Homo sapien
aaaatctgccaacatacccaggctg

SEQ ID NO: 416237 - DNA, 25 bp, Homo sapien
gccaacatacccaggctgcttttca

SEQ ID NO: 416238 - DNA, 25 bp, Homo sapien
ccccatcataatgtaaaccattcta

SEQ ID NO: 416239 - DNA, 25 bp, Homo sapien
gctgctacttcaagttactcaaatg

SEQ ID NO: 416240 - DNA, 25 bp, Homo sapien
acttcaagttactcaaatgtgtttt

SEQ ID NO: 416241 - DNA, 25 bp, Homo sapien
tttctccagtgttttggaccaagac

SEQ ID NO: 416242 - DNA, 25 bp, Homo sapien
tctccagtgttttggaccaagacta

SEQ ID NO: 416243 - DNA, 25 bp, Homo sapien
gttttggaccaagactagatttcct

SEQ ID NO: 416244 - DNA, 25 bp, Homo sapien
gaccaagactagatttcctgagact

SEQ ID NO: 416245 - DNA, 25 bp, Homo sapien
aattccctagggagatgggcacaag

SEQ ID NO: 416246 - DNA, 25 bp, Homo sapien
agatgggcacaagtccttgatctgc

SEQ ID NO: 416247 - DNA, 25 bp, Homo sapien
gggttttccatggtccatgagtcca

SEQ ID NO: 416248 - DNA, 25 bp, Homo sapien
tctgcctacagtcaaagaggccagt

SEQ ID NO: 416249 - DNA, 25 bp, Homo sapien
aaagaggccagtgatcggccaggcg

SEQ ID NO: 416250 - DNA, 25 bp, Homo sapien
atggtccatgagtccatcagagctc

SEQ ID NO: 416251 - DNA, 25 bp, Homo sapien
tccatgagtccatcagagctcagat

SEQ ID NO: 416252 - DNA, 25 bp, Homo sapien
cttctcatctgctttctcgtattgg

SEQ ID NO: 416253 - DNA, 25 bp, Homo sapien
catctgctttctcgtattggcccta

SEQ ID NO: 416254 - DNA, 25 bp, Homo sapien
gctttctcgtattggccctaattcc

SEQ ID NO: 416255 - DNA, 25 bp, Homo sapien
gtattggccctaattccctagggag

SEQ ID NO: 416256 - DNA, 25 bp, Homo sapien
ggcagatgttcagtctcacagtgat

SEQ ID NO: 416257 - DNA, 25 bp, Homo sapien
gtctcacagtgatgttggaaagcat

SEQ ID NO: 416258 - DNA, 25 bp, Homo sapien
tatgcagtctaaacactatttctgt

SEQ ID NO: 416259 - DNA, 25 bp, Homo sapien
gaggataaattctaattgctttttg

SEQ ID NO: 416260 - DNA, 25 bp, Homo sapien
aagcattagccccagtttgtataaa

SEQ ID NO: 416261 - DNA, 25 bp, Homo sapien
gcattagccccagtttgtataaaat

SEQ ID NO: 416262 - DNA, 25 bp, Homo sapien
atgtctgctgcaactgaattcatga

SEQ ID NO: 416263 - DNA, 25 bp, Homo sapien
gctgcaactgaattcatgatagttc

SEQ ID NO: 416264 - DNA, 25 bp, Homo sapien
taaaactttacctgtgacaaggaat

SEQ ID NO: 416265 - DNA, 25 bp, Homo sapien
tatactgtttttcttgtgcaaataa

SEQ ID NO: 416266 - DNA, 25 bp, Homo sapien
gcaaataatacttaaggcagatgtt

SEQ ID NO: 416267 - DNA, 25 bp, Homo sapien
ggaatgagcccatttctccaatgag

SEQ ID NO: 416268 - DNA, 25 bp, Homo sapien
tctccaatgagccaagctaggccat

SEQ ID NO: 416269 - DNA, 25 bp, Homo sapien
ttgagccatggtgcagtttctgcag

SEQ ID NO: 416270 - DNA, 25 bp, Homo sapien
gcagtttctgcagtgaagaagcaac

SEQ ID NO: 416271 - DNA, 25 bp, Homo sapien
gtgaagaagcaacagggccagaata

SEQ ID NO: 416272 - DNA, 25 bp, Homo sapien
gaataggcccacatggtcagactct

SEQ ID NO: 416273 - DNA, 25 bp, Homo sapien
gcccacatggtcagactctcagact

SEQ ID NO: 416274 - DNA, 25 bp, Homo sapien
ctctcagacttacaaccttactcaa

SEQ ID NO: 416275 - DNA, 25 bp, Homo sapien
gagtgttccaatgatctgagcagaa

SEQ ID NO: 416276 - DNA, 25 bp, Homo sapien
taagtgctctgctagtctgtgtcat

SEQ ID NO: 416277 - DNA, 25 bp, Homo sapien
tgcacacccatctcttgggtggata

SEQ ID NO: 416278 - DNA, 25 bp, Homo sapien
ggttattaggagctaattatgggcc

SEQ ID NO: 416279 - DNA, 25 bp, Homo sapien
gttattaggagctaattatgggcca

SEQ ID NO: 416280 - DNA, 25 bp, Homo sapien
ttattaggagctaattatgggccaa

SEQ ID NO: 416281 - DNA, 25 bp, Homo sapien
tattaggagctaattatgggccaag

SEQ ID NO: 416282 - DNA, 25 bp, Homo sapien
attaggagctaattatgggccaagt

SEQ ID NO: 416283 - DNA, 25 bp, Homo sapien
ttaggagctaattatgggccaagta

SEQ ID NO: 416284 - DNA, 25 bp, Homo sapien
taggagctaattatgggccaagtat

SEQ ID NO: 416285 - DNA, 25 bp, Homo sapien
aggagctaattatgggccaagtatg

SEQ ID NO: 416286 - DNA, 25 bp, Homo sapien
ggagctaattatgggccaagtatgg

SEQ ID NO: 416287 - DNA, 25 bp, Homo sapien
gagctaattatgggccaagtatggt

SEQ ID NO: 416288 - DNA, 25 bp, Homo sapien
agctaattatgggccaagtatggtg

SEQ ID NO: 416289 - DNA, 25 bp, Homo sapien
aaatattgttgatgtcctgactctg

SEQ ID NO: 416290 - DNA, 25 bp, Homo sapien
ttgatgtcctgactctgtgagctca

SEQ ID NO: 416291 - DNA, 25 bp, Homo sapien
gagctcatagggagtatcttcatag

SEQ ID NO: 416292 - DNA, 25 bp, Homo sapien
gtaatgacatttgatcagccataaa

SEQ ID NO: 416293 - DNA, 25 bp, Homo sapien
tacattatgttcatatgcacccaaa

SEQ ID NO: 416294 - DNA, 25 bp, Homo sapien
tatgcacccaaaaaagctagtcagg

SEQ ID NO: 416295 - DNA, 25 bp, Homo sapien
gctagtcaggtaatgaatacccttg

SEQ ID NO: 416296 - DNA, 25 bp, Homo sapien
gaatacccttgaagtgaatagcaat

SEQ ID NO: 416297 - DNA, 25 bp, Homo sapien
atagcaattttgatttaggcagtgt

SEQ ID NO: 416298 - DNA, 25 bp, Homo sapien
aggcagtgtgttaggccatccttgc

SEQ ID NO: 416299 - DNA, 25 bp, Homo sapien
gtgtgttaggccatccttgcattgc

SEQ ID NO: 416300 - DNA, 25 bp, Homo sapien
acaacctgcctacataagacataag

SEQ ID NO: 416301 - DNA, 25 bp, Homo sapien
aagacataagcatctaggagcagag

SEQ ID NO: 416302 - DNA, 25 bp, Homo sapien
agccaactgaacctgctaattgcca

SEQ ID NO: 416303 - DNA, 25 bp, Homo sapien
aggagcagagaatccctcctccttt

SEQ ID NO: 416304 - DNA, 25 bp, Homo sapien
aagcagctctttcccaacagaataa

SEQ ID NO: 416305 - DNA, 25 bp, Homo sapien
ctgaacctgctaattgccagaatta

SEQ ID NO: 416306 - DNA, 25 bp, Homo sapien
gtcactgagctgtgaatgcctgttc

SEQ ID NO: 416307 - DNA, 25 bp, Homo sapien
attaggcatattcggctgatctgtc

SEQ ID NO: 416308 - DNA, 25 bp, Homo sapien
atattcggctgatctgtcacaggaa

SEQ ID NO: 416309 - DNA, 25 bp, Homo sapien
ctgtcacaggaaatgctgggctgga

SEQ ID NO: 416310 - DNA, 25 bp, Homo sapien
ccatgttttacaacctgcctacata

SEQ ID NO: 416311 - DNA, 25 bp, Homo sapien
cagagaagccactgtcaggaaagga

SEQ ID NO: 416312 - DNA, 25 bp, Homo sapien
ggaagtgaaccctactgaagccaga

SEQ ID NO: 416313 - DNA, 25 bp, Homo sapien
tgaagccagagaattcaccccggcc

SEQ ID NO: 416314 - DNA, 25 bp, Homo sapien
gccagagaattcaccccggccaaag

SEQ ID NO: 416315 - DNA, 25 bp, Homo sapien
cagtattgcatccatctactgcagc

SEQ ID NO: 416316 - DNA, 25 bp, Homo sapien
atctactgcagctacacatcctgag

SEQ ID NO: 416317 - DNA, 25 bp, Homo sapien
gcagctacacatcctgagggcagca

SEQ ID NO: 416318 - DNA, 25 bp, Homo sapien
ggcctgctggcccatcgcaggacta

SEQ ID NO: 416319 - DNA, 25 bp, Homo sapien
tagcccaggcacctgccgggcattg

SEQ ID NO: 416320 - DNA, 25 bp, Homo sapien
tgccgggcattgcaggatatccagt

SEQ ID NO: 416321 - DNA, 25 bp, Homo sapien
gactgctccctgatgcgtcagaaga

SEQ ID NO: 416322 - DNA, 25 bp, Homo sapien
aacagttttactacattgtacccag

SEQ ID NO: 416323 - DNA, 25 bp, Homo sapien
ttactacattgtacccagctgtggt

SEQ ID NO: 416324 - DNA, 25 bp, Homo sapien
aagccagggcttcttaaatcacatt

SEQ ID NO: 416325 - DNA, 25 bp, Homo sapien
agggcttcttaaatcacattttgaa

SEQ ID NO: 416326 - DNA, 25 bp, Homo sapien
gaattttaggtgttagaggctgaga

SEQ ID NO: 416327 - DNA, 25 bp, Homo sapien
agttactgtcttagtgttgctcctt

SEQ ID NO: 416328 - DNA, 25 bp, Homo sapien
agaggttcattaatggataccaaac

SEQ ID NO: 416329 - DNA, 25 bp, Homo sapien
gtcttagtgttgctcctttaaaaat

SEQ ID NO: 416330 - DNA, 25 bp, Homo sapien
tagctatgtaggaggaaggagttct

SEQ ID NO: 416331 - DNA, 25 bp, Homo sapien
tttttctcacggctttaatcatttt

SEQ ID NO: 416332 - DNA, 25 bp, Homo sapien
ttctcacggctttaatcatttttct

SEQ ID NO: 416333 - DNA, 25 bp, Homo sapien
catagggaatagtttttcattttat

SEQ ID NO: 416334 - DNA, 25 bp, Homo sapien
tttttcattttatgccaagtgattt

SEQ ID NO: 416335 - DNA, 25 bp, Homo sapien
ttctgttttattagctagtgaaacc

SEQ ID NO: 416336 - DNA, 25 bp, Homo sapien
tattagctagtgaaaccaatgttgg

SEQ ID NO: 416337 - DNA, 25 bp, Homo sapien
ttagctagtgaaaccaatgttggta

SEQ ID NO: 416338 - DNA, 25 bp, Homo sapien
gctagtgaaaccaatgttggtaaaa

SEQ ID NO: 416339 - DNA, 25 bp, Homo sapien
aacaattttagagtttgtgctagaa

SEQ ID NO: 416340 - DNA, 25 bp, Homo sapien
agagtttgtgctagaaaagatattc

SEQ ID NO: 416341 - DNA, 25 bp, Homo sapien
gaaaagatattctgaggccggatgt

SEQ ID NO: 416342 - DNA, 25 bp, Homo sapien
aaaagatattctgaggccggatgtg

SEQ ID NO: 416343 - DNA, 25 bp, Homo sapien
aaagatattctgaggccggatgtgg

SEQ ID NO: 416344 - DNA, 25 bp, Homo sapien
tttcctgagactttaaatacgcaag

SEQ ID NO: 416345 - DNA, 25 bp, Homo sapien
gagactttaaatacgcaagacaaat

SEQ ID NO: 416346 - DNA, 25 bp, Homo sapien
aaaatctgccaacatacccaggctg

SEQ ID NO: 416347 - DNA, 25 bp, Homo sapien
gccaacatacccaggctgcttttca

SEQ ID NO: 416348 - DNA, 25 bp, Homo sapien
ggctgcttttcaggagtgaatcact

SEQ ID NO: 416349 - DNA, 25 bp, Homo sapien
tcctataacactactttcttttggg

SEQ ID NO: 416350 - DNA, 25 bp, Homo sapien
tgggcctattctatgctgctacttc

SEQ ID NO: 416351 - DNA, 25 bp, Homo sapien
gctgctacttcaagttactcaaatg

SEQ ID NO: 416352 - DNA, 25 bp, Homo sapien
acttcaagttactcaaatgtgtttt

SEQ ID NO: 416353 - DNA, 25 bp, Homo sapien
ttctccagtgttttggaccaagact

SEQ ID NO: 416354 - DNA, 25 bp, Homo sapien
gaccaagactagatttcctgagact

SEQ ID NO: 416355 - DNA, 25 bp, Homo sapien
aaatgagcactttcccctctgtcaa

SEQ ID NO: 416356 - DNA, 25 bp, Homo sapien
taatcagttttcataggaattaggt

SEQ ID NO: 416357 - DNA, 25 bp, Homo sapien
gaattaggtttttagccaaatggct

SEQ ID NO: 416358 - DNA, 25 bp, Homo sapien
agccaaatggctgtgaggcaagttg

SEQ ID NO: 416359 - DNA, 25 bp, Homo sapien
aaatggctgtgaggcaagttgaagt

SEQ ID NO: 416360 - DNA, 25 bp, Homo sapien
ctgtgaggcaagttgaagtaagaca

SEQ ID NO: 416361 - DNA, 25 bp, Homo sapien
tttactttcagcagattttgagaca

SEQ ID NO: 416362 - DNA, 25 bp, Homo sapien
ctttcagcagattttgagacagtct

SEQ ID NO: 416363 - DNA, 25 bp, Homo sapien
gattcatttctcaaactacttaggt

SEQ ID NO: 416364 - DNA, 25 bp, Homo sapien
tcatttctcaaactacttaggtaga

SEQ ID NO: 416365 - DNA, 25 bp, Homo sapien
agttaaatgagcactttcccctctg

SEQ ID NO: 416366 - DNA, 25 bp, Homo sapien
gacgcaggtgctgtctcacccttta

SEQ ID NO: 416367 - DNA, 25 bp, Homo sapien
tctcaccctttactgtgtcctgtgg

SEQ ID NO: 416368 - DNA, 25 bp, Homo sapien
ctgtggccccaggtgtagaagcgac

SEQ ID NO: 416369 - DNA, 25 bp, Homo sapien
gccccaggtgtagaagcgactggaa

SEQ ID NO: 416370 - DNA, 25 bp, Homo sapien
acctcctttcacgtttctgcagtag

SEQ ID NO: 416371 - DNA, 25 bp, Homo sapien
tttcacgtttctgcagtagccgagg

SEQ ID NO: 416372 - DNA, 25 bp, Homo sapien
gtttctgcagtagccgaggtgctca

SEQ ID NO: 416373 - DNA, 25 bp, Homo sapien
gtagccgaggtgctcacagaagctc

SEQ ID NO: 416374 - DNA, 25 bp, Homo sapien
gaggtgctcacagaagctccttgga

SEQ ID NO: 416375 - DNA, 25 bp, Homo sapien
tgctcacagaagctccttggaggcg

SEQ ID NO: 416376 - DNA, 25 bp, Homo sapien
cttggaggcgctgggcctttgtcct

SEQ ID NO: 416377 - DNA, 25 bp, Homo sapien
gttcagtgcctcgttatcatagctt

SEQ ID NO: 416378 - DNA, 25 bp, Homo sapien
cagtgcctcgttatcatagcttact

SEQ ID NO: 416379 - DNA, 25 bp, Homo sapien
cttacttaggtattactggcatata

SEQ ID NO: 416380 - DNA, 25 bp, Homo sapien
attactggcatatataaactgcaca

SEQ ID NO: 416381 - DNA, 25 bp, Homo sapien
aaactgcacatgtttaaagtggctc

SEQ ID NO: 416382 - DNA, 25 bp, Homo sapien
gcacatgtttaaagtggctctacct

SEQ ID NO: 416383 - DNA, 25 bp, Homo sapien
tgtttaaagtggctctacctttgtt

SEQ ID NO: 416384 - DNA, 25 bp, Homo sapien
tgttttttataggtaattccaatag

SEQ ID NO: 416385 - DNA, 25 bp, Homo sapien
aatctattttactcatggctttcca

SEQ ID NO: 416386 - DNA, 25 bp, Homo sapien
tattttactcatggctttccagtac

SEQ ID NO: 416387 - DNA, 25 bp, Homo sapien
ttactcatggctttccagtacattt

SEQ ID NO: 416388 - DNA, 25 bp, Homo sapien
aagtcagagttacggagctcgcctc

SEQ ID NO: 416389 - DNA, 25 bp, Homo sapien
gagttacggagctcgcctctgcatt

SEQ ID NO: 416390 - DNA, 25 bp, Homo sapien
gaaactgctataccctcttcagcct

SEQ ID NO: 416391 - DNA, 25 bp, Homo sapien
ctcttcagccttgcagaggtttgca

SEQ ID NO: 416392 - DNA, 25 bp, Homo sapien
agccttgcagaggtttgcagcagat

SEQ ID NO: 416393 - DNA, 25 bp, Homo sapien
gatgccaggaaagccaagtacattc

SEQ ID NO: 416394 - DNA, 25 bp, Homo sapien
gtacattccaatacccaatcttttc

SEQ ID NO: 416395 - DNA, 25 bp, Homo sapien
tacccaatcttttccctcagatttt

SEQ ID NO: 416396 - DNA, 25 bp, Homo sapien
ttttccatctccagagcttcccttt

SEQ ID NO: 416397 - DNA, 25 bp, Homo sapien
agagcttccctttatggagctttct

SEQ ID NO: 416398 - DNA, 25 bp, Homo sapien
ccctttatggagctttctgaggata

SEQ ID NO: 416399 - DNA, 25 bp, Homo sapien
aaaacaaggaaggtcagtcagtgaa

SEQ ID NO: 416400 - DNA, 25 bp, Homo sapien
ggaaagggagctcctctagcatcaa

SEQ ID NO: 416401 - DNA, 25 bp, Homo sapien
agctcctctagcatcaaactgtctg

SEQ ID NO: 416402 - DNA, 25 bp, Homo sapien
caaactgtctgcatgtcgagtctca

SEQ ID NO: 416403 - DNA, 25 bp, Homo sapien
ctgtctgcatgtcgagtctcagaaa

SEQ ID NO: 416404 - DNA, 25 bp, Homo sapien
gtcgagtctcagaaaaacaaggatt

SEQ ID NO: 416405 - DNA, 25 bp, Homo sapien
aacaaggattcgtcagtcaacccct

SEQ ID NO: 416406 - DNA, 25 bp, Homo sapien
tcaacccctttctgcatgcacagtg

SEQ ID NO: 416407 - DNA, 25 bp, Homo sapien
gcatgcacagtggatttagggtaaa

SEQ ID NO: 416408 - DNA, 25 bp, Homo sapien
atgactcatgaacttaaggtactta

SEQ ID NO: 416409 - DNA, 25 bp, Homo sapien
ccatagcggagaactactgagttaa

SEQ ID NO: 416410 - DNA, 25 bp, Homo sapien
ctgctttgccttctttaagaaggaa

SEQ ID NO: 416411 - DNA, 25 bp, Homo sapien
tgctttgccttctttaagaaggaaa

SEQ ID NO: 416412 - DNA, 25 bp, Homo sapien
tgcctgtagtccctggcaatttggg

SEQ ID NO: 416413 - DNA, 25 bp, Homo sapien
cctgtagtccctggcaatttgggag

SEQ ID NO: 416414 - DNA, 25 bp, Homo sapien
tgtagtccctggcaatttgggaggc

SEQ ID NO: 416415 - DNA, 25 bp, Homo sapien
gtagtccctggcaatttgggaggcc

SEQ ID NO: 416416 - DNA, 25 bp, Homo sapien
ctggccggcagggtgaagccccgtc

SEQ ID NO: 416417 - DNA, 25 bp, Homo sapien
tggccggcagggtgaagccccgtct

SEQ ID NO: 416418 - DNA, 25 bp, Homo sapien
ttagtcaggcgtggtgatacatgcc

SEQ ID NO: 416419 - DNA, 25 bp, Homo sapien
tagtcaggcgtggtgatacatgcct

SEQ ID NO: 416420 - DNA, 25 bp, Homo sapien
agctgctcggggagctgacgcagga

SEQ ID NO: 416421 - DNA, 25 bp, Homo sapien
tctgaataaatgtgaaacccgaaac

SEQ ID NO: 416422 - DNA, 25 bp, Homo sapien
agggatacttaacagcctagtggta

SEQ ID NO: 416423 - DNA, 25 bp, Homo sapien
aacagcctagtggtataaacttgaa

SEQ ID NO: 416424 - DNA, 25 bp, Homo sapien
tagtggtataaacttgaataacctt

SEQ ID NO: 416425 - DNA, 25 bp, Homo sapien
aatgatactcttaacaattctaagg

SEQ ID NO: 416426 - DNA, 25 bp, Homo sapien
atagtcactgtgcattaaagagctg

SEQ ID NO: 416427 - DNA, 25 bp, Homo sapien
taaagagctgcacaaagatattcat

SEQ ID NO: 416428 - DNA, 25 bp, Homo sapien
agatattcatggcagcattttttgt

SEQ ID NO: 416429 - DNA, 25 bp, Homo sapien
catggcagcattttttgttgtcaac

SEQ ID NO: 416430 - DNA, 25 bp, Homo sapien
tggcagcattttttgttgtcaactg

SEQ ID NO: 416431 - DNA, 25 bp, Homo sapien
caactgtatataatatgaactgcat

SEQ ID NO: 416432 - DNA, 25 bp, Homo sapien
gagccatattggattgttcttcatg

SEQ ID NO: 416433 - DNA, 25 bp, Homo sapien
ggattgttcttcatgatcgaattgt

SEQ ID NO: 416434 - DNA, 25 bp, Homo sapien
gatcgaattgtgagtgtcatcagca

SEQ ID NO: 416435 - DNA, 25 bp, Homo sapien
ttgtgagtgtcatcagcagccccag

SEQ ID NO: 416436 - DNA, 25 bp, Homo sapien
gccccagcttgacgtctgaaacaga

SEQ ID NO: 416437 - DNA, 25 bp, Homo sapien
cttgacgtctgaaacagagtgggtt

SEQ ID NO: 416438 - DNA, 25 bp, Homo sapien
ttgatttcactgcctgtcatcagtc

SEQ ID NO: 416439 - DNA, 25 bp, Homo sapien
gctatacgttagctcttgcacatgc

SEQ ID NO: 416440 - DNA, 25 bp, Homo sapien
tagctcttgcacatgctgtgtggca

SEQ ID NO: 416441 - DNA, 25 bp, Homo sapien
gcacatgctgtgtggcaccattcta

SEQ ID NO: 416442 - DNA, 25 bp, Homo sapien
atgctgtgtggcaccattctagcat

SEQ ID NO: 416443 - DNA, 25 bp, Homo sapien
ggagcaccaggacagagcagccttt

SEQ ID NO: 416444 - DNA, 25 bp, Homo sapien
tgcccctgtggacctcgaatgcaga

SEQ ID NO: 416445 - DNA, 25 bp, Homo sapien
tgtggacctcgaatgcagagcttat

SEQ ID NO: 416446 - DNA, 25 bp, Homo sapien
tgcagagcttatgcacctaccgaag

SEQ ID NO: 416447 - DNA, 25 bp, Homo sapien
gtgtcagcacccaaggcagaacgag

SEQ ID NO: 416448 - DNA, 25 bp, Homo sapien
agcacccaaggcagaacgaggctgc

SEQ ID NO: 416449 - DNA, 25 bp, Homo sapien
gctgccctgggaactagggtcaatt

SEQ ID NO: 416450 - DNA, 25 bp, Homo sapien
agggtcaattaaaacagcttgtgct

SEQ ID NO: 416451 - DNA, 25 bp, Homo sapien
agaaaagatggagcacacgctgggt

SEQ ID NO: 416452 - DNA, 25 bp, Homo sapien
atggagcacacgctgggtggtggcc

SEQ ID NO: 416453 - DNA, 25 bp, Homo sapien
aaggagatggtgctcttcttttttc

SEQ ID NO: 416454 - DNA, 25 bp, Homo sapien
tggtagcacagtcataccctttaat

SEQ ID NO: 416455 - DNA, 25 bp, Homo sapien
aaatcgatcataagggaagcatctc

SEQ ID NO: 416456 - DNA, 25 bp, Homo sapien
cataagggaagcatctcaggttttt

SEQ ID NO: 416457 - DNA, 25 bp, Homo sapien
aaaaatgactttctattgacacgat

SEQ ID NO: 416458 - DNA, 25 bp, Homo sapien
atgactttctattgacacgatttgt

SEQ ID NO: 416459 - DNA, 25 bp, Homo sapien
ctattgacacgatttgttatttcag

SEQ ID NO: 416460 - DNA, 25 bp, Homo sapien
gcaaaatagaagtctgtcagtctaa

SEQ ID NO: 416461 - DNA, 25 bp, Homo sapien
aatagaagtctgtcagtctaatgtt

SEQ ID NO: 416462 - DNA, 25 bp, Homo sapien
tgttcaaacagcatgatattaactt

SEQ ID NO: 416463 - DNA, 25 bp, Homo sapien
aagcacaaatgcttcatgcatataa

SEQ ID NO: 416464 - DNA, 25 bp, Homo sapien
gcttcatgcatataacttaaagagt

SEQ ID NO: 416465 - DNA, 25 bp, Homo sapien
acagaattagagcatccctcgtcca

SEQ ID NO: 416466 - DNA, 25 bp, Homo sapien
tgtctggtttatcccatgtctccaa

SEQ ID NO: 416467 - DNA, 25 bp, Homo sapien
gacctgagtaattcccagagcctgt

SEQ ID NO: 416468 - DNA, 25 bp, Homo sapien
atgtctccaatttccagggttgttt

SEQ ID NO: 416469 - DNA, 25 bp, Homo sapien
ttttctcagctttatgctttctgaa

SEQ ID NO: 416470 - DNA, 25 bp, Homo sapien
agtcagggttttctctcagagtttt

SEQ ID NO: 416471 - DNA, 25 bp, Homo sapien
agttttagctgttcgtgttgttgtg

SEQ ID NO: 416472 - DNA, 25 bp, Homo sapien
gttgttgtgaaggtccacctgactg

SEQ ID NO: 416473 - DNA, 25 bp, Homo sapien
tgactgggacagttctcagggaaaa

SEQ ID NO: 416474 - DNA, 25 bp, Homo sapien
gtttgggcacatttttgcagctcgg

SEQ ID NO: 416475 - DNA, 25 bp, Homo sapien
ctgggacttctgttgattcatatac

SEQ ID NO: 416476 - DNA, 25 bp, Homo sapien
atgtcttccacaagattattagaaa

SEQ ID NO: 416477 - DNA, 25 bp, Homo sapien
acatttatgaggtatcaggtgttgt

SEQ ID NO: 416478 - DNA, 25 bp, Homo sapien
aggtatcaggtgttgttatgattta

SEQ ID NO: 416479 - DNA, 25 bp, Homo sapien
gaaactaattaacgtattcaaatga

SEQ ID NO: 416480 - DNA, 25 bp, Homo sapien
gattattagaaaactctgctacttt

SEQ ID NO: 416481 - DNA, 25 bp, Homo sapien
attagaaaactctgctactttgtag

SEQ ID NO: 416482 - DNA, 25 bp, Homo sapien
tagaaaactctgctactttgtagga

SEQ ID NO: 416483 - DNA, 25 bp, Homo sapien
gaaaactctgctactttgtaggagg

SEQ ID NO: 416484 - DNA, 25 bp, Homo sapien
aactctgctactttgtaggaggagc

SEQ ID NO: 416485 - DNA, 25 bp, Homo sapien
ctctgctactttgtaggaggagctt

SEQ ID NO: 416486 - DNA, 25 bp, Homo sapien
ctactttgtaggaggagctttggat

SEQ ID NO: 416487 - DNA, 25 bp, Homo sapien
tcttggtgaactggaaatatgctgt

SEQ ID NO: 416488 - DNA, 25 bp, Homo sapien
gtacttaagaacgtatctgatggcc

SEQ ID NO: 416489 - DNA, 25 bp, Homo sapien
cttaagaacgtatctgatggccggc

SEQ ID NO: 416490 - DNA, 25 bp, Homo sapien
taagaacgtatctgatggccggcac

SEQ ID NO: 416491 - DNA, 25 bp, Homo sapien
aagaacgtatctgatggccggcacg

SEQ ID NO: 416492 - DNA, 25 bp, Homo sapien
agaacgtatctgatggccggcacgc

SEQ ID NO: 416493 - DNA, 25 bp, Homo sapien
tggtgaactggaaatatgctgtgtc

SEQ ID NO: 416494 - DNA, 25 bp, Homo sapien
gtgaactggaaatatgctgtgtcat

SEQ ID NO: 416495 - DNA, 25 bp, Homo sapien
taacttgttcttgaatttgaagatg

SEQ ID NO: 416496 - DNA, 25 bp, Homo sapien
gacacaaatgatatttaagtctttc

SEQ ID NO: 416497 - DNA, 25 bp, Homo sapien
gatatttaagtctttcaaattcaaa

SEQ ID NO: 416498 - DNA, 25 bp, Homo sapien
ccccttgctttctggagacaattaa

SEQ ID NO: 416499 - DNA, 25 bp, Homo sapien
agaatacttgtgtagatcacctgaa

SEQ ID NO: 416500 - DNA, 25 bp, Homo sapien
gtagatcacctgaaactgtttccca

SEQ ID NO: 416501 - DNA, 25 bp, Homo sapien
actgtttcccaccaattgttgtttg

SEQ ID NO: 416502 - DNA, 25 bp, Homo sapien
gaacaggtgagtgaggtagaacata

SEQ ID NO: 416503 - DNA, 25 bp, Homo sapien
atttaatgtgctcctactggtttag

SEQ ID NO: 416504 - DNA, 25 bp, Homo sapien
gaacatagtacagattctctctagc

SEQ ID NO: 416505 - DNA, 25 bp, Homo sapien
gattctctctagcatgaggttatgt

SEQ ID NO: 416506 - DNA, 25 bp, Homo sapien
tactggtttaggatgctaggttcat

SEQ ID NO: 416507 - DNA, 25 bp, Homo sapien
gatgctaggttcatctaaatgtgca

SEQ ID NO: 416508 - DNA, 25 bp, Homo sapien
gtgcataactacttttagggtctta

SEQ ID NO: 416509 - DNA, 25 bp, Homo sapien
gtgaatgcctgttctattcagattt

SEQ ID NO: 416510 - DNA, 25 bp, Homo sapien
gaatgcctgttctattcagatttac

SEQ ID NO: 416511 - DNA, 25 bp, Homo sapien
gcctgttctattcagatttacctct

SEQ ID NO: 416512 - DNA, 25 bp, Homo sapien
tgttctattcagatttacctcttag

SEQ ID NO: 416513 - DNA, 25 bp, Homo sapien
tattcagatttacctcttagataag

SEQ ID NO: 416514 - DNA, 25 bp, Homo sapien
tcagatttacctcttagataagttg

SEQ ID NO: 416515 - DNA, 25 bp, Homo sapien
tagataagttgttccagctaccccg

SEQ ID NO: 416516 - DNA, 25 bp, Homo sapien
gataagttgttccagctaccccggg

SEQ ID NO: 416517 - DNA, 25 bp, Homo sapien
ttgttccagctaccccgggaaggag

SEQ ID NO: 416518 - DNA, 25 bp, Homo sapien
ttgaactgtaacaccctgtacatgg

SEQ ID NO: 416519 - DNA, 25 bp, Homo sapien
tgaactgtaacaccctgtacatggg

SEQ ID NO: 416520 - DNA, 25 bp, Homo sapien
ttcccttttaatatagtcattgcca

SEQ ID NO: 416521 - DNA, 25 bp, Homo sapien
tatagtcattgccagtttccagagg

SEQ ID NO: 416522 - DNA, 25 bp, Homo sapien
gttctctttctgtgaaatgtacact

SEQ ID NO: 416523 - DNA, 25 bp, Homo sapien
gtacacttggcccttaaatactaat

SEQ ID NO: 416524 - DNA, 25 bp, Homo sapien
attgagactctattgtatgctaaat

SEQ ID NO: 416525 - DNA, 25 bp, Homo sapien
gtaaatatgactgggtctctctcct

SEQ ID NO: 416526 - DNA, 25 bp, Homo sapien
gtctctctccttaggtggatcgtgg

SEQ ID NO: 416527 - DNA, 25 bp, Homo sapien
tggatcgtggcctagtagagattaa

SEQ ID NO: 416528 - DNA, 25 bp, Homo sapien
gagattaaatacttgtcagtgtctt

SEQ ID NO: 416529 - DNA, 25 bp, Homo sapien
gtcagtgtctttattgtacttattt

SEQ ID NO: 416530 - DNA, 25 bp, Homo sapien
tttgcatatagcatacttctaggta

SEQ ID NO: 416531 - DNA, 25 bp, Homo sapien
accccaggacttctcattatagatt

SEQ ID NO: 416532 - DNA, 25 bp, Homo sapien
atagatttcctggagcacgcagcag

SEQ ID NO: 416533 - DNA, 25 bp, Homo sapien
gagcacgcagcagaaactttgccta

SEQ ID NO: 416534 - DNA, 25 bp, Homo sapien
cagaaactttgcctagcccagtggt

SEQ ID NO: 416535 - DNA, 25 bp, Homo sapien
ctagcccagtggttgtttccattat

SEQ ID NO: 416536 - DNA, 25 bp, Homo sapien
ttgtttccattatctgctgccaaag

SEQ ID NO: 416537 - DNA, 25 bp, Homo sapien
ttatctgctgccaaagtgggatttg

SEQ ID NO: 416538 - DNA, 25 bp, Homo sapien
tccatccacaagatacctgtagcag

SEQ ID NO: 416539 - DNA, 25 bp, Homo sapien
acaagatacctgtagcagtgtcctg

SEQ ID NO: 416540 - DNA, 25 bp, Homo sapien
gtgtcctgccaacggtaacaatcaa

SEQ ID NO: 416541 - DNA, 25 bp, Homo sapien
gtatgtcatcagacattgcccaatg

SEQ ID NO: 416542 - DNA, 25 bp, Homo sapien
taccatgtcaggatatttttagtgt

SEQ ID NO: 416543 - DNA, 25 bp, Homo sapien
accatgtcaggatatttttagtgtc

SEQ ID NO: 416544 - DNA, 25 bp, Homo sapien
atatttttagtgtctcaaggcctga

SEQ ID NO: 416545 - DNA, 25 bp, Homo sapien
tatttttagtgtctcaaggcctgaa

SEQ ID NO: 416546 - DNA, 25 bp, Homo sapien
atttttagtgtctcaaggcctgaat

SEQ ID NO: 416547 - DNA, 25 bp, Homo sapien
tttttagtgtctcaaggcctgaatc

SEQ ID NO: 416548 - DNA, 25 bp, Homo sapien
ttttagtgtctcaaggcctgaatca

SEQ ID NO: 416549 - DNA, 25 bp, Homo sapien
tttagtgtctcaaggcctgaatcac

SEQ ID NO: 416550 - DNA, 25 bp, Homo sapien
ttagtgtctcaaggcctgaatcacc

SEQ ID NO: 416551 - DNA, 25 bp, Homo sapien
gtgtctcaaggcctgaatcacctga

SEQ ID NO: 416552 - DNA, 25 bp, Homo sapien
tgtctcaaggcctgaatcacctgaa

SEQ ID NO: 416553 - DNA, 25 bp, Homo sapien
tcctgctccggtcttctgagtagca

SEQ ID NO: 416554 - DNA, 25 bp, Homo sapien
tgctccggtcttctgagtagcagga

SEQ ID NO: 416555 - DNA, 25 bp, Homo sapien
gctccggtcttctgagtagcaggaa

SEQ ID NO: 416556 - DNA, 25 bp, Homo sapien
tccggtcttctgagtagcaggaacc

SEQ ID NO: 416557 - DNA, 25 bp, Homo sapien
ggtcttctgagtagcaggaaccaca

SEQ ID NO: 416558 - DNA, 25 bp, Homo sapien
aggtgtgagtcacctcaccggccct

SEQ ID NO: 416559 - DNA, 25 bp, Homo sapien
gtgagtcacctcaccggcccttaaa

SEQ ID NO: 416560 - DNA, 25 bp, Homo sapien
gaagcagtgtgcattcattagtact

SEQ ID NO: 416561 - DNA, 25 bp, Homo sapien
agcagtgtgcattcattagtactgt

SEQ ID NO: 416562 - DNA, 25 bp, Homo sapien
gtgtgcattcattagtactgtgttt

SEQ ID NO: 416563 - DNA, 25 bp, Homo sapien
gcattcattagtactgtgtttgcct

SEQ ID NO: 416564 - DNA, 25 bp, Homo sapien
attcccaatttaccatttcctgtct

SEQ ID NO: 416565 - DNA, 25 bp, Homo sapien
tttcctgtcttgaataatcccaaca

SEQ ID NO: 416566 - DNA, 25 bp, Homo sapien
tgtcttgaataatcccaacaaaacc

SEQ ID NO: 416567 - DNA, 25 bp, Homo sapien
caaaaccatttgaatcctcaagtaa

SEQ ID NO: 416568 - DNA, 25 bp, Homo sapien
gaaagaattatcttctacttccata

SEQ ID NO: 416569 - DNA, 25 bp, Homo sapien
gaattatcttctacttccataaata

SEQ ID NO: 416570 - DNA, 25 bp, Homo sapien
tatcttctacttccataaatatatt

SEQ ID NO: 416571 - DNA, 25 bp, Homo sapien
atagagtctattttcacttaaacag

SEQ ID NO: 416572 - DNA, 25 bp, Homo sapien
ttcacttaaacagagaactatgact

SEQ ID NO: 416573 - DNA, 25 bp, Homo sapien
gagaactatgactgaagtgttatta

SEQ ID NO: 416574 - DNA, 25 bp, Homo sapien
atgcatgataagtatatttctaagt

SEQ ID NO: 416575 - DNA, 25 bp, Homo sapien
tacagtgcaggttacaaaagtctaa

SEQ ID NO: 416576 - DNA, 25 bp, Homo sapien
aatgcaaatcctgaagtgctcgtaa

SEQ ID NO: 416577 - DNA, 25 bp, Homo sapien
gtgctcgtaaggacaattgatcatt

SEQ ID NO: 416578 - DNA, 25 bp, Homo sapien
gatcatttatcaagacgccaagcca

SEQ ID NO: 416579 - DNA, 25 bp, Homo sapien
aagacgccaagccaagcaaattgtt

SEQ ID NO: 416580 - DNA, 25 bp, Homo sapien
agcaaattgtttcatcagcaaagat

SEQ ID NO: 416581 - DNA, 25 bp, Homo sapien
cagaagccctgcaagaagaggtaga

SEQ ID NO: 416582 - DNA, 25 bp, Homo sapien
gagttactaagattgccttctgatt

SEQ ID NO: 416583 - DNA, 25 bp, Homo sapien
ttctgatttccctggtgctgtggct

SEQ ID NO: 416584 - DNA, 25 bp, Homo sapien
atttccctggtgctgtggcttcttc

SEQ ID NO: 416585 - DNA, 25 bp, Homo sapien
caaagcatgaagctatctgatgaga

SEQ ID NO: 416586 - DNA, 25 bp, Homo sapien
cagtgtggaaacttgtgcctcttct

SEQ ID NO: 416587 - DNA, 25 bp, Homo sapien
tgtggaaacttgtgcctcttcttag

SEQ ID NO: 416588 - DNA, 25 bp, Homo sapien
gaaacttgtgcctcttcttagtata

SEQ ID NO: 416589 - DNA, 25 bp, Homo sapien
attgtgtgtgttaaggctttccagt

SEQ ID NO: 416590 - DNA, 25 bp, Homo sapien
gtgtgttaaggctttccagtatttt

SEQ ID NO: 416591 - DNA, 25 bp, Homo sapien
tgttaaggctttccagtattttctg

SEQ ID NO: 416592 - DNA, 25 bp, Homo sapien
tagtgcttttattggtgagtatatt

SEQ ID NO: 416593 - DNA, 25 bp, Homo sapien
ccagtattttctgagcattggaatg

SEQ ID NO: 416594 - DNA, 25 bp, Homo sapien
gagcattggaatgtagtcagtccct

SEQ ID NO: 416595 - DNA, 25 bp, Homo sapien
tggaatgtagtcagtccctacctct

SEQ ID NO: 416596 - DNA, 25 bp, Homo sapien
tgcttttagggagaacagtgtggaa

SEQ ID NO: 416597 - DNA, 25 bp, Homo sapien
agctcaattgctactccttaagtgg

SEQ ID NO: 416598 - DNA, 25 bp, Homo sapien
caattgctactccttaagtggacac

SEQ ID NO: 416599 - DNA, 25 bp, Homo sapien
cttaagtggacacacagctttgcac

SEQ ID NO: 416600 - DNA, 25 bp, Homo sapien
tctctgtgccaagcaattggtttgg

SEQ ID NO: 416601 - DNA, 25 bp, Homo sapien
tgggaaaacccctcttcacgtggct

SEQ ID NO: 416602 - DNA, 25 bp, Homo sapien
acccctcttcacgtggcttgtgaaa

SEQ ID NO: 416603 - DNA, 25 bp, Homo sapien
tcacgtggcttgtgaaatggccaat

SEQ ID NO: 416604 - DNA, 25 bp, Homo sapien
aaatggccaatgtggattgtgttaa

SEQ ID NO: 416605 - DNA, 25 bp, Homo sapien
gattgtgttaagatcctctgtgatc

SEQ ID NO: 416606 - DNA, 25 bp, Homo sapien
tgttaagatcctctgtgatcgtggg

SEQ ID NO: 416607 - DNA, 25 bp, Homo sapien
gggcaaagctcaattgctactcctt

SEQ ID NO: 416608 - DNA, 25 bp, Homo sapien
ggcctctctcctctgtcagagtgga

SEQ ID NO: 416609 - DNA, 25 bp, Homo sapien
gcctctctcctctgtcagagtggag

SEQ ID NO: 416610 - DNA, 25 bp, Homo sapien
tcctctgtcagagtggagtcccgag

SEQ ID NO: 416611 - DNA, 25 bp, Homo sapien
tctgtcagagtggagtcccgagctc

SEQ ID NO: 416612 - DNA, 25 bp, Homo sapien
gtcagagtggagtcccgagctccca

SEQ ID NO: 416613 - DNA, 25 bp, Homo sapien
gagtggagtcccgagctcccagaaa

SEQ ID NO: 416614 - DNA, 25 bp, Homo sapien
agtggagtcccgagctcccagaaat

SEQ ID NO: 416615 - DNA, 25 bp, Homo sapien
tggagtcccgagctcccagaaatgc

SEQ ID NO: 416616 - DNA, 25 bp, Homo sapien
gagtcccgagctcccagaaatgcca

SEQ ID NO: 416617 - DNA, 25 bp, Homo sapien
cgagctcccagaaatgccacatgat

SEQ ID NO: 416618 - DNA, 25 bp, Homo sapien
gagctcccagaaatgccacatgatg

SEQ ID NO: 416619 - DNA, 25 bp, Homo sapien
agggctgaaactaggcattaaatat

SEQ ID NO: 416620 - DNA, 25 bp, Homo sapien
ataactgatgctcaaaggtaagatt

SEQ ID NO: 416621 - DNA, 25 bp, Homo sapien
aggtaagatttccatccaacagatt

SEQ ID NO: 416622 - DNA, 25 bp, Homo sapien
aggcagtgctgctacttatcccaaa

SEQ ID NO: 416623 - DNA, 25 bp, Homo sapien
gcagtgctgctacttatcccaaata

SEQ ID NO: 416624 - DNA, 25 bp, Homo sapien
gtgctgctacttatcccaaataaaa

SEQ ID NO: 416625 - DNA, 25 bp, Homo sapien
gctacttatcccaaataaaatggta

SEQ ID NO: 416626 - DNA, 25 bp, Homo sapien
atcttcctttcgctccttgactttc

SEQ ID NO: 416627 - DNA, 25 bp, Homo sapien
tgactttccttgacttgctgttgga

SEQ ID NO: 416628 - DNA, 25 bp, Homo sapien
actttccttgacttgctgttggaaa

SEQ ID NO: 416629 - DNA, 25 bp, Homo sapien
gaaagtctaatatgaaaagggctga

SEQ ID NO: 416630 - DNA, 25 bp, Homo sapien
attaatcttttctttatggtcttgg

SEQ ID NO: 416631 - DNA, 25 bp, Homo sapien
tggtcttggactttattgttgcata

SEQ ID NO: 416632 - DNA, 25 bp, Homo sapien
ggactttattgttgcataaccgctg

SEQ ID NO: 416633 - DNA, 25 bp, Homo sapien
tattgttgcataaccgctgccttca

SEQ ID NO: 416634 - DNA, 25 bp, Homo sapien
ataaccgctgccttcaccaggaaca

SEQ ID NO: 416635 - DNA, 25 bp, Homo sapien
aaatgttcttctgagattttatgat

SEQ ID NO: 416636 - DNA, 25 bp, Homo sapien
gatgtatatttagcaccttttcata

SEQ ID NO: 416637 - DNA, 25 bp, Homo sapien
gcaccttttcatatatcactctttg

SEQ ID NO: 416638 - DNA, 25 bp, Homo sapien
atcactctttgtcacatattatgca

SEQ ID NO: 416639 - DNA, 25 bp, Homo sapien
ctaatttgtcatttccatcaatttt

SEQ ID NO: 416640 - DNA, 25 bp, Homo sapien
atgcttcatttttaagctgtcagat

SEQ ID NO: 416641 - DNA, 25 bp, Homo sapien
attaaaaatgtctatcctcagccgg

SEQ ID NO: 416642 - DNA, 25 bp, Homo sapien
ttaaaaatgtctatcctcagccggg

SEQ ID NO: 416643 - DNA, 25 bp, Homo sapien
taaaaatgtctatcctcagccgggc

SEQ ID NO: 416644 - DNA, 25 bp, Homo sapien
aaaaatgtctatcctcagccgggcg

SEQ ID NO: 416645 - DNA, 25 bp, Homo sapien
aaaatgtctatcctcagccgggcgt

SEQ ID NO: 416646 - DNA, 25 bp, Homo sapien
aaatgtctatcctcagccgggcgtg

SEQ ID NO: 416647 - DNA, 25 bp, Homo sapien
aatgtctatcctcagccgggcgtgg

SEQ ID NO: 416648 - DNA, 25 bp, Homo sapien
atgtctatcctcagccgggcgtggt

SEQ ID NO: 416649 - DNA, 25 bp, Homo sapien
tgtctatcctcagccgggcgtggta

SEQ ID NO: 416650 - DNA, 25 bp, Homo sapien
gtctatcctcagccgggcgtggtag

SEQ ID NO: 416651 - DNA, 25 bp, Homo sapien
tttggggggtcgagatgggcagatc

SEQ ID NO: 416652 - DNA, 25 bp, Homo sapien
ccagagcgcgttagtaagcttcaat

SEQ ID NO: 416653 - DNA, 25 bp, Homo sapien
gcgttagtaagcttcaatcaggatt

SEQ ID NO: 416654 - DNA, 25 bp, Homo sapien
aatcttaatatagtgctgagggttt

SEQ ID NO: 416655 - DNA, 25 bp, Homo sapien
gagttagcttttgtgcaagcactat

SEQ ID NO: 416656 - DNA, 25 bp, Homo sapien
cactattattcatggaagtcccctt

SEQ ID NO: 416657 - DNA, 25 bp, Homo sapien
actaagctgtccttctatctctgtg

SEQ ID NO: 416658 - DNA, 25 bp, Homo sapien
gctgtctcagagaagcactgtggaa

SEQ ID NO: 416659 - DNA, 25 bp, Homo sapien
tggaactccagggtgctacgtagct

SEQ ID NO: 416660 - DNA, 25 bp, Homo sapien
gtgctacgtagctcaccacggtgac

SEQ ID NO: 416661 - DNA, 25 bp, Homo sapien
aatgcaggccacttacagaagcttg

SEQ ID NO: 416662 - DNA, 25 bp, Homo sapien
agcttgaagatctgtgatttgctca

SEQ ID NO: 416663 - DNA, 25 bp, Homo sapien
gtgaggtgatgccccgccttgcttt

SEQ ID NO: 416664 - DNA, 25 bp, Homo sapien
gtgatgccccgccttgctttggctt

SEQ ID NO: 416665 - DNA, 25 bp, Homo sapien
tgatgccccgccttgctttggcttg

SEQ ID NO: 416666 - DNA, 25 bp, Homo sapien
tgctggttgctaagaccgtgggaaa

SEQ ID NO: 416667 - DNA, 25 bp, Homo sapien
gctggttgctaagaccgtgggaaaa

SEQ ID NO: 416668 - DNA, 25 bp, Homo sapien
gaaaagtgcagtattagggcagaag

SEQ ID NO: 416669 - DNA, 25 bp, Homo sapien
aaaagtgcagtattagggcagaagt

SEQ ID NO: 416670 - DNA, 25 bp, Homo sapien
agtgcagtattagggcagaagtgtc

SEQ ID NO: 416671 - DNA, 25 bp, Homo sapien
gtgcagtattagggcagaagtgtcc

SEQ ID NO: 416672 - DNA, 25 bp, Homo sapien
gaagtgtcccatttttccaggtaca

SEQ ID NO: 416673 - DNA, 25 bp, Homo sapien
aagtgtcccatttttccaggtacag

SEQ ID NO: 416674 - DNA, 25 bp, Homo sapien
tttttcccgagaagagctccagctc

SEQ ID NO: 416675 - DNA, 25 bp, Homo sapien
agctccagctcgcaggtccttagaa

SEQ ID NO: 416676 - DNA, 25 bp, Homo sapien
ggaaccaacggccagctccttggcg

SEQ ID NO: 416677 - DNA, 25 bp, Homo sapien
gcaaacgggcatttccttgaacttt

SEQ ID NO: 416678 - DNA, 25 bp, Homo sapien
gaacttttgagagtgcctttgacca

SEQ ID NO: 416679 - DNA, 25 bp, Homo sapien
gctgttcgcagctgggaaactccaa

SEQ ID NO: 416680 - DNA, 25 bp, Homo sapien
gggaaactccaacttttgaagtcag

SEQ ID NO: 416681 - DNA, 25 bp, Homo sapien
tgaagtcagagcttggagcggcccc

SEQ ID NO: 416682 - DNA, 25 bp, Homo sapien
cccagagctgggagccattgcttat

SEQ ID NO: 416683 - DNA, 25 bp, Homo sapien
gagccattgcttatgcaagcccgtt

SEQ ID NO: 416684 - DNA, 25 bp, Homo sapien
gcaagcccgtttcttttgatgtaaa

SEQ ID NO: 416685 - DNA, 25 bp, Homo sapien
ttgtcaaatgctacagtgtgaacat

SEQ ID NO: 416686 - DNA, 25 bp, Homo sapien
caaatgctacagtgtgaacatgtat

SEQ ID NO: 416687 - DNA, 25 bp, Homo sapien
tattttgaatattctgtaacagggc

SEQ ID NO: 416688 - DNA, 25 bp, Homo sapien
taacagggcaagtttccactctaag

SEQ ID NO: 416689 - DNA, 25 bp, Homo sapien
acagggcaagtttccactctaagca

SEQ ID NO: 416690 - DNA, 25 bp, Homo sapien
agggcaagtttccactctaagcagc

SEQ ID NO: 416691 - DNA, 25 bp, Homo sapien
gcaagtttccactctaagcagctat

SEQ ID NO: 416692 - DNA, 25 bp, Homo sapien
aagtttccactctaagcagctattt

SEQ ID NO: 416693 - DNA, 25 bp, Homo sapien
agtttccactctaagcagctattta

SEQ ID NO: 416694 - DNA, 25 bp, Homo sapien
ttccactctaagcagctatttaaaa

SEQ ID NO: 416695 - DNA, 25 bp, Homo sapien
tggtaataaatgcttatgcttaagt

SEQ ID NO: 416696 - DNA, 25 bp, Homo sapien
ggaaacatcaaagcaagttacaagg

SEQ ID NO: 416697 - DNA, 25 bp, Homo sapien
agttttacagtgttggcagcctagg

SEQ ID NO: 416698 - DNA, 25 bp, Homo sapien
caggtatcacttaacttttcttcaa

SEQ ID NO: 416699 - DNA, 25 bp, Homo sapien
tatcacttaacttttcttcaagaag

SEQ ID NO: 416700 - DNA, 25 bp, Homo sapien
gaaggtctatgagttacattttact

SEQ ID NO: 416701 - DNA, 25 bp, Homo sapien
ggtatcccaggcatcaaggagtgta

SEQ ID NO: 416702 - DNA, 25 bp, Homo sapien
caggcatcaaggagtgtaactttca

SEQ ID NO: 416703 - DNA, 25 bp, Homo sapien
aggagtgtaactttcaatgaatcaa

SEQ ID NO: 416704 - DNA, 25 bp, Homo sapien
tcattttaaattccagcctctgttt

SEQ ID NO: 416705 - DNA, 25 bp, Homo sapien
agcctctgtttaaagaaggatctta

SEQ ID NO: 416706 - DNA, 25 bp, Homo sapien
gagaaattaaccacctgacccaggg

SEQ ID NO: 416707 - DNA, 25 bp, Homo sapien
attttctttcccctgaaagattgtg

SEQ ID NO: 416708 - DNA, 25 bp, Homo sapien
tctttcccctgaaagattgtgttag

SEQ ID NO: 416709 - DNA, 25 bp, Homo sapien
gttagtttgtaacacactctcacag

SEQ ID NO: 416710 - DNA, 25 bp, Homo sapien
gtttgtaacacactctcacagtacc

SEQ ID NO: 416711 - DNA, 25 bp, Homo sapien
actctcacagtaccactgtaaaata

SEQ ID NO: 416712 - DNA, 25 bp, Homo sapien
taatttggaatatgcttctaacttt

SEQ ID NO: 416713 - DNA, 25 bp, Homo sapien
tatgcttctaacttttttaccctct

SEQ ID NO: 416714 - DNA, 25 bp, Homo sapien
tttaccctcttttaggtgatgaagg

SEQ ID NO: 416715 - DNA, 25 bp, Homo sapien
ggagagacggatgtaagatttacca

SEQ ID NO: 416716 - DNA, 25 bp, Homo sapien
gacggatgtaagatttaccaatatc

SEQ ID NO: 416717 - DNA, 25 bp, Homo sapien
atatgttgatcttaaaagccaatgt

SEQ ID NO: 416718 - DNA, 25 bp, Homo sapien
ttggcttttccatgttagtaagaca

SEQ ID NO: 416719 - DNA, 25 bp, Homo sapien
aggcatgtttcagtcacgatgtaat

SEQ ID NO: 416720 - DNA, 25 bp, Homo sapien
agtcacgatgtaatatttcctaaaa

SEQ ID NO: 416721 - DNA, 25 bp, Homo sapien
tttcctaaaattttgaagctatggg

SEQ ID NO: 416722 - DNA, 25 bp, Homo sapien
gtaagcaaacaatacttagtacatt

SEQ ID NO: 416723 - DNA, 25 bp, Homo sapien
gaaattgccattgtatgtgtggtct

SEQ ID NO: 416724 - DNA, 25 bp, Homo sapien
ttgtatgtgtggtctgactgccaga

SEQ ID NO: 416725 - DNA, 25 bp, Homo sapien
gtgtggtctgactgccagaaaacct

SEQ ID NO: 416726 - DNA, 25 bp, Homo sapien
acctaaaataagtaaactgctgcca

SEQ ID NO: 416727 - DNA, 25 bp, Homo sapien
aactgctgccatgatgaaaagtcaa

SEQ ID NO: 416728 - DNA, 25 bp, Homo sapien
gtcaaggagtaagttggcttttcca

SEQ ID NO: 416729 - DNA, 25 bp, Homo sapien
aaataaataatgagctgcatgtggt

SEQ ID NO: 416730 - DNA, 25 bp, Homo sapien
gtgcacctgtgatcctagctccgtg

SEQ ID NO: 416731 - DNA, 25 bp, Homo sapien
tgcacctgtgatcctagctccgtgg

SEQ ID NO: 416732 - DNA, 25 bp, Homo sapien
acctgtgatcctagctccgtgggag

SEQ ID NO: 416733 - DNA, 25 bp, Homo sapien
aggcgatagggggagaccctctctc

SEQ ID NO: 416734 - DNA, 25 bp, Homo sapien
agtctttcttgaattcactatacag

SEQ ID NO: 416735 - DNA, 25 bp, Homo sapien
gtctttcttgaattcactatacagc

SEQ ID NO: 416736 - DNA, 25 bp, Homo sapien
tctttcttgaattcactatacagca

SEQ ID NO: 416737 - DNA, 25 bp, Homo sapien
ctttcttgaattcactatacagcaa

SEQ ID NO: 416738 - DNA, 25 bp, Homo sapien
tttcttgaattcactatacagcaag

SEQ ID NO: 416739 - DNA, 25 bp, Homo sapien
tgaggcgagaagatcgcttgaatcc

SEQ ID NO: 416740 - DNA, 25 bp, Homo sapien
gttcccttcatggttgattctgcct

SEQ ID NO: 416741 - DNA, 25 bp, Homo sapien
ttcccttcatggttgattctgcctt

SEQ ID NO: 416742 - DNA, 25 bp, Homo sapien
tcccttcatggttgattctgccttt

SEQ ID NO: 416743 - DNA, 25 bp, Homo sapien
cccttcatggttgattctgccttta

SEQ ID NO: 416744 - DNA, 25 bp, Homo sapien
ccttcatggttgattctgcctttaa

SEQ ID NO: 416745 - DNA, 25 bp, Homo sapien
cttcatggttgattctgcctttaaa

SEQ ID NO: 416746 - DNA, 25 bp, Homo sapien
ttcatggttgattctgcctttaaag

SEQ ID NO: 416747 - DNA, 25 bp, Homo sapien
tcatggttgattctgcctttaaagg

SEQ ID NO: 416748 - DNA, 25 bp, Homo sapien
catggttgattctgcctttaaagga

SEQ ID NO: 416749 - DNA, 25 bp, Homo sapien
atggttgattctgcctttaaaggag

SEQ ID NO: 416750 - DNA, 25 bp, Homo sapien
gttgattctgcctttaaaggagcct

SEQ ID NO: 416751 - DNA, 25 bp, Homo sapien
tttctcatattgagagctctgctat

SEQ ID NO: 416752 - DNA, 25 bp, Homo sapien
tgtccctagccctcacttcaaactc

SEQ ID NO: 416753 - DNA, 25 bp, Homo sapien
tttcattttccccttaggcatattt

SEQ ID NO: 416754 - DNA, 25 bp, Homo sapien
tatttttcccccaggcagatcattc

SEQ ID NO: 416755 - DNA, 25 bp, Homo sapien
ccccaggcagatcattctgagtgtg

SEQ ID NO: 416756 - DNA, 25 bp, Homo sapien
caggcagatcattctgagtgtgcga

SEQ ID NO: 416757 - DNA, 25 bp, Homo sapien
gatcattctgagtgtgcgagtgtgt

SEQ ID NO: 416758 - DNA, 25 bp, Homo sapien
gcacatgttacaaaggcaactacca

SEQ ID NO: 416759 - DNA, 25 bp, Homo sapien
atgttacaaaggcaactaccatgtt

SEQ ID NO: 416760 - DNA, 25 bp, Homo sapien
gttacaaaggcaactaccatgttaa

SEQ ID NO: 416761 - DNA, 25 bp, Homo sapien
caaaggcaactaccatgttaataaa

SEQ ID NO: 416762 - DNA, 25 bp, Homo sapien
ttggtttggagaggtaagcctttct

SEQ ID NO: 416763 - DNA, 25 bp, Homo sapien
ggtaagcctttctgggtggccaaca

SEQ ID NO: 416764 - DNA, 25 bp, Homo sapien
aagcctttctgggtggccaacattg

SEQ ID NO: 416765 - DNA, 25 bp, Homo sapien
tttctgggtggccaacattgttgtc

SEQ ID NO: 416766 - DNA, 25 bp, Homo sapien
gggtggccaacattgttgtctgctt

SEQ ID NO: 416767 - DNA, 25 bp, Homo sapien
gccaacattgttgtctgcttgtaca

SEQ ID NO: 416768 - DNA, 25 bp, Homo sapien
acattgttgtctgcttgtacactca

SEQ ID NO: 416769 - DNA, 25 bp, Homo sapien
actcatggtttcaagactttgtgac

SEQ ID NO: 416770 - DNA, 25 bp, Homo sapien
atggtttcaagactttgtgacccct

SEQ ID NO: 416771 - DNA, 25 bp, Homo sapien
cctacctaccccagatgatgtagta

SEQ ID NO: 416772 - DNA, 25 bp, Homo sapien
ataaagatgcaattatgcctagtac

SEQ ID NO: 416773 - DNA, 25 bp, Homo sapien
ggtgtgtgaactgctggaaaactgt

SEQ ID NO: 416774 - DNA, 25 bp, Homo sapien
gaactgctggaaaactgtactaaaa

SEQ ID NO: 416775 - DNA, 25 bp, Homo sapien
attagactagtggttggcaagctac

SEQ ID NO: 416776 - DNA, 25 bp, Homo sapien
tggttggcaagctacagcctgtgaa

SEQ ID NO: 416777 - DNA, 25 bp, Homo sapien
agcctgtgaaccaaatctagcctgc

SEQ ID NO: 416778 - DNA, 25 bp, Homo sapien
gtgaaccaaatctagcctgctgcct

SEQ ID NO: 416779 - DNA, 25 bp, Homo sapien
atgtttctatttatagcacctgtta

SEQ ID NO: 416780 - DNA, 25 bp, Homo sapien
gcacctgttatatcactgtaactgt

SEQ ID NO: 416781 - DNA, 25 bp, Homo sapien
atcactgtaactgtatgttggcatg

SEQ ID NO: 416782 - DNA, 25 bp, Homo sapien
gtatgttggcatgagtttcttctac

SEQ ID NO: 416783 - DNA, 25 bp, Homo sapien
gagtttcttctactaaatcaggggg

SEQ ID NO: 416784 - DNA, 25 bp, Homo sapien
gaagaaatttcttcactctcatttt

SEQ ID NO: 416785 - DNA, 25 bp, Homo sapien
ctctcatttttatagaaatcttgga

SEQ ID NO: 416786 - DNA, 25 bp, Homo sapien
gaaatcttggaatcagcttaagctg

SEQ ID NO: 416787 - DNA, 25 bp, Homo sapien
gcttaagctgtagcttttatgacaa

SEQ ID NO: 416788 - DNA, 25 bp, Homo sapien
agacagtcatttttggtcagagtga

SEQ ID NO: 416789 - DNA, 25 bp, Homo sapien
cagagtgatatttggtgacggaaac

SEQ ID NO: 416790 - DNA, 25 bp, Homo sapien
atttggtgacggaaacttgttcata

SEQ ID NO: 416791 - DNA, 25 bp, Homo sapien
tctcatttttagttctgatagttaa

SEQ ID NO: 416792 - DNA, 25 bp, Homo sapien
tttggtttgttctgtgccttcagtt

SEQ ID NO: 416793 - DNA, 25 bp, Homo sapien
ctgtgccttcagtttaaattatttc

SEQ ID NO: 416794 - DNA, 25 bp, Homo sapien
aatggtgtgaatcattcaggatgga

SEQ ID NO: 416795 - DNA, 25 bp, Homo sapien
ggtctattcttcagctgattctcta

SEQ ID NO: 416796 - DNA, 25 bp, Homo sapien
agtatttttgtttggagtctaagct

SEQ ID NO: 416797 - DNA, 25 bp, Homo sapien
gtctaagctagacttgttgggcatt

SEQ ID NO: 416798 - DNA, 25 bp, Homo sapien
ctggtcattccatacatctgtgtaa

SEQ ID NO: 416799 - DNA, 25 bp, Homo sapien
tgttttatacttactacttcatttc

SEQ ID NO: 416800 - DNA, 25 bp, Homo sapien
acttcatttccagtagatggcacca

SEQ ID NO: 416801 - DNA, 25 bp, Homo sapien
agatggcaccaaacaccctttgaag

SEQ ID NO: 416802 - DNA, 25 bp, Homo sapien
ggtcttcattatactaatccctagt

SEQ ID NO: 416803 - DNA, 25 bp, Homo sapien
aatccctagttggtgttgctggcta

SEQ ID NO: 416804 - DNA, 25 bp, Homo sapien
ttgataatttcatccaccaccaagg

SEQ ID NO: 416805 - DNA, 25 bp, Homo sapien
ggaacgaacatggtctattcttcag

SEQ ID NO: 416806 - DNA, 25 bp, Homo sapien
ttattcaacttgacagacttcacat

SEQ ID NO: 416807 - DNA, 25 bp, Homo sapien
ttcaacttgacagacttcacattac

SEQ ID NO: 416808 - DNA, 25 bp, Homo sapien
cttgacagacttcacattacacctt

SEQ ID NO: 416809 - DNA, 25 bp, Homo sapien
cagacttcacattacacctttcagt

SEQ ID NO: 416810 - DNA, 25 bp, Homo sapien
gacttcacattacacctttcagtaa

SEQ ID NO: 416811 - DNA, 25 bp, Homo sapien
tacacctttcagtaaattcaatcaa

SEQ ID NO: 416812 - DNA, 25 bp, Homo sapien
caaaagataaataatgggccggaca

SEQ ID NO: 416813 - DNA, 25 bp, Homo sapien
taatgggccggacaaggtggctcgt

SEQ ID NO: 416814 - DNA, 25 bp, Homo sapien
gggccggacaaggtggctcgtgcct

SEQ ID NO: 416815 - DNA, 25 bp, Homo sapien
gattgatatttctgtaaagtatgat

SEQ ID NO: 416816 - DNA, 25 bp, Homo sapien
aggcatgtaaaatacaagcccaaat

SEQ ID NO: 416817 - DNA, 25 bp, Homo sapien
ctgtccctagccctcacttcaaact

SEQ ID NO: 416818 - DNA, 25 bp, Homo sapien
gtccctagccctcacttcaaactct

SEQ ID NO: 416819 - DNA, 25 bp, Homo sapien
gcacatgttacaaaggcaactacca

SEQ ID NO: 416820 - DNA, 25 bp, Homo sapien
cacatgttacaaaggcaactaccat

SEQ ID NO: 416821 - DNA, 25 bp, Homo sapien
acatgttacaaaggcaactaccatg

SEQ ID NO: 416822 - DNA, 25 bp, Homo sapien
atgttacaaaggcaactaccatgtt

SEQ ID NO: 416823 - DNA, 25 bp, Homo sapien
tgttacaaaggcaactaccatgtta

SEQ ID NO: 416824 - DNA, 25 bp, Homo sapien
gttacaaaggcaactaccatgttaa

SEQ ID NO: 416825 - DNA, 25 bp, Homo sapien
ttacaaaggcaactaccatgttaat

SEQ ID NO: 416826 - DNA, 25 bp, Homo sapien
tacaaaggcaactaccatgttaata

SEQ ID NO: 416827 - DNA, 25 bp, Homo sapien
acaaaggcaactaccatgttaataa

SEQ ID NO: 416828 - DNA, 25 bp, Homo sapien
gcttagattacttgcagctccacat

SEQ ID NO: 416829 - DNA, 25 bp, Homo sapien
tgcagctccacatttcagaaaactg

SEQ ID NO: 416830 - DNA, 25 bp, Homo sapien
tcagaaaactgcactttgcctccat

SEQ ID NO: 416831 - DNA, 25 bp, Homo sapien
tgcactttgcctccatcaggtattc

SEQ ID NO: 416832 - DNA, 25 bp, Homo sapien
tgtgacaggcgctggacacatccac

SEQ ID NO: 416833 - DNA, 25 bp, Homo sapien
gcagcattttaatgtcttgatgcct

SEQ ID NO: 416834 - DNA, 25 bp, Homo sapien
atgtcttgatgcctaggagatacag

SEQ ID NO: 416835 - DNA, 25 bp, Homo sapien
cttattctgtctttaggttccattg

SEQ ID NO: 416836 - DNA, 25 bp, Homo sapien
ggttccattgtaggtaaatctgttc

SEQ ID NO: 416837 - DNA, 25 bp, Homo sapien
aggtaaatctgttcactacatgtga

SEQ ID NO: 416838 - DNA, 25 bp, Homo sapien
tcactacatgtgattcttgatcctc

SEQ ID NO: 416839 - DNA, 25 bp, Homo sapien
gaaaatcttcccatctatatcaaaa

SEQ ID NO: 416840 - DNA, 25 bp, Homo sapien
ggttcctatgattttgacttcagta

SEQ ID NO: 416841 - DNA, 25 bp, Homo sapien
tattttgcaattcatttttacatta

SEQ ID NO: 416842 - DNA, 25 bp, Homo sapien
gaagaagcgataagtggagtcagtt

SEQ ID NO: 416843 - DNA, 25 bp, Homo sapien
aagtggagtcagtttcaatgctagg

SEQ ID NO: 416844 - DNA, 25 bp, Homo sapien
gtggagtcagtttcaatgctaggtg

SEQ ID NO: 416845 - DNA, 25 bp, Homo sapien
atgatttttctggtgttgctgctaa

SEQ ID NO: 416846 - DNA, 25 bp, Homo sapien
atttttctggtgttgctgctaatgt

SEQ ID NO: 416847 - DNA, 25 bp, Homo sapien
ttctggtgttgctgctaatgtggat

SEQ ID NO: 416848 - DNA, 25 bp, Homo sapien
tggtgttgctgctaatgtggattaa

SEQ ID NO: 416849 - DNA, 25 bp, Homo sapien
gttgctgctaatgtggattaacaaa

SEQ ID NO: 416850 - DNA, 25 bp, Homo sapien
gtgattctcccttttagccatggaa

SEQ ID NO: 416851 - DNA, 25 bp, Homo sapien
agaggaaccatttgtctatcacaaa

SEQ ID NO: 416852 - DNA, 25 bp, Homo sapien
tgtctatcacaaactgtcccagagt

SEQ ID NO: 416853 - DNA, 25 bp, Homo sapien
tgtcccagagtcttccagatttcac

SEQ ID NO: 416854 - DNA, 25 bp, Homo sapien
tcacgtttggaatgaaagtctcagg

SEQ ID NO: 416855 - DNA, 25 bp, Homo sapien
caggaaggcacggactttgttttct

SEQ ID NO: 416856 - DNA, 25 bp, Homo sapien
gttttcttcctcatgtatggcatag

SEQ ID NO: 416857 - DNA, 25 bp, Homo sapien
tatggcatagagcagcggtccccaa

SEQ ID NO: 416858 - DNA, 25 bp, Homo sapien
ctgggccacagatcagtatcgttct

SEQ ID NO: 416859 - DNA, 25 bp, Homo sapien
atcagtatcgttctgtggcctgtta

SEQ ID NO: 416860 - DNA, 25 bp, Homo sapien
ggcgggccagcaagctaagcttcat

SEQ ID NO: 416861 - DNA, 25 bp, Homo sapien
gttagttgaactctttgaaccacag

SEQ ID NO: 416862 - DNA, 25 bp, Homo sapien
tttgaaccacagtagaaaccgcttt

SEQ ID NO: 416863 - DNA, 25 bp, Homo sapien
agtagaaaccgctttgtgtggcctg

SEQ ID NO: 416864 - DNA, 25 bp, Homo sapien
aaaccgctttgtgtggcctgtgaga

SEQ ID NO: 416865 - DNA, 25 bp, Homo sapien
gtgtggcctgtgagattataagctt

SEQ ID NO: 416866 - DNA, 25 bp, Homo sapien
ttaatctcttaatctcatgctttga

SEQ ID NO: 416867 - DNA, 25 bp, Homo sapien
gattgaattttagctctgttcctta

SEQ ID NO: 416868 - DNA, 25 bp, Homo sapien
gattacagcttttactcccgacttg

SEQ ID NO: 416869 - DNA, 25 bp, Homo sapien
tacagcttttactcccgacttgttt

SEQ ID NO: 416870 - DNA, 25 bp, Homo sapien
ataagacaattggtttacaaacaca

SEQ ID NO: 416871 - DNA, 25 bp, Homo sapien
aacaactgtccatcgttttaggaag

SEQ ID NO: 416872 - DNA, 25 bp, Homo sapien
atttgaagtcggctgggccctctac

SEQ ID NO: 416873 - DNA, 25 bp, Homo sapien
ggctgggccctctacatacatgttt

SEQ ID NO: 416874 - DNA, 25 bp, Homo sapien
tacatacatgtttccttccctttgt

SEQ ID NO: 416875 - DNA, 25 bp, Homo sapien
tgtttccttccctttgtgggattga

SEQ ID NO: 416876 - DNA, 25 bp, Homo sapien
aggtatgaccacagggtggtgccaa

SEQ ID NO: 416877 - DNA, 25 bp, Homo sapien
tgccaaaaatcaacacatagctgcc

SEQ ID NO: 416878 - DNA, 25 bp, Homo sapien
accaaaaacctaagcctgtaatctg

SEQ ID NO: 416879 - DNA, 25 bp, Homo sapien
atatagggagatggctcaggagtct

SEQ ID NO: 416880 - DNA, 25 bp, Homo sapien
ggagtctagaagacctggcaagtat

SEQ ID NO: 416881 - DNA, 25 bp, Homo sapien
agaatttacttcatggtctggtgta

SEQ ID NO: 416882 - DNA, 25 bp, Homo sapien
tggtgtaacctgaatctgtagactt

SEQ ID NO: 416883 - DNA, 25 bp, Homo sapien
tagcataatttactttcatttccat

SEQ ID NO: 416884 - DNA, 25 bp, Homo sapien
ataagaacttaatatgtaggcacat

SEQ ID NO: 416885 - DNA, 25 bp, Homo sapien
tgtaggcacatataatctcatgtag

SEQ ID NO: 416886 - DNA, 25 bp, Homo sapien
atctcatgtagaagcagcacacaaa

SEQ ID NO: 416887 - DNA, 25 bp, Homo sapien
gcagcacacaaaaatattcgagtat

SEQ ID NO: 416888 - DNA, 25 bp, Homo sapien
gcaaccttaggtgagtcagatatgt

SEQ ID NO: 416889 - DNA, 25 bp, Homo sapien
agtcagatatgtggattgggtagat

SEQ ID NO: 416890 - DNA, 25 bp, Homo sapien
gggtagatcctatggtatactgcaa

SEQ ID NO: 416891 - DNA, 25 bp, Homo sapien
gatcctatggtatactgcaagttac

SEQ ID NO: 416892 - DNA, 25 bp, Homo sapien
gcaagttacaatatggtactcaatt

SEQ ID NO: 416893 - DNA, 25 bp, Homo sapien
acacatgtggcttaatttacagtaa

SEQ ID NO: 416894 - DNA, 25 bp, Homo sapien
gggtaggtctgttagcttttcaaga

SEQ ID NO: 416895 - DNA, 25 bp, Homo sapien
ggtctgttagcttttcaagatcatg

SEQ ID NO: 416896 - DNA, 25 bp, Homo sapien
caagatcatgaagtatttttaggtc

SEQ ID NO: 416897 - DNA, 25 bp, Homo sapien
tttttaggtccaagttgtcaccagc

SEQ ID NO: 416898 - DNA, 25 bp, Homo sapien
gcataccgggctcttgcttgtcata

SEQ ID NO: 416899 - DNA, 25 bp, Homo sapien
ggctcttgcttgtcatagcttggat

SEQ ID NO: 416900 - DNA, 25 bp, Homo sapien
atagcttggatgtcccctggatcat

SEQ ID NO: 416901 - DNA, 25 bp, Homo sapien
ataacgagcatagcatcctcccatg

SEQ ID NO: 416902 - DNA, 25 bp, Homo sapien
atgtgagaactgctcagtctcctga

SEQ ID NO: 416903 - DNA, 25 bp, Homo sapien
tgctcagtctcctgacagacccggg

SEQ ID NO: 416904 - DNA, 25 bp, Homo sapien
ggctgcaggcacattttccctaggg

SEQ ID NO: 416905 - DNA, 25 bp, Homo sapien
ggaagatcttaagacctagaaggaa

SEQ ID NO: 416906 - DNA, 25 bp, Homo sapien
gacctagaaggaaaactgattgcag

SEQ ID NO: 416907 - DNA, 25 bp, Homo sapien
ggaaaactgattgcagaccaggctt

SEQ ID NO: 416908 - DNA, 25 bp, Homo sapien
aactgattgcagaccaggcttggtg

SEQ ID NO: 416909 - DNA, 25 bp, Homo sapien
aaaatcaaaactgaaggtagtgtca

SEQ ID NO: 416910 - DNA, 25 bp, Homo sapien
aactgaaggtagtgtcagtgtatat

SEQ ID NO: 416911 - DNA, 25 bp, Homo sapien
gagtcccttgtgctgaaagtcaaag

SEQ ID NO: 416912 - DNA, 25 bp, Homo sapien
gtcccttgtgctgaaagtcaaagca

SEQ ID NO: 416913 - DNA, 25 bp, Homo sapien
gaaagtcaaagcagcttcatttggg

SEQ ID NO: 416914 - DNA, 25 bp, Homo sapien
gcagcttcatttgggggcctcaaga

SEQ ID NO: 416915 - DNA, 25 bp, Homo sapien
gctctgggctcttcacctctaagcc

SEQ ID NO: 416916 - DNA, 25 bp, Homo sapien
ctggtgagtggtggccccacacact

SEQ ID NO: 416917 - DNA, 25 bp, Homo sapien
gctcagcacagaatctgcctccagc

SEQ ID NO: 416918 - DNA, 25 bp, Homo sapien
ccagctcttttacacaggaattcat

SEQ ID NO: 416919 - DNA, 25 bp, Homo sapien
tacacaggaattcatctcaggcatt

SEQ ID NO: 416920 - DNA, 25 bp, Homo sapien
caggaattcatctcaggcatttggg

SEQ ID NO: 416921 - DNA, 25 bp, Homo sapien
ggggcactggttcagacccatgtct

SEQ ID NO: 416922 - DNA, 25 bp, Homo sapien
cctctctgccgttacacatagttaa

SEQ ID NO: 416923 - DNA, 25 bp, Homo sapien
ctgccgttacacatagttaagagat

SEQ ID NO: 416924 - DNA, 25 bp, Homo sapien
atgggtacattaatcaaatcaagga

SEQ ID NO: 416925 - DNA, 25 bp, Homo sapien
gaaaataattattacggctgggcgc

SEQ ID NO: 416926 - DNA, 25 bp, Homo sapien
atgaggggcccagatgagctgcttc

SEQ ID NO: 416927 - DNA, 25 bp, Homo sapien
atcctagctctttgttattcaccag

SEQ ID NO: 416928 - DNA, 25 bp, Homo sapien
tagctctttgttattcaccagcttt

SEQ ID NO: 416929 - DNA, 25 bp, Homo sapien
tctttgttattcaccagctttttaa

SEQ ID NO: 416930 - DNA, 25 bp, Homo sapien
aaattatacattctcgactttgggg

SEQ ID NO: 416931 - DNA, 25 bp, Homo sapien
tgtggcatcattataaggcttaatt

SEQ ID NO: 416932 - DNA, 25 bp, Homo sapien
ggcttaattgtggaaagctaagtac

SEQ ID NO: 416933 - DNA, 25 bp, Homo sapien
agtacttgcttctattccttccaat

SEQ ID NO: 416934 - DNA, 25 bp, Homo sapien
cttgcttctattccttccaatgaga

SEQ ID NO: 416935 - DNA, 25 bp, Homo sapien
gcttctattccttccaatgagagat

SEQ ID NO: 416936 - DNA, 25 bp, Homo sapien
attccttccaatgagagattataac

SEQ ID NO: 416937 - DNA, 25 bp, Homo sapien
aattattctgctaatatacctagat

SEQ ID NO: 416938 - DNA, 25 bp, Homo sapien
ccacggcgctgcagaaggtaaggct

SEQ ID NO: 416939 - DNA, 25 bp, Homo sapien
ccaggagtttgttgggtctcagcag

SEQ ID NO: 416940 - DNA, 25 bp, Homo sapien
agtttgttgggtctcagcagtgtca

SEQ ID NO: 416941 - DNA, 25 bp, Homo sapien
tgggtctcagcagtgtcagacaaga

SEQ ID NO: 416942 - DNA, 25 bp, Homo sapien
gacaagagactgaattcaccaagtg

SEQ ID NO: 416943 - DNA, 25 bp, Homo sapien
gactgaattcaccaagtgcatactg

SEQ ID NO: 416944 - DNA, 25 bp, Homo sapien
atcctgctgtctcgctgtcggccag

SEQ ID NO: 416945 - DNA, 25 bp, Homo sapien
tgtcggccagcgttttacagccctg

SEQ ID NO: 416946 - DNA, 25 bp, Homo sapien
cagcgttttacagccctgcatgggc

SEQ ID NO: 416947 - DNA, 25 bp, Homo sapien
ctgcatgggcaccactgatcagaga

SEQ ID NO: 416948 - DNA, 25 bp, Homo sapien
ggcaccactgatcagagaatctcat

SEQ ID NO: 416949 - DNA, 25 bp, Homo sapien
agctgtctctggctgaaccggcgct

SEQ ID NO: 416950 - DNA, 25 bp, Homo sapien
gctgtctctggctgaaccggcgctc

SEQ ID NO: 416951 - DNA, 25 bp, Homo sapien
gtctctggctgaaccggcgctctcg

SEQ ID NO: 416952 - DNA, 25 bp, Homo sapien
ctccctgccgaacacagcgtgagga

SEQ ID NO: 416953 - DNA, 25 bp, Homo sapien
tccctgccgaacacagcgtgaggag

SEQ ID NO: 416954 - DNA, 25 bp, Homo sapien
cctgccgaacacagcgtgaggagcc

SEQ ID NO: 416955 - DNA, 25 bp, Homo sapien
tgccgaacacagcgtgaggagcccc

SEQ ID NO: 416956 - DNA, 25 bp, Homo sapien
atggtgtttgagtctctgggcttgc

SEQ ID NO: 416957 - DNA, 25 bp, Homo sapien
gtctctgggcttgccgagcactaag

SEQ ID NO: 416958 - DNA, 25 bp, Homo sapien
tctgggcttgccgagcactaagtcc

SEQ ID NO: 416959 - DNA, 25 bp, Homo sapien
ctgggcttgccgagcactaagtcct

SEQ ID NO: 416960 - DNA, 25 bp, Homo sapien
tggcttgttgacatgcataattgca

SEQ ID NO: 416961 - DNA, 25 bp, Homo sapien
gcatttatgttggttcttgtgccct

SEQ ID NO: 416962 - DNA, 25 bp, Homo sapien
atgttggttcttgtgccctagacaa

SEQ ID NO: 416963 - DNA, 25 bp, Homo sapien
acaaggatgccccacctcttttcaa

SEQ ID NO: 416964 - DNA, 25 bp, Homo sapien
cctcttttcaatagtgggtgcccac

SEQ ID NO: 416965 - DNA, 25 bp, Homo sapien
tgcccactccttatgatctttacat

SEQ ID NO: 416966 - DNA, 25 bp, Homo sapien
aattgcagttgtccacaaccctatc

SEQ ID NO: 416967 - DNA, 25 bp, Homo sapien
aaccctatcacttctaggaccatta

SEQ ID NO: 416968 - DNA, 25 bp, Homo sapien
ggaccattatacctcttttgcatta

SEQ ID NO: 416969 - DNA, 25 bp, Homo sapien
aaggccccttctggtggactatcaa

SEQ ID NO: 416970 - DNA, 25 bp, Homo sapien
cccttctggtggactatcaacatat

SEQ ID NO: 416971 - DNA, 25 bp, Homo sapien
gtttggtgagatgcgttcacaagtc

SEQ ID NO: 416972 - DNA, 25 bp, Homo sapien
ccccagccaggtagtgggctcgatg

SEQ ID NO: 416973 - DNA, 25 bp, Homo sapien
tgctcgcaacgcagagtcagagaca

SEQ ID NO: 416974 - DNA, 25 bp, Homo sapien
gcaacgcagagtcagagacacacgt

SEQ ID NO: 416975 - DNA, 25 bp, Homo sapien
aaagctaagtgcatctccctaatct

SEQ ID NO: 416976 - DNA, 25 bp, Homo sapien
gtgcatctccctaatctagtaagaa

SEQ ID NO: 416977 - DNA, 25 bp, Homo sapien
aggagacgatgggtgtatttctttt

SEQ ID NO: 416978 - DNA, 25 bp, Homo sapien
tgtatttcttttctgggccaggtag

SEQ ID NO: 416979 - DNA, 25 bp, Homo sapien
ttttctgggccaggtagctggcagc

SEQ ID NO: 416980 - DNA, 25 bp, Homo sapien
tagctggcagctgctagagctcgct

SEQ ID NO: 416981 - DNA, 25 bp, Homo sapien
agctcgctgagggtctgttgggaag

SEQ ID NO: 416982 - DNA, 25 bp, Homo sapien
tgctaaacatcttgcaatgcactgg

SEQ ID NO: 416983 - DNA, 25 bp, Homo sapien
cttgcaatgcactggagagtccctt

SEQ ID NO: 416984 - DNA, 25 bp, Homo sapien
tggagagtcccttgcaacaatcatc

SEQ ID NO: 416985 - DNA, 25 bp, Homo sapien
cttgcaacaatcatctggcccaaaa

SEQ ID NO: 416986 - DNA, 25 bp, Homo sapien
ctggcccaaaacgtcatagtgctga

SEQ ID NO: 416987 - DNA, 25 bp, Homo sapien
gaaactcctttaatgccatcgttct

SEQ ID NO: 416988 - DNA, 25 bp, Homo sapien
aatgccatcgttctgaatgttaact

SEQ ID NO: 416989 - DNA, 25 bp, Homo sapien
tcagttcttttctctaatctagtag

SEQ ID NO: 416990 - DNA, 25 bp, Homo sapien
tttcaagtggattttgcccatcagc

SEQ ID NO: 416991 - DNA, 25 bp, Homo sapien
tttgcccatcagcagatattgtatg

SEQ ID NO: 416992 - DNA, 25 bp, Homo sapien
atgtggcaatgcctacagacatttt

SEQ ID NO: 416993 - DNA, 25 bp, Homo sapien
caaattcttttcaacaactattgta

SEQ ID NO: 416994 - DNA, 25 bp, Homo sapien
tttctgttttcagtctgactcccca

SEQ ID NO: 416995 - DNA, 25 bp, Homo sapien
attgccgtattgtttagctaagccc

SEQ ID NO: 416996 - DNA, 25 bp, Homo sapien
gccgtattgtttagctaagccctat

SEQ ID NO: 416997 - DNA, 25 bp, Homo sapien
agctaagccctattgtcttggtgtc

SEQ ID NO: 416998 - DNA, 25 bp, Homo sapien
ccctattgtcttggtgtccttcaaa

SEQ ID NO: 416999 - DNA, 25 bp, Homo sapien
ttgtcttggtgtccttcaaaactgt

SEQ ID NO: 417000 - DNA, 25 bp, Homo sapien
tgactccccagctttctgtatcatt

SEQ ID NO: 417001 - DNA, 25 bp, Homo sapien
cccagctttctgtatcattgtttta

SEQ ID NO: 417002 - DNA, 25 bp, Homo sapien
cattgttttaacatacatccccttt

SEQ ID NO: 417003 - DNA, 25 bp, Homo sapien
ctcctttattggaagagaagctata

SEQ ID NO: 417004 - DNA, 25 bp, Homo sapien
cttcattttaccagctacctccttc

SEQ ID NO: 417005 - DNA, 25 bp, Homo sapien
ctccttccagattgaatgcttcagt

SEQ ID NO: 417006 - DNA, 25 bp, Homo sapien
gattgaatgcttcagtgcactttga

SEQ ID NO: 417007 - DNA, 25 bp, Homo sapien
gaatgcttcagtgcactttgatttt

SEQ ID NO: 417008 - DNA, 25 bp, Homo sapien
tttgattttcaaattggctattatt

SEQ ID NO: 417009 - DNA, 25 bp, Homo sapien
ggatattctgatccttaggttataa

SEQ ID NO: 417010 - DNA, 25 bp, Homo sapien
aatatgtgacttgatggtttatgta

SEQ ID NO: 417011 - DNA, 25 bp, Homo sapien
gtttatgtaacattcaagtagcatg

SEQ ID NO: 417012 - DNA, 25 bp, Homo sapien
cataccttgtatgttgcttgacaga

SEQ ID NO: 417013 - DNA, 25 bp, Homo sapien
gtatgttgcttgacagatctgtttt

SEQ ID NO: 417014 - DNA, 25 bp, Homo sapien
gttgcttgacagatctgttttagaa

SEQ ID NO: 417015 - DNA, 25 bp, Homo sapien
catgtattgaacctttctcttcctc

SEQ ID NO: 417016 - DNA, 25 bp, Homo sapien
ttctcttcctctgaatatacttaag

SEQ ID NO: 417017 - DNA, 25 bp, Homo sapien
cattcatctcccatacctacaaaat

SEQ ID NO: 417018 - DNA, 25 bp, Homo sapien
tcattttctgcatgggtcctttaca

SEQ ID NO: 417019 - DNA, 25 bp, Homo sapien
gcatgggtcctttacattgtcattt

SEQ ID NO: 417020 - DNA, 25 bp, Homo sapien
attttctatttgtaatgggcctgtg

SEQ ID NO: 417021 - DNA, 25 bp, Homo sapien
tgtcatttttcttcaggtctgttct

SEQ ID NO: 417022 - DNA, 25 bp, Homo sapien
atgtattcagacttttattcagaga

SEQ ID NO: 417023 - DNA, 25 bp, Homo sapien
taatgggcctgtggatgacttttgc

SEQ ID NO: 417024 - DNA, 25 bp, Homo sapien
tgacttttgcccctttatatgttgg

SEQ ID NO: 417025 - DNA, 25 bp, Homo sapien
tctgattatcatatgcttgcacaag

SEQ ID NO: 417026 - DNA, 25 bp, Homo sapien
gttgtgatatgttaacctgcaagtt

SEQ ID NO: 417027 - DNA, 25 bp, Homo sapien
cctgcaagttttgaacattgacatg

SEQ ID NO: 417028 - DNA, 25 bp, Homo sapien
cattgacatgttttcgtgttaggaa

SEQ ID NO: 417029 - DNA, 25 bp, Homo sapien
aaacaggagctcacttttctacatc

SEQ ID NO: 417030 - DNA, 25 bp, Homo sapien
agctcacttttctacatccttgttg

SEQ ID NO: 417031 - DNA, 25 bp, Homo sapien
acatccttgttggagcatgctggga

SEQ ID NO: 417032 - DNA, 25 bp, Homo sapien
ttggagcatgctgggaatgaagaca

SEQ ID NO: 417033 - DNA, 25 bp, Homo sapien
gacaggtggatcttttaactttctc

SEQ ID NO: 417034 - DNA, 25 bp, Homo sapien
gatcttttaactttctcacttctat

SEQ ID NO: 417035 - DNA, 25 bp, Homo sapien
aagggtcagtgcaagtcctgtagaa

SEQ ID NO: 417036 - DNA, 25 bp, Homo sapien
gtgcaagtcctgtagaaatgtattt

SEQ ID NO: 417037 - DNA, 25 bp, Homo sapien
gctcttggagttctctaaaagggtt

SEQ ID NO: 417038 - DNA, 25 bp, Homo sapien
ggttgtgtatattcacttgggtgcc

SEQ ID NO: 417039 - DNA, 25 bp, Homo sapien
gtatattcacttgggtgccagcgat

SEQ ID NO: 417040 - DNA, 25 bp, Homo sapien
gggtgccagcgattgattccaaata

SEQ ID NO: 417041 - DNA, 25 bp, Homo sapien
gaaataaagtcataggagccacaga

SEQ ID NO: 417042 - DNA, 25 bp, Homo sapien
taggagccacagaattaacccagga

SEQ ID NO: 417043 - DNA, 25 bp, Homo sapien
ttaacccaggaatgaataagtgtgt

SEQ ID NO: 417044 - DNA, 25 bp, Homo sapien
gtgtagtttggtgctgatgttatca

SEQ ID NO: 417045 - DNA, 25 bp, Homo sapien
ggtgctgatgttatcatcctttatt

SEQ ID NO: 417046 - DNA, 25 bp, Homo sapien
tacattgcttgtacagttgctctga

SEQ ID NO: 417047 - DNA, 25 bp, Homo sapien
gttgctctgagaaggtaagtcttaa

SEQ ID NO: 417048 - DNA, 25 bp, Homo sapien
cttgtattttcaaatccaaaccatt

SEQ ID NO: 417049 - DNA, 25 bp, Homo sapien
ttgtattttcaaatccaaaccattt

SEQ ID NO: 417050 - DNA, 25 bp, Homo sapien
tgtattttcaaatccaaaccattta

SEQ ID NO: 417051 - DNA, 25 bp, Homo sapien
gtattttcaaatccaaaccatttag

SEQ ID NO: 417052 - DNA, 25 bp, Homo sapien
tattttcaaatccaaaccatttagt

SEQ ID NO: 417053 - DNA, 25 bp, Homo sapien
ttttcaaatccaaaccatttagtag

SEQ ID NO: 417054 - DNA, 25 bp, Homo sapien
tttcaaatccaaaccatttagtagt

SEQ ID NO: 417055 - DNA, 25 bp, Homo sapien
caaaccatttagtagtttataactg

SEQ ID NO: 417056 - DNA, 25 bp, Homo sapien
accatttagtagtttataactggat

SEQ ID NO: 417057 - DNA, 25 bp, Homo sapien
catttagtagtttataactggattt

SEQ ID NO: 417058 - DNA, 25 bp, Homo sapien
gacagagtctcttgctctacccagg

SEQ ID NO: 417059 - DNA, 25 bp, Homo sapien
tattacagccagcacacttgcgaat

SEQ ID NO: 417060 - DNA, 25 bp, Homo sapien
gcgaatataaactgagcactacttt

SEQ ID NO: 417061 - DNA, 25 bp, Homo sapien
tatttactcgttgcatcctttttct

SEQ ID NO: 417062 - DNA, 25 bp, Homo sapien
tgcatcctttttctggtttcacttc

SEQ ID NO: 417063 - DNA, 25 bp, Homo sapien
ggtttcacttctctttggtggcttt

SEQ ID NO: 417064 - DNA, 25 bp, Homo sapien
ggtggcttttcacaagcaatagaat

SEQ ID NO: 417065 - DNA, 25 bp, Homo sapien
attgtcactgtctgcatgggtggca

SEQ ID NO: 417066 - DNA, 25 bp, Homo sapien
taatggaagcccacacaatggagaa

SEQ ID NO: 417067 - DNA, 25 bp, Homo sapien
gggtggcaaccaccaacatgtgaac

SEQ ID NO: 417068 - DNA, 25 bp, Homo sapien
agtatagatagtggccctccacctg

SEQ ID NO: 417069 - DNA, 25 bp, Homo sapien
tggccctccacctgacaaacaatat

SEQ ID NO: 417070 - DNA, 25 bp, Homo sapien
gcgcttcccaggtgaggtgatgccc

SEQ ID NO: 417071 - DNA, 25 bp, Homo sapien
gtgatgccccgccttgctttggctt

SEQ ID NO: 417072 - DNA, 25 bp, Homo sapien
tgatgccccgccttgctttggcttg

SEQ ID NO: 417073 - DNA, 25 bp, Homo sapien
aaatctcctggtctgctggttgcta

SEQ ID NO: 417074 - DNA, 25 bp, Homo sapien
tgctggttgctaagaccgtgggaaa

SEQ ID NO: 417075 - DNA, 25 bp, Homo sapien
gctggttgctaagaccgtgggaaaa

SEQ ID NO: 417076 - DNA, 25 bp, Homo sapien
gttgctaagaccgtgggaaaagtgc

SEQ ID NO: 417077 - DNA, 25 bp, Homo sapien
aaaagtgcagtattagggcagaagt

SEQ ID NO: 417078 - DNA, 25 bp, Homo sapien
cagtattagggcagaagtgtcccat

SEQ ID NO: 417079 - DNA, 25 bp, Homo sapien
gaagtgtcccatttttccaggtaca

SEQ ID NO: 417080 - DNA, 25 bp, Homo sapien
aagtgtcccatttttccaggtacag

SEQ ID NO: 417081 - DNA, 25 bp, Homo sapien
gcaccttgcaggtctggaagcggtc

SEQ ID NO: 417082 - DNA, 25 bp, Homo sapien
aagcggtcggtgaaagtcctgaggt

SEQ ID NO: 417083 - DNA, 25 bp, Homo sapien
ggtccccgaagaggccacagtgcgt

SEQ ID NO: 417084 - DNA, 25 bp, Homo sapien
gtgcttgtgaaagctcttctcgtaa

SEQ ID NO: 417085 - DNA, 25 bp, Homo sapien
gaaagctcttctcgtaatggcagat

SEQ ID NO: 417086 - DNA, 25 bp, Homo sapien
tcttctcgtaatggcagatctcggg

SEQ ID NO: 417087 - DNA, 25 bp, Homo sapien
gggccatccttggagcagttgtgct

SEQ ID NO: 417088 - DNA, 25 bp, Homo sapien
agttgtgctggctcatgaggtcctc

SEQ ID NO: 417089 - DNA, 25 bp, Homo sapien
atgaggtcctctatgccatggacgg

SEQ ID NO: 417090 - DNA, 25 bp, Homo sapien
tctatgccatggacggccgagtggt

SEQ ID NO: 417091 - DNA, 25 bp, Homo sapien
agtggtaggccaggtcaccccggca

SEQ ID NO: 417092 - DNA, 25 bp, Homo sapien
catgttgaccatgcagccaattgtt

SEQ ID NO: 417093 - DNA, 25 bp, Homo sapien
atgcagccaattgttggcccgtaga

SEQ ID NO: 417094 - DNA, 25 bp, Homo sapien
ggcccgtagagtgaacaaaaccaga

SEQ ID NO: 417095 - DNA, 25 bp, Homo sapien
aaccagaccacaagattgagggctt

SEQ ID NO: 417096 - DNA, 25 bp, Homo sapien
aaaaagcagactgtgactctctggg

SEQ ID NO: 417097 - DNA, 25 bp, Homo sapien
gacactaggaattctcaaagcgaga

SEQ ID NO: 417098 - DNA, 25 bp, Homo sapien
ggccctttttcggaaatgacctctg

SEQ ID NO: 417099 - DNA, 25 bp, Homo sapien
tctgataaacacaccctccagggtt

SEQ ID NO: 417100 - DNA, 25 bp, Homo sapien
ttccacggacagacaagctgcactt

SEQ ID NO: 417101 - DNA, 25 bp, Homo sapien
gcactttagcagtcctgaataccta

SEQ ID NO: 417102 - DNA, 25 bp, Homo sapien
gaatacctagagacttccttaacag

SEQ ID NO: 417103 - DNA, 25 bp, Homo sapien
tttttgttttcctgtgagctcaact

SEQ ID NO: 417104 - DNA, 25 bp, Homo sapien
gtgagctcaactaagttcacggcaa

SEQ ID NO: 417105 - DNA, 25 bp, Homo sapien
agttcacggcaaaatgtcattgttc

SEQ ID NO: 417106 - DNA, 25 bp, Homo sapien
aaatgtcattgttctccctcctacc

SEQ ID NO: 417107 - DNA, 25 bp, Homo sapien
ctcctacctgtctgtagtgttgtgg

SEQ ID NO: 417108 - DNA, 25 bp, Homo sapien
ggtcctcccatggatcatcaaggtg

SEQ ID NO: 417109 - DNA, 25 bp, Homo sapien
gtgaaacactttggtattctttggc

SEQ ID NO: 417110 - DNA, 25 bp, Homo sapien
attctttggcaatcagtgctcctgt

SEQ ID NO: 417111 - DNA, 25 bp, Homo sapien
ggcaatcagtgctcctgtaagtcaa

SEQ ID NO: 417112 - DNA, 25 bp, Homo sapien
aaatgtgtgctttgtactgctgttg

SEQ ID NO: 417113 - DNA, 25 bp, Homo sapien
aaaatgcaaaatcctggtgatgtgt

SEQ ID NO: 417114 - DNA, 25 bp, Homo sapien
gaattcagaaactagatttactgca

SEQ ID NO: 417115 - DNA, 25 bp, Homo sapien
gatttactgcatattagctgtgctt

SEQ ID NO: 417116 - DNA, 25 bp, Homo sapien
gatatactagtactttgggattgtc

SEQ ID NO: 417117 - DNA, 25 bp, Homo sapien
tactagtactttgggattgtcatga

SEQ ID NO: 417118 - DNA, 25 bp, Homo sapien
actttgggattgtcatgaggttgtc

SEQ ID NO: 417119 - DNA, 25 bp, Homo sapien
ttgtcatgaggttgtcatcatcatt

SEQ ID NO: 417120 - DNA, 25 bp, Homo sapien
aaatttcagtaataggctgggcgtg

SEQ ID NO: 417121 - DNA, 25 bp, Homo sapien
caggaggattgcttacatacaggag

SEQ ID NO: 417122 - DNA, 25 bp, Homo sapien
tataggaattaatagcatgggctct

SEQ ID NO: 417123 - DNA, 25 bp, Homo sapien
gaattaatagcatgggctctggaat

SEQ ID NO: 417124 - DNA, 25 bp, Homo sapien
gctctggaataagaatgcctgaatt

SEQ ID NO: 417125 - DNA, 25 bp, Homo sapien
gtatataatgctacaattgccatat

SEQ ID NO: 417126 - DNA, 25 bp, Homo sapien
taatgctacaattgccatatttaac

SEQ ID NO: 417127 - DNA, 25 bp, Homo sapien
gctacaattgccatatttaacattt

SEQ ID NO: 417128 - DNA, 25 bp, Homo sapien
gattatggaatcttagccattgtaa

SEQ ID NO: 417129 - DNA, 25 bp, Homo sapien
tagccattgtaacaggccgtgaaaa

SEQ ID NO: 417130 - DNA, 25 bp, Homo sapien
gtaacaggccgtgaaaaacatgatg

SEQ ID NO: 417131 - DNA, 25 bp, Homo sapien
caggccgtgaaaaacatgatgtgtc

SEQ ID NO: 417132 - DNA, 25 bp, Homo sapien
gccgtgaaaaacatgatgtgtcgta

SEQ ID NO: 417133 - DNA, 25 bp, Homo sapien
tgcttaagagatcaatggtattggt

SEQ ID NO: 417134 - DNA, 25 bp, Homo sapien
atcaatggtattggtactataacat

SEQ ID NO: 417135 - DNA, 25 bp, Homo sapien
caagaataccagacagtaagtataa

SEQ ID NO: 417136 - DNA, 25 bp, Homo sapien
tccggtagaactgtctgcagtggaa

SEQ ID NO: 417137 - DNA, 25 bp, Homo sapien
aagatggaaatgtctgcgctgtcct

SEQ ID NO: 417138 - DNA, 25 bp, Homo sapien
tgcgctgtcctgtagagtacacgtg

SEQ ID NO: 417139 - DNA, 25 bp, Homo sapien
agtacacgtggtcctatgtggctgc

SEQ ID NO: 417140 - DNA, 25 bp, Homo sapien
atgtggctgccgagcatctgaaatg

SEQ ID NO: 417141 - DNA, 25 bp, Homo sapien
atctgaaatgtggttaatgtggcta

SEQ ID NO: 417142 - DNA, 25 bp, Homo sapien
aatgtggctaagaaactgtgttttt

SEQ ID NO: 417143 - DNA, 25 bp, Homo sapien
gccatatgtggctgatgcttaccat

SEQ ID NO: 417144 - DNA, 25 bp, Homo sapien
tgtggctgatgcttaccatgttggg

SEQ ID NO: 417145 - DNA, 25 bp, Homo sapien
agtaggaacttggtccttggacatt

SEQ ID NO: 417146 - DNA, 25 bp, Homo sapien
ggtccttggacatttgggatttgaa

SEQ ID NO: 417147 - DNA, 25 bp, Homo sapien
gcaaggcagacgtgagccaggcctt

SEQ ID NO: 417148 - DNA, 25 bp, Homo sapien
agacgtgagccaggccttggttatt

SEQ ID NO: 417149 - DNA, 25 bp, Homo sapien
gtgagccaggccttggttattagga

SEQ ID NO: 417150 - DNA, 25 bp, Homo sapien
tattaggagctaattatgggccaag

SEQ ID NO: 417151 - DNA, 25 bp, Homo sapien
attaggagctaattatgggccaagt

SEQ ID NO: 417152 - DNA, 25 bp, Homo sapien
ttaggagctaattatgggccaagta

SEQ ID NO: 417153 - DNA, 25 bp, Homo sapien
taggagctaattatgggccaagtat

SEQ ID NO: 417154 - DNA, 25 bp, Homo sapien
aggagctaattatgggccaagtatg

SEQ ID NO: 417155 - DNA, 25 bp, Homo sapien
ggagctaattatgggccaagtatgg

SEQ ID NO: 417156 - DNA, 25 bp, Homo sapien
agctaattatgggccaagtatggtg

SEQ ID NO: 417157 - DNA, 25 bp, Homo sapien
ttatgggccaagtatggtggctcac

SEQ ID NO: 417158 - DNA, 25 bp, Homo sapien
aggccttctgtctcatagatcttct

SEQ ID NO: 417159 - DNA, 25 bp, Homo sapien
ttctgtctcatagatcttctccttt

SEQ ID NO: 417160 - DNA, 25 bp, Homo sapien
atagatcttctccttttcgataacc

SEQ ID NO: 417161 - DNA, 25 bp, Homo sapien
gatcttctccttttcgataaccata

SEQ ID NO: 417162 - DNA, 25 bp, Homo sapien
ccttttcgataaccatattttgtga

SEQ ID NO: 417163 - DNA, 25 bp, Homo sapien
gatgattttctaacacaccattgca

SEQ ID NO: 417164 - DNA, 25 bp, Homo sapien
gcaagtttctacaacttacttagtc

SEQ ID NO: 417165 - DNA, 25 bp, Homo sapien
tacttagtcgttaatagatattctg

SEQ ID NO: 417166 - DNA, 25 bp, Homo sapien
gtgttcacagttatagtagtcccct

SEQ ID NO: 417167 - DNA, 25 bp, Homo sapien
tcacagttatagtagtcccctttta

SEQ ID NO: 417168 - DNA, 25 bp, Homo sapien
ctatactctgttggcagtttgatgc

SEQ ID NO: 417169 - DNA, 25 bp, Homo sapien
tgccccacgagtttgtctctcagtg

SEQ ID NO: 417170 - DNA, 25 bp, Homo sapien
gtctctcagtggactctataggttt

SEQ ID NO: 417171 - DNA, 25 bp, Homo sapien
ggactctataggtttgctacttttg

SEQ ID NO: 417172 - DNA, 25 bp, Homo sapien
ggtttgctacttttgcatgacacag

SEQ ID NO: 417173 - DNA, 25 bp, Homo sapien
ttgcatgacacagcaagcccagtgt

SEQ ID NO: 417174 - DNA, 25 bp, Homo sapien
agtgtcccctttgcaagctgcagag

SEQ ID NO: 417175 - DNA, 25 bp, Homo sapien
gtcccctttgcaagctgcagagagg

SEQ ID NO: 417176 - DNA, 25 bp, Homo sapien
tgcagagagggaaacagagtcccag

SEQ ID NO: 417177 - DNA, 25 bp, Homo sapien
tggcaggctccatggcaggcaccag

SEQ ID NO: 417178 - DNA, 25 bp, Homo sapien
atggcaggcaccaggtccctagcag

SEQ ID NO: 417179 - DNA, 25 bp, Homo sapien
agcccagaacagctctgactggagc

SEQ ID NO: 417180 - DNA, 25 bp, Homo sapien
agatgcactcgctgttcccaaaacg

SEQ ID NO: 417181 - DNA, 25 bp, Homo sapien
ggtcccagctccgagggagactaag

SEQ ID NO: 417182 - DNA, 25 bp, Homo sapien
agctccgagggagactaaggataca

SEQ ID NO: 417183 - DNA, 25 bp, Homo sapien
ggagactaaggatacaggatcgctt

SEQ ID NO: 417184 - DNA, 25 bp, Homo sapien
gactaaggatacaggatcgcttgag

SEQ ID NO: 417185 - DNA, 25 bp, Homo sapien
gctgttcccaaaacgccaagccaca

SEQ ID NO: 417186 - DNA, 25 bp, Homo sapien
cacacccactcctttagggatggta

SEQ ID NO: 417187 - DNA, 25 bp, Homo sapien
cacccactcctttagggatggtaga

SEQ ID NO: 417188 - DNA, 25 bp, Homo sapien
cccactcctttagggatggtagaca

SEQ ID NO: 417189 - DNA, 25 bp, Homo sapien
ctcctttagggatggtagacattgg

SEQ ID NO: 417190 - DNA, 25 bp, Homo sapien
gggtctcggttttattggtcatcct

SEQ ID NO: 417191 - DNA, 25 bp, Homo sapien
ctggctggcagagcatactatctca

SEQ ID NO: 417192 - DNA, 25 bp, Homo sapien
ggcagagcatactatctcatacccc

SEQ ID NO: 417193 - DNA, 25 bp, Homo sapien
cccctttacagagtaggactctgag

SEQ ID NO: 417194 - DNA, 25 bp, Homo sapien
tgcacaggctcatggccaggttgag

SEQ ID NO: 417195 - DNA, 25 bp, Homo sapien
tggccaggttgaggctggccctcca

SEQ ID NO: 417196 - DNA, 25 bp, Homo sapien
tccaggtgcttacagcctcattgtc

SEQ ID NO: 417197 - DNA, 25 bp, Homo sapien
gtgcttacagcctcattgtctgaag

SEQ ID NO: 417198 - DNA, 25 bp, Homo sapien
tacagcctcattgtctgaagaccac

SEQ ID NO: 417199 - DNA, 25 bp, Homo sapien
ttgtctgaagaccactgtagtgccc

SEQ ID NO: 417200 - DNA, 25 bp, Homo sapien
aagaccactgtagtgccccacttgg

SEQ ID NO: 417201 - DNA, 25 bp, Homo sapien
gagccatagcagtgcgtcaagactt

SEQ ID NO: 417202 - DNA, 25 bp, Homo sapien
cttaaacgaatattggcagccagca

SEQ ID NO: 417203 - DNA, 25 bp, Homo sapien
atattggcagccagcaagaacaaac

SEQ ID NO: 417204 - DNA, 25 bp, Homo sapien
cagcaagaacaaacaagccagattt

SEQ ID NO: 417205 - DNA, 25 bp, Homo sapien
aagccagatttgagcgatagagtca

SEQ ID NO: 417206 - DNA, 25 bp, Homo sapien
gagcgatagagtcagcagttcttat

SEQ ID NO: 417207 - DNA, 25 bp, Homo sapien
agagtcagcagttcttataaaaaga

SEQ ID NO: 417208 - DNA, 25 bp, Homo sapien
ggagctgaagctggtactgaaaaag

SEQ ID NO: 417209 - DNA, 25 bp, Homo sapien
atatgttagtagaacatcctcttaa

SEQ ID NO: 417210 - DNA, 25 bp, Homo sapien
atcctcttaaaaatgtgaggccagc

SEQ ID NO: 417211 - DNA, 25 bp, Homo sapien
gaggccagcagtagaaatttggaat

SEQ ID NO: 417212 - DNA, 25 bp, Homo sapien
tgataacatttaagagttgcacagg

SEQ ID NO: 417213 - DNA, 25 bp, Homo sapien
tggcctgctttagtgtgagtgctct

SEQ ID NO: 417214 - DNA, 25 bp, Homo sapien
ggcctgctttagtgtgagtgctctg

SEQ ID NO: 417215 - DNA, 25 bp, Homo sapien
ctctgccagagggaaagctcctaga

SEQ ID NO: 417216 - DNA, 25 bp, Homo sapien
ccagagggaaagctcctagaacagt

SEQ ID NO: 417217 - DNA, 25 bp, Homo sapien
gaaagctcctagaacagtgagaagg

SEQ ID NO: 417218 - DNA, 25 bp, Homo sapien
gggaattcctcgaatactcagaggc

SEQ ID NO: 417219 - DNA, 25 bp, Homo sapien
ctcgaatactcagaggcagtagtgt

SEQ ID NO: 417220 - DNA, 25 bp, Homo sapien
ggggtagtagttgaagcacacagct

SEQ ID NO: 417221 - DNA, 25 bp, Homo sapien
cttggttctgtgaccagccttgaat

SEQ ID NO: 417222 - DNA, 25 bp, Homo sapien
ggttctgtgaccagccttgaatgag

SEQ ID NO: 417223 - DNA, 25 bp, Homo sapien
tgtgaccagccttgaatgagttatt

SEQ ID NO: 417224 - DNA, 25 bp, Homo sapien
aaaatatttgatctaggagctctta

SEQ ID NO: 417225 - DNA, 25 bp, Homo sapien
atttgatctaggagctcttatctaa

SEQ ID NO: 417226 - DNA, 25 bp, Homo sapien
ggagctcttatctaaaatgccataa

SEQ ID NO: 417227 - DNA, 25 bp, Homo sapien
aaaggatacaaattatgactgcatt

SEQ ID NO: 417228 - DNA, 25 bp, Homo sapien
gactgcattgaaaaatagcactttg

SEQ ID NO: 417229 - DNA, 25 bp, Homo sapien
aatagcactttgaagctgagcatgg

SEQ ID NO: 417230 - DNA, 25 bp, Homo sapien
taaggtttagcatttagttctcttt

SEQ ID NO: 417231 - DNA, 25 bp, Homo sapien
ttatagtggatctttattgttcatt

SEQ ID NO: 417232 - DNA, 25 bp, Homo sapien
catttatgtatgaaacctgtgctag

SEQ ID NO: 417233 - DNA, 25 bp, Homo sapien
gtatgaaacctgtgctagggattat

SEQ ID NO: 417234 - DNA, 25 bp, Homo sapien
acctgtgctagggattatagaagat

SEQ ID NO: 417235 - DNA, 25 bp, Homo sapien
aaaggatgaatacatgactccactt

SEQ ID NO: 417236 - DNA, 25 bp, Homo sapien
gatgaatacatgactccacttaatt

SEQ ID NO: 417237 - DNA, 25 bp, Homo sapien
tgaatacatgactccacttaattga

SEQ ID NO: 417238 - DNA, 25 bp, Homo sapien
acatgactccacttaattgaggtac

SEQ ID NO: 417239 - DNA, 25 bp, Homo sapien
tgactccacttaattgaggtaccta

SEQ ID NO: 417240 - DNA, 25 bp, Homo sapien
agaatggttgttgccaaaggctgga

SEQ ID NO: 417241 - DNA, 25 bp, Homo sapien
tattttttgggatatatgtagtacc

SEQ ID NO: 417242 - DNA, 25 bp, Homo sapien
ggaaagatgaaaacgtactggtgat

SEQ ID NO: 417243 - DNA, 25 bp, Homo sapien
tgaaaacgtactggtgatggatggt

SEQ ID NO: 417244 - DNA, 25 bp, Homo sapien
tatatgtagtacctggaaccaaata

SEQ ID NO: 417245 - DNA, 25 bp, Homo sapien
tgtagtacctggaaccaaatatttt

SEQ ID NO: 417246 - DNA, 25 bp, Homo sapien
catttgaattctgtttgcaatgaat

SEQ ID NO: 417247 - DNA, 25 bp, Homo sapien
ggaaactttagactgtggtcaaaag

SEQ ID NO: 417248 - DNA, 25 bp, Homo sapien
gaatgtatatcttgcttttagccca

SEQ ID NO: 417249 - DNA, 25 bp, Homo sapien
gtatatcttgcttttagcccatttg

SEQ ID NO: 417250 - DNA, 25 bp, Homo sapien
ttgcttttagcccatttgaaattat

SEQ ID NO: 417251 - DNA, 25 bp, Homo sapien
tgtttgtttctattcagttggatgt

SEQ ID NO: 417252 - DNA, 25 bp, Homo sapien
ctattcagttggatgttattgtaat

SEQ ID NO: 417253 - DNA, 25 bp, Homo sapien
gttactgaaatattacctgatcctg

SEQ ID NO: 417254 - DNA, 25 bp, Homo sapien
actgaaatattacctgatcctgatc

SEQ ID NO: 417255 - DNA, 25 bp, Homo sapien
gatcctgatcaggttgtcttttaaa

SEQ ID NO: 417256 - DNA, 25 bp, Homo sapien
aatgtctcagtgttctcaaattgcc

SEQ ID NO: 417257 - DNA, 25 bp, Homo sapien
ttccccaactaaagcgtgaactcct

SEQ ID NO: 417258 - DNA, 25 bp, Homo sapien
ccaactaaagcgtgaactcctagca

SEQ ID NO: 417259 - DNA, 25 bp, Homo sapien
aactaaagcgtgaactcctagcagg

SEQ ID NO: 417260 - DNA, 25 bp, Homo sapien
actaaagcgtgaactcctagcaggg

SEQ ID NO: 417261 - DNA, 25 bp, Homo sapien
ctaaagcgtgaactcctagcagggc

SEQ ID NO: 417262 - DNA, 25 bp, Homo sapien
taaagcgtgaactcctagcagggcg

SEQ ID NO: 417263 - DNA, 25 bp, Homo sapien
aaagcgtgaactcctagcagggcgt

SEQ ID NO: 417264 - DNA, 25 bp, Homo sapien
gcgtgaactcctagcagggcgtggt

SEQ ID NO: 417265 - DNA, 25 bp, Homo sapien
tgagcagagatctcaccagtacact

SEQ ID NO: 417266 - DNA, 25 bp, Homo sapien
gagcagagatctcaccagtacactc

SEQ ID NO: 417267 - DNA, 25 bp, Homo sapien
gcagagatctcaccagtacactcca

SEQ ID NO: 417268 - DNA, 25 bp, Homo sapien
taccgtcactgtctaaaaataccat

SEQ ID NO: 417269 - DNA, 25 bp, Homo sapien
tcactgtatcgatagctgtctgtaa

SEQ ID NO: 417270 - DNA, 25 bp, Homo sapien
tactggaactctgtggagcacgctc

SEQ ID NO: 417271 - DNA, 25 bp, Homo sapien
gatgactctgtatggagagctctgt

SEQ ID NO: 417272 - DNA, 25 bp, Homo sapien
aatactggaactctattgctagctg

SEQ ID NO: 417273 - DNA, 25 bp, Homo sapien
ttgctagctgtaaacggtgtaactc

SEQ ID NO: 417274 - DNA, 25 bp, Homo sapien
taactatgtgtcgacagctgcctat

SEQ ID NO: 417275 - DNA, 25 bp, Homo sapien
gtcgacagctgcctataaatgctat

SEQ ID NO: 417276 - DNA, 25 bp, Homo sapien
gtgtgaatactgaagctccatagct

SEQ ID NO: 417277 - DNA, 25 bp, Homo sapien
ccatagctgatagctgtcggtgtaa

SEQ ID NO: 417278 - DNA, 25 bp, Homo sapien
gtcggtgtaagcctactgtcactgt

SEQ ID NO: 417279 - DNA, 25 bp, Homo sapien
cagtatttctagaaagtgtccaaaa

SEQ ID NO: 417280 - DNA, 25 bp, Homo sapien
aagtgtccaaaaagcagtatttctt

SEQ ID NO: 417281 - DNA, 25 bp, Homo sapien
ctttcccttggttgtgagagtaact

SEQ ID NO: 417282 - DNA, 25 bp, Homo sapien
aaatacatacactggtatcacacag

SEQ ID NO: 417283 - DNA, 25 bp, Homo sapien
ggtatcacacagtctttctacaatg

SEQ ID NO: 417284 - DNA, 25 bp, Homo sapien
gtctttctacaatgtttctgtattc

SEQ ID NO: 417285 - DNA, 25 bp, Homo sapien
agaatttcctttagaagatggcagt

SEQ ID NO: 417286 - DNA, 25 bp, Homo sapien
attaatatgatttcatttgttccag

SEQ ID NO: 417287 - DNA, 25 bp, Homo sapien
gttccagtgtttagacatgaaatca

SEQ ID NO: 417288 - DNA, 25 bp, Homo sapien
aaatcatcttccttgtctcatgaaa

SEQ ID NO: 417289 - DNA, 25 bp, Homo sapien
atcatcttccttgtctcatgaaaac

SEQ ID NO: 417290 - DNA, 25 bp, Homo sapien
cttttatacaactggctgtgcaggt

SEQ ID NO: 417291 - DNA, 25 bp, Homo sapien
atacaactggctgtgcaggtttgtt

SEQ ID NO: 417292 - DNA, 25 bp, Homo sapien
ttacaccagcatcactacaaacgtg

SEQ ID NO: 417293 - DNA, 25 bp, Homo sapien
accagcatcactacaaacgtgagta

SEQ ID NO: 417294 - DNA, 25 bp, Homo sapien
aacgtgagtaatgcttccactgtga

SEQ ID NO: 417295 - DNA, 25 bp, Homo sapien
gtgagtaatgcttccactgtgacat

SEQ ID NO: 417296 - DNA, 25 bp, Homo sapien
atgcttccactgtgacattactagg

SEQ ID NO: 417297 - DNA, 25 bp, Homo sapien
tccactgtgacattactaggtgata

SEQ ID NO: 417298 - DNA, 25 bp, Homo sapien
ttaatgttatgggactactgttgta

SEQ ID NO: 417299 - DNA, 25 bp, Homo sapien
ttgtatatgtggtctcttattgacc

SEQ ID NO: 417300 - DNA, 25 bp, Homo sapien
ataaaccactaacatattcatttgt

SEQ ID NO: 417301 - DNA, 25 bp, Homo sapien
accatgtctggcagattttagcttt

SEQ ID NO: 417302 - DNA, 25 bp, Homo sapien
atgtctggcagattttagcttttta

SEQ ID NO: 417303 - DNA, 25 bp, Homo sapien
tagctttttaatattcctggaggac

SEQ ID NO: 417304 - DNA, 25 bp, Homo sapien
attcctggaggacttgttttgagac

SEQ ID NO: 417305 - DNA, 25 bp, Homo sapien
gaggacttgttttgagactgtttct

SEQ ID NO: 417306 - DNA, 25 bp, Homo sapien
gttttgagactgtttctcgttagga

SEQ ID NO: 417307 - DNA, 25 bp, Homo sapien
gagactgtttctcgttaggaaacca

SEQ ID NO: 417308 - DNA, 25 bp, Homo sapien
ttctaaaagtcatgtggagagagtt

SEQ ID NO: 417309 - DNA, 25 bp, Homo sapien
cctgggaatgtacatttctagtaac

SEQ ID NO: 417310 - DNA, 25 bp, Homo sapien
gtacatttctagtaaccattttatt

SEQ ID NO: 417311 - DNA, 25 bp, Homo sapien
gttacattagttaaactctgttgcc

SEQ ID NO: 417312 - DNA, 25 bp, Homo sapien
aagtttgagcagtttttccaaggca

SEQ ID NO: 417313 - DNA, 25 bp, Homo sapien
tgatagttagattcagggccaggct

SEQ ID NO: 417314 - DNA, 25 bp, Homo sapien
agggccaggctgtaagtctagaatt

SEQ ID NO: 417315 - DNA, 25 bp, Homo sapien
ctagaatttagatatcctgatcccc

SEQ ID NO: 417316 - DNA, 25 bp, Homo sapien
agataccgctcttctggttatacac

SEQ ID NO: 417317 - DNA, 25 bp, Homo sapien
ggttatacacagaccagctataatt

SEQ ID NO: 417318 - DNA, 25 bp, Homo sapien
tgtattagccagctgtggctccaga

SEQ ID NO: 417319 - DNA, 25 bp, Homo sapien
agagtctgtgccctttaccaccgtg

SEQ ID NO: 417320 - DNA, 25 bp, Homo sapien
tgcccaactgtttcacatgctgtgt

SEQ ID NO: 417321 - DNA, 25 bp, Homo sapien
tagtttttcctagtgctctccttaa

SEQ ID NO: 417322 - DNA, 25 bp, Homo sapien
gtgctctccttaataatggtggtgt

SEQ ID NO: 417323 - DNA, 25 bp, Homo sapien
agctgtctctggctgaaccggcgct

SEQ ID NO: 417324 - DNA, 25 bp, Homo sapien
gtctctggctgaaccggcgctctcg

SEQ ID NO: 417325 - DNA, 25 bp, Homo sapien
tccctgccgaacacagcgtgaggag

SEQ ID NO: 417326 - DNA, 25 bp, Homo sapien
cctgccgaacacagcgtgaggagcc

SEQ ID NO: 417327 - DNA, 25 bp, Homo sapien
atggtgtttgagtctctgggcttgc

SEQ ID NO: 417328 - DNA, 25 bp, Homo sapien
gtctctgggcttgccgagcactaag

SEQ ID NO: 417329 - DNA, 25 bp, Homo sapien
tctgggcttgccgagcactaagtcc

SEQ ID NO: 417330 - DNA, 25 bp, Homo sapien
ctgggcttgccgagcactaagtcct

SEQ ID NO: 417331 - DNA, 25 bp, Homo sapien
gcactaagtcctctgagttccgcag

SEQ ID NO: 417332 - DNA, 25 bp, Homo sapien
aagtcctctgagttccgcagcgcag

SEQ ID NO: 417333 - DNA, 25 bp, Homo sapien
agttccgcagcgcagcaccggaagc

SEQ ID NO: 417334 - DNA, 25 bp, Homo sapien
aggagtgggactgtctgatccctgc

SEQ ID NO: 417335 - DNA, 25 bp, Homo sapien
gggcctctacaaggatgtgatgatg

SEQ ID NO: 417336 - DNA, 25 bp, Homo sapien
gggacctatgggaacctactctcat

SEQ ID NO: 417337 - DNA, 25 bp, Homo sapien
tactctcattagtaggtgaatggtt

SEQ ID NO: 417338 - DNA, 25 bp, Homo sapien
ccataccatgggatacgactcaaca

SEQ ID NO: 417339 - DNA, 25 bp, Homo sapien
taccatgggatacgactcaacaatc

SEQ ID NO: 417340 - DNA, 25 bp, Homo sapien
gggatacgactcaacaatcaaaagg

SEQ ID NO: 417341 - DNA, 25 bp, Homo sapien
tcaaaaggaactgcccagacttcac

SEQ ID NO: 417342 - DNA, 25 bp, Homo sapien
gacttcaccacgatgcaatatatgc

SEQ ID NO: 417343 - DNA, 25 bp, Homo sapien
tgtaagaaatctgcacttatacccc

SEQ ID NO: 417344 - DNA, 25 bp, Homo sapien
aaaggaagaagatacatgcaacaac

SEQ ID NO: 417345 - DNA, 25 bp, Homo sapien
gcactaagtcctctgagttccgcag

SEQ ID NO: 417346 - DNA, 25 bp, Homo sapien
cactaagtcctctgagttccgcagc

SEQ ID NO: 417347 - DNA, 25 bp, Homo sapien
actaagtcctctgagttccgcagcg

SEQ ID NO: 417348 - DNA, 25 bp, Homo sapien
taagtcctctgagttccgcagcgca

SEQ ID NO: 417349 - DNA, 25 bp, Homo sapien
aagtcctctgagttccgcagcgcag

SEQ ID NO: 417350 - DNA, 25 bp, Homo sapien
agtcctctgagttccgcagcgcagc

SEQ ID NO: 417351 - DNA, 25 bp, Homo sapien
gtcctctgagttccgcagcgcagca

SEQ ID NO: 417352 - DNA, 25 bp, Homo sapien
tctgagttccgcagcgcagcaccgg

SEQ ID NO: 417353 - DNA, 25 bp, Homo sapien
agttccgcagcgcagcaccggaagc

SEQ ID NO: 417354 - DNA, 25 bp, Homo sapien
gttccgcagcgcagcaccggaagcg

SEQ ID NO: 417355 - DNA, 25 bp, Homo sapien
gcgcagcaccggaagcggccgagcg

SEQ ID NO: 417356 - DNA, 25 bp, Homo sapien
tcaacccattgaatagtacatttaa

SEQ ID NO: 417357 - DNA, 25 bp, Homo sapien
aatgatttctcaataaagtcgttaa

SEQ ID NO: 417358 - DNA, 25 bp, Homo sapien
actcagtaaaataactcaatagggt

SEQ ID NO: 417359 - DNA, 25 bp, Homo sapien
aactcaatagggtaataggtatgat

SEQ ID NO: 417360 - DNA, 25 bp, Homo sapien
atcaaaagccttcataaatgtaaac

SEQ ID NO: 417361 - DNA, 25 bp, Homo sapien
taaggaaggctggtccaaaggtcca

SEQ ID NO: 417362 - DNA, 25 bp, Homo sapien
ggaaggctggtccaaaggtccaact

SEQ ID NO: 417363 - DNA, 25 bp, Homo sapien
ggtgatggctgtacagctctctaaa

SEQ ID NO: 417364 - DNA, 25 bp, Homo sapien
ggctgtacagctctctaaatatact

SEQ ID NO: 417365 - DNA, 25 bp, Homo sapien
gctctctaaatatacttcaacccat

SEQ ID NO: 417366 - DNA, 25 bp, Homo sapien
ctctaaatatacttcaacccattga

SEQ ID NO: 417367 - DNA, 25 bp, Homo sapien
gagccctatggatttattatgcagc

SEQ ID NO: 417368 - DNA, 25 bp, Homo sapien
tattatgcagcctgtcaaaaatata

SEQ ID NO: 417369 - DNA, 25 bp, Homo sapien
aaactatagatacatttggtaaggt

SEQ ID NO: 417370 - DNA, 25 bp, Homo sapien
ggttggatatcttaccatttatgaa

SEQ ID NO: 417371 - DNA, 25 bp, Homo sapien
tatgaaatttagtggctgggcgcag

SEQ ID NO: 417372 - DNA, 25 bp, Homo sapien
atgggcgcagctgagatacaacact

SEQ ID NO: 417373 - DNA, 25 bp, Homo sapien
ggcgcagctgagatacaacactcat

SEQ ID NO: 417374 - DNA, 25 bp, Homo sapien
gctgagatacaacactcattttctt

SEQ ID NO: 417375 - DNA, 25 bp, Homo sapien
tcttcttactgaataatccttgttg

SEQ ID NO: 417376 - DNA, 25 bp, Homo sapien
tcttactgaataatccttgttgaaa

SEQ ID NO: 417377 - DNA, 25 bp, Homo sapien
gttgaaattcagatagagccctatg

SEQ ID NO: 417378 - DNA, 25 bp, Homo sapien
ctagtgttctgccattaactattag

SEQ ID NO: 417379 - DNA, 25 bp, Homo sapien
gtgttctgccattaactattagatt

SEQ ID NO: 417380 - DNA, 25 bp, Homo sapien
ctattagatttattggttgaaggtt

SEQ ID NO: 417381 - DNA, 25 bp, Homo sapien
gttgaaggtttgagagatttctttt

SEQ ID NO: 417382 - DNA, 25 bp, Homo sapien
tcctgatgttaatgaacattcttaa

SEQ ID NO: 417383 - DNA, 25 bp, Homo sapien
cattcttaatgaagacctttccgtt

SEQ ID NO: 417384 - DNA, 25 bp, Homo sapien
ttaatgaagacctttccgttaatga

SEQ ID NO: 417385 - DNA, 25 bp, Homo sapien
gaagacctttccgttaatgaggaat

SEQ ID NO: 417386 - DNA, 25 bp, Homo sapien
gacctttccgttaatgaggaatgtt

SEQ ID NO: 417387 - DNA, 25 bp, Homo sapien
gcctcagcttcactagagcagtttt

SEQ ID NO: 417388 - DNA, 25 bp, Homo sapien
tcagcttcactagagcagttttaag

SEQ ID NO: 417389 - DNA, 25 bp, Homo sapien
ttgcaataaatgtaaagctgaatct

SEQ ID NO: 417390 - DNA, 25 bp, Homo sapien
gctgaatcttagaatttcaaacgga

SEQ ID NO: 417391 - DNA, 25 bp, Homo sapien
aagtgtaactgttgagtttttccat

SEQ ID NO: 417392 - DNA, 25 bp, Homo sapien
aactgttgagtttttccatattggc

SEQ ID NO: 417393 - DNA, 25 bp, Homo sapien
ttccatattggcaatatactgccag

SEQ ID NO: 417394 - DNA, 25 bp, Homo sapien
gcaatatactgccaggttcccttat

SEQ ID NO: 417395 - DNA, 25 bp, Homo sapien
tactgccaggttcccttatggacag

SEQ ID NO: 417396 - DNA, 25 bp, Homo sapien
gttcccttatggacagaatgaatca

SEQ ID NO: 417397 - DNA, 25 bp, Homo sapien
cagaatgaatcatcggctgggtgca

SEQ ID NO: 417398 - DNA, 25 bp, Homo sapien
tggctcatgctgctaatcctcagga

SEQ ID NO: 417399 - DNA, 25 bp, Homo sapien
tcatgctgctaatcctcaggaagat

SEQ ID NO: 417400 - DNA, 25 bp, Homo sapien
tactctcattagtaggtgaatggtt

SEQ ID NO: 417401 - DNA, 25 bp, Homo sapien
ccataccatgggatacgactcaaca

SEQ ID NO: 417402 - DNA, 25 bp, Homo sapien
ataccatgggatacgactcaacaat

SEQ ID NO: 417403 - DNA, 25 bp, Homo sapien
ccatgggatacgactcaacaatcaa

SEQ ID NO: 417404 - DNA, 25 bp, Homo sapien
gggatacgactcaacaatcaaaagg

SEQ ID NO: 417405 - DNA, 25 bp, Homo sapien
caatcaaaaggaactgcccagactt

SEQ ID NO: 417406 - DNA, 25 bp, Homo sapien
tcaaaaggaactgcccagacttcac

SEQ ID NO: 417407 - DNA, 25 bp, Homo sapien
gacttcaccacgatgcaatatatgc

SEQ ID NO: 417408 - DNA, 25 bp, Homo sapien
caccacgatgcaatatatgcatgta

SEQ ID NO: 417409 - DNA, 25 bp, Homo sapien
tgtaagaaatctgcacttatacccc

SEQ ID NO: 417410 - DNA, 25 bp, Homo sapien
aaaggaagaagatacatgcaacaac

SEQ ID NO: 417411 - DNA, 25 bp, Homo sapien
acgaatgtgagatcaggtaactggt

SEQ ID NO: 417412 - DNA, 25 bp, Homo sapien
ctggtgatagttgcagatctgggac

SEQ ID NO: 417413 - DNA, 25 bp, Homo sapien
tgcagatctgggactagaaaccaat

SEQ ID NO: 417414 - DNA, 25 bp, Homo sapien
gcacaggaagggttgcattcagcaa

SEQ ID NO: 417415 - DNA, 25 bp, Homo sapien
gaagttatgctcagcatggttgctc

SEQ ID NO: 417416 - DNA, 25 bp, Homo sapien
tcagcatggttgctcgtgcctgtaa

SEQ ID NO: 417417 - DNA, 25 bp, Homo sapien
gtagaattttaaagctcggaagaga

SEQ ID NO: 417418 - DNA, 25 bp, Homo sapien
ggaagagacctttagcaagcccctg

SEQ ID NO: 417419 - DNA, 25 bp, Homo sapien
agacctttagcaagcccctgatttt

SEQ ID NO: 417420 - DNA, 25 bp, Homo sapien
agcaagcccctgattttgtaggtga

SEQ ID NO: 417421 - DNA, 25 bp, Homo sapien
gcccctgattttgtaggtgagagaa

SEQ ID NO: 417422 - DNA, 25 bp, Homo sapien
ctcaacaccagagagctcatattga

SEQ ID NO: 417423 - DNA, 25 bp, Homo sapien
aacaccagagagctcatattgatga

SEQ ID NO: 417424 - DNA, 25 bp, Homo sapien
catattgatgagaaatcttgtgaac

SEQ ID NO: 417425 - DNA, 25 bp, Homo sapien
gctcaacttctgagtattcatactt

SEQ ID NO: 417426 - DNA, 25 bp, Homo sapien
gagtattcatacttctgagaaatct

SEQ ID NO: 417427 - DNA, 25 bp, Homo sapien
tcatacttctgagaaatctttgagt

SEQ ID NO: 417428 - DNA, 25 bp, Homo sapien
agagttcggagaagataattcttgt

SEQ ID NO: 417429 - DNA, 25 bp, Homo sapien
gataattcttgtgagaaagtctttg

SEQ ID NO: 417430 - DNA, 25 bp, Homo sapien
aatatagggtagttgtcatgttcac

SEQ ID NO: 417431 - DNA, 25 bp, Homo sapien
gtcatgttcacaatgtactccctat

SEQ ID NO: 417432 - DNA, 25 bp, Homo sapien
gttcacaatgtactccctatgaaat

SEQ ID NO: 417433 - DNA, 25 bp, Homo sapien
cccagggcatggaggtgagatacag

SEQ ID NO: 417434 - DNA, 25 bp, Homo sapien
gtacaggatgctgaagggcccctaa

SEQ ID NO: 417435 - DNA, 25 bp, Homo sapien
tgaagggcccctaaaaattcgcagt

SEQ ID NO: 417436 - DNA, 25 bp, Homo sapien
ggcccctaaaaattcgcagttgcac

SEQ ID NO: 417437 - DNA, 25 bp, Homo sapien
aaaattcgcagttgcactcctgcag

SEQ ID NO: 417438 - DNA, 25 bp, Homo sapien
gttgcactcctgcagtattctgaga

SEQ ID NO: 417439 - DNA, 25 bp, Homo sapien
gcactcctgcagtattctgagatgt

SEQ ID NO: 417440 - DNA, 25 bp, Homo sapien
cagtattctgagatgtctggagctc

SEQ ID NO: 417441 - DNA, 25 bp, Homo sapien
atgtctggagctcagttacgattcc

SEQ ID NO: 417442 - DNA, 25 bp, Homo sapien
tggagctcagttacgattccctttt

SEQ ID NO: 417443 - DNA, 25 bp, Homo sapien
ctcagttacgattcccttttccagg

SEQ ID NO: 417444 - DNA, 25 bp, Homo sapien
ggttttgctactattttgccgacag

SEQ ID NO: 417445 - DNA, 25 bp, Homo sapien
tattttgccgacagacatggatggt

SEQ ID NO: 417446 - DNA, 25 bp, Homo sapien
acatggatggtgttccttcctctct

SEQ ID NO: 417447 - DNA, 25 bp, Homo sapien
tcctctctatcttgaattacttggc

SEQ ID NO: 417448 - DNA, 25 bp, Homo sapien
aattacttggcctcacagtacttga

SEQ ID NO: 417449 - DNA, 25 bp, Homo sapien
cagtacttgagaacattccatttca

SEQ ID NO: 417450 - DNA, 25 bp, Homo sapien
ccatagcggtatagcctactaatgt

SEQ ID NO: 417451 - DNA, 25 bp, Homo sapien
tccaggcaacatgctaggtcaatgt

SEQ ID NO: 417452 - DNA, 25 bp, Homo sapien
acatgctaggtcaatgtgacttact

SEQ ID NO: 417453 - DNA, 25 bp, Homo sapien
gtgacttactaagttttgacctttg

SEQ ID NO: 417454 - DNA, 25 bp, Homo sapien
agttaactaaattcctatgcgagag

SEQ ID NO: 417455 - DNA, 25 bp, Homo sapien
aaacaccatgtgtaactttgctaat

SEQ ID NO: 417456 - DNA, 25 bp, Homo sapien
acaccatgtgtaactttgctaatta

SEQ ID NO: 417457 - DNA, 25 bp, Homo sapien
gtgtaactttgctaattaatggact

SEQ ID NO: 417458 - DNA, 25 bp, Homo sapien
aactttgctaattaatggactagat

SEQ ID NO: 417459 - DNA, 25 bp, Homo sapien
tggactagatatacaaatacaaact

SEQ ID NO: 417460 - DNA, 25 bp, Homo sapien
gtggctcatatttgtagtccaagct

SEQ ID NO: 417461 - DNA, 25 bp, Homo sapien
cctgagtttagctgtttaggaaaga

SEQ ID NO: 417462 - DNA, 25 bp, Homo sapien
ggctcatatttgtagtccaagctac

SEQ ID NO: 417463 - DNA, 25 bp, Homo sapien
gctgtttaggaaagaggcaataact

SEQ ID NO: 417464 - DNA, 25 bp, Homo sapien
gaggcaataactaaacgaaggagac

SEQ ID NO: 417465 - DNA, 25 bp, Homo sapien
taaacgaaggagacagtagagtcaa

SEQ ID NO: 417466 - DNA, 25 bp, Homo sapien
aaaaaccagggcactcaggcaagga

SEQ ID NO: 417467 - DNA, 25 bp, Homo sapien
aaaccagggcactcaggcaaggagg

SEQ ID NO: 417468 - DNA, 25 bp, Homo sapien
gcactcaggcaaggagggataaagt

SEQ ID NO: 417469 - DNA, 25 bp, Homo sapien
aaagtgaggagcttgatcatgtcat

SEQ ID NO: 417470 - DNA, 25 bp, Homo sapien
gaggagcttgatcatgtcataacca

SEQ ID NO: 417471 - DNA, 25 bp, Homo sapien
tgatcatgtcataaccaagctttgg

SEQ ID NO: 417472 - DNA, 25 bp, Homo sapien
atcatgtcataaccaagctttggtg

SEQ ID NO: 417473 - DNA, 25 bp, Homo sapien
gggcagcaggacctactcatgtccc

SEQ ID NO: 417474 - DNA, 25 bp, Homo sapien
agcaggacctactcatgtccctctg

SEQ ID NO: 417475 - DNA, 25 bp, Homo sapien
aaacaaatgtgtttggctgggcaca

SEQ ID NO: 417476 - DNA, 25 bp, Homo sapien
aacaaatgtgtttggctgggcacag

SEQ ID NO: 417477 - DNA, 25 bp, Homo sapien
aattctaaagatgttccccatgggt

SEQ ID NO: 417478 - DNA, 25 bp, Homo sapien
aaagatgttccccatgggttttgat

SEQ ID NO: 417479 - DNA, 25 bp, Homo sapien
ttccccatgggttttgattgtgtct

SEQ ID NO: 417480 - DNA, 25 bp, Homo sapien
ccatgggttttgattgtgtctaagc

SEQ ID NO: 417481 - DNA, 25 bp, Homo sapien
gttttgattgtgtctaagctatgat

SEQ ID NO: 417482 - DNA, 25 bp, Homo sapien
tttacttaacatgagtgcactttac

SEQ ID NO: 417483 - DNA, 25 bp, Homo sapien
agtgcactttactaatcctcatggc

SEQ ID NO: 417484 - DNA, 25 bp, Homo sapien
gcactttactaatcctcatggcaca

SEQ ID NO: 417485 - DNA, 25 bp, Homo sapien
ctttactaatcctcatggcacagtg

SEQ ID NO: 417486 - DNA, 25 bp, Homo sapien
gtgtctcatccaggataggataggt

SEQ ID NO: 417487 - DNA, 25 bp, Homo sapien
tccaggataggataggttgtcttct

SEQ ID NO: 417488 - DNA, 25 bp, Homo sapien
aatgttattgactcctcaaccatgg

SEQ ID NO: 417489 - DNA, 25 bp, Homo sapien
tattgactcctcaaccatggttttt

SEQ ID NO: 417490 - DNA, 25 bp, Homo sapien
gaacagcaacctaaaatactcatac

SEQ ID NO: 417491 - DNA, 25 bp, Homo sapien
atgatcacattattgcacgttagcc

SEQ ID NO: 417492 - DNA, 25 bp, Homo sapien
atcacattattgcacgttagcctgg

SEQ ID NO: 417493 - DNA, 25 bp, Homo sapien
cattattgcacgttagcctgggtaa

SEQ ID NO: 417494 - DNA, 25 bp, Homo sapien
ttattgcacgttagcctgggtaaca

SEQ ID NO: 417495 - DNA, 25 bp, Homo sapien
aatactcatacagttagctctaaca

SEQ ID NO: 417496 - DNA, 25 bp, Homo sapien
tctaacaatgtttacaagtcttaaa

SEQ ID NO: 417497 - DNA, 25 bp, Homo sapien
tttacaagtcttaaaactattcctg

SEQ ID NO: 417498 - DNA, 25 bp, Homo sapien
ttcctgcaaattgttgtattacata

SEQ ID NO: 417499 - DNA, 25 bp, Homo sapien
agttcataatatgggaggctaaggc

SEQ ID NO: 417500 - DNA, 25 bp, Homo sapien
tgacattcccaggatggtttcctca

SEQ ID NO: 417501 - DNA, 25 bp, Homo sapien
gacattcccaggatggtttcctcac

SEQ ID NO: 417502 - DNA, 25 bp, Homo sapien
tcagcatgggcgctagagccagacc

SEQ ID NO: 417503 - DNA, 25 bp, Homo sapien
agcatgggcgctagagccagaccct

SEQ ID NO: 417504 - DNA, 25 bp, Homo sapien
gcatgggcgctagagccagaccctg

SEQ ID NO: 417505 - DNA, 25 bp, Homo sapien
tcccaggatggtttcctcactgatt

SEQ ID NO: 417506 - DNA, 25 bp, Homo sapien
ccaggatggtttcctcactgattaa

SEQ ID NO: 417507 - DNA, 25 bp, Homo sapien
aaatgttttagtgaatttgatgcta

SEQ ID NO: 417508 - DNA, 25 bp, Homo sapien
tttgatgctaattctgttctagaac

SEQ ID NO: 417509 - DNA, 25 bp, Homo sapien
gtattatttgcagttctgttgtata

SEQ ID NO: 417510 - DNA, 25 bp, Homo sapien
gggctccagcagttcgcccacctca

SEQ ID NO: 417511 - DNA, 25 bp, Homo sapien
tgcctggccccacaaagtgttttgt

SEQ ID NO: 417512 - DNA, 25 bp, Homo sapien
gcctggccccacaaagtgttttgta

SEQ ID NO: 417513 - DNA, 25 bp, Homo sapien
cctggccccacaaagtgttttgtag

SEQ ID NO: 417514 - DNA, 25 bp, Homo sapien
ctggccccacaaagtgttttgtaga

SEQ ID NO: 417515 - DNA, 25 bp, Homo sapien
gccccacaaagtgttttgtagagac

SEQ ID NO: 417516 - DNA, 25 bp, Homo sapien
gtcttgttttgtctcctaggttggt

SEQ ID NO: 417517 - DNA, 25 bp, Homo sapien
tcttgttttgtctcctaggttggtc

SEQ ID NO: 417518 - DNA, 25 bp, Homo sapien
ttgttttgtctcctaggttggtctt

SEQ ID NO: 417519 - DNA, 25 bp, Homo sapien
ttttgtctcctaggttggtcttgaa

SEQ ID NO: 417520 - DNA, 25 bp, Homo sapien
tgaactcttcaccttaagcgatcct

SEQ ID NO: 417521 - DNA, 25 bp, Homo sapien
agttcataatatgggaggctaaggc

SEQ ID NO: 417522 - DNA, 25 bp, Homo sapien
tgacattcccaggatggtttcctca

SEQ ID NO: 417523 - DNA, 25 bp, Homo sapien
gacattcccaggatggtttcctcac

SEQ ID NO: 417524 - DNA, 25 bp, Homo sapien
tcagcatgggcgctagagccagacc

SEQ ID NO: 417525 - DNA, 25 bp, Homo sapien
cagcatgggcgctagagccagaccc

SEQ ID NO: 417526 - DNA, 25 bp, Homo sapien
agcatgggcgctagagccagaccct

SEQ ID NO: 417527 - DNA, 25 bp, Homo sapien
gcatgggcgctagagccagaccctg

SEQ ID NO: 417528 - DNA, 25 bp, Homo sapien
tcccaggatggtttcctcactgatt

SEQ ID NO: 417529 - DNA, 25 bp, Homo sapien
cccaggatggtttcctcactgatta

SEQ ID NO: 417530 - DNA, 25 bp, Homo sapien
ccaggatggtttcctcactgattaa

SEQ ID NO: 417531 - DNA, 25 bp, Homo sapien
gttttagtgaatttgatgctaattc

SEQ ID NO: 417532 - DNA, 25 bp, Homo sapien
cagacttatctataatatgaaaatt

SEQ ID NO: 417533 - DNA, 25 bp, Homo sapien
ttttaaaaatgcatacatcggccgg

SEQ ID NO: 417534 - DNA, 25 bp, Homo sapien
tttaaaaatgcatacatcggccggg

SEQ ID NO: 417535 - DNA, 25 bp, Homo sapien
ttaaaaatgcatacatcggccgggt

SEQ ID NO: 417536 - DNA, 25 bp, Homo sapien
taaaaatgcatacatcggccgggtg

SEQ ID NO: 417537 - DNA, 25 bp, Homo sapien
aaaaatgcatacatcggccgggtgc

SEQ ID NO: 417538 - DNA, 25 bp, Homo sapien
aaaatgcatacatcggccgggtgca

SEQ ID NO: 417539 - DNA, 25 bp, Homo sapien
aaatgcatacatcggccgggtgcag

SEQ ID NO: 417540 - DNA, 25 bp, Homo sapien
aatgcatacatcggccgggtgcagt

SEQ ID NO: 417541 - DNA, 25 bp, Homo sapien
atgcatacatcggccgggtgcagtg

SEQ ID NO: 417542 - DNA, 25 bp, Homo sapien
tgcatacatcggccgggtgcagtgg

SEQ ID NO: 417543 - DNA, 25 bp, Homo sapien
tctttcaggtaagtaagtggctttt

SEQ ID NO: 417544 - DNA, 25 bp, Homo sapien
ggctttttagagtgattgccttttc

SEQ ID NO: 417545 - DNA, 25 bp, Homo sapien
ccctcaaagagcctaattttctgta

SEQ ID NO: 417546 - DNA, 25 bp, Homo sapien
caaagagcctaattttctgtactaa

SEQ ID NO: 417547 - DNA, 25 bp, Homo sapien
gagcctaattttctgtactaaatgc

SEQ ID NO: 417548 - DNA, 25 bp, Homo sapien
tttctgtactaaatgctgcaattcg

SEQ ID NO: 417549 - DNA, 25 bp, Homo sapien
gctgcaattcgattatatttagtct

SEQ ID NO: 417550 - DNA, 25 bp, Homo sapien
ttaatttctttcatctctaataatg

SEQ ID NO: 417551 - DNA, 25 bp, Homo sapien
tcatctctaataatggtcaccatat

SEQ ID NO: 417552 - DNA, 25 bp, Homo sapien
aataatggtcaccatatgatttttc

SEQ ID NO: 417553 - DNA, 25 bp, Homo sapien
tttcaggcatgttatatcaccatta

SEQ ID NO: 417554 - DNA, 25 bp, Homo sapien
ctgggctccagcagttcgcccacct

SEQ ID NO: 417555 - DNA, 25 bp, Homo sapien
gggctccagcagttcgcccacctca

SEQ ID NO: 417556 - DNA, 25 bp, Homo sapien
ggctccagcagttcgcccacctcag

SEQ ID NO: 417557 - DNA, 25 bp, Homo sapien
gctccagcagttcgcccacctcagc

SEQ ID NO: 417558 - DNA, 25 bp, Homo sapien
tgcctggccccacaaagtgttttgt

SEQ ID NO: 417559 - DNA, 25 bp, Homo sapien
gcctggccccacaaagtgttttgta

SEQ ID NO: 417560 - DNA, 25 bp, Homo sapien
cctggccccacaaagtgttttgtag

SEQ ID NO: 417561 - DNA, 25 bp, Homo sapien
ctggccccacaaagtgttttgtaga

SEQ ID NO: 417562 - DNA, 25 bp, Homo sapien
gaaagtgcttttatggatatcttag

SEQ ID NO: 417563 - DNA, 25 bp, Homo sapien
gatatcttagcttatccttcgtcca

SEQ ID NO: 417564 - DNA, 25 bp, Homo sapien
tatcttagcttatccttcgtccatt

SEQ ID NO: 417565 - DNA, 25 bp, Homo sapien
ttagcttatccttcgtccatttaaa

SEQ ID NO: 417566 - DNA, 25 bp, Homo sapien
gcttatccttcgtccatttaaatat

SEQ ID NO: 417567 - DNA, 25 bp, Homo sapien
tccttcgtccatttaaatattgtta

SEQ ID NO: 417568 - DNA, 25 bp, Homo sapien
tattgttagttttagccgggaacat

SEQ ID NO: 417569 - DNA, 25 bp, Homo sapien
agttttagccgggaacatgcctgta

SEQ ID NO: 417570 - DNA, 25 bp, Homo sapien
taagacagtaacaaagatggcaaag

SEQ ID NO: 417571 - DNA, 25 bp, Homo sapien
agtatgctgtattacctgaaagtgc

SEQ ID NO: 417572 - DNA, 25 bp, Homo sapien
gctgtattacctgaaagtgctttta

SEQ ID NO: 417573 - DNA, 25 bp, Homo sapien
atctgtaatagagaaccattttggc

SEQ ID NO: 417574 - DNA, 25 bp, Homo sapien
aatcagtctgacaaaatagttctct

SEQ ID NO: 417575 - DNA, 25 bp, Homo sapien
tggcatttgaacagctattttacat

SEQ ID NO: 417576 - DNA, 25 bp, Homo sapien
aacacatctgtttgctttacccaga

SEQ ID NO: 417577 - DNA, 25 bp, Homo sapien
gtttcatcttcatattgtttagtag

SEQ ID NO: 417578 - DNA, 25 bp, Homo sapien
gagtagtcctttatctttctctaat

SEQ ID NO: 417579 - DNA, 25 bp, Homo sapien
atagttctctggtagtcagcattca

SEQ ID NO: 417580 - DNA, 25 bp, Homo sapien
gtcagcattcatttaaggcagcttg

SEQ ID NO: 417581 - DNA, 25 bp, Homo sapien
aggcagcttgcctgataatttcctg

SEQ ID NO: 417582 - DNA, 25 bp, Homo sapien
gcttgcctgataatttcctgtgtta

SEQ ID NO: 417583 - DNA, 25 bp, Homo sapien
ctgtgttatgtgaagtgtcttgcac

SEQ ID NO: 417584 - DNA, 25 bp, Homo sapien
aacatgggaagagcctgtctcttgc

SEQ ID NO: 417585 - DNA, 25 bp, Homo sapien
gaaagttcttgtctcaggctagctt

SEQ ID NO: 417586 - DNA, 25 bp, Homo sapien
agttcttgtctcaggctagctttgg

SEQ ID NO: 417587 - DNA, 25 bp, Homo sapien
ggaccaaatgaagcactcccatgta

SEQ ID NO: 417588 - DNA, 25 bp, Homo sapien
agcactcccatgtaggcactcaaat

SEQ ID NO: 417589 - DNA, 25 bp, Homo sapien
ggcactcaaatggaactatgtaaac

SEQ ID NO: 417590 - DNA, 25 bp, Homo sapien
gtaaaccttaggcaaggcacctctg

SEQ ID NO: 417591 - DNA, 25 bp, Homo sapien
ttaggcaaggcacctctgcctcagt

SEQ ID NO: 417592 - DNA, 25 bp, Homo sapien
cgggacagtccgtatgtgggttata

SEQ ID NO: 417593 - DNA, 25 bp, Homo sapien
aggtgcttgctgttaccaggccata

SEQ ID NO: 417594 - DNA, 25 bp, Homo sapien
caggccatatgggttattcacagat

SEQ ID NO: 417595 - DNA, 25 bp, Homo sapien
ggagacctcacttttttatggctgc

SEQ ID NO: 417596 - DNA, 25 bp, Homo sapien
gttgatgggcatttatccacttcac

SEQ ID NO: 417597 - DNA, 25 bp, Homo sapien
ggcatttatccacttcactgttggt

SEQ ID NO: 417598 - DNA, 25 bp, Homo sapien
gtgggaatttaggttgaatccatgt

SEQ ID NO: 417599 - DNA, 25 bp, Homo sapien
gaagtcacactttttaatcaagtta

SEQ ID NO: 417600 - DNA, 25 bp, Homo sapien
ttatttaactttcctgtgttcattt

SEQ ID NO: 417601 - DNA, 25 bp, Homo sapien
gtgttcatttgtgttatataccaga

SEQ ID NO: 417602 - DNA, 25 bp, Homo sapien
tttctatggttttaatgccacctaa

SEQ ID NO: 417603 - DNA, 25 bp, Homo sapien
ggttttaatgccacctaatatgatt

SEQ ID NO: 417604 - DNA, 25 bp, Homo sapien
gattatcaatgtgtcattctccata

SEQ ID NO: 417605 - DNA, 25 bp, Homo sapien
cattctccataaatcattgtgttat

SEQ ID NO: 417606 - DNA, 25 bp, Homo sapien
cagaacatggctcaggactcctgaa

SEQ ID NO: 417607 - DNA, 25 bp, Homo sapien
tcaggactcctgaaaatcatcccat

SEQ ID NO: 417608 - DNA, 25 bp, Homo sapien
aaatcatcccattcgggagcaagtg

SEQ ID NO: 417609 - DNA, 25 bp, Homo sapien
atcccattcgggagcaagtgggttt

SEQ ID NO: 417610 - DNA, 25 bp, Homo sapien
gattagctttcatgcaaacacttgg

SEQ ID NO: 417611 - DNA, 25 bp, Homo sapien
gctttcatgcaaacacttggtccat

SEQ ID NO: 417612 - DNA, 25 bp, Homo sapien
gcaaacacttggtccatttggccat

SEQ ID NO: 417613 - DNA, 25 bp, Homo sapien
aacacttggtccatttggccattta

SEQ ID NO: 417614 - DNA, 25 bp, Homo sapien
acttggtccatttggccatttaata

SEQ ID NO: 417615 - DNA, 25 bp, Homo sapien
aagactgaagtctcatgttccataa

SEQ ID NO: 417616 - DNA, 25 bp, Homo sapien
actgaagtctcatgttccataactt

SEQ ID NO: 417617 - DNA, 25 bp, Homo sapien
atttcaggaatatgtcttgtgccag

SEQ ID NO: 417618 - DNA, 25 bp, Homo sapien
aggaatatgtcttgtgccaggaact

SEQ ID NO: 417619 - DNA, 25 bp, Homo sapien
gtgtagtgattacatgttcgcttca

SEQ ID NO: 417620 - DNA, 25 bp, Homo sapien
gtgattacatgttcgcttcacatgt

SEQ ID NO: 417621 - DNA, 25 bp, Homo sapien
atgttcgcttcacatgtgaaaggtc

SEQ ID NO: 417622 - DNA, 25 bp, Homo sapien
acatgtgaaaggtctcaggtttggg

SEQ ID NO: 417623 - DNA, 25 bp, Homo sapien
aggtctcaggtttgggacctttcat

SEQ ID NO: 417624 - DNA, 25 bp, Homo sapien
tctcaggtttgggacctttcatcat

SEQ ID NO: 417625 - DNA, 25 bp, Homo sapien
aggtttgggacctttcatcatcaac

SEQ ID NO: 417626 - DNA, 25 bp, Homo sapien
aattgcttaattccaagaggtagat

SEQ ID NO: 417627 - DNA, 25 bp, Homo sapien
taattccaagaggtagatgttgcag

SEQ ID NO: 417628 - DNA, 25 bp, Homo sapien
ttgtgggagcaccaggacagagcag

SEQ ID NO: 417629 - DNA, 25 bp, Homo sapien
tgcccctgtggacctcgaatgcaga

SEQ ID NO: 417630 - DNA, 25 bp, Homo sapien
tgtggacctcgaatgcagagcttat

SEQ ID NO: 417631 - DNA, 25 bp, Homo sapien
gaatgcagagcttatgcacctaccg

SEQ ID NO: 417632 - DNA, 25 bp, Homo sapien
tgcagagcttatgcacctaccgaag

SEQ ID NO: 417633 - DNA, 25 bp, Homo sapien
gtgtcagcacccaaggcagaacgag

SEQ ID NO: 417634 - DNA, 25 bp, Homo sapien
agcacccaaggcagaacgaggctgc

SEQ ID NO: 417635 - DNA, 25 bp, Homo sapien
gctgccctgggaactagggtcaatt

SEQ ID NO: 417636 - DNA, 25 bp, Homo sapien
agggtcaattaaaacagcttgtgct

SEQ ID NO: 417637 - DNA, 25 bp, Homo sapien
agaaaagatggagcacacgctgggt

SEQ ID NO: 417638 - DNA, 25 bp, Homo sapien
atggagcacacgctgggtggtggcc

SEQ ID NO: 417639 - DNA, 25 bp, Homo sapien
cacacctgatgcagtccagaggcaa

SEQ ID NO: 417640 - DNA, 25 bp, Homo sapien
gcagtccagaggcaaatttctttgt

SEQ ID NO: 417641 - DNA, 25 bp, Homo sapien
ggcaaatttctttgttaatccactt

SEQ ID NO: 417642 - DNA, 25 bp, Homo sapien
tagaaaggagttacatacacaatga

SEQ ID NO: 417643 - DNA, 25 bp, Homo sapien
gtagcatatctaagctcatgtctgt

SEQ ID NO: 417644 - DNA, 25 bp, Homo sapien
ctaagctcatgtctgtcttaggaat

SEQ ID NO: 417645 - DNA, 25 bp, Homo sapien
gaattggaattttagcaggcagaga

SEQ ID NO: 417646 - DNA, 25 bp, Homo sapien
gagatcatcaccttaactctgtggt

SEQ ID NO: 417647 - DNA, 25 bp, Homo sapien
actctgtggtgttcaatcttttagc

SEQ ID NO: 417648 - DNA, 25 bp, Homo sapien
cacaatgaacattcgaggactgaat

SEQ ID NO: 417649 - DNA, 25 bp, Homo sapien
aacaaaaaatgccagaagctcactg

SEQ ID NO: 417650 - DNA, 25 bp, Homo sapien
ggctgagcttgccagctccatttct

SEQ ID NO: 417651 - DNA, 25 bp, Homo sapien
gccagctccatttctgactgctcat

SEQ ID NO: 417652 - DNA, 25 bp, Homo sapien
gtgtgagtgccaagatgatgccaag

SEQ ID NO: 417653 - DNA, 25 bp, Homo sapien
gtgccaagatgatgccaagggctgt

SEQ ID NO: 417654 - DNA, 25 bp, Homo sapien
atgccaagggctgtgatttcctggt

SEQ ID NO: 417655 - DNA, 25 bp, Homo sapien
gctgtgatttcctggtgggaagaaa

SEQ ID NO: 417656 - DNA, 25 bp, Homo sapien
aaagcaaaaccaagaatcacaagga

SEQ ID NO: 417657 - DNA, 25 bp, Homo sapien
gaatcacaaggaatcaagttcggag

SEQ ID NO: 417658 - DNA, 25 bp, Homo sapien
caagttcggagagaattttggcaga

SEQ ID NO: 417659 - DNA, 25 bp, Homo sapien
gggctttaagtcagccatggacata

SEQ ID NO: 417660 - DNA, 25 bp, Homo sapien
agccatggacatactgaagcaagag

SEQ ID NO: 417661 - DNA, 25 bp, Homo sapien
gtgtacccatctgccggtgacattg

SEQ ID NO: 417662 - DNA, 25 bp, Homo sapien
tgacattggatgtggcagggtccca

SEQ ID NO: 417663 - DNA, 25 bp, Homo sapien
gccatcttttctccaagttttttca

SEQ ID NO: 417664 - DNA, 25 bp, Homo sapien
tctccaagttttttcaggctactag

SEQ ID NO: 417665 - DNA, 25 bp, Homo sapien
tcaggctactagacctttgctttag

SEQ ID NO: 417666 - DNA, 25 bp, Homo sapien
gtgtgatgtctacgtgctaaggcaa

SEQ ID NO: 417667 - DNA, 25 bp, Homo sapien
agacctttgctttagctattccttc

SEQ ID NO: 417668 - DNA, 25 bp, Homo sapien
tcccatctcttcagtctagaggcga

SEQ ID NO: 417669 - DNA, 25 bp, Homo sapien
ggaagtagttccaagggcctgagtc

SEQ ID NO: 417670 - DNA, 25 bp, Homo sapien
caagggcctgagtcaatgtgtctgt

SEQ ID NO: 417671 - DNA, 25 bp, Homo sapien
caatgtgtctgtgggacagctgaat

SEQ ID NO: 417672 - DNA, 25 bp, Homo sapien
ggctgcaggtccttcttgaaaggct

SEQ ID NO: 417673 - DNA, 25 bp, Homo sapien
gctgcaggtccttcttgaaaggctg

SEQ ID NO: 417674 - DNA, 25 bp, Homo sapien
cttgaaaggctgtgagtagtgagac

SEQ ID NO: 417675 - DNA, 25 bp, Homo sapien
tgaaaggctgtgagtagtgagacaa

SEQ ID NO: 417676 - DNA, 25 bp, Homo sapien
aaaggagagagaacggcttagacaa

SEQ ID NO: 417677 - DNA, 25 bp, Homo sapien
agagagaacggcttagacaaggaga

SEQ ID NO: 417678 - DNA, 25 bp, Homo sapien
agaacggcttagacaaggagagaaa

SEQ ID NO: 417679 - DNA, 25 bp, Homo sapien
agagagcagggctgactctgccagt

SEQ ID NO: 417680 - DNA, 25 bp, Homo sapien
atggaaagataaagagactgggcgc

SEQ ID NO: 417681 - DNA, 25 bp, Homo sapien
agagcagggctgactctgccagtgc

SEQ ID NO: 417682 - DNA, 25 bp, Homo sapien
tgcatcagcctcatcgctctcctag

SEQ ID NO: 417683 - DNA, 25 bp, Homo sapien
gcaatggatctgttgattgggttta

SEQ ID NO: 417684 - DNA, 25 bp, Homo sapien
gatctgttgattgggtttaagttac

SEQ ID NO: 417685 - DNA, 25 bp, Homo sapien
tctgttgattgggtttaagttactt

SEQ ID NO: 417686 - DNA, 25 bp, Homo sapien
agctaaagtatgtagggaacatgtt

SEQ ID NO: 417687 - DNA, 25 bp, Homo sapien
gaaggtgggtgaacttcctgtatgt

SEQ ID NO: 417688 - DNA, 25 bp, Homo sapien
aggtgggtgaacttcctgtatgttt

SEQ ID NO: 417689 - DNA, 25 bp, Homo sapien
ggtgggtgaacttcctgtatgtttt

SEQ ID NO: 417690 - DNA, 25 bp, Homo sapien
gtgggtgaacttcctgtatgtttta

SEQ ID NO: 417691 - DNA, 25 bp, Homo sapien
gggtgaacttcctgtatgttttata

SEQ ID NO: 417692 - DNA, 25 bp, Homo sapien
ggtgaacttcctgtatgttttatat

SEQ ID NO: 417693 - DNA, 25 bp, Homo sapien
gtgaacttcctgtatgttttatata

SEQ ID NO: 417694 - DNA, 25 bp, Homo sapien
aaagcacccatgatagtgcccggca

SEQ ID NO: 417695 - DNA, 25 bp, Homo sapien
gatagtgcccggcaatgtgaaacac

SEQ ID NO: 417696 - DNA, 25 bp, Homo sapien
atgtgcaatgtgcttttctttgttg

SEQ ID NO: 417697 - DNA, 25 bp, Homo sapien
ttctttgttgtgatttccagtacca

SEQ ID NO: 417698 - DNA, 25 bp, Homo sapien
actgctctgcctttgcttaaagaat

SEQ ID NO: 417699 - DNA, 25 bp, Homo sapien
gtttcactgtacaaggttctgctca

SEQ ID NO: 417700 - DNA, 25 bp, Homo sapien
caaggttctgctcaatgatatgact

SEQ ID NO: 417701 - DNA, 25 bp, Homo sapien
gactcttagcagtagtaactatctt

SEQ ID NO: 417702 - DNA, 25 bp, Homo sapien
gtaactatcttttcaaatgctctgg

SEQ ID NO: 417703 - DNA, 25 bp, Homo sapien
aaatgctctggtggcctggcaaaaa

SEQ ID NO: 417704 - DNA, 25 bp, Homo sapien
ggtggcctggcaaaaaggctgtatt

SEQ ID NO: 417705 - DNA, 25 bp, Homo sapien
aattgtggtgggatgataactgaaa

SEQ ID NO: 417706 - DNA, 25 bp, Homo sapien
tggtgggatgataactgaaagatac

SEQ ID NO: 417707 - DNA, 25 bp, Homo sapien
ttttaggaagtttttatatatctca

SEQ ID NO: 417708 - DNA, 25 bp, Homo sapien
atatatctcatttgacccactaaga

SEQ ID NO: 417709 - DNA, 25 bp, Homo sapien
tctcatttgacccactaagaaacga

SEQ ID NO: 417710 - DNA, 25 bp, Homo sapien
atttgacccactaagaaacgacatc

SEQ ID NO: 417711 - DNA, 25 bp, Homo sapien
gacccactaagaaacgacatccaga

SEQ ID NO: 417712 - DNA, 25 bp, Homo sapien
gaaacgacatccagaaaggagctaa

SEQ ID NO: 417713 - DNA, 25 bp, Homo sapien
acatccagaaaggagctaaagacca

SEQ ID NO: 417714 - DNA, 25 bp, Homo sapien
agaccagaggtaattgattagctca

SEQ ID NO: 417715 - DNA, 25 bp, Homo sapien
cagaggtaattgattagctcagcac

SEQ ID NO: 417716 - DNA, 25 bp, Homo sapien
gcagaagccctaattgaacatgtaa

SEQ ID NO: 417717 - DNA, 25 bp, Homo sapien
tagatacagattatgtggagctcaa

SEQ ID NO: 417718 - DNA, 25 bp, Homo sapien
gtggagctcaaagaccttgttggga

SEQ ID NO: 417719 - DNA, 25 bp, Homo sapien
gggaacaacattttctaattgcgtt

SEQ ID NO: 417720 - DNA, 25 bp, Homo sapien
ctaattgcgtttcttctccgtggat

SEQ ID NO: 417721 - DNA, 25 bp, Homo sapien
gggctaggcaaagtggctctcacgc

SEQ ID NO: 417722 - DNA, 25 bp, Homo sapien
atatttccatcctacaaacgtggtc

SEQ ID NO: 417723 - DNA, 25 bp, Homo sapien
acaaacgtggtcatgcttctaaaaa

SEQ ID NO: 417724 - DNA, 25 bp, Homo sapien
atgaagtagctcaagatgtttggcc

SEQ ID NO: 417725 - DNA, 25 bp, Homo sapien
gatgtttggccagccaatgcgcaga

SEQ ID NO: 417726 - DNA, 25 bp, Homo sapien
cagccaatgcgcagaagccctaatt

SEQ ID NO: 417727 - DNA, 25 bp, Homo sapien
gttcttagaatacctgttaatgttt

SEQ ID NO: 417728 - DNA, 25 bp, Homo sapien
aaaagtaacatatagctctggagtg

SEQ ID NO: 417729 - DNA, 25 bp, Homo sapien
atagctctggagtgtttttattaag

SEQ ID NO: 417730 - DNA, 25 bp, Homo sapien
gagcatttgtacatgcaaagcacaa

SEQ ID NO: 417731 - DNA, 25 bp, Homo sapien
gtggaagatactttttagtgtgaca

SEQ ID NO: 417732 - DNA, 25 bp, Homo sapien
gatactttttagtgtgacagagaat

SEQ ID NO: 417733 - DNA, 25 bp, Homo sapien
gtttgaaacaggcttaccgattcct

SEQ ID NO: 417734 - DNA, 25 bp, Homo sapien
gaaacaggcttaccgattccttctt

SEQ ID NO: 417735 - DNA, 25 bp, Homo sapien
ccagcttcagttttgaatttgtaag

SEQ ID NO: 417736 - DNA, 25 bp, Homo sapien
gaggataataatgcctatctcacag

SEQ ID NO: 417737 - DNA, 25 bp, Homo sapien
ttctttcaagttcttagaatacctg

SEQ ID NO: 417738 - DNA, 25 bp, Homo sapien
aagcaactggccctggcattattcc

SEQ ID NO: 417739 - DNA, 25 bp, Homo sapien
agcaactggccctggcattattcct

SEQ ID NO: 417740 - DNA, 25 bp, Homo sapien
gcaactggccctggcattattcctc

SEQ ID NO: 417741 - DNA, 25 bp, Homo sapien
gtttacctccttaccttcatccgag

SEQ ID NO: 417742 - DNA, 25 bp, Homo sapien
tttacctccttaccttcatccgaga

SEQ ID NO: 417743 - DNA, 25 bp, Homo sapien
ttcatccgagacctggattttaccc

SEQ ID NO: 417744 - DNA, 25 bp, Homo sapien
tcatccgagacctggattttacccc

SEQ ID NO: 417745 - DNA, 25 bp, Homo sapien
gattttaccccaaccccacattctg

SEQ ID NO: 417746 - DNA, 25 bp, Homo sapien
aggtagaagcgagttcccttcagga

SEQ ID NO: 417747 - DNA, 25 bp, Homo sapien
cagtcagaggaccattgtttccagt

SEQ ID NO: 417748 - DNA, 25 bp, Homo sapien
gggcccgttcatgagaagaggacct

SEQ ID NO: 417749 - DNA, 25 bp, Homo sapien
gagctaacattagatttcacactgt

SEQ ID NO: 417750 - DNA, 25 bp, Homo sapien
gctaacattagatttcacactgttt

SEQ ID NO: 417751 - DNA, 25 bp, Homo sapien
aagcaaactttgctgattactttgg

SEQ ID NO: 417752 - DNA, 25 bp, Homo sapien
aactttgctgattactttggaagaa

SEQ ID NO: 417753 - DNA, 25 bp, Homo sapien
gattactttggaagaatccctgatt

SEQ ID NO: 417754 - DNA, 25 bp, Homo sapien
actttggaagaatccctgatttggg

SEQ ID NO: 417755 - DNA, 25 bp, Homo sapien
gaagctgggaaagcaaacccatttt

SEQ ID NO: 417756 - DNA, 25 bp, Homo sapien
gaaagcaaacccattttgtttcatt

SEQ ID NO: 417757 - DNA, 25 bp, Homo sapien
gagggcagatataactgagaggttt

SEQ ID NO: 417758 - DNA, 25 bp, Homo sapien
aactgagaggttttgtgctaaggct

SEQ ID NO: 417759 - DNA, 25 bp, Homo sapien
gaggttttgtgctaaggcttatatt

SEQ ID NO: 417760 - DNA, 25 bp, Homo sapien
cagagtgaggactgtgccattgatt

SEQ ID NO: 417761 - DNA, 25 bp, Homo sapien
gagtgaggactgtgccattgattaa

SEQ ID NO: 417762 - DNA, 25 bp, Homo sapien
agtgaggactgtgccattgattaaa

SEQ ID NO: 417763 - DNA, 25 bp, Homo sapien
gaggactgtgccattgattaaagtg

SEQ ID NO: 417764 - DNA, 25 bp, Homo sapien
ctgtgccattgattaaagtgggtcc

SEQ ID NO: 417765 - DNA, 25 bp, Homo sapien
gtgccattgattaaagtgggtccag

SEQ ID NO: 417766 - DNA, 25 bp, Homo sapien
cattgattaaagtgggtccaggagc

SEQ ID NO: 417767 - DNA, 25 bp, Homo sapien
attaaagtgggtccaggagcggtgg

SEQ ID NO: 417768 - DNA, 25 bp, Homo sapien
agctaggttctagggtttgactata

SEQ ID NO: 417769 - DNA, 25 bp, Homo sapien
taggttctagggtttgactataggg

SEQ ID NO: 417770 - DNA, 25 bp, Homo sapien
aggggatgtctacccctaagcatgg

SEQ ID NO: 417771 - DNA, 25 bp, Homo sapien
gcccgaacctgtgaaatgttacgtt

SEQ ID NO: 417772 - DNA, 25 bp, Homo sapien
acctgtgaaatgttacgtttgtgct

SEQ ID NO: 417773 - DNA, 25 bp, Homo sapien
tacgtttgtgcttcatttttgccaa

SEQ ID NO: 417774 - DNA, 25 bp, Homo sapien
ttgtgcttcatttttgccaaggtaa

SEQ ID NO: 417775 - DNA, 25 bp, Homo sapien
tttgccaaggtaaaaatgttccatc

SEQ ID NO: 417776 - DNA, 25 bp, Homo sapien
ttctagctaaaactccatttggtgg

SEQ ID NO: 417777 - DNA, 25 bp, Homo sapien
aaactccatttggtggaaccaacat

SEQ ID NO: 417778 - DNA, 25 bp, Homo sapien
accaacatatccatttcttttccta

SEQ ID NO: 417779 - DNA, 25 bp, Homo sapien
tccatttcttttcctagttacggat

SEQ ID NO: 417780 - DNA, 25 bp, Homo sapien
cttttcctagttacggatgatttgg

SEQ ID NO: 417781 - DNA, 25 bp, Homo sapien
gaaatgtgttcatagatgatgctga

SEQ ID NO: 417782 - DNA, 25 bp, Homo sapien
tggaaagtctgctcatctactcacc

SEQ ID NO: 417783 - DNA, 25 bp, Homo sapien
caaaggctgagggttcccctacctg

SEQ ID NO: 417784 - DNA, 25 bp, Homo sapien
cccctacctgcagaagctagagtgt

SEQ ID NO: 417785 - DNA, 25 bp, Homo sapien
ggcatttgagtcaatgacccagact

SEQ ID NO: 417786 - DNA, 25 bp, Homo sapien
tatagtcacgcactgcataatgatg

SEQ ID NO: 417787 - DNA, 25 bp, Homo sapien
gactgcatataatgatggcggtcct

SEQ ID NO: 417788 - DNA, 25 bp, Homo sapien
tactcaccctatcagtgactcactt

SEQ ID NO: 417789 - DNA, 25 bp, Homo sapien
tgactcacttccaatctcaaacttt

SEQ ID NO: 417790 - DNA, 25 bp, Homo sapien
actttcttccagatgggtctgtgtg

SEQ ID NO: 417791 - DNA, 25 bp, Homo sapien
gtctgtgtgcaaatcagtatgccca

SEQ ID NO: 417792 - DNA, 25 bp, Homo sapien
cagtatgcccaatggtaacctctgg

SEQ ID NO: 417793 - DNA, 25 bp, Homo sapien
ggctgcaggtccttcttgaaaggct

SEQ ID NO: 417794 - DNA, 25 bp, Homo sapien
gctgcaggtccttcttgaaaggctg

SEQ ID NO: 417795 - DNA, 25 bp, Homo sapien
cttgaaaggctgtgagtagtgagac

SEQ ID NO: 417796 - DNA, 25 bp, Homo sapien
tgaaaggctgtgagtagtgagacaa

SEQ ID NO: 417797 - DNA, 25 bp, Homo sapien
gtagtgagacaaggagcaggagtga

SEQ ID NO: 417798 - DNA, 25 bp, Homo sapien
aaaggagagagaacggcttagacaa

SEQ ID NO: 417799 - DNA, 25 bp, Homo sapien
agagagaacggcttagacaaggaga

SEQ ID NO: 417800 - DNA, 25 bp, Homo sapien
agaacggcttagacaaggagagaaa

SEQ ID NO: 417801 - DNA, 25 bp, Homo sapien
atggaaagataaagagactgggcgc

SEQ ID NO: 417802 - DNA, 25 bp, Homo sapien
gtgcctgcatcagcctcatcgctct

SEQ ID NO: 417803 - DNA, 25 bp, Homo sapien
gcatcagcctcatcgctctcctagg

SEQ ID NO: 417804 - DNA, 25 bp, Homo sapien
gggacgcagccaaaccatatcgggt

SEQ ID NO: 417805 - DNA, 25 bp, Homo sapien
gacgcagccaaaccatatcgggtag

SEQ ID NO: 417806 - DNA, 25 bp, Homo sapien
acgcagccaaaccatatcgggtagc

SEQ ID NO: 417807 - DNA, 25 bp, Homo sapien
cgcagccaaaccatatcgggtagca

SEQ ID NO: 417808 - DNA, 25 bp, Homo sapien
gcagccaaaccatatcgggtagcaa

SEQ ID NO: 417809 - DNA, 25 bp, Homo sapien
agccaaaccatatcgggtagcaaca

SEQ ID NO: 417810 - DNA, 25 bp, Homo sapien
aggagcaaaaaggtatgtcttccat

SEQ ID NO: 417811 - DNA, 25 bp, Homo sapien
gagcaaaaaggtatgtcttccatgg

SEQ ID NO: 417812 - DNA, 25 bp, Homo sapien
agcaaaaaggtatgtcttccatggc

SEQ ID NO: 417813 - DNA, 25 bp, Homo sapien
agcacgtgcagggaaactgcccttt

SEQ ID NO: 417814 - DNA, 25 bp, Homo sapien
acgagaacagtatgggaaaaacctg

SEQ ID NO: 417815 - DNA, 25 bp, Homo sapien
attgattttggtgccgcatatgtgt

SEQ ID NO: 417816 - DNA, 25 bp, Homo sapien
gcatatgtgttggagcaggcttctt

SEQ ID NO: 417817 - DNA, 25 bp, Homo sapien
aggcttcttctcatatcggtaattc

SEQ ID NO: 417818 - DNA, 25 bp, Homo sapien
ggtaattccactcaggccactgtga

SEQ ID NO: 417819 - DNA, 25 bp, Homo sapien
aaagctcaatagcatcttaacgtga

SEQ ID NO: 417820 - DNA, 25 bp, Homo sapien
aagaacacaacaagcccctactgat

SEQ ID NO: 417821 - DNA, 25 bp, Homo sapien
acaagcccctactgatttctgggtt

SEQ ID NO: 417822 - DNA, 25 bp, Homo sapien
ttctgggtttctgccacggccacag

SEQ ID NO: 417823 - DNA, 25 bp, Homo sapien
cacggccacaggttcatatccagag

SEQ ID NO: 417824 - DNA, 25 bp, Homo sapien
atggcagatctgagacgatccagga

SEQ ID NO: 417825 - DNA, 25 bp, Homo sapien
ggaagagctaaaacatggccctgta

SEQ ID NO: 417826 - DNA, 25 bp, Homo sapien
gataaaaagagttttgagcaagctc

SEQ ID NO: 417827 - DNA, 25 bp, Homo sapien
ttgagcaagctcaaagacccgtgtg

SEQ ID NO: 417828 - DNA, 25 bp, Homo sapien
gcaagctcaaagacccgtgtgccag

SEQ ID NO: 417829 - DNA, 25 bp, Homo sapien
aaagacccgtgtgccagcagtcaga

SEQ ID NO: 417830 - DNA, 25 bp, Homo sapien
gtgtgccagcagtcagatgccccgt

SEQ ID NO: 417831 - DNA, 25 bp, Homo sapien
tcagatgccccgttgggtgcacagg

SEQ ID NO: 417832 - DNA, 25 bp, Homo sapien
atgccccgttgggtgcacaggctaa

SEQ ID NO: 417833 - DNA, 25 bp, Homo sapien
agcccggcccaatctggaaaccagt

SEQ ID NO: 417834 - DNA, 25 bp, Homo sapien
caatctggaaaccagtcaggctttt

SEQ ID NO: 417835 - DNA, 25 bp, Homo sapien
agtcaggcttttgccagcccctaat

SEQ ID NO: 417836 - DNA, 25 bp, Homo sapien
atgttggtggatacccccaactttg

SEQ ID NO: 417837 - DNA, 25 bp, Homo sapien
taatatgtttgaggtacctggccta

SEQ ID NO: 417838 - DNA, 25 bp, Homo sapien
atatgtttgaggtacctggcctagt

SEQ ID NO: 417839 - DNA, 25 bp, Homo sapien
atgtttgaggtacctggcctagtaa

SEQ ID NO: 417840 - DNA, 25 bp, Homo sapien
tttgaggtacctggcctagtaagca

SEQ ID NO: 417841 - DNA, 25 bp, Homo sapien
gaggtacctggcctagtaagcacca

SEQ ID NO: 417842 - DNA, 25 bp, Homo sapien
aggtacctggcctagtaagcaccat

SEQ ID NO: 417843 - DNA, 25 bp, Homo sapien
ggtacctggcctagtaagcaccata

SEQ ID NO: 417844 - DNA, 25 bp, Homo sapien
gtacctggcctagtaagcaccatac

SEQ ID NO: 417845 - DNA, 25 bp, Homo sapien
acctggcctagtaagcaccatacaa

SEQ ID NO: 417846 - DNA, 25 bp, Homo sapien
tggcctagtaagcaccatacaagtg

SEQ ID NO: 417847 - DNA, 25 bp, Homo sapien
caccatacaagtgctattatttcta

SEQ ID NO: 417848 - DNA, 25 bp, Homo sapien
aaaaagactgggtacagatgtgata

SEQ ID NO: 417849 - DNA, 25 bp, Homo sapien
atcaagctgatgaggttaggatacc

SEQ ID NO: 417850 - DNA, 25 bp, Homo sapien
tgatgaggttaggatacccaggccc

SEQ ID NO: 417851 - DNA, 25 bp, Homo sapien
ttccatcgatggcatttcagtctat

SEQ ID NO: 417852 - DNA, 25 bp, Homo sapien
catcgatggcatttcagtctatagg

SEQ ID NO: 417853 - DNA, 25 bp, Homo sapien
cgatggcatttcagtctataggtaa

SEQ ID NO: 417854 - DNA, 25 bp, Homo sapien
atggcatttcagtctataggtaaac

SEQ ID NO: 417855 - DNA, 25 bp, Homo sapien
ggcatttcagtctataggtaaactt

SEQ ID NO: 417856 - DNA, 25 bp, Homo sapien
cagtctataggtaaacttcctggaa

SEQ ID NO: 417857 - DNA, 25 bp, Homo sapien
tctataggtaaacttcctggaagct

SEQ ID NO: 417858 - DNA, 25 bp, Homo sapien
aggtaaacttcctggaagctggatt

SEQ ID NO: 417859 - DNA, 25 bp, Homo sapien
atggtagagaattccaatgtcccta

SEQ ID NO: 417860 - DNA, 25 bp, Homo sapien
gaattccaatgtccctagccacaag

SEQ ID NO: 417861 - DNA, 25 bp, Homo sapien
tagccacaagggaccagttccactg

SEQ ID NO: 417862 - DNA, 25 bp, Homo sapien
gggaccagttccactgagaagtgaa

SEQ ID NO: 417863 - DNA, 25 bp, Homo sapien
cagtgggaactcaaaatttcagaaa

SEQ ID NO: 417864 - DNA, 25 bp, Homo sapien
gggaaaattggctttctcttaattg

SEQ ID NO: 417865 - DNA, 25 bp, Homo sapien
ggctttctcttaattggcagatgtt

SEQ ID NO: 417866 - DNA, 25 bp, Homo sapien
ctcttaattggcagatgttccagtg

SEQ ID NO: 417867 - DNA, 25 bp, Homo sapien
gtatgtacgcatatatggaccggag

SEQ ID NO: 417868 - DNA, 25 bp, Homo sapien
tggaccggagtctgctgagtttata

SEQ ID NO: 417869 - DNA, 25 bp, Homo sapien
gtctgctgagtttataaggttccaa

SEQ ID NO: 417870 - DNA, 25 bp, Homo sapien
gagatttttctaggcaataagttta

SEQ ID NO: 417871 - DNA, 25 bp, Homo sapien
taaacagcatgattgatgggtacag

SEQ ID NO: 417872 - DNA, 25 bp, Homo sapien
gatgggtacagaaccatgcatcatg

SEQ ID NO: 417873 - DNA, 25 bp, Homo sapien
gaaccatgcatcatgagctccttat

SEQ ID NO: 417874 - DNA, 25 bp, Homo sapien
tcatgagctccttatgatgaaagaa

SEQ ID NO: 417875 - DNA, 25 bp, Homo sapien
tgaaagaaaccgttattgccaaagg

SEQ ID NO: 417876 - DNA, 25 bp, Homo sapien
ggaaaacttgacttagcacatgaca

SEQ ID NO: 417877 - DNA, 25 bp, Homo sapien
aagaattcaaatctactttcttgtc

SEQ ID NO: 417878 - DNA, 25 bp, Homo sapien
aacatcaagaacacttcagttggcc

SEQ ID NO: 417879 - DNA, 25 bp, Homo sapien
cacagtaggctaactgcctgagatt

SEQ ID NO: 417880 - DNA, 25 bp, Homo sapien
ggctaactgcctgagatttttctag

SEQ ID NO: 417881 - DNA, 25 bp, Homo sapien
tcaacaccagagagctcatattgat

SEQ ID NO: 417882 - DNA, 25 bp, Homo sapien
catattgatgagaaatcttgtgaac

SEQ ID NO: 417883 - DNA, 25 bp, Homo sapien
gaagaactttcatcatggcctggga

SEQ ID NO: 417884 - DNA, 25 bp, Homo sapien
catggcctgggatttgctcaacttc

SEQ ID NO: 417885 - DNA, 25 bp, Homo sapien
gctcaacttctgagtattcatactt

SEQ ID NO: 417886 - DNA, 25 bp, Homo sapien
gagtattcatacttctgagaaatct

SEQ ID NO: 417887 - DNA, 25 bp, Homo sapien
agagttcggagaagataattcttgt

SEQ ID NO: 417888 - DNA, 25 bp, Homo sapien
gataattcttgtgagaaagtctttg

SEQ ID NO: 417889 - DNA, 25 bp, Homo sapien
aatatagggtagttgtcatgttcac

SEQ ID NO: 417890 - DNA, 25 bp, Homo sapien
gtcatgttcacaatgtactccctat

SEQ ID NO: 417891 - DNA, 25 bp, Homo sapien
gttcacaatgtactccctatgaaat

SEQ ID NO: 417892 - DNA, 25 bp, Homo sapien
aaagccaaatatgtctgccgtcttg

SEQ ID NO: 417893 - DNA, 25 bp, Homo sapien
tgtctgccgtcttgggactgagcaa

SEQ ID NO: 417894 - DNA, 25 bp, Homo sapien
gcaagaaatggaagctctgctcatt

SEQ ID NO: 417895 - DNA, 25 bp, Homo sapien
gctctgctcattgcttacttctaaa

SEQ ID NO: 417896 - DNA, 25 bp, Homo sapien
agcaaagcaaagtctcctggagttt

SEQ ID NO: 417897 - DNA, 25 bp, Homo sapien
tcttctttgtccaggcagaggttgg

SEQ ID NO: 417898 - DNA, 25 bp, Homo sapien
agatgctactgttgttgcctctggt

SEQ ID NO: 417899 - DNA, 25 bp, Homo sapien
ctctggtgctgttccattgacaggt

SEQ ID NO: 417900 - DNA, 25 bp, Homo sapien
ttgacaggtactccgcattgcaatc

SEQ ID NO: 417901 - DNA, 25 bp, Homo sapien
ctccgcattgcaatcaccgggaaat

SEQ ID NO: 417902 - DNA, 25 bp, Homo sapien
ggctagcattggctgttgccatcat

SEQ ID NO: 417903 - DNA, 25 bp, Homo sapien
actcttgggctcaaaatatagcctt

SEQ ID NO: 417904 - DNA, 25 bp, Homo sapien
cttgggctcaaaatatagccttggc

SEQ ID NO: 417905 - DNA, 25 bp, Homo sapien
tcccaaagtgctatattttacgttt

SEQ ID NO: 417906 - DNA, 25 bp, Homo sapien
gtgctatattttacgttttaaagat

SEQ ID NO: 417907 - DNA, 25 bp, Homo sapien
taaaataggccttttgaatgtaggt

SEQ ID NO: 417908 - DNA, 25 bp, Homo sapien
gaaaaatcttttaacctctgcaggc

SEQ ID NO: 417909 - DNA, 25 bp, Homo sapien
aaatcttttaacctctgcaggccta

SEQ ID NO: 417910 - DNA, 25 bp, Homo sapien
atcttttaacctctgcaggcctaga

SEQ ID NO: 417911 - DNA, 25 bp, Homo sapien
ttttaacctctgcaggcctagatct

SEQ ID NO: 417912 - DNA, 25 bp, Homo sapien
ttaacctctgcaggcctagatctga

SEQ ID NO: 417913 - DNA, 25 bp, Homo sapien
acctctgcaggcctagatctgaaaa

SEQ ID NO: 417914 - DNA, 25 bp, Homo sapien
tgccctccttgtcctttggtgaaaa

SEQ ID NO: 417915 - DNA, 25 bp, Homo sapien
tccttgtcctttggtgaaaatgtaa

SEQ ID NO: 417916 - DNA, 25 bp, Homo sapien
aaaaaccagggcactcaggcaagga

SEQ ID NO: 417917 - DNA, 25 bp, Homo sapien
gcactcaggcaaggagggataaagt

SEQ ID NO: 417918 - DNA, 25 bp, Homo sapien
aaagtgaggagcttgatcatgtcat

SEQ ID NO: 417919 - DNA, 25 bp, Homo sapien
gaggagcttgatcatgtcataacca

SEQ ID NO: 417920 - DNA, 25 bp, Homo sapien
tgatcatgtcataaccaagctttgg

SEQ ID NO: 417921 - DNA, 25 bp, Homo sapien
gtgcctgcaaagctcatttattggg

SEQ ID NO: 417922 - DNA, 25 bp, Homo sapien
tttattgggcagcaggacctactca

SEQ ID NO: 417923 - DNA, 25 bp, Homo sapien
agcaggacctactcatgtccctctg

SEQ ID NO: 417924 - DNA, 25 bp, Homo sapien
aaacaaatgtgtttggctgggcaca

SEQ ID NO: 417925 - DNA, 25 bp, Homo sapien
acctccattgtgtagcagttccagt

SEQ ID NO: 417926 - DNA, 25 bp, Homo sapien
gttccagttcctcttgggcaggatc

SEQ ID NO: 417927 - DNA, 25 bp, Homo sapien
tcctcttgggcaggatcaattaccc

SEQ ID NO: 417928 - DNA, 25 bp, Homo sapien
cccttccttgcctattgattcagag

SEQ ID NO: 417929 - DNA, 25 bp, Homo sapien
gattcagaggtgtgaggagcccaaa

SEQ ID NO: 417930 - DNA, 25 bp, Homo sapien
gtcctgtatggattgttgttatttt

SEQ ID NO: 417931 - DNA, 25 bp, Homo sapien
ctgggtggctgtcttaacttccagt

SEQ ID NO: 417932 - DNA, 25 bp, Homo sapien
ttttatcgactgtaatcacagggca

SEQ ID NO: 417933 - DNA, 25 bp, Homo sapien
tcacagggcagggtacagagatgtc

SEQ ID NO: 417934 - DNA, 25 bp, Homo sapien
gagatgtcctaagggatctccttaa

SEQ ID NO: 417935 - DNA, 25 bp, Homo sapien
gggatctccttaagccagacatact

SEQ ID NO: 417936 - DNA, 25 bp, Homo sapien
gggagcttgctctatgcaaagtcac

SEQ ID NO: 417937 - DNA, 25 bp, Homo sapien
agtcacccaggaaatgatactcccc

SEQ ID NO: 417938 - DNA, 25 bp, Homo sapien
ccccactgtgaaacactagctagag

SEQ ID NO: 417939 - DNA, 25 bp, Homo sapien
gcacatttgttgtaatctccctttg

SEQ ID NO: 417940 - DNA, 25 bp, Homo sapien
aatctccctttgacgggattcaggt

SEQ ID NO: 417941 - DNA, 25 bp, Homo sapien
gggatagatgtcgaagcagctgctt

SEQ ID NO: 417942 - DNA, 25 bp, Homo sapien
cagctgcttctaggtagtcaacgaa

SEQ ID NO: 417943 - DNA, 25 bp, Homo sapien
agtcaacgaagatgtcaactagtaa

SEQ ID NO: 417944 - DNA, 25 bp, Homo sapien
gacaacagacaaggatgagcacagc

SEQ ID NO: 417945 - DNA, 25 bp, Homo sapien
acagcagagctgtaagattctagat

SEQ ID NO: 417946 - DNA, 25 bp, Homo sapien
tcaaaaagagcaagcagtctgttgt

SEQ ID NO: 417947 - DNA, 25 bp, Homo sapien
gaaacttgctaccacagtagatctt

SEQ ID NO: 417948 - DNA, 25 bp, Homo sapien
gatcttaaatattctcaacacgcac

SEQ ID NO: 417949 - DNA, 25 bp, Homo sapien
taaatattctcaacacgcacacaca

SEQ ID NO: 417950 - DNA, 25 bp, Homo sapien
acacatagacggtcatggtgtgagg

SEQ ID NO: 417951 - DNA, 25 bp, Homo sapien
gtgtgaggtgacagatatttcaatt

SEQ ID NO: 417952 - DNA, 25 bp, Homo sapien
atttcaattagcttggttgtggtaa

SEQ ID NO: 417953 - DNA, 25 bp, Homo sapien
gcatcatgttgtacactgtaactat

SEQ ID NO: 417954 - DNA, 25 bp, Homo sapien
atttgtcaaatatgcttcgataaag

SEQ ID NO: 417955 - DNA, 25 bp, Homo sapien
gatgaacaagttttgggaatctaat

SEQ ID NO: 417956 - DNA, 25 bp, Homo sapien
gaatctaataaataacatggtgaca

SEQ ID NO: 417957 - DNA, 25 bp, Homo sapien
atatacttgaaacttgctaccacag

SEQ ID NO: 417958 - DNA, 25 bp, Homo sapien
aagtccacctcaaagcacataaagt

SEQ ID NO: 417959 - DNA, 25 bp, Homo sapien
gcatccatacaaggaggtaccctgt

SEQ ID NO: 417960 - DNA, 25 bp, Homo sapien
aaaacaagatactgactacaggaat

SEQ ID NO: 417961 - DNA, 25 bp, Homo sapien
caaggaggtaccctgtggctataca

SEQ ID NO: 417962 - DNA, 25 bp, Homo sapien
acaggaatgtctagttacttgaact

SEQ ID NO: 417963 - DNA, 25 bp, Homo sapien
gtctagttacttgaactcagaaatc

SEQ ID NO: 417964 - DNA, 25 bp, Homo sapien
attttagctattggttgcttctggg

SEQ ID NO: 417965 - DNA, 25 bp, Homo sapien
gtaccctgtggctatacagaatggt

SEQ ID NO: 417966 - DNA, 25 bp, Homo sapien
gtaaaggagctctttagttactcaa

SEQ ID NO: 417967 - DNA, 25 bp, Homo sapien
gagctctttagttactcaaatggaa

SEQ ID NO: 417968 - DNA, 25 bp, Homo sapien
caaatggaatgatcactggaataaa

SEQ ID NO: 417969 - DNA, 25 bp, Homo sapien
agtgactactacatgacctggatcc

SEQ ID NO: 417970 - DNA, 25 bp, Homo sapien
gtgactactacatgacctggatccg

SEQ ID NO: 417971 - DNA, 25 bp, Homo sapien
tgactactacatgacctggatccgc

SEQ ID NO: 417972 - DNA, 25 bp, Homo sapien
gggctgaaatggtttcatacattag

SEQ ID NO: 417973 - DNA, 25 bp, Homo sapien
ggctgaaatggtttcatacattagt

SEQ ID NO: 417974 - DNA, 25 bp, Homo sapien
gctgaaatggtttcatacattagta

SEQ ID NO: 417975 - DNA, 25 bp, Homo sapien
ctgaaatggtttcatacattagtag

SEQ ID NO: 417976 - DNA, 25 bp, Homo sapien
gaaatggtttcatacattagtagta

SEQ ID NO: 417977 - DNA, 25 bp, Homo sapien
aaatggtttcatacattagtagtag

SEQ ID NO: 417978 - DNA, 25 bp, Homo sapien
aatggtttcatacattagtagtagt

SEQ ID NO: 417979 - DNA, 25 bp, Homo sapien
atggtttcatacattagtagtagtg

SEQ ID NO: 417980 - DNA, 25 bp, Homo sapien
ccttcgcagggtcaagttcaagttc

SEQ ID NO: 417981 - DNA, 25 bp, Homo sapien
cttcgcagggtcaagttcaagttcc

SEQ ID NO: 417982 - DNA, 25 bp, Homo sapien
cagaaggtccacatttcaaagaagg

SEQ ID NO: 417983 - DNA, 25 bp, Homo sapien
agaaggtccacatttcaaagaaggg

SEQ ID NO: 417984 - DNA, 25 bp, Homo sapien
ctgtgggatcaagtacatccccgat

SEQ ID NO: 417985 - DNA, 25 bp, Homo sapien
tgtgggatcaagtacatccccgatc

SEQ ID NO: 417986 - DNA, 25 bp, Homo sapien
gtgggatcaagtacatccccgatcg

SEQ ID NO: 417987 - DNA, 25 bp, Homo sapien
tgggatcaagtacatccccgatcgt

SEQ ID NO: 417988 - DNA, 25 bp, Homo sapien
gggatcaagtacatccccgatcgtg

SEQ ID NO: 417989 - DNA, 25 bp, Homo sapien
ggatcaagtacatccccgatcgtgg

SEQ ID NO: 417990 - DNA, 25 bp, Homo sapien
gatcaagtacatccccgatcgtggc

SEQ ID NO: 417991 - DNA, 25 bp, Homo sapien
gtcttcggcaaggtgaaagaaggca

SEQ ID NO: 417992 - DNA, 25 bp, Homo sapien
aggccatggagtactctgggtccag

SEQ ID NO: 417993 - DNA, 25 bp, Homo sapien
catggagtactctgggtccaggaat

SEQ ID NO: 417994 - DNA, 25 bp, Homo sapien
gataatcattgctgactgcagacaa

SEQ ID NO: 417995 - DNA, 25 bp, Homo sapien
actgcagacaacttcgataagtttg

SEQ ID NO: 417996 - DNA, 25 bp, Homo sapien
cttcgataagtttgacttccatttt

SEQ ID NO: 417997 - DNA, 25 bp, Homo sapien
taaccaccagactattccttccgta

SEQ ID NO: 417998 - DNA, 25 bp, Homo sapien
agactattccttccgtagctcagga

SEQ ID NO: 417999 - DNA, 25 bp, Homo sapien
tcccttccatgcctagctgtgttga

SEQ ID NO: 418000 - DNA, 25 bp, Homo sapien
tccatgcctagctgtgttgaagagt

SEQ ID NO: 418001 - DNA, 25 bp, Homo sapien
tgcctagctgtgttgaagagttaag

SEQ ID NO: 418002 - DNA, 25 bp, Homo sapien
atacaaatccttgagccttactcaa

SEQ ID NO: 418003 - DNA, 25 bp, Homo sapien
gagccttactcaagactgcatttct

SEQ ID NO: 418004 - DNA, 25 bp, Homo sapien
atttctctgtcatttattggccact

SEQ ID NO: 418005 - DNA, 25 bp, Homo sapien
attggccactgtctgatattctttc

SEQ ID NO: 418006 - DNA, 25 bp, Homo sapien
gtctgatattctttcttctagatat

SEQ ID NO: 418007 - DNA, 25 bp, Homo sapien
aaagtgtgtagagacccctgggagt

SEQ ID NO: 418008 - DNA, 25 bp, Homo sapien
gggatacaatactctgaagcagaag

SEQ ID NO: 418009 - DNA, 25 bp, Homo sapien
tgcagtgatggttagggactcttct

SEQ ID NO: 418010 - DNA, 25 bp, Homo sapien
gactcttctgagtaggagacgtaat

SEQ ID NO: 418011 - DNA, 25 bp, Homo sapien
gacgtaatcggcttttggtccatgg

SEQ ID NO: 418012 - DNA, 25 bp, Homo sapien
ggaacttttaccacatgtattcagc

SEQ ID NO: 418013 - DNA, 25 bp, Homo sapien
cctggccctttgcagagttaaaaga

SEQ ID NO: 418014 - DNA, 25 bp, Homo sapien
ctggccctttgcagagttaaaagaa

SEQ ID NO: 418015 - DNA, 25 bp, Homo sapien
tggccctttgcagagttaaaagaag

SEQ ID NO: 418016 - DNA, 25 bp, Homo sapien
ggccctttgcagagttaaaagaagc

SEQ ID NO: 418017 - DNA, 25 bp, Homo sapien
gccctttgcagagttaaaagaagcc

SEQ ID NO: 418018 - DNA, 25 bp, Homo sapien
cctttgcagagttaaaagaagccag

SEQ ID NO: 418019 - DNA, 25 bp, Homo sapien
gaggtcaagggtttgaaaccagcgt

SEQ ID NO: 418020 - DNA, 25 bp, Homo sapien
aggtcaagggtttgaaaccagcgtg

SEQ ID NO: 418021 - DNA, 25 bp, Homo sapien
gtcaagggtttgaaaccagcgtggc

SEQ ID NO: 418022 - DNA, 25 bp, Homo sapien
tcaagggtttgaaaccagcgtggcc

SEQ ID NO: 418023 - DNA, 25 bp, Homo sapien
caagggtttgaaaccagcgtggcca

SEQ ID NO: 418024 - DNA, 25 bp, Homo sapien
aatggagtgcttctttcactggtaa

SEQ ID NO: 418025 - DNA, 25 bp, Homo sapien
atacgtatggtagtgacttcagcag

SEQ ID NO: 418026 - DNA, 25 bp, Homo sapien
aaccggctttggtagaggtgagcaa

SEQ ID NO: 418027 - DNA, 25 bp, Homo sapien
gcaaaggtgtgctggtatcaccagg

SEQ ID NO: 418028 - DNA, 25 bp, Homo sapien
gtgttgaaagtgtgctggcctcaga

SEQ ID NO: 418029 - DNA, 25 bp, Homo sapien
aaggactcatcacagatatagggct

SEQ ID NO: 418030 - DNA, 25 bp, Homo sapien
tagggctgatgaggacagttgtcaa

SEQ ID NO: 418031 - DNA, 25 bp, Homo sapien
gtgcttctttcactcgtagttgaca

SEQ ID NO: 418032 - DNA, 25 bp, Homo sapien
cactcgtagttgacataggcatggt

SEQ ID NO: 418033 - DNA, 25 bp, Homo sapien
gccttcagaggcagtggtcatagac

SEQ ID NO: 418034 - DNA, 25 bp, Homo sapien
ggtcatagacatgctggtgtaaaca

SEQ ID NO: 418035 - DNA, 25 bp, Homo sapien
aatactatgcagactccataagggc

SEQ ID NO: 418036 - DNA, 25 bp, Homo sapien
ggatttatcttcagcaactatggca

SEQ ID NO: 418037 - DNA, 25 bp, Homo sapien
atttatcttcagcaactatggcatg

SEQ ID NO: 418038 - DNA, 25 bp, Homo sapien
tttatcttcagcaactatggcatgc

SEQ ID NO: 418039 - DNA, 25 bp, Homo sapien
ttatcttcagcaactatggcatgca

SEQ ID NO: 418040 - DNA, 25 bp, Homo sapien
agcaactatggcatgcagtgggtcc

SEQ ID NO: 418041 - DNA, 25 bp, Homo sapien
agtgggtccgccaggttccaggcga

SEQ ID NO: 418042 - DNA, 25 bp, Homo sapien
gtgggtccgccaggttccaggcgag

SEQ ID NO: 418043 - DNA, 25 bp, Homo sapien
ggtggcagttatatgctctgatgga

SEQ ID NO: 418044 - DNA, 25 bp, Homo sapien
ggcagttatatgctctgatggaagt

SEQ ID NO: 418045 - DNA, 25 bp, Homo sapien
gttatatgctctgatggaagtaata

SEQ ID NO: 418046 - DNA, 25 bp, Homo sapien
gcctcggccctggactttgatgtgt

SEQ ID NO: 418047 - DNA, 25 bp, Homo sapien
gactttgatgtgtccagcaaccaca

SEQ ID NO: 418048 - DNA, 25 bp, Homo sapien
actggacagacatcagcctgaaggt

SEQ ID NO: 418049 - DNA, 25 bp, Homo sapien
ctgaaggtagcgtgggcccgaacat

SEQ ID NO: 418050 - DNA, 25 bp, Homo sapien
cacacgtgcagcctatatgggaaaa

SEQ ID NO: 418051 - DNA, 25 bp, Homo sapien
tctgtacctgcctcaaaggtttcag

SEQ ID NO: 418052 - DNA, 25 bp, Homo sapien
gcctcaaaggtttcagacatttttc

SEQ ID NO: 418053 - DNA, 25 bp, Homo sapien
gacatttttcttaaagcactataat

SEQ ID NO: 418054 - DNA, 25 bp, Homo sapien
atatgagcaagcctatttcaaaaaa

SEQ ID NO: 418055 - DNA, 25 bp, Homo sapien
gacgattataatgagcaaatccggt

SEQ ID NO: 418056 - DNA, 25 bp, Homo sapien
cacacatgacggcttttgtgaaatg

SEQ ID NO: 418057 - DNA, 25 bp, Homo sapien
gacgtccttgggtgctgagggccct

SEQ ID NO: 418058 - DNA, 25 bp, Homo sapien
agtgcctccccacataggcactagt

SEQ ID NO: 418059 - DNA, 25 bp, Homo sapien
tccccacataggcactagttggaca

SEQ ID NO: 418060 - DNA, 25 bp, Homo sapien
cacataggcactagttggacaacaa

SEQ ID NO: 418061 - DNA, 25 bp, Homo sapien
ggcactagttggacaacaagtggaa

SEQ ID NO: 418062 - DNA, 25 bp, Homo sapien
ggacaacaagtggaaagatgtggcc

SEQ ID NO: 418063 - DNA, 25 bp, Homo sapien
atttaccatctgaatcatttctaag

SEQ ID NO: 418064 - DNA, 25 bp, Homo sapien
taccatctgaatcatttctaagtgc

SEQ ID NO: 418065 - DNA, 25 bp, Homo sapien
atctgaatcatttctaagtgcacat

SEQ ID NO: 418066 - DNA, 25 bp, Homo sapien
gtgttaagtacattcggctgggtgc

SEQ ID NO: 418067 - DNA, 25 bp, Homo sapien
tgttaagtacattcggctgggtgcg

SEQ ID NO: 418068 - DNA, 25 bp, Homo sapien
tatggccacactgagaagcctttga

SEQ ID NO: 418069 - DNA, 25 bp, Homo sapien
atacttttcatcaccaattgcccaa

SEQ ID NO: 418070 - DNA, 25 bp, Homo sapien
tgcttcctcagccttgtagcaaagg

SEQ ID NO: 418071 - DNA, 25 bp, Homo sapien
agcccacagtccacagtctttttgg

SEQ ID NO: 418072 - DNA, 25 bp, Homo sapien
ttttgggaaaattggcctgccacct

SEQ ID NO: 418073 - DNA, 25 bp, Homo sapien
gccaccttctttaagctcagtttat

SEQ ID NO: 418074 - DNA, 25 bp, Homo sapien
gacttactttctttgctgtagttat

SEQ ID NO: 418075 - DNA, 25 bp, Homo sapien
gggcattaaaatcccatggcaagga

SEQ ID NO: 418076 - DNA, 25 bp, Homo sapien
aagagatgttctcgtagctctgcgt

SEQ ID NO: 418077 - DNA, 25 bp, Homo sapien
tagctctgcgttgtgtgaaatgtcc

SEQ ID NO: 418078 - DNA, 25 bp, Homo sapien
gtgaaatgtccatcttagttttgtt

SEQ ID NO: 418079 - DNA, 25 bp, Homo sapien
tgcctcccaatttctgtcctttgga

SEQ ID NO: 418080 - DNA, 25 bp, Homo sapien
aatttctgtcctttggatcactcct

SEQ ID NO: 418081 - DNA, 25 bp, Homo sapien
tgggttgttggtgtaactccagcat

SEQ ID NO: 418082 - DNA, 25 bp, Homo sapien
aactccagcatgcaagtccacgagg

SEQ ID NO: 418083 - DNA, 25 bp, Homo sapien
ggacaggcgggctttgcaatgatcc

SEQ ID NO: 418084 - DNA, 25 bp, Homo sapien
gggctttgcaatgatccccgtactc

SEQ ID NO: 418085 - DNA, 25 bp, Homo sapien
tcctgcccctgctcgtggtgtgagg

SEQ ID NO: 418086 - DNA, 25 bp, Homo sapien
tgctcgtggtgtgaggcccagccct

SEQ ID NO: 418087 - DNA, 25 bp, Homo sapien
cagggttgtgtctgcaagctccaag

SEQ ID NO: 418088 - DNA, 25 bp, Homo sapien
gtgtctgcaagctccaaggaggcct

SEQ ID NO: 418089 - DNA, 25 bp, Homo sapien
gcctgtgtgcactactctttgtgtt

SEQ ID NO: 418090 - DNA, 25 bp, Homo sapien
gcgttcaggcgctgttgctagaaat

SEQ ID NO: 418091 - DNA, 25 bp, Homo sapien
tcaggcgctgttgctagaaatctct

SEQ ID NO: 418092 - DNA, 25 bp, Homo sapien
gctagaaatctctgtctttactctg

SEQ ID NO: 418093 - DNA, 25 bp, Homo sapien
agaaatctctgtctttactctgttt

SEQ ID NO: 418094 - DNA, 25 bp, Homo sapien
aggcagcatggcagggtgaacacaa

SEQ ID NO: 418095 - DNA, 25 bp, Homo sapien
ggcagggtgaacacaagcacagact

SEQ ID NO: 418096 - DNA, 25 bp, Homo sapien
agcacagactgaaggcagcttgccg

SEQ ID NO: 418097 - DNA, 25 bp, Homo sapien
tgaaggcagcttgccgcggttcaca

SEQ ID NO: 418098 - DNA, 25 bp, Homo sapien
tacttgcaagcctcgctcagtctta

SEQ ID NO: 418099 - DNA, 25 bp, Homo sapien
aagcctcgctcagtcttaagcaaga

SEQ ID NO: 418100 - DNA, 25 bp, Homo sapien
ttcgcccgcagcactgagaatccag

SEQ ID NO: 418101 - DNA, 25 bp, Homo sapien
aagcaagatttgatccatatggaaa

SEQ ID NO: 418102 - DNA, 25 bp, Homo sapien
ggaaagaataagttctccacttgta

SEQ ID NO: 418103 - DNA, 25 bp, Homo sapien
aagttctccacttgtagaatttgta

SEQ ID NO: 418104 - DNA, 25 bp, Homo sapien
aaagttctgtgcaccaaccaggttc

SEQ ID NO: 418105 - DNA, 25 bp, Homo sapien
aaccaggttctcattactgccaggg

SEQ ID NO: 418106 - DNA, 25 bp, Homo sapien
aggttctcattactgccagggctgt

SEQ ID NO: 418107 - DNA, 25 bp, Homo sapien
tgccagggctgtgcctacaaaaaag

SEQ ID NO: 418108 - DNA, 25 bp, Homo sapien
caaaaaaggcatctgtgcgatgtgt

SEQ ID NO: 418109 - DNA, 25 bp, Homo sapien
aggatggtgtgcgaaaaatgtgaaa

SEQ ID NO: 418110 - DNA, 25 bp, Homo sapien
agaaacttggtactgttatcactcc

SEQ ID NO: 418111 - DNA, 25 bp, Homo sapien
tggtactgttatcactccagataca

SEQ ID NO: 418112 - DNA, 25 bp, Homo sapien
gccatttgatttatgtttccctcag

SEQ ID NO: 418113 - DNA, 25 bp, Homo sapien
tttatgtttccctcagtcatttggt

SEQ ID NO: 418114 - DNA, 25 bp, Homo sapien
gtttccctcagtcatttggtttatg

SEQ ID NO: 418115 - DNA, 25 bp, Homo sapien
ccctcagtcatttggtttatgtttg

SEQ ID NO: 418116 - DNA, 25 bp, Homo sapien
ttggtttatgtttggttatggcaag

SEQ ID NO: 418117 - DNA, 25 bp, Homo sapien
ggttatggcaagatgttacagcatt

SEQ ID NO: 418118 - DNA, 25 bp, Homo sapien
gttacagcatttatagttaatacta

SEQ ID NO: 418119 - DNA, 25 bp, Homo sapien
aacaactttcagattctgttgacat

SEQ ID NO: 418120 - DNA, 25 bp, Homo sapien
gattctgttgacattgtctttgtgg

SEQ ID NO: 418121 - DNA, 25 bp, Homo sapien
tatttcatgggttttaatttctctt

SEQ ID NO: 418122 - DNA, 25 bp, Homo sapien
agacttacctaaatattcagttaca

SEQ ID NO: 418123 - DNA, 25 bp, Homo sapien
gaattccgttcccatccagcaagag

SEQ ID NO: 418124 - DNA, 25 bp, Homo sapien
agcaagagaccctggtcgtccggag

SEQ ID NO: 418125 - DNA, 25 bp, Homo sapien
agaccctggtcgtccggaggaagca

SEQ ID NO: 418126 - DNA, 25 bp, Homo sapien
gtcgtccggaggaagcaccaaggct

SEQ ID NO: 418127 - DNA, 25 bp, Homo sapien
gctggtgactgttggctgcacctgc

SEQ ID NO: 418128 - DNA, 25 bp, Homo sapien
ctcggaagttgtacaggcccagtgt

SEQ ID NO: 418129 - DNA, 25 bp, Homo sapien
tgtacaggcccagtgtaggaacttg

SEQ ID NO: 418130 - DNA, 25 bp, Homo sapien
cagtgtaggaacttgggctgcatca

SEQ ID NO: 418131 - DNA, 25 bp, Homo sapien
tgggctgcatcaatgctcaaggaaa

SEQ ID NO: 418132 - DNA, 25 bp, Homo sapien
gaaaggaagacatctccatgaattc

SEQ ID NO: 418133 - DNA, 25 bp, Homo sapien
aagacatctccatgaattccgttcc

SEQ ID NO: 418134 - DNA, 25 bp, Homo sapien
gcccagccttattttcttgactcat

SEQ ID NO: 418135 - DNA, 25 bp, Homo sapien
cccagccttattttcttgactcata

SEQ ID NO: 418136 - DNA, 25 bp, Homo sapien
ccagccttattttcttgactcatag

SEQ ID NO: 418137 - DNA, 25 bp, Homo sapien
cagccttattttcttgactcatagg

SEQ ID NO: 418138 - DNA, 25 bp, Homo sapien
agccttattttcttgactcatagga

SEQ ID NO: 418139 - DNA, 25 bp, Homo sapien
gccttattttcttgactcataggaa

SEQ ID NO: 418140 - DNA, 25 bp, Homo sapien
cttattttcttgactcataggaata

SEQ ID NO: 418141 - DNA, 25 bp, Homo sapien
tattttcttgactcataggaataaa

SEQ ID NO: 418142 - DNA, 25 bp, Homo sapien
gactcataggaataaatatgtctag

SEQ ID NO: 418143 - DNA, 25 bp, Homo sapien
atacttactgaattaagattacagc

SEQ ID NO: 418144 - DNA, 25 bp, Homo sapien
taaagggccaagtagaataaagact

SEQ ID NO: 418145 - DNA, 25 bp, Homo sapien
ttaagatttctgagagcccgggtgc

SEQ ID NO: 418146 - DNA, 25 bp, Homo sapien
agatttctgagagcccgggtgcaat

SEQ ID NO: 418147 - DNA, 25 bp, Homo sapien
attatttctgaattagtcttgctgt

SEQ ID NO: 418148 - DNA, 25 bp, Homo sapien
tttctgaattagtcttgctgttttt

SEQ ID NO: 418149 - DNA, 25 bp, Homo sapien
taaaacttggagtcaccctattggt

SEQ ID NO: 418150 - DNA, 25 bp, Homo sapien
cttggagtcaccctattggttagat

SEQ ID NO: 418151 - DNA, 25 bp, Homo sapien
gtcaccctattggttagataatacc

SEQ ID NO: 418152 - DNA, 25 bp, Homo sapien
gataataccaaccatctattagcaa

SEQ ID NO: 418153 - DNA, 25 bp, Homo sapien
gcaaacaaacatcaagctgccctga

SEQ ID NO: 418154 - DNA, 25 bp, Homo sapien
catcaagctgccctgaaatatgact

SEQ ID NO: 418155 - DNA, 25 bp, Homo sapien
atgactgatgtggagtgttgccttg

SEQ ID NO: 418156 - DNA, 25 bp, Homo sapien
cactctatgccgtagccgtccaggg

SEQ ID NO: 418157 - DNA, 25 bp, Homo sapien
actctatgccgtagccgtccaggga

SEQ ID NO: 418158 - DNA, 25 bp, Homo sapien
ctctatgccgtagccgtccagggac

SEQ ID NO: 418159 - DNA, 25 bp, Homo sapien
tctatgccgtagccgtccagggact

SEQ ID NO: 418160 - DNA, 25 bp, Homo sapien
tgaagggtgagtgacctgcaagact

SEQ ID NO: 418161 - DNA, 25 bp, Homo sapien
gaagggtgagtgacctgcaagactc

SEQ ID NO: 418162 - DNA, 25 bp, Homo sapien
aagggtgagtgacctgcaagactca

SEQ ID NO: 418163 - DNA, 25 bp, Homo sapien
gcaagactcacaagagggaaagccg

SEQ ID NO: 418164 - DNA, 25 bp, Homo sapien
caagactcacaagagggaaagccga

SEQ ID NO: 418165 - DNA, 25 bp, Homo sapien
aagactcacaagagggaaagccgac

SEQ ID NO: 418166 - DNA, 25 bp, Homo sapien
agggaaagccgacagagatacctac

SEQ ID NO: 418167 - DNA, 25 bp, Homo sapien
cgagcagcagcttgtcttggaagga

SEQ ID NO: 418168 - DNA, 25 bp, Homo sapien
agggcgagccgattgccagcccgca

SEQ ID NO: 418169 - DNA, 25 bp, Homo sapien
gcgcacgcagcgaagcttcatgaat

SEQ ID NO: 418170 - DNA, 25 bp, Homo sapien
gcgaagcttcatgaatgcacacagt

SEQ ID NO: 418171 - DNA, 25 bp, Homo sapien
gaatgcacacagtcacgtcgcagaa

SEQ ID NO: 418172 - DNA, 25 bp, Homo sapien
acacagtcacgtcgcagaagtgccc

SEQ ID NO: 418173 - DNA, 25 bp, Homo sapien
agcttctgcccattgagggtctcaa

SEQ ID NO: 418174 - DNA, 25 bp, Homo sapien
gcccattgagggtctcaagcagaga

SEQ ID NO: 418175 - DNA, 25 bp, Homo sapien
cagagagcgtgagaagttctgcaga

SEQ ID NO: 418176 - DNA, 25 bp, Homo sapien
gttctgcagatgtatgtggcgcaca

SEQ ID NO: 418177 - DNA, 25 bp, Homo sapien
tgtatgtggcgcacagcctctacag

SEQ ID NO: 418178 - DNA, 25 bp, Homo sapien
gtttattcacatttgtctgctggaa

SEQ ID NO: 418179 - DNA, 25 bp, Homo sapien
aaatagtctccagctgaccattgca

SEQ ID NO: 418180 - DNA, 25 bp, Homo sapien
tgaccattgcaattggtgccccaac

SEQ ID NO: 418181 - DNA, 25 bp, Homo sapien
aaatggaaaaatctgcccggcaagc

SEQ ID NO: 418182 - DNA, 25 bp, Homo sapien
gcccggcaagcaatttcagatggtg

SEQ ID NO: 418183 - DNA, 25 bp, Homo sapien
ggtgtcacaaatcccaaaatgctgg

SEQ ID NO: 418184 - DNA, 25 bp, Homo sapien
ccaaaatgctggtggttctccgcaa

SEQ ID NO: 418185 - DNA, 25 bp, Homo sapien
gtggttctccgcaattcagaacttt

SEQ ID NO: 418186 - DNA, 25 bp, Homo sapien
gaactttttcaagctctcaatatgc

SEQ ID NO: 418187 - DNA, 25 bp, Homo sapien
gactttgagatttctgctgatcatt

SEQ ID NO: 418188 - DNA, 25 bp, Homo sapien
gatcatttcagcaaactcaagacaa

SEQ ID NO: 418189 - DNA, 25 bp, Homo sapien
aacatttaacaagcatcactgccct

SEQ ID NO: 418190 - DNA, 25 bp, Homo sapien
acatttaacaagcatcactgccctc

SEQ ID NO: 418191 - DNA, 25 bp, Homo sapien
cattgtgactttgctgtcaagtgta

SEQ ID NO: 418192 - DNA, 25 bp, Homo sapien
cagctaaccagttctttagaaatat

SEQ ID NO: 418193 - DNA, 25 bp, Homo sapien
agctaaccagttctttagaaatatg

SEQ ID NO: 418194 - DNA, 25 bp, Homo sapien
aaatatgctctctatccaagtctaa

SEQ ID NO: 418195 - DNA, 25 bp, Homo sapien
aatatgctctctatccaagtctaac

SEQ ID NO: 418196 - DNA, 25 bp, Homo sapien
atgctctctatccaagtctaacttt

SEQ ID NO: 418197 - DNA, 25 bp, Homo sapien
tgctctctatccaagtctaacttta

SEQ ID NO: 418198 - DNA, 25 bp, Homo sapien
gtctcaaagattctgtaccaactgg

SEQ ID NO: 418199 - DNA, 25 bp, Homo sapien
tctcaaagattctgtaccaactggg

SEQ ID NO: 418200 - DNA, 25 bp, Homo sapien
ctcaaagattctgtaccaactgggc

SEQ ID NO: 418201 - DNA, 25 bp, Homo sapien
tcaaagattctgtaccaactgggcg

SEQ ID NO: 418202 - DNA, 25 bp, Homo sapien
caaagattctgtaccaactgggcgt

SEQ ID NO: 418203 - DNA, 25 bp, Homo sapien
aaagattctgtaccaactgggcgtg

SEQ ID NO: 418204 - DNA, 25 bp, Homo sapien
aagattctgtaccaactgggcgtgg

SEQ ID NO: 418205 - DNA, 25 bp, Homo sapien
agattctgtaccaactgggcgtggt

SEQ ID NO: 418206 - DNA, 25 bp, Homo sapien
gattctgtaccaactgggcgtggtg

SEQ ID NO: 418207 - DNA, 25 bp, Homo sapien
tgaagtgggagagttacttgggccc

SEQ ID NO: 418208 - DNA, 25 bp, Homo sapien
ggagagttacttgggcccagggagg

SEQ ID NO: 418209 - DNA, 25 bp, Homo sapien
taacaaactataaagaccaccgaca

SEQ ID NO: 418210 - DNA, 25 bp, Homo sapien
aactataaagaccaccgacactatg

SEQ ID NO: 418211 - DNA, 25 bp, Homo sapien
ctataaagaccaccgacactatgaa

SEQ ID NO: 418212 - DNA, 25 bp, Homo sapien
ataaagaccaccgacactatgaaga

SEQ ID NO: 418213 - DNA, 25 bp, Homo sapien
aaagaccaccgacactatgaagaaa

SEQ ID NO: 418214 - DNA, 25 bp, Homo sapien
agaccaccgacactatgaagaaact

SEQ ID NO: 418215 - DNA, 25 bp, Homo sapien
ccttaaatgcaaacgggctaaatgc

SEQ ID NO: 418216 - DNA, 25 bp, Homo sapien
atgcaaacgggctaaatgccacaat

SEQ ID NO: 418217 - DNA, 25 bp, Homo sapien
caaacgggctaaatgccacaattaa

SEQ ID NO: 418218 - DNA, 25 bp, Homo sapien
gatagagtcaaaatccatcattgtg

SEQ ID NO: 418219 - DNA, 25 bp, Homo sapien
atagagtcaaaatccatcattgtgc

SEQ ID NO: 418220 - DNA, 25 bp, Homo sapien
tgtatacaaggagccatgataagta

SEQ ID NO: 418221 - DNA, 25 bp, Homo sapien
caaggagccatgataagtatggtca

SEQ ID NO: 418222 - DNA, 25 bp, Homo sapien
aaggagccatgataagtatggtcaa

SEQ ID NO: 418223 - DNA, 25 bp, Homo sapien
gagccatgataagtatggtcaagaa

SEQ ID NO: 418224 - DNA, 25 bp, Homo sapien
gtatggtcaagaaaacaaagcttct

SEQ ID NO: 418225 - DNA, 25 bp, Homo sapien
ggtcaagaaaacaaagcttctaggc

SEQ ID NO: 418226 - DNA, 25 bp, Homo sapien
aagaaaacaaagcttctaggccagg

SEQ ID NO: 418227 - DNA, 25 bp, Homo sapien
agaaaacaaagcttctaggccaggc

SEQ ID NO: 418228 - DNA, 25 bp, Homo sapien
gaaaacaaagcttctaggccaggca

SEQ ID NO: 418229 - DNA, 25 bp, Homo sapien
aaaacaaagcttctaggccaggcat

SEQ ID NO: 418230 - DNA, 25 bp, Homo sapien
aaacaaagcttctaggccaggcatg

SEQ ID NO: 418231 - DNA, 25 bp, Homo sapien
agtgactactacatgacctggatcc

SEQ ID NO: 418232 - DNA, 25 bp, Homo sapien
gtgactactacatgacctggatccg

SEQ ID NO: 418233 - DNA, 25 bp, Homo sapien
tgactactacatgacctggatccgc

SEQ ID NO: 418234 - DNA, 25 bp, Homo sapien
gactactacatgacctggatccgcc

SEQ ID NO: 418235 - DNA, 25 bp, Homo sapien
actactacatgacctggatccgcca

SEQ ID NO: 418236 - DNA, 25 bp, Homo sapien
tactacatgacctggatccgccagg

SEQ ID NO: 418237 - DNA, 25 bp, Homo sapien
gggctgaaatggtttcatacattag

SEQ ID NO: 418238 - DNA, 25 bp, Homo sapien
ggctgaaatggtttcatacattagt

SEQ ID NO: 418239 - DNA, 25 bp, Homo sapien
gctgaaatggtttcatacattagta

SEQ ID NO: 418240 - DNA, 25 bp, Homo sapien
gaaatggtttcatacattagtagta

SEQ ID NO: 418241 - DNA, 25 bp, Homo sapien
atggtttcatacattagtagtagtg

SEQ ID NO: 418242 - DNA, 25 bp, Homo sapien
caaggtgctgttcatgaccggttat

SEQ ID NO: 418243 - DNA, 25 bp, Homo sapien
tgccgagcgccagggttttcttgaa

SEQ ID NO: 418244 - DNA, 25 bp, Homo sapien
ggttttcttgaaccgggcatggatt

SEQ ID NO: 418245 - DNA, 25 bp, Homo sapien
ggcatggatttgatcgccaagcctt

SEQ ID NO: 418246 - DNA, 25 bp, Homo sapien
ttttaccctggatgcactggcgaac

SEQ ID NO: 418247 - DNA, 25 bp, Homo sapien
gtgcgcgacatgatcgggcaaacgt

SEQ ID NO: 418248 - DNA, 25 bp, Homo sapien
aaacgtcctgatcttcgggcataat

SEQ ID NO: 418249 - DNA, 25 bp, Homo sapien
aaccaatcgatgaaagcccaagccc

SEQ ID NO: 418250 - DNA, 25 bp, Homo sapien
aagcccgtcatatcctggtcaagac

SEQ ID NO: 418251 - DNA, 25 bp, Homo sapien
tcaagaccgccgaggaagccgaaca

SEQ ID NO: 418252 - DNA, 25 bp, Homo sapien
gaacaactcaggttacgtatcgtca

SEQ ID NO: 418253 - DNA, 25 bp, Homo sapien
gccgccatggggcagactctctgat

SEQ ID NO: 418254 - DNA, 25 bp, Homo sapien
actctctgatgccagtccccaaaag

SEQ ID NO: 418255 - DNA, 25 bp, Homo sapien
tctgatgccagtccccaaaagtggg

SEQ ID NO: 418256 - DNA, 25 bp, Homo sapien
gggctctgaagtctcggaccctcat

SEQ ID NO: 418257 - DNA, 25 bp, Homo sapien
gctctgaagtctcggaccctcatgg

SEQ ID NO: 418258 - DNA, 25 bp, Homo sapien
tctgaagtctcggaccctcatggca

SEQ ID NO: 418259 - DNA, 25 bp, Homo sapien
ctgaagtctcggaccctcatggcac

SEQ ID NO: 418260 - DNA, 25 bp, Homo sapien
tgaagtctcggaccctcatggcacc

SEQ ID NO: 418261 - DNA, 25 bp, Homo sapien
acccggtgccccaaagcaaaggctg

SEQ ID NO: 418262 - DNA, 25 bp, Homo sapien
aagcaaaggctgcttctcctccagt

SEQ ID NO: 418263 - DNA, 25 bp, Homo sapien
ccttgggggccttgtgtgtaaatgt

SEQ ID NO: 418264 - DNA, 25 bp, Homo sapien
agccatgttctgtctctttttgtga

SEQ ID NO: 418265 - DNA, 25 bp, Homo sapien
tgttctgtctctttttgtgaatcgc

SEQ ID NO: 418266 - DNA, 25 bp, Homo sapien
gacttagtcatttggatgcattcct

SEQ ID NO: 418267 - DNA, 25 bp, Homo sapien
agtcatttggatgcattcctttaaa

SEQ ID NO: 418268 - DNA, 25 bp, Homo sapien
attcctttaaatacagtgcattact

SEQ ID NO: 418269 - DNA, 25 bp, Homo sapien
cagtgcattactaaagtcagacctt

SEQ ID NO: 418270 - DNA, 25 bp, Homo sapien
tactaaagtcagacctttttgaaat

SEQ ID NO: 418271 - DNA, 25 bp, Homo sapien
gagtcctgtttaacgtaaaatagct

SEQ ID NO: 418272 - DNA, 25 bp, Homo sapien
gaaaggccaaacaacatttcctcct

SEQ ID NO: 418273 - DNA, 25 bp, Homo sapien
gtagaaggaggtacattgctgcagt

SEQ ID NO: 418274 - DNA, 25 bp, Homo sapien
cagtgtcagtgcagtgtagaagcag

SEQ ID NO: 418275 - DNA, 25 bp, Homo sapien
tcctgtttttaatgattaagcctca

SEQ ID NO: 418276 - DNA, 25 bp, Homo sapien
gtttttaatgattaagcctcagcct

SEQ ID NO: 418277 - DNA, 25 bp, Homo sapien
tttttaatgattaagcctcagcctc

SEQ ID NO: 418278 - DNA, 25 bp, Homo sapien
ttttaatgattaagcctcagcctca

SEQ ID NO: 418279 - DNA, 25 bp, Homo sapien
tttaatgattaagcctcagcctcaa

SEQ ID NO: 418280 - DNA, 25 bp, Homo sapien
taatgattaagcctcagcctcaaaa

SEQ ID NO: 418281 - DNA, 25 bp, Homo sapien
tcagcctcaaaaagcttttgacagc

SEQ ID NO: 418282 - DNA, 25 bp, Homo sapien
gcctcaaaaagcttttgacagcctg

SEQ ID NO: 418283 - DNA, 25 bp, Homo sapien
caaaaagcttttgacagcctggaca

SEQ ID NO: 418284 - DNA, 25 bp, Homo sapien
aaaaagcttttgacagcctggacaa

SEQ ID NO: 418285 - DNA, 25 bp, Homo sapien
aaagcttttgacagcctggacaaca

SEQ ID NO: 418286 - DNA, 25 bp, Homo sapien
ggtagaacaggatggagggcaagac

SEQ ID NO: 418287 - DNA, 25 bp, Homo sapien
agggcaagacctgtgtaagaagaag

SEQ ID NO: 418288 - DNA, 25 bp, Homo sapien
ggcaagacctgtgtaagaagaagtc

SEQ ID NO: 418289 - DNA, 25 bp, Homo sapien
gaagaagtcttaaactgtaaacatg

SEQ ID NO: 418290 - DNA, 25 bp, Homo sapien
gtcttaaactgtaaacatgggtgta

SEQ ID NO: 418291 - DNA, 25 bp, Homo sapien
aactgtaaacatgggtgtagtgagg

SEQ ID NO: 418292 - DNA, 25 bp, Homo sapien
agtgtggctaagaggaaatggatcc

SEQ ID NO: 418293 - DNA, 25 bp, Homo sapien
atggcaggggtgcatcggctcactg

SEQ ID NO: 418294 - DNA, 25 bp, Homo sapien
tcactggggctgcatctgaggtaaa

SEQ ID NO: 418295 - DNA, 25 bp, Homo sapien
gggctgcatctgaggtaaatggaaa

SEQ ID NO: 418296 - DNA, 25 bp, Homo sapien
gctgcatctgaggtaaatggaaata

SEQ ID NO: 418297 - DNA, 25 bp, Homo sapien
gttctggtgagtctaattgttgacc

SEQ ID NO: 418298 - DNA, 25 bp, Homo sapien
gttgaccagagagattgtttacttc

SEQ ID NO: 418299 - DNA, 25 bp, Homo sapien
gtttacttcagagcacctggatttg

SEQ ID NO: 418300 - DNA, 25 bp, Homo sapien
gatttgaattgcagtgtgccacctg

SEQ ID NO: 418301 - DNA, 25 bp, Homo sapien
cctgctgctgtgttacctggtacaa

SEQ ID NO: 418302 - DNA, 25 bp, Homo sapien
acctggtacaagttaatgcattctc

SEQ ID NO: 418303 - DNA, 25 bp, Homo sapien
aatgcattctcttcacacctcagtt

SEQ ID NO: 418304 - DNA, 25 bp, Homo sapien
gttttatcatcttctgaatgaggct

SEQ ID NO: 418305 - DNA, 25 bp, Homo sapien
tagtagtacctgtcatagatgcttg

SEQ ID NO: 418306 - DNA, 25 bp, Homo sapien
tagatgcttgtaacagtgcctgcat

SEQ ID NO: 418307 - DNA, 25 bp, Homo sapien
acagtgcctgcatagagtaagaatg

SEQ ID NO: 418308 - DNA, 25 bp, Homo sapien
gaatcccagcaaaatggttttccat

SEQ ID NO: 418309 - DNA, 25 bp, Homo sapien
ttttccattaaacaggggtagcgtg

SEQ ID NO: 418310 - DNA, 25 bp, Homo sapien
ggtagcgtgttctgctgtgctgaat

SEQ ID NO: 418311 - DNA, 25 bp, Homo sapien
agcgtgttctgctgtgctgaattac

SEQ ID NO: 418312 - DNA, 25 bp, Homo sapien
gtgttctgctgtgctgaattacttc

SEQ ID NO: 418313 - DNA, 25 bp, Homo sapien
gttctgctgtgctgaattacttcct

SEQ ID NO: 418314 - DNA, 25 bp, Homo sapien
tctgctgtgctgaattacttcctgt

SEQ ID NO: 418315 - DNA, 25 bp, Homo sapien
tgctgtgctgaattacttcctgttc

SEQ ID NO: 418316 - DNA, 25 bp, Homo sapien
ctgtgctgaattacttcctgttctt

SEQ ID NO: 418317 - DNA, 25 bp, Homo sapien
tgctgaattacttcctgttcttatt

SEQ ID NO: 418318 - DNA, 25 bp, Homo sapien
gtatcaaatatccttttggttgtgt

SEQ ID NO: 418319 - DNA, 25 bp, Homo sapien
gattgcagtcttttgagaccaggaa

SEQ ID NO: 418320 - DNA, 25 bp, Homo sapien
agaagccagctaatctgtgcttgga

SEQ ID NO: 418321 - DNA, 25 bp, Homo sapien
gctaatctgtgcttggactcctgac

SEQ ID NO: 418322 - DNA, 25 bp, Homo sapien
gtgtcttgttcttaacacaccagat

SEQ ID NO: 418323 - DNA, 25 bp, Homo sapien
gttcttaacacaccagatttgtggt

SEQ ID NO: 418324 - DNA, 25 bp, Homo sapien
tagaaaactaacaaactaggcctca

SEQ ID NO: 418325 - DNA, 25 bp, Homo sapien
ctataaacagttttgcaggtacact

SEQ ID NO: 418326 - DNA, 25 bp, Homo sapien
gcaggtacactgtagaacacacaat

SEQ ID NO: 418327 - DNA, 25 bp, Homo sapien
atgagtgaataccagcaggagcttc

SEQ ID NO: 418328 - DNA, 25 bp, Homo sapien
gaataccagcaggagcttctattta

SEQ ID NO: 418329 - DNA, 25 bp, Homo sapien
agcaggagcttctatttaaacatct

SEQ ID NO: 418330 - DNA, 25 bp, Homo sapien
gtccccagtacttagaacagtatct

SEQ ID NO: 418331 - DNA, 25 bp, Homo sapien
tccccagtacttagaacagtatctg

SEQ ID NO: 418332 - DNA, 25 bp, Homo sapien
ccccagtacttagaacagtatctgg

SEQ ID NO: 418333 - DNA, 25 bp, Homo sapien
tagaacagtatctggaacagccagg

SEQ ID NO: 418334 - DNA, 25 bp, Homo sapien
agaacagtatctggaacagccaggt

SEQ ID NO: 418335 - DNA, 25 bp, Homo sapien
gaacagtatctggaacagccaggtg

SEQ ID NO: 418336 - DNA, 25 bp, Homo sapien
aacagtatctggaacagccaggtgt

SEQ ID NO: 418337 - DNA, 25 bp, Homo sapien
acagtatctggaacagccaggtgtg

SEQ ID NO: 418338 - DNA, 25 bp, Homo sapien
cagtatctggaacagccaggtgtgg

SEQ ID NO: 418339 - DNA, 25 bp, Homo sapien
agtatctggaacagccaggtgtggt

SEQ ID NO: 418340 - DNA, 25 bp, Homo sapien
gtatctggaacagccaggtgtggtg

SEQ ID NO: 418341 - DNA, 25 bp, Homo sapien
agcaagcccagaatggtatcagcat

SEQ ID NO: 418342 - DNA, 25 bp, Homo sapien
gtatcagcataggtaatagcctgga

SEQ ID NO: 418343 - DNA, 25 bp, Homo sapien
atagcctggagaggtgaaaagccca

SEQ ID NO: 418344 - DNA, 25 bp, Homo sapien
aaagcccagaaggttgctaagcaga

SEQ ID NO: 418345 - DNA, 25 bp, Homo sapien
tttcagaaatccctcatgagaagag

SEQ ID NO: 418346 - DNA, 25 bp, Homo sapien
tggttacagccatttcaagagagag

SEQ ID NO: 418347 - DNA, 25 bp, Homo sapien
gagagagagttatggccaccctcct

SEQ ID NO: 418348 - DNA, 25 bp, Homo sapien
gccaccctcctttaagatcttagag

SEQ ID NO: 418349 - DNA, 25 bp, Homo sapien
gaaggttgagaagtacccatctagt

SEQ ID NO: 418350 - DNA, 25 bp, Homo sapien
tcaaccttttgggtgtcctccaagg

SEQ ID NO: 418351 - DNA, 25 bp, Homo sapien
ttgggtgtcctccaagggcagtacc

SEQ ID NO: 418352 - DNA, 25 bp, Homo sapien
ccactctatgccgtagccgtccagg

SEQ ID NO: 418353 - DNA, 25 bp, Homo sapien
cactctatgccgtagccgtccaggg

SEQ ID NO: 418354 - DNA, 25 bp, Homo sapien
actctatgccgtagccgtccaggga

SEQ ID NO: 418355 - DNA, 25 bp, Homo sapien
ctctatgccgtagccgtccagggac

SEQ ID NO: 418356 - DNA, 25 bp, Homo sapien
tctatgccgtagccgtccagggact

SEQ ID NO: 418357 - DNA, 25 bp, Homo sapien
tgaagggtgagtgacctgcaagact

SEQ ID NO: 418358 - DNA, 25 bp, Homo sapien
gaagggtgagtgacctgcaagactc

SEQ ID NO: 418359 - DNA, 25 bp, Homo sapien
aagggtgagtgacctgcaagactca

SEQ ID NO: 418360 - DNA, 25 bp, Homo sapien
ttgacaagtcaactcctcatggctg

SEQ ID NO: 418361 - DNA, 25 bp, Homo sapien
tcaactcctcatggctgtaggactg

SEQ ID NO: 418362 - DNA, 25 bp, Homo sapien
aggactgaggttcccaagtccttgt

SEQ ID NO: 418363 - DNA, 25 bp, Homo sapien
aagtccttgtccctggtcctgtggt

SEQ ID NO: 418364 - DNA, 25 bp, Homo sapien
aaaccagcaatggtgcattgagcaa

SEQ ID NO: 418365 - DNA, 25 bp, Homo sapien
ctgcagcttggaccgcaagggcaaa

SEQ ID NO: 418366 - DNA, 25 bp, Homo sapien
gggtctctcagactgacgtcaggcc

SEQ ID NO: 418367 - DNA, 25 bp, Homo sapien
acgtcaggccttggtgggctgcact

SEQ ID NO: 418368 - DNA, 25 bp, Homo sapien
tgcactctcacctggaggctccggg

SEQ ID NO: 418369 - DNA, 25 bp, Homo sapien
ggaagcatctgcctccaggaccatt

SEQ ID NO: 418370 - DNA, 25 bp, Homo sapien
ggaccattcaggctgttgacaagtc

SEQ ID NO: 418371 - DNA, 25 bp, Homo sapien
aaatcaggttattggtcatccgtgc

SEQ ID NO: 418372 - DNA, 25 bp, Homo sapien
tattggtcatccgtgcacagggact

SEQ ID NO: 418373 - DNA, 25 bp, Homo sapien
tccgtgcacagggacttctgggaag

SEQ ID NO: 418374 - DNA, 25 bp, Homo sapien
aatttagaacagtgtccttgacagc

SEQ ID NO: 418375 - DNA, 25 bp, Homo sapien
gtccttgacagcattcagtcctgag

SEQ ID NO: 418376 - DNA, 25 bp, Homo sapien
cagtcctgaggattaccagaatgtt

SEQ ID NO: 418377 - DNA, 25 bp, Homo sapien
tgttgctggcacattagaatttcaa

SEQ ID NO: 418378 - DNA, 25 bp, Homo sapien
ctgataattctattcctgaactgga

SEQ ID NO: 418379 - DNA, 25 bp, Homo sapien
ttaaacttggaaggaggagctctgc

SEQ ID NO: 418380 - DNA, 25 bp, Homo sapien
aggagctctgctagatctatctaca

SEQ ID NO: 418381 - DNA, 25 bp, Homo sapien
ataacgctgtaaaatctggtccttt

SEQ ID NO: 418382 - DNA, 25 bp, Homo sapien
ttcgcatcttctctacagtgctgag

SEQ ID NO: 418383 - DNA, 25 bp, Homo sapien
agtgctgagaatcccatcagctgag

SEQ ID NO: 418384 - DNA, 25 bp, Homo sapien
agctgagggccggaccaaggtcttc

SEQ ID NO: 418385 - DNA, 25 bp, Homo sapien
ctatttgtagccaccttctttcttt

SEQ ID NO: 418386 - DNA, 25 bp, Homo sapien
tctttctttcagctgcaggctttga

SEQ ID NO: 418387 - DNA, 25 bp, Homo sapien
agctgcaggctttgagtttctcaga

SEQ ID NO: 418388 - DNA, 25 bp, Homo sapien
agactgccttctgattcctcatcga

SEQ ID NO: 418389 - DNA, 25 bp, Homo sapien
tcctcatcgactgtggaccttgtat

SEQ ID NO: 418390 - DNA, 25 bp, Homo sapien
gaccttgtattctccgtattctata

SEQ ID NO: 418391 - DNA, 25 bp, Homo sapien
tattctatactgtgatacctccaac

SEQ ID NO: 418392 - DNA, 25 bp, Homo sapien
ctccaacactcaatccagtcattta

SEQ ID NO: 418393 - DNA, 25 bp, Homo sapien
ttgtcctgttgagaatttttagatc

SEQ ID NO: 418394 - DNA, 25 bp, Homo sapien
tttttagatctggactggaactgcc

SEQ ID NO: 418395 - DNA, 25 bp, Homo sapien
tggactggaactgccaggaccaccg

SEQ ID NO: 418396 - DNA, 25 bp, Homo sapien
gcctccagggagtcgctgggcacct

SEQ ID NO: 418397 - DNA, 25 bp, Homo sapien
ctgggcacctggaggtatcgtcgat

SEQ ID NO: 418398 - DNA, 25 bp, Homo sapien
gcacctggaggtatcgtcgatgcct

SEQ ID NO: 418399 - DNA, 25 bp, Homo sapien
tggaggtatcgtcgatgcctctccc

SEQ ID NO: 418400 - DNA, 25 bp, Homo sapien
ttaggattgataagggtcccatgac

SEQ ID NO: 418401 - DNA, 25 bp, Homo sapien
ggtcccatgaccagcattatgaaaa

SEQ ID NO: 418402 - DNA, 25 bp, Homo sapien
aggacacagtgtgagacttccacta

SEQ ID NO: 418403 - DNA, 25 bp, Homo sapien
tgaaagttagggttaggacatcctt

SEQ ID NO: 418404 - DNA, 25 bp, Homo sapien
ctccactcctgttttagtgcagtta

SEQ ID NO: 418405 - DNA, 25 bp, Homo sapien
gtgcagttaacttggctatagtcaa

SEQ ID NO: 418406 - DNA, 25 bp, Homo sapien
cttgagtataggtcacattttccta

SEQ ID NO: 418407 - DNA, 25 bp, Homo sapien
aaactacaaacttctcccatacagt

SEQ ID NO: 418408 - DNA, 25 bp, Homo sapien
acttctcccatacagtaagcggcat

SEQ ID NO: 418409 - DNA, 25 bp, Homo sapien
agtgcaattctcttcttccaaatgc

SEQ ID NO: 418410 - DNA, 25 bp, Homo sapien
ctgccctttggttactctctagtgt

SEQ ID NO: 418411 - DNA, 25 bp, Homo sapien
gatagacactgcgaataacaggcta

SEQ ID NO: 418412 - DNA, 25 bp, Homo sapien
taacaggctacagaaactcagactt

SEQ ID NO: 418413 - DNA, 25 bp, Homo sapien
agacttctgctatgttccaccaaag

SEQ ID NO: 418414 - DNA, 25 bp, Homo sapien
gttccaccaaagagaagtgccctcc

SEQ ID NO: 418415 - DNA, 25 bp, Homo sapien
aacagttacaccacagaatacgccg

SEQ ID NO: 418416 - DNA, 25 bp, Homo sapien
agttacaccacagaatacgccgcgt

SEQ ID NO: 418417 - DNA, 25 bp, Homo sapien
ttacaccacagaatacgccgcgtct

SEQ ID NO: 418418 - DNA, 25 bp, Homo sapien
gaatacgccgcgtctgtgaaaggca

SEQ ID NO: 418419 - DNA, 25 bp, Homo sapien
tacgccgcgtctgtgaaaggcagat

SEQ ID NO: 418420 - DNA, 25 bp, Homo sapien
cgccgcgtctgtgaaaggcagattc

SEQ ID NO: 418421 - DNA, 25 bp, Homo sapien
ttcaccttcagtgaccactacatgg

SEQ ID NO: 418422 - DNA, 25 bp, Homo sapien
ttcagtgaccactacatggactggg

SEQ ID NO: 418423 - DNA, 25 bp, Homo sapien
cgtgtattactgtgctagcctcact

SEQ ID NO: 418424 - DNA, 25 bp, Homo sapien
tgaccactacatggactgggtccgc

SEQ ID NO: 418425 - DNA, 25 bp, Homo sapien
aagctaacagttacaccacagaata

SEQ ID NO: 418426 - DNA, 25 bp, Homo sapien
cagatgctggctgcataagggctaa

SEQ ID NO: 418427 - DNA, 25 bp, Homo sapien
atgctggctgcataagggctaaggt

SEQ ID NO: 418428 - DNA, 25 bp, Homo sapien
tgctggctgcataagggctaaggta

SEQ ID NO: 418429 - DNA, 25 bp, Homo sapien
gttggtgtcttattaaaagcattca

SEQ ID NO: 418430 - DNA, 25 bp, Homo sapien
aaaagcattcaaatgaggatttgct

SEQ ID NO: 418431 - DNA, 25 bp, Homo sapien
acaccattagaaactgtccagatgc

SEQ ID NO: 418432 - DNA, 25 bp, Homo sapien
attagaaactgtccagatgctggct

SEQ ID NO: 418433 - DNA, 25 bp, Homo sapien
gaaactgtccagatgctggctgcat

SEQ ID NO: 418434 - DNA, 25 bp, Homo sapien
aactgtccagatgctggctgcataa

SEQ ID NO: 418435 - DNA, 25 bp, Homo sapien
actgtccagatgctggctgcataag

SEQ ID NO: 418436 - DNA, 25 bp, Homo sapien
tccagatgctggctgcataagggct

SEQ ID NO: 418437 - DNA, 25 bp, Homo sapien
aaggatctggaacctactactcctc

SEQ ID NO: 418438 - DNA, 25 bp, Homo sapien
tggaacctactactcctcaggagta

SEQ ID NO: 418439 - DNA, 25 bp, Homo sapien
actcctcaggagtatattctcaaag

SEQ ID NO: 418440 - DNA, 25 bp, Homo sapien
ttctcaaaggagtggtcaatgcagc

SEQ ID NO: 418441 - DNA, 25 bp, Homo sapien
gagtggtcaatgcagcccttggcca

SEQ ID NO: 418442 - DNA, 25 bp, Homo sapien
aatgcagcccttggccaggaaatgg

SEQ ID NO: 418443 - DNA, 25 bp, Homo sapien
agcccttggccaggaaatgggttca

SEQ ID NO: 418444 - DNA, 25 bp, Homo sapien
ggctaaacttggtgatttactacct

SEQ ID NO: 418445 - DNA, 25 bp, Homo sapien
ggtgatttactaccttcgtcaagat

SEQ ID NO: 418446 - DNA, 25 bp, Homo sapien
actaccttcgtcaagatgatgtaca

SEQ ID NO: 418447 - DNA, 25 bp, Homo sapien
gatgtacaagaagcttataacttaa

SEQ ID NO: 418448 - DNA, 25 bp, Homo sapien
ttatctgcaccaaactgccattcca

SEQ ID NO: 418449 - DNA, 25 bp, Homo sapien
tgccattccagtcactcactgggat

SEQ ID NO: 418450 - DNA, 25 bp, Homo sapien
tgggatcattaaaccaccacttgca

SEQ ID NO: 418451 - DNA, 25 bp, Homo sapien
accacttgcagttttccagggcttt

SEQ ID NO: 418452 - DNA, 25 bp, Homo sapien
ggaccacgtgcctgggagattccga

SEQ ID NO: 418453 - DNA, 25 bp, Homo sapien
cagggctttctttgttctactagga

SEQ ID NO: 418454 - DNA, 25 bp, Homo sapien
tgttctactaggaagtatatgcccc

SEQ ID NO: 418455 - DNA, 25 bp, Homo sapien
tgggagattccgacaggctgtcctt

SEQ ID NO: 418456 - DNA, 25 bp, Homo sapien
catgcgggcgcgtgtttccacggat

SEQ ID NO: 418457 - DNA, 25 bp, Homo sapien
gtttccacggatctagtccgtctta

SEQ ID NO: 418458 - DNA, 25 bp, Homo sapien
tagtccgtcttatctgcaccaaact

SEQ ID NO: 418459 - DNA, 25 bp, Homo sapien
tgggaacatttaacaagcatcactg

SEQ ID NO: 418460 - DNA, 25 bp, Homo sapien
acatttaacaagcatcactgccctc

SEQ ID NO: 418461 - DNA, 25 bp, Homo sapien
atttaacaagcatcactgccctcac

SEQ ID NO: 418462 - DNA, 25 bp, Homo sapien
taacaagcatcactgccctcactaa

SEQ ID NO: 418463 - DNA, 25 bp, Homo sapien
cattgtgactttgctgtcaagtgta

SEQ ID NO: 418464 - DNA, 25 bp, Homo sapien
cagctaaccagttctttagaaatat

SEQ ID NO: 418465 - DNA, 25 bp, Homo sapien
agctaaccagttctttagaaatatg

SEQ ID NO: 418466 - DNA, 25 bp, Homo sapien
aaatatgctctctatccaagtctaa

SEQ ID NO: 418467 - DNA, 25 bp, Homo sapien
aatatgctctctatccaagtctaac

SEQ ID NO: 418468 - DNA, 25 bp, Homo sapien
atgctctctatccaagtctaacttt

SEQ ID NO: 418469 - DNA, 25 bp, Homo sapien
tgctctctatccaagtctaacttta

SEQ ID NO: 418470 - DNA, 25 bp, Homo sapien
gggctgcgcagagtttgtccccgac

SEQ ID NO: 418471 - DNA, 25 bp, Homo sapien
cgcagagtttgtccccgaccgcgtg

SEQ ID NO: 418472 - DNA, 25 bp, Homo sapien
tccagcgaccgtcaagcctgtcgga

SEQ ID NO: 418473 - DNA, 25 bp, Homo sapien
gaccgtcaagcctgtcggacaattt

SEQ ID NO: 418474 - DNA, 25 bp, Homo sapien
agcctgtcggacaattttgcagcaa

SEQ ID NO: 418475 - DNA, 25 bp, Homo sapien
tgtcggacaattttgcagcaacagc

SEQ ID NO: 418476 - DNA, 25 bp, Homo sapien
cctcacttggtcctcagccttggga

SEQ ID NO: 418477 - DNA, 25 bp, Homo sapien
gagggcaagggtctggcgtcgccac

SEQ ID NO: 418478 - DNA, 25 bp, Homo sapien
caccgggaggcggatgcatctcttt

SEQ ID NO: 418479 - DNA, 25 bp, Homo sapien
aggcggatgcatctctttcagcatt

SEQ ID NO: 418480 - DNA, 25 bp, Homo sapien
ttcagcattgagagtatcatgcaag

SEQ ID NO: 418481 - DNA, 25 bp, Homo sapien
tttaacccagacgggcccggctgag

SEQ ID NO: 418482 - DNA, 25 bp, Homo sapien
ttaacccagacgggcccggctgagt

SEQ ID NO: 418483 - DNA, 25 bp, Homo sapien
taacccagacgggcccggctgagtg

SEQ ID NO: 418484 - DNA, 25 bp, Homo sapien
aacccagacgggcccggctgagtgt

SEQ ID NO: 418485 - DNA, 25 bp, Homo sapien
acccagacgggcccggctgagtgtg

SEQ ID NO: 418486 - DNA, 25 bp, Homo sapien
cccagacgggcccggctgagtgtgg

SEQ ID NO: 418487 - DNA, 25 bp, Homo sapien
ccagacgggcccggctgagtgtggt

SEQ ID NO: 418488 - DNA, 25 bp, Homo sapien
cagacgggcccggctgagtgtggtg

SEQ ID NO: 418489 - DNA, 25 bp, Homo sapien
agacgggcccggctgagtgtggtgg

SEQ ID NO: 418490 - DNA, 25 bp, Homo sapien
caggagaggtccacaggccagacgc

SEQ ID NO: 418491 - DNA, 25 bp, Homo sapien
ggagaggtccacaggccagacgcca

SEQ ID NO: 418492 - DNA, 25 bp, Homo sapien
agacgccacctttccccaggctagc

SEQ ID NO: 418493 - DNA, 25 bp, Homo sapien
ccagcaccggagtcagaagtcagtg

SEQ ID NO: 418494 - DNA, 25 bp, Homo sapien
gcaccggagtcagaagtcagtggtt

SEQ ID NO: 418495 - DNA, 25 bp, Homo sapien
agtcagaagtcagtggtttgaggcc

SEQ ID NO: 418496 - DNA, 25 bp, Homo sapien
tcagaagtcagtggtttgaggccaa

SEQ ID NO: 418497 - DNA, 25 bp, Homo sapien
gaagtcagtggtttgaggccaagct

SEQ ID NO: 418498 - DNA, 25 bp, Homo sapien
aagtcagtggtttgaggccaagctg

SEQ ID NO: 418499 - DNA, 25 bp, Homo sapien
tcagtggtttgaggccaagctgggc

SEQ ID NO: 418500 - DNA, 25 bp, Homo sapien
gcaggtgacttgaggtcgggtattt

SEQ ID NO: 418501 - DNA, 25 bp, Homo sapien
tatatgtgccacactttgcactact

SEQ ID NO: 418502 - DNA, 25 bp, Homo sapien
aagaaaggaaccaaattattatgct

SEQ ID NO: 418503 - DNA, 25 bp, Homo sapien
tctaacttcgtttattgtataatgc

SEQ ID NO: 418504 - DNA, 25 bp, Homo sapien
aacttcgtttattgtataatgcatc

SEQ ID NO: 418505 - DNA, 25 bp, Homo sapien
cttcgtttattgtataatgcatcat

SEQ ID NO: 418506 - DNA, 25 bp, Homo sapien
tcatttgaaaataccaaggaggaaa

SEQ ID NO: 418507 - DNA, 25 bp, Homo sapien
tttttaatgatgcaagagtggacgt

SEQ ID NO: 418508 - DNA, 25 bp, Homo sapien
ttaatgatgcaagagtggacgtaat

SEQ ID NO: 418509 - DNA, 25 bp, Homo sapien
agagtggacgtaatgctagttggca

SEQ ID NO: 418510 - DNA, 25 bp, Homo sapien
agtggacgtaatgctagttggcagt

SEQ ID NO: 418511 - DNA, 25 bp, Homo sapien
ggacgtaatgctagttggcagtatt

SEQ ID NO: 418512 - DNA, 25 bp, Homo sapien
cctttgatgattatgccatgcactg

SEQ ID NO: 418513 - DNA, 25 bp, Homo sapien
ctttgatgattatgccatgcactgg

SEQ ID NO: 418514 - DNA, 25 bp, Homo sapien
gatgattatgccatgcactgggtcc

SEQ ID NO: 418515 - DNA, 25 bp, Homo sapien
atgattatgccatgcactgggtccg

SEQ ID NO: 418516 - DNA, 25 bp, Homo sapien
tgattatgccatgcactgggtccgg

SEQ ID NO: 418517 - DNA, 25 bp, Homo sapien
gattatgccatgcactgggtccggc

SEQ ID NO: 418518 - DNA, 25 bp, Homo sapien
ttatgccatgcactgggtccggcaa

SEQ ID NO: 418519 - DNA, 25 bp, Homo sapien
tatgccatgcactgggtccggcaag

SEQ ID NO: 418520 - DNA, 25 bp, Homo sapien
tgggtctcaggtattagttggaata

SEQ ID NO: 418521 - DNA, 25 bp, Homo sapien
ggtctcaggtattagttggaatagt

SEQ ID NO: 418522 - DNA, 25 bp, Homo sapien
ataggctatgcggactctgtgaagg

SEQ ID NO: 418523 - DNA, 25 bp, Homo sapien
cccgagtgtttcacagccaatggtg

SEQ ID NO: 418524 - DNA, 25 bp, Homo sapien
acagccaatggtgcggattataggg

SEQ ID NO: 418525 - DNA, 25 bp, Homo sapien
aactggacagcactacaaggcggga

SEQ ID NO: 418526 - DNA, 25 bp, Homo sapien
acaaggcgggaagccatgtctgttt

SEQ ID NO: 418527 - DNA, 25 bp, Homo sapien
aagccatgtctgttttggaacgaga

SEQ ID NO: 418528 - DNA, 25 bp, Homo sapien
ggaacgagactttccagcatccata

SEQ ID NO: 418529 - DNA, 25 bp, Homo sapien
tccagcatccatacaacactctgaa

SEQ ID NO: 418530 - DNA, 25 bp, Homo sapien
caacactctgaaataccccaacggg

SEQ ID NO: 418531 - DNA, 25 bp, Homo sapien
gagcacaactattgcagaaatccag

SEQ ID NO: 418532 - DNA, 25 bp, Homo sapien
aatccagatggagacgtgagcccct

SEQ ID NO: 418533 - DNA, 25 bp, Homo sapien
gcagagcacgaggatggtgtctact

SEQ ID NO: 418534 - DNA, 25 bp, Homo sapien
attgtatacatttttgatgctgcta

SEQ ID NO: 418535 - DNA, 25 bp, Homo sapien
gatgctgctattgctatagatgtct

SEQ ID NO: 418536 - DNA, 25 bp, Homo sapien
gctattgctatagatgtcttctgga

SEQ ID NO: 418537 - DNA, 25 bp, Homo sapien
gtcttctggaagttgagttgtgcct

SEQ ID NO: 418538 - DNA, 25 bp, Homo sapien
gaagttgagttgtgcctttaggaat

SEQ ID NO: 418539 - DNA, 25 bp, Homo sapien
gtgcctttaggaatattttcccact

SEQ ID NO: 418540 - DNA, 25 bp, Homo sapien
taggaatattttcccactacatcac

SEQ ID NO: 418541 - DNA, 25 bp, Homo sapien
tcccactacatcactgtaatgagtg

SEQ ID NO: 418542 - DNA, 25 bp, Homo sapien
aaagtctctgtacattctgcatgcc

SEQ ID NO: 418543 - DNA, 25 bp, Homo sapien
gtacattctgcatgccttgattaaa

SEQ ID NO: 418544 - DNA, 25 bp, Homo sapien
ttttctaccaaatcactattcctat

SEQ ID NO: 418545 - DNA, 25 bp, Homo sapien
aaatatggccgactgcatcattagc

SEQ ID NO: 418546 - DNA, 25 bp, Homo sapien
cattagcatgtggactcagctggtt

SEQ ID NO: 418547 - DNA, 25 bp, Homo sapien
cagctggttttcaacctcaagagga

SEQ ID NO: 418548 - DNA, 25 bp, Homo sapien
tcccacaatcctcctctgaagaagg

SEQ ID NO: 418549 - DNA, 25 bp, Homo sapien
aggaggattcctcccacaactggca

SEQ ID NO: 418550 - DNA, 25 bp, Homo sapien
aactggcaacatatcactgagcaag

SEQ ID NO: 418551 - DNA, 25 bp, Homo sapien
gcaagttggcaagttttgtttcaca

SEQ ID NO: 418552 - DNA, 25 bp, Homo sapien
gactggctgaccaaggagttctcca

SEQ ID NO: 418553 - DNA, 25 bp, Homo sapien
tctagatgacaaaggatggccacat

SEQ ID NO: 418554 - DNA, 25 bp, Homo sapien
ggtcacttctggcaacgtgggctac

SEQ ID NO: 418555 - DNA, 25 bp, Homo sapien
gaacactccggatttgtaaaaacag

SEQ ID NO: 418556 - DNA, 25 bp, Homo sapien
ggaaaagtgctcttttttgaggact

SEQ ID NO: 418557 - DNA, 25 bp, Homo sapien
tgaggacttcttagtttagatactt

SEQ ID NO: 418558 - DNA, 25 bp, Homo sapien
agatacttttctaaggtccttgaat

SEQ ID NO: 418559 - DNA, 25 bp, Homo sapien
ggtccttgaatgtattacctcttca

SEQ ID NO: 418560 - DNA, 25 bp, Homo sapien
ttgtccaagtggaacctgctagtaa

SEQ ID NO: 418561 - DNA, 25 bp, Homo sapien
ctagtaagcggtagaggtggtccat

SEQ ID NO: 418562 - DNA, 25 bp, Homo sapien
tagaggtggtccatggtctggctcc

SEQ ID NO: 418563 - DNA, 25 bp, Homo sapien
tctggctcccaagtccatgctgtta

SEQ ID NO: 418564 - DNA, 25 bp, Homo sapien
ccaagtccatgctgttagcctctac

SEQ ID NO: 418565 - DNA, 25 bp, Homo sapien
tgaaattctggctctgcaaccatct

SEQ ID NO: 418566 - DNA, 25 bp, Homo sapien
caaccatctctcacaccagtaaaaa

SEQ ID NO: 418567 - DNA, 25 bp, Homo sapien
attttcctcttccatttatcatcct

SEQ ID NO: 418568 - DNA, 25 bp, Homo sapien
gctttcttttagattttgttccaga

SEQ ID NO: 418569 - DNA, 25 bp, Homo sapien
cttttagattttgttccagatagga

SEQ ID NO: 418570 - DNA, 25 bp, Homo sapien
cataaggtagttctgcatttttgga

SEQ ID NO: 418571 - DNA, 25 bp, Homo sapien
gcatttttggattccaggatcctgt

SEQ ID NO: 418572 - DNA, 25 bp, Homo sapien
ggatcctgtttgaaatcttccatgt

SEQ ID NO: 418573 - DNA, 25 bp, Homo sapien
ctgtttgaaatcttccatgtgagga

SEQ ID NO: 418574 - DNA, 25 bp, Homo sapien
gacagggtggtttatttaaagagat

SEQ ID NO: 418575 - DNA, 25 bp, Homo sapien
agaacttgtgccatatctcgtctgt

SEQ ID NO: 418576 - DNA, 25 bp, Homo sapien
ttgtgccatatctcgtctgttttat

SEQ ID NO: 418577 - DNA, 25 bp, Homo sapien
ccatatctcgtctgttttattgcat

SEQ ID NO: 418578 - DNA, 25 bp, Homo sapien
gaaagtcttctatcactagatcaac

SEQ ID NO: 418579 - DNA, 25 bp, Homo sapien
tacatcctggagaaagcctttatga

SEQ ID NO: 418580 - DNA, 25 bp, Homo sapien
gagtgtagtgaatgcgcgaaatcca

SEQ ID NO: 418581 - DNA, 25 bp, Homo sapien
gtgaatgcgcgaaatccattaccca

SEQ ID NO: 418582 - DNA, 25 bp, Homo sapien
aatccattacccaaaggaatcactt

SEQ ID NO: 418583 - DNA, 25 bp, Homo sapien
aggaatcacttcagtacacacctgc

SEQ ID NO: 418584 - DNA, 25 bp, Homo sapien
atcacataacagaaaggccttagat

SEQ ID NO: 418585 - DNA, 25 bp, Homo sapien
ggatatgtgcactttcctgttcagt

SEQ ID NO: 418586 - DNA, 25 bp, Homo sapien
ttcagtgcggcaaccctggaggaaa

SEQ ID NO: 418587 - DNA, 25 bp, Homo sapien
gaggcttcagcctgaattgaatctc

SEQ ID NO: 418588 - DNA, 25 bp, Homo sapien
gaatctcatacatccaaatgttcac

SEQ ID NO: 418589 - DNA, 25 bp, Homo sapien
aagtccagaaacaaattacgccaat

SEQ ID NO: 418590 - DNA, 25 bp, Homo sapien
aattacgccaatacactatggtcaa

SEQ ID NO: 418591 - DNA, 25 bp, Homo sapien
cgccaatacactatggtcaattgat

SEQ ID NO: 418592 - DNA, 25 bp, Homo sapien
gaaagaacagtgtcttcaactaata

SEQ ID NO: 418593 - DNA, 25 bp, Homo sapien
acagtgtcttcaactaatagtgcta

SEQ ID NO: 418594 - DNA, 25 bp, Homo sapien
gtgtcttcaactaatagtgctaaga

SEQ ID NO: 418595 - DNA, 25 bp, Homo sapien
tagtgctaagacaagtgaatattca

SEQ ID NO: 418596 - DNA, 25 bp, Homo sapien
gaatttgtacctgtacttcatacca

SEQ ID NO: 418597 - DNA, 25 bp, Homo sapien
tttgtacctgtacttcataccatat

SEQ ID NO: 418598 - DNA, 25 bp, Homo sapien
gtacctgtacttcataccatatata

SEQ ID NO: 418599 - DNA, 25 bp, Homo sapien
gaccttggatttggcaatggtttct

SEQ ID NO: 418600 - DNA, 25 bp, Homo sapien
cctttgatgattatggcatgacctg

SEQ ID NO: 418601 - DNA, 25 bp, Homo sapien
tttgatgattatggcatgacctggg

SEQ ID NO: 418602 - DNA, 25 bp, Homo sapien
gatgattatggcatgacctgggtcc

SEQ ID NO: 418603 - DNA, 25 bp, Homo sapien
atgattatggcatgacctgggtccg

SEQ ID NO: 418604 - DNA, 25 bp, Homo sapien
tgattatggcatgacctgggtccgc

SEQ ID NO: 418605 - DNA, 25 bp, Homo sapien
gattatggcatgacctgggtccgcc

SEQ ID NO: 418606 - DNA, 25 bp, Homo sapien
gctggagtgggtctctggtattaat

SEQ ID NO: 418607 - DNA, 25 bp, Homo sapien
tgggtctctggtattaattggaatg

SEQ ID NO: 418608 - DNA, 25 bp, Homo sapien
gtctctggtattaattggaatggtt

SEQ ID NO: 418609 - DNA, 25 bp, Homo sapien
gtattaattggaatggttgtaccac

SEQ ID NO: 418610 - DNA, 25 bp, Homo sapien
attggaatggttgtaccacaaatta

SEQ ID NO: 418611 - DNA, 25 bp, Homo sapien
agctccattgcctgtatccattcct

SEQ ID NO: 418612 - DNA, 25 bp, Homo sapien
attgcctgtatccattccttccttc

SEQ ID NO: 418613 - DNA, 25 bp, Homo sapien
ccttccttcttcttagagttggtgg

SEQ ID NO: 418614 - DNA, 25 bp, Homo sapien
cttagagttggtggtggccagacta

SEQ ID NO: 418615 - DNA, 25 bp, Homo sapien
gagggtgctgctgacaatgacattg

SEQ ID NO: 418616 - DNA, 25 bp, Homo sapien
gacacaggtctaaggactttccaaa

SEQ ID NO: 418617 - DNA, 25 bp, Homo sapien
tttccaaagtattagtcagtcagtc

SEQ ID NO: 418618 - DNA, 25 bp, Homo sapien
tcagtcctcacacaggattgtaggt

SEQ ID NO: 418619 - DNA, 25 bp, Homo sapien
cacacaggattgtaggtactgtcat

SEQ ID NO: 418620 - DNA, 25 bp, Homo sapien
gtactgtcataactccatttcatag

SEQ ID NO: 418621 - DNA, 25 bp, Homo sapien
ataactccatttcatagttgaggaa

SEQ ID NO: 418622 - DNA, 25 bp, Homo sapien
gcaagaacgatcctaatgcccccaa

SEQ ID NO: 418623 - DNA, 25 bp, Homo sapien
aagcagccttatgtcactaaggtgg

SEQ ID NO: 418624 - DNA, 25 bp, Homo sapien
gcagccttatgtcactaaggtggca

SEQ ID NO: 418625 - DNA, 25 bp, Homo sapien
agccttatgtcactaaggtggcaaa

SEQ ID NO: 418626 - DNA, 25 bp, Homo sapien
ttatgtcactaaggtggcaaagctg

SEQ ID NO: 418627 - DNA, 25 bp, Homo sapien
gttggacggcacaaaaggtcctgct

SEQ ID NO: 418628 - DNA, 25 bp, Homo sapien
tggacggcacaaaaggtcctgctaa

SEQ ID NO: 418629 - DNA, 25 bp, Homo sapien
gacggcacaaaaggtcctgctaaag

SEQ ID NO: 418630 - DNA, 25 bp, Homo sapien
cggcacaaaaggtcctgctaaagtt

SEQ ID NO: 418631 - DNA, 25 bp, Homo sapien
cctgctaaagttgcctgggaaaaga

SEQ ID NO: 418632 - DNA, 25 bp, Homo sapien
aagttgcctgggaaaagatggaaga

SEQ ID NO: 418633 - DNA, 25 bp, Homo sapien
ttggtttttgggaagcctactctat

SEQ ID NO: 418634 - DNA, 25 bp, Homo sapien
ttccaggtctgtgtatctacatatt

SEQ ID NO: 418635 - DNA, 25 bp, Homo sapien
ccaggtctgtgtatctacatatttc

SEQ ID NO: 418636 - DNA, 25 bp, Homo sapien
gaaattctgtgaattgtgttctgtc

SEQ ID NO: 418637 - DNA, 25 bp, Homo sapien
atcctgctcacggaataggctatgt

SEQ ID NO: 418638 - DNA, 25 bp, Homo sapien
aataggctatgtaaacaacgggcgc

SEQ ID NO: 418639 - DNA, 25 bp, Homo sapien
catatttctgtatacattcttatag

SEQ ID NO: 418640 - DNA, 25 bp, Homo sapien
gtatacattcttatagatacggttt

SEQ ID NO: 418641 - DNA, 25 bp, Homo sapien
gatacggtttaatgccatggtttca

SEQ ID NO: 418642 - DNA, 25 bp, Homo sapien
ggtttaatgccatggtttcattcag

SEQ ID NO: 418643 - DNA, 25 bp, Homo sapien
tggtttcattcaggcttattttcta

SEQ ID NO: 418644 - DNA, 25 bp, Homo sapien
gacactctgttgtactattggtcat

SEQ ID NO: 418645 - DNA, 25 bp, Homo sapien
ttggtcattgaatcaaagcagtctt

SEQ ID NO: 418646 - DNA, 25 bp, Homo sapien
atcaaagcagtcttgacagtatgca

SEQ ID NO: 418647 - DNA, 25 bp, Homo sapien
gtcttgacagtatgcaaaatcctta

SEQ ID NO: 418648 - DNA, 25 bp, Homo sapien
aatccttaaaatcatggacactttt

SEQ ID NO: 418649 - DNA, 25 bp, Homo sapien
ggacacttttgatcaagcaattcca

SEQ ID NO: 418650 - DNA, 25 bp, Homo sapien
caagcaattccatatgtaagagttt

SEQ ID NO: 418651 - DNA, 25 bp, Homo sapien
gtaagagtttatcctaagcaaatca

SEQ ID NO: 418652 - DNA, 25 bp, Homo sapien
gttggtcaaagtgtacagtgttagg

SEQ ID NO: 418653 - DNA, 25 bp, Homo sapien
tgagataacactgcacaacatggta

SEQ ID NO: 418654 - DNA, 25 bp, Homo sapien
ctgcacaacatggtaactacagtta

SEQ ID NO: 418655 - DNA, 25 bp, Homo sapien
aatgtatacattcaatcggaaagat

SEQ ID NO: 418656 - DNA, 25 bp, Homo sapien
gaaagtgagggtcaaataagcagat

SEQ ID NO: 418657 - DNA, 25 bp, Homo sapien
gggtcaaataagcagatgaggaatt

SEQ ID NO: 418658 - DNA, 25 bp, Homo sapien
atgaggaattattatccctggaaat

SEQ ID NO: 418659 - DNA, 25 bp, Homo sapien
gaggaattattatccctggaaatac

SEQ ID NO: 418660 - DNA, 25 bp, Homo sapien
cctggaaatacagggaattttcttg

SEQ ID NO: 418661 - DNA, 25 bp, Homo sapien
acagggaattttcttgttgatacaa

SEQ ID NO: 418662 - DNA, 25 bp, Homo sapien
tctggttttagtacctttcatcaaa

SEQ ID NO: 418663 - DNA, 25 bp, Homo sapien
tggttttagtacctttcatcaaact

SEQ ID NO: 418664 - DNA, 25 bp, Homo sapien
gtacctttcatcaaactttcttaat

SEQ ID NO: 418665 - DNA, 25 bp, Homo sapien
tcatcaaactttcttaatgtattag

SEQ ID NO: 418666 - DNA, 25 bp, Homo sapien
cgagcagcactagtcctgcctggtg

SEQ ID NO: 418667 - DNA, 25 bp, Homo sapien
caggatgggaccaaagtcaaggcct

SEQ ID NO: 418668 - DNA, 25 bp, Homo sapien
gggcatggctgagtaccccagacgt

SEQ ID NO: 418669 - DNA, 25 bp, Homo sapien
catggctgagtaccccagacgtctg

SEQ ID NO: 418670 - DNA, 25 bp, Homo sapien
tgagtaccccagacgtctggtccag

SEQ ID NO: 418671 - DNA, 25 bp, Homo sapien
gacgtctggtccagggcagacacat

SEQ ID NO: 418672 - DNA, 25 bp, Homo sapien
tggtccagggcagacacattcctct

SEQ ID NO: 418673 - DNA, 25 bp, Homo sapien
ggcagacacattcctctcagaagcc

SEQ ID NO: 418674 - DNA, 25 bp, Homo sapien
gacacattcctctcagaagcccgtg

SEQ ID NO: 418675 - DNA, 25 bp, Homo sapien
cagaagcccgtgtctcagtgcaggt

SEQ ID NO: 418676 - DNA, 25 bp, Homo sapien
agcgtgaaggtgtctccagccaggc

SEQ ID NO: 418677 - DNA, 25 bp, Homo sapien
gtgcggatcttcaatcgccaaggca

SEQ ID NO: 418678 - DNA, 25 bp, Homo sapien
caaggcatttgcgacgggtttcggc

SEQ ID NO: 418679 - DNA, 25 bp, Homo sapien
cgggcggccggcaaaatcatccata

SEQ ID NO: 418680 - DNA, 25 bp, Homo sapien
atccatatgagttcggtgcaccagg

SEQ ID NO: 418681 - DNA, 25 bp, Homo sapien
atgtgaattacgcagcctccaaggg

SEQ ID NO: 418682 - DNA, 25 bp, Homo sapien
gtgtggagatgctgatgcgcaccct

SEQ ID NO: 418683 - DNA, 25 bp, Homo sapien
gaagtcagtgaacagcgcatccgca

SEQ ID NO: 418684 - DNA, 25 bp, Homo sapien
agcgcatccgcatcaatggcatcgc

SEQ ID NO: 418685 - DNA, 25 bp, Homo sapien
gggcgattcgcacggcaatcaaccg

SEQ ID NO: 418686 - DNA, 25 bp, Homo sapien
ggcgcggctgaaaaagaattgctca

SEQ ID NO: 418687 - DNA, 25 bp, Homo sapien
attgctcaagttgattccctacggc

SEQ ID NO: 418688 - DNA, 25 bp, Homo sapien
agaaccctgatctcaactcttcgtt

SEQ ID NO: 418689 - DNA, 25 bp, Homo sapien
tcaactcttcgtttttccaggttat

SEQ ID NO: 418690 - DNA, 25 bp, Homo sapien
gatgactatccataaatcttccgat

SEQ ID NO: 418691 - DNA, 25 bp, Homo sapien
atcttccgatgaacgaacctcttta

SEQ ID NO: 418692 - DNA, 25 bp, Homo sapien
aacctctttatgaccagagctcctg

SEQ ID NO: 418693 - DNA, 25 bp, Homo sapien
agaaaggttttataatggctgtctt

SEQ ID NO: 418694 - DNA, 25 bp, Homo sapien
ggctgtcttaatttgtttggtggtt

SEQ ID NO: 418695 - DNA, 25 bp, Homo sapien
ccaggtattaatgccaaatttgcct

SEQ ID NO: 418696 - DNA, 25 bp, Homo sapien
tctgtttcttatcacactgttttca

SEQ ID NO: 418697 - DNA, 25 bp, Homo sapien
tcacactgttttcaggttacatcat

SEQ ID NO: 418698 - DNA, 25 bp, Homo sapien
ggttacatcattatcttaaaaaggc

SEQ ID NO: 418699 - DNA, 25 bp, Homo sapien
aagatcttagatgttcgaaggctta

SEQ ID NO: 418700 - DNA, 25 bp, Homo sapien
agatcttagatgttcgaaggcttaa

SEQ ID NO: 418701 - DNA, 25 bp, Homo sapien
gatcttagatgttcgaaggcttaaa

SEQ ID NO: 418702 - DNA, 25 bp, Homo sapien
atcttagatgttcgaaggcttaaaa

SEQ ID NO: 418703 - DNA, 25 bp, Homo sapien
tcttagatgttcgaaggcttaaaaa

SEQ ID NO: 418704 - DNA, 25 bp, Homo sapien
gcgaggtggtgaatgcctattagta

SEQ ID NO: 418705 - DNA, 25 bp, Homo sapien
cgaggtggtgaatgcctattagtaa

SEQ ID NO: 418706 - DNA, 25 bp, Homo sapien
gaggtggtgaatgcctattagtaat

SEQ ID NO: 418707 - DNA, 25 bp, Homo sapien
ggtggtgaatgcctattagtaatcc

SEQ ID NO: 418708 - DNA, 25 bp, Homo sapien
ggtgaatgcctattagtaatcccag

SEQ ID NO: 418709 - DNA, 25 bp, Homo sapien
gtgaatgcctattagtaatcccagc

SEQ ID NO: 418710 - DNA, 25 bp, Homo sapien
accagctctgccatgaggtgggtcc

SEQ ID NO: 418711 - DNA, 25 bp, Homo sapien
ccagctctgccatgaggtgggtccg

SEQ ID NO: 418712 - DNA, 25 bp, Homo sapien
ctgcaaatgaattccctgagagtcg

SEQ ID NO: 418713 - DNA, 25 bp, Homo sapien
gctctgccatgaggtgggtccgcca

SEQ ID NO: 418714 - DNA, 25 bp, Homo sapien
aaatgaattccctgagagtcgaggg

SEQ ID NO: 418715 - DNA, 25 bp, Homo sapien
aatgaattccctgagagtcgagggc

SEQ ID NO: 418716 - DNA, 25 bp, Homo sapien
ttagtggtagtggtgaaaccacata

SEQ ID NO: 418717 - DNA, 25 bp, Homo sapien
tagtggtagtggtgaaaccacatat

SEQ ID NO: 418718 - DNA, 25 bp, Homo sapien
agtggtgaaaccacatattatgcag

SEQ ID NO: 418719 - DNA, 25 bp, Homo sapien
gaaaccacatattatgcagactccg

SEQ ID NO: 418720 - DNA, 25 bp, Homo sapien
aaaccacatattatgcagactccgt

SEQ ID NO: 418721 - DNA, 25 bp, Homo sapien
gaagctgaagcaggttatatacagt

SEQ ID NO: 418722 - DNA, 25 bp, Homo sapien
gaagcaggttatatacagtatacca

SEQ ID NO: 418723 - DNA, 25 bp, Homo sapien
tgtttaagtgatacattaggaatgc

SEQ ID NO: 418724 - DNA, 25 bp, Homo sapien
taggaatgcaaaacattcaagtttt

SEQ ID NO: 418725 - DNA, 25 bp, Homo sapien
tcaagttttagataatggctacctc

SEQ ID NO: 418726 - DNA, 25 bp, Homo sapien
gttttagataatggctacctcttga

SEQ ID NO: 418727 - DNA, 25 bp, Homo sapien
ttagataatggctacctcttgaata

SEQ ID NO: 418728 - DNA, 25 bp, Homo sapien
agataatggctacctcttgaataaa

SEQ ID NO: 418729 - DNA, 25 bp, Homo sapien
gggatttcagccatatctagtattt

SEQ ID NO: 418730 - DNA, 25 bp, Homo sapien
gatttcagccatatctagtatttat

SEQ ID NO: 418731 - DNA, 25 bp, Homo sapien
ttcagccatatctagtatttatttt

SEQ ID NO: 418732 - DNA, 25 bp, Homo sapien
gatgctaagatgaacatcctcttac

SEQ ID NO: 418733 - DNA, 25 bp, Homo sapien
tcctgatggacctgcacacatcaat

SEQ ID NO: 418734 - DNA, 25 bp, Homo sapien
gcacacatcaatttccaggcatata

SEQ ID NO: 418735 - DNA, 25 bp, Homo sapien
gggtttcaaattttctgtgtctctt

SEQ ID NO: 418736 - DNA, 25 bp, Homo sapien
gtctcttagaaacactgaaaagtcg

SEQ ID NO: 418737 - DNA, 25 bp, Homo sapien
aagtcgatttatgataaccttatgg

SEQ ID NO: 418738 - DNA, 25 bp, Homo sapien
aaccttatggaaaatgtagcttact

SEQ ID NO: 418739 - DNA, 25 bp, Homo sapien
gtagcttactccttgaaataattgg

SEQ ID NO: 418740 - DNA, 25 bp, Homo sapien
ttaatagaattcacccattctcccc

SEQ ID NO: 418741 - DNA, 25 bp, Homo sapien
attctcccctgtagcactttctaga

SEQ ID NO: 418742 - DNA, 25 bp, Homo sapien
agcactttctagagtcagaacctga

SEQ ID NO: 418743 - DNA, 25 bp, Homo sapien
ggactacatgcatacaccaacacag

SEQ ID NO: 418744 - DNA, 25 bp, Homo sapien
gcatacaccaacacagccaactaat

SEQ ID NO: 418745 - DNA, 25 bp, Homo sapien
tcctggccttgagagattctcctgc

SEQ ID NO: 418746 - DNA, 25 bp, Homo sapien
gctgggattacaatatccggcccta

SEQ ID NO: 418747 - DNA, 25 bp, Homo sapien
atatccggccctactggaatatttt

SEQ ID NO: 418748 - DNA, 25 bp, Homo sapien
aaatctcaggtgttacatcattgca

SEQ ID NO: 418749 - DNA, 25 bp, Homo sapien
caggtgttacatcattgcacttgta

SEQ ID NO: 418750 - DNA, 25 bp, Homo sapien
catcattgcacttgtaagtacttta

SEQ ID NO: 418751 - DNA, 25 bp, Homo sapien
atctctagcagataaatctttttaa

SEQ ID NO: 418752 - DNA, 25 bp, Homo sapien
aaccacagcatcattgtcacactca

SEQ ID NO: 418753 - DNA, 25 bp, Homo sapien
acagcatcattgtcacactcaaaaa

SEQ ID NO: 418754 - DNA, 25 bp, Homo sapien
gaaaatcttgcttttatggtcttcc

SEQ ID NO: 418755 - DNA, 25 bp, Homo sapien
ttgcttttatggtcttcccccctcg

SEQ ID NO: 418756 - DNA, 25 bp, Homo sapien
ctcgccctcaagaacaagggccttg

SEQ ID NO: 418757 - DNA, 25 bp, Homo sapien
tcgccctcaagaacaagggccttgt

SEQ ID NO: 418758 - DNA, 25 bp, Homo sapien
gccctcaagaacaagggccttgtgc

SEQ ID NO: 418759 - DNA, 25 bp, Homo sapien
caagggccttgtgcgtgggccttcc

SEQ ID NO: 418760 - DNA, 25 bp, Homo sapien
gggccttgtgcgtgggccttcccat

SEQ ID NO: 418761 - DNA, 25 bp, Homo sapien
gattcaggggagaggccttcccagg

SEQ ID NO: 418762 - DNA, 25 bp, Homo sapien
cagaggcctgagcaacccctctctg

SEQ ID NO: 418763 - DNA, 25 bp, Homo sapien
gcaacccctctctgggtggtttggg

SEQ ID NO: 418764 - DNA, 25 bp, Homo sapien
gaaaatctcagggacagatgaggct

SEQ ID NO: 418765 - DNA, 25 bp, Homo sapien
gggagtaaccggattcgccttgcct

SEQ ID NO: 418766 - DNA, 25 bp, Homo sapien
cgccttgcctgtctgtgattgggaa

SEQ ID NO: 418767 - DNA, 25 bp, Homo sapien
tgattgggaagcacgcaccctttat

SEQ ID NO: 418768 - DNA, 25 bp, Homo sapien
gaagcacgcaccctttattttccaa

SEQ ID NO: 418769 - DNA, 25 bp, Homo sapien
tttattttccaactgggaacaagat

SEQ ID NO: 418770 - DNA, 25 bp, Homo sapien
gaacaagatactggaaattcctctt

SEQ ID NO: 418771 - DNA, 25 bp, Homo sapien
actgggtaatagttctagagcactt

SEQ ID NO: 418772 - DNA, 25 bp, Homo sapien
attctttcaggataagtgttatacg

SEQ ID NO: 418773 - DNA, 25 bp, Homo sapien
gttaaattgtgttcctatcattggt

SEQ ID NO: 418774 - DNA, 25 bp, Homo sapien
gtgttcctatcattggtaacgcccc

SEQ ID NO: 418775 - DNA, 25 bp, Homo sapien
tatcattggtaacgccccaagtaaa

SEQ ID NO: 418776 - DNA, 25 bp, Homo sapien
tattttgaactgaaggcgaaactgc

SEQ ID NO: 418777 - DNA, 25 bp, Homo sapien
aggcgaaactgcagagttcccctga

SEQ ID NO: 418778 - DNA, 25 bp, Homo sapien
gaaactgcagagttcccctgactac

SEQ ID NO: 418779 - DNA, 25 bp, Homo sapien
agagttcccctgactacctacaggt

SEQ ID NO: 418780 - DNA, 25 bp, Homo sapien
gatctaggtcatgtaatcttacttc

SEQ ID NO: 418781 - DNA, 25 bp, Homo sapien
gtaatcttacttcatacagaggaca

SEQ ID NO: 418782 - DNA, 25 bp, Homo sapien
acttcatacagaggacatttattta

SEQ ID NO: 418783 - DNA, 25 bp, Homo sapien
gaaagtgccttttgttgacttctaa

SEQ ID NO: 418784 - DNA, 25 bp, Homo sapien
gccttttgttgacttctaacttcca

SEQ ID NO: 418785 - DNA, 25 bp, Homo sapien
tgtctcattaactgtagctgcaaag

SEQ ID NO: 418786 - DNA, 25 bp, Homo sapien
taactgtagctgcaaagatgtgtca

SEQ ID NO: 418787 - DNA, 25 bp, Homo sapien
gaatatgaggtgaggttcccctttt

SEQ ID NO: 418788 - DNA, 25 bp, Homo sapien
tttcctgcaaaattactcctcagag

SEQ ID NO: 418789 - DNA, 25 bp, Homo sapien
gtggagtcaatgcaaagcctctgct

SEQ ID NO: 418790 - DNA, 25 bp, Homo sapien
aaagcctctgctattactgggtgct

SEQ ID NO: 418791 - DNA, 25 bp, Homo sapien
gctattactgggtgctttctccaag

SEQ ID NO: 418792 - DNA, 25 bp, Homo sapien
gaggaagacacattagccccacatg

SEQ ID NO: 418793 - DNA, 25 bp, Homo sapien
cacatgaccctgtttaatgcggtta

SEQ ID NO: 418794 - DNA, 25 bp, Homo sapien
tatggagggcacctgacaaaatctt

SEQ ID NO: 418795 - DNA, 25 bp, Homo sapien
aagggtatggcagctttgaaaatag

SEQ ID NO: 418796 - DNA, 25 bp, Homo sapien
tattcttaggaatgtgtcctcacag

SEQ ID NO: 418797 - DNA, 25 bp, Homo sapien
gtgtcctcacagttgtaaatgcaaa

SEQ ID NO: 418798 - DNA, 25 bp, Homo sapien
gaggtgagaactgttatctctgtta

SEQ ID NO: 418799 - DNA, 25 bp, Homo sapien
gaactgttatctctgttacacatag

SEQ ID NO: 418800 - DNA, 25 bp, Homo sapien
gttatctctgttacacatagaagga

SEQ ID NO: 418801 - DNA, 25 bp, Homo sapien
gagtgccgcagtgtggtcctcagaa

SEQ ID NO: 418802 - DNA, 25 bp, Homo sapien
gccgcagtgtggtcctcagaagaca

SEQ ID NO: 418803 - DNA, 25 bp, Homo sapien
gatacactgttagcattggatgaaa

SEQ ID NO: 418804 - DNA, 25 bp, Homo sapien
gatgaaaaagaagggcttcatacct

SEQ ID NO: 418805 - DNA, 25 bp, Homo sapien
ttcatacctttccacagaggtcggt

SEQ ID NO: 418806 - DNA, 25 bp, Homo sapien
agaggtcggtcctcttcaagaccat

SEQ ID NO: 418807 - DNA, 25 bp, Homo sapien
ggtcctcttcaagaccatttgaatt

SEQ ID NO: 418808 - DNA, 25 bp, Homo sapien
ttaatgctcaaagagtttccttctc

SEQ ID NO: 418809 - DNA, 25 bp, Homo sapien
acaggcaaagccaatatgagatcat

SEQ ID NO: 418810 - DNA, 25 bp, Homo sapien
gagatcatggccaagcagaactgga

SEQ ID NO: 418811 - DNA, 25 bp, Homo sapien
ggttcaccagctggactgaggaact

SEQ ID NO: 418812 - DNA, 25 bp, Homo sapien
tgaaccaggaggtcactggccacat

SEQ ID NO: 418813 - DNA, 25 bp, Homo sapien
ggtcactggccacatagagcagctc

SEQ ID NO: 418814 - DNA, 25 bp, Homo sapien
aggtccgaggtcactgacctgcagt

SEQ ID NO: 418815 - DNA, 25 bp, Homo sapien
tgacctgcagtgcaccctccagggt

SEQ ID NO: 418816 - DNA, 25 bp, Homo sapien
ctgcactcgcagctcagcgtgaaag

SEQ ID NO: 418817 - DNA, 25 bp, Homo sapien
agcgtgaaagctcccttagaaggca

SEQ ID NO: 418818 - DNA, 25 bp, Homo sapien
cttagaaggcacactggcagaaaca

SEQ ID NO: 418819 - DNA, 25 bp, Homo sapien
agctggtgcagatccaggcactgat

SEQ ID NO: 418820 - DNA, 25 bp, Homo sapien
aaaagcctttaatgtcttagtgatt

SEQ ID NO: 418821 - DNA, 25 bp, Homo sapien
gcctttaatgtcttagtgattatct

SEQ ID NO: 418822 - DNA, 25 bp, Homo sapien
gtcttagtgattatcttggttttat

SEQ ID NO: 418823 - DNA, 25 bp, Homo sapien
gggtcaggtctgtcatatcagtgta

SEQ ID NO: 418824 - DNA, 25 bp, Homo sapien
tcaggtctgtcatatcagtgtaaaa

SEQ ID NO: 418825 - DNA, 25 bp, Homo sapien
gtagaatggctaggcaagttgacat

SEQ ID NO: 418826 - DNA, 25 bp, Homo sapien
atggctaggcaagttgacatttgtt

SEQ ID NO: 418827 - DNA, 25 bp, Homo sapien
gctaggcaagttgacatttgtttat

SEQ ID NO: 418828 - DNA, 25 bp, Homo sapien
aggcaagttgacatttgtttatggt

SEQ ID NO: 418829 - DNA, 25 bp, Homo sapien
gtagactgaaattttatacctgttt

SEQ ID NO: 418830 - DNA, 25 bp, Homo sapien
gactgaaattttatacctgtttatt

SEQ ID NO: 418831 - DNA, 25 bp, Homo sapien
tgctacctacagatttctcacggtg

SEQ ID NO: 418832 - DNA, 25 bp, Homo sapien
tacagatttctcacggtgctcccaa

SEQ ID NO: 418833 - DNA, 25 bp, Homo sapien
tttctcacggtgctcccaaaactat

SEQ ID NO: 418834 - DNA, 25 bp, Homo sapien
atgatgtttggaaactgtctgccct

SEQ ID NO: 418835 - DNA, 25 bp, Homo sapien
ctcggtgtcagggaccgtgggacag

SEQ ID NO: 418836 - DNA, 25 bp, Homo sapien
agggtcaccctctcctgtagtggaa

SEQ ID NO: 418837 - DNA, 25 bp, Homo sapien
accctctcctgtagtggaaacacaa

SEQ ID NO: 418838 - DNA, 25 bp, Homo sapien
tagtggaaacacaaacaacgttgga

SEQ ID NO: 418839 - DNA, 25 bp, Homo sapien
acaaacaacgttggaagttatgctg

SEQ ID NO: 418840 - DNA, 25 bp, Homo sapien
gctgtgggctgctacctacagattt

SEQ ID NO: 418841 - DNA, 25 bp, Homo sapien
tgggctgctacctacagatttctca

SEQ ID NO: 418842 - DNA, 25 bp, Homo sapien
gttaggaacttgcattccttgctca

SEQ ID NO: 418843 - DNA, 25 bp, Homo sapien
gaacttgcattccttgctcagagtt

SEQ ID NO: 418844 - DNA, 25 bp, Homo sapien
ttccttgctcagagttctctcttta

SEQ ID NO: 418845 - DNA, 25 bp, Homo sapien
tctctagatagaatacaaagtgggt

SEQ ID NO: 418846 - DNA, 25 bp, Homo sapien
gggtctgtgctaaggtataatttta

SEQ ID NO: 418847 - DNA, 25 bp, Homo sapien
ttttagttacttctcatagcctttt

SEQ ID NO: 418848 - DNA, 25 bp, Homo sapien
ttcgaagaaagcgtttttgccctga

SEQ ID NO: 418849 - DNA, 25 bp, Homo sapien
gaaagcgtttttgccctgaaagcgg

SEQ ID NO: 418850 - DNA, 25 bp, Homo sapien
gtttttgccctgaaagcggctgcag

SEQ ID NO: 418851 - DNA, 25 bp, Homo sapien
tttgccctgaaagcggctgcagctc

SEQ ID NO: 418852 - DNA, 25 bp, Homo sapien
ctcagtggaagctggaactgaaata

SEQ ID NO: 418853 - DNA, 25 bp, Homo sapien
gaagcattaacatggtacagtccta

SEQ ID NO: 418854 - DNA, 25 bp, Homo sapien
tggtacagtcctagcagatgagaga

SEQ ID NO: 418855 - DNA, 25 bp, Homo sapien
gagagaatgcttcattatctttgga

SEQ ID NO: 418856 - DNA, 25 bp, Homo sapien
gcttcattatctttggaggttggga

SEQ ID NO: 418857 - DNA, 25 bp, Homo sapien
atatgagggaccaggaagctttcct

SEQ ID NO: 418858 - DNA, 25 bp, Homo sapien
ggaagagcttacattatgacccaat

SEQ ID NO: 418859 - DNA, 25 bp, Homo sapien
tatgacccaacataacacatgtata

SEQ ID NO: 418860 - DNA, 25 bp, Homo sapien
acatgtatacacctatgtgcaatgt

SEQ ID NO: 418861 - DNA, 25 bp, Homo sapien
cacctatgtgcaatgtgtttataca

SEQ ID NO: 418862 - DNA, 25 bp, Homo sapien
taaaacagaacttagcatcagtatg

SEQ ID NO: 418863 - DNA, 25 bp, Homo sapien
tcagtatgcatagttctctgtaata

SEQ ID NO: 418864 - DNA, 25 bp, Homo sapien
ttttttctttcttagggcatctgta

SEQ ID NO: 418865 - DNA, 25 bp, Homo sapien
ttttctttcttagggcatctgtagg

SEQ ID NO: 418866 - DNA, 25 bp, Homo sapien
ttcttagggcatctgtaggcctcaa

SEQ ID NO: 418867 - DNA, 25 bp, Homo sapien
ttagggcatctgtaggcctcaaagg

SEQ ID NO: 418868 - DNA, 25 bp, Homo sapien
catctgtaggcctcaaaggaccttt

SEQ ID NO: 418869 - DNA, 25 bp, Homo sapien
tgtaggcctcaaaggacctttcctt

SEQ ID NO: 418870 - DNA, 25 bp, Homo sapien
ctttcctttaggtcatattcctcag

SEQ ID NO: 418871 - DNA, 25 bp, Homo sapien
taggtcatattcctcagaaagtctt

SEQ ID NO: 418872 - DNA, 25 bp, Homo sapien
tttagaagtataggctgtcgttggc

SEQ ID NO: 418873 - DNA, 25 bp, Homo sapien
ataggctgtcgttggcggcagcagt

SEQ ID NO: 418874 - DNA, 25 bp, Homo sapien
gcggcagcagtatattctgaaatgt

SEQ ID NO: 418875 - DNA, 25 bp, Homo sapien
ggagatcattccctaaaggtatgtg

SEQ ID NO: 418876 - DNA, 25 bp, Homo sapien
aaggtatgtgggttgtctgaagtca

SEQ ID NO: 418877 - DNA, 25 bp, Homo sapien
tatttacaaagtccttctacccact

SEQ ID NO: 418878 - DNA, 25 bp, Homo sapien
gtccttctacccactatcaaaaatg

SEQ ID NO: 418879 - DNA, 25 bp, Homo sapien
aaatgaactgatctgcattcagcag

SEQ ID NO: 418880 - DNA, 25 bp, Homo sapien
aaaattgcactgaaatgctgacaaa

SEQ ID NO: 418881 - DNA, 25 bp, Homo sapien
atgaagtggcttccaaaatatgcac

SEQ ID NO: 418882 - DNA, 25 bp, Homo sapien
ggcttccaaaatatgcactgatgtt

SEQ ID NO: 418883 - DNA, 25 bp, Homo sapien
gcactgatgttatcctttgtattta

SEQ ID NO: 418884 - DNA, 25 bp, Homo sapien
gtatttataggcacagttatcttac

SEQ ID NO: 418885 - DNA, 25 bp, Homo sapien
gttatcttactgaaaatgcatgcat

SEQ ID NO: 418886 - DNA, 25 bp, Homo sapien
tcagggcaccatgagggtgtacaga

SEQ ID NO: 418887 - DNA, 25 bp, Homo sapien
ggtgtacagatgtgctgtgtcctca

SEQ ID NO: 418888 - DNA, 25 bp, Homo sapien
aggtgccctcacttactgcctgggc

SEQ ID NO: 418889 - DNA, 25 bp, Homo sapien
gcagcctcaaggacaggcctttgtc

SEQ ID NO: 418890 - DNA, 25 bp, Homo sapien
aaggacaggcctttgtccctcacgg

SEQ ID NO: 418891 - DNA, 25 bp, Homo sapien
ttgtccctcacggttgtggacagga

SEQ ID NO: 418892 - DNA, 25 bp, Homo sapien
gttgtggacaggaggtcgcaccact

SEQ ID NO: 418893 - DNA, 25 bp, Homo sapien
acaggaggtcgcaccactggcctgc

SEQ ID NO: 418894 - DNA, 25 bp, Homo sapien
tggcttcccccagttatctgctaag

SEQ ID NO: 418895 - DNA, 25 bp, Homo sapien
atctgctaaggaaaactgtgctctt

SEQ ID NO: 418896 - DNA, 25 bp, Homo sapien
gctaaggaaaactgtgctcttcgaa

SEQ ID NO: 418897 - DNA, 25 bp, Homo sapien
gacatccagactgaggttcttgttc

SEQ ID NO: 418898 - DNA, 25 bp, Homo sapien
ttgtctctgactgggcatcagtgga

SEQ ID NO: 418899 - DNA, 25 bp, Homo sapien
tgaacccaaggaaaagcacgagcct

SEQ ID NO: 418900 - DNA, 25 bp, Homo sapien
aaagcacgagcctattgctcactta

SEQ ID NO: 418901 - DNA, 25 bp, Homo sapien
agcctattgctcacttactggatgg

SEQ ID NO: 418902 - DNA, 25 bp, Homo sapien
ttgctcacttactggatggacaaga

SEQ ID NO: 418903 - DNA, 25 bp, Homo sapien
agtgctacccactttgagttgcaca

SEQ ID NO: 418904 - DNA, 25 bp, Homo sapien
tttgagttgcacacctgaacccatg

SEQ ID NO: 418905 - DNA, 25 bp, Homo sapien
cagatacaggcccttcgctaggagt

SEQ ID NO: 418906 - DNA, 25 bp, Homo sapien
aggcccttcgctaggagtcatagtt

SEQ ID NO: 418907 - DNA, 25 bp, Homo sapien
ggagtcatagttttagattccataa

SEQ ID NO: 418908 - DNA, 25 bp, Homo sapien
gagacacatactttccaggctccgt

SEQ ID NO: 418909 - DNA, 25 bp, Homo sapien
atactttccaggctccgtgaagggt

SEQ ID NO: 418910 - DNA, 25 bp, Homo sapien
tttccaggctccgtgaagggtcgat

SEQ ID NO: 418911 - DNA, 25 bp, Homo sapien
gctccgtgaagggtcgattctccat

SEQ ID NO: 418912 - DNA, 25 bp, Homo sapien
ctggattcaccttcactaggtttga

SEQ ID NO: 418913 - DNA, 25 bp, Homo sapien
ctaggtttgacatgcactgggtccg

SEQ ID NO: 418914 - DNA, 25 bp, Homo sapien
tgggtccgccaagctacaggaaaag

SEQ ID NO: 418915 - DNA, 25 bp, Homo sapien
tgggtctcacttattggtcctgctg

SEQ ID NO: 418916 - DNA, 25 bp, Homo sapien
tcacttattggtcctgctggagaca

SEQ ID NO: 418917 - DNA, 25 bp, Homo sapien
ttattggtcctgctggagacacata

SEQ ID NO: 418918 - DNA, 25 bp, Homo sapien
ggtcctgctggagacacatactttc

SEQ ID NO: 418919 - DNA, 25 bp, Homo sapien
ccaagttatccaatcaaggtgatca

SEQ ID NO: 418920 - DNA, 25 bp, Homo sapien
gaaaggttctacttatagtcgacac

SEQ ID NO: 418921 - DNA, 25 bp, Homo sapien
agtcgacacaatgaattctctgagg

SEQ ID NO: 418922 - DNA, 25 bp, Homo sapien
ttctctgaggttgccaagacattga

SEQ ID NO: 418923 - DNA, 25 bp, Homo sapien
gaaagcctcaaagcctgtattcgct

SEQ ID NO: 418924 - DNA, 25 bp, Homo sapien
gtattcgctgtaattcacctgcaaa

SEQ ID NO: 418925 - DNA, 25 bp, Homo sapien
gattgctatttacaacgggcaacct

SEQ ID NO: 418926 - DNA, 25 bp, Homo sapien
ggcaacctgcaaacgagaaggctgt

SEQ ID NO: 418927 - DNA, 25 bp, Homo sapien
aaggctgtggatttgattattgtac

SEQ ID NO: 418928 - DNA, 25 bp, Homo sapien
aagactgttcagatggcaagctcct

SEQ ID NO: 418929 - DNA, 25 bp, Homo sapien
gatggcaagctcctcaaagccagtt

SEQ ID NO: 418930 - DNA, 25 bp, Homo sapien
ctgagaatctggagaaagttccatt

SEQ ID NO: 418931 - DNA, 25 bp, Homo sapien
gaaacaactctgtctgatgtcttct

SEQ ID NO: 418932 - DNA, 25 bp, Homo sapien
ctgatgtcttctgggatggccttaa

SEQ ID NO: 418933 - DNA, 25 bp, Homo sapien
gggatggccttaatacagatagcat

SEQ ID NO: 418934 - DNA, 25 bp, Homo sapien
cagatagcattgtctcttccatttc

SEQ ID NO: 418935 - DNA, 25 bp, Homo sapien
ctcttccatttctgataatgattgt

SEQ ID NO: 418936 - DNA, 25 bp, Homo sapien
gattgtttcagctgttcatctgctt

SEQ ID NO: 418937 - DNA, 25 bp, Homo sapien
ttggatgccatgtataatcaattgt

SEQ ID NO: 418938 - DNA, 25 bp, Homo sapien
taagcatgacacttgggacagtcca

SEQ ID NO: 418939 - DNA, 25 bp, Homo sapien
ttgggacagtccagcattcaaccca

SEQ ID NO: 418940 - DNA, 25 bp, Homo sapien
agcattcaacccaaccagacttttc

SEQ ID NO: 418941 - DNA, 25 bp, Homo sapien
cccacatagggtgcccagcgaagga

SEQ ID NO: 418942 - DNA, 25 bp, Homo sapien
acccaggactggatccgctttaaat

SEQ ID NO: 418943 - DNA, 25 bp, Homo sapien
atccgctttaaatgatcaaacgagc

SEQ ID NO: 418944 - DNA, 25 bp, Homo sapien
gatcaaacgagccttcgttcatctt

SEQ ID NO: 418945 - DNA, 25 bp, Homo sapien
cttcgttcatcttctctgtgacaag

SEQ ID NO: 418946 - DNA, 25 bp, Homo sapien
ctctgtgacaagagcaccctgccta

SEQ ID NO: 418947 - DNA, 25 bp, Homo sapien
accctgcctaccctgtttagagcaa

SEQ ID NO: 418948 - DNA, 25 bp, Homo sapien
cctaccctgtttagagcaactccag

SEQ ID NO: 418949 - DNA, 25 bp, Homo sapien
agagctcttcactctctagcatggg

SEQ ID NO: 418950 - DNA, 25 bp, Homo sapien
cactctctagcatgggttggtattt

SEQ ID NO: 418951 - DNA, 25 bp, Homo sapien
gttggtatttactaatcgattttgt

SEQ ID NO: 418952 - DNA, 25 bp, Homo sapien
aaaaggaataactacagccagaaat

SEQ ID NO: 418953 - DNA, 25 bp, Homo sapien
actacagccagaaataacttcattt

SEQ ID NO: 418954 - DNA, 25 bp, Homo sapien
gaaggggcttttctacacaggaata

SEQ ID NO: 418955 - DNA, 25 bp, Homo sapien
cacaggaatatattatcgggaacaa

SEQ ID NO: 418956 - DNA, 25 bp, Homo sapien
tatcgggaacaaagtatttcctgct

SEQ ID NO: 418957 - DNA, 25 bp, Homo sapien
ctgctgccttaactctttgggatgc

SEQ ID NO: 418958 - DNA, 25 bp, Homo sapien
ctgccttaactctttgggatgcata

SEQ ID NO: 418959 - DNA, 25 bp, Homo sapien
aactctttgggatgcataggataaa

SEQ ID NO: 418960 - DNA, 25 bp, Homo sapien
aagaccattttaatatcagaaaggg

SEQ ID NO: 418961 - DNA, 25 bp, Homo sapien
tcagaaagggttgtcttattaattt

SEQ ID NO: 418962 - DNA, 25 bp, Homo sapien
atggggagctcattcagaaactaaa

SEQ ID NO: 418963 - DNA, 25 bp, Homo sapien
ggaacctacaagctttttataacat

SEQ ID NO: 418964 - DNA, 25 bp, Homo sapien
gctttttataacatgctacgctcat

SEQ ID NO: 418965 - DNA, 25 bp, Homo sapien
aacatgctacgctcatatgaccttg

SEQ ID NO: 418966 - DNA, 25 bp, Homo sapien
catgctacgctcatatgaccttgga

SEQ ID NO: 418967 - DNA, 25 bp, Homo sapien
tacgctcatatgaccttggagacac

SEQ ID NO: 418968 - DNA, 25 bp, Homo sapien
cacagggcgcattggccgaaataat

SEQ ID NO: 418969 - DNA, 25 bp, Homo sapien
ggcgcattggccgaaataatttcaa

SEQ ID NO: 418970 - DNA, 25 bp, Homo sapien
gaaaatcatgcacgtcttctgtcca

SEQ ID NO: 418971 - DNA, 25 bp, Homo sapien
aaatcatgcacgtcttctgtccatt

SEQ ID NO: 418972 - DNA, 25 bp, Homo sapien
tcatgcacgtcttctgtccattttt

SEQ ID NO: 418973 - DNA, 25 bp, Homo sapien
catgatacaattactaggaacctac

SEQ ID NO: 418974 - DNA, 25 bp, Homo sapien
aagacgcaaggtagagagcaagaga

SEQ ID NO: 418975 - DNA, 25 bp, Homo sapien
tagaacaggatggagggcaagacct

SEQ ID NO: 418976 - DNA, 25 bp, Homo sapien
gggcaagacctgtgtaagaagaagt

SEQ ID NO: 418977 - DNA, 25 bp, Homo sapien
gaagaagtcttaaactgtaaacatg

SEQ ID NO: 418978 - DNA, 25 bp, Homo sapien
gtcttaaactgtaaacatgggtgta

SEQ ID NO: 418979 - DNA, 25 bp, Homo sapien
aactgtaaacatgggtgtagtgagg

SEQ ID NO: 418980 - DNA, 25 bp, Homo sapien
agtgtggctaagaggaaatggatcc

SEQ ID NO: 418981 - DNA, 25 bp, Homo sapien
aaatggatccagatgggcttgatgg

SEQ ID NO: 418982 - DNA, 25 bp, Homo sapien
gggctgcatctgaggtaaatggaaa

SEQ ID NO: 418983 - DNA, 25 bp, Homo sapien
ctgtggagttttgtgggagccttct

SEQ ID NO: 418984 - DNA, 25 bp, Homo sapien
ttttgtgggagccttcttgatggaa

SEQ ID NO: 418985 - DNA, 25 bp, Homo sapien
tgttgctggttctggaactggcaga

SEQ ID NO: 418986 - DNA, 25 bp, Homo sapien
gaactggcagaacaagtgattctca

SEQ ID NO: 418987 - DNA, 25 bp, Homo sapien
ataaaggcgtccaaatatgtccaag

SEQ ID NO: 418988 - DNA, 25 bp, Homo sapien
aaatatgtccaagcgcctctaataa

SEQ ID NO: 418989 - DNA, 25 bp, Homo sapien
gcctctaataatttctgctgcctaa

SEQ ID NO: 418990 - DNA, 25 bp, Homo sapien
tctgctgcctaaagcttatgtccac

SEQ ID NO: 418991 - DNA, 25 bp, Homo sapien
gagcatggccaggtgcaattccatc

SEQ ID NO: 418992 - DNA, 25 bp, Homo sapien
aattccatcagaccccggcgcaatg

SEQ ID NO: 418993 - DNA, 25 bp, Homo sapien
agtctcacctgctgggagctagagc

SEQ ID NO: 418994 - DNA, 25 bp, Homo sapien
gaactcacctctgcataaacactaa

SEQ ID NO: 418995 - DNA, 25 bp, Homo sapien
aacactaacattttgcctgcagttt

SEQ ID NO: 418996 - DNA, 25 bp, Homo sapien
attgtcctgttgagaatttttagat

SEQ ID NO: 418997 - DNA, 25 bp, Homo sapien
gaatttttagatctggactggaact

SEQ ID NO: 418998 - DNA, 25 bp, Homo sapien
ttttagatctggactggaactgcca

SEQ ID NO: 418999 - DNA, 25 bp, Homo sapien
gcctccagggagtcgctgggcacct

SEQ ID NO: 419000 - DNA, 25 bp, Homo sapien
ctgggcacctggaggtatcgtcgat

SEQ ID NO: 419001 - DNA, 25 bp, Homo sapien
gcacctggaggtatcgtcgatgcct

SEQ ID NO: 419002 - DNA, 25 bp, Homo sapien
acctggaggtatcgtcgatgcctct

SEQ ID NO: 419003 - DNA, 25 bp, Homo sapien
tggaggtatcgtcgatgcctctccc

SEQ ID NO: 419004 - DNA, 25 bp, Homo sapien
ttaggattgataagggtcccatgac

SEQ ID NO: 419005 - DNA, 25 bp, Homo sapien
ggtcccatgaccagcattatgaaaa

SEQ ID NO: 419006 - DNA, 25 bp, Homo sapien
tgaaagttagggttaggacatcctt

SEQ ID NO: 419007 - DNA, 25 bp, Homo sapien
aattttcatgtgctggcatgcttac

SEQ ID NO: 419008 - DNA, 25 bp, Homo sapien
gtgctggcatgcttacaagttaata

SEQ ID NO: 419009 - DNA, 25 bp, Homo sapien
agtgttatagaatgctcagctctca

SEQ ID NO: 419010 - DNA, 25 bp, Homo sapien
gaatgctcagctctcaatatgaggg

SEQ ID NO: 419011 - DNA, 25 bp, Homo sapien
ggttgtttgtggtgaattgcataac

SEQ ID NO: 419012 - DNA, 25 bp, Homo sapien
aacatatgtcatctatttgctgaaa

SEQ ID NO: 419013 - DNA, 25 bp, Homo sapien
gctgtttagcaaactacctgctgag

SEQ ID NO: 419014 - DNA, 25 bp, Homo sapien
acctgctgagcaacataataagatt

SEQ ID NO: 419015 - DNA, 25 bp, Homo sapien
ttttctatgatttcctaagaggcat

SEQ ID NO: 419016 - DNA, 25 bp, Homo sapien
agaggcattatcagggtcttacaga

SEQ ID NO: 419017 - DNA, 25 bp, Homo sapien
gatggagtaagcctgtttattaaaa

SEQ ID NO: 419018 - DNA, 25 bp, Homo sapien
acacctgcttctccatggaaaacag

SEQ ID NO: 419019 - DNA, 25 bp, Homo sapien
acctgcttctccatggaaaacagca

SEQ ID NO: 419020 - DNA, 25 bp, Homo sapien
gcttctccatggaaaacagcaactc

SEQ ID NO: 419021 - DNA, 25 bp, Homo sapien
tccatggaaaacagcaactccctgt

SEQ ID NO: 419022 - DNA, 25 bp, Homo sapien
tggaaaacagcaactccctgtatgt

SEQ ID NO: 419023 - DNA, 25 bp, Homo sapien
gacctgcagcggaagctgtacatgc

SEQ ID NO: 419024 - DNA, 25 bp, Homo sapien
gcagcggaagctgtacatgctcgag

SEQ ID NO: 419025 - DNA, 25 bp, Homo sapien
agcggaagctgtacatgctcgagct

SEQ ID NO: 419026 - DNA, 25 bp, Homo sapien
ggaagctgtacatgctcgagctgcg

SEQ ID NO: 419027 - DNA, 25 bp, Homo sapien
aagctgtacatgctcgagctgcggc

SEQ ID NO: 419028 - DNA, 25 bp, Homo sapien
gctgtacatgctcgagctgcggccc

SEQ ID NO: 419029 - DNA, 25 bp, Homo sapien
gggtgccctttaaaacagtctagag

SEQ ID NO: 419030 - DNA, 25 bp, Homo sapien
ggtgccctttaaaacagtctagagc

SEQ ID NO: 419031 - DNA, 25 bp, Homo sapien
gtgccctttaaaacagtctagagct

SEQ ID NO: 419032 - DNA, 25 bp, Homo sapien
tgccctttaaaacagtctagagctg

SEQ ID NO: 419033 - DNA, 25 bp, Homo sapien
gccctttaaaacagtctagagctgg

SEQ ID NO: 419034 - DNA, 25 bp, Homo sapien
tttaaaacagtctagagctgggccg

SEQ ID NO: 419035 - DNA, 25 bp, Homo sapien
ttaaaacagtctagagctgggccgg

SEQ ID NO: 419036 - DNA, 25 bp, Homo sapien
taaaacagtctagagctgggccggg

SEQ ID NO: 419037 - DNA, 25 bp, Homo sapien
aaaacagtctagagctgggccgggc

SEQ ID NO: 419038 - DNA, 25 bp, Homo sapien
aacagtctagagctgggccgggcgc

SEQ ID NO: 419039 - DNA, 25 bp, Homo sapien
acagtctagagctgggccgggcgcg

SEQ ID NO: 419040 - DNA, 25 bp, Homo sapien
cctaaagctgcatgctcagttgaag

SEQ ID NO: 419041 - DNA, 25 bp, Homo sapien
ggacgagaggacgaccttctctgat

SEQ ID NO: 419042 - DNA, 25 bp, Homo sapien
gaggacgaccttctctgatagagga

SEQ ID NO: 419043 - DNA, 25 bp, Homo sapien
cacgcttcagtcaaaggcatacaag

SEQ ID NO: 419044 - DNA, 25 bp, Homo sapien
caagtatctatctggacttccctgc

SEQ ID NO: 419045 - DNA, 25 bp, Homo sapien
tggcacttccaaacaagctcagaga

SEQ ID NO: 419046 - DNA, 25 bp, Homo sapien
atctgcccgggttcagtaccatgga

SEQ ID NO: 419047 - DNA, 25 bp, Homo sapien
tcgacccgctgtttacaaccatgac

SEQ ID NO: 419048 - DNA, 25 bp, Homo sapien
caaccatgaccccttggacactgga

SEQ ID NO: 419049 - DNA, 25 bp, Homo sapien
ttggacactggactgcatgcacttt

SEQ ID NO: 419050 - DNA, 25 bp, Homo sapien
gaattattgcataccatcttcatga

SEQ ID NO: 419051 - DNA, 25 bp, Homo sapien
gaaacttctcaagccaattcctgtg

SEQ ID NO: 419052 - DNA, 25 bp, Homo sapien
tctcaagccaattcctgtgtctttg

SEQ ID NO: 419053 - DNA, 25 bp, Homo sapien
tgtctttgagtatttttggtttatt

SEQ ID NO: 419054 - DNA, 25 bp, Homo sapien
gtatcgtaagatgttccaagctctc

SEQ ID NO: 419055 - DNA, 25 bp, Homo sapien
aagatgttccaagctctcattgtgc

SEQ ID NO: 419056 - DNA, 25 bp, Homo sapien
ttccaagctctcattgtgccttttt

SEQ ID NO: 419057 - DNA, 25 bp, Homo sapien
ttttgcctcagatctggaagcagcc

SEQ ID NO: 419058 - DNA, 25 bp, Homo sapien
tccagggtaccctagctccttttag

SEQ ID NO: 419059 - DNA, 25 bp, Homo sapien
taccctagctccttttagtattaat

SEQ ID NO: 419060 - DNA, 25 bp, Homo sapien
agctccttttagtattaatggtatt

SEQ ID NO: 419061 - DNA, 25 bp, Homo sapien
aaactaagatgtatgggttgggagc

SEQ ID NO: 419062 - DNA, 25 bp, Homo sapien
cacagcctagctgagtgcaaagaaa

SEQ ID NO: 419063 - DNA, 25 bp, Homo sapien
acagcctagctgagtgcaaagaaat

SEQ ID NO: 419064 - DNA, 25 bp, Homo sapien
agcctagctgagtgcaaagaaatat

SEQ ID NO: 419065 - DNA, 25 bp, Homo sapien
gcctagctgagtgcaaagaaatata

SEQ ID NO: 419066 - DNA, 25 bp, Homo sapien
gtgcaaagaaatataggatgcttag

SEQ ID NO: 419067 - DNA, 25 bp, Homo sapien
taggatgcttagaaagcatacagga

SEQ ID NO: 419068 - DNA, 25 bp, Homo sapien
tacctgagatcaggtggattacctg

SEQ ID NO: 419069 - DNA, 25 bp, Homo sapien
ggtggattacctggtctcgagacca

SEQ ID NO: 419070 - DNA, 25 bp, Homo sapien
gtggattacctggtctcgagaccag

SEQ ID NO: 419071 - DNA, 25 bp, Homo sapien
ggattacctggtctcgagaccagcc

SEQ ID NO: 419072 - DNA, 25 bp, Homo sapien
attacctggtctcgagaccagcctg

SEQ ID NO: 419073 - DNA, 25 bp, Homo sapien
ttgatcttcagggttgatagaatct

SEQ ID NO: 419074 - DNA, 25 bp, Homo sapien
ggcttaaatagcctcactgaatgag

SEQ ID NO: 419075 - DNA, 25 bp, Homo sapien
gagattatttacttaactgtgattg

SEQ ID NO: 419076 - DNA, 25 bp, Homo sapien
actgtgattgccctttctgtttcgg

SEQ ID NO: 419077 - DNA, 25 bp, Homo sapien
ttgccctttctgtttcggaattgac

SEQ ID NO: 419078 - DNA, 25 bp, Homo sapien
ctgtttcggaattgaccttgctaat

SEQ ID NO: 419079 - DNA, 25 bp, Homo sapien
ccttgctaatttttgaatcaggagc

SEQ ID NO: 419080 - DNA, 25 bp, Homo sapien
ggagcactgaaacagatctctaaat

SEQ ID NO: 419081 - DNA, 25 bp, Homo sapien
taaattttgaaggtctggctctagg

SEQ ID NO: 419082 - DNA, 25 bp, Homo sapien
ggattattttattagacatgccttc

SEQ ID NO: 419083 - DNA, 25 bp, Homo sapien
ttagacatgccttctgaaagattag

SEQ ID NO: 419084 - DNA, 25 bp, Homo sapien
acagcatgttggttcaggccctgaa

SEQ ID NO: 419085 - DNA, 25 bp, Homo sapien
gactggcttctgatggacaatgtta

SEQ ID NO: 419086 - DNA, 25 bp, Homo sapien
atgttaacttctgcaacccatcagt

SEQ ID NO: 419087 - DNA, 25 bp, Homo sapien
aacccatcagtgttggatcgtttga

SEQ ID NO: 419088 - DNA, 25 bp, Homo sapien
gttggatcgtttgaatgctttgctt

SEQ ID NO: 419089 - DNA, 25 bp, Homo sapien
aacccggaggtgtcctcactattag

SEQ ID NO: 419090 - DNA, 25 bp, Homo sapien
atgatagatggatccactcccacga

SEQ ID NO: 419091 - DNA, 25 bp, Homo sapien
ccacgataacaccaaatcccaattt

SEQ ID NO: 419092 - DNA, 25 bp, Homo sapien
aagcaccccagacaacctggatttg

SEQ ID NO: 419093 - DNA, 25 bp, Homo sapien
tttgaaagttctgctgcacagcctt

SEQ ID NO: 419094 - DNA, 25 bp, Homo sapien
gggaacagtgtatgtgacatcctct

SEQ ID NO: 419095 - DNA, 25 bp, Homo sapien
ttaattttgatcctgccctctccag

SEQ ID NO: 419096 - DNA, 25 bp, Homo sapien
gttacagaatcttaggtgccgtctc

SEQ ID NO: 419097 - DNA, 25 bp, Homo sapien
ttaggtgccgtctctagtctgtgag

SEQ ID NO: 419098 - DNA, 25 bp, Homo sapien
gtgagggaggaactcccagcatccc

SEQ ID NO: 419099 - DNA, 25 bp, Homo sapien
atccccattgcccacaaatggaatc

SEQ ID NO: 419100 - DNA, 25 bp, Homo sapien
tcctcactgtatccactaggagatt

SEQ ID NO: 419101 - DNA, 25 bp, Homo sapien
aggtttcttcactacttctatggta

SEQ ID NO: 419102 - DNA, 25 bp, Homo sapien
tagggttgtctgaaattccctttca

SEQ ID NO: 419103 - DNA, 25 bp, Homo sapien
aattccctttcaggctgtgggtact

SEQ ID NO: 419104 - DNA, 25 bp, Homo sapien
ctgtgggtactggtcttgggttcta

SEQ ID NO: 419105 - DNA, 25 bp, Homo sapien
actggtcttgggttctagtcataag

SEQ ID NO: 419106 - DNA, 25 bp, Homo sapien
gaagaaaatcgatatgcagccccag

SEQ ID NO: 419107 - DNA, 25 bp, Homo sapien
ccagcaccgattcatctcggataaa

SEQ ID NO: 419108 - DNA, 25 bp, Homo sapien
aatccctaggaggacatgttggtag

SEQ ID NO: 419109 - DNA, 25 bp, Homo sapien
gtcattgacacctattctaggattt

SEQ ID NO: 419110 - DNA, 25 bp, Homo sapien
taggattttattccccattgtgtat

SEQ ID NO: 419111 - DNA, 25 bp, Homo sapien
gatgcagttcaagctatggcctttg

SEQ ID NO: 419112 - DNA, 25 bp, Homo sapien
tatggcctttgatggttgttaccat

SEQ ID NO: 419113 - DNA, 25 bp, Homo sapien
tggttgttaccatgacagcgagatt

SEQ ID NO: 419114 - DNA, 25 bp, Homo sapien
tgacagcgagattgacatggaccag

SEQ ID NO: 419115 - DNA, 25 bp, Homo sapien
ttgacatggaccagacttccctctc

SEQ ID NO: 419116 - DNA, 25 bp, Homo sapien
ttccctctctctaaactcagaagac

SEQ ID NO: 419117 - DNA, 25 bp, Homo sapien
ctggttgtgtcaggctgtccctaga

SEQ ID NO: 419118 - DNA, 25 bp, Homo sapien
gtgtcaggctgtccctagagatcac

SEQ ID NO: 419119 - DNA, 25 bp, Homo sapien
aggctgtccctagagatcaccctga

SEQ ID NO: 419120 - DNA, 25 bp, Homo sapien
gctggaagcattggctagtagatga

SEQ ID NO: 419121 - DNA, 25 bp, Homo sapien
ggctagtagatgatcgaggctttct

SEQ ID NO: 419122 - DNA, 25 bp, Homo sapien
gatgatcgaggctttctataccacc

SEQ ID NO: 419123 - DNA, 25 bp, Homo sapien
tgatcgaggctttctataccaccac

SEQ ID NO: 419124 - DNA, 25 bp, Homo sapien
aggctttctataccaccaccaaggt

SEQ ID NO: 419125 - DNA, 25 bp, Homo sapien
tttctataccaccaccaaggtgtgt

SEQ ID NO: 419126 - DNA, 25 bp, Homo sapien
caccaaggtgtgtattttctcatca

SEQ ID NO: 419127 - DNA, 25 bp, Homo sapien
caaggtgtgtattttctcatcatcc

SEQ ID NO: 419128 - DNA, 25 bp, Homo sapien
gacgcaacaatagtcttagagccat

SEQ ID NO: 419129 - DNA, 25 bp, Homo sapien
aatagtcttagagccatgtgccagt

SEQ ID NO: 419130 - DNA, 25 bp, Homo sapien
agagccatgtgccagtgattataca

SEQ ID NO: 419131 - DNA, 25 bp, Homo sapien
gtgccagtgattatacaggtgattg

SEQ ID NO: 419132 - DNA, 25 bp, Homo sapien
tgattgtgcaaaactagtgtagtac

SEQ ID NO: 419133 - DNA, 25 bp, Homo sapien
aaacctacagttacatatcctattg

SEQ ID NO: 419134 - DNA, 25 bp, Homo sapien
tatcctattgataatggagtagcac

SEQ ID NO: 419135 - DNA, 25 bp, Homo sapien
atggagtagcactgtactattactg

SEQ ID NO: 419136 - DNA, 25 bp, Homo sapien
tactgttactctttctataaggtaa

SEQ ID NO: 419137 - DNA, 25 bp, Homo sapien
gccaaacaaagggtattcttagcca

SEQ ID NO: 419138 - DNA, 25 bp, Homo sapien
aagggtattcttagccaggagtggt

SEQ ID NO: 419139 - DNA, 25 bp, Homo sapien
cagattggatcacttgtgctggaaa

SEQ ID NO: 419140 - DNA, 25 bp, Homo sapien
attgacactaggttggcagcacgga

SEQ ID NO: 419141 - DNA, 25 bp, Homo sapien
atggtggttaaatgcttgggccctg

SEQ ID NO: 419142 - DNA, 25 bp, Homo sapien
ttgggccctggagcttgacagcctg

SEQ ID NO: 419143 - DNA, 25 bp, Homo sapien
tgacagcctggttttacattcttgc

SEQ ID NO: 419144 - DNA, 25 bp, Homo sapien
ctggttttacattcttgctgagcaa

SEQ ID NO: 419145 - DNA, 25 bp, Homo sapien
ttcttactttacaaggctgttgatg

SEQ ID NO: 419146 - DNA, 25 bp, Homo sapien
tacctggcacaaaagaactcggtct

SEQ ID NO: 419147 - DNA, 25 bp, Homo sapien
agaactcggtctacattagcttatg

SEQ ID NO: 419148 - DNA, 25 bp, Homo sapien
cattagcttatgttgttgctgttga

SEQ ID NO: 419149 - DNA, 25 bp, Homo sapien
gctgggactatagatattttacaca

SEQ ID NO: 419150 - DNA, 25 bp, Homo sapien
ttgagatattgagtgctacaagcat

SEQ ID NO: 419151 - DNA, 25 bp, Homo sapien
gtgctacaagcatttattttggttt

SEQ ID NO: 419152 - DNA, 25 bp, Homo sapien
ttggttttaccttaacatattatga

SEQ ID NO: 419153 - DNA, 25 bp, Homo sapien
catattatgattcctcagttttgtt

SEQ ID NO: 419154 - DNA, 25 bp, Homo sapien
aaaatgtcttcttacctttgatatt

SEQ ID NO: 419155 - DNA, 25 bp, Homo sapien
tatttataatcactcctcggtcatg

SEQ ID NO: 419156 - DNA, 25 bp, Homo sapien
aatcactcctcggtcatgtaaatag

SEQ ID NO: 419157 - DNA, 25 bp, Homo sapien
cctcggtcatgtaaatagtttgctt

SEQ ID NO: 419158 - DNA, 25 bp, Homo sapien
tttactgttttaaagtctgtgacct

SEQ ID NO: 419159 - DNA, 25 bp, Homo sapien
tttaaagtctgtgaccttacctgcc

SEQ ID NO: 419160 - DNA, 25 bp, Homo sapien
tgccctcttctgtagcaaagtgcag

SEQ ID NO: 419161 - DNA, 25 bp, Homo sapien
aacagaagtataacgggtgatccat

SEQ ID NO: 419162 - DNA, 25 bp, Homo sapien
aagtataacgggtgatccatgccca

SEQ ID NO: 419163 - DNA, 25 bp, Homo sapien
gtataacgggtgatccatgcccatc

SEQ ID NO: 419164 - DNA, 25 bp, Homo sapien
ataacgggtgatccatgcccatcca

SEQ ID NO: 419165 - DNA, 25 bp, Homo sapien
aacgggtgatccatgcccatccaaa

SEQ ID NO: 419166 - DNA, 25 bp, Homo sapien
cgggtgatccatgcccatccaaaag

SEQ ID NO: 419167 - DNA, 25 bp, Homo sapien
ggtgatccatgcccatccaaaagga

SEQ ID NO: 419168 - DNA, 25 bp, Homo sapien
ggtcaacaaattggcaaaatagtca

SEQ ID NO: 419169 - DNA, 25 bp, Homo sapien
acaaattggcaaaatagtcaaggtt

SEQ ID NO: 419170 - DNA, 25 bp, Homo sapien
aagaccgcaaaaatatccgtgaacg

SEQ ID NO: 419171 - DNA, 25 bp, Homo sapien
gaccgcaaaaatatccgtgaacgga

SEQ ID NO: 419172 - DNA, 25 bp, Homo sapien
atctcctccatgacgatgctggaga

SEQ ID NO: 419173 - DNA, 25 bp, Homo sapien
tgctggagaagctctcggacaccta

SEQ ID NO: 419174 - DNA, 25 bp, Homo sapien
tggagaagctctcggacacctacac

SEQ ID NO: 419175 - DNA, 25 bp, Homo sapien
agaagctctcggacacctacacctg

SEQ ID NO: 419176 - DNA, 25 bp, Homo sapien
ctgtatgtccttcacctgtttggag

SEQ ID NO: 419177 - DNA, 25 bp, Homo sapien
gtatgtccttcacctgtttggagaa

SEQ ID NO: 419178 - DNA, 25 bp, Homo sapien
gtccttcacctgtttggagaatgcc

SEQ ID NO: 419179 - DNA, 25 bp, Homo sapien
ttcacctgtttggagaatgcctgtt

SEQ ID NO: 419180 - DNA, 25 bp, Homo sapien
acctgtttggagaatgcctgttcat

SEQ ID NO: 419181 - DNA, 25 bp, Homo sapien
tggagaatgcctgttcattgccatc

SEQ ID NO: 419182 - DNA, 25 bp, Homo sapien
aatgcctgttcattgccatcaatgg

SEQ ID NO: 419183 - DNA, 25 bp, Homo sapien
ccacaaattatgcagactctgtgaa

SEQ ID NO: 419184 - DNA, 25 bp, Homo sapien
agaactccctgtttctgcgaatgaa

SEQ ID NO: 419185 - DNA, 25 bp, Homo sapien
cctttgatgattatggcatgacctg

SEQ ID NO: 419186 - DNA, 25 bp, Homo sapien
gatgattatggcatgacctgggtcc

SEQ ID NO: 419187 - DNA, 25 bp, Homo sapien
tgattatggcatgacctgggtccgc

SEQ ID NO: 419188 - DNA, 25 bp, Homo sapien
gattatggcatgacctgggtccgcc

SEQ ID NO: 419189 - DNA, 25 bp, Homo sapien
gctggagtgggtctctggtattaat

SEQ ID NO: 419190 - DNA, 25 bp, Homo sapien
tgggtctctggtattaattggaatg

SEQ ID NO: 419191 - DNA, 25 bp, Homo sapien
gtctctggtattaattggaatggtt

SEQ ID NO: 419192 - DNA, 25 bp, Homo sapien
gtattaattggaatggttgtaccac

SEQ ID NO: 419193 - DNA, 25 bp, Homo sapien
attggaatggttgtaccacaaatta

SEQ ID NO: 419194 - DNA, 25 bp, Homo sapien
gcagcaaatttcaaactgtatgcca

SEQ ID NO: 419195 - DNA, 25 bp, Homo sapien
atttcaaactgtatgccagacctgg

SEQ ID NO: 419196 - DNA, 25 bp, Homo sapien
ttcaaactgtatgccagacctggcc

SEQ ID NO: 419197 - DNA, 25 bp, Homo sapien
aaactgtatgccagacctggccctt

SEQ ID NO: 419198 - DNA, 25 bp, Homo sapien
tgtatgccagacctggccctttgca

SEQ ID NO: 419199 - DNA, 25 bp, Homo sapien
cctggccctttgcagagttaaaaga

SEQ ID NO: 419200 - DNA, 25 bp, Homo sapien
ctggccctttgcagagttaaaagaa

SEQ ID NO: 419201 - DNA, 25 bp, Homo sapien
ggccctttgcagagttaaaagaagc

SEQ ID NO: 419202 - DNA, 25 bp, Homo sapien
cctttgcagagttaaaagaagccag

SEQ ID NO: 419203 - DNA, 25 bp, Homo sapien
gaggtcaagggtttgaaaccagcgt

SEQ ID NO: 419204 - DNA, 25 bp, Homo sapien
caagggtttgaaaccagcgtggcca

SEQ ID NO: 419205 - DNA, 25 bp, Homo sapien
aaaatacttagttcaatgcctggct

SEQ ID NO: 419206 - DNA, 25 bp, Homo sapien
aatacttagttcaatgcctggctca

SEQ ID NO: 419207 - DNA, 25 bp, Homo sapien
tacttagttcaatgcctggctcata

SEQ ID NO: 419208 - DNA, 25 bp, Homo sapien
tagttcaatgcctggctcatagtaa

SEQ ID NO: 419209 - DNA, 25 bp, Homo sapien
tcaatgcctggctcatagtaagtgg

SEQ ID NO: 419210 - DNA, 25 bp, Homo sapien
aatgcctggctcatagtaagtggta

SEQ ID NO: 419211 - DNA, 25 bp, Homo sapien
gcctggctcatagtaagtggtaagt

SEQ ID NO: 419212 - DNA, 25 bp, Homo sapien
gctcatagtaagtggtaagtgctca

SEQ ID NO: 419213 - DNA, 25 bp, Homo sapien
gtaagtggtaagtgctcaccatatt

SEQ ID NO: 419214 - DNA, 25 bp, Homo sapien
aagtggtaagtgctcaccatatttt

SEQ ID NO: 419215 - DNA, 25 bp, Homo sapien
acatagaacatgtcttactttttca

SEQ ID NO: 419216 - DNA, 25 bp, Homo sapien
gacaatgaggaaatcagagtccaga

SEQ ID NO: 419217 - DNA, 25 bp, Homo sapien
gagtccagaatccatttcaacttag

SEQ ID NO: 419218 - DNA, 25 bp, Homo sapien
atttcaacttagcaaacatttactg

SEQ ID NO: 419219 - DNA, 25 bp, Homo sapien
gtctatattttgtttcggatactgg

SEQ ID NO: 419220 - DNA, 25 bp, Homo sapien
caaaaggaatttgcatctctgaact

SEQ ID NO: 419221 - DNA, 25 bp, Homo sapien
tcacagtcttgaacagggcaatcca

SEQ ID NO: 419222 - DNA, 25 bp, Homo sapien
agggcaatccaagttgtactgtaaa

SEQ ID NO: 419223 - DNA, 25 bp, Homo sapien
aatagtatgatcgagaactgggaaa

SEQ ID NO: 419224 - DNA, 25 bp, Homo sapien
gaaacagcctttgaatagataccca

SEQ ID NO: 419225 - DNA, 25 bp, Homo sapien
gcctttgaatagatacccattctgg

SEQ ID NO: 419226 - DNA, 25 bp, Homo sapien
tttaatgcaggaaagccaattggga

SEQ ID NO: 419227 - DNA, 25 bp, Homo sapien
ggaaaatatataccatgatctacag

SEQ ID NO: 419228 - DNA, 25 bp, Homo sapien
atataccatgatctacaggaacttg

SEQ ID NO: 419229 - DNA, 25 bp, Homo sapien
ataccatgatctacaggaacttggt

SEQ ID NO: 419230 - DNA, 25 bp, Homo sapien
tacaggaacttggtagtagtcaatc

SEQ ID NO: 419231 - DNA, 25 bp, Homo sapien
aggaacttggtagtagtcaatcagc

SEQ ID NO: 419232 - DNA, 25 bp, Homo sapien
gaacttggtagtagtcaatcagcag

SEQ ID NO: 419233 - DNA, 25 bp, Homo sapien
acttggtagtagtcaatcagcagga

SEQ ID NO: 419234 - DNA, 25 bp, Homo sapien
tggtagtagtcaatcagcaggaatc

SEQ ID NO: 419235 - DNA, 25 bp, Homo sapien
ggtagtagtcaatcagcaggaatca

SEQ ID NO: 419236 - DNA, 25 bp, Homo sapien
tcaatcagcaggaatcatcggactc

SEQ ID NO: 419237 - DNA, 25 bp, Homo sapien
caatcagcaggaatcatcggactca

SEQ ID NO: 419238 - DNA, 25 bp, Homo sapien
tctctcataagaccatattcccttt

SEQ ID NO: 419239 - DNA, 25 bp, Homo sapien
aaaagagtaagcttcaatatgtgaa

SEQ ID NO: 419240 - DNA, 25 bp, Homo sapien
gtaaataagtgtgtggccttcttta

SEQ ID NO: 419241 - DNA, 25 bp, Homo sapien
taagtgtgtggccttctttaaaata

SEQ ID NO: 419242 - DNA, 25 bp, Homo sapien
gccttctttaaaatagctggctaac

SEQ ID NO: 419243 - DNA, 25 bp, Homo sapien
gctggctaacataggaggcacttct

SEQ ID NO: 419244 - DNA, 25 bp, Homo sapien
acataggaggcacttcttttcataa

SEQ ID NO: 419245 - DNA, 25 bp, Homo sapien
ggaggcacttcttttcataaagaga

SEQ ID NO: 419246 - DNA, 25 bp, Homo sapien
ctctttatatgagctgtcccaccag

SEQ ID NO: 419247 - DNA, 25 bp, Homo sapien
tgtcccaccagcaacttatatatgt

SEQ ID NO: 419248 - DNA, 25 bp, Homo sapien
tgtgtgtaaacataaaagtccttta

SEQ ID NO: 419249 - DNA, 25 bp, Homo sapien
gaaacccaggttatttaatgtatat

SEQ ID NO: 419250 - DNA, 25 bp, Homo sapien
ggttgaacgatgagtttgtgcatga

SEQ ID NO: 419251 - DNA, 25 bp, Homo sapien
catttatattcgctgactctccttg

SEQ ID NO: 419252 - DNA, 25 bp, Homo sapien
cgctgactctccttggtggttttaa

SEQ ID NO: 419253 - DNA, 25 bp, Homo sapien
aaacctgtgtcccaaaagcctctgt

SEQ ID NO: 419254 - DNA, 25 bp, Homo sapien
gtcccaaaagcctctgtacagtgtg

SEQ ID NO: 419255 - DNA, 25 bp, Homo sapien
gcctctgtacagtgtgcatgatact

SEQ ID NO: 419256 - DNA, 25 bp, Homo sapien
ttgtgcatgagaactcaggtttcct

SEQ ID NO: 419257 - DNA, 25 bp, Homo sapien
tacaatttagtgcagagtctgtact

SEQ ID NO: 419258 - DNA, 25 bp, Homo sapien
ggtttcctaactcctgggtcaatat

SEQ ID NO: 419259 - DNA, 25 bp, Homo sapien
tgtgtatacttcagaaacccaggtt

SEQ ID NO: 419260 - DNA, 25 bp, Homo sapien
gcagcaaatttcaaactgtatgcca

SEQ ID NO: 419261 - DNA, 25 bp, Homo sapien
gcaaatttcaaactgtatgccagac

SEQ ID NO: 419262 - DNA, 25 bp, Homo sapien
aatttcaaactgtatgccagacctg

SEQ ID NO: 419263 - DNA, 25 bp, Homo sapien
atttcaaactgtatgccagacctgg

SEQ ID NO: 419264 - DNA, 25 bp, Homo sapien
tttcaaactgtatgccagacctggc

SEQ ID NO: 419265 - DNA, 25 bp, Homo sapien
ttcaaactgtatgccagacctggcc

SEQ ID NO: 419266 - DNA, 25 bp, Homo sapien
aaactgtatgccagacctggccctt

SEQ ID NO: 419267 - DNA, 25 bp, Homo sapien
aactgtatgccagacctggcccttt

SEQ ID NO: 419268 - DNA, 25 bp, Homo sapien
actgtatgccagacctggccctttg

SEQ ID NO: 419269 - DNA, 25 bp, Homo sapien
tgtatgccagacctggccctttgca

SEQ ID NO: 419270 - DNA, 25 bp, Homo sapien
gtatgccagacctggccctttgcag

SEQ ID NO: 419271 - DNA, 25 bp, Homo sapien
tacctgggaccagcttgaagtgcta

SEQ ID NO: 419272 - DNA, 25 bp, Homo sapien
accagcttgaagtgctatcctgaag

SEQ ID NO: 419273 - DNA, 25 bp, Homo sapien
gcagggccggccagaccctttttca

SEQ ID NO: 419274 - DNA, 25 bp, Homo sapien
tctgtatcccacacaggcatctggt

SEQ ID NO: 419275 - DNA, 25 bp, Homo sapien
tccaggtgtttctgtggcagttctg

SEQ ID NO: 419276 - DNA, 25 bp, Homo sapien
ggagctactgggtgattgcaagatt

SEQ ID NO: 419277 - DNA, 25 bp, Homo sapien
ctaagttgactttctatgtggtgcc

SEQ ID NO: 419278 - DNA, 25 bp, Homo sapien
agttgactttctatgtggtgcctga

SEQ ID NO: 419279 - DNA, 25 bp, Homo sapien
gactttctatgtggtgcctgaatga

SEQ ID NO: 419280 - DNA, 25 bp, Homo sapien
gtggtgcctgaatgacgttttcttt

SEQ ID NO: 419281 - DNA, 25 bp, Homo sapien
gttcagtaggaatccttttttatag

SEQ ID NO: 419282 - DNA, 25 bp, Homo sapien
ggaagatcatggctctcttttatgg

SEQ ID NO: 419283 - DNA, 25 bp, Homo sapien
gatcatggctctcttttatggcatt

SEQ ID NO: 419284 - DNA, 25 bp, Homo sapien
ggctctcttttatggcattgtcaca

SEQ ID NO: 419285 - DNA, 25 bp, Homo sapien
caacccattcatctacacattgaga

SEQ ID NO: 419286 - DNA, 25 bp, Homo sapien
gaaacaaggatgtgaaagctgccct

SEQ ID NO: 419287 - DNA, 25 bp, Homo sapien
aaggatgtgaaagctgccctgagaa

SEQ ID NO: 419288 - DNA, 25 bp, Homo sapien
tcttctacttcacagccatcagtat

SEQ ID NO: 419289 - DNA, 25 bp, Homo sapien
acttcacagccatcagtatgtatgt

SEQ ID NO: 419290 - DNA, 25 bp, Homo sapien
atcagtatgtatgtccagcctccct

SEQ ID NO: 419291 - DNA, 25 bp, Homo sapien
gtatgtatgtccagcctccctctag

SEQ ID NO: 419292 - DNA, 25 bp, Homo sapien
tccctctagctattctcatgaccgg

SEQ ID NO: 419293 - DNA, 25 bp, Homo sapien
ttattgcaaatgactcactttttgt

SEQ ID NO: 419294 - DNA, 25 bp, Homo sapien
aatgactcactttttgtgtggttcc

SEQ ID NO: 419295 - DNA, 25 bp, Homo sapien
tgactcactttttgtgtggttcctt

SEQ ID NO: 419296 - DNA, 25 bp, Homo sapien
actcactttttgtgtggttccttct

SEQ ID NO: 419297 - DNA, 25 bp, Homo sapien
cactttttgtgtggttccttctctc

SEQ ID NO: 419298 - DNA, 25 bp, Homo sapien
tttttccctcctatcgtcactttag

SEQ ID NO: 419299 - DNA, 25 bp, Homo sapien
tttccctcctatcgtcactttagaa

SEQ ID NO: 419300 - DNA, 25 bp, Homo sapien
tccctcctatcgtcactttagaagt

SEQ ID NO: 419301 - DNA, 25 bp, Homo sapien
cctcctatcgtcactttagaagtct

SEQ ID NO: 419302 - DNA, 25 bp, Homo sapien
tatcgtcactttagaagtctggcct

SEQ ID NO: 419303 - DNA, 25 bp, Homo sapien
tcgtcactttagaagtctggccttc

SEQ ID NO: 419304 - DNA, 25 bp, Homo sapien
gtaccaacaatacccaggcacagtc

SEQ ID NO: 419305 - DNA, 25 bp, Homo sapien
agtccccaaatccatgatctacaat

SEQ ID NO: 419306 - DNA, 25 bp, Homo sapien
aaatccatgatctacaatgtcgata

SEQ ID NO: 419307 - DNA, 25 bp, Homo sapien
tacaatgtcgatattcagccctcag

SEQ ID NO: 419308 - DNA, 25 bp, Homo sapien
caatgtcgatattcagccctcaggg

SEQ ID NO: 419309 - DNA, 25 bp, Homo sapien
gggtccctcatcgtttctctgagtc

SEQ ID NO: 419310 - DNA, 25 bp, Homo sapien
tcatcgtttctctgagtccaagtct

SEQ ID NO: 419311 - DNA, 25 bp, Homo sapien
gtttctctgagtccaagtctggcaa

SEQ ID NO: 419312 - DNA, 25 bp, Homo sapien
aagtctggcaatacggcctccaaga

SEQ ID NO: 419313 - DNA, 25 bp, Homo sapien
atgttgggcgttatgactatgtctc

SEQ ID NO: 419314 - DNA, 25 bp, Homo sapien
gactatgtctccgggtaccaacaat

SEQ ID NO: 419315 - DNA, 25 bp, Homo sapien
gtttttgtagttttgctctaacata

SEQ ID NO: 419316 - DNA, 25 bp, Homo sapien
gttttgctctaacataaatttctct

SEQ ID NO: 419317 - DNA, 25 bp, Homo sapien
tttgccacctccaaagttattatat

SEQ ID NO: 419318 - DNA, 25 bp, Homo sapien
attggtagcagaacgtgctagctga

SEQ ID NO: 419319 - DNA, 25 bp, Homo sapien
aactgcccaggtaagcaggacctga

SEQ ID NO: 419320 - DNA, 25 bp, Homo sapien
gttgaagagcagattgacacaggag

SEQ ID NO: 419321 - DNA, 25 bp, Homo sapien
gtgctagctgagaatacgttgtatt

SEQ ID NO: 419322 - DNA, 25 bp, Homo sapien
tacgttgtattctacatcactgata

SEQ ID NO: 419323 - DNA, 25 bp, Homo sapien
gataatgatctgaagtgtacaagtc

SEQ ID NO: 419324 - DNA, 25 bp, Homo sapien
gtgtacaagtcatcagtatcagatc

SEQ ID NO: 419325 - DNA, 25 bp, Homo sapien
cagtatcagatctatgagagttttt

SEQ ID NO: 419326 - DNA, 25 bp, Homo sapien
ggaaattaggaactgcttcctcatt

SEQ ID NO: 419327 - DNA, 25 bp, Homo sapien
aggaactgcttcctcatttaacaag

SEQ ID NO: 419328 - DNA, 25 bp, Homo sapien
tcagagagcccctgacgcctgcagg

SEQ ID NO: 419329 - DNA, 25 bp, Homo sapien
agaggagacaccgtctgtcttcaca

SEQ ID NO: 419330 - DNA, 25 bp, Homo sapien
gtctgtcttcacaaagtacgtcctc

SEQ ID NO: 419331 - DNA, 25 bp, Homo sapien
cagcctgacttatccagggacagag

SEQ ID NO: 419332 - DNA, 25 bp, Homo sapien
agagcagtagatgcctggcactcct

SEQ ID NO: 419333 - DNA, 25 bp, Homo sapien
tggcactcctcgatgcccagtgaaa

SEQ ID NO: 419334 - DNA, 25 bp, Homo sapien
atgcccagtgaaaccagactgtgct

SEQ ID NO: 419335 - DNA, 25 bp, Homo sapien
atgctcactggctcatttcttggga

SEQ ID NO: 419336 - DNA, 25 bp, Homo sapien
ctcatttcttgggagggcttagagc

SEQ ID NO: 419337 - DNA, 25 bp, Homo sapien
tggaagttgatccgccagtccccag

SEQ ID NO: 419338 - DNA, 25 bp, Homo sapien
attggcgaactcaatcatagtggct

SEQ ID NO: 419339 - DNA, 25 bp, Homo sapien
tggcgaactcaatcatagtggctgc

SEQ ID NO: 419340 - DNA, 25 bp, Homo sapien
gcgaactcaatcatagtggctgcac

SEQ ID NO: 419341 - DNA, 25 bp, Homo sapien
gaactcaatcatagtggctgcacct

SEQ ID NO: 419342 - DNA, 25 bp, Homo sapien
actcaatcatagtggctgcacctac

SEQ ID NO: 419343 - DNA, 25 bp, Homo sapien
ctcaatcatagtggctgcacctact

SEQ ID NO: 419344 - DNA, 25 bp, Homo sapien
aatcatagtggctgcacctactgca

SEQ ID NO: 419345 - DNA, 25 bp, Homo sapien
tcatagtggctgcacctactgcatt

SEQ ID NO: 419346 - DNA, 25 bp, Homo sapien
atagtggctgcacctactgcatttc

SEQ ID NO: 419347 - DNA, 25 bp, Homo sapien
agtggctgcacctactgcatttcgt

SEQ ID NO: 419348 - DNA, 25 bp, Homo sapien
catgggatcatttgagcttaaaaaa

SEQ ID NO: 419349 - DNA, 25 bp, Homo sapien
atgggatcatttgagcttaaaaaat

SEQ ID NO: 419350 - DNA, 25 bp, Homo sapien
tgggatcatttgagcttaaaaaata

SEQ ID NO: 419351 - DNA, 25 bp, Homo sapien
gggatcatttgagcttaaaaaatac

SEQ ID NO: 419352 - DNA, 25 bp, Homo sapien
tgagcttaaaaaatactgggggccg

SEQ ID NO: 419353 - DNA, 25 bp, Homo sapien
aaaatactgggggccgggcacagtg

SEQ ID NO: 419354 - DNA, 25 bp, Homo sapien
aaatactgggggccgggcacagtgg

SEQ ID NO: 419355 - DNA, 25 bp, Homo sapien
aatactgggggccgggcacagtggc

SEQ ID NO: 419356 - DNA, 25 bp, Homo sapien
gtgtggtgactcacagccgtaatcc

SEQ ID NO: 419357 - DNA, 25 bp, Homo sapien
tgactcacagccgtaatcccagcta

SEQ ID NO: 419358 - DNA, 25 bp, Homo sapien
actcacagccgtaatcccagctact

SEQ ID NO: 419359 - DNA, 25 bp, Homo sapien
ccagcacttcatgtttgcaccataa

SEQ ID NO: 419360 - DNA, 25 bp, Homo sapien
agatgatcaaattcccaattgacta

SEQ ID NO: 419361 - DNA, 25 bp, Homo sapien
aattcccaattgactatgtttcaag

SEQ ID NO: 419362 - DNA, 25 bp, Homo sapien
gactatgtttcaagcattcatttta

SEQ ID NO: 419363 - DNA, 25 bp, Homo sapien
aaaaatcattgttagtcctcttaat

SEQ ID NO: 419364 - DNA, 25 bp, Homo sapien
tagtcctcttaatatattttctcag

SEQ ID NO: 419365 - DNA, 25 bp, Homo sapien
tatcaattgggttcacaggctagct

SEQ ID NO: 419366 - DNA, 25 bp, Homo sapien
gggttcacaggctagctctcaaaaa

SEQ ID NO: 419367 - DNA, 25 bp, Homo sapien
ggctagctctcaaaaatctgtttaa

SEQ ID NO: 419368 - DNA, 25 bp, Homo sapien
tctgtttaacccactaatgtagcta

SEQ ID NO: 419369 - DNA, 25 bp, Homo sapien
gcagtggttctacaccaaaagcaca

SEQ ID NO: 419370 - DNA, 25 bp, Homo sapien
tttaacccagacgggcccggctgag

SEQ ID NO: 419371 - DNA, 25 bp, Homo sapien
ttaacccagacgggcccggctgagt

SEQ ID NO: 419372 - DNA, 25 bp, Homo sapien
taacccagacgggcccggctgagtg

SEQ ID NO: 419373 - DNA, 25 bp, Homo sapien
aacccagacgggcccggctgagtgt

SEQ ID NO: 419374 - DNA, 25 bp, Homo sapien
acccagacgggcccggctgagtgtg

SEQ ID NO: 419375 - DNA, 25 bp, Homo sapien
cccagacgggcccggctgagtgtgg

SEQ ID NO: 419376 - DNA, 25 bp, Homo sapien
ccagacgggcccggctgagtgtggt

SEQ ID NO: 419377 - DNA, 25 bp, Homo sapien
cagacgggcccggctgagtgtggtg

SEQ ID NO: 419378 - DNA, 25 bp, Homo sapien
agacgggcccggctgagtgtggtgg

SEQ ID NO: 419379 - DNA, 25 bp, Homo sapien
gacgggcccggctgagtgtggtggc

SEQ ID NO: 419380 - DNA, 25 bp, Homo sapien
acgggcccggctgagtgtggtggct

SEQ ID NO: 419381 - DNA, 25 bp, Homo sapien
aatggtgataccacagattacacag

SEQ ID NO: 419382 - DNA, 25 bp, Homo sapien
gataccacagattacacagactctg

SEQ ID NO: 419383 - DNA, 25 bp, Homo sapien
ctgtgaagggccgactctgcatctc

SEQ ID NO: 419384 - DNA, 25 bp, Homo sapien
tctggattcacttttgaagattctg

SEQ ID NO: 419385 - DNA, 25 bp, Homo sapien
aagggccgactctgcatctccagag

SEQ ID NO: 419386 - DNA, 25 bp, Homo sapien
ggccagaactccctgcatgtgcaga

SEQ ID NO: 419387 - DNA, 25 bp, Homo sapien
agaactccctgcatgtgcagatgaa

SEQ ID NO: 419388 - DNA, 25 bp, Homo sapien
gcatgtgcagatgaacagtctgaga

SEQ ID NO: 419389 - DNA, 25 bp, Homo sapien
attctgacatggagtgggtccgcca

SEQ ID NO: 419390 - DNA, 25 bp, Homo sapien
gacatggagtgggtccgccaacctc

SEQ ID NO: 419391 - DNA, 25 bp, Homo sapien
agtgggtcgctggtagtggtgtaaa

SEQ ID NO: 419392 - DNA, 25 bp, Homo sapien
gagaggaggaacattcttctatcat

SEQ ID NO: 419393 - DNA, 25 bp, Homo sapien
cattcttctatcatttcactcttac

SEQ ID NO: 419394 - DNA, 25 bp, Homo sapien
atcatttcactcttacctgtatatg

SEQ ID NO: 419395 - DNA, 25 bp, Homo sapien
atatgaagaatatacttacctcccc

SEQ ID NO: 419396 - DNA, 25 bp, Homo sapien
aatctggagtcccttctagttagtg

SEQ ID NO: 419397 - DNA, 25 bp, Homo sapien
gtcccttctagttagtgcattcagc

SEQ ID NO: 419398 - DNA, 25 bp, Homo sapien
gttagtgcattcagctcaaagccaa

SEQ ID NO: 419399 - DNA, 25 bp, Homo sapien
aaatgtgtcatcttctccaatacgt

SEQ ID NO: 419400 - DNA, 25 bp, Homo sapien
gtcatcttctccaatacgtgaatgt

SEQ ID NO: 419401 - DNA, 25 bp, Homo sapien
acgtgaatgtttgaattctcctgaa

SEQ ID NO: 419402 - DNA, 25 bp, Homo sapien
cccatatacacctacatgtgagggt

SEQ ID NO: 419403 - DNA, 25 bp, Homo sapien
gttgatcatttgtattagctttttg

SEQ ID NO: 419404 - DNA, 25 bp, Homo sapien
gatcatttgtattagctttttgaaa

SEQ ID NO: 419405 - DNA, 25 bp, Homo sapien
ttagctttttgaaattgctgaagac

SEQ ID NO: 419406 - DNA, 25 bp, Homo sapien
gaatttaaagctttaatctggtaga

SEQ ID NO: 419407 - DNA, 25 bp, Homo sapien
gctttaatctggtagaaacatctgt

SEQ ID NO: 419408 - DNA, 25 bp, Homo sapien
agaaacatctgtactctgattataa

SEQ ID NO: 419409 - DNA, 25 bp, Homo sapien
aaacatctgtactctgattataatt

SEQ ID NO: 419410 - DNA, 25 bp, Homo sapien
ctgtactctgattataattttctaa

SEQ ID NO: 419411 - DNA, 25 bp, Homo sapien
ataattgtattgcatgagtagatag

SEQ ID NO: 419412 - DNA, 25 bp, Homo sapien
ttgcatgagtagatagaagggaatt

SEQ ID NO: 419413 - DNA, 25 bp, Homo sapien
gaagggaattataggaagtcagaat

SEQ ID NO: 419414 - DNA, 25 bp, Homo sapien
gcacttactagttgtgtcaccgcgg

SEQ ID NO: 419415 - DNA, 25 bp, Homo sapien
ctagttgtgtcaccgcgggcagtta

SEQ ID NO: 419416 - DNA, 25 bp, Homo sapien
gcgggcagttactaacctctcagtg

SEQ ID NO: 419417 - DNA, 25 bp, Homo sapien
tcagtgcctgttccctcgtttgcaa

SEQ ID NO: 419418 - DNA, 25 bp, Homo sapien
ggatgatactagtacctatcttgta

SEQ ID NO: 419419 - DNA, 25 bp, Homo sapien
ctagtacctatcttgtagaattgtg

SEQ ID NO: 419420 - DNA, 25 bp, Homo sapien
aaaatgctctgttactgattagtct

SEQ ID NO: 419421 - DNA, 25 bp, Homo sapien
gattagtcttatcatccatatcatt

SEQ ID NO: 419422 - DNA, 25 bp, Homo sapien
catatcattatattaacctgtgttg

SEQ ID NO: 419423 - DNA, 25 bp, Homo sapien
ttaacctgtgttgtgatactggaat

SEQ ID NO: 419424 - DNA, 25 bp, Homo sapien
aaaaattatattgcctactatccca

SEQ ID NO: 419425 - DNA, 25 bp, Homo sapien
atctagcagaatgcctaggctaaca

SEQ ID NO: 419426 - DNA, 25 bp, Homo sapien
tccctcatctgttaatctattggca

SEQ ID NO: 419427 - DNA, 25 bp, Homo sapien
tctattggcatgtcacagaattatc

SEQ ID NO: 419428 - DNA, 25 bp, Homo sapien
cagaattatcatctggtaccagtga

SEQ ID NO: 419429 - DNA, 25 bp, Homo sapien
gtttgtatgacaactgttatttcaa

SEQ ID NO: 419430 - DNA, 25 bp, Homo sapien
tttcaatttatacagatgattcagg

SEQ ID NO: 419431 - DNA, 25 bp, Homo sapien
acatttggtcaggtgtaatgctcaa

SEQ ID NO: 419432 - DNA, 25 bp, Homo sapien
caataaattgagcattcgctgagat

SEQ ID NO: 419433 - DNA, 25 bp, Homo sapien
ttcgctgagattagtaaatgctgtt

SEQ ID NO: 419434 - DNA, 25 bp, Homo sapien
atgctgttatttcagtggattgcaa

SEQ ID NO: 419435 - DNA, 25 bp, Homo sapien
ggattgcaattatttaaagtctggt

SEQ ID NO: 419436 - DNA, 25 bp, Homo sapien
tgctggctgcataagggctaaggta

SEQ ID NO: 419437 - DNA, 25 bp, Homo sapien
ggctgcaatgaaacttggagatacg

SEQ ID NO: 419438 - DNA, 25 bp, Homo sapien
ggctttgcaaacaatgtttcctttg

SEQ ID NO: 419439 - DNA, 25 bp, Homo sapien
aatgtttcctttgttggtgtcttat

SEQ ID NO: 419440 - DNA, 25 bp, Homo sapien
gttggtgtcttattaaaagcattca

SEQ ID NO: 419441 - DNA, 25 bp, Homo sapien
aaaagcattcaaatgaggatttgct

SEQ ID NO: 419442 - DNA, 25 bp, Homo sapien
acaccattagaaactgtccagatgc

SEQ ID NO: 419443 - DNA, 25 bp, Homo sapien
attagaaactgtccagatgctggct

SEQ ID NO: 419444 - DNA, 25 bp, Homo sapien
gaaactgtccagatgctggctgcat

SEQ ID NO: 419445 - DNA, 25 bp, Homo sapien
aactgtccagatgctggctgcataa

SEQ ID NO: 419446 - DNA, 25 bp, Homo sapien
ccagatgctggctgcataagggcta

SEQ ID NO: 419447 - DNA, 25 bp, Homo sapien
gctgtgcagtggaagagcaacaaca

SEQ ID NO: 419448 - DNA, 25 bp, Homo sapien
ggaagagcaacaacagacaggtgac

SEQ ID NO: 419449 - DNA, 25 bp, Homo sapien
caacagacaggtgaccttcttgggt

SEQ ID NO: 419450 - DNA, 25 bp, Homo sapien
tgaccttcttgggttgtgcttcaca

SEQ ID NO: 419451 - DNA, 25 bp, Homo sapien
accttcttgggttgtgcttcacaat

SEQ ID NO: 419452 - DNA, 25 bp, Homo sapien
cttcttgggttgtgcttcacaatgg

SEQ ID NO: 419453 - DNA, 25 bp, Homo sapien
cttgggttgtgcttcacaatggact

SEQ ID NO: 419454 - DNA, 25 bp, Homo sapien
gttgtgcttcacaatggactgggaa

SEQ ID NO: 419455 - DNA, 25 bp, Homo sapien
ttggcgggactggtatgtcccagct

SEQ ID NO: 419456 - DNA, 25 bp, Homo sapien
gcgggactggtatgtcccagctaca

SEQ ID NO: 419457 - DNA, 25 bp, Homo sapien
ggactggtatgtcccagctacacgg

SEQ ID NO: 419458 - DNA, 25 bp, Homo sapien
tctggcctttgtgggcaccaaaagt

SEQ ID NO: 419459 - DNA, 25 bp, Homo sapien
tgggcaccaaaagtggcaagctgaa

SEQ ID NO: 419460 - DNA, 25 bp, Homo sapien
aagctgaagaagtccttcggcacag

SEQ ID NO: 419461 - DNA, 25 bp, Homo sapien
aagtccttcggcacaggtccacaag

SEQ ID NO: 419462 - DNA, 25 bp, Homo sapien
attgcttctcaggaacagatgctgt

SEQ ID NO: 419463 - DNA, 25 bp, Homo sapien
gtgtatcttcagtgctcaagtcaca

SEQ ID NO: 419464 - DNA, 25 bp, Homo sapien
tcaagtcacaaagcaatatcagatc

SEQ ID NO: 419465 - DNA, 25 bp, Homo sapien
aatatcagatcagagagtccagcct

SEQ ID NO: 419466 - DNA, 25 bp, Homo sapien
gagtccagcctctgctttgttgctt

SEQ ID NO: 419467 - DNA, 25 bp, Homo sapien
tttgttgcttcctaaatgtacctgg

SEQ ID NO: 419468 - DNA, 25 bp, Homo sapien
tgtacctgggaattcttcctaaaat

SEQ ID NO: 419469 - DNA, 25 bp, Homo sapien
gagcgttgactgtgttgacaatgaa

SEQ ID NO: 419470 - DNA, 25 bp, Homo sapien
gaggtcaatagccaaatgtttcaag

SEQ ID NO: 419471 - DNA, 25 bp, Homo sapien
ggcaagtcaggcaggtgcagaacaa

SEQ ID NO: 419472 - DNA, 25 bp, Homo sapien
caggcaggtgcagaacaacatgtaa

SEQ ID NO: 419473 - DNA, 25 bp, Homo sapien
actgaggctaagtgctgtgtggatc

SEQ ID NO: 419474 - DNA, 25 bp, Homo sapien
gtgtggatcccaagtatgtacctgt

SEQ ID NO: 419475 - DNA, 25 bp, Homo sapien
ggatcccaagtatgtacctgtaaaa

SEQ ID NO: 419476 - DNA, 25 bp, Homo sapien
agacacaaatacaagcctggaatca

SEQ ID NO: 419477 - DNA, 25 bp, Homo sapien
aagcctggaatcaacttctgcagtc

SEQ ID NO: 419478 - DNA, 25 bp, Homo sapien
gaatcaacttctgcagtctgacacc

SEQ ID NO: 419479 - DNA, 25 bp, Homo sapien
tctcttccaaccttgagtctcaaca

SEQ ID NO: 419480 - DNA, 25 bp, Homo sapien
ataagtttgcatatgttaattgaat

SEQ ID NO: 419481 - DNA, 25 bp, Homo sapien
cgttaagtgtgaagtagaatctgca

SEQ ID NO: 419482 - DNA, 25 bp, Homo sapien
atctgcagatcccttaagtcccata

SEQ ID NO: 419483 - DNA, 25 bp, Homo sapien
tctgcagatcccttaagtcccatat

SEQ ID NO: 419484 - DNA, 25 bp, Homo sapien
tgcagatcccttaagtcccatataa

SEQ ID NO: 419485 - DNA, 25 bp, Homo sapien
gcagatcccttaagtcccatataaa

SEQ ID NO: 419486 - DNA, 25 bp, Homo sapien
agatcccttaagtcccatataaatg

SEQ ID NO: 419487 - DNA, 25 bp, Homo sapien
gatcccttaagtcccatataaatga

SEQ ID NO: 419488 - DNA, 25 bp, Homo sapien
tttagaatgttgataatggccaggt

SEQ ID NO: 419489 - DNA, 25 bp, Homo sapien
gtaagtcaggttcttaactctctta

SEQ ID NO: 419490 - DNA, 25 bp, Homo sapien
taagtcaggttcttaactctcttaa

SEQ ID NO: 419491 - DNA, 25 bp, Homo sapien
gctgtgcagtggaagagcaacaaca

SEQ ID NO: 419492 - DNA, 25 bp, Homo sapien
ggaagagcaacaacagacaggtgac

SEQ ID NO: 419493 - DNA, 25 bp, Homo sapien
caacagacaggtgaccttcttgggt

SEQ ID NO: 419494 - DNA, 25 bp, Homo sapien
tgaccttcttgggttgtgcttcaca

SEQ ID NO: 419495 - DNA, 25 bp, Homo sapien
accttcttgggttgtgcttcacaat

SEQ ID NO: 419496 - DNA, 25 bp, Homo sapien
cttgggttgtgcttcacaatggact

SEQ ID NO: 419497 - DNA, 25 bp, Homo sapien
gttgtgcttcacaatggactgggaa

SEQ ID NO: 419498 - DNA, 25 bp, Homo sapien
gggaaaaacatctttgaaatcagga

SEQ ID NO: 419499 - DNA, 25 bp, Homo sapien
aaatcaggaaatcaggccgggcgca

SEQ ID NO: 419500 - DNA, 25 bp, Homo sapien
ttggcgggactggtatgtcccagct

SEQ ID NO: 419501 - DNA, 25 bp, Homo sapien
ggactggtatgtcccagctacacgg

SEQ ID NO: 419502 - DNA, 25 bp, Homo sapien
gatgatctgcttaagagtcttcata

SEQ ID NO: 419503 - DNA, 25 bp, Homo sapien
aagagtcttcatattctgaactcga

SEQ ID NO: 419504 - DNA, 25 bp, Homo sapien
attctgaactcgaaaggccttttat

SEQ ID NO: 419505 - DNA, 25 bp, Homo sapien
ggccttttatgttatattattgctc

SEQ ID NO: 419506 - DNA, 25 bp, Homo sapien
attattgctcgctttacgcaactcc

SEQ ID NO: 419507 - DNA, 25 bp, Homo sapien
acgcaactccaaattgctttcctat

SEQ ID NO: 419508 - DNA, 25 bp, Homo sapien
gaatgttcttctagtaaactggtgt

SEQ ID NO: 419509 - DNA, 25 bp, Homo sapien
gcttcaccttggtaaactgaactca

SEQ ID NO: 419510 - DNA, 25 bp, Homo sapien
tttccctcccttaaaatggcatagc

SEQ ID NO: 419511 - DNA, 25 bp, Homo sapien
gcatagctgagaaagccccggtact

SEQ ID NO: 419512 - DNA, 25 bp, Homo sapien
aagccccggtactactaattgagat

SEQ ID NO: 419513 - DNA, 25 bp, Homo sapien
agcatctgaagatagccaaggacct

SEQ ID NO: 419514 - DNA, 25 bp, Homo sapien
agaggcccgggcttatagcaacctg

SEQ ID NO: 419515 - DNA, 25 bp, Homo sapien
ttatagcaacctgggcagtgcctat

SEQ ID NO: 419516 - DNA, 25 bp, Homo sapien
gcagtgcctatcactaccggaggaa

SEQ ID NO: 419517 - DNA, 25 bp, Homo sapien
atcactaccggaggaactttgacaa

SEQ ID NO: 419518 - DNA, 25 bp, Homo sapien
tttgacaaggccatgtcttaccata

SEQ ID NO: 419519 - DNA, 25 bp, Homo sapien
ggccatgtcttaccataactatgtc

SEQ ID NO: 419520 - DNA, 25 bp, Homo sapien
taactatgtcctggagctggcacag

SEQ ID NO: 419521 - DNA, 25 bp, Homo sapien
ggctattgagatgcgggcctatgct

SEQ ID NO: 419522 - DNA, 25 bp, Homo sapien
gagatgcgggcctatgctggactag

SEQ ID NO: 419523 - DNA, 25 bp, Homo sapien
atgctgccaggtgcatgcaggattt

SEQ ID NO: 419524 - DNA, 25 bp, Homo sapien
agatccaggtaatctctgccactaa

SEQ ID NO: 419525 - DNA, 25 bp, Homo sapien
tccaggtaatctctgccactaatca

SEQ ID NO: 419526 - DNA, 25 bp, Homo sapien
gaagggcacaggcattaatgcacag

SEQ ID NO: 419527 - DNA, 25 bp, Homo sapien
aggcattaatgcacagacaacaggc

SEQ ID NO: 419528 - DNA, 25 bp, Homo sapien
acaacaggcatagcagccgtgacaa

SEQ ID NO: 419529 - DNA, 25 bp, Homo sapien
acaggcatagcagccgtgacaaaag

SEQ ID NO: 419530 - DNA, 25 bp, Homo sapien
agccgtgacaaaagctgcaggaaag

SEQ ID NO: 419531 - DNA, 25 bp, Homo sapien
aagctgcaggaaagggtgttaccca

SEQ ID NO: 419532 - DNA, 25 bp, Homo sapien
aagggtgttacccacatctgagttg

SEQ ID NO: 419533 - DNA, 25 bp, Homo sapien
gggtgttacccacatctgagttgtg

SEQ ID NO: 419534 - DNA, 25 bp, Homo sapien
gttacccacatctgagttgtggtga

SEQ ID NO: 419535 - DNA, 25 bp, Homo sapien
gagcattttcccctgaccctggagt

SEQ ID NO: 419536 - DNA, 25 bp, Homo sapien
cagcagtgaactccgggacggccta

SEQ ID NO: 419537 - DNA, 25 bp, Homo sapien
tcatccactattcctatggagttaa

SEQ ID NO: 419538 - DNA, 25 bp, Homo sapien
attcctatggagttaattccacaga

SEQ ID NO: 419539 - DNA, 25 bp, Homo sapien
ttccacagagaagggagatctttcc

SEQ ID NO: 419540 - DNA, 25 bp, Homo sapien
aagggagatctttcctctgagtcaa

SEQ ID NO: 419541 - DNA, 25 bp, Homo sapien
ggagatctttcctctgagtcaacag

SEQ ID NO: 419542 - DNA, 25 bp, Homo sapien
tttcctctgagtcaacagtctccag

SEQ ID NO: 419543 - DNA, 25 bp, Homo sapien
gagtcaacagtctccagaataagga

SEQ ID NO: 419544 - DNA, 25 bp, Homo sapien
gaataaggacggagcattttcccct

SEQ ID NO: 419545 - DNA, 25 bp, Homo sapien
taaggacggagcattttcccctgac

SEQ ID NO: 419546 - DNA, 25 bp, Homo sapien
catgtaagagtttgtgttcttgttc

SEQ ID NO: 419547 - DNA, 25 bp, Homo sapien
tttcactcttacacactctaaaaga

SEQ ID NO: 419548 - DNA, 25 bp, Homo sapien
cttctgcaaagccatcaaccaaaga

SEQ ID NO: 419549 - DNA, 25 bp, Homo sapien
gaggatgagagagcccttgactagt

SEQ ID NO: 419550 - DNA, 25 bp, Homo sapien
cctggagcttaagtaatatgatgtc

SEQ ID NO: 419551 - DNA, 25 bp, Homo sapien
aatatgatgtcaccctgtttactac

SEQ ID NO: 419552 - DNA, 25 bp, Homo sapien
tgatgtcaccctgtttactacacaa

SEQ ID NO: 419553 - DNA, 25 bp, Homo sapien
caaatttacattggtattttggcca

SEQ ID NO: 419554 - DNA, 25 bp, Homo sapien
tctaatttcctacttgccattgttc

SEQ ID NO: 419555 - DNA, 25 bp, Homo sapien
tcctacttgccattgttctacttat

SEQ ID NO: 419556 - DNA, 25 bp, Homo sapien
ttatataaatctccttcagaggcca

SEQ ID NO: 419557 - DNA, 25 bp, Homo sapien
caggagactccagtgctgtggacat

SEQ ID NO: 419558 - DNA, 25 bp, Homo sapien
ccagtgctgtggacatgggtctgaa

SEQ ID NO: 419559 - DNA, 25 bp, Homo sapien
gggtctgaacgaattgatcacctag

SEQ ID NO: 419560 - DNA, 25 bp, Homo sapien
actgagaacgcggtgctctgtaagt

SEQ ID NO: 419561 - DNA, 25 bp, Homo sapien
aacgcggtgctctgtaagtatccat

SEQ ID NO: 419562 - DNA, 25 bp, Homo sapien
tccatggatgcacagcgcagacgcg

SEQ ID NO: 419563 - DNA, 25 bp, Homo sapien
gcgcagacgcggaaagggatcccca

SEQ ID NO: 419564 - DNA, 25 bp, Homo sapien
aagggatccccagaatgttccttct

SEQ ID NO: 419565 - DNA, 25 bp, Homo sapien
ccccagaatgttccttctgttgctg

SEQ ID NO: 419566 - DNA, 25 bp, Homo sapien
atgcattttccatgagtctttaact

SEQ ID NO: 419567 - DNA, 25 bp, Homo sapien
tttccatgagtctttaacttagtat

SEQ ID NO: 419568 - DNA, 25 bp, Homo sapien
acccgtcgcaaatgccttggcgatt

SEQ ID NO: 419569 - DNA, 25 bp, Homo sapien
ttggcgattgaagatccgcacggcg

SEQ ID NO: 419570 - DNA, 25 bp, Homo sapien
atcacggtgttccaatcgtcgaagg

SEQ ID NO: 419571 - DNA, 25 bp, Homo sapien
tccaatcgtcgaaggtcatgtcaac

SEQ ID NO: 419572 - DNA, 25 bp, Homo sapien
aggtcatgtcaaccaaattggcgtc

SEQ ID NO: 419573 - DNA, 25 bp, Homo sapien
aattggcgtcttttgcaggcccgaa

SEQ ID NO: 419574 - DNA, 25 bp, Homo sapien
gaattggccaccaaaatgtccaggt

SEQ ID NO: 419575 - DNA, 25 bp, Homo sapien
gtctgggcgaacaggcgctccacgt

SEQ ID NO: 419576 - DNA, 25 bp, Homo sapien
gcgctccacgttcggtttctttgga

SEQ ID NO: 419577 - DNA, 25 bp, Homo sapien
ttctttggaaacttcacgccgatgg

SEQ ID NO: 419578 - DNA, 25 bp, Homo sapien
aaacttcacgccgatggcaattgcc

SEQ ID NO: 419579 - DNA, 25 bp, Homo sapien
aacagaagtataacgggtgatccat

SEQ ID NO: 419580 - DNA, 25 bp, Homo sapien
aagtataacgggtgatccatgccca

SEQ ID NO: 419581 - DNA, 25 bp, Homo sapien
gtataacgggtgatccatgcccatc

SEQ ID NO: 419582 - DNA, 25 bp, Homo sapien
taacgggtgatccatgcccatccaa

SEQ ID NO: 419583 - DNA, 25 bp, Homo sapien
cgggtgatccatgcccatccaaaag

SEQ ID NO: 419584 - DNA, 25 bp, Homo sapien
ggtgatccatgcccatccaaaagga

SEQ ID NO: 419585 - DNA, 25 bp, Homo sapien
gaagttcaggttgtacgaggacact

SEQ ID NO: 419586 - DNA, 25 bp, Homo sapien
ggtcaacaaattggcaaaatagtca

SEQ ID NO: 419587 - DNA, 25 bp, Homo sapien
ctatctacattgaacgggtgcagcg

SEQ ID NO: 419588 - DNA, 25 bp, Homo sapien
aagaccgcaaaaatatccgtgaacg

SEQ ID NO: 419589 - DNA, 25 bp, Homo sapien
gaccgcaaaaatatccgtgaacgga

SEQ ID NO: 419590 - DNA, 25 bp, Homo sapien
gtgcacgcggtggatgctctgcttc

SEQ ID NO: 419591 - DNA, 25 bp, Homo sapien
gcacgcggtggatgctctgcttcag

SEQ ID NO: 419592 - DNA, 25 bp, Homo sapien
cgcggtggatgctctgcttcagctg

SEQ ID NO: 419593 - DNA, 25 bp, Homo sapien
acctgctcgtgcatctccagggcgc

SEQ ID NO: 419594 - DNA, 25 bp, Homo sapien
tccagggcgcccatgctgttgcaat

SEQ ID NO: 419595 - DNA, 25 bp, Homo sapien
gggcgcccatgctgttgcaatggtt

SEQ ID NO: 419596 - DNA, 25 bp, Homo sapien
gcgcccatgctgttgcaatggttca

SEQ ID NO: 419597 - DNA, 25 bp, Homo sapien
agaacttcgcctgcaacaagagtag

SEQ ID NO: 419598 - DNA, 25 bp, Homo sapien
aacttcgcctgcaacaagagtagga

SEQ ID NO: 419599 - DNA, 25 bp, Homo sapien
cttcgcctgcaacaagagtaggaga

SEQ ID NO: 419600 - DNA, 25 bp, Homo sapien
tggaggtggtcacctagccctcggc

SEQ ID NO: 419601 - DNA, 25 bp, Homo sapien
atgactacttcacatcctttaactc

SEQ ID NO: 419602 - DNA, 25 bp, Homo sapien
acatcctttaactcttcctacagaa

SEQ ID NO: 419603 - DNA, 25 bp, Homo sapien
aagtttgcacagttctagacacgat

SEQ ID NO: 419604 - DNA, 25 bp, Homo sapien
acacaactcagaaaatgtcccttaa

SEQ ID NO: 419605 - DNA, 25 bp, Homo sapien
ttgagccattggtacttgtgaatta

SEQ ID NO: 419606 - DNA, 25 bp, Homo sapien
gagacatctatgttctgatccactg

SEQ ID NO: 419607 - DNA, 25 bp, Homo sapien
tctgatccactgttgaaagctgtac

SEQ ID NO: 419608 - DNA, 25 bp, Homo sapien
gaaagctgtacaatgttacctattt

SEQ ID NO: 419609 - DNA, 25 bp, Homo sapien
gttacctatttatttgcagacatcc

SEQ ID NO: 419610 - DNA, 25 bp, Homo sapien
ttatttgcagacatcctttggaaac

SEQ ID NO: 419611 - DNA, 25 bp, Homo sapien
ggagtacagctgctgacattacctt

SEQ ID NO: 419612 - DNA, 25 bp, Homo sapien
gggctttcatcgattggttaccttg

SEQ ID NO: 419613 - DNA, 25 bp, Homo sapien
gattatgcccgaagatcaggacgtt

SEQ ID NO: 419614 - DNA, 25 bp, Homo sapien
ttggccagcacatcaaaggcttcgc

SEQ ID NO: 419615 - DNA, 25 bp, Homo sapien
atcaggacgtttgcccgatcatgtc

SEQ ID NO: 419616 - DNA, 25 bp, Homo sapien
gttcgccagtgcatccagggtaaaa

SEQ ID NO: 419617 - DNA, 25 bp, Homo sapien
gatcaaatccatgcccggttcaaga

SEQ ID NO: 419618 - DNA, 25 bp, Homo sapien
ttcaagaaaaccctggcgctcggca

SEQ ID NO: 419619 - DNA, 25 bp, Homo sapien
aggcttcgcccttgacgatacgtaa

SEQ ID NO: 419620 - DNA, 25 bp, Homo sapien
tacgtaacctgagttgttcggcttc

SEQ ID NO: 419621 - DNA, 25 bp, Homo sapien
ttcctcggcggtcttgaccaggata

SEQ ID NO: 419622 - DNA, 25 bp, Homo sapien
gatatgacgggcttgggctttcatc

SEQ ID NO: 419623 - DNA, 25 bp, Homo sapien
gaaagccctggaaaactgcaagtgg

SEQ ID NO: 419624 - DNA, 25 bp, Homo sapien
gcaagtggtggtttaatgatcccag

SEQ ID NO: 419625 - DNA, 25 bp, Homo sapien
gtttaatgatcccagtgagtgactg

SEQ ID NO: 419626 - DNA, 25 bp, Homo sapien
ctggaatggcagtttggtgcagata

SEQ ID NO: 419627 - DNA, 25 bp, Homo sapien
ggtgcagataagacggactagatcc

SEQ ID NO: 419628 - DNA, 25 bp, Homo sapien
gactagatccgtggaaacacgcgcc

SEQ ID NO: 419629 - DNA, 25 bp, Homo sapien
atccgtggaaacacgcgcccgcatg

SEQ ID NO: 419630 - DNA, 25 bp, Homo sapien
aaggacagcctgtcggaatctccca

SEQ ID NO: 419631 - DNA, 25 bp, Homo sapien
gaatctcccaggcacgtggtcctgt

SEQ ID NO: 419632 - DNA, 25 bp, Homo sapien
taaattctgttaattctgtttgaaa

SEQ ID NO: 419633 - DNA, 25 bp, Homo sapien
gggcatatacttcctagtagaacaa

SEQ ID NO: 419634 - DNA, 25 bp, Homo sapien
ggtttccaggtggagctcaggaatc

SEQ ID NO: 419635 - DNA, 25 bp, Homo sapien
tccaggtggagctcaggaatcctag

SEQ ID NO: 419636 - DNA, 25 bp, Homo sapien
gagctcaggaatcctaggaatctgt

SEQ ID NO: 419637 - DNA, 25 bp, Homo sapien
gaatcctaggaatctgtagtattct

SEQ ID NO: 419638 - DNA, 25 bp, Homo sapien
gtagtattctagacaaggagcaaag

SEQ ID NO: 419639 - DNA, 25 bp, Homo sapien
agacttggatgggtatatccccttg

SEQ ID NO: 419640 - DNA, 25 bp, Homo sapien
ttggatgggtatatccccttggcac

SEQ ID NO: 419641 - DNA, 25 bp, Homo sapien
gggtatatccccttggcactgcaga

SEQ ID NO: 419642 - DNA, 25 bp, Homo sapien
ttggcactgcagactctctagcctg

SEQ ID NO: 419643 - DNA, 25 bp, Homo sapien
cactgcagactctctagcctgtggg

SEQ ID NO: 419644 - DNA, 25 bp, Homo sapien
gggatgtacgcagcaaactccccac

SEQ ID NO: 419645 - DNA, 25 bp, Homo sapien
gaaacaatgcaagtgagaagccatt

SEQ ID NO: 419646 - DNA, 25 bp, Homo sapien
gtgagaagccattggagctgcattt

SEQ ID NO: 419647 - DNA, 25 bp, Homo sapien
agaagccattggagctgcattttaa

SEQ ID NO: 419648 - DNA, 25 bp, Homo sapien
aaattgccaatcttgaattctgttc

SEQ ID NO: 419649 - DNA, 25 bp, Homo sapien
attgccaatcttgaattctgttccc

SEQ ID NO: 419650 - DNA, 25 bp, Homo sapien
gccaatcttgaattctgttcccagt

SEQ ID NO: 419651 - DNA, 25 bp, Homo sapien
aatcttgaattctgttcccagtgaa

SEQ ID NO: 419652 - DNA, 25 bp, Homo sapien
gaattctgttcccagtgaaaatatt

SEQ ID NO: 419653 - DNA, 25 bp, Homo sapien
agacttttttcagattggaaaagca

SEQ ID NO: 419654 - DNA, 25 bp, Homo sapien
ggaaaagcaattccatcaagtgaat

SEQ ID NO: 419655 - DNA, 25 bp, Homo sapien
agcaattccatcaagtgaatatatt

SEQ ID NO: 419656 - DNA, 25 bp, Homo sapien
gcccagccttattttcttgactcat

SEQ ID NO: 419657 - DNA, 25 bp, Homo sapien
cccagccttattttcttgactcata

SEQ ID NO: 419658 - DNA, 25 bp, Homo sapien
ccagccttattttcttgactcatag

SEQ ID NO: 419659 - DNA, 25 bp, Homo sapien
cagccttattttcttgactcatagg

SEQ ID NO: 419660 - DNA, 25 bp, Homo sapien
agccttattttcttgactcatagga

SEQ ID NO: 419661 - DNA, 25 bp, Homo sapien
gccttattttcttgactcataggaa

SEQ ID NO: 419662 - DNA, 25 bp, Homo sapien
cttattttcttgactcataggaata

SEQ ID NO: 419663 - DNA, 25 bp, Homo sapien
gactcataggaataaatatgtctag

SEQ ID NO: 419664 - DNA, 25 bp, Homo sapien
atacttactgaattaagattacagc

SEQ ID NO: 419665 - DNA, 25 bp, Homo sapien
ttgatgtcttatttgttaaagggcc

SEQ ID NO: 419666 - DNA, 25 bp, Homo sapien
taaagggccaagtagaataaagact

SEQ ID NO: 419667 - DNA, 25 bp, Homo sapien
agcctccctataatcctaggcaagg

SEQ ID NO: 419668 - DNA, 25 bp, Homo sapien
aggcaagggtaagtacagggtcact

SEQ ID NO: 419669 - DNA, 25 bp, Homo sapien
acagggtcactgagtatgcatggca

SEQ ID NO: 419670 - DNA, 25 bp, Homo sapien
gagtatgcatggcaggtccaacctt

SEQ ID NO: 419671 - DNA, 25 bp, Homo sapien
gcatggcaggtccaaccttatgcaa

SEQ ID NO: 419672 - DNA, 25 bp, Homo sapien
ggtccaaccttatgcaagctgcttt

SEQ ID NO: 419673 - DNA, 25 bp, Homo sapien
tccaactaaggactttaatttcagg

SEQ ID NO: 419674 - DNA, 25 bp, Homo sapien
aatttcaggtcttccattaatgtgg

SEQ ID NO: 419675 - DNA, 25 bp, Homo sapien
tcaggtcttccattaatgtggccaa

SEQ ID NO: 419676 - DNA, 25 bp, Homo sapien
ttccattaatgtggccaagtccctg

SEQ ID NO: 419677 - DNA, 25 bp, Homo sapien
attaatgtggccaagtccctgcccc

SEQ ID NO: 419678 - DNA, 25 bp, Homo sapien
gatggcaaatcaaacttttctagga

SEQ ID NO: 419679 - DNA, 25 bp, Homo sapien
cttttctaggatgaagacagcttat

SEQ ID NO: 419680 - DNA, 25 bp, Homo sapien
gacagcttatttttaagttgtatag

SEQ ID NO: 419681 - DNA, 25 bp, Homo sapien
tagtcttagttggtttagggtctca

SEQ ID NO: 419682 - DNA, 25 bp, Homo sapien
tcttagttggtttagggtctcaatt

SEQ ID NO: 419683 - DNA, 25 bp, Homo sapien
atttgcttgtccttttgaattcctg

SEQ ID NO: 419684 - DNA, 25 bp, Homo sapien
gcttgtccttttgaattcctgtttt

SEQ ID NO: 419685 - DNA, 25 bp, Homo sapien
tgtccttttgaattcctgttttaat

SEQ ID NO: 419686 - DNA, 25 bp, Homo sapien
gttgaagttcagattaatctcttct

SEQ ID NO: 419687 - DNA, 25 bp, Homo sapien
tttttcctctgtgatgagttgtttc

SEQ ID NO: 419688 - DNA, 25 bp, Homo sapien
ctctgtgatgagttgtttctgactt

SEQ ID NO: 419689 - DNA, 25 bp, Homo sapien
tggctgacgcgccttggacacacag

SEQ ID NO: 419690 - DNA, 25 bp, Homo sapien
acagcctcggcgctgcatcattttt

SEQ ID NO: 419691 - DNA, 25 bp, Homo sapien
agctatctgaggaatatttatctga

SEQ ID NO: 419692 - DNA, 25 bp, Homo sapien
gagaccagaggtgacattaataagc

SEQ ID NO: 419693 - DNA, 25 bp, Homo sapien
ggaataaaaccctgctcgtttgagc

SEQ ID NO: 419694 - DNA, 25 bp, Homo sapien
gctcgtttgagcatgccagcagact

SEQ ID NO: 419695 - DNA, 25 bp, Homo sapien
gcatgccagcagactaaagaatatt

SEQ ID NO: 419696 - DNA, 25 bp, Homo sapien
gagccagtcaaaagagtctcagttt

SEQ ID NO: 419697 - DNA, 25 bp, Homo sapien
aagagtctcagtttgaagtgttcag

SEQ ID NO: 419698 - DNA, 25 bp, Homo sapien
cagttaagtttaagtctcagtgata

SEQ ID NO: 419699 - DNA, 25 bp, Homo sapien
ctcagtgataagttttcaggcattc

SEQ ID NO: 419700 - DNA, 25 bp, Homo sapien
tcctgtttttaatgattaagcctca

SEQ ID NO: 419701 - DNA, 25 bp, Homo sapien
gtttttaatgattaagcctcagcct

SEQ ID NO: 419702 - DNA, 25 bp, Homo sapien
tttttaatgattaagcctcagcctc

SEQ ID NO: 419703 - DNA, 25 bp, Homo sapien
ttttaatgattaagcctcagcctca

SEQ ID NO: 419704 - DNA, 25 bp, Homo sapien
tttaatgattaagcctcagcctcaa

SEQ ID NO: 419705 - DNA, 25 bp, Homo sapien
taatgattaagcctcagcctcaaaa

SEQ ID NO: 419706 - DNA, 25 bp, Homo sapien
tcagcctcaaaaagcttttgacagc

SEQ ID NO: 419707 - DNA, 25 bp, Homo sapien
gcctcaaaaagcttttgacagcctg

SEQ ID NO: 419708 - DNA, 25 bp, Homo sapien
tcaaaaagcttttgacagcctggac

SEQ ID NO: 419709 - DNA, 25 bp, Homo sapien
caaaaagcttttgacagcctggaca

SEQ ID NO: 419710 - DNA, 25 bp, Homo sapien
aaaaagcttttgacagcctggacaa

SEQ ID NO: 419711 - DNA, 25 bp, Homo sapien
ggagagtcactacccgagttattcg

SEQ ID NO: 419712 - DNA, 25 bp, Homo sapien
tattcgccggcgtttgattataaag

SEQ ID NO: 419713 - DNA, 25 bp, Homo sapien
aaaggtatcctgtagctggatcatt

SEQ ID NO: 419714 - DNA, 25 bp, Homo sapien
ggatcattatgtggcattgctctac

SEQ ID NO: 419715 - DNA, 25 bp, Homo sapien
atgtggcattgctctactattagaa

SEQ ID NO: 419716 - DNA, 25 bp, Homo sapien
ttagaaactccttccttgtggttgt

SEQ ID NO: 419717 - DNA, 25 bp, Homo sapien
ttgtggttgtagaaactccttcctt

SEQ ID NO: 419718 - DNA, 25 bp, Homo sapien
gtagaaactccttccttgtggttgt

SEQ ID NO: 419719 - DNA, 25 bp, Homo sapien
ttttttgcacccttgaaagcttgta

SEQ ID NO: 419720 - DNA, 25 bp, Homo sapien
gcatggtattctgtataggcctatt

SEQ ID NO: 419721 - DNA, 25 bp, Homo sapien
atgtggcggttgtagttttatttga

SEQ ID NO: 419722 - DNA, 25 bp, Homo sapien
atttatcttcagcaactatggcatg

SEQ ID NO: 419723 - DNA, 25 bp, Homo sapien
tttatcttcagcaactatggcatgc

SEQ ID NO: 419724 - DNA, 25 bp, Homo sapien
ttatcttcagcaactatggcatgca

SEQ ID NO: 419725 - DNA, 25 bp, Homo sapien
cagtgggtccgccaggttccaggcg

SEQ ID NO: 419726 - DNA, 25 bp, Homo sapien
agtgggtccgccaggttccaggcga

SEQ ID NO: 419727 - DNA, 25 bp, Homo sapien
gtgggtccgccaggttccaggcgag

SEQ ID NO: 419728 - DNA, 25 bp, Homo sapien
gggtggcagttatatgctctgatgg

SEQ ID NO: 419729 - DNA, 25 bp, Homo sapien
ggtggcagttatatgctctgatgga

SEQ ID NO: 419730 - DNA, 25 bp, Homo sapien
ggcagttatatgctctgatggaagt

SEQ ID NO: 419731 - DNA, 25 bp, Homo sapien
tgggttctcccagaagcagagcgta

SEQ ID NO: 419732 - DNA, 25 bp, Homo sapien
ggttctcccagaagcagagcgtaaa

SEQ ID NO: 419733 - DNA, 25 bp, Homo sapien
gagcgtaaaacaatgcttcacgtga

SEQ ID NO: 419734 - DNA, 25 bp, Homo sapien
tgcttcacgtgaaagtaatcagtag

SEQ ID NO: 419735 - DNA, 25 bp, Homo sapien
gaaagcagccaatgaaaagtttact

SEQ ID NO: 419736 - DNA, 25 bp, Homo sapien
aagtttactattaagccagctacgg

SEQ ID NO: 419737 - DNA, 25 bp, Homo sapien
agccagctacggtaagtgggcaatt

SEQ ID NO: 419738 - DNA, 25 bp, Homo sapien
gcaattagagtttggtgccccaggg

SEQ ID NO: 419739 - DNA, 25 bp, Homo sapien
attagagtttggtgccccagggaga

SEQ ID NO: 419740 - DNA, 25 bp, Homo sapien
atttatataacaacttgccagggtt

SEQ ID NO: 419741 - DNA, 25 bp, Homo sapien
taacaacttgccagggttactgagt

SEQ ID NO: 419742 - DNA, 25 bp, Homo sapien
agatccaggtaatctctgccactaa

SEQ ID NO: 419743 - DNA, 25 bp, Homo sapien
tccaggtaatctctgccactaatca

SEQ ID NO: 419744 - DNA, 25 bp, Homo sapien
gaagggcacaggcattaatgcacag

SEQ ID NO: 419745 - DNA, 25 bp, Homo sapien
aggcattaatgcacagacaacaggc

SEQ ID NO: 419746 - DNA, 25 bp, Homo sapien
acaacaggcatagcagccgtgacaa

SEQ ID NO: 419747 - DNA, 25 bp, Homo sapien
agccgtgacaaaagctgcaggaaag

SEQ ID NO: 419748 - DNA, 25 bp, Homo sapien
aagctgcaggaaagggtgttaccca

SEQ ID NO: 419749 - DNA, 25 bp, Homo sapien
aagggtgttacccacatctgagttg

SEQ ID NO: 419750 - DNA, 25 bp, Homo sapien
gttacccacatctgagttgtggtga

SEQ ID NO: 419751 - DNA, 25 bp, Homo sapien
aggacacctgtctgccatccaggga

SEQ ID NO: 419752 - DNA, 25 bp, Homo sapien
gtctgccatccagggactgaccatg

SEQ ID NO: 419753 - DNA, 25 bp, Homo sapien
gagaacagaaatgtgtcccagatag

SEQ ID NO: 419754 - DNA, 25 bp, Homo sapien
aatgtgtcccagatagaaacagcct

SEQ ID NO: 419755 - DNA, 25 bp, Homo sapien
catcctcattgagaacatggaaggc

SEQ ID NO: 419756 - DNA, 25 bp, Homo sapien
aacatggaaggcacctacgactgga

SEQ ID NO: 419757 - DNA, 25 bp, Homo sapien
aaggcacctacgactggacaagctg

SEQ ID NO: 419758 - DNA, 25 bp, Homo sapien
gcacctacgactggacaagctggct

SEQ ID NO: 419759 - DNA, 25 bp, Homo sapien
gggatgatgtgctcacctaccagat

SEQ ID NO: 419760 - DNA, 25 bp, Homo sapien
tgctcacctaccagatggcgcatga

SEQ ID NO: 419761 - DNA, 25 bp, Homo sapien
accagatggcgcatgatgggcagct

SEQ ID NO: 419762 - DNA, 25 bp, Homo sapien
agcagagctcagaggccacccttgg

SEQ ID NO: 419763 - DNA, 25 bp, Homo sapien
agaggccacccttgggctcatgcca

SEQ ID NO: 419764 - DNA, 25 bp, Homo sapien
ttcccctgattttggaagcatggtt

SEQ ID NO: 419765 - DNA, 25 bp, Homo sapien
taacttaccctggttctacaacaca

SEQ ID NO: 419766 - DNA, 25 bp, Homo sapien
cctggttctacaacacagtggttaa

SEQ ID NO: 419767 - DNA, 25 bp, Homo sapien
ctttctagttcgttcctatatgtct

SEQ ID NO: 419768 - DNA, 25 bp, Homo sapien
tcgttcctatatgtctttccttttt

SEQ ID NO: 419769 - DNA, 25 bp, Homo sapien
cttttttgttcttctgctatacaaa

SEQ ID NO: 419770 - DNA, 25 bp, Homo sapien
gtttgctgttatattactgtgaatt

SEQ ID NO: 419771 - DNA, 25 bp, Homo sapien
gaaattagttcatcctacttttatg

SEQ ID NO: 419772 - DNA, 25 bp, Homo sapien
gttcatcctacttttatgtccaaaa

SEQ ID NO: 419773 - DNA, 25 bp, Homo sapien
aaaaaatctgtaacgcatccttata

SEQ ID NO: 419774 - DNA, 25 bp, Homo sapien
atctgtaacgcatccttatatattg

SEQ ID NO: 419775 - DNA, 25 bp, Homo sapien
ctttggtacatcaaactacacacaa

SEQ ID NO: 419776 - DNA, 25 bp, Homo sapien
ggtacatcaaactacacacaaaagt

SEQ ID NO: 419777 - DNA, 25 bp, Homo sapien
tcaaactacacacaaaagttccagg

SEQ ID NO: 419778 - DNA, 25 bp, Homo sapien
aggcaccttcagaaattatagtctc

SEQ ID NO: 419779 - DNA, 25 bp, Homo sapien
gcaccttcagaaattatagtctcaa

SEQ ID NO: 419780 - DNA, 25 bp, Homo sapien
gaaattatagtctcaactgcgtgcg

SEQ ID NO: 419781 - DNA, 25 bp, Homo sapien
aattatagtctcaactgcgtgcgac

SEQ ID NO: 419782 - DNA, 25 bp, Homo sapien
attatagtctcaactgcgtgcgaca

SEQ ID NO: 419783 - DNA, 25 bp, Homo sapien
ttatagtctcaactgcgtgcgacag

SEQ ID NO: 419784 - DNA, 25 bp, Homo sapien
tatagtctcaactgcgtgcgacagg

SEQ ID NO: 419785 - DNA, 25 bp, Homo sapien
atagtctcaactgcgtgcgacaggc

SEQ ID NO: 419786 - DNA, 25 bp, Homo sapien
aaaaaggaatgagaggccgggcaca

SEQ ID NO: 419787 - DNA, 25 bp, Homo sapien
aaaggaatgagaggccgggcacagc

SEQ ID NO: 419788 - DNA, 25 bp, Homo sapien
aaggaatgagaggccgggcacagcg

SEQ ID NO: 419789 - DNA, 25 bp, Homo sapien
aggaatgagaggccgggcacagcgg

SEQ ID NO: 419790 - DNA, 25 bp, Homo sapien
aatgagaggccgggcacagcggttc

SEQ ID NO: 419791 - DNA, 25 bp, Homo sapien
atgagaggccgggcacagcggttca

SEQ ID NO: 419792 - DNA, 25 bp, Homo sapien
tgagaggccgggcacagcggttcac

SEQ ID NO: 419793 - DNA, 25 bp, Homo sapien
agaggccgggcacagcggttcacgc

SEQ ID NO: 419794 - DNA, 25 bp, Homo sapien
gcacagcggttcacgcctgtggtcc

SEQ ID NO: 419795 - DNA, 25 bp, Homo sapien
atcgcgaggtcagggtttcaagacc

SEQ ID NO: 419796 - DNA, 25 bp, Homo sapien
cgcgaggtcagggtttcaagaccag

SEQ ID NO: 419797 - DNA, 25 bp, Homo sapien
agagcaggttgatttaggtcagctt

SEQ ID NO: 419798 - DNA, 25 bp, Homo sapien
aggtcagcttctccttgattctaga

SEQ ID NO: 419799 - DNA, 25 bp, Homo sapien
ggtcagcttctccttgattctagaa

SEQ ID NO: 419800 - DNA, 25 bp, Homo sapien
gtgcctcacagcacgactttgtgac

SEQ ID NO: 419801 - DNA, 25 bp, Homo sapien
ctcacagcacgactttgtgaccttg

SEQ ID NO: 419802 - DNA, 25 bp, Homo sapien
acagcacgactttgtgaccttgcat

SEQ ID NO: 419803 - DNA, 25 bp, Homo sapien
agcacgactttgtgaccttgcatct

SEQ ID NO: 419804 - DNA, 25 bp, Homo sapien
acgactttgtgaccttgcatctcaa

SEQ ID NO: 419805 - DNA, 25 bp, Homo sapien
cgactttgtgaccttgcatctcaaa

SEQ ID NO: 419806 - DNA, 25 bp, Homo sapien
gactttgtgaccttgcatctcaaac

SEQ ID NO: 419807 - DNA, 25 bp, Homo sapien
actttgtgaccttgcatctcaaaca

SEQ ID NO: 419808 - DNA, 25 bp, Homo sapien
aggcaatcgccatcctaacttttgt

SEQ ID NO: 419809 - DNA, 25 bp, Homo sapien
taacttttgtactggcctcatcttc

SEQ ID NO: 419810 - DNA, 25 bp, Homo sapien
taccgcctacggatgtaccttgaag

SEQ ID NO: 419811 - DNA, 25 bp, Homo sapien
gagcctggtgttgactgcatttgga

SEQ ID NO: 419812 - DNA, 25 bp, Homo sapien
agacgcaacatttctgtgtgccttg

SEQ ID NO: 419813 - DNA, 25 bp, Homo sapien
cttctgctcatcactgggtctgtga

SEQ ID NO: 419814 - DNA, 25 bp, Homo sapien
tgaagttgctcatttgaccccatat

SEQ ID NO: 419815 - DNA, 25 bp, Homo sapien
gaccccatattttgctttacagttg

SEQ ID NO: 419816 - DNA, 25 bp, Homo sapien
ttacagttgcataaacactccacag

SEQ ID NO: 419817 - DNA, 25 bp, Homo sapien
cagttatttatccatcccactgttg

SEQ ID NO: 419818 - DNA, 25 bp, Homo sapien
atcccactgttgagggacagctgtt

SEQ ID NO: 419819 - DNA, 25 bp, Homo sapien
gtttatgtcagggtatagcgtttca

SEQ ID NO: 419820 - DNA, 25 bp, Homo sapien
cagggtatagcgtttcaagggattt

SEQ ID NO: 419821 - DNA, 25 bp, Homo sapien
agcgtttcaagggatttgagggtca

SEQ ID NO: 419822 - DNA, 25 bp, Homo sapien
gaaatgtagccccttattttgccag

SEQ ID NO: 419823 - DNA, 25 bp, Homo sapien
tagccccttattttgccagtgtgaa

SEQ ID NO: 419824 - DNA, 25 bp, Homo sapien
ttgccagtgtgaagcagataccctg

SEQ ID NO: 419825 - DNA, 25 bp, Homo sapien
ccctgcttttctttacagtagcgga

SEQ ID NO: 419826 - DNA, 25 bp, Homo sapien
ttctttacagtagcggagtcagctt

SEQ ID NO: 419827 - DNA, 25 bp, Homo sapien
agcggagtcagcttaagagctttaa

SEQ ID NO: 419828 - DNA, 25 bp, Homo sapien
tcaaaaacattacagtgccccatcc

SEQ ID NO: 419829 - DNA, 25 bp, Homo sapien
catcctccgccttaatgtaattcaa

SEQ ID NO: 419830 - DNA, 25 bp, Homo sapien
ctccagatgggtgcaaacaaacgct

SEQ ID NO: 419831 - DNA, 25 bp, Homo sapien
ggtgcaaacaaacgctccagccagg

SEQ ID NO: 419832 - DNA, 25 bp, Homo sapien
gcacatctacaacaccaaactggga

SEQ ID NO: 419833 - DNA, 25 bp, Homo sapien
aactgggagcccacaagtgtgacaa

SEQ ID NO: 419834 - DNA, 25 bp, Homo sapien
atgggtgacacgcagagtgccaacc

SEQ ID NO: 419835 - DNA, 25 bp, Homo sapien
agagtgccaaccacagcgtccaggg

SEQ ID NO: 419836 - DNA, 25 bp, Homo sapien
aaccacagcgtccagggctttggcc

SEQ ID NO: 419837 - DNA, 25 bp, Homo sapien
ggcctgggccagcagatatactatc

SEQ ID NO: 419838 - DNA, 25 bp, Homo sapien
gatatactatcccaagtactgccct

SEQ ID NO: 419839 - DNA, 25 bp, Homo sapien
gggctcccttggatgccggcaactg

SEQ ID NO: 419840 - DNA, 25 bp, Homo sapien
cttggatgccggcaactgcccagga

SEQ ID NO: 419841 - DNA, 25 bp, Homo sapien
accatttgggtgaaaggaagagagc

SEQ ID NO: 419842 - DNA, 25 bp, Homo sapien
gaagagagcttttagtaggaagatt

SEQ ID NO: 419843 - DNA, 25 bp, Homo sapien
gattttggaactcaagggagcagaa

SEQ ID NO: 419844 - DNA, 25 bp, Homo sapien
gaatgtgtagcacctaatagtagct

SEQ ID NO: 419845 - DNA, 25 bp, Homo sapien
gcacctaatagtagctagtggtcta

SEQ ID NO: 419846 - DNA, 25 bp, Homo sapien
gctagtggtctattaaatcgaattt

SEQ ID NO: 419847 - DNA, 25 bp, Homo sapien
cctgggtcctgggtgtcacaaagag

SEQ ID NO: 419848 - DNA, 25 bp, Homo sapien
gggtcctgggtgtcacaaagagcat

SEQ ID NO: 419849 - DNA, 25 bp, Homo sapien
tgggtgtcacaaagagcatacccct

SEQ ID NO: 419850 - DNA, 25 bp, Homo sapien
agagcatacccctgcttctgggagg

SEQ ID NO: 419851 - DNA, 25 bp, Homo sapien
ggcctgcccagaattaattctagga

SEQ ID NO: 419852 - DNA, 25 bp, Homo sapien
ttggctgtgtcctctcgctttttca

SEQ ID NO: 419853 - DNA, 25 bp, Homo sapien
tctcgctttttcacttacttgtagg

SEQ ID NO: 419854 - DNA, 25 bp, Homo sapien
ggttcccatgtaaagaagcagcaga

SEQ ID NO: 419855 - DNA, 25 bp, Homo sapien
agcagcagagaaatgcgatggttca

SEQ ID NO: 419856 - DNA, 25 bp, Homo sapien
agtatgcagacttgaccttggcggg

SEQ ID NO: 419857 - DNA, 25 bp, Homo sapien
gggtcctgggcttctagagtctagc

SEQ ID NO: 419858 - DNA, 25 bp, Homo sapien
agagtctagcccgttgaccccaaag

SEQ ID NO: 419859 - DNA, 25 bp, Homo sapien
cctcagggcttatgtccaacggtcc

SEQ ID NO: 419860 - DNA, 25 bp, Homo sapien
gtccaacggtcccattgggagcaac

SEQ ID NO: 419861 - DNA, 25 bp, Homo sapien
gtcccattgggagcaacagtgattg

SEQ ID NO: 419862 - DNA, 25 bp, Homo sapien
aatgagggcagctgttaattttttc

SEQ ID NO: 419863 - DNA, 25 bp, Homo sapien
atcagcctgaaggtagcgtgggccc

SEQ ID NO: 419864 - DNA, 25 bp, Homo sapien
ctgaaggtagcgtgggcccgaacat

SEQ ID NO: 419865 - DNA, 25 bp, Homo sapien
cacacgtgcagcctatatgggaaaa

SEQ ID NO: 419866 - DNA, 25 bp, Homo sapien
cgtgcagcctatatgggaaaacctt

SEQ ID NO: 419867 - DNA, 25 bp, Homo sapien
ctctgtacctgcctcaaaggtttca

SEQ ID NO: 419868 - DNA, 25 bp, Homo sapien
gtacctgcctcaaaggtttcagaca

SEQ ID NO: 419869 - DNA, 25 bp, Homo sapien
gcctcaaaggtttcagacatttttc

SEQ ID NO: 419870 - DNA, 25 bp, Homo sapien
gacatttttcttaaagcactataat

SEQ ID NO: 419871 - DNA, 25 bp, Homo sapien
atatgagcaagcctatttcaaaaaa

SEQ ID NO: 419872 - DNA, 25 bp, Homo sapien
gacgattataatgagcaaatccggt

SEQ ID NO: 419873 - DNA, 25 bp, Homo sapien
cacacatgacggcttttgtgaaatg

SEQ ID NO: 419874 - DNA, 25 bp, Homo sapien
gattcgtccgtaattcctacaacag

SEQ ID NO: 419875 - DNA, 25 bp, Homo sapien
aaaccaggagaactgtggctacttg

SEQ ID NO: 419876 - DNA, 25 bp, Homo sapien
gtaatcctccccatagaaatatcaa

SEQ ID NO: 419877 - DNA, 25 bp, Homo sapien
atgagccgtgtatcattaggcctaa

SEQ ID NO: 419878 - DNA, 25 bp, Homo sapien
ggcctaaagccagatgcaatcccag

SEQ ID NO: 419879 - DNA, 25 bp, Homo sapien
gcaatcccaggacttttaaaccaag

SEQ ID NO: 419880 - DNA, 25 bp, Homo sapien
aacgttgacatctacatggccaggt

SEQ ID NO: 419881 - DNA, 25 bp, Homo sapien
aggtctttactacaatcaatcccca

SEQ ID NO: 419882 - DNA, 25 bp, Homo sapien
agatctaatcacagcttcatgccca

SEQ ID NO: 419883 - DNA, 25 bp, Homo sapien
agcttcatgcccattgttcttgaac

SEQ ID NO: 419884 - DNA, 25 bp, Homo sapien
attgttcttgaactggtacctctaa

SEQ ID NO: 419885 - DNA, 25 bp, Homo sapien
gtgctgttgttttctcagctgtgaa

SEQ ID NO: 419886 - DNA, 25 bp, Homo sapien
tcagctgtgaaaggaatattctggt

SEQ ID NO: 419887 - DNA, 25 bp, Homo sapien
ggacaaggttacagagttgctgaga

SEQ ID NO: 419888 - DNA, 25 bp, Homo sapien
gagttgctgagagggtctcatgaca

SEQ ID NO: 419889 - DNA, 25 bp, Homo sapien
tctcatgacatgaaggtactggcct

SEQ ID NO: 419890 - DNA, 25 bp, Homo sapien
catgaaggtactggccttggcacag

SEQ ID NO: 419891 - DNA, 25 bp, Homo sapien
gggactccgcacatgcctgtgatgt

SEQ ID NO: 419892 - DNA, 25 bp, Homo sapien
tccgcacatgcctgtgatgtcacag

SEQ ID NO: 419893 - DNA, 25 bp, Homo sapien
gatgtcacagttactgtcagttcac

SEQ ID NO: 419894 - DNA, 25 bp, Homo sapien
gttactgtcagttcacagcgaacct

SEQ ID NO: 419895 - DNA, 25 bp, Homo sapien
tgttgactttcccacactcctgtaa

SEQ ID NO: 419896 - DNA, 25 bp, Homo sapien
cacagccactcaaagctgatttctt

SEQ ID NO: 419897 - DNA, 25 bp, Homo sapien
tttcttttcaacctacatctttagc

SEQ ID NO: 419898 - DNA, 25 bp, Homo sapien
catctttagcaacatgaatacttaa

SEQ ID NO: 419899 - DNA, 25 bp, Homo sapien
ttaattataatctaagccttcttac

SEQ ID NO: 419900 - DNA, 25 bp, Homo sapien
aagccttcttacaagtgtctccaag

SEQ ID NO: 419901 - DNA, 25 bp, Homo sapien
agtgtctccaagaacaaatgttact

SEQ ID NO: 419902 - DNA, 25 bp, Homo sapien
aaatgtagacgctaacctgtgcttg

SEQ ID NO: 419903 - DNA, 25 bp, Homo sapien
gtagacgctaacctgtgcttgtaca

SEQ ID NO: 419904 - DNA, 25 bp, Homo sapien
gttctgttgaagataaatgctttac

SEQ ID NO: 419905 - DNA, 25 bp, Homo sapien
tgctttacagtacatattctaacag

SEQ ID NO: 419906 - DNA, 25 bp, Homo sapien
atacgttgggccctaacgaagagag

SEQ ID NO: 419907 - DNA, 25 bp, Homo sapien
ggatacagtgagaagtcagccattt

SEQ ID NO: 419908 - DNA, 25 bp, Homo sapien
gaagtcagccatttacgagccagga

SEQ ID NO: 419909 - DNA, 25 bp, Homo sapien
tcagccatttacgagccaggaagag

SEQ ID NO: 419910 - DNA, 25 bp, Homo sapien
agagggtcctcaccaagaacttaat

SEQ ID NO: 419911 - DNA, 25 bp, Homo sapien
gtcctcaccaagaacttaatctgcc

SEQ ID NO: 419912 - DNA, 25 bp, Homo sapien
ccaagaacttaatctgccagtacat

SEQ ID NO: 419913 - DNA, 25 bp, Homo sapien
taatctgccagtacattgattttgg

SEQ ID NO: 419914 - DNA, 25 bp, Homo sapien
ttttggacttcgcagctttcagtac

SEQ ID NO: 419915 - DNA, 25 bp, Homo sapien
gacttcgcagctttcagtactatga

SEQ ID NO: 419916 - DNA, 25 bp, Homo sapien
ttcgcagctttcagtactatgagaa

SEQ ID NO: 419917 - DNA, 25 bp, Homo sapien
ggtggagcccacacaatgggattag

SEQ ID NO: 419918 - DNA, 25 bp, Homo sapien
cagcccgctaccttgtttctttatt

SEQ ID NO: 419919 - DNA, 25 bp, Homo sapien
cgctaccttgtttctttattctcaa

SEQ ID NO: 419920 - DNA, 25 bp, Homo sapien
gtttctttattctcaaaatctacct

SEQ ID NO: 419921 - DNA, 25 bp, Homo sapien
aaaatctacctttgtcatcacttcc

SEQ ID NO: 419922 - DNA, 25 bp, Homo sapien
ctacctttgtcatcacttccttcag

SEQ ID NO: 419923 - DNA, 25 bp, Homo sapien
gggctgagtgcagtgccacatgctt

SEQ ID NO: 419924 - DNA, 25 bp, Homo sapien
gagtgcagtgccacatgcttgaaat

SEQ ID NO: 419925 - DNA, 25 bp, Homo sapien
cagtgccacatgcttgaaatcccaa

SEQ ID NO: 419926 - DNA, 25 bp, Homo sapien
gccacatgcttgaaatcccaactgt

SEQ ID NO: 419927 - DNA, 25 bp, Homo sapien
gaaatcccaactgttaggtaggctg

SEQ ID NO: 419928 - DNA, 25 bp, Homo sapien
cccaactgttaggtaggctgaagca

SEQ ID NO: 419929 - DNA, 25 bp, Homo sapien
gttcctctgttctgtgaatggactc

SEQ ID NO: 419930 - DNA, 25 bp, Homo sapien
ttcctctgttctgtgaatggactct

SEQ ID NO: 419931 - DNA, 25 bp, Homo sapien
tcctctgttctgtgaatggactctg

SEQ ID NO: 419932 - DNA, 25 bp, Homo sapien
cctctgttctgtgaatggactctgt

SEQ ID NO: 419933 - DNA, 25 bp, Homo sapien
tctgttctgtgaatggactctgtgt

SEQ ID NO: 419934 - DNA, 25 bp, Homo sapien
ttctgtgaatggactctgtgtccct

SEQ ID NO: 419935 - DNA, 25 bp, Homo sapien
ctgtgaatggactctgtgtccctgc

SEQ ID NO: 419936 - DNA, 25 bp, Homo sapien
gtgaatggactctgtgtccctgcct

SEQ ID NO: 419937 - DNA, 25 bp, Homo sapien
tgaatggactctgtgtccctgcctg

SEQ ID NO: 419938 - DNA, 25 bp, Homo sapien
aatggactctgtgtccctgcctgtg

SEQ ID NO: 419939 - DNA, 25 bp, Homo sapien
atggactctgtgtccctgcctgtga

SEQ ID NO: 419940 - DNA, 25 bp, Homo sapien
cctaaactcattgagagttgggact

SEQ ID NO: 419941 - DNA, 25 bp, Homo sapien
actcattgagagttgggactatttc

SEQ ID NO: 419942 - DNA, 25 bp, Homo sapien
tcattgagagttgggactatttcac

SEQ ID NO: 419943 - DNA, 25 bp, Homo sapien
ttgagagttgggactatttcacaca

SEQ ID NO: 419944 - DNA, 25 bp, Homo sapien
tgagagttgggactatttcacacat

SEQ ID NO: 419945 - DNA, 25 bp, Homo sapien
gagagttgggactatttcacacata

SEQ ID NO: 419946 - DNA, 25 bp, Homo sapien
agagttgggactatttcacacatac

SEQ ID NO: 419947 - DNA, 25 bp, Homo sapien
gagttgggactatttcacacataca

SEQ ID NO: 419948 - DNA, 25 bp, Homo sapien
cctggcatgtagaagggacttaatg

SEQ ID NO: 419949 - DNA, 25 bp, Homo sapien
gcatgtagaagggacttaatgttga

SEQ ID NO: 419950 - DNA, 25 bp, Homo sapien
tagaagggacttaatgttgaaagaa

SEQ ID NO: 419951 - DNA, 25 bp, Homo sapien
agagcaggttgatttaggtcagctt

SEQ ID NO: 419952 - DNA, 25 bp, Homo sapien
caggttgatttaggtcagcttctcc

SEQ ID NO: 419953 - DNA, 25 bp, Homo sapien
aggtcagcttctccttgattctaga

SEQ ID NO: 419954 - DNA, 25 bp, Homo sapien
ggtcagcttctccttgattctagaa

SEQ ID NO: 419955 - DNA, 25 bp, Homo sapien
tggagctcagtcctgcatctgttca

SEQ ID NO: 419956 - DNA, 25 bp, Homo sapien
gtgcctcacagcacgactttgtgac

SEQ ID NO: 419957 - DNA, 25 bp, Homo sapien
acagcacgactttgtgaccttgcat

SEQ ID NO: 419958 - DNA, 25 bp, Homo sapien
agcacgactttgtgaccttgcatct

SEQ ID NO: 419959 - DNA, 25 bp, Homo sapien
acgactttgtgaccttgcatctcaa

SEQ ID NO: 419960 - DNA, 25 bp, Homo sapien
gactttgtgaccttgcatctcaaac

SEQ ID NO: 419961 - DNA, 25 bp, Homo sapien
actttgtgaccttgcatctcaaaca

SEQ ID NO: 419962 - DNA, 25 bp, Homo sapien
gggtgtctgggtggttcctgcacag

SEQ ID NO: 419963 - DNA, 25 bp, Homo sapien
ttttcttaggtcttcagcacactcc

SEQ ID NO: 419964 - DNA, 25 bp, Homo sapien
ttaggtcttcagcacactcctcaca

SEQ ID NO: 419965 - DNA, 25 bp, Homo sapien
ggtcttcagcacactcctcacaggg

SEQ ID NO: 419966 - DNA, 25 bp, Homo sapien
taaatgtatgaactgggccatgtct

SEQ ID NO: 419967 - DNA, 25 bp, Homo sapien
tgggccatgtcttgctgctgttctg

SEQ ID NO: 419968 - DNA, 25 bp, Homo sapien
gggccatgtcttgctgctgttctgg

SEQ ID NO: 419969 - DNA, 25 bp, Homo sapien
gatccggcgggcagtcctccctaaa

SEQ ID NO: 419970 - DNA, 25 bp, Homo sapien
cggcgggcagtcctccctaaacttg

SEQ ID NO: 419971 - DNA, 25 bp, Homo sapien
taaacttggtgtcccgcttctgctg

SEQ ID NO: 419972 - DNA, 25 bp, Homo sapien
tggtgtcccgcttctgctgcgtccg

SEQ ID NO: 419973 - DNA, 25 bp, Homo sapien
ttatattacagttttcctctatgaa

SEQ ID NO: 419974 - DNA, 25 bp, Homo sapien
gttttcctctatgaaagtccttact

SEQ ID NO: 419975 - DNA, 25 bp, Homo sapien
tatgatacaagcactgtgttttgtg

SEQ ID NO: 419976 - DNA, 25 bp, Homo sapien
gttttgtgcttaaactcttcagcgg

SEQ ID NO: 419977 - DNA, 25 bp, Homo sapien
tgggtcccttccctagaagaatggt

SEQ ID NO: 419978 - DNA, 25 bp, Homo sapien
atggttgctgatatggctactgctt

SEQ ID NO: 419979 - DNA, 25 bp, Homo sapien
gctactgcttctacatcttgagttt

SEQ ID NO: 419980 - DNA, 25 bp, Homo sapien
gtagcattgagactgcttgattcaa

SEQ ID NO: 419981 - DNA, 25 bp, Homo sapien
cttgattcaagtctggtgctttgcc

SEQ ID NO: 419982 - DNA, 25 bp, Homo sapien
ggtgctttgccagatgtattaattt

SEQ ID NO: 419983 - DNA, 25 bp, Homo sapien
ccataaatgctttgtgagtttggtt

SEQ ID NO: 419984 - DNA, 25 bp, Homo sapien
cacccaaatacaagtcccagtggaa

SEQ ID NO: 419985 - DNA, 25 bp, Homo sapien
aaggtagtacctattcttctccatg

SEQ ID NO: 419986 - DNA, 25 bp, Homo sapien
tactctttcagtctccaagcacttt

SEQ ID NO: 419987 - DNA, 25 bp, Homo sapien
aaacattcaggttgccagacctgtc

SEQ ID NO: 419988 - DNA, 25 bp, Homo sapien
aggttgccagacctgtcacacagtg

SEQ ID NO: 419989 - DNA, 25 bp, Homo sapien
acctgtcacacagtgggctctgata

SEQ ID NO: 419990 - DNA, 25 bp, Homo sapien
cacagtgggctctgatagggttacg

SEQ ID NO: 419991 - DNA, 25 bp, Homo sapien
tggctctcagtctctactctcctat

SEQ ID NO: 419992 - DNA, 25 bp, Homo sapien
tactctcctatgtcccatcagttgg

SEQ ID NO: 419993 - DNA, 25 bp, Homo sapien
atgtcccatcagttggttggaggcc

SEQ ID NO: 419994 - DNA, 25 bp, Homo sapien
atcagttggttggaggccaccttcc

SEQ ID NO: 419995 - DNA, 25 bp, Homo sapien
aagggagctttcacgctgagctgcg

SEQ ID NO: 419996 - DNA, 25 bp, Homo sapien
tgcagctcaatctcaagaccctgga

SEQ ID NO: 419997 - DNA, 25 bp, Homo sapien
aggtcagtgacctcggacctgctta

SEQ ID NO: 419998 - DNA, 25 bp, Homo sapien
gacctgcttatctggagctgctcta

SEQ ID NO: 419999 - DNA, 25 bp, Homo sapien
atgtggccagtgacctcctggttca

SEQ ID NO: 420000 - DNA, 25 bp, Homo sapien
agctgggcttcaatactgctgatca

SEQ ID NO: 420001 - DNA, 25 bp, Homo sapien
ttcctcagtccagctggtgaaccag

SEQ ID NO: 420002 - DNA, 25 bp, Homo sapien
gttctgcttggccatgatctcatat

SEQ ID NO: 420003 - DNA, 25 bp, Homo sapien
tgatcagtgcctggatctgcaccag

SEQ ID NO: 420004 - DNA, 25 bp, Homo sapien
tgggctccaaagcatgcctctgttt

SEQ ID NO: 420005 - DNA, 25 bp, Homo sapien
gccagtgtgccttctaagggagctt

SEQ ID NO: 420006 - DNA, 25 bp, Homo sapien
ctgcatgtggagtaagcggaggtgg

SEQ ID NO: 420007 - DNA, 25 bp, Homo sapien
aggtgtgtctactatctcttaattg

SEQ ID NO: 420008 - DNA, 25 bp, Homo sapien
ttaattgagacaccatggaccctga

SEQ ID NO: 420009 - DNA, 25 bp, Homo sapien
gtgcagaaatttgatacctgtatct

SEQ ID NO: 420010 - DNA, 25 bp, Homo sapien
gatacctgtatctgttatgagaacc

SEQ ID NO: 420011 - DNA, 25 bp, Homo sapien
atacctgtatctgttatgagaacct

SEQ ID NO: 420012 - DNA, 25 bp, Homo sapien
gcagcaggaccatggtaaagagcta

SEQ ID NO: 420013 - DNA, 25 bp, Homo sapien
ggtaaagagctaggttggatccaca

SEQ ID NO: 420014 - DNA, 25 bp, Homo sapien
gagctaggttggatccacactggga

SEQ ID NO: 420015 - DNA, 25 bp, Homo sapien
cacactgggagggtctggaatacca

SEQ ID NO: 420016 - DNA, 25 bp, Homo sapien
tctggaataccaggctaaggcattt

SEQ ID NO: 420017 - DNA, 25 bp, Homo sapien
gggaggcattttaaaatccacatca

SEQ ID NO: 420018 - DNA, 25 bp, Homo sapien
aaaatgttgttctgtttgggagtgg

SEQ ID NO: 420019 - DNA, 25 bp, Homo sapien
actcattgagagttgggactatttc

SEQ ID NO: 420020 - DNA, 25 bp, Homo sapien
tcattgagagttgggactatttcac

SEQ ID NO: 420021 - DNA, 25 bp, Homo sapien
ttgagagttgggactatttcacaca

SEQ ID NO: 420022 - DNA, 25 bp, Homo sapien
gagagttgggactatttcacacata

SEQ ID NO: 420023 - DNA, 25 bp, Homo sapien
agagttgggactatttcacacatac

SEQ ID NO: 420024 - DNA, 25 bp, Homo sapien
gagttgggactatttcacacataca

SEQ ID NO: 420025 - DNA, 25 bp, Homo sapien
cctggcatgtagaagggacttaatg

SEQ ID NO: 420026 - DNA, 25 bp, Homo sapien
gcatgtagaagggacttaatgttga

SEQ ID NO: 420027 - DNA, 25 bp, Homo sapien
tagaagggacttaatgttgaaagaa

SEQ ID NO: 420028 - DNA, 25 bp, Homo sapien
agggacagggtctgcacgctctgct

SEQ ID NO: 420029 - DNA, 25 bp, Homo sapien
acagggtctgcacgctctgctgaga

SEQ ID NO: 420030 - DNA, 25 bp, Homo sapien
tgcacgctctgctgagagttgctca

SEQ ID NO: 420031 - DNA, 25 bp, Homo sapien
tgctgagagttgctcagctccgaga

SEQ ID NO: 420032 - DNA, 25 bp, Homo sapien
agctccgagagcttcttctccagcg

SEQ ID NO: 420033 - DNA, 25 bp, Homo sapien
tctccagcgccgactcagagaagga

SEQ ID NO: 420034 - DNA, 25 bp, Homo sapien
acctgacaggctgcgggacttttta

SEQ ID NO: 420035 - DNA, 25 bp, Homo sapien
aaagtaagctttctatttgatttgg

SEQ ID NO: 420036 - DNA, 25 bp, Homo sapien
gctcgcggtgccacacggagacgat

SEQ ID NO: 420037 - DNA, 25 bp, Homo sapien
cacacggagacgatgggtcccgcgt

SEQ ID NO: 420038 - DNA, 25 bp, Homo sapien
gtgcttgcggtggtggatgagccaa

SEQ ID NO: 420039 - DNA, 25 bp, Homo sapien
gacaaaattgtttggatatccttat

SEQ ID NO: 420040 - DNA, 25 bp, Homo sapien
ggatatccttatgttctcaagtctg

SEQ ID NO: 420041 - DNA, 25 bp, Homo sapien
atccttatgttctcaagtctgtatc

SEQ ID NO: 420042 - DNA, 25 bp, Homo sapien
ctcccctgccttatttcttatgttt

SEQ ID NO: 420043 - DNA, 25 bp, Homo sapien
tttgccacagttaacccattgtgct

SEQ ID NO: 420044 - DNA, 25 bp, Homo sapien
aacccattgtgcttctttgtaatca

SEQ ID NO: 420045 - DNA, 25 bp, Homo sapien
gtgcttctttgtaatcaaacagttt

SEQ ID NO: 420046 - DNA, 25 bp, Homo sapien
caaacagtttgtgggagaatgggct

SEQ ID NO: 420047 - DNA, 25 bp, Homo sapien
ctctcagtgaattgttattgtttgc

SEQ ID NO: 420048 - DNA, 25 bp, Homo sapien
attgtttgcaaaaatgcactgggca

SEQ ID NO: 420049 - DNA, 25 bp, Homo sapien
aatgcactgggcagtaacattttgt

SEQ ID NO: 420050 - DNA, 25 bp, Homo sapien
ggaaccatcacattaattacacaat

SEQ ID NO: 420051 - DNA, 25 bp, Homo sapien
gtgtctgaggtaacccagtttcttg

SEQ ID NO: 420052 - DNA, 25 bp, Homo sapien
gaggtaacccagtttcttgagagaa

SEQ ID NO: 420053 - DNA, 25 bp, Homo sapien
aacccagtttcttgagagaagcgta

SEQ ID NO: 420054 - DNA, 25 bp, Homo sapien
gagaagcgtaactattttcaaaagt

SEQ ID NO: 420055 - DNA, 25 bp, Homo sapien
atagcaacattctcaatactcgtgg

SEQ ID NO: 420056 - DNA, 25 bp, Homo sapien
acattctcaatactcgtggtgtaaa

SEQ ID NO: 420057 - DNA, 25 bp, Homo sapien
gtaaaaaccatgaatcccctggctt

SEQ ID NO: 420058 - DNA, 25 bp, Homo sapien
gaatcccctggcttaatgccaaatt

SEQ ID NO: 420059 - DNA, 25 bp, Homo sapien
taatgccaaattatagccttagaag

SEQ ID NO: 420060 - DNA, 25 bp, Homo sapien
tcaagagtaacccaagtaagaactt

SEQ ID NO: 420061 - DNA, 25 bp, Homo sapien
gtctcaaagattctgtaccaactgg

SEQ ID NO: 420062 - DNA, 25 bp, Homo sapien
tctcaaagattctgtaccaactggg

SEQ ID NO: 420063 - DNA, 25 bp, Homo sapien
ctcaaagattctgtaccaactgggc

SEQ ID NO: 420064 - DNA, 25 bp, Homo sapien
tcaaagattctgtaccaactgggcg

SEQ ID NO: 420065 - DNA, 25 bp, Homo sapien
caaagattctgtaccaactgggcgt

SEQ ID NO: 420066 - DNA, 25 bp, Homo sapien
aaagattctgtaccaactgggcgtg

SEQ ID NO: 420067 - DNA, 25 bp, Homo sapien
aagattctgtaccaactgggcgtgg

SEQ ID NO: 420068 - DNA, 25 bp, Homo sapien
agattctgtaccaactgggcgtggt

SEQ ID NO: 420069 - DNA, 25 bp, Homo sapien
gattctgtaccaactgggcgtggtg

SEQ ID NO: 420070 - DNA, 25 bp, Homo sapien
tgaagtgggagagttacttgggccc

SEQ ID NO: 420071 - DNA, 25 bp, Homo sapien
aagtgggagagttacttgggcccag

SEQ ID NO: 420072 - DNA, 25 bp, Homo sapien
gaaggcagcactaaacacataaagg

SEQ ID NO: 420073 - DNA, 25 bp, Homo sapien
taacaaactataaagaccaccgaca

SEQ ID NO: 420074 - DNA, 25 bp, Homo sapien
aactataaagaccaccgacactatg

SEQ ID NO: 420075 - DNA, 25 bp, Homo sapien
ataaagaccaccgacactatgaaga

SEQ ID NO: 420076 - DNA, 25 bp, Homo sapien
aaagaccaccgacactatgaagaaa

SEQ ID NO: 420077 - DNA, 25 bp, Homo sapien
agaccaccgacactatgaagaaact

SEQ ID NO: 420078 - DNA, 25 bp, Homo sapien
ccaccgacactatgaagaaactgca

SEQ ID NO: 420079 - DNA, 25 bp, Homo sapien
ggcaaaataaccaactagcatcata

SEQ ID NO: 420080 - DNA, 25 bp, Homo sapien
atgcaaacgggctaaatgccacaat

SEQ ID NO: 420081 - DNA, 25 bp, Homo sapien
caaacgggctaaatgccacaattaa

SEQ ID NO: 420082 - DNA, 25 bp, Homo sapien
gatagagtcaaaatccatcattgtg

SEQ ID NO: 420083 - DNA, 25 bp, Homo sapien
ttagttgcccagcatcgcgtgctca

SEQ ID NO: 420084 - DNA, 25 bp, Homo sapien
agcccatccccatcctagaggtggg

SEQ ID NO: 420085 - DNA, 25 bp, Homo sapien
ccatcctagaggtgggctctctgcc

SEQ ID NO: 420086 - DNA, 25 bp, Homo sapien
aggtgggctctctgccccttggagt

SEQ ID NO: 420087 - DNA, 25 bp, Homo sapien
gcaagtggtgtgtgagttcgacatt

SEQ ID NO: 420088 - DNA, 25 bp, Homo sapien
gtgtgagttcgacatttcacataaa

SEQ ID NO: 420089 - DNA, 25 bp, Homo sapien
ttcattaccagcacggaaggtgccc

SEQ ID NO: 420090 - DNA, 25 bp, Homo sapien
agcacggaaggtgcccactggcctg

SEQ ID NO: 420091 - DNA, 25 bp, Homo sapien
ggatacagcccagcactatgtggtg

SEQ ID NO: 420092 - DNA, 25 bp, Homo sapien
agcccagcactatgtggtgttgctt

SEQ ID NO: 420093 - DNA, 25 bp, Homo sapien
gcactatgtggtgttgctttttagg

SEQ ID NO: 420094 - DNA, 25 bp, Homo sapien
ctgcatgtggagtaagcggaggtgg

SEQ ID NO: 420095 - DNA, 25 bp, Homo sapien
gtgcagaaatttgatacctgtatct

SEQ ID NO: 420096 - DNA, 25 bp, Homo sapien
tgatacctgtatctgttatgagaac

SEQ ID NO: 420097 - DNA, 25 bp, Homo sapien
gatacctgtatctgttatgagaacc

SEQ ID NO: 420098 - DNA, 25 bp, Homo sapien
atacctgtatctgttatgagaacct

SEQ ID NO: 420099 - DNA, 25 bp, Homo sapien
gcagcaggaccatggtaaagagcta

SEQ ID NO: 420100 - DNA, 25 bp, Homo sapien
caggaccatggtaaagagctaggtt

SEQ ID NO: 420101 - DNA, 25 bp, Homo sapien
catggtaaagagctaggttggatcc

SEQ ID NO: 420102 - DNA, 25 bp, Homo sapien
ggtaaagagctaggttggatccaca

SEQ ID NO: 420103 - DNA, 25 bp, Homo sapien
agggtctggaataccaggctaaggc

SEQ ID NO: 420104 - DNA, 25 bp, Homo sapien
tctggaataccaggctaaggcattt

SEQ ID NO: 420105 - DNA, 25 bp, Homo sapien
gagtggctgcttagcattggcctcc

SEQ ID NO: 420106 - DNA, 25 bp, Homo sapien
tctgggtcctttcattgctgacagg

SEQ ID NO: 420107 - DNA, 25 bp, Homo sapien
gtcctttcattgctgacaggctgtg

SEQ ID NO: 420108 - DNA, 25 bp, Homo sapien
ttcattgctgacaggctgtgatggc

SEQ ID NO: 420109 - DNA, 25 bp, Homo sapien
gctgtgatggccctcttgagccttg

SEQ ID NO: 420110 - DNA, 25 bp, Homo sapien
atggccctcttgagccttgggcagg

SEQ ID NO: 420111 - DNA, 25 bp, Homo sapien
ttagcattggcctccgccgttaggc

SEQ ID NO: 420112 - DNA, 25 bp, Homo sapien
gccttccaggaggtggctttgttcc

SEQ ID NO: 420113 - DNA, 25 bp, Homo sapien
aggaggtggctttgttccgtgcctc

SEQ ID NO: 420114 - DNA, 25 bp, Homo sapien
ctaccaggtctggtacggagtcggt

SEQ ID NO: 420115 - DNA, 25 bp, Homo sapien
ttggcctccgccgttaggctcggga

SEQ ID NO: 420116 - DNA, 25 bp, Homo sapien
gccgccatggggcagactctctgat

SEQ ID NO: 420117 - DNA, 25 bp, Homo sapien
gccatggggcagactctctgatgcc

SEQ ID NO: 420118 - DNA, 25 bp, Homo sapien
atgccagtccccaaaagtggggctc

SEQ ID NO: 420119 - DNA, 25 bp, Homo sapien
gggctctgaagtctcggaccctcat

SEQ ID NO: 420120 - DNA, 25 bp, Homo sapien
ggctctgaagtctcggaccctcatg

SEQ ID NO: 420121 - DNA, 25 bp, Homo sapien
gctctgaagtctcggaccctcatgg

SEQ ID NO: 420122 - DNA, 25 bp, Homo sapien
tctgaagtctcggaccctcatggca

SEQ ID NO: 420123 - DNA, 25 bp, Homo sapien
ctgaagtctcggaccctcatggcac

SEQ ID NO: 420124 - DNA, 25 bp, Homo sapien
catggcacccggtgccccaaagcaa

SEQ ID NO: 420125 - DNA, 25 bp, Homo sapien
aagcaaaggctgcttctcctccagt

SEQ ID NO: 420126 - DNA, 25 bp, Homo sapien
ccttgggggccttgtgtgtaaatgt

SEQ ID NO: 420127 - DNA, 25 bp, Homo sapien
tcattattgccgtattttctaaatt

SEQ ID NO: 420128 - DNA, 25 bp, Homo sapien
atgaactgcatatatttgctttcaa

SEQ ID NO: 420129 - DNA, 25 bp, Homo sapien
aatcattatgtgtttgagtagtata

SEQ ID NO: 420130 - DNA, 25 bp, Homo sapien
gtagtatagatagctcttcccaggt

SEQ ID NO: 420131 - DNA, 25 bp, Homo sapien
atagatagctcttcccaggtatcaa

SEQ ID NO: 420132 - DNA, 25 bp, Homo sapien
gatagctcttcccaggtatcaatag

SEQ ID NO: 420133 - DNA, 25 bp, Homo sapien
agctcttcccaggtatcaatagcca

SEQ ID NO: 420134 - DNA, 25 bp, Homo sapien
tcttcccaggtatcaatagccaaat

SEQ ID NO: 420135 - DNA, 25 bp, Homo sapien
ggtatcaatagccaaatttgacatg

SEQ ID NO: 420136 - DNA, 25 bp, Homo sapien
gatactgtaatttactagccttttt

SEQ ID NO: 420137 - DNA, 25 bp, Homo sapien
tgtagacagagcttttaaattattt

SEQ ID NO: 420138 - DNA, 25 bp, Homo sapien
ggcttcctgaagcttagatttccag

SEQ ID NO: 420139 - DNA, 25 bp, Homo sapien
tagatttccagcttgtcaccttcaa

SEQ ID NO: 420140 - DNA, 25 bp, Homo sapien
gtcaccttcaaggttaccttgtgaa

SEQ ID NO: 420141 - DNA, 25 bp, Homo sapien
gagctatttctatccagttgactat

SEQ ID NO: 420142 - DNA, 25 bp, Homo sapien
gttgactatggattttgcctgttgc

SEQ ID NO: 420143 - DNA, 25 bp, Homo sapien
tgcctgttgctttgtttccaccaac

SEQ ID NO: 420144 - DNA, 25 bp, Homo sapien
aactctccctgaagatgaggcgcac

SEQ ID NO: 420145 - DNA, 25 bp, Homo sapien
agatgaggcgcacagacagacaact

SEQ ID NO: 420146 - DNA, 25 bp, Homo sapien
gacagacaactcacaggcaagaaca

SEQ ID NO: 420147 - DNA, 25 bp, Homo sapien
agaacagcctggtccatcttgaaag

SEQ ID NO: 420148 - DNA, 25 bp, Homo sapien
gattctcaagactattctccacaag

SEQ ID NO: 420149 - DNA, 25 bp, Homo sapien
ttcctccttgtatgtatgaggtgac

SEQ ID NO: 420150 - DNA, 25 bp, Homo sapien
ttttttctttcttagggcatctgta

SEQ ID NO: 420151 - DNA, 25 bp, Homo sapien
ttcttagggcatctgtaggcctcaa

SEQ ID NO: 420152 - DNA, 25 bp, Homo sapien
catctgtaggcctcaaaggaccttt

SEQ ID NO: 420153 - DNA, 25 bp, Homo sapien
tgtaggcctcaaaggacctttcctt

SEQ ID NO: 420154 - DNA, 25 bp, Homo sapien
ctttcctttaggtcatattcctcag

SEQ ID NO: 420155 - DNA, 25 bp, Homo sapien
taggtcatattcctcagaaagtctt

SEQ ID NO: 420156 - DNA, 25 bp, Homo sapien
agaaagtcttcaatcttcccttgtt

SEQ ID NO: 420157 - DNA, 25 bp, Homo sapien
tttagaagtataggctgtcgttggc

SEQ ID NO: 420158 - DNA, 25 bp, Homo sapien
ataggctgtcgttggcggcagcagt

SEQ ID NO: 420159 - DNA, 25 bp, Homo sapien
gcggcagcagtatattctgaaatgt

SEQ ID NO: 420160 - DNA, 25 bp, Homo sapien
aataatattcaatttcacagatgct

SEQ ID NO: 420161 - DNA, 25 bp, Homo sapien
gcccagccaacttctattcttggta

SEQ ID NO: 420162 - DNA, 25 bp, Homo sapien
ttcaataaaagacagatgaccaact

SEQ ID NO: 420163 - DNA, 25 bp, Homo sapien
agatgaccaactcaaacattttttc

SEQ ID NO: 420164 - DNA, 25 bp, Homo sapien
agccaacttctattcttggtaaaca

SEQ ID NO: 420165 - DNA, 25 bp, Homo sapien
caataaatacgtctttagggacaat

SEQ ID NO: 420166 - DNA, 25 bp, Homo sapien
aaactgacattttagggcatagcca

SEQ ID NO: 420167 - DNA, 25 bp, Homo sapien
ttttagggcatagccaagcgcacat

SEQ ID NO: 420168 - DNA, 25 bp, Homo sapien
tagggcatagccaagcgcacataaa

SEQ ID NO: 420169 - DNA, 25 bp, Homo sapien
gggcatagccaagcgcacataaaat

SEQ ID NO: 420170 - DNA, 25 bp, Homo sapien
tagccaagcgcacataaaataatat

SEQ ID NO: 420171 - DNA, 25 bp, Homo sapien
ggcaacagaacagccctctagcaga

SEQ ID NO: 420172 - DNA, 25 bp, Homo sapien
aacagccctctagcagagcgtcagt

SEQ ID NO: 420173 - DNA, 25 bp, Homo sapien
gagcgtcagtgcagtcgtgttatcc

SEQ ID NO: 420174 - DNA, 25 bp, Homo sapien
gtgttatcccggcttttacagaata

SEQ ID NO: 420175 - DNA, 25 bp, Homo sapien
ttgcagtctgttgattatgtgcagt

SEQ ID NO: 420176 - DNA, 25 bp, Homo sapien
ttatgtgcagtagacccgggacact

SEQ ID NO: 420177 - DNA, 25 bp, Homo sapien
gggacactgcgttttaccgatcacc

SEQ ID NO: 420178 - DNA, 25 bp, Homo sapien
tgcgttttaccgatcaccttgaatg

SEQ ID NO: 420179 - DNA, 25 bp, Homo sapien
accgatcaccttgaatgtggtgcct

SEQ ID NO: 420180 - DNA, 25 bp, Homo sapien
aatgtggtgcctggatgtgcctttt

SEQ ID NO: 420181 - DNA, 25 bp, Homo sapien
gtgagttcatcagttcatagttttt

SEQ ID NO: 420182 - DNA, 25 bp, Homo sapien
tcttgctgtgctcgttcttccagtg

SEQ ID NO: 420183 - DNA, 25 bp, Homo sapien
gctgtgctcgttcttccagtgcttt

SEQ ID NO: 420184 - DNA, 25 bp, Homo sapien
tgctcgttcttccagtgctttcctt

SEQ ID NO: 420185 - DNA, 25 bp, Homo sapien
tcgttcttccagtgctttccttgcc

SEQ ID NO: 420186 - DNA, 25 bp, Homo sapien
agtgctttccttgcccccagagtaa

SEQ ID NO: 420187 - DNA, 25 bp, Homo sapien
cttgcccccagagtaatccaattat

SEQ ID NO: 420188 - DNA, 25 bp, Homo sapien
cagagtaatccaattatatcagtta

SEQ ID NO: 420189 - DNA, 25 bp, Homo sapien
agatgagaaattactccaggccagg

SEQ ID NO: 420190 - DNA, 25 bp, Homo sapien
gagaaattactccaggccaggcaca

SEQ ID NO: 420191 - DNA, 25 bp, Homo sapien
aggcacagcggcccacgctataatc

SEQ ID NO: 420192 - DNA, 25 bp, Homo sapien
gtgagccacagtggttgcactgact

SEQ ID NO: 420193 - DNA, 25 bp, Homo sapien
atgctggttggttcggtatgtgggg

SEQ ID NO: 420194 - DNA, 25 bp, Homo sapien
tggttcggtatgtggggacctgtaa

SEQ ID NO: 420195 - DNA, 25 bp, Homo sapien
ggagcatttggggagcactcctctg

SEQ ID NO: 420196 - DNA, 25 bp, Homo sapien
ggagcactcctctgacaggtgagaa

SEQ ID NO: 420197 - DNA, 25 bp, Homo sapien
gagcactcctctgacaggtgagaag

SEQ ID NO: 420198 - DNA, 25 bp, Homo sapien
agcactcctctgacaggtgagaaga

SEQ ID NO: 420199 - DNA, 25 bp, Homo sapien
gcactcctctgacaggtgagaagat

SEQ ID NO: 420200 - DNA, 25 bp, Homo sapien
cactcctctgacaggtgagaagatg

SEQ ID NO: 420201 - DNA, 25 bp, Homo sapien
gccccctgtgccgttgttacctgtt

SEQ ID NO: 420202 - DNA, 25 bp, Homo sapien
agctgagcctccatatgtgggatct

SEQ ID NO: 420203 - DNA, 25 bp, Homo sapien
gctgagcctccatatgtgggatctg

SEQ ID NO: 420204 - DNA, 25 bp, Homo sapien
ggagttgctgctgggccatcgaggg

SEQ ID NO: 420205 - DNA, 25 bp, Homo sapien
aatgttctgggtgaccagtcaccta

SEQ ID NO: 420206 - DNA, 25 bp, Homo sapien
tgttctgggtgaccagtcacctact

SEQ ID NO: 420207 - DNA, 25 bp, Homo sapien
ttctgggtgaccagtcacctacttt

SEQ ID NO: 420208 - DNA, 25 bp, Homo sapien
gggtgaccagtcacctactttctga

SEQ ID NO: 420209 - DNA, 25 bp, Homo sapien
ggtgaccagtcacctactttctgat

SEQ ID NO: 420210 - DNA, 25 bp, Homo sapien
tgaccagtcacctactttctgatca

SEQ ID NO: 420211 - DNA, 25 bp, Homo sapien
accagtcacctactttctgatcaat

SEQ ID NO: 420212 - DNA, 25 bp, Homo sapien
ccagtcacctactttctgatcaata

SEQ ID NO: 420213 - DNA, 25 bp, Homo sapien
agtcacctactttctgatcaataaa

SEQ ID NO: 420214 - DNA, 25 bp, Homo sapien
gatcaataaaaatgtcgacatgcat

SEQ ID NO: 420215 - DNA, 25 bp, Homo sapien
tgtgaaaaggaaaacaagttgctca

SEQ ID NO: 420216 - DNA, 25 bp, Homo sapien
gtgaaaaggaaaacaagttgctcag

SEQ ID NO: 420217 - DNA, 25 bp, Homo sapien
tgaaaaggaaaacaagttgctcagc

SEQ ID NO: 420218 - DNA, 25 bp, Homo sapien
gaaaaggaaaacaagttgctcagca

SEQ ID NO: 420219 - DNA, 25 bp, Homo sapien
aaggaaaacaagttgctcagcaagt

SEQ ID NO: 420220 - DNA, 25 bp, Homo sapien
aggaaaacaagttgctcagcaagtg

SEQ ID NO: 420221 - DNA, 25 bp, Homo sapien
ggaaaacaagttgctcagcaagtgg

SEQ ID NO: 420222 - DNA, 25 bp, Homo sapien
gaaaacaagttgctcagcaagtgga

SEQ ID NO: 420223 - DNA, 25 bp, Homo sapien
aaaacaagttgctcagcaagtggac

SEQ ID NO: 420224 - DNA, 25 bp, Homo sapien
aaacaagttgctcagcaagtggaca

SEQ ID NO: 420225 - DNA, 25 bp, Homo sapien
gcagctgctgatgcaaggaatcccc

SEQ ID NO: 420226 - DNA, 25 bp, Homo sapien
tgatgcaaggaatcccctgggctcc

SEQ ID NO: 420227 - DNA, 25 bp, Homo sapien
agcccattcgcctgtgctgagtctt

SEQ ID NO: 420228 - DNA, 25 bp, Homo sapien
tcgcctgtgctgagtcttcctgcag

SEQ ID NO: 420229 - DNA, 25 bp, Homo sapien
aggcctttccttgcctctgtgggac

SEQ ID NO: 420230 - DNA, 25 bp, Homo sapien
ggctggagaagaaaagcctctcatg

SEQ ID NO: 420231 - DNA, 25 bp, Homo sapien
aaagcctctcatgctaacgttgcag

SEQ ID NO: 420232 - DNA, 25 bp, Homo sapien
gctaacgttgcagaccccagagggt

SEQ ID NO: 420233 - DNA, 25 bp, Homo sapien
caaaacgggcggtcgagcagaacgt

SEQ ID NO: 420234 - DNA, 25 bp, Homo sapien
gtcgagcagaacgtgtagccgcgtc

SEQ ID NO: 420235 - DNA, 25 bp, Homo sapien
agcagaacgtgtagccgcgtcccct

SEQ ID NO: 420236 - DNA, 25 bp, Homo sapien
tagaagtatcactggaggatttatt

SEQ ID NO: 420237 - DNA, 25 bp, Homo sapien
gtatttcttaattttagtcctagct

SEQ ID NO: 420238 - DNA, 25 bp, Homo sapien
agtcctagctactaaagtatgtaag

SEQ ID NO: 420239 - DNA, 25 bp, Homo sapien
gctactaaagtatgtaagccttaaa

SEQ ID NO: 420240 - DNA, 25 bp, Homo sapien
tcttaaattagctttatacacaaac

SEQ ID NO: 420241 - DNA, 25 bp, Homo sapien
gaaatgggaggagatagtccactgt

SEQ ID NO: 420242 - DNA, 25 bp, Homo sapien
catttgttaatttatccctcatatc

SEQ ID NO: 420243 - DNA, 25 bp, Homo sapien
ttgttaatttatccctcatatcatg

SEQ ID NO: 420244 - DNA, 25 bp, Homo sapien
tttcttacagcttttgcagttaata

SEQ ID NO: 420245 - DNA, 25 bp, Homo sapien
cagcttttgcagttaatatattcta

SEQ ID NO: 420246 - DNA, 25 bp, Homo sapien
atgtggtatcaatcaataatagaag

SEQ ID NO: 420247 - DNA, 25 bp, Homo sapien
aaaatcacagtttatccctgcacct

SEQ ID NO: 420248 - DNA, 25 bp, Homo sapien
ccctgcaccttcatagattatgttg

SEQ ID NO: 420249 - DNA, 25 bp, Homo sapien
gattatgttgctcgtcttagagacc

SEQ ID NO: 420250 - DNA, 25 bp, Homo sapien
gttgctcgtcttagagaccaccagg

SEQ ID NO: 420251 - DNA, 25 bp, Homo sapien
tagagaccaccaggcagcgaatgga

SEQ ID NO: 420252 - DNA, 25 bp, Homo sapien
cagcgaatggagtcaagcccttgcg

SEQ ID NO: 420253 - DNA, 25 bp, Homo sapien
agagtcctgccctgactacaggact

SEQ ID NO: 420254 - DNA, 25 bp, Homo sapien
gactacaggactagtttctcccatt

SEQ ID NO: 420255 - DNA, 25 bp, Homo sapien
tacaggactagtttctcccattctt

SEQ ID NO: 420256 - DNA, 25 bp, Homo sapien
cattctttccttctccaggataaag

SEQ ID NO: 420257 - DNA, 25 bp, Homo sapien
tccttctccaggataaagttcctca

SEQ ID NO: 420258 - DNA, 25 bp, Homo sapien
gacagctccgttataaactgcactt

SEQ ID NO: 420259 - DNA, 25 bp, Homo sapien
aactgcacttacacagacagctcct

SEQ ID NO: 420260 - DNA, 25 bp, Homo sapien
gagcaggtctccagttgctgacgta

SEQ ID NO: 420261 - DNA, 25 bp, Homo sapien
cagttgctgacgtatattttttcaa

SEQ ID NO: 420262 - DNA, 25 bp, Homo sapien
ttgctggattttcgttcctgttttt

SEQ ID NO: 420263 - DNA, 25 bp, Homo sapien
aagaccaaagactcactgttctatt

SEQ ID NO: 420264 - DNA, 25 bp, Homo sapien
gataaacatctgtctctgcgcattg

SEQ ID NO: 420265 - DNA, 25 bp, Homo sapien
tgcgcattgcagacacccagactgg

SEQ ID NO: 420266 - DNA, 25 bp, Homo sapien
ctgcagctggactgtatgagtagag

SEQ ID NO: 420267 - DNA, 25 bp, Homo sapien
agaggatgtggagcagagtcttttc

SEQ ID NO: 420268 - DNA, 25 bp, Homo sapien
agagtcttttcctgagtgtccgaga

SEQ ID NO: 420269 - DNA, 25 bp, Homo sapien
tggaacttgaagatacgtcacgaaa

SEQ ID NO: 420270 - DNA, 25 bp, Homo sapien
gatacgtcacgaaaatcactataaa

SEQ ID NO: 420271 - DNA, 25 bp, Homo sapien
aaaagtctgatttatgtgtgatgtc

SEQ ID NO: 420272 - DNA, 25 bp, Homo sapien
atatctgtggtgactgacctctgta

SEQ ID NO: 420273 - DNA, 25 bp, Homo sapien
ggtgactgacctctgtatactagaa

SEQ ID NO: 420274 - DNA, 25 bp, Homo sapien
tgtatactagaaacctcaacatctc

SEQ ID NO: 420275 - DNA, 25 bp, Homo sapien
tgctttgcactctgaaaggctaatt

SEQ ID NO: 420276 - DNA, 25 bp, Homo sapien
aaggctaattgggtgaatcttataa

SEQ ID NO: 420277 - DNA, 25 bp, Homo sapien
aggtctagagacagatgtgtgattc

SEQ ID NO: 420278 - DNA, 25 bp, Homo sapien
gattcacaggcatagaagttgtcgc

SEQ ID NO: 420279 - DNA, 25 bp, Homo sapien
aagttgtcgctgaaaccaagtgtgt

SEQ ID NO: 420280 - DNA, 25 bp, Homo sapien
agcctcactggagttgggatgcaac

SEQ ID NO: 420281 - DNA, 25 bp, Homo sapien
ggtggaactgttaatctcttctggt

SEQ ID NO: 420282 - DNA, 25 bp, Homo sapien
tggtatgtccagtaccctggtcaac

SEQ ID NO: 420283 - DNA, 25 bp, Homo sapien
tgtccagtaccctggtcaacacctt

SEQ ID NO: 420284 - DNA, 25 bp, Homo sapien
agtaccctggtcaacaccttcagct

SEQ ID NO: 420285 - DNA, 25 bp, Homo sapien
ttcagcttctcctcaagtacttttc

SEQ ID NO: 420286 - DNA, 25 bp, Homo sapien
gcttctcctcaagtacttttcaggg

SEQ ID NO: 420287 - DNA, 25 bp, Homo sapien
ctcaagtacttttcaggggatccac

SEQ ID NO: 420288 - DNA, 25 bp, Homo sapien
aggggatccactggttaaaggcatc

SEQ ID NO: 420289 - DNA, 25 bp, Homo sapien
gagtaaattctcctttaatctgagg

SEQ ID NO: 420290 - DNA, 25 bp, Homo sapien
taaccaccacgtaattctctctgaa

SEQ ID NO: 420291 - DNA, 25 bp, Homo sapien
ctgtgggcccttgtcaagagctgga

SEQ ID NO: 420292 - DNA, 25 bp, Homo sapien
tgtgggcccttgtcaagagctggag

SEQ ID NO: 420293 - DNA, 25 bp, Homo sapien
gtgggcccttgtcaagagctggagg

SEQ ID NO: 420294 - DNA, 25 bp, Homo sapien
tgggcccttgtcaagagctggaggc

SEQ ID NO: 420295 - DNA, 25 bp, Homo sapien
ggcccttgtcaagagctggaggcca

SEQ ID NO: 420296 - DNA, 25 bp, Homo sapien
gcccttgtcaagagctggaggccac

SEQ ID NO: 420297 - DNA, 25 bp, Homo sapien
gctggaggccactcccaagagcctc

SEQ ID NO: 420298 - DNA, 25 bp, Homo sapien
actcccaagagcctctcctatggca

SEQ ID NO: 420299 - DNA, 25 bp, Homo sapien
tcccaagagcctctcctatggcagc

SEQ ID NO: 420300 - DNA, 25 bp, Homo sapien
gtggaggaggacgaataaatttatt

SEQ ID NO: 420301 - DNA, 25 bp, Homo sapien
tggaggaggacgaataaatttattt

SEQ ID NO: 420302 - DNA, 25 bp, Homo sapien
gccaatgtcaacagcgactctcagc

SEQ ID NO: 420303 - DNA, 25 bp, Homo sapien
cccggctagacccttaaatcagaat

SEQ ID NO: 420304 - DNA, 25 bp, Homo sapien
gaatctctgaggctgggaactgcca

SEQ ID NO: 420305 - DNA, 25 bp, Homo sapien
ctgggaactgccatgctgtgtgtac

SEQ ID NO: 420306 - DNA, 25 bp, Homo sapien
gccatgctgtgtgtactttttacaa

SEQ ID NO: 420307 - DNA, 25 bp, Homo sapien
ggataatcccagactcacatgcagt

SEQ ID NO: 420308 - DNA, 25 bp, Homo sapien
atcccagactcacatgcagttaaag

SEQ ID NO: 420309 - DNA, 25 bp, Homo sapien
ttcgtgtacttggtaccccatttca

SEQ ID NO: 420310 - DNA, 25 bp, Homo sapien
tggtaccccatttcacccaatggta

SEQ ID NO: 420311 - DNA, 25 bp, Homo sapien
gcaaaactctaggataaagcatcac

SEQ ID NO: 420312 - DNA, 25 bp, Homo sapien
taaagcatcacagccagggtgttga

SEQ ID NO: 420313 - DNA, 25 bp, Homo sapien
tttgccgtggacaagacgccaggag

SEQ ID NO: 420314 - DNA, 25 bp, Homo sapien
gacgccaggagctgtatgcttagga

SEQ ID NO: 420315 - DNA, 25 bp, Homo sapien
gttctcatcatcaaattccttgctg

SEQ ID NO: 420316 - DNA, 25 bp, Homo sapien
tgctgtagagggacttgccaccagt

SEQ ID NO: 420317 - DNA, 25 bp, Homo sapien
cacacaccccggaataattctgtaa

SEQ ID NO: 420318 - DNA, 25 bp, Homo sapien
tcaccttgccaaagaccacatgctg

SEQ ID NO: 420319 - DNA, 25 bp, Homo sapien
taaaagcagggacctttatcaccaa

SEQ ID NO: 420320 - DNA, 25 bp, Homo sapien
aaatactttctctccagtgttcaga

SEQ ID NO: 420321 - DNA, 25 bp, Homo sapien
ttctctccagtgttcagagcacaaa

SEQ ID NO: 420322 - DNA, 25 bp, Homo sapien
aaagaccacatgctgtcatccatcc

SEQ ID NO: 420323 - DNA, 25 bp, Homo sapien
atccatcctctgtcttggcagtaca

SEQ ID NO: 420324 - DNA, 25 bp, Homo sapien
gaaatgcagaaccactgagacctgg

SEQ ID NO: 420325 - DNA, 25 bp, Homo sapien
cactgagacctggacaactgttggt

SEQ ID NO: 420326 - DNA, 25 bp, Homo sapien
aactgttggtcttattttctgcttg

SEQ ID NO: 420327 - DNA, 25 bp, Homo sapien
ttctgcttggatgagataccttcct

SEQ ID NO: 420328 - DNA, 25 bp, Homo sapien
gatgagataccttcctgctatttct

SEQ ID NO: 420329 - DNA, 25 bp, Homo sapien
cagctgcctggagtagttaaaattt

SEQ ID NO: 420330 - DNA, 25 bp, Homo sapien
cagtcacagctgaataccaggcagt

SEQ ID NO: 420331 - DNA, 25 bp, Homo sapien
aataccaggcagttggttgagtagt

SEQ ID NO: 420332 - DNA, 25 bp, Homo sapien
tgagtagtgagttcttctggaagat

SEQ ID NO: 420333 - DNA, 25 bp, Homo sapien
gaagatggacgggaaaactgtcaac

SEQ ID NO: 420334 - DNA, 25 bp, Homo sapien
gagacatatttctcttttaggaaga

SEQ ID NO: 420335 - DNA, 25 bp, Homo sapien
ggaggaacatctggcaacaggaacc

SEQ ID NO: 420336 - DNA, 25 bp, Homo sapien
gtaatggatgaggaaggcaaactct

SEQ ID NO: 420337 - DNA, 25 bp, Homo sapien
ggaagtgggctaactggagctaaac

SEQ ID NO: 420338 - DNA, 25 bp, Homo sapien
tggagctaaacttcaggactgtatg

SEQ ID NO: 420339 - DNA, 25 bp, Homo sapien
aggactgtatgagccgagcagttac

SEQ ID NO: 420340 - DNA, 25 bp, Homo sapien
tgagccgagcagttacaagacacaa

SEQ ID NO: 420341 - DNA, 25 bp, Homo sapien
gccgagcagttacaagacacaaaga

SEQ ID NO: 420342 - DNA, 25 bp, Homo sapien
gtaattaagagtatgaaacccaaat

SEQ ID NO: 420343 - DNA, 25 bp, Homo sapien
aaacccaaataaacagccaccacat

SEQ ID NO: 420344 - DNA, 25 bp, Homo sapien
ttgtatttgttaacactgtgcacaa

SEQ ID NO: 420345 - DNA, 25 bp, Homo sapien
gttaacactgtgcacaaacgtttta

SEQ ID NO: 420346 - DNA, 25 bp, Homo sapien
tattaccaaccaaagagatgcatgt

SEQ ID NO: 420347 - DNA, 25 bp, Homo sapien
ccaaccaaagagatgcatgtgcaat

SEQ ID NO: 420348 - DNA, 25 bp, Homo sapien
catgtgcaatagaagccttccttaa

SEQ ID NO: 420349 - DNA, 25 bp, Homo sapien
tgtgcaatagaagccttccttaaaa

SEQ ID NO: 420350 - DNA, 25 bp, Homo sapien
aacaggctaaataacctcattttat

SEQ ID NO: 420351 - DNA, 25 bp, Homo sapien
ataacctcattttatgcagcagttt

SEQ ID NO: 420352 - DNA, 25 bp, Homo sapien
gcagcagtttaatctgagaacagag

SEQ ID NO: 420353 - DNA, 25 bp, Homo sapien
gcagtggttccagaggggccttata

SEQ ID NO: 420354 - DNA, 25 bp, Homo sapien
ttggtgacacctaatggattctttt

SEQ ID NO: 420355 - DNA, 25 bp, Homo sapien
tgacacctaatggattctttttgaa

SEQ ID NO: 420356 - DNA, 25 bp, Homo sapien
ttttgaaattccaaggtgcttcagt

SEQ ID NO: 420357 - DNA, 25 bp, Homo sapien
tagttaattgaaatggaattggcaa

SEQ ID NO: 420358 - DNA, 25 bp, Homo sapien
ttgaaatggaattggcaatgtggga

SEQ ID NO: 420359 - DNA, 25 bp, Homo sapien
tgaaatggaattggcaatgtgggaa

SEQ ID NO: 420360 - DNA, 25 bp, Homo sapien
aaatggaattggcaatgtgggaaat

SEQ ID NO: 420361 - DNA, 25 bp, Homo sapien
aatggaattggcaatgtgggaaata

SEQ ID NO: 420362 - DNA, 25 bp, Homo sapien
atggaattggcaatgtgggaaataa

SEQ ID NO: 420363 - DNA, 25 bp, Homo sapien
tggaattggcaatgtgggaaataag

SEQ ID NO: 420364 - DNA, 25 bp, Homo sapien
ggaattggcaatgtgggaaataaga

SEQ ID NO: 420365 - DNA, 25 bp, Homo sapien
gaattggcaatgtgggaaataagaa

SEQ ID NO: 420366 - DNA, 25 bp, Homo sapien
aattggcaatgtgggaaataagaaa

SEQ ID NO: 420367 - DNA, 25 bp, Homo sapien
attggcaatgtgggaaataagaaat

SEQ ID NO: 420368 - DNA, 25 bp, Homo sapien
ggtttatttatgtacctcttgcaca

SEQ ID NO: 420369 - DNA, 25 bp, Homo sapien
atttatgtacctcttgcacactcat

SEQ ID NO: 420370 - DNA, 25 bp, Homo sapien
gcacactcatcaacctatgcaagtc

SEQ ID NO: 420371 - DNA, 25 bp, Homo sapien
gatggatgggccacctcgtttggaa

SEQ ID NO: 420372 - DNA, 25 bp, Homo sapien
ggccacctcgtttggaatcagcagg

SEQ ID NO: 420373 - DNA, 25 bp, Homo sapien
gaatcagcagggtgtccctctcatg

SEQ ID NO: 420374 - DNA, 25 bp, Homo sapien
tgtcttgttcactctccatcagggt

SEQ ID NO: 420375 - DNA, 25 bp, Homo sapien
ttcactctccatcagggtgagctga

SEQ ID NO: 420376 - DNA, 25 bp, Homo sapien
tctccatcagggtgagctgactgtg

SEQ ID NO: 420377 - DNA, 25 bp, Homo sapien
tgagggacaccgtctcacacacaca

SEQ ID NO: 420378 - DNA, 25 bp, Homo sapien
ggacaccgtctcacacacacaggga

SEQ ID NO: 420379 - DNA, 25 bp, Homo sapien
cattaacacatggagaccgtgccct

SEQ ID NO: 420380 - DNA, 25 bp, Homo sapien
tggctgccagcatggtctgtgtttc

SEQ ID NO: 420381 - DNA, 25 bp, Homo sapien
atggtctgtgtttccttgtggattc

SEQ ID NO: 420382 - DNA, 25 bp, Homo sapien
tttccttgtggattcacctgtggcc

SEQ ID NO: 420383 - DNA, 25 bp, Homo sapien
cagcatggtctgtgtcctcgtggat

SEQ ID NO: 420384 - DNA, 25 bp, Homo sapien
gtgtcctcgtggattcactgcagct

SEQ ID NO: 420385 - DNA, 25 bp, Homo sapien
cactgcagctgtcggatgcgagttt

SEQ ID NO: 420386 - DNA, 25 bp, Homo sapien
gtcggatgcgagtttctgtcataat

SEQ ID NO: 420387 - DNA, 25 bp, Homo sapien
ttctgtcataatcatttgtttcctg

SEQ ID NO: 420388 - DNA, 25 bp, Homo sapien
tgtaaaataatctcctccctcaaat

SEQ ID NO: 420389 - DNA, 25 bp, Homo sapien
atctcctccctcaaatgcaaaggtt

SEQ ID NO: 420390 - DNA, 25 bp, Homo sapien
gtgcacaggtggaataaattcacag

SEQ ID NO: 420391 - DNA, 25 bp, Homo sapien
aattccaatatgctacagtttctag

SEQ ID NO: 420392 - DNA, 25 bp, Homo sapien
gattgtttactcacaagtatttctt

SEQ ID NO: 420393 - DNA, 25 bp, Homo sapien
catgccaagtgaagagtgagtttaa

SEQ ID NO: 420394 - DNA, 25 bp, Homo sapien
gtgagtttaagtcgaccaaaagtca

SEQ ID NO: 420395 - DNA, 25 bp, Homo sapien
gtcgaccaaaagtcatataactgat

SEQ ID NO: 420396 - DNA, 25 bp, Homo sapien
aactgatgtgatataattgcatagc

SEQ ID NO: 420397 - DNA, 25 bp, Homo sapien
attgcatagcatacatagtgagaat

SEQ ID NO: 420398 - DNA, 25 bp, Homo sapien
aaatatcttaccagctttgttatgc

SEQ ID NO: 420399 - DNA, 25 bp, Homo sapien
agctttgttatgctatctcccacag

SEQ ID NO: 420400 - DNA, 25 bp, Homo sapien
gttatgctatctcccacagtgcaca

SEQ ID NO: 420401 - DNA, 25 bp, Homo sapien
caaagaatccaaccctttcatctta

SEQ ID NO: 420402 - DNA, 25 bp, Homo sapien
catgtatgtgttttgtaagctgtga

SEQ ID NO: 420403 - DNA, 25 bp, Homo sapien
taagctgtgagcaccgtaacaaaat

SEQ ID NO: 420404 - DNA, 25 bp, Homo sapien
gaagaagcacccaggccacttgact

SEQ ID NO: 420405 - DNA, 25 bp, Homo sapien
aggccacttgactcccagtctggtg

SEQ ID NO: 420406 - DNA, 25 bp, Homo sapien
agtctggtgccctgtctacaccaga

SEQ ID NO: 420407 - DNA, 25 bp, Homo sapien
gtctacaccagacaacacaggagct

SEQ ID NO: 420408 - DNA, 25 bp, Homo sapien
aggagctgggtcagattcccctcag

SEQ ID NO: 420409 - DNA, 25 bp, Homo sapien
ttcccctcagctgcttaacaaagtt

SEQ ID NO: 420410 - DNA, 25 bp, Homo sapien
agttcctcgaacagaaagtgcttac

SEQ ID NO: 420411 - DNA, 25 bp, Homo sapien
aaagctgccttctcggatactgaaa

SEQ ID NO: 420412 - DNA, 25 bp, Homo sapien
tttaacctgagcgtcctctgctcag

SEQ ID NO: 420413 - DNA, 25 bp, Homo sapien
aacctgagcgtcctctgctcaggat

SEQ ID NO: 420414 - DNA, 25 bp, Homo sapien
tctgctcaggatcataccccagcct

SEQ ID NO: 420415 - DNA, 25 bp, Homo sapien
ccccagcctgcactgagtcaagaag

SEQ ID NO: 420416 - DNA, 25 bp, Homo sapien
ccagcctgcactgagtcaagaagga

SEQ ID NO: 420417 - DNA, 25 bp, Homo sapien
gcctgcactgagtcaagaaggagaa

SEQ ID NO: 420418 - DNA, 25 bp, Homo sapien
gttgggactcccctgagaaagagct

SEQ ID NO: 420419 - DNA, 25 bp, Homo sapien
actcccctgagaaagagctgtgggt

SEQ ID NO: 420420 - DNA, 25 bp, Homo sapien
gagtgagcattgcagagatagggct

SEQ ID NO: 420421 - DNA, 25 bp, Homo sapien
cacactgagtgtgggaagctctgga

SEQ ID NO: 420422 - DNA, 25 bp, Homo sapien
ccagtcacctactttctgatcaata

SEQ ID NO: 420423 - DNA, 25 bp, Homo sapien
ctgcttgcagccagtcactgtgtaa

SEQ ID NO: 420424 - DNA, 25 bp, Homo sapien
gcagccagtcactgtgtaaagcctc

SEQ ID NO: 420425 - DNA, 25 bp, Homo sapien
aaagcctctctgatgtgcacttaag

SEQ ID NO: 420426 - DNA, 25 bp, Homo sapien
ggttctgtgcagtcacaggtcactt

SEQ ID NO: 420427 - DNA, 25 bp, Homo sapien
aggtcacttccttgacaacacaatc

SEQ ID NO: 420428 - DNA, 25 bp, Homo sapien
gacaacacaatcatttctgatcttt

SEQ ID NO: 420429 - DNA, 25 bp, Homo sapien
gatctttatcactgtaaccacgtct

SEQ ID NO: 420430 - DNA, 25 bp, Homo sapien
taaccacgtcttctattccatagga

SEQ ID NO: 420431 - DNA, 25 bp, Homo sapien
agtttcttttgattctctcagttgc

SEQ ID NO: 420432 - DNA, 25 bp, Homo sapien
gattgccatacttagactcactgtg

SEQ ID NO: 420433 - DNA, 25 bp, Homo sapien
gtctccccggccatttcacgaggag

SEQ ID NO: 420434 - DNA, 25 bp, Homo sapien
cctcgcccgcggtgcagtttgatca

SEQ ID NO: 420435 - DNA, 25 bp, Homo sapien
ttcagtttgttcagaactgcattct

SEQ ID NO: 420436 - DNA, 25 bp, Homo sapien
gaagaagcttcttcccaacaccttc

SEQ ID NO: 420437 - DNA, 25 bp, Homo sapien
agcttcttcccaacaccttcatgat

SEQ ID NO: 420438 - DNA, 25 bp, Homo sapien
atccaggtccggagggcagggcaca

SEQ ID NO: 420439 - DNA, 25 bp, Homo sapien
gcagggcacagcaatccacgggtct

SEQ ID NO: 420440 - DNA, 25 bp, Homo sapien
gggcacagcaatccacgggtctctg

SEQ ID NO: 420441 - DNA, 25 bp, Homo sapien
aactgcattcttctggcggagaagc

SEQ ID NO: 420442 - DNA, 25 bp, Homo sapien
gccccactgagcttgcatgtcagac

SEQ ID NO: 420443 - DNA, 25 bp, Homo sapien
gcttgcatgtcagacacacattttc

SEQ ID NO: 420444 - DNA, 25 bp, Homo sapien
ttcttctggcggagaagccctgaga

SEQ ID NO: 420445 - DNA, 25 bp, Homo sapien
caaattatctacattaagtcatctt

SEQ ID NO: 420446 - DNA, 25 bp, Homo sapien
aatctgtttcttctgatttcgaaag

SEQ ID NO: 420447 - DNA, 25 bp, Homo sapien
taatagaaactctgctgtagaacat

SEQ ID NO: 420448 - DNA, 25 bp, Homo sapien
gaaactctgctgtagaacataaact

SEQ ID NO: 420449 - DNA, 25 bp, Homo sapien
aaatgatagttgtctgcaatcccat

SEQ ID NO: 420450 - DNA, 25 bp, Homo sapien
tagttgtctgcaatcccataatccg

SEQ ID NO: 420451 - DNA, 25 bp, Homo sapien
gtctgcaatcccataatccggaaat

SEQ ID NO: 420452 - DNA, 25 bp, Homo sapien
tcccataatccggaaatattgaagt

SEQ ID NO: 420453 - DNA, 25 bp, Homo sapien
attgaagtactgtccgtaacatggt

SEQ ID NO: 420454 - DNA, 25 bp, Homo sapien
gtactgtccgtaacatggttatgac

SEQ ID NO: 420455 - DNA, 25 bp, Homo sapien
tgacatgttaagtggaagggtagaa

SEQ ID NO: 420456 - DNA, 25 bp, Homo sapien
gaaaacagtgatttaaattatgaag

SEQ ID NO: 420457 - DNA, 25 bp, Homo sapien
aaaacagtgatttaaattatgaagt

SEQ ID NO: 420458 - DNA, 25 bp, Homo sapien
taaattatgaagtatggggccaggt

SEQ ID NO: 420459 - DNA, 25 bp, Homo sapien
aaattatgaagtatggggccaggtg

SEQ ID NO: 420460 - DNA, 25 bp, Homo sapien
aattatgaagtatggggccaggtgc

SEQ ID NO: 420461 - DNA, 25 bp, Homo sapien
attatgaagtatggggccaggtgca

SEQ ID NO: 420462 - DNA, 25 bp, Homo sapien
agaggctaaggcaagtgggtcactt

SEQ ID NO: 420463 - DNA, 25 bp, Homo sapien
aggctaaggcaagtgggtcacttga

SEQ ID NO: 420464 - DNA, 25 bp, Homo sapien
aggcacaggaattgcgtgaacccag

SEQ ID NO: 420465 - DNA, 25 bp, Homo sapien
ggcacaggaattgcgtgaacccagg

SEQ ID NO: 420466 - DNA, 25 bp, Homo sapien
cacaggaattgcgtgaacccaggag

SEQ ID NO: 420467 - DNA, 25 bp, Homo sapien
tattgttactccttttagctaccct

SEQ ID NO: 420468 - DNA, 25 bp, Homo sapien
ttagctaccctgaaaaatgatcctt

SEQ ID NO: 420469 - DNA, 25 bp, Homo sapien
aaatgatccttaaaggtggcctagt

SEQ ID NO: 420470 - DNA, 25 bp, Homo sapien
gtggcctagttggtaagactgtttt

SEQ ID NO: 420471 - DNA, 25 bp, Homo sapien
gactgttttatccttaatctgcatt

SEQ ID NO: 420472 - DNA, 25 bp, Homo sapien
aatctgcattcttctttcattgtag

SEQ ID NO: 420473 - DNA, 25 bp, Homo sapien
cagtatttgcaactcattttttctt

SEQ ID NO: 420474 - DNA, 25 bp, Homo sapien
ttgacatttaagaccaaacatctct

SEQ ID NO: 420475 - DNA, 25 bp, Homo sapien
gaccaaacatctcttatgttatctt

SEQ ID NO: 420476 - DNA, 25 bp, Homo sapien
taatgattgcaatgatgtttcttcc

SEQ ID NO: 420477 - DNA, 25 bp, Homo sapien
tgtttcttcctgtgattccacataa

SEQ ID NO: 420478 - DNA, 25 bp, Homo sapien
gtcgagggccaggagctgttctaca

SEQ ID NO: 420479 - DNA, 25 bp, Homo sapien
gagctgttctacacgcccgagatgg

SEQ ID NO: 420480 - DNA, 25 bp, Homo sapien
cgagatggctgaccccaagtcagaa

SEQ ID NO: 420481 - DNA, 25 bp, Homo sapien
gagcattgagagcaccctggacgac

SEQ ID NO: 420482 - DNA, 25 bp, Homo sapien
attgagagcaccctggacgacctct

SEQ ID NO: 420483 - DNA, 25 bp, Homo sapien
tggacgacctcttccggaattcaga

SEQ ID NO: 420484 - DNA, 25 bp, Homo sapien
cctcttccggaattcagacgtcaag

SEQ ID NO: 420485 - DNA, 25 bp, Homo sapien
ggaattcagacgtcaagaaggattt

SEQ ID NO: 420486 - DNA, 25 bp, Homo sapien
atccgtccgcgccattgtggatgtg

SEQ ID NO: 420487 - DNA, 25 bp, Homo sapien
gcgccattgtggatgtgcactttga

SEQ ID NO: 420488 - DNA, 25 bp, Homo sapien
tgctccggcagatccaggtgtccag

SEQ ID NO: 420489 - DNA, 25 bp, Homo sapien
actgcacttacagcaacagtgcttt

SEQ ID NO: 420490 - DNA, 25 bp, Homo sapien
cagtgcttttcaatacttcatgtgg

SEQ ID NO: 420491 - DNA, 25 bp, Homo sapien
caatacttcatgtggtacagacagt

SEQ ID NO: 420492 - DNA, 25 bp, Homo sapien
gtacagacagtattccagaaaaggc

SEQ ID NO: 420493 - DNA, 25 bp, Homo sapien
ccctgagttgctgatgtacacatac

SEQ ID NO: 420494 - DNA, 25 bp, Homo sapien
gatgtacacatactccagtggtaac

SEQ ID NO: 420495 - DNA, 25 bp, Homo sapien
aggtttacagcacaggtcgataaat

SEQ ID NO: 420496 - DNA, 25 bp, Homo sapien
agcacaggtcgataaatccagcaag

SEQ ID NO: 420497 - DNA, 25 bp, Homo sapien
aagtatatctccttgttcatcagag

SEQ ID NO: 420498 - DNA, 25 bp, Homo sapien
tccttgttcatcagagactcacagc

SEQ ID NO: 420499 - DNA, 25 bp, Homo sapien
gcaggatcctggaccactcagtgtt

SEQ ID NO: 420500 - DNA, 25 bp, Homo sapien
tccctggtggttgcagctttctaca

SEQ ID NO: 420501 - DNA, 25 bp, Homo sapien
gtggttgcagctttctacaagattg

SEQ ID NO: 420502 - DNA, 25 bp, Homo sapien
tacaagattgctatggccgaaccaa

SEQ ID NO: 420503 - DNA, 25 bp, Homo sapien
attgctatggccgaaccaagaaaga

SEQ ID NO: 420504 - DNA, 25 bp, Homo sapien
tctggtgctttgacaaaacctccaa

SEQ ID NO: 420505 - DNA, 25 bp, Homo sapien
gtgctttgacaaaacctccaatgca

SEQ ID NO: 420506 - DNA, 25 bp, Homo sapien
gacaaaacctccaatgcatagcctt

SEQ ID NO: 420507 - DNA, 25 bp, Homo sapien
aaacctccaatgcatagccttctgg

SEQ ID NO: 420508 - DNA, 25 bp, Homo sapien
tgcatagccttctggttaagcgtct

SEQ ID NO: 420509 - DNA, 25 bp, Homo sapien
agccttctggttaagcgtctgtgat

SEQ ID NO: 420510 - DNA, 25 bp, Homo sapien
ggttaagcgtctgtgatttcatatt

SEQ ID NO: 420511 - DNA, 25 bp, Homo sapien
gctattgattttcacggctcctatt

SEQ ID NO: 420512 - DNA, 25 bp, Homo sapien
tcagaggctcattcggctggtgatt

SEQ ID NO: 420513 - DNA, 25 bp, Homo sapien
gctggtgattttggtactgtttatt

SEQ ID NO: 420514 - DNA, 25 bp, Homo sapien
acatttgctaaattttctcgtggta

SEQ ID NO: 420515 - DNA, 25 bp, Homo sapien
tttctcgtggtatagttcacttata

SEQ ID NO: 420516 - DNA, 25 bp, Homo sapien
gttcacttataatgacatcactact

SEQ ID NO: 420517 - DNA, 25 bp, Homo sapien
gacatcactactgtgctttaaatat

SEQ ID NO: 420518 - DNA, 25 bp, Homo sapien
gtgtctttaatattttgctggttgc

SEQ ID NO: 420519 - DNA, 25 bp, Homo sapien
gttgcagttcatttagagtagagat

SEQ ID NO: 420520 - DNA, 25 bp, Homo sapien
gagatgtacctcatttaacatagag

SEQ ID NO: 420521 - DNA, 25 bp, Homo sapien
atgtatttctaaaaacttgtgtcta

SEQ ID NO: 420522 - DNA, 25 bp, Homo sapien
tcctaataccaacaccttgaaggta

SEQ ID NO: 420523 - DNA, 25 bp, Homo sapien
cacagcagccactgagtcacatgag

SEQ ID NO: 420524 - DNA, 25 bp, Homo sapien
ctgagtcacatgaggcaagggcaaa

SEQ ID NO: 420525 - DNA, 25 bp, Homo sapien
aacagaggctctggctcgaaggaag

SEQ ID NO: 420526 - DNA, 25 bp, Homo sapien
tgagacagccaacacctcttccaag

SEQ ID NO: 420527 - DNA, 25 bp, Homo sapien
aaggccttccttggtgttgcctcca

SEQ ID NO: 420528 - DNA, 25 bp, Homo sapien
tgttgcctccattccctggaaaggt

SEQ ID NO: 420529 - DNA, 25 bp, Homo sapien
attccctggaaaggtctggctcctg

SEQ ID NO: 420530 - DNA, 25 bp, Homo sapien
ctggctcctgtgttttacatttcag

SEQ ID NO: 420531 - DNA, 25 bp, Homo sapien
gtgtgctcttcccagtagagcggta

SEQ ID NO: 420532 - DNA, 25 bp, Homo sapien
agagcggtaggttactctgggcaca

SEQ ID NO: 420533 - DNA, 25 bp, Homo sapien
tcatcagcaccgagttctccgcgga

SEQ ID NO: 420534 - DNA, 25 bp, Homo sapien
tcagcaccgagttctccgcggagct

SEQ ID NO: 420535 - DNA, 25 bp, Homo sapien
cccaacaacggacagaagtgcacag

SEQ ID NO: 420536 - DNA, 25 bp, Homo sapien
ggacagaagtgcacagagagcccct

SEQ ID NO: 420537 - DNA, 25 bp, Homo sapien
acagaagtgcacagagagcccctcg

SEQ ID NO: 420538 - DNA, 25 bp, Homo sapien
agaagtgcacagagagcccctcgga

SEQ ID NO: 420539 - DNA, 25 bp, Homo sapien
aagtgcacagagagcccctcggacg

SEQ ID NO: 420540 - DNA, 25 bp, Homo sapien
cacagagagcccctcggacgaggac

SEQ ID NO: 420541 - DNA, 25 bp, Homo sapien
gagcccctcggacgaggactacatc

SEQ ID NO: 420542 - DNA, 25 bp, Homo sapien
tggagatctacaagcccactgcccg

SEQ ID NO: 420543 - DNA, 25 bp, Homo sapien
gacaacatgcagctcatcaccaggg

SEQ ID NO: 420544 - DNA, 25 bp, Homo sapien
gaaatggaacccagttcttcttctt

SEQ ID NO: 420545 - DNA, 25 bp, Homo sapien
gaacccagttcttcttctttctgtg

SEQ ID NO: 420546 - DNA, 25 bp, Homo sapien
acaataggctgtgctcatgagaacg

SEQ ID NO: 420547 - DNA, 25 bp, Homo sapien
atgagaacgcattttgtttccacag

SEQ ID NO: 420548 - DNA, 25 bp, Homo sapien
aaatgttttttctcactctgtcctg

SEQ ID NO: 420549 - DNA, 25 bp, Homo sapien
cactctgtcctgattttgatttctg

SEQ ID NO: 420550 - DNA, 25 bp, Homo sapien
gattttgatttctgttaaactcagt

SEQ ID NO: 420551 - DNA, 25 bp, Homo sapien
cccaactcacagttcaccaaaggta

SEQ ID NO: 420552 - DNA, 25 bp, Homo sapien
ttcaccaaaggtatttcatctgttt

SEQ ID NO: 420553 - DNA, 25 bp, Homo sapien
gctgtctagatttatgtgtgctctg

SEQ ID NO: 420554 - DNA, 25 bp, Homo sapien
gtgtgctctgacaagaaatgttttg

SEQ ID NO: 420555 - DNA, 25 bp, Homo sapien
gacaggagtggtgatccaccaggca

SEQ ID NO: 420556 - DNA, 25 bp, Homo sapien
caggagtggtgatccaccaggcaag

SEQ ID NO: 420557 - DNA, 25 bp, Homo sapien
gctggcgaaggcatcctctgggatc

SEQ ID NO: 420558 - DNA, 25 bp, Homo sapien
ggcgaaggcatcctctgggatccct

SEQ ID NO: 420559 - DNA, 25 bp, Homo sapien
gaaggcatcctctgggatccctggc

SEQ ID NO: 420560 - DNA, 25 bp, Homo sapien
agagccccgctgaagggagccacag

SEQ ID NO: 420561 - DNA, 25 bp, Homo sapien
agccccgctgaagggagccacagtg

SEQ ID NO: 420562 - DNA, 25 bp, Homo sapien
ccccgctgaagggagccacagtgag

SEQ ID NO: 420563 - DNA, 25 bp, Homo sapien
ccgctgaagggagccacagtgagcc

SEQ ID NO: 420564 - DNA, 25 bp, Homo sapien
tgagccctgggcacaggtgggacag

SEQ ID NO: 420565 - DNA, 25 bp, Homo sapien
acaggtgggacaggcctcgagtcct

SEQ ID NO: 420566 - DNA, 25 bp, Homo sapien
gatcagttttgatcacatcacaggg

SEQ ID NO: 420567 - DNA, 25 bp, Homo sapien
gatcacatcacagggaatttgagag

SEQ ID NO: 420568 - DNA, 25 bp, Homo sapien
aaatgtattcacagaggcttattac

SEQ ID NO: 420569 - DNA, 25 bp, Homo sapien
tatcattaccactgtcatcttgacc

SEQ ID NO: 420570 - DNA, 25 bp, Homo sapien
atcttgacccttaccacatcattat

SEQ ID NO: 420571 - DNA, 25 bp, Homo sapien
gacccttaccacatcattatgttga

SEQ ID NO: 420572 - DNA, 25 bp, Homo sapien
cattatgttgattccaaacctcaga

SEQ ID NO: 420573 - DNA, 25 bp, Homo sapien
aaacctcagaaaacgtcatctaaag

SEQ ID NO: 420574 - DNA, 25 bp, Homo sapien
atgtcagggaactggtgctatttta

SEQ ID NO: 420575 - DNA, 25 bp, Homo sapien
tgctattttagcaaaagccagaagc

SEQ ID NO: 420576 - DNA, 25 bp, Homo sapien
aaagccagaagcataatttaccaga

SEQ ID NO: 420577 - DNA, 25 bp, Homo sapien
ccatgggagctattgattttcacgg

SEQ ID NO: 420578 - DNA, 25 bp, Homo sapien
catgggagctattgattttcacggc

SEQ ID NO: 420579 - DNA, 25 bp, Homo sapien
atgggagctattgattttcacggct

SEQ ID NO: 420580 - DNA, 25 bp, Homo sapien
tgggagctattgattttcacggctc

SEQ ID NO: 420581 - DNA, 25 bp, Homo sapien
gggagctattgattttcacggctcc

SEQ ID NO: 420582 - DNA, 25 bp, Homo sapien
ggagctattgattttcacggctcct

SEQ ID NO: 420583 - DNA, 25 bp, Homo sapien
gagctattgattttcacggctccta

SEQ ID NO: 420584 - DNA, 25 bp, Homo sapien
agctattgattttcacggctcctat

SEQ ID NO: 420585 - DNA, 25 bp, Homo sapien
gctattgattttcacggctcctatt

SEQ ID NO: 420586 - DNA, 25 bp, Homo sapien
ctattgattttcacggctcctattc

SEQ ID NO: 420587 - DNA, 25 bp, Homo sapien
cagaaattcacctcgttcacgatct

SEQ ID NO: 420588 - DNA, 25 bp, Homo sapien
aattcacctcgttcacgatctcctg

SEQ ID NO: 420589 - DNA, 25 bp, Homo sapien
agaatatagtagagtgtccccacag

SEQ ID NO: 420590 - DNA, 25 bp, Homo sapien
tatagtagagtgtccccacagccta

SEQ ID NO: 420591 - DNA, 25 bp, Homo sapien
gagtgtccccacagcctatgattag

SEQ ID NO: 420592 - DNA, 25 bp, Homo sapien
acagcctatgattagccgcttacag

SEQ ID NO: 420593 - DNA, 25 bp, Homo sapien
tgattagccgcttacagcaacctcg

SEQ ID NO: 420594 - DNA, 25 bp, Homo sapien
agcaacctcgcctttcacttcaagg

SEQ ID NO: 420595 - DNA, 25 bp, Homo sapien
acttcaaggccatcccacagattta

SEQ ID NO: 420596 - DNA, 25 bp, Homo sapien
ggccatcccacagatttacagacaa

SEQ ID NO: 420597 - DNA, 25 bp, Homo sapien
tcccacagatttacagacaagcaat

SEQ ID NO: 420598 - DNA, 25 bp, Homo sapien
cagatcagtctgagctatgcgaaat

SEQ ID NO: 420599 - DNA, 25 bp, Homo sapien
cagtctgagctatgcgaaatgtatc

SEQ ID NO: 420600 - DNA, 25 bp, Homo sapien
gctatgcgaaatgtatcaggcccag

SEQ ID NO: 420601 - DNA, 25 bp, Homo sapien
atgcgaaatgtatcaggcccaggga

SEQ ID NO: 420602 - DNA, 25 bp, Homo sapien
cgaaatgtatcaggcccagggagac

SEQ ID NO: 420603 - DNA, 25 bp, Homo sapien
atgtatcaggcccagggagactgta

SEQ ID NO: 420604 - DNA, 25 bp, Homo sapien
tcaggcccagggagactgtacagtg

SEQ ID NO: 420605 - DNA, 25 bp, Homo sapien
gcccagggagactgtacagtgaata

SEQ ID NO: 420606 - DNA, 25 bp, Homo sapien
tgaataggggacttcggtcacacgc

SEQ ID NO: 420607 - DNA, 25 bp, Homo sapien
catgcccgaggcagtggttcctgca

SEQ ID NO: 420608 - DNA, 25 bp, Homo sapien
tgcccgaggcagtggttcctgcaca

SEQ ID NO: 420609 - DNA, 25 bp, Homo sapien
ggattaacatctttctcttgacact

SEQ ID NO: 420610 - DNA, 25 bp, Homo sapien
cactgagactgggttctcctgggaa

SEQ ID NO: 420611 - DNA, 25 bp, Homo sapien
gttagttcccaagagagtgagttgt

SEQ ID NO: 420612 - DNA, 25 bp, Homo sapien
atgctgcctcttctattttgcgctt

SEQ ID NO: 420613 - DNA, 25 bp, Homo sapien
attttgcgctttttgtttgcacaaa

SEQ ID NO: 420614 - DNA, 25 bp, Homo sapien
ttgtttgcacaaactcggtcccctt

SEQ ID NO: 420615 - DNA, 25 bp, Homo sapien
cttctgtttctctacgatgttttga

SEQ ID NO: 420616 - DNA, 25 bp, Homo sapien
gttttgatgcagcatgaggcagtca

SEQ ID NO: 420617 - DNA, 25 bp, Homo sapien
gaggcagtcatgagaacccaccaga

SEQ ID NO: 420618 - DNA, 25 bp, Homo sapien
catgagaacccaccagatacagctg

SEQ ID NO: 420619 - DNA, 25 bp, Homo sapien
gatacagctgcctgatcctgaattt

SEQ ID NO: 420620 - DNA, 25 bp, Homo sapien
catggctgtatcttttgtagctgag

SEQ ID NO: 420621 - DNA, 25 bp, Homo sapien
gctgtatcttttgtagctgagagtg

SEQ ID NO: 420622 - DNA, 25 bp, Homo sapien
tatcttttgtagctgagagtgaagc

SEQ ID NO: 420623 - DNA, 25 bp, Homo sapien
acatctcagtaagtaaatgatcatt

SEQ ID NO: 420624 - DNA, 25 bp, Homo sapien
gatcattgggtaatagtgatttaca

SEQ ID NO: 420625 - DNA, 25 bp, Homo sapien
aatagtgatttacatatgcgcataa

SEQ ID NO: 420626 - DNA, 25 bp, Homo sapien
atgcgcataaaatgcagatatggct

SEQ ID NO: 420627 - DNA, 25 bp, Homo sapien
cagatatggctgcattttatgttaa

SEQ ID NO: 420628 - DNA, 25 bp, Homo sapien
gatatggctgcattttatgttaaaa

SEQ ID NO: 420629 - DNA, 25 bp, Homo sapien
aaacagtaacactatgtcatggtca

SEQ ID NO: 420630 - DNA, 25 bp, Homo sapien
gtcatggtcaataacatgtggtaaa

SEQ ID NO: 420631 - DNA, 25 bp, Homo sapien
gggctccagtactgagtgtatctac

SEQ ID NO: 420632 - DNA, 25 bp, Homo sapien
ctgagtgtatctacagtgctatggg

SEQ ID NO: 420633 - DNA, 25 bp, Homo sapien
gggacacctaggagaacctctacca

SEQ ID NO: 420634 - DNA, 25 bp, Homo sapien
cctctaccagtctgagatgggcttg

SEQ ID NO: 420635 - DNA, 25 bp, Homo sapien
accagtctgagatgggcttgctgtg

SEQ ID NO: 420636 - DNA, 25 bp, Homo sapien
gcttgctgtgggtaagacagtgaaa

SEQ ID NO: 420637 - DNA, 25 bp, Homo sapien
gaatagaaaaacactctggacagag

SEQ ID NO: 420638 - DNA, 25 bp, Homo sapien
atgagtgagaaaaagcctgggagct

SEQ ID NO: 420639 - DNA, 25 bp, Homo sapien
gtaagaagcaatctgctttctcagc

SEQ ID NO: 420640 - DNA, 25 bp, Homo sapien
aagcaatctgctttctcagccatct

SEQ ID NO: 420641 - DNA, 25 bp, Homo sapien
aatctgctttctcagccatcttggc

SEQ ID NO: 420642 - DNA, 25 bp, Homo sapien
aaatattagtgtccattctgtatga

SEQ ID NO: 420643 - DNA, 25 bp, Homo sapien
gtgtccattctgtatgactcgctaa

SEQ ID NO: 420644 - DNA, 25 bp, Homo sapien
attctgtatgactcgctaacctact

SEQ ID NO: 420645 - DNA, 25 bp, Homo sapien
tatgactcgctaacctactttgcaa

SEQ ID NO: 420646 - DNA, 25 bp, Homo sapien
ctcgctaacctactttgcaaggctt

SEQ ID NO: 420647 - DNA, 25 bp, Homo sapien
gggcaacattttagctcattaactt

SEQ ID NO: 420648 - DNA, 25 bp, Homo sapien
cattaacttcaagatgatgtgtcat

SEQ ID NO: 420649 - DNA, 25 bp, Homo sapien
gatgtgtcatctgtataggtcaaag

SEQ ID NO: 420650 - DNA, 25 bp, Homo sapien
gaatgggacttctgaactgaggaat

SEQ ID NO: 420651 - DNA, 25 bp, Homo sapien
actgaggaatttgctgttgacagcc

SEQ ID NO: 420652 - DNA, 25 bp, Homo sapien
gctgttgacagccaaagtatagtgt

SEQ ID NO: 420653 - DNA, 25 bp, Homo sapien
gaagacctggagtttggcacagcag

SEQ ID NO: 420654 - DNA, 25 bp, Homo sapien
aagacctggagtttggcacagcagg

SEQ ID NO: 420655 - DNA, 25 bp, Homo sapien
ggtagaagaaggtgcacctccaccc

SEQ ID NO: 420656 - DNA, 25 bp, Homo sapien
tgagtctcccccaaaggtgcagcca

SEQ ID NO: 420657 - DNA, 25 bp, Homo sapien
caaaggtgcagccagaacccgaacc

SEQ ID NO: 420658 - DNA, 25 bp, Homo sapien
ggtgcagccagaacccgaacccgaa

SEQ ID NO: 420659 - DNA, 25 bp, Homo sapien
cgaacccgggctgcttttggaagtg

SEQ ID NO: 420660 - DNA, 25 bp, Homo sapien
gagcgtggggctgacacagctccca

SEQ ID NO: 420661 - DNA, 25 bp, Homo sapien
tgaagcgctcccctcccagggagag

SEQ ID NO: 420662 - DNA, 25 bp, Homo sapien
ccctccccaggagcttgttgaagaa

SEQ ID NO: 420663 - DNA, 25 bp, Homo sapien
cctccccaggagcttgttgaagaag

SEQ ID NO: 420664 - DNA, 25 bp, Homo sapien
gttgcatctcacttcatggaagtag

SEQ ID NO: 420665 - DNA, 25 bp, Homo sapien
agaagttccctctggatccttttct

SEQ ID NO: 420666 - DNA, 25 bp, Homo sapien
ggatccttttcttgacaagcagtca

SEQ ID NO: 420667 - DNA, 25 bp, Homo sapien
gtcaagaggaaggtccccatacaca

SEQ ID NO: 420668 - DNA, 25 bp, Homo sapien
gtccccatacacatgtacctgtgtg

SEQ ID NO: 420669 - DNA, 25 bp, Homo sapien
atggtgctacataagcgttgctgtt

SEQ ID NO: 420670 - DNA, 25 bp, Homo sapien
agcgttgctgttaggctgggatcct

SEQ ID NO: 420671 - DNA, 25 bp, Homo sapien
ggctgggatcctattaatgaacgtt

SEQ ID NO: 420672 - DNA, 25 bp, Homo sapien
gaaaggctaccaggacagcatttat

SEQ ID NO: 420673 - DNA, 25 bp, Homo sapien
tgtagaatgggagccttcttccctc

SEQ ID NO: 420674 - DNA, 25 bp, Homo sapien
cccctccactttcattttagcatga

SEQ ID NO: 420675 - DNA, 25 bp, Homo sapien
gctgactgtccaatcaaagtttttg

SEQ ID NO: 420676 - DNA, 25 bp, Homo sapien
aagcatgccatgtgacaaatgcctg

SEQ ID NO: 420677 - DNA, 25 bp, Homo sapien
gcctggcatattcagtaaggaacat

SEQ ID NO: 420678 - DNA, 25 bp, Homo sapien
aattaacacatgacttcagagaagt

SEQ ID NO: 420679 - DNA, 25 bp, Homo sapien
gaagtctttcgttaatcagcacatg

SEQ ID NO: 420680 - DNA, 25 bp, Homo sapien
tcagcacatggatcttggttatttg

SEQ ID NO: 420681 - DNA, 25 bp, Homo sapien
tggatcttggttatttgtacccttt

SEQ ID NO: 420682 - DNA, 25 bp, Homo sapien
gggaaaatttcacactcagatgcaa

SEQ ID NO: 420683 - DNA, 25 bp, Homo sapien
actcagatgcaaaaataccaggcta

SEQ ID NO: 420684 - DNA, 25 bp, Homo sapien
taccaggctaaatacattgctttgt

SEQ ID NO: 420685 - DNA, 25 bp, Homo sapien
gaggatattcatcacaatggtacta

SEQ ID NO: 420686 - DNA, 25 bp, Homo sapien
tctgtttgggaaaatctaaggattt

SEQ ID NO: 420687 - DNA, 25 bp, Homo sapien
aggatttactgtggttagtcttaca

SEQ ID NO: 420688 - DNA, 25 bp, Homo sapien
gtggatttgataaactagtgcctat

SEQ ID NO: 420689 - DNA, 25 bp, Homo sapien
taaactagtgcctatgattttaact

SEQ ID NO: 420690 - DNA, 25 bp, Homo sapien
gcctatgattttaacttatgtttga

SEQ ID NO: 420691 - DNA, 25 bp, Homo sapien
tgattattttgtgccaacagcccag

SEQ ID NO: 420692 - DNA, 25 bp, Homo sapien
ttttgtgccaacagcccagaattgt

SEQ ID NO: 420693 - DNA, 25 bp, Homo sapien
gccaacagcccagaattgtcactta

SEQ ID NO: 420694 - DNA, 25 bp, Homo sapien
agcccagaattgtcacttatatgta

SEQ ID NO: 420695 - DNA, 25 bp, Homo sapien
gaattgtcacttatatgtaagcaga

SEQ ID NO: 420696 - DNA, 25 bp, Homo sapien
gcagaaaacaatgagctctgcttcc

SEQ ID NO: 420697 - DNA, 25 bp, Homo sapien
ttttctttttacctttgccagagtg

SEQ ID NO: 420698 - DNA, 25 bp, Homo sapien
ctttttacctttgccagagtgtggg

SEQ ID NO: 420699 - DNA, 25 bp, Homo sapien
gggcctgccagggtgtatagccctt

SEQ ID NO: 420700 - DNA, 25 bp, Homo sapien
gtatagcccttcctgcttggtggag

SEQ ID NO: 420701 - DNA, 25 bp, Homo sapien
ttcctgcttggtggaggccagtcag

SEQ ID NO: 420702 - DNA, 25 bp, Homo sapien
aaggaggccagttccagtgtagccc

SEQ ID NO: 420703 - DNA, 25 bp, Homo sapien
tatcccctccagatgtgctgcttct

SEQ ID NO: 420704 - DNA, 25 bp, Homo sapien
tggctgtgcactcagtgactgccct

SEQ ID NO: 420705 - DNA, 25 bp, Homo sapien
cactgctcaaccctgtgctgtgtgg

SEQ ID NO: 420706 - DNA, 25 bp, Homo sapien
gtggtgtgtttctttccccactgac

SEQ ID NO: 420707 - DNA, 25 bp, Homo sapien
gtttctttccccactgacagtgaat

SEQ ID NO: 420708 - DNA, 25 bp, Homo sapien
gtttggcacagcaggaggggaggta

SEQ ID NO: 420709 - DNA, 25 bp, Homo sapien
gagcgtggggctgacacagctccca

SEQ ID NO: 420710 - DNA, 25 bp, Homo sapien
agcgtggggctgacacagctcccac

SEQ ID NO: 420711 - DNA, 25 bp, Homo sapien
gcgtggggctgacacagctcccacc

SEQ ID NO: 420712 - DNA, 25 bp, Homo sapien
cgtggggctgacacagctcccaccc

SEQ ID NO: 420713 - DNA, 25 bp, Homo sapien
ggaaagccctgcggcagggccccct

SEQ ID NO: 420714 - DNA, 25 bp, Homo sapien
gaaagccctgcggcagggccccctc

SEQ ID NO: 420715 - DNA, 25 bp, Homo sapien
gccctgcggcagggccccctcccca

SEQ ID NO: 420716 - DNA, 25 bp, Homo sapien
ccctgcggcagggccccctccccag

SEQ ID NO: 420717 - DNA, 25 bp, Homo sapien
gtggactgaggctgcgctgcccggg

SEQ ID NO: 420718 - DNA, 25 bp, Homo sapien
tgcccagctcagagtgcccgtcagg

SEQ ID NO: 420719 - DNA, 25 bp, Homo sapien
ctcagagtgcccgtcagggcctgtg

SEQ ID NO: 420720 - DNA, 25 bp, Homo sapien
tcagagtgcccgtcagggcctgtgc

SEQ ID NO: 420721 - DNA, 25 bp, Homo sapien
agagtgcccgtcagggcctgtgcat

SEQ ID NO: 420722 - DNA, 25 bp, Homo sapien
gagtgcccgtcagggcctgtgcatc

SEQ ID NO: 420723 - DNA, 25 bp, Homo sapien
cagggcctgtgcatccgcacgcgga

SEQ ID NO: 420724 - DNA, 25 bp, Homo sapien
agggcctgtgcatccgcacgcggag

SEQ ID NO: 420725 - DNA, 25 bp, Homo sapien
tgtgcatccgcacgcggagccgtct

SEQ ID NO: 420726 - DNA, 25 bp, Homo sapien
tgccagccccgtgttagcacctggg

SEQ ID NO: 420727 - DNA, 25 bp, Homo sapien
gccccgtgttagcacctgggcctca

SEQ ID NO: 420728 - DNA, 25 bp, Homo sapien
gccatggaatgccatatcctcccca

SEQ ID NO: 420729 - DNA, 25 bp, Homo sapien
attatctcccccttgtctggataat

SEQ ID NO: 420730 - DNA, 25 bp, Homo sapien
ccccttgtctggataattcctactc

SEQ ID NO: 420731 - DNA, 25 bp, Homo sapien
aattcctactcatcctacaatactg

SEQ ID NO: 420732 - DNA, 25 bp, Homo sapien
cctactcatcctacaatactgattt

SEQ ID NO: 420733 - DNA, 25 bp, Homo sapien
caatactgattttatctgtgcaaag

SEQ ID NO: 420734 - DNA, 25 bp, Homo sapien
acaggggtttcctctggcttctcca

SEQ ID NO: 420735 - DNA, 25 bp, Homo sapien
acagcccttagcaccctggggagga

SEQ ID NO: 420736 - DNA, 25 bp, Homo sapien
aggaggtgttgctgtccaggtaaat

SEQ ID NO: 420737 - DNA, 25 bp, Homo sapien
gcctacccacaaacaggacctgcat

SEQ ID NO: 420738 - DNA, 25 bp, Homo sapien
ggacctgcatcctgtctcacaaata

SEQ ID NO: 420739 - DNA, 25 bp, Homo sapien
ttttatttcccctcagagctgtgaa

SEQ ID NO: 420740 - DNA, 25 bp, Homo sapien
ctcagagctgtgaatgggcaggtct

SEQ ID NO: 420741 - DNA, 25 bp, Homo sapien
aggtctgtctctggtttggcatcac

SEQ ID NO: 420742 - DNA, 25 bp, Homo sapien
ctggtttggcatcactgagtttttc

SEQ ID NO: 420743 - DNA, 25 bp, Homo sapien
tttttcccatgcattggccccaggg

SEQ ID NO: 420744 - DNA, 25 bp, Homo sapien
cccagggctgctaggatgtgagaca

SEQ ID NO: 420745 - DNA, 25 bp, Homo sapien
ggatgtgagacaaatctccctacaa

SEQ ID NO: 420746 - DNA, 25 bp, Homo sapien
aaatctccctacaatgggcttgctc

SEQ ID NO: 420747 - DNA, 25 bp, Homo sapien
ttgctcccattgtctgtacagttta

SEQ ID NO: 420748 - DNA, 25 bp, Homo sapien
gatgctggcatgtcggaggttaccc

SEQ ID NO: 420749 - DNA, 25 bp, Homo sapien
catgtcggaggttacccatgagtca

SEQ ID NO: 420750 - DNA, 25 bp, Homo sapien
ttgaatcattgttagtccgggacct

SEQ ID NO: 420751 - DNA, 25 bp, Homo sapien
gttagtccgggaccttcagtactgc

SEQ ID NO: 420752 - DNA, 25 bp, Homo sapien
gaccttcagtactgccaagtcccag

SEQ ID NO: 420753 - DNA, 25 bp, Homo sapien
tgccaagtcccagagaaaacgcttt

SEQ ID NO: 420754 - DNA, 25 bp, Homo sapien
gtcccagagaaaacgcttttactct

SEQ ID NO: 420755 - DNA, 25 bp, Homo sapien
tgatggctcattagatctgtccctt

SEQ ID NO: 420756 - DNA, 25 bp, Homo sapien
ttagatctgtcccttccccgaggtc

SEQ ID NO: 420757 - DNA, 25 bp, Homo sapien
ccgaggtccgtgtgtgactttgagc

SEQ ID NO: 420758 - DNA, 25 bp, Homo sapien
acttgagtttttccaatgtgctgta

SEQ ID NO: 420759 - DNA, 25 bp, Homo sapien
ttccaatgtgctgtaaagtgtttta

SEQ ID NO: 420760 - DNA, 25 bp, Homo sapien
attgtaaattgctcatctcaataaa

SEQ ID NO: 420761 - DNA, 25 bp, Homo sapien
ggccttgaaacgctttgtcatgctt

SEQ ID NO: 420762 - DNA, 25 bp, Homo sapien
aaacgctttgtcatgcttcttcagt

SEQ ID NO: 420763 - DNA, 25 bp, Homo sapien
ctttgtcatgcttcttcagtaccat

SEQ ID NO: 420764 - DNA, 25 bp, Homo sapien
atgcttcttcagtaccatggatttg

SEQ ID NO: 420765 - DNA, 25 bp, Homo sapien
cagtaccatggatttgaaatgaact

SEQ ID NO: 420766 - DNA, 25 bp, Homo sapien
ccaggagcccttgagaagtttatct

SEQ ID NO: 420767 - DNA, 25 bp, Homo sapien
tatctatgactatgaaactggcaac

SEQ ID NO: 420768 - DNA, 25 bp, Homo sapien
tatgaaactggcaacgtcaccccag

SEQ ID NO: 420769 - DNA, 25 bp, Homo sapien
aacgtcaccccagaattacggtcag

SEQ ID NO: 420770 - DNA, 25 bp, Homo sapien
accccagaattacggtcagccttat

SEQ ID NO: 420771 - DNA, 25 bp, Homo sapien
gaattacggtcagccttattcccct

SEQ ID NO: 420772 - DNA, 25 bp, Homo sapien
gaaatctgaaatgttccaaaacctg

SEQ ID NO: 420773 - DNA, 25 bp, Homo sapien
gcgcccggcctaacctgaaacttct

SEQ ID NO: 420774 - DNA, 25 bp, Homo sapien
ccggcctaacctgaaacttcttgag

SEQ ID NO: 420775 - DNA, 25 bp, Homo sapien
aacttcttgagtactgaagtgacac

SEQ ID NO: 420776 - DNA, 25 bp, Homo sapien
ttcttgagtactgaagtgacactca

SEQ ID NO: 420777 - DNA, 25 bp, Homo sapien
gtgacactcaaagaactactcattg

SEQ ID NO: 420778 - DNA, 25 bp, Homo sapien
gacactcaaagaactactcattgga

SEQ ID NO: 420779 - DNA, 25 bp, Homo sapien
actcaaagaactactcattggagca

SEQ ID NO: 420780 - DNA, 25 bp, Homo sapien
caaagaactactcattggagcagtt

SEQ ID NO: 420781 - DNA, 25 bp, Homo sapien
gaactactcattggagcagttcaga

SEQ ID NO: 420782 - DNA, 25 bp, Homo sapien
actcattggagcagttcagattttg

SEQ ID NO: 420783 - DNA, 25 bp, Homo sapien
aatgaagctgtagaagccaatagaa

SEQ ID NO: 420784 - DNA, 25 bp, Homo sapien
atgaagctgtagaagccaatagaaa

SEQ ID NO: 420785 - DNA, 25 bp, Homo sapien
tgaagctgtagaagccaatagaaaa

SEQ ID NO: 420786 - DNA, 25 bp, Homo sapien
gaagctgtagaagccaatagaaaat

SEQ ID NO: 420787 - DNA, 25 bp, Homo sapien
agctgtagaagccaatagaaaattt

SEQ ID NO: 420788 - DNA, 25 bp, Homo sapien
gctgtagaagccaatagaaaatttc

SEQ ID NO: 420789 - DNA, 25 bp, Homo sapien
ctgtagaagccaatagaaaatttca

SEQ ID NO: 420790 - DNA, 25 bp, Homo sapien
gtagaagccaatagaaaatttcaag

SEQ ID NO: 420791 - DNA, 25 bp, Homo sapien
tagaagccaatagaaaatttcaaga

SEQ ID NO: 420792 - DNA, 25 bp, Homo sapien
ttcaagaagtaagagatccttggcc

SEQ ID NO: 420793 - DNA, 25 bp, Homo sapien
tcaagaagtaagagatccttggcca

SEQ ID NO: 420794 - DNA, 25 bp, Homo sapien
gtcaacttgccatcgtttcatgata

SEQ ID NO: 420795 - DNA, 25 bp, Homo sapien
gccatcgtttcatgataacaaccat

SEQ ID NO: 420796 - DNA, 25 bp, Homo sapien
aaagacaggacacgctttccatcgt

SEQ ID NO: 420797 - DNA, 25 bp, Homo sapien
cgctttccatcgttcagtatttgat

SEQ ID NO: 420798 - DNA, 25 bp, Homo sapien
tgatgacacaaaattccagttctaa

SEQ ID NO: 420799 - DNA, 25 bp, Homo sapien
tgggcatcaacttctagcactacga

SEQ ID NO: 420800 - DNA, 25 bp, Homo sapien
tagcactacgagtgtggctcccact

SEQ ID NO: 420801 - DNA, 25 bp, Homo sapien
gtgtggctcccacttggacaagata

SEQ ID NO: 420802 - DNA, 25 bp, Homo sapien
cttggacaagataccgagcttcgtt

SEQ ID NO: 420803 - DNA, 25 bp, Homo sapien
ccgagcttcgttatgcagtttttaa

SEQ ID NO: 420804 - DNA, 25 bp, Homo sapien
atatctgggaagtcaacttgccatc

SEQ ID NO: 420805 - DNA, 25 bp, Homo sapien
gtgattgtcaaaaatgttgctactc

SEQ ID NO: 420806 - DNA, 25 bp, Homo sapien
ttgtcaaaaatgttgctactctggg

SEQ ID NO: 420807 - DNA, 25 bp, Homo sapien
gtcaaaaatgttgctactctgggcc

SEQ ID NO: 420808 - DNA, 25 bp, Homo sapien
caaaaatgttgctactctgggccac

SEQ ID NO: 420809 - DNA, 25 bp, Homo sapien
aaaaatgttgctactctgggccacg

SEQ ID NO: 420810 - DNA, 25 bp, Homo sapien
aaaatgttgctactctgggccacgt

SEQ ID NO: 420811 - DNA, 25 bp, Homo sapien
aaatgttgctactctgggccacgtg

SEQ ID NO: 420812 - DNA, 25 bp, Homo sapien
aatgttgctactctgggccacgtgc

SEQ ID NO: 420813 - DNA, 25 bp, Homo sapien
atgttgctactctgggccacgtgcg

SEQ ID NO: 420814 - DNA, 25 bp, Homo sapien
tgttgctactctgggccacgtgcgg

SEQ ID NO: 420815 - DNA, 25 bp, Homo sapien
ttgctactctgggccacgtgcggtg

SEQ ID NO: 420816 - DNA, 25 bp, Homo sapien
gggaaacaagtcaaacaaactcagg

SEQ ID NO: 420817 - DNA, 25 bp, Homo sapien
aacaagtcaaacaaactcaggtgtg

SEQ ID NO: 420818 - DNA, 25 bp, Homo sapien
agtcaaacaaactcaggtgtgtcac

SEQ ID NO: 420819 - DNA, 25 bp, Homo sapien
aacaaactcaggtgtgtcacttggg

SEQ ID NO: 420820 - DNA, 25 bp, Homo sapien
aatgaggcttttccagtccagaggg

SEQ ID NO: 420821 - DNA, 25 bp, Homo sapien
gcttttccagtccagaggggccacc

SEQ ID NO: 420822 - DNA, 25 bp, Homo sapien
cagatcagtctgagctatgcgaaat

SEQ ID NO: 420823 - DNA, 25 bp, Homo sapien
atgcgaaatgtatcaggcccaggga

SEQ ID NO: 420824 - DNA, 25 bp, Homo sapien
atgcccgaggcagtggttcctgcac

SEQ ID NO: 420825 - DNA, 25 bp, Homo sapien
cacacaagtcccacaaactcaggtg

SEQ ID NO: 420826 - DNA, 25 bp, Homo sapien
agtcccacaaactcaggtgtgtcac

SEQ ID NO: 420827 - DNA, 25 bp, Homo sapien
aaccttgattatgcaacaccttagc

SEQ ID NO: 420828 - DNA, 25 bp, Homo sapien
gcaacaccttagcatagaaagttac

SEQ ID NO: 420829 - DNA, 25 bp, Homo sapien
atgtgctgactactcatctactgta

SEQ ID NO: 420830 - DNA, 25 bp, Homo sapien
gactactcatctactgtattttagg

SEQ ID NO: 420831 - DNA, 25 bp, Homo sapien
gctgttgctttaattgcccgggtaa

SEQ ID NO: 420832 - DNA, 25 bp, Homo sapien
ggaaatacaattaggctgcctttct

SEQ ID NO: 420833 - DNA, 25 bp, Homo sapien
ttctcttcccctatgtagactgtaa

SEQ ID NO: 420834 - DNA, 25 bp, Homo sapien
ataactgtagatctttctcttgttt

SEQ ID NO: 420835 - DNA, 25 bp, Homo sapien
tgcccgggtaaataattctgcctcg

SEQ ID NO: 420836 - DNA, 25 bp, Homo sapien
aataattctgcctcggtgttagtga

SEQ ID NO: 420837 - DNA, 25 bp, Homo sapien
gcctcggtgttagtgagcattttaa

SEQ ID NO: 420838 - DNA, 25 bp, Homo sapien
cagagggagccactgtcgctttcaa

SEQ ID NO: 420839 - DNA, 25 bp, Homo sapien
gagccactgtcgctttcaactgtac

SEQ ID NO: 420840 - DNA, 25 bp, Homo sapien
cttctggtacagacaggattgcagg

SEQ ID NO: 420841 - DNA, 25 bp, Homo sapien
gacaggattgcaggaaagaacctaa

SEQ ID NO: 420842 - DNA, 25 bp, Homo sapien
gaacctaagttgctgatgtccgtat

SEQ ID NO: 420843 - DNA, 25 bp, Homo sapien
tgatgtccgtatactccagtggtaa

SEQ ID NO: 420844 - DNA, 25 bp, Homo sapien
gtccgtatactccagtggtaatgaa

SEQ ID NO: 420845 - DNA, 25 bp, Homo sapien
atagagccagccagtatatttccct

SEQ ID NO: 420846 - DNA, 25 bp, Homo sapien
gagccagccagtatatttccctgct

SEQ ID NO: 420847 - DNA, 25 bp, Homo sapien
gcaggatcctggacccttcaatgtt

SEQ ID NO: 420848 - DNA, 25 bp, Homo sapien
cctggacccttcaatgttccagagg

SEQ ID NO: 420849 - DNA, 25 bp, Homo sapien
aggaaagtacactccgagcggtcag

SEQ ID NO: 420850 - DNA, 25 bp, Homo sapien
tcttcgtctctaaccacgcctatta

SEQ ID NO: 420851 - DNA, 25 bp, Homo sapien
ttcgtctctaaccacgcctattaag

SEQ ID NO: 420852 - DNA, 25 bp, Homo sapien
tctaaccacgcctattaagcggagg

SEQ ID NO: 420853 - DNA, 25 bp, Homo sapien
accacgcctattaagcggaggtgtt

SEQ ID NO: 420854 - DNA, 25 bp, Homo sapien
gcctattaagcggaggtgttcccag

SEQ ID NO: 420855 - DNA, 25 bp, Homo sapien
attaagcggaggtgttcccaggctg

SEQ ID NO: 420856 - DNA, 25 bp, Homo sapien
tcccactcttgaagaggaggccgcc

SEQ ID NO: 420857 - DNA, 25 bp, Homo sapien
tctttcttccctcgtgacagtggtg

SEQ ID NO: 420858 - DNA, 25 bp, Homo sapien
tcttccctcgtgacagtggtgtgtg

SEQ ID NO: 420859 - DNA, 25 bp, Homo sapien
gtgaatgctaagtccatcacccttt

SEQ ID NO: 420860 - DNA, 25 bp, Homo sapien
ccttggaccagttacaacagcagag

SEQ ID NO: 420861 - DNA, 25 bp, Homo sapien
atcagagcaaattggcatgtgtaca

SEQ ID NO: 420862 - DNA, 25 bp, Homo sapien
catgtgtacatggtatcaaagggac

SEQ ID NO: 420863 - DNA, 25 bp, Homo sapien
aaagggaccagtatttcttcagaag

SEQ ID NO: 420864 - DNA, 25 bp, Homo sapien
gagagctctcaggaggttcacatgt

SEQ ID NO: 420865 - DNA, 25 bp, Homo sapien
gttcacatgttgtcagttgctccag

SEQ ID NO: 420866 - DNA, 25 bp, Homo sapien
atgttgtcagttgctccagttgctt

SEQ ID NO: 420867 - DNA, 25 bp, Homo sapien
tccagttgcttcctctgagacaggg

SEQ ID NO: 420868 - DNA, 25 bp, Homo sapien
ttgcttcctctgagacagggccctg

SEQ ID NO: 420869 - DNA, 25 bp, Homo sapien
ggccctgcacacttggtttggatag

SEQ ID NO: 420870 - DNA, 25 bp, Homo sapien
gtgaaaattctgttgaagagcccca

SEQ ID NO: 420871 - DNA, 25 bp, Homo sapien
ctggtatgatagagcactggactga

SEQ ID NO: 420872 - DNA, 25 bp, Homo sapien
ctggactgagtaacgaagagattct

SEQ ID NO: 420873 - DNA, 25 bp, Homo sapien
gagattctagtcatggctcttgtgg

SEQ ID NO: 420874 - DNA, 25 bp, Homo sapien
agtcatggctcttgtggtcatttca

SEQ ID NO: 420875 - DNA, 25 bp, Homo sapien
ggtcatttcatttttgagcctcaca

SEQ ID NO: 420876 - DNA, 25 bp, Homo sapien
attcttccaattaatgagggtacca

SEQ ID NO: 420877 - DNA, 25 bp, Homo sapien
gagggtaccagattaaataaactct

SEQ ID NO: 420878 - DNA, 25 bp, Homo sapien
gggattcatcccaattcgaactctg

SEQ ID NO: 420879 - DNA, 25 bp, Homo sapien
atcccaattcgaactctgtaattct

SEQ ID NO: 420880 - DNA, 25 bp, Homo sapien
gtaattctctgaatgaactctctct

SEQ ID NO: 420881 - DNA, 25 bp, Homo sapien
aactctctcttcaattaaagccaaa

SEQ ID NO: 420882 - DNA, 25 bp, Homo sapien
tgcacttacagtgaccgaggttccc

SEQ ID NO: 420883 - DNA, 25 bp, Homo sapien
gcacttacagtgaccgaggttccca

SEQ ID NO: 420884 - DNA, 25 bp, Homo sapien
cacttacagtgaccgaggttcccag

SEQ ID NO: 420885 - DNA, 25 bp, Homo sapien
cttacagtgaccgaggttcccagtc

SEQ ID NO: 420886 - DNA, 25 bp, Homo sapien
tacagtgaccgaggttcccagtcct

SEQ ID NO: 420887 - DNA, 25 bp, Homo sapien
ggttcccagtccttcttctggtaca

SEQ ID NO: 420888 - DNA, 25 bp, Homo sapien
gttcccagtccttcttctggtacag

SEQ ID NO: 420889 - DNA, 25 bp, Homo sapien
cttctggtacagacaatattctggg

SEQ ID NO: 420890 - DNA, 25 bp, Homo sapien
tacagacaatattctgggaaaagcc

SEQ ID NO: 420891 - DNA, 25 bp, Homo sapien
gggaaaagccctgagttgataatgt

SEQ ID NO: 420892 - DNA, 25 bp, Homo sapien
catatactccaatggtgacaaagaa

SEQ ID NO: 420893 - DNA, 25 bp, Homo sapien
attcctctcctttcatcctgggagc

SEQ ID NO: 420894 - DNA, 25 bp, Homo sapien
gcagtgggtgtccagagcaaacaaa

SEQ ID NO: 420895 - DNA, 25 bp, Homo sapien
aagaacttattttggctggacagca

SEQ ID NO: 420896 - DNA, 25 bp, Homo sapien
gacagcaagcagagtgccagttcca

SEQ ID NO: 420897 - DNA, 25 bp, Homo sapien
agagtgccagttccaaagatgagct

SEQ ID NO: 420898 - DNA, 25 bp, Homo sapien
gatgagcttgtttgtagcaccacca

SEQ ID NO: 420899 - DNA, 25 bp, Homo sapien
gtagcaccaccataaatttgggaag

SEQ ID NO: 420900 - DNA, 25 bp, Homo sapien
aaatttgggaagcacagtaatacat

SEQ ID NO: 420901 - DNA, 25 bp, Homo sapien
gagagagaagaagtccccaacatga

SEQ ID NO: 420902 - DNA, 25 bp, Homo sapien
catgactgtaacttgttgattcttt

SEQ ID NO: 420903 - DNA, 25 bp, Homo sapien
ttatatttcaagaggaagtgtccaa

SEQ ID NO: 420904 - DNA, 25 bp, Homo sapien
agcgatggaatataatatccctaga

SEQ ID NO: 420905 - DNA, 25 bp, Homo sapien
tatccctagatgatggctacagttt

SEQ ID NO: 420906 - DNA, 25 bp, Homo sapien
tgatggctacagtttctcatcttcc

SEQ ID NO: 420907 - DNA, 25 bp, Homo sapien
tacagtttctcatcttcccggctat

SEQ ID NO: 420908 - DNA, 25 bp, Homo sapien
tcatcttcccggctatgtcctatca

SEQ ID NO: 420909 - DNA, 25 bp, Homo sapien
ctatgtcctatcacaatttgcatgc

SEQ ID NO: 420910 - DNA, 25 bp, Homo sapien
atgctggaattgctcggtcttagga

SEQ ID NO: 420911 - DNA, 25 bp, Homo sapien
tggaattgctcggtcttaggaactt

SEQ ID NO: 420912 - DNA, 25 bp, Homo sapien
aattgctcggtcttaggaacttcta

SEQ ID NO: 420913 - DNA, 25 bp, Homo sapien
gctcggtcttaggaacttctaataa

SEQ ID NO: 420914 - DNA, 25 bp, Homo sapien
agaatactattctgttatctgaggg

SEQ ID NO: 420915 - DNA, 25 bp, Homo sapien
aaaggaagaagtgttgtcggagtca

SEQ ID NO: 420916 - DNA, 25 bp, Homo sapien
agaaccaacaagctggtgctgccgc

SEQ ID NO: 420917 - DNA, 25 bp, Homo sapien
ggtgctgccgctttagctccagaga

SEQ ID NO: 420918 - DNA, 25 bp, Homo sapien
tgccgctttagctccagagatagtc

SEQ ID NO: 420919 - DNA, 25 bp, Homo sapien
ttagctccagagatagtcattaaag

SEQ ID NO: 420920 - DNA, 25 bp, Homo sapien
ttgaccctgagctagactcctaatc

SEQ ID NO: 420921 - DNA, 25 bp, Homo sapien
agactcctaatctagcttgccatta

SEQ ID NO: 420922 - DNA, 25 bp, Homo sapien
tctagcttgccattattgtgtgtgt

SEQ ID NO: 420923 - DNA, 25 bp, Homo sapien
gtgtgtaattatggccaaaaggaca

SEQ ID NO: 420924 - DNA, 25 bp, Homo sapien
ggactaagatgtcttggaccacctt

SEQ ID NO: 420925 - DNA, 25 bp, Homo sapien
aagatgtcttggaccacctttgtgt

SEQ ID NO: 420926 - DNA, 25 bp, Homo sapien
tggtatgtccagtcccccggccaag

SEQ ID NO: 420927 - DNA, 25 bp, Homo sapien
gctgctcctgaagtacttttcagga

SEQ ID NO: 420928 - DNA, 25 bp, Homo sapien
gaagtacttttcaggagacactctg

SEQ ID NO: 420929 - DNA, 25 bp, Homo sapien
gtacttttcaggagacactctggtt

SEQ ID NO: 420930 - DNA, 25 bp, Homo sapien
acttttcaggagacactctggttca

SEQ ID NO: 420931 - DNA, 25 bp, Homo sapien
ttttcaggagacactctggttcaag

SEQ ID NO: 420932 - DNA, 25 bp, Homo sapien
aggagacactctggttcaaggcatt

SEQ ID NO: 420933 - DNA, 25 bp, Homo sapien
gagacactctggttcaaggcattaa

SEQ ID NO: 420934 - DNA, 25 bp, Homo sapien
gacactctggttcaaggcattaaag

SEQ ID NO: 420935 - DNA, 25 bp, Homo sapien
tctggttcaaggcattaaaggcttt

SEQ ID NO: 420936 - DNA, 25 bp, Homo sapien
tcaaggcattaaaggctttgaggct

SEQ ID NO: 420937 - DNA, 25 bp, Homo sapien
atagagaccctatactcatgtgccc

SEQ ID NO: 420938 - DNA, 25 bp, Homo sapien
tactcatgtgcccaaccattgtaat

SEQ ID NO: 420939 - DNA, 25 bp, Homo sapien
gtgcccaaccattgtaatatgcgta

SEQ ID NO: 420940 - DNA, 25 bp, Homo sapien
atgcgtattgacgtatatgatagga

SEQ ID NO: 420941 - DNA, 25 bp, Homo sapien
gagaaaacactagcattttgagtta

SEQ ID NO: 420942 - DNA, 25 bp, Homo sapien
aagtaggtcagtttggattaatgga

SEQ ID NO: 420943 - DNA, 25 bp, Homo sapien
tattcttttcaatacacaagtggaa

SEQ ID NO: 420944 - DNA, 25 bp, Homo sapien
aagtggaaatgtttctccagtctaa

SEQ ID NO: 420945 - DNA, 25 bp, Homo sapien
tccagtctaaattccccctagtatt

SEQ ID NO: 420946 - DNA, 25 bp, Homo sapien
ccctagtattctcctgaaacaaaat

SEQ ID NO: 420947 - DNA, 25 bp, Homo sapien
gcagatatttgcttcttttgcaagt

SEQ ID NO: 420948 - DNA, 25 bp, Homo sapien
gacgttgggagtaacgctgctttgc

SEQ ID NO: 420949 - DNA, 25 bp, Homo sapien
acgttgggagtaacgctgctttgct

SEQ ID NO: 420950 - DNA, 25 bp, Homo sapien
cgttgggagtaacgctgctttgctt

SEQ ID NO: 420951 - DNA, 25 bp, Homo sapien
gttgggagtaacgctgctttgcttt

SEQ ID NO: 420952 - DNA, 25 bp, Homo sapien
ttgggagtaacgctgctttgctttg

SEQ ID NO: 420953 - DNA, 25 bp, Homo sapien
tgggagtaacgctgctttgctttgg

SEQ ID NO: 420954 - DNA, 25 bp, Homo sapien
gggagtaacgctgctttgctttggc

SEQ ID NO: 420955 - DNA, 25 bp, Homo sapien
tgctttgctttggcaggttgaaggg

SEQ ID NO: 420956 - DNA, 25 bp, Homo sapien
gctttgctttggcaggttgaagggg

SEQ ID NO: 420957 - DNA, 25 bp, Homo sapien
ctttgctttggcaggttgaaggggc

SEQ ID NO: 420958 - DNA, 25 bp, Homo sapien
ttgctttggcaggttgaaggggccc

SEQ ID NO: 420959 - DNA, 25 bp, Homo sapien
cctcgcccgcggtgcagtttgatca

SEQ ID NO: 420960 - DNA, 25 bp, Homo sapien
ttcagtttgttcagaactgcattct

SEQ ID NO: 420961 - DNA, 25 bp, Homo sapien
aggacgggaaacagcacccagaaga

SEQ ID NO: 420962 - DNA, 25 bp, Homo sapien
gaagaagcttcttcccaacaccttc

SEQ ID NO: 420963 - DNA, 25 bp, Homo sapien
ttcatgatccaggtccggagggcag

SEQ ID NO: 420964 - DNA, 25 bp, Homo sapien
gcagggcacagcaatccacgggtct

SEQ ID NO: 420965 - DNA, 25 bp, Homo sapien
aactgcattcttctggcggagaagc

SEQ ID NO: 420966 - DNA, 25 bp, Homo sapien
gccccactgagcttgcatgtcagac

SEQ ID NO: 420967 - DNA, 25 bp, Homo sapien
gcttgcatgtcagacacacattttc

SEQ ID NO: 420968 - DNA, 25 bp, Homo sapien
ttcttctggcggagaagccctgaga

SEQ ID NO: 420969 - DNA, 25 bp, Homo sapien
tgagagcttcctgcagctgtcccgg

SEQ ID NO: 420970 - DNA, 25 bp, Homo sapien
taaagctattatcttgaacagagtc

SEQ ID NO: 420971 - DNA, 25 bp, Homo sapien
gaacagagtccctaaagctagtcta

SEQ ID NO: 420972 - DNA, 25 bp, Homo sapien
gctagtctagtttttgccacatctg

SEQ ID NO: 420973 - DNA, 25 bp, Homo sapien
gccacatctgcaatgattattgttt

SEQ ID NO: 420974 - DNA, 25 bp, Homo sapien
agaatcctcaggctctacaatctag

SEQ ID NO: 420975 - DNA, 25 bp, Homo sapien
aaatgtgtttccactatacttggga

SEQ ID NO: 420976 - DNA, 25 bp, Homo sapien
gaaaaggtcagtaggatgtgcatcc

SEQ ID NO: 420977 - DNA, 25 bp, Homo sapien
ggatgtgcatcctagggaagataaa

SEQ ID NO: 420978 - DNA, 25 bp, Homo sapien
ttttgcattatatctaggaaccata

SEQ ID NO: 420979 - DNA, 25 bp, Homo sapien
tcctattaatgctgagagatcctaa

SEQ ID NO: 420980 - DNA, 25 bp, Homo sapien
gagatcctaagagctagtatgttgt

SEQ ID NO: 420981 - DNA, 25 bp, Homo sapien
aagcaactggccctggccttattcc

SEQ ID NO: 420982 - DNA, 25 bp, Homo sapien
agcaactggccctggccttattcct

SEQ ID NO: 420983 - DNA, 25 bp, Homo sapien
ttgctccaatcagcggtccattgtt

SEQ ID NO: 420984 - DNA, 25 bp, Homo sapien
aatcagcggtccattgtttccagtg

SEQ ID NO: 420985 - DNA, 25 bp, Homo sapien
ccagtggatacaaggggcccattca

SEQ ID NO: 420986 - DNA, 25 bp, Homo sapien
cagtggatacaaggggcccattcat

SEQ ID NO: 420987 - DNA, 25 bp, Homo sapien
tacaaggggcccattcatgagaaga

SEQ ID NO: 420988 - DNA, 25 bp, Homo sapien
acaaggggcccattcatgagaagag

SEQ ID NO: 420989 - DNA, 25 bp, Homo sapien
gaaccatgtttggagcttctcgagg

SEQ ID NO: 420990 - DNA, 25 bp, Homo sapien
gtttacctccttaccttcatccgag

SEQ ID NO: 420991 - DNA, 25 bp, Homo sapien
tttacctccttaccttcatccgaga

SEQ ID NO: 420992 - DNA, 25 bp, Homo sapien
gacgttgggagtaacgctgctttgc

SEQ ID NO: 420993 - DNA, 25 bp, Homo sapien
gggagtaacgctgctttgctttggc

SEQ ID NO: 420994 - DNA, 25 bp, Homo sapien
tggcctgagagcagcgatgacctct

SEQ ID NO: 420995 - DNA, 25 bp, Homo sapien
aggagggacttcacctggaacaaga

SEQ ID NO: 420996 - DNA, 25 bp, Homo sapien
ggacttcacctggaacaagagctgg

SEQ ID NO: 420997 - DNA, 25 bp, Homo sapien
aggcttgtcccctgaggcgcttcgc

SEQ ID NO: 420998 - DNA, 25 bp, Homo sapien
gcttcgccagtgaggtgcgggctca

SEQ ID NO: 420999 - DNA, 25 bp, Homo sapien
agggcctcgagtctctcctggagca

SEQ ID NO: 421000 - DNA, 25 bp, Homo sapien
gagtctctcctggagcacgggctgc

SEQ ID NO: 421001 - DNA, 25 bp, Homo sapien
agtccttgcccacaacgatgtggag

SEQ ID NO: 421002 - DNA, 25 bp, Homo sapien
gtggagccctgtgaaagtcggattc

SEQ ID NO: 421003 - DNA, 25 bp, Homo sapien
acttgtgaatcagtaaacgtactag

SEQ ID NO: 421004 - DNA, 25 bp, Homo sapien
aacgtactagacaaagcagccatta

SEQ ID NO: 421005 - DNA, 25 bp, Homo sapien
cagccattacttatgcattcctgca

SEQ ID NO: 421006 - DNA, 25 bp, Homo sapien
ttatgcattcctgcatatccagcaa

SEQ ID NO: 421007 - DNA, 25 bp, Homo sapien
acttcattatgatatcggtttacac

SEQ ID NO: 421008 - DNA, 25 bp, Homo sapien
gatatcggtttacacttccagggta

SEQ ID NO: 421009 - DNA, 25 bp, Homo sapien
tcggtttacacttccagggtacaca

SEQ ID NO: 421010 - DNA, 25 bp, Homo sapien
cagggtacacaaaaagaggccattt

SEQ ID NO: 421011 - DNA, 25 bp, Homo sapien
gaggccatttcatcaagctaattgc

SEQ ID NO: 421012 - DNA, 25 bp, Homo sapien
gagagaactttagctattagtctat

SEQ ID NO: 421013 - DNA, 25 bp, Homo sapien
gaactacagatcagagcaatcaatc

SEQ ID NO: 421014 - DNA, 25 bp, Homo sapien
gaaatttcagcattatcctcatata

SEQ ID NO: 421015 - DNA, 25 bp, Homo sapien
agcattatcctcatataaaacgtat

SEQ ID NO: 421016 - DNA, 25 bp, Homo sapien
aaaacgtatagctcgtcatcgacat

SEQ ID NO: 421017 - DNA, 25 bp, Homo sapien
gctcgtcatcgacatctaccaaaat

SEQ ID NO: 421018 - DNA, 25 bp, Homo sapien
tcgacatctaccaaaatctatctat

SEQ ID NO: 421019 - DNA, 25 bp, Homo sapien
tatctatagccagattcaggaacag

SEQ ID NO: 421020 - DNA, 25 bp, Homo sapien
gcgcatcatgaaagaagctcgtcga

SEQ ID NO: 421021 - DNA, 25 bp, Homo sapien
tcatgaaagaagctcgtcgacgaaa

SEQ ID NO: 421022 - DNA, 25 bp, Homo sapien
atcgtattaaacacagcaagcctgg

SEQ ID NO: 421023 - DNA, 25 bp, Homo sapien
ggatctgtgccacttgtgtcagaga

SEQ ID NO: 421024 - DNA, 25 bp, Homo sapien
ggtattcctaacaatcctgatgtat

SEQ ID NO: 421025 - DNA, 25 bp, Homo sapien
ggcagccataatcctcctaggcaca

SEQ ID NO: 421026 - DNA, 25 bp, Homo sapien
tcctcctaggcacacaacttcagtg

SEQ ID NO: 421027 - DNA, 25 bp, Homo sapien
acctgatggttcttccctacacaca

SEQ ID NO: 421028 - DNA, 25 bp, Homo sapien
ggttcttccctacacacactggtgg

SEQ ID NO: 421029 - DNA, 25 bp, Homo sapien
tggctgaagacaaagggcttatact

SEQ ID NO: 421030 - DNA, 25 bp, Homo sapien
caaagggcttatactcttgggagtt

SEQ ID NO: 421031 - DNA, 25 bp, Homo sapien
tactcttgggagttctagggcctta

SEQ ID NO: 421032 - DNA, 25 bp, Homo sapien
agtacctcttcatactaccacagct

SEQ ID NO: 421033 - DNA, 25 bp, Homo sapien
cacagctgatgctttctggaaagtg

SEQ ID NO: 421034 - DNA, 25 bp, Homo sapien
tttctggaaagtgccaccttctgca

SEQ ID NO: 421035 - DNA, 25 bp, Homo sapien
caccttctgcaggaggtcaaacagc

SEQ ID NO: 421036 - DNA, 25 bp, Homo sapien
gaggcgcttcgccagtgaggtgcgg

SEQ ID NO: 421037 - DNA, 25 bp, Homo sapien
gcttcgccagtgaggtgcgggctca

SEQ ID NO: 421038 - DNA, 25 bp, Homo sapien
cttcgccagtgaggtgcgggctcag

SEQ ID NO: 421039 - DNA, 25 bp, Homo sapien
gggctcagggcctcgagtctctcct

SEQ ID NO: 421040 - DNA, 25 bp, Homo sapien
ggctcagggcctcgagtctctcctg

SEQ ID NO: 421041 - DNA, 25 bp, Homo sapien
tcagggcctcgagtctctcctggag

SEQ ID NO: 421042 - DNA, 25 bp, Homo sapien
agggcctcgagtctctcctggagca

SEQ ID NO: 421043 - DNA, 25 bp, Homo sapien
gggcctcgagtctctcctggagcac

SEQ ID NO: 421044 - DNA, 25 bp, Homo sapien
ctctcctggagcacgggctgcggtg

SEQ ID NO: 421045 - DNA, 25 bp, Homo sapien
gcagcttacggggcggccagtcctt

SEQ ID NO: 421046 - DNA, 25 bp, Homo sapien
cggccagtccttgcccacaacgatg

SEQ ID NO: 421047 - DNA, 25 bp, Homo sapien
tacctgatgcgcactggcacgaggg

SEQ ID NO: 421048 - DNA, 25 bp, Homo sapien
gcttgattcgatccactggctttaa

SEQ ID NO: 421049 - DNA, 25 bp, Homo sapien
tgctttgaatgtcccctcaagacct

SEQ ID NO: 421050 - DNA, 25 bp, Homo sapien
atgtcccctcaagacctgggaagga

SEQ ID NO: 421051 - DNA, 25 bp, Homo sapien
ggaaaaaataacatcacctccttga

SEQ ID NO: 421052 - DNA, 25 bp, Homo sapien
aaaactgcaccaaaggaatctctgt

SEQ ID NO: 421053 - DNA, 25 bp, Homo sapien
caaaggaatctctgtccacctaaac

SEQ ID NO: 421054 - DNA, 25 bp, Homo sapien
ggaatctctgtccacctaaaccata

SEQ ID NO: 421055 - DNA, 25 bp, Homo sapien
cacctaaaccatactgctcactaaa

SEQ ID NO: 421056 - DNA, 25 bp, Homo sapien
tactgctcactaaaagacaggaatg

SEQ ID NO: 421057 - DNA, 25 bp, Homo sapien
tccacactgtacctgatgcgcactg

SEQ ID NO: 421058 - DNA, 25 bp, Homo sapien
ggtctctgtactttagtgcatttat

SEQ ID NO: 421059 - DNA, 25 bp, Homo sapien
cttttctatatcttgcccattcaaa

SEQ ID NO: 421060 - DNA, 25 bp, Homo sapien
tatcttgcccattcaaataaccctc

SEQ ID NO: 421061 - DNA, 25 bp, Homo sapien
ctacccatcagtccctaggaaagtc

SEQ ID NO: 421062 - DNA, 25 bp, Homo sapien
taagtagatcagtcaggtgaggcct

SEQ ID NO: 421063 - DNA, 25 bp, Homo sapien
aggtgaggcctgatcaagtggttct

SEQ ID NO: 421064 - DNA, 25 bp, Homo sapien
ggcctgatcaagtggttctgatgat

SEQ ID NO: 421065 - DNA, 25 bp, Homo sapien
gatgataatgccaaggactccattt

SEQ ID NO: 421066 - DNA, 25 bp, Homo sapien
ttccttttgttattcccctctgcct

SEQ ID NO: 421067 - DNA, 25 bp, Homo sapien
gcataatagcatattgttagctctg

SEQ ID NO: 421068 - DNA, 25 bp, Homo sapien
agaatttgttgtattggtctctgta

SEQ ID NO: 421069 - DNA, 25 bp, Homo sapien
atattattttatgtgcgcttggcta

SEQ ID NO: 421070 - DNA, 25 bp, Homo sapien
attttatgtgcgcttggctatgccc

SEQ ID NO: 421071 - DNA, 25 bp, Homo sapien
atgtgcgcttggctatgccctaaaa

SEQ ID NO: 421072 - DNA, 25 bp, Homo sapien
ttggctatgccctaaaatgtcagtt

SEQ ID NO: 421073 - DNA, 25 bp, Homo sapien
aaatgtcagtttattgtccctaaag

SEQ ID NO: 421074 - DNA, 25 bp, Homo sapien
gtcagtttattgtccctaaagacgt

SEQ ID NO: 421075 - DNA, 25 bp, Homo sapien
gtccctaaagacgtatttattgatg

SEQ ID NO: 421076 - DNA, 25 bp, Homo sapien
aattataccaatcctttcatatatg

SEQ ID NO: 421077 - DNA, 25 bp, Homo sapien
aaaatgtttgagttggtcatctgtc

SEQ ID NO: 421078 - DNA, 25 bp, Homo sapien
gagttggtcatctgtcttttattga

SEQ ID NO: 421079 - DNA, 25 bp, Homo sapien
ctgtcttttattgaagatgcatttc

SEQ ID NO: 421080 - DNA, 25 bp, Homo sapien
ttctatttgttcactctccactttc

SEQ ID NO: 421081 - DNA, 25 bp, Homo sapien
ttctcaataaatccattctgccacc

SEQ ID NO: 421082 - DNA, 25 bp, Homo sapien
tgggaatttcccctacaatcggtgg

SEQ ID NO: 421083 - DNA, 25 bp, Homo sapien
ccatctactcacagtgtctgtttta

SEQ ID NO: 421084 - DNA, 25 bp, Homo sapien
tttatttctccttcccagtgagatt

SEQ ID NO: 421085 - DNA, 25 bp, Homo sapien
atttctccttcccagtgagattcaa

SEQ ID NO: 421086 - DNA, 25 bp, Homo sapien
gtgagattcaaacatcagtccttaa

SEQ ID NO: 421087 - DNA, 25 bp, Homo sapien
tcaaacatcagtccttaagtcctcc

SEQ ID NO: 421088 - DNA, 25 bp, Homo sapien
taagtcctcctcgttatgcagtcga

SEQ ID NO: 421089 - DNA, 25 bp, Homo sapien
tcctcgttatgcagtcgacgcggcc

SEQ ID NO: 421090 - DNA, 25 bp, Homo sapien
caatatgatccctcctttttctatt

SEQ ID NO: 421091 - DNA, 25 bp, Homo sapien
aatgaagctgtagaagccaatagaa

SEQ ID NO: 421092 - DNA, 25 bp, Homo sapien
atgaagctgtagaagccaatagaaa

SEQ ID NO: 421093 - DNA, 25 bp, Homo sapien
gaagctgtagaagccaatagaaaat

SEQ ID NO: 421094 - DNA, 25 bp, Homo sapien
agctgtagaagccaatagaaaattt

SEQ ID NO: 421095 - DNA, 25 bp, Homo sapien
gctgtagaagccaatagaaaatttc

SEQ ID NO: 421096 - DNA, 25 bp, Homo sapien
gtagaagccaatagaaaatttcaag

SEQ ID NO: 421097 - DNA, 25 bp, Homo sapien
ttcaagaagtaagagatccttggcc

SEQ ID NO: 421098 - DNA, 25 bp, Homo sapien
tcaagaagtaagagatccttggcca

SEQ ID NO: 421099 - DNA, 25 bp, Homo sapien
aagtaagagatccttggccaggcgt

SEQ ID NO: 421100 - DNA, 25 bp, Homo sapien
agtaagagatccttggccaggcgtg

SEQ ID NO: 421101 - DNA, 25 bp, Homo sapien
tgagaggctcaggtgggccgatcac

SEQ ID NO: 421102 - DNA, 25 bp, Homo sapien
ctaagatcttcgagcgggtgcggca

SEQ ID NO: 421103 - DNA, 25 bp, Homo sapien
agagcgcggacttcatgccactgaa

SEQ ID NO: 421104 - DNA, 25 bp, Homo sapien
atgaaaactctcaacaacgacctgg

SEQ ID NO: 421105 - DNA, 25 bp, Homo sapien
tgggccccaactggcgggacaagtt

SEQ ID NO: 421106 - DNA, 25 bp, Homo sapien
ttggaatacttcgaggagcggccct

SEQ ID NO: 421107 - DNA, 25 bp, Homo sapien
agaaggccgtgctgggttccagtcc

SEQ ID NO: 421108 - DNA, 25 bp, Homo sapien
tttcctgtccgaggccaatgcagag

SEQ ID NO: 421109 - DNA, 25 bp, Homo sapien
aatgcagagcggatcgtgcgcacgc

SEQ ID NO: 421110 - DNA, 25 bp, Homo sapien
atcgtgcgcacgctctgcaaggtgc

SEQ ID NO: 421111 - DNA, 25 bp, Homo sapien
gtgcggcactcaagctgggccagat

SEQ ID NO: 421112 - DNA, 25 bp, Homo sapien
ccaggatgatgcctttatcaacccc

SEQ ID NO: 421113 - DNA, 25 bp, Homo sapien
aagctaggctacctaaggcaggcat

SEQ ID NO: 421114 - DNA, 25 bp, Homo sapien
aggcaggcatacatctccaatttct

SEQ ID NO: 421115 - DNA, 25 bp, Homo sapien
atctccaatttctggaagtgttcaa

SEQ ID NO: 421116 - DNA, 25 bp, Homo sapien
gaaagactaatcaaccaaaacccag

SEQ ID NO: 421117 - DNA, 25 bp, Homo sapien
agaatggcaagagtagatcctacaa

SEQ ID NO: 421118 - DNA, 25 bp, Homo sapien
acaacagataaagactcccactcag

SEQ ID NO: 421119 - DNA, 25 bp, Homo sapien
gactcccactcagagatgtgattaa

SEQ ID NO: 421120 - DNA, 25 bp, Homo sapien
gtgattaatctgtgaaacatactgt

SEQ ID NO: 421121 - DNA, 25 bp, Homo sapien
gttctaaatagcactgatgtttcca

SEQ ID NO: 421122 - DNA, 25 bp, Homo sapien
gaaaaccaaagtcaacagtacgtag

SEQ ID NO: 421123 - DNA, 25 bp, Homo sapien
agtcaacagtacgtagctccaagag

SEQ ID NO: 421124 - DNA, 25 bp, Homo sapien
tggtttatatcatggccagcccctt

SEQ ID NO: 421125 - DNA, 25 bp, Homo sapien
tccaagacttatcctcctgatctca

SEQ ID NO: 421126 - DNA, 25 bp, Homo sapien
tgggagacactcatggcagcctatc

SEQ ID NO: 421127 - DNA, 25 bp, Homo sapien
tatccttctcttcattctctcatat

SEQ ID NO: 421128 - DNA, 25 bp, Homo sapien
attcctagggtgaagcagacttgtc

SEQ ID NO: 421129 - DNA, 25 bp, Homo sapien
cagacttgtcagaagatcctgtgga

SEQ ID NO: 421130 - DNA, 25 bp, Homo sapien
aagacagtgtgtgctcggagatgct

SEQ ID NO: 421131 - DNA, 25 bp, Homo sapien
tgtggtcaggacactcttgggacgc

SEQ ID NO: 421132 - DNA, 25 bp, Homo sapien
acactcttgggacgctcttttgata

SEQ ID NO: 421133 - DNA, 25 bp, Homo sapien
gacgctcttttgatagctctctata

SEQ ID NO: 421134 - DNA, 25 bp, Homo sapien
ctataagggagctgctttccatgtc

SEQ ID NO: 421135 - DNA, 25 bp, Homo sapien
gcctgttagaatagaagccttagtc

SEQ ID NO: 421136 - DNA, 25 bp, Homo sapien
agaatagaagccttagtcccactcc

SEQ ID NO: 421137 - DNA, 25 bp, Homo sapien
gatttctaaagagggattcagcaga

SEQ ID NO: 421138 - DNA, 25 bp, Homo sapien
cgtctggtctgtccgtgtgccgtct

SEQ ID NO: 421139 - DNA, 25 bp, Homo sapien
tgtgccgtctgtttctctgggccat

SEQ ID NO: 421140 - DNA, 25 bp, Homo sapien
gtttctctgggccatgtgtgagcag

SEQ ID NO: 421141 - DNA, 25 bp, Homo sapien
atgtgtgagcagtgtccccatctcc

SEQ ID NO: 421142 - DNA, 25 bp, Homo sapien
tgtccccgcatcattgggcctgagt

SEQ ID NO: 421143 - DNA, 25 bp, Homo sapien
ggcctgagtgtgctctgtatacaac

SEQ ID NO: 421144 - DNA, 25 bp, Homo sapien
gagtgtgctctgtatacaacgtcat

SEQ ID NO: 421145 - DNA, 25 bp, Homo sapien
gtgctctgtatacaacgtcatgtct

SEQ ID NO: 421146 - DNA, 25 bp, Homo sapien
ttctttacttcaaacactgaagctg

SEQ ID NO: 421147 - DNA, 25 bp, Homo sapien
aacactgaagctgtaggcgagccat

SEQ ID NO: 421148 - DNA, 25 bp, Homo sapien
gaagctgtaggcgagccatcccgta

SEQ ID NO: 421149 - DNA, 25 bp, Homo sapien
tgtaggcgagccatcccgtatcgac

SEQ ID NO: 421150 - DNA, 25 bp, Homo sapien
gagccatcccgtatcgactttatac

SEQ ID NO: 421151 - DNA, 25 bp, Homo sapien
atcccgtatcgactttatactcaaa

SEQ ID NO: 421152 - DNA, 25 bp, Homo sapien
aagccagattgcagtgagtgggtag

SEQ ID NO: 421153 - DNA, 25 bp, Homo sapien
agtgggtaggacagctcagatccaa

SEQ ID NO: 421154 - DNA, 25 bp, Homo sapien
tgggtaggacagctcagatccaaat

SEQ ID NO: 421155 - DNA, 25 bp, Homo sapien
gacagctcagatccaaatgaaagta

SEQ ID NO: 421156 - DNA, 25 bp, Homo sapien
gatccaaatgaaagtagggtctcaa

SEQ ID NO: 421157 - DNA, 25 bp, Homo sapien
tgctcagtgtgcgaaatttattgat

SEQ ID NO: 421158 - DNA, 25 bp, Homo sapien
acagcagattctacattggcagcac

SEQ ID NO: 421159 - DNA, 25 bp, Homo sapien
ttggcagcactattcccggaagcgg

SEQ ID NO: 421160 - DNA, 25 bp, Homo sapien
aagcggatgcgccttcagcaagcct

SEQ ID NO: 421161 - DNA, 25 bp, Homo sapien
gcaagccttggcagagcagcaacag

SEQ ID NO: 421162 - DNA, 25 bp, Homo sapien
aactggatacaaacgaggcacttaa

SEQ ID NO: 421163 - DNA, 25 bp, Homo sapien
atgaaaactcttcctatctaccttt

SEQ ID NO: 421164 - DNA, 25 bp, Homo sapien
actcttcctatctacctttattatg

SEQ ID NO: 421165 - DNA, 25 bp, Homo sapien
tacctttattatggtagcccctaga

SEQ ID NO: 421166 - DNA, 25 bp, Homo sapien
gtagcccctagaacctttagtgtgc

SEQ ID NO: 421167 - DNA, 25 bp, Homo sapien
tagtgtgctttttcatccaactttt

SEQ ID NO: 421168 - DNA, 25 bp, Homo sapien
gggacacaagggatgcttattcact

SEQ ID NO: 421169 - DNA, 25 bp, Homo sapien
atgcttattcactcagatccttgta

SEQ ID NO: 421170 - DNA, 25 bp, Homo sapien
tattcactcagatccttgtaggtac

SEQ ID NO: 421171 - DNA, 25 bp, Homo sapien
ccttgtaggtacacaatggatgcat

SEQ ID NO: 421172 - DNA, 25 bp, Homo sapien
caatggatgcatattgtctcagatc

SEQ ID NO: 421173 - DNA, 25 bp, Homo sapien
tgtctcagatccttgtggcatatta

SEQ ID NO: 421174 - DNA, 25 bp, Homo sapien
atccttgtggcatattactatcagt

SEQ ID NO: 421175 - DNA, 25 bp, Homo sapien
tactatcagtggttgaagtggtagc

SEQ ID NO: 421176 - DNA, 25 bp, Homo sapien
gaagtggtagctgtgttatattctt

SEQ ID NO: 421177 - DNA, 25 bp, Homo sapien
aacgagtttgttgactgttcactta

SEQ ID NO: 421178 - DNA, 25 bp, Homo sapien
tttgattgagtcagggtttcactcc

SEQ ID NO: 421179 - DNA, 25 bp, Homo sapien
ttttggtctcttcctcttctgataa

SEQ ID NO: 421180 - DNA, 25 bp, Homo sapien
tgataagggcactaacctcatcatg

SEQ ID NO: 421181 - DNA, 25 bp, Homo sapien
aacctcatcatgagggtcccatcct

SEQ ID NO: 421182 - DNA, 25 bp, Homo sapien
taccatcacgttgaaggttgcttcc

SEQ ID NO: 421183 - DNA, 25 bp, Homo sapien
aggttgcttccttcctggtcgtttg

SEQ ID NO: 421184 - DNA, 25 bp, Homo sapien
ggtcgtttgctctggtgagaccaaa

SEQ ID NO: 421185 - DNA, 25 bp, Homo sapien
tgagaccaaatgacctgcaaagtgt

SEQ ID NO: 421186 - DNA, 25 bp, Homo sapien
aagtgtcacttgattccattctctc

SEQ ID NO: 421187 - DNA, 25 bp, Homo sapien
ttccatcccaggcaatctttatcta

SEQ ID NO: 421188 - DNA, 25 bp, Homo sapien
ggcaatctttatctagctacaccaa

SEQ ID NO: 421189 - DNA, 25 bp, Homo sapien
tctttatctagctacaccaacctgt

SEQ ID NO: 421190 - DNA, 25 bp, Homo sapien
agaactgccagagcccagtcagtga

SEQ ID NO: 421191 - DNA, 25 bp, Homo sapien
acatccacatcactgtctctgaagg

SEQ ID NO: 421192 - DNA, 25 bp, Homo sapien
gttgagatgtaactattcctatggg

SEQ ID NO: 421193 - DNA, 25 bp, Homo sapien
tccagctgctcctgaagtacttttc

SEQ ID NO: 421194 - DNA, 25 bp, Homo sapien
gaagtacttttcaggagacactctg

SEQ ID NO: 421195 - DNA, 25 bp, Homo sapien
acttttcaggagacactctggttca

SEQ ID NO: 421196 - DNA, 25 bp, Homo sapien
ggagacactctggttcaaggcatta

SEQ ID NO: 421197 - DNA, 25 bp, Homo sapien
gacactctggttcaaggcattaaag

SEQ ID NO: 421198 - DNA, 25 bp, Homo sapien
tctggttcaaggcattaaaggcttt

SEQ ID NO: 421199 - DNA, 25 bp, Homo sapien
tcaaggcattaaaggctttgaggct

SEQ ID NO: 421200 - DNA, 25 bp, Homo sapien
gaggagtcaatcttccttcaatctg

SEQ ID NO: 421201 - DNA, 25 bp, Homo sapien
tcaggagggtaaaacggccaccctg

SEQ ID NO: 421202 - DNA, 25 bp, Homo sapien
accctgacctgcaactatacaaact

SEQ ID NO: 421203 - DNA, 25 bp, Homo sapien
aactatacaaactattccccagcat

SEQ ID NO: 421204 - DNA, 25 bp, Homo sapien
attccccagcatacttacagtggta

SEQ ID NO: 421205 - DNA, 25 bp, Homo sapien
tacagtggtaccgacaagatccagg

SEQ ID NO: 421206 - DNA, 25 bp, Homo sapien
aggaagaggccctgttttcttgcta

SEQ ID NO: 421207 - DNA, 25 bp, Homo sapien
ctgttttcttgctactcatacgtga

SEQ ID NO: 421208 - DNA, 25 bp, Homo sapien
tgaaggtcacctttgataccaccct

SEQ ID NO: 421209 - DNA, 25 bp, Homo sapien
cctttgataccacccttaaacagag

SEQ ID NO: 421210 - DNA, 25 bp, Homo sapien
atagaacagaattccgaggccctga

SEQ ID NO: 421211 - DNA, 25 bp, Homo sapien
aattccgaggccctgaacattcagg

SEQ ID NO: 421212 - DNA, 25 bp, Homo sapien
cttttccaccatgctttttaggaag

SEQ ID NO: 421213 - DNA, 25 bp, Homo sapien
catgctttttaggaaggaacaccag

SEQ ID NO: 421214 - DNA, 25 bp, Homo sapien
ggaacaccaggtagggctcaagtac

SEQ ID NO: 421215 - DNA, 25 bp, Homo sapien
tgtaactccctttactcaactccaa

SEQ ID NO: 421216 - DNA, 25 bp, Homo sapien
tcaactccaagtatgtctgtgcacg

SEQ ID NO: 421217 - DNA, 25 bp, Homo sapien
tctgtgcacggacaatgagacgaaa

SEQ ID NO: 421218 - DNA, 25 bp, Homo sapien
gagacgaaagcatgctcaatgcgaa

SEQ ID NO: 421219 - DNA, 25 bp, Homo sapien
tgagaaatcactacaatgccaaatt

SEQ ID NO: 421220 - DNA, 25 bp, Homo sapien
atatctttaagaactcgctgtgtta

SEQ ID NO: 421221 - DNA, 25 bp, Homo sapien
gaactcgctgtgttagggaaactgt

SEQ ID NO: 421222 - DNA, 25 bp, Homo sapien
ctgtttacatattgaggtgttcctc

SEQ ID NO: 421223 - DNA, 25 bp, Homo sapien
acacagatcctgaagtggccccagc

SEQ ID NO: 421224 - DNA, 25 bp, Homo sapien
aggtggtgaccaagaccatggtgaa

SEQ ID NO: 421225 - DNA, 25 bp, Homo sapien
gtgaccaagaccatggtgaacacag

SEQ ID NO: 421226 - DNA, 25 bp, Homo sapien
tgaacacagtggtggccaatgcctc

SEQ ID NO: 421227 - DNA, 25 bp, Homo sapien
tgacggactccaacatcgtagccat

SEQ ID NO: 421228 - DNA, 25 bp, Homo sapien
gactccaacatcgtagccatctggg

SEQ ID NO: 421229 - DNA, 25 bp, Homo sapien
accagggacacagctaactaactta

SEQ ID NO: 421230 - DNA, 25 bp, Homo sapien
gggacacagctaactaacttattca

SEQ ID NO: 421231 - DNA, 25 bp, Homo sapien
aactaacttattcagctttgggccg

SEQ ID NO: 421232 - DNA, 25 bp, Homo sapien
acttattcagctttgggccgatggg

SEQ ID NO: 421233 - DNA, 25 bp, Homo sapien
tatttttattaaactctactgtgga

SEQ ID NO: 421234 - DNA, 25 bp, Homo sapien
ggatgccatggaatgccatatcctc

SEQ ID NO: 421235 - DNA, 25 bp, Homo sapien
tggaatgccatatcctccccattat

SEQ ID NO: 421236 - DNA, 25 bp, Homo sapien
ccccttgtctggataattcctactc

SEQ ID NO: 421237 - DNA, 25 bp, Homo sapien
attcctactcatcctacaatactga

SEQ ID NO: 421238 - DNA, 25 bp, Homo sapien
caatactgattttatctgtgcaaag

SEQ ID NO: 421239 - DNA, 25 bp, Homo sapien
acaggggtttcctctggcttctcca

SEQ ID NO: 421240 - DNA, 25 bp, Homo sapien
ggcttctccagactttctgttcctc

SEQ ID NO: 421241 - DNA, 25 bp, Homo sapien
acagcccttagcaccctggggagga

SEQ ID NO: 421242 - DNA, 25 bp, Homo sapien
aggaggtgttgctgtccaggtaaat

SEQ ID NO: 421243 - DNA, 25 bp, Homo sapien
gcctacccacaaacaggacctgcat

SEQ ID NO: 421244 - DNA, 25 bp, Homo sapien
ggacctgcatcctgtctcacaaata

SEQ ID NO: 421245 - DNA, 25 bp, Homo sapien
ccttttctggtatgtccaatatcct

SEQ ID NO: 421246 - DNA, 25 bp, Homo sapien
ttttctggtatgtccaatatcctgg

SEQ ID NO: 421247 - DNA, 25 bp, Homo sapien
tctggtatgtccaatatcctggaga

SEQ ID NO: 421248 - DNA, 25 bp, Homo sapien
atatcctggagaaggtctacagctc

SEQ ID NO: 421249 - DNA, 25 bp, Homo sapien
atcctggagaaggtctacagctcct

SEQ ID NO: 421250 - DNA, 25 bp, Homo sapien
ggagaaggtctacagctcctcctga

SEQ ID NO: 421251 - DNA, 25 bp, Homo sapien
gagaaggtctacagctcctcctgaa

SEQ ID NO: 421252 - DNA, 25 bp, Homo sapien
agaaggtctacagctcctcctgaaa

SEQ ID NO: 421253 - DNA, 25 bp, Homo sapien
cctcctgaaagccacgaaggctgat

SEQ ID NO: 421254 - DNA, 25 bp, Homo sapien
tcctgaaagccacgaaggctgatga

SEQ ID NO: 421255 - DNA, 25 bp, Homo sapien
gaaagccacgaaggctgatgacaag

SEQ ID NO: 421256 - DNA, 25 bp, Homo sapien
gcttttgcagcaattgtgtgttctg

SEQ ID NO: 421257 - DNA, 25 bp, Homo sapien
ttttgcagcaattgtgtgttctgga

SEQ ID NO: 421258 - DNA, 25 bp, Homo sapien
tgcagcaattgtgtgttctggagac

SEQ ID NO: 421259 - DNA, 25 bp, Homo sapien
cagcaattgtgtgttctggagacaa

SEQ ID NO: 421260 - DNA, 25 bp, Homo sapien
acaagcacatggtgggtggtgatct

SEQ ID NO: 421261 - DNA, 25 bp, Homo sapien
gcacatggtgggtggtgatcttaca

SEQ ID NO: 421262 - DNA, 25 bp, Homo sapien
acatggtgggtggtgatcttacaaa

SEQ ID NO: 421263 - DNA, 25 bp, Homo sapien
catggtgggtggtgatcttacaaat

SEQ ID NO: 421264 - DNA, 25 bp, Homo sapien
tggtgggtggtgatcttacaaatac

SEQ ID NO: 421265 - DNA, 25 bp, Homo sapien
ggtgggtggtgatcttacaaatacg

SEQ ID NO: 421266 - DNA, 25 bp, Homo sapien
gggtggtgatcttacaaatacgggt

SEQ ID NO: 421267 - DNA, 25 bp, Homo sapien
atgcaggtcgccatggcccgggcaa

SEQ ID NO: 421268 - DNA, 25 bp, Homo sapien
caacgacggcgacaggaaacaggtt

SEQ ID NO: 421269 - DNA, 25 bp, Homo sapien
gtggcctggcctgctgatcatgttg

SEQ ID NO: 421270 - DNA, 25 bp, Homo sapien
atcatgttgggttctctctgccata

SEQ ID NO: 421271 - DNA, 25 bp, Homo sapien
tctgccatagaggttcaccgtgtgg

SEQ ID NO: 421272 - DNA, 25 bp, Homo sapien
tggcctttcaacacacgtagaaata

SEQ ID NO: 421273 - DNA, 25 bp, Homo sapien
gacacagagctctggagtttcttca

SEQ ID NO: 421274 - DNA, 25 bp, Homo sapien
gagctgttactagaacaccaggatg

SEQ ID NO: 421275 - DNA, 25 bp, Homo sapien
tgtttcctgattgtttttaccctag

SEQ ID NO: 421276 - DNA, 25 bp, Homo sapien
ttgtttttaccctagcatctgcaaa

SEQ ID NO: 421277 - DNA, 25 bp, Homo sapien
agctccgcagccaaatgcaggtcgc

SEQ ID NO: 421278 - DNA, 25 bp, Homo sapien
tcatgccccagagggactgtgaaaa

SEQ ID NO: 421279 - DNA, 25 bp, Homo sapien
actgtgaaaaggcttcctgtgacct

SEQ ID NO: 421280 - DNA, 25 bp, Homo sapien
gatggcggcccctcattggccaagg

SEQ ID NO: 421281 - DNA, 25 bp, Homo sapien
gccaagggcactgtggatgttttgt

SEQ ID NO: 421282 - DNA, 25 bp, Homo sapien
gcagtagacgtggagccggcacctc

SEQ ID NO: 421283 - DNA, 25 bp, Homo sapien
ggagccggcacctctggtctggatt

SEQ ID NO: 421284 - DNA, 25 bp, Homo sapien
cctctggtctggattccacttaaaa

SEQ ID NO: 421285 - DNA, 25 bp, Homo sapien
ggattccacttaaaaccagttgagt

SEQ ID NO: 421286 - DNA, 25 bp, Homo sapien
ccagttgagtggtctcaagccctta

SEQ ID NO: 421287 - DNA, 25 bp, Homo sapien
gagtggtctcaagcccttaacctct

SEQ ID NO: 421288 - DNA, 25 bp, Homo sapien
gaaatcacagtaataaagcgtcgta

SEQ ID NO: 421289 - DNA, 25 bp, Homo sapien
acgtggacgacatgcccaacgcgct

SEQ ID NO: 421290 - DNA, 25 bp, Homo sapien
cgtggacgacatgcccaacgcgctg

SEQ ID NO: 421291 - DNA, 25 bp, Homo sapien
gacctgcacgcgcacaagcttcggg

SEQ ID NO: 421292 - DNA, 25 bp, Homo sapien
acctgcacgcgcacaagcttcgggt

SEQ ID NO: 421293 - DNA, 25 bp, Homo sapien
cctgcacgcgcacaagcttcgggtg

SEQ ID NO: 421294 - DNA, 25 bp, Homo sapien
ctgcacgcgcacaagcttcgggtgg

SEQ ID NO: 421295 - DNA, 25 bp, Homo sapien
tgcacgcgcacaagcttcgggtgga

SEQ ID NO: 421296 - DNA, 25 bp, Homo sapien
gcacgcgcacaagcttcgggtggac

SEQ ID NO: 421297 - DNA, 25 bp, Homo sapien
ccgccgagttcacccctgcggtgca

SEQ ID NO: 421298 - DNA, 25 bp, Homo sapien
gccgagttcacccctgcggtgcacg

SEQ ID NO: 421299 - DNA, 25 bp, Homo sapien
ccgagttcacccctgcggtgcacgc

SEQ ID NO: 421300 - DNA, 25 bp, Homo sapien
gtggcctggcctgctgatcatgttg

SEQ ID NO: 421301 - DNA, 25 bp, Homo sapien
gcctggcctgctgatcatgttgggt

SEQ ID NO: 421302 - DNA, 25 bp, Homo sapien
ctggcctgctgatcatgttgggttc

SEQ ID NO: 421303 - DNA, 25 bp, Homo sapien
ggcctgctgatcatgttgggttctc

SEQ ID NO: 421304 - DNA, 25 bp, Homo sapien
ctgctgatcatgttgggttctctct

SEQ ID NO: 421305 - DNA, 25 bp, Homo sapien
gctgatcatgttgggttctctctgc

SEQ ID NO: 421306 - DNA, 25 bp, Homo sapien
tgatcatgttgggttctctctgcca

SEQ ID NO: 421307 - DNA, 25 bp, Homo sapien
atcatgttgggttctctctgccata

SEQ ID NO: 421308 - DNA, 25 bp, Homo sapien
tcatgttgggttctctctgccatag

SEQ ID NO: 421309 - DNA, 25 bp, Homo sapien
tggcctttcaacacacgtagaaata

SEQ ID NO: 421310 - DNA, 25 bp, Homo sapien
acacgtagaaataggacacagagct

SEQ ID NO: 421311 - DNA, 25 bp, Homo sapien
ctgcagatgctggttggttcggtat

SEQ ID NO: 421312 - DNA, 25 bp, Homo sapien
ggagcactcctctgacaggtgagaa

SEQ ID NO: 421313 - DNA, 25 bp, Homo sapien
gagcactcctctgacaggtgagaag

SEQ ID NO: 421314 - DNA, 25 bp, Homo sapien
gcactcctctgacaggtgagaagat

SEQ ID NO: 421315 - DNA, 25 bp, Homo sapien
cactcctctgacaggtgagaagatg

SEQ ID NO: 421316 - DNA, 25 bp, Homo sapien
atagccaccttctgaactcaaactg

SEQ ID NO: 421317 - DNA, 25 bp, Homo sapien
tgtgccgttgttacctgtttccgtt

SEQ ID NO: 421318 - DNA, 25 bp, Homo sapien
tttccgtttccaagccagccctgag

SEQ ID NO: 421319 - DNA, 25 bp, Homo sapien
agccctgagagctgagcctccatat

SEQ ID NO: 421320 - DNA, 25 bp, Homo sapien
agctgagcctccatatgtgggatct

SEQ ID NO: 421321 - DNA, 25 bp, Homo sapien
gctgagcctccatatgtgggatctg

SEQ ID NO: 421322 - DNA, 25 bp, Homo sapien
ccagaattgcaagaataggccaggt

SEQ ID NO: 421323 - DNA, 25 bp, Homo sapien
cagaattgcaagaataggccaggtg

SEQ ID NO: 421324 - DNA, 25 bp, Homo sapien
agaattgcaagaataggccaggtgt

SEQ ID NO: 421325 - DNA, 25 bp, Homo sapien
gaattgcaagaataggccaggtgtg

SEQ ID NO: 421326 - DNA, 25 bp, Homo sapien
taatctcagtttcttgggaggttcg

SEQ ID NO: 421327 - DNA, 25 bp, Homo sapien
aatctcagtttcttgggaggttcgg

SEQ ID NO: 421328 - DNA, 25 bp, Homo sapien
atctcagtttcttgggaggttcggg

SEQ ID NO: 421329 - DNA, 25 bp, Homo sapien
tctcagtttcttgggaggttcgggt

SEQ ID NO: 421330 - DNA, 25 bp, Homo sapien
ctcagtttcttgggaggttcgggtg

SEQ ID NO: 421331 - DNA, 25 bp, Homo sapien
tcagtttcttgggaggttcgggtgg

SEQ ID NO: 421332 - DNA, 25 bp, Homo sapien
agagatcatcaaacagcactttaat

SEQ ID NO: 421333 - DNA, 25 bp, Homo sapien
atcaaacagcactttaatgacattt

SEQ ID NO: 421334 - DNA, 25 bp, Homo sapien
catcagatgtgtttggtaatcatac

SEQ ID NO: 421335 - DNA, 25 bp, Homo sapien
gtaatcatacaatcactctccatag

SEQ ID NO: 421336 - DNA, 25 bp, Homo sapien
atacaatcactctccatagaatcac

SEQ ID NO: 421337 - DNA, 25 bp, Homo sapien
atatttgacagaggccaatatctgg

SEQ ID NO: 421338 - DNA, 25 bp, Homo sapien
gacagaggccaatatctgggcaaat

SEQ ID NO: 421339 - DNA, 25 bp, Homo sapien
tatctgggcaaatacctaatggatg

SEQ ID NO: 421340 - DNA, 25 bp, Homo sapien
gaaaatggtgaattcaggctatcca

SEQ ID NO: 421341 - DNA, 25 bp, Homo sapien
tcaggctatccaaaacttcacattc

SEQ ID NO: 421342 - DNA, 25 bp, Homo sapien
acttcacattcaacctaatttactg

SEQ ID NO: 421343 - DNA, 25 bp, Homo sapien
agctatggccgtttgaccttcaaat

SEQ ID NO: 421344 - DNA, 25 bp, Homo sapien
ggccgtttgaccttcaaatatgaaa

SEQ ID NO: 421345 - DNA, 25 bp, Homo sapien
aagggattctaactaccacttgctc

SEQ ID NO: 421346 - DNA, 25 bp, Homo sapien
gaaagcatggtggaactattcccat

SEQ ID NO: 421347 - DNA, 25 bp, Homo sapien
ggtggaactattcccattgtaccca

SEQ ID NO: 421348 - DNA, 25 bp, Homo sapien
ttgtacccacggcagagttccaaga

SEQ ID NO: 421349 - DNA, 25 bp, Homo sapien
atatcgggtgcatctgagaaagaca

SEQ ID NO: 421350 - DNA, 25 bp, Homo sapien
cttggcatacacaatggagcgttct

SEQ ID NO: 421351 - DNA, 25 bp, Homo sapien
aatggagcgttctgccaggcaaatt

SEQ ID NO: 421352 - DNA, 25 bp, Homo sapien
tgaagtataacctgggattggacct

SEQ ID NO: 421353 - DNA, 25 bp, Homo sapien
gattggacctgagaacagctgccta

SEQ ID NO: 421354 - DNA, 25 bp, Homo sapien
agttgccttttacatactgggtcca

SEQ ID NO: 421355 - DNA, 25 bp, Homo sapien
gccttttacatactgggtccacata

SEQ ID NO: 421356 - DNA, 25 bp, Homo sapien
gggtccacataaggactgtgctata

SEQ ID NO: 421357 - DNA, 25 bp, Homo sapien
actgtgctatagttagattgtcaac

SEQ ID NO: 421358 - DNA, 25 bp, Homo sapien
gtcaacatcacatatagtgtcctgg

SEQ ID NO: 421359 - DNA, 25 bp, Homo sapien
atagtgtcctggtcaggctgcaact

SEQ ID NO: 421360 - DNA, 25 bp, Homo sapien
tctctccaaagcatgctcttcacat

SEQ ID NO: 421361 - DNA, 25 bp, Homo sapien
tgctcttcacatgctttagttcaaa

SEQ ID NO: 421362 - DNA, 25 bp, Homo sapien
cattatatctgattgctgcgtggca

SEQ ID NO: 421363 - DNA, 25 bp, Homo sapien
tgcgtggcaggctattctgctagtc

SEQ ID NO: 421364 - DNA, 25 bp, Homo sapien
attctgctagtccttcctttcacat

SEQ ID NO: 421365 - DNA, 25 bp, Homo sapien
gggagccctaagaatccatcctcag

SEQ ID NO: 421366 - DNA, 25 bp, Homo sapien
gagccctaagaatccatcctcagct

SEQ ID NO: 421367 - DNA, 25 bp, Homo sapien
agctcccaggcttgtctgagacatg

SEQ ID NO: 421368 - DNA, 25 bp, Homo sapien
gcttgtctgagacatggtacgtgtc

SEQ ID NO: 421369 - DNA, 25 bp, Homo sapien
acatggtacgtgtctggctggtctg

SEQ ID NO: 421370 - DNA, 25 bp, Homo sapien
gggaaagcctatcaccctctgggag

SEQ ID NO: 421371 - DNA, 25 bp, Homo sapien
atcaccctctgggagcttcagttct

SEQ ID NO: 421372 - DNA, 25 bp, Homo sapien
cactgatgagaggatcagttcagcc

SEQ ID NO: 421373 - DNA, 25 bp, Homo sapien
agttcagccttactccctgagagtt

SEQ ID NO: 421374 - DNA, 25 bp, Homo sapien
cctgagagtttcatggagatcgact

SEQ ID NO: 421375 - DNA, 25 bp, Homo sapien
agcaaagcccgctgtcctgggactg

SEQ ID NO: 421376 - DNA, 25 bp, Homo sapien
gagatcaagaactggtgtccggttt

SEQ ID NO: 421377 - DNA, 25 bp, Homo sapien
actggtgtccggtttgttcaagaga

SEQ ID NO: 421378 - DNA, 25 bp, Homo sapien
gactgatgatatgactcagcttcat

SEQ ID NO: 421379 - DNA, 25 bp, Homo sapien
atgactcagcttcatggttttcatc

SEQ ID NO: 421380 - DNA, 25 bp, Homo sapien
ggttttcatcagtctcttcgagacc

SEQ ID NO: 421381 - DNA, 25 bp, Homo sapien
gaacaaattcgccttggagatgatt

SEQ ID NO: 421382 - DNA, 25 bp, Homo sapien
gatttcaacagggagctttccagaa

SEQ ID NO: 421383 - DNA, 25 bp, Homo sapien
gctttccagaaggagccggtcagat

SEQ ID NO: 421384 - DNA, 25 bp, Homo sapien
ggagccggtcagatgccgaaacaaa

SEQ ID NO: 421385 - DNA, 25 bp, Homo sapien
aagaagtgttttttgtgaagagcct

SEQ ID NO: 421386 - DNA, 25 bp, Homo sapien
atacaatgcctgtcttctgctgaag

SEQ ID NO: 421387 - DNA, 25 bp, Homo sapien
tttttccaccttgcaaatagaaggg

SEQ ID NO: 421388 - DNA, 25 bp, Homo sapien
aaaaatcaaccttgcctatctgatg

SEQ ID NO: 421389 - DNA, 25 bp, Homo sapien
aaccttgcctatctgatgatttagt

SEQ ID NO: 421390 - DNA, 25 bp, Homo sapien
gatttagtgtcatagggattccaaa

SEQ ID NO: 421391 - DNA, 25 bp, Homo sapien
atgttatttgtaacgtgtaccttga

SEQ ID NO: 421392 - DNA, 25 bp, Homo sapien
gtaacgtgtaccttgatatgctaat

SEQ ID NO: 421393 - DNA, 25 bp, Homo sapien
atctcctgtttcttgatttggtctt

SEQ ID NO: 421394 - DNA, 25 bp, Homo sapien
tgtttcttgatttggtcttctcatc

SEQ ID NO: 421395 - DNA, 25 bp, Homo sapien
tcaaatccattctgcgacttcacca

SEQ ID NO: 421396 - DNA, 25 bp, Homo sapien
tgcgacttcaccagcagattaatat

SEQ ID NO: 421397 - DNA, 25 bp, Homo sapien
taatattctttcctggtctcttgga

SEQ ID NO: 421398 - DNA, 25 bp, Homo sapien
aaaccggctggatctcgagcccact

SEQ ID NO: 421399 - DNA, 25 bp, Homo sapien
cactcacctgaacgctgaacttttt

SEQ ID NO: 421400 - DNA, 25 bp, Homo sapien
acctgaacgctgaactttttagttg

SEQ ID NO: 421401 - DNA, 25 bp, Homo sapien
ttaccagatacgaacagggagtttt

SEQ ID NO: 421402 - DNA, 25 bp, Homo sapien
tttgtactgggtgtttatttcctgg

SEQ ID NO: 421403 - DNA, 25 bp, Homo sapien
gtttatttcctggaccatgggtact

SEQ ID NO: 421404 - DNA, 25 bp, Homo sapien
ttcctggaccatgggtactgccggt

SEQ ID NO: 421405 - DNA, 25 bp, Homo sapien
aaaagattttacagccgcccacctg

SEQ ID NO: 421406 - DNA, 25 bp, Homo sapien
gaggactccagcgaaagcttgagtt

SEQ ID NO: 421407 - DNA, 25 bp, Homo sapien
agcttgagttgctgaggattactga

SEQ ID NO: 421408 - DNA, 25 bp, Homo sapien
gctgccatcggagctagcagccgga

SEQ ID NO: 421409 - DNA, 25 bp, Homo sapien
ttagttcctcacctgatctttcctt

SEQ ID NO: 421410 - DNA, 25 bp, Homo sapien
gatctttccttgtatccacttcaga

SEQ ID NO: 421411 - DNA, 25 bp, Homo sapien
cttgtatccacttcagagtctctga

SEQ ID NO: 421412 - DNA, 25 bp, Homo sapien
tgtttgttggttcctgggaaattga

SEQ ID NO: 421413 - DNA, 25 bp, Homo sapien
gagccttttcaaagactccatctag

SEQ ID NO: 421414 - DNA, 25 bp, Homo sapien
aaagcttatcatcatgggtcattag

SEQ ID NO: 421415 - DNA, 25 bp, Homo sapien
tatcatcatgggtcattaggagaaa

SEQ ID NO: 421416 - DNA, 25 bp, Homo sapien
aggagaaatgcacagcaggaaccac

SEQ ID NO: 421417 - DNA, 25 bp, Homo sapien
gaggataccatcttcataccagtta

SEQ ID NO: 421418 - DNA, 25 bp, Homo sapien
gataccatcttcataccagttagga

SEQ ID NO: 421419 - DNA, 25 bp, Homo sapien
accagttaggatgggtgatcactta

SEQ ID NO: 421420 - DNA, 25 bp, Homo sapien
tgcaaggaggcagcaagaagtttct

SEQ ID NO: 421421 - DNA, 25 bp, Homo sapien
agaagtttctggaagccaagccact

SEQ ID NO: 421422 - DNA, 25 bp, Homo sapien
gtttctggaagccaagccactctgg

SEQ ID NO: 421423 - DNA, 25 bp, Homo sapien
agccactctggccaacactggagca

SEQ ID NO: 421424 - DNA, 25 bp, Homo sapien
tggcagccccaaaacgctctttgtt

SEQ ID NO: 421425 - DNA, 25 bp, Homo sapien
acgctctttgttcccctgccaaaga

SEQ ID NO: 421426 - DNA, 25 bp, Homo sapien
aaagacacccctattagcagtggcc

SEQ ID NO: 421427 - DNA, 25 bp, Homo sapien
acccctattagcagtggcctgggat

SEQ ID NO: 421428 - DNA, 25 bp, Homo sapien
cctattagcagtggcctgggattgg

SEQ ID NO: 421429 - DNA, 25 bp, Homo sapien
ggaggctggcatcataagtgaccca

SEQ ID NO: 421430 - DNA, 25 bp, Homo sapien
gctggcatcataagtgacccaaaga

SEQ ID NO: 421431 - DNA, 25 bp, Homo sapien
gcatggagcagagccgcttcaaacg

SEQ ID NO: 421432 - DNA, 25 bp, Homo sapien
ttcaaacgccaccagttgatcctgc

SEQ ID NO: 421433 - DNA, 25 bp, Homo sapien
gatcctgcctgcctttgagcatgag

SEQ ID NO: 421434 - DNA, 25 bp, Homo sapien
gcctttgagcatgagtaccgcagtg

SEQ ID NO: 421435 - DNA, 25 bp, Homo sapien
tggctcccagcacatctgcaagaag

SEQ ID NO: 421436 - DNA, 25 bp, Homo sapien
gaaatgcactacaaggccgtccaca

SEQ ID NO: 421437 - DNA, 25 bp, Homo sapien
aaggccgtccacaacacggctgtgc

SEQ ID NO: 421438 - DNA, 25 bp, Homo sapien
gtgctcttcctacagaacgaccctg

SEQ ID NO: 421439 - DNA, 25 bp, Homo sapien
gaacgaccctggctttgccaagtgg

SEQ ID NO: 421440 - DNA, 25 bp, Homo sapien
aggccgcagccacagctctggttct

SEQ ID NO: 421441 - DNA, 25 bp, Homo sapien
tcctcggaggccaaggaccgggact

SEQ ID NO: 421442 - DNA, 25 bp, Homo sapien
gctcttaaaggagatcacctcttaa

SEQ ID NO: 421443 - DNA, 25 bp, Homo sapien
taaaggacccacctttcaatgccat

SEQ ID NO: 421444 - DNA, 25 bp, Homo sapien
ttcaatgccattacactggcaattt

SEQ ID NO: 421445 - DNA, 25 bp, Homo sapien
gtacttcaaagccaatttattctct

SEQ ID NO: 421446 - DNA, 25 bp, Homo sapien
tttattctcttaattagcttcatta

SEQ ID NO: 421447 - DNA, 25 bp, Homo sapien
tagcttcattattcttgtctttgtg

SEQ ID NO: 421448 - DNA, 25 bp, Homo sapien
tcttgtctttgtgtgtggattacct

SEQ ID NO: 421449 - DNA, 25 bp, Homo sapien
tctttgtgtgtggattacctaaact

SEQ ID NO: 421450 - DNA, 25 bp, Homo sapien
aggagcccacttctgacataactaa

SEQ ID NO: 421451 - DNA, 25 bp, Homo sapien
tgacataactaacccacacctgaga

SEQ ID NO: 421452 - DNA, 25 bp, Homo sapien
ccacacctgagataacggcattaat

SEQ ID NO: 421453 - DNA, 25 bp, Homo sapien
catgtgtccagccttctctctagtg

SEQ ID NO: 421454 - DNA, 25 bp, Homo sapien
atgtgtccagccttctctctagtgt

SEQ ID NO: 421455 - DNA, 25 bp, Homo sapien
tgtgtccagccttctctctagtgtc

SEQ ID NO: 421456 - DNA, 25 bp, Homo sapien
gtgtccagccttctctctagtgtct

SEQ ID NO: 421457 - DNA, 25 bp, Homo sapien
tgtccagccttctctctagtgtctt

SEQ ID NO: 421458 - DNA, 25 bp, Homo sapien
gtccagccttctctctagtgtcttt

SEQ ID NO: 421459 - DNA, 25 bp, Homo sapien
tccagccttctctctagtgtcttta

SEQ ID NO: 421460 - DNA, 25 bp, Homo sapien
ccagccttctctctagtgtctttaa

SEQ ID NO: 421461 - DNA, 25 bp, Homo sapien
cagccttctctctagtgtctttaag

SEQ ID NO: 421462 - DNA, 25 bp, Homo sapien
agccttctctctagtgtctttaagt

SEQ ID NO: 421463 - DNA, 25 bp, Homo sapien
gccttctctctagtgtctttaagtt

SEQ ID NO: 421464 - DNA, 25 bp, Homo sapien
tttaacctgagcgtcctctgctcag

SEQ ID NO: 421465 - DNA, 25 bp, Homo sapien
aacctgagcgtcctctgctcaggat

SEQ ID NO: 421466 - DNA, 25 bp, Homo sapien
cctgagcgtcctctgctcaggatca

SEQ ID NO: 421467 - DNA, 25 bp, Homo sapien
tctgctcaggatcataccccagcct

SEQ ID NO: 421468 - DNA, 25 bp, Homo sapien
ccccagcctgcactgagtcaagaag

SEQ ID NO: 421469 - DNA, 25 bp, Homo sapien
cccagcctgcactgagtcaagaagg

SEQ ID NO: 421470 - DNA, 25 bp, Homo sapien
cagcctgcactgagtcaagaaggag

SEQ ID NO: 421471 - DNA, 25 bp, Homo sapien
gcctgcactgagtcaagaaggagaa

SEQ ID NO: 421472 - DNA, 25 bp, Homo sapien
cctgagaaagagctgtgggtaggaa

SEQ ID NO: 421473 - DNA, 25 bp, Homo sapien
gtaggaagggagtgagcattgcaga

SEQ ID NO: 421474 - DNA, 25 bp, Homo sapien
gagtgagcattgcagagatagggct

SEQ ID NO: 421475 - DNA, 25 bp, Homo sapien
ggttctgaggacacaggcctttctg

SEQ ID NO: 421476 - DNA, 25 bp, Homo sapien
gttttaacacctcagttcatgggac

SEQ ID NO: 421477 - DNA, 25 bp, Homo sapien
ttcatgggactttggtgctaacact

SEQ ID NO: 421478 - DNA, 25 bp, Homo sapien
tggtgctaacactgggtaagtccca

SEQ ID NO: 421479 - DNA, 25 bp, Homo sapien
tgggtaagtcccatgagatcatctg

SEQ ID NO: 421480 - DNA, 25 bp, Homo sapien
tgagatcatctggttaccctcagtg

SEQ ID NO: 421481 - DNA, 25 bp, Homo sapien
atctggttaccctcagtgcatctcg

SEQ ID NO: 421482 - DNA, 25 bp, Homo sapien
agtgcatctcgccattctgctactg

SEQ ID NO: 421483 - DNA, 25 bp, Homo sapien
tactgcaccttcctgtcaagagtta

SEQ ID NO: 421484 - DNA, 25 bp, Homo sapien
gcaccttcctgtcaagagttacaga

SEQ ID NO: 421485 - DNA, 25 bp, Homo sapien
gttacagacctgagcgccgtatgat

SEQ ID NO: 421486 - DNA, 25 bp, Homo sapien
gttgatccactttaaactgagtaac

SEQ ID NO: 421487 - DNA, 25 bp, Homo sapien
gatccactttaaactgagtaactgt

SEQ ID NO: 421488 - DNA, 25 bp, Homo sapien
attctgccttacatcaatttttgca

SEQ ID NO: 421489 - DNA, 25 bp, Homo sapien
atatatccttgaaatcggctatttc

SEQ ID NO: 421490 - DNA, 25 bp, Homo sapien
atcggctatttcaattttatcagac

SEQ ID NO: 421491 - DNA, 25 bp, Homo sapien
caattttatcagacttttaccagag

SEQ ID NO: 421492 - DNA, 25 bp, Homo sapien
tttaccagagtaaaacttgcttctg

SEQ ID NO: 421493 - DNA, 25 bp, Homo sapien
acttgcttctgtagcaggcctctca

SEQ ID NO: 421494 - DNA, 25 bp, Homo sapien
ctgtagcaggcctctcattttttat

SEQ ID NO: 421495 - DNA, 25 bp, Homo sapien
cattttttattatgaggtctgtttt

SEQ ID NO: 421496 - DNA, 25 bp, Homo sapien
aatacttaatttgaacagctctaag

SEQ ID NO: 421497 - DNA, 25 bp, Homo sapien
ggtggcagaatggatttattgagaa

SEQ ID NO: 421498 - DNA, 25 bp, Homo sapien
cgactgcataacgaggaggacttaa

SEQ ID NO: 421499 - DNA, 25 bp, Homo sapien
gggcattgccaggacaagctagcaa

SEQ ID NO: 421500 - DNA, 25 bp, Homo sapien
aggacaagctagcaaccgaatgtag

SEQ ID NO: 421501 - DNA, 25 bp, Homo sapien
gaaattcccagggtgaccttagcta

SEQ ID NO: 421502 - DNA, 25 bp, Homo sapien
gggtgaccttagctaagactcctag

SEQ ID NO: 421503 - DNA, 25 bp, Homo sapien
cgaggaggacttaaggactgatgtt

SEQ ID NO: 421504 - DNA, 25 bp, Homo sapien
aagactcctagcaatggcagatatg

SEQ ID NO: 421505 - DNA, 25 bp, Homo sapien
ggatcctgaactggccatctcctgt

SEQ ID NO: 421506 - DNA, 25 bp, Homo sapien
gactgatgtttgaatctcactggga

SEQ ID NO: 421507 - DNA, 25 bp, Homo sapien
gatgtttgaatctcactgggaagga

SEQ ID NO: 421508 - DNA, 25 bp, Homo sapien
ctggcccctccataaatctgaagag

SEQ ID NO: 421509 - DNA, 25 bp, Homo sapien
gaaatggcgttgtcacttgaatcaa

SEQ ID NO: 421510 - DNA, 25 bp, Homo sapien
gaatcaaggccactttttgtcctac

SEQ ID NO: 421511 - DNA, 25 bp, Homo sapien
ctttttgtcctacttgagcatctca

SEQ ID NO: 421512 - DNA, 25 bp, Homo sapien
gaattttgcatatttcttgttgcca

SEQ ID NO: 421513 - DNA, 25 bp, Homo sapien
ttttttgggtgtaccgagagtgcca

SEQ ID NO: 421514 - DNA, 25 bp, Homo sapien
gtgtaccgagagtgccagtgactgt

SEQ ID NO: 421515 - DNA, 25 bp, Homo sapien
gccagtgactgtgcttcttacaatt

SEQ ID NO: 421516 - DNA, 25 bp, Homo sapien
tcttgttgccataatgctgtgctat

SEQ ID NO: 421517 - DNA, 25 bp, Homo sapien
gctgtgctattttaccctgattttc

SEQ ID NO: 421518 - DNA, 25 bp, Homo sapien
aatatgggtgacaatactggcccct

SEQ ID NO: 421519 - DNA, 25 bp, Homo sapien
gtgcagccaagtcacaaaagtgctt

SEQ ID NO: 421520 - DNA, 25 bp, Homo sapien
agtattactgagcagccattttaga

SEQ ID NO: 421521 - DNA, 25 bp, Homo sapien
gattggcagtgctctgaacgcatgt

SEQ ID NO: 421522 - DNA, 25 bp, Homo sapien
atgttaaacagccagctactcccac

SEQ ID NO: 421523 - DNA, 25 bp, Homo sapien
tactcccacttgcagagtctgagat

SEQ ID NO: 421524 - DNA, 25 bp, Homo sapien
gagtctgagatctgactagcagcaa

SEQ ID NO: 421525 - DNA, 25 bp, Homo sapien
gcaaagtgtagcacattcgccgatg

SEQ ID NO: 421526 - DNA, 25 bp, Homo sapien
cgccgatgctgggtacctagttaaa

SEQ ID NO: 421527 - DNA, 25 bp, Homo sapien
aagaggcatttgtagccctctgctc

SEQ ID NO: 421528 - DNA, 25 bp, Homo sapien
agctttgttactaagactcacctat

SEQ ID NO: 421529 - DNA, 25 bp, Homo sapien
actcacctattgttagtgcagccaa

SEQ ID NO: 421530 - DNA, 25 bp, Homo sapien
gtgattgtttagaggtcagaagtcc

SEQ ID NO: 421531 - DNA, 25 bp, Homo sapien
gattgtttagaggtcagaagtccag

SEQ ID NO: 421532 - DNA, 25 bp, Homo sapien
tgtttagaggtcagaagtccaggcc

SEQ ID NO: 421533 - DNA, 25 bp, Homo sapien
gtttagaggtcagaagtccaggccg

SEQ ID NO: 421534 - DNA, 25 bp, Homo sapien
tttagaggtcagaagtccaggccgg

SEQ ID NO: 421535 - DNA, 25 bp, Homo sapien
ttagaggtcagaagtccaggccggc

SEQ ID NO: 421536 - DNA, 25 bp, Homo sapien
agaggtcagaagtccaggccggcgc

SEQ ID NO: 421537 - DNA, 25 bp, Homo sapien
aggtcagaagtccaggccggcgcgg

SEQ ID NO: 421538 - DNA, 25 bp, Homo sapien
gtcagaagtccaggccggcgcggcg

SEQ ID NO: 421539 - DNA, 25 bp, Homo sapien
cggcgcggcggcttatgcccctaat

SEQ ID NO: 421540 - DNA, 25 bp, Homo sapien
ggcgcggcggcttatgcccctaatc

SEQ ID NO: 421541 - DNA, 25 bp, Homo sapien
gctggtgattttggtactgtttatt

SEQ ID NO: 421542 - DNA, 25 bp, Homo sapien
acatttgctaaattttctcgtggta

SEQ ID NO: 421543 - DNA, 25 bp, Homo sapien
tttctcgtggtatagttcacttata

SEQ ID NO: 421544 - DNA, 25 bp, Homo sapien
gttcacttataatgacatcactact

SEQ ID NO: 421545 - DNA, 25 bp, Homo sapien
gacatcactactgtgctttaaatat

SEQ ID NO: 421546 - DNA, 25 bp, Homo sapien
gtgtctttaatattttgctggttgc

SEQ ID NO: 421547 - DNA, 25 bp, Homo sapien
gtattttctatttaatgttgcagtt

SEQ ID NO: 421548 - DNA, 25 bp, Homo sapien
gttgcagttcatttagagtagagat

SEQ ID NO: 421549 - DNA, 25 bp, Homo sapien
gagtagagatgtacctcatttaaca

SEQ ID NO: 421550 - DNA, 25 bp, Homo sapien
gagatgtacctcatttaacatagag

SEQ ID NO: 421551 - DNA, 25 bp, Homo sapien
atgtatttctaaaaacttgtgtcta

SEQ ID NO: 421552 - DNA, 25 bp, Homo sapien
gggaaacaagtcaaacaaactcagg

SEQ ID NO: 421553 - DNA, 25 bp, Homo sapien
ggaaacaagtcaaacaaactcaggt

SEQ ID NO: 421554 - DNA, 25 bp, Homo sapien
gaaacaagtcaaacaaactcaggtg

SEQ ID NO: 421555 - DNA, 25 bp, Homo sapien
aaacaagtcaaacaaactcaggtgt

SEQ ID NO: 421556 - DNA, 25 bp, Homo sapien
aacaagtcaaacaaactcaggtgtg

SEQ ID NO: 421557 - DNA, 25 bp, Homo sapien
aatgaggcttttccagtccagaggg

SEQ ID NO: 421558 - DNA, 25 bp, Homo sapien
tgaggcttttccagtccagaggggc

SEQ ID NO: 421559 - DNA, 25 bp, Homo sapien
aggcttttccagtccagaggggcca

SEQ ID NO: 421560 - DNA, 25 bp, Homo sapien
ggcttttccagtccagaggggccac

SEQ ID NO: 421561 - DNA, 25 bp, Homo sapien
gcttttccagtccagaggggccacc

SEQ ID NO: 421562 - DNA, 25 bp, Homo sapien
cacacaagtcccacaaactcaggtg

SEQ ID NO: 421563 - DNA, 25 bp, Homo sapien
ggtcatttccctgagttacactgaa

SEQ ID NO: 421564 - DNA, 25 bp, Homo sapien
cctgagttacactgaagatggtccc

SEQ ID NO: 421565 - DNA, 25 bp, Homo sapien
ggagcatcttaatttaagccctcta

SEQ ID NO: 421566 - DNA, 25 bp, Homo sapien
ttaatttaagccctctacatccctg

SEQ ID NO: 421567 - DNA, 25 bp, Homo sapien
tacatccctgcacggtagatacaac

SEQ ID NO: 421568 - DNA, 25 bp, Homo sapien
ggtagatacaaccagctccgtttcc

SEQ ID NO: 421569 - DNA, 25 bp, Homo sapien
atacaaccagctccgtttccaagga

SEQ ID NO: 421570 - DNA, 25 bp, Homo sapien
accagctccgtttccaaggacgagg

SEQ ID NO: 421571 - DNA, 25 bp, Homo sapien
tccgtttccaaggacgaggagcaac

SEQ ID NO: 421572 - DNA, 25 bp, Homo sapien
gcaacagagtgaggtcatttccctg

SEQ ID NO: 421573 - DNA, 25 bp, Homo sapien
gagtgaggtcatttccctgagttac

SEQ ID NO: 421574 - DNA, 25 bp, Homo sapien
tagttaattgaaatggaattggcaa

SEQ ID NO: 421575 - DNA, 25 bp, Homo sapien
ttgaaatggaattggcaatgtggga

SEQ ID NO: 421576 - DNA, 25 bp, Homo sapien
tgaaatggaattggcaatgtgggaa

SEQ ID NO: 421577 - DNA, 25 bp, Homo sapien
aaatggaattggcaatgtgggaaat

SEQ ID NO: 421578 - DNA, 25 bp, Homo sapien
aatggaattggcaatgtgggaaata

SEQ ID NO: 421579 - DNA, 25 bp, Homo sapien
tggaattggcaatgtgggaaataag

SEQ ID NO: 421580 - DNA, 25 bp, Homo sapien
ggaattggcaatgtgggaaataaga

SEQ ID NO: 421581 - DNA, 25 bp, Homo sapien
gaattggcaatgtgggaaataagaa

SEQ ID NO: 421582 - DNA, 25 bp, Homo sapien
aattggcaatgtgggaaataagaaa

SEQ ID NO: 421583 - DNA, 25 bp, Homo sapien
ttggcaatgtgggaaataagaaatc

SEQ ID NO: 421584 - DNA, 25 bp, Homo sapien
ataagaaatcacatttttggccagg

SEQ ID NO: 421585 - DNA, 25 bp, Homo sapien
tgcacattgctcaccaacacacagg

SEQ ID NO: 421586 - DNA, 25 bp, Homo sapien
attgctcaccaacacacagggtaga

SEQ ID NO: 421587 - DNA, 25 bp, Homo sapien
acagggtagaaaaccactagctctt

SEQ ID NO: 421588 - DNA, 25 bp, Homo sapien
tggagagaacagaacatgcagcctc

SEQ ID NO: 421589 - DNA, 25 bp, Homo sapien
gtccccagaaacagccgcagacttg

SEQ ID NO: 421590 - DNA, 25 bp, Homo sapien
gaaacagccgcagacttgagctcac

SEQ ID NO: 421591 - DNA, 25 bp, Homo sapien
cgcagacttgagctcactacatcaa

SEQ ID NO: 421592 - DNA, 25 bp, Homo sapien
gagctcactacatcaagaacaccac

SEQ ID NO: 421593 - DNA, 25 bp, Homo sapien
acagctacaagcacagagacagagg

SEQ ID NO: 421594 - DNA, 25 bp, Homo sapien
caagcaaacttgaacccgagaatgt

SEQ ID NO: 421595 - DNA, 25 bp, Homo sapien
cttgaacccgagaatgtacacagaa

SEQ ID NO: 421596 - DNA, 25 bp, Homo sapien
ttcagtcaaggtacaacatccaggc

SEQ ID NO: 421597 - DNA, 25 bp, Homo sapien
agtcaaggtacaacatccaggcggt

SEQ ID NO: 421598 - DNA, 25 bp, Homo sapien
tcaaggtacaacatccaggcggtaa

SEQ ID NO: 421599 - DNA, 25 bp, Homo sapien
aggtacaacatccaggcggtaaaat

SEQ ID NO: 421600 - DNA, 25 bp, Homo sapien
acatccaggcggtaaaatgctccca

SEQ ID NO: 421601 - DNA, 25 bp, Homo sapien
atccaggcggtaaaatgctcccatc

SEQ ID NO: 421602 - DNA, 25 bp, Homo sapien
ccaggcggtaaaatgctcccatcag

SEQ ID NO: 421603 - DNA, 25 bp, Homo sapien
aggcggtaaaatgctcccatcagcc

SEQ ID NO: 421604 - DNA, 25 bp, Homo sapien
aaaatgctcccatcagccacttact

SEQ ID NO: 421605 - DNA, 25 bp, Homo sapien
aatgctcccatcagccacttactgg

SEQ ID NO: 421606 - DNA, 25 bp, Homo sapien
catcagccacttactggcgcagtgg

SEQ ID NO: 421607 - DNA, 25 bp, Homo sapien
agtttagttattttgttctgttctg

SEQ ID NO: 421608 - DNA, 25 bp, Homo sapien
gttctgttctgtcatgtgccacaaa

SEQ ID NO: 421609 - DNA, 25 bp, Homo sapien
gtcatgtgccacaaaatatgtactt

SEQ ID NO: 421610 - DNA, 25 bp, Homo sapien
ttttccctttgtatatcagttacgg

SEQ ID NO: 421611 - DNA, 25 bp, Homo sapien
acgggttacaactggttcattctga

SEQ ID NO: 421612 - DNA, 25 bp, Homo sapien
gtgcccaagtaattcactacagcct

SEQ ID NO: 421613 - DNA, 25 bp, Homo sapien
actacagcctaaagccttgcctttg

SEQ ID NO: 421614 - DNA, 25 bp, Homo sapien
agccttgcctttgtaatttgacttc

SEQ ID NO: 421615 - DNA, 25 bp, Homo sapien
taatttgacttctgacatgttggca

SEQ ID NO: 421616 - DNA, 25 bp, Homo sapien
gttggcaatcaaagcatgcacttgt

SEQ ID NO: 421617 - DNA, 25 bp, Homo sapien
caaagcatgcacttgtaacaatgaa

SEQ ID NO: 421618 - DNA, 25 bp, Homo sapien
ttggagcctcccctagcttacacag

SEQ ID NO: 421619 - DNA, 25 bp, Homo sapien
tcccctagcttacacagttaacttg

SEQ ID NO: 421620 - DNA, 25 bp, Homo sapien
agcttacacagttaacttgatttta

SEQ ID NO: 421621 - DNA, 25 bp, Homo sapien
tttttcatcacatgccaaaaacggg

SEQ ID NO: 421622 - DNA, 25 bp, Homo sapien
agaaggagtggcaggcctaggcccc

SEQ ID NO: 421623 - DNA, 25 bp, Homo sapien
taggcccctccgattgtcccttggg

SEQ ID NO: 421624 - DNA, 25 bp, Homo sapien
agcccacctcactatggtgctgggt

SEQ ID NO: 421625 - DNA, 25 bp, Homo sapien
cacctcactatggtgctgggtagag

SEQ ID NO: 421626 - DNA, 25 bp, Homo sapien
gatacctgggttctaacctctaaat

SEQ ID NO: 421627 - DNA, 25 bp, Homo sapien
agcctccacaaagaggcccttttat

SEQ ID NO: 421628 - DNA, 25 bp, Homo sapien
gattagccattttaaaccaacgagg

SEQ ID NO: 421629 - DNA, 25 bp, Homo sapien
gtccctgatcatcctggagggaaag

SEQ ID NO: 421630 - DNA, 25 bp, Homo sapien
gaactgcactcttcaatgcaattat

SEQ ID NO: 421631 - DNA, 25 bp, Homo sapien
gcaattatacagtgagccccttcag

SEQ ID NO: 421632 - DNA, 25 bp, Homo sapien
tgagccccttcagcaacttaaggtg

SEQ ID NO: 421633 - DNA, 25 bp, Homo sapien
ataagcaagatactgggagaggtcc

SEQ ID NO: 421634 - DNA, 25 bp, Homo sapien
ggagaggtcctgtttccctgacaat

SEQ ID NO: 421635 - DNA, 25 bp, Homo sapien
cctgtttccctgacaatcatgactt

SEQ ID NO: 421636 - DNA, 25 bp, Homo sapien
cagtgagaacacaaagtcgaacgga

SEQ ID NO: 421637 - DNA, 25 bp, Homo sapien
gatatacagcaactctggatgcaga

SEQ ID NO: 421638 - DNA, 25 bp, Homo sapien
gacgaccttcttggtgattttgtgg

SEQ ID NO: 421639 - DNA, 25 bp, Homo sapien
caaagcaaagctctctgcacatcac

SEQ ID NO: 421640 - DNA, 25 bp, Homo sapien
aggcctttcattaacctatctagaa

SEQ ID NO: 421641 - DNA, 25 bp, Homo sapien
taacctatctagaagtccccaatgc

SEQ ID NO: 421642 - DNA, 25 bp, Homo sapien
gaagtccccaatgcagtaggaaaac

SEQ ID NO: 421643 - DNA, 25 bp, Homo sapien
gtaggaaaacatgttcattccccta

SEQ ID NO: 421644 - DNA, 25 bp, Homo sapien
gttcattcccctaacattgcagtat

SEQ ID NO: 421645 - DNA, 25 bp, Homo sapien
gcagtatatactagcattagctttc

SEQ ID NO: 421646 - DNA, 25 bp, Homo sapien
aaatagtccttagtttgtacatcat

SEQ ID NO: 421647 - DNA, 25 bp, Homo sapien
gtccttagtttgtacatcattttgt

SEQ ID NO: 421648 - DNA, 25 bp, Homo sapien
gatgtcatccatttttagtgctgcg

SEQ ID NO: 421649 - DNA, 25 bp, Homo sapien
atccatttttagtgctgcgactgta

SEQ ID NO: 421650 - DNA, 25 bp, Homo sapien
tagtgctgcgactgtaaacgtacaa

SEQ ID NO: 421651 - DNA, 25 bp, Homo sapien
tccaggagggagacagcgctgttat

SEQ ID NO: 421652 - DNA, 25 bp, Homo sapien
gagacagcgctgttatcaagtgtac

SEQ ID NO: 421653 - DNA, 25 bp, Homo sapien
cagcgctgttatcaagtgtacttat

SEQ ID NO: 421654 - DNA, 25 bp, Homo sapien
caagtgtacttattcagacagtgcc

SEQ ID NO: 421655 - DNA, 25 bp, Homo sapien
ttcagacagtgcctcaaactacttc

SEQ ID NO: 421656 - DNA, 25 bp, Homo sapien
tgcctcaaactacttcccttggtat

SEQ ID NO: 421657 - DNA, 25 bp, Homo sapien
caaactacttcccttggtataagca

SEQ ID NO: 421658 - DNA, 25 bp, Homo sapien
tgtatttatattcctgtggctgcag

SEQ ID NO: 421659 - DNA, 25 bp, Homo sapien
atttatattcctgtggctgcagctg

SEQ ID NO: 421660 - DNA, 25 bp, Homo sapien
cagctggacttggtgaatggagaga

SEQ ID NO: 421661 - DNA, 25 bp, Homo sapien
tgtggagcagcatccttcaaccctg

SEQ ID NO: 421662 - DNA, 25 bp, Homo sapien
tcctgggactttatcaccgtgccag

SEQ ID NO: 421663 - DNA, 25 bp, Homo sapien
gagacttacagggtgcgaacattcc

SEQ ID NO: 421664 - DNA, 25 bp, Homo sapien
tcaccgtgccagacttcatggagga

SEQ ID NO: 421665 - DNA, 25 bp, Homo sapien
gacttcatggaggaactgtttacca

SEQ ID NO: 421666 - DNA, 25 bp, Homo sapien
actgtttaccagaatgttagatgtg

SEQ ID NO: 421667 - DNA, 25 bp, Homo sapien
gttagatgtgacagcctcatggcct

SEQ ID NO: 421668 - DNA, 25 bp, Homo sapien
tcatggcctcctctaggtatggtgg

SEQ ID NO: 421669 - DNA, 25 bp, Homo sapien
tcctctaggtatggtggcatcttcc

SEQ ID NO: 421670 - DNA, 25 bp, Homo sapien
ggtgcgaacattccagataggtaca

SEQ ID NO: 421671 - DNA, 25 bp, Homo sapien
ctggttccagcctttctgggtagaa

SEQ ID NO: 421672 - DNA, 25 bp, Homo sapien
tctgggtagaaccatctcctcctat

SEQ ID NO: 421673 - DNA, 25 bp, Homo sapien
ccccagcaaagaggtatttctatta

SEQ ID NO: 421674 - DNA, 25 bp, Homo sapien
tagtaaagcatagtacacccctctt

SEQ ID NO: 421675 - DNA, 25 bp, Homo sapien
tagtacacccctcttctttaggtct

SEQ ID NO: 421676 - DNA, 25 bp, Homo sapien
tcttctttaggtctgcctgcagtag

SEQ ID NO: 421677 - DNA, 25 bp, Homo sapien
gtctgcctgcagtagccagttaata

SEQ ID NO: 421678 - DNA, 25 bp, Homo sapien
gcctgcagtagccagttaatataag

SEQ ID NO: 421679 - DNA, 25 bp, Homo sapien
taagttggtaatctgcagtgcacac

SEQ ID NO: 421680 - DNA, 25 bp, Homo sapien
gtaatctgcagtgcacacccattta

SEQ ID NO: 421681 - DNA, 25 bp, Homo sapien
tctgcagtgcacacccatttaaaaa

SEQ ID NO: 421682 - DNA, 25 bp, Homo sapien
ggataccttccccaaactaatccat

SEQ ID NO: 421683 - DNA, 25 bp, Homo sapien
ttttttcttcccacagcgtttgctg

SEQ ID NO: 421684 - DNA, 25 bp, Homo sapien
accagtggcaagcacctggcagatg

SEQ ID NO: 421685 - DNA, 25 bp, Homo sapien
atggagcccgggtgtttctgcgtaa

SEQ ID NO: 421686 - DNA, 25 bp, Homo sapien
aggaatccagcttttccatgagatt

SEQ ID NO: 421687 - DNA, 25 bp, Homo sapien
tttccatgagattcagctgcagttg

SEQ ID NO: 421688 - DNA, 25 bp, Homo sapien
gctgcagttgtcgaaaaccctgtgt

SEQ ID NO: 421689 - DNA, 25 bp, Homo sapien
aaaaccctgtgtgagccagcagttc

SEQ ID NO: 421690 - DNA, 25 bp, Homo sapien
gtttttattggagagcctgtggcgc

SEQ ID NO: 421691 - DNA, 25 bp, Homo sapien
aacagctgcgaggtggccaggctcc

SEQ ID NO: 421692 - DNA, 25 bp, Homo sapien
gtgagtcaccactcaggcctgagta

SEQ ID NO: 421693 - DNA, 25 bp, Homo sapien
tcaggcctgagtacaccgtggagag

SEQ ID NO: 421694 - DNA, 25 bp, Homo sapien
gcgctgaagtgccaccaaggatttg

SEQ ID NO: 421695 - DNA, 25 bp, Homo sapien
gaagcagaacacaaaccctttaaat

SEQ ID NO: 421696 - DNA, 25 bp, Homo sapien
ggaaatatttctttgcaaactctct

SEQ ID NO: 421697 - DNA, 25 bp, Homo sapien
ttgcaaactctctgtatggccacag

SEQ ID NO: 421698 - DNA, 25 bp, Homo sapien
tgtatggccacagcagggcattctt

SEQ ID NO: 421699 - DNA, 25 bp, Homo sapien
acagcagggcattctttctccagaa

SEQ ID NO: 421700 - DNA, 25 bp, Homo sapien
tatatcatcactcatcagctagcca

SEQ ID NO: 421701 - DNA, 25 bp, Homo sapien
tcatcactcatcagctagccataca

SEQ ID NO: 421702 - DNA, 25 bp, Homo sapien
aaaattctcatcatttaccctgcct

SEQ ID NO: 421703 - DNA, 25 bp, Homo sapien
attctcatcatttaccctgcctaaa

SEQ ID NO: 421704 - DNA, 25 bp, Homo sapien
gtattcatttcgtctagcagcactg

SEQ ID NO: 421705 - DNA, 25 bp, Homo sapien
ttcgtctagcagcactggacacaca

SEQ ID NO: 421706 - DNA, 25 bp, Homo sapien
gacccatggcatcaactgcagtgtt

SEQ ID NO: 421707 - DNA, 25 bp, Homo sapien
gtttctgctgtgttcatcttctcag

SEQ ID NO: 421708 - DNA, 25 bp, Homo sapien
gtgttcatcttctcagaaaactctg

SEQ ID NO: 421709 - DNA, 25 bp, Homo sapien
aaaactctgtgacccagttctttgg

SEQ ID NO: 421710 - DNA, 25 bp, Homo sapien
agttctttgggagcttttgtcagtc

SEQ ID NO: 421711 - DNA, 25 bp, Homo sapien
ttttgtcagtctctttcgtgccatc

SEQ ID NO: 421712 - DNA, 25 bp, Homo sapien
tcgtgccatctaccttcgaaggaag

SEQ ID NO: 421713 - DNA, 25 bp, Homo sapien
ggagcgggacaatactcaatcctat

SEQ ID NO: 421714 - DNA, 25 bp, Homo sapien
attgagattagtttcctactgggag

SEQ ID NO: 421715 - DNA, 25 bp, Homo sapien
ctactgggagtaagtgcctggccct

SEQ ID NO: 421716 - DNA, 25 bp, Homo sapien
ccctgctactcctatttgaatgcta

SEQ ID NO: 421717 - DNA, 25 bp, Homo sapien
gtatttcttctgcagaggattgcca

SEQ ID NO: 421718 - DNA, 25 bp, Homo sapien
gcagaggattgccagaaatttctta

SEQ ID NO: 421719 - DNA, 25 bp, Homo sapien
gagtgataatttggtgatccaccta

SEQ ID NO: 421720 - DNA, 25 bp, Homo sapien
gtgatccacctatgtaccttttgat

SEQ ID NO: 421721 - DNA, 25 bp, Homo sapien
gtttgattcaaacctgctgataaaa

SEQ ID NO: 421722 - DNA, 25 bp, Homo sapien
gtaccttttgatgtctcatcacaga

SEQ ID NO: 421723 - DNA, 25 bp, Homo sapien
tcatcacagagattagtgcttcctc

SEQ ID NO: 421724 - DNA, 25 bp, Homo sapien
gtgcttcctctgataatacatttgc

SEQ ID NO: 421725 - DNA, 25 bp, Homo sapien
aatacatttgcttgatcctgctaat

SEQ ID NO: 421726 - DNA, 25 bp, Homo sapien
gatcctgctaataagaactcacctt

SEQ ID NO: 421727 - DNA, 25 bp, Homo sapien
ataaatctccccattatgtagttaa

SEQ ID NO: 421728 - DNA, 25 bp, Homo sapien
tgaacacaaatctcagtcagacagt

SEQ ID NO: 421729 - DNA, 25 bp, Homo sapien
agtgatagcttattgcaccccagga

SEQ ID NO: 421730 - DNA, 25 bp, Homo sapien
aggactggtcaaccaggtctaccat

SEQ ID NO: 421731 - DNA, 25 bp, Homo sapien
gcgtcgacattctcatgactacttt

SEQ ID NO: 421732 - DNA, 25 bp, Homo sapien
ggtctaccatctgtattcaggaact

SEQ ID NO: 421733 - DNA, 25 bp, Homo sapien
tgtaacccagaggtaagaccatcga

SEQ ID NO: 421734 - DNA, 25 bp, Homo sapien
aagaccatcgagagaccagtccagt

SEQ ID NO: 421735 - DNA, 25 bp, Homo sapien
gagaccagtccagtgtaacttccga

SEQ ID NO: 421736 - DNA, 25 bp, Homo sapien
gtaacttccgactggatgttctatt

SEQ ID NO: 421737 - DNA, 25 bp, Homo sapien
gagatcaggatgttactggcatcta

SEQ ID NO: 421738 - DNA, 25 bp, Homo sapien
gaggtccaaggattttcccacaaat

SEQ ID NO: 421739 - DNA, 25 bp, Homo sapien
gggagccctaagaatccatcctcag

SEQ ID NO: 421740 - DNA, 25 bp, Homo sapien
gagccctaagaatccatcctcagct

SEQ ID NO: 421741 - DNA, 25 bp, Homo sapien
gcttgtctgagacatggtacgtgtc

SEQ ID NO: 421742 - DNA, 25 bp, Homo sapien
tctgagacatggtacgtgtctggct

SEQ ID NO: 421743 - DNA, 25 bp, Homo sapien
acatggtacgtgtctggctggtctg

SEQ ID NO: 421744 - DNA, 25 bp, Homo sapien
ggctggtctgggacaggagaaatta

SEQ ID NO: 421745 - DNA, 25 bp, Homo sapien
gggaaagcctatcaccctctgggag

SEQ ID NO: 421746 - DNA, 25 bp, Homo sapien
gaaagcctatcaccctctgggagct

SEQ ID NO: 421747 - DNA, 25 bp, Homo sapien
cactgatgagaggatcagttcagcc

SEQ ID NO: 421748 - DNA, 25 bp, Homo sapien
agcaaagcccgctgtcctgggactg

SEQ ID NO: 421749 - DNA, 25 bp, Homo sapien
caaagcccgctgtcctgggactggg

SEQ ID NO: 421750 - DNA, 25 bp, Homo sapien
gcaggaggctctgaacctcttcaag

SEQ ID NO: 421751 - DNA, 25 bp, Homo sapien
acctcttcaagagcatctggaacaa

SEQ ID NO: 421752 - DNA, 25 bp, Homo sapien
ggaacaacagatggctgcgcaccat

SEQ ID NO: 421753 - DNA, 25 bp, Homo sapien
tgcgcaccatctctgtgatcctgtt

SEQ ID NO: 421754 - DNA, 25 bp, Homo sapien
ctgttcctcaacaagcaagatctgc

SEQ ID NO: 421755 - DNA, 25 bp, Homo sapien
gatctgctcgctgagaaagtccttg

SEQ ID NO: 421756 - DNA, 25 bp, Homo sapien
aaagtccttgctgggaaatcgaaga

SEQ ID NO: 421757 - DNA, 25 bp, Homo sapien
gaagattgaggactactttccagaa

SEQ ID NO: 421758 - DNA, 25 bp, Homo sapien
ctttccagaatttgctcgctacact

SEQ ID NO: 421759 - DNA, 25 bp, Homo sapien
tcgctacactactcctgaggatgct

SEQ ID NO: 421760 - DNA, 25 bp, Homo sapien
tgaggatgctactcccgagcccgga

SEQ ID NO: 421761 - DNA, 25 bp, Homo sapien
cctcccgtgcatggacattttttaa

SEQ ID NO: 421762 - DNA, 25 bp, Homo sapien
tttaaaccaccgattccaagaggat

SEQ ID NO: 421763 - DNA, 25 bp, Homo sapien
aaccaccgattccaagaggatgagg

SEQ ID NO: 421764 - DNA, 25 bp, Homo sapien
gaggatgaggagtgttttctaaaat

SEQ ID NO: 421765 - DNA, 25 bp, Homo sapien
ctggaccagactcagtggacatttg

SEQ ID NO: 421766 - DNA, 25 bp, Homo sapien
cagactcagtggacatttgtgcaat

SEQ ID NO: 421767 - DNA, 25 bp, Homo sapien
ggacatttgtgcaattgctcgccct

SEQ ID NO: 421768 - DNA, 25 bp, Homo sapien
atttgtgcaattgctcgccctggag

SEQ ID NO: 421769 - DNA, 25 bp, Homo sapien
aattgctcgccctggagggaaccag

SEQ ID NO: 421770 - DNA, 25 bp, Homo sapien
tcgccctggagggaaccagatcatt

SEQ ID NO: 421771 - DNA, 25 bp, Homo sapien
gggaaccagatcatttttaaaccag

SEQ ID NO: 421772 - DNA, 25 bp, Homo sapien
ctttgttcactggtacgtgggtgag

SEQ ID NO: 421773 - DNA, 25 bp, Homo sapien
cccgtgaagatatggctgcccttga

SEQ ID NO: 421774 - DNA, 25 bp, Homo sapien
ggagaggaatactaattatccattc

SEQ ID NO: 421775 - DNA, 25 bp, Homo sapien
gagaggaatactaattatccattcc

SEQ ID NO: 421776 - DNA, 25 bp, Homo sapien
agaggaatactaattatccattcct

SEQ ID NO: 421777 - DNA, 25 bp, Homo sapien
gaggaatactaattatccattcctt

SEQ ID NO: 421778 - DNA, 25 bp, Homo sapien
aggaatactaattatccattccttt

SEQ ID NO: 421779 - DNA, 25 bp, Homo sapien
ggaatactaattatccattcctttt

SEQ ID NO: 421780 - DNA, 25 bp, Homo sapien
gaatactaattatccattccttttg

SEQ ID NO: 421781 - DNA, 25 bp, Homo sapien
atactaattatccattccttttggc

SEQ ID NO: 421782 - DNA, 25 bp, Homo sapien
taattatccattccttttggccctg

SEQ ID NO: 421783 - DNA, 25 bp, Homo sapien
acaaactgggtggtcctggataaat

SEQ ID NO: 421784 - DNA, 25 bp, Homo sapien
acttaacctctgtggtcttcagttt

SEQ ID NO: 421785 - DNA, 25 bp, Homo sapien
tcctcccaactttgtagggttattg

SEQ ID NO: 421786 - DNA, 25 bp, Homo sapien
attcaatcagtgttcattcccttct

SEQ ID NO: 421787 - DNA, 25 bp, Homo sapien
aagacttataatggccttttcatgg

SEQ ID NO: 421788 - DNA, 25 bp, Homo sapien
tttcatggaattgtctctacctata

SEQ ID NO: 421789 - DNA, 25 bp, Homo sapien
gtgactgtgccttcagattatcaaa

SEQ ID NO: 421790 - DNA, 25 bp, Homo sapien
tatgaattgtccatgtgcccttggt

SEQ ID NO: 421791 - DNA, 25 bp, Homo sapien
gtgcccttggttttgaatgttcaat

SEQ ID NO: 421792 - DNA, 25 bp, Homo sapien
aattctgtattgcaggaatgcctac

SEQ ID NO: 421793 - DNA, 25 bp, Homo sapien
ggaatgcctactcagttgcttgaat

SEQ ID NO: 421794 - DNA, 25 bp, Homo sapien
ggcagaggatctccatgagggccct

SEQ ID NO: 421795 - DNA, 25 bp, Homo sapien
tggccatccaggcatttccgcacat

SEQ ID NO: 421796 - DNA, 25 bp, Homo sapien
aggcatttccgcacatcctctttaa

SEQ ID NO: 421797 - DNA, 25 bp, Homo sapien
tttccgcacatcctctttaatctag

SEQ ID NO: 421798 - DNA, 25 bp, Homo sapien
gcacatcctctttaatctaggcgaa

SEQ ID NO: 421799 - DNA, 25 bp, Homo sapien
tcctctttaatctaggcgaaggttt

SEQ ID NO: 421800 - DNA, 25 bp, Homo sapien
tccaaaccccagttcttgacttctg

SEQ ID NO: 421801 - DNA, 25 bp, Homo sapien
actcgcagtctcaacaccacatgga

SEQ ID NO: 421802 - DNA, 25 bp, Homo sapien
atggaagctgtcaaggcttggagct

SEQ ID NO: 421803 - DNA, 25 bp, Homo sapien
ggcttggagcttgcactccccgaag

SEQ ID NO: 421804 - DNA, 25 bp, Homo sapien
ggagcttgcactccccgaagctaca

SEQ ID NO: 421805 - DNA, 25 bp, Homo sapien
caaactttccttaaagttctcattg

SEQ ID NO: 421806 - DNA, 25 bp, Homo sapien
ttgcactgcttctgtgaacagtctt

SEQ ID NO: 421807 - DNA, 25 bp, Homo sapien
gggcagtcctggtcaagacactcat

SEQ ID NO: 421808 - DNA, 25 bp, Homo sapien
gacactcatgccctggcaatgtggc

SEQ ID NO: 421809 - DNA, 25 bp, Homo sapien
atgccctggcaatgtggctgccaga

SEQ ID NO: 421810 - DNA, 25 bp, Homo sapien
acccaccagtttcttgttgatttgg

SEQ ID NO: 421811 - DNA, 25 bp, Homo sapien
tgttgatttggagaggtcaaggcca

SEQ ID NO: 421812 - DNA, 25 bp, Homo sapien
ccccacttggcttgaagggacattt

SEQ ID NO: 421813 - DNA, 25 bp, Homo sapien
ttgaagggacattttcagacttttc

SEQ ID NO: 421814 - DNA, 25 bp, Homo sapien
ttctgtcacttggagtgtctatgcc

SEQ ID NO: 421815 - DNA, 25 bp, Homo sapien
gtcacttggagtgtctatgcctctc

SEQ ID NO: 421816 - DNA, 25 bp, Homo sapien
agaatcttctacctcataacttcct

SEQ ID NO: 421817 - DNA, 25 bp, Homo sapien
tccaaaggcagctcagaagattaga

SEQ ID NO: 421818 - DNA, 25 bp, Homo sapien
ggcagctcagaagattagaaccaga

SEQ ID NO: 421819 - DNA, 25 bp, Homo sapien
gattagaaccagacttactaaccaa

SEQ ID NO: 421820 - DNA, 25 bp, Homo sapien
gttttctatggaactgatctaagat

SEQ ID NO: 421821 - DNA, 25 bp, Homo sapien
atttacatgactctaagactataag

SEQ ID NO: 421822 - DNA, 25 bp, Homo sapien
cagtgacaaagtgctagcatttatt

SEQ ID NO: 421823 - DNA, 25 bp, Homo sapien
gtgctagcatttattgttatctaat

SEQ ID NO: 421824 - DNA, 25 bp, Homo sapien
gttatctaataaagaccttggagca

SEQ ID NO: 421825 - DNA, 25 bp, Homo sapien
gaccttggagcatatgtgcaactta

SEQ ID NO: 421826 - DNA, 25 bp, Homo sapien
atatgtgcaacttatgagtgtatca

SEQ ID NO: 421827 - DNA, 25 bp, Homo sapien
gcgcccggcctaacctgaaacttct

SEQ ID NO: 421828 - DNA, 25 bp, Homo sapien
aaacttcttgagtactgaagtgaca

SEQ ID NO: 421829 - DNA, 25 bp, Homo sapien
aacttcttgagtactgaagtgacac

SEQ ID NO: 421830 - DNA, 25 bp, Homo sapien
gtgacactcaaagaactactcattg

SEQ ID NO: 421831 - DNA, 25 bp, Homo sapien
tgacactcaaagaactactcattgg

SEQ ID NO: 421832 - DNA, 25 bp, Homo sapien
gacactcaaagaactactcattgga

SEQ ID NO: 421833 - DNA, 25 bp, Homo sapien
acactcaaagaactactcattggag

SEQ ID NO: 421834 - DNA, 25 bp, Homo sapien
actcaaagaactactcattggagca

SEQ ID NO: 421835 - DNA, 25 bp, Homo sapien
caaagaactactcattggagcagtt

SEQ ID NO: 421836 - DNA, 25 bp, Homo sapien
aagaactactcattggagcagttca

SEQ ID NO: 421837 - DNA, 25 bp, Homo sapien
gaactactcattggagcagttcaga

SEQ ID NO: 421838 - DNA, 25 bp, Homo sapien
ttaaccattgtgtttgtgccctacc

SEQ ID NO: 421839 - DNA, 25 bp, Homo sapien
gtagactgagaagaatccacgaggt

SEQ ID NO: 421840 - DNA, 25 bp, Homo sapien
atccacgaggtgctatctggccaga

SEQ ID NO: 421841 - DNA, 25 bp, Homo sapien
tctggccagatttaagtagattcta

SEQ ID NO: 421842 - DNA, 25 bp, Homo sapien
agtagattctatttccttggttctc

SEQ ID NO: 421843 - DNA, 25 bp, Homo sapien
ccctgaggacctcttattttattgt

SEQ ID NO: 421844 - DNA, 25 bp, Homo sapien
tcttattttattgtcccctcttcta

SEQ ID NO: 421845 - DNA, 25 bp, Homo sapien
ttgtcccctcttctaggttaattct

SEQ ID NO: 421846 - DNA, 25 bp, Homo sapien
ggttaattctcctttgatttgactt

SEQ ID NO: 421847 - DNA, 25 bp, Homo sapien
gacagtagattagcaaagttccaag

SEQ ID NO: 421848 - DNA, 25 bp, Homo sapien
gttccaagtgcaaaattacagtgtg

SEQ ID NO: 421849 - DNA, 25 bp, Homo sapien
gcgtcagtgaaagtcgtccttgtct

SEQ ID NO: 421850 - DNA, 25 bp, Homo sapien
tcagtgaaagtcgtccttgtctcag

SEQ ID NO: 421851 - DNA, 25 bp, Homo sapien
agccagtgtctgaccaaggtcaagg

SEQ ID NO: 421852 - DNA, 25 bp, Homo sapien
ggatggctccgaagccagaaatgcc

SEQ ID NO: 421853 - DNA, 25 bp, Homo sapien
agaaatgccttaaactgcaacgtcc

SEQ ID NO: 421854 - DNA, 25 bp, Homo sapien
cctcctaggagcaggacccgatgaa

SEQ ID NO: 421855 - DNA, 25 bp, Homo sapien
cctaggagcaggacccgatgaagcg

SEQ ID NO: 421856 - DNA, 25 bp, Homo sapien
gggctgggtgccgtgttactaactc

SEQ ID NO: 421857 - DNA, 25 bp, Homo sapien
gggtgccgtgttactaactctagta

SEQ ID NO: 421858 - DNA, 25 bp, Homo sapien
gccgtgttactaactctagtatgtt

SEQ ID NO: 421859 - DNA, 25 bp, Homo sapien
ttactaactctagtatgtttctgtg

SEQ ID NO: 421860 - DNA, 25 bp, Homo sapien
ctgtggctccctcggaatgctaagg

SEQ ID NO: 421861 - DNA, 25 bp, Homo sapien
ggatcggacatgaaaggaccctgtg

SEQ ID NO: 421862 - DNA, 25 bp, Homo sapien
tgaaaggaccctgtgagccgattgt

SEQ ID NO: 421863 - DNA, 25 bp, Homo sapien
tgtgagccgattgtcctatctccag

SEQ ID NO: 421864 - DNA, 25 bp, Homo sapien
gtcatccagctcactcatcaatggg

SEQ ID NO: 421865 - DNA, 25 bp, Homo sapien
caggcactgggctccggaggactca

SEQ ID NO: 421866 - DNA, 25 bp, Homo sapien
tggtgcaagttgaggacttcttgct

SEQ ID NO: 421867 - DNA, 25 bp, Homo sapien
acttcttgctggtctagtcacgcat

SEQ ID NO: 421868 - DNA, 25 bp, Homo sapien
ctggtctagtcacgcatgcagtgtt

SEQ ID NO: 421869 - DNA, 25 bp, Homo sapien
atgccttggtttttactgctctgag

SEQ ID NO: 421870 - DNA, 25 bp, Homo sapien
cttggtttttactgctctgagaatt

SEQ ID NO: 421871 - DNA, 25 bp, Homo sapien
tgatattttaacagtaaggttcacg

SEQ ID NO: 421872 - DNA, 25 bp, Homo sapien
cagactactttgaagtaagcagcaa

SEQ ID NO: 421873 - DNA, 25 bp, Homo sapien
aagatatggttgaagagtctgaggc

SEQ ID NO: 421874 - DNA, 25 bp, Homo sapien
agacctctcttccaaatgttcacca

SEQ ID NO: 421875 - DNA, 25 bp, Homo sapien
atgttcaccatagctcatgacttcc

SEQ ID NO: 421876 - DNA, 25 bp, Homo sapien
atagctcatgacttcctctcggcta

SEQ ID NO: 421877 - DNA, 25 bp, Homo sapien
atgacttcctctcggctatcactca

SEQ ID NO: 421878 - DNA, 25 bp, Homo sapien
tcacccctgtcctcagagtgataaa

SEQ ID NO: 421879 - DNA, 25 bp, Homo sapien
gtcctcagagtgataaactaagtca

SEQ ID NO: 421880 - DNA, 25 bp, Homo sapien
actaagtcacatacagataaagcac

SEQ ID NO: 421881 - DNA, 25 bp, Homo sapien
accccccaccaatatgtaattctat

SEQ ID NO: 421882 - DNA, 25 bp, Homo sapien
gtcaagaattagcagaaaccctctg

SEQ ID NO: 421883 - DNA, 25 bp, Homo sapien
gaaaccctctgcatttacaaacact

SEQ ID NO: 421884 - DNA, 25 bp, Homo sapien
gcatttacaaacactttgtgctata

SEQ ID NO: 421885 - DNA, 25 bp, Homo sapien
gagaaaacaaatatacctgtccaaa

SEQ ID NO: 421886 - DNA, 25 bp, Homo sapien
atacctgtccaaaccatatactttt

SEQ ID NO: 421887 - DNA, 25 bp, Homo sapien
ttttttccatacaagctgttgttaa

SEQ ID NO: 421888 - DNA, 25 bp, Homo sapien
ggtaaagtgctgatttgcaaacttc

SEQ ID NO: 421889 - DNA, 25 bp, Homo sapien
gtgctgatttgcaaacttcatcaaa

SEQ ID NO: 421890 - DNA, 25 bp, Homo sapien
gcaaacttcatcaaattgttcccaa

SEQ ID NO: 421891 - DNA, 25 bp, Homo sapien
ttgttcccaagtggattctccttgt

SEQ ID NO: 421892 - DNA, 25 bp, Homo sapien
gcaccatgtgcacagtcaagaatta

SEQ ID NO: 421893 - DNA, 25 bp, Homo sapien
agagcatcaccaggagtgcctgcta

SEQ ID NO: 421894 - DNA, 25 bp, Homo sapien
gagtgcctgctagtgtactggcagc

SEQ ID NO: 421895 - DNA, 25 bp, Homo sapien
tgctagtgtactggcagcttgccac

SEQ ID NO: 421896 - DNA, 25 bp, Homo sapien
cttcacccagacacgtggtagggat

SEQ ID NO: 421897 - DNA, 25 bp, Homo sapien
aaaggattcttcacagagcactctg

SEQ ID NO: 421898 - DNA, 25 bp, Homo sapien
agagcactctggcacaccatatcgg

SEQ ID NO: 421899 - DNA, 25 bp, Homo sapien
ggcacaccatatcggagaaaacttg

SEQ ID NO: 421900 - DNA, 25 bp, Homo sapien
ttggtatgttctccctcaaccaaga

SEQ ID NO: 421901 - DNA, 25 bp, Homo sapien
ctccctcaaccaagatcttctaaaa

SEQ ID NO: 421902 - DNA, 25 bp, Homo sapien
ggaactgactgtgaagcgacgccca

SEQ ID NO: 421903 - DNA, 25 bp, Homo sapien
agcgacgcccagtgaaaaacatgtt

SEQ ID NO: 421904 - DNA, 25 bp, Homo sapien
ttggaaccctggtccctatactctg

SEQ ID NO: 421905 - DNA, 25 bp, Homo sapien
tggtccctatactctgcagtcagaa

SEQ ID NO: 421906 - DNA, 25 bp, Homo sapien
gaagtgggactgagccatacatgcc

SEQ ID NO: 421907 - DNA, 25 bp, Homo sapien
gactgagccatacatgcccttgaat

SEQ ID NO: 421908 - DNA, 25 bp, Homo sapien
tacatgcccttgaattcctccctgt

SEQ ID NO: 421909 - DNA, 25 bp, Homo sapien
tctccagcaagcagggttttcttta

SEQ ID NO: 421910 - DNA, 25 bp, Homo sapien
gttttctttaacttggcagtgtgca

SEQ ID NO: 421911 - DNA, 25 bp, Homo sapien
tgcagaggagaagtggtaacacccc

SEQ ID NO: 421912 - DNA, 25 bp, Homo sapien
attcccctgcatcggagctcagtat

SEQ ID NO: 421913 - DNA, 25 bp, Homo sapien
ggagctcagtattcctacagggtaa

SEQ ID NO: 421914 - DNA, 25 bp, Homo sapien
taagaggtaggaatcttgctgggac

SEQ ID NO: 421915 - DNA, 25 bp, Homo sapien
gccagtaacatcctgatctcattaa

SEQ ID NO: 421916 - DNA, 25 bp, Homo sapien
ggaagttacactggactggtctctc

SEQ ID NO: 421917 - DNA, 25 bp, Homo sapien
tggactggtctctcgatggtcttac

SEQ ID NO: 421918 - DNA, 25 bp, Homo sapien
atggtcttacctctgggttacagtt

SEQ ID NO: 421919 - DNA, 25 bp, Homo sapien
tggtagacctggttgaccagtcctg

SEQ ID NO: 421920 - DNA, 25 bp, Homo sapien
gcgtcgacgccattttgttctgaga

SEQ ID NO: 421921 - DNA, 25 bp, Homo sapien
ataagctatcactgtctgactgaga

SEQ ID NO: 421922 - DNA, 25 bp, Homo sapien
tgtgggaaaatccttggacctccaa

SEQ ID NO: 421923 - DNA, 25 bp, Homo sapien
ttgttctgagatgcttccctgaaac

SEQ ID NO: 421924 - DNA, 25 bp, Homo sapien
tgaaacatgaggatgcctcctctgc

SEQ ID NO: 421925 - DNA, 25 bp, Homo sapien
ctctgctcggagtttgttttataga

SEQ ID NO: 421926 - DNA, 25 bp, Homo sapien
ttatgtacagaaccgtacgggaatc

SEQ ID NO: 421927 - DNA, 25 bp, Homo sapien
tgctggaaagtcacagaaattgtct

SEQ ID NO: 421928 - DNA, 25 bp, Homo sapien
aaattgtctgtgagtgtaggtacac

SEQ ID NO: 421929 - DNA, 25 bp, Homo sapien
gtaggtacacatagatacccacata

SEQ ID NO: 421930 - DNA, 25 bp, Homo sapien
atagatacccacatatacatgtgca

SEQ ID NO: 421931 - DNA, 25 bp, Homo sapien
acatgtgcacacagttttactttgt

SEQ ID NO: 421932 - DNA, 25 bp, Homo sapien
gaaccgtacgggaatcagcatggat

SEQ ID NO: 421933 - DNA, 25 bp, Homo sapien
taacttactgtgaaggtactacatg

SEQ ID NO: 421934 - DNA, 25 bp, Homo sapien
gaaggtactacatgttcattccaga

SEQ ID NO: 421935 - DNA, 25 bp, Homo sapien
agcatggatggcctaagcttgtatt

SEQ ID NO: 421936 - DNA, 25 bp, Homo sapien
ggatggcctaagcttgtattgacag

SEQ ID NO: 421937 - DNA, 25 bp, Homo sapien
gaggcgcttcgccagtgaggtgcgg

SEQ ID NO: 421938 - DNA, 25 bp, Homo sapien
gcttcgccagtgaggtgcgggctca

SEQ ID NO: 421939 - DNA, 25 bp, Homo sapien
gggctcagggcctcgagtctctcct

SEQ ID NO: 421940 - DNA, 25 bp, Homo sapien
tcagggcctcgagtctctcctggag

SEQ ID NO: 421941 - DNA, 25 bp, Homo sapien
agggcctcgagtctctcctggagca

SEQ ID NO: 421942 - DNA, 25 bp, Homo sapien
gggcctcgagtctctcctggagcac

SEQ ID NO: 421943 - DNA, 25 bp, Homo sapien
ctctcctggagcacgggctgcggtg

SEQ ID NO: 421944 - DNA, 25 bp, Homo sapien
cggccagtccttgcccacaacgatg

SEQ ID NO: 421945 - DNA, 25 bp, Homo sapien
gtcggattcgaataaagggccacgt

SEQ ID NO: 421946 - DNA, 25 bp, Homo sapien
cggattcgaataaagggccacgtgt

SEQ ID NO: 421947 - DNA, 25 bp, Homo sapien
gattcgaataaagggccacgtgtgc

SEQ ID NO: 421948 - DNA, 25 bp, Homo sapien
agagtgtttttctattcttctctcc

SEQ ID NO: 421949 - DNA, 25 bp, Homo sapien
tattcttctctccaccgtcttctat

SEQ ID NO: 421950 - DNA, 25 bp, Homo sapien
cgtcttctattccttccttgaattt

SEQ ID NO: 421951 - DNA, 25 bp, Homo sapien
atttcactgtcttacccacagcaag

SEQ ID NO: 421952 - DNA, 25 bp, Homo sapien
agcaagcccatctcagactggtaga

SEQ ID NO: 421953 - DNA, 25 bp, Homo sapien
atctcagactggtagaggttctcct

SEQ ID NO: 421954 - DNA, 25 bp, Homo sapien
aggttctcctaggtgtccccatagc

SEQ ID NO: 421955 - DNA, 25 bp, Homo sapien
taggtgtccccatagcactgtagat

SEQ ID NO: 421956 - DNA, 25 bp, Homo sapien
gtccccatagcactgtagatacact

SEQ ID NO: 421957 - DNA, 25 bp, Homo sapien
gatacactcagtactggagccccag

SEQ ID NO: 421958 - DNA, 25 bp, Homo sapien
gcttcagccccttcaaaactatttt

SEQ ID NO: 421959 - DNA, 25 bp, Homo sapien
attttgctaaatgcccttgtgctac

SEQ ID NO: 421960 - DNA, 25 bp, Homo sapien
acgactgacagtgttcttctcttta

SEQ ID NO: 421961 - DNA, 25 bp, Homo sapien
gttcttctctttatgtgttttgctg

SEQ ID NO: 421962 - DNA, 25 bp, Homo sapien
gaatgctgctggaaacttttgcgaa

SEQ ID NO: 421963 - DNA, 25 bp, Homo sapien
gttgtatgccaacttctgatgttca

SEQ ID NO: 421964 - DNA, 25 bp, Homo sapien
gatgttcaaaatcgtgcttggctac

SEQ ID NO: 421965 - DNA, 25 bp, Homo sapien
gcttggctactgtctgagatgtttt

SEQ ID NO: 421966 - DNA, 25 bp, Homo sapien
gttttggtttgtttagtctctggag

SEQ ID NO: 421967 - DNA, 25 bp, Homo sapien
tttgcgaaatcaaccatgcctcact

SEQ ID NO: 421968 - DNA, 25 bp, Homo sapien
atgcctcactgtttaggccttagaa

SEQ ID NO: 421969 - DNA, 25 bp, Homo sapien
aactggatgcctgtaatgtttaccg

SEQ ID NO: 421970 - DNA, 25 bp, Homo sapien
gtgaacagattctctgcagactccc

SEQ ID NO: 421971 - DNA, 25 bp, Homo sapien
acagattctctgcagactcccaggt

SEQ ID NO: 421972 - DNA, 25 bp, Homo sapien
aggtcccattctgtgcttgttccca

SEQ ID NO: 421973 - DNA, 25 bp, Homo sapien
acctcccagtagtggcggccacagg

SEQ ID NO: 421974 - DNA, 25 bp, Homo sapien
ggacacgtcaaatctctcggcaagg

SEQ ID NO: 421975 - DNA, 25 bp, Homo sapien
cgtcaaatctctcggcaaggtcttg

SEQ ID NO: 421976 - DNA, 25 bp, Homo sapien
caaggtcttgccgattctgtgtgat

SEQ ID NO: 421977 - DNA, 25 bp, Homo sapien
ccacttcggacgctcctgaggtcgt

SEQ ID NO: 421978 - DNA, 25 bp, Homo sapien
gaagttgttggctgtgtcggcatcc

SEQ ID NO: 421979 - DNA, 25 bp, Homo sapien
gctgtgtcggcatccaaggtcatat

SEQ ID NO: 421980 - DNA, 25 bp, Homo sapien
gcatccaaggtcatatccactgtga

SEQ ID NO: 421981 - DNA, 25 bp, Homo sapien
gtcaagttgttctttgtatccttta

SEQ ID NO: 421982 - DNA, 25 bp, Homo sapien
ttgtatcctttaatgctttatgtgc

SEQ ID NO: 421983 - DNA, 25 bp, Homo sapien
gctttatgtgcaacctttcattgat

SEQ ID NO: 421984 - DNA, 25 bp, Homo sapien
caacctttcattgatagtgggctga

SEQ ID NO: 421985 - DNA, 25 bp, Homo sapien
agtgggctgatgtttggcaatgctt

SEQ ID NO: 421986 - DNA, 25 bp, Homo sapien
ggcaatgcttctgaactgtcacaga

SEQ ID NO: 421987 - DNA, 25 bp, Homo sapien
ggctgtagctttccacagccactgc

SEQ ID NO: 421988 - DNA, 25 bp, Homo sapien
agccactgcccatgcataagcagaa

SEQ ID NO: 421989 - DNA, 25 bp, Homo sapien
gaacagcctggccttttgaatgtat

SEQ ID NO: 421990 - DNA, 25 bp, Homo sapien
gccttttgaatgtattttcctgggt

SEQ ID NO: 421991 - DNA, 25 bp, Homo sapien
gttgcaaagcactggcattttatgt

SEQ ID NO: 421992 - DNA, 25 bp, Homo sapien
aaggctacagaggtcaactcagtgg

SEQ ID NO: 421993 - DNA, 25 bp, Homo sapien
aactcagtggaacacggttctccca

SEQ ID NO: 421994 - DNA, 25 bp, Homo sapien
acacggttctcccaaacagattttg

SEQ ID NO: 421995 - DNA, 25 bp, Homo sapien
gtaattccgaaaatccacgcatgcg

SEQ ID NO: 421996 - DNA, 25 bp, Homo sapien
aaatccacgcatgcgcaaacatacg

SEQ ID NO: 421997 - DNA, 25 bp, Homo sapien
aaacatacgcatacactcccatgtt

SEQ ID NO: 421998 - DNA, 25 bp, Homo sapien
gttcctggacagtttatagctacca

SEQ ID NO: 421999 - DNA, 25 bp, Homo sapien
gctaccataacctggcattttccaa

SEQ ID NO: 422000 - DNA, 25 bp, Homo sapien
taccatgtagactcttggatacaca

SEQ ID NO: 422001 - DNA, 25 bp, Homo sapien
gccacattaggatgaaccttttaaa

SEQ ID NO: 422002 - DNA, 25 bp, Homo sapien
ccccactggctgtattataggacaa

SEQ ID NO: 422003 - DNA, 25 bp, Homo sapien
gcatacttgcaaggagctggaactc

SEQ ID NO: 422004 - DNA, 25 bp, Homo sapien
gtgccaggccaattccagtacatgt

SEQ ID NO: 422005 - DNA, 25 bp, Homo sapien
aagtcagcctctgcatatgatcagg

SEQ ID NO: 422006 - DNA, 25 bp, Homo sapien
tatgatcagggctcaggtttgcggt

SEQ ID NO: 422007 - DNA, 25 bp, Homo sapien
aatgcgtaggaatgccacagccctg

SEQ ID NO: 422008 - DNA, 25 bp, Homo sapien
acagccctgccgtacatgatgggca

SEQ ID NO: 422009 - DNA, 25 bp, Homo sapien
gaagatagaaatccacccactcaca

SEQ ID NO: 422010 - DNA, 25 bp, Homo sapien
cacccactcacagcttgttattgta

SEQ ID NO: 422011 - DNA, 25 bp, Homo sapien
gtatgatctaccacagttccaggag

SEQ ID NO: 422012 - DNA, 25 bp, Homo sapien
ggagcagccagatatagattagtac

SEQ ID NO: 422013 - DNA, 25 bp, Homo sapien
agtactgattttcttctgaactaca

SEQ ID NO: 422014 - DNA, 25 bp, Homo sapien
ccacttgtcaccctaggattttgga

SEQ ID NO: 422015 - DNA, 25 bp, Homo sapien
ttgtcaccctaggattttggagatt

SEQ ID NO: 422016 - DNA, 25 bp, Homo sapien
atcctgaagaaggtgagcactgcct

SEQ ID NO: 422017 - DNA, 25 bp, Homo sapien
tgaagaaggtgagcactgcctgccc

SEQ ID NO: 422018 - DNA, 25 bp, Homo sapien
gaaggtgagcactgcctgccctagc

SEQ ID NO: 422019 - DNA, 25 bp, Homo sapien
ggtgagcactgcctgccctagcctt

SEQ ID NO: 422020 - DNA, 25 bp, Homo sapien
tctccacaagccagtcctttagaaa

SEQ ID NO: 422021 - DNA, 25 bp, Homo sapien
tccacaagccagtcctttagaaatg

SEQ ID NO: 422022 - DNA, 25 bp, Homo sapien
agccagtcctttagaaatgggcact

SEQ ID NO: 422023 - DNA, 25 bp, Homo sapien
cagtcctttagaaatgggcactcag

SEQ ID NO: 422024 - DNA, 25 bp, Homo sapien
atgggcactcagattgcttgaacct

SEQ ID NO: 422025 - DNA, 25 bp, Homo sapien
ggaaaatggaatttcttactatata

SEQ ID NO: 422026 - DNA, 25 bp, Homo sapien
agagactcattgtattagagaatca

SEQ ID NO: 422027 - DNA, 25 bp, Homo sapien
tattagagaatcaagtcagccagct

SEQ ID NO: 422028 - DNA, 25 bp, Homo sapien
agagaatcaagtcagccagctaaag

SEQ ID NO: 422029 - DNA, 25 bp, Homo sapien
agtcagccagctaaagtatcctact

SEQ ID NO: 422030 - DNA, 25 bp, Homo sapien
gccagctaaagtatcctactgttaa

SEQ ID NO: 422031 - DNA, 25 bp, Homo sapien
taaagtatcctactgttaaatcctt

SEQ ID NO: 422032 - DNA, 25 bp, Homo sapien
gaaagttaatcaatgtatttacctt

SEQ ID NO: 422033 - DNA, 25 bp, Homo sapien
tgtatttaccttacatgttggaaag

SEQ ID NO: 422034 - DNA, 25 bp, Homo sapien
gaactatgttaggtctgattcatgt

SEQ ID NO: 422035 - DNA, 25 bp, Homo sapien
tgttaggtctgattcatgtgaagaa

SEQ ID NO: 422036 - DNA, 25 bp, Homo sapien
ggcttcccgtagctcgcaggcactg

SEQ ID NO: 422037 - DNA, 25 bp, Homo sapien
gcaggcactgccgtaggtgacaccg

SEQ ID NO: 422038 - DNA, 25 bp, Homo sapien
taggtgacaccgtcgctgccacaca

SEQ ID NO: 422039 - DNA, 25 bp, Homo sapien
tgcggagcacacagccccaaaagca

SEQ ID NO: 422040 - DNA, 25 bp, Homo sapien
aagcacacacagcatctccacaggt

SEQ ID NO: 422041 - DNA, 25 bp, Homo sapien
acaggtctcacagggtccagctgag

SEQ ID NO: 422042 - DNA, 25 bp, Homo sapien
acagggtccagctgaggccacgtgc

SEQ ID NO: 422043 - DNA, 25 bp, Homo sapien
ccacgtgcaggctgatctggtgtgt

SEQ ID NO: 422044 - DNA, 25 bp, Homo sapien
gtgcacgtgcagcatgcactcgctg

SEQ ID NO: 422045 - DNA, 25 bp, Homo sapien
tacgtgtgcccgtcggagccacaca

SEQ ID NO: 422046 - DNA, 25 bp, Homo sapien
tgggccaaagccacgcattcagagg

SEQ ID NO: 422047 - DNA, 25 bp, Homo sapien
tggtatgtccagtaccctggtcaac

SEQ ID NO: 422048 - DNA, 25 bp, Homo sapien
gtatgtccagtaccctggtcaacac

SEQ ID NO: 422049 - DNA, 25 bp, Homo sapien
tgtccagtaccctggtcaacacctt

SEQ ID NO: 422050 - DNA, 25 bp, Homo sapien
ttcagcttctcctcaagtacttttc

SEQ ID NO: 422051 - DNA, 25 bp, Homo sapien
tcagcttctcctcaagtacttttca

SEQ ID NO: 422052 - DNA, 25 bp, Homo sapien
gcttctcctcaagtacttttcaggg

SEQ ID NO: 422053 - DNA, 25 bp, Homo sapien
ctcaagtacttttcaggggatccac

SEQ ID NO: 422054 - DNA, 25 bp, Homo sapien
aggggatccactggttaaaggcatc

SEQ ID NO: 422055 - DNA, 25 bp, Homo sapien
aagagtaaattctcctttaatctga

SEQ ID NO: 422056 - DNA, 25 bp, Homo sapien
gagtaaattctcctttaatctgagg

SEQ ID NO: 422057 - DNA, 25 bp, Homo sapien
taaattctcctttaatctgaggaaa

SEQ ID NO: 422058 - DNA, 25 bp, Homo sapien
gaatttgaaagtgctttaattgaaa

SEQ ID NO: 422059 - DNA, 25 bp, Homo sapien
ttaattgaaaatgtacttgaggctg

SEQ ID NO: 422060 - DNA, 25 bp, Homo sapien
taattgaaaatgtacttgaggctgg

SEQ ID NO: 422061 - DNA, 25 bp, Homo sapien
aattgaaaatgtacttgaggctggg

SEQ ID NO: 422062 - DNA, 25 bp, Homo sapien
attgaaaatgtacttgaggctgggt

SEQ ID NO: 422063 - DNA, 25 bp, Homo sapien
cttgaggctgggtaaggaggctcat

SEQ ID NO: 422064 - DNA, 25 bp, Homo sapien
ttgaggctgggtaaggaggctcatg

SEQ ID NO: 422065 - DNA, 25 bp, Homo sapien
tgaggctgggtaaggaggctcatgc

SEQ ID NO: 422066 - DNA, 25 bp, Homo sapien
gaggctgggtaaggaggctcatgcc

SEQ ID NO: 422067 - DNA, 25 bp, Homo sapien
aggctgggtaaggaggctcatgcct

SEQ ID NO: 422068 - DNA, 25 bp, Homo sapien
gctgggtaaggaggctcatgcctgt

SEQ ID NO: 422069 - DNA, 25 bp, Homo sapien
gagctgagcacggagcctggtcggg

SEQ ID NO: 422070 - DNA, 25 bp, Homo sapien
gggtgctccacagaagctgtgcctg

SEQ ID NO: 422071 - DNA, 25 bp, Homo sapien
gcttgggagccaaggccatgtccct

SEQ ID NO: 422072 - DNA, 25 bp, Homo sapien
ggagacggagcccatccacagtgtc

SEQ ID NO: 422073 - DNA, 25 bp, Homo sapien
gagcccatccacagtgtcagctatg

SEQ ID NO: 422074 - DNA, 25 bp, Homo sapien
tccacagtgtcagctatggccatgt

SEQ ID NO: 422075 - DNA, 25 bp, Homo sapien
cagtgtcagctatggccatgtggcc

SEQ ID NO: 422076 - DNA, 25 bp, Homo sapien
gtcagctatggccatgtggccgcct

SEQ ID NO: 422077 - DNA, 25 bp, Homo sapien
atgtggccgcctgccagctaatggg

SEQ ID NO: 422078 - DNA, 25 bp, Homo sapien
cacaccctggccttgagggtgggag

SEQ ID NO: 422079 - DNA, 25 bp, Homo sapien
agggtgggagagagccagctcctcc

SEQ ID NO: 422080 - DNA, 25 bp, Homo sapien
tggaactgctggctcacacagggtt

SEQ ID NO: 422081 - DNA, 25 bp, Homo sapien
aactgctggctcacacagggttttc

SEQ ID NO: 422082 - DNA, 25 bp, Homo sapien
tgctggctcacacagggttttcgac

SEQ ID NO: 422083 - DNA, 25 bp, Homo sapien
ctggctcacacagggttttcgacaa

SEQ ID NO: 422084 - DNA, 25 bp, Homo sapien
ggctcacacagggttttcgacaact

SEQ ID NO: 422085 - DNA, 25 bp, Homo sapien
ctgcagctgaatctcatggaaaagc

SEQ ID NO: 422086 - DNA, 25 bp, Homo sapien
gctgaatctcatggaaaagctggat

SEQ ID NO: 422087 - DNA, 25 bp, Homo sapien
ctcatggaaaagctggattcctctg

SEQ ID NO: 422088 - DNA, 25 bp, Homo sapien
tgccactggtcctggcagaaatggc

SEQ ID NO: 422089 - DNA, 25 bp, Homo sapien
actggtcctggcagaaatggcggct

SEQ ID NO: 422090 - DNA, 25 bp, Homo sapien
tggtggcacttcagcgccacaggct

SEQ ID NO: 422091 - DNA, 25 bp, Homo sapien
aaagaggtcagtgactccgctactc

SEQ ID NO: 422092 - DNA, 25 bp, Homo sapien
tccgctactctcactacatcttaga

SEQ ID NO: 422093 - DNA, 25 bp, Homo sapien
gttgatctgagacagtaaggttcca

SEQ ID NO: 422094 - DNA, 25 bp, Homo sapien
ggttccaggagatggtcttgcccta

SEQ ID NO: 422095 - DNA, 25 bp, Homo sapien
ggtcttgccctactatatgtcagga

SEQ ID NO: 422096 - DNA, 25 bp, Homo sapien
ggaacagctagccttagaattcagt

SEQ ID NO: 422097 - DNA, 25 bp, Homo sapien
aattcagtatacttggtggcccacc

SEQ ID NO: 422098 - DNA, 25 bp, Homo sapien
cccagtgccttatttggtctaaagc

SEQ ID NO: 422099 - DNA, 25 bp, Homo sapien
cttttccattcttaatcagctgatt

SEQ ID NO: 422100 - DNA, 25 bp, Homo sapien
cagctgattatgctaaatgcgtaaa

SEQ ID NO: 422101 - DNA, 25 bp, Homo sapien
agaaaaacaccttacaaatccacag

SEQ ID NO: 422102 - DNA, 25 bp, Homo sapien
acctcaagtgagctgcctacctggc

SEQ ID NO: 422103 - DNA, 25 bp, Homo sapien
ttgtccatttctttagaaccaaaat

SEQ ID NO: 422104 - DNA, 25 bp, Homo sapien
tagaaccaaaattggcaaccagaga

SEQ ID NO: 422105 - DNA, 25 bp, Homo sapien
aaattggcaaccagagagtatttgg

SEQ ID NO: 422106 - DNA, 25 bp, Homo sapien
cagagagtatttggatgttacacaa

SEQ ID NO: 422107 - DNA, 25 bp, Homo sapien
tagtttccctttctagcctaaattg

SEQ ID NO: 422108 - DNA, 25 bp, Homo sapien
tccctttctagcctaaattgggttg

SEQ ID NO: 422109 - DNA, 25 bp, Homo sapien
ttgggttgtttatagcacccgtctc

SEQ ID NO: 422110 - DNA, 25 bp, Homo sapien
ttgtttatagcacccgtctctccat

SEQ ID NO: 422111 - DNA, 25 bp, Homo sapien
gcacccgtctctccatttgagaaaa

SEQ ID NO: 422112 - DNA, 25 bp, Homo sapien
cccgtctctccatttgagaaaaatg

SEQ ID NO: 422113 - DNA, 25 bp, Homo sapien
tctctgccttgaattagtatccagt

SEQ ID NO: 422114 - DNA, 25 bp, Homo sapien
gtatccagtcacgaacattggcttc

SEQ ID NO: 422115 - DNA, 25 bp, Homo sapien
gaacattggcttcatcctctagcat

SEQ ID NO: 422116 - DNA, 25 bp, Homo sapien
atcctctagcattctccagagacta

SEQ ID NO: 422117 - DNA, 25 bp, Homo sapien
aaaacatctcagacagtagccaagc

SEQ ID NO: 422118 - DNA, 25 bp, Homo sapien
gtagccaagcacgattttgaacatc

SEQ ID NO: 422119 - DNA, 25 bp, Homo sapien
ggcatacaaccaaagcacagcaaaa

SEQ ID NO: 422120 - DNA, 25 bp, Homo sapien
tcagtcgtgttccttcataaaccca

SEQ ID NO: 422121 - DNA, 25 bp, Homo sapien
ttcataaacccaccatctataagat

SEQ ID NO: 422122 - DNA, 25 bp, Homo sapien
gattctatcatatgttaggatctct

SEQ ID NO: 422123 - DNA, 25 bp, Homo sapien
ttaggatctctacaccagttctctg

SEQ ID NO: 422124 - DNA, 25 bp, Homo sapien
gtcaagaattagcagaaaccctctg

SEQ ID NO: 422125 - DNA, 25 bp, Homo sapien
ccctctgcatttacaaacactttgt

SEQ ID NO: 422126 - DNA, 25 bp, Homo sapien
gcatttacaaacactttgtgctata

SEQ ID NO: 422127 - DNA, 25 bp, Homo sapien
gagaaaacaaatatacctgtccaaa

SEQ ID NO: 422128 - DNA, 25 bp, Homo sapien
atacctgtccaaaccatatactttt

SEQ ID NO: 422129 - DNA, 25 bp, Homo sapien
ttttttccatacaagctgttgttaa

SEQ ID NO: 422130 - DNA, 25 bp, Homo sapien
ccatacaagctgttgttaatttggg

SEQ ID NO: 422131 - DNA, 25 bp, Homo sapien
ggtaaagtgctgatttgcaaacttc

SEQ ID NO: 422132 - DNA, 25 bp, Homo sapien
gtgctgatttgcaaacttcatcaaa

SEQ ID NO: 422133 - DNA, 25 bp, Homo sapien
gcaaacttcatcaaattgttcccaa

SEQ ID NO: 422134 - DNA, 25 bp, Homo sapien
gcaccatgtgcacagtcaagaatta

SEQ ID NO: 422135 - DNA, 25 bp, Homo sapien
caaaggttaaccaatgaagactgct

SEQ ID NO: 422136 - DNA, 25 bp, Homo sapien
gaagactgctttagactctcatcag

SEQ ID NO: 422137 - DNA, 25 bp, Homo sapien
agactctcatcagcctggaggtgat

SEQ ID NO: 422138 - DNA, 25 bp, Homo sapien
tacagaggactctacttcaccagct

SEQ ID NO: 422139 - DNA, 25 bp, Homo sapien
ttcaccagctgtctagccagccttt

SEQ ID NO: 422140 - DNA, 25 bp, Homo sapien
tttgtccgccatggatttgccttcc

SEQ ID NO: 422141 - DNA, 25 bp, Homo sapien
ttcccacaagttgcctgcagagact

SEQ ID NO: 422142 - DNA, 25 bp, Homo sapien
gcagagacttacagtccttttcctt

SEQ ID NO: 422143 - DNA, 25 bp, Homo sapien
aatgtgctattctttgttgaggatc

SEQ ID NO: 422144 - DNA, 25 bp, Homo sapien
taagctgggagtcaaggccacttct

SEQ ID NO: 422145 - DNA, 25 bp, Homo sapien
aatgattctggatacttctctgggt

SEQ ID NO: 422146 - DNA, 25 bp, Homo sapien
tcggggtgctccacagaagctgtgc

SEQ ID NO: 422147 - DNA, 25 bp, Homo sapien
ctgggcttgggagccaaggccatgt

SEQ ID NO: 422148 - DNA, 25 bp, Homo sapien
ggagacggagcccatccacagtgtc

SEQ ID NO: 422149 - DNA, 25 bp, Homo sapien
gagcccatccacagtgtcagctatg

SEQ ID NO: 422150 - DNA, 25 bp, Homo sapien
tccacagtgtcagctatggccatgt

SEQ ID NO: 422151 - DNA, 25 bp, Homo sapien
acagtgtcagctatggccatgtggc

SEQ ID NO: 422152 - DNA, 25 bp, Homo sapien
agtgtcagctatggccatgtggccg

SEQ ID NO: 422153 - DNA, 25 bp, Homo sapien
tcagctatggccatgtggccgcctg

SEQ ID NO: 422154 - DNA, 25 bp, Homo sapien
gtggccgcctgccagctaatgggcc

SEQ ID NO: 422155 - DNA, 25 bp, Homo sapien
cacaccctggccttgagggtgggag

SEQ ID NO: 422156 - DNA, 25 bp, Homo sapien
agggtgggagagagccagctcctcc

SEQ ID NO: 422157 - DNA, 25 bp, Homo sapien
gagtggtcagtggagccagcaccct

SEQ ID NO: 422158 - DNA, 25 bp, Homo sapien
tgctgcttcagcatctccgcctgga

SEQ ID NO: 422159 - DNA, 25 bp, Homo sapien
agcatctccgcctggagccagctgt

SEQ ID NO: 422160 - DNA, 25 bp, Homo sapien
tctcaggctccatccgaacaaaagg

SEQ ID NO: 422161 - DNA, 25 bp, Homo sapien
caggctccatccgaacaaaaggaag

SEQ ID NO: 422162 - DNA, 25 bp, Homo sapien
atgtctgccttcacacgctgcctta

SEQ ID NO: 422163 - DNA, 25 bp, Homo sapien
acacgctgccttatggcttctgtgt

SEQ ID NO: 422164 - DNA, 25 bp, Homo sapien
gctgccttatggcttctgtgtctcc

SEQ ID NO: 422165 - DNA, 25 bp, Homo sapien
tctccttcccaatagtcacaagatt

SEQ ID NO: 422166 - DNA, 25 bp, Homo sapien
ttcccaatagtcacaagatttacca

SEQ ID NO: 422167 - DNA, 25 bp, Homo sapien
tagtcacaagatttaccatgataat

SEQ ID NO: 422168 - DNA, 25 bp, Homo sapien
ggtttgcttacctaacaagcaacaa

SEQ ID NO: 422169 - DNA, 25 bp, Homo sapien
agttccaaaatctagtttattacat

SEQ ID NO: 422170 - DNA, 25 bp, Homo sapien
aatctctatgaatccttgagggcct

SEQ ID NO: 422171 - DNA, 25 bp, Homo sapien
ccttgagggcctatatctatattat

SEQ ID NO: 422172 - DNA, 25 bp, Homo sapien
ttttaaatatctatgggactttgcc

SEQ ID NO: 422173 - DNA, 25 bp, Homo sapien
gggactttgccatttacagccttaa

SEQ ID NO: 422174 - DNA, 25 bp, Homo sapien
aattacgagattatattctttccat

SEQ ID NO: 422175 - DNA, 25 bp, Homo sapien
ttctttccattaccctttatttctg

SEQ ID NO: 422176 - DNA, 25 bp, Homo sapien
tccattaccctttatttctgctaac

SEQ ID NO: 422177 - DNA, 25 bp, Homo sapien
actttttaaagactggaacattctg

SEQ ID NO: 422178 - DNA, 25 bp, Homo sapien
cattctgtggatgttgtcaaagttt

SEQ ID NO: 422179 - DNA, 25 bp, Homo sapien
ggaggaggaaacaaactcacctttg

SEQ ID NO: 422180 - DNA, 25 bp, Homo sapien
gaggaggaaacaaactcacctttgg

SEQ ID NO: 422181 - DNA, 25 bp, Homo sapien
actcacctttgggacaggcactcag

SEQ ID NO: 422182 - DNA, 25 bp, Homo sapien
tcacctttgggacaggcactcagct

SEQ ID NO: 422183 - DNA, 25 bp, Homo sapien
acctttgggacaggcactcagctaa

SEQ ID NO: 422184 - DNA, 25 bp, Homo sapien
ctttgggacaggcactcagctaaaa

SEQ ID NO: 422185 - DNA, 25 bp, Homo sapien
ttgggacaggcactcagctaaaagt

SEQ ID NO: 422186 - DNA, 25 bp, Homo sapien
ggacaggcactcagctaaaagtgga

SEQ ID NO: 422187 - DNA, 25 bp, Homo sapien
acaggcactcagctaaaagtggaac

SEQ ID NO: 422188 - DNA, 25 bp, Homo sapien
aaagtggaactcaatatccagaacc

SEQ ID NO: 422189 - DNA, 25 bp, Homo sapien
aagtggaactcaatatccagaaccc

SEQ ID NO: 422190 - DNA, 25 bp, Homo sapien
atgatccatatgtaccagaaccagt

SEQ ID NO: 422191 - DNA, 25 bp, Homo sapien
ttaggtacccatggccacatgaaat

SEQ ID NO: 422192 - DNA, 25 bp, Homo sapien
gtaccctggctgaaaagtgagattt

SEQ ID NO: 422193 - DNA, 25 bp, Homo sapien
catggccacatgaaatgcagctttg

SEQ ID NO: 422194 - DNA, 25 bp, Homo sapien
ggtgccagtcagtactccagggatg

SEQ ID NO: 422195 - DNA, 25 bp, Homo sapien
ggcacaagttgtgattgggcaaagt

SEQ ID NO: 422196 - DNA, 25 bp, Homo sapien
gtttattttctatgtcagcctgtca

SEQ ID NO: 422197 - DNA, 25 bp, Homo sapien
ttttctatgtcagcctgtcagtcca

SEQ ID NO: 422198 - DNA, 25 bp, Homo sapien
atgggaagctaaaatctcaagacac

SEQ ID NO: 422199 - DNA, 25 bp, Homo sapien
gacacagtactgatgaacctgtata

SEQ ID NO: 422200 - DNA, 25 bp, Homo sapien
tgaacctgtataaacgagtcttccc

SEQ ID NO: 422201 - DNA, 25 bp, Homo sapien
tgttagctgactcatgcagcccccg

SEQ ID NO: 422202 - DNA, 25 bp, Homo sapien
ttagctgactcatgcagcccccggt

SEQ ID NO: 422203 - DNA, 25 bp, Homo sapien
tcacgttccccgagcttgctcgatt

SEQ ID NO: 422204 - DNA, 25 bp, Homo sapien
acgttccccgagcttgctcgattta

SEQ ID NO: 422205 - DNA, 25 bp, Homo sapien
gttccccgagcttgctcgatttatc

SEQ ID NO: 422206 - DNA, 25 bp, Homo sapien
ttccccgagcttgctcgatttatca

SEQ ID NO: 422207 - DNA, 25 bp, Homo sapien
cccgagcttgctcgatttatcacga

SEQ ID NO: 422208 - DNA, 25 bp, Homo sapien
ccgagcttgctcgatttatcacgac

SEQ ID NO: 422209 - DNA, 25 bp, Homo sapien
cgagcttgctcgatttatcacgacc

SEQ ID NO: 422210 - DNA, 25 bp, Homo sapien
gagcttgctcgatttatcacgaccc

SEQ ID NO: 422211 - DNA, 25 bp, Homo sapien
agcttgctcgatttatcacgaccct

SEQ ID NO: 422212 - DNA, 25 bp, Homo sapien
tctccacggtgtactcaggcctgag

SEQ ID NO: 422213 - DNA, 25 bp, Homo sapien
ctccacggtgtactcaggcctgagt

SEQ ID NO: 422214 - DNA, 25 bp, Homo sapien
ggctcacacagggttttcgacaact

SEQ ID NO: 422215 - DNA, 25 bp, Homo sapien
tctgccttacgcagaaacacccggg

SEQ ID NO: 422216 - DNA, 25 bp, Homo sapien
tacgcagaaacacccgggctccatc

SEQ ID NO: 422217 - DNA, 25 bp, Homo sapien
ggctccatctgccaggtgcttgcca

SEQ ID NO: 422218 - DNA, 25 bp, Homo sapien
atctgccaggtgcttgccactggtc

SEQ ID NO: 422219 - DNA, 25 bp, Homo sapien
ctgccaggtgcttgccactggtcct

SEQ ID NO: 422220 - DNA, 25 bp, Homo sapien
tgcttgccactggtcctggcagaaa

SEQ ID NO: 422221 - DNA, 25 bp, Homo sapien
gaaatggcggctgctgaaagtgacc

SEQ ID NO: 422222 - DNA, 25 bp, Homo sapien
aagtgaccttccaaatccttggtgg

SEQ ID NO: 422223 - DNA, 25 bp, Homo sapien
gaactccttaagttagggaatacat

SEQ ID NO: 422224 - DNA, 25 bp, Homo sapien
aatacatactcccttcccagttttg

SEQ ID NO: 422225 - DNA, 25 bp, Homo sapien
aaattgattcaaatttgccacctta

SEQ ID NO: 422226 - DNA, 25 bp, Homo sapien
gccaccttataaacatccagctatt

SEQ ID NO: 422227 - DNA, 25 bp, Homo sapien
cagctattgcaaagagcctggtata

SEQ ID NO: 422228 - DNA, 25 bp, Homo sapien
gagcctggtatatcgtagagtttca

SEQ ID NO: 422229 - DNA, 25 bp, Homo sapien
cccctgtggtcttgcagaatggaat

SEQ ID NO: 422230 - DNA, 25 bp, Homo sapien
caagactctaccctgaaccaattaa

SEQ ID NO: 422231 - DNA, 25 bp, Homo sapien
ttaaattacagcctaaagtgcagct

SEQ ID NO: 422232 - DNA, 25 bp, Homo sapien
aagtgcagctgagtttgagaatcat

SEQ ID NO: 422233 - DNA, 25 bp, Homo sapien
tgagaatcatggcttaccttttctt

SEQ ID NO: 422234 - DNA, 25 bp, Homo sapien
ctctccacggtgtactcaggcctga

SEQ ID NO: 422235 - DNA, 25 bp, Homo sapien
tctccacggtgtactcaggcctgag

SEQ ID NO: 422236 - DNA, 25 bp, Homo sapien
ctccacggtgtactcaggcctgagt

SEQ ID NO: 422237 - DNA, 25 bp, Homo sapien
tctgccttacgcagaaacacccggg

SEQ ID NO: 422238 - DNA, 25 bp, Homo sapien
tacgcagaaacacccgggctccatc

SEQ ID NO: 422239 - DNA, 25 bp, Homo sapien
gaaacacccgggctccatctgccag

SEQ ID NO: 422240 - DNA, 25 bp, Homo sapien
catctgccaggtgcttgccactggt

SEQ ID NO: 422241 - DNA, 25 bp, Homo sapien
atctgccaggtgcttgccactggtc

SEQ ID NO: 422242 - DNA, 25 bp, Homo sapien
tctgccaggtgcttgccactggtcc

SEQ ID NO: 422243 - DNA, 25 bp, Homo sapien
ctgccaggtgcttgccactggtcct

SEQ ID NO: 422244 - DNA, 25 bp, Homo sapien
gaaatggcggctgctgaaagtgacc

SEQ ID NO: 422245 - DNA, 25 bp, Homo sapien
tccccaccccaaaatgtcattatag

SEQ ID NO: 422246 - DNA, 25 bp, Homo sapien
atagtacttgcgaatttgctccagt

SEQ ID NO: 422247 - DNA, 25 bp, Homo sapien
gcgaatttgctccagtacagcataa

SEQ ID NO: 422248 - DNA, 25 bp, Homo sapien
gtacagcataaagcatattctaatt

SEQ ID NO: 422249 - DNA, 25 bp, Homo sapien
ttttatggctacataatgggcattt

SEQ ID NO: 422250 - DNA, 25 bp, Homo sapien
ataaggtctcactctatgtcccagg

SEQ ID NO: 422251 - DNA, 25 bp, Homo sapien
gtgtaatcatgactaactgcagctt

SEQ ID NO: 422252 - DNA, 25 bp, Homo sapien
aatcatgactaactgcagcttccca

SEQ ID NO: 422253 - DNA, 25 bp, Homo sapien
atgactaactgcagcttcccatgcc

SEQ ID NO: 422254 - DNA, 25 bp, Homo sapien
ttatacagacaggatcttgcccagg

SEQ ID NO: 422255 - DNA, 25 bp, Homo sapien
tacagacaggatcttgcccaggctt

SEQ ID NO: 422256 - DNA, 25 bp, Homo sapien
cattggtgtcgactggcgagatcct

SEQ ID NO: 422257 - DNA, 25 bp, Homo sapien
gtgtcgactggcgagatccttcctc

SEQ ID NO: 422258 - DNA, 25 bp, Homo sapien
gcgatgttgcctgtcactgtacaga

SEQ ID NO: 422259 - DNA, 25 bp, Homo sapien
gttgcctgtcactgtacagaactga

SEQ ID NO: 422260 - DNA, 25 bp, Homo sapien
gtacagaactgactatggcaggctt

SEQ ID NO: 422261 - DNA, 25 bp, Homo sapien
actatggcaggcttgttcggagcac

SEQ ID NO: 422262 - DNA, 25 bp, Homo sapien
tctggcatcactcctgccttttgaa

SEQ ID NO: 422263 - DNA, 25 bp, Homo sapien
ctggcccaaccaacactgataagtt

SEQ ID NO: 422264 - DNA, 25 bp, Homo sapien
gataagtttcaattttaaggacgct

SEQ ID NO: 422265 - DNA, 25 bp, Homo sapien
gtgtattcttgttactttactaaat

SEQ ID NO: 422266 - DNA, 25 bp, Homo sapien
taaatccttaccaacattaacagaa

SEQ ID NO: 422267 - DNA, 25 bp, Homo sapien
tgttagctgactcatgcagcccccg

SEQ ID NO: 422268 - DNA, 25 bp, Homo sapien
ttagctgactcatgcagcccccggt

SEQ ID NO: 422269 - DNA, 25 bp, Homo sapien
acgttccccgagcttgctcgattta

SEQ ID NO: 422270 - DNA, 25 bp, Homo sapien
ttccccgagcttgctcgatttatca

SEQ ID NO: 422271 - DNA, 25 bp, Homo sapien
cccgagcttgctcgatttatcacga

SEQ ID NO: 422272 - DNA, 25 bp, Homo sapien
ccgagcttgctcgatttatcacgac

SEQ ID NO: 422273 - DNA, 25 bp, Homo sapien
cgagcttgctcgatttatcacgacc

SEQ ID NO: 422274 - DNA, 25 bp, Homo sapien
gagcttgctcgatttatcacgaccc

SEQ ID NO: 422275 - DNA, 25 bp, Homo sapien
agcttgctcgatttatcacgaccct

SEQ ID NO: 422276 - DNA, 25 bp, Homo sapien
aaggccaagaatgtctttttcaggg

SEQ ID NO: 422277 - DNA, 25 bp, Homo sapien
ggctcttgacgcaagtctgctgatg

SEQ ID NO: 422278 - DNA, 25 bp, Homo sapien
caaggtaagcgtggcgttctttctc

SEQ ID NO: 422279 - DNA, 25 bp, Homo sapien
cgttctttctcaactcagagtccaa

SEQ ID NO: 422280 - DNA, 25 bp, Homo sapien
ttacccctatctctaggctccaggg

SEQ ID NO: 422281 - DNA, 25 bp, Homo sapien
gcaaagtgactctgtatttgtctta

SEQ ID NO: 422282 - DNA, 25 bp, Homo sapien
taatgaggcctttgaaacaggtagt

SEQ ID NO: 422283 - DNA, 25 bp, Homo sapien
aggtttatgcctacatttattcagt

SEQ ID NO: 422284 - DNA, 25 bp, Homo sapien
tcagtaagtattgaactcccttctc

SEQ ID NO: 422285 - DNA, 25 bp, Homo sapien
ttctcttttctcagccttatagtag

SEQ ID NO: 422286 - DNA, 25 bp, Homo sapien
gccttatagtaggaatgtgtcccca

SEQ ID NO: 422287 - DNA, 25 bp, Homo sapien
aatgtgtccccattgatgaaaaagt

SEQ ID NO: 422288 - DNA, 25 bp, Homo sapien
aagtgtatctatgtgctcaaggaac

SEQ ID NO: 422289 - DNA, 25 bp, Homo sapien
gggaccatcttcagtgtaactcagg

SEQ ID NO: 422290 - DNA, 25 bp, Homo sapien
accatcttcagtgtaactcagggaa

SEQ ID NO: 422291 - DNA, 25 bp, Homo sapien
ttcagtgtaactcagggaaatgacc

SEQ ID NO: 422292 - DNA, 25 bp, Homo sapien
agggaaatgacctcactctgttgct

SEQ ID NO: 422293 - DNA, 25 bp, Homo sapien
gaaatgacctcactctgttgctcct

SEQ ID NO: 422294 - DNA, 25 bp, Homo sapien
gttgctcctcgtccttggaaacgga

SEQ ID NO: 422295 - DNA, 25 bp, Homo sapien
tcctcgtccttggaaacggagctgg

SEQ ID NO: 422296 - DNA, 25 bp, Homo sapien
tcgtccttggaaacggagctggttg

SEQ ID NO: 422297 - DNA, 25 bp, Homo sapien
tggaaacggagctggttgtatctac

SEQ ID NO: 422298 - DNA, 25 bp, Homo sapien
ggagctggttgtatctaccgtgcag

SEQ ID NO: 422299 - DNA, 25 bp, Homo sapien
ctggttgtatctaccgtgcagggat

SEQ ID NO: 422300 - DNA, 25 bp, Homo sapien
ccacctgttgactagaaaattgcca

SEQ ID NO: 422301 - DNA, 25 bp, Homo sapien
aaattgccatgcactgtggtcacca

SEQ ID NO: 422302 - DNA, 25 bp, Homo sapien
gagtaaaaccatgaacttccaccca

SEQ ID NO: 422303 - DNA, 25 bp, Homo sapien
ttccacccaccataggcagaagtga

SEQ ID NO: 422304 - DNA, 25 bp, Homo sapien
gaatcattcagacagagccatccag

SEQ ID NO: 422305 - DNA, 25 bp, Homo sapien
gaccccatttgacctgggctgggta

SEQ ID NO: 422306 - DNA, 25 bp, Homo sapien
tgggctgggtactccatggagctca

SEQ ID NO: 422307 - DNA, 25 bp, Homo sapien
agctcaagctcaaggtcggctctgt

SEQ ID NO: 422308 - DNA, 25 bp, Homo sapien
caaggtcggctctgtcagccccaaa

SEQ ID NO: 422309 - DNA, 25 bp, Homo sapien
agctttctgctttggaagtaccagc

SEQ ID NO: 422310 - DNA, 25 bp, Homo sapien
tggaagtaccagcttatatccccac

SEQ ID NO: 422311 - DNA, 25 bp, Homo sapien
gaggtggaatcagtgatgaacccgt

SEQ ID NO: 422312 - DNA, 25 bp, Homo sapien
gtggaatcagtgatgaacccgtatt

SEQ ID NO: 422313 - DNA, 25 bp, Homo sapien
gtatttgtaagatcaccacccacca

SEQ ID NO: 422314 - DNA, 25 bp, Homo sapien
atttgtaagatcaccacccaccatg

SEQ ID NO: 422315 - DNA, 25 bp, Homo sapien
ttgtaagatcaccacccaccatgtg

SEQ ID NO: 422316 - DNA, 25 bp, Homo sapien
agatcaccacccaccatgtgcttgt

SEQ ID NO: 422317 - DNA, 25 bp, Homo sapien
acccaccatgtgcttgtctccagaa

SEQ ID NO: 422318 - DNA, 25 bp, Homo sapien
accatgtgcttgtctccagaacaca

SEQ ID NO: 422319 - DNA, 25 bp, Homo sapien
tgtgcttgtctccagaacacacaat

SEQ ID NO: 422320 - DNA, 25 bp, Homo sapien
gaacacacaattgctgcaaaagctt

SEQ ID NO: 422321 - DNA, 25 bp, Homo sapien
acacaattgctgcaaaagctttcca

SEQ ID NO: 422322 - DNA, 25 bp, Homo sapien
ccacttgtcaccctaggattttgga

SEQ ID NO: 422323 - DNA, 25 bp, Homo sapien
ttgtcaccctaggattttggagatt

SEQ ID NO: 422324 - DNA, 25 bp, Homo sapien
accaagatggctattactcagtaca

SEQ ID NO: 422325 - DNA, 25 bp, Homo sapien
gattgcacagctcattgccggctac

SEQ ID NO: 422326 - DNA, 25 bp, Homo sapien
tcattgccggctacatcgatatcat

SEQ ID NO: 422327 - DNA, 25 bp, Homo sapien
tacatcgatatcatcctgaagaagg

SEQ ID NO: 422328 - DNA, 25 bp, Homo sapien
tgaagaaggtgagcactgcctgccc

SEQ ID NO: 422329 - DNA, 25 bp, Homo sapien
gaaggtgagcactgcctgccctagc

SEQ ID NO: 422330 - DNA, 25 bp, Homo sapien
tctccacaagccagtcctttagaaa

SEQ ID NO: 422331 - DNA, 25 bp, Homo sapien
gccagtcctttagaaatgggcactc

SEQ ID NO: 422332 - DNA, 25 bp, Homo sapien
atgggcactcagattgcttgaacct

SEQ ID NO: 422333 - DNA, 25 bp, Homo sapien
gattaaccctgatgaactttcttta

SEQ ID NO: 422334 - DNA, 25 bp, Homo sapien
gatgaactttctttaggtctatatg

SEQ ID NO: 422335 - DNA, 25 bp, Homo sapien
gaactttctttaggtctatatgtaa

SEQ ID NO: 422336 - DNA, 25 bp, Homo sapien
aatttgcatttttacttcatgcttt

SEQ ID NO: 422337 - DNA, 25 bp, Homo sapien
aaattcagggatatcctcacatttt

SEQ ID NO: 422338 - DNA, 25 bp, Homo sapien
gaaagggtgaactctagctcatgat

SEQ ID NO: 422339 - DNA, 25 bp, Homo sapien
ggtgaactctagctcatgatggcat

SEQ ID NO: 422340 - DNA, 25 bp, Homo sapien
tcatgatggcatgtgtagcaaagat

SEQ ID NO: 422341 - DNA, 25 bp, Homo sapien
agactgcagcagtagtcaggccaga

SEQ ID NO: 422342 - DNA, 25 bp, Homo sapien
gtagtcaggccagatgtaagggttt

SEQ ID NO: 422343 - DNA, 25 bp, Homo sapien
atgtaagggtttggcccgagctaat

SEQ ID NO: 422344 - DNA, 25 bp, Homo sapien
ggtaaggccctagaactcccaagag

SEQ ID NO: 422345 - DNA, 25 bp, Homo sapien
aactcccaagagtataagccctttg

SEQ ID NO: 422346 - DNA, 25 bp, Homo sapien
ttcagccaccagtgtgtgtagggaa

SEQ ID NO: 422347 - DNA, 25 bp, Homo sapien
actctccttgggtgggtcttgctgc

SEQ ID NO: 422348 - DNA, 25 bp, Homo sapien
gagattcccaggtcactgaagttgt

SEQ ID NO: 422349 - DNA, 25 bp, Homo sapien
actgaagttgtgtgcctaggaggat

SEQ ID NO: 422350 - DNA, 25 bp, Homo sapien
tgcctaggaggattatggctgcctg

SEQ ID NO: 422351 - DNA, 25 bp, Homo sapien
atggctgcctgtgctgagtcatgca

SEQ ID NO: 422352 - DNA, 25 bp, Homo sapien
tttttgtgctgtttgacctcctgca

SEQ ID NO: 422353 - DNA, 25 bp, Homo sapien
ttgacctcctgcagaaggtggcact

SEQ ID NO: 422354 - DNA, 25 bp, Homo sapien
gcagaaggtggcactttccagaaag

SEQ ID NO: 422355 - DNA, 25 bp, Homo sapien
tcttccccgtcccgcaggcccagga

SEQ ID NO: 422356 - DNA, 25 bp, Homo sapien
gcaggcccaggaccgcccctgtcag

SEQ ID NO: 422357 - DNA, 25 bp, Homo sapien
tgtcagtccccccaattttgtattc

SEQ ID NO: 422358 - DNA, 25 bp, Homo sapien
gtcagtccccccaattttgtattct

SEQ ID NO: 422359 - DNA, 25 bp, Homo sapien
tcagtccccccaattttgtattctg

SEQ ID NO: 422360 - DNA, 25 bp, Homo sapien
cagtccccccaattttgtattctgg

SEQ ID NO: 422361 - DNA, 25 bp, Homo sapien
tgtattctggggggaggagccctct

SEQ ID NO: 422362 - DNA, 25 bp, Homo sapien
tcttcctgtggccccaccttggccc

SEQ ID NO: 422363 - DNA, 25 bp, Homo sapien
ctcttttctgtgtcagtttctctcc

SEQ ID NO: 422364 - DNA, 25 bp, Homo sapien
tcttttctgtgtcagtttctctccc

SEQ ID NO: 422365 - DNA, 25 bp, Homo sapien
cttttctgtgtcagtttctctccct

SEQ ID NO: 422366 - DNA, 25 bp, Homo sapien
gggttaacagatcccacaagtccta

SEQ ID NO: 422367 - DNA, 25 bp, Homo sapien
taacagatcccacaagtcctaactt

SEQ ID NO: 422368 - DNA, 25 bp, Homo sapien
gatcccacaagtcctaacttttcaa

SEQ ID NO: 422369 - DNA, 25 bp, Homo sapien
cacaagtcctaacttttcaattgta

SEQ ID NO: 422370 - DNA, 25 bp, Homo sapien
tggaatttattctatcaactgcctg

SEQ ID NO: 422371 - DNA, 25 bp, Homo sapien
gaatttattctatcaactgcctgag

SEQ ID NO: 422372 - DNA, 25 bp, Homo sapien
tttattctatcaactgcctgagagg

SEQ ID NO: 422373 - DNA, 25 bp, Homo sapien
gggcttcggaccacagcaggagccc

SEQ ID NO: 422374 - DNA, 25 bp, Homo sapien
ctggctctgtaaccattaacctctt

SEQ ID NO: 422375 - DNA, 25 bp, Homo sapien
ggctctgtaaccattaacctcttcc

SEQ ID NO: 422376 - DNA, 25 bp, Homo sapien
accaatgaaaacaccattccacgtg

SEQ ID NO: 422377 - DNA, 25 bp, Homo sapien
gtgcttggcgtcagccttatccagg

SEQ ID NO: 422378 - DNA, 25 bp, Homo sapien
gcaggatgccatgtaaaggtgtcag

SEQ ID NO: 422379 - DNA, 25 bp, Homo sapien
tgtaaaggtgtcaggtggagctcac

SEQ ID NO: 422380 - DNA, 25 bp, Homo sapien
agctcaccttgcctgtagagtgcag

SEQ ID NO: 422381 - DNA, 25 bp, Homo sapien
tgcagcggcataacgggatgtgtta

SEQ ID NO: 422382 - DNA, 25 bp, Homo sapien
taacgggatgtgttactggtggtct

SEQ ID NO: 422383 - DNA, 25 bp, Homo sapien
aaggtctgcttgtccatcagcttcg

SEQ ID NO: 422384 - DNA, 25 bp, Homo sapien
tgtccatcagcttcgaggaatacgt

SEQ ID NO: 422385 - DNA, 25 bp, Homo sapien
aggaatacgtgctggtctcgtcggc

SEQ ID NO: 422386 - DNA, 25 bp, Homo sapien
gttcagcgcaatctgctcccctttg

SEQ ID NO: 422387 - DNA, 25 bp, Homo sapien
ctcccctttgctgcggcaatagttg

SEQ ID NO: 422388 - DNA, 25 bp, Homo sapien
tgaactttggaagggtccactacca

SEQ ID NO: 422389 - DNA, 25 bp, Homo sapien
ggaagggtccactaccagagacaga

SEQ ID NO: 422390 - DNA, 25 bp, Homo sapien
gggtccactaccagagacagatgaa

SEQ ID NO: 422391 - DNA, 25 bp, Homo sapien
gagtattttcaggatttgtttctat

SEQ ID NO: 422392 - DNA, 25 bp, Homo sapien
caggatttgtttctatgagacgaga

SEQ ID NO: 422393 - DNA, 25 bp, Homo sapien
gacgagagagagaagcctccgctcc

SEQ ID NO: 422394 - DNA, 25 bp, Homo sapien
gaagcctccgctccttaatgtgaaa

SEQ ID NO: 422395 - DNA, 25 bp, Homo sapien
ccgctccttaatgtgaaacttcatg

SEQ ID NO: 422396 - DNA, 25 bp, Homo sapien
aacttcatgcaatttgaaattccat

SEQ ID NO: 422397 - DNA, 25 bp, Homo sapien
agtttttatctgcaagttacagctt

SEQ ID NO: 422398 - DNA, 25 bp, Homo sapien
gttacagcttgtgtggtttgtcttt

SEQ ID NO: 422399 - DNA, 25 bp, Homo sapien
agccttttggaagcgtaggaccttg

SEQ ID NO: 422400 - DNA, 25 bp, Homo sapien
gaagcgtaggaccttgccagccagc

SEQ ID NO: 422401 - DNA, 25 bp, Homo sapien
ccagccagcgctgggatatgcagga

SEQ ID NO: 422402 - DNA, 25 bp, Homo sapien
gggacagcattcagcacctcgcgca

SEQ ID NO: 422403 - DNA, 25 bp, Homo sapien
agcattcagcacctcgcgcagaaag

SEQ ID NO: 422404 - DNA, 25 bp, Homo sapien
ttcagtccctcctgagctaggtcca

SEQ ID NO: 422405 - DNA, 25 bp, Homo sapien
cctgagctaggtccagcagcctgag

SEQ ID NO: 422406 - DNA, 25 bp, Homo sapien
atctctgccaggaaggcctcagtca

SEQ ID NO: 422407 - DNA, 25 bp, Homo sapien
caggaaggcctcagtcaggtctcgg

SEQ ID NO: 422408 - DNA, 25 bp, Homo sapien
caggtcatcctgtgctcagttagca

SEQ ID NO: 422409 - DNA, 25 bp, Homo sapien
tgtgctcagttagcagctcatccag

SEQ ID NO: 422410 - DNA, 25 bp, Homo sapien
taaggacttggcgtcttttcccagt

SEQ ID NO: 422411 - DNA, 25 bp, Homo sapien
gctggcccagccatgtaactttagg

SEQ ID NO: 422412 - DNA, 25 bp, Homo sapien
gtaactttaggaaggccctctcagg

SEQ ID NO: 422413 - DNA, 25 bp, Homo sapien
aggaaggccctctcagggactcaga

SEQ ID NO: 422414 - DNA, 25 bp, Homo sapien
ttagatagcctgtgagatcccttcc

SEQ ID NO: 422415 - DNA, 25 bp, Homo sapien
gtgagatcccttccaacactaacaa

SEQ ID NO: 422416 - DNA, 25 bp, Homo sapien
acactaacaaccttcgcggagactt

SEQ ID NO: 422417 - DNA, 25 bp, Homo sapien
ggagacttcccaactgtgccctggg

SEQ ID NO: 422418 - DNA, 25 bp, Homo sapien
ggcacctggtgcaaatttcattctt

SEQ ID NO: 422419 - DNA, 25 bp, Homo sapien
tatggtgtatttcaagctctctttt

SEQ ID NO: 422420 - DNA, 25 bp, Homo sapien
agatagcacccacagactttaatat

SEQ ID NO: 422421 - DNA, 25 bp, Homo sapien
tgctggcacccggagggcaagaccc

SEQ ID NO: 422422 - DNA, 25 bp, Homo sapien
cgggggtacacaggcgctgctgcag

SEQ ID NO: 422423 - DNA, 25 bp, Homo sapien
cagccgaggaaatgttcgtcgcggc

SEQ ID NO: 422424 - DNA, 25 bp, Homo sapien
gaggaaatgttcgtcgcggcggaac

SEQ ID NO: 422425 - DNA, 25 bp, Homo sapien
aatgttcgtcgcggcggaacgcctg

SEQ ID NO: 422426 - DNA, 25 bp, Homo sapien
ggaaacctgtcctacgcggacctga

SEQ ID NO: 422427 - DNA, 25 bp, Homo sapien
gaaacctgtcctacgcggacctgat

SEQ ID NO: 422428 - DNA, 25 bp, Homo sapien
aaacctgtcctacgcggacctgatc

SEQ ID NO: 422429 - DNA, 25 bp, Homo sapien
tgtcctacgcggacctgatcacccg

SEQ ID NO: 422430 - DNA, 25 bp, Homo sapien
gatcacccgcgccatcgagagctcc

SEQ ID NO: 422431 - DNA, 25 bp, Homo sapien
acggctcactctgtcccagatctac

SEQ ID NO: 422432 - DNA, 25 bp, Homo sapien
ggcacatagtaagtgatctttcaag

SEQ ID NO: 422433 - DNA, 25 bp, Homo sapien
tgatctttcaagtgttaaccattac

SEQ ID NO: 422434 - DNA, 25 bp, Homo sapien
gaacttcttccccaacaattagatt

SEQ ID NO: 422435 - DNA, 25 bp, Homo sapien
aagcaacttaactgctcaggaattt

SEQ ID NO: 422436 - DNA, 25 bp, Homo sapien
acttaactgctcaggaattttttct

SEQ ID NO: 422437 - DNA, 25 bp, Homo sapien
gttgggattatgcaattaagattaa

SEQ ID NO: 422438 - DNA, 25 bp, Homo sapien
taaaaggtacagaactattgacctt

SEQ ID NO: 422439 - DNA, 25 bp, Homo sapien
tttcccctaatgctctaagttttct

SEQ ID NO: 422440 - DNA, 25 bp, Homo sapien
ctaatgctctaagttttctatgaag

SEQ ID NO: 422441 - DNA, 25 bp, Homo sapien
tagtttattcccctatatgagatgg

SEQ ID NO: 422442 - DNA, 25 bp, Homo sapien
tttattcccctatatgagatggtag

SEQ ID NO: 422443 - DNA, 25 bp, Homo sapien
gaaggagccggttcgagctcagccc

SEQ ID NO: 422444 - DNA, 25 bp, Homo sapien
tctcgggcccgcacccgtgagcgta

SEQ ID NO: 422445 - DNA, 25 bp, Homo sapien
ggagccggttcgagctcagcccctg

SEQ ID NO: 422446 - DNA, 25 bp, Homo sapien
gcctcaggccgaagctgaagcgcgc

SEQ ID NO: 422447 - DNA, 25 bp, Homo sapien
tcaggccgaagctgaagcgcgctcc

SEQ ID NO: 422448 - DNA, 25 bp, Homo sapien
ggtcccgagacgttccgccagcgtt

SEQ ID NO: 422449 - DNA, 25 bp, Homo sapien
ctcagcccctgagcgtaactgtgtg

SEQ ID NO: 422450 - DNA, 25 bp, Homo sapien
cagcccctgagcgtaactgtgtggg

SEQ ID NO: 422451 - DNA, 25 bp, Homo sapien
gcccctgagcgtaactgtgtgggct

SEQ ID NO: 422452 - DNA, 25 bp, Homo sapien
cctgagcgtaactgtgtgggctcct

SEQ ID NO: 422453 - DNA, 25 bp, Homo sapien
tgtgtgggctcctcgctgccagagg

SEQ ID NO: 422454 - DNA, 25 bp, Homo sapien
ggttttgctaatatcgtcttcctcc

SEQ ID NO: 422455 - DNA, 25 bp, Homo sapien
tccgagtctctttcatgtggacagt

SEQ ID NO: 422456 - DNA, 25 bp, Homo sapien
gacagtaggacagatgtggctccaa

SEQ ID NO: 422457 - DNA, 25 bp, Homo sapien
gacagatgtggctccaaggtccagg

SEQ ID NO: 422458 - DNA, 25 bp, Homo sapien
ggagggaaggtctttcactctgctg

SEQ ID NO: 422459 - DNA, 25 bp, Homo sapien
cactctgctgagttaacctgagaca

SEQ ID NO: 422460 - DNA, 25 bp, Homo sapien
agacactcagagaagcacagtagag

SEQ ID NO: 422461 - DNA, 25 bp, Homo sapien
gagagctgacagtcggaatcgaaca

SEQ ID NO: 422462 - DNA, 25 bp, Homo sapien
agctgtgtcaccttggacaacttca

SEQ ID NO: 422463 - DNA, 25 bp, Homo sapien
aatgggaacaacaacctccacctcg

SEQ ID NO: 422464 - DNA, 25 bp, Homo sapien
acctcgcagcactgttttgcaaatc

SEQ ID NO: 422465 - DNA, 25 bp, Homo sapien
aaccccaacaccatgatggcctttt

SEQ ID NO: 422466 - DNA, 25 bp, Homo sapien
tctcttcctctctacagagacacat

SEQ ID NO: 422467 - DNA, 25 bp, Homo sapien
tctctacagagacacatcccatggt

SEQ ID NO: 422468 - DNA, 25 bp, Homo sapien
tacagagacacatcccatggtttca

SEQ ID NO: 422469 - DNA, 25 bp, Homo sapien
agagacacatcccatggtttcacgt

SEQ ID NO: 422470 - DNA, 25 bp, Homo sapien
acatcccatggtttcacgtctctga

SEQ ID NO: 422471 - DNA, 25 bp, Homo sapien
tttcacgtctctgagtccctctggg

SEQ ID NO: 422472 - DNA, 25 bp, Homo sapien
gtgcaaattaaaggtgccacccttc

SEQ ID NO: 422473 - DNA, 25 bp, Homo sapien
ccttcctagtgccatttgcattaaa

SEQ ID NO: 422474 - DNA, 25 bp, Homo sapien
atattttaagaagatgaaccggaga

SEQ ID NO: 422475 - DNA, 25 bp, Homo sapien
agctttcccaaccttacagtttcat

SEQ ID NO: 422476 - DNA, 25 bp, Homo sapien
agttgggaccagagtatgcctttga

SEQ ID NO: 422477 - DNA, 25 bp, Homo sapien
ggcagagaatgcctggccaatatgc

SEQ ID NO: 422478 - DNA, 25 bp, Homo sapien
atatgctgtttggtctatactgagt

SEQ ID NO: 422479 - DNA, 25 bp, Homo sapien
aacctctgcccttgggttagcgaat

SEQ ID NO: 422480 - DNA, 25 bp, Homo sapien
tgggttagcgaatcccagggaacct

SEQ ID NO: 422481 - DNA, 25 bp, Homo sapien
tttacaaggtgacgccgtgtcctgc

SEQ ID NO: 422482 - DNA, 25 bp, Homo sapien
gtgtcctgcagtgtgccacacattg

SEQ ID NO: 422483 - DNA, 25 bp, Homo sapien
aggacggctctgagcagtttctacc

SEQ ID NO: 422484 - DNA, 25 bp, Homo sapien
agtttctaccacctacttagttctg

SEQ ID NO: 422485 - DNA, 25 bp, Homo sapien
acttagttctgtattctccaaatga

SEQ ID NO: 422486 - DNA, 25 bp, Homo sapien
aatgagtcatactgccgggtgttcc

SEQ ID NO: 422487 - DNA, 25 bp, Homo sapien
tcttctgcccgtaaaaagaaacaag

SEQ ID NO: 422488 - DNA, 25 bp, Homo sapien
cctccctgtagacatggctatgaac

SEQ ID NO: 422489 - DNA, 25 bp, Homo sapien
tatgaacggcaggatgcctgaaact

SEQ ID NO: 422490 - DNA, 25 bp, Homo sapien
aactgtccaggcttgttatgatgga

SEQ ID NO: 422491 - DNA, 25 bp, Homo sapien
tatgatggagagacacactgcacag

SEQ ID NO: 422492 - DNA, 25 bp, Homo sapien
tataccctaagaatggtagaccaga

SEQ ID NO: 422493 - DNA, 25 bp, Homo sapien
gtaaagcatctgtatccttgttgaa

SEQ ID NO: 422494 - DNA, 25 bp, Homo sapien
cttgttgaaattatagtgcctccca

SEQ ID NO: 422495 - DNA, 25 bp, Homo sapien
gtgcctcccaattaacatacctaga

SEQ ID NO: 422496 - DNA, 25 bp, Homo sapien
atacctagaactgtttacctctgga

SEQ ID NO: 422497 - DNA, 25 bp, Homo sapien
aactgtttacctctggacatttcat

SEQ ID NO: 422498 - DNA, 25 bp, Homo sapien
tcaagaggcacactttttaaggaaa

SEQ ID NO: 422499 - DNA, 25 bp, Homo sapien
ggaaagtgttaattatgctccacat

SEQ ID NO: 422500 - DNA, 25 bp, Homo sapien
gtgttaattatgctccacattaaat

SEQ ID NO: 422501 - DNA, 25 bp, Homo sapien
aatgactttacaacgactgaattac

SEQ ID NO: 422502 - DNA, 25 bp, Homo sapien
taggtacccataataggtctttaca

SEQ ID NO: 422503 - DNA, 25 bp, Homo sapien
tgaggcccaggcacagcagttcatg

SEQ ID NO: 422504 - DNA, 25 bp, Homo sapien
ccataataggtctttacactcagtt

SEQ ID NO: 422505 - DNA, 25 bp, Homo sapien
ttcaagaccagactaagtagcaaag

SEQ ID NO: 422506 - DNA, 25 bp, Homo sapien
gactaagtagcaaagcgagaccctg

SEQ ID NO: 422507 - DNA, 25 bp, Homo sapien
aaagtttgctttatcctcaagaggc

SEQ ID NO: 422508 - DNA, 25 bp, Homo sapien
atcctcaagaggcacactttttaag

SEQ ID NO: 422509 - DNA, 25 bp, Homo sapien
gatgaactgcagtaaagtttctata

SEQ ID NO: 422510 - DNA, 25 bp, Homo sapien
attttccatctattcatttgctcaa

SEQ ID NO: 422511 - DNA, 25 bp, Homo sapien
ttgctcaatcaccttgtaatggtta

SEQ ID NO: 422512 - DNA, 25 bp, Homo sapien
tggttaattccagtctctcatgtgt

SEQ ID NO: 422513 - DNA, 25 bp, Homo sapien
ttccagtctctcatgtgtaagcaac

SEQ ID NO: 422514 - DNA, 25 bp, Homo sapien
aataattttcaggatcaatgcgttg

SEQ ID NO: 422515 - DNA, 25 bp, Homo sapien
caatgcgttgaggattaggaatggc

SEQ ID NO: 422516 - DNA, 25 bp, Homo sapien
ggaatggcaatgtgtattactactt

SEQ ID NO: 422517 - DNA, 25 bp, Homo sapien
gtgtattactactttgataccaact

SEQ ID NO: 422518 - DNA, 25 bp, Homo sapien
gataccaactatatccgatctaatg

SEQ ID NO: 422519 - DNA, 25 bp, Homo sapien
gtatttgaaaacaggcagcactgaa

SEQ ID NO: 422520 - DNA, 25 bp, Homo sapien
actttccacctagctgatcctaaat

SEQ ID NO: 422521 - DNA, 25 bp, Homo sapien
tagctgatcctaaatgttccttcct

SEQ ID NO: 422522 - DNA, 25 bp, Homo sapien
taaatgttccttcctcagggaggtc

SEQ ID NO: 422523 - DNA, 25 bp, Homo sapien
ggtgggtcaagactttctgataaat

SEQ ID NO: 422524 - DNA, 25 bp, Homo sapien
gataaatcagttagcaccatgcatt

SEQ ID NO: 422525 - DNA, 25 bp, Homo sapien
gttagcaccatgcattttccagagt

SEQ ID NO: 422526 - DNA, 25 bp, Homo sapien
tatggctgtaataggctggctgcgc

SEQ ID NO: 422527 - DNA, 25 bp, Homo sapien
gctggctgcgctgctagattgtaag

SEQ ID NO: 422528 - DNA, 25 bp, Homo sapien
gtaagctcacgagggcagagatctt

SEQ ID NO: 422529 - DNA, 25 bp, Homo sapien
gagatcttgttcacatcttgctcac

SEQ ID NO: 422530 - DNA, 25 bp, Homo sapien
cacatcttgctcactgctatattct

SEQ ID NO: 422531 - DNA, 25 bp, Homo sapien
aattgtgatcactgaacatgaggca

SEQ ID NO: 422532 - DNA, 25 bp, Homo sapien
acatgaggcaacatcttctaggaag

SEQ ID NO: 422533 - DNA, 25 bp, Homo sapien
ttctaggaagacatttccatagtct

SEQ ID NO: 422534 - DNA, 25 bp, Homo sapien
acaatcctatatgaagcttacctga

SEQ ID NO: 422535 - DNA, 25 bp, Homo sapien
gcttacctgaagttgctgtagccgt

SEQ ID NO: 422536 - DNA, 25 bp, Homo sapien
gttgctgtagccgtttggcaagtct

SEQ ID NO: 422537 - DNA, 25 bp, Homo sapien
ggagactaacagacacactgaggat

SEQ ID NO: 422538 - DNA, 25 bp, Homo sapien
tttggtgaaattcatgagcttctga

SEQ ID NO: 422539 - DNA, 25 bp, Homo sapien
gagcttctgaataacgaaccccata

SEQ ID NO: 422540 - DNA, 25 bp, Homo sapien
ttctgaataacgaaccccataccac

SEQ ID NO: 422541 - DNA, 25 bp, Homo sapien
cataccaccctacctctataaaaga

SEQ ID NO: 422542 - DNA, 25 bp, Homo sapien
tagtctcctgcctttccgcaagtgt

SEQ ID NO: 422543 - DNA, 25 bp, Homo sapien
agtgtctccacccagctccgataga

SEQ ID NO: 422544 - DNA, 25 bp, Homo sapien
tctccacccagctccgatagagtgg

SEQ ID NO: 422545 - DNA, 25 bp, Homo sapien
ccagctccgatagagtgggtagcat

SEQ ID NO: 422546 - DNA, 25 bp, Homo sapien
gctccgatagagtgggtagcatcag

SEQ ID NO: 422547 - DNA, 25 bp, Homo sapien
cagggatgagtgttgtagcatctca

SEQ ID NO: 422548 - DNA, 25 bp, Homo sapien
gagtgttgtagcatctcaacattta

SEQ ID NO: 422549 - DNA, 25 bp, Homo sapien
ttgtagcatctcaacatttaagagc

SEQ ID NO: 422550 - DNA, 25 bp, Homo sapien
gtaggtaatgggttgataggtaaat

SEQ ID NO: 422551 - DNA, 25 bp, Homo sapien
tctgggttctactttcctagtctcc

SEQ ID NO: 422552 - DNA, 25 bp, Homo sapien
tgggttctactttcctagtctcctg

SEQ ID NO: 422553 - DNA, 25 bp, Homo sapien
aacagagctgttattgctttaagtg

SEQ ID NO: 422554 - DNA, 25 bp, Homo sapien
gctttaagtgatttgtagggtgttt

SEQ ID NO: 422555 - DNA, 25 bp, Homo sapien
ggtgacattgtcttagggatcaaaa

SEQ ID NO: 422556 - DNA, 25 bp, Homo sapien
aacagcaaacctgctatttttctgt

SEQ ID NO: 422557 - DNA, 25 bp, Homo sapien
tttttctgtgtacactttcaggaaa

SEQ ID NO: 422558 - DNA, 25 bp, Homo sapien
atgttttaaaagacgctaagtgaca

SEQ ID NO: 422559 - DNA, 25 bp, Homo sapien
aagtgacagcgatgcctcatttgaa

SEQ ID NO: 422560 - DNA, 25 bp, Homo sapien
gcgatgcctcatttgaaatcagaaa

SEQ ID NO: 422561 - DNA, 25 bp, Homo sapien
gaactttcattcgacacaaccatat

SEQ ID NO: 422562 - DNA, 25 bp, Homo sapien
gacacaaccatatgctttctttgat

SEQ ID NO: 422563 - DNA, 25 bp, Homo sapien
ctttgatggcttgaatggttaggga

SEQ ID NO: 422564 - DNA, 25 bp, Homo sapien
agtgcttggaattccttccgtggct

SEQ ID NO: 422565 - DNA, 25 bp, Homo sapien
cttccgtggctattcatctgagatt

SEQ ID NO: 422566 - DNA, 25 bp, Homo sapien
gattcaaatgatgacgcttcctccg

SEQ ID NO: 422567 - DNA, 25 bp, Homo sapien
tcctccgggtcagtttgtgattaca

SEQ ID NO: 422568 - DNA, 25 bp, Homo sapien
agacagtggtgtggcaactccagtt

SEQ ID NO: 422569 - DNA, 25 bp, Homo sapien
aactccagttactactggccaggtg

SEQ ID NO: 422570 - DNA, 25 bp, Homo sapien
ctggccaggtgaaggcggttacttc

SEQ ID NO: 422571 - DNA, 25 bp, Homo sapien
aaggcggttacttcgggtcattatg

SEQ ID NO: 422572 - DNA, 25 bp, Homo sapien
acttcgggtcattatgtgttatcag

SEQ ID NO: 422573 - DNA, 25 bp, Homo sapien
tctctggtggagtccaggtcgagcc

SEQ ID NO: 422574 - DNA, 25 bp, Homo sapien
aggtcgagccacctgcacacagtga

SEQ ID NO: 422575 - DNA, 25 bp, Homo sapien
tcttgccactgtactgtgccagaag

SEQ ID NO: 422576 - DNA, 25 bp, Homo sapien
gaaaatgcttccttgggacctgttt

SEQ ID NO: 422577 - DNA, 25 bp, Homo sapien
gacctgtttccttcgaattaaagat

SEQ ID NO: 422578 - DNA, 25 bp, Homo sapien
attaaagatgttgctgaccatttgg

SEQ ID NO: 422579 - DNA, 25 bp, Homo sapien
tggagttatgttttatcaccagata

SEQ ID NO: 422580 - DNA, 25 bp, Homo sapien
gataaacagttttcacccaacaaat

SEQ ID NO: 422581 - DNA, 25 bp, Homo sapien
caacaaattatctactaaaggccaa

SEQ ID NO: 422582 - DNA, 25 bp, Homo sapien
tatatctatgtttccctttcgtcta

SEQ ID NO: 422583 - DNA, 25 bp, Homo sapien
ctttcgtctattctatcttttcctt

SEQ ID NO: 422584 - DNA, 25 bp, Homo sapien
tttcatctattttctacacccttct

SEQ ID NO: 422585 - DNA, 25 bp, Homo sapien
acacccttctattaactgtatcata

SEQ ID NO: 422586 - DNA, 25 bp, Homo sapien
aggtggtgtaactctgacgtttcaa

SEQ ID NO: 422587 - DNA, 25 bp, Homo sapien
gtaactctgacgtttcaagattttt

SEQ ID NO: 422588 - DNA, 25 bp, Homo sapien
aattactgacaagacaacctctggt

SEQ ID NO: 422589 - DNA, 25 bp, Homo sapien
tactgacaagacaacctctggttac

SEQ ID NO: 422590 - DNA, 25 bp, Homo sapien
gacaagacaacctctggttacctga

SEQ ID NO: 422591 - DNA, 25 bp, Homo sapien
agacaacctctggttacctgaaaat

SEQ ID NO: 422592 - DNA, 25 bp, Homo sapien
acctctggttacctgaaaatggtca

SEQ ID NO: 422593 - DNA, 25 bp, Homo sapien
aatggtcagaaaagtcatgggactt

SEQ ID NO: 422594 - DNA, 25 bp, Homo sapien
tcatgggacttaccctaaatttaat

SEQ ID NO: 422595 - DNA, 25 bp, Homo sapien
ggaaaacagccctatagaataaatt

SEQ ID NO: 422596 - DNA, 25 bp, Homo sapien
taaagtttgctttatgattacaaaa

SEQ ID NO: 422597 - DNA, 25 bp, Homo sapien
aaacatgtgattagggagctatctt

SEQ ID NO: 422598 - DNA, 25 bp, Homo sapien
agggagctatctttatctgaataat

SEQ ID NO: 422599 - DNA, 25 bp, Homo sapien
gtaaaacctgagatagagtactaca

SEQ ID NO: 422600 - DNA, 25 bp, Homo sapien
aaaatcatgttgatgacttcagatt

SEQ ID NO: 422601 - DNA, 25 bp, Homo sapien
aaatcatgtctgttatttgcattct

SEQ ID NO: 422602 - DNA, 25 bp, Homo sapien
atttgcattctttagaaacttgact

SEQ ID NO: 422603 - DNA, 25 bp, Homo sapien
aacttgactaagtacctgaattcat

SEQ ID NO: 422604 - DNA, 25 bp, Homo sapien
tcatatttctattctactgtgcaac

SEQ ID NO: 422605 - DNA, 25 bp, Homo sapien
gaacatttccattgtgttaagtgta

SEQ ID NO: 422606 - DNA, 25 bp, Homo sapien
gttaagtgtaaaaaggtccagacat

SEQ ID NO: 422607 - DNA, 25 bp, Homo sapien
aggtccagacatgatcataaaattt

SEQ ID NO: 422608 - DNA, 25 bp, Homo sapien
aggtcagtgatactgtccctagtgt

SEQ ID NO: 422609 - DNA, 25 bp, Homo sapien
tgatactgtccctagtgtctccaca

SEQ ID NO: 422610 - DNA, 25 bp, Homo sapien
agtgtctccacatcccattatgaag

SEQ ID NO: 422611 - DNA, 25 bp, Homo sapien
agcccaagccatagatgcagccatg

SEQ ID NO: 422612 - DNA, 25 bp, Homo sapien
atagatgcagccatgcctggcgcta

SEQ ID NO: 422613 - DNA, 25 bp, Homo sapien
tggcgctactgccaaagctagtgca

SEQ ID NO: 422614 - DNA, 25 bp, Homo sapien
ctagtgcagtttccagagccatatg

SEQ ID NO: 422615 - DNA, 25 bp, Homo sapien
tttccagagccatatgtccagcata

SEQ ID NO: 422616 - DNA, 25 bp, Homo sapien
atatgtccagcatatcttcctacct

SEQ ID NO: 422617 - DNA, 25 bp, Homo sapien
tcttcctacctctactgaggactga

SEQ ID NO: 422618 - DNA, 25 bp, Homo sapien
acaccacaggaaagattttcttgaa

SEQ ID NO: 422619 - DNA, 25 bp, Homo sapien
ggatttggctgaagactgttaatta

SEQ ID NO: 422620 - DNA, 25 bp, Homo sapien
taagtttagttagttggctcccact

SEQ ID NO: 422621 - DNA, 25 bp, Homo sapien
gtttagttagttggctcccacttat

SEQ ID NO: 422622 - DNA, 25 bp, Homo sapien
tagttagttggctcccacttatttc

SEQ ID NO: 422623 - DNA, 25 bp, Homo sapien
ttagttggctcccacttatttcaat

SEQ ID NO: 422624 - DNA, 25 bp, Homo sapien
agttggctcccacttatttcaattt

SEQ ID NO: 422625 - DNA, 25 bp, Homo sapien
gttggctcccacttatttcaatttt

SEQ ID NO: 422626 - DNA, 25 bp, Homo sapien
ttggctcccacttatttcaatttta

SEQ ID NO: 422627 - DNA, 25 bp, Homo sapien
aaacatgttttttgtactttggcag

SEQ ID NO: 422628 - DNA, 25 bp, Homo sapien
catgttttttgtactttggcaggaa

SEQ ID NO: 422629 - DNA, 25 bp, Homo sapien
aagactgttaattatatcctgcggg

SEQ ID NO: 422630 - DNA, 25 bp, Homo sapien
ctcctttccaggtcaaacagtgcta

SEQ ID NO: 422631 - DNA, 25 bp, Homo sapien
cagtgctaattcacaacccttattc

SEQ ID NO: 422632 - DNA, 25 bp, Homo sapien
acccttattcaatggcgtgttccta

SEQ ID NO: 422633 - DNA, 25 bp, Homo sapien
taaaagcctcaccatcctagtcatc

SEQ ID NO: 422634 - DNA, 25 bp, Homo sapien
gcttcagtttgcagagaaccctcta

SEQ ID NO: 422635 - DNA, 25 bp, Homo sapien
gagaatagcacagccctctagatat

SEQ ID NO: 422636 - DNA, 25 bp, Homo sapien
agcagaggaactgtcacctttctca

SEQ ID NO: 422637 - DNA, 25 bp, Homo sapien
tcacctttctcagggtaggctacta

SEQ ID NO: 422638 - DNA, 25 bp, Homo sapien
aggctactatacttctcttaatgca

SEQ ID NO: 422639 - DNA, 25 bp, Homo sapien
ggaagctagatcatcctgtcaattc

SEQ ID NO: 422640 - DNA, 25 bp, Homo sapien
ttcatactgagtttgatgtctcccc

SEQ ID NO: 422641 - DNA, 25 bp, Homo sapien
ttacatatcatttcctaagcatctg

SEQ ID NO: 422642 - DNA, 25 bp, Homo sapien
catatcatttcctaagcatctgcct

SEQ ID NO: 422643 - DNA, 25 bp, Homo sapien
tatcatttcctaagcatctgcctta

SEQ ID NO: 422644 - DNA, 25 bp, Homo sapien
catttcctaagcatctgccttagaa

SEQ ID NO: 422645 - DNA, 25 bp, Homo sapien
agcatctgccttagaaatacagtta

SEQ ID NO: 422646 - DNA, 25 bp, Homo sapien
gatcaacatatgttaagaacatgca

SEQ ID NO: 422647 - DNA, 25 bp, Homo sapien
gaacatgcagttcagtttgtttcag

SEQ ID NO: 422648 - DNA, 25 bp, Homo sapien
aacatgcagttcagtttgtttcaga

SEQ ID NO: 422649 - DNA, 25 bp, Homo sapien
attcaaggaagccataagtcatact

SEQ ID NO: 422650 - DNA, 25 bp, Homo sapien
aggaagccataagtcatactaaata

SEQ ID NO: 422651 - DNA, 25 bp, Homo sapien
agttttgttattgtgacttacattt

SEQ ID NO: 422652 - DNA, 25 bp, Homo sapien
ttatgtgatgggatatcaccctgaa

SEQ ID NO: 422653 - DNA, 25 bp, Homo sapien
ggatatcaccctgaagagttgtgtc

SEQ ID NO: 422654 - DNA, 25 bp, Homo sapien
ttgtgtcttttgtggccagtgacaa

SEQ ID NO: 422655 - DNA, 25 bp, Homo sapien
gtcttttgtggccagtgacaaatcc

SEQ ID NO: 422656 - DNA, 25 bp, Homo sapien
aaatgaatgttgctgatagggataa

SEQ ID NO: 422657 - DNA, 25 bp, Homo sapien
gatagggataaatcttgaggctgag

SEQ ID NO: 422658 - DNA, 25 bp, Homo sapien
gtacagatgtgtatgggaaacccca

SEQ ID NO: 422659 - DNA, 25 bp, Homo sapien
tattgtaaatagatgggctgggcta

SEQ ID NO: 422660 - DNA, 25 bp, Homo sapien
ggctgggctaaacattgttgccgtt

SEQ ID NO: 422661 - DNA, 25 bp, Homo sapien
acattgttgccgtttcatactccta

SEQ ID NO: 422662 - DNA, 25 bp, Homo sapien
atactcctaccaactcagcttttac

SEQ ID NO: 422663 - DNA, 25 bp, Homo sapien
gttcattctaaaagtatgtcttgta

SEQ ID NO: 422664 - DNA, 25 bp, Homo sapien
atcacattttcgacaagttgtaaca

SEQ ID NO: 422665 - DNA, 25 bp, Homo sapien
aattgatataaatccatgcccacaa

SEQ ID NO: 422666 - DNA, 25 bp, Homo sapien
aaatccatgcccacaaagtattcca

SEQ ID NO: 422667 - DNA, 25 bp, Homo sapien
tgcccacaaagtattccattttcat

SEQ ID NO: 422668 - DNA, 25 bp, Homo sapien
cattttcattacttttactgttcat

SEQ ID NO: 422669 - DNA, 25 bp, Homo sapien
cattacttttactgttcatgccaag

SEQ ID NO: 422670 - DNA, 25 bp, Homo sapien
tacttttactgttcatgccaagatg

SEQ ID NO: 422671 - DNA, 25 bp, Homo sapien
tactgttcatgccaagatgtttcaa

SEQ ID NO: 422672 - DNA, 25 bp, Homo sapien
gttcatgccaagatgtttcaaatat

SEQ ID NO: 422673 - DNA, 25 bp, Homo sapien
atatattccatttgtaatctgtctt

SEQ ID NO: 422674 - DNA, 25 bp, Homo sapien
atttttatggccaaactgattctga

SEQ ID NO: 422675 - DNA, 25 bp, Homo sapien
gaaactgcaaacctcgtgtgtctta

SEQ ID NO: 422676 - DNA, 25 bp, Homo sapien
tgcaaacctcgtgtgtcttaactcc

SEQ ID NO: 422677 - DNA, 25 bp, Homo sapien
gccccgtggtctggtgcgtgacaat

SEQ ID NO: 422678 - DNA, 25 bp, Homo sapien
gtggtctggtgcgtgacaatccaaa

SEQ ID NO: 422679 - DNA, 25 bp, Homo sapien
tgacaatccaaagcgccgagacgag

SEQ ID NO: 422680 - DNA, 25 bp, Homo sapien
tccaaagcgccgagacgagggtgct

SEQ ID NO: 422681 - DNA, 25 bp, Homo sapien
tcaaacccagagtggtgggcgcctc

SEQ ID NO: 422682 - DNA, 25 bp, Homo sapien
ggtgggcgcctctgaaaccatacag

SEQ ID NO: 422683 - DNA, 25 bp, Homo sapien
acaccccgtctttttagagatctct

SEQ ID NO: 422684 - DNA, 25 bp, Homo sapien
tagagatctctctaataaatcgggt

SEQ ID NO: 422685 - DNA, 25 bp, Homo sapien
ggagattccctcacttagttgcaca

SEQ ID NO: 422686 - DNA, 25 bp, Homo sapien
tagttgcacactacagcttctacct

SEQ ID NO: 422687 - DNA, 25 bp, Homo sapien
cctctaaatgtttccgcagctcaag

SEQ ID NO: 422688 - DNA, 25 bp, Homo sapien
aagtgcaacaaagaccttccttctc

SEQ ID NO: 422689 - DNA, 25 bp, Homo sapien
tccttctcctacttctcatgaacaa

SEQ ID NO: 422690 - DNA, 25 bp, Homo sapien
gaatatgtgagcaacttctcttgca

SEQ ID NO: 422691 - DNA, 25 bp, Homo sapien
acttctcttgcaaccttgtgtgata

SEQ ID NO: 422692 - DNA, 25 bp, Homo sapien
gattctggaaggtctgtccttggtg

SEQ ID NO: 422693 - DNA, 25 bp, Homo sapien
cttggtgggccctaagagatgtctt

SEQ ID NO: 422694 - DNA, 25 bp, Homo sapien
gagtggtttacctgtgcctagcaaa

SEQ ID NO: 422695 - DNA, 25 bp, Homo sapien
tagcaaacctcctagcacataggaa

SEQ ID NO: 422696 - DNA, 25 bp, Homo sapien
taatgtctgctctcagaccacaatg

SEQ ID NO: 422697 - DNA, 25 bp, Homo sapien
gtctgctctcagaccacaatggatt

SEQ ID NO: 422698 - DNA, 25 bp, Homo sapien
tgctctcagaccacaatggatttaa

SEQ ID NO: 422699 - DNA, 25 bp, Homo sapien
agaccacaatggatttaaactagaa

SEQ ID NO: 422700 - DNA, 25 bp, Homo sapien
tggaaagttccaaaatatttagaga

SEQ ID NO: 422701 - DNA, 25 bp, Homo sapien
gagattagatagcatacttctaagt

SEQ ID NO: 422702 - DNA, 25 bp, Homo sapien
caaaatgtgtaagatgcggtgatga

SEQ ID NO: 422703 - DNA, 25 bp, Homo sapien
taagatgcggtgatgagagagaaat

SEQ ID NO: 422704 - DNA, 25 bp, Homo sapien
gagagaaatttataccacttaatgc

SEQ ID NO: 422705 - DNA, 25 bp, Homo sapien
gaaatttataccacttaatgcatat

SEQ ID NO: 422706 - DNA, 25 bp, Homo sapien
gaatgctctaaaataaatcatctaa

SEQ ID NO: 422707 - DNA, 25 bp, Homo sapien
aaatatctgcctttgttatacaaag

SEQ ID NO: 422708 - DNA, 25 bp, Homo sapien
atctgcctttgttatacaaagcaaa

SEQ ID NO: 422709 - DNA, 25 bp, Homo sapien
agcaaagttttcgtaaatcctctat

SEQ ID NO: 422710 - DNA, 25 bp, Homo sapien
caaagttttcgtaaatcctctatat

SEQ ID NO: 422711 - DNA, 25 bp, Homo sapien
gttttcgtaaatcctctatattata

SEQ ID NO: 422712 - DNA, 25 bp, Homo sapien
tcgtaaatcctctatattatagctc

SEQ ID NO: 422713 - DNA, 25 bp, Homo sapien
tattatagctctagacaaaactatt

SEQ ID NO: 422714 - DNA, 25 bp, Homo sapien
ttgattgacagtggtattctcattc

SEQ ID NO: 422715 - DNA, 25 bp, Homo sapien
ggtattctcattctccaaaaaggtc

SEQ ID NO: 422716 - DNA, 25 bp, Homo sapien
ggtctttagtatcttttcacctatc

SEQ ID NO: 422717 - DNA, 25 bp, Homo sapien
ctttagtatcttttcacctatctta

SEQ ID NO: 422718 - DNA, 25 bp, Homo sapien
ggccctcaactgaccatttgcttct

SEQ ID NO: 422719 - DNA, 25 bp, Homo sapien
atttgcttctcagaatttcagtttg

SEQ ID NO: 422720 - DNA, 25 bp, Homo sapien
agaatttcagtttgagacatgagag

SEQ ID NO: 422721 - DNA, 25 bp, Homo sapien
gacatgagaggtataatcagttact

SEQ ID NO: 422722 - DNA, 25 bp, Homo sapien
ctatggtatgtggttcagctgaaac

SEQ ID NO: 422723 - DNA, 25 bp, Homo sapien
aacacatacaactgcatccttttgg

SEQ ID NO: 422724 - DNA, 25 bp, Homo sapien
acaactgcatccttttggagtcctt

SEQ ID NO: 422725 - DNA, 25 bp, Homo sapien
gcatccttttggagtcctttgccaa

SEQ ID NO: 422726 - DNA, 25 bp, Homo sapien
gaccaacagaccagatggtgtccat

SEQ ID NO: 422727 - DNA, 25 bp, Homo sapien
agatggtgtccatgttcaatatcat

SEQ ID NO: 422728 - DNA, 25 bp, Homo sapien
ggtgtccatgttcaatatcatgtct

SEQ ID NO: 422729 - DNA, 25 bp, Homo sapien
gcaagttactagcttaggcacgtta

SEQ ID NO: 422730 - DNA, 25 bp, Homo sapien
taggcacgttaacttaagttttctg

SEQ ID NO: 422731 - DNA, 25 bp, Homo sapien
gttttctgtgactttaccgactgta

SEQ ID NO: 422732 - DNA, 25 bp, Homo sapien
gtgactttaccgactgtaataatat

SEQ ID NO: 422733 - DNA, 25 bp, Homo sapien
aatagctaccgcatagttgaggatg

SEQ ID NO: 422734 - DNA, 25 bp, Homo sapien
tcaccaatggccacactcaggagaa

SEQ ID NO: 422735 - DNA, 25 bp, Homo sapien
ggcactagtgcccttcgaaagaatt

SEQ ID NO: 422736 - DNA, 25 bp, Homo sapien
tactcttaccatccttttatatttt

SEQ ID NO: 422737 - DNA, 25 bp, Homo sapien
tttgttgactcctctaatgtacagc

SEQ ID NO: 422738 - DNA, 25 bp, Homo sapien
gactcctctaatgtacagcaagtga

SEQ ID NO: 422739 - DNA, 25 bp, Homo sapien
acagcaagtgagtaccatatcaaat

SEQ ID NO: 422740 - DNA, 25 bp, Homo sapien
tcccatgttggaagttgctctgaag

SEQ ID NO: 422741 - DNA, 25 bp, Homo sapien
gatgctggaagccagacacaaccct

SEQ ID NO: 422742 - DNA, 25 bp, Homo sapien
tggaagccagacacaaccctgcgta

SEQ ID NO: 422743 - DNA, 25 bp, Homo sapien
ggactggagtcagcccagctgggag

SEQ ID NO: 422744 - DNA, 25 bp, Homo sapien
ggatctgcagctgaagcccgaggca

SEQ ID NO: 422745 - DNA, 25 bp, Homo sapien
tgaggagaaaacaggaaacgggctt

SEQ ID NO: 422746 - DNA, 25 bp, Homo sapien
gaaacgggctttctctgaattggta

SEQ ID NO: 422747 - DNA, 25 bp, Homo sapien
gctttctctgaattggtaaatggga

SEQ ID NO: 422748 - DNA, 25 bp, Homo sapien
gtgagcaacttaagattgtcacaat

SEQ ID NO: 422749 - DNA, 25 bp, Homo sapien
gattgtcacaattaatcacaagtgt

SEQ ID NO: 422750 - DNA, 25 bp, Homo sapien
gtgtacaggattagactgggtttat

SEQ ID NO: 422751 - DNA, 25 bp, Homo sapien
tgccctggtccatggtgtctatgac

SEQ ID NO: 422752 - DNA, 25 bp, Homo sapien
tccatggtgtctatgactgctctgt

SEQ ID NO: 422753 - DNA, 25 bp, Homo sapien
accagctctgcctgccgcagaggga

SEQ ID NO: 422754 - DNA, 25 bp, Homo sapien
agcagcccttgtgcaagctggcttc

SEQ ID NO: 422755 - DNA, 25 bp, Homo sapien
aagctggcttcagccgtttcaggtg

SEQ ID NO: 422756 - DNA, 25 bp, Homo sapien
ccgtttcaggtgtggtctctaggct

SEQ ID NO: 422757 - DNA, 25 bp, Homo sapien
ctctaggctgggagattttgcgacc

SEQ ID NO: 422758 - DNA, 25 bp, Homo sapien
gggagattttgcgacctgccctggc

SEQ ID NO: 422759 - DNA, 25 bp, Homo sapien
tggccactgctgatgcgtccagcct

SEQ ID NO: 422760 - DNA, 25 bp, Homo sapien
agcctcctctccaaggtggaaggca

SEQ ID NO: 422761 - DNA, 25 bp, Homo sapien
gacaaggccctgttgtgcccatgtg

SEQ ID NO: 422762 - DNA, 25 bp, Homo sapien
agtcatcttactagcaccttccagc

SEQ ID NO: 422763 - DNA, 25 bp, Homo sapien
atcttactagcaccttccagcattc

SEQ ID NO: 422764 - DNA, 25 bp, Homo sapien
ttccagcattctcctttcagtgaga

SEQ ID NO: 422765 - DNA, 25 bp, Homo sapien
ccagcattctcctttcagtgagata

SEQ ID NO: 422766 - DNA, 25 bp, Homo sapien
agcattctcctttcagtgagataat

SEQ ID NO: 422767 - DNA, 25 bp, Homo sapien
ttctcctttcagtgagataataagg

SEQ ID NO: 422768 - DNA, 25 bp, Homo sapien
ggaaacatggatggtgttcttatgt

SEQ ID NO: 422769 - DNA, 25 bp, Homo sapien
taacattaattagcatttagcagat

SEQ ID NO: 422770 - DNA, 25 bp, Homo sapien
ttagcatttagcagatgaccacaat

SEQ ID NO: 422771 - DNA, 25 bp, Homo sapien
agcatttagcagatgaccacaataa

SEQ ID NO: 422772 - DNA, 25 bp, Homo sapien
gcagatgaccacaataaattatttt

SEQ ID NO: 422773 - DNA, 25 bp, Homo sapien
actagtacgttaactatttcagtat

SEQ ID NO: 422774 - DNA, 25 bp, Homo sapien
tgaattattccgtgttctattttta

SEQ ID NO: 422775 - DNA, 25 bp, Homo sapien
atttttaaaggctatcagatgctaa

SEQ ID NO: 422776 - DNA, 25 bp, Homo sapien
ggctatcagatgctaattagtgtta

SEQ ID NO: 422777 - DNA, 25 bp, Homo sapien
ataatgaggtcatagagctttggat

SEQ ID NO: 422778 - DNA, 25 bp, Homo sapien
agagctttggatttagacagactgc

SEQ ID NO: 422779 - DNA, 25 bp, Homo sapien
ctttggatttagacagactgcttac

SEQ ID NO: 422780 - DNA, 25 bp, Homo sapien
atttagacagactgcttacaagccc

SEQ ID NO: 422781 - DNA, 25 bp, Homo sapien
tcagtttcctgcatctggaaatcag

SEQ ID NO: 422782 - DNA, 25 bp, Homo sapien
tcctgcatctggaaatcagggtaat

SEQ ID NO: 422783 - DNA, 25 bp, Homo sapien
cagggtaatagtttatgttggataa

SEQ ID NO: 422784 - DNA, 25 bp, Homo sapien
gcattttaagatttgatagcaacgc

SEQ ID NO: 422785 - DNA, 25 bp, Homo sapien
ttttaagatttgatagcaacgctag

SEQ ID NO: 422786 - DNA, 25 bp, Homo sapien
tttaagatttgatagcaacgctagt

SEQ ID NO: 422787 - DNA, 25 bp, Homo sapien
aagatttgatagcaacgctagtggc

SEQ ID NO: 422788 - DNA, 25 bp, Homo sapien
agatttgatagcaacgctagtggct

SEQ ID NO: 422789 - DNA, 25 bp, Homo sapien
gatttgatagcaacgctagtggctc

SEQ ID NO: 422790 - DNA, 25 bp, Homo sapien
atttgatagcaacgctagtggctca

SEQ ID NO: 422791 - DNA, 25 bp, Homo sapien
ttgatagcaacgctagtggctcatg

SEQ ID NO: 422792 - DNA, 25 bp, Homo sapien
tgatagcaacgctagtggctcatgc

SEQ ID NO: 422793 - DNA, 25 bp, Homo sapien
gatagcaacgctagtggctcatgcc

SEQ ID NO: 422794 - DNA, 25 bp, Homo sapien
atagcaacgctagtggctcatgcct

SEQ ID NO: 422795 - DNA, 25 bp, Homo sapien
attagcaagatctggaataggttta

SEQ ID NO: 422796 - DNA, 25 bp, Homo sapien
tctggaataggtttattagcactaa

SEQ ID NO: 422797 - DNA, 25 bp, Homo sapien
ttagcactaaatattatactttggt

SEQ ID NO: 422798 - DNA, 25 bp, Homo sapien
tactttggttatgtacagaaaatgg

SEQ ID NO: 422799 - DNA, 25 bp, Homo sapien
ggaatgtgtgcaatcatgttgatga

SEQ ID NO: 422800 - DNA, 25 bp, Homo sapien
atgttgatgaagtaccttcccctat

SEQ ID NO: 422801 - DNA, 25 bp, Homo sapien
gatgaagtaccttcccctattgtga

SEQ ID NO: 422802 - DNA, 25 bp, Homo sapien
gtaccttcccctattgtgacatatt

SEQ ID NO: 422803 - DNA, 25 bp, Homo sapien
attgtgacatattctttccctttcc

SEQ ID NO: 422804 - DNA, 25 bp, Homo sapien
tgtgacatattctttccctttccaa

SEQ ID NO: 422805 - DNA, 25 bp, Homo sapien
ttccctttccaaatggcagtgttag

SEQ ID NO: 422806 - DNA, 25 bp, Homo sapien
gggctactagctattgtgttagata

SEQ ID NO: 422807 - DNA, 25 bp, Homo sapien
gatagcacggtatactttattctct

SEQ ID NO: 422808 - DNA, 25 bp, Homo sapien
actttattctctttcttgtgttgta

SEQ ID NO: 422809 - DNA, 25 bp, Homo sapien
tgggcttggtatcccctggtcttca

SEQ ID NO: 422810 - DNA, 25 bp, Homo sapien
ttggtatcccctggtcttcactatt

SEQ ID NO: 422811 - DNA, 25 bp, Homo sapien
tatcccctggtcttcactattctag

SEQ ID NO: 422812 - DNA, 25 bp, Homo sapien
ccctggtcttcactattctagcttg

SEQ ID NO: 422813 - DNA, 25 bp, Homo sapien
agcttgccattgaatttgtctccca

SEQ ID NO: 422814 - DNA, 25 bp, Homo sapien
gcttgccattgaatttgtctcccag

SEQ ID NO: 422815 - DNA, 25 bp, Homo sapien
taacttgacatctatatattgcaca

SEQ ID NO: 422816 - DNA, 25 bp, Homo sapien
attgcacatattcctgtatagtgaa

SEQ ID NO: 422817 - DNA, 25 bp, Homo sapien
cttacaagcccaatttcttcattca

SEQ ID NO: 422818 - DNA, 25 bp, Homo sapien
tacaagcccaatttcttcattcaag

SEQ ID NO: 422819 - DNA, 25 bp, Homo sapien
acaagcccaatttcttcattcaaga

SEQ ID NO: 422820 - DNA, 25 bp, Homo sapien
aatttcttcattcaagagcagtgtg

SEQ ID NO: 422821 - DNA, 25 bp, Homo sapien
tttcttcattcaagagcagtgtgac

SEQ ID NO: 422822 - DNA, 25 bp, Homo sapien
tcttcattcaagagcagtgtgacat

SEQ ID NO: 422823 - DNA, 25 bp, Homo sapien
cttcattcaagagcagtgtgacatc

SEQ ID NO: 422824 - DNA, 25 bp, Homo sapien
tcattcaagagcagtgtgacatcat

SEQ ID NO: 422825 - DNA, 25 bp, Homo sapien
attcaagagcagtgtgacatcatac

SEQ ID NO: 422826 - DNA, 25 bp, Homo sapien
tcaagagcagtgtgacatcatacaa

SEQ ID NO: 422827 - DNA, 25 bp, Homo sapien
agagcagtgtgacatcatacaagtt

SEQ ID NO: 422828 - DNA, 25 bp, Homo sapien
ttatggaaatgcctctaactttaca

SEQ ID NO: 422829 - DNA, 25 bp, Homo sapien
cattttcattccatctgtagatttt

SEQ ID NO: 422830 - DNA, 25 bp, Homo sapien
tcaaactaagcttacaaatcgcatg

SEQ ID NO: 422831 - DNA, 25 bp, Homo sapien
gtgtctgtttatattgcttcctttt

SEQ ID NO: 422832 - DNA, 25 bp, Homo sapien
attgcttccttttttgtagcctttg

SEQ ID NO: 422833 - DNA, 25 bp, Homo sapien
gtagcctttgtacctgtacagggtg

SEQ ID NO: 422834 - DNA, 25 bp, Homo sapien
acagggtgacagtaagggccaagca

SEQ ID NO: 422835 - DNA, 25 bp, Homo sapien
gcaggagaggcgtaatccttgtata

SEQ ID NO: 422836 - DNA, 25 bp, Homo sapien
aaataggatccagcgacactcttgt

SEQ ID NO: 422837 - DNA, 25 bp, Homo sapien
gcgacactcttgtatttatctgttc

SEQ ID NO: 422838 - DNA, 25 bp, Homo sapien
gtatttatctgttctctttttagtc

SEQ ID NO: 422839 - DNA, 25 bp, Homo sapien
taaagacgtgccttttcactctgat

SEQ ID NO: 422840 - DNA, 25 bp, Homo sapien
gtgccttttcactctgatacacggg

SEQ ID NO: 422841 - DNA, 25 bp, Homo sapien
gccttgctctgagcagacagctgaa

SEQ ID NO: 422842 - DNA, 25 bp, Homo sapien
gaatctcaggtgacaaccccaggga

SEQ ID NO: 422843 - DNA, 25 bp, Homo sapien
caaccccagggaaatggtgtttgtg

SEQ ID NO: 422844 - DNA, 25 bp, Homo sapien
gtgtttgtggcactcaggcattcgc

SEQ ID NO: 422845 - DNA, 25 bp, Homo sapien
aggcattcgccacgccgaagaggca

SEQ ID NO: 422846 - DNA, 25 bp, Homo sapien
agaggcaaagcaacagacataggat

SEQ ID NO: 422847 - DNA, 25 bp, Homo sapien
gacataggatgtcagcgtgctgatt

SEQ ID NO: 422848 - DNA, 25 bp, Homo sapien
taaggagaacagaggccgaccatgc

SEQ ID NO: 422849 - DNA, 25 bp, Homo sapien
gggaaagcttagatgactacatgtt

SEQ ID NO: 422850 - DNA, 25 bp, Homo sapien
acagcactccaaccaaaagccaaaa

SEQ ID NO: 422851 - DNA, 25 bp, Homo sapien
agcaagacttactaacgcatatcaa

SEQ ID NO: 422852 - DNA, 25 bp, Homo sapien
aaggtacaaaatcgtgaatctcagt

SEQ ID NO: 422853 - DNA, 25 bp, Homo sapien
aattattcaaattctcacgccttcc

SEQ ID NO: 422854 - DNA, 25 bp, Homo sapien
cacgccttccaactcaaaattagca

SEQ ID NO: 422855 - DNA, 25 bp, Homo sapien
taaagtaatttccatatcctagatg

SEQ ID NO: 422856 - DNA, 25 bp, Homo sapien
atcctagatggaaaccctcatgcta

SEQ ID NO: 422857 - DNA, 25 bp, Homo sapien
gaaaccctcatgctaaactgtctga

SEQ ID NO: 422858 - DNA, 25 bp, Homo sapien
actgtctgattatgcatggttctaa

SEQ ID NO: 422859 - DNA, 25 bp, Homo sapien
ggttctaaatggtttcagtggcaaa

SEQ ID NO: 422860 - DNA, 25 bp, Homo sapien
acattgtactactgattaaactgaa

SEQ ID NO: 422861 - DNA, 25 bp, Homo sapien
gatttcatttagcaatggccaggta

SEQ ID NO: 422862 - DNA, 25 bp, Homo sapien
gcaatggccaggtatcatggccaaa

SEQ ID NO: 422863 - DNA, 25 bp, Homo sapien
catggccaaatagatactttgactt

SEQ ID NO: 422864 - DNA, 25 bp, Homo sapien
actttgacttgaattatctgcctaa

SEQ ID NO: 422865 - DNA, 25 bp, Homo sapien
atctgcctaaatgttctaattctcc

SEQ ID NO: 422866 - DNA, 25 bp, Homo sapien
tgttctaattctccactttacttca

SEQ ID NO: 422867 - DNA, 25 bp, Homo sapien
ttctccactttacttcacgaaactg

SEQ ID NO: 422868 - DNA, 25 bp, Homo sapien
ttacttcacgaaactgaggaaattc

SEQ ID NO: 422869 - DNA, 25 bp, Homo sapien
atctttatgattcattggtctcttt

SEQ ID NO: 422870 - DNA, 25 bp, Homo sapien
tggtctctttgtgatgtgccaaaca

SEQ ID NO: 422871 - DNA, 25 bp, Homo sapien
tgtgccaaacataaccaggatttat

SEQ ID NO: 422872 - DNA, 25 bp, Homo sapien
tcccttccctgcatgagcttagcag

SEQ ID NO: 422873 - DNA, 25 bp, Homo sapien
gcttagcagccaagcaggcttactt

SEQ ID NO: 422874 - DNA, 25 bp, Homo sapien
aagcaggcttactttggaatatttg

SEQ ID NO: 422875 - DNA, 25 bp, Homo sapien
ggaatatttgatgggcccaggttcc

SEQ ID NO: 422876 - DNA, 25 bp, Homo sapien
gatgggcccaggttcctcgaatttt

SEQ ID NO: 422877 - DNA, 25 bp, Homo sapien
cctcgaattttttgcctatcttagt

SEQ ID NO: 422878 - DNA, 25 bp, Homo sapien
attttttgcctatcttagtccttgg

SEQ ID NO: 422879 - DNA, 25 bp, Homo sapien
ctatcttagtccttggctcttacag

SEQ ID NO: 422880 - DNA, 25 bp, Homo sapien
tagtccttggctcttacaggtggcg

SEQ ID NO: 422881 - DNA, 25 bp, Homo sapien
ggagccattctggtgagtaccgtcc

SEQ ID NO: 422882 - DNA, 25 bp, Homo sapien
ttctggtgagtaccgtccccttcca

SEQ ID NO: 422883 - DNA, 25 bp, Homo sapien
aaaagtgtctctggaaaatgctgac

SEQ ID NO: 422884 - DNA, 25 bp, Homo sapien
aaatgctgactattgcctctggggc

SEQ ID NO: 422885 - DNA, 25 bp, Homo sapien
gcatcctgatatggctgcagtggga

SEQ ID NO: 422886 - DNA, 25 bp, Homo sapien
ggaggccggcagaagtaacaaccct

SEQ ID NO: 422887 - DNA, 25 bp, Homo sapien
cagaagtaacaaccctcccatcgtg

SEQ ID NO: 422888 - DNA, 25 bp, Homo sapien
ttttttcatcagctttttctagtta

SEQ ID NO: 422889 - DNA, 25 bp, Homo sapien
tatgcgcgtgcatgcaaatgcatac

SEQ ID NO: 422890 - DNA, 25 bp, Homo sapien
catgcaaatgcatacacacgtacat

SEQ ID NO: 422891 - DNA, 25 bp, Homo sapien
gagacctatctgctatttactgagt

SEQ ID NO: 422892 - DNA, 25 bp, Homo sapien
ttactgagtgccctggagaaattgc

SEQ ID NO: 422893 - DNA, 25 bp, Homo sapien
gaaattgcaaaaagtgtctctggaa

SEQ ID NO: 422894 - DNA, 25 bp, Homo sapien
gatgaggtcataggctttgtcagct

SEQ ID NO: 422895 - DNA, 25 bp, Homo sapien
aggctttgtcagctgtacccgcagt

SEQ ID NO: 422896 - DNA, 25 bp, Homo sapien
agccacggttagaggtcactgtctt

SEQ ID NO: 422897 - DNA, 25 bp, Homo sapien
gtcactgtcttgaccctggcggtga

SEQ ID NO: 422898 - DNA, 25 bp, Homo sapien
ctggcggtgacccttgctctttgca

SEQ ID NO: 422899 - DNA, 25 bp, Homo sapien
tctttgcagttgtgccacccactct

SEQ ID NO: 422900 - DNA, 25 bp, Homo sapien
tgcatccctacttgcagcagcttaa

SEQ ID NO: 422901 - DNA, 25 bp, Homo sapien
tacttgcagcagcttaatctggcct

SEQ ID NO: 422902 - DNA, 25 bp, Homo sapien
gcttaatctggcctctttcaaaata

SEQ ID NO: 422903 - DNA, 25 bp, Homo sapien
tcaaccgacggtaattgtatatatt

SEQ ID NO: 422904 - DNA, 25 bp, Homo sapien
gtatatatttcttaggtacaatgtg

SEQ ID NO: 422905 - DNA, 25 bp, Homo sapien
actgatgtctttcccagaatttatg

SEQ ID NO: 422906 - DNA, 25 bp, Homo sapien
ctttcccagaatttatgtactctat

SEQ ID NO: 422907 - DNA, 25 bp, Homo sapien
tctataacggtgtgaatgattacca

SEQ ID NO: 422908 - DNA, 25 bp, Homo sapien
gtgtgaatgattaccagtattaagc

SEQ ID NO: 422909 - DNA, 25 bp, Homo sapien
catctgatatattgagctatgtttt

SEQ ID NO: 422910 - DNA, 25 bp, Homo sapien
tgtaattggttgttgtttcatgtcc

SEQ ID NO: 422911 - DNA, 25 bp, Homo sapien
gttgtttcatgtcctacacagtaag

SEQ ID NO: 422912 - DNA, 25 bp, Homo sapien
gtttcatgtcctacacagtaagaac

SEQ ID NO: 422913 - DNA, 25 bp, Homo sapien
tgtcctacacagtaagaacaagagt

SEQ ID NO: 422914 - DNA, 25 bp, Homo sapien
aagagtatgttaacctttttgtcag

SEQ ID NO: 422915 - DNA, 25 bp, Homo sapien
gtatgttaacctttttgtcaggata

SEQ ID NO: 422916 - DNA, 25 bp, Homo sapien
attcagctgcagcaatgcattcctt

SEQ ID NO: 422917 - DNA, 25 bp, Homo sapien
caatgcattccttccaatttattat

SEQ ID NO: 422918 - DNA, 25 bp, Homo sapien
ttggcttacagagaccctacatctt

SEQ ID NO: 422919 - DNA, 25 bp, Homo sapien
atcttctgcctggagtcgcatgtcc

SEQ ID NO: 422920 - DNA, 25 bp, Homo sapien
gtcgcatgtccaggtacttaacttc

SEQ ID NO: 422921 - DNA, 25 bp, Homo sapien
ggaaattggctgcaatggcctccac

SEQ ID NO: 422922 - DNA, 25 bp, Homo sapien
tgcaatggcctccacctggaaaggc

SEQ ID NO: 422923 - DNA, 25 bp, Homo sapien
gaactggcttgttagatgtccacag

SEQ ID NO: 422924 - DNA, 25 bp, Homo sapien
aaagcaagtctttgccttagcccaa

SEQ ID NO: 422925 - DNA, 25 bp, Homo sapien
tagcccaaagcccttgaatttttat

SEQ ID NO: 422926 - DNA, 25 bp, Homo sapien
tgctgttttactagattggtgcaaa

SEQ ID NO: 422927 - DNA, 25 bp, Homo sapien
cagaaagtgacatgccttggcctat

SEQ ID NO: 422928 - DNA, 25 bp, Homo sapien
acatgccttggcctatagtcctaac

SEQ ID NO: 422929 - DNA, 25 bp, Homo sapien
tgggcctctttcctgtggttcacag

SEQ ID NO: 422930 - DNA, 25 bp, Homo sapien
ggttcacagctgtagtatggagatt

SEQ ID NO: 422931 - DNA, 25 bp, Homo sapien
ggatctttgcagtacaacacctcta

SEQ ID NO: 422932 - DNA, 25 bp, Homo sapien
tatgcacttctttctctgtagcaca

SEQ ID NO: 422933 - DNA, 25 bp, Homo sapien
tgtagcacatgttacctttctttgt

SEQ ID NO: 422934 - DNA, 25 bp, Homo sapien
gttacctttctttgtgaggcaatgg

SEQ ID NO: 422935 - DNA, 25 bp, Homo sapien
aatggagtggtctaggattgagcaa

SEQ ID NO: 422936 - DNA, 25 bp, Homo sapien
ggtagacagctacccatgatctagc

SEQ ID NO: 422937 - DNA, 25 bp, Homo sapien
catgatctagcccagtcgtatttta

SEQ ID NO: 422938 - DNA, 25 bp, Homo sapien
acaacagtcacctcccttcatatat

SEQ ID NO: 422939 - DNA, 25 bp, Homo sapien
agtcacctcccttcatatatgacac

SEQ ID NO: 422940 - DNA, 25 bp, Homo sapien
tcccttcatatatgacaccccaaaa

SEQ ID NO: 422941 - DNA, 25 bp, Homo sapien
atatgacaccccaaaatggaagaca

SEQ ID NO: 422942 - DNA, 25 bp, Homo sapien
atcatgtcagggagctatatgccag

SEQ ID NO: 422943 - DNA, 25 bp, Homo sapien
agggagctatatgccagggctacct

SEQ ID NO: 422944 - DNA, 25 bp, Homo sapien
ggctcagtcggcaggtgccagaaca

SEQ ID NO: 422945 - DNA, 25 bp, Homo sapien
gcaggtgccagaacattccctggga

SEQ ID NO: 422946 - DNA, 25 bp, Homo sapien
gtgccagaacattccctgggaaggc

SEQ ID NO: 422947 - DNA, 25 bp, Homo sapien
agcctgtcaccttgtgtccaaaatt

SEQ ID NO: 422948 - DNA, 25 bp, Homo sapien
caccttgtgtccaaaattggtgggt

SEQ ID NO: 422949 - DNA, 25 bp, Homo sapien
tctcacttagcatgttcccaaggtt

SEQ ID NO: 422950 - DNA, 25 bp, Homo sapien
aaggttcctcctgtctgtagcctgt

SEQ ID NO: 422951 - DNA, 25 bp, Homo sapien
gtctgtagcctgtatcactacttca

SEQ ID NO: 422952 - DNA, 25 bp, Homo sapien
ttcagccctagggaggagccactaa

SEQ ID NO: 422953 - DNA, 25 bp, Homo sapien
ggaggagccactaacgtgctttctc

SEQ ID NO: 422954 - DNA, 25 bp, Homo sapien
cactaacgtgctttctccacagatg

SEQ ID NO: 422955 - DNA, 25 bp, Homo sapien
tctccacagatgtccctcttctggg

SEQ ID NO: 422956 - DNA, 25 bp, Homo sapien
tctgggcattgcacgtaaacggaat

SEQ ID NO: 422957 - DNA, 25 bp, Homo sapien
aacggaatcgctgtgtgtgatctcc

SEQ ID NO: 422958 - DNA, 25 bp, Homo sapien
tcgctgtgtgtgatctcctgtgtct

SEQ ID NO: 422959 - DNA, 25 bp, Homo sapien
tgtgtctggttcctctcacttagca

SEQ ID NO: 422960 - DNA, 25 bp, Homo sapien
ttcttcttcacccattcactgaagg

SEQ ID NO: 422961 - DNA, 25 bp, Homo sapien
tcactgaaggttattggtatccaaa

SEQ ID NO: 422962 - DNA, 25 bp, Homo sapien
tcaaatttctagttttcttctcctt

SEQ ID NO: 422963 - DNA, 25 bp, Homo sapien
ctccttctggtatcctcactcgtaa

SEQ ID NO: 422964 - DNA, 25 bp, Homo sapien
atcctcactcgtaaccatttctttg

SEQ ID NO: 422965 - DNA, 25 bp, Homo sapien
ctttgcctgttctgaagacccacta

SEQ ID NO: 422966 - DNA, 25 bp, Homo sapien
gaagacccactacaaagaatcccaa

SEQ ID NO: 422967 - DNA, 25 bp, Homo sapien
caaagaatcccaagactcgttttct

SEQ ID NO: 422968 - DNA, 25 bp, Homo sapien
ttcttcagcaacatgagatcctcgc

SEQ ID NO: 422969 - DNA, 25 bp, Homo sapien
agatcctcgccaaacctattataat

SEQ ID NO: 422970 - DNA, 25 bp, Homo sapien
tctcttccacctacatctatttttt

SEQ ID NO: 422971 - DNA, 25 bp, Homo sapien
gagaaccgtccaccctggaaagaag

SEQ ID NO: 422972 - DNA, 25 bp, Homo sapien
ctcttggctctcggagccgcaggga

SEQ ID NO: 422973 - DNA, 25 bp, Homo sapien
ctctcggagccgcagggagtgtgtc

SEQ ID NO: 422974 - DNA, 25 bp, Homo sapien
tctcggagccgcagggagtgtgtct

SEQ ID NO: 422975 - DNA, 25 bp, Homo sapien
ctcggagccgcagggagtgtgtctt

SEQ ID NO: 422976 - DNA, 25 bp, Homo sapien
agggagtgtgtcttcccgcgccacc

SEQ ID NO: 422977 - DNA, 25 bp, Homo sapien
ggagtgtgtcttcccgcgccaccct

SEQ ID NO: 422978 - DNA, 25 bp, Homo sapien
ggccaaggagctattttggggtctc

SEQ ID NO: 422979 - DNA, 25 bp, Homo sapien
tattttggggtctcgtttgcccagg

SEQ ID NO: 422980 - DNA, 25 bp, Homo sapien
gtctcgtttgcccagggagggcttg

SEQ ID NO: 422981 - DNA, 25 bp, Homo sapien
ctcgtttgcccagggagggcttggc

SEQ ID NO: 422982 - DNA, 25 bp, Homo sapien
gtaaccaatggaaacccatagaagg

SEQ ID NO: 422983 - DNA, 25 bp, Homo sapien
tgagcccctatgctcaggcttgctc

SEQ ID NO: 422984 - DNA, 25 bp, Homo sapien
ctcaggcttgctcccacattgtgga

SEQ ID NO: 422985 - DNA, 25 bp, Homo sapien
ttcatttcttccttgcttcgtttgt

SEQ ID NO: 422986 - DNA, 25 bp, Homo sapien
ttcttccttgcttcgtttgtgcgtt

SEQ ID NO: 422987 - DNA, 25 bp, Homo sapien
accctctactggtaacactctgatt

SEQ ID NO: 422988 - DNA, 25 bp, Homo sapien
ggtaacactctgattaagctccaat

SEQ ID NO: 422989 - DNA, 25 bp, Homo sapien
ttaagctccaattcaagcctgccat

SEQ ID NO: 422990 - DNA, 25 bp, Homo sapien
attcaagcctgccataaatcacctg

SEQ ID NO: 422991 - DNA, 25 bp, Homo sapien
aaatcacctgacatgctcgtgaagc

SEQ ID NO: 422992 - DNA, 25 bp, Homo sapien
gacatgctcgtgaagcctcctcagt

SEQ ID NO: 422993 - DNA, 25 bp, Homo sapien
tagaacaaaactcctgctttcattt

SEQ ID NO: 422994 - DNA, 25 bp, Homo sapien
tttggaaatacattggtcttagttt

SEQ ID NO: 422995 - DNA, 25 bp, Homo sapien
aatacattggtcttagtttttctga

SEQ ID NO: 422996 - DNA, 25 bp, Homo sapien
cattggtcttagtttttctgagtcc

SEQ ID NO: 422997 - DNA, 25 bp, Homo sapien
tggtcttagtttttctgagtccatg

SEQ ID NO: 422998 - DNA, 25 bp, Homo sapien
tttctgagtccatgatacataccat

SEQ ID NO: 422999 - DNA, 25 bp, Homo sapien
gagtccatgatacataccataccct

SEQ ID NO: 423000 - DNA, 25 bp, Homo sapien
atgatacataccataccctattttg

SEQ ID NO: 423001 - DNA, 25 bp, Homo sapien
cataccataccctattttggtttgt

SEQ ID NO: 423002 - DNA, 25 bp, Homo sapien
cataccctattttggtttgtaggag

SEQ ID NO: 423003 - DNA, 25 bp, Homo sapien
atgaaatctaacactttcaggttaa

SEQ ID NO: 423004 - DNA, 25 bp, Homo sapien
agaaagttggttaccctgccatggg

SEQ ID NO: 423005 - DNA, 25 bp, Homo sapien
ccctgccatgggaataaagtagctg

SEQ ID NO: 423006 - DNA, 25 bp, Homo sapien
taaccactgaagtaccagcacctgt

SEQ ID NO: 423007 - DNA, 25 bp, Homo sapien
gaagtaccagcacctgtaggatgct

SEQ ID NO: 423008 - DNA, 25 bp, Homo sapien
cctgtaggatgctgtctttgaagaa

SEQ ID NO: 423009 - DNA, 25 bp, Homo sapien
tgaagaaactgaggcggacctccaa

SEQ ID NO: 423010 - DNA, 25 bp, Homo sapien
gcggacctccaaatgcagccctaag

SEQ ID NO: 423011 - DNA, 25 bp, Homo sapien
gcagccctaaggcagaggtcaacgt

SEQ ID NO: 423012 - DNA, 25 bp, Homo sapien
agaggtcaacgtggaagaccagccc

SEQ ID NO: 423013 - DNA, 25 bp, Homo sapien
cactggtctttgcaagctgtacgtt

SEQ ID NO: 423014 - DNA, 25 bp, Homo sapien
aagctgtacgttgtaggcaatctga

SEQ ID NO: 423015 - DNA, 25 bp, Homo sapien
tgagagggacatcttcatccctact

SEQ ID NO: 423016 - DNA, 25 bp, Homo sapien
gaagacagctttattgcttaactct

SEQ ID NO: 423017 - DNA, 25 bp, Homo sapien
gacagctttattgcttaactctatt

SEQ ID NO: 423018 - DNA, 25 bp, Homo sapien
tgcttaactctattgtacataggat

SEQ ID NO: 423019 - DNA, 25 bp, Homo sapien
ctattgtacataggatacacgttca

SEQ ID NO: 423020 - DNA, 25 bp, Homo sapien
aattcaggcttaatgctgcacctag

SEQ ID NO: 423021 - DNA, 25 bp, Homo sapien
caggcttaatgctgcacctagatat

SEQ ID NO: 423022 - DNA, 25 bp, Homo sapien
ttaatgctgcacctagatataaatg

SEQ ID NO: 423023 - DNA, 25 bp, Homo sapien
gatataaatgctaatgatacttggg

SEQ ID NO: 423024 - DNA, 25 bp, Homo sapien
gatacttgggtttatagccttctga

SEQ ID NO: 423025 - DNA, 25 bp, Homo sapien
tacttgggtttatagccttctgatc

SEQ ID NO: 423026 - DNA, 25 bp, Homo sapien
gctatgatggcaccagtgcatttca

SEQ ID NO: 423027 - DNA, 25 bp, Homo sapien
aaaatgaagattctgatgactgcct

SEQ ID NO: 423028 - DNA, 25 bp, Homo sapien
gagatttaagagaatgtgcagcctg

SEQ ID NO: 423029 - DNA, 25 bp, Homo sapien
ctgcctagggaagagaaattctaag

SEQ ID NO: 423030 - DNA, 25 bp, Homo sapien
gatttaagagaatgtgcagcctggg

SEQ ID NO: 423031 - DNA, 25 bp, Homo sapien
atttaagagaatgtgcagcctgggc

SEQ ID NO: 423032 - DNA, 25 bp, Homo sapien
tttaagagaatgtgcagcctgggca

SEQ ID NO: 423033 - DNA, 25 bp, Homo sapien
ttaagagaatgtgcagcctgggcaa

SEQ ID NO: 423034 - DNA, 25 bp, Homo sapien
aaatattagccaagcttggcagtgt

SEQ ID NO: 423035 - DNA, 25 bp, Homo sapien
atattagccaagcttggcagtgtgc

SEQ ID NO: 423036 - DNA, 25 bp, Homo sapien
attagccaagcttggcagtgtgcac

SEQ ID NO: 423037 - DNA, 25 bp, Homo sapien
gtagatgtttactggatggatggac

SEQ ID NO: 423038 - DNA, 25 bp, Homo sapien
gatggacggatctatggacagacag

SEQ ID NO: 423039 - DNA, 25 bp, Homo sapien
gcccaaggcatctttataggtcagt

SEQ ID NO: 423040 - DNA, 25 bp, Homo sapien
ataggtcagtgggtatatctgcaca

SEQ ID NO: 423041 - DNA, 25 bp, Homo sapien
tatctgcacagttcagcaatttctg

SEQ ID NO: 423042 - DNA, 25 bp, Homo sapien
cagcaatttctgaagagtgttcttg

SEQ ID NO: 423043 - DNA, 25 bp, Homo sapien
agtgttcttggaactctagccccta

SEQ ID NO: 423044 - DNA, 25 bp, Homo sapien
tctagcccctaagatactcctaagg

SEQ ID NO: 423045 - DNA, 25 bp, Homo sapien
atattccctggtcaattaaacttag

SEQ ID NO: 423046 - DNA, 25 bp, Homo sapien
atgacagtttgatacaccactctcc

SEQ ID NO: 423047 - DNA, 25 bp, Homo sapien
gatacaccactctcctgatgatttg

SEQ ID NO: 423048 - DNA, 25 bp, Homo sapien
gatacctgtactgtggttatataag

SEQ ID NO: 423049 - DNA, 25 bp, Homo sapien
ctgtggttatataagaggctgtcct

SEQ ID NO: 423050 - DNA, 25 bp, Homo sapien
tataagaggctgtccttgtttagga

SEQ ID NO: 423051 - DNA, 25 bp, Homo sapien
aggctgtccttgtttaggaaatata

SEQ ID NO: 423052 - DNA, 25 bp, Homo sapien
ggaaatatatactgaactttttggg

SEQ ID NO: 423053 - DNA, 25 bp, Homo sapien
gatattaggtcagcaatttactctc

SEQ ID NO: 423054 - DNA, 25 bp, Homo sapien
atttactctcaaatgtttccagaaa

SEQ ID NO: 423055 - DNA, 25 bp, Homo sapien
taaaagtattccttgtgttatttct

SEQ ID NO: 423056 - DNA, 25 bp, Homo sapien
gtgttatttctaaaacttctctgta

SEQ ID NO: 423057 - DNA, 25 bp, Homo sapien
aaacttctctgtatgtctgacttca

SEQ ID NO: 423058 - DNA, 25 bp, Homo sapien
cttctctgtatgtctgacttcaaaa

SEQ ID NO: 423059 - DNA, 25 bp, Homo sapien
ctgcaggagctgcccgggacggacg

SEQ ID NO: 423060 - DNA, 25 bp, Homo sapien
tgcaggagctgcccgggacggacga

SEQ ID NO: 423061 - DNA, 25 bp, Homo sapien
ggagctgcccgggacggacgactac

SEQ ID NO: 423062 - DNA, 25 bp, Homo sapien
gagctgcccgggacggacgactacg

SEQ ID NO: 423063 - DNA, 25 bp, Homo sapien
agctgcccgggacggacgactacgt

SEQ ID NO: 423064 - DNA, 25 bp, Homo sapien
tgcccgggacggacgactacgtctt

SEQ ID NO: 423065 - DNA, 25 bp, Homo sapien
ggacggacgactacgtcttttactg

SEQ ID NO: 423066 - DNA, 25 bp, Homo sapien
gacggacgactacgtcttttactgc

SEQ ID NO: 423067 - DNA, 25 bp, Homo sapien
acggacgactacgtcttttactgca

SEQ ID NO: 423068 - DNA, 25 bp, Homo sapien
cggacgactacgtcttttactgcaa

SEQ ID NO: 423069 - DNA, 25 bp, Homo sapien
gtgggggcctgcgctacatgggaaa

SEQ ID NO: 423070 - DNA, 25 bp, Homo sapien
ttgcgggcccgctcctggaactcag

SEQ ID NO: 423071 - DNA, 25 bp, Homo sapien
tggaactcagggaactgccggctgc

SEQ ID NO: 423072 - DNA, 25 bp, Homo sapien
aactgccggctgcaggactcgatga

SEQ ID NO: 423073 - DNA, 25 bp, Homo sapien
ggactcgatgatggcctggatcttc

SEQ ID NO: 423074 - DNA, 25 bp, Homo sapien
ggatcttctccttgggctgcttgga

SEQ ID NO: 423075 - DNA, 25 bp, Homo sapien
agatgggcaccatgcggtccaggtt

SEQ ID NO: 423076 - DNA, 25 bp, Homo sapien
ggtccaggttctcgtccacaaagag

SEQ ID NO: 423077 - DNA, 25 bp, Homo sapien
cacaaagagacgcacaaacatctgt

SEQ ID NO: 423078 - DNA, 25 bp, Homo sapien
aaacatctgtggagacacgggccat

SEQ ID NO: 423079 - DNA, 25 bp, Homo sapien
gccggtgctcacgttgaaggcctta

SEQ ID NO: 423080 - DNA, 25 bp, Homo sapien
aaggccttaagacgctcagggtcca

SEQ ID NO: 423081 - DNA, 25 bp, Homo sapien
ccaatagtttgaacctaaaccagtg

SEQ ID NO: 423082 - DNA, 25 bp, Homo sapien
caatagtttgaacctaaaccagtgg

SEQ ID NO: 423083 - DNA, 25 bp, Homo sapien
ctaaaccagtggttcccagatgcca

SEQ ID NO: 423084 - DNA, 25 bp, Homo sapien
gttcccagatgccagtctgtgagcc

SEQ ID NO: 423085 - DNA, 25 bp, Homo sapien
ttcccagatgccagtctgtgagcca

SEQ ID NO: 423086 - DNA, 25 bp, Homo sapien
gtctgtgagccagctccatcagaat

SEQ ID NO: 423087 - DNA, 25 bp, Homo sapien
taaaaatgcccatagtcgtgggagg

SEQ ID NO: 423088 - DNA, 25 bp, Homo sapien
aaaaatgcccatagtcgtgggaggc

SEQ ID NO: 423089 - DNA, 25 bp, Homo sapien
aaaatgcccatagtcgtgggaggct

SEQ ID NO: 423090 - DNA, 25 bp, Homo sapien
aaatgcccatagtcgtgggaggctg

SEQ ID NO: 423091 - DNA, 25 bp, Homo sapien
tgcccatagtcgtgggaggctgaga

SEQ ID NO: 423092 - DNA, 25 bp, Homo sapien
agcaaatagttctggtatgttagcc

SEQ ID NO: 423093 - DNA, 25 bp, Homo sapien
aatagttctggtatgttagccattc

SEQ ID NO: 423094 - DNA, 25 bp, Homo sapien
tagttctggtatgttagccattcac

SEQ ID NO: 423095 - DNA, 25 bp, Homo sapien
gttctggtatgttagccattcacat

SEQ ID NO: 423096 - DNA, 25 bp, Homo sapien
tctggtatgttagccattcacattt

SEQ ID NO: 423097 - DNA, 25 bp, Homo sapien
tggtatgttagccattcacatttta

SEQ ID NO: 423098 - DNA, 25 bp, Homo sapien
gtatgttagccattcacattttagc

SEQ ID NO: 423099 - DNA, 25 bp, Homo sapien
tgttagccattcacattttagcatg

SEQ ID NO: 423100 - DNA, 25 bp, Homo sapien
gttagccattcacattttagcatga

SEQ ID NO: 423101 - DNA, 25 bp, Homo sapien
ttagccattcacattttagcatgaa

SEQ ID NO: 423102 - DNA, 25 bp, Homo sapien
gaaacagcataaataaatggacttc

SEQ ID NO: 423103 - DNA, 25 bp, Homo sapien
tagctgtgttggtggtgccagcact

SEQ ID NO: 423104 - DNA, 25 bp, Homo sapien
tggtgccagcactggcagaagcagt

SEQ ID NO: 423105 - DNA, 25 bp, Homo sapien
gggctggcggtggagccatacctgg

SEQ ID NO: 423106 - DNA, 25 bp, Homo sapien
cctgagccacaaggactggctgcat

SEQ ID NO: 423107 - DNA, 25 bp, Homo sapien
gactggctgcataagaagctgcccc

SEQ ID NO: 423108 - DNA, 25 bp, Homo sapien
tgcataagaagctgccccacaaggc

SEQ ID NO: 423109 - DNA, 25 bp, Homo sapien
accatctgggccaacgaggcattgg

SEQ ID NO: 423110 - DNA, 25 bp, Homo sapien
aacgaggcattggtacccagaccgg

SEQ ID NO: 423111 - DNA, 25 bp, Homo sapien
tagcaggttccccagaagctgagag

SEQ ID NO: 423112 - DNA, 25 bp, Homo sapien
ggcgccctgcagtgtcccagagact

SEQ ID NO: 423113 - DNA, 25 bp, Homo sapien
aactgaagatcagccatggagggtt

SEQ ID NO: 423114 - DNA, 25 bp, Homo sapien
gaggtatacctaagtatcatttatt

SEQ ID NO: 423115 - DNA, 25 bp, Homo sapien
gtatcatttattcaaggacctaaga

SEQ ID NO: 423116 - DNA, 25 bp, Homo sapien
aatttctttaaagtcatctgtctga

SEQ ID NO: 423117 - DNA, 25 bp, Homo sapien
taaagtcatctgtctgattctgtaa

SEQ ID NO: 423118 - DNA, 25 bp, Homo sapien
aagtcatctgtctgattctgtaaaa

SEQ ID NO: 423119 - DNA, 25 bp, Homo sapien
catctgtctgattctgtaaaaattt

SEQ ID NO: 423120 - DNA, 25 bp, Homo sapien
gttcttgctagttgtgttccccctc

SEQ ID NO: 423121 - DNA, 25 bp, Homo sapien
gctagttgtgttccccctccttatt

SEQ ID NO: 423122 - DNA, 25 bp, Homo sapien
ctccttattccatccatttcatagt

SEQ ID NO: 423123 - DNA, 25 bp, Homo sapien
ccttattccatccatttcatagtaa

SEQ ID NO: 423124 - DNA, 25 bp, Homo sapien
attccatccatttcatagtaataag

SEQ ID NO: 423125 - DNA, 25 bp, Homo sapien
aagacatctacattaatacatattc

SEQ ID NO: 423126 - DNA, 25 bp, Homo sapien
tactagataatctgggttctgcaca

SEQ ID NO: 423127 - DNA, 25 bp, Homo sapien
aatctgggttctgcacaattttgta

SEQ ID NO: 423128 - DNA, 25 bp, Homo sapien
ggccatttatttgttctatatatca

SEQ ID NO: 423129 - DNA, 25 bp, Homo sapien
caagtttttgaagcctccaatacca

SEQ ID NO: 423130 - DNA, 25 bp, Homo sapien
gaagcctccaataccaacatatttt

SEQ ID NO: 423131 - DNA, 25 bp, Homo sapien
tttgctgacataccatggttactac

SEQ ID NO: 423132 - DNA, 25 bp, Homo sapien
ggttactacaccaatttatcgtcac

SEQ ID NO: 423133 - DNA, 25 bp, Homo sapien
atcgtcacgagatatctgaacatga

SEQ ID NO: 423134 - DNA, 25 bp, Homo sapien
gaacatgatgttggacttaggaaac

SEQ ID NO: 423135 - DNA, 25 bp, Homo sapien
tggacttaggaaactagtacttgta

SEQ ID NO: 423136 - DNA, 25 bp, Homo sapien
gtccctgtgtgctaccagtgcaaga

SEQ ID NO: 423137 - DNA, 25 bp, Homo sapien
gatctgaggctctagtgggaaacct

SEQ ID NO: 423138 - DNA, 25 bp, Homo sapien
agtgggaaacctcaggtagctcctg

SEQ ID NO: 423139 - DNA, 25 bp, Homo sapien
gaagatctgtgctttccaacaagtg

SEQ ID NO: 423140 - DNA, 25 bp, Homo sapien
aagtgactacccttgaagcacatcc

SEQ ID NO: 423141 - DNA, 25 bp, Homo sapien
ctggatctgaaaagagcccttggct

SEQ ID NO: 423142 - DNA, 25 bp, Homo sapien
ttggctcagggcgtctttttccagc

SEQ ID NO: 423143 - DNA, 25 bp, Homo sapien
tttttccagcccctgaggaaatgga

SEQ ID NO: 423144 - DNA, 25 bp, Homo sapien
cctgcccattccctataagaatatc

SEQ ID NO: 423145 - DNA, 25 bp, Homo sapien
aatatcccaagacccaggcaatttt

SEQ ID NO: 423146 - DNA, 25 bp, Homo sapien
tatgtctgagccaaactgcactggg

SEQ ID NO: 423147 - DNA, 25 bp, Homo sapien
gagaaccgtccaccctggaaagaag

SEQ ID NO: 423148 - DNA, 25 bp, Homo sapien
gtccaccctggaaagaagagctcag

SEQ ID NO: 423149 - DNA, 25 bp, Homo sapien
gaagagctcagattcctcttggctc

SEQ ID NO: 423150 - DNA, 25 bp, Homo sapien
attcctcttggctctcggagccgca

SEQ ID NO: 423151 - DNA, 25 bp, Homo sapien
agggagtgtgtcttcccgcgccacc

SEQ ID NO: 423152 - DNA, 25 bp, Homo sapien
gtttctgtttctaatcccagcctgg

SEQ ID NO: 423153 - DNA, 25 bp, Homo sapien
tctgtttctaatcccagcctgggca

SEQ ID NO: 423154 - DNA, 25 bp, Homo sapien
agcctgggcaggaatgtggctcccc

SEQ ID NO: 423155 - DNA, 25 bp, Homo sapien
tgggcaggaatgtggctccccggcc

SEQ ID NO: 423156 - DNA, 25 bp, Homo sapien
gggcaggaatgtggctccccggcca

SEQ ID NO: 423157 - DNA, 25 bp, Homo sapien
caggaatgtggctccccggccaggg

SEQ ID NO: 423158 - DNA, 25 bp, Homo sapien
aggtccacatgcaaaatcagctttt

SEQ ID NO: 423159 - DNA, 25 bp, Homo sapien
ccccgtaattatcagagcagctagg

SEQ ID NO: 423160 - DNA, 25 bp, Homo sapien
attatcagagcagctaggcagggct

SEQ ID NO: 423161 - DNA, 25 bp, Homo sapien
agactcagtgggaggcttctggcct

SEQ ID NO: 423162 - DNA, 25 bp, Homo sapien
ctgagtgtggccttccccagagggt

SEQ ID NO: 423163 - DNA, 25 bp, Homo sapien
ccagagggtggttttccaaaggcag

SEQ ID NO: 423164 - DNA, 25 bp, Homo sapien
gggctgcttgtcattacctgaatca

SEQ ID NO: 423165 - DNA, 25 bp, Homo sapien
acctgaatcacagatgctcttttgt

SEQ ID NO: 423166 - DNA, 25 bp, Homo sapien
gatgctcttttgtcatacacagcca

SEQ ID NO: 423167 - DNA, 25 bp, Homo sapien
tttgtcatacacagccagcattcct

SEQ ID NO: 423168 - DNA, 25 bp, Homo sapien
gcattcctctgggtttcagcaagtt

SEQ ID NO: 423169 - DNA, 25 bp, Homo sapien
agcagggcacactggtgcctcccat

SEQ ID NO: 423170 - DNA, 25 bp, Homo sapien
gcagggtcaccacagccggcaagca

SEQ ID NO: 423171 - DNA, 25 bp, Homo sapien
acagccggcaagcactgggcctggg

SEQ ID NO: 423172 - DNA, 25 bp, Homo sapien
gaaaacagaacgctggtcatccgtg

SEQ ID NO: 423173 - DNA, 25 bp, Homo sapien
aacagaacgctggtcatccgtggca

SEQ ID NO: 423174 - DNA, 25 bp, Homo sapien
aacgctggtcatccgtggcactcag

SEQ ID NO: 423175 - DNA, 25 bp, Homo sapien
gtcatccgtggcactcagggctagg

SEQ ID NO: 423176 - DNA, 25 bp, Homo sapien
tccgtggcactcagggctaggcagt

SEQ ID NO: 423177 - DNA, 25 bp, Homo sapien
cactcagggctaggcagtccaggga

SEQ ID NO: 423178 - DNA, 25 bp, Homo sapien
gctaggcagtccagggagcagaaaa

SEQ ID NO: 423179 - DNA, 25 bp, Homo sapien
tcctggaggtcagagcggagcccct

SEQ ID NO: 423180 - DNA, 25 bp, Homo sapien
gggctctgatgagtctctcatcgct

SEQ ID NO: 423181 - DNA, 25 bp, Homo sapien
ggctctgatgagtctctcatcgctt

SEQ ID NO: 423182 - DNA, 25 bp, Homo sapien
gctctgatgagtctctcatcgcttg

SEQ ID NO: 423183 - DNA, 25 bp, Homo sapien
ctctgatgagtctctcatcgcttgt

SEQ ID NO: 423184 - DNA, 25 bp, Homo sapien
tctgatgagtctctcatcgcttgta

SEQ ID NO: 423185 - DNA, 25 bp, Homo sapien
ctgatgagtctctcatcgcttgtaa

SEQ ID NO: 423186 - DNA, 25 bp, Homo sapien
tgatgagtctctcatcgcttgtaaa

SEQ ID NO: 423187 - DNA, 25 bp, Homo sapien
gatgagtctctcatcgcttgtaaag

SEQ ID NO: 423188 - DNA, 25 bp, Homo sapien
atgagtctctcatcgcttgtaaagc

SEQ ID NO: 423189 - DNA, 25 bp, Homo sapien
agtctctcatcgcttgtaaagcctg

SEQ ID NO: 423190 - DNA, 25 bp, Homo sapien
gtctctcatcgcttgtaaagcctga

SEQ ID NO: 423191 - DNA, 25 bp, Homo sapien
aagaggtaagagaggcttgctgatt

SEQ ID NO: 423192 - DNA, 25 bp, Homo sapien
agaggcttgctgattggatggtgtg

SEQ ID NO: 423193 - DNA, 25 bp, Homo sapien
gggatagataacttcctgatcttgg

SEQ ID NO: 423194 - DNA, 25 bp, Homo sapien
ctgatcttggattttatagctgggt

SEQ ID NO: 423195 - DNA, 25 bp, Homo sapien
tcttggattttatagctgggtggat

SEQ ID NO: 423196 - DNA, 25 bp, Homo sapien
agactggaatgctggattaagcaat

SEQ ID NO: 423197 - DNA, 25 bp, Homo sapien
taagcaatgtatatgaacagggcat

SEQ ID NO: 423198 - DNA, 25 bp, Homo sapien
tgtatatgaacagggcatgttccct

SEQ ID NO: 423199 - DNA, 25 bp, Homo sapien
gcatgttccctaccctttaaagagt

SEQ ID NO: 423200 - DNA, 25 bp, Homo sapien
ctaccctttaaagagttatgtatat

SEQ ID NO: 423201 - DNA, 25 bp, Homo sapien
ttctccacttgtaatgtgttttagt

SEQ ID NO: 423202 - DNA, 25 bp, Homo sapien
tcacttggccagaagattgtacgac

SEQ ID NO: 423203 - DNA, 25 bp, Homo sapien
gtacgacatggctgctcaaacgagt

SEQ ID NO: 423204 - DNA, 25 bp, Homo sapien
tgctcaaacgagtccagatgcccac

SEQ ID NO: 423205 - DNA, 25 bp, Homo sapien
atacctgtgctctttgccgtcatga

SEQ ID NO: 423206 - DNA, 25 bp, Homo sapien
gctctttgccgtcatgaaactggaa

SEQ ID NO: 423207 - DNA, 25 bp, Homo sapien
ggaaactacgcatttgctccgggat

SEQ ID NO: 423208 - DNA, 25 bp, Homo sapien
ttgctccgggatatcctgtttttta

SEQ ID NO: 423209 - DNA, 25 bp, Homo sapien
atggaactggctgaaactggacaac

SEQ ID NO: 423210 - DNA, 25 bp, Homo sapien
accattggaccacactgggacttat

SEQ ID NO: 423211 - DNA, 25 bp, Homo sapien
gggacttatttgtgattggcctcat

SEQ ID NO: 423212 - DNA, 25 bp, Homo sapien
ctcattgttcctgggctgattttgt

SEQ ID NO: 423213 - DNA, 25 bp, Homo sapien
aatcagaaatatagttggctgggtg

SEQ ID NO: 423214 - DNA, 25 bp, Homo sapien
tcagaaatatagttggctgggtgca

SEQ ID NO: 423215 - DNA, 25 bp, Homo sapien
caggcatggtgatgctttcctgtaa

SEQ ID NO: 423216 - DNA, 25 bp, Homo sapien
catggtgatgctttcctgtaatccc

SEQ ID NO: 423217 - DNA, 25 bp, Homo sapien
cccagttactgtggaggctgatcac

SEQ ID NO: 423218 - DNA, 25 bp, Homo sapien
ccagttactgtggaggctgatcact

SEQ ID NO: 423219 - DNA, 25 bp, Homo sapien
cagttactgtggaggctgatcactt

SEQ ID NO: 423220 - DNA, 25 bp, Homo sapien
agttactgtggaggctgatcacttg

SEQ ID NO: 423221 - DNA, 25 bp, Homo sapien
gttactgtggaggctgatcacttga

SEQ ID NO: 423222 - DNA, 25 bp, Homo sapien
tgccactgcaacctagcctgaatga

SEQ ID NO: 423223 - DNA, 25 bp, Homo sapien
cactgcaacctagcctgaatgacag

SEQ ID NO: 423224 - DNA, 25 bp, Homo sapien
gttgtacccctagcttatggattag

SEQ ID NO: 423225 - DNA, 25 bp, Homo sapien
aggcaagtcacttctactcgtatac

SEQ ID NO: 423226 - DNA, 25 bp, Homo sapien
tcacttctactcgtataccctgttt

SEQ ID NO: 423227 - DNA, 25 bp, Homo sapien
tcgtataccctgtttccccatttgt

SEQ ID NO: 423228 - DNA, 25 bp, Homo sapien
gatgtgttactctaaggatctctaa

SEQ ID NO: 423229 - DNA, 25 bp, Homo sapien
ctaagattctttgcagttgttaaat

SEQ ID NO: 423230 - DNA, 25 bp, Homo sapien
gttaaattgcatagctctccactga

SEQ ID NO: 423231 - DNA, 25 bp, Homo sapien
atagctctccactgattccatggtg

SEQ ID NO: 423232 - DNA, 25 bp, Homo sapien
ggtggaaatttgctattctattaca

SEQ ID NO: 423233 - DNA, 25 bp, Homo sapien
gagatatcagacatactcatttaaa

SEQ ID NO: 423234 - DNA, 25 bp, Homo sapien
attctatatgtctttgtttctcttc

SEQ ID NO: 423235 - DNA, 25 bp, Homo sapien
gtttttgccttcaacaatatcggaa

SEQ ID NO: 423236 - DNA, 25 bp, Homo sapien
gtggaatgtcagattgcaatgcaat

SEQ ID NO: 423237 - DNA, 25 bp, Homo sapien
caattgcttgtgtttctgcggagtt

SEQ ID NO: 423238 - DNA, 25 bp, Homo sapien
gtgtttctgcggagttcatggaaga

SEQ ID NO: 423239 - DNA, 25 bp, Homo sapien
ggaagaaactcattatactcatttg

SEQ ID NO: 423240 - DNA, 25 bp, Homo sapien
ctcatttgtaatgcttgatggtaaa

SEQ ID NO: 423241 - DNA, 25 bp, Homo sapien
tttaaaactgcctctctgtgagcag

SEQ ID NO: 423242 - DNA, 25 bp, Homo sapien
tgcctctctgtgagcagtttctcca

SEQ ID NO: 423243 - DNA, 25 bp, Homo sapien
acgggtgtaatttcaactcgttgag

SEQ ID NO: 423244 - DNA, 25 bp, Homo sapien
actcgttgagagtgctcagttatgc

SEQ ID NO: 423245 - DNA, 25 bp, Homo sapien
gcaatgtttcttatctgtgtctgaa

SEQ ID NO: 423246 - DNA, 25 bp, Homo sapien
gaggacttctggcaaatccaaagct

SEQ ID NO: 423247 - DNA, 25 bp, Homo sapien
ggcaaatccaaagctcattccctat

SEQ ID NO: 423248 - DNA, 25 bp, Homo sapien
attccctatctcttgatgccttaac

SEQ ID NO: 423249 - DNA, 25 bp, Homo sapien
atgccttaacatcaggtgctgcctt

SEQ ID NO: 423250 - DNA, 25 bp, Homo sapien
acatcaggtgctgcctttgtagttg

SEQ ID NO: 423251 - DNA, 25 bp, Homo sapien
acagcccacaggacccattttttct

SEQ ID NO: 423252 - DNA, 25 bp, Homo sapien
gccaggctgcttagctggcagcaag

SEQ ID NO: 423253 - DNA, 25 bp, Homo sapien
tggcagcaagcacctcttcagctct

SEQ ID NO: 423254 - DNA, 25 bp, Homo sapien
tactcagcacatgtctcctctggtt

SEQ ID NO: 423255 - DNA, 25 bp, Homo sapien
gattattctgggaccttgttagggc

SEQ ID NO: 423256 - DNA, 25 bp, Homo sapien
tgggaccttgttagggctccaatcc

SEQ ID NO: 423257 - DNA, 25 bp, Homo sapien
aacaatagttctgcacaagtgtatc

SEQ ID NO: 423258 - DNA, 25 bp, Homo sapien
atagttctgcacaagtgtatcatga

SEQ ID NO: 423259 - DNA, 25 bp, Homo sapien
tctgcacaagtgtatcatgagatat

SEQ ID NO: 423260 - DNA, 25 bp, Homo sapien
tggtagtagaacaagtcatcatatc

SEQ ID NO: 423261 - DNA, 25 bp, Homo sapien
agtagaacaagtcatcatatcagga

SEQ ID NO: 423262 - DNA, 25 bp, Homo sapien
gaacaagtcatcatatcaggacaaa

SEQ ID NO: 423263 - DNA, 25 bp, Homo sapien
aaatgtatgtaatgactttctagat

SEQ ID NO: 423264 - DNA, 25 bp, Homo sapien
gtatgtaatgactttctagatagat

SEQ ID NO: 423265 - DNA, 25 bp, Homo sapien
ctagatagataagttgtttcttttt

SEQ ID NO: 423266 - DNA, 25 bp, Homo sapien
gatcacttgagcttgagctcgggag

SEQ ID NO: 423267 - DNA, 25 bp, Homo sapien
ttgagcttgagctcgggagatcaag

SEQ ID NO: 423268 - DNA, 25 bp, Homo sapien
acagaaaaccagacatggcatgttc

SEQ ID NO: 423269 - DNA, 25 bp, Homo sapien
cagaaaaccagacatggcatgttct

SEQ ID NO: 423270 - DNA, 25 bp, Homo sapien
agaaaaccagacatggcatgttctc

SEQ ID NO: 423271 - DNA, 25 bp, Homo sapien
gaaaaccagacatggcatgttctca

SEQ ID NO: 423272 - DNA, 25 bp, Homo sapien
aaaaccagacatggcatgttctcac

SEQ ID NO: 423273 - DNA, 25 bp, Homo sapien
aaaccagacatggcatgttctcact

SEQ ID NO: 423274 - DNA, 25 bp, Homo sapien
aaccagacatggcatgttctcactc

SEQ ID NO: 423275 - DNA, 25 bp, Homo sapien
accagacatggcatgttctcactca

SEQ ID NO: 423276 - DNA, 25 bp, Homo sapien
gatttgacacatacagaagcgtgaa

SEQ ID NO: 423277 - DNA, 25 bp, Homo sapien
gaagcgtgaaaaactcttgtgtgac

SEQ ID NO: 423278 - DNA, 25 bp, Homo sapien
tcttgtgtgactgggatagctcctc

SEQ ID NO: 423279 - DNA, 25 bp, Homo sapien
gggatagctcctctgcaatgagaac

SEQ ID NO: 423280 - DNA, 25 bp, Homo sapien
gaacatgcctgggataatgtactga

SEQ ID NO: 423281 - DNA, 25 bp, Homo sapien
atgaagcagagtccagtcatcccag

SEQ ID NO: 423282 - DNA, 25 bp, Homo sapien
cagagtccagtcatcccagccaaga

SEQ ID NO: 423283 - DNA, 25 bp, Homo sapien
gaaccagctgtgaatgtaaccgcat

SEQ ID NO: 423284 - DNA, 25 bp, Homo sapien
atgtaaccgcatgactttgaggcaa

SEQ ID NO: 423285 - DNA, 25 bp, Homo sapien
actttgaggcaagtccagaccaaga

SEQ ID NO: 423286 - DNA, 25 bp, Homo sapien
gaggcaagtccagaccaagaacaaa

SEQ ID NO: 423287 - DNA, 25 bp, Homo sapien
gttatgctaagtaaagttcgtttca

SEQ ID NO: 423288 - DNA, 25 bp, Homo sapien
tgctaagtaaagttcgtttcaaaag

SEQ ID NO: 423289 - DNA, 25 bp, Homo sapien
aagaccacgtattgtgtgagtacac

SEQ ID NO: 423290 - DNA, 25 bp, Homo sapien
gtattgtgtgagtacactgacagaa

SEQ ID NO: 423291 - DNA, 25 bp, Homo sapien
aaatatgtacatctacagaaagtag

SEQ ID NO: 423292 - DNA, 25 bp, Homo sapien
ttggaagtgactgttaatgggtatc

SEQ ID NO: 423293 - DNA, 25 bp, Homo sapien
gttaatgggtatcaggtatcttttt

SEQ ID NO: 423294 - DNA, 25 bp, Homo sapien
tttgagattatgtaaatgtcctaaa

SEQ ID NO: 423295 - DNA, 25 bp, Homo sapien
atgtcctaaaaattgattgcagtga

SEQ ID NO: 423296 - DNA, 25 bp, Homo sapien
ttgcacaactctctggatataataa

SEQ ID NO: 423297 - DNA, 25 bp, Homo sapien
gggtaaactgtatccattatatctc

SEQ ID NO: 423298 - DNA, 25 bp, Homo sapien
gtaacagtcagtcccaccgcagttt

SEQ ID NO: 423299 - DNA, 25 bp, Homo sapien
caccgcagtttaacccacaaggaat

SEQ ID NO: 423300 - DNA, 25 bp, Homo sapien
ggaattttctcttgtcctaaactat

SEQ ID NO: 423301 - DNA, 25 bp, Homo sapien
aactattatggccttctttgtccga

SEQ ID NO: 423302 - DNA, 25 bp, Homo sapien
tggccttctttgtccgattgaacgg

SEQ ID NO: 423303 - DNA, 25 bp, Homo sapien
gaggtaacgaagtctcgtcttccgc

SEQ ID NO: 423304 - DNA, 25 bp, Homo sapien
tgatcgtttctgcaggattccagaa

SEQ ID NO: 423305 - DNA, 25 bp, Homo sapien
ggctcttacattacttttctaccta

SEQ ID NO: 423306 - DNA, 25 bp, Homo sapien
tttctacctaattcgtatccttggg

SEQ ID NO: 423307 - DNA, 25 bp, Homo sapien
gtatacaagttttgcgattacgcct

SEQ ID NO: 423308 - DNA, 25 bp, Homo sapien
gattacgccttctgcgtaacagtca

SEQ ID NO: 423309 - DNA, 25 bp, Homo sapien
gtttctgtttctaatcccagcctgg

SEQ ID NO: 423310 - DNA, 25 bp, Homo sapien
tctgtttctaatcccagcctgggca

SEQ ID NO: 423311 - DNA, 25 bp, Homo sapien
ctgggcaggaatgtggctccccggc

SEQ ID NO: 423312 - DNA, 25 bp, Homo sapien
tgggcaggaatgtggctccccggcc

SEQ ID NO: 423313 - DNA, 25 bp, Homo sapien
gggcaggaatgtggctccccggcca

SEQ ID NO: 423314 - DNA, 25 bp, Homo sapien
ggcaggaatgtggctccccggccag

SEQ ID NO: 423315 - DNA, 25 bp, Homo sapien
gcaggaatgtggctccccggccagg

SEQ ID NO: 423316 - DNA, 25 bp, Homo sapien
caggaatgtggctccccggccaggg

SEQ ID NO: 423317 - DNA, 25 bp, Homo sapien
atgatgatctactcctatttatgtg

SEQ ID NO: 423318 - DNA, 25 bp, Homo sapien
atttatgtggacttgctctggatta

SEQ ID NO: 423319 - DNA, 25 bp, Homo sapien
gatgagaagacctgactctactgtt

SEQ ID NO: 423320 - DNA, 25 bp, Homo sapien
agacctgactctactgttttcttga

SEQ ID NO: 423321 - DNA, 25 bp, Homo sapien
tactgttttcttgataagtgacctt

SEQ ID NO: 423322 - DNA, 25 bp, Homo sapien
tgaccttgaaccagacacatgtgct

SEQ ID NO: 423323 - DNA, 25 bp, Homo sapien
ttgaaccagacacatgtgctcaagt

SEQ ID NO: 423324 - DNA, 25 bp, Homo sapien
aatgaagatacctggccttcctact

SEQ ID NO: 423325 - DNA, 25 bp, Homo sapien
tggccttcctacttcacaaggttct

SEQ ID NO: 423326 - DNA, 25 bp, Homo sapien
ttcacaaggttcttttgaagatcaa

SEQ ID NO: 423327 - DNA, 25 bp, Homo sapien
gaagatcaaatgtaatactgcataa

SEQ ID NO: 423328 - DNA, 25 bp, Homo sapien
aacagggccttgtccttagagcact

SEQ ID NO: 423329 - DNA, 25 bp, Homo sapien
agggccttgtccttagagcactggg

SEQ ID NO: 423330 - DNA, 25 bp, Homo sapien
ggctggcatccctgtagagccagag

SEQ ID NO: 423331 - DNA, 25 bp, Homo sapien
gacattccagatatgttgggctcac

SEQ ID NO: 423332 - DNA, 25 bp, Homo sapien
atatgttgggctcacctcatccttg

SEQ ID NO: 423333 - DNA, 25 bp, Homo sapien
ttgctgtgagactggagttccatgg

SEQ ID NO: 423334 - DNA, 25 bp, Homo sapien
gacatgaagtcagtacaccgcagag

SEQ ID NO: 423335 - DNA, 25 bp, Homo sapien
agtacaccgcagagctgctcagctg

SEQ ID NO: 423336 - DNA, 25 bp, Homo sapien
tctacctctcgctgacttttttgtt

SEQ ID NO: 423337 - DNA, 25 bp, Homo sapien
tctcgctgacttttttgttgcacat

SEQ ID NO: 423338 - DNA, 25 bp, Homo sapien
atacattttctttcaattagcattt

SEQ ID NO: 423339 - DNA, 25 bp, Homo sapien
aagtgagagataaagcccctaagga

SEQ ID NO: 423340 - DNA, 25 bp, Homo sapien
taaggaagggacacctaagtgcctc

SEQ ID NO: 423341 - DNA, 25 bp, Homo sapien
taagtgcctccccaaccagggtctg

SEQ ID NO: 423342 - DNA, 25 bp, Homo sapien
agggtctgtccttcgtgtcccaagt

SEQ ID NO: 423343 - DNA, 25 bp, Homo sapien
cttcgtgtcccaagtgtgtgtagtg

SEQ ID NO: 423344 - DNA, 25 bp, Homo sapien
tagtggagggagtgctccccagttt

SEQ ID NO: 423345 - DNA, 25 bp, Homo sapien
gcggtattctaaacctttggaaatg

SEQ ID NO: 423346 - DNA, 25 bp, Homo sapien
tagatactacttgggacactatgtc

SEQ ID NO: 423347 - DNA, 25 bp, Homo sapien
gggacactatgtcttggttctgtat

SEQ ID NO: 423348 - DNA, 25 bp, Homo sapien
tcttggttctgtatgtcctgggaca

SEQ ID NO: 423349 - DNA, 25 bp, Homo sapien
caaaattttcaacatcacagtctaa

SEQ ID NO: 423350 - DNA, 25 bp, Homo sapien
acctcggaaatgcagctttccctag

SEQ ID NO: 423351 - DNA, 25 bp, Homo sapien
agccagtgagtctattgcatggtgt

SEQ ID NO: 423352 - DNA, 25 bp, Homo sapien
gtgagtctattgcatggtgttttga

SEQ ID NO: 423353 - DNA, 25 bp, Homo sapien
ctattgcatggtgttttgagaaagg

SEQ ID NO: 423354 - DNA, 25 bp, Homo sapien
atttgcctgcaaatagtataaacaa

SEQ ID NO: 423355 - DNA, 25 bp, Homo sapien
tgctcagcatcatttcatgccaaag

SEQ ID NO: 423356 - DNA, 25 bp, Homo sapien
catttcatgccaaagtgctgctatg

SEQ ID NO: 423357 - DNA, 25 bp, Homo sapien
gccaaagtgctgctatgggctgctt

SEQ ID NO: 423358 - DNA, 25 bp, Homo sapien
tatgggctgctttgtgtgcacaaaa

SEQ ID NO: 423359 - DNA, 25 bp, Homo sapien
gtgtgcacaaaattgctttttccac

SEQ ID NO: 423360 - DNA, 25 bp, Homo sapien
cacaaaattgctttttccacctcgg

SEQ ID NO: 423361 - DNA, 25 bp, Homo sapien
gaattgtgaatcctagccctagatc

SEQ ID NO: 423362 - DNA, 25 bp, Homo sapien
agccctagatcttcccacaggtggg

SEQ ID NO: 423363 - DNA, 25 bp, Homo sapien
agcacacaggtgaagtatctcgtat

SEQ ID NO: 423364 - DNA, 25 bp, Homo sapien
gaagtatctcgtatgctcatcctgc

SEQ ID NO: 423365 - DNA, 25 bp, Homo sapien
cctctggttaggtcttgaatcttgt

SEQ ID NO: 423366 - DNA, 25 bp, Homo sapien
ttgaatcttgtacatggacacagtc

SEQ ID NO: 423367 - DNA, 25 bp, Homo sapien
cacagtccgcagttggaatgtcata

SEQ ID NO: 423368 - DNA, 25 bp, Homo sapien
gtcatatgtagatccagccacaggt

SEQ ID NO: 423369 - DNA, 25 bp, Homo sapien
gccacaggtgtgatgttgacctatt

SEQ ID NO: 423370 - DNA, 25 bp, Homo sapien
aagttagctcacaggcacattgata

SEQ ID NO: 423371 - DNA, 25 bp, Homo sapien
tgataactctcatacctggatccag

SEQ ID NO: 423372 - DNA, 25 bp, Homo sapien
ggtggaagttctacctagatttgaa

SEQ ID NO: 423373 - DNA, 25 bp, Homo sapien
tctacctagatttgaatgagtgttt

SEQ ID NO: 423374 - DNA, 25 bp, Homo sapien
agggaatgagaatgtcatggtgcta

SEQ ID NO: 423375 - DNA, 25 bp, Homo sapien
gtcatggtgctaaacctgacaaata

SEQ ID NO: 423376 - DNA, 25 bp, Homo sapien
aacagtcttcttaaaagtattgagg

SEQ ID NO: 423377 - DNA, 25 bp, Homo sapien
aataagcctataaatgtgtttcaca

SEQ ID NO: 423378 - DNA, 25 bp, Homo sapien
atgtgtttcacattgctaacttgag

SEQ ID NO: 423379 - DNA, 25 bp, Homo sapien
cacattgctaacttgagtttcagtt

SEQ ID NO: 423380 - DNA, 25 bp, Homo sapien
gagtttcagttgattcagtttgtaa

SEQ ID NO: 423381 - DNA, 25 bp, Homo sapien
gtaataactagtaatgagcttctgt

SEQ ID NO: 423382 - DNA, 25 bp, Homo sapien
gtaatgagcttctgtttacaataaa

SEQ ID NO: 423383 - DNA, 25 bp, Homo sapien
gtcttggctgcacatcctggtttcc

SEQ ID NO: 423384 - DNA, 25 bp, Homo sapien
cttggctgcacatcctggtttcctc

SEQ ID NO: 423385 - DNA, 25 bp, Homo sapien
atcctggtttcctcttcatccatgg

SEQ ID NO: 423386 - DNA, 25 bp, Homo sapien
tcctggtttcctcttcatccatggg

SEQ ID NO: 423387 - DNA, 25 bp, Homo sapien
tttcctcttcatccatggggagcag

SEQ ID NO: 423388 - DNA, 25 bp, Homo sapien
gggagcagcaccttatgaagaaaac

SEQ ID NO: 423389 - DNA, 25 bp, Homo sapien
gagcagcaccttatgaagaaaacaa

SEQ ID NO: 423390 - DNA, 25 bp, Homo sapien
gaaaacaagcggcataatgaataaa

SEQ ID NO: 423391 - DNA, 25 bp, Homo sapien
atgaataaatactcacctctagcaa

SEQ ID NO: 423392 - DNA, 25 bp, Homo sapien
tattcatatatattaacgtgttgat

SEQ ID NO: 423393 - DNA, 25 bp, Homo sapien
aacgtgttgatttaaatattactat

SEQ ID NO: 423394 - DNA, 25 bp, Homo sapien
ggaaatgatgtttgatgtcgggaaa

SEQ ID NO: 423395 - DNA, 25 bp, Homo sapien
atgtcgggaaaactcaaccacctct

SEQ ID NO: 423396 - DNA, 25 bp, Homo sapien
gaaaactcaaccacctctgatgaag

SEQ ID NO: 423397 - DNA, 25 bp, Homo sapien
tgaagagagcattttccactgagaa

SEQ ID NO: 423398 - DNA, 25 bp, Homo sapien
aaatcaaccttgcttcatatcaaat

SEQ ID NO: 423399 - DNA, 25 bp, Homo sapien
aagtgaaagcattctgtgtttactc

SEQ ID NO: 423400 - DNA, 25 bp, Homo sapien
attctgtgtttactctttgcattaa

SEQ ID NO: 423401 - DNA, 25 bp, Homo sapien
aattcttttgactttgtttctcttg

SEQ ID NO: 423402 - DNA, 25 bp, Homo sapien
ctttgtttctcttgtgtagtggtaa

SEQ ID NO: 423403 - DNA, 25 bp, Homo sapien
gtggtaaaatggtagctggtgctta

SEQ ID NO: 423404 - DNA, 25 bp, Homo sapien
gctggtgcttattgagatttgctgt

SEQ ID NO: 423405 - DNA, 25 bp, Homo sapien
atatgccttctgaaaatgtttctgc

SEQ ID NO: 423406 - DNA, 25 bp, Homo sapien
aatgtttctgcagtaactcatttca

SEQ ID NO: 423407 - DNA, 25 bp, Homo sapien
tgaaaactcgttttcttagactcgt

SEQ ID NO: 423408 - DNA, 25 bp, Homo sapien
gactcgtaacactattgtaaactgg

SEQ ID NO: 423409 - DNA, 25 bp, Homo sapien
tgtaaactgggagcacttctgtaat

SEQ ID NO: 423410 - DNA, 25 bp, Homo sapien
tcaaagttagcatgactcagctgtt

SEQ ID NO: 423411 - DNA, 25 bp, Homo sapien
ctcagctgtttcaaacttctacctt

SEQ ID NO: 423412 - DNA, 25 bp, Homo sapien
acttctacctttatgatactcttga

SEQ ID NO: 423413 - DNA, 25 bp, Homo sapien
acggtagaatacatttttccacatg

SEQ ID NO: 423414 - DNA, 25 bp, Homo sapien
atttttccacatgtcaaattagact

SEQ ID NO: 423415 - DNA, 25 bp, Homo sapien
tgcataattttcactttgactttga

SEQ ID NO: 423416 - DNA, 25 bp, Homo sapien
aggcggttcccttggtctggaatgc

SEQ ID NO: 423417 - DNA, 25 bp, Homo sapien
ttggtctggaatgccactctccact

SEQ ID NO: 423418 - DNA, 25 bp, Homo sapien
tctgcccagatgacgaacacctgtg

SEQ ID NO: 423419 - DNA, 25 bp, Homo sapien
agatgacgaacacctgtgcctcttt

SEQ ID NO: 423420 - DNA, 25 bp, Homo sapien
ttcaggacttggcttgggatctttc

SEQ ID NO: 423421 - DNA, 25 bp, Homo sapien
tggcttgggatctttcctcggaaga

SEQ ID NO: 423422 - DNA, 25 bp, Homo sapien
atctttcctcggaagattttccaga

SEQ ID NO: 423423 - DNA, 25 bp, Homo sapien
gaactgtcctgagatagtgtttcca

SEQ ID NO: 423424 - DNA, 25 bp, Homo sapien
agatagtgtttccatttctccccat

SEQ ID NO: 423425 - DNA, 25 bp, Homo sapien
ggaagatgcccctaaacacctggag

SEQ ID NO: 423426 - DNA, 25 bp, Homo sapien
ctggaggtgattcagcctcaccctc

SEQ ID NO: 423427 - DNA, 25 bp, Homo sapien
gtggtactgctctgcacttacgaca

SEQ ID NO: 423428 - DNA, 25 bp, Homo sapien
actgctctgcacttacgacactgta

SEQ ID NO: 423429 - DNA, 25 bp, Homo sapien
tttattctggtaccggataaggcca

SEQ ID NO: 423430 - DNA, 25 bp, Homo sapien
gccagattattcctttcagtttgtc

SEQ ID NO: 423431 - DNA, 25 bp, Homo sapien
agaaggtgcagattttactcaagga

SEQ ID NO: 423432 - DNA, 25 bp, Homo sapien
tactcaaggacggttttctgtgaaa

SEQ ID NO: 423433 - DNA, 25 bp, Homo sapien
tgtgaaacacattctgacccagaaa

SEQ ID NO: 423434 - DNA, 25 bp, Homo sapien
ccagaaagcctttcacttggtgatc

SEQ ID NO: 423435 - DNA, 25 bp, Homo sapien
acttggtgatctctccagtaaggac

SEQ ID NO: 423436 - DNA, 25 bp, Homo sapien
tgtgtgacaaagtaacccagagttc

SEQ ID NO: 423437 - DNA, 25 bp, Homo sapien
cagagttccccggaccagacggtgg

SEQ ID NO: 423438 - DNA, 25 bp, Homo sapien
gtaaccagagatgcctcaattcaat

SEQ ID NO: 423439 - DNA, 25 bp, Homo sapien
aaaacaggattctgaaaccattcag

SEQ ID NO: 423440 - DNA, 25 bp, Homo sapien
gaaaccattcagtgacttccctcca

SEQ ID NO: 423441 - DNA, 25 bp, Homo sapien
tccacgaacatcctcacacaaaagg

SEQ ID NO: 423442 - DNA, 25 bp, Homo sapien
tcctcacacaaaaggttgtctcctc

SEQ ID NO: 423443 - DNA, 25 bp, Homo sapien
tctcctctgggaggtgaacctggtg

SEQ ID NO: 423444 - DNA, 25 bp, Homo sapien
gtgaacctggtgaacactgcatttt

SEQ ID NO: 423445 - DNA, 25 bp, Homo sapien
gaacactgcattttaagtacttatg

SEQ ID NO: 423446 - DNA, 25 bp, Homo sapien
acttatgcaataagctgcgggcgct

SEQ ID NO: 423447 - DNA, 25 bp, Homo sapien
aagctgcgggcgcttctacctgttc

SEQ ID NO: 423448 - DNA, 25 bp, Homo sapien
cagagaagagccacaaggctgggca

SEQ ID NO: 423449 - DNA, 25 bp, Homo sapien
gtatcgtactttcctacatttgcat

SEQ ID NO: 423450 - DNA, 25 bp, Homo sapien
atttgcataatctccaccatcttga

SEQ ID NO: 423451 - DNA, 25 bp, Homo sapien
tccaccatcttgaggatccagtcct

SEQ ID NO: 423452 - DNA, 25 bp, Homo sapien
ttgaggatccagtcctcagagggaa

SEQ ID NO: 423453 - DNA, 25 bp, Homo sapien
gaaaagccttttctacatgtgcctc

SEQ ID NO: 423454 - DNA, 25 bp, Homo sapien
tctcttttatggcagcgccatcttt

SEQ ID NO: 423455 - DNA, 25 bp, Homo sapien
tttacatatgtacggcccatctcaa

SEQ ID NO: 423456 - DNA, 25 bp, Homo sapien
ggcccatctcaacttactcattaaa

SEQ ID NO: 423457 - DNA, 25 bp, Homo sapien
gataggttggtttcagtgttgtaca

SEQ ID NO: 423458 - DNA, 25 bp, Homo sapien
ttgtacagtgttgttacccccatgc

SEQ ID NO: 423459 - DNA, 25 bp, Homo sapien
tatagggagcaagtggcagccacca

SEQ ID NO: 423460 - DNA, 25 bp, Homo sapien
acccactaaatgagcaggttacaag

SEQ ID NO: 423461 - DNA, 25 bp, Homo sapien
aagacaaatgtcaccagcctcaagt

SEQ ID NO: 423462 - DNA, 25 bp, Homo sapien
acaaatgtcaccagcctcaagtatt

SEQ ID NO: 423463 - DNA, 25 bp, Homo sapien
cagcctcaagtattttatgaactat

SEQ ID NO: 423464 - DNA, 25 bp, Homo sapien
ttttatgaactatttactgagggta

SEQ ID NO: 423465 - DNA, 25 bp, Homo sapien
gtggtaaattatttcctgaatcctt

SEQ ID NO: 423466 - DNA, 25 bp, Homo sapien
ttatttcctgaatcctttatcacag

SEQ ID NO: 423467 - DNA, 25 bp, Homo sapien
tcacaggaaaaacacagaccctcat

SEQ ID NO: 423468 - DNA, 25 bp, Homo sapien
ataattaaaacggatgtgtctgaac

SEQ ID NO: 423469 - DNA, 25 bp, Homo sapien
cggatgtgtctgaacatttagtgaa

SEQ ID NO: 423470 - DNA, 25 bp, Homo sapien
gtgtatttgtgtattttgagggttt

SEQ ID NO: 423471 - DNA, 25 bp, Homo sapien
caggagaggcctttcccaccgggag

SEQ ID NO: 423472 - DNA, 25 bp, Homo sapien
ttcccaccgggagagaaacttccag

SEQ ID NO: 423473 - DNA, 25 bp, Homo sapien
cactacagccagaagaggcctttcc

SEQ ID NO: 423474 - DNA, 25 bp, Homo sapien
cagaagaggcctttcccaccgggag

SEQ ID NO: 423475 - DNA, 25 bp, Homo sapien
tcccaccgggagaggaacttccaga

SEQ ID NO: 423476 - DNA, 25 bp, Homo sapien
tcacaccacagccaggagaggcctt

SEQ ID NO: 423477 - DNA, 25 bp, Homo sapien
aggagaggcctttcccgcctggaga

SEQ ID NO: 423478 - DNA, 25 bp, Homo sapien
gagagaccttttctgcctggagaga

SEQ ID NO: 423479 - DNA, 25 bp, Homo sapien
ggagagaaactttcagaccagcccc

SEQ ID NO: 423480 - DNA, 25 bp, Homo sapien
accacagccaggagaggccgttcct

SEQ ID NO: 423481 - DNA, 25 bp, Homo sapien
agagaagcttccagaccagcccttc

SEQ ID NO: 423482 - DNA, 25 bp, Homo sapien
atgtctcatggactctggccccaca

SEQ ID NO: 423483 - DNA, 25 bp, Homo sapien
aggtggcctcacattctgctctgct

SEQ ID NO: 423484 - DNA, 25 bp, Homo sapien
gtggcctcacattctgctctgctaa

SEQ ID NO: 423485 - DNA, 25 bp, Homo sapien
tggcctcacattctgctctgctaag

SEQ ID NO: 423486 - DNA, 25 bp, Homo sapien
ggcctcacattctgctctgctaagt

SEQ ID NO: 423487 - DNA, 25 bp, Homo sapien
gcctcacattctgctctgctaagtt

SEQ ID NO: 423488 - DNA, 25 bp, Homo sapien
ctcacattctgctctgctaagtttg

SEQ ID NO: 423489 - DNA, 25 bp, Homo sapien
tcacattctgctctgctaagtttgg

SEQ ID NO: 423490 - DNA, 25 bp, Homo sapien
cacattctgctctgctaagtttgga

SEQ ID NO: 423491 - DNA, 25 bp, Homo sapien
acattctgctctgctaagtttggag

SEQ ID NO: 423492 - DNA, 25 bp, Homo sapien
cattctgctctgctaagtttggaga

SEQ ID NO: 423493 - DNA, 25 bp, Homo sapien
tctgtgacttggagatgtcccttca

SEQ ID NO: 423494 - DNA, 25 bp, Homo sapien
gtctgctttatgaaactatgcacat

SEQ ID NO: 423495 - DNA, 25 bp, Homo sapien
gggttgggtaggagcttccaggcct

SEQ ID NO: 423496 - DNA, 25 bp, Homo sapien
ttccaggcctgggatttacaccacg

SEQ ID NO: 423497 - DNA, 25 bp, Homo sapien
gggatttacaccacgcctagcccag

SEQ ID NO: 423498 - DNA, 25 bp, Homo sapien
tgggagtgacatttgcttgaggctt

SEQ ID NO: 423499 - DNA, 25 bp, Homo sapien
ttgcttgaggcttatacactggtgt

SEQ ID NO: 423500 - DNA, 25 bp, Homo sapien
acactggtgtggttgcctggcttgc

SEQ ID NO: 423501 - DNA, 25 bp, Homo sapien
ttgcaggaaatgaccaagctcacac

SEQ ID NO: 423502 - DNA, 25 bp, Homo sapien
caagctcacacatgctggctgaagc

SEQ ID NO: 423503 - DNA, 25 bp, Homo sapien
ctggctgaagcgtaagcagacaact

SEQ ID NO: 423504 - DNA, 25 bp, Homo sapien
tgcagtttacacacattgcctaaag

SEQ ID NO: 423505 - DNA, 25 bp, Homo sapien
gcaccggatacaggccacgataaac

SEQ ID NO: 423506 - DNA, 25 bp, Homo sapien
ataaacatcctttcgtgtgttccct

SEQ ID NO: 423507 - DNA, 25 bp, Homo sapien
ttcgtgtgttcccttctgtgcttgt

SEQ ID NO: 423508 - DNA, 25 bp, Homo sapien
gcatgtgtacccaggatgggcctat

SEQ ID NO: 423509 - DNA, 25 bp, Homo sapien
atgggcctataggtcacagaggtca

SEQ ID NO: 423510 - DNA, 25 bp, Homo sapien
acagaggtcagtttctctttggttt

SEQ ID NO: 423511 - DNA, 25 bp, Homo sapien
tttagaacggtgactgaccctccta

SEQ ID NO: 423512 - DNA, 25 bp, Homo sapien
acttgtattgccagactacctaatt

SEQ ID NO: 423513 - DNA, 25 bp, Homo sapien
gccagactacctaatttttgccagt

SEQ ID NO: 423514 - DNA, 25 bp, Homo sapien
ttgccagtctcatgggtagatagtg

SEQ ID NO: 423515 - DNA, 25 bp, Homo sapien
gacagaaacagacccctccaaggag

SEQ ID NO: 423516 - DNA, 25 bp, Homo sapien
caaggagacccctcctggcctgatg

SEQ ID NO: 423517 - DNA, 25 bp, Homo sapien
aacctagaccctctcctgaagggag

SEQ ID NO: 423518 - DNA, 25 bp, Homo sapien
gaccctctcctgaagggagacatga

SEQ ID NO: 423519 - DNA, 25 bp, Homo sapien
gaaacatatttatcagaaactggaa

SEQ ID NO: 423520 - DNA, 25 bp, Homo sapien
aagcccaggaagcttttgtgaattc

SEQ ID NO: 423521 - DNA, 25 bp, Homo sapien
ttttgtgaattcctagcatctctac

SEQ ID NO: 423522 - DNA, 25 bp, Homo sapien
gaattcctagcatctctacaccaca

SEQ ID NO: 423523 - DNA, 25 bp, Homo sapien
tacaccacactgattagtgacagtt

SEQ ID NO: 423524 - DNA, 25 bp, Homo sapien
ttattcctgcagtacacctgtctat

SEQ ID NO: 423525 - DNA, 25 bp, Homo sapien
gcagtacacctgtctataacagtga

SEQ ID NO: 423526 - DNA, 25 bp, Homo sapien
agtgtggtgatgtcacgtagccatc

SEQ ID NO: 423527 - DNA, 25 bp, Homo sapien
gtagccatcagtcactcttacaaaa

SEQ ID NO: 423528 - DNA, 25 bp, Homo sapien
tgacagtacactgtcccctaagtgt

SEQ ID NO: 423529 - DNA, 25 bp, Homo sapien
taagtgtccctactggacgcatcac

SEQ ID NO: 423530 - DNA, 25 bp, Homo sapien
tactggacgcatcacactgcaaaac

SEQ ID NO: 423531 - DNA, 25 bp, Homo sapien
aaacaaacattctgtgcaactggca

SEQ ID NO: 423532 - DNA, 25 bp, Homo sapien
tggcaggagccaggtaccattctag

SEQ ID NO: 423533 - DNA, 25 bp, Homo sapien
ttccttattatctcatctattccca

SEQ ID NO: 423534 - DNA, 25 bp, Homo sapien
atagcgactgtctgttttacaaatg

SEQ ID NO: 423535 - DNA, 25 bp, Homo sapien
gaggcaaatttatccaaggtcacac

SEQ ID NO: 423536 - DNA, 25 bp, Homo sapien
gtaagcacatgacgcacagctctga

SEQ ID NO: 423537 - DNA, 25 bp, Homo sapien
cctcaaggagctgctagttaggtca

SEQ ID NO: 423538 - DNA, 25 bp, Homo sapien
taggtcagggagacaggccagtctt

SEQ ID NO: 423539 - DNA, 25 bp, Homo sapien
aggccagtcttacattcctgtcatt

SEQ ID NO: 423540 - DNA, 25 bp, Homo sapien
gtcattcaggtctccactcaaaagt

SEQ ID NO: 423541 - DNA, 25 bp, Homo sapien
actcaaaagtcacctcctccgggag

SEQ ID NO: 423542 - DNA, 25 bp, Homo sapien
gggaggccttcctgaattgcccagg

SEQ ID NO: 423543 - DNA, 25 bp, Homo sapien
ttgcccaggctataggagtccactt

SEQ ID NO: 423544 - DNA, 25 bp, Homo sapien
aggagtccacttttggtcatccagt

SEQ ID NO: 423545 - DNA, 25 bp, Homo sapien
acttttggtcatccagtcccgatgc

SEQ ID NO: 423546 - DNA, 25 bp, Homo sapien
cagtcccgatgctctgttttttgtt

SEQ ID NO: 423547 - DNA, 25 bp, Homo sapien
aatagcacctattatacctgaaatt

SEQ ID NO: 423548 - DNA, 25 bp, Homo sapien
tccagagtgctctaaaacatagtgt

SEQ ID NO: 423549 - DNA, 25 bp, Homo sapien
aacatagtgtgatgtgccctttcat

SEQ ID NO: 423550 - DNA, 25 bp, Homo sapien
ttttggctgggcagacctctctaag

SEQ ID NO: 423551 - DNA, 25 bp, Homo sapien
tgggcagacctctctaagatagatt

SEQ ID NO: 423552 - DNA, 25 bp, Homo sapien
gatagattataaggagctggctttt

SEQ ID NO: 423553 - DNA, 25 bp, Homo sapien
aggcaatgaaaactgcttctgtatt

SEQ ID NO: 423554 - DNA, 25 bp, Homo sapien
ctgcttctgtattcacatttacccc

SEQ ID NO: 423555 - DNA, 25 bp, Homo sapien
cctccctccattatctgaggtatgt

SEQ ID NO: 423556 - DNA, 25 bp, Homo sapien
tcttgttcctgttaccatgtaatat

SEQ ID NO: 423557 - DNA, 25 bp, Homo sapien
taccatgtaatatatcttcaagtgc

SEQ ID NO: 423558 - DNA, 25 bp, Homo sapien
caagtgctgagaaaacatcttacaa

SEQ ID NO: 423559 - DNA, 25 bp, Homo sapien
gtctccatctcttgattctgaattc

SEQ ID NO: 423560 - DNA, 25 bp, Homo sapien
catctcttgattctgaattcagcca

SEQ ID NO: 423561 - DNA, 25 bp, Homo sapien
gaattcagccataatacttgctctc

SEQ ID NO: 423562 - DNA, 25 bp, Homo sapien
attcagccataatacttgctctccc

SEQ ID NO: 423563 - DNA, 25 bp, Homo sapien
ataatacttgctctccccaatgttg

SEQ ID NO: 423564 - DNA, 25 bp, Homo sapien
aatacttgctctccccaatgttgtt

SEQ ID NO: 423565 - DNA, 25 bp, Homo sapien
acttgctctccccaatgttgtttta

SEQ ID NO: 423566 - DNA, 25 bp, Homo sapien
gctctccccaatgttgttttagcag

SEQ ID NO: 423567 - DNA, 25 bp, Homo sapien
ctccccaatgttgttttagcagatt

SEQ ID NO: 423568 - DNA, 25 bp, Homo sapien
cccaatgttgttttagcagatttga

SEQ ID NO: 423569 - DNA, 25 bp, Homo sapien
gttgttttagcagatttgacacata

SEQ ID NO: 423570 - DNA, 25 bp, Homo sapien
taaagcagtcaggaatccacatggt

SEQ ID NO: 423571 - DNA, 25 bp, Homo sapien
aagcagtcaggaatccacatggtgt

SEQ ID NO: 423572 - DNA, 25 bp, Homo sapien
agcagtcaggaatccacatggtgta

SEQ ID NO: 423573 - DNA, 25 bp, Homo sapien
gcagtcaggaatccacatggtgtaa

SEQ ID NO: 423574 - DNA, 25 bp, Homo sapien
cagtcaggaatccacatggtgtaat

SEQ ID NO: 423575 - DNA, 25 bp, Homo sapien
gtcaggaatccacatggtgtaataa

SEQ ID NO: 423576 - DNA, 25 bp, Homo sapien
tcaggaatccacatggtgtaataaa

SEQ ID NO: 423577 - DNA, 25 bp, Homo sapien
gaatccacatggtgtaataaagaga

SEQ ID NO: 423578 - DNA, 25 bp, Homo sapien
tccacatggtgtaataaagagactg

SEQ ID NO: 423579 - DNA, 25 bp, Homo sapien
catggtgtaataaagagactgggct

SEQ ID NO: 423580 - DNA, 25 bp, Homo sapien
gagactgggctttagccgggcatgg

SEQ ID NO: 423581 - DNA, 25 bp, Homo sapien
ggttgtgcccacagagtctcatcaa

SEQ ID NO: 423582 - DNA, 25 bp, Homo sapien
gtctcatcaacaaatcactgggtat

SEQ ID NO: 423583 - DNA, 25 bp, Homo sapien
aaatcactgggtatgtgcacaaaca

SEQ ID NO: 423584 - DNA, 25 bp, Homo sapien
gtgcacaaacactaactgtccagag

SEQ ID NO: 423585 - DNA, 25 bp, Homo sapien
agtgaattgtcttgcatctctccta

SEQ ID NO: 423586 - DNA, 25 bp, Homo sapien
atctctcctacctactacagtgtct

SEQ ID NO: 423587 - DNA, 25 bp, Homo sapien
agtgtctctgtaatccaagggctct

SEQ ID NO: 423588 - DNA, 25 bp, Homo sapien
gctcttcttacaaccacctttataa

SEQ ID NO: 423589 - DNA, 25 bp, Homo sapien
tttataagtcatcctggcctcatca

SEQ ID NO: 423590 - DNA, 25 bp, Homo sapien
gcctcatcagcctgactaagtgcta

SEQ ID NO: 423591 - DNA, 25 bp, Homo sapien
gtttcaaaggcccatgaccatcata

SEQ ID NO: 423592 - DNA, 25 bp, Homo sapien
aagcaaacaactcacttgtcaaatt

SEQ ID NO: 423593 - DNA, 25 bp, Homo sapien
aactcacttgtcaaatttcaaatgg

SEQ ID NO: 423594 - DNA, 25 bp, Homo sapien
gaaactgtgattttcaacttatgaa

SEQ ID NO: 423595 - DNA, 25 bp, Homo sapien
aatgctataatgtcccagcgcggga

SEQ ID NO: 423596 - DNA, 25 bp, Homo sapien
ctataatgtcccagcgcgggaagct

SEQ ID NO: 423597 - DNA, 25 bp, Homo sapien
cgcgggaagctcacgctgtgtgaac

SEQ ID NO: 423598 - DNA, 25 bp, Homo sapien
tcacgctgtgtgaacatgaagttgt

SEQ ID NO: 423599 - DNA, 25 bp, Homo sapien
caaccaacctacacacaaatgtttt

SEQ ID NO: 423600 - DNA, 25 bp, Homo sapien
aatgttttcataggcactgtataaa

SEQ ID NO: 423601 - DNA, 25 bp, Homo sapien
ggaaacgtcactgagatgaagaggc

SEQ ID NO: 423602 - DNA, 25 bp, Homo sapien
cactgagatgaagaggcgggtaaat

SEQ ID NO: 423603 - DNA, 25 bp, Homo sapien
ggtatatttcagagtttttctttcg

SEQ ID NO: 423604 - DNA, 25 bp, Homo sapien
gagtttttctttcgaatgtaacatg

SEQ ID NO: 423605 - DNA, 25 bp, Homo sapien
gtcattttgaaaacaagcagggtat

SEQ ID NO: 423606 - DNA, 25 bp, Homo sapien
agggtcaagttgttgcttggttaca

SEQ ID NO: 423607 - DNA, 25 bp, Homo sapien
tgatgagggatatgtacacctgtgg

SEQ ID NO: 423608 - DNA, 25 bp, Homo sapien
tgctctgtaaagtactgtgcaaaag

SEQ ID NO: 423609 - DNA, 25 bp, Homo sapien
agagtagttgtggtgctgtctttct

SEQ ID NO: 423610 - DNA, 25 bp, Homo sapien
tgtggtgctgtctttcttcgtctac

SEQ ID NO: 423611 - DNA, 25 bp, Homo sapien
ttcgtctactccatgggcttgagat

SEQ ID NO: 423612 - DNA, 25 bp, Homo sapien
tactccatgggcttgagatttttgt

SEQ ID NO: 423613 - DNA, 25 bp, Homo sapien
gacagtcaaggttcacagctgctgc

SEQ ID NO: 423614 - DNA, 25 bp, Homo sapien
ggagccactttctaagagggtaaat

SEQ ID NO: 423615 - DNA, 25 bp, Homo sapien
gaggataagaagtctttaaccattt

SEQ ID NO: 423616 - DNA, 25 bp, Homo sapien
taaccatttctattgaggataggct

SEQ ID NO: 423617 - DNA, 25 bp, Homo sapien
attgaggataggctgctgtaattac

SEQ ID NO: 423618 - DNA, 25 bp, Homo sapien
aaggcagaagtagaacatttgttct

SEQ ID NO: 423619 - DNA, 25 bp, Homo sapien
agacaaagacagctcctagaattga

SEQ ID NO: 423620 - DNA, 25 bp, Homo sapien
gtaatgataaatcccattttcaggt

SEQ ID NO: 423621 - DNA, 25 bp, Homo sapien
attttcaggttaagactgcatctgg

SEQ ID NO: 423622 - DNA, 25 bp, Homo sapien
aagactgcatctggagtattgaaac

SEQ ID NO: 423623 - DNA, 25 bp, Homo sapien
gagtattgaaacttggagccacttt

SEQ ID NO: 423624 - DNA, 25 bp, Homo sapien
acttggagccactttctaagagggt

SEQ ID NO: 423625 - DNA, 25 bp, Homo sapien
ttgcatgattacagaataaccgttt

SEQ ID NO: 423626 - DNA, 25 bp, Homo sapien
cttaccaaatggatacttattctag

SEQ ID NO: 423627 - DNA, 25 bp, Homo sapien
tggatacttattctagtttttacat

SEQ ID NO: 423628 - DNA, 25 bp, Homo sapien
tttacattttccctatgcatatacg

SEQ ID NO: 423629 - DNA, 25 bp, Homo sapien
attttccctatgcatatacgtagag

SEQ ID NO: 423630 - DNA, 25 bp, Homo sapien
tgcatatacgtagaggaacacacat

SEQ ID NO: 423631 - DNA, 25 bp, Homo sapien
gaggaacacacatacatagttgagt

SEQ ID NO: 423632 - DNA, 25 bp, Homo sapien
cacatacatagttgagtttcttttt

SEQ ID NO: 423633 - DNA, 25 bp, Homo sapien
gggacatgttgttgtactatggata

SEQ ID NO: 423634 - DNA, 25 bp, Homo sapien
gtgactgaaaacatggcccccacca

SEQ ID NO: 423635 - DNA, 25 bp, Homo sapien
agagagaatcctaatcacacaaata

SEQ ID NO: 423636 - DNA, 25 bp, Homo sapien
gaatatgaaatatctcctctaaaaa

SEQ ID NO: 423637 - DNA, 25 bp, Homo sapien
tttaaagccccaatcagcaaagaat

SEQ ID NO: 423638 - DNA, 25 bp, Homo sapien
aagaataaatccttcgcagatctaa

SEQ ID NO: 423639 - DNA, 25 bp, Homo sapien
aatccttcgcagatctaattaccag

SEQ ID NO: 423640 - DNA, 25 bp, Homo sapien
tcgcagatctaattaccagcgctct

SEQ ID NO: 423641 - DNA, 25 bp, Homo sapien
gatctaattaccagcgctctcggaa

SEQ ID NO: 423642 - DNA, 25 bp, Homo sapien
taattaccagcgctctcggaagacc

SEQ ID NO: 423643 - DNA, 25 bp, Homo sapien
agcgctctcggaagacccaggccga

SEQ ID NO: 423644 - DNA, 25 bp, Homo sapien
accagccaatcttccccgtgtttga

SEQ ID NO: 423645 - DNA, 25 bp, Homo sapien
gtgtttgaacagcttgatgaactag

SEQ ID NO: 423646 - DNA, 25 bp, Homo sapien
ttaaattatcatcagtacaacacaa

SEQ ID NO: 423647 - DNA, 25 bp, Homo sapien
ctgcccagagtatgggcactcaggt

SEQ ID NO: 423648 - DNA, 25 bp, Homo sapien
gcactcaggtgtgggccgaacctga

SEQ ID NO: 423649 - DNA, 25 bp, Homo sapien
aggtgtgggccgaacctgatacctg

SEQ ID NO: 423650 - DNA, 25 bp, Homo sapien
gtgtgggccgaacctgatacctgcc

SEQ ID NO: 423651 - DNA, 25 bp, Homo sapien
ggccgaacctgatacctgcctggga

SEQ ID NO: 423652 - DNA, 25 bp, Homo sapien
gaacctgatacctgcctgggacagc

SEQ ID NO: 423653 - DNA, 25 bp, Homo sapien
gggacagccactggaaacttttggg

SEQ ID NO: 423654 - DNA, 25 bp, Homo sapien
ttggacctagaggattgtccacctt

SEQ ID NO: 423655 - DNA, 25 bp, Homo sapien
gacctagaggattgtccaccttctg

SEQ ID NO: 423656 - DNA, 25 bp, Homo sapien
cctagaggattgtccaccttctgcc

SEQ ID NO: 423657 - DNA, 25 bp, Homo sapien
tgcctggtcaataaaccactgttcc

SEQ ID NO: 423658 - DNA, 25 bp, Homo sapien
tacgtgaaggccatggtggtcgata

SEQ ID NO: 423659 - DNA, 25 bp, Homo sapien
atggtggtcgataaggactttccgg

SEQ ID NO: 423660 - DNA, 25 bp, Homo sapien
gtcgataaggactttccggaggaca

SEQ ID NO: 423661 - DNA, 25 bp, Homo sapien
cgataaggactttccggaggacagg

SEQ ID NO: 423662 - DNA, 25 bp, Homo sapien
aggcccaggaaggtgtccccagtga

SEQ ID NO: 423663 - DNA, 25 bp, Homo sapien
ggcccaggaaggtgtccccagtgaa

SEQ ID NO: 423664 - DNA, 25 bp, Homo sapien
gtgaaggtgacagccctgggcggtg

SEQ ID NO: 423665 - DNA, 25 bp, Homo sapien
ttggaagccacgttcaccttcatga

SEQ ID NO: 423666 - DNA, 25 bp, Homo sapien
aagccacgttcaccttcatgaggga

SEQ ID NO: 423667 - DNA, 25 bp, Homo sapien
cacgttcaccttcatgagggaggat

SEQ ID NO: 423668 - DNA, 25 bp, Homo sapien
gttcaccttcatgagggaggatcgg

SEQ ID NO: 423669 - DNA, 25 bp, Homo sapien
aaagtttacctacatgctgcacaga

SEQ ID NO: 423670 - DNA, 25 bp, Homo sapien
ggatttcaagccagcacgggctgct

SEQ ID NO: 423671 - DNA, 25 bp, Homo sapien
gatcaccagctaatgaggtaacgct

SEQ ID NO: 423672 - DNA, 25 bp, Homo sapien
ggtaacgctgtagcataccacatgc

SEQ ID NO: 423673 - DNA, 25 bp, Homo sapien
ataccacatgctttatgccaaaaat

SEQ ID NO: 423674 - DNA, 25 bp, Homo sapien
tttggcacaggaacggacgatcagt

SEQ ID NO: 423675 - DNA, 25 bp, Homo sapien
gacgatcagttgtggatgctgtatt

SEQ ID NO: 423676 - DNA, 25 bp, Homo sapien
gctgtattacaggaagacgccactt

SEQ ID NO: 423677 - DNA, 25 bp, Homo sapien
aggaagacgccacttagagccatcg

SEQ ID NO: 423678 - DNA, 25 bp, Homo sapien
tagagccatcgcagtcaatttgacc

SEQ ID NO: 423679 - DNA, 25 bp, Homo sapien
cagtcaatttgacctttgtgctggg

SEQ ID NO: 423680 - DNA, 25 bp, Homo sapien
actctattggctgaactattttgga

SEQ ID NO: 423681 - DNA, 25 bp, Homo sapien
attttggagtttgtaagctttgtat

SEQ ID NO: 423682 - DNA, 25 bp, Homo sapien
gtaagctttgtattagatattcctg

SEQ ID NO: 423683 - DNA, 25 bp, Homo sapien
gatattcctgatttaactgaaacta

SEQ ID NO: 423684 - DNA, 25 bp, Homo sapien
tcatcccagttttacttgttttact

SEQ ID NO: 423685 - DNA, 25 bp, Homo sapien
tttactgtcctcaaaaactcaagac

SEQ ID NO: 423686 - DNA, 25 bp, Homo sapien
aactcaagacatctgaactcaaagg

SEQ ID NO: 423687 - DNA, 25 bp, Homo sapien
gaactcaaaggatctaagcagtata

SEQ ID NO: 423688 - DNA, 25 bp, Homo sapien
gaatcactgtagctttcgtaggaca

SEQ ID NO: 423689 - DNA, 25 bp, Homo sapien
gtagctttcgtaggacatctgatta

SEQ ID NO: 423690 - DNA, 25 bp, Homo sapien
tgaaagcttaaatccagcatttggg

SEQ ID NO: 423691 - DNA, 25 bp, Homo sapien
tgctatattccaatcagaacagaag

SEQ ID NO: 423692 - DNA, 25 bp, Homo sapien
gaacagaagcttcagggctcatagt

SEQ ID NO: 423693 - DNA, 25 bp, Homo sapien
tgagaaaactcacgtttttctacct

SEQ ID NO: 423694 - DNA, 25 bp, Homo sapien
tttttctacctctaacttcatatag

SEQ ID NO: 423695 - DNA, 25 bp, Homo sapien
agcaccaccaaactgcacatatttg

SEQ ID NO: 423696 - DNA, 25 bp, Homo sapien
agcttcagacttttcccatgaggac

SEQ ID NO: 423697 - DNA, 25 bp, Homo sapien
taaactgctgtgtggatactgtgag

SEQ ID NO: 423698 - DNA, 25 bp, Homo sapien
gagtgttcagctttatcgatgacct

SEQ ID NO: 423699 - DNA, 25 bp, Homo sapien
ttatcgatgacctagccttggacca

SEQ ID NO: 423700 - DNA, 25 bp, Homo sapien
gacctagccttggaccagatagctg

SEQ ID NO: 423701 - DNA, 25 bp, Homo sapien
aatgttcaggatgtgtactcaagct

SEQ ID NO: 423702 - DNA, 25 bp, Homo sapien
ttttcactccactggaaagagttca

SEQ ID NO: 423703 - DNA, 25 bp, Homo sapien
tcagacattgcttcaagaccacaag

SEQ ID NO: 423704 - DNA, 25 bp, Homo sapien
tttaccaacacttaccaggctttca

SEQ ID NO: 423705 - DNA, 25 bp, Homo sapien
acttaccaggctttcaaggcactga

SEQ ID NO: 423706 - DNA, 25 bp, Homo sapien
agagtattatcgaggcttggtgccc

SEQ ID NO: 423707 - DNA, 25 bp, Homo sapien
aggcttggtgcccattcttttccgg

SEQ ID NO: 423708 - DNA, 25 bp, Homo sapien
agcaatgtcttgtttttcggccttc

SEQ ID NO: 423709 - DNA, 25 bp, Homo sapien
tcggccttcgaggtcccattaagga

SEQ ID NO: 423710 - DNA, 25 bp, Homo sapien
attaaggagcatctgcctaccgcaa

SEQ ID NO: 423711 - DNA, 25 bp, Homo sapien
gcaacgactcacagtgctcatctgg

SEQ ID NO: 423712 - DNA, 25 bp, Homo sapien
agtgctcatctggtcaatgatttta

SEQ ID NO: 423713 - DNA, 25 bp, Homo sapien
ttgacccgctgctgcaaaaacattc

SEQ ID NO: 423714 - DNA, 25 bp, Homo sapien
tgctgcaaaaacattccctccaatg

SEQ ID NO: 423715 - DNA, 25 bp, Homo sapien
atgccacctccgtgactctgggctg

SEQ ID NO: 423716 - DNA, 25 bp, Homo sapien
ttcccggagccggtgatggtgacct

SEQ ID NO: 423717 - DNA, 25 bp, Homo sapien
atggtgacctgggacacaggctccc

SEQ ID NO: 423718 - DNA, 25 bp, Homo sapien
acaggctccctcaacgggacaacta

SEQ ID NO: 423719 - DNA, 25 bp, Homo sapien
gggacaactatgaccttaccagcca

SEQ ID NO: 423720 - DNA, 25 bp, Homo sapien
atcagcttgctgaccgtctcgggtg

SEQ ID NO: 423721 - DNA, 25 bp, Homo sapien
gcgtgggccaagcagatgttcacct

SEQ ID NO: 423722 - DNA, 25 bp, Homo sapien
atcgtccacagactgggtcgacaac

SEQ ID NO: 423723 - DNA, 25 bp, Homo sapien
gactgggtcgacaacaaaaccttca

SEQ ID NO: 423724 - DNA, 25 bp, Homo sapien
gttgagctatcttatttcatactgt

SEQ ID NO: 423725 - DNA, 25 bp, Homo sapien
ttaatatgttaggacagttctctcc

SEQ ID NO: 423726 - DNA, 25 bp, Homo sapien
ggacagttctctccttacgactttc

SEQ ID NO: 423727 - DNA, 25 bp, Homo sapien
tctccttacgactttcttttgcaaa

SEQ ID NO: 423728 - DNA, 25 bp, Homo sapien
gcaaaaattttctagctacactcat

SEQ ID NO: 423729 - DNA, 25 bp, Homo sapien
attttctagctacactcatttggat

SEQ ID NO: 423730 - DNA, 25 bp, Homo sapien
tcttcatgatgaactctgagataat

SEQ ID NO: 423731 - DNA, 25 bp, Homo sapien
tttaacacattccaaaagacatatt

SEQ ID NO: 423732 - DNA, 25 bp, Homo sapien
acagaatctaatcttttcatctatg

SEQ ID NO: 423733 - DNA, 25 bp, Homo sapien
aatcttttcatctatgtatctctat

SEQ ID NO: 423734 - DNA, 25 bp, Homo sapien
gtatctctattgaagcatttgttta

SEQ ID NO: 423735 - DNA, 25 bp, Homo sapien
ggaattataaatatgaccagctctc

SEQ ID NO: 423736 - DNA, 25 bp, Homo sapien
ttataaatatgaccagctctctgtg

SEQ ID NO: 423737 - DNA, 25 bp, Homo sapien
aaatatgaccagctctctgtgaacg

SEQ ID NO: 423738 - DNA, 25 bp, Homo sapien
atatgaccagctctctgtgaacgtg

SEQ ID NO: 423739 - DNA, 25 bp, Homo sapien
atgaccagctctctgtgaacgtgac

SEQ ID NO: 423740 - DNA, 25 bp, Homo sapien
gaccagctctctgtgaacgtgacag

SEQ ID NO: 423741 - DNA, 25 bp, Homo sapien
gggtaacctgactgagtcctgggca

SEQ ID NO: 423742 - DNA, 25 bp, Homo sapien
acctgactgagtcctgggcagatga

SEQ ID NO: 423743 - DNA, 25 bp, Homo sapien
tgagtcctgggcagatgataacccc

SEQ ID NO: 423744 - DNA, 25 bp, Homo sapien
agtatgcacccctcagctttcataa

SEQ ID NO: 423745 - DNA, 25 bp, Homo sapien
atgcacccctcagctttcataaggg

SEQ ID NO: 423746 - DNA, 25 bp, Homo sapien
acagatacaacagggtggccttgtt

SEQ ID NO: 423747 - DNA, 25 bp, Homo sapien
cggtattatacctgcatgtgctcta

SEQ ID NO: 423748 - DNA, 25 bp, Homo sapien
tgtgctctagcaaggataccaaggc

SEQ ID NO: 423749 - DNA, 25 bp, Homo sapien
aaggcaagcatacatgtagctggct

SEQ ID NO: 423750 - DNA, 25 bp, Homo sapien
gtagctggcttgagtttgtaccaaa

SEQ ID NO: 423751 - DNA, 25 bp, Homo sapien
ccaaaacagtccttcaactttgcac

SEQ ID NO: 423752 - DNA, 25 bp, Homo sapien
tgcactgtgccttaagtaattacta

SEQ ID NO: 423753 - DNA, 25 bp, Homo sapien
ttagctgcaatctctactttcgatg

SEQ ID NO: 423754 - DNA, 25 bp, Homo sapien
ggaaatcccagtaagctttctgatt

SEQ ID NO: 423755 - DNA, 25 bp, Homo sapien
tctgattcaagtacaatgctgccat

SEQ ID NO: 423756 - DNA, 25 bp, Homo sapien
gggccacaactatagaattaccact

SEQ ID NO: 423757 - DNA, 25 bp, Homo sapien
agtgaagggaagtctcccacagtct

SEQ ID NO: 423758 - DNA, 25 bp, Homo sapien
tctcccacagtctcatattacttga

SEQ ID NO: 423759 - DNA, 25 bp, Homo sapien
tgaaagattggaactacgcggaact

SEQ ID NO: 423760 - DNA, 25 bp, Homo sapien
caaatggtggataggaagcaggact

SEQ ID NO: 423761 - DNA, 25 bp, Homo sapien
tcccactcagacagagagtagcttg

SEQ ID NO: 423762 - DNA, 25 bp, Homo sapien
gagagtagcttgtggagactcacat

SEQ ID NO: 423763 - DNA, 25 bp, Homo sapien
gaactacgcggaactccaaattcat

SEQ ID NO: 423764 - DNA, 25 bp, Homo sapien
ggagactcacattgtgaacttttgc

SEQ ID NO: 423765 - DNA, 25 bp, Homo sapien
caaattcatagttggttctcaccat

SEQ ID NO: 423766 - DNA, 25 bp, Homo sapien
ggttctcaccattaaacatttgctg

SEQ ID NO: 423767 - DNA, 25 bp, Homo sapien
ggaattctaataggcatagctggca

SEQ ID NO: 423768 - DNA, 25 bp, Homo sapien
tcctccgtgtctgacgcgggcccag

SEQ ID NO: 423769 - DNA, 25 bp, Homo sapien
gccagcaggttcactcagtgttcgc

SEQ ID NO: 423770 - DNA, 25 bp, Homo sapien
agcaggttcactcagtgttcgcctt

SEQ ID NO: 423771 - DNA, 25 bp, Homo sapien
ggttcactcagtgttcgccttcggg

SEQ ID NO: 423772 - DNA, 25 bp, Homo sapien
tgggccctgggctctcatctagtgg

SEQ ID NO: 423773 - DNA, 25 bp, Homo sapien
ggccctgggctctcatctagtggag

SEQ ID NO: 423774 - DNA, 25 bp, Homo sapien
cctgggctctcatctagtggaggtg

SEQ ID NO: 423775 - DNA, 25 bp, Homo sapien
ggctctcatctagtggaggtggctc

SEQ ID NO: 423776 - DNA, 25 bp, Homo sapien
tctcatctagtggaggtggctccgg

SEQ ID NO: 423777 - DNA, 25 bp, Homo sapien
atctagtggaggtggctccgggctg

SEQ ID NO: 423778 - DNA, 25 bp, Homo sapien
aaaggactggctgcgaggagtcccc

SEQ ID NO: 423779 - DNA, 25 bp, Homo sapien
taattttctgttcagcaaattctat

SEQ ID NO: 423780 - DNA, 25 bp, Homo sapien
tttctgttcagcaaattctattata

SEQ ID NO: 423781 - DNA, 25 bp, Homo sapien
gtctttgtgtaactgtagcctttac

SEQ ID NO: 423782 - DNA, 25 bp, Homo sapien
tctttgtgtaactgtagcctttaca

SEQ ID NO: 423783 - DNA, 25 bp, Homo sapien
cagtaaaatttgagcctatcatgag

SEQ ID NO: 423784 - DNA, 25 bp, Homo sapien
aatttgagcctatcatgaggtgtac

SEQ ID NO: 423785 - DNA, 25 bp, Homo sapien
tttgagcctatcatgaggtgtacat

SEQ ID NO: 423786 - DNA, 25 bp, Homo sapien
tgagcctatcatgaggtgtacattt

SEQ ID NO: 423787 - DNA, 25 bp, Homo sapien
aaaaggacctaacaaatgatgctct

SEQ ID NO: 423788 - DNA, 25 bp, Homo sapien
aaggacctaacaaatgatgctcttc

SEQ ID NO: 423789 - DNA, 25 bp, Homo sapien
ggaagagtgaaggcctactggcaat

SEQ ID NO: 423790 - DNA, 25 bp, Homo sapien
ctccctatcatgtaccgtgaaaacc

SEQ ID NO: 423791 - DNA, 25 bp, Homo sapien
gggtttctatctttcttccaccaga

SEQ ID NO: 423792 - DNA, 25 bp, Homo sapien
tctcctccaagactgtgttgtcttt

SEQ ID NO: 423793 - DNA, 25 bp, Homo sapien
tgttgtcttttctcaccaagagtat

SEQ ID NO: 423794 - DNA, 25 bp, Homo sapien
ttaacactactaagtctttcacctt

SEQ ID NO: 423795 - DNA, 25 bp, Homo sapien
gtctttcaccttaacttatgactca

SEQ ID NO: 423796 - DNA, 25 bp, Homo sapien
tcaggatttattcacgtcctgccca

SEQ ID NO: 423797 - DNA, 25 bp, Homo sapien
gcccactctaggctcacaggaataa

SEQ ID NO: 423798 - DNA, 25 bp, Homo sapien
atcaagtgctagacacactggctgc

SEQ ID NO: 423799 - DNA, 25 bp, Homo sapien
gacacactggctgctactaaggcac

SEQ ID NO: 423800 - DNA, 25 bp, Homo sapien
tgctactaaggcactagcctctgta

SEQ ID NO: 423801 - DNA, 25 bp, Homo sapien
gaagaggactccagtgtattaaaca

SEQ ID NO: 423802 - DNA, 25 bp, Homo sapien
taaacaaataggttgctgagatgca

SEQ ID NO: 423803 - DNA, 25 bp, Homo sapien
ctcagaatatcgaggctggccatct

SEQ ID NO: 423804 - DNA, 25 bp, Homo sapien
atcgaggctggccatctgtaaacac

SEQ ID NO: 423805 - DNA, 25 bp, Homo sapien
aaacacagcctgtctctaggagaac

SEQ ID NO: 423806 - DNA, 25 bp, Homo sapien
ggagaacagaggtggaatcctcctt

SEQ ID NO: 423807 - DNA, 25 bp, Homo sapien
gaggtggaatcctccttgcaagttt

SEQ ID NO: 423808 - DNA, 25 bp, Homo sapien
gagtaatctcagtggatgtcttaag

SEQ ID NO: 423809 - DNA, 25 bp, Homo sapien
ttagttgacatatctcatatctcag

SEQ ID NO: 423810 - DNA, 25 bp, Homo sapien
tgacatatctcatatctcagtgatg

SEQ ID NO: 423811 - DNA, 25 bp, Homo sapien
cagtgatggtaaataaaccttccct

SEQ ID NO: 423812 - DNA, 25 bp, Homo sapien
ggcagccctgggataaattctggac

SEQ ID NO: 423813 - DNA, 25 bp, Homo sapien
aatcatatacgatttccatgaaggg

SEQ ID NO: 423814 - DNA, 25 bp, Homo sapien
ggaccttaaacagaagtgtgccctt

SEQ ID NO: 423815 - DNA, 25 bp, Homo sapien
ctgaaatgtagatgcaactgctggc

SEQ ID NO: 423816 - DNA, 25 bp, Homo sapien
caactgctggcatttgagcagccat

SEQ ID NO: 423817 - DNA, 25 bp, Homo sapien
agcagccatcttgggccatgtggta

SEQ ID NO: 423818 - DNA, 25 bp, Homo sapien
tcttgggccatgtggtagcttctta

SEQ ID NO: 423819 - DNA, 25 bp, Homo sapien
tagcttcttatggatgatctaggac

SEQ ID NO: 423820 - DNA, 25 bp, Homo sapien
gatctaggactaattcaagggtcta

SEQ ID NO: 423821 - DNA, 25 bp, Homo sapien
tcaagggtctagatttacctccaaa

SEQ ID NO: 423822 - DNA, 25 bp, Homo sapien
tacctccaaactttgtttatctaca

SEQ ID NO: 423823 - DNA, 25 bp, Homo sapien
tgtgttggtggtgccagcactggca

SEQ ID NO: 423824 - DNA, 25 bp, Homo sapien
gggctggcggtggagccatacctgg

SEQ ID NO: 423825 - DNA, 25 bp, Homo sapien
cctgagccacaaggactggctgcat

SEQ ID NO: 423826 - DNA, 25 bp, Homo sapien
gactggctgcataagaagctgcccc

SEQ ID NO: 423827 - DNA, 25 bp, Homo sapien
tgcataagaagctgccccacaaggc

SEQ ID NO: 423828 - DNA, 25 bp, Homo sapien
accatctgggccaacgaggcattgg

SEQ ID NO: 423829 - DNA, 25 bp, Homo sapien
atctgggccaacgaggcattggtac

SEQ ID NO: 423830 - DNA, 25 bp, Homo sapien
aacgaggcattggtacccagaccgg

SEQ ID NO: 423831 - DNA, 25 bp, Homo sapien
cgaggcattggtacccagaccggcg

SEQ ID NO: 423832 - DNA, 25 bp, Homo sapien
ggcgccctgcagtgtcccagagact

SEQ ID NO: 423833 - DNA, 25 bp, Homo sapien
aactgaagatcagccatggagggtt

SEQ ID NO: 423834 - DNA, 25 bp, Homo sapien
aaatcatactttgtcttccatcatg

SEQ ID NO: 423835 - DNA, 25 bp, Homo sapien
cttccatcatgttgtctatcacagt

SEQ ID NO: 423836 - DNA, 25 bp, Homo sapien
tcatgttgtctatcacagtttgttt

SEQ ID NO: 423837 - DNA, 25 bp, Homo sapien
cacagtttgttttagttacagtcct

SEQ ID NO: 423838 - DNA, 25 bp, Homo sapien
gttttagttacagtcctgtttctct

SEQ ID NO: 423839 - DNA, 25 bp, Homo sapien
gtttctctgattgttaagctttcca

SEQ ID NO: 423840 - DNA, 25 bp, Homo sapien
gattgttaagctttccatctgattt

SEQ ID NO: 423841 - DNA, 25 bp, Homo sapien
agctttccatctgatttagaatctc

SEQ ID NO: 423842 - DNA, 25 bp, Homo sapien
tagaatctctaattcattaagcaga

SEQ ID NO: 423843 - DNA, 25 bp, Homo sapien
agagctgtaaatccatgctgtgaca

SEQ ID NO: 423844 - DNA, 25 bp, Homo sapien
catgctgtgacaatgatgggaaatt

SEQ ID NO: 423845 - DNA, 25 bp, Homo sapien
tttcatgggcttcgtctgccatctt

SEQ ID NO: 423846 - DNA, 25 bp, Homo sapien
ctgccatctttgtgggtgccctaga

SEQ ID NO: 423847 - DNA, 25 bp, Homo sapien
catctttgtgggtgccctagactta

SEQ ID NO: 423848 - DNA, 25 bp, Homo sapien
gtgggtgccctagacttagtcctta

SEQ ID NO: 423849 - DNA, 25 bp, Homo sapien
acttagtccttatcttgtcctggtt

SEQ ID NO: 423850 - DNA, 25 bp, Homo sapien
tccttatcttgtcctggtttccttt

SEQ ID NO: 423851 - DNA, 25 bp, Homo sapien
tgaccatctccccatgaaagtgctg

SEQ ID NO: 423852 - DNA, 25 bp, Homo sapien
aaagtgctgtacaaattccacccgc

SEQ ID NO: 423853 - DNA, 25 bp, Homo sapien
attggtggccactgtttgtatgttc

SEQ ID NO: 423854 - DNA, 25 bp, Homo sapien
gtggccactgtttgtatgttcttga

SEQ ID NO: 423855 - DNA, 25 bp, Homo sapien
actgtttgtatgttcttgagtgcaa

SEQ ID NO: 423856 - DNA, 25 bp, Homo sapien
aaagctgttcatctccaggagtctg

SEQ ID NO: 423857 - DNA, 25 bp, Homo sapien
gagtctgggatccaaattgcttcct

SEQ ID NO: 423858 - DNA, 25 bp, Homo sapien
aattgcttcctgtaaccaccaacag

SEQ ID NO: 423859 - DNA, 25 bp, Homo sapien
ccaccaacagctctaccagaaatga

SEQ ID NO: 423860 - DNA, 25 bp, Homo sapien
tgacctggaagccttttgattctct

SEQ ID NO: 423861 - DNA, 25 bp, Homo sapien
aagccttttgattctctgagtcctg

SEQ ID NO: 423862 - DNA, 25 bp, Homo sapien
tgtccacgccttctgcagatgttca

SEQ ID NO: 423863 - DNA, 25 bp, Homo sapien
gcttcccaggctattgacttccagt

SEQ ID NO: 423864 - DNA, 25 bp, Homo sapien
gacttccagtcatctagagtgtgta

SEQ ID NO: 423865 - DNA, 25 bp, Homo sapien
gagtgtgtatccctcggatccgtga

SEQ ID NO: 423866 - DNA, 25 bp, Homo sapien
tccaggcatctggagtgcgtattcc

SEQ ID NO: 423867 - DNA, 25 bp, Homo sapien
acagaaatggtgtcatgtgcatgta

SEQ ID NO: 423868 - DNA, 25 bp, Homo sapien
cagaaatggtgtcatgtgcatgtag

SEQ ID NO: 423869 - DNA, 25 bp, Homo sapien
aaatggtgtcatgtgcatgtagtac

SEQ ID NO: 423870 - DNA, 25 bp, Homo sapien
aatggtgtcatgtgcatgtagtact

SEQ ID NO: 423871 - DNA, 25 bp, Homo sapien
gtgcatgtagtacttgtattcccag

SEQ ID NO: 423872 - DNA, 25 bp, Homo sapien
tgcatgtagtacttgtattcccagc

SEQ ID NO: 423873 - DNA, 25 bp, Homo sapien
gcatgtagtacttgtattcccagct

SEQ ID NO: 423874 - DNA, 25 bp, Homo sapien
gtagtacttgtattcccagctacct

SEQ ID NO: 423875 - DNA, 25 bp, Homo sapien
agtacttgtattcccagctacctca

SEQ ID NO: 423876 - DNA, 25 bp, Homo sapien
acttgtattcccagctacctcagga

SEQ ID NO: 423877 - DNA, 25 bp, Homo sapien
atgatggtgccagtgtacttcagcc

SEQ ID NO: 423878 - DNA, 25 bp, Homo sapien
gaaacaagctggaatcgctccagga

SEQ ID NO: 423879 - DNA, 25 bp, Homo sapien
gctggaatcgctccaggaaaaactc

SEQ ID NO: 423880 - DNA, 25 bp, Homo sapien
gaaaaactctggttacacctggaag

SEQ ID NO: 423881 - DNA, 25 bp, Homo sapien
ttacacctggaagatggaagtcgca

SEQ ID NO: 423882 - DNA, 25 bp, Homo sapien
ggaagtcgcattgtagattcaagaa

SEQ ID NO: 423883 - DNA, 25 bp, Homo sapien
gttttcagtttctcacgggaaccat

SEQ ID NO: 423884 - DNA, 25 bp, Homo sapien
tcacgggaaccatgctgcttgggaa

SEQ ID NO: 423885 - DNA, 25 bp, Homo sapien
aaccatgctgcttgggaatgtgtgt

SEQ ID NO: 423886 - DNA, 25 bp, Homo sapien
gaatgtgtgtgatgccttctgtcaa

SEQ ID NO: 423887 - DNA, 25 bp, Homo sapien
gtgtgtgatgccttctgtcaataaa

SEQ ID NO: 423888 - DNA, 25 bp, Homo sapien
gtgatgccttctgtcaataaaaaca

SEQ ID NO: 423889 - DNA, 25 bp, Homo sapien
gggccatgggcttcagagaattagt

SEQ ID NO: 423890 - DNA, 25 bp, Homo sapien
catgggcttcagagaattagtggaa

SEQ ID NO: 423891 - DNA, 25 bp, Homo sapien
agtggaagactctaatgtgacccta

SEQ ID NO: 423892 - DNA, 25 bp, Homo sapien
ggaagactctaatgtgaccctaggt

SEQ ID NO: 423893 - DNA, 25 bp, Homo sapien
gctaaagttagataacatgtgtctc

SEQ ID NO: 423894 - DNA, 25 bp, Homo sapien
tgggagcacattcactgatcatttc

SEQ ID NO: 423895 - DNA, 25 bp, Homo sapien
gagcacattcactgatcatttcatc

SEQ ID NO: 423896 - DNA, 25 bp, Homo sapien
acattcactgatcatttcatcagcc

SEQ ID NO: 423897 - DNA, 25 bp, Homo sapien
ctcagggagggctggtcctgaccat

SEQ ID NO: 423898 - DNA, 25 bp, Homo sapien
cagcagaaccgagtagagtccggca

SEQ ID NO: 423899 - DNA, 25 bp, Homo sapien
agtagagtccggcaggacacacctt

SEQ ID NO: 423900 - DNA, 25 bp, Homo sapien
ctgcaggagctgcccgggacggacg

SEQ ID NO: 423901 - DNA, 25 bp, Homo sapien
tgcaggagctgcccgggacggacga

SEQ ID NO: 423902 - DNA, 25 bp, Homo sapien
ggagctgcccgggacggacgactac

SEQ ID NO: 423903 - DNA, 25 bp, Homo sapien
gagctgcccgggacggacgactacg

SEQ ID NO: 423904 - DNA, 25 bp, Homo sapien
agctgcccgggacggacgactacgt

SEQ ID NO: 423905 - DNA, 25 bp, Homo sapien
tgcccgggacggacgactacgtctt

SEQ ID NO: 423906 - DNA, 25 bp, Homo sapien
ggacggacgactacgtcttttactg

SEQ ID NO: 423907 - DNA, 25 bp, Homo sapien
gacggacgactacgtcttttactgc

SEQ ID NO: 423908 - DNA, 25 bp, Homo sapien
acggacgactacgtcttttactgca

SEQ ID NO: 423909 - DNA, 25 bp, Homo sapien
cggacgactacgtcttttactgcaa

SEQ ID NO: 423910 - DNA, 25 bp, Homo sapien
gtgggggcctgcgctacatgggaaa

SEQ ID NO: 423911 - DNA, 25 bp, Homo sapien
gccttcccttggagccttcgtaaat

SEQ ID NO: 423912 - DNA, 25 bp, Homo sapien
tcccttggagccttcgtaaattcat

SEQ ID NO: 423913 - DNA, 25 bp, Homo sapien
cttggagccttcgtaaattcattta

SEQ ID NO: 423914 - DNA, 25 bp, Homo sapien
gagccttcgtaaattcatttaatct

SEQ ID NO: 423915 - DNA, 25 bp, Homo sapien
tttaatctaaatgggtgaaggtgct

SEQ ID NO: 423916 - DNA, 25 bp, Homo sapien
tcctttagtccccagtaaagcttgt

SEQ ID NO: 423917 - DNA, 25 bp, Homo sapien
tttagtccccagtaaagcttgtttg

SEQ ID NO: 423918 - DNA, 25 bp, Homo sapien
tagtccccagtaaagcttgtttgtg

SEQ ID NO: 423919 - DNA, 25 bp, Homo sapien
gtccccagtaaagcttgtttgtgaa

SEQ ID NO: 423920 - DNA, 25 bp, Homo sapien
gtaaagcttgtttgtgaaggtctgg

SEQ ID NO: 423921 - DNA, 25 bp, Homo sapien
gttccttaagatccacaataaaact

SEQ ID NO: 423922 - DNA, 25 bp, Homo sapien
agctcagcggatcccccagagtgga

SEQ ID NO: 423923 - DNA, 25 bp, Homo sapien
tgacccaccggcagcgagtgcgcag

SEQ ID NO: 423924 - DNA, 25 bp, Homo sapien
cagcgagtgcgcaggtgtgagtgta

SEQ ID NO: 423925 - DNA, 25 bp, Homo sapien
ttcatgtaggagagtgtatgcgtgt

SEQ ID NO: 423926 - DNA, 25 bp, Homo sapien
cctgtgccctgcttgcaggcaagca

SEQ ID NO: 423927 - DNA, 25 bp, Homo sapien
acatcgctgctctttctcacagtct

SEQ ID NO: 423928 - DNA, 25 bp, Homo sapien
tcacagtctgcctctgatgagggcg

SEQ ID NO: 423929 - DNA, 25 bp, Homo sapien
agtctgcctctgatgagggcgaatt

SEQ ID NO: 423930 - DNA, 25 bp, Homo sapien
gagggcgaattgctatgacattcca

SEQ ID NO: 423931 - DNA, 25 bp, Homo sapien
tgctatgacattccaagctccaata

SEQ ID NO: 423932 - DNA, 25 bp, Homo sapien
aagctccaataaagactgtcccaga

SEQ ID NO: 423933 - DNA, 25 bp, Homo sapien
tgcggtgagccgagttcgtgccatg

SEQ ID NO: 423934 - DNA, 25 bp, Homo sapien
gcggtgagccgagttcgtgccatgg

SEQ ID NO: 423935 - DNA, 25 bp, Homo sapien
cggtgagccgagttcgtgccatggc

SEQ ID NO: 423936 - DNA, 25 bp, Homo sapien
ggtgagccgagttcgtgccatggca

SEQ ID NO: 423937 - DNA, 25 bp, Homo sapien
ataaaaaggatggatgtaggctggg

SEQ ID NO: 423938 - DNA, 25 bp, Homo sapien
taaaaaggatggatgtaggctgggc

SEQ ID NO: 423939 - DNA, 25 bp, Homo sapien
aaaaaggatggatgtaggctgggcg

SEQ ID NO: 423940 - DNA, 25 bp, Homo sapien
aaaaggatggatgtaggctgggcgc

SEQ ID NO: 423941 - DNA, 25 bp, Homo sapien
aaaggatggatgtaggctgggcgcg

SEQ ID NO: 423942 - DNA, 25 bp, Homo sapien
aaggatggatgtaggctgggcgcgg

SEQ ID NO: 423943 - DNA, 25 bp, Homo sapien
aggatggatgtaggctgggcgcggt

SEQ ID NO: 423944 - DNA, 25 bp, Homo sapien
acagtgttggtgtaaattctcctta

SEQ ID NO: 423945 - DNA, 25 bp, Homo sapien
tctccttagatggataggtaagccc

SEQ ID NO: 423946 - DNA, 25 bp, Homo sapien
attggcaccatatgaccgtatgcaa

SEQ ID NO: 423947 - DNA, 25 bp, Homo sapien
acattataggtctggtgagacccta

SEQ ID NO: 423948 - DNA, 25 bp, Homo sapien
gagaccctatttttttctgacagtg

SEQ ID NO: 423949 - DNA, 25 bp, Homo sapien
cagtgtcatctgtatttacgtgtct

SEQ ID NO: 423950 - DNA, 25 bp, Homo sapien
tttacgtgtctatttcgggaatttg

SEQ ID NO: 423951 - DNA, 25 bp, Homo sapien
aagtcaagggattctatgctggatt

SEQ ID NO: 423952 - DNA, 25 bp, Homo sapien
gctggattgtgaagcatctgtttct

SEQ ID NO: 423953 - DNA, 25 bp, Homo sapien
atctgtttctgcttgatgtagctac

SEQ ID NO: 423954 - DNA, 25 bp, Homo sapien
gtagctactcaattttgtattcttg

SEQ ID NO: 423955 - DNA, 25 bp, Homo sapien
tggtgatgcattacaacttgttttc

SEQ ID NO: 423956 - DNA, 25 bp, Homo sapien
ttatctggtagcaaactggttcttt

SEQ ID NO: 423957 - DNA, 25 bp, Homo sapien
aaactggttctttcggagccatcct

SEQ ID NO: 423958 - DNA, 25 bp, Homo sapien
catgcagctccaccaaaccttaggg

SEQ ID NO: 423959 - DNA, 25 bp, Homo sapien
gggacgtgaaatcactgcctgttgt

SEQ ID NO: 423960 - DNA, 25 bp, Homo sapien
gaaatcactgcctgttgtggtctcc

SEQ ID NO: 423961 - DNA, 25 bp, Homo sapien
ctgttgtggtctccgaggacacatg

SEQ ID NO: 423962 - DNA, 25 bp, Homo sapien
catggtaatggtgatgctgtgcctt

SEQ ID NO: 423963 - DNA, 25 bp, Homo sapien
gctgtgccttgttatctaagaacat

SEQ ID NO: 423964 - DNA, 25 bp, Homo sapien
aaatgtcaatattgtgccatttgtg

SEQ ID NO: 423965 - DNA, 25 bp, Homo sapien
tgtttcaaaaccttggtgatgcatt

SEQ ID NO: 423966 - DNA, 25 bp, Homo sapien
atctccatcatgaacatggcagccc

SEQ ID NO: 423967 - DNA, 25 bp, Homo sapien
accccatctttgctgggattcccat

SEQ ID NO: 423968 - DNA, 25 bp, Homo sapien
tgggattcccatcaactctcagaac

SEQ ID NO: 423969 - DNA, 25 bp, Homo sapien
ttcccatcaactctcagaactgtgt

SEQ ID NO: 423970 - DNA, 25 bp, Homo sapien
ccatcaactctcagaactgtgtggg

SEQ ID NO: 423971 - DNA, 25 bp, Homo sapien
aagccatgacttcacaaagacccta

SEQ ID NO: 423972 - DNA, 25 bp, Homo sapien
ttcacaaagaccctacctgtcagtt

SEQ ID NO: 423973 - DNA, 25 bp, Homo sapien
caaagaccctacctgtcagttcttg

SEQ ID NO: 423974 - DNA, 25 bp, Homo sapien
ggagggatcacctgcactgagaatg

SEQ ID NO: 423975 - DNA, 25 bp, Homo sapien
gggatcacctgcactgagaatgagg

SEQ ID NO: 423976 - DNA, 25 bp, Homo sapien
gagaatgaggcagtttgacacagat

SEQ ID NO: 423977 - DNA, 25 bp, Homo sapien
aaaatgggcttgacattaactctct

SEQ ID NO: 423978 - DNA, 25 bp, Homo sapien
aatgggcttgacattaactctctgc

SEQ ID NO: 423979 - DNA, 25 bp, Homo sapien
atgggcttgacattaactctctgcc

SEQ ID NO: 423980 - DNA, 25 bp, Homo sapien
ctccatctctcttcgtattacttat

SEQ ID NO: 423981 - DNA, 25 bp, Homo sapien
ccatctctcttcgtattacttatat

SEQ ID NO: 423982 - DNA, 25 bp, Homo sapien
gtattacttatatactcctcttctg

SEQ ID NO: 423983 - DNA, 25 bp, Homo sapien
attacttatatactcctcttctgat

SEQ ID NO: 423984 - DNA, 25 bp, Homo sapien
ttacttatatactcctcttctgatt

SEQ ID NO: 423985 - DNA, 25 bp, Homo sapien
acttatatactcctcttctgatttc

SEQ ID NO: 423986 - DNA, 25 bp, Homo sapien
cttatatactcctcttctgatttca

SEQ ID NO: 423987 - DNA, 25 bp, Homo sapien
tttcaggctaaatttatcgtgaaga

SEQ ID NO: 423988 - DNA, 25 bp, Homo sapien
caatagtttgaacctaaaccagtgg

SEQ ID NO: 423989 - DNA, 25 bp, Homo sapien
ctaaaccagtggttcccagatgcca

SEQ ID NO: 423990 - DNA, 25 bp, Homo sapien
gttcccagatgccagtctgtgagcc

SEQ ID NO: 423991 - DNA, 25 bp, Homo sapien
ttcccagatgccagtctgtgagcca

SEQ ID NO: 423992 - DNA, 25 bp, Homo sapien
gtctgtgagccagctccatcagaat

SEQ ID NO: 423993 - DNA, 25 bp, Homo sapien
tgtgagccagctccatcagaatcat

SEQ ID NO: 423994 - DNA, 25 bp, Homo sapien
gagccagctccatcagaatcatctt

SEQ ID NO: 423995 - DNA, 25 bp, Homo sapien
gccagctccatcagaatcatctttt

SEQ ID NO: 423996 - DNA, 25 bp, Homo sapien
agctccatcagaatcatcttttaaa

SEQ ID NO: 423997 - DNA, 25 bp, Homo sapien
aaaaatgcccatagtcgtgggaggc

SEQ ID NO: 423998 - DNA, 25 bp, Homo sapien
aaatgcccatagtcgtgggaggctg

SEQ ID NO: 423999 - DNA, 25 bp, Homo sapien
tggcaccagtgggaacggcacacat

SEQ ID NO: 424000 - DNA, 25 bp, Homo sapien
gtgggaacggcacacataccaccaa

SEQ ID NO: 424001 - DNA, 25 bp, Homo sapien
ataccaccaaccatgcacctagagt

SEQ ID NO: 424002 - DNA, 25 bp, Homo sapien
aaccatgcacctagagtcacctgca

SEQ ID NO: 424003 - DNA, 25 bp, Homo sapien
tagagtcacctgcactccaggtaat

SEQ ID NO: 424004 - DNA, 25 bp, Homo sapien
actccaggtaatgggacctgcccag

SEQ ID NO: 424005 - DNA, 25 bp, Homo sapien
cagtagcagaggcatggatcccaca

SEQ ID NO: 424006 - DNA, 25 bp, Homo sapien
cagaggcatggatcccacaggcagg

SEQ ID NO: 424007 - DNA, 25 bp, Homo sapien
accagagcagcaggttgatatgcat

SEQ ID NO: 424008 - DNA, 25 bp, Homo sapien
tgcatgacatgctcttggaagaact

SEQ ID NO: 424009 - DNA, 25 bp, Homo sapien
tgctcttggaagaactggcaccagt

SEQ ID NO: 424010 - DNA, 25 bp, Homo sapien
atttgctggcacttttaatgggcat

SEQ ID NO: 424011 - DNA, 25 bp, Homo sapien
gctggcacttttaatgggcatgaca

SEQ ID NO: 424012 - DNA, 25 bp, Homo sapien
tgggcatgacagtgtttctgaatct

SEQ ID NO: 424013 - DNA, 25 bp, Homo sapien
gacagtgtttctgaatctgagtctc

SEQ ID NO: 424014 - DNA, 25 bp, Homo sapien
ttctgaatctgagtctcctttaatt

SEQ ID NO: 424015 - DNA, 25 bp, Homo sapien
aatctgagtctcctttaattataca

SEQ ID NO: 424016 - DNA, 25 bp, Homo sapien
gagtctcctttaattatacaagtga

SEQ ID NO: 424017 - DNA, 25 bp, Homo sapien
aattatacaagtgaagacttcttat

SEQ ID NO: 424018 - DNA, 25 bp, Homo sapien
aaacaagacactaattgaggagaga

SEQ ID NO: 424019 - DNA, 25 bp, Homo sapien
gagaaaggcacttgtattctgtatt

SEQ ID NO: 424020 - DNA, 25 bp, Homo sapien
attacagtaagtattcagttgagga

SEQ ID NO: 424021 - DNA, 25 bp, Homo sapien
tcgcggcaatccagtgtaagaagat

SEQ ID NO: 424022 - DNA, 25 bp, Homo sapien
tctccacattctcagattgccttct

SEQ ID NO: 424023 - DNA, 25 bp, Homo sapien
gattgccttcttcacataacagctc

SEQ ID NO: 424024 - DNA, 25 bp, Homo sapien
ttcacataacagctccttcctatct

SEQ ID NO: 424025 - DNA, 25 bp, Homo sapien
tatctcctctgtattgtctgacctg

SEQ ID NO: 424026 - DNA, 25 bp, Homo sapien
tctgtattgtctgacctgagcctct

SEQ ID NO: 424027 - DNA, 25 bp, Homo sapien
tctcatttccctgactgtccaataa

SEQ ID NO: 424028 - DNA, 25 bp, Homo sapien
tgtccaataatgtccgcctgcaatt

SEQ ID NO: 424029 - DNA, 25 bp, Homo sapien
ccgcctgcaattagttcttctgcaa

SEQ ID NO: 424030 - DNA, 25 bp, Homo sapien
tcagtccctgagtttcccacaaagg

SEQ ID NO: 424031 - DNA, 25 bp, Homo sapien
tgagtttcccacaaaggccaagtta

SEQ ID NO: 424032 - DNA, 25 bp, Homo sapien
aaatcatcacctatttataaactgt

SEQ ID NO: 424033 - DNA, 25 bp, Homo sapien
actgtattaattacacataatgctt

SEQ ID NO: 424034 - DNA, 25 bp, Homo sapien
ttattgattcaatgaggtttctcta

SEQ ID NO: 424035 - DNA, 25 bp, Homo sapien
gaggtttctctaaagacttctgctt

SEQ ID NO: 424036 - DNA, 25 bp, Homo sapien
gtttctctaaagacttctgcttaat

SEQ ID NO: 424037 - DNA, 25 bp, Homo sapien
gacttctgcttaataaatatgctga

SEQ ID NO: 424038 - DNA, 25 bp, Homo sapien
aatatgctgacttcatttaaattag

SEQ ID NO: 424039 - DNA, 25 bp, Homo sapien
gatcagaaagcatatcagaatgttg

SEQ ID NO: 424040 - DNA, 25 bp, Homo sapien
gatgatatcaaggagacaatctaca

SEQ ID NO: 424041 - DNA, 25 bp, Homo sapien
gagacaatctacagagtttttgcct

SEQ ID NO: 424042 - DNA, 25 bp, Homo sapien
gagtttttgcctctgtggatggaaa

SEQ ID NO: 424043 - DNA, 25 bp, Homo sapien
gtatgacagtgtttgctcactagag

SEQ ID NO: 424044 - DNA, 25 bp, Homo sapien
gtcagagagtgttgggtgtcatttt

SEQ ID NO: 424045 - DNA, 25 bp, Homo sapien
gtcattttgaatttgggtgatcctg

SEQ ID NO: 424046 - DNA, 25 bp, Homo sapien
tttataaggttatcagtctgcccac

SEQ ID NO: 424047 - DNA, 25 bp, Homo sapien
agtctgcccactttgcaattatgca

SEQ ID NO: 424048 - DNA, 25 bp, Homo sapien
aattatgcaggttattgtctataga

SEQ ID NO: 424049 - DNA, 25 bp, Homo sapien
ttttagagttagacaggcagaacct

SEQ ID NO: 424050 - DNA, 25 bp, Homo sapien
ttgcctcttaccaaatatcttcatt

SEQ ID NO: 424051 - DNA, 25 bp, Homo sapien
ttcatttaataagtgtcagtaccct

SEQ ID NO: 424052 - DNA, 25 bp, Homo sapien
gtcagtacccttatctgtaacatgg

SEQ ID NO: 424053 - DNA, 25 bp, Homo sapien
aaatgtacctacctcatactgttac

SEQ ID NO: 424054 - DNA, 25 bp, Homo sapien
taaagcatcagacgtcctatgttct

SEQ ID NO: 424055 - DNA, 25 bp, Homo sapien
gcatcagacgtcctatgttctgtgt

SEQ ID NO: 424056 - DNA, 25 bp, Homo sapien
tgtgtatataaagcctcagaagtcg

SEQ ID NO: 424057 - DNA, 25 bp, Homo sapien
aagcctcagaagtcgcaaatccaga

SEQ ID NO: 424058 - DNA, 25 bp, Homo sapien
gaagtcgcaaatccagagaggcaaa

SEQ ID NO: 424059 - DNA, 25 bp, Homo sapien
gagaggcaaaaagcaggtccctggt

SEQ ID NO: 424060 - DNA, 25 bp, Homo sapien
cagggagcatgcaaaatggctgtaa

SEQ ID NO: 424061 - DNA, 25 bp, Homo sapien
tgcaaaatggctgtaaatggcttct

SEQ ID NO: 424062 - DNA, 25 bp, Homo sapien
aatggtctaaaacctattgtgccaa

SEQ ID NO: 424063 - DNA, 25 bp, Homo sapien
tctaaaacctattgtgccaaaggct

SEQ ID NO: 424064 - DNA, 25 bp, Homo sapien
taaaaacactgaatcacacccttta

SEQ ID NO: 424065 - DNA, 25 bp, Homo sapien
agaatgggtccctattatccagcag

SEQ ID NO: 424066 - DNA, 25 bp, Homo sapien
tatccagcaggacattcagagccag

SEQ ID NO: 424067 - DNA, 25 bp, Homo sapien
gcaggacattcagagccagcggaag

SEQ ID NO: 424068 - DNA, 25 bp, Homo sapien
gccagcggaaggtgaaaccgcagcc

SEQ ID NO: 424069 - DNA, 25 bp, Homo sapien
tgagtgatgcctacctcagtggtat

SEQ ID NO: 424070 - DNA, 25 bp, Homo sapien
agtggtatgcctgccaagagacgca

SEQ ID NO: 424071 - DNA, 25 bp, Homo sapien
agctccggtctgatatacaaaaacg

SEQ ID NO: 424072 - DNA, 25 bp, Homo sapien
aaacgactgcaggaagaccccaact

SEQ ID NO: 424073 - DNA, 25 bp, Homo sapien
actgcaggaagaccccaactacagt

SEQ ID NO: 424074 - DNA, 25 bp, Homo sapien
tgatgatccttagctctttgctcta

SEQ ID NO: 424075 - DNA, 25 bp, Homo sapien
ttagctctttgctctatggcccttc

SEQ ID NO: 424076 - DNA, 25 bp, Homo sapien
attctagccaacattgagtcactca

SEQ ID NO: 424077 - DNA, 25 bp, Homo sapien
gagtcactcaataagtctcaacagt

SEQ ID NO: 424078 - DNA, 25 bp, Homo sapien
tctcaacagtgggtgtgtttgctga

SEQ ID NO: 424079 - DNA, 25 bp, Homo sapien
tgtttgctgagattgtccagcggtt

SEQ ID NO: 424080 - DNA, 25 bp, Homo sapien
tccagcggttgagcagtttggtctc

SEQ ID NO: 424081 - DNA, 25 bp, Homo sapien
acctccctcgctagttgagaccaaa

SEQ ID NO: 424082 - DNA, 25 bp, Homo sapien
tcatggtctttgaaacataatgctt

SEQ ID NO: 424083 - DNA, 25 bp, Homo sapien
acataatgcttatttcgtggtcaat

SEQ ID NO: 424084 - DNA, 25 bp, Homo sapien
gcttatttcgtggtcaatggcttta

SEQ ID NO: 424085 - DNA, 25 bp, Homo sapien
gttttcttcaacaaactcactagtt

SEQ ID NO: 424086 - DNA, 25 bp, Homo sapien
actagttttcccttaaatgatattg

SEQ ID NO: 424087 - DNA, 25 bp, Homo sapien
accctccaatggctttctgtaacac

SEQ ID NO: 424088 - DNA, 25 bp, Homo sapien
aagtacaatctgaactcttcgcctg

SEQ ID NO: 424089 - DNA, 25 bp, Homo sapien
gaactcttcgcctggcctatgaagg

SEQ ID NO: 424090 - DNA, 25 bp, Homo sapien
gccttcttaggatttgtctgactgt

SEQ ID NO: 424091 - DNA, 25 bp, Homo sapien
tgactgtctcatattccattcctta

SEQ ID NO: 424092 - DNA, 25 bp, Homo sapien
ttactgtccaccttaacgactgtgc

SEQ ID NO: 424093 - DNA, 25 bp, Homo sapien
acgactgtgcttctggtacattgac

SEQ ID NO: 424094 - DNA, 25 bp, Homo sapien
attgaccttcttctaattccttgta

SEQ ID NO: 424095 - DNA, 25 bp, Homo sapien
tgtatttgccaaagcttattcctac

SEQ ID NO: 424096 - DNA, 25 bp, Homo sapien
ttattcctaccacagggctttcgca

SEQ ID NO: 424097 - DNA, 25 bp, Homo sapien
tagctgccctttttacctggtaagc

SEQ ID NO: 424098 - DNA, 25 bp, Homo sapien
gtttgctatataaatccaattggga

SEQ ID NO: 424099 - DNA, 25 bp, Homo sapien
caattgggataagttggctggaaaa

SEQ ID NO: 424100 - DNA, 25 bp, Homo sapien
atattccctatctgtttaaccaaag

SEQ ID NO: 424101 - DNA, 25 bp, Homo sapien
attcctctttgtgctccttacaact

SEQ ID NO: 424102 - DNA, 25 bp, Homo sapien
ctctttgtgctccttacaactttaa

SEQ ID NO: 424103 - DNA, 25 bp, Homo sapien
tgtgctccttacaactttaaaaaag

SEQ ID NO: 424104 - DNA, 25 bp, Homo sapien
agcaagtaccttatactgaaccaag

SEQ ID NO: 424105 - DNA, 25 bp, Homo sapien
tgaaccaagatcatgaatgccaagt

SEQ ID NO: 424106 - DNA, 25 bp, Homo sapien
aagatcatgaatgccaagtttttgc

SEQ ID NO: 424107 - DNA, 25 bp, Homo sapien
gggtttcaaatggaaagcctcacag

SEQ ID NO: 424108 - DNA, 25 bp, Homo sapien
atggaaagcctcacagacttcagac

SEQ ID NO: 424109 - DNA, 25 bp, Homo sapien
attacatgcttgagctaccatacct

SEQ ID NO: 424110 - DNA, 25 bp, Homo sapien
ttacatgcttgagctaccatacctg

SEQ ID NO: 424111 - DNA, 25 bp, Homo sapien
tacatgcttgagctaccatacctgg

SEQ ID NO: 424112 - DNA, 25 bp, Homo sapien
acatgcttgagctaccatacctggc

SEQ ID NO: 424113 - DNA, 25 bp, Homo sapien
catgcttgagctaccatacctggct

SEQ ID NO: 424114 - DNA, 25 bp, Homo sapien
atgcttgagctaccatacctggcta

SEQ ID NO: 424115 - DNA, 25 bp, Homo sapien
tgcttgagctaccatacctggctaa

SEQ ID NO: 424116 - DNA, 25 bp, Homo sapien
gcttgagctaccatacctggctaat

SEQ ID NO: 424117 - DNA, 25 bp, Homo sapien
cttgagctaccatacctggctaatt

SEQ ID NO: 424118 - DNA, 25 bp, Homo sapien
aaacccaacagcttcaactattgcc

SEQ ID NO: 424119 - DNA, 25 bp, Homo sapien
gcttcaactattgccctttcaacag

SEQ ID NO: 424120 - DNA, 25 bp, Homo sapien
tttcaacagttttgccactgaccgg

SEQ ID NO: 424121 - DNA, 25 bp, Homo sapien
ttttgccactgaccggatagaaacg

SEQ ID NO: 424122 - DNA, 25 bp, Homo sapien
gaaacggtttcagtctctggatgga

SEQ ID NO: 424123 - DNA, 25 bp, Homo sapien
tttcagtctctggatggatgtgttt

SEQ ID NO: 424124 - DNA, 25 bp, Homo sapien
ctagatatagcatacagagcctgtt

SEQ ID NO: 424125 - DNA, 25 bp, Homo sapien
gagcctgtttttgagttttagatac

SEQ ID NO: 424126 - DNA, 25 bp, Homo sapien
tgctgtgttttagtcctggtaggaa

SEQ ID NO: 424127 - DNA, 25 bp, Homo sapien
ggaatatttatcagagttcacacta

SEQ ID NO: 424128 - DNA, 25 bp, Homo sapien
gagttcacactatataaaacccaac

SEQ ID NO: 424129 - DNA, 25 bp, Homo sapien
aaaatttgccttataaattacagca

SEQ ID NO: 424130 - DNA, 25 bp, Homo sapien
tggcctcattcaaaccatggggcag

SEQ ID NO: 424131 - DNA, 25 bp, Homo sapien
gggctcagttcgctgccccaagaag

SEQ ID NO: 424132 - DNA, 25 bp, Homo sapien
cagttgggcaaagctgggcagctat

SEQ ID NO: 424133 - DNA, 25 bp, Homo sapien
cagctattgctggagagagttgtct

SEQ ID NO: 424134 - DNA, 25 bp, Homo sapien
gttgtctcaagagttcagggctgta

SEQ ID NO: 424135 - DNA, 25 bp, Homo sapien
caggacggccacaggacagcagcag

SEQ ID NO: 424136 - DNA, 25 bp, Homo sapien
agccctgtggccagcagaaccattc

SEQ ID NO: 424137 - DNA, 25 bp, Homo sapien
agcagaaccattccccacaaggaaa

SEQ ID NO: 424138 - DNA, 25 bp, Homo sapien
gaaccattccccacaaggaaacctg

SEQ ID NO: 424139 - DNA, 25 bp, Homo sapien
tccccacaaggaaacctgggaatag

SEQ ID NO: 424140 - DNA, 25 bp, Homo sapien
ttagcgatatcctccctacttgcat

SEQ ID NO: 424141 - DNA, 25 bp, Homo sapien
atcctccctacttgcatgtcctttt

SEQ ID NO: 424142 - DNA, 25 bp, Homo sapien
tcctccctacttgcatgtcctttta

SEQ ID NO: 424143 - DNA, 25 bp, Homo sapien
cctccctacttgcatgtccttttat

SEQ ID NO: 424144 - DNA, 25 bp, Homo sapien
ctccctacttgcatgtccttttata

SEQ ID NO: 424145 - DNA, 25 bp, Homo sapien
tccctacttgcatgtccttttatag

SEQ ID NO: 424146 - DNA, 25 bp, Homo sapien
ccctacttgcatgtccttttatagg

SEQ ID NO: 424147 - DNA, 25 bp, Homo sapien
tggctttttttgcctgaccctgcag

SEQ ID NO: 424148 - DNA, 25 bp, Homo sapien
ggctttttttgcctgaccctgcagg

SEQ ID NO: 424149 - DNA, 25 bp, Homo sapien
tttttttgcctgaccctgcaggcag

SEQ ID NO: 424150 - DNA, 25 bp, Homo sapien
caggattaagagatgagagtaagac

SEQ ID NO: 424151 - DNA, 25 bp, Homo sapien
aggtgtgtgctgactggattcagag

SEQ ID NO: 424152 - DNA, 25 bp, Homo sapien
gaatgtctaagtgaagggaccagtt

SEQ ID NO: 424153 - DNA, 25 bp, Homo sapien
tctaagtgaagggaccagtttgaat

SEQ ID NO: 424154 - DNA, 25 bp, Homo sapien
tgaaggttcagagacatgggatcgt

SEQ ID NO: 424155 - DNA, 25 bp, Homo sapien
ggttcagagacatgggatcgtttcc

SEQ ID NO: 424156 - DNA, 25 bp, Homo sapien
tgagaatccacaagctacccactga

SEQ ID NO: 424157 - DNA, 25 bp, Homo sapien
aatccacaagctacccactgacttg

SEQ ID NO: 424158 - DNA, 25 bp, Homo sapien
taagcagttgacttccatcagtgtt

SEQ ID NO: 424159 - DNA, 25 bp, Homo sapien
agcagttgacttccatcagtgttga

SEQ ID NO: 424160 - DNA, 25 bp, Homo sapien
gcagttgacttccatcagtgttgag

SEQ ID NO: 424161 - DNA, 25 bp, Homo sapien
agttgacttccatcagtgttgagcc

SEQ ID NO: 424162 - DNA, 25 bp, Homo sapien
gagagtgaggtaagtgaccacagca

SEQ ID NO: 424163 - DNA, 25 bp, Homo sapien
aggtaagtgaccacagcaggatggc

SEQ ID NO: 424164 - DNA, 25 bp, Homo sapien
agctggctgggcagctggacactta

SEQ ID NO: 424165 - DNA, 25 bp, Homo sapien
acacttagccccctgcagagcagag

SEQ ID NO: 424166 - DNA, 25 bp, Homo sapien
gctaagtcaagctcaaaggatttaa

SEQ ID NO: 424167 - DNA, 25 bp, Homo sapien
gatttaatgtacctgcctgtgaagc

SEQ ID NO: 424168 - DNA, 25 bp, Homo sapien
ggaggaaactgtctggcctttccta

SEQ ID NO: 424169 - DNA, 25 bp, Homo sapien
tggcctttcctaaccagggatgaac

SEQ ID NO: 424170 - DNA, 25 bp, Homo sapien
aaactgaactaaactgccagaaaag

SEQ ID NO: 424171 - DNA, 25 bp, Homo sapien
tttggaggtttttctccctgcagag

SEQ ID NO: 424172 - DNA, 25 bp, Homo sapien
aggtttttctccctgcagagataaa

SEQ ID NO: 424173 - DNA, 25 bp, Homo sapien
aaaattgaaatgtaaggctgtgtaa

SEQ ID NO: 424174 - DNA, 25 bp, Homo sapien
aaatgtaaggctgtgtaagatttgt

SEQ ID NO: 424175 - DNA, 25 bp, Homo sapien
ttgtttttaaactgtacagtgtctt

SEQ ID NO: 424176 - DNA, 25 bp, Homo sapien
tgtttttaaactgtacagtgtcttt

SEQ ID NO: 424177 - DNA, 25 bp, Homo sapien
ttaaactgtacagtgtctttttttg

SEQ ID NO: 424178 - DNA, 25 bp, Homo sapien
actgtacagtgtctttttttgtata

SEQ ID NO: 424179 - DNA, 25 bp, Homo sapien
ttttgtatagttaacacactaccga

SEQ ID NO: 424180 - DNA, 25 bp, Homo sapien
ttagatagccctgtcctggtggtat

SEQ ID NO: 424181 - DNA, 25 bp, Homo sapien
ttttcaatagccactaaccttgcct

SEQ ID NO: 424182 - DNA, 25 bp, Homo sapien
tttcaatagccactaaccttgcctg

SEQ ID NO: 424183 - DNA, 25 bp, Homo sapien
actaaccttgcctggtacagtatgg

SEQ ID NO: 424184 - DNA, 25 bp, Homo sapien
tgcggcgtggtctctcccaggagac

SEQ ID NO: 424185 - DNA, 25 bp, Homo sapien
ttcccatgtgtaacttcctcacgtt

SEQ ID NO: 424186 - DNA, 25 bp, Homo sapien
atgtgtaacttcctcacgttgtgtg

SEQ ID NO: 424187 - DNA, 25 bp, Homo sapien
acttcctcacgttgtgtgcgataac

SEQ ID NO: 424188 - DNA, 25 bp, Homo sapien
tgtgcgataacgtattttattgtac

SEQ ID NO: 424189 - DNA, 25 bp, Homo sapien
tcactcatttctcctgcgtctgtgt

SEQ ID NO: 424190 - DNA, 25 bp, Homo sapien
atttctcctgcgtctgtgtgcatag

SEQ ID NO: 424191 - DNA, 25 bp, Homo sapien
gcgtctgtgtgcataggacatgata

SEQ ID NO: 424192 - DNA, 25 bp, Homo sapien
ggacatgatactaataaccacacgg

SEQ ID NO: 424193 - DNA, 25 bp, Homo sapien
tactaataaccacacggctggcgtg

SEQ ID NO: 424194 - DNA, 25 bp, Homo sapien
aaccacacggctggcgtgaccttgg

SEQ ID NO: 424195 - DNA, 25 bp, Homo sapien
gaaaatcctgatgcggaagacggag

SEQ ID NO: 424196 - DNA, 25 bp, Homo sapien
cagtgacctgccgaggtcggcagca

SEQ ID NO: 424197 - DNA, 25 bp, Homo sapien
gacctgccgaggtcggcagcacaga

SEQ ID NO: 424198 - DNA, 25 bp, Homo sapien
gccgaggtcggcagcacagagctct

SEQ ID NO: 424199 - DNA, 25 bp, Homo sapien
gtcggcagcacagagctctggagat

SEQ ID NO: 424200 - DNA, 25 bp, Homo sapien
cggcagcacagagctctggagatga

SEQ ID NO: 424201 - DNA, 25 bp, Homo sapien
gcacagagctctggagatgaagacc

SEQ ID NO: 424202 - DNA, 25 bp, Homo sapien
agatgaagaccctgttcctgggtgt

SEQ ID NO: 424203 - DNA, 25 bp, Homo sapien
atgaagaccctgttcctgggtgtca

SEQ ID NO: 424204 - DNA, 25 bp, Homo sapien
tgaagaccctgttcctgggtgtcac

SEQ ID NO: 424205 - DNA, 25 bp, Homo sapien
tgggtgtcacgctcggcctggccgc

SEQ ID NO: 424206 - DNA, 25 bp, Homo sapien
attctacagataattttcagggccg

SEQ ID NO: 424207 - DNA, 25 bp, Homo sapien
ttttcagggccgaatgttaccattt

SEQ ID NO: 424208 - DNA, 25 bp, Homo sapien
gggccgaatgttaccatttggctta

SEQ ID NO: 424209 - DNA, 25 bp, Homo sapien
cgaatgttaccatttggcttaataa

SEQ ID NO: 424210 - DNA, 25 bp, Homo sapien
ggcttaataatatatagaggcacta

SEQ ID NO: 424211 - DNA, 25 bp, Homo sapien
gcactaaaaaactcacttcttccta

SEQ ID NO: 424212 - DNA, 25 bp, Homo sapien
ttcttcctaaacagtctttacgtag

SEQ ID NO: 424213 - DNA, 25 bp, Homo sapien
tccttcaaattgagacagaggtatt

SEQ ID NO: 424214 - DNA, 25 bp, Homo sapien
tttgttattagtatcgtttccgtat

SEQ ID NO: 424215 - DNA, 25 bp, Homo sapien
ttattagtatcgtttccgtatgaaa

SEQ ID NO: 424216 - DNA, 25 bp, Homo sapien
gtatcgtttccgtatgaaattaatt

SEQ ID NO: 424217 - DNA, 25 bp, Homo sapien
gaaatccaactaatgagaccgcact

SEQ ID NO: 424218 - DNA, 25 bp, Homo sapien
caactaatgagaccgcactccttgg

SEQ ID NO: 424219 - DNA, 25 bp, Homo sapien
actccttggcttgttcctgcgtgtt

SEQ ID NO: 424220 - DNA, 25 bp, Homo sapien
ttgttcctgcgtgtttcacccaaag

SEQ ID NO: 424221 - DNA, 25 bp, Homo sapien
cctgcgtgtttcacccaaaggagaa

SEQ ID NO: 424222 - DNA, 25 bp, Homo sapien
taggatgaagtcaatcttcttgcag

SEQ ID NO: 424223 - DNA, 25 bp, Homo sapien
gaagtcaatcttcttgcaggaacat

SEQ ID NO: 424224 - DNA, 25 bp, Homo sapien
gtcaatcttcttgcaggaacatgtt

SEQ ID NO: 424225 - DNA, 25 bp, Homo sapien
tcttcttgcaggaacatgttactat

SEQ ID NO: 424226 - DNA, 25 bp, Homo sapien
atgttactatggtgatttctacgca

SEQ ID NO: 424227 - DNA, 25 bp, Homo sapien
ctatggtgatttctacgcaacacta

SEQ ID NO: 424228 - DNA, 25 bp, Homo sapien
taaattagacagaaatggtgtcatg

SEQ ID NO: 424229 - DNA, 25 bp, Homo sapien
aaattagacagaaatggtgtcatgt

SEQ ID NO: 424230 - DNA, 25 bp, Homo sapien
acagaaatggtgtcatgtgcatgta

SEQ ID NO: 424231 - DNA, 25 bp, Homo sapien
cagaaatggtgtcatgtgcatgtag

SEQ ID NO: 424232 - DNA, 25 bp, Homo sapien
agaaatggtgtcatgtgcatgtagt

SEQ ID NO: 424233 - DNA, 25 bp, Homo sapien
gaaatggtgtcatgtgcatgtagta

SEQ ID NO: 424234 - DNA, 25 bp, Homo sapien
aaatggtgtcatgtgcatgtagtac

SEQ ID NO: 424235 - DNA, 25 bp, Homo sapien
aatggtgtcatgtgcatgtagtact

SEQ ID NO: 424236 - DNA, 25 bp, Homo sapien
gtgcatgtagtacttgtattcccag

SEQ ID NO: 424237 - DNA, 25 bp, Homo sapien
tgcatgtagtacttgtattcccagc

SEQ ID NO: 424238 - DNA, 25 bp, Homo sapien
gcatgtagtacttgtattcccagct

SEQ ID NO: 424239 - DNA, 25 bp, Homo sapien
gttcaaggatcccaatgcacccaag

SEQ ID NO: 424240 - DNA, 25 bp, Homo sapien
aatgcacccaagaggcctccttcgg

SEQ ID NO: 424241 - DNA, 25 bp, Homo sapien
ccaagaggcctccttcggccttctt

SEQ ID NO: 424242 - DNA, 25 bp, Homo sapien
tcttctgctctgagtatcgcccaaa

SEQ ID NO: 424243 - DNA, 25 bp, Homo sapien
gagtatcgcccaaaaatcaaaggag

SEQ ID NO: 424244 - DNA, 25 bp, Homo sapien
tggtgatgttgcgaagaaactggga

SEQ ID NO: 424245 - DNA, 25 bp, Homo sapien
gtgatgttgcgaagaaactgggaga

SEQ ID NO: 424246 - DNA, 25 bp, Homo sapien
tgatgttgcgaagaaactgggagag

SEQ ID NO: 424247 - DNA, 25 bp, Homo sapien
agatgtggaataacactgctgcaga

SEQ ID NO: 424248 - DNA, 25 bp, Homo sapien
ctgcagatgacaagcagccttatga

SEQ ID NO: 424249 - DNA, 25 bp, Homo sapien
ggatattgctgcatatcgagctaaa

SEQ ID NO: 424250 - DNA, 25 bp, Homo sapien
acttccgaggacctttgcgattaca

SEQ ID NO: 424251 - DNA, 25 bp, Homo sapien
gcgattacaaaagtcccacctggat

SEQ ID NO: 424252 - DNA, 25 bp, Homo sapien
catctcaaggacagctgactcgcaa

SEQ ID NO: 424253 - DNA, 25 bp, Homo sapien
ggacagctgactcgcaaccttaatt

SEQ ID NO: 424254 - DNA, 25 bp, Homo sapien
accttaattcccaactgccatataa

SEQ ID NO: 424255 - DNA, 25 bp, Homo sapien
cctaccccacatattgctagagcaa

SEQ ID NO: 424256 - DNA, 25 bp, Homo sapien
gagcaatcaggccaatgagcccagt

SEQ ID NO: 424257 - DNA, 25 bp, Homo sapien
aatgagcccagtccacatgcatgac

SEQ ID NO: 424258 - DNA, 25 bp, Homo sapien
catgcatgaccccagtatgaagcct

SEQ ID NO: 424259 - DNA, 25 bp, Homo sapien
tatgaagcctggcataccaccattt

SEQ ID NO: 424260 - DNA, 25 bp, Homo sapien
ggcataccaccatttctagaaacca

SEQ ID NO: 424261 - DNA, 25 bp, Homo sapien
ttttcctccttcctgccttgcttgt

SEQ ID NO: 424262 - DNA, 25 bp, Homo sapien
tcctttttgggtacataatcagaat

SEQ ID NO: 424263 - DNA, 25 bp, Homo sapien
tttccacaaaatcatttcgatataa

SEQ ID NO: 424264 - DNA, 25 bp, Homo sapien
gttcatgccaacatttatacagcta

SEQ ID NO: 424265 - DNA, 25 bp, Homo sapien
tcatgccaacatttatacagctagt

SEQ ID NO: 424266 - DNA, 25 bp, Homo sapien
gccaacatttatacagctagtttaa

SEQ ID NO: 424267 - DNA, 25 bp, Homo sapien
atacagctagtttaattgttcagtt

SEQ ID NO: 424268 - DNA, 25 bp, Homo sapien
aatgtgttgtattactttgttttgc

SEQ ID NO: 424269 - DNA, 25 bp, Homo sapien
gtattactttgttttgcttcatatc

SEQ ID NO: 424270 - DNA, 25 bp, Homo sapien
attactttgttttgcttcatatctg

SEQ ID NO: 424271 - DNA, 25 bp, Homo sapien
ttgcttcatatctgttttgtatata

SEQ ID NO: 424272 - DNA, 25 bp, Homo sapien
gtgtaagtggttaactgaagtctaa

SEQ ID NO: 424273 - DNA, 25 bp, Homo sapien
ggttaactgaagtctaactagatag

SEQ ID NO: 424274 - DNA, 25 bp, Homo sapien
actagataggtttgttgtaagctta

SEQ ID NO: 424275 - DNA, 25 bp, Homo sapien
gataggtttgttgtaagcttaggat

SEQ ID NO: 424276 - DNA, 25 bp, Homo sapien
agcttaggatgtttacagttcttca

SEQ ID NO: 424277 - DNA, 25 bp, Homo sapien
ggatgtttacagttcttcatgttaa

SEQ ID NO: 424278 - DNA, 25 bp, Homo sapien
tcttcatgttaagttgagcgtgatg

SEQ ID NO: 424279 - DNA, 25 bp, Homo sapien
atgggaagggaaagaatgctgatct

SEQ ID NO: 424280 - DNA, 25 bp, Homo sapien
gtatttagtgaattaattgcatcct

SEQ ID NO: 424281 - DNA, 25 bp, Homo sapien
agtcaaacttgaaaagcacatttta

SEQ ID NO: 424282 - DNA, 25 bp, Homo sapien
catcagaagagaacaatggtacaga

SEQ ID NO: 424283 - DNA, 25 bp, Homo sapien
gatgaccttggcctgaccctggtct

SEQ ID NO: 424284 - DNA, 25 bp, Homo sapien
tggcctgaccctggtctggtctcag

SEQ ID NO: 424285 - DNA, 25 bp, Homo sapien
tggtctcagaatcacttttcccatc

SEQ ID NO: 424286 - DNA, 25 bp, Homo sapien
ggtgttgaaagttcttcctggagca

SEQ ID NO: 424287 - DNA, 25 bp, Homo sapien
tcctggagcagatgtcctagaaggt

SEQ ID NO: 424288 - DNA, 25 bp, Homo sapien
atagtgacagagtcaggccacccca

SEQ ID NO: 424289 - DNA, 25 bp, Homo sapien
agagtcaggccaccccaagggccat

SEQ ID NO: 424290 - DNA, 25 bp, Homo sapien
ggagccagctgacctgcttgaccga

SEQ ID NO: 424291 - DNA, 25 bp, Homo sapien
tgacctgcttgaccgaaggatttct

SEQ ID NO: 424292 - DNA, 25 bp, Homo sapien
ggatttctgacagactatctttggg

SEQ ID NO: 424293 - DNA, 25 bp, Homo sapien
atttctctcgggaataattttatag

SEQ ID NO: 424294 - DNA, 25 bp, Homo sapien
gggcggcattttactgctcagaatt

SEQ ID NO: 424295 - DNA, 25 bp, Homo sapien
attttactgctcagaatttggaggg

SEQ ID NO: 424296 - DNA, 25 bp, Homo sapien
gggagcagtaccttcccggagtcca

SEQ ID NO: 424297 - DNA, 25 bp, Homo sapien
ttcccggagtccacgcatgtgagtt

SEQ ID NO: 424298 - DNA, 25 bp, Homo sapien
agtccacgcatgtgagttgggtcaa

SEQ ID NO: 424299 - DNA, 25 bp, Homo sapien
agttgggtcaagtgcattggaccta

SEQ ID NO: 424300 - DNA, 25 bp, Homo sapien
caagtgcattggacctagggaaaga

SEQ ID NO: 424301 - DNA, 25 bp, Homo sapien
gtgaatgcaagatacaaagtgggat

SEQ ID NO: 424302 - DNA, 25 bp, Homo sapien
aattaaatccagagttccaggcaat

SEQ ID NO: 424303 - DNA, 25 bp, Homo sapien
gagttccaggcaatcaaaatgagtg

SEQ ID NO: 424304 - DNA, 25 bp, Homo sapien
acaggtgaattttagtggcatatgg

SEQ ID NO: 424305 - DNA, 25 bp, Homo sapien
ttccgcggttttcagtgacccagtt

SEQ ID NO: 424306 - DNA, 25 bp, Homo sapien
tgacccagtttgttgcatggcacat

SEQ ID NO: 424307 - DNA, 25 bp, Homo sapien
aaggtgaatctgaccgcgttacttc

SEQ ID NO: 424308 - DNA, 25 bp, Homo sapien
tcagagatgcgctgtgagctgcttt

SEQ ID NO: 424309 - DNA, 25 bp, Homo sapien
gagctgctttgtgccgcgaaatgac

SEQ ID NO: 424310 - DNA, 25 bp, Homo sapien
gaaatgacctgtttacccgacagcg

SEQ ID NO: 424311 - DNA, 25 bp, Homo sapien
gccggaacgggctttttcatgatgt

SEQ ID NO: 424312 - DNA, 25 bp, Homo sapien
tcatgatgttcctgcgttgtgttta

SEQ ID NO: 424313 - DNA, 25 bp, Homo sapien
gttgtgtttacagcctccctgcgag

SEQ ID NO: 424314 - DNA, 25 bp, Homo sapien
acaggcggacctcgttttgttgcgc

SEQ ID NO: 424315 - DNA, 25 bp, Homo sapien
tttgttgcgccttgctctattgtgc

SEQ ID NO: 424316 - DNA, 25 bp, Homo sapien
agcatttcaaagtgacttctatgaa

SEQ ID NO: 424317 - DNA, 25 bp, Homo sapien
gagttaagcactgctttcagtttta

SEQ ID NO: 424318 - DNA, 25 bp, Homo sapien
tcagttttaatatccaccttgaggg

SEQ ID NO: 424319 - DNA, 25 bp, Homo sapien
gggtcgctgcttgagggctcttatc

SEQ ID NO: 424320 - DNA, 25 bp, Homo sapien
ctgcttgagggctcttatcccaggg

SEQ ID NO: 424321 - DNA, 25 bp, Homo sapien
ggatgttacttaatgtggcttctct

SEQ ID NO: 424322 - DNA, 25 bp, Homo sapien
gtggcttctctaatgtagtttcttt

SEQ ID NO: 424323 - DNA, 25 bp, Homo sapien
gtttctttgattaccgactacacaa

SEQ ID NO: 424324 - DNA, 25 bp, Homo sapien
ttatgtaccatcacagtattagtgg

SEQ ID NO: 424325 - DNA, 25 bp, Homo sapien
aagtaccatgtgatttaattctcca

SEQ ID NO: 424326 - DNA, 25 bp, Homo sapien
taattctccattcctccaatgtaac

SEQ ID NO: 424327 - DNA, 25 bp, Homo sapien
aggcctctgaggtttgaagggctct

SEQ ID NO: 424328 - DNA, 25 bp, Homo sapien
aagggctctgtgagttagagttgtc

SEQ ID NO: 424329 - DNA, 25 bp, Homo sapien
tagagttgtcacatgttctcctggt

SEQ ID NO: 424330 - DNA, 25 bp, Homo sapien
tcacatgttctcctggttcttgaat

SEQ ID NO: 424331 - DNA, 25 bp, Homo sapien
agcaggtcctgaaaaggaaggctct

SEQ ID NO: 424332 - DNA, 25 bp, Homo sapien
tttggtttctgagcagcccagagag

SEQ ID NO: 424333 - DNA, 25 bp, Homo sapien
agagcccagggctggagtccccaat

SEQ ID NO: 424334 - DNA, 25 bp, Homo sapien
ggagtccccaatccctgtgctatgg

SEQ ID NO: 424335 - DNA, 25 bp, Homo sapien
tgctatgggcacaaagagacttcag

SEQ ID NO: 424336 - DNA, 25 bp, Homo sapien
aagagacttcagctcttcctgttgc

SEQ ID NO: 424337 - DNA, 25 bp, Homo sapien
gttgccttggctttttcctgagcaa

SEQ ID NO: 424338 - DNA, 25 bp, Homo sapien
gttgaacaatttttgctgaagcacc

SEQ ID NO: 424339 - DNA, 25 bp, Homo sapien
tgaacaatttttgctgaagcacccc

SEQ ID NO: 424340 - DNA, 25 bp, Homo sapien
taactacatggatattgggagtacc

SEQ ID NO: 424341 - DNA, 25 bp, Homo sapien
gatattgggagtaccaacaaactca

SEQ ID NO: 424342 - DNA, 25 bp, Homo sapien
aagatgatacgggaacttgacaatg

SEQ ID NO: 424343 - DNA, 25 bp, Homo sapien
aatgacattgcctttaatgttaaac

SEQ ID NO: 424344 - DNA, 25 bp, Homo sapien
aggttgtattaatttcagcagagat

SEQ ID NO: 424345 - DNA, 25 bp, Homo sapien
cagcagagatggaaggatttggaca

SEQ ID NO: 424346 - DNA, 25 bp, Homo sapien
ggatttggacatattgtttggtact

SEQ ID NO: 424347 - DNA, 25 bp, Homo sapien
gacatattgtttggtactgtcatat

SEQ ID NO: 424348 - DNA, 25 bp, Homo sapien
gtttggtactgtcatatgagataca

SEQ ID NO: 424349 - DNA, 25 bp, Homo sapien
ttgatgtatttttccataggccaca

SEQ ID NO: 424350 - DNA, 25 bp, Homo sapien
aggccacaagtattagcagctgcac

SEQ ID NO: 424351 - DNA, 25 bp, Homo sapien
cagctgcacagataattttctgttc

SEQ ID NO: 424352 - DNA, 25 bp, Homo sapien
ttttctgttcagcaaattctattat

SEQ ID NO: 424353 - DNA, 25 bp, Homo sapien
gtctttgtgtaactgtagcctttac

SEQ ID NO: 424354 - DNA, 25 bp, Homo sapien
cagtaaaatttgagcctatcatgag

SEQ ID NO: 424355 - DNA, 25 bp, Homo sapien
aatttgagcctatcatgaggtgtac

SEQ ID NO: 424356 - DNA, 25 bp, Homo sapien
tgagcctatcatgaggtgtacattt

SEQ ID NO: 424357 - DNA, 25 bp, Homo sapien
aaggacctaacaaatgatgctcttc

SEQ ID NO: 424358 - DNA, 25 bp, Homo sapien
taacaaatgatgctcttctggaaga

SEQ ID NO: 424359 - DNA, 25 bp, Homo sapien
ggaagagtgaaggcctactggcaat

SEQ ID NO: 424360 - DNA, 25 bp, Homo sapien
ttgcccctcctcagctgtgcaagga

SEQ ID NO: 424361 - DNA, 25 bp, Homo sapien
gctgtgcaaggagaaagcatgctta

SEQ ID NO: 424362 - DNA, 25 bp, Homo sapien
gcttaggaagttttcaggtccttgt

SEQ ID NO: 424363 - DNA, 25 bp, Homo sapien
gaagttttcaggtccttgtgataaa

SEQ ID NO: 424364 - DNA, 25 bp, Homo sapien
ttgtgataaaacctccttaaatctg

SEQ ID NO: 424365 - DNA, 25 bp, Homo sapien
aatctgttcagaccaagcaatgcga

SEQ ID NO: 424366 - DNA, 25 bp, Homo sapien
cccgaaagggtggtagcaggctgga

SEQ ID NO: 424367 - DNA, 25 bp, Homo sapien
tggaagccagaaccaacccctgcgt

SEQ ID NO: 424368 - DNA, 25 bp, Homo sapien
ccctgcgtacgctgctcagttggtg

SEQ ID NO: 424369 - DNA, 25 bp, Homo sapien
ggctgggactggaatcaccccacct

SEQ ID NO: 424370 - DNA, 25 bp, Homo sapien
ggcttgggaggatctggaattaaac

SEQ ID NO: 424371 - DNA, 25 bp, Homo sapien
accagtcgacatttgcagccagcat

SEQ ID NO: 424372 - DNA, 25 bp, Homo sapien
agcatctgggtaccttgggagctcc

SEQ ID NO: 424373 - DNA, 25 bp, Homo sapien
gtgaattggacacggcattgcgctt

SEQ ID NO: 424374 - DNA, 25 bp, Homo sapien
ggcattgcgcttaacagcgcggcta

SEQ ID NO: 424375 - DNA, 25 bp, Homo sapien
ggctacctcaggctgctggtaagta

SEQ ID NO: 424376 - DNA, 25 bp, Homo sapien
taagtaccagaatgctgtttctcct

SEQ ID NO: 424377 - DNA, 25 bp, Homo sapien
ttgtcttacagaaagctcgctcccc

SEQ ID NO: 424378 - DNA, 25 bp, Homo sapien
atgaccctgcaccttcaaagcactt

SEQ ID NO: 424379 - DNA, 25 bp, Homo sapien
caaagcacttttctcataggttcta

SEQ ID NO: 424380 - DNA, 25 bp, Homo sapien
tcataggttctatattagctggaga

SEQ ID NO: 424381 - DNA, 25 bp, Homo sapien
gaaaaaccttcaagggcatttggag

SEQ ID NO: 424382 - DNA, 25 bp, Homo sapien
aaaattcagagctggcacagttggg

SEQ ID NO: 424383 - DNA, 25 bp, Homo sapien
gggactgaccttccttgatctcacc

SEQ ID NO: 424384 - DNA, 25 bp, Homo sapien
aggcctggcatagggaaagaaactc

SEQ ID NO: 424385 - DNA, 25 bp, Homo sapien
aagaaactcagctcgagcatccaga

SEQ ID NO: 424386 - DNA, 25 bp, Homo sapien
agaacatccatcttgctctcaaata

SEQ ID NO: 424387 - DNA, 25 bp, Homo sapien
cttgctctcaaatacctaatacagg

SEQ ID NO: 424388 - DNA, 25 bp, Homo sapien
gtattggagctggtaccatttatta

SEQ ID NO: 424389 - DNA, 25 bp, Homo sapien
aggtaattcagttacaaagcttcaa

SEQ ID NO: 424390 - DNA, 25 bp, Homo sapien
tttctcatccacaaatgggcatttg

SEQ ID NO: 424391 - DNA, 25 bp, Homo sapien
tttgaggctgggtgctcctaaaccc

SEQ ID NO: 424392 - DNA, 25 bp, Homo sapien
tgctcctaaaccctacaaaattcag

SEQ ID NO: 424393 - DNA, 25 bp, Homo sapien
cctcagctgtgcaaggagaaagcat

SEQ ID NO: 424394 - DNA, 25 bp, Homo sapien
tcagctgtgcaaggagaaagcatgc

SEQ ID NO: 424395 - DNA, 25 bp, Homo sapien
gcttaggaagttttcaggtccttgt

SEQ ID NO: 424396 - DNA, 25 bp, Homo sapien
ggaagttttcaggtccttgtgataa

SEQ ID NO: 424397 - DNA, 25 bp, Homo sapien
gaagttttcaggtccttgtgataaa

SEQ ID NO: 424398 - DNA, 25 bp, Homo sapien
tccttgtgataaaacctccttaaat

SEQ ID NO: 424399 - DNA, 25 bp, Homo sapien
ttgtgataaaacctccttaaatctg

SEQ ID NO: 424400 - DNA, 25 bp, Homo sapien
cctccttaaatctgttcagaccaag

SEQ ID NO: 424401 - DNA, 25 bp, Homo sapien
aatctgttcagaccaagcaatgcga

SEQ ID NO: 424402 - DNA, 25 bp, Homo sapien
tctgttcagaccaagcaatgcgagc

SEQ ID NO: 424403 - DNA, 25 bp, Homo sapien
ccctgcgtacgctgctcagttggtg

SEQ ID NO: 424404 - DNA, 25 bp, Homo sapien
atcctgattatcttgagtcatgagc

SEQ ID NO: 424405 - DNA, 25 bp, Homo sapien
tgctatgaggcagtagttcccagag

SEQ ID NO: 424406 - DNA, 25 bp, Homo sapien
gaggcagtagttcccagagcaacca

SEQ ID NO: 424407 - DNA, 25 bp, Homo sapien
ttcccagagcaaccagtgcctgtgg

SEQ ID NO: 424408 - DNA, 25 bp, Homo sapien
tgtggtcctgatgaccccaccttag

SEQ ID NO: 424409 - DNA, 25 bp, Homo sapien
gatgaccccaccttagacagaatgt

SEQ ID NO: 424410 - DNA, 25 bp, Homo sapien
acagaatgtgtttggtgatgtgaac

SEQ ID NO: 424411 - DNA, 25 bp, Homo sapien
caggccctgggacctctaagaggcc

SEQ ID NO: 424412 - DNA, 25 bp, Homo sapien
gagcccatgagagttctggttcccc

SEQ ID NO: 424413 - DNA, 25 bp, Homo sapien
atgagagttctggttcccctgcggg

SEQ ID NO: 424414 - DNA, 25 bp, Homo sapien
ctgcgggcttgtgggttcacaccca

SEQ ID NO: 424415 - DNA, 25 bp, Homo sapien
catcctgaatttatactttattgta

SEQ ID NO: 424416 - DNA, 25 bp, Homo sapien
catacatttcaattgattgcactgt

SEQ ID NO: 424417 - DNA, 25 bp, Homo sapien
tcaattgattgcactgtattgcagg

SEQ ID NO: 424418 - DNA, 25 bp, Homo sapien
ctgtattgcaggatatggagatttc

SEQ ID NO: 424419 - DNA, 25 bp, Homo sapien
ggagatttcatcacctactacaata

SEQ ID NO: 424420 - DNA, 25 bp, Homo sapien
atcacctactacaatacagcatatt

SEQ ID NO: 424421 - DNA, 25 bp, Homo sapien
atttgtcatatattctacttgtatt

SEQ ID NO: 424422 - DNA, 25 bp, Homo sapien
cttgtattttgtactgagatcatac

SEQ ID NO: 424423 - DNA, 25 bp, Homo sapien
gatcatacaatctttcattatctaa

SEQ ID NO: 424424 - DNA, 25 bp, Homo sapien
aatgacttgtttggttgctttataa

SEQ ID NO: 424425 - DNA, 25 bp, Homo sapien
aatttcttgcatctggaatttgtat

SEQ ID NO: 424426 - DNA, 25 bp, Homo sapien
gggtttctgtcaatctgtcctcggc

SEQ ID NO: 424427 - DNA, 25 bp, Homo sapien
aaagcaagcttgctaggtgccctct

SEQ ID NO: 424428 - DNA, 25 bp, Homo sapien
tggctccagcctttaccggaagtgt

SEQ ID NO: 424429 - DNA, 25 bp, Homo sapien
ccggaagtgtggtgcatgtttttaa

SEQ ID NO: 424430 - DNA, 25 bp, Homo sapien
ggtgcatgtttttaacttcagggaa

SEQ ID NO: 424431 - DNA, 25 bp, Homo sapien
ttcagggaagcggtatcctgtcact

SEQ ID NO: 424432 - DNA, 25 bp, Homo sapien
tggagaagaggcaccagccacgatt

SEQ ID NO: 424433 - DNA, 25 bp, Homo sapien
agccacgattccttcctaagcatct

SEQ ID NO: 424434 - DNA, 25 bp, Homo sapien
ttcctaagcatctcctgttctgact

SEQ ID NO: 424435 - DNA, 25 bp, Homo sapien
tcctgttctgactgctcatgaattg

SEQ ID NO: 424436 - DNA, 25 bp, Homo sapien
atgaattgaagaaactgacccttgt

SEQ ID NO: 424437 - DNA, 25 bp, Homo sapien
gggttggtctgtaacaagattttca

SEQ ID NO: 424438 - DNA, 25 bp, Homo sapien
gaaactttacaattcgacttggaca

SEQ ID NO: 424439 - DNA, 25 bp, Homo sapien
attcgacttggacaaccagagatta

SEQ ID NO: 424440 - DNA, 25 bp, Homo sapien
gggagcttagctctcccattctgtg

SEQ ID NO: 424441 - DNA, 25 bp, Homo sapien
tgtgattccttcctctgaaggccct

SEQ ID NO: 424442 - DNA, 25 bp, Homo sapien
aggccctcaaagcaactccataata

SEQ ID NO: 424443 - DNA, 25 bp, Homo sapien
acagagctgccagagccgatgtttt

SEQ ID NO: 424444 - DNA, 25 bp, Homo sapien
agagccgatgttttggagcaccctg

SEQ ID NO: 424445 - DNA, 25 bp, Homo sapien
tggagcaccctgagacatatgaact

SEQ ID NO: 424446 - DNA, 25 bp, Homo sapien
gaactctaatataacttccaggaga

SEQ ID NO: 424447 - DNA, 25 bp, Homo sapien
acataggattccacttagagccaat

SEQ ID NO: 424448 - DNA, 25 bp, Homo sapien
gatagaaatcaattgtcagcttgag

SEQ ID NO: 424449 - DNA, 25 bp, Homo sapien
attgtcagcttgagaaagttgtttt

SEQ ID NO: 424450 - DNA, 25 bp, Homo sapien
taatctgtctaaatagttcatgcat

SEQ ID NO: 424451 - DNA, 25 bp, Homo sapien
atagttcatgcattactacagttaa

SEQ ID NO: 424452 - DNA, 25 bp, Homo sapien
taacatctgatgttacatgcacatt

SEQ ID NO: 424453 - DNA, 25 bp, Homo sapien
tagacttaattttattccggttcag

SEQ ID NO: 424454 - DNA, 25 bp, Homo sapien
tttattccggttcagtataatctct

SEQ ID NO: 424455 - DNA, 25 bp, Homo sapien
tcagcaaactgattggtcaaggtat

SEQ ID NO: 424456 - DNA, 25 bp, Homo sapien
ggtcaaggtattaacatagcttcta

SEQ ID NO: 424457 - DNA, 25 bp, Homo sapien
attaacatagcttctacttccttta

SEQ ID NO: 424458 - DNA, 25 bp, Homo sapien
aactgaactatgagaagccatggta

SEQ ID NO: 424459 - DNA, 25 bp, Homo sapien
atacttggccgcctgagttaggccg

SEQ ID NO: 424460 - DNA, 25 bp, Homo sapien
tggccgcctgagttaggccggatta

SEQ ID NO: 424461 - DNA, 25 bp, Homo sapien
aggccggattagtactatcctccaa

SEQ ID NO: 424462 - DNA, 25 bp, Homo sapien
agtactatcctccaaaagctaatat

SEQ ID NO: 424463 - DNA, 25 bp, Homo sapien
atataaatgcacatcagttctttct

SEQ ID NO: 424464 - DNA, 25 bp, Homo sapien
atcagttctttctagcgcagcgctg

SEQ ID NO: 424465 - DNA, 25 bp, Homo sapien
cgcagcgctgaagagggtgccacta

SEQ ID NO: 424466 - DNA, 25 bp, Homo sapien
gaagagggtgccactacttgtgctg

SEQ ID NO: 424467 - DNA, 25 bp, Homo sapien
ggtgccactacttgtgctgggtgct

SEQ ID NO: 424468 - DNA, 25 bp, Homo sapien
tgctgggtgctgtttggcatggcca

SEQ ID NO: 424469 - DNA, 25 bp, Homo sapien
catggccagtggcacagtaagagaa

SEQ ID NO: 424470 - DNA, 25 bp, Homo sapien
agtgtgagcagtgcgctggcttcct

SEQ ID NO: 424471 - DNA, 25 bp, Homo sapien
tgagcagtgcgctggcttcctcctg

SEQ ID NO: 424472 - DNA, 25 bp, Homo sapien
tgcctcaggaatagagcccttcatc

SEQ ID NO: 424473 - DNA, 25 bp, Homo sapien
ctccctgaagggaagattcatcagc

SEQ ID NO: 424474 - DNA, 25 bp, Homo sapien
gattcatcagcagcgagggaagatt

SEQ ID NO: 424475 - DNA, 25 bp, Homo sapien
agggaagattcacgagcccagccca

SEQ ID NO: 424476 - DNA, 25 bp, Homo sapien
ccagctggcatttgtcatcattcca

SEQ ID NO: 424477 - DNA, 25 bp, Homo sapien
atcattccagagacatgagccacgc

SEQ ID NO: 424478 - DNA, 25 bp, Homo sapien
ttggctgctcttcgcagaccctctg

SEQ ID NO: 424479 - DNA, 25 bp, Homo sapien
acctctctctgcatgcatgctgggc

SEQ ID NO: 424480 - DNA, 25 bp, Homo sapien
gccaccacacagactgtgtgctttg

SEQ ID NO: 424481 - DNA, 25 bp, Homo sapien
tatataaaacttaaccggcattcct

SEQ ID NO: 424482 - DNA, 25 bp, Homo sapien
atataaaacttaaccggcattcctg

SEQ ID NO: 424483 - DNA, 25 bp, Homo sapien
tataaaacttaaccggcattcctgg

SEQ ID NO: 424484 - DNA, 25 bp, Homo sapien
aacttaaccggcattcctgggtgtg

SEQ ID NO: 424485 - DNA, 25 bp, Homo sapien
acttaaccggcattcctgggtgtgg

SEQ ID NO: 424486 - DNA, 25 bp, Homo sapien
cttaaccggcattcctgggtgtggt

SEQ ID NO: 424487 - DNA, 25 bp, Homo sapien
ttaaccggcattcctgggtgtggtg

SEQ ID NO: 424488 - DNA, 25 bp, Homo sapien
taaccggcattcctgggtgtggtgg

SEQ ID NO: 424489 - DNA, 25 bp, Homo sapien
aaccggcattcctgggtgtggtggc

SEQ ID NO: 424490 - DNA, 25 bp, Homo sapien
accggcattcctgggtgtggtggct

SEQ ID NO: 424491 - DNA, 25 bp, Homo sapien
ccaaggtgagcagatcatggggtca

SEQ ID NO: 424492 - DNA, 25 bp, Homo sapien
ttttctaatgtacaatgcagacaaa

SEQ ID NO: 424493 - DNA, 25 bp, Homo sapien
gcagacaaatgtactgctctctgaa

SEQ ID NO: 424494 - DNA, 25 bp, Homo sapien
atgtactgctctctgaatacttgaa

SEQ ID NO: 424495 - DNA, 25 bp, Homo sapien
ctgctctctgaatacttgaagaaat

SEQ ID NO: 424496 - DNA, 25 bp, Homo sapien
ttagttataccttttcacaatctta

SEQ ID NO: 424497 - DNA, 25 bp, Homo sapien
caatcttattacgatgttgccgtta

SEQ ID NO: 424498 - DNA, 25 bp, Homo sapien
acaggcaatgaatggtgggatagta

SEQ ID NO: 424499 - DNA, 25 bp, Homo sapien
atttgattaagttgacagtaggcac

SEQ ID NO: 424500 - DNA, 25 bp, Homo sapien
cagtaggcactgattggatgattaa

SEQ ID NO: 424501 - DNA, 25 bp, Homo sapien
acataagttaatctccactgtgata

SEQ ID NO: 424502 - DNA, 25 bp, Homo sapien
atctccactgtgataaaaacttaaa

SEQ ID NO: 424503 - DNA, 25 bp, Homo sapien
gcaggcccaggaccgcccctgtcag

SEQ ID NO: 424504 - DNA, 25 bp, Homo sapien
tgtcagtccccccaattttgtattc

SEQ ID NO: 424505 - DNA, 25 bp, Homo sapien
cagtccccccaattttgtattctgg

SEQ ID NO: 424506 - DNA, 25 bp, Homo sapien
ggaggagccctctcttcctgtggcc

SEQ ID NO: 424507 - DNA, 25 bp, Homo sapien
tcctctctcttttctgtgtcagttt

SEQ ID NO: 424508 - DNA, 25 bp, Homo sapien
ctctctcttttctgtgtcagtttct

SEQ ID NO: 424509 - DNA, 25 bp, Homo sapien
tctctcttttctgtgtcagtttctc

SEQ ID NO: 424510 - DNA, 25 bp, Homo sapien
ctcttttctgtgtcagtttctctcc

SEQ ID NO: 424511 - DNA, 25 bp, Homo sapien
tcttttctgtgtcagtttctctccc

SEQ ID NO: 424512 - DNA, 25 bp, Homo sapien
cttttctgtgtcagtttctctccct

SEQ ID NO: 424513 - DNA, 25 bp, Homo sapien
gctgatgccatctctggttctggac

SEQ ID NO: 424514 - DNA, 25 bp, Homo sapien
gattacaaatatgggccaccaccac

SEQ ID NO: 424515 - DNA, 25 bp, Homo sapien
tattgatttagtgtatgggaacctt

SEQ ID NO: 424516 - DNA, 25 bp, Homo sapien
tagtgtatgggaaccttagttaaat

SEQ ID NO: 424517 - DNA, 25 bp, Homo sapien
tgggaaccttagttaaatagcttgg

SEQ ID NO: 424518 - DNA, 25 bp, Homo sapien
tggggagggacttttgtaccatata

SEQ ID NO: 424519 - DNA, 25 bp, Homo sapien
atactaaaatccaaatgtcccacat

SEQ ID NO: 424520 - DNA, 25 bp, Homo sapien
aaatccaaatgtcccacatagtatt

SEQ ID NO: 424521 - DNA, 25 bp, Homo sapien
aaggctaattcttttctctgtgtcc

SEQ ID NO: 424522 - DNA, 25 bp, Homo sapien
ggctaattcttttctctgtgtcctt

SEQ ID NO: 424523 - DNA, 25 bp, Homo sapien
ttctctgtgtcctttaagcttaagg

SEQ ID NO: 424524 - DNA, 25 bp, Homo sapien
ctctgtgtcctttaagcttaaggaa

SEQ ID NO: 424525 - DNA, 25 bp, Homo sapien
caagatttgggttttggtctcagtc

SEQ ID NO: 424526 - DNA, 25 bp, Homo sapien
ggtctcagtctttgcttccttggac

SEQ ID NO: 424527 - DNA, 25 bp, Homo sapien
ttccttggacttgggtctcttttag

SEQ ID NO: 424528 - DNA, 25 bp, Homo sapien
agagactggttgttcttggtggcta

SEQ ID NO: 424529 - DNA, 25 bp, Homo sapien
tggtggctaggctgatttgcatcat

SEQ ID NO: 424530 - DNA, 25 bp, Homo sapien
aggtcccgtagttatcagctgcagg

SEQ ID NO: 424531 - DNA, 25 bp, Homo sapien
gagctatgtgacttgcttggaacca

SEQ ID NO: 424532 - DNA, 25 bp, Homo sapien
tgcttggaaccaatgccctgggata

SEQ ID NO: 424533 - DNA, 25 bp, Homo sapien
caatgccctgggataactttagtgt

SEQ ID NO: 424534 - DNA, 25 bp, Homo sapien
actttagtgttctgaatttccaact

SEQ ID NO: 424535 - DNA, 25 bp, Homo sapien
tttccaactaaaactgcagccaaaa

SEQ ID NO: 424536 - DNA, 25 bp, Homo sapien
gattacaaatatgggccaccaccac

SEQ ID NO: 424537 - DNA, 25 bp, Homo sapien
tattgatttagtgtatgggaacctt

SEQ ID NO: 424538 - DNA, 25 bp, Homo sapien
tagtgtatgggaaccttagttaaat

SEQ ID NO: 424539 - DNA, 25 bp, Homo sapien
tgggaaccttagttaaatagcttgg

SEQ ID NO: 424540 - DNA, 25 bp, Homo sapien
tggggagggacttttgtaccatata

SEQ ID NO: 424541 - DNA, 25 bp, Homo sapien
aatactaaaatccaaatgtcccaca

SEQ ID NO: 424542 - DNA, 25 bp, Homo sapien
actaaaatccaaatgtcccacatag

SEQ ID NO: 424543 - DNA, 25 bp, Homo sapien
aaatccaaatgtcccacatagtatt

SEQ ID NO: 424544 - DNA, 25 bp, Homo sapien
gtcaaataacatttaaaggctaatt

SEQ ID NO: 424545 - DNA, 25 bp, Homo sapien
ttctctgtgtcctttaagcttaagg

SEQ ID NO: 424546 - DNA, 25 bp, Homo sapien
ctctgtgtcctttaagcttaaggaa

SEQ ID NO: 424547 - DNA, 25 bp, Homo sapien
gaaactgtacatttgagcttatcac

SEQ ID NO: 424548 - DNA, 25 bp, Homo sapien
agcttatcactatcctgcccattat

SEQ ID NO: 424549 - DNA, 25 bp, Homo sapien
attatgccccaccatcaagtgaaga

SEQ ID NO: 424550 - DNA, 25 bp, Homo sapien
caagtgaagatgtgcaggactgcca

SEQ ID NO: 424551 - DNA, 25 bp, Homo sapien
tgcaggactgccatagaggtgctac

SEQ ID NO: 424552 - DNA, 25 bp, Homo sapien
tgaggactatgtgaggagacccaga

SEQ ID NO: 424553 - DNA, 25 bp, Homo sapien
gtaataactgtgattagcaccttct

SEQ ID NO: 424554 - DNA, 25 bp, Homo sapien
gtgattagcaccttctttattttga

SEQ ID NO: 424555 - DNA, 25 bp, Homo sapien
attttgattccccaggtgtgctgga

SEQ ID NO: 424556 - DNA, 25 bp, Homo sapien
tagaaacacacttagggccagacat

SEQ ID NO: 424557 - DNA, 25 bp, Homo sapien
acttagggccagacattgtgcctca

SEQ ID NO: 424558 - DNA, 25 bp, Homo sapien
ggtactcagtgccactcagttgtca

SEQ ID NO: 424559 - DNA, 25 bp, Homo sapien
agtgccactcagttgtcattgatcc

SEQ ID NO: 424560 - DNA, 25 bp, Homo sapien
ttgtcattgatcctgggctcttgca

SEQ ID NO: 424561 - DNA, 25 bp, Homo sapien
cctgggctcttgcaatgcacaaaat

SEQ ID NO: 424562 - DNA, 25 bp, Homo sapien
tttcaaacttttgtctcttgctctg

SEQ ID NO: 424563 - DNA, 25 bp, Homo sapien
aaacttttgtctcttgctctgcaaa

SEQ ID NO: 424564 - DNA, 25 bp, Homo sapien
cttgctctgcaaatcttttttccta

SEQ ID NO: 424565 - DNA, 25 bp, Homo sapien
tctgcaaatcttttttcctaacata

SEQ ID NO: 424566 - DNA, 25 bp, Homo sapien
tatttgctttatgctatgctataca

SEQ ID NO: 424567 - DNA, 25 bp, Homo sapien
aaatatgattattacggcttacaat

SEQ ID NO: 424568 - DNA, 25 bp, Homo sapien
tacggcttacaataaagtcactgaa

SEQ ID NO: 424569 - DNA, 25 bp, Homo sapien
tgagcactcgaactgtggctggtgc

SEQ ID NO: 424570 - DNA, 25 bp, Homo sapien
aatttttagtagctagtggctgcca

SEQ ID NO: 424571 - DNA, 25 bp, Homo sapien
tttttagtagctagtggctgccatc

SEQ ID NO: 424572 - DNA, 25 bp, Homo sapien
tttagtagctagtggctgccatcag

SEQ ID NO: 424573 - DNA, 25 bp, Homo sapien
agtagctagtggctgccatcagagt

SEQ ID NO: 424574 - DNA, 25 bp, Homo sapien
atttatattgtcttaatcttttctc

SEQ ID NO: 424575 - DNA, 25 bp, Homo sapien
tttgttgcccattcttggcttgaac

SEQ ID NO: 424576 - DNA, 25 bp, Homo sapien
ttgcccattcttggcttgaactcct

SEQ ID NO: 424577 - DNA, 25 bp, Homo sapien
gtggctggtgcaaccaaggaaccga

SEQ ID NO: 424578 - DNA, 25 bp, Homo sapien
gctggtgcaaccaaggaaccgaatt

SEQ ID NO: 424579 - DNA, 25 bp, Homo sapien
tggtgcaaccaaggaaccgaatttt

SEQ ID NO: 424580 - DNA, 25 bp, Homo sapien
aaccagccacaggagcacagcataa

SEQ ID NO: 424581 - DNA, 25 bp, Homo sapien
agcataagtgacatcctcacgacct

SEQ ID NO: 424582 - DNA, 25 bp, Homo sapien
agtgcccctaatcccagaggtagtg

SEQ ID NO: 424583 - DNA, 25 bp, Homo sapien
agaggtagtggagcttccaccgtca

SEQ ID NO: 424584 - DNA, 25 bp, Homo sapien
gcccaggagctctccttgtgtacat

SEQ ID NO: 424585 - DNA, 25 bp, Homo sapien
tgtgtacatcatcatggttccccag

SEQ ID NO: 424586 - DNA, 25 bp, Homo sapien
gttccccaggagtggatttaccagt

SEQ ID NO: 424587 - DNA, 25 bp, Homo sapien
gatttaccagttaccataccagaag

SEQ ID NO: 424588 - DNA, 25 bp, Homo sapien
agaagtttcttcagtccctgatcag

SEQ ID NO: 424589 - DNA, 25 bp, Homo sapien
gaggctcatcaggacttgtaaacag

SEQ ID NO: 424590 - DNA, 25 bp, Homo sapien
agagctatgaccactcaaggcacca

SEQ ID NO: 424591 - DNA, 25 bp, Homo sapien
ggcttcccttctgggatggagccct

SEQ ID NO: 424592 - DNA, 25 bp, Homo sapien
cttctgggatggagccctgcacagg

SEQ ID NO: 424593 - DNA, 25 bp, Homo sapien
tttggtataagtgggccccttgact

SEQ ID NO: 424594 - DNA, 25 bp, Homo sapien
aagtgggccccttgacttggtctgg

SEQ ID NO: 424595 - DNA, 25 bp, Homo sapien
tctcttcttctcatatttttcctgg

SEQ ID NO: 424596 - DNA, 25 bp, Homo sapien
cttcactttctgaggatccctggaa

SEQ ID NO: 424597 - DNA, 25 bp, Homo sapien
ggtactaaagatgtccgagcatcaa

SEQ ID NO: 424598 - DNA, 25 bp, Homo sapien
gagcatcaaacagacccaaccaaat

SEQ ID NO: 424599 - DNA, 25 bp, Homo sapien
aaccaaatcttccggcaaacctcat

SEQ ID NO: 424600 - DNA, 25 bp, Homo sapien
atttccacgggattgcaggaatact

SEQ ID NO: 424601 - DNA, 25 bp, Homo sapien
gtcatggagattgacttgacacgat

SEQ ID NO: 424602 - DNA, 25 bp, Homo sapien
ccaggagtgtaacatcaagcaccga

SEQ ID NO: 424603 - DNA, 25 bp, Homo sapien
caggagtgtaacatcaagcaccgag

SEQ ID NO: 424604 - DNA, 25 bp, Homo sapien
aggagtgtaacatcaagcaccgagg

SEQ ID NO: 424605 - DNA, 25 bp, Homo sapien
ggagtgtaacatcaagcaccgagga

SEQ ID NO: 424606 - DNA, 25 bp, Homo sapien
gagtgtaacatcaagcaccgaggac

SEQ ID NO: 424607 - DNA, 25 bp, Homo sapien
gagatgtgcactgagggactgttgg

SEQ ID NO: 424608 - DNA, 25 bp, Homo sapien
agatgtgcactgagggactgttggc

SEQ ID NO: 424609 - DNA, 25 bp, Homo sapien
gatgtgcactgagggactgttggcc

SEQ ID NO: 424610 - DNA, 25 bp, Homo sapien
tgtgcactgagggactgttggcccc

SEQ ID NO: 424611 - DNA, 25 bp, Homo sapien
gtgcactgagggactgttggcccct

SEQ ID NO: 424612 - DNA, 25 bp, Homo sapien
gcactgagggactgttggcccctgt

SEQ ID NO: 424613 - DNA, 25 bp, Homo sapien
gagagccttcaggtgagaacgccta

SEQ ID NO: 424614 - DNA, 25 bp, Homo sapien
gagccttcaggtgagaacgcctagt

SEQ ID NO: 424615 - DNA, 25 bp, Homo sapien
cttcaggtgagaacgcctagtccaa

SEQ ID NO: 424616 - DNA, 25 bp, Homo sapien
ggtgagaacgcctagtccaagttgg

SEQ ID NO: 424617 - DNA, 25 bp, Homo sapien
gagaacgcctagtccaagttggcct

SEQ ID NO: 424618 - DNA, 25 bp, Homo sapien
aacgcctagtccaagttggccttca

SEQ ID NO: 424619 - DNA, 25 bp, Homo sapien
gtccaagttggccttcagctctttg

SEQ ID NO: 424620 - DNA, 25 bp, Homo sapien
ttcagctctttgcagctactctcag

SEQ ID NO: 424621 - DNA, 25 bp, Homo sapien
tttgcagctactctcagctgtgacc

SEQ ID NO: 424622 - DNA, 25 bp, Homo sapien
atttcatgggagttttgatttttct

SEQ ID NO: 424623 - DNA, 25 bp, Homo sapien
gggatttttatatacaccatttgtt

SEQ ID NO: 424624 - DNA, 25 bp, Homo sapien
atttccccacaagatctgaagtttg

SEQ ID NO: 424625 - DNA, 25 bp, Homo sapien
tccccacaagatctgaagtttggta

SEQ ID NO: 424626 - DNA, 25 bp, Homo sapien
gatctgaagtttggtatttttgcat

SEQ ID NO: 424627 - DNA, 25 bp, Homo sapien
gtttggtatttttgcattatgacag

SEQ ID NO: 424628 - DNA, 25 bp, Homo sapien
gcattatgacagttgttgagactag

SEQ ID NO: 424629 - DNA, 25 bp, Homo sapien
aactgaaggcagaatggaactaata

SEQ ID NO: 424630 - DNA, 25 bp, Homo sapien
gttgttgagactaggattttaagct

SEQ ID NO: 424631 - DNA, 25 bp, Homo sapien
taagctaggatatgattatatttcc

SEQ ID NO: 424632 - DNA, 25 bp, Homo sapien
atggaactaatatatgtaacagaga

SEQ ID NO: 424633 - DNA, 25 bp, Homo sapien
tgaacttgttttatatttgcatatc

SEQ ID NO: 424634 - DNA, 25 bp, Homo sapien
tcaagagtcaagtatgatgtttttt

SEQ ID NO: 424635 - DNA, 25 bp, Homo sapien
tcccagggcagaagtcatctgaggc

SEQ ID NO: 424636 - DNA, 25 bp, Homo sapien
gaagtcatctgaggcctccgggagg

SEQ ID NO: 424637 - DNA, 25 bp, Homo sapien
tccgggaggcagacgggcaggatcc

SEQ ID NO: 424638 - DNA, 25 bp, Homo sapien
gcaggatccggctggagagggtcac

SEQ ID NO: 424639 - DNA, 25 bp, Homo sapien
gggacactgagctccaccagggcga

SEQ ID NO: 424640 - DNA, 25 bp, Homo sapien
actgagctccaccagggcgatgtcc

SEQ ID NO: 424641 - DNA, 25 bp, Homo sapien
agtgcaggatgatctgcctcacggt

SEQ ID NO: 424642 - DNA, 25 bp, Homo sapien
gagacaaagtgatctccagttcccc

SEQ ID NO: 424643 - DNA, 25 bp, Homo sapien
ccaggtgcacctggtagtcggatga

SEQ ID NO: 424644 - DNA, 25 bp, Homo sapien
tgcacctggtagtcggatgagttca

SEQ ID NO: 424645 - DNA, 25 bp, Homo sapien
atgagttcagggacccggagaagca

SEQ ID NO: 424646 - DNA, 25 bp, Homo sapien
gaaagtctaggacaaccttttatgt

SEQ ID NO: 424647 - DNA, 25 bp, Homo sapien
caaccttttatgtttgaaattctca

SEQ ID NO: 424648 - DNA, 25 bp, Homo sapien
gaaattctcaaatatccctaccaga

SEQ ID NO: 424649 - DNA, 25 bp, Homo sapien
atatccctaccagaagaggcacagg

SEQ ID NO: 424650 - DNA, 25 bp, Homo sapien
agaagaggcacaggctagcatggat

SEQ ID NO: 424651 - DNA, 25 bp, Homo sapien
ggctagcatggatgattccaaacaa

SEQ ID NO: 424652 - DNA, 25 bp, Homo sapien
acaagggattgagaagtcacttcca

SEQ ID NO: 424653 - DNA, 25 bp, Homo sapien
gtcacttccactggttttaaggtga

SEQ ID NO: 424654 - DNA, 25 bp, Homo sapien
gtgaatggcatggaggtacccactc

SEQ ID NO: 424655 - DNA, 25 bp, Homo sapien
cccattaaatttaccttcaagcctg

SEQ ID NO: 424656 - DNA, 25 bp, Homo sapien
atttaccttcaagcctggtgtggtg

SEQ ID NO: 424657 - DNA, 25 bp, Homo sapien
aatttgcatttttccaacattgaag

SEQ ID NO: 424658 - DNA, 25 bp, Homo sapien
gcatttttccaacattgaaggtatt

SEQ ID NO: 424659 - DNA, 25 bp, Homo sapien
aagtcactaagagattcattctttt

SEQ ID NO: 424660 - DNA, 25 bp, Homo sapien
cttctgtaagtatgtattgctatga

SEQ ID NO: 424661 - DNA, 25 bp, Homo sapien
atttcattactgttactgggtgcca

SEQ ID NO: 424662 - DNA, 25 bp, Homo sapien
ttcattactgttactgggtgccaag

SEQ ID NO: 424663 - DNA, 25 bp, Homo sapien
attactgttactgggtgccaagtgt

SEQ ID NO: 424664 - DNA, 25 bp, Homo sapien
gggtgccaagtgtctttcatttgga

SEQ ID NO: 424665 - DNA, 25 bp, Homo sapien
ttcatttggaagtgaacttactcca

SEQ ID NO: 424666 - DNA, 25 bp, Homo sapien
ggaagtgaacttactccagttattg

SEQ ID NO: 424667 - DNA, 25 bp, Homo sapien
actccagttattgaatgtttatcat

SEQ ID NO: 424668 - DNA, 25 bp, Homo sapien
gctagtgacaatgtgtttcctgtgc

SEQ ID NO: 424669 - DNA, 25 bp, Homo sapien
gtgtttcctgtgcactcgtgaaaat

SEQ ID NO: 424670 - DNA, 25 bp, Homo sapien
agggaggacaactgcatgcttagat

SEQ ID NO: 424671 - DNA, 25 bp, Homo sapien
tgcatgcttagatctgtttcttttt

SEQ ID NO: 424672 - DNA, 25 bp, Homo sapien
acaattagtcattggttttctgtac

SEQ ID NO: 424673 - DNA, 25 bp, Homo sapien
ctgtactgctatgaatatgtctgat

SEQ ID NO: 424674 - DNA, 25 bp, Homo sapien
atgtctgatttcaagttttggtcaa

SEQ ID NO: 424675 - DNA, 25 bp, Homo sapien
gcaaggtgaaagtgcctttgtctct

SEQ ID NO: 424676 - DNA, 25 bp, Homo sapien
gcctttgtctctatgcttctaaaat

SEQ ID NO: 424677 - DNA, 25 bp, Homo sapien
aaatcgctcatgcttagttgtggta

SEQ ID NO: 424678 - DNA, 25 bp, Homo sapien
ttgtggtatggatgtcttccgcagt

SEQ ID NO: 424679 - DNA, 25 bp, Homo sapien
gtcaggactgatgaggtaaacttca

SEQ ID NO: 424680 - DNA, 25 bp, Homo sapien
aaacttcagactggccaatcgtgaa

SEQ ID NO: 424681 - DNA, 25 bp, Homo sapien
ctggccaatcgtgaagagcatagtt

SEQ ID NO: 424682 - DNA, 25 bp, Homo sapien
gagcatagttcgattttcctcgata

SEQ ID NO: 424683 - DNA, 25 bp, Homo sapien
ttcctcgatatctgtgggctgcaca

SEQ ID NO: 424684 - DNA, 25 bp, Homo sapien
gggctgcacaatattgtgtccgcta

SEQ ID NO: 424685 - DNA, 25 bp, Homo sapien
attgtgtccgctaatgaggtggttc

SEQ ID NO: 424686 - DNA, 25 bp, Homo sapien
gaggtggttctcaatgtcgctctcc

SEQ ID NO: 424687 - DNA, 25 bp, Homo sapien
gtcgctctcctcgaaggagctgaag

SEQ ID NO: 424688 - DNA, 25 bp, Homo sapien
gaagactcccgacagataaacccaa

SEQ ID NO: 424689 - DNA, 25 bp, Homo sapien
ggtccacgtgtctgatgccctgaga

SEQ ID NO: 424690 - DNA, 25 bp, Homo sapien
gaactatccagtataaatgtcagaa

SEQ ID NO: 424691 - DNA, 25 bp, Homo sapien
cagaagacagatttcctaaacaagt

SEQ ID NO: 424692 - DNA, 25 bp, Homo sapien
atcattttttaccacttttacagcg

SEQ ID NO: 424693 - DNA, 25 bp, Homo sapien
tttacagcggtgtttcaagcggact

SEQ ID NO: 424694 - DNA, 25 bp, Homo sapien
gtttcaagcggactgtcactcagat

SEQ ID NO: 424695 - DNA, 25 bp, Homo sapien
actgtcactcagatctgcagagatg

SEQ ID NO: 424696 - DNA, 25 bp, Homo sapien
ttttttcaactaccgcaaagctata

SEQ ID NO: 424697 - DNA, 25 bp, Homo sapien
taccgcaaagctatacagatttttt

SEQ ID NO: 424698 - DNA, 25 bp, Homo sapien
acttgtggatcttttgtacttctca

SEQ ID NO: 424699 - DNA, 25 bp, Homo sapien
ggatcttttgtacttctcataacct

SEQ ID NO: 424700 - DNA, 25 bp, Homo sapien
gtacttctcataacctaatgtcaga

SEQ ID NO: 424701 - DNA, 25 bp, Homo sapien
gccatggagtctgctggaggcacca

SEQ ID NO: 424702 - DNA, 25 bp, Homo sapien
ggaggcaccatatcagcctgcggga

SEQ ID NO: 424703 - DNA, 25 bp, Homo sapien
accatatcagcctgcgggactaggg

SEQ ID NO: 424704 - DNA, 25 bp, Homo sapien
ggtctggacagttcaagtgtgatgc

SEQ ID NO: 424705 - DNA, 25 bp, Homo sapien
agttcaagtgtgatgcagctgtggc

SEQ ID NO: 424706 - DNA, 25 bp, Homo sapien
tggcaaggagaaatccttccgcctc

SEQ ID NO: 424707 - DNA, 25 bp, Homo sapien
gggacatggccagctgacggacaac

SEQ ID NO: 424708 - DNA, 25 bp, Homo sapien
ggccagctgacggacaactgagtct

SEQ ID NO: 424709 - DNA, 25 bp, Homo sapien
gacggacaactgagtctccggccca

SEQ ID NO: 424710 - DNA, 25 bp, Homo sapien
caaagtgtgcagagggctcagcaga

SEQ ID NO: 424711 - DNA, 25 bp, Homo sapien
tgcagagggctcagcagagaacagt

SEQ ID NO: 424712 - DNA, 25 bp, Homo sapien
cccaagcagactaagacaccatgtt

SEQ ID NO: 424713 - DNA, 25 bp, Homo sapien
gactaagacaccatgttcagacaga

SEQ ID NO: 424714 - DNA, 25 bp, Homo sapien
gacaccatgttcagacagaatttga

SEQ ID NO: 424715 - DNA, 25 bp, Homo sapien
attacttttaagtttgcaccagaat

SEQ ID NO: 424716 - DNA, 25 bp, Homo sapien
aaagcaggtgtagagtttgtaggaa

SEQ ID NO: 424717 - DNA, 25 bp, Homo sapien
tagagtttgtaggaaacctttatgt

SEQ ID NO: 424718 - DNA, 25 bp, Homo sapien
gttatttaatccctgtaatcatggt

SEQ ID NO: 424719 - DNA, 25 bp, Homo sapien
taatccctgtaatcatggtaccctc

SEQ ID NO: 424720 - DNA, 25 bp, Homo sapien
ctgtaatcatggtaccctcttgaga

SEQ ID NO: 424721 - DNA, 25 bp, Homo sapien
aatcatggtaccctcttgagagttt

SEQ ID NO: 424722 - DNA, 25 bp, Homo sapien
tttaactcactcatgatttttttca

SEQ ID NO: 424723 - DNA, 25 bp, Homo sapien
cttgggtttttgtgatgtaggaaat

SEQ ID NO: 424724 - DNA, 25 bp, Homo sapien
gtaggaaatggtttccatctgtact

SEQ ID NO: 424725 - DNA, 25 bp, Homo sapien
atggtttccatctgtactttggtcc

SEQ ID NO: 424726 - DNA, 25 bp, Homo sapien
ttccatctgtactttggtcctctga

SEQ ID NO: 424727 - DNA, 25 bp, Homo sapien
tctgtactttggtcctctgatttca

SEQ ID NO: 424728 - DNA, 25 bp, Homo sapien
atattgcaacctagtactttattag

SEQ ID NO: 424729 - DNA, 25 bp, Homo sapien
tgcaacctagtactttattagttta

SEQ ID NO: 424730 - DNA, 25 bp, Homo sapien
ggttgttcaaagtttaagcaattca

SEQ ID NO: 424731 - DNA, 25 bp, Homo sapien
caattcattctctctgaacacacat

SEQ ID NO: 424732 - DNA, 25 bp, Homo sapien
cattctctctgaacacacattgcta

SEQ ID NO: 424733 - DNA, 25 bp, Homo sapien
ctgaacacacattgctattcccatc

SEQ ID NO: 424734 - DNA, 25 bp, Homo sapien
actgtgccgggcctcaaatattttc

SEQ ID NO: 424735 - DNA, 25 bp, Homo sapien
tgtgccgggcctcaaatattttctc

SEQ ID NO: 424736 - DNA, 25 bp, Homo sapien
gtgccgggcctcaaatattttctct

SEQ ID NO: 424737 - DNA, 25 bp, Homo sapien
tgttctcttgattaaagttgttagg

SEQ ID NO: 424738 - DNA, 25 bp, Homo sapien
gaatgtgttaatttcttccactgtg

SEQ ID NO: 424739 - DNA, 25 bp, Homo sapien
gtgttaatttcttccactgtgattg

SEQ ID NO: 424740 - DNA, 25 bp, Homo sapien
gttaatttcttccactgtgattgtg

SEQ ID NO: 424741 - DNA, 25 bp, Homo sapien
aatttcttccactgtgattgtgttt

SEQ ID NO: 424742 - DNA, 25 bp, Homo sapien
gtattttcttgcattatgccatgga

SEQ ID NO: 424743 - DNA, 25 bp, Homo sapien
atgccatggaaattgctggtttcct

SEQ ID NO: 424744 - DNA, 25 bp, Homo sapien
gaaattgctggtttcctaggtcaaa

SEQ ID NO: 424745 - DNA, 25 bp, Homo sapien
acaggcgcgggccatgatgcctggc

SEQ ID NO: 424746 - DNA, 25 bp, Homo sapien
gcgcgggccatgatgcctggctaat

SEQ ID NO: 424747 - DNA, 25 bp, Homo sapien
cgcgggccatgatgcctggctaatt

SEQ ID NO: 424748 - DNA, 25 bp, Homo sapien
caaccttgaccccaggacttaagcg

SEQ ID NO: 424749 - DNA, 25 bp, Homo sapien
accttgaccccaggacttaagcgat

SEQ ID NO: 424750 - DNA, 25 bp, Homo sapien
cttgaccccaggacttaagcgatcc

SEQ ID NO: 424751 - DNA, 25 bp, Homo sapien
ttgaccccaggacttaagcgatcct

SEQ ID NO: 424752 - DNA, 25 bp, Homo sapien
tgaccccaggacttaagcgatcctt

SEQ ID NO: 424753 - DNA, 25 bp, Homo sapien
gaccccaggacttaagcgatccttc

SEQ ID NO: 424754 - DNA, 25 bp, Homo sapien
gaccacaggcgtgggccatgatgcc

SEQ ID NO: 424755 - DNA, 25 bp, Homo sapien
gtgggccatgatgcctggctgattt

SEQ ID NO: 424756 - DNA, 25 bp, Homo sapien
aaatgggagattgaatcagagcccc

SEQ ID NO: 424757 - DNA, 25 bp, Homo sapien
gaatcagagccccagataaccagag

SEQ ID NO: 424758 - DNA, 25 bp, Homo sapien
ataaccagaggccaataccatccca

SEQ ID NO: 424759 - DNA, 25 bp, Homo sapien
aataccatcccatggtccacaagag

SEQ ID NO: 424760 - DNA, 25 bp, Homo sapien
ggtccacaagagtccctgggctgaa

SEQ ID NO: 424761 - DNA, 25 bp, Homo sapien
cctgggctgaatgtcaagggtgaat

SEQ ID NO: 424762 - DNA, 25 bp, Homo sapien
tgaacacagggcaggcatgttcctg

SEQ ID NO: 424763 - DNA, 25 bp, Homo sapien
cagtcagacaaggtcctgctgttga

SEQ ID NO: 424764 - DNA, 25 bp, Homo sapien
aaggtcctgctgttgaggagcccca

SEQ ID NO: 424765 - DNA, 25 bp, Homo sapien
gaggagccccagtctagatcaaaag

SEQ ID NO: 424766 - DNA, 25 bp, Homo sapien
aaggaggtaaacagcctctgggaca

SEQ ID NO: 424767 - DNA, 25 bp, Homo sapien
gggagcgaaagtttcttggtctcag

SEQ ID NO: 424768 - DNA, 25 bp, Homo sapien
gaaagtttcttggtctcagcttcat

SEQ ID NO: 424769 - DNA, 25 bp, Homo sapien
agtttcttggtctcagcttcatttc

SEQ ID NO: 424770 - DNA, 25 bp, Homo sapien
tggtctcagcttcatttccgtgaag

SEQ ID NO: 424771 - DNA, 25 bp, Homo sapien
gtggtaccagctcactccctgggaa

SEQ ID NO: 424772 - DNA, 25 bp, Homo sapien
taaggaggtagctcccagcactcaa

SEQ ID NO: 424773 - DNA, 25 bp, Homo sapien
gaggtagctcccagcactcaaccaa

SEQ ID NO: 424774 - DNA, 25 bp, Homo sapien
tgaccctccgctgcagaggattgag

SEQ ID NO: 424775 - DNA, 25 bp, Homo sapien
ccgctgcagaggattgaggcttaat

SEQ ID NO: 424776 - DNA, 25 bp, Homo sapien
gaggcttaattctgagctggccctt

SEQ ID NO: 424777 - DNA, 25 bp, Homo sapien
ttaattctgagctggccctttccag

SEQ ID NO: 424778 - DNA, 25 bp, Homo sapien
ggtttgtggttcacagctttcatcc

SEQ ID NO: 424779 - DNA, 25 bp, Homo sapien
gtggttcacagctttcatccaagct

SEQ ID NO: 424780 - DNA, 25 bp, Homo sapien
gttcacagctttcatccaagcttgg

SEQ ID NO: 424781 - DNA, 25 bp, Homo sapien
acagctttcatccaagcttggtgat

SEQ ID NO: 424782 - DNA, 25 bp, Homo sapien
atccaagcttggtgataatcaattt

SEQ ID NO: 424783 - DNA, 25 bp, Homo sapien
catttaaatctctgtactatgcatt

SEQ ID NO: 424784 - DNA, 25 bp, Homo sapien
gtactatgcatttttgtttcagttt

SEQ ID NO: 424785 - DNA, 25 bp, Homo sapien
aaagcaggccctatgactattgttt

SEQ ID NO: 424786 - DNA, 25 bp, Homo sapien
ggccctatgactattgttttcaaaa

SEQ ID NO: 424787 - DNA, 25 bp, Homo sapien
atttctttaacaggattgcacctat

SEQ ID NO: 424788 - DNA, 25 bp, Homo sapien
caggattgcacctatcaatttcttg

SEQ ID NO: 424789 - DNA, 25 bp, Homo sapien
tttcctgactgagaatcccttgctt

SEQ ID NO: 424790 - DNA, 25 bp, Homo sapien
tcccttgcttgcttagaatatctga

SEQ ID NO: 424791 - DNA, 25 bp, Homo sapien
gaatatctgacttcccattgaaatg

SEQ ID NO: 424792 - DNA, 25 bp, Homo sapien
gaaaatgtgttttcttatgtgactc

SEQ ID NO: 424793 - DNA, 25 bp, Homo sapien
gtgactctcattattggttccttta

SEQ ID NO: 424794 - DNA, 25 bp, Homo sapien
tcctttatcttagttgtgctacaat

SEQ ID NO: 424795 - DNA, 25 bp, Homo sapien
gtgctacaatataaggctggacctg

SEQ ID NO: 424796 - DNA, 25 bp, Homo sapien
ggctggacctgtaatacactatgta

SEQ ID NO: 424797 - DNA, 25 bp, Homo sapien
aaatgtgatcgatttgttttctaag

SEQ ID NO: 424798 - DNA, 25 bp, Homo sapien
gttttctaagtcctcctctatataa

SEQ ID NO: 424799 - DNA, 25 bp, Homo sapien
gtgacagaacctggttttcctgact

SEQ ID NO: 424800 - DNA, 25 bp, Homo sapien
aaatgcctatacagaaattaacaag

SEQ ID NO: 424801 - DNA, 25 bp, Homo sapien
aacactgctggaaactcgagatcct

SEQ ID NO: 424802 - DNA, 25 bp, Homo sapien
gaaactcgagatcctttctggtgat

SEQ ID NO: 424803 - DNA, 25 bp, Homo sapien
gaggcactgaaaagttaatcaccaa

SEQ ID NO: 424804 - DNA, 25 bp, Homo sapien
gaaaagttaatcaccaaagctgaaa

SEQ ID NO: 424805 - DNA, 25 bp, Homo sapien
aaagctgaaaagattagactggcaa

SEQ ID NO: 424806 - DNA, 25 bp, Homo sapien
agactggcaaagactcaacaagcga

SEQ ID NO: 424807 - DNA, 25 bp, Homo sapien
aacagttcacctcttaatacttcac

SEQ ID NO: 424808 - DNA, 25 bp, Homo sapien
aatacttcacaagatacttgagctg

SEQ ID NO: 424809 - DNA, 25 bp, Homo sapien
gatacttgagctgttcttgggagat

SEQ ID NO: 424810 - DNA, 25 bp, Homo sapien
agctgttcttgggagattcactttt

SEQ ID NO: 424811 - DNA, 25 bp, Homo sapien
atctctgtactatgcatttttgttt

SEQ ID NO: 424812 - DNA, 25 bp, Homo sapien
ctctgtactatgcatttttgtttca

SEQ ID NO: 424813 - DNA, 25 bp, Homo sapien
tactatgcatttttgtttcagtttg

SEQ ID NO: 424814 - DNA, 25 bp, Homo sapien
aaagcaggccctatgactattgttt

SEQ ID NO: 424815 - DNA, 25 bp, Homo sapien
agcaggccctatgactattgttttc

SEQ ID NO: 424816 - DNA, 25 bp, Homo sapien
gcaggccctatgactattgttttca

SEQ ID NO: 424817 - DNA, 25 bp, Homo sapien
aggccctatgactattgttttcaaa

SEQ ID NO: 424818 - DNA, 25 bp, Homo sapien
gccctatgactattgttttcaaaaa

SEQ ID NO: 424819 - DNA, 25 bp, Homo sapien
atttctttaacaggattgcacctat

SEQ ID NO: 424820 - DNA, 25 bp, Homo sapien
taacaggattgcacctatcaatttc

SEQ ID NO: 424821 - DNA, 25 bp, Homo sapien
caggattgcacctatcaatttcttg

SEQ ID NO: 424822 - DNA, 25 bp, Homo sapien
ttgttgctttaattaccaaggttat

SEQ ID NO: 424823 - DNA, 25 bp, Homo sapien
ttttaatctcaacactgacaaaatg

SEQ ID NO: 424824 - DNA, 25 bp, Homo sapien
aaaccaaatatctcttcctcaccat

SEQ ID NO: 424825 - DNA, 25 bp, Homo sapien
accatttctcaaggaggctgcctgt

SEQ ID NO: 424826 - DNA, 25 bp, Homo sapien
ggaggctgcctgttggaattgtttt

SEQ ID NO: 424827 - DNA, 25 bp, Homo sapien
gggaaggttgcccttatgccacata

SEQ ID NO: 424828 - DNA, 25 bp, Homo sapien
ggttgcccttatgccacatataata

SEQ ID NO: 424829 - DNA, 25 bp, Homo sapien
gccacatataataccaaattgcttt

SEQ ID NO: 424830 - DNA, 25 bp, Homo sapien
aaattgcttttttatgggctgccat

SEQ ID NO: 424831 - DNA, 25 bp, Homo sapien
atgggctgccataacctgaagggaa

SEQ ID NO: 424832 - DNA, 25 bp, Homo sapien
ggctgccataacctgaagggaaaaa

SEQ ID NO: 424833 - DNA, 25 bp, Homo sapien
tttcttatctgcctgttttgcaagc

SEQ ID NO: 424834 - DNA, 25 bp, Homo sapien
ttcttatctgcctgttttgcaagca

SEQ ID NO: 424835 - DNA, 25 bp, Homo sapien
tcttatctgcctgttttgcaagcac

SEQ ID NO: 424836 - DNA, 25 bp, Homo sapien
ttatctgcctgttttgcaagcacct

SEQ ID NO: 424837 - DNA, 25 bp, Homo sapien
tatctgcctgttttgcaagcacctt

SEQ ID NO: 424838 - DNA, 25 bp, Homo sapien
atctgcctgttttgcaagcaccttc

SEQ ID NO: 424839 - DNA, 25 bp, Homo sapien
tctgcctgttttgcaagcaccttct

SEQ ID NO: 424840 - DNA, 25 bp, Homo sapien
gcctgttttgcaagcaccttctcct

SEQ ID NO: 424841 - DNA, 25 bp, Homo sapien
aagcaccttctcctgtgtccttggg

SEQ ID NO: 424842 - DNA, 25 bp, Homo sapien
gcaccttctcctgtgtccttgggag

SEQ ID NO: 424843 - DNA, 25 bp, Homo sapien
cttctcctgtgtccttgggagccct

SEQ ID NO: 424844 - DNA, 25 bp, Homo sapien
ctgatcgggcaatgggaggtggcca

SEQ ID NO: 424845 - DNA, 25 bp, Homo sapien
agagtctggcctgccaggctcctct

SEQ ID NO: 424846 - DNA, 25 bp, Homo sapien
ggtgtgctgtgggtattcaccaccc

SEQ ID NO: 424847 - DNA, 25 bp, Homo sapien
tgtgggtattcaccaccctgggacc

SEQ ID NO: 424848 - DNA, 25 bp, Homo sapien
ttctgacctcatgagtgtcaaacgt

SEQ ID NO: 424849 - DNA, 25 bp, Homo sapien
acctcatgagtgtcaaacgtgcccc

SEQ ID NO: 424850 - DNA, 25 bp, Homo sapien
ccccagttccttaggagatgtcatg

SEQ ID NO: 424851 - DNA, 25 bp, Homo sapien
agttccttaggagatgtcatgacaa

SEQ ID NO: 424852 - DNA, 25 bp, Homo sapien
gatgtcatgacaacactacacgcac

SEQ ID NO: 424853 - DNA, 25 bp, Homo sapien
tgacaacactacacgcacccaataa

SEQ ID NO: 424854 - DNA, 25 bp, Homo sapien
acactacacgcacccaataaagcga

SEQ ID NO: 424855 - DNA, 25 bp, Homo sapien
ccccggccgcaggattcccacttgg

SEQ ID NO: 424856 - DNA, 25 bp, Homo sapien
agcacaaagtgaagtaagcacaggg

SEQ ID NO: 424857 - DNA, 25 bp, Homo sapien
ggactagaatcagtcccccatagca

SEQ ID NO: 424858 - DNA, 25 bp, Homo sapien
actagaatcagtcccccatagcaag

SEQ ID NO: 424859 - DNA, 25 bp, Homo sapien
gaatcagtcccccatagcaagcaca

SEQ ID NO: 424860 - DNA, 25 bp, Homo sapien
tcagtcccccatagcaagcacagaa

SEQ ID NO: 424861 - DNA, 25 bp, Homo sapien
agtcccccatagcaagcacagaaag

SEQ ID NO: 424862 - DNA, 25 bp, Homo sapien
gtcccccatagcaagcacagaaagg

SEQ ID NO: 424863 - DNA, 25 bp, Homo sapien
ccccatagcaagcacagaaaggagg

SEQ ID NO: 424864 - DNA, 25 bp, Homo sapien
cccatagcaagcacagaaaggagga

SEQ ID NO: 424865 - DNA, 25 bp, Homo sapien
ggaaggtccgcacctggggagagct

SEQ ID NO: 424866 - DNA, 25 bp, Homo sapien
taaactggtttgttgttaggcaatt

SEQ ID NO: 424867 - DNA, 25 bp, Homo sapien
gggacaataggcatcacaaagtagt

SEQ ID NO: 424868 - DNA, 25 bp, Homo sapien
cacaaagtagtttcagcttcatcag

SEQ ID NO: 424869 - DNA, 25 bp, Homo sapien
gtagtttcagcttcatcagtaaaga

SEQ ID NO: 424870 - DNA, 25 bp, Homo sapien
atgtatttaccaaaggtcccatgtc

SEQ ID NO: 424871 - DNA, 25 bp, Homo sapien
taccaaaggtcccatgtcaggtttc

SEQ ID NO: 424872 - DNA, 25 bp, Homo sapien
aaaggtcccatgtcaggtttcctag

SEQ ID NO: 424873 - DNA, 25 bp, Homo sapien
gtcccatgtcaggtttcctagattt

SEQ ID NO: 424874 - DNA, 25 bp, Homo sapien
gcatgaaaattacacattctgaggt

SEQ ID NO: 424875 - DNA, 25 bp, Homo sapien
acacattctgaggtaaagctctaag

SEQ ID NO: 424876 - DNA, 25 bp, Homo sapien
agctctaagaattcatcatctttta

SEQ ID NO: 424877 - DNA, 25 bp, Homo sapien
gggaaaggttctgcaagttgccatt

SEQ ID NO: 424878 - DNA, 25 bp, Homo sapien
agttgccattgtacaaatccagttt

SEQ ID NO: 424879 - DNA, 25 bp, Homo sapien
attcattgccgagagccctgcagaa

SEQ ID NO: 424880 - DNA, 25 bp, Homo sapien
gagccctgcagaatctcagagcaaa

SEQ ID NO: 424881 - DNA, 25 bp, Homo sapien
agcaaagtggctgtgtgttccgagc

SEQ ID NO: 424882 - DNA, 25 bp, Homo sapien
gagcctgacctgtggaccgtcttta

SEQ ID NO: 424883 - DNA, 25 bp, Homo sapien
ggaccgtctttaatgtcttctgcac

SEQ ID NO: 424884 - DNA, 25 bp, Homo sapien
aatgtcttctgcaccagtcctttta

SEQ ID NO: 424885 - DNA, 25 bp, Homo sapien
cagtccttttatgacgtgggctttt

SEQ ID NO: 424886 - DNA, 25 bp, Homo sapien
gttgcattgcaaactcaggtattat

SEQ ID NO: 424887 - DNA, 25 bp, Homo sapien
gtgtagctagcagcgtggagacatt

SEQ ID NO: 424888 - DNA, 25 bp, Homo sapien
tttacacttgttcggcttttttcat

SEQ ID NO: 424889 - DNA, 25 bp, Homo sapien
acacttgttcggcttttttcatcaa

SEQ ID NO: 424890 - DNA, 25 bp, Homo sapien
acttgttcggcttttttcatcaaca

SEQ ID NO: 424891 - DNA, 25 bp, Homo sapien
ggcttttttcatcaacaatttcata

SEQ ID NO: 424892 - DNA, 25 bp, Homo sapien
tcagattaaagaagagctctcagaa

SEQ ID NO: 424893 - DNA, 25 bp, Homo sapien
ccacctttctaaaccagaccaatgt

SEQ ID NO: 424894 - DNA, 25 bp, Homo sapien
atgtatttgatatcttatgcctccc

SEQ ID NO: 424895 - DNA, 25 bp, Homo sapien
gtatttgatatcttatgcctcccta

SEQ ID NO: 424896 - DNA, 25 bp, Homo sapien
atttgatatcttatgcctccctaaa

SEQ ID NO: 424897 - DNA, 25 bp, Homo sapien
tttgatatcttatgcctccctaaaa

SEQ ID NO: 424898 - DNA, 25 bp, Homo sapien
tgtaccttagccaccttgggcacat

SEQ ID NO: 424899 - DNA, 25 bp, Homo sapien
gggcccagtgttatttcttctgcat

SEQ ID NO: 424900 - DNA, 25 bp, Homo sapien
gcccagtgttatttcttctgcatcc

SEQ ID NO: 424901 - DNA, 25 bp, Homo sapien
ttctgcatccagctagccacttatc

SEQ ID NO: 424902 - DNA, 25 bp, Homo sapien
tccagctagccacttatcccaaggg

SEQ ID NO: 424903 - DNA, 25 bp, Homo sapien
aagactaccccgtcggtcattctgt

SEQ ID NO: 424904 - DNA, 25 bp, Homo sapien
taccccgtcggtcattctgttcctg

SEQ ID NO: 424905 - DNA, 25 bp, Homo sapien
gattcattttgagttgctttctgta

SEQ ID NO: 424906 - DNA, 25 bp, Homo sapien
tttgagttgctttctgtacatggtg

SEQ ID NO: 424907 - DNA, 25 bp, Homo sapien
agttgctttctgtacatggtgagac

SEQ ID NO: 424908 - DNA, 25 bp, Homo sapien
tgctttctgtacatggtgagacaca

SEQ ID NO: 424909 - DNA, 25 bp, Homo sapien
tttctgtacatggtgagacacaggg

SEQ ID NO: 424910 - DNA, 25 bp, Homo sapien
cagcagcttacgcaaacagaacctt

SEQ ID NO: 424911 - DNA, 25 bp, Homo sapien
agaaccttgacctccttgaacagtt

SEQ ID NO: 424912 - DNA, 25 bp, Homo sapien
ctccttgaacagttgcaggtggcaa

SEQ ID NO: 424913 - DNA, 25 bp, Homo sapien
gcaggtggcaaatggtaggatccaa

SEQ ID NO: 424914 - DNA, 25 bp, Homo sapien
ggatccaaagccttgaggccaccat

SEQ ID NO: 424915 - DNA, 25 bp, Homo sapien
gccaccattgagaagctcctgagca

SEQ ID NO: 424916 - DNA, 25 bp, Homo sapien
gaagcaggccatgcttaccttagaa

SEQ ID NO: 424917 - DNA, 25 bp, Homo sapien
cttagaactggagcggtcggccctg

SEQ ID NO: 424918 - DNA, 25 bp, Homo sapien
cagagcccagcgaccgggagcctga

SEQ ID NO: 424919 - DNA, 25 bp, Homo sapien
gagcctgagtgcacgcagcccgagc

SEQ ID NO: 424920 - DNA, 25 bp, Homo sapien
cacgggcgactgacagctctgcagg

SEQ ID NO: 424921 - DNA, 25 bp, Homo sapien
ccttcttccccatgttttatacaga

SEQ ID NO: 424922 - DNA, 25 bp, Homo sapien
tgttttatacagacggaccagaagc

SEQ ID NO: 424923 - DNA, 25 bp, Homo sapien
acagacggaccagaagccacctttt

SEQ ID NO: 424924 - DNA, 25 bp, Homo sapien
gggctccacacagactaacgtaggc

SEQ ID NO: 424925 - DNA, 25 bp, Homo sapien
ccacacagactaacgtaggcactat

SEQ ID NO: 424926 - DNA, 25 bp, Homo sapien
gtaggcactataaggaccagcccaa

SEQ ID NO: 424927 - DNA, 25 bp, Homo sapien
gaccaggggaccttgccttgactga

SEQ ID NO: 424928 - DNA, 25 bp, Homo sapien
ccttgactgaggcacttcacgagct

SEQ ID NO: 424929 - DNA, 25 bp, Homo sapien
gcacttcacgagctcagtgagaagg

SEQ ID NO: 424930 - DNA, 25 bp, Homo sapien
gtgagaagggccctgtattcacctc

SEQ ID NO: 424931 - DNA, 25 bp, Homo sapien
aagggccctgtattcacctccactg

SEQ ID NO: 424932 - DNA, 25 bp, Homo sapien
tcactgcccccttgagctaggtgga

SEQ ID NO: 424933 - DNA, 25 bp, Homo sapien
ttgagctaggtggattttctcttca

SEQ ID NO: 424934 - DNA, 25 bp, Homo sapien
ggattttctcttcatgacaagagta

SEQ ID NO: 424935 - DNA, 25 bp, Homo sapien
caagagtatttggtagggaaagcag

SEQ ID NO: 424936 - DNA, 25 bp, Homo sapien
accatcaacaccaacaagtttctgt

SEQ ID NO: 424937 - DNA, 25 bp, Homo sapien
acaccaacaagtttctgtgttcctt

SEQ ID NO: 424938 - DNA, 25 bp, Homo sapien
acaagtttctgtgttccttttacag

SEQ ID NO: 424939 - DNA, 25 bp, Homo sapien
aagtttctgtgttccttttacagca

SEQ ID NO: 424940 - DNA, 25 bp, Homo sapien
gtttctgtgttccttttacagcaaa

SEQ ID NO: 424941 - DNA, 25 bp, Homo sapien
ttctgtgttccttttacagcaaaag

SEQ ID NO: 424942 - DNA, 25 bp, Homo sapien
ttttagtgactttttgataatgtac

SEQ ID NO: 424943 - DNA, 25 bp, Homo sapien
ttctgaaacacacaccagccctgag

SEQ ID NO: 424944 - DNA, 25 bp, Homo sapien
gccctgagttctgggctcatttgaa

SEQ ID NO: 424945 - DNA, 25 bp, Homo sapien
agggccaaagccatagtgtccggtc

SEQ ID NO: 424946 - DNA, 25 bp, Homo sapien
aaagccatagtgtccggtcccaagg

SEQ ID NO: 424947 - DNA, 25 bp, Homo sapien
gtccggtcccaaggacaaggctctt

SEQ ID NO: 424948 - DNA, 25 bp, Homo sapien
aaggctcttccagtgctaggagagg

SEQ ID NO: 424949 - DNA, 25 bp, Homo sapien
tcagtcttggagtcctgttgggtga

SEQ ID NO: 424950 - DNA, 25 bp, Homo sapien
agatgggaaagagcctcaccagcag

SEQ ID NO: 424951 - DNA, 25 bp, Homo sapien
gagggtggcctcgacatcaaactgc

SEQ ID NO: 424952 - DNA, 25 bp, Homo sapien
atcaaactgcctggatttttctacc

SEQ ID NO: 424953 - DNA, 25 bp, Homo sapien
ggatttttctaccaccctgttacat

SEQ ID NO: 424954 - DNA, 25 bp, Homo sapien
agtccagccccgaacaggcctgtga

SEQ ID NO: 424955 - DNA, 25 bp, Homo sapien
ctgtgatcagcagccgggttcgaag

SEQ ID NO: 424956 - DNA, 25 bp, Homo sapien
agggccctgccttgacaaaagccag

SEQ ID NO: 424957 - DNA, 25 bp, Homo sapien
tgccttgacaaaagccaggacctca

SEQ ID NO: 424958 - DNA, 25 bp, Homo sapien
aggacctcagatgcagggcctggcc

SEQ ID NO: 424959 - DNA, 25 bp, Homo sapien
gcttgagctgagagagcctgtgcca

SEQ ID NO: 424960 - DNA, 25 bp, Homo sapien
ctgagagagcctgtgccaagctgtg

SEQ ID NO: 424961 - DNA, 25 bp, Homo sapien
ggctccgagtcagcagcagcatgga

SEQ ID NO: 424962 - DNA, 25 bp, Homo sapien
cagcatggatctgatgctcctggaa

SEQ ID NO: 424963 - DNA, 25 bp, Homo sapien
gatgctcctggaaacaagcacaggc

SEQ ID NO: 424964 - DNA, 25 bp, Homo sapien
caagcacaggcgtcaggagccagaa

SEQ ID NO: 424965 - DNA, 25 bp, Homo sapien
taaatgatggcgcttcctggacaat

SEQ ID NO: 424966 - DNA, 25 bp, Homo sapien
agtcactcctgtgcctgtggtagag

SEQ ID NO: 424967 - DNA, 25 bp, Homo sapien
ctgtgcctgtggtagagagccttca

SEQ ID NO: 424968 - DNA, 25 bp, Homo sapien
gagagccttcaggtgagaacgccta

SEQ ID NO: 424969 - DNA, 25 bp, Homo sapien
gagaacgcctagtccaagttggcct

SEQ ID NO: 424970 - DNA, 25 bp, Homo sapien
gtccaagttggccttcagctctttg

SEQ ID NO: 424971 - DNA, 25 bp, Homo sapien
ttcagctctttgcagctactctcag

SEQ ID NO: 424972 - DNA, 25 bp, Homo sapien
tttgcagctactctcagctgtgacc

SEQ ID NO: 424973 - DNA, 25 bp, Homo sapien
tcagctgtgacctggcatcatttca

SEQ ID NO: 424974 - DNA, 25 bp, Homo sapien
atttcatgggagttttgatttttct

SEQ ID NO: 424975 - DNA, 25 bp, Homo sapien
gggatttttatatacaccatttgtt

SEQ ID NO: 424976 - DNA, 25 bp, Homo sapien
gacatttggcaatgcaatggcaact

SEQ ID NO: 424977 - DNA, 25 bp, Homo sapien
atggcaacttttggttgtcgcagcc

SEQ ID NO: 424978 - DNA, 25 bp, Homo sapien
cgtagaggtcatggacgccgttaaa

SEQ ID NO: 424979 - DNA, 25 bp, Homo sapien
atggacgccgttaaacatcctacag

SEQ ID NO: 424980 - DNA, 25 bp, Homo sapien
gaccacgaagagttgtcttgctcaa

SEQ ID NO: 424981 - DNA, 25 bp, Homo sapien
gctcaaatatcaacagtgctgcagt

SEQ ID NO: 424982 - DNA, 25 bp, Homo sapien
agtgctgcagtgtagaaacttgatc

SEQ ID NO: 424983 - DNA, 25 bp, Homo sapien
gtagaaacttgatcgttggttttct

SEQ ID NO: 424984 - DNA, 25 bp, Homo sapien
tgcaaaactctcataaaaacctttc

SEQ ID NO: 424985 - DNA, 25 bp, Homo sapien
tttcctgtcattgattatatgcttg

SEQ ID NO: 424986 - DNA, 25 bp, Homo sapien
gattatatgcttgatacacccaaaa

SEQ ID NO: 424987 - DNA, 25 bp, Homo sapien
tcgggtgcatgtatataccgctact

SEQ ID NO: 424988 - DNA, 25 bp, Homo sapien
atgtatataccgctactgtgtcctc

SEQ ID NO: 424989 - DNA, 25 bp, Homo sapien
tgtcctcgccatcacctaaatgtga

SEQ ID NO: 424990 - DNA, 25 bp, Homo sapien
atgtgactcagtctgttccactgta

SEQ ID NO: 424991 - DNA, 25 bp, Homo sapien
agtctgttccactgtaatatgttgt

SEQ ID NO: 424992 - DNA, 25 bp, Homo sapien
ttattgttggtcttcttgcatcgat

SEQ ID NO: 424993 - DNA, 25 bp, Homo sapien
ggtcttcttgcatcgatgatccaac

SEQ ID NO: 424994 - DNA, 25 bp, Homo sapien
cgatgatccaacagcaacaccattt

SEQ ID NO: 424995 - DNA, 25 bp, Homo sapien
aactggcaatgtacagagtttactc

SEQ ID NO: 424996 - DNA, 25 bp, Homo sapien
aaacacatgatgatgcctctgggtc

SEQ ID NO: 424997 - DNA, 25 bp, Homo sapien
tgcctctgggtctgtatgagaccgt

SEQ ID NO: 424998 - DNA, 25 bp, Homo sapien
cctcaggtataactactgttctcat

SEQ ID NO: 424999 - DNA, 25 bp, Homo sapien
tcaggtataactactgttctcattc

SEQ ID NO: 425000 - DNA, 25 bp, Homo sapien
aggtataactactgttctcattctt

SEQ ID NO: 425001 - DNA, 25 bp, Homo sapien
ggtataactactgttctcattcttt

SEQ ID NO: 425002 - DNA, 25 bp, Homo sapien
tacctgttctaaacttcatatgagt

SEQ ID NO: 425003 - DNA, 25 bp, Homo sapien
cctgttctaaacttcatatgagtga

SEQ ID NO: 425004 - DNA, 25 bp, Homo sapien
ttattgctgagtattctttcgtatg

SEQ ID NO: 425005 - DNA, 25 bp, Homo sapien
attgctgagtattctttcgtatgaa

SEQ ID NO: 425006 - DNA, 25 bp, Homo sapien
gctgagtattctttcgtatgaatat

SEQ ID NO: 425007 - DNA, 25 bp, Homo sapien
gtattctttcgtatgaatatatcac

SEQ ID NO: 425008 - DNA, 25 bp, Homo sapien
ttgatggacactgggctctttctgc

SEQ ID NO: 425009 - DNA, 25 bp, Homo sapien
gacaatcattagcacagataaggca

SEQ ID NO: 425010 - DNA, 25 bp, Homo sapien
atcattagcacagataaggcagagt

SEQ ID NO: 425011 - DNA, 25 bp, Homo sapien
ttagcacagataaggcagagtatac

SEQ ID NO: 425012 - DNA, 25 bp, Homo sapien
gcacagataaggcagagtatacatt

SEQ ID NO: 425013 - DNA, 25 bp, Homo sapien
gataaggcagagtatacattttatg

SEQ ID NO: 425014 - DNA, 25 bp, Homo sapien
cactcctgtgcctgtggtagagagc

SEQ ID NO: 425015 - DNA, 25 bp, Homo sapien
actcctgtgcctgtggtagagagcc

SEQ ID NO: 425016 - DNA, 25 bp, Homo sapien
tcctgtgcctgtggtagagagcctt

SEQ ID NO: 425017 - DNA, 25 bp, Homo sapien
cctgtgcctgtggtagagagccttc

SEQ ID NO: 425018 - DNA, 25 bp, Homo sapien
ctgtgcctgtggtagagagccttca

SEQ ID NO: 425019 - DNA, 25 bp, Homo sapien
tgtgcctgtggtagagagccttcag

SEQ ID NO: 425020 - DNA, 25 bp, Homo sapien
ttctctttcatgcaagggatcatgg

SEQ ID NO: 425021 - DNA, 25 bp, Homo sapien
ttcagcaaccacctcaactcattga

SEQ ID NO: 425022 - DNA, 25 bp, Homo sapien
gccaacatccgtcaggaggatgcct

SEQ ID NO: 425023 - DNA, 25 bp, Homo sapien
ggaggatgcctttgataacaacagt

SEQ ID NO: 425024 - DNA, 25 bp, Homo sapien
acattgctgaagatggtggccagac

SEQ ID NO: 425025 - DNA, 25 bp, Homo sapien
gtggccagacaccatatgaagctac

SEQ ID NO: 425026 - DNA, 25 bp, Homo sapien
gcagcaaggctttcagtacccagct

SEQ ID NO: 425027 - DNA, 25 bp, Homo sapien
gtacccagctacaacagaagatctt

SEQ ID NO: 425028 - DNA, 25 bp, Homo sapien
tcttcctccactcacaaatgggtat

SEQ ID NO: 425029 - DNA, 25 bp, Homo sapien
gggtatccatcatcaatcagtgtgt

SEQ ID NO: 425030 - DNA, 25 bp, Homo sapien
aatcagtatcctaatgggtcagcca

SEQ ID NO: 425031 - DNA, 25 bp, Homo sapien
gtggattccggaagagcctacgcat

SEQ ID NO: 425032 - DNA, 25 bp, Homo sapien
gaagagcctacgcattctgcctctc

SEQ ID NO: 425033 - DNA, 25 bp, Homo sapien
tgcctctccgtgtgtctgcagcgac

SEQ ID NO: 425034 - DNA, 25 bp, Homo sapien
tgtctgcagcgacccgcgaccgagt

SEQ ID NO: 425035 - DNA, 25 bp, Homo sapien
gcttccgagaggcatctccaaacac

SEQ ID NO: 425036 - DNA, 25 bp, Homo sapien
acgcgccgtgggttgtcttctgact

SEQ ID NO: 425037 - DNA, 25 bp, Homo sapien
tgtcttctgactctgtcgcggtcga

SEQ ID NO: 425038 - DNA, 25 bp, Homo sapien
actctgtcgcggtcgaggcagagac

SEQ ID NO: 425039 - DNA, 25 bp, Homo sapien
aggcagagacgcgttttgggcaccg

SEQ ID NO: 425040 - DNA, 25 bp, Homo sapien
ttccctttcgccatctgtctctttt

SEQ ID NO: 425041 - DNA, 25 bp, Homo sapien
gtctgtctctgcgtggattccggaa

SEQ ID NO: 425042 - DNA, 25 bp, Homo sapien
ctctgtactgtgtgcggacccgcag

SEQ ID NO: 425043 - DNA, 25 bp, Homo sapien
gacggccagtaaagtggacttaact

SEQ ID NO: 425044 - DNA, 25 bp, Homo sapien
taactcccaaggtgtgtcgcgccgg

SEQ ID NO: 425045 - DNA, 25 bp, Homo sapien
tcccaaggtgtgtcgcgccggacac

SEQ ID NO: 425046 - DNA, 25 bp, Homo sapien
tggacatgctgcttccatgtgcagt

SEQ ID NO: 425047 - DNA, 25 bp, Homo sapien
tgcttctcgctgtctgtccttgttc

SEQ ID NO: 425048 - DNA, 25 bp, Homo sapien
cccgcaggttgcagagttgttgtct

SEQ ID NO: 425049 - DNA, 25 bp, Homo sapien
tgcagagttgttgtctgcagtccag

SEQ ID NO: 425050 - DNA, 25 bp, Homo sapien
tgttgtctgcagtccagtgtgggta

SEQ ID NO: 425051 - DNA, 25 bp, Homo sapien
cagtgtgggtagagcgatcggtgta

SEQ ID NO: 425052 - DNA, 25 bp, Homo sapien
gggttcctgcgctccttgtctcttc

SEQ ID NO: 425053 - DNA, 25 bp, Homo sapien
agacgaaaaaataagcgcagcatat

SEQ ID NO: 425054 - DNA, 25 bp, Homo sapien
gcgcagcatattgactaaagcacat

SEQ ID NO: 425055 - DNA, 25 bp, Homo sapien
gactaaagcacatttcttcctctat

SEQ ID NO: 425056 - DNA, 25 bp, Homo sapien
tcctctatagtttgggaactgtgtc

SEQ ID NO: 425057 - DNA, 25 bp, Homo sapien
gaactgtgtcacagtcggaccaata

SEQ ID NO: 425058 - DNA, 25 bp, Homo sapien
cagtcggaccaatatatggctctaa

SEQ ID NO: 425059 - DNA, 25 bp, Homo sapien
atggctctaaccaacatgtagcttt

SEQ ID NO: 425060 - DNA, 25 bp, Homo sapien
tttttggtcttcttaatttgaggat

SEQ ID NO: 425061 - DNA, 25 bp, Homo sapien
gaggatttagcattccagttgtcat

SEQ ID NO: 425062 - DNA, 25 bp, Homo sapien
tagcattccagttgtcatgtttgat

SEQ ID NO: 425063 - DNA, 25 bp, Homo sapien
gttgtcatgtttgatgccattctga

SEQ ID NO: 425064 - DNA, 25 bp, Homo sapien
tgatcactgtattcagctctgtcaa

SEQ ID NO: 425065 - DNA, 25 bp, Homo sapien
gatcactgtattcagctctgtcaag

SEQ ID NO: 425066 - DNA, 25 bp, Homo sapien
atcactgtattcagctctgtcaaga

SEQ ID NO: 425067 - DNA, 25 bp, Homo sapien
tcactgtattcagctctgtcaagaa

SEQ ID NO: 425068 - DNA, 25 bp, Homo sapien
actgtattcagctctgtcaagaatg

SEQ ID NO: 425069 - DNA, 25 bp, Homo sapien
tgtattcagctctgtcaagaatggt

SEQ ID NO: 425070 - DNA, 25 bp, Homo sapien
tattcagctctgtcaagaatggtcc

SEQ ID NO: 425071 - DNA, 25 bp, Homo sapien
ttcagctctgtcaagaatggtccag

SEQ ID NO: 425072 - DNA, 25 bp, Homo sapien
tcagctctgtcaagaatggtccagg

SEQ ID NO: 425073 - DNA, 25 bp, Homo sapien
agctctgtcaagaatggtccaggtt

SEQ ID NO: 425074 - DNA, 25 bp, Homo sapien
gctctgtcaagaatggtccaggttc

SEQ ID NO: 425075 - DNA, 25 bp, Homo sapien
tcctcagcgtggtggccgtctggct

SEQ ID NO: 425076 - DNA, 25 bp, Homo sapien
tgccactaccacatctgcaagacgg

SEQ ID NO: 425077 - DNA, 25 bp, Homo sapien
actaccacatctgcaagacggtgcg

SEQ ID NO: 425078 - DNA, 25 bp, Homo sapien
taccacatctgcaagacggtgcgcc

SEQ ID NO: 425079 - DNA, 25 bp, Homo sapien
acatctgcaagacggtgcgcctgtc

SEQ ID NO: 425080 - DNA, 25 bp, Homo sapien
atctgcaagacggtgcgcctgtcgg

SEQ ID NO: 425081 - DNA, 25 bp, Homo sapien
ctgcaagacggtgcgcctgtcggac

SEQ ID NO: 425082 - DNA, 25 bp, Homo sapien
aagacggtgcgcctgtcggacgtgc

SEQ ID NO: 425083 - DNA, 25 bp, Homo sapien
gcctgtcggacgtgcgcgtgcggcc

SEQ ID NO: 425084 - DNA, 25 bp, Homo sapien
gcgtgcggccggtgaacacctacgc

SEQ ID NO: 425085 - DNA, 25 bp, Homo sapien
cggtgaacacctacgcgcgcgtgct

SEQ ID NO: 425086 - DNA, 25 bp, Homo sapien
agagatattgtgtttgctgccagcc

SEQ ID NO: 425087 - DNA, 25 bp, Homo sapien
tttgctgccagcctctacttgtaga

SEQ ID NO: 425088 - DNA, 25 bp, Homo sapien
gtcagctaaaggaatgtgagatttt

SEQ ID NO: 425089 - DNA, 25 bp, Homo sapien
aattattgaccacctgtttgattac

SEQ ID NO: 425090 - DNA, 25 bp, Homo sapien
gaccacctgtttgattacagttgac

SEQ ID NO: 425091 - DNA, 25 bp, Homo sapien
tacaaatgcctgcaagtgtggattt

SEQ ID NO: 425092 - DNA, 25 bp, Homo sapien
gcaagtgtggatttggttctcccat

SEQ ID NO: 425093 - DNA, 25 bp, Homo sapien
agtgtggatttggttctcccataca

SEQ ID NO: 425094 - DNA, 25 bp, Homo sapien
tggatttggttctcccatacatttt

SEQ ID NO: 425095 - DNA, 25 bp, Homo sapien
aaatcaaacatcattcatagaaagc

SEQ ID NO: 425096 - DNA, 25 bp, Homo sapien
gtttatacataagcattacattttt

SEQ ID NO: 425097 - DNA, 25 bp, Homo sapien
aggcctcccagagaaggctggtgac

SEQ ID NO: 425098 - DNA, 25 bp, Homo sapien
gcctcccagagaaggctggtgacca

SEQ ID NO: 425099 - DNA, 25 bp, Homo sapien
agagaaggctggtgaccaggtccca

SEQ ID NO: 425100 - DNA, 25 bp, Homo sapien
tggtgaccaggtcccaggcgggcaa

SEQ ID NO: 425101 - DNA, 25 bp, Homo sapien
gagggacaccgggagagccaggagc

SEQ ID NO: 425102 - DNA, 25 bp, Homo sapien
agaactcatcacagaggctggcgtc

SEQ ID NO: 425103 - DNA, 25 bp, Homo sapien
actcatcacagaggctggcgtccag

SEQ ID NO: 425104 - DNA, 25 bp, Homo sapien
cccgggtcacgtgcagcaggaacaa

SEQ ID NO: 425105 - DNA, 25 bp, Homo sapien
agcaggaacaagcagccactctggg

SEQ ID NO: 425106 - DNA, 25 bp, Homo sapien
aagagggtgcccgtgttcttgcgaa

SEQ ID NO: 425107 - DNA, 25 bp, Homo sapien
agggtgcccgtgttcttgcgaaagc

SEQ ID NO: 425108 - DNA, 25 bp, Homo sapien
ggaaccaacatgtccaatggagtct

SEQ ID NO: 425109 - DNA, 25 bp, Homo sapien
atttgcatatgcaaaccacaagcaa

SEQ ID NO: 425110 - DNA, 25 bp, Homo sapien
acaagcaagcatgatcaaacagaca

SEQ ID NO: 425111 - DNA, 25 bp, Homo sapien
aaacagacaactgcgcgtgtccgag

SEQ ID NO: 425112 - DNA, 25 bp, Homo sapien
acaactgcgcgtgtccgaggacttt

SEQ ID NO: 425113 - DNA, 25 bp, Homo sapien
gtgtccgaggactttccagatctcc

SEQ ID NO: 425114 - DNA, 25 bp, Homo sapien
cttccaccaatcacttactaatctg

SEQ ID NO: 425115 - DNA, 25 bp, Homo sapien
cttactaatctgagaatccatcccc

SEQ ID NO: 425116 - DNA, 25 bp, Homo sapien
cactgccttaaagcctgcacaggaa

SEQ ID NO: 425117 - DNA, 25 bp, Homo sapien
ggaagacaaatttgagctggactca

SEQ ID NO: 425118 - DNA, 25 bp, Homo sapien
tgagctggactcagtgtctctttat

SEQ ID NO: 425119 - DNA, 25 bp, Homo sapien
gcaggattcgccgagtctgtagcct

SEQ ID NO: 425120 - DNA, 25 bp, Homo sapien
aggattcgccgagtctgtagcctcc

SEQ ID NO: 425121 - DNA, 25 bp, Homo sapien
acctccactgcacaactcgggcggg

SEQ ID NO: 425122 - DNA, 25 bp, Homo sapien
gactccgtggtttccgtatcgtcaa

SEQ ID NO: 425123 - DNA, 25 bp, Homo sapien
cttcccatcaactctttctgcttga

SEQ ID NO: 425124 - DNA, 25 bp, Homo sapien
ccatcaactctttctgcttgacaat

SEQ ID NO: 425125 - DNA, 25 bp, Homo sapien
caactctttctgcttgacaatgtag

SEQ ID NO: 425126 - DNA, 25 bp, Homo sapien
actctttctgcttgacaatgtagca

SEQ ID NO: 425127 - DNA, 25 bp, Homo sapien
tttttcctctccctgacaataaagt

SEQ ID NO: 425128 - DNA, 25 bp, Homo sapien
ttcctctccctgacaataaagtctg

SEQ ID NO: 425129 - DNA, 25 bp, Homo sapien
ctctccctgacaataaagtctgaat

SEQ ID NO: 425130 - DNA, 25 bp, Homo sapien
gccgaagagggcagatcccttgaac

SEQ ID NO: 425131 - DNA, 25 bp, Homo sapien
ccgaagagggcagatcccttgaacc

SEQ ID NO: 425132 - DNA, 25 bp, Homo sapien
cgaagagggcagatcccttgaaccc

SEQ ID NO: 425133 - DNA, 25 bp, Homo sapien
gaagagggcagatcccttgaaccca

SEQ ID NO: 425134 - DNA, 25 bp, Homo sapien
atctctacaaaatagttcgctgcgt

SEQ ID NO: 425135 - DNA, 25 bp, Homo sapien
tctctacaaaatagttcgctgcgtg

SEQ ID NO: 425136 - DNA, 25 bp, Homo sapien
ctctacaaaatagttcgctgcgtgt

SEQ ID NO: 425137 - DNA, 25 bp, Homo sapien
tctacaaaatagttcgctgcgtgtg

SEQ ID NO: 425138 - DNA, 25 bp, Homo sapien
ctacaaaatagttcgctgcgtgtgg

SEQ ID NO: 425139 - DNA, 25 bp, Homo sapien
tacaaaatagttcgctgcgtgtggt

SEQ ID NO: 425140 - DNA, 25 bp, Homo sapien
aaaatagttcgctgcgtgtggtggt

SEQ ID NO: 425141 - DNA, 25 bp, Homo sapien
gccttaccactgctaaatatctaca

SEQ ID NO: 425142 - DNA, 25 bp, Homo sapien
aatatctacacggttccctgttaag

SEQ ID NO: 425143 - DNA, 25 bp, Homo sapien
gactctcttgagaaatcctggataa

SEQ ID NO: 425144 - DNA, 25 bp, Homo sapien
agaatggagcatttttcctgcctct

SEQ ID NO: 425145 - DNA, 25 bp, Homo sapien
taagctttgctccactgcaatcttt

SEQ ID NO: 425146 - DNA, 25 bp, Homo sapien
actgcaatctttcacatgctgtgta

SEQ ID NO: 425147 - DNA, 25 bp, Homo sapien
ttcacatgctgtgtatccagagggt

SEQ ID NO: 425148 - DNA, 25 bp, Homo sapien
ggtgactgccagatagcttcttgaa

SEQ ID NO: 425149 - DNA, 25 bp, Homo sapien
aaacggtcattttcttgctgcgctt

SEQ ID NO: 425150 - DNA, 25 bp, Homo sapien
gcgctttctaacacccaacagagga

SEQ ID NO: 425151 - DNA, 25 bp, Homo sapien
gggagtttggctgacttatggtaaa

SEQ ID NO: 425152 - DNA, 25 bp, Homo sapien
gatttctgtcaagttcataaccagc

SEQ ID NO: 425153 - DNA, 25 bp, Homo sapien
agttcataaccagcttcatatttta

SEQ ID NO: 425154 - DNA, 25 bp, Homo sapien
cttcatattttaaaggcttcaggtt

SEQ ID NO: 425155 - DNA, 25 bp, Homo sapien
gtcaactgcatgcagctttgctgat

SEQ ID NO: 425156 - DNA, 25 bp, Homo sapien
atgaataattctctttgatgccatt

SEQ ID NO: 425157 - DNA, 25 bp, Homo sapien
aagacttcaatatctgttgcctgtc

SEQ ID NO: 425158 - DNA, 25 bp, Homo sapien
atatctgttgcctgtcatatttaag

SEQ ID NO: 425159 - DNA, 25 bp, Homo sapien
ctgtttctactctctgtatctgatt

SEQ ID NO: 425160 - DNA, 25 bp, Homo sapien
aaaactattcatacctggcttccag

SEQ ID NO: 425161 - DNA, 25 bp, Homo sapien
ctggcttccaggtaattgactttga

SEQ ID NO: 425162 - DNA, 25 bp, Homo sapien
tacaagcaaaggtcattgtgttttt

SEQ ID NO: 425163 - DNA, 25 bp, Homo sapien
aaaatgccctattgtaagttgttgg

SEQ ID NO: 425164 - DNA, 25 bp, Homo sapien
taagtaacactagtagctgttttga

SEQ ID NO: 425165 - DNA, 25 bp, Homo sapien
gaataacataggtgctcttcctcat

SEQ ID NO: 425166 - DNA, 25 bp, Homo sapien
atctcatctcctacaccgtggtgag

SEQ ID NO: 425167 - DNA, 25 bp, Homo sapien
ccgtggtgagcatacagagtgtcct

SEQ ID NO: 425168 - DNA, 25 bp, Homo sapien
gcatacagagtgtcctgatttgtgt

SEQ ID NO: 425169 - DNA, 25 bp, Homo sapien
aaaggatcatggtttttgctctact

SEQ ID NO: 425170 - DNA, 25 bp, Homo sapien
tcatggtttttgctctactttataa

SEQ ID NO: 425171 - DNA, 25 bp, Homo sapien
tgctctactttataatcaagacaag

SEQ ID NO: 425172 - DNA, 25 bp, Homo sapien
actgttttggaatgttggctgtaat

SEQ ID NO: 425173 - DNA, 25 bp, Homo sapien
gtaatgtaacagcaattttcataat

SEQ ID NO: 425174 - DNA, 25 bp, Homo sapien
catgcggagcttggctaagagaaac

SEQ ID NO: 425175 - DNA, 25 bp, Homo sapien
gaaaccagatcagaatgcaagctgt

SEQ ID NO: 425176 - DNA, 25 bp, Homo sapien
acactgctctctggtgggtttgggc

SEQ ID NO: 425177 - DNA, 25 bp, Homo sapien
tctctggtgggtttgggcagtccct

SEQ ID NO: 425178 - DNA, 25 bp, Homo sapien
ctggctctagtctctgctgcagatt

SEQ ID NO: 425179 - DNA, 25 bp, Homo sapien
tctgctgcagattctcaggaccaaa

SEQ ID NO: 425180 - DNA, 25 bp, Homo sapien
ttctcaggaccaaaatgtgggtgat

SEQ ID NO: 425181 - DNA, 25 bp, Homo sapien
gggtccaggcaggagacagaaatca

SEQ ID NO: 425182 - DNA, 25 bp, Homo sapien
gacagaaatcacacaagctctttta

SEQ ID NO: 425183 - DNA, 25 bp, Homo sapien
aaggtatccatggaggtagcaccac

SEQ ID NO: 425184 - DNA, 25 bp, Homo sapien
tatccatggaggtagcaccacagga

SEQ ID NO: 425185 - DNA, 25 bp, Homo sapien
tttgactttgttaagaaaggtggct

SEQ ID NO: 425186 - DNA, 25 bp, Homo sapien
tttgttaagaaaggtggctgggcac

SEQ ID NO: 425187 - DNA, 25 bp, Homo sapien
tcacttgagccgaggcggacgtttt

SEQ ID NO: 425188 - DNA, 25 bp, Homo sapien
cacttgagccgaggcggacgttttt

SEQ ID NO: 425189 - DNA, 25 bp, Homo sapien
acttgagccgaggcggacgtttttg

SEQ ID NO: 425190 - DNA, 25 bp, Homo sapien
gccgaggcggacgtttttgagatca

SEQ ID NO: 425191 - DNA, 25 bp, Homo sapien
ccgaggcggacgtttttgagatcag

SEQ ID NO: 425192 - DNA, 25 bp, Homo sapien
cgaggcggacgtttttgagatcagc

SEQ ID NO: 425193 - DNA, 25 bp, Homo sapien
gaggcggacgtttttgagatcagcc

SEQ ID NO: 425194 - DNA, 25 bp, Homo sapien
aggcggacgtttttgagatcagcct

SEQ ID NO: 425195 - DNA, 25 bp, Homo sapien
ggcggacgtttttgagatcagcctg

SEQ ID NO: 425196 - DNA, 25 bp, Homo sapien
cttcctgaccacctgactgcggaaa

SEQ ID NO: 425197 - DNA, 25 bp, Homo sapien
ttcctgaccacctgactgcggaaac

SEQ ID NO: 425198 - DNA, 25 bp, Homo sapien
cctgaccacctgactgcggaaacat

SEQ ID NO: 425199 - DNA, 25 bp, Homo sapien
ctgaccacctgactgcggaaacatc

SEQ ID NO: 425200 - DNA, 25 bp, Homo sapien
tgaccacctgactgcggaaacatcc

SEQ ID NO: 425201 - DNA, 25 bp, Homo sapien
gaccacctgactgcggaaacatcct

SEQ ID NO: 425202 - DNA, 25 bp, Homo sapien
ttatcgcatcctcccgggcgaaggc

SEQ ID NO: 425203 - DNA, 25 bp, Homo sapien
tggtgatggcactaagctgatttcc

SEQ ID NO: 425204 - DNA, 25 bp, Homo sapien
ggtgatggcactaagctgatttcct

SEQ ID NO: 425205 - DNA, 25 bp, Homo sapien
gtgatggcactaagctgatttcctc

SEQ ID NO: 425206 - DNA, 25 bp, Homo sapien
actaagctgatttcctcctctgcag

SEQ ID NO: 425207 - DNA, 25 bp, Homo sapien
ctgtacagtgtttaatagaggtgca

SEQ ID NO: 425208 - DNA, 25 bp, Homo sapien
gaggtgcataatcagctgttgttac

SEQ ID NO: 425209 - DNA, 25 bp, Homo sapien
gatttagttgtgagcatcctcccga

SEQ ID NO: 425210 - DNA, 25 bp, Homo sapien
tcccgatgcttcaagctgcatgcat

SEQ ID NO: 425211 - DNA, 25 bp, Homo sapien
caagctgcatgcattaacagacagt

SEQ ID NO: 425212 - DNA, 25 bp, Homo sapien
aagcatttataacggaatcaggcac

SEQ ID NO: 425213 - DNA, 25 bp, Homo sapien
gaatcaggcacaccttttccacgag

SEQ ID NO: 425214 - DNA, 25 bp, Homo sapien
acaccttttccacgagactcgagtg

SEQ ID NO: 425215 - DNA, 25 bp, Homo sapien
agactcgagtgtgctggcatttctc

SEQ ID NO: 425216 - DNA, 25 bp, Homo sapien
cctttcatctttagccctctgagta

SEQ ID NO: 425217 - DNA, 25 bp, Homo sapien
tagccctctgagtactttgaagcac

SEQ ID NO: 425218 - DNA, 25 bp, Homo sapien
accattcagcagagacacgatcaca

SEQ ID NO: 425219 - DNA, 25 bp, Homo sapien
agacacgatcacaccagttcagaga

SEQ ID NO: 425220 - DNA, 25 bp, Homo sapien
gttcagagagctacactttatgggt

SEQ ID NO: 425221 - DNA, 25 bp, Homo sapien
actttatgggtaacagtttcacctg

SEQ ID NO: 425222 - DNA, 25 bp, Homo sapien
gtttcacctgtgatacagttcccta

SEQ ID NO: 425223 - DNA, 25 bp, Homo sapien
tacagttccctagaacattttccca

SEQ ID NO: 425224 - DNA, 25 bp, Homo sapien
gaactgcaaagtgcttaggtttgac

SEQ ID NO: 425225 - DNA, 25 bp, Homo sapien
ggtttacactttgcagggtattctt

SEQ ID NO: 425226 - DNA, 25 bp, Homo sapien
tgctccttagtctgtgatctttgct

SEQ ID NO: 425227 - DNA, 25 bp, Homo sapien
gtgcacattacccagcctaattaaa

SEQ ID NO: 425228 - DNA, 25 bp, Homo sapien
gtgtggtggagccagctatccccac

SEQ ID NO: 425229 - DNA, 25 bp, Homo sapien
gtcttggacagacctcggtcagctc

SEQ ID NO: 425230 - DNA, 25 bp, Homo sapien
ggtcagctctggcacagtcaagaat

SEQ ID NO: 425231 - DNA, 25 bp, Homo sapien
tctggcacagtcaagaatccacctt

SEQ ID NO: 425232 - DNA, 25 bp, Homo sapien
aagaatccaccttgggcagttcttc

SEQ ID NO: 425233 - DNA, 25 bp, Homo sapien
ttgggcagttcttctttgagtctta

SEQ ID NO: 425234 - DNA, 25 bp, Homo sapien
gttcttctttgagtcttagccctaa

SEQ ID NO: 425235 - DNA, 25 bp, Homo sapien
ctttgagtcttagccctaatccctt

SEQ ID NO: 425236 - DNA, 25 bp, Homo sapien
tcaatccagtcaacacctactatgt

SEQ ID NO: 425237 - DNA, 25 bp, Homo sapien
ttggtctcatgagcgtcttttcagc

SEQ ID NO: 425238 - DNA, 25 bp, Homo sapien
catgagcgtcttttcagctttgtgg

SEQ ID NO: 425239 - DNA, 25 bp, Homo sapien
acccctctgtccctagattgtgtga

SEQ ID NO: 425240 - DNA, 25 bp, Homo sapien
gcttcccaagtctaagctctgtgac

SEQ ID NO: 425241 - DNA, 25 bp, Homo sapien
gctctgtgactttgcaccagtgtgt

SEQ ID NO: 425242 - DNA, 25 bp, Homo sapien
atgtgcaaggcccttcaagtggtct

SEQ ID NO: 425243 - DNA, 25 bp, Homo sapien
aagtggtctgaaaccgtggctctaa

SEQ ID NO: 425244 - DNA, 25 bp, Homo sapien
gtggctctaaaaaccacagctggtg

SEQ ID NO: 425245 - DNA, 25 bp, Homo sapien
gaggaggacagacacacttgccacc

SEQ ID NO: 425246 - DNA, 25 bp, Homo sapien
cttgcctacctaattgccatctaaa

SEQ ID NO: 425247 - DNA, 25 bp, Homo sapien
aattgccatctaaaatgggccgaac

SEQ ID NO: 425248 - DNA, 25 bp, Homo sapien
tgggccgaacagtggatttcacaat

SEQ ID NO: 425249 - DNA, 25 bp, Homo sapien
cacaatagagttttcaccctttaga

SEQ ID NO: 425250 - DNA, 25 bp, Homo sapien
acaacctgtcaggtggaaactgaag

SEQ ID NO: 425251 - DNA, 25 bp, Homo sapien
gctggaggcaccatatcagcctgcg

SEQ ID NO: 425252 - DNA, 25 bp, Homo sapien
ggaggcaccatatcagcctgcggga

SEQ ID NO: 425253 - DNA, 25 bp, Homo sapien
accatatcagcctgcgggactaggg

SEQ ID NO: 425254 - DNA, 25 bp, Homo sapien
gcaaacaggccagcggtggaggtct

SEQ ID NO: 425255 - DNA, 25 bp, Homo sapien
ggtctggacagttcaagtgtgatgc

SEQ ID NO: 425256 - DNA, 25 bp, Homo sapien
agttcaagtgtgatgcagctgtggc

SEQ ID NO: 425257 - DNA, 25 bp, Homo sapien
gggacatggccagctgacggacaac

SEQ ID NO: 425258 - DNA, 25 bp, Homo sapien
ggccagctgacggacaactgagtct

SEQ ID NO: 425259 - DNA, 25 bp, Homo sapien
gacggacaactgagtctccggccca

SEQ ID NO: 425260 - DNA, 25 bp, Homo sapien
caaagtgtgcagagggctcagcaga

SEQ ID NO: 425261 - DNA, 25 bp, Homo sapien
tgcagagggctcagcagagaacagt

SEQ ID NO: 425262 - DNA, 25 bp, Homo sapien
cagagcatccggaggttcacaacct

SEQ ID NO: 425263 - DNA, 25 bp, Homo sapien
gagcatccggaggttcacaacctct

SEQ ID NO: 425264 - DNA, 25 bp, Homo sapien
gcatccggaggttcacaacctctgt

SEQ ID NO: 425265 - DNA, 25 bp, Homo sapien
tccggaggttcacaacctctgtggt

SEQ ID NO: 425266 - DNA, 25 bp, Homo sapien
aggttcacaacctctgtggtccgta

SEQ ID NO: 425267 - DNA, 25 bp, Homo sapien
ggttcacaacctctgtggtccgtag

SEQ ID NO: 425268 - DNA, 25 bp, Homo sapien
ttcacaacctctgtggtccgtagga

SEQ ID NO: 425269 - DNA, 25 bp, Homo sapien
tcacaacctctgtggtccgtaggag

SEQ ID NO: 425270 - DNA, 25 bp, Homo sapien
acaacctctgtggtccgtaggagcc

SEQ ID NO: 425271 - DNA, 25 bp, Homo sapien
aacctctgtggtccgtaggagccac

SEQ ID NO: 425272 - DNA, 25 bp, Homo sapien
gagggccctgggaagaatttgccat

SEQ ID NO: 425273 - DNA, 25 bp, Homo sapien
gtttaatttgtggttggctgcaact

SEQ ID NO: 425274 - DNA, 25 bp, Homo sapien
ggctgcaactgtgtatcatgtatat

SEQ ID NO: 425275 - DNA, 25 bp, Homo sapien
aaaaaagttctcgacattcagatct

SEQ ID NO: 425276 - DNA, 25 bp, Homo sapien
accacttttattgcggtttgactgc

SEQ ID NO: 425277 - DNA, 25 bp, Homo sapien
tgcggtttgactgcattgagctcta

SEQ ID NO: 425278 - DNA, 25 bp, Homo sapien
gactgcattgagctctaggatatta

SEQ ID NO: 425279 - DNA, 25 bp, Homo sapien
ttttgcatgtaatttgctcatttga

SEQ ID NO: 425280 - DNA, 25 bp, Homo sapien
atttgctcatttgagtgagggcact

SEQ ID NO: 425281 - DNA, 25 bp, Homo sapien
agtgagggcactttttttgtacata

SEQ ID NO: 425282 - DNA, 25 bp, Homo sapien
gggccaatgcacaatacttttatca

SEQ ID NO: 425283 - DNA, 25 bp, Homo sapien
gcacaatacttttatcacaatcaac

SEQ ID NO: 425284 - DNA, 25 bp, Homo sapien
gtattacaatcacataggaccacca

SEQ ID NO: 425285 - DNA, 25 bp, Homo sapien
aatcacataggaccaccattttaca

SEQ ID NO: 425286 - DNA, 25 bp, Homo sapien
cataggaccaccattttacatgagg

SEQ ID NO: 425287 - DNA, 25 bp, Homo sapien
accattttacatgaggtccctcgtt

SEQ ID NO: 425288 - DNA, 25 bp, Homo sapien
catgaggtccctcgttgacagaaac

SEQ ID NO: 425289 - DNA, 25 bp, Homo sapien
ggtccctcgttgacagaaacactgt

SEQ ID NO: 425290 - DNA, 25 bp, Homo sapien
agaaacactgttacgcagagcgtga

SEQ ID NO: 425291 - DNA, 25 bp, Homo sapien
gttacgcagagcgtgactgcaccag

SEQ ID NO: 425292 - DNA, 25 bp, Homo sapien
cgcagagcgtgactgcaccagaatc

SEQ ID NO: 425293 - DNA, 25 bp, Homo sapien
ccagaatcatgggaaaactttcgta

SEQ ID NO: 425294 - DNA, 25 bp, Homo sapien
gtagtgaagaattttgggtgcccca

SEQ ID NO: 425295 - DNA, 25 bp, Homo sapien
gaaaaacttgcggagttgttgcttt

SEQ ID NO: 425296 - DNA, 25 bp, Homo sapien
cttgcggagttgttgctttggttac

SEQ ID NO: 425297 - DNA, 25 bp, Homo sapien
cggagttgttgctttggttacagag

SEQ ID NO: 425298 - DNA, 25 bp, Homo sapien
attcagatctttgtatttgcattaa

SEQ ID NO: 425299 - DNA, 25 bp, Homo sapien
tgtatttgcattaatgtctgagttt

SEQ ID NO: 425300 - DNA, 25 bp, Homo sapien
gtttggaataggttgtgaaccaata

SEQ ID NO: 425301 - DNA, 25 bp, Homo sapien
aaaagcaataggttaatcacagatt

SEQ ID NO: 425302 - DNA, 25 bp, Homo sapien
aggttaatcacagattaggctagga

SEQ ID NO: 425303 - DNA, 25 bp, Homo sapien
aagccatcacacatagttctttgaa

SEQ ID NO: 425304 - DNA, 25 bp, Homo sapien
atcacacatagttctttgaaagtaa

SEQ ID NO: 425305 - DNA, 25 bp, Homo sapien
gaaagtaaggtattatgagcatgta

SEQ ID NO: 425306 - DNA, 25 bp, Homo sapien
aattggtcaccttcaagcggagtct

SEQ ID NO: 425307 - DNA, 25 bp, Homo sapien
aagacacttggcctgacactctaaa

SEQ ID NO: 425308 - DNA, 25 bp, Homo sapien
taaaagggtcagcatcttccttgcc

SEQ ID NO: 425309 - DNA, 25 bp, Homo sapien
cttgcccacctccaaggagatttaa

SEQ ID NO: 425310 - DNA, 25 bp, Homo sapien
agatttaaatactccttcctgcgtg

SEQ ID NO: 425311 - DNA, 25 bp, Homo sapien
gctccagaacactaacttcatacct

SEQ ID NO: 425312 - DNA, 25 bp, Homo sapien
cttcatacctgtttacattctgcct

SEQ ID NO: 425313 - DNA, 25 bp, Homo sapien
tgtttacattctgccttcttcattt

SEQ ID NO: 425314 - DNA, 25 bp, Homo sapien
ttcttcatttaatccagctgctggg

SEQ ID NO: 425315 - DNA, 25 bp, Homo sapien
gcacaggccggcaagtgttagatga

SEQ ID NO: 425316 - DNA, 25 bp, Homo sapien
ggaacttgggccttgcaaactagaa

SEQ ID NO: 425317 - DNA, 25 bp, Homo sapien
aacacacttgttagctatgatccgg

SEQ ID NO: 425318 - DNA, 25 bp, Homo sapien
acacttgttagctatgatccggttc

SEQ ID NO: 425319 - DNA, 25 bp, Homo sapien
acttgttagctatgatccggttcca

SEQ ID NO: 425320 - DNA, 25 bp, Homo sapien
tgttagctatgatccggttccagag

SEQ ID NO: 425321 - DNA, 25 bp, Homo sapien
gctatgatccggttccagagcccaa

SEQ ID NO: 425322 - DNA, 25 bp, Homo sapien
aaacgattttgctagtgcagttggc

SEQ ID NO: 425323 - DNA, 25 bp, Homo sapien
attttgctagtgcagttggcatcct

SEQ ID NO: 425324 - DNA, 25 bp, Homo sapien
ttgctagtgcagttggcatcctaga

SEQ ID NO: 425325 - DNA, 25 bp, Homo sapien
tagtgcagttggcatcctagaggct

SEQ ID NO: 425326 - DNA, 25 bp, Homo sapien
cagttggcatcctagaggctgttaa

SEQ ID NO: 425327 - DNA, 25 bp, Homo sapien
gttggcatcctagaggctgttaagg

SEQ ID NO: 425328 - DNA, 25 bp, Homo sapien
agcaccaggtgcccgcgtactgagt

SEQ ID NO: 425329 - DNA, 25 bp, Homo sapien
caggtgcccgcgtactgagtccgcg

SEQ ID NO: 425330 - DNA, 25 bp, Homo sapien
aggtgcccgcgtactgagtccgcgc

SEQ ID NO: 425331 - DNA, 25 bp, Homo sapien
ggtgcccgcgtactgagtccgcgcg

SEQ ID NO: 425332 - DNA, 25 bp, Homo sapien
tgcccgcgtactgagtccgcgcgcg

SEQ ID NO: 425333 - DNA, 25 bp, Homo sapien
cccgagtgtgcccaggaactcagag

SEQ ID NO: 425334 - DNA, 25 bp, Homo sapien
ccgagtgtgcccaggaactcagaga

SEQ ID NO: 425335 - DNA, 25 bp, Homo sapien
cgagtgtgcccaggaactcagagag

SEQ ID NO: 425336 - DNA, 25 bp, Homo sapien
gagtgtgcccaggaactcagagagg

SEQ ID NO: 425337 - DNA, 25 bp, Homo sapien
cgagggtgcccaggactcggaaggg

SEQ ID NO: 425338 - DNA, 25 bp, Homo sapien
ggcgccccggactcgacaagctgga

SEQ ID NO: 425339 - DNA, 25 bp, Homo sapien
atgatgtctacctgccttgctgatg

SEQ ID NO: 425340 - DNA, 25 bp, Homo sapien
tgtctacctgccttgctgatgagta

SEQ ID NO: 425341 - DNA, 25 bp, Homo sapien
tacctgccttgctgatgagtaggat

SEQ ID NO: 425342 - DNA, 25 bp, Homo sapien
agtaggatgtgatttggctctttag

SEQ ID NO: 425343 - DNA, 25 bp, Homo sapien
gtgatttggctctttaggaaactga

SEQ ID NO: 425344 - DNA, 25 bp, Homo sapien
ggaaactgaatttgcagaacttaag

SEQ ID NO: 425345 - DNA, 25 bp, Homo sapien
aaagggcatggccattgacccagtc

SEQ ID NO: 425346 - DNA, 25 bp, Homo sapien
attgacccagtccatcttatgcaaa

SEQ ID NO: 425347 - DNA, 25 bp, Homo sapien
gacccagtccatcttatgcaaatct

SEQ ID NO: 425348 - DNA, 25 bp, Homo sapien
atcttatgcaaatctggatgccata

SEQ ID NO: 425349 - DNA, 25 bp, Homo sapien
gtgagcagagattgcccccgctaca

SEQ ID NO: 425350 - DNA, 25 bp, Homo sapien
gaagtttgcagcctcaggcggcttt

SEQ ID NO: 425351 - DNA, 25 bp, Homo sapien
aggcggctttctccaccacatggct

SEQ ID NO: 425352 - DNA, 25 bp, Homo sapien
gccggaatgagaatcaatgttgtca

SEQ ID NO: 425353 - DNA, 25 bp, Homo sapien
acatggctgggctaagcagttccaa

SEQ ID NO: 425354 - DNA, 25 bp, Homo sapien
agttccaagctttccatgtccaagg

SEQ ID NO: 425355 - DNA, 25 bp, Homo sapien
gaatgatgcatacacagctcctgct

SEQ ID NO: 425356 - DNA, 25 bp, Homo sapien
tcccttcctctattcgaacaaaagc

SEQ ID NO: 425357 - DNA, 25 bp, Homo sapien
aaaagccttgaccaacatgtcccgg

SEQ ID NO: 425358 - DNA, 25 bp, Homo sapien
tgaccaacatgtcccggacactggt

SEQ ID NO: 425359 - DNA, 25 bp, Homo sapien
gatgatggtatagcttccgttccta

SEQ ID NO: 425360 - DNA, 25 bp, Homo sapien
atagcttccgttcctactaaacaga

SEQ ID NO: 425361 - DNA, 25 bp, Homo sapien
ttaaatctctctaggatgagtttag

SEQ ID NO: 425362 - DNA, 25 bp, Homo sapien
gatgagtttagaactgtagcagtgc

SEQ ID NO: 425363 - DNA, 25 bp, Homo sapien
aactgtagcagtgcaggtggcttaa

SEQ ID NO: 425364 - DNA, 25 bp, Homo sapien
gtgcaggtggcttaagtgaagtaac

SEQ ID NO: 425365 - DNA, 25 bp, Homo sapien
agtgaagtaactccatatgtaatta

SEQ ID NO: 425366 - DNA, 25 bp, Homo sapien
tattaaaatacttcaatcctggatt

SEQ ID NO: 425367 - DNA, 25 bp, Homo sapien
acaaatttttggcatctggtaatat

SEQ ID NO: 425368 - DNA, 25 bp, Homo sapien
agaaatacactctgtgctcactgtg

SEQ ID NO: 425369 - DNA, 25 bp, Homo sapien
atacactctgtgctcactgtgcaga

SEQ ID NO: 425370 - DNA, 25 bp, Homo sapien
tgtgctcactgtgcagaggaacatc

SEQ ID NO: 425371 - DNA, 25 bp, Homo sapien
gaggaacatcagttttcaaaccaac

SEQ ID NO: 425372 - DNA, 25 bp, Homo sapien
gtaatgatactgtgtgttttcccaa

SEQ ID NO: 425373 - DNA, 25 bp, Homo sapien
aatgatactgtgtgttttcccaaag

SEQ ID NO: 425374 - DNA, 25 bp, Homo sapien
attactatctgttgaaaaggtgtcc

SEQ ID NO: 425375 - DNA, 25 bp, Homo sapien
actatctgttgaaaaggtgtccttt

SEQ ID NO: 425376 - DNA, 25 bp, Homo sapien
tttcttaccaaaattcactaatctt

SEQ ID NO: 425377 - DNA, 25 bp, Homo sapien
tcaaatgcagaatacttgactcatt

SEQ ID NO: 425378 - DNA, 25 bp, Homo sapien
gcagaatacttgactcatttaaagc

SEQ ID NO: 425379 - DNA, 25 bp, Homo sapien
gaatacttgactcatttaaagctaa

SEQ ID NO: 425380 - DNA, 25 bp, Homo sapien
ataattgtaatggatttttgacttt

SEQ ID NO: 425381 - DNA, 25 bp, Homo sapien
aatggattcttttcatcaaaaagcc

SEQ ID NO: 425382 - DNA, 25 bp, Homo sapien
tattttttatctatgtggaaaacac

SEQ ID NO: 425383 - DNA, 25 bp, Homo sapien
caggtgcccgcgtactgagtccgcg

SEQ ID NO: 425384 - DNA, 25 bp, Homo sapien
aggtgcccgcgtactgagtccgcgc

SEQ ID NO: 425385 - DNA, 25 bp, Homo sapien
ggtgcccgcgtactgagtccgcgcg

SEQ ID NO: 425386 - DNA, 25 bp, Homo sapien
gtgcccgcgtactgagtccgcgcgc

SEQ ID NO: 425387 - DNA, 25 bp, Homo sapien
tgcccgcgtactgagtccgcgcgcg

SEQ ID NO: 425388 - DNA, 25 bp, Homo sapien
gcccgcgtactgagtccgcgcgcgg

SEQ ID NO: 425389 - DNA, 25 bp, Homo sapien
cccgcgtactgagtccgcgcgcggg

SEQ ID NO: 425390 - DNA, 25 bp, Homo sapien
cgcgtactgagtccgcgcgcggggc

SEQ ID NO: 425391 - DNA, 25 bp, Homo sapien
tctgtgtcctttgcaaactcattct

SEQ ID NO: 425392 - DNA, 25 bp, Homo sapien
tgcaaactcattctcaactccttag

SEQ ID NO: 425393 - DNA, 25 bp, Homo sapien
tctcaactccttagactcagtcaag

SEQ ID NO: 425394 - DNA, 25 bp, Homo sapien
ccagttacacacttccatggtacta

SEQ ID NO: 425395 - DNA, 25 bp, Homo sapien
ggtactatatatcattccttcagag

SEQ ID NO: 425396 - DNA, 25 bp, Homo sapien
aacacagttatttcctatgtatttg

SEQ ID NO: 425397 - DNA, 25 bp, Homo sapien
aaagttccacaaggtcagtgaccat

SEQ ID NO: 425398 - DNA, 25 bp, Homo sapien
gaccatttctatctgtgttcaccaa

SEQ ID NO: 425399 - DNA, 25 bp, Homo sapien
gtgttcaccaatgtgttcccagtgc

SEQ ID NO: 425400 - DNA, 25 bp, Homo sapien
ccagtgcccagaaacaatgcctagc

SEQ ID NO: 425401 - DNA, 25 bp, Homo sapien
aatgcctagcataaagcagctgttt

SEQ ID NO: 425402 - DNA, 25 bp, Homo sapien
taaagccttaagaagtttccaggct

SEQ ID NO: 425403 - DNA, 25 bp, Homo sapien
aaagccttaagaagtttccaggctg

SEQ ID NO: 425404 - DNA, 25 bp, Homo sapien
aagccttaagaagtttccaggctgg

SEQ ID NO: 425405 - DNA, 25 bp, Homo sapien
agccttaagaagtttccaggctggg

SEQ ID NO: 425406 - DNA, 25 bp, Homo sapien
gccttaagaagtttccaggctgggc

SEQ ID NO: 425407 - DNA, 25 bp, Homo sapien
ccttaagaagtttccaggctgggcg

SEQ ID NO: 425408 - DNA, 25 bp, Homo sapien
cttaagaagtttccaggctgggcgc

SEQ ID NO: 425409 - DNA, 25 bp, Homo sapien
ttaagaagtttccaggctgggcgca

SEQ ID NO: 425410 - DNA, 25 bp, Homo sapien
aagaagtttccaggctgggcgcagc

SEQ ID NO: 425411 - DNA, 25 bp, Homo sapien
gaagtttccaggctgggcgcagcgg

SEQ ID NO: 425412 - DNA, 25 bp, Homo sapien
agtttccaggctgggcgcagcggct

SEQ ID NO: 425413 - DNA, 25 bp, Homo sapien
taactcccaaggtgtgtcgcgccgg

SEQ ID NO: 425414 - DNA, 25 bp, Homo sapien
aactcccaaggtgtgtcgcgccgga

SEQ ID NO: 425415 - DNA, 25 bp, Homo sapien
tcccaaggtgtgtcgcgccggacac

SEQ ID NO: 425416 - DNA, 25 bp, Homo sapien
tgcttctcgctgtctgtccttgttc

SEQ ID NO: 425417 - DNA, 25 bp, Homo sapien
cccgcaggttgcagagttgttgtct

SEQ ID NO: 425418 - DNA, 25 bp, Homo sapien
ccgcaggttgcagagttgttgtctg

SEQ ID NO: 425419 - DNA, 25 bp, Homo sapien
gttgcagagttgttgtctgcagtcc

SEQ ID NO: 425420 - DNA, 25 bp, Homo sapien
tgcagagttgttgtctgcagtccag

SEQ ID NO: 425421 - DNA, 25 bp, Homo sapien
tgcagtccagtgtgggtagagcgat

SEQ ID NO: 425422 - DNA, 25 bp, Homo sapien
agtgtgggtagagcgatcggtgtac

SEQ ID NO: 425423 - DNA, 25 bp, Homo sapien
gggttcctgcgctccttgtctcttc

SEQ ID NO: 425424 - DNA, 25 bp, Homo sapien
gtaccttgcgatgctggcgcctacg

SEQ ID NO: 425425 - DNA, 25 bp, Homo sapien
tggcgcctacggagggcatccgaaa

SEQ ID NO: 425426 - DNA, 25 bp, Homo sapien
gaaactgccctacagagcagtcgcc

SEQ ID NO: 425427 - DNA, 25 bp, Homo sapien
gtcgccgggcagttgaagatcagct

SEQ ID NO: 425428 - DNA, 25 bp, Homo sapien
tcagctaaagatatgtggccacagg

SEQ ID NO: 425429 - DNA, 25 bp, Homo sapien
atgtctttgagctgttcctttctaa

SEQ ID NO: 425430 - DNA, 25 bp, Homo sapien
taagagatccaactactccaggcca

SEQ ID NO: 425431 - DNA, 25 bp, Homo sapien
aggccacatcaatcaaatggaccaa

SEQ ID NO: 425432 - DNA, 25 bp, Homo sapien
atggaccaactatcctcagacagtg

SEQ ID NO: 425433 - DNA, 25 bp, Homo sapien
gaggccggattaatcaccgctgctt

SEQ ID NO: 425434 - DNA, 25 bp, Homo sapien
gcccatgtgtcctgatgtcctggga

SEQ ID NO: 425435 - DNA, 25 bp, Homo sapien
ctgatcgggcaatgggaggtggcca

SEQ ID NO: 425436 - DNA, 25 bp, Homo sapien
ggatcagagtctggcctgccaggct

SEQ ID NO: 425437 - DNA, 25 bp, Homo sapien
ggtgtgctgtgggtattcaccaccc

SEQ ID NO: 425438 - DNA, 25 bp, Homo sapien
tgtgggtattcaccaccctgggacc

SEQ ID NO: 425439 - DNA, 25 bp, Homo sapien
agacctgttctgacctcatgagtgt

SEQ ID NO: 425440 - DNA, 25 bp, Homo sapien
acctcatgagtgtcaaacgtgcccc

SEQ ID NO: 425441 - DNA, 25 bp, Homo sapien
ccccagttccttaggagatgtcatg

SEQ ID NO: 425442 - DNA, 25 bp, Homo sapien
agttccttaggagatgtcatgacaa

SEQ ID NO: 425443 - DNA, 25 bp, Homo sapien
gatgtcatgacaacactacacgcac

SEQ ID NO: 425444 - DNA, 25 bp, Homo sapien
tgacaacactacacgcacccaataa

SEQ ID NO: 425445 - DNA, 25 bp, Homo sapien
acactacacgcacccaataaagcga

SEQ ID NO: 425446 - DNA, 25 bp, Homo sapien
aagcaggcacgtcttcttaatattc

SEQ ID NO: 425447 - DNA, 25 bp, Homo sapien
tcctttgaaattccttatggcgcac

SEQ ID NO: 425448 - DNA, 25 bp, Homo sapien
ttccttatggcgcacaggtagcgta

SEQ ID NO: 425449 - DNA, 25 bp, Homo sapien
gaaaataactgcttcacgctgactg

SEQ ID NO: 425450 - DNA, 25 bp, Homo sapien
ttcacgctgactgtggtcctctggg

SEQ ID NO: 425451 - DNA, 25 bp, Homo sapien
ggatgattttcccatcgtgatcaaa

SEQ ID NO: 425452 - DNA, 25 bp, Homo sapien
gtgatcaaacaccagtcgagtccca

SEQ ID NO: 425453 - DNA, 25 bp, Homo sapien
cttcaccgacgcgtggcaggtagaa

SEQ ID NO: 425454 - DNA, 25 bp, Homo sapien
agaaatggtgacatcgctcagtgca

SEQ ID NO: 425455 - DNA, 25 bp, Homo sapien
tgacatcgctcagtgcacacagtga

SEQ ID NO: 425456 - DNA, 25 bp, Homo sapien
gctcagtgcacacagtgagctcaga

SEQ ID NO: 425457 - DNA, 25 bp, Homo sapien
tgtaaatgtccctcgtccaaaccgc

SEQ ID NO: 425458 - DNA, 25 bp, Homo sapien
tcctggagcccgtctggcagaggat

SEQ ID NO: 425459 - DNA, 25 bp, Homo sapien
gtgaacgtgtgggaccagaccctgt

SEQ ID NO: 425460 - DNA, 25 bp, Homo sapien
gggtgcgcccaagtcactttaacca

SEQ ID NO: 425461 - DNA, 25 bp, Homo sapien
gtcactttaaccacaaaacgccatc

SEQ ID NO: 425462 - DNA, 25 bp, Homo sapien
aaaacgccatcgtcgtcagggtaag

SEQ ID NO: 425463 - DNA, 25 bp, Homo sapien
gtcagggtaagctctgctctctaca

SEQ ID NO: 425464 - DNA, 25 bp, Homo sapien
tctgctctctacaaagactcgcgag

SEQ ID NO: 425465 - DNA, 25 bp, Homo sapien
ccttgtcttggctgggtttgtcaga

SEQ ID NO: 425466 - DNA, 25 bp, Homo sapien
gtcagaggtcaaaccggctctttta

SEQ ID NO: 425467 - DNA, 25 bp, Homo sapien
aattgcattgccgtttctttcttta

SEQ ID NO: 425468 - DNA, 25 bp, Homo sapien
atcagcccaggcctagggcagttag

SEQ ID NO: 425469 - DNA, 25 bp, Homo sapien
gggcagttaggacctttctgtttat

SEQ ID NO: 425470 - DNA, 25 bp, Homo sapien
cagagtttgcaaatgaagccttttt

SEQ ID NO: 425471 - DNA, 25 bp, Homo sapien
ttttgcactttcattcacatgcact

SEQ ID NO: 425472 - DNA, 25 bp, Homo sapien
tttcattcacatgcactttggtggg

SEQ ID NO: 425473 - DNA, 25 bp, Homo sapien
gggttacatttttgtacttgcctct

SEQ ID NO: 425474 - DNA, 25 bp, Homo sapien
acttgcctcttgtgtgtgcacatgt

SEQ ID NO: 425475 - DNA, 25 bp, Homo sapien
aagagaatcttctggcttaagctaa

SEQ ID NO: 425476 - DNA, 25 bp, Homo sapien
ggcttaagctaaggtgactcttgaa

SEQ ID NO: 425477 - DNA, 25 bp, Homo sapien
aaatgtggtgtgatctgtcagtgta

SEQ ID NO: 425478 - DNA, 25 bp, Homo sapien
gatctgtcagtgtatcaaaacaaca

SEQ ID NO: 425479 - DNA, 25 bp, Homo sapien
aaatcccggtgcttggtgtccttgc

SEQ ID NO: 425480 - DNA, 25 bp, Homo sapien
ggtgtccttgcatgacatggagttt

SEQ ID NO: 425481 - DNA, 25 bp, Homo sapien
ggagttttgcatgtagatcaattta

SEQ ID NO: 425482 - DNA, 25 bp, Homo sapien
aaagataatgttgccaaactttgga

SEQ ID NO: 425483 - DNA, 25 bp, Homo sapien
ggaaatgttaatgttcagactgaaa

SEQ ID NO: 425484 - DNA, 25 bp, Homo sapien
gactgaaaatctccactacatgtaa

SEQ ID NO: 425485 - DNA, 25 bp, Homo sapien
actacatgtaactttcttcctctgg

SEQ ID NO: 425486 - DNA, 25 bp, Homo sapien
actttcttcctctggatcagtggca

SEQ ID NO: 425487 - DNA, 25 bp, Homo sapien
gatcagtggcatggcttataatccc

SEQ ID NO: 425488 - DNA, 25 bp, Homo sapien
gcttataatcccagccagtggtttg

SEQ ID NO: 425489 - DNA, 25 bp, Homo sapien
agccagtggtttgaactgttccagt

SEQ ID NO: 425490 - DNA, 25 bp, Homo sapien
aaggttccagaatccgggcagaagc

SEQ ID NO: 425491 - DNA, 25 bp, Homo sapien
agaatccgggcagaagcctggctgt

SEQ ID NO: 425492 - DNA, 25 bp, Homo sapien
cagaagcctggctgttcccggtgag

SEQ ID NO: 425493 - DNA, 25 bp, Homo sapien
ggtgagggctctcccttgctagcac

SEQ ID NO: 425494 - DNA, 25 bp, Homo sapien
gctcatgtccctggagaggacagct

SEQ ID NO: 425495 - DNA, 25 bp, Homo sapien
agaggacagctttggccaagttgtt

SEQ ID NO: 425496 - DNA, 25 bp, Homo sapien
ggccaagttgttaaacatctctgag

SEQ ID NO: 425497 - DNA, 25 bp, Homo sapien
actgagatggtacttgtttcctaac

SEQ ID NO: 425498 - DNA, 25 bp, Homo sapien
agtgcattcaccaatagagggccca

SEQ ID NO: 425499 - DNA, 25 bp, Homo sapien
aatagagggcccacctattctggtg

SEQ ID NO: 425500 - DNA, 25 bp, Homo sapien
gggcccacctattctggtggagaga

SEQ ID NO: 425501 - DNA, 25 bp, Homo sapien
ttaatattcaggtatagatgtcaaa

SEQ ID NO: 425502 - DNA, 25 bp, Homo sapien
gatgtcaaattacttctgaatactt

SEQ ID NO: 425503 - DNA, 25 bp, Homo sapien
taaaaaattcacctctgaactagca

SEQ ID NO: 425504 - DNA, 25 bp, Homo sapien
gaactagcacatagagctacagatt

SEQ ID NO: 425505 - DNA, 25 bp, Homo sapien
attatgggcagaatcaagaatttta

SEQ ID NO: 425506 - DNA, 25 bp, Homo sapien
aaaatgcagttgtcatctgatttcc

SEQ ID NO: 425507 - DNA, 25 bp, Homo sapien
cctctgaacactgacctttgaagct

SEQ ID NO: 425508 - DNA, 25 bp, Homo sapien
tgaacactgacctttgaagctttgt

SEQ ID NO: 425509 - DNA, 25 bp, Homo sapien
gacctttgaagctttgtgaatccta

SEQ ID NO: 425510 - DNA, 25 bp, Homo sapien
tgaagctttgtgaatcctacgttaa

SEQ ID NO: 425511 - DNA, 25 bp, Homo sapien
tgtgaatcctacgttaagcactctg

SEQ ID NO: 425512 - DNA, 25 bp, Homo sapien
catgcgggacatcaacaagaagttc

SEQ ID NO: 425513 - DNA, 25 bp, Homo sapien
aagaagttctctgtgcgctattacc

SEQ ID NO: 425514 - DNA, 25 bp, Homo sapien
tgtgcgctattacctcaacctggtg

SEQ ID NO: 425515 - DNA, 25 bp, Homo sapien
gaggagcggcgctacttcaagcagc

SEQ ID NO: 425516 - DNA, 25 bp, Homo sapien
aagggtgacatcgtacggaagagca

SEQ ID NO: 425517 - DNA, 25 bp, Homo sapien
gtacggaagagcatgtcccaccagg

SEQ ID NO: 425518 - DNA, 25 bp, Homo sapien
ggccatcgcctcacagcgctttgag

SEQ ID NO: 425519 - DNA, 25 bp, Homo sapien
ttgagggcaccacctccctgggtga

SEQ ID NO: 425520 - DNA, 25 bp, Homo sapien
tacaggagagcccatcccgatccgg

SEQ ID NO: 425521 - DNA, 25 bp, Homo sapien
ttcctggccgggtcatgagtcacgc

SEQ ID NO: 425522 - DNA, 25 bp, Homo sapien
atgagtcacgcccaccatgcgggac

SEQ ID NO: 425523 - DNA, 25 bp, Homo sapien
tctgcatctactgtgcaaagatcat

SEQ ID NO: 425524 - DNA, 25 bp, Homo sapien
gcatctactgtgcaaagatcatgat

SEQ ID NO: 425525 - DNA, 25 bp, Homo sapien
ctactgtgcaaagatcatgattaac

SEQ ID NO: 425526 - DNA, 25 bp, Homo sapien
tgtgcaaagatcatgattaactgtc

SEQ ID NO: 425527 - DNA, 25 bp, Homo sapien
gcaaagatcatgattaactgtcaag

SEQ ID NO: 425528 - DNA, 25 bp, Homo sapien
gatcatgattaactgtcaagacact

SEQ ID NO: 425529 - DNA, 25 bp, Homo sapien
gtcaagacactggtagaacagaaca

SEQ ID NO: 425530 - DNA, 25 bp, Homo sapien
gacactggtagaacagaacaagcaa

SEQ ID NO: 425531 - DNA, 25 bp, Homo sapien
gagttcaaaagtaaatgcaaccaat

SEQ ID NO: 425532 - DNA, 25 bp, Homo sapien
aatgcaaccaatttaacatgtagtg

SEQ ID NO: 425533 - DNA, 25 bp, Homo sapien
tgcaaccaatttaacatgtagtgtt

SEQ ID NO: 425534 - DNA, 25 bp, Homo sapien
ttgtgcattcccaggtcagatgtca

SEQ ID NO: 425535 - DNA, 25 bp, Homo sapien
tgcattcccaggtcagatgtcatgt

SEQ ID NO: 425536 - DNA, 25 bp, Homo sapien
cggtccgctcttgtgtctatactga

SEQ ID NO: 425537 - DNA, 25 bp, Homo sapien
gtccgctcttgtgtctatactgaca

SEQ ID NO: 425538 - DNA, 25 bp, Homo sapien
gtctatactgacactttagggtcgc

SEQ ID NO: 425539 - DNA, 25 bp, Homo sapien
tgacactttagggtcgctttctttt

SEQ ID NO: 425540 - DNA, 25 bp, Homo sapien
tagggtcgctttcttttgtaacacg

SEQ ID NO: 425541 - DNA, 25 bp, Homo sapien
gtcgctttcttttgtaacacgttat

SEQ ID NO: 425542 - DNA, 25 bp, Homo sapien
gtaacacgttatgtagacctacagt

SEQ ID NO: 425543 - DNA, 25 bp, Homo sapien
acagtgtttcacttctagtaccaat

SEQ ID NO: 425544 - DNA, 25 bp, Homo sapien
gtgtttcacttctagtaccaatgga

SEQ ID NO: 425545 - DNA, 25 bp, Homo sapien
acatcaacaagtactatgaccagat

SEQ ID NO: 425546 - DNA, 25 bp, Homo sapien
ccctggaggaggatggcacggccca

SEQ ID NO: 425547 - DNA, 25 bp, Homo sapien
gaagatgcagctgggctatcggctc

SEQ ID NO: 425548 - DNA, 25 bp, Homo sapien
tgggctatcggctccagcagattgc

SEQ ID NO: 425549 - DNA, 25 bp, Homo sapien
ctatcggctccagcagattgcagct

SEQ ID NO: 425550 - DNA, 25 bp, Homo sapien
aggagaggccaccttcttaggtgcc

SEQ ID NO: 425551 - DNA, 25 bp, Homo sapien
accttcttaggtgcctgtagtgact

SEQ ID NO: 425552 - DNA, 25 bp, Homo sapien
cttaggtgcctgtagtgactgacaa

SEQ ID NO: 425553 - DNA, 25 bp, Homo sapien
gtgcctgtagtgactgacaagcaga

SEQ ID NO: 425554 - DNA, 25 bp, Homo sapien
gaaggtgactcccagtctcctggtg

SEQ ID NO: 425555 - DNA, 25 bp, Homo sapien
gactcccagtctcctggtggctctg

SEQ ID NO: 425556 - DNA, 25 bp, Homo sapien
cagtttgctcgatctgctagaccaa

SEQ ID NO: 425557 - DNA, 25 bp, Homo sapien
agtttgctcgatctgctagaccaaa

SEQ ID NO: 425558 - DNA, 25 bp, Homo sapien
gtttgctcgatctgctagaccaaaa

SEQ ID NO: 425559 - DNA, 25 bp, Homo sapien
tttgctcgatctgctagaccaaaac

SEQ ID NO: 425560 - DNA, 25 bp, Homo sapien
ttgctcgatctgctagaccaaaaca

SEQ ID NO: 425561 - DNA, 25 bp, Homo sapien
tgctcgatctgctagaccaaaacaa

SEQ ID NO: 425562 - DNA, 25 bp, Homo sapien
gctcgatctgctagaccaaaacaag

SEQ ID NO: 425563 - DNA, 25 bp, Homo sapien
tcgatctgctagaccaaaacaagat

SEQ ID NO: 425564 - DNA, 25 bp, Homo sapien
tctgctagaccaaaacaagatccta

SEQ ID NO: 425565 - DNA, 25 bp, Homo sapien
gctagaccaaaacaagatcctaagg

SEQ ID NO: 425566 - DNA, 25 bp, Homo sapien
gaccaaaacaagatcctaaggaagg

SEQ ID NO: 425567 - DNA, 25 bp, Homo sapien
tgttaaattgttttgtccagtccgt

SEQ ID NO: 425568 - DNA, 25 bp, Homo sapien
ttggattggaggaaatcgagcttct

SEQ ID NO: 425569 - DNA, 25 bp, Homo sapien
ggaggaaatcgagcttctgagtgca

SEQ ID NO: 425570 - DNA, 25 bp, Homo sapien
ggaaatcgagcttctgagtgcagga

SEQ ID NO: 425571 - DNA, 25 bp, Homo sapien
caggatctgtgaactttgcaatgtg

SEQ ID NO: 425572 - DNA, 25 bp, Homo sapien
tctgtgaactttgcaatgtggctgc

SEQ ID NO: 425573 - DNA, 25 bp, Homo sapien
aactttgcaatgtggctgcaagggt

SEQ ID NO: 425574 - DNA, 25 bp, Homo sapien
gttatttgttaactatggacacagt

SEQ ID NO: 425575 - DNA, 25 bp, Homo sapien
atggacacagtgaacgtagtttacg

SEQ ID NO: 425576 - DNA, 25 bp, Homo sapien
agtgaacgtagtttacgatcttgaa

SEQ ID NO: 425577 - DNA, 25 bp, Homo sapien
aaatgttcagatacagttttgtgaa

SEQ ID NO: 425578 - DNA, 25 bp, Homo sapien
gatagacggctatcctactgtgagt

SEQ ID NO: 425579 - DNA, 25 bp, Homo sapien
ggctatcctactgtgagtcctgaaa

SEQ ID NO: 425580 - DNA, 25 bp, Homo sapien
gcagagaaactcagtgtgggctaca

SEQ ID NO: 425581 - DNA, 25 bp, Homo sapien
tgggctacatacaatttcagcttga

SEQ ID NO: 425582 - DNA, 25 bp, Homo sapien
gaatcacacttaacagatcctctgt

SEQ ID NO: 425583 - DNA, 25 bp, Homo sapien
gatcctctgttccaaccatttaaat

SEQ ID NO: 425584 - DNA, 25 bp, Homo sapien
aactaaggcacagaactacttgaga

SEQ ID NO: 425585 - DNA, 25 bp, Homo sapien
gaaaactagagctcctgattgttct

SEQ ID NO: 425586 - DNA, 25 bp, Homo sapien
agagctcctgattgttctcaaaata

SEQ ID NO: 425587 - DNA, 25 bp, Homo sapien
ttttatcatactgcatcgggttcta

SEQ ID NO: 425588 - DNA, 25 bp, Homo sapien
atcgggttctaagtgagagggcttc

SEQ ID NO: 425589 - DNA, 25 bp, Homo sapien
accagcattctcgaaattggaggac

SEQ ID NO: 425590 - DNA, 25 bp, Homo sapien
gcattctcgaaattggaggactcct

SEQ ID NO: 425591 - DNA, 25 bp, Homo sapien
attctcgaaattggaggactccttt

SEQ ID NO: 425592 - DNA, 25 bp, Homo sapien
aattggaggactcctttgaggccct

SEQ ID NO: 425593 - DNA, 25 bp, Homo sapien
ttggaggactcctttgaggccctct

SEQ ID NO: 425594 - DNA, 25 bp, Homo sapien
ggaggactcctttgaggccctctcc

SEQ ID NO: 425595 - DNA, 25 bp, Homo sapien
ttgaggccctctccctgtacctggg

SEQ ID NO: 425596 - DNA, 25 bp, Homo sapien
tgggcatcccgctgcctgcagagct

SEQ ID NO: 425597 - DNA, 25 bp, Homo sapien
ctggaggagttggaccacactgtga

SEQ ID NO: 425598 - DNA, 25 bp, Homo sapien
aggagttggaccacactgtgagcat

SEQ ID NO: 425599 - DNA, 25 bp, Homo sapien
gttggaccacactgtgagcatgcag

SEQ ID NO: 425600 - DNA, 25 bp, Homo sapien
ctcatttcttgtcagaacccattga

SEQ ID NO: 425601 - DNA, 25 bp, Homo sapien
ttgtcagaacccattgagaatagtg

SEQ ID NO: 425602 - DNA, 25 bp, Homo sapien
tattgatggaagactgtcaagccca

SEQ ID NO: 425603 - DNA, 25 bp, Homo sapien
ggaagactgtcaagcccatccagtt

SEQ ID NO: 425604 - DNA, 25 bp, Homo sapien
cccatccagttctctagtctaaata

SEQ ID NO: 425605 - DNA, 25 bp, Homo sapien
gttctctagtctaaatagtctcagt

SEQ ID NO: 425606 - DNA, 25 bp, Homo sapien
taaatagtctcagtttatccatgac

SEQ ID NO: 425607 - DNA, 25 bp, Homo sapien
gtttatccatgacttgagccatcta

SEQ ID NO: 425608 - DNA, 25 bp, Homo sapien
atccatgacttgagccatctaaaag

SEQ ID NO: 425609 - DNA, 25 bp, Homo sapien
ttgagccatctaaaagttgcataac

SEQ ID NO: 425610 - DNA, 25 bp, Homo sapien
aaagttgcataacaaattagccggg

SEQ ID NO: 425611 - DNA, 25 bp, Homo sapien
gagccacaataaagctgagctaggt

SEQ ID NO: 425612 - DNA, 25 bp, Homo sapien
gctgagctaggttcctattctgtat

SEQ ID NO: 425613 - DNA, 25 bp, Homo sapien
cccgtgaattctattgggaaatatt

SEQ ID NO: 425614 - DNA, 25 bp, Homo sapien
gaaaggtaggtggtattttgtacat

SEQ ID NO: 425615 - DNA, 25 bp, Homo sapien
cattaatttagtgtataaccaggac

SEQ ID NO: 425616 - DNA, 25 bp, Homo sapien
gtataaccaggacaaatttcattct

SEQ ID NO: 425617 - DNA, 25 bp, Homo sapien
aatttcattctgaattgctttgcta

SEQ ID NO: 425618 - DNA, 25 bp, Homo sapien
attgctttgctaaatcatcacagag

SEQ ID NO: 425619 - DNA, 25 bp, Homo sapien
tgagctctcccatggtcagggaact

SEQ ID NO: 425620 - DNA, 25 bp, Homo sapien
atggtcagggaactccttccaacac

SEQ ID NO: 425621 - DNA, 25 bp, Homo sapien
cagggaactccttccaacaccaagt

SEQ ID NO: 425622 - DNA, 25 bp, Homo sapien
gaagttctatcagttctcgacggag

SEQ ID NO: 425623 - DNA, 25 bp, Homo sapien
agttctcgacggagatatttcacct

SEQ ID NO: 425624 - DNA, 25 bp, Homo sapien
gatatttcacctgacttgattcaag

SEQ ID NO: 425625 - DNA, 25 bp, Homo sapien
gtttcagtatcctactgcactgaat

SEQ ID NO: 425626 - DNA, 25 bp, Homo sapien
gtatcctactgcactgaattgcaaa

SEQ ID NO: 425627 - DNA, 25 bp, Homo sapien
gcaaaggaaaggtcagaactatcaa

SEQ ID NO: 425628 - DNA, 25 bp, Homo sapien
tccctaccatccacagtatcatttt

SEQ ID NO: 425629 - DNA, 25 bp, Homo sapien
cttcatctttatactttattgttac

SEQ ID NO: 425630 - DNA, 25 bp, Homo sapien
ccacagtatcattttcaggaatatt

SEQ ID NO: 425631 - DNA, 25 bp, Homo sapien
ggtggttccaagctatccaataaac

SEQ ID NO: 425632 - DNA, 25 bp, Homo sapien
gctatccaataaacgattcacttta

SEQ ID NO: 425633 - DNA, 25 bp, Homo sapien
gagtcctacaatagccctggaaggc

SEQ ID NO: 425634 - DNA, 25 bp, Homo sapien
ggaaggcaagagctgtttcctttcc

SEQ ID NO: 425635 - DNA, 25 bp, Homo sapien
ttcctttccatttctacaatgagtc

SEQ ID NO: 425636 - DNA, 25 bp, Homo sapien
gatgatgctataacacttccagtgt

SEQ ID NO: 425637 - DNA, 25 bp, Homo sapien
gtgtttctgacacttccctgaagct

SEQ ID NO: 425638 - DNA, 25 bp, Homo sapien
aagctatacctgctaccttcatggg

SEQ ID NO: 425639 - DNA, 25 bp, Homo sapien
tcatgggccgagcttgcccttatga

SEQ ID NO: 425640 - DNA, 25 bp, Homo sapien
ttgcccttatgaggcccacaggtgg

SEQ ID NO: 425641 - DNA, 25 bp, Homo sapien
cacagctctggtgccgtttctcaag

SEQ ID NO: 425642 - DNA, 25 bp, Homo sapien
tgggcttcattcaacattttctatc

SEQ ID NO: 425643 - DNA, 25 bp, Homo sapien
acattttctatctagctcttcatgg

SEQ ID NO: 425644 - DNA, 25 bp, Homo sapien
tctggccgcctgaggctttagactt

SEQ ID NO: 425645 - DNA, 25 bp, Homo sapien
gatcctcaaagacctcgaggaagag

SEQ ID NO: 425646 - DNA, 25 bp, Homo sapien
gggcactcgactttcatgtggagga

SEQ ID NO: 425647 - DNA, 25 bp, Homo sapien
aggccccgatcatgcggaggtcagt

SEQ ID NO: 425648 - DNA, 25 bp, Homo sapien
atcatgcggaggtcagtcaccttca

SEQ ID NO: 425649 - DNA, 25 bp, Homo sapien
ggaggtcagtcaccttcatcagcag

SEQ ID NO: 425650 - DNA, 25 bp, Homo sapien
agtcaccttcatcagcagcttgggc

SEQ ID NO: 425651 - DNA, 25 bp, Homo sapien
gccagaagtgcggaatgttgtgttt

SEQ ID NO: 425652 - DNA, 25 bp, Homo sapien
gaatgttgtgtttgcggtggttgac

SEQ ID NO: 425653 - DNA, 25 bp, Homo sapien
gtggttgacgtagtgctcgaacgcc

SEQ ID NO: 425654 - DNA, 25 bp, Homo sapien
gacgtagtgctcgaacgccagcagg

SEQ ID NO: 425655 - DNA, 25 bp, Homo sapien
ttgcctgctttacccacaactgctg

SEQ ID NO: 425656 - DNA, 25 bp, Homo sapien
tgcctgctttacccacaactgctgg

SEQ ID NO: 425657 - DNA, 25 bp, Homo sapien
gcctgctttacccacaactgctggg

SEQ ID NO: 425658 - DNA, 25 bp, Homo sapien
cctgctttacccacaactgctgggt

SEQ ID NO: 425659 - DNA, 25 bp, Homo sapien
ctgctttacccacaactgctgggtc

SEQ ID NO: 425660 - DNA, 25 bp, Homo sapien
tgctttacccacaactgctgggtcc

SEQ ID NO: 425661 - DNA, 25 bp, Homo sapien
gctttacccacaactgctgggtcct

SEQ ID NO: 425662 - DNA, 25 bp, Homo sapien
ctttacccacaactgctgggtcctg

SEQ ID NO: 425663 - DNA, 25 bp, Homo sapien
tgtctctgtgtttgtggactggatt

SEQ ID NO: 425664 - DNA, 25 bp, Homo sapien
gtctctgtgtttgtggactggattc

SEQ ID NO: 425665 - DNA, 25 bp, Homo sapien
ttggaaaacccatggtggttcagtt

SEQ ID NO: 425666 - DNA, 25 bp, Homo sapien
ggttcagtttgctcgatctgctaga

SEQ ID NO: 425667 - DNA, 25 bp, Homo sapien
ttgctcgatctgctagaccaaaaca

SEQ ID NO: 425668 - DNA, 25 bp, Homo sapien
ttttgaatcccgtgtccttcaagtg

SEQ ID NO: 425669 - DNA, 25 bp, Homo sapien
ttgaatcccgtgtccttcaagtgct

SEQ ID NO: 425670 - DNA, 25 bp, Homo sapien
tcaagtgctttctaactttgagagg

SEQ ID NO: 425671 - DNA, 25 bp, Homo sapien
gtgctttctaactttgagaggaaga

SEQ ID NO: 425672 - DNA, 25 bp, Homo sapien
aaatctatatgcctttaaatcagtg

SEQ ID NO: 425673 - DNA, 25 bp, Homo sapien
tctatatgcctttaaatcagtgaat

SEQ ID NO: 425674 - DNA, 25 bp, Homo sapien
tatatgcctttaaatcagtgaattg

SEQ ID NO: 425675 - DNA, 25 bp, Homo sapien
ttaatgattttcctcaaatataata

SEQ ID NO: 425676 - DNA, 25 bp, Homo sapien
agtccaggcctttctaagatactcc

SEQ ID NO: 425677 - DNA, 25 bp, Homo sapien
gtccaggcctttctaagatactcct

SEQ ID NO: 425678 - DNA, 25 bp, Homo sapien
tccaggcctttctaagatactcctc

SEQ ID NO: 425679 - DNA, 25 bp, Homo sapien
ctttctaagatactcctccagccgg

SEQ ID NO: 425680 - DNA, 25 bp, Homo sapien
tttctaagatactcctccagccggg

SEQ ID NO: 425681 - DNA, 25 bp, Homo sapien
ttctaagatactcctccagccgggc

SEQ ID NO: 425682 - DNA, 25 bp, Homo sapien
tctaagatactcctccagccgggcg

SEQ ID NO: 425683 - DNA, 25 bp, Homo sapien
taagatactcctccagccgggcgcg

SEQ ID NO: 425684 - DNA, 25 bp, Homo sapien
aagatactcctccagccgggcgcgg

SEQ ID NO: 425685 - DNA, 25 bp, Homo sapien
agatactcctccagccgggcgcggt

SEQ ID NO: 425686 - DNA, 25 bp, Homo sapien
gatactcctccagccgggcgcggtg

SEQ ID NO: 425687 - DNA, 25 bp, Homo sapien
atggactacgcgcaatgccttcagc

SEQ ID NO: 425688 - DNA, 25 bp, Homo sapien
tcgggatggagaaagcgacgagccc

SEQ ID NO: 425689 - DNA, 25 bp, Homo sapien
gggagcaactccaaacgcagaagag

SEQ ID NO: 425690 - DNA, 25 bp, Homo sapien
tccaaacgcagaagagtggtccttg

SEQ ID NO: 425691 - DNA, 25 bp, Homo sapien
acgcagaagagtggtccttgggtct

SEQ ID NO: 425692 - DNA, 25 bp, Homo sapien
aagagtggtccttgggtcttcgccg

SEQ ID NO: 425693 - DNA, 25 bp, Homo sapien
tccttgggtcttcgccggcgccaag

SEQ ID NO: 425694 - DNA, 25 bp, Homo sapien
gcaatgccttcagcctgcggtgggc

SEQ ID NO: 425695 - DNA, 25 bp, Homo sapien
ttcagcctgcggtgggctcaggaac

SEQ ID NO: 425696 - DNA, 25 bp, Homo sapien
ctcaggaaccgaggcgctgccgctg

SEQ ID NO: 425697 - DNA, 25 bp, Homo sapien
aacgctcctccgcgacctgtgttgt

SEQ ID NO: 425698 - DNA, 25 bp, Homo sapien
aaagatgaggcttggtcctacctca

SEQ ID NO: 425699 - DNA, 25 bp, Homo sapien
atgaggcttggtcctacctcagggc

SEQ ID NO: 425700 - DNA, 25 bp, Homo sapien
atcactatagatcactgcatgcttc

SEQ ID NO: 425701 - DNA, 25 bp, Homo sapien
gatcactgcatgcttcttatcattc

SEQ ID NO: 425702 - DNA, 25 bp, Homo sapien
ttcttatcattctagctttggcttt

SEQ ID NO: 425703 - DNA, 25 bp, Homo sapien
tagctttggctttaatgtcacctgc

SEQ ID NO: 425704 - DNA, 25 bp, Homo sapien
taatgtcacctgctctttgatgtca

SEQ ID NO: 425705 - DNA, 25 bp, Homo sapien
tttgatgtcacctgcccttagaagt

SEQ ID NO: 425706 - DNA, 25 bp, Homo sapien
atgtcacctgcccttagaagtcttt

SEQ ID NO: 425707 - DNA, 25 bp, Homo sapien
ttagaagtctttcctggcttgttgc

SEQ ID NO: 425708 - DNA, 25 bp, Homo sapien
tttcctggcttgttgcggtggctca

SEQ ID NO: 425709 - DNA, 25 bp, Homo sapien
gtagtgactcattgtattacttaaa

SEQ ID NO: 425710 - DNA, 25 bp, Homo sapien
aacttatataacacgctgtattaga

SEQ ID NO: 425711 - DNA, 25 bp, Homo sapien
gtctaaatgctatttctgaataaat

SEQ ID NO: 425712 - DNA, 25 bp, Homo sapien
gagctgattagcatcaatgtgtttg

SEQ ID NO: 425713 - DNA, 25 bp, Homo sapien
gccttgaggatagtcttcatgttca

SEQ ID NO: 425714 - DNA, 25 bp, Homo sapien
gtcttcatgttcaaaggcactatgc

SEQ ID NO: 425715 - DNA, 25 bp, Homo sapien
aggcactatgcttttattatataac

SEQ ID NO: 425716 - DNA, 25 bp, Homo sapien
gcttttattatataacttccttcag

SEQ ID NO: 425717 - DNA, 25 bp, Homo sapien
ttccttcagaagactgaaccacatg

SEQ ID NO: 425718 - DNA, 25 bp, Homo sapien
accacatgatattctcagccctgtt

SEQ ID NO: 425719 - DNA, 25 bp, Homo sapien
ttctcagccctgttaacactaaaaa

SEQ ID NO: 425720 - DNA, 25 bp, Homo sapien
ctgaccagtgtaaacccacttaatt

SEQ ID NO: 425721 - DNA, 25 bp, Homo sapien
cccacttaattattgcagcctaaag

SEQ ID NO: 425722 - DNA, 25 bp, Homo sapien
aattcagctacttctactcttcata

SEQ ID NO: 425723 - DNA, 25 bp, Homo sapien
tctactcttcataaatgtgcccaag

SEQ ID NO: 425724 - DNA, 25 bp, Homo sapien
tgtgcccaagtaaatatgtgttttt

SEQ ID NO: 425725 - DNA, 25 bp, Homo sapien
agctcatgttttggtgtctttgtac

SEQ ID NO: 425726 - DNA, 25 bp, Homo sapien
tggtgtctttgtactcagattgtga

SEQ ID NO: 425727 - DNA, 25 bp, Homo sapien
ggcatatttcactgatttagactta

SEQ ID NO: 425728 - DNA, 25 bp, Homo sapien
gagatagttctgtcagcaatccaac

SEQ ID NO: 425729 - DNA, 25 bp, Homo sapien
gtcagcaatccaacatctatagcaa

SEQ ID NO: 425730 - DNA, 25 bp, Homo sapien
gtaatcaactcatatttcacgaatt

SEQ ID NO: 425731 - DNA, 25 bp, Homo sapien
ttaggcaagttgcttaatccctttg

SEQ ID NO: 425732 - DNA, 25 bp, Homo sapien
gcaagttgcttaatccctttgaatt

SEQ ID NO: 425733 - DNA, 25 bp, Homo sapien
tagtctcttcatacggagtaggttg

SEQ ID NO: 425734 - DNA, 25 bp, Homo sapien
tactatgtacctcaaaggattattg

SEQ ID NO: 425735 - DNA, 25 bp, Homo sapien
gtgaagattgagttaacccatgtaa

SEQ ID NO: 425736 - DNA, 25 bp, Homo sapien
gttgagactgtctgatacacagaaa

SEQ ID NO: 425737 - DNA, 25 bp, Homo sapien
agctatcattggtacacagaggtca

SEQ ID NO: 425738 - DNA, 25 bp, Homo sapien
gactgattattgctacacatgtcaa

SEQ ID NO: 425739 - DNA, 25 bp, Homo sapien
atttcagaatgtcccatgatatcag

SEQ ID NO: 425740 - DNA, 25 bp, Homo sapien
tgtcccatgatatcagtcagttcaa

SEQ ID NO: 425741 - DNA, 25 bp, Homo sapien
gtcagttcaaaagcatctatcacta

SEQ ID NO: 425742 - DNA, 25 bp, Homo sapien
aggctgagatgggcgcatcgcatga

SEQ ID NO: 425743 - DNA, 25 bp, Homo sapien
ctgagatgggcgcatcgcatgaggt

SEQ ID NO: 425744 - DNA, 25 bp, Homo sapien
tgagatgggcgcatcgcatgaggtc

SEQ ID NO: 425745 - DNA, 25 bp, Homo sapien
gagatgggcgcatcgcatgaggtcg

SEQ ID NO: 425746 - DNA, 25 bp, Homo sapien
agatgggcgcatcgcatgaggtcgg

SEQ ID NO: 425747 - DNA, 25 bp, Homo sapien
gatgggcgcatcgcatgaggtcggg

SEQ ID NO: 425748 - DNA, 25 bp, Homo sapien
atgggcgcatcgcatgaggtcggga

SEQ ID NO: 425749 - DNA, 25 bp, Homo sapien
tgggcgcatcgcatgaggtcgggag

SEQ ID NO: 425750 - DNA, 25 bp, Homo sapien
gggcgcatcgcatgaggtcgggagt

SEQ ID NO: 425751 - DNA, 25 bp, Homo sapien
gcgcatcgcatgaggtcgggagttt

SEQ ID NO: 425752 - DNA, 25 bp, Homo sapien
gagaatgccactgcactacagcctg

SEQ ID NO: 425753 - DNA, 25 bp, Homo sapien
tgcccactgtgcgaaaaggccttca

SEQ ID NO: 425754 - DNA, 25 bp, Homo sapien
gcccactgtgcgaaaaggccttcaa

SEQ ID NO: 425755 - DNA, 25 bp, Homo sapien
gctcgggcctggtgcaacaccagcg

SEQ ID NO: 425756 - DNA, 25 bp, Homo sapien
gcctggtgcaacaccagcgcgcgca

SEQ ID NO: 425757 - DNA, 25 bp, Homo sapien
tccgagtgcggaaagaccttccgcg

SEQ ID NO: 425758 - DNA, 25 bp, Homo sapien
gagtgcggaaagaccttccgcggct

SEQ ID NO: 425759 - DNA, 25 bp, Homo sapien
tgcggaaagaccttccgcggctgct

SEQ ID NO: 425760 - DNA, 25 bp, Homo sapien
gcggaaagaccttccgcggctgctc

SEQ ID NO: 425761 - DNA, 25 bp, Homo sapien
agcacgagcgcctgcactcgggcga

SEQ ID NO: 425762 - DNA, 25 bp, Homo sapien
ttcaaccagcgctcgaacctgagcc

SEQ ID NO: 425763 - DNA, 25 bp, Homo sapien
agcgctcgaacctgagccggcacca

SEQ ID NO: 425764 - DNA, 25 bp, Homo sapien
ctcagcatccatctctatatacttg

SEQ ID NO: 425765 - DNA, 25 bp, Homo sapien
gcatccatctctatatacttgatta

SEQ ID NO: 425766 - DNA, 25 bp, Homo sapien
agtctcttttatcacctctatgtaa

SEQ ID NO: 425767 - DNA, 25 bp, Homo sapien
ttatcacctctatgtaaagttttat

SEQ ID NO: 425768 - DNA, 25 bp, Homo sapien
atgggtagttatcgtcagtgtattt

SEQ ID NO: 425769 - DNA, 25 bp, Homo sapien
gtatgttttaaaggctggtcttcaa

SEQ ID NO: 425770 - DNA, 25 bp, Homo sapien
aaggctggtcttcaatactgtggag

SEQ ID NO: 425771 - DNA, 25 bp, Homo sapien
gtacgttagacttttgctggcattc

SEQ ID NO: 425772 - DNA, 25 bp, Homo sapien
gctggcattcaagtcatggctagtc

SEQ ID NO: 425773 - DNA, 25 bp, Homo sapien
gtcatggctagtctgtgtatttaat

SEQ ID NO: 425774 - DNA, 25 bp, Homo sapien
atttatgtcgtgtttgtcaatggaa

SEQ ID NO: 425775 - DNA, 25 bp, Homo sapien
gcagatctattcctttctggttact

SEQ ID NO: 425776 - DNA, 25 bp, Homo sapien
cagatctattcctttctggttacta

SEQ ID NO: 425777 - DNA, 25 bp, Homo sapien
agatctattcctttctggttactaa

SEQ ID NO: 425778 - DNA, 25 bp, Homo sapien
gatctattcctttctggttactaaa

SEQ ID NO: 425779 - DNA, 25 bp, Homo sapien
atctattcctttctggttactaaat

SEQ ID NO: 425780 - DNA, 25 bp, Homo sapien
tctattcctttctggttactaaatt

SEQ ID NO: 425781 - DNA, 25 bp, Homo sapien
ctattcctttctggttactaaattg

SEQ ID NO: 425782 - DNA, 25 bp, Homo sapien
tattcctttctggttactaaattgg

SEQ ID NO: 425783 - DNA, 25 bp, Homo sapien
tggaggccgcggtgagtcgagacca

SEQ ID NO: 425784 - DNA, 25 bp, Homo sapien
gaggccgcggtgagtcgagaccacg

SEQ ID NO: 425785 - DNA, 25 bp, Homo sapien
cgcggtgagtcgagaccacgccact

SEQ ID NO: 425786 - DNA, 25 bp, Homo sapien
cagtctgcaaagtgggattccctct

SEQ ID NO: 425787 - DNA, 25 bp, Homo sapien
agtctgcaaagtgggattccctctc

SEQ ID NO: 425788 - DNA, 25 bp, Homo sapien
tgcaaagtgggattccctctcggtt

SEQ ID NO: 425789 - DNA, 25 bp, Homo sapien
caaagtgggattccctctcggttca

SEQ ID NO: 425790 - DNA, 25 bp, Homo sapien
aagtgggattccctctcggttcagt

SEQ ID NO: 425791 - DNA, 25 bp, Homo sapien
gtgggattccctctcggttcagtga

SEQ ID NO: 425792 - DNA, 25 bp, Homo sapien
gggattccctctcggttcagtgaca

SEQ ID NO: 425793 - DNA, 25 bp, Homo sapien
gattccctctcggttcagtgacagt

SEQ ID NO: 425794 - DNA, 25 bp, Homo sapien
attccctctcggttcagtgacagtg

SEQ ID NO: 425795 - DNA, 25 bp, Homo sapien
tccctctcggttcagtgacagtgga

SEQ ID NO: 425796 - DNA, 25 bp, Homo sapien
gggcagattacactctcaccatccg

SEQ ID NO: 425797 - DNA, 25 bp, Homo sapien
agccaaccgatacttttctccaaat

SEQ ID NO: 425798 - DNA, 25 bp, Homo sapien
aacagtagaggagccgtcaaatcca

SEQ ID NO: 425799 - DNA, 25 bp, Homo sapien
cgtcaaatccagaggctagcagttc

SEQ ID NO: 425800 - DNA, 25 bp, Homo sapien
ttctgtaacaccagatgttagtgac

SEQ ID NO: 425801 - DNA, 25 bp, Homo sapien
cagatgttagtgacaatgaacctga

SEQ ID NO: 425802 - DNA, 25 bp, Homo sapien
gatcattatagatattctgacacca

SEQ ID NO: 425803 - DNA, 25 bp, Homo sapien
tgacaccactgactctgatccagag

SEQ ID NO: 425804 - DNA, 25 bp, Homo sapien
ctgatccagagaatgaaccttttga

SEQ ID NO: 425805 - DNA, 25 bp, Homo sapien
gatagcatttgcagtatagagcgtg

SEQ ID NO: 425806 - DNA, 25 bp, Homo sapien
gtatagagcgtgcagataatgacaa

SEQ ID NO: 425807 - DNA, 25 bp, Homo sapien
taaagacaaagccaaccgatacttt

SEQ ID NO: 425808 - DNA, 25 bp, Homo sapien
gggctttaactgtagtatttggcag

SEQ ID NO: 425809 - DNA, 25 bp, Homo sapien
atttggcagagttgccttctacctg

SEQ ID NO: 425810 - DNA, 25 bp, Homo sapien
tctacctgccagttcaaaagttcaa

SEQ ID NO: 425811 - DNA, 25 bp, Homo sapien
aaacagccttactctgattcagcct

SEQ ID NO: 425812 - DNA, 25 bp, Homo sapien
gattcagcctcttcagatactcttg

SEQ ID NO: 425813 - DNA, 25 bp, Homo sapien
cagatactcttgtgctgtgcagcag

SEQ ID NO: 425814 - DNA, 25 bp, Homo sapien
gcagtggctctgtgtgtaaatgcta

SEQ ID NO: 425815 - DNA, 25 bp, Homo sapien
aatgctatgcactgaggatacacaa

SEQ ID NO: 425816 - DNA, 25 bp, Homo sapien
ggataatgcctcatcccaatcagat

SEQ ID NO: 425817 - DNA, 25 bp, Homo sapien
cagatgtccatttgttattgtgttt

SEQ ID NO: 425818 - DNA, 25 bp, Homo sapien
gttaacaaccctttatctcttagtg

SEQ ID NO: 425819 - DNA, 25 bp, Homo sapien
tgggtgggtcggtgggccctagatt

SEQ ID NO: 425820 - DNA, 25 bp, Homo sapien
tctgggcgcagggcccatttcttct

SEQ ID NO: 425821 - DNA, 25 bp, Homo sapien
gggcgcagggcccatttcttctttt

SEQ ID NO: 425822 - DNA, 25 bp, Homo sapien
gcgcagggcccatttcttctttttt

SEQ ID NO: 425823 - DNA, 25 bp, Homo sapien
ggagccggttcccccgttgcattgc

SEQ ID NO: 425824 - DNA, 25 bp, Homo sapien
ccccgttgcattgccgggccctgtg

SEQ ID NO: 425825 - DNA, 25 bp, Homo sapien
cattgccgggccctgtgggtgggtc

SEQ ID NO: 425826 - DNA, 25 bp, Homo sapien
attgccgggccctgtgggtgggtcg

SEQ ID NO: 425827 - DNA, 25 bp, Homo sapien
ttgccgggccctgtgggtgggtcgg

SEQ ID NO: 425828 - DNA, 25 bp, Homo sapien
tgccgggccctgtgggtgggtcggt

SEQ ID NO: 425829 - DNA, 25 bp, Homo sapien
gccgggccctgtgggtgggtcggtg

SEQ ID NO: 425830 - DNA, 25 bp, Homo sapien
ggccgcaggattcccacttggagca

SEQ ID NO: 425831 - DNA, 25 bp, Homo sapien
gcaggattcccacttggagcacaaa

SEQ ID NO: 425832 - DNA, 25 bp, Homo sapien
aggattcccacttggagcacaaagt

SEQ ID NO: 425833 - DNA, 25 bp, Homo sapien
agcacaaagtgaagtaagcacaggg

SEQ ID NO: 425834 - DNA, 25 bp, Homo sapien
ggactagaatcagtcccccatagca

SEQ ID NO: 425835 - DNA, 25 bp, Homo sapien
actagaatcagtcccccatagcaag

SEQ ID NO: 425836 - DNA, 25 bp, Homo sapien
gaatcagtcccccatagcaagcaca

SEQ ID NO: 425837 - DNA, 25 bp, Homo sapien
agtcccccatagcaagcacagaaag

SEQ ID NO: 425838 - DNA, 25 bp, Homo sapien
cccatagcaagcacagaaaggagga

SEQ ID NO: 425839 - DNA, 25 bp, Homo sapien
aagcacagaaaggaggagctgcgca

SEQ ID NO: 425840 - DNA, 25 bp, Homo sapien
ggagctgcgcagaaggcagagcccc

SEQ ID NO: 425841 - DNA, 25 bp, Homo sapien
aggctgagatgggcgcatcgcatga

SEQ ID NO: 425842 - DNA, 25 bp, Homo sapien
ggctgagatgggcgcatcgcatgag

SEQ ID NO: 425843 - DNA, 25 bp, Homo sapien
gctgagatgggcgcatcgcatgagg

SEQ ID NO: 425844 - DNA, 25 bp, Homo sapien
ctgagatgggcgcatcgcatgaggt

SEQ ID NO: 425845 - DNA, 25 bp, Homo sapien
tgagatgggcgcatcgcatgaggtc

SEQ ID NO: 425846 - DNA, 25 bp, Homo sapien
gagatgggcgcatcgcatgaggtcg

SEQ ID NO: 425847 - DNA, 25 bp, Homo sapien
agatgggcgcatcgcatgaggtcgg

SEQ ID NO: 425848 - DNA, 25 bp, Homo sapien
gatgggcgcatcgcatgaggtcggg

SEQ ID NO: 425849 - DNA, 25 bp, Homo sapien
atgggcgcatcgcatgaggtcggga

SEQ ID NO: 425850 - DNA, 25 bp, Homo sapien
tgggcgcatcgcatgaggtcgggag

SEQ ID NO: 425851 - DNA, 25 bp, Homo sapien
gagctgcaacttcttacttccctaa

SEQ ID NO: 425852 - DNA, 25 bp, Homo sapien
gcaacttcttacttccctaatgaag

SEQ ID NO: 425853 - DNA, 25 bp, Homo sapien
ttccctaatgaagttaagaacctga

SEQ ID NO: 425854 - DNA, 25 bp, Homo sapien
tgaagttaagaacctgaatataaat

SEQ ID NO: 425855 - DNA, 25 bp, Homo sapien
acctgaatataaatttgtgttctca

SEQ ID NO: 425856 - DNA, 25 bp, Homo sapien
aaatatttgctatgaagcgttgatg

SEQ ID NO: 425857 - DNA, 25 bp, Homo sapien
atttgctatgaagcgttgatggatt

SEQ ID NO: 425858 - DNA, 25 bp, Homo sapien
gctatgaagcgttgatggattaatt

SEQ ID NO: 425859 - DNA, 25 bp, Homo sapien
atgaagcgttgatggattaattaaa

SEQ ID NO: 425860 - DNA, 25 bp, Homo sapien
aataagtcaattcctagaagttgag

SEQ ID NO: 425861 - DNA, 25 bp, Homo sapien
caattcctagaagttgagagagcaa

SEQ ID NO: 425862 - DNA, 25 bp, Homo sapien
aactacacagtgtcttcttaatagt

SEQ ID NO: 425863 - DNA, 25 bp, Homo sapien
acagtgtcttcttaatagtggcatt

SEQ ID NO: 425864 - DNA, 25 bp, Homo sapien
tagtggcattaatttgtgtctcata

SEQ ID NO: 425865 - DNA, 25 bp, Homo sapien
gtgtctcatatcattctgttccctt

SEQ ID NO: 425866 - DNA, 25 bp, Homo sapien
gtctcatatcattctgttcccttaa

SEQ ID NO: 425867 - DNA, 25 bp, Homo sapien
attctgttcccttaatgagatggtg

SEQ ID NO: 425868 - DNA, 25 bp, Homo sapien
gaatttctgaggaagctatgcaaga

SEQ ID NO: 425869 - DNA, 25 bp, Homo sapien
aagatgcaaggaaggtagtagtaat

SEQ ID NO: 425870 - DNA, 25 bp, Homo sapien
ttaacaccagatgtctaggactggg

SEQ ID NO: 425871 - DNA, 25 bp, Homo sapien
gactaagcaattaatgcgcgaaatt

SEQ ID NO: 425872 - DNA, 25 bp, Homo sapien
atgcgcgaaattttataatgaactg

SEQ ID NO: 425873 - DNA, 25 bp, Homo sapien
gcatctgcctctcaaacaggtccag

SEQ ID NO: 425874 - DNA, 25 bp, Homo sapien
caaacaggtccagggcttcaaccag

SEQ ID NO: 425875 - DNA, 25 bp, Homo sapien
gtttgcactgcaagaagtaccagta

SEQ ID NO: 425876 - DNA, 25 bp, Homo sapien
ggcctcgccataatttgggctccgg

SEQ ID NO: 425877 - DNA, 25 bp, Homo sapien
ataatttgggctccggttccatttg

SEQ ID NO: 425878 - DNA, 25 bp, Homo sapien
ggttccatttgctcatctctccgtt

SEQ ID NO: 425879 - DNA, 25 bp, Homo sapien
aaaccgcaggttatggaactgggct

SEQ ID NO: 425880 - DNA, 25 bp, Homo sapien
aactgggctgcggatttgcggaata

SEQ ID NO: 425881 - DNA, 25 bp, Homo sapien
atttgcggaatagtctccgggagga

SEQ ID NO: 425882 - DNA, 25 bp, Homo sapien
gagtatttgtcagagagggtcccaa

SEQ ID NO: 425883 - DNA, 25 bp, Homo sapien
ttcttcctgcgtggccgtggagttg

SEQ ID NO: 425884 - DNA, 25 bp, Homo sapien
tgaaaggaattagaatccccaaccg

SEQ ID NO: 425885 - DNA, 25 bp, Homo sapien
gctggccagccgtcttcacgcgtgt

SEQ ID NO: 425886 - DNA, 25 bp, Homo sapien
tctctgtgtttgtggactggattca

SEQ ID NO: 425887 - DNA, 25 bp, Homo sapien
gattcacaaggtcatgagactgggt

SEQ ID NO: 425888 - DNA, 25 bp, Homo sapien
gagactgggttaggcccagccttga

SEQ ID NO: 425889 - DNA, 25 bp, Homo sapien
cagccttgacgccatatgctttggg

SEQ ID NO: 425890 - DNA, 25 bp, Homo sapien
ggaggacaaaacttgtaagtacagt

SEQ ID NO: 425891 - DNA, 25 bp, Homo sapien
aacttgtaagtacagtcaaggacaa

SEQ ID NO: 425892 - DNA, 25 bp, Homo sapien
tacagtcaaggacaagacttgtact

SEQ ID NO: 425893 - DNA, 25 bp, Homo sapien
ggacaagacttgtactcaaggttga

SEQ ID NO: 425894 - DNA, 25 bp, Homo sapien
gacttgtactcaaggttgagattta

SEQ ID NO: 425895 - DNA, 25 bp, Homo sapien
ccatatctgcaggagagctgttcta

SEQ ID NO: 425896 - DNA, 25 bp, Homo sapien
tatatagggccccaatccattgcca

SEQ ID NO: 425897 - DNA, 25 bp, Homo sapien
tgccatcaaattgcccttggacttt

SEQ ID NO: 425898 - DNA, 25 bp, Homo sapien
gcaaaattccaagctaccatgtaac

SEQ ID NO: 425899 - DNA, 25 bp, Homo sapien
gtttcctaccttctttacatgttgt

SEQ ID NO: 425900 - DNA, 25 bp, Homo sapien
catgttgtgcattgttgtggtccag

SEQ ID NO: 425901 - DNA, 25 bp, Homo sapien
gtggtccagaaatgccaaacctttt

SEQ ID NO: 425902 - DNA, 25 bp, Homo sapien
atggtgcaactttgagtccttggct

SEQ ID NO: 425903 - DNA, 25 bp, Homo sapien
gtccttggcttgactatacaggcct

SEQ ID NO: 425904 - DNA, 25 bp, Homo sapien
aggccttgaacttcatggcatatca

SEQ ID NO: 425905 - DNA, 25 bp, Homo sapien
ggcatatcaactttgccatatctgc

SEQ ID NO: 425906 - DNA, 25 bp, Homo sapien
cagctggtgggttgtcttccgccat

SEQ ID NO: 425907 - DNA, 25 bp, Homo sapien
gtgggttgtcttccgccatctttga

SEQ ID NO: 425908 - DNA, 25 bp, Homo sapien
ttgtcttccgccatctttgatcagg

SEQ ID NO: 425909 - DNA, 25 bp, Homo sapien
tcttccgccatctttgatcagggca

SEQ ID NO: 425910 - DNA, 25 bp, Homo sapien
cgccatctttgatcagggcactaag

SEQ ID NO: 425911 - DNA, 25 bp, Homo sapien
atcagggcactaaggatgctcccga

SEQ ID NO: 425912 - DNA, 25 bp, Homo sapien
agggcactaaggatgctcccgacgg

SEQ ID NO: 425913 - DNA, 25 bp, Homo sapien
actaaggatgctcccgacggccttc

SEQ ID NO: 425914 - DNA, 25 bp, Homo sapien
acggccttcacagtgacggcggaga

SEQ ID NO: 425915 - DNA, 25 bp, Homo sapien
ccttcacagtgacggcggagaccct

SEQ ID NO: 425916 - DNA, 25 bp, Homo sapien
ggtgggaaccgctgcgttccccatc

SEQ ID NO: 425917 - DNA, 25 bp, Homo sapien
caataaatatttctaggtgctttgt

SEQ ID NO: 425918 - DNA, 25 bp, Homo sapien
aatatttctaggtgctttgtgattc

SEQ ID NO: 425919 - DNA, 25 bp, Homo sapien
tttctaggtgctttgtgattctttc

SEQ ID NO: 425920 - DNA, 25 bp, Homo sapien
aagccattgctttactatattgcgt

SEQ ID NO: 425921 - DNA, 25 bp, Homo sapien
attgctttactatattgcgttgcca

SEQ ID NO: 425922 - DNA, 25 bp, Homo sapien
tgctttactatattgcgttgccact

SEQ ID NO: 425923 - DNA, 25 bp, Homo sapien
ctttactatattgcgttgccacttt

SEQ ID NO: 425924 - DNA, 25 bp, Homo sapien
gacattgtttttgacagatttcact

SEQ ID NO: 425925 - DNA, 25 bp, Homo sapien
gacagatttcactatattcttatgt

SEQ ID NO: 425926 - DNA, 25 bp, Homo sapien
gatttcactatattcttatgtaatt

SEQ ID NO: 425927 - DNA, 25 bp, Homo sapien
tgaataaactttgtactccctctaa

SEQ ID NO: 425928 - DNA, 25 bp, Homo sapien
gggaggacaaaacttgtaagtacag

SEQ ID NO: 425929 - DNA, 25 bp, Homo sapien
gaggacaaaacttgtaagtacagtc

SEQ ID NO: 425930 - DNA, 25 bp, Homo sapien
aaacttgtaagtacagtcaaggaca

SEQ ID NO: 425931 - DNA, 25 bp, Homo sapien
aacttgtaagtacagtcaaggacaa

SEQ ID NO: 425932 - DNA, 25 bp, Homo sapien
ttgtaagtacagtcaaggacaagac

SEQ ID NO: 425933 - DNA, 25 bp, Homo sapien
gtaagtacagtcaaggacaagactt

SEQ ID NO: 425934 - DNA, 25 bp, Homo sapien
aagtacagtcaaggacaagacttgt

SEQ ID NO: 425935 - DNA, 25 bp, Homo sapien
agtacagtcaaggacaagacttgta

SEQ ID NO: 425936 - DNA, 25 bp, Homo sapien
tacagtcaaggacaagacttgtact

SEQ ID NO: 425937 - DNA, 25 bp, Homo sapien
cagtcaaggacaagacttgtactca

SEQ ID NO: 425938 - DNA, 25 bp, Homo sapien
agtcaaggacaagacttgtactcaa

SEQ ID NO: 425939 - DNA, 25 bp, Homo sapien
ttctaaattatttcctcaccatcct

SEQ ID NO: 425940 - DNA, 25 bp, Homo sapien
tttcctcaccatccttttgttgaaa

SEQ ID NO: 425941 - DNA, 25 bp, Homo sapien
tggcatcgtacataatttttcaata

SEQ ID NO: 425942 - DNA, 25 bp, Homo sapien
tgaagcatagctgagtagttgaact

SEQ ID NO: 425943 - DNA, 25 bp, Homo sapien
ttggtgacctggctaagacttcctg

SEQ ID NO: 425944 - DNA, 25 bp, Homo sapien
ctggctaagacttcctgtttgtctt

SEQ ID NO: 425945 - DNA, 25 bp, Homo sapien
gttttaaatggtcttcatgccccac

SEQ ID NO: 425946 - DNA, 25 bp, Homo sapien
cttcatgccccacattcttaaatta

SEQ ID NO: 425947 - DNA, 25 bp, Homo sapien
gccccacattcttaaattatcacag

SEQ ID NO: 425948 - DNA, 25 bp, Homo sapien
ttatcacaggattttgttatgttac

SEQ ID NO: 425949 - DNA, 25 bp, Homo sapien
gttatgttactcagaattttgcttt

SEQ ID NO: 425950 - DNA, 25 bp, Homo sapien
atcttgtgaaacaacagtgccactg

SEQ ID NO: 425951 - DNA, 25 bp, Homo sapien
aacagtgccactggtctataatcca

SEQ ID NO: 425952 - DNA, 25 bp, Homo sapien
atgattctttaccaggtagctatag

SEQ ID NO: 425953 - DNA, 25 bp, Homo sapien
taccaggtagctatagtaatacaca

SEQ ID NO: 425954 - DNA, 25 bp, Homo sapien
atagtaatacacatagcgcctctga

SEQ ID NO: 425955 - DNA, 25 bp, Homo sapien
gtaatacacatagcgcctctgactg

SEQ ID NO: 425956 - DNA, 25 bp, Homo sapien
tacacatagcgcctctgactgggaa

SEQ ID NO: 425957 - DNA, 25 bp, Homo sapien
acatagcgcctctgactgggaatag

SEQ ID NO: 425958 - DNA, 25 bp, Homo sapien
atagcgcctctgactgggaatagtt

SEQ ID NO: 425959 - DNA, 25 bp, Homo sapien
gcgcctctgactgggaatagttact

SEQ ID NO: 425960 - DNA, 25 bp, Homo sapien
tgactgggaatagttactccctttt

SEQ ID NO: 425961 - DNA, 25 bp, Homo sapien
acagtcccggcccagttcagaagaa

SEQ ID NO: 425962 - DNA, 25 bp, Homo sapien
ggcccagttcagaagaacctgcaca

SEQ ID NO: 425963 - DNA, 25 bp, Homo sapien
agaagaacctgcacaaccctattgt

SEQ ID NO: 425964 - DNA, 25 bp, Homo sapien
gaacctgcacaaccctattgtacag

SEQ ID NO: 425965 - DNA, 25 bp, Homo sapien
gcacaaccctattgtacagtcacta

SEQ ID NO: 425966 - DNA, 25 bp, Homo sapien
tattgtacagtcactagaggatctt

SEQ ID NO: 425967 - DNA, 25 bp, Homo sapien
gtcactagaggatcttgaagaccaa

SEQ ID NO: 425968 - DNA, 25 bp, Homo sapien
gaggatcttgaagaccaaaaacgga

SEQ ID NO: 425969 - DNA, 25 bp, Homo sapien
ctctttgatggtaccgcccctgatt

SEQ ID NO: 425970 - DNA, 25 bp, Homo sapien
gtaccgcccctgattattacataga

SEQ ID NO: 425971 - DNA, 25 bp, Homo sapien
gacgcggactggtgatacgcgctcc

SEQ ID NO: 425972 - DNA, 25 bp, Homo sapien
ttaaaacacacacactgctctgcgt

SEQ ID NO: 425973 - DNA, 25 bp, Homo sapien
acacactgctctgcgttgtatagtt

SEQ ID NO: 425974 - DNA, 25 bp, Homo sapien
gctctgcgttgtatagtttttcctt

SEQ ID NO: 425975 - DNA, 25 bp, Homo sapien
tccttttttgtatgtaacagaacac

SEQ ID NO: 425976 - DNA, 25 bp, Homo sapien
gaacacatttcagattgtatttaat

SEQ ID NO: 425977 - DNA, 25 bp, Homo sapien
gagcaaatgtctgaatgtggcctga

SEQ ID NO: 425978 - DNA, 25 bp, Homo sapien
aatgtctgaatgtggcctgaatcaa

SEQ ID NO: 425979 - DNA, 25 bp, Homo sapien
gaatgtggcctgaatcaagtttaaa

SEQ ID NO: 425980 - DNA, 25 bp, Homo sapien
ccattgtttttattgtcctgagttg

SEQ ID NO: 425981 - DNA, 25 bp, Homo sapien
gtcctgagttgtcttaaacctgcaa

SEQ ID NO: 425982 - DNA, 25 bp, Homo sapien
acctgcaaaatatacactacccatt

SEQ ID NO: 425983 - DNA, 25 bp, Homo sapien
gtatgaagaatgtatagggcaataa

SEQ ID NO: 425984 - DNA, 25 bp, Homo sapien
tgtatagggcaataattgaaatctg

SEQ ID NO: 425985 - DNA, 25 bp, Homo sapien
tctgttgaagctgggtacacaaaag

SEQ ID NO: 425986 - DNA, 25 bp, Homo sapien
gttgaagctgggtacacaaaagttc

SEQ ID NO: 425987 - DNA, 25 bp, Homo sapien
gaagctgggtacacaaaagttcatt

SEQ ID NO: 425988 - DNA, 25 bp, Homo sapien
agctgggtacacaaaagttcattat

SEQ ID NO: 425989 - DNA, 25 bp, Homo sapien
gctgggtacacaaaagttcattatg

SEQ ID NO: 425990 - DNA, 25 bp, Homo sapien
gggtacacaaaagttcattatgttg

SEQ ID NO: 425991 - DNA, 25 bp, Homo sapien
aagttcattatgttgtttctctaca

SEQ ID NO: 425992 - DNA, 25 bp, Homo sapien
gttcattatgttgtttctctacatt

SEQ ID NO: 425993 - DNA, 25 bp, Homo sapien
tgtttctctacatttatatctattt

SEQ ID NO: 425994 - DNA, 25 bp, Homo sapien
taaagcagtcaggaatccacatggt

SEQ ID NO: 425995 - DNA, 25 bp, Homo sapien
aagcagtcaggaatccacatggtgt

SEQ ID NO: 425996 - DNA, 25 bp, Homo sapien
agcagtcaggaatccacatggtgta

SEQ ID NO: 425997 - DNA, 25 bp, Homo sapien
gcagtcaggaatccacatggtgtaa

SEQ ID NO: 425998 - DNA, 25 bp, Homo sapien
cagtcaggaatccacatggtgtaat

SEQ ID NO: 425999 - DNA, 25 bp, Homo sapien
gtcaggaatccacatggtgtaataa

SEQ ID NO: 426000 - DNA, 25 bp, Homo sapien
gaatccacatggtgtaataaagaga

SEQ ID NO: 426001 - DNA, 25 bp, Homo sapien
tccacatggtgtaataaagagactg

SEQ ID NO: 426002 - DNA, 25 bp, Homo sapien
catggtgtaataaagagactgggct

SEQ ID NO: 426003 - DNA, 25 bp, Homo sapien
aagagactgggctttagccgggcat

SEQ ID NO: 426004 - DNA, 25 bp, Homo sapien
gagactgggctttagccgggcatgg

SEQ ID NO: 426005 - DNA, 25 bp, Homo sapien
attatccagtcttgggcaattcttg

SEQ ID NO: 426006 - DNA, 25 bp, Homo sapien
ccagtcttgggcaattcttgatagc

SEQ ID NO: 426007 - DNA, 25 bp, Homo sapien
gtcttgggcaattcttgatagcagt

SEQ ID NO: 426008 - DNA, 25 bp, Homo sapien
ttgggcaattcttgatagcagtgtg

SEQ ID NO: 426009 - DNA, 25 bp, Homo sapien
tgtaatttaaatttcatgtcttttt

SEQ ID NO: 426010 - DNA, 25 bp, Homo sapien
ttctccttgccttacatagggtaaa

SEQ ID NO: 426011 - DNA, 25 bp, Homo sapien
gccttacatagggtaaagaccaaga

SEQ ID NO: 426012 - DNA, 25 bp, Homo sapien
aagaccaagaaatgccaaacgtgaa

SEQ ID NO: 426013 - DNA, 25 bp, Homo sapien
gaaatgccaaacgtgaactaaaata

SEQ ID NO: 426014 - DNA, 25 bp, Homo sapien
gaactaaaatatgtagggccttcaa

SEQ ID NO: 426015 - DNA, 25 bp, Homo sapien
ctaaaatatgtagggccttcaactt

SEQ ID NO: 426016 - DNA, 25 bp, Homo sapien
ccactgccaccaacagtgcaggatg

SEQ ID NO: 426017 - DNA, 25 bp, Homo sapien
caccaacagtgcaggatggccctaa

SEQ ID NO: 426018 - DNA, 25 bp, Homo sapien
acagtgcaggatggccctaagagga

SEQ ID NO: 426019 - DNA, 25 bp, Homo sapien
caggatggccctaagaggagaagta

SEQ ID NO: 426020 - DNA, 25 bp, Homo sapien
ggagaagtaatgtgctaccaagtgg

SEQ ID NO: 426021 - DNA, 25 bp, Homo sapien
gtgtgaaccaaacagtctggtacca

SEQ ID NO: 426022 - DNA, 25 bp, Homo sapien
ctggtaccaaaaccctattctggat

SEQ ID NO: 426023 - DNA, 25 bp, Homo sapien
aaaaccctattctggatcattcctc

SEQ ID NO: 426024 - DNA, 25 bp, Homo sapien
ctattctggatcattcctcctttct

SEQ ID NO: 426025 - DNA, 25 bp, Homo sapien
tggatcattcctcctttctgctcca

SEQ ID NO: 426026 - DNA, 25 bp, Homo sapien
ctttctgctccaccagcagtttggg

SEQ ID NO: 426027 - DNA, 25 bp, Homo sapien
gccctaattgttcaccagagaactc

SEQ ID NO: 426028 - DNA, 25 bp, Homo sapien
cctaattgttcaccagagaactcat

SEQ ID NO: 426029 - DNA, 25 bp, Homo sapien
gaaaatcattctgtgtgaagtcaaa

SEQ ID NO: 426030 - DNA, 25 bp, Homo sapien
ttgcacatcatagaacatacacagg

SEQ ID NO: 426031 - DNA, 25 bp, Homo sapien
tgcacatcatagaacatacacaggg

SEQ ID NO: 426032 - DNA, 25 bp, Homo sapien
gcacatcatagaacatacacagggg

SEQ ID NO: 426033 - DNA, 25 bp, Homo sapien
gtaagtgagggaaattactctgggt

SEQ ID NO: 426034 - DNA, 25 bp, Homo sapien
agtgagggaaattactctgggtgaa

SEQ ID NO: 426035 - DNA, 25 bp, Homo sapien
agggaaattactctgggtgaagtca

SEQ ID NO: 426036 - DNA, 25 bp, Homo sapien
aaattactctgggtgaagtcagaac

SEQ ID NO: 426037 - DNA, 25 bp, Homo sapien
aattactctgggtgaagtcagaact

SEQ ID NO: 426038 - DNA, 25 bp, Homo sapien
ttggccttagttccaggtagattaa

SEQ ID NO: 426039 - DNA, 25 bp, Homo sapien
aaagctgctagctcacatacaggac

SEQ ID NO: 426040 - DNA, 25 bp, Homo sapien
gctagctcacatacaggacagccag

SEQ ID NO: 426041 - DNA, 25 bp, Homo sapien
atactgctcacgtgcgctgcaggaa

SEQ ID NO: 426042 - DNA, 25 bp, Homo sapien
aagcaatcagtcacaactcacctag

SEQ ID NO: 426043 - DNA, 25 bp, Homo sapien
agtcacaactcacctagcgacctga

SEQ ID NO: 426044 - DNA, 25 bp, Homo sapien
tagcgacctgacttactctggaatc

SEQ ID NO: 426045 - DNA, 25 bp, Homo sapien
tactctggaatcttggcgggcatcg

SEQ ID NO: 426046 - DNA, 25 bp, Homo sapien
atcgccgaccctattattccattac

SEQ ID NO: 426047 - DNA, 25 bp, Homo sapien
ccacatgccaactgacttgatgctt

SEQ ID NO: 426048 - DNA, 25 bp, Homo sapien
gctgctgcctgtttgattctattta

SEQ ID NO: 426049 - DNA, 25 bp, Homo sapien
cattctccaccacaagtttcttaag

SEQ ID NO: 426050 - DNA, 25 bp, Homo sapien
tatgccacataaggctttcacttag

SEQ ID NO: 426051 - DNA, 25 bp, Homo sapien
gaaacttcataccatatgggcctag

SEQ ID NO: 426052 - DNA, 25 bp, Homo sapien
accatatgggcctagtagttctgat

SEQ ID NO: 426053 - DNA, 25 bp, Homo sapien
gtagttctgataatgacctcatttc

SEQ ID NO: 426054 - DNA, 25 bp, Homo sapien
gaatattcctctgcattgaatgtta

SEQ ID NO: 426055 - DNA, 25 bp, Homo sapien
attcattttctgtaggtaagttcac

SEQ ID NO: 426056 - DNA, 25 bp, Homo sapien
gttcacaaacgctttcattgcagga

SEQ ID NO: 426057 - DNA, 25 bp, Homo sapien
atgctatatggccattgctgacttg

SEQ ID NO: 426058 - DNA, 25 bp, Homo sapien
gctgacttgtcgtaacaaagtttcc

SEQ ID NO: 426059 - DNA, 25 bp, Homo sapien
agacttgtaatggttggctctccat

SEQ ID NO: 426060 - DNA, 25 bp, Homo sapien
ttttcgggctgctggaaagaccttt

SEQ ID NO: 426061 - DNA, 25 bp, Homo sapien
tttcgggctgctggaaagacctttt

SEQ ID NO: 426062 - DNA, 25 bp, Homo sapien
ttcgggctgctggaaagaccttttc

SEQ ID NO: 426063 - DNA, 25 bp, Homo sapien
tcgggctgctggaaagaccttttct

SEQ ID NO: 426064 - DNA, 25 bp, Homo sapien
cgggctgctggaaagaccttttctt

SEQ ID NO: 426065 - DNA, 25 bp, Homo sapien
ggctgctggaaagaccttttctttt

SEQ ID NO: 426066 - DNA, 25 bp, Homo sapien
tgctggaaagaccttttcttttctt

SEQ ID NO: 426067 - DNA, 25 bp, Homo sapien
aagtgactctcatgctttagcctcc

SEQ ID NO: 426068 - DNA, 25 bp, Homo sapien
gtgactctcatgctttagcctccca

SEQ ID NO: 426069 - DNA, 25 bp, Homo sapien
tgactctcatgctttagcctcccaa

SEQ ID NO: 426070 - DNA, 25 bp, Homo sapien
gactctcatgctttagcctcccaag

SEQ ID NO: 426071 - DNA, 25 bp, Homo sapien
agcagaatggcaggtgtcagaggat

SEQ ID NO: 426072 - DNA, 25 bp, Homo sapien
aagttactgtttaacgggtgcagag

SEQ ID NO: 426073 - DNA, 25 bp, Homo sapien
tgtttaacgggtgcagagtctcagt

SEQ ID NO: 426074 - DNA, 25 bp, Homo sapien
acgggtgcagagtctcagtttgaga

SEQ ID NO: 426075 - DNA, 25 bp, Homo sapien
gaaaatgaaactggtctggagatga

SEQ ID NO: 426076 - DNA, 25 bp, Homo sapien
gaaactggtctggagatgactgatg

SEQ ID NO: 426077 - DNA, 25 bp, Homo sapien
gagatgactgatggtgatggttaca

SEQ ID NO: 426078 - DNA, 25 bp, Homo sapien
tggtgatggttacattacaatgtga

SEQ ID NO: 426079 - DNA, 25 bp, Homo sapien
taacattattgaactgtatacctaa

SEQ ID NO: 426080 - DNA, 25 bp, Homo sapien
gaactgtatacctaaatacggctaa

SEQ ID NO: 426081 - DNA, 25 bp, Homo sapien
ctaaatacggctaaaatggcaaatt

SEQ ID NO: 426082 - DNA, 25 bp, Homo sapien
ccgttgtctccctgcaagtgctgat

SEQ ID NO: 426083 - DNA, 25 bp, Homo sapien
cgttgtctccctgcaagtgctgatt

SEQ ID NO: 426084 - DNA, 25 bp, Homo sapien
gttgtctccctgcaagtgctgattt

SEQ ID NO: 426085 - DNA, 25 bp, Homo sapien
ttgtctccctgcaagtgctgatttg

SEQ ID NO: 426086 - DNA, 25 bp, Homo sapien
tgtctccctgcaagtgctgatttga

SEQ ID NO: 426087 - DNA, 25 bp, Homo sapien
gtctccctgcaagtgctgatttgaa

SEQ ID NO: 426088 - DNA, 25 bp, Homo sapien
tctccctgcaagtgctgatttgaaa

SEQ ID NO: 426089 - DNA, 25 bp, Homo sapien
ctccctgcaagtgctgatttgaaat

SEQ ID NO: 426090 - DNA, 25 bp, Homo sapien
gaaagaggcaagatcatcctcgtta

SEQ ID NO: 426091 - DNA, 25 bp, Homo sapien
ggcaagatcatcctcgttatcagat

SEQ ID NO: 426092 - DNA, 25 bp, Homo sapien
gatcatcctcgttatcagatgataa

SEQ ID NO: 426093 - DNA, 25 bp, Homo sapien
atggaaactagtaagaatcttcaag

SEQ ID NO: 426094 - DNA, 25 bp, Homo sapien
aatcttcaagaaggttggcaatgac

SEQ ID NO: 426095 - DNA, 25 bp, Homo sapien
gaaggttggcaatgacagaattcac

SEQ ID NO: 426096 - DNA, 25 bp, Homo sapien
ggcaatgacagaattcacaacagga

SEQ ID NO: 426097 - DNA, 25 bp, Homo sapien
gaattcacaacaggaatactgtgta

SEQ ID NO: 426098 - DNA, 25 bp, Homo sapien
gtaaactagtcattttgagtaagat

SEQ ID NO: 426099 - DNA, 25 bp, Homo sapien
gtttttaaacagaggcatagcttgc

SEQ ID NO: 426100 - DNA, 25 bp, Homo sapien
agaggcatagcttgctatgttgccc

SEQ ID NO: 426101 - DNA, 25 bp, Homo sapien
tttctacctgccacgcgtcggtgaa

SEQ ID NO: 426102 - DNA, 25 bp, Homo sapien
ttctacctgccacgcgtcggtgaag

SEQ ID NO: 426103 - DNA, 25 bp, Homo sapien
tctacctgccacgcgtcggtgaagg

SEQ ID NO: 426104 - DNA, 25 bp, Homo sapien
ctacctgccacgcgtcggtgaaggt

SEQ ID NO: 426105 - DNA, 25 bp, Homo sapien
acctgccacgcgtcggtgaaggttg

SEQ ID NO: 426106 - DNA, 25 bp, Homo sapien
cctgccacgcgtcggtgaaggttgg

SEQ ID NO: 426107 - DNA, 25 bp, Homo sapien
tgccacgcgtcggtgaaggttggga

SEQ ID NO: 426108 - DNA, 25 bp, Homo sapien
gccacgcgtcggtgaaggttgggac

SEQ ID NO: 426109 - DNA, 25 bp, Homo sapien
ccacgcgtcggtgaaggttgggact

SEQ ID NO: 426110 - DNA, 25 bp, Homo sapien
cacgcgtcggtgaaggttgggactc

SEQ ID NO: 426111 - DNA, 25 bp, Homo sapien
acgcgtcggtgaaggttgggactcg

SEQ ID NO: 426112 - DNA, 25 bp, Homo sapien
atggaccttcatatagatggtgttt

SEQ ID NO: 426113 - DNA, 25 bp, Homo sapien
gtgttttggacagcacccccagaaa

SEQ ID NO: 426114 - DNA, 25 bp, Homo sapien
aagggttatcactttatctgtggtt

SEQ ID NO: 426115 - DNA, 25 bp, Homo sapien
ggttgtttcatataacattcctcag

SEQ ID NO: 426116 - DNA, 25 bp, Homo sapien
cagtgcaagtgcagaagattattgt

SEQ ID NO: 426117 - DNA, 25 bp, Homo sapien
gtatgtatttggtttttccagtcag

SEQ ID NO: 426118 - DNA, 25 bp, Homo sapien
tttccagtcagattagcctaatgcc

SEQ ID NO: 426119 - DNA, 25 bp, Homo sapien
cagattagcctaatgccagagaatg

SEQ ID NO: 426120 - DNA, 25 bp, Homo sapien
agcaggtaccactgtcattactttc

SEQ ID NO: 426121 - DNA, 25 bp, Homo sapien
ttcttgtgtagctttccagagctta

SEQ ID NO: 426122 - DNA, 25 bp, Homo sapien
gctttccagagcttatttgtacata

SEQ ID NO: 426123 - DNA, 25 bp, Homo sapien
actgaagctaagctcatcctgtctt

SEQ ID NO: 426124 - DNA, 25 bp, Homo sapien
tccttacattgctaatatctgactt

SEQ ID NO: 426125 - DNA, 25 bp, Homo sapien
gtgtcatttaagtaggtgtggaagc

SEQ ID NO: 426126 - DNA, 25 bp, Homo sapien
gtgtggaagcattagcctagatttt

SEQ ID NO: 426127 - DNA, 25 bp, Homo sapien
gactagttctttggtgtcttctgca

SEQ ID NO: 426128 - DNA, 25 bp, Homo sapien
ttggtgtcttctgcagctcatagag

SEQ ID NO: 426129 - DNA, 25 bp, Homo sapien
atagaggcactataatcacaacccc

SEQ ID NO: 426130 - DNA, 25 bp, Homo sapien
gaaagtgaaagtggctacacctctt

SEQ ID NO: 426131 - DNA, 25 bp, Homo sapien
aagtggctacacctcttagagaaca

SEQ ID NO: 426132 - DNA, 25 bp, Homo sapien
atcagtgagtatcttttatgggtaa

SEQ ID NO: 426133 - DNA, 25 bp, Homo sapien
gaaagagacctttcagttaactgaa

SEQ ID NO: 426134 - DNA, 25 bp, Homo sapien
ccagcctgttctccgggcctgaatg

SEQ ID NO: 426135 - DNA, 25 bp, Homo sapien
ggtgcttgtgccttttctgagaagc

SEQ ID NO: 426136 - DNA, 25 bp, Homo sapien
ttgtgccttttctgagaagcgttgt

SEQ ID NO: 426137 - DNA, 25 bp, Homo sapien
gaagcgttgtgactgctcaacatcc

SEQ ID NO: 426138 - DNA, 25 bp, Homo sapien
atccccatcaaggtttgagtccaca

SEQ ID NO: 426139 - DNA, 25 bp, Homo sapien
aaaagtggacctccctatcatgctt

SEQ ID NO: 426140 - DNA, 25 bp, Homo sapien
tccccttccctctagcatgtgggaa

SEQ ID NO: 426141 - DNA, 25 bp, Homo sapien
gttctgcattgctaaataagggctt

SEQ ID NO: 426142 - DNA, 25 bp, Homo sapien
attgctaaataagggcttcctctgc

SEQ ID NO: 426143 - DNA, 25 bp, Homo sapien
tgccttctacctacagtgcatttga

SEQ ID NO: 426144 - DNA, 25 bp, Homo sapien
cagtgcatttgaactgccttctgaa

SEQ ID NO: 426145 - DNA, 25 bp, Homo sapien
gtgagtcgagatcgagccattacat

SEQ ID NO: 426146 - DNA, 25 bp, Homo sapien
gagtcgagatcgagccattacattc

SEQ ID NO: 426147 - DNA, 25 bp, Homo sapien
agtcgagatcgagccattacattcc

SEQ ID NO: 426148 - DNA, 25 bp, Homo sapien
gagatcgagccattacattccatcc

SEQ ID NO: 426149 - DNA, 25 bp, Homo sapien
agatcgagccattacattccatcct

SEQ ID NO: 426150 - DNA, 25 bp, Homo sapien
gatcgagccattacattccatcctg

SEQ ID NO: 426151 - DNA, 25 bp, Homo sapien
atcgagccattacattccatcctgg

SEQ ID NO: 426152 - DNA, 25 bp, Homo sapien
tcgagccattacattccatcctggg

SEQ ID NO: 426153 - DNA, 25 bp, Homo sapien
cgagccattacattccatcctgggc

SEQ ID NO: 426154 - DNA, 25 bp, Homo sapien
caagagcaaaactagatgccaggat

SEQ ID NO: 426155 - DNA, 25 bp, Homo sapien
gagcaaaactagatgccaggatcac

SEQ ID NO: 426156 - DNA, 25 bp, Homo sapien
gtctcgcagcatcttctcatatggt

SEQ ID NO: 426157 - DNA, 25 bp, Homo sapien
tgcctaaagctttcccatagcaaaa

SEQ ID NO: 426158 - DNA, 25 bp, Homo sapien
gcagaaatagtcctcaactgttttt

SEQ ID NO: 426159 - DNA, 25 bp, Homo sapien
ttctgagtgtttcaatttctacagc

SEQ ID NO: 426160 - DNA, 25 bp, Homo sapien
aatttctacagcatctacactcatc

SEQ ID NO: 426161 - DNA, 25 bp, Homo sapien
tacactcatccgatttgcctgggtt

SEQ ID NO: 426162 - DNA, 25 bp, Homo sapien
ttgcctgggttgtagatttcatttt

SEQ ID NO: 426163 - DNA, 25 bp, Homo sapien
tgaatgaaatccctgctttgttctc

SEQ ID NO: 426164 - DNA, 25 bp, Homo sapien
aaatccctgctttgttctccaaaat

SEQ ID NO: 426165 - DNA, 25 bp, Homo sapien
tccaaaatccatttcagggttgcaa

SEQ ID NO: 426166 - DNA, 25 bp, Homo sapien
agggttgcaagatcatagttctcgg

SEQ ID NO: 426167 - DNA, 25 bp, Homo sapien
tgggtgggtcggtgggccctagatt

SEQ ID NO: 426168 - DNA, 25 bp, Homo sapien
tctgggcgcagggcccatttcttct

SEQ ID NO: 426169 - DNA, 25 bp, Homo sapien
ctgggcgcagggcccatttcttctt

SEQ ID NO: 426170 - DNA, 25 bp, Homo sapien
tggggagccggttcccccgttgcat

SEQ ID NO: 426171 - DNA, 25 bp, Homo sapien
ggagccggttcccccgttgcattgc

SEQ ID NO: 426172 - DNA, 25 bp, Homo sapien
ccccgttgcattgccgggccctgtg

SEQ ID NO: 426173 - DNA, 25 bp, Homo sapien
cattgccgggccctgtgggtgggtc

SEQ ID NO: 426174 - DNA, 25 bp, Homo sapien
attgccgggccctgtgggtgggtcg

SEQ ID NO: 426175 - DNA, 25 bp, Homo sapien
ttgccgggccctgtgggtgggtcgg

SEQ ID NO: 426176 - DNA, 25 bp, Homo sapien
tgccgggccctgtgggtgggtcggt

SEQ ID NO: 426177 - DNA, 25 bp, Homo sapien
gccgggccctgtgggtgggtcggtg

SEQ ID NO: 426178 - DNA, 25 bp, Homo sapien
ggacatcatggattgtctaacacca

SEQ ID NO: 426179 - DNA, 25 bp, Homo sapien
acagtccctggctcaggattctaat

SEQ ID NO: 426180 - DNA, 25 bp, Homo sapien
gctcaggattctaatgtagcattat

SEQ ID NO: 426181 - DNA, 25 bp, Homo sapien
ggataaacccagctgtgctacactg

SEQ ID NO: 426182 - DNA, 25 bp, Homo sapien
gtgctacactgcagagtaaaatctc

SEQ ID NO: 426183 - DNA, 25 bp, Homo sapien
aaatctctgagtcatgattctggac

SEQ ID NO: 426184 - DNA, 25 bp, Homo sapien
tcatgattctggactttgggagcta

SEQ ID NO: 426185 - DNA, 25 bp, Homo sapien
gactttgggagctagttttgaaact

SEQ ID NO: 426186 - DNA, 25 bp, Homo sapien
gaaactctgatttattgtagaactt

SEQ ID NO: 426187 - DNA, 25 bp, Homo sapien
gtagaacttaggcttgtaccaattt

SEQ ID NO: 426188 - DNA, 25 bp, Homo sapien
gctcccagccatattttgttcttaa

SEQ ID NO: 426189 - DNA, 25 bp, Homo sapien
aagtcctcagccacgtcaacagcgg

SEQ ID NO: 426190 - DNA, 25 bp, Homo sapien
agccacgtcaacagcggctgccagc

SEQ ID NO: 426191 - DNA, 25 bp, Homo sapien
gtcaacagcggctgccagctgctgc

SEQ ID NO: 426192 - DNA, 25 bp, Homo sapien
caggtgcccgcgtactgagtccgcg

SEQ ID NO: 426193 - DNA, 25 bp, Homo sapien
aggtgcccgcgtactgagtccgcgc

SEQ ID NO: 426194 - DNA, 25 bp, Homo sapien
tgggcgccccggacttggagagggt

SEQ ID NO: 426195 - DNA, 25 bp, Homo sapien
ccggacttggagagggtgcggccct

SEQ ID NO: 426196 - DNA, 25 bp, Homo sapien
cccgagtgtgcccaggaactcagag

SEQ ID NO: 426197 - DNA, 25 bp, Homo sapien
ccgagtgtgcccaggaactcagaga

SEQ ID NO: 426198 - DNA, 25 bp, Homo sapien
cgagtgtgcccaggaactcagagag

SEQ ID NO: 426199 - DNA, 25 bp, Homo sapien
agggtgcccaggactcgacaagctg

SEQ ID NO: 426200 - DNA, 25 bp, Homo sapien
aggactttctgcttgagctgcgcca

SEQ ID NO: 426201 - DNA, 25 bp, Homo sapien
agctccgtgttctgactcttgaggg

SEQ ID NO: 426202 - DNA, 25 bp, Homo sapien
ctgactcttgagggtcttcactttc

SEQ ID NO: 426203 - DNA, 25 bp, Homo sapien
ttcactttctcttccaggcgcgaga

SEQ ID NO: 426204 - DNA, 25 bp, Homo sapien
caggcgcgagatgcgctccagcttg

SEQ ID NO: 426205 - DNA, 25 bp, Homo sapien
cagcttgcgcttgcggcacttggag

SEQ ID NO: 426206 - DNA, 25 bp, Homo sapien
atgcggttgcgcagccgcttgcgct

SEQ ID NO: 426207 - DNA, 25 bp, Homo sapien
ttgatgcgctcctgcgtgtccatgt

SEQ ID NO: 426208 - DNA, 25 bp, Homo sapien
cctgcgtgtccatgtcgatgggcga

SEQ ID NO: 426209 - DNA, 25 bp, Homo sapien
ccgctgttgacgtggctgaggactt

SEQ ID NO: 426210 - DNA, 25 bp, Homo sapien
acgtggctgaggactttctgcttga

SEQ ID NO: 426211 - DNA, 25 bp, Homo sapien
ccattgctggttccatttagcttac

SEQ ID NO: 426212 - DNA, 25 bp, Homo sapien
cattgctggttccatttagcttaca

SEQ ID NO: 426213 - DNA, 25 bp, Homo sapien
attgctggttccatttagcttacat

SEQ ID NO: 426214 - DNA, 25 bp, Homo sapien
atattgttggctcatactgattatg

SEQ ID NO: 426215 - DNA, 25 bp, Homo sapien
gttggctcatactgattatggtgcc

SEQ ID NO: 426216 - DNA, 25 bp, Homo sapien
tggctcatactgattatggtgccta

SEQ ID NO: 426217 - DNA, 25 bp, Homo sapien
gctcatactgattatggtgcctaag

SEQ ID NO: 426218 - DNA, 25 bp, Homo sapien
catactgattatggtgcctaagaga

SEQ ID NO: 426219 - DNA, 25 bp, Homo sapien
actgattatggtgcctaagagagct

SEQ ID NO: 426220 - DNA, 25 bp, Homo sapien
gattatggtgcctaagagagctata

SEQ ID NO: 426221 - DNA, 25 bp, Homo sapien
ttatggtgcctaagagagctatata

SEQ ID NO: 426222 - DNA, 25 bp, Homo sapien
ataaccactttttgttgggcaatat

SEQ ID NO: 426223 - DNA, 25 bp, Homo sapien
ccactttttgttgggcaatatgaaa

SEQ ID NO: 426224 - DNA, 25 bp, Homo sapien
caaatgatagaaacagactgcctga

SEQ ID NO: 426225 - DNA, 25 bp, Homo sapien
gatagaaacagactgcctgaattga

SEQ ID NO: 426226 - DNA, 25 bp, Homo sapien
gaaacagactgcctgaattgagaat

SEQ ID NO: 426227 - DNA, 25 bp, Homo sapien
aacagactgcctgaattgagaattt

SEQ ID NO: 426228 - DNA, 25 bp, Homo sapien
gtttctttctaaattgctgttcctt

SEQ ID NO: 426229 - DNA, 25 bp, Homo sapien
tctttctaaattgctgttccttaat

SEQ ID NO: 426230 - DNA, 25 bp, Homo sapien
aattgctgttccttaatttgattaa

SEQ ID NO: 426231 - DNA, 25 bp, Homo sapien
aggcagatgagcttacaagtattga

SEQ ID NO: 426232 - DNA, 25 bp, Homo sapien
aacattctaattaaaggctttgcaa

SEQ ID NO: 426233 - DNA, 25 bp, Homo sapien
agcttttggatccacacctctgcac

SEQ ID NO: 426234 - DNA, 25 bp, Homo sapien
acacctctgcacaagtgtgaatacc

SEQ ID NO: 426235 - DNA, 25 bp, Homo sapien
gcacaagtgtgaatacctctgcaca

SEQ ID NO: 426236 - DNA, 25 bp, Homo sapien
gtgtgaatacctctgcacatatggg

SEQ ID NO: 426237 - DNA, 25 bp, Homo sapien
gtatctgtgtgtgctcgtgtatatg

SEQ ID NO: 426238 - DNA, 25 bp, Homo sapien
atctgtgtgtgctcgtgtatatggg

SEQ ID NO: 426239 - DNA, 25 bp, Homo sapien
ggccagatatgctccaccagccatg

SEQ ID NO: 426240 - DNA, 25 bp, Homo sapien
agatatgctccaccagccatgcaag

SEQ ID NO: 426241 - DNA, 25 bp, Homo sapien
agccatgcaagctgatgcagggcgg

SEQ ID NO: 426242 - DNA, 25 bp, Homo sapien
aagggctgggtgttgcactattgct

SEQ ID NO: 426243 - DNA, 25 bp, Homo sapien
gctgggtgttgcactattgctgcgc

SEQ ID NO: 426244 - DNA, 25 bp, Homo sapien
aagtcctcagccacgtcaacagcgg

SEQ ID NO: 426245 - DNA, 25 bp, Homo sapien
agtcctcagccacgtcaacagcggc

SEQ ID NO: 426246 - DNA, 25 bp, Homo sapien
gtcctcagccacgtcaacagcggct

SEQ ID NO: 426247 - DNA, 25 bp, Homo sapien
tcctcagccacgtcaacagcggctg

SEQ ID NO: 426248 - DNA, 25 bp, Homo sapien
cctcagccacgtcaacagcggctgc

SEQ ID NO: 426249 - DNA, 25 bp, Homo sapien
ctcagccacgtcaacagcggctgcc

SEQ ID NO: 426250 - DNA, 25 bp, Homo sapien
tcagccacgtcaacagcggctgcca

SEQ ID NO: 426251 - DNA, 25 bp, Homo sapien
cagccacgtcaacagcggctgccag

SEQ ID NO: 426252 - DNA, 25 bp, Homo sapien
agccacgtcaacagcggctgccagc

SEQ ID NO: 426253 - DNA, 25 bp, Homo sapien
gccacgtcaacagcggctgccagct

SEQ ID NO: 426254 - DNA, 25 bp, Homo sapien
ccacgtcaacagcggctgccagctg

SEQ ID NO: 426255 - DNA, 25 bp, Homo sapien
actctcagaaagctggcaaagaaaa

SEQ ID NO: 426256 - DNA, 25 bp, Homo sapien
agaaaatctttatctgacagtgaat

SEQ ID NO: 426257 - DNA, 25 bp, Homo sapien
tttatctgacagtgaatctgatgac

SEQ ID NO: 426258 - DNA, 25 bp, Homo sapien
acaaaccaagaggatttgccagagg

SEQ ID NO: 426259 - DNA, 25 bp, Homo sapien
caaaccaagaggatttgccagaggt

SEQ ID NO: 426260 - DNA, 25 bp, Homo sapien
aaaccaagaggatttgccagaggtc

SEQ ID NO: 426261 - DNA, 25 bp, Homo sapien
aaccaagaggatttgccagaggtct

SEQ ID NO: 426262 - DNA, 25 bp, Homo sapien
accaagaggatttgccagaggtctt

SEQ ID NO: 426263 - DNA, 25 bp, Homo sapien
agaggatttgccagaggtcttgatc

SEQ ID NO: 426264 - DNA, 25 bp, Homo sapien
ggatttgccagaggtcttgatcctg

SEQ ID NO: 426265 - DNA, 25 bp, Homo sapien
aggcaaatatgaagtgtcctcaaat

SEQ ID NO: 426266 - DNA, 25 bp, Homo sapien
tggccagaaaactgggccttgcaga

SEQ ID NO: 426267 - DNA, 25 bp, Homo sapien
ttgcagacccccttagcattttttc

SEQ ID NO: 426268 - DNA, 25 bp, Homo sapien
ttccttccctgctttctacttcttt

SEQ ID NO: 426269 - DNA, 25 bp, Homo sapien
agccccttgtgttttggagtctgac

SEQ ID NO: 426270 - DNA, 25 bp, Homo sapien
gagtctgactggagtctcgcatcct

SEQ ID NO: 426271 - DNA, 25 bp, Homo sapien
tctgactggagtctcgcatcctggg

SEQ ID NO: 426272 - DNA, 25 bp, Homo sapien
aagccctgtgtctttccatagtcag

SEQ ID NO: 426273 - DNA, 25 bp, Homo sapien
gtctttccatagtcagggtcaggcc

SEQ ID NO: 426274 - DNA, 25 bp, Homo sapien
gtcaggccctgcatctattccaagg

SEQ ID NO: 426275 - DNA, 25 bp, Homo sapien
gggcactcagtacacattccataaa

SEQ ID NO: 426276 - DNA, 25 bp, Homo sapien
ccccatgaaactcgagcaggtctct

SEQ ID NO: 426277 - DNA, 25 bp, Homo sapien
gtacatagtaggtgttgactggatt

SEQ ID NO: 426278 - DNA, 25 bp, Homo sapien
agggattagggctaagactcaaaga

SEQ ID NO: 426279 - DNA, 25 bp, Homo sapien
taagactcaaagaagaactgcccaa

SEQ ID NO: 426280 - DNA, 25 bp, Homo sapien
gaactgcccaaggtggattcttgac

SEQ ID NO: 426281 - DNA, 25 bp, Homo sapien
gtggattcttgactgtgccagagct

SEQ ID NO: 426282 - DNA, 25 bp, Homo sapien
tgactgtgccagagctgaccgaggt

SEQ ID NO: 426283 - DNA, 25 bp, Homo sapien
agagctgaccgaggtctgtccaaga

SEQ ID NO: 426284 - DNA, 25 bp, Homo sapien
gtctgtccaagacctaaggatgcta

SEQ ID NO: 426285 - DNA, 25 bp, Homo sapien
ctaaggatgctacaaggtgttcata

SEQ ID NO: 426286 - DNA, 25 bp, Homo sapien
acaaggtgttcatattgagcatggg

SEQ ID NO: 426287 - DNA, 25 bp, Homo sapien
gggtggtctgtcaatcaaaagaaga

SEQ ID NO: 426288 - DNA, 25 bp, Homo sapien
gggcccagtgttatttcttctgcat

SEQ ID NO: 426289 - DNA, 25 bp, Homo sapien
agtgttatttcttctgcatccagct

SEQ ID NO: 426290 - DNA, 25 bp, Homo sapien
ttctgcatccagctagccacttatc

SEQ ID NO: 426291 - DNA, 25 bp, Homo sapien
tccagctagccacttatcccaaggg

SEQ ID NO: 426292 - DNA, 25 bp, Homo sapien
aagactaccccgtcggtcattctgt

SEQ ID NO: 426293 - DNA, 25 bp, Homo sapien
taccccgtcggtcattctgttcctg

SEQ ID NO: 426294 - DNA, 25 bp, Homo sapien
gcctgggattttgcatttcaatctt

SEQ ID NO: 426295 - DNA, 25 bp, Homo sapien
gattcattttgagttgctttctgta

SEQ ID NO: 426296 - DNA, 25 bp, Homo sapien
tttgagttgctttctgtacatggtg

SEQ ID NO: 426297 - DNA, 25 bp, Homo sapien
agttgctttctgtacatggtgagac

SEQ ID NO: 426298 - DNA, 25 bp, Homo sapien
tgctttctgtacatggtgagacaca

SEQ ID NO: 426299 - DNA, 25 bp, Homo sapien
caggatcactgcaggtgagggtccc

SEQ ID NO: 426300 - DNA, 25 bp, Homo sapien
ccaggtgggagttgtacctctggtt

SEQ ID NO: 426301 - DNA, 25 bp, Homo sapien
gagttgtacctctggttgggcagca

SEQ ID NO: 426302 - DNA, 25 bp, Homo sapien
ttgtacctctggttgggcagcacct

SEQ ID NO: 426303 - DNA, 25 bp, Homo sapien
gttgggcagcacctctgtcatctcc

SEQ ID NO: 426304 - DNA, 25 bp, Homo sapien
catcttggtcttcaggaaaatccca

SEQ ID NO: 426305 - DNA, 25 bp, Homo sapien
tcaggaaaatcccaaaaccaacatc

SEQ ID NO: 426306 - DNA, 25 bp, Homo sapien
caacatccgctccatctgacataaa

SEQ ID NO: 426307 - DNA, 25 bp, Homo sapien
atccgctccatctgacataaactgc

SEQ ID NO: 426308 - DNA, 25 bp, Homo sapien
tccatctgacataaactgccacctg

SEQ ID NO: 426309 - DNA, 25 bp, Homo sapien
gggaagaggatctcatactccactt

SEQ ID NO: 426310 - DNA, 25 bp, Homo sapien
tttacacttgttcggcttttttcat

SEQ ID NO: 426311 - DNA, 25 bp, Homo sapien
acacttgttcggcttttttcatcaa

SEQ ID NO: 426312 - DNA, 25 bp, Homo sapien
cacttgttcggcttttttcatcaac

SEQ ID NO: 426313 - DNA, 25 bp, Homo sapien
acttgttcggcttttttcatcaaca

SEQ ID NO: 426314 - DNA, 25 bp, Homo sapien
tcagattaaagaagagctctcagaa

SEQ ID NO: 426315 - DNA, 25 bp, Homo sapien
ccacctttctaaaccagaccaatgt

SEQ ID NO: 426316 - DNA, 25 bp, Homo sapien
atgtatttgatatcttatgcctccc

SEQ ID NO: 426317 - DNA, 25 bp, Homo sapien
tgtatttgatatcttatgcctccct

SEQ ID NO: 426318 - DNA, 25 bp, Homo sapien
gtatttgatatcttatgcctcccta

SEQ ID NO: 426319 - DNA, 25 bp, Homo sapien
atttgatatcttatgcctccctaaa

SEQ ID NO: 426320 - DNA, 25 bp, Homo sapien
tttgatatcttatgcctccctaaaa

SEQ ID NO: 426321 - DNA, 25 bp, Homo sapien
aagccctgtgtctttccatagtcag

SEQ ID NO: 426322 - DNA, 25 bp, Homo sapien
ctgtgtctttccatagtcagggtca

SEQ ID NO: 426323 - DNA, 25 bp, Homo sapien
gtgtctttccatagtcagggtcagg

SEQ ID NO: 426324 - DNA, 25 bp, Homo sapien
gtctttccatagtcagggtcaggcc

SEQ ID NO: 426325 - DNA, 25 bp, Homo sapien
tctttccatagtcagggtcaggccc

SEQ ID NO: 426326 - DNA, 25 bp, Homo sapien
tgcatctattccaaggggcactcag

SEQ ID NO: 426327 - DNA, 25 bp, Homo sapien
gggcactcagtacacattccataaa

SEQ ID NO: 426328 - DNA, 25 bp, Homo sapien
ggcactcagtacacattccataaat

SEQ ID NO: 426329 - DNA, 25 bp, Homo sapien
caccccatgaaactcgagcaggtct

SEQ ID NO: 426330 - DNA, 25 bp, Homo sapien
ccccatgaaactcgagcaggtctct

SEQ ID NO: 426331 - DNA, 25 bp, Homo sapien
ccatgaaactcgagcaggtctctgg

SEQ ID NO: 426332 - DNA, 25 bp, Homo sapien
cgaatcaaacacaaacagcgaggga

SEQ ID NO: 426333 - DNA, 25 bp, Homo sapien
ggaagttacacaaacgccagcacaa

SEQ ID NO: 426334 - DNA, 25 bp, Homo sapien
aaccagtgtcacatcatctacagcc

SEQ ID NO: 426335 - DNA, 25 bp, Homo sapien
acagccacagtggtatcctaactac

SEQ ID NO: 426336 - DNA, 25 bp, Homo sapien
atcctaactaccgtctttttgctag

SEQ ID NO: 426337 - DNA, 25 bp, Homo sapien
gtctttttgctaggacttaaactga

SEQ ID NO: 426338 - DNA, 25 bp, Homo sapien
acttaaactgacttgagtgtggcaa

SEQ ID NO: 426339 - DNA, 25 bp, Homo sapien
gaacaatcgtttgtggtttcttggg

SEQ ID NO: 426340 - DNA, 25 bp, Homo sapien
gggaaaacttttcataccaggtgat

SEQ ID NO: 426341 - DNA, 25 bp, Homo sapien
gtgatactattcaaaaaccccgttg

SEQ ID NO: 426342 - DNA, 25 bp, Homo sapien
gtctccctgcaagtgctgatttgaa

SEQ ID NO: 426343 - DNA, 25 bp, Homo sapien
tatgccaggttttcttggtgcttct

SEQ ID NO: 426344 - DNA, 25 bp, Homo sapien
gcttcttctggtgggttgttaagaa

SEQ ID NO: 426345 - DNA, 25 bp, Homo sapien
ggatctggacttacctcaattgctt

SEQ ID NO: 426346 - DNA, 25 bp, Homo sapien
ggacttacctcaattgcttttgctg

SEQ ID NO: 426347 - DNA, 25 bp, Homo sapien
caattgcttttgctgcttgttcttt

SEQ ID NO: 426348 - DNA, 25 bp, Homo sapien
ttcatcttacttcaactacacctat

SEQ ID NO: 426349 - DNA, 25 bp, Homo sapien
caaattccacaaacgcaaatccctt

SEQ ID NO: 426350 - DNA, 25 bp, Homo sapien
aacgcaaatccctttggatctccag

SEQ ID NO: 426351 - DNA, 25 bp, Homo sapien
tattgaaaaatactcacccacaact

SEQ ID NO: 426352 - DNA, 25 bp, Homo sapien
acccacaactcttaaggctggaatg

SEQ ID NO: 426353 - DNA, 25 bp, Homo sapien
ctcttaaggctggaatgggcttatt

SEQ ID NO: 426354 - DNA, 25 bp, Homo sapien
attcaagccaggtgccccctaacga

SEQ ID NO: 426355 - DNA, 25 bp, Homo sapien
aagccaggtgccccctaacgaatca

SEQ ID NO: 426356 - DNA, 25 bp, Homo sapien
agccaggtgccccctaacgaatcaa

SEQ ID NO: 426357 - DNA, 25 bp, Homo sapien
gccaggtgccccctaacgaatcaaa

SEQ ID NO: 426358 - DNA, 25 bp, Homo sapien
caggtgccccctaacgaatcaaaca

SEQ ID NO: 426359 - DNA, 25 bp, Homo sapien
ggtgccccctaacgaatcaaacaca

SEQ ID NO: 426360 - DNA, 25 bp, Homo sapien
actgacttgagtgtggcaaaaagtt

SEQ ID NO: 426361 - DNA, 25 bp, Homo sapien
ctgacttgagtgtggcaaaaagtta

SEQ ID NO: 426362 - DNA, 25 bp, Homo sapien
aagggctcaactatggtgttgctac

SEQ ID NO: 426363 - DNA, 25 bp, Homo sapien
ggtgttgctactgccattgttatta

SEQ ID NO: 426364 - DNA, 25 bp, Homo sapien
gccattgttattacaggcacacagt

SEQ ID NO: 426365 - DNA, 25 bp, Homo sapien
ggcacacagttcgagctataatcat

SEQ ID NO: 426366 - DNA, 25 bp, Homo sapien
aattcttatgtgtcagttctggatc

SEQ ID NO: 426367 - DNA, 25 bp, Homo sapien
tctggatcgaggtctgagattctgc

SEQ ID NO: 426368 - DNA, 25 bp, Homo sapien
gattctgcatttcaaacaaacttcc

SEQ ID NO: 426369 - DNA, 25 bp, Homo sapien
aaacaaacttccaggaatgctgctg

SEQ ID NO: 426370 - DNA, 25 bp, Homo sapien
tgcttcttggtccacacttggagaa

SEQ ID NO: 426371 - DNA, 25 bp, Homo sapien
catgtcttatggattggtgtgtgaa

SEQ ID NO: 426372 - DNA, 25 bp, Homo sapien
gtgtgaattcagttagcgagtgtag

SEQ ID NO: 426373 - DNA, 25 bp, Homo sapien
gcaacatggatcagtgtgtgtcccc

SEQ ID NO: 426374 - DNA, 25 bp, Homo sapien
atccacagtggccttccttgctggt

SEQ ID NO: 426375 - DNA, 25 bp, Homo sapien
gcagtgtatcctgatggcagggtac

SEQ ID NO: 426376 - DNA, 25 bp, Homo sapien
cctgatggcagggtacaagtaccat

SEQ ID NO: 426377 - DNA, 25 bp, Homo sapien
gtaccattaatgaagggtctgcaac

SEQ ID NO: 426378 - DNA, 25 bp, Homo sapien
gggtctgcaacataaagccttaaaa

SEQ ID NO: 426379 - DNA, 25 bp, Homo sapien
gaaaactgtaaaaccttgaacattg

SEQ ID NO: 426380 - DNA, 25 bp, Homo sapien
gatcactatgtttgttgtgctaacc

SEQ ID NO: 426381 - DNA, 25 bp, Homo sapien
gtgctaaccacttatttgattctgt

SEQ ID NO: 426382 - DNA, 25 bp, Homo sapien
ttctgttttgtggtggacatagatg

SEQ ID NO: 426383 - DNA, 25 bp, Homo sapien
gacatagatgattacgtttgagctt

SEQ ID NO: 426384 - DNA, 25 bp, Homo sapien
aaggcattcagtattgcaacgggac

SEQ ID NO: 426385 - DNA, 25 bp, Homo sapien
ttcagtattgcaacgggacagtcct

SEQ ID NO: 426386 - DNA, 25 bp, Homo sapien
gtattgcaacgggacagtccttgga

SEQ ID NO: 426387 - DNA, 25 bp, Homo sapien
ttgcaacgggacagtccttggagga

SEQ ID NO: 426388 - DNA, 25 bp, Homo sapien
aagtacttaggccaggcaaggtgcc

SEQ ID NO: 426389 - DNA, 25 bp, Homo sapien
gtacttaggccaggcaaggtgcctc

SEQ ID NO: 426390 - DNA, 25 bp, Homo sapien
cttaggccaggcaaggtgcctcaca

SEQ ID NO: 426391 - DNA, 25 bp, Homo sapien
acttttggaagccaacgccagagga

SEQ ID NO: 426392 - DNA, 25 bp, Homo sapien
ttttggaagccaacgccagaggatc

SEQ ID NO: 426393 - DNA, 25 bp, Homo sapien
ggaagccaacgccagaggatcattt

SEQ ID NO: 426394 - DNA, 25 bp, Homo sapien
gatcatttgagttaagaaaccagcc

SEQ ID NO: 426395 - DNA, 25 bp, Homo sapien
gagtttatcacttaggatatagaat

SEQ ID NO: 426396 - DNA, 25 bp, Homo sapien
gaaactgttacctataaacaaagat

SEQ ID NO: 426397 - DNA, 25 bp, Homo sapien
aacaaagattgactggattcgatcc

SEQ ID NO: 426398 - DNA, 25 bp, Homo sapien
gattgactggattcgatccaaaaga

SEQ ID NO: 426399 - DNA, 25 bp, Homo sapien
ggattcgatccaaaagataaaactt

SEQ ID NO: 426400 - DNA, 25 bp, Homo sapien
acttgaagctattctggaactaaca

SEQ ID NO: 426401 - DNA, 25 bp, Homo sapien
ctattctggaactaacatggaaaaa

SEQ ID NO: 426402 - DNA, 25 bp, Homo sapien
tacattgttgatgggatatgagtta

SEQ ID NO: 426403 - DNA, 25 bp, Homo sapien
tacaaactgtaattgatgaggacat

SEQ ID NO: 426404 - DNA, 25 bp, Homo sapien
attgatgaggacatggataatatct

SEQ ID NO: 426405 - DNA, 25 bp, Homo sapien
gtttctgagaagtaatctgtatgtg

SEQ ID NO: 426406 - DNA, 25 bp, Homo sapien
atgcgccgcttcttcgagagccgct

SEQ ID NO: 426407 - DNA, 25 bp, Homo sapien
ccgcttcttcgagagccgctgggag

SEQ ID NO: 426408 - DNA, 25 bp, Homo sapien
ccgctgggaggagttttatcaggga

SEQ ID NO: 426409 - DNA, 25 bp, Homo sapien
caggccaatctgtgaggcaagggag

SEQ ID NO: 426410 - DNA, 25 bp, Homo sapien
gggagtcaccttgtggcatctcccc

SEQ ID NO: 426411 - DNA, 25 bp, Homo sapien
acaaaaacctgccattttcacctgc

SEQ ID NO: 426412 - DNA, 25 bp, Homo sapien
aacctgccattttcacctgctgatg

SEQ ID NO: 426413 - DNA, 25 bp, Homo sapien
cagactcaagtcagatacaaccctg

SEQ ID NO: 426414 - DNA, 25 bp, Homo sapien
tcaagtcagatacaaccctgatttt

SEQ ID NO: 426415 - DNA, 25 bp, Homo sapien
acatcctcttattcctacatccctt

SEQ ID NO: 426416 - DNA, 25 bp, Homo sapien
gctcctcaagtaagaggtgcagaga

SEQ ID NO: 426417 - DNA, 25 bp, Homo sapien
ccagactggccttgagccacagtcc

SEQ ID NO: 426418 - DNA, 25 bp, Homo sapien
tggccttgagccacagtccctcttt

SEQ ID NO: 426419 - DNA, 25 bp, Homo sapien
ggctcccgggtctgtccatttgtta

SEQ ID NO: 426420 - DNA, 25 bp, Homo sapien
cgggtctgtccatttgttactgtgc

SEQ ID NO: 426421 - DNA, 25 bp, Homo sapien
gccgaggtggcgtgagattccactt

SEQ ID NO: 426422 - DNA, 25 bp, Homo sapien
gagattccacttgtgtagaactttg

SEQ ID NO: 426423 - DNA, 25 bp, Homo sapien
gttgttttttgcacaatgaagtttc

SEQ ID NO: 426424 - DNA, 25 bp, Homo sapien
atgaagtttcagcttctcaaccttc

SEQ ID NO: 426425 - DNA, 25 bp, Homo sapien
gaagtttcagcttctcaaccttctc

SEQ ID NO: 426426 - DNA, 25 bp, Homo sapien
ctacccagggctgtggacccagact

SEQ ID NO: 426427 - DNA, 25 bp, Homo sapien
tgtggacccagactggccttgagcc

SEQ ID NO: 426428 - DNA, 25 bp, Homo sapien
cttggatactgcaattgcatttgaa

SEQ ID NO: 426429 - DNA, 25 bp, Homo sapien
gcaattgcatttgaaagatctattt

SEQ ID NO: 426430 - DNA, 25 bp, Homo sapien
gatctattttccaaaacctgagcag

SEQ ID NO: 426431 - DNA, 25 bp, Homo sapien
tattttccaaaacctgagcagagag

SEQ ID NO: 426432 - DNA, 25 bp, Homo sapien
gctaggaggaatgcagacaggacat

SEQ ID NO: 426433 - DNA, 25 bp, Homo sapien
gaggaatgcagacaggacattgaaa

SEQ ID NO: 426434 - DNA, 25 bp, Homo sapien
gacattgaaaatgcgaattcccttt

SEQ ID NO: 426435 - DNA, 25 bp, Homo sapien
gaaaatgcgaattccctttactagt

SEQ ID NO: 426436 - DNA, 25 bp, Homo sapien
aatgcgaattccctttactagtaga

SEQ ID NO: 426437 - DNA, 25 bp, Homo sapien
gaattccctttactagtagaacatg

SEQ ID NO: 426438 - DNA, 25 bp, Homo sapien
aaaatactacgaggttttctcatct

SEQ ID NO: 426439 - DNA, 25 bp, Homo sapien
agtttctgcatgtagggaagttgga

SEQ ID NO: 426440 - DNA, 25 bp, Homo sapien
cctcccctgggagcttgtaacaaag

SEQ ID NO: 426441 - DNA, 25 bp, Homo sapien
gtaacaaagcagacagggatgcaaa

SEQ ID NO: 426442 - DNA, 25 bp, Homo sapien
taaatgatgtcagcctgcagccaaa

SEQ ID NO: 426443 - DNA, 25 bp, Homo sapien
gctgacccactgctcatcgcgaggg

SEQ ID NO: 426444 - DNA, 25 bp, Homo sapien
tgctcatcgcgagggcctgccagga

SEQ ID NO: 426445 - DNA, 25 bp, Homo sapien
cctcccgcactacttgtgagtaaag

SEQ ID NO: 426446 - DNA, 25 bp, Homo sapien
aataccaatcttagagtacaactgt

SEQ ID NO: 426447 - DNA, 25 bp, Homo sapien
gtacaactgtaccagcagtaagtat

SEQ ID NO: 426448 - DNA, 25 bp, Homo sapien
ctgtaccagcagtaagtatatctag

SEQ ID NO: 426449 - DNA, 25 bp, Homo sapien
gtatatctaggactgtaactgacaa

SEQ ID NO: 426450 - DNA, 25 bp, Homo sapien
cattactttcagacattacccattg

SEQ ID NO: 426451 - DNA, 25 bp, Homo sapien
attacccattgatgtcctgctatga

SEQ ID NO: 426452 - DNA, 25 bp, Homo sapien
attgatgtcctgctatgagaaatga

SEQ ID NO: 426453 - DNA, 25 bp, Homo sapien
gatcatttacagcaagttcaactcc

SEQ ID NO: 426454 - DNA, 25 bp, Homo sapien
ttacagcaagttcaactccgtcctg

SEQ ID NO: 426455 - DNA, 25 bp, Homo sapien
tcaactccgtcctgcttctagtata

SEQ ID NO: 426456 - DNA, 25 bp, Homo sapien
gagtaatgcctttatttcctgttcc

SEQ ID NO: 426457 - DNA, 25 bp, Homo sapien
atgcctttatttcctgttccatgaa

SEQ ID NO: 426458 - DNA, 25 bp, Homo sapien
gttccatgaactacagacaatattt

SEQ ID NO: 426459 - DNA, 25 bp, Homo sapien
ttgttagatgagagaataccctttc

SEQ ID NO: 426460 - DNA, 25 bp, Homo sapien
atctccatacctacataatatgtgg

SEQ ID NO: 426461 - DNA, 25 bp, Homo sapien
tttgttaagaaaggtggctgggcac

SEQ ID NO: 426462 - DNA, 25 bp, Homo sapien
agaaaggtggctgggcacaagggct

SEQ ID NO: 426463 - DNA, 25 bp, Homo sapien
tcacttgagccgaggcggacgtttt

SEQ ID NO: 426464 - DNA, 25 bp, Homo sapien
cacttgagccgaggcggacgttttt

SEQ ID NO: 426465 - DNA, 25 bp, Homo sapien
acttgagccgaggcggacgtttttg

SEQ ID NO: 426466 - DNA, 25 bp, Homo sapien
gccgaggcggacgtttttgagatca

SEQ ID NO: 426467 - DNA, 25 bp, Homo sapien
ccgaggcggacgtttttgagatcag

SEQ ID NO: 426468 - DNA, 25 bp, Homo sapien
cgaggcggacgtttttgagatcagc

SEQ ID NO: 426469 - DNA, 25 bp, Homo sapien
gaggcggacgtttttgagatcagcc

SEQ ID NO: 426470 - DNA, 25 bp, Homo sapien
aggcggacgtttttgagatcagcct

SEQ ID NO: 426471 - DNA, 25 bp, Homo sapien
ggcggacgtttttgagatcagcctg

SEQ ID NO: 426472 - DNA, 25 bp, Homo sapien
ttgtagtcaatgtttggatgctcag

SEQ ID NO: 426473 - DNA, 25 bp, Homo sapien
gtttggatgctcaggagaacctgaa

SEQ ID NO: 426474 - DNA, 25 bp, Homo sapien
caggagaacctgaatttatcagttt

SEQ ID NO: 426475 - DNA, 25 bp, Homo sapien
tatcagtttaattctcagcaggttg

SEQ ID NO: 426476 - DNA, 25 bp, Homo sapien
tctcagcaggttgaaatgctttaag

SEQ ID NO: 426477 - DNA, 25 bp, Homo sapien
tgctttaagagaatttgtgtgctaa

SEQ ID NO: 426478 - DNA, 25 bp, Homo sapien
agttttgatttattagtcttacaag

SEQ ID NO: 426479 - DNA, 25 bp, Homo sapien
acaagaactaagtaagtcctgagaa

SEQ ID NO: 426480 - DNA, 25 bp, Homo sapien
agattttgtttcttctatttgtaag

SEQ ID NO: 426481 - DNA, 25 bp, Homo sapien
tatttgtaagtcttcctgttaggga

SEQ ID NO: 426482 - DNA, 25 bp, Homo sapien
tcctgttagggatttgaagatttta

SEQ ID NO: 426483 - DNA, 25 bp, Homo sapien
aaatggttcagctcttagttatttt

SEQ ID NO: 426484 - DNA, 25 bp, Homo sapien
aatggttcagctcttagttattttt

SEQ ID NO: 426485 - DNA, 25 bp, Homo sapien
atggttcagctcttagttattttta

SEQ ID NO: 426486 - DNA, 25 bp, Homo sapien
ttaaactaatgacctgtgttatact

SEQ ID NO: 426487 - DNA, 25 bp, Homo sapien
aaactaatgacctgtgttatacttc

SEQ ID NO: 426488 - DNA, 25 bp, Homo sapien
aactaatgacctgtgttatacttcc

SEQ ID NO: 426489 - DNA, 25 bp, Homo sapien
actaatgacctgtgttatacttcct

SEQ ID NO: 426490 - DNA, 25 bp, Homo sapien
ctaatgacctgtgttatacttccta

SEQ ID NO: 426491 - DNA, 25 bp, Homo sapien
taatgacctgtgttatacttcctat

SEQ ID NO: 426492 - DNA, 25 bp, Homo sapien
aatgacctgtgttatacttcctatt

SEQ ID NO: 426493 - DNA, 25 bp, Homo sapien
atgacctgtgttatacttcctattt

SEQ ID NO: 426494 - DNA, 25 bp, Homo sapien
gccgaagagggcagatcccttgaac

SEQ ID NO: 426495 - DNA, 25 bp, Homo sapien
cgaagagggcagatcccttgaaccc

SEQ ID NO: 426496 - DNA, 25 bp, Homo sapien
gaagagggcagatcccttgaaccca

SEQ ID NO: 426497 - DNA, 25 bp, Homo sapien
atctctacaaaatagttcgctgcgt

SEQ ID NO: 426498 - DNA, 25 bp, Homo sapien
tctctacaaaatagttcgctgcgtg

SEQ ID NO: 426499 - DNA, 25 bp, Homo sapien
ctctacaaaatagttcgctgcgtgt

SEQ ID NO: 426500 - DNA, 25 bp, Homo sapien
tctacaaaatagttcgctgcgtgtg

SEQ ID NO: 426501 - DNA, 25 bp, Homo sapien
ctacaaaatagttcgctgcgtgtgg

SEQ ID NO: 426502 - DNA, 25 bp, Homo sapien
tacaaaatagttcgctgcgtgtggt

SEQ ID NO: 426503 - DNA, 25 bp, Homo sapien
aaaatagttcgctgcgtgtggtggt

SEQ ID NO: 426504 - DNA, 25 bp, Homo sapien
cagaggagcccagttggagatcagc

SEQ ID NO: 426505 - DNA, 25 bp, Homo sapien
ttttttctcatctcttttctgggtt

SEQ ID NO: 426506 - DNA, 25 bp, Homo sapien
tttcttatctgcctgttttgcaagc

SEQ ID NO: 426507 - DNA, 25 bp, Homo sapien
tcttatctgcctgttttgcaagcac

SEQ ID NO: 426508 - DNA, 25 bp, Homo sapien
ttatctgcctgttttgcaagcacct

SEQ ID NO: 426509 - DNA, 25 bp, Homo sapien
tatctgcctgttttgcaagcacctt

SEQ ID NO: 426510 - DNA, 25 bp, Homo sapien
atctgcctgttttgcaagcaccttc

SEQ ID NO: 426511 - DNA, 25 bp, Homo sapien
tctgcctgttttgcaagcaccttct

SEQ ID NO: 426512 - DNA, 25 bp, Homo sapien
gcctgttttgcaagcaccttctcct

SEQ ID NO: 426513 - DNA, 25 bp, Homo sapien
aagcaccttctcctgtgtccttggg

SEQ ID NO: 426514 - DNA, 25 bp, Homo sapien
gcaccttctcctgtgtccttgggag

SEQ ID NO: 426515 - DNA, 25 bp, Homo sapien
cttctcctgtgtccttgggagccct

SEQ ID NO: 426516 - DNA, 25 bp, Homo sapien
aaaagaacctgctgcggctacagga

SEQ ID NO: 426517 - DNA, 25 bp, Homo sapien
aaagaacctgctgcggctacaggac

SEQ ID NO: 426518 - DNA, 25 bp, Homo sapien
gtggacaagctgcaactgaaggtca

SEQ ID NO: 426519 - DNA, 25 bp, Homo sapien
gagccgtgacattggtgccaagcaa

SEQ ID NO: 426520 - DNA, 25 bp, Homo sapien
gccgtgacattggtgccaagcaaaa

SEQ ID NO: 426521 - DNA, 25 bp, Homo sapien
acattggtgccaagcaaaaaatgca

SEQ ID NO: 426522 - DNA, 25 bp, Homo sapien
ggtgccaagcaaaaaatgcacgatg

SEQ ID NO: 426523 - DNA, 25 bp, Homo sapien
tgcacgatgaggagtgacactgcct

SEQ ID NO: 426524 - DNA, 25 bp, Homo sapien
acgatgaggagtgacactgcctcgg

SEQ ID NO: 426525 - DNA, 25 bp, Homo sapien
atgaggagtgacactgcctcgggaa

SEQ ID NO: 426526 - DNA, 25 bp, Homo sapien
aggagtgacactgcctcgggaacct

SEQ ID NO: 426527 - DNA, 25 bp, Homo sapien
gactggctgcatcagtcccgcaagg

SEQ ID NO: 426528 - DNA, 25 bp, Homo sapien
gtcccgcaaggctggtttcttctta

SEQ ID NO: 426529 - DNA, 25 bp, Homo sapien
aatatgtggtgaccgaccctgagca

SEQ ID NO: 426530 - DNA, 25 bp, Homo sapien
ttcaagacgcactgagcagggctcg

SEQ ID NO: 426531 - DNA, 25 bp, Homo sapien
aaggctgctagagggctatgagatc

SEQ ID NO: 426532 - DNA, 25 bp, Homo sapien
atgagatctatgtgacccctggagt

SEQ ID NO: 426533 - DNA, 25 bp, Homo sapien
tagctgctgtggaggcacataccta

SEQ ID NO: 426534 - DNA, 25 bp, Homo sapien
gtggaggcacatacctacccagcat

SEQ ID NO: 426535 - DNA, 25 bp, Homo sapien
tacccagcatgcctcggtcctataa

SEQ ID NO: 426536 - DNA, 25 bp, Homo sapien
tcggtcctataagcctcagagagtt

SEQ ID NO: 426537 - DNA, 25 bp, Homo sapien
gagttgtgatcacatgccctcagga

SEQ ID NO: 426538 - DNA, 25 bp, Homo sapien
gaatacaaaatcctgctggatgtga

SEQ ID NO: 426539 - DNA, 25 bp, Homo sapien
gagggagaggatgcccacctgactc

SEQ ID NO: 426540 - DNA, 25 bp, Homo sapien
gagaggatgcccacctgactcagta

SEQ ID NO: 426541 - DNA, 25 bp, Homo sapien
aggatgcccacctgactcagtacaa

SEQ ID NO: 426542 - DNA, 25 bp, Homo sapien
atgcccacctgactcagtacaagaa

SEQ ID NO: 426543 - DNA, 25 bp, Homo sapien
gcccacctgactcagtacaagaaag

SEQ ID NO: 426544 - DNA, 25 bp, Homo sapien
cagtacaagaaagaaccggtgacca

SEQ ID NO: 426545 - DNA, 25 bp, Homo sapien
gaaagaaccggtgaccacccgtcag

SEQ ID NO: 426546 - DNA, 25 bp, Homo sapien
agaaccggtgaccacccgtcaggtg

SEQ ID NO: 426547 - DNA, 25 bp, Homo sapien
aaccggtgaccacccgtcaggtgcg

SEQ ID NO: 426548 - DNA, 25 bp, Homo sapien
ctgaggactcagctaccccggccgg

SEQ ID NO: 426549 - DNA, 25 bp, Homo sapien
gaaggatccttgaagcacttgagta

SEQ ID NO: 426550 - DNA, 25 bp, Homo sapien
gcacttgagtagaaagagcacacat

SEQ ID NO: 426551 - DNA, 25 bp, Homo sapien
acacatattcaatgagtcctgctct

SEQ ID NO: 426552 - DNA, 25 bp, Homo sapien
caatgagtcctgctctgaaaacaga

SEQ ID NO: 426553 - DNA, 25 bp, Homo sapien
ctctaacatgggactccagacccag

SEQ ID NO: 426554 - DNA, 25 bp, Homo sapien
agccaggaagatagtgccaggtttg

SEQ ID NO: 426555 - DNA, 25 bp, Homo sapien
tgagttccagtcctagctttgccac

SEQ ID NO: 426556 - DNA, 25 bp, Homo sapien
tagctttgccactgacagatggacg

SEQ ID NO: 426557 - DNA, 25 bp, Homo sapien
cagatggacgacttaggcaggaaat

SEQ ID NO: 426558 - DNA, 25 bp, Homo sapien
ggcttctgttatttcgtacggctgc

SEQ ID NO: 426559 - DNA, 25 bp, Homo sapien
tcgtacggctgcttgccatgaatct

SEQ ID NO: 426560 - DNA, 25 bp, Homo sapien
ttttgtactaccatactctggccaa

SEQ ID NO: 426561 - DNA, 25 bp, Homo sapien
actaccatactctggccaataccag

SEQ ID NO: 426562 - DNA, 25 bp, Homo sapien
caataccagagcatatcagcagagt

SEQ ID NO: 426563 - DNA, 25 bp, Homo sapien
gtaggagagcaaggatttggtttcc

SEQ ID NO: 426564 - DNA, 25 bp, Homo sapien
atgcaatgttaatggcacagtacct

SEQ ID NO: 426565 - DNA, 25 bp, Homo sapien
atggcacagtacctaatgaatattg

SEQ ID NO: 426566 - DNA, 25 bp, Homo sapien
atgaatattgttggccattttcaaa

SEQ ID NO: 426567 - DNA, 25 bp, Homo sapien
ggatgaatactatctttctaatgaa

SEQ ID NO: 426568 - DNA, 25 bp, Homo sapien
cccctaggttgttcttagatgcctg

SEQ ID NO: 426569 - DNA, 25 bp, Homo sapien
aggttgttcttagatgcctggctta

SEQ ID NO: 426570 - DNA, 25 bp, Homo sapien
gatgcctggcttatgtgttgacaaa

SEQ ID NO: 426571 - DNA, 25 bp, Homo sapien
agctgtgaactgatgcttactgcat

SEQ ID NO: 426572 - DNA, 25 bp, Homo sapien
tgcttactgcatattctgttagata

SEQ ID NO: 426573 - DNA, 25 bp, Homo sapien
gatttttccatgagtcctgcacaca

SEQ ID NO: 426574 - DNA, 25 bp, Homo sapien
atgagtcctgcacacaagtacacgc

SEQ ID NO: 426575 - DNA, 25 bp, Homo sapien
acaagtacacgcacagccccttatt

SEQ ID NO: 426576 - DNA, 25 bp, Homo sapien
cagccccttattacagcactatata

SEQ ID NO: 426577 - DNA, 25 bp, Homo sapien
tccttagtagaatatcagagagcct

SEQ ID NO: 426578 - DNA, 25 bp, Homo sapien
gagagcctaaactatgaacattggt

SEQ ID NO: 426579 - DNA, 25 bp, Homo sapien
attggtgttactgtcctgatttcta

SEQ ID NO: 426580 - DNA, 25 bp, Homo sapien
tgatttctaccaccgtctgcatctt

SEQ ID NO: 426581 - DNA, 25 bp, Homo sapien
gtctgcatctttggcctgttttcat

SEQ ID NO: 426582 - DNA, 25 bp, Homo sapien
gtgcttatagaatgtgatcctgcca

SEQ ID NO: 426583 - DNA, 25 bp, Homo sapien
cagtttctgctgtacttggatgagt

SEQ ID NO: 426584 - DNA, 25 bp, Homo sapien
acttggatgagtccaatgccctggg

SEQ ID NO: 426585 - DNA, 25 bp, Homo sapien
ttcaagacattgatgacactcacgt

SEQ ID NO: 426586 - DNA, 25 bp, Homo sapien
gacactcacgtctttgtaatagcag

SEQ ID NO: 426587 - DNA, 25 bp, Homo sapien
gcagaattggttaatgtcctccagg

SEQ ID NO: 426588 - DNA, 25 bp, Homo sapien
tcctccaggagcgagtgggtgaatt

SEQ ID NO: 426589 - DNA, 25 bp, Homo sapien
atgctttttcccttacccagaaatg

SEQ ID NO: 426590 - DNA, 25 bp, Homo sapien
aggcgcttctgcatctgtgggccga

SEQ ID NO: 426591 - DNA, 25 bp, Homo sapien
gtgggccgagcattcttcaggtcat

SEQ ID NO: 426592 - DNA, 25 bp, Homo sapien
gagaaaacatggtcaacgtcttgaa

SEQ ID NO: 426593 - DNA, 25 bp, Homo sapien
taagtgggacgagcccaggccctag

SEQ ID NO: 426594 - DNA, 25 bp, Homo sapien
tctctaatgctctggagcctgccca

SEQ ID NO: 426595 - DNA, 25 bp, Homo sapien
tgagatctggaccagtctctgcctc

SEQ ID NO: 426596 - DNA, 25 bp, Homo sapien
gcataaacatatgctctgtgagaat

SEQ ID NO: 426597 - DNA, 25 bp, Homo sapien
tatgctctgtgagaatttggtgtca

SEQ ID NO: 426598 - DNA, 25 bp, Homo sapien
ggtgtcagagttctcaatactggat

SEQ ID NO: 426599 - DNA, 25 bp, Homo sapien
cagagttctcaatactggatgataa

SEQ ID NO: 426600 - DNA, 25 bp, Homo sapien
ttctgtgctcctgaatgtgtagcta

SEQ ID NO: 426601 - DNA, 25 bp, Homo sapien
gaatgtgtagctacagactctaatt

SEQ ID NO: 426602 - DNA, 25 bp, Homo sapien
gactctaatttcgaaacaaacctga

SEQ ID NO: 426603 - DNA, 25 bp, Homo sapien
caaacctgataagtgggacgagccc

SEQ ID NO: 426604 - DNA, 25 bp, Homo sapien
aatttgcatttttccaacattgaag

SEQ ID NO: 426605 - DNA, 25 bp, Homo sapien
gcatttttccaacattgaaggtatt

SEQ ID NO: 426606 - DNA, 25 bp, Homo sapien
aagtcactaagagattcattctttt

SEQ ID NO: 426607 - DNA, 25 bp, Homo sapien
cttctgtaagtatgtattgctatga

SEQ ID NO: 426608 - DNA, 25 bp, Homo sapien
ttagagacctccaggcagacctcct

SEQ ID NO: 426609 - DNA, 25 bp, Homo sapien
aggcagacctccttactgtcttcag

SEQ ID NO: 426610 - DNA, 25 bp, Homo sapien
atttcattactgttactgggtgcca

SEQ ID NO: 426611 - DNA, 25 bp, Homo sapien
attactgttactgggtgccaagtgt

SEQ ID NO: 426612 - DNA, 25 bp, Homo sapien
gggtgccaagtgtctttcatttgga

SEQ ID NO: 426613 - DNA, 25 bp, Homo sapien
ggaagtgaacttactccagttattg

SEQ ID NO: 426614 - DNA, 25 bp, Homo sapien
actccagttattgaatgtttatcat

SEQ ID NO: 426615 - DNA, 25 bp, Homo sapien
atgttttcgtgagcctcttgtacca

SEQ ID NO: 426616 - DNA, 25 bp, Homo sapien
tcttgtaccatctccagtccttagg

SEQ ID NO: 426617 - DNA, 25 bp, Homo sapien
tcctaccgccacaaagttgagggat

SEQ ID NO: 426618 - DNA, 25 bp, Homo sapien
agggatgggcactggccccgcaaca

SEQ ID NO: 426619 - DNA, 25 bp, Homo sapien
gctaaatcgcccgtagaaagtccgc

SEQ ID NO: 426620 - DNA, 25 bp, Homo sapien
gaaagtccgcagctcgctagaatga

SEQ ID NO: 426621 - DNA, 25 bp, Homo sapien
agctcgctagaatgacatcgcgtag

SEQ ID NO: 426622 - DNA, 25 bp, Homo sapien
gacatcgcgtagttacgtcgcatca

SEQ ID NO: 426623 - DNA, 25 bp, Homo sapien
gtcgcatcagggacgtatcaagtca

SEQ ID NO: 426624 - DNA, 25 bp, Homo sapien
gggacgtatcaagtcacctgagctc

SEQ ID NO: 426625 - DNA, 25 bp, Homo sapien
ccaatataattcaagcactgctcat

SEQ ID NO: 426626 - DNA, 25 bp, Homo sapien
ctgcagaaacagtacttaggtaatt

SEQ ID NO: 426627 - DNA, 25 bp, Homo sapien
acttaggtaattgtagggcgaggat

SEQ ID NO: 426628 - DNA, 25 bp, Homo sapien
caaaatcacttagcagcaactgaag

SEQ ID NO: 426629 - DNA, 25 bp, Homo sapien
gaagacaattatcaaccacgtggag

SEQ ID NO: 426630 - DNA, 25 bp, Homo sapien
caaccacgtggagaaaatcaaaccg

SEQ ID NO: 426631 - DNA, 25 bp, Homo sapien
aatcaaaccgagcagggctgtgtga

SEQ ID NO: 426632 - DNA, 25 bp, Homo sapien
cagggctgtgtgaaacatggttgta

SEQ ID NO: 426633 - DNA, 25 bp, Homo sapien
acatggttgtaatatgcgactgcga

SEQ ID NO: 426634 - DNA, 25 bp, Homo sapien
atgcgactgcgaacactgaactcta

SEQ ID NO: 426635 - DNA, 25 bp, Homo sapien
tgcgaacactgaactctacgccact

SEQ ID NO: 426636 - DNA, 25 bp, Homo sapien
gatgttttcaggtgtcatggactgt

SEQ ID NO: 426637 - DNA, 25 bp, Homo sapien
atactgacatgattcactaattttc

SEQ ID NO: 426638 - DNA, 25 bp, Homo sapien
ttctaaatataaatggttcagctct

SEQ ID NO: 426639 - DNA, 25 bp, Homo sapien
taaatggttcagctcttagttattt

SEQ ID NO: 426640 - DNA, 25 bp, Homo sapien
atggttcagctcttagttattttta

SEQ ID NO: 426641 - DNA, 25 bp, Homo sapien
actaatgacctgtgttatacttcct

SEQ ID NO: 426642 - DNA, 25 bp, Homo sapien
atgacctgtgttatacttcctattt

SEQ ID NO: 426643 - DNA, 25 bp, Homo sapien
ttttgaatcccgtgtccttcaagtg

SEQ ID NO: 426644 - DNA, 25 bp, Homo sapien
ttgaatcccgtgtccttcaagtgct

SEQ ID NO: 426645 - DNA, 25 bp, Homo sapien
tcaagtgctttctaactttgagagg

SEQ ID NO: 426646 - DNA, 25 bp, Homo sapien
aaatctatatgcctttaaatcagtg

SEQ ID NO: 426647 - DNA, 25 bp, Homo sapien
tctatatgcctttaaatcagtgaat

SEQ ID NO: 426648 - DNA, 25 bp, Homo sapien
gtgctccacttgcagttctttaaag

SEQ ID NO: 426649 - DNA, 25 bp, Homo sapien
aatgctgctttttattctcctaacc

SEQ ID NO: 426650 - DNA, 25 bp, Homo sapien
tcaagtgggtgcagacttctcgtta

SEQ ID NO: 426651 - DNA, 25 bp, Homo sapien
gcagacttctcgttagcagctggaa

SEQ ID NO: 426652 - DNA, 25 bp, Homo sapien
tggaagacattcctcccacactttt

SEQ ID NO: 426653 - DNA, 25 bp, Homo sapien
tcctggcccaagagagcatccagaa

SEQ ID NO: 426654 - DNA, 25 bp, Homo sapien
ctggtttttcaggtactgggagccg

SEQ ID NO: 426655 - DNA, 25 bp, Homo sapien
cttgcactgtgcttagggtagggat

SEQ ID NO: 426656 - DNA, 25 bp, Homo sapien
gatggtaaatatcctccctgcatgg

SEQ ID NO: 426657 - DNA, 25 bp, Homo sapien
tctcatcccaaagcaggtatcttct

SEQ ID NO: 426658 - DNA, 25 bp, Homo sapien
aaagcaggtatcttctggttgtcac

SEQ ID NO: 426659 - DNA, 25 bp, Homo sapien
gaatataacactatcagtattattt

SEQ ID NO: 426660 - DNA, 25 bp, Homo sapien
tttatcctttaaatggaactgtgct

SEQ ID NO: 426661 - DNA, 25 bp, Homo sapien
atcctttaaatggaactgtgcttta

SEQ ID NO: 426662 - DNA, 25 bp, Homo sapien
gaactgtgctttagttttacaggat

SEQ ID NO: 426663 - DNA, 25 bp, Homo sapien
atatcagaaggaagctatacttagt

SEQ ID NO: 426664 - DNA, 25 bp, Homo sapien
agaaggaagctatacttagtaacgt

SEQ ID NO: 426665 - DNA, 25 bp, Homo sapien
ggaagctatacttagtaacgtattt

SEQ ID NO: 426666 - DNA, 25 bp, Homo sapien
tacttagtaacgtatttgctacttt

SEQ ID NO: 426667 - DNA, 25 bp, Homo sapien
gtaacgtatttgctactttatagtg

SEQ ID NO: 426668 - DNA, 25 bp, Homo sapien
aacgtatttgctactttatagtgaa

SEQ ID NO: 426669 - DNA, 25 bp, Homo sapien
cgtatttgctactttatagtgaata

SEQ ID NO: 426670 - DNA, 25 bp, Homo sapien
ggagaccaggatggatagataagaa

SEQ ID NO: 426671 - DNA, 25 bp, Homo sapien
gagaccaggatggatagataagaag

SEQ ID NO: 426672 - DNA, 25 bp, Homo sapien
agaccaggatggatagataagaaga

SEQ ID NO: 426673 - DNA, 25 bp, Homo sapien
gaccaggatggatagataagaagaa

SEQ ID NO: 426674 - DNA, 25 bp, Homo sapien
accaggatggatagataagaagaag

SEQ ID NO: 426675 - DNA, 25 bp, Homo sapien
atagataagaagaagggcaggcttt

SEQ ID NO: 426676 - DNA, 25 bp, Homo sapien
tagataagaagaagggcaggctttg

SEQ ID NO: 426677 - DNA, 25 bp, Homo sapien
ataagaagaagggcaggctttggct

SEQ ID NO: 426678 - DNA, 25 bp, Homo sapien
agaagggcaggctttggctgggcgt

SEQ ID NO: 426679 - DNA, 25 bp, Homo sapien
gaagggcaggctttggctgggcgtg

SEQ ID NO: 426680 - DNA, 25 bp, Homo sapien
aagggcaggctttggctgggcgtgg

SEQ ID NO: 426681 - DNA, 25 bp, Homo sapien
gagaagactggcacaattccaacta

SEQ ID NO: 426682 - DNA, 25 bp, Homo sapien
ttccaactagagtcaacccatgctg

SEQ ID NO: 426683 - DNA, 25 bp, Homo sapien
ttcccactcagatctagatcctgct

SEQ ID NO: 426684 - DNA, 25 bp, Homo sapien
cagatctagatcctgctttcatttc

SEQ ID NO: 426685 - DNA, 25 bp, Homo sapien
catttctggctagtgaagtagactt

SEQ ID NO: 426686 - DNA, 25 bp, Homo sapien
tttgaggtttattagcaggtctgct

SEQ ID NO: 426687 - DNA, 25 bp, Homo sapien
ggtctgctcaggaaccaaactaatg

SEQ ID NO: 426688 - DNA, 25 bp, Homo sapien
agtagctttatattgggccacccca

SEQ ID NO: 426689 - DNA, 25 bp, Homo sapien
gaaaaagcagatgtagaccccctcc

SEQ ID NO: 426690 - DNA, 25 bp, Homo sapien
ctcggatccttattggtgtgccctt

SEQ ID NO: 426691 - DNA, 25 bp, Homo sapien
ggtgtgccctttagcactccgcaga

SEQ ID NO: 426692 - DNA, 25 bp, Homo sapien
atgaaccgtcgctccaatgagtgga

SEQ ID NO: 426693 - DNA, 25 bp, Homo sapien
acagtgatgggttgtgtcttcttct

SEQ ID NO: 426694 - DNA, 25 bp, Homo sapien
gatgggttgtgtcttcttcttcatt

SEQ ID NO: 426695 - DNA, 25 bp, Homo sapien
ttcttcttcattggattcgcagctc

SEQ ID NO: 426696 - DNA, 25 bp, Homo sapien
tcgcagctctggtgatttggtggca

SEQ ID NO: 426697 - DNA, 25 bp, Homo sapien
tggtggcagcgggtctacgtatttc

SEQ ID NO: 426698 - DNA, 25 bp, Homo sapien
tacgtatttcctccaaagccgatca

SEQ ID NO: 426699 - DNA, 25 bp, Homo sapien
aaagccgatcaccttgacggacgag

SEQ ID NO: 426700 - DNA, 25 bp, Homo sapien
acggacgagcggaaagcccagcagc

SEQ ID NO: 426701 - DNA, 25 bp, Homo sapien
cctcccgctgggactatgagaagaa

SEQ ID NO: 426702 - DNA, 25 bp, Homo sapien
gaagaagtgacttgcatccccagct

SEQ ID NO: 426703 - DNA, 25 bp, Homo sapien
agcggctgggtcaccccttacgctg

SEQ ID NO: 426704 - DNA, 25 bp, Homo sapien
accccttacgctggtgatcaggaaa

SEQ ID NO: 426705 - DNA, 25 bp, Homo sapien
acgctggtgatcaggaaagcccgct

SEQ ID NO: 426706 - DNA, 25 bp, Homo sapien
tggtgatcaggaaagcccgctgccc

SEQ ID NO: 426707 - DNA, 25 bp, Homo sapien
ggtggtcgccgggataattaatgac

SEQ ID NO: 426708 - DNA, 25 bp, Homo sapien
gggataattaatgaccaccgccaat

SEQ ID NO: 426709 - DNA, 25 bp, Homo sapien
aattaatgaccaccgccaattcatc

SEQ ID NO: 426710 - DNA, 25 bp, Homo sapien
cctagcccgtctggcacagagggtg

SEQ ID NO: 426711 - DNA, 25 bp, Homo sapien
gaatgggacagagggattctctttc

SEQ ID NO: 426712 - DNA, 25 bp, Homo sapien
ggacagagggattctctttccctaa

SEQ ID NO: 426713 - DNA, 25 bp, Homo sapien
cagagggattctctttccctaattt

SEQ ID NO: 426714 - DNA, 25 bp, Homo sapien
acatcttaaacctttcttctgggag

SEQ ID NO: 426715 - DNA, 25 bp, Homo sapien
aatttgctttgattctctcaggcgc

SEQ ID NO: 426716 - DNA, 25 bp, Homo sapien
ttgattctctcaggcgctgtgcaca

SEQ ID NO: 426717 - DNA, 25 bp, Homo sapien
ttctctttcttactctacccacatt

SEQ ID NO: 426718 - DNA, 25 bp, Homo sapien
cttctctatccaactgtgaaagtga

SEQ ID NO: 426719 - DNA, 25 bp, Homo sapien
taaggtccccaaacctgggagtgca

SEQ ID NO: 426720 - DNA, 25 bp, Homo sapien
cctgggagtgcataggtactaaatc

SEQ ID NO: 426721 - DNA, 25 bp, Homo sapien
ggtactaaatcaagcagtgcaactt

SEQ ID NO: 426722 - DNA, 25 bp, Homo sapien
caacttgtaattaagcagctgcagt

SEQ ID NO: 426723 - DNA, 25 bp, Homo sapien
catgtttcttaatgtgtcatctttt

SEQ ID NO: 426724 - DNA, 25 bp, Homo sapien
gtcatcttttcaatggctgtattaa

SEQ ID NO: 426725 - DNA, 25 bp, Homo sapien
gcagaagactgattatcattttagt

SEQ ID NO: 426726 - DNA, 25 bp, Homo sapien
gaaacatcaggcttcagctggctgg

SEQ ID NO: 426727 - DNA, 25 bp, Homo sapien
cagctggctgggtggttcatctgaa

SEQ ID NO: 426728 - DNA, 25 bp, Homo sapien
gttcatctgaagagcaaatagccat

SEQ ID NO: 426729 - DNA, 25 bp, Homo sapien
ccatgtataatgctcttgttcagga

SEQ ID NO: 426730 - DNA, 25 bp, Homo sapien
gaattaaagttgtcctgcttgagct

SEQ ID NO: 426731 - DNA, 25 bp, Homo sapien
gagaaaatgccagaatcgattaaat

SEQ ID NO: 426732 - DNA, 25 bp, Homo sapien
gggactttacacagggaccacagtc

SEQ ID NO: 426733 - DNA, 25 bp, Homo sapien
acagggaccacagtctgcaaagaca

SEQ ID NO: 426734 - DNA, 25 bp, Homo sapien
gtctgcaaagacaaggttctggaag

SEQ ID NO: 426735 - DNA, 25 bp, Homo sapien
agaatgtcaggtaccacatgccagt

SEQ ID NO: 426736 - DNA, 25 bp, Homo sapien
gagtcgcggagtagtcctcatggcc

SEQ ID NO: 426737 - DNA, 25 bp, Homo sapien
ggaagtcccttaagctcctaggatt

SEQ ID NO: 426738 - DNA, 25 bp, Homo sapien
gatgttgaaaatactccctgcgccc

SEQ ID NO: 426739 - DNA, 25 bp, Homo sapien
ctgcgcccggcattcaatattgtat

SEQ ID NO: 426740 - DNA, 25 bp, Homo sapien
caatattgtatggttcattaggatc

SEQ ID NO: 426741 - DNA, 25 bp, Homo sapien
atggttcattaggatctgttgtggc

SEQ ID NO: 426742 - DNA, 25 bp, Homo sapien
tcattaggatctgttgtggctggct

SEQ ID NO: 426743 - DNA, 25 bp, Homo sapien
attaggatctgttgtggctggcttt

SEQ ID NO: 426744 - DNA, 25 bp, Homo sapien
atctgttgtggctggctttggacat

SEQ ID NO: 426745 - DNA, 25 bp, Homo sapien
tctgttgtggctggctttggacatt

SEQ ID NO: 426746 - DNA, 25 bp, Homo sapien
ggacattttttgttcactagtagaa

SEQ ID NO: 426747 - DNA, 25 bp, Homo sapien
ggacacatttcacacctcaggctcg

SEQ ID NO: 426748 - DNA, 25 bp, Homo sapien
acatttcacacctcaggctcgtggt

SEQ ID NO: 426749 - DNA, 25 bp, Homo sapien
atttcacacctcaggctcgtggtgg

SEQ ID NO: 426750 - DNA, 25 bp, Homo sapien
tcacacctcaggctcgtggtggtgc

SEQ ID NO: 426751 - DNA, 25 bp, Homo sapien
cacctgtggagggcatttcccgtgg

SEQ ID NO: 426752 - DNA, 25 bp, Homo sapien
cccgagacccgcctagatggaggaa

SEQ ID NO: 426753 - DNA, 25 bp, Homo sapien
cctagatggaggaagcgctgctggg

SEQ ID NO: 426754 - DNA, 25 bp, Homo sapien
tcaccccttgagctgctttggagac

SEQ ID NO: 426755 - DNA, 25 bp, Homo sapien
tgctttggagactcggctgccagag

SEQ ID NO: 426756 - DNA, 25 bp, Homo sapien
ctgccagagggagggccatgggccg

SEQ ID NO: 426757 - DNA, 25 bp, Homo sapien
tgggccgaggcctggcattcacgtt

SEQ ID NO: 426758 - DNA, 25 bp, Homo sapien
gatccccgggatgcaaactggccag

SEQ ID NO: 426759 - DNA, 25 bp, Homo sapien
aactggccagggattagaattccac

SEQ ID NO: 426760 - DNA, 25 bp, Homo sapien
tagaattccacatttgagcaaacag

SEQ ID NO: 426761 - DNA, 25 bp, Homo sapien
acatcctctaggtgttcctggcaga

SEQ ID NO: 426762 - DNA, 25 bp, Homo sapien
tggcagaggcccttgctacttgtct

SEQ ID NO: 426763 - DNA, 25 bp, Homo sapien
ttgctacttgtctgtgcccaaaggc

SEQ ID NO: 426764 - DNA, 25 bp, Homo sapien
ccaaaggccctagagggtcctagat

SEQ ID NO: 426765 - DNA, 25 bp, Homo sapien
cagtcccaggcctggaaacagctgg

SEQ ID NO: 426766 - DNA, 25 bp, Homo sapien
tgggtgtggttatcttttcccagct

SEQ ID NO: 426767 - DNA, 25 bp, Homo sapien
ttcccagcttgtggctccgaggtga

SEQ ID NO: 426768 - DNA, 25 bp, Homo sapien
gtgacagaaccaatctcaggaggct

SEQ ID NO: 426769 - DNA, 25 bp, Homo sapien
ggatgaagtgtcctcttgctagcac

SEQ ID NO: 426770 - DNA, 25 bp, Homo sapien
gtgtcctcttgctagcaccaataaa

SEQ ID NO: 426771 - DNA, 25 bp, Homo sapien
aaacacattgccctctcataaagag

SEQ ID NO: 426772 - DNA, 25 bp, Homo sapien
acattgccctctcataaagagcaag

SEQ ID NO: 426773 - DNA, 25 bp, Homo sapien
gaccatgaacaaaaagagggcgata

SEQ ID NO: 426774 - DNA, 25 bp, Homo sapien
agaaacacagaagccatccttacaa

SEQ ID NO: 426775 - DNA, 25 bp, Homo sapien
gaagccatccttacaagcacagctt

SEQ ID NO: 426776 - DNA, 25 bp, Homo sapien
acaagcacagcttccgcgctcgagg

SEQ ID NO: 426777 - DNA, 25 bp, Homo sapien
gcgctcgaggttccgccagttactc

SEQ ID NO: 426778 - DNA, 25 bp, Homo sapien
gttactccccgccacgaaagcggag

SEQ ID NO: 426779 - DNA, 25 bp, Homo sapien
ccaaccggcggtgaggctggaacca

SEQ ID NO: 426780 - DNA, 25 bp, Homo sapien
agatgattgagaacagccttgcctg

SEQ ID NO: 426781 - DNA, 25 bp, Homo sapien
gtcactgtcctagaacaccctggag

SEQ ID NO: 426782 - DNA, 25 bp, Homo sapien
accctggagtttagtgttctgtgtc

SEQ ID NO: 426783 - DNA, 25 bp, Homo sapien
ttctgtgtcagagtcttgggagcct

SEQ ID NO: 426784 - DNA, 25 bp, Homo sapien
tccttcagacccagatgacgggcct

SEQ ID NO: 426785 - DNA, 25 bp, Homo sapien
ccctctgtccaaggagcagctgtaa

SEQ ID NO: 426786 - DNA, 25 bp, Homo sapien
gatttcatttgtttggtggctgtta

SEQ ID NO: 426787 - DNA, 25 bp, Homo sapien
gtggctgttaccttgtctgtaagtc

SEQ ID NO: 426788 - DNA, 25 bp, Homo sapien
gcagtgctttttaaacgattccctt

SEQ ID NO: 426789 - DNA, 25 bp, Homo sapien
taaacgattcccttttgcagctaaa

SEQ ID NO: 426790 - DNA, 25 bp, Homo sapien
atttcacagggctatttctaatacg

SEQ ID NO: 426791 - DNA, 25 bp, Homo sapien
ttcttcttagtttatggacttacca

SEQ ID NO: 426792 - DNA, 25 bp, Homo sapien
atggacttaccataaactcaggatg

SEQ ID NO: 426793 - DNA, 25 bp, Homo sapien
taccataaactcaggatggccgagt

SEQ ID NO: 426794 - DNA, 25 bp, Homo sapien
atggccgagtgggtccctgcagaag

SEQ ID NO: 426795 - DNA, 25 bp, Homo sapien
gatatggtgattgcgggagttacaa

SEQ ID NO: 426796 - DNA, 25 bp, Homo sapien
gattgcgggagttacaagacattac

SEQ ID NO: 426797 - DNA, 25 bp, Homo sapien
gcgggagttacaagacattacttat

SEQ ID NO: 426798 - DNA, 25 bp, Homo sapien
gagttacaagacattacttataggg

SEQ ID NO: 426799 - DNA, 25 bp, Homo sapien
gcagctcttctctgcgtggcgcctg

SEQ ID NO: 426800 - DNA, 25 bp, Homo sapien
tcttctctgcgtggcgcctgggatg

SEQ ID NO: 426801 - DNA, 25 bp, Homo sapien
gtggcgcctgggatgaatggtttct

SEQ ID NO: 426802 - DNA, 25 bp, Homo sapien
ctccaggatgtgttcgaaatgcgct

SEQ ID NO: 426803 - DNA, 25 bp, Homo sapien
gatgtgttcgaaatgcgctttgcca

SEQ ID NO: 426804 - DNA, 25 bp, Homo sapien
tgtgttcgaaatgcgctttgccaag

SEQ ID NO: 426805 - DNA, 25 bp, Homo sapien
ctttgccaagatgccggacgagcct

SEQ ID NO: 426806 - DNA, 25 bp, Homo sapien
ccaagatgccggacgagcctgagga

SEQ ID NO: 426807 - DNA, 25 bp, Homo sapien
gatgccggacgagcctgaggagcca

SEQ ID NO: 426808 - DNA, 25 bp, Homo sapien
agcagcagcgatagctcctcggaca

SEQ ID NO: 426809 - DNA, 25 bp, Homo sapien
cagcagcgatagctcctcggacagt

SEQ ID NO: 426810 - DNA, 25 bp, Homo sapien
ctcctcggacagtgacagttcgact

SEQ ID NO: 426811 - DNA, 25 bp, Homo sapien
gacagttcgactgatgactctgagg

SEQ ID NO: 426812 - DNA, 25 bp, Homo sapien
cagttcgactgatgactctgaggag

SEQ ID NO: 426813 - DNA, 25 bp, Homo sapien
tcatgattctcataacattcagcat

SEQ ID NO: 426814 - DNA, 25 bp, Homo sapien
cattcagcataagtgtagcaaagtt

SEQ ID NO: 426815 - DNA, 25 bp, Homo sapien
agcaaagttgctaataacggaaggg

SEQ ID NO: 426816 - DNA, 25 bp, Homo sapien
gatcatagtggtgttgaatgtaact

SEQ ID NO: 426817 - DNA, 25 bp, Homo sapien
ggaatggccttttaagtctgagaga

SEQ ID NO: 426818 - DNA, 25 bp, Homo sapien
tggccttttaagtctgagagagaac

SEQ ID NO: 426819 - DNA, 25 bp, Homo sapien
gagagagaacatttgaatccttttc

SEQ ID NO: 426820 - DNA, 25 bp, Homo sapien
ttccacacaggcactattataattt

SEQ ID NO: 426821 - DNA, 25 bp, Homo sapien
tattataattttcagtgccatgtta

SEQ ID NO: 426822 - DNA, 25 bp, Homo sapien
attttcagtgccatgttaaattgga

SEQ ID NO: 426823 - DNA, 25 bp, Homo sapien
gtgccatgttaaattggattatttc

SEQ ID NO: 426824 - DNA, 25 bp, Homo sapien
gacagcccatctttctcaccaagga

SEQ ID NO: 426825 - DNA, 25 bp, Homo sapien
gaggcataactaataacactaactt

SEQ ID NO: 426826 - DNA, 25 bp, Homo sapien
gtggaataaatccagcctaggctgt

SEQ ID NO: 426827 - DNA, 25 bp, Homo sapien
atagagaatcaagctgtcagagtca

SEQ ID NO: 426828 - DNA, 25 bp, Homo sapien
gatcattatgcgactgagttcacta

SEQ ID NO: 426829 - DNA, 25 bp, Homo sapien
tgagttcactagcagttcagcccat

SEQ ID NO: 426830 - DNA, 25 bp, Homo sapien
agcagttcagcccatccatagctta

SEQ ID NO: 426831 - DNA, 25 bp, Homo sapien
tccatagcttacctcattcttacta

SEQ ID NO: 426832 - DNA, 25 bp, Homo sapien
ttcttactatccaaaagccactcct

SEQ ID NO: 426833 - DNA, 25 bp, Homo sapien
ctgtaccaagacctcactcgaatgt

SEQ ID NO: 426834 - DNA, 25 bp, Homo sapien
cactcgaatgtcactatcccaagat

SEQ ID NO: 426835 - DNA, 25 bp, Homo sapien
gatttgaccgagatcggctcttcaa

SEQ ID NO: 426836 - DNA, 25 bp, Homo sapien
gaggatctggctggacttccagagt

SEQ ID NO: 426837 - DNA, 25 bp, Homo sapien
gctggacttccagagtacctgagca

SEQ ID NO: 426838 - DNA, 25 bp, Homo sapien
agcaagtacctcaccgactcggaat

SEQ ID NO: 426839 - DNA, 25 bp, Homo sapien
gactcggaatacacagagggctcca

SEQ ID NO: 426840 - DNA, 25 bp, Homo sapien
agggctccacaggtaagacgtgcct

SEQ ID NO: 426841 - DNA, 25 bp, Homo sapien
aagacgtgcctgatgaaggctgtgc

SEQ ID NO: 426842 - DNA, 25 bp, Homo sapien
caatgcctgcattctgccactgctg

SEQ ID NO: 426843 - DNA, 25 bp, Homo sapien
tcagcccctggtaaatgcccagtgc

SEQ ID NO: 426844 - DNA, 25 bp, Homo sapien
atgcccagtgcacagatgactatta

SEQ ID NO: 426845 - DNA, 25 bp, Homo sapien
atgactattaccgaggccacagcgc

SEQ ID NO: 426846 - DNA, 25 bp, Homo sapien
ccaaagactgactgttgtggtttta

SEQ ID NO: 426847 - DNA, 25 bp, Homo sapien
ttgtggttttaactcctctctgtaa

SEQ ID NO: 426848 - DNA, 25 bp, Homo sapien
ctcctttctgaaagaagacccagtg

SEQ ID NO: 426849 - DNA, 25 bp, Homo sapien
gtgcagagcggcctttactttcaat

SEQ ID NO: 426850 - DNA, 25 bp, Homo sapien
gcggcctttactttcaatttctact

SEQ ID NO: 426851 - DNA, 25 bp, Homo sapien
atttctactgctgaatagactactt

SEQ ID NO: 426852 - DNA, 25 bp, Homo sapien
tgatgggcattttcagtactgtatc

SEQ ID NO: 426853 - DNA, 25 bp, Homo sapien
aatagcacagctaggagcctctgac

SEQ ID NO: 426854 - DNA, 25 bp, Homo sapien
gagcctctgacattgtctggtgttt

SEQ ID NO: 426855 - DNA, 25 bp, Homo sapien
tctggtgttttacgtggtctgttca

SEQ ID NO: 426856 - DNA, 25 bp, Homo sapien
tggtctgttcatcaaaattcccctt

SEQ ID NO: 426857 - DNA, 25 bp, Homo sapien
gtggtctaaaccttcccttgtactg

SEQ ID NO: 426858 - DNA, 25 bp, Homo sapien
tggtctaaaccttcccttgtactgt

SEQ ID NO: 426859 - DNA, 25 bp, Homo sapien
tctaaaccttcccttgtactgtagt

SEQ ID NO: 426860 - DNA, 25 bp, Homo sapien
ttcccttgtactgtagtttgttttg

SEQ ID NO: 426861 - DNA, 25 bp, Homo sapien
ccttgtactgtagtttgttttgaat

SEQ ID NO: 426862 - DNA, 25 bp, Homo sapien
gtttgttttgaatggcatgtatttg

SEQ ID NO: 426863 - DNA, 25 bp, Homo sapien
gaatggcatgtatttgtatgtaata

SEQ ID NO: 426864 - DNA, 25 bp, Homo sapien
ggcatgtatttgtatgtaatagtct

SEQ ID NO: 426865 - DNA, 25 bp, Homo sapien
gtatgtaatagtctaattctaggta

SEQ ID NO: 426866 - DNA, 25 bp, Homo sapien
gtctaattctaggtattttgtttgc

SEQ ID NO: 426867 - DNA, 25 bp, Homo sapien
taattctaggtattttgtttgcttc

SEQ ID NO: 426868 - DNA, 25 bp, Homo sapien
cagggagtccttgcgtcccatgagg

SEQ ID NO: 426869 - DNA, 25 bp, Homo sapien
gtcccatgaggtcttcccgcaaggc

SEQ ID NO: 426870 - DNA, 25 bp, Homo sapien
gcctgctgaggccttctcttgaggc

SEQ ID NO: 426871 - DNA, 25 bp, Homo sapien
ggtcccttgcttagcctgtgctgga

SEQ ID NO: 426872 - DNA, 25 bp, Homo sapien
tgcttagcctgtgctggaccagctg

SEQ ID NO: 426873 - DNA, 25 bp, Homo sapien
agaccttggctgctcactgtccaca

SEQ ID NO: 426874 - DNA, 25 bp, Homo sapien
cactgtccacatgtgaactttttct

SEQ ID NO: 426875 - DNA, 25 bp, Homo sapien
gaactttttctaggtggcaggacaa

SEQ ID NO: 426876 - DNA, 25 bp, Homo sapien
tggcaggacaaatcgcgcccattta

SEQ ID NO: 426877 - DNA, 25 bp, Homo sapien
aaatcgcgcccatttagaggatgtg

SEQ ID NO: 426878 - DNA, 25 bp, Homo sapien
gtaacctgctggatgggactccata

SEQ ID NO: 426879 - DNA, 25 bp, Homo sapien
ggcaggaagccccaattctgccctg

SEQ ID NO: 426880 - DNA, 25 bp, Homo sapien
ttctgccctgcagtggttgcctgga

SEQ ID NO: 426881 - DNA, 25 bp, Homo sapien
tggacaccctcgtaacccagctgag

SEQ ID NO: 426882 - DNA, 25 bp, Homo sapien
tgggccactctgctgctctgtcttg

SEQ ID NO: 426883 - DNA, 25 bp, Homo sapien
tcttgcacccttgacttcctttgag

SEQ ID NO: 426884 - DNA, 25 bp, Homo sapien
ccttgacttcctttgagggttgact

SEQ ID NO: 426885 - DNA, 25 bp, Homo sapien
ttcctttgagggttgactctggacc

SEQ ID NO: 426886 - DNA, 25 bp, Homo sapien
ggttgactctggacccttaagcctc

SEQ ID NO: 426887 - DNA, 25 bp, Homo sapien
aggccggccgcctggcaaggactgg

SEQ ID NO: 426888 - DNA, 25 bp, Homo sapien
tccttgtttccgaaggagagcctgc

SEQ ID NO: 426889 - DNA, 25 bp, Homo sapien
gttgaacattccagctccttgctct

SEQ ID NO: 426890 - DNA, 25 bp, Homo sapien
ggagattatccgaaaacagctattt

SEQ ID NO: 426891 - DNA, 25 bp, Homo sapien
tctcccaggattcaaccaacttaat

SEQ ID NO: 426892 - DNA, 25 bp, Homo sapien
caggattcaaccaacttaatgatga

SEQ ID NO: 426893 - DNA, 25 bp, Homo sapien
actttttatctgcttgtaaagggat

SEQ ID NO: 426894 - DNA, 25 bp, Homo sapien
ttatgtgtatttctgcataatcaga

SEQ ID NO: 426895 - DNA, 25 bp, Homo sapien
gttttctactgatgaaattctctgt

SEQ ID NO: 426896 - DNA, 25 bp, Homo sapien
ttttcttacattatccaacaggcat

SEQ ID NO: 426897 - DNA, 25 bp, Homo sapien
ttacattatccaacaggcataaaga

SEQ ID NO: 426898 - DNA, 25 bp, Homo sapien
gacttttgtgtttgtaatactacct

SEQ ID NO: 426899 - DNA, 25 bp, Homo sapien
tgtaatactacctcttttatccctg

SEQ ID NO: 426900 - DNA, 25 bp, Homo sapien
taatactacctcttttatccctgca

SEQ ID NO: 426901 - DNA, 25 bp, Homo sapien
tatcagagaacgtagtggtccacct

SEQ ID NO: 426902 - DNA, 25 bp, Homo sapien
acctccatcaatgactctataaatg

SEQ ID NO: 426903 - DNA, 25 bp, Homo sapien
aagcttcttaatactatggtcctgt

SEQ ID NO: 426904 - DNA, 25 bp, Homo sapien
actatggtcctgtaaattcacattc

SEQ ID NO: 426905 - DNA, 25 bp, Homo sapien
tcacattcagtatctacttctaagc

SEQ ID NO: 426906 - DNA, 25 bp, Homo sapien
taagcctctggcatccccagtgaaa

SEQ ID NO: 426907 - DNA, 25 bp, Homo sapien
aagctttatccaaaggctgcctggg

SEQ ID NO: 426908 - DNA, 25 bp, Homo sapien
gggcctcacataatacaaagctggg

SEQ ID NO: 426909 - DNA, 25 bp, Homo sapien
tacaaagctgggtcgggtctacaaa

SEQ ID NO: 426910 - DNA, 25 bp, Homo sapien
agactagtgagatttgggccaggaa

SEQ ID NO: 426911 - DNA, 25 bp, Homo sapien
gggccaggaagtaattctaagcatt

SEQ ID NO: 426912 - DNA, 25 bp, Homo sapien
cccaggtcactaagagaatgagctt

SEQ ID NO: 426913 - DNA, 25 bp, Homo sapien
agaatgagcttccactgtattccca

SEQ ID NO: 426914 - DNA, 25 bp, Homo sapien
aatgagcttccactgtattcccatc

SEQ ID NO: 426915 - DNA, 25 bp, Homo sapien
tgaggctgacctgtggacaagacaa

SEQ ID NO: 426916 - DNA, 25 bp, Homo sapien
gacctgtggacaagacaatgggaca

SEQ ID NO: 426917 - DNA, 25 bp, Homo sapien
atgggacagggataggcagttcctc

SEQ ID NO: 426918 - DNA, 25 bp, Homo sapien
gacagggataggcagttcctccatc

SEQ ID NO: 426919 - DNA, 25 bp, Homo sapien
cagggataggcagttcctccatcca

SEQ ID NO: 426920 - DNA, 25 bp, Homo sapien
gatattcaagggtagtttcaggagc

SEQ ID NO: 426921 - DNA, 25 bp, Homo sapien
tattcaagggtagtttcaggagcac

SEQ ID NO: 426922 - DNA, 25 bp, Homo sapien
ttcaagggtagtttcaggagcacag

SEQ ID NO: 426923 - DNA, 25 bp, Homo sapien
gggctcaagatccccatgactccta

SEQ ID NO: 426924 - DNA, 25 bp, Homo sapien
gactcctacatcctcttttgtgtct

SEQ ID NO: 426925 - DNA, 25 bp, Homo sapien
cctgatcttagtagcagacaatgca

SEQ ID NO: 426926 - DNA, 25 bp, Homo sapien
gatcttagtagcagacaatgcaggg

SEQ ID NO: 426927 - DNA, 25 bp, Homo sapien
tcaaaagatgccaaccaggttcact

SEQ ID NO: 426928 - DNA, 25 bp, Homo sapien
aaccaggttcactccactaccagga

SEQ ID NO: 426929 - DNA, 25 bp, Homo sapien
aggttcactccactaccaggaggaa

SEQ ID NO: 426930 - DNA, 25 bp, Homo sapien
gttcactccactaccaggaggaata

SEQ ID NO: 426931 - DNA, 25 bp, Homo sapien
aggaggaatagcaacagtccgccct

SEQ ID NO: 426932 - DNA, 25 bp, Homo sapien
aggaatagcaacagtccgccctctc

SEQ ID NO: 426933 - DNA, 25 bp, Homo sapien
tctccgtcctctatgaaccaaagaa

SEQ ID NO: 426934 - DNA, 25 bp, Homo sapien
agagagagaacctagttctgactgc

SEQ ID NO: 426935 - DNA, 25 bp, Homo sapien
gagagagaacctagttctgactgca

SEQ ID NO: 426936 - DNA, 25 bp, Homo sapien
agagagaacctagttctgactgcag

SEQ ID NO: 426937 - DNA, 25 bp, Homo sapien
gagagaacctagttctgactgcaga

SEQ ID NO: 426938 - DNA, 25 bp, Homo sapien
agagaacctagttctgactgcagaa

SEQ ID NO: 426939 - DNA, 25 bp, Homo sapien
gagaacctagttctgactgcagaat

SEQ ID NO: 426940 - DNA, 25 bp, Homo sapien
agaacctagttctgactgcagaatc

SEQ ID NO: 426941 - DNA, 25 bp, Homo sapien
gaacctagttctgactgcagaatcc

SEQ ID NO: 426942 - DNA, 25 bp, Homo sapien
aacctagttctgactgcagaatccc

SEQ ID NO: 426943 - DNA, 25 bp, Homo sapien
acctagttctgactgcagaatccct

SEQ ID NO: 426944 - DNA, 25 bp, Homo sapien
cctagttctgactgcagaatccctg

SEQ ID NO: 426945 - DNA, 25 bp, Homo sapien
atggcagcctgattaccagtgtcgg

SEQ ID NO: 426946 - DNA, 25 bp, Homo sapien
tgattaccagtgtcgggcctgcatg

SEQ ID NO: 426947 - DNA, 25 bp, Homo sapien
cacacgtgtgcacatgggccatagc

SEQ ID NO: 426948 - DNA, 25 bp, Homo sapien
atgggccatagccacaagccagctc

SEQ ID NO: 426949 - DNA, 25 bp, Homo sapien
tcctttcaacctcgctgtccaggga

SEQ ID NO: 426950 - DNA, 25 bp, Homo sapien
gggcttccatctggcagagaacgtt

SEQ ID NO: 426951 - DNA, 25 bp, Homo sapien
cagagaacgttcagggcttgttgaa

SEQ ID NO: 426952 - DNA, 25 bp, Homo sapien
attagacttaagctgtcacctgtgc

SEQ ID NO: 426953 - DNA, 25 bp, Homo sapien
taagctgtcacctgtgcttggtgcc

SEQ ID NO: 426954 - DNA, 25 bp, Homo sapien
ttggtgccccaggaacagccagaga

SEQ ID NO: 426955 - DNA, 25 bp, Homo sapien
agagaggacagtgcccactcacttc

SEQ ID NO: 426956 - DNA, 25 bp, Homo sapien
gttatgttgtgggaaaagtccaaag

SEQ ID NO: 426957 - DNA, 25 bp, Homo sapien
gaaagctagcaaacataaagtgagg

SEQ ID NO: 426958 - DNA, 25 bp, Homo sapien
aagtgagggatctcctttgatcctc

SEQ ID NO: 426959 - DNA, 25 bp, Homo sapien
gagggatctcctttgatcctcacag

SEQ ID NO: 426960 - DNA, 25 bp, Homo sapien
ggatctcctttgatcctcacagcca

SEQ ID NO: 426961 - DNA, 25 bp, Homo sapien
cctcacagccaccttttgaagtcaa

SEQ ID NO: 426962 - DNA, 25 bp, Homo sapien
ctgaaattatactctgaaagcaata

SEQ ID NO: 426963 - DNA, 25 bp, Homo sapien
aagcaatatttcatttagccctcat

SEQ ID NO: 426964 - DNA, 25 bp, Homo sapien
agcaatatttcatttagccctcata

SEQ ID NO: 426965 - DNA, 25 bp, Homo sapien
ctgtaaaataggtagggcaggcctg

SEQ ID NO: 426966 - DNA, 25 bp, Homo sapien
ataggtagggcaggcctggcacagt

SEQ ID NO: 426967 - DNA, 25 bp, Homo sapien
agagatccaaagactcttgggaggg

SEQ ID NO: 426968 - DNA, 25 bp, Homo sapien
agactcttgggagggagttactgaa

SEQ ID NO: 426969 - DNA, 25 bp, Homo sapien
ggatgctaaaaatgtcacgaatatg

SEQ ID NO: 426970 - DNA, 25 bp, Homo sapien
gaatatggacatatcatctgtggac

SEQ ID NO: 426971 - DNA, 25 bp, Homo sapien
tatcatctgtggactgaccttgtaa

SEQ ID NO: 426972 - DNA, 25 bp, Homo sapien
gaccttgtaaaagacagtgtatgta

SEQ ID NO: 426973 - DNA, 25 bp, Homo sapien
gaagtcttaaggacaaagtgccaaa

SEQ ID NO: 426974 - DNA, 25 bp, Homo sapien
gcttttcccatcagcgtgcattcac

SEQ ID NO: 426975 - DNA, 25 bp, Homo sapien
ccatcgccacaaactctatcggaga

SEQ ID NO: 426976 - DNA, 25 bp, Homo sapien
gccacaaactctatcggagaacatg

SEQ ID NO: 426977 - DNA, 25 bp, Homo sapien
agaacatgaatcaaaagtgcctcaa

SEQ ID NO: 426978 - DNA, 25 bp, Homo sapien
tgaggtgcttcaaatactaacttac

SEQ ID NO: 426979 - DNA, 25 bp, Homo sapien
gttaaattacacagcacacatccat

SEQ ID NO: 426980 - DNA, 25 bp, Homo sapien
acagcacacatccattacacagttt

SEQ ID NO: 426981 - DNA, 25 bp, Homo sapien
aaattctcccatcttttgcattact

SEQ ID NO: 426982 - DNA, 25 bp, Homo sapien
tctcccatcttttgcattacttttt

SEQ ID NO: 426983 - DNA, 25 bp, Homo sapien
gattgaaatggactattggcctcta

SEQ ID NO: 426984 - DNA, 25 bp, Homo sapien
aaattactaatatcccttatgctga

SEQ ID NO: 426985 - DNA, 25 bp, Homo sapien
tatgctgatgaacactctggcgtat

SEQ ID NO: 426986 - DNA, 25 bp, Homo sapien
gaacactctggcgtatatttagata

SEQ ID NO: 426987 - DNA, 25 bp, Homo sapien
agtgtttaaagcatcttcctagcca

SEQ ID NO: 426988 - DNA, 25 bp, Homo sapien
atcttcctagccacctgattgaggt

SEQ ID NO: 426989 - DNA, 25 bp, Homo sapien
gacaaggttctcagggaagttttgg

SEQ ID NO: 426990 - DNA, 25 bp, Homo sapien
gaagttttggagtttgcaaccacag

SEQ ID NO: 426991 - DNA, 25 bp, Homo sapien
gttttggagtttgcaaccacagtat

SEQ ID NO: 426992 - DNA, 25 bp, Homo sapien
gagtttgcaaccacagtattccttt

SEQ ID NO: 426993 - DNA, 25 bp, Homo sapien
gtttgcaaccacagtattcctttgt

SEQ ID NO: 426994 - DNA, 25 bp, Homo sapien
ttgcaaccacagtattcctttgtct

SEQ ID NO: 426995 - DNA, 25 bp, Homo sapien
gcaaccacagtattcctttgtctgt

SEQ ID NO: 426996 - DNA, 25 bp, Homo sapien
ttcctttgtctgtcgaggctgggag

SEQ ID NO: 426997 - DNA, 25 bp, Homo sapien
tttgtctgtcgaggctgggagggta

SEQ ID NO: 426998 - DNA, 25 bp, Homo sapien
gagggtagccgtgagcgtggtgggt

SEQ ID NO: 426999 - DNA, 25 bp, Homo sapien
gggtgggtggtgtgagtggcatctt

SEQ ID NO: 427000 - DNA, 25 bp, Homo sapien
actggaatgtgttgggagtttacaa

SEQ ID NO: 427001 - DNA, 25 bp, Homo sapien
ttgggagtttacaagagtgaacatt

SEQ ID NO: 427002 - DNA, 25 bp, Homo sapien
agtgtctattgcctgtaaacctaca

SEQ ID NO: 427003 - DNA, 25 bp, Homo sapien
gtaaacctacaagcctgagctgtgt

SEQ ID NO: 427004 - DNA, 25 bp, Homo sapien
aatactcttggcttctttatgactc

SEQ ID NO: 427005 - DNA, 25 bp, Homo sapien
ggcttctttatgactcctcttgaat

SEQ ID NO: 427006 - DNA, 25 bp, Homo sapien
ctttatgactcctcttgaattcatg

SEQ ID NO: 427007 - DNA, 25 bp, Homo sapien
gaattcatgaatgcatctttgttct

SEQ ID NO: 427008 - DNA, 25 bp, Homo sapien
gcatctttgttctttcctaattttg

SEQ ID NO: 427009 - DNA, 25 bp, Homo sapien
ctaattttggtctttcatcctagaa

SEQ ID NO: 427010 - DNA, 25 bp, Homo sapien
ttggtctttcatcctagaattcatt

SEQ ID NO: 427011 - DNA, 25 bp, Homo sapien
tttgactaccgtgtgccagtgctgg

SEQ ID NO: 427012 - DNA, 25 bp, Homo sapien
cagtgctggtgattctcacacacct

SEQ ID NO: 427013 - DNA, 25 bp, Homo sapien
cctccatccgctctttgtggaaaaa

SEQ ID NO: 427014 - DNA, 25 bp, Homo sapien
ggaactagcaggacatcacttacaa

SEQ ID NO: 427015 - DNA, 25 bp, Homo sapien
tacaaattcacccacgagacacttg

SEQ ID NO: 427016 - DNA, 25 bp, Homo sapien
aagcgactcttgcattgctttttgt

SEQ ID NO: 427017 - DNA, 25 bp, Homo sapien
ctccggcaccagttgtcaatactaa

SEQ ID NO: 427018 - DNA, 25 bp, Homo sapien
gttgtcaatactaacccgctggttt

SEQ ID NO: 427019 - DNA, 25 bp, Homo sapien
tggtttgcctccatcacatttgtga

SEQ ID NO: 427020 - DNA, 25 bp, Homo sapien
cacatttgtgatctgtagctctgga

SEQ ID NO: 427021 - DNA, 25 bp, Homo sapien
tagctctggatacatctcctgacag

SEQ ID NO: 427022 - DNA, 25 bp, Homo sapien
ttgctcagagcaaactcggtttcta

SEQ ID NO: 427023 - DNA, 25 bp, Homo sapien
taatactcagagacaaggccccaaa

SEQ ID NO: 427024 - DNA, 25 bp, Homo sapien
gacaaggccccaaacggtctatgct

SEQ ID NO: 427025 - DNA, 25 bp, Homo sapien
tggagacccctgcacatttcacaga

SEQ ID NO: 427026 - DNA, 25 bp, Homo sapien
cacatttcacagagcgtgcccaggc

SEQ ID NO: 427027 - DNA, 25 bp, Homo sapien
ggtggcctgcactggacagtcaatg

SEQ ID NO: 427028 - DNA, 25 bp, Homo sapien
aatgctgcatttcacaaggccagtt

SEQ ID NO: 427029 - DNA, 25 bp, Homo sapien
aggccagttccttgctagaaattta

SEQ ID NO: 427030 - DNA, 25 bp, Homo sapien
gactgggaaatttactctcgatatt

SEQ ID NO: 427031 - DNA, 25 bp, Homo sapien
tcttgagacaatctcctactaatgg

SEQ ID NO: 427032 - DNA, 25 bp, Homo sapien
agcgaggaggtccaaattgctcaga

SEQ ID NO: 427033 - DNA, 25 bp, Homo sapien
taggtctccgaggtgtaggcccgcc

SEQ ID NO: 427034 - DNA, 25 bp, Homo sapien
acacatgctgcagcagtaggccttg

SEQ ID NO: 427035 - DNA, 25 bp, Homo sapien
agcagtaggccttggcgtgcttgat

SEQ ID NO: 427036 - DNA, 25 bp, Homo sapien
gatctgcaaagaagcggagtccgaa

SEQ ID NO: 427037 - DNA, 25 bp, Homo sapien
cggagtccgaataggcccggtagca

SEQ ID NO: 427038 - DNA, 25 bp, Homo sapien
gcccggtagcagttgggacacttgt

SEQ ID NO: 427039 - DNA, 25 bp, Homo sapien
cacttgtagggcttgtccttgttgt

SEQ ID NO: 427040 - DNA, 25 bp, Homo sapien
tgagtgaaagccttctcgcagccag

SEQ ID NO: 427041 - DNA, 25 bp, Homo sapien
tcgcagccaggatgtgggcacttgt

SEQ ID NO: 427042 - DNA, 25 bp, Homo sapien
tgggcacttgtagggtctgtcgcct

SEQ ID NO: 427043 - DNA, 25 bp, Homo sapien
gtctgtcgcctgtgtggattctggt

SEQ ID NO: 427044 - DNA, 25 bp, Homo sapien
ggaaagtgttgatctgggttttctg

SEQ ID NO: 427045 - DNA, 25 bp, Homo sapien
acatcgggacatgggtttgatcttt

SEQ ID NO: 427046 - DNA, 25 bp, Homo sapien
gatcttttgttgtacctgatgacag

SEQ ID NO: 427047 - DNA, 25 bp, Homo sapien
gatgacagtgcagagattctccaca

SEQ ID NO: 427048 - DNA, 25 bp, Homo sapien
gattctccacagctggataaaaatg

SEQ ID NO: 427049 - DNA, 25 bp, Homo sapien
aaaatgtcacaaagctacttactgt

SEQ ID NO: 427050 - DNA, 25 bp, Homo sapien
aagctacttactgtacatgggcagt

SEQ ID NO: 427051 - DNA, 25 bp, Homo sapien
gtacatgggcagtatcagatttcaa

SEQ ID NO: 427052 - DNA, 25 bp, Homo sapien
gatttcaaatcctaatatttcagct

SEQ ID NO: 427053 - DNA, 25 bp, Homo sapien
agatgtactgtctttcatgtggcct

SEQ ID NO: 427054 - DNA, 25 bp, Homo sapien
tgtctttcatgtggcctcacattta

SEQ ID NO: 427055 - DNA, 25 bp, Homo sapien
ggcctcatgcactcagcatctcttt

SEQ ID NO: 427056 - DNA, 25 bp, Homo sapien
gcatctctttattagcaaacactta

SEQ ID NO: 427057 - DNA, 25 bp, Homo sapien
ttattgaacccctagtacatgccag

SEQ ID NO: 427058 - DNA, 25 bp, Homo sapien
ttgaacccctagtacatgccaggca

SEQ ID NO: 427059 - DNA, 25 bp, Homo sapien
gccaggcactgttatgaggtcccgg

SEQ ID NO: 427060 - DNA, 25 bp, Homo sapien
agggacagaagcattcctgctcttg

SEQ ID NO: 427061 - DNA, 25 bp, Homo sapien
gtgaagtttacattgactagatagt

SEQ ID NO: 427062 - DNA, 25 bp, Homo sapien
tgggtttcaattctgtctccacctc

SEQ ID NO: 427063 - DNA, 25 bp, Homo sapien
tctccacctcttattagctagctat

SEQ ID NO: 427064 - DNA, 25 bp, Homo sapien
tagctagctatggactcctctctga

SEQ ID NO: 427065 - DNA, 25 bp, Homo sapien
gtaatggtgtgagcagcgtttccct

SEQ ID NO: 427066 - DNA, 25 bp, Homo sapien
gtaagtagttggatggctttcataa

SEQ ID NO: 427067 - DNA, 25 bp, Homo sapien
aattcaagaagaggattcatgcttt

SEQ ID NO: 427068 - DNA, 25 bp, Homo sapien
gaggattcatgctttaagaaacatt

SEQ ID NO: 427069 - DNA, 25 bp, Homo sapien
gttatacattcctcacaaattatac

SEQ ID NO: 427070 - DNA, 25 bp, Homo sapien
tgtagcaggcagtgtgttttccttc

SEQ ID NO: 427071 - DNA, 25 bp, Homo sapien
atgtctctctgcactacctgcagtg

SEQ ID NO: 427072 - DNA, 25 bp, Homo sapien
actacctgcagtgtgtcctctgagg

SEQ ID NO: 427073 - DNA, 25 bp, Homo sapien
ctgcagtgtgtcctctgaggctgca

SEQ ID NO: 427074 - DNA, 25 bp, Homo sapien
gctgcaagtctgtcctatctgaatt

SEQ ID NO: 427075 - DNA, 25 bp, Homo sapien
tcctatctgaattcccagcagaagc

SEQ ID NO: 427076 - DNA, 25 bp, Homo sapien
gaattcccagcagaagcactaagaa

SEQ ID NO: 427077 - DNA, 25 bp, Homo sapien
ggaggtgctaggacaaaactcgaaa

SEQ ID NO: 427078 - DNA, 25 bp, Homo sapien
aaactcgaaaggtggccctatcagg

SEQ ID NO: 427079 - DNA, 25 bp, Homo sapien
aaggtggccctatcagggaagcaga

SEQ ID NO: 427080 - DNA, 25 bp, Homo sapien
agaggccgtcctagggaagcccagc

SEQ ID NO: 427081 - DNA, 25 bp, Homo sapien
ggaagcccagctccggcacttttgg

SEQ ID NO: 427082 - DNA, 25 bp, Homo sapien
tggaggagcaggaccctagacctct

SEQ ID NO: 427083 - DNA, 25 bp, Homo sapien
ggagcaggaccctagacctctgcag

SEQ ID NO: 427084 - DNA, 25 bp, Homo sapien
tgcagcccataccaggtctcatgga

SEQ ID NO: 427085 - DNA, 25 bp, Homo sapien
agcccataccaggtctcatggaggg

SEQ ID NO: 427086 - DNA, 25 bp, Homo sapien
gctggaggagcaggactctagccct

SEQ ID NO: 427087 - DNA, 25 bp, Homo sapien
acagtccactccagggctcatgaag

SEQ ID NO: 427088 - DNA, 25 bp, Homo sapien
gggagcagatttaccagcgcgtcca

SEQ ID NO: 427089 - DNA, 25 bp, Homo sapien
tggccatcgcagagcagcacaagcg

SEQ ID NO: 427090 - DNA, 25 bp, Homo sapien
agcacaagcgggtcctgctggaaat

SEQ ID NO: 427091 - DNA, 25 bp, Homo sapien
gagaagaacgtgaggctgctgaaca

SEQ ID NO: 427092 - DNA, 25 bp, Homo sapien
tgaacaagggcacggaacattactc

SEQ ID NO: 427093 - DNA, 25 bp, Homo sapien
ggaacattactcgtatccctgcaca

SEQ ID NO: 427094 - DNA, 25 bp, Homo sapien
tgcctactggcaccacatcactggt

SEQ ID NO: 427095 - DNA, 25 bp, Homo sapien
actggttcccagaacatcgccgaag

SEQ ID NO: 427096 - DNA, 25 bp, Homo sapien
cgaagcctccagctatgctggtgag

SEQ ID NO: 427097 - DNA, 25 bp, Homo sapien
aggccagctcggaaacagacctcct

SEQ ID NO: 427098 - DNA, 25 bp, Homo sapien
aacagattcatcctgctaaagccaa

SEQ ID NO: 427099 - DNA, 25 bp, Homo sapien
taaaataatttgaaggcgatctttt

SEQ ID NO: 427100 - DNA, 25 bp, Homo sapien
taaaagaccttgaaatccatgacgc

SEQ ID NO: 427101 - DNA, 25 bp, Homo sapien
aaagaccttgaaatccatgacgcag

SEQ ID NO: 427102 - DNA, 25 bp, Homo sapien
gaccttgaaatccatgacgcaggga

SEQ ID NO: 427103 - DNA, 25 bp, Homo sapien
aaatccatgacgcagggagaattgc

SEQ ID NO: 427104 - DNA, 25 bp, Homo sapien
gggagaattgcgtcatttaaagcct

SEQ ID NO: 427105 - DNA, 25 bp, Homo sapien
gaattgcgtcatttaaagcctagtt

SEQ ID NO: 427106 - DNA, 25 bp, Homo sapien
ttaaagcctagttaacgcatttact

SEQ ID NO: 427107 - DNA, 25 bp, Homo sapien
tagttaacgcatttactaaacgcag

SEQ ID NO: 427108 - DNA, 25 bp, Homo sapien
aacgcatttactaaacgcagacgaa

SEQ ID NO: 427109 - DNA, 25 bp, Homo sapien
tttactaaacgcagacgaaaatgga

SEQ ID NO: 427110 - DNA, 25 bp, Homo sapien
atcagtgtttatttcattgtgttaa

SEQ ID NO: 427111 - DNA, 25 bp, Homo sapien
gattatgttaactctgagtctgtcc

SEQ ID NO: 427112 - DNA, 25 bp, Homo sapien
aatgagttcacttccattttcaaat

SEQ ID NO: 427113 - DNA, 25 bp, Homo sapien
ttttatcggcattaatttttcagtg

SEQ ID NO: 427114 - DNA, 25 bp, Homo sapien
tatcggcattaatttttcagtgtag

SEQ ID NO: 427115 - DNA, 25 bp, Homo sapien
atcggcattaatttttcagtgtagt

SEQ ID NO: 427116 - DNA, 25 bp, Homo sapien
cggcattaatttttcagtgtagttt

SEQ ID NO: 427117 - DNA, 25 bp, Homo sapien
taatttttcagtgtagtttgttgtt

SEQ ID NO: 427118 - DNA, 25 bp, Homo sapien
tgatgcatattgttacactactatt

SEQ ID NO: 427119 - DNA, 25 bp, Homo sapien
tacactactattaactaggcttcag

SEQ ID NO: 427120 - DNA, 25 bp, Homo sapien
taactaggcttcagtatatcagtgt

SEQ ID NO: 427121 - DNA, 25 bp, Homo sapien
taaaataatttgaaggcgatctttt

SEQ ID NO: 427122 - DNA, 25 bp, Homo sapien
ccatgacgcagggagaattgcgtca

SEQ ID NO: 427123 - DNA, 25 bp, Homo sapien
ttaaagcctagttaacgcatttact

SEQ ID NO: 427124 - DNA, 25 bp, Homo sapien
taaagcctagttaacgcatttacta

SEQ ID NO: 427125 - DNA, 25 bp, Homo sapien
gcctagttaacgcatttactaaacg

SEQ ID NO: 427126 - DNA, 25 bp, Homo sapien
ctagttaacgcatttactaaacgca

SEQ ID NO: 427127 - DNA, 25 bp, Homo sapien
tagttaacgcatttactaaacgcag

SEQ ID NO: 427128 - DNA, 25 bp, Homo sapien
agaagatagaagtttgaagtggaaa

SEQ ID NO: 427129 - DNA, 25 bp, Homo sapien
ggaagacagaagtacgggaaggcga

SEQ ID NO: 427130 - DNA, 25 bp, Homo sapien
gaagacagaagtacgggaaggcgaa

SEQ ID NO: 427131 - DNA, 25 bp, Homo sapien
aagacagaagtacgggaaggcgaag

SEQ ID NO: 427132 - DNA, 25 bp, Homo sapien
gtagaatcaggaaacccggatgcct

SEQ ID NO: 427133 - DNA, 25 bp, Homo sapien
acccggatgcctaacagctcaaaga

SEQ ID NO: 427134 - DNA, 25 bp, Homo sapien
ttttaatacgttttgcaaatgcatc

SEQ ID NO: 427135 - DNA, 25 bp, Homo sapien
gctgcagtgtcgcttatgaaagtac

SEQ ID NO: 427136 - DNA, 25 bp, Homo sapien
gaagtgctgactctagcatcagcct

SEQ ID NO: 427137 - DNA, 25 bp, Homo sapien
gcatcagcctctaccgattgatttt

SEQ ID NO: 427138 - DNA, 25 bp, Homo sapien
tctaccgattgattttcctcccttc

SEQ ID NO: 427139 - DNA, 25 bp, Homo sapien
agccctggatgtccacttagggata

SEQ ID NO: 427140 - DNA, 25 bp, Homo sapien
tatggttttggttcccatttctagt

SEQ ID NO: 427141 - DNA, 25 bp, Homo sapien
ggttcccatttctagttcacgttga

SEQ ID NO: 427142 - DNA, 25 bp, Homo sapien
gttcacgttgaatgacaggcctgga

SEQ ID NO: 427143 - DNA, 25 bp, Homo sapien
tggaggagcaggaccctagacctct

SEQ ID NO: 427144 - DNA, 25 bp, Homo sapien
aggagcaggaccctagacctctgca

SEQ ID NO: 427145 - DNA, 25 bp, Homo sapien
gagcaggaccctagacctctgcagc

SEQ ID NO: 427146 - DNA, 25 bp, Homo sapien
tctgcagcccataccaggtctcatg

SEQ ID NO: 427147 - DNA, 25 bp, Homo sapien
tgcagcccataccaggtctcatgga

SEQ ID NO: 427148 - DNA, 25 bp, Homo sapien
gcagcccataccaggtctcatggag

SEQ ID NO: 427149 - DNA, 25 bp, Homo sapien
agcccataccaggtctcatggaggg

SEQ ID NO: 427150 - DNA, 25 bp, Homo sapien
ctggaggagcaggactctagccctc

SEQ ID NO: 427151 - DNA, 25 bp, Homo sapien
ggaggagcaggactctagccctcca

SEQ ID NO: 427152 - DNA, 25 bp, Homo sapien
acagtccactccagggctcatgaag

SEQ ID NO: 427153 - DNA, 25 bp, Homo sapien
cagtccactccagggctcatgaagg

SEQ ID NO: 427154 - DNA, 25 bp, Homo sapien
tagtctggaagctccgaccgacatc

SEQ ID NO: 427155 - DNA, 25 bp, Homo sapien
cgacatcacggagcagccttcaagc

SEQ ID NO: 427156 - DNA, 25 bp, Homo sapien
gacatcacggagcagccttcaagca

SEQ ID NO: 427157 - DNA, 25 bp, Homo sapien
acatcacggagcagccttcaagcat

SEQ ID NO: 427158 - DNA, 25 bp, Homo sapien
catcacggagcagccttcaagcatt

SEQ ID NO: 427159 - DNA, 25 bp, Homo sapien
tcacggagcagccttcaagcattcc

SEQ ID NO: 427160 - DNA, 25 bp, Homo sapien
acggagcagccttcaagcattccat

SEQ ID NO: 427161 - DNA, 25 bp, Homo sapien
cggagcagccttcaagcattccatt

SEQ ID NO: 427162 - DNA, 25 bp, Homo sapien
ggagcagccttcaagcattccatta

SEQ ID NO: 427163 - DNA, 25 bp, Homo sapien
gagcagccttcaagcattccattac

SEQ ID NO: 427164 - DNA, 25 bp, Homo sapien
gcagccttcaagcattccattacgc

SEQ ID NO: 427165 - DNA, 25 bp, Homo sapien
taaaataatttgaaggcgatctttt

SEQ ID NO: 427166 - DNA, 25 bp, Homo sapien
ccatgacgcagggagaattgcgtca

SEQ ID NO: 427167 - DNA, 25 bp, Homo sapien
ttaaagcctagttaacgcatttact

SEQ ID NO: 427168 - DNA, 25 bp, Homo sapien
taaagcctagttaacgcatttacta

SEQ ID NO: 427169 - DNA, 25 bp, Homo sapien
gcctagttaacgcatttactaaacg

SEQ ID NO: 427170 - DNA, 25 bp, Homo sapien
ctagttaacgcatttactaaacgca

SEQ ID NO: 427171 - DNA, 25 bp, Homo sapien
tagttaacgcatttactaaacgcag

SEQ ID NO: 427172 - DNA, 25 bp, Homo sapien
agaagatagaagtttgaagtggaaa

SEQ ID NO: 427173 - DNA, 25 bp, Homo sapien
gaattttatcggcattaatttttca

SEQ ID NO: 427174 - DNA, 25 bp, Homo sapien
ttttatcggcattaatttttcagtg

SEQ ID NO: 427175 - DNA, 25 bp, Homo sapien
tttatcggcattaatttttcagtgt

SEQ ID NO: 427176 - DNA, 25 bp, Homo sapien
ttatcggcattaatttttcagtgta

SEQ ID NO: 427177 - DNA, 25 bp, Homo sapien
tatcggcattaatttttcagtgtag

SEQ ID NO: 427178 - DNA, 25 bp, Homo sapien
atcggcattaatttttcagtgtagt

SEQ ID NO: 427179 - DNA, 25 bp, Homo sapien
tcggcattaatttttcagtgtagtt

SEQ ID NO: 427180 - DNA, 25 bp, Homo sapien
cggcattaatttttcagtgtagttt

SEQ ID NO: 427181 - DNA, 25 bp, Homo sapien
ggcattaatttttcagtgtagtttg

SEQ ID NO: 427182 - DNA, 25 bp, Homo sapien
gcattaatttttcagtgtagtttgt

SEQ ID NO: 427183 - DNA, 25 bp, Homo sapien
taatttttcagtgtagtttgttgtt

SEQ ID NO: 427184 - DNA, 25 bp, Homo sapien
cagcctgtagtaacctggatggttt

SEQ ID NO: 427185 - DNA, 25 bp, Homo sapien
gtagtaacctggatggttttcaatg

SEQ ID NO: 427186 - DNA, 25 bp, Homo sapien
atggttttcaatggcatggttagtc

SEQ ID NO: 427187 - DNA, 25 bp, Homo sapien
tcaatggcatggttagtcaaattca

SEQ ID NO: 427188 - DNA, 25 bp, Homo sapien
tttaaacttagaagcagctttcggg

SEQ ID NO: 427189 - DNA, 25 bp, Homo sapien
gggtaggttggagcatttattacat

SEQ ID NO: 427190 - DNA, 25 bp, Homo sapien
tgtttaatgtcttaaccgtgggcct

SEQ ID NO: 427191 - DNA, 25 bp, Homo sapien
ctgaaatgattgttgggctgtggaa

SEQ ID NO: 427192 - DNA, 25 bp, Homo sapien
gggctgtggaaaacatttacctatt

SEQ ID NO: 427193 - DNA, 25 bp, Homo sapien
aaagacagtccactttttagcatgt

SEQ ID NO: 427194 - DNA, 25 bp, Homo sapien
cagcctgtggtcgtcttaactaata

SEQ ID NO: 427195 - DNA, 25 bp, Homo sapien
ttttctcctccctcaactggatcat

SEQ ID NO: 427196 - DNA, 25 bp, Homo sapien
tcctccctcaactggatcataactt

SEQ ID NO: 427197 - DNA, 25 bp, Homo sapien
tcataacttatgactctgaggctga

SEQ ID NO: 427198 - DNA, 25 bp, Homo sapien
aggctgctctatttgtgcctgtagc

SEQ ID NO: 427199 - DNA, 25 bp, Homo sapien
ctgctctatttgtgcctgtagcttg

SEQ ID NO: 427200 - DNA, 25 bp, Homo sapien
gatttttcaggctgtctttcatttt

SEQ ID NO: 427201 - DNA, 25 bp, Homo sapien
ttttcaggctgtctttcattttgaa

SEQ ID NO: 427202 - DNA, 25 bp, Homo sapien
tgaaagaattttaccaaagacaagt

SEQ ID NO: 427203 - DNA, 25 bp, Homo sapien
gacaagttttagctgtctgcccaac

SEQ ID NO: 427204 - DNA, 25 bp, Homo sapien
aagttttagctgtctgcccaactag

SEQ ID NO: 427205 - DNA, 25 bp, Homo sapien
tagctgtctgcccaactagtttttc

SEQ ID NO: 427206 - DNA, 25 bp, Homo sapien
ggtgtagctacatttctaccagtca

SEQ ID NO: 427207 - DNA, 25 bp, Homo sapien
agctacatttctaccagtcaaagta

SEQ ID NO: 427208 - DNA, 25 bp, Homo sapien
gtagacttcaagagtatcatgaaca

SEQ ID NO: 427209 - DNA, 25 bp, Homo sapien
ggagaaacatttcacagaaatcaga

SEQ ID NO: 427210 - DNA, 25 bp, Homo sapien
gaaatcagaatcaacgcgacaaagt

SEQ ID NO: 427211 - DNA, 25 bp, Homo sapien
tcaacgcgacaaagttatgggaagt

SEQ ID NO: 427212 - DNA, 25 bp, Homo sapien
tctgtaaacgccagggcagactgac

SEQ ID NO: 427213 - DNA, 25 bp, Homo sapien
gaaaaaacaaagcatggccgagcat

SEQ ID NO: 427214 - DNA, 25 bp, Homo sapien
aagcatggccgagcatatactgtct

SEQ ID NO: 427215 - DNA, 25 bp, Homo sapien
atggccgagcatatactgtctaaaa

SEQ ID NO: 427216 - DNA, 25 bp, Homo sapien
tactgtctaaaaaaggtgagctgaa

SEQ ID NO: 427217 - DNA, 25 bp, Homo sapien
taaaggtttcatagttatcttcaat

SEQ ID NO: 427218 - DNA, 25 bp, Homo sapien
catagttatcttcaatgggttagta

SEQ ID NO: 427219 - DNA, 25 bp, Homo sapien
attctataggatgaggtgataccta

SEQ ID NO: 427220 - DNA, 25 bp, Homo sapien
gatattctcaattgtatttctgcct

SEQ ID NO: 427221 - DNA, 25 bp, Homo sapien
gtatttctgcctatgtttgcttttt

SEQ ID NO: 427222 - DNA, 25 bp, Homo sapien
gtttgcttttttggctcaagcatct

SEQ ID NO: 427223 - DNA, 25 bp, Homo sapien
cttttttggctcaagcatctgttgg

SEQ ID NO: 427224 - DNA, 25 bp, Homo sapien
tttggctcaagcatctgttggaaga

SEQ ID NO: 427225 - DNA, 25 bp, Homo sapien
ctcaagcatctgttggaagagacaa

SEQ ID NO: 427226 - DNA, 25 bp, Homo sapien
gagacaaaatgtgacttggttcata

SEQ ID NO: 427227 - DNA, 25 bp, Homo sapien
atgtgacttggttcataataaagca

SEQ ID NO: 427228 - DNA, 25 bp, Homo sapien
gagtttgactatctcaagagcctgg

SEQ ID NO: 427229 - DNA, 25 bp, Homo sapien
ctcaagagcctggagatagaggaga

SEQ ID NO: 427230 - DNA, 25 bp, Homo sapien
atcaacaagatcaagtggctcccac

SEQ ID NO: 427231 - DNA, 25 bp, Homo sapien
acaagatcaagtggctcccacagca

SEQ ID NO: 427232 - DNA, 25 bp, Homo sapien
tcactcctgtccaccaacgataaaa

SEQ ID NO: 427233 - DNA, 25 bp, Homo sapien
tcctgtccaccaacgataaaactat

SEQ ID NO: 427234 - DNA, 25 bp, Homo sapien
aattatggaagattaccgaacgaga

SEQ ID NO: 427235 - DNA, 25 bp, Homo sapien
ggaagattaccgaacgagataaaag

SEQ ID NO: 427236 - DNA, 25 bp, Homo sapien
gagccctcggaggatctttgccaat

SEQ ID NO: 427237 - DNA, 25 bp, Homo sapien
tcggaggatctttgccaatggccac

SEQ ID NO: 427238 - DNA, 25 bp, Homo sapien
ggatctttgccaatggccacaccta

SEQ ID NO: 427239 - DNA, 25 bp, Homo sapien
tccagaatgccgtgtgatatcagag

SEQ ID NO: 427240 - DNA, 25 bp, Homo sapien
cagagtttgtaattccaagtgtgta

SEQ ID NO: 427241 - DNA, 25 bp, Homo sapien
gaacgagttgattgaagctttcaaa

SEQ ID NO: 427242 - DNA, 25 bp, Homo sapien
aaatgtctttatcgccatgcttacc

SEQ ID NO: 427243 - DNA, 25 bp, Homo sapien
atgcttaccccgatgggcggctagc

SEQ ID NO: 427244 - DNA, 25 bp, Homo sapien
tagcagagcctgagaaacctcggaa

SEQ ID NO: 427245 - DNA, 25 bp, Homo sapien
gagaaacctcggaaacagctcagtt

SEQ ID NO: 427246 - DNA, 25 bp, Homo sapien
gaaacagctcagttctcaaggcact

SEQ ID NO: 427247 - DNA, 25 bp, Homo sapien
caaggcactgtgaggttctttaatt

SEQ ID NO: 427248 - DNA, 25 bp, Homo sapien
aggttctttaattcagtgcggctct

SEQ ID NO: 427249 - DNA, 25 bp, Homo sapien
tgcggctctgggatttcatcgagaa

SEQ ID NO: 427250 - DNA, 25 bp, Homo sapien
gaaaatggtgcccaacgttcacctg

SEQ ID NO: 427251 - DNA, 25 bp, Homo sapien
aacgttcacctgaactgcctgtgaa

SEQ ID NO: 427252 - DNA, 25 bp, Homo sapien
gaactgcctgtgaatttaggttgta

SEQ ID NO: 427253 - DNA, 25 bp, Homo sapien
agaactgagttgtttaggctaccca

SEQ ID NO: 427254 - DNA, 25 bp, Homo sapien
taggctacccaggatccaggttatt

SEQ ID NO: 427255 - DNA, 25 bp, Homo sapien
ggatccaggttattatggccattga

SEQ ID NO: 427256 - DNA, 25 bp, Homo sapien
tatggccattgaagtgctatttgct

SEQ ID NO: 427257 - DNA, 25 bp, Homo sapien
gctatttgcttcctaactgttgttc

SEQ ID NO: 427258 - DNA, 25 bp, Homo sapien
ttcctaactgttgttcaagctcaca

SEQ ID NO: 427259 - DNA, 25 bp, Homo sapien
acttagggcctttcctagtgacaag

SEQ ID NO: 427260 - DNA, 25 bp, Homo sapien
gagaagtgcccttgacttagtggtg

SEQ ID NO: 427261 - DNA, 25 bp, Homo sapien
tgtacaatagaaaccaaaccaaatg

SEQ ID NO: 427262 - DNA, 25 bp, Homo sapien
accaaatgggcaccctcggttgccg

SEQ ID NO: 427263 - DNA, 25 bp, Homo sapien
ctctccactctttacccacaaaggc

SEQ ID NO: 427264 - DNA, 25 bp, Homo sapien
aaggcagaagactgttacactaggg

SEQ ID NO: 427265 - DNA, 25 bp, Homo sapien
actagggggctcagcaaattcaatc

SEQ ID NO: 427266 - DNA, 25 bp, Homo sapien
aattcaatcccacccttaccaattg

SEQ ID NO: 427267 - DNA, 25 bp, Homo sapien
ttcaatcccacccttaccaattgag

SEQ ID NO: 427268 - DNA, 25 bp, Homo sapien
ccttaccaattgagccaaacctaga

SEQ ID NO: 427269 - DNA, 25 bp, Homo sapien
agggagcgagacaggcgaccaacac

SEQ ID NO: 427270 - DNA, 25 bp, Homo sapien
agcgagacaggcgaccaacacagag

SEQ ID NO: 427271 - DNA, 25 bp, Homo sapien
acaggcgaccaacacagaggagaga

SEQ ID NO: 427272 - DNA, 25 bp, Homo sapien
aatggcaggttgatttccacttcct

SEQ ID NO: 427273 - DNA, 25 bp, Homo sapien
tgatttccacttcctcgagaggttt

SEQ ID NO: 427274 - DNA, 25 bp, Homo sapien
acctcttcgcctttgaggcgatgga

SEQ ID NO: 427275 - DNA, 25 bp, Homo sapien
tgaggcgatggatttcttcctgcag

SEQ ID NO: 427276 - DNA, 25 bp, Homo sapien
ttcttccaggcgcaagctcgaaagg

SEQ ID NO: 427277 - DNA, 25 bp, Homo sapien
gcagaagctcgaggtacatctcgta

SEQ ID NO: 427278 - DNA, 25 bp, Homo sapien
gaggtacatctcgtagcccacgctg

SEQ ID NO: 427279 - DNA, 25 bp, Homo sapien
atgtggccgctctgcgagctgccga

SEQ ID NO: 427280 - DNA, 25 bp, Homo sapien
ggtagagcgccaggcggtccttcat

SEQ ID NO: 427281 - DNA, 25 bp, Homo sapien
aggcggtccttcatgtcgggcacgt

SEQ ID NO: 427282 - DNA, 25 bp, Homo sapien
ttcatgtcgggcacgtacgtttcgg

SEQ ID NO: 427283 - DNA, 25 bp, Homo sapien
ggtacacaaggttgattctcagttt

SEQ ID NO: 427284 - DNA, 25 bp, Homo sapien
gattctcagtttggtaggctctata

SEQ ID NO: 427285 - DNA, 25 bp, Homo sapien
tggtaggctctatagttccatccca

SEQ ID NO: 427286 - DNA, 25 bp, Homo sapien
ccatcccagctgtctaattctgaag

SEQ ID NO: 427287 - DNA, 25 bp, Homo sapien
attctgaagtgctccagtcttattg

SEQ ID NO: 427288 - DNA, 25 bp, Homo sapien
gctccagtcttattggtgcccaatg

SEQ ID NO: 427289 - DNA, 25 bp, Homo sapien
ggtaatctgtgcctcttccccaaaa

SEQ ID NO: 427290 - DNA, 25 bp, Homo sapien
tcttccccaaaagcaatgacaggca

SEQ ID NO: 427291 - DNA, 25 bp, Homo sapien
aggcaccagtgtctccacatttaga

SEQ ID NO: 427292 - DNA, 25 bp, Homo sapien
gatatattcccagtctctgtacatt

SEQ ID NO: 427293 - DNA, 25 bp, Homo sapien
gtaggaccttgtgtgcagtttcatt

SEQ ID NO: 427294 - DNA, 25 bp, Homo sapien
tcctctcactgttgcctgcatttgt

SEQ ID NO: 427295 - DNA, 25 bp, Homo sapien
tctcactgttgcctgcatttgtacg

SEQ ID NO: 427296 - DNA, 25 bp, Homo sapien
tcactgttgcctgcatttgtacgtg

SEQ ID NO: 427297 - DNA, 25 bp, Homo sapien
cactgttgcctgcatttgtacgtga

SEQ ID NO: 427298 - DNA, 25 bp, Homo sapien
ctgttgcctgcatttgtacgtgaga

SEQ ID NO: 427299 - DNA, 25 bp, Homo sapien
tgttgcctgcatttgtacgtgagaa

SEQ ID NO: 427300 - DNA, 25 bp, Homo sapien
gttgcctgcatttgtacgtgagaaa

SEQ ID NO: 427301 - DNA, 25 bp, Homo sapien
ttgcctgcatttgtacgtgagaaac

SEQ ID NO: 427302 - DNA, 25 bp, Homo sapien
gcctgcatttgtacgtgagaaacgc

SEQ ID NO: 427303 - DNA, 25 bp, Homo sapien
ctgcatttgtacgtgagaaacgctc

SEQ ID NO: 427304 - DNA, 25 bp, Homo sapien
gcatttgtacgtgagaaacgctcat

SEQ ID NO: 427305 - DNA, 25 bp, Homo sapien
tgaagacttcgacctccacgtgttt

SEQ ID NO: 427306 - DNA, 25 bp, Homo sapien
gacctccacgtgtttatactggttt

SEQ ID NO: 427307 - DNA, 25 bp, Homo sapien
cacacaggtatggtagtctggtgaa

SEQ ID NO: 427308 - DNA, 25 bp, Homo sapien
gtagtctggtgaaagcttcgataac

SEQ ID NO: 427309 - DNA, 25 bp, Homo sapien
gcttcgataacaaaaccagcttttc

SEQ ID NO: 427310 - DNA, 25 bp, Homo sapien
gcttttctgaaaacttcaggcagac

SEQ ID NO: 427311 - DNA, 25 bp, Homo sapien
aggcagactattcacttgttcttcc

SEQ ID NO: 427312 - DNA, 25 bp, Homo sapien
agactattcacttgttcttcccagt

SEQ ID NO: 427313 - DNA, 25 bp, Homo sapien
ccacctacgttttccacatagggat

SEQ ID NO: 427314 - DNA, 25 bp, Homo sapien
gacaagggcaaggatgaccctgcct

SEQ ID NO: 427315 - DNA, 25 bp, Homo sapien
caaggatgaccctgcctctagttgg

SEQ ID NO: 427316 - DNA, 25 bp, Homo sapien
gttacaattcagaagtcttttccac

SEQ ID NO: 427317 - DNA, 25 bp, Homo sapien
cttttccacttatttctgacctgta

SEQ ID NO: 427318 - DNA, 25 bp, Homo sapien
atttctgacctgtaactgcattctg

SEQ ID NO: 427319 - DNA, 25 bp, Homo sapien
gtaactgcattctgattctatttat

SEQ ID NO: 427320 - DNA, 25 bp, Homo sapien
ttatttaacaaactccttgcacaca

SEQ ID NO: 427321 - DNA, 25 bp, Homo sapien
atcctctaccacattctacataaaa

SEQ ID NO: 427322 - DNA, 25 bp, Homo sapien
atctgagatggttctattagtttta

SEQ ID NO: 427323 - DNA, 25 bp, Homo sapien
atgagtatcttaaggattttcactt

SEQ ID NO: 427324 - DNA, 25 bp, Homo sapien
taatccattcaggagacaccagcca

SEQ ID NO: 427325 - DNA, 25 bp, Homo sapien
ttcaggagacaccagccacgacaaa

SEQ ID NO: 427326 - DNA, 25 bp, Homo sapien
gccacgacaaagctggacttcatct

SEQ ID NO: 427327 - DNA, 25 bp, Homo sapien
ccatttaaaggtttcatagttatct

SEQ ID NO: 427328 - DNA, 25 bp, Homo sapien
gtttcatagttatcttcaatgggtt

SEQ ID NO: 427329 - DNA, 25 bp, Homo sapien
catagttatcttcaatgggttagta

SEQ ID NO: 427330 - DNA, 25 bp, Homo sapien
attctataggatgaggtgataccta

SEQ ID NO: 427331 - DNA, 25 bp, Homo sapien
gtttgcttttttggctcaagcatct

SEQ ID NO: 427332 - DNA, 25 bp, Homo sapien
cttttttggctcaagcatctgttgg

SEQ ID NO: 427333 - DNA, 25 bp, Homo sapien
tttggctcaagcatctgttggaaga

SEQ ID NO: 427334 - DNA, 25 bp, Homo sapien
ggctcaagcatctgttggaagagac

SEQ ID NO: 427335 - DNA, 25 bp, Homo sapien
caagcatctgttggaagagacaaaa

SEQ ID NO: 427336 - DNA, 25 bp, Homo sapien
gagacaaaatgtgacttggttcata

SEQ ID NO: 427337 - DNA, 25 bp, Homo sapien
atgtgacttggttcataataaagca

SEQ ID NO: 427338 - DNA, 25 bp, Homo sapien
ctgacactgtcatggcctgctctgt

SEQ ID NO: 427339 - DNA, 25 bp, Homo sapien
gaactaggtgtcatcatcaacaagg

SEQ ID NO: 427340 - DNA, 25 bp, Homo sapien
tgatggctcctgcacaggccctgca

SEQ ID NO: 427341 - DNA, 25 bp, Homo sapien
gcacaggccctgcacataggatgag

SEQ ID NO: 427342 - DNA, 25 bp, Homo sapien
aaaggcccagtgacaggtgtggaca

SEQ ID NO: 427343 - DNA, 25 bp, Homo sapien
agccgcctcttctcggtagaaggga

SEQ ID NO: 427344 - DNA, 25 bp, Homo sapien
gagaaggacagagctctcttcaata

SEQ ID NO: 427345 - DNA, 25 bp, Homo sapien
ttcaataaattcgtcaggtcaaagc

SEQ ID NO: 427346 - DNA, 25 bp, Homo sapien
aagtacaggcttgtgtatgtgtgtc

SEQ ID NO: 427347 - DNA, 25 bp, Homo sapien
atgtgtgtctgacggaagggctgac

SEQ ID NO: 427348 - DNA, 25 bp, Homo sapien
gggctgacactgtcatggcctgctc

SEQ ID NO: 427349 - DNA, 25 bp, Homo sapien
gaaaaagatctccagtgtcacgccc

SEQ ID NO: 427350 - DNA, 25 bp, Homo sapien
gtgtcacgcccctgtgagattagac

SEQ ID NO: 427351 - DNA, 25 bp, Homo sapien
gagattagacttgcctcctgagaag

SEQ ID NO: 427352 - DNA, 25 bp, Homo sapien
tgagaagcctctcacaagctcttta

SEQ ID NO: 427353 - DNA, 25 bp, Homo sapien
ctctcacaagctctttagccaaaca

SEQ ID NO: 427354 - DNA, 25 bp, Homo sapien
gtagaacagacaccccttcaagaag

SEQ ID NO: 427355 - DNA, 25 bp, Homo sapien
gcagagaaaagatccaagtgctttc

SEQ ID NO: 427356 - DNA, 25 bp, Homo sapien
tgtgactgattttattgctcctggc

SEQ ID NO: 427357 - DNA, 25 bp, Homo sapien
attttattgctcctggctactccat

SEQ ID NO: 427358 - DNA, 25 bp, Homo sapien
tgatcattaaacacccaatggattt

SEQ ID NO: 427359 - DNA, 25 bp, Homo sapien
gatcaagaacaatgactatcagtcc

SEQ ID NO: 427360 - DNA, 25 bp, Homo sapien
agatgccaatccacgcccgtgacag

SEQ ID NO: 427361 - DNA, 25 bp, Homo sapien
tccacgcccgtgacagaaataccag

SEQ ID NO: 427362 - DNA, 25 bp, Homo sapien
atctcataatgccacaaggcccgca

SEQ ID NO: 427363 - DNA, 25 bp, Homo sapien
taccaggcagtcctaattctccaaa

SEQ ID NO: 427364 - DNA, 25 bp, Homo sapien
aaatgaccatcgatggacacggaca

SEQ ID NO: 427365 - DNA, 25 bp, Homo sapien
tggacacggacagggcatgcaaata

SEQ ID NO: 427366 - DNA, 25 bp, Homo sapien
acagggcatgcaaatacttatcgat

SEQ ID NO: 427367 - DNA, 25 bp, Homo sapien
atacttatcgatcagtgtgggcaca

SEQ ID NO: 427368 - DNA, 25 bp, Homo sapien
atcgatcagtgtgggcacagtgcca

SEQ ID NO: 427369 - DNA, 25 bp, Homo sapien
ctttccatgggcagcgagtaacaat

SEQ ID NO: 427370 - DNA, 25 bp, Homo sapien
cagaattgatccagaggaaacacca

SEQ ID NO: 427371 - DNA, 25 bp, Homo sapien
aaacctggctctaaggtgggatcac

SEQ ID NO: 427372 - DNA, 25 bp, Homo sapien
gcagtctctgcccaaacataaagag

SEQ ID NO: 427373 - DNA, 25 bp, Homo sapien
gggagcctgagccacaaaaatgttc

SEQ ID NO: 427374 - DNA, 25 bp, Homo sapien
accctcaagggttatagactgccat

SEQ ID NO: 427375 - DNA, 25 bp, Homo sapien
agactgccatgctagacaagcttgt

SEQ ID NO: 427376 - DNA, 25 bp, Homo sapien
gctagacaagcttgtccatgtaata

SEQ ID NO: 427377 - DNA, 25 bp, Homo sapien
gcccctgccttgattagactcctag

SEQ ID NO: 427378 - DNA, 25 bp, Homo sapien
tgattagactcctagcacctggcta

SEQ ID NO: 427379 - DNA, 25 bp, Homo sapien
agactcctagcacctggctagtttc

SEQ ID NO: 427380 - DNA, 25 bp, Homo sapien
ttctaacatgttttgtgcagcacag

SEQ ID NO: 427381 - DNA, 25 bp, Homo sapien
tttgtgcagcacagtttttaataaa

SEQ ID NO: 427382 - DNA, 25 bp, Homo sapien
gagattgaagaactaggtgtcatca

SEQ ID NO: 427383 - DNA, 25 bp, Homo sapien
gaagaactaggtgtcatcatcaaca

SEQ ID NO: 427384 - DNA, 25 bp, Homo sapien
aagaactaggtgtcatcatcaacaa

SEQ ID NO: 427385 - DNA, 25 bp, Homo sapien
gaactaggtgtcatcatcaacaagg

SEQ ID NO: 427386 - DNA, 25 bp, Homo sapien
aactaggtgtcatcatcaacaaggt

SEQ ID NO: 427387 - DNA, 25 bp, Homo sapien
tgatggctcctgcacaggccctgca

SEQ ID NO: 427388 - DNA, 25 bp, Homo sapien
aggtgccagccctgcaagccgcctc

SEQ ID NO: 427389 - DNA, 25 bp, Homo sapien
cgcctcttctcggtagaagggagaa

SEQ ID NO: 427390 - DNA, 25 bp, Homo sapien
gagaaggacagagctctcttcaata

SEQ ID NO: 427391 - DNA, 25 bp, Homo sapien
tctcttcaataaattcgtcaggtca

SEQ ID NO: 427392 - DNA, 25 bp, Homo sapien
ttcaataaattcgtcaggtcaaagc

SEQ ID NO: 427393 - DNA, 25 bp, Homo sapien
gcaaatataaacgattcctatagac

SEQ ID NO: 427394 - DNA, 25 bp, Homo sapien
ataaacgattcctatagacttttgt

SEQ ID NO: 427395 - DNA, 25 bp, Homo sapien
taaacgattcctatagacttttgta

SEQ ID NO: 427396 - DNA, 25 bp, Homo sapien
aaacgattcctatagacttttgtat

SEQ ID NO: 427397 - DNA, 25 bp, Homo sapien
aacgattcctatagacttttgtatt

SEQ ID NO: 427398 - DNA, 25 bp, Homo sapien
acgattcctatagacttttgtattt

SEQ ID NO: 427399 - DNA, 25 bp, Homo sapien
cgattcctatagacttttgtatttt

SEQ ID NO: 427400 - DNA, 25 bp, Homo sapien
agaaaaaagtagcagcactttggga

SEQ ID NO: 427401 - DNA, 25 bp, Homo sapien
aacatgtccaaacccctcctgtact

SEQ ID NO: 427402 - DNA, 25 bp, Homo sapien
gctgagatcataccatcgtgctccg

SEQ ID NO: 427403 - DNA, 25 bp, Homo sapien
ataccatcgtgctccggcctgggtg

SEQ ID NO: 427404 - DNA, 25 bp, Homo sapien
taacaaacgtttaacgcagggctat

SEQ ID NO: 427405 - DNA, 25 bp, Homo sapien
aacgcagggctattttctagataaa

SEQ ID NO: 427406 - DNA, 25 bp, Homo sapien
gtcaaatgggacacgatgcacgatt

SEQ ID NO: 427407 - DNA, 25 bp, Homo sapien
gatgcacgattctgtattcctactc

SEQ ID NO: 427408 - DNA, 25 bp, Homo sapien
ctctgtggagtttttatctacctat

SEQ ID NO: 427409 - DNA, 25 bp, Homo sapien
tatctacctattgggacttcttgcc

SEQ ID NO: 427410 - DNA, 25 bp, Homo sapien
atttctgtggctgataccacatcta

SEQ ID NO: 427411 - DNA, 25 bp, Homo sapien
tatacttactgatatttgccttcgt

SEQ ID NO: 427412 - DNA, 25 bp, Homo sapien
actgatatttgccttcgtttactga

SEQ ID NO: 427413 - DNA, 25 bp, Homo sapien
tttgccttcgtttactgaacagatt

SEQ ID NO: 427414 - DNA, 25 bp, Homo sapien
gaaatcagcacttttaacaaacgtt

SEQ ID NO: 427415 - DNA, 25 bp, Homo sapien
aaggtcagagacagatttgatatta

SEQ ID NO: 427416 - DNA, 25 bp, Homo sapien
ggtcagagacagatttgatattaaa

SEQ ID NO: 427417 - DNA, 25 bp, Homo sapien
ggcaatggcatgtttgctcctaaat

SEQ ID NO: 427418 - DNA, 25 bp, Homo sapien
gcaatggcatgtttgctcctaaatc

SEQ ID NO: 427419 - DNA, 25 bp, Homo sapien
atggaaagcacctcatgtggctaaa

SEQ ID NO: 427420 - DNA, 25 bp, Homo sapien
ctgttgcctgcatttgtacgtgaga

SEQ ID NO: 427421 - DNA, 25 bp, Homo sapien
ctcatgacagcaaagctccttatgt

SEQ ID NO: 427422 - DNA, 25 bp, Homo sapien
catgacagcaaagctccttatgtat

SEQ ID NO: 427423 - DNA, 25 bp, Homo sapien
atgacagcaaagctccttatgtata

SEQ ID NO: 427424 - DNA, 25 bp, Homo sapien
gcaaagctccttatgtataatgaaa

SEQ ID NO: 427425 - DNA, 25 bp, Homo sapien
gtataatgaaacaaggtcagagaca

SEQ ID NO: 427426 - DNA, 25 bp, Homo sapien
tttcaaacctgtattccttctttat

SEQ ID NO: 427427 - DNA, 25 bp, Homo sapien
caaacctgtattccttctttatact

SEQ ID NO: 427428 - DNA, 25 bp, Homo sapien
agaagatgaagattctgtctccctg

SEQ ID NO: 427429 - DNA, 25 bp, Homo sapien
aaagtgtctgagcatatgcctggct

SEQ ID NO: 427430 - DNA, 25 bp, Homo sapien
gtgtctgagcatatgcctggctgtc

SEQ ID NO: 427431 - DNA, 25 bp, Homo sapien
gagcatatgcctggctgtcctcaga

SEQ ID NO: 427432 - DNA, 25 bp, Homo sapien
atgcctggctgtcctcagatcatca

SEQ ID NO: 427433 - DNA, 25 bp, Homo sapien
gaaaagccctttctacatgctagaa

SEQ ID NO: 427434 - DNA, 25 bp, Homo sapien
acatgctagaaggaaatacatccaa

SEQ ID NO: 427435 - DNA, 25 bp, Homo sapien
gttagcattggagtgttagaaacta

SEQ ID NO: 427436 - DNA, 25 bp, Homo sapien
gaaactagaatagacctctccgcca

SEQ ID NO: 427437 - DNA, 25 bp, Homo sapien
aattatgtctgttctgtttgatcac

SEQ ID NO: 427438 - DNA, 25 bp, Homo sapien
attatgtctgttctgtttgatcaca

SEQ ID NO: 427439 - DNA, 25 bp, Homo sapien
ttatgtctgttctgtttgatcacag

SEQ ID NO: 427440 - DNA, 25 bp, Homo sapien
tatgtctgttctgtttgatcacaga

SEQ ID NO: 427441 - DNA, 25 bp, Homo sapien
atgtctgttctgtttgatcacagag

SEQ ID NO: 427442 - DNA, 25 bp, Homo sapien
tgtctgttctgtttgatcacagagt

SEQ ID NO: 427443 - DNA, 25 bp, Homo sapien
gtctgttctgtttgatcacagagtt

SEQ ID NO: 427444 - DNA, 25 bp, Homo sapien
ctgttctgtttgatcacagagttgc

SEQ ID NO: 427445 - DNA, 25 bp, Homo sapien
gttctgtttgatcacagagttgcaa

SEQ ID NO: 427446 - DNA, 25 bp, Homo sapien
ttctgtttgatcacagagttgcaac

SEQ ID NO: 427447 - DNA, 25 bp, Homo sapien
ctgtttgatcacagagttgcaacaa

SEQ ID NO: 427448 - DNA, 25 bp, Homo sapien
cattgccttgcgcagtgtaatgctt

SEQ ID NO: 427449 - DNA, 25 bp, Homo sapien
agtgtaatgcttatgctcccactgc

SEQ ID NO: 427450 - DNA, 25 bp, Homo sapien
tttctgtggccacaataccctcaca

SEQ ID NO: 427451 - DNA, 25 bp, Homo sapien
cagatctgatcaaattgccctgtgg

SEQ ID NO: 427452 - DNA, 25 bp, Homo sapien
tgtggagacacacgccccaatagca

SEQ ID NO: 427453 - DNA, 25 bp, Homo sapien
tggctctatttgtcattaccttcac

SEQ ID NO: 427454 - DNA, 25 bp, Homo sapien
catttggactggacttattgttcat

SEQ ID NO: 427455 - DNA, 25 bp, Homo sapien
gtggtttcttatgtgctgattcttc

SEQ ID NO: 427456 - DNA, 25 bp, Homo sapien
gctgattcttcatacagtactggaa

SEQ ID NO: 427457 - DNA, 25 bp, Homo sapien
agtactggaaatagcttctggagca

SEQ ID NO: 427458 - DNA, 25 bp, Homo sapien
gcagggcgtggcaggcactcaacac

SEQ ID NO: 427459 - DNA, 25 bp, Homo sapien
cacttcttagaatagctgttgtttt

SEQ ID NO: 427460 - DNA, 25 bp, Homo sapien
ttctaagtcctgaaagttatagttt

SEQ ID NO: 427461 - DNA, 25 bp, Homo sapien
gataggcgatgtgctaagccctcag

SEQ ID NO: 427462 - DNA, 25 bp, Homo sapien
atgtgctaagccctcaggctacaaa

SEQ ID NO: 427463 - DNA, 25 bp, Homo sapien
aagccctcaggctacaaaggtgaaa

SEQ ID NO: 427464 - DNA, 25 bp, Homo sapien
gatgtttatacagacaactacaata

SEQ ID NO: 427465 - DNA, 25 bp, Homo sapien
gacaactacaatatatgatactaca

SEQ ID NO: 427466 - DNA, 25 bp, Homo sapien
caacatactgtcttagaagtgtgga

SEQ ID NO: 427467 - DNA, 25 bp, Homo sapien
gagacttataccttctctggttggg

SEQ ID NO: 427468 - DNA, 25 bp, Homo sapien
ttataccttctctggttgggcaaga

SEQ ID NO: 427469 - DNA, 25 bp, Homo sapien
ctggttgggcaagagacacttctta

SEQ ID NO: 427470 - DNA, 25 bp, Homo sapien
ccagggtcacgtcccgcttggtgtt

SEQ ID NO: 427471 - DNA, 25 bp, Homo sapien
agaagttgttgtaggccccggtcat

SEQ ID NO: 427472 - DNA, 25 bp, Homo sapien
ttgtaggccccggtcatgatgacgc

SEQ ID NO: 427473 - DNA, 25 bp, Homo sapien
tcatgatgacgctgtcgctcccgtt

SEQ ID NO: 427474 - DNA, 25 bp, Homo sapien
gttccaggcacattcaaacttgtcg

SEQ ID NO: 427475 - DNA, 25 bp, Homo sapien
ttgtcgaaaatgcagtcgttctcgt

SEQ ID NO: 427476 - DNA, 25 bp, Homo sapien
aatgcagtcgttctcgtacagggaa

SEQ ID NO: 427477 - DNA, 25 bp, Homo sapien
ttctcgtacagggaacagagcttgc

SEQ ID NO: 427478 - DNA, 25 bp, Homo sapien
acagagcttgctccgaaggtagtca

SEQ ID NO: 427479 - DNA, 25 bp, Homo sapien
ttgctccgaaggtagtcatggacct

SEQ ID NO: 427480 - DNA, 25 bp, Homo sapien
gtagtcatggacctggtaggtctct

SEQ ID NO: 427481 - DNA, 25 bp, Homo sapien
aaggtcagagacagatttgatatta

SEQ ID NO: 427482 - DNA, 25 bp, Homo sapien
aggtcagagacagatttgatattaa

SEQ ID NO: 427483 - DNA, 25 bp, Homo sapien
ggtcagagacagatttgatattaaa

SEQ ID NO: 427484 - DNA, 25 bp, Homo sapien
gtcagagacagatttgatattaaaa

SEQ ID NO: 427485 - DNA, 25 bp, Homo sapien
tcagagacagatttgatattaaaaa

SEQ ID NO: 427486 - DNA, 25 bp, Homo sapien
cagagacagatttgatattaaaaaa

SEQ ID NO: 427487 - DNA, 25 bp, Homo sapien
atgtataatgaaacaaggtcagaga

SEQ ID NO: 427488 - DNA, 25 bp, Homo sapien
tgtataatgaaacaaggtcagagac

SEQ ID NO: 427489 - DNA, 25 bp, Homo sapien
gtataatgaaacaaggtcagagaca

SEQ ID NO: 427490 - DNA, 25 bp, Homo sapien
tataatgaaacaaggtcagagacag

SEQ ID NO: 427491 - DNA, 25 bp, Homo sapien
tgcggatggaactcagatgctgtga

SEQ ID NO: 427492 - DNA, 25 bp, Homo sapien
gatgctgtgatcacctccgtaaggt

SEQ ID NO: 427493 - DNA, 25 bp, Homo sapien
gtaaggtcctccatgttggccggct

SEQ ID NO: 427494 - DNA, 25 bp, Homo sapien
atgttggccggcttgatgtccacga

SEQ ID NO: 427495 - DNA, 25 bp, Homo sapien
gatgtccacgatgttgaagctcctg

SEQ ID NO: 427496 - DNA, 25 bp, Homo sapien
ttgaagctcctgtcggtgatggcca

SEQ ID NO: 427497 - DNA, 25 bp, Homo sapien
tgccagaggttgatgcgcaggtcat

SEQ ID NO: 427498 - DNA, 25 bp, Homo sapien
aggtcatccgccgacatgtaggtct

SEQ ID NO: 427499 - DNA, 25 bp, Homo sapien
atgtaggtctcgcagtcactgttga

SEQ ID NO: 427500 - DNA, 25 bp, Homo sapien
gtggccatagtcaaatatcctccga

SEQ ID NO: 427501 - DNA, 25 bp, Homo sapien
tccaccatcatatccatgggcttca

SEQ ID NO: 427502 - DNA, 25 bp, Homo sapien
atgacatgtttatgaccctccaaat

SEQ ID NO: 427503 - DNA, 25 bp, Homo sapien
gtttatgaccctccaaatgtaccaa

SEQ ID NO: 427504 - DNA, 25 bp, Homo sapien
aaactacctaactaattcactgaga

SEQ ID NO: 427505 - DNA, 25 bp, Homo sapien
ctaattcactgagaggaagccaact

SEQ ID NO: 427506 - DNA, 25 bp, Homo sapien
agccaactgcaaaaataggattttt

SEQ ID NO: 427507 - DNA, 25 bp, Homo sapien
ttatggatttcagacaaagaaacct

SEQ ID NO: 427508 - DNA, 25 bp, Homo sapien
gaaacctccgtttattatatcctga

SEQ ID NO: 427509 - DNA, 25 bp, Homo sapien
acctccgtttattatatcctgatgg

SEQ ID NO: 427510 - DNA, 25 bp, Homo sapien
ccgtttattatatcctgatggtgag

SEQ ID NO: 427511 - DNA, 25 bp, Homo sapien
taaaatctatcattgctaccaccct

SEQ ID NO: 427512 - DNA, 25 bp, Homo sapien
aaaatctatcattgctaccaccctg

SEQ ID NO: 427513 - DNA, 25 bp, Homo sapien
gcaaatataaacgattcctatagac

SEQ ID NO: 427514 - DNA, 25 bp, Homo sapien
aatataaacgattcctatagacttt

SEQ ID NO: 427515 - DNA, 25 bp, Homo sapien
ataaacgattcctatagacttttgt

SEQ ID NO: 427516 - DNA, 25 bp, Homo sapien
taaacgattcctatagacttttgta

SEQ ID NO: 427517 - DNA, 25 bp, Homo sapien
aaacgattcctatagacttttgtat

SEQ ID NO: 427518 - DNA, 25 bp, Homo sapien
aacgattcctatagacttttgtatt

SEQ ID NO: 427519 - DNA, 25 bp, Homo sapien
acgattcctatagacttttgtattt

SEQ ID NO: 427520 - DNA, 25 bp, Homo sapien
cgattcctatagacttttgtatttt

SEQ ID NO: 427521 - DNA, 25 bp, Homo sapien
agaaaaaagtagcagcactttggga

SEQ ID NO: 427522 - DNA, 25 bp, Homo sapien
tggccaacatgtccaaacccctcct

SEQ ID NO: 427523 - DNA, 25 bp, Homo sapien
aacatgtccaaacccctcctgtact

SEQ ID NO: 427524 - DNA, 25 bp, Homo sapien
tgtaaggagctgactgggattcagt

SEQ ID NO: 427525 - DNA, 25 bp, Homo sapien
ttcagtcactgacttggagccgctc

SEQ ID NO: 427526 - DNA, 25 bp, Homo sapien
agtcactgacttggagccgctcggg

SEQ ID NO: 427527 - DNA, 25 bp, Homo sapien
ggtgggtgaggttccgcggcgcctg

SEQ ID NO: 427528 - DNA, 25 bp, Homo sapien
gttccgcggcgcctggtccagtttc

SEQ ID NO: 427529 - DNA, 25 bp, Homo sapien
tggtccagtttctcggcagtcaggc

SEQ ID NO: 427530 - DNA, 25 bp, Homo sapien
ttcctcacaatttggtttgtgctgc

SEQ ID NO: 427531 - DNA, 25 bp, Homo sapien
cacaatttggtttgtgctgcaaggg

SEQ ID NO: 427532 - DNA, 25 bp, Homo sapien
catctggccccagtggtgtaaggag

SEQ ID NO: 427533 - DNA, 25 bp, Homo sapien
tctggccccagtggtgtaaggagct

SEQ ID NO: 427534 - DNA, 25 bp, Homo sapien
gccccagtggtgtaaggagctgact

SEQ ID NO: 427535 - DNA, 25 bp, Homo sapien
aggaaaggcacagaaatcatctgga

SEQ ID NO: 427536 - DNA, 25 bp, Homo sapien
ggaaaggcacagaaatcatctggag

SEQ ID NO: 427537 - DNA, 25 bp, Homo sapien
gaaaggcacagaaatcatctggagt

SEQ ID NO: 427538 - DNA, 25 bp, Homo sapien
aaaggcacagaaatcatctggagtt

SEQ ID NO: 427539 - DNA, 25 bp, Homo sapien
aaggcacagaaatcatctggagttg

SEQ ID NO: 427540 - DNA, 25 bp, Homo sapien
aggcacagaaatcatctggagttgc

SEQ ID NO: 427541 - DNA, 25 bp, Homo sapien
ggcacagaaatcatctggagttgcc

SEQ ID NO: 427542 - DNA, 25 bp, Homo sapien
gcacagaaatcatctggagttgcca

SEQ ID NO: 427543 - DNA, 25 bp, Homo sapien
gaaatcatctggagttgccactcct

SEQ ID NO: 427544 - DNA, 25 bp, Homo sapien
aaatcatctggagttgccactcctg

SEQ ID NO: 427545 - DNA, 25 bp, Homo sapien
agcagaatcacatcaccgagcatga

SEQ ID NO: 427546 - DNA, 25 bp, Homo sapien
aatcacatcaccgagcatgaagact

SEQ ID NO: 427547 - DNA, 25 bp, Homo sapien
atccttcgaaaaacatccacagcag

SEQ ID NO: 427548 - DNA, 25 bp, Homo sapien
aaagctttcccttcttcataactga

SEQ ID NO: 427549 - DNA, 25 bp, Homo sapien
tttcccttcttcataactgatcacc

SEQ ID NO: 427550 - DNA, 25 bp, Homo sapien
taactgatcaccctttccatatgca

SEQ ID NO: 427551 - DNA, 25 bp, Homo sapien
atcaccctttccatatgcaggtctt

SEQ ID NO: 427552 - DNA, 25 bp, Homo sapien
atatgcaggtctttcttattcccaa

SEQ ID NO: 427553 - DNA, 25 bp, Homo sapien
gtctttcttattcccaaccaacata

SEQ ID NO: 427554 - DNA, 25 bp, Homo sapien
taggtatttgtactttccccaccat

SEQ ID NO: 427555 - DNA, 25 bp, Homo sapien
gccatggataactttaatcacttca

SEQ ID NO: 427556 - DNA, 25 bp, Homo sapien
ggcagttagcctttacttaatatca

SEQ ID NO: 427557 - DNA, 25 bp, Homo sapien
aaaatattggcatcgatgaaaccga

SEQ ID NO: 427558 - DNA, 25 bp, Homo sapien
gaaaccgataacattggcctcattg

SEQ ID NO: 427559 - DNA, 25 bp, Homo sapien
ttggcctcattggatttctttaccc

SEQ ID NO: 427560 - DNA, 25 bp, Homo sapien
gatttctttacccattcacagtgta

SEQ ID NO: 427561 - DNA, 25 bp, Homo sapien
gaagttaccttcatgctttcattgt

SEQ ID NO: 427562 - DNA, 25 bp, Homo sapien
tcatgctttcattgtacctgcaggc

SEQ ID NO: 427563 - DNA, 25 bp, Homo sapien
tacctgcaggcctgtgggcttgtac

SEQ ID NO: 427564 - DNA, 25 bp, Homo sapien
aggcctgtgggcttgtacagtagat

SEQ ID NO: 427565 - DNA, 25 bp, Homo sapien
gctgcctattttcttcctaggttag

SEQ ID NO: 427566 - DNA, 25 bp, Homo sapien
tcctaggttaggttatatcttcata

SEQ ID NO: 427567 - DNA, 25 bp, Homo sapien
acaagagactttagattgatctgca

SEQ ID NO: 427568 - DNA, 25 bp, Homo sapien
gagactttagattgatctgcatgaa

SEQ ID NO: 427569 - DNA, 25 bp, Homo sapien
gaagatcacagttaagtatacagga

SEQ ID NO: 427570 - DNA, 25 bp, Homo sapien
atcacagttaagtatacaggagtag

SEQ ID NO: 427571 - DNA, 25 bp, Homo sapien
acaggagtagaactgcattattgca

SEQ ID NO: 427572 - DNA, 25 bp, Homo sapien
tagaactgcattattgcagcctttt

SEQ ID NO: 427573 - DNA, 25 bp, Homo sapien
aagtgaatcatttagttgactctat

SEQ ID NO: 427574 - DNA, 25 bp, Homo sapien
tagttgactctataattctaaggtc

SEQ ID NO: 427575 - DNA, 25 bp, Homo sapien
actctataattctaaggtcaaaatg

SEQ ID NO: 427576 - DNA, 25 bp, Homo sapien
aaaaatgtatacacctaacatagaa

SEQ ID NO: 427577 - DNA, 25 bp, Homo sapien
agatagctgcagaccattagaaaaa

SEQ ID NO: 427578 - DNA, 25 bp, Homo sapien
gagacttgctgattttctggttgga

SEQ ID NO: 427579 - DNA, 25 bp, Homo sapien
gctgattttctggttggagtgtttt

SEQ ID NO: 427580 - DNA, 25 bp, Homo sapien
tttttgtattgccatagtcccttcc

SEQ ID NO: 427581 - DNA, 25 bp, Homo sapien
gcaatacgcctttccaatctttatt

SEQ ID NO: 427582 - DNA, 25 bp, Homo sapien
cctgcctacttcctaatttattctt

SEQ ID NO: 427583 - DNA, 25 bp, Homo sapien
acagagggtatggaagacttgcaat

SEQ ID NO: 427584 - DNA, 25 bp, Homo sapien
gggaccagttccaaagtcagtaatt

SEQ ID NO: 427585 - DNA, 25 bp, Homo sapien
cagtaattgtgttaaccacgtgtat

SEQ ID NO: 427586 - DNA, 25 bp, Homo sapien
aaccacgtgtataacagctctgctg

SEQ ID NO: 427587 - DNA, 25 bp, Homo sapien
gctctgctggacacccaagaaagcc

SEQ ID NO: 427588 - DNA, 25 bp, Homo sapien
aaagccatgggaacgccaactggaa

SEQ ID NO: 427589 - DNA, 25 bp, Homo sapien
ttgtgccaaaaaaatctgacagttt

SEQ ID NO: 427590 - DNA, 25 bp, Homo sapien
tttcttctatctcttacaaagtttt

SEQ ID NO: 427591 - DNA, 25 bp, Homo sapien
aataatacattcatttactccaggg

SEQ ID NO: 427592 - DNA, 25 bp, Homo sapien
tacattcatttactccagggatcag

SEQ ID NO: 427593 - DNA, 25 bp, Homo sapien
ttcatttactccagggatcagcaaa

SEQ ID NO: 427594 - DNA, 25 bp, Homo sapien
ggatcagcaaactttatctgtaagg

SEQ ID NO: 427595 - DNA, 25 bp, Homo sapien
gcaaactttatctgtaagggaccag

SEQ ID NO: 427596 - DNA, 25 bp, Homo sapien
gctctggtggagcaaaagcacccac

SEQ ID NO: 427597 - DNA, 25 bp, Homo sapien
ggagcaaaagcacccacataatatg

SEQ ID NO: 427598 - DNA, 25 bp, Homo sapien
gcaaaagcacccacataatatgtaa

SEQ ID NO: 427599 - DNA, 25 bp, Homo sapien
gaatgtggcaatgttcaaataaaac

SEQ ID NO: 427600 - DNA, 25 bp, Homo sapien
tttctccagaaaacaactgcgtgag

SEQ ID NO: 427601 - DNA, 25 bp, Homo sapien
gaaaaattttaagctgactcaaggg

SEQ ID NO: 427602 - DNA, 25 bp, Homo sapien
ggaaaatgtttagtatctgcctgat

SEQ ID NO: 427603 - DNA, 25 bp, Homo sapien
tatctgcctgatacacacgaaagtg

SEQ ID NO: 427604 - DNA, 25 bp, Homo sapien
aagtgcatatgacatttccagtttc

SEQ ID NO: 427605 - DNA, 25 bp, Homo sapien
acatttccagtttcaagcttggtaa

SEQ ID NO: 427606 - DNA, 25 bp, Homo sapien
caagcttggtaatcattatgcaaac

SEQ ID NO: 427607 - DNA, 25 bp, Homo sapien
atgcaaactgcactatactattagg

SEQ ID NO: 427608 - DNA, 25 bp, Homo sapien
tactattaggatactggctaacagt

SEQ ID NO: 427609 - DNA, 25 bp, Homo sapien
gttttcttataaggcagactgtgct

SEQ ID NO: 427610 - DNA, 25 bp, Homo sapien
ctgtgctgagttctgatgatacgct

SEQ ID NO: 427611 - DNA, 25 bp, Homo sapien
atgtatgttcacaacagtctgacaa

SEQ ID NO: 427612 - DNA, 25 bp, Homo sapien
attagtgttcgatatttagctgata

SEQ ID NO: 427613 - DNA, 25 bp, Homo sapien
tatgcagttatcttctgtgaataca

SEQ ID NO: 427614 - DNA, 25 bp, Homo sapien
caaaattggcacttgctgcttgggt

SEQ ID NO: 427615 - DNA, 25 bp, Homo sapien
ttgctgcttgggtatgtggccttaa

SEQ ID NO: 427616 - DNA, 25 bp, Homo sapien
tgtggccttaattcggcagtgccag

SEQ ID NO: 427617 - DNA, 25 bp, Homo sapien
tgccagcacccacaaagctattgac

SEQ ID NO: 427618 - DNA, 25 bp, Homo sapien
tgactgttgggatctttgtccgtaa

SEQ ID NO: 427619 - DNA, 25 bp, Homo sapien
ttgtccgtaattagcattagctgcc

SEQ ID NO: 427620 - DNA, 25 bp, Homo sapien
tctaattcattgatcgtgactcaaa

SEQ ID NO: 427621 - DNA, 25 bp, Homo sapien
gattcaaaactgtttactagtcaga

SEQ ID NO: 427622 - DNA, 25 bp, Homo sapien
atgttacttgtacataagtagcagc

SEQ ID NO: 427623 - DNA, 25 bp, Homo sapien
gtacataagtagcagcacaatacgt

SEQ ID NO: 427624 - DNA, 25 bp, Homo sapien
ataagtagcagcacaatacgtacat

SEQ ID NO: 427625 - DNA, 25 bp, Homo sapien
aagtagcagcacaatacgtacatat

SEQ ID NO: 427626 - DNA, 25 bp, Homo sapien
gtagcagcacaatacgtacatataa

SEQ ID NO: 427627 - DNA, 25 bp, Homo sapien
gcagcacaatacgtacatataaacc

SEQ ID NO: 427628 - DNA, 25 bp, Homo sapien
gcacaatacgtacatataaacccta

SEQ ID NO: 427629 - DNA, 25 bp, Homo sapien
atacgtacatataaaccctatgagt

SEQ ID NO: 427630 - DNA, 25 bp, Homo sapien
cgtacatataaaccctatgagtata

SEQ ID NO: 427631 - DNA, 25 bp, Homo sapien
aattatgtctgttctgtttgatcac

SEQ ID NO: 427632 - DNA, 25 bp, Homo sapien
atgagactcgtggtgtggaattaca

SEQ ID NO: 427633 - DNA, 25 bp, Homo sapien
gagagagactcgtgacttttccggt

SEQ ID NO: 427634 - DNA, 25 bp, Homo sapien
gactcgtgacttttccggtttcaga

SEQ ID NO: 427635 - DNA, 25 bp, Homo sapien
tcagaaaaacccaatgattaccctt

SEQ ID NO: 427636 - DNA, 25 bp, Homo sapien
gattacccttaattaaaactgcttg

SEQ ID NO: 427637 - DNA, 25 bp, Homo sapien
aagacaagggaaatgtagacttcat

SEQ ID NO: 427638 - DNA, 25 bp, Homo sapien
gtagacttcataaacatggctgtat

SEQ ID NO: 427639 - DNA, 25 bp, Homo sapien
ttttgacgacaaaaggtatgtactt

SEQ ID NO: 427640 - DNA, 25 bp, Homo sapien
gttaacgttattagcatatctttgt

SEQ ID NO: 427641 - DNA, 25 bp, Homo sapien
atctttgtgctttattatcctggtg

SEQ ID NO: 427642 - DNA, 25 bp, Homo sapien
gtgctttattatcctggtgacagtt

SEQ ID NO: 427643 - DNA, 25 bp, Homo sapien
gtgacagttaccgttctatgtaggc

SEQ ID NO: 427644 - DNA, 25 bp, Homo sapien
gggactgtgtacaatgagttatgga

SEQ ID NO: 427645 - DNA, 25 bp, Homo sapien
ttatggagactcgagggttcatgca

SEQ ID NO: 427646 - DNA, 25 bp, Homo sapien
tcgagggttcatgcagtcagtgtta

SEQ ID NO: 427647 - DNA, 25 bp, Homo sapien
gtcagtgttataccaaacccagtgt

SEQ ID NO: 427648 - DNA, 25 bp, Homo sapien
taccaaacccagtgttaggagaaag

SEQ ID NO: 427649 - DNA, 25 bp, Homo sapien
agaaaggacacagcgtaatggagaa

SEQ ID NO: 427650 - DNA, 25 bp, Homo sapien
aaaaatgcgcatctctttctttgtt

SEQ ID NO: 427651 - DNA, 25 bp, Homo sapien
gagaaacattcaggacctcatcatt

SEQ ID NO: 427652 - DNA, 25 bp, Homo sapien
attcaggacctcatcattatgtggg

SEQ ID NO: 427653 - DNA, 25 bp, Homo sapien
ctttgttctccacagggtcaggtaa

SEQ ID NO: 427654 - DNA, 25 bp, Homo sapien
cacaatcagaaatcacgcaggcatt

SEQ ID NO: 427655 - DNA, 25 bp, Homo sapien
ttatctttggacacagaggacctgc

SEQ ID NO: 427656 - DNA, 25 bp, Homo sapien
acacagaggacctgcacaccagaga

SEQ ID NO: 427657 - DNA, 25 bp, Homo sapien
gcacaccagagacagaggtccgcat

SEQ ID NO: 427658 - DNA, 25 bp, Homo sapien
gacagaggtccgcattaagtaaagt

SEQ ID NO: 427659 - DNA, 25 bp, Homo sapien
gtaaagtggatttcactttcttcag

SEQ ID NO: 427660 - DNA, 25 bp, Homo sapien
ctttcttcagttgtgagatttctct

SEQ ID NO: 427661 - DNA, 25 bp, Homo sapien
aaagatatatcttccaccaagcctc

SEQ ID NO: 427662 - DNA, 25 bp, Homo sapien
cttccaccaagcctcatttaaaagc

SEQ ID NO: 427663 - DNA, 25 bp, Homo sapien
aaggaaactatctcttggccatcca

SEQ ID NO: 427664 - DNA, 25 bp, Homo sapien
acagccagactgcatattgagatta

SEQ ID NO: 427665 - DNA, 25 bp, Homo sapien
gtctttcctttgtatattgtcataa

SEQ ID NO: 427666 - DNA, 25 bp, Homo sapien
gcagtcagccagtgggtctgacaaa

SEQ ID NO: 427667 - DNA, 25 bp, Homo sapien
catgcttccgcagaggtgatgaggt

SEQ ID NO: 427668 - DNA, 25 bp, Homo sapien
tgcactcgccatgcattcaatggtg

SEQ ID NO: 427669 - DNA, 25 bp, Homo sapien
atgcattcaatggtgccccatctct

SEQ ID NO: 427670 - DNA, 25 bp, Homo sapien
ctcttgttctctaggaagcattccc

SEQ ID NO: 427671 - DNA, 25 bp, Homo sapien
aagcattcccgctacctgtgtgatg

SEQ ID NO: 427672 - DNA, 25 bp, Homo sapien
tgtgtgatgcagttggttccaccta

SEQ ID NO: 427673 - DNA, 25 bp, Homo sapien
agttggttccacctattcccagaga

SEQ ID NO: 427674 - DNA, 25 bp, Homo sapien
gtgggacagttgtcattgcccagcc

SEQ ID NO: 427675 - DNA, 25 bp, Homo sapien
attgcccagcctgtgagttgaagtc

SEQ ID NO: 427676 - DNA, 25 bp, Homo sapien
gttgaagtctgtgcagtcagccagt

SEQ ID NO: 427677 - DNA, 25 bp, Homo sapien
tggagctgcttttatccttggaaga

SEQ ID NO: 427678 - DNA, 25 bp, Homo sapien
tatccttggaagagtattcccagtt

SEQ ID NO: 427679 - DNA, 25 bp, Homo sapien
aagagtattcccagttgaagctgaa

SEQ ID NO: 427680 - DNA, 25 bp, Homo sapien
tacagcacagtgcagctttggttca

SEQ ID NO: 427681 - DNA, 25 bp, Homo sapien
gtgcagctttggttcatattcagtc

SEQ ID NO: 427682 - DNA, 25 bp, Homo sapien
ggttcatattcagtcatctcaggag

SEQ ID NO: 427683 - DNA, 25 bp, Homo sapien
attcagtcatctcaggagaacttca

SEQ ID NO: 427684 - DNA, 25 bp, Homo sapien
gaagagcttgagtaggccaaatgtt

SEQ ID NO: 427685 - DNA, 25 bp, Homo sapien
gttttccaataatgtgacttcttaa

SEQ ID NO: 427686 - DNA, 25 bp, Homo sapien
atattggcaattagttggcagtggc

SEQ ID NO: 427687 - DNA, 25 bp, Homo sapien
ttagttggcagtggcctgttacggt

SEQ ID NO: 427688 - DNA, 25 bp, Homo sapien
ggcaaccgtcaagctattctctgtc

SEQ ID NO: 427689 - DNA, 25 bp, Homo sapien
tattctctgtccctataccaggtgt

SEQ ID NO: 427690 - DNA, 25 bp, Homo sapien
gtccctataccaggtgtcatcaaat

SEQ ID NO: 427691 - DNA, 25 bp, Homo sapien
ttttttctggaaaggcccatgcagt

SEQ ID NO: 427692 - DNA, 25 bp, Homo sapien
aggcccatgcagtaaatagttcaag

SEQ ID NO: 427693 - DNA, 25 bp, Homo sapien
gctttgtgggcttttatagtctctg

SEQ ID NO: 427694 - DNA, 25 bp, Homo sapien
tttatagtctctgttgctgctgctg

SEQ ID NO: 427695 - DNA, 25 bp, Homo sapien
gctgaactcagctgttgtagcacga

SEQ ID NO: 427696 - DNA, 25 bp, Homo sapien
gtagcacgaaagcagccaggtaatt

SEQ ID NO: 427697 - DNA, 25 bp, Homo sapien
gtttcaatagagctttatttctgca

SEQ ID NO: 427698 - DNA, 25 bp, Homo sapien
atactgttttctccaaccatttaat

SEQ ID NO: 427699 - DNA, 25 bp, Homo sapien
tctctcttcctgacacattccaaaa

SEQ ID NO: 427700 - DNA, 25 bp, Homo sapien
tctaggacatttaagaacgcccatg

SEQ ID NO: 427701 - DNA, 25 bp, Homo sapien
gcaactctatgcttgacaggccatg

SEQ ID NO: 427702 - DNA, 25 bp, Homo sapien
ctatgcttgacaggccatgcacaat

SEQ ID NO: 427703 - DNA, 25 bp, Homo sapien
gcttgacaggccatgcacaataaaa

SEQ ID NO: 427704 - DNA, 25 bp, Homo sapien
caggccatgcacaataaaactcttt

SEQ ID NO: 427705 - DNA, 25 bp, Homo sapien
gcacaataaaactctttggcctgta

SEQ ID NO: 427706 - DNA, 25 bp, Homo sapien
aaactctttggcctgtaagcgagaa

SEQ ID NO: 427707 - DNA, 25 bp, Homo sapien
ctttggcctgtaagcgagaagaaaa

SEQ ID NO: 427708 - DNA, 25 bp, Homo sapien
ctgcctcatgggttgccaaaatgat

SEQ ID NO: 427709 - DNA, 25 bp, Homo sapien
tgggttgccaaaatgatgtggaaac

SEQ ID NO: 427710 - DNA, 25 bp, Homo sapien
caatggtcaaattcagagctctggt

SEQ ID NO: 427711 - DNA, 25 bp, Homo sapien
gagctctggttctgatgatgtaaaa

SEQ ID NO: 427712 - DNA, 25 bp, Homo sapien
gaggttaggccctctgaggcaaaga

SEQ ID NO: 427713 - DNA, 25 bp, Homo sapien
agtcaagcaatgtctctgaggctct

SEQ ID NO: 427714 - DNA, 25 bp, Homo sapien
tctgaggctctcgtgctatacaaag

SEQ ID NO: 427715 - DNA, 25 bp, Homo sapien
agagctagggctttgaactcaaaca

SEQ ID NO: 427716 - DNA, 25 bp, Homo sapien
aaacagactagggtcatgtcagatt

SEQ ID NO: 427717 - DNA, 25 bp, Homo sapien
taccagttactagctctgcagtcat

SEQ ID NO: 427718 - DNA, 25 bp, Homo sapien
atagtgcctacattctcaggctagc

SEQ ID NO: 427719 - DNA, 25 bp, Homo sapien
gctagccctcaaaagcctattaaac

SEQ ID NO: 427720 - DNA, 25 bp, Homo sapien
tgaggaaacactgggcaatggtcaa

SEQ ID NO: 427721 - DNA, 25 bp, Homo sapien
tgcttccctcgaacccagagatttt

SEQ ID NO: 427722 - DNA, 25 bp, Homo sapien
tccctcgaacccagagatttttgag

SEQ ID NO: 427723 - DNA, 25 bp, Homo sapien
tttttgagggatgaacgggtagaca

SEQ ID NO: 427724 - DNA, 25 bp, Homo sapien
gaacgggtagacaaggactgagatt

SEQ ID NO: 427725 - DNA, 25 bp, Homo sapien
aaggactgagattgcctctgacttc

SEQ ID NO: 427726 - DNA, 25 bp, Homo sapien
gactgagattgcctctgacttcctc

SEQ ID NO: 427727 - DNA, 25 bp, Homo sapien
ctccccttgcttccagggaagatga

SEQ ID NO: 427728 - DNA, 25 bp, Homo sapien
ggctctggctccctaacacctgaat

SEQ ID NO: 427729 - DNA, 25 bp, Homo sapien
ctaacacctgaatcccagatgatgg

SEQ ID NO: 427730 - DNA, 25 bp, Homo sapien
gatgggaagtatgttttcaagtgtg

SEQ ID NO: 427731 - DNA, 25 bp, Homo sapien
tggctttatgtccattttaccactg

SEQ ID NO: 427732 - DNA, 25 bp, Homo sapien
tggtgagtctcatatgccatattat

SEQ ID NO: 427733 - DNA, 25 bp, Homo sapien
agttaatttcctgttgcctttctgt

SEQ ID NO: 427734 - DNA, 25 bp, Homo sapien
gcctttctgtgtcagccacaatatc

SEQ ID NO: 427735 - DNA, 25 bp, Homo sapien
tgtgtcagccacaatatcaggtcta

SEQ ID NO: 427736 - DNA, 25 bp, Homo sapien
atatcaggtctaaccctaatccagg

SEQ ID NO: 427737 - DNA, 25 bp, Homo sapien
ctaatccagggatgccagtaaactg

SEQ ID NO: 427738 - DNA, 25 bp, Homo sapien
gccagtaaactgaaggcaattttag

SEQ ID NO: 427739 - DNA, 25 bp, Homo sapien
ggatattccagcaaagtctctaact

SEQ ID NO: 427740 - DNA, 25 bp, Homo sapien
ttccagcaaagtctctaactgcagc

SEQ ID NO: 427741 - DNA, 25 bp, Homo sapien
aactgcagcctgtagacaatttgct

SEQ ID NO: 427742 - DNA, 25 bp, Homo sapien
gcagcctgtagacaatttgctatta

SEQ ID NO: 427743 - DNA, 25 bp, Homo sapien
cttcacacacacatgtgtgcgtgca

SEQ ID NO: 427744 - DNA, 25 bp, Homo sapien
tgtgcgtgcacgtgcatttcattac

SEQ ID NO: 427745 - DNA, 25 bp, Homo sapien
gtgcacgtgcatttcattaccatgt

SEQ ID NO: 427746 - DNA, 25 bp, Homo sapien
gtgcatttcattaccatgtagacaa

SEQ ID NO: 427747 - DNA, 25 bp, Homo sapien
cattaccatgtagacaagacagtta

SEQ ID NO: 427748 - DNA, 25 bp, Homo sapien
tgaagaattgcactatttgataatg

SEQ ID NO: 427749 - DNA, 25 bp, Homo sapien
atttgataatgctgctactacatga

SEQ ID NO: 427750 - DNA, 25 bp, Homo sapien
gctgctactacatgagataactctg

SEQ ID NO: 427751 - DNA, 25 bp, Homo sapien
gatgaatggctttctagaagcgtgt

SEQ ID NO: 427752 - DNA, 25 bp, Homo sapien
ggctttctagaagcgtgttgctttt

SEQ ID NO: 427753 - DNA, 25 bp, Homo sapien
tctagaagcgtgttgctttttgttt

SEQ ID NO: 427754 - DNA, 25 bp, Homo sapien
aaaatgcagatcttgccacattaga

SEQ ID NO: 427755 - DNA, 25 bp, Homo sapien
gatcttgccacattagaaagcattc

SEQ ID NO: 427756 - DNA, 25 bp, Homo sapien
aagcattcaatgtcagtcctgtttt

SEQ ID NO: 427757 - DNA, 25 bp, Homo sapien
cctgttttaatggaatatctgacta

SEQ ID NO: 427758 - DNA, 25 bp, Homo sapien
aatatctgactattcaatggtaaat

SEQ ID NO: 427759 - DNA, 25 bp, Homo sapien
gaccgtaaagagtatgagcgcgcca

SEQ ID NO: 427760 - DNA, 25 bp, Homo sapien
gtatgagcgcgccattcatcatcag

SEQ ID NO: 427761 - DNA, 25 bp, Homo sapien
gagcgcgccattcatcatcagacag

SEQ ID NO: 427762 - DNA, 25 bp, Homo sapien
tcatcatcagacagcccacactggt

SEQ ID NO: 427763 - DNA, 25 bp, Homo sapien
tagtcttataggtatggctttagca

SEQ ID NO: 427764 - DNA, 25 bp, Homo sapien
atggctttagcaattgagagagttc

SEQ ID NO: 427765 - DNA, 25 bp, Homo sapien
gatcagaaggaatccgccgaggcag

SEQ ID NO: 427766 - DNA, 25 bp, Homo sapien
atgggtgtgcccatgtgtgccttga

SEQ ID NO: 427767 - DNA, 25 bp, Homo sapien
tgtgcccatgtgtgccttgacggga

SEQ ID NO: 427768 - DNA, 25 bp, Homo sapien
atgtgtgccttgacgggacttcatc

SEQ ID NO: 427769 - DNA, 25 bp, Homo sapien
tgccttgacgggacttcatcttata

SEQ ID NO: 427770 - DNA, 25 bp, Homo sapien
gacgggacttcatcttatagactgt

SEQ ID NO: 427771 - DNA, 25 bp, Homo sapien
gggacttcatcttatagactgttaa

SEQ ID NO: 427772 - DNA, 25 bp, Homo sapien
agactgttaaactgtcacacacaaa

SEQ ID NO: 427773 - DNA, 25 bp, Homo sapien
tgctctgagagcaccacgcacagat

SEQ ID NO: 427774 - DNA, 25 bp, Homo sapien
agagcaccacgcacagatttccagt

SEQ ID NO: 427775 - DNA, 25 bp, Homo sapien
accacgcacagatttccagttctta

SEQ ID NO: 427776 - DNA, 25 bp, Homo sapien
gaagccaagggtctctataaatcag

SEQ ID NO: 427777 - DNA, 25 bp, Homo sapien
ataaatcagccctgaatgcacccat

SEQ ID NO: 427778 - DNA, 25 bp, Homo sapien
ctgaatgcacccatttggctgccaa

SEQ ID NO: 427779 - DNA, 25 bp, Homo sapien
tttggctgccaagagcttctcactg

SEQ ID NO: 427780 - DNA, 25 bp, Homo sapien
agagcttctcactgccttgctagca

SEQ ID NO: 427781 - DNA, 25 bp, Homo sapien
gccactgttccctggcaaattgaaa

SEQ ID NO: 427782 - DNA, 25 bp, Homo sapien
ggcaaattgaaaccacccacgcaaa

SEQ ID NO: 427783 - DNA, 25 bp, Homo sapien
gctcatagtgtcaacatctcctcta

SEQ ID NO: 427784 - DNA, 25 bp, Homo sapien
ccagcccaaggaccagtagcagaag

SEQ ID NO: 427785 - DNA, 25 bp, Homo sapien
gcagaagcacatgggcgatgtctcc

SEQ ID NO: 427786 - DNA, 25 bp, Homo sapien
cacccctctggcagaaaatctaaca

SEQ ID NO: 427787 - DNA, 25 bp, Homo sapien
ggcctgatccagaatggagactgga

SEQ ID NO: 427788 - DNA, 25 bp, Homo sapien
atccagaatggagactggaccttcc

SEQ ID NO: 427789 - DNA, 25 bp, Homo sapien
gagtggagaggtttacacctgccaa

SEQ ID NO: 427790 - DNA, 25 bp, Homo sapien
agtggagaggtttacacctgccaag

SEQ ID NO: 427791 - DNA, 25 bp, Homo sapien
gtggagaggtttacacctgccaagt

SEQ ID NO: 427792 - DNA, 25 bp, Homo sapien
tggagaggtttacacctgccaagtg

SEQ ID NO: 427793 - DNA, 25 bp, Homo sapien
acgagccctctcacagtggaatgga

SEQ ID NO: 427794 - DNA, 25 bp, Homo sapien
cgagccctctcacagtggaatggag

SEQ ID NO: 427795 - DNA, 25 bp, Homo sapien
gcacggtctgaatctgcacagagca

SEQ ID NO: 427796 - DNA, 25 bp, Homo sapien
agatgctgagtggagtcgggggctt

SEQ ID NO: 427797 - DNA, 25 bp, Homo sapien
ttggggccgggctgttcatctactt

SEQ ID NO: 427798 - DNA, 25 bp, Homo sapien
cgagtggccggctgcaaccacggct

SEQ ID NO: 427799 - DNA, 25 bp, Homo sapien
tcctctccagggtaggccagcttga

SEQ ID NO: 427800 - DNA, 25 bp, Homo sapien
gccagcttgaggaatcttatttatt

SEQ ID NO: 427801 - DNA, 25 bp, Homo sapien
tacccaaatttgaactagtctgttg

SEQ ID NO: 427802 - DNA, 25 bp, Homo sapien
cagtccctcaccatcggctgcacat

SEQ ID NO: 427803 - DNA, 25 bp, Homo sapien
atcggctgcacatcgcgccctcggg

SEQ ID NO: 427804 - DNA, 25 bp, Homo sapien
tccctggtgctactgacctctcaag

SEQ ID NO: 427805 - DNA, 25 bp, Homo sapien
ctggtgctactgacctctcaaggct

SEQ ID NO: 427806 - DNA, 25 bp, Homo sapien
tggtgctactgacctctcaaggctt

SEQ ID NO: 427807 - DNA, 25 bp, Homo sapien
ggtgctactgacctctcaaggcttc

SEQ ID NO: 427808 - DNA, 25 bp, Homo sapien
tgctactgacctctcaaggcttcct

SEQ ID NO: 427809 - DNA, 25 bp, Homo sapien
acacaaaagaggatgtaggagtcat

SEQ ID NO: 427810 - DNA, 25 bp, Homo sapien
gatcttgagcccctctgtggatgtg

SEQ ID NO: 427811 - DNA, 25 bp, Homo sapien
atcttgagcccctctgtggatgtgg

SEQ ID NO: 427812 - DNA, 25 bp, Homo sapien
atgtggacagccacggctgggcctc

SEQ ID NO: 427813 - DNA, 25 bp, Homo sapien
ggctgggcctctccgttgatcttag

SEQ ID NO: 427814 - DNA, 25 bp, Homo sapien
ctgggcctctccgttgatcttaggg

SEQ ID NO: 427815 - DNA, 25 bp, Homo sapien
tccgttgatcttagggggcccgact

SEQ ID NO: 427816 - DNA, 25 bp, Homo sapien
gggcccgacttcaccttctggttct

SEQ ID NO: 427817 - DNA, 25 bp, Homo sapien
ccgacttcaccttctggttctggag

SEQ ID NO: 427818 - DNA, 25 bp, Homo sapien
cgacttcaccttctggttctggaga

SEQ ID NO: 427819 - DNA, 25 bp, Homo sapien
tggttctggagagggcttccttttc

SEQ ID NO: 427820 - DNA, 25 bp, Homo sapien
gtattgcatgcttcctataatttaa

SEQ ID NO: 427821 - DNA, 25 bp, Homo sapien
aactctccataattgatgcctgcag

SEQ ID NO: 427822 - DNA, 25 bp, Homo sapien
cctgcagtagtgtaaggcatttcat

SEQ ID NO: 427823 - DNA, 25 bp, Homo sapien
aggcatttcatactagtctcctcta

SEQ ID NO: 427824 - DNA, 25 bp, Homo sapien
tagtctcctctagtagacctgtgac

SEQ ID NO: 427825 - DNA, 25 bp, Homo sapien
agacctgtgacttactgtgttggac

SEQ ID NO: 427826 - DNA, 25 bp, Homo sapien
ctgtgttggacatattatttagact

SEQ ID NO: 427827 - DNA, 25 bp, Homo sapien
cttagctcttttttcatctcacagt

SEQ ID NO: 427828 - DNA, 25 bp, Homo sapien
agctcttttttcatctcacagtaaa

SEQ ID NO: 427829 - DNA, 25 bp, Homo sapien
tcacagtaaagcctatttccccagg

SEQ ID NO: 427830 - DNA, 25 bp, Homo sapien
gtctattttaatattcacctatgaa

SEQ ID NO: 427831 - DNA, 25 bp, Homo sapien
attcagtacggggatgcgtccctcc

SEQ ID NO: 427832 - DNA, 25 bp, Homo sapien
ctctgagaggccgtgtcctaacctg

SEQ ID NO: 427833 - DNA, 25 bp, Homo sapien
tctgagaggccgtgtcctaacctgc

SEQ ID NO: 427834 - DNA, 25 bp, Homo sapien
tgagaggccgtgtcctaacctgccc

SEQ ID NO: 427835 - DNA, 25 bp, Homo sapien
agaggccgtgtcctaacctgccctg

SEQ ID NO: 427836 - DNA, 25 bp, Homo sapien
gaggccgtgtcctaacctgccctgg

SEQ ID NO: 427837 - DNA, 25 bp, Homo sapien
gggatgcgtccctccgccagcttcg

SEQ ID NO: 427838 - DNA, 25 bp, Homo sapien
agggggaatcccgtacctgctgctg

SEQ ID NO: 427839 - DNA, 25 bp, Homo sapien
gccagcttcggcagcctcggagtgc

SEQ ID NO: 427840 - DNA, 25 bp, Homo sapien
agcttcggcagcctcggagtgccca

SEQ ID NO: 427841 - DNA, 25 bp, Homo sapien
cagccgtgtggctgctgagctctgt

SEQ ID NO: 427842 - DNA, 25 bp, Homo sapien
gggcttttggtattaaagatattct

SEQ ID NO: 427843 - DNA, 25 bp, Homo sapien
tttggaatggagtatatgcctgaaa

SEQ ID NO: 427844 - DNA, 25 bp, Homo sapien
tatgcctgaaaaggttttggattca

SEQ ID NO: 427845 - DNA, 25 bp, Homo sapien
aaggatggttagtttaatcagtgat

SEQ ID NO: 427846 - DNA, 25 bp, Homo sapien
aaactcttcaaatatcatgaacaag

SEQ ID NO: 427847 - DNA, 25 bp, Homo sapien
gatactaaattgtacctaaggattt

SEQ ID NO: 427848 - DNA, 25 bp, Homo sapien
tgtacctaaggatttgtatttcttt

SEQ ID NO: 427849 - DNA, 25 bp, Homo sapien
ctttacaatttgttctaaatatctg

SEQ ID NO: 427850 - DNA, 25 bp, Homo sapien
aaatatctgtttaatgactagttga

SEQ ID NO: 427851 - DNA, 25 bp, Homo sapien
ttaatgactagttgatatttgtgca

SEQ ID NO: 427852 - DNA, 25 bp, Homo sapien
gatatttgtgcatgttatttaataa

SEQ ID NO: 427853 - DNA, 25 bp, Homo sapien
gttttgttagcaatacactgtcttt

SEQ ID NO: 427854 - DNA, 25 bp, Homo sapien
acactgtcttttagtggtgcctaaa

SEQ ID NO: 427855 - DNA, 25 bp, Homo sapien
gtggtgcctaaaataatggtatagt

SEQ ID NO: 427856 - DNA, 25 bp, Homo sapien
gtatagttgtgaggtgatcttagat

SEQ ID NO: 427857 - DNA, 25 bp, Homo sapien
agcacagtatgcaggtaggcctaat

SEQ ID NO: 427858 - DNA, 25 bp, Homo sapien
gaaagctgttctgtggatgacctac

SEQ ID NO: 427859 - DNA, 25 bp, Homo sapien
tgtggatgacctaccctttccttta

SEQ ID NO: 427860 - DNA, 25 bp, Homo sapien
ctttcctttaaacacgattctctca

SEQ ID NO: 427861 - DNA, 25 bp, Homo sapien
ttaaacacgattctctcacttccaa

SEQ ID NO: 427862 - DNA, 25 bp, Homo sapien
ccaactccaaacttgctcaactaat

SEQ ID NO: 427863 - DNA, 25 bp, Homo sapien
acttgctcaactaatccttaaaaat

SEQ ID NO: 427864 - DNA, 25 bp, Homo sapien
tatcgtaagcacgtatggagttcga

SEQ ID NO: 427865 - DNA, 25 bp, Homo sapien
cgtaagcacgtatggagttcgaaaa

SEQ ID NO: 427866 - DNA, 25 bp, Homo sapien
gcacgtatggagttcgaaaagcaat

SEQ ID NO: 427867 - DNA, 25 bp, Homo sapien
acgtatggagttcgaaaagcaatgg

SEQ ID NO: 427868 - DNA, 25 bp, Homo sapien
ttgtggatttgacagaagacactga

SEQ ID NO: 427869 - DNA, 25 bp, Homo sapien
gaacctaaaaagacggatgttgctg

SEQ ID NO: 427870 - DNA, 25 bp, Homo sapien
aaaaagacggatgttgctgagtgtg

SEQ ID NO: 427871 - DNA, 25 bp, Homo sapien
gacggatgttgctgagtgtggacct

SEQ ID NO: 427872 - DNA, 25 bp, Homo sapien
gatgttgctgagtgtggacctggtg

SEQ ID NO: 427873 - DNA, 25 bp, Homo sapien
ttttcattcttaacttagaaatgct

SEQ ID NO: 427874 - DNA, 25 bp, Homo sapien
aacttagaaatgcttttcagaagat

SEQ ID NO: 427875 - DNA, 25 bp, Homo sapien
aatgatgtaaattccccaaggctgg

SEQ ID NO: 427876 - DNA, 25 bp, Homo sapien
taaattccccaaggctggaagaaat

SEQ ID NO: 427877 - DNA, 25 bp, Homo sapien
gcagacagggtcataaataacaaca

SEQ ID NO: 427878 - DNA, 25 bp, Homo sapien
aagtgctgtattttcagagctgaac

SEQ ID NO: 427879 - DNA, 25 bp, Homo sapien
aacaatgaatactgcatatgccaca

SEQ ID NO: 427880 - DNA, 25 bp, Homo sapien
gatgctgtgatagtgacactctttc

SEQ ID NO: 427881 - DNA, 25 bp, Homo sapien
tcagagctgaacaattaacataagg

SEQ ID NO: 427882 - DNA, 25 bp, Homo sapien
aaggagcatgagtcaggctttgaac

SEQ ID NO: 427883 - DNA, 25 bp, Homo sapien
aggctttgaacaactctgtgggaac

SEQ ID NO: 427884 - DNA, 25 bp, Homo sapien
actctgtgggaaccagaaagccttt

SEQ ID NO: 427885 - DNA, 25 bp, Homo sapien
gaaagccttttgctattaggaatga

SEQ ID NO: 427886 - DNA, 25 bp, Homo sapien
cacgctcacaaaggtaaagactttt

SEQ ID NO: 427887 - DNA, 25 bp, Homo sapien
acttttctgtggcttaatccttgtc

SEQ ID NO: 427888 - DNA, 25 bp, Homo sapien
taatccttgtcatgttttcggctca

SEQ ID NO: 427889 - DNA, 25 bp, Homo sapien
gttttcggctcatggacacaaggac

SEQ ID NO: 427890 - DNA, 25 bp, Homo sapien
ggctcatggacacaaggacacattt

SEQ ID NO: 427891 - DNA, 25 bp, Homo sapien
aggacacattttcatgccttctctc

SEQ ID NO: 427892 - DNA, 25 bp, Homo sapien
tacactcccttcacagagacacttg

SEQ ID NO: 427893 - DNA, 25 bp, Homo sapien
aggtctctcgacttctggacctgct

SEQ ID NO: 427894 - DNA, 25 bp, Homo sapien
tctggacctgcttcttaccatgccg

SEQ ID NO: 427895 - DNA, 25 bp, Homo sapien
taccatgccgtcttaagcagtcagg

SEQ ID NO: 427896 - DNA, 25 bp, Homo sapien
ttaagcagtcaggagtcgctgcctg

SEQ ID NO: 427897 - DNA, 25 bp, Homo sapien
aatagtaaacattatctgtcagttt

SEQ ID NO: 427898 - DNA, 25 bp, Homo sapien
tagtttaacatgatggttctggccc

SEQ ID NO: 427899 - DNA, 25 bp, Homo sapien
tggttctggcccatggtatcatgaa

SEQ ID NO: 427900 - DNA, 25 bp, Homo sapien
ggtatcatgaagttacagtcaagat

SEQ ID NO: 427901 - DNA, 25 bp, Homo sapien
gagctggagaaaccacttccaagtt

SEQ ID NO: 427902 - DNA, 25 bp, Homo sapien
agaaaccacttccaagttctctctt

SEQ ID NO: 427903 - DNA, 25 bp, Homo sapien
aagttctctctttgtggccgttggc

SEQ ID NO: 427904 - DNA, 25 bp, Homo sapien
ctttgtggccgttggcaggatgcct

SEQ ID NO: 427905 - DNA, 25 bp, Homo sapien
tcagtttcttcccatgtgggtctct

SEQ ID NO: 427906 - DNA, 25 bp, Homo sapien
cagcatgagtgtcctcacaccatga

SEQ ID NO: 427907 - DNA, 25 bp, Homo sapien
agtgtcctcacaccatgacacctgg

SEQ ID NO: 427908 - DNA, 25 bp, Homo sapien
catgatgtaatctgtgggactagaa

SEQ ID NO: 427909 - DNA, 25 bp, Homo sapien
ttttctcaaggcgaggatggccctg

SEQ ID NO: 427910 - DNA, 25 bp, Homo sapien
ccctgcatgggttgatggcgtctgt

SEQ ID NO: 427911 - DNA, 25 bp, Homo sapien
tgatggcgtctgtgccacctgaact

SEQ ID NO: 427912 - DNA, 25 bp, Homo sapien
acctgcaggcctcatttgcataggt

SEQ ID NO: 427913 - DNA, 25 bp, Homo sapien
aggcctcatttgcataggtggattc

SEQ ID NO: 427914 - DNA, 25 bp, Homo sapien
aggtggattcttggccatctagcac

SEQ ID NO: 427915 - DNA, 25 bp, Homo sapien
gattcttggccatctagcacattaa

SEQ ID NO: 427916 - DNA, 25 bp, Homo sapien
tctagcacattaacagcacgtctgg

SEQ ID NO: 427917 - DNA, 25 bp, Homo sapien
aacagcacgtctgggacctggaaac

SEQ ID NO: 427918 - DNA, 25 bp, Homo sapien
gtcagcaatgacgttctttaagaaa

SEQ ID NO: 427919 - DNA, 25 bp, Homo sapien
ggatctcgatatttcagatgggctt

SEQ ID NO: 427920 - DNA, 25 bp, Homo sapien
agatgggcttttgatgcactgttgc

SEQ ID NO: 427921 - DNA, 25 bp, Homo sapien
gcactgttgccaaggaaggcttttt

SEQ ID NO: 427922 - DNA, 25 bp, Homo sapien
gaatttttgcacactttcattggtg

SEQ ID NO: 427923 - DNA, 25 bp, Homo sapien
actttcattggtgtctttcggcaac

SEQ ID NO: 427924 - DNA, 25 bp, Homo sapien
gtctttcggcaacttacacacattg

SEQ ID NO: 427925 - DNA, 25 bp, Homo sapien
atgcatgtctgattgtacttgtaac

SEQ ID NO: 427926 - DNA, 25 bp, Homo sapien
atgaacggctgtgcagtaggcccag

SEQ ID NO: 427927 - DNA, 25 bp, Homo sapien
agcgctgctgtgtctcgtcagagga

SEQ ID NO: 427928 - DNA, 25 bp, Homo sapien
gaggaatagcttaccacgaacccct

SEQ ID NO: 427929 - DNA, 25 bp, Homo sapien
gaacccctcagcatactgggaatct

SEQ ID NO: 427930 - DNA, 25 bp, Homo sapien
tttacgcctgcgaatctttgaaaaa

SEQ ID NO: 427931 - DNA, 25 bp, Homo sapien
atttccaaacagacctcaaatggtg

SEQ ID NO: 427932 - DNA, 25 bp, Homo sapien
aatggtgaaaatctcaaagcttcct

SEQ ID NO: 427933 - DNA, 25 bp, Homo sapien
aaagcttccttcagattttacagtt

SEQ ID NO: 427934 - DNA, 25 bp, Homo sapien
tttacagttcctaaaatcagggaga

SEQ ID NO: 427935 - DNA, 25 bp, Homo sapien
atgaagcagtttattgaccgccagc

SEQ ID NO: 427936 - DNA, 25 bp, Homo sapien
gcagtttattgaccgccagcaacag

SEQ ID NO: 427937 - DNA, 25 bp, Homo sapien
gccagcaacaggacacatgttgcct

SEQ ID NO: 427938 - DNA, 25 bp, Homo sapien
aggacaacaaatacatcgaccaaaa

SEQ ID NO: 427939 - DNA, 25 bp, Homo sapien
gaagcaaatgcggacaccaaagaaa

SEQ ID NO: 427940 - DNA, 25 bp, Homo sapien
caaagaaaagctccctttacgcctg

SEQ ID NO: 427941 - DNA, 25 bp, Homo sapien
tatgtggtcacatagctgctgagtg

SEQ ID NO: 427942 - DNA, 25 bp, Homo sapien
gtgaagacttgaacccacactggta

SEQ ID NO: 427943 - DNA, 25 bp, Homo sapien
gaacccacactggtaactatcacaa

SEQ ID NO: 427944 - DNA, 25 bp, Homo sapien
aacccaaactttgcatctgtcagat

SEQ ID NO: 427945 - DNA, 25 bp, Homo sapien
tgcatctgtcagattgttggcagtt

SEQ ID NO: 427946 - DNA, 25 bp, Homo sapien
gaaacagaaagcttcatgccctgct

SEQ ID NO: 427947 - DNA, 25 bp, Homo sapien
cagaatataggctggtgcaggtgtc

SEQ ID NO: 427948 - DNA, 25 bp, Homo sapien
gtgtcctggagataagcctgggaaa

SEQ ID NO: 427949 - DNA, 25 bp, Homo sapien
aagcctgggaaagttgagctcaact

SEQ ID NO: 427950 - DNA, 25 bp, Homo sapien
ctgaggcatatagatgtggcttatc

SEQ ID NO: 427951 - DNA, 25 bp, Homo sapien
gtggcttatctgcttttatgtggtc

SEQ ID NO: 427952 - DNA, 25 bp, Homo sapien
tacagagggccgacttcttctatat

SEQ ID NO: 427953 - DNA, 25 bp, Homo sapien
gggccgacttcttctatatatgggt

SEQ ID NO: 427954 - DNA, 25 bp, Homo sapien
cttcttctatatatgggtcctgcag

SEQ ID NO: 427955 - DNA, 25 bp, Homo sapien
ggtcctgcagggtaactgtggaact

SEQ ID NO: 427956 - DNA, 25 bp, Homo sapien
ctgtggaactttaatgtctgtggat

SEQ ID NO: 427957 - DNA, 25 bp, Homo sapien
gatttttgtatccatgggcagccct

SEQ ID NO: 427958 - DNA, 25 bp, Homo sapien
cccctgttccaagagacagttgtac

SEQ ID NO: 427959 - DNA, 25 bp, Homo sapien
gagacagttgtacttaacaaccaat

SEQ ID NO: 427960 - DNA, 25 bp, Homo sapien
aaacaagttttttgatgcagatcag

SEQ ID NO: 427961 - DNA, 25 bp, Homo sapien
tcagcctcatttttcactgagagaa

SEQ ID NO: 427962 - DNA, 25 bp, Homo sapien
gcagaacctgtgtttatgtgaaatc

SEQ ID NO: 427963 - DNA, 25 bp, Homo sapien
gtgattctagttggctctgtttcca

SEQ ID NO: 427964 - DNA, 25 bp, Homo sapien
ctctgtttccacctgtgtgcaaatg

SEQ ID NO: 427965 - DNA, 25 bp, Homo sapien
acctgtgtgcaaatgtagtccccaa

SEQ ID NO: 427966 - DNA, 25 bp, Homo sapien
gtgcaaatgtagtccccaatttctt

SEQ ID NO: 427967 - DNA, 25 bp, Homo sapien
gcccattgcatacagttctcactaa

SEQ ID NO: 427968 - DNA, 25 bp, Homo sapien
ttaagagttcctagagttgccagat

SEQ ID NO: 427969 - DNA, 25 bp, Homo sapien
tcaaatattgaatgggacacactta

SEQ ID NO: 427970 - DNA, 25 bp, Homo sapien
ccagaagatttgaaaagggcacgtt

SEQ ID NO: 427971 - DNA, 25 bp, Homo sapien
gggcacgttaaactgaaatgtctaa

SEQ ID NO: 427972 - DNA, 25 bp, Homo sapien
gaaatgtctaaaactagtgtttctg

SEQ ID NO: 427973 - DNA, 25 bp, Homo sapien
gtttctggctgtccgtgattctagt

SEQ ID NO: 427974 - DNA, 25 bp, Homo sapien
tttctgttacaccttgagtcatttg

SEQ ID NO: 427975 - DNA, 25 bp, Homo sapien
gttacaccttgagtcatttgccttt

SEQ ID NO: 427976 - DNA, 25 bp, Homo sapien
cttgagtcatttgcctttaggattc

SEQ ID NO: 427977 - DNA, 25 bp, Homo sapien
ttgcctttaggattctagacagacc

SEQ ID NO: 427978 - DNA, 25 bp, Homo sapien
ggattctagacagacctaagggaaa

SEQ ID NO: 427979 - DNA, 25 bp, Homo sapien
gcctcagttacacatccaaactcta

SEQ ID NO: 427980 - DNA, 25 bp, Homo sapien
gttacacatccaaactctacattta

SEQ ID NO: 427981 - DNA, 25 bp, Homo sapien
atccaaactctacatttacaaaacg

SEQ ID NO: 427982 - DNA, 25 bp, Homo sapien
ttacaaaacgaattcagggtgagga

SEQ ID NO: 427983 - DNA, 25 bp, Homo sapien
gtaaaaacaggtcatctattcacaa

SEQ ID NO: 427984 - DNA, 25 bp, Homo sapien
acaggtcatctattcacaaaactga

SEQ ID NO: 427985 - DNA, 25 bp, Homo sapien
aacggatagggctataattaggcaa

SEQ ID NO: 427986 - DNA, 25 bp, Homo sapien
acggatagggctataattaggcaat

SEQ ID NO: 427987 - DNA, 25 bp, Homo sapien
cggatagggctataattaggcaata

SEQ ID NO: 427988 - DNA, 25 bp, Homo sapien
ggaggtgctcgcctatagtctcagc

SEQ ID NO: 427989 - DNA, 25 bp, Homo sapien
ggctgaggtagaaggctccttcgag

SEQ ID NO: 427990 - DNA, 25 bp, Homo sapien
gctgaggtagaaggctccttcgagc

SEQ ID NO: 427991 - DNA, 25 bp, Homo sapien
gaggtagaaggctccttcgagccta

SEQ ID NO: 427992 - DNA, 25 bp, Homo sapien
aggtagaaggctccttcgagcctag

SEQ ID NO: 427993 - DNA, 25 bp, Homo sapien
gtagaaggctccttcgagcctagga

SEQ ID NO: 427994 - DNA, 25 bp, Homo sapien
tagaaggctccttcgagcctaggag

SEQ ID NO: 427995 - DNA, 25 bp, Homo sapien
gaaataaaaggtacaggctgggcgt

SEQ ID NO: 427996 - DNA, 25 bp, Homo sapien
atacaccacaggttaccagaacctt

SEQ ID NO: 427997 - DNA, 25 bp, Homo sapien
caggttaccagaaccttcagattta

SEQ ID NO: 427998 - DNA, 25 bp, Homo sapien
gcagaagcagtgagcatcgacatca

SEQ ID NO: 427999 - DNA, 25 bp, Homo sapien
gtgagcatcgacatcaactgtacaa

SEQ ID NO: 428000 - DNA, 25 bp, Homo sapien
gcatcgacatcaactgtacaagcat

SEQ ID NO: 428001 - DNA, 25 bp, Homo sapien
gtacaagcattacaaagactcctgt

SEQ ID NO: 428002 - DNA, 25 bp, Homo sapien
aagactcctgtgacgaaaacacaat

SEQ ID NO: 428003 - DNA, 25 bp, Homo sapien
gtgtacattctccacagatcatatt

SEQ ID NO: 428004 - DNA, 25 bp, Homo sapien
gatcatattaaggagtttgtaggtg

SEQ ID NO: 428005 - DNA, 25 bp, Homo sapien
gtaggtgaagtttaatctgtgcata

SEQ ID NO: 428006 - DNA, 25 bp, Homo sapien
atctgtgcatagtgggtagagacat

SEQ ID NO: 428007 - DNA, 25 bp, Homo sapien
acagttcagggttctttcattcacg

SEQ ID NO: 428008 - DNA, 25 bp, Homo sapien
ttcctgtctcggtctgcggtcttta

SEQ ID NO: 428009 - DNA, 25 bp, Homo sapien
tctgcggtctttaccacatcaatag

SEQ ID NO: 428010 - DNA, 25 bp, Homo sapien
caataggactttttatgcgtccggg

SEQ ID NO: 428011 - DNA, 25 bp, Homo sapien
tcctgttgcagggaccggagctgat

SEQ ID NO: 428012 - DNA, 25 bp, Homo sapien
accggagctgatgggagctgcttct

SEQ ID NO: 428013 - DNA, 25 bp, Homo sapien
tggtcccagatcagggctccaggga

SEQ ID NO: 428014 - DNA, 25 bp, Homo sapien
ccagggacagatgatgagtctcaaa

SEQ ID NO: 428015 - DNA, 25 bp, Homo sapien
tgagtctcaaacgagccagccaggg

SEQ ID NO: 428016 - DNA, 25 bp, Homo sapien
aattcgccctgtctcagagctgatg

SEQ ID NO: 428017 - DNA, 25 bp, Homo sapien
agagctgatgacctcaccgttgttt

SEQ ID NO: 428018 - DNA, 25 bp, Homo sapien
ggccggctccttcttaaacttgctc

SEQ ID NO: 428019 - DNA, 25 bp, Homo sapien
gctccttcttaaacttgctctcgaa

SEQ ID NO: 428020 - DNA, 25 bp, Homo sapien
gagtggccgtgctggtgcagcgcca

SEQ ID NO: 428021 - DNA, 25 bp, Homo sapien
gccagcagcgtgtcgcgcacggtct

SEQ ID NO: 428022 - DNA, 25 bp, Homo sapien
tcgcgcacggtcttgggcctgttga

SEQ ID NO: 428023 - DNA, 25 bp, Homo sapien
acggtcttgggcctgttgacccagt

SEQ ID NO: 428024 - DNA, 25 bp, Homo sapien
ttgggcctgttgacccagtcctgct

SEQ ID NO: 428025 - DNA, 25 bp, Homo sapien
tcacgctgctcgtgctccacggcag

SEQ ID NO: 428026 - DNA, 25 bp, Homo sapien
cggcagcgctgctcgacacggatgc

SEQ ID NO: 428027 - DNA, 25 bp, Homo sapien
cagcgctgctcgacacggatgccgg

SEQ ID NO: 428028 - DNA, 25 bp, Homo sapien
gctcgacacggatgccggccgcttg

SEQ ID NO: 428029 - DNA, 25 bp, Homo sapien
tcccagccttgtcggcagtgaggac

SEQ ID NO: 428030 - DNA, 25 bp, Homo sapien
aggacatggaccctcgctggcatcc

SEQ ID NO: 428031 - DNA, 25 bp, Homo sapien
tccgtctggcacaacgtgccgtgtt

SEQ ID NO: 428032 - DNA, 25 bp, Homo sapien
tgccgtgttctctctggttagggtt

SEQ ID NO: 428033 - DNA, 25 bp, Homo sapien
tgggacggagactgcgcccctgttc

SEQ ID NO: 428034 - DNA, 25 bp, Homo sapien
agtctctgccagtctgagtctcgtg

SEQ ID NO: 428035 - DNA, 25 bp, Homo sapien
agtctgagtctcgtgggccttttct

SEQ ID NO: 428036 - DNA, 25 bp, Homo sapien
gccacctgccaagtagctgcaatgg

SEQ ID NO: 428037 - DNA, 25 bp, Homo sapien
gaagagatgcggttcccgtgacagc

SEQ ID NO: 428038 - DNA, 25 bp, Homo sapien
gttcccgtgacagccaggcctggat

SEQ ID NO: 428039 - DNA, 25 bp, Homo sapien
agccaggcctggatgttcaagtcat

SEQ ID NO: 428040 - DNA, 25 bp, Homo sapien
atgttacttgtacataagtagcagc

SEQ ID NO: 428041 - DNA, 25 bp, Homo sapien
gtacataagtagcagcacaatacgt

SEQ ID NO: 428042 - DNA, 25 bp, Homo sapien
ataagtagcagcacaatacgtacat

SEQ ID NO: 428043 - DNA, 25 bp, Homo sapien
aagtagcagcacaatacgtacatat

SEQ ID NO: 428044 - DNA, 25 bp, Homo sapien
agtagcagcacaatacgtacatata

SEQ ID NO: 428045 - DNA, 25 bp, Homo sapien
gtagcagcacaatacgtacatataa

SEQ ID NO: 428046 - DNA, 25 bp, Homo sapien
tagcagcacaatacgtacatataaa

SEQ ID NO: 428047 - DNA, 25 bp, Homo sapien
gcagcacaatacgtacatataaacc

SEQ ID NO: 428048 - DNA, 25 bp, Homo sapien
gcacaatacgtacatataaacccta

SEQ ID NO: 428049 - DNA, 25 bp, Homo sapien
atacgtacatataaaccctatgagt

SEQ ID NO: 428050 - DNA, 25 bp, Homo sapien
cgtacatataaaccctatgagtata

SEQ ID NO: 428051 - DNA, 25 bp, Homo sapien
aaagggagactcaaagctataaatg

SEQ ID NO: 428052 - DNA, 25 bp, Homo sapien
aagggagactcaaagctataaatgc

SEQ ID NO: 428053 - DNA, 25 bp, Homo sapien
agggagactcaaagctataaatgct

SEQ ID NO: 428054 - DNA, 25 bp, Homo sapien
gggagactcaaagctataaatgctt

SEQ ID NO: 428055 - DNA, 25 bp, Homo sapien
ggagactcaaagctataaatgcttt

SEQ ID NO: 428056 - DNA, 25 bp, Homo sapien
gagactcaaagctataaatgcttta

SEQ ID NO: 428057 - DNA, 25 bp, Homo sapien
agactcaaagctataaatgctttaa

SEQ ID NO: 428058 - DNA, 25 bp, Homo sapien
gactcaaagctataaatgctttaag

SEQ ID NO: 428059 - DNA, 25 bp, Homo sapien
actcaaagctataaatgctttaaga

SEQ ID NO: 428060 - DNA, 25 bp, Homo sapien
atgctttaagaaaaatttgtggctg

SEQ ID NO: 428061 - DNA, 25 bp, Homo sapien
gctttaagaaaaatttgtggctggg

SEQ ID NO: 428062 - DNA, 25 bp, Homo sapien
actgcttaaaccacaggacctggtt

SEQ ID NO: 428063 - DNA, 25 bp, Homo sapien
aggacctggttaactcctcaccaag

SEQ ID NO: 428064 - DNA, 25 bp, Homo sapien
ctatcaggtggttttggagaaaaca

SEQ ID NO: 428065 - DNA, 25 bp, Homo sapien
acgaccctggttgccaatgggcgcg

SEQ ID NO: 428066 - DNA, 25 bp, Homo sapien
atgggcgcgggagacattgtataca

SEQ ID NO: 428067 - DNA, 25 bp, Homo sapien
gacattgtatacacatcatgctatt

SEQ ID NO: 428068 - DNA, 25 bp, Homo sapien
gtgtaaatgctaattaaccatattg

SEQ ID NO: 428069 - DNA, 25 bp, Homo sapien
aaccatattggtatataaccggaat

SEQ ID NO: 428070 - DNA, 25 bp, Homo sapien
gcctcctttttaaatatatgccgtg

SEQ ID NO: 428071 - DNA, 25 bp, Homo sapien
aggaatcccgggtgctccactgctt

SEQ ID NO: 428072 - DNA, 25 bp, Homo sapien
gtgctccactgcttaaaccacagga

SEQ ID NO: 428073 - DNA, 25 bp, Homo sapien
cgtcggacagggttgcattgtagaa

SEQ ID NO: 428074 - DNA, 25 bp, Homo sapien
gggttgcattgtagaaagtggcttt

SEQ ID NO: 428075 - DNA, 25 bp, Homo sapien
agaaagtggctttgttcgatccttc

SEQ ID NO: 428076 - DNA, 25 bp, Homo sapien
aagtggctttgttcgatccttcgca

SEQ ID NO: 428077 - DNA, 25 bp, Homo sapien
tgttcgatccttcgcacagatgcaa

SEQ ID NO: 428078 - DNA, 25 bp, Homo sapien
cttcgcacagatgcaaatggccaga

SEQ ID NO: 428079 - DNA, 25 bp, Homo sapien
aaatggccagagcattcattccctt

SEQ ID NO: 428080 - DNA, 25 bp, Homo sapien
agctctcctctgactcatctcagga

SEQ ID NO: 428081 - DNA, 25 bp, Homo sapien
aggacatccaaaactcactcaagat

SEQ ID NO: 428082 - DNA, 25 bp, Homo sapien
aactcactcaagatcaccaagtggt

SEQ ID NO: 428083 - DNA, 25 bp, Homo sapien
atcaccaagtggtaggaaagtacta

SEQ ID NO: 428084 - DNA, 25 bp, Homo sapien
tgagccccggctagcatgaattttc

SEQ ID NO: 428085 - DNA, 25 bp, Homo sapien
gcatgaattttctaagtcagaccaa

SEQ ID NO: 428086 - DNA, 25 bp, Homo sapien
taattttttgttgaaggaggctgtt

SEQ ID NO: 428087 - DNA, 25 bp, Homo sapien
gttctgtgcattgttggatttttag

SEQ ID NO: 428088 - DNA, 25 bp, Homo sapien
ttggatttttagcagcgtccctgac

SEQ ID NO: 428089 - DNA, 25 bp, Homo sapien
tgacctcagtccaatagatgccagt

SEQ ID NO: 428090 - DNA, 25 bp, Homo sapien
gtaacaactccctcccgattatgat

SEQ ID NO: 428091 - DNA, 25 bp, Homo sapien
gtctaatagtgagggcatttcgcca

SEQ ID NO: 428092 - DNA, 25 bp, Homo sapien
agggcatttcgccaagttgcctagg

SEQ ID NO: 428093 - DNA, 25 bp, Homo sapien
taggctgatcatgaatcctgaactc

SEQ ID NO: 428094 - DNA, 25 bp, Homo sapien
atgaatcctgaactcaggccatcct

SEQ ID NO: 428095 - DNA, 25 bp, Homo sapien
tacttgaggcaaagggcggccccgg

SEQ ID NO: 428096 - DNA, 25 bp, Homo sapien
ggccccggccggcaggctgcttagg

SEQ ID NO: 428097 - DNA, 25 bp, Homo sapien
ccggcaggctgcttaggctagggtc

SEQ ID NO: 428098 - DNA, 25 bp, Homo sapien
cggcaggctgcttaggctagggtcg

SEQ ID NO: 428099 - DNA, 25 bp, Homo sapien
caacgccggctgaacctactagcag

SEQ ID NO: 428100 - DNA, 25 bp, Homo sapien
aacgccggctgaacctactagcagc

SEQ ID NO: 428101 - DNA, 25 bp, Homo sapien
cggctgaacctactagcagcccggg

SEQ ID NO: 428102 - DNA, 25 bp, Homo sapien
tgaacctactagcagcccggggaca

SEQ ID NO: 428103 - DNA, 25 bp, Homo sapien
gggtcagccggctcgaagcagccca

SEQ ID NO: 428104 - DNA, 25 bp, Homo sapien
tcagccggctcgaagcagcccaggg

SEQ ID NO: 428105 - DNA, 25 bp, Homo sapien
gacgccgggcgttcccgaggcggcg

SEQ ID NO: 428106 - DNA, 25 bp, Homo sapien
gtagtaacctggatggttttcaatg

SEQ ID NO: 428107 - DNA, 25 bp, Homo sapien
atggttttcaatggcatggttagtc

SEQ ID NO: 428108 - DNA, 25 bp, Homo sapien
tcaatggcatggttagtcaaattca

SEQ ID NO: 428109 - DNA, 25 bp, Homo sapien
gagggtaggttggagcatttattac

SEQ ID NO: 428110 - DNA, 25 bp, Homo sapien
taggttggagcatttattacatatt

SEQ ID NO: 428111 - DNA, 25 bp, Homo sapien
ttactgtttaatgtcttaaccgtgg

SEQ ID NO: 428112 - DNA, 25 bp, Homo sapien
tgtttaatgtcttaaccgtgggcct

SEQ ID NO: 428113 - DNA, 25 bp, Homo sapien
ctgaaatgattgttgggctgtggaa

SEQ ID NO: 428114 - DNA, 25 bp, Homo sapien
gttgggctgtggaaaacatttacct

SEQ ID NO: 428115 - DNA, 25 bp, Homo sapien
gggctgtggaaaacatttacctatt

SEQ ID NO: 428116 - DNA, 25 bp, Homo sapien
aaagacagtccactttttagcatgt

SEQ ID NO: 428117 - DNA, 25 bp, Homo sapien
gcaataaatgctatagtgccatgtt

SEQ ID NO: 428118 - DNA, 25 bp, Homo sapien
tgctatagtgccatgttagattatt

SEQ ID NO: 428119 - DNA, 25 bp, Homo sapien
ttttgtgtctcctttgctaagttaa

SEQ ID NO: 428120 - DNA, 25 bp, Homo sapien
gtgtctcctttgctaagttaaacca

SEQ ID NO: 428121 - DNA, 25 bp, Homo sapien
taaaccaaagtattcattagctaat

SEQ ID NO: 428122 - DNA, 25 bp, Homo sapien
attcattagctaattcattcactca

SEQ ID NO: 428123 - DNA, 25 bp, Homo sapien
cattcactcaatagcctgaaacaca

SEQ ID NO: 428124 - DNA, 25 bp, Homo sapien
tagcctgaaacacaaaagtcctcca

SEQ ID NO: 428125 - DNA, 25 bp, Homo sapien
agtcctccagacaactagagaagaa

SEQ ID NO: 428126 - DNA, 25 bp, Homo sapien
actagagaagaactggatcatccca

SEQ ID NO: 428127 - DNA, 25 bp, Homo sapien
agaagaactggatcatcccatagtt

SEQ ID NO: 428128 - DNA, 25 bp, Homo sapien
aaacaccagcagatactattacttg

SEQ ID NO: 428129 - DNA, 25 bp, Homo sapien
cagcagatactattacttgcttaaa

SEQ ID NO: 428130 - DNA, 25 bp, Homo sapien
gggcacttttcatagtcttggaatg

SEQ ID NO: 428131 - DNA, 25 bp, Homo sapien
cttttcatagtcttggaatgctaag

SEQ ID NO: 428132 - DNA, 25 bp, Homo sapien
aatattgtgacagaaagctttaagt

SEQ ID NO: 428133 - DNA, 25 bp, Homo sapien
gagctctgtattatatttgatactc

SEQ ID NO: 428134 - DNA, 25 bp, Homo sapien
tatatttgatactcttacagttaaa

SEQ ID NO: 428135 - DNA, 25 bp, Homo sapien
atacattgttaattattgaccagtt

SEQ ID NO: 428136 - DNA, 25 bp, Homo sapien
tattgaccagttttgaagtttgggt

SEQ ID NO: 428137 - DNA, 25 bp, Homo sapien
ggaaggactcttgttttacacttgt

SEQ ID NO: 428138 - DNA, 25 bp, Homo sapien
ggactcttgttttacacttgtatta

SEQ ID NO: 428139 - DNA, 25 bp, Homo sapien
aattcctcagtaaatttcacatgga

SEQ ID NO: 428140 - DNA, 25 bp, Homo sapien
acatggaaaatctgaactacaaaca

SEQ ID NO: 428141 - DNA, 25 bp, Homo sapien
gaactacaaacaattttggacacag

SEQ ID NO: 428142 - DNA, 25 bp, Homo sapien
ggacacagttttgtaggctataaaa

SEQ ID NO: 428143 - DNA, 25 bp, Homo sapien
ttttcttgctcatatttagtcttca

SEQ ID NO: 428144 - DNA, 25 bp, Homo sapien
gctcatatttagtcttcaatccttt

SEQ ID NO: 428145 - DNA, 25 bp, Homo sapien
tcaatcctttgaatgtctgaacata

SEQ ID NO: 428146 - DNA, 25 bp, Homo sapien
gaatgtctgaacatattcaatcgat

SEQ ID NO: 428147 - DNA, 25 bp, Homo sapien
tattcaatcgattcaagtgctttat

SEQ ID NO: 428148 - DNA, 25 bp, Homo sapien
ttaccctcctattcaactctatgct

SEQ ID NO: 428149 - DNA, 25 bp, Homo sapien
caactctatgctatccagtgatgga

SEQ ID NO: 428150 - DNA, 25 bp, Homo sapien
atcaggttgctgctcagagagcacc

SEQ ID NO: 428151 - DNA, 25 bp, Homo sapien
tcaggttgctgctcagagagcacca

SEQ ID NO: 428152 - DNA, 25 bp, Homo sapien
agggctctgctggacagagacctga

SEQ ID NO: 428153 - DNA, 25 bp, Homo sapien
gggctctgctggacagagacctgat

SEQ ID NO: 428154 - DNA, 25 bp, Homo sapien
ggctctgctggacagagacctgatc

SEQ ID NO: 428155 - DNA, 25 bp, Homo sapien
gctctgctggacagagacctgatca

SEQ ID NO: 428156 - DNA, 25 bp, Homo sapien
ctctgctggacagagacctgatcaa

SEQ ID NO: 428157 - DNA, 25 bp, Homo sapien
tctgctggacagagacctgatcaag

SEQ ID NO: 428158 - DNA, 25 bp, Homo sapien
aacccaactggtgaccaagagtggt

SEQ ID NO: 428159 - DNA, 25 bp, Homo sapien
acccaactggtgaccaagagtggtg

SEQ ID NO: 428160 - DNA, 25 bp, Homo sapien
cccaactggtgaccaagagtggtgg

SEQ ID NO: 428161 - DNA, 25 bp, Homo sapien
ttctgtcaagcatatcttggcctct

SEQ ID NO: 428162 - DNA, 25 bp, Homo sapien
ccatgtctcagtgttgcctgcattt

SEQ ID NO: 428163 - DNA, 25 bp, Homo sapien
tgcctgcatttctcccaggacttgg

SEQ ID NO: 428164 - DNA, 25 bp, Homo sapien
acaagcccagcaggtcctgagtgaa

SEQ ID NO: 428165 - DNA, 25 bp, Homo sapien
gggccctccaaatgctcgttttata

SEQ ID NO: 428166 - DNA, 25 bp, Homo sapien
tcgttttatagcaacctctctctac

SEQ ID NO: 428167 - DNA, 25 bp, Homo sapien
tagttctccaaattcacttctgcct

SEQ ID NO: 428168 - DNA, 25 bp, Homo sapien
ataccaatgcagttttgctacggtt

SEQ ID NO: 428169 - DNA, 25 bp, Homo sapien
gcagttttgctacggttacaatttt

SEQ ID NO: 428170 - DNA, 25 bp, Homo sapien
taactgagcctcaaaatcacccttt

SEQ ID NO: 428171 - DNA, 25 bp, Homo sapien
aaaatcaccctttctgtcaagcata

SEQ ID NO: 428172 - DNA, 25 bp, Homo sapien
attttgtggtggtgatcctagctcc

SEQ ID NO: 428173 - DNA, 25 bp, Homo sapien
ggtggtgatcctagctcctaagtgg

SEQ ID NO: 428174 - DNA, 25 bp, Homo sapien
cttggaagagctgttaatagtctgc

SEQ ID NO: 428175 - DNA, 25 bp, Homo sapien
gagctgttaatagtctgcatgttag

SEQ ID NO: 428176 - DNA, 25 bp, Homo sapien
tagtctgcatgttaggaatacattt

SEQ ID NO: 428177 - DNA, 25 bp, Homo sapien
ttatcctttccagacttgttgctag

SEQ ID NO: 428178 - DNA, 25 bp, Homo sapien
ccagacttgttgctagggattaaat

SEQ ID NO: 428179 - DNA, 25 bp, Homo sapien
gaaatgctctgtttctaaaacttaa

SEQ ID NO: 428180 - DNA, 25 bp, Homo sapien
taaactgtcttgaaaactagaacat

SEQ ID NO: 428181 - DNA, 25 bp, Homo sapien
tatttttcaggtcctaaaacctgct

SEQ ID NO: 428182 - DNA, 25 bp, Homo sapien
tcaggtcctaaaacctgctaaatgt

SEQ ID NO: 428183 - DNA, 25 bp, Homo sapien
ggaggacttgttaaaatacagatgt

SEQ ID NO: 428184 - DNA, 25 bp, Homo sapien
tgttaaaatacagatgtctgccggg

SEQ ID NO: 428185 - DNA, 25 bp, Homo sapien
gttaaaatacagatgtctgccgggc

SEQ ID NO: 428186 - DNA, 25 bp, Homo sapien
ttaaaatacagatgtctgccgggcg

SEQ ID NO: 428187 - DNA, 25 bp, Homo sapien
taaaatacagatgtctgccgggcgc

SEQ ID NO: 428188 - DNA, 25 bp, Homo sapien
aaaatacagatgtctgccgggcgcg

SEQ ID NO: 428189 - DNA, 25 bp, Homo sapien
aaatacagatgtctgccgggcgcgg

SEQ ID NO: 428190 - DNA, 25 bp, Homo sapien
aatacagatgtctgccgggcgcggt

SEQ ID NO: 428191 - DNA, 25 bp, Homo sapien
atacagatgtctgccgggcgcggtg

SEQ ID NO: 428192 - DNA, 25 bp, Homo sapien
tacagatgtctgccgggcgcggtgg

SEQ ID NO: 428193 - DNA, 25 bp, Homo sapien
acagatgtctgccgggcgcggtggc

SEQ ID NO: 428194 - DNA, 25 bp, Homo sapien
tttcaaacctgtattccttctttat

SEQ ID NO: 428195 - DNA, 25 bp, Homo sapien
caaacctgtattccttctttatact

SEQ ID NO: 428196 - DNA, 25 bp, Homo sapien
gaaaatgtcaccaagcaccctcctc

SEQ ID NO: 428197 - DNA, 25 bp, Homo sapien
aaagtgtctgagcatatgcctggct

SEQ ID NO: 428198 - DNA, 25 bp, Homo sapien
gtgtctgagcatatgcctggctgtc

SEQ ID NO: 428199 - DNA, 25 bp, Homo sapien
gagcatatgcctggctgtcctcaga

SEQ ID NO: 428200 - DNA, 25 bp, Homo sapien
atatgcctggctgtcctcagatcat

SEQ ID NO: 428201 - DNA, 25 bp, Homo sapien
atgcctggctgtcctcagatcatca

SEQ ID NO: 428202 - DNA, 25 bp, Homo sapien
acatgctagaaggaaatacatccaa

SEQ ID NO: 428203 - DNA, 25 bp, Homo sapien
gttagcattggagtgttagaaacta

SEQ ID NO: 428204 - DNA, 25 bp, Homo sapien
gaaactagaatagacctctccgcca

SEQ ID NO: 428205 - DNA, 25 bp, Homo sapien
ggaggaattacaacgtactttgatt

SEQ ID NO: 428206 - DNA, 25 bp, Homo sapien
tttgaatactagtagaaactggcca

SEQ ID NO: 428207 - DNA, 25 bp, Homo sapien
aatggatcacttgggaattactgac

SEQ ID NO: 428208 - DNA, 25 bp, Homo sapien
tgggaattactgacttgactagaag

SEQ ID NO: 428209 - DNA, 25 bp, Homo sapien
gtgaatgtgggttatgttctttccc

SEQ ID NO: 428210 - DNA, 25 bp, Homo sapien
tatgttctttcccaccttgtagcat

SEQ ID NO: 428211 - DNA, 25 bp, Homo sapien
ttcccaccttgtagcatattcgatg

SEQ ID NO: 428212 - DNA, 25 bp, Homo sapien
atggttctctgatttgagggaggtt

SEQ ID NO: 428213 - DNA, 25 bp, Homo sapien
taaacatcaaacaggtttcctctat

SEQ ID NO: 428214 - DNA, 25 bp, Homo sapien
aacaggtttcctctattggccataa

SEQ ID NO: 428215 - DNA, 25 bp, Homo sapien
ggtttcctctattggccataacatg

SEQ ID NO: 428216 - DNA, 25 bp, Homo sapien
tgcacagccccgaagttcgccgggc

SEQ ID NO: 428217 - DNA, 25 bp, Homo sapien
gcaagcaaggaatacgttcccccag

SEQ ID NO: 428218 - DNA, 25 bp, Homo sapien
cgccaacatgtactcgtcggccgga

SEQ ID NO: 428219 - DNA, 25 bp, Homo sapien
acatgtactcgtcggccggagccgc

SEQ ID NO: 428220 - DNA, 25 bp, Homo sapien
gaagtatccggttccccagtccctg

SEQ ID NO: 428221 - DNA, 25 bp, Homo sapien
ggctcctacgactattgccccagat

SEQ ID NO: 428222 - DNA, 25 bp, Homo sapien
tcctacgactattgccccagataac

SEQ ID NO: 428223 - DNA, 25 bp, Homo sapien
cgactattgccccagataacacggg

SEQ ID NO: 428224 - DNA, 25 bp, Homo sapien
gactattgccccagataacacgggc

SEQ ID NO: 428225 - DNA, 25 bp, Homo sapien
tattgccccagataacacgggccct

SEQ ID NO: 428226 - DNA, 25 bp, Homo sapien
ttgccccagataacacgggccctgt

SEQ ID NO: 428227 - DNA, 25 bp, Homo sapien
atttctgtttattctgcttgggatg

SEQ ID NO: 428228 - DNA, 25 bp, Homo sapien
cttgggatgtgttttccttctggga

SEQ ID NO: 428229 - DNA, 25 bp, Homo sapien
gggatctgtgaatcggtttctcatt

SEQ ID NO: 428230 - DNA, 25 bp, Homo sapien
aacctgaagccagttatctcttaaa

SEQ ID NO: 428231 - DNA, 25 bp, Homo sapien
atctcttaaaataccagctctcctt

SEQ ID NO: 428232 - DNA, 25 bp, Homo sapien
aaaaggactaactcacatggctgca

SEQ ID NO: 428233 - DNA, 25 bp, Homo sapien
ctgcagtaagtgctggctgttagct

SEQ ID NO: 428234 - DNA, 25 bp, Homo sapien
ggctgttagctggaagcacaaccaa

SEQ ID NO: 428235 - DNA, 25 bp, Homo sapien
gctgttaacaggtgtgccttggttc

SEQ ID NO: 428236 - DNA, 25 bp, Homo sapien
gccttggttctcttccatatggctt

SEQ ID NO: 428237 - DNA, 25 bp, Homo sapien
gcttctcttttgttttcagtactct

SEQ ID NO: 428238 - DNA, 25 bp, Homo sapien
aaagggagactcaaagctataaatg

SEQ ID NO: 428239 - DNA, 25 bp, Homo sapien
aagggagactcaaagctataaatgc

SEQ ID NO: 428240 - DNA, 25 bp, Homo sapien
agggagactcaaagctataaatgct

SEQ ID NO: 428241 - DNA, 25 bp, Homo sapien
gggagactcaaagctataaatgctt

SEQ ID NO: 428242 - DNA, 25 bp, Homo sapien
ggagactcaaagctataaatgcttt

SEQ ID NO: 428243 - DNA, 25 bp, Homo sapien
gagactcaaagctataaatgcttta

SEQ ID NO: 428244 - DNA, 25 bp, Homo sapien
agactcaaagctataaatgctttaa

SEQ ID NO: 428245 - DNA, 25 bp, Homo sapien
gactcaaagctataaatgctttaag

SEQ ID NO: 428246 - DNA, 25 bp, Homo sapien
actcaaagctataaatgctttaaga

SEQ ID NO: 428247 - DNA, 25 bp, Homo sapien
ctcaaagctataaatgctttaagaa

SEQ ID NO: 428248 - DNA, 25 bp, Homo sapien
taaagtcatccacaactgcaaagat

SEQ ID NO: 428249 - DNA, 25 bp, Homo sapien
agccaccaagcatctccaagggatg

SEQ ID NO: 428250 - DNA, 25 bp, Homo sapien
gacacagtgaaagggcaattgctag

SEQ ID NO: 428251 - DNA, 25 bp, Homo sapien
aagggatgcatccatttacgtactt

SEQ ID NO: 428252 - DNA, 25 bp, Homo sapien
tccatttacgtacttgctcatatcc

SEQ ID NO: 428253 - DNA, 25 bp, Homo sapien
acgtacttgctcatatcctttgaaa

SEQ ID NO: 428254 - DNA, 25 bp, Homo sapien
agaagcctggcagaaccatcaaggg

SEQ ID NO: 428255 - DNA, 25 bp, Homo sapien
taggcactaggaagctaggcttaac

SEQ ID NO: 428256 - DNA, 25 bp, Homo sapien
gaagcacctggaacaagttctgctc

SEQ ID NO: 428257 - DNA, 25 bp, Homo sapien
ttctgctccataaaactgcagccag

SEQ ID NO: 428258 - DNA, 25 bp, Homo sapien
actcagatgaactcccaccaataaa

SEQ ID NO: 428259 - DNA, 25 bp, Homo sapien
gattaacggatgcacaacgtttttt

SEQ ID NO: 428260 - DNA, 25 bp, Homo sapien
atatcgtggtcaaattgcgttggcc

SEQ ID NO: 428261 - DNA, 25 bp, Homo sapien
gtagagtgcgtctacgcttgcctgg

SEQ ID NO: 428262 - DNA, 25 bp, Homo sapien
aattgcgttggccaaattctaagag

SEQ ID NO: 428263 - DNA, 25 bp, Homo sapien
ggaaactcagtacctgggcttgtcc

SEQ ID NO: 428264 - DNA, 25 bp, Homo sapien
cacagtaaacgccagatgaccagat

SEQ ID NO: 428265 - DNA, 25 bp, Homo sapien
aactgcaagtcttccaggcaggctt

SEQ ID NO: 428266 - DNA, 25 bp, Homo sapien
tgggcatgaacacaccgctgaacat

SEQ ID NO: 428267 - DNA, 25 bp, Homo sapien
gctgaacattgctggctcaccgaga

SEQ ID NO: 428268 - DNA, 25 bp, Homo sapien
agaccgagggcaggtatgtccatac

SEQ ID NO: 428269 - DNA, 25 bp, Homo sapien
catacccctgatactttagcttgca

SEQ ID NO: 428270 - DNA, 25 bp, Homo sapien
ctctctgttgaccagtgagcgagtg

SEQ ID NO: 428271 - DNA, 25 bp, Homo sapien
agcgagtggcaaagcagttcccagt

SEQ ID NO: 428272 - DNA, 25 bp, Homo sapien
agttcccagtgatgactgaggccat

SEQ ID NO: 428273 - DNA, 25 bp, Homo sapien
gaggccataactcaaattcgggcaa

SEQ ID NO: 428274 - DNA, 25 bp, Homo sapien
tttgatgtgattgtggagtcctgca

SEQ ID NO: 428275 - DNA, 25 bp, Homo sapien
gagtcctgcatggaagggatctgta

SEQ ID NO: 428276 - DNA, 25 bp, Homo sapien
gtaagccagaccctaggatctacaa

SEQ ID NO: 428277 - DNA, 25 bp, Homo sapien
gaccctaggatctacaagctgtgct

SEQ ID NO: 428278 - DNA, 25 bp, Homo sapien
aagctgtgcttggagcagctcggcc

SEQ ID NO: 428279 - DNA, 25 bp, Homo sapien
agccctctgagtccatctttcttga

SEQ ID NO: 428280 - DNA, 25 bp, Homo sapien
atctttcttgatgaccttggaacaa

SEQ ID NO: 428281 - DNA, 25 bp, Homo sapien
aggctgggtggctgttccaaagtac

SEQ ID NO: 428282 - DNA, 25 bp, Homo sapien
agtaccccaactcaacacatataaa

SEQ ID NO: 428283 - DNA, 25 bp, Homo sapien
actgctgtcctcgtggaagtcctca

SEQ ID NO: 428284 - DNA, 25 bp, Homo sapien
gtggaagtcctcatgaccgcataag

SEQ ID NO: 428285 - DNA, 25 bp, Homo sapien
atgaccgcataagctgtccaagcca

SEQ ID NO: 428286 - DNA, 25 bp, Homo sapien
cataagctgtccaagccagaaacct

SEQ ID NO: 428287 - DNA, 25 bp, Homo sapien
gaaacctggaaattgctctagagct

SEQ ID NO: 428288 - DNA, 25 bp, Homo sapien
ttgctctagagctgcactaacgtga

SEQ ID NO: 428289 - DNA, 25 bp, Homo sapien
gagctgcactaacgtgatagccact

SEQ ID NO: 428290 - DNA, 25 bp, Homo sapien
gtctgccatgcccaggtggatccga

SEQ ID NO: 428291 - DNA, 25 bp, Homo sapien
acagcctgggctgtcgctgcagcag

SEQ ID NO: 428292 - DNA, 25 bp, Homo sapien
agtacaattgtgaccctgttaccca

SEQ ID NO: 428293 - DNA, 25 bp, Homo sapien
accctgttacccaatcacttgagtt

SEQ ID NO: 428294 - DNA, 25 bp, Homo sapien
ccaatcacttgagtttattttccaa

SEQ ID NO: 428295 - DNA, 25 bp, Homo sapien
atatgacatcactgaacacagagtt

SEQ ID NO: 428296 - DNA, 25 bp, Homo sapien
gtgtgagccttatatcaccagccta

SEQ ID NO: 428297 - DNA, 25 bp, Homo sapien
tatcaccagcctaatgggcattggt

SEQ ID NO: 428298 - DNA, 25 bp, Homo sapien
agttatgaaaatttgggccagctcc

SEQ ID NO: 428299 - DNA, 25 bp, Homo sapien
gaaaatttgggccagctccaccata

SEQ ID NO: 428300 - DNA, 25 bp, Homo sapien
agctccaccataatttggctgtagc

SEQ ID NO: 428301 - DNA, 25 bp, Homo sapien
tggctgtagccaatcttgattatct

SEQ ID NO: 428302 - DNA, 25 bp, Homo sapien
tcttgattatctagattgactcggg

SEQ ID NO: 428303 - DNA, 25 bp, Homo sapien
gtatcaagacagttatcaaccaagg

SEQ ID NO: 428304 - DNA, 25 bp, Homo sapien
gttatcaaccaaggagggtaccaga

SEQ ID NO: 428305 - DNA, 25 bp, Homo sapien
ggagggtaccagatgacagattcac

SEQ ID NO: 428306 - DNA, 25 bp, Homo sapien
agatgacagattcacccaacactca

SEQ ID NO: 428307 - DNA, 25 bp, Homo sapien
agattcacccaacactcatctgagg

SEQ ID NO: 428308 - DNA, 25 bp, Homo sapien
aactgctggaccatggttgggttag

SEQ ID NO: 428309 - DNA, 25 bp, Homo sapien
ccatggttgggttaggatttgtcaa

SEQ ID NO: 428310 - DNA, 25 bp, Homo sapien
aggatttgtcaatgtttgggaacag

SEQ ID NO: 428311 - DNA, 25 bp, Homo sapien
cagtgattaggtttatcccggcctt

SEQ ID NO: 428312 - DNA, 25 bp, Homo sapien
gattaggtttatcccggcctttcag

SEQ ID NO: 428313 - DNA, 25 bp, Homo sapien
attctaggggctgtttccatggagg

SEQ ID NO: 428314 - DNA, 25 bp, Homo sapien
ggacaatgccatttatccttttcac

SEQ ID NO: 428315 - DNA, 25 bp, Homo sapien
tttatccttttcactgggtaggtga

SEQ ID NO: 428316 - DNA, 25 bp, Homo sapien
acaaagcaactgattcgtgaaaata

SEQ ID NO: 428317 - DNA, 25 bp, Homo sapien
atcatttgcatcatgagatcagttc

SEQ ID NO: 428318 - DNA, 25 bp, Homo sapien
agatcagttctctctagggaagcag

SEQ ID NO: 428319 - DNA, 25 bp, Homo sapien
cagttctctctagggaagcagggta

SEQ ID NO: 428320 - DNA, 25 bp, Homo sapien
cagggtagggaatgcagtcaaacaa

SEQ ID NO: 428321 - DNA, 25 bp, Homo sapien
atcagtgacttcaacattatctgta

SEQ ID NO: 428322 - DNA, 25 bp, Homo sapien
ttccctacaacctaaataatgggag

SEQ ID NO: 428323 - DNA, 25 bp, Homo sapien
gggagaaaatattcataagctatgc

SEQ ID NO: 428324 - DNA, 25 bp, Homo sapien
ataagctatgcatctaagaaaggtc

SEQ ID NO: 428325 - DNA, 25 bp, Homo sapien
gcttcaataggttgtgtggttttgc

SEQ ID NO: 428326 - DNA, 25 bp, Homo sapien
gaaatagccactttgaagcctgata

SEQ ID NO: 428327 - DNA, 25 bp, Homo sapien
gaagcctgatattttggaattcttt

SEQ ID NO: 428328 - DNA, 25 bp, Homo sapien
ctttatatcacctctcttggttcag

SEQ ID NO: 428329 - DNA, 25 bp, Homo sapien
cacctctcttggttcagattgtaga

SEQ ID NO: 428330 - DNA, 25 bp, Homo sapien
ttttattatgttctcaacttctctc

SEQ ID NO: 428331 - DNA, 25 bp, Homo sapien
ttgtagacagtttcatagggcccat

SEQ ID NO: 428332 - DNA, 25 bp, Homo sapien
attttctgtcactagattcctcttc

SEQ ID NO: 428333 - DNA, 25 bp, Homo sapien
gattcctcttcactaggtcctacat

SEQ ID NO: 428334 - DNA, 25 bp, Homo sapien
ggtcctacatcttctctaaaacata

SEQ ID NO: 428335 - DNA, 25 bp, Homo sapien
caacttctctctggtattggtgaca

SEQ ID NO: 428336 - DNA, 25 bp, Homo sapien
attgccacggtcatcgtcatcagcc

SEQ ID NO: 428337 - DNA, 25 bp, Homo sapien
gcaccatcagccacgggatcgtgga

SEQ ID NO: 428338 - DNA, 25 bp, Homo sapien
catcagccacgggatcgtggaggtt

SEQ ID NO: 428339 - DNA, 25 bp, Homo sapien
gatcgtggaggttgatccaatgctc

SEQ ID NO: 428340 - DNA, 25 bp, Homo sapien
gtggaggttgatccaatgctcaccc

SEQ ID NO: 428341 - DNA, 25 bp, Homo sapien
gaggttgatccaatgctcaccccag

SEQ ID NO: 428342 - DNA, 25 bp, Homo sapien
tgatccaatgctcaccccagaagag

SEQ ID NO: 428343 - DNA, 25 bp, Homo sapien
aatgctcaccccagaagagcgtcac

SEQ ID NO: 428344 - DNA, 25 bp, Homo sapien
ctatgagaaccccacctacaaatac

SEQ ID NO: 428345 - DNA, 25 bp, Homo sapien
gagaaccccacctacaaatacctgg

SEQ ID NO: 428346 - DNA, 25 bp, Homo sapien
atttaggtggcagggagcgcggcag

SEQ ID NO: 428347 - DNA, 25 bp, Homo sapien
caatattgtatggttcattaggatc

SEQ ID NO: 428348 - DNA, 25 bp, Homo sapien
tgtatggttcattaggatctgttgt

SEQ ID NO: 428349 - DNA, 25 bp, Homo sapien
atggttcattaggatctgttgtggc

SEQ ID NO: 428350 - DNA, 25 bp, Homo sapien
ggttcattaggatctgttgtggctg

SEQ ID NO: 428351 - DNA, 25 bp, Homo sapien
tcattaggatctgttgtggctggct

SEQ ID NO: 428352 - DNA, 25 bp, Homo sapien
attaggatctgttgtggctggcttt

SEQ ID NO: 428353 - DNA, 25 bp, Homo sapien
ttaggatctgttgtggctggctttg

SEQ ID NO: 428354 - DNA, 25 bp, Homo sapien
atctgttgtggctggctttggacat

SEQ ID NO: 428355 - DNA, 25 bp, Homo sapien
tctgttgtggctggctttggacatt

SEQ ID NO: 428356 - DNA, 25 bp, Homo sapien
ggacattttttgttcactagtagaa

SEQ ID NO: 428357 - DNA, 25 bp, Homo sapien
ttttgttcactagtagaattagaag

SEQ ID NO: 428358 - DNA, 25 bp, Homo sapien
tagttggactatgtgggtttaaact

SEQ ID NO: 428359 - DNA, 25 bp, Homo sapien
tggcaaataactttctaaggttagt

SEQ ID NO: 428360 - DNA, 25 bp, Homo sapien
gataggaaatactcgaaggctgctt

SEQ ID NO: 428361 - DNA, 25 bp, Homo sapien
ggaaatactcgaaggctgcttacta

SEQ ID NO: 428362 - DNA, 25 bp, Homo sapien
ggctgcttactatccttattacatt

SEQ ID NO: 428363 - DNA, 25 bp, Homo sapien
atgggtatcttgaaactacaaacct

SEQ ID NO: 428364 - DNA, 25 bp, Homo sapien
ggtgaacaagttttgtcctatgcta

SEQ ID NO: 428365 - DNA, 25 bp, Homo sapien
ttttgtcctatgctatggaggaggc

SEQ ID NO: 428366 - DNA, 25 bp, Homo sapien
atggaggaggcatagcacagtgatt

SEQ ID NO: 428367 - DNA, 25 bp, Homo sapien
tgattaagagcttgggctctgtagt

SEQ ID NO: 428368 - DNA, 25 bp, Homo sapien
ttgggctctgtagttggactatgtg

SEQ ID NO: 428369 - DNA, 25 bp, Homo sapien
tggtgctccggaacctggactctct

SEQ ID NO: 428370 - DNA, 25 bp, Homo sapien
tggactctcttcactcagccttctt

SEQ ID NO: 428371 - DNA, 25 bp, Homo sapien
acactcggcccatcttggtgcggat

SEQ ID NO: 428372 - DNA, 25 bp, Homo sapien
atcttggtgcggatgtttcgtagga

SEQ ID NO: 428373 - DNA, 25 bp, Homo sapien
gtgctggccgcacaaatcacttcag

SEQ ID NO: 428374 - DNA, 25 bp, Homo sapien
tcacttcagccacccagaaggctgt

SEQ ID NO: 428375 - DNA, 25 bp, Homo sapien
gaaggctgtgctccaactgtagtgc

SEQ ID NO: 428376 - DNA, 25 bp, Homo sapien
aactgtagtgcttggcaatggtgct

SEQ ID NO: 428377 - DNA, 25 bp, Homo sapien
ggaagaacctaagccagtggtgcta

SEQ ID NO: 428378 - DNA, 25 bp, Homo sapien
agtggtgctagctccagcttctcac

SEQ ID NO: 428379 - DNA, 25 bp, Homo sapien
agcttctcactggtctatatgcaaa

SEQ ID NO: 428380 - DNA, 25 bp, Homo sapien
aatacttactatctttaccactcac

SEQ ID NO: 428381 - DNA, 25 bp, Homo sapien
tttaccactcactgctctattttga

SEQ ID NO: 428382 - DNA, 25 bp, Homo sapien
ctgctaagaatgctgtccttcactt

SEQ ID NO: 428383 - DNA, 25 bp, Homo sapien
gctaagaatgctgtccttcactttt

SEQ ID NO: 428384 - DNA, 25 bp, Homo sapien
aaaatgccctgtttgcataccttct

SEQ ID NO: 428385 - DNA, 25 bp, Homo sapien
gtttgcataccttctcttctttgta

SEQ ID NO: 428386 - DNA, 25 bp, Homo sapien
accttctcttctttgtatactgtaa

SEQ ID NO: 428387 - DNA, 25 bp, Homo sapien
ctttgtatactgtaaactcctgtat

SEQ ID NO: 428388 - DNA, 25 bp, Homo sapien
ttttgtagttactctttaaggatat

SEQ ID NO: 428389 - DNA, 25 bp, Homo sapien
aggaatagtcaagttcccctatctc

SEQ ID NO: 428390 - DNA, 25 bp, Homo sapien
aatagtcaagttcccctatctcctt

SEQ ID NO: 428391 - DNA, 25 bp, Homo sapien
gattgagctacttcaggacttaaaa

SEQ ID NO: 428392 - DNA, 25 bp, Homo sapien
ggacttaaaacaaaccttgtgctct

SEQ ID NO: 428393 - DNA, 25 bp, Homo sapien
gagatcttatgtcaagttctacatc

SEQ ID NO: 428394 - DNA, 25 bp, Homo sapien
gttctacatcaatatcatccctgtc

SEQ ID NO: 428395 - DNA, 25 bp, Homo sapien
tcaatatcatccctgtcttattagg

SEQ ID NO: 428396 - DNA, 25 bp, Homo sapien
gaaatcgggagtgcactttttgact

SEQ ID NO: 428397 - DNA, 25 bp, Homo sapien
cgggagtgcactttttgactgtaga

SEQ ID NO: 428398 - DNA, 25 bp, Homo sapien
gactgtagattgttcgaagacacat

SEQ ID NO: 428399 - DNA, 25 bp, Homo sapien
acatttgtaaattttcaagcagcaa

SEQ ID NO: 428400 - DNA, 25 bp, Homo sapien
aattcatgcatctcaacaaaggtgg

SEQ ID NO: 428401 - DNA, 25 bp, Homo sapien
gcatctcaacaaaggtggcagcagt

SEQ ID NO: 428402 - DNA, 25 bp, Homo sapien
ctgcagcgccacttcatctttttaa

SEQ ID NO: 428403 - DNA, 25 bp, Homo sapien
tcatctttttaaacaccctagaggt

SEQ ID NO: 428404 - DNA, 25 bp, Homo sapien
cctagaggtctgtttgttgttgctg

SEQ ID NO: 428405 - DNA, 25 bp, Homo sapien
gttgctgttgtcctttattttgaaa

SEQ ID NO: 428406 - DNA, 25 bp, Homo sapien
agagaagttacagtccaggtgaact

SEQ ID NO: 428407 - DNA, 25 bp, Homo sapien
attgtgggattggttttgtttctgt

SEQ ID NO: 428408 - DNA, 25 bp, Homo sapien
catttacctgtagtgctattgctgt

SEQ ID NO: 428409 - DNA, 25 bp, Homo sapien
gtagtgctattgctgttgatactat

SEQ ID NO: 428410 - DNA, 25 bp, Homo sapien
ttgatactatcacctataccctgtt

SEQ ID NO: 428411 - DNA, 25 bp, Homo sapien
ctataccctgtttctagtgagtgct

SEQ ID NO: 428412 - DNA, 25 bp, Homo sapien
gtgagtgctgaatacagtatggtac

SEQ ID NO: 428413 - DNA, 25 bp, Homo sapien
tctgggcagtgctgtggctctgcac

SEQ ID NO: 428414 - DNA, 25 bp, Homo sapien
tgtggctctgcacctttggcatgat

SEQ ID NO: 428415 - DNA, 25 bp, Homo sapien
gctggaggagcaggactctagccct

SEQ ID NO: 428416 - DNA, 25 bp, Homo sapien
ggaggagcaggactctagccctcca

SEQ ID NO: 428417 - DNA, 25 bp, Homo sapien
acagtccactccagggctcatgaag

SEQ ID NO: 428418 - DNA, 25 bp, Homo sapien
aggaggaggccctgatcgagttcca

SEQ ID NO: 428419 - DNA, 25 bp, Homo sapien
tggtgtgctcccagcacaaccgcat

SEQ ID NO: 428420 - DNA, 25 bp, Homo sapien
agcacaaccgcatgaagacggcctt

SEQ ID NO: 428421 - DNA, 25 bp, Homo sapien
aaccgcatgaagacggccttctggg

SEQ ID NO: 428422 - DNA, 25 bp, Homo sapien
atgaagacggccttctgggcagtgc

SEQ ID NO: 428423 - DNA, 25 bp, Homo sapien
aagacggccttctgggcagtgctgt

SEQ ID NO: 428424 - DNA, 25 bp, Homo sapien
aatctttttgtagtatgctacagat

SEQ ID NO: 428425 - DNA, 25 bp, Homo sapien
gtagtatgctacagatttaattata

SEQ ID NO: 428426 - DNA, 25 bp, Homo sapien
aactcttttttaagacattgaccat

SEQ ID NO: 428427 - DNA, 25 bp, Homo sapien
gacattgaccatgacttaacatttt

SEQ ID NO: 428428 - DNA, 25 bp, Homo sapien
gaccatgacttaacattttgccttc

SEQ ID NO: 428429 - DNA, 25 bp, Homo sapien
ttgccttctaacaccttttaaatct

SEQ ID NO: 428430 - DNA, 25 bp, Homo sapien
gccttctaacaccttttaaatctat

SEQ ID NO: 428431 - DNA, 25 bp, Homo sapien
aatctgtttgtaaaaggctatctct

SEQ ID NO: 428432 - DNA, 25 bp, Homo sapien
ctgtttgtaaaaggctatctctaag

SEQ ID NO: 428433 - DNA, 25 bp, Homo sapien
ctaagcctagtatgtgggtaatttt

SEQ ID NO: 428434 - DNA, 25 bp, Homo sapien
atgtgggtaattttacaggtgtgtt

SEQ ID NO: 428435 - DNA, 25 bp, Homo sapien
gggaatgtccctgtctgcacgacct

SEQ ID NO: 428436 - DNA, 25 bp, Homo sapien
tgtctgcacgacctgggactctgcc

SEQ ID NO: 428437 - DNA, 25 bp, Homo sapien
tgcccatgtgcttttgcctgtggaa

SEQ ID NO: 428438 - DNA, 25 bp, Homo sapien
agacgcggaccctggatagtggttc

SEQ ID NO: 428439 - DNA, 25 bp, Homo sapien
atagtggttctatgactctgcgagg

SEQ ID NO: 428440 - DNA, 25 bp, Homo sapien
tatgactctgcgagggacaggccca

SEQ ID NO: 428441 - DNA, 25 bp, Homo sapien
ctcaagagcttctgaaaaactaatg

SEQ ID NO: 428442 - DNA, 25 bp, Homo sapien
aaaactaatgactctgctgccttct

SEQ ID NO: 428443 - DNA, 25 bp, Homo sapien
tgctgccttctcctttgtctttgtt

SEQ ID NO: 428444 - DNA, 25 bp, Homo sapien
tttgtctttgtttcactctgtgttt

SEQ ID NO: 428445 - DNA, 25 bp, Homo sapien
tcactctgtgtttccaataaactca

SEQ ID NO: 428446 - DNA, 25 bp, Homo sapien
gcagcaggaaaccaattcgtgctca

SEQ ID NO: 428447 - DNA, 25 bp, Homo sapien
gcaggaaaccaattcgtgctcatgg

SEQ ID NO: 428448 - DNA, 25 bp, Homo sapien
ggaaaccaattcgtgctcatggaag

SEQ ID NO: 428449 - DNA, 25 bp, Homo sapien
aaccaattcgtgctcatggaagatg

SEQ ID NO: 428450 - DNA, 25 bp, Homo sapien
gctcatggaagatggcattcattag

SEQ ID NO: 428451 - DNA, 25 bp, Homo sapien
ggaagatggcattcattagcgtctg

SEQ ID NO: 428452 - DNA, 25 bp, Homo sapien
gatggcattcattagcgtctgccca

SEQ ID NO: 428453 - DNA, 25 bp, Homo sapien
tggcattcattagcgtctgcccaga

SEQ ID NO: 428454 - DNA, 25 bp, Homo sapien
cattcattagcgtctgcccagagaa

SEQ ID NO: 428455 - DNA, 25 bp, Homo sapien
tcattagcgtctgcccagagaaggt

SEQ ID NO: 428456 - DNA, 25 bp, Homo sapien
ttagcgtctgcccagagaaggttag

SEQ ID NO: 428457 - DNA, 25 bp, Homo sapien
ggctcaaggactgtacaagcagagt

SEQ ID NO: 428458 - DNA, 25 bp, Homo sapien
cgcctgttgggtttggtcctgtgta

SEQ ID NO: 428459 - DNA, 25 bp, Homo sapien
gtttggtcctgtgtagatgattccc

SEQ ID NO: 428460 - DNA, 25 bp, Homo sapien
tagatgattcccagagtctcattca

SEQ ID NO: 428461 - DNA, 25 bp, Homo sapien
cagctcctcttcagacagaaggtcc

SEQ ID NO: 428462 - DNA, 25 bp, Homo sapien
agaaggtccccatggtcagacagct

SEQ ID NO: 428463 - DNA, 25 bp, Homo sapien
acagctggtctgcattgctggtact

SEQ ID NO: 428464 - DNA, 25 bp, Homo sapien
tggtactggttgcatcatcctcatc

SEQ ID NO: 428465 - DNA, 25 bp, Homo sapien
tcatcctcagagctggcttcacagg

SEQ ID NO: 428466 - DNA, 25 bp, Homo sapien
gaagagctgcatgagttctcgaaaa

SEQ ID NO: 428467 - DNA, 25 bp, Homo sapien
ggagggctgtattcactgatcctta

SEQ ID NO: 428468 - DNA, 25 bp, Homo sapien
ggacagttggatcatttctcgtttg

SEQ ID NO: 428469 - DNA, 25 bp, Homo sapien
ttgtgtgtggctgtcgtcctgtcat

SEQ ID NO: 428470 - DNA, 25 bp, Homo sapien
ggctgtggtgaataacactgccata

SEQ ID NO: 428471 - DNA, 25 bp, Homo sapien
cactgccataaacatctcgtacttg

SEQ ID NO: 428472 - DNA, 25 bp, Homo sapien
atctcgtacttgagccatcattgat

SEQ ID NO: 428473 - DNA, 25 bp, Homo sapien
gtagggtatgcggactttcaactct

SEQ ID NO: 428474 - DNA, 25 bp, Homo sapien
ggactttcaactctaccacctgatg

SEQ ID NO: 428475 - DNA, 25 bp, Homo sapien
accacctgatgccaattttttcttt

SEQ ID NO: 428476 - DNA, 25 bp, Homo sapien
atttcactgttacttaggcaagctt

SEQ ID NO: 428477 - DNA, 25 bp, Homo sapien
ttaggcaagcttcatttgttcgttt

SEQ ID NO: 428478 - DNA, 25 bp, Homo sapien
ttgttcgttttactgttagtggaca

SEQ ID NO: 428479 - DNA, 25 bp, Homo sapien
gttctggagtgttcattcagagtga

SEQ ID NO: 428480 - DNA, 25 bp, Homo sapien
gagtgttcattcagagtgaagggaa

SEQ ID NO: 428481 - DNA, 25 bp, Homo sapien
tgaagggaaaactttatccttctat

SEQ ID NO: 428482 - DNA, 25 bp, Homo sapien
actttgcagttggatgaatagagaa

SEQ ID NO: 428483 - DNA, 25 bp, Homo sapien
gaggagctgttagcaaggcccactg

SEQ ID NO: 428484 - DNA, 25 bp, Homo sapien
aggagctgttagcaaggcccactgc

SEQ ID NO: 428485 - DNA, 25 bp, Homo sapien
gagctgttagcaaggcccactgctg

SEQ ID NO: 428486 - DNA, 25 bp, Homo sapien
agctgttagcaaggcccactgctgc

SEQ ID NO: 428487 - DNA, 25 bp, Homo sapien
cctgggtgagaagggagctctggag

SEQ ID NO: 428488 - DNA, 25 bp, Homo sapien
gggccggcactgctgcttagagtgg

SEQ ID NO: 428489 - DNA, 25 bp, Homo sapien
cttagagtggaggaggctggccaaa

SEQ ID NO: 428490 - DNA, 25 bp, Homo sapien
aaataacaccaatcctgagcctcag

SEQ ID NO: 428491 - DNA, 25 bp, Homo sapien
gagcctcagttccaaacagaagcca

SEQ ID NO: 428492 - DNA, 25 bp, Homo sapien
actgggccttcagctcatgaagaaa

SEQ ID NO: 428493 - DNA, 25 bp, Homo sapien
cagctcatgaagaaacatccaccag

SEQ ID NO: 428494 - DNA, 25 bp, Homo sapien
ggactctgctcttcaggacacagat

SEQ ID NO: 428495 - DNA, 25 bp, Homo sapien
gatgatgacccagtcctgatcccag

SEQ ID NO: 428496 - DNA, 25 bp, Homo sapien
agtcctgatcccaggtgcaaggtat

SEQ ID NO: 428497 - DNA, 25 bp, Homo sapien
ggacctggtgatagatttaatatca

SEQ ID NO: 428498 - DNA, 25 bp, Homo sapien
cagaggaacaacaataggtgataga

SEQ ID NO: 428499 - DNA, 25 bp, Homo sapien
gcccgtattcaggagttcttcagac

SEQ ID NO: 428500 - DNA, 25 bp, Homo sapien
ttcaggagttcttcagacggagaaa

SEQ ID NO: 428501 - DNA, 25 bp, Homo sapien
aagcacgcacattctacagctatgc

SEQ ID NO: 428502 - DNA, 25 bp, Homo sapien
ttctacagctatgcgatttgctcac

SEQ ID NO: 428503 - DNA, 25 bp, Homo sapien
gcgatttgctcactcggaattgcat

SEQ ID NO: 428504 - DNA, 25 bp, Homo sapien
ggaattgcattctggaaaactcctc

SEQ ID NO: 428505 - DNA, 25 bp, Homo sapien
agagtccccttgcagaacgccattt

SEQ ID NO: 428506 - DNA, 25 bp, Homo sapien
gcagaacgccatttgtgtctttagt

SEQ ID NO: 428507 - DNA, 25 bp, Homo sapien
gtctttagttggttgtagctgggaa

SEQ ID NO: 428508 - DNA, 25 bp, Homo sapien
aggaactccatcctaagacttctta

SEQ ID NO: 428509 - DNA, 25 bp, Homo sapien
tgaaactactgaccctcaaggatct

SEQ ID NO: 428510 - DNA, 25 bp, Homo sapien
ccaccacccaacctagaatatatat

SEQ ID NO: 428511 - DNA, 25 bp, Homo sapien
atcattgtttatttcacttgcttgc

SEQ ID NO: 428512 - DNA, 25 bp, Homo sapien
tgaaaataacaccaatcctgagcct

SEQ ID NO: 428513 - DNA, 25 bp, Homo sapien
aaaataacaccaatcctgagcctca

SEQ ID NO: 428514 - DNA, 25 bp, Homo sapien
aataacaccaatcctgagcctcagt

SEQ ID NO: 428515 - DNA, 25 bp, Homo sapien
ctgagcctcagttccaaacagaagc

SEQ ID NO: 428516 - DNA, 25 bp, Homo sapien
gagcctcagttccaaacagaagcca

SEQ ID NO: 428517 - DNA, 25 bp, Homo sapien
gcctcagttccaaacagaagccact

SEQ ID NO: 428518 - DNA, 25 bp, Homo sapien
ggactctgctcttcaggacacagat

SEQ ID NO: 428519 - DNA, 25 bp, Homo sapien
gactctgctcttcaggacacagatg

SEQ ID NO: 428520 - DNA, 25 bp, Homo sapien
actctgctcttcaggacacagatga

SEQ ID NO: 428521 - DNA, 25 bp, Homo sapien
tctgctcttcaggacacagatgaca

SEQ ID NO: 428522 - DNA, 25 bp, Homo sapien
caggagttcttcagacggagaaaag

SEQ ID NO: 428523 - DNA, 25 bp, Homo sapien
aaatggaaaatagggccctgttcat

SEQ ID NO: 428524 - DNA, 25 bp, Homo sapien
ggttctctgacaccatatgtcgaca

SEQ ID NO: 428525 - DNA, 25 bp, Homo sapien
catttcttcagtattatctctagga

SEQ ID NO: 428526 - DNA, 25 bp, Homo sapien
atctctaggatatgtttgaactttc

SEQ ID NO: 428527 - DNA, 25 bp, Homo sapien
gtgtagctagtaagttcctggtagt

SEQ ID NO: 428528 - DNA, 25 bp, Homo sapien
gttcctggtagtatcagtatgcatt

SEQ ID NO: 428529 - DNA, 25 bp, Homo sapien
gcattaatacacctgaagtcttcca

SEQ ID NO: 428530 - DNA, 25 bp, Homo sapien
ctgaagtcttccagtgatcctgtcc

SEQ ID NO: 428531 - DNA, 25 bp, Homo sapien
tgtcgacagactagtaagacgttct

SEQ ID NO: 428532 - DNA, 25 bp, Homo sapien
acttgcatttatctgtctgtaaagg

SEQ ID NO: 428533 - DNA, 25 bp, Homo sapien
tatctgtctgtaaaggcttgtatac

SEQ ID NO: 428534 - DNA, 25 bp, Homo sapien
gccggccggtcacgtgggcgtgttg

SEQ ID NO: 428535 - DNA, 25 bp, Homo sapien
gggtcatgacgcagcgagtttcagt

SEQ ID NO: 428536 - DNA, 25 bp, Homo sapien
ggtcatgacgcagcgagtttcagtc

SEQ ID NO: 428537 - DNA, 25 bp, Homo sapien
tcatgacgcagcgagtttcagtcgt

SEQ ID NO: 428538 - DNA, 25 bp, Homo sapien
atgacgcagcgagtttcagtcgtga

SEQ ID NO: 428539 - DNA, 25 bp, Homo sapien
gacgcagcgagtttcagtcgtgact

SEQ ID NO: 428540 - DNA, 25 bp, Homo sapien
acgcagcgagtttcagtcgtgactt

SEQ ID NO: 428541 - DNA, 25 bp, Homo sapien
gcagcgagtttcagtcgtgactttt

SEQ ID NO: 428542 - DNA, 25 bp, Homo sapien
agcgagtttcagtcgtgacttttct

SEQ ID NO: 428543 - DNA, 25 bp, Homo sapien
gcgagtttcagtcgtgacttttctg

SEQ ID NO: 428544 - DNA, 25 bp, Homo sapien
gagtttcagtcgtgacttttctggg

SEQ ID NO: 428545 - DNA, 25 bp, Homo sapien
gcttgcgcaccgacactgaacacag

SEQ ID NO: 428546 - DNA, 25 bp, Homo sapien
gaacacagcggtgtaaccgataccc

SEQ ID NO: 428547 - DNA, 25 bp, Homo sapien
gataccccgggacataatttgtgaa

SEQ ID NO: 428548 - DNA, 25 bp, Homo sapien
tcaagctatgcatccaacgcgttgg

SEQ ID NO: 428549 - DNA, 25 bp, Homo sapien
tgaatttctcgcttcaatgcctcga

SEQ ID NO: 428550 - DNA, 25 bp, Homo sapien
aatgcctcgattttatcgccagcta

SEQ ID NO: 428551 - DNA, 25 bp, Homo sapien
ttatcgccagctacgtcggcattgg

SEQ ID NO: 428552 - DNA, 25 bp, Homo sapien
acgtcggcattggtcaggacgacct

SEQ ID NO: 428553 - DNA, 25 bp, Homo sapien
gggaatcctggcatcgctaccgagc

SEQ ID NO: 428554 - DNA, 25 bp, Homo sapien
ggcatcgctaccgagccgctggatg

SEQ ID NO: 428555 - DNA, 25 bp, Homo sapien
gtcgacaggcttccacgcttgcgca

SEQ ID NO: 428556 - DNA, 25 bp, Homo sapien
gggttagagatattcaagggtagtt

SEQ ID NO: 428557 - DNA, 25 bp, Homo sapien
gttagagatattcaagggtagtttc

SEQ ID NO: 428558 - DNA, 25 bp, Homo sapien
ttagagatattcaagggtagtttca

SEQ ID NO: 428559 - DNA, 25 bp, Homo sapien
tagagatattcaagggtagtttcag

SEQ ID NO: 428560 - DNA, 25 bp, Homo sapien
agagatattcaagggtagtttcagg

SEQ ID NO: 428561 - DNA, 25 bp, Homo sapien
agatattcaagggtagtttcaggag

SEQ ID NO: 428562 - DNA, 25 bp, Homo sapien
gatattcaagggtagtttcaggagc

SEQ ID NO: 428563 - DNA, 25 bp, Homo sapien
atattcaagggtagtttcaggagca

SEQ ID NO: 428564 - DNA, 25 bp, Homo sapien
tattcaagggtagtttcaggagcac

SEQ ID NO: 428565 - DNA, 25 bp, Homo sapien
attcaagggtagtttcaggagcaca

SEQ ID NO: 428566 - DNA, 25 bp, Homo sapien
ttcaagggtagtttcaggagcacag

SEQ ID NO: 428567 - DNA, 25 bp, Homo sapien
agctctctccatataaaccctcaag

SEQ ID NO: 428568 - DNA, 25 bp, Homo sapien
ctctctccatataaaccctcaagat

SEQ ID NO: 428569 - DNA, 25 bp, Homo sapien
aaaccctcaagattatgtcaattgg

SEQ ID NO: 428570 - DNA, 25 bp, Homo sapien
atgtcaattggttagagccagccgg

SEQ ID NO: 428571 - DNA, 25 bp, Homo sapien
tggttagagccagccgggaatttcg

SEQ ID NO: 428572 - DNA, 25 bp, Homo sapien
cgggaatttcgtgcgggtgctgaag

SEQ ID NO: 428573 - DNA, 25 bp, Homo sapien
aaggaagagtagctccttcttcttc

SEQ ID NO: 428574 - DNA, 25 bp, Homo sapien
gagccggagaagaatgaaactgcgt

SEQ ID NO: 428575 - DNA, 25 bp, Homo sapien
ggaagagtagctccttcttcttctt

SEQ ID NO: 428576 - DNA, 25 bp, Homo sapien
tttcttccactcttaaaaagcttct

SEQ ID NO: 428577 - DNA, 25 bp, Homo sapien
cactcttaaaaagcttctttctctt

SEQ ID NO: 428578 - DNA, 25 bp, Homo sapien
aagaattgctgctactttgtgcaag

SEQ ID NO: 428579 - DNA, 25 bp, Homo sapien
gctactttgtgcaagaactttgaag

SEQ ID NO: 428580 - DNA, 25 bp, Homo sapien
gaaggtcaaattaggcaaattccag

SEQ ID NO: 428581 - DNA, 25 bp, Homo sapien
ttctctctagtttacttgtgtgtgc

SEQ ID NO: 428582 - DNA, 25 bp, Homo sapien
acttgtgtgtgcatacatctcatcc

SEQ ID NO: 428583 - DNA, 25 bp, Homo sapien
gtgtgcatacatctcatccacaggg

SEQ ID NO: 428584 - DNA, 25 bp, Homo sapien
aaagatggtcacacaaacagtttcc

SEQ ID NO: 428585 - DNA, 25 bp, Homo sapien
ggtcacacaaacagtttccataaag

SEQ ID NO: 428586 - DNA, 25 bp, Homo sapien
cattatacttctgacctttgggctt

SEQ ID NO: 428587 - DNA, 25 bp, Homo sapien
tacttctgacctttgggctttcttt

SEQ ID NO: 428588 - DNA, 25 bp, Homo sapien
aaagtgtacactactgatgctgttt

SEQ ID NO: 428589 - DNA, 25 bp, Homo sapien
ttcttctgaactgatctactgctgc

SEQ ID NO: 428590 - DNA, 25 bp, Homo sapien
tgaactgatctactgctgcagtgga

SEQ ID NO: 428591 - DNA, 25 bp, Homo sapien
gcaggaagtatgtatccctttctga

SEQ ID NO: 428592 - DNA, 25 bp, Homo sapien
caaaatggcagcttatgggcagcca

SEQ ID NO: 428593 - DNA, 25 bp, Homo sapien
tgggcagccaggaaatcttcttatg

SEQ ID NO: 428594 - DNA, 25 bp, Homo sapien
tcttcttatggccagctacaattgc

SEQ ID NO: 428595 - DNA, 25 bp, Homo sapien
tatggccagctacaattgctcacac

SEQ ID NO: 428596 - DNA, 25 bp, Homo sapien
gctacaattgctcacacatctggag

SEQ ID NO: 428597 - DNA, 25 bp, Homo sapien
gtatgtatccctttctgatgcaaat

SEQ ID NO: 428598 - DNA, 25 bp, Homo sapien
tttaaatagcaaccatttgtttctg

SEQ ID NO: 428599 - DNA, 25 bp, Homo sapien
tttctgttggcattcttgctgggaa

SEQ ID NO: 428600 - DNA, 25 bp, Homo sapien
agggacccctgactgaatcctggaa

SEQ ID NO: 428601 - DNA, 25 bp, Homo sapien
gacccctgactgaatcctggaaaga

SEQ ID NO: 428602 - DNA, 25 bp, Homo sapien
gaaagatggcaaccccctgaagaag

SEQ ID NO: 428603 - DNA, 25 bp, Homo sapien
cattatgcaaccctcagcttccata

SEQ ID NO: 428604 - DNA, 25 bp, Homo sapien
ctcagcttccataaagtgaagcctc

SEQ ID NO: 428605 - DNA, 25 bp, Homo sapien
agtgaagcctcaggacccgcaggga

SEQ ID NO: 428606 - DNA, 25 bp, Homo sapien
actgacagtgaatactcggagatca

SEQ ID NO: 428607 - DNA, 25 bp, Homo sapien
caagatccacaagcgagaaactgca

SEQ ID NO: 428608 - DNA, 25 bp, Homo sapien
caggcctgtttgaggaatcacaacc

SEQ ID NO: 428609 - DNA, 25 bp, Homo sapien
gtttgaggaatcacaacccctccag

SEQ ID NO: 428610 - DNA, 25 bp, Homo sapien
gaggaatcacaacccctccagcaaa

SEQ ID NO: 428611 - DNA, 25 bp, Homo sapien
agatttctctataataagccacaca

SEQ ID NO: 428612 - DNA, 25 bp, Homo sapien
aataagccacacattatatttagac

SEQ ID NO: 428613 - DNA, 25 bp, Homo sapien
tttagactatattaagggaccttgg

SEQ ID NO: 428614 - DNA, 25 bp, Homo sapien
ccttggttttcttctagatagcagc

SEQ ID NO: 428615 - DNA, 25 bp, Homo sapien
gttttcttctagatagcagctgtcc

SEQ ID NO: 428616 - DNA, 25 bp, Homo sapien
gatttagctattatctgccagttgt

SEQ ID NO: 428617 - DNA, 25 bp, Homo sapien
ttatctgccagttgttaagaggttt

SEQ ID NO: 428618 - DNA, 25 bp, Homo sapien
agcaatgttgagagctgaacttaag

SEQ ID NO: 428619 - DNA, 25 bp, Homo sapien
catctgttactgtccttcattcttg

SEQ ID NO: 428620 - DNA, 25 bp, Homo sapien
ttcttggctccctactatctataaa

SEQ ID NO: 428621 - DNA, 25 bp, Homo sapien
ctactatctataaacagctgctgtg

SEQ ID NO: 428622 - DNA, 25 bp, Homo sapien
gcatcccacatgacctttgtcataa

SEQ ID NO: 428623 - DNA, 25 bp, Homo sapien
agtgaactggctgacttgatggaat

SEQ ID NO: 428624 - DNA, 25 bp, Homo sapien
ggaatcatgttcaagtggcatctgt

SEQ ID NO: 428625 - DNA, 25 bp, Homo sapien
gtggcatctgtaaactattatcccc

SEQ ID NO: 428626 - DNA, 25 bp, Homo sapien
aatgtaactccattggggctttcca

SEQ ID NO: 428627 - DNA, 25 bp, Homo sapien
tttccaggccggatgccatagtgga

SEQ ID NO: 428628 - DNA, 25 bp, Homo sapien
gatgccatagtggaacatccagaag

SEQ ID NO: 428629 - DNA, 25 bp, Homo sapien
atccagaagggcaactgtctactgt

SEQ ID NO: 428630 - DNA, 25 bp, Homo sapien
agggcaactgtctactgtctgctta

SEQ ID NO: 428631 - DNA, 25 bp, Homo sapien
aactgtctactgtctgcttatttaa

SEQ ID NO: 428632 - DNA, 25 bp, Homo sapien
actgtctgcttatttaagtgactat

SEQ ID NO: 428633 - DNA, 25 bp, Homo sapien
tgtctccataaaagtcctgtcacca

SEQ ID NO: 428634 - DNA, 25 bp, Homo sapien
gttaaaggcattttattccagcgtc

SEQ ID NO: 428635 - DNA, 25 bp, Homo sapien
ttttattccagcgtcttctagagag

SEQ ID NO: 428636 - DNA, 25 bp, Homo sapien
gcgtcttctagagagcttagtgtat

SEQ ID NO: 428637 - DNA, 25 bp, Homo sapien
gtgtatacagatgagggtgtccgct

SEQ ID NO: 428638 - DNA, 25 bp, Homo sapien
tttccttcggaatccagtgcttcca

SEQ ID NO: 428639 - DNA, 25 bp, Homo sapien
gtgcttccacagagattagcctgta

SEQ ID NO: 428640 - DNA, 25 bp, Homo sapien
gcttatatttgacattcttcactgt

SEQ ID NO: 428641 - DNA, 25 bp, Homo sapien
ttcactgtctgttgtttacctaccg

SEQ ID NO: 428642 - DNA, 25 bp, Homo sapien
tctgttgtttacctaccgtagcttt

SEQ ID NO: 428643 - DNA, 25 bp, Homo sapien
ccttccaactatgtccagatgtgca

SEQ ID NO: 428644 - DNA, 25 bp, Homo sapien
aaaactgcacaaagcattcacttta

SEQ ID NO: 428645 - DNA, 25 bp, Homo sapien
gcattcactttattgattgagtaca

SEQ ID NO: 428646 - DNA, 25 bp, Homo sapien
atgctttagtgtttctacctaagta

SEQ ID NO: 428647 - DNA, 25 bp, Homo sapien
aagtattagtacatctgttcaggaa

SEQ ID NO: 428648 - DNA, 25 bp, Homo sapien
taaatttgttttatcagctgaggtt

SEQ ID NO: 428649 - DNA, 25 bp, Homo sapien
tcagctgaggttgtggaggattttt

SEQ ID NO: 428650 - DNA, 25 bp, Homo sapien
ggaggatttttgtccactgatcttt

SEQ ID NO: 428651 - DNA, 25 bp, Homo sapien
tgtccactgatcttttgcaacagaa

SEQ ID NO: 428652 - DNA, 25 bp, Homo sapien
gaaaagcatactttgtcagcttcta

SEQ ID NO: 428653 - DNA, 25 bp, Homo sapien
gtcagcttctaataagatagccagg

SEQ ID NO: 428654 - DNA, 25 bp, Homo sapien
gatctcttggtaacaattgacattg

SEQ ID NO: 428655 - DNA, 25 bp, Homo sapien
tgacctgatggccacctcggaaaat

SEQ ID NO: 428656 - DNA, 25 bp, Homo sapien
tggccacctcggaaaatgacagcct

SEQ ID NO: 428657 - DNA, 25 bp, Homo sapien
aaatgacagcctggcagatttgtgt

SEQ ID NO: 428658 - DNA, 25 bp, Homo sapien
atttgtgtgtaagagctcttccacc

SEQ ID NO: 428659 - DNA, 25 bp, Homo sapien
cacccttgctggttggtacttggga

SEQ ID NO: 428660 - DNA, 25 bp, Homo sapien
ggtacttgggaactctgatggcact

SEQ ID NO: 428661 - DNA, 25 bp, Homo sapien
aactctgatggcactatgcatggca

SEQ ID NO: 428662 - DNA, 25 bp, Homo sapien
gggtttatgggcctcatgctgcctc

SEQ ID NO: 428663 - DNA, 25 bp, Homo sapien
atgctgcctcctagagcaactgtgg

SEQ ID NO: 428664 - DNA, 25 bp, Homo sapien
agcaactgtggccatagctagctgc

SEQ ID NO: 428665 - DNA, 25 bp, Homo sapien
aagccgggtgacctgatggccacct

SEQ ID NO: 428666 - DNA, 25 bp, Homo sapien
gaatagtccaggcacgttcactgat

SEQ ID NO: 428667 - DNA, 25 bp, Homo sapien
gttcactgattatagtggcccaaga

SEQ ID NO: 428668 - DNA, 25 bp, Homo sapien
ataccactaatttcaccaaagcatg

SEQ ID NO: 428669 - DNA, 25 bp, Homo sapien
aaagcatggcatgggcttttgcatc

SEQ ID NO: 428670 - DNA, 25 bp, Homo sapien
gcatcaaattttttggcctcatttc

SEQ ID NO: 428671 - DNA, 25 bp, Homo sapien
gcctcatttcatgcaaacgaagtga

SEQ ID NO: 428672 - DNA, 25 bp, Homo sapien
attgaccaatgcttcctgatttctc

SEQ ID NO: 428673 - DNA, 25 bp, Homo sapien
gtaattattcactatcactgttgtt

SEQ ID NO: 428674 - DNA, 25 bp, Homo sapien
cactgttgttgatcttgggtcttat

SEQ ID NO: 428675 - DNA, 25 bp, Homo sapien
ttgggtcttatctatctcatcttct

SEQ ID NO: 428676 - DNA, 25 bp, Homo sapien
tctcatcttctcttgggaacttagg

SEQ ID NO: 428677 - DNA, 25 bp, Homo sapien
taattcacacaaacttaaactttag

SEQ ID NO: 428678 - DNA, 25 bp, Homo sapien
tcacacaaacttaaactttagtggt

SEQ ID NO: 428679 - DNA, 25 bp, Homo sapien
cacacaaacttaaactttagtggtg

SEQ ID NO: 428680 - DNA, 25 bp, Homo sapien
tgaagaaagcatttcacatacctgt

SEQ ID NO: 428681 - DNA, 25 bp, Homo sapien
tcacatacctgttttggggtcctcc

SEQ ID NO: 428682 - DNA, 25 bp, Homo sapien
cccatttttcctaactctgcacaga

SEQ ID NO: 428683 - DNA, 25 bp, Homo sapien
ccatttttcctaactctgcacagaa

SEQ ID NO: 428684 - DNA, 25 bp, Homo sapien
catttttcctaactctgcacagaaa

SEQ ID NO: 428685 - DNA, 25 bp, Homo sapien
atttttcctaactctgcacagaaat

SEQ ID NO: 428686 - DNA, 25 bp, Homo sapien
tttcctaactctgcacagaaattag

SEQ ID NO: 428687 - DNA, 25 bp, Homo sapien
cctaactctgcacagaaattagaag

SEQ ID NO: 428688 - DNA, 25 bp, Homo sapien
gtcttacattcccactgtacatcat

SEQ ID NO: 428689 - DNA, 25 bp, Homo sapien
ccagcctttgttctgacactgtatg

SEQ ID NO: 428690 - DNA, 25 bp, Homo sapien
tgtgcctccaacacatttcaactgt

SEQ ID NO: 428691 - DNA, 25 bp, Homo sapien
ccaacacatttcaactgtgggatgg

SEQ ID NO: 428692 - DNA, 25 bp, Homo sapien
gggtaagagcttttacatcccgcag

SEQ ID NO: 428693 - DNA, 25 bp, Homo sapien
atcccgcagcaacattctgtcaggg

SEQ ID NO: 428694 - DNA, 25 bp, Homo sapien
aacattctgtcagggtcgttccagc

SEQ ID NO: 428695 - DNA, 25 bp, Homo sapien
ctgtcagggtcgttccagcccaggg

SEQ ID NO: 428696 - DNA, 25 bp, Homo sapien
gggcccgcggtcagcagaaacaaat

SEQ ID NO: 428697 - DNA, 25 bp, Homo sapien
gaaacaaatgcaagccgaggagcaa

SEQ ID NO: 428698 - DNA, 25 bp, Homo sapien
gaggagcaagcagtacccggccgct

SEQ ID NO: 428699 - DNA, 25 bp, Homo sapien
cccagggataactggcaaggcgact

SEQ ID NO: 428700 - DNA, 25 bp, Homo sapien
gggactatatcttggcctcatctgt

SEQ ID NO: 428701 - DNA, 25 bp, Homo sapien
gaagcctaaggctagagtccctata

SEQ ID NO: 428702 - DNA, 25 bp, Homo sapien
ggctagagtccctatatgattaaat

SEQ ID NO: 428703 - DNA, 25 bp, Homo sapien
tgaaacaaacttctcccatgaaacg

SEQ ID NO: 428704 - DNA, 25 bp, Homo sapien
aaacttctcccatgaaacgcaaaga

SEQ ID NO: 428705 - DNA, 25 bp, Homo sapien
taccctagcccaaagacgagaggtt

SEQ ID NO: 428706 - DNA, 25 bp, Homo sapien
agacgagaggtttgctttccagaat

SEQ ID NO: 428707 - DNA, 25 bp, Homo sapien
gaggtttgctttccagaatagatga

SEQ ID NO: 428708 - DNA, 25 bp, Homo sapien
gaatagatgaaccagagggcctctg

SEQ ID NO: 428709 - DNA, 25 bp, Homo sapien
gggagcaccccagggataactggca

SEQ ID NO: 428710 - DNA, 25 bp, Homo sapien
gatggtcagtaggacagaaggtaac

SEQ ID NO: 428711 - DNA, 25 bp, Homo sapien
gactcgctcattggtggaaatgcct

SEQ ID NO: 428712 - DNA, 25 bp, Homo sapien
attggtggaaatgcctccgctgaag

SEQ ID NO: 428713 - DNA, 25 bp, Homo sapien
aaatgcctccgctgaaggccccgag

SEQ ID NO: 428714 - DNA, 25 bp, Homo sapien
cgagggcgaaggtaccgaaagcaca

SEQ ID NO: 428715 - DNA, 25 bp, Homo sapien
aagcacagtaatcactggtgtcgat

SEQ ID NO: 428716 - DNA, 25 bp, Homo sapien
cactggtgtcgatattgtcatgaac

SEQ ID NO: 428717 - DNA, 25 bp, Homo sapien
tattgtcatgaaccatcacctgcag

SEQ ID NO: 428718 - DNA, 25 bp, Homo sapien
gtcatgaaccatcacctgcaggaaa

SEQ ID NO: 428719 - DNA, 25 bp, Homo sapien
ccacgatgagatgttctccgacatc

SEQ ID NO: 428720 - DNA, 25 bp, Homo sapien
atgttctccgacatctacaagatcc

SEQ ID NO: 428721 - DNA, 25 bp, Homo sapien
gaattaattgattactgctttttaa

SEQ ID NO: 428722 - DNA, 25 bp, Homo sapien
aaaacattccccagtgcctaaggct

SEQ ID NO: 428723 - DNA, 25 bp, Homo sapien
aacattccccagtgcctaaggctaa

SEQ ID NO: 428724 - DNA, 25 bp, Homo sapien
attccccagtgcctaaggctaacag

SEQ ID NO: 428725 - DNA, 25 bp, Homo sapien
agtgcctaaggctaacagacgtggg

SEQ ID NO: 428726 - DNA, 25 bp, Homo sapien
tttccacagagcaatcctcatcttc

SEQ ID NO: 428727 - DNA, 25 bp, Homo sapien
ttctgttccttctgttgtcactggt

SEQ ID NO: 428728 - DNA, 25 bp, Homo sapien
cttctgttgtcactggtgaaagacg

SEQ ID NO: 428729 - DNA, 25 bp, Homo sapien
gtgaaagacgacttggtgcccaatt

SEQ ID NO: 428730 - DNA, 25 bp, Homo sapien
agacgacttggtgcccaatttctaa

SEQ ID NO: 428731 - DNA, 25 bp, Homo sapien
cttggtgcccaatttctaataaaca

SEQ ID NO: 428732 - DNA, 25 bp, Homo sapien
ggcgagggcgcccagtccctcacca

SEQ ID NO: 428733 - DNA, 25 bp, Homo sapien
agtccctcaccatcggctgcacatc

SEQ ID NO: 428734 - DNA, 25 bp, Homo sapien
atcggctgcacatcgcgccctcggg

SEQ ID NO: 428735 - DNA, 25 bp, Homo sapien
tccctggtgctactgacctctcaag

SEQ ID NO: 428736 - DNA, 25 bp, Homo sapien
ccctggtgctactgacctctcaagg

SEQ ID NO: 428737 - DNA, 25 bp, Homo sapien
ctggtgctactgacctctcaaggct

SEQ ID NO: 428738 - DNA, 25 bp, Homo sapien
tggtgctactgacctctcaaggctt

SEQ ID NO: 428739 - DNA, 25 bp, Homo sapien
ggtgctactgacctctcaaggcttc

SEQ ID NO: 428740 - DNA, 25 bp, Homo sapien
gtgctactgacctctcaaggcttcc

SEQ ID NO: 428741 - DNA, 25 bp, Homo sapien
tgctactgacctctcaaggcttcct

SEQ ID NO: 428742 - DNA, 25 bp, Homo sapien
gctactgacctctcaaggcttcctc

SEQ ID NO: 428743 - DNA, 25 bp, Homo sapien
gaagctttgctttaagtgacactac

SEQ ID NO: 428744 - DNA, 25 bp, Homo sapien
gtgacactacgcgtgcagttcattt

SEQ ID NO: 428745 - DNA, 25 bp, Homo sapien
gcgtgcagttcatttctagttcttg

SEQ ID NO: 428746 - DNA, 25 bp, Homo sapien
gttcttgatagaactgcacttaatt

SEQ ID NO: 428747 - DNA, 25 bp, Homo sapien
gtagtcttgactttttaagggctgt

SEQ ID NO: 428748 - DNA, 25 bp, Homo sapien
gattggaaattcctttagtgtcagt

SEQ ID NO: 428749 - DNA, 25 bp, Homo sapien
ggctgtgttatattaagttctccct

SEQ ID NO: 428750 - DNA, 25 bp, Homo sapien
tatattaagttctcccttactgtta

SEQ ID NO: 428751 - DNA, 25 bp, Homo sapien
tttctaagacagtcctctggatcct

SEQ ID NO: 428752 - DNA, 25 bp, Homo sapien
ttttggaagccaatgatgtttgcca

SEQ ID NO: 428753 - DNA, 25 bp, Homo sapien
gtttgccactgatacattcatagaa

SEQ ID NO: 428754 - DNA, 25 bp, Homo sapien
actgccatatgaggatgcagcacaa

SEQ ID NO: 428755 - DNA, 25 bp, Homo sapien
gcacaaatatggtgggtgtctataa

SEQ ID NO: 428756 - DNA, 25 bp, Homo sapien
aaatgggctctcaccaaaacctgat

SEQ ID NO: 428757 - DNA, 25 bp, Homo sapien
tctcaccaaaacctgatcctgctga

SEQ ID NO: 428758 - DNA, 25 bp, Homo sapien
aaaacctgatcctgctgacaccctg

SEQ ID NO: 428759 - DNA, 25 bp, Homo sapien
ggtctgttatttataagttattcag

SEQ ID NO: 428760 - DNA, 25 bp, Homo sapien
agcagcctgagatgactaagacaca

SEQ ID NO: 428761 - DNA, 25 bp, Homo sapien
gagatgactaagacacagccagttt

SEQ ID NO: 428762 - DNA, 25 bp, Homo sapien
ggcagaggccccataaataggatta

SEQ ID NO: 428763 - DNA, 25 bp, Homo sapien
gaggccccataaataggattaacat

SEQ ID NO: 428764 - DNA, 25 bp, Homo sapien
tccttattaaaaagacctggagacg

SEQ ID NO: 428765 - DNA, 25 bp, Homo sapien
ttgcctgctttacccacaactgctg

SEQ ID NO: 428766 - DNA, 25 bp, Homo sapien
tgcctgctttacccacaactgctgg

SEQ ID NO: 428767 - DNA, 25 bp, Homo sapien
gcctgctttacccacaactgctggg

SEQ ID NO: 428768 - DNA, 25 bp, Homo sapien
cctgctttacccacaactgctgggt

SEQ ID NO: 428769 - DNA, 25 bp, Homo sapien
ctgctttacccacaactgctgggtc

SEQ ID NO: 428770 - DNA, 25 bp, Homo sapien
tgctttacccacaactgctgggtcc

SEQ ID NO: 428771 - DNA, 25 bp, Homo sapien
gctttacccacaactgctgggtcct

SEQ ID NO: 428772 - DNA, 25 bp, Homo sapien
ctttacccacaactgctgggtcctg

SEQ ID NO: 428773 - DNA, 25 bp, Homo sapien
tgtctctgtgtttgtggactggatt

SEQ ID NO: 428774 - DNA, 25 bp, Homo sapien
gtctctgtgtttgtggactggattc

SEQ ID NO: 428775 - DNA, 25 bp, Homo sapien
ctcccacttcattctgactggcaag

SEQ ID NO: 428776 - DNA, 25 bp, Homo sapien
acttcattctgactggcaagccctg

SEQ ID NO: 428777 - DNA, 25 bp, Homo sapien
gactggcaagccctgtcctgcacag

SEQ ID NO: 428778 - DNA, 25 bp, Homo sapien
tggcaagccctgtcctgcacagctt

SEQ ID NO: 428779 - DNA, 25 bp, Homo sapien
gagtttctgaagacagtgtctccct

SEQ ID NO: 428780 - DNA, 25 bp, Homo sapien
gaaaggcacagaaatcatctggagt

SEQ ID NO: 428781 - DNA, 25 bp, Homo sapien
gcacagaaatcatctggagttgcca

SEQ ID NO: 428782 - DNA, 25 bp, Homo sapien
gaaatcatctggagttgccactcct

SEQ ID NO: 428783 - DNA, 25 bp, Homo sapien
aaatcatctggagttgccactcctg

SEQ ID NO: 428784 - DNA, 25 bp, Homo sapien
ctcactgctcactgccatggtgtat

SEQ ID NO: 428785 - DNA, 25 bp, Homo sapien
actgccatggtgtatctgcctctct

SEQ ID NO: 428786 - DNA, 25 bp, Homo sapien
agaattccagctttgggccgcactg

SEQ ID NO: 428787 - DNA, 25 bp, Homo sapien
aattccagctttgggccgcactgta

SEQ ID NO: 428788 - DNA, 25 bp, Homo sapien
agctttgggccgcactgtacagcag

SEQ ID NO: 428789 - DNA, 25 bp, Homo sapien
gggccgcactgtacagcagtctgga

SEQ ID NO: 428790 - DNA, 25 bp, Homo sapien
cgcactgtacagcagtctggataga

SEQ ID NO: 428791 - DNA, 25 bp, Homo sapien
agcagcacctatcctggctcttggt

SEQ ID NO: 428792 - DNA, 25 bp, Homo sapien
gtcctggcctgcagccaagtgctgt

SEQ ID NO: 428793 - DNA, 25 bp, Homo sapien
agccaagtgctgttcctagcctgag

SEQ ID NO: 428794 - DNA, 25 bp, Homo sapien
aagtgctgttcctagcctgaggctt

SEQ ID NO: 428795 - DNA, 25 bp, Homo sapien
gttcctagcctgaggcttgagacag

SEQ ID NO: 428796 - DNA, 25 bp, Homo sapien
acaggtggggttggctcctcaccaa

SEQ ID NO: 428797 - DNA, 25 bp, Homo sapien
tctgttgatttctctgatggctgct

SEQ ID NO: 428798 - DNA, 25 bp, Homo sapien
gctgctgttcagctgatctggaaac

SEQ ID NO: 428799 - DNA, 25 bp, Homo sapien
attgtgagcatcgttacttcctgta

SEQ ID NO: 428800 - DNA, 25 bp, Homo sapien
cctgtatctgatgcctgcttgggta

SEQ ID NO: 428801 - DNA, 25 bp, Homo sapien
gcttgggtaggctttttggctctgt

SEQ ID NO: 428802 - DNA, 25 bp, Homo sapien
ctgtgtgttcttttggctttccttc

SEQ ID NO: 428803 - DNA, 25 bp, Homo sapien
tccttcttgggattttttctcatga

SEQ ID NO: 428804 - DNA, 25 bp, Homo sapien
tttctcatgaaccacagacagcttg

SEQ ID NO: 428805 - DNA, 25 bp, Homo sapien
agcttggttgactgtgacttcttct

SEQ ID NO: 428806 - DNA, 25 bp, Homo sapien
gacttcttctcaggttctgttttta

SEQ ID NO: 428807 - DNA, 25 bp, Homo sapien
gaagatgtggtccttccatctgttg

SEQ ID NO: 428808 - DNA, 25 bp, Homo sapien
gggacccaacatcccgaatctaatt

SEQ ID NO: 428809 - DNA, 25 bp, Homo sapien
gaaatgacgtgtttgccaaattctc

SEQ ID NO: 428810 - DNA, 25 bp, Homo sapien
gtgtttgccaaattctcagcgttta

SEQ ID NO: 428811 - DNA, 25 bp, Homo sapien
tgccaaattctcagcgtttataaaa

SEQ ID NO: 428812 - DNA, 25 bp, Homo sapien
cacgaagaaggatgcaaatgagatt

SEQ ID NO: 428813 - DNA, 25 bp, Homo sapien
attacttaaatagccctctgcctga

SEQ ID NO: 428814 - DNA, 25 bp, Homo sapien
taaatagccctctgcctgatgaaat

SEQ ID NO: 428815 - DNA, 25 bp, Homo sapien
tagccctctgcctgatgaaatagat

SEQ ID NO: 428816 - DNA, 25 bp, Homo sapien
tgaaatagatgcctacagcaccgag

SEQ ID NO: 428817 - DNA, 25 bp, Homo sapien
ggatgtcactgtttctggaaggaag

SEQ ID NO: 428818 - DNA, 25 bp, Homo sapien
tcactgtttctggaaggaagtttct

SEQ ID NO: 428819 - DNA, 25 bp, Homo sapien
aatctgacagtttttacctttgtga

SEQ ID NO: 428820 - DNA, 25 bp, Homo sapien
tacctttgtgatttcttctatctct

SEQ ID NO: 428821 - DNA, 25 bp, Homo sapien
ttcttctatctcttacaaagtttta

SEQ ID NO: 428822 - DNA, 25 bp, Homo sapien
aataatacattcatttactccaggg

SEQ ID NO: 428823 - DNA, 25 bp, Homo sapien
tacattcatttactccagggatcag

SEQ ID NO: 428824 - DNA, 25 bp, Homo sapien
ttcatttactccagggatcagcaaa

SEQ ID NO: 428825 - DNA, 25 bp, Homo sapien
ggatcagcaaactttatctgtaagg

SEQ ID NO: 428826 - DNA, 25 bp, Homo sapien
gcaaactttatctgtaagggaccag

SEQ ID NO: 428827 - DNA, 25 bp, Homo sapien
gctctggtggagcaaaagcacccac

SEQ ID NO: 428828 - DNA, 25 bp, Homo sapien
ggagcaaaagcacccacataatatg

SEQ ID NO: 428829 - DNA, 25 bp, Homo sapien
gaatgtggcaatgttcaaataaaac

SEQ ID NO: 428830 - DNA, 25 bp, Homo sapien
ctcccacttcattctgactggcaag

SEQ ID NO: 428831 - DNA, 25 bp, Homo sapien
tcccacttcattctgactggcaagc

SEQ ID NO: 428832 - DNA, 25 bp, Homo sapien
cccacttcattctgactggcaagcc

SEQ ID NO: 428833 - DNA, 25 bp, Homo sapien
cacttcattctgactggcaagccct

SEQ ID NO: 428834 - DNA, 25 bp, Homo sapien
acttcattctgactggcaagccctg

SEQ ID NO: 428835 - DNA, 25 bp, Homo sapien
tctgactggcaagccctgtcctgca

SEQ ID NO: 428836 - DNA, 25 bp, Homo sapien
ctgactggcaagccctgtcctgcac

SEQ ID NO: 428837 - DNA, 25 bp, Homo sapien
cagtgtctccctcactgctcactgc

SEQ ID NO: 428838 - DNA, 25 bp, Homo sapien
agtgtctccctcactgctcactgcc

SEQ ID NO: 428839 - DNA, 25 bp, Homo sapien
gtgtctccctcactgctcactgcca

SEQ ID NO: 428840 - DNA, 25 bp, Homo sapien
gacattgccaaatgagtaagcactt

SEQ ID NO: 428841 - DNA, 25 bp, Homo sapien
aagcacttaattcgctgcttctgag

SEQ ID NO: 428842 - DNA, 25 bp, Homo sapien
tgcttctgagacttctctgtcaaaa

SEQ ID NO: 428843 - DNA, 25 bp, Homo sapien
ttctctgtcaaaacagccccactga

SEQ ID NO: 428844 - DNA, 25 bp, Homo sapien
acagccccactgataatattagaca

SEQ ID NO: 428845 - DNA, 25 bp, Homo sapien
gaagctcatgaggagctcggcttaa

SEQ ID NO: 428846 - DNA, 25 bp, Homo sapien
ggagctcggcttaaaatgtctttga

SEQ ID NO: 428847 - DNA, 25 bp, Homo sapien
taaaatgtctttgatgtctcttcct

SEQ ID NO: 428848 - DNA, 25 bp, Homo sapien
gatgtctcttcctttgtctcaaaaa

SEQ ID NO: 428849 - DNA, 25 bp, Homo sapien
atattactatctgcatttgttttaa

SEQ ID NO: 428850 - DNA, 25 bp, Homo sapien
ttgctgcctacctttttctcccaaa

SEQ ID NO: 428851 - DNA, 25 bp, Homo sapien
ggtgttctgagaattccagctttgg

SEQ ID NO: 428852 - DNA, 25 bp, Homo sapien
agaattccagctttgggccgcactg

SEQ ID NO: 428853 - DNA, 25 bp, Homo sapien
agctttgggccgcactgtacagcag

SEQ ID NO: 428854 - DNA, 25 bp, Homo sapien
gccgcactgtacagcagtctggata

SEQ ID NO: 428855 - DNA, 25 bp, Homo sapien
actggttttcttggttctcagccca

SEQ ID NO: 428856 - DNA, 25 bp, Homo sapien
agcagcacctatcctggctcttggt

SEQ ID NO: 428857 - DNA, 25 bp, Homo sapien
gtcctggcctgcagccaagtgctgt

SEQ ID NO: 428858 - DNA, 25 bp, Homo sapien
agccaagtgctgttcctagcctgag

SEQ ID NO: 428859 - DNA, 25 bp, Homo sapien
aagtgctgttcctagcctgaggctt

SEQ ID NO: 428860 - DNA, 25 bp, Homo sapien
gttcctagcctgaggcttgagacag

SEQ ID NO: 428861 - DNA, 25 bp, Homo sapien
acaggtggggttggctcctcaccaa

SEQ ID NO: 428862 - DNA, 25 bp, Homo sapien
actatcatttactttttacattaca

SEQ ID NO: 428863 - DNA, 25 bp, Homo sapien
cacaaaatgaaactcccgaatgggt

SEQ ID NO: 428864 - DNA, 25 bp, Homo sapien
tgaaactcccgaatgggtggagtat

SEQ ID NO: 428865 - DNA, 25 bp, Homo sapien
tgtgattattggtacctggtccttc

SEQ ID NO: 428866 - DNA, 25 bp, Homo sapien
attggtacctggtccttctggtgct

SEQ ID NO: 428867 - DNA, 25 bp, Homo sapien
atgtgagtacatgcagcccagcaag

SEQ ID NO: 428868 - DNA, 25 bp, Homo sapien
agaaactaaactgaactctcttctc

SEQ ID NO: 428869 - DNA, 25 bp, Homo sapien
tcttctcctatcctagtccattaag

SEQ ID NO: 428870 - DNA, 25 bp, Homo sapien
tcctatcctagtccattaaggagaa

SEQ ID NO: 428871 - DNA, 25 bp, Homo sapien
ggagaagaaccagcattgcttttgt

SEQ ID NO: 428872 - DNA, 25 bp, Homo sapien
gcattgcttttgtgtttggtgtgaa

SEQ ID NO: 428873 - DNA, 25 bp, Homo sapien
gatgcaactttcaaaattcttatta

SEQ ID NO: 428874 - DNA, 25 bp, Homo sapien
caaaattcttattattcctatttgt

SEQ ID NO: 428875 - DNA, 25 bp, Homo sapien
tatatacacgagagaacccaaccag

SEQ ID NO: 428876 - DNA, 25 bp, Homo sapien
tacacgagagaacccaaccagtgcc

SEQ ID NO: 428877 - DNA, 25 bp, Homo sapien
aagtcaacagtgtagttctaaacct

SEQ ID NO: 428878 - DNA, 25 bp, Homo sapien
cagtgtagttctaaaccttatccca

SEQ ID NO: 428879 - DNA, 25 bp, Homo sapien
aaccttatcccaaacagaaaatgtg

SEQ ID NO: 428880 - DNA, 25 bp, Homo sapien
atgtcactttccttgctggtcatca

SEQ ID NO: 428881 - DNA, 25 bp, Homo sapien
ttgctggtcatcattaggcttaaat

SEQ ID NO: 428882 - DNA, 25 bp, Homo sapien
agctgtcatcaaagagtttacacta

SEQ ID NO: 428883 - DNA, 25 bp, Homo sapien
aagagtttacactaaaatcttcagg

SEQ ID NO: 428884 - DNA, 25 bp, Homo sapien
gtcccatcaagtgactggtaaccac

SEQ ID NO: 428885 - DNA, 25 bp, Homo sapien
agaacactggatttccacgtagcaa

SEQ ID NO: 428886 - DNA, 25 bp, Homo sapien
cacgtagcaatcagccctattacaa

SEQ ID NO: 428887 - DNA, 25 bp, Homo sapien
caatagtcgtggtgtgtctcgtgga

SEQ ID NO: 428888 - DNA, 25 bp, Homo sapien
tagaggcttgatgaatggataccgg

SEQ ID NO: 428889 - DNA, 25 bp, Homo sapien
atggttaccgcccttcattctctaa

SEQ ID NO: 428890 - DNA, 25 bp, Homo sapien
cttcattctctaacactccaaacag

SEQ ID NO: 428891 - DNA, 25 bp, Homo sapien
aaacagtggttatacacagtctcag

SEQ ID NO: 428892 - DNA, 25 bp, Homo sapien
tcagttcagtgctccccgggattac

SEQ ID NO: 428893 - DNA, 25 bp, Homo sapien
ccgggattactctggctatcaacgg

SEQ ID NO: 428894 - DNA, 25 bp, Homo sapien
tactctggctatcaacgggatggat

SEQ ID NO: 428895 - DNA, 25 bp, Homo sapien
ggagagctgacttgggactcctggc

SEQ ID NO: 428896 - DNA, 25 bp, Homo sapien
tcatccttctgccaaggcagctttc

SEQ ID NO: 428897 - DNA, 25 bp, Homo sapien
gttttctgtgttcttagcctccacc

SEQ ID NO: 428898 - DNA, 25 bp, Homo sapien
gccacccttgtggactaggaccagg

SEQ ID NO: 428899 - DNA, 25 bp, Homo sapien
gtggactaggaccaggtcctgaccc

SEQ ID NO: 428900 - DNA, 25 bp, Homo sapien
gaccccagtcagaaaatgatgatat

SEQ ID NO: 428901 - DNA, 25 bp, Homo sapien
tgatatgtacagtggcacaccttaa

SEQ ID NO: 428902 - DNA, 25 bp, Homo sapien
tgtacagtggcacaccttaaccagt

SEQ ID NO: 428903 - DNA, 25 bp, Homo sapien
gtggcacaccttaaccagtcactaa

SEQ ID NO: 428904 - DNA, 25 bp, Homo sapien
gcacaccttaaccagtcactaattt

SEQ ID NO: 428905 - DNA, 25 bp, Homo sapien
cttaaccagtcactaattttcactg

SEQ ID NO: 428906 - DNA, 25 bp, Homo sapien
gtggtgtttggttcacatatcaact

SEQ ID NO: 428907 - DNA, 25 bp, Homo sapien
gtttggttcacatatcaactgttta

SEQ ID NO: 428908 - DNA, 25 bp, Homo sapien
ggttcacatatcaactgtttaagcc

SEQ ID NO: 428909 - DNA, 25 bp, Homo sapien
catatcaactgtttaagccataatt

SEQ ID NO: 428910 - DNA, 25 bp, Homo sapien
aagccataattttagccaatgaatt

SEQ ID NO: 428911 - DNA, 25 bp, Homo sapien
tattcagtataactatttgaggttt

SEQ ID NO: 428912 - DNA, 25 bp, Homo sapien
ggtttactagatgcatttattaata

SEQ ID NO: 428913 - DNA, 25 bp, Homo sapien
gtgggaataaaatcaacctttgctt

SEQ ID NO: 428914 - DNA, 25 bp, Homo sapien
ataaaatcaacctttgcttgtaatt

SEQ ID NO: 428915 - DNA, 25 bp, Homo sapien
gcttgtaattaaagttgctgctatt

SEQ ID NO: 428916 - DNA, 25 bp, Homo sapien
ttgctgctatttctgtaatgtgtat

SEQ ID NO: 428917 - DNA, 25 bp, Homo sapien
tggctgatgcctgcacacatttaat

SEQ ID NO: 428918 - DNA, 25 bp, Homo sapien
ctgatgcctgcacacatttaattta

SEQ ID NO: 428919 - DNA, 25 bp, Homo sapien
aatttaatctcccaccttccacata

SEQ ID NO: 428920 - DNA, 25 bp, Homo sapien
cccaccttccacatagatcattgat

SEQ ID NO: 428921 - DNA, 25 bp, Homo sapien
tagtaaacgtaaccattcatgattc

SEQ ID NO: 428922 - DNA, 25 bp, Homo sapien
acgtaaccattcatgattcattctg

SEQ ID NO: 428923 - DNA, 25 bp, Homo sapien
gattcattctgtggcaagatactca

SEQ ID NO: 428924 - DNA, 25 bp, Homo sapien
gtggcaagatactcaataaagctta

SEQ ID NO: 428925 - DNA, 25 bp, Homo sapien
aattatgtttaccaccttgaactag

SEQ ID NO: 428926 - DNA, 25 bp, Homo sapien
gtttaccaccttgaactagaacaag

SEQ ID NO: 428927 - DNA, 25 bp, Homo sapien
tttcaatcacaagggtataactttt

SEQ ID NO: 428928 - DNA, 25 bp, Homo sapien
ctgttctgtgtgttggttaattttt

SEQ ID NO: 428929 - DNA, 25 bp, Homo sapien
ggtaccatttgaccatactgtacaa

SEQ ID NO: 428930 - DNA, 25 bp, Homo sapien
accatttgaccatactgtacaagat

SEQ ID NO: 428931 - DNA, 25 bp, Homo sapien
ttgaccatactgtacaagatatgag

SEQ ID NO: 428932 - DNA, 25 bp, Homo sapien
gtactgaaattgaattaggctactt

SEQ ID NO: 428933 - DNA, 25 bp, Homo sapien
ttgaattaggctacttttaataaag

SEQ ID NO: 428934 - DNA, 25 bp, Homo sapien
tgatttatgggaatacagaactaga

SEQ ID NO: 428935 - DNA, 25 bp, Homo sapien
aaaagcatcacaaatcctactccat

SEQ ID NO: 428936 - DNA, 25 bp, Homo sapien
agcatcacaaatcctactccatcaa

SEQ ID NO: 428937 - DNA, 25 bp, Homo sapien
tatcaaaacagttacttgttcaaga

SEQ ID NO: 428938 - DNA, 25 bp, Homo sapien
aaacagttacttgttcaagatatca

SEQ ID NO: 428939 - DNA, 25 bp, Homo sapien
gggcttcggacacaatacctttcct

SEQ ID NO: 428940 - DNA, 25 bp, Homo sapien
ggacacaatacctttcctaaatgaa

SEQ ID NO: 428941 - DNA, 25 bp, Homo sapien
atacctttcctaaatgaaaccagtg

SEQ ID NO: 428942 - DNA, 25 bp, Homo sapien
aatgaaaccagtgcctgcttcgtta

SEQ ID NO: 428943 - DNA, 25 bp, Homo sapien
aaaccagtgcctgcttcgttacagg

SEQ ID NO: 428944 - DNA, 25 bp, Homo sapien
ctgcttcgttacaggcacaaggtat

SEQ ID NO: 428945 - DNA, 25 bp, Homo sapien
gttacaggcacaaggtatgtactgt

SEQ ID NO: 428946 - DNA, 25 bp, Homo sapien
atgtactgtgggtgacatccagccc

SEQ ID NO: 428947 - DNA, 25 bp, Homo sapien
ccttcagttttccagagtctttcct

SEQ ID NO: 428948 - DNA, 25 bp, Homo sapien
tcagttttccagagtctttcctggg

SEQ ID NO: 428949 - DNA, 25 bp, Homo sapien
ctgggcctgcaaaggtaaaagaagc

SEQ ID NO: 428950 - DNA, 25 bp, Homo sapien
taaatctagattttctaaactaagg

SEQ ID NO: 428951 - DNA, 25 bp, Homo sapien
tctagattttctaaactaaggaagt

SEQ ID NO: 428952 - DNA, 25 bp, Homo sapien
tagacaactaaaatatgggaggcat

SEQ ID NO: 428953 - DNA, 25 bp, Homo sapien
gatattaaactttatcacaaggtta

SEQ ID NO: 428954 - DNA, 25 bp, Homo sapien
ttaaactttatcacaaggttatttg

SEQ ID NO: 428955 - DNA, 25 bp, Homo sapien
aaactttatcacaaggttatttgat

SEQ ID NO: 428956 - DNA, 25 bp, Homo sapien
ttatcacaaggttatttgattgggt

SEQ ID NO: 428957 - DNA, 25 bp, Homo sapien
tcacaaggttatttgattgggtaat

SEQ ID NO: 428958 - DNA, 25 bp, Homo sapien
caaggttatttgattgggtaatagc

SEQ ID NO: 428959 - DNA, 25 bp, Homo sapien
ggttatttgattgggtaatagctat

SEQ ID NO: 428960 - DNA, 25 bp, Homo sapien
atttgattgggtaatagctataggg

SEQ ID NO: 428961 - DNA, 25 bp, Homo sapien
atttctcacaccattttatacactg

SEQ ID NO: 428962 - DNA, 25 bp, Homo sapien
ttatacactgtgttttaatgtttgg

SEQ ID NO: 428963 - DNA, 25 bp, Homo sapien
attttttgcacttgttaatacagga

SEQ ID NO: 428964 - DNA, 25 bp, Homo sapien
gggatggtttctcagaggtaaacta

SEQ ID NO: 428965 - DNA, 25 bp, Homo sapien
ctaagtcttttcactgtctctatct

SEQ ID NO: 428966 - DNA, 25 bp, Homo sapien
tgtgttcatcagatagttctgtctt

SEQ ID NO: 428967 - DNA, 25 bp, Homo sapien
gatagttctgtctttatgtcctgtc

SEQ ID NO: 428968 - DNA, 25 bp, Homo sapien
gtctttatgtcctgtcagcttctat

SEQ ID NO: 428969 - DNA, 25 bp, Homo sapien
atgtcctgtcagcttctattagagg

SEQ ID NO: 428970 - DNA, 25 bp, Homo sapien
gaggaatgattgctatgacctcatg

SEQ ID NO: 428971 - DNA, 25 bp, Homo sapien
tgacctcatggtatagcaaaaaaca

SEQ ID NO: 428972 - DNA, 25 bp, Homo sapien
aatagagagctatggagtcaaggca

SEQ ID NO: 428973 - DNA, 25 bp, Homo sapien
gagctatggagtcaaggcatgttta

SEQ ID NO: 428974 - DNA, 25 bp, Homo sapien
caaggcatgtttaagatgggaggta

SEQ ID NO: 428975 - DNA, 25 bp, Homo sapien
atgggaggtagagcatgccaatatt

SEQ ID NO: 428976 - DNA, 25 bp, Homo sapien
gagcatgccaatattgatggcaaca

SEQ ID NO: 428977 - DNA, 25 bp, Homo sapien
atggcaacagtcaagatggtgtgat

SEQ ID NO: 428978 - DNA, 25 bp, Homo sapien
aaggagcagagtccatgagaaagaa

SEQ ID NO: 428979 - DNA, 25 bp, Homo sapien
tgggacctttgtaggaagagacaca

SEQ ID NO: 428980 - DNA, 25 bp, Homo sapien
tgtaggaagagacacagtcctgcag

SEQ ID NO: 428981 - DNA, 25 bp, Homo sapien
gtcctgcagcctcatatggctcaat

SEQ ID NO: 428982 - DNA, 25 bp, Homo sapien
ctgcagcctcatatggctcaataaa

SEQ ID NO: 428983 - DNA, 25 bp, Homo sapien
gtgacttatgaaggttttgtttctt

SEQ ID NO: 428984 - DNA, 25 bp, Homo sapien
gaattttacttttgctacttgtcca

SEQ ID NO: 428985 - DNA, 25 bp, Homo sapien
gctacttgtccaatagtggctagtt

SEQ ID NO: 428986 - DNA, 25 bp, Homo sapien
tagtggctagtttatgtttatcaat

SEQ ID NO: 428987 - DNA, 25 bp, Homo sapien
agttattcactgtgccttaagttta

SEQ ID NO: 428988 - DNA, 25 bp, Homo sapien
attcgagatagtacctctcactcac

SEQ ID NO: 428989 - DNA, 25 bp, Homo sapien
gtacctctcactcacagatatttat

SEQ ID NO: 428990 - DNA, 25 bp, Homo sapien
taggtgtgtctaaaagtgatcttct

SEQ ID NO: 428991 - DNA, 25 bp, Homo sapien
aagtgatcttctgaatcctgtctcc

SEQ ID NO: 428992 - DNA, 25 bp, Homo sapien
aatcctgtctccctagaggtactag

SEQ ID NO: 428993 - DNA, 25 bp, Homo sapien
actagtatctagagtttacccagaa

SEQ ID NO: 428994 - DNA, 25 bp, Homo sapien
ggagaggcagaattctaacaatcat

SEQ ID NO: 428995 - DNA, 25 bp, Homo sapien
attcctgatgtgtgcgtgatcccca

SEQ ID NO: 428996 - DNA, 25 bp, Homo sapien
aaacacgagctatcagttaatctgt

SEQ ID NO: 428997 - DNA, 25 bp, Homo sapien
gagagtcaagcactgttgcctcggt

SEQ ID NO: 428998 - DNA, 25 bp, Homo sapien
gttgcctcggtcatacaacatgtat

SEQ ID NO: 428999 - DNA, 25 bp, Homo sapien
tgtatgtgttgatcctgactttgca

SEQ ID NO: 429000 - DNA, 25 bp, Homo sapien
tgactttgcaccaggtcctattctc

SEQ ID NO: 429001 - DNA, 25 bp, Homo sapien
gtcctattctcaccccagtggagaa

SEQ ID NO: 429002 - DNA, 25 bp, Homo sapien
ttaatctgtataaccaatgccaagt

SEQ ID NO: 429003 - DNA, 25 bp, Homo sapien
aagtttcattacctctcttgtccaa

SEQ ID NO: 429004 - DNA, 25 bp, Homo sapien
gaaaatgagcatagccacatctttt

SEQ ID NO: 429005 - DNA, 25 bp, Homo sapien
taaatattcatatttgtctgctcag

SEQ ID NO: 429006 - DNA, 25 bp, Homo sapien
ttgtctgctcaggagatgaaaatct

SEQ ID NO: 429007 - DNA, 25 bp, Homo sapien
attatgttgcccaaattttcataaa

SEQ ID NO: 429008 - DNA, 25 bp, Homo sapien
agacgtttcatctaaattgggtttg

SEQ ID NO: 429009 - DNA, 25 bp, Homo sapien
gatatggaaattagtctcactcaaa

SEQ ID NO: 429010 - DNA, 25 bp, Homo sapien
aattagtctcactcaaagtcctcca

SEQ ID NO: 429011 - DNA, 25 bp, Homo sapien
tcaaagtcctccaggccacgagtaa

SEQ ID NO: 429012 - DNA, 25 bp, Homo sapien
aggccacgagtaagccgggctcacg

SEQ ID NO: 429013 - DNA, 25 bp, Homo sapien
gtgaggtggccactctatcagatgt

SEQ ID NO: 429014 - DNA, 25 bp, Homo sapien
gtggccactctatcagatgttgctt

SEQ ID NO: 429015 - DNA, 25 bp, Homo sapien
gcagtggataatactcaagatcaga

SEQ ID NO: 429016 - DNA, 25 bp, Homo sapien
ggtccacatcgaagaccagcccctg

SEQ ID NO: 429017 - DNA, 25 bp, Homo sapien
gtccacatcgaagaccagcccctgg

SEQ ID NO: 429018 - DNA, 25 bp, Homo sapien
tccacatcgaagaccagcccctggg

SEQ ID NO: 429019 - DNA, 25 bp, Homo sapien
ccaggtctccagagaaccctcccat

SEQ ID NO: 429020 - DNA, 25 bp, Homo sapien
aggtctccagagaaccctcccattc

SEQ ID NO: 429021 - DNA, 25 bp, Homo sapien
ggtctccagagaaccctcccattcc

SEQ ID NO: 429022 - DNA, 25 bp, Homo sapien
gtctccagagaaccctcccattcca

SEQ ID NO: 429023 - DNA, 25 bp, Homo sapien
tccagagaaccctcccattccatcg

SEQ ID NO: 429024 - DNA, 25 bp, Homo sapien
agagaaccctcccattccatcgctg

SEQ ID NO: 429025 - DNA, 25 bp, Homo sapien
gagaaccctcccattccatcgctgt

SEQ ID NO: 429026 - DNA, 25 bp, Homo sapien
attccatcgctgtcttcccaaagtg

SEQ ID NO: 429027 - DNA, 25 bp, Homo sapien
tttaacccaccacaaaacattatca

SEQ ID NO: 429028 - DNA, 25 bp, Homo sapien
aacccaccacaaaacattatcatta

SEQ ID NO: 429029 - DNA, 25 bp, Homo sapien
gggaaaaactcacctcaattatgaa

SEQ ID NO: 429030 - DNA, 25 bp, Homo sapien
aaactcacctcaattatgaaaacaa

SEQ ID NO: 429031 - DNA, 25 bp, Homo sapien
acaaacccagcaacttttgcttagg

SEQ ID NO: 429032 - DNA, 25 bp, Homo sapien
gcaacttttgcttaggtttagtgtt

SEQ ID NO: 429033 - DNA, 25 bp, Homo sapien
gttttatgtttcaaacacaaggaga

SEQ ID NO: 429034 - DNA, 25 bp, Homo sapien
aacacaaggagaatatgggagacac

SEQ ID NO: 429035 - DNA, 25 bp, Homo sapien
aaaagccactgcttaattttaagag

SEQ ID NO: 429036 - DNA, 25 bp, Homo sapien
gcttaattttaagagtgctaacatt

SEQ ID NO: 429037 - DNA, 25 bp, Homo sapien
gagtgctaacattaacaaaatctat

SEQ ID NO: 429038 - DNA, 25 bp, Homo sapien
gttttgtctctaatacgcattttgt

SEQ ID NO: 429039 - DNA, 25 bp, Homo sapien
acgcattttgtacagaagccgataa

SEQ ID NO: 429040 - DNA, 25 bp, Homo sapien
gaagccgataagtgcaggcatcgct

SEQ ID NO: 429041 - DNA, 25 bp, Homo sapien
aggcatcgctgcttggctaggacac

SEQ ID NO: 429042 - DNA, 25 bp, Homo sapien
atcgctgcttggctaggacacggtt

SEQ ID NO: 429043 - DNA, 25 bp, Homo sapien
gcttggctaggacacggtttattta

SEQ ID NO: 429044 - DNA, 25 bp, Homo sapien
ttatttaggttaagagtgtttccat

SEQ ID NO: 429045 - DNA, 25 bp, Homo sapien
gagtatcagaagattgggaaccgac

SEQ ID NO: 429046 - DNA, 25 bp, Homo sapien
gattgggaaccgacaacacccagct

SEQ ID NO: 429047 - DNA, 25 bp, Homo sapien
cacgctcgcggttggaaaatcattt

SEQ ID NO: 429048 - DNA, 25 bp, Homo sapien
cacctcctatcctgggctcaaggat

SEQ ID NO: 429049 - DNA, 25 bp, Homo sapien
aattcataacagtcaaggcctgaga

SEQ ID NO: 429050 - DNA, 25 bp, Homo sapien
ttatcttgggccactggagccagta

SEQ ID NO: 429051 - DNA, 25 bp, Homo sapien
actggagccagtactgattaacatt

SEQ ID NO: 429052 - DNA, 25 bp, Homo sapien
ggctgctatggatgggcgcttctta

SEQ ID NO: 429053 - DNA, 25 bp, Homo sapien
gcgcttcttaccagttgctagtatg

SEQ ID NO: 429054 - DNA, 25 bp, Homo sapien
attgatgtcattctttggcacaagc

SEQ ID NO: 429055 - DNA, 25 bp, Homo sapien
tggcacaagcgacatgattctcact

SEQ ID NO: 429056 - DNA, 25 bp, Homo sapien
atgattctcacttgaatggatccag

SEQ ID NO: 429057 - DNA, 25 bp, Homo sapien
gagtcttgtatccttagtctgcttc

SEQ ID NO: 429058 - DNA, 25 bp, Homo sapien
tgcttctaagcatttgaaactactg

SEQ ID NO: 429059 - DNA, 25 bp, Homo sapien
gaatctgataattttgactggcaaa

SEQ ID NO: 429060 - DNA, 25 bp, Homo sapien
aaaaagtgtgatgtgctgctcagaa

SEQ ID NO: 429061 - DNA, 25 bp, Homo sapien
gtgatgtgctgctcagaaggtcaga

SEQ ID NO: 429062 - DNA, 25 bp, Homo sapien
agaaggtcagactccatgtctgcct

SEQ ID NO: 429063 - DNA, 25 bp, Homo sapien
aaggtcagactccatgtctgccttg

SEQ ID NO: 429064 - DNA, 25 bp, Homo sapien
ggctggaacatgggatctcctcttc

SEQ ID NO: 429065 - DNA, 25 bp, Homo sapien
ttgcactaaaacagaaccttttctt

SEQ ID NO: 429066 - DNA, 25 bp, Homo sapien
ggaagcaacagtgaactctacctgt

SEQ ID NO: 429067 - DNA, 25 bp, Homo sapien
cagtgaactctacctgttctggagt

SEQ ID NO: 429068 - DNA, 25 bp, Homo sapien
aactctacctgttctggagttctcc

SEQ ID NO: 429069 - DNA, 25 bp, Homo sapien
acctgttctggagttctcctgggtc

SEQ ID NO: 429070 - DNA, 25 bp, Homo sapien
aataaggctgttctttcatatttta

SEQ ID NO: 429071 - DNA, 25 bp, Homo sapien
gggttccccattcatccgccttttg

SEQ ID NO: 429072 - DNA, 25 bp, Homo sapien
gttccccattcatccgccttttgga

SEQ ID NO: 429073 - DNA, 25 bp, Homo sapien
ttccccattcatccgccttttggag

SEQ ID NO: 429074 - DNA, 25 bp, Homo sapien
ccattcatccgccttttggagtagg

SEQ ID NO: 429075 - DNA, 25 bp, Homo sapien
cattcatccgccttttggagtaggg

SEQ ID NO: 429076 - DNA, 25 bp, Homo sapien
aaaggaagccctggcccctgacagc

SEQ ID NO: 429077 - DNA, 25 bp, Homo sapien
ctggcccctgacagctttgacagtc

SEQ ID NO: 429078 - DNA, 25 bp, Homo sapien
tgacagctttgacagtccatcaggg

SEQ ID NO: 429079 - DNA, 25 bp, Homo sapien
ggttgtagcaaatagaaagcactca

SEQ ID NO: 429080 - DNA, 25 bp, Homo sapien
ggtcctggcgccagcctcaggcctg

SEQ ID NO: 429081 - DNA, 25 bp, Homo sapien
aggcctgcaggtcctaacctcagcc

SEQ ID NO: 429082 - DNA, 25 bp, Homo sapien
tagttgacaacatttcagtattaaa

SEQ ID NO: 429083 - DNA, 25 bp, Homo sapien
ctgcccaacacatataccatctgaa

SEQ ID NO: 429084 - DNA, 25 bp, Homo sapien
gcccaacacatataccatctgaaaa

SEQ ID NO: 429085 - DNA, 25 bp, Homo sapien
aaatgttagaattctgagttgtgat

SEQ ID NO: 429086 - DNA, 25 bp, Homo sapien
aattctgagttgtgattttattgac

SEQ ID NO: 429087 - DNA, 25 bp, Homo sapien
gtgattttattgacttgttgcttgc

SEQ ID NO: 429088 - DNA, 25 bp, Homo sapien
gattttattgacttgttgcttgctt

SEQ ID NO: 429089 - DNA, 25 bp, Homo sapien
ttattgacttgttgcttgctttttc

SEQ ID NO: 429090 - DNA, 25 bp, Homo sapien
gcttgctttttcttaggctttgtaa

SEQ ID NO: 429091 - DNA, 25 bp, Homo sapien
tgctttttcttaggctttgtaactt

SEQ ID NO: 429092 - DNA, 25 bp, Homo sapien
tttcttaggctttgtaacttgtaat

SEQ ID NO: 429093 - DNA, 25 bp, Homo sapien
ctgcatttcgtgtgttagaagctga

SEQ ID NO: 429094 - DNA, 25 bp, Homo sapien
atttcgtgtgttagaagctgattct

SEQ ID NO: 429095 - DNA, 25 bp, Homo sapien
tagaagctgattctaggctgaggaa

SEQ ID NO: 429096 - DNA, 25 bp, Homo sapien
gctgaggaaagcaagagttctctac

SEQ ID NO: 429097 - DNA, 25 bp, Homo sapien
aaagcaagagttctctacttttgct

SEQ ID NO: 429098 - DNA, 25 bp, Homo sapien
cttttgctcaatattgaggcttacc

SEQ ID NO: 429099 - DNA, 25 bp, Homo sapien
agtttgactctacagctagtgaagt

SEQ ID NO: 429100 - DNA, 25 bp, Homo sapien
ttgactctacagctagtgaagtggt

SEQ ID NO: 429101 - DNA, 25 bp, Homo sapien
gactctacagctagtgaagtggttt

SEQ ID NO: 429102 - DNA, 25 bp, Homo sapien
tacagctagtgaagtggtttattgc

SEQ ID NO: 429103 - DNA, 25 bp, Homo sapien
gtgaagtggtttattgcttcaataa

SEQ ID NO: 429104 - DNA, 25 bp, Homo sapien
ttcagagttaagatgcacctggact

SEQ ID NO: 429105 - DNA, 25 bp, Homo sapien
gcacctggacttttagattctgact

SEQ ID NO: 429106 - DNA, 25 bp, Homo sapien
gattctgacttgaaagcgagctcac

SEQ ID NO: 429107 - DNA, 25 bp, Homo sapien
gcgagctcacattaactgttccata

SEQ ID NO: 429108 - DNA, 25 bp, Homo sapien
gatggagacacctaatgtcgttgtc

SEQ ID NO: 429109 - DNA, 25 bp, Homo sapien
gtcgttgtcaaattcctctgagtag

SEQ ID NO: 429110 - DNA, 25 bp, Homo sapien
gagtagtttttcaatgagccaaacc

SEQ ID NO: 429111 - DNA, 25 bp, Homo sapien
aaaccaaatgcaggacttcagggct

SEQ ID NO: 429112 - DNA, 25 bp, Homo sapien
cagggcttgtgagttattctctcta

SEQ ID NO: 429113 - DNA, 25 bp, Homo sapien
attctctctaaagtgatgctgcaaa

SEQ ID NO: 429114 - DNA, 25 bp, Homo sapien
gtactgcccctcaaatggattctga

SEQ ID NO: 429115 - DNA, 25 bp, Homo sapien
tcatgttccaacagtggtgaatagt

SEQ ID NO: 429116 - DNA, 25 bp, Homo sapien
gttccaacagtggtgaatagtaata

SEQ ID NO: 429117 - DNA, 25 bp, Homo sapien
agtaataaaagtgaggcactccagt

SEQ ID NO: 429118 - DNA, 25 bp, Homo sapien
taagtattcccaatataagttatat

SEQ ID NO: 429119 - DNA, 25 bp, Homo sapien
gcattaaatatgtgtcaccagtttt

SEQ ID NO: 429120 - DNA, 25 bp, Homo sapien
tatgtgtcaccagttttcatctgtg

SEQ ID NO: 429121 - DNA, 25 bp, Homo sapien
gccaagaagaaaccgcagatttgct

SEQ ID NO: 429122 - DNA, 25 bp, Homo sapien
gaaaccgcagatttgctaaaggaac

SEQ ID NO: 429123 - DNA, 25 bp, Homo sapien
cgcagatttgctaaaggaactgtct

SEQ ID NO: 429124 - DNA, 25 bp, Homo sapien
tggtattcatgttccaacagtggtg

SEQ ID NO: 429125 - DNA, 25 bp, Homo sapien
gtattcatgttccaacagtggtgaa

SEQ ID NO: 429126 - DNA, 25 bp, Homo sapien
tctgaaaccatcactctaatgctta

SEQ ID NO: 429127 - DNA, 25 bp, Homo sapien
actctaatgcttacaacaattctgc

SEQ ID NO: 429128 - DNA, 25 bp, Homo sapien
gcaaggtctacattattacccagaa

SEQ ID NO: 429129 - DNA, 25 bp, Homo sapien
attacccagaatcctcaaatagaag

SEQ ID NO: 429130 - DNA, 25 bp, Homo sapien
aatagaagcagagggcagctcagag

SEQ ID NO: 429131 - DNA, 25 bp, Homo sapien
agatgctttaatcccatctcagtgg

SEQ ID NO: 429132 - DNA, 25 bp, Homo sapien
tcaaattcaactccggttctggtta

SEQ ID NO: 429133 - DNA, 25 bp, Homo sapien
tcaaagagcagttccctggcatcac

SEQ ID NO: 429134 - DNA, 25 bp, Homo sapien
gcagttccctggcatcacttgaaag

SEQ ID NO: 429135 - DNA, 25 bp, Homo sapien
cctggcatcacttgaaagcttgtaa

SEQ ID NO: 429136 - DNA, 25 bp, Homo sapien
aaaatgcaaatccttgggctccacc

SEQ ID NO: 429137 - DNA, 25 bp, Homo sapien
aagctctttgctacataagtcaagc

SEQ ID NO: 429138 - DNA, 25 bp, Homo sapien
aaacttccatttcccgacatgacat

SEQ ID NO: 429139 - DNA, 25 bp, Homo sapien
atttcccgacatgacatggccaaat

SEQ ID NO: 429140 - DNA, 25 bp, Homo sapien
gaaggccaggttaccagagattaaa

SEQ ID NO: 429141 - DNA, 25 bp, Homo sapien
gacgttgctgcagagtcctgggacc

SEQ ID NO: 429142 - DNA, 25 bp, Homo sapien
tcctgggaccggctggcaaatgaca

SEQ ID NO: 429143 - DNA, 25 bp, Homo sapien
tgacacaggaactttgggagcgcat

SEQ ID NO: 429144 - DNA, 25 bp, Homo sapien
tttgggagcgcatggactcaggcca

SEQ ID NO: 429145 - DNA, 25 bp, Homo sapien
atggactcaggccaagcggccgtcc

SEQ ID NO: 429146 - DNA, 25 bp, Homo sapien
aagccctggcaacccaaaactgaag

SEQ ID NO: 429147 - DNA, 25 bp, Homo sapien
tcggccacctcagggcagggacgaa

SEQ ID NO: 429148 - DNA, 25 bp, Homo sapien
tggtgttagcagttttggccctccc

SEQ ID NO: 429149 - DNA, 25 bp, Homo sapien
gaaacttgtagttctcaatactgcc

SEQ ID NO: 429150 - DNA, 25 bp, Homo sapien
cctcctggcgcgttggctgtggcaa

SEQ ID NO: 429151 - DNA, 25 bp, Homo sapien
gttggctgtggcaagcgttcagtaa

SEQ ID NO: 429152 - DNA, 25 bp, Homo sapien
cttcatatgagggagagggtacacc

SEQ ID NO: 429153 - DNA, 25 bp, Homo sapien
agggtacacctcagctgggagatcc

SEQ ID NO: 429154 - DNA, 25 bp, Homo sapien
cagctgggagatccgcagcctctat

SEQ ID NO: 429155 - DNA, 25 bp, Homo sapien
agttctcaatactgcctttataggc

SEQ ID NO: 429156 - DNA, 25 bp, Homo sapien
ttgtttgtattcagacatgccctcc

SEQ ID NO: 429157 - DNA, 25 bp, Homo sapien
gtattcagacatgccctccgggagt

SEQ ID NO: 429158 - DNA, 25 bp, Homo sapien
ataggttatgtggttctctataaac

SEQ ID NO: 429159 - DNA, 25 bp, Homo sapien
tctgggcgggcccagtggagtttgg

SEQ ID NO: 429160 - DNA, 25 bp, Homo sapien
cgaaagcaacgggactgctgggaga

SEQ ID NO: 429161 - DNA, 25 bp, Homo sapien
gggcggctacgtcaaggtctacacc

SEQ ID NO: 429162 - DNA, 25 bp, Homo sapien
aggaaggcccgcctgagcgcgacgg

SEQ ID NO: 429163 - DNA, 25 bp, Homo sapien
gcggctacgtcaaggtctacaccgg

SEQ ID NO: 429164 - DNA, 25 bp, Homo sapien
gggcctcggatacctgctgcccaga

SEQ ID NO: 429165 - DNA, 25 bp, Homo sapien
tacgtcaaggtctacaccggccgca

SEQ ID NO: 429166 - DNA, 25 bp, Homo sapien
tcaaggtctacaccggccgcaaggt

SEQ ID NO: 429167 - DNA, 25 bp, Homo sapien
tgtttcccaccgactttctagagga

SEQ ID NO: 429168 - DNA, 25 bp, Homo sapien
tcccaccgactttctagaggaaatt

SEQ ID NO: 429169 - DNA, 25 bp, Homo sapien
tgcgggcgcctgcaagcgggagaca

SEQ ID NO: 429170 - DNA, 25 bp, Homo sapien
ctgctggagctcaggcaaacaaacc

SEQ ID NO: 429171 - DNA, 25 bp, Homo sapien
tgctggagctcaggcaaacaaacca

SEQ ID NO: 429172 - DNA, 25 bp, Homo sapien
tggagctcaggcaaacaaaccacct

SEQ ID NO: 429173 - DNA, 25 bp, Homo sapien
gagctcaggcaaacaaaccacctct

SEQ ID NO: 429174 - DNA, 25 bp, Homo sapien
ctctgtctcccacgaggtcttggaa

SEQ ID NO: 429175 - DNA, 25 bp, Homo sapien
tctgtctcccacgaggtcttggaag

SEQ ID NO: 429176 - DNA, 25 bp, Homo sapien
ctgtctcccacgaggtcttggaaga

SEQ ID NO: 429177 - DNA, 25 bp, Homo sapien
tgtctcccacgaggtcttggaagag

SEQ ID NO: 429178 - DNA, 25 bp, Homo sapien
gtctcccacgaggtcttggaagagg

SEQ ID NO: 429179 - DNA, 25 bp, Homo sapien
gtgagtataaggaccaggccccggt

SEQ ID NO: 429180 - DNA, 25 bp, Homo sapien
tgagtataaggaccaggccccggtc

SEQ ID NO: 429181 - DNA, 25 bp, Homo sapien
tgtatgtatatgtaagtctaattgc

SEQ ID NO: 429182 - DNA, 25 bp, Homo sapien
gtctaattgcttaaaggtatacctc

SEQ ID NO: 429183 - DNA, 25 bp, Homo sapien
ggtatacctctaagattccaaattg

SEQ ID NO: 429184 - DNA, 25 bp, Homo sapien
gattgatgctagaaggcagctgttt

SEQ ID NO: 429185 - DNA, 25 bp, Homo sapien
ttgaggaccagaggcatggcttata

SEQ ID NO: 429186 - DNA, 25 bp, Homo sapien
ccagaggcatggcttatatgcaaaa

SEQ ID NO: 429187 - DNA, 25 bp, Homo sapien
tggatcacagaaagacagtattatt

SEQ ID NO: 429188 - DNA, 25 bp, Homo sapien
aatttgaaatctggcagctctccta

SEQ ID NO: 429189 - DNA, 25 bp, Homo sapien
ttgaaatctggcagctctcctagga

SEQ ID NO: 429190 - DNA, 25 bp, Homo sapien
tgaatttgacattttgaactgggaa

SEQ ID NO: 429191 - DNA, 25 bp, Homo sapien
ttgacattttgaactgggaaacagc

SEQ ID NO: 429192 - DNA, 25 bp, Homo sapien
gggcaggtagcttactccaaggaaa

SEQ ID NO: 429193 - DNA, 25 bp, Homo sapien
tcttcttcacacaagtcagggagcc

SEQ ID NO: 429194 - DNA, 25 bp, Homo sapien
atgcgcagggcatccacatgttctt

SEQ ID NO: 429195 - DNA, 25 bp, Homo sapien
ttcagtggcttatactcatcatgca

SEQ ID NO: 429196 - DNA, 25 bp, Homo sapien
tcatcatgcagcctccttgtagact

SEQ ID NO: 429197 - DNA, 25 bp, Homo sapien
ctccttgtagactctagcagcttgt

SEQ ID NO: 429198 - DNA, 25 bp, Homo sapien
gcagcttgtttaggtcattctcaga

SEQ ID NO: 429199 - DNA, 25 bp, Homo sapien
gtttgatagtgttttccatcacatt

SEQ ID NO: 429200 - DNA, 25 bp, Homo sapien
ccatcacattgatgtcagcgtggat

SEQ ID NO: 429201 - DNA, 25 bp, Homo sapien
agcgtggatcagtcggagttcctcc

SEQ ID NO: 429202 - DNA, 25 bp, Homo sapien
ttctcctgtagcagaaggtccatct

SEQ ID NO: 429203 - DNA, 25 bp, Homo sapien
aactgctaacatgcacataagttac

SEQ ID NO: 429204 - DNA, 25 bp, Homo sapien
catgcacataagttactatgtctga

SEQ ID NO: 429205 - DNA, 25 bp, Homo sapien
atagtctttgtcaagaataattgtg

SEQ ID NO: 429206 - DNA, 25 bp, Homo sapien
tttgttatctgatttcctatctgca

SEQ ID NO: 429207 - DNA, 25 bp, Homo sapien
gttatctgatttcctatctgcattt

SEQ ID NO: 429208 - DNA, 25 bp, Homo sapien
atctgatttcctatctgcattttca

SEQ ID NO: 429209 - DNA, 25 bp, Homo sapien
tgatttcctatctgcattttcagtt

SEQ ID NO: 429210 - DNA, 25 bp, Homo sapien
atatgcaacaatttcttagttctct

SEQ ID NO: 429211 - DNA, 25 bp, Homo sapien
cttagttctctaagcattgctatta

SEQ ID NO: 429212 - DNA, 25 bp, Homo sapien
aagcattgctattattctcctctgg

SEQ ID NO: 429213 - DNA, 25 bp, Homo sapien
gcattgctattattctcctctggaa

SEQ ID NO: 429214 - DNA, 25 bp, Homo sapien
cgacttgaggttcgcgaagggcacg

SEQ ID NO: 429215 - DNA, 25 bp, Homo sapien
ttgaggttcgcgaagggcacgtcga

SEQ ID NO: 429216 - DNA, 25 bp, Homo sapien
gaggttcgcgaagggcacgtcgacc

SEQ ID NO: 429217 - DNA, 25 bp, Homo sapien
ggacgggcgggtcggtgagctcctc

SEQ ID NO: 429218 - DNA, 25 bp, Homo sapien
gggcgggtcggtgagctcctcgcac

SEQ ID NO: 429219 - DNA, 25 bp, Homo sapien
gagctcctcgcacccctcacaggtt

SEQ ID NO: 429220 - DNA, 25 bp, Homo sapien
gcagcctctgaggtgagggcgaggg

SEQ ID NO: 429221 - DNA, 25 bp, Homo sapien
cggtgtgggccgcagagacgttgga

SEQ ID NO: 429222 - DNA, 25 bp, Homo sapien
gtgtgggccgcagagacgttggagc

SEQ ID NO: 429223 - DNA, 25 bp, Homo sapien
tgggccgcagagacgttggagccgg

SEQ ID NO: 429224 - DNA, 25 bp, Homo sapien
gccgcagagacgttggagccggcgg

SEQ ID NO: 429225 - DNA, 25 bp, Homo sapien
gaggacaaccagacatcactttcat

SEQ ID NO: 429226 - DNA, 25 bp, Homo sapien
agacatcactttcatcaccatcttg

SEQ ID NO: 429227 - DNA, 25 bp, Homo sapien
tactgcatcctgttttatcatcagg

SEQ ID NO: 429228 - DNA, 25 bp, Homo sapien
gttttatcatcaggtcattgtgacc

SEQ ID NO: 429229 - DNA, 25 bp, Homo sapien
gtgacctatattttgtgccgacctg

SEQ ID NO: 429230 - DNA, 25 bp, Homo sapien
atattttgtgccgacctgctatctc

SEQ ID NO: 429231 - DNA, 25 bp, Homo sapien
ctcatcctgtgagtaacaatgccaa

SEQ ID NO: 429232 - DNA, 25 bp, Homo sapien
aacaatgccaaacctcctgggaatg

SEQ ID NO: 429233 - DNA, 25 bp, Homo sapien
gactatttagggtaacttctgggca

SEQ ID NO: 429234 - DNA, 25 bp, Homo sapien
aacttctgggcattgctatgggtat

SEQ ID NO: 429235 - DNA, 25 bp, Homo sapien
gctatgggtatttgtagactgtcat

SEQ ID NO: 429236 - DNA, 25 bp, Homo sapien
ccccggtggctttgtcagcaggatg

SEQ ID NO: 429237 - DNA, 25 bp, Homo sapien
agggcggccctctggcttggaggat

SEQ ID NO: 429238 - DNA, 25 bp, Homo sapien
tggaggatgtggttgccatggctgc

SEQ ID NO: 429239 - DNA, 25 bp, Homo sapien
cctgtggacagggagctttcagaat

SEQ ID NO: 429240 - DNA, 25 bp, Homo sapien
gggcggttactgtcgcagcgatggt

SEQ ID NO: 429241 - DNA, 25 bp, Homo sapien
ctgtcgcagcgatggtggagatggt

SEQ ID NO: 429242 - DNA, 25 bp, Homo sapien
atggtgtgcgtaggagggtgcccct

SEQ ID NO: 429243 - DNA, 25 bp, Homo sapien
ctgcacggggtgtcagtgttgccat

SEQ ID NO: 429244 - DNA, 25 bp, Homo sapien
tcagtgttgccatgggagctgcagc

SEQ ID NO: 429245 - DNA, 25 bp, Homo sapien
ggattgggggtcagcatcaccacag

SEQ ID NO: 429246 - DNA, 25 bp, Homo sapien
ggggtcagcatcaccacagaagtat

SEQ ID NO: 429247 - DNA, 25 bp, Homo sapien
gcagctgccgctgggattcttgtac

SEQ ID NO: 429248 - DNA, 25 bp, Homo sapien
agctgccgctgggattcttgtacgt

SEQ ID NO: 429249 - DNA, 25 bp, Homo sapien
gccgctgggattcttgtacgtgcat

SEQ ID NO: 429250 - DNA, 25 bp, Homo sapien
ttgtacgtgcatcacacctacgtgc

SEQ ID NO: 429251 - DNA, 25 bp, Homo sapien
tgcacggacttcacgcgctgcgcag

SEQ ID NO: 429252 - DNA, 25 bp, Homo sapien
cgcagccaacatgcgctccatgcag

SEQ ID NO: 429253 - DNA, 25 bp, Homo sapien
taccaccaggacacgcaaggctggg

SEQ ID NO: 429254 - DNA, 25 bp, Homo sapien
ggagacatcggctacagtttcgtgg

SEQ ID NO: 429255 - DNA, 25 bp, Homo sapien
gacatcggctacagtttcgtggtgg

SEQ ID NO: 429256 - DNA, 25 bp, Homo sapien
ttcgtggtgggctcggacggctacg

SEQ ID NO: 429257 - DNA, 25 bp, Homo sapien
ggacggctacgtgtacgagggacgc

SEQ ID NO: 429258 - DNA, 25 bp, Homo sapien
ggttatacttaatcatgccaaaggt

SEQ ID NO: 429259 - DNA, 25 bp, Homo sapien
gccaaaggtctgtgcatgattaaca

SEQ ID NO: 429260 - DNA, 25 bp, Homo sapien
tgtgcatgattaacagacctgtttg

SEQ ID NO: 429261 - DNA, 25 bp, Homo sapien
gcagccagcagggtttgctcaggcc

SEQ ID NO: 429262 - DNA, 25 bp, Homo sapien
agcagggtttgctcaggcccagctc

SEQ ID NO: 429263 - DNA, 25 bp, Homo sapien
gcagtttcctgcactgtcgtccgta

SEQ ID NO: 429264 - DNA, 25 bp, Homo sapien
tgtcgtccgtacttctaaggctatg

SEQ ID NO: 429265 - DNA, 25 bp, Homo sapien
gtacttctaaggctatggttcacaa

SEQ ID NO: 429266 - DNA, 25 bp, Homo sapien
gggaaaccattccagctatgtagaa

SEQ ID NO: 429267 - DNA, 25 bp, Homo sapien
atgttgtttaagatcttttccagaa

SEQ ID NO: 429268 - DNA, 25 bp, Homo sapien
tcttttccagaagatggttatactt

SEQ ID NO: 429269 - DNA, 25 bp, Homo sapien
atgtgtagcaggcttacaagaaata

SEQ ID NO: 429270 - DNA, 25 bp, Homo sapien
tgtgtagcaggcttacaagaaatac

SEQ ID NO: 429271 - DNA, 25 bp, Homo sapien
gtgtagcaggcttacaagaaatact

SEQ ID NO: 429272 - DNA, 25 bp, Homo sapien
tgtagcaggcttacaagaaatactt

SEQ ID NO: 429273 - DNA, 25 bp, Homo sapien
gtagcaggcttacaagaaatacttg

SEQ ID NO: 429274 - DNA, 25 bp, Homo sapien
agcaggcttacaagaaatacttgtg

SEQ ID NO: 429275 - DNA, 25 bp, Homo sapien
ggcttacaagaaatacttgtggccg

SEQ ID NO: 429276 - DNA, 25 bp, Homo sapien
ttacaagaaatacttgtggccgggc

SEQ ID NO: 429277 - DNA, 25 bp, Homo sapien
tacaagaaatacttgtggccgggcg

SEQ ID NO: 429278 - DNA, 25 bp, Homo sapien
acaagaaatacttgtggccgggcgc

SEQ ID NO: 429279 - DNA, 25 bp, Homo sapien
caagaaatacttgtggccgggcgcg

SEQ ID NO: 429280 - DNA, 25 bp, Homo sapien
ttgggcacccaaaccatttaaacag

SEQ ID NO: 429281 - DNA, 25 bp, Homo sapien
gatactgttttataactagttgcca

SEQ ID NO: 429282 - DNA, 25 bp, Homo sapien
ttataactagttgccaaacttaaag

SEQ ID NO: 429283 - DNA, 25 bp, Homo sapien
caaacttaaagttaatgctcttcag

SEQ ID NO: 429284 - DNA, 25 bp, Homo sapien
aaagttaatgctcttcaggggccat

SEQ ID NO: 429285 - DNA, 25 bp, Homo sapien
gggccattcatagaagctgtttaaa

SEQ ID NO: 429286 - DNA, 25 bp, Homo sapien
gagaaggtgggtgctctttgtcatt

SEQ ID NO: 429287 - DNA, 25 bp, Homo sapien
gtgggtgctctttgtcattgttgaa

SEQ ID NO: 429288 - DNA, 25 bp, Homo sapien
ttttcactttgagagctagattatg

SEQ ID NO: 429289 - DNA, 25 bp, Homo sapien
gctagattatgtgtctggtcttaaa

SEQ ID NO: 429290 - DNA, 25 bp, Homo sapien
atgtgtctggtcttaaatctttatg

SEQ ID NO: 429291 - DNA, 25 bp, Homo sapien
ggtgaatcagggagccgggagcccc

SEQ ID NO: 429292 - DNA, 25 bp, Homo sapien
gtgaatcagggagccgggagccccg

SEQ ID NO: 429293 - DNA, 25 bp, Homo sapien
gccccagctggctccattgctgagg

SEQ ID NO: 429294 - DNA, 25 bp, Homo sapien
attgctgaggcctggcctgcttcct

SEQ ID NO: 429295 - DNA, 25 bp, Homo sapien
gcagaccccagtgcttcctgcacag

SEQ ID NO: 429296 - DNA, 25 bp, Homo sapien
caccagcaggaggagacccgaggga

SEQ ID NO: 429297 - DNA, 25 bp, Homo sapien
agcagctcagactcacccagggtga

SEQ ID NO: 429298 - DNA, 25 bp, Homo sapien
gcagctcagactcacccagggtgac

SEQ ID NO: 429299 - DNA, 25 bp, Homo sapien
agctcagactcacccagggtgacca

SEQ ID NO: 429300 - DNA, 25 bp, Homo sapien
tcagactcacccagggtgaccacca

SEQ ID NO: 429301 - DNA, 25 bp, Homo sapien
ggtgaccaccatgacggggatgctc

SEQ ID NO: 429302 - DNA, 25 bp, Homo sapien
gtaaaccatttttctatcaaaatag

SEQ ID NO: 429303 - DNA, 25 bp, Homo sapien
acattcagagtatatctttgcttct

SEQ ID NO: 429304 - DNA, 25 bp, Homo sapien
ttcagagtatatctttgcttctctc

SEQ ID NO: 429305 - DNA, 25 bp, Homo sapien
ttccattaccagaaatgtactaact

SEQ ID NO: 429306 - DNA, 25 bp, Homo sapien
taccagaaatgtactaactttagac

SEQ ID NO: 429307 - DNA, 25 bp, Homo sapien
gaaatgtactaactttagaccaaca

SEQ ID NO: 429308 - DNA, 25 bp, Homo sapien
gtactaactttagaccaacataata

SEQ ID NO: 429309 - DNA, 25 bp, Homo sapien
gctctgatttctgacaaaggcccct

SEQ ID NO: 429310 - DNA, 25 bp, Homo sapien
tctgatttctgacaaaggcccctag

SEQ ID NO: 429311 - DNA, 25 bp, Homo sapien
gatttctgacaaaggcccctagata

SEQ ID NO: 429312 - DNA, 25 bp, Homo sapien
acaaaggcccctagataaatgcatg

SEQ ID NO: 429313 - DNA, 25 bp, Homo sapien
gtcagccctatactgtggtcttaat

SEQ ID NO: 429314 - DNA, 25 bp, Homo sapien
ctgcatttcgtgtgttagaagctga

SEQ ID NO: 429315 - DNA, 25 bp, Homo sapien
tagaagctgattctaggctgaggaa

SEQ ID NO: 429316 - DNA, 25 bp, Homo sapien
gctgaggaaagcaagagttctctac

SEQ ID NO: 429317 - DNA, 25 bp, Homo sapien
aaagcaagagttctctacttttgct

SEQ ID NO: 429318 - DNA, 25 bp, Homo sapien
agagttctctacttttgctcaatat

SEQ ID NO: 429319 - DNA, 25 bp, Homo sapien
cttttgctcaatattgaggcttacc

SEQ ID NO: 429320 - DNA, 25 bp, Homo sapien
agtttgactctacagctagtgaagt

SEQ ID NO: 429321 - DNA, 25 bp, Homo sapien
gactctacagctagtgaagtggttt

SEQ ID NO: 429322 - DNA, 25 bp, Homo sapien
tacagctagtgaagtggtttattgc

SEQ ID NO: 429323 - DNA, 25 bp, Homo sapien
gtgaagtggtttattgcttcaataa

SEQ ID NO: 429324 - DNA, 25 bp, Homo sapien
aagggagcttcccaaatgagcctgt

SEQ ID NO: 429325 - DNA, 25 bp, Homo sapien
gagcttcccaaatgagcctgtagaa

SEQ ID NO: 429326 - DNA, 25 bp, Homo sapien
tcccaaatgagcctgtagaaagcca

SEQ ID NO: 429327 - DNA, 25 bp, Homo sapien
ggtttctcagccttgaggtataagg

SEQ ID NO: 429328 - DNA, 25 bp, Homo sapien
aggtataaggtctaaaggctctggg

SEQ ID NO: 429329 - DNA, 25 bp, Homo sapien
gggattcactgcatacaccacttcc

SEQ ID NO: 429330 - DNA, 25 bp, Homo sapien
ttcactgcatacaccacttccagtt

SEQ ID NO: 429331 - DNA, 25 bp, Homo sapien
acttccagttcaagcgcctaggttg

SEQ ID NO: 429332 - DNA, 25 bp, Homo sapien
agttcaagcgcctaggttggttaca

SEQ ID NO: 429333 - DNA, 25 bp, Homo sapien
caagcgcctaggttggttacagcag

SEQ ID NO: 429334 - DNA, 25 bp, Homo sapien
tggttacagcaggaagttgacaagt

SEQ ID NO: 429335 - DNA, 25 bp, Homo sapien
gtagaatagctgtcagaggccagaa

SEQ ID NO: 429336 - DNA, 25 bp, Homo sapien
cagccttccgagtaatggatcagta

SEQ ID NO: 429337 - DNA, 25 bp, Homo sapien
actgtttaatgggtagaggtgtcca

SEQ ID NO: 429338 - DNA, 25 bp, Homo sapien
gtagaggtgtccaattgtgaatgat

SEQ ID NO: 429339 - DNA, 25 bp, Homo sapien
ggtgtccaattgtgaatgatgagaa

SEQ ID NO: 429340 - DNA, 25 bp, Homo sapien
atggatcagtatgcgcaccatgctg

SEQ ID NO: 429341 - DNA, 25 bp, Homo sapien
gatcagtatgcgcaccatgctgcta

SEQ ID NO: 429342 - DNA, 25 bp, Homo sapien
gatgagttctccatgttggcagctg

SEQ ID NO: 429343 - DNA, 25 bp, Homo sapien
gagttctccatgttggcagctggtc

SEQ ID NO: 429344 - DNA, 25 bp, Homo sapien
tgttggcagctggtcttgactccga

SEQ ID NO: 429345 - DNA, 25 bp, Homo sapien
ttggcagctggtcttgactccgacc

SEQ ID NO: 429346 - DNA, 25 bp, Homo sapien
tgagcgtgtccatgctgctgcggta

SEQ ID NO: 429347 - DNA, 25 bp, Homo sapien
tgtccatgctgctgcggtactcaca

SEQ ID NO: 429348 - DNA, 25 bp, Homo sapien
tgcggtactcacaccaccagatctt

SEQ ID NO: 429349 - DNA, 25 bp, Homo sapien
accagatcttcgtcttcatcgtgga

SEQ ID NO: 429350 - DNA, 25 bp, Homo sapien
gaggccatcatgtcggagttcttca

SEQ ID NO: 429351 - DNA, 25 bp, Homo sapien
tcggagttcttcaacgacaccacca

SEQ ID NO: 429352 - DNA, 25 bp, Homo sapien
atcatcctcatcgtgtggctcgcgg

SEQ ID NO: 429353 - DNA, 25 bp, Homo sapien
catcgtgtggctcgcggaccagtat

SEQ ID NO: 429354 - DNA, 25 bp, Homo sapien
ggaccagtatgacgccatctgctgc

SEQ ID NO: 429355 - DNA, 25 bp, Homo sapien
accagcaccagcaagcggcattggc

SEQ ID NO: 429356 - DNA, 25 bp, Homo sapien
ccagcaagcggcattggctgcggtt

SEQ ID NO: 429357 - DNA, 25 bp, Homo sapien
acttctttcctcatagcctgtgagt

SEQ ID NO: 429358 - DNA, 25 bp, Homo sapien
tcatagcctgtgagtcactctgctg

SEQ ID NO: 429359 - DNA, 25 bp, Homo sapien
agtcactctgctgggtgccctctga

SEQ ID NO: 429360 - DNA, 25 bp, Homo sapien
cagctgtgcacctggtaaggccgct

SEQ ID NO: 429361 - DNA, 25 bp, Homo sapien
gagatctgaagccaccaggatccca

SEQ ID NO: 429362 - DNA, 25 bp, Homo sapien
aggatcccaggtcacccatttctct

SEQ ID NO: 429363 - DNA, 25 bp, Homo sapien
ccttgaccgtcacagtgcatctggg

SEQ ID NO: 429364 - DNA, 25 bp, Homo sapien
gggagcctttcagtcttgtcgcagg

SEQ ID NO: 429365 - DNA, 25 bp, Homo sapien
tttcagtcttgtcgcaggttgagca

SEQ ID NO: 429366 - DNA, 25 bp, Homo sapien
gggctgcaggtcttggcatcctgaa

SEQ ID NO: 429367 - DNA, 25 bp, Homo sapien
ttggcatcctgaagatacaagcaag

SEQ ID NO: 429368 - DNA, 25 bp, Homo sapien
ttctacttgtccaataaggatgatg

SEQ ID NO: 429369 - DNA, 25 bp, Homo sapien
ttgtccaataaggatgatgattttc

SEQ ID NO: 429370 - DNA, 25 bp, Homo sapien
gatgtaaatgttaacttcaatagca

SEQ ID NO: 429371 - DNA, 25 bp, Homo sapien
tctctttgagattgactgtgaatgt

SEQ ID NO: 429372 - DNA, 25 bp, Homo sapien
aagtgtctaaattagtctgaggatc

SEQ ID NO: 429373 - DNA, 25 bp, Homo sapien
tagtctgaggatcaatgagggtcaa

SEQ ID NO: 429374 - DNA, 25 bp, Homo sapien
caatgagggtcaattcagttaggaa

SEQ ID NO: 429375 - DNA, 25 bp, Homo sapien
gaataatgaaacgtgtctctctgaa

SEQ ID NO: 429376 - DNA, 25 bp, Homo sapien
taatgaaacgtgtctctctgaattc

SEQ ID NO: 429377 - DNA, 25 bp, Homo sapien
tgttttagtcatttatcaggccaaa

SEQ ID NO: 429378 - DNA, 25 bp, Homo sapien
aaatgtttttgtactacaagatgga

SEQ ID NO: 429379 - DNA, 25 bp, Homo sapien
cagaggttggaatggcattgtgcca

SEQ ID NO: 429380 - DNA, 25 bp, Homo sapien
ggcattgtgccaaaaccatgggttt

SEQ ID NO: 429381 - DNA, 25 bp, Homo sapien
gagatctgagggtatatccatgctg

SEQ ID NO: 429382 - DNA, 25 bp, Homo sapien
ggtatatccatgctgtttactacat

SEQ ID NO: 429383 - DNA, 25 bp, Homo sapien
tattatgtctgtctcaaagttgttg

SEQ ID NO: 429384 - DNA, 25 bp, Homo sapien
gaaaacagtagttatgaaaacccat

SEQ ID NO: 429385 - DNA, 25 bp, Homo sapien
gaaaacccatgtaggaacctggaat

SEQ ID NO: 429386 - DNA, 25 bp, Homo sapien
gaacctggaataagacattctcaat

SEQ ID NO: 429387 - DNA, 25 bp, Homo sapien
ctcaataaatggtagttctcaaaaa

SEQ ID NO: 429388 - DNA, 25 bp, Homo sapien
aggctgtagtaataacatttaccaa

SEQ ID NO: 429389 - DNA, 25 bp, Homo sapien
catttaccaaaacgatggcatttat

SEQ ID NO: 429390 - DNA, 25 bp, Homo sapien
gagtggaagatcctgcccatttgag

SEQ ID NO: 429391 - DNA, 25 bp, Homo sapien
gatcctgcccatttgagatcagttc

SEQ ID NO: 429392 - DNA, 25 bp, Homo sapien
agatcagttcatacctcggcatcga

SEQ ID NO: 429393 - DNA, 25 bp, Homo sapien
tcggcatcgacgaggctgacaggca

SEQ ID NO: 429394 - DNA, 25 bp, Homo sapien
gacaggcagctgactcgatgctgac

SEQ ID NO: 429395 - DNA, 25 bp, Homo sapien
gactcgatgctgacgatgctgacca

SEQ ID NO: 429396 - DNA, 25 bp, Homo sapien
gatgctgaccagacctgcattttcc

SEQ ID NO: 429397 - DNA, 25 bp, Homo sapien
ggcctctagagctctgaatcctgga

SEQ ID NO: 429398 - DNA, 25 bp, Homo sapien
tagagggcaacctaggtcttctctg

SEQ ID NO: 429399 - DNA, 25 bp, Homo sapien
tgaggtccccaacaggcactatcag

SEQ ID NO: 429400 - DNA, 25 bp, Homo sapien
ggcactatcagcttgacctgaacat

SEQ ID NO: 429401 - DNA, 25 bp, Homo sapien
caggcctgtcgctgctgtgcctggt

SEQ ID NO: 429402 - DNA, 25 bp, Homo sapien
tgtgcctggtgttggcgctgcctgc

SEQ ID NO: 429403 - DNA, 25 bp, Homo sapien
gctgtacgcggagtggcagaaacac

SEQ ID NO: 429404 - DNA, 25 bp, Homo sapien
tgtacgcggagtggcagaaacaccc

SEQ ID NO: 429405 - DNA, 25 bp, Homo sapien
gcggagtggcagaaacacccaccta

SEQ ID NO: 429406 - DNA, 25 bp, Homo sapien
ggagtggcagaaacacccacctacc

SEQ ID NO: 429407 - DNA, 25 bp, Homo sapien
tacccctggcgggacgcagagacag

SEQ ID NO: 429408 - DNA, 25 bp, Homo sapien
gcacctttgtgcagcggccgtgccg

SEQ ID NO: 429409 - DNA, 25 bp, Homo sapien
gacagccccacgacgtgtggcccgt

SEQ ID NO: 429410 - DNA, 25 bp, Homo sapien
gccactacacgcagttctggaacta

SEQ ID NO: 429411 - DNA, 25 bp, Homo sapien
actacacgcagttctggaactacct

SEQ ID NO: 429412 - DNA, 25 bp, Homo sapien
gcttctgttattccaccaataagga

SEQ ID NO: 429413 - DNA, 25 bp, Homo sapien
gactggattttgttcttcctcttca

SEQ ID NO: 429414 - DNA, 25 bp, Homo sapien
atttctcaccaagacctgcattaga

SEQ ID NO: 429415 - DNA, 25 bp, Homo sapien
gaagcttaggcacacaactctgatt

SEQ ID NO: 429416 - DNA, 25 bp, Homo sapien
ttacctagtacttttctttgctgcc

SEQ ID NO: 429417 - DNA, 25 bp, Homo sapien
actgctgcagtcatacctatgtcaa

SEQ ID NO: 429418 - DNA, 25 bp, Homo sapien
ctatgtcaaagttacactcctctct

SEQ ID NO: 429419 - DNA, 25 bp, Homo sapien
actcctctcttccaatgatttgagc

SEQ ID NO: 429420 - DNA, 25 bp, Homo sapien
tgagctcctctcttttgtttcaagg

SEQ ID NO: 429421 - DNA, 25 bp, Homo sapien
tcttttgtttcaaggctaccctcat

SEQ ID NO: 429422 - DNA, 25 bp, Homo sapien
gctaccctcatcttgaatcttggtt

SEQ ID NO: 429423 - DNA, 25 bp, Homo sapien
ggagggctctggtcatgtccagaat

SEQ ID NO: 429424 - DNA, 25 bp, Homo sapien
gctggcctggctggtgagggtcaca

SEQ ID NO: 429425 - DNA, 25 bp, Homo sapien
agggtcacagaccagtcatccatgg

SEQ ID NO: 429426 - DNA, 25 bp, Homo sapien
cagtcatccatggaggtttgcccat

SEQ ID NO: 429427 - DNA, 25 bp, Homo sapien
ggaggtttgcccatggactacacgc

SEQ ID NO: 429428 - DNA, 25 bp, Homo sapien
gactacacgcaaagatcctaacaaa

SEQ ID NO: 429429 - DNA, 25 bp, Homo sapien
agaggaatcactgttggcaaggccc

SEQ ID NO: 429430 - DNA, 25 bp, Homo sapien
atcactgttggcaaggccccactgt

SEQ ID NO: 429431 - DNA, 25 bp, Homo sapien
aagacagtgcctggcagtgtgcagc

SEQ ID NO: 429432 - DNA, 25 bp, Homo sapien
aggggtttgcacctcatctttcaga

SEQ ID NO: 429433 - DNA, 25 bp, Homo sapien
atggcagtttggactctgggctgct

SEQ ID NO: 429434 - DNA, 25 bp, Homo sapien
aatttgtcacagcagacctaggtaa

SEQ ID NO: 429435 - DNA, 25 bp, Homo sapien
tttgtcacagcagacctaggtaata

SEQ ID NO: 429436 - DNA, 25 bp, Homo sapien
gtcacagcagacctaggtaataagt

SEQ ID NO: 429437 - DNA, 25 bp, Homo sapien
gcagacctaggtaataagtaaatac

SEQ ID NO: 429438 - DNA, 25 bp, Homo sapien
aagtaaatactctatcatattctag

SEQ ID NO: 429439 - DNA, 25 bp, Homo sapien
atactctatcatattctagaaccta

SEQ ID NO: 429440 - DNA, 25 bp, Homo sapien
atcatattctagaacctatcatagt

SEQ ID NO: 429441 - DNA, 25 bp, Homo sapien
cctatcatagtttctaccatctgtt

SEQ ID NO: 429442 - DNA, 25 bp, Homo sapien
tatcatagtttctaccatctgttct

SEQ ID NO: 429443 - DNA, 25 bp, Homo sapien
tcatagtttctaccatctgttctct

SEQ ID NO: 429444 - DNA, 25 bp, Homo sapien
tattgaaaggctactatgtgccaga

SEQ ID NO: 429445 - DNA, 25 bp, Homo sapien
atttttcaagtgctgcccccaagcc

SEQ ID NO: 429446 - DNA, 25 bp, Homo sapien
aacaattatgcttatgaagtttact

SEQ ID NO: 429447 - DNA, 25 bp, Homo sapien
attttctttagtgtagtatgtgaag

SEQ ID NO: 429448 - DNA, 25 bp, Homo sapien
gtagtatgtgaaggcactggttcaa

SEQ ID NO: 429449 - DNA, 25 bp, Homo sapien
tgtgaaggcactggttcaacaggat

SEQ ID NO: 429450 - DNA, 25 bp, Homo sapien
gcactggttcaacaggatggctcca

SEQ ID NO: 429451 - DNA, 25 bp, Homo sapien
ggttcaacaggatggctccagaact

SEQ ID NO: 429452 - DNA, 25 bp, Homo sapien
aacaggatggctccagaactgtgtt

SEQ ID NO: 429453 - DNA, 25 bp, Homo sapien
gctccagaactgtgtttttctaatg

SEQ ID NO: 429454 - DNA, 25 bp, Homo sapien
gaactgtgtttttctaatgtttggt

SEQ ID NO: 429455 - DNA, 25 bp, Homo sapien
ctgtgtttttctaatgtttggtaag

SEQ ID NO: 429456 - DNA, 25 bp, Homo sapien
agagcatatgatttaacttagaaga

SEQ ID NO: 429457 - DNA, 25 bp, Homo sapien
atttaggagccaaaaggaagctgac

SEQ ID NO: 429458 - DNA, 25 bp, Homo sapien
ggaacatgtgaaaaacccctgagct

SEQ ID NO: 429459 - DNA, 25 bp, Homo sapien
acatgtgaaaaacccctgagctgaa

SEQ ID NO: 429460 - DNA, 25 bp, Homo sapien
aaacccctgagctgaaggaaccaca

SEQ ID NO: 429461 - DNA, 25 bp, Homo sapien
tgaaggaaccacaagcccgcaattg

SEQ ID NO: 429462 - DNA, 25 bp, Homo sapien
acaagcccgcaattgtcctggcctt

SEQ ID NO: 429463 - DNA, 25 bp, Homo sapien
gcccgcaattgtcctggccttgcag

SEQ ID NO: 429464 - DNA, 25 bp, Homo sapien
aaaggaagctgacttagacaataga

SEQ ID NO: 429465 - DNA, 25 bp, Homo sapien
cactcctctctagatgggagccgaa

SEQ ID NO: 429466 - DNA, 25 bp, Homo sapien
ctctctagatgggagccgaagggaa

SEQ ID NO: 429467 - DNA, 25 bp, Homo sapien
atgcccggccagtgtcctttcttat

SEQ ID NO: 429468 - DNA, 25 bp, Homo sapien
cggccagtgtcctttcttatacacg

SEQ ID NO: 429469 - DNA, 25 bp, Homo sapien
gccagtgtcctttcttatacacgta

SEQ ID NO: 429470 - DNA, 25 bp, Homo sapien
cagtgtcctttcttatacacgtaca

SEQ ID NO: 429471 - DNA, 25 bp, Homo sapien
gtgtcctttcttatacacgtacata

SEQ ID NO: 429472 - DNA, 25 bp, Homo sapien
gtcctttcttatacacgtacataca

SEQ ID NO: 429473 - DNA, 25 bp, Homo sapien
cctttcttatacacgtacatacatg

SEQ ID NO: 429474 - DNA, 25 bp, Homo sapien
ttcttatacacgtacatacatgatg

SEQ ID NO: 429475 - DNA, 25 bp, Homo sapien
atacacgtacatacatgatgatggc

SEQ ID NO: 429476 - DNA, 25 bp, Homo sapien
acacgtacatacatgatgatggctt

SEQ ID NO: 429477 - DNA, 25 bp, Homo sapien
cgtacatacatgatgatggcttgag

SEQ ID NO: 429478 - DNA, 25 bp, Homo sapien
gcataaaaacgcagacacaacagtg

SEQ ID NO: 429479 - DNA, 25 bp, Homo sapien
aacgcagacacaacagtgagaagtc

SEQ ID NO: 429480 - DNA, 25 bp, Homo sapien
gagaagtcagactagttgagttact

SEQ ID NO: 429481 - DNA, 25 bp, Homo sapien
gtcagactagttgagttactacaac

SEQ ID NO: 429482 - DNA, 25 bp, Homo sapien
caaagtattttagttaagagatcac

SEQ ID NO: 429483 - DNA, 25 bp, Homo sapien
cacttagaaatttggtactggatga

SEQ ID NO: 429484 - DNA, 25 bp, Homo sapien
taaaggcaatagcatgcggcaaact

SEQ ID NO: 429485 - DNA, 25 bp, Homo sapien
tagcatgcggcaaactggtttttaa

SEQ ID NO: 429486 - DNA, 25 bp, Homo sapien
aattcatgtgcaattttactacaaa

SEQ ID NO: 429487 - DNA, 25 bp, Homo sapien
ggaaatacataaacacactatctca

SEQ ID NO: 429488 - DNA, 25 bp, Homo sapien
aacacactatctcaataaggcaccc

SEQ ID NO: 429489 - DNA, 25 bp, Homo sapien
agaacgccggagtcatcaagctctt

SEQ ID NO: 429490 - DNA, 25 bp, Homo sapien
aagactgatgagcttctctgtgcaa

SEQ ID NO: 429491 - DNA, 25 bp, Homo sapien
gtgaactaggtcaagtcactctccc

SEQ ID NO: 429492 - DNA, 25 bp, Homo sapien
ggatcaccagtttacccaactgtaa

SEQ ID NO: 429493 - DNA, 25 bp, Homo sapien
gaactgaacgttcttccttctacag

SEQ ID NO: 429494 - DNA, 25 bp, Homo sapien
agcttctctgtgcaagggtgccttt

SEQ ID NO: 429495 - DNA, 25 bp, Homo sapien
aattcttcgtttgctaggtttgtga

SEQ ID NO: 429496 - DNA, 25 bp, Homo sapien
gtgcctttttggagcaatgtcccca

SEQ ID NO: 429497 - DNA, 25 bp, Homo sapien
aatgtccccattcggtccattgata

SEQ ID NO: 429498 - DNA, 25 bp, Homo sapien
cggtccattgatatgaaccacttca

SEQ ID NO: 429499 - DNA, 25 bp, Homo sapien
gaaccacttcattgaatgtcttaga

SEQ ID NO: 429500 - DNA, 25 bp, Homo sapien
cagtcagacatctggtgtggactct

SEQ ID NO: 429501 - DNA, 25 bp, Homo sapien
tgtggactctgttctacccatgcct

SEQ ID NO: 429502 - DNA, 25 bp, Homo sapien
tgcctcctctgcaaggtacccagta

SEQ ID NO: 429503 - DNA, 25 bp, Homo sapien
gtacccagtaccatgaagttaggct

SEQ ID NO: 429504 - DNA, 25 bp, Homo sapien
agttaggctatgcttcaagctgcca

SEQ ID NO: 429505 - DNA, 25 bp, Homo sapien
tgcagaatttgcttgggagccatgt

SEQ ID NO: 429506 - DNA, 25 bp, Homo sapien
gtgaaagtgagctttaaccccactt

SEQ ID NO: 429507 - DNA, 25 bp, Homo sapien
actttcctactttccagttgtatgg

SEQ ID NO: 429508 - DNA, 25 bp, Homo sapien
atctttattcctgatgagcttcaag

SEQ ID NO: 429509 - DNA, 25 bp, Homo sapien
gagcttcaagctcctcatctgtgaa

SEQ ID NO: 429510 - DNA, 25 bp, Homo sapien
gtggcttatgtcacagtcagacatc

SEQ ID NO: 429511 - DNA, 25 bp, Homo sapien
gacacattccaaagagctctaacta

SEQ ID NO: 429512 - DNA, 25 bp, Homo sapien
gagctctaactatgataggtcctga

SEQ ID NO: 429513 - DNA, 25 bp, Homo sapien
aggtcctgattactaaagaagcttc

SEQ ID NO: 429514 - DNA, 25 bp, Homo sapien
aagaagcttctttactggcctcaat

SEQ ID NO: 429515 - DNA, 25 bp, Homo sapien
tggcctcaatttctagctttcatgt

SEQ ID NO: 429516 - DNA, 25 bp, Homo sapien
ggaaaattttctgcagtccttctgt

SEQ ID NO: 429517 - DNA, 25 bp, Homo sapien
tagagcaaagtgctcctgtttttta

SEQ ID NO: 429518 - DNA, 25 bp, Homo sapien
acaattattgtgttcttttcatgga

SEQ ID NO: 429519 - DNA, 25 bp, Homo sapien
ggatgttaacatttccagggtggga

SEQ ID NO: 429520 - DNA, 25 bp, Homo sapien
gggtaatcctaaatcatttcccaat

SEQ ID NO: 429521 - DNA, 25 bp, Homo sapien
tttcccaatctattctaattacctt

SEQ ID NO: 429522 - DNA, 25 bp, Homo sapien
agataatagagcacagcctacccct

SEQ ID NO: 429523 - DNA, 25 bp, Homo sapien
aactcagcacccatatgcacttaca

SEQ ID NO: 429524 - DNA, 25 bp, Homo sapien
atgcacttacacaaccaaacaacag

SEQ ID NO: 429525 - DNA, 25 bp, Homo sapien
gtagcaacaatatcatgcttctgcc

SEQ ID NO: 429526 - DNA, 25 bp, Homo sapien
atgcttctgcctgatgtaatacaac

SEQ ID NO: 429527 - DNA, 25 bp, Homo sapien
atgtaatacaactagctcctgcacc

SEQ ID NO: 429528 - DNA, 25 bp, Homo sapien
agctcctgcaccagtatgtgttgca

SEQ ID NO: 429529 - DNA, 25 bp, Homo sapien
catggttatatatagtctggtgtac

SEQ ID NO: 429530 - DNA, 25 bp, Homo sapien
tatagtctggtgtactactggcaat

SEQ ID NO: 429531 - DNA, 25 bp, Homo sapien
gtactactggcaatggatcctgcaa

SEQ ID NO: 429532 - DNA, 25 bp, Homo sapien
atcctgcaaaatgtaggcttgtctt

SEQ ID NO: 429533 - DNA, 25 bp, Homo sapien
gaaatcatttaatccaacctcctaa

SEQ ID NO: 429534 - DNA, 25 bp, Homo sapien
atccaacctcctaatttttcagatg

SEQ ID NO: 429535 - DNA, 25 bp, Homo sapien
gagaccaaggcccacagaggtgcct

SEQ ID NO: 429536 - DNA, 25 bp, Homo sapien
agaggtgcctttgatttgcccaggt

SEQ ID NO: 429537 - DNA, 25 bp, Homo sapien
gatttgcccaggtcctattagttag

SEQ ID NO: 429538 - DNA, 25 bp, Homo sapien
gttagtggctcaggtggaccagaat

SEQ ID NO: 429539 - DNA, 25 bp, Homo sapien
tctttatgctccacctgtttcattt

SEQ ID NO: 429540 - DNA, 25 bp, Homo sapien
aaaatacctattcctcactgtacca

SEQ ID NO: 429541 - DNA, 25 bp, Homo sapien
ggccaggaggaagtacattccacaa

SEQ ID NO: 429542 - DNA, 25 bp, Homo sapien
aagtatgccctaatgggagcaatta

SEQ ID NO: 429543 - DNA, 25 bp, Homo sapien
ggagcaattactatcctaatgcact

SEQ ID NO: 429544 - DNA, 25 bp, Homo sapien
tcttttgaaagacttgcagatgcaa

SEQ ID NO: 429545 - DNA, 25 bp, Homo sapien
cttgcagatgcaatagtctaattag

SEQ ID NO: 429546 - DNA, 25 bp, Homo sapien
gtttagcaaatagcttacaagttga

SEQ ID NO: 429547 - DNA, 25 bp, Homo sapien
ttttttcctatggaatggcattcta

SEQ ID NO: 429548 - DNA, 25 bp, Homo sapien
gcttacaagttgagccaattttgga

SEQ ID NO: 429549 - DNA, 25 bp, Homo sapien
gagccaattttggatttgttgggta

SEQ ID NO: 429550 - DNA, 25 bp, Homo sapien
gatttgttgggtagttaaacttcag

SEQ ID NO: 429551 - DNA, 25 bp, Homo sapien
ggtagttaaacttcagagatatttt

SEQ ID NO: 429552 - DNA, 25 bp, Homo sapien
gagatattttgttgcctgtatttaa

SEQ ID NO: 429553 - DNA, 25 bp, Homo sapien
ggaatggcattctatattatctaga

SEQ ID NO: 429554 - DNA, 25 bp, Homo sapien
tgcctcccccaaaagaatttcatat

SEQ ID NO: 429555 - DNA, 25 bp, Homo sapien
ctggctaaaagtctctcttgggatt

SEQ ID NO: 429556 - DNA, 25 bp, Homo sapien
taaaagtctctcttgggattgccaa

SEQ ID NO: 429557 - DNA, 25 bp, Homo sapien
gtctctcttgggattgccaatgagg

SEQ ID NO: 429558 - DNA, 25 bp, Homo sapien
ccaatgaggagtgccatggctcgta

SEQ ID NO: 429559 - DNA, 25 bp, Homo sapien
gaggagtgccatggctcgtacatga

SEQ ID NO: 429560 - DNA, 25 bp, Homo sapien
gagtgccatggctcgtacatgatca

SEQ ID NO: 429561 - DNA, 25 bp, Homo sapien
tgccatggctcgtacatgatcaccc

SEQ ID NO: 429562 - DNA, 25 bp, Homo sapien
caaaccccaagtcctgtattctagt

SEQ ID NO: 429563 - DNA, 25 bp, Homo sapien
accccaagtcctgtattctagtaag

SEQ ID NO: 429564 - DNA, 25 bp, Homo sapien
ctgtattctagtaaggtgccacaca

SEQ ID NO: 429565 - DNA, 25 bp, Homo sapien
ttctagtaaggtgccacacagcctg

SEQ ID NO: 429566 - DNA, 25 bp, Homo sapien
aaaaattaagaatcccactgagtag

SEQ ID NO: 429567 - DNA, 25 bp, Homo sapien
aagaatcccactgagtagtgcaaaa

SEQ ID NO: 429568 - DNA, 25 bp, Homo sapien
agatgtacacatatgactcaaggaa

SEQ ID NO: 429569 - DNA, 25 bp, Homo sapien
tacaatgtgtcaatgaaacagctaa

SEQ ID NO: 429570 - DNA, 25 bp, Homo sapien
ttggtttcctgttggttacctgtag

SEQ ID NO: 429571 - DNA, 25 bp, Homo sapien
tcctgttggttacctgtagccacaa

SEQ ID NO: 429572 - DNA, 25 bp, Homo sapien
ttggttacctgtagccacaacttgc

SEQ ID NO: 429573 - DNA, 25 bp, Homo sapien
agccacaacttgctgttcctttaaa

SEQ ID NO: 429574 - DNA, 25 bp, Homo sapien
gctgttcctttaaagagctctctca

SEQ ID NO: 429575 - DNA, 25 bp, Homo sapien
taaagagctctctcattattataga

SEQ ID NO: 429576 - DNA, 25 bp, Homo sapien
tataaaagcagttttctgacgaaaa

SEQ ID NO: 429577 - DNA, 25 bp, Homo sapien
gaagaaattgccttgtagatgtgga

SEQ ID NO: 429578 - DNA, 25 bp, Homo sapien
cttgtagatgtggagggctgcaatc

SEQ ID NO: 429579 - DNA, 25 bp, Homo sapien
tgatttctccaagcacttaactttc

SEQ ID NO: 429580 - DNA, 25 bp, Homo sapien
actttctttgactgcactgagaatt

SEQ ID NO: 429581 - DNA, 25 bp, Homo sapien
tttgactgcactgagaattgctaat

SEQ ID NO: 429582 - DNA, 25 bp, Homo sapien
gcttacttttgtatactgtattttc

SEQ ID NO: 429583 - DNA, 25 bp, Homo sapien
ttttccagcattacagaaccttggt

SEQ ID NO: 429584 - DNA, 25 bp, Homo sapien
gcattacagaaccttggttattgtt

SEQ ID NO: 429585 - DNA, 25 bp, Homo sapien
gttttttagccatagaatcttctag

SEQ ID NO: 429586 - DNA, 25 bp, Homo sapien
ttagatttaagcatttgcctatggg

SEQ ID NO: 429587 - DNA, 25 bp, Homo sapien
cactgaatatgtggatgtgtgtatt

SEQ ID NO: 429588 - DNA, 25 bp, Homo sapien
agaggggcactctataaaactcctg

SEQ ID NO: 429589 - DNA, 25 bp, Homo sapien
cacacagctatcatggtcctcagag

SEQ ID NO: 429590 - DNA, 25 bp, Homo sapien
gctatcatggtcctcagagacaagg

SEQ ID NO: 429591 - DNA, 25 bp, Homo sapien
agacaaggagagtcggagaagctca

SEQ ID NO: 429592 - DNA, 25 bp, Homo sapien
gatgagatgggcacttcaccccggg

SEQ ID NO: 429593 - DNA, 25 bp, Homo sapien
agtgggaccctcgacgggatccctg

SEQ ID NO: 429594 - DNA, 25 bp, Homo sapien
gaagtgtgggccacgctcccggtaa

SEQ ID NO: 429595 - DNA, 25 bp, Homo sapien
gggatcgtcctaatgattcataaac

SEQ ID NO: 429596 - DNA, 25 bp, Homo sapien
aatgattcataaacccagtctaatg

SEQ ID NO: 429597 - DNA, 25 bp, Homo sapien
gaaagacagcagacagtcccagtag

SEQ ID NO: 429598 - DNA, 25 bp, Homo sapien
gacagcagacagtcccagtagaggg

SEQ ID NO: 429599 - DNA, 25 bp, Homo sapien
acactcaggagaacacgggcggaga

SEQ ID NO: 429600 - DNA, 25 bp, Homo sapien
aacacgggcggagaaagctcactga

SEQ ID NO: 429601 - DNA, 25 bp, Homo sapien
gagaaagctcactgatcacgtcgac

SEQ ID NO: 429602 - DNA, 25 bp, Homo sapien
tctaagcctttattgagcactactg

SEQ ID NO: 429603 - DNA, 25 bp, Homo sapien
tgagcactactgtgggtcaggctct

SEQ ID NO: 429604 - DNA, 25 bp, Homo sapien
ctactgtgggtcaggctctgggctt

SEQ ID NO: 429605 - DNA, 25 bp, Homo sapien
aggctctgggcttgactttgtaatc

SEQ ID NO: 429606 - DNA, 25 bp, Homo sapien
tctgggcttgactttgtaatcgcaa

SEQ ID NO: 429607 - DNA, 25 bp, Homo sapien
ggcttgactttgtaatcgcaagagg

SEQ ID NO: 429608 - DNA, 25 bp, Homo sapien
agaaacgggctgctctcaggacact

SEQ ID NO: 429609 - DNA, 25 bp, Homo sapien
gctgctctcaggacactcaggagaa

SEQ ID NO: 429610 - DNA, 25 bp, Homo sapien
tgggccggcggccaaaccagtcact

SEQ ID NO: 429611 - DNA, 25 bp, Homo sapien
gcggccaaaccagtcactcggggag

SEQ ID NO: 429612 - DNA, 25 bp, Homo sapien
agagcttgcgcctcgggcataggga

SEQ ID NO: 429613 - DNA, 25 bp, Homo sapien
ggtgcaggcgccaacatcagtggca

SEQ ID NO: 429614 - DNA, 25 bp, Homo sapien
gtgcaggcgccaacatcagtggcag

SEQ ID NO: 429615 - DNA, 25 bp, Homo sapien
tgcaggcgccaacatcagtggcagc

SEQ ID NO: 429616 - DNA, 25 bp, Homo sapien
gcaggcgccaacatcagtggcagca

SEQ ID NO: 429617 - DNA, 25 bp, Homo sapien
caggcgccaacatcagtggcagcag

SEQ ID NO: 429618 - DNA, 25 bp, Homo sapien
aggcgccaacatcagtggcagcagc

SEQ ID NO: 429619 - DNA, 25 bp, Homo sapien
ggcgccaacatcagtggcagcagcc

SEQ ID NO: 429620 - DNA, 25 bp, Homo sapien
cagccagggccgtggtccagtccca

SEQ ID NO: 429621 - DNA, 25 bp, Homo sapien
aatcctaaagtttgtatagaatcac

SEQ ID NO: 429622 - DNA, 25 bp, Homo sapien
gaatcacaaaatacctcaaatagcc

SEQ ID NO: 429623 - DNA, 25 bp, Homo sapien
agctggaggtatcacactaccagat

SEQ ID NO: 429624 - DNA, 25 bp, Homo sapien
gtatcacactaccagatgccaaaat

SEQ ID NO: 429625 - DNA, 25 bp, Homo sapien
tatcctgcaaagctgtagtaaccaa

SEQ ID NO: 429626 - DNA, 25 bp, Homo sapien
ttatactggcatacaaatagacata

SEQ ID NO: 429627 - DNA, 25 bp, Homo sapien
gaatagcgaacacagaaattaatcc

SEQ ID NO: 429628 - DNA, 25 bp, Homo sapien
atatctgtaaccaactgattttgac

SEQ ID NO: 429629 - DNA, 25 bp, Homo sapien
ccaactgattttgacaaatgtgcca

SEQ ID NO: 429630 - DNA, 25 bp, Homo sapien
aatgtgccaacaacactctttagga

SEQ ID NO: 429631 - DNA, 25 bp, Homo sapien
gtctctttaaaaaatggtgctgtgt

SEQ ID NO: 429632 - DNA, 25 bp, Homo sapien
ttagcactgcaccgccaggtccatg

SEQ ID NO: 429633 - DNA, 25 bp, Homo sapien
ggcagagcttccgaggctgggtggc

SEQ ID NO: 429634 - DNA, 25 bp, Homo sapien
gctgggtggccctggttctgcatct

SEQ ID NO: 429635 - DNA, 25 bp, Homo sapien
catcgcttgtcccaaatgcgagaga

SEQ ID NO: 429636 - DNA, 25 bp, Homo sapien
gcttgtcccaaatgcgagagacgct

SEQ ID NO: 429637 - DNA, 25 bp, Homo sapien
aaatgcgagagacgcttctggcgac

SEQ ID NO: 429638 - DNA, 25 bp, Homo sapien
gcgagagacgcttctggcgacgaaa

SEQ ID NO: 429639 - DNA, 25 bp, Homo sapien
acgcttctggcgacgaaagcagctt

SEQ ID NO: 429640 - DNA, 25 bp, Homo sapien
acgaaagcagcttcgagctcatctg

SEQ ID NO: 429641 - DNA, 25 bp, Homo sapien
gtggccggagctttgcccagtggga

SEQ ID NO: 429642 - DNA, 25 bp, Homo sapien
gggaccagctagttgcccacaagcg

SEQ ID NO: 429643 - DNA, 25 bp, Homo sapien
gagtgattctccaacgggcgttagc

SEQ ID NO: 429644 - DNA, 25 bp, Homo sapien
aaaaaggcagctggcatcgacccaa

SEQ ID NO: 429645 - DNA, 25 bp, Homo sapien
agctggcatcgacccaatggagcaa

SEQ ID NO: 429646 - DNA, 25 bp, Homo sapien
aaccacactctactcagcatgtgga

SEQ ID NO: 429647 - DNA, 25 bp, Homo sapien
tcagcatgtggagaaccttcttccc

SEQ ID NO: 429648 - DNA, 25 bp, Homo sapien
ggcacccctcataacagatttcaaa

SEQ ID NO: 429649 - DNA, 25 bp, Homo sapien
tttgtcaccacctcctatttaattt

SEQ ID NO: 429650 - DNA, 25 bp, Homo sapien
tttaatttccttgttcctcattata

SEQ ID NO: 429651 - DNA, 25 bp, Homo sapien
tcctcattataaacagcagcgccaa

SEQ ID NO: 429652 - DNA, 25 bp, Homo sapien
gcagcgccaaccctatcatttattt

SEQ ID NO: 429653 - DNA, 25 bp, Homo sapien
aatctctcagagtgattctccaacg

SEQ ID NO: 429654 - DNA, 25 bp, Homo sapien
cattgtaaaaagcaaatccatgttt

SEQ ID NO: 429655 - DNA, 25 bp, Homo sapien
agtctattcccatggtggcagcttg

SEQ ID NO: 429656 - DNA, 25 bp, Homo sapien
tctattcccatggtggcagcttgaa

SEQ ID NO: 429657 - DNA, 25 bp, Homo sapien
ttcccatggtggcagcttgaagcag

SEQ ID NO: 429658 - DNA, 25 bp, Homo sapien
gcttgaagcagttactcctgtgggt

SEQ ID NO: 429659 - DNA, 25 bp, Homo sapien
aagcagttactcctgtgggtagatc

SEQ ID NO: 429660 - DNA, 25 bp, Homo sapien
tgggtagatcagtccaggcacttct

SEQ ID NO: 429661 - DNA, 25 bp, Homo sapien
cacttctttcctgggctttgataaa

SEQ ID NO: 429662 - DNA, 25 bp, Homo sapien
ctttcctgggctttgataaagttga

SEQ ID NO: 429663 - DNA, 25 bp, Homo sapien
actcttctactaaaactgaatagcc

SEQ ID NO: 429664 - DNA, 25 bp, Homo sapien
ctgaatagcccatatagatcacttt

SEQ ID NO: 429665 - DNA, 25 bp, Homo sapien
aaatgggattcgcttggcactgcct

SEQ ID NO: 429666 - DNA, 25 bp, Homo sapien
gcttggcactgcctcttaaagatag

SEQ ID NO: 429667 - DNA, 25 bp, Homo sapien
tgttgggatcttgattgtggccgcc

SEQ ID NO: 429668 - DNA, 25 bp, Homo sapien
tttgtccttcttggcaagcctgttc

SEQ ID NO: 429669 - DNA, 25 bp, Homo sapien
aagcctgttcacatggacgtccaga

SEQ ID NO: 429670 - DNA, 25 bp, Homo sapien
atggacgtccagagccagtggacag

SEQ ID NO: 429671 - DNA, 25 bp, Homo sapien
gacggacagcagaggtgctgctttt

SEQ ID NO: 429672 - DNA, 25 bp, Homo sapien
gcagcagaaactttgttgcagttca

SEQ ID NO: 429673 - DNA, 25 bp, Homo sapien
cagttcagagtataccttctgctct

SEQ ID NO: 429674 - DNA, 25 bp, Homo sapien
tctgctccagagcaagagttgcaaa

SEQ ID NO: 429675 - DNA, 25 bp, Homo sapien
gggctggccatttgtttttgtaaat

SEQ ID NO: 429676 - DNA, 25 bp, Homo sapien
aaaccggagagctggcgcatctcca

SEQ ID NO: 429677 - DNA, 25 bp, Homo sapien
cgatatcccgattaagttgcttcac

SEQ ID NO: 429678 - DNA, 25 bp, Homo sapien
gttgcttcactatggcagttatgtt

SEQ ID NO: 429679 - DNA, 25 bp, Homo sapien
tgtttctgatatgctcctccaagaa

SEQ ID NO: 429680 - DNA, 25 bp, Homo sapien
gatatgctcctccaagaaaagcctg

SEQ ID NO: 429681 - DNA, 25 bp, Homo sapien
tgcattttctgcaaactgttgacaa

SEQ ID NO: 429682 - DNA, 25 bp, Homo sapien
gggtttttgatgagcacagacccca

SEQ ID NO: 429683 - DNA, 25 bp, Homo sapien
gagcacagaccccaccatttgaaca

SEQ ID NO: 429684 - DNA, 25 bp, Homo sapien
ttgaacacctaccttgccattgttc

SEQ ID NO: 429685 - DNA, 25 bp, Homo sapien
ttgccattgttcctcaaagttctcc

SEQ ID NO: 429686 - DNA, 25 bp, Homo sapien
aaagttctcccaaaccggagagctg

SEQ ID NO: 429687 - DNA, 25 bp, Homo sapien
ctaaatcctgtattcctggctagga

SEQ ID NO: 429688 - DNA, 25 bp, Homo sapien
aaatcctgtattcctggctaggaag

SEQ ID NO: 429689 - DNA, 25 bp, Homo sapien
atcctgtattcctggctaggaagca

SEQ ID NO: 429690 - DNA, 25 bp, Homo sapien
tgtattcctggctaggaagcacttc

SEQ ID NO: 429691 - DNA, 25 bp, Homo sapien
tattcctggctaggaagcacttctc

SEQ ID NO: 429692 - DNA, 25 bp, Homo sapien
tccacccctctgctttgagttacaa

SEQ ID NO: 429693 - DNA, 25 bp, Homo sapien
ccacccctctgctttgagttacaaa

SEQ ID NO: 429694 - DNA, 25 bp, Homo sapien
ctttgagttacaaattcaattcaat

SEQ ID NO: 429695 - DNA, 25 bp, Homo sapien
atacctacagataaagtactgtgct

SEQ ID NO: 429696 - DNA, 25 bp, Homo sapien
agtactgtgctttgggggacacaaa

SEQ ID NO: 429697 - DNA, 25 bp, Homo sapien
gacacaaaggtgactggtacctgct

SEQ ID NO: 429698 - DNA, 25 bp, Homo sapien
tttcaaattagggttgcttggttct

SEQ ID NO: 429699 - DNA, 25 bp, Homo sapien
agttgatggtgttgctgggttataa

SEQ ID NO: 429700 - DNA, 25 bp, Homo sapien
cagtgaacttcatcttggcctcaag

SEQ ID NO: 429701 - DNA, 25 bp, Homo sapien
agtgaacttcatcttggcctcaagt

SEQ ID NO: 429702 - DNA, 25 bp, Homo sapien
gtgaacttcatcttggcctcaagtt

SEQ ID NO: 429703 - DNA, 25 bp, Homo sapien
tcaagttcctgaggtgcatatgaat

SEQ ID NO: 429704 - DNA, 25 bp, Homo sapien
gttcctgaggtgcatatgaataaac

SEQ ID NO: 429705 - DNA, 25 bp, Homo sapien
tgaggtgcatatgaataaacagtct

SEQ ID NO: 429706 - DNA, 25 bp, Homo sapien
taaacagtctctaacccagagggtt

SEQ ID NO: 429707 - DNA, 25 bp, Homo sapien
ggtttcaagaaaagcagagtcctca

SEQ ID NO: 429708 - DNA, 25 bp, Homo sapien
agaaaagcagagtcctcaaaatcca

SEQ ID NO: 429709 - DNA, 25 bp, Homo sapien
actcccggatctcttctaagttgat

SEQ ID NO: 429710 - DNA, 25 bp, Homo sapien
taagttgatcccatcctcatccaga

SEQ ID NO: 429711 - DNA, 25 bp, Homo sapien
catccagacttggagtatgtggctt

SEQ ID NO: 429712 - DNA, 25 bp, Homo sapien
tatgtggcttggacaccaactggct

SEQ ID NO: 429713 - DNA, 25 bp, Homo sapien
ttggacaccaactggctgacggtgg

SEQ ID NO: 429714 - DNA, 25 bp, Homo sapien
gtctctgagcaggtaattgggatag

SEQ ID NO: 429715 - DNA, 25 bp, Homo sapien
ctggagctgggctggcaatgaccac

SEQ ID NO: 429716 - DNA, 25 bp, Homo sapien
gggctggcaatgaccacagcaggct

SEQ ID NO: 429717 - DNA, 25 bp, Homo sapien
tggatgggctgcacctcactcttag

SEQ ID NO: 429718 - DNA, 25 bp, Homo sapien
tgtgcttggcttccggacagccaca

SEQ ID NO: 429719 - DNA, 25 bp, Homo sapien
gggctgctagccagggtcgcaatca

SEQ ID NO: 429720 - DNA, 25 bp, Homo sapien
atcctggattctaatctctagattt

SEQ ID NO: 429721 - DNA, 25 bp, Homo sapien
aatctctagatttggctgtgggaaa

SEQ ID NO: 429722 - DNA, 25 bp, Homo sapien
tccttataacccacaactgaaattc

SEQ ID NO: 429723 - DNA, 25 bp, Homo sapien
aactgaaattcagcatctctgccct

SEQ ID NO: 429724 - DNA, 25 bp, Homo sapien
aattcagcatctctgccctgtggct

SEQ ID NO: 429725 - DNA, 25 bp, Homo sapien
gggaggctcatatcgggtcttttct

SEQ ID NO: 429726 - DNA, 25 bp, Homo sapien
atatcgggtcttttcttaccctctg

SEQ ID NO: 429727 - DNA, 25 bp, Homo sapien
taccctctgtcgacctcagctttag

SEQ ID NO: 429728 - DNA, 25 bp, Homo sapien
aaggtgttcccttaggatagactga

SEQ ID NO: 429729 - DNA, 25 bp, Homo sapien
aagttcatcatcctgaacatccctt

SEQ ID NO: 429730 - DNA, 25 bp, Homo sapien
gaacatcccttcaaatatggtgaaa

SEQ ID NO: 429731 - DNA, 25 bp, Homo sapien
gagccacaataagccttgaacaaca

SEQ ID NO: 429732 - DNA, 25 bp, Homo sapien
taagccttgaacaacatacagtcag

SEQ ID NO: 429733 - DNA, 25 bp, Homo sapien
ttgttgctttaacttccttttggct

SEQ ID NO: 429734 - DNA, 25 bp, Homo sapien
ttccttttggctggaagctccatat

SEQ ID NO: 429735 - DNA, 25 bp, Homo sapien
gctggaagctccatattctggtaat

SEQ ID NO: 429736 - DNA, 25 bp, Homo sapien
ttctggtaattcaccaaaatggcca

SEQ ID NO: 429737 - DNA, 25 bp, Homo sapien
gaaaacaggagaggcacccagtgta

SEQ ID NO: 429738 - DNA, 25 bp, Homo sapien
cccagtgtatgttttctaggccttt

SEQ ID NO: 429739 - DNA, 25 bp, Homo sapien
aaaacatggagttggccacatgcat

SEQ ID NO: 429740 - DNA, 25 bp, Homo sapien
tggccacatgcatgggagtctataa

SEQ ID NO: 429741 - DNA, 25 bp, Homo sapien
aaaaatatctgcaaagagccacaat

SEQ ID NO: 429742 - DNA, 25 bp, Homo sapien
aaattgctaattttatacagtgtaa

SEQ ID NO: 429743 - DNA, 25 bp, Homo sapien
tgttcttcacaaaataggtttcatt

SEQ ID NO: 429744 - DNA, 25 bp, Homo sapien
aactgttggtcagaaaatgatctgc

SEQ ID NO: 429745 - DNA, 25 bp, Homo sapien
atgatctgcaattcaagtaagtctg

SEQ ID NO: 429746 - DNA, 25 bp, Homo sapien
gcaattcaagtaagtctgcattact

SEQ ID NO: 429747 - DNA, 25 bp, Homo sapien
agtactttaacatgccttatttatt

SEQ ID NO: 429748 - DNA, 25 bp, Homo sapien
attttttgacagatataaccttgca

SEQ ID NO: 429749 - DNA, 25 bp, Homo sapien
ttgacagatataaccttgcataagt

SEQ ID NO: 429750 - DNA, 25 bp, Homo sapien
ccttgcataagtagtatttagggtg

SEQ ID NO: 429751 - DNA, 25 bp, Homo sapien
gggtgattttgatactatctttaga

SEQ ID NO: 429752 - DNA, 25 bp, Homo sapien
actatctttagagttttgcattgga

SEQ ID NO: 429753 - DNA, 25 bp, Homo sapien
gcaagaggatcattcgaacccgcaa

SEQ ID NO: 429754 - DNA, 25 bp, Homo sapien
ggatcattcgaacccgcaaggcgga

SEQ ID NO: 429755 - DNA, 25 bp, Homo sapien
aggagagacagtattctgaaggcta

SEQ ID NO: 429756 - DNA, 25 bp, Homo sapien
ctggaagtctgctgggctttataga

SEQ ID NO: 429757 - DNA, 25 bp, Homo sapien
gcaacagatgattccagccaacggt

SEQ ID NO: 429758 - DNA, 25 bp, Homo sapien
tgattccagccaacggtcagagcca

SEQ ID NO: 429759 - DNA, 25 bp, Homo sapien
agccacctgggtaatagagaatgca

SEQ ID NO: 429760 - DNA, 25 bp, Homo sapien
aatagagaatgcacaccccattccc

SEQ ID NO: 429761 - DNA, 25 bp, Homo sapien
attcccactcgcttgattgacagga

SEQ ID NO: 429762 - DNA, 25 bp, Homo sapien
cactcgcttgattgacaggatgaat

SEQ ID NO: 429763 - DNA, 25 bp, Homo sapien
atgacgctgtgggaacccagcttta

SEQ ID NO: 429764 - DNA, 25 bp, Homo sapien
gcatctgcagcaggtccacgatgaa

SEQ ID NO: 429765 - DNA, 25 bp, Homo sapien
gcagcaggtccacgatgaagacgaa

SEQ ID NO: 429766 - DNA, 25 bp, Homo sapien
tccacgatgaagacgaagatctggt

SEQ ID NO: 429767 - DNA, 25 bp, Homo sapien
aagatctggtggtgtgagtaccgca

SEQ ID NO: 429768 - DNA, 25 bp, Homo sapien
tgtgagtaccgcagcagcatggaca

SEQ ID NO: 429769 - DNA, 25 bp, Homo sapien
gcagcagcatggacacgctcagcgt

SEQ ID NO: 429770 - DNA, 25 bp, Homo sapien
cggccaggtaggacgtccgcgccat

SEQ ID NO: 429771 - DNA, 25 bp, Homo sapien
gccatccacatgctcacaaagcggt

SEQ ID NO: 429772 - DNA, 25 bp, Homo sapien
acaaagcggtagtgctcgcccgaca

SEQ ID NO: 429773 - DNA, 25 bp, Homo sapien
ttgttctcctcgttctcggccaggc

SEQ ID NO: 429774 - DNA, 25 bp, Homo sapien
gccaggcccttcacgctggacatga

SEQ ID NO: 429775 - DNA, 25 bp, Homo sapien
taactgctactctgtcggtcattgt

SEQ ID NO: 429776 - DNA, 25 bp, Homo sapien
tactctgtcggtcattgtctctata

SEQ ID NO: 429777 - DNA, 25 bp, Homo sapien
ggtcattgtctctatatgcagtaaa

SEQ ID NO: 429778 - DNA, 25 bp, Homo sapien
ttatggtccctttataggaatataa

SEQ ID NO: 429779 - DNA, 25 bp, Homo sapien
attttgatgctattctatttttgtt

SEQ ID NO: 429780 - DNA, 25 bp, Homo sapien
aactgtatgctgttaaactctagga

SEQ ID NO: 429781 - DNA, 25 bp, Homo sapien
gctgttaaactctaggatgtatctg

SEQ ID NO: 429782 - DNA, 25 bp, Homo sapien
aggatgtatctgaatctttcctttt

SEQ ID NO: 429783 - DNA, 25 bp, Homo sapien
cccctcctccaaatatataaatctg

SEQ ID NO: 429784 - DNA, 25 bp, Homo sapien
aaatatataaatctgtgctctcaca

SEQ ID NO: 429785 - DNA, 25 bp, Homo sapien
ctgtgctctcacatgtaatgtattt

SEQ ID NO: 429786 - DNA, 25 bp, Homo sapien
tgaaaataaattaggcctggcgcgg

SEQ ID NO: 429787 - DNA, 25 bp, Homo sapien
gaaaataaattaggcctggcgcggt

SEQ ID NO: 429788 - DNA, 25 bp, Homo sapien
aaaataaattaggcctggcgcggtg

SEQ ID NO: 429789 - DNA, 25 bp, Homo sapien
aaataaattaggcctggcgcggtgg

SEQ ID NO: 429790 - DNA, 25 bp, Homo sapien
aataaattaggcctggcgcggtggc

SEQ ID NO: 429791 - DNA, 25 bp, Homo sapien
ataaattaggcctggcgcggtggct

SEQ ID NO: 429792 - DNA, 25 bp, Homo sapien
taaattaggcctggcgcggtggctc

SEQ ID NO: 429793 - DNA, 25 bp, Homo sapien
gtgaaaccccctgtctattaataat

SEQ ID NO: 429794 - DNA, 25 bp, Homo sapien
tgaaaccccctgtctattaataata

SEQ ID NO: 429795 - DNA, 25 bp, Homo sapien
taataatacaaaaatgggcgtggtg

SEQ ID NO: 429796 - DNA, 25 bp, Homo sapien
gagcaagactccgttaaacaaacaa

SEQ ID NO: 429797 - DNA, 25 bp, Homo sapien
ctcccgcttacactttgatcttatt

SEQ ID NO: 429798 - DNA, 25 bp, Homo sapien
cgcttacactttgatcttatttgat

SEQ ID NO: 429799 - DNA, 25 bp, Homo sapien
ttatttgatcggatcgtgaccccag

SEQ ID NO: 429800 - DNA, 25 bp, Homo sapien
atttgatcggatcgtgaccccagcc

SEQ ID NO: 429801 - DNA, 25 bp, Homo sapien
gggccgacccgaaatgaaaagctct

SEQ ID NO: 429802 - DNA, 25 bp, Homo sapien
gacccgaaatgaaaagctctcctcc

SEQ ID NO: 429803 - DNA, 25 bp, Homo sapien
cgctgtgcagcgaggccccttaggc

SEQ ID NO: 429804 - DNA, 25 bp, Homo sapien
ttaggcggcggccacgctgtggtcc

SEQ ID NO: 429805 - DNA, 25 bp, Homo sapien
ggcgcgtgcagggtgagtgtgagtg

SEQ ID NO: 429806 - DNA, 25 bp, Homo sapien
gagtgtgcgcgcttggagcgtgtta

SEQ ID NO: 429807 - DNA, 25 bp, Homo sapien
tgttaggcgagtgcgtgcgcccacc

SEQ ID NO: 429808 - DNA, 25 bp, Homo sapien
gtggcatgaagcaaagggctatcct

SEQ ID NO: 429809 - DNA, 25 bp, Homo sapien
aaagggctatcctgtgtggcacaga

SEQ ID NO: 429810 - DNA, 25 bp, Homo sapien
tgtgtgagtcactgtgtctgagtgt

SEQ ID NO: 429811 - DNA, 25 bp, Homo sapien
aaggcccagaggatgctcacttggc

SEQ ID NO: 429812 - DNA, 25 bp, Homo sapien
agaggatgctcacttggctagccat

SEQ ID NO: 429813 - DNA, 25 bp, Homo sapien
gctcacttggctagccatggagaaa

SEQ ID NO: 429814 - DNA, 25 bp, Homo sapien
gaaagaaaagactacatcgggcaag

SEQ ID NO: 429815 - DNA, 25 bp, Homo sapien
catcgggcaagtcctcttatttatt

SEQ ID NO: 429816 - DNA, 25 bp, Homo sapien
tgtggtcttctgagtgcatatgact

SEQ ID NO: 429817 - DNA, 25 bp, Homo sapien
atatgactgtgtgcgtttctctcct

SEQ ID NO: 429818 - DNA, 25 bp, Homo sapien
ttctctcctgttgcagctgtgatca

SEQ ID NO: 429819 - DNA, 25 bp, Homo sapien
agtcactgtaacagactgccacata

SEQ ID NO: 429820 - DNA, 25 bp, Homo sapien
gtaacagactgccacatacacactc

SEQ ID NO: 429821 - DNA, 25 bp, Homo sapien
agactgccacatacacactcggtct

SEQ ID NO: 429822 - DNA, 25 bp, Homo sapien
tcggtctcacactcacctgtgggtt

SEQ ID NO: 429823 - DNA, 25 bp, Homo sapien
taactttacagggtcagttccgctt

SEQ ID NO: 429824 - DNA, 25 bp, Homo sapien
actttacagggtcagttccgcttca

SEQ ID NO: 429825 - DNA, 25 bp, Homo sapien
ttacagggtcagttccgcttcacct

SEQ ID NO: 429826 - DNA, 25 bp, Homo sapien
tccgcttcacctccttttgtatgga

SEQ ID NO: 429827 - DNA, 25 bp, Homo sapien
ttcacctccttttgtatggagttcc

SEQ ID NO: 429828 - DNA, 25 bp, Homo sapien
ctcctgaccctgacgttgtgatacg

SEQ ID NO: 429829 - DNA, 25 bp, Homo sapien
gacgttgtgatacgccccacagaga

SEQ ID NO: 429830 - DNA, 25 bp, Homo sapien
tttctgataatctcaaactgctcac

SEQ ID NO: 429831 - DNA, 25 bp, Homo sapien
aactgctcacatctccttgttagaa

SEQ ID NO: 429832 - DNA, 25 bp, Homo sapien
ggacgagttgtagtcctatccctga

SEQ ID NO: 429833 - DNA, 25 bp, Homo sapien
gttctgaaatcacattgctcctaaa

SEQ ID NO: 429834 - DNA, 25 bp, Homo sapien
attatcttcgtcttactattccctt

SEQ ID NO: 429835 - DNA, 25 bp, Homo sapien
tcgtcttactattccctttcacttt

SEQ ID NO: 429836 - DNA, 25 bp, Homo sapien
gtcctatccctgacattttatgtcc

SEQ ID NO: 429837 - DNA, 25 bp, Homo sapien
atgtccttggttaatgtgcttagcc

SEQ ID NO: 429838 - DNA, 25 bp, Homo sapien
gtgcttagccatcttgtgcttcaga

SEQ ID NO: 429839 - DNA, 25 bp, Homo sapien
tgtgcttcagaaatgtcctcctatc

SEQ ID NO: 429840 - DNA, 25 bp, Homo sapien
tcctcctatctgttcaaacctgtaa

SEQ ID NO: 429841 - DNA, 25 bp, Homo sapien
attttctcaataattagtgacagtg

SEQ ID NO: 429842 - DNA, 25 bp, Homo sapien
ttctcaataattagtgacagtgtct

SEQ ID NO: 429843 - DNA, 25 bp, Homo sapien
agtgacagtgtctactgattgtaaa

SEQ ID NO: 429844 - DNA, 25 bp, Homo sapien
gtgacagtgtctactgattgtaaaa

SEQ ID NO: 429845 - DNA, 25 bp, Homo sapien
tgacagtgtctactgattgtaaaat

SEQ ID NO: 429846 - DNA, 25 bp, Homo sapien
gacagtgtctactgattgtaaaatg

SEQ ID NO: 429847 - DNA, 25 bp, Homo sapien
cagtgtctactgattgtaaaatgaa

SEQ ID NO: 429848 - DNA, 25 bp, Homo sapien
gtgtctactgattgtaaaatgaagc

SEQ ID NO: 429849 - DNA, 25 bp, Homo sapien
gtctactgattgtaaaatgaagctt

SEQ ID NO: 429850 - DNA, 25 bp, Homo sapien
gattgtaaaatgaagcttgaaggcc

SEQ ID NO: 429851 - DNA, 25 bp, Homo sapien
gtaaaatgaagcttgaaggccaggc

SEQ ID NO: 429852 - DNA, 25 bp, Homo sapien
ttaaaatgtgctatcactgtattgc

SEQ ID NO: 429853 - DNA, 25 bp, Homo sapien
atggcaatacactatgcagtattat

SEQ ID NO: 429854 - DNA, 25 bp, Homo sapien
atttcaatactttaagaggcatcta

SEQ ID NO: 429855 - DNA, 25 bp, Homo sapien
gaggcatctattacttcattgaaca

SEQ ID NO: 429856 - DNA, 25 bp, Homo sapien
gaacacataagcagctagcctcctt

SEQ ID NO: 429857 - DNA, 25 bp, Homo sapien
tagcctcctttcctctgtaaataag

SEQ ID NO: 429858 - DNA, 25 bp, Homo sapien
aaataaggactttttggcatcctga

SEQ ID NO: 429859 - DNA, 25 bp, Homo sapien
gactttttggcatcctgatgttcct

SEQ ID NO: 429860 - DNA, 25 bp, Homo sapien
gatgttcctcgctgttcatttggta

SEQ ID NO: 429861 - DNA, 25 bp, Homo sapien
tgttcctcgctgttcatttggtatc

SEQ ID NO: 429862 - DNA, 25 bp, Homo sapien
gttccatcaagactgaggattttct

SEQ ID NO: 429863 - DNA, 25 bp, Homo sapien
tcctgggtccagcttgtttcatgag

SEQ ID NO: 429864 - DNA, 25 bp, Homo sapien
gattgtaactgttcgggcacggtga

SEQ ID NO: 429865 - DNA, 25 bp, Homo sapien
gcctccctgaggctacagaagcaaa

SEQ ID NO: 429866 - DNA, 25 bp, Homo sapien
gtacagttacagaatccgtgggcaa

SEQ ID NO: 429867 - DNA, 25 bp, Homo sapien
gaatccgtgggcaaagcatctcggg

SEQ ID NO: 429868 - DNA, 25 bp, Homo sapien
gagcctgaaggcactgtgtaggcct

SEQ ID NO: 429869 - DNA, 25 bp, Homo sapien
gtgtaggccttgatcagtttagcaa

SEQ ID NO: 429870 - DNA, 25 bp, Homo sapien
tttctacgattctgacatcctcttt

SEQ ID NO: 429871 - DNA, 25 bp, Homo sapien
tttctgttctttccggactcaggca

SEQ ID NO: 429872 - DNA, 25 bp, Homo sapien
gagacagagcctcctcatgatgtca

SEQ ID NO: 429873 - DNA, 25 bp, Homo sapien
atgatgtcacgatgtcacctgagct

SEQ ID NO: 429874 - DNA, 25 bp, Homo sapien
gtatttgtgcaggattctttaggct

SEQ ID NO: 429875 - DNA, 25 bp, Homo sapien
gcaggattctttaggctttatcagt

SEQ ID NO: 429876 - DNA, 25 bp, Homo sapien
ctttaggctttatcagtgtaatctc

SEQ ID NO: 429877 - DNA, 25 bp, Homo sapien
cagtgtaatctctgccttttaagat

SEQ ID NO: 429878 - DNA, 25 bp, Homo sapien
ctgccttttaagatatgtacagaaa

SEQ ID NO: 429879 - DNA, 25 bp, Homo sapien
tgtccatataaatttccattgaagt

SEQ ID NO: 429880 - DNA, 25 bp, Homo sapien
tttccattgaagtcgaatgatactg

SEQ ID NO: 429881 - DNA, 25 bp, Homo sapien
gtcgaatgatactgagaagcctgta

SEQ ID NO: 429882 - DNA, 25 bp, Homo sapien
aaaacataagctgtgtttccccata

SEQ ID NO: 429883 - DNA, 25 bp, Homo sapien
gagtgatgcttatgttaagtcctaa

SEQ ID NO: 429884 - DNA, 25 bp, Homo sapien
ttatgttaagtcctaacactacagt

SEQ ID NO: 429885 - DNA, 25 bp, Homo sapien
tttggtttccactctgtatcacagt

SEQ ID NO: 429886 - DNA, 25 bp, Homo sapien
gtatcacagtggttacgatgctcgg

SEQ ID NO: 429887 - DNA, 25 bp, Homo sapien
tgtttctcgtcacttctctggagga

SEQ ID NO: 429888 - DNA, 25 bp, Homo sapien
tacgatgctcggaactcagacttac

SEQ ID NO: 429889 - DNA, 25 bp, Homo sapien
ggaactcagacttaccttgttttag

SEQ ID NO: 429890 - DNA, 25 bp, Homo sapien
ttttagccccaccacttctaacttg

SEQ ID NO: 429891 - DNA, 25 bp, Homo sapien
agaagttacttgtttgtgtttcact

SEQ ID NO: 429892 - DNA, 25 bp, Homo sapien
ataattgcactatcctcataaaatg

SEQ ID NO: 429893 - DNA, 25 bp, Homo sapien
gtgagggagctacaaacaagcttta

SEQ ID NO: 429894 - DNA, 25 bp, Homo sapien
aacaagctttagatgtagacagtct

SEQ ID NO: 429895 - DNA, 25 bp, Homo sapien
gtagacagtctaggttcaaatccca

SEQ ID NO: 429896 - DNA, 25 bp, Homo sapien
gtatcctataactatcaacttccca

SEQ ID NO: 429897 - DNA, 25 bp, Homo sapien
caacttcccaggttgaagacgatgt

SEQ ID NO: 429898 - DNA, 25 bp, Homo sapien
actgattgattgattcctgtcctcc

SEQ ID NO: 429899 - DNA, 25 bp, Homo sapien
tgtttccgtcactggttcactaaaa

SEQ ID NO: 429900 - DNA, 25 bp, Homo sapien
gtatttatatagctccactggctct

SEQ ID NO: 429901 - DNA, 25 bp, Homo sapien
atatagctccactggctctaaagct

SEQ ID NO: 429902 - DNA, 25 bp, Homo sapien
ggctctaaagctcttagtccttcta

SEQ ID NO: 429903 - DNA, 25 bp, Homo sapien
gctcttagtccttctaatattttgg

SEQ ID NO: 429904 - DNA, 25 bp, Homo sapien
atgcctggagcttaaaacaaagtat

SEQ ID NO: 429905 - DNA, 25 bp, Homo sapien
aaagtatgtgcaacctaccatctca

SEQ ID NO: 429906 - DNA, 25 bp, Homo sapien
gcaacctaccatctcacttgaaatt

SEQ ID NO: 429907 - DNA, 25 bp, Homo sapien
tctctaagtttaattttctagcgtg

SEQ ID NO: 429908 - DNA, 25 bp, Homo sapien
ttttctagcgtgttgttgtcttacc

SEQ ID NO: 429909 - DNA, 25 bp, Homo sapien
tagcgtgttgttgtcttaccttttt

SEQ ID NO: 429910 - DNA, 25 bp, Homo sapien
tttaaccttaccataatatttctgt

SEQ ID NO: 429911 - DNA, 25 bp, Homo sapien
taatatttctgttaactgttacatt

SEQ ID NO: 429912 - DNA, 25 bp, Homo sapien
taactgttacatttaatataccaat

SEQ ID NO: 429913 - DNA, 25 bp, Homo sapien
taccaatgtgtgtaagtatacagag

SEQ ID NO: 429914 - DNA, 25 bp, Homo sapien
acatatgtggatgtatgacttattt

SEQ ID NO: 429915 - DNA, 25 bp, Homo sapien
atttttccttatccacagatttcag

SEQ ID NO: 429916 - DNA, 25 bp, Homo sapien
ttccttatccacagatttcagctac

SEQ ID NO: 429917 - DNA, 25 bp, Homo sapien
cagatttcagctaccatgtatatat

SEQ ID NO: 429918 - DNA, 25 bp, Homo sapien
gaagaggcaggcattgacacgcatg

SEQ ID NO: 429919 - DNA, 25 bp, Homo sapien
acacgcatgcacaggtggaggctca

SEQ ID NO: 429920 - DNA, 25 bp, Homo sapien
tggaggctcacgacctagggcaaac

SEQ ID NO: 429921 - DNA, 25 bp, Homo sapien
tagggcaaacgcagctgcacacagt

SEQ ID NO: 429922 - DNA, 25 bp, Homo sapien
tgcacacagtacagtcaccgcagtg

SEQ ID NO: 429923 - DNA, 25 bp, Homo sapien
accgcagtgacttcggctggttgct

SEQ ID NO: 429924 - DNA, 25 bp, Homo sapien
ggaagagtacagtgcgccggcacac

SEQ ID NO: 429925 - DNA, 25 bp, Homo sapien
tgcgccggcacacgctgacactgag

SEQ ID NO: 429926 - DNA, 25 bp, Homo sapien
gacactgagccctacgggatctgaa

SEQ ID NO: 429927 - DNA, 25 bp, Homo sapien
atgcccagccagagcctaaggctct

SEQ ID NO: 429928 - DNA, 25 bp, Homo sapien
gcctccccagggtgtgacatatgtg

SEQ ID NO: 429929 - DNA, 25 bp, Homo sapien
attataatatcccaggccccttgat

SEQ ID NO: 429930 - DNA, 25 bp, Homo sapien
atcccaggccccttgataaaagctg

SEQ ID NO: 429931 - DNA, 25 bp, Homo sapien
aaagctgagggttatcatgacctta

SEQ ID NO: 429932 - DNA, 25 bp, Homo sapien
gagggttatcatgaccttaatgcta

SEQ ID NO: 429933 - DNA, 25 bp, Homo sapien
gaccttaatgctaattcaatgagaa

SEQ ID NO: 429934 - DNA, 25 bp, Homo sapien
aaattccatatatcttccctgcatc

SEQ ID NO: 429935 - DNA, 25 bp, Homo sapien
atatatcttccctgcatcttgtcac

SEQ ID NO: 429936 - DNA, 25 bp, Homo sapien
gcatcttgtcactgtgtaccattca

SEQ ID NO: 429937 - DNA, 25 bp, Homo sapien
ctgtgtaccattcaaagtgtttata

SEQ ID NO: 429938 - DNA, 25 bp, Homo sapien
aaaactctagattcatcaaatgaga

SEQ ID NO: 429939 - DNA, 25 bp, Homo sapien
aagatgtgtttggagaaggctgcat

SEQ ID NO: 429940 - DNA, 25 bp, Homo sapien
tgtagtctgcaagtgtgtttcattt

SEQ ID NO: 429941 - DNA, 25 bp, Homo sapien
ttcatttaatgggtcttgcctctga

SEQ ID NO: 429942 - DNA, 25 bp, Homo sapien
cttgcctctgacaaaccattggttt

SEQ ID NO: 429943 - DNA, 25 bp, Homo sapien
tggttgactgtgtggctgtatttgc

SEQ ID NO: 429944 - DNA, 25 bp, Homo sapien
tgctgggaggaatatatgtcaaact

SEQ ID NO: 429945 - DNA, 25 bp, Homo sapien
gtcaaactgatcagcagctctcatg

SEQ ID NO: 429946 - DNA, 25 bp, Homo sapien
cagctctcatggcatcttcattgag

SEQ ID NO: 429947 - DNA, 25 bp, Homo sapien
gaaggcttgccaggcccacagaaag

SEQ ID NO: 429948 - DNA, 25 bp, Homo sapien
agaaagctggattactgctggcaac

SEQ ID NO: 429949 - DNA, 25 bp, Homo sapien
ggcaacaggatgcatcattttctca

SEQ ID NO: 429950 - DNA, 25 bp, Homo sapien
tatttctatgcttctgccacttgta

SEQ ID NO: 429951 - DNA, 25 bp, Homo sapien
tctctgtgattttggctactaccgt

SEQ ID NO: 429952 - DNA, 25 bp, Homo sapien
gattttggctactaccgtccagaaa

SEQ ID NO: 429953 - DNA, 25 bp, Homo sapien
taccgtccagaaaatgactccaagt

SEQ ID NO: 429954 - DNA, 25 bp, Homo sapien
gactccaagtgtgtggaacagccag

SEQ ID NO: 429955 - DNA, 25 bp, Homo sapien
gccagaactgaagggccacgacctg

SEQ ID NO: 429956 - DNA, 25 bp, Homo sapien
agggccacgacctggagttttgtct

SEQ ID NO: 429957 - DNA, 25 bp, Homo sapien
ggagttttgtctgtacggaagagaa

SEQ ID NO: 429958 - DNA, 25 bp, Homo sapien
ggaagagaagaacacctaacaacaa

SEQ ID NO: 429959 - DNA, 25 bp, Homo sapien
gcacaagcaactttttgagtccgga

SEQ ID NO: 429960 - DNA, 25 bp, Homo sapien
aattctgttccaattatcctggcca

SEQ ID NO: 429961 - DNA, 25 bp, Homo sapien
ttatcctggccatcgtgggattgat

SEQ ID NO: 429962 - DNA, 25 bp, Homo sapien
gggtcgtgatccatagacttagcaa

SEQ ID NO: 429963 - DNA, 25 bp, Homo sapien
agcaagtcttgccttatctatggag

SEQ ID NO: 429964 - DNA, 25 bp, Homo sapien
gccttatctatggagctcgatggtg

SEQ ID NO: 429965 - DNA, 25 bp, Homo sapien
ttgtctgatgtccatagttccttcc

SEQ ID NO: 429966 - DNA, 25 bp, Homo sapien
ccctagattgtttctttccacggat

SEQ ID NO: 429967 - DNA, 25 bp, Homo sapien
tccacggattgtgttcatctgaacc

SEQ ID NO: 429968 - DNA, 25 bp, Homo sapien
aagtactgtacttggctatttgcag

SEQ ID NO: 429969 - DNA, 25 bp, Homo sapien
acttggctatttgcagtgttttcaa

SEQ ID NO: 429970 - DNA, 25 bp, Homo sapien
taatcttcgatacttggtgcaatag

SEQ ID NO: 429971 - DNA, 25 bp, Homo sapien
gaagctgcaaagatgtgccacttta

SEQ ID NO: 429972 - DNA, 25 bp, Homo sapien
gatgtgccactttatctatgaaatg

SEQ ID NO: 429973 - DNA, 25 bp, Homo sapien
tagagtgtactaagacttctgaatt

SEQ ID NO: 429974 - DNA, 25 bp, Homo sapien
gacttctgaattataacaatcccac

SEQ ID NO: 429975 - DNA, 25 bp, Homo sapien
gaattataacaatcccactattagg

SEQ ID NO: 429976 - DNA, 25 bp, Homo sapien
aatcccactattaggtaatgtgcac

SEQ ID NO: 429977 - DNA, 25 bp, Homo sapien
ggtaatgtgcacctgtccttttagc

SEQ ID NO: 429978 - DNA, 25 bp, Homo sapien
atgtgcacctgtccttttagcatat

SEQ ID NO: 429979 - DNA, 25 bp, Homo sapien
cacctgtccttttagcatatctgtt

SEQ ID NO: 429980 - DNA, 25 bp, Homo sapien
gtccttttagcatatctgttactta

SEQ ID NO: 429981 - DNA, 25 bp, Homo sapien
ctaaggaagtggagattctaatctt

SEQ ID NO: 429982 - DNA, 25 bp, Homo sapien
gagattctaatcttaagcatgttca

SEQ ID NO: 429983 - DNA, 25 bp, Homo sapien
tctaatcttaagcatgttcatctag

SEQ ID NO: 429984 - DNA, 25 bp, Homo sapien
ggaccctgggtaagatggctacatt

SEQ ID NO: 429985 - DNA, 25 bp, Homo sapien
ggctacatttaaggtgactctgaat

SEQ ID NO: 429986 - DNA, 25 bp, Homo sapien
gttctagcttggtcactttcatttc

SEQ ID NO: 429987 - DNA, 25 bp, Homo sapien
actagtaggctgtggagtgcgcttc

SEQ ID NO: 429988 - DNA, 25 bp, Homo sapien
tggagtgcgcttcctgtttgtgtca

SEQ ID NO: 429989 - DNA, 25 bp, Homo sapien
catctggtcgtagaaccttttccaa

SEQ ID NO: 429990 - DNA, 25 bp, Homo sapien
aacagaagcatctgcctttggctgt

SEQ ID NO: 429991 - DNA, 25 bp, Homo sapien
gtgacctttgaagccagtctcagtg

SEQ ID NO: 429992 - DNA, 25 bp, Homo sapien
cagtctcagtggtttaggcagcttt

SEQ ID NO: 429993 - DNA, 25 bp, Homo sapien
aggcagctttgcagttctaactcta

SEQ ID NO: 429994 - DNA, 25 bp, Homo sapien
aggccaggctgtgtgcagagctaaa

SEQ ID NO: 429995 - DNA, 25 bp, Homo sapien
gggtcccggccttgtgccttacctg

SEQ ID NO: 429996 - DNA, 25 bp, Homo sapien
ttgtgccttacctgcgcccggaggt

SEQ ID NO: 429997 - DNA, 25 bp, Homo sapien
aggtcgcctccttcttgggagagga

SEQ ID NO: 429998 - DNA, 25 bp, Homo sapien
tcgcctccttcttgggagaggatgg

SEQ ID NO: 429999 - DNA, 25 bp, Homo sapien
gggacgtggcatagccacccacgcg

SEQ ID NO: 430000 - DNA, 25 bp, Homo sapien
gtcccgagccattaaggggcgtcct

SEQ ID NO: 430001 - DNA, 25 bp, Homo sapien
gtgggaaggcctttcaagagctgac

SEQ ID NO: 430002 - DNA, 25 bp, Homo sapien
ggaaggcctttcaagagctgacaca

SEQ ID NO: 430003 - DNA, 25 bp, Homo sapien
aaggcctttcaagagctgacacact

SEQ ID NO: 430004 - DNA, 25 bp, Homo sapien
gcctttcaagagctgacacactgga

SEQ ID NO: 430005 - DNA, 25 bp, Homo sapien
tcaagagctgacacactggagggat

SEQ ID NO: 430006 - DNA, 25 bp, Homo sapien
gaaacaaccaagctcaggttcaagg

SEQ ID NO: 430007 - DNA, 25 bp, Homo sapien
caagctcaggttcaaggttgagttt

SEQ ID NO: 430008 - DNA, 25 bp, Homo sapien
atctagggatctgattctcatatta

SEQ ID NO: 430009 - DNA, 25 bp, Homo sapien
ggatctgattctcatattagaggat

SEQ ID NO: 430010 - DNA, 25 bp, Homo sapien
tagaggataatatctccccaaaggg

SEQ ID NO: 430011 - DNA, 25 bp, Homo sapien
tatttcttttggtagataacattga

SEQ ID NO: 430012 - DNA, 25 bp, Homo sapien
tccttgaaaatctttggcatttctg

SEQ ID NO: 430013 - DNA, 25 bp, Homo sapien
aaatctttggcatttctgagagtct

SEQ ID NO: 430014 - DNA, 25 bp, Homo sapien
gcatttctgagagtctttgtaggct

SEQ ID NO: 430015 - DNA, 25 bp, Homo sapien
agagtctttgtaggctgaggttttt

SEQ ID NO: 430016 - DNA, 25 bp, Homo sapien
taggaaattgtttacgagtggagaa

SEQ ID NO: 430017 - DNA, 25 bp, Homo sapien
ctccccggagagaaactggacatgg

SEQ ID NO: 430018 - DNA, 25 bp, Homo sapien
gaggacccctttcccgtggcattag

SEQ ID NO: 430019 - DNA, 25 bp, Homo sapien
gacccctttcccgtggcattagaag

SEQ ID NO: 430020 - DNA, 25 bp, Homo sapien
ccagtcagtgtttgagcctcctcgt

SEQ ID NO: 430021 - DNA, 25 bp, Homo sapien
agtcagtgtttgagcctcctcgttc

SEQ ID NO: 430022 - DNA, 25 bp, Homo sapien
agtgtttgagcctcctcgttcccct

SEQ ID NO: 430023 - DNA, 25 bp, Homo sapien
acgcaccctcggtgaatccttggtg

SEQ ID NO: 430024 - DNA, 25 bp, Homo sapien
gaatccttggtgatgattttggcaa

SEQ ID NO: 430025 - DNA, 25 bp, Homo sapien
tccttggtgatgattttggcaactt

SEQ ID NO: 430026 - DNA, 25 bp, Homo sapien
gatgattttggcaactttgggaata

SEQ ID NO: 430027 - DNA, 25 bp, Homo sapien
ggcaactttgggaataaatggcaat

SEQ ID NO: 430028 - DNA, 25 bp, Homo sapien
catgactccagacaggtattgttat

SEQ ID NO: 430029 - DNA, 25 bp, Homo sapien
gacaggtattgttattcattgttta

SEQ ID NO: 430030 - DNA, 25 bp, Homo sapien
agcctaggtctgcttccaaatttcg

SEQ ID NO: 430031 - DNA, 25 bp, Homo sapien
gcttccaaatttcgtggtttcggat

SEQ ID NO: 430032 - DNA, 25 bp, Homo sapien
gtggtttcggatttagtgccttcat

SEQ ID NO: 430033 - DNA, 25 bp, Homo sapien
tcattgtgtttcacctacaggttaa

SEQ ID NO: 430034 - DNA, 25 bp, Homo sapien
tcacctacaggttaagaagttgttg

SEQ ID NO: 430035 - DNA, 25 bp, Homo sapien
atatttaagacgctgggagaatcca

SEQ ID NO: 430036 - DNA, 25 bp, Homo sapien
gggagaatccaaaaaattgtctagt

SEQ ID NO: 430037 - DNA, 25 bp, Homo sapien
gttgtgtgtaacatagtctcaggat

SEQ ID NO: 430038 - DNA, 25 bp, Homo sapien
gtctcaggattcttacagtgtgcaa

SEQ ID NO: 430039 - DNA, 25 bp, Homo sapien
agactgcaggcccttgatgccagga

SEQ ID NO: 430040 - DNA, 25 bp, Homo sapien
ttgatgccaggactctctctactaa

SEQ ID NO: 430041 - DNA, 25 bp, Homo sapien
aggactctctctactaaggccagtt

SEQ ID NO: 430042 - DNA, 25 bp, Homo sapien
ctaaggccagttcaggtctgggaaa

SEQ ID NO: 430043 - DNA, 25 bp, Homo sapien
aagggagctggcctattgcccacca

SEQ ID NO: 430044 - DNA, 25 bp, Homo sapien
ttgcccaccacctgttgtcagtagg

SEQ ID NO: 430045 - DNA, 25 bp, Homo sapien
gttaggagctgttgactcaggatga

SEQ ID NO: 430046 - DNA, 25 bp, Homo sapien
gaaaaaggtctattcttcagcagat

SEQ ID NO: 430047 - DNA, 25 bp, Homo sapien
ttcttcagcagatcactgtggcccc

SEQ ID NO: 430048 - DNA, 25 bp, Homo sapien
cactgtggcccctcttggagctggg

SEQ ID NO: 430049 - DNA, 25 bp, Homo sapien
gaatgtggatagtgagatttgcttc

SEQ ID NO: 430050 - DNA, 25 bp, Homo sapien
aagatggctgtcacctattcgcggc

SEQ ID NO: 430051 - DNA, 25 bp, Homo sapien
tggctgtcacctattcgcggctctt

SEQ ID NO: 430052 - DNA, 25 bp, Homo sapien
ttccgccgtctcttcgagttcttcg

SEQ ID NO: 430053 - DNA, 25 bp, Homo sapien
gtctcttcgagttcttcgtgctgct

SEQ ID NO: 430054 - DNA, 25 bp, Homo sapien
tcttcgagttcttcgtgctgctcaa

SEQ ID NO: 430055 - DNA, 25 bp, Homo sapien
tcgagttcttcgtgctgctcaaggc

SEQ ID NO: 430056 - DNA, 25 bp, Homo sapien
agttcttcgtgctgctcaaggccct

SEQ ID NO: 430057 - DNA, 25 bp, Homo sapien
ttcgtgctgctcaaggccctgtttg

SEQ ID NO: 430058 - DNA, 25 bp, Homo sapien
cgtgctgctcaaggccctgtttgtg

SEQ ID NO: 430059 - DNA, 25 bp, Homo sapien
ctgtttgtgctcttcgtcctggcct

SEQ ID NO: 430060 - DNA, 25 bp, Homo sapien
tggcctacatccacatcgtcttctc

SEQ ID NO: 430061 - DNA, 25 bp, Homo sapien
aagtaaggcatggtccacagccaca

SEQ ID NO: 430062 - DNA, 25 bp, Homo sapien
aggcatggtccacagccacaaggag

SEQ ID NO: 430063 - DNA, 25 bp, Homo sapien
cacagccacaaggagcttatagtcc

SEQ ID NO: 430064 - DNA, 25 bp, Homo sapien
ggagcttatagtccaggatataaat

SEQ ID NO: 430065 - DNA, 25 bp, Homo sapien
gtagctgattagagcagtgcctctc

SEQ ID NO: 430066 - DNA, 25 bp, Homo sapien
ggcaaaattaattctgatgcagagt

SEQ ID NO: 430067 - DNA, 25 bp, Homo sapien
agcagtgcctctcaagtcgcctggg

SEQ ID NO: 430068 - DNA, 25 bp, Homo sapien
tagaatcacaggcaagcagtcccac

SEQ ID NO: 430069 - DNA, 25 bp, Homo sapien
acaggcaagcagtcccacacctggg

SEQ ID NO: 430070 - DNA, 25 bp, Homo sapien
acacctgggcactctgatgcgacaa

SEQ ID NO: 430071 - DNA, 25 bp, Homo sapien
gggcactctgatgcgacaaataagt

SEQ ID NO: 430072 - DNA, 25 bp, Homo sapien
ttagatgaagcaagaggccaggccc

SEQ ID NO: 430073 - DNA, 25 bp, Homo sapien
agcaagaggccaggcccggaacaga

SEQ ID NO: 430074 - DNA, 25 bp, Homo sapien
ctcagcagtcagtcacaaggctgca

SEQ ID NO: 430075 - DNA, 25 bp, Homo sapien
cagtcagtcacaaggctgcagagtg

SEQ ID NO: 430076 - DNA, 25 bp, Homo sapien
ttatttgatacttgccgtgttggta

SEQ ID NO: 430077 - DNA, 25 bp, Homo sapien
gaaaggtaggaaccgctctccgcca

SEQ ID NO: 430078 - DNA, 25 bp, Homo sapien
gatacttgccgtgttggtaggccaa

SEQ ID NO: 430079 - DNA, 25 bp, Homo sapien
gtcagtagccctacccacaatcagg

SEQ ID NO: 430080 - DNA, 25 bp, Homo sapien
tcggcctggtcccaaaaattgtgaa

SEQ ID NO: 430081 - DNA, 25 bp, Homo sapien
ttgccgtgttggtaggccaaaaggt

SEQ ID NO: 430082 - DNA, 25 bp, Homo sapien
caaaaattgtgaacgccgccctctc

SEQ ID NO: 430083 - DNA, 25 bp, Homo sapien
cagtgtggggttccccattcatccg

SEQ ID NO: 430084 - DNA, 25 bp, Homo sapien
gggttccccattcatccgccttttg

SEQ ID NO: 430085 - DNA, 25 bp, Homo sapien
ggttccccattcatccgccttttgg

SEQ ID NO: 430086 - DNA, 25 bp, Homo sapien
gttccccattcatccgccttttgga

SEQ ID NO: 430087 - DNA, 25 bp, Homo sapien
ttccccattcatccgccttttggag

SEQ ID NO: 430088 - DNA, 25 bp, Homo sapien
ccattcatccgccttttggagtagg

SEQ ID NO: 430089 - DNA, 25 bp, Homo sapien
cattcatccgccttttggagtaggg

SEQ ID NO: 430090 - DNA, 25 bp, Homo sapien
ggtcctggcgccagcctcaggcctg

SEQ ID NO: 430091 - DNA, 25 bp, Homo sapien
aggcctgcaggtcctaacctcagcc

SEQ ID NO: 430092 - DNA, 25 bp, Homo sapien
ggcctgcaggtcctaacctcagcca

SEQ ID NO: 430093 - DNA, 25 bp, Homo sapien
cctgcaggtcctaacctcagccact

SEQ ID NO: 430094 - DNA, 25 bp, Homo sapien
ggctctgccaagtgcccaagagaga

SEQ ID NO: 430095 - DNA, 25 bp, Homo sapien
tgcccaagagagaggagtcacagtg

SEQ ID NO: 430096 - DNA, 25 bp, Homo sapien
gagtcacagtgactggacctcagac

SEQ ID NO: 430097 - DNA, 25 bp, Homo sapien
agtgactggacctcagacccgagtc

SEQ ID NO: 430098 - DNA, 25 bp, Homo sapien
gacccgagtcctggcagagagtgtt

SEQ ID NO: 430099 - DNA, 25 bp, Homo sapien
gaagacatcaccagggctcagaggt

SEQ ID NO: 430100 - DNA, 25 bp, Homo sapien
ggttccaaacctggcccagagactg

SEQ ID NO: 430101 - DNA, 25 bp, Homo sapien
gcccagagactggaggccctcagag

SEQ ID NO: 430102 - DNA, 25 bp, Homo sapien
tggaggccctcagagaccagattgg

SEQ ID NO: 430103 - DNA, 25 bp, Homo sapien
tcagagaccagattggcagctccct

SEQ ID NO: 430104 - DNA, 25 bp, Homo sapien
ggtgacaggcgcacatatgcccggc

SEQ ID NO: 430105 - DNA, 25 bp, Homo sapien
gcaacatagtggtgttaaagcacac

SEQ ID NO: 430106 - DNA, 25 bp, Homo sapien
taaagcacacatccattggactatg

SEQ ID NO: 430107 - DNA, 25 bp, Homo sapien
acatccattggactatgcaaatcaa

SEQ ID NO: 430108 - DNA, 25 bp, Homo sapien
caatttctactagcagcactgagca

SEQ ID NO: 430109 - DNA, 25 bp, Homo sapien
gcactgagcaactgggcacgtgcta

SEQ ID NO: 430110 - DNA, 25 bp, Homo sapien
tactctaactgtgctagctcttggg

SEQ ID NO: 430111 - DNA, 25 bp, Homo sapien
ctgtgctagctcttgggttgaggaa

SEQ ID NO: 430112 - DNA, 25 bp, Homo sapien
gaatggaatgggtagccttctgctt

SEQ ID NO: 430113 - DNA, 25 bp, Homo sapien
agccttctgcttactggagatgcac

SEQ ID NO: 430114 - DNA, 25 bp, Homo sapien
gatgcacagagaaacatggctgaaa

SEQ ID NO: 430115 - DNA, 25 bp, Homo sapien
gctgctgcccgggtgtaaactatcc

SEQ ID NO: 430116 - DNA, 25 bp, Homo sapien
caagctctatcggagatcccatagt

SEQ ID NO: 430117 - DNA, 25 bp, Homo sapien
gagatcccatagtctggttgttccc

SEQ ID NO: 430118 - DNA, 25 bp, Homo sapien
gttccccctgtggatggacatcaag

SEQ ID NO: 430119 - DNA, 25 bp, Homo sapien
ggacatcaagactgctgcccatttt

SEQ ID NO: 430120 - DNA, 25 bp, Homo sapien
aagactgctgcccatttttcactgt

SEQ ID NO: 430121 - DNA, 25 bp, Homo sapien
gcccatttttcactgtttcgagcaa

SEQ ID NO: 430122 - DNA, 25 bp, Homo sapien
tttcactgtttcgagcaatgcagaa

SEQ ID NO: 430123 - DNA, 25 bp, Homo sapien
aagcattgtatgagcatcctggttc

SEQ ID NO: 430124 - DNA, 25 bp, Homo sapien
agcatcctggttctttgtgcacaaa

SEQ ID NO: 430125 - DNA, 25 bp, Homo sapien
ggttctttgtgcacaaacatatgaa

SEQ ID NO: 430126 - DNA, 25 bp, Homo sapien
gaatatatttcttacccgtgacaac

SEQ ID NO: 430127 - DNA, 25 bp, Homo sapien
cagcgcaagagggataatctgtgga

SEQ ID NO: 430128 - DNA, 25 bp, Homo sapien
agcgcaagagggataatctgtggac

SEQ ID NO: 430129 - DNA, 25 bp, Homo sapien
gcgcaagagggataatctgtggact

SEQ ID NO: 430130 - DNA, 25 bp, Homo sapien
cgcaagagggataatctgtggactc

SEQ ID NO: 430131 - DNA, 25 bp, Homo sapien
tggcttacaaacttggcagagacaa

SEQ ID NO: 430132 - DNA, 25 bp, Homo sapien
ggcttacaaacttggcagagacaaa

SEQ ID NO: 430133 - DNA, 25 bp, Homo sapien
gcttacaaacttggcagagacaaac

SEQ ID NO: 430134 - DNA, 25 bp, Homo sapien
cttacaaacttggcagagacaaacc

SEQ ID NO: 430135 - DNA, 25 bp, Homo sapien
gatggtataccatcaccattccact

SEQ ID NO: 430136 - DNA, 25 bp, Homo sapien
attccactcggccacaaagccagat

SEQ ID NO: 430137 - DNA, 25 bp, Homo sapien
aacctactccaaatgtatcagttca

SEQ ID NO: 430138 - DNA, 25 bp, Homo sapien
ttcagtcttgaaccatggattacat

SEQ ID NO: 430139 - DNA, 25 bp, Homo sapien
catggattacatatgtttacactaa

SEQ ID NO: 430140 - DNA, 25 bp, Homo sapien
aactgatgtaaagtgtgttgtaact

SEQ ID NO: 430141 - DNA, 25 bp, Homo sapien
cagctgagacagttgatgccttcgt

SEQ ID NO: 430142 - DNA, 25 bp, Homo sapien
gacagttgatgccttcgtcatgatt

SEQ ID NO: 430143 - DNA, 25 bp, Homo sapien
gatgccttcgtcatgattttagaat

SEQ ID NO: 430144 - DNA, 25 bp, Homo sapien
taatgcaagtgctttttaagagact

SEQ ID NO: 430145 - DNA, 25 bp, Homo sapien
gagactttttacagatttgtatgct

SEQ ID NO: 430146 - DNA, 25 bp, Homo sapien
accagacactggtttggggtcttca

SEQ ID NO: 430147 - DNA, 25 bp, Homo sapien
gggtcttcagcagtcctctgtcgaa

SEQ ID NO: 430148 - DNA, 25 bp, Homo sapien
ggtcttcagcagtcctctgtcgaaa

SEQ ID NO: 430149 - DNA, 25 bp, Homo sapien
gtcttcagcagtcctctgtcgaaat

SEQ ID NO: 430150 - DNA, 25 bp, Homo sapien
tcttcagcagtcctctgtcgaaata

SEQ ID NO: 430151 - DNA, 25 bp, Homo sapien
ttcagcagtcctctgtcgaaataca

SEQ ID NO: 430152 - DNA, 25 bp, Homo sapien
tcagcagtcctctgtcgaaatacat

SEQ ID NO: 430153 - DNA, 25 bp, Homo sapien
agcagtcctctgtcgaaatacatat

SEQ ID NO: 430154 - DNA, 25 bp, Homo sapien
gcagtcctctgtcgaaatacatata

SEQ ID NO: 430155 - DNA, 25 bp, Homo sapien
agtcctctgtcgaaatacatatatt

SEQ ID NO: 430156 - DNA, 25 bp, Homo sapien
cctctgtcgaaatacatatattcag

SEQ ID NO: 430157 - DNA, 25 bp, Homo sapien
aagacataagacttgtcctatggac

SEQ ID NO: 430158 - DNA, 25 bp, Homo sapien
gaggagagtgcaataggctgaattt

SEQ ID NO: 430159 - DNA, 25 bp, Homo sapien
ggctgaatttaagacaggactctgt

SEQ ID NO: 430160 - DNA, 25 bp, Homo sapien
taagacaggactctgtagtagtcag

SEQ ID NO: 430161 - DNA, 25 bp, Homo sapien
tcagagcagtggactaagttaaacc

SEQ ID NO: 430162 - DNA, 25 bp, Homo sapien
aagttaaaccagtcactcatgagtt

SEQ ID NO: 430163 - DNA, 25 bp, Homo sapien
gtcactcatgagttcttcaccttga

SEQ ID NO: 430164 - DNA, 25 bp, Homo sapien
tcccaataatggactgcagtttgca

SEQ ID NO: 430165 - DNA, 25 bp, Homo sapien
gtttgcaaaataatcttgtttcctt

SEQ ID NO: 430166 - DNA, 25 bp, Homo sapien
ccttatgttaagatgtgttacccaa

SEQ ID NO: 430167 - DNA, 25 bp, Homo sapien
gggtgtgaatgaacttttattgtga

SEQ ID NO: 430168 - DNA, 25 bp, Homo sapien
gctgaagtgctggaaaacctggcat

SEQ ID NO: 430169 - DNA, 25 bp, Homo sapien
ttgaacttctacaggagttcctgcc

SEQ ID NO: 430170 - DNA, 25 bp, Homo sapien
gagttcctgcccctagtgggtaagt

SEQ ID NO: 430171 - DNA, 25 bp, Homo sapien
gggtaagttacctattgcactgact

SEQ ID NO: 430172 - DNA, 25 bp, Homo sapien
tacctattgcactgactttatgaag

SEQ ID NO: 430173 - DNA, 25 bp, Homo sapien
tgaagatatctcttccagtgccctt

SEQ ID NO: 430174 - DNA, 25 bp, Homo sapien
agtgcccttaagtgtgagcatcccc

SEQ ID NO: 430175 - DNA, 25 bp, Homo sapien
tgagcatccccacaaaccttatgaa

SEQ ID NO: 430176 - DNA, 25 bp, Homo sapien
agttgaatccaacctgaatgcctct

SEQ ID NO: 430177 - DNA, 25 bp, Homo sapien
tgaatgcctctccataagcccggag

SEQ ID NO: 430178 - DNA, 25 bp, Homo sapien
aggctaggagagatgttccctccgg

SEQ ID NO: 430179 - DNA, 25 bp, Homo sapien
gggtcttcagcagtcctctgtcgaa

SEQ ID NO: 430180 - DNA, 25 bp, Homo sapien
ggtcttcagcagtcctctgtcgaaa

SEQ ID NO: 430181 - DNA, 25 bp, Homo sapien
gtcttcagcagtcctctgtcgaaat

SEQ ID NO: 430182 - DNA, 25 bp, Homo sapien
tcttcagcagtcctctgtcgaaata

SEQ ID NO: 430183 - DNA, 25 bp, Homo sapien
cttcagcagtcctctgtcgaaatac

SEQ ID NO: 430184 - DNA, 25 bp, Homo sapien
ttcagcagtcctctgtcgaaataca

SEQ ID NO: 430185 - DNA, 25 bp, Homo sapien
tcagcagtcctctgtcgaaatacat

SEQ ID NO: 430186 - DNA, 25 bp, Homo sapien
agcagtcctctgtcgaaatacatat

SEQ ID NO: 430187 - DNA, 25 bp, Homo sapien
gcagtcctctgtcgaaatacatata

SEQ ID NO: 430188 - DNA, 25 bp, Homo sapien
agtcctctgtcgaaatacatatatt

SEQ ID NO: 430189 - DNA, 25 bp, Homo sapien
cctctgtcgaaatacatatattcag

SEQ ID NO: 430190 - DNA, 25 bp, Homo sapien
gttaacaatcctaggaatcctgcct

SEQ ID NO: 430191 - DNA, 25 bp, Homo sapien
taggaatcctgcctgtcacaagctc

SEQ ID NO: 430192 - DNA, 25 bp, Homo sapien
acaagctcccagttccctgtcattt

SEQ ID NO: 430193 - DNA, 25 bp, Homo sapien
cttcatgattagaactgatcttcca

SEQ ID NO: 430194 - DNA, 25 bp, Homo sapien
gaactgatcttccatttaactatta

SEQ ID NO: 430195 - DNA, 25 bp, Homo sapien
aagcagtaactattgcaactatcta

SEQ ID NO: 430196 - DNA, 25 bp, Homo sapien
gcaactatctaatagttcacacaaa

SEQ ID NO: 430197 - DNA, 25 bp, Homo sapien
gtgataaatgaaatctcctaccaat

SEQ ID NO: 430198 - DNA, 25 bp, Homo sapien
tgaaatctcctaccaatccatccag

SEQ ID NO: 430199 - DNA, 25 bp, Homo sapien
atccatccagcctttaccagggaag

SEQ ID NO: 430200 - DNA, 25 bp, Homo sapien
ttaccagggaagaaaagcaattatt

SEQ ID NO: 430201 - DNA, 25 bp, Homo sapien
tgctctgccctgcacgtcagggttg

SEQ ID NO: 430202 - DNA, 25 bp, Homo sapien
gtcagggttggcatccacccagatc

SEQ ID NO: 430203 - DNA, 25 bp, Homo sapien
ttggcatccacccagatccagatgg

SEQ ID NO: 430204 - DNA, 25 bp, Homo sapien
gcatccacccagatccagatggaag

SEQ ID NO: 430205 - DNA, 25 bp, Homo sapien
atccacccagatccagatggaaggg

SEQ ID NO: 430206 - DNA, 25 bp, Homo sapien
gatggaagggaaacttctctcttct

SEQ ID NO: 430207 - DNA, 25 bp, Homo sapien
gaagggaaacttctctcttctcctt

SEQ ID NO: 430208 - DNA, 25 bp, Homo sapien
tcaccagagcagggcgcttctcttg

SEQ ID NO: 430209 - DNA, 25 bp, Homo sapien
gaaggatcttcgagaaatcgtgttc

SEQ ID NO: 430210 - DNA, 25 bp, Homo sapien
gatcttcgagaaatcgtgttcagta

SEQ ID NO: 430211 - DNA, 25 bp, Homo sapien
cgagaaatcgtgttcagtatttcaa

SEQ ID NO: 430212 - DNA, 25 bp, Homo sapien
ttgcatcaatctaaggcaggaatca

SEQ ID NO: 430213 - DNA, 25 bp, Homo sapien
gcatcaatctaaggcaggaatcagc

SEQ ID NO: 430214 - DNA, 25 bp, Homo sapien
atcaatctaaggcaggaatcagctg

SEQ ID NO: 430215 - DNA, 25 bp, Homo sapien
caatctaaggcaggaatcagctggt

SEQ ID NO: 430216 - DNA, 25 bp, Homo sapien
aatctaaggcaggaatcagctggta

SEQ ID NO: 430217 - DNA, 25 bp, Homo sapien
atctaaggcaggaatcagctggtaa

SEQ ID NO: 430218 - DNA, 25 bp, Homo sapien
ctaaggcaggaatcagctggtaaga

SEQ ID NO: 430219 - DNA, 25 bp, Homo sapien
aaggcaggaatcagctggtaagagc

SEQ ID NO: 430220 - DNA, 25 bp, Homo sapien
gcaggaatcagctggtaagagcata

SEQ ID NO: 430221 - DNA, 25 bp, Homo sapien
gaatcagctggtaagagcatagact

SEQ ID NO: 430222 - DNA, 25 bp, Homo sapien
atcagctggtaagagcatagactgg

SEQ ID NO: 430223 - DNA, 25 bp, Homo sapien
cctattctctaactacacttgggaa

SEQ ID NO: 430224 - DNA, 25 bp, Homo sapien
tattctctaactacacttgggaagt

SEQ ID NO: 430225 - DNA, 25 bp, Homo sapien
tctctaactacacttgggaagtgca

SEQ ID NO: 430226 - DNA, 25 bp, Homo sapien
aaaggcttttatgagtttacagtag

SEQ ID NO: 430227 - DNA, 25 bp, Homo sapien
ccatagaaaaggtcctcttagtgaa

SEQ ID NO: 430228 - DNA, 25 bp, Homo sapien
tagaaaaggtcctcttagtgaacaa

SEQ ID NO: 430229 - DNA, 25 bp, Homo sapien
atagctatgaaatttccccgggcat

SEQ ID NO: 430230 - DNA, 25 bp, Homo sapien
tagctatgaaatttccccgggcatt

SEQ ID NO: 430231 - DNA, 25 bp, Homo sapien
gctatgaaatttccccgggcatttg

SEQ ID NO: 430232 - DNA, 25 bp, Homo sapien
gagtttacagtagaatcagtggaag

SEQ ID NO: 430233 - DNA, 25 bp, Homo sapien
gaaggaagagttaataagggctgtt

SEQ ID NO: 430234 - DNA, 25 bp, Homo sapien
taagccaacctggtcaaccaactga

SEQ ID NO: 430235 - DNA, 25 bp, Homo sapien
gtcaaccaactgatgaaagccacat

SEQ ID NO: 430236 - DNA, 25 bp, Homo sapien
aagccacattctatggtttctgcgg

SEQ ID NO: 430237 - DNA, 25 bp, Homo sapien
cacattctatggtttctgcggatag

SEQ ID NO: 430238 - DNA, 25 bp, Homo sapien
tctgcggatagaacgaagaagactt

SEQ ID NO: 430239 - DNA, 25 bp, Homo sapien
gaagaagacttcttaccccacatca

SEQ ID NO: 430240 - DNA, 25 bp, Homo sapien
ttcttaccccacatcacacaggtga

SEQ ID NO: 430241 - DNA, 25 bp, Homo sapien
acaggtgacgccctcgccagaagtt

SEQ ID NO: 430242 - DNA, 25 bp, Homo sapien
gacgccctcgccagaagtttcaaga

SEQ ID NO: 430243 - DNA, 25 bp, Homo sapien
agaagtttcaagagctccacaaggt

SEQ ID NO: 430244 - DNA, 25 bp, Homo sapien
gagctccacaaggtgttctgaagca

SEQ ID NO: 430245 - DNA, 25 bp, Homo sapien
actgattttctacaaaagtgcatgg

SEQ ID NO: 430246 - DNA, 25 bp, Homo sapien
aaaccttctgactggaagttctatc

SEQ ID NO: 430247 - DNA, 25 bp, Homo sapien
ggaagttctatcacacaagaggcaa

SEQ ID NO: 430248 - DNA, 25 bp, Homo sapien
ggtgggaaatcagcctatttgtgaa

SEQ ID NO: 430249 - DNA, 25 bp, Homo sapien
aaaggaacaccgatttgcgggcagg

SEQ ID NO: 430250 - DNA, 25 bp, Homo sapien
aaaacttcagtcacgtttgcacacc

SEQ ID NO: 430251 - DNA, 25 bp, Homo sapien
agtcacgtttgcacacctttctttc

SEQ ID NO: 430252 - DNA, 25 bp, Homo sapien
tttttctgtctgagtgtgagctcca

SEQ ID NO: 430253 - DNA, 25 bp, Homo sapien
atccgcctgggcatctgattttttg

SEQ ID NO: 430254 - DNA, 25 bp, Homo sapien
gtccagttttatgatcttcacaggc

SEQ ID NO: 430255 - DNA, 25 bp, Homo sapien
atgatcttcacaggctattgcattt

SEQ ID NO: 430256 - DNA, 25 bp, Homo sapien
gggaaagcgcattaacatggacaaa

SEQ ID NO: 430257 - DNA, 25 bp, Homo sapien
gtgagaatcattcaagcacctattt

SEQ ID NO: 430258 - DNA, 25 bp, Homo sapien
atagtgatgatatgacaccagcata

SEQ ID NO: 430259 - DNA, 25 bp, Homo sapien
aactagctacacaaacgtcttggag

SEQ ID NO: 430260 - DNA, 25 bp, Homo sapien
gtcttggagtttggtttcgttctct

SEQ ID NO: 430261 - DNA, 25 bp, Homo sapien
gtttggtttcgttctcttttctcat

SEQ ID NO: 430262 - DNA, 25 bp, Homo sapien
tttctcatcatagatctccgtgcag

SEQ ID NO: 430263 - DNA, 25 bp, Homo sapien
gatctccgtgcagaatagtgctaat

SEQ ID NO: 430264 - DNA, 25 bp, Homo sapien
gtgctaattcttatttctcgtttgc

SEQ ID NO: 430265 - DNA, 25 bp, Homo sapien
ttcttatttctcgtttgcctttcta

SEQ ID NO: 430266 - DNA, 25 bp, Homo sapien
ttctcgtttgcctttctatttcctt

SEQ ID NO: 430267 - DNA, 25 bp, Homo sapien
actttgggaaatttgctgcaaggct

SEQ ID NO: 430268 - DNA, 25 bp, Homo sapien
tgcctcactctcagtatagtcaagg

SEQ ID NO: 430269 - DNA, 25 bp, Homo sapien
gtatagtcaaggctcagcgttttga

SEQ ID NO: 430270 - DNA, 25 bp, Homo sapien
agcgttttgaataacctctcggtct

SEQ ID NO: 430271 - DNA, 25 bp, Homo sapien
cggtctcaaaacaactgctgtgatt

SEQ ID NO: 430272 - DNA, 25 bp, Homo sapien
caactgctgtgatttgatccaatgt

SEQ ID NO: 430273 - DNA, 25 bp, Homo sapien
gatccaatgtggtagtagctctctg

SEQ ID NO: 430274 - DNA, 25 bp, Homo sapien
atgtggtagtagctctctgggtctc

SEQ ID NO: 430275 - DNA, 25 bp, Homo sapien
tcctagtactccttagcctgaagcc

SEQ ID NO: 430276 - DNA, 25 bp, Homo sapien
tccttagcctgaagcctctgtaaaa

SEQ ID NO: 430277 - DNA, 25 bp, Homo sapien
aaagggagcccagataaggcacttt

SEQ ID NO: 430278 - DNA, 25 bp, Homo sapien
gagaggcctcagaatgcgatcgacc

SEQ ID NO: 430279 - DNA, 25 bp, Homo sapien
caagccaaaagcctagttgatttca

SEQ ID NO: 430280 - DNA, 25 bp, Homo sapien
aaagcctagttgatttcatctgcca

SEQ ID NO: 430281 - DNA, 25 bp, Homo sapien
gatttcatctgccaaaccaacgggc

SEQ ID NO: 430282 - DNA, 25 bp, Homo sapien
ttcatctgccaaaccaacgggctag

SEQ ID NO: 430283 - DNA, 25 bp, Homo sapien
atctgccaaaccaacgggctagata

SEQ ID NO: 430284 - DNA, 25 bp, Homo sapien
acaggaagaatgttgtcgaatcata

SEQ ID NO: 430285 - DNA, 25 bp, Homo sapien
gaatgttgtcgaatcatatctggca

SEQ ID NO: 430286 - DNA, 25 bp, Homo sapien
gttgtcgaatcatatctggcattgc

SEQ ID NO: 430287 - DNA, 25 bp, Homo sapien
gtcgaatcatatctggcattgcgtg

SEQ ID NO: 430288 - DNA, 25 bp, Homo sapien
cgaatcatatctggcattgcgtgga

SEQ ID NO: 430289 - DNA, 25 bp, Homo sapien
cagatcgttaacatgggtaacccag

SEQ ID NO: 430290 - DNA, 25 bp, Homo sapien
tatttcccagcagtgacaatctaca

SEQ ID NO: 430291 - DNA, 25 bp, Homo sapien
tgacaatctacaccctttatctaaa

SEQ ID NO: 430292 - DNA, 25 bp, Homo sapien
agatgtgcttttttcctgtgttagt

SEQ ID NO: 430293 - DNA, 25 bp, Homo sapien
aaagaatctcttcttgcctcccatt

SEQ ID NO: 430294 - DNA, 25 bp, Homo sapien
gattttctgtattgatggactcatt

SEQ ID NO: 430295 - DNA, 25 bp, Homo sapien
gatggactcatttctctcaagagat

SEQ ID NO: 430296 - DNA, 25 bp, Homo sapien
gagagcagctctatgttcattcatg

SEQ ID NO: 430297 - DNA, 25 bp, Homo sapien
gatgagccaatttgagcaccactgt

SEQ ID NO: 430298 - DNA, 25 bp, Homo sapien
atttgagcaccactgtaggccaact

SEQ ID NO: 430299 - DNA, 25 bp, Homo sapien
gtaggccaactctaaatttattcag

SEQ ID NO: 430300 - DNA, 25 bp, Homo sapien
attcctgtcctatataattagttga

SEQ ID NO: 430301 - DNA, 25 bp, Homo sapien
ggctgcttcttgctaataatgaagg

SEQ ID NO: 430302 - DNA, 25 bp, Homo sapien
agctttgtgagtacattctcaggtc

SEQ ID NO: 430303 - DNA, 25 bp, Homo sapien
attctcaggtctaaagtcctcaccc

SEQ ID NO: 430304 - DNA, 25 bp, Homo sapien
gctaataatgaagggttttctctcc

SEQ ID NO: 430305 - DNA, 25 bp, Homo sapien
gtgcagtttgttatttcaggccttt

SEQ ID NO: 430306 - DNA, 25 bp, Homo sapien
ggttttctctcctgatattgtctga

SEQ ID NO: 430307 - DNA, 25 bp, Homo sapien
tattgtctgagaatctatcatagat

SEQ ID NO: 430308 - DNA, 25 bp, Homo sapien
tcatagatgaggttagattgccttt

SEQ ID NO: 430309 - DNA, 25 bp, Homo sapien
gattgcctttggaaagatgcttcta

SEQ ID NO: 430310 - DNA, 25 bp, Homo sapien
agatgcttctagttaattcctgtcc

SEQ ID NO: 430311 - DNA, 25 bp, Homo sapien
tcctgaactcaattaactctaccgc

SEQ ID NO: 430312 - DNA, 25 bp, Homo sapien
agggagctacactacagctgtgtgc

SEQ ID NO: 430313 - DNA, 25 bp, Homo sapien
cccagctttttgtagacaggctctt

SEQ ID NO: 430314 - DNA, 25 bp, Homo sapien
gactttcctggccttaagctatcct

SEQ ID NO: 430315 - DNA, 25 bp, Homo sapien
gccttaagctatcctccaacttcag

SEQ ID NO: 430316 - DNA, 25 bp, Homo sapien
ctgcaactggcctaaagctcacttt

SEQ ID NO: 430317 - DNA, 25 bp, Homo sapien
gtgcttgcttccctattaacaatgc

SEQ ID NO: 430318 - DNA, 25 bp, Homo sapien
tgcttccctattaacaatgccatca

SEQ ID NO: 430319 - DNA, 25 bp, Homo sapien
aatgccatcacaaccatggtaacat

SEQ ID NO: 430320 - DNA, 25 bp, Homo sapien
attttaccaagatacatctacctaa

SEQ ID NO: 430321 - DNA, 25 bp, Homo sapien
acctaaacattaactaccttgcaca

SEQ ID NO: 430322 - DNA, 25 bp, Homo sapien
tccaacctttggctaggccggagat

SEQ ID NO: 430323 - DNA, 25 bp, Homo sapien
tggctaggccggagattatcctcaa

SEQ ID NO: 430324 - DNA, 25 bp, Homo sapien
ttatcctcaaccactgtgctcctgg

SEQ ID NO: 430325 - DNA, 25 bp, Homo sapien
aacgaaatgtctgaagccccagctg

SEQ ID NO: 430326 - DNA, 25 bp, Homo sapien
ctgcctcttgaggtagatgtgaact

SEQ ID NO: 430327 - DNA, 25 bp, Homo sapien
ggtagatgtgaactgcctgcccgaa

SEQ ID NO: 430328 - DNA, 25 bp, Homo sapien
gactctagctcccaaggtcagaatt

SEQ ID NO: 430329 - DNA, 25 bp, Homo sapien
gacattggttcaaagctggactcat

SEQ ID NO: 430330 - DNA, 25 bp, Homo sapien
aaagctggactcatgggaggaacac

SEQ ID NO: 430331 - DNA, 25 bp, Homo sapien
gggaggaacacatcttttctgcctt

SEQ ID NO: 430332 - DNA, 25 bp, Homo sapien
aattcgggataagctctgaagaggc

SEQ ID NO: 430333 - DNA, 25 bp, Homo sapien
tgggagatgaatttgaccttataga

SEQ ID NO: 430334 - DNA, 25 bp, Homo sapien
tttgaccttatagatcattctgact

SEQ ID NO: 430335 - DNA, 25 bp, Homo sapien
gatcattctgacttacacattttgg

SEQ ID NO: 430336 - DNA, 25 bp, Homo sapien
tgggagctgaatgccatgaccacca

SEQ ID NO: 430337 - DNA, 25 bp, Homo sapien
agctgaatgccatgaccaccaacag

SEQ ID NO: 430338 - DNA, 25 bp, Homo sapien
tgaccaccaacagcaatatcagtcg

SEQ ID NO: 430339 - DNA, 25 bp, Homo sapien
aacagcaatatcagtcgccccatcg

SEQ ID NO: 430340 - DNA, 25 bp, Homo sapien
agcaatatcagtcgccccatcgtct

SEQ ID NO: 430341 - DNA, 25 bp, Homo sapien
ttccttgagctgtcgctgtactctg

SEQ ID NO: 430342 - DNA, 25 bp, Homo sapien
ttgagctgtcgctgtactctgaagt

SEQ ID NO: 430343 - DNA, 25 bp, Homo sapien
agctgtcgctgtactctgaagttca

SEQ ID NO: 430344 - DNA, 25 bp, Homo sapien
tccccaatactggatgcatgtaatg

SEQ ID NO: 430345 - DNA, 25 bp, Homo sapien
tactggatgcatgtaatgtaaaaca

SEQ ID NO: 430346 - DNA, 25 bp, Homo sapien
cctagtgccaacaaagaaacatcat

SEQ ID NO: 430347 - DNA, 25 bp, Homo sapien
gaaacatcatctttttcagggcctg

SEQ ID NO: 430348 - DNA, 25 bp, Homo sapien
tcagggcctggcctcactctgtcag

SEQ ID NO: 430349 - DNA, 25 bp, Homo sapien
tgtcaggccctaatcctaaaggcct

SEQ ID NO: 430350 - DNA, 25 bp, Homo sapien
gccctaatcctaaaggcctagatat

SEQ ID NO: 430351 - DNA, 25 bp, Homo sapien
gtcatgtgactgctgccttcaataa

SEQ ID NO: 430352 - DNA, 25 bp, Homo sapien
tatattcgataaagtgtggtcctct

SEQ ID NO: 430353 - DNA, 25 bp, Homo sapien
cgataaagtgtggtcctcttattta

SEQ ID NO: 430354 - DNA, 25 bp, Homo sapien
cggtaacccaacacagttgtgtttg

SEQ ID NO: 430355 - DNA, 25 bp, Homo sapien
gtaaaccatttttctatcaaaatag

SEQ ID NO: 430356 - DNA, 25 bp, Homo sapien
acattcagagtatatctttgcttct

SEQ ID NO: 430357 - DNA, 25 bp, Homo sapien
cattcagagtatatctttgcttctc

SEQ ID NO: 430358 - DNA, 25 bp, Homo sapien
ttcagagtatatctttgcttctctc

SEQ ID NO: 430359 - DNA, 25 bp, Homo sapien
ttccattaccagaaatgtactaact

SEQ ID NO: 430360 - DNA, 25 bp, Homo sapien
taccagaaatgtactaactttagac

SEQ ID NO: 430361 - DNA, 25 bp, Homo sapien
gaaatgtactaactttagaccaaca

SEQ ID NO: 430362 - DNA, 25 bp, Homo sapien
aatgtactaactttagaccaacata

SEQ ID NO: 430363 - DNA, 25 bp, Homo sapien
gtactaactttagaccaacataata

SEQ ID NO: 430364 - DNA, 25 bp, Homo sapien
gctctgatttctgacaaaggcccct

SEQ ID NO: 430365 - DNA, 25 bp, Homo sapien
ttctgacaaaggcccctagataaat

SEQ ID NO: 430366 - DNA, 25 bp, Homo sapien
agaagagtcacagagcataggcccc

SEQ ID NO: 430367 - DNA, 25 bp, Homo sapien
atatgagttagttttttggctaagc

SEQ ID NO: 430368 - DNA, 25 bp, Homo sapien
ttggctaagctatgaatttaccttg

SEQ ID NO: 430369 - DNA, 25 bp, Homo sapien
ctaagctatgaatttaccttgtgcc

SEQ ID NO: 430370 - DNA, 25 bp, Homo sapien
aatcactcagtcttttgtgactgta

SEQ ID NO: 430371 - DNA, 25 bp, Homo sapien
taggcccccctagggtacacagaga

SEQ ID NO: 430372 - DNA, 25 bp, Homo sapien
cacagagatttcattagtccctaga

SEQ ID NO: 430373 - DNA, 25 bp, Homo sapien
gagatttcattagtccctagatgtt

SEQ ID NO: 430374 - DNA, 25 bp, Homo sapien
cattagtccctagatgtttcctgat

SEQ ID NO: 430375 - DNA, 25 bp, Homo sapien
ccctagatgtttcctgatcctttta

SEQ ID NO: 430376 - DNA, 25 bp, Homo sapien
ctagatgtttcctgatccttttaaa

SEQ ID NO: 430377 - DNA, 25 bp, Homo sapien
gaaggcaaacctgagtcacttaatt

SEQ ID NO: 430378 - DNA, 25 bp, Homo sapien
acctgagtcacttaatttctacccg

SEQ ID NO: 430379 - DNA, 25 bp, Homo sapien
cacttaatttctacccgaacctcag

SEQ ID NO: 430380 - DNA, 25 bp, Homo sapien
gtgcctgcctcatcagactgttgtg

SEQ ID NO: 430381 - DNA, 25 bp, Homo sapien
gcctcatcagactgttgtggaaatt

SEQ ID NO: 430382 - DNA, 25 bp, Homo sapien
gtaagctctccacaaacattggcta

SEQ ID NO: 430383 - DNA, 25 bp, Homo sapien
agagaaaacctactcttaagatggg

SEQ ID NO: 430384 - DNA, 25 bp, Homo sapien
tgtgacctttgcgtgctgaatttgg

SEQ ID NO: 430385 - DNA, 25 bp, Homo sapien
cgtgctgaatttgggaggatacttt

SEQ ID NO: 430386 - DNA, 25 bp, Homo sapien
gaggatactttaagcctggcagaga

SEQ ID NO: 430387 - DNA, 25 bp, Homo sapien
ctggcagagacagggtaataacacc

SEQ ID NO: 430388 - DNA, 25 bp, Homo sapien
ttcccacatgaatataggcacaaaa

SEQ ID NO: 430389 - DNA, 25 bp, Homo sapien
gatttgtaatcctgaatgccttcca

SEQ ID NO: 430390 - DNA, 25 bp, Homo sapien
ttgtaatcctgaatgccttccacat

SEQ ID NO: 430391 - DNA, 25 bp, Homo sapien
aatcctgaatgccttccacatctta

SEQ ID NO: 430392 - DNA, 25 bp, Homo sapien
tgaatgccttccacatcttatttct

SEQ ID NO: 430393 - DNA, 25 bp, Homo sapien
atgccttccacatcttatttctgat

SEQ ID NO: 430394 - DNA, 25 bp, Homo sapien
gccttccacatcttatttctgatac

SEQ ID NO: 430395 - DNA, 25 bp, Homo sapien
actattttatccatttcgtacagct

SEQ ID NO: 430396 - DNA, 25 bp, Homo sapien
attttatccatttcgtacagcttac

SEQ ID NO: 430397 - DNA, 25 bp, Homo sapien
tatccatttcgtacagcttacccat

SEQ ID NO: 430398 - DNA, 25 bp, Homo sapien
catttcgtacagcttacccatttcc

SEQ ID NO: 430399 - DNA, 25 bp, Homo sapien
gggatctgaaagacgttcagcttgc

SEQ ID NO: 430400 - DNA, 25 bp, Homo sapien
ggatctgaaagacgttcagcttgct

SEQ ID NO: 430401 - DNA, 25 bp, Homo sapien
gatctgaaagacgttcagcttgctg

SEQ ID NO: 430402 - DNA, 25 bp, Homo sapien
atctgaaagacgttcagcttgctgg

SEQ ID NO: 430403 - DNA, 25 bp, Homo sapien
tctgaaagacgttcagcttgctggt

SEQ ID NO: 430404 - DNA, 25 bp, Homo sapien
ctgaaagacgttcagcttgctggtg

SEQ ID NO: 430405 - DNA, 25 bp, Homo sapien
tgaaagacgttcagcttgctggtgt

SEQ ID NO: 430406 - DNA, 25 bp, Homo sapien
gaaagacgttcagcttgctggtgtt

SEQ ID NO: 430407 - DNA, 25 bp, Homo sapien
aaagacgttcagcttgctggtgttc

SEQ ID NO: 430408 - DNA, 25 bp, Homo sapien
aagacgttcagcttgctggtgttct

SEQ ID NO: 430409 - DNA, 25 bp, Homo sapien
agacgttcagcttgctggtgttctt

SEQ ID NO: 430410 - DNA, 25 bp, Homo sapien
tggctgcctatctgctgcttcttag

SEQ ID NO: 430411 - DNA, 25 bp, Homo sapien
gctgcctatctgctgcttcttaggt

SEQ ID NO: 430412 - DNA, 25 bp, Homo sapien
tttattaccaggctttccttctcac

SEQ ID NO: 430413 - DNA, 25 bp, Homo sapien
tccttctcaccccttttttctgact

SEQ ID NO: 430414 - DNA, 25 bp, Homo sapien
ttttctgactttgccaagtaatttg

SEQ ID NO: 430415 - DNA, 25 bp, Homo sapien
gactttgccaagtaatttgttgaca

SEQ ID NO: 430416 - DNA, 25 bp, Homo sapien
ctttgccaagtaatttgttgacacg

SEQ ID NO: 430417 - DNA, 25 bp, Homo sapien
tagatgatgctttgtgtgatacatt

SEQ ID NO: 430418 - DNA, 25 bp, Homo sapien
gatgatgctttgtgtgatacattaa

SEQ ID NO: 430419 - DNA, 25 bp, Homo sapien
gctttgtgtgatacattaagttctt

SEQ ID NO: 430420 - DNA, 25 bp, Homo sapien
gatacattaagttcttattttggat

SEQ ID NO: 430421 - DNA, 25 bp, Homo sapien
ttaattcattgacccattacactgg

SEQ ID NO: 430422 - DNA, 25 bp, Homo sapien
tcattgacccattacactggtgaat

SEQ ID NO: 430423 - DNA, 25 bp, Homo sapien
tacactggtgaattttggctccaaa

SEQ ID NO: 430424 - DNA, 25 bp, Homo sapien
ttttggctccaaaggtgttcaggtt

SEQ ID NO: 430425 - DNA, 25 bp, Homo sapien
ggtgttcaggttggtaatcaatcta

SEQ ID NO: 430426 - DNA, 25 bp, Homo sapien
ggttggtaatcaatctatgacttat

SEQ ID NO: 430427 - DNA, 25 bp, Homo sapien
aaagaccttgagacattatcaaatt

SEQ ID NO: 430428 - DNA, 25 bp, Homo sapien
aaattactcttattgagagtccaag

SEQ ID NO: 430429 - DNA, 25 bp, Homo sapien
gagagtccaagagactgtagtttag

SEQ ID NO: 430430 - DNA, 25 bp, Homo sapien
acagatttacagtcagatagactta

SEQ ID NO: 430431 - DNA, 25 bp, Homo sapien
ttgttactaagtacactgatgctat

SEQ ID NO: 430432 - DNA, 25 bp, Homo sapien
ctccacctgagatgctgttctcttc

SEQ ID NO: 430433 - DNA, 25 bp, Homo sapien
ttctttggctgacctactcaccatg

SEQ ID NO: 430434 - DNA, 25 bp, Homo sapien
tgacctactcaccatgtccatgatc

SEQ ID NO: 430435 - DNA, 25 bp, Homo sapien
tgtccatgatcagatgtccacaaag

SEQ ID NO: 430436 - DNA, 25 bp, Homo sapien
tgctggaaaccagagtactgcagaa

SEQ ID NO: 430437 - DNA, 25 bp, Homo sapien
agttaaacccagactggtaagatga

SEQ ID NO: 430438 - DNA, 25 bp, Homo sapien
ggtaagatgaatcagccacttcccc

SEQ ID NO: 430439 - DNA, 25 bp, Homo sapien
taagatgaatcagccacttccccaa

SEQ ID NO: 430440 - DNA, 25 bp, Homo sapien
acttccccaacagccaagaggatta

SEQ ID NO: 430441 - DNA, 25 bp, Homo sapien
atttctcagaaagatgtgtcactct

SEQ ID NO: 430442 - DNA, 25 bp, Homo sapien
tcagaaagatgtgtcactctgtgca

SEQ ID NO: 430443 - DNA, 25 bp, Homo sapien
acatatcttccctctgtctgccagg

SEQ ID NO: 430444 - DNA, 25 bp, Homo sapien
tcttccctctgtctgccaggctgga

SEQ ID NO: 430445 - DNA, 25 bp, Homo sapien
gctggagcgcagtgttgccattatg

SEQ ID NO: 430446 - DNA, 25 bp, Homo sapien
tggagcgcagtgttgccattatggc

SEQ ID NO: 430447 - DNA, 25 bp, Homo sapien
ggagcgcagtgttgccattatggcc

SEQ ID NO: 430448 - DNA, 25 bp, Homo sapien
gagcgcagtgttgccattatggccc

SEQ ID NO: 430449 - DNA, 25 bp, Homo sapien
cgcagtgttgccattatggcccact

SEQ ID NO: 430450 - DNA, 25 bp, Homo sapien
gtgttgccattatggcccactgcag

SEQ ID NO: 430451 - DNA, 25 bp, Homo sapien
gtagctaggatcgtaggcatacacc

SEQ ID NO: 430452 - DNA, 25 bp, Homo sapien
ctaggatcgtaggcatacaccacca

SEQ ID NO: 430453 - DNA, 25 bp, Homo sapien
gcctggctcatttttacaatttttt

SEQ ID NO: 430454 - DNA, 25 bp, Homo sapien
tccaaagccggaaaaggatcctcta

SEQ ID NO: 430455 - DNA, 25 bp, Homo sapien
aaaggatcctctagtagccacggtg

SEQ ID NO: 430456 - DNA, 25 bp, Homo sapien
gctgctctgaaccaggacctggacc

SEQ ID NO: 430457 - DNA, 25 bp, Homo sapien
tggacccggacccaaagtgccatgt

SEQ ID NO: 430458 - DNA, 25 bp, Homo sapien
cggacccaaagtgccatgtctttaa

SEQ ID NO: 430459 - DNA, 25 bp, Homo sapien
atgtctttaatgttagctcccagcg

SEQ ID NO: 430460 - DNA, 25 bp, Homo sapien
tagctcccagcgatgccagatggga

SEQ ID NO: 430461 - DNA, 25 bp, Homo sapien
agatgggatcagcacagccctgcct

SEQ ID NO: 430462 - DNA, 25 bp, Homo sapien
ctgctaattgttcctctaaagtaat

SEQ ID NO: 430463 - DNA, 25 bp, Homo sapien
gttcctctaaagtaatcgccatgcg

SEQ ID NO: 430464 - DNA, 25 bp, Homo sapien
tattctggaaaaccttttggcagtt

SEQ ID NO: 430465 - DNA, 25 bp, Homo sapien
accctaatgaacagccctcttaaga

SEQ ID NO: 430466 - DNA, 25 bp, Homo sapien
gccctcttaagagtggtcatcagac

SEQ ID NO: 430467 - DNA, 25 bp, Homo sapien
ggtcatcagacttcaatttcacaga

SEQ ID NO: 430468 - DNA, 25 bp, Homo sapien
gacttcaatttcacagactagaatt

SEQ ID NO: 430469 - DNA, 25 bp, Homo sapien
aaaccttgggataccagccttccat

SEQ ID NO: 430470 - DNA, 25 bp, Homo sapien
gggataccagccttccattttggta

SEQ ID NO: 430471 - DNA, 25 bp, Homo sapien
tccattttggtagggatcatttaaa

SEQ ID NO: 430472 - DNA, 25 bp, Homo sapien
aatgtgttggtgtctgaaacttact

SEQ ID NO: 430473 - DNA, 25 bp, Homo sapien
ttggtgtctgaaacttactttgaag

SEQ ID NO: 430474 - DNA, 25 bp, Homo sapien
atgtactgtacaattctttctttac

SEQ ID NO: 430475 - DNA, 25 bp, Homo sapien
ttctttctttacaattttatggatg

SEQ ID NO: 430476 - DNA, 25 bp, Homo sapien
tataaacttataaatttgctctggg

SEQ ID NO: 430477 - DNA, 25 bp, Homo sapien
ataaacttataaatttgctctggga

SEQ ID NO: 430478 - DNA, 25 bp, Homo sapien
attatatatagtgttcagtcccatg

SEQ ID NO: 430479 - DNA, 25 bp, Homo sapien
ttatatatagtgttcagtcccatgg

SEQ ID NO: 430480 - DNA, 25 bp, Homo sapien
tatatatagtgttcagtcccatggg

SEQ ID NO: 430481 - DNA, 25 bp, Homo sapien
atatatagtgttcagtcccatgggt

SEQ ID NO: 430482 - DNA, 25 bp, Homo sapien
tatatagtgttcagtcccatgggtg

SEQ ID NO: 430483 - DNA, 25 bp, Homo sapien
atatagtgttcagtcccatgggtgg

SEQ ID NO: 430484 - DNA, 25 bp, Homo sapien
tagtgttcagtcccatgggtggtgt

SEQ ID NO: 430485 - DNA, 25 bp, Homo sapien
atcctggattctaatctctagattt

SEQ ID NO: 430486 - DNA, 25 bp, Homo sapien
aatctctagatttggctgtgggaaa

SEQ ID NO: 430487 - DNA, 25 bp, Homo sapien
tccttataacccacaactgaaattc

SEQ ID NO: 430488 - DNA, 25 bp, Homo sapien
aactgaaattcagcatctctgccct

SEQ ID NO: 430489 - DNA, 25 bp, Homo sapien
gaaattcagcatctctgccctgtgg

SEQ ID NO: 430490 - DNA, 25 bp, Homo sapien
ttcagcatctctgccctgtggcttt

SEQ ID NO: 430491 - DNA, 25 bp, Homo sapien
gtggctttcaatttggggaggctca

SEQ ID NO: 430492 - DNA, 25 bp, Homo sapien
gggaggctcatatcgggtcttttct

SEQ ID NO: 430493 - DNA, 25 bp, Homo sapien
ggctcatatcgggtcttttcttacc

SEQ ID NO: 430494 - DNA, 25 bp, Homo sapien
atatcgggtcttttcttaccctctg

SEQ ID NO: 430495 - DNA, 25 bp, Homo sapien
tcgggtcttttcttaccctctgtcg

SEQ ID NO: 430496 - DNA, 25 bp, Homo sapien
tgagccactgtgctgacctgtttcc

SEQ ID NO: 430497 - DNA, 25 bp, Homo sapien
taaacagctccttttaccactccct

SEQ ID NO: 430498 - DNA, 25 bp, Homo sapien
gctccttttaccactccctcaaagt

SEQ ID NO: 430499 - DNA, 25 bp, Homo sapien
ccctcaaagtttgttccattgggag

SEQ ID NO: 430500 - DNA, 25 bp, Homo sapien
ctcaaagtttgttccattgggaggg

SEQ ID NO: 430501 - DNA, 25 bp, Homo sapien
tcaaagtttgttccattgggagggt

SEQ ID NO: 430502 - DNA, 25 bp, Homo sapien
gtttgttccattgggagggtggaga

SEQ ID NO: 430503 - DNA, 25 bp, Homo sapien
aagaaaacagatataggattacacg

SEQ ID NO: 430504 - DNA, 25 bp, Homo sapien
acagatataggattacacgttgtat

SEQ ID NO: 430505 - DNA, 25 bp, Homo sapien
cagatataggattacacgttgtatc

SEQ ID NO: 430506 - DNA, 25 bp, Homo sapien
agatataggattacacgttgtatct

SEQ ID NO: 430507 - DNA, 25 bp, Homo sapien
tgtgaatctcaactggcccaattgt

SEQ ID NO: 430508 - DNA, 25 bp, Homo sapien
attgtctttcactgccatcatggga

SEQ ID NO: 430509 - DNA, 25 bp, Homo sapien
caaagtcaatcctctggctgtgcag

SEQ ID NO: 430510 - DNA, 25 bp, Homo sapien
gggattttctttctacaagcacaca

SEQ ID NO: 430511 - DNA, 25 bp, Homo sapien
aagcacacacaatacttcccatgtt

SEQ ID NO: 430512 - DNA, 25 bp, Homo sapien
atacttcccatgttttaagctatta

SEQ ID NO: 430513 - DNA, 25 bp, Homo sapien
gaagctgtgtgccaaaatctcacat

SEQ ID NO: 430514 - DNA, 25 bp, Homo sapien
aatctcacatttatcccatgttgaa

SEQ ID NO: 430515 - DNA, 25 bp, Homo sapien
gaaggttggataggcatttgtgcaa

SEQ ID NO: 430516 - DNA, 25 bp, Homo sapien
gaactatgaactctgcctactacat

SEQ ID NO: 430517 - DNA, 25 bp, Homo sapien
tgcctactacattatagtgctcagg

SEQ ID NO: 430518 - DNA, 25 bp, Homo sapien
gagctgagaggctttgtcctcgtgc

SEQ ID NO: 430519 - DNA, 25 bp, Homo sapien
gtcctcgtgccagtaactctgaaat

SEQ ID NO: 430520 - DNA, 25 bp, Homo sapien
gaaatctctcttaattcctgctgtc

SEQ ID NO: 430521 - DNA, 25 bp, Homo sapien
agaatgccatggtttccccaagtag

SEQ ID NO: 430522 - DNA, 25 bp, Homo sapien
tccccaagtaggtagctgctttagc

SEQ ID NO: 430523 - DNA, 25 bp, Homo sapien
gttaaagcccaaatgtctgttctgt

SEQ ID NO: 430524 - DNA, 25 bp, Homo sapien
gtctgttctgttgatcagaggtctc

SEQ ID NO: 430525 - DNA, 25 bp, Homo sapien
gaggtctctgaatttctgaagtggt

SEQ ID NO: 430526 - DNA, 25 bp, Homo sapien
gtttcgtttctggtgactgagttaa

SEQ ID NO: 430527 - DNA, 25 bp, Homo sapien
agttaatcctttacaatccctcttg

SEQ ID NO: 430528 - DNA, 25 bp, Homo sapien
caatccctcttgtaaagtgtgctaa

SEQ ID NO: 430529 - DNA, 25 bp, Homo sapien
ccatttcctttatcacactctgttc

SEQ ID NO: 430530 - DNA, 25 bp, Homo sapien
ctgcttctgtgaactttggattctc

SEQ ID NO: 430531 - DNA, 25 bp, Homo sapien
aactttggattctctgctctatttg

SEQ ID NO: 430532 - DNA, 25 bp, Homo sapien
gctctatttgagcattgttcagaag

SEQ ID NO: 430533 - DNA, 25 bp, Homo sapien
tttgagcattgttcagaagtcactg

SEQ ID NO: 430534 - DNA, 25 bp, Homo sapien
gagttgtcagaactatgtgttttct

SEQ ID NO: 430535 - DNA, 25 bp, Homo sapien
aactatgtgttttctgggtgcttca

SEQ ID NO: 430536 - DNA, 25 bp, Homo sapien
gggtgcttcatttcttatccaattc

SEQ ID NO: 430537 - DNA, 25 bp, Homo sapien
cttcatttcttatccaattctccta

SEQ ID NO: 430538 - DNA, 25 bp, Homo sapien
ccaattctcctaattccactgtaga

SEQ ID NO: 430539 - DNA, 25 bp, Homo sapien
cctaattccactgtagaagcttttt

SEQ ID NO: 430540 - DNA, 25 bp, Homo sapien
tactctcacaatattcaaattggtc

SEQ ID NO: 430541 - DNA, 25 bp, Homo sapien
ggtaattgaagcacattttccttta

SEQ ID NO: 430542 - DNA, 25 bp, Homo sapien
agggagcaggaatgtctcacccaca

SEQ ID NO: 430543 - DNA, 25 bp, Homo sapien
tcacccacacccttacaatagaaaa

SEQ ID NO: 430544 - DNA, 25 bp, Homo sapien
taacttttcttgaacccatcaggag

SEQ ID NO: 430545 - DNA, 25 bp, Homo sapien
gaacccatcaggagttgagcttacc

SEQ ID NO: 430546 - DNA, 25 bp, Homo sapien
atcaggagttgagcttaccaggcaa

SEQ ID NO: 430547 - DNA, 25 bp, Homo sapien
ggagttgagcttaccaggcaaacag

SEQ ID NO: 430548 - DNA, 25 bp, Homo sapien
caggcaaacagctaactggaaatct

SEQ ID NO: 430549 - DNA, 25 bp, Homo sapien
acagctaactggaaatctagagaga

SEQ ID NO: 430550 - DNA, 25 bp, Homo sapien
gaacacttgtttacttgaagcagaa

SEQ ID NO: 430551 - DNA, 25 bp, Homo sapien
ccctgtttttgattgaaatggagaa

SEQ ID NO: 430552 - DNA, 25 bp, Homo sapien
tgtagcgtttttgtgaaagcaaatt

SEQ ID NO: 430553 - DNA, 25 bp, Homo sapien
gagcaacccggagagaaattaacag

SEQ ID NO: 430554 - DNA, 25 bp, Homo sapien
ccaagttgacctgaagttctggtag

SEQ ID NO: 430555 - DNA, 25 bp, Homo sapien
agttctggtagtagaacatactggc

SEQ ID NO: 430556 - DNA, 25 bp, Homo sapien
ggccccaggagaggtctaactcaga

SEQ ID NO: 430557 - DNA, 25 bp, Homo sapien
gtattctaatgaagactactgataa

SEQ ID NO: 430558 - DNA, 25 bp, Homo sapien
gactactgataagacaaggtttaca

SEQ ID NO: 430559 - DNA, 25 bp, Homo sapien
tttggaaaagttacagactgctctt

SEQ ID NO: 430560 - DNA, 25 bp, Homo sapien
gttacagactgctcttagtgcctaa

SEQ ID NO: 430561 - DNA, 25 bp, Homo sapien
gactgctcttagtgcctaaaaaatt

SEQ ID NO: 430562 - DNA, 25 bp, Homo sapien
gaacccagaaatcattgtctagcaa

SEQ ID NO: 430563 - DNA, 25 bp, Homo sapien
atcattgtctagcaaaagccagtat

SEQ ID NO: 430564 - DNA, 25 bp, Homo sapien
gccagtatagtgattaattaccctg

SEQ ID NO: 430565 - DNA, 25 bp, Homo sapien
atattagaatgtccttagcgtgcag

SEQ ID NO: 430566 - DNA, 25 bp, Homo sapien
aatgtccttagcgtgcagagagcaa

SEQ ID NO: 430567 - DNA, 25 bp, Homo sapien
atcagacgctaaactactcatccag

SEQ ID NO: 430568 - DNA, 25 bp, Homo sapien
aaactactcatccagaattttgtca

SEQ ID NO: 430569 - DNA, 25 bp, Homo sapien
ggaagactcaacttgtactatcatt

SEQ ID NO: 430570 - DNA, 25 bp, Homo sapien
gtactatcattctatagactttatg

SEQ ID NO: 430571 - DNA, 25 bp, Homo sapien
gactttatgattgggtagactacat

SEQ ID NO: 430572 - DNA, 25 bp, Homo sapien
gactacatgagtattgaacccagaa

SEQ ID NO: 430573 - DNA, 25 bp, Homo sapien
tttcatgtctataggtctgtcattg

SEQ ID NO: 430574 - DNA, 25 bp, Homo sapien
catgtctataggtctgtcattgtcc

SEQ ID NO: 430575 - DNA, 25 bp, Homo sapien
gtctataggtctgtcattgtccttt

SEQ ID NO: 430576 - DNA, 25 bp, Homo sapien
ctataggtctgtcattgtccttttt

SEQ ID NO: 430577 - DNA, 25 bp, Homo sapien
ataggtctgtcattgtcctttttca

SEQ ID NO: 430578 - DNA, 25 bp, Homo sapien
taggtctgtcattgtcctttttcaa

SEQ ID NO: 430579 - DNA, 25 bp, Homo sapien
aggtctgtcattgtcctttttcaaa

SEQ ID NO: 430580 - DNA, 25 bp, Homo sapien
ggtctgtcattgtcctttttcaaag

SEQ ID NO: 430581 - DNA, 25 bp, Homo sapien
gtctgtcattgtcctttttcaaagc

SEQ ID NO: 430582 - DNA, 25 bp, Homo sapien
tctgtcattgtcctttttcaaagca

SEQ ID NO: 430583 - DNA, 25 bp, Homo sapien
ttgctctgggagaatgcattctaaa

SEQ ID NO: 430584 - DNA, 25 bp, Homo sapien
tggccactcctgtcctgtggattgt

SEQ ID NO: 430585 - DNA, 25 bp, Homo sapien
ccactcctgtcctgtggattgtgca

SEQ ID NO: 430586 - DNA, 25 bp, Homo sapien
aagaaaaggcatcaggctccccaag

SEQ ID NO: 430587 - DNA, 25 bp, Homo sapien
tttccaccaaagccaggtttcctgg

SEQ ID NO: 430588 - DNA, 25 bp, Homo sapien
caggtttcctggtaaggtcactcga

SEQ ID NO: 430589 - DNA, 25 bp, Homo sapien
tcctggtaaggtcactcgaagataa

SEQ ID NO: 430590 - DNA, 25 bp, Homo sapien
taaggtcactcgaagataagggatg

SEQ ID NO: 430591 - DNA, 25 bp, Homo sapien
attttagccccaggtctcagtacct

SEQ ID NO: 430592 - DNA, 25 bp, Homo sapien
agtagttttacattgccacagtgtg

SEQ ID NO: 430593 - DNA, 25 bp, Homo sapien
ttacattgccacagtgtgtatgtgt

SEQ ID NO: 430594 - DNA, 25 bp, Homo sapien
gtgttcactatataaaatgttcctc

SEQ ID NO: 430595 - DNA, 25 bp, Homo sapien
atatgtggaacaaactctcaacaaa

SEQ ID NO: 430596 - DNA, 25 bp, Homo sapien
atgtggaacaaactctcaacaaaat

SEQ ID NO: 430597 - DNA, 25 bp, Homo sapien
agatcagtttttccatccggattat

SEQ ID NO: 430598 - DNA, 25 bp, Homo sapien
gatcagtttttccatccggattatt

SEQ ID NO: 430599 - DNA, 25 bp, Homo sapien
atcagtttttccatccggattatta

SEQ ID NO: 430600 - DNA, 25 bp, Homo sapien
cagtttttccatccggattattatt

SEQ ID NO: 430601 - DNA, 25 bp, Homo sapien
tttccatccggattattattggttc

SEQ ID NO: 430602 - DNA, 25 bp, Homo sapien
ccatccggattattattggttcatg

SEQ ID NO: 430603 - DNA, 25 bp, Homo sapien
tccggattattattggttcatgatt

SEQ ID NO: 430604 - DNA, 25 bp, Homo sapien
tattggttcatgattttatatgtga

SEQ ID NO: 430605 - DNA, 25 bp, Homo sapien
gaatatgtaagatatgttctgcaat

SEQ ID NO: 430606 - DNA, 25 bp, Homo sapien
atacttgagaaagcagattcagaga

SEQ ID NO: 430607 - DNA, 25 bp, Homo sapien
ttgagaaagcagattcagagaagtt

SEQ ID NO: 430608 - DNA, 25 bp, Homo sapien
acgaaagtagtaagtagtaatgcca

SEQ ID NO: 430609 - DNA, 25 bp, Homo sapien
gaaagtagtaagtagtaatgccaga

SEQ ID NO: 430610 - DNA, 25 bp, Homo sapien
aagtagtaagtagtaatgccagagt

SEQ ID NO: 430611 - DNA, 25 bp, Homo sapien
agtagtaagtagtaatgccagagta

SEQ ID NO: 430612 - DNA, 25 bp, Homo sapien
gtagtaagtagtaatgccagagtac

SEQ ID NO: 430613 - DNA, 25 bp, Homo sapien
agtaagtagtaatgccagagtacaa

SEQ ID NO: 430614 - DNA, 25 bp, Homo sapien
tcttacagtgtgcaattttattcac

SEQ ID NO: 430615 - DNA, 25 bp, Homo sapien
cttacagtgtgcaattttattcacc

SEQ ID NO: 430616 - DNA, 25 bp, Homo sapien
cagtgtgcaattttattcaccccct

SEQ ID NO: 430617 - DNA, 25 bp, Homo sapien
gtgagctcattctttaacaaatcgc

SEQ ID NO: 430618 - DNA, 25 bp, Homo sapien
ttaacaaatcgctcctgtgcaggca

SEQ ID NO: 430619 - DNA, 25 bp, Homo sapien
aatcgctcctgtgcaggcattgaca

SEQ ID NO: 430620 - DNA, 25 bp, Homo sapien
caggcattgacagctgtgtcatgac

SEQ ID NO: 430621 - DNA, 25 bp, Homo sapien
gtgtcatgacagctgcctgaccata

SEQ ID NO: 430622 - DNA, 25 bp, Homo sapien
gatactgtcactttcatgatgttaa

SEQ ID NO: 430623 - DNA, 25 bp, Homo sapien
gacagctgcctgaccatagtaaggt

SEQ ID NO: 430624 - DNA, 25 bp, Homo sapien
aaatgcattccagttttcagagatg

SEQ ID NO: 430625 - DNA, 25 bp, Homo sapien
catgatgttaaccaatatcacgaaa

SEQ ID NO: 430626 - DNA, 25 bp, Homo sapien
tttcatcaggaaaagcaactcagtc

SEQ ID NO: 430627 - DNA, 25 bp, Homo sapien
gagtttttcagtgagctcattcttt

SEQ ID NO: 430628 - DNA, 25 bp, Homo sapien
aaaagactgatttcaactgctgatt

SEQ ID NO: 430629 - DNA, 25 bp, Homo sapien
gactgatttcaactgctgatttaac

SEQ ID NO: 430630 - DNA, 25 bp, Homo sapien
agtgttaggcactactctagaagat

SEQ ID NO: 430631 - DNA, 25 bp, Homo sapien
ggcactactctagaagatgtgacta

SEQ ID NO: 430632 - DNA, 25 bp, Homo sapien
ataagccagaataaatgatcacatg

SEQ ID NO: 430633 - DNA, 25 bp, Homo sapien
tcacatggtgacaactgctatgctg

SEQ ID NO: 430634 - DNA, 25 bp, Homo sapien
catggtgacaactgctatgctgaga

SEQ ID NO: 430635 - DNA, 25 bp, Homo sapien
tcaacagtgactgggtatctagatt

SEQ ID NO: 430636 - DNA, 25 bp, Homo sapien
actgggtatctagattgtgcggtca

SEQ ID NO: 430637 - DNA, 25 bp, Homo sapien
gattgtgcggtcagagatggcctct

SEQ ID NO: 430638 - DNA, 25 bp, Homo sapien
gcggtcagagatggcctctctaaaa

SEQ ID NO: 430639 - DNA, 25 bp, Homo sapien
ttgcatcaatctaaggcaggaatca

SEQ ID NO: 430640 - DNA, 25 bp, Homo sapien
gcatcaatctaaggcaggaatcagc

SEQ ID NO: 430641 - DNA, 25 bp, Homo sapien
atcaatctaaggcaggaatcagctg

SEQ ID NO: 430642 - DNA, 25 bp, Homo sapien
caatctaaggcaggaatcagctggt

SEQ ID NO: 430643 - DNA, 25 bp, Homo sapien
atctaaggcaggaatcagctggtaa

SEQ ID NO: 430644 - DNA, 25 bp, Homo sapien
ctaaggcaggaatcagctggtaaga

SEQ ID NO: 430645 - DNA, 25 bp, Homo sapien
aaggcaggaatcagctggtaagagc

SEQ ID NO: 430646 - DNA, 25 bp, Homo sapien
gcaggaatcagctggtaagagcata

SEQ ID NO: 430647 - DNA, 25 bp, Homo sapien
gaatcagctggtaagagcatagact

SEQ ID NO: 430648 - DNA, 25 bp, Homo sapien
atcagctggtaagagcatagactgg

SEQ ID NO: 430649 - DNA, 25 bp, Homo sapien
aagagcatagactggccaggtgcag

SEQ ID NO: 430650 - DNA, 25 bp, Homo sapien
gtttgatggacccttggcttgatac

SEQ ID NO: 430651 - DNA, 25 bp, Homo sapien
ggacccttggcttgatacagttttg

SEQ ID NO: 430652 - DNA, 25 bp, Homo sapien
ggcttgatacagttttgatttctaa

SEQ ID NO: 430653 - DNA, 25 bp, Homo sapien
aaatgatgattgtgctgggtttgaa

SEQ ID NO: 430654 - DNA, 25 bp, Homo sapien
aactgtttggctgtagtggagtgac

SEQ ID NO: 430655 - DNA, 25 bp, Homo sapien
gaactcctagagttacatagtagaa

SEQ ID NO: 430656 - DNA, 25 bp, Homo sapien
gtagaattctagatcgtcaagacta

SEQ ID NO: 430657 - DNA, 25 bp, Homo sapien
tcgtcaagactatagcattcccctg

SEQ ID NO: 430658 - DNA, 25 bp, Homo sapien
attttttccatgcttgccaactgca

SEQ ID NO: 430659 - DNA, 25 bp, Homo sapien
tgccaactgcagtagaatttttcta

SEQ ID NO: 430660 - DNA, 25 bp, Homo sapien
aaaggtgcacggtttgatggaccct

SEQ ID NO: 430661 - DNA, 25 bp, Homo sapien
atagaccaaggtaaaaatctcaaag

SEQ ID NO: 430662 - DNA, 25 bp, Homo sapien
gagacttgtaatgagaatgccacaa

SEQ ID NO: 430663 - DNA, 25 bp, Homo sapien
gaatgccacaaacttgaatacctta

SEQ ID NO: 430664 - DNA, 25 bp, Homo sapien
aaacttgaataccttatgcacaaaa

SEQ ID NO: 430665 - DNA, 25 bp, Homo sapien
gtacatgaaccctgaaacaaagata

SEQ ID NO: 430666 - DNA, 25 bp, Homo sapien
agataatgatttggaccacccaact

SEQ ID NO: 430667 - DNA, 25 bp, Homo sapien
ttggaccacccaactgaagtggcat

SEQ ID NO: 430668 - DNA, 25 bp, Homo sapien
cacccaactgaagtggcatgttatg

SEQ ID NO: 430669 - DNA, 25 bp, Homo sapien
agctataacgctttgcaatttcagt

SEQ ID NO: 430670 - DNA, 25 bp, Homo sapien
gcaatttcagtaacagttctgcctc

SEQ ID NO: 430671 - DNA, 25 bp, Homo sapien
tttcagtaacagttctgcctctgat

SEQ ID NO: 430672 - DNA, 25 bp, Homo sapien
gggctaaaatttgttgataacactt

SEQ ID NO: 430673 - DNA, 25 bp, Homo sapien
gttgataacactttaacatataact

SEQ ID NO: 430674 - DNA, 25 bp, Homo sapien
agacaccaccatgttttattccaag

SEQ ID NO: 430675 - DNA, 25 bp, Homo sapien
gatcaatagaggagattccaaactg

SEQ ID NO: 430676 - DNA, 25 bp, Homo sapien
aaactgaatatttggacttccagag

SEQ ID NO: 430677 - DNA, 25 bp, Homo sapien
atgttttattccaagatcctgggca

SEQ ID NO: 430678 - DNA, 25 bp, Homo sapien
agataactttgcagtctctacatgg

SEQ ID NO: 430679 - DNA, 25 bp, Homo sapien
aactttgcagtctctacatggaaaa

SEQ ID NO: 430680 - DNA, 25 bp, Homo sapien
atcctgggcatggaggtcatgactt

SEQ ID NO: 430681 - DNA, 25 bp, Homo sapien
catgacttttaaggtaagcacttcc

SEQ ID NO: 430682 - DNA, 25 bp, Homo sapien
aaatgccaaaattcaggtgggctaa

SEQ ID NO: 430683 - DNA, 25 bp, Homo sapien
gagtatggcttttgtcttccatctt

SEQ ID NO: 430684 - DNA, 25 bp, Homo sapien
cttccatcttgctcagggtactttg

SEQ ID NO: 430685 - DNA, 25 bp, Homo sapien
gggtactttggaaccgctatacatt

SEQ ID NO: 430686 - DNA, 25 bp, Homo sapien
accgctatacattgcaggagcttag

SEQ ID NO: 430687 - DNA, 25 bp, Homo sapien
ggagcttagcttctggttaccatgg

SEQ ID NO: 430688 - DNA, 25 bp, Homo sapien
gttaccatggtttgcttccagagca

SEQ ID NO: 430689 - DNA, 25 bp, Homo sapien
gagcaacaagcctagtacttcaaca

SEQ ID NO: 430690 - DNA, 25 bp, Homo sapien
ggtggtagttcttttttgtcagact

SEQ ID NO: 430691 - DNA, 25 bp, Homo sapien
ttggccatgcctttttgagtttacc

SEQ ID NO: 430692 - DNA, 25 bp, Homo sapien
gtttgtgggtagctccattctagtc

SEQ ID NO: 430693 - DNA, 25 bp, Homo sapien
ctagtcctgggctttaatctgtgag

SEQ ID NO: 430694 - DNA, 25 bp, Homo sapien
gagagaagcctcagaacctttaaat

SEQ ID NO: 430695 - DNA, 25 bp, Homo sapien
gaagcctcagaacctttaaattgaa

SEQ ID NO: 430696 - DNA, 25 bp, Homo sapien
gagatattttacagtgtggtacact

SEQ ID NO: 430697 - DNA, 25 bp, Homo sapien
agtgtggtacactcctaacacaaaa

SEQ ID NO: 430698 - DNA, 25 bp, Homo sapien
aaaaaggactggacatagttgcaca

SEQ ID NO: 430699 - DNA, 25 bp, Homo sapien
ctggacatagttgcacaggtttatg

SEQ ID NO: 430700 - DNA, 25 bp, Homo sapien
attatattgaatgaccacatgcacc

SEQ ID NO: 430701 - DNA, 25 bp, Homo sapien
gcacctgtaaacacattgagcaaat

SEQ ID NO: 430702 - DNA, 25 bp, Homo sapien
tctgtattcctagtgctaagtgatt

SEQ ID NO: 430703 - DNA, 25 bp, Homo sapien
tcctagtgctaagtgattcaaattg

SEQ ID NO: 430704 - DNA, 25 bp, Homo sapien
gtatcattgattttctgtaaaacca

SEQ ID NO: 430705 - DNA, 25 bp, Homo sapien
ggccaatttcaccaacgaacgttga

SEQ ID NO: 430706 - DNA, 25 bp, Homo sapien
ttctactaagtagcccagttttcca

SEQ ID NO: 430707 - DNA, 25 bp, Homo sapien
gtagcccagttttccaatcacatga

SEQ ID NO: 430708 - DNA, 25 bp, Homo sapien
gttttccaatcacatgaattttctg

SEQ ID NO: 430709 - DNA, 25 bp, Homo sapien
tttaccccagatatagacaaagtta

SEQ ID NO: 430710 - DNA, 25 bp, Homo sapien
gaacgttgaattgaccaaacatgta

SEQ ID NO: 430711 - DNA, 25 bp, Homo sapien
aacatgtactaagtgcattctgcag

SEQ ID NO: 430712 - DNA, 25 bp, Homo sapien
gtgcattctgcagacataacggaga

SEQ ID NO: 430713 - DNA, 25 bp, Homo sapien
cataacggagactgaattttggaga

SEQ ID NO: 430714 - DNA, 25 bp, Homo sapien
gagatctttgcttcccaaagaatcc

SEQ ID NO: 430715 - DNA, 25 bp, Homo sapien
ctttgcttcccaaagaatcccctga

SEQ ID NO: 430716 - DNA, 25 bp, Homo sapien
gggaattcaaggcaattacaccgaa

SEQ ID NO: 430717 - DNA, 25 bp, Homo sapien
ggcaattacaccgaaagaggtccga

SEQ ID NO: 430718 - DNA, 25 bp, Homo sapien
aagaggtccgagtaagtgtccctga

SEQ ID NO: 430719 - DNA, 25 bp, Homo sapien
ggtccgagtaagtgtccctgagaga

SEQ ID NO: 430720 - DNA, 25 bp, Homo sapien
agtgtccctgagagagacgaggcac

SEQ ID NO: 430721 - DNA, 25 bp, Homo sapien
gtcagggtgcccaagcactgcggaa

SEQ ID NO: 430722 - DNA, 25 bp, Homo sapien
gcactgcggaagagcttttctacac

SEQ ID NO: 430723 - DNA, 25 bp, Homo sapien
gcttttctacacgaaggctcttgga

SEQ ID NO: 430724 - DNA, 25 bp, Homo sapien
aaggctcttggagccggagcgccca

SEQ ID NO: 430725 - DNA, 25 bp, Homo sapien
acgggctgggacttgcctgagtcac

SEQ ID NO: 430726 - DNA, 25 bp, Homo sapien
tttaagttacaagacctgggaggtg

SEQ ID NO: 430727 - DNA, 25 bp, Homo sapien
tccacatcgaagaccagcccctggg

SEQ ID NO: 430728 - DNA, 25 bp, Homo sapien
gggctcagacaacttcaggcctgtc

SEQ ID NO: 430729 - DNA, 25 bp, Homo sapien
aggcctgtccccaggtctccagaga

SEQ ID NO: 430730 - DNA, 25 bp, Homo sapien
aggtctccagagaaccctcccattc

SEQ ID NO: 430731 - DNA, 25 bp, Homo sapien
attccatcgctgtcttcccaaagtg

SEQ ID NO: 430732 - DNA, 25 bp, Homo sapien
tgcgcccggccaaatgtgggtttta

SEQ ID NO: 430733 - DNA, 25 bp, Homo sapien
atttgggaacgtggctgacccagca

SEQ ID NO: 430734 - DNA, 25 bp, Homo sapien
gaacgtggctgacccagcaatggaa

SEQ ID NO: 430735 - DNA, 25 bp, Homo sapien
gctgacccagcaatggaattactat

SEQ ID NO: 430736 - DNA, 25 bp, Homo sapien
caatggaattactatgtgagcccga

SEQ ID NO: 430737 - DNA, 25 bp, Homo sapien
tggaattactatgtgagcccgaggg

SEQ ID NO: 430738 - DNA, 25 bp, Homo sapien
tttcatgtctataggtctgtcattg

SEQ ID NO: 430739 - DNA, 25 bp, Homo sapien
ggtctgtcattgtcctttttcaaag

SEQ ID NO: 430740 - DNA, 25 bp, Homo sapien
ataaacttataaatttgctctggga

SEQ ID NO: 430741 - DNA, 25 bp, Homo sapien
tttgctctgggagaatgcattctaa

SEQ ID NO: 430742 - DNA, 25 bp, Homo sapien
attatatatagtgttcagtcccatg

SEQ ID NO: 430743 - DNA, 25 bp, Homo sapien
tatatatagtgttcagtcccatggg

SEQ ID NO: 430744 - DNA, 25 bp, Homo sapien
atatatagtgttcagtcccatgggt

SEQ ID NO: 430745 - DNA, 25 bp, Homo sapien
tatatagtgttcagtcccatgggtg

SEQ ID NO: 430746 - DNA, 25 bp, Homo sapien
atatagtgttcagtcccatgggtgg

SEQ ID NO: 430747 - DNA, 25 bp, Homo sapien
tatagtgttcagtcccatgggtggt

SEQ ID NO: 430748 - DNA, 25 bp, Homo sapien
gttcagtcccatgggtggtgtcata

SEQ ID NO: 430749 - DNA, 25 bp, Homo sapien
tactttactatctttcttctctacc

SEQ ID NO: 430750 - DNA, 25 bp, Homo sapien
tttactatctttcttctctacctta

SEQ ID NO: 430751 - DNA, 25 bp, Homo sapien
actatctttcttctctaccttacta

SEQ ID NO: 430752 - DNA, 25 bp, Homo sapien
tctttcttctctaccttactattat

SEQ ID NO: 430753 - DNA, 25 bp, Homo sapien
tcttctctaccttactattattttc

SEQ ID NO: 430754 - DNA, 25 bp, Homo sapien
accttactattattttcttacacat

SEQ ID NO: 430755 - DNA, 25 bp, Homo sapien
tgtattgaaagaagcctactctcat

SEQ ID NO: 430756 - DNA, 25 bp, Homo sapien
gaaagaagcctactctcataattta

SEQ ID NO: 430757 - DNA, 25 bp, Homo sapien
gaagcctactctcataatttatggg

SEQ ID NO: 430758 - DNA, 25 bp, Homo sapien
atttatgggatggtgcaaggaaaac

SEQ ID NO: 430759 - DNA, 25 bp, Homo sapien
gatggtgcaaggaaaacagtggcaa

SEQ ID NO: 430760 - DNA, 25 bp, Homo sapien
tgtttctcctttcagttctatcaaa

SEQ ID NO: 430761 - DNA, 25 bp, Homo sapien
ggattgctgtattttcttgaagaat

SEQ ID NO: 430762 - DNA, 25 bp, Homo sapien
taaccccttttttatgatgagatac

SEQ ID NO: 430763 - DNA, 25 bp, Homo sapien
gatgagatacctctctgtgttcttg

SEQ ID NO: 430764 - DNA, 25 bp, Homo sapien
gatacctctctgtgttcttgataat

SEQ ID NO: 430765 - DNA, 25 bp, Homo sapien
gtgttcttgataatatggtccatgt

SEQ ID NO: 430766 - DNA, 25 bp, Homo sapien
ggtccatgttcttaagtttactttg

SEQ ID NO: 430767 - DNA, 25 bp, Homo sapien
ctttgtctaacattggtataaccac

SEQ ID NO: 430768 - DNA, 25 bp, Homo sapien
ggtataaccacttaagctctatttc

SEQ ID NO: 430769 - DNA, 25 bp, Homo sapien
accacttaagctctatttcattgtt

SEQ ID NO: 430770 - DNA, 25 bp, Homo sapien
tttcattgtttcagagtatcacttg

SEQ ID NO: 430771 - DNA, 25 bp, Homo sapien
gcacaagatctatgtaaagtgttta

SEQ ID NO: 430772 - DNA, 25 bp, Homo sapien
atacattggaatatgagacttgaac

SEQ ID NO: 430773 - DNA, 25 bp, Homo sapien
atatgagacttgaacattttgaaga

SEQ ID NO: 430774 - DNA, 25 bp, Homo sapien
ttttatcctcatgtttacatttaac

SEQ ID NO: 430775 - DNA, 25 bp, Homo sapien
gggagagtggtatcaaccactaaga

SEQ ID NO: 430776 - DNA, 25 bp, Homo sapien
ggtatcaaccactaagaggattaaa

SEQ ID NO: 430777 - DNA, 25 bp, Homo sapien
atatttgtaaaacacgtagcctaga

SEQ ID NO: 430778 - DNA, 25 bp, Homo sapien
tttgtaaaacacgtagcctagaata

SEQ ID NO: 430779 - DNA, 25 bp, Homo sapien
gtaaaacacgtagcctagaatagat

SEQ ID NO: 430780 - DNA, 25 bp, Homo sapien
acacgtagcctagaatagatattta

SEQ ID NO: 430781 - DNA, 25 bp, Homo sapien
gatatttataaagcacaagatctat

SEQ ID NO: 430782 - DNA, 25 bp, Homo sapien
acatgagctggtgaatacctgatga

SEQ ID NO: 430783 - DNA, 25 bp, Homo sapien
agtacagatagctcttgacttacga

SEQ ID NO: 430784 - DNA, 25 bp, Homo sapien
ataggctttgtcttggataattttc

SEQ ID NO: 430785 - DNA, 25 bp, Homo sapien
gataattttccccaactataagcta

SEQ ID NO: 430786 - DNA, 25 bp, Homo sapien
ataagctaatgtaagtcttctgaat

SEQ ID NO: 430787 - DNA, 25 bp, Homo sapien
atagctcttgacttacgatggtgca

SEQ ID NO: 430788 - DNA, 25 bp, Homo sapien
aagctatgatgtttgccaggttagt

SEQ ID NO: 430789 - DNA, 25 bp, Homo sapien
tgacttacgatggtgcaactttagg

SEQ ID NO: 430790 - DNA, 25 bp, Homo sapien
tacccatacaaccatgccgtttgtc

SEQ ID NO: 430791 - DNA, 25 bp, Homo sapien
accatgccgtttgtcagtttcagta

SEQ ID NO: 430792 - DNA, 25 bp, Homo sapien
gccgtttgtcagtttcagtacagta

SEQ ID NO: 430793 - DNA, 25 bp, Homo sapien
cgacttgaggttcgcgaagggcacg

SEQ ID NO: 430794 - DNA, 25 bp, Homo sapien
gaggttcgcgaagggcacgtcgacc

SEQ ID NO: 430795 - DNA, 25 bp, Homo sapien
gtgggagcaaaaccaacgcctggct

SEQ ID NO: 430796 - DNA, 25 bp, Homo sapien
aaaaccaacgcctggctcggagcag

SEQ ID NO: 430797 - DNA, 25 bp, Homo sapien
ggacgggcgggtcggtgagctcctc

SEQ ID NO: 430798 - DNA, 25 bp, Homo sapien
gggcgggtcggtgagctcctcgcac

SEQ ID NO: 430799 - DNA, 25 bp, Homo sapien
ctcggagcagcagcctctgaggtga

SEQ ID NO: 430800 - DNA, 25 bp, Homo sapien
gcagcctctgaggtgagggcgaggg

SEQ ID NO: 430801 - DNA, 25 bp, Homo sapien
cggtgtgggccgcagagacgttgga

SEQ ID NO: 430802 - DNA, 25 bp, Homo sapien
tgtgggccgcagagacgttggagcc

SEQ ID NO: 430803 - DNA, 25 bp, Homo sapien
gccgcagagacgttggagccggcgg

SEQ ID NO: 430804 - DNA, 25 bp, Homo sapien
gtttgtaattctataccatgcacta

SEQ ID NO: 430805 - DNA, 25 bp, Homo sapien
ataccatgcactagcaatgatcact

SEQ ID NO: 430806 - DNA, 25 bp, Homo sapien
aaacaggctactacacagataatat

SEQ ID NO: 430807 - DNA, 25 bp, Homo sapien
taatttctacagtaattccacttcc

SEQ ID NO: 430808 - DNA, 25 bp, Homo sapien
aaattactggatttcaagtgaccga

SEQ ID NO: 430809 - DNA, 25 bp, Homo sapien
atagtgataactttgactttgtcaa

SEQ ID NO: 430810 - DNA, 25 bp, Homo sapien
tgactttgtcaagtttcacacatcg

SEQ ID NO: 430811 - DNA, 25 bp, Homo sapien
ggccatgatttgagccagggcagtc

SEQ ID NO: 430812 - DNA, 25 bp, Homo sapien
ccagggcagtctgactctgaatttg

SEQ ID NO: 430813 - DNA, 25 bp, Homo sapien
gaacagtgtttaattgccaggaaca

SEQ ID NO: 430814 - DNA, 25 bp, Homo sapien
attgccaggaacaaaccacagggaa

SEQ ID NO: 430815 - DNA, 25 bp, Homo sapien
gttttgatattcaatctgcatattc

SEQ ID NO: 430816 - DNA, 25 bp, Homo sapien
gatattcaatctgcatattcaaaat

SEQ ID NO: 430817 - DNA, 25 bp, Homo sapien
tcaaaatgcaaagtatcaaaaccag

SEQ ID NO: 430818 - DNA, 25 bp, Homo sapien
aatagtgtaggagcttatatctgtg

SEQ ID NO: 430819 - DNA, 25 bp, Homo sapien
agtgtttagattgacataatccaac

SEQ ID NO: 430820 - DNA, 25 bp, Homo sapien
agtgtaggagcttatatctgtgttc

SEQ ID NO: 430821 - DNA, 25 bp, Homo sapien
gtgtaggagcttatatctgtgttcc

SEQ ID NO: 430822 - DNA, 25 bp, Homo sapien
gtaggagcttatatctgtgttccat

SEQ ID NO: 430823 - DNA, 25 bp, Homo sapien
taggagcttatatctgtgttccata

SEQ ID NO: 430824 - DNA, 25 bp, Homo sapien
tagattgacataatccaacattcaa

SEQ ID NO: 430825 - DNA, 25 bp, Homo sapien
gacataatccaacattcaattttta

SEQ ID NO: 430826 - DNA, 25 bp, Homo sapien
gtgggtgaatcagggagccgggagc

SEQ ID NO: 430827 - DNA, 25 bp, Homo sapien
gggtgaatcagggagccgggagccc

SEQ ID NO: 430828 - DNA, 25 bp, Homo sapien
ggtgaatcagggagccgggagcccc

SEQ ID NO: 430829 - DNA, 25 bp, Homo sapien
gtgaatcagggagccgggagccccg

SEQ ID NO: 430830 - DNA, 25 bp, Homo sapien
tgaatcagggagccgggagccccgc

SEQ ID NO: 430831 - DNA, 25 bp, Homo sapien
gccccagctggctccattgctgagg

SEQ ID NO: 430832 - DNA, 25 bp, Homo sapien
ggggcggggcagaccccagtgcttc

SEQ ID NO: 430833 - DNA, 25 bp, Homo sapien
agcagctcagactcacccagggtga

SEQ ID NO: 430834 - DNA, 25 bp, Homo sapien
gcagctcagactcacccagggtgac

SEQ ID NO: 430835 - DNA, 25 bp, Homo sapien
agctcagactcacccagggtgacca

SEQ ID NO: 430836 - DNA, 25 bp, Homo sapien
tcagactcacccagggtgaccacca

SEQ ID NO: 430837 - DNA, 25 bp, Homo sapien
atatgtggaacaaactctcaacaaa

SEQ ID NO: 430838 - DNA, 25 bp, Homo sapien
atgtggaacaaactctcaacaaaat

SEQ ID NO: 430839 - DNA, 25 bp, Homo sapien
agatcagtttttccatccggattat

SEQ ID NO: 430840 - DNA, 25 bp, Homo sapien
tcagtttttccatccggattattat

SEQ ID NO: 430841 - DNA, 25 bp, Homo sapien
tttccatccggattattattggttc

SEQ ID NO: 430842 - DNA, 25 bp, Homo sapien
ccatccggattattattggttcatg

SEQ ID NO: 430843 - DNA, 25 bp, Homo sapien
tccggattattattggttcatgatt

SEQ ID NO: 430844 - DNA, 25 bp, Homo sapien
tattggttcatgattttatatgtga

SEQ ID NO: 430845 - DNA, 25 bp, Homo sapien
gaatatgtaagatatgttctgcaat

SEQ ID NO: 430846 - DNA, 25 bp, Homo sapien
gtaagatatgttctgcaattttata

SEQ ID NO: 430847 - DNA, 25 bp, Homo sapien
gaaattctgtgtctccagcaggcaa

SEQ ID NO: 430848 - DNA, 25 bp, Homo sapien
aaagagatctttttaccagtgttat

SEQ ID NO: 430849 - DNA, 25 bp, Homo sapien
gagatctttttaccagtgttatcgt

SEQ ID NO: 430850 - DNA, 25 bp, Homo sapien
tttttaccagtgttatcgtttctag

SEQ ID NO: 430851 - DNA, 25 bp, Homo sapien
ttaccagtgttatcgtttctagtct

SEQ ID NO: 430852 - DNA, 25 bp, Homo sapien
aaatctgtctctaaggagataacac

SEQ ID NO: 430853 - DNA, 25 bp, Homo sapien
ggagataacacattagtatattttc

SEQ ID NO: 430854 - DNA, 25 bp, Homo sapien
gtatattttctacactattgaagcc

SEQ ID NO: 430855 - DNA, 25 bp, Homo sapien
tctacactattgaagcctctaccta

SEQ ID NO: 430856 - DNA, 25 bp, Homo sapien
tacactattgaagcctctacctaat

SEQ ID NO: 430857 - DNA, 25 bp, Homo sapien
ctattgaagcctctacctaatgtat

SEQ ID NO: 430858 - DNA, 25 bp, Homo sapien
gaagcctctacctaatgtatgactt

SEQ ID NO: 430859 - DNA, 25 bp, Homo sapien
tatctgttgttatgccagcaccaca

SEQ ID NO: 430860 - DNA, 25 bp, Homo sapien
atgaaagtcctctagctttgctctt

SEQ ID NO: 430861 - DNA, 25 bp, Homo sapien
ttggctattctaggtcccatgaagc

SEQ ID NO: 430862 - DNA, 25 bp, Homo sapien
gtcccatgaagcttgcaaggctttt

SEQ ID NO: 430863 - DNA, 25 bp, Homo sapien
ggcttttgaaggaccagctatcttt

SEQ ID NO: 430864 - DNA, 25 bp, Homo sapien
tgcctggttccagagtctatctgca

SEQ ID NO: 430865 - DNA, 25 bp, Homo sapien
tctatctgcaggctgagcatctgag

SEQ ID NO: 430866 - DNA, 25 bp, Homo sapien
ctgagcatctgagggtggcttgcac

SEQ ID NO: 430867 - DNA, 25 bp, Homo sapien
agggtttatttatggactctcaatt

SEQ ID NO: 430868 - DNA, 25 bp, Homo sapien
ggactctcaatttgattccactgat

SEQ ID NO: 430869 - DNA, 25 bp, Homo sapien
gattccactgatctatatatctgtt

SEQ ID NO: 430870 - DNA, 25 bp, Homo sapien
tgatcacgtcgacctagcaagcgag

SEQ ID NO: 430871 - DNA, 25 bp, Homo sapien
acgtcgacctagcaagcgagcgcac

SEQ ID NO: 430872 - DNA, 25 bp, Homo sapien
gacctagcaagcgagcgcacgctgg

SEQ ID NO: 430873 - DNA, 25 bp, Homo sapien
cgcacgctggagaaaacgctgggat

SEQ ID NO: 430874 - DNA, 25 bp, Homo sapien
acgctggagaaaacgctgggatcaa

SEQ ID NO: 430875 - DNA, 25 bp, Homo sapien
gaaaacgctgggatcaacacgcatc

SEQ ID NO: 430876 - DNA, 25 bp, Homo sapien
aacgctgggatcaacacgcatctgc

SEQ ID NO: 430877 - DNA, 25 bp, Homo sapien
gggatcaacacgcatctgccaggcc

SEQ ID NO: 430878 - DNA, 25 bp, Homo sapien
gcactgctggaaaggccgggaacct

SEQ ID NO: 430879 - DNA, 25 bp, Homo sapien
catccctcttttgggaacttggcag

SEQ ID NO: 430880 - DNA, 25 bp, Homo sapien
ctcttttgggaacttggcaggcaat

SEQ ID NO: 430881 - DNA, 25 bp, Homo sapien
atgcaatacaccctatcagcaaatt

SEQ ID NO: 430882 - DNA, 25 bp, Homo sapien
aagacagttttctaccagcatgaga

SEQ ID NO: 430883 - DNA, 25 bp, Homo sapien
taggtgtggacgacaggaactttat

SEQ ID NO: 430884 - DNA, 25 bp, Homo sapien
gtacatgccattgctgtttaacagt

SEQ ID NO: 430885 - DNA, 25 bp, Homo sapien
gctgtttaacagtgttgggttcata

SEQ ID NO: 430886 - DNA, 25 bp, Homo sapien
tcataacaggtgattagacagtctt

SEQ ID NO: 430887 - DNA, 25 bp, Homo sapien
agacagtcttgttgatagtttggag

SEQ ID NO: 430888 - DNA, 25 bp, Homo sapien
gagaaccatcttaatcatgacctag

SEQ ID NO: 430889 - DNA, 25 bp, Homo sapien
gaactgaaacacgatagcatgcctt

SEQ ID NO: 430890 - DNA, 25 bp, Homo sapien
gatagcatgccttttatggcgaaat

SEQ ID NO: 430891 - DNA, 25 bp, Homo sapien
atggcgaaatgtgtttgaacttcaa

SEQ ID NO: 430892 - DNA, 25 bp, Homo sapien
tccccaatactggatgcatgtaatg

SEQ ID NO: 430893 - DNA, 25 bp, Homo sapien
tactggatgcatgtaatgtaaaaca

SEQ ID NO: 430894 - DNA, 25 bp, Homo sapien
cctagtgccaacaaagaaacatcat

SEQ ID NO: 430895 - DNA, 25 bp, Homo sapien
gaaacatcatctttttcagggcctg

SEQ ID NO: 430896 - DNA, 25 bp, Homo sapien
tgtcaggccctaatcctaaaggcct

SEQ ID NO: 430897 - DNA, 25 bp, Homo sapien
gccctaatcctaaaggcctagatat

SEQ ID NO: 430898 - DNA, 25 bp, Homo sapien
ttatattcgataaagtgtggtcctc

SEQ ID NO: 430899 - DNA, 25 bp, Homo sapien
attcgataaagtgtggtcctcttat

SEQ ID NO: 430900 - DNA, 25 bp, Homo sapien
cgataaagtgtggtcctcttattta

SEQ ID NO: 430901 - DNA, 25 bp, Homo sapien
ataaagtgtggtcctcttatttatt

SEQ ID NO: 430902 - DNA, 25 bp, Homo sapien
cggtaacccaacacagttgtgtttg

SEQ ID NO: 430903 - DNA, 25 bp, Homo sapien
tttgttgccaaagggcgccgcaaag

SEQ ID NO: 430904 - DNA, 25 bp, Homo sapien
gcgccgcaaagcagaggctgagaat

SEQ ID NO: 430905 - DNA, 25 bp, Homo sapien
aaggcggcagccttggcctgcaaga

SEQ ID NO: 430906 - DNA, 25 bp, Homo sapien
gtggacaggaacaacgaaccgctta

SEQ ID NO: 430907 - DNA, 25 bp, Homo sapien
aggaacaacgaaccgcttacacacg

SEQ ID NO: 430908 - DNA, 25 bp, Homo sapien
acacggttacggagccgatggctga

SEQ ID NO: 430909 - DNA, 25 bp, Homo sapien
gagccgatggctgacgtatttcatg

SEQ ID NO: 430910 - DNA, 25 bp, Homo sapien
gtatttcatggcagtcaagtccaat

SEQ ID NO: 430911 - DNA, 25 bp, Homo sapien
caagtccaatggcagcgtcttcgtc

SEQ ID NO: 430912 - DNA, 25 bp, Homo sapien
aggtgcacccgctagctgtgctgct

SEQ ID NO: 430913 - DNA, 25 bp, Homo sapien
acgtgcacatccgtgatgacgggcg

SEQ ID NO: 430914 - DNA, 25 bp, Homo sapien
ttctgtgtaatataaccagctgcca

SEQ ID NO: 430915 - DNA, 25 bp, Homo sapien
gtgtaatataaccagctgccatact

SEQ ID NO: 430916 - DNA, 25 bp, Homo sapien
tgtaatataaccagctgccatactt

SEQ ID NO: 430917 - DNA, 25 bp, Homo sapien
tatgcagggcttatgaatgcttttg

SEQ ID NO: 430918 - DNA, 25 bp, Homo sapien
cagggcttatgaatgcttttggtaa

SEQ ID NO: 430919 - DNA, 25 bp, Homo sapien
atgcttttggtaaggcagatctgtc

SEQ ID NO: 430920 - DNA, 25 bp, Homo sapien
gcagatctgtctttggggagttcaa

SEQ ID NO: 430921 - DNA, 25 bp, Homo sapien
ctatgattaccctcatgcctatcac

SEQ ID NO: 430922 - DNA, 25 bp, Homo sapien
aatatttcagaccatagtagcagat

SEQ ID NO: 430923 - DNA, 25 bp, Homo sapien
tttcagaccatagtagcagatttag

SEQ ID NO: 430924 - DNA, 25 bp, Homo sapien
gaccatagtagcagatttagaaaag

SEQ ID NO: 430925 - DNA, 25 bp, Homo sapien
agacatttaagtcactcagattctg

SEQ ID NO: 430926 - DNA, 25 bp, Homo sapien
gattctgaaggtaccccaaaaccag

SEQ ID NO: 430927 - DNA, 25 bp, Homo sapien
ccttttcctctttactgatcatcga

SEQ ID NO: 430928 - DNA, 25 bp, Homo sapien
gatcatcgagccaaggaaaagccac

SEQ ID NO: 430929 - DNA, 25 bp, Homo sapien
actggaagggacttgggctcacact

SEQ ID NO: 430930 - DNA, 25 bp, Homo sapien
ggacttgggctcacacttacaaata

SEQ ID NO: 430931 - DNA, 25 bp, Homo sapien
caaatagctggcttgcatggaaggc

SEQ ID NO: 430932 - DNA, 25 bp, Homo sapien
cccagcatctaggagtgttctcttc

SEQ ID NO: 430933 - DNA, 25 bp, Homo sapien
agtgttctcttcctagagcatgctt

SEQ ID NO: 430934 - DNA, 25 bp, Homo sapien
gctttctgagttgttcacgtgaaca

SEQ ID NO: 430935 - DNA, 25 bp, Homo sapien
tgttcacgtgaacatctacaatgtt

SEQ ID NO: 430936 - DNA, 25 bp, Homo sapien
gataaggtttgtttggcagggtcca

SEQ ID NO: 430937 - DNA, 25 bp, Homo sapien
ggcagggtccaagcacttcatggaa

SEQ ID NO: 430938 - DNA, 25 bp, Homo sapien
ggaatggagacctttggctgtcaga

SEQ ID NO: 430939 - DNA, 25 bp, Homo sapien
ttcagcagtgttcaacctgagggaa

SEQ ID NO: 430940 - DNA, 25 bp, Homo sapien
aggaagatttgtcagggcctgctac

SEQ ID NO: 430941 - DNA, 25 bp, Homo sapien
gctacactctgagggcttgcagttt

SEQ ID NO: 430942 - DNA, 25 bp, Homo sapien
ggatggttgggaacacttcttcctt

SEQ ID NO: 430943 - DNA, 25 bp, Homo sapien
aacacttcttccttgcactgatggt

SEQ ID NO: 430944 - DNA, 25 bp, Homo sapien
tgatggtgctcctatttctatgaca

SEQ ID NO: 430945 - DNA, 25 bp, Homo sapien
tatgacacgtgtactagttcagaca

SEQ ID NO: 430946 - DNA, 25 bp, Homo sapien
agtaggtcaattctcttggcagcag

SEQ ID NO: 430947 - DNA, 25 bp, Homo sapien
aaacatgatgttctctgtaccattt

SEQ ID NO: 430948 - DNA, 25 bp, Homo sapien
gatgttctctgtaccatttaacatt

SEQ ID NO: 430949 - DNA, 25 bp, Homo sapien
ttttcaagacatattctccccaagc

SEQ ID NO: 430950 - DNA, 25 bp, Homo sapien
atattctccccaagcaaattctgtt

SEQ ID NO: 430951 - DNA, 25 bp, Homo sapien
gcaaattctgttggaaccaagtgtt

SEQ ID NO: 430952 - DNA, 25 bp, Homo sapien
aaccaagtgtttccagttctagaag

SEQ ID NO: 430953 - DNA, 25 bp, Homo sapien
gtgtttccagttctagaagtttact

SEQ ID NO: 430954 - DNA, 25 bp, Homo sapien
acttctagagtcttcatatgaaatt

SEQ ID NO: 430955 - DNA, 25 bp, Homo sapien
tacagttgggctttcatagggtttt

SEQ ID NO: 430956 - DNA, 25 bp, Homo sapien
tttaatttgcactgaatccttcctt

SEQ ID NO: 430957 - DNA, 25 bp, Homo sapien
atgtattaagacctatcagcatgtc

SEQ ID NO: 430958 - DNA, 25 bp, Homo sapien
atccccttggagctggccggtaaga

SEQ ID NO: 430959 - DNA, 25 bp, Homo sapien
gccggtaagatattagtgcctcatt

SEQ ID NO: 430960 - DNA, 25 bp, Homo sapien
ggaattaagcaatttggccaacaga

SEQ ID NO: 430961 - DNA, 25 bp, Homo sapien
gattccagagttttatctcccactt

SEQ ID NO: 430962 - DNA, 25 bp, Homo sapien
ttatctcccactttagggtggcagc

SEQ ID NO: 430963 - DNA, 25 bp, Homo sapien
gggtggcagccagtaggccaaactc

SEQ ID NO: 430964 - DNA, 25 bp, Homo sapien
gtaggccaaactccaaagaccgttg

SEQ ID NO: 430965 - DNA, 25 bp, Homo sapien
agaccgttgctgatgtctttttctg

SEQ ID NO: 430966 - DNA, 25 bp, Homo sapien
cccctctttgggttagtgtggtatg

SEQ ID NO: 430967 - DNA, 25 bp, Homo sapien
agtgtggtatgtacaagctcactct

SEQ ID NO: 430968 - DNA, 25 bp, Homo sapien
acaagctcactcttgttgaaaatta

SEQ ID NO: 430969 - DNA, 25 bp, Homo sapien
ggttctgtaatcgacgccagacact

SEQ ID NO: 430970 - DNA, 25 bp, Homo sapien
gacgccagacactgaagaacaccag

SEQ ID NO: 430971 - DNA, 25 bp, Homo sapien
tcagatcccgtagggctcagtgtca

SEQ ID NO: 430972 - DNA, 25 bp, Homo sapien
tcagtgtcagcgtgtgccggcgcac

SEQ ID NO: 430973 - DNA, 25 bp, Homo sapien
agcaaccagccgaagtcactgcggt

SEQ ID NO: 430974 - DNA, 25 bp, Homo sapien
gtcactgcggtgactgtactgtgtg

SEQ ID NO: 430975 - DNA, 25 bp, Homo sapien
actgtgtgcagctgcgtttgcccta

SEQ ID NO: 430976 - DNA, 25 bp, Homo sapien
gtttgccctaggtcgtgagcctcca

SEQ ID NO: 430977 - DNA, 25 bp, Homo sapien
tgagcctccacctgtgcatgcgtgt

SEQ ID NO: 430978 - DNA, 25 bp, Homo sapien
tgtgcatgcgtgtcaatgcctgcct

SEQ ID NO: 430979 - DNA, 25 bp, Homo sapien
gcatgagagccttaggctctggctg

SEQ ID NO: 430980 - DNA, 25 bp, Homo sapien
cggcagacgtggagcgcactggcat

SEQ ID NO: 430981 - DNA, 25 bp, Homo sapien
gtggagcgcactggcatgggcattg

SEQ ID NO: 430982 - DNA, 25 bp, Homo sapien
agggccgacatcctctgctccagtt

SEQ ID NO: 430983 - DNA, 25 bp, Homo sapien
tccagttcatccttcctttgcctat

SEQ ID NO: 430984 - DNA, 25 bp, Homo sapien
tcctttgcctatccaagacgagaag

SEQ ID NO: 430985 - DNA, 25 bp, Homo sapien
tgcctatccaagacgagaagcctat

SEQ ID NO: 430986 - DNA, 25 bp, Homo sapien
tccaagacgagaagcctatcagata

SEQ ID NO: 430987 - DNA, 25 bp, Homo sapien
cctatcagataaagagaccctcaaa

SEQ ID NO: 430988 - DNA, 25 bp, Homo sapien
aaagagaccctcaaagatggatcta

SEQ ID NO: 430989 - DNA, 25 bp, Homo sapien
aagatggatctaaggccaggtgaaa

SEQ ID NO: 430990 - DNA, 25 bp, Homo sapien
tctaaggccaggtgaaatggatttc

SEQ ID NO: 430991 - DNA, 25 bp, Homo sapien
ataaatctgcagataaccacttgaa

SEQ ID NO: 430992 - DNA, 25 bp, Homo sapien
gataaccacttgaaccaggcaaata

SEQ ID NO: 430993 - DNA, 25 bp, Homo sapien
gtcatgaccattttagtcttgcaga

SEQ ID NO: 430994 - DNA, 25 bp, Homo sapien
agtcttgcagatagcagggcagccc

SEQ ID NO: 430995 - DNA, 25 bp, Homo sapien
tgggaggtaccgttaagagccttct

SEQ ID NO: 430996 - DNA, 25 bp, Homo sapien
aagtatactagttgcaagaacaagc

SEQ ID NO: 430997 - DNA, 25 bp, Homo sapien
gcaggatttgcaggttgctttacca

SEQ ID NO: 430998 - DNA, 25 bp, Homo sapien
ggttgctttaccagcatgagtctca

SEQ ID NO: 430999 - DNA, 25 bp, Homo sapien
gctttaccagcatgagtctcatttt

SEQ ID NO: 431000 - DNA, 25 bp, Homo sapien
gagtctcatttttctggcttaaaat

SEQ ID NO: 431001 - DNA, 25 bp, Homo sapien
tttctggcttaaaatctgggactgt

SEQ ID NO: 431002 - DNA, 25 bp, Homo sapien
agtacgttcaaaagggacaatcgct

SEQ ID NO: 431003 - DNA, 25 bp, Homo sapien
aagggacaatcgcttgcagttggta

SEQ ID NO: 431004 - DNA, 25 bp, Homo sapien
cttgcagttggtagatctagcgatc

SEQ ID NO: 431005 - DNA, 25 bp, Homo sapien
gatctagcgatctagttgggagata

SEQ ID NO: 431006 - DNA, 25 bp, Homo sapien
ggtgtttaccccatatgaagtattc

SEQ ID NO: 431007 - DNA, 25 bp, Homo sapien
agtattcaatagttctacttgtgaa

SEQ ID NO: 431008 - DNA, 25 bp, Homo sapien
attttgagttatacttgacacagaa

SEQ ID NO: 431009 - DNA, 25 bp, Homo sapien
gatgttaaaatttctgcatggttac

SEQ ID NO: 431010 - DNA, 25 bp, Homo sapien
gcatggttaccagtttttctcacaa

SEQ ID NO: 431011 - DNA, 25 bp, Homo sapien
cactgaatttggtagcttttcccga

SEQ ID NO: 431012 - DNA, 25 bp, Homo sapien
gcttttcccgaaaaaatcttcacag

SEQ ID NO: 431013 - DNA, 25 bp, Homo sapien
actctgaataatgtccttggatttt

SEQ ID NO: 431014 - DNA, 25 bp, Homo sapien
gtccttggatttttcaaaccaggca

SEQ ID NO: 431015 - DNA, 25 bp, Homo sapien
ggatttttcaaaccaggcaaccatg

SEQ ID NO: 431016 - DNA, 25 bp, Homo sapien
gatttttcaaaccaggcaaccatgt

SEQ ID NO: 431017 - DNA, 25 bp, Homo sapien
ggaatgaacttattagagttccatt

SEQ ID NO: 431018 - DNA, 25 bp, Homo sapien
agaatgtacttatctatctttgcat

SEQ ID NO: 431019 - DNA, 25 bp, Homo sapien
aatgtacttatctatctttgcataa

SEQ ID NO: 431020 - DNA, 25 bp, Homo sapien
ctttgcataaacagtaaacctagga

SEQ ID NO: 431021 - DNA, 25 bp, Homo sapien
gtaaacctaggaataaagacacatc

SEQ ID NO: 431022 - DNA, 25 bp, Homo sapien
agatcaactaagtcttctatcatat

SEQ ID NO: 431023 - DNA, 25 bp, Homo sapien
gatcaactaagtcttctatcatatt

SEQ ID NO: 431024 - DNA, 25 bp, Homo sapien
atatgtaaattccacaggtcttggc

SEQ ID NO: 431025 - DNA, 25 bp, Homo sapien
acaggtcttggctgtttgtattccc

SEQ ID NO: 431026 - DNA, 25 bp, Homo sapien
ggctgtttgtattcccctgaaaagg

SEQ ID NO: 431027 - DNA, 25 bp, Homo sapien
gaggcagagacaccaagcaaatagg

SEQ ID NO: 431028 - DNA, 25 bp, Homo sapien
ggagaaatcccatcattgctagcat

SEQ ID NO: 431029 - DNA, 25 bp, Homo sapien
atcccatcattgctagcattctcag

SEQ ID NO: 431030 - DNA, 25 bp, Homo sapien
gcattctcagcaatgcttgtttttc

SEQ ID NO: 431031 - DNA, 25 bp, Homo sapien
ggagactatttaagacactattgca

SEQ ID NO: 431032 - DNA, 25 bp, Homo sapien
catttgttaaattatgtctctcctc

SEQ ID NO: 431033 - DNA, 25 bp, Homo sapien
aagacactattgcaacggtcccggt

SEQ ID NO: 431034 - DNA, 25 bp, Homo sapien
gcaacggtcccggtgagataaaact

SEQ ID NO: 431035 - DNA, 25 bp, Homo sapien
taaagcacaagatctatgtaaagtg

SEQ ID NO: 431036 - DNA, 25 bp, Homo sapien
gcacaagatctatgtaaagtgttta

SEQ ID NO: 431037 - DNA, 25 bp, Homo sapien
atacattggaatatgagacttgaac

SEQ ID NO: 431038 - DNA, 25 bp, Homo sapien
gggagagtggtatcaaccactaaga

SEQ ID NO: 431039 - DNA, 25 bp, Homo sapien
tggtatcaaccactaagaggattaa

SEQ ID NO: 431040 - DNA, 25 bp, Homo sapien
gtatcaaccactaagaggattaaat

SEQ ID NO: 431041 - DNA, 25 bp, Homo sapien
atatttgtaaaacacgtagcctaga

SEQ ID NO: 431042 - DNA, 25 bp, Homo sapien
tttgtaaaacacgtagcctagaata

SEQ ID NO: 431043 - DNA, 25 bp, Homo sapien
gtaaaacacgtagcctagaatagat

SEQ ID NO: 431044 - DNA, 25 bp, Homo sapien
aacacgtagcctagaatagatattt

SEQ ID NO: 431045 - DNA, 25 bp, Homo sapien
cacgtagcctagaatagatatttat

SEQ ID NO: 431046 - DNA, 25 bp, Homo sapien
gcggtgaccccgtccgtgtctgtgt

SEQ ID NO: 431047 - DNA, 25 bp, Homo sapien
tgtctgtgtctgtccatacgtgtga

SEQ ID NO: 431048 - DNA, 25 bp, Homo sapien
gtccatacgtgtgagtccagctaaa

SEQ ID NO: 431049 - DNA, 25 bp, Homo sapien
gacaaaacagaacccgtgggcccag

SEQ ID NO: 431050 - DNA, 25 bp, Homo sapien
agaaggctccgacgtctccgaagtg

SEQ ID NO: 431051 - DNA, 25 bp, Homo sapien
acgtctccgaagtgcagcccttggg

SEQ ID NO: 431052 - DNA, 25 bp, Homo sapien
agcccttgggatggcattccgttgt

SEQ ID NO: 431053 - DNA, 25 bp, Homo sapien
atggcattccgttgtgtgccttatt

SEQ ID NO: 431054 - DNA, 25 bp, Homo sapien
gttgtgtgccttattcctggagaat

SEQ ID NO: 431055 - DNA, 25 bp, Homo sapien
ggagaatctgtatacggctcgccta

SEQ ID NO: 431056 - DNA, 25 bp, Homo sapien
tatacggctcgcctatagaaatata

SEQ ID NO: 431057 - DNA, 25 bp, Homo sapien
ctctgtaatctgcattccctatgta

SEQ ID NO: 431058 - DNA, 25 bp, Homo sapien
gtaatctgcattccctatgtatgat

SEQ ID NO: 431059 - DNA, 25 bp, Homo sapien
atctgcattccctatgtatgatttg

SEQ ID NO: 431060 - DNA, 25 bp, Homo sapien
gcattccctatgtatgatttggctc

SEQ ID NO: 431061 - DNA, 25 bp, Homo sapien
attccctatgtatgatttggctctg

SEQ ID NO: 431062 - DNA, 25 bp, Homo sapien
ttttgcttatctctttccaaccata

SEQ ID NO: 431063 - DNA, 25 bp, Homo sapien
gcttatctctttccaaccatattta

SEQ ID NO: 431064 - DNA, 25 bp, Homo sapien
atctctttccaaccatatttatgaa

SEQ ID NO: 431065 - DNA, 25 bp, Homo sapien
tttttccatggccaactctactcat

SEQ ID NO: 431066 - DNA, 25 bp, Homo sapien
tggccaactctactcatctatgaag

SEQ ID NO: 431067 - DNA, 25 bp, Homo sapien
gccaactctactcatctatgaagtt

SEQ ID NO: 431068 - DNA, 25 bp, Homo sapien
atgcagccgtttggcatggtaagca

SEQ ID NO: 431069 - DNA, 25 bp, Homo sapien
agccgtttggcatggtaagcaagga

SEQ ID NO: 431070 - DNA, 25 bp, Homo sapien
gtaagcaaggatactttcacctttg

SEQ ID NO: 431071 - DNA, 25 bp, Homo sapien
ttcacctttgtgttgccattcatgt

SEQ ID NO: 431072 - DNA, 25 bp, Homo sapien
gccattcatgtgtgctgcattggaa

SEQ ID NO: 431073 - DNA, 25 bp, Homo sapien
gtgtgctgcattggaactgtgttac

SEQ ID NO: 431074 - DNA, 25 bp, Homo sapien
gctgcattggaactgtgttaccatt

SEQ ID NO: 431075 - DNA, 25 bp, Homo sapien
gttaccattccattttattgattga

SEQ ID NO: 431076 - DNA, 25 bp, Homo sapien
gaagtgatatttactattccctgtt

SEQ ID NO: 431077 - DNA, 25 bp, Homo sapien
gatatttactattccctgttacctg

SEQ ID NO: 431078 - DNA, 25 bp, Homo sapien
ctattccctgttacctgtttgcatg

SEQ ID NO: 431079 - DNA, 25 bp, Homo sapien
acagctttgacagtccatcagggga

SEQ ID NO: 431080 - DNA, 25 bp, Homo sapien
cagctttgacagtccatcaggggaa

SEQ ID NO: 431081 - DNA, 25 bp, Homo sapien
agctttgacagtccatcaggggaat

SEQ ID NO: 431082 - DNA, 25 bp, Homo sapien
gctttgacagtccatcaggggaata

SEQ ID NO: 431083 - DNA, 25 bp, Homo sapien
ccatcaggggaataggttgtagcaa

SEQ ID NO: 431084 - DNA, 25 bp, Homo sapien
ataggttgtagcaaatagaaagcac

SEQ ID NO: 431085 - DNA, 25 bp, Homo sapien
taggttgtagcaaatagaaagcact

SEQ ID NO: 431086 - DNA, 25 bp, Homo sapien
aggttgtagcaaatagaaagcactc

SEQ ID NO: 431087 - DNA, 25 bp, Homo sapien
ggttgtagcaaatagaaagcactca

SEQ ID NO: 431088 - DNA, 25 bp, Homo sapien
gttgtagcaaatagaaagcactcaa

SEQ ID NO: 431089 - DNA, 25 bp, Homo sapien
ttgtagcaaatagaaagcactcaat

SEQ ID NO: 431090 - DNA, 25 bp, Homo sapien
taccctctgtcgacctcagctttag

SEQ ID NO: 431091 - DNA, 25 bp, Homo sapien
accctctgtcgacctcagctttagg

SEQ ID NO: 431092 - DNA, 25 bp, Homo sapien
aaggtgttcccttaggatagactga

SEQ ID NO: 431093 - DNA, 25 bp, Homo sapien
aggtgttcccttaggatagactgaa

SEQ ID NO: 431094 - DNA, 25 bp, Homo sapien
gtgttcccttaggatagactgaact

SEQ ID NO: 431095 - DNA, 25 bp, Homo sapien
cattttaagttcatcatcctgaaca

SEQ ID NO: 431096 - DNA, 25 bp, Homo sapien
aagttcatcatcctgaacatccctt

SEQ ID NO: 431097 - DNA, 25 bp, Homo sapien
agttcatcatcctgaacatcccttc

SEQ ID NO: 431098 - DNA, 25 bp, Homo sapien
gaacatcccttcaaatatggtgaaa

SEQ ID NO: 431099 - DNA, 25 bp, Homo sapien
acatcccttcaaatatggtgaaaat

SEQ ID NO: 431100 - DNA, 25 bp, Homo sapien
atatggtgaaaattttagcagtatt

SEQ ID NO: 431101 - DNA, 25 bp, Homo sapien
gtcaaagtgctcatttcctatctgt

SEQ ID NO: 431102 - DNA, 25 bp, Homo sapien
gagttgtagcaaatttcttactact

SEQ ID NO: 431103 - DNA, 25 bp, Homo sapien
tactacttaaataactgccagagag

SEQ ID NO: 431104 - DNA, 25 bp, Homo sapien
actgccagagagtaagagctttcac

SEQ ID NO: 431105 - DNA, 25 bp, Homo sapien
aattcagaaaccctccaatggacaa

SEQ ID NO: 431106 - DNA, 25 bp, Homo sapien
aatggacaaactgaggcacacctgt

SEQ ID NO: 431107 - DNA, 25 bp, Homo sapien
gaggcacacctgtattcatttagta

SEQ ID NO: 431108 - DNA, 25 bp, Homo sapien
caggcacacagaagttaagtaacac

SEQ ID NO: 431109 - DNA, 25 bp, Homo sapien
aagtaacacaaccactgtcacagtt

SEQ ID NO: 431110 - DNA, 25 bp, Homo sapien
ccactgtcacagttagtaagtagca

SEQ ID NO: 431111 - DNA, 25 bp, Homo sapien
gtctgacctggacagtcaaagtgct

SEQ ID NO: 431112 - DNA, 25 bp, Homo sapien
taaatacaactcacaactgctagct

SEQ ID NO: 431113 - DNA, 25 bp, Homo sapien
acaactcacaactgctagctttggg

SEQ ID NO: 431114 - DNA, 25 bp, Homo sapien
ttattgattagtctttaaagtaggc

SEQ ID NO: 431115 - DNA, 25 bp, Homo sapien
aatactggaccatcattaaatgtgt

SEQ ID NO: 431116 - DNA, 25 bp, Homo sapien
ggaccatcattaaatgtgtactgtg

SEQ ID NO: 431117 - DNA, 25 bp, Homo sapien
cattaaatgtgtactgtgaagagat

SEQ ID NO: 431118 - DNA, 25 bp, Homo sapien
taatatgtatgaagggctttaccaa

SEQ ID NO: 431119 - DNA, 25 bp, Homo sapien
tatgaagggctttaccaaagtccac

SEQ ID NO: 431120 - DNA, 25 bp, Homo sapien
aattgattactattgctgcataccc

SEQ ID NO: 431121 - DNA, 25 bp, Homo sapien
tgattactattgctgcatacccggg

SEQ ID NO: 431122 - DNA, 25 bp, Homo sapien
gggtggttggagaaccagaactatt

SEQ ID NO: 431123 - DNA, 25 bp, Homo sapien
agaaagctacttcaaggacttcctt

SEQ ID NO: 431124 - DNA, 25 bp, Homo sapien
tcaaggacttccttcggcaaggcct

SEQ ID NO: 431125 - DNA, 25 bp, Homo sapien
tcggcaaggcctttcaaacaagttt

SEQ ID NO: 431126 - DNA, 25 bp, Homo sapien
ttgaaaacacccatccttcaaagag

SEQ ID NO: 431127 - DNA, 25 bp, Homo sapien
tcaaagagcttgaagccccaagtgt

SEQ ID NO: 431128 - DNA, 25 bp, Homo sapien
aagccccaagtgtccatcttccagg

SEQ ID NO: 431129 - DNA, 25 bp, Homo sapien
ttccaggatgcacaagactccccaa

SEQ ID NO: 431130 - DNA, 25 bp, Homo sapien
atatccacactacattgttcggcac

SEQ ID NO: 431131 - DNA, 25 bp, Homo sapien
tacattgttcggcacttggtttccc

SEQ ID NO: 431132 - DNA, 25 bp, Homo sapien
ttggtttccctccagtatgcaccgt

SEQ ID NO: 431133 - DNA, 25 bp, Homo sapien
cagtatgcaccgtggcagccagtaa

SEQ ID NO: 431134 - DNA, 25 bp, Homo sapien
ggactgcgggacagagcctgctact

SEQ ID NO: 431135 - DNA, 25 bp, Homo sapien
acagagcctgctactacttgggagt

SEQ ID NO: 431136 - DNA, 25 bp, Homo sapien
agcctgctactacttgggagttggt

SEQ ID NO: 431137 - DNA, 25 bp, Homo sapien
tggcctggcctccaagagttctgga

SEQ ID NO: 431138 - DNA, 25 bp, Homo sapien
caagagttctggacaggaggcagac

SEQ ID NO: 431139 - DNA, 25 bp, Homo sapien
gacactgcccagatgctcggtggag

SEQ ID NO: 431140 - DNA, 25 bp, Homo sapien
tgatggcctttgactcatgaggcct

SEQ ID NO: 431141 - DNA, 25 bp, Homo sapien
accatgtaagagtgatttccgattt

SEQ ID NO: 431142 - DNA, 25 bp, Homo sapien
gagtgatttccgatttctctccttt

SEQ ID NO: 431143 - DNA, 25 bp, Homo sapien
gatttctctcctttcagttgtgtga

SEQ ID NO: 431144 - DNA, 25 bp, Homo sapien
ttgtgtgaaaaaacagctggcctgg

SEQ ID NO: 431145 - DNA, 25 bp, Homo sapien
tactgatcatctggtcagctaacat

SEQ ID NO: 431146 - DNA, 25 bp, Homo sapien
gttttcattgtgaaccttcttgaac

SEQ ID NO: 431147 - DNA, 25 bp, Homo sapien
gaagaggtcttcgaggctaggtccc

SEQ ID NO: 431148 - DNA, 25 bp, Homo sapien
tcgaggctaggtcccagaagatcca

SEQ ID NO: 431149 - DNA, 25 bp, Homo sapien
agaagatccatgactagtacattgt

SEQ ID NO: 431150 - DNA, 25 bp, Homo sapien
tgtagtctttttcctgaccatacca

SEQ ID NO: 431151 - DNA, 25 bp, Homo sapien
atagagcttgctctcgtacagcaac

SEQ ID NO: 431152 - DNA, 25 bp, Homo sapien
ggatgcctggccttctgagattcta

SEQ ID NO: 431153 - DNA, 25 bp, Homo sapien
tgagattctagcttcactgccactt

SEQ ID NO: 431154 - DNA, 25 bp, Homo sapien
acttcctcgccgttggtgatgttga

SEQ ID NO: 431155 - DNA, 25 bp, Homo sapien
gttgatcgccaaatagatgtccccg

SEQ ID NO: 431156 - DNA, 25 bp, Homo sapien
aaatggaggttaaatcacttacaca

SEQ ID NO: 431157 - DNA, 25 bp, Homo sapien
atggaggttaaatcacttacacagg

SEQ ID NO: 431158 - DNA, 25 bp, Homo sapien
tggaggttaaatcacttacacaggc

SEQ ID NO: 431159 - DNA, 25 bp, Homo sapien
ggaggttaaatcacttacacaggct

SEQ ID NO: 431160 - DNA, 25 bp, Homo sapien
gaggttaaatcacttacacaggctg

SEQ ID NO: 431161 - DNA, 25 bp, Homo sapien
aggttaaatcacttacacaggctgg

SEQ ID NO: 431162 - DNA, 25 bp, Homo sapien
ggttaaatcacttacacaggctggg

SEQ ID NO: 431163 - DNA, 25 bp, Homo sapien
gttaaatcacttacacaggctgggc

SEQ ID NO: 431164 - DNA, 25 bp, Homo sapien
ttaaatcacttacacaggctgggca

SEQ ID NO: 431165 - DNA, 25 bp, Homo sapien
aatcacttacacaggctgggcacgg

SEQ ID NO: 431166 - DNA, 25 bp, Homo sapien
aactgtgattttaaagggcagggag

SEQ ID NO: 431167 - DNA, 25 bp, Homo sapien
tctactctgaccaaattgaagatga

SEQ ID NO: 431168 - DNA, 25 bp, Homo sapien
acagcattttgtttatacagtcttg

SEQ ID NO: 431169 - DNA, 25 bp, Homo sapien
gtctctgtggaagctgtgtaactct

SEQ ID NO: 431170 - DNA, 25 bp, Homo sapien
ttgttattctaacaattctctcaaa

SEQ ID NO: 431171 - DNA, 25 bp, Homo sapien
tctctcaaaaaacagcatttccaat

SEQ ID NO: 431172 - DNA, 25 bp, Homo sapien
cagcatttccaatggtaatcggtat

SEQ ID NO: 431173 - DNA, 25 bp, Homo sapien
taatcggtattgttacgctgtactt

SEQ ID NO: 431174 - DNA, 25 bp, Homo sapien
tacgctgtacttatgtattccctgt

SEQ ID NO: 431175 - DNA, 25 bp, Homo sapien
tacttatgtattccctgtacctgaa

SEQ ID NO: 431176 - DNA, 25 bp, Homo sapien
tgtacctgaacacttgttgctgcct

SEQ ID NO: 431177 - DNA, 25 bp, Homo sapien
cctgaacacttgttgctgcctcaca

SEQ ID NO: 431178 - DNA, 25 bp, Homo sapien
ctctatacatgaccagacacagctg

SEQ ID NO: 431179 - DNA, 25 bp, Homo sapien
gacacagctgctgtttgcttgcttt

SEQ ID NO: 431180 - DNA, 25 bp, Homo sapien
aatgtatggagcagctacttcccaa

SEQ ID NO: 431181 - DNA, 25 bp, Homo sapien
ttaagccatttgacacatgacctgt

SEQ ID NO: 431182 - DNA, 25 bp, Homo sapien
tgacctgtgtcaattagtctttggt

SEQ ID NO: 431183 - DNA, 25 bp, Homo sapien
ggagcagctacttcccaaacctgaa

SEQ ID NO: 431184 - DNA, 25 bp, Homo sapien
gtccaaaactttctaaagtcatcat

SEQ ID NO: 431185 - DNA, 25 bp, Homo sapien
gattttaagctgcatacttttccta

SEQ ID NO: 431186 - DNA, 25 bp, Homo sapien
taagctgcatacttttcctaagcaa

SEQ ID NO: 431187 - DNA, 25 bp, Homo sapien
acgacattgtttccacatgctatta

SEQ ID NO: 431188 - DNA, 25 bp, Homo sapien
attaaacatcaacttcatccgaagt

SEQ ID NO: 431189 - DNA, 25 bp, Homo sapien
tcgacgcctgaatactaaaattggc

SEQ ID NO: 431190 - DNA, 25 bp, Homo sapien
cctgaatactaaaattggctacttg

SEQ ID NO: 431191 - DNA, 25 bp, Homo sapien
attggctacttgtactaagcagttt

SEQ ID NO: 431192 - DNA, 25 bp, Homo sapien
gctacttgtactaagcagtttcccg

SEQ ID NO: 431193 - DNA, 25 bp, Homo sapien
acttgtactaagcagtttcccgtgt

SEQ ID NO: 431194 - DNA, 25 bp, Homo sapien
tgtactaagcagtttcccgtgtttg

SEQ ID NO: 431195 - DNA, 25 bp, Homo sapien
tactaagcagtttcccgtgtttgtt

SEQ ID NO: 431196 - DNA, 25 bp, Homo sapien
gcagtttcccgtgtttgttaagtag

SEQ ID NO: 431197 - DNA, 25 bp, Homo sapien
tcccgtgtttgttaagtagctaaca

SEQ ID NO: 431198 - DNA, 25 bp, Homo sapien
cacttaatcaagtcagttatgtgtt

SEQ ID NO: 431199 - DNA, 25 bp, Homo sapien
taatcaagtcagttatgtgtttttt

SEQ ID NO: 431200 - DNA, 25 bp, Homo sapien
tggaagccacactcagacaccagag

SEQ ID NO: 431201 - DNA, 25 bp, Homo sapien
ggaagccacactcagacaccagagc

SEQ ID NO: 431202 - DNA, 25 bp, Homo sapien
gaagccacactcagacaccagagca

SEQ ID NO: 431203 - DNA, 25 bp, Homo sapien
tcagacaccagagcagctctcaatg

SEQ ID NO: 431204 - DNA, 25 bp, Homo sapien
gacaccagagcagctctcaatgctg

SEQ ID NO: 431205 - DNA, 25 bp, Homo sapien
acaccagagcagctctcaatgctgg

SEQ ID NO: 431206 - DNA, 25 bp, Homo sapien
accagagcagctctcaatgctggga

SEQ ID NO: 431207 - DNA, 25 bp, Homo sapien
ccagagcagctctcaatgctgggaa

SEQ ID NO: 431208 - DNA, 25 bp, Homo sapien
gaatcctgggagactgatgatgacc

SEQ ID NO: 431209 - DNA, 25 bp, Homo sapien
atcctgggagactgatgatgaccgc

SEQ ID NO: 431210 - DNA, 25 bp, Homo sapien
gtgcagaattccaaatgttatttac

SEQ ID NO: 431211 - DNA, 25 bp, Homo sapien
gaatcttttacatcgtagttttgat

SEQ ID NO: 431212 - DNA, 25 bp, Homo sapien
catcgtagttttgatcagaattcca

SEQ ID NO: 431213 - DNA, 25 bp, Homo sapien
gtagttttgatcagaattccaaaga

SEQ ID NO: 431214 - DNA, 25 bp, Homo sapien
gaacaaggttaacaaaaatgtggct

SEQ ID NO: 431215 - DNA, 25 bp, Homo sapien
aaaatgtggcttcctctatctgtat

SEQ ID NO: 431216 - DNA, 25 bp, Homo sapien
aatgtggcttcctctatctgtatcc

SEQ ID NO: 431217 - DNA, 25 bp, Homo sapien
ttcctctatctgtatccctgtattt

SEQ ID NO: 431218 - DNA, 25 bp, Homo sapien
ctctatctgtatccctgtatttctt

SEQ ID NO: 431219 - DNA, 25 bp, Homo sapien
atctgtatccctgtatttcttactt

SEQ ID NO: 431220 - DNA, 25 bp, Homo sapien
gtatttcttactttacatcatgatt

SEQ ID NO: 431221 - DNA, 25 bp, Homo sapien
tttacatcatgatttttctccacat

SEQ ID NO: 431222 - DNA, 25 bp, Homo sapien
agactctgggactggtgagttcaag

SEQ ID NO: 431223 - DNA, 25 bp, Homo sapien
gttcctgaagccaatatttcctaat

SEQ ID NO: 431224 - DNA, 25 bp, Homo sapien
atttcctaatctcttggttcaggac

SEQ ID NO: 431225 - DNA, 25 bp, Homo sapien
gaaaaccccaagttcagaaatagct

SEQ ID NO: 431226 - DNA, 25 bp, Homo sapien
gcttggtattcagttaagtattgta

SEQ ID NO: 431227 - DNA, 25 bp, Homo sapien
tagttcagtgaaccgcccgttagtt

SEQ ID NO: 431228 - DNA, 25 bp, Homo sapien
agttttgtcaaacttcccactgcaa

SEQ ID NO: 431229 - DNA, 25 bp, Homo sapien
aaacttcccactgcaatgcctttat

SEQ ID NO: 431230 - DNA, 25 bp, Homo sapien
tcccactgcaatgcctttatttaaa

SEQ ID NO: 431231 - DNA, 25 bp, Homo sapien
ttcataccacaatttcaaacctact

SEQ ID NO: 431232 - DNA, 25 bp, Homo sapien
ccctgataaagctaaatttgtccct

SEQ ID NO: 431233 - DNA, 25 bp, Homo sapien
tgtccctcggcacagcctcggcaca

SEQ ID NO: 431234 - DNA, 25 bp, Homo sapien
tccctcggcacagcctcggcacaaa

SEQ ID NO: 431235 - DNA, 25 bp, Homo sapien
ctcggcacagcctcggcacaaacca

SEQ ID NO: 431236 - DNA, 25 bp, Homo sapien
tcggcacagcctcggcacaaaccac

SEQ ID NO: 431237 - DNA, 25 bp, Homo sapien
tcggcacaaaccacattgcctgggt

SEQ ID NO: 431238 - DNA, 25 bp, Homo sapien
gcacaaaccacattgcctgggtggg

SEQ ID NO: 431239 - DNA, 25 bp, Homo sapien
ctcacagcttgcagttgtccaaaaa

SEQ ID NO: 431240 - DNA, 25 bp, Homo sapien
tcacagcttgcagttgtccaaaaac

SEQ ID NO: 431241 - DNA, 25 bp, Homo sapien
cacagcttgcagttgtccaaaaaca

SEQ ID NO: 431242 - DNA, 25 bp, Homo sapien
acagcttgcagttgtccaaaaacaa

SEQ ID NO: 431243 - DNA, 25 bp, Homo sapien
cagcttgcagttgtccaaaaacaaa

SEQ ID NO: 431244 - DNA, 25 bp, Homo sapien
taaacagaattgcagtgctgccgaa

SEQ ID NO: 431245 - DNA, 25 bp, Homo sapien
gcagtgctgccgaaattcttgatct

SEQ ID NO: 431246 - DNA, 25 bp, Homo sapien
ccgaaattcttgatcttggctaaga

SEQ ID NO: 431247 - DNA, 25 bp, Homo sapien
tcttggctaagagagtatttttccc

SEQ ID NO: 431248 - DNA, 25 bp, Homo sapien
tgactctgagataaaattgccattt

SEQ ID NO: 431249 - DNA, 25 bp, Homo sapien
ggattgcaatttctctgatctgaca

SEQ ID NO: 431250 - DNA, 25 bp, Homo sapien
atattacctcatttgggcatcatta

SEQ ID NO: 431251 - DNA, 25 bp, Homo sapien
cctcatttgggcatcattactctgt

SEQ ID NO: 431252 - DNA, 25 bp, Homo sapien
gggcatcattactctgttaattcta

SEQ ID NO: 431253 - DNA, 25 bp, Homo sapien
tactctgttaattctatatcaaagg

SEQ ID NO: 431254 - DNA, 25 bp, Homo sapien
aataaacttgctacttgcactaaat

SEQ ID NO: 431255 - DNA, 25 bp, Homo sapien
agatacggttctcatcacatttgcc

SEQ ID NO: 431256 - DNA, 25 bp, Homo sapien
cacatttgcctgagaactacgtata

SEQ ID NO: 431257 - DNA, 25 bp, Homo sapien
ctacgtatagtcatccattcagtgc

SEQ ID NO: 431258 - DNA, 25 bp, Homo sapien
catccattcagtgcctcgttaagta

SEQ ID NO: 431259 - DNA, 25 bp, Homo sapien
gaatcatttgtatacatgacctcat

SEQ ID NO: 431260 - DNA, 25 bp, Homo sapien
catgacctcatggaaaaaagcacgg

SEQ ID NO: 431261 - DNA, 25 bp, Homo sapien
acagaattattcaacccggacaggt

SEQ ID NO: 431262 - DNA, 25 bp, Homo sapien
tattcaacccggacaggtgttagat

SEQ ID NO: 431263 - DNA, 25 bp, Homo sapien
ggtgttagatgttcactctatcccc

SEQ ID NO: 431264 - DNA, 25 bp, Homo sapien
attatttgcatcatctatggaccta

SEQ ID NO: 431265 - DNA, 25 bp, Homo sapien
ggacctaaaagcatgctcattgtca

SEQ ID NO: 431266 - DNA, 25 bp, Homo sapien
gggccccaagtgaatggtgaacaca

SEQ ID NO: 431267 - DNA, 25 bp, Homo sapien
aacacagggccatagcgctcactga

SEQ ID NO: 431268 - DNA, 25 bp, Homo sapien
atagcgctcactgatcttcatgatg

SEQ ID NO: 431269 - DNA, 25 bp, Homo sapien
actgatcttcatgatggagtcacat

SEQ ID NO: 431270 - DNA, 25 bp, Homo sapien
ggagtcacatatgtgctctgtgttc

SEQ ID NO: 431271 - DNA, 25 bp, Homo sapien
atatgtgctctgtgttcagctgcag

SEQ ID NO: 431272 - DNA, 25 bp, Homo sapien
gttcagctgcaggtagtttccaata

SEQ ID NO: 431273 - DNA, 25 bp, Homo sapien
gctgccagactgacatcaagaccat

SEQ ID NO: 431274 - DNA, 25 bp, Homo sapien
agaccatcacagtcaggctggccag

SEQ ID NO: 431275 - DNA, 25 bp, Homo sapien
ccagcatggtggtagtgagatgaca

SEQ ID NO: 431276 - DNA, 25 bp, Homo sapien
tggtttgcctttatactgcctgaaa

SEQ ID NO: 431277 - DNA, 25 bp, Homo sapien
aagaatagttcagccttctgccatg

SEQ ID NO: 431278 - DNA, 25 bp, Homo sapien
acacagcctcagcttgaatctggtt

SEQ ID NO: 431279 - DNA, 25 bp, Homo sapien
tgaatctggttcattgcgtcctcgt

SEQ ID NO: 431280 - DNA, 25 bp, Homo sapien
tccttgccttaaaccagggattctg

SEQ ID NO: 431281 - DNA, 25 bp, Homo sapien
gaaaaccatggagtctgttcgtgac

SEQ ID NO: 431282 - DNA, 25 bp, Homo sapien
gtaggagccacttcataaacattct

SEQ ID NO: 431283 - DNA, 25 bp, Homo sapien
gctggtttccgttcaagggcaagga

SEQ ID NO: 431284 - DNA, 25 bp, Homo sapien
ggcaaggatcacagctgcccttgaa

SEQ ID NO: 431285 - DNA, 25 bp, Homo sapien
tgcccttgaatctcattgcctcaga

SEQ ID NO: 431286 - DNA, 25 bp, Homo sapien
agactagagggctcttggactatcc

SEQ ID NO: 431287 - DNA, 25 bp, Homo sapien
ggactatccctagggctacacaaga

SEQ ID NO: 431288 - DNA, 25 bp, Homo sapien
gctgctttgtattacaaggatttcc

SEQ ID NO: 431289 - DNA, 25 bp, Homo sapien
ctgctggccggatcgtgtgccctga

SEQ ID NO: 431290 - DNA, 25 bp, Homo sapien
gccggatcgtgtgccctgaggaacc

SEQ ID NO: 431291 - DNA, 25 bp, Homo sapien
atcgtgtgccctgaggaaccgcact

SEQ ID NO: 431292 - DNA, 25 bp, Homo sapien
cggatcaaaaggtgctgtgcttgct

SEQ ID NO: 431293 - DNA, 25 bp, Homo sapien
aaaaggtgctgtgcttgctggcctc

SEQ ID NO: 431294 - DNA, 25 bp, Homo sapien
tggcctccctctttggcgggaagat

SEQ ID NO: 431295 - DNA, 25 bp, Homo sapien
ctctttggcgggaagattgccgtgt

SEQ ID NO: 431296 - DNA, 25 bp, Homo sapien
gattgccgtgttggagatcaacccg

SEQ ID NO: 431297 - DNA, 25 bp, Homo sapien
gttggagatcaacccggccgcgcta

SEQ ID NO: 431298 - DNA, 25 bp, Homo sapien
cggccgcgctagtcagggctcagca

SEQ ID NO: 431299 - DNA, 25 bp, Homo sapien
aacacaatccacacaagtctacttc

SEQ ID NO: 431300 - DNA, 25 bp, Homo sapien
agtctacttccacgtccacaaaact

SEQ ID NO: 431301 - DNA, 25 bp, Homo sapien
aaaactccagctgattccttggcat

SEQ ID NO: 431302 - DNA, 25 bp, Homo sapien
tccagctgattccttggcatttttt

SEQ ID NO: 431303 - DNA, 25 bp, Homo sapien
ttttcattattctgcttaaaaagcc

SEQ ID NO: 431304 - DNA, 25 bp, Homo sapien
tttctttttgtacttggataagctt

SEQ ID NO: 431305 - DNA, 25 bp, Homo sapien
aaaatgactgcttcaccagcttttc

SEQ ID NO: 431306 - DNA, 25 bp, Homo sapien
tttccttggaagttccccacagcaa

SEQ ID NO: 431307 - DNA, 25 bp, Homo sapien
gaaactgactgtgctcacgggtgtg

SEQ ID NO: 431308 - DNA, 25 bp, Homo sapien
agagtttcgatatttgtccttgccc

SEQ ID NO: 431309 - DNA, 25 bp, Homo sapien
gatatttgtccttgcccaaatctca

SEQ ID NO: 431310 - DNA, 25 bp, Homo sapien
gggacgctcgtggactgcgggcgcc

SEQ ID NO: 431311 - DNA, 25 bp, Homo sapien
gctgacttgggcctcgctgccgacc

SEQ ID NO: 431312 - DNA, 25 bp, Homo sapien
ttccctgtcgacacaaccgagctgg

SEQ ID NO: 431313 - DNA, 25 bp, Homo sapien
ctgtcgacacaaccgagctggtgct

SEQ ID NO: 431314 - DNA, 25 bp, Homo sapien
gtcgacacaaccgagctggtgctga

SEQ ID NO: 431315 - DNA, 25 bp, Homo sapien
tcgacacaaccgagctggtgctgac

SEQ ID NO: 431316 - DNA, 25 bp, Homo sapien
agctggtgctgaccggcaacaacct

SEQ ID NO: 431317 - DNA, 25 bp, Homo sapien
ggtgctgaccggcaacaacctgacg

SEQ ID NO: 431318 - DNA, 25 bp, Homo sapien
tgctgaccggcaacaacctgacggc

SEQ ID NO: 431319 - DNA, 25 bp, Homo sapien
gaccggcaacaacctgacggcgctg

SEQ ID NO: 431320 - DNA, 25 bp, Homo sapien
tggcgctgcgactgccgccttgtgc

SEQ ID NO: 431321 - DNA, 25 bp, Homo sapien
cttttgtgccaacctgaggataatt

SEQ ID NO: 431322 - DNA, 25 bp, Homo sapien
gccaacctgaggataattttaacaa

SEQ ID NO: 431323 - DNA, 25 bp, Homo sapien
taacaaaatgtaaggccagtttcag

SEQ ID NO: 431324 - DNA, 25 bp, Homo sapien
gtaaggccagtttcagaggttgttt

SEQ ID NO: 431325 - DNA, 25 bp, Homo sapien
gtttcagaggttgttttgccccaca

SEQ ID NO: 431326 - DNA, 25 bp, Homo sapien
gttttgccccacagagagactaatc

SEQ ID NO: 431327 - DNA, 25 bp, Homo sapien
tgccccacagagagactaatcccaa

SEQ ID NO: 431328 - DNA, 25 bp, Homo sapien
gagactaatcccaatacaagaatat

SEQ ID NO: 431329 - DNA, 25 bp, Homo sapien
aaagtagttattgcacaggacggaa

SEQ ID NO: 431330 - DNA, 25 bp, Homo sapien
gcacaggacggaaaggtgtctttat

SEQ ID NO: 431331 - DNA, 25 bp, Homo sapien
gacggaaaggtgtctttatttcatc

SEQ ID NO: 431332 - DNA, 25 bp, Homo sapien
ttctggaaggttcttagtctcgact

SEQ ID NO: 431333 - DNA, 25 bp, Homo sapien
aggaagccaacatccttttggagcc

SEQ ID NO: 431334 - DNA, 25 bp, Homo sapien
agccatgaatattgtccgaactcca

SEQ ID NO: 431335 - DNA, 25 bp, Homo sapien
aatattgtccgaactccatctgttg

SEQ ID NO: 431336 - DNA, 25 bp, Homo sapien
agtatggctcagcagactcctgtag

SEQ ID NO: 431337 - DNA, 25 bp, Homo sapien
ttagtctcgactagggcagtagccc

SEQ ID NO: 431338 - DNA, 25 bp, Homo sapien
actcctgtaggtaatgctgctgtat

SEQ ID NO: 431339 - DNA, 25 bp, Homo sapien
gggcagtagccccaggactcctagt

SEQ ID NO: 431340 - DNA, 25 bp, Homo sapien
aggactcctagtcgccggcttcagg

SEQ ID NO: 431341 - DNA, 25 bp, Homo sapien
cggcttcaggtcactgccggctgaa

SEQ ID NO: 431342 - DNA, 25 bp, Homo sapien
gtcactgccggctgaacggagctgc

SEQ ID NO: 431343 - DNA, 25 bp, Homo sapien
aaagtgaggcagtgttaggaaacca

SEQ ID NO: 431344 - DNA, 25 bp, Homo sapien
aagtgaggcagtgttaggaaaccat

SEQ ID NO: 431345 - DNA, 25 bp, Homo sapien
agtgaggcagtgttaggaaaccatg

SEQ ID NO: 431346 - DNA, 25 bp, Homo sapien
gtgaggcagtgttaggaaaccatgg

SEQ ID NO: 431347 - DNA, 25 bp, Homo sapien
aggcagtgttaggaaaccatgggct

SEQ ID NO: 431348 - DNA, 25 bp, Homo sapien
ggcagtgttaggaaaccatgggctg

SEQ ID NO: 431349 - DNA, 25 bp, Homo sapien
gcagtgttaggaaaccatgggctgg

SEQ ID NO: 431350 - DNA, 25 bp, Homo sapien
cagtgttaggaaaccatgggctggg

SEQ ID NO: 431351 - DNA, 25 bp, Homo sapien
agtgttaggaaaccatgggctgggt

SEQ ID NO: 431352 - DNA, 25 bp, Homo sapien
gtgttaggaaaccatgggctgggtg

SEQ ID NO: 431353 - DNA, 25 bp, Homo sapien
tgttaggaaaccatgggctgggtgc

SEQ ID NO: 431354 - DNA, 25 bp, Homo sapien
gatcatgcacaatccatgccactta

SEQ ID NO: 431355 - DNA, 25 bp, Homo sapien
atgccacttaaatgggttttagctg

SEQ ID NO: 431356 - DNA, 25 bp, Homo sapien
aggttttgctcatgttactctgaat

SEQ ID NO: 431357 - DNA, 25 bp, Homo sapien
ttctaaggacagatcagtgaccctc

SEQ ID NO: 431358 - DNA, 25 bp, Homo sapien
gtgaccctcttagcctgagcagaaa

SEQ ID NO: 431359 - DNA, 25 bp, Homo sapien
agaaagcatattcttcccactgcag

SEQ ID NO: 431360 - DNA, 25 bp, Homo sapien
agtgctacatcacctgtctttcgcc

SEQ ID NO: 431361 - DNA, 25 bp, Homo sapien
gccctgactctccaaatgaacataa

SEQ ID NO: 431362 - DNA, 25 bp, Homo sapien
aaaaggctggtaacagagctagctg

SEQ ID NO: 431363 - DNA, 25 bp, Homo sapien
gagctagctgggacaatcactgcat

SEQ ID NO: 431364 - DNA, 25 bp, Homo sapien
atcactgcatctatagaacagccaa

SEQ ID NO: 431365 - DNA, 25 bp, Homo sapien
aagtgactgctcaaaatcgccgagg

SEQ ID NO: 431366 - DNA, 25 bp, Homo sapien
atcgccgagggcttaagttctaagt

SEQ ID NO: 431367 - DNA, 25 bp, Homo sapien
taagttctaagtgcagttcctgtcc

SEQ ID NO: 431368 - DNA, 25 bp, Homo sapien
gttcctgtccaaatgctgaaaatcg

SEQ ID NO: 431369 - DNA, 25 bp, Homo sapien
tagtgcagggagcttctggcattct

SEQ ID NO: 431370 - DNA, 25 bp, Homo sapien
ctttttcctgccgttgtgcaaaatg

SEQ ID NO: 431371 - DNA, 25 bp, Homo sapien
gaggaggagctgtcatttctgataa

SEQ ID NO: 431372 - DNA, 25 bp, Homo sapien
tatatgacccggctgagtctacttc

SEQ ID NO: 431373 - DNA, 25 bp, Homo sapien
gagtctacttctactggcgtgacaa

SEQ ID NO: 431374 - DNA, 25 bp, Homo sapien
aatccctgatagaagcattgctgca

SEQ ID NO: 431375 - DNA, 25 bp, Homo sapien
cattgctgcacctcgggtttctgag

SEQ ID NO: 431376 - DNA, 25 bp, Homo sapien
cattgtaaagccgtgaatgttttta

SEQ ID NO: 431377 - DNA, 25 bp, Homo sapien
gaatgtttttagtcttgttgacgag

SEQ ID NO: 431378 - DNA, 25 bp, Homo sapien
acgagtttttagagactgctggacc

SEQ ID NO: 431379 - DNA, 25 bp, Homo sapien
actgctggacctctgagggctttga

SEQ ID NO: 431380 - DNA, 25 bp, Homo sapien
gcagctgtgatgatgtttcactatt

SEQ ID NO: 431381 - DNA, 25 bp, Homo sapien
gatgtttcactattacttcagtgtg

SEQ ID NO: 431382 - DNA, 25 bp, Homo sapien
gtagaaccaaggactcatcttcatt

SEQ ID NO: 431383 - DNA, 25 bp, Homo sapien
tatacctaaaagtgccttgtcaaga

SEQ ID NO: 431384 - DNA, 25 bp, Homo sapien
atatttttgtacacagagttcaagg

SEQ ID NO: 431385 - DNA, 25 bp, Homo sapien
agaatggatgttctttgtgtggtat

SEQ ID NO: 431386 - DNA, 25 bp, Homo sapien
gaggttggtttgtatctcaaaagca

SEQ ID NO: 431387 - DNA, 25 bp, Homo sapien
gggacaagagcctccaccctttgct

SEQ ID NO: 431388 - DNA, 25 bp, Homo sapien
tttctggaggcccatgtccggctct

SEQ ID NO: 431389 - DNA, 25 bp, Homo sapien
cctgggcctggacaaacgtcaatca

SEQ ID NO: 431390 - DNA, 25 bp, Homo sapien
caaacgtcaatcagaggctcggctc

SEQ ID NO: 431391 - DNA, 25 bp, Homo sapien
gtcaatcagaggctcggctccaagc

SEQ ID NO: 431392 - DNA, 25 bp, Homo sapien
cccccagtctcaaagaattgctcat

SEQ ID NO: 431393 - DNA, 25 bp, Homo sapien
aggaggtgctggactaacccttgcc

SEQ ID NO: 431394 - DNA, 25 bp, Homo sapien
ggactaacccttgcctagatttaag

SEQ ID NO: 431395 - DNA, 25 bp, Homo sapien
acccttgcctagatttaaggccact

SEQ ID NO: 431396 - DNA, 25 bp, Homo sapien
tagatttaaggccactgtgaggaga

SEQ ID NO: 431397 - DNA, 25 bp, Homo sapien
ggacctgatgagaacagaatagctg

SEQ ID NO: 431398 - DNA, 25 bp, Homo sapien
ggaaaagctgactcacgcccatcca

SEQ ID NO: 431399 - DNA, 25 bp, Homo sapien
gggacagtcgcttccgccttgacac

SEQ ID NO: 431400 - DNA, 25 bp, Homo sapien
ttgacacctcactctcagttgaata

SEQ ID NO: 431401 - DNA, 25 bp, Homo sapien
gaataactcaagcttggtcatcttc

SEQ ID NO: 431402 - DNA, 25 bp, Homo sapien
ggtcatcttcagactcgaattcttg

SEQ ID NO: 431403 - DNA, 25 bp, Homo sapien
attcttgagtagacccagacggctt

SEQ ID NO: 431404 - DNA, 25 bp, Homo sapien
gacggcttagcccaagtctagttgc

SEQ ID NO: 431405 - DNA, 25 bp, Homo sapien
aagtctagttgcagctgcctcggca

SEQ ID NO: 431406 - DNA, 25 bp, Homo sapien
ggcaagtccccatttgctcaggcag

SEQ ID NO: 431407 - DNA, 25 bp, Homo sapien
aggcagccctgaatgggcctgttta

SEQ ID NO: 431408 - DNA, 25 bp, Homo sapien
ggaaggaatatagcttccagcttca

SEQ ID NO: 431409 - DNA, 25 bp, Homo sapien
gttcttcccaggcacttccttggca

SEQ ID NO: 431410 - DNA, 25 bp, Homo sapien
ttccttggcacacccggtgaagctg

SEQ ID NO: 431411 - DNA, 25 bp, Homo sapien
cccaggcacatgcagcagaagtcag

SEQ ID NO: 431412 - DNA, 25 bp, Homo sapien
gggaacagatgactctgcccagcca

SEQ ID NO: 431413 - DNA, 25 bp, Homo sapien
agctctcctaggaccctctcaggta

SEQ ID NO: 431414 - DNA, 25 bp, Homo sapien
aggaccctctcaggtacggatggca

SEQ ID NO: 431415 - DNA, 25 bp, Homo sapien
ctcaggtacggatggcaggaatcaa

SEQ ID NO: 431416 - DNA, 25 bp, Homo sapien
cacaagggaggcagggtagtctcaa

SEQ ID NO: 431417 - DNA, 25 bp, Homo sapien
agggaggcagggtagtctcaaccct

SEQ ID NO: 431418 - DNA, 25 bp, Homo sapien
gcacagctgcagagtcctgttcttc

SEQ ID NO: 431419 - DNA, 25 bp, Homo sapien
agctgcagagtcctgttcttcccag

SEQ ID NO: 431420 - DNA, 25 bp, Homo sapien
acaggaagattagtcacttctggaa

SEQ ID NO: 431421 - DNA, 25 bp, Homo sapien
gatgaagtactttaaacaggaatgt

SEQ ID NO: 431422 - DNA, 25 bp, Homo sapien
tggaactggaagtgctagggctaaa

SEQ ID NO: 431423 - DNA, 25 bp, Homo sapien
gtgctagggctaaaagacagatgtg

SEQ ID NO: 431424 - DNA, 25 bp, Homo sapien
taatctgaacagcacgaaacttgac

SEQ ID NO: 431425 - DNA, 25 bp, Homo sapien
gaacagcacgaaacttgacaaaaaa

SEQ ID NO: 431426 - DNA, 25 bp, Homo sapien
gtttgctaatacataaatattggct

SEQ ID NO: 431427 - DNA, 25 bp, Homo sapien
atattggctattttaatctgttgaa

SEQ ID NO: 431428 - DNA, 25 bp, Homo sapien
aatctgttgaaaacggaaggctagt

SEQ ID NO: 431429 - DNA, 25 bp, Homo sapien
ttgaaaacggaaggctagtaccaag

SEQ ID NO: 431430 - DNA, 25 bp, Homo sapien
gaaaagtaaacattatgcaacatga

SEQ ID NO: 431431 - DNA, 25 bp, Homo sapien
aagcacctcctgctccagtaattgt

SEQ ID NO: 431432 - DNA, 25 bp, Homo sapien
acctcctgctccagtaattgttaca

SEQ ID NO: 431433 - DNA, 25 bp, Homo sapien
gctccagtaattgttacagaaaccc

SEQ ID NO: 431434 - DNA, 25 bp, Homo sapien
aaccccagaaccagcgatgactagt

SEQ ID NO: 431435 - DNA, 25 bp, Homo sapien
gactagtggtgtgtataggcctcct

SEQ ID NO: 431436 - DNA, 25 bp, Homo sapien
ctagtggtgtgtataggcctcctgg

SEQ ID NO: 431437 - DNA, 25 bp, Homo sapien
cacaaggaccaccagaaatctacag

SEQ ID NO: 431438 - DNA, 25 bp, Homo sapien
ggaccaccagaaatctacagtgata

SEQ ID NO: 431439 - DNA, 25 bp, Homo sapien
tacagtgatacacagttcccatccc

SEQ ID NO: 431440 - DNA, 25 bp, Homo sapien
gtgatacacagttcccatccctgca

SEQ ID NO: 431441 - DNA, 25 bp, Homo sapien
atccctgcagtcaactgccaagcat

SEQ ID NO: 431442 - DNA, 25 bp, Homo sapien
tccagatttctctatgtttttgaga

SEQ ID NO: 431443 - DNA, 25 bp, Homo sapien
gttttgccatggtaaaagatttcaa

SEQ ID NO: 431444 - DNA, 25 bp, Homo sapien
tgtttctctgaatcaaatgaagtag

SEQ ID NO: 431445 - DNA, 25 bp, Homo sapien
caaagctaactttcttcttgtctag

SEQ ID NO: 431446 - DNA, 25 bp, Homo sapien
aactttcttcttgtctagctattaa

SEQ ID NO: 431447 - DNA, 25 bp, Homo sapien
gtctagctattaacatgatttgtca

SEQ ID NO: 431448 - DNA, 25 bp, Homo sapien
tgcatgtttttttcagccaaagcct

SEQ ID NO: 431449 - DNA, 25 bp, Homo sapien
cagccaaagccttgtttccattttt

SEQ ID NO: 431450 - DNA, 25 bp, Homo sapien
tttgttgatgtgtactcttgctctt

SEQ ID NO: 431451 - DNA, 25 bp, Homo sapien
tgatgtgtactcttgctcttttagc

SEQ ID NO: 431452 - DNA, 25 bp, Homo sapien
cttgctcttttagctagagtgtatg

SEQ ID NO: 431453 - DNA, 25 bp, Homo sapien
tttcctctttatgtttactgctggg

SEQ ID NO: 431454 - DNA, 25 bp, Homo sapien
atgtttactgctgggaagctcatgg

SEQ ID NO: 431455 - DNA, 25 bp, Homo sapien
tgtgatccatctctagtcagcagga

SEQ ID NO: 431456 - DNA, 25 bp, Homo sapien
atctctagtcagcaggatagcctta

SEQ ID NO: 431457 - DNA, 25 bp, Homo sapien
aaggcatgcattttatttactactg

SEQ ID NO: 431458 - DNA, 25 bp, Homo sapien
gggaagtcccattttatgtccgcaa

SEQ ID NO: 431459 - DNA, 25 bp, Homo sapien
gtcccattttatgtccgcaatatat

SEQ ID NO: 431460 - DNA, 25 bp, Homo sapien
taaaaacctcccataaatcaaagct

SEQ ID NO: 431461 - DNA, 25 bp, Homo sapien
agctcatgtaattcaagggcagttt

SEQ ID NO: 431462 - DNA, 25 bp, Homo sapien
accaatatttttctggaagtgcata

SEQ ID NO: 431463 - DNA, 25 bp, Homo sapien
gtgcatatatctttagccatttggt

SEQ ID NO: 431464 - DNA, 25 bp, Homo sapien
agccaccacacagaatgcatctgga

SEQ ID NO: 431465 - DNA, 25 bp, Homo sapien
ccaccacacagaatgcatctggagc

SEQ ID NO: 431466 - DNA, 25 bp, Homo sapien
accacacagaatgcatctggagcga

SEQ ID NO: 431467 - DNA, 25 bp, Homo sapien
cacacagaatgcatctggagcgaat

SEQ ID NO: 431468 - DNA, 25 bp, Homo sapien
acacagaatgcatctggagcgaatg

SEQ ID NO: 431469 - DNA, 25 bp, Homo sapien
tcatgcaatcaactaacttaatccc

SEQ ID NO: 431470 - DNA, 25 bp, Homo sapien
catgcaatcaactaacttaatccct

SEQ ID NO: 431471 - DNA, 25 bp, Homo sapien
caatcaactaacttaatcccttgat

SEQ ID NO: 431472 - DNA, 25 bp, Homo sapien
tcaactaacttaatcccttgatttt

SEQ ID NO: 431473 - DNA, 25 bp, Homo sapien
taacttaatcccttgattttctaag

SEQ ID NO: 431474 - DNA, 25 bp, Homo sapien
ataggcaatgcacatatggcccagc

SEQ ID NO: 431475 - DNA, 25 bp, Homo sapien
cattaggaaaccattactgtggcag

SEQ ID NO: 431476 - DNA, 25 bp, Homo sapien
ttactgtggcagaaagtctaaaacc

SEQ ID NO: 431477 - DNA, 25 bp, Homo sapien
agatgacataaaccatacctctggt

SEQ ID NO: 431478 - DNA, 25 bp, Homo sapien
accatacctctggttggttgcatca

SEQ ID NO: 431479 - DNA, 25 bp, Homo sapien
acctctggttggttgcatcagatcc

SEQ ID NO: 431480 - DNA, 25 bp, Homo sapien
gttgcatcagatcccacatcaagac

SEQ ID NO: 431481 - DNA, 25 bp, Homo sapien
gatcccacatcaagactaaacccaa

SEQ ID NO: 431482 - DNA, 25 bp, Homo sapien
gatccccacaatttcttgtgattgg

SEQ ID NO: 431483 - DNA, 25 bp, Homo sapien
atttcttgtgattggtgaggaacta

SEQ ID NO: 431484 - DNA, 25 bp, Homo sapien
gaggaactataaatgactcccatcc

SEQ ID NO: 431485 - DNA, 25 bp, Homo sapien
gcttaacaagccctgaataacataa

SEQ ID NO: 431486 - DNA, 25 bp, Homo sapien
aaatgaggtactcatacatatctcc

SEQ ID NO: 431487 - DNA, 25 bp, Homo sapien
atgcttggagacatcttaagtctca

SEQ ID NO: 431488 - DNA, 25 bp, Homo sapien
tatctcctacatttgttataggttt

SEQ ID NO: 431489 - DNA, 25 bp, Homo sapien
gcaattcacgtagcacagggcatat

SEQ ID NO: 431490 - DNA, 25 bp, Homo sapien
aatagctagctcttattgagtctct

SEQ ID NO: 431491 - DNA, 25 bp, Homo sapien
cttaagtctcagcttaaatcctttc

SEQ ID NO: 431492 - DNA, 25 bp, Homo sapien
tattgagtctctgcttcatgctaag

SEQ ID NO: 431493 - DNA, 25 bp, Homo sapien
ctctgcttcatgctaagtgcttcac

SEQ ID NO: 431494 - DNA, 25 bp, Homo sapien
attttggctgttagtccttctggaa

SEQ ID NO: 431495 - DNA, 25 bp, Homo sapien
tagtccttctggaagctgctactgt

SEQ ID NO: 431496 - DNA, 25 bp, Homo sapien
tctggaagctgctactgtctcagga

SEQ ID NO: 431497 - DNA, 25 bp, Homo sapien
ttgattttgctcctcttactctctt

SEQ ID NO: 431498 - DNA, 25 bp, Homo sapien
tcttactctcttctctgaggcagta

SEQ ID NO: 431499 - DNA, 25 bp, Homo sapien
tctcttctctgaggcagtatcatga

SEQ ID NO: 431500 - DNA, 25 bp, Homo sapien
ggttgtaaatagaccttctctctct

SEQ ID NO: 431501 - DNA, 25 bp, Homo sapien
ttgcatccatcatctgccgtcacaa

SEQ ID NO: 431502 - DNA, 25 bp, Homo sapien
atcatctgccgtcacaaaggaaagt

SEQ ID NO: 431503 - DNA, 25 bp, Homo sapien
aagtagccaaggatgacacctgtgt

SEQ ID NO: 431504 - DNA, 25 bp, Homo sapien
ctgtgtagtagaggttctgcattca

SEQ ID NO: 431505 - DNA, 25 bp, Homo sapien
ggaatcatctatattttgtgtaggc

SEQ ID NO: 431506 - DNA, 25 bp, Homo sapien
ttgtgtaggcagatcaattccattt

SEQ ID NO: 431507 - DNA, 25 bp, Homo sapien
ggcagatcaattccattttactatt

SEQ ID NO: 431508 - DNA, 25 bp, Homo sapien
gataatagtatcttgcatctgaata

SEQ ID NO: 431509 - DNA, 25 bp, Homo sapien
gacaaatgcttgtgcaatattgcca

SEQ ID NO: 431510 - DNA, 25 bp, Homo sapien
tgaaaattccggacacttgcctttt

SEQ ID NO: 431511 - DNA, 25 bp, Homo sapien
ttggtgctgattaacaatatgtatg

SEQ ID NO: 431512 - DNA, 25 bp, Homo sapien
aagctgaatatttctacattgtaaa

SEQ ID NO: 431513 - DNA, 25 bp, Homo sapien
aaacccagtaattcaactcctagat

SEQ ID NO: 431514 - DNA, 25 bp, Homo sapien
atatgtatgaatgtggcctttgccc

SEQ ID NO: 431515 - DNA, 25 bp, Homo sapien
ggcctttgccctgaagctattatat

SEQ ID NO: 431516 - DNA, 25 bp, Homo sapien
atatgtaaccagaccccgctatggt

SEQ ID NO: 431517 - DNA, 25 bp, Homo sapien
cagaccccgctatggtcagagaata

SEQ ID NO: 431518 - DNA, 25 bp, Homo sapien
gctatggtcagagaatatccacaaa

SEQ ID NO: 431519 - DNA, 25 bp, Homo sapien
tgtccgtgcaggaattggactccga

SEQ ID NO: 431520 - DNA, 25 bp, Homo sapien
actccgaggagggttacagtatctc

SEQ ID NO: 431521 - DNA, 25 bp, Homo sapien
tacagtatctcctgacgggacctgc

SEQ ID NO: 431522 - DNA, 25 bp, Homo sapien
gccactcgcatctgggcaatgttga

SEQ ID NO: 431523 - DNA, 25 bp, Homo sapien
gcatctgggcaatgttgacatttga

SEQ ID NO: 431524 - DNA, 25 bp, Homo sapien
ggatgcctgccttctaatatatttg

SEQ ID NO: 431525 - DNA, 25 bp, Homo sapien
atatatttgggtgagtaactgagcc

SEQ ID NO: 431526 - DNA, 25 bp, Homo sapien
actgagccagccaagggaaggttga

SEQ ID NO: 431527 - DNA, 25 bp, Homo sapien
gggattcttggtaaactgaagactt

SEQ ID NO: 431528 - DNA, 25 bp, Homo sapien
aaatctcttcatcgttgaactgtgc

SEQ ID NO: 431529 - DNA, 25 bp, Homo sapien
tgaactgtgcattttccctgcattt

SEQ ID NO: 431530 - DNA, 25 bp, Homo sapien
aataaaaatcccaggcctatgttct

SEQ ID NO: 431531 - DNA, 25 bp, Homo sapien
aaatcccaggcctatgttctatgtg

SEQ ID NO: 431532 - DNA, 25 bp, Homo sapien
caggcctatgttctatgtggatgtg

SEQ ID NO: 431533 - DNA, 25 bp, Homo sapien
gtgtggtatgggaatcacatgctga

SEQ ID NO: 431534 - DNA, 25 bp, Homo sapien
gggacagaaccattgaaacctatag

SEQ ID NO: 431535 - DNA, 25 bp, Homo sapien
gaaacctatagaatctcagcaaaag

SEQ ID NO: 431536 - DNA, 25 bp, Homo sapien
gcaatacatttttatgatccagggt

SEQ ID NO: 431537 - DNA, 25 bp, Homo sapien
gatccagggtaatggaaccccacag

SEQ ID NO: 431538 - DNA, 25 bp, Homo sapien
tagtaacttctcttgtccattaaaa

SEQ ID NO: 431539 - DNA, 25 bp, Homo sapien
gcttatgttgtctctggaaccacaa

SEQ ID NO: 431540 - DNA, 25 bp, Homo sapien
gttgtctctggaaccacaaggagaa

SEQ ID NO: 431541 - DNA, 25 bp, Homo sapien
tgggtctcaccctgctatcatatct

SEQ ID NO: 431542 - DNA, 25 bp, Homo sapien
tctcaccctgctatcatatcttaag

SEQ ID NO: 431543 - DNA, 25 bp, Homo sapien
gctatcatatcttaaggccttgcag

SEQ ID NO: 431544 - DNA, 25 bp, Homo sapien
atcatatcttaaggccttgcagaaa

SEQ ID NO: 431545 - DNA, 25 bp, Homo sapien
cttaaggccttgcagaaaccaggat

SEQ ID NO: 431546 - DNA, 25 bp, Homo sapien
gaaagctccttgagggaagggccct

SEQ ID NO: 431547 - DNA, 25 bp, Homo sapien
agggaagggccctcagtgctgctct

SEQ ID NO: 431548 - DNA, 25 bp, Homo sapien
aagggccctcagtgctgctctgatc

SEQ ID NO: 431549 - DNA, 25 bp, Homo sapien
gcatgtgagaaaaccacactcttcc

SEQ ID NO: 431550 - DNA, 25 bp, Homo sapien
acactcttcctcagcctattatagt

SEQ ID NO: 431551 - DNA, 25 bp, Homo sapien
ctcttcctcagcctattatagttta

SEQ ID NO: 431552 - DNA, 25 bp, Homo sapien
ctagcagtcctggagttgtgctcat

SEQ ID NO: 431553 - DNA, 25 bp, Homo sapien
tcctggagttgtgctcatggagact

SEQ ID NO: 431554 - DNA, 25 bp, Homo sapien
acaaggacagcgttgtattgacaaa

SEQ ID NO: 431555 - DNA, 25 bp, Homo sapien
aaaatttcagccctcagtctagtct

SEQ ID NO: 431556 - DNA, 25 bp, Homo sapien
ctcagtctagtcttgtaaacgatag

SEQ ID NO: 431557 - DNA, 25 bp, Homo sapien
gatcaggagtgtacttaaccgtcgt

SEQ ID NO: 431558 - DNA, 25 bp, Homo sapien
ttaaccgtcgttactttgatccagc

SEQ ID NO: 431559 - DNA, 25 bp, Homo sapien
ttgatccagccctaggtttcccttt

SEQ ID NO: 431560 - DNA, 25 bp, Homo sapien
gtggagatcgggaattccagccaaa

SEQ ID NO: 431561 - DNA, 25 bp, Homo sapien
tcgggaattccagccaaagagaaat

SEQ ID NO: 431562 - DNA, 25 bp, Homo sapien
ggagaaaattcccactctagcagtc

SEQ ID NO: 431563 - DNA, 25 bp, Homo sapien
cactgggatcctccacatgagtgtg

SEQ ID NO: 431564 - DNA, 25 bp, Homo sapien
ttccagggtcacactgaggcaggac

SEQ ID NO: 431565 - DNA, 25 bp, Homo sapien
aggacattttttgccaatgcctgtt

SEQ ID NO: 431566 - DNA, 25 bp, Homo sapien
ctgttaccccatggaaggctgaggt

SEQ ID NO: 431567 - DNA, 25 bp, Homo sapien
ggtacggatgcacctgatctggaaa

SEQ ID NO: 431568 - DNA, 25 bp, Homo sapien
gtcagactccacatttctgcaacaa

SEQ ID NO: 431569 - DNA, 25 bp, Homo sapien
aagcatcacctgcaatgactctttt

SEQ ID NO: 431570 - DNA, 25 bp, Homo sapien
aaaggacagaaccagcttccgtgtt

SEQ ID NO: 431571 - DNA, 25 bp, Homo sapien
gcttccgtgttttaggctcactaga

SEQ ID NO: 431572 - DNA, 25 bp, Homo sapien
tgctccccatggctattctgtttgg

SEQ ID NO: 431573 - DNA, 25 bp, Homo sapien
gaatttgatctaacccgaagcctaa

SEQ ID NO: 431574 - DNA, 25 bp, Homo sapien
gagaatcatgaaattggtctattca

SEQ ID NO: 431575 - DNA, 25 bp, Homo sapien
attggtctattcaaaggatggagtt

SEQ ID NO: 431576 - DNA, 25 bp, Homo sapien
ggagttgagtccattctgttattgt

SEQ ID NO: 431577 - DNA, 25 bp, Homo sapien
gagtccattctgttattgttgcaag

SEQ ID NO: 431578 - DNA, 25 bp, Homo sapien
ttctgttattgttgcaagaggttgc

SEQ ID NO: 431579 - DNA, 25 bp, Homo sapien
ggttgcatatttggtgagtcagtta

SEQ ID NO: 431580 - DNA, 25 bp, Homo sapien
gcatatttggtgagtcagttatata

SEQ ID NO: 431581 - DNA, 25 bp, Homo sapien
atatgatacttctcataatctattt

SEQ ID NO: 431582 - DNA, 25 bp, Homo sapien
aatctattttatcatgtgtataaca

SEQ ID NO: 431583 - DNA, 25 bp, Homo sapien
gtgtataacattcaaactgacaaat

SEQ ID NO: 431584 - DNA, 25 bp, Homo sapien
aaggtgtcaaaaaactggcacatca

SEQ ID NO: 431585 - DNA, 25 bp, Homo sapien
ggagcagatacttttaatgttctta

SEQ ID NO: 431586 - DNA, 25 bp, Homo sapien
tgttcttaccattgaatatgccatt

SEQ ID NO: 431587 - DNA, 25 bp, Homo sapien
atatgatttttgtccagctctctaa

SEQ ID NO: 431588 - DNA, 25 bp, Homo sapien
tgtccagctctctaaattgtcatct

SEQ ID NO: 431589 - DNA, 25 bp, Homo sapien
gctctctaaattgtcatctccaata

SEQ ID NO: 431590 - DNA, 25 bp, Homo sapien
aatagtaaccacattactggtaagt

SEQ ID NO: 431591 - DNA, 25 bp, Homo sapien
gatggtggctacacccctactaaga

SEQ ID NO: 431592 - DNA, 25 bp, Homo sapien
ccctactaagactgccttaccagat

SEQ ID NO: 431593 - DNA, 25 bp, Homo sapien
aagactgccttaccagataaatgaa

SEQ ID NO: 431594 - DNA, 25 bp, Homo sapien
gccttaccagataaatgaaatcctt

SEQ ID NO: 431595 - DNA, 25 bp, Homo sapien
aatcctttttgtattaggcacaaca

SEQ ID NO: 431596 - DNA, 25 bp, Homo sapien
gacagccttctagtagaatctctgg

SEQ ID NO: 431597 - DNA, 25 bp, Homo sapien
gccttctagtagaatctctggaatt

SEQ ID NO: 431598 - DNA, 25 bp, Homo sapien
atctctggaattgtgcatgtgagtg

SEQ ID NO: 431599 - DNA, 25 bp, Homo sapien
tgacctccccagttgcgtcaggtgc

SEQ ID NO: 431600 - DNA, 25 bp, Homo sapien
agttgcgtcaggtgccctctctgtg

SEQ ID NO: 431601 - DNA, 25 bp, Homo sapien
gtagcactcccctttctgtgatgaa

SEQ ID NO: 431602 - DNA, 25 bp, Homo sapien
ttctgtgatgaaacattgtgttgat

SEQ ID NO: 431603 - DNA, 25 bp, Homo sapien
tgtgttgatatgtctgttgcctgcc

SEQ ID NO: 431604 - DNA, 25 bp, Homo sapien
tgatatgtctgttgcctgccctgga

SEQ ID NO: 431605 - DNA, 25 bp, Homo sapien
atgtctgttgcctgccctggactgt

SEQ ID NO: 431606 - DNA, 25 bp, Homo sapien
aggctatgccatctttctctgatct

SEQ ID NO: 431607 - DNA, 25 bp, Homo sapien
cttttccccacatgtacaatgacaa

SEQ ID NO: 431608 - DNA, 25 bp, Homo sapien
atgccttcaacctatttgatccagc

SEQ ID NO: 431609 - DNA, 25 bp, Homo sapien
ttgatccagccgttccagtacaact

SEQ ID NO: 431610 - DNA, 25 bp, Homo sapien
gtacaactcctatacttgccatctt

SEQ ID NO: 431611 - DNA, 25 bp, Homo sapien
ttgccatctttccaagcccaaaggt

SEQ ID NO: 431612 - DNA, 25 bp, Homo sapien
agcccaaaggtacatccagctgatg

SEQ ID NO: 431613 - DNA, 25 bp, Homo sapien
ggagcatcttggtgttaatattctt

SEQ ID NO: 431614 - DNA, 25 bp, Homo sapien
aatattcttttagtcatggtctctg

SEQ ID NO: 431615 - DNA, 25 bp, Homo sapien
attctggcacaatcttatctagcta

SEQ ID NO: 431616 - DNA, 25 bp, Homo sapien
atctagctatagttcctcatggtcc

SEQ ID NO: 431617 - DNA, 25 bp, Homo sapien
atggtcctgcactccatggactaaa

SEQ ID NO: 431618 - DNA, 25 bp, Homo sapien
cgtgtaaagcttggttaacctgtat

SEQ ID NO: 431619 - DNA, 25 bp, Homo sapien
ggttaacctgtatatagatagctta

SEQ ID NO: 431620 - DNA, 25 bp, Homo sapien
gttatagtgtatttagggttgcctg

SEQ ID NO: 431621 - DNA, 25 bp, Homo sapien
gggttgcctgtaatatttaagcttc

SEQ ID NO: 431622 - DNA, 25 bp, Homo sapien
gcttctttactgatgtgtgtgctgg

SEQ ID NO: 431623 - DNA, 25 bp, Homo sapien
gtgctggtaggaacatataattttt

SEQ ID NO: 431624 - DNA, 25 bp, Homo sapien
atttactgagatgttgcctttttta

SEQ ID NO: 431625 - DNA, 25 bp, Homo sapien
ttttgcttccgtgaggattaatttg

SEQ ID NO: 431626 - DNA, 25 bp, Homo sapien
taatgacattccactgatttcagat

SEQ ID NO: 431627 - DNA, 25 bp, Homo sapien
cagattttgcttgagattgacttca

SEQ ID NO: 431628 - DNA, 25 bp, Homo sapien
ttcaataaattgtcctgtatgttcc

SEQ ID NO: 431629 - DNA, 25 bp, Homo sapien
acaagttatcttacaatagcagttc

SEQ ID NO: 431630 - DNA, 25 bp, Homo sapien
gttatcttacaatagcagttctcaa

SEQ ID NO: 431631 - DNA, 25 bp, Homo sapien
ttacaatagcagttctcaatcaggg

SEQ ID NO: 431632 - DNA, 25 bp, Homo sapien
ggattgccactggtgtctagtggat

SEQ ID NO: 431633 - DNA, 25 bp, Homo sapien
ctggtgtctagtggataaaggctga

SEQ ID NO: 431634 - DNA, 25 bp, Homo sapien
ataaaggctgagatgttgctaaaca

SEQ ID NO: 431635 - DNA, 25 bp, Homo sapien
gatgttgctaaacagctcacggcct

SEQ ID NO: 431636 - DNA, 25 bp, Homo sapien
tgttgctaaacagctcacggcctta

SEQ ID NO: 431637 - DNA, 25 bp, Homo sapien
tgctaaacagctcacggccttatga

SEQ ID NO: 431638 - DNA, 25 bp, Homo sapien
ctaaacagctcacggccttatgaca

SEQ ID NO: 431639 - DNA, 25 bp, Homo sapien
aacagctcacggccttatgacaaag

SEQ ID NO: 431640 - DNA, 25 bp, Homo sapien
ggaggtagatcccaccattttatgg

SEQ ID NO: 431641 - DNA, 25 bp, Homo sapien
gtagatcccaccattttatgggtga

SEQ ID NO: 431642 - DNA, 25 bp, Homo sapien
atgggtgaatggcaaaatcaaacag

SEQ ID NO: 431643 - DNA, 25 bp, Homo sapien
gcaggcatctttggaaacattctac

SEQ ID NO: 431644 - DNA, 25 bp, Homo sapien
ggaaacattctacttagctaatttt

SEQ ID NO: 431645 - DNA, 25 bp, Homo sapien
tagctaattttatgctaggctttag

SEQ ID NO: 431646 - DNA, 25 bp, Homo sapien
gagagagctgacatgctgtggtaca

SEQ ID NO: 431647 - DNA, 25 bp, Homo sapien
gagctgacatgctgtggtacacact

SEQ ID NO: 431648 - DNA, 25 bp, Homo sapien
ctgacatgctgtggtacacacttat

SEQ ID NO: 431649 - DNA, 25 bp, Homo sapien
tttgaggtagtgtgcgatgatcgtt

SEQ ID NO: 431650 - DNA, 25 bp, Homo sapien
gcgatgatcgttcttgtgaatagcc

SEQ ID NO: 431651 - DNA, 25 bp, Homo sapien
ttggcatttaatgttcctctcctgg

SEQ ID NO: 431652 - DNA, 25 bp, Homo sapien
ttaatgttcctctcctggcaaaaat

SEQ ID NO: 431653 - DNA, 25 bp, Homo sapien
ggcaaaaattcactgccacagacaa

SEQ ID NO: 431654 - DNA, 25 bp, Homo sapien
cagccagccctcaaaacacaaagga

SEQ ID NO: 431655 - DNA, 25 bp, Homo sapien
aaggaacaaagacagtccactcaga

SEQ ID NO: 431656 - DNA, 25 bp, Homo sapien
atcttgaagtcgtgagtgaagctgc

SEQ ID NO: 431657 - DNA, 25 bp, Homo sapien
ggttggcttgactgggctcagccac

SEQ ID NO: 431658 - DNA, 25 bp, Homo sapien
tgagctgcctcaaccggccaaggaa

SEQ ID NO: 431659 - DNA, 25 bp, Homo sapien
cgggattatgatgactatgcggact

SEQ ID NO: 431660 - DNA, 25 bp, Homo sapien
tatgcggacttctatattgtcttca

SEQ ID NO: 431661 - DNA, 25 bp, Homo sapien
attgtcttcatctcattgtgtgtat

SEQ ID NO: 431662 - DNA, 25 bp, Homo sapien
cactaagttaatataatggagcaga

SEQ ID NO: 431663 - DNA, 25 bp, Homo sapien
atacttttaatgttcttaccattga

SEQ ID NO: 431664 - DNA, 25 bp, Homo sapien
tgttcttaccattgaatatgccatt

SEQ ID NO: 431665 - DNA, 25 bp, Homo sapien
gccatttaagtttgttatacttgaa

SEQ ID NO: 431666 - DNA, 25 bp, Homo sapien
attatatgatttttgtccagctctc

SEQ ID NO: 431667 - DNA, 25 bp, Homo sapien
tatgatttttgtccagctctctaaa

SEQ ID NO: 431668 - DNA, 25 bp, Homo sapien
gatttttgtccagctctctaaattg

SEQ ID NO: 431669 - DNA, 25 bp, Homo sapien
tttgtccagctctctaaattgtcat

SEQ ID NO: 431670 - DNA, 25 bp, Homo sapien
tgtccagctctctaaattgtcatct

SEQ ID NO: 431671 - DNA, 25 bp, Homo sapien
cagctctctaaattgtcatctccaa

SEQ ID NO: 431672 - DNA, 25 bp, Homo sapien
ctaaattgtcatctccaatagattt

SEQ ID NO: 431673 - DNA, 25 bp, Homo sapien
gctggctggttctagagagatcatt

SEQ ID NO: 431674 - DNA, 25 bp, Homo sapien
gagatcatttggtctcaccattgcc

SEQ ID NO: 431675 - DNA, 25 bp, Homo sapien
gttgcctttgatttgtaagtccctt

SEQ ID NO: 431676 - DNA, 25 bp, Homo sapien
tgagcttggccggtccactcaacat

SEQ ID NO: 431677 - DNA, 25 bp, Homo sapien
aagtccctttgagagcaagttcttg

SEQ ID NO: 431678 - DNA, 25 bp, Homo sapien
caagttcttgtgtggttccttggtt

SEQ ID NO: 431679 - DNA, 25 bp, Homo sapien
acaggaaccacatcttgcccttagt

SEQ ID NO: 431680 - DNA, 25 bp, Homo sapien
atcttgcccttagtgcgggcttaat

SEQ ID NO: 431681 - DNA, 25 bp, Homo sapien
caaatctggtgtggaggagcatgct

SEQ ID NO: 431682 - DNA, 25 bp, Homo sapien
atgctggctctccatgcacatagtg

SEQ ID NO: 431683 - DNA, 25 bp, Homo sapien
gcacatagtgctggctggttctaga

SEQ ID NO: 431684 - DNA, 25 bp, Homo sapien
gcatcaaatcttgaagtcgtgagtg

SEQ ID NO: 431685 - DNA, 25 bp, Homo sapien
atcttgaagtcgtgagtgaagctgc

SEQ ID NO: 431686 - DNA, 25 bp, Homo sapien
gtgaagctgcgggttggcttgactg

SEQ ID NO: 431687 - DNA, 25 bp, Homo sapien
gttggcttgactgggctcagccact

SEQ ID NO: 431688 - DNA, 25 bp, Homo sapien
tgagctgcctcaaccggccaaggaa

SEQ ID NO: 431689 - DNA, 25 bp, Homo sapien
accggccaaggaacgggattatgat

SEQ ID NO: 431690 - DNA, 25 bp, Homo sapien
gattatgatgactatgcggacttct

SEQ ID NO: 431691 - DNA, 25 bp, Homo sapien
gatgactatgcggacttctatattg

SEQ ID NO: 431692 - DNA, 25 bp, Homo sapien
gcggacttctatattgtcttcatct

SEQ ID NO: 431693 - DNA, 25 bp, Homo sapien
atattgtcttcatctcattgtgtgt

SEQ ID NO: 431694 - DNA, 25 bp, Homo sapien
gtcttcatctcattgtgtgtattat

SEQ ID NO: 431695 - DNA, 25 bp, Homo sapien
tcagagatcagtaccgctgccgccg

SEQ ID NO: 431696 - DNA, 25 bp, Homo sapien
ttgacctcactacatctgctttcca

SEQ ID NO: 431697 - DNA, 25 bp, Homo sapien
gccatgagggcagtgctgatcccaa

SEQ ID NO: 431698 - DNA, 25 bp, Homo sapien
ggcagtgctgatcccaattcgagag

SEQ ID NO: 431699 - DNA, 25 bp, Homo sapien
aattcgagaggttctgaccccagaa

SEQ ID NO: 431700 - DNA, 25 bp, Homo sapien
aggttctgaccccagaatcggacat

SEQ ID NO: 431701 - DNA, 25 bp, Homo sapien
cagaatcggacatctccattgcaca

SEQ ID NO: 431702 - DNA, 25 bp, Homo sapien
atctccattgcacacgttctggctg

SEQ ID NO: 431703 - DNA, 25 bp, Homo sapien
ctgctgtgccatcaacaaggtgctt

SEQ ID NO: 431704 - DNA, 25 bp, Homo sapien
caaggtgcttatgggcaacgttcca

SEQ ID NO: 431705 - DNA, 25 bp, Homo sapien
cttatgggcaacgttccagaccggg

SEQ ID NO: 431706 - DNA, 25 bp, Homo sapien
tcagggccagcctgtgacagggtac

SEQ ID NO: 431707 - DNA, 25 bp, Homo sapien
acagggtacccacaggatggttcat

SEQ ID NO: 431708 - DNA, 25 bp, Homo sapien
agctcctgccagttttaacttgtgt

SEQ ID NO: 431709 - DNA, 25 bp, Homo sapien
ttaacttgtgtttaattcctggcac

SEQ ID NO: 431710 - DNA, 25 bp, Homo sapien
taattcctggcacagttgtcctgga

SEQ ID NO: 431711 - DNA, 25 bp, Homo sapien
gcacagttgtcctggaaatgccttt

SEQ ID NO: 431712 - DNA, 25 bp, Homo sapien
tttttctcttgcctgggaaccacta

SEQ ID NO: 431713 - DNA, 25 bp, Homo sapien
ggccagggccatgcaaattcaacat

SEQ ID NO: 431714 - DNA, 25 bp, Homo sapien
aattcaacatcttgtttctgccctt

SEQ ID NO: 431715 - DNA, 25 bp, Homo sapien
ccccgtgtagctgaggctaggtgtt

SEQ ID NO: 431716 - DNA, 25 bp, Homo sapien
taggtgttggcattacccagtgctt

SEQ ID NO: 431717 - DNA, 25 bp, Homo sapien
tatgcgtgcatatacaaccaagtgg

SEQ ID NO: 431718 - DNA, 25 bp, Homo sapien
gggtagacctaggtgttctctcaga

SEQ ID NO: 431719 - DNA, 25 bp, Homo sapien
gcgtgcgcgtgtgcctagaatatat

SEQ ID NO: 431720 - DNA, 25 bp, Homo sapien
ctctcagaggagattctgttgcttt

SEQ ID NO: 431721 - DNA, 25 bp, Homo sapien
tgttttgtgattagttcgccccttc

SEQ ID NO: 431722 - DNA, 25 bp, Homo sapien
ccaccccttaccagatgttaagcag

SEQ ID NO: 431723 - DNA, 25 bp, Homo sapien
ttctctgtactagttctggtctcct

SEQ ID NO: 431724 - DNA, 25 bp, Homo sapien
tggtctccttttgactggactgtgg

SEQ ID NO: 431725 - DNA, 25 bp, Homo sapien
actggactgtggctctgaaccttga

SEQ ID NO: 431726 - DNA, 25 bp, Homo sapien
ttgagcatagtaccacggactccgt

SEQ ID NO: 431727 - DNA, 25 bp, Homo sapien
actccgtgggcgctcaataaacaca

SEQ ID NO: 431728 - DNA, 25 bp, Homo sapien
agagaggtttgtcccatatatcttg

SEQ ID NO: 431729 - DNA, 25 bp, Homo sapien
gtttgtcccatatatcttgttccag

SEQ ID NO: 431730 - DNA, 25 bp, Homo sapien
catatatcttgttccagcagccata

SEQ ID NO: 431731 - DNA, 25 bp, Homo sapien
tatcttgttccagcagccatatatc

SEQ ID NO: 431732 - DNA, 25 bp, Homo sapien
agcagccatatatcttgtggtctac

SEQ ID NO: 431733 - DNA, 25 bp, Homo sapien
atatcttgtggtctacagcctgaag

SEQ ID NO: 431734 - DNA, 25 bp, Homo sapien
ttgtggtctacagcctgaagcatga

SEQ ID NO: 431735 - DNA, 25 bp, Homo sapien
tgaagcatgatttcccttgaagtct

SEQ ID NO: 431736 - DNA, 25 bp, Homo sapien
gcatgatttcccttgaagtcttggg

SEQ ID NO: 431737 - DNA, 25 bp, Homo sapien
agtcccttcaatataaaacctctga

SEQ ID NO: 431738 - DNA, 25 bp, Homo sapien
gagaatggctcactaatgtgaacaa

SEQ ID NO: 431739 - DNA, 25 bp, Homo sapien
caaaagtctcaaaagctggcatttc

SEQ ID NO: 431740 - DNA, 25 bp, Homo sapien
gctggcatttcaacccctaaataat

SEQ ID NO: 431741 - DNA, 25 bp, Homo sapien
aatatagtctgggagcttgaggcca

SEQ ID NO: 431742 - DNA, 25 bp, Homo sapien
ggagcttgaggccagtctgcaataa

SEQ ID NO: 431743 - DNA, 25 bp, Homo sapien
gaggccagtctgcaataaatctaat

SEQ ID NO: 431744 - DNA, 25 bp, Homo sapien
atgggtgggttaaatgtcttctcta

SEQ ID NO: 431745 - DNA, 25 bp, Homo sapien
gggttaaatgtcttctctaggtcta

SEQ ID NO: 431746 - DNA, 25 bp, Homo sapien
taaatgtcttctctaggtctataat

SEQ ID NO: 431747 - DNA, 25 bp, Homo sapien
ataattgcaacagttatccaaaata

SEQ ID NO: 431748 - DNA, 25 bp, Homo sapien
tttttaaactgacaatttctcctag

SEQ ID NO: 431749 - DNA, 25 bp, Homo sapien
aatttctcctagtgagcccatgatt

SEQ ID NO: 431750 - DNA, 25 bp, Homo sapien
cagctctctacacctctatatatta

SEQ ID NO: 431751 - DNA, 25 bp, Homo sapien
gctctctacacctctatatattata

SEQ ID NO: 431752 - DNA, 25 bp, Homo sapien
actcttacccaatttctgggctctg

SEQ ID NO: 431753 - DNA, 25 bp, Homo sapien
ttacccaatttctgggctctggatc

SEQ ID NO: 431754 - DNA, 25 bp, Homo sapien
gctctggatcctcacagtcatggag

SEQ ID NO: 431755 - DNA, 25 bp, Homo sapien
tcacagtcatggaggcaccgtgggc

SEQ ID NO: 431756 - DNA, 25 bp, Homo sapien
ggcctggcacttgcaaaagtgtggc

SEQ ID NO: 431757 - DNA, 25 bp, Homo sapien
acttgcaaaagtgtggcccctcact

SEQ ID NO: 431758 - DNA, 25 bp, Homo sapien
aaagtgtggcccctcactctagtgt

SEQ ID NO: 431759 - DNA, 25 bp, Homo sapien
gtggcccctcactctagtgtgtggt

SEQ ID NO: 431760 - DNA, 25 bp, Homo sapien
tctagtgtgtggtccctctcagggt

SEQ ID NO: 431761 - DNA, 25 bp, Homo sapien
ataaatgtgcagaaccaaggctgaa

SEQ ID NO: 431762 - DNA, 25 bp, Homo sapien
tgatgtcatggagcacagtgatctt

SEQ ID NO: 431763 - DNA, 25 bp, Homo sapien
acagtgatcttccatagcttcttta

SEQ ID NO: 431764 - DNA, 25 bp, Homo sapien
ccatagcttctttatcatttgtcct

SEQ ID NO: 431765 - DNA, 25 bp, Homo sapien
gaattcaccatgataaccactttca

SEQ ID NO: 431766 - DNA, 25 bp, Homo sapien
tgtcctattaaagggcatgtagcta

SEQ ID NO: 431767 - DNA, 25 bp, Homo sapien
gtatgttgtcactttctgtacaggt

SEQ ID NO: 431768 - DNA, 25 bp, Homo sapien
gtcactttctgtacaggtctgatat

SEQ ID NO: 431769 - DNA, 25 bp, Homo sapien
ctttcaacccagatactccttaata

SEQ ID NO: 431770 - DNA, 25 bp, Homo sapien
aaacaactgtatttccctgtctttg

SEQ ID NO: 431771 - DNA, 25 bp, Homo sapien
gtatttccctgtctttgtaatttat

SEQ ID NO: 431772 - DNA, 25 bp, Homo sapien
ggcagtgacaattctgaggtggttt

SEQ ID NO: 431773 - DNA, 25 bp, Homo sapien
tattgggagtccttctacatttctc

SEQ ID NO: 431774 - DNA, 25 bp, Homo sapien
ttagataactctgcactctgggtgg

SEQ ID NO: 431775 - DNA, 25 bp, Homo sapien
ctgcactctgggtggctattgtgta

SEQ ID NO: 431776 - DNA, 25 bp, Homo sapien
gccccagagtgcctgttagccaaat

SEQ ID NO: 431777 - DNA, 25 bp, Homo sapien
ctgttagccaaatatttcccctctg

SEQ ID NO: 431778 - DNA, 25 bp, Homo sapien
tcccctctgataggaatattttcta

SEQ ID NO: 431779 - DNA, 25 bp, Homo sapien
agctgataacttgcgtgctggacct

SEQ ID NO: 431780 - DNA, 25 bp, Homo sapien
tgctggaccttgttatctgtgcccc

SEQ ID NO: 431781 - DNA, 25 bp, Homo sapien
tgggagacacacgttttcttggttt

SEQ ID NO: 431782 - DNA, 25 bp, Homo sapien
aacacaggcaactttacattttggg

SEQ ID NO: 431783 - DNA, 25 bp, Homo sapien
tctcgccatagcctattggattgct

SEQ ID NO: 431784 - DNA, 25 bp, Homo sapien
atagcctattggattgctccgtgca

SEQ ID NO: 431785 - DNA, 25 bp, Homo sapien
agcctattggattgctccgtgcagc

SEQ ID NO: 431786 - DNA, 25 bp, Homo sapien
ctattggattgctccgtgcagcaag

SEQ ID NO: 431787 - DNA, 25 bp, Homo sapien
tgtggtatgaaaatctctcaggctt

SEQ ID NO: 431788 - DNA, 25 bp, Homo sapien
gaaaatctctcaggcttacgtcaac

SEQ ID NO: 431789 - DNA, 25 bp, Homo sapien
aatctctcaggcttacgtcaacagt

SEQ ID NO: 431790 - DNA, 25 bp, Homo sapien
tctcaggcttacgtcaacagtctat

SEQ ID NO: 431791 - DNA, 25 bp, Homo sapien
ggcttacgtcaacagtctatcgctg

SEQ ID NO: 431792 - DNA, 25 bp, Homo sapien
ttggagtctccataggcctcccttt

SEQ ID NO: 431793 - DNA, 25 bp, Homo sapien
cttttctcgccatagcctattggat

SEQ ID NO: 431794 - DNA, 25 bp, Homo sapien
accacaggttgttagcagatgcttt

SEQ ID NO: 431795 - DNA, 25 bp, Homo sapien
tagcagatgctttttgtcctgaagg

SEQ ID NO: 431796 - DNA, 25 bp, Homo sapien
gtcctgaaggataatactaacaatt

SEQ ID NO: 431797 - DNA, 25 bp, Homo sapien
actaacaattatatctaccgaaatg

SEQ ID NO: 431798 - DNA, 25 bp, Homo sapien
gaagtgacccaatcttaagctacta

SEQ ID NO: 431799 - DNA, 25 bp, Homo sapien
gacccaatcttaagctactactaat

SEQ ID NO: 431800 - DNA, 25 bp, Homo sapien
acagatttattgtattttaatgcca

SEQ ID NO: 431801 - DNA, 25 bp, Homo sapien
gaatgactattgtaagggcagttga

SEQ ID NO: 431802 - DNA, 25 bp, Homo sapien
tgagtttttgatgtcacctcccaaa

SEQ ID NO: 431803 - DNA, 25 bp, Homo sapien
gtcacctcccaaactttgcaagtaa

SEQ ID NO: 431804 - DNA, 25 bp, Homo sapien
gtaacaactttttaggaggtcaatg

SEQ ID NO: 431805 - DNA, 25 bp, Homo sapien
ggaagccctgaaatgaattcaacaa

SEQ ID NO: 431806 - DNA, 25 bp, Homo sapien
tattcatcgcacttcttctgtggaa

SEQ ID NO: 431807 - DNA, 25 bp, Homo sapien
gctggattagtggatgttgctatct

SEQ ID NO: 431808 - DNA, 25 bp, Homo sapien
gatgttgctatctgggttggcactt

SEQ ID NO: 431809 - DNA, 25 bp, Homo sapien
ggttggcacttgttcagattaccca

SEQ ID NO: 431810 - DNA, 25 bp, Homo sapien
gattacccaaaaggagatgcttcta

SEQ ID NO: 431811 - DNA, 25 bp, Homo sapien
agatgcttctactggatggaattca

SEQ ID NO: 431812 - DNA, 25 bp, Homo sapien
atggaattcagtttctcgcatcatt

SEQ ID NO: 431813 - DNA, 25 bp, Homo sapien
cagtttctcgcatcattattgaaga

SEQ ID NO: 431814 - DNA, 25 bp, Homo sapien
taattttcatttgctacctcttttt

SEQ ID NO: 431815 - DNA, 25 bp, Homo sapien
ttattatgccttggaatggttcact

SEQ ID NO: 431816 - DNA, 25 bp, Homo sapien
aaaaattgcattggccaacttggag

SEQ ID NO: 431817 - DNA, 25 bp, Homo sapien
ggccaacttggaggcttcagtgtta

SEQ ID NO: 431818 - DNA, 25 bp, Homo sapien
gaagaatgttcacttttgtcatcta

SEQ ID NO: 431819 - DNA, 25 bp, Homo sapien
atctaattttacactgctccttcag

SEQ ID NO: 431820 - DNA, 25 bp, Homo sapien
ttacactgctccttcagcaaactga

SEQ ID NO: 431821 - DNA, 25 bp, Homo sapien
cagcaaactgactttatggagagat

SEQ ID NO: 431822 - DNA, 25 bp, Homo sapien
gagagataaccctgtttacctttag

SEQ ID NO: 431823 - DNA, 25 bp, Homo sapien
agttgtggattcctcagtcttactc

SEQ ID NO: 431824 - DNA, 25 bp, Homo sapien
gtcttactcccattactattggtca

SEQ ID NO: 431825 - DNA, 25 bp, Homo sapien
ctattggtcattcaacagcccatct

SEQ ID NO: 431826 - DNA, 25 bp, Homo sapien
ttcaacagcccatcttcccagaagg

SEQ ID NO: 431827 - DNA, 25 bp, Homo sapien
aagaaggttcactgttgaggaaagt

SEQ ID NO: 431828 - DNA, 25 bp, Homo sapien
ggaaagtggcacagggttccataac

SEQ ID NO: 431829 - DNA, 25 bp, Homo sapien
cctgtttataacaagcttagtaaag

SEQ ID NO: 431830 - DNA, 25 bp, Homo sapien
gagagtataggtgtgtagctacaaa

SEQ ID NO: 431831 - DNA, 25 bp, Homo sapien
gtgtagctacaaacaaatcaggaat

SEQ ID NO: 431832 - DNA, 25 bp, Homo sapien
aatcaggaatggctgagagctttgc

SEQ ID NO: 431833 - DNA, 25 bp, Homo sapien
tgcagcactcaccttaacttaaaat

SEQ ID NO: 431834 - DNA, 25 bp, Homo sapien
aaatgtaatgttttagtgcctcagt

SEQ ID NO: 431835 - DNA, 25 bp, Homo sapien
gtaatgttttagtgcctcagtaatt

SEQ ID NO: 431836 - DNA, 25 bp, Homo sapien
gtgcctcagtaattattagcattga

SEQ ID NO: 431837 - DNA, 25 bp, Homo sapien
gcattgatctgagtgctttcatatt

SEQ ID NO: 431838 - DNA, 25 bp, Homo sapien
atggaccctttgttactcaaatttg

SEQ ID NO: 431839 - DNA, 25 bp, Homo sapien
atttgaccaatcttggaagcttgga

SEQ ID NO: 431840 - DNA, 25 bp, Homo sapien
gaagcttggatgtgcactgacttga

SEQ ID NO: 431841 - DNA, 25 bp, Homo sapien
tgcactgacttgacaaccacttttt

SEQ ID NO: 431842 - DNA, 25 bp, Homo sapien
gacaaccactttttgtgggacataa

SEQ ID NO: 431843 - DNA, 25 bp, Homo sapien
gggacataacactctagacacaggt

SEQ ID NO: 431844 - DNA, 25 bp, Homo sapien
gacacaggtgcttctagctctaagg

SEQ ID NO: 431845 - DNA, 25 bp, Homo sapien
ctaatctgtggccaaccaaccaatg

SEQ ID NO: 431846 - DNA, 25 bp, Homo sapien
attaatcagctatgctgcctcggat

SEQ ID NO: 431847 - DNA, 25 bp, Homo sapien
tatgctgcctcggatcttgatcaaa

SEQ ID NO: 431848 - DNA, 25 bp, Homo sapien
ttctaagaaggactgcctgcacaat

SEQ ID NO: 431849 - DNA, 25 bp, Homo sapien
aacctggaagacattatatgtgaaa

SEQ ID NO: 431850 - DNA, 25 bp, Homo sapien
aagtacctagagtagtgtaattcat

SEQ ID NO: 431851 - DNA, 25 bp, Homo sapien
gaaactttttcaatgccgacacgat

SEQ ID NO: 431852 - DNA, 25 bp, Homo sapien
aactttttcaatgccgacacgatgc

SEQ ID NO: 431853 - DNA, 25 bp, Homo sapien
tttttcaatgccgacacgatgctca

SEQ ID NO: 431854 - DNA, 25 bp, Homo sapien
tttcaatgccgacacgatgctcaaa

SEQ ID NO: 431855 - DNA, 25 bp, Homo sapien
caatgccgacacgatgctcaaagaa

SEQ ID NO: 431856 - DNA, 25 bp, Homo sapien
tgccgacacgatgctcaaagaaaat

SEQ ID NO: 431857 - DNA, 25 bp, Homo sapien
gacacgatgctcaaagaaaatgcta

SEQ ID NO: 431858 - DNA, 25 bp, Homo sapien
attctgacatgtgctacaatatgat

SEQ ID NO: 431859 - DNA, 25 bp, Homo sapien
tgacatgtgctacaatatgatgaac

SEQ ID NO: 431860 - DNA, 25 bp, Homo sapien
gggatttgagaggatctaaaactat

SEQ ID NO: 431861 - DNA, 25 bp, Homo sapien
aagtttgtttatattcagaagtctg

SEQ ID NO: 431862 - DNA, 25 bp, Homo sapien
gaagtctgactatgatgaataaatc

SEQ ID NO: 431863 - DNA, 25 bp, Homo sapien
gtagttaagagactaactctccact

SEQ ID NO: 431864 - DNA, 25 bp, Homo sapien
gagactaactctccacttgtatggg

SEQ ID NO: 431865 - DNA, 25 bp, Homo sapien
actctccacttgtatgggaactaca

SEQ ID NO: 431866 - DNA, 25 bp, Homo sapien
gggaactacatttcactcttggttt

SEQ ID NO: 431867 - DNA, 25 bp, Homo sapien
acatttcactcttggttttcaggat

SEQ ID NO: 431868 - DNA, 25 bp, Homo sapien
ggttttcaggatataacagcacttc

SEQ ID NO: 431869 - DNA, 25 bp, Homo sapien
ggatataacagcacttcaccgaaat

SEQ ID NO: 431870 - DNA, 25 bp, Homo sapien
taacagcacttcaccgaaatattct

SEQ ID NO: 431871 - DNA, 25 bp, Homo sapien
taccgagctcgaattaattcctctt

SEQ ID NO: 431872 - DNA, 25 bp, Homo sapien
accgagctcgaattaattcctcttc

SEQ ID NO: 431873 - DNA, 25 bp, Homo sapien
ccgagctcgaattaattcctcttcc

SEQ ID NO: 431874 - DNA, 25 bp, Homo sapien
cgagctcgaattaattcctcttccg

SEQ ID NO: 431875 - DNA, 25 bp, Homo sapien
gagctcgaattaattcctcttccgc

SEQ ID NO: 431876 - DNA, 25 bp, Homo sapien
agctcgaattaattcctcttccgct

SEQ ID NO: 431877 - DNA, 25 bp, Homo sapien
gctcgaattaattcctcttccgctt

SEQ ID NO: 431878 - DNA, 25 bp, Homo sapien
ctcgaattaattcctcttccgcttc

SEQ ID NO: 431879 - DNA, 25 bp, Homo sapien
tcgaattaattcctcttccgcttcc

SEQ ID NO: 431880 - DNA, 25 bp, Homo sapien
cgaattaattcctcttccgcttcct

SEQ ID NO: 431881 - DNA, 25 bp, Homo sapien
gaattaattcctcttccgcttcctc

SEQ ID NO: 431882 - DNA, 25 bp, Homo sapien
atgctcttcactgtggcgtaggagg

SEQ ID NO: 431883 - DNA, 25 bp, Homo sapien
gtaggaggcctccatgtcagcttca

SEQ ID NO: 431884 - DNA, 25 bp, Homo sapien
atgtcagcttcactcagcccatact

SEQ ID NO: 431885 - DNA, 25 bp, Homo sapien
tgatccctgcccaatgacatatatg

SEQ ID NO: 431886 - DNA, 25 bp, Homo sapien
atgacatatatggtctctccgcatc

SEQ ID NO: 431887 - DNA, 25 bp, Homo sapien
ccacatctgccgaagtaggctgtca

SEQ ID NO: 431888 - DNA, 25 bp, Homo sapien
taggctgtcatactgctctgatgta

SEQ ID NO: 431889 - DNA, 25 bp, Homo sapien
actgctctgatgtagggctcactag

SEQ ID NO: 431890 - DNA, 25 bp, Homo sapien
agggctcactagaaccagcttgctg

SEQ ID NO: 431891 - DNA, 25 bp, Homo sapien
aggtccagctctggctcgccgttga

SEQ ID NO: 431892 - DNA, 25 bp, Homo sapien
tgcagtccgagtcaaagccgccgtg

SEQ ID NO: 431893 - DNA, 25 bp, Homo sapien
gaggcaagagactgcatacaatctt

SEQ ID NO: 431894 - DNA, 25 bp, Homo sapien
gcatacaatcttacagatcaggaga

SEQ ID NO: 431895 - DNA, 25 bp, Homo sapien
aagggtctggattttactctaagtg

SEQ ID NO: 431896 - DNA, 25 bp, Homo sapien
attttacttgcaatgattaccctca

SEQ ID NO: 431897 - DNA, 25 bp, Homo sapien
gattaccctcactgctgtgtagaga

SEQ ID NO: 431898 - DNA, 25 bp, Homo sapien
cctcactgctgtgtagagaatacat

SEQ ID NO: 431899 - DNA, 25 bp, Homo sapien
acaaggagactagtaatctcaggcc

SEQ ID NO: 431900 - DNA, 25 bp, Homo sapien
ataatttatcaaggatgctggtgta

SEQ ID NO: 431901 - DNA, 25 bp, Homo sapien
gctggtgtagctaaatcaggagaca

SEQ ID NO: 431902 - DNA, 25 bp, Homo sapien
tcaggagacaagtaggataccagta

SEQ ID NO: 431903 - DNA, 25 bp, Homo sapien
ataccagtaggtaacatgggtgaag

SEQ ID NO: 431904 - DNA, 25 bp, Homo sapien
caagggctaaggtaatggtaatcag

SEQ ID NO: 431905 - DNA, 25 bp, Homo sapien
atggtaatcagactacagttctaga

SEQ ID NO: 431906 - DNA, 25 bp, Homo sapien
agttctagaaatgcctctggatctt

SEQ ID NO: 431907 - DNA, 25 bp, Homo sapien
tctggatctttaatacatgactggc

SEQ ID NO: 431908 - DNA, 25 bp, Homo sapien
tggcagctcttctaaacctctatgt

SEQ ID NO: 431909 - DNA, 25 bp, Homo sapien
taaacctctatgttacctctattag

SEQ ID NO: 431910 - DNA, 25 bp, Homo sapien
taaataggtttcatatcttcacaga

SEQ ID NO: 431911 - DNA, 25 bp, Homo sapien
ggaatggaggagaacactgtataca

SEQ ID NO: 431912 - DNA, 25 bp, Homo sapien
ttcacagaaagggtttacacaactt

SEQ ID NO: 431913 - DNA, 25 bp, Homo sapien
caacttttgtatatcattttctgag

SEQ ID NO: 431914 - DNA, 25 bp, Homo sapien
attttctgagatgtctgaatcctag

SEQ ID NO: 431915 - DNA, 25 bp, Homo sapien
gatttcactgactgttcaatttcca

SEQ ID NO: 431916 - DNA, 25 bp, Homo sapien
tcaatttccatgtaacccctgtttt

SEQ ID NO: 431917 - DNA, 25 bp, Homo sapien
cctgttttcttccaaggtgtcatca

SEQ ID NO: 431918 - DNA, 25 bp, Homo sapien
aaggtgtcatcagactcgtcgtcgt

SEQ ID NO: 431919 - DNA, 25 bp, Homo sapien
gcccgtggtccagtcatagtctggt

SEQ ID NO: 431920 - DNA, 25 bp, Homo sapien
atagtctggttctccataatcgcca

SEQ ID NO: 431921 - DNA, 25 bp, Homo sapien
ataatcgccattgtctagagtgtct

SEQ ID NO: 431922 - DNA, 25 bp, Homo sapien
tctagagtgtctttggctgtggatg

SEQ ID NO: 431923 - DNA, 25 bp, Homo sapien
ttcagcatgagaagatcctcctcct

SEQ ID NO: 431924 - DNA, 25 bp, Homo sapien
agatcctcctcctctatactaggat

SEQ ID NO: 431925 - DNA, 25 bp, Homo sapien
aagaaatggctgtcttcctcttcta

SEQ ID NO: 431926 - DNA, 25 bp, Homo sapien
tgggtgccaaataccaaggaaagcc

SEQ ID NO: 431927 - DNA, 25 bp, Homo sapien
agccttaaacggactccccagagat

SEQ ID NO: 431928 - DNA, 25 bp, Homo sapien
gactccccagagattaccgatagca

SEQ ID NO: 431929 - DNA, 25 bp, Homo sapien
cagagattaccgatagcattagcat

SEQ ID NO: 431930 - DNA, 25 bp, Homo sapien
taccgatagcattagcatctcatgg

SEQ ID NO: 431931 - DNA, 25 bp, Homo sapien
gcattagcatctcatggaggacccc

SEQ ID NO: 431932 - DNA, 25 bp, Homo sapien
ttattctctggagaacatgtttctt

SEQ ID NO: 431933 - DNA, 25 bp, Homo sapien
tcttcggctcctccaggtgggcatg

SEQ ID NO: 431934 - DNA, 25 bp, Homo sapien
atgggaggctccagctcatttgggc

SEQ ID NO: 431935 - DNA, 25 bp, Homo sapien
acatgtttcttggtattgacgtgaa

SEQ ID NO: 431936 - DNA, 25 bp, Homo sapien
cttggtattgacgtgaatgggagca

SEQ ID NO: 431937 - DNA, 25 bp, Homo sapien
gaagagcacccagcatatagctctc

SEQ ID NO: 431938 - DNA, 25 bp, Homo sapien
gagcacccagcatatagctctcatt

SEQ ID NO: 431939 - DNA, 25 bp, Homo sapien
gcacccagcatatagctctcatttg

SEQ ID NO: 431940 - DNA, 25 bp, Homo sapien
acccagcatatagctctcatttgtt

SEQ ID NO: 431941 - DNA, 25 bp, Homo sapien
cagcatatagctctcatttgttgat

SEQ ID NO: 431942 - DNA, 25 bp, Homo sapien
gcatatagctctcatttgttgattc

SEQ ID NO: 431943 - DNA, 25 bp, Homo sapien
tatagctctcatttgttgattctgt

SEQ ID NO: 431944 - DNA, 25 bp, Homo sapien
attctaatcagtcaatctggggcta

SEQ ID NO: 431945 - DNA, 25 bp, Homo sapien
gttgaatgtttatagtactaccctt

SEQ ID NO: 431946 - DNA, 25 bp, Homo sapien
ttcccattgagtacttctctttagc

SEQ ID NO: 431947 - DNA, 25 bp, Homo sapien
tcccattgagtacttctctttagca

SEQ ID NO: 431948 - DNA, 25 bp, Homo sapien
aaatcagtaaagcttgtctaaaatg

SEQ ID NO: 431949 - DNA, 25 bp, Homo sapien
atatatgtagctaattcttatgata

SEQ ID NO: 431950 - DNA, 25 bp, Homo sapien
tcttatgatataggaaaccttccca

SEQ ID NO: 431951 - DNA, 25 bp, Homo sapien
gaaaccttcccagtagccaatataa

SEQ ID NO: 431952 - DNA, 25 bp, Homo sapien
ttcccagtagccaatataaagagat

SEQ ID NO: 431953 - DNA, 25 bp, Homo sapien
gacaaatgaggtaagcagcctctaa

SEQ ID NO: 431954 - DNA, 25 bp, Homo sapien
gcctctaagacggtgatctcaatga

SEQ ID NO: 431955 - DNA, 25 bp, Homo sapien
ggtgatctcaatgagccatgcctcc

SEQ ID NO: 431956 - DNA, 25 bp, Homo sapien
agccatgcctcctagtgttcatgca

SEQ ID NO: 431957 - DNA, 25 bp, Homo sapien
gttcatgcacttgcataatccctat

SEQ ID NO: 431958 - DNA, 25 bp, Homo sapien
tgcataatccctatccttgagtgtg

SEQ ID NO: 431959 - DNA, 25 bp, Homo sapien
tcaaggtgagcagaacacctgagga

SEQ ID NO: 431960 - DNA, 25 bp, Homo sapien
aaatcagacgggcacagtggtggtg

SEQ ID NO: 431961 - DNA, 25 bp, Homo sapien
gagaatagaagaagctactgcatga

SEQ ID NO: 431962 - DNA, 25 bp, Homo sapien
gaatagaagaagctactgcatgatg

SEQ ID NO: 431963 - DNA, 25 bp, Homo sapien
atagaagaagctactgcatgatgtt

SEQ ID NO: 431964 - DNA, 25 bp, Homo sapien
agaagaagctactgcatgatgttag

SEQ ID NO: 431965 - DNA, 25 bp, Homo sapien
gaagaagctactgcatgatgttagt

SEQ ID NO: 431966 - DNA, 25 bp, Homo sapien
aagaagctactgcatgatgttagtt

SEQ ID NO: 431967 - DNA, 25 bp, Homo sapien
agaagctactgcatgatgttagtta

SEQ ID NO: 431968 - DNA, 25 bp, Homo sapien
gaagctactgcatgatgttagttac

SEQ ID NO: 431969 - DNA, 25 bp, Homo sapien
aagctactgcatgatgttagttacc

SEQ ID NO: 431970 - DNA, 25 bp, Homo sapien
ggctcccatgacagtgggatatatt

SEQ ID NO: 431971 - DNA, 25 bp, Homo sapien
ccatgacagtgggatatattgaagg

SEQ ID NO: 431972 - DNA, 25 bp, Homo sapien
ttgtccttggactgagagatttctg

SEQ ID NO: 431973 - DNA, 25 bp, Homo sapien
gtccttggactgagagatttctgaa

SEQ ID NO: 431974 - DNA, 25 bp, Homo sapien
gagatttctgaactcaaaacctggc

SEQ ID NO: 431975 - DNA, 25 bp, Homo sapien
tttctgaactcaaaacctggctcca

SEQ ID NO: 431976 - DNA, 25 bp, Homo sapien
aaaacctggctccaatatggagtaa

SEQ ID NO: 431977 - DNA, 25 bp, Homo sapien
acctggctccaatatggagtaagga

SEQ ID NO: 431978 - DNA, 25 bp, Homo sapien
aaaactgtacatcgagacttgtatg

SEQ ID NO: 431979 - DNA, 25 bp, Homo sapien
ctgtacatcgagacttgtatgagat

SEQ ID NO: 431980 - DNA, 25 bp, Homo sapien
ctctcttaaattctctcttccttct

SEQ ID NO: 431981 - DNA, 25 bp, Homo sapien
atgggtagtgggtcccagcccagca

SEQ ID NO: 431982 - DNA, 25 bp, Homo sapien
cagggcagtgggtggataggctcaa

SEQ ID NO: 431983 - DNA, 25 bp, Homo sapien
tcctggatcaggctaggcacacaga

SEQ ID NO: 431984 - DNA, 25 bp, Homo sapien
tggatcaggctaggcacacagatgt

SEQ ID NO: 431985 - DNA, 25 bp, Homo sapien
acacagatgtgcactcttaggttgg

SEQ ID NO: 431986 - DNA, 25 bp, Homo sapien
gagtccctagggaagacatacgtaa

SEQ ID NO: 431987 - DNA, 25 bp, Homo sapien
ggaagacatacgtaaccacctggcc

SEQ ID NO: 431988 - DNA, 25 bp, Homo sapien
catacgtaaccacctggcctgggag

SEQ ID NO: 431989 - DNA, 25 bp, Homo sapien
taccctggacagttagatgtggacc

SEQ ID NO: 431990 - DNA, 25 bp, Homo sapien
gacagttagatgtggacctccaaga

SEQ ID NO: 431991 - DNA, 25 bp, Homo sapien
tagatgtggacctccaagatcaggg

SEQ ID NO: 431992 - DNA, 25 bp, Homo sapien
tcttcctaagccgtaccacctccaa

SEQ ID NO: 431993 - DNA, 25 bp, Homo sapien
cttcctaagccgtaccacctccaat

SEQ ID NO: 431994 - DNA, 25 bp, Homo sapien
ttcctaagccgtaccacctccaatg

SEQ ID NO: 431995 - DNA, 25 bp, Homo sapien
tcctaagccgtaccacctccaatgt

SEQ ID NO: 431996 - DNA, 25 bp, Homo sapien
cctaagccgtaccacctccaatgtc

SEQ ID NO: 431997 - DNA, 25 bp, Homo sapien
gtcactgctgtgcatgatgctggaa

SEQ ID NO: 431998 - DNA, 25 bp, Homo sapien
tcactgctgtgcatgatgctggaaa

SEQ ID NO: 431999 - DNA, 25 bp, Homo sapien
cactgctgtgcatgatgctggaaag

SEQ ID NO: 432000 - DNA, 25 bp, Homo sapien
actgctgtgcatgatgctggaaagc

SEQ ID NO: 432001 - DNA, 25 bp, Homo sapien
ggctgtcttgttgagtcatttgtct

SEQ ID NO: 432002 - DNA, 25 bp, Homo sapien
gttgagtcatttgtctctgcttttc

SEQ ID NO: 432003 - DNA, 25 bp, Homo sapien
tttcttgttgctctggtctcagtct

SEQ ID NO: 432004 - DNA, 25 bp, Homo sapien
gtctcagtcttgtgatttactccta

SEQ ID NO: 432005 - DNA, 25 bp, Homo sapien
tactcctagaggtgctggcaagcct

SEQ ID NO: 432006 - DNA, 25 bp, Homo sapien
gatgagatagggactagcagctgat

SEQ ID NO: 432007 - DNA, 25 bp, Homo sapien
aagggtggacatattcatcgtaggg

SEQ ID NO: 432008 - DNA, 25 bp, Homo sapien
gggtttcaggaactccattatctca

SEQ ID NO: 432009 - DNA, 25 bp, Homo sapien
aggaactccattatctcacactcag

SEQ ID NO: 432010 - DNA, 25 bp, Homo sapien
gtcatctctgggatcaacacagtgt

SEQ ID NO: 432011 - DNA, 25 bp, Homo sapien
cacagtgttatcatcgatcagcccc

SEQ ID NO: 432012 - DNA, 25 bp, Homo sapien
ggtttgccctcttcatgtctactct

SEQ ID NO: 432013 - DNA, 25 bp, Homo sapien
ttcatgtctactctccttccaaata

SEQ ID NO: 432014 - DNA, 25 bp, Homo sapien
atgtctactctccttccaaatagtt

SEQ ID NO: 432015 - DNA, 25 bp, Homo sapien
gtctactctccttccaaatagttat

SEQ ID NO: 432016 - DNA, 25 bp, Homo sapien
tctccttccaaatagttatatccaa

SEQ ID NO: 432017 - DNA, 25 bp, Homo sapien
agggattgattaatgtcccgctcct

SEQ ID NO: 432018 - DNA, 25 bp, Homo sapien
ggattgattaatgtcccgctcctga

SEQ ID NO: 432019 - DNA, 25 bp, Homo sapien
attgattaatgtcccgctcctgaat

SEQ ID NO: 432020 - DNA, 25 bp, Homo sapien
attaatgtcccgctcctgaatacat

SEQ ID NO: 432021 - DNA, 25 bp, Homo sapien
taatgtcccgctcctgaatacatgt

SEQ ID NO: 432022 - DNA, 25 bp, Homo sapien
ttgtaatctgtagacttattacctg

SEQ ID NO: 432023 - DNA, 25 bp, Homo sapien
aggtcttgattgtgagctttctctt

SEQ ID NO: 432024 - DNA, 25 bp, Homo sapien
ctcttgcccttccaggtataacaga

SEQ ID NO: 432025 - DNA, 25 bp, Homo sapien
ataacagactatacccagtccagag

SEQ ID NO: 432026 - DNA, 25 bp, Homo sapien
cagtccagagcctgggcatgcccag

SEQ ID NO: 432027 - DNA, 25 bp, Homo sapien
ggctcctggtccgtctgactgtgga

SEQ ID NO: 432028 - DNA, 25 bp, Homo sapien
caggaggaagccaccgaggtatcca

SEQ ID NO: 432029 - DNA, 25 bp, Homo sapien
gaggtatccagggtagccgtcttct

SEQ ID NO: 432030 - DNA, 25 bp, Homo sapien
tgtgtcacctttacgtccgggaggc

SEQ ID NO: 432031 - DNA, 25 bp, Homo sapien
caaattttactcttcaggcaatgga

SEQ ID NO: 432032 - DNA, 25 bp, Homo sapien
ggagatgggcgatcctgtatccata

SEQ ID NO: 432033 - DNA, 25 bp, Homo sapien
tcctgtatccataccaaggtcttga

SEQ ID NO: 432034 - DNA, 25 bp, Homo sapien
gtgttggtatagtacccttcataag

SEQ ID NO: 432035 - DNA, 25 bp, Homo sapien
aatgcctataagtagcaggcctttg

SEQ ID NO: 432036 - DNA, 25 bp, Homo sapien
tcaagagatgctaaaagctttacaa

SEQ ID NO: 432037 - DNA, 25 bp, Homo sapien
agctttacaatggaagtggcctcat

SEQ ID NO: 432038 - DNA, 25 bp, Homo sapien
aagtggcctcatggatgaatccggg

SEQ ID NO: 432039 - DNA, 25 bp, Homo sapien
gtatgagcccaggagaacgtgctgc

SEQ ID NO: 432040 - DNA, 25 bp, Homo sapien
agcccaggagaacgtgctgcttttg

SEQ ID NO: 432041 - DNA, 25 bp, Homo sapien
gctgcttttggtaacttatcccttt

SEQ ID NO: 432042 - DNA, 25 bp, Homo sapien
atccctttttctcttaagaaagcag

SEQ ID NO: 432043 - DNA, 25 bp, Homo sapien
aagcaggtactttcttattagaaat

SEQ ID NO: 432044 - DNA, 25 bp, Homo sapien
gtaagcaaacgacagtgcctttaga

SEQ ID NO: 432045 - DNA, 25 bp, Homo sapien
caaagagtgtgagtgcatgcggact

SEQ ID NO: 432046 - DNA, 25 bp, Homo sapien
caagccccgtggtccagcttaaggt

SEQ ID NO: 432047 - DNA, 25 bp, Homo sapien
gtggtccagcttaaggtcctcggtt

SEQ ID NO: 432048 - DNA, 25 bp, Homo sapien
ttaaggtcctcggttacatgcgccg

SEQ ID NO: 432049 - DNA, 25 bp, Homo sapien
tacatgcgccgctcagagcaggtca

SEQ ID NO: 432050 - DNA, 25 bp, Homo sapien
gcaggtcactttctgccttccacgt

SEQ ID NO: 432051 - DNA, 25 bp, Homo sapien
aggaagccccatgtgggtagctttc

SEQ ID NO: 432052 - DNA, 25 bp, Homo sapien
ggtagctttcaatatcgcaggttct

SEQ ID NO: 432053 - DNA, 25 bp, Homo sapien
aatatcgcaggttcttactcctctg

SEQ ID NO: 432054 - DNA, 25 bp, Homo sapien
actcctctgcctctataagctcaaa

SEQ ID NO: 432055 - DNA, 25 bp, Homo sapien
taagctcaaacccaccaacgatcgg

SEQ ID NO: 432056 - DNA, 25 bp, Homo sapien
acgtgctgcttttggtaacttatcc

SEQ ID NO: 432057 - DNA, 25 bp, Homo sapien
gtgctgcttttggtaacttatccct

SEQ ID NO: 432058 - DNA, 25 bp, Homo sapien
tgctgcttttggtaacttatccctt

SEQ ID NO: 432059 - DNA, 25 bp, Homo sapien
gctgcttttggtaacttatcccttt

SEQ ID NO: 432060 - DNA, 25 bp, Homo sapien
tatccctttttctcttaagaaagca

SEQ ID NO: 432061 - DNA, 25 bp, Homo sapien
tttctcttaagaaagcaggtacttt

SEQ ID NO: 432062 - DNA, 25 bp, Homo sapien
aagcaggtactttcttattagaaat

SEQ ID NO: 432063 - DNA, 25 bp, Homo sapien
atgtgtaagcaaacgacagtgcctt

SEQ ID NO: 432064 - DNA, 25 bp, Homo sapien
gtaagcaaacgacagtgcctttaga

SEQ ID NO: 432065 - DNA, 25 bp, Homo sapien
aagcaaacgacagtgcctttagaat

SEQ ID NO: 432066 - DNA, 25 bp, Homo sapien
gtgcctttagaattacaattctaac

SEQ ID NO: 432067 - DNA, 25 bp, Homo sapien
taatgtacccttgaaattaaatgca

SEQ ID NO: 432068 - DNA, 25 bp, Homo sapien
gtacccttgaaattaaatgcaagca

SEQ ID NO: 432069 - DNA, 25 bp, Homo sapien
gcaagcacatagtcagtttgtctaa

SEQ ID NO: 432070 - DNA, 25 bp, Homo sapien
catttcatctatatttgtgcctacc

SEQ ID NO: 432071 - DNA, 25 bp, Homo sapien
atttcatctatatttgtgcctacca

SEQ ID NO: 432072 - DNA, 25 bp, Homo sapien
tttcatctatatttgtgcctaccat

SEQ ID NO: 432073 - DNA, 25 bp, Homo sapien
tcatctatatttgtgcctaccatgt

SEQ ID NO: 432074 - DNA, 25 bp, Homo sapien
ctatatttgtgcctaccatgttata

SEQ ID NO: 432075 - DNA, 25 bp, Homo sapien
aaatgttcataagtaccttcatgtg

SEQ ID NO: 432076 - DNA, 25 bp, Homo sapien
atgttcataagtaccttcatgtgtc

SEQ ID NO: 432077 - DNA, 25 bp, Homo sapien
gttcataagtaccttcatgtgtcta

SEQ ID NO: 432078 - DNA, 25 bp, Homo sapien
gggcagctcgcttaagttcatgtcg

SEQ ID NO: 432079 - DNA, 25 bp, Homo sapien
ttaagttcatgtcgctgtccagctg

SEQ ID NO: 432080 - DNA, 25 bp, Homo sapien
caggctgctgtccaacttgcggttg

SEQ ID NO: 432081 - DNA, 25 bp, Homo sapien
caacttgcggttgctcaacgggcgg

SEQ ID NO: 432082 - DNA, 25 bp, Homo sapien
gtagagtcataatcgtgcatcagga

SEQ ID NO: 432083 - DNA, 25 bp, Homo sapien
ggtgctgcagcagcgcgcgaataaa

SEQ ID NO: 432084 - DNA, 25 bp, Homo sapien
gctccgtcctgcaggaatacaacat

SEQ ID NO: 432085 - DNA, 25 bp, Homo sapien
tgttatattccacacggtttcctgt

SEQ ID NO: 432086 - DNA, 25 bp, Homo sapien
acacggtttcctgtcgagccaaacg

SEQ ID NO: 432087 - DNA, 25 bp, Homo sapien
gagccaaacgctcatcagtgatatt

SEQ ID NO: 432088 - DNA, 25 bp, Homo sapien
gatattaataaactccccgggcagc

SEQ ID NO: 432089 - DNA, 25 bp, Homo sapien
gcatcgccctacagatacagactag

SEQ ID NO: 432090 - DNA, 25 bp, Homo sapien
tacagactaggcactttgcacatga

SEQ ID NO: 432091 - DNA, 25 bp, Homo sapien
aagcaaatctcgcattcgtgaccgc

SEQ ID NO: 432092 - DNA, 25 bp, Homo sapien
attccccatcatcattgttgccaag

SEQ ID NO: 432093 - DNA, 25 bp, Homo sapien
gaccgccagacctacgggatgtgta

SEQ ID NO: 432094 - DNA, 25 bp, Homo sapien
aaggcacattctcaatctcatcact

SEQ ID NO: 432095 - DNA, 25 bp, Homo sapien
gagagttgcattgcctagtccagca

SEQ ID NO: 432096 - DNA, 25 bp, Homo sapien
cgtgaaggactctctgctgtttttc

SEQ ID NO: 432097 - DNA, 25 bp, Homo sapien
gttgccaagtgaccccaaatattcc

SEQ ID NO: 432098 - DNA, 25 bp, Homo sapien
aatattcctatcctgtctgttgtaa

SEQ ID NO: 432099 - DNA, 25 bp, Homo sapien
gtcttggaagaacagcatcgcccta

SEQ ID NO: 432100 - DNA, 25 bp, Homo sapien
ggaccacctgccagtagccatgcga

SEQ ID NO: 432101 - DNA, 25 bp, Homo sapien
ctgccagtagccatgcgactgatgg

SEQ ID NO: 432102 - DNA, 25 bp, Homo sapien
gccagtagccatgcgactgatggtg

SEQ ID NO: 432103 - DNA, 25 bp, Homo sapien
gtagccatgcgactgatggtgtctt

SEQ ID NO: 432104 - DNA, 25 bp, Homo sapien
agccatgcgactgatggtgtcttcg

SEQ ID NO: 432105 - DNA, 25 bp, Homo sapien
ccatgcgactgatggtgtcttcggg

SEQ ID NO: 432106 - DNA, 25 bp, Homo sapien
tgggccatgtcccctccatcgagtg

SEQ ID NO: 432107 - DNA, 25 bp, Homo sapien
cctccatcgagtgcccggtgcttgg

SEQ ID NO: 432108 - DNA, 25 bp, Homo sapien
gcctcactgtggacagaggagtcag

SEQ ID NO: 432109 - DNA, 25 bp, Homo sapien
agctgcctaaccagtgccatttttt

SEQ ID NO: 432110 - DNA, 25 bp, Homo sapien
gctgcctaaccagtgccattttttc

SEQ ID NO: 432111 - DNA, 25 bp, Homo sapien
cgcccagcctatagttcttatttaa

SEQ ID NO: 432112 - DNA, 25 bp, Homo sapien
gcccagcctatagttcttatttaaa

SEQ ID NO: 432113 - DNA, 25 bp, Homo sapien
ccagcctatagttcttatttaaact

SEQ ID NO: 432114 - DNA, 25 bp, Homo sapien
cagcctatagttcttatttaaacta

SEQ ID NO: 432115 - DNA, 25 bp, Homo sapien
gcctatagttcttatttaaactaat

SEQ ID NO: 432116 - DNA, 25 bp, Homo sapien
tgggttcaagtgagtattttgtatt

SEQ ID NO: 432117 - DNA, 25 bp, Homo sapien
gggttcaagtgagtattttgtattt

SEQ ID NO: 432118 - DNA, 25 bp, Homo sapien
ggttcaagtgagtattttgtatttt

SEQ ID NO: 432119 - DNA, 25 bp, Homo sapien
ataaatgtgtgaactagtttcaaca

SEQ ID NO: 432120 - DNA, 25 bp, Homo sapien
taaatgtgtgaactagtttcaacag

SEQ ID NO: 432121 - DNA, 25 bp, Homo sapien
aaatgtgtgaactagtttcaacagt

SEQ ID NO: 432122 - DNA, 25 bp, Homo sapien
aatgtgtgaactagtttcaacagtg

SEQ ID NO: 432123 - DNA, 25 bp, Homo sapien
ttcatatttactctgcaaatacaaa

SEQ ID NO: 432124 - DNA, 25 bp, Homo sapien
tcatatttactctgcaaatacaaaa

SEQ ID NO: 432125 - DNA, 25 bp, Homo sapien
catatttactctgcaaatacaaaaa

SEQ ID NO: 432126 - DNA, 25 bp, Homo sapien
tttcaaaatctttttatgttcagat

SEQ ID NO: 432127 - DNA, 25 bp, Homo sapien
ttcaaaatctttttatgttcagata

SEQ ID NO: 432128 - DNA, 25 bp, Homo sapien
tcaaaatctttttatgttcagatac

SEQ ID NO: 432129 - DNA, 25 bp, Homo sapien
aaaatctttttatgttcagatactg

SEQ ID NO: 432130 - DNA, 25 bp, Homo sapien
tacccatcccaacactgaaactgtg

SEQ ID NO: 432131 - DNA, 25 bp, Homo sapien
tgaaactgtgtttgaagcctttctg

SEQ ID NO: 432132 - DNA, 25 bp, Homo sapien
tccaaaaaggccaggccagtgctaa

SEQ ID NO: 432133 - DNA, 25 bp, Homo sapien
aaaattagatgaagtgcgcctgaga

SEQ ID NO: 432134 - DNA, 25 bp, Homo sapien
atgaagtgcgcctgagaggaagaaa

SEQ ID NO: 432135 - DNA, 25 bp, Homo sapien
tccatggttgggtagaagaatgtgt

SEQ ID NO: 432136 - DNA, 25 bp, Homo sapien
atgtgtatgacaaccacacacagtg

SEQ ID NO: 432137 - DNA, 25 bp, Homo sapien
tcatttcagcacttccagaggataa

SEQ ID NO: 432138 - DNA, 25 bp, Homo sapien
cagcacttccagaggataagggagt

SEQ ID NO: 432139 - DNA, 25 bp, Homo sapien
aagggagtagacctctatgtcctgg

SEQ ID NO: 432140 - DNA, 25 bp, Homo sapien
tctatgtcctggagaaggccttcct

SEQ ID NO: 432141 - DNA, 25 bp, Homo sapien
tgcaaactgccacctgactcatctt

SEQ ID NO: 432142 - DNA, 25 bp, Homo sapien
gaagatgtccattcctacctttccc

SEQ ID NO: 432143 - DNA, 25 bp, Homo sapien
atcttctcaagccacagctgacatg

SEQ ID NO: 432144 - DNA, 25 bp, Homo sapien
aacccaaacatccatttagctgctc

SEQ ID NO: 432145 - DNA, 25 bp, Homo sapien
atttagctgctcctcagtacaaatc

SEQ ID NO: 432146 - DNA, 25 bp, Homo sapien
gaagatgcacgaggcagctccctgt

SEQ ID NO: 432147 - DNA, 25 bp, Homo sapien
ctgtcctcgaggagcagtggccatt

SEQ ID NO: 432148 - DNA, 25 bp, Homo sapien
agcagtggccattgccgcagaggaa

SEQ ID NO: 432149 - DNA, 25 bp, Homo sapien
cgcagaggaaccctggtatcccaaa

SEQ ID NO: 432150 - DNA, 25 bp, Homo sapien
tttcccactgacattatccctggtg

SEQ ID NO: 432151 - DNA, 25 bp, Homo sapien
ttgcctcatgcatcttgcaaactgc

SEQ ID NO: 432152 - DNA, 25 bp, Homo sapien
taatgtacccttgaaattaaatgca

SEQ ID NO: 432153 - DNA, 25 bp, Homo sapien
gtacccttgaaattaaatgcaagca

SEQ ID NO: 432154 - DNA, 25 bp, Homo sapien
aacatttcatctatatttgtgccta

SEQ ID NO: 432155 - DNA, 25 bp, Homo sapien
catttcatctatatttgtgcctacc

SEQ ID NO: 432156 - DNA, 25 bp, Homo sapien
atttcatctatatttgtgcctacca

SEQ ID NO: 432157 - DNA, 25 bp, Homo sapien
tttcatctatatttgtgcctaccat

SEQ ID NO: 432158 - DNA, 25 bp, Homo sapien
tcatctatatttgtgcctaccatgt

SEQ ID NO: 432159 - DNA, 25 bp, Homo sapien
taccatgttataaatgttcataagt

SEQ ID NO: 432160 - DNA, 25 bp, Homo sapien
aaatgttcataagtaccttcatgtg

SEQ ID NO: 432161 - DNA, 25 bp, Homo sapien
atgttcataagtaccttcatgtgtc

SEQ ID NO: 432162 - DNA, 25 bp, Homo sapien
gttcataagtaccttcatgtgtcta

SEQ ID NO: 432163 - DNA, 25 bp, Homo sapien
aatgaagcatcttctgagactcaca

SEQ ID NO: 432164 - DNA, 25 bp, Homo sapien
gtgatctacccaatcacagtcagtg

SEQ ID NO: 432165 - DNA, 25 bp, Homo sapien
acagtcagtgtgattattttattcc

SEQ ID NO: 432166 - DNA, 25 bp, Homo sapien
gaataagatcctccgatgttcgcaa

SEQ ID NO: 432167 - DNA, 25 bp, Homo sapien
cgatgttcgcaatggtgtggtgtca

SEQ ID NO: 432168 - DNA, 25 bp, Homo sapien
tgtggtgtcaggaggctgcctctta

SEQ ID NO: 432169 - DNA, 25 bp, Homo sapien
ggctgcctcttagacaatctccaga

SEQ ID NO: 432170 - DNA, 25 bp, Homo sapien
aatctccagatgtactgtgatgtga

SEQ ID NO: 432171 - DNA, 25 bp, Homo sapien
gggagacatgccactagctgagctt

SEQ ID NO: 432172 - DNA, 25 bp, Homo sapien
ctgagcttcccaaaagtctaccaag

SEQ ID NO: 432173 - DNA, 25 bp, Homo sapien
aagagctgaggaattgtatcttcat

SEQ ID NO: 432174 - DNA, 25 bp, Homo sapien
gggagaattccatcctgacaccctc

SEQ ID NO: 432175 - DNA, 25 bp, Homo sapien
ctccagatggctcttcaagtagtga

SEQ ID NO: 432176 - DNA, 25 bp, Homo sapien
gaacatccagaccatcgcaatgagt

SEQ ID NO: 432177 - DNA, 25 bp, Homo sapien
accatcgcaatgagtagggctgggt

SEQ ID NO: 432178 - DNA, 25 bp, Homo sapien
ctgggtctcggccatggaaagcata

SEQ ID NO: 432179 - DNA, 25 bp, Homo sapien
tcggccatggaaagcatacctcagt

SEQ ID NO: 432180 - DNA, 25 bp, Homo sapien
atacctcagtgctcaggatgatact

SEQ ID NO: 432181 - DNA, 25 bp, Homo sapien
gatgatactggctgtctgttcttaa

SEQ ID NO: 432182 - DNA, 25 bp, Homo sapien
gaactgctattggagcctggaaact

SEQ ID NO: 432183 - DNA, 25 bp, Homo sapien
gaaatgcagatctctgtgaaacaaa

SEQ ID NO: 432184 - DNA, 25 bp, Homo sapien
acggagacgctgaatagttttattt

SEQ ID NO: 432185 - DNA, 25 bp, Homo sapien
caggaaacccagtccacattttagg

SEQ ID NO: 432186 - DNA, 25 bp, Homo sapien
cagtccacattttagggcttcctta

SEQ ID NO: 432187 - DNA, 25 bp, Homo sapien
gggcttccttaaaacaggcttctga

SEQ ID NO: 432188 - DNA, 25 bp, Homo sapien
aggcttctgagagtcgtatcttttt

SEQ ID NO: 432189 - DNA, 25 bp, Homo sapien
ctgagagtcgtatcttttttctttt

SEQ ID NO: 432190 - DNA, 25 bp, Homo sapien
ttttgccaaaacacctcctcaataa

SEQ ID NO: 432191 - DNA, 25 bp, Homo sapien
tcctggccagcaacatgtgtgcacc

SEQ ID NO: 432192 - DNA, 25 bp, Homo sapien
atgtgtgcacccaccgaggtacgcc

SEQ ID NO: 432193 - DNA, 25 bp, Homo sapien
atagcacgagcgaacagccagccct

SEQ ID NO: 432194 - DNA, 25 bp, Homo sapien
agcgaacagccagccctgtttattt

SEQ ID NO: 432195 - DNA, 25 bp, Homo sapien
cttttcaggaagagctagcagggca

SEQ ID NO: 432196 - DNA, 25 bp, Homo sapien
gcacccggcccaaggatacctattt

SEQ ID NO: 432197 - DNA, 25 bp, Homo sapien
tggaagccacactcagacaccagag

SEQ ID NO: 432198 - DNA, 25 bp, Homo sapien
gaagccacactcagacaccagagca

SEQ ID NO: 432199 - DNA, 25 bp, Homo sapien
tcagacaccagagcagctctcaatg

SEQ ID NO: 432200 - DNA, 25 bp, Homo sapien
gacaccagagcagctctcaatgctg

SEQ ID NO: 432201 - DNA, 25 bp, Homo sapien
accagagcagctctcaatgctggga

SEQ ID NO: 432202 - DNA, 25 bp, Homo sapien
ccagagcagctctcaatgctgggaa

SEQ ID NO: 432203 - DNA, 25 bp, Homo sapien
caatgctgggaatcctgggagactg

SEQ ID NO: 432204 - DNA, 25 bp, Homo sapien
gaatcctgggagactgatgatgacc

SEQ ID NO: 432205 - DNA, 25 bp, Homo sapien
atcctgggagactgatgatgaccgc

SEQ ID NO: 432206 - DNA, 25 bp, Homo sapien
gtgcagaattccaaatgttatttac

SEQ ID NO: 432207 - DNA, 25 bp, Homo sapien
ggacatcgaacccattaaatgaagc

SEQ ID NO: 432208 - DNA, 25 bp, Homo sapien
gaaatctgtatcacttcaccttcca

SEQ ID NO: 432209 - DNA, 25 bp, Homo sapien
atacattgttctgatctcgtccctt

SEQ ID NO: 432210 - DNA, 25 bp, Homo sapien
gagacttagaggattcttgccataa

SEQ ID NO: 432211 - DNA, 25 bp, Homo sapien
ttgccataacgtcttcctcatggag

SEQ ID NO: 432212 - DNA, 25 bp, Homo sapien
catggaggctcttcatgtgggcctg

SEQ ID NO: 432213 - DNA, 25 bp, Homo sapien
tgtgggcctgtgtagttggcacacc

SEQ ID NO: 432214 - DNA, 25 bp, Homo sapien
tgggcttctggctataggctgctca

SEQ ID NO: 432215 - DNA, 25 bp, Homo sapien
tggctataggctgctcaggcctctg

SEQ ID NO: 432216 - DNA, 25 bp, Homo sapien
tgcaacagccgttctgggtgaggtc

SEQ ID NO: 432217 - DNA, 25 bp, Homo sapien
ggtgaggtcttgtggacctttatca

SEQ ID NO: 432218 - DNA, 25 bp, Homo sapien
aaatggaggttaaatcacttacaca

SEQ ID NO: 432219 - DNA, 25 bp, Homo sapien
aatggaggttaaatcacttacacag

SEQ ID NO: 432220 - DNA, 25 bp, Homo sapien
atggaggttaaatcacttacacagg

SEQ ID NO: 432221 - DNA, 25 bp, Homo sapien
tggaggttaaatcacttacacaggc

SEQ ID NO: 432222 - DNA, 25 bp, Homo sapien
ggaggttaaatcacttacacaggct

SEQ ID NO: 432223 - DNA, 25 bp, Homo sapien
gaggttaaatcacttacacaggctg

SEQ ID NO: 432224 - DNA, 25 bp, Homo sapien
aggttaaatcacttacacaggctgg

SEQ ID NO: 432225 - DNA, 25 bp, Homo sapien
ggttaaatcacttacacaggctggg

SEQ ID NO: 432226 - DNA, 25 bp, Homo sapien
gttaaatcacttacacaggctgggc

SEQ ID NO: 432227 - DNA, 25 bp, Homo sapien
ttaaatcacttacacaggctgggca

SEQ ID NO: 432228 - DNA, 25 bp, Homo sapien
aactgtgattttaaagggcagggag

SEQ ID NO: 432229 - DNA, 25 bp, Homo sapien
ccgatggtgattgtatgttcaatga

SEQ ID NO: 432230 - DNA, 25 bp, Homo sapien
aatatatttttgacagtaactgtgc

SEQ ID NO: 432231 - DNA, 25 bp, Homo sapien
gtaactgtgcactttactccgactt

SEQ ID NO: 432232 - DNA, 25 bp, Homo sapien
ctgtgcactttactccgactttttt

SEQ ID NO: 432233 - DNA, 25 bp, Homo sapien
gtactctgcgctggttttgcccaca

SEQ ID NO: 432234 - DNA, 25 bp, Homo sapien
tttgcccacagctgcttgcgaatgg

SEQ ID NO: 432235 - DNA, 25 bp, Homo sapien
gctgcttgcgaatggcaggcttttt

SEQ ID NO: 432236 - DNA, 25 bp, Homo sapien
ctccattcctttgcggaacatagaa

SEQ ID NO: 432237 - DNA, 25 bp, Homo sapien
tcctttgcggaacatagaagagttt

SEQ ID NO: 432238 - DNA, 25 bp, Homo sapien
gaagagtttgtctcagttctcttag

SEQ ID NO: 432239 - DNA, 25 bp, Homo sapien
gtttgtctcagttctcttagaattg

SEQ ID NO: 432240 - DNA, 25 bp, Homo sapien
gggttcttcccactggagggcgtgg

SEQ ID NO: 432241 - DNA, 25 bp, Homo sapien
gagggcgtggcctcaggctgagagt

SEQ ID NO: 432242 - DNA, 25 bp, Homo sapien
gcctcaggctgagagtgaagacggg

SEQ ID NO: 432243 - DNA, 25 bp, Homo sapien
gctcctgagaccaggagccagacct

SEQ ID NO: 432244 - DNA, 25 bp, Homo sapien
gagccagacctggtaagtacatgac

SEQ ID NO: 432245 - DNA, 25 bp, Homo sapien
gccagacctggtaagtacatgacct

SEQ ID NO: 432246 - DNA, 25 bp, Homo sapien
agacctggtaagtacatgaccttag

SEQ ID NO: 432247 - DNA, 25 bp, Homo sapien
acctggtaagtacatgaccttaggg

SEQ ID NO: 432248 - DNA, 25 bp, Homo sapien
aagtacatgaccttaggggctgggc

SEQ ID NO: 432249 - DNA, 25 bp, Homo sapien
gaagccatgagttaaaaccagcctg

SEQ ID NO: 432250 - DNA, 25 bp, Homo sapien
tcaggtgggttcttcccactggagg

SEQ ID NO: 432251 - DNA, 25 bp, Homo sapien
aaagccaagtgtgcgtttgggccac

SEQ ID NO: 432252 - DNA, 25 bp, Homo sapien
cagctcagctgccaagaagttatca

SEQ ID NO: 432253 - DNA, 25 bp, Homo sapien
gcctaataacgggaagtgcctctta

SEQ ID NO: 432254 - DNA, 25 bp, Homo sapien
aagtgcctcttaatggcccttcaaa

SEQ ID NO: 432255 - DNA, 25 bp, Homo sapien
aatggcccttcaaatcatttcatta

SEQ ID NO: 432256 - DNA, 25 bp, Homo sapien
ttaaaagttgccgtgatgtctccag

SEQ ID NO: 432257 - DNA, 25 bp, Homo sapien
tgatgtctccagctgaatccgagtc

SEQ ID NO: 432258 - DNA, 25 bp, Homo sapien
aatccgagtcgtgctgggaaggcca

SEQ ID NO: 432259 - DNA, 25 bp, Homo sapien
cagctcaccatctactcttaattaa

SEQ ID NO: 432260 - DNA, 25 bp, Homo sapien
aaattaggtcctactgccaactcag

SEQ ID NO: 432261 - DNA, 25 bp, Homo sapien
aaaacagagagctggccagcgaccc

SEQ ID NO: 432262 - DNA, 25 bp, Homo sapien
gcattatttcaaaaactgtgaatgt

SEQ ID NO: 432263 - DNA, 25 bp, Homo sapien
taataacactacagcaatcacacag

SEQ ID NO: 432264 - DNA, 25 bp, Homo sapien
ataacactacagcaatcacacagtg

SEQ ID NO: 432265 - DNA, 25 bp, Homo sapien
gagggaggacaaactttctagaaga

SEQ ID NO: 432266 - DNA, 25 bp, Homo sapien
tttttgttgctaatcatttgacact

SEQ ID NO: 432267 - DNA, 25 bp, Homo sapien
tgttgctaatcatttgacacttaat

SEQ ID NO: 432268 - DNA, 25 bp, Homo sapien
atttgacacttaatcgaaacagaat

SEQ ID NO: 432269 - DNA, 25 bp, Homo sapien
aaaaaggatgatccaactcctgagg

SEQ ID NO: 432270 - DNA, 25 bp, Homo sapien
aaggatgatccaactcctgaggatt

SEQ ID NO: 432271 - DNA, 25 bp, Homo sapien
gatgatccaactcctgaggattgcc

SEQ ID NO: 432272 - DNA, 25 bp, Homo sapien
gtgtgtctttaattgattatctttg

SEQ ID NO: 432273 - DNA, 25 bp, Homo sapien
tgacaagaaaggagagcagcctctt

SEQ ID NO: 432274 - DNA, 25 bp, Homo sapien
gagcagcctcttaacaagaacagtg

SEQ ID NO: 432275 - DNA, 25 bp, Homo sapien
ttaagttttacaggttttccagctg

SEQ ID NO: 432276 - DNA, 25 bp, Homo sapien
acaggttttccagctgtctttaatt

SEQ ID NO: 432277 - DNA, 25 bp, Homo sapien
ggtgctgaataaatttgtcttagtt

SEQ ID NO: 432278 - DNA, 25 bp, Homo sapien
attctccttgataagagtaacaaca

SEQ ID NO: 432279 - DNA, 25 bp, Homo sapien
aacagaggcgttcctcctgaaattt

SEQ ID NO: 432280 - DNA, 25 bp, Homo sapien
atagtttttgtgtgtactgtacgtg

SEQ ID NO: 432281 - DNA, 25 bp, Homo sapien
gtactgtacgtgttaggatattctt

SEQ ID NO: 432282 - DNA, 25 bp, Homo sapien
ttctctttctcataacactagcagt

SEQ ID NO: 432283 - DNA, 25 bp, Homo sapien
ctcataacactagcagtttctttga

SEQ ID NO: 432284 - DNA, 25 bp, Homo sapien
gtctccatgtggtttttgggtgttt

SEQ ID NO: 432285 - DNA, 25 bp, Homo sapien
ttcttgttgtgtcctggattccgat

SEQ ID NO: 432286 - DNA, 25 bp, Homo sapien
gtcctggattccgataaaattaaag

SEQ ID NO: 432287 - DNA, 25 bp, Homo sapien
tgcccgccttttaacaacgtctgga

SEQ ID NO: 432288 - DNA, 25 bp, Homo sapien
gcccgccttttaacaacgtctggat

SEQ ID NO: 432289 - DNA, 25 bp, Homo sapien
ccgccttttaacaacgtctggattg

SEQ ID NO: 432290 - DNA, 25 bp, Homo sapien
cgccttttaacaacgtctggattgg

SEQ ID NO: 432291 - DNA, 25 bp, Homo sapien
gccttttaacaacgtctggattgga

SEQ ID NO: 432292 - DNA, 25 bp, Homo sapien
cgtctggattggaaaacccctggcg

SEQ ID NO: 432293 - DNA, 25 bp, Homo sapien
tctggattggaaaacccctggcgtt

SEQ ID NO: 432294 - DNA, 25 bp, Homo sapien
ctggcgttccccaattaaatcgctt

SEQ ID NO: 432295 - DNA, 25 bp, Homo sapien
agccaatgggacagtgtctatacca

SEQ ID NO: 432296 - DNA, 25 bp, Homo sapien
agtgtctataccactggcttagaga

SEQ ID NO: 432297 - DNA, 25 bp, Homo sapien
ataccactggcttagagagggacat

SEQ ID NO: 432298 - DNA, 25 bp, Homo sapien
actggcttagagagggacatatttt

SEQ ID NO: 432299 - DNA, 25 bp, Homo sapien
ggacatattttgaatgcacgtgtat

SEQ ID NO: 432300 - DNA, 25 bp, Homo sapien
ttttctcactacctgtacactcaaa

SEQ ID NO: 432301 - DNA, 25 bp, Homo sapien
tcactacctgtacactcaaacgaca

SEQ ID NO: 432302 - DNA, 25 bp, Homo sapien
ggaatgggatgaaatcaccctgagg

SEQ ID NO: 432303 - DNA, 25 bp, Homo sapien
tcaaacgacagtattaactctgaat

SEQ ID NO: 432304 - DNA, 25 bp, Homo sapien
gtggatgatgtgactgatcccagca

SEQ ID NO: 432305 - DNA, 25 bp, Homo sapien
gatgtgactgatcccagcataacac

SEQ ID NO: 432306 - DNA, 25 bp, Homo sapien
gtgaccatcattttactttttagat

SEQ ID NO: 432307 - DNA, 25 bp, Homo sapien
aacaatccaagtatccaatgcagtg

SEQ ID NO: 432308 - DNA, 25 bp, Homo sapien
caagtatccaatgcagtggctataa

SEQ ID NO: 432309 - DNA, 25 bp, Homo sapien
gacagacttcaattttacactgctt

SEQ ID NO: 432310 - DNA, 25 bp, Homo sapien
gacttcaattttacactgcttgcac

SEQ ID NO: 432311 - DNA, 25 bp, Homo sapien
cactgcttgcactttattttgtaca

SEQ ID NO: 432312 - DNA, 25 bp, Homo sapien
tattttgtacagacatttcattaat

SEQ ID NO: 432313 - DNA, 25 bp, Homo sapien
tactcaattttgaggtgcaaacctt

SEQ ID NO: 432314 - DNA, 25 bp, Homo sapien
ggtgcaaaccttctgaatatagctt

SEQ ID NO: 432315 - DNA, 25 bp, Homo sapien
tatagctttcattttggaccaaaca

SEQ ID NO: 432316 - DNA, 25 bp, Homo sapien
attttggaccaaacaatttgttatg

SEQ ID NO: 432317 - DNA, 25 bp, Homo sapien
tgtggcaaaaaggatcagtgagatt

SEQ ID NO: 432318 - DNA, 25 bp, Homo sapien
aaaggagtttgctgcaatggaggca

SEQ ID NO: 432319 - DNA, 25 bp, Homo sapien
cagctgccctgaaagcataccaaga

SEQ ID NO: 432320 - DNA, 25 bp, Homo sapien
ccctgaaagcataccaagaggattt

SEQ ID NO: 432321 - DNA, 25 bp, Homo sapien
agagtcagaaattttggagccaagc

SEQ ID NO: 432322 - DNA, 25 bp, Homo sapien
attttggagccaagcataacaccag

SEQ ID NO: 432323 - DNA, 25 bp, Homo sapien
ataacaccagtaaccagcactatcc

SEQ ID NO: 432324 - DNA, 25 bp, Homo sapien
gaaattctgtgattactgcaagtgc

SEQ ID NO: 432325 - DNA, 25 bp, Homo sapien
gtgattactgcaagtgctggatagc

SEQ ID NO: 432326 - DNA, 25 bp, Homo sapien
gatagcagacaataggcctagtgtt

SEQ ID NO: 432327 - DNA, 25 bp, Homo sapien
ataggcctagtgttgaatttcatga

SEQ ID NO: 432328 - DNA, 25 bp, Homo sapien
gtccattcttgcattgctataacga

SEQ ID NO: 432329 - DNA, 25 bp, Homo sapien
tccattcttgcattgctataacgaa

SEQ ID NO: 432330 - DNA, 25 bp, Homo sapien
ccattcttgcattgctataacgaaa

SEQ ID NO: 432331 - DNA, 25 bp, Homo sapien
cattcttgcattgctataacgaaat

SEQ ID NO: 432332 - DNA, 25 bp, Homo sapien
attcttgcattgctataacgaaata

SEQ ID NO: 432333 - DNA, 25 bp, Homo sapien
gggtatggtggctcaagcatgtaat

SEQ ID NO: 432334 - DNA, 25 bp, Homo sapien
ggtgggaggatacgaggtcagcagt

SEQ ID NO: 432335 - DNA, 25 bp, Homo sapien
gtgggaggatacgaggtcagcagtt

SEQ ID NO: 432336 - DNA, 25 bp, Homo sapien
tgggaggatacgaggtcagcagttc

SEQ ID NO: 432337 - DNA, 25 bp, Homo sapien
gggaggatacgaggtcagcagttcg

SEQ ID NO: 432338 - DNA, 25 bp, Homo sapien
ggaggatacgaggtcagcagttcga

SEQ ID NO: 432339 - DNA, 25 bp, Homo sapien
tgttccatccagaaagcgcatactt

SEQ ID NO: 432340 - DNA, 25 bp, Homo sapien
agaaagcgcatacttgtcagaacaa

SEQ ID NO: 432341 - DNA, 25 bp, Homo sapien
ttgtcagaacaagccgtctgccagg

SEQ ID NO: 432342 - DNA, 25 bp, Homo sapien
aacaagccgtctgccagggcgtctg

SEQ ID NO: 432343 - DNA, 25 bp, Homo sapien
tgacttacctgaagtcctcgggcag

SEQ ID NO: 432344 - DNA, 25 bp, Homo sapien
tacctgaagtcctcgggcagtggca

SEQ ID NO: 432345 - DNA, 25 bp, Homo sapien
aaggagggcattcctccactgttac

SEQ ID NO: 432346 - DNA, 25 bp, Homo sapien
aagcaggtgtggtcctttgcagcaa

SEQ ID NO: 432347 - DNA, 25 bp, Homo sapien
gtggtcctttgcagcaagctgacat

SEQ ID NO: 432348 - DNA, 25 bp, Homo sapien
tgcagcaagctgacatcaacgaaaa

SEQ ID NO: 432349 - DNA, 25 bp, Homo sapien
cattccttggcccttcgattcctgt

SEQ ID NO: 432350 - DNA, 25 bp, Homo sapien
actctatgaatattcattcattcca

SEQ ID NO: 432351 - DNA, 25 bp, Homo sapien
ttcattcattccatgaacctacaag

SEQ ID NO: 432352 - DNA, 25 bp, Homo sapien
tcattcattccatgaacctacaagg

SEQ ID NO: 432353 - DNA, 25 bp, Homo sapien
cattcattccatgaacctacaaggt

SEQ ID NO: 432354 - DNA, 25 bp, Homo sapien
ttcattccatgaacctacaaggttt

SEQ ID NO: 432355 - DNA, 25 bp, Homo sapien
cattccatgaacctacaaggttttt

SEQ ID NO: 432356 - DNA, 25 bp, Homo sapien
ttccatgaacctacaaggtttttag

SEQ ID NO: 432357 - DNA, 25 bp, Homo sapien
tccatgaacctacaaggtttttagg

SEQ ID NO: 432358 - DNA, 25 bp, Homo sapien
gtttaaataagaactataggctggg

SEQ ID NO: 432359 - DNA, 25 bp, Homo sapien
taaataagaactataggctgggcgc

SEQ ID NO: 432360 - DNA, 25 bp, Homo sapien
aatacaaaatactcacttgaaccca

SEQ ID NO: 432361 - DNA, 25 bp, Homo sapien
aatttgctacagtgttaatctgcat

SEQ ID NO: 432362 - DNA, 25 bp, Homo sapien
ttaatctgcatggtctttaagcctg

SEQ ID NO: 432363 - DNA, 25 bp, Homo sapien
gcatggtctttaagcctgctgtagt

SEQ ID NO: 432364 - DNA, 25 bp, Homo sapien
ttaagcctgctgtagttgagttgca

SEQ ID NO: 432365 - DNA, 25 bp, Homo sapien
gttgagttgcagacagtgcatgaaa

SEQ ID NO: 432366 - DNA, 25 bp, Homo sapien
gcatgaaaaagtattccgctgggaa

SEQ ID NO: 432367 - DNA, 25 bp, Homo sapien
attccgctgggaattgagccatgcc

SEQ ID NO: 432368 - DNA, 25 bp, Homo sapien
gggaattgagccatgccaccaaagc

SEQ ID NO: 432369 - DNA, 25 bp, Homo sapien
tgtgtgttcctctgaacaaagcgga

SEQ ID NO: 432370 - DNA, 25 bp, Homo sapien
gttcctctgaacaaagcggagaaaa

SEQ ID NO: 432371 - DNA, 25 bp, Homo sapien
ttgaaattaaacttccaacttctct

SEQ ID NO: 432372 - DNA, 25 bp, Homo sapien
cgcctggcctcattgtactccttaa

SEQ ID NO: 432373 - DNA, 25 bp, Homo sapien
tggcctcattgtactccttaacaca

SEQ ID NO: 432374 - DNA, 25 bp, Homo sapien
gcctcattgtactccttaacacaag

SEQ ID NO: 432375 - DNA, 25 bp, Homo sapien
ctcattgtactccttaacacaagaa

SEQ ID NO: 432376 - DNA, 25 bp, Homo sapien
tagttgtttataaggaagcaggatc

SEQ ID NO: 432377 - DNA, 25 bp, Homo sapien
tgtttataaggaagcaggatcatta

SEQ ID NO: 432378 - DNA, 25 bp, Homo sapien
gatcattaccaaaataaatcctgct

SEQ ID NO: 432379 - DNA, 25 bp, Homo sapien
cattaccaaaataaatcctgctaaa

SEQ ID NO: 432380 - DNA, 25 bp, Homo sapien
ctgctaaaacaacaggaatcatgtt

SEQ ID NO: 432381 - DNA, 25 bp, Homo sapien
ggaatcatgttttaaagcctagttt

SEQ ID NO: 432382 - DNA, 25 bp, Homo sapien
aatcatgttttaaagcctagtttgc

SEQ ID NO: 432383 - DNA, 25 bp, Homo sapien
gtccttaaaataacttgcaacctgt

SEQ ID NO: 432384 - DNA, 25 bp, Homo sapien
ttgcaacctgttacctcttcactta

SEQ ID NO: 432385 - DNA, 25 bp, Homo sapien
cgccaccacaagaatcctgtgtgtt

SEQ ID NO: 432386 - DNA, 25 bp, Homo sapien
gcatccagtctaaaacgggtctgct

SEQ ID NO: 432387 - DNA, 25 bp, Homo sapien
tctgcttttattcataggcttttgt

SEQ ID NO: 432388 - DNA, 25 bp, Homo sapien
aagacactgcttaaaagagtccaat

SEQ ID NO: 432389 - DNA, 25 bp, Homo sapien
gagtccaatgcagtatgaatttgta

SEQ ID NO: 432390 - DNA, 25 bp, Homo sapien
gtatttgtgtttaacttttgtgctt

SEQ ID NO: 432391 - DNA, 25 bp, Homo sapien
acttttgtgcttaacagatctgcca

SEQ ID NO: 432392 - DNA, 25 bp, Homo sapien
aacagatctgccatggctgaactct

SEQ ID NO: 432393 - DNA, 25 bp, Homo sapien
ggctgaactctcagttgcttaagca

SEQ ID NO: 432394 - DNA, 25 bp, Homo sapien
taaggtggtaaccatggccaacaac

SEQ ID NO: 432395 - DNA, 25 bp, Homo sapien
ggtggtaaccatggccaacaacatt

SEQ ID NO: 432396 - DNA, 25 bp, Homo sapien
ggtaaccatggccaacaacattctc

SEQ ID NO: 432397 - DNA, 25 bp, Homo sapien
gtaaccatggccaacaacattctct

SEQ ID NO: 432398 - DNA, 25 bp, Homo sapien
aaccatggccaacaacattctctct

SEQ ID NO: 432399 - DNA, 25 bp, Homo sapien
attctctctcacctatcatactaat

SEQ ID NO: 432400 - DNA, 25 bp, Homo sapien
ttctctctcacctatcatactaatg

SEQ ID NO: 432401 - DNA, 25 bp, Homo sapien
tctctctcacctatcatactaatgc

SEQ ID NO: 432402 - DNA, 25 bp, Homo sapien
ctctcacctatcatactaatgccat

SEQ ID NO: 432403 - DNA, 25 bp, Homo sapien
acctatcatactaatgccatataag

SEQ ID NO: 432404 - DNA, 25 bp, Homo sapien
taatgccatataagtagtagtgttt

SEQ ID NO: 432405 - DNA, 25 bp, Homo sapien
ctcaggaggagctttagggaaatca

SEQ ID NO: 432406 - DNA, 25 bp, Homo sapien
agaagactggcccagtctctaccaa

SEQ ID NO: 432407 - DNA, 25 bp, Homo sapien
ggcccagtctctaccaagtggtgga

SEQ ID NO: 432408 - DNA, 25 bp, Homo sapien
caagtggtggatttagagccggcat

SEQ ID NO: 432409 - DNA, 25 bp, Homo sapien
atttagagccggcatggcttcgttc

SEQ ID NO: 432410 - DNA, 25 bp, Homo sapien
ggcatggcttcgttccaaatctcac

SEQ ID NO: 432411 - DNA, 25 bp, Homo sapien
gcttcgttccaaatctcacccttgt

SEQ ID NO: 432412 - DNA, 25 bp, Homo sapien
atgggacctcccattcctgagggag

SEQ ID NO: 432413 - DNA, 25 bp, Homo sapien
cattcctgagggagcctggatacgg

SEQ ID NO: 432414 - DNA, 25 bp, Homo sapien
ctggatacgggcaagtgcacaaccc

SEQ ID NO: 432415 - DNA, 25 bp, Homo sapien
atacgggcaagtgcacaacccggga

SEQ ID NO: 432416 - DNA, 25 bp, Homo sapien
taaggatggggttttactatgttgg

SEQ ID NO: 432417 - DNA, 25 bp, Homo sapien
acctcagatggatccgcctgccttg

SEQ ID NO: 432418 - DNA, 25 bp, Homo sapien
cctcagatggatccgcctgccttgg

SEQ ID NO: 432419 - DNA, 25 bp, Homo sapien
ctcagatggatccgcctgccttggc

SEQ ID NO: 432420 - DNA, 25 bp, Homo sapien
accgtgcccagctgccactgatttt

SEQ ID NO: 432421 - DNA, 25 bp, Homo sapien
ccgtgcccagctgccactgattttt

SEQ ID NO: 432422 - DNA, 25 bp, Homo sapien
cgtgcccagctgccactgatttttc

SEQ ID NO: 432423 - DNA, 25 bp, Homo sapien
gtgcccagctgccactgatttttcc

SEQ ID NO: 432424 - DNA, 25 bp, Homo sapien
tgcccagctgccactgatttttcca

SEQ ID NO: 432425 - DNA, 25 bp, Homo sapien
ataggaacctagatgttgacataat

SEQ ID NO: 432426 - DNA, 25 bp, Homo sapien
gttgacataataaaccagatgttca

SEQ ID NO: 432427 - DNA, 25 bp, Homo sapien
gaacaattaggctgtcaagtccatg

SEQ ID NO: 432428 - DNA, 25 bp, Homo sapien
taggctgtcaagtccatgaagaagt

SEQ ID NO: 432429 - DNA, 25 bp, Homo sapien
gtcaagtccatgaagaagtctacag

SEQ ID NO: 432430 - DNA, 25 bp, Homo sapien
aagcaggcttgagttttgggatgaa

SEQ ID NO: 432431 - DNA, 25 bp, Homo sapien
tgcagcaaaagagttccctgaattt

SEQ ID NO: 432432 - DNA, 25 bp, Homo sapien
ataggatatatgtacttactgcttc

SEQ ID NO: 432433 - DNA, 25 bp, Homo sapien
atagatacaattttatagccagtag

SEQ ID NO: 432434 - DNA, 25 bp, Homo sapien
tatagccagtagagagaagagctgt

SEQ ID NO: 432435 - DNA, 25 bp, Homo sapien
tccaagttagaataggaacctagat

SEQ ID NO: 432436 - DNA, 25 bp, Homo sapien
accgtgcgctgagtgatacgtggtt

SEQ ID NO: 432437 - DNA, 25 bp, Homo sapien
gatacgtggttcactttaacttcgc

SEQ ID NO: 432438 - DNA, 25 bp, Homo sapien
gttcactttaacttcgcacatggta

SEQ ID NO: 432439 - DNA, 25 bp, Homo sapien
aaaatcagtttctttccatgatctg

SEQ ID NO: 432440 - DNA, 25 bp, Homo sapien
agtttctttccatgatctgtttcac

SEQ ID NO: 432441 - DNA, 25 bp, Homo sapien
acagtctctgtgaagctacctacca

SEQ ID NO: 432442 - DNA, 25 bp, Homo sapien
tctgtgaagctacctaccacaaaga

SEQ ID NO: 432443 - DNA, 25 bp, Homo sapien
gtgagtgatgactttctagaatcta

SEQ ID NO: 432444 - DNA, 25 bp, Homo sapien
ctagaatctaagtatatggcatgta

SEQ ID NO: 432445 - DNA, 25 bp, Homo sapien
ggaaattacaaaccccttgagatga

SEQ ID NO: 432446 - DNA, 25 bp, Homo sapien
caaaccccttgagatgaagtgataa

SEQ ID NO: 432447 - DNA, 25 bp, Homo sapien
caggcacgcgacaccacgtccagat

SEQ ID NO: 432448 - DNA, 25 bp, Homo sapien
aggcacgcgacaccacgtccagata

SEQ ID NO: 432449 - DNA, 25 bp, Homo sapien
ggcacgcgacaccacgtccagataa

SEQ ID NO: 432450 - DNA, 25 bp, Homo sapien
gcacgcgacaccacgtccagataat

SEQ ID NO: 432451 - DNA, 25 bp, Homo sapien
cacgcgacaccacgtccagataatt

SEQ ID NO: 432452 - DNA, 25 bp, Homo sapien
acgcgacaccacgtccagataattt

SEQ ID NO: 432453 - DNA, 25 bp, Homo sapien
cgcgacaccacgtccagataatttt

SEQ ID NO: 432454 - DNA, 25 bp, Homo sapien
tcagcttcccaagagagacatttcc

SEQ ID NO: 432455 - DNA, 25 bp, Homo sapien
cagcttcccaagagagacatttccc

SEQ ID NO: 432456 - DNA, 25 bp, Homo sapien
agcttcccaagagagacatttccct

SEQ ID NO: 432457 - DNA, 25 bp, Homo sapien
gcttcccaagagagacatttccctt

SEQ ID NO: 432458 - DNA, 25 bp, Homo sapien
ctgtgctcccttctctttgggcaga

SEQ ID NO: 432459 - DNA, 25 bp, Homo sapien
gaaagcatgtcaggacagagctgtt

SEQ ID NO: 432460 - DNA, 25 bp, Homo sapien
aagcatgtcaggacagagctgttgg

SEQ ID NO: 432461 - DNA, 25 bp, Homo sapien
catgtcaggacagagctgttggatt

SEQ ID NO: 432462 - DNA, 25 bp, Homo sapien
tcaggacagagctgttggattggct

SEQ ID NO: 432463 - DNA, 25 bp, Homo sapien
aggacagagctgttggattggcttt

SEQ ID NO: 432464 - DNA, 25 bp, Homo sapien
gacagagctgttggattggctttga

SEQ ID NO: 432465 - DNA, 25 bp, Homo sapien
cagagatgatggcagtccagcagca

SEQ ID NO: 432466 - DNA, 25 bp, Homo sapien
agagatgatggcagtccagcagcaa

SEQ ID NO: 432467 - DNA, 25 bp, Homo sapien
gagatgatggcagtccagcagcaac

SEQ ID NO: 432468 - DNA, 25 bp, Homo sapien
agatgatggcagtccagcagcaact

SEQ ID NO: 432469 - DNA, 25 bp, Homo sapien
caaatttgagttttgtgaacccctg

SEQ ID NO: 432470 - DNA, 25 bp, Homo sapien
gtgaacccctgaacagatggtctta

SEQ ID NO: 432471 - DNA, 25 bp, Homo sapien
tggtcttaaggacgttatctggaac

SEQ ID NO: 432472 - DNA, 25 bp, Homo sapien
gacaattctatagattaaatcctgg

SEQ ID NO: 432473 - DNA, 25 bp, Homo sapien
ctggtaaggacaaacattgccatta

SEQ ID NO: 432474 - DNA, 25 bp, Homo sapien
aaaagcttcaaaatagacctgtggc

SEQ ID NO: 432475 - DNA, 25 bp, Homo sapien
gacctgtggcagatgtcacatgagt

SEQ ID NO: 432476 - DNA, 25 bp, Homo sapien
catgagtagaatttctgcccagcct

SEQ ID NO: 432477 - DNA, 25 bp, Homo sapien
cccattgatccttctaacatgctgt

SEQ ID NO: 432478 - DNA, 25 bp, Homo sapien
aacatgctgttgacatcacacctaa

SEQ ID NO: 432479 - DNA, 25 bp, Homo sapien
gacatcacacctaatattcagaggg

SEQ ID NO: 432480 - DNA, 25 bp, Homo sapien
tattataatttatcatgtgcaggca

SEQ ID NO: 432481 - DNA, 25 bp, Homo sapien
catgtgcaggcattgttgctcactt

SEQ ID NO: 432482 - DNA, 25 bp, Homo sapien
aggcattgttgctcactttacaggc

SEQ ID NO: 432483 - DNA, 25 bp, Homo sapien
gctcactttacaggcaatctcatgt

SEQ ID NO: 432484 - DNA, 25 bp, Homo sapien
ggcaatctcatgtacatacaacttt

SEQ ID NO: 432485 - DNA, 25 bp, Homo sapien
caactttatgacatagttactgtta

SEQ ID NO: 432486 - DNA, 25 bp, Homo sapien
gttattatccccaattatagatgaa

SEQ ID NO: 432487 - DNA, 25 bp, Homo sapien
taggttacatgacttgaccaatgtc

SEQ ID NO: 432488 - DNA, 25 bp, Homo sapien
caatgtcacataacttgtacaggtg

SEQ ID NO: 432489 - DNA, 25 bp, Homo sapien
acatcatctgatcagcatcatcagt

SEQ ID NO: 432490 - DNA, 25 bp, Homo sapien
atcagcatcatcagttaattagtat

SEQ ID NO: 432491 - DNA, 25 bp, Homo sapien
agcagagggcccataggcagcaccc

SEQ ID NO: 432492 - DNA, 25 bp, Homo sapien
aaaaatgatctacgtgtgaggagag

SEQ ID NO: 432493 - DNA, 25 bp, Homo sapien
ttctatgatcccttcctttagtatg

SEQ ID NO: 432494 - DNA, 25 bp, Homo sapien
gatcccttcctttagtatggagctc

SEQ ID NO: 432495 - DNA, 25 bp, Homo sapien
cccttcctttagtatggagctcgat

SEQ ID NO: 432496 - DNA, 25 bp, Homo sapien
tatggagctcgattttccagctggc

SEQ ID NO: 432497 - DNA, 25 bp, Homo sapien
gagctcgattttccagctggcgctt

SEQ ID NO: 432498 - DNA, 25 bp, Homo sapien
gattttccagctggcgcttggtgag

SEQ ID NO: 432499 - DNA, 25 bp, Homo sapien
tccagctggcgcttggtgagaaagt

SEQ ID NO: 432500 - DNA, 25 bp, Homo sapien
ggcgcttggtgagaaagtacttgaa

SEQ ID NO: 432501 - DNA, 25 bp, Homo sapien
acagccttccggtgagcggccgtgc

SEQ ID NO: 432502 - DNA, 25 bp, Homo sapien
gacacccgctttaatagtggcttca

SEQ ID NO: 432503 - DNA, 25 bp, Homo sapien
tagtggcttcagatgaggcaccttg

SEQ ID NO: 432504 - DNA, 25 bp, Homo sapien
accttgtgacagaggagctcttccc

SEQ ID NO: 432505 - DNA, 25 bp, Homo sapien
aatagccattcttacttcactctga

SEQ ID NO: 432506 - DNA, 25 bp, Homo sapien
ttcactctgaggatcacgatggcgt

SEQ ID NO: 432507 - DNA, 25 bp, Homo sapien
gcgtgcaagggtgtgccaagcacat

SEQ ID NO: 432508 - DNA, 25 bp, Homo sapien
gtgccaagcacattgctatctttgg

SEQ ID NO: 432509 - DNA, 25 bp, Homo sapien
attctctctcacattagtacacctg

SEQ ID NO: 432510 - DNA, 25 bp, Homo sapien
gtacacctggatgtgaatggcacgt

SEQ ID NO: 432511 - DNA, 25 bp, Homo sapien
gaatggcacgttatctatgtaagca

SEQ ID NO: 432512 - DNA, 25 bp, Homo sapien
gcagtgatggtctctatcttgtggt

SEQ ID NO: 432513 - DNA, 25 bp, Homo sapien
acctcatcattactgtttgtctagc

SEQ ID NO: 432514 - DNA, 25 bp, Homo sapien
tcatcattactgtttgtctagcatt

SEQ ID NO: 432515 - DNA, 25 bp, Homo sapien
ttactgtttgtctagcatttgcctg

SEQ ID NO: 432516 - DNA, 25 bp, Homo sapien
actgtttgtctagcatttgcctggc

SEQ ID NO: 432517 - DNA, 25 bp, Homo sapien
gtttgtctagcatttgcctggctag

SEQ ID NO: 432518 - DNA, 25 bp, Homo sapien
gcctggctagtctcatgtgcttatt

SEQ ID NO: 432519 - DNA, 25 bp, Homo sapien
ggctagtctcatgtgcttatttttc

SEQ ID NO: 432520 - DNA, 25 bp, Homo sapien
atgtaatctttatatccttcctttc

SEQ ID NO: 432521 - DNA, 25 bp, Homo sapien
aacatttagaatcattttgagcaag

SEQ ID NO: 432522 - DNA, 25 bp, Homo sapien
ctttccaccctcagtctttttagtg

SEQ ID NO: 432523 - DNA, 25 bp, Homo sapien
tccaccctcagtctttttagtggat

SEQ ID NO: 432524 - DNA, 25 bp, Homo sapien
aatatttgatttctgtgtcacctac

SEQ ID NO: 432525 - DNA, 25 bp, Homo sapien
tgatttctgtgtcacctactgtcat

SEQ ID NO: 432526 - DNA, 25 bp, Homo sapien
gtgtcacctactgtcatttgttaaa

SEQ ID NO: 432527 - DNA, 25 bp, Homo sapien
ttgtaaatataaaacctgcctcagt

SEQ ID NO: 432528 - DNA, 25 bp, Homo sapien
aacctgcctcagttagaatgaatgg

SEQ ID NO: 432529 - DNA, 25 bp, Homo sapien
gaatggaaagcagatctacaatttg

SEQ ID NO: 432530 - DNA, 25 bp, Homo sapien
gcagatctacaatttgctaatatag

SEQ ID NO: 432531 - DNA, 25 bp, Homo sapien
atcaggttgactatatagccatact

SEQ ID NO: 432532 - DNA, 25 bp, Homo sapien
tagccatacttgaaaatgcttctga

SEQ ID NO: 432533 - DNA, 25 bp, Homo sapien
aatgcttctgagtggtgtcaacttt

SEQ ID NO: 432534 - DNA, 25 bp, Homo sapien
gtggtgtcaactttacttgaatgaa

SEQ ID NO: 432535 - DNA, 25 bp, Homo sapien
tatacagtccattgtcgttgaattc

SEQ ID NO: 432536 - DNA, 25 bp, Homo sapien
cagtccattgtcgttgaattcttat

SEQ ID NO: 432537 - DNA, 25 bp, Homo sapien
cattgtcgttgaattcttatttgaa

SEQ ID NO: 432538 - DNA, 25 bp, Homo sapien
gtgatacaccctctcatagggaaca

SEQ ID NO: 432539 - DNA, 25 bp, Homo sapien
tacaccctctcatagggaacataac

SEQ ID NO: 432540 - DNA, 25 bp, Homo sapien
atttcctcccacagcaattaatgac

SEQ ID NO: 432541 - DNA, 25 bp, Homo sapien
cacagcaattaatgacgagtgcgat

SEQ ID NO: 432542 - DNA, 25 bp, Homo sapien
tgacgagtgcgatgagaagcataat

SEQ ID NO: 432543 - DNA, 25 bp, Homo sapien
caaccaactgttgatgattgtacta

SEQ ID NO: 432544 - DNA, 25 bp, Homo sapien
aatttcatttttacacaaccagttg

SEQ ID NO: 432545 - DNA, 25 bp, Homo sapien
gtttaatttctatctataaccagta

SEQ ID NO: 432546 - DNA, 25 bp, Homo sapien
gaaaggaagggacattcctgctctt

SEQ ID NO: 432547 - DNA, 25 bp, Homo sapien
agggacattcctgctcttagagagc

SEQ ID NO: 432548 - DNA, 25 bp, Homo sapien
ctgctcttagagagcggtagccatc

SEQ ID NO: 432549 - DNA, 25 bp, Homo sapien
aggacgtgatgcgactcacagagca

SEQ ID NO: 432550 - DNA, 25 bp, Homo sapien
gatgcgactcacagagcacccagca

SEQ ID NO: 432551 - DNA, 25 bp, Homo sapien
caccggactgggtcagaaggacatt

SEQ ID NO: 432552 - DNA, 25 bp, Homo sapien
aaggacattgtcattcttcactaga

SEQ ID NO: 432553 - DNA, 25 bp, Homo sapien
gacattgtcattcttcactagaaga

SEQ ID NO: 432554 - DNA, 25 bp, Homo sapien
tcactagaagaaaggttaacccaag

SEQ ID NO: 432555 - DNA, 25 bp, Homo sapien
gaggttgatctttaaagtctttgaa

SEQ ID NO: 432556 - DNA, 25 bp, Homo sapien
ataaaacttgtcactgaatcagagg

SEQ ID NO: 432557 - DNA, 25 bp, Homo sapien
ttaaatcttacttttacagctgggc

SEQ ID NO: 432558 - DNA, 25 bp, Homo sapien
taaatcttacttttacagctgggca

SEQ ID NO: 432559 - DNA, 25 bp, Homo sapien
aaatcttacttttacagctgggcat

SEQ ID NO: 432560 - DNA, 25 bp, Homo sapien
aatcttacttttacagctgggcatg

SEQ ID NO: 432561 - DNA, 25 bp, Homo sapien
atcttacttttacagctgggcatgg

SEQ ID NO: 432562 - DNA, 25 bp, Homo sapien
tgcatgtaatcccaattactcagta

SEQ ID NO: 432563 - DNA, 25 bp, Homo sapien
gcatgtaatcccaattactcagtaa

SEQ ID NO: 432564 - DNA, 25 bp, Homo sapien
atgtaatcccaattactcagtaacc

SEQ ID NO: 432565 - DNA, 25 bp, Homo sapien
gtaatcccaattactcagtaacctg

SEQ ID NO: 432566 - DNA, 25 bp, Homo sapien
aatcccaattactcagtaacctgag

SEQ ID NO: 432567 - DNA, 25 bp, Homo sapien
ccaattactcagtaacctgaggcag

SEQ ID NO: 432568 - DNA, 25 bp, Homo sapien
taagcgcaagagtgcatgtgtgcct

SEQ ID NO: 432569 - DNA, 25 bp, Homo sapien
gtgtgcctgcaacagcaatttggtg

SEQ ID NO: 432570 - DNA, 25 bp, Homo sapien
gagttctcgaggacagcaaggatgt

SEQ ID NO: 432571 - DNA, 25 bp, Homo sapien
agccatggcagcaaatcaggaggaa

SEQ ID NO: 432572 - DNA, 25 bp, Homo sapien
caggaggaagctaggtgttcaccac

SEQ ID NO: 432573 - DNA, 25 bp, Homo sapien
gtgttcaccacattaaccttatcat

SEQ ID NO: 432574 - DNA, 25 bp, Homo sapien
aagaaaacaatctgcctctcttggc

SEQ ID NO: 432575 - DNA, 25 bp, Homo sapien
acaatctgcctctcttggcctggga

SEQ ID NO: 432576 - DNA, 25 bp, Homo sapien
attccagatctcatacattaagttg

SEQ ID NO: 432577 - DNA, 25 bp, Homo sapien
aaagctgtggatcatgttataatat

SEQ ID NO: 432578 - DNA, 25 bp, Homo sapien
gaggtcaaaagccttcttgctgaga

SEQ ID NO: 432579 - DNA, 25 bp, Homo sapien
tctgtgctaaataacgctcctgcta

SEQ ID NO: 432580 - DNA, 25 bp, Homo sapien
tcctgctagctccatgacagttgac

SEQ ID NO: 432581 - DNA, 25 bp, Homo sapien
gacaatcgccatgacagtgaccaga

SEQ ID NO: 432582 - DNA, 25 bp, Homo sapien
ggaaggcagcactctggttttagga

SEQ ID NO: 432583 - DNA, 25 bp, Homo sapien
ggttttaggaagttcactgcccatt

SEQ ID NO: 432584 - DNA, 25 bp, Homo sapien
aagttcactgcccatttctgaaaaa

SEQ ID NO: 432585 - DNA, 25 bp, Homo sapien
tccctttgcttgaatgtgaaacacc

SEQ ID NO: 432586 - DNA, 25 bp, Homo sapien
cccctcactcctcattagttgaaaa

SEQ ID NO: 432587 - DNA, 25 bp, Homo sapien
tgatttgtgagccatactcctgctt

SEQ ID NO: 432588 - DNA, 25 bp, Homo sapien
cctgcttctcaattcagtggcgatt

SEQ ID NO: 432589 - DNA, 25 bp, Homo sapien
ggcgattgaataaaacctgcagtgt

SEQ ID NO: 432590 - DNA, 25 bp, Homo sapien
gccgattatccccaattttcaagtt

SEQ ID NO: 432591 - DNA, 25 bp, Homo sapien
cgattatccccaattttcaagttca

SEQ ID NO: 432592 - DNA, 25 bp, Homo sapien
tttcaagttcatgacactggtagga

SEQ ID NO: 432593 - DNA, 25 bp, Homo sapien
gttcatgacactggtaggaatatgg

SEQ ID NO: 432594 - DNA, 25 bp, Homo sapien
gaaatcgagaactttcgaaatagct

SEQ ID NO: 432595 - DNA, 25 bp, Homo sapien
aatagctttggacttaacattcaat

SEQ ID NO: 432596 - DNA, 25 bp, Homo sapien
aatttttggttattcttggcaagct

SEQ ID NO: 432597 - DNA, 25 bp, Homo sapien
attcttggcaagctgatggtacttt

SEQ ID NO: 432598 - DNA, 25 bp, Homo sapien
caagctgatggtactttttgcataa

SEQ ID NO: 432599 - DNA, 25 bp, Homo sapien
ttttgtggattcttggttgtactgt

SEQ ID NO: 432600 - DNA, 25 bp, Homo sapien
tgtggattcttggttgtactgtagt

SEQ ID NO: 432601 - DNA, 25 bp, Homo sapien
aagttagctttcttattggagttat

SEQ ID NO: 432602 - DNA, 25 bp, Homo sapien
attggagttatttcttttctgtaag

SEQ ID NO: 432603 - DNA, 25 bp, Homo sapien
agagattttgttttacgcattttag

SEQ ID NO: 432604 - DNA, 25 bp, Homo sapien
tacgcattttagtaacctgcaacaa

SEQ ID NO: 432605 - DNA, 25 bp, Homo sapien
cctgcaacaaccaactctaaaaaag

SEQ ID NO: 432606 - DNA, 25 bp, Homo sapien
gatttggcttgtaatgacggtctct

SEQ ID NO: 432607 - DNA, 25 bp, Homo sapien
aatgacggtctctgcttttttgggt

SEQ ID NO: 432608 - DNA, 25 bp, Homo sapien
ttgggtttggagtacacaattgtaa

SEQ ID NO: 432609 - DNA, 25 bp, Homo sapien
gttcaaggtattgactagtttcata

SEQ ID NO: 432610 - DNA, 25 bp, Homo sapien
tcattggttggaaagcagattacat

SEQ ID NO: 432611 - DNA, 25 bp, Homo sapien
gaaagcagattacattttgcactat

SEQ ID NO: 432612 - DNA, 25 bp, Homo sapien
catagctctgctgcgtaggtctaca

SEQ ID NO: 432613 - DNA, 25 bp, Homo sapien
tagctctgctgcgtaggtctacatc

SEQ ID NO: 432614 - DNA, 25 bp, Homo sapien
tctgctgcgtaggtctacatcttac

SEQ ID NO: 432615 - DNA, 25 bp, Homo sapien
gcgtaggtctacatcttactcagaa

SEQ ID NO: 432616 - DNA, 25 bp, Homo sapien
ggtctacatcttactcagaatcact

SEQ ID NO: 432617 - DNA, 25 bp, Homo sapien
atcttactcagaatcactacacatt

SEQ ID NO: 432618 - DNA, 25 bp, Homo sapien
gaatcactacacattcctttagtct

SEQ ID NO: 432619 - DNA, 25 bp, Homo sapien
tacacattcctttagtcttcctcca

SEQ ID NO: 432620 - DNA, 25 bp, Homo sapien
tttagtcttcctccaagctccagag

SEQ ID NO: 432621 - DNA, 25 bp, Homo sapien
aagctccagagccattggtacaaat

SEQ ID NO: 432622 - DNA, 25 bp, Homo sapien
gctccagagccattggtacaaatgc

SEQ ID NO: 432623 - DNA, 25 bp, Homo sapien
gactgtgagggctcaaatacatcac

SEQ ID NO: 432624 - DNA, 25 bp, Homo sapien
gggctcaaatacatcacctactcat

SEQ ID NO: 432625 - DNA, 25 bp, Homo sapien
tacatcacctactcattgcatggtc

SEQ ID NO: 432626 - DNA, 25 bp, Homo sapien
tactcattgcatggtccttcctaaa

SEQ ID NO: 432627 - DNA, 25 bp, Homo sapien
attgcatggtccttcctaaagagcc

SEQ ID NO: 432628 - DNA, 25 bp, Homo sapien
atggtccttcctaaagagcctagaa

SEQ ID NO: 432629 - DNA, 25 bp, Homo sapien
agagcctagaaaatggtttctcctg

SEQ ID NO: 432630 - DNA, 25 bp, Homo sapien
aaaatggtttctcctgctgggtgtg

SEQ ID NO: 432631 - DNA, 25 bp, Homo sapien
cacgcttctgcagcaaactcttaag

SEQ ID NO: 432632 - DNA, 25 bp, Homo sapien
tgcagcaaactcttaagtcctccag

SEQ ID NO: 432633 - DNA, 25 bp, Homo sapien
agcaaactcttaagtcctccagctc

SEQ ID NO: 432634 - DNA, 25 bp, Homo sapien
agacagggactcagcgcagtgctcc

SEQ ID NO: 432635 - DNA, 25 bp, Homo sapien
tccttccgggagcagggtgtggtgg

SEQ ID NO: 432636 - DNA, 25 bp, Homo sapien
gaggcaggcagctgtcacagccaca

SEQ ID NO: 432637 - DNA, 25 bp, Homo sapien
aggcagctgtcacagccacagcggc

SEQ ID NO: 432638 - DNA, 25 bp, Homo sapien
ccacagcggctctgaatggcttgag

SEQ ID NO: 432639 - DNA, 25 bp, Homo sapien
gcggctctgaatggcttgagctttt

SEQ ID NO: 432640 - DNA, 25 bp, Homo sapien
tggcttgagcttttagtatgtgttc

SEQ ID NO: 432641 - DNA, 25 bp, Homo sapien
ttgagcttttagtatgtgttcaagt

SEQ ID NO: 432642 - DNA, 25 bp, Homo sapien
gttcaagtgcaggatactacaaact

SEQ ID NO: 432643 - DNA, 25 bp, Homo sapien
agtgcaggatactacaaactggtaa

SEQ ID NO: 432644 - DNA, 25 bp, Homo sapien
aaactggtaaagacttccaccatgt

SEQ ID NO: 432645 - DNA, 25 bp, Homo sapien
agatactgagtattccttaagggta

SEQ ID NO: 432646 - DNA, 25 bp, Homo sapien
agtattccttaagggtagggcacag

SEQ ID NO: 432647 - DNA, 25 bp, Homo sapien
caggacaggttaattaaggtcactt

SEQ ID NO: 432648 - DNA, 25 bp, Homo sapien
taaggtcacttaaatcttcatcttt

SEQ ID NO: 432649 - DNA, 25 bp, Homo sapien
atcttcatcttttacagcagatcag

SEQ ID NO: 432650 - DNA, 25 bp, Homo sapien
agcagatcagaacccagatggctga

SEQ ID NO: 432651 - DNA, 25 bp, Homo sapien
gctgactttttatgcaggatttctg

SEQ ID NO: 432652 - DNA, 25 bp, Homo sapien
gtagagctggttgcaaggttcacat

SEQ ID NO: 432653 - DNA, 25 bp, Homo sapien
ggttgcaaggttcacatcgacactt

SEQ ID NO: 432654 - DNA, 25 bp, Homo sapien
ggttcacatcgacacttaatagttg

SEQ ID NO: 432655 - DNA, 25 bp, Homo sapien
atagttgtaatcttcttatccagaa

SEQ ID NO: 432656 - DNA, 25 bp, Homo sapien
acatctagaaacattacaccacaca

SEQ ID NO: 432657 - DNA, 25 bp, Homo sapien
catctagaaacattacaccacacac

SEQ ID NO: 432658 - DNA, 25 bp, Homo sapien
atctagaaacattacaccacacaca

SEQ ID NO: 432659 - DNA, 25 bp, Homo sapien
tctagaaacattacaccacacacac

SEQ ID NO: 432660 - DNA, 25 bp, Homo sapien
ctagaaacattacaccacacacacc

SEQ ID NO: 432661 - DNA, 25 bp, Homo sapien
aacattacaccacacacaccgtcat

SEQ ID NO: 432662 - DNA, 25 bp, Homo sapien
cattacaccacacacaccgtcatca

SEQ ID NO: 432663 - DNA, 25 bp, Homo sapien
ttacaccacacacaccgtcatcaca

SEQ ID NO: 432664 - DNA, 25 bp, Homo sapien
accacacacaccgtcatcacatttt

SEQ ID NO: 432665 - DNA, 25 bp, Homo sapien
ccacacacaccgtcatcacattttc

SEQ ID NO: 432666 - DNA, 25 bp, Homo sapien
attcctggggtttaattgttgtgca

SEQ ID NO: 432667 - DNA, 25 bp, Homo sapien
aagctgctgttgatgacaaagactc

SEQ ID NO: 432668 - DNA, 25 bp, Homo sapien
aagactcaaaggctggaagagctcc

SEQ ID NO: 432669 - DNA, 25 bp, Homo sapien
ggaagagctcccaaggaagctagaa

SEQ ID NO: 432670 - DNA, 25 bp, Homo sapien
agctagaaatgcttgtctttgaaag

SEQ ID NO: 432671 - DNA, 25 bp, Homo sapien
tctttgaaagaactgtgggacccct

SEQ ID NO: 432672 - DNA, 25 bp, Homo sapien
ggaccccttcagattccctgaggta

SEQ ID NO: 432673 - DNA, 25 bp, Homo sapien
attccctgaggtatggcttggtcac

SEQ ID NO: 432674 - DNA, 25 bp, Homo sapien
ttggtcactctcaggtcctcaaagc

SEQ ID NO: 432675 - DNA, 25 bp, Homo sapien
cctgtcttagttgggctgggtccta

SEQ ID NO: 432676 - DNA, 25 bp, Homo sapien
tgggtcctagctgcagggtctttgt

SEQ ID NO: 432677 - DNA, 25 bp, Homo sapien
ctgcagggtctttgtgagggtcaca

SEQ ID NO: 432678 - DNA, 25 bp, Homo sapien
atctggagcagcatggacctgtcag

SEQ ID NO: 432679 - DNA, 25 bp, Homo sapien
acaaactttggtatgtcttactgaa

SEQ ID NO: 432680 - DNA, 25 bp, Homo sapien
gaaacatgcttctaaccctagagca

SEQ ID NO: 432681 - DNA, 25 bp, Homo sapien
atgcttctaaccctagagcaggagg

SEQ ID NO: 432682 - DNA, 25 bp, Homo sapien
agagattgccaatgccaagtccaga

SEQ ID NO: 432683 - DNA, 25 bp, Homo sapien
gccaatgccaagtccagagcggtta

SEQ ID NO: 432684 - DNA, 25 bp, Homo sapien
gtccagagcggttagataaggtagt

SEQ ID NO: 432685 - DNA, 25 bp, Homo sapien
aaggtagtagattccatggatgcat

SEQ ID NO: 432686 - DNA, 25 bp, Homo sapien
cattagataaagttgtccaggaaag

SEQ ID NO: 432687 - DNA, 25 bp, Homo sapien
tgccctaaggcttcttcagactggt

SEQ ID NO: 432688 - DNA, 25 bp, Homo sapien
taaggcttcttcagactggtcaaga

SEQ ID NO: 432689 - DNA, 25 bp, Homo sapien
aggagctagatgtgcagactgcagt

SEQ ID NO: 432690 - DNA, 25 bp, Homo sapien
gcagtagcactgcagtctgagactg

SEQ ID NO: 432691 - DNA, 25 bp, Homo sapien
tgacaagcgggaactactctagaat

SEQ ID NO: 432692 - DNA, 25 bp, Homo sapien
gggaatgcctccaatctagctcaat

SEQ ID NO: 432693 - DNA, 25 bp, Homo sapien
tacatggtatctatgccccatactc

SEQ ID NO: 432694 - DNA, 25 bp, Homo sapien
atctatgccccatactcacactgta

SEQ ID NO: 432695 - DNA, 25 bp, Homo sapien
atttgcaactggaataggtctagaa

SEQ ID NO: 432696 - DNA, 25 bp, Homo sapien
ctagctcaataccaagacttccagt

SEQ ID NO: 432697 - DNA, 25 bp, Homo sapien
agacttccagttataagaggtgtgc

SEQ ID NO: 432698 - DNA, 25 bp, Homo sapien
ggtgtgccagaagcaattctgactt

SEQ ID NO: 432699 - DNA, 25 bp, Homo sapien
attctgacttgctgcaacttgcagg

SEQ ID NO: 432700 - DNA, 25 bp, Homo sapien
aaaatactttccagtcagacttctc

SEQ ID NO: 432701 - DNA, 25 bp, Homo sapien
ttccagtcagacttctcgtcaatta

SEQ ID NO: 432702 - DNA, 25 bp, Homo sapien
gacttctcgtcaattataggtgata

SEQ ID NO: 432703 - DNA, 25 bp, Homo sapien
gattcccttgttcaatcaggactct

SEQ ID NO: 432704 - DNA, 25 bp, Homo sapien
cccttgttcaatcaggactcttgat

SEQ ID NO: 432705 - DNA, 25 bp, Homo sapien
tcttgattttctgaaggaactttat

SEQ ID NO: 432706 - DNA, 25 bp, Homo sapien
gatataaaacatacagaacactctg

SEQ ID NO: 432707 - DNA, 25 bp, Homo sapien
agaacactctgctttaaacctttag

SEQ ID NO: 432708 - DNA, 25 bp, Homo sapien
aaccaaaggaaagtgccgtgttgca

SEQ ID NO: 432709 - DNA, 25 bp, Homo sapien
aacttcattgtcttaaaagccacat

SEQ ID NO: 432710 - DNA, 25 bp, Homo sapien
aagccacattgagctatagtttgtt

SEQ ID NO: 432711 - DNA, 25 bp, Homo sapien
agtataatgagaatgacatgtctgt

SEQ ID NO: 432712 - DNA, 25 bp, Homo sapien
ggagagggcagcaaaagttcatttt

SEQ ID NO: 432713 - DNA, 25 bp, Homo sapien
ggcagcaaaagttcattttccctgt

SEQ ID NO: 432714 - DNA, 25 bp, Homo sapien
gcaaaagttcattttccctgttagt

SEQ ID NO: 432715 - DNA, 25 bp, Homo sapien
attttccctgttagtaatgctgtgg

SEQ ID NO: 432716 - DNA, 25 bp, Homo sapien
ttccctgttagtaatgctgtggttc

SEQ ID NO: 432717 - DNA, 25 bp, Homo sapien
ccctgttagtaatgctgtggttcat

SEQ ID NO: 432718 - DNA, 25 bp, Homo sapien
gtaatgctgtggttcatgatcggtt

SEQ ID NO: 432719 - DNA, 25 bp, Homo sapien
tgctgtggttcatgatcggttttaa

SEQ ID NO: 432720 - DNA, 25 bp, Homo sapien
gtggttcatgatcggttttaaattt

SEQ ID NO: 432721 - DNA, 25 bp, Homo sapien
agcatctctttgtgagtagaggtaa

SEQ ID NO: 432722 - DNA, 25 bp, Homo sapien
ggtcgtgaccgcttacaccccttct

SEQ ID NO: 432723 - DNA, 25 bp, Homo sapien
acctcctggcaactctcggtgccgt

SEQ ID NO: 432724 - DNA, 25 bp, Homo sapien
ttctccccagcaccgctgtggtgtg

SEQ ID NO: 432725 - DNA, 25 bp, Homo sapien
caccgctgtggtgtgccgggatcct

SEQ ID NO: 432726 - DNA, 25 bp, Homo sapien
gtgccgggatcctgagcctaggcct

SEQ ID NO: 432727 - DNA, 25 bp, Homo sapien
gagcctaggcctcccgatgttccca

SEQ ID NO: 432728 - DNA, 25 bp, Homo sapien
gccacacgatgctccgttttcttcc

SEQ ID NO: 432729 - DNA, 25 bp, Homo sapien
tgtgaatgccgcgtcctgtcctggt

SEQ ID NO: 432730 - DNA, 25 bp, Homo sapien
aatgccgcgtcctgtcctggtgaca

SEQ ID NO: 432731 - DNA, 25 bp, Homo sapien
cctggtgacaggagaacaatgttgg

SEQ ID NO: 432732 - DNA, 25 bp, Homo sapien
caggagaacaatgttggtgaacgtc

SEQ ID NO: 432733 - DNA, 25 bp, Homo sapien
gggtggagggcgcttgctgggatgt

SEQ ID NO: 432734 - DNA, 25 bp, Homo sapien
cgcttgctgggatgtgtggtgtgct

SEQ ID NO: 432735 - DNA, 25 bp, Homo sapien
atgtgtggtgtgctggctggctgac

SEQ ID NO: 432736 - DNA, 25 bp, Homo sapien
acggcagaggcgaggaaccccgcat

SEQ ID NO: 432737 - DNA, 25 bp, Homo sapien
agaggcgaggaaccccgcatgtcta

SEQ ID NO: 432738 - DNA, 25 bp, Homo sapien
gaggaaccccgcatgtctagaagag

SEQ ID NO: 432739 - DNA, 25 bp, Homo sapien
ggaaccccgcatgtctagaagagtt

SEQ ID NO: 432740 - DNA, 25 bp, Homo sapien
aaccccgcatgtctagaagagttgg

SEQ ID NO: 432741 - DNA, 25 bp, Homo sapien
gcatgtctagaagagttgggtcata

SEQ ID NO: 432742 - DNA, 25 bp, Homo sapien
gagttgggtcatatttaagcaggga

SEQ ID NO: 432743 - DNA, 25 bp, Homo sapien
tgggtcatatttaagcagggagaaa

SEQ ID NO: 432744 - DNA, 25 bp, Homo sapien
acttgttcatcctacatatctgcta

SEQ ID NO: 432745 - DNA, 25 bp, Homo sapien
atatctgctattttgtatccttgac

SEQ ID NO: 432746 - DNA, 25 bp, Homo sapien
tttgtatccttgacctatatctccc

SEQ ID NO: 432747 - DNA, 25 bp, Homo sapien
agtagtaaccactgtttcgttctgt

SEQ ID NO: 432748 - DNA, 25 bp, Homo sapien
cgttctgtgtattttagctccttaa

SEQ ID NO: 432749 - DNA, 25 bp, Homo sapien
gcaatattttccttggtgtctggct

SEQ ID NO: 432750 - DNA, 25 bp, Homo sapien
cttggtgtctggcttatctcattta

SEQ ID NO: 432751 - DNA, 25 bp, Homo sapien
tctcatttaacataacgtccttcag

SEQ ID NO: 432752 - DNA, 25 bp, Homo sapien
gtccttcaggtccatctatgttgtg

SEQ ID NO: 432753 - DNA, 25 bp, Homo sapien
agtaggatctccttttttaaggctg

SEQ ID NO: 432754 - DNA, 25 bp, Homo sapien
atgttccattgtacattgtctatac

SEQ ID NO: 432755 - DNA, 25 bp, Homo sapien
aacctttaaccatctctgaactagt

SEQ ID NO: 432756 - DNA, 25 bp, Homo sapien
gaactagtgtacaacccaagtgcca

SEQ ID NO: 432757 - DNA, 25 bp, Homo sapien
tgagattgacatgctctttgactgt

SEQ ID NO: 432758 - DNA, 25 bp, Homo sapien
tttgactgtccttctaggcttgagt

SEQ ID NO: 432759 - DNA, 25 bp, Homo sapien
gtccttctaggcttgagttggaaag

SEQ ID NO: 432760 - DNA, 25 bp, Homo sapien
attcatttgaggatctggaagcaga

SEQ ID NO: 432761 - DNA, 25 bp, Homo sapien
gatgaaaacgcctttttgattgctg

SEQ ID NO: 432762 - DNA, 25 bp, Homo sapien
ctcgccgtgctttgtcgtggagcta

SEQ ID NO: 432763 - DNA, 25 bp, Homo sapien
cgtggagctacgacattctgactgg

SEQ ID NO: 432764 - DNA, 25 bp, Homo sapien
tacgacattctgactggccatattc

SEQ ID NO: 432765 - DNA, 25 bp, Homo sapien
gactggccatattcgggtgaaccca

SEQ ID NO: 432766 - DNA, 25 bp, Homo sapien
agtcatcccatttgtatgcctcata

SEQ ID NO: 432767 - DNA, 25 bp, Homo sapien
tcatacttcctctaccctggtagat

SEQ ID NO: 432768 - DNA, 25 bp, Homo sapien
ctaccctggtagattctttcaagat

SEQ ID NO: 432769 - DNA, 25 bp, Homo sapien
ttcaagatccttgggctttactttc

SEQ ID NO: 432770 - DNA, 25 bp, Homo sapien
gctttactttcctcacataactcag

SEQ ID NO: 432771 - DNA, 25 bp, Homo sapien
gttattctgcttctagtttaccatt

SEQ ID NO: 432772 - DNA, 25 bp, Homo sapien
attctggaaattgagagtcccatcc

SEQ ID NO: 432773 - DNA, 25 bp, Homo sapien
tggacttatgacactactgaaactt

SEQ ID NO: 432774 - DNA, 25 bp, Homo sapien
ttagacttcaaggttcctcacctac

SEQ ID NO: 432775 - DNA, 25 bp, Homo sapien
ccctcttcctgtgctctaataatat

SEQ ID NO: 432776 - DNA, 25 bp, Homo sapien
agagggctcgatggatatgtgttca

SEQ ID NO: 432777 - DNA, 25 bp, Homo sapien
ctttttctgggtgctgagaagggag

SEQ ID NO: 432778 - DNA, 25 bp, Homo sapien
gtaaacagtaatatctttagcttaa

SEQ ID NO: 432779 - DNA, 25 bp, Homo sapien
gtgcaatcagtgttgttgattccac

SEQ ID NO: 432780 - DNA, 25 bp, Homo sapien
atcagtgttgttgattccaccgaat

SEQ ID NO: 432781 - DNA, 25 bp, Homo sapien
gtgttgttgattccaccgaattcta

SEQ ID NO: 432782 - DNA, 25 bp, Homo sapien
gttgattccaccgaattctaagaat

SEQ ID NO: 432783 - DNA, 25 bp, Homo sapien
gaattccattacatcttgatatctg

SEQ ID NO: 432784 - DNA, 25 bp, Homo sapien
ccattacatcttgatatctggtaca

SEQ ID NO: 432785 - DNA, 25 bp, Homo sapien
tacatcttgatatctggtacaagct

SEQ ID NO: 432786 - DNA, 25 bp, Homo sapien
tttagcttaagaacccaactgaaat

SEQ ID NO: 432787 - DNA, 25 bp, Homo sapien
ttaagaacccaactgaaatgtttgt

SEQ ID NO: 432788 - DNA, 25 bp, Homo sapien
attgatctcctattggcaatctgaa

SEQ ID NO: 432789 - DNA, 25 bp, Homo sapien
ggcaatctgaactcctttggttgtt

SEQ ID NO: 432790 - DNA, 25 bp, Homo sapien
cctttggttgttgctgtggttcaat

SEQ ID NO: 432791 - DNA, 25 bp, Homo sapien
gctgtggttcaatggcttttaccgg

SEQ ID NO: 432792 - DNA, 25 bp, Homo sapien
gcttttaccggcaaggaaggcaccg

SEQ ID NO: 432793 - DNA, 25 bp, Homo sapien
gaaggcaccggatctttggaattga

SEQ ID NO: 432794 - DNA, 25 bp, Homo sapien
ggaattgacatatacatctcttagt

SEQ ID NO: 432795 - DNA, 25 bp, Homo sapien
catctcttagtaaggacagcagctt

SEQ ID NO: 432796 - DNA, 25 bp, Homo sapien
gaaacttcttcctcgatttctggat

SEQ ID NO: 432797 - DNA, 25 bp, Homo sapien
aatcatctggacaccctagggactt

SEQ ID NO: 432798 - DNA, 25 bp, Homo sapien
gggacttacattagggcgagactct

SEQ ID NO: 432799 - DNA, 25 bp, Homo sapien
ttctccatccctctaatgagactga

SEQ ID NO: 432800 - DNA, 25 bp, Homo sapien
gagactgaccatattgtgcttcaca

SEQ ID NO: 432801 - DNA, 25 bp, Homo sapien
tgtgcttcacagtagagccagcttg

SEQ ID NO: 432802 - DNA, 25 bp, Homo sapien
accaaagctgcccactgtttctctt

SEQ ID NO: 432803 - DNA, 25 bp, Homo sapien
tgtttctcttgagctggcctctcta

SEQ ID NO: 432804 - DNA, 25 bp, Homo sapien
ggcctctctagcacaatttgcacta

SEQ ID NO: 432805 - DNA, 25 bp, Homo sapien
aatatttcccatttgtgccagagga

SEQ ID NO: 432806 - DNA, 25 bp, Homo sapien
gaggaatcctggcagcccagagact

SEQ ID NO: 432807 - DNA, 25 bp, Homo sapien
gcagcccagagactttgtagatcct

SEQ ID NO: 432808 - DNA, 25 bp, Homo sapien
ttgtagatccttagaggtcctctgg

SEQ ID NO: 432809 - DNA, 25 bp, Homo sapien
ttagaggtcctctggagccctaacc

SEQ ID NO: 432810 - DNA, 25 bp, Homo sapien
ttttactcatttcttggtatgcttt

SEQ ID NO: 432811 - DNA, 25 bp, Homo sapien
tactcatttcttggtatgcttttat

SEQ ID NO: 432812 - DNA, 25 bp, Homo sapien
ttctctcttagaaattggatttgta

SEQ ID NO: 432813 - DNA, 25 bp, Homo sapien
cataaaatctgttcatattctgtat

SEQ ID NO: 432814 - DNA, 25 bp, Homo sapien
aatgttttttgatccaatgttgact

SEQ ID NO: 432815 - DNA, 25 bp, Homo sapien
ttttgatccaatgttgactgaagtg

SEQ ID NO: 432816 - DNA, 25 bp, Homo sapien
atagatgtagctttagtgtatatat

SEQ ID NO: 432817 - DNA, 25 bp, Homo sapien
tattattttgtattctgctcttttc

SEQ ID NO: 432818 - DNA, 25 bp, Homo sapien
tattttgtattctgctcttttcact

SEQ ID NO: 432819 - DNA, 25 bp, Homo sapien
aagtcatatgacctagtacatttta

SEQ ID NO: 432820 - DNA, 25 bp, Homo sapien
tatgacctagtacattttactcatt

SEQ ID NO: 432821 - DNA, 25 bp, Homo sapien
ccaccacacagaatgcatctggagc

SEQ ID NO: 432822 - DNA, 25 bp, Homo sapien
caccacacagaatgcatctggagcg

SEQ ID NO: 432823 - DNA, 25 bp, Homo sapien
accacacagaatgcatctggagcga

SEQ ID NO: 432824 - DNA, 25 bp, Homo sapien
ccacacagaatgcatctggagcgaa

SEQ ID NO: 432825 - DNA, 25 bp, Homo sapien
cacacagaatgcatctggagcgaat

SEQ ID NO: 432826 - DNA, 25 bp, Homo sapien
acacagaatgcatctggagcgaatg

SEQ ID NO: 432827 - DNA, 25 bp, Homo sapien
tcatgcaatcaactaacttaatccc

SEQ ID NO: 432828 - DNA, 25 bp, Homo sapien
catgcaatcaactaacttaatccct

SEQ ID NO: 432829 - DNA, 25 bp, Homo sapien
caatcaactaacttaatcccttgat

SEQ ID NO: 432830 - DNA, 25 bp, Homo sapien
tcaactaacttaatcccttgatttt

SEQ ID NO: 432831 - DNA, 25 bp, Homo sapien
ataggcaatgcacatatggcccagc

SEQ ID NO: 432832 - DNA, 25 bp, Homo sapien
aatatccacgtgaagctatctgaca

SEQ ID NO: 432833 - DNA, 25 bp, Homo sapien
gattttatccattcagttagctcag

SEQ ID NO: 432834 - DNA, 25 bp, Homo sapien
tatccattcagttagctcagttttg

SEQ ID NO: 432835 - DNA, 25 bp, Homo sapien
attcagttagctcagttttgtccaa

SEQ ID NO: 432836 - DNA, 25 bp, Homo sapien
agttagctcagttttgtccaaagga

SEQ ID NO: 432837 - DNA, 25 bp, Homo sapien
tccacgtgaagctatctgacagtta

SEQ ID NO: 432838 - DNA, 25 bp, Homo sapien
atttcttgatattattcccaataca

SEQ ID NO: 432839 - DNA, 25 bp, Homo sapien
aaattaatcaaagcacttcattctg

SEQ ID NO: 432840 - DNA, 25 bp, Homo sapien
gctatctgacagttagagggaccta

SEQ ID NO: 432841 - DNA, 25 bp, Homo sapien
cattctgtatatcagatttctggct

SEQ ID NO: 432842 - DNA, 25 bp, Homo sapien
ctgacagttagagggacctaagttt

SEQ ID NO: 432843 - DNA, 25 bp, Homo sapien
aaaatgtctctaggtgtttgtcagc

SEQ ID NO: 432844 - DNA, 25 bp, Homo sapien
aatgtctctaggtgtttgtcagcaa

SEQ ID NO: 432845 - DNA, 25 bp, Homo sapien
tgtctctaggtgtttgtcagcaata

SEQ ID NO: 432846 - DNA, 25 bp, Homo sapien
tctctaggtgtttgtcagcaataaa

SEQ ID NO: 432847 - DNA, 25 bp, Homo sapien
tgtttgtcagcaataaacggtatct

SEQ ID NO: 432848 - DNA, 25 bp, Homo sapien
gtttatttgattttatgtgcatgaa

SEQ ID NO: 432849 - DNA, 25 bp, Homo sapien
aagagtatgcattgacttggaggga

SEQ ID NO: 432850 - DNA, 25 bp, Homo sapien
gaggtgggtaatgcaggtaggttat

SEQ ID NO: 432851 - DNA, 25 bp, Homo sapien
atcacgggtgataccacaaatgtgt

SEQ ID NO: 432852 - DNA, 25 bp, Homo sapien
gggtgataccacaaatgtgtgagtt

SEQ ID NO: 432853 - DNA, 25 bp, Homo sapien
tgtgtgagttagtaaatttggctgg

SEQ ID NO: 432854 - DNA, 25 bp, Homo sapien
aaaccacaagtaaacaactgcctgt

SEQ ID NO: 432855 - DNA, 25 bp, Homo sapien
aacaactgcctgttaacctgttatt

SEQ ID NO: 432856 - DNA, 25 bp, Homo sapien
agactgaaaagccaacaggcatttt

SEQ ID NO: 432857 - DNA, 25 bp, Homo sapien
acaggcatttttcgtgtgcaatttt

SEQ ID NO: 432858 - DNA, 25 bp, Homo sapien
gcatttttcgtgtgcaatttttctt

SEQ ID NO: 432859 - DNA, 25 bp, Homo sapien
tgaaatatcaaatctgcacagcgct

SEQ ID NO: 432860 - DNA, 25 bp, Homo sapien
gcacagcgctgtcccttcacagaag

SEQ ID NO: 432861 - DNA, 25 bp, Homo sapien
gaaggcaagaaactgccggcacatc

SEQ ID NO: 432862 - DNA, 25 bp, Homo sapien
aactgccggcacatcatgtcagagg

SEQ ID NO: 432863 - DNA, 25 bp, Homo sapien
agtgggcctccctcagggtctggtt

SEQ ID NO: 432864 - DNA, 25 bp, Homo sapien
aggccttggcacagcgcggactgct

SEQ ID NO: 432865 - DNA, 25 bp, Homo sapien
attttgggaggacagtggatcacaa

SEQ ID NO: 432866 - DNA, 25 bp, Homo sapien
ttttgggaggacagtggatcacaag

SEQ ID NO: 432867 - DNA, 25 bp, Homo sapien
tttgggaggacagtggatcacaagg

SEQ ID NO: 432868 - DNA, 25 bp, Homo sapien
tgggaggacagtggatcacaaggtt

SEQ ID NO: 432869 - DNA, 25 bp, Homo sapien
aattagctgggcacatgcctgttgt

SEQ ID NO: 432870 - DNA, 25 bp, Homo sapien
attagctgggcacatgcctgttgtc

SEQ ID NO: 432871 - DNA, 25 bp, Homo sapien
ttagctgggcacatgcctgttgtcc

SEQ ID NO: 432872 - DNA, 25 bp, Homo sapien
tagctgggcacatgcctgttgtccc

SEQ ID NO: 432873 - DNA, 25 bp, Homo sapien
agctgggcacatgcctgttgtccca

SEQ ID NO: 432874 - DNA, 25 bp, Homo sapien
gcctgttgtcccagttatttgagag

SEQ ID NO: 432875 - DNA, 25 bp, Homo sapien
tgtcccagttatttgagaggctggg

SEQ ID NO: 432876 - DNA, 25 bp, Homo sapien
gatcaatttaaacacttttctttct

SEQ ID NO: 432877 - DNA, 25 bp, Homo sapien
ctcttttcagactctctagctttaa

SEQ ID NO: 432878 - DNA, 25 bp, Homo sapien
cagactctctagctttaaaaacatt

SEQ ID NO: 432879 - DNA, 25 bp, Homo sapien
agcatattacttctgaaatcacgta

SEQ ID NO: 432880 - DNA, 25 bp, Homo sapien
aactatgctcataatttctcttaca

SEQ ID NO: 432881 - DNA, 25 bp, Homo sapien
aaaatcagcccccatagtattctaa

SEQ ID NO: 432882 - DNA, 25 bp, Homo sapien
catagtattctaaaattctgtgctg

SEQ ID NO: 432883 - DNA, 25 bp, Homo sapien
gtgctgaaatatattacaactctac

SEQ ID NO: 432884 - DNA, 25 bp, Homo sapien
acaactctactaaactgtatcataa

SEQ ID NO: 432885 - DNA, 25 bp, Homo sapien
cataaacagcatttggttctctaaa

SEQ ID NO: 432886 - DNA, 25 bp, Homo sapien
tttcacagggaatttagcaggattt

SEQ ID NO: 432887 - DNA, 25 bp, Homo sapien
gagaattcctgtgttcccaaagcaa

SEQ ID NO: 432888 - DNA, 25 bp, Homo sapien
gtgttcccaaagcaactgatgttta

SEQ ID NO: 432889 - DNA, 25 bp, Homo sapien
atgtttacaggtcttgtgtttctcc

SEQ ID NO: 432890 - DNA, 25 bp, Homo sapien
tcctcctcctttctaaggatgaggg

SEQ ID NO: 432891 - DNA, 25 bp, Homo sapien
gggaatccacaacagactttctcta

SEQ ID NO: 432892 - DNA, 25 bp, Homo sapien
ggacaactttttggtgtcatcaatg

SEQ ID NO: 432893 - DNA, 25 bp, Homo sapien
gtcatcaatgagttggctactacct

SEQ ID NO: 432894 - DNA, 25 bp, Homo sapien
gagttggctactaccttgatgtaaa

SEQ ID NO: 432895 - DNA, 25 bp, Homo sapien
attttcaccatttcgagtgtcaagt

SEQ ID NO: 432896 - DNA, 25 bp, Homo sapien
aactgtctggtttgtacttttatga

SEQ ID NO: 432897 - DNA, 25 bp, Homo sapien
gacttttgtactaccaaagcggagt

SEQ ID NO: 432898 - DNA, 25 bp, Homo sapien
ggaagtagctcacccattctccact

SEQ ID NO: 432899 - DNA, 25 bp, Homo sapien
cccattctccactaagttatttcaa

SEQ ID NO: 432900 - DNA, 25 bp, Homo sapien
aagttatttcaactttcctctctgg

SEQ ID NO: 432901 - DNA, 25 bp, Homo sapien
ctctggagggcccataaaagaatat

SEQ ID NO: 432902 - DNA, 25 bp, Homo sapien
tatggcagcaatgtagtatcaaact

SEQ ID NO: 432903 - DNA, 25 bp, Homo sapien
agtatcaaactaccacagatgctag

SEQ ID NO: 432904 - DNA, 25 bp, Homo sapien
taccacagatgctagagttccactt

SEQ ID NO: 432905 - DNA, 25 bp, Homo sapien
gctagagttccacttgctataaaac

SEQ ID NO: 432906 - DNA, 25 bp, Homo sapien
cttgctataaaacctcacttagttt

SEQ ID NO: 432907 - DNA, 25 bp, Homo sapien
ggataatactataccttttgagttg

SEQ ID NO: 432908 - DNA, 25 bp, Homo sapien
ctataccttttgagttgtgaagttt

SEQ ID NO: 432909 - DNA, 25 bp, Homo sapien
gggatgggacgattgccctctagtt

SEQ ID NO: 432910 - DNA, 25 bp, Homo sapien
gatgggacgattgccctctagttgt

SEQ ID NO: 432911 - DNA, 25 bp, Homo sapien
tcatatatgatgtaaacttgctttt

SEQ ID NO: 432912 - DNA, 25 bp, Homo sapien
taaggacaagtgtgaatgtgctttt

SEQ ID NO: 432913 - DNA, 25 bp, Homo sapien
ggagaagtcagagttctttacaatc

SEQ ID NO: 432914 - DNA, 25 bp, Homo sapien
gtcagagttctttacaatcaaacgt

SEQ ID NO: 432915 - DNA, 25 bp, Homo sapien
gagttctttacaatcaaacgtttat

SEQ ID NO: 432916 - DNA, 25 bp, Homo sapien
tattaactggagtacttagaataag

SEQ ID NO: 432917 - DNA, 25 bp, Homo sapien
gaatttagttcaagggctaagcaac

SEQ ID NO: 432918 - DNA, 25 bp, Homo sapien
tagttcaagggctaagcaacacatt

SEQ ID NO: 432919 - DNA, 25 bp, Homo sapien
caagggctaagcaacacatttttaa

SEQ ID NO: 432920 - DNA, 25 bp, Homo sapien
attattgacgttttggacctgatca

SEQ ID NO: 432921 - DNA, 25 bp, Homo sapien
gttttggacctgatcattctttgtt

SEQ ID NO: 432922 - DNA, 25 bp, Homo sapien
tttagcatcattcctggccttgact

SEQ ID NO: 432923 - DNA, 25 bp, Homo sapien
tgccagtggaactccctcagttgtg

SEQ ID NO: 432924 - DNA, 25 bp, Homo sapien
ggaactccctcagttgtgacaatca

SEQ ID NO: 432925 - DNA, 25 bp, Homo sapien
tcaaaacgtcttacacacgccaatt

SEQ ID NO: 432926 - DNA, 25 bp, Homo sapien
acgccaattataccccgggtggcag

SEQ ID NO: 432927 - DNA, 25 bp, Homo sapien
attgcccaattgagaaccatggtta

SEQ ID NO: 432928 - DNA, 25 bp, Homo sapien
agaaccatggttacaggctgacaac

SEQ ID NO: 432929 - DNA, 25 bp, Homo sapien
ggctgacaacatgagtttcaaagct

SEQ ID NO: 432930 - DNA, 25 bp, Homo sapien
caaggaagacacctaattccagtct

SEQ ID NO: 432931 - DNA, 25 bp, Homo sapien
ggtaattcagttttagtgttagcta

SEQ ID NO: 432932 - DNA, 25 bp, Homo sapien
atttagctttgtaaattccaaggct

SEQ ID NO: 432933 - DNA, 25 bp, Homo sapien
ttccaaggctaaaaccctttcatgg

SEQ ID NO: 432934 - DNA, 25 bp, Homo sapien
cctttcatgggcttcacagtattta

SEQ ID NO: 432935 - DNA, 25 bp, Homo sapien
gggcttcacagtatttagtcctaat

SEQ ID NO: 432936 - DNA, 25 bp, Homo sapien
aatacccttctttattccatgacct

SEQ ID NO: 432937 - DNA, 25 bp, Homo sapien
cccttctttattccatgaccttatt

SEQ ID NO: 432938 - DNA, 25 bp, Homo sapien
aaattagtaattcagtcccagtcct

SEQ ID NO: 432939 - DNA, 25 bp, Homo sapien
ctggatctctgtagtgttttgacat

SEQ ID NO: 432940 - DNA, 25 bp, Homo sapien
aactgatattctttaaatgtggacc

SEQ ID NO: 432941 - DNA, 25 bp, Homo sapien
ctttaaatgtggacctgtaaggaga

SEQ ID NO: 432942 - DNA, 25 bp, Homo sapien
aaagtgacaccatgttcctttgggc

SEQ ID NO: 432943 - DNA, 25 bp, Homo sapien
caaaatcatgctcccagccctaaat

SEQ ID NO: 432944 - DNA, 25 bp, Homo sapien
aaatctaccattacatgtctcccac

SEQ ID NO: 432945 - DNA, 25 bp, Homo sapien
tacatgtctcccacccattagacag

SEQ ID NO: 432946 - DNA, 25 bp, Homo sapien
tagacagctctgtatgccaagcatg

SEQ ID NO: 432947 - DNA, 25 bp, Homo sapien
tgtatgccaagcatgtctctcacga

SEQ ID NO: 432948 - DNA, 25 bp, Homo sapien
atgtctctcacgacaactgcagcta

SEQ ID NO: 432949 - DNA, 25 bp, Homo sapien
tgcagctaccactcatgaatacacc

SEQ ID NO: 432950 - DNA, 25 bp, Homo sapien
tgtaaccaagcaacagatctccctg

SEQ ID NO: 432951 - DNA, 25 bp, Homo sapien
agatctccctggtagctgtccatgt

SEQ ID NO: 432952 - DNA, 25 bp, Homo sapien
acattccagtgaaaccctgttacac

SEQ ID NO: 432953 - DNA, 25 bp, Homo sapien
gctcgcacctactgagccgcgaaga

SEQ ID NO: 432954 - DNA, 25 bp, Homo sapien
tactgagccgcgaagaggcggccta

SEQ ID NO: 432955 - DNA, 25 bp, Homo sapien
aagaggcggcctacatggtggacat

SEQ ID NO: 432956 - DNA, 25 bp, Homo sapien
gcaacatcaacaccgtgcgcgctat

SEQ ID NO: 432957 - DNA, 25 bp, Homo sapien
acaccgtgcgcgctatcaacgtggc

SEQ ID NO: 432958 - DNA, 25 bp, Homo sapien
tgcgcgctatcaacgtggccctcgg

SEQ ID NO: 432959 - DNA, 25 bp, Homo sapien
gaccgctacttccttatggctaaaa

SEQ ID NO: 432960 - DNA, 25 bp, Homo sapien
cttatggctaaaagggctgtccggg

SEQ ID NO: 432961 - DNA, 25 bp, Homo sapien
gccacgccaaggtcgtctgggagat

SEQ ID NO: 432962 - DNA, 25 bp, Homo sapien
ccaaggtcgtctgggagatgctcaa

SEQ ID NO: 432963 - DNA, 25 bp, Homo sapien
tcgtctgggagatgctcaagtttga

SEQ ID NO: 432964 - DNA, 25 bp, Homo sapien
agcaatgagtcattattggttcttt

SEQ ID NO: 432965 - DNA, 25 bp, Homo sapien
aactcaatctgatcaacattttgga

SEQ ID NO: 432966 - DNA, 25 bp, Homo sapien
tttggatctaacttcctttatagga

SEQ ID NO: 432967 - DNA, 25 bp, Homo sapien
aaactatcttcattgctcaaaagtg

SEQ ID NO: 432968 - DNA, 25 bp, Homo sapien
attgcttaccaatttccaaaccaag

SEQ ID NO: 432969 - DNA, 25 bp, Homo sapien
cacccatcccacttaagaaaacatg

SEQ ID NO: 432970 - DNA, 25 bp, Homo sapien
aaaacatgggacttggccatcttct

SEQ ID NO: 432971 - DNA, 25 bp, Homo sapien
acttggccatcttctgcattgctgt

SEQ ID NO: 432972 - DNA, 25 bp, Homo sapien
tgcattgctgtgtctccaagaacgt

SEQ ID NO: 432973 - DNA, 25 bp, Homo sapien
tgtgtctccaagaacgtacctctgt

SEQ ID NO: 432974 - DNA, 25 bp, Homo sapien
aacgtacctctgtcgactacacgga

SEQ ID NO: 432975 - DNA, 25 bp, Homo sapien
tcataccagggtactgcaataccac

SEQ ID NO: 432976 - DNA, 25 bp, Homo sapien
accagggtactgcaataccactgtt

SEQ ID NO: 432977 - DNA, 25 bp, Homo sapien
gggtactgcaataccactgtttata

SEQ ID NO: 432978 - DNA, 25 bp, Homo sapien
tgcaataccactgtttataagtgac

SEQ ID NO: 432979 - DNA, 25 bp, Homo sapien
aaatcaggaagctggttactggctc

SEQ ID NO: 432980 - DNA, 25 bp, Homo sapien
caggaagctggttactggctctact

SEQ ID NO: 432981 - DNA, 25 bp, Homo sapien
gaagctggttactggctctactgag

SEQ ID NO: 432982 - DNA, 25 bp, Homo sapien
gctggttactggctctactgagagt

SEQ ID NO: 432983 - DNA, 25 bp, Homo sapien
gttactggctctactgagagttgga

SEQ ID NO: 432984 - DNA, 25 bp, Homo sapien
tctactgagagttggagccctgatg

SEQ ID NO: 432985 - DNA, 25 bp, Homo sapien
tctgattcttcaaagtcaccctaaa

SEQ ID NO: 432986 - DNA, 25 bp, Homo sapien
gctgggcttgaccatatgtacgaag

SEQ ID NO: 432987 - DNA, 25 bp, Homo sapien
aggcatcccatggatgtctcctagt

SEQ ID NO: 432988 - DNA, 25 bp, Homo sapien
atgtctcctagttccctcactgtgg

SEQ ID NO: 432989 - DNA, 25 bp, Homo sapien
actgtggcccagtgttgtatatcaa

SEQ ID NO: 432990 - DNA, 25 bp, Homo sapien
ggcccagtgttgtatatcaacgtca

SEQ ID NO: 432991 - DNA, 25 bp, Homo sapien
tcaacgtcatcatggatacacctcc

SEQ ID NO: 432992 - DNA, 25 bp, Homo sapien
atcatggatacacctcctgtgggag

SEQ ID NO: 432993 - DNA, 25 bp, Homo sapien
tgcccttatagaagggaccctggac

SEQ ID NO: 432994 - DNA, 25 bp, Homo sapien
ggacctccactctgcaaggatacag

SEQ ID NO: 432995 - DNA, 25 bp, Homo sapien
agaacccagcctcaggtacactcat

SEQ ID NO: 432996 - DNA, 25 bp, Homo sapien
aggtacactcatctcagacttgcag

SEQ ID NO: 432997 - DNA, 25 bp, Homo sapien
cgcccagcctatagttcttatttaa

SEQ ID NO: 432998 - DNA, 25 bp, Homo sapien
gcccagcctatagttcttatttaaa

SEQ ID NO: 432999 - DNA, 25 bp, Homo sapien
ccagcctatagttcttatttaaact

SEQ ID NO: 433000 - DNA, 25 bp, Homo sapien
cagcctatagttcttatttaaacta

SEQ ID NO: 433001 - DNA, 25 bp, Homo sapien
gcctatagttcttatttaaactaat

SEQ ID NO: 433002 - DNA, 25 bp, Homo sapien
tgggttcaagtgagtattttgtatt

SEQ ID NO: 433003 - DNA, 25 bp, Homo sapien
gggttcaagtgagtattttgtattt

SEQ ID NO: 433004 - DNA, 25 bp, Homo sapien
ggttcaagtgagtattttgtatttt

SEQ ID NO: 433005 - DNA, 25 bp, Homo sapien
gttcaagtgagtattttgtattttt

SEQ ID NO: 433006 - DNA, 25 bp, Homo sapien
ttcaagtgagtattttgtattttta

SEQ ID NO: 433007 - DNA, 25 bp, Homo sapien
tcaagtgagtattttgtatttttag

SEQ ID NO: 433008 - DNA, 25 bp, Homo sapien
ctcagagccagagcatcaagaagct

SEQ ID NO: 433009 - DNA, 25 bp, Homo sapien
gaagctctccaaccagttaaccttt

SEQ ID NO: 433010 - DNA, 25 bp, Homo sapien
gttaacctttctgaattggaatcca

SEQ ID NO: 433011 - DNA, 25 bp, Homo sapien
gaatccattgtaactgaaaggccac

SEQ ID NO: 433012 - DNA, 25 bp, Homo sapien
gaaaggccacaattcagcagacaaa

SEQ ID NO: 433013 - DNA, 25 bp, Homo sapien
ttcagcagacaaaaagatttccagc

SEQ ID NO: 433014 - DNA, 25 bp, Homo sapien
ttccagcagcaacaggttctggagt

SEQ ID NO: 433015 - DNA, 25 bp, Homo sapien
aatgctaagaaaatgtggccccagt

SEQ ID NO: 433016 - DNA, 25 bp, Homo sapien
gaagatcagcatcctaccattctaa

SEQ ID NO: 433017 - DNA, 25 bp, Homo sapien
gatcagcatcctaccattctaaaga

SEQ ID NO: 433018 - DNA, 25 bp, Homo sapien
attctaaagaaatcctcagagccag

SEQ ID NO: 433019 - DNA, 25 bp, Homo sapien
ctccccacttccaaagatgcaaaag

SEQ ID NO: 433020 - DNA, 25 bp, Homo sapien
gcaaaaggcctaattgaatcaagtc

SEQ ID NO: 433021 - DNA, 25 bp, Homo sapien
aaaggcctaattgaatcaagtctcc

SEQ ID NO: 433022 - DNA, 25 bp, Homo sapien
ctttccatctggcaggagacatttt

SEQ ID NO: 433023 - DNA, 25 bp, Homo sapien
tccatctggcaggagacattttaat

SEQ ID NO: 433024 - DNA, 25 bp, Homo sapien
catctggcaggagacattttaataa

SEQ ID NO: 433025 - DNA, 25 bp, Homo sapien
tttcctacatttcttggccaagtgt

SEQ ID NO: 433026 - DNA, 25 bp, Homo sapien
acatttcttggccaagtgtcatagg

SEQ ID NO: 433027 - DNA, 25 bp, Homo sapien
tcttggccaagtgtcataggaatgt

SEQ ID NO: 433028 - DNA, 25 bp, Homo sapien
agtgtcataggaatgtggcctcttt

SEQ ID NO: 433029 - DNA, 25 bp, Homo sapien
gtcataggaatgtggcctcttttga

SEQ ID NO: 433030 - DNA, 25 bp, Homo sapien
agagcagccaatcgtgcgccagtgt

SEQ ID NO: 433031 - DNA, 25 bp, Homo sapien
aatcgtgcgccagtgtcttcaacgt

SEQ ID NO: 433032 - DNA, 25 bp, Homo sapien
gacagccacttccaagcagttccag

SEQ ID NO: 433033 - DNA, 25 bp, Homo sapien
acttccaagcagttccagtacagga

SEQ ID NO: 433034 - DNA, 25 bp, Homo sapien
taggccctgtgctaagtccccatag

SEQ ID NO: 433035 - DNA, 25 bp, Homo sapien
taagtccccatagtgaccctggttg

SEQ ID NO: 433036 - DNA, 25 bp, Homo sapien
cccatagtgaccctggttggtgtag

SEQ ID NO: 433037 - DNA, 25 bp, Homo sapien
aaaaaggctcagaagggcaccgtgg

SEQ ID NO: 433038 - DNA, 25 bp, Homo sapien
ggcaccgtggcgtgcattcgcccag

SEQ ID NO: 433039 - DNA, 25 bp, Homo sapien
ttcgcccagccccagaggttaaagc

SEQ ID NO: 433040 - DNA, 25 bp, Homo sapien
cagaggttaaagcacccagcagagc

SEQ ID NO: 433041 - DNA, 25 bp, Homo sapien
aggcctggagcctgtagggctggac

SEQ ID NO: 433042 - DNA, 25 bp, Homo sapien
cctggagcctgtagggctggactga

SEQ ID NO: 433043 - DNA, 25 bp, Homo sapien
agcctgtagggctggactgaggttc

SEQ ID NO: 433044 - DNA, 25 bp, Homo sapien
ggctggactgaggttcaggtctccc

SEQ ID NO: 433045 - DNA, 25 bp, Homo sapien
gctggactgaggttcaggtctcccc

SEQ ID NO: 433046 - DNA, 25 bp, Homo sapien
ggactgaggttcaggtctcccccca

SEQ ID NO: 433047 - DNA, 25 bp, Homo sapien
cactttgtccccactctagagcagg

SEQ ID NO: 433048 - DNA, 25 bp, Homo sapien
actttgtccccactctagagcaggg

SEQ ID NO: 433049 - DNA, 25 bp, Homo sapien
ctttgtccccactctagagcaggga

SEQ ID NO: 433050 - DNA, 25 bp, Homo sapien
tttgtccccactctagagcagggag

SEQ ID NO: 433051 - DNA, 25 bp, Homo sapien
ttgtccccactctagagcagggagg

SEQ ID NO: 433052 - DNA, 25 bp, Homo sapien
aagcctgccctctgtggccatagtg

SEQ ID NO: 433053 - DNA, 25 bp, Homo sapien
taccaactgggctagggatgcctct

SEQ ID NO: 433054 - DNA, 25 bp, Homo sapien
agggatgcctctgcccttagggttg

SEQ ID NO: 433055 - DNA, 25 bp, Homo sapien
gttggtgcccagagttcatgccagt

SEQ ID NO: 433056 - DNA, 25 bp, Homo sapien
tcatgccagtggcttttaagtgcct

SEQ ID NO: 433057 - DNA, 25 bp, Homo sapien
gggcacaggtttgccagtgttcatt

SEQ ID NO: 433058 - DNA, 25 bp, Homo sapien
atcaggaacttcctcagttcaccag

SEQ ID NO: 433059 - DNA, 25 bp, Homo sapien
ggatgcctcctgacagttctgttaa

SEQ ID NO: 433060 - DNA, 25 bp, Homo sapien
taaagacacactgagtcttctccaa

SEQ ID NO: 433061 - DNA, 25 bp, Homo sapien
aatgggcagccactggcacaaacta

SEQ ID NO: 433062 - DNA, 25 bp, Homo sapien
gcacaaactagcctgctctctgtgg

SEQ ID NO: 433063 - DNA, 25 bp, Homo sapien
agccattactaacgctgattggaat

SEQ ID NO: 433064 - DNA, 25 bp, Homo sapien
aacgctgattggaattgactccgaa

SEQ ID NO: 433065 - DNA, 25 bp, Homo sapien
gtaaaacctatttggcacttttgct

SEQ ID NO: 433066 - DNA, 25 bp, Homo sapien
atacaagacactaatgctgctcccc

SEQ ID NO: 433067 - DNA, 25 bp, Homo sapien
gcacttttgctctaggcagtgttca

SEQ ID NO: 433068 - DNA, 25 bp, Homo sapien
gtgttcctatgcctgagtgggattc

SEQ ID NO: 433069 - DNA, 25 bp, Homo sapien
gagtgggattcttcttttggaaatt

SEQ ID NO: 433070 - DNA, 25 bp, Homo sapien
aatactatgaaatcctctctaaaaa

SEQ ID NO: 433071 - DNA, 25 bp, Homo sapien
aaatatcctcaaaatctttcttggt

SEQ ID NO: 433072 - DNA, 25 bp, Homo sapien
atctttcttggtatagtgccctagg

SEQ ID NO: 433073 - DNA, 25 bp, Homo sapien
tagtgccctaggcagccattactaa

SEQ ID NO: 433074 - DNA, 25 bp, Homo sapien
taccatctcccaacttttaaagcca

SEQ ID NO: 433075 - DNA, 25 bp, Homo sapien
ggattttagatcttaatgggttcga

SEQ ID NO: 433076 - DNA, 25 bp, Homo sapien
taatgggttcgatggtagggaatac

SEQ ID NO: 433077 - DNA, 25 bp, Homo sapien
gcaaacaactcgatgctgtaagaag

SEQ ID NO: 433078 - DNA, 25 bp, Homo sapien
gatgctgtaagaagacaagctgttt

SEQ ID NO: 433079 - DNA, 25 bp, Homo sapien
agacaagctgtttgagctttcaaac

SEQ ID NO: 433080 - DNA, 25 bp, Homo sapien
cacagcacaattcagaaatacccag

SEQ ID NO: 433081 - DNA, 25 bp, Homo sapien
aggaggattcctgcaggcttaacag

SEQ ID NO: 433082 - DNA, 25 bp, Homo sapien
attcctgcaggcttaacagttggca

SEQ ID NO: 433083 - DNA, 25 bp, Homo sapien
caggcttaacagttggcatcgtact

SEQ ID NO: 433084 - DNA, 25 bp, Homo sapien
agttggcatcgtactgaaatgaaac

SEQ ID NO: 433085 - DNA, 25 bp, Homo sapien
cagaggaatatattgacttcctgtt

SEQ ID NO: 433086 - DNA, 25 bp, Homo sapien
attgacttcctgttaaatgtggcaa

SEQ ID NO: 433087 - DNA, 25 bp, Homo sapien
cttcctgttaaatgtggcaaatcaa

SEQ ID NO: 433088 - DNA, 25 bp, Homo sapien
attgagaggttttacaactgcctac

SEQ ID NO: 433089 - DNA, 25 bp, Homo sapien
acaactgcctacagcatgctttgga

SEQ ID NO: 433090 - DNA, 25 bp, Homo sapien
gctttggaaagggaaacgatgacta

SEQ ID NO: 433091 - DNA, 25 bp, Homo sapien
aacgatgactaacttacatcccaag

SEQ ID NO: 433092 - DNA, 25 bp, Homo sapien
aacttacatcccaagatcaaagaga

SEQ ID NO: 433093 - DNA, 25 bp, Homo sapien
acccagaaaaaacacgtgcccagtg

SEQ ID NO: 433094 - DNA, 25 bp, Homo sapien
acgtgcccagtgtattactaaagaa

SEQ ID NO: 433095 - DNA, 25 bp, Homo sapien
taggaatcaatgttaccatcttccc

SEQ ID NO: 433096 - DNA, 25 bp, Homo sapien
tggcggagaacccaaagtggtattt

SEQ ID NO: 433097 - DNA, 25 bp, Homo sapien
aacagtcacttctcttggagttatg

SEQ ID NO: 433098 - DNA, 25 bp, Homo sapien
gtcacttctcttggagttatggcag

SEQ ID NO: 433099 - DNA, 25 bp, Homo sapien
atggagtggccccagtcttcaaaaa

SEQ ID NO: 433100 - DNA, 25 bp, Homo sapien
gagtggccccagtcttcaaaaagag

SEQ ID NO: 433101 - DNA, 25 bp, Homo sapien
taaggcaacgaggtgatgatcaata

SEQ ID NO: 433102 - DNA, 25 bp, Homo sapien
atagttgcaggagagctttttgtac

SEQ ID NO: 433103 - DNA, 25 bp, Homo sapien
gctttttgtacatgcttttaggaca

SEQ ID NO: 433104 - DNA, 25 bp, Homo sapien
tgcttttaggacagaatggagactt

SEQ ID NO: 433105 - DNA, 25 bp, Homo sapien
gaatggagacttatacacccaaagt

SEQ ID NO: 433106 - DNA, 25 bp, Homo sapien
acacccaaagtttatctgtgtttgt

SEQ ID NO: 433107 - DNA, 25 bp, Homo sapien
gagggactcgggacaatggcaactt

SEQ ID NO: 433108 - DNA, 25 bp, Homo sapien
gacaatggcaacttcgtcttcgaga

SEQ ID NO: 433109 - DNA, 25 bp, Homo sapien
tggcaacttcgtcttcgagaatgat

SEQ ID NO: 433110 - DNA, 25 bp, Homo sapien
cgtcttcgagaatgatggcttgggc

SEQ ID NO: 433111 - DNA, 25 bp, Homo sapien
atggcttgggcgtctatcacagggc

SEQ ID NO: 433112 - DNA, 25 bp, Homo sapien
tgatgctattccgacccaggcttca

SEQ ID NO: 433113 - DNA, 25 bp, Homo sapien
gacccaggcttcatgttgtgtagac

SEQ ID NO: 433114 - DNA, 25 bp, Homo sapien
aggcttcatgttgtgtagacagcaa

SEQ ID NO: 433115 - DNA, 25 bp, Homo sapien
agacagcaacaggagtttggcccct

SEQ ID NO: 433116 - DNA, 25 bp, Homo sapien
cagcaacaggagtttggcccctcag

SEQ ID NO: 433117 - DNA, 25 bp, Homo sapien
agggagctgcgatgggacagcccct

SEQ ID NO: 433118 - DNA, 25 bp, Homo sapien
gtggcctggcccttgaaatagtagt

SEQ ID NO: 433119 - DNA, 25 bp, Homo sapien
ctggcccttgaaatagtagtgttta

SEQ ID NO: 433120 - DNA, 25 bp, Homo sapien
gtagtgtttaggtagatgcttgtgt

SEQ ID NO: 433121 - DNA, 25 bp, Homo sapien
tagatgcttgtgtaggattcctgat

SEQ ID NO: 433122 - DNA, 25 bp, Homo sapien
gtaggattcctgataagagcaactg

SEQ ID NO: 433123 - DNA, 25 bp, Homo sapien
tggttaccagggaattacctcttat

SEQ ID NO: 433124 - DNA, 25 bp, Homo sapien
ggaattacctcttatgtgttatatc

SEQ ID NO: 433125 - DNA, 25 bp, Homo sapien
ttatctctggaaaagagtaccctgc

SEQ ID NO: 433126 - DNA, 25 bp, Homo sapien
agagtaccctgcaaaattccctaca

SEQ ID NO: 433127 - DNA, 25 bp, Homo sapien
gcaaaattccctacagctgcaagca

SEQ ID NO: 433128 - DNA, 25 bp, Homo sapien
cagctgcaagcagatgtcacttgat

SEQ ID NO: 433129 - DNA, 25 bp, Homo sapien
agctggtgacccgacagttcctggc

SEQ ID NO: 433130 - DNA, 25 bp, Homo sapien
agttcctggctccttgttcagacag

SEQ ID NO: 433131 - DNA, 25 bp, Homo sapien
ggctccttgttcagacagcttgtca

SEQ ID NO: 433132 - DNA, 25 bp, Homo sapien
cagacagcttgtcagtgaagaagac

SEQ ID NO: 433133 - DNA, 25 bp, Homo sapien
gaagaagacaacacgtctgcacctt

SEQ ID NO: 433134 - DNA, 25 bp, Homo sapien
acgtctgcaccttcattattcaaac

SEQ ID NO: 433135 - DNA, 25 bp, Homo sapien
ttattcaaacttggctggctctcta

SEQ ID NO: 433136 - DNA, 25 bp, Homo sapien
ttggctggctctctagtatgactaa

SEQ ID NO: 433137 - DNA, 25 bp, Homo sapien
taacatggcaacacatctgtctctc

SEQ ID NO: 433138 - DNA, 25 bp, Homo sapien
cacatctgtctctccctaaataaat

SEQ ID NO: 433139 - DNA, 25 bp, Homo sapien
aatactaccacattatttcttctaa

SEQ ID NO: 433140 - DNA, 25 bp, Homo sapien
aaacgcccgcagcacaacgaagagg

SEQ ID NO: 433141 - DNA, 25 bp, Homo sapien
aacgcccgcagcacaacgaagaggc

SEQ ID NO: 433142 - DNA, 25 bp, Homo sapien
cccgcagcacaacgaagaggccaat

SEQ ID NO: 433143 - DNA, 25 bp, Homo sapien
cgcagcacaacgaagaggccaatgg

SEQ ID NO: 433144 - DNA, 25 bp, Homo sapien
agcacaacgaagaggccaatgggca

SEQ ID NO: 433145 - DNA, 25 bp, Homo sapien
caacgaagaggccaatgggcactct

SEQ ID NO: 433146 - DNA, 25 bp, Homo sapien
gaagaggccaatgggcactcttcca

SEQ ID NO: 433147 - DNA, 25 bp, Homo sapien
aggccaatgggcactcttccagagg

SEQ ID NO: 433148 - DNA, 25 bp, Homo sapien
gccaatgggcactcttccagaggct

SEQ ID NO: 433149 - DNA, 25 bp, Homo sapien
caatgggcactcttccagaggcttt

SEQ ID NO: 433150 - DNA, 25 bp, Homo sapien
aatgggcactcttccagaggctttg

SEQ ID NO: 433151 - DNA, 25 bp, Homo sapien
agagtctttaggcattaagtggctc

SEQ ID NO: 433152 - DNA, 25 bp, Homo sapien
ttaagtggctcagtgagggcttcag

SEQ ID NO: 433153 - DNA, 25 bp, Homo sapien
ttcagccctagtggtattttcaggt

SEQ ID NO: 433154 - DNA, 25 bp, Homo sapien
gtggtattttcaggttttctcagct

SEQ ID NO: 433155 - DNA, 25 bp, Homo sapien
aggttttctcagctgggactcctgt

SEQ ID NO: 433156 - DNA, 25 bp, Homo sapien
tgggactcctgtcgtttttcataca

SEQ ID NO: 433157 - DNA, 25 bp, Homo sapien
gactcctgtcgtttttcatacagca

SEQ ID NO: 433158 - DNA, 25 bp, Homo sapien
gtcgtttttcatacagcatagtgat

SEQ ID NO: 433159 - DNA, 25 bp, Homo sapien
gctataaatccaaacacaattgcag

SEQ ID NO: 433160 - DNA, 25 bp, Homo sapien
tacttttgtggtatcaactctctca

SEQ ID NO: 433161 - DNA, 25 bp, Homo sapien
tgtggtatcaactctctcataaaat

SEQ ID NO: 433162 - DNA, 25 bp, Homo sapien
caagctcccaggtgaggcctcgcta

SEQ ID NO: 433163 - DNA, 25 bp, Homo sapien
tgaggcctcgctaccatacttggac

SEQ ID NO: 433164 - DNA, 25 bp, Homo sapien
ttggaccacgctcccagtgccaaag

SEQ ID NO: 433165 - DNA, 25 bp, Homo sapien
gggttgtcatgatggctattaactt

SEQ ID NO: 433166 - DNA, 25 bp, Homo sapien
ttaacttatgtgttgcttgccgcat

SEQ ID NO: 433167 - DNA, 25 bp, Homo sapien
tatgtgttgcttgccgcatcccaaa

SEQ ID NO: 433168 - DNA, 25 bp, Homo sapien
cttgccgcatcccaaaacgatttaa

SEQ ID NO: 433169 - DNA, 25 bp, Homo sapien
aaaacgatttaaggtgactcacatc

SEQ ID NO: 433170 - DNA, 25 bp, Homo sapien
gactcacatcgaggtataagtgttt

SEQ ID NO: 433171 - DNA, 25 bp, Homo sapien
gtataagtgtttcatgagaacttct

SEQ ID NO: 433172 - DNA, 25 bp, Homo sapien
gatgacaacaaagcagcccaatatc

SEQ ID NO: 433173 - DNA, 25 bp, Homo sapien
aggcacgcgacaccacgtccagata

SEQ ID NO: 433174 - DNA, 25 bp, Homo sapien
ggcacgcgacaccacgtccagataa

SEQ ID NO: 433175 - DNA, 25 bp, Homo sapien
gcacgcgacaccacgtccagataat

SEQ ID NO: 433176 - DNA, 25 bp, Homo sapien
cacgcgacaccacgtccagataatt

SEQ ID NO: 433177 - DNA, 25 bp, Homo sapien
acgcgacaccacgtccagataattt

SEQ ID NO: 433178 - DNA, 25 bp, Homo sapien
cgcgacaccacgtccagataatttt

SEQ ID NO: 433179 - DNA, 25 bp, Homo sapien
gacaccacgtccagataatttttgt

SEQ ID NO: 433180 - DNA, 25 bp, Homo sapien
tcagcttcccaagagagacatttcc

SEQ ID NO: 433181 - DNA, 25 bp, Homo sapien
cagcttcccaagagagacatttccc

SEQ ID NO: 433182 - DNA, 25 bp, Homo sapien
agcttcccaagagagacatttccct

SEQ ID NO: 433183 - DNA, 25 bp, Homo sapien
gcttcccaagagagacatttccctt

SEQ ID NO: 433184 - DNA, 25 bp, Homo sapien
catgttacatctggcctttttgtgc

SEQ ID NO: 433185 - DNA, 25 bp, Homo sapien
gtgcctttgacaatttgagtgctca

SEQ ID NO: 433186 - DNA, 25 bp, Homo sapien
aatttgagtgctcactttgttgcca

SEQ ID NO: 433187 - DNA, 25 bp, Homo sapien
atagggccagttgctgattcattta

SEQ ID NO: 433188 - DNA, 25 bp, Homo sapien
aaactacatctagtccattatagta

SEQ ID NO: 433189 - DNA, 25 bp, Homo sapien
aaggtagtttcatctcggagcttcc

SEQ ID NO: 433190 - DNA, 25 bp, Homo sapien
agcttcctgcaacagcgtggttgga

SEQ ID NO: 433191 - DNA, 25 bp, Homo sapien
agctgtaagttgctcactactcttc

SEQ ID NO: 433192 - DNA, 25 bp, Homo sapien
tgctcactactcttctacacctgtt

SEQ ID NO: 433193 - DNA, 25 bp, Homo sapien
tgttcccctcaagtggcaactgaaa

SEQ ID NO: 433194 - DNA, 25 bp, Homo sapien
aggtgggcgccatgttacatctggc

SEQ ID NO: 433195 - DNA, 25 bp, Homo sapien
taccctcccctgttgttagctgggt

SEQ ID NO: 433196 - DNA, 25 bp, Homo sapien
tttggctttatagtgcagcaacaaa

SEQ ID NO: 433197 - DNA, 25 bp, Homo sapien
acatcttacctccactaatgtcagt

SEQ ID NO: 433198 - DNA, 25 bp, Homo sapien
gaagtttgagtcagccctctgcttt

SEQ ID NO: 433199 - DNA, 25 bp, Homo sapien
gcccagcagggaggtgagcttacac

SEQ ID NO: 433200 - DNA, 25 bp, Homo sapien
agggaggtgagcttacacccctact

SEQ ID NO: 433201 - DNA, 25 bp, Homo sapien
acacccctactcagaggcagtgagg

SEQ ID NO: 433202 - DNA, 25 bp, Homo sapien
aggtgatacaggttggtgccctact

SEQ ID NO: 433203 - DNA, 25 bp, Homo sapien
atacaggttggtgccctactttcat

SEQ ID NO: 433204 - DNA, 25 bp, Homo sapien
gtggagaactgagccttcactccca

SEQ ID NO: 433205 - DNA, 25 bp, Homo sapien
ttcactcccatctggcaagtgatgg

SEQ ID NO: 433206 - DNA, 25 bp, Homo sapien
actctatgaatattcattcattcca

SEQ ID NO: 433207 - DNA, 25 bp, Homo sapien
ttcattcattccatgaacctacaag

SEQ ID NO: 433208 - DNA, 25 bp, Homo sapien
tcattcattccatgaacctacaagg

SEQ ID NO: 433209 - DNA, 25 bp, Homo sapien
cattcattccatgaacctacaaggt

SEQ ID NO: 433210 - DNA, 25 bp, Homo sapien
ttcattccatgaacctacaaggttt

SEQ ID NO: 433211 - DNA, 25 bp, Homo sapien
tcattccatgaacctacaaggtttt

SEQ ID NO: 433212 - DNA, 25 bp, Homo sapien
cattccatgaacctacaaggttttt

SEQ ID NO: 433213 - DNA, 25 bp, Homo sapien
ttccatgaacctacaaggtttttag

SEQ ID NO: 433214 - DNA, 25 bp, Homo sapien
tccatgaacctacaaggtttttagg

SEQ ID NO: 433215 - DNA, 25 bp, Homo sapien
gtttaaataagaactataggctggg

SEQ ID NO: 433216 - DNA, 25 bp, Homo sapien
aatacaaaatactcacttgaaccca

SEQ ID NO: 433217 - DNA, 25 bp, Homo sapien
tcactaccgaaggtagaaactggag

SEQ ID NO: 433218 - DNA, 25 bp, Homo sapien
gaaactggagcagataccttataaa

SEQ ID NO: 433219 - DNA, 25 bp, Homo sapien
aaactggagcagataccttataaaa

SEQ ID NO: 433220 - DNA, 25 bp, Homo sapien
actggagcagataccttataaaaac

SEQ ID NO: 433221 - DNA, 25 bp, Homo sapien
ggagcagataccttataaaaaccac

SEQ ID NO: 433222 - DNA, 25 bp, Homo sapien
gagcagataccttataaaaaccact

SEQ ID NO: 433223 - DNA, 25 bp, Homo sapien
agataccttataaaaaccactgctt

SEQ ID NO: 433224 - DNA, 25 bp, Homo sapien
gataccttataaaaaccactgcttt

SEQ ID NO: 433225 - DNA, 25 bp, Homo sapien
aaaccactgctttagccaggcgcgg

SEQ ID NO: 433226 - DNA, 25 bp, Homo sapien
aaccactgctttagccaggcgcggt

SEQ ID NO: 433227 - DNA, 25 bp, Homo sapien
tgcagagagtcaagactgggacact

SEQ ID NO: 433228 - DNA, 25 bp, Homo sapien
ttagtcagagagaacacagacctcc

SEQ ID NO: 433229 - DNA, 25 bp, Homo sapien
agtgatggaaagattccgactggat

SEQ ID NO: 433230 - DNA, 25 bp, Homo sapien
ctggaagagagcagaagccatagag

SEQ ID NO: 433231 - DNA, 25 bp, Homo sapien
ccatagagagcagcctcgaggtgga

SEQ ID NO: 433232 - DNA, 25 bp, Homo sapien
aagcttgcgaacacatctgttcgat

SEQ ID NO: 433233 - DNA, 25 bp, Homo sapien
gaacacatctgttcgatttcaaaac

SEQ ID NO: 433234 - DNA, 25 bp, Homo sapien
gttcgatttcaaaacagtcagattt

SEQ ID NO: 433235 - DNA, 25 bp, Homo sapien
aacagtcagatttcttcaggaaccc

SEQ ID NO: 433236 - DNA, 25 bp, Homo sapien
gtcagatttcttcaggaacccaggt

SEQ ID NO: 433237 - DNA, 25 bp, Homo sapien
gatttcttcaggaacccaggtagaa

SEQ ID NO: 433238 - DNA, 25 bp, Homo sapien
tcaggaacccaggtagaaaaataca

SEQ ID NO: 433239 - DNA, 25 bp, Homo sapien
ggaacacctgtcatagaagcaataa

SEQ ID NO: 433240 - DNA, 25 bp, Homo sapien
gcaataactctaactctatactgta

SEQ ID NO: 433241 - DNA, 25 bp, Homo sapien
actgtagagatgagtctggtccgaa

SEQ ID NO: 433242 - DNA, 25 bp, Homo sapien
tggtccgaagcagattagtaattta

SEQ ID NO: 433243 - DNA, 25 bp, Homo sapien
aatttagagataagccatgcataca

SEQ ID NO: 433244 - DNA, 25 bp, Homo sapien
atgcatacaagtttgccccattctc

SEQ ID NO: 433245 - DNA, 25 bp, Homo sapien
gaagacccagctatgaaaccgcagt

SEQ ID NO: 433246 - DNA, 25 bp, Homo sapien
atgaaaccgcagttcctgtgggttg

SEQ ID NO: 433247 - DNA, 25 bp, Homo sapien
gcaccccaggtctggtgagcagaca

SEQ ID NO: 433248 - DNA, 25 bp, Homo sapien
tgagcagacagagccggcgttaaac

SEQ ID NO: 433249 - DNA, 25 bp, Homo sapien
gttaaaccccgatcaggtcattgtc

SEQ ID NO: 433250 - DNA, 25 bp, Homo sapien
gcttcccggagctgacagtgaggca

SEQ ID NO: 433251 - DNA, 25 bp, Homo sapien
gacagtgaggcagacatcccggatc

SEQ ID NO: 433252 - DNA, 25 bp, Homo sapien
ttatcacaggtgcagccacgcaact

SEQ ID NO: 433253 - DNA, 25 bp, Homo sapien
tgcagccacgcaacttttgggttac

SEQ ID NO: 433254 - DNA, 25 bp, Homo sapien
taccttcccgccacgaaatggaaat

SEQ ID NO: 433255 - DNA, 25 bp, Homo sapien
gaaatgatttcctgagggccggaaa

SEQ ID NO: 433256 - DNA, 25 bp, Homo sapien
agggccggaaagatcatttgcatcg

SEQ ID NO: 433257 - DNA, 25 bp, Homo sapien
catttgcatcgggcctcaggtctgg

SEQ ID NO: 433258 - DNA, 25 bp, Homo sapien
gcctcgaacaacagggaagccccgt

SEQ ID NO: 433259 - DNA, 25 bp, Homo sapien
gaacaacagggaagccccgtggagc

SEQ ID NO: 433260 - DNA, 25 bp, Homo sapien
cgtttctcaccctgacagcagggag

SEQ ID NO: 433261 - DNA, 25 bp, Homo sapien
tggtttggctttacaaatatgtagc

SEQ ID NO: 433262 - DNA, 25 bp, Homo sapien
aatatgtagctgtcttctcacatgt

SEQ ID NO: 433263 - DNA, 25 bp, Homo sapien
tcttctcacatgttacctgctgtaa

SEQ ID NO: 433264 - DNA, 25 bp, Homo sapien
atgttacctgctgtaaaaccattca

SEQ ID NO: 433265 - DNA, 25 bp, Homo sapien
gaatcttaatagctttcacgtttac

SEQ ID NO: 433266 - DNA, 25 bp, Homo sapien
atagctttcacgtttacagtaacaa

SEQ ID NO: 433267 - DNA, 25 bp, Homo sapien
ttctcttgccctttacaaattagtt

SEQ ID NO: 433268 - DNA, 25 bp, Homo sapien
acagtaacaaatgaatttccgagaa

SEQ ID NO: 433269 - DNA, 25 bp, Homo sapien
ttccgagaaatcaagtaagttgccc

SEQ ID NO: 433270 - DNA, 25 bp, Homo sapien
gtaagttgcccaagatccaacatat

SEQ ID NO: 433271 - DNA, 25 bp, Homo sapien
attagttttctcacttaaagctatt

SEQ ID NO: 433272 - DNA, 25 bp, Homo sapien
gaattcagtctggtagtattacgtg

SEQ ID NO: 433273 - DNA, 25 bp, Homo sapien
gtctggtagtattacgtgtggtttt

SEQ ID NO: 433274 - DNA, 25 bp, Homo sapien
ttatgtgtgtgtgagcatctgcatt

SEQ ID NO: 433275 - DNA, 25 bp, Homo sapien
gtgagcatctgcatttacttttaaa

SEQ ID NO: 433276 - DNA, 25 bp, Homo sapien
tgaacttaagtacctattagccagc

SEQ ID NO: 433277 - DNA, 25 bp, Homo sapien
aagtacctattagccagcttattaa

SEQ ID NO: 433278 - DNA, 25 bp, Homo sapien
cagcttattaaaacatggtcagtct

SEQ ID NO: 433279 - DNA, 25 bp, Homo sapien
tggtcagtcttgtttcacctgttac

SEQ ID NO: 433280 - DNA, 25 bp, Homo sapien
ctgttacatcccttttcttttactg

SEQ ID NO: 433281 - DNA, 25 bp, Homo sapien
tcagtttatgaagtctgctttctaa

SEQ ID NO: 433282 - DNA, 25 bp, Homo sapien
gaagtctgctttctaaaaagtactt

SEQ ID NO: 433283 - DNA, 25 bp, Homo sapien
atggcgtcccggattcccgcgagac

SEQ ID NO: 433284 - DNA, 25 bp, Homo sapien
cgagacccttcatgctcttcacgta

SEQ ID NO: 433285 - DNA, 25 bp, Homo sapien
tcttcacgtacatgagcaggttggt

SEQ ID NO: 433286 - DNA, 25 bp, Homo sapien
gagcaggttggtgatcccattttta

SEQ ID NO: 433287 - DNA, 25 bp, Homo sapien
aatgtcttcattacacatgtggatc

SEQ ID NO: 433288 - DNA, 25 bp, Homo sapien
tggatccatttctgcagcgtgtctt

SEQ ID NO: 433289 - DNA, 25 bp, Homo sapien
tctgcagcgtgtctttcaggtattc

SEQ ID NO: 433290 - DNA, 25 bp, Homo sapien
aactcgacgatggatgctggcaggt

SEQ ID NO: 433291 - DNA, 25 bp, Homo sapien
aggtgtttaaaccagctgcagagtt

SEQ ID NO: 433292 - DNA, 25 bp, Homo sapien
agagtttcatctcttcctgcaggac

SEQ ID NO: 433293 - DNA, 25 bp, Homo sapien
acaccagtgccctttccggcaggat

SEQ ID NO: 433294 - DNA, 25 bp, Homo sapien
gttgattggacattgaagacataag

SEQ ID NO: 433295 - DNA, 25 bp, Homo sapien
ttcttttcacctgagttgttacttt

SEQ ID NO: 433296 - DNA, 25 bp, Homo sapien
acctgagttgttacttttgtgctgt

SEQ ID NO: 433297 - DNA, 25 bp, Homo sapien
gagttgttacttttgtgctgttatt

SEQ ID NO: 433298 - DNA, 25 bp, Homo sapien
cttttgtgctgttattgagtttgat

SEQ ID NO: 433299 - DNA, 25 bp, Homo sapien
aatggattattgttcacggttctgc

SEQ ID NO: 433300 - DNA, 25 bp, Homo sapien
attgttcacggttctgcacattcat

SEQ ID NO: 433301 - DNA, 25 bp, Homo sapien
cacggttctgcacattcatttctaa

SEQ ID NO: 433302 - DNA, 25 bp, Homo sapien
ggttctgcacattcatttctaagaa

SEQ ID NO: 433303 - DNA, 25 bp, Homo sapien
taagaagcaataactgtcatgtggg

SEQ ID NO: 433304 - DNA, 25 bp, Homo sapien
gagaggatagcaggcaaactacaaa

SEQ ID NO: 433305 - DNA, 25 bp, Homo sapien
ggcatgtttatcaagttatatccca

SEQ ID NO: 433306 - DNA, 25 bp, Homo sapien
tatcaagttatatcccagggcaatg

SEQ ID NO: 433307 - DNA, 25 bp, Homo sapien
agggcaatgtgtatgctagcaggat

SEQ ID NO: 433308 - DNA, 25 bp, Homo sapien
gcaggatgaatgctatcttttcaaa

SEQ ID NO: 433309 - DNA, 25 bp, Homo sapien
gtaagtttataatcatactcccaaa

SEQ ID NO: 433310 - DNA, 25 bp, Homo sapien
aaattctcctagttcatgtacttag

SEQ ID NO: 433311 - DNA, 25 bp, Homo sapien
ttctcctagttcatgtacttagatg

SEQ ID NO: 433312 - DNA, 25 bp, Homo sapien
tagttttggaatgacgtttatggaa

SEQ ID NO: 433313 - DNA, 25 bp, Homo sapien
gaacttaatcatttgatcactgcct

SEQ ID NO: 433314 - DNA, 25 bp, Homo sapien
catttgatcactgcctatcactagg

SEQ ID NO: 433315 - DNA, 25 bp, Homo sapien
gatcactgcctatcactaggcagaa

SEQ ID NO: 433316 - DNA, 25 bp, Homo sapien
tctttagacttaaggcttttgccac

SEQ ID NO: 433317 - DNA, 25 bp, Homo sapien
tagacttaaggcttttgccacaggc

SEQ ID NO: 433318 - DNA, 25 bp, Homo sapien
caggctcctggcagcattggtgcca

SEQ ID NO: 433319 - DNA, 25 bp, Homo sapien
attggtgccagctcaccttcaagaa

SEQ ID NO: 433320 - DNA, 25 bp, Homo sapien
gtgccagctcaccttcaagaagctc

SEQ ID NO: 433321 - DNA, 25 bp, Homo sapien
atcttctggggtcgcggtctcttct

SEQ ID NO: 433322 - DNA, 25 bp, Homo sapien
atcaccactgtggtgggccgcccca

SEQ ID NO: 433323 - DNA, 25 bp, Homo sapien
cccaccgaggaggaagtcaatcact

SEQ ID NO: 433324 - DNA, 25 bp, Homo sapien
aggaagtcaatcactatcacgccct

SEQ ID NO: 433325 - DNA, 25 bp, Homo sapien
aagtcaatcactatcacgccctcta

SEQ ID NO: 433326 - DNA, 25 bp, Homo sapien
gccctctacatgacggccctggagc

SEQ ID NO: 433327 - DNA, 25 bp, Homo sapien
gcggcgctggcctcaaaagagaaca

SEQ ID NO: 433328 - DNA, 25 bp, Homo sapien
aaagagaacatgaccttgtcccggc

SEQ ID NO: 433329 - DNA, 25 bp, Homo sapien
tgtcccggccatagcaatgcaacag

SEQ ID NO: 433330 - DNA, 25 bp, Homo sapien
atgcaacagagtgtagggccaggac

SEQ ID NO: 433331 - DNA, 25 bp, Homo sapien
agcagctccggtacctgactctggg

SEQ ID NO: 433332 - DNA, 25 bp, Homo sapien
actctgggctcccatggtcaggaga

SEQ ID NO: 433333 - DNA, 25 bp, Homo sapien
gtcaggagagtcagcctttcagcct

SEQ ID NO: 433334 - DNA, 25 bp, Homo sapien
aggaggcatgcaggccacagtgctc

SEQ ID NO: 433335 - DNA, 25 bp, Homo sapien
atggcagtctcatctgcctggaaga

SEQ ID NO: 433336 - DNA, 25 bp, Homo sapien
tggaagatgtcatttccctgtgccg

SEQ ID NO: 433337 - DNA, 25 bp, Homo sapien
tttccctgtgccgtctggaaaggaa

SEQ ID NO: 433338 - DNA, 25 bp, Homo sapien
gaacacagagcgctcactcaggagg

SEQ ID NO: 433339 - DNA, 25 bp, Homo sapien
gagcgctcactcaggaggtatttat

SEQ ID NO: 433340 - DNA, 25 bp, Homo sapien
attgagcctctaagaggtaccaggt

SEQ ID NO: 433341 - DNA, 25 bp, Homo sapien
ggtaccaggtgctgcaatagagctg

SEQ ID NO: 433342 - DNA, 25 bp, Homo sapien
agagctgggctagactttacttaga

SEQ ID NO: 433343 - DNA, 25 bp, Homo sapien
cattgtttcaatctgttgtataggg

SEQ ID NO: 433344 - DNA, 25 bp, Homo sapien
tgactgtctaacatcttactgcctc

SEQ ID NO: 433345 - DNA, 25 bp, Homo sapien
gactccccaatttcctccagattag

SEQ ID NO: 433346 - DNA, 25 bp, Homo sapien
gaaagtccttcctcattaagctgtc

SEQ ID NO: 433347 - DNA, 25 bp, Homo sapien
attaagctgtccctaaaccttgcat

SEQ ID NO: 433348 - DNA, 25 bp, Homo sapien
aaaccttgcatctggcatggaacac

SEQ ID NO: 433349 - DNA, 25 bp, Homo sapien
gggcttctccagcactaattctgga

SEQ ID NO: 433350 - DNA, 25 bp, Homo sapien
taattctggagcgttcttgccttta

SEQ ID NO: 433351 - DNA, 25 bp, Homo sapien
tcttgcctttagtcttgtccatcat

SEQ ID NO: 433352 - DNA, 25 bp, Homo sapien
agaactgagctggtaactctggaga

SEQ ID NO: 433353 - DNA, 25 bp, Homo sapien
gagagtgaggccctacatctgcatc

SEQ ID NO: 433354 - DNA, 25 bp, Homo sapien
aggccctacatctgcatctatagca

SEQ ID NO: 433355 - DNA, 25 bp, Homo sapien
tatagcagattccaggccaaaccga

SEQ ID NO: 433356 - DNA, 25 bp, Homo sapien
ggccaaaccgaatgcctggaattgc

SEQ ID NO: 433357 - DNA, 25 bp, Homo sapien
gcctggaattgctagttcattgatt

SEQ ID NO: 433358 - DNA, 25 bp, Homo sapien
ggtgggttatcatttatatcttcta

SEQ ID NO: 433359 - DNA, 25 bp, Homo sapien
gaggattctctgctacaatctctaa

SEQ ID NO: 433360 - DNA, 25 bp, Homo sapien
tcacaactaatttcacagatggtag

SEQ ID NO: 433361 - DNA, 25 bp, Homo sapien
gatggtagaacctccttagagcaaa

SEQ ID NO: 433362 - DNA, 25 bp, Homo sapien
gagcaaaaggacacagcagttaaat

SEQ ID NO: 433363 - DNA, 25 bp, Homo sapien
aaatgtgacatacctgattgttcaa

SEQ ID NO: 433364 - DNA, 25 bp, Homo sapien
gattgttcaaaatgcaaggctctgg

SEQ ID NO: 433365 - DNA, 25 bp, Homo sapien
aaggctctggacattgcattctttg

SEQ ID NO: 433366 - DNA, 25 bp, Homo sapien
cttttattttcctttgagcctgtgc

SEQ ID NO: 433367 - DNA, 25 bp, Homo sapien
ttgagcctgtgccagtttctgtccc

SEQ ID NO: 433368 - DNA, 25 bp, Homo sapien
atttttgcaacttcagttctactaa

SEQ ID NO: 433369 - DNA, 25 bp, Homo sapien
gttctactaaacctccctgaagaat

SEQ ID NO: 433370 - DNA, 25 bp, Homo sapien
tgaagaatcttccagctgctgagta

SEQ ID NO: 433371 - DNA, 25 bp, Homo sapien
ccctcgctgtggcaagcagttcaac

SEQ ID NO: 433372 - DNA, 25 bp, Homo sapien
gcaagcagttcaaccacagcagcaa

SEQ ID NO: 433373 - DNA, 25 bp, Homo sapien
aaccgccacatgaacgtgcatcgtg

SEQ ID NO: 433374 - DNA, 25 bp, Homo sapien
gtgcatcgtggtgtcaagtcacact

SEQ ID NO: 433375 - DNA, 25 bp, Homo sapien
aagtcacactcgtgcggcatctgcg

SEQ ID NO: 433376 - DNA, 25 bp, Homo sapien
acaagcctgccattaggcggcacct

SEQ ID NO: 433377 - DNA, 25 bp, Homo sapien
ttaggcggcacctcaaggagcaaca

SEQ ID NO: 433378 - DNA, 25 bp, Homo sapien
acctcaaggagcaacacggcaagac

SEQ ID NO: 433379 - DNA, 25 bp, Homo sapien
agaccacggccgagaacgtgctgga

SEQ ID NO: 433380 - DNA, 25 bp, Homo sapien
gccagtgtggccgagattaacgtcc

SEQ ID NO: 433381 - DNA, 25 bp, Homo sapien
gagattaacgtcctcatccgctagc

SEQ ID NO: 433382 - DNA, 25 bp, Homo sapien
atgttacattctcaattctctcttt

SEQ ID NO: 433383 - DNA, 25 bp, Homo sapien
tctctcttttgtttagacattacta

SEQ ID NO: 433384 - DNA, 25 bp, Homo sapien
agacattactactggatgggaatcc

SEQ ID NO: 433385 - DNA, 25 bp, Homo sapien
atgggaatccattccgagttctcga

SEQ ID NO: 433386 - DNA, 25 bp, Homo sapien
gaatccattccgagttctcgagcag

SEQ ID NO: 433387 - DNA, 25 bp, Homo sapien
agttctcgagcagcctattatgaaa

SEQ ID NO: 433388 - DNA, 25 bp, Homo sapien
ttctcgagcagcctattatgaaaga

SEQ ID NO: 433389 - DNA, 25 bp, Homo sapien
ctcgagcagcctattatgaaagaac

SEQ ID NO: 433390 - DNA, 25 bp, Homo sapien
gagcagcctattatgaaagaacagc

SEQ ID NO: 433391 - DNA, 25 bp, Homo sapien
gcctattatgaaagaacagctggtt

SEQ ID NO: 433392 - DNA, 25 bp, Homo sapien
ttatgaaagaacagctggtttcctg

SEQ ID NO: 433393 - DNA, 25 bp, Homo sapien
tccagctgcatttgcatggcatgcc

SEQ ID NO: 433394 - DNA, 25 bp, Homo sapien
ggcatgccccagtgtactatggcag

SEQ ID NO: 433395 - DNA, 25 bp, Homo sapien
gaacactgggtctgcagtgctgaag

SEQ ID NO: 433396 - DNA, 25 bp, Homo sapien
gctggacagcccgtcttgtgacagt

SEQ ID NO: 433397 - DNA, 25 bp, Homo sapien
gcccgtcttgtgacagtgactccca

SEQ ID NO: 433398 - DNA, 25 bp, Homo sapien
aggacaagtggaccccatgtttcca

SEQ ID NO: 433399 - DNA, 25 bp, Homo sapien
agtgactcccagtgagccccagaaa

SEQ ID NO: 433400 - DNA, 25 bp, Homo sapien
tgagccccagaaatgacaagcgtgt

SEQ ID NO: 433401 - DNA, 25 bp, Homo sapien
gacaagcgtgtcttggcagagccag

SEQ ID NO: 433402 - DNA, 25 bp, Homo sapien
tggcagagccagcacacaagtggat

SEQ ID NO: 433403 - DNA, 25 bp, Homo sapien
tggaccccatgtttccatgtggaag

SEQ ID NO: 433404 - DNA, 25 bp, Homo sapien
tcatccccaggaagatgatgagatg

SEQ ID NO: 433405 - DNA, 25 bp, Homo sapien
atgagatgatgctcacgggtagact

SEQ ID NO: 433406 - DNA, 25 bp, Homo sapien
tacagatcttctaaacaccaggaga

SEQ ID NO: 433407 - DNA, 25 bp, Homo sapien
gagaagaactgaactgtcccaatct

SEQ ID NO: 433408 - DNA, 25 bp, Homo sapien
gaactgaactgtcccaatcttctga

SEQ ID NO: 433409 - DNA, 25 bp, Homo sapien
aactgtcccaatcttctgagtcgcc

SEQ ID NO: 433410 - DNA, 25 bp, Homo sapien
tgtcccaatcttctgagtcgcctgg

SEQ ID NO: 433411 - DNA, 25 bp, Homo sapien
aatcttctgagtcgcctggtctgat

SEQ ID NO: 433412 - DNA, 25 bp, Homo sapien
ttctgagtcgcctggtctgatgcca

SEQ ID NO: 433413 - DNA, 25 bp, Homo sapien
cgcctggtctgatgccagttttcct

SEQ ID NO: 433414 - DNA, 25 bp, Homo sapien
tttcctcatccccaggaagatgatg

SEQ ID NO: 433415 - DNA, 25 bp, Homo sapien
attttttgcctatttgaggtatgtg

SEQ ID NO: 433416 - DNA, 25 bp, Homo sapien
cctgcttctaacgtcacttgtgatg

SEQ ID NO: 433417 - DNA, 25 bp, Homo sapien
ctgcttctaacgtcacttgtgatgt

SEQ ID NO: 433418 - DNA, 25 bp, Homo sapien
gcttctaacgtcacttgtgatgtga

SEQ ID NO: 433419 - DNA, 25 bp, Homo sapien
ctaacgtcacttgtgatgtgaccat

SEQ ID NO: 433420 - DNA, 25 bp, Homo sapien
aacgtcacttgtgatgtgaccatgt

SEQ ID NO: 433421 - DNA, 25 bp, Homo sapien
cacttgtgatgtgaccatgttcgtt

SEQ ID NO: 433422 - DNA, 25 bp, Homo sapien
gtaagacaagcaaaaacgacaacag

SEQ ID NO: 433423 - DNA, 25 bp, Homo sapien
agacaagcaaaaacgacaacagaaa

SEQ ID NO: 433424 - DNA, 25 bp, Homo sapien
tttgtgtgtgcgtacttagctgtac

SEQ ID NO: 433425 - DNA, 25 bp, Homo sapien
ttgtgtgtgcgtacttagctgtact

SEQ ID NO: 433426 - DNA, 25 bp, Homo sapien
gctcggtggaccttgggctgtccct

SEQ ID NO: 433427 - DNA, 25 bp, Homo sapien
ctgggctcctggcatactcagtagc

SEQ ID NO: 433428 - DNA, 25 bp, Homo sapien
gcatactcagtagcctcatagccaa

SEQ ID NO: 433429 - DNA, 25 bp, Homo sapien
agcctcatagccaaactctggacag

SEQ ID NO: 433430 - DNA, 25 bp, Homo sapien
acagatggaggtgattttcccgccc

SEQ ID NO: 433431 - DNA, 25 bp, Homo sapien
atggaggtgattttcccgcccctgt

SEQ ID NO: 433432 - DNA, 25 bp, Homo sapien
tgtcattgacatcttggcccggcta

SEQ ID NO: 433433 - DNA, 25 bp, Homo sapien
cattgacatcttggcccggctagga

SEQ ID NO: 433434 - DNA, 25 bp, Homo sapien
gggaatgactttgtggcatggccca

SEQ ID NO: 433435 - DNA, 25 bp, Homo sapien
ggctgtccatttcctggtttggaca

SEQ ID NO: 433436 - DNA, 25 bp, Homo sapien
ttcctggtttggacatggttttgcg

SEQ ID NO: 433437 - DNA, 25 bp, Homo sapien
tagtgtgcacttcccccaaagatga

SEQ ID NO: 433438 - DNA, 25 bp, Homo sapien
gatgaagaaggattcctaagggatt

SEQ ID NO: 433439 - DNA, 25 bp, Homo sapien
tatttattgctacctcctggagatt

SEQ ID NO: 433440 - DNA, 25 bp, Homo sapien
attgctacctcctggagatttccag

SEQ ID NO: 433441 - DNA, 25 bp, Homo sapien
gctacctcctggagatttccagaac

SEQ ID NO: 433442 - DNA, 25 bp, Homo sapien
gatttccagaacaagatcatgcgat

SEQ ID NO: 433443 - DNA, 25 bp, Homo sapien
gatcatgcgatactttgtcagggaa

SEQ ID NO: 433444 - DNA, 25 bp, Homo sapien
gcgatactttgtcagggaaatcctt

SEQ ID NO: 433445 - DNA, 25 bp, Homo sapien
tttgtcagggaaatccttgcacgag

SEQ ID NO: 433446 - DNA, 25 bp, Homo sapien
cagggaaatccttgcacgaggaatt

SEQ ID NO: 433447 - DNA, 25 bp, Homo sapien
taataaatcaactcagtgatcctga

SEQ ID NO: 433448 - DNA, 25 bp, Homo sapien
gatttttacctcgatcttcaagcta

SEQ ID NO: 433449 - DNA, 25 bp, Homo sapien
acctcgatcttcaagctatcttaaa

SEQ ID NO: 433450 - DNA, 25 bp, Homo sapien
gttatgctttcctgagacacaacct

SEQ ID NO: 433451 - DNA, 25 bp, Homo sapien
ctgagacacaacctattttgggaag

SEQ ID NO: 433452 - DNA, 25 bp, Homo sapien
aagttgatcatccttctttgtgctc

SEQ ID NO: 433453 - DNA, 25 bp, Homo sapien
aggcctggcccacactcagtgaagg

SEQ ID NO: 433454 - DNA, 25 bp, Homo sapien
ccacactcagtgaaggaccggataa

SEQ ID NO: 433455 - DNA, 25 bp, Homo sapien
ggaccggataaaacttccacacaca

SEQ ID NO: 433456 - DNA, 25 bp, Homo sapien
tgctatgcagttcctaacagaccat

SEQ ID NO: 433457 - DNA, 25 bp, Homo sapien
taacagaccatggaccggtaccagt

SEQ ID NO: 433458 - DNA, 25 bp, Homo sapien
gtaccagtccgtgacctggcggttg

SEQ ID NO: 433459 - DNA, 25 bp, Homo sapien
tccagagtttccactaaagggttgg

SEQ ID NO: 433460 - DNA, 25 bp, Homo sapien
ttacaaatacctttggtctctgaac

SEQ ID NO: 433461 - DNA, 25 bp, Homo sapien
ctctgaacttcagtggcaaagaaca

SEQ ID NO: 433462 - DNA, 25 bp, Homo sapien
tcagtggcaaagaacagggatcaag

SEQ ID NO: 433463 - DNA, 25 bp, Homo sapien
acagggatcaagttgaatgttctca

SEQ ID NO: 433464 - DNA, 25 bp, Homo sapien
ggctttggatcctagaggagaaaca

SEQ ID NO: 433465 - DNA, 25 bp, Homo sapien
gagcagaaatggttatccctgttta

SEQ ID NO: 433466 - DNA, 25 bp, Homo sapien
gcagaaatggttatccctgtttaaa

SEQ ID NO: 433467 - DNA, 25 bp, Homo sapien
tccctgtttaaaataagccctcact

SEQ ID NO: 433468 - DNA, 25 bp, Homo sapien
tcactctttaccacttccttaaagg

SEQ ID NO: 433469 - DNA, 25 bp, Homo sapien
cttccttaaaggagtggaggtgctg

SEQ ID NO: 433470 - DNA, 25 bp, Homo sapien
ggcaaactgttgaccatgctctgtt

SEQ ID NO: 433471 - DNA, 25 bp, Homo sapien
gttgcaattgcttgtgtgggtacaa

SEQ ID NO: 433472 - DNA, 25 bp, Homo sapien
ggttcactccagtggctcccattgg

SEQ ID NO: 433473 - DNA, 25 bp, Homo sapien
agcttgactaaagggctgtccaaat

SEQ ID NO: 433474 - DNA, 25 bp, Homo sapien
ttgtgttcccagttattcccatcat

SEQ ID NO: 433475 - DNA, 25 bp, Homo sapien
tcttcatctttagacttcctcttag

SEQ ID NO: 433476 - DNA, 25 bp, Homo sapien
ctcttagaagaggactgacacctga

SEQ ID NO: 433477 - DNA, 25 bp, Homo sapien
ggtacaattcccactgatgtttgca

SEQ ID NO: 433478 - DNA, 25 bp, Homo sapien
gcatctgagacatatttggcacgtt

SEQ ID NO: 433479 - DNA, 25 bp, Homo sapien
ggcacgttggtgactgaagtattct

SEQ ID NO: 433480 - DNA, 25 bp, Homo sapien
gaagtattcttgatatctgtaggga

SEQ ID NO: 433481 - DNA, 25 bp, Homo sapien
ccatgcaggctcagggcaaggaaag

SEQ ID NO: 433482 - DNA, 25 bp, Homo sapien
gaatgtgctgctagcactggacctc

SEQ ID NO: 433483 - DNA, 25 bp, Homo sapien
actggacctcagctccgggcaaggc

SEQ ID NO: 433484 - DNA, 25 bp, Homo sapien
aaggctgcaccttctgaaccgacgg

SEQ ID NO: 433485 - DNA, 25 bp, Homo sapien
aaccgacggcccaggagcgaagtga

SEQ ID NO: 433486 - DNA, 25 bp, Homo sapien
ggagcgaagtgacccatacttcctc

SEQ ID NO: 433487 - DNA, 25 bp, Homo sapien
aaagcatcactctccagacatggga

SEQ ID NO: 433488 - DNA, 25 bp, Homo sapien
tctccctggactgtggtccacagga

SEQ ID NO: 433489 - DNA, 25 bp, Homo sapien
gaacaaggagctctactccacagga

SEQ ID NO: 433490 - DNA, 25 bp, Homo sapien
cagaagcctcgggaaacgtggacga

SEQ ID NO: 433491 - DNA, 25 bp, Homo sapien
ggacgacaatagattccagttgatg

SEQ ID NO: 433492 - DNA, 25 bp, Homo sapien
attctttgttaacatgagagtccca

SEQ ID NO: 433493 - DNA, 25 bp, Homo sapien
tgagagtcccatgtctgaaaaccaa

SEQ ID NO: 433494 - DNA, 25 bp, Homo sapien
aaaaccaaagtccaatttctgtctg

SEQ ID NO: 433495 - DNA, 25 bp, Homo sapien
agtccaatttctgtctggccttttg

SEQ ID NO: 433496 - DNA, 25 bp, Homo sapien
tggccttttgtctcatccttcttgg

SEQ ID NO: 433497 - DNA, 25 bp, Homo sapien
gtctcatccttcttggcaaaagtag

SEQ ID NO: 433498 - DNA, 25 bp, Homo sapien
atccttcttggcaaaagtagctttt

SEQ ID NO: 433499 - DNA, 25 bp, Homo sapien
gaaaagtattaatgtgcttgacacc

SEQ ID NO: 433500 - DNA, 25 bp, Homo sapien
aatgtgcttgacaccatgactgaaa

SEQ ID NO: 433501 - DNA, 25 bp, Homo sapien
gcttgacaccatgactgaaatacta

SEQ ID NO: 433502 - DNA, 25 bp, Homo sapien
gaaatactatgatcttgtttgtcaa

SEQ ID NO: 433503 - DNA, 25 bp, Homo sapien
tattaaagtggccagggagaaaaca

SEQ ID NO: 433504 - DNA, 25 bp, Homo sapien
aatggatgagaaatagactgctaac

SEQ ID NO: 433505 - DNA, 25 bp, Homo sapien
gactgctaacagatttgtcatcagc

SEQ ID NO: 433506 - DNA, 25 bp, Homo sapien
acagatttgtcatcagcaacactga

SEQ ID NO: 433507 - DNA, 25 bp, Homo sapien
gcaacactgaatgccagaagtcaat

SEQ ID NO: 433508 - DNA, 25 bp, Homo sapien
aagtcaatggatcaacatcttcaga

SEQ ID NO: 433509 - DNA, 25 bp, Homo sapien
ggatcaacatcttcagagcttaagg

SEQ ID NO: 433510 - DNA, 25 bp, Homo sapien
aatttttgtacctagaatttcatag

SEQ ID NO: 433511 - DNA, 25 bp, Homo sapien
atttcatagtaaggcagactgtcaa

SEQ ID NO: 433512 - DNA, 25 bp, Homo sapien
gacattttctgtcaggcaaattttc

SEQ ID NO: 433513 - DNA, 25 bp, Homo sapien
aatacaatctacatctagacacaat

SEQ ID NO: 433514 - DNA, 25 bp, Homo sapien
ggaggcgctgcggttggaacaggag

SEQ ID NO: 433515 - DNA, 25 bp, Homo sapien
tccccacgctgcatcatgagtgcag

SEQ ID NO: 433516 - DNA, 25 bp, Homo sapien
ccacgctgcatcatgagtgcagccg

SEQ ID NO: 433517 - DNA, 25 bp, Homo sapien
cacgctgcatcatgagtgcagccgg

SEQ ID NO: 433518 - DNA, 25 bp, Homo sapien
acgctgcatcatgagtgcagccggc

SEQ ID NO: 433519 - DNA, 25 bp, Homo sapien
cgctgcatcatgagtgcagccggct

SEQ ID NO: 433520 - DNA, 25 bp, Homo sapien
gctgcatcatgagtgcagccggctg

SEQ ID NO: 433521 - DNA, 25 bp, Homo sapien
ctgcatcatgagtgcagccggctgc

SEQ ID NO: 433522 - DNA, 25 bp, Homo sapien
tgcatcatgagtgcagccggctgca

SEQ ID NO: 433523 - DNA, 25 bp, Homo sapien
gcatcatgagtgcagccggctgcag

SEQ ID NO: 433524 - DNA, 25 bp, Homo sapien
catcatgagtgcagccggctgcagg

SEQ ID NO: 433525 - DNA, 25 bp, Homo sapien
gtggaatcaaaggtagagatactta

SEQ ID NO: 433526 - DNA, 25 bp, Homo sapien
aaggtagagatacttatatattcaa

SEQ ID NO: 433527 - DNA, 25 bp, Homo sapien
gaaaagatcttcagttaatggaaca

SEQ ID NO: 433528 - DNA, 25 bp, Homo sapien
gatcttcagttaatggaacaagaac

SEQ ID NO: 433529 - DNA, 25 bp, Homo sapien
ctagaggattagtgtattgttcaaa

SEQ ID NO: 433530 - DNA, 25 bp, Homo sapien
gaggattagtgtattgttcaaagct

SEQ ID NO: 433531 - DNA, 25 bp, Homo sapien
gattagtgtattgttcaaagctata

SEQ ID NO: 433532 - DNA, 25 bp, Homo sapien
gtgatgtaactatcagacatttgga

SEQ ID NO: 433533 - DNA, 25 bp, Homo sapien
gtaactatcagacatttggagagag

SEQ ID NO: 433534 - DNA, 25 bp, Homo sapien
actatcagacatttggagagagatg

SEQ ID NO: 433535 - DNA, 25 bp, Homo sapien
atggacaaaggaaagtggcgatagt

SEQ ID NO: 433536 - DNA, 25 bp, Homo sapien
aaagaactatatgaccatttggata

SEQ ID NO: 433537 - DNA, 25 bp, Homo sapien
aagaactatatgaccatttggatat

SEQ ID NO: 433538 - DNA, 25 bp, Homo sapien
tgaccatttggatatagtagaaacc

SEQ ID NO: 433539 - DNA, 25 bp, Homo sapien
aaacaaggagttagaaatgcagtat

SEQ ID NO: 433540 - DNA, 25 bp, Homo sapien
ttagaaatgcagtataagttacggg

SEQ ID NO: 433541 - DNA, 25 bp, Homo sapien
gcagtataagttacggggctctgta

SEQ ID NO: 433542 - DNA, 25 bp, Homo sapien
tgtaggaaagagaaccatggatatt

SEQ ID NO: 433543 - DNA, 25 bp, Homo sapien
gagaaccatggatattaaaattaag

SEQ ID NO: 433544 - DNA, 25 bp, Homo sapien
gaaaacttcaataataactttggtg

SEQ ID NO: 433545 - DNA, 25 bp, Homo sapien
acttcaataataactttggtgacaa

SEQ ID NO: 433546 - DNA, 25 bp, Homo sapien
caataataactttggtgacaataaa

SEQ ID NO: 433547 - DNA, 25 bp, Homo sapien
gaaaggagaacaacagaggccattt

SEQ ID NO: 433548 - DNA, 25 bp, Homo sapien
aaggagaacaacagaggccatttaa

SEQ ID NO: 433549 - DNA, 25 bp, Homo sapien
aggagaacaacagaggccatttaag

SEQ ID NO: 433550 - DNA, 25 bp, Homo sapien
gagaacaacagaggccatttaagga

SEQ ID NO: 433551 - DNA, 25 bp, Homo sapien
acagaggccatttaaggaaaacctg

SEQ ID NO: 433552 - DNA, 25 bp, Homo sapien
tacaccattctttaaaaccaataat

SEQ ID NO: 433553 - DNA, 25 bp, Homo sapien
gagaactatcatttactgagcatat

SEQ ID NO: 433554 - DNA, 25 bp, Homo sapien
gaactatcatttactgagcatatat

SEQ ID NO: 433555 - DNA, 25 bp, Homo sapien
ctatcatttactgagcatatataat

SEQ ID NO: 433556 - DNA, 25 bp, Homo sapien
gacatgagggtcttattatgttgcc

SEQ ID NO: 433557 - DNA, 25 bp, Homo sapien
tgaacaaaggtttactccaatacct

SEQ ID NO: 433558 - DNA, 25 bp, Homo sapien
tgatacgacagctctctgtgcactg

SEQ ID NO: 433559 - DNA, 25 bp, Homo sapien
agctctctgtgcactgattgcatat

SEQ ID NO: 433560 - DNA, 25 bp, Homo sapien
gtgcactgattgcatatgcatccca

SEQ ID NO: 433561 - DNA, 25 bp, Homo sapien
atgcatcccaagattatattattgt

SEQ ID NO: 433562 - DNA, 25 bp, Homo sapien
atgtgtcacactttgccaaacagga

SEQ ID NO: 433563 - DNA, 25 bp, Homo sapien
ccttccttaacaagacaattggtca

SEQ ID NO: 433564 - DNA, 25 bp, Homo sapien
gaactccattgcttaagaaacacat

SEQ ID NO: 433565 - DNA, 25 bp, Homo sapien
ataaacaccatttagtcactgaaca

SEQ ID NO: 433566 - DNA, 25 bp, Homo sapien
tttagtcactgaacatagctatatg

SEQ ID NO: 433567 - DNA, 25 bp, Homo sapien
atttctttgaaaattctggcagacc

SEQ ID NO: 433568 - DNA, 25 bp, Homo sapien
ctggcagaccaaggttctttttgtt

SEQ ID NO: 433569 - DNA, 25 bp, Homo sapien
ggctgccacaagctctctgcgggtc

SEQ ID NO: 433570 - DNA, 25 bp, Homo sapien
tgccacaagctctctgcgggtccat

SEQ ID NO: 433571 - DNA, 25 bp, Homo sapien
cctcaagcgtcgtctgcatgagtga

SEQ ID NO: 433572 - DNA, 25 bp, Homo sapien
ctcaagcgtcgtctgcatgagtgag

SEQ ID NO: 433573 - DNA, 25 bp, Homo sapien
catgagtgagcaggcgtgggtggac

SEQ ID NO: 433574 - DNA, 25 bp, Homo sapien
aggcgtgggtggactctggccgcgg

SEQ ID NO: 433575 - DNA, 25 bp, Homo sapien
tctggccgcggccacacttggtgct

SEQ ID NO: 433576 - DNA, 25 bp, Homo sapien
acttggtgctcaccagctgcttcgg

SEQ ID NO: 433577 - DNA, 25 bp, Homo sapien
agctgcttcggccttcaggtgacct

SEQ ID NO: 433578 - DNA, 25 bp, Homo sapien
ggcatcctgctctccgggtggaaga

SEQ ID NO: 433579 - DNA, 25 bp, Homo sapien
ctctccgggtggaagagcagctttc

SEQ ID NO: 433580 - DNA, 25 bp, Homo sapien
ttggaaataattaaccttggctaca

SEQ ID NO: 433581 - DNA, 25 bp, Homo sapien
gaaataattaaccttggctacaaag

SEQ ID NO: 433582 - DNA, 25 bp, Homo sapien
aagaacagtagcaagtgtactcccg

SEQ ID NO: 433583 - DNA, 25 bp, Homo sapien
agaacagtagcaagtgtactcccgg

SEQ ID NO: 433584 - DNA, 25 bp, Homo sapien
gaacagtagcaagtgtactcccggc

SEQ ID NO: 433585 - DNA, 25 bp, Homo sapien
aacagtagcaagtgtactcccggcc

SEQ ID NO: 433586 - DNA, 25 bp, Homo sapien
acagtagcaagtgtactcccggccg

SEQ ID NO: 433587 - DNA, 25 bp, Homo sapien
cagtagcaagtgtactcccggccgg

SEQ ID NO: 433588 - DNA, 25 bp, Homo sapien
agtagcaagtgtactcccggccggg

SEQ ID NO: 433589 - DNA, 25 bp, Homo sapien
tagcaagtgtactcccggccgggcg

SEQ ID NO: 433590 - DNA, 25 bp, Homo sapien
agcaagtgtactcccggccgggcgc

SEQ ID NO: 433591 - DNA, 25 bp, Homo sapien
gcctccaggtgcctaagcttgccaa

SEQ ID NO: 433592 - DNA, 25 bp, Homo sapien
cctccaggtgcctaagcttgccaat

SEQ ID NO: 433593 - DNA, 25 bp, Homo sapien
ctccaggtgcctaagcttgccaatc

SEQ ID NO: 433594 - DNA, 25 bp, Homo sapien
tccaggtgcctaagcttgccaatca

SEQ ID NO: 433595 - DNA, 25 bp, Homo sapien
ccaggtgcctaagcttgccaatcat

SEQ ID NO: 433596 - DNA, 25 bp, Homo sapien
caggtgcctaagcttgccaatcata

SEQ ID NO: 433597 - DNA, 25 bp, Homo sapien
aggtgcctaagcttgccaatcatac

SEQ ID NO: 433598 - DNA, 25 bp, Homo sapien
ggtgcctaagcttgccaatcatacg

SEQ ID NO: 433599 - DNA, 25 bp, Homo sapien
ttgccaatcatacgcatctctgcct

SEQ ID NO: 433600 - DNA, 25 bp, Homo sapien
ccaatcatacgcatctctgccttct

SEQ ID NO: 433601 - DNA, 25 bp, Homo sapien
ctggctggaggcctcggagggctgc

SEQ ID NO: 433602 - DNA, 25 bp, Homo sapien
gaggaagctaaatctctcaacactt

SEQ ID NO: 433603 - DNA, 25 bp, Homo sapien
tcaacacttgtgtctcccatattag

SEQ ID NO: 433604 - DNA, 25 bp, Homo sapien
gtctcccatattagctgtgtcctag

SEQ ID NO: 433605 - DNA, 25 bp, Homo sapien
tgtgtcctagtatttcacatcactg

SEQ ID NO: 433606 - DNA, 25 bp, Homo sapien
catcactgtgatgggactgtcattc

SEQ ID NO: 433607 - DNA, 25 bp, Homo sapien
tgtcattcattcacaggtttgggaa

SEQ ID NO: 433608 - DNA, 25 bp, Homo sapien
tgggaaacatgcacctcatgtggtc

SEQ ID NO: 433609 - DNA, 25 bp, Homo sapien
tggtccccattaccatgagctatgt

SEQ ID NO: 433610 - DNA, 25 bp, Homo sapien
tgagctatgtccattttctctttcc

SEQ ID NO: 433611 - DNA, 25 bp, Homo sapien
tttcctccattcgtgaatcctatca

SEQ ID NO: 433612 - DNA, 25 bp, Homo sapien
tatcatttatagcatcaagaccaag

SEQ ID NO: 433613 - DNA, 25 bp, Homo sapien
ccttacctccagcatgttgtagatg

SEQ ID NO: 433614 - DNA, 25 bp, Homo sapien
gtagagcttgatgacggactgcccc

SEQ ID NO: 433615 - DNA, 25 bp, Homo sapien
ccagaggtgtgtcccagaccagcag

SEQ ID NO: 433616 - DNA, 25 bp, Homo sapien
ggaaatgcagattctccagacccag

SEQ ID NO: 433617 - DNA, 25 bp, Homo sapien
cccagcctagatctcctaaatcaga

SEQ ID NO: 433618 - DNA, 25 bp, Homo sapien
gatgacagcacagtaaaggccagaa

SEQ ID NO: 433619 - DNA, 25 bp, Homo sapien
aaggccagaagcaccataactagag

SEQ ID NO: 433620 - DNA, 25 bp, Homo sapien
taactagagtcggtagagcattctt

SEQ ID NO: 433621 - DNA, 25 bp, Homo sapien
gagcattcttgactctcaggtacct

SEQ ID NO: 433622 - DNA, 25 bp, Homo sapien
tgactctcaggtaccttcagaactg

SEQ ID NO: 433623 - DNA, 25 bp, Homo sapien
tgaagacttgaagctgagtgccctg

SEQ ID NO: 433624 - DNA, 25 bp, Homo sapien
ggcacccacaacatataccgggaat

SEQ ID NO: 433625 - DNA, 25 bp, Homo sapien
gggcgctgtcaccaagtgctatcga

SEQ ID NO: 433626 - DNA, 25 bp, Homo sapien
aagtgctatcgagacatgggcgccc

SEQ ID NO: 433627 - DNA, 25 bp, Homo sapien
gggcccactccatccagatcaggaa

SEQ ID NO: 433628 - DNA, 25 bp, Homo sapien
caagaggcccgataccttcttctaa

SEQ ID NO: 433629 - DNA, 25 bp, Homo sapien
aagaggcccgataccttcttctaag

SEQ ID NO: 433630 - DNA, 25 bp, Homo sapien
agaggcccgataccttcttctaagg

SEQ ID NO: 433631 - DNA, 25 bp, Homo sapien
gaggcccgataccttcttctaaggg

SEQ ID NO: 433632 - DNA, 25 bp, Homo sapien
ggcccgataccttcttctaagggca

SEQ ID NO: 433633 - DNA, 25 bp, Homo sapien
cccgataccttcttctaagggcagg

SEQ ID NO: 433634 - DNA, 25 bp, Homo sapien
gataccttcttctaagggcagggcc

SEQ ID NO: 433635 - DNA, 25 bp, Homo sapien
gaataactgggaacacaagtccatt

SEQ ID NO: 433636 - DNA, 25 bp, Homo sapien
agtccatttggacagccctttagtc

SEQ ID NO: 433637 - DNA, 25 bp, Homo sapien
gacagccctttagtcaagctggagg

SEQ ID NO: 433638 - DNA, 25 bp, Homo sapien
tagtcaagctggagggcagccaatg

SEQ ID NO: 433639 - DNA, 25 bp, Homo sapien
aatgggagccactggagtgaacccc

SEQ ID NO: 433640 - DNA, 25 bp, Homo sapien
agtgaacccccagttagccagcaaa

SEQ ID NO: 433641 - DNA, 25 bp, Homo sapien
gagcatggtcaacagtttgcccacc

SEQ ID NO: 433642 - DNA, 25 bp, Homo sapien
atcaagaatacttcagtcaccaacg

SEQ ID NO: 433643 - DNA, 25 bp, Homo sapien
ttcagtcaccaacgtgccaaatatg

SEQ ID NO: 433644 - DNA, 25 bp, Homo sapien
aacgtgccaaatatgtctcagatgc

SEQ ID NO: 433645 - DNA, 25 bp, Homo sapien
atatgtctcagatgcaaacatcagt

SEQ ID NO: 433646 - DNA, 25 bp, Homo sapien
atttcctgcttatccaagttcacca

SEQ ID NO: 433647 - DNA, 25 bp, Homo sapien
tttcctgcttatccaagttcaccat

SEQ ID NO: 433648 - DNA, 25 bp, Homo sapien
ttcctgcttatccaagttcaccatt

SEQ ID NO: 433649 - DNA, 25 bp, Homo sapien
tcctgcttatccaagttcaccattt

SEQ ID NO: 433650 - DNA, 25 bp, Homo sapien
ctgcttatccaagttcaccatttca

SEQ ID NO: 433651 - DNA, 25 bp, Homo sapien
tgcttatccaagttcaccatttcag

SEQ ID NO: 433652 - DNA, 25 bp, Homo sapien
cttatccaagttcaccatttcaggt

SEQ ID NO: 433653 - DNA, 25 bp, Homo sapien
atccaagttcaccatttcaggtcac

SEQ ID NO: 433654 - DNA, 25 bp, Homo sapien
atataattatcaggcatttcctgct

SEQ ID NO: 433655 - DNA, 25 bp, Homo sapien
aggtcaccactggatatcagttcca

SEQ ID NO: 433656 - DNA, 25 bp, Homo sapien
accactggatatcagttccatgtat

SEQ ID NO: 433657 - DNA, 25 bp, Homo sapien
agatgacagatgttctacccagcca

SEQ ID NO: 433658 - DNA, 25 bp, Homo sapien
ataacgcccacatggtgcccgagga

SEQ ID NO: 433659 - DNA, 25 bp, Homo sapien
tcagaggccggcgtctatgtcctac

SEQ ID NO: 433660 - DNA, 25 bp, Homo sapien
gacaacacctatagctttgtccacg

SEQ ID NO: 433661 - DNA, 25 bp, Homo sapien
ttgtccacgccaagaaggtcagctt

SEQ ID NO: 433662 - DNA, 25 bp, Homo sapien
aggtcagcttcacagtggaggtcct

SEQ ID NO: 433663 - DNA, 25 bp, Homo sapien
ggtcctgctccctgacgagggcatg

SEQ ID NO: 433664 - DNA, 25 bp, Homo sapien
aatacgagatcctatttccaggctg

SEQ ID NO: 433665 - DNA, 25 bp, Homo sapien
ttccaggctgcgttctcaggtggca

SEQ ID NO: 433666 - DNA, 25 bp, Homo sapien
gttctcatctgatggtgcggacatc

SEQ ID NO: 433667 - DNA, 25 bp, Homo sapien
gcggacatcggcttcggagttttcc

SEQ ID NO: 433668 - DNA, 25 bp, Homo sapien
ccatgggacagacaatcaagatcac

SEQ ID NO: 433669 - DNA, 25 bp, Homo sapien
catgggacagacaatcaagatcaca

SEQ ID NO: 433670 - DNA, 25 bp, Homo sapien
atgggacagacaatcaagatcacat

SEQ ID NO: 433671 - DNA, 25 bp, Homo sapien
ggagacagcctcaaaaagttttatg

SEQ ID NO: 433672 - DNA, 25 bp, Homo sapien
gagacagcctcaaaaagttttatgc

SEQ ID NO: 433673 - DNA, 25 bp, Homo sapien
agacagcctcaaaaagttttatgca

SEQ ID NO: 433674 - DNA, 25 bp, Homo sapien
gacagcctcaaaaagttttatgcaa

SEQ ID NO: 433675 - DNA, 25 bp, Homo sapien
cagcctcaaaaagttttatgcaacc

SEQ ID NO: 433676 - DNA, 25 bp, Homo sapien
gcctcaaaaagttttatgcaacctg

SEQ ID NO: 433677 - DNA, 25 bp, Homo sapien
ctcaaaaagttttatgcaacctggt

SEQ ID NO: 433678 - DNA, 25 bp, Homo sapien
aaagttttatgcaacctggtaccag

SEQ ID NO: 433679 - DNA, 25 bp, Homo sapien
gaggacatcttttctggtacacagc

SEQ ID NO: 433680 - DNA, 25 bp, Homo sapien
cacagcaaggctcaggaatcccagg

SEQ ID NO: 433681 - DNA, 25 bp, Homo sapien
ttatctgcaggcacaggtgtctact

SEQ ID NO: 433682 - DNA, 25 bp, Homo sapien
acagctctcactatactctggatgg

SEQ ID NO: 433683 - DNA, 25 bp, Homo sapien
ggtagcatgatttgatggcttcaaa

SEQ ID NO: 433684 - DNA, 25 bp, Homo sapien
gaaatgaaagcagactcctatgcaa

SEQ ID NO: 433685 - DNA, 25 bp, Homo sapien
ggcacaggtgtctactgtcatgttg

SEQ ID NO: 433686 - DNA, 25 bp, Homo sapien
cctatgcaaaggtggaactccgttt

SEQ ID NO: 433687 - DNA, 25 bp, Homo sapien
actcctcagttcctattacactaaa

SEQ ID NO: 433688 - DNA, 25 bp, Homo sapien
ttcagaaccacattccgattctcat

SEQ ID NO: 433689 - DNA, 25 bp, Homo sapien
ttccgattctcatccaggaataaaa

SEQ ID NO: 433690 - DNA, 25 bp, Homo sapien
gcacccttgaggtctctcctttgag

SEQ ID NO: 433691 - DNA, 25 bp, Homo sapien
cctttgagccgtggtcaccgagagg

SEQ ID NO: 433692 - DNA, 25 bp, Homo sapien
gttgaggacgcagcacccgaggtcc

SEQ ID NO: 433693 - DNA, 25 bp, Homo sapien
gaggtcccagcctttgcaggagcct

SEQ ID NO: 433694 - DNA, 25 bp, Homo sapien
gctggacttagatcttcggtggcct

SEQ ID NO: 433695 - DNA, 25 bp, Homo sapien
tagatcttcggtggcctcatgtaaa

SEQ ID NO: 433696 - DNA, 25 bp, Homo sapien
tcttcggtggcctcatgtaaacgtg

SEQ ID NO: 433697 - DNA, 25 bp, Homo sapien
atgtaaacgtggcagccagcctctt

SEQ ID NO: 433698 - DNA, 25 bp, Homo sapien
aaagtgaagactgccttgtcccgca

SEQ ID NO: 433699 - DNA, 25 bp, Homo sapien
gcagctccttctggcttagattgaa

SEQ ID NO: 433700 - DNA, 25 bp, Homo sapien
tgggcttcctaatgggttaaatcct

SEQ ID NO: 433701 - DNA, 25 bp, Homo sapien
gcaggcccctgttcttgtcgtctat

SEQ ID NO: 433702 - DNA, 25 bp, Homo sapien
ccatgggacagacaatcaagatcac

SEQ ID NO: 433703 - DNA, 25 bp, Homo sapien
catgggacagacaatcaagatcaca

SEQ ID NO: 433704 - DNA, 25 bp, Homo sapien
atgggacagacaatcaagatcacat

SEQ ID NO: 433705 - DNA, 25 bp, Homo sapien
ggagacagcctcaaaaagttttatg

SEQ ID NO: 433706 - DNA, 25 bp, Homo sapien
gagacagcctcaaaaagttttatgc

SEQ ID NO: 433707 - DNA, 25 bp, Homo sapien
gacagcctcaaaaagttttatgcaa

SEQ ID NO: 433708 - DNA, 25 bp, Homo sapien
cagcctcaaaaagttttatgcaacc

SEQ ID NO: 433709 - DNA, 25 bp, Homo sapien
gcctcaaaaagttttatgcaacctg

SEQ ID NO: 433710 - DNA, 25 bp, Homo sapien
ctcaaaaagttttatgcaacctggt

SEQ ID NO: 433711 - DNA, 25 bp, Homo sapien
aaagttttatgcaacctggtaccag

SEQ ID NO: 433712 - DNA, 25 bp, Homo sapien
gctacctcctgcctgatgagatata

SEQ ID NO: 433713 - DNA, 25 bp, Homo sapien
gatatactctgaactccaggaggct

SEQ ID NO: 433714 - DNA, 25 bp, Homo sapien
ggcatctcaatggaagggttatatt

SEQ ID NO: 433715 - DNA, 25 bp, Homo sapien
ggttatattcatcaacccaggacca

SEQ ID NO: 433716 - DNA, 25 bp, Homo sapien
caggaccagcaactctgcgcagcag

SEQ ID NO: 433717 - DNA, 25 bp, Homo sapien
aactctgcgcagcagaactccagga

SEQ ID NO: 433718 - DNA, 25 bp, Homo sapien
ttcaagcttcaccattcagcacagt

SEQ ID NO: 433719 - DNA, 25 bp, Homo sapien
attcagcacagtaaggccttctcta

SEQ ID NO: 433720 - DNA, 25 bp, Homo sapien
taaggccttctctaccaccaagtat

SEQ ID NO: 433721 - DNA, 25 bp, Homo sapien
taccaccaagtattcctgctattct

SEQ ID NO: 433722 - DNA, 25 bp, Homo sapien
ttcctgctattctgatgctgaaggt

SEQ ID NO: 433723 - DNA, 25 bp, Homo sapien
agggcacgggctccgaggcgtccag

SEQ ID NO: 433724 - DNA, 25 bp, Homo sapien
agcctgggccagaccgctaggagcg

SEQ ID NO: 433725 - DNA, 25 bp, Homo sapien
caggccgccgggttagggctcgtgg

SEQ ID NO: 433726 - DNA, 25 bp, Homo sapien
agcggctgagcctggcccgcaacgt

SEQ ID NO: 433727 - DNA, 25 bp, Homo sapien
tcgccttcctgagcagcagcgtgaa

SEQ ID NO: 433728 - DNA, 25 bp, Homo sapien
tgagcagcagcgtgaaccccgtgct

SEQ ID NO: 433729 - DNA, 25 bp, Homo sapien
gcagcagcgtgaaccccgtgctgta

SEQ ID NO: 433730 - DNA, 25 bp, Homo sapien
tgaaccccgtgctgtacgcgtgcgc

SEQ ID NO: 433731 - DNA, 25 bp, Homo sapien
tgctgtacgcgtgcgccggcggcgg

SEQ ID NO: 433732 - DNA, 25 bp, Homo sapien
gcgtgggcttcgtcgccaagctgct

SEQ ID NO: 433733 - DNA, 25 bp, Homo sapien
gggcttcgtcgccaagctgctggag

SEQ ID NO: 433734 - DNA, 25 bp, Homo sapien
gagcaagtccagtgctgaccttgac

SEQ ID NO: 433735 - DNA, 25 bp, Homo sapien
tgaccttgacctcagaaccaacggg

SEQ ID NO: 433736 - DNA, 25 bp, Homo sapien
atgtgcattctcacggcctatgtgc

SEQ ID NO: 433737 - DNA, 25 bp, Homo sapien
tacggtttcaccatcgttcgtgact

SEQ ID NO: 433738 - DNA, 25 bp, Homo sapien
cttccccactgtgttcgtgaaggaa

SEQ ID NO: 433739 - DNA, 25 bp, Homo sapien
aggaaaagcactacctcactgcctt

SEQ ID NO: 433740 - DNA, 25 bp, Homo sapien
actgccttctacgtggtcgagtgca

SEQ ID NO: 433741 - DNA, 25 bp, Homo sapien
tggtcgagtgcatcgccatgagcaa

SEQ ID NO: 433742 - DNA, 25 bp, Homo sapien
gcatcgccatgagcaacagcatgat

SEQ ID NO: 433743 - DNA, 25 bp, Homo sapien
atgatcaacaccgtgtgcttcgtga

SEQ ID NO: 433744 - DNA, 25 bp, Homo sapien
gtgacggtcaagaacaacaccatga

SEQ ID NO: 433745 - DNA, 25 bp, Homo sapien
tccgaggcgtccagcacgcgccgcg

SEQ ID NO: 433746 - DNA, 25 bp, Homo sapien
ggcagcctgggccagaccgctagga

SEQ ID NO: 433747 - DNA, 25 bp, Homo sapien
agcctgggccagaccgctaggagcg

SEQ ID NO: 433748 - DNA, 25 bp, Homo sapien
gagcccggcccttccgagagcctca

SEQ ID NO: 433749 - DNA, 25 bp, Homo sapien
caggccgccgggttagggctcgtgg

SEQ ID NO: 433750 - DNA, 25 bp, Homo sapien
tgagcagcagcgtgaaccccgtgct

SEQ ID NO: 433751 - DNA, 25 bp, Homo sapien
agcagcagcgtgaaccccgtgctgt

SEQ ID NO: 433752 - DNA, 25 bp, Homo sapien
cagcagcgtgaaccccgtgctgtac

SEQ ID NO: 433753 - DNA, 25 bp, Homo sapien
gtgctgtacgcgtgcgccggcggcg

SEQ ID NO: 433754 - DNA, 25 bp, Homo sapien
gctcggcgggcgtgggcttcgtcgc

SEQ ID NO: 433755 - DNA, 25 bp, Homo sapien
cgggcgtgggcttcgtcgccaagct

SEQ ID NO: 433756 - DNA, 25 bp, Homo sapien
gcttcagcaagcagatgctgttcca

SEQ ID NO: 433757 - DNA, 25 bp, Homo sapien
tgctctctatacaagtgcctagtac

SEQ ID NO: 433758 - DNA, 25 bp, Homo sapien
aagtgcctagtacactgcttggacc

SEQ ID NO: 433759 - DNA, 25 bp, Homo sapien
ctagtacactgcttggacctctgaa

SEQ ID NO: 433760 - DNA, 25 bp, Homo sapien
gtacactgcttggacctctgaaggt

SEQ ID NO: 433761 - DNA, 25 bp, Homo sapien
cactgcttggacctctgaaggtatt

SEQ ID NO: 433762 - DNA, 25 bp, Homo sapien
cgagccagcggcgacgaatgaagaa

SEQ ID NO: 433763 - DNA, 25 bp, Homo sapien
agcggcgacgaatgaagaacttttt

SEQ ID NO: 433764 - DNA, 25 bp, Homo sapien
agaactttttcacttactgcaggat

SEQ ID NO: 433765 - DNA, 25 bp, Homo sapien
cttactgcaggattttcagcttcag

SEQ ID NO: 433766 - DNA, 25 bp, Homo sapien
ttttcagcttcagcaagcagatgct

SEQ ID NO: 433767 - DNA, 25 bp, Homo sapien
acataaaggcacacctcagtttccc

SEQ ID NO: 433768 - DNA, 25 bp, Homo sapien
tattgagcttcacttcgcagatctt

SEQ ID NO: 433769 - DNA, 25 bp, Homo sapien
agcttcacttcgcagatcttgcatt

SEQ ID NO: 433770 - DNA, 25 bp, Homo sapien
tcacttcgcagatcttgcatttttt

SEQ ID NO: 433771 - DNA, 25 bp, Homo sapien
acaagcaaccctgcatggaagcaag

SEQ ID NO: 433772 - DNA, 25 bp, Homo sapien
ggcaccatttttgctcgcttcgtgt

SEQ ID NO: 433773 - DNA, 25 bp, Homo sapien
atttttgctcgcttcgtgtctctct

SEQ ID NO: 433774 - DNA, 25 bp, Homo sapien
tctctcttacattttaatctattac

SEQ ID NO: 433775 - DNA, 25 bp, Homo sapien
aatctattactgtgatctatgatca

SEQ ID NO: 433776 - DNA, 25 bp, Homo sapien
gggcatcacaaactatgcccataaa

SEQ ID NO: 433777 - DNA, 25 bp, Homo sapien
atggtagtcctaataaatgttgtgt

SEQ ID NO: 433778 - DNA, 25 bp, Homo sapien
attacacacgggaatttatatagcc

SEQ ID NO: 433779 - DNA, 25 bp, Homo sapien
acacgggaatttatatagccaactt

SEQ ID NO: 433780 - DNA, 25 bp, Homo sapien
cacgggaatttatatagccaacttt

SEQ ID NO: 433781 - DNA, 25 bp, Homo sapien
gattcagaaaagtaccacggaattt

SEQ ID NO: 433782 - DNA, 25 bp, Homo sapien
gactttaaaaaaccttcaattgcag

SEQ ID NO: 433783 - DNA, 25 bp, Homo sapien
aaaaaccttcaattgcagaactaat

SEQ ID NO: 433784 - DNA, 25 bp, Homo sapien
ccttcaattgcagaactaattttgt

SEQ ID NO: 433785 - DNA, 25 bp, Homo sapien
tcaaattgaaggaactcttttaggt

SEQ ID NO: 433786 - DNA, 25 bp, Homo sapien
gaaattcgattagtaattcaatcaa

SEQ ID NO: 433787 - DNA, 25 bp, Homo sapien
aattgacaaattctgacataaaaac

SEQ ID NO: 433788 - DNA, 25 bp, Homo sapien
tagaacaactaagatcgcttaaaaa

SEQ ID NO: 433789 - DNA, 25 bp, Homo sapien
ccggctatctggaaatcagttccat

SEQ ID NO: 433790 - DNA, 25 bp, Homo sapien
gatcttggaggcagctgagtttatc

SEQ ID NO: 433791 - DNA, 25 bp, Homo sapien
ggaggcagctgagtttatcaaattc

SEQ ID NO: 433792 - DNA, 25 bp, Homo sapien
atcaaattcacagtcatcaggccgc

SEQ ID NO: 433793 - DNA, 25 bp, Homo sapien
aaattcacagtcatcaggccgcttc

SEQ ID NO: 433794 - DNA, 25 bp, Homo sapien
aatggtgagtattctacaggtgaga

SEQ ID NO: 433795 - DNA, 25 bp, Homo sapien
acaggtgagaagaacgttccggcaa

SEQ ID NO: 433796 - DNA, 25 bp, Homo sapien
gaacgttccggcaatgttgggccat

SEQ ID NO: 433797 - DNA, 25 bp, Homo sapien
aatgttgggccatgggaagtgtctt

SEQ ID NO: 433798 - DNA, 25 bp, Homo sapien
tttgcttccgtgagcctgggaccca

SEQ ID NO: 433799 - DNA, 25 bp, Homo sapien
gcctgggacccaagtatgcagcctt

SEQ ID NO: 433800 - DNA, 25 bp, Homo sapien
gtgtacagtacacatatcttatata

SEQ ID NO: 433801 - DNA, 25 bp, Homo sapien
tataatgaccaagccaagattgatg

SEQ ID NO: 433802 - DNA, 25 bp, Homo sapien
aagattgatgcttaccacctactgg

SEQ ID NO: 433803 - DNA, 25 bp, Homo sapien
atgcttaccacctactggttgccaa

SEQ ID NO: 433804 - DNA, 25 bp, Homo sapien
tactggttgccaagcctttcatttg

SEQ ID NO: 433805 - DNA, 25 bp, Homo sapien
ttgccaagcctttcatttgcattgc

SEQ ID NO: 433806 - DNA, 25 bp, Homo sapien
agcctttcatttgcattgcttcttc

SEQ ID NO: 433807 - DNA, 25 bp, Homo sapien
tgcttcttctttccacactgacttg

SEQ ID NO: 433808 - DNA, 25 bp, Homo sapien
cactgacttgtgcacattttgagtt

SEQ ID NO: 433809 - DNA, 25 bp, Homo sapien
agttaaatgctcacaggaatggtgt

SEQ ID NO: 433810 - DNA, 25 bp, Homo sapien
catttttcttgtgcagtggttattt

SEQ ID NO: 433811 - DNA, 25 bp, Homo sapien
gaatgggagagagttctttctttct

SEQ ID NO: 433812 - DNA, 25 bp, Homo sapien
ttctttcttcaaggaacttacagcc

SEQ ID NO: 433813 - DNA, 25 bp, Homo sapien
aataaggaatatcacaacatttaaa

SEQ ID NO: 433814 - DNA, 25 bp, Homo sapien
aaatatctctattcctttatgtttc

SEQ ID NO: 433815 - DNA, 25 bp, Homo sapien
aatatctctattcctttatgtttct

SEQ ID NO: 433816 - DNA, 25 bp, Homo sapien
ttcttgatagaatgtagcctaacta

SEQ ID NO: 433817 - DNA, 25 bp, Homo sapien
gtagcctaactatataactatctgg

SEQ ID NO: 433818 - DNA, 25 bp, Homo sapien
gcctaactatataactatctggtca

SEQ ID NO: 433819 - DNA, 25 bp, Homo sapien
taactatataactatctggtcagat

SEQ ID NO: 433820 - DNA, 25 bp, Homo sapien
ctatctggtcagattattttggcca

SEQ ID NO: 433821 - DNA, 25 bp, Homo sapien
ctcttgactacacaatttccgttaa

SEQ ID NO: 433822 - DNA, 25 bp, Homo sapien
agagagatacgcttggctccagacc

SEQ ID NO: 433823 - DNA, 25 bp, Homo sapien
gggcacagtagccttcgtgtgtctt

SEQ ID NO: 433824 - DNA, 25 bp, Homo sapien
agccttcgtgtgtcttcctctagca

SEQ ID NO: 433825 - DNA, 25 bp, Homo sapien
gcacagacccctgagctgagggtag

SEQ ID NO: 433826 - DNA, 25 bp, Homo sapien
gaaggcagcacgagggacgctccca

SEQ ID NO: 433827 - DNA, 25 bp, Homo sapien
tatcctcaagaacctcggccaatga

SEQ ID NO: 433828 - DNA, 25 bp, Homo sapien
gagttacagccacatcgtgggtgca

SEQ ID NO: 433829 - DNA, 25 bp, Homo sapien
tgcagcagggtgtaggcgattccaa

SEQ ID NO: 433830 - DNA, 25 bp, Homo sapien
taggcgattccaaagagcagatgat

SEQ ID NO: 433831 - DNA, 25 bp, Homo sapien
cagatgattcaaattcgtgtgcgat

SEQ ID NO: 433832 - DNA, 25 bp, Homo sapien
aattcgtgtgcgatgggtacagaga

SEQ ID NO: 433833 - DNA, 25 bp, Homo sapien
gggagataaaaaatacctacttcat

SEQ ID NO: 433834 - DNA, 25 bp, Homo sapien
caacattctctccagttattctcta

SEQ ID NO: 433835 - DNA, 25 bp, Homo sapien
ctccagttattctctatcacctaaa

SEQ ID NO: 433836 - DNA, 25 bp, Homo sapien
ttctctatcacctaaatctggtttg

SEQ ID NO: 433837 - DNA, 25 bp, Homo sapien
atctggtttgctgtctttaaggcca

SEQ ID NO: 433838 - DNA, 25 bp, Homo sapien
tgctgtctttaaggccatctgaaat

SEQ ID NO: 433839 - DNA, 25 bp, Homo sapien
tttatacttattacctgtcacctcc

SEQ ID NO: 433840 - DNA, 25 bp, Homo sapien
cctgtcacctccactaaaattcata

SEQ ID NO: 433841 - DNA, 25 bp, Homo sapien
gaaatcagattagcgtggttccact

SEQ ID NO: 433842 - DNA, 25 bp, Homo sapien
gattagcgtggttccactactttgt

SEQ ID NO: 433843 - DNA, 25 bp, Homo sapien
tccactactttgtgaccctaggcaa

SEQ ID NO: 433844 - DNA, 25 bp, Homo sapien
ctttttgctgttctgctctgagtat

SEQ ID NO: 433845 - DNA, 25 bp, Homo sapien
cctggcctgcctattagcgatgttg

SEQ ID NO: 433846 - DNA, 25 bp, Homo sapien
ctggcctgcctattagcgatgttgc

SEQ ID NO: 433847 - DNA, 25 bp, Homo sapien
tggcctgcctattagcgatgttgca

SEQ ID NO: 433848 - DNA, 25 bp, Homo sapien
ggcctgcctattagcgatgttgcaa

SEQ ID NO: 433849 - DNA, 25 bp, Homo sapien
gcctgcctattagcgatgttgcaaa

SEQ ID NO: 433850 - DNA, 25 bp, Homo sapien
ctgcctattagcgatgttgcaaaga

SEQ ID NO: 433851 - DNA, 25 bp, Homo sapien
gcctattagcgatgttgcaaagaaa

SEQ ID NO: 433852 - DNA, 25 bp, Homo sapien
ctattagcgatgttgcaaagaaact

SEQ ID NO: 433853 - DNA, 25 bp, Homo sapien
aatacaaaaaggatacagctacata

SEQ ID NO: 433854 - DNA, 25 bp, Homo sapien
aaaaaggatacagctacatatcgag

SEQ ID NO: 433855 - DNA, 25 bp, Homo sapien
ctggataaactgaaagctgagcgtg

SEQ ID NO: 433856 - DNA, 25 bp, Homo sapien
tggataaactgaaagctgagcgtga

SEQ ID NO: 433857 - DNA, 25 bp, Homo sapien
taaactgaaagctgagcgtgaacgt

SEQ ID NO: 433858 - DNA, 25 bp, Homo sapien
actgaaagctgagcgtgaacgtggt

SEQ ID NO: 433859 - DNA, 25 bp, Homo sapien
aaagctgagcgtgaacgtggtatca

SEQ ID NO: 433860 - DNA, 25 bp, Homo sapien
agctgagcgtgaacgtggtatcacc

SEQ ID NO: 433861 - DNA, 25 bp, Homo sapien
tttgagaccagcaagcccatgtgtg

SEQ ID NO: 433862 - DNA, 25 bp, Homo sapien
tatccaccttgggtcgcttgctgtt

SEQ ID NO: 433863 - DNA, 25 bp, Homo sapien
atccaccttgggtcgcttgctgttc

SEQ ID NO: 433864 - DNA, 25 bp, Homo sapien
tccaccttgggtcgcttgctgttcg

SEQ ID NO: 433865 - DNA, 25 bp, Homo sapien
ccaccttgggtcgcttgctgttcgt

SEQ ID NO: 433866 - DNA, 25 bp, Homo sapien
ttaaacgctttaatatatggcacct

SEQ ID NO: 433867 - DNA, 25 bp, Homo sapien
aaacgctttaatatatggcaccttt

SEQ ID NO: 433868 - DNA, 25 bp, Homo sapien
aacgctttaatatatggcaccttta

SEQ ID NO: 433869 - DNA, 25 bp, Homo sapien
acgctttaatatatggcacctttaa

SEQ ID NO: 433870 - DNA, 25 bp, Homo sapien
atatatggcacctttaaaattgagt

SEQ ID NO: 433871 - DNA, 25 bp, Homo sapien
aaaattgagtcagagccttttagtg

SEQ ID NO: 433872 - DNA, 25 bp, Homo sapien
aaattgagtcagagccttttagtga

SEQ ID NO: 433873 - DNA, 25 bp, Homo sapien
aattgagtcagagccttttagtgaa

SEQ ID NO: 433874 - DNA, 25 bp, Homo sapien
ttgagtcagagccttttagtgaaag

SEQ ID NO: 433875 - DNA, 25 bp, Homo sapien
tagtgaaagaatctgttttccctaa

SEQ ID NO: 433876 - DNA, 25 bp, Homo sapien
tgaaagaatctgttttccctaaaat

SEQ ID NO: 433877 - DNA, 25 bp, Homo sapien
aaaggctgactctcctgaccatggg

SEQ ID NO: 433878 - DNA, 25 bp, Homo sapien
catgggagcccagagtcaggtaccg

SEQ ID NO: 433879 - DNA, 25 bp, Homo sapien
gagcccagagtcaggtaccggagct

SEQ ID NO: 433880 - DNA, 25 bp, Homo sapien
cagagtcaggtaccggagctgctcc

SEQ ID NO: 433881 - DNA, 25 bp, Homo sapien
agtcaggtaccggagctgctcctgt

SEQ ID NO: 433882 - DNA, 25 bp, Homo sapien
tgttgcattgctatggccgggacaa

SEQ ID NO: 433883 - DNA, 25 bp, Homo sapien
gtcatgttctcttttgaggccagcg

SEQ ID NO: 433884 - DNA, 25 bp, Homo sapien
atgttctcttttgaggccagcgccg

SEQ ID NO: 433885 - DNA, 25 bp, Homo sapien
gttctcttttgaggccagcgccgct

SEQ ID NO: 433886 - DNA, 25 bp, Homo sapien
tgggccctggaaccttcctttccag

SEQ ID NO: 433887 - DNA, 25 bp, Homo sapien
aggactgaggcggtcgagcactgtg

SEQ ID NO: 433888 - DNA, 25 bp, Homo sapien
ccgcagtggcctgagttgcagtgat

SEQ ID NO: 433889 - DNA, 25 bp, Homo sapien
gattcgtattcactcattctttgat

SEQ ID NO: 433890 - DNA, 25 bp, Homo sapien
agggttttgtgcgtgttgtttcagc

SEQ ID NO: 433891 - DNA, 25 bp, Homo sapien
ttcagcatatgacacgtggcaccag

SEQ ID NO: 433892 - DNA, 25 bp, Homo sapien
gacacgtggcaccagctgtacactg

SEQ ID NO: 433893 - DNA, 25 bp, Homo sapien
actgcccttctggttagtgttgttc

SEQ ID NO: 433894 - DNA, 25 bp, Homo sapien
gtgttgttcttggtcaagggctcca

SEQ ID NO: 433895 - DNA, 25 bp, Homo sapien
aagggctccaggctgtcttccatgc

SEQ ID NO: 433896 - DNA, 25 bp, Homo sapien
ctatcttcatgagtgggtggcagca

SEQ ID NO: 433897 - DNA, 25 bp, Homo sapien
gcccactgggagaagcattgatact

SEQ ID NO: 433898 - DNA, 25 bp, Homo sapien
gaagcattgatactgtggccactca

SEQ ID NO: 433899 - DNA, 25 bp, Homo sapien
gcagccagcgggtacagaatggatt

SEQ ID NO: 433900 - DNA, 25 bp, Homo sapien
gattttggaagagggagtcaccact

SEQ ID NO: 433901 - DNA, 25 bp, Homo sapien
agtcaccactggacctccaaggaag

SEQ ID NO: 433902 - DNA, 25 bp, Homo sapien
ggaagccacgtgcagacatctacaa

SEQ ID NO: 433903 - DNA, 25 bp, Homo sapien
aaccttcgatctcctgacgagttta

SEQ ID NO: 433904 - DNA, 25 bp, Homo sapien
cctgacgagtttattgttggccaaa

SEQ ID NO: 433905 - DNA, 25 bp, Homo sapien
tttattgttggccaaaaccaggctt

SEQ ID NO: 433906 - DNA, 25 bp, Homo sapien
aaccaggctttgattgaaccaggat

SEQ ID NO: 433907 - DNA, 25 bp, Homo sapien
ttgaaccaggatgaatgcgggtgtt

SEQ ID NO: 433908 - DNA, 25 bp, Homo sapien
gagtgtggtacttctcctagttgca

SEQ ID NO: 433909 - DNA, 25 bp, Homo sapien
ctcctagttgcagtcaggcttcata

SEQ ID NO: 433910 - DNA, 25 bp, Homo sapien
gatgcactttaactccaatggcctg

SEQ ID NO: 433911 - DNA, 25 bp, Homo sapien
tccaatggcctggaacccaaagaaa

SEQ ID NO: 433912 - DNA, 25 bp, Homo sapien
aagaaaacgagcctccatctccact

SEQ ID NO: 433913 - DNA, 25 bp, Homo sapien
atctccactggtctctgggattatt

SEQ ID NO: 433914 - DNA, 25 bp, Homo sapien
ttattgattacaacatgcccctcac

SEQ ID NO: 433915 - DNA, 25 bp, Homo sapien
acctccacctacctgaagcagatga

SEQ ID NO: 433916 - DNA, 25 bp, Homo sapien
tgaagcttcgagtgatgaattccca

SEQ ID NO: 433917 - DNA, 25 bp, Homo sapien
gcacctggcttcgtaaacactgtta

SEQ ID NO: 433918 - DNA, 25 bp, Homo sapien
aaacactgttatcaccgtgctcatc

SEQ ID NO: 433919 - DNA, 25 bp, Homo sapien
gtgctcatctgtgcccatgaagaat

SEQ ID NO: 433920 - DNA, 25 bp, Homo sapien
aaaaccgcacaaacagccggaagca

SEQ ID NO: 433921 - DNA, 25 bp, Homo sapien
gagcgagaacaggtccacaaggatg

SEQ ID NO: 433922 - DNA, 25 bp, Homo sapien
gatgagtctgggacagcttcttttg

SEQ ID NO: 433923 - DNA, 25 bp, Homo sapien
agggattccgactacaatctcctaa

SEQ ID NO: 433924 - DNA, 25 bp, Homo sapien
ttacctgtgtttgaagaagagactc

SEQ ID NO: 433925 - DNA, 25 bp, Homo sapien
gaagagactcgcattttccagaaag

SEQ ID NO: 433926 - DNA, 25 bp, Homo sapien
aaatatgccttgtgctgaattttgg

SEQ ID NO: 433927 - DNA, 25 bp, Homo sapien
gaattttggcttggaatcaccaact

SEQ ID NO: 433928 - DNA, 25 bp, Homo sapien
aactctgcctgtattgtgatcccca

SEQ ID NO: 433929 - DNA, 25 bp, Homo sapien
tattgtgatccccaagactccagac

SEQ ID NO: 433930 - DNA, 25 bp, Homo sapien
cagagtcacctgctggcttagagga

SEQ ID NO: 433931 - DNA, 25 bp, Homo sapien
aggagtggagtgctttctatgtaat

SEQ ID NO: 433932 - DNA, 25 bp, Homo sapien
gacggatagatagatttcagacaga

SEQ ID NO: 433933 - DNA, 25 bp, Homo sapien
atccccttaaagacagagaaactgc

SEQ ID NO: 433934 - DNA, 25 bp, Homo sapien
gaaactgcctggtattggaaaccta

SEQ ID NO: 433935 - DNA, 25 bp, Homo sapien
tggaaacctagccaactaccttggg

SEQ ID NO: 433936 - DNA, 25 bp, Homo sapien
actaccttgggctagggaagtcatg

SEQ ID NO: 433937 - DNA, 25 bp, Homo sapien
tagggaagtcatgcttcttgacaga

SEQ ID NO: 433938 - DNA, 25 bp, Homo sapien
gagaacctacaaccactaatttact

SEQ ID NO: 433939 - DNA, 25 bp, Homo sapien
atatagtccataactatgctctaaa

SEQ ID NO: 433940 - DNA, 25 bp, Homo sapien
gatggtgacatttcctcgactctgt

SEQ ID NO: 433941 - DNA, 25 bp, Homo sapien
tgtctctcaggcctcacctaaatgg

SEQ ID NO: 433942 - DNA, 25 bp, Homo sapien
gcctcacctaaatgggtggacggat

SEQ ID NO: 433943 - DNA, 25 bp, Homo sapien
gcaagatccttgaggtaagagctga

SEQ ID NO: 433944 - DNA, 25 bp, Homo sapien
gtaagagctgatctctgacgtccgc

SEQ ID NO: 433945 - DNA, 25 bp, Homo sapien
gatctctgacgtccgctgggaactg

SEQ ID NO: 433946 - DNA, 25 bp, Homo sapien
gctctgcaggtttctgtatcacatt

SEQ ID NO: 433947 - DNA, 25 bp, Homo sapien
ggtttctgtatcacattttctgcac

SEQ ID NO: 433948 - DNA, 25 bp, Homo sapien
gtatcacattttctgcacatgtcca

SEQ ID NO: 433949 - DNA, 25 bp, Homo sapien
ttctgcacatgtccattagaattgg

SEQ ID NO: 433950 - DNA, 25 bp, Homo sapien
tctagtgttgaataaaggcccggca

SEQ ID NO: 433951 - DNA, 25 bp, Homo sapien
acttgactcattcttggtggcgacc

SEQ ID NO: 433952 - DNA, 25 bp, Homo sapien
ccacccacaggcacctaaaatgaaa

SEQ ID NO: 433953 - DNA, 25 bp, Homo sapien
gagagtttggtgagcaagatccttg

SEQ ID NO: 433954 - DNA, 25 bp, Homo sapien
gaggcattcaaagccctccagagag

SEQ ID NO: 433955 - DNA, 25 bp, Homo sapien
aggcgactgggatgtgctcctcttt

SEQ ID NO: 433956 - DNA, 25 bp, Homo sapien
tcctctttgaggacggagcatcgtg

SEQ ID NO: 433957 - DNA, 25 bp, Homo sapien
taagtatgtactacctgctgccact

SEQ ID NO: 433958 - DNA, 25 bp, Homo sapien
aactggactcctttatggtgtcatc

SEQ ID NO: 433959 - DNA, 25 bp, Homo sapien
gtgtcatcaattttgcggagcctta

SEQ ID NO: 433960 - DNA, 25 bp, Homo sapien
gccttacatgtgcttggacgggaat

SEQ ID NO: 433961 - DNA, 25 bp, Homo sapien
ggaatgccaggctgaaagctaactt

SEQ ID NO: 433962 - DNA, 25 bp, Homo sapien
gccactgctgtcctctgaaaagatt

SEQ ID NO: 433963 - DNA, 25 bp, Homo sapien
ataagtgctcattcaagggtcctgt

SEQ ID NO: 433964 - DNA, 25 bp, Homo sapien
aagggtcctgttgactgatcagaga

SEQ ID NO: 433965 - DNA, 25 bp, Homo sapien
gcaggtctgacatgcactggatccg

SEQ ID NO: 433966 - DNA, 25 bp, Homo sapien
gtctgacatgcactggatccgccag

SEQ ID NO: 433967 - DNA, 25 bp, Homo sapien
tgacatgcactggatccgccagact

SEQ ID NO: 433968 - DNA, 25 bp, Homo sapien
ggagtggatggcagtaatatcacat

SEQ ID NO: 433969 - DNA, 25 bp, Homo sapien
gatggcagtaatatcacatgatgaa

SEQ ID NO: 433970 - DNA, 25 bp, Homo sapien
tccagagacaatttcgagaacacat

SEQ ID NO: 433971 - DNA, 25 bp, Homo sapien
tcgagaacacattgtatttgcaaat

SEQ ID NO: 433972 - DNA, 25 bp, Homo sapien
atgaattggctgaaagtcgacgaca

SEQ ID NO: 433973 - DNA, 25 bp, Homo sapien
aaagtcgacgacaacggtgtatatt

SEQ ID NO: 433974 - DNA, 25 bp, Homo sapien
acaacggtgtatattattgtgcgaa

SEQ ID NO: 433975 - DNA, 25 bp, Homo sapien
attcagcaggtctgacatgcactgg

SEQ ID NO: 433976 - DNA, 25 bp, Homo sapien
tacttttctgtagttgaccatttaa

SEQ ID NO: 433977 - DNA, 25 bp, Homo sapien
gtagttgaccatttaacttcacata

SEQ ID NO: 433978 - DNA, 25 bp, Homo sapien
gaccatttaacttcacataatacac

SEQ ID NO: 433979 - DNA, 25 bp, Homo sapien
taacttcacataatacactacaaat

SEQ ID NO: 433980 - DNA, 25 bp, Homo sapien
gaaaacacttcagatttgtattaca

SEQ ID NO: 433981 - DNA, 25 bp, Homo sapien
ttgtattacaatcaattaaggaggg

SEQ ID NO: 433982 - DNA, 25 bp, Homo sapien
gaaagacaggaagtagaccaaaata

SEQ ID NO: 433983 - DNA, 25 bp, Homo sapien
aaagggacacggatctataccaaat

SEQ ID NO: 433984 - DNA, 25 bp, Homo sapien
gacacggatctataccaaatatctg

SEQ ID NO: 433985 - DNA, 25 bp, Homo sapien
ccaaatatctggctgctctaaaagt

SEQ ID NO: 433986 - DNA, 25 bp, Homo sapien
aagattaaacactggcaagaatgcc

SEQ ID NO: 433987 - DNA, 25 bp, Homo sapien
gcctcatcgtggtaacatgcacagc

SEQ ID NO: 433988 - DNA, 25 bp, Homo sapien
gtggtaacatgcacagcccttgcca

SEQ ID NO: 433989 - DNA, 25 bp, Homo sapien
ccatggcccatgtagaaacaaccat

SEQ ID NO: 433990 - DNA, 25 bp, Homo sapien
tgtagaaacaaccatgtggccttca

SEQ ID NO: 433991 - DNA, 25 bp, Homo sapien
agcaccaggaccctggtcagggtta

SEQ ID NO: 433992 - DNA, 25 bp, Homo sapien
cctggtcagggttagaggtttctgc

SEQ ID NO: 433993 - DNA, 25 bp, Homo sapien
ctgctgagtcaaagccacatggagg

SEQ ID NO: 433994 - DNA, 25 bp, Homo sapien
gagagatgcagagtcatgtttccag

SEQ ID NO: 433995 - DNA, 25 bp, Homo sapien
tgcagagtcatgtttccaggaggag

SEQ ID NO: 433996 - DNA, 25 bp, Homo sapien
ccaggaggaggttatctgagcataa

SEQ ID NO: 433997 - DNA, 25 bp, Homo sapien
ggccacaggatacctctgaggctca

SEQ ID NO: 433998 - DNA, 25 bp, Homo sapien
agaagggaggagttactcatctctt

SEQ ID NO: 433999 - DNA, 25 bp, Homo sapien
actacttcaggcgtgacttaggggt

SEQ ID NO: 434000 - DNA, 25 bp, Homo sapien
aggagcatagtctgaattgtctggt

SEQ ID NO: 434001 - DNA, 25 bp, Homo sapien
agcatagtctgaattgtctggtggc

SEQ ID NO: 434002 - DNA, 25 bp, Homo sapien
catagtctgaattgtctggtggcta

SEQ ID NO: 434003 - DNA, 25 bp, Homo sapien
tagtctgaattgtctggtggctaac

SEQ ID NO: 434004 - DNA, 25 bp, Homo sapien
gtctgaattgtctggtggctaactg

SEQ ID NO: 434005 - DNA, 25 bp, Homo sapien
ctgaattgtctggtggctaactgta

SEQ ID NO: 434006 - DNA, 25 bp, Homo sapien
gaattgtctggtggctaactgtagt

SEQ ID NO: 434007 - DNA, 25 bp, Homo sapien
tctggtggctaactgtagtttcaat

SEQ ID NO: 434008 - DNA, 25 bp, Homo sapien
ggtggctaactgtagtttcaataag

SEQ ID NO: 434009 - DNA, 25 bp, Homo sapien
atgctgagctacatgatgaaagaag

SEQ ID NO: 434010 - DNA, 25 bp, Homo sapien
aagaagtgaagcatcccattcatct

SEQ ID NO: 434011 - DNA, 25 bp, Homo sapien
ataaaggcttattccactccaattc

SEQ ID NO: 434012 - DNA, 25 bp, Homo sapien
cttattccactccaattcagcagta

SEQ ID NO: 434013 - DNA, 25 bp, Homo sapien
ttcagcagtatcaggattatgatgt

SEQ ID NO: 434014 - DNA, 25 bp, Homo sapien
ttatgatgttgagccctatcgctgg

SEQ ID NO: 434015 - DNA, 25 bp, Homo sapien
ttcttcaactggtttgctgaccgca

SEQ ID NO: 434016 - DNA, 25 bp, Homo sapien
tttgctgaccgcaacttcacaggat

SEQ ID NO: 434017 - DNA, 25 bp, Homo sapien
gcaacttcacaggatctaacaggat

SEQ ID NO: 434018 - DNA, 25 bp, Homo sapien
ggatctaacaggattgctgaggaga

SEQ ID NO: 434019 - DNA, 25 bp, Homo sapien
tgctgaggagacttatgtacggaac

SEQ ID NO: 434020 - DNA, 25 bp, Homo sapien
atagatgctttttaagtgtcattag

SEQ ID NO: 434021 - DNA, 25 bp, Homo sapien
aagtgtcattagttatcggaatcaa

SEQ ID NO: 434022 - DNA, 25 bp, Homo sapien
ggattatctgtaactccccaaattt

SEQ ID NO: 434023 - DNA, 25 bp, Homo sapien
taactccccaaatttactgttcttg

SEQ ID NO: 434024 - DNA, 25 bp, Homo sapien
tttactgttcttgaatgacattctc

SEQ ID NO: 434025 - DNA, 25 bp, Homo sapien
aatgagttagtctcatccctgcttt

SEQ ID NO: 434026 - DNA, 25 bp, Homo sapien
agttagtctcatccctgctttctgt

SEQ ID NO: 434027 - DNA, 25 bp, Homo sapien
gctttctgtttcctctctctgcatc

SEQ ID NO: 434028 - DNA, 25 bp, Homo sapien
tctctctgcatcttctcttggcata

SEQ ID NO: 434029 - DNA, 25 bp, Homo sapien
aaaaagatgcattcccttcctgttc

SEQ ID NO: 434030 - DNA, 25 bp, Homo sapien
aagatgcattcccttcctgttcaca

SEQ ID NO: 434031 - DNA, 25 bp, Homo sapien
tcttatacagaagaaactaacttag

SEQ ID NO: 434032 - DNA, 25 bp, Homo sapien
cttatacagaagaaactaacttaga

SEQ ID NO: 434033 - DNA, 25 bp, Homo sapien
ttatacagaagaaactaacttagaa

SEQ ID NO: 434034 - DNA, 25 bp, Homo sapien
tatacagaagaaactaacttagaaa

SEQ ID NO: 434035 - DNA, 25 bp, Homo sapien
tacagaagaaactaacttagaaaca

SEQ ID NO: 434036 - DNA, 25 bp, Homo sapien
ctaacttagaaacaaaggattcaat

SEQ ID NO: 434037 - DNA, 25 bp, Homo sapien
aacttagaaacaaaggattcaatat

SEQ ID NO: 434038 - DNA, 25 bp, Homo sapien
acttagaaacaaaggattcaatatt

SEQ ID NO: 434039 - DNA, 25 bp, Homo sapien
aagggtgtatgtccactgcttgagc

SEQ ID NO: 434040 - DNA, 25 bp, Homo sapien
gtatgtccactgcttgagccctgaa

SEQ ID NO: 434041 - DNA, 25 bp, Homo sapien
aggtcatggtgctcagccaaggaac

SEQ ID NO: 434042 - DNA, 25 bp, Homo sapien
aggaacaccatgtgctgtgttccct

SEQ ID NO: 434043 - DNA, 25 bp, Homo sapien
acaaacatttgggagagtacctggg

SEQ ID NO: 434044 - DNA, 25 bp, Homo sapien
gggacataccaagaaaaacactcat

SEQ ID NO: 434045 - DNA, 25 bp, Homo sapien
aagaaaaacactcatcacacacaga

SEQ ID NO: 434046 - DNA, 25 bp, Homo sapien
gtggggcaaatttccagagttgtcc

SEQ ID NO: 434047 - DNA, 25 bp, Homo sapien
agagttgtcctgctaccacctagga

SEQ ID NO: 434048 - DNA, 25 bp, Homo sapien
taccacctaggaatgccctgtatgt

SEQ ID NO: 434049 - DNA, 25 bp, Homo sapien
taggaatgccctgtatgttaagtcc

SEQ ID NO: 434050 - DNA, 25 bp, Homo sapien
tctatgggctagaggtgagaccttt

SEQ ID NO: 434051 - DNA, 25 bp, Homo sapien
gaggtgagacctttgcaggctcaac

SEQ ID NO: 434052 - DNA, 25 bp, Homo sapien
gacctttgcaggctcaacaaatgct

SEQ ID NO: 434053 - DNA, 25 bp, Homo sapien
aatgcttgagggttattctgatcca

SEQ ID NO: 434054 - DNA, 25 bp, Homo sapien
ttctgatccaggcatatggctaggc

SEQ ID NO: 434055 - DNA, 25 bp, Homo sapien
ggcatatggctaggccatgtcctag

SEQ ID NO: 434056 - DNA, 25 bp, Homo sapien
catgtcctagagagtactggcctct

SEQ ID NO: 434057 - DNA, 25 bp, Homo sapien
ctagagagtactggcctctcagtaa

SEQ ID NO: 434058 - DNA, 25 bp, Homo sapien
gcctctcagtaagtgcccatagtga

SEQ ID NO: 434059 - DNA, 25 bp, Homo sapien
actatgtggtagacgctgtgctttg

SEQ ID NO: 434060 - DNA, 25 bp, Homo sapien
gacgctgtgctttgtaactgtttcg

SEQ ID NO: 434061 - DNA, 25 bp, Homo sapien
atgttacattctcaattctctcttt

SEQ ID NO: 434062 - DNA, 25 bp, Homo sapien
agttctcgagcagcctattatgaaa

SEQ ID NO: 434063 - DNA, 25 bp, Homo sapien
ttctcgagcagcctattatgaaaga

SEQ ID NO: 434064 - DNA, 25 bp, Homo sapien
tctcgagcagcctattatgaaagaa

SEQ ID NO: 434065 - DNA, 25 bp, Homo sapien
ctcgagcagcctattatgaaagaac

SEQ ID NO: 434066 - DNA, 25 bp, Homo sapien
tcgagcagcctattatgaaagaaca

SEQ ID NO: 434067 - DNA, 25 bp, Homo sapien
cgagcagcctattatgaaagaacag

SEQ ID NO: 434068 - DNA, 25 bp, Homo sapien
gagcagcctattatgaaagaacagc

SEQ ID NO: 434069 - DNA, 25 bp, Homo sapien
gcctattatgaaagaacagctggtt

SEQ ID NO: 434070 - DNA, 25 bp, Homo sapien
cctattatgaaagaacagctggttt

SEQ ID NO: 434071 - DNA, 25 bp, Homo sapien
ttatgaaagaacagctggtttcctg

SEQ ID NO: 434072 - DNA, 25 bp, Homo sapien
tacccaggatggagtaggcggcggc

SEQ ID NO: 434073 - DNA, 25 bp, Homo sapien
cctggtgtccatccggaaggctatg

SEQ ID NO: 434074 - DNA, 25 bp, Homo sapien
ccatccggaaggctatggacaactt

SEQ ID NO: 434075 - DNA, 25 bp, Homo sapien
gaaggctatggacaacttccatgca

SEQ ID NO: 434076 - DNA, 25 bp, Homo sapien
ggacaacttccatgcagagctccat

SEQ ID NO: 434077 - DNA, 25 bp, Homo sapien
ttctggatcatgaagctgccacggt

SEQ ID NO: 434078 - DNA, 25 bp, Homo sapien
cacggtggaggtcccaccacaatgt

SEQ ID NO: 434079 - DNA, 25 bp, Homo sapien
aggtcccaccacaatgtcctggagg

SEQ ID NO: 434080 - DNA, 25 bp, Homo sapien
cacaatgtcctggagggcggccgct

SEQ ID NO: 434081 - DNA, 25 bp, Homo sapien
gacccgcgaggacgtcctaaaagag

SEQ ID NO: 434082 - DNA, 25 bp, Homo sapien
cactccgggctgtcctccgaaagac

SEQ ID NO: 434083 - DNA, 25 bp, Homo sapien
aaattcaaattgcaggccggcacgt

SEQ ID NO: 434084 - DNA, 25 bp, Homo sapien
aattcaaattgcaggccggcacgtg

SEQ ID NO: 434085 - DNA, 25 bp, Homo sapien
attcaaattgcaggccggcacgtgg

SEQ ID NO: 434086 - DNA, 25 bp, Homo sapien
ttcaaattgcaggccggcacgtggc

SEQ ID NO: 434087 - DNA, 25 bp, Homo sapien
tcaaattgcaggccggcacgtggct

SEQ ID NO: 434088 - DNA, 25 bp, Homo sapien
caaattgcaggccggcacgtggctc

SEQ ID NO: 434089 - DNA, 25 bp, Homo sapien
ttgcaggccggcacgtggctcacac

SEQ ID NO: 434090 - DNA, 25 bp, Homo sapien
gaggctgaggcagggcggatgacct

SEQ ID NO: 434091 - DNA, 25 bp, Homo sapien
ttagccgtgcctggtggcgcgtgcc

SEQ ID NO: 434092 - DNA, 25 bp, Homo sapien
ctgaaatcgtcccactgcacccagc

SEQ ID NO: 434093 - DNA, 25 bp, Homo sapien
tgaaatcgtcccactgcacccagcc

SEQ ID NO: 434094 - DNA, 25 bp, Homo sapien
aggcagcagcggaactcctggcttt

SEQ ID NO: 434095 - DNA, 25 bp, Homo sapien
ggaactcctggctttctgcgagacg

SEQ ID NO: 434096 - DNA, 25 bp, Homo sapien
ggctttctgcgagacgcatgccaaa

SEQ ID NO: 434097 - DNA, 25 bp, Homo sapien
gcatgccaaagatgacccgctggtg

SEQ ID NO: 434098 - DNA, 25 bp, Homo sapien
aaagatgacccgctggtgacgccag

SEQ ID NO: 434099 - DNA, 25 bp, Homo sapien
tggtgacgccagtacccgccgcgga

SEQ ID NO: 434100 - DNA, 25 bp, Homo sapien
ccgaggcccgcaagacggtggaaca

SEQ ID NO: 434101 - DNA, 25 bp, Homo sapien
aagctggaggtgaacatcgaccgca

SEQ ID NO: 434102 - DNA, 25 bp, Homo sapien
aggtgaacatcgaccgcatgaaggt

SEQ ID NO: 434103 - DNA, 25 bp, Homo sapien
ccgcatgaaggtgtcgcaggcagca

SEQ ID NO: 434104 - DNA, 25 bp, Homo sapien
tgtcgcaggcagcagcggaactcct

SEQ ID NO: 434105 - DNA, 25 bp, Homo sapien
tgaggtcacgctggattttccaatc

SEQ ID NO: 434106 - DNA, 25 bp, Homo sapien
ggtcacgctggattttccaatccat

SEQ ID NO: 434107 - DNA, 25 bp, Homo sapien
ctggattttccaatccataggccca

SEQ ID NO: 434108 - DNA, 25 bp, Homo sapien
atccataggcccaaagtgaactccc

SEQ ID NO: 434109 - DNA, 25 bp, Homo sapien
ataggcccaaagtgaactcccacgt

SEQ ID NO: 434110 - DNA, 25 bp, Homo sapien
gcccaaagtgaactcccacgtggag

SEQ ID NO: 434111 - DNA, 25 bp, Homo sapien
agtgaactcccacgtggagtaggat

SEQ ID NO: 434112 - DNA, 25 bp, Homo sapien
ggagtaggatgaaaacccacagcat

SEQ ID NO: 434113 - DNA, 25 bp, Homo sapien
tgaaaacccacagcatctagatctt

SEQ ID NO: 434114 - DNA, 25 bp, Homo sapien
aaacccacagcatctagatcttcaa

SEQ ID NO: 434115 - DNA, 25 bp, Homo sapien
gcatctagatcttcaaattctggag

SEQ ID NO: 434116 - DNA, 25 bp, Homo sapien
atttcaaccatttgattttgtatga

SEQ ID NO: 434117 - DNA, 25 bp, Homo sapien
gattttgtatgattgaaacttgcac

SEQ ID NO: 434118 - DNA, 25 bp, Homo sapien
attttgtatgattgaaacttgcacc

SEQ ID NO: 434119 - DNA, 25 bp, Homo sapien
ttttgtatgattgaaacttgcaccg

SEQ ID NO: 434120 - DNA, 25 bp, Homo sapien
tttgtatgattgaaacttgcaccga

SEQ ID NO: 434121 - DNA, 25 bp, Homo sapien
tataatttaacttgtgaactccttg

SEQ ID NO: 434122 - DNA, 25 bp, Homo sapien
ataatttaacttgtgaactccttgg

SEQ ID NO: 434123 - DNA, 25 bp, Homo sapien
tgtgaactccttggatatgatatta

SEQ ID NO: 434124 - DNA, 25 bp, Homo sapien
gtgaactccttggatatgatattat

SEQ ID NO: 434125 - DNA, 25 bp, Homo sapien
ggaaagcacaaaacaatggttcaga

SEQ ID NO: 434126 - DNA, 25 bp, Homo sapien
aatggttcagagataaattggctaa

SEQ ID NO: 434127 - DNA, 25 bp, Homo sapien
gttggagactgtgcaatgtacgact

SEQ ID NO: 434128 - DNA, 25 bp, Homo sapien
actgtgcaatgtacgacttggagga

SEQ ID NO: 434129 - DNA, 25 bp, Homo sapien
cttggaggagtttgtttggcataat

SEQ ID NO: 434130 - DNA, 25 bp, Homo sapien
atgattttgtaggtctgtcagcatt

SEQ ID NO: 434131 - DNA, 25 bp, Homo sapien
aggtctgtcagcattttgatatatt

SEQ ID NO: 434132 - DNA, 25 bp, Homo sapien
ttgtggattagccaggtgaatgatc

SEQ ID NO: 434133 - DNA, 25 bp, Homo sapien
atgatccttgaaacatctctttcag

SEQ ID NO: 434134 - DNA, 25 bp, Homo sapien
gaaacatctctttcaggtctggaga

SEQ ID NO: 434135 - DNA, 25 bp, Homo sapien
gacagaatgcccttaaagtgtgaaa

SEQ ID NO: 434136 - DNA, 25 bp, Homo sapien
aatattaacaccttattgtagctag

SEQ ID NO: 434137 - DNA, 25 bp, Homo sapien
agtaaattaacttcctgatgcaagg

SEQ ID NO: 434138 - DNA, 25 bp, Homo sapien
caaggagttggtagcatagtacagt

SEQ ID NO: 434139 - DNA, 25 bp, Homo sapien
gcatagtacagtgtagtgtttcaca

SEQ ID NO: 434140 - DNA, 25 bp, Homo sapien
gtgtttcacaaatataacctgttga

SEQ ID NO: 434141 - DNA, 25 bp, Homo sapien
taacctgttgatcctataaggtcaa

SEQ ID NO: 434142 - DNA, 25 bp, Homo sapien
agatgtggttttctgttatcattgt

SEQ ID NO: 434143 - DNA, 25 bp, Homo sapien
gtgtttgtactgataatgtggaagc

SEQ ID NO: 434144 - DNA, 25 bp, Homo sapien
gatgggtaaaactgctgatgcctca

SEQ ID NO: 434145 - DNA, 25 bp, Homo sapien
aatcagtgctgtgacaccagtctgt

SEQ ID NO: 434146 - DNA, 25 bp, Homo sapien
gtgacaccagtctgtactagtagtc

SEQ ID NO: 434147 - DNA, 25 bp, Homo sapien
acaatcttcctagactctctgatca

SEQ ID NO: 434148 - DNA, 25 bp, Homo sapien
ttaatactgtcataggcattgcctc

SEQ ID NO: 434149 - DNA, 25 bp, Homo sapien
ataggcattgcctctggtgaagaga

SEQ ID NO: 434150 - DNA, 25 bp, Homo sapien
gagccaaagccctcaatacctgtat

SEQ ID NO: 434151 - DNA, 25 bp, Homo sapien
acctgtatctcccacattagttgtg

SEQ ID NO: 434152 - DNA, 25 bp, Homo sapien
gtgttcttatcttctatgttacggt

SEQ ID NO: 434153 - DNA, 25 bp, Homo sapien
gatgggtttgacattcatttacaga

SEQ ID NO: 434154 - DNA, 25 bp, Homo sapien
gaagaatgtgccagaggttgtccac

SEQ ID NO: 434155 - DNA, 25 bp, Homo sapien
agaggttgtccacattatcatgagt

SEQ ID NO: 434156 - DNA, 25 bp, Homo sapien
ctctttcctcctttaatgaaccctg

SEQ ID NO: 434157 - DNA, 25 bp, Homo sapien
tgaaccctgtcatctacagcatcaa

SEQ ID NO: 434158 - DNA, 25 bp, Homo sapien
aaattttgcatcttctttgctcaag

SEQ ID NO: 434159 - DNA, 25 bp, Homo sapien
cttctttgctcaagggcctttagat

SEQ ID NO: 434160 - DNA, 25 bp, Homo sapien
aagggcctttagatgtaacaacaca

SEQ ID NO: 434161 - DNA, 25 bp, Homo sapien
acacagacatgatacaaggctgaca

SEQ ID NO: 434162 - DNA, 25 bp, Homo sapien
caaggctgacaatgacattatgatt

SEQ ID NO: 434163 - DNA, 25 bp, Homo sapien
atggttttgcatagtcctgactcac

SEQ ID NO: 434164 - DNA, 25 bp, Homo sapien
atagtcctgactcactgcctacata

SEQ ID NO: 434165 - DNA, 25 bp, Homo sapien
tacatacccctcttgttcctcagtt

SEQ ID NO: 434166 - DNA, 25 bp, Homo sapien
cttgttcctcagttcttatccctga

SEQ ID NO: 434167 - DNA, 25 bp, Homo sapien
ctgatttcttacaggatggcctaag

SEQ ID NO: 434168 - DNA, 25 bp, Homo sapien
gatggcctaagacagctgtagatgt

SEQ ID NO: 434169 - DNA, 25 bp, Homo sapien
tcatatacctctaaaagatgccagt

SEQ ID NO: 434170 - DNA, 25 bp, Homo sapien
gatgccagtaatgatgtctaccctg

SEQ ID NO: 434171 - DNA, 25 bp, Homo sapien
taatgatgtctaccctgcagtgttg

SEQ ID NO: 434172 - DNA, 25 bp, Homo sapien
gtctaccctgcagtgttgctgtgag

SEQ ID NO: 434173 - DNA, 25 bp, Homo sapien
gaatttcaacctggtaaatgctgta

SEQ ID NO: 434174 - DNA, 25 bp, Homo sapien
gtaaatgctgtagaaccgcgcctgg

SEQ ID NO: 434175 - DNA, 25 bp, Homo sapien
gaaccgcgcctggtatgtggtaaca

SEQ ID NO: 434176 - DNA, 25 bp, Homo sapien
gcgcctggtatgtggtaacattcaa

SEQ ID NO: 434177 - DNA, 25 bp, Homo sapien
ggttgttgctgttactgtcatcatc

SEQ ID NO: 434178 - DNA, 25 bp, Homo sapien
ttactgtcatcatcaactttaggga

SEQ ID NO: 434179 - DNA, 25 bp, Homo sapien
tttttctacctgattttctttccag

SEQ ID NO: 434180 - DNA, 25 bp, Homo sapien
gaagccataatggatccatgagaca

SEQ ID NO: 434181 - DNA, 25 bp, Homo sapien
atggatccatgagacaaactttggg

SEQ ID NO: 434182 - DNA, 25 bp, Homo sapien
agtaaaagtgaattctggaccatcc

SEQ ID NO: 434183 - DNA, 25 bp, Homo sapien
ttctccttgagttatgcaaaatttc

SEQ ID NO: 434184 - DNA, 25 bp, Homo sapien
gcaaaatttcttcaactaagctgta

SEQ ID NO: 434185 - DNA, 25 bp, Homo sapien
ttcaactaagctgtaaggtcctcgt

SEQ ID NO: 434186 - DNA, 25 bp, Homo sapien
taagctgtaaggtcctcgttggcaa

SEQ ID NO: 434187 - DNA, 25 bp, Homo sapien
tgtaaggtcctcgttggcaagactc

SEQ ID NO: 434188 - DNA, 25 bp, Homo sapien
aaggtcctcgttggcaagactcaag

SEQ ID NO: 434189 - DNA, 25 bp, Homo sapien
gactcaagccatgtgaagaagccat

SEQ ID NO: 434190 - DNA, 25 bp, Homo sapien
tcaagccatgtgaagaagccataat

SEQ ID NO: 434191 - DNA, 25 bp, Homo sapien
gaagagcatcaagggaagattacat

SEQ ID NO: 434192 - DNA, 25 bp, Homo sapien
gggaagattacatacgccttgaaac

SEQ ID NO: 434193 - DNA, 25 bp, Homo sapien
ggaagattacatacgccttgaaacc

SEQ ID NO: 434194 - DNA, 25 bp, Homo sapien
gaagattacatacgccttgaaaccg

SEQ ID NO: 434195 - DNA, 25 bp, Homo sapien
gattacatacgccttgaaaccgaac

SEQ ID NO: 434196 - DNA, 25 bp, Homo sapien
acatacgccttgaaaccgaaccctg

SEQ ID NO: 434197 - DNA, 25 bp, Homo sapien
catacgccttgaaaccgaaccctgc

SEQ ID NO: 434198 - DNA, 25 bp, Homo sapien
gccttgaaaccgaaccctgcctgat

SEQ ID NO: 434199 - DNA, 25 bp, Homo sapien
ccttgaaaccgaaccctgcctgatg

SEQ ID NO: 434200 - DNA, 25 bp, Homo sapien
cttgaaaccgaaccctgcctgatgt

SEQ ID NO: 434201 - DNA, 25 bp, Homo sapien
tgaaaccgaaccctgcctgatgtgg

SEQ ID NO: 434202 - DNA, 25 bp, Homo sapien
aaagaacagtagcaagtgtactccc

SEQ ID NO: 434203 - DNA, 25 bp, Homo sapien
aagaacagtagcaagtgtactcccg

SEQ ID NO: 434204 - DNA, 25 bp, Homo sapien
agaacagtagcaagtgtactcccgg

SEQ ID NO: 434205 - DNA, 25 bp, Homo sapien
gaacagtagcaagtgtactcccggc

SEQ ID NO: 434206 - DNA, 25 bp, Homo sapien
aacagtagcaagtgtactcccggcc

SEQ ID NO: 434207 - DNA, 25 bp, Homo sapien
acagtagcaagtgtactcccggccg

SEQ ID NO: 434208 - DNA, 25 bp, Homo sapien
cagtagcaagtgtactcccggccgg

SEQ ID NO: 434209 - DNA, 25 bp, Homo sapien
agtagcaagtgtactcccggccggg

SEQ ID NO: 434210 - DNA, 25 bp, Homo sapien
tagcaagtgtactcccggccgggcg

SEQ ID NO: 434211 - DNA, 25 bp, Homo sapien
agcaagtgtactcccggccgggcgc

SEQ ID NO: 434212 - DNA, 25 bp, Homo sapien
gcaagtgtactcccggccgggcgcg

SEQ ID NO: 434213 - DNA, 25 bp, Homo sapien
agaagagaggcaccactgctgcctt

SEQ ID NO: 434214 - DNA, 25 bp, Homo sapien
tgctgccttcgcacaggttaacttg

SEQ ID NO: 434215 - DNA, 25 bp, Homo sapien
gctgccttcgcacaggttaacttgg

SEQ ID NO: 434216 - DNA, 25 bp, Homo sapien
ggtcccaagtctgtggctcgcatca

SEQ ID NO: 434217 - DNA, 25 bp, Homo sapien
ccaagtctgtggctcgcatcaccaa

SEQ ID NO: 434218 - DNA, 25 bp, Homo sapien
tctgtggctcgcatcaccaagctaa

SEQ ID NO: 434219 - DNA, 25 bp, Homo sapien
gtggctcgcatcaccaagctaaaaa

SEQ ID NO: 434220 - DNA, 25 bp, Homo sapien
ggctcgcatcaccaagctaaaaaag

SEQ ID NO: 434221 - DNA, 25 bp, Homo sapien
ctcgcatcaccaagctaaaaaaggc

SEQ ID NO: 434222 - DNA, 25 bp, Homo sapien
gggacttctagtccacaagaagaga

SEQ ID NO: 434223 - DNA, 25 bp, Homo sapien
gtccacaagaagagaggcaccactg

SEQ ID NO: 434224 - DNA, 25 bp, Homo sapien
cgatggaatatgagaggagccctct

SEQ ID NO: 434225 - DNA, 25 bp, Homo sapien
gaatatgagaggagccctctggaaa

SEQ ID NO: 434226 - DNA, 25 bp, Homo sapien
aggacagaccctgtgctttcatgaa

SEQ ID NO: 434227 - DNA, 25 bp, Homo sapien
tgaaccagttccacaaggttactgt

SEQ ID NO: 434228 - DNA, 25 bp, Homo sapien
aggttactgtatacatagcctgagt

SEQ ID NO: 434229 - DNA, 25 bp, Homo sapien
actgtatacatagcctgagtttaaa

SEQ ID NO: 434230 - DNA, 25 bp, Homo sapien
gctgtgcccacttcaagaatgtcat

SEQ ID NO: 434231 - DNA, 25 bp, Homo sapien
gtgcccacttcaagaatgtcattgt

SEQ ID NO: 434232 - DNA, 25 bp, Homo sapien
gcccacttcaagaatgtcattgtta

SEQ ID NO: 434233 - DNA, 25 bp, Homo sapien
gaatgtcattgttagactttgaaat

SEQ ID NO: 434234 - DNA, 25 bp, Homo sapien
tttgaaatttctaactgcctacctg

SEQ ID NO: 434235 - DNA, 25 bp, Homo sapien
ctgaccatgggagcccagagtcagg

SEQ ID NO: 434236 - DNA, 25 bp, Homo sapien
catgggagcccagagtcaggtaccg

SEQ ID NO: 434237 - DNA, 25 bp, Homo sapien
gagcccagagtcaggtaccggagct

SEQ ID NO: 434238 - DNA, 25 bp, Homo sapien
cagagtcaggtaccggagctgctcc

SEQ ID NO: 434239 - DNA, 25 bp, Homo sapien
agtcaggtaccggagctgctcctgt

SEQ ID NO: 434240 - DNA, 25 bp, Homo sapien
gtcatgttctcttttgaggccagcg

SEQ ID NO: 434241 - DNA, 25 bp, Homo sapien
tcatgttctcttttgaggccagcgc

SEQ ID NO: 434242 - DNA, 25 bp, Homo sapien
atgttctcttttgaggccagcgccg

SEQ ID NO: 434243 - DNA, 25 bp, Homo sapien
gttctcttttgaggccagcgccgct

SEQ ID NO: 434244 - DNA, 25 bp, Homo sapien
tgggccctggaaccttcctttccag

SEQ ID NO: 434245 - DNA, 25 bp, Homo sapien
aggactgaggcggtcgagcactgtg

SEQ ID NO: 434246 - DNA, 25 bp, Homo sapien
gcagtcgtgcccaggagcagaaacc

SEQ ID NO: 434247 - DNA, 25 bp, Homo sapien
aggcctcgtggtccaggcccagcgg

SEQ ID NO: 434248 - DNA, 25 bp, Homo sapien
aggcgtcgcggcagagccagcggga

SEQ ID NO: 434249 - DNA, 25 bp, Homo sapien
caggtggacctgtttaagcgccgcg

SEQ ID NO: 434250 - DNA, 25 bp, Homo sapien
tggacctgtttaagcgccgcgtggt

SEQ ID NO: 434251 - DNA, 25 bp, Homo sapien
tggtgcggagactggcatccctcaa

SEQ ID NO: 434252 - DNA, 25 bp, Homo sapien
ggagactggcatccctcaagacacg

SEQ ID NO: 434253 - DNA, 25 bp, Homo sapien
tggcatccctcaagacacggcgctg

SEQ ID NO: 434254 - DNA, 25 bp, Homo sapien
aagacacggcgctgccggctgagca

SEQ ID NO: 434255 - DNA, 25 bp, Homo sapien
agatccgggtgctgagacctgtgcg

SEQ ID NO: 434256 - DNA, 25 bp, Homo sapien
acctgtgcggtgtgcctggactact

SEQ ID NO: 434257 - DNA, 25 bp, Homo sapien
atccttactctctgcatctacagga

SEQ ID NO: 434258 - DNA, 25 bp, Homo sapien
ccttactctctgcatctacaggaga

SEQ ID NO: 434259 - DNA, 25 bp, Homo sapien
actctctgcatctacaggagacaga

SEQ ID NO: 434260 - DNA, 25 bp, Homo sapien
acagagtcaccatcagttgtcggat

SEQ ID NO: 434261 - DNA, 25 bp, Homo sapien
gagtcaccatcagttgtcggatgag

SEQ ID NO: 434262 - DNA, 25 bp, Homo sapien
atcagttgtcggatgagtcagggca

SEQ ID NO: 434263 - DNA, 25 bp, Homo sapien
agttgtcggatgagtcagggcatta

SEQ ID NO: 434264 - DNA, 25 bp, Homo sapien
gtcaacagtattatagtttccctcc

SEQ ID NO: 434265 - DNA, 25 bp, Homo sapien
acagtattatagtttccctcccaca

SEQ ID NO: 434266 - DNA, 25 bp, Homo sapien
agtattatagtttccctcccacagt

SEQ ID NO: 434267 - DNA, 25 bp, Homo sapien
attatagtttccctcccacagtgtt

SEQ ID NO: 434268 - DNA, 25 bp, Homo sapien
actggtggctcctgcatgtgcgccg

SEQ ID NO: 434269 - DNA, 25 bp, Homo sapien
ggcgttggagaagtgcaactgctat

SEQ ID NO: 434270 - DNA, 25 bp, Homo sapien
gaagtgcaactgctatgcctgacgt

SEQ ID NO: 434271 - DNA, 25 bp, Homo sapien
gtgcaactgctatgcctgacgtggg

SEQ ID NO: 434272 - DNA, 25 bp, Homo sapien
tatgcctgacgtggggacagctctg

SEQ ID NO: 434273 - DNA, 25 bp, Homo sapien
tgacgtggggacagctctgctccca

SEQ ID NO: 434274 - DNA, 25 bp, Homo sapien
ctctgctcccagatgtaaatagagt

SEQ ID NO: 434275 - DNA, 25 bp, Homo sapien
gtaaatagagtaacctgcacaaacc

SEQ ID NO: 434276 - DNA, 25 bp, Homo sapien
taaatagagtaacctgcacaaacct

SEQ ID NO: 434277 - DNA, 25 bp, Homo sapien
gagtaacctgcacaaacctggattt

SEQ ID NO: 434278 - DNA, 25 bp, Homo sapien
acaacactgagccatttgcttcatt

SEQ ID NO: 434279 - DNA, 25 bp, Homo sapien
gtgaaccttacggtttggaatctgt

SEQ ID NO: 434280 - DNA, 25 bp, Homo sapien
gaatctgtaatctgaatgtaaccca

SEQ ID NO: 434281 - DNA, 25 bp, Homo sapien
tattcttaaattagtactccttggg

SEQ ID NO: 434282 - DNA, 25 bp, Homo sapien
gaattgccagacagccaactcagag

SEQ ID NO: 434283 - DNA, 25 bp, Homo sapien
gccaactcagagtgactggtcaatg

SEQ ID NO: 434284 - DNA, 25 bp, Homo sapien
ggagaacactttgaacgagccatct

SEQ ID NO: 434285 - DNA, 25 bp, Homo sapien
gaacgagccatctttgcaatgccaa

SEQ ID NO: 434286 - DNA, 25 bp, Homo sapien
ttgcaatgccaaaatgtcctcccac

SEQ ID NO: 434287 - DNA, 25 bp, Homo sapien
atgtcctcccacaaggagtatgtta

SEQ ID NO: 434288 - DNA, 25 bp, Homo sapien
tttggaatacccttatcgaatggaa

SEQ ID NO: 434289 - DNA, 25 bp, Homo sapien
aattattgtagtttgtcctaggact

SEQ ID NO: 434290 - DNA, 25 bp, Homo sapien
cttaggcccaggtgccaggtgtcat

SEQ ID NO: 434291 - DNA, 25 bp, Homo sapien
atcttcccaaggatgccattgctgt

SEQ ID NO: 434292 - DNA, 25 bp, Homo sapien
tgccattgctgtcttcatcgtcttc

SEQ ID NO: 434293 - DNA, 25 bp, Homo sapien
ccccgtgtgagacactggttgtctg

SEQ ID NO: 434294 - DNA, 25 bp, Homo sapien
tggttgtctggtactcggcgacagt

SEQ ID NO: 434295 - DNA, 25 bp, Homo sapien
tcggcgacagtgtaccagacgcgca

SEQ ID NO: 434296 - DNA, 25 bp, Homo sapien
agacgcgcaccctatgtgaggtgct

SEQ ID NO: 434297 - DNA, 25 bp, Homo sapien
gtgaggtgctttaaggtccctgtcc

SEQ ID NO: 434298 - DNA, 25 bp, Homo sapien
tgtcctcaggaagcgcagtctggtg

SEQ ID NO: 434299 - DNA, 25 bp, Homo sapien
gagatgagcgctgaacaaatcacta

SEQ ID NO: 434300 - DNA, 25 bp, Homo sapien
aaaacaacaatgtaagcagcacttt

SEQ ID NO: 434301 - DNA, 25 bp, Homo sapien
cctggattcatgattttatgtcaga

SEQ ID NO: 434302 - DNA, 25 bp, Homo sapien
gagtatctgatagagctttcaaaag

SEQ ID NO: 434303 - DNA, 25 bp, Homo sapien
attaatgactgcctctgaaaccttg

SEQ ID NO: 434304 - DNA, 25 bp, Homo sapien
atgactgcctctgaaaccttgacaa

SEQ ID NO: 434305 - DNA, 25 bp, Homo sapien
ctgcctctgaaaccttgacaactaa

SEQ ID NO: 434306 - DNA, 25 bp, Homo sapien
gaaaccttgacaactaattcagatt

SEQ ID NO: 434307 - DNA, 25 bp, Homo sapien
aaaaatcttaactctgctacatggc

SEQ ID NO: 434308 - DNA, 25 bp, Homo sapien
atcttaactctgctacatggctctg

SEQ ID NO: 434309 - DNA, 25 bp, Homo sapien
taactctgctacatggctctgactg

SEQ ID NO: 434310 - DNA, 25 bp, Homo sapien
gctacatggctctgactgctgtggg

SEQ ID NO: 434311 - DNA, 25 bp, Homo sapien
tgttttaacagagttgacttttcaa

SEQ ID NO: 434312 - DNA, 25 bp, Homo sapien
gggcgctgtcaccaagtgctatcga

SEQ ID NO: 434313 - DNA, 25 bp, Homo sapien
aagtgctatcgagacatgggcgccc

SEQ ID NO: 434314 - DNA, 25 bp, Homo sapien
caagaggcccgataccttcttctaa

SEQ ID NO: 434315 - DNA, 25 bp, Homo sapien
aagaggcccgataccttcttctaag

SEQ ID NO: 434316 - DNA, 25 bp, Homo sapien
agaggcccgataccttcttctaagg

SEQ ID NO: 434317 - DNA, 25 bp, Homo sapien
gaggcccgataccttcttctaaggg

SEQ ID NO: 434318 - DNA, 25 bp, Homo sapien
ggcccgataccttcttctaagggca

SEQ ID NO: 434319 - DNA, 25 bp, Homo sapien
gcccgataccttcttctaagggcag

SEQ ID NO: 434320 - DNA, 25 bp, Homo sapien
cccgataccttcttctaagggcagg

SEQ ID NO: 434321 - DNA, 25 bp, Homo sapien
cgataccttcttctaagggcagggc

SEQ ID NO: 434322 - DNA, 25 bp, Homo sapien
gataccttcttctaagggcagggcc

SEQ ID NO: 434323 - DNA, 25 bp, Homo sapien
ggctgctcaactccatgtgggcagt

SEQ ID NO: 434324 - DNA, 25 bp, Homo sapien
tcaactccatgtgggcagtgttcgt

SEQ ID NO: 434325 - DNA, 25 bp, Homo sapien
agtgttcgtggatttgtccgcggtc

SEQ ID NO: 434326 - DNA, 25 bp, Homo sapien
ttgtccgcggtcatcgtgattctgc

SEQ ID NO: 434327 - DNA, 25 bp, Homo sapien
gcggtcatcgtgattctgccctgga

SEQ ID NO: 434328 - DNA, 25 bp, Homo sapien
gattctgccctggaagttctgtgcg

SEQ ID NO: 434329 - DNA, 25 bp, Homo sapien
gaagttctgtgcgtagtttgtcaaa

SEQ ID NO: 434330 - DNA, 25 bp, Homo sapien
gtttgtcaaatcaacgatagggatg

SEQ ID NO: 434331 - DNA, 25 bp, Homo sapien
gatagggatgatccttcccatccac

SEQ ID NO: 434332 - DNA, 25 bp, Homo sapien
gatgactgtggtcccttcgccccag

SEQ ID NO: 434333 - DNA, 25 bp, Homo sapien
ttcgccccagacgtcaatgtagttg

SEQ ID NO: 434334 - DNA, 25 bp, Homo sapien
ctccgtgcttgggacctgctttggg

SEQ ID NO: 434335 - DNA, 25 bp, Homo sapien
gaagtcctcattgtgagtatccggc

SEQ ID NO: 434336 - DNA, 25 bp, Homo sapien
tcattgtgagtatccggccggtggc

SEQ ID NO: 434337 - DNA, 25 bp, Homo sapien
tcgtgggtgcttttcagcggctgcc

SEQ ID NO: 434338 - DNA, 25 bp, Homo sapien
agcggctgcctcagttacgtcaagg

SEQ ID NO: 434339 - DNA, 25 bp, Homo sapien
gctgcctcagttacgtcaaggtgat

SEQ ID NO: 434340 - DNA, 25 bp, Homo sapien
gcctcagttacgtcaaggtgatgct

SEQ ID NO: 434341 - DNA, 25 bp, Homo sapien
tcaaggtgatgctgggcgtggtcct

SEQ ID NO: 434342 - DNA, 25 bp, Homo sapien
tcgctgctcggagcgctgctcatgt

SEQ ID NO: 434343 - DNA, 25 bp, Homo sapien
tgctcatgttccctctggtcaacgt

SEQ ID NO: 434344 - DNA, 25 bp, Homo sapien
ctctggtcaacgtgctgcggctctt

SEQ ID NO: 434345 - DNA, 25 bp, Homo sapien
aagtctcgtagtggtgacggtccat

SEQ ID NO: 434346 - DNA, 25 bp, Homo sapien
tgacggtccatgtttcccatgagga

SEQ ID NO: 434347 - DNA, 25 bp, Homo sapien
tcccatgaggaagtcgaagatcgtc

SEQ ID NO: 434348 - DNA, 25 bp, Homo sapien
ggaagtcgaagatcgtcatgtccat

SEQ ID NO: 434349 - DNA, 25 bp, Homo sapien
atgtccatgacgtccaggatgcggt

SEQ ID NO: 434350 - DNA, 25 bp, Homo sapien
tgtcgtagggcggtgtctgcttcac

SEQ ID NO: 434351 - DNA, 25 bp, Homo sapien
ttcacctcctcgcagtagtcagggt

SEQ ID NO: 434352 - DNA, 25 bp, Homo sapien
tcctcgcagtagtcagggtccacct

SEQ ID NO: 434353 - DNA, 25 bp, Homo sapien
aagagaaacactgcggcagggacct

SEQ ID NO: 434354 - DNA, 25 bp, Homo sapien
gaccttggcgtctgcagatggaccc

SEQ ID NO: 434355 - DNA, 25 bp, Homo sapien
gtctgcagatggacccgcccgggct

SEQ ID NO: 434356 - DNA, 25 bp, Homo sapien
tgaggtcacgctgggacttccagtt

SEQ ID NO: 434357 - DNA, 25 bp, Homo sapien
aggtcacgctgggacttccagttcc

SEQ ID NO: 434358 - DNA, 25 bp, Homo sapien
ggtcacgctgggacttccagttccc

SEQ ID NO: 434359 - DNA, 25 bp, Homo sapien
agatggggtcacaatgctgcagaaa

SEQ ID NO: 434360 - DNA, 25 bp, Homo sapien
ctttggaatgaagatctcccggact

SEQ ID NO: 434361 - DNA, 25 bp, Homo sapien
ttggaatgaagatctcccggacttc

SEQ ID NO: 434362 - DNA, 25 bp, Homo sapien
gaatgaagatctcccggacttcaag

SEQ ID NO: 434363 - DNA, 25 bp, Homo sapien
gaagatctcccggacttcaaggaga

SEQ ID NO: 434364 - DNA, 25 bp, Homo sapien
gatctcccggacttcaaggagattc

SEQ ID NO: 434365 - DNA, 25 bp, Homo sapien
cccggacttcaaggagattcagaaa

SEQ ID NO: 434366 - DNA, 25 bp, Homo sapien
aggagattcagaaaacgtccagtgc

SEQ ID NO: 434367 - DNA, 25 bp, Homo sapien
gctcagtaaatgatagttctcttat

SEQ ID NO: 434368 - DNA, 25 bp, Homo sapien
gatagttctcttatctttcccacta

SEQ ID NO: 434369 - DNA, 25 bp, Homo sapien
tctcttatctttcccactattattg

SEQ ID NO: 434370 - DNA, 25 bp, Homo sapien
tatctttcccactattattggtttt

SEQ ID NO: 434371 - DNA, 25 bp, Homo sapien
agaatggtgtagacaggttttcctt

SEQ ID NO: 434372 - DNA, 25 bp, Homo sapien
ggttttccttaaatggcctctgttg

SEQ ID NO: 434373 - DNA, 25 bp, Homo sapien
tccttaaatggcctctgttgttctc

SEQ ID NO: 434374 - DNA, 25 bp, Homo sapien
taaatggcctctgttgttctccttt

SEQ ID NO: 434375 - DNA, 25 bp, Homo sapien
gttctcctttctcccaaaatattca

SEQ ID NO: 434376 - DNA, 25 bp, Homo sapien
cataataagaccctcatgtcttaaa

SEQ ID NO: 434377 - DNA, 25 bp, Homo sapien
gtgtattatatatgctcagtaaatg

SEQ ID NO: 434378 - DNA, 25 bp, Homo sapien
agaagggaggagttactcatctctt

SEQ ID NO: 434379 - DNA, 25 bp, Homo sapien
tactcatctcttcaagctttcagac

SEQ ID NO: 434380 - DNA, 25 bp, Homo sapien
gaatctttcattcctgtctatttgg

SEQ ID NO: 434381 - DNA, 25 bp, Homo sapien
actacttcaggcgtgacttaggggt

SEQ ID NO: 434382 - DNA, 25 bp, Homo sapien
atcgtgtcgttgtagcaggagcata

SEQ ID NO: 434383 - DNA, 25 bp, Homo sapien
aggagcatagtctgaattgtctggt

SEQ ID NO: 434384 - DNA, 25 bp, Homo sapien
gcatagtctgaattgtctggtggct

SEQ ID NO: 434385 - DNA, 25 bp, Homo sapien
gtctgaattgtctggtggctaactg

SEQ ID NO: 434386 - DNA, 25 bp, Homo sapien
gaattgtctggtggctaactgtagt

SEQ ID NO: 434387 - DNA, 25 bp, Homo sapien
tctggtggctaactgtagtttcaat

SEQ ID NO: 434388 - DNA, 25 bp, Homo sapien
ggtggctaactgtagtttcaataag

SEQ ID NO: 434389 - DNA, 25 bp, Homo sapien
gaggcgcacggcattacctggtacc

SEQ ID NO: 434390 - DNA, 25 bp, Homo sapien
ttcctgcagcacagagcccttggga

SEQ ID NO: 434391 - DNA, 25 bp, Homo sapien
gtcatcagggattcagaataggcct

SEQ ID NO: 434392 - DNA, 25 bp, Homo sapien
ggcctccttatcctttgagcccttt

SEQ ID NO: 434393 - DNA, 25 bp, Homo sapien
tgagccctttttactactactccaa

SEQ ID NO: 434394 - DNA, 25 bp, Homo sapien
atttctcctagaagataaccaagct

SEQ ID NO: 434395 - DNA, 25 bp, Homo sapien
atagttgacgttgaagccacataaa

SEQ ID NO: 434396 - DNA, 25 bp, Homo sapien
tacacaaatatgcatcttcagtctg

SEQ ID NO: 434397 - DNA, 25 bp, Homo sapien
atcttcagtctgtaagccgccagca

SEQ ID NO: 434398 - DNA, 25 bp, Homo sapien
taagccgccagcattctacttgata

SEQ ID NO: 434399 - DNA, 25 bp, Homo sapien
gccagcattctacttgatatgggag

SEQ ID NO: 434400 - DNA, 25 bp, Homo sapien
gctgggcctgtcactggcataggaa

SEQ ID NO: 434401 - DNA, 25 bp, Homo sapien
tgccaacagctgaagccgagcacag

SEQ ID NO: 434402 - DNA, 25 bp, Homo sapien
tccctttgcacgctggaacagttac

SEQ ID NO: 434403 - DNA, 25 bp, Homo sapien
gaacagttactcacctgtggcttct

SEQ ID NO: 434404 - DNA, 25 bp, Homo sapien
acattcttgtgcacgcgggcatttg

SEQ ID NO: 434405 - DNA, 25 bp, Homo sapien
gcatttgcaggcacgctctcgcgta

SEQ ID NO: 434406 - DNA, 25 bp, Homo sapien
gctctcgcgtagttacctatctgaa

SEQ ID NO: 434407 - DNA, 25 bp, Homo sapien
agttacctatctgaatgcacaccaa

SEQ ID NO: 434408 - DNA, 25 bp, Homo sapien
actctgcgtctgtgattcatttcat

SEQ ID NO: 434409 - DNA, 25 bp, Homo sapien
ttcatgtagtggtctaagctcctcc

SEQ ID NO: 434410 - DNA, 25 bp, Homo sapien
ctcccagggctgtgtggatctgaca

SEQ ID NO: 434411 - DNA, 25 bp, Homo sapien
ttgataaagcatcatgttccctttg

SEQ ID NO: 434412 - DNA, 25 bp, Homo sapien
aaagcatcatgttccctttgattat

SEQ ID NO: 434413 - DNA, 25 bp, Homo sapien
gcatcatgttccctttgattatccc

SEQ ID NO: 434414 - DNA, 25 bp, Homo sapien
atcatgttccctttgattatcccct

SEQ ID NO: 434415 - DNA, 25 bp, Homo sapien
taaccaacactcaactacaaatagg

SEQ ID NO: 434416 - DNA, 25 bp, Homo sapien
acactcaactacaaataggctggga

SEQ ID NO: 434417 - DNA, 25 bp, Homo sapien
actacaaataggctgggattcaatg

SEQ ID NO: 434418 - DNA, 25 bp, Homo sapien
aaataggctgggattcaatgtggag

SEQ ID NO: 434419 - DNA, 25 bp, Homo sapien
ttcaatgtggagtggtggatttcct

SEQ ID NO: 434420 - DNA, 25 bp, Homo sapien
atgtggagtggtggatttcctgaaa

SEQ ID NO: 434421 - DNA, 25 bp, Homo sapien
ctgaaagaaagtagtgcagatattt

SEQ ID NO: 434422 - DNA, 25 bp, Homo sapien
atcacttggatgtgcaagttgccag

SEQ ID NO: 434423 - DNA, 25 bp, Homo sapien
ttgccagagtggacagggtcgccac

SEQ ID NO: 434424 - DNA, 25 bp, Homo sapien
acagggtcgccaccatcagaggcaa

SEQ ID NO: 434425 - DNA, 25 bp, Homo sapien
ccatcagaggcaaccaggacaagct

SEQ ID NO: 434426 - DNA, 25 bp, Homo sapien
tttttctcacggtccagggcccgct

SEQ ID NO: 434427 - DNA, 25 bp, Homo sapien
cagcaccagctctggatacttggcc

SEQ ID NO: 434428 - DNA, 25 bp, Homo sapien
gagacgctattcacagccagagaga

SEQ ID NO: 434429 - DNA, 25 bp, Homo sapien
ttctgcagggagttaatgcctacat

SEQ ID NO: 434430 - DNA, 25 bp, Homo sapien
taatgcctacatctgggtcaaaagc

SEQ ID NO: 434431 - DNA, 25 bp, Homo sapien
ttccaggaaccgttagttcaccaat

SEQ ID NO: 434432 - DNA, 25 bp, Homo sapien
ttttatttccaattcctcagacaca

SEQ ID NO: 434433 - DNA, 25 bp, Homo sapien
aaattcaaattgcaggccggcacgt

SEQ ID NO: 434434 - DNA, 25 bp, Homo sapien
aattcaaattgcaggccggcacgtg

SEQ ID NO: 434435 - DNA, 25 bp, Homo sapien
attcaaattgcaggccggcacgtgg

SEQ ID NO: 434436 - DNA, 25 bp, Homo sapien
ttcaaattgcaggccggcacgtggc

SEQ ID NO: 434437 - DNA, 25 bp, Homo sapien
tcaaattgcaggccggcacgtggct

SEQ ID NO: 434438 - DNA, 25 bp, Homo sapien
caaattgcaggccggcacgtggctc

SEQ ID NO: 434439 - DNA, 25 bp, Homo sapien
gctgaaatcgtcccactgcacccag

SEQ ID NO: 434440 - DNA, 25 bp, Homo sapien
ctgaaatcgtcccactgcacccagc

SEQ ID NO: 434441 - DNA, 25 bp, Homo sapien
aaaaccttcacttctcataagggtg

SEQ ID NO: 434442 - DNA, 25 bp, Homo sapien
cacttctcataagggtgatgctacc

SEQ ID NO: 434443 - DNA, 25 bp, Homo sapien
cggcttgcttcacctggaattagag

SEQ ID NO: 434444 - DNA, 25 bp, Homo sapien
gagaatattaactcgcttcaaacaa

SEQ ID NO: 434445 - DNA, 25 bp, Homo sapien
aaatagtcattttgccgacatttca

SEQ ID NO: 434446 - DNA, 25 bp, Homo sapien
gccgacatttcataaaatcgccagt

SEQ ID NO: 434447 - DNA, 25 bp, Homo sapien
cagttttaagctcagttcagaggct

SEQ ID NO: 434448 - DNA, 25 bp, Homo sapien
agacctagtaaagtgcctccattca

SEQ ID NO: 434449 - DNA, 25 bp, Homo sapien
gtaaagtgcctccattcataaaatg

SEQ ID NO: 434450 - DNA, 25 bp, Homo sapien
gacaatttcatactgatgcgcatct

SEQ ID NO: 434451 - DNA, 25 bp, Homo sapien
gcgcatctaaaataggtcgacgtat

SEQ ID NO: 434452 - DNA, 25 bp, Homo sapien
atgttctaaaatccacccaggcatg

SEQ ID NO: 434453 - DNA, 25 bp, Homo sapien
gactgtgtttcctcccgatgatggc

SEQ ID NO: 434454 - DNA, 25 bp, Homo sapien
atgatggccaggaggctccctgttc

SEQ ID NO: 434455 - DNA, 25 bp, Homo sapien
aggtgggacccagttggctgccttc

SEQ ID NO: 434456 - DNA, 25 bp, Homo sapien
gagaacagcaccaggatgtctcctt

SEQ ID NO: 434457 - DNA, 25 bp, Homo sapien
tctccttcatcatcagcttgggcaa

SEQ ID NO: 434458 - DNA, 25 bp, Homo sapien
atcagcttgggcaaagttaggtcca

SEQ ID NO: 434459 - DNA, 25 bp, Homo sapien
taggtccaacccctttgtcaaattg

SEQ ID NO: 434460 - DNA, 25 bp, Homo sapien
cccctttgtcaaattgtcctgttgg

SEQ ID NO: 434461 - DNA, 25 bp, Homo sapien
agaaaaggatgcagatgtcttcctc

SEQ ID NO: 434462 - DNA, 25 bp, Homo sapien
atcagagcaggtttgttaaccttca

SEQ ID NO: 434463 - DNA, 25 bp, Homo sapien
cctggcctgcctattagcgatgttg

SEQ ID NO: 434464 - DNA, 25 bp, Homo sapien
ctggcctgcctattagcgatgttgc

SEQ ID NO: 434465 - DNA, 25 bp, Homo sapien
tggcctgcctattagcgatgttgca

SEQ ID NO: 434466 - DNA, 25 bp, Homo sapien
ggcctgcctattagcgatgttgcaa

SEQ ID NO: 434467 - DNA, 25 bp, Homo sapien
gcctgcctattagcgatgttgcaaa

SEQ ID NO: 434468 - DNA, 25 bp, Homo sapien
ctgcctattagcgatgttgcaaaga

SEQ ID NO: 434469 - DNA, 25 bp, Homo sapien
tgcctattagcgatgttgcaaagaa

SEQ ID NO: 434470 - DNA, 25 bp, Homo sapien
gcctattagcgatgttgcaaagaaa

SEQ ID NO: 434471 - DNA, 25 bp, Homo sapien
ctattagcgatgttgcaaagaaact

SEQ ID NO: 434472 - DNA, 25 bp, Homo sapien
aatacaaaaaggatacagctacata

SEQ ID NO: 434473 - DNA, 25 bp, Homo sapien
aaaaaggatacagctacatatcgag

SEQ ID NO: 434474 - DNA, 25 bp, Homo sapien
aagccactcagtctatggtacattg

SEQ ID NO: 434475 - DNA, 25 bp, Homo sapien
tggtacattgttatagtagcctata

SEQ ID NO: 434476 - DNA, 25 bp, Homo sapien
ttttgattcttccttccgtctgttc

SEQ ID NO: 434477 - DNA, 25 bp, Homo sapien
aaataagttactcccttcatgccat

SEQ ID NO: 434478 - DNA, 25 bp, Homo sapien
ttcatgccatatcccacatcacttg

SEQ ID NO: 434479 - DNA, 25 bp, Homo sapien
atatcccacatcacttgcttgtata

SEQ ID NO: 434480 - DNA, 25 bp, Homo sapien
atcacttgcttgtataccgtgtaaa

SEQ ID NO: 434481 - DNA, 25 bp, Homo sapien
attttatatatacctgcctggcatc

SEQ ID NO: 434482 - DNA, 25 bp, Homo sapien
gcctggcatcagtttgtgctgattt

SEQ ID NO: 434483 - DNA, 25 bp, Homo sapien
cagtttgtgctgattttgtaaattt

SEQ ID NO: 434484 - DNA, 25 bp, Homo sapien
tatggcacatatcttaataactttt

SEQ ID NO: 434485 - DNA, 25 bp, Homo sapien
tgccctgcacgctggtgacgagctg

SEQ ID NO: 434486 - DNA, 25 bp, Homo sapien
catggtcctgaaggtgcccaggctg

SEQ ID NO: 434487 - DNA, 25 bp, Homo sapien
tccctcctgggtttcggagacattt

SEQ ID NO: 434488 - DNA, 25 bp, Homo sapien
gagacattttggtgccagggctgct

SEQ ID NO: 434489 - DNA, 25 bp, Homo sapien
gtggcctactgccacaggtttgaca

SEQ ID NO: 434490 - DNA, 25 bp, Homo sapien
aggtttgacatccaggtacagtcct

SEQ ID NO: 434491 - DNA, 25 bp, Homo sapien
aggtacagtcctccagggtatactt

SEQ ID NO: 434492 - DNA, 25 bp, Homo sapien
agggtatacttcgtggcctgcacca

SEQ ID NO: 434493 - DNA, 25 bp, Homo sapien
tatggcgttggcctccttgtgacat

SEQ ID NO: 434494 - DNA, 25 bp, Homo sapien
tggcctccttgtgacattcgtggca

SEQ ID NO: 434495 - DNA, 25 bp, Homo sapien
attcgtggcactggccctgatgcag

SEQ ID NO: 434496 - DNA, 25 bp, Homo sapien
gacgtgtctgtgtgtggaagtttta

SEQ ID NO: 434497 - DNA, 25 bp, Homo sapien
gtgtgtggaagttttatccggtcct

SEQ ID NO: 434498 - DNA, 25 bp, Homo sapien
aagttttatccggtccttcactgag

SEQ ID NO: 434499 - DNA, 25 bp, Homo sapien
cttcactgagtgtgggccaggcctg

SEQ ID NO: 434500 - DNA, 25 bp, Homo sapien
agaaggatgatcaacttcccaaaat

SEQ ID NO: 434501 - DNA, 25 bp, Homo sapien
ttcccaaaataggttgtgtctcagg

SEQ ID NO: 434502 - DNA, 25 bp, Homo sapien
gtgtctcaggaaagcataacattgc

SEQ ID NO: 434503 - DNA, 25 bp, Homo sapien
acattgctttaggttttaagatagc

SEQ ID NO: 434504 - DNA, 25 bp, Homo sapien
tcaaactttgtccctactttattct

SEQ ID NO: 434505 - DNA, 25 bp, Homo sapien
caaccgccaggtcacggactggtac

SEQ ID NO: 434506 - DNA, 25 bp, Homo sapien
tcacggactggtaccggtccatggt

SEQ ID NO: 434507 - DNA, 25 bp, Homo sapien
tcccccacccggcacctggtggcac

SEQ ID NO: 434508 - DNA, 25 bp, Homo sapien
ccccacccggcacctggtggcaccg

SEQ ID NO: 434509 - DNA, 25 bp, Homo sapien
cccacccggcacctggtggcaccgg

SEQ ID NO: 434510 - DNA, 25 bp, Homo sapien
ccacccggcacctggtggcaccggg

SEQ ID NO: 434511 - DNA, 25 bp, Homo sapien
cacccggcacctggtggcaccgggc

SEQ ID NO: 434512 - DNA, 25 bp, Homo sapien
cccggcacctggtggcaccgggcca

SEQ ID NO: 434513 - DNA, 25 bp, Homo sapien
ccggcacctggtggcaccgggccag

SEQ ID NO: 434514 - DNA, 25 bp, Homo sapien
ggcacctggtggcaccgggccaggc

SEQ ID NO: 434515 - DNA, 25 bp, Homo sapien
gcacctggtggcaccgggccaggcc

SEQ ID NO: 434516 - DNA, 25 bp, Homo sapien
cacctggtggcaccgggccaggccc

SEQ ID NO: 434517 - DNA, 25 bp, Homo sapien
gcaccgggccaggcccaggcgggtg

SEQ ID NO: 434518 - DNA, 25 bp, Homo sapien
tgagaacattccaatagagacagag

SEQ ID NO: 434519 - DNA, 25 bp, Homo sapien
caacagagccaacagaacggtgaag

SEQ ID NO: 434520 - DNA, 25 bp, Homo sapien
gaagaaggcaaatctactgaggaca

SEQ ID NO: 434521 - DNA, 25 bp, Homo sapien
aggcaaatctactgaggacaaggag

SEQ ID NO: 434522 - DNA, 25 bp, Homo sapien
aaccagtgacagtaacattggctca

SEQ ID NO: 434523 - DNA, 25 bp, Homo sapien
gacagtaacattggctcagagagaa

SEQ ID NO: 434524 - DNA, 25 bp, Homo sapien
cagagagaaatggtgcaacagtgga

SEQ ID NO: 434525 - DNA, 25 bp, Homo sapien
aaggaggcagcagagcaagtttagt

SEQ ID NO: 434526 - DNA, 25 bp, Homo sapien
gagcaagtttagtgcagtgagagca

SEQ ID NO: 434527 - DNA, 25 bp, Homo sapien
tgcagtgagagcagcatcattcctg

SEQ ID NO: 434528 - DNA, 25 bp, Homo sapien
agccagtggccaacaaaggcgagga

SEQ ID NO: 434529 - DNA, 25 bp, Homo sapien
ggaatttatggacaacacgagccgc

SEQ ID NO: 434530 - DNA, 25 bp, Homo sapien
gaatttatggacaacacgagccgct

SEQ ID NO: 434531 - DNA, 25 bp, Homo sapien
aatttatggacaacacgagccgctc

SEQ ID NO: 434532 - DNA, 25 bp, Homo sapien
atttatggacaacacgagccgctcc

SEQ ID NO: 434533 - DNA, 25 bp, Homo sapien
tttatggacaacacgagccgctcca

SEQ ID NO: 434534 - DNA, 25 bp, Homo sapien
ttatggacaacacgagccgctccag

SEQ ID NO: 434535 - DNA, 25 bp, Homo sapien
atggacaacacgagccgctccagca

SEQ ID NO: 434536 - DNA, 25 bp, Homo sapien
agccgctccagcatccgcagtgtaa

SEQ ID NO: 434537 - DNA, 25 bp, Homo sapien
ccgctccagcatccgcagtgtaaaa

SEQ ID NO: 434538 - DNA, 25 bp, Homo sapien
ctccagcatccgcagtgtaaaaggc

SEQ ID NO: 434539 - DNA, 25 bp, Homo sapien
tgagggggacgtgctcaccctgttg

SEQ ID NO: 434540 - DNA, 25 bp, Homo sapien
cccgtttgtgatcgccccctgtgat

SEQ ID NO: 434541 - DNA, 25 bp, Homo sapien
tgtgatcgccccctgtgatggccct

SEQ ID NO: 434542 - DNA, 25 bp, Homo sapien
gatcgccccctgtgatggccctggg

SEQ ID NO: 434543 - DNA, 25 bp, Homo sapien
cagaccggcgcgtccccggtggcct

SEQ ID NO: 434544 - DNA, 25 bp, Homo sapien
tccccggtggcctcagcggcgcagc

SEQ ID NO: 434545 - DNA, 25 bp, Homo sapien
gcctcagcggcgcagctcctggaca

SEQ ID NO: 434546 - DNA, 25 bp, Homo sapien
agcggcgcagctcctggacacacac

SEQ ID NO: 434547 - DNA, 25 bp, Homo sapien
ggcgcagctcctggacacacacctg

SEQ ID NO: 434548 - DNA, 25 bp, Homo sapien
acacacctgcacattggcaccggcc

SEQ ID NO: 434549 - DNA, 25 bp, Homo sapien
gctggccccaggttgtgagcccctg

SEQ ID NO: 434550 - DNA, 25 bp, Homo sapien
ctggccccaggttgtgagcccctgg

SEQ ID NO: 434551 - DNA, 25 bp, Homo sapien
tggccagctggccttttcattgttg

SEQ ID NO: 434552 - DNA, 25 bp, Homo sapien
ggccagctggccttttcattgttga

SEQ ID NO: 434553 - DNA, 25 bp, Homo sapien
gccagctggccttttcattgttgat

SEQ ID NO: 434554 - DNA, 25 bp, Homo sapien
ccagctggccttttcattgttgatt

SEQ ID NO: 434555 - DNA, 25 bp, Homo sapien
tttattgagtaagcccttgctcagt

SEQ ID NO: 434556 - DNA, 25 bp, Homo sapien
attgagtaagcccttgctcagtaaa

SEQ ID NO: 434557 - DNA, 25 bp, Homo sapien
ttgagtaagcccttgctcagtaaat

SEQ ID NO: 434558 - DNA, 25 bp, Homo sapien
gagtaagcccttgctcagtaaattt

SEQ ID NO: 434559 - DNA, 25 bp, Homo sapien
agtaagcccttgctcagtaaattta

SEQ ID NO: 434560 - DNA, 25 bp, Homo sapien
gtaagcccttgctcagtaaatttaa

SEQ ID NO: 434561 - DNA, 25 bp, Homo sapien
taagcccttgctcagtaaatttaat

SEQ ID NO: 434562 - DNA, 25 bp, Homo sapien
tggctgttcccctttccgggagatg

SEQ ID NO: 434563 - DNA, 25 bp, Homo sapien
ggagatgcggctgagttccctttcc

SEQ ID NO: 434564 - DNA, 25 bp, Homo sapien
tctccttgaaggttgggtagactta

SEQ ID NO: 434565 - DNA, 25 bp, Homo sapien
ggtagacttagtgctctgcttctaa

SEQ ID NO: 434566 - DNA, 25 bp, Homo sapien
ttaagcaagcactaccggaactaag

SEQ ID NO: 434567 - DNA, 25 bp, Homo sapien
ggttaacatctccagtaatggcatg

SEQ ID NO: 434568 - DNA, 25 bp, Homo sapien
gtaatggcatgtggctacctatcaa

SEQ ID NO: 434569 - DNA, 25 bp, Homo sapien
tggctacctatcaaaaacccctgat

SEQ ID NO: 434570 - DNA, 25 bp, Homo sapien
gataagaaggacacatcacctctag

SEQ ID NO: 434571 - DNA, 25 bp, Homo sapien
tcacctctagggtagtctttcaaaa

SEQ ID NO: 434572 - DNA, 25 bp, Homo sapien
acacccctaatttgagcctaattat

SEQ ID NO: 434573 - DNA, 25 bp, Homo sapien
actattgtgatgttctgagaggtaa

SEQ ID NO: 434574 - DNA, 25 bp, Homo sapien
aagggaaattgccaggttcctgtga

SEQ ID NO: 434575 - DNA, 25 bp, Homo sapien
aaattgccaggttcctgtgactttg

SEQ ID NO: 434576 - DNA, 25 bp, Homo sapien
gactttgaaaggactgaggaagcag

SEQ ID NO: 434577 - DNA, 25 bp, Homo sapien
gggacttcactgaaactgactgcat

SEQ ID NO: 434578 - DNA, 25 bp, Homo sapien
cactgaaactgactgcatcttgcaa

SEQ ID NO: 434579 - DNA, 25 bp, Homo sapien
gcatcttgcaattttctttttcgaa

SEQ ID NO: 434580 - DNA, 25 bp, Homo sapien
gcaattttctttttcgaattggcag

SEQ ID NO: 434581 - DNA, 25 bp, Homo sapien
atattgtatttccatcgattgaaga

SEQ ID NO: 434582 - DNA, 25 bp, Homo sapien
gaaaaacaagtgtctggtaattaat

SEQ ID NO: 434583 - DNA, 25 bp, Homo sapien
ataatctgtcagttgtggaatgtaa

SEQ ID NO: 434584 - DNA, 25 bp, Homo sapien
gagcaactttaactcctggagccag

SEQ ID NO: 434585 - DNA, 25 bp, Homo sapien
ctggagccaggtttatcatggtgct

SEQ ID NO: 434586 - DNA, 25 bp, Homo sapien
aacaagacgaaatcctgctcggcag

SEQ ID NO: 434587 - DNA, 25 bp, Homo sapien
aatcctgctcggcagtacctgagat

SEQ ID NO: 434588 - DNA, 25 bp, Homo sapien
gcagtacctgagatggccaagcaat

SEQ ID NO: 434589 - DNA, 25 bp, Homo sapien
ggccaagcaattcttcaggcctggg

SEQ ID NO: 434590 - DNA, 25 bp, Homo sapien
caagtcactcgcagcagctctgggt

SEQ ID NO: 434591 - DNA, 25 bp, Homo sapien
aggtacggatactgggcactggact

SEQ ID NO: 434592 - DNA, 25 bp, Homo sapien
gactgagctcacaggatggcagaga

SEQ ID NO: 434593 - DNA, 25 bp, Homo sapien
agaagacaaagacgcccatctgagc

SEQ ID NO: 434594 - DNA, 25 bp, Homo sapien
catctgagccaaggctggcaatgct

SEQ ID NO: 434595 - DNA, 25 bp, Homo sapien
gaacttacagcctagagggggatac

SEQ ID NO: 434596 - DNA, 25 bp, Homo sapien
aataaggaatatcacaacatttaaa

SEQ ID NO: 434597 - DNA, 25 bp, Homo sapien
aaatatctctattcctttatgtttc

SEQ ID NO: 434598 - DNA, 25 bp, Homo sapien
aatatctctattcctttatgtttct

SEQ ID NO: 434599 - DNA, 25 bp, Homo sapien
ttcttgatagaatgtagcctaacta

SEQ ID NO: 434600 - DNA, 25 bp, Homo sapien
gaatgtagcctaactatataactat

SEQ ID NO: 434601 - DNA, 25 bp, Homo sapien
gtagcctaactatataactatctgg

SEQ ID NO: 434602 - DNA, 25 bp, Homo sapien
gcctaactatataactatctggtca

SEQ ID NO: 434603 - DNA, 25 bp, Homo sapien
taactatataactatctggtcagat

SEQ ID NO: 434604 - DNA, 25 bp, Homo sapien
ctatctggtcagattattttggcca

SEQ ID NO: 434605 - DNA, 25 bp, Homo sapien
ctcttgactacacaatttccgttaa

SEQ ID NO: 434606 - DNA, 25 bp, Homo sapien
agagttttcctctgagattgcttcc

SEQ ID NO: 434607 - DNA, 25 bp, Homo sapien
gcttccctttcctttgtattttcat

SEQ ID NO: 434608 - DNA, 25 bp, Homo sapien
tcatttttccctcttgggctttact

SEQ ID NO: 434609 - DNA, 25 bp, Homo sapien
tgggctttacttttcagtcgtgtat

SEQ ID NO: 434610 - DNA, 25 bp, Homo sapien
cttttcagtcgtgtatttctatccc

SEQ ID NO: 434611 - DNA, 25 bp, Homo sapien
gtatttctatcccaatgttaattta

SEQ ID NO: 434612 - DNA, 25 bp, Homo sapien
atattttcctgtccttcaattcatc

SEQ ID NO: 434613 - DNA, 25 bp, Homo sapien
tgtccttcaattcatcagtagatta

SEQ ID NO: 434614 - DNA, 25 bp, Homo sapien
gattagtgaagtacttattccttta

SEQ ID NO: 434615 - DNA, 25 bp, Homo sapien
aatttctttttggataacgatacat

SEQ ID NO: 434616 - DNA, 25 bp, Homo sapien
gtttcttaatagcttttctctacca

SEQ ID NO: 434617 - DNA, 25 bp, Homo sapien
cccgtttgtgatcgccccctgtgat

SEQ ID NO: 434618 - DNA, 25 bp, Homo sapien
gatcgccccctgtgatggccctggg

SEQ ID NO: 434619 - DNA, 25 bp, Homo sapien
cagaccggcgcgtccccggtggcct

SEQ ID NO: 434620 - DNA, 25 bp, Homo sapien
tccccggtggcctcagcggcgcagc

SEQ ID NO: 434621 - DNA, 25 bp, Homo sapien
tcagcggcgcagctcctggacacac

SEQ ID NO: 434622 - DNA, 25 bp, Homo sapien
ggcgcagctcctggacacacacctg

SEQ ID NO: 434623 - DNA, 25 bp, Homo sapien
acacacctgcacattggcaccggcc

SEQ ID NO: 434624 - DNA, 25 bp, Homo sapien
caggctggccccaggttgtgagccc

SEQ ID NO: 434625 - DNA, 25 bp, Homo sapien
gctggccccaggttgtgagcccctg

SEQ ID NO: 434626 - DNA, 25 bp, Homo sapien
ctggccccaggttgtgagcccctgg

SEQ ID NO: 434627 - DNA, 25 bp, Homo sapien
gggactgtgagatggaggacctgat

SEQ ID NO: 434628 - DNA, 25 bp, Homo sapien
gcctccagggtgttccactgcagga

SEQ ID NO: 434629 - DNA, 25 bp, Homo sapien
tccactgcaggaaggcggtgttgat

SEQ ID NO: 434630 - DNA, 25 bp, Homo sapien
cggtgttgatggacttgtcgactga

SEQ ID NO: 434631 - DNA, 25 bp, Homo sapien
tgtcgactgagatggagacctggcc

SEQ ID NO: 434632 - DNA, 25 bp, Homo sapien
acgggctgtatctggtgtcagagtc

SEQ ID NO: 434633 - DNA, 25 bp, Homo sapien
gtgtcagagtcaccaggatagatga

SEQ ID NO: 434634 - DNA, 25 bp, Homo sapien
aggatagatgatccccatccactcc

SEQ ID NO: 434635 - DNA, 25 bp, Homo sapien
acccagccgatccagtagtcggaaa

SEQ ID NO: 434636 - DNA, 25 bp, Homo sapien
acttataataagtccccgaatcata

SEQ ID NO: 434637 - DNA, 25 bp, Homo sapien
atcataataataccctctcgcacag

SEQ ID NO: 434638 - DNA, 25 bp, Homo sapien
aatacatggcggtgtccgaagcctc

SEQ ID NO: 434639 - DNA, 25 bp, Homo sapien
tacccaggatggagtaggcggcggc

SEQ ID NO: 434640 - DNA, 25 bp, Homo sapien
gccctggtgtccatccggaaggcta

SEQ ID NO: 434641 - DNA, 25 bp, Homo sapien
cctggtgtccatccggaaggctatg

SEQ ID NO: 434642 - DNA, 25 bp, Homo sapien
ccatccggaaggctatggacaactt

SEQ ID NO: 434643 - DNA, 25 bp, Homo sapien
gaaggctatggacaacttccatgca

SEQ ID NO: 434644 - DNA, 25 bp, Homo sapien
ggacaacttccatgcagagctccat

SEQ ID NO: 434645 - DNA, 25 bp, Homo sapien
cacggtggaggtcccaccacaatgt

SEQ ID NO: 434646 - DNA, 25 bp, Homo sapien
aggtcccaccacaatgtcctggagg

SEQ ID NO: 434647 - DNA, 25 bp, Homo sapien
ccaccacaatgtcctggagggcggc

SEQ ID NO: 434648 - DNA, 25 bp, Homo sapien
gacccgcgaggacgtcctaaaagag

SEQ ID NO: 434649 - DNA, 25 bp, Homo sapien
cactccgggctgtcctccgaaagac

SEQ ID NO: 434650 - DNA, 25 bp, Homo sapien
ggacaggaagtgatcagtaccccaa

SEQ ID NO: 434651 - DNA, 25 bp, Homo sapien
gatcagtaccccaactagcaagagt

SEQ ID NO: 434652 - DNA, 25 bp, Homo sapien
actagcaagagtggcccgttcattg

SEQ ID NO: 434653 - DNA, 25 bp, Homo sapien
cgttcattggccgaggttcttgagg

SEQ ID NO: 434654 - DNA, 25 bp, Homo sapien
gaggaagacacacgaaggctactgt

SEQ ID NO: 434655 - DNA, 25 bp, Homo sapien
cgtgggtctggagccaagcgtatct

SEQ ID NO: 434656 - DNA, 25 bp, Homo sapien
tggagccaagcgtatctctctgtac

SEQ ID NO: 434657 - DNA, 25 bp, Homo sapien
tgtacccatcgcacacgaatttgaa

SEQ ID NO: 434658 - DNA, 25 bp, Homo sapien
cgaatttgaatcatctgctctttgg

SEQ ID NO: 434659 - DNA, 25 bp, Homo sapien
atcatctgctctttggaatcgccta

SEQ ID NO: 434660 - DNA, 25 bp, Homo sapien
ttggaatcgcctacaccctgctgca

SEQ ID NO: 434661 - DNA, 25 bp, Homo sapien
ttttgctctaccatccaacacctag

SEQ ID NO: 434662 - DNA, 25 bp, Homo sapien
acctagccagactcgatttgcagct

SEQ ID NO: 434663 - DNA, 25 bp, Homo sapien
gactcgatttgcagctcagttgact

SEQ ID NO: 434664 - DNA, 25 bp, Homo sapien
tttgcagctcagttgactgaagcaa

SEQ ID NO: 434665 - DNA, 25 bp, Homo sapien
gcaaaatacaacagctcaaagaata

SEQ ID NO: 434666 - DNA, 25 bp, Homo sapien
ctgcctgaagggatttatgaccctg

SEQ ID NO: 434667 - DNA, 25 bp, Homo sapien
gaccctggaagagatagatcagatc

SEQ ID NO: 434668 - DNA, 25 bp, Homo sapien
gggacctgattcagtttctgccatg

SEQ ID NO: 434669 - DNA, 25 bp, Homo sapien
acctgattcagtttctgccatgcat

SEQ ID NO: 434670 - DNA, 25 bp, Homo sapien
tctgccatgcatgcacatttatcat

SEQ ID NO: 434671 - DNA, 25 bp, Homo sapien
gcatgcacatttatcatgaggatta

SEQ ID NO: 434672 - DNA, 25 bp, Homo sapien
ctgtggctatgttctgggtttccaa

SEQ ID NO: 434673 - DNA, 25 bp, Homo sapien
tgttctgggtttccaatcaggccga

SEQ ID NO: 434674 - DNA, 25 bp, Homo sapien
caatcaggccgagtggtttgaggac

SEQ ID NO: 434675 - DNA, 25 bp, Homo sapien
gaggacgatgtcatacagcgcaaga

SEQ ID NO: 434676 - DNA, 25 bp, Homo sapien
gtggccacctgagaagcttcaagag

SEQ ID NO: 434677 - DNA, 25 bp, Homo sapien
ttcaaagagaggttacggaagcggc

SEQ ID NO: 434678 - DNA, 25 bp, Homo sapien
gcgacgcccagcagaactcctgagg

SEQ ID NO: 434679 - DNA, 25 bp, Homo sapien
gaactggctttgttgaccgggagaa

SEQ ID NO: 434680 - DNA, 25 bp, Homo sapien
aagctggagatatttcggatgataa

SEQ ID NO: 434681 - DNA, 25 bp, Homo sapien
cggatgataatctacctcactttcc

SEQ ID NO: 434682 - DNA, 25 bp, Homo sapien
gataatctacctcactttccctgtg

SEQ ID NO: 434683 - DNA, 25 bp, Homo sapien
ttttagtggaggtgacaggtaataa

SEQ ID NO: 434684 - DNA, 25 bp, Homo sapien
aatgtaatttcagatggccttaaag

SEQ ID NO: 434685 - DNA, 25 bp, Homo sapien
ggccttaaagacagcaaaccagatt

SEQ ID NO: 434686 - DNA, 25 bp, Homo sapien
aaccagatttaggtgatagagaata

SEQ ID NO: 434687 - DNA, 25 bp, Homo sapien
tttaaaatcttcataataaccctat

SEQ ID NO: 434688 - DNA, 25 bp, Homo sapien
ggaatttcagacttgcctagggtca

SEQ ID NO: 434689 - DNA, 25 bp, Homo sapien
ttcagacttgcctagggtcacaaag

SEQ ID NO: 434690 - DNA, 25 bp, Homo sapien
gacttgcctagggtcacaaagtagt

SEQ ID NO: 434691 - DNA, 25 bp, Homo sapien
ggtcacaaagtagtggaaccacgct

SEQ ID NO: 434692 - DNA, 25 bp, Homo sapien
agtggaaccacgctaatctgatttc

SEQ ID NO: 434693 - DNA, 25 bp, Homo sapien
gaaccacgctaatctgatttcatta

SEQ ID NO: 434694 - DNA, 25 bp, Homo sapien
tgtttctcctctaggatccaaagcc

SEQ ID NO: 434695 - DNA, 25 bp, Homo sapien
tcctctaggatccaaagccctgaga

SEQ ID NO: 434696 - DNA, 25 bp, Homo sapien
gagaacattcaacttgatccctgtt

SEQ ID NO: 434697 - DNA, 25 bp, Homo sapien
acattcaacttgatccctgttcttt

SEQ ID NO: 434698 - DNA, 25 bp, Homo sapien
attcaacttgatccctgttctttgc

SEQ ID NO: 434699 - DNA, 25 bp, Homo sapien
aacttgatccctgttctttgccact

SEQ ID NO: 434700 - DNA, 25 bp, Homo sapien
tctttgccactgaagttcagagacc

SEQ ID NO: 434701 - DNA, 25 bp, Homo sapien
ctgaagttcagagaccaaaggtatt

SEQ ID NO: 434702 - DNA, 25 bp, Homo sapien
caaccctttagtggaaactctggag

SEQ ID NO: 434703 - DNA, 25 bp, Homo sapien
agcacctccactcctttaaggaagt

SEQ ID NO: 434704 - DNA, 25 bp, Homo sapien
gtggtaaagagtgagggcttatttt

SEQ ID NO: 434705 - DNA, 25 bp, Homo sapien
agagaagttccatggcaccgacttt

SEQ ID NO: 434706 - DNA, 25 bp, Homo sapien
catggcaccgactttgatactgtct

SEQ ID NO: 434707 - DNA, 25 bp, Homo sapien
gatactgtcttctggaagtgcgaca

SEQ ID NO: 434708 - DNA, 25 bp, Homo sapien
ggatgagctgaagcggctgctctac

SEQ ID NO: 434709 - DNA, 25 bp, Homo sapien
tgaagcggctgctctacgacacctt

SEQ ID NO: 434710 - DNA, 25 bp, Homo sapien
tacgacaccttctgcgagcacctgt

SEQ ID NO: 434711 - DNA, 25 bp, Homo sapien
gagaacatcatcatgacggaggagg

SEQ ID NO: 434712 - DNA, 25 bp, Homo sapien
ggatgtggagacctgctccaaccag

SEQ ID NO: 434713 - DNA, 25 bp, Homo sapien
agatccgccagacttgcgtgcgcaa

SEQ ID NO: 434714 - DNA, 25 bp, Homo sapien
ttgcgtgcgcaagagtctcatctgc

SEQ ID NO: 434715 - DNA, 25 bp, Homo sapien
aagagtctcatctgcgccttcgcca

SEQ ID NO: 434716 - DNA, 25 bp, Homo sapien
atttgatttttctccagagtttcca

SEQ ID NO: 434717 - DNA, 25 bp, Homo sapien
tccagagtttccactaaagggttgg

SEQ ID NO: 434718 - DNA, 25 bp, Homo sapien
ttacaaatacctttggtctctgaac

SEQ ID NO: 434719 - DNA, 25 bp, Homo sapien
ctctgaacttcagtggcaaagaaca

SEQ ID NO: 434720 - DNA, 25 bp, Homo sapien
acagggatcaagttgaatgttctca

SEQ ID NO: 434721 - DNA, 25 bp, Homo sapien
tgaatgttctcagggctttggatcc

SEQ ID NO: 434722 - DNA, 25 bp, Homo sapien
ggctttggatcctagaggagaaaca

SEQ ID NO: 434723 - DNA, 25 bp, Homo sapien
gagcagaaatggttatccctgttta

SEQ ID NO: 434724 - DNA, 25 bp, Homo sapien
tccctgtttaaaataagccctcact

SEQ ID NO: 434725 - DNA, 25 bp, Homo sapien
tcactctttaccacttccttaaagg

SEQ ID NO: 434726 - DNA, 25 bp, Homo sapien
cttccttaaaggagtggaggtgctg

SEQ ID NO: 434727 - DNA, 25 bp, Homo sapien
gtacgttttcctatgaaaataagct

SEQ ID NO: 434728 - DNA, 25 bp, Homo sapien
tacgttttcctatgaaaataagctc

SEQ ID NO: 434729 - DNA, 25 bp, Homo sapien
acgttttcctatgaaaataagctca

SEQ ID NO: 434730 - DNA, 25 bp, Homo sapien
cgttttcctatgaaaataagctcaa

SEQ ID NO: 434731 - DNA, 25 bp, Homo sapien
gttttcctatgaaaataagctcaag

SEQ ID NO: 434732 - DNA, 25 bp, Homo sapien
ttttcctatgaaaataagctcaaga

SEQ ID NO: 434733 - DNA, 25 bp, Homo sapien
tttcctatgaaaataagctcaagaa

SEQ ID NO: 434734 - DNA, 25 bp, Homo sapien
agctcaagaaataatatttggctgg

SEQ ID NO: 434735 - DNA, 25 bp, Homo sapien
gctcaagaaataatatttggctggg

SEQ ID NO: 434736 - DNA, 25 bp, Homo sapien
ctcaagaaataatatttggctgggc

SEQ ID NO: 434737 - DNA, 25 bp, Homo sapien
agaaataatatttggctgggcacgg

SEQ ID NO: 434738 - DNA, 25 bp, Homo sapien
gaattgcatttagtgtaataggaac

SEQ ID NO: 434739 - DNA, 25 bp, Homo sapien
ggaaaacggagttccacctttgcat

SEQ ID NO: 434740 - DNA, 25 bp, Homo sapien
aaacggagttccacctttgcatagg

SEQ ID NO: 434741 - DNA, 25 bp, Homo sapien
acggagttccacctttgcataggag

SEQ ID NO: 434742 - DNA, 25 bp, Homo sapien
gagttccacctttgcataggagtct

SEQ ID NO: 434743 - DNA, 25 bp, Homo sapien
gttccacctttgcataggagtctgc

SEQ ID NO: 434744 - DNA, 25 bp, Homo sapien
tccacctttgcataggagtctgctt

SEQ ID NO: 434745 - DNA, 25 bp, Homo sapien
acctttgcataggagtctgctttca

SEQ ID NO: 434746 - DNA, 25 bp, Homo sapien
tgcataggagtctgctttcatttct

SEQ ID NO: 434747 - DNA, 25 bp, Homo sapien
tgatgctcagaggtgttataggatt

SEQ ID NO: 434748 - DNA, 25 bp, Homo sapien
cagaggtgttataggattgttgaaa

SEQ ID NO: 434749 - DNA, 25 bp, Homo sapien
aggaagatatcctggctggcactct

SEQ ID NO: 434750 - DNA, 25 bp, Homo sapien
ggctggcactctttcagttgacaga

SEQ ID NO: 434751 - DNA, 25 bp, Homo sapien
ctttcagttgacagagagtgacctc

SEQ ID NO: 434752 - DNA, 25 bp, Homo sapien
tgtggccccggatcagcacaccagg

SEQ ID NO: 434753 - DNA, 25 bp, Homo sapien
tgcctttcgctttttacagtcttct

SEQ ID NO: 434754 - DNA, 25 bp, Homo sapien
agtcttctctcctacttccatgaag

SEQ ID NO: 434755 - DNA, 25 bp, Homo sapien
acttccatgaagacgcggccatcag

SEQ ID NO: 434756 - DNA, 25 bp, Homo sapien
cggccatcagggaagaggccttcct

SEQ ID NO: 434757 - DNA, 25 bp, Homo sapien
aggccttcctgcatgttgctgtgga

SEQ ID NO: 434758 - DNA, 25 bp, Homo sapien
gttgctgtggacatgtacttgaagc

SEQ ID NO: 434759 - DNA, 25 bp, Homo sapien
agctggtccagctcttcgtggctgg

SEQ ID NO: 434760 - DNA, 25 bp, Homo sapien
gttcatatatggctctattcttaga

SEQ ID NO: 434761 - DNA, 25 bp, Homo sapien
gaatgtgatctttcaatagtctgaa

SEQ ID NO: 434762 - DNA, 25 bp, Homo sapien
aatacgactctgttgtcttacttga

SEQ ID NO: 434763 - DNA, 25 bp, Homo sapien
gttgtcttacttgatatttcttgcc

SEQ ID NO: 434764 - DNA, 25 bp, Homo sapien
atttcttgccctagtaatgtacttg

SEQ ID NO: 434765 - DNA, 25 bp, Homo sapien
gtacttgacatttatgttcctaagc

SEQ ID NO: 434766 - DNA, 25 bp, Homo sapien
ttatgttcctaagcagtgtaagtac

SEQ ID NO: 434767 - DNA, 25 bp, Homo sapien
gtagaatttctctgtcaaactcaat

SEQ ID NO: 434768 - DNA, 25 bp, Homo sapien
tagtacttttgtcttctcccatgtg

SEQ ID NO: 434769 - DNA, 25 bp, Homo sapien
cttttgtcttctcccatgtgcttga

SEQ ID NO: 434770 - DNA, 25 bp, Homo sapien
aaagtgtcactaccgtatttcttgt

SEQ ID NO: 434771 - DNA, 25 bp, Homo sapien
gcctaagtaaatctgctctcaacct

SEQ ID NO: 434772 - DNA, 25 bp, Homo sapien
atctgctctcaacctatatatatac

SEQ ID NO: 434773 - DNA, 25 bp, Homo sapien
atacaaggtcattcattctagcatt

SEQ ID NO: 434774 - DNA, 25 bp, Homo sapien
ggtcattcattctagcattgtttgc

SEQ ID NO: 434775 - DNA, 25 bp, Homo sapien
ctagcattgtttgcaagagtgaaag

SEQ ID NO: 434776 - DNA, 25 bp, Homo sapien
gaaagagtggaaacacccgaagtgt

SEQ ID NO: 434777 - DNA, 25 bp, Homo sapien
acacccgaagtgtccatcagtaagg

SEQ ID NO: 434778 - DNA, 25 bp, Homo sapien
ccatcagtaagggacaggctagatt

SEQ ID NO: 434779 - DNA, 25 bp, Homo sapien
caggctagattgattacggatgtaa

SEQ ID NO: 434780 - DNA, 25 bp, Homo sapien
tacggatgtaattgctgtccatcca

SEQ ID NO: 434781 - DNA, 25 bp, Homo sapien
ctgggaacaggtaatcaggcccctc

SEQ ID NO: 434782 - DNA, 25 bp, Homo sapien
attagtggttgtaggttctctgtca

SEQ ID NO: 434783 - DNA, 25 bp, Homo sapien
tctgtcaagaagcatgacttcccta

SEQ ID NO: 434784 - DNA, 25 bp, Homo sapien
atgacttccctagcccaaggtagtt

SEQ ID NO: 434785 - DNA, 25 bp, Homo sapien
caaggtagttggctaggtttccaat

SEQ ID NO: 434786 - DNA, 25 bp, Homo sapien
ggctaggtttccaataccaggcagt

SEQ ID NO: 434787 - DNA, 25 bp, Homo sapien
taccaggcagtttctctgtctttaa

SEQ ID NO: 434788 - DNA, 25 bp, Homo sapien
ctgtccatctgtctgaaatctatct

SEQ ID NO: 434789 - DNA, 25 bp, Homo sapien
gtctgaaatctatctatccgtccac

SEQ ID NO: 434790 - DNA, 25 bp, Homo sapien
tatccgtccacccatttaggtgagg

SEQ ID NO: 434791 - DNA, 25 bp, Homo sapien
acccatttaggtgaggcctgagaga

SEQ ID NO: 434792 - DNA, 25 bp, Homo sapien
gagtcgaggaaatgtcaccatcttt

SEQ ID NO: 434793 - DNA, 25 bp, Homo sapien
acttcatcaggttcgacactggtaa

SEQ ID NO: 434794 - DNA, 25 bp, Homo sapien
agctttgccacttgactttccaaca

SEQ ID NO: 434795 - DNA, 25 bp, Homo sapien
tgtttgcaagggcaacataccatgg

SEQ ID NO: 434796 - DNA, 25 bp, Homo sapien
ttccccaaggaaaaggtatctgcct

SEQ ID NO: 434797 - DNA, 25 bp, Homo sapien
tccccaaggaaaaggtatctgcctc

SEQ ID NO: 434798 - DNA, 25 bp, Homo sapien
ccccaaggaaaaggtatctgcctca

SEQ ID NO: 434799 - DNA, 25 bp, Homo sapien
cccaaggaaaaggtatctgcctcac

SEQ ID NO: 434800 - DNA, 25 bp, Homo sapien
ccaaggaaaaggtatctgcctcacc

SEQ ID NO: 434801 - DNA, 25 bp, Homo sapien
caaggaaaaggtatctgcctcacca

SEQ ID NO: 434802 - DNA, 25 bp, Homo sapien
aaggaaaaggtatctgcctcaccat

SEQ ID NO: 434803 - DNA, 25 bp, Homo sapien
tctgcctcaccattgctgaagagag

SEQ ID NO: 434804 - DNA, 25 bp, Homo sapien
tgagaacattccaatagagacagag

SEQ ID NO: 434805 - DNA, 25 bp, Homo sapien
gaagaaggcaaatctactgaggaca

SEQ ID NO: 434806 - DNA, 25 bp, Homo sapien
aggcaaatctactgaggacaaggag

SEQ ID NO: 434807 - DNA, 25 bp, Homo sapien
aaccagtgacagtaacattggctca

SEQ ID NO: 434808 - DNA, 25 bp, Homo sapien
ccagtgacagtaacattggctcaga

SEQ ID NO: 434809 - DNA, 25 bp, Homo sapien
gacagtaacattggctcagagagaa

SEQ ID NO: 434810 - DNA, 25 bp, Homo sapien
cagagagaaatggtgcaacagtgga

SEQ ID NO: 434811 - DNA, 25 bp, Homo sapien
aaggaggcagcagagcaagtttagt

SEQ ID NO: 434812 - DNA, 25 bp, Homo sapien
ggcagcagagcaagtttagtgcagt

SEQ ID NO: 434813 - DNA, 25 bp, Homo sapien
gagcaagtttagtgcagtgagagca

SEQ ID NO: 434814 - DNA, 25 bp, Homo sapien
agccagtggccaacaaaggcgagga

SEQ ID NO: 434815 - DNA, 25 bp, Homo sapien
tatattgattgctctcaaaagatgt

SEQ ID NO: 434816 - DNA, 25 bp, Homo sapien
gttaagtcagtatcttcaatgcttt

SEQ ID NO: 434817 - DNA, 25 bp, Homo sapien
gtcagtatcttcaatgctttaacag

SEQ ID NO: 434818 - DNA, 25 bp, Homo sapien
tcttcaatgctttaacagtaggtag

SEQ ID NO: 434819 - DNA, 25 bp, Homo sapien
gctttaacagtaggtagaggtcttt

SEQ ID NO: 434820 - DNA, 25 bp, Homo sapien
ggttggaactcaggatacagtgact

SEQ ID NO: 434821 - DNA, 25 bp, Homo sapien
aactcaggatacagtgactaggaca

SEQ ID NO: 434822 - DNA, 25 bp, Homo sapien
gtgactaggacagagtgcattctta

SEQ ID NO: 434823 - DNA, 25 bp, Homo sapien
ggacagagtgcattcttaggctaat

SEQ ID NO: 434824 - DNA, 25 bp, Homo sapien
cagagtgcattcttaggctaattag

SEQ ID NO: 434825 - DNA, 25 bp, Homo sapien
gaaatatattgattgctctcaaaag

SEQ ID NO: 434826 - DNA, 25 bp, Homo sapien
actgctatgcctgacgtggggacag

SEQ ID NO: 434827 - DNA, 25 bp, Homo sapien
ctgctatgcctgacgtggggacagc

SEQ ID NO: 434828 - DNA, 25 bp, Homo sapien
gctatgcctgacgtggggacagctc

SEQ ID NO: 434829 - DNA, 25 bp, Homo sapien
ctatgcctgacgtggggacagctct

SEQ ID NO: 434830 - DNA, 25 bp, Homo sapien
tatgcctgacgtggggacagctctg

SEQ ID NO: 434831 - DNA, 25 bp, Homo sapien
gcctgacgtggggacagctctgctc

SEQ ID NO: 434832 - DNA, 25 bp, Homo sapien
tgacgtggggacagctctgctccca

SEQ ID NO: 434833 - DNA, 25 bp, Homo sapien
atgtaaatagagtaacctgcacaaa

SEQ ID NO: 434834 - DNA, 25 bp, Homo sapien
tgtaaatagagtaacctgcacaaac

SEQ ID NO: 434835 - DNA, 25 bp, Homo sapien
gtaaatagagtaacctgcacaaacc

SEQ ID NO: 434836 - DNA, 25 bp, Homo sapien
taaatagagtaacctgcacaaacct

SEQ ID NO: 434837 - DNA, 25 bp, Homo sapien
aattcaatgtgatgtcttgccagga

SEQ ID NO: 434838 - DNA, 25 bp, Homo sapien
gaagttagctttcagcctggcattc

SEQ ID NO: 434839 - DNA, 25 bp, Homo sapien
attcccgtccaagcacatgtaaggc

SEQ ID NO: 434840 - DNA, 25 bp, Homo sapien
gtaaggctccgcaaaattgatgaca

SEQ ID NO: 434841 - DNA, 25 bp, Homo sapien
taaaggagtccagtttccaccacca

SEQ ID NO: 434842 - DNA, 25 bp, Homo sapien
cacgatgctccgtcctcaaagagga

SEQ ID NO: 434843 - DNA, 25 bp, Homo sapien
aaagaggagcacatcccagtcgcct

SEQ ID NO: 434844 - DNA, 25 bp, Homo sapien
gcctctctctggagggctttgaatg

SEQ ID NO: 434845 - DNA, 25 bp, Homo sapien
gaatgcctctctgatcagtcaacag

SEQ ID NO: 434846 - DNA, 25 bp, Homo sapien
acaggacccttgaatgagcacttat

SEQ ID NO: 434847 - DNA, 25 bp, Homo sapien
attgtgccagtaatcttttcagagg

SEQ ID NO: 434848 - DNA, 25 bp, Homo sapien
gggactgactactgcccagtctgtg

SEQ ID NO: 434849 - DNA, 25 bp, Homo sapien
tgactactgcccagtctgtgtctgc

SEQ ID NO: 434850 - DNA, 25 bp, Homo sapien
gtctgtgtctgcaatgttgatggcc

SEQ ID NO: 434851 - DNA, 25 bp, Homo sapien
tgtctgcaatgttgatggccaccac

SEQ ID NO: 434852 - DNA, 25 bp, Homo sapien
ctgcaatgttgatggccaccaccct

SEQ ID NO: 434853 - DNA, 25 bp, Homo sapien
accaccctcatgacatcatggatgg

SEQ ID NO: 434854 - DNA, 25 bp, Homo sapien
catggatggcatcaacagtgttgtg

SEQ ID NO: 434855 - DNA, 25 bp, Homo sapien
aacagtgttgtggtggaatgcccaa

SEQ ID NO: 434856 - DNA, 25 bp, Homo sapien
ttgtggtggaatgcccaactagtta

SEQ ID NO: 434857 - DNA, 25 bp, Homo sapien
tggaatgcccaactagttaagaagc

SEQ ID NO: 434858 - DNA, 25 bp, Homo sapien
gcccaactagttaagaagcacaaag

SEQ ID NO: 434859 - DNA, 25 bp, Homo sapien
gtgtcaccgtggaaaccaaacagta

SEQ ID NO: 434860 - DNA, 25 bp, Homo sapien
taaacagaggactcgcgagctcctg

SEQ ID NO: 434861 - DNA, 25 bp, Homo sapien
ccaggcccgtatggataatccctta

SEQ ID NO: 434862 - DNA, 25 bp, Homo sapien
ggataatcccttacatcgagcagat

SEQ ID NO: 434863 - DNA, 25 bp, Homo sapien
atcgagcagatgagcaaggccatgc

SEQ ID NO: 434864 - DNA, 25 bp, Homo sapien
gagtcttcagacctcaccgaggtcg

SEQ ID NO: 434865 - DNA, 25 bp, Homo sapien
tcaccgaggtcgtggtttacagctc

SEQ ID NO: 434866 - DNA, 25 bp, Homo sapien
ggtttacagctcctattggtacaag

SEQ ID NO: 434867 - DNA, 25 bp, Homo sapien
ggtacaagctccaaaccaagtggat

SEQ ID NO: 434868 - DNA, 25 bp, Homo sapien
actgccagcaccaggagcaagggat

SEQ ID NO: 434869 - DNA, 25 bp, Homo sapien
ggcgcctacgtgtcaccgtggaaac

SEQ ID NO: 434870 - DNA, 25 bp, Homo sapien
tcccacgccggacctggaagagaaa

SEQ ID NO: 434871 - DNA, 25 bp, Homo sapien
agagcaaagcttgcagaggctgcag

SEQ ID NO: 434872 - DNA, 25 bp, Homo sapien
gaggctgcagagagaagacaaaaag

SEQ ID NO: 434873 - DNA, 25 bp, Homo sapien
agaggctgcatctcggggaatttta

SEQ ID NO: 434874 - DNA, 25 bp, Homo sapien
gaattttagatgttcaatctgtgca

SEQ ID NO: 434875 - DNA, 25 bp, Homo sapien
gatgttcaatctgtgcaagaaaaga

SEQ ID NO: 434876 - DNA, 25 bp, Homo sapien
gaaaaacaaattgctacatccgggc

SEQ ID NO: 434877 - DNA, 25 bp, Homo sapien
gacccggtcagggttctcaagctgt

SEQ ID NO: 434878 - DNA, 25 bp, Homo sapien
ggtcagggttctcaagctgtcgtcc

SEQ ID NO: 434879 - DNA, 25 bp, Homo sapien
gttctcaagctgtcgtccctatggg

SEQ ID NO: 434880 - DNA, 25 bp, Homo sapien
ctatggggctgtgttttccttgtcc

SEQ ID NO: 434881 - DNA, 25 bp, Homo sapien
aataatgaaagactgaatatgctga

SEQ ID NO: 434882 - DNA, 25 bp, Homo sapien
tacttttctgtagttgaccatttaa

SEQ ID NO: 434883 - DNA, 25 bp, Homo sapien
gtagttgaccatttaacttcacata

SEQ ID NO: 434884 - DNA, 25 bp, Homo sapien
gttgaccatttaacttcacataata

SEQ ID NO: 434885 - DNA, 25 bp, Homo sapien
gaccatttaacttcacataatacac

SEQ ID NO: 434886 - DNA, 25 bp, Homo sapien
taacttcacataatacactacaaat

SEQ ID NO: 434887 - DNA, 25 bp, Homo sapien
ttgtattacaatcaattaaggaggg

SEQ ID NO: 434888 - DNA, 25 bp, Homo sapien
gagaaagacaggaagtagaccaaaa

SEQ ID NO: 434889 - DNA, 25 bp, Homo sapien
caggaagtagaccaaaatatagaaa

SEQ ID NO: 434890 - DNA, 25 bp, Homo sapien
atagaaaagggacacggatctatac

SEQ ID NO: 434891 - DNA, 25 bp, Homo sapien
aagattaaacactggcaagaatgcc

SEQ ID NO: 434892 - DNA, 25 bp, Homo sapien
tatgtcatatggatggtaggtgcct

SEQ ID NO: 434893 - DNA, 25 bp, Homo sapien
atgtcatatggatggtaggtgcctt

SEQ ID NO: 434894 - DNA, 25 bp, Homo sapien
tgtcatatggatggtaggtgccttt

SEQ ID NO: 434895 - DNA, 25 bp, Homo sapien
gtcatatggatggtaggtgcctttt

SEQ ID NO: 434896 - DNA, 25 bp, Homo sapien
tcatatggatggtaggtgcctttta

SEQ ID NO: 434897 - DNA, 25 bp, Homo sapien
catatggatggtaggtgccttttaa

SEQ ID NO: 434898 - DNA, 25 bp, Homo sapien
tatggatggtaggtgccttttaaaa

SEQ ID NO: 434899 - DNA, 25 bp, Homo sapien
tggatggtaggtgccttttaaaatt

SEQ ID NO: 434900 - DNA, 25 bp, Homo sapien
ggagatagggtgtttaagcagtaat

SEQ ID NO: 434901 - DNA, 25 bp, Homo sapien
gatagggtgtttaagcagtaattta

SEQ ID NO: 434902 - DNA, 25 bp, Homo sapien
tagggtgtttaagcagtaatttatt

SEQ ID NO: 434903 - DNA, 25 bp, Homo sapien
tattattctctttcactttagtttg

SEQ ID NO: 434904 - DNA, 25 bp, Homo sapien
tctctttcactttagtttgaccaca

SEQ ID NO: 434905 - DNA, 25 bp, Homo sapien
gtttgaccacattatgctgttagct

SEQ ID NO: 434906 - DNA, 25 bp, Homo sapien
cagtatttggaaggctgacagatac

SEQ ID NO: 434907 - DNA, 25 bp, Homo sapien
ggctgacagatacttaaagttgaaa

SEQ ID NO: 434908 - DNA, 25 bp, Homo sapien
aatactcaggagattgtcatttctt

SEQ ID NO: 434909 - DNA, 25 bp, Homo sapien
caggagattgtcatttcttgataaa

SEQ ID NO: 434910 - DNA, 25 bp, Homo sapien
catatagtgctatttatgatatctt

SEQ ID NO: 434911 - DNA, 25 bp, Homo sapien
gatatcttctcattgttattcatca

SEQ ID NO: 434912 - DNA, 25 bp, Homo sapien
ctcattgttattcatcagattttta

SEQ ID NO: 434913 - DNA, 25 bp, Homo sapien
aacttgattaagtgagtgtgaacta

SEQ ID NO: 434914 - DNA, 25 bp, Homo sapien
ttggcttctgcacccactcggagtg

SEQ ID NO: 434915 - DNA, 25 bp, Homo sapien
gcttctgcacccactcggagtgata

SEQ ID NO: 434916 - DNA, 25 bp, Homo sapien
ttctgcacccactcggagtgatagc

SEQ ID NO: 434917 - DNA, 25 bp, Homo sapien
tgcacccactcggagtgatagcttc

SEQ ID NO: 434918 - DNA, 25 bp, Homo sapien
acccactcggagtgatagcttcatg

SEQ ID NO: 434919 - DNA, 25 bp, Homo sapien
ccactcggagtgatagcttcatgat

SEQ ID NO: 434920 - DNA, 25 bp, Homo sapien
cactcggagtgatagcttcatgatg

SEQ ID NO: 434921 - DNA, 25 bp, Homo sapien
ctcggagtgatagcttcatgatggt

SEQ ID NO: 434922 - DNA, 25 bp, Homo sapien
cggagtgatagcttcatgatggtga

SEQ ID NO: 434923 - DNA, 25 bp, Homo sapien
agcttcatgatggtgaagtcaccca

SEQ ID NO: 434924 - DNA, 25 bp, Homo sapien
aggggagcctgttcgcccaagctgc

SEQ ID NO: 434925 - DNA, 25 bp, Homo sapien
ggaatttatggacaacacgagccgc

SEQ ID NO: 434926 - DNA, 25 bp, Homo sapien
gaatttatggacaacacgagccgct

SEQ ID NO: 434927 - DNA, 25 bp, Homo sapien
aatttatggacaacacgagccgctc

SEQ ID NO: 434928 - DNA, 25 bp, Homo sapien
atttatggacaacacgagccgctcc

SEQ ID NO: 434929 - DNA, 25 bp, Homo sapien
tttatggacaacacgagccgctcca

SEQ ID NO: 434930 - DNA, 25 bp, Homo sapien
ttatggacaacacgagccgctccag

SEQ ID NO: 434931 - DNA, 25 bp, Homo sapien
atggacaacacgagccgctccagca

SEQ ID NO: 434932 - DNA, 25 bp, Homo sapien
tggacaacacgagccgctccagcat

SEQ ID NO: 434933 - DNA, 25 bp, Homo sapien
aacacgagccgctccagcatccgca

SEQ ID NO: 434934 - DNA, 25 bp, Homo sapien
acgagccgctccagcatccgcagtg

SEQ ID NO: 434935 - DNA, 25 bp, Homo sapien
tgagggggacgtgctcaccctgttg

SEQ ID NO: 434936 - DNA, 25 bp, Homo sapien
ccttatgatctcatccaaccttgat

SEQ ID NO: 434937 - DNA, 25 bp, Homo sapien
tgatctcatccaaccttgattacct

SEQ ID NO: 434938 - DNA, 25 bp, Homo sapien
aaccttgattacctcccagaggcct

SEQ ID NO: 434939 - DNA, 25 bp, Homo sapien
agaggcctccatctccaagtactat

SEQ ID NO: 434940 - DNA, 25 bp, Homo sapien
tccatctccaagtactatcacatga

SEQ ID NO: 434941 - DNA, 25 bp, Homo sapien
tatcacatgagattagggcttcagt

SEQ ID NO: 434942 - DNA, 25 bp, Homo sapien
tgagattagggcttcagtatatgaa

SEQ ID NO: 434943 - DNA, 25 bp, Homo sapien
gggaatacagtttaatccataacat

SEQ ID NO: 434944 - DNA, 25 bp, Homo sapien
acatgtaaccatagtagcatcttta

SEQ ID NO: 434945 - DNA, 25 bp, Homo sapien
ccatagtagcatctttaatactggg

SEQ ID NO: 434946 - DNA, 25 bp, Homo sapien
gggttattttgcacttcttttgtat

SEQ ID NO: 434947 - DNA, 25 bp, Homo sapien
gcccttgagacactttgtaatgctc

SEQ ID NO: 434948 - DNA, 25 bp, Homo sapien
aatgctcttttgtaactatcgacaa

SEQ ID NO: 434949 - DNA, 25 bp, Homo sapien
tgctcttttgtaactatcgacaaag

SEQ ID NO: 434950 - DNA, 25 bp, Homo sapien
ttgtaactatcgacaaaggtgtggg

SEQ ID NO: 434951 - DNA, 25 bp, Homo sapien
gtcttcttaaaggtcaagtctgctc

SEQ ID NO: 434952 - DNA, 25 bp, Homo sapien
tcttaaaggtcaagtctgctctccc

SEQ ID NO: 434953 - DNA, 25 bp, Homo sapien
ttaaaggtcaagtctgctctccctc

SEQ ID NO: 434954 - DNA, 25 bp, Homo sapien
aaaggtcaagtctgctctccctcgc

SEQ ID NO: 434955 - DNA, 25 bp, Homo sapien
agtctgctctccctcgcctaaagtg

SEQ ID NO: 434956 - DNA, 25 bp, Homo sapien
tccctcgcctaaagtgcagcagcag

SEQ ID NO: 434957 - DNA, 25 bp, Homo sapien
ggtaggagtgtttttctagcaagaa

SEQ ID NO: 434958 - DNA, 25 bp, Homo sapien
ctggacgagtcgctgtctgccggga

SEQ ID NO: 434959 - DNA, 25 bp, Homo sapien
tggacgagtcgctgtctgccgggag

SEQ ID NO: 434960 - DNA, 25 bp, Homo sapien
ggacgagtcgctgtctgccgggagc

SEQ ID NO: 434961 - DNA, 25 bp, Homo sapien
gacgagtcgctgtctgccgggagcg

SEQ ID NO: 434962 - DNA, 25 bp, Homo sapien
acgagtcgctgtctgccgggagcgt

SEQ ID NO: 434963 - DNA, 25 bp, Homo sapien
gtgcccggcgcggtcctgaccctct

SEQ ID NO: 434964 - DNA, 25 bp, Homo sapien
tgcccggcgcggtcctgaccctctg

SEQ ID NO: 434965 - DNA, 25 bp, Homo sapien
gcccggcgcggtcctgaccctctgc

SEQ ID NO: 434966 - DNA, 25 bp, Homo sapien
cccggcgcggtcctgaccctctgcc

SEQ ID NO: 434967 - DNA, 25 bp, Homo sapien
tcttcgccagccgagtgcagtggtg

SEQ ID NO: 434968 - DNA, 25 bp, Homo sapien
gtggtgctatctcggtcatgcaagt

SEQ ID NO: 434969 - DNA, 25 bp, Homo sapien
ggtgctatctcggtcatgcaagtcg

SEQ ID NO: 434970 - DNA, 25 bp, Homo sapien
tgctatctcggtcatgcaagtcgct

SEQ ID NO: 434971 - DNA, 25 bp, Homo sapien
gctatctcggtcatgcaagtcgctc

SEQ ID NO: 434972 - DNA, 25 bp, Homo sapien
atctcggtcatgcaagtcgctcctt

SEQ ID NO: 434973 - DNA, 25 bp, Homo sapien
tcggtcatgcaagtcgctccttggt

SEQ ID NO: 434974 - DNA, 25 bp, Homo sapien
ggtcatgcaagtcgctccttggttc

SEQ ID NO: 434975 - DNA, 25 bp, Homo sapien
tcatgcaagtcgctccttggttcac

SEQ ID NO: 434976 - DNA, 25 bp, Homo sapien
atgcaagtcgctccttggttcacgc

SEQ ID NO: 434977 - DNA, 25 bp, Homo sapien
gcaagtcgctccttggttcacgcca

SEQ ID NO: 434978 - DNA, 25 bp, Homo sapien
tttatgaaaaccaggtacacagcct

SEQ ID NO: 434979 - DNA, 25 bp, Homo sapien
gtacacagcctgagaatagaatgtg

SEQ ID NO: 434980 - DNA, 25 bp, Homo sapien
cctgcaagagctttggtgcctaatt

SEQ ID NO: 434981 - DNA, 25 bp, Homo sapien
ctgcaagagctttggtgcctaatta

SEQ ID NO: 434982 - DNA, 25 bp, Homo sapien
tgcaagagctttggtgcctaattat

SEQ ID NO: 434983 - DNA, 25 bp, Homo sapien
gcaagagctttggtgcctaattatg

SEQ ID NO: 434984 - DNA, 25 bp, Homo sapien
caagagctttggtgcctaattatgt

SEQ ID NO: 434985 - DNA, 25 bp, Homo sapien
aagagctttggtgcctaattatgtc

SEQ ID NO: 434986 - DNA, 25 bp, Homo sapien
gagctttggtgcctaattatgtcta

SEQ ID NO: 434987 - DNA, 25 bp, Homo sapien
agctttggtgcctaattatgtctaa

SEQ ID NO: 434988 - DNA, 25 bp, Homo sapien
ttggtgcctaattatgtctaaagaa

SEQ ID NO: 434989 - DNA, 25 bp, Homo sapien
tctgtacagcctgacactgtatggg

SEQ ID NO: 434990 - DNA, 25 bp, Homo sapien
ctgacactgtatgggctgcgaggac

SEQ ID NO: 434991 - DNA, 25 bp, Homo sapien
gtatgggctgcgaggaccccacaag

SEQ ID NO: 434992 - DNA, 25 bp, Homo sapien
cacaaggccgacagcatccagggaa

SEQ ID NO: 434993 - DNA, 25 bp, Homo sapien
gcaccctcagcccagttctggagag

SEQ ID NO: 434994 - DNA, 25 bp, Homo sapien
cccgtgacctccaattcagtgaaat

SEQ ID NO: 434995 - DNA, 25 bp, Homo sapien
tcagccaaggtcaactggatgcccc

SEQ ID NO: 434996 - DNA, 25 bp, Homo sapien
gggcggacagcttcaaagtctccta

SEQ ID NO: 434997 - DNA, 25 bp, Homo sapien
aaagtctcctaccagctggcggacg

SEQ ID NO: 434998 - DNA, 25 bp, Homo sapien
ggttcctgacggtcccacacagttg

SEQ ID NO: 434999 - DNA, 25 bp, Homo sapien
gtcccacacagttgcgtgcactgaa

SEQ ID NO: 435000 - DNA, 25 bp, Homo sapien
gaacccacgaggacatctgccactg

SEQ ID NO: 435001 - DNA, 25 bp, Homo sapien
tgccactggcatggtctactcactg

SEQ ID NO: 435002 - DNA, 25 bp, Homo sapien
tgactccagggcagagacgtccgtg

SEQ ID NO: 435003 - DNA, 25 bp, Homo sapien
agagacgtccgtgcgggaactgacc

SEQ ID NO: 435004 - DNA, 25 bp, Homo sapien
tcgctgcacgtggtcacttccgaag

SEQ ID NO: 435005 - DNA, 25 bp, Homo sapien
aagcagcgctccctgtggccgcaga

SEQ ID NO: 435006 - DNA, 25 bp, Homo sapien
tgtggccgcagagacagagcccgca

SEQ ID NO: 435007 - DNA, 25 bp, Homo sapien
ttgagtgcggcctccagactcgagt

SEQ ID NO: 435008 - DNA, 25 bp, Homo sapien
tccagactcgagtccagaatctgtt

SEQ ID NO: 435009 - DNA, 25 bp, Homo sapien
gagtccagaatctgtttctgtcaag

SEQ ID NO: 435010 - DNA, 25 bp, Homo sapien
tttctgtcaagtcagtcgtccccag

SEQ ID NO: 435011 - DNA, 25 bp, Homo sapien
gaaaggagaacaacagaggccattt

SEQ ID NO: 435012 - DNA, 25 bp, Homo sapien
aaggagaacaacagaggccatttaa

SEQ ID NO: 435013 - DNA, 25 bp, Homo sapien
gagaacaacagaggccatttaagga

SEQ ID NO: 435014 - DNA, 25 bp, Homo sapien
acagaggccatttaaggaaaacctg

SEQ ID NO: 435015 - DNA, 25 bp, Homo sapien
aggaaaacctgtctacaccattctt

SEQ ID NO: 435016 - DNA, 25 bp, Homo sapien
tacaccattctttaaaaccaataat

SEQ ID NO: 435017 - DNA, 25 bp, Homo sapien
gagaactatcatttactgagcatat

SEQ ID NO: 435018 - DNA, 25 bp, Homo sapien
ctatcatttactgagcatatataat

SEQ ID NO: 435019 - DNA, 25 bp, Homo sapien
gacatgagggtcttattatgttgcc

SEQ ID NO: 435020 - DNA, 25 bp, Homo sapien
tgaacaaaggtttactccaatacct

SEQ ID NO: 435021 - DNA, 25 bp, Homo sapien
ttactccaatacctacaaatttctt

SEQ ID NO: 435022 - DNA, 25 bp, Homo sapien
gaaaaacttcttcaggagattagga

SEQ ID NO: 435023 - DNA, 25 bp, Homo sapien
aaggagagaggctatcaccagcaat

SEQ ID NO: 435024 - DNA, 25 bp, Homo sapien
atcaccagcaatagcaccacctagg

SEQ ID NO: 435025 - DNA, 25 bp, Homo sapien
cagagggcactgtccagtgctgaat

SEQ ID NO: 435026 - DNA, 25 bp, Homo sapien
gaataagtcactacggatgccagag

SEQ ID NO: 435027 - DNA, 25 bp, Homo sapien
actcacttcacttgtgtgggtgtgc

SEQ ID NO: 435028 - DNA, 25 bp, Homo sapien
tcacttgtgtgggtgtgctttccac

SEQ ID NO: 435029 - DNA, 25 bp, Homo sapien
gtgtgctttccactagctgttctta

SEQ ID NO: 435030 - DNA, 25 bp, Homo sapien
agctgttcttacttggactgaggac

SEQ ID NO: 435031 - DNA, 25 bp, Homo sapien
gcaaagcatgattgtatcccaggaa

SEQ ID NO: 435032 - DNA, 25 bp, Homo sapien
ccctgtgtgtggcacaagcatcatg

SEQ ID NO: 435033 - DNA, 25 bp, Homo sapien
gaaggaaactgaaccgtatgtaccg

SEQ ID NO: 435034 - DNA, 25 bp, Homo sapien
ggaaactgaaccgtatgtaccgagc

SEQ ID NO: 435035 - DNA, 25 bp, Homo sapien
gaaactgaaccgtatgtaccgagca

SEQ ID NO: 435036 - DNA, 25 bp, Homo sapien
aaactgaaccgtatgtaccgagcaa

SEQ ID NO: 435037 - DNA, 25 bp, Homo sapien
aactgaaccgtatgtaccgagcaaa

SEQ ID NO: 435038 - DNA, 25 bp, Homo sapien
aatgctagtcctagattaattgatt

SEQ ID NO: 435039 - DNA, 25 bp, Homo sapien
caaattagtgttttatagaccctgg

SEQ ID NO: 435040 - DNA, 25 bp, Homo sapien
aatagctcaaaatgtcacttctgtt

SEQ ID NO: 435041 - DNA, 25 bp, Homo sapien
actgagcaaggaaacgtaatttgga

SEQ ID NO: 435042 - DNA, 25 bp, Homo sapien
ctgagcaaggaaacgtaatttggat

SEQ ID NO: 435043 - DNA, 25 bp, Homo sapien
gcaaggaaacgtaatttggattata

SEQ ID NO: 435044 - DNA, 25 bp, Homo sapien
tttttaccatagacgacaagaacag

SEQ ID NO: 435045 - DNA, 25 bp, Homo sapien
tccctccgccgaataatacatggtt

SEQ ID NO: 435046 - DNA, 25 bp, Homo sapien
ataaaactttttgaggctgtctcct

SEQ ID NO: 435047 - DNA, 25 bp, Homo sapien
atgtgatcttgattgtctgtcccat

SEQ ID NO: 435048 - DNA, 25 bp, Homo sapien
gtgatcttgattgtctgtcccatgg

SEQ ID NO: 435049 - DNA, 25 bp, Homo sapien
gccgaataatacatggttaccactg

SEQ ID NO: 435050 - DNA, 25 bp, Homo sapien
aatacatggttaccactgctgtccc

SEQ ID NO: 435051 - DNA, 25 bp, Homo sapien
atggttaccactgctgtcccgagaa

SEQ ID NO: 435052 - DNA, 25 bp, Homo sapien
ttaccactgctgtcccgagaattac

SEQ ID NO: 435053 - DNA, 25 bp, Homo sapien
actgctgtcccgagaattacagtaa

SEQ ID NO: 435054 - DNA, 25 bp, Homo sapien
gtcccgagaattacagtaatagtca

SEQ ID NO: 435055 - DNA, 25 bp, Homo sapien
tcaaacccagagtggcgtgggcctt

SEQ ID NO: 435056 - DNA, 25 bp, Homo sapien
gtggcgtgggccttccttgtactgc

SEQ ID NO: 435057 - DNA, 25 bp, Homo sapien
tccttgtactgccttctgacttctt

SEQ ID NO: 435058 - DNA, 25 bp, Homo sapien
ttcagctgctatgtctgtacttgcc

SEQ ID NO: 435059 - DNA, 25 bp, Homo sapien
atgtctgtacttgccctcctatgtg

SEQ ID NO: 435060 - DNA, 25 bp, Homo sapien
tctgccctctgactgagaagatcta

SEQ ID NO: 435061 - DNA, 25 bp, Homo sapien
gaagatctagaatttgactgtcctc

SEQ ID NO: 435062 - DNA, 25 bp, Homo sapien
gactgtcctctttaggccagagcta

SEQ ID NO: 435063 - DNA, 25 bp, Homo sapien
cagagctatcattactcatataaat

SEQ ID NO: 435064 - DNA, 25 bp, Homo sapien
tttcctcttcatttggcatcaaaac

SEQ ID NO: 435065 - DNA, 25 bp, Homo sapien
gatgaaactaacttcctttccagta

SEQ ID NO: 435066 - DNA, 25 bp, Homo sapien
gaagcttttggactttggtggtctg

SEQ ID NO: 435067 - DNA, 25 bp, Homo sapien
ttggtggtctgtctaacctgcaggt

SEQ ID NO: 435068 - DNA, 25 bp, Homo sapien
tggtggtctgtctaacctgcaggtc

SEQ ID NO: 435069 - DNA, 25 bp, Homo sapien
ggtggtctgtctaacctgcaggtca

SEQ ID NO: 435070 - DNA, 25 bp, Homo sapien
gtggtctgtctaacctgcaggtcac

SEQ ID NO: 435071 - DNA, 25 bp, Homo sapien
tggtctgtctaacctgcaggtcact

SEQ ID NO: 435072 - DNA, 25 bp, Homo sapien
ggacctgtttgaatcttttctgcaa

SEQ ID NO: 435073 - DNA, 25 bp, Homo sapien
gacctgtttgaatcttttctgcaat

SEQ ID NO: 435074 - DNA, 25 bp, Homo sapien
acctgtttgaatcttttctgcaatg

SEQ ID NO: 435075 - DNA, 25 bp, Homo sapien
cctgtttgaatcttttctgcaatgc

SEQ ID NO: 435076 - DNA, 25 bp, Homo sapien
tgtttgaatcttttctgcaatgctg

SEQ ID NO: 435077 - DNA, 25 bp, Homo sapien
ggatgtttccttttgtacacttcat

SEQ ID NO: 435078 - DNA, 25 bp, Homo sapien
catttttacaagttttgctactcac

SEQ ID NO: 435079 - DNA, 25 bp, Homo sapien
gttttgctactcacaagctttatgt

SEQ ID NO: 435080 - DNA, 25 bp, Homo sapien
gatagaggtatttttggtctttaga

SEQ ID NO: 435081 - DNA, 25 bp, Homo sapien
gggtgagggctgctaacttacactt

SEQ ID NO: 435082 - DNA, 25 bp, Homo sapien
gctaacttacacttcagaggcctgt

SEQ ID NO: 435083 - DNA, 25 bp, Homo sapien
caaaggcctggctgcgtttgccgtg

SEQ ID NO: 435084 - DNA, 25 bp, Homo sapien
tttgccgtgctgtgcgaggacctgt

SEQ ID NO: 435085 - DNA, 25 bp, Homo sapien
tgctgtgcgaggacctgtgtacaca

SEQ ID NO: 435086 - DNA, 25 bp, Homo sapien
tgcccgagcgcgagtagctcttgtg

SEQ ID NO: 435087 - DNA, 25 bp, Homo sapien
gagtagctcttgtgtagtggtgaaa

SEQ ID NO: 435088 - DNA, 25 bp, Homo sapien
tatgaaacccagatgtcaccaaatg

SEQ ID NO: 435089 - DNA, 25 bp, Homo sapien
gaaacccagatgtcaccaaatggac

SEQ ID NO: 435090 - DNA, 25 bp, Homo sapien
acccagatgtcaccaaatggacatt

SEQ ID NO: 435091 - DNA, 25 bp, Homo sapien
gatgtcaccaaatggacattaatag

SEQ ID NO: 435092 - DNA, 25 bp, Homo sapien
ggacattaatagttgcattaaggat

SEQ ID NO: 435093 - DNA, 25 bp, Homo sapien
agttgcattaaggatcagtagcatt

SEQ ID NO: 435094 - DNA, 25 bp, Homo sapien
tgagggaattttagcgacactgtct

SEQ ID NO: 435095 - DNA, 25 bp, Homo sapien
gagggaattttagcgacactgtctg

SEQ ID NO: 435096 - DNA, 25 bp, Homo sapien
gggaattttagcgacactgtctgag

SEQ ID NO: 435097 - DNA, 25 bp, Homo sapien
gaattttagcgacactgtctgagca

SEQ ID NO: 435098 - DNA, 25 bp, Homo sapien
tttgaactcccagtgggatgcccta

SEQ ID NO: 435099 - DNA, 25 bp, Homo sapien
gaacaatttgtgagctatataggaa

SEQ ID NO: 435100 - DNA, 25 bp, Homo sapien
gagctatataggaaacattgttatt

SEQ ID NO: 435101 - DNA, 25 bp, Homo sapien
catgttaaaattacagccgtccttt

SEQ ID NO: 435102 - DNA, 25 bp, Homo sapien
acagccgtcctttattgtacactta

SEQ ID NO: 435103 - DNA, 25 bp, Homo sapien
gccgtcctttattgtacacttattg

SEQ ID NO: 435104 - DNA, 25 bp, Homo sapien
tgtacacttattgggttaagcctat

SEQ ID NO: 435105 - DNA, 25 bp, Homo sapien
gggttaagcctattataccatatta

SEQ ID NO: 435106 - DNA, 25 bp, Homo sapien
atgaagcaacaaggctccaggacat

SEQ ID NO: 435107 - DNA, 25 bp, Homo sapien
tccaggacattaaaactcacacaaa

SEQ ID NO: 435108 - DNA, 25 bp, Homo sapien
aaaactcacacaaagttatgctcat

SEQ ID NO: 435109 - DNA, 25 bp, Homo sapien
ggatttattagtgacaagtttgtat

SEQ ID NO: 435110 - DNA, 25 bp, Homo sapien
tgtttgcaagggcaacataccatgg

SEQ ID NO: 435111 - DNA, 25 bp, Homo sapien
ttccccaaggaaaaggtatctgcct

SEQ ID NO: 435112 - DNA, 25 bp, Homo sapien
tccccaaggaaaaggtatctgcctc

SEQ ID NO: 435113 - DNA, 25 bp, Homo sapien
ccccaaggaaaaggtatctgcctca

SEQ ID NO: 435114 - DNA, 25 bp, Homo sapien
cccaaggaaaaggtatctgcctcac

SEQ ID NO: 435115 - DNA, 25 bp, Homo sapien
ccaaggaaaaggtatctgcctcacc

SEQ ID NO: 435116 - DNA, 25 bp, Homo sapien
caaggaaaaggtatctgcctcacca

SEQ ID NO: 435117 - DNA, 25 bp, Homo sapien
aaggaaaaggtatctgcctcaccat

SEQ ID NO: 435118 - DNA, 25 bp, Homo sapien
atgagagaatcaagcctggcccaga

SEQ ID NO: 435119 - DNA, 25 bp, Homo sapien
tttgatgtcatctttacctgtgagg

SEQ ID NO: 435120 - DNA, 25 bp, Homo sapien
tacctgtgaggagcgtgtctatgac

SEQ ID NO: 435121 - DNA, 25 bp, Homo sapien
acagtggtggaagatctgtgttcca

SEQ ID NO: 435122 - DNA, 25 bp, Homo sapien
agagaacagcagacctttcagcctg

SEQ ID NO: 435123 - DNA, 25 bp, Homo sapien
tttcagcctgtgcacgtgatcaaca

SEQ ID NO: 435124 - DNA, 25 bp, Homo sapien
tgtgcacgtgatcaacatggacatc

SEQ ID NO: 435125 - DNA, 25 bp, Homo sapien
tctgtgagatttgccagtgcctgca

SEQ ID NO: 435126 - DNA, 25 bp, Homo sapien
gtgcctgcagcagtccgacgacatg

SEQ ID NO: 435127 - DNA, 25 bp, Homo sapien
agtccgacgacatggaagacagtct

SEQ ID NO: 435128 - DNA, 25 bp, Homo sapien
cagtctggaggagctgctgttgcaa

SEQ ID NO: 435129 - DNA, 25 bp, Homo sapien
ggaacagcatctgcttgctgaagct

SEQ ID NO: 435130 - DNA, 25 bp, Homo sapien
agcatctgcttgctgaagctgaaaa

SEQ ID NO: 435131 - DNA, 25 bp, Homo sapien
ctgcttgctgaagctgaaaatcctg

SEQ ID NO: 435132 - DNA, 25 bp, Homo sapien
agctgaaaatcctgcagtaagtgaa

SEQ ID NO: 435133 - DNA, 25 bp, Homo sapien
aaaatcctgcagtaagtgaaaaagt

SEQ ID NO: 435134 - DNA, 25 bp, Homo sapien
aaataccttcagaggtccaagcagt

SEQ ID NO: 435135 - DNA, 25 bp, Homo sapien
taccttcagaggtccaagcagtgta

SEQ ID NO: 435136 - DNA, 25 bp, Homo sapien
ttcagaggtccaagcagtgtactag

SEQ ID NO: 435137 - DNA, 25 bp, Homo sapien
ggtccaagcagtgtactaggcactt

SEQ ID NO: 435138 - DNA, 25 bp, Homo sapien
caagcagtgtactaggcacttgtat

SEQ ID NO: 435139 - DNA, 25 bp, Homo sapien
gtactaggcacttgtatagagagca

SEQ ID NO: 435140 - DNA, 25 bp, Homo sapien
agctgctggacgagtcgctgtctgc

SEQ ID NO: 435141 - DNA, 25 bp, Homo sapien
atggtgcccgaggtgcccggcgcgg

SEQ ID NO: 435142 - DNA, 25 bp, Homo sapien
gcctccaggtgcctaagcttgccaa

SEQ ID NO: 435143 - DNA, 25 bp, Homo sapien
tccaggtgcctaagcttgccaatca

SEQ ID NO: 435144 - DNA, 25 bp, Homo sapien
caggtgcctaagcttgccaatcata

SEQ ID NO: 435145 - DNA, 25 bp, Homo sapien
aggtgcctaagcttgccaatcatac

SEQ ID NO: 435146 - DNA, 25 bp, Homo sapien
ggtgcctaagcttgccaatcatacg

SEQ ID NO: 435147 - DNA, 25 bp, Homo sapien
ttgccaatcatacgcatctctgcct

SEQ ID NO: 435148 - DNA, 25 bp, Homo sapien
aatcatacgcatctctgccttcttc

SEQ ID NO: 435149 - DNA, 25 bp, Homo sapien
tctgcctctggctggaggcctcgga

SEQ ID NO: 435150 - DNA, 25 bp, Homo sapien
ctggctggaggcctcggagggctgc

SEQ ID NO: 435151 - DNA, 25 bp, Homo sapien
cattacgttaaagaacgggatgcca

SEQ ID NO: 435152 - DNA, 25 bp, Homo sapien
tgatgtggctctgggaattcctgca

SEQ ID NO: 435153 - DNA, 25 bp, Homo sapien
gaacctggactgaagaaccacctag

SEQ ID NO: 435154 - DNA, 25 bp, Homo sapien
tgaggtcacgctgggacttccagtt

SEQ ID NO: 435155 - DNA, 25 bp, Homo sapien
aggtcacgctgggacttccagttcc

SEQ ID NO: 435156 - DNA, 25 bp, Homo sapien
agatggggtcacaatgctgcagaaa

SEQ ID NO: 435157 - DNA, 25 bp, Homo sapien
ctttggaatgaagatctcccggact

SEQ ID NO: 435158 - DNA, 25 bp, Homo sapien
ggaatgaagatctcccggacttcaa

SEQ ID NO: 435159 - DNA, 25 bp, Homo sapien
gaagatctcccggacttcaaggaga

SEQ ID NO: 435160 - DNA, 25 bp, Homo sapien
cccggacttcaaggagattcagaaa

SEQ ID NO: 435161 - DNA, 25 bp, Homo sapien
aggagattcagaaaacgtccagtgc

SEQ ID NO: 435162 - DNA, 25 bp, Homo sapien
aatgaatattatccctaatacctgc

SEQ ID NO: 435163 - DNA, 25 bp, Homo sapien
atgaatattatccctaatacctgcc

SEQ ID NO: 435164 - DNA, 25 bp, Homo sapien
cactcttaatcagtggtggaagaac

SEQ ID NO: 435165 - DNA, 25 bp, Homo sapien
ctcttaatcagtggtggaagaacgg

SEQ ID NO: 435166 - DNA, 25 bp, Homo sapien
agaactgtttgtttcaattggccat

SEQ ID NO: 435167 - DNA, 25 bp, Homo sapien
gaactgtttgtttcaattggccatt

SEQ ID NO: 435168 - DNA, 25 bp, Homo sapien
aactgtttgtttcaattggccattt

SEQ ID NO: 435169 - DNA, 25 bp, Homo sapien
tgtttgtttcaattggccatttaag

SEQ ID NO: 435170 - DNA, 25 bp, Homo sapien
tcaattggccatttaagtttagtag

SEQ ID NO: 435171 - DNA, 25 bp, Homo sapien
caattggccatttaagtttagtagt

SEQ ID NO: 435172 - DNA, 25 bp, Homo sapien
taacaatgcatcgtaaaaccttcag

SEQ ID NO: 435173 - DNA, 25 bp, Homo sapien
acgaggaccttacagcttagttgaa

SEQ ID NO: 435174 - DNA, 25 bp, Homo sapien
ggaccttacagcttagttgaagaaa

SEQ ID NO: 435175 - DNA, 25 bp, Homo sapien
cccaaagtttgtctcatggatccat

SEQ ID NO: 435176 - DNA, 25 bp, Homo sapien
tggatccattatggcttcttcacat

SEQ ID NO: 435177 - DNA, 25 bp, Homo sapien
attatggcttcttcacatggcttga

SEQ ID NO: 435178 - DNA, 25 bp, Homo sapien
atggcttcttcacatggcttgagtc

SEQ ID NO: 435179 - DNA, 25 bp, Homo sapien
gcttcttcacatggcttgagtcttg

SEQ ID NO: 435180 - DNA, 25 bp, Homo sapien
tcacatggcttgagtcttgccaacg

SEQ ID NO: 435181 - DNA, 25 bp, Homo sapien
ggcttgagtcttgccaacgaggacc

SEQ ID NO: 435182 - DNA, 25 bp, Homo sapien
gagtcttgccaacgaggaccttaca

SEQ ID NO: 435183 - DNA, 25 bp, Homo sapien
ttgccaacgaggaccttacagctta

SEQ ID NO: 435184 - DNA, 25 bp, Homo sapien
ttggtgtccggctcaagtagccttc

SEQ ID NO: 435185 - DNA, 25 bp, Homo sapien
aagtagccttcctctgctctgggac

SEQ ID NO: 435186 - DNA, 25 bp, Homo sapien
gtggtttattttcccgcaaacgctg

SEQ ID NO: 435187 - DNA, 25 bp, Homo sapien
attttcccgcaaacgctgagtgact

SEQ ID NO: 435188 - DNA, 25 bp, Homo sapien
gggccggacagttcataaataattg

SEQ ID NO: 435189 - DNA, 25 bp, Homo sapien
attgattcctttccccactaaagca

SEQ ID NO: 435190 - DNA, 25 bp, Homo sapien
cccactaaagcagtcgaggagattt

SEQ ID NO: 435191 - DNA, 25 bp, Homo sapien
gagatttgtaatccactttttagtg

SEQ ID NO: 435192 - DNA, 25 bp, Homo sapien
ttttagtgcaacaagagctccatgt

SEQ ID NO: 435193 - DNA, 25 bp, Homo sapien
gagctccatgttatgcttgtaataa

SEQ ID NO: 435194 - DNA, 25 bp, Homo sapien
tggactccgcagtggctgtgtcagc

SEQ ID NO: 435195 - DNA, 25 bp, Homo sapien
taaaggtgccatatattaaagcgtt

SEQ ID NO: 435196 - DNA, 25 bp, Homo sapien
atggagtgtataaacctgaagctat

SEQ ID NO: 435197 - DNA, 25 bp, Homo sapien
ggagtgtataaacctgaagctatta

SEQ ID NO: 435198 - DNA, 25 bp, Homo sapien
gtgtataaacctgaagctattaaat

SEQ ID NO: 435199 - DNA, 25 bp, Homo sapien
tagggaaaacagattctttcactaa

SEQ ID NO: 435200 - DNA, 25 bp, Homo sapien
ctttcactaaaaggctctgactcaa

SEQ ID NO: 435201 - DNA, 25 bp, Homo sapien
tcactaaaaggctctgactcaattt

SEQ ID NO: 435202 - DNA, 25 bp, Homo sapien
aaaggctctgactcaattttaaagg

SEQ ID NO: 435203 - DNA, 25 bp, Homo sapien
ggctctgactcaattttaaaggtgc

SEQ ID NO: 435204 - DNA, 25 bp, Homo sapien
tctgactcaattttaaaggtgccat

SEQ ID NO: 435205 - DNA, 25 bp, Homo sapien
gactcaattttaaaggtgccatata

SEQ ID NO: 435206 - DNA, 25 bp, Homo sapien
attaccatggcaaaattggaagaat

SEQ ID NO: 435207 - DNA, 25 bp, Homo sapien
ttggaagaatctacagtgttaccca

SEQ ID NO: 435208 - DNA, 25 bp, Homo sapien
tattaagcactctaagtgccgagac

SEQ ID NO: 435209 - DNA, 25 bp, Homo sapien
taagcactctaagtgccgagacggc

SEQ ID NO: 435210 - DNA, 25 bp, Homo sapien
ctaagtgccgagacggcttcctaaa

SEQ ID NO: 435211 - DNA, 25 bp, Homo sapien
tgccgagacggcttcctaaaacaca

SEQ ID NO: 435212 - DNA, 25 bp, Homo sapien
cgagacggcttcctaaaacacataa

SEQ ID NO: 435213 - DNA, 25 bp, Homo sapien
gctccacccagggaaacatactttg

SEQ ID NO: 435214 - DNA, 25 bp, Homo sapien
acccagggaaacatactttgtgaga

SEQ ID NO: 435215 - DNA, 25 bp, Homo sapien
agggaaacatactttgtgagaacca

SEQ ID NO: 435216 - DNA, 25 bp, Homo sapien
tgtgagaaccaaagcctgagctgct

SEQ ID NO: 435217 - DNA, 25 bp, Homo sapien
tagtagaagctaggccactgatcca

SEQ ID NO: 435218 - DNA, 25 bp, Homo sapien
gaagctaggccactgatccatgaat

SEQ ID NO: 435219 - DNA, 25 bp, Homo sapien
gctaggccactgatccatgaattgt

SEQ ID NO: 435220 - DNA, 25 bp, Homo sapien
ggccactgatccatgaattgttaac

SEQ ID NO: 435221 - DNA, 25 bp, Homo sapien
aactgaacggcggagatcgaagacg

SEQ ID NO: 435222 - DNA, 25 bp, Homo sapien
acggcggagatcgaagacgaacaaa

SEQ ID NO: 435223 - DNA, 25 bp, Homo sapien
gcaaaaacccttgctacacgggcaa

SEQ ID NO: 435224 - DNA, 25 bp, Homo sapien
agatgaggatcatacagacggagta

SEQ ID NO: 435225 - DNA, 25 bp, Homo sapien
tacagacggagtagtagcttgtgct

SEQ ID NO: 435226 - DNA, 25 bp, Homo sapien
gacttatatacagcatttgggaagg

SEQ ID NO: 435227 - DNA, 25 bp, Homo sapien
ttgggaaggatgtactgaaactagt

SEQ ID NO: 435228 - DNA, 25 bp, Homo sapien
aatttatgaaaaccaggtacacagc

SEQ ID NO: 435229 - DNA, 25 bp, Homo sapien
atttatgaaaaccaggtacacagcc

SEQ ID NO: 435230 - DNA, 25 bp, Homo sapien
tttatgaaaaccaggtacacagcct

SEQ ID NO: 435231 - DNA, 25 bp, Homo sapien
cctgcaagagctttggtgcctaatt

SEQ ID NO: 435232 - DNA, 25 bp, Homo sapien
ctgcaagagctttggtgcctaatta

SEQ ID NO: 435233 - DNA, 25 bp, Homo sapien
tgcaagagctttggtgcctaattat

SEQ ID NO: 435234 - DNA, 25 bp, Homo sapien
gcaagagctttggtgcctaattatg

SEQ ID NO: 435235 - DNA, 25 bp, Homo sapien
caagagctttggtgcctaattatgt

SEQ ID NO: 435236 - DNA, 25 bp, Homo sapien
aagagctttggtgcctaattatgtc

SEQ ID NO: 435237 - DNA, 25 bp, Homo sapien
gagctttggtgcctaattatgtcta

SEQ ID NO: 435238 - DNA, 25 bp, Homo sapien
agctttggtgcctaattatgtctaa

SEQ ID NO: 435239 - DNA, 25 bp, Homo sapien
atgtcagacgcagccgtagacacca

SEQ ID NO: 435240 - DNA, 25 bp, Homo sapien
tgtcagacgcagccgtagacaccag

SEQ ID NO: 435241 - DNA, 25 bp, Homo sapien
gtcagacgcagccgtagacaccagc

SEQ ID NO: 435242 - DNA, 25 bp, Homo sapien
tcagacgcagccgtagacaccagct

SEQ ID NO: 435243 - DNA, 25 bp, Homo sapien
cagacgcagccgtagacaccagctc

SEQ ID NO: 435244 - DNA, 25 bp, Homo sapien
gcagccgtagacaccagctccgaaa

SEQ ID NO: 435245 - DNA, 25 bp, Homo sapien
cagccgtagacaccagctccgaaat

SEQ ID NO: 435246 - DNA, 25 bp, Homo sapien
agccgtagacaccagctccgaaatc

SEQ ID NO: 435247 - DNA, 25 bp, Homo sapien
gccgtagacaccagctccgaaatca

SEQ ID NO: 435248 - DNA, 25 bp, Homo sapien
gtagacaccagctccgaaatcacca

SEQ ID NO: 435249 - DNA, 25 bp, Homo sapien
tagacaccagctccgaaatcaccac

SEQ ID NO: 435250 - DNA, 25 bp, Homo sapien
ataaccatttctgctcttctgattg

SEQ ID NO: 435251 - DNA, 25 bp, Homo sapien
tgtttctcctctaggatccaaagcc

SEQ ID NO: 435252 - DNA, 25 bp, Homo sapien
tcctctaggatccaaagccctgaga

SEQ ID NO: 435253 - DNA, 25 bp, Homo sapien
ggatccaaagccctgagaacattca

SEQ ID NO: 435254 - DNA, 25 bp, Homo sapien
gagaacattcaacttgatccctgtt

SEQ ID NO: 435255 - DNA, 25 bp, Homo sapien
attcaacttgatccctgttctttgc

SEQ ID NO: 435256 - DNA, 25 bp, Homo sapien
aacttgatccctgttctttgccact

SEQ ID NO: 435257 - DNA, 25 bp, Homo sapien
tctttgccactgaagttcagagacc

SEQ ID NO: 435258 - DNA, 25 bp, Homo sapien
ctgaagttcagagaccaaaggtatt

SEQ ID NO: 435259 - DNA, 25 bp, Homo sapien
caaccctttagtggaaactctggag

SEQ ID NO: 435260 - DNA, 25 bp, Homo sapien
agcacctccactcctttaaggaagt

SEQ ID NO: 435261 - DNA, 25 bp, Homo sapien
ctgaactagcaactagccttttcca

SEQ ID NO: 435262 - DNA, 25 bp, Homo sapien
acctttaaaagttgtgccaagtcat

SEQ ID NO: 435263 - DNA, 25 bp, Homo sapien
agttgtgccaagtcataatcatatt

SEQ ID NO: 435264 - DNA, 25 bp, Homo sapien
attgtgtataacttggaaatggtgc

SEQ ID NO: 435265 - DNA, 25 bp, Homo sapien
gcttgtttctgtcctagctggaggt

SEQ ID NO: 435266 - DNA, 25 bp, Homo sapien
gtttctgtcctagctggaggtgtaa

SEQ ID NO: 435267 - DNA, 25 bp, Homo sapien
tcctagctggaggtgtaaaatgcac

SEQ ID NO: 435268 - DNA, 25 bp, Homo sapien
gcacaatgtgtagcaggtagaatac

SEQ ID NO: 435269 - DNA, 25 bp, Homo sapien
gaatacagctccttatcgttctatg

SEQ ID NO: 435270 - DNA, 25 bp, Homo sapien
agctccttatcgttctatgtaccag

SEQ ID NO: 435271 - DNA, 25 bp, Homo sapien
ttatcgttctatgtaccaggtattt

SEQ ID NO: 435272 - DNA, 25 bp, Homo sapien
gccaggcccatgtcgcactgagtct

SEQ ID NO: 435273 - DNA, 25 bp, Homo sapien
catgtcgcactgagtctcccagcaa

SEQ ID NO: 435274 - DNA, 25 bp, Homo sapien
gtcgcactgagtctcccagcaacag

SEQ ID NO: 435275 - DNA, 25 bp, Homo sapien
tgcatttttcgccttcattttgtct

SEQ ID NO: 435276 - DNA, 25 bp, Homo sapien
atttttcgccttcattttgtctgta

SEQ ID NO: 435277 - DNA, 25 bp, Homo sapien
tttcgccttcattttgtctgtagcc

SEQ ID NO: 435278 - DNA, 25 bp, Homo sapien
gccttcattttgtctgtagccccag

SEQ ID NO: 435279 - DNA, 25 bp, Homo sapien
tcattttgtctgtagccccaggcaa

SEQ ID NO: 435280 - DNA, 25 bp, Homo sapien
tgtctgtagccccaggcaacagtgg

SEQ ID NO: 435281 - DNA, 25 bp, Homo sapien
tctgtagccccaggcaacagtggga

SEQ ID NO: 435282 - DNA, 25 bp, Homo sapien
ttccccaaggtcaccagctctgtac

SEQ ID NO: 435283 - DNA, 25 bp, Homo sapien
tgaccagccctgtgggtggaggtac

SEQ ID NO: 435284 - DNA, 25 bp, Homo sapien
tggaggtacctgtaaaaagcgaaag

SEQ ID NO: 435285 - DNA, 25 bp, Homo sapien
ctgaggtctgcaacaccaagaagtg

SEQ ID NO: 435286 - DNA, 25 bp, Homo sapien
gtctgcaacaccaagaagtggctca

SEQ ID NO: 435287 - DNA, 25 bp, Homo sapien
accaagaagtggctcaggcaactct

SEQ ID NO: 435288 - DNA, 25 bp, Homo sapien
aagtggctcaggcaactctggacat

SEQ ID NO: 435289 - DNA, 25 bp, Homo sapien
ggctcaggcaactctggacatctct

SEQ ID NO: 435290 - DNA, 25 bp, Homo sapien
aactctggacatctctgcctattat

SEQ ID NO: 435291 - DNA, 25 bp, Homo sapien
ggacatctctgcctattatcagtgc

SEQ ID NO: 435292 - DNA, 25 bp, Homo sapien
atctctgcctattatcagtgctggg

SEQ ID NO: 435293 - DNA, 25 bp, Homo sapien
tcgggacgtgtaccctgggaggcct

SEQ ID NO: 435294 - DNA, 25 bp, Homo sapien
aaatggcgatgacaccggcacctgg

SEQ ID NO: 435295 - DNA, 25 bp, Homo sapien
tggcccaacaaccagtttgacacag

SEQ ID NO: 435296 - DNA, 25 bp, Homo sapien
gctgcaagccatgatcttggcgtcc

SEQ ID NO: 435297 - DNA, 25 bp, Homo sapien
atgatcttggcgtccgccagtgaag

SEQ ID NO: 435298 - DNA, 25 bp, Homo sapien
tgaagctgctgatgggagctccacc

SEQ ID NO: 435299 - DNA, 25 bp, Homo sapien
tgccggcaccatgggattgagcgcc

SEQ ID NO: 435300 - DNA, 25 bp, Homo sapien
accatgggattgagcgcccgctacg

SEQ ID NO: 435301 - DNA, 25 bp, Homo sapien
acgtgcccgactaccgccagaatgt

SEQ ID NO: 435302 - DNA, 25 bp, Homo sapien
gccagaatgtctacatcccaggcag

SEQ ID NO: 435303 - DNA, 25 bp, Homo sapien
cccagcaggtggcaatggcaacaag

SEQ ID NO: 435304 - DNA, 25 bp, Homo sapien
gtggcaatggcaacaagaagaagtc

SEQ ID NO: 435305 - DNA, 25 bp, Homo sapien
tttccactccagaggctatataatg

SEQ ID NO: 435306 - DNA, 25 bp, Homo sapien
aatacgtgcttgtatattcttgtgt

SEQ ID NO: 435307 - DNA, 25 bp, Homo sapien
attcttgtgtttgtaggactttcca

SEQ ID NO: 435308 - DNA, 25 bp, Homo sapien
tgtaggactttccaggtttatttat

SEQ ID NO: 435309 - DNA, 25 bp, Homo sapien
ggtttatttattaccatatggcaat

SEQ ID NO: 435310 - DNA, 25 bp, Homo sapien
gtataacccacaaaacccaacagat

SEQ ID NO: 435311 - DNA, 25 bp, Homo sapien
ggcacctctaacaagggtcctaaga

SEQ ID NO: 435312 - DNA, 25 bp, Homo sapien
ccaaaatgtttgaggactgctaatc

SEQ ID NO: 435313 - DNA, 25 bp, Homo sapien
gaggactgctaatcgatattattca

SEQ ID NO: 435314 - DNA, 25 bp, Homo sapien
attattcaattgtctagtcccctaa

SEQ ID NO: 435315 - DNA, 25 bp, Homo sapien
actccaacccttcttatcaggacta

SEQ ID NO: 435316 - DNA, 25 bp, Homo sapien
attatggagggagccctgatcacaa

SEQ ID NO: 435317 - DNA, 25 bp, Homo sapien
ccctcagacggcaggcacaggagga

SEQ ID NO: 435318 - DNA, 25 bp, Homo sapien
aggaggacgggtcaccccatcaccg

SEQ ID NO: 435319 - DNA, 25 bp, Homo sapien
cccatcaccggaatgtctacagtgg

SEQ ID NO: 435320 - DNA, 25 bp, Homo sapien
ccggaatgtctacagtggcatgaac

SEQ ID NO: 435321 - DNA, 25 bp, Homo sapien
catgaacggtgggtcagtatgtgct

SEQ ID NO: 435322 - DNA, 25 bp, Homo sapien
gagggagcccggagcatcttcagaa

SEQ ID NO: 435323 - DNA, 25 bp, Homo sapien
agcatcttcagaaacacgctcttgg

SEQ ID NO: 435324 - DNA, 25 bp, Homo sapien
gggagcctagagcatctccccagag

SEQ ID NO: 435325 - DNA, 25 bp, Homo sapien
ccggagcacctcaaacaacattatg

SEQ ID NO: 435326 - DNA, 25 bp, Homo sapien
aacaacattatggagggagccctga

SEQ ID NO: 435327 - DNA, 25 bp, Homo sapien
ttgtctacaagtaagatgttttcct

SEQ ID NO: 435328 - DNA, 25 bp, Homo sapien
gtaagatgttttcctaagccacaat

SEQ ID NO: 435329 - DNA, 25 bp, Homo sapien
tttcctaagccacaattacctacag

SEQ ID NO: 435330 - DNA, 25 bp, Homo sapien
attacctacagagtaaacacagcaa

SEQ ID NO: 435331 - DNA, 25 bp, Homo sapien
gtaaacacagcaaagtagacaatat

SEQ ID NO: 435332 - DNA, 25 bp, Homo sapien
gaaaactattaggtttacacattat

SEQ ID NO: 435333 - DNA, 25 bp, Homo sapien
aaaatttgtttcgatcctacctatg

SEQ ID NO: 435334 - DNA, 25 bp, Homo sapien
atttgtttcgatcctacctatgtct

SEQ ID NO: 435335 - DNA, 25 bp, Homo sapien
gtttcgatcctacctatgtcttctc

SEQ ID NO: 435336 - DNA, 25 bp, Homo sapien
atgtcttctccaatactgagacccc

SEQ ID NO: 435337 - DNA, 25 bp, Homo sapien
taacagcaatacattgatcatggat

SEQ ID NO: 435338 - DNA, 25 bp, Homo sapien
gtgggtatattcaactgtcatggta

SEQ ID NO: 435339 - DNA, 25 bp, Homo sapien
tacactgctgacaaagaaatccgaa

SEQ ID NO: 435340 - DNA, 25 bp, Homo sapien
gaaatccgaaccgatgacttgtgct

SEQ ID NO: 435341 - DNA, 25 bp, Homo sapien
gacttgtgcttggatgtttctagac

SEQ ID NO: 435342 - DNA, 25 bp, Homo sapien
ggatgtttctagactcaatggacct

SEQ ID NO: 435343 - DNA, 25 bp, Homo sapien
gactcaatggacctgtaatcatgtt

SEQ ID NO: 435344 - DNA, 25 bp, Homo sapien
gttaaaatgccaccatatgagagga

SEQ ID NO: 435345 - DNA, 25 bp, Homo sapien
gagagactcacgttgcgacatgtta

SEQ ID NO: 435346 - DNA, 25 bp, Homo sapien
accaatgtctcgatgaaccttctga

SEQ ID NO: 435347 - DNA, 25 bp, Homo sapien
ggtgcctacaatgcaggactgtagt

SEQ ID NO: 435348 - DNA, 25 bp, Homo sapien
gactgtagtggaagcagatcccaac

SEQ ID NO: 435349 - DNA, 25 bp, Homo sapien
aggatcatccctatcgttgatttga

SEQ ID NO: 435350 - DNA, 25 bp, Homo sapien
cgttgatttgacaaactacgcacag

SEQ ID NO: 435351 - DNA, 25 bp, Homo sapien
acgaacactgcccacatggagttga

SEQ ID NO: 435352 - DNA, 25 bp, Homo sapien
cacatggagttgagcagcctgggat

SEQ ID NO: 435353 - DNA, 25 bp, Homo sapien
tttctgtgcgagagttccccctaaa

SEQ ID NO: 435354 - DNA, 25 bp, Homo sapien
tggcggaggcttcttctacaactac

SEQ ID NO: 435355 - DNA, 25 bp, Homo sapien
ttctacaactacattgacgtctggg

SEQ ID NO: 435356 - DNA, 25 bp, Homo sapien
ggcgaagggaccacagtcatcgtct

SEQ ID NO: 435357 - DNA, 25 bp, Homo sapien
ggcacctttggcgattatgttttca

SEQ ID NO: 435358 - DNA, 25 bp, Homo sapien
tggcgattatgttttcacctgggtg

SEQ ID NO: 435359 - DNA, 25 bp, Homo sapien
atgttttcacctgggtgcgacagac

SEQ ID NO: 435360 - DNA, 25 bp, Homo sapien
tcagcgaaacttgagcccaatcagg

SEQ ID NO: 435361 - DNA, 25 bp, Homo sapien
gaaacttgagcccaatcaggcgctg

SEQ ID NO: 435362 - DNA, 25 bp, Homo sapien
ttgagcccaatcaggcgctgctggc

SEQ ID NO: 435363 - DNA, 25 bp, Homo sapien
ggcaggcaagggagcagatctttat

SEQ ID NO: 435364 - DNA, 25 bp, Homo sapien
ggagcagatctttatgccctggtga

SEQ ID NO: 435365 - DNA, 25 bp, Homo sapien
gcagatctttatgccctggtgagag

SEQ ID NO: 435366 - DNA, 25 bp, Homo sapien
cctggtgagagcttctgtggagcaa

SEQ ID NO: 435367 - DNA, 25 bp, Homo sapien
actcagcgtcgtccacgtggagaaa

SEQ ID NO: 435368 - DNA, 25 bp, Homo sapien
gtccacgtggagaaaccgcgatgca

SEQ ID NO: 435369 - DNA, 25 bp, Homo sapien
gagaaaccgcgatgcagacaagaaa

SEQ ID NO: 435370 - DNA, 25 bp, Homo sapien
ctgcaagccctgctctgcggaacaa

SEQ ID NO: 435371 - DNA, 25 bp, Homo sapien
gggaatgtcgcaaaggcccatctca

SEQ ID NO: 435372 - DNA, 25 bp, Homo sapien
gaatgtcgcaaaggcccatctcaga

SEQ ID NO: 435373 - DNA, 25 bp, Homo sapien
agtgggacctccgaggcacaggaat

SEQ ID NO: 435374 - DNA, 25 bp, Homo sapien
acctccgaggcacaggaatgctgca

SEQ ID NO: 435375 - DNA, 25 bp, Homo sapien
aggaatgctgcagaccaagtcccgg

SEQ ID NO: 435376 - DNA, 25 bp, Homo sapien
tgcagaccaagtcccggcagagctg

SEQ ID NO: 435377 - DNA, 25 bp, Homo sapien
agtcccggcagagctggtgttacct

SEQ ID NO: 435378 - DNA, 25 bp, Homo sapien
gcagagctggtgttacctgggaaac

SEQ ID NO: 435379 - DNA, 25 bp, Homo sapien
aagagcaggaccgtgcagaatagat

SEQ ID NO: 435380 - DNA, 25 bp, Homo sapien
gaccgtgcagaatagatgggcctct

SEQ ID NO: 435381 - DNA, 25 bp, Homo sapien
tgcagaatagatgggcctctgcctg

SEQ ID NO: 435382 - DNA, 25 bp, Homo sapien
tttttatgtggcttcaacgtcaact

SEQ ID NO: 435383 - DNA, 25 bp, Homo sapien
ttatgtggcttcaacgtcaactata

SEQ ID NO: 435384 - DNA, 25 bp, Homo sapien
gtggcttcaacgtcaactataaatt

SEQ ID NO: 435385 - DNA, 25 bp, Homo sapien
caacgtcaactataaattagcttgg

SEQ ID NO: 435386 - DNA, 25 bp, Homo sapien
aattagcttggttatcttctaggag

SEQ ID NO: 435387 - DNA, 25 bp, Homo sapien
ggttatcttctaggagaaatgctat

SEQ ID NO: 435388 - DNA, 25 bp, Homo sapien
gggtaccaggtaatgccgtgcgcct

SEQ ID NO: 435389 - DNA, 25 bp, Homo sapien
cccctcccatatcaagtagaatgct

SEQ ID NO: 435390 - DNA, 25 bp, Homo sapien
atcaagtagaatgctggcggcttac

SEQ ID NO: 435391 - DNA, 25 bp, Homo sapien
gaatgctggcggcttacagactgaa

SEQ ID NO: 435392 - DNA, 25 bp, Homo sapien
tgctggcggcttacagactgaagat

SEQ ID NO: 435393 - DNA, 25 bp, Homo sapien
ttgatggtcgccaccctcggttcca

SEQ ID NO: 435394 - DNA, 25 bp, Homo sapien
ggttccacagccatgttctcagcag

SEQ ID NO: 435395 - DNA, 25 bp, Homo sapien
ttggaggccgggactatctcctcgg

SEQ ID NO: 435396 - DNA, 25 bp, Homo sapien
tatctcctcgggtttatccttcttc

SEQ ID NO: 435397 - DNA, 25 bp, Homo sapien
ttcttcttccggaccgaggctttat

SEQ ID NO: 435398 - DNA, 25 bp, Homo sapien
ggaccgaggctttatccacgagctc

SEQ ID NO: 435399 - DNA, 25 bp, Homo sapien
ccagctccgaggtcatggacttgga

SEQ ID NO: 435400 - DNA, 25 bp, Homo sapien
tccgaggtcatggacttggagcgca

SEQ ID NO: 435401 - DNA, 25 bp, Homo sapien
gagctttcttcctggcggtgtcgtc

SEQ ID NO: 435402 - DNA, 25 bp, Homo sapien
tggtcaccgtgaccaccttaaggac

SEQ ID NO: 435403 - DNA, 25 bp, Homo sapien
caccttaaggaccaggtgattccct

SEQ ID NO: 435404 - DNA, 25 bp, Homo sapien
aatgctcttttgtaactatcgacaa

SEQ ID NO: 435405 - DNA, 25 bp, Homo sapien
tgctcttttgtaactatcgacaaag

SEQ ID NO: 435406 - DNA, 25 bp, Homo sapien
ttgtaactatcgacaaaggtgtggg

SEQ ID NO: 435407 - DNA, 25 bp, Homo sapien
gtcttcttaaaggtcaagtctgctc

SEQ ID NO: 435408 - DNA, 25 bp, Homo sapien
cttcttaaaggtcaagtctgctctc

SEQ ID NO: 435409 - DNA, 25 bp, Homo sapien
tcttaaaggtcaagtctgctctccc

SEQ ID NO: 435410 - DNA, 25 bp, Homo sapien
ttaaaggtcaagtctgctctccctc

SEQ ID NO: 435411 - DNA, 25 bp, Homo sapien
taaaggtcaagtctgctctccctcg

SEQ ID NO: 435412 - DNA, 25 bp, Homo sapien
aaaggtcaagtctgctctccctcgc

SEQ ID NO: 435413 - DNA, 25 bp, Homo sapien
agtctgctctccctcgcctaaagtg

SEQ ID NO: 435414 - DNA, 25 bp, Homo sapien
tccctcgcctaaagtgcagcagcag

SEQ ID NO: 435415 - DNA, 25 bp, Homo sapien
aagttggatctgaaccgccttgtca

SEQ ID NO: 435416 - DNA, 25 bp, Homo sapien
tggaggaagaaaagtgcgccctgca

SEQ ID NO: 435417 - DNA, 25 bp, Homo sapien
ccggcagcggcaggcgaagcaggag

SEQ ID NO: 435418 - DNA, 25 bp, Homo sapien
ggcacgggaagagcaggagcggctg

SEQ ID NO: 435419 - DNA, 25 bp, Homo sapien
ggaggcgctgcggttggaacaggag

SEQ ID NO: 435420 - DNA, 25 bp, Homo sapien
tccccacgctgcatcatgagtgcag

SEQ ID NO: 435421 - DNA, 25 bp, Homo sapien
ccacgctgcatcatgagtgcagccg

SEQ ID NO: 435422 - DNA, 25 bp, Homo sapien
acgctgcatcatgagtgcagccggc

SEQ ID NO: 435423 - DNA, 25 bp, Homo sapien
gctgcatcatgagtgcagccggctg

SEQ ID NO: 435424 - DNA, 25 bp, Homo sapien
tgcatcatgagtgcagccggctgca

SEQ ID NO: 435425 - DNA, 25 bp, Homo sapien
catcatgagtgcagccggctgcagg

SEQ ID NO: 435426 - DNA, 25 bp, Homo sapien
ctatctcacaccagaacagtttgat

SEQ ID NO: 435427 - DNA, 25 bp, Homo sapien
tatctcacaccagaacagtttgatg

SEQ ID NO: 435428 - DNA, 25 bp, Homo sapien
atctcacaccagaacagtttgatga

SEQ ID NO: 435429 - DNA, 25 bp, Homo sapien
ctcacaccagaacagtttgatgaac

SEQ ID NO: 435430 - DNA, 25 bp, Homo sapien
tcacaccagaacagtttgatgaaca

SEQ ID NO: 435431 - DNA, 25 bp, Homo sapien
cacaccagaacagtttgatgaacag

SEQ ID NO: 435432 - DNA, 25 bp, Homo sapien
acaccagaacagtttgatgaacagg

SEQ ID NO: 435433 - DNA, 25 bp, Homo sapien
caccagaacagtttgatgaacaggt

SEQ ID NO: 435434 - DNA, 25 bp, Homo sapien
accagaacagtttgatgaacaggta

SEQ ID NO: 435435 - DNA, 25 bp, Homo sapien
gaccctacacgttttcctctgtttg

SEQ ID NO: 435436 - DNA, 25 bp, Homo sapien
gaaggcagtccaatgtactgtctac

SEQ ID NO: 435437 - DNA, 25 bp, Homo sapien
gtactgtctacattcatttcagttc

SEQ ID NO: 435438 - DNA, 25 bp, Homo sapien
tcatttcagttcagttcaatatata

SEQ ID NO: 435439 - DNA, 25 bp, Homo sapien
atttacatcagattactgagcacta

SEQ ID NO: 435440 - DNA, 25 bp, Homo sapien
actgagcactattatgtcttaatga

SEQ ID NO: 435441 - DNA, 25 bp, Homo sapien
attatgaatgcaataccatggactt

SEQ ID NO: 435442 - DNA, 25 bp, Homo sapien
ccatggactttacaatgtggttggg

SEQ ID NO: 435443 - DNA, 25 bp, Homo sapien
tacatagggaatggccagtcactga

SEQ ID NO: 435444 - DNA, 25 bp, Homo sapien
ccagtcactgaacaaacttctgtat

SEQ ID NO: 435445 - DNA, 25 bp, Homo sapien
caaacttctgtattaaaggcagtta

SEQ ID NO: 435446 - DNA, 25 bp, Homo sapien
atttacttcgatcagatcctggtga

SEQ ID NO: 435447 - DNA, 25 bp, Homo sapien
gggtaattttttcacattggagtct

SEQ ID NO: 435448 - DNA, 25 bp, Homo sapien
cattggagtctgtctttgtagcacc

SEQ ID NO: 435449 - DNA, 25 bp, Homo sapien
aatttacagtttcagttttcacgtg

SEQ ID NO: 435450 - DNA, 25 bp, Homo sapien
gttttcacgtgattaaagtctacca

SEQ ID NO: 435451 - DNA, 25 bp, Homo sapien
gtctaccagagccaaactatccagg

SEQ ID NO: 435452 - DNA, 25 bp, Homo sapien
aaccagtaatatctgcctttgcggg

SEQ ID NO: 435453 - DNA, 25 bp, Homo sapien
aaagatgttactcgtgaagctgcca

SEQ ID NO: 435454 - DNA, 25 bp, Homo sapien
gaagctgccacgaatggtgtcctgc

SEQ ID NO: 435455 - DNA, 25 bp, Homo sapien
ggtgtcctgctctacctagataaag

SEQ ID NO: 435456 - DNA, 25 bp, Homo sapien
tggttggaggctggcagtattccac

SEQ ID NO: 435457 - DNA, 25 bp, Homo sapien
aacctccagccccatatagggtgaa

SEQ ID NO: 435458 - DNA, 25 bp, Homo sapien
ggtgaacctcttgataagctctctg

SEQ ID NO: 435459 - DNA, 25 bp, Homo sapien
aatgtttggaggaatcactggcatt

SEQ ID NO: 435460 - DNA, 25 bp, Homo sapien
ataacataagcctgggctctgagcc

SEQ ID NO: 435461 - DNA, 25 bp, Homo sapien
tgagccctggaagattctccccatg

SEQ ID NO: 435462 - DNA, 25 bp, Homo sapien
ggcagagtggtctccttacgtgctc

SEQ ID NO: 435463 - DNA, 25 bp, Homo sapien
ttacgtgctcacacccagtcagctt

SEQ ID NO: 435464 - DNA, 25 bp, Homo sapien
agtcagcttgggtccctatctctgg

SEQ ID NO: 435465 - DNA, 25 bp, Homo sapien
ttgggtccctatctctggccagagt

SEQ ID NO: 435466 - DNA, 25 bp, Homo sapien
tggccagagtttggcaggactgcca

SEQ ID NO: 435467 - DNA, 25 bp, Homo sapien
gtggcctctgccagcaagagaagtg

SEQ ID NO: 435468 - DNA, 25 bp, Homo sapien
gcagtcgtgcccaggagcagaaacc

SEQ ID NO: 435469 - DNA, 25 bp, Homo sapien
agaaacccctgcagcagctgtggaa

SEQ ID NO: 435470 - DNA, 25 bp, Homo sapien
gcagctgtggaacgccatcctgctg

SEQ ID NO: 435471 - DNA, 25 bp, Homo sapien
caggtggacctgtttaagcgccgcg

SEQ ID NO: 435472 - DNA, 25 bp, Homo sapien
tggacctgtttaagcgccgcgtggt

SEQ ID NO: 435473 - DNA, 25 bp, Homo sapien
tggtgcggagactggcatccctcaa

SEQ ID NO: 435474 - DNA, 25 bp, Homo sapien
agactggcatccctcaagacacggc

SEQ ID NO: 435475 - DNA, 25 bp, Homo sapien
aagacacggcgctgccggctgagca

SEQ ID NO: 435476 - DNA, 25 bp, Homo sapien
agggcctcccagatccgggtgctga

SEQ ID NO: 435477 - DNA, 25 bp, Homo sapien
ccagatccgggtgctgagacctgtg

SEQ ID NO: 435478 - DNA, 25 bp, Homo sapien
acctgtgcggtgtgcctggactact

SEQ ID NO: 435479 - DNA, 25 bp, Homo sapien
ttgaatgcatctagttcagggttct

SEQ ID NO: 435480 - DNA, 25 bp, Homo sapien
ataccaccttccttttttgatcgca

SEQ ID NO: 435481 - DNA, 25 bp, Homo sapien
gtaggtgtctgagcttcacaagcct

SEQ ID NO: 435482 - DNA, 25 bp, Homo sapien
gtgtctgagcttcacaagcctttta

SEQ ID NO: 435483 - DNA, 25 bp, Homo sapien
aagccttttatagtccattcagcac

SEQ ID NO: 435484 - DNA, 25 bp, Homo sapien
tagtccattcagcactgcattcatt

SEQ ID NO: 435485 - DNA, 25 bp, Homo sapien
tgaaaggtggctatgtaccaggcat

SEQ ID NO: 435486 - DNA, 25 bp, Homo sapien
gtaccaggcatattgtttcatgcca

SEQ ID NO: 435487 - DNA, 25 bp, Homo sapien
ggtgagaaaaactccatgcctgcat

SEQ ID NO: 435488 - DNA, 25 bp, Homo sapien
catgcctgcatgttttcactctttg

SEQ ID NO: 435489 - DNA, 25 bp, Homo sapien
gttttcactctttgcaagacacagt

SEQ ID NO: 435490 - DNA, 25 bp, Homo sapien
ctggagaggattgtgcaggcacatt

SEQ ID NO: 435491 - DNA, 25 bp, Homo sapien
gcaggcacattaatattgtgaccaa

SEQ ID NO: 435492 - DNA, 25 bp, Homo sapien
gtgaccaatcacagaatctgggaat

SEQ ID NO: 435493 - DNA, 25 bp, Homo sapien
cagaatctgggaatatgaagctata

SEQ ID NO: 435494 - DNA, 25 bp, Homo sapien
taatgtcacaaagctctagtgcaat

SEQ ID NO: 435495 - DNA, 25 bp, Homo sapien
aaagctctagtgcaatctagttgaa

SEQ ID NO: 435496 - DNA, 25 bp, Homo sapien
caatctagttgaatgcagatgcctg

SEQ ID NO: 435497 - DNA, 25 bp, Homo sapien
ttggagttgtgtgttaatgtgtaaa

SEQ ID NO: 435498 - DNA, 25 bp, Homo sapien
aaatttttgcctgtactatcatata

SEQ ID NO: 435499 - DNA, 25 bp, Homo sapien
gtatatacaccagaaactatttttc

SEQ ID NO: 435500 - DNA, 25 bp, Homo sapien
ttttttactgcaaccaatagttaag

SEQ ID NO: 435501 - DNA, 25 bp, Homo sapien
aagctgataaactagcctgcaccct

SEQ ID NO: 435502 - DNA, 25 bp, Homo sapien
tcctcccactgcaatgtctagttaa

SEQ ID NO: 435503 - DNA, 25 bp, Homo sapien
cccactgcaatgtctagttaacttt

SEQ ID NO: 435504 - DNA, 25 bp, Homo sapien
gtctagttaactttgtaatcccaca

SEQ ID NO: 435505 - DNA, 25 bp, Homo sapien
tagttaactttgtaatcccacaggt

SEQ ID NO: 435506 - DNA, 25 bp, Homo sapien
gctccattgagaaagccacttttaa

SEQ ID NO: 435507 - DNA, 25 bp, Homo sapien
ttttaaagttgctctctgtaccacc

SEQ ID NO: 435508 - DNA, 25 bp, Homo sapien
ttaaagttgctctctgtaccacccc

SEQ ID NO: 435509 - DNA, 25 bp, Homo sapien
cggaaaggacacttggttggagcaa

SEQ ID NO: 435510 - DNA, 25 bp, Homo sapien
gacacttggttggagcaatggcccg

SEQ ID NO: 435511 - DNA, 25 bp, Homo sapien
cacttggttggagcaatggcccgag

SEQ ID NO: 435512 - DNA, 25 bp, Homo sapien
ctaccgagctgttgtccagattttc

SEQ ID NO: 435513 - DNA, 25 bp, Homo sapien
gtccagattttctgacagctgtcca

SEQ ID NO: 435514 - DNA, 25 bp, Homo sapien
ctgacagctgtccatcctgtgtctg

SEQ ID NO: 435515 - DNA, 25 bp, Homo sapien
tgggtcagccagaggttcctccagg

SEQ ID NO: 435516 - DNA, 25 bp, Homo sapien
cagccagaggttcctccaggcagga

SEQ ID NO: 435517 - DNA, 25 bp, Homo sapien
tgggcagtgaggtccctgtaccagc

SEQ ID NO: 435518 - DNA, 25 bp, Homo sapien
agtgaggtccctgtaccagcgactc

SEQ ID NO: 435519 - DNA, 25 bp, Homo sapien
ggttcaaccctaccagcttgtggta

SEQ ID NO: 435520 - DNA, 25 bp, Homo sapien
accagcttgtggtaacttactgtca

SEQ ID NO: 435521 - DNA, 25 bp, Homo sapien
ggtaacttactgtcacatagctctg

SEQ ID NO: 435522 - DNA, 25 bp, Homo sapien
catagctctgacgttttgttgtaat

SEQ ID NO: 435523 - DNA, 25 bp, Homo sapien
tatgttttcataagtggttaagcaa

SEQ ID NO: 435524 - DNA, 25 bp, Homo sapien
agtggttaagcaagtattctcgtta

SEQ ID NO: 435525 - DNA, 25 bp, Homo sapien
gtattctcgttacttttgctcttaa

SEQ ID NO: 435526 - DNA, 25 bp, Homo sapien
tcgttacttttgctcttaaatccct

SEQ ID NO: 435527 - DNA, 25 bp, Homo sapien
atccctattcattacagcaatgttg

SEQ ID NO: 435528 - DNA, 25 bp, Homo sapien
gttcaatggtcctgaaatacataac

SEQ ID NO: 435529 - DNA, 25 bp, Homo sapien
gtacattgtaaagtagaatcctctg

SEQ ID NO: 435530 - DNA, 25 bp, Homo sapien
gtagaatcctctgttcataatgaac

SEQ ID NO: 435531 - DNA, 25 bp, Homo sapien
acaagatgaaccaatgtggattaga

SEQ ID NO: 435532 - DNA, 25 bp, Homo sapien
agaagtccgagatattaattccaaa

SEQ ID NO: 435533 - DNA, 25 bp, Homo sapien
ttccaaaatatccagacattgttaa

SEQ ID NO: 435534 - DNA, 25 bp, Homo sapien
acaaggagcttgagcgttgcaatga

SEQ ID NO: 435535 - DNA, 25 bp, Homo sapien
agcttgagcgttgcaatgagaagtc

SEQ ID NO: 435536 - DNA, 25 bp, Homo sapien
gaagtcatggctgtgaatcccaccc

SEQ ID NO: 435537 - DNA, 25 bp, Homo sapien
ccaccccatcacgttttgaatgttg

SEQ ID NO: 435538 - DNA, 25 bp, Homo sapien
ccatcacgttttgaatgttgggcaa

SEQ ID NO: 435539 - DNA, 25 bp, Homo sapien
taatcgttttatccacttactaggc

SEQ ID NO: 435540 - DNA, 25 bp, Homo sapien
tatccacttactaggcgatgtatag

SEQ ID NO: 435541 - DNA, 25 bp, Homo sapien
tagtttgtatacttcatgccagtca

SEQ ID NO: 435542 - DNA, 25 bp, Homo sapien
acttcatgccagtcattgttttaga

SEQ ID NO: 435543 - DNA, 25 bp, Homo sapien
atgtgatgagcacttctccttctgg

SEQ ID NO: 435544 - DNA, 25 bp, Homo sapien
gagcacttctccttctgggtgcata

SEQ ID NO: 435545 - DNA, 25 bp, Homo sapien
ccagcggactttttagggatcttca

SEQ ID NO: 435546 - DNA, 25 bp, Homo sapien
ggatcttcactttattctctttcaa

SEQ ID NO: 435547 - DNA, 25 bp, Homo sapien
tctctttcaaagacgtctttttggg

SEQ ID NO: 435548 - DNA, 25 bp, Homo sapien
tttcgttgagggtctggcccgagtc

SEQ ID NO: 435549 - DNA, 25 bp, Homo sapien
agtctttccactactctgcttccta

SEQ ID NO: 435550 - DNA, 25 bp, Homo sapien
tgcttcctattcgtggctttctgag

SEQ ID NO: 435551 - DNA, 25 bp, Homo sapien
gctttctgaggccttgaagaggatt

SEQ ID NO: 435552 - DNA, 25 bp, Homo sapien
gccttgaagaggattcaccggcccc

SEQ ID NO: 435553 - DNA, 25 bp, Homo sapien
gttttgcaggtttcgtcagtgtttc

SEQ ID NO: 435554 - DNA, 25 bp, Homo sapien
gtttcgtcagtgtttccgaggcaat

SEQ ID NO: 435555 - DNA, 25 bp, Homo sapien
aggcaatagactgggaaggcctttt

SEQ ID NO: 435556 - DNA, 25 bp, Homo sapien
aatttcatcattctggccttttgca

SEQ ID NO: 435557 - DNA, 25 bp, Homo sapien
catcattctggccttttgcagttaa

SEQ ID NO: 435558 - DNA, 25 bp, Homo sapien
ggccttttgcagttaaatattctcc

SEQ ID NO: 435559 - DNA, 25 bp, Homo sapien
tgcagttaaatattctccaaggata

SEQ ID NO: 435560 - DNA, 25 bp, Homo sapien
atattctccaaggatatgatctatg

SEQ ID NO: 435561 - DNA, 25 bp, Homo sapien
cataggagaagaaactctggaaaca

SEQ ID NO: 435562 - DNA, 25 bp, Homo sapien
tctgcccctgtggaaattcaatccg

SEQ ID NO: 435563 - DNA, 25 bp, Homo sapien
gaaattcaatccgaaacccttcatg

SEQ ID NO: 435564 - DNA, 25 bp, Homo sapien
atccgaaacccttcatgtttttgct

SEQ ID NO: 435565 - DNA, 25 bp, Homo sapien
ctcttctctacatggatggaatatg

SEQ ID NO: 435566 - DNA, 25 bp, Homo sapien
gacaaagttgtaatgagttttctgt

SEQ ID NO: 435567 - DNA, 25 bp, Homo sapien
gataggcatatggacacacacgtaa

SEQ ID NO: 435568 - DNA, 25 bp, Homo sapien
atggacacacacgtaattttctact

SEQ ID NO: 435569 - DNA, 25 bp, Homo sapien
tactgaatgtaagtttgagtccctt

SEQ ID NO: 435570 - DNA, 25 bp, Homo sapien
tttgagtccctttctacagaatcaa

SEQ ID NO: 435571 - DNA, 25 bp, Homo sapien
agaaaatggctgaggtgcacatcgg

SEQ ID NO: 435572 - DNA, 25 bp, Homo sapien
tgcacatcgggccaactgcaaaaat

SEQ ID NO: 435573 - DNA, 25 bp, Homo sapien
aaaaatcaagcagagtcatatacct

SEQ ID NO: 435574 - DNA, 25 bp, Homo sapien
gagtcatatacctgcaatctgaaag

SEQ ID NO: 435575 - DNA, 25 bp, Homo sapien
tgcaatctgaaagccaatatcctga

SEQ ID NO: 435576 - DNA, 25 bp, Homo sapien
caatatcctgaaaatacgtgggcaa

SEQ ID NO: 435577 - DNA, 25 bp, Homo sapien
atacgtgggcaaaaaggctaaagca

SEQ ID NO: 435578 - DNA, 25 bp, Homo sapien
aagtgagcactgacttctctttttt

SEQ ID NO: 435579 - DNA, 25 bp, Homo sapien
cacacacaggtctaacagccaaaat

SEQ ID NO: 435580 - DNA, 25 bp, Homo sapien
gagctcctgctgtcttccatagtcc

SEQ ID NO: 435581 - DNA, 25 bp, Homo sapien
gctgtcttccatagtccccattctg

SEQ ID NO: 435582 - DNA, 25 bp, Homo sapien
tccatagtccccattctgtggctga

SEQ ID NO: 435583 - DNA, 25 bp, Homo sapien
ctccctcctctcatacatagggatt

SEQ ID NO: 435584 - DNA, 25 bp, Homo sapien
catacatagggattcatagtggcca

SEQ ID NO: 435585 - DNA, 25 bp, Homo sapien
atagtggccactttacactacaggt

SEQ ID NO: 435586 - DNA, 25 bp, Homo sapien
agtggccactttacactacaggtgt

SEQ ID NO: 435587 - DNA, 25 bp, Homo sapien
actacaggtgtaatgcattttgtct

SEQ ID NO: 435588 - DNA, 25 bp, Homo sapien
attttgtctgtttcacattgtgtgc

SEQ ID NO: 435589 - DNA, 25 bp, Homo sapien
gtgtgtacaacttaacacctggact

SEQ ID NO: 435590 - DNA, 25 bp, Homo sapien
tgtacaacttaacacctggactttt

SEQ ID NO: 435591 - DNA, 25 bp, Homo sapien
caacttaacacctggacttttactg

SEQ ID NO: 435592 - DNA, 25 bp, Homo sapien
gtgattctgtaaccaacattagaat

SEQ ID NO: 435593 - DNA, 25 bp, Homo sapien
caacattagaattactttggatttg

SEQ ID NO: 435594 - DNA, 25 bp, Homo sapien
ctatgatttgtctttgactattcac

SEQ ID NO: 435595 - DNA, 25 bp, Homo sapien
gatttgtctttgactattcacagat

SEQ ID NO: 435596 - DNA, 25 bp, Homo sapien
tttgtctttgactattcacagataa

SEQ ID NO: 435597 - DNA, 25 bp, Homo sapien
gtctttgactattcacagataattg

SEQ ID NO: 435598 - DNA, 25 bp, Homo sapien
gactattcacagataattgtaaatg

SEQ ID NO: 435599 - DNA, 25 bp, Homo sapien
tttataagcccaagtcattttacat

SEQ ID NO: 435600 - DNA, 25 bp, Homo sapien
aggcgtccctaggtcaggccgttga

SEQ ID NO: 435601 - DNA, 25 bp, Homo sapien
aggtcaggccgttgagttcgagctc

SEQ ID NO: 435602 - DNA, 25 bp, Homo sapien
ttgagttcgagctccgatgggccac

SEQ ID NO: 435603 - DNA, 25 bp, Homo sapien
cgatgggccaccttgaatccaggac

SEQ ID NO: 435604 - DNA, 25 bp, Homo sapien
cttgaatccaggactgaccgcccgt

SEQ ID NO: 435605 - DNA, 25 bp, Homo sapien
tgaccgcccgtgtgtgcacagtttg

SEQ ID NO: 435606 - DNA, 25 bp, Homo sapien
gcacagtttgttcttggacgaggac

SEQ ID NO: 435607 - DNA, 25 bp, Homo sapien
gtcacagcggtgtcccaggtccctg

SEQ ID NO: 435608 - DNA, 25 bp, Homo sapien
cctgccatccgattttacctgggat

SEQ ID NO: 435609 - DNA, 25 bp, Homo sapien
gattttacctgggatgtcttctctg

SEQ ID NO: 435610 - DNA, 25 bp, Homo sapien
gatgtcttctctggagtttggaatt

SEQ ID NO: 435611 - DNA, 25 bp, Homo sapien
atgccccgcaggtcgcgagctgctg

SEQ ID NO: 435612 - DNA, 25 bp, Homo sapien
cgcaggtcgcgagctgctgttcttt

SEQ ID NO: 435613 - DNA, 25 bp, Homo sapien
aggtcgcgagctgctgttctttcga

SEQ ID NO: 435614 - DNA, 25 bp, Homo sapien
ggtcgcgagctgctgttctttcgaa

SEQ ID NO: 435615 - DNA, 25 bp, Homo sapien
gtcgcgagctgctgttctttcgaag

SEQ ID NO: 435616 - DNA, 25 bp, Homo sapien
tcgcgagctgctgttctttcgaagg

SEQ ID NO: 435617 - DNA, 25 bp, Homo sapien
gcgagctgctgttctttcgaaggcg

SEQ ID NO: 435618 - DNA, 25 bp, Homo sapien
tctgactcggagcagcgccgagcac

SEQ ID NO: 435619 - DNA, 25 bp, Homo sapien
ggagcagcgccgagcactgacgctc

SEQ ID NO: 435620 - DNA, 25 bp, Homo sapien
tgacgctcccgcccttgggcaagga

SEQ ID NO: 435621 - DNA, 25 bp, Homo sapien
ccttgggcaaggacgccagtgcgcc

SEQ ID NO: 435622 - DNA, 25 bp, Homo sapien
gggcagaagctgcagttagccaaga

SEQ ID NO: 435623 - DNA, 25 bp, Homo sapien
cttagtttattagtactgtacttca

SEQ ID NO: 435624 - DNA, 25 bp, Homo sapien
ttagtttattagtactgtacttcaa

SEQ ID NO: 435625 - DNA, 25 bp, Homo sapien
tagtttattagtactgtacttcaaa

SEQ ID NO: 435626 - DNA, 25 bp, Homo sapien
tttattagtactgtacttcaaaaag

SEQ ID NO: 435627 - DNA, 25 bp, Homo sapien
ttattagtactgtacttcaaaaaga

SEQ ID NO: 435628 - DNA, 25 bp, Homo sapien
attagtactgtacttcaaaaagatt

SEQ ID NO: 435629 - DNA, 25 bp, Homo sapien
ttagtactgtacttcaaaaagattt

SEQ ID NO: 435630 - DNA, 25 bp, Homo sapien
tagtactgtacttcaaaaagatttt

SEQ ID NO: 435631 - DNA, 25 bp, Homo sapien
tttaaataggtccggcacggtggct

SEQ ID NO: 435632 - DNA, 25 bp, Homo sapien
ttaaataggtccggcacggtggctc

SEQ ID NO: 435633 - DNA, 25 bp, Homo sapien
tgtgtcctacattcgcccaggtatg

SEQ ID NO: 435634 - DNA, 25 bp, Homo sapien
gtgtcctacattcgcccaggtatgc

SEQ ID NO: 435635 - DNA, 25 bp, Homo sapien
ctacattcgcccaggtatgcacata

SEQ ID NO: 435636 - DNA, 25 bp, Homo sapien
acattcgcccaggtatgcacatacg

SEQ ID NO: 435637 - DNA, 25 bp, Homo sapien
attcgcccaggtatgcacatacgcc

SEQ ID NO: 435638 - DNA, 25 bp, Homo sapien
gcccaggtatgcacatacgcccagg

SEQ ID NO: 435639 - DNA, 25 bp, Homo sapien
caggtatgcacatacgcccaggtac

SEQ ID NO: 435640 - DNA, 25 bp, Homo sapien
caggtacgcatgcttacctgggcgt

SEQ ID NO: 435641 - DNA, 25 bp, Homo sapien
acctgggcgtatggcgtacggtcag

SEQ ID NO: 435642 - DNA, 25 bp, Homo sapien
gtatggcgtacggtcagagaagcca

SEQ ID NO: 435643 - DNA, 25 bp, Homo sapien
ggcgtacggtcagagaagccatcac

SEQ ID NO: 435644 - DNA, 25 bp, Homo sapien
tggcttcaggacatgggttctcttc

SEQ ID NO: 435645 - DNA, 25 bp, Homo sapien
gttctcttctcctgtgatcattcaa

SEQ ID NO: 435646 - DNA, 25 bp, Homo sapien
gtgatcattcaagtgctcactgcat

SEQ ID NO: 435647 - DNA, 25 bp, Homo sapien
gtgctcactgcatgaagactggctt

SEQ ID NO: 435648 - DNA, 25 bp, Homo sapien
gactggcttgtctcagtgtttcaac

SEQ ID NO: 435649 - DNA, 25 bp, Homo sapien
tcaccagggctgtctcttggtccac

SEQ ID NO: 435650 - DNA, 25 bp, Homo sapien
gctccctgttagtgccgtatgacag

SEQ ID NO: 435651 - DNA, 25 bp, Homo sapien
cttggccaagtcacggtttctctgt

SEQ ID NO: 435652 - DNA, 25 bp, Homo sapien
gtttctctgtggtcaaggttggttg

SEQ ID NO: 435653 - DNA, 25 bp, Homo sapien
aaggaggccacgtgagcagtcagca

SEQ ID NO: 435654 - DNA, 25 bp, Homo sapien
acgtgagcagtcagcaccagttctg

SEQ ID NO: 435655 - DNA, 25 bp, Homo sapien
gagagaggatttctattcaccttta

SEQ ID NO: 435656 - DNA, 25 bp, Homo sapien
agcccaccgcttctgtacatgtcta

SEQ ID NO: 435657 - DNA, 25 bp, Homo sapien
gtgggtaggattgtgaatttctgat

SEQ ID NO: 435658 - DNA, 25 bp, Homo sapien
gaatttctgatgcagggccttttta

SEQ ID NO: 435659 - DNA, 25 bp, Homo sapien
ataggttagggtagcatcattcaga

SEQ ID NO: 435660 - DNA, 25 bp, Homo sapien
gggtagcatcattcagacttctctg

SEQ ID NO: 435661 - DNA, 25 bp, Homo sapien
gcatcattcagacttctctgttgtt

SEQ ID NO: 435662 - DNA, 25 bp, Homo sapien
ttctctgttgtttttgtccctgtct

SEQ ID NO: 435663 - DNA, 25 bp, Homo sapien
gtccctgtctttttcttatgttgtg

SEQ ID NO: 435664 - DNA, 25 bp, Homo sapien
gtctttttcttatgttgtgttacta

SEQ ID NO: 435665 - DNA, 25 bp, Homo sapien
ttttagatcctccctttcctataga

SEQ ID NO: 435666 - DNA, 25 bp, Homo sapien
gaagggactcacctgcccggcagat

SEQ ID NO: 435667 - DNA, 25 bp, Homo sapien
gctgctgccagctacacctccgttg

SEQ ID NO: 435668 - DNA, 25 bp, Homo sapien
aggccctgggatcaaaccctgccca

SEQ ID NO: 435669 - DNA, 25 bp, Homo sapien
tgggatcaaaccctgcccaccagct

SEQ ID NO: 435670 - DNA, 25 bp, Homo sapien
cagctgccacgtcctgtaaccaaaa

SEQ ID NO: 435671 - DNA, 25 bp, Homo sapien
tcctgtaaccaaaagtgaccgggat

SEQ ID NO: 435672 - DNA, 25 bp, Homo sapien
ctgtaaccaaaagtgaccgggatga

SEQ ID NO: 435673 - DNA, 25 bp, Homo sapien
gtaaccaaaagtgaccgggatgaat

SEQ ID NO: 435674 - DNA, 25 bp, Homo sapien
aagtgaccgggatgaatgcctggct

SEQ ID NO: 435675 - DNA, 25 bp, Homo sapien
agtgaccgggatgaatgcctggctc

SEQ ID NO: 435676 - DNA, 25 bp, Homo sapien
gtgaccgggatgaatgcctggctcc

SEQ ID NO: 435677 - DNA, 25 bp, Homo sapien
agttaagttcccacggcatatgctg

SEQ ID NO: 435678 - DNA, 25 bp, Homo sapien
cccacggcatatgctggccataaaa

SEQ ID NO: 435679 - DNA, 25 bp, Homo sapien
atgctggccataaaaacttcaccaa

SEQ ID NO: 435680 - DNA, 25 bp, Homo sapien
ttttggtgactctgagtgctggcag

SEQ ID NO: 435681 - DNA, 25 bp, Homo sapien
gtgactctgagtgctggcagttgca

SEQ ID NO: 435682 - DNA, 25 bp, Homo sapien
gcagttgcagcgatggtgagttata

SEQ ID NO: 435683 - DNA, 25 bp, Homo sapien
tatatcaccagaataaatgtttgca

SEQ ID NO: 435684 - DNA, 25 bp, Homo sapien
gcaaaaattgtcaggagcgcctcct

SEQ ID NO: 435685 - DNA, 25 bp, Homo sapien
aaattgtcaggagcgcctccttcca

SEQ ID NO: 435686 - DNA, 25 bp, Homo sapien
caccacgcaggtcaaaacaaccaga

SEQ ID NO: 435687 - DNA, 25 bp, Homo sapien
aaacaaccagaatgaacgggtcact

SEQ ID NO: 435688 - DNA, 25 bp, Homo sapien
cttcttgcttagagtttattgataa

SEQ ID NO: 435689 - DNA, 25 bp, Homo sapien
agaatatcccatttaaatgtacagt

SEQ ID NO: 435690 - DNA, 25 bp, Homo sapien
ccacttagtggctctttgtgactgg

SEQ ID NO: 435691 - DNA, 25 bp, Homo sapien
acttagtggctctttgtgactggca

SEQ ID NO: 435692 - DNA, 25 bp, Homo sapien
gtgactggcagttctgtatatctga

SEQ ID NO: 435693 - DNA, 25 bp, Homo sapien
ggcagttctgtatatctgaaacaaa

SEQ ID NO: 435694 - DNA, 25 bp, Homo sapien
ctgaaacaaataagctgtaagcact

SEQ ID NO: 435695 - DNA, 25 bp, Homo sapien
gtcaaataatccttttatgtacttg

SEQ ID NO: 435696 - DNA, 25 bp, Homo sapien
atgtacttgttctcagacctgttct

SEQ ID NO: 435697 - DNA, 25 bp, Homo sapien
ctgttctctggttatgaaatgtgtt

SEQ ID NO: 435698 - DNA, 25 bp, Homo sapien
tgtgttaaagacaaggtgcaaattt

SEQ ID NO: 435699 - DNA, 25 bp, Homo sapien
ggaagtttgtcctgttaaccaaatg

SEQ ID NO: 435700 - DNA, 25 bp, Homo sapien
taaccaaatggttactgcactacca

SEQ ID NO: 435701 - DNA, 25 bp, Homo sapien
actgcactaccagggttactggttt

SEQ ID NO: 435702 - DNA, 25 bp, Homo sapien
ttactggtttattttccagggagct

SEQ ID NO: 435703 - DNA, 25 bp, Homo sapien
aggagaactgttgctgcatgttttc

SEQ ID NO: 435704 - DNA, 25 bp, Homo sapien
gcatgttttctatttggactccgtc

SEQ ID NO: 435705 - DNA, 25 bp, Homo sapien
ttggactccgtcacaatatggtagg

SEQ ID NO: 435706 - DNA, 25 bp, Homo sapien
cacaatatggtaggatatccctcac

SEQ ID NO: 435707 - DNA, 25 bp, Homo sapien
ccgacactcagcagacttgttttta

SEQ ID NO: 435708 - DNA, 25 bp, Homo sapien
cattcttactacgtattttttgact

SEQ ID NO: 435709 - DNA, 25 bp, Homo sapien
gagccaatgatgatatttgctttag

SEQ ID NO: 435710 - DNA, 25 bp, Homo sapien
ttctgccagcatctgttgatcagtg

SEQ ID NO: 435711 - DNA, 25 bp, Homo sapien
tgccagcatctgttgatcagtgagt

SEQ ID NO: 435712 - DNA, 25 bp, Homo sapien
agcatctgttgatcagtgagtgagt

SEQ ID NO: 435713 - DNA, 25 bp, Homo sapien
gcaggagccagtgaagagcaggccc

SEQ ID NO: 435714 - DNA, 25 bp, Homo sapien
ccacattgtcggagaagcctctgca

SEQ ID NO: 435715 - DNA, 25 bp, Homo sapien
attgtcggagaagcctctgcaccag

SEQ ID NO: 435716 - DNA, 25 bp, Homo sapien
gtcggagaagcctctgcaccagctc

SEQ ID NO: 435717 - DNA, 25 bp, Homo sapien
agaggggcactctgcagtctgtccc

SEQ ID NO: 435718 - DNA, 25 bp, Homo sapien
gctggacttctggacatggcctcca

SEQ ID NO: 435719 - DNA, 25 bp, Homo sapien
tggacatggcctccagatttgcacc

SEQ ID NO: 435720 - DNA, 25 bp, Homo sapien
ggcctccagatttgcacctcttaaa

SEQ ID NO: 435721 - DNA, 25 bp, Homo sapien
ctgcctctcaattcatgcatatgta

SEQ ID NO: 435722 - DNA, 25 bp, Homo sapien
aagtaaagtccaagttgactgctga

SEQ ID NO: 435723 - DNA, 25 bp, Homo sapien
gactgctgaaaggtgctcctaccat

SEQ ID NO: 435724 - DNA, 25 bp, Homo sapien
gctgaaaggtgctcctaccattatt

SEQ ID NO: 435725 - DNA, 25 bp, Homo sapien
cataattaatgtgctgtcttctaac

SEQ ID NO: 435726 - DNA, 25 bp, Homo sapien
gtgctgtcttctaacatgtatcagt

SEQ ID NO: 435727 - DNA, 25 bp, Homo sapien
gtatcagttgtctggagttgctgga

SEQ ID NO: 435728 - DNA, 25 bp, Homo sapien
ggaagacaggagcacctcatatcta

SEQ ID NO: 435729 - DNA, 25 bp, Homo sapien
tcatatctaccccacgctggctgtg

SEQ ID NO: 435730 - DNA, 25 bp, Homo sapien
aatccttgctggacggagcttatat

SEQ ID NO: 435731 - DNA, 25 bp, Homo sapien
cacccagacctactgtagaatcaat

SEQ ID NO: 435732 - DNA, 25 bp, Homo sapien
tgtcaagctggaacagtctttagtg

SEQ ID NO: 435733 - DNA, 25 bp, Homo sapien
tttagtgaacacagcttacctcttt

SEQ ID NO: 435734 - DNA, 25 bp, Homo sapien
gtgaacacagcttacctcttttaaa

SEQ ID NO: 435735 - DNA, 25 bp, Homo sapien
tttaaaactgctggtttctactgaa

SEQ ID NO: 435736 - DNA, 25 bp, Homo sapien
tactgaaggaaacatggatgacatt

SEQ ID NO: 435737 - DNA, 25 bp, Homo sapien
ggatgacatttagtgttctgtgact

SEQ ID NO: 435738 - DNA, 25 bp, Homo sapien
gttctgtgactggtctggcacccta

SEQ ID NO: 435739 - DNA, 25 bp, Homo sapien
ctggcaccctacttttgttgacaaa

SEQ ID NO: 435740 - DNA, 25 bp, Homo sapien
gggtctaaaagtcatgtcacttata

SEQ ID NO: 435741 - DNA, 25 bp, Homo sapien
ttagagcagaactaagaccacttag

SEQ ID NO: 435742 - DNA, 25 bp, Homo sapien
agaccagagacttatatctctgcat

SEQ ID NO: 435743 - DNA, 25 bp, Homo sapien
gtaagctttggtacaagctgacctt

SEQ ID NO: 435744 - DNA, 25 bp, Homo sapien
aagctgacctttctatagcgtgctg

SEQ ID NO: 435745 - DNA, 25 bp, Homo sapien
gacctttctatagcgtgctgcattg

SEQ ID NO: 435746 - DNA, 25 bp, Homo sapien
tagcgtgctgcattggtaaatgaaa

SEQ ID NO: 435747 - DNA, 25 bp, Homo sapien
tttccttgtaaattgccagcatcag

SEQ ID NO: 435748 - DNA, 25 bp, Homo sapien
gccagcatcagcttaaaaactcctg

SEQ ID NO: 435749 - DNA, 25 bp, Homo sapien
aactcctgtatgttacatatcgtac

SEQ ID NO: 435750 - DNA, 25 bp, Homo sapien
atcgtaccattttaatctcttcaac

SEQ ID NO: 435751 - DNA, 25 bp, Homo sapien
tctcttcaactttctttgtaccttc

SEQ ID NO: 435752 - DNA, 25 bp, Homo sapien
ggctgtatgctttctcttttaactt

SEQ ID NO: 435753 - DNA, 25 bp, Homo sapien
tgtatgctttctcttttaacttttt

SEQ ID NO: 435754 - DNA, 25 bp, Homo sapien
aatcgggccaagaaacgaggtgacg

SEQ ID NO: 435755 - DNA, 25 bp, Homo sapien
atcgggccaagaaacgaggtgacgt

SEQ ID NO: 435756 - DNA, 25 bp, Homo sapien
tcgggccaagaaacgaggtgacgtg

SEQ ID NO: 435757 - DNA, 25 bp, Homo sapien
cgggccaagaaacgaggtgacgtgg

SEQ ID NO: 435758 - DNA, 25 bp, Homo sapien
gggccaagaaacgaggtgacgtggg

SEQ ID NO: 435759 - DNA, 25 bp, Homo sapien
caagaaacgaggtgacgtggggcct

SEQ ID NO: 435760 - DNA, 25 bp, Homo sapien
gaggtgacgtggggcctcgtgtggg

SEQ ID NO: 435761 - DNA, 25 bp, Homo sapien
gtgacgtggggcctcgtgtggggtc

SEQ ID NO: 435762 - DNA, 25 bp, Homo sapien
tgacgtggggcctcgtgtggggtca

SEQ ID NO: 435763 - DNA, 25 bp, Homo sapien
gacgtggggcctcgtgtggggtcag

SEQ ID NO: 435764 - DNA, 25 bp, Homo sapien
acgtggggcctcgtgtggggtcagg

SEQ ID NO: 435765 - DNA, 25 bp, Homo sapien
aaatcaaaaaccactctgctatctg

SEQ ID NO: 435766 - DNA, 25 bp, Homo sapien
aaaaccactctgctatctgactaaa

SEQ ID NO: 435767 - DNA, 25 bp, Homo sapien
ctctgctatctgactaaaccagtga

SEQ ID NO: 435768 - DNA, 25 bp, Homo sapien
aaaccagtgatgtcgctgttctgcc

SEQ ID NO: 435769 - DNA, 25 bp, Homo sapien
tgatgtcgctgttctgccactagat

SEQ ID NO: 435770 - DNA, 25 bp, Homo sapien
tgttctgccactagatggccataat

SEQ ID NO: 435771 - DNA, 25 bp, Homo sapien
ggccataatggctcagctaagtcac

SEQ ID NO: 435772 - DNA, 25 bp, Homo sapien
aatggctcagctaagtcacccaaac

SEQ ID NO: 435773 - DNA, 25 bp, Homo sapien
ctgtccctttcctgactgttggtgg

SEQ ID NO: 435774 - DNA, 25 bp, Homo sapien
gctgtcagaccatgccttcttctac

SEQ ID NO: 435775 - DNA, 25 bp, Homo sapien
catgccttcttctacagcttcattg

SEQ ID NO: 435776 - DNA, 25 bp, Homo sapien
cagaccgggacgcagcgaccacaag

SEQ ID NO: 435777 - DNA, 25 bp, Homo sapien
gacgcagcgaccacaagcgtggctg

SEQ ID NO: 435778 - DNA, 25 bp, Homo sapien
gaccacaagcgtggctgcgggacgg

SEQ ID NO: 435779 - DNA, 25 bp, Homo sapien
aggcgccgccgggtgaagcaggtgt

SEQ ID NO: 435780 - DNA, 25 bp, Homo sapien
gtgaagcaggtgtcccggagggccg

SEQ ID NO: 435781 - DNA, 25 bp, Homo sapien
tcccttctctggcagcactgcgagg

SEQ ID NO: 435782 - DNA, 25 bp, Homo sapien
gcggcgcggaccagtcgtacacgta

SEQ ID NO: 435783 - DNA, 25 bp, Homo sapien
gcggaccagtcgtacacgtaggaca

SEQ ID NO: 435784 - DNA, 25 bp, Homo sapien
tcgtacacgtaggacaggcgcagct

SEQ ID NO: 435785 - DNA, 25 bp, Homo sapien
acacgtaggacaggcgcagctgcac

SEQ ID NO: 435786 - DNA, 25 bp, Homo sapien
tgcacctcgcgcttgcacaggcggc

SEQ ID NO: 435787 - DNA, 25 bp, Homo sapien
actactcttgtccctgagaaggcag

SEQ ID NO: 435788 - DNA, 25 bp, Homo sapien
tggataccttgggcctttcccttat

SEQ ID NO: 435789 - DNA, 25 bp, Homo sapien
ttgggcctttcccttattcctgcac

SEQ ID NO: 435790 - DNA, 25 bp, Homo sapien
tcctgcccctacctgggagaaggtt

SEQ ID NO: 435791 - DNA, 25 bp, Homo sapien
gagaaggttcaagtattgcgctgat

SEQ ID NO: 435792 - DNA, 25 bp, Homo sapien
aaggttcaagtattgcgctgatggg

SEQ ID NO: 435793 - DNA, 25 bp, Homo sapien
tggtcccacagtctttaatgctgta

SEQ ID NO: 435794 - DNA, 25 bp, Homo sapien
cagtctttaatgctgtagagtagga

SEQ ID NO: 435795 - DNA, 25 bp, Homo sapien
gtgagggtggtaaaggactactctt

SEQ ID NO: 435796 - DNA, 25 bp, Homo sapien
ggtaaaggactactcttgtccctga

SEQ ID NO: 435797 - DNA, 25 bp, Homo sapien
aaggactactcttgtccctgagaag

SEQ ID NO: 435798 - DNA, 25 bp, Homo sapien
tggcctcttccctgaatcagcttca

SEQ ID NO: 435799 - DNA, 25 bp, Homo sapien
tgaatcagcttcaagatggcaccag

SEQ ID NO: 435800 - DNA, 25 bp, Homo sapien
caagatggcaccagctctttgggcc

SEQ ID NO: 435801 - DNA, 25 bp, Homo sapien
agctctttgggcctaggatactgcc

SEQ ID NO: 435802 - DNA, 25 bp, Homo sapien
ctttgggcctaggatactgccgggc

SEQ ID NO: 435803 - DNA, 25 bp, Homo sapien
tggcctcctggtgtctgcggtcaca

SEQ ID NO: 435804 - DNA, 25 bp, Homo sapien
gtgtctgcggtcacagtggcccctg

SEQ ID NO: 435805 - DNA, 25 bp, Homo sapien
caggctgaccctgaggtgctgctgc

SEQ ID NO: 435806 - DNA, 25 bp, Homo sapien
ctgctgggtctgtcttggctctggg

SEQ ID NO: 435807 - DNA, 25 bp, Homo sapien
ccctctgaaagctaagtgtctgtgt

SEQ ID NO: 435808 - DNA, 25 bp, Homo sapien
tggagctcgagggtctgtgaataaa

SEQ ID NO: 435809 - DNA, 25 bp, Homo sapien
agtttctgggtgttctcagttggaa

SEQ ID NO: 435810 - DNA, 25 bp, Homo sapien
tgttctcagttggaagcaagagcca

SEQ ID NO: 435811 - DNA, 25 bp, Homo sapien
ggtgagggtcccacagaccaaatca

SEQ ID NO: 435812 - DNA, 25 bp, Homo sapien
ttcccctggtgttgacttcctggca

SEQ ID NO: 435813 - DNA, 25 bp, Homo sapien
ggccaacagggcatagtccattttg

SEQ ID NO: 435814 - DNA, 25 bp, Homo sapien
gcatagtccattttggaggagtccc

SEQ ID NO: 435815 - DNA, 25 bp, Homo sapien
gaagggaattcagttacttttcctg

SEQ ID NO: 435816 - DNA, 25 bp, Homo sapien
aattcagttacttttcctgttcagc

SEQ ID NO: 435817 - DNA, 25 bp, Homo sapien
ctgttcagccgctcctgggaggact

SEQ ID NO: 435818 - DNA, 25 bp, Homo sapien
ccgctcctgggaggactgtgccttg

SEQ ID NO: 435819 - DNA, 25 bp, Homo sapien
gggctcccacagtttctgggtgttc

SEQ ID NO: 435820 - DNA, 25 bp, Homo sapien
tgtttataaccttttagctatctaa

SEQ ID NO: 435821 - DNA, 25 bp, Homo sapien
ataatacgtattccatactcaggat

SEQ ID NO: 435822 - DNA, 25 bp, Homo sapien
ccatactcaggatagctggttagct

SEQ ID NO: 435823 - DNA, 25 bp, Homo sapien
gctggttagctagcaaaagaattaa

SEQ ID NO: 435824 - DNA, 25 bp, Homo sapien
tacttgcaaactttactgaagccat

SEQ ID NO: 435825 - DNA, 25 bp, Homo sapien
tgaagccatattcattatcttcctt

SEQ ID NO: 435826 - DNA, 25 bp, Homo sapien
attatcttccttgtcaccaaggctg

SEQ ID NO: 435827 - DNA, 25 bp, Homo sapien
gtcaccaaggctgttgaccttaaat

SEQ ID NO: 435828 - DNA, 25 bp, Homo sapien
gattttgcacaacactgtatttgtg

SEQ ID NO: 435829 - DNA, 25 bp, Homo sapien
ttatgtttgtttccgcatatattca

SEQ ID NO: 435830 - DNA, 25 bp, Homo sapien
attctgtaacttttctcgagtggtg

SEQ ID NO: 435831 - DNA, 25 bp, Homo sapien
cgatttgcgctttgccggactggat

SEQ ID NO: 435832 - DNA, 25 bp, Homo sapien
gcgctttgccggactggatggagtg

SEQ ID NO: 435833 - DNA, 25 bp, Homo sapien
ctactccccgaagttaccagctcag

SEQ ID NO: 435834 - DNA, 25 bp, Homo sapien
ttaccagctcagctcgagtcttcag

SEQ ID NO: 435835 - DNA, 25 bp, Homo sapien
agctcagctcgagtcttcagggctg

SEQ ID NO: 435836 - DNA, 25 bp, Homo sapien
accctcactggcctccagtgggatt

SEQ ID NO: 435837 - DNA, 25 bp, Homo sapien
acaggccacccctggcttgggctgg

SEQ ID NO: 435838 - DNA, 25 bp, Homo sapien
cttgggctgggttctgtgaagttac

SEQ ID NO: 435839 - DNA, 25 bp, Homo sapien
gctgggttctgtgaagttacgtatt

SEQ ID NO: 435840 - DNA, 25 bp, Homo sapien
gtgaagttacgtatttattgagctt

SEQ ID NO: 435841 - DNA, 25 bp, Homo sapien
tattgagcttttggttcttttataa

SEQ ID NO: 435842 - DNA, 25 bp, Homo sapien
aaagctacatattgcctaatactct

SEQ ID NO: 435843 - DNA, 25 bp, Homo sapien
gcctaatactctatttcagtgtcgt

SEQ ID NO: 435844 - DNA, 25 bp, Homo sapien
agtttatttccctgattggcacaaa

SEQ ID NO: 435845 - DNA, 25 bp, Homo sapien
ttggcacaaacacaagagtttcctt

SEQ ID NO: 435846 - DNA, 25 bp, Homo sapien
gtttccttgaaccatgtaccaagca

SEQ ID NO: 435847 - DNA, 25 bp, Homo sapien
tttcatgaagaaatccccaggctgg

SEQ ID NO: 435848 - DNA, 25 bp, Homo sapien
tgaagaaatccccaggctggcagtt

SEQ ID NO: 435849 - DNA, 25 bp, Homo sapien
gttggaactatatgtattgctgata

SEQ ID NO: 435850 - DNA, 25 bp, Homo sapien
agggctccagaatatgtgctctgtg

SEQ ID NO: 435851 - DNA, 25 bp, Homo sapien
agaatatgtgctctgtggtcgctgc

SEQ ID NO: 435852 - DNA, 25 bp, Homo sapien
tatgtgctctgtggtcgctgcgctg

SEQ ID NO: 435853 - DNA, 25 bp, Homo sapien
agtttgatgctcttttcacagaccc

SEQ ID NO: 435854 - DNA, 25 bp, Homo sapien
ttgatgctcttttcacagacccagc

SEQ ID NO: 435855 - DNA, 25 bp, Homo sapien
tgtgtcctacattcgcccaggtatg

SEQ ID NO: 435856 - DNA, 25 bp, Homo sapien
ctacattcgcccaggtatgcacata

SEQ ID NO: 435857 - DNA, 25 bp, Homo sapien
acattcgcccaggtatgcacatacg

SEQ ID NO: 435858 - DNA, 25 bp, Homo sapien
caggtatgcacatacgcccaggtac

SEQ ID NO: 435859 - DNA, 25 bp, Homo sapien
caggtacgcatgcttacctgggcgt

SEQ ID NO: 435860 - DNA, 25 bp, Homo sapien
acctgggcgtatggcgtacggtcag

SEQ ID NO: 435861 - DNA, 25 bp, Homo sapien
ggcgtacggtcagagaagccatcac

SEQ ID NO: 435862 - DNA, 25 bp, Homo sapien
atcacctcagatggcagcttttaaa

SEQ ID NO: 435863 - DNA, 25 bp, Homo sapien
ttatctctcaacaccatgattcctt

SEQ ID NO: 435864 - DNA, 25 bp, Homo sapien
tagtgttttgtgctactgatgatga

SEQ ID NO: 435865 - DNA, 25 bp, Homo sapien
gatgatgagctgtacactgcttaga

SEQ ID NO: 435866 - DNA, 25 bp, Homo sapien
agtgaggcaatttacaatcctaaac

SEQ ID NO: 435867 - DNA, 25 bp, Homo sapien
aaactcaaccacatatttgggcctt

SEQ ID NO: 435868 - DNA, 25 bp, Homo sapien
catatttgggcctttacttgccttt

SEQ ID NO: 435869 - DNA, 25 bp, Homo sapien
aagagcttctcagtacatattctac

SEQ ID NO: 435870 - DNA, 25 bp, Homo sapien
gaagcaattgttgtttgtgcctcct

SEQ ID NO: 435871 - DNA, 25 bp, Homo sapien
ttgtttgtgcctcctgttgccattg

SEQ ID NO: 435872 - DNA, 25 bp, Homo sapien
gccattgtccaaacacccattgtaa

SEQ ID NO: 435873 - DNA, 25 bp, Homo sapien
attgtaaacagtgctccgaccctga

SEQ ID NO: 435874 - DNA, 25 bp, Homo sapien
agtgctccgaccctgaaaaaggaat

SEQ ID NO: 435875 - DNA, 25 bp, Homo sapien
gtttgaaatccacttctacgggcac

SEQ ID NO: 435876 - DNA, 25 bp, Homo sapien
gaaatccacttctacgggcacgaag

SEQ ID NO: 435877 - DNA, 25 bp, Homo sapien
gggcacgaagccacttagctccaaa

SEQ ID NO: 435878 - DNA, 25 bp, Homo sapien
atcatttaagcccagacattcgaga

SEQ ID NO: 435879 - DNA, 25 bp, Homo sapien
tagctccaaagccaaggagcgcttt

SEQ ID NO: 435880 - DNA, 25 bp, Homo sapien
gaagaggtcccaactggtgcagatc

SEQ ID NO: 435881 - DNA, 25 bp, Homo sapien
tttaagcccagacattcgagaccac

SEQ ID NO: 435882 - DNA, 25 bp, Homo sapien
gtcccaactggtgcagatccaaggt

SEQ ID NO: 435883 - DNA, 25 bp, Homo sapien
gtgcagatccaaggtttcccatggg

SEQ ID NO: 435884 - DNA, 25 bp, Homo sapien
gaggtgagggctgtacgatctccaa

SEQ ID NO: 435885 - DNA, 25 bp, Homo sapien
tgagggctgtacgatctccaaggaa

SEQ ID NO: 435886 - DNA, 25 bp, Homo sapien
agatggagtgaacgtgccaccttcc

SEQ ID NO: 435887 - DNA, 25 bp, Homo sapien
gcctccacttctagacgggagaagt

SEQ ID NO: 435888 - DNA, 25 bp, Homo sapien
gcttgctgtctccataaaggctgtg

SEQ ID NO: 435889 - DNA, 25 bp, Homo sapien
tgtctccataaaggctgtgcacacc

SEQ ID NO: 435890 - DNA, 25 bp, Homo sapien
accctgcttgagaagcttgggcgat

SEQ ID NO: 435891 - DNA, 25 bp, Homo sapien
gggcgatgcgttttattttcaagta

SEQ ID NO: 435892 - DNA, 25 bp, Homo sapien
caaagaccacttactttctctccag

SEQ ID NO: 435893 - DNA, 25 bp, Homo sapien
agccacctccagatgcgcttgcaag

SEQ ID NO: 435894 - DNA, 25 bp, Homo sapien
cagatgcgcttgcaagctgtgcctg

SEQ ID NO: 435895 - DNA, 25 bp, Homo sapien
gggccacctccagatagttgccaaa

SEQ ID NO: 435896 - DNA, 25 bp, Homo sapien
cccacacttcactgtcactttggag

SEQ ID NO: 435897 - DNA, 25 bp, Homo sapien
agaaacatttgcaaagatcttgagg

SEQ ID NO: 435898 - DNA, 25 bp, Homo sapien
ggcataaatgagcttgagacatctg

SEQ ID NO: 435899 - DNA, 25 bp, Homo sapien
gagggccacagaaggcttccttgag

SEQ ID NO: 435900 - DNA, 25 bp, Homo sapien
gagccgcagagccattgctaaccat

SEQ ID NO: 435901 - DNA, 25 bp, Homo sapien
ttgctaaccatcctgtgtgagatat

SEQ ID NO: 435902 - DNA, 25 bp, Homo sapien
taaccatcctgtgtgagatatcccc

SEQ ID NO: 435903 - DNA, 25 bp, Homo sapien
ccccattctgtagctttattctcat

SEQ ID NO: 435904 - DNA, 25 bp, Homo sapien
gtagctttattctcataaccctgct

SEQ ID NO: 435905 - DNA, 25 bp, Homo sapien
cttccttgagcccttgagaaagtga

SEQ ID NO: 435906 - DNA, 25 bp, Homo sapien
gagcccttgagaaagtgatttgcat

SEQ ID NO: 435907 - DNA, 25 bp, Homo sapien
gtgatttgcatctgagttctgaagg

SEQ ID NO: 435908 - DNA, 25 bp, Homo sapien
agtttgatgctcttttcacagaccc

SEQ ID NO: 435909 - DNA, 25 bp, Homo sapien
gtttgatgctcttttcacagaccca

SEQ ID NO: 435910 - DNA, 25 bp, Homo sapien
tttgatgctcttttcacagacccag

SEQ ID NO: 435911 - DNA, 25 bp, Homo sapien
ttgatgctcttttcacagacccagc

SEQ ID NO: 435912 - DNA, 25 bp, Homo sapien
tgatgctcttttcacagacccagcc

SEQ ID NO: 435913 - DNA, 25 bp, Homo sapien
taccatctgtgtacctcttcagggg

SEQ ID NO: 435914 - DNA, 25 bp, Homo sapien
accatctgtgtacctcttcaggggt

SEQ ID NO: 435915 - DNA, 25 bp, Homo sapien
ccatctgtgtacctcttcaggggtt

SEQ ID NO: 435916 - DNA, 25 bp, Homo sapien
catctgtgtacctcttcaggggttt

SEQ ID NO: 435917 - DNA, 25 bp, Homo sapien
aaaatccaccaaacacagcaactgc

SEQ ID NO: 435918 - DNA, 25 bp, Homo sapien
tgccttctcaacataactgtcgact

SEQ ID NO: 435919 - DNA, 25 bp, Homo sapien
aaatgcctctggaataagttggaaa

SEQ ID NO: 435920 - DNA, 25 bp, Homo sapien
aaaagagtcccaatagccagcccca

SEQ ID NO: 435921 - DNA, 25 bp, Homo sapien
tagccagccccacaaaaaaggtcaa

SEQ ID NO: 435922 - DNA, 25 bp, Homo sapien
aagatttctttatcagtggagtcaa

SEQ ID NO: 435923 - DNA, 25 bp, Homo sapien
gtggagtcaaaatcaatccgaggag

SEQ ID NO: 435924 - DNA, 25 bp, Homo sapien
atccgaggagagatgccagattaat

SEQ ID NO: 435925 - DNA, 25 bp, Homo sapien
aatcgtcactgacaggaatccatat

SEQ ID NO: 435926 - DNA, 25 bp, Homo sapien
aatccatatccccaaacttctgaat

SEQ ID NO: 435927 - DNA, 25 bp, Homo sapien
ataacatctttagcattctttcaaa

SEQ ID NO: 435928 - DNA, 25 bp, Homo sapien
tcaccgtccacagctttggaataaa

SEQ ID NO: 435929 - DNA, 25 bp, Homo sapien
gtacttccagtcgaatgctgaaccg

SEQ ID NO: 435930 - DNA, 25 bp, Homo sapien
agtcgaatgctgaaccgcgctgccc

SEQ ID NO: 435931 - DNA, 25 bp, Homo sapien
tgcaacgactactggccccacgaga

SEQ ID NO: 435932 - DNA, 25 bp, Homo sapien
ccacgagatcccaaaagtcttcgac

SEQ ID NO: 435933 - DNA, 25 bp, Homo sapien
aaaagtcttcgaccctgagaaggag

SEQ ID NO: 435934 - DNA, 25 bp, Homo sapien
ggtccaggcagcattagccatcgtg

SEQ ID NO: 435935 - DNA, 25 bp, Homo sapien
gccttgagtggcctgatcgccacag

SEQ ID NO: 435936 - DNA, 25 bp, Homo sapien
gtgtttcaggttccacgcgagtcac

SEQ ID NO: 435937 - DNA, 25 bp, Homo sapien
gagtcacctctttcgtcttaatgtt

SEQ ID NO: 435938 - DNA, 25 bp, Homo sapien
tttcgtcttaatgttcaccgtccac

SEQ ID NO: 435939 - DNA, 25 bp, Homo sapien
atctttatcctcctgacgctcgtct

SEQ ID NO: 435940 - DNA, 25 bp, Homo sapien
tgacgctcgtctatgcctactggac

SEQ ID NO: 435941 - DNA, 25 bp, Homo sapien
cgtctatgcctactggaccatgtga

SEQ ID NO: 435942 - DNA, 25 bp, Homo sapien
tatgcctactggaccatgtgagcct

SEQ ID NO: 435943 - DNA, 25 bp, Homo sapien
actggaccatgtgagcctggcactt

SEQ ID NO: 435944 - DNA, 25 bp, Homo sapien
atgtgagcctggcacttccccacaa

SEQ ID NO: 435945 - DNA, 25 bp, Homo sapien
tcaggatcaagcaggcacttcaagc

SEQ ID NO: 435946 - DNA, 25 bp, Homo sapien
caagcctcaataggaccaaggtgct

SEQ ID NO: 435947 - DNA, 25 bp, Homo sapien
ctcccaacctagtgttcaagcatgg

SEQ ID NO: 435948 - DNA, 25 bp, Homo sapien
aacctagtgttcaagcatggcttcc

SEQ ID NO: 435949 - DNA, 25 bp, Homo sapien
aagggagaggcaataaagaacacaa

SEQ ID NO: 435950 - DNA, 25 bp, Homo sapien
atgtaacagaccatggccccatgaa

SEQ ID NO: 435951 - DNA, 25 bp, Homo sapien
gtaacagaccatggccccatgaaat

SEQ ID NO: 435952 - DNA, 25 bp, Homo sapien
catggccccatgaaatgatcccgga

SEQ ID NO: 435953 - DNA, 25 bp, Homo sapien
atggccccatgaaatgatcccggac

SEQ ID NO: 435954 - DNA, 25 bp, Homo sapien
ccccatgaaatgatcccggaccaga

SEQ ID NO: 435955 - DNA, 25 bp, Homo sapien
gaaatgatcccggaccagatccgtc

SEQ ID NO: 435956 - DNA, 25 bp, Homo sapien
aatgatcccggaccagatccgtcca

SEQ ID NO: 435957 - DNA, 25 bp, Homo sapien
tggccgagctcacagtacaaccaca

SEQ ID NO: 435958 - DNA, 25 bp, Homo sapien
ccgagctcacagtacaaccacaata

SEQ ID NO: 435959 - DNA, 25 bp, Homo sapien
gagctcacagtacaaccacaataaa

SEQ ID NO: 435960 - DNA, 25 bp, Homo sapien
agtacaaccacaataaactcttgtt

SEQ ID NO: 435961 - DNA, 25 bp, Homo sapien
ttctgggcaagatgttctttagagt

SEQ ID NO: 435962 - DNA, 25 bp, Homo sapien
tagagtaagcaaacctacaacctaa

SEQ ID NO: 435963 - DNA, 25 bp, Homo sapien
gtgacgagacctcttcaaaaaccca

SEQ ID NO: 435964 - DNA, 25 bp, Homo sapien
ccagtctgccaccaaacatgaacaa

SEQ ID NO: 435965 - DNA, 25 bp, Homo sapien
aaattctgctgctaatcggtttccc

SEQ ID NO: 435966 - DNA, 25 bp, Homo sapien
tctgctgctaatcggtttcccttgt

SEQ ID NO: 435967 - DNA, 25 bp, Homo sapien
tttcccttgtgatctggttcctgag

SEQ ID NO: 435968 - DNA, 25 bp, Homo sapien
tgatctggttcctgaggtcttcgga

SEQ ID NO: 435969 - DNA, 25 bp, Homo sapien
tgaggtcttcggatctgtgcaatga

SEQ ID NO: 435970 - DNA, 25 bp, Homo sapien
taaaccgacagtggtgtcccagaga

SEQ ID NO: 435971 - DNA, 25 bp, Homo sapien
aatggaaatctggtgctgtgataaa

SEQ ID NO: 435972 - DNA, 25 bp, Homo sapien
agcaacctgagcaggcacgtgcgct

SEQ ID NO: 435973 - DNA, 25 bp, Homo sapien
gtgcgctcgcatggtgacaagctgt

SEQ ID NO: 435974 - DNA, 25 bp, Homo sapien
gcaaaattgttcagccgcaaagaga

SEQ ID NO: 435975 - DNA, 25 bp, Homo sapien
gagagcctaaagcagcacgtttcct

SEQ ID NO: 435976 - DNA, 25 bp, Homo sapien
agcagcacgtttcctacaagcacag

SEQ ID NO: 435977 - DNA, 25 bp, Homo sapien
gcgagtacaggtaccgctgcggcac

SEQ ID NO: 435978 - DNA, 25 bp, Homo sapien
taccgctgcggcacttgtgagaaga

SEQ ID NO: 435979 - DNA, 25 bp, Homo sapien
tgagaagaccttccgcatcgagagc

SEQ ID NO: 435980 - DNA, 25 bp, Homo sapien
atcgagagcgcgctggagttccaca

SEQ ID NO: 435981 - DNA, 25 bp, Homo sapien
ggagttccacaactgcaggacaggt

SEQ ID NO: 435982 - DNA, 25 bp, Homo sapien
ctcggccgctgtgcggtacggattc

SEQ ID NO: 435983 - DNA, 25 bp, Homo sapien
gttactacattatgtaaacatccaa

SEQ ID NO: 435984 - DNA, 25 bp, Homo sapien
tacaattttagagttgtggaaactg

SEQ ID NO: 435985 - DNA, 25 bp, Homo sapien
agagtagttctgtaacattcccaca

SEQ ID NO: 435986 - DNA, 25 bp, Homo sapien
agtagttctgtaacattcccacaca

SEQ ID NO: 435987 - DNA, 25 bp, Homo sapien
agttctgtaacattcccacacagct

SEQ ID NO: 435988 - DNA, 25 bp, Homo sapien
cacagctgagaaatgaaggaggcaa

SEQ ID NO: 435989 - DNA, 25 bp, Homo sapien
aaggaggcaagatttcaacctggca

SEQ ID NO: 435990 - DNA, 25 bp, Homo sapien
ggcaagatttcaacctggcagttta

SEQ ID NO: 435991 - DNA, 25 bp, Homo sapien
atttcaacctggcagtttagctcca

SEQ ID NO: 435992 - DNA, 25 bp, Homo sapien
tcaacctggcagtttagctccagaa

SEQ ID NO: 435993 - DNA, 25 bp, Homo sapien
ggcagtttagctccagaacctgtac

SEQ ID NO: 435994 - DNA, 25 bp, Homo sapien
ttggagatctgtgccgtggtcctga

SEQ ID NO: 435995 - DNA, 25 bp, Homo sapien
tggtcctgaggcagttgtctccaca

SEQ ID NO: 435996 - DNA, 25 bp, Homo sapien
acaagtactacttcctcgtgggcta

SEQ ID NO: 435997 - DNA, 25 bp, Homo sapien
ctacttcctcgtgggctacagtgaa

SEQ ID NO: 435998 - DNA, 25 bp, Homo sapien
cagtgaaactttgctgtcctacttt

SEQ ID NO: 435999 - DNA, 25 bp, Homo sapien
ttacaaatgtcctgtgcgactccac

SEQ ID NO: 436000 - DNA, 25 bp, Homo sapien
aactgtgccctcaaaggttgtgtat

SEQ ID NO: 436001 - DNA, 25 bp, Homo sapien
taagtacctctagaacaatcccctt

SEQ ID NO: 436002 - DNA, 25 bp, Homo sapien
atccccttttttccatcaagctgta

SEQ ID NO: 436003 - DNA, 25 bp, Homo sapien
catcaagctgtagcctgcagagaat

SEQ ID NO: 436004 - DNA, 25 bp, Homo sapien
ggcatagtctctcatctgctattga

SEQ ID NO: 436005 - DNA, 25 bp, Homo sapien
agcgcttgatccagcacgagctctg

SEQ ID NO: 436006 - DNA, 25 bp, Homo sapien
acgagctctgggtatttcttgccgt

SEQ ID NO: 436007 - DNA, 25 bp, Homo sapien
ttgccgtcgctgtgattgcgagtga

SEQ ID NO: 436008 - DNA, 25 bp, Homo sapien
gtagttctgaactgtgttgctacct

SEQ ID NO: 436009 - DNA, 25 bp, Homo sapien
ttgctacctacgtccaaatcttgag

SEQ ID NO: 436010 - DNA, 25 bp, Homo sapien
ggatggctgccttcggagattttca

SEQ ID NO: 436011 - DNA, 25 bp, Homo sapien
ggaggatttcattttccaagaattc

SEQ ID NO: 436012 - DNA, 25 bp, Homo sapien
ggcatggtcatttacatcttggagc

SEQ ID NO: 436013 - DNA, 25 bp, Homo sapien
atcttggagctgtagttcaccttga

SEQ ID NO: 436014 - DNA, 25 bp, Homo sapien
ttcaccttgaataaactgcaccgga

SEQ ID NO: 436015 - DNA, 25 bp, Homo sapien
tgcaccggatttttcagtaacatct

SEQ ID NO: 436016 - DNA, 25 bp, Homo sapien
gaccttgtggttaagaatccgatcc

SEQ ID NO: 436017 - DNA, 25 bp, Homo sapien
aatccgatccttaacattgaggctg

SEQ ID NO: 436018 - DNA, 25 bp, Homo sapien
attgaggctgataagtggacttcca

SEQ ID NO: 436019 - DNA, 25 bp, Homo sapien
aagtggacttccaagtctcaaccac

SEQ ID NO: 436020 - DNA, 25 bp, Homo sapien
aaccaccctgtggagccaaagaact

SEQ ID NO: 436021 - DNA, 25 bp, Homo sapien
ggtatcctcccggattgatattctt

SEQ ID NO: 436022 - DNA, 25 bp, Homo sapien
tgatattcttcgtttgctccttcaa

SEQ ID NO: 436023 - DNA, 25 bp, Homo sapien
ttcaacagctggaggcaaccctgga

SEQ ID NO: 436024 - DNA, 25 bp, Homo sapien
gatattcagtatcctttccttggtc

SEQ ID NO: 436025 - DNA, 25 bp, Homo sapien
tttccttggtcctgtacctaccaga

SEQ ID NO: 436026 - DNA, 25 bp, Homo sapien
gggtggattctttaattctggctgt

SEQ ID NO: 436027 - DNA, 25 bp, Homo sapien
gagcagcacacagggtaaatatgaa

SEQ ID NO: 436028 - DNA, 25 bp, Homo sapien
gttgcaagcaatcttgttgcttcaa

SEQ ID NO: 436029 - DNA, 25 bp, Homo sapien
cttcaaacattttcttcagttgctt

SEQ ID NO: 436030 - DNA, 25 bp, Homo sapien
tcagttgcttcacaggtcccattaa

SEQ ID NO: 436031 - DNA, 25 bp, Homo sapien
taacgcagcaagattgccgagggta

SEQ ID NO: 436032 - DNA, 25 bp, Homo sapien
gattgccgagggtataaaacactgc

SEQ ID NO: 436033 - DNA, 25 bp, Homo sapien
caaaaagctttatgccgcccggaag

SEQ ID NO: 436034 - DNA, 25 bp, Homo sapien
gaagccacagcaatccagttccaag

SEQ ID NO: 436035 - DNA, 25 bp, Homo sapien
gaaaacgccacatacgaagcagatg

SEQ ID NO: 436036 - DNA, 25 bp, Homo sapien
gatggcaaaccatttcaatctggtg

SEQ ID NO: 436037 - DNA, 25 bp, Homo sapien
gatgaggcatccaggacctgcgcag

SEQ ID NO: 436038 - DNA, 25 bp, Homo sapien
cttcatcctgatcccgttttgcttt

SEQ ID NO: 436039 - DNA, 25 bp, Homo sapien
tttgctttgaagagaccccagtaac

SEQ ID NO: 436040 - DNA, 25 bp, Homo sapien
agaagccaaaaccatgcctggatct

SEQ ID NO: 436041 - DNA, 25 bp, Homo sapien
aaaaccatgcctggatctcccatag

SEQ ID NO: 436042 - DNA, 25 bp, Homo sapien
atgcctggatctcccatagcttctc

SEQ ID NO: 436043 - DNA, 25 bp, Homo sapien
aaaatatcttctggcttcttgtgtg

SEQ ID NO: 436044 - DNA, 25 bp, Homo sapien
atcttctggcttcttgtgtgtacag

SEQ ID NO: 436045 - DNA, 25 bp, Homo sapien
ggaatcttttctgcaccaaagctgc

SEQ ID NO: 436046 - DNA, 25 bp, Homo sapien
ttttctgcaccaaagctgcttctaa

SEQ ID NO: 436047 - DNA, 25 bp, Homo sapien
gctcttggtgtttcatgctgcctta

SEQ ID NO: 436048 - DNA, 25 bp, Homo sapien
ggtgtttcatgctgccttatttata

SEQ ID NO: 436049 - DNA, 25 bp, Homo sapien
gagttattattatctcatagcgtat

SEQ ID NO: 436050 - DNA, 25 bp, Homo sapien
gaataattttgattgacctctggga

SEQ ID NO: 436051 - DNA, 25 bp, Homo sapien
ttgattgacctctgggatgttatta

SEQ ID NO: 436052 - DNA, 25 bp, Homo sapien
taaagcctaacgttccttctattct

SEQ ID NO: 436053 - DNA, 25 bp, Homo sapien
aacgttccttctattctcacaaatt

SEQ ID NO: 436054 - DNA, 25 bp, Homo sapien
cacaaattttcgttatgacttcaga

SEQ ID NO: 436055 - DNA, 25 bp, Homo sapien
gaaggatcattaactctggtatctg

SEQ ID NO: 436056 - DNA, 25 bp, Homo sapien
aactctggtatctgtttgtttgctt

SEQ ID NO: 436057 - DNA, 25 bp, Homo sapien
gtttgtttgcttgtatggcaccaat

SEQ ID NO: 436058 - DNA, 25 bp, Homo sapien
gtatggcaccaataagcagatttct

SEQ ID NO: 436059 - DNA, 25 bp, Homo sapien
ccaggagaaggctaatacagagact

SEQ ID NO: 436060 - DNA, 25 bp, Homo sapien
gagaaattttagacagcagctctgt

SEQ ID NO: 436061 - DNA, 25 bp, Homo sapien
aattttagacagcagctctgtgttc

SEQ ID NO: 436062 - DNA, 25 bp, Homo sapien
tgttctttttttgccgcagccaata

SEQ ID NO: 436063 - DNA, 25 bp, Homo sapien
gaattagccaatcctaaaaccttct

SEQ ID NO: 436064 - DNA, 25 bp, Homo sapien
ttgacgtgtgtttttagtttagaag

SEQ ID NO: 436065 - DNA, 25 bp, Homo sapien
gaagtgctgtattccacaaggttta

SEQ ID NO: 436066 - DNA, 25 bp, Homo sapien
attccacaaggtttaagtcagtgag

SEQ ID NO: 436067 - DNA, 25 bp, Homo sapien
cagtgaggttggaagataccctatc

SEQ ID NO: 436068 - DNA, 25 bp, Homo sapien
gaagataccctatcttttttattca

SEQ ID NO: 436069 - DNA, 25 bp, Homo sapien
taaagtacaacttgcttttagcatg

SEQ ID NO: 436070 - DNA, 25 bp, Homo sapien
ttgcttttagcatgattattttcct

SEQ ID NO: 436071 - DNA, 25 bp, Homo sapien
ctcatgcacaccttttatacagcca

SEQ ID NO: 436072 - DNA, 25 bp, Homo sapien
ttatacagccatagtgcactgcaat

SEQ ID NO: 436073 - DNA, 25 bp, Homo sapien
tgcactgcaatactcatagtcccct

SEQ ID NO: 436074 - DNA, 25 bp, Homo sapien
tagtcccctcagtgagtatatcaga

SEQ ID NO: 436075 - DNA, 25 bp, Homo sapien
tcagattgtctcatgcttttgtgcc

SEQ ID NO: 436076 - DNA, 25 bp, Homo sapien
gtgcctttacacaagatgttccttt

SEQ ID NO: 436077 - DNA, 25 bp, Homo sapien
gatgttccttttacccattgagaat

SEQ ID NO: 436078 - DNA, 25 bp, Homo sapien
gagaatcataccctatcagatccct

SEQ ID NO: 436079 - DNA, 25 bp, Homo sapien
accaccactttatttcagaggcctt

SEQ ID NO: 436080 - DNA, 25 bp, Homo sapien
tatatgcttctacaacattcgtggt

SEQ ID NO: 436081 - DNA, 25 bp, Homo sapien
aacattcgtggtacttacaatcata

SEQ ID NO: 436082 - DNA, 25 bp, Homo sapien
ggcctagctgtgtataaatgatcct

SEQ ID NO: 436083 - DNA, 25 bp, Homo sapien
gctgtgtataaatgatccttgctga

SEQ ID NO: 436084 - DNA, 25 bp, Homo sapien
gatccttgctgaatatcttaaggtt

SEQ ID NO: 436085 - DNA, 25 bp, Homo sapien
aatgaaacctcttttgcaacttaag

SEQ ID NO: 436086 - DNA, 25 bp, Homo sapien
tttgcaacttaagaattctatggaa

SEQ ID NO: 436087 - DNA, 25 bp, Homo sapien
tcatattttgtgtccatgcaccatt

SEQ ID NO: 436088 - DNA, 25 bp, Homo sapien
ttgtgtccatgcaccatttttctta

SEQ ID NO: 436089 - DNA, 25 bp, Homo sapien
gtaaacaatttgtgatctggccagt

SEQ ID NO: 436090 - DNA, 25 bp, Homo sapien
gatctggccagttgtacttttagct

SEQ ID NO: 436091 - DNA, 25 bp, Homo sapien
cagttgtacttttagctcccagagg

SEQ ID NO: 436092 - DNA, 25 bp, Homo sapien
ttgtacttttagctcccagagggag

SEQ ID NO: 436093 - DNA, 25 bp, Homo sapien
aaaatggtggcttgcttctcagtac

SEQ ID NO: 436094 - DNA, 25 bp, Homo sapien
tggtggcttgcttctcagtaccaat

SEQ ID NO: 436095 - DNA, 25 bp, Homo sapien
agttttcaaacctacacgttgatgt

SEQ ID NO: 436096 - DNA, 25 bp, Homo sapien
aacctacacgttgatgttccaaagg

SEQ ID NO: 436097 - DNA, 25 bp, Homo sapien
ccaaaggatttgaccaaacctgtgg

SEQ ID NO: 436098 - DNA, 25 bp, Homo sapien
aacaatctctgatgaaccagacata

SEQ ID NO: 436099 - DNA, 25 bp, Homo sapien
gacatattatataagcgcctctcgg

SEQ ID NO: 436100 - DNA, 25 bp, Homo sapien
aagcgcctctcggttttggtgaaag

SEQ ID NO: 436101 - DNA, 25 bp, Homo sapien
gaaaggtcacgataaggctgtattg

SEQ ID NO: 436102 - DNA, 25 bp, Homo sapien
ggctgtattggacagttatgaatat

SEQ ID NO: 436103 - DNA, 25 bp, Homo sapien
ttttctgtaaacacttctaagggca

SEQ ID NO: 436104 - DNA, 25 bp, Homo sapien
ttacaggcacccgtcaagggatttt

SEQ ID NO: 436105 - DNA, 25 bp, Homo sapien
tacaggcacccgtcaagggattttc

SEQ ID NO: 436106 - DNA, 25 bp, Homo sapien
caggcacccgtcaagggattttcct

SEQ ID NO: 436107 - DNA, 25 bp, Homo sapien
aggcacccgtcaagggattttcctg

SEQ ID NO: 436108 - DNA, 25 bp, Homo sapien
ggcacccgtcaagggattttcctgc

SEQ ID NO: 436109 - DNA, 25 bp, Homo sapien
cacccgtcaagggattttcctgcct

SEQ ID NO: 436110 - DNA, 25 bp, Homo sapien
cccgtcaagggattttcctgcctca

SEQ ID NO: 436111 - DNA, 25 bp, Homo sapien
ccagtagctggtattataggggcct

SEQ ID NO: 436112 - DNA, 25 bp, Homo sapien
cagtagctggtattataggggcctg

SEQ ID NO: 436113 - DNA, 25 bp, Homo sapien
gtagctggtattataggggcctgcc

SEQ ID NO: 436114 - DNA, 25 bp, Homo sapien
ggtattataggggcctgccaccacg

SEQ ID NO: 436115 - DNA, 25 bp, Homo sapien
tgtacctccaccgaccagaagaata

SEQ ID NO: 436116 - DNA, 25 bp, Homo sapien
caccgaccagaagaatacaagcaga

SEQ ID NO: 436117 - DNA, 25 bp, Homo sapien
gagtacatccagaaatacgccacgg

SEQ ID NO: 436118 - DNA, 25 bp, Homo sapien
atacgccacggaggaggcgctgaaa

SEQ ID NO: 436119 - DNA, 25 bp, Homo sapien
gggacagctcatcggagagctctat

SEQ ID NO: 436120 - DNA, 25 bp, Homo sapien
gagctctatgtctgacttttccgaa

SEQ ID NO: 436121 - DNA, 25 bp, Homo sapien
tgacttttccgaagatgaggcccag

SEQ ID NO: 436122 - DNA, 25 bp, Homo sapien
atgaggcccaggatatggagttgta

SEQ ID NO: 436123 - DNA, 25 bp, Homo sapien
gttgtagtagaaaaagcacctgctt

SEQ ID NO: 436124 - DNA, 25 bp, Homo sapien
agactattatttcctaaccatgaga

SEQ ID NO: 436125 - DNA, 25 bp, Homo sapien
tcctaaccatgagaagcagactata

SEQ ID NO: 436126 - DNA, 25 bp, Homo sapien
gttgggacaagtacagtaaccctcg

SEQ ID NO: 436127 - DNA, 25 bp, Homo sapien
tgggacaagtacagtaaccctcgcc

SEQ ID NO: 436128 - DNA, 25 bp, Homo sapien
ggacaagtacagtaaccctcgcccg

SEQ ID NO: 436129 - DNA, 25 bp, Homo sapien
gacaagtacagtaaccctcgcccgt

SEQ ID NO: 436130 - DNA, 25 bp, Homo sapien
agtacagtaaccctcgcccgtcaag

SEQ ID NO: 436131 - DNA, 25 bp, Homo sapien
gtacagtaaccctcgcccgtcaaga

SEQ ID NO: 436132 - DNA, 25 bp, Homo sapien
tcaagacgggccagggctgtggcga

SEQ ID NO: 436133 - DNA, 25 bp, Homo sapien
ggtctgactcagttcctgcggggaa

SEQ ID NO: 436134 - DNA, 25 bp, Homo sapien
gggaacttcaccagtgacccagtca

SEQ ID NO: 436135 - DNA, 25 bp, Homo sapien
ccagtcagtgcccttcagttaaaga

SEQ ID NO: 436136 - DNA, 25 bp, Homo sapien
cagtcagtgcccttcagttaaagac

SEQ ID NO: 436137 - DNA, 25 bp, Homo sapien
gagcaagtggcttaatgttcccatc

SEQ ID NO: 436138 - DNA, 25 bp, Homo sapien
gtggcttaatgttcccatcttattt

SEQ ID NO: 436139 - DNA, 25 bp, Homo sapien
aatgttcccatcttatttataaaat

SEQ ID NO: 436140 - DNA, 25 bp, Homo sapien
tgagcttaataatccctcttctgtt

SEQ ID NO: 436141 - DNA, 25 bp, Homo sapien
gatagcatttgtaaagcttagtaca

SEQ ID NO: 436142 - DNA, 25 bp, Homo sapien
agcttagtacagtatctggcactta

SEQ ID NO: 436143 - DNA, 25 bp, Homo sapien
ttagtacagtatctggcacttagta

SEQ ID NO: 436144 - DNA, 25 bp, Homo sapien
tagtaggcattcaatggccaaaaaa

SEQ ID NO: 436145 - DNA, 25 bp, Homo sapien
gaggatggcagagccaagcaacctg

SEQ ID NO: 436146 - DNA, 25 bp, Homo sapien
atttactggctattgtgacattgag

SEQ ID NO: 436147 - DNA, 25 bp, Homo sapien
tattgtgacattgagcaagtggctt

SEQ ID NO: 436148 - DNA, 25 bp, Homo sapien
aaagaacacttttgtcagactccaa

SEQ ID NO: 436149 - DNA, 25 bp, Homo sapien
gaacacttttgtcagactccaaaat

SEQ ID NO: 436150 - DNA, 25 bp, Homo sapien
gtatatacttccaggccataagagt

SEQ ID NO: 436151 - DNA, 25 bp, Homo sapien
tacttccaggccataagagttgatg

SEQ ID NO: 436152 - DNA, 25 bp, Homo sapien
aggccataagagttgatggtattat

SEQ ID NO: 436153 - DNA, 25 bp, Homo sapien
tattgagaagggatcgtgtttacag

SEQ ID NO: 436154 - DNA, 25 bp, Homo sapien
gatcgtgtttacagaggacttcttt

SEQ ID NO: 436155 - DNA, 25 bp, Homo sapien
ttacagaggacttctttaaagtgtc

SEQ ID NO: 436156 - DNA, 25 bp, Homo sapien
gatacaattgcagtgttgtgcttgt

SEQ ID NO: 436157 - DNA, 25 bp, Homo sapien
attgcagtgttgtgcttgttgtcaa

SEQ ID NO: 436158 - DNA, 25 bp, Homo sapien
agtgttgtgcttgttgtcaatgaca

SEQ ID NO: 436159 - DNA, 25 bp, Homo sapien
gaatccattctttacaatatgcagt

SEQ ID NO: 436160 - DNA, 25 bp, Homo sapien
tatgcagtgagatgggcttaagttt

SEQ ID NO: 436161 - DNA, 25 bp, Homo sapien
agtttgggctagagtttgactttat

SEQ ID NO: 436162 - DNA, 25 bp, Homo sapien
aagagaacagtgacgtaggcaaatg

SEQ ID NO: 436163 - DNA, 25 bp, Homo sapien
ttcaagcactttagaaacagtactt

SEQ ID NO: 436164 - DNA, 25 bp, Homo sapien
gaaacagtacttttcctataattag

SEQ ID NO: 436165 - DNA, 25 bp, Homo sapien
ccatgccaataagtttcctgctgtg

SEQ ID NO: 436166 - DNA, 25 bp, Homo sapien
tttcctgctgtgtctgttaggcagc

SEQ ID NO: 436167 - DNA, 25 bp, Homo sapien
gttaggcagcattgctttgatgcaa

SEQ ID NO: 436168 - DNA, 25 bp, Homo sapien
tgatgcaatttctattgtcctatat

SEQ ID NO: 436169 - DNA, 25 bp, Homo sapien
ctacattccagtaaaaatatcccgt

SEQ ID NO: 436170 - DNA, 25 bp, Homo sapien
cagcgtgaggtgaacacttctgggt

SEQ ID NO: 436171 - DNA, 25 bp, Homo sapien
gaggtgaacacttctgggtttgccc

SEQ ID NO: 436172 - DNA, 25 bp, Homo sapien
ggagcaccacgttctgggcctggag

SEQ ID NO: 436173 - DNA, 25 bp, Homo sapien
gggcctggagtgtgctgcgtgtccc

SEQ ID NO: 436174 - DNA, 25 bp, Homo sapien
agccacctacacgtgtgtggtcagc

SEQ ID NO: 436175 - DNA, 25 bp, Homo sapien
gtggtcagccacgaggactcccgga

SEQ ID NO: 436176 - DNA, 25 bp, Homo sapien
ggactctgctcaacgccagccggag

SEQ ID NO: 436177 - DNA, 25 bp, Homo sapien
ccggagcctagaagtcagctatgta

SEQ ID NO: 436178 - DNA, 25 bp, Homo sapien
gagcctagaagtcagctatgtaaca

SEQ ID NO: 436179 - DNA, 25 bp, Homo sapien
tatgtaacagaccatggccccatga

SEQ ID NO: 436180 - DNA, 25 bp, Homo sapien
atggccccatgaaatgatcccggac

SEQ ID NO: 436181 - DNA, 25 bp, Homo sapien
ataaagcaaacagtggaagacggat

SEQ ID NO: 436182 - DNA, 25 bp, Homo sapien
ggaagacggattggtaccatacaaa

SEQ ID NO: 436183 - DNA, 25 bp, Homo sapien
gacggattggtaccatacaaaaacg

SEQ ID NO: 436184 - DNA, 25 bp, Homo sapien
atcagatagaacttacaatttccat

SEQ ID NO: 436185 - DNA, 25 bp, Homo sapien
acaatttccataaagttatccggag

SEQ ID NO: 436186 - DNA, 25 bp, Homo sapien
aaagttatccggagtgtgcctgccc

SEQ ID NO: 436187 - DNA, 25 bp, Homo sapien
gttatccggagtgtgcctgcccctt

SEQ ID NO: 436188 - DNA, 25 bp, Homo sapien
gtcaccccgagacagcgaagagcaa

SEQ ID NO: 436189 - DNA, 25 bp, Homo sapien
gagacagcgaagagcaacccctcct

SEQ ID NO: 436190 - DNA, 25 bp, Homo sapien
tcctcagcctactcattattaagat

SEQ ID NO: 436191 - DNA, 25 bp, Homo sapien
cagcctactcattattaagatgatg

SEQ ID NO: 436192 - DNA, 25 bp, Homo sapien
ataaaacctctctgaaaccatttga

SEQ ID NO: 436193 - DNA, 25 bp, Homo sapien
gaaaccatttgaatctttgatccta

SEQ ID NO: 436194 - DNA, 25 bp, Homo sapien
atttgaatctttgatcctaccatag

SEQ ID NO: 436195 - DNA, 25 bp, Homo sapien
gaatctttgatcctaccatagagtt

SEQ ID NO: 436196 - DNA, 25 bp, Homo sapien
atctttgatcctaccatagagtttt

SEQ ID NO: 436197 - DNA, 25 bp, Homo sapien
acattttgatgtacttgctcttgaa

SEQ ID NO: 436198 - DNA, 25 bp, Homo sapien
ttttgatgtacttgctcttgaaagc

SEQ ID NO: 436199 - DNA, 25 bp, Homo sapien
gatgtacttgctcttgaaagcacta

SEQ ID NO: 436200 - DNA, 25 bp, Homo sapien
gtacttgctcttgaaagcactagaa

SEQ ID NO: 436201 - DNA, 25 bp, Homo sapien
gctcttgaaagcactagaacaaatt

SEQ ID NO: 436202 - DNA, 25 bp, Homo sapien
gaaataaaacctctctgaaaccatt

SEQ ID NO: 436203 - DNA, 25 bp, Homo sapien
agctggtttctctgtctccagttga

SEQ ID NO: 436204 - DNA, 25 bp, Homo sapien
gtctccagttgaactctgctgtggg

SEQ ID NO: 436205 - DNA, 25 bp, Homo sapien
aaatcactgaactgtccagcctgga

SEQ ID NO: 436206 - DNA, 25 bp, Homo sapien
tggatgacggcagcacctcacttgc

SEQ ID NO: 436207 - DNA, 25 bp, Homo sapien
acctcacttgccttgctgctgggag

SEQ ID NO: 436208 - DNA, 25 bp, Homo sapien
gaatggtagctgtgattatcatcat

SEQ ID NO: 436209 - DNA, 25 bp, Homo sapien
tgattatcatcatggctgcactggg

SEQ ID NO: 436210 - DNA, 25 bp, Homo sapien
tgagtggcacaggtctcttgctcac

SEQ ID NO: 436211 - DNA, 25 bp, Homo sapien
acaggtctcttgctcactgtatgtc

SEQ ID NO: 436212 - DNA, 25 bp, Homo sapien
gctcactgtatgtcccctgtggact

SEQ ID NO: 436213 - DNA, 25 bp, Homo sapien
agcagtgacccttgggaagtctcat

SEQ ID NO: 436214 - DNA, 25 bp, Homo sapien
aagttcctgaagccggtgattccca

SEQ ID NO: 436215 - DNA, 25 bp, Homo sapien
agttcctgaagccggtgattcccaa

SEQ ID NO: 436216 - DNA, 25 bp, Homo sapien
ttcctgaagccggtgattcccaatc

SEQ ID NO: 436217 - DNA, 25 bp, Homo sapien
tcctgaagccggtgattcccaatct

SEQ ID NO: 436218 - DNA, 25 bp, Homo sapien
ctgaagccggtgattcccaatctcc

SEQ ID NO: 436219 - DNA, 25 bp, Homo sapien
tgaagccggtgattcccaatctcct

SEQ ID NO: 436220 - DNA, 25 bp, Homo sapien
gaagccggtgattcccaatctcctg

SEQ ID NO: 436221 - DNA, 25 bp, Homo sapien
aagccggtgattcccaatctcctgt

SEQ ID NO: 436222 - DNA, 25 bp, Homo sapien
agccggtgattcccaatctcctgtc

SEQ ID NO: 436223 - DNA, 25 bp, Homo sapien
cggtgattcccaatctcctgtcccg

SEQ ID NO: 436224 - DNA, 25 bp, Homo sapien
tgattcccaatctcctgtcccgcga

SEQ ID NO: 436225 - DNA, 25 bp, Homo sapien
tgcctccttgagaacatgaaccttt

SEQ ID NO: 436226 - DNA, 25 bp, Homo sapien
ataacaacacgaagacaaagtcctg

SEQ ID NO: 436227 - DNA, 25 bp, Homo sapien
tagagtgcagcgtgcaatcgtgcaa

SEQ ID NO: 436228 - DNA, 25 bp, Homo sapien
gtgcaatcgtgcaatcgcagcctac

SEQ ID NO: 436229 - DNA, 25 bp, Homo sapien
tgcaatcgcagcctacagtaaggta

SEQ ID NO: 436230 - DNA, 25 bp, Homo sapien
cagtaaggtagaattcctggcctca

SEQ ID NO: 436231 - DNA, 25 bp, Homo sapien
gtggcctcctgaagggctccgatta

SEQ ID NO: 436232 - DNA, 25 bp, Homo sapien
ccagccaaacctgtcttttattctg

SEQ ID NO: 436233 - DNA, 25 bp, Homo sapien
aaacctgtcttttattctgtatctc

SEQ ID NO: 436234 - DNA, 25 bp, Homo sapien
agagcagtccctggccctgataagg

SEQ ID NO: 436235 - DNA, 25 bp, Homo sapien
gtccctggccctgataagggttcaa

SEQ ID NO: 436236 - DNA, 25 bp, Homo sapien
gatttagacaacatagctgaccttt

SEQ ID NO: 436237 - DNA, 25 bp, Homo sapien
gctgaccttttatgacaaggcagtt

SEQ ID NO: 436238 - DNA, 25 bp, Homo sapien
caaggcagtttgaatagggactatt

SEQ ID NO: 436239 - DNA, 25 bp, Homo sapien
gggactattgtaataccctcacaca

SEQ ID NO: 436240 - DNA, 25 bp, Homo sapien
ttgtaataccctcacacattatagg

SEQ ID NO: 436241 - DNA, 25 bp, Homo sapien
tctacagagagctttaagaggccgg

SEQ ID NO: 436242 - DNA, 25 bp, Homo sapien
gaaaagacattatcagggcctggaa

SEQ ID NO: 436243 - DNA, 25 bp, Homo sapien
atcagggcctggaaagtctcttcca

SEQ ID NO: 436244 - DNA, 25 bp, Homo sapien
agtctcttccagttcatcagggtag

SEQ ID NO: 436245 - DNA, 25 bp, Homo sapien
atcagggtagtagacctgtcagatt

SEQ ID NO: 436246 - DNA, 25 bp, Homo sapien
ctgtcagattggaggtcaaagtcaa

SEQ ID NO: 436247 - DNA, 25 bp, Homo sapien
tgcacccagcctaatctttataaat

SEQ ID NO: 436248 - DNA, 25 bp, Homo sapien
gcacccagcctaatctttataaatc

SEQ ID NO: 436249 - DNA, 25 bp, Homo sapien
cacccagcctaatctttataaatct

SEQ ID NO: 436250 - DNA, 25 bp, Homo sapien
acccagcctaatctttataaatctc

SEQ ID NO: 436251 - DNA, 25 bp, Homo sapien
ccagcctaatctttataaatctcca

SEQ ID NO: 436252 - DNA, 25 bp, Homo sapien
agcctaatctttataaatctccatc

SEQ ID NO: 436253 - DNA, 25 bp, Homo sapien
tcgtagcttactgcagtaagttcac

SEQ ID NO: 436254 - DNA, 25 bp, Homo sapien
gtagcttactgcagtaagttcactt

SEQ ID NO: 436255 - DNA, 25 bp, Homo sapien
gcttactgcagtaagttcacttgaa

SEQ ID NO: 436256 - DNA, 25 bp, Homo sapien
ttactgcagtaagttcacttgaact

SEQ ID NO: 436257 - DNA, 25 bp, Homo sapien
tgcagtaagttcacttgaactcctg

SEQ ID NO: 436258 - DNA, 25 bp, Homo sapien
gtgactttggaaacaagttatgttt

SEQ ID NO: 436259 - DNA, 25 bp, Homo sapien
gactttggaaacaagttatgttttg

SEQ ID NO: 436260 - DNA, 25 bp, Homo sapien
gtggagaaaaatgtatactcaacaa

SEQ ID NO: 436261 - DNA, 25 bp, Homo sapien
atgtatactcaacaatgtcattttg

SEQ ID NO: 436262 - DNA, 25 bp, Homo sapien
tgtatactcaacaatgtcattttgt

SEQ ID NO: 436263 - DNA, 25 bp, Homo sapien
gtatactcaacaatgtcattttgtg

SEQ ID NO: 436264 - DNA, 25 bp, Homo sapien
tatactcaacaatgtcattttgtga

SEQ ID NO: 436265 - DNA, 25 bp, Homo sapien
atactcaacaatgtcattttgtgac

SEQ ID NO: 436266 - DNA, 25 bp, Homo sapien
tactcaacaatgtcattttgtgact

SEQ ID NO: 436267 - DNA, 25 bp, Homo sapien
actcaacaatgtcattttgtgactt

SEQ ID NO: 436268 - DNA, 25 bp, Homo sapien
ctcaacaatgtcattttgtgacttt

SEQ ID NO: 436269 - DNA, 25 bp, Homo sapien
ctgtgaccccttgggccagggatta

SEQ ID NO: 436270 - DNA, 25 bp, Homo sapien
gtaacccactcattttgtgtgtagg

SEQ ID NO: 436271 - DNA, 25 bp, Homo sapien
agggattaactgctgtcactcttag

SEQ ID NO: 436272 - DNA, 25 bp, Homo sapien
tgctgtcactcttagttccctcaac

SEQ ID NO: 436273 - DNA, 25 bp, Homo sapien
ctcaaccctcaggtgcatgtgatta

SEQ ID NO: 436274 - DNA, 25 bp, Homo sapien
ccctcaggtgcatgtgattatattc

SEQ ID NO: 436275 - DNA, 25 bp, Homo sapien
gattatattcactgcctgatatggt

SEQ ID NO: 436276 - DNA, 25 bp, Homo sapien
gtgtaggcaaaagcaactatgaata

SEQ ID NO: 436277 - DNA, 25 bp, Homo sapien
agtctcccacagtgggtaaatgtgt

SEQ ID NO: 436278 - DNA, 25 bp, Homo sapien
atgtgtggacctgggtttgaaacct

SEQ ID NO: 436279 - DNA, 25 bp, Homo sapien
ggacctgggtttgaaacctgatgaa

SEQ ID NO: 436280 - DNA, 25 bp, Homo sapien
gtggattacccaggctcagggttaa

SEQ ID NO: 436281 - DNA, 25 bp, Homo sapien
tacccaggctcagggttaacagcta

SEQ ID NO: 436282 - DNA, 25 bp, Homo sapien
tgagacacacctagagaagggtttt

SEQ ID NO: 436283 - DNA, 25 bp, Homo sapien
gccagtttctgttgctgccaaagta

SEQ ID NO: 436284 - DNA, 25 bp, Homo sapien
gttgctgccaaagtaatgtggctct

SEQ ID NO: 436285 - DNA, 25 bp, Homo sapien
gccaaagtaatgtggctctctgctg

SEQ ID NO: 436286 - DNA, 25 bp, Homo sapien
accctgtgctgctgaggtgcgtagc

SEQ ID NO: 436287 - DNA, 25 bp, Homo sapien
agtctctagggctgcctgactggag

SEQ ID NO: 436288 - DNA, 25 bp, Homo sapien
tagggctgcctgactggaggccttc

SEQ ID NO: 436289 - DNA, 25 bp, Homo sapien
tgcctgactggaggccttccaaggg

SEQ ID NO: 436290 - DNA, 25 bp, Homo sapien
gggtttcagtctggacttatacagg

SEQ ID NO: 436291 - DNA, 25 bp, Homo sapien
gactgaggttatcagctgctcctga

SEQ ID NO: 436292 - DNA, 25 bp, Homo sapien
tatcagctgctcctgagaccggaat

SEQ ID NO: 436293 - DNA, 25 bp, Homo sapien
agaccggaatctccaggaggtcact

SEQ ID NO: 436294 - DNA, 25 bp, Homo sapien
gggttctgaccatacctgcaggata

SEQ ID NO: 436295 - DNA, 25 bp, Homo sapien
gcctgcgagagccatagcatctgag

SEQ ID NO: 436296 - DNA, 25 bp, Homo sapien
atagcatctgagcatccacctgtgg

SEQ ID NO: 436297 - DNA, 25 bp, Homo sapien
aacagggcctggaactgcccactgg

SEQ ID NO: 436298 - DNA, 25 bp, Homo sapien
tcagctgtgagtccaaggtccagga

SEQ ID NO: 436299 - DNA, 25 bp, Homo sapien
ggtctccttcctcagtcagaatgaa

SEQ ID NO: 436300 - DNA, 25 bp, Homo sapien
aatgaacctgtcgaatctcagccgt

SEQ ID NO: 436301 - DNA, 25 bp, Homo sapien
tgagccacactggagggtcacgttc

SEQ ID NO: 436302 - DNA, 25 bp, Homo sapien
gaggagaccgaagtcaggccctgaa

SEQ ID NO: 436303 - DNA, 25 bp, Homo sapien
aagtcaggccctgaagccggtcctg

SEQ ID NO: 436304 - DNA, 25 bp, Homo sapien
tgaagccggtcctgctctgagctga

SEQ ID NO: 436305 - DNA, 25 bp, Homo sapien
ggtcctgctctgagctgacagactt

SEQ ID NO: 436306 - DNA, 25 bp, Homo sapien
tgctctgagctgacagacttggcca

SEQ ID NO: 436307 - DNA, 25 bp, Homo sapien
tgagctgacagacttggccagtccc

SEQ ID NO: 436308 - DNA, 25 bp, Homo sapien
gggctgtaagcctctccatccggga

SEQ ID NO: 436309 - DNA, 25 bp, Homo sapien
tgtaagcctctccatccgggagctt

SEQ ID NO: 436310 - DNA, 25 bp, Homo sapien
tgggtggctccccactctggaattt

SEQ ID NO: 436311 - DNA, 25 bp, Homo sapien
tctggaatttccctaccaataaaag

SEQ ID NO: 436312 - DNA, 25 bp, Homo sapien
tggaatttccctaccaataaaagca

SEQ ID NO: 436313 - DNA, 25 bp, Homo sapien
ttggttggaacgcattggctttttt

SEQ ID NO: 436314 - DNA, 25 bp, Homo sapien
tggttggaacgcattggcttttttt

SEQ ID NO: 436315 - DNA, 25 bp, Homo sapien
tgttatacattgacattaactgctg

SEQ ID NO: 436316 - DNA, 25 bp, Homo sapien
gttatacattgacattaactgctgt

SEQ ID NO: 436317 - DNA, 25 bp, Homo sapien
ttatacattgacattaactgctgta

SEQ ID NO: 436318 - DNA, 25 bp, Homo sapien
tatacattgacattaactgctgtat

SEQ ID NO: 436319 - DNA, 25 bp, Homo sapien
tacattgacattaactgctgtattt

SEQ ID NO: 436320 - DNA, 25 bp, Homo sapien
gttcaataattttgttctttcaggg

SEQ ID NO: 436321 - DNA, 25 bp, Homo sapien
ttcaataattttgttctttcagggc

SEQ ID NO: 436322 - DNA, 25 bp, Homo sapien
attttgttctttcagggctagaaat

SEQ ID NO: 436323 - DNA, 25 bp, Homo sapien
ttttgttctttcagggctagaaata

SEQ ID NO: 436324 - DNA, 25 bp, Homo sapien
ggctctccatcagttgtgaacatct

SEQ ID NO: 436325 - DNA, 25 bp, Homo sapien
tgtgaacatctattggtttatccca

SEQ ID NO: 436326 - DNA, 25 bp, Homo sapien
ggtttatcccaagtcactaagcata

SEQ ID NO: 436327 - DNA, 25 bp, Homo sapien
ttttccttctacagctgtttctgga

SEQ ID NO: 436328 - DNA, 25 bp, Homo sapien
ctgtttctggagtatagggtcgcat

SEQ ID NO: 436329 - DNA, 25 bp, Homo sapien
ggtcgcatactcataaacccagtgt

SEQ ID NO: 436330 - DNA, 25 bp, Homo sapien
aacccagtgtaactcagaaacgcat

SEQ ID NO: 436331 - DNA, 25 bp, Homo sapien
gcatctaatattccagtaaacccat

SEQ ID NO: 436332 - DNA, 25 bp, Homo sapien
ccatcataagtcacggtttgtccgt

SEQ ID NO: 436333 - DNA, 25 bp, Homo sapien
gggcgtcatcaattccattgtattc

SEQ ID NO: 436334 - DNA, 25 bp, Homo sapien
gtattcagtaatgctgtacaccatt

SEQ ID NO: 436335 - DNA, 25 bp, Homo sapien
atgtgtatggcgtgtgttcttgaaa

SEQ ID NO: 436336 - DNA, 25 bp, Homo sapien
gaaatgatgtctctctgaatatcca

SEQ ID NO: 436337 - DNA, 25 bp, Homo sapien
gactgaccatgatcaatctagcata

SEQ ID NO: 436338 - DNA, 25 bp, Homo sapien
tatgtatgttcagtgggctagcctt

SEQ ID NO: 436339 - DNA, 25 bp, Homo sapien
ttggtcctcagggacagtgtgtgac

SEQ ID NO: 436340 - DNA, 25 bp, Homo sapien
agtgtgtgactctagtggtcttcct

SEQ ID NO: 436341 - DNA, 25 bp, Homo sapien
tagtggtcttcctaaccagtctctt

SEQ ID NO: 436342 - DNA, 25 bp, Homo sapien
gtctcttgcctaaagatatctggga

SEQ ID NO: 436343 - DNA, 25 bp, Homo sapien
atatctgggacctctactggcttta

SEQ ID NO: 436344 - DNA, 25 bp, Homo sapien
gttatgttgaggttatgcttccttt

SEQ ID NO: 436345 - DNA, 25 bp, Homo sapien
atgcttcctttgttatttgctgatt

SEQ ID NO: 436346 - DNA, 25 bp, Homo sapien
ggtgtctggcggatgcggtcgtgaa

SEQ ID NO: 436347 - DNA, 25 bp, Homo sapien
cggtcgtgaagataggtactggttt

SEQ ID NO: 436348 - DNA, 25 bp, Homo sapien
tcgtgaagataggtactggttttgg

SEQ ID NO: 436349 - DNA, 25 bp, Homo sapien
ggtactggttttggattaggaattg

SEQ ID NO: 436350 - DNA, 25 bp, Homo sapien
aaatatgtcaaagagcaggagcagt

SEQ ID NO: 436351 - DNA, 25 bp, Homo sapien
gaacatgtctgagtcggagctcggc

SEQ ID NO: 436352 - DNA, 25 bp, Homo sapien
aacatgtctgagtcggagctcggca

SEQ ID NO: 436353 - DNA, 25 bp, Homo sapien
atgtctgagtcggagctcggcagga

SEQ ID NO: 436354 - DNA, 25 bp, Homo sapien
tctgagtcggagctcggcaggaagt

SEQ ID NO: 436355 - DNA, 25 bp, Homo sapien
gtcggagctcggcaggaagtgggac

SEQ ID NO: 436356 - DNA, 25 bp, Homo sapien
aagtgggaccggtgtctggcggatg

SEQ ID NO: 436357 - DNA, 25 bp, Homo sapien
gagagttttctaatccatataatgc

SEQ ID NO: 436358 - DNA, 25 bp, Homo sapien
taatgcaatgggtcaggttgctcat

SEQ ID NO: 436359 - DNA, 25 bp, Homo sapien
gggtcaggttgctcatatgattaaa

SEQ ID NO: 436360 - DNA, 25 bp, Homo sapien
gtaattttgcaaatgccaacatgaa

SEQ ID NO: 436361 - DNA, 25 bp, Homo sapien
tttaaattcccatttgtctatctta

SEQ ID NO: 436362 - DNA, 25 bp, Homo sapien
aatgccaacatgaatactagtgagt

SEQ ID NO: 436363 - DNA, 25 bp, Homo sapien
taggacaaatgatgacttcttcgtg

SEQ ID NO: 436364 - DNA, 25 bp, Homo sapien
gatgacttcttcgtgtagtaatgaa

SEQ ID NO: 436365 - DNA, 25 bp, Homo sapien
gtgagtactcaatttacgacagaca

SEQ ID NO: 436366 - DNA, 25 bp, Homo sapien
tacgacagacaatttcacaaaaacc

SEQ ID NO: 436367 - DNA, 25 bp, Homo sapien
gagtgatttgatattcttgcttctt

SEQ ID NO: 436368 - DNA, 25 bp, Homo sapien
gtagaccccagtgtttattcattaa

SEQ ID NO: 436369 - DNA, 25 bp, Homo sapien
gaaatgtttaaatctgtctatgcca

SEQ ID NO: 436370 - DNA, 25 bp, Homo sapien
tgtttaaatctgtctatgccatatg

SEQ ID NO: 436371 - DNA, 25 bp, Homo sapien
tttaaatctgtctatgccatatgtg

SEQ ID NO: 436372 - DNA, 25 bp, Homo sapien
aaatctgtctatgccatatgtgcct

SEQ ID NO: 436373 - DNA, 25 bp, Homo sapien
atctgtctatgccatatgtgcctct

SEQ ID NO: 436374 - DNA, 25 bp, Homo sapien
ctgtctatgccatatgtgcctctgg

SEQ ID NO: 436375 - DNA, 25 bp, Homo sapien
tggtttctgtctttaatttttgtca

SEQ ID NO: 436376 - DNA, 25 bp, Homo sapien
gatctcaaaacatctgcttttattg

SEQ ID NO: 436377 - DNA, 25 bp, Homo sapien
caaaacatctgcttttattgtaggg

SEQ ID NO: 436378 - DNA, 25 bp, Homo sapien
attgtaggggctcgtgctgccatct

SEQ ID NO: 436379 - DNA, 25 bp, Homo sapien
gtcaatgacctggtatagcctgtcg

SEQ ID NO: 436380 - DNA, 25 bp, Homo sapien
aatgacctggtatagcctgtcgtac

SEQ ID NO: 436381 - DNA, 25 bp, Homo sapien
tgacctggtatagcctgtcgtacat

SEQ ID NO: 436382 - DNA, 25 bp, Homo sapien
tggtatagcctgtcgtacatcccat

SEQ ID NO: 436383 - DNA, 25 bp, Homo sapien
tagcctgtcgtacatcccatatgca

SEQ ID NO: 436384 - DNA, 25 bp, Homo sapien
tcccatatgcaagggatgcagttat

SEQ ID NO: 436385 - DNA, 25 bp, Homo sapien
gttattaaatgctgttcttctctcc

SEQ ID NO: 436386 - DNA, 25 bp, Homo sapien
attaaatgctgttcttctctcctaa

SEQ ID NO: 436387 - DNA, 25 bp, Homo sapien
taaatgctgttcttctctcctaagt

SEQ ID NO: 436388 - DNA, 25 bp, Homo sapien
aatgctgttcttctctcctaagttg

SEQ ID NO: 436389 - DNA, 25 bp, Homo sapien
tgctgttcttctctcctaagttgaa

SEQ ID NO: 436390 - DNA, 25 bp, Homo sapien
ggagcaccacgttctgggcctggag

SEQ ID NO: 436391 - DNA, 25 bp, Homo sapien
gagcaccacgttctgggcctggagt

SEQ ID NO: 436392 - DNA, 25 bp, Homo sapien
tgggcctggagtgtgctgcgtgtcc

SEQ ID NO: 436393 - DNA, 25 bp, Homo sapien
gggcctggagtgtgctgcgtgtccc

SEQ ID NO: 436394 - DNA, 25 bp, Homo sapien
aggactcccggactctgctcaacgc

SEQ ID NO: 436395 - DNA, 25 bp, Homo sapien
ggactctgctcaacgccagccggag

SEQ ID NO: 436396 - DNA, 25 bp, Homo sapien
gactctgctcaacgccagccggagc

SEQ ID NO: 436397 - DNA, 25 bp, Homo sapien
ccggagcctagaagtcagctatgta

SEQ ID NO: 436398 - DNA, 25 bp, Homo sapien
cggagcctagaagtcagctatgtaa

SEQ ID NO: 436399 - DNA, 25 bp, Homo sapien
ggagcctagaagtcagctatgtaac

SEQ ID NO: 436400 - DNA, 25 bp, Homo sapien
gagcctagaagtcagctatgtaaca

SEQ ID NO: 436401 - DNA, 25 bp, Homo sapien
agcctctggccatcagtcctggtgc

SEQ ID NO: 436402 - DNA, 25 bp, Homo sapien
tcctggtgccagagctttgcgtgaa

SEQ ID NO: 436403 - DNA, 25 bp, Homo sapien
ggtgccagagctttgcgtgaagttc

SEQ ID NO: 436404 - DNA, 25 bp, Homo sapien
cagagctttgcgtgaagttcgggcc

SEQ ID NO: 436405 - DNA, 25 bp, Homo sapien
ctttgcgtgaagttcgggccgcaga

SEQ ID NO: 436406 - DNA, 25 bp, Homo sapien
catgtgctgccgtctgatgtgctca

SEQ ID NO: 436407 - DNA, 25 bp, Homo sapien
gtgctgccgtctgatgtgctcagat

SEQ ID NO: 436408 - DNA, 25 bp, Homo sapien
gatgtgctcagatgggctcatcgtt

SEQ ID NO: 436409 - DNA, 25 bp, Homo sapien
tgggctcatcgttggttcgttttta

SEQ ID NO: 436410 - DNA, 25 bp, Homo sapien
ctcatcgttggttcgtttttactgt

SEQ ID NO: 436411 - DNA, 25 bp, Homo sapien
tcgttggttcgtttttactgtatat

SEQ ID NO: 436412 - DNA, 25 bp, Homo sapien
aaaatttctggttgtctcattagac

SEQ ID NO: 436413 - DNA, 25 bp, Homo sapien
cattagactgatgaggtgagttttc

SEQ ID NO: 436414 - DNA, 25 bp, Homo sapien
ggtgagttttcttcttcatatgaac

SEQ ID NO: 436415 - DNA, 25 bp, Homo sapien
gttaataacagcagagttctcactc

SEQ ID NO: 436416 - DNA, 25 bp, Homo sapien
agagttctcactcagtgctcagtac

SEQ ID NO: 436417 - DNA, 25 bp, Homo sapien
tctcactcagtgctcagtacttaat

SEQ ID NO: 436418 - DNA, 25 bp, Homo sapien
agtacttaattttccactgcaccac

SEQ ID NO: 436419 - DNA, 25 bp, Homo sapien
actgcaccacaactgtcttaactaa

SEQ ID NO: 436420 - DNA, 25 bp, Homo sapien
aactgtcttaactaaatgtgctgta

SEQ ID NO: 436421 - DNA, 25 bp, Homo sapien
agagttctatttggtgttttcagga

SEQ ID NO: 436422 - DNA, 25 bp, Homo sapien
gaatatacgtgaaaagacatgccat

SEQ ID NO: 436423 - DNA, 25 bp, Homo sapien
gacagagcagatcacacaagatttc

SEQ ID NO: 436424 - DNA, 25 bp, Homo sapien
acagtactcagaaaaccacaccatt

SEQ ID NO: 436425 - DNA, 25 bp, Homo sapien
atatttttgaccacagtttcccatg

SEQ ID NO: 436426 - DNA, 25 bp, Homo sapien
tttttgaccacagtttcccatggat

SEQ ID NO: 436427 - DNA, 25 bp, Homo sapien
ctgaaaccatgggaagtggaactgt

SEQ ID NO: 436428 - DNA, 25 bp, Homo sapien
aaccaggttcttaggatgagctact

SEQ ID NO: 436429 - DNA, 25 bp, Homo sapien
ggataaggcaggactactgtaacta

SEQ ID NO: 436430 - DNA, 25 bp, Homo sapien
atgagctactaaatgacaaatgggt

SEQ ID NO: 436431 - DNA, 25 bp, Homo sapien
caaatgggtgggtagtacatagagt

SEQ ID NO: 436432 - DNA, 25 bp, Homo sapien
gtgtagatacaccagacaaagaaat

SEQ ID NO: 436433 - DNA, 25 bp, Homo sapien
aagaaatgattcacagcccaggcag

SEQ ID NO: 436434 - DNA, 25 bp, Homo sapien
tcccaccaatgtgtggtaagcagtt

SEQ ID NO: 436435 - DNA, 25 bp, Homo sapien
aagcagttgtgtcagttggttccca

SEQ ID NO: 436436 - DNA, 25 bp, Homo sapien
gtgtcagttggttcccattaagccc

SEQ ID NO: 436437 - DNA, 25 bp, Homo sapien
tggttcccattaagcccttgggttg

SEQ ID NO: 436438 - DNA, 25 bp, Homo sapien
ggttgaaaccaaaagcctggttgtg

SEQ ID NO: 436439 - DNA, 25 bp, Homo sapien
gtgattagatggattgcagcatgct

SEQ ID NO: 436440 - DNA, 25 bp, Homo sapien
tggattgcagcatgcttgatttttt

SEQ ID NO: 436441 - DNA, 25 bp, Homo sapien
gggtgttagaactgacctggcttct

SEQ ID NO: 436442 - DNA, 25 bp, Homo sapien
gaactgacctggcttcttggcaagt

SEQ ID NO: 436443 - DNA, 25 bp, Homo sapien
ttgttccattgctttctggcgctca

SEQ ID NO: 436444 - DNA, 25 bp, Homo sapien
agcactttcccaccaatgtgtggta

SEQ ID NO: 436445 - DNA, 25 bp, Homo sapien
acgagaccggctacttctcggcgct

SEQ ID NO: 436446 - DNA, 25 bp, Homo sapien
ggagtactggcaacagacctgccta

SEQ ID NO: 436447 - DNA, 25 bp, Homo sapien
gacctgcctagagctggaacgttac

SEQ ID NO: 436448 - DNA, 25 bp, Homo sapien
tggaacgttacctccagagcgagcc

SEQ ID NO: 436449 - DNA, 25 bp, Homo sapien
agagcgagccctgctatgtttcagc

SEQ ID NO: 436450 - DNA, 25 bp, Homo sapien
cctgctatgtttcagcctcagaaat

SEQ ID NO: 436451 - DNA, 25 bp, Homo sapien
gaactgaagatatcttccagtcctc

SEQ ID NO: 436452 - DNA, 25 bp, Homo sapien
gttacaacttagagaccaacagcct

SEQ ID NO: 436453 - DNA, 25 bp, Homo sapien
tagagaccaacagcctgaactcaga

SEQ ID NO: 436454 - DNA, 25 bp, Homo sapien
tgaactcagatgtcagcagcgaatc

SEQ ID NO: 436455 - DNA, 25 bp, Homo sapien
tcagcagcgaatcctctgacagctc

SEQ ID NO: 436456 - DNA, 25 bp, Homo sapien
aacaggcaaggctacgacacgatta

SEQ ID NO: 436457 - DNA, 25 bp, Homo sapien
ggcaaggctacgacacgattactat

SEQ ID NO: 436458 - DNA, 25 bp, Homo sapien
ggctacgacacgattactattgact

SEQ ID NO: 436459 - DNA, 25 bp, Homo sapien
tacgacacgattactattgactaaa

SEQ ID NO: 436460 - DNA, 25 bp, Homo sapien
attgactaaattatgcccgtgccca

SEQ ID NO: 436461 - DNA, 25 bp, Homo sapien
tgactaaattatgcccgtgcccaaa

SEQ ID NO: 436462 - DNA, 25 bp, Homo sapien
aattatgcccgtgcccaaattcaga

SEQ ID NO: 436463 - DNA, 25 bp, Homo sapien
gcccgtgcccaaattcagacgttga

SEQ ID NO: 436464 - DNA, 25 bp, Homo sapien
cccctcagaaggtgactgtaattgg

SEQ ID NO: 436465 - DNA, 25 bp, Homo sapien
gactgtaattggagataggacctta

SEQ ID NO: 436466 - DNA, 25 bp, Homo sapien
taatgagaattgactctagcaatgt

SEQ ID NO: 436467 - DNA, 25 bp, Homo sapien
ccccatttacaatccttcatgtatt

SEQ ID NO: 436468 - DNA, 25 bp, Homo sapien
tacaatccttcatgtattacataga

SEQ ID NO: 436469 - DNA, 25 bp, Homo sapien
catgtattacatagaaggattgctt

SEQ ID NO: 436470 - DNA, 25 bp, Homo sapien
gtattacatagaaggattgcttttt

SEQ ID NO: 436471 - DNA, 25 bp, Homo sapien
taaaaatatactgcgggttggaaag

SEQ ID NO: 436472 - DNA, 25 bp, Homo sapien
aatatactgcgggttggaaagggat

SEQ ID NO: 436473 - DNA, 25 bp, Homo sapien
tactgcgggttggaaagggatattt

SEQ ID NO: 436474 - DNA, 25 bp, Homo sapien
gaaggcgagaggagcagaacatttt

SEQ ID NO: 436475 - DNA, 25 bp, Homo sapien
gagaggagcagaacattttggtcta

SEQ ID NO: 436476 - DNA, 25 bp, Homo sapien
ggagcagaacattttggtctagggt

SEQ ID NO: 436477 - DNA, 25 bp, Homo sapien
cagaacattttggtctagggtggtt

SEQ ID NO: 436478 - DNA, 25 bp, Homo sapien
tatttgggagcccagtgccctttcc

SEQ ID NO: 436479 - DNA, 25 bp, Homo sapien
tgggagcccagtgccctttcctaga

SEQ ID NO: 436480 - DNA, 25 bp, Homo sapien
agcccagtgccctttcctagaattc

SEQ ID NO: 436481 - DNA, 25 bp, Homo sapien
cgacatgtgtcagccatgcctctgt

SEQ ID NO: 436482 - DNA, 25 bp, Homo sapien
acatgtgtcagccatgcctctgtgg

SEQ ID NO: 436483 - DNA, 25 bp, Homo sapien
atggcggcagatgttagccaggtct

SEQ ID NO: 436484 - DNA, 25 bp, Homo sapien
gcagatgttagccaggtctgccctc

SEQ ID NO: 436485 - DNA, 25 bp, Homo sapien
ttcaagccccttctccactgtagca

SEQ ID NO: 436486 - DNA, 25 bp, Homo sapien
cactgtagcaaaataagcaccccca

SEQ ID NO: 436487 - DNA, 25 bp, Homo sapien
tgccttcaggtcttcttcacagcct

SEQ ID NO: 436488 - DNA, 25 bp, Homo sapien
aggtcttcttcacagcctgcactgc

SEQ ID NO: 436489 - DNA, 25 bp, Homo sapien
gcccacttgggcaaaaacgcatgca

SEQ ID NO: 436490 - DNA, 25 bp, Homo sapien
acgcatgcagaaggtggagttttta

SEQ ID NO: 436491 - DNA, 25 bp, Homo sapien
tagataagttcaggcatatgtatgc

SEQ ID NO: 436492 - DNA, 25 bp, Homo sapien
tggaaagccactagaaatcttcagg

SEQ ID NO: 436493 - DNA, 25 bp, Homo sapien
tcattaacgtatcaattcaatttct

SEQ ID NO: 436494 - DNA, 25 bp, Homo sapien
gaaatcttcaggcacacagataatg

SEQ ID NO: 436495 - DNA, 25 bp, Homo sapien
tgcaggttgctcatgaagtatttag

SEQ ID NO: 436496 - DNA, 25 bp, Homo sapien
tgaagtatttagtgaaccaggagag

SEQ ID NO: 436497 - DNA, 25 bp, Homo sapien
atttctataacctttgaagtggcag

SEQ ID NO: 436498 - DNA, 25 bp, Homo sapien
gatacttgggagatagttgcccact

SEQ ID NO: 436499 - DNA, 25 bp, Homo sapien
tgggagatagttgcccacttgggca

SEQ ID NO: 436500 - DNA, 25 bp, Homo sapien
tggtgcagggacactaggtgctact

SEQ ID NO: 436501 - DNA, 25 bp, Homo sapien
actaggtgctactgcggctcatcta

SEQ ID NO: 436502 - DNA, 25 bp, Homo sapien
gctcatctactttgtcaccaatcag

SEQ ID NO: 436503 - DNA, 25 bp, Homo sapien
aatcagctggttcaccttgttggga

SEQ ID NO: 436504 - DNA, 25 bp, Homo sapien
agaagcttttccctgagtcttcctt

SEQ ID NO: 436505 - DNA, 25 bp, Homo sapien
accttttttgattcctgagctgtgt

SEQ ID NO: 436506 - DNA, 25 bp, Homo sapien
tgtgtgtctagtcctgtggcaaaaa

SEQ ID NO: 436507 - DNA, 25 bp, Homo sapien
aaaagtgtcagctcctctagcaagg

SEQ ID NO: 436508 - DNA, 25 bp, Homo sapien
gaaagaatgaccagctcgtgtctta

SEQ ID NO: 436509 - DNA, 25 bp, Homo sapien
agctcgtgtcttaggttccaactca

SEQ ID NO: 436510 - DNA, 25 bp, Homo sapien
aggttccaactcatttttgctcttc

SEQ ID NO: 436511 - DNA, 25 bp, Homo sapien
ttggttcacatgatgatacctgctt

SEQ ID NO: 436512 - DNA, 25 bp, Homo sapien
atgatacctgcttttctcaggcctg

SEQ ID NO: 436513 - DNA, 25 bp, Homo sapien
tgctagaggcatccaacgccctggt

SEQ ID NO: 436514 - DNA, 25 bp, Homo sapien
caacgccctggtttgtaaatagcaa

SEQ ID NO: 436515 - DNA, 25 bp, Homo sapien
gtaaatagcaacctaaaggcgtatt

SEQ ID NO: 436516 - DNA, 25 bp, Homo sapien
ccccttcacagatggtggtgggctt

SEQ ID NO: 436517 - DNA, 25 bp, Homo sapien
ggtgggcttcgctctacaaagagga

SEQ ID NO: 436518 - DNA, 25 bp, Homo sapien
ggactctgatgttactcttgagctt

SEQ ID NO: 436519 - DNA, 25 bp, Homo sapien
gagcttatgagccagagagctgaaa

SEQ ID NO: 436520 - DNA, 25 bp, Homo sapien
gaaaaccgcaggcttgttgtgttaa

SEQ ID NO: 436521 - DNA, 25 bp, Homo sapien
agaaacacaccttcaaacttcaact

SEQ ID NO: 436522 - DNA, 25 bp, Homo sapien
aatttcgtggtagtaagttcggcat

SEQ ID NO: 436523 - DNA, 25 bp, Homo sapien
cgtggtagtaagttcggcatttgtt

SEQ ID NO: 436524 - DNA, 25 bp, Homo sapien
gttcggcatttgttacatgtataga

SEQ ID NO: 436525 - DNA, 25 bp, Homo sapien
gaagactaataatctctatttataa

SEQ ID NO: 436526 - DNA, 25 bp, Homo sapien
gaaaaagattcccattgactgtaga

SEQ ID NO: 436527 - DNA, 25 bp, Homo sapien
gattcccattgactgtagacttctt

SEQ ID NO: 436528 - DNA, 25 bp, Homo sapien
attgactgtagacttcttcccattt

SEQ ID NO: 436529 - DNA, 25 bp, Homo sapien
tgtttccccttcaggcttggctcta

SEQ ID NO: 436530 - DNA, 25 bp, Homo sapien
ttcaggcttggctctaggaaccaaa

SEQ ID NO: 436531 - DNA, 25 bp, Homo sapien
ttggctctaggaaccaaagtgattt

SEQ ID NO: 436532 - DNA, 25 bp, Homo sapien
gtgactttggttagtgccactacct

SEQ ID NO: 436533 - DNA, 25 bp, Homo sapien
agcacacttctgttctcttagaact

SEQ ID NO: 436534 - DNA, 25 bp, Homo sapien
gcacacttctgttctcttagaactt

SEQ ID NO: 436535 - DNA, 25 bp, Homo sapien
acacttctgttctcttagaacttag

SEQ ID NO: 436536 - DNA, 25 bp, Homo sapien
tgttctcttagaacttagaagtgtt

SEQ ID NO: 436537 - DNA, 25 bp, Homo sapien
tctcttagaacttagaagtgtttct

SEQ ID NO: 436538 - DNA, 25 bp, Homo sapien
agaagtgtttctaagagaacagaag

SEQ ID NO: 436539 - DNA, 25 bp, Homo sapien
gtaataagagaaacagttacgtgtg

SEQ ID NO: 436540 - DNA, 25 bp, Homo sapien
acagttacgtgtggaattcaacatc

SEQ ID NO: 436541 - DNA, 25 bp, Homo sapien
cgtgtggaattcaacatctttggtt

SEQ ID NO: 436542 - DNA, 25 bp, Homo sapien
ttggttggaacgcattggctttttt

SEQ ID NO: 436543 - DNA, 25 bp, Homo sapien
caataattttgttctttcagggcta

SEQ ID NO: 436544 - DNA, 25 bp, Homo sapien
gctgggagcctggaggactagcgag

SEQ ID NO: 436545 - DNA, 25 bp, Homo sapien
ctgggagcctggaggactagcgagg

SEQ ID NO: 436546 - DNA, 25 bp, Homo sapien
tgggagcctggaggactagcgagga

SEQ ID NO: 436547 - DNA, 25 bp, Homo sapien
gggagcctggaggactagcgaggag

SEQ ID NO: 436548 - DNA, 25 bp, Homo sapien
gagcctggaggactagcgaggagga

SEQ ID NO: 436549 - DNA, 25 bp, Homo sapien
agcctggaggactagcgaggaggag

SEQ ID NO: 436550 - DNA, 25 bp, Homo sapien
cctggaggactagcgaggaggagtt

SEQ ID NO: 436551 - DNA, 25 bp, Homo sapien
tggaggactagcgaggaggagttga

SEQ ID NO: 436552 - DNA, 25 bp, Homo sapien
gaggactagcgaggaggagttgaga

SEQ ID NO: 436553 - DNA, 25 bp, Homo sapien
actagcgaggaggagttgagagaac

SEQ ID NO: 436554 - DNA, 25 bp, Homo sapien
agcgaggaggagttgagagaacgga

SEQ ID NO: 436555 - DNA, 25 bp, Homo sapien
accctcatctagctctgttcaggag

SEQ ID NO: 436556 - DNA, 25 bp, Homo sapien
ggagagctgcaaacacagagcccac

SEQ ID NO: 436557 - DNA, 25 bp, Homo sapien
gaggagaccgaagtcaggccctgaa

SEQ ID NO: 436558 - DNA, 25 bp, Homo sapien
aagtcaggccctgaagccggtcctg

SEQ ID NO: 436559 - DNA, 25 bp, Homo sapien
tgaagccggtcctgctctgagctga

SEQ ID NO: 436560 - DNA, 25 bp, Homo sapien
ggtcctgctctgagctgacagactt

SEQ ID NO: 436561 - DNA, 25 bp, Homo sapien
tgagctgacagacttggccagtccc

SEQ ID NO: 436562 - DNA, 25 bp, Homo sapien
gggctgtaagcctctccatccggga

SEQ ID NO: 436563 - DNA, 25 bp, Homo sapien
tgtaagcctctccatccgggagctt

SEQ ID NO: 436564 - DNA, 25 bp, Homo sapien
tgggtggctccccactctggaattt

SEQ ID NO: 436565 - DNA, 25 bp, Homo sapien
tctggaatttccctaccaataaaag

SEQ ID NO: 436566 - DNA, 25 bp, Homo sapien
tcagatgtgtgagcctcgcccataa

SEQ ID NO: 436567 - DNA, 25 bp, Homo sapien
gtgagcctcgcccataagaaacaag

SEQ ID NO: 436568 - DNA, 25 bp, Homo sapien
aatcatgttaacagctttggcgtgg

SEQ ID NO: 436569 - DNA, 25 bp, Homo sapien
ggcactccccaggataggcacagga

SEQ ID NO: 436570 - DNA, 25 bp, Homo sapien
cacaggagctgtgcaggcaagtaga

SEQ ID NO: 436571 - DNA, 25 bp, Homo sapien
ggagaacggcccagttcacagaaga

SEQ ID NO: 436572 - DNA, 25 bp, Homo sapien
ggcacattgcaggtgctttttgcta

SEQ ID NO: 436573 - DNA, 25 bp, Homo sapien
tgctttttgctatgtcagttcctca

SEQ ID NO: 436574 - DNA, 25 bp, Homo sapien
agttcctcacctgcttaaagaggtc

SEQ ID NO: 436575 - DNA, 25 bp, Homo sapien
ggaggacagtcttcctgggcgactc

SEQ ID NO: 436576 - DNA, 25 bp, Homo sapien
cctggcctcaggaactcagatgtgt

SEQ ID NO: 436577 - DNA, 25 bp, Homo sapien
ccagggtcaccacctatcattgttt

SEQ ID NO: 436578 - DNA, 25 bp, Homo sapien
accacctatcattgtttccagcata

SEQ ID NO: 436579 - DNA, 25 bp, Homo sapien
cagttatcaccccaccgacatgtag

SEQ ID NO: 436580 - DNA, 25 bp, Homo sapien
tactcacacacgcacaagcttcagt

SEQ ID NO: 436581 - DNA, 25 bp, Homo sapien
aagcttcagtgtcccttaagatgtt

SEQ ID NO: 436582 - DNA, 25 bp, Homo sapien
atataggtagctgtcattcaatgaa

SEQ ID NO: 436583 - DNA, 25 bp, Homo sapien
gaatattttcaggtagtttggaaca

SEQ ID NO: 436584 - DNA, 25 bp, Homo sapien
ggaatgcatacaacatgcttagcat

SEQ ID NO: 436585 - DNA, 25 bp, Homo sapien
catgcttagcataacacctgtcaca

SEQ ID NO: 436586 - DNA, 25 bp, Homo sapien
tagcataacacctgtcacatggtaa

SEQ ID NO: 436587 - DNA, 25 bp, Homo sapien
cacatggtaagtgctccagggtcac

SEQ ID NO: 436588 - DNA, 25 bp, Homo sapien
tagccaggaagaccaacaaacaggt

SEQ ID NO: 436589 - DNA, 25 bp, Homo sapien
caaacaggtgtttgtcagctataac

SEQ ID NO: 436590 - DNA, 25 bp, Homo sapien
gtgtttgtcagctataaccttcaga

SEQ ID NO: 436591 - DNA, 25 bp, Homo sapien
aaccttcagaacacagacagtaact

SEQ ID NO: 436592 - DNA, 25 bp, Homo sapien
gaacacagacagtaacttcgcatta

SEQ ID NO: 436593 - DNA, 25 bp, Homo sapien
gtaacttcgcattacttgtagaaaa

SEQ ID NO: 436594 - DNA, 25 bp, Homo sapien
ggaagagatggaggctttccccgaa

SEQ ID NO: 436595 - DNA, 25 bp, Homo sapien
gagatggaggctttccccgaaaagt

SEQ ID NO: 436596 - DNA, 25 bp, Homo sapien
ggctttccccgaaaagttctagctg

SEQ ID NO: 436597 - DNA, 25 bp, Homo sapien
cccgaaaagttctagctgagtggca

SEQ ID NO: 436598 - DNA, 25 bp, Homo sapien
aaaagttctagctgagtggcagaag

SEQ ID NO: 436599 - DNA, 25 bp, Homo sapien
agaactttataatcagccgacttga

SEQ ID NO: 436600 - DNA, 25 bp, Homo sapien
gacttgaaactcacagtcgtcccct

SEQ ID NO: 436601 - DNA, 25 bp, Homo sapien
gtcgtcccctcagaaaggcagggca

SEQ ID NO: 436602 - DNA, 25 bp, Homo sapien
agggcaaatgttgttatttccaatt

SEQ ID NO: 436603 - DNA, 25 bp, Homo sapien
gcatgctctgtgtatagcagatatc

SEQ ID NO: 436604 - DNA, 25 bp, Homo sapien
attctgttgctgacagtccttgcaa

SEQ ID NO: 436605 - DNA, 25 bp, Homo sapien
tcagaatcaggaccggagccccaga

SEQ ID NO: 436606 - DNA, 25 bp, Homo sapien
agatgcgctggtgtcactgatgtcc

SEQ ID NO: 436607 - DNA, 25 bp, Homo sapien
gtaagtgatgttcacacatgctgct

SEQ ID NO: 436608 - DNA, 25 bp, Homo sapien
tgctgctgtcatgaacactatctca

SEQ ID NO: 436609 - DNA, 25 bp, Homo sapien
cactatctcatgttgtgtaacactt

SEQ ID NO: 436610 - DNA, 25 bp, Homo sapien
ctcccacggacactaaaacgctaat

SEQ ID NO: 436611 - DNA, 25 bp, Homo sapien
taatttattagatctaaagcccctt

SEQ ID NO: 436612 - DNA, 25 bp, Homo sapien
cagcccctgctttcattaaggtatt

SEQ ID NO: 436613 - DNA, 25 bp, Homo sapien
gcccctgctttcattaaggtattta

SEQ ID NO: 436614 - DNA, 25 bp, Homo sapien
gagggagccccccaacctcagtgag

SEQ ID NO: 436615 - DNA, 25 bp, Homo sapien
acctcagtgaggagagccccgagcc

SEQ ID NO: 436616 - DNA, 25 bp, Homo sapien
gcagagggagttcccccagatcagt

SEQ ID NO: 436617 - DNA, 25 bp, Homo sapien
tccccagctagtagcatgaccagga

SEQ ID NO: 436618 - DNA, 25 bp, Homo sapien
cagctagtagcatgaccaggagagg

SEQ ID NO: 436619 - DNA, 25 bp, Homo sapien
ccaggagagggttaatgagagccaa

SEQ ID NO: 436620 - DNA, 25 bp, Homo sapien
gagccaagaggagtacctggtgcac

SEQ ID NO: 436621 - DNA, 25 bp, Homo sapien
aggacccaccctggactcttctgtg

SEQ ID NO: 436622 - DNA, 25 bp, Homo sapien
gtgtgcaggaagatgcgccagcccc

SEQ ID NO: 436623 - DNA, 25 bp, Homo sapien
tgtgcaggaagatgcgccagcccct

SEQ ID NO: 436624 - DNA, 25 bp, Homo sapien
gtgcaggaagatgcgccagcccctg

SEQ ID NO: 436625 - DNA, 25 bp, Homo sapien
aggaagatgcgccagcccctgcccc

SEQ ID NO: 436626 - DNA, 25 bp, Homo sapien
tagaccagggggacgggcacccatc

SEQ ID NO: 436627 - DNA, 25 bp, Homo sapien
agggggacgggcacccatcactccg

SEQ ID NO: 436628 - DNA, 25 bp, Homo sapien
ccatcactccgcaggcgaatcagag

SEQ ID NO: 436629 - DNA, 25 bp, Homo sapien
cactccgcaggcgaatcagagcccc

SEQ ID NO: 436630 - DNA, 25 bp, Homo sapien
agagccagctacacccctgccccgg

SEQ ID NO: 436631 - DNA, 25 bp, Homo sapien
agagccagctagtcccacctgcagc

SEQ ID NO: 436632 - DNA, 25 bp, Homo sapien
agctattctgtattgcaccttttca

SEQ ID NO: 436633 - DNA, 25 bp, Homo sapien
tgcaccttttcacaatttaatacat

SEQ ID NO: 436634 - DNA, 25 bp, Homo sapien
tcctgtgattttcgaaactaaacca

SEQ ID NO: 436635 - DNA, 25 bp, Homo sapien
cgaaactaaaccattgtgtgtcctg

SEQ ID NO: 436636 - DNA, 25 bp, Homo sapien
ttgagctgccgctcagcagcttcct

SEQ ID NO: 436637 - DNA, 25 bp, Homo sapien
gatttggaacacctgtgtctgtcgc

SEQ ID NO: 436638 - DNA, 25 bp, Homo sapien
gctgctgggactggcgtctgtacac

SEQ ID NO: 436639 - DNA, 25 bp, Homo sapien
gactggcgtctgtacacacttgttt

SEQ ID NO: 436640 - DNA, 25 bp, Homo sapien
gtacacacttgtttggccttttctg

SEQ ID NO: 436641 - DNA, 25 bp, Homo sapien
acttgtttggccttttctgtagttg

SEQ ID NO: 436642 - DNA, 25 bp, Homo sapien
tgctgtaaactctatggctttttaa

SEQ ID NO: 436643 - DNA, 25 bp, Homo sapien
cccagaagacattggaagacctgtt

SEQ ID NO: 436644 - DNA, 25 bp, Homo sapien
ccagaagacattggaagacctgttt

SEQ ID NO: 436645 - DNA, 25 bp, Homo sapien
cagaagacattggaagacctgtttt

SEQ ID NO: 436646 - DNA, 25 bp, Homo sapien
gacattggaagacctgttttaaaat

SEQ ID NO: 436647 - DNA, 25 bp, Homo sapien
aatcaataaaatgggctagggatat

SEQ ID NO: 436648 - DNA, 25 bp, Homo sapien
gggatataaatcagcaattcaaggg

SEQ ID NO: 436649 - DNA, 25 bp, Homo sapien
gaccaactaatatatgtaaagatgc

SEQ ID NO: 436650 - DNA, 25 bp, Homo sapien
ccaactaatatatgtaaagatgcac

SEQ ID NO: 436651 - DNA, 25 bp, Homo sapien
aaatattggtaggacttatgtagac

SEQ ID NO: 436652 - DNA, 25 bp, Homo sapien
aatattggtaggacttatgtagaca

SEQ ID NO: 436653 - DNA, 25 bp, Homo sapien
gtaggacttatgtagacaaaggact

SEQ ID NO: 436654 - DNA, 25 bp, Homo sapien
agagtagcatataggccatgtgtat

SEQ ID NO: 436655 - DNA, 25 bp, Homo sapien
atctagtcattttcaactgtgattg

SEQ ID NO: 436656 - DNA, 25 bp, Homo sapien
gtgattgaacacttccctttaactc

SEQ ID NO: 436657 - DNA, 25 bp, Homo sapien
gatcatattgtatcccaggtactag

SEQ ID NO: 436658 - DNA, 25 bp, Homo sapien
ggtactagaatttctgttcagctgt

SEQ ID NO: 436659 - DNA, 25 bp, Homo sapien
tgttcagctgtttataggcctccac

SEQ ID NO: 436660 - DNA, 25 bp, Homo sapien
gaaattggctccaaacctattccca

SEQ ID NO: 436661 - DNA, 25 bp, Homo sapien
caaacctattcccattacatcatca

SEQ ID NO: 436662 - DNA, 25 bp, Homo sapien
tcatcacccactaatgtcattacac

SEQ ID NO: 436663 - DNA, 25 bp, Homo sapien
aatgaaatctgctttgaggcttgta

SEQ ID NO: 436664 - DNA, 25 bp, Homo sapien
gaggcttgtattgttgttttccttc

SEQ ID NO: 436665 - DNA, 25 bp, Homo sapien
ggtctcactcttctgtgctgatctc

SEQ ID NO: 436666 - DNA, 25 bp, Homo sapien
cactcttctgtgctgatctctttaa

SEQ ID NO: 436667 - DNA, 25 bp, Homo sapien
tcttctgtgctgatctctttaactc

SEQ ID NO: 436668 - DNA, 25 bp, Homo sapien
tgtgctgatctctttaactcctgaa

SEQ ID NO: 436669 - DNA, 25 bp, Homo sapien
gctgatctctttaactcctgaatat

SEQ ID NO: 436670 - DNA, 25 bp, Homo sapien
gagactggatagttatcagcacaat

SEQ ID NO: 436671 - DNA, 25 bp, Homo sapien
gttgagatgtttaaatctccttcat

SEQ ID NO: 436672 - DNA, 25 bp, Homo sapien
gatgtttaaatctccttcatattta

SEQ ID NO: 436673 - DNA, 25 bp, Homo sapien
taaatccctttatactcatcagtca

SEQ ID NO: 436674 - DNA, 25 bp, Homo sapien
atccctttatactcatcagtcatta

SEQ ID NO: 436675 - DNA, 25 bp, Homo sapien
tactcatcagtcattataacagtaa

SEQ ID NO: 436676 - DNA, 25 bp, Homo sapien
gttttcagtggacagttgctattcc

SEQ ID NO: 436677 - DNA, 25 bp, Homo sapien
tcagtggacagttgctattccaaga

SEQ ID NO: 436678 - DNA, 25 bp, Homo sapien
gagtactttagcaattcccagcgta

SEQ ID NO: 436679 - DNA, 25 bp, Homo sapien
tagcaattcccagcgtattacatac

SEQ ID NO: 436680 - DNA, 25 bp, Homo sapien
agcgtattacatacacccagtgata

SEQ ID NO: 436681 - DNA, 25 bp, Homo sapien
acacccagtgataaggttctttgca

SEQ ID NO: 436682 - DNA, 25 bp, Homo sapien
aaggttctttgcatgttttgtgtta

SEQ ID NO: 436683 - DNA, 25 bp, Homo sapien
gtgttatgtattactctgactcttt

SEQ ID NO: 436684 - DNA, 25 bp, Homo sapien
gtattactctgactctttagagatt

SEQ ID NO: 436685 - DNA, 25 bp, Homo sapien
tcctccaaaagttagacgaaacaag

SEQ ID NO: 436686 - DNA, 25 bp, Homo sapien
aatgtgtactaactcctgattttgt

SEQ ID NO: 436687 - DNA, 25 bp, Homo sapien
gtggcaaagcttttcacctatccac

SEQ ID NO: 436688 - DNA, 25 bp, Homo sapien
gcaaagcttttcacctatccacaca

SEQ ID NO: 436689 - DNA, 25 bp, Homo sapien
tcacctatccacacaccttactaca

SEQ ID NO: 436690 - DNA, 25 bp, Homo sapien
ttaaccattctgcaaccctttcttc

SEQ ID NO: 436691 - DNA, 25 bp, Homo sapien
taaccattctgcaaccctttcttca

SEQ ID NO: 436692 - DNA, 25 bp, Homo sapien
accattctgcaaccctttcttcaca

SEQ ID NO: 436693 - DNA, 25 bp, Homo sapien
attctgcaaccctttcttcacataa

SEQ ID NO: 436694 - DNA, 25 bp, Homo sapien
ttctgcaaccctttcttcacataag

SEQ ID NO: 436695 - DNA, 25 bp, Homo sapien
tctgcaaccctttcttcacataaga

SEQ ID NO: 436696 - DNA, 25 bp, Homo sapien
ctgcaaccctttcttcacataagaa

SEQ ID NO: 436697 - DNA, 25 bp, Homo sapien
tgcaaccctttcttcacataagaaa

SEQ ID NO: 436698 - DNA, 25 bp, Homo sapien
tagcaagctaagagccctaagcctt

SEQ ID NO: 436699 - DNA, 25 bp, Homo sapien
ctaagccttcgcctgcaggtgtgac

SEQ ID NO: 436700 - DNA, 25 bp, Homo sapien
aggtccctggtactcatgtctgtta

SEQ ID NO: 436701 - DNA, 25 bp, Homo sapien
catgtctgttatccctccagtggta

SEQ ID NO: 436702 - DNA, 25 bp, Homo sapien
gtcactgcaaatgctttgtctctgg

SEQ ID NO: 436703 - DNA, 25 bp, Homo sapien
ttgtctctgggcaggacggtagcca

SEQ ID NO: 436704 - DNA, 25 bp, Homo sapien
ccattgtctggtgaggcttggccca

SEQ ID NO: 436705 - DNA, 25 bp, Homo sapien
ttggcccaccttctgatttaacctt

SEQ ID NO: 436706 - DNA, 25 bp, Homo sapien
gatttaaccttgacctttggcactg

SEQ ID NO: 436707 - DNA, 25 bp, Homo sapien
tttggcactgagcttcttggagcta

SEQ ID NO: 436708 - DNA, 25 bp, Homo sapien
agttactgccctgataacacacgca

SEQ ID NO: 436709 - DNA, 25 bp, Homo sapien
agggtatcttccaacctcactgact

SEQ ID NO: 436710 - DNA, 25 bp, Homo sapien
aacctcactgacttaaaccttgtgg

SEQ ID NO: 436711 - DNA, 25 bp, Homo sapien
aaccttgtggaatacagcacttcta

SEQ ID NO: 436712 - DNA, 25 bp, Homo sapien
ggaatacagcacttctaaactaaaa

SEQ ID NO: 436713 - DNA, 25 bp, Homo sapien
gctcaaaaatcgtctttagaaggtt

SEQ ID NO: 436714 - DNA, 25 bp, Homo sapien
tttaggattggctaattctgctatt

SEQ ID NO: 436715 - DNA, 25 bp, Homo sapien
aagaacacagagctgctgtctaaaa

SEQ ID NO: 436716 - DNA, 25 bp, Homo sapien
gttcagcaggcaacactcagatttg

SEQ ID NO: 436717 - DNA, 25 bp, Homo sapien
ttgaaagaaactctgcagcaacctg

SEQ ID NO: 436718 - DNA, 25 bp, Homo sapien
gcaacctggacatatggttagctga

SEQ ID NO: 436719 - DNA, 25 bp, Homo sapien
ggttagctgagtcgacatttgatta

SEQ ID NO: 436720 - DNA, 25 bp, Homo sapien
cacagccacggcctacctgtgcggg

SEQ ID NO: 436721 - DNA, 25 bp, Homo sapien
cacggcctacctgtgcggggtcaag

SEQ ID NO: 436722 - DNA, 25 bp, Homo sapien
ggcttgagtgcagccgcccgcttta

SEQ ID NO: 436723 - DNA, 25 bp, Homo sapien
gcccgctttaaccagtgcaacacga

SEQ ID NO: 436724 - DNA, 25 bp, Homo sapien
cgctttaaccagtgcaacacgacac

SEQ ID NO: 436725 - DNA, 25 bp, Homo sapien
gctttaaccagtgcaacacgacacg

SEQ ID NO: 436726 - DNA, 25 bp, Homo sapien
tttaaccagtgcaacacgacacgcg

SEQ ID NO: 436727 - DNA, 25 bp, Homo sapien
ttaaccagtgcaacacgacacgcgg

SEQ ID NO: 436728 - DNA, 25 bp, Homo sapien
taaccagtgcaacacgacacgcggc

SEQ ID NO: 436729 - DNA, 25 bp, Homo sapien
aaccagtgcaacacgacacgcggca

SEQ ID NO: 436730 - DNA, 25 bp, Homo sapien
accagtgcaacacgacacgcggcaa

SEQ ID NO: 436731 - DNA, 25 bp, Homo sapien
agcacacttctgttctcttagaact

SEQ ID NO: 436732 - DNA, 25 bp, Homo sapien
gcacacttctgttctcttagaactt

SEQ ID NO: 436733 - DNA, 25 bp, Homo sapien
cacacttctgttctcttagaactta

SEQ ID NO: 436734 - DNA, 25 bp, Homo sapien
acacttctgttctcttagaacttag

SEQ ID NO: 436735 - DNA, 25 bp, Homo sapien
cttctgttctcttagaacttagaag

SEQ ID NO: 436736 - DNA, 25 bp, Homo sapien
tctgttctcttagaacttagaagtg

SEQ ID NO: 436737 - DNA, 25 bp, Homo sapien
tgttctcttagaacttagaagtgtt

SEQ ID NO: 436738 - DNA, 25 bp, Homo sapien
gttctcttagaacttagaagtgttt

SEQ ID NO: 436739 - DNA, 25 bp, Homo sapien
tctcttagaacttagaagtgtttct

SEQ ID NO: 436740 - DNA, 25 bp, Homo sapien
agaagtgtttctaagagaacagaag

SEQ ID NO: 436741 - DNA, 25 bp, Homo sapien
gtaataagagaaacagttacgtgtg

SEQ ID NO: 436742 - DNA, 25 bp, Homo sapien
tgggtcgtcttctcaagtctaatgg

SEQ ID NO: 436743 - DNA, 25 bp, Homo sapien
taatggtccatgagcggcttgtcca

SEQ ID NO: 436744 - DNA, 25 bp, Homo sapien
gaaatctgcaacctttctaagcaca

SEQ ID NO: 436745 - DNA, 25 bp, Homo sapien
cccagaaacacaaccctcatattta

SEQ ID NO: 436746 - DNA, 25 bp, Homo sapien
ctcttaagttcagggtagcggtctc

SEQ ID NO: 436747 - DNA, 25 bp, Homo sapien
agggtagcggtctcaaactgccaaa

SEQ ID NO: 436748 - DNA, 25 bp, Homo sapien
aactgccaaacactaggatgaggat

SEQ ID NO: 436749 - DNA, 25 bp, Homo sapien
tgaggatgtgactctgcatgtgttt

SEQ ID NO: 436750 - DNA, 25 bp, Homo sapien
gatgagaggaagcatcgtcccagtc

SEQ ID NO: 436751 - DNA, 25 bp, Homo sapien
catgaaggcaagtacccagggcttt

SEQ ID NO: 436752 - DNA, 25 bp, Homo sapien
tttgcagtcaccacgtgggtcgtct

SEQ ID NO: 436753 - DNA, 25 bp, Homo sapien
ccctgacagtcatatgctgtttttc

SEQ ID NO: 436754 - DNA, 25 bp, Homo sapien
tgctgtttttccttagatgcccaaa

SEQ ID NO: 436755 - DNA, 25 bp, Homo sapien
tcctttttctgtcaagtcggccgtt

SEQ ID NO: 436756 - DNA, 25 bp, Homo sapien
cggccgttttattcgaatgtgtcat

SEQ ID NO: 436757 - DNA, 25 bp, Homo sapien
tgttggtattggttgtcctggtcca

SEQ ID NO: 436758 - DNA, 25 bp, Homo sapien
gtcctggtccatatttgcaagcgta

SEQ ID NO: 436759 - DNA, 25 bp, Homo sapien
gcaagcgtatggtgtgctctttcta

SEQ ID NO: 436760 - DNA, 25 bp, Homo sapien
gtgtgctctttctatgtgtacttca

SEQ ID NO: 436761 - DNA, 25 bp, Homo sapien
tgtgtacttcacatctgttatttta

SEQ ID NO: 436762 - DNA, 25 bp, Homo sapien
aaatgatcttcacctttattatgca

SEQ ID NO: 436763 - DNA, 25 bp, Homo sapien
tttattatgcatctatcttcatggg

SEQ ID NO: 436764 - DNA, 25 bp, Homo sapien
gtgcattgattaaatcacggtcatg

SEQ ID NO: 436765 - DNA, 25 bp, Homo sapien
ccccaaaagccaggtggagctctat

SEQ ID NO: 436766 - DNA, 25 bp, Homo sapien
ggagctctattgaccacaagccggg

SEQ ID NO: 436767 - DNA, 25 bp, Homo sapien
gggtagctacatccagtgcaacggt

SEQ ID NO: 436768 - DNA, 25 bp, Homo sapien
tagctacatccagtgcaacggtggg

SEQ ID NO: 436769 - DNA, 25 bp, Homo sapien
ggtgctccaagcgccttcgaaacgt

SEQ ID NO: 436770 - DNA, 25 bp, Homo sapien
atcacggtcatgaaggaacatttac

SEQ ID NO: 436771 - DNA, 25 bp, Homo sapien
gcaccaactggcaaaaccttctaat

SEQ ID NO: 436772 - DNA, 25 bp, Homo sapien
gcaaaaccttctaattttctagacg

SEQ ID NO: 436773 - DNA, 25 bp, Homo sapien
tacgttcactaaaaagtccacccag

SEQ ID NO: 436774 - DNA, 25 bp, Homo sapien
tcactaaaaagtccacccaggtaat

SEQ ID NO: 436775 - DNA, 25 bp, Homo sapien
aagggttgacaaataccagttgaat

SEQ ID NO: 436776 - DNA, 25 bp, Homo sapien
agtttcaagtggaagcctcccatat

SEQ ID NO: 436777 - DNA, 25 bp, Homo sapien
aagtggaagcctcccatatttctcc

SEQ ID NO: 436778 - DNA, 25 bp, Homo sapien
cctcccatatttctccactatattt

SEQ ID NO: 436779 - DNA, 25 bp, Homo sapien
caatataaaaagtaccagggcacgg

SEQ ID NO: 436780 - DNA, 25 bp, Homo sapien
caaaagtctcccctaattatcacag

SEQ ID NO: 436781 - DNA, 25 bp, Homo sapien
agtctcccctaattatcacagtcag

SEQ ID NO: 436782 - DNA, 25 bp, Homo sapien
taattatcacagtcaggcctgaatt

SEQ ID NO: 436783 - DNA, 25 bp, Homo sapien
ttatcacagtcaggcctgaattagt

SEQ ID NO: 436784 - DNA, 25 bp, Homo sapien
agtaaaacatgttcgcggccttcaa

SEQ ID NO: 436785 - DNA, 25 bp, Homo sapien
tgttcgcggccttcaaaaaagattc

SEQ ID NO: 436786 - DNA, 25 bp, Homo sapien
gtcaggtttacacggcagttcagaa

SEQ ID NO: 436787 - DNA, 25 bp, Homo sapien
aagcgagaacgctttcattacttgc

SEQ ID NO: 436788 - DNA, 25 bp, Homo sapien
tacaaactcttgcttccttaaaggt

SEQ ID NO: 436789 - DNA, 25 bp, Homo sapien
aaaggtcagaacatcaggccaaagt

SEQ ID NO: 436790 - DNA, 25 bp, Homo sapien
gccttccaatttacgcattttcaat

SEQ ID NO: 436791 - DNA, 25 bp, Homo sapien
attttcaatttgctctccccatttg

SEQ ID NO: 436792 - DNA, 25 bp, Homo sapien
gctctccccatttgttgagtcagaa

SEQ ID NO: 436793 - DNA, 25 bp, Homo sapien
agaagcagcattgcccagaaacagg

SEQ ID NO: 436794 - DNA, 25 bp, Homo sapien
tcaacacacacattattcacatcct

SEQ ID NO: 436795 - DNA, 25 bp, Homo sapien
ttcacatcctattggtatactggta

SEQ ID NO: 436796 - DNA, 25 bp, Homo sapien
tatactggtatgttgacttgggaat

SEQ ID NO: 436797 - DNA, 25 bp, Homo sapien
gatatgtatatcatctgccgcctaa

SEQ ID NO: 436798 - DNA, 25 bp, Homo sapien
atctgccgcctaaagccatattcat

SEQ ID NO: 436799 - DNA, 25 bp, Homo sapien
gcctaaagccatattcattcaccat

SEQ ID NO: 436800 - DNA, 25 bp, Homo sapien
gccatattcattcaccataaatttt

SEQ ID NO: 436801 - DNA, 25 bp, Homo sapien
ttgccaggaagaatgcttaagatgt

SEQ ID NO: 436802 - DNA, 25 bp, Homo sapien
agtggatggatctcaatgacctggc

SEQ ID NO: 436803 - DNA, 25 bp, Homo sapien
ggatctcaatgacctggcgaagact

SEQ ID NO: 436804 - DNA, 25 bp, Homo sapien
ggcgaagactgaaaatacaactccc

SEQ ID NO: 436805 - DNA, 25 bp, Homo sapien
atacaactcccatcaccagcagagt

SEQ ID NO: 436806 - DNA, 25 bp, Homo sapien
tcaccagcagagttgctaggctgct

SEQ ID NO: 436807 - DNA, 25 bp, Homo sapien
ctgctgctgtatgggtacagagaag

SEQ ID NO: 436808 - DNA, 25 bp, Homo sapien
agagtccaccagtcccactcaatgc

SEQ ID NO: 436809 - DNA, 25 bp, Homo sapien
gagtccaccagtcccactcaatgct

SEQ ID NO: 436810 - DNA, 25 bp, Homo sapien
agtccaccagtcccactcaatgctg

SEQ ID NO: 436811 - DNA, 25 bp, Homo sapien
gtccaccagtcccactcaatgctgc

SEQ ID NO: 436812 - DNA, 25 bp, Homo sapien
tccaccagtcccactcaatgctgct

SEQ ID NO: 436813 - DNA, 25 bp, Homo sapien
caccagtcccactcaatgctgctct

SEQ ID NO: 436814 - DNA, 25 bp, Homo sapien
accagtcccactcaatgctgctcta

SEQ ID NO: 436815 - DNA, 25 bp, Homo sapien
tctaactctacccacacccacctaa

SEQ ID NO: 436816 - DNA, 25 bp, Homo sapien
ctaactctacccacacccacctaat

SEQ ID NO: 436817 - DNA, 25 bp, Homo sapien
tttttctcatctaccaaaggatgaa

SEQ ID NO: 436818 - DNA, 25 bp, Homo sapien
ttttctcatctaccaaaggatgaaa

SEQ ID NO: 436819 - DNA, 25 bp, Homo sapien
gtggatggagagtccaccagtccca

SEQ ID NO: 436820 - DNA, 25 bp, Homo sapien
accagtcccactcaatgctgctcta

SEQ ID NO: 436821 - DNA, 25 bp, Homo sapien
gggtgctaataaaacatgctgaggt

SEQ ID NO: 436822 - DNA, 25 bp, Homo sapien
cattccatagagctgaaatctggtt

SEQ ID NO: 436823 - DNA, 25 bp, Homo sapien
aaatctggttttcaaggcctctgtg

SEQ ID NO: 436824 - DNA, 25 bp, Homo sapien
cagccctggctggaatgtagattgt

SEQ ID NO: 436825 - DNA, 25 bp, Homo sapien
tgtactgtgagctgtcttctgtata

SEQ ID NO: 436826 - DNA, 25 bp, Homo sapien
gagctgtcttctgtataatgtattt

SEQ ID NO: 436827 - DNA, 25 bp, Homo sapien
gtatttttctcatctaccaaaggat

SEQ ID NO: 436828 - DNA, 25 bp, Homo sapien
tttttctcatctaccaaaggatgaa

SEQ ID NO: 436829 - DNA, 25 bp, Homo sapien
ttttctcatctaccaaaggatgaaa

SEQ ID NO: 436830 - DNA, 25 bp, Homo sapien
tgagcccctgggttttcactttgtc

SEQ ID NO: 436831 - DNA, 25 bp, Homo sapien
gagcccctgggttttcactttgtca

SEQ ID NO: 436832 - DNA, 25 bp, Homo sapien
tacttcagctcccacaagtagctgg

SEQ ID NO: 436833 - DNA, 25 bp, Homo sapien
tgggactgcagctatgtgccatcat

SEQ ID NO: 436834 - DNA, 25 bp, Homo sapien
gactgcagctatgtgccatcatgcc

SEQ ID NO: 436835 - DNA, 25 bp, Homo sapien
tcatgcctggctgatgtttatatgt

SEQ ID NO: 436836 - DNA, 25 bp, Homo sapien
atgcctggctgatgtttatatgttt

SEQ ID NO: 436837 - DNA, 25 bp, Homo sapien
tgcctggctgatgtttatatgtttt

SEQ ID NO: 436838 - DNA, 25 bp, Homo sapien
gcctggctgatgtttatatgttttg

SEQ ID NO: 436839 - DNA, 25 bp, Homo sapien
cctggctgatgtttatatgttttgt

SEQ ID NO: 436840 - DNA, 25 bp, Homo sapien
tggctgatgtttatatgttttgtag

SEQ ID NO: 436841 - DNA, 25 bp, Homo sapien
atggtggagcacgttgaattttctg

SEQ ID NO: 436842 - DNA, 25 bp, Homo sapien
gtggagcacgttgaattttctgata

SEQ ID NO: 436843 - DNA, 25 bp, Homo sapien
ttctgatatatagtgttattttcct

SEQ ID NO: 436844 - DNA, 25 bp, Homo sapien
ttattttcctgggatcccctatgcc

SEQ ID NO: 436845 - DNA, 25 bp, Homo sapien
attttcctgggatcccctatgcctt

SEQ ID NO: 436846 - DNA, 25 bp, Homo sapien
tacagtattactattcctatcccat

SEQ ID NO: 436847 - DNA, 25 bp, Homo sapien
gtattactattcctatcccattttc

SEQ ID NO: 436848 - DNA, 25 bp, Homo sapien
attactattcctatcccattttctg

SEQ ID NO: 436849 - DNA, 25 bp, Homo sapien
tactattcctatcccattttctgac

SEQ ID NO: 436850 - DNA, 25 bp, Homo sapien
ttttctcaatcactgtaaattttta

SEQ ID NO: 436851 - DNA, 25 bp, Homo sapien
tattttctatttcctattgataatt

SEQ ID NO: 436852 - DNA, 25 bp, Homo sapien
tcttgtttcctttcacaggcaatga

SEQ ID NO: 436853 - DNA, 25 bp, Homo sapien
gccccatggcccaagttagtatatt

SEQ ID NO: 436854 - DNA, 25 bp, Homo sapien
gttagtatatttggtttaagactca

SEQ ID NO: 436855 - DNA, 25 bp, Homo sapien
aagactcataattcttgctttggct

SEQ ID NO: 436856 - DNA, 25 bp, Homo sapien
caaaccaagtgtaacctttcctgct

SEQ ID NO: 436857 - DNA, 25 bp, Homo sapien
tcctgctaaaactcttcttgggtct

SEQ ID NO: 436858 - DNA, 25 bp, Homo sapien
taaaactcttcttgggtctggcagc

SEQ ID NO: 436859 - DNA, 25 bp, Homo sapien
aactcttcttgggtctggcagcatt

SEQ ID NO: 436860 - DNA, 25 bp, Homo sapien
tcttgggtctggcagcattggtacc

SEQ ID NO: 436861 - DNA, 25 bp, Homo sapien
ggcagcattggtaccttgcttgcaa

SEQ ID NO: 436862 - DNA, 25 bp, Homo sapien
ttggtaccttgcttgcaacatccta

SEQ ID NO: 436863 - DNA, 25 bp, Homo sapien
gagtttgctgttggtgcaggaataa

SEQ ID NO: 436864 - DNA, 25 bp, Homo sapien
ggaaaggcccaaggtatccaagcct

SEQ ID NO: 436865 - DNA, 25 bp, Homo sapien
aaggcccaaggtatccaagcctggg

SEQ ID NO: 436866 - DNA, 25 bp, Homo sapien
tgccttctcagggacaagagtagtc

SEQ ID NO: 436867 - DNA, 25 bp, Homo sapien
gacaagagtagtcctttaccaccct

SEQ ID NO: 436868 - DNA, 25 bp, Homo sapien
agagtagtcctttaccaccctcact

SEQ ID NO: 436869 - DNA, 25 bp, Homo sapien
cctctcctactctacagcattaaag

SEQ ID NO: 436870 - DNA, 25 bp, Homo sapien
taaagactgtgggaccaggacccta

SEQ ID NO: 436871 - DNA, 25 bp, Homo sapien
tgtgtgggagaagttttataattgc

SEQ ID NO: 436872 - DNA, 25 bp, Homo sapien
ttataattgcttccaaacagctggg

SEQ ID NO: 436873 - DNA, 25 bp, Homo sapien
attgcttccaaacagctgggtttaa

SEQ ID NO: 436874 - DNA, 25 bp, Homo sapien
aagagccttagatttttaaacatgt

SEQ ID NO: 436875 - DNA, 25 bp, Homo sapien
aaacatgttagttaccagaatgcta

SEQ ID NO: 436876 - DNA, 25 bp, Homo sapien
gctaaaataccagttgattacccaa

SEQ ID NO: 436877 - DNA, 25 bp, Homo sapien
atccataatggaagtctacaacaaa

SEQ ID NO: 436878 - DNA, 25 bp, Homo sapien
gaattctcatttctagagtacctga

SEQ ID NO: 436879 - DNA, 25 bp, Homo sapien
tctagagtacctgagccaaacaaat

SEQ ID NO: 436880 - DNA, 25 bp, Homo sapien
aaatacacaacggaagctgcagctg

SEQ ID NO: 436881 - DNA, 25 bp, Homo sapien
gctgcagctgtatcatcactagcaa

SEQ ID NO: 436882 - DNA, 25 bp, Homo sapien
tcattatttactacctttgaaccta

SEQ ID NO: 436883 - DNA, 25 bp, Homo sapien
tttgaacctaaggtttcctgcctat

SEQ ID NO: 436884 - DNA, 25 bp, Homo sapien
tttgaaagcaaaaatcagtctcctt

SEQ ID NO: 436885 - DNA, 25 bp, Homo sapien
gggcacttgagctgtccctgcaatg

SEQ ID NO: 436886 - DNA, 25 bp, Homo sapien
gtccctgcaatgttttcatatctag

SEQ ID NO: 436887 - DNA, 25 bp, Homo sapien
gcaatgttttcatatctagtagtca

SEQ ID NO: 436888 - DNA, 25 bp, Homo sapien
catatctagtagtcattttagggaa

SEQ ID NO: 436889 - DNA, 25 bp, Homo sapien
gttttgatatgactgatactttctt

SEQ ID NO: 436890 - DNA, 25 bp, Homo sapien
tgatatgactgatactttctttgtt

SEQ ID NO: 436891 - DNA, 25 bp, Homo sapien
ggttgtattaagtcttcaatttcaa

SEQ ID NO: 436892 - DNA, 25 bp, Homo sapien
agaatgcctatgaaatacccactat

SEQ ID NO: 436893 - DNA, 25 bp, Homo sapien
aatacccactataacagcattcctt

SEQ ID NO: 436894 - DNA, 25 bp, Homo sapien
acagcattccttttgtgtttagaac

SEQ ID NO: 436895 - DNA, 25 bp, Homo sapien
gcattccttttgtgtttagaactat

SEQ ID NO: 436896 - DNA, 25 bp, Homo sapien
gtggattacccaggctcagggttaa

SEQ ID NO: 436897 - DNA, 25 bp, Homo sapien
ggattacccaggctcagggttaaca

SEQ ID NO: 436898 - DNA, 25 bp, Homo sapien
tacccaggctcagggttaacagcta

SEQ ID NO: 436899 - DNA, 25 bp, Homo sapien
ttgagacacacctagagaagggttt

SEQ ID NO: 436900 - DNA, 25 bp, Homo sapien
tgagacacacctagagaagggtttt

SEQ ID NO: 436901 - DNA, 25 bp, Homo sapien
ttctgttgctgccaaagtaatgtgg

SEQ ID NO: 436902 - DNA, 25 bp, Homo sapien
gttgctgccaaagtaatgtggctct

SEQ ID NO: 436903 - DNA, 25 bp, Homo sapien
gctgccaaagtaatgtggctctctg

SEQ ID NO: 436904 - DNA, 25 bp, Homo sapien
gccaaagtaatgtggctctctgctg

SEQ ID NO: 436905 - DNA, 25 bp, Homo sapien
agtctctagggctgcctgactggag

SEQ ID NO: 436906 - DNA, 25 bp, Homo sapien
gggtttcagtctggacttatacagg

SEQ ID NO: 436907 - DNA, 25 bp, Homo sapien
tggcccaaggagcatctcgctgatg

SEQ ID NO: 436908 - DNA, 25 bp, Homo sapien
tcgctgatgcggatccagtcggctg

SEQ ID NO: 436909 - DNA, 25 bp, Homo sapien
tggccatcagcgtctccaggtagtc

SEQ ID NO: 436910 - DNA, 25 bp, Homo sapien
tctccaggtagtcgcggcccaggta

SEQ ID NO: 436911 - DNA, 25 bp, Homo sapien
tcgttgatcctctgtgggagccgct

SEQ ID NO: 436912 - DNA, 25 bp, Homo sapien
taaaatttattgtactctcctcgcc

SEQ ID NO: 436913 - DNA, 25 bp, Homo sapien
gcacgtaccggcacaggaaggacag

SEQ ID NO: 436914 - DNA, 25 bp, Homo sapien
ggaaggacagccactcgagcagaaa

SEQ ID NO: 436915 - DNA, 25 bp, Homo sapien
gtgcccctgggaaagcctgaggcta

SEQ ID NO: 436916 - DNA, 25 bp, Homo sapien
agcctgaggctacttgtacgcgttg

SEQ ID NO: 436917 - DNA, 25 bp, Homo sapien
cgttggccttgtgcttcggcaagaa

SEQ ID NO: 436918 - DNA, 25 bp, Homo sapien
ttccttctctgcacactaagtggtt

SEQ ID NO: 436919 - DNA, 25 bp, Homo sapien
tctgcacactaagtggtttcatctc

SEQ ID NO: 436920 - DNA, 25 bp, Homo sapien
ttttcatgattccatctagtatctg

SEQ ID NO: 436921 - DNA, 25 bp, Homo sapien
attccatctagtatctgtacgtaga

SEQ ID NO: 436922 - DNA, 25 bp, Homo sapien
tctgtacgtagatgatctcagttat

SEQ ID NO: 436923 - DNA, 25 bp, Homo sapien
gttaatctccatgtattcactgtca

SEQ ID NO: 436924 - DNA, 25 bp, Homo sapien
taatctccatgtattcactgtcaga

SEQ ID NO: 436925 - DNA, 25 bp, Homo sapien
agaagtgtttttgcatctttaacaa

SEQ ID NO: 436926 - DNA, 25 bp, Homo sapien
ttttgcatctttaacaaattctgct

SEQ ID NO: 436927 - DNA, 25 bp, Homo sapien
tttcttcatggttctgttctgtctc

SEQ ID NO: 436928 - DNA, 25 bp, Homo sapien
ttcatggttctgttctgtctcttct

SEQ ID NO: 436929 - DNA, 25 bp, Homo sapien
agcttcatttttgttacctgataga

SEQ ID NO: 436930 - DNA, 25 bp, Homo sapien
ttgttacctgatagaatagcttttc

SEQ ID NO: 436931 - DNA, 25 bp, Homo sapien
gatagaatagcttttcttatgagat

SEQ ID NO: 436932 - DNA, 25 bp, Homo sapien
agcaagactcagtggtgtatcttca

SEQ ID NO: 436933 - DNA, 25 bp, Homo sapien
gactcagtggtgtatcttcattaaa

SEQ ID NO: 436934 - DNA, 25 bp, Homo sapien
gtatcttcattaaaagcttccttta

SEQ ID NO: 436935 - DNA, 25 bp, Homo sapien
aacaagtacccaaacaatcaagttg

SEQ ID NO: 436936 - DNA, 25 bp, Homo sapien
caaacaatcaagttgggccaacctt

SEQ ID NO: 436937 - DNA, 25 bp, Homo sapien
tcaagttgggccaaccttggaacct

SEQ ID NO: 436938 - DNA, 25 bp, Homo sapien
accttgttttgaatatctttcattg

SEQ ID NO: 436939 - DNA, 25 bp, Homo sapien
gaatgtatggttgaaaactcaggaa

SEQ ID NO: 436940 - DNA, 25 bp, Homo sapien
aaagtcagacatagagctctccgat

SEQ ID NO: 436941 - DNA, 25 bp, Homo sapien
atagagctctccgatgagctgtccc

SEQ ID NO: 436942 - DNA, 25 bp, Homo sapien
ctccgtggcgtatttctggatgtac

SEQ ID NO: 436943 - DNA, 25 bp, Homo sapien
ttctggatgtactctttaattttct

SEQ ID NO: 436944 - DNA, 25 bp, Homo sapien
tttctgcttgtattcttctggtcgg

SEQ ID NO: 436945 - DNA, 25 bp, Homo sapien
tattcttctggtcggtggaggtaca

SEQ ID NO: 436946 - DNA, 25 bp, Homo sapien
gaggtacatggctgcagcgtcacca

SEQ ID NO: 436947 - DNA, 25 bp, Homo sapien
gcagcgtcaccattgagaggatcta

SEQ ID NO: 436948 - DNA, 25 bp, Homo sapien
gagagctgtccaagtttgattaatt

SEQ ID NO: 436949 - DNA, 25 bp, Homo sapien
acatctagacacacagttcctgacg

SEQ ID NO: 436950 - DNA, 25 bp, Homo sapien
gttcctgacgcttcatcaatgttgg

SEQ ID NO: 436951 - DNA, 25 bp, Homo sapien
tcggctaataactatcagggtggat

SEQ ID NO: 436952 - DNA, 25 bp, Homo sapien
acaagactctgctaccagcacaaag

SEQ ID NO: 436953 - DNA, 25 bp, Homo sapien
aaagagcccaatccttcttggcagt

SEQ ID NO: 436954 - DNA, 25 bp, Homo sapien
aatccttcttggcagtctggcccat

SEQ ID NO: 436955 - DNA, 25 bp, Homo sapien
gcagtctggcccatcagatctacag

SEQ ID NO: 436956 - DNA, 25 bp, Homo sapien
tggaatcaggttagggcttgaccca

SEQ ID NO: 436957 - DNA, 25 bp, Homo sapien
gggcttgacccaaaactactggcta

SEQ ID NO: 436958 - DNA, 25 bp, Homo sapien
tactggctaaaatcctaaatatgag

SEQ ID NO: 436959 - DNA, 25 bp, Homo sapien
aatatgagctcaggacggtgttggt

SEQ ID NO: 436960 - DNA, 25 bp, Homo sapien
gacggtgttggtcaagtgacactta

SEQ ID NO: 436961 - DNA, 25 bp, Homo sapien
cttataatcctgtacctggagtgat

SEQ ID NO: 436962 - DNA, 25 bp, Homo sapien
catggatggctgcaaggtccaagat

SEQ ID NO: 436963 - DNA, 25 bp, Homo sapien
gctgcaaggtccaagatggccgctg

SEQ ID NO: 436964 - DNA, 25 bp, Homo sapien
caaggtccaagatggccgctggcat

SEQ ID NO: 436965 - DNA, 25 bp, Homo sapien
caagatggccgctggcatcagacac

SEQ ID NO: 436966 - DNA, 25 bp, Homo sapien
gctggcatcagacactcttcacctt

SEQ ID NO: 436967 - DNA, 25 bp, Homo sapien
gctgcccatcatcagtgtggacaac

SEQ ID NO: 436968 - DNA, 25 bp, Homo sapien
cctcatcagggaagcagtaccgcct

SEQ ID NO: 436969 - DNA, 25 bp, Homo sapien
gcagtaccgcctggaagttggacct

SEQ ID NO: 436970 - DNA, 25 bp, Homo sapien
gaagttggacctgcgtgcttcctct

SEQ ID NO: 436971 - DNA, 25 bp, Homo sapien
gttggacctgcgtgcttcctctgac

SEQ ID NO: 436972 - DNA, 25 bp, Homo sapien
agatggctccaggagaggcagctcc

SEQ ID NO: 436973 - DNA, 25 bp, Homo sapien
ggtatcaatgtctcccactccattt

SEQ ID NO: 436974 - DNA, 25 bp, Homo sapien
ctcatcttccaggactgggtctagt

SEQ ID NO: 436975 - DNA, 25 bp, Homo sapien
tgggtctagtttcccattcacacac

SEQ ID NO: 436976 - DNA, 25 bp, Homo sapien
ggttacctaattcttgactctgtca

SEQ ID NO: 436977 - DNA, 25 bp, Homo sapien
gactctgtcaatttaaggagcagca

SEQ ID NO: 436978 - DNA, 25 bp, Homo sapien
ggagcagcagataaggcttagtaac

SEQ ID NO: 436979 - DNA, 25 bp, Homo sapien
tccatgagcatcagctaaggcctgc

SEQ ID NO: 436980 - DNA, 25 bp, Homo sapien
atcagctaaggcctgctggaaagct

SEQ ID NO: 436981 - DNA, 25 bp, Homo sapien
tggaaagcttcaggcaacgcacaga

SEQ ID NO: 436982 - DNA, 25 bp, Homo sapien
aggcaacgcacagagcacagcagct

SEQ ID NO: 436983 - DNA, 25 bp, Homo sapien
acactgggcccggtggtgtgcactc

SEQ ID NO: 436984 - DNA, 25 bp, Homo sapien
tagtttctccgtccctacacaggga

SEQ ID NO: 436985 - DNA, 25 bp, Homo sapien
ggagctcctccccaagggtagatcg

SEQ ID NO: 436986 - DNA, 25 bp, Homo sapien
cccaagggtagatcggaccgttcat

SEQ ID NO: 436987 - DNA, 25 bp, Homo sapien
ggaccgttcatgctgcctataggca

SEQ ID NO: 436988 - DNA, 25 bp, Homo sapien
gcctataggcattatgtccctcaaa

SEQ ID NO: 436989 - DNA, 25 bp, Homo sapien
tttgcctgcatcctgtgtacaacat

SEQ ID NO: 436990 - DNA, 25 bp, Homo sapien
tgctgcagtatgtatcggcatcctc

SEQ ID NO: 436991 - DNA, 25 bp, Homo sapien
ggtgcctactctgggagcagcgact

SEQ ID NO: 436992 - DNA, 25 bp, Homo sapien
agctcagacagcgaaggcaccatca

SEQ ID NO: 436993 - DNA, 25 bp, Homo sapien
ggcaccatcaatgccaccggaaaga

SEQ ID NO: 436994 - DNA, 25 bp, Homo sapien
accggaaagattgtctcctccatct

SEQ ID NO: 436995 - DNA, 25 bp, Homo sapien
tctggactcttctgcctgagggaga

SEQ ID NO: 436996 - DNA, 25 bp, Homo sapien
agggagaggcaaacgaccccacatt

SEQ ID NO: 436997 - DNA, 25 bp, Homo sapien
aacgaccccacattgtttgaatgaa

SEQ ID NO: 436998 - DNA, 25 bp, Homo sapien
agtatggaaaaatgctgccccacag

SEQ ID NO: 436999 - DNA, 25 bp, Homo sapien
cacagctctgattttggcaatgcaa

SEQ ID NO: 437000 - DNA, 25 bp, Homo sapien
tttggcaatgcaaggtgctgctgct

SEQ ID NO: 437001 - DNA, 25 bp, Homo sapien
actggctcctaaccacctgggactg

SEQ ID NO: 437002 - DNA, 25 bp, Homo sapien
ggcaacagggcatggcagcagtgat

SEQ ID NO: 437003 - DNA, 25 bp, Homo sapien
gatggcagccaagagcaagagagca

SEQ ID NO: 437004 - DNA, 25 bp, Homo sapien
agcaagagagcagagttcccccgag

SEQ ID NO: 437005 - DNA, 25 bp, Homo sapien
gcctcaaaccgttcccagataagat

SEQ ID NO: 437006 - DNA, 25 bp, Homo sapien
gcctatctattgcatctgaagtata

SEQ ID NO: 437007 - DNA, 25 bp, Homo sapien
gaagttggatgtctacatactatag

SEQ ID NO: 437008 - DNA, 25 bp, Homo sapien
gtctacatactatagtaactacttg

SEQ ID NO: 437009 - DNA, 25 bp, Homo sapien
gtaactacttgacaggatacctacc

SEQ ID NO: 437010 - DNA, 25 bp, Homo sapien
tacttgacaggatacctaccttata

SEQ ID NO: 437011 - DNA, 25 bp, Homo sapien
caagcggggcaacgagactctgtct

SEQ ID NO: 437012 - DNA, 25 bp, Homo sapien
tgactttcaagttatccagccactc

SEQ ID NO: 437013 - DNA, 25 bp, Homo sapien
atccagccactcctcttcttaaaaa

SEQ ID NO: 437014 - DNA, 25 bp, Homo sapien
aaattaaacctaaactctggcatct

SEQ ID NO: 437015 - DNA, 25 bp, Homo sapien
tctggcatctataagacaaaaagct

SEQ ID NO: 437016 - DNA, 25 bp, Homo sapien
attcctatgaatgcctatctattgc

SEQ ID NO: 437017 - DNA, 25 bp, Homo sapien
accctggactcttctgtgtgcagga

SEQ ID NO: 437018 - DNA, 25 bp, Homo sapien
cctggactcttctgtgtgcaggaag

SEQ ID NO: 437019 - DNA, 25 bp, Homo sapien
tggactcttctgtgtgcaggaagat

SEQ ID NO: 437020 - DNA, 25 bp, Homo sapien
gtgtgcaggaagatgcgccagcccc

SEQ ID NO: 437021 - DNA, 25 bp, Homo sapien
tgtgcaggaagatgcgccagcccct

SEQ ID NO: 437022 - DNA, 25 bp, Homo sapien
gtgcaggaagatgcgccagcccctg

SEQ ID NO: 437023 - DNA, 25 bp, Homo sapien
agggggacgggcacccatcactccg

SEQ ID NO: 437024 - DNA, 25 bp, Homo sapien
ccatcactccgcaggcgaatcagag

SEQ ID NO: 437025 - DNA, 25 bp, Homo sapien
cactccgcaggcgaatcagagcccc

SEQ ID NO: 437026 - DNA, 25 bp, Homo sapien
tgtgcttcccccagagccagctagt

SEQ ID NO: 437027 - DNA, 25 bp, Homo sapien
agagccagctagtcccacctgcagc

SEQ ID NO: 437028 - DNA, 25 bp, Homo sapien
ctcaaagccaagtttacatctgtgt

SEQ ID NO: 437029 - DNA, 25 bp, Homo sapien
atctgtgtacacaagtgtgcatgca

SEQ ID NO: 437030 - DNA, 25 bp, Homo sapien
ctcctattcctgtattgtattaagt

SEQ ID NO: 437031 - DNA, 25 bp, Homo sapien
tattaagtgtactatcatgttcttg

SEQ ID NO: 437032 - DNA, 25 bp, Homo sapien
atgttcttgaggcatatctccagga

SEQ ID NO: 437033 - DNA, 25 bp, Homo sapien
acgctagagctagatactcctttaa

SEQ ID NO: 437034 - DNA, 25 bp, Homo sapien
gatactcctttaatctctattacgt

SEQ ID NO: 437035 - DNA, 25 bp, Homo sapien
aatctctattacgtcagatctctgg

SEQ ID NO: 437036 - DNA, 25 bp, Homo sapien
tcagatctctggctcccttttacaa

SEQ ID NO: 437037 - DNA, 25 bp, Homo sapien
tggctcccttttacaaccaggcaat

SEQ ID NO: 437038 - DNA, 25 bp, Homo sapien
caaccaggcaatcttcaattatagg

SEQ ID NO: 437039 - DNA, 25 bp, Homo sapien
gaccctgtcccagaattatcagtat

SEQ ID NO: 437040 - DNA, 25 bp, Homo sapien
tgtcccagaattatcagtatgaagt

SEQ ID NO: 437041 - DNA, 25 bp, Homo sapien
atcagtatgaagtttacctggcaga

SEQ ID NO: 437042 - DNA, 25 bp, Homo sapien
aagtttacctggcagaaagctctga

SEQ ID NO: 437043 - DNA, 25 bp, Homo sapien
tacctggcagaaagctctgagagcc

SEQ ID NO: 437044 - DNA, 25 bp, Homo sapien
gctctgagagccagttaaagtttct

SEQ ID NO: 437045 - DNA, 25 bp, Homo sapien
ctgagagccagttaaagtttcttaa

SEQ ID NO: 437046 - DNA, 25 bp, Homo sapien
gggacagcgaggcaaactccaactc

SEQ ID NO: 437047 - DNA, 25 bp, Homo sapien
agcgaggcaaactccaactctagga

SEQ ID NO: 437048 - DNA, 25 bp, Homo sapien
ggcaaactccaactctaggaatcat

SEQ ID NO: 437049 - DNA, 25 bp, Homo sapien
aactccaactctaggaatcattttg

SEQ ID NO: 437050 - DNA, 25 bp, Homo sapien
aggctctgccaacaggaaggaaagt

SEQ ID NO: 437051 - DNA, 25 bp, Homo sapien
ggctctgccaacaggaaggaaagtt

SEQ ID NO: 437052 - DNA, 25 bp, Homo sapien
gctctgccaacaggaaggaaagttc

SEQ ID NO: 437053 - DNA, 25 bp, Homo sapien
ctctgccaacaggaaggaaagttct

SEQ ID NO: 437054 - DNA, 25 bp, Homo sapien
tctgccaacaggaaggaaagttctg

SEQ ID NO: 437055 - DNA, 25 bp, Homo sapien
ctgccaacaggaaggaaagttctga

SEQ ID NO: 437056 - DNA, 25 bp, Homo sapien
tgccaacaggaaggaaagttctgag

SEQ ID NO: 437057 - DNA, 25 bp, Homo sapien
gccaacaggaaggaaagttctgagc

SEQ ID NO: 437058 - DNA, 25 bp, Homo sapien
caacaggaaggaaagttctgagcaa

SEQ ID NO: 437059 - DNA, 25 bp, Homo sapien
acaggaaggaaagttctgagcaaaa

SEQ ID NO: 437060 - DNA, 25 bp, Homo sapien
gaaggaaagttctgagcaaaagagg

SEQ ID NO: 437061 - DNA, 25 bp, Homo sapien
aaagagatgctgcaccactcacttc

SEQ ID NO: 437062 - DNA, 25 bp, Homo sapien
tggagacagggacagcgacttcctt

SEQ ID NO: 437063 - DNA, 25 bp, Homo sapien
agggacagcgacttccttgcagcct

SEQ ID NO: 437064 - DNA, 25 bp, Homo sapien
cagagacgtgtgtcggagttgccca

SEQ ID NO: 437065 - DNA, 25 bp, Homo sapien
acgtgtgtcggagttgcccagccca

SEQ ID NO: 437066 - DNA, 25 bp, Homo sapien
tgcccacgtgggacctcactgcatt

SEQ ID NO: 437067 - DNA, 25 bp, Homo sapien
attcccagcaccgaaagcatcatag

SEQ ID NO: 437068 - DNA, 25 bp, Homo sapien
aagcatcatagttttccccagttat

SEQ ID NO: 437069 - DNA, 25 bp, Homo sapien
gttttccccagttatatgtagcata

SEQ ID NO: 437070 - DNA, 25 bp, Homo sapien
ataaatgtctcccttaggcatgata

SEQ ID NO: 437071 - DNA, 25 bp, Homo sapien
gtctcccttaggcatgataaacatt

SEQ ID NO: 437072 - DNA, 25 bp, Homo sapien
ttgtctcattgtgttattgtctgac

SEQ ID NO: 437073 - DNA, 25 bp, Homo sapien
tgtctcattgtgttattgtctgact

SEQ ID NO: 437074 - DNA, 25 bp, Homo sapien
gtctcattgtgttattgtctgacta

SEQ ID NO: 437075 - DNA, 25 bp, Homo sapien
tctcattgtgttattgtctgactaa

SEQ ID NO: 437076 - DNA, 25 bp, Homo sapien
ctcattgtgttattgtctgactaaa

SEQ ID NO: 437077 - DNA, 25 bp, Homo sapien
cattgtgttattgtctgactaaatc

SEQ ID NO: 437078 - DNA, 25 bp, Homo sapien
gtgttattgtctgactaaatctaaa

SEQ ID NO: 437079 - DNA, 25 bp, Homo sapien
taaatctaaaaccaaacccatgttg

SEQ ID NO: 437080 - DNA, 25 bp, Homo sapien
ccaaacccatgttgaaactagtact

SEQ ID NO: 437081 - DNA, 25 bp, Homo sapien
caaacccatgttgaaactagtactt

SEQ ID NO: 437082 - DNA, 25 bp, Homo sapien
catgttgaaactagtacttttccct

SEQ ID NO: 437083 - DNA, 25 bp, Homo sapien
tatccgggaggagcatatgtacgca

SEQ ID NO: 437084 - DNA, 25 bp, Homo sapien
ggagcatatgtacgcaaatcctggg

SEQ ID NO: 437085 - DNA, 25 bp, Homo sapien
tcctggggcgtttgcaaacccggat

SEQ ID NO: 437086 - DNA, 25 bp, Homo sapien
ccgggcgtttgagggctactgccac

SEQ ID NO: 437087 - DNA, 25 bp, Homo sapien
ttgagggctactgccacgcagcgtt

SEQ ID NO: 437088 - DNA, 25 bp, Homo sapien
tgccacgcagcgtttctggagcctg

SEQ ID NO: 437089 - DNA, 25 bp, Homo sapien
tttctggagcctgccggctggtgcc

SEQ ID NO: 437090 - DNA, 25 bp, Homo sapien
tgccctggtggcctttatctctgtc

SEQ ID NO: 437091 - DNA, 25 bp, Homo sapien
tttgtcctctttatctcaggctctc

SEQ ID NO: 437092 - DNA, 25 bp, Homo sapien
tagtttttcctaagaagtggcgtgg

SEQ ID NO: 437093 - DNA, 25 bp, Homo sapien
tttcctaagaagtggcgtggtttgg

SEQ ID NO: 437094 - DNA, 25 bp, Homo sapien
ccacctgcatagtctgacacatacg

SEQ ID NO: 437095 - DNA, 25 bp, Homo sapien
tagtctgacacatacgtatgtacag

SEQ ID NO: 437096 - DNA, 25 bp, Homo sapien
gtatgtacagttagacttgcaggct

SEQ ID NO: 437097 - DNA, 25 bp, Homo sapien
aggctgcaggagtgccctgcattgt

SEQ ID NO: 437098 - DNA, 25 bp, Homo sapien
aggagtgccctgcattgttttcttt

SEQ ID NO: 437099 - DNA, 25 bp, Homo sapien
agtctaaatgtggttctggtgctgg

SEQ ID NO: 437100 - DNA, 25 bp, Homo sapien
tatgtaacaatataggacccctcca

SEQ ID NO: 437101 - DNA, 25 bp, Homo sapien
cccctccaaataggttttgcttctg

SEQ ID NO: 437102 - DNA, 25 bp, Homo sapien
aaataggttttgcttctggtgaatc

SEQ ID NO: 437103 - DNA, 25 bp, Homo sapien
ctggtgaatcttggtcattgggtta

SEQ ID NO: 437104 - DNA, 25 bp, Homo sapien
cattgggttagtatatgactgtcta

SEQ ID NO: 437105 - DNA, 25 bp, Homo sapien
agccccatgcccctgttcggaaatg

SEQ ID NO: 437106 - DNA, 25 bp, Homo sapien
atcttgtcatttgaggatgccaacc

SEQ ID NO: 437107 - DNA, 25 bp, Homo sapien
tgccaaccgcgccatgcagactggt

SEQ ID NO: 437108 - DNA, 25 bp, Homo sapien
tgcagactggtgtcaccgggatcat

SEQ ID NO: 437109 - DNA, 25 bp, Homo sapien
gggatcatgattgcccgtggcgccc

SEQ ID NO: 437110 - DNA, 25 bp, Homo sapien
aagccgtggctcttcacggagatca

SEQ ID NO: 437111 - DNA, 25 bp, Homo sapien
ttcacggagatcaaggagcagcggc

SEQ ID NO: 437112 - DNA, 25 bp, Homo sapien
gagcagcggcactgggacatctcgt

SEQ ID NO: 437113 - DNA, 25 bp, Homo sapien
acatctcgtcgtccgagcgcctgga

SEQ ID NO: 437114 - DNA, 25 bp, Homo sapien
tcctgcgggacttcaccaactacgg

SEQ ID NO: 437115 - DNA, 25 bp, Homo sapien
accaactacggcctggagcactggg

SEQ ID NO: 437116 - DNA, 25 bp, Homo sapien
ctgttagcagttatttcgagttatt

SEQ ID NO: 437117 - DNA, 25 bp, Homo sapien
tactaagtatgtgtgagcctggagc

SEQ ID NO: 437118 - DNA, 25 bp, Homo sapien
tgagcctggagctgccatggagcat

SEQ ID NO: 437119 - DNA, 25 bp, Homo sapien
gccatggagcatgtagagagagtct

SEQ ID NO: 437120 - DNA, 25 bp, Homo sapien
gagagagtctcctagttgataccaa

SEQ ID NO: 437121 - DNA, 25 bp, Homo sapien
gttgataccaactcaggaaagcaga

SEQ ID NO: 437122 - DNA, 25 bp, Homo sapien
aaagagacattttgggcctgatgac

SEQ ID NO: 437123 - DNA, 25 bp, Homo sapien
gacattttgggcctgatgacatcat

SEQ ID NO: 437124 - DNA, 25 bp, Homo sapien
cctggatccagcgatgcctaaagat

SEQ ID NO: 437125 - DNA, 25 bp, Homo sapien
gcgatgcctaaagatgtgactccta

SEQ ID NO: 437126 - DNA, 25 bp, Homo sapien
gatgtgactcctagacttttcactt

SEQ ID NO: 437127 - DNA, 25 bp, Homo sapien
gtgcgtgttgatagcaataatttgt

SEQ ID NO: 437128 - DNA, 25 bp, Homo sapien
taaagattctaaaaggtctgagacc

SEQ ID NO: 437129 - DNA, 25 bp, Homo sapien
ggtctgagacctgtagcattaatta

SEQ ID NO: 437130 - DNA, 25 bp, Homo sapien
gcattaattatttgagtgccctccc

SEQ ID NO: 437131 - DNA, 25 bp, Homo sapien
ctctccttctcctttattcattgtt

SEQ ID NO: 437132 - DNA, 25 bp, Homo sapien
aagtatctgtggtttggttctggca

SEQ ID NO: 437133 - DNA, 25 bp, Homo sapien
atctgtggtttggttctggcatttt

SEQ ID NO: 437134 - DNA, 25 bp, Homo sapien
ttggttctggcattttgttcccacc

SEQ ID NO: 437135 - DNA, 25 bp, Homo sapien
cttgccatcctgcagtagtataaat

SEQ ID NO: 437136 - DNA, 25 bp, Homo sapien
gccatcctgcagtagtataaatcat

SEQ ID NO: 437137 - DNA, 25 bp, Homo sapien
tcctgcagtagtataaatcatgaat

SEQ ID NO: 437138 - DNA, 25 bp, Homo sapien
aggctctgccaacaggaaggaaagt

SEQ ID NO: 437139 - DNA, 25 bp, Homo sapien
ggctctgccaacaggaaggaaagtt

SEQ ID NO: 437140 - DNA, 25 bp, Homo sapien
gctctgccaacaggaaggaaagttc

SEQ ID NO: 437141 - DNA, 25 bp, Homo sapien
ctctgccaacaggaaggaaagttct

SEQ ID NO: 437142 - DNA, 25 bp, Homo sapien
tctgccaacaggaaggaaagttctg

SEQ ID NO: 437143 - DNA, 25 bp, Homo sapien
ctgccaacaggaaggaaagttctga

SEQ ID NO: 437144 - DNA, 25 bp, Homo sapien
tgccaacaggaaggaaagttctgag

SEQ ID NO: 437145 - DNA, 25 bp, Homo sapien
gccaacaggaaggaaagttctgagc

SEQ ID NO: 437146 - DNA, 25 bp, Homo sapien
agcacatgtgactaagtttgcattt

SEQ ID NO: 437147 - DNA, 25 bp, Homo sapien
tttgcatttgtcagtattgttctac

SEQ ID NO: 437148 - DNA, 25 bp, Homo sapien
ttctactgtttgtactgaaagtctc

SEQ ID NO: 437149 - DNA, 25 bp, Homo sapien
gtactgaaagtctcattttaaaatt

SEQ ID NO: 437150 - DNA, 25 bp, Homo sapien
aaaattgctacttaacactgtacta

SEQ ID NO: 437151 - DNA, 25 bp, Homo sapien
aacactgtactataccttgtaattt

SEQ ID NO: 437152 - DNA, 25 bp, Homo sapien
ttttagattctccacttgtattctt

SEQ ID NO: 437153 - DNA, 25 bp, Homo sapien
tccagatgcctttagttttagctgc

SEQ ID NO: 437154 - DNA, 25 bp, Homo sapien
atgcctttagttttagctgctgtaa

SEQ ID NO: 437155 - DNA, 25 bp, Homo sapien
tagctactttgcgttatttgatata

SEQ ID NO: 437156 - DNA, 25 bp, Homo sapien
aaactccatttatttatacagagac

SEQ ID NO: 437157 - DNA, 25 bp, Homo sapien
gatgtgcaaccagacacttcagctt

SEQ ID NO: 437158 - DNA, 25 bp, Homo sapien
tttaacttctacttcatgtgatcca

SEQ ID NO: 437159 - DNA, 25 bp, Homo sapien
gatcaacagcaatctgaagactctg

SEQ ID NO: 437160 - DNA, 25 bp, Homo sapien
gaagactctgactaacatgcagaat

SEQ ID NO: 437161 - DNA, 25 bp, Homo sapien
atgcagaatctacccaataccacac

SEQ ID NO: 437162 - DNA, 25 bp, Homo sapien
aaaaacaatattgcctcctccaatc

SEQ ID NO: 437163 - DNA, 25 bp, Homo sapien
aatattgcctcctccaatctgtgtt

SEQ ID NO: 437164 - DNA, 25 bp, Homo sapien
aatctgtgttctcaactgtggttgc

SEQ ID NO: 437165 - DNA, 25 bp, Homo sapien
ggttgccacctcattaacttacaaa

SEQ ID NO: 437166 - DNA, 25 bp, Homo sapien
gaagggcatgctgagcactcaaaca

SEQ ID NO: 437167 - DNA, 25 bp, Homo sapien
gctgagcactcaaacaatttgttct

SEQ ID NO: 437168 - DNA, 25 bp, Homo sapien
tattcagtgtattccatgtttcagc

SEQ ID NO: 437169 - DNA, 25 bp, Homo sapien
gtgtattccatgtttcagcataagg

SEQ ID NO: 437170 - DNA, 25 bp, Homo sapien
aaggaaagtttgtgcctgatatggc

SEQ ID NO: 437171 - DNA, 25 bp, Homo sapien
gatatggcaggagaaagaacactat

SEQ ID NO: 437172 - DNA, 25 bp, Homo sapien
aagaacactatggtaatttcattgt

SEQ ID NO: 437173 - DNA, 25 bp, Homo sapien
aatttcattgttacttcaggtctct

SEQ ID NO: 437174 - DNA, 25 bp, Homo sapien
tgttacttcaggtctctttcaatct

SEQ ID NO: 437175 - DNA, 25 bp, Homo sapien
ttcaatctgaagaactgggttgtct

SEQ ID NO: 437176 - DNA, 25 bp, Homo sapien
aactgggttgtctggagaattgaac

SEQ ID NO: 437177 - DNA, 25 bp, Homo sapien
gaacatagccaagcaatattatcaa

SEQ ID NO: 437178 - DNA, 25 bp, Homo sapien
aagttttattcagaggatctatgta

SEQ ID NO: 437179 - DNA, 25 bp, Homo sapien
cacacgtggccgtccggcctccggg

SEQ ID NO: 437180 - DNA, 25 bp, Homo sapien
tggccgtccggcctccgggatcagt

SEQ ID NO: 437181 - DNA, 25 bp, Homo sapien
ggccgtccggcctccgggatcagtg

SEQ ID NO: 437182 - DNA, 25 bp, Homo sapien
gccgtccggcctccgggatcagtgg

SEQ ID NO: 437183 - DNA, 25 bp, Homo sapien
tccggcctccgggatcagtggggat

SEQ ID NO: 437184 - DNA, 25 bp, Homo sapien
cggcctccgggatcagtggggatga

SEQ ID NO: 437185 - DNA, 25 bp, Homo sapien
atgagtttgaacttggaaggagaat

SEQ ID NO: 437186 - DNA, 25 bp, Homo sapien
tgagtttgaacttggaaggagaatg

SEQ ID NO: 437187 - DNA, 25 bp, Homo sapien
agtttgaacttggaaggagaatggc

SEQ ID NO: 437188 - DNA, 25 bp, Homo sapien
gtttgaacttggaaggagaatggca

SEQ ID NO: 437189 - DNA, 25 bp, Homo sapien
tttgaacttggaaggagaatggcat

SEQ ID NO: 437190 - DNA, 25 bp, Homo sapien
ggtgtctggcggatgcggtcgtgaa

SEQ ID NO: 437191 - DNA, 25 bp, Homo sapien
cggtcgtgaagataggtactggttt

SEQ ID NO: 437192 - DNA, 25 bp, Homo sapien
ggtactggttttggattaggaattg

SEQ ID NO: 437193 - DNA, 25 bp, Homo sapien
ggattaggaattgttttctcactta

SEQ ID NO: 437194 - DNA, 25 bp, Homo sapien
agaatgtggccattagccttcggtt

SEQ ID NO: 437195 - DNA, 25 bp, Homo sapien
agccttcggttctggcatgggatta

SEQ ID NO: 437196 - DNA, 25 bp, Homo sapien
gaatggcttattccaactgtcagca

SEQ ID NO: 437197 - DNA, 25 bp, Homo sapien
aactgtcagcatgatttccaggctc

SEQ ID NO: 437198 - DNA, 25 bp, Homo sapien
tgatttccaggctccatatcttcta

SEQ ID NO: 437199 - DNA, 25 bp, Homo sapien
aaatatgtcaaagagcaggagcagt

SEQ ID NO: 437200 - DNA, 25 bp, Homo sapien
aacatgtctgagtcggagctcggca

SEQ ID NO: 437201 - DNA, 25 bp, Homo sapien
tcgtggtcagtaaattccgggaaat

SEQ ID NO: 437202 - DNA, 25 bp, Homo sapien
aattcaacaggagctttccagtgga

SEQ ID NO: 437203 - DNA, 25 bp, Homo sapien
caacaggagctttccagtggaagga

SEQ ID NO: 437204 - DNA, 25 bp, Homo sapien
atgaaggccagctgaatggtgaaac

SEQ ID NO: 437205 - DNA, 25 bp, Homo sapien
gtgaaacaaatacacccattgaagg

SEQ ID NO: 437206 - DNA, 25 bp, Homo sapien
gaagatagaggaagtactttctggg

SEQ ID NO: 437207 - DNA, 25 bp, Homo sapien
gggtcttagatacagaactacgata

SEQ ID NO: 437208 - DNA, 25 bp, Homo sapien
agatacagaactacgatataagcca

SEQ ID NO: 437209 - DNA, 25 bp, Homo sapien
gaccaacatcgagcagatttttagg

SEQ ID NO: 437210 - DNA, 25 bp, Homo sapien
gatttttaggtctttcgtggtcagt

SEQ ID NO: 437211 - DNA, 25 bp, Homo sapien
ggtctttcgtggtcagtaaattccg

SEQ ID NO: 437212 - DNA, 25 bp, Homo sapien
tgatcttccctaaacatcgacgttc

SEQ ID NO: 437213 - DNA, 25 bp, Homo sapien
gacgttcctggaaatctttggcctc

SEQ ID NO: 437214 - DNA, 25 bp, Homo sapien
aaatctttggcctctgagctgactt

SEQ ID NO: 437215 - DNA, 25 bp, Homo sapien
ttctctgttgcttgtgagccaggaa

SEQ ID NO: 437216 - DNA, 25 bp, Homo sapien
tctgttgtatgtgcaggctgcagat

SEQ ID NO: 437217 - DNA, 25 bp, Homo sapien
agatgcttctcttcagcttttgcta

SEQ ID NO: 437218 - DNA, 25 bp, Homo sapien
cagcttttgctatccaatgtgtgtg

SEQ ID NO: 437219 - DNA, 25 bp, Homo sapien
ttaaaaaacctgttgcttccatgca

SEQ ID NO: 437220 - DNA, 25 bp, Homo sapien
atgcaacggcccacacaacttggga

SEQ ID NO: 437221 - DNA, 25 bp, Homo sapien
aacttgggactcatggtcagcctca

SEQ ID NO: 437222 - DNA, 25 bp, Homo sapien
gcctcaccttccacattggctaaaa

SEQ ID NO: 437223 - DNA, 25 bp, Homo sapien
atgatagtggatcagaagcatgatt

SEQ ID NO: 437224 - DNA, 25 bp, Homo sapien
tgatagtggatcagaagcatgattt

SEQ ID NO: 437225 - DNA, 25 bp, Homo sapien
gatagtggatcagaagcatgattta

SEQ ID NO: 437226 - DNA, 25 bp, Homo sapien
atagtggatcagaagcatgatttaa

SEQ ID NO: 437227 - DNA, 25 bp, Homo sapien
tagtggatcagaagcatgatttaaa

SEQ ID NO: 437228 - DNA, 25 bp, Homo sapien
agtggatcagaagcatgatttaaaa

SEQ ID NO: 437229 - DNA, 25 bp, Homo sapien
gtggatcagaagcatgatttaaaag

SEQ ID NO: 437230 - DNA, 25 bp, Homo sapien
tggatcagaagcatgatttaaaaga

SEQ ID NO: 437231 - DNA, 25 bp, Homo sapien
ggatcagaagcatgatttaaaagaa

SEQ ID NO: 437232 - DNA, 25 bp, Homo sapien
gatcagaagcatgatttaaaagaaa

SEQ ID NO: 437233 - DNA, 25 bp, Homo sapien
tgcaatcccagctagtccggaggct

SEQ ID NO: 437234 - DNA, 25 bp, Homo sapien
gaaatgtttaaatctgtctatgcca

SEQ ID NO: 437235 - DNA, 25 bp, Homo sapien
tgtttaaatctgtctatgccatatg

SEQ ID NO: 437236 - DNA, 25 bp, Homo sapien
tttaaatctgtctatgccatatgtg

SEQ ID NO: 437237 - DNA, 25 bp, Homo sapien
aaatctgtctatgccatatgtgcct

SEQ ID NO: 437238 - DNA, 25 bp, Homo sapien
atctgtctatgccatatgtgcctct

SEQ ID NO: 437239 - DNA, 25 bp, Homo sapien
ctgtctatgccatatgtgcctctgg

SEQ ID NO: 437240 - DNA, 25 bp, Homo sapien
tggtttctgtctttaatttttgtca

SEQ ID NO: 437241 - DNA, 25 bp, Homo sapien
gtctttaatttttgtcagaagaaat

SEQ ID NO: 437242 - DNA, 25 bp, Homo sapien
gatctcaaaacatctgcttttattg

SEQ ID NO: 437243 - DNA, 25 bp, Homo sapien
caaaacatctgcttttattgtaggg

SEQ ID NO: 437244 - DNA, 25 bp, Homo sapien
attgtaggggctcgtgctgccatct

SEQ ID NO: 437245 - DNA, 25 bp, Homo sapien
gcaggcccactgtccttgggtttaa

SEQ ID NO: 437246 - DNA, 25 bp, Homo sapien
ggcccactgtccttgggtttaatga

SEQ ID NO: 437247 - DNA, 25 bp, Homo sapien
tccttgggtttaatgacgtctcttc

SEQ ID NO: 437248 - DNA, 25 bp, Homo sapien
gggtttaatgacgtctcttctctgt

SEQ ID NO: 437249 - DNA, 25 bp, Homo sapien
tctctgtggaacttcacgattcctt

SEQ ID NO: 437250 - DNA, 25 bp, Homo sapien
tgtggaacttcacgattccttccca

SEQ ID NO: 437251 - DNA, 25 bp, Homo sapien
gattccttcccacggtcaactcggg

SEQ ID NO: 437252 - DNA, 25 bp, Homo sapien
gggacttggccgagcggatcctaat

SEQ ID NO: 437253 - DNA, 25 bp, Homo sapien
ttggccgagcggatcctaataaggg

SEQ ID NO: 437254 - DNA, 25 bp, Homo sapien
aattttaccgccagtgtgctgtcgt

SEQ ID NO: 437255 - DNA, 25 bp, Homo sapien
tttaccgccagtgtgctgtcgttcc

SEQ ID NO: 437256 - DNA, 25 bp, Homo sapien
agcctctggcaatttctagagggag

SEQ ID NO: 437257 - DNA, 25 bp, Homo sapien
atgcaccattgaatgctggagcctt

SEQ ID NO: 437258 - DNA, 25 bp, Homo sapien
atgctggagccttggaagcgaatct

SEQ ID NO: 437259 - DNA, 25 bp, Homo sapien
gaagcgaatctgatggtcctaggag

SEQ ID NO: 437260 - DNA, 25 bp, Homo sapien
gtcctaggaggttcgggaagaccat

SEQ ID NO: 437261 - DNA, 25 bp, Homo sapien
gttcgggaagaccatctgaggccta

SEQ ID NO: 437262 - DNA, 25 bp, Homo sapien
gaagaccatctgaggcctatgccat

SEQ ID NO: 437263 - DNA, 25 bp, Homo sapien
atctgaggcctatgccatctggact

SEQ ID NO: 437264 - DNA, 25 bp, Homo sapien
aggcctatgccatctggactgtctg

SEQ ID NO: 437265 - DNA, 25 bp, Homo sapien
atctggactgtctgctggcaatttc

SEQ ID NO: 437266 - DNA, 25 bp, Homo sapien
ggactgtctgctggcaatttctttt

SEQ ID NO: 437267 - DNA, 25 bp, Homo sapien
aggaggcgctgcacaggcagttact

SEQ ID NO: 437268 - DNA, 25 bp, Homo sapien
gaggcgctgcacaggcagttactgc

SEQ ID NO: 437269 - DNA, 25 bp, Homo sapien
aggcgctgcacaggcagttactgct

SEQ ID NO: 437270 - DNA, 25 bp, Homo sapien
aaagcggtggctgagattataacat

SEQ ID NO: 437271 - DNA, 25 bp, Homo sapien
aagcggtggctgagattataacatt

SEQ ID NO: 437272 - DNA, 25 bp, Homo sapien
gcggtggctgagattataacatttt

SEQ ID NO: 437273 - DNA, 25 bp, Homo sapien
cggtggctgagattataacatttta

SEQ ID NO: 437274 - DNA, 25 bp, Homo sapien
gtggctgagattataacattttaaa

SEQ ID NO: 437275 - DNA, 25 bp, Homo sapien
aagagatgccaattcaagtccaaac

SEQ ID NO: 437276 - DNA, 25 bp, Homo sapien
gagatgccaattcaagtccaaacct

SEQ ID NO: 437277 - DNA, 25 bp, Homo sapien
gatgccaattcaagtccaaaccttt

SEQ ID NO: 437278 - DNA, 25 bp, Homo sapien
tacataagaaattacatacctggcc

SEQ ID NO: 437279 - DNA, 25 bp, Homo sapien
acataagaaattacatacctggcca

SEQ ID NO: 437280 - DNA, 25 bp, Homo sapien
cataagaaattacatacctggccag

SEQ ID NO: 437281 - DNA, 25 bp, Homo sapien
ataagaaattacatacctggccagg

SEQ ID NO: 437282 - DNA, 25 bp, Homo sapien
taagaaattacatacctggccaggt

SEQ ID NO: 437283 - DNA, 25 bp, Homo sapien
aagaaattacatacctggccaggtg

SEQ ID NO: 437284 - DNA, 25 bp, Homo sapien
agaaattacatacctggccaggtgc

SEQ ID NO: 437285 - DNA, 25 bp, Homo sapien
gaaattacatacctggccaggtgca

SEQ ID NO: 437286 - DNA, 25 bp, Homo sapien
tacttaggaggttgcgatgggagaa

SEQ ID NO: 437287 - DNA, 25 bp, Homo sapien
aggacactcagacactgaccgtgat

SEQ ID NO: 437288 - DNA, 25 bp, Homo sapien
agacactgaccgtgataactcgtcc

SEQ ID NO: 437289 - DNA, 25 bp, Homo sapien
cgtgataactcgtccctgacaggga

SEQ ID NO: 437290 - DNA, 25 bp, Homo sapien
acacaaagattgttgcgggtctgaa

SEQ ID NO: 437291 - DNA, 25 bp, Homo sapien
ttgttgcgggtctgaaatggcctgt

SEQ ID NO: 437292 - DNA, 25 bp, Homo sapien
tgctggaacaagagaggaccccact

SEQ ID NO: 437293 - DNA, 25 bp, Homo sapien
gccacagatagtagcagggctgttc

SEQ ID NO: 437294 - DNA, 25 bp, Homo sapien
ctgttcatggccacagtggcctcaa

SEQ ID NO: 437295 - DNA, 25 bp, Homo sapien
ggcctcaaaaggcaacgaattgaat

SEQ ID NO: 437296 - DNA, 25 bp, Homo sapien
gattcagagaattcctcctcagaga

SEQ ID NO: 437297 - DNA, 25 bp, Homo sapien
gaattcctcctcagagaagaaatta

SEQ ID NO: 437298 - DNA, 25 bp, Homo sapien
tgggcttgggaagaaatggccatta

SEQ ID NO: 437299 - DNA, 25 bp, Homo sapien
aatggccattatttacagattgtat

SEQ ID NO: 437300 - DNA, 25 bp, Homo sapien
ggtacatattgtgtgatacttgaaa

SEQ ID NO: 437301 - DNA, 25 bp, Homo sapien
gaaaagataaaagggactgccagcc

SEQ ID NO: 437302 - DNA, 25 bp, Homo sapien
gcccctaactgaaatctgaagcttt

SEQ ID NO: 437303 - DNA, 25 bp, Homo sapien
gctttttatcgcttatttttcctcg

SEQ ID NO: 437304 - DNA, 25 bp, Homo sapien
tatcgcttatttttcctcgccctgt

SEQ ID NO: 437305 - DNA, 25 bp, Homo sapien
ctttctccttgcattgtgatgatct

SEQ ID NO: 437306 - DNA, 25 bp, Homo sapien
gatctagtaggcacgtctgtcaaca

SEQ ID NO: 437307 - DNA, 25 bp, Homo sapien
acgtctgtcaacaggacacatgcct

SEQ ID NO: 437308 - DNA, 25 bp, Homo sapien
aacctcttaatagttgtgtataatg

SEQ ID NO: 437309 - DNA, 25 bp, Homo sapien
gcaagagccatgattgtaggagtat

SEQ ID NO: 437310 - DNA, 25 bp, Homo sapien
acagtactttacaattttcacaagg

SEQ ID NO: 437311 - DNA, 25 bp, Homo sapien
tattggcttctcactacaccattat

SEQ ID NO: 437312 - DNA, 25 bp, Homo sapien
tctcactacaccattattaccattc

SEQ ID NO: 437313 - DNA, 25 bp, Homo sapien
attattaccattcccacttcacagg

SEQ ID NO: 437314 - DNA, 25 bp, Homo sapien
ttcacaggcaagtaaactgagtcac

SEQ ID NO: 437315 - DNA, 25 bp, Homo sapien
actgagtcacaggtaagcaaggcta

SEQ ID NO: 437316 - DNA, 25 bp, Homo sapien
caaggctaacagagtttgcatagat

SEQ ID NO: 437317 - DNA, 25 bp, Homo sapien
cagagtttgcatagataatctcaca

SEQ ID NO: 437318 - DNA, 25 bp, Homo sapien
gagtagtaacacaatgacttcattt

SEQ ID NO: 437319 - DNA, 25 bp, Homo sapien
tgacttcatttccatttcccagctt

SEQ ID NO: 437320 - DNA, 25 bp, Homo sapien
gatgtaaacacatctgatagttctc

SEQ ID NO: 437321 - DNA, 25 bp, Homo sapien
gatagttctctctgtaagccacttt

SEQ ID NO: 437322 - DNA, 25 bp, Homo sapien
ccactttccactgatttataaagct

SEQ ID NO: 437323 - DNA, 25 bp, Homo sapien
tgctgcatgcagtaatttcattgta

SEQ ID NO: 437324 - DNA, 25 bp, Homo sapien
aatttcattgtacattctcaactac

SEQ ID NO: 437325 - DNA, 25 bp, Homo sapien
gtacattctcaactacaatgcaatc

SEQ ID NO: 437326 - DNA, 25 bp, Homo sapien
acaatgcaatcttcaaaccctcttg

SEQ ID NO: 437327 - DNA, 25 bp, Homo sapien
aatcttcaaaccctcttgcagagct

SEQ ID NO: 437328 - DNA, 25 bp, Homo sapien
tcttgcagagcttgacatatctcat

SEQ ID NO: 437329 - DNA, 25 bp, Homo sapien
gagcttgacatatctcatcagaatt

SEQ ID NO: 437330 - DNA, 25 bp, Homo sapien
atgaacatagcaatgccaaagcatt

SEQ ID NO: 437331 - DNA, 25 bp, Homo sapien
gattgttcctgccaccctacatctg

SEQ ID NO: 437332 - DNA, 25 bp, Homo sapien
ttgttcctgccaccctacatctgcc

SEQ ID NO: 437333 - DNA, 25 bp, Homo sapien
gattgttcctgccaccctacaccgc

SEQ ID NO: 437334 - DNA, 25 bp, Homo sapien
ttgttcctgccaccctacaccgcag

SEQ ID NO: 437335 - DNA, 25 bp, Homo sapien
tcctgccaccctacaccgcagccgt

SEQ ID NO: 437336 - DNA, 25 bp, Homo sapien
tacctacagacggtgttctgtgccc

SEQ ID NO: 437337 - DNA, 25 bp, Homo sapien
acctacagacggtgttctgtgcccc

SEQ ID NO: 437338 - DNA, 25 bp, Homo sapien
tacagacggtgttctgtgccccctg

SEQ ID NO: 437339 - DNA, 25 bp, Homo sapien
agacggtgttctgtgccccctggtg

SEQ ID NO: 437340 - DNA, 25 bp, Homo sapien
acggtgttctgtgccccctggtgct

SEQ ID NO: 437341 - DNA, 25 bp, Homo sapien
tctgtgccccctggtgctgacaaga

SEQ ID NO: 437342 - DNA, 25 bp, Homo sapien
cagatcatgcatgccaatccctgtt

SEQ ID NO: 437343 - DNA, 25 bp, Homo sapien
tgccaatccctgttgccgcatggag

SEQ ID NO: 437344 - DNA, 25 bp, Homo sapien
cctgttgccgcatggagctcctcag

SEQ ID NO: 437345 - DNA, 25 bp, Homo sapien
tgcttccccgtcatgcatggtggtg

SEQ ID NO: 437346 - DNA, 25 bp, Homo sapien
cttccccgtcatgcatggtggtggt

SEQ ID NO: 437347 - DNA, 25 bp, Homo sapien
ggtgtttctacggtgtctggttctg

SEQ ID NO: 437348 - DNA, 25 bp, Homo sapien
ttctacggtgtctggttctgtgccc

SEQ ID NO: 437349 - DNA, 25 bp, Homo sapien
gttctgtgcccgtctctgagacagt

SEQ ID NO: 437350 - DNA, 25 bp, Homo sapien
tctgagacagtctctgtgtggaatt

SEQ ID NO: 437351 - DNA, 25 bp, Homo sapien
ctgtgtggaatttgccttaaactga

SEQ ID NO: 437352 - DNA, 25 bp, Homo sapien
gtggaatttgccttaaactgaagta

SEQ ID NO: 437353 - DNA, 25 bp, Homo sapien
cagggtgcagccttcagcccagagg

SEQ ID NO: 437354 - DNA, 25 bp, Homo sapien
tataccgagacgcagccacacgtgg

SEQ ID NO: 437355 - DNA, 25 bp, Homo sapien
tggccgtccggcctccgggatcagt

SEQ ID NO: 437356 - DNA, 25 bp, Homo sapien
gaacttggaaggagaatggcattat

SEQ ID NO: 437357 - DNA, 25 bp, Homo sapien
cattatctatagaggctgatgcagg

SEQ ID NO: 437358 - DNA, 25 bp, Homo sapien
acacctgcctctggttcccgcctgg

SEQ ID NO: 437359 - DNA, 25 bp, Homo sapien
agcttcaggaccccacctccaaagg

SEQ ID NO: 437360 - DNA, 25 bp, Homo sapien
ggcccctctgctcaatgcctacctc

SEQ ID NO: 437361 - DNA, 25 bp, Homo sapien
cctctgctcaatgcctacctcccta

SEQ ID NO: 437362 - DNA, 25 bp, Homo sapien
tgctcaatgcctacctccctagggc

SEQ ID NO: 437363 - DNA, 25 bp, Homo sapien
tccctagggccctgctgggacatgg

SEQ ID NO: 437364 - DNA, 25 bp, Homo sapien
gttagtaccaatgccatttctcctg

SEQ ID NO: 437365 - DNA, 25 bp, Homo sapien
atttctcctgtatttggaatccacg

SEQ ID NO: 437366 - DNA, 25 bp, Homo sapien
ggaatccacggctaacatggctata

SEQ ID NO: 437367 - DNA, 25 bp, Homo sapien
ataacctctgcggaacatctttttg

SEQ ID NO: 437368 - DNA, 25 bp, Homo sapien
gaacatctttttgtgcatatccaac

SEQ ID NO: 437369 - DNA, 25 bp, Homo sapien
aacttgcaaacgatggcacctacac

SEQ ID NO: 437370 - DNA, 25 bp, Homo sapien
acagctgtggccagttgtggataaa

SEQ ID NO: 437371 - DNA, 25 bp, Homo sapien
tagggttcggacagatctttggtga

SEQ ID NO: 437372 - DNA, 25 bp, Homo sapien
gatcagtctcatgatatcgggcatt

SEQ ID NO: 437373 - DNA, 25 bp, Homo sapien
tcgggcatttgtagctcggattcat

SEQ ID NO: 437374 - DNA, 25 bp, Homo sapien
ggacatatcgtatcgtccgatcctc

SEQ ID NO: 437375 - DNA, 25 bp, Homo sapien
gattggtccagtaccaactctggat

SEQ ID NO: 437376 - DNA, 25 bp, Homo sapien
aactctggatattttctgccctcat

SEQ ID NO: 437377 - DNA, 25 bp, Homo sapien
tggatattttctgccctcatcgcta

SEQ ID NO: 437378 - DNA, 25 bp, Homo sapien
atcgctatcccgtaatttaaggtgg

SEQ ID NO: 437379 - DNA, 25 bp, Homo sapien
ttttgaacaccattctttcccacat

SEQ ID NO: 437380 - DNA, 25 bp, Homo sapien
aagtcctgcgcactatctatttgga

SEQ ID NO: 437381 - DNA, 25 bp, Homo sapien
ggttcctagagtagcaccttcggag

SEQ ID NO: 437382 - DNA, 25 bp, Homo sapien
gtagcaccttcggagatttttagaa

SEQ ID NO: 437383 - DNA, 25 bp, Homo sapien
cgtgggagtgtgatcatttatgtct

SEQ ID NO: 437384 - DNA, 25 bp, Homo sapien
gtctttgaccaaaagctcagcacga

SEQ ID NO: 437385 - DNA, 25 bp, Homo sapien
gcaacggattttcaaataacacctg

SEQ ID NO: 437386 - DNA, 25 bp, Homo sapien
ttttcacccgggaaagaggtgagag

SEQ ID NO: 437387 - DNA, 25 bp, Homo sapien
gaagcggcgagatcctcgggctggg

SEQ ID NO: 437388 - DNA, 25 bp, Homo sapien
ctcccactgtgaaatcgctggtgct

SEQ ID NO: 437389 - DNA, 25 bp, Homo sapien
ctgtgaaatcgctggtgctcacaat

SEQ ID NO: 437390 - DNA, 25 bp, Homo sapien
tggtgctcacaattgtctctcacag

SEQ ID NO: 437391 - DNA, 25 bp, Homo sapien
cacaattgtctctcacagtgtatgt

SEQ ID NO: 437392 - DNA, 25 bp, Homo sapien
gtctctcacagtgtatgtgattttt

SEQ ID NO: 437393 - DNA, 25 bp, Homo sapien
tttaagattctgaaggtgctaccat

SEQ ID NO: 437394 - DNA, 25 bp, Homo sapien
gaaggtgctaccattattttgccac

SEQ ID NO: 437395 - DNA, 25 bp, Homo sapien
gctaccattattttgccacagactt

SEQ ID NO: 437396 - DNA, 25 bp, Homo sapien
cattattttgccacagactttgaag

SEQ ID NO: 437397 - DNA, 25 bp, Homo sapien
gactgagcaggagtcgtccgcttat

SEQ ID NO: 437398 - DNA, 25 bp, Homo sapien
actgagcaggagtcgtccgcttata

SEQ ID NO: 437399 - DNA, 25 bp, Homo sapien
tgagcaggagtcgtccgcttatagt

SEQ ID NO: 437400 - DNA, 25 bp, Homo sapien
gagcaggagtcgtccgcttatagtg

SEQ ID NO: 437401 - DNA, 25 bp, Homo sapien
gagtcgtccgcttatagtggaggct

SEQ ID NO: 437402 - DNA, 25 bp, Homo sapien
gtcgtccgcttatagtggaggctgc

SEQ ID NO: 437403 - DNA, 25 bp, Homo sapien
cgtccgcttatagtggaggctgcta

SEQ ID NO: 437404 - DNA, 25 bp, Homo sapien
gtccgcttatagtggaggctgctag

SEQ ID NO: 437405 - DNA, 25 bp, Homo sapien
ccgcttatagtggaggctgctagga

SEQ ID NO: 437406 - DNA, 25 bp, Homo sapien
tggaggctgctaggagccggtcaga

SEQ ID NO: 437407 - DNA, 25 bp, Homo sapien
gctaggagccggtcagagggtgagt

SEQ ID NO: 437408 - DNA, 25 bp, Homo sapien
ccaaggacatcaggcgcctgttctg

SEQ ID NO: 437409 - DNA, 25 bp, Homo sapien
caagcacttctatttatgagcccag

SEQ ID NO: 437410 - DNA, 25 bp, Homo sapien
gtggtgggatggtcccctgtggccc

SEQ ID NO: 437411 - DNA, 25 bp, Homo sapien
acttctatttatgagcccagcactg

SEQ ID NO: 437412 - DNA, 25 bp, Homo sapien
caggcagcctggtgccggagaggcg

SEQ ID NO: 437413 - DNA, 25 bp, Homo sapien
cggagaggcggtgcgtgctggtggt

SEQ ID NO: 437414 - DNA, 25 bp, Homo sapien
ccagacagcgcaggccgggcagggt

SEQ ID NO: 437415 - DNA, 25 bp, Homo sapien
gagcccagcactggaagactctggt

SEQ ID NO: 437416 - DNA, 25 bp, Homo sapien
ccagcactggaagactctggtgggt

SEQ ID NO: 437417 - DNA, 25 bp, Homo sapien
gaggaggtctccaaggacatcaggc

SEQ ID NO: 437418 - DNA, 25 bp, Homo sapien
gtctccaaggacatcaggcgcctgt

SEQ ID NO: 437419 - DNA, 25 bp, Homo sapien
gaaacccattgtcattagctccaag

SEQ ID NO: 437420 - DNA, 25 bp, Homo sapien
gggaatctcggagttcgacaccata

SEQ ID NO: 437421 - DNA, 25 bp, Homo sapien
gagttcgacaccatagtgacgttca

SEQ ID NO: 437422 - DNA, 25 bp, Homo sapien
atagtgacgttcagcgtcctctgaa

SEQ ID NO: 437423 - DNA, 25 bp, Homo sapien
gttcagcgtcctctgaattgtgcta

SEQ ID NO: 437424 - DNA, 25 bp, Homo sapien
gaattgtgctacatcagcgaacaag

SEQ ID NO: 437425 - DNA, 25 bp, Homo sapien
atcagcgaacaagtcggcgcttgaa

SEQ ID NO: 437426 - DNA, 25 bp, Homo sapien
agtcggcgcttgaattggattttga

SEQ ID NO: 437427 - DNA, 25 bp, Homo sapien
aagtctctatttgtgtatttctctc

SEQ ID NO: 437428 - DNA, 25 bp, Homo sapien
atttctctcctaaagttgtgtctct

SEQ ID NO: 437429 - DNA, 25 bp, Homo sapien
gttgtgtctctttgggaattggatt

SEQ ID NO: 437430 - DNA, 25 bp, Homo sapien
acgtgtttgttcatctcaggacggc

SEQ ID NO: 437431 - DNA, 25 bp, Homo sapien
cgtgttcactcatctcaggacagca

SEQ ID NO: 437432 - DNA, 25 bp, Homo sapien
ttcactcatctcaggacagcacggc

SEQ ID NO: 437433 - DNA, 25 bp, Homo sapien
agcacggcccaggtgagtctgtttc

SEQ ID NO: 437434 - DNA, 25 bp, Homo sapien
agcaagcctgctgcatgtgaacgcc

SEQ ID NO: 437435 - DNA, 25 bp, Homo sapien
aagcctgctgcatgtgaacgccgca

SEQ ID NO: 437436 - DNA, 25 bp, Homo sapien
gctgcatgtgaacgccgcagcaccg

SEQ ID NO: 437437 - DNA, 25 bp, Homo sapien
cacaaatccaactgcacctgttcta

SEQ ID NO: 437438 - DNA, 25 bp, Homo sapien
acctgttctatgcactgcaccgaat

SEQ ID NO: 437439 - DNA, 25 bp, Homo sapien
tgcactgcaccgaataacacagctc

SEQ ID NO: 437440 - DNA, 25 bp, Homo sapien
gcaccgaataacacagctcagaaag

SEQ ID NO: 437441 - DNA, 25 bp, Homo sapien
gcatccaactgtgatgagcctatgt

SEQ ID NO: 437442 - DNA, 25 bp, Homo sapien
tccaactgtgatgagcctatgtatg

SEQ ID NO: 437443 - DNA, 25 bp, Homo sapien
caactgtgatgagcctatgtatgtc

SEQ ID NO: 437444 - DNA, 25 bp, Homo sapien
actgtgatgagcctatgtatgtcaa

SEQ ID NO: 437445 - DNA, 25 bp, Homo sapien
ctgtgatgagcctatgtatgtcaag

SEQ ID NO: 437446 - DNA, 25 bp, Homo sapien
tgacaacaagaaactaggagaatgg

SEQ ID NO: 437447 - DNA, 25 bp, Homo sapien
tgggtaggcctttgtaaaattgaca

SEQ ID NO: 437448 - DNA, 25 bp, Homo sapien
ggtaggcctttgtaaaattgacaga

SEQ ID NO: 437449 - DNA, 25 bp, Homo sapien
taggcctttgtaaaattgacagaga

SEQ ID NO: 437450 - DNA, 25 bp, Homo sapien
gagtctcaggccaaggatgtcattg

SEQ ID NO: 437451 - DNA, 25 bp, Homo sapien
agtctcaggccaaggatgtcattga

SEQ ID NO: 437452 - DNA, 25 bp, Homo sapien
gaaaatggctaaattcgtgatccgc

SEQ ID NO: 437453 - DNA, 25 bp, Homo sapien
atggctaaattcgtgatccgcccag

SEQ ID NO: 437454 - DNA, 25 bp, Homo sapien
gctaaattcgtgatccgcccagcca

SEQ ID NO: 437455 - DNA, 25 bp, Homo sapien
tgccgccgactgcagtgacatactg

SEQ ID NO: 437456 - DNA, 25 bp, Homo sapien
gactgcagtgacatactgcggctga

SEQ ID NO: 437457 - DNA, 25 bp, Homo sapien
cagtgacatactgcggctgatcaag

SEQ ID NO: 437458 - DNA, 25 bp, Homo sapien
ggaagaacaagtaatcttaactgaa

SEQ ID NO: 437459 - DNA, 25 bp, Homo sapien
gaagatggttttggagagcacccct

SEQ ID NO: 437460 - DNA, 25 bp, Homo sapien
ccttttaccactgcctggttgcaga

SEQ ID NO: 437461 - DNA, 25 bp, Homo sapien
ttttaccactgcctggttgcagaag

SEQ ID NO: 437462 - DNA, 25 bp, Homo sapien
taccactgcctggttgcagaagtgc

SEQ ID NO: 437463 - DNA, 25 bp, Homo sapien
cagcagtgagactagtacctgggtc

SEQ ID NO: 437464 - DNA, 25 bp, Homo sapien
tgagactagtacctgggtcacctgc

SEQ ID NO: 437465 - DNA, 25 bp, Homo sapien
ggtcacctgcagcagtacgtggcca

SEQ ID NO: 437466 - DNA, 25 bp, Homo sapien
aggaggcgctgcacaggcagttact

SEQ ID NO: 437467 - DNA, 25 bp, Homo sapien
aggcgctgcacaggcagttactgct

SEQ ID NO: 437468 - DNA, 25 bp, Homo sapien
gcacaggcagttactgctgcagacc

SEQ ID NO: 437469 - DNA, 25 bp, Homo sapien
aaagcggtggctgagattataacat

SEQ ID NO: 437470 - DNA, 25 bp, Homo sapien
cggtggctgagattataacatttta

SEQ ID NO: 437471 - DNA, 25 bp, Homo sapien
aagagatgccaattcaagtccaaac

SEQ ID NO: 437472 - DNA, 25 bp, Homo sapien
gagatgccaattcaagtccaaacct

SEQ ID NO: 437473 - DNA, 25 bp, Homo sapien
gatgccaattcaagtccaaaccttt

SEQ ID NO: 437474 - DNA, 25 bp, Homo sapien
ttcctgcattctgtacataaagttt

SEQ ID NO: 437475 - DNA, 25 bp, Homo sapien
ataaagttttaagtggcaggtccag

SEQ ID NO: 437476 - DNA, 25 bp, Homo sapien
gtggcaggtccagatatgtaaaatc

SEQ ID NO: 437477 - DNA, 25 bp, Homo sapien
atttctctctattttccagctggtt

SEQ ID NO: 437478 - DNA, 25 bp, Homo sapien
ttccagctggttttgttaatgattc

SEQ ID NO: 437479 - DNA, 25 bp, Homo sapien
aatgattctctaggacagcaggtaa

SEQ ID NO: 437480 - DNA, 25 bp, Homo sapien
agtttgtgactatgcttgatttaat

SEQ ID NO: 437481 - DNA, 25 bp, Homo sapien
ctgagagtctcttgtttgtctgtca

SEQ ID NO: 437482 - DNA, 25 bp, Homo sapien
tgtttgtctgtcaaggtgccttcct

SEQ ID NO: 437483 - DNA, 25 bp, Homo sapien
ttctcacccagtaacggttaactct

SEQ ID NO: 437484 - DNA, 25 bp, Homo sapien
ggttaactcttctcttgtgtatatg

SEQ ID NO: 437485 - DNA, 25 bp, Homo sapien
tacataagaaattacatacctggcc

SEQ ID NO: 437486 - DNA, 25 bp, Homo sapien
acataagaaattacatacctggcca

SEQ ID NO: 437487 - DNA, 25 bp, Homo sapien
cataagaaattacatacctggccag

SEQ ID NO: 437488 - DNA, 25 bp, Homo sapien
ataagaaattacatacctggccagg

SEQ ID NO: 437489 - DNA, 25 bp, Homo sapien
taagaaattacatacctggccaggt

SEQ ID NO: 437490 - DNA, 25 bp, Homo sapien
aagaaattacatacctggccaggtg

SEQ ID NO: 437491 - DNA, 25 bp, Homo sapien
agaaattacatacctggccaggtgc

SEQ ID NO: 437492 - DNA, 25 bp, Homo sapien
gaaattacatacctggccaggtgca

SEQ ID NO: 437493 - DNA, 25 bp, Homo sapien
gtaatcctaacaaacactctgggag

SEQ ID NO: 437494 - DNA, 25 bp, Homo sapien
tacttaggaggttgcgatgggagaa

SEQ ID NO: 437495 - DNA, 25 bp, Homo sapien
tgagcccagaggtccagtctgcagt

SEQ ID NO: 437496 - DNA, 25 bp, Homo sapien
caggaaaagtaaggctcaaaaatgt

SEQ ID NO: 437497 - DNA, 25 bp, Homo sapien
acagatttcccaaaagtaacatagg

SEQ ID NO: 437498 - DNA, 25 bp, Homo sapien
gatctagatttcatatttgcaatta

SEQ ID NO: 437499 - DNA, 25 bp, Homo sapien
gataataactctatctagggtgaat

SEQ ID NO: 437500 - DNA, 25 bp, Homo sapien
taactctatctagggtgaatacttg

SEQ ID NO: 437501 - DNA, 25 bp, Homo sapien
actctatctagggtgaatacttgag

SEQ ID NO: 437502 - DNA, 25 bp, Homo sapien
ctagggtgaatacttgagattttaa

SEQ ID NO: 437503 - DNA, 25 bp, Homo sapien
tgtatagctgcaaaagtcgtgttac

SEQ ID NO: 437504 - DNA, 25 bp, Homo sapien
atagctgcaaaagtcgtgttacaat

SEQ ID NO: 437505 - DNA, 25 bp, Homo sapien
agctgcaaaagtcgtgttacaattt

SEQ ID NO: 437506 - DNA, 25 bp, Homo sapien
tgcaaaagtcgtgttacaatttttt

SEQ ID NO: 437507 - DNA, 25 bp, Homo sapien
gatcagaaaccagacggtagttttt

SEQ ID NO: 437508 - DNA, 25 bp, Homo sapien
ttcccacttgctcgacaaatctatg

SEQ ID NO: 437509 - DNA, 25 bp, Homo sapien
catgttttaactttaccttgccctg

SEQ ID NO: 437510 - DNA, 25 bp, Homo sapien
taactttaccttgccctgtgttatg

SEQ ID NO: 437511 - DNA, 25 bp, Homo sapien
taccttgccctgtgttatggtactg

SEQ ID NO: 437512 - DNA, 25 bp, Homo sapien
ccctgtgttatggtactggctgaca

SEQ ID NO: 437513 - DNA, 25 bp, Homo sapien
tatggtactggctgacatgtctaag

SEQ ID NO: 437514 - DNA, 25 bp, Homo sapien
actggctgacatgtctaagactgga

SEQ ID NO: 437515 - DNA, 25 bp, Homo sapien
gtctaagactggatgtgtatattta

SEQ ID NO: 437516 - DNA, 25 bp, Homo sapien
catgaagttcatcacttttcaggag

SEQ ID NO: 437517 - DNA, 25 bp, Homo sapien
gttcatcacttttcaggagtataga

SEQ ID NO: 437518 - DNA, 25 bp, Homo sapien
catggatggctgcaaggtccaagat

SEQ ID NO: 437519 - DNA, 25 bp, Homo sapien
gctgcaaggtccaagatggccgctg

SEQ ID NO: 437520 - DNA, 25 bp, Homo sapien
caaggtccaagatggccgctggcat

SEQ ID NO: 437521 - DNA, 25 bp, Homo sapien
caagatggccgctggcatcagacac

SEQ ID NO: 437522 - DNA, 25 bp, Homo sapien
tggccgctggcatcagacactcttc

SEQ ID NO: 437523 - DNA, 25 bp, Homo sapien
gctggcatcagacactcttcacctt

SEQ ID NO: 437524 - DNA, 25 bp, Homo sapien
cctcatcagggaagcagtaccgcct

SEQ ID NO: 437525 - DNA, 25 bp, Homo sapien
aagcagtaccgcctggaagttggac

SEQ ID NO: 437526 - DNA, 25 bp, Homo sapien
gcagtaccgcctggaagttggacct

SEQ ID NO: 437527 - DNA, 25 bp, Homo sapien
gaagttggacctgcgtgcttcctct

SEQ ID NO: 437528 - DNA, 25 bp, Homo sapien
gttggacctgcgtgcttcctctgac

SEQ ID NO: 437529 - DNA, 25 bp, Homo sapien
aaaccaatttcctgcattaagctga

SEQ ID NO: 437530 - DNA, 25 bp, Homo sapien
caatttcctgcattaagctgagaca

SEQ ID NO: 437531 - DNA, 25 bp, Homo sapien
tcctgcattaagctgagacaagtat

SEQ ID NO: 437532 - DNA, 25 bp, Homo sapien
acagccctatacagtttcatagctt

SEQ ID NO: 437533 - DNA, 25 bp, Homo sapien
gccctatacagtttcatagcttttc

SEQ ID NO: 437534 - DNA, 25 bp, Homo sapien
tcctcccccatttatgtgtattggt

SEQ ID NO: 437535 - DNA, 25 bp, Homo sapien
atgtgtattggtgacagtgggtata

SEQ ID NO: 437536 - DNA, 25 bp, Homo sapien
gtgggtataaaacagcctgaaagtg

SEQ ID NO: 437537 - DNA, 25 bp, Homo sapien
agcctgaaagtgtatgcatgtacca

SEQ ID NO: 437538 - DNA, 25 bp, Homo sapien
gacttaatatattgtggagtattca

SEQ ID NO: 437539 - DNA, 25 bp, Homo sapien
ggagtattcaataaccattatgtag

SEQ ID NO: 437540 - DNA, 25 bp, Homo sapien
aagtgtcagttacagcctctgagct

SEQ ID NO: 437541 - DNA, 25 bp, Homo sapien
acagcctctgagctttagtcaattg

SEQ ID NO: 437542 - DNA, 25 bp, Homo sapien
agataaggcaatccagttaaactgt

SEQ ID NO: 437543 - DNA, 25 bp, Homo sapien
gttaaactgtatatcccacttgctg

SEQ ID NO: 437544 - DNA, 25 bp, Homo sapien
cttgctgttttctgtccctaaattc

SEQ ID NO: 437545 - DNA, 25 bp, Homo sapien
tctgtccctaaattctctctgagta

SEQ ID NO: 437546 - DNA, 25 bp, Homo sapien
aaattctctctgagtacactgcagc

SEQ ID NO: 437547 - DNA, 25 bp, Homo sapien
gagtacactgcagccctgaagttct

SEQ ID NO: 437548 - DNA, 25 bp, Homo sapien
taaaatttgtaggaggccactgatt

SEQ ID NO: 437549 - DNA, 25 bp, Homo sapien
actgatttggcctaggctcctatga

SEQ ID NO: 437550 - DNA, 25 bp, Homo sapien
taggctcctatgatgtaaccaacag

SEQ ID NO: 437551 - DNA, 25 bp, Homo sapien
ttaagccaggctaaggaaagccctt

SEQ ID NO: 437552 - DNA, 25 bp, Homo sapien
ggaaagcccttaacagaacttctgc

SEQ ID NO: 437553 - DNA, 25 bp, Homo sapien
acttctgctggaactactggaaaga

SEQ ID NO: 437554 - DNA, 25 bp, Homo sapien
gaaggctttatggagatcccaggaa

SEQ ID NO: 437555 - DNA, 25 bp, Homo sapien
ggaaccaaggaccatgtaagcctga

SEQ ID NO: 437556 - DNA, 25 bp, Homo sapien
ccatgtaagcctgaatttgtgccat

SEQ ID NO: 437557 - DNA, 25 bp, Homo sapien
tgtgccatgtggagagagtctgtct

SEQ ID NO: 437558 - DNA, 25 bp, Homo sapien
agtctgtctgaggagaaactcggat

SEQ ID NO: 437559 - DNA, 25 bp, Homo sapien
ggagaaactcggatgctagcagaaa

SEQ ID NO: 437560 - DNA, 25 bp, Homo sapien
gttctgatgtcatttttctggaggc

SEQ ID NO: 437561 - DNA, 25 bp, Homo sapien
aggccctagatccagctgtgcctaa

SEQ ID NO: 437562 - DNA, 25 bp, Homo sapien
aatatctgacaccactttggactca

SEQ ID NO: 437563 - DNA, 25 bp, Homo sapien
gacaccactttggactcaagagact

SEQ ID NO: 437564 - DNA, 25 bp, Homo sapien
gagactcagtaacgtattatcctgt

SEQ ID NO: 437565 - DNA, 25 bp, Homo sapien
agcttggttttagctgtgttctctc

SEQ ID NO: 437566 - DNA, 25 bp, Homo sapien
agctgtgttctctctggataaccca

SEQ ID NO: 437567 - DNA, 25 bp, Homo sapien
ctggataacccacttgatgttagga

SEQ ID NO: 437568 - DNA, 25 bp, Homo sapien
gttaggaacattacttctctgctta

SEQ ID NO: 437569 - DNA, 25 bp, Homo sapien
acttctctgcttattccatattaat

SEQ ID NO: 437570 - DNA, 25 bp, Homo sapien
aattcttaccttctattatcctata

SEQ ID NO: 437571 - DNA, 25 bp, Homo sapien
attagcttcaatacatccaaaccaa

SEQ ID NO: 437572 - DNA, 25 bp, Homo sapien
aaaccaaatggctgttaggtagatt

SEQ ID NO: 437573 - DNA, 25 bp, Homo sapien
gtatttttcttctggaatggaattc

SEQ ID NO: 437574 - DNA, 25 bp, Homo sapien
aatgcaaatcgctatccattttgac

SEQ ID NO: 437575 - DNA, 25 bp, Homo sapien
aatcgctatccattttgactgcaat

SEQ ID NO: 437576 - DNA, 25 bp, Homo sapien
gctatccattttgactgcaatgatg

SEQ ID NO: 437577 - DNA, 25 bp, Homo sapien
ttttgactgcaatgatgaaacttgt

SEQ ID NO: 437578 - DNA, 25 bp, Homo sapien
gaaacttgtttatcttccagaggac

SEQ ID NO: 437579 - DNA, 25 bp, Homo sapien
gtttatcttccagaggacatatata

SEQ ID NO: 437580 - DNA, 25 bp, Homo sapien
gtgtgtattgtacagatacctttaa

SEQ ID NO: 437581 - DNA, 25 bp, Homo sapien
gatacctttaatttgattacactgt

SEQ ID NO: 437582 - DNA, 25 bp, Homo sapien
tgaaacttttcaagaggattctatg

SEQ ID NO: 437583 - DNA, 25 bp, Homo sapien
aagaggattctatgtatatattgta

SEQ ID NO: 437584 - DNA, 25 bp, Homo sapien
agacattggttgtcacaacttcggg

SEQ ID NO: 437585 - DNA, 25 bp, Homo sapien
ggacagtaccggcatttatgcatag

SEQ ID NO: 437586 - DNA, 25 bp, Homo sapien
cggcatttatgcatagcggtcaggg

SEQ ID NO: 437587 - DNA, 25 bp, Homo sapien
taaacatcctacagtacacaaccca

SEQ ID NO: 437588 - DNA, 25 bp, Homo sapien
tacacaacccacacatcaggagcaa

SEQ ID NO: 437589 - DNA, 25 bp, Homo sapien
gtaatgccaagactgagaacccctg

SEQ ID NO: 437590 - DNA, 25 bp, Homo sapien
gaacccctggagtaagcctcacaaa

SEQ ID NO: 437591 - DNA, 25 bp, Homo sapien
aaagctcttatgacctcacagggca

SEQ ID NO: 437592 - DNA, 25 bp, Homo sapien
ggcagctgtcttattgtaatcccaa

SEQ ID NO: 437593 - DNA, 25 bp, Homo sapien
ttgtaatcccaaatctacctcagtg

SEQ ID NO: 437594 - DNA, 25 bp, Homo sapien
cagtgatttccttgacattcaaaac

SEQ ID NO: 437595 - DNA, 25 bp, Homo sapien
ccaagtctagcaagcaggccaaaga

SEQ ID NO: 437596 - DNA, 25 bp, Homo sapien
gcaggccaaagatgtctcccgcatg

SEQ ID NO: 437597 - DNA, 25 bp, Homo sapien
gccaaagatgtctcccgcatgcgct

SEQ ID NO: 437598 - DNA, 25 bp, Homo sapien
aggccccgctggtgcactgaagagc

SEQ ID NO: 437599 - DNA, 25 bp, Homo sapien
caccctgtggaaacactacatctgc

SEQ ID NO: 437600 - DNA, 25 bp, Homo sapien
acatctgcaatatcttaatcctact

SEQ ID NO: 437601 - DNA, 25 bp, Homo sapien
taatcctactcagtgaagctcttca

SEQ ID NO: 437602 - DNA, 25 bp, Homo sapien
ctcttcacagtcattggattaatta

SEQ ID NO: 437603 - DNA, 25 bp, Homo sapien
tgttgagttcttttggaccaaacct

SEQ ID NO: 437604 - DNA, 25 bp, Homo sapien
cctttttgtctttagagttgttcat

SEQ ID NO: 437605 - DNA, 25 bp, Homo sapien
tgttcattgtttgtgattgcatgtt

SEQ ID NO: 437606 - DNA, 25 bp, Homo sapien
cccagaagacattggaagacctgtt

SEQ ID NO: 437607 - DNA, 25 bp, Homo sapien
ccagaagacattggaagacctgttt

SEQ ID NO: 437608 - DNA, 25 bp, Homo sapien
cagaagacattggaagacctgtttt

SEQ ID NO: 437609 - DNA, 25 bp, Homo sapien
gaccaactaatatatgtaaagatgc

SEQ ID NO: 437610 - DNA, 25 bp, Homo sapien
ccaactaatatatgtaaagatgcac

SEQ ID NO: 437611 - DNA, 25 bp, Homo sapien
aatatatgtaaagatgcacaaattc

SEQ ID NO: 437612 - DNA, 25 bp, Homo sapien
gaaaaatattggtaggacttatgta

SEQ ID NO: 437613 - DNA, 25 bp, Homo sapien
aaaaatattggtaggacttatgtag

SEQ ID NO: 437614 - DNA, 25 bp, Homo sapien
aaaatattggtaggacttatgtaga

SEQ ID NO: 437615 - DNA, 25 bp, Homo sapien
aaatattggtaggacttatgtagac

SEQ ID NO: 437616 - DNA, 25 bp, Homo sapien
aatattggtaggacttatgtagaca

SEQ ID NO: 437617 - DNA, 25 bp, Homo sapien
acacagcaggttcagagaagttttt

SEQ ID NO: 437618 - DNA, 25 bp, Homo sapien
cacagcaggttcagagaagtttttg

SEQ ID NO: 437619 - DNA, 25 bp, Homo sapien
acagcaggttcagagaagtttttga

SEQ ID NO: 437620 - DNA, 25 bp, Homo sapien
cagcaggttcagagaagtttttgaa

SEQ ID NO: 437621 - DNA, 25 bp, Homo sapien
agcaggttcagagaagtttttgaag

SEQ ID NO: 437622 - DNA, 25 bp, Homo sapien
aatcagaattcaggtacagtcacat

SEQ ID NO: 437623 - DNA, 25 bp, Homo sapien
atcagaattcaggtacagtcacatg

SEQ ID NO: 437624 - DNA, 25 bp, Homo sapien
tcagaattcaggtacagtcacatga

SEQ ID NO: 437625 - DNA, 25 bp, Homo sapien
cagaattcaggtacagtcacatgag

SEQ ID NO: 437626 - DNA, 25 bp, Homo sapien
agaattcaggtacagtcacatgagt

SEQ ID NO: 437627 - DNA, 25 bp, Homo sapien
gaattcaggtacagtcacatgagta

SEQ ID NO: 437628 - DNA, 25 bp, Homo sapien
ctggattttatctgtgtagtcttac

SEQ ID NO: 437629 - DNA, 25 bp, Homo sapien
gtgtagtcttacttgtctttatttt

SEQ ID NO: 437630 - DNA, 25 bp, Homo sapien
tgtctttattttaatgctgtctgaa

SEQ ID NO: 437631 - DNA, 25 bp, Homo sapien
ctgtctgaagggaacttggtatcca

SEQ ID NO: 437632 - DNA, 25 bp, Homo sapien
atccaaataaagcaggtaacctcat

SEQ ID NO: 437633 - DNA, 25 bp, Homo sapien
gtaacctcattttacttcaagggca

SEQ ID NO: 437634 - DNA, 25 bp, Homo sapien
tactgtgtagtgctgaatttaatct

SEQ ID NO: 437635 - DNA, 25 bp, Homo sapien
ttgaaaggatttgcctagtcccact

SEQ ID NO: 437636 - DNA, 25 bp, Homo sapien
aaaggatttgcctagtcccacttct

SEQ ID NO: 437637 - DNA, 25 bp, Homo sapien
ttctgtccactttttagtaccactg

SEQ ID NO: 437638 - DNA, 25 bp, Homo sapien
agtaccactggtatcttttatatgt

SEQ ID NO: 437639 - DNA, 25 bp, Homo sapien
aaactgttgagcattattctatacc

SEQ ID NO: 437640 - DNA, 25 bp, Homo sapien
gcattattctatacctctaagctgt

SEQ ID NO: 437641 - DNA, 25 bp, Homo sapien
ttcttttctgaaccatgaatcggga

SEQ ID NO: 437642 - DNA, 25 bp, Homo sapien
gagaattattgtcactcatacatga

SEQ ID NO: 437643 - DNA, 25 bp, Homo sapien
ataatccctaaaccttctttctcat

SEQ ID NO: 437644 - DNA, 25 bp, Homo sapien
ggtggtttaatatatcactgacgga

SEQ ID NO: 437645 - DNA, 25 bp, Homo sapien
tcactgacggaacacgatgctttgt

SEQ ID NO: 437646 - DNA, 25 bp, Homo sapien
gctttgtttaatgaagactcagacg

SEQ ID NO: 437647 - DNA, 25 bp, Homo sapien
gactcagacggaaaggatcagacat

SEQ ID NO: 437648 - DNA, 25 bp, Homo sapien
ggatcagacatcaacctataaatgc

SEQ ID NO: 437649 - DNA, 25 bp, Homo sapien
aacctataaatgcatcaaccagaag

SEQ ID NO: 437650 - DNA, 25 bp, Homo sapien
cttttatatgtaatgtatgcttttt

SEQ ID NO: 437651 - DNA, 25 bp, Homo sapien
agaaagaattttgcaacaatatggg

SEQ ID NO: 437652 - DNA, 25 bp, Homo sapien
gggaaatttttcattgttggatttg

SEQ ID NO: 437653 - DNA, 25 bp, Homo sapien
gttggatttgaattatactggattt

SEQ ID NO: 437654 - DNA, 25 bp, Homo sapien
ctggattttatctgtgtagtcttac

SEQ ID NO: 437655 - DNA, 25 bp, Homo sapien
ttgtctttattttaatgctgtctga

SEQ ID NO: 437656 - DNA, 25 bp, Homo sapien
tattttaatgctgtctgaagggaac

SEQ ID NO: 437657 - DNA, 25 bp, Homo sapien
aatgctgtctgaagggaacttggta

SEQ ID NO: 437658 - DNA, 25 bp, Homo sapien
ctgtctgaagggaacttggtatcca

SEQ ID NO: 437659 - DNA, 25 bp, Homo sapien
tctgaagggaacttggtatccaaat

SEQ ID NO: 437660 - DNA, 25 bp, Homo sapien
atccaaataaagcaggtaacctcat

SEQ ID NO: 437661 - DNA, 25 bp, Homo sapien
caggaaaagtaaggctcaaaaatgt

SEQ ID NO: 437662 - DNA, 25 bp, Homo sapien
acagatttcccaaaagtaacatagg

SEQ ID NO: 437663 - DNA, 25 bp, Homo sapien
gatctagatttcatatttgcaatta

SEQ ID NO: 437664 - DNA, 25 bp, Homo sapien
gataataactctatctagggtgaat

SEQ ID NO: 437665 - DNA, 25 bp, Homo sapien
actctatctagggtgaatacttgag

SEQ ID NO: 437666 - DNA, 25 bp, Homo sapien
ctagggtgaatacttgagattttaa

SEQ ID NO: 437667 - DNA, 25 bp, Homo sapien
gtatagctgcaaaagtcgtgttaca

SEQ ID NO: 437668 - DNA, 25 bp, Homo sapien
gctgcaaaagtcgtgttacaatttt

SEQ ID NO: 437669 - DNA, 25 bp, Homo sapien
agtggcacaaccatggctcaggtat

SEQ ID NO: 437670 - DNA, 25 bp, Homo sapien
gcacaaccatggctcaggtattcct

SEQ ID NO: 437671 - DNA, 25 bp, Homo sapien
aaccatggctcaggtattcctcctg

SEQ ID NO: 437672 - DNA, 25 bp, Homo sapien
tgctcctggacttcatgcctctcca

SEQ ID NO: 437673 - DNA, 25 bp, Homo sapien
tctccattctcattgcctacaatct

SEQ ID NO: 437674 - DNA, 25 bp, Homo sapien
attctcattgcctacaatctctgtg

SEQ ID NO: 437675 - DNA, 25 bp, Homo sapien
tgcctacaatctctgtgccccagaa

SEQ ID NO: 437676 - DNA, 25 bp, Homo sapien
tccagacatgcacttaccttgactt

SEQ ID NO: 437677 - DNA, 25 bp, Homo sapien
agacatgcacttaccttgactttac

SEQ ID NO: 437678 - DNA, 25 bp, Homo sapien
atgcacttaccttgactttacccca

SEQ ID NO: 437679 - DNA, 25 bp, Homo sapien
gcaatctgaagacttctccagccac

SEQ ID NO: 437680 - DNA, 25 bp, Homo sapien
gaagacttctccagccacacaggca

SEQ ID NO: 437681 - DNA, 25 bp, Homo sapien
tcagctgtctgccaccatctatgtg

SEQ ID NO: 437682 - DNA, 25 bp, Homo sapien
agctgtctgccaccatctatgtgcc

SEQ ID NO: 437683 - DNA, 25 bp, Homo sapien
aggtgcatacacacgtccgagacag

SEQ ID NO: 437684 - DNA, 25 bp, Homo sapien
ccaggcctgcaatgaaatgcgcttt

SEQ ID NO: 437685 - DNA, 25 bp, Homo sapien
tatgggtacgcttttctgatgttac

SEQ ID NO: 437686 - DNA, 25 bp, Homo sapien
atgcgctttaattgcatcaaagggt

SEQ ID NO: 437687 - DNA, 25 bp, Homo sapien
gcatcaaagggttcttctcaatggg

SEQ ID NO: 437688 - DNA, 25 bp, Homo sapien
agcggcgttcccagcgagggttcct

SEQ ID NO: 437689 - DNA, 25 bp, Homo sapien
cgagggttcctttccggctggccag

SEQ ID NO: 437690 - DNA, 25 bp, Homo sapien
ctgatgttacagaacgtctgcgaga

SEQ ID NO: 437691 - DNA, 25 bp, Homo sapien
agagagggagctcaagttcccgcct

SEQ ID NO: 437692 - DNA, 25 bp, Homo sapien
caagttcccgcctggtctctaagta

SEQ ID NO: 437693 - DNA, 25 bp, Homo sapien
gtaacccggcccacaaaggtgcata

SEQ ID NO: 437694 - DNA, 25 bp, Homo sapien
gagcaagccatgaggtgccctggca

SEQ ID NO: 437695 - DNA, 25 bp, Homo sapien
tgccctggcacatgcacaaattgat

SEQ ID NO: 437696 - DNA, 25 bp, Homo sapien
aaattgatcctttgcgtgacagtct

SEQ ID NO: 437697 - DNA, 25 bp, Homo sapien
tgcgtgacagtcttgtatggaaaac

SEQ ID NO: 437698 - DNA, 25 bp, Homo sapien
gtagactaccatgccacacaaaaag

SEQ ID NO: 437699 - DNA, 25 bp, Homo sapien
aaggctaaatatctactccaatggg

SEQ ID NO: 437700 - DNA, 25 bp, Homo sapien
tactccaatgggtttccagttcagt

SEQ ID NO: 437701 - DNA, 25 bp, Homo sapien
ttccagttcagtttgaagtcaatca

SEQ ID NO: 437702 - DNA, 25 bp, Homo sapien
tttgtattttcggtgtctccttgat

SEQ ID NO: 437703 - DNA, 25 bp, Homo sapien
gtctccttgattggttttgctagta

SEQ ID NO: 437704 - DNA, 25 bp, Homo sapien
atttgaaactgatgcttcacctttc

SEQ ID NO: 437705 - DNA, 25 bp, Homo sapien
agcaataagtaaatttcagccatgt

SEQ ID NO: 437706 - DNA, 25 bp, Homo sapien
gcaataagtaaatttcagccatgta

SEQ ID NO: 437707 - DNA, 25 bp, Homo sapien
aataagtaaatttcagccatgtata

SEQ ID NO: 437708 - DNA, 25 bp, Homo sapien
gtaaatttcagccatgtatatacgt

SEQ ID NO: 437709 - DNA, 25 bp, Homo sapien
taaatttcagccatgtatatacgtg

SEQ ID NO: 437710 - DNA, 25 bp, Homo sapien
aaatttcagccatgtatatacgtga

SEQ ID NO: 437711 - DNA, 25 bp, Homo sapien
atttcagccatgtatatacgtgaac

SEQ ID NO: 437712 - DNA, 25 bp, Homo sapien
tttcagccatgtatatacgtgaact

SEQ ID NO: 437713 - DNA, 25 bp, Homo sapien
tcagccatgtatatacgtgaactaa

SEQ ID NO: 437714 - DNA, 25 bp, Homo sapien
cagccatgtatatacgtgaactaat

SEQ ID NO: 437715 - DNA, 25 bp, Homo sapien
agccatgtatatacgtgaactaatt

SEQ ID NO: 437716 - DNA, 25 bp, Homo sapien
gagaggatctctgttctgccccatg

SEQ ID NO: 437717 - DNA, 25 bp, Homo sapien
agttactccagagatcctctcagac

SEQ ID NO: 437718 - DNA, 25 bp, Homo sapien
gaggaggaccgggtatcttctaata

SEQ ID NO: 437719 - DNA, 25 bp, Homo sapien
acagctatgactacggtgatgagta

SEQ ID NO: 437720 - DNA, 25 bp, Homo sapien
acggtgatgagtaccggccgctgtt

SEQ ID NO: 437721 - DNA, 25 bp, Homo sapien
gctgttcttctaccaggagaccacg

SEQ ID NO: 437722 - DNA, 25 bp, Homo sapien
aggagaccacggctcagatcctggt

SEQ ID NO: 437723 - DNA, 25 bp, Homo sapien
acctgggcttgtatgtgttctatgt

SEQ ID NO: 437724 - DNA, 25 bp, Homo sapien
atgtgttctatgtggtcactgtgat

SEQ ID NO: 437725 - DNA, 25 bp, Homo sapien
tgtgattctctgcacctggatctac

SEQ ID NO: 437726 - DNA, 25 bp, Homo sapien
ctggatctaccaacggcaacggaga

SEQ ID NO: 437727 - DNA, 25 bp, Homo sapien
gaacatactattgtggtctgggtca

SEQ ID NO: 437728 - DNA, 25 bp, Homo sapien
actattgtggtctgggtcatctttt

SEQ ID NO: 437729 - DNA, 25 bp, Homo sapien
aacacagacgatgtctgagacagat

SEQ ID NO: 437730 - DNA, 25 bp, Homo sapien
aaggccagacttgcctggctgaact

SEQ ID NO: 437731 - DNA, 25 bp, Homo sapien
agacttgcctggctgaactcagcct

SEQ ID NO: 437732 - DNA, 25 bp, Homo sapien
actcagagttcctcctgaggttctg

SEQ ID NO: 437733 - DNA, 25 bp, Homo sapien
ttcctcctgaggttctgggtaaagc

SEQ ID NO: 437734 - DNA, 25 bp, Homo sapien
tgaggttctgggtaaagcagctgca

SEQ ID NO: 437735 - DNA, 25 bp, Homo sapien
gcagaggagagatttctcctacagt

SEQ ID NO: 437736 - DNA, 25 bp, Homo sapien
tcctacagtggcaacaacatacagt

SEQ ID NO: 437737 - DNA, 25 bp, Homo sapien
gggctggaagttatcttgttccact

SEQ ID NO: 437738 - DNA, 25 bp, Homo sapien
acttcctgtgtcatgtgactctcct

SEQ ID NO: 437739 - DNA, 25 bp, Homo sapien
tgtgactctcctagtcatcacatga

SEQ ID NO: 437740 - DNA, 25 bp, Homo sapien
atcacatgacccatccacattggga

SEQ ID NO: 437741 - DNA, 25 bp, Homo sapien
tcacatataccctccagaattttat

SEQ ID NO: 437742 - DNA, 25 bp, Homo sapien
ggaagccagaattacttgcaggagt

SEQ ID NO: 437743 - DNA, 25 bp, Homo sapien
gtgactatagctatggcaggtacct

SEQ ID NO: 437744 - DNA, 25 bp, Homo sapien
caggtacctgcatccttgtttttgt

SEQ ID NO: 437745 - DNA, 25 bp, Homo sapien
tagtggatcctctatccttcagaga

SEQ ID NO: 437746 - DNA, 25 bp, Homo sapien
ctcgtctagtgaccctgaggtgatg

SEQ ID NO: 437747 - DNA, 25 bp, Homo sapien
ggaggaagccaattgccctttagaa

SEQ ID NO: 437748 - DNA, 25 bp, Homo sapien
aatatggctgcaattgcctcacttc

SEQ ID NO: 437749 - DNA, 25 bp, Homo sapien
gggaaaggttccacgatacataaat

SEQ ID NO: 437750 - DNA, 25 bp, Homo sapien
ggttccacgatacataaatcatttc

SEQ ID NO: 437751 - DNA, 25 bp, Homo sapien
ataaatcatttctcatttgctttaa

SEQ ID NO: 437752 - DNA, 25 bp, Homo sapien
attatgagagactttattcgttaac

SEQ ID NO: 437753 - DNA, 25 bp, Homo sapien
agagactttattcgttaacaatggg

SEQ ID NO: 437754 - DNA, 25 bp, Homo sapien
gggtaaagagctatatacatgaaaa

SEQ ID NO: 437755 - DNA, 25 bp, Homo sapien
gtgcaaataaaagcactgctactat

SEQ ID NO: 437756 - DNA, 25 bp, Homo sapien
aagcactgctactataagacattct

SEQ ID NO: 437757 - DNA, 25 bp, Homo sapien
taagacattctggaatggttgttta

SEQ ID NO: 437758 - DNA, 25 bp, Homo sapien
tctggaatggttgtttaataagggt

SEQ ID NO: 437759 - DNA, 25 bp, Homo sapien
ggtattatccatttgatctatagca

SEQ ID NO: 437760 - DNA, 25 bp, Homo sapien
ctgcccaaggggaagaagcctgctc

SEQ ID NO: 437761 - DNA, 25 bp, Homo sapien
gagtatgccagcattcagaccagcc

SEQ ID NO: 437762 - DNA, 25 bp, Homo sapien
ggaggacaccctcacctatgctgac

SEQ ID NO: 437763 - DNA, 25 bp, Homo sapien
cagggctccacttcttctacaaggt

SEQ ID NO: 437764 - DNA, 25 bp, Homo sapien
agggctccacttcttctacaaggtt

SEQ ID NO: 437765 - DNA, 25 bp, Homo sapien
gggctccacttcttctacaaggttg

SEQ ID NO: 437766 - DNA, 25 bp, Homo sapien
ggctccacttcttctacaaggttgc

SEQ ID NO: 437767 - DNA, 25 bp, Homo sapien
gctccacttcttctacaaggttgca

SEQ ID NO: 437768 - DNA, 25 bp, Homo sapien
ctccacttcttctacaaggttgcat

SEQ ID NO: 437769 - DNA, 25 bp, Homo sapien
tccacttcttctacaaggttgcatg

SEQ ID NO: 437770 - DNA, 25 bp, Homo sapien
ccacttcttctacaaggttgcatga

SEQ ID NO: 437771 - DNA, 25 bp, Homo sapien
ggtccagagggatggcatctgccca

SEQ ID NO: 437772 - DNA, 25 bp, Homo sapien
ttgccctcttgttgcctgcactcat

SEQ ID NO: 437773 - DNA, 25 bp, Homo sapien
gttgcctgcactcatttcccaggga

SEQ ID NO: 437774 - DNA, 25 bp, Homo sapien
taggataggaatgccctccttcctg

SEQ ID NO: 437775 - DNA, 25 bp, Homo sapien
gataggaatgccctccttcctggcc

SEQ ID NO: 437776 - DNA, 25 bp, Homo sapien
ccacataatcaccatctcagcccaa

SEQ ID NO: 437777 - DNA, 25 bp, Homo sapien
tggccctctaggtctccatgcattc

SEQ ID NO: 437778 - DNA, 25 bp, Homo sapien
tctaggtctccatgcattcttcctg

SEQ ID NO: 437779 - DNA, 25 bp, Homo sapien
ccatgcattcttcctgccctagagt

SEQ ID NO: 437780 - DNA, 25 bp, Homo sapien
ccctagagtagccagctcaccaagg

SEQ ID NO: 437781 - DNA, 25 bp, Homo sapien
caaggcctttatccccagcccagga

SEQ ID NO: 437782 - DNA, 25 bp, Homo sapien
ttagtctttttgctggtgaagggtc

SEQ ID NO: 437783 - DNA, 25 bp, Homo sapien
gttgctgaatattgaagtggttgta

SEQ ID NO: 437784 - DNA, 25 bp, Homo sapien
ttgaagtggttgtaacaatttctta

SEQ ID NO: 437785 - DNA, 25 bp, Homo sapien
atttgccacattaactgactcttcc

SEQ ID NO: 437786 - DNA, 25 bp, Homo sapien
attaactgactcttccttccacgaa

SEQ ID NO: 437787 - DNA, 25 bp, Homo sapien
gaaagatttcagtgtaccatgcgat

SEQ ID NO: 437788 - DNA, 25 bp, Homo sapien
agatttcagtgtaccatgcgatact

SEQ ID NO: 437789 - DNA, 25 bp, Homo sapien
gtgtaccatgcgatactgtttgata

SEQ ID NO: 437790 - DNA, 25 bp, Homo sapien
taccatgcgatactgtttgataagc

SEQ ID NO: 437791 - DNA, 25 bp, Homo sapien
ttgataagcattttacccatagtag

SEQ ID NO: 437792 - DNA, 25 bp, Homo sapien
aaaccctgccactgttttactatgt

SEQ ID NO: 437793 - DNA, 25 bp, Homo sapien
atgatgagcttacatataatagcaa

SEQ ID NO: 437794 - DNA, 25 bp, Homo sapien
atgagcttacatataatagcaataa

SEQ ID NO: 437795 - DNA, 25 bp, Homo sapien
tgagcttacatataatagcaataat

SEQ ID NO: 437796 - DNA, 25 bp, Homo sapien
atagcaataatagaccagaagcggt

SEQ ID NO: 437797 - DNA, 25 bp, Homo sapien
tagcaataatagaccagaagcggtg

SEQ ID NO: 437798 - DNA, 25 bp, Homo sapien
gcaataatagaccagaagcggtggc

SEQ ID NO: 437799 - DNA, 25 bp, Homo sapien
caataatagaccagaagcggtggct

SEQ ID NO: 437800 - DNA, 25 bp, Homo sapien
aataatagaccagaagcggtggctc

SEQ ID NO: 437801 - DNA, 25 bp, Homo sapien
ataatagaccagaagcggtggctca

SEQ ID NO: 437802 - DNA, 25 bp, Homo sapien
taatagaccagaagcggtggctcac

SEQ ID NO: 437803 - DNA, 25 bp, Homo sapien
tagaccagaagcggtggctcacaca

SEQ ID NO: 437804 - DNA, 25 bp, Homo sapien
atactgctaagatgctaacccctga

SEQ ID NO: 437805 - DNA, 25 bp, Homo sapien
agatgctaacccctgagccaatgtt

SEQ ID NO: 437806 - DNA, 25 bp, Homo sapien
tgagccaatgttcaccagaagcaga

SEQ ID NO: 437807 - DNA, 25 bp, Homo sapien
caccagaagcagaggatacggattt

SEQ ID NO: 437808 - DNA, 25 bp, Homo sapien
agagcttcttcaaaagtggtacagc

SEQ ID NO: 437809 - DNA, 25 bp, Homo sapien
tcaaatggtaacttctgacactttt

SEQ ID NO: 437810 - DNA, 25 bp, Homo sapien
gacacttttcagaatcagcagggtt

SEQ ID NO: 437811 - DNA, 25 bp, Homo sapien
gtaatagcactgtgaccgtccattg

SEQ ID NO: 437812 - DNA, 25 bp, Homo sapien
gaccgtccattgaatccgactgagt

SEQ ID NO: 437813 - DNA, 25 bp, Homo sapien
tttgatcaagcaatctagttcatcc

SEQ ID NO: 437814 - DNA, 25 bp, Homo sapien
ggtacagccagtaagaagacagcag

SEQ ID NO: 437815 - DNA, 25 bp, Homo sapien
aatacaaatgcaacagcctcaaatt

SEQ ID NO: 437816 - DNA, 25 bp, Homo sapien
gcctcaaattagcagtggatgcctc

SEQ ID NO: 437817 - DNA, 25 bp, Homo sapien
ttctgcaaccgctttccacgggttc

SEQ ID NO: 437818 - DNA, 25 bp, Homo sapien
acgggttccaccagatggctagctg

SEQ ID NO: 437819 - DNA, 25 bp, Homo sapien
cagatggctagctggtaatgaccca

SEQ ID NO: 437820 - DNA, 25 bp, Homo sapien
ctagctggtaatgacccagacacct

SEQ ID NO: 437821 - DNA, 25 bp, Homo sapien
gacacctctgagtaaactcccagaa

SEQ ID NO: 437822 - DNA, 25 bp, Homo sapien
gttgcaaacttagccatatgtagag

SEQ ID NO: 437823 - DNA, 25 bp, Homo sapien
gtagagtggctacaccacatttgca

SEQ ID NO: 437824 - DNA, 25 bp, Homo sapien
gctctcttaacagcatgaccttctt

SEQ ID NO: 437825 - DNA, 25 bp, Homo sapien
gaccttctttaatagtgatcacttc

SEQ ID NO: 437826 - DNA, 25 bp, Homo sapien
attctgacatagtacatctctgcca

SEQ ID NO: 437827 - DNA, 25 bp, Homo sapien
gacatagtacatctctgccaaaaac

SEQ ID NO: 437828 - DNA, 25 bp, Homo sapien
aaaccacacaccctctgtggatatg

SEQ ID NO: 437829 - DNA, 25 bp, Homo sapien
atgaattcccagattttatatactc

SEQ ID NO: 437830 - DNA, 25 bp, Homo sapien
aatgtccatgcagccatttttccaa

SEQ ID NO: 437831 - DNA, 25 bp, Homo sapien
caacagatgctgtacaccgttcatt

SEQ ID NO: 437832 - DNA, 25 bp, Homo sapien
tgtacaccgttcattttatatagac

SEQ ID NO: 437833 - DNA, 25 bp, Homo sapien
ctagggagattcaaatacagtgcat

SEQ ID NO: 437834 - DNA, 25 bp, Homo sapien
acagtgcattttctattggtatttg

SEQ ID NO: 437835 - DNA, 25 bp, Homo sapien
gtgcatttttagcaacttctaccag

SEQ ID NO: 437836 - DNA, 25 bp, Homo sapien
tagcaacttctaccagcaaataaag

SEQ ID NO: 437837 - DNA, 25 bp, Homo sapien
ccagaacaggccacctcattctaga

SEQ ID NO: 437838 - DNA, 25 bp, Homo sapien
tctagaattctagctgtctcacaaa

SEQ ID NO: 437839 - DNA, 25 bp, Homo sapien
ctagaattctagctgtctcacaaac

SEQ ID NO: 437840 - DNA, 25 bp, Homo sapien
tagaattctagctgtctcacaaaca

SEQ ID NO: 437841 - DNA, 25 bp, Homo sapien
agaattctagctgtctcacaaacac

SEQ ID NO: 437842 - DNA, 25 bp, Homo sapien
gaattctagctgtctcacaaacact

SEQ ID NO: 437843 - DNA, 25 bp, Homo sapien
attctagctgtctcacaaacacttt

SEQ ID NO: 437844 - DNA, 25 bp, Homo sapien
actttgtgtgtgtatggtcactaac

SEQ ID NO: 437845 - DNA, 25 bp, Homo sapien
ctttgtgtgtgtatggtcactaaca

SEQ ID NO: 437846 - DNA, 25 bp, Homo sapien
gtgtgtgtatggtcactaacatttt

SEQ ID NO: 437847 - DNA, 25 bp, Homo sapien
gtgtgtatggtcactaacatttttc

SEQ ID NO: 437848 - DNA, 25 bp, Homo sapien
gaaaggtctggaagcctgagtgggc

SEQ ID NO: 437849 - DNA, 25 bp, Homo sapien
tgagtgggcgcagccgagcttaatt

SEQ ID NO: 437850 - DNA, 25 bp, Homo sapien
gggcgcagccgagcttaattacaga

SEQ ID NO: 437851 - DNA, 25 bp, Homo sapien
cagccgagcttaattacagagcagc

SEQ ID NO: 437852 - DNA, 25 bp, Homo sapien
gagtgagagcagaccgcccttgtgt

SEQ ID NO: 437853 - DNA, 25 bp, Homo sapien
agcagaccgcccttgtgtgggccac

SEQ ID NO: 437854 - DNA, 25 bp, Homo sapien
cttgtgtgggccacacacatgctgt

SEQ ID NO: 437855 - DNA, 25 bp, Homo sapien
ggagggtttccctcgcggtgacact

SEQ ID NO: 437856 - DNA, 25 bp, Homo sapien
tcgcggtgacactcacagagtggca

SEQ ID NO: 437857 - DNA, 25 bp, Homo sapien
agagtggcacatgtgagcttcacct

SEQ ID NO: 437858 - DNA, 25 bp, Homo sapien
tggcacatgtgagcttcacctgcac

SEQ ID NO: 437859 - DNA, 25 bp, Homo sapien
ccaggacgtggtacagagtaactgt

SEQ ID NO: 437860 - DNA, 25 bp, Homo sapien
actgtacattaaactggcagagctt

SEQ ID NO: 437861 - DNA, 25 bp, Homo sapien
ttagtggtaaaggtggtgagtcctt

SEQ ID NO: 437862 - DNA, 25 bp, Homo sapien
tgagtccttgggtgcgcagtggagc

SEQ ID NO: 437863 - DNA, 25 bp, Homo sapien
tcacctcttcctgtcactgggaggg

SEQ ID NO: 437864 - DNA, 25 bp, Homo sapien
tcttcctgtcactgggagggcccct

SEQ ID NO: 437865 - DNA, 25 bp, Homo sapien
tgggtctcgctgtgcctggacgcca

SEQ ID NO: 437866 - DNA, 25 bp, Homo sapien
atcgctcagctcagtgctgactcag

SEQ ID NO: 437867 - DNA, 25 bp, Homo sapien
agttcagaggattcttccctcagga

SEQ ID NO: 437868 - DNA, 25 bp, Homo sapien
aggattcttccctcaggaccgcagc

SEQ ID NO: 437869 - DNA, 25 bp, Homo sapien
cgcagctcttgcagtgaataaagtt

SEQ ID NO: 437870 - DNA, 25 bp, Homo sapien
gaatgagattgctctttgtgtcctg

SEQ ID NO: 437871 - DNA, 25 bp, Homo sapien
gagattgctctttgtgtcctgttgc

SEQ ID NO: 437872 - DNA, 25 bp, Homo sapien
tgctctttgtgtcctgttgcggaaa

SEQ ID NO: 437873 - DNA, 25 bp, Homo sapien
ttgtgtcctgttgcggaaaaattac

SEQ ID NO: 437874 - DNA, 25 bp, Homo sapien
tcctgttgcggaaaaattactaaca

SEQ ID NO: 437875 - DNA, 25 bp, Homo sapien
cagtatatagagagaaggctacatt

SEQ ID NO: 437876 - DNA, 25 bp, Homo sapien
aaggctacatttgtgtgaagggaac

SEQ ID NO: 437877 - DNA, 25 bp, Homo sapien
aatatttgtatttgatggtatgctc

SEQ ID NO: 437878 - DNA, 25 bp, Homo sapien
gtatttgatggtatgctcatgaaca

SEQ ID NO: 437879 - DNA, 25 bp, Homo sapien
gatggtatgctcatgaacattgtgt

SEQ ID NO: 437880 - DNA, 25 bp, Homo sapien
gttgaaattttaatctgcaaatgaa

SEQ ID NO: 437881 - DNA, 25 bp, Homo sapien
cgtctttacagaggtaatcaagtta

SEQ ID NO: 437882 - DNA, 25 bp, Homo sapien
aatgaggtcatttgggcaggtgcag

SEQ ID NO: 437883 - DNA, 25 bp, Homo sapien
atgaggtcatttgggcaggtgcagt

SEQ ID NO: 437884 - DNA, 25 bp, Homo sapien
tgaggtcatttgggcaggtgcagtg

SEQ ID NO: 437885 - DNA, 25 bp, Homo sapien
gaggtcatttgggcaggtgcagtgg

SEQ ID NO: 437886 - DNA, 25 bp, Homo sapien
aggtcatttgggcaggtgcagtggt

SEQ ID NO: 437887 - DNA, 25 bp, Homo sapien
ggtcatttgggcaggtgcagtggtt

SEQ ID NO: 437888 - DNA, 25 bp, Homo sapien
gtcatttgggcaggtgcagtggttc

SEQ ID NO: 437889 - DNA, 25 bp, Homo sapien
tcatttgggcaggtgcagtggttca

SEQ ID NO: 437890 - DNA, 25 bp, Homo sapien
caaaaaaattagccattagctgggc

SEQ ID NO: 437891 - DNA, 25 bp, Homo sapien
aaaaattagccattagctgggcatg

SEQ ID NO: 437892 - DNA, 25 bp, Homo sapien
ctagatgctcagacttttcacacaa

SEQ ID NO: 437893 - DNA, 25 bp, Homo sapien
atcaggttctgttccataaactctg

SEQ ID NO: 437894 - DNA, 25 bp, Homo sapien
aactctggattgcattcctacatgg

SEQ ID NO: 437895 - DNA, 25 bp, Homo sapien
ctacatggaaatgcctctggagtgt

SEQ ID NO: 437896 - DNA, 25 bp, Homo sapien
attcttcttatttcccagatcatcc

SEQ ID NO: 437897 - DNA, 25 bp, Homo sapien
gatcatccattgcattcgatatcag

SEQ ID NO: 437898 - DNA, 25 bp, Homo sapien
acggaccagtcctacattgatgttt

SEQ ID NO: 437899 - DNA, 25 bp, Homo sapien
cattgatgttttacctgagttcaga

SEQ ID NO: 437900 - DNA, 25 bp, Homo sapien
gagttcagagattcttaccccatta

SEQ ID NO: 437901 - DNA, 25 bp, Homo sapien
accccattaagtatgtccatgcctt

SEQ ID NO: 437902 - DNA, 25 bp, Homo sapien
ttatttacttcttgacggtccaaag

SEQ ID NO: 437903 - DNA, 25 bp, Homo sapien
gaatactgttcaggctgaataccgt

SEQ ID NO: 437904 - DNA, 25 bp, Homo sapien
tactgttcaggctgaataccgtcct

SEQ ID NO: 437905 - DNA, 25 bp, Homo sapien
gaataccgtcctgtgacatgggttt

SEQ ID NO: 437906 - DNA, 25 bp, Homo sapien
taccgtcctgtgacatgggtttaaa

SEQ ID NO: 437907 - DNA, 25 bp, Homo sapien
gtcctgtgacatgggtttaaaaaca

SEQ ID NO: 437908 - DNA, 25 bp, Homo sapien
acatgggtttaaaaacacaggccag

SEQ ID NO: 437909 - DNA, 25 bp, Homo sapien
tggtggtggcacgtgtcattgtccc

SEQ ID NO: 437910 - DNA, 25 bp, Homo sapien
tggtggcacgtgtcattgtcccggc

SEQ ID NO: 437911 - DNA, 25 bp, Homo sapien
gtggcacgtgtcattgtcccggcca

SEQ ID NO: 437912 - DNA, 25 bp, Homo sapien
acgtgtcattgtcccggccacttgg

SEQ ID NO: 437913 - DNA, 25 bp, Homo sapien
tcattgtcccggccacttgggaggc

SEQ ID NO: 437914 - DNA, 25 bp, Homo sapien
actgaggcagtcatgcccagggcat

SEQ ID NO: 437915 - DNA, 25 bp, Homo sapien
atgcccagggcatatagcttggctg

SEQ ID NO: 437916 - DNA, 25 bp, Homo sapien
ggcatatagcttggctgagggcacc

SEQ ID NO: 437917 - DNA, 25 bp, Homo sapien
tcacctgcaggcctttatactccta

SEQ ID NO: 437918 - DNA, 25 bp, Homo sapien
gcctttatactcctagccatagaca

SEQ ID NO: 437919 - DNA, 25 bp, Homo sapien
tcctagccatagacagtggcctgca

SEQ ID NO: 437920 - DNA, 25 bp, Homo sapien
gtggcctgcacagcactaccaagaa

SEQ ID NO: 437921 - DNA, 25 bp, Homo sapien
agcactaccaagaactaccgggaga

SEQ ID NO: 437922 - DNA, 25 bp, Homo sapien
taccgggagacaagaaagggacact

SEQ ID NO: 437923 - DNA, 25 bp, Homo sapien
gggacactctctagagaaggcttca

SEQ ID NO: 437924 - DNA, 25 bp, Homo sapien
cttcaaggaaagcttatggccaggc

SEQ ID NO: 437925 - DNA, 25 bp, Homo sapien
cagtgtcagtcttggttgtgtattg

SEQ ID NO: 437926 - DNA, 25 bp, Homo sapien
gtcagtcttggttgtgtattgcata

SEQ ID NO: 437927 - DNA, 25 bp, Homo sapien
cagtcttggttgtgtattgcatata

SEQ ID NO: 437928 - DNA, 25 bp, Homo sapien
ggttgtgtattgcatatactgtatt

SEQ ID NO: 437929 - DNA, 25 bp, Homo sapien
tttaactttgttcaagtatgtggta

SEQ ID NO: 437930 - DNA, 25 bp, Homo sapien
gtatgtggtaatttgctcctattag

SEQ ID NO: 437931 - DNA, 25 bp, Homo sapien
ggtaatttgctcctattagagtaaa

SEQ ID NO: 437932 - DNA, 25 bp, Homo sapien
ccagtaaattatcagtttgtgtaac

SEQ ID NO: 437933 - DNA, 25 bp, Homo sapien
agatctagatgcataaaattttgaa

SEQ ID NO: 437934 - DNA, 25 bp, Homo sapien
gaatgtgaaaattgcagggcatttt

SEQ ID NO: 437935 - DNA, 25 bp, Homo sapien
atattttcccatgttctctgttatt

SEQ ID NO: 437936 - DNA, 25 bp, Homo sapien
taaaaatactcagctgggcgcgatg

SEQ ID NO: 437937 - DNA, 25 bp, Homo sapien
aaaaatactcagctgggcgcgatgg

SEQ ID NO: 437938 - DNA, 25 bp, Homo sapien
aaaatactcagctgggcgcgatggc

SEQ ID NO: 437939 - DNA, 25 bp, Homo sapien
aaatactcagctgggcgcgatggct

SEQ ID NO: 437940 - DNA, 25 bp, Homo sapien
aatactcagctgggcgcgatggctc

SEQ ID NO: 437941 - DNA, 25 bp, Homo sapien
atactcagctgggcgcgatggctca

SEQ ID NO: 437942 - DNA, 25 bp, Homo sapien
tactcagctgggcgcgatggctcac

SEQ ID NO: 437943 - DNA, 25 bp, Homo sapien
actcagctgggcgcgatggctcacg

SEQ ID NO: 437944 - DNA, 25 bp, Homo sapien
ctcagctgggcgcgatggctcacgc

SEQ ID NO: 437945 - DNA, 25 bp, Homo sapien
tcagctgggcgcgatggctcacgcc

SEQ ID NO: 437946 - DNA, 25 bp, Homo sapien
agcatccagccagtgagtgggcacc

SEQ ID NO: 437947 - DNA, 25 bp, Homo sapien
aggatgagaccagtaaatgccggag

SEQ ID NO: 437948 - DNA, 25 bp, Homo sapien
agtctcgcttggctctcatgactgt

SEQ ID NO: 437949 - DNA, 25 bp, Homo sapien
cttggctctcatgactgtggtggtg

SEQ ID NO: 437950 - DNA, 25 bp, Homo sapien
gagcctcgcccatggtctcacgtgg

SEQ ID NO: 437951 - DNA, 25 bp, Homo sapien
ggcaagaagtgcctttagctctgga

SEQ ID NO: 437952 - DNA, 25 bp, Homo sapien
gcaagaagtgcctttagctctggat

SEQ ID NO: 437953 - DNA, 25 bp, Homo sapien
caagaagtgcctttagctctggatc

SEQ ID NO: 437954 - DNA, 25 bp, Homo sapien
aagaagtgcctttagctctggatcc

SEQ ID NO: 437955 - DNA, 25 bp, Homo sapien
aggcccctctggaattgtccttatt

SEQ ID NO: 437956 - DNA, 25 bp, Homo sapien
gcccctctggaattgtccttattaa

SEQ ID NO: 437957 - DNA, 25 bp, Homo sapien
gatgttttttgtaacctagcctctg

SEQ ID NO: 437958 - DNA, 25 bp, Homo sapien
gtaacctagcctctgaaagtgtcat

SEQ ID NO: 437959 - DNA, 25 bp, Homo sapien
gaaagtgtcataccaattctgtatt

SEQ ID NO: 437960 - DNA, 25 bp, Homo sapien
gtcaactacaacgtgggagactcct

SEQ ID NO: 437961 - DNA, 25 bp, Homo sapien
gggagactcctacacaaggcatgaa

SEQ ID NO: 437962 - DNA, 25 bp, Homo sapien
gcatgaattctaggaggtgggcatt

SEQ ID NO: 437963 - DNA, 25 bp, Homo sapien
ggtgggcatttttaagtgtcatctg

SEQ ID NO: 437964 - DNA, 25 bp, Homo sapien
ggaggctgtcacaacctggaagtta

SEQ ID NO: 437965 - DNA, 25 bp, Homo sapien
agagggcctctcacaacatggcagt

SEQ ID NO: 437966 - DNA, 25 bp, Homo sapien
caacatggcagttatttgtccccag

SEQ ID NO: 437967 - DNA, 25 bp, Homo sapien
tatttgtccccagagcaagcaacac

SEQ ID NO: 437968 - DNA, 25 bp, Homo sapien
tacgctcacttgtaagtcttcgtgc

SEQ ID NO: 437969 - DNA, 25 bp, Homo sapien
acttgtaagtcttcgtgctgttgta

SEQ ID NO: 437970 - DNA, 25 bp, Homo sapien
gtaagtcttcgtgctgttgtaaaaa

SEQ ID NO: 437971 - DNA, 25 bp, Homo sapien
agtcttcgtgctgttgtaaaaattg

SEQ ID NO: 437972 - DNA, 25 bp, Homo sapien
cgtgctgttgtaaaaattgaggtcg

SEQ ID NO: 437973 - DNA, 25 bp, Homo sapien
attgaggtcgtggttttccacgcga

SEQ ID NO: 437974 - DNA, 25 bp, Homo sapien
ttttccacgcgatttggctggcgaa

SEQ ID NO: 437975 - DNA, 25 bp, Homo sapien
gatttggctggcgaagagaccacga

SEQ ID NO: 437976 - DNA, 25 bp, Homo sapien
tggcgaagagaccacgaagccaccc

SEQ ID NO: 437977 - DNA, 25 bp, Homo sapien
atttttgcttgctatccagatcctg

SEQ ID NO: 437978 - DNA, 25 bp, Homo sapien
ttgcttgctatccagatcctgggtt

SEQ ID NO: 437979 - DNA, 25 bp, Homo sapien
aggtgatagcagctattccttacct

SEQ ID NO: 437980 - DNA, 25 bp, Homo sapien
tattccttacctttgtctcatttct

SEQ ID NO: 437981 - DNA, 25 bp, Homo sapien
ctgttgttagcttaattcttccttg

SEQ ID NO: 437982 - DNA, 25 bp, Homo sapien
gttctatgaattattcctttggtac

SEQ ID NO: 437983 - DNA, 25 bp, Homo sapien
ggtacaatcttctatcaacaacacg

SEQ ID NO: 437984 - DNA, 25 bp, Homo sapien
tatcaacaacacgtggtctctgcat

SEQ ID NO: 437985 - DNA, 25 bp, Homo sapien
acacgtggtctctgcatgggacagt

SEQ ID NO: 437986 - DNA, 25 bp, Homo sapien
gtctctgcatgggacagtgaggtca

SEQ ID NO: 437987 - DNA, 25 bp, Homo sapien
gagagatgttagtcactttagtcaa

SEQ ID NO: 437988 - DNA, 25 bp, Homo sapien
gtgaagggaagttaccagtagcatg

SEQ ID NO: 437989 - DNA, 25 bp, Homo sapien
gtagcatggagctctctaagctctc

SEQ ID NO: 437990 - DNA, 25 bp, Homo sapien
tctctgagtacccttggcctcatct

SEQ ID NO: 437991 - DNA, 25 bp, Homo sapien
tctgagtacccttggcctcatctgt

SEQ ID NO: 437992 - DNA, 25 bp, Homo sapien
ctgagtacccttggcctcatctgta

SEQ ID NO: 437993 - DNA, 25 bp, Homo sapien
gagtacccttggcctcatctgtaaa

SEQ ID NO: 437994 - DNA, 25 bp, Homo sapien
gaggataatgatacctacttttggc

SEQ ID NO: 437995 - DNA, 25 bp, Homo sapien
aggataatgatacctacttttggcg

SEQ ID NO: 437996 - DNA, 25 bp, Homo sapien
ggataatgatacctacttttggcgg

SEQ ID NO: 437997 - DNA, 25 bp, Homo sapien
gataatgatacctacttttggcggg

SEQ ID NO: 437998 - DNA, 25 bp, Homo sapien
ataatgatacctacttttggcgggg

SEQ ID NO: 437999 - DNA, 25 bp, Homo sapien
atgatacctacttttggcggggtgc

SEQ ID NO: 438000 - DNA, 25 bp, Homo sapien
atacctacttttggcggggtgcagg

SEQ ID NO: 438001 - DNA, 25 bp, Homo sapien
attggattaacatcttcagcataag

SEQ ID NO: 438002 - DNA, 25 bp, Homo sapien
attaacatcttcagcataagacctg

SEQ ID NO: 438003 - DNA, 25 bp, Homo sapien
acatcttcagcataagacctgaaac

SEQ ID NO: 438004 - DNA, 25 bp, Homo sapien
gacctgaaactgttaaactactgga

SEQ ID NO: 438005 - DNA, 25 bp, Homo sapien
tgaaactgttaaactactggaagaa

SEQ ID NO: 438006 - DNA, 25 bp, Homo sapien
gctaaatgacattgtgtctggacaa

SEQ ID NO: 438007 - DNA, 25 bp, Homo sapien
ttgtgtctggacaatgatatttata

SEQ ID NO: 438008 - DNA, 25 bp, Homo sapien
taaatcctcaaaacaactctatgag

SEQ ID NO: 438009 - DNA, 25 bp, Homo sapien
ctgatgtacagagtgattaaatgac

SEQ ID NO: 438010 - DNA, 25 bp, Homo sapien
ttaaatgacttgctagaggctaggt

SEQ ID NO: 438011 - DNA, 25 bp, Homo sapien
tgacttgctagaggctaggtgcagt

SEQ ID NO: 438012 - DNA, 25 bp, Homo sapien
cgactgtaaccatgctagcaaactt

SEQ ID NO: 438013 - DNA, 25 bp, Homo sapien
gccatttactttgtgtctgtaataa

SEQ ID NO: 438014 - DNA, 25 bp, Homo sapien
atcaagtttggagttttaagaatct

SEQ ID NO: 438015 - DNA, 25 bp, Homo sapien
atgctagcaaacttagtacccttta

SEQ ID NO: 438016 - DNA, 25 bp, Homo sapien
aacaaacctgtcttcatgttctgcc

SEQ ID NO: 438017 - DNA, 25 bp, Homo sapien
ctgtcttcatgttctgccaagctat

SEQ ID NO: 438018 - DNA, 25 bp, Homo sapien
tcttcatgttctgccaagctattgg

SEQ ID NO: 438019 - DNA, 25 bp, Homo sapien
gctattggattcagctgttcttcag

SEQ ID NO: 438020 - DNA, 25 bp, Homo sapien
tagtaccctttactgtaaccctgat

SEQ ID NO: 438021 - DNA, 25 bp, Homo sapien
tttactgtaaccctgatatcttttc

SEQ ID NO: 438022 - DNA, 25 bp, Homo sapien
gctgttagtctgttctctgtgtaaa

SEQ ID NO: 438023 - DNA, 25 bp, Homo sapien
cccatatgtgcagcagggccacaga

SEQ ID NO: 438024 - DNA, 25 bp, Homo sapien
agggccacagatgtgcttgtcggta

SEQ ID NO: 438025 - DNA, 25 bp, Homo sapien
tgtgcttgtcggtaggagagaccaa

SEQ ID NO: 438026 - DNA, 25 bp, Homo sapien
accaagctgtctgtgtgccgatgtc

SEQ ID NO: 438027 - DNA, 25 bp, Homo sapien
agctgtctgtgtgccgatgtcttga

SEQ ID NO: 438028 - DNA, 25 bp, Homo sapien
tgtgccgatgtcttgacacctgaga

SEQ ID NO: 438029 - DNA, 25 bp, Homo sapien
gatgtcttgacacctgagacttcag

SEQ ID NO: 438030 - DNA, 25 bp, Homo sapien
tgagacttcaggttcacccatcctg

SEQ ID NO: 438031 - DNA, 25 bp, Homo sapien
aggttcacccatcctggttctgcca

SEQ ID NO: 438032 - DNA, 25 bp, Homo sapien
tggttctgccattccattgcagggt

SEQ ID NO: 438033 - DNA, 25 bp, Homo sapien
ggactcttaacgctttggtctgtta

SEQ ID NO: 438034 - DNA, 25 bp, Homo sapien
gctacaatgcccacatggtgcctga

SEQ ID NO: 438035 - DNA, 25 bp, Homo sapien
caatgcccacatggtgcctgaggat

SEQ ID NO: 438036 - DNA, 25 bp, Homo sapien
cctgcctccaggctggcgtctatgt

SEQ ID NO: 438037 - DNA, 25 bp, Homo sapien
caggctggcgtctatgtcctgcgct

SEQ ID NO: 438038 - DNA, 25 bp, Homo sapien
acctacagccggatgcatgccaaga

SEQ ID NO: 438039 - DNA, 25 bp, Homo sapien
cagccggatgcatgccaagaagctc

SEQ ID NO: 438040 - DNA, 25 bp, Homo sapien
aagaagctcagctacactgtggagg

SEQ ID NO: 438041 - DNA, 25 bp, Homo sapien
tgtggaggtgctgcttcccgacaag

SEQ ID NO: 438042 - DNA, 25 bp, Homo sapien
tgcttcccgacaaggcctctgagga

SEQ ID NO: 438043 - DNA, 25 bp, Homo sapien
tcccgacaaggcctctgaggagacg

SEQ ID NO: 438044 - DNA, 25 bp, Homo sapien
gtgtgctcaggtggcagtttgcttc

SEQ ID NO: 438045 - DNA, 25 bp, Homo sapien
caccgtctcgttccggaagaggatg

SEQ ID NO: 438046 - DNA, 25 bp, Homo sapien
cgcatttgtactccccggtccagat

SEQ ID NO: 438047 - DNA, 25 bp, Homo sapien
gaagagcgtcttcaagctggacttg

SEQ ID NO: 438048 - DNA, 25 bp, Homo sapien
gcttctcctcgtagacgcgtaggaa

SEQ ID NO: 438049 - DNA, 25 bp, Homo sapien
acgcgtaggaacagggccagcttct

SEQ ID NO: 438050 - DNA, 25 bp, Homo sapien
gagcggaagctcacgtcgaattcgc

SEQ ID NO: 438051 - DNA, 25 bp, Homo sapien
gaagctcacgtcgaattcgcggctg

SEQ ID NO: 438052 - DNA, 25 bp, Homo sapien
cccgggatctggatgaccgcgtaga

SEQ ID NO: 438053 - DNA, 25 bp, Homo sapien
agatcccaaacctgtcggtcacttt

SEQ ID NO: 438054 - DNA, 25 bp, Homo sapien
cagcacgtcgcagtggcgcttgagc

SEQ ID NO: 438055 - DNA, 25 bp, Homo sapien
agtggcgcttgagccaagtcacaat

SEQ ID NO: 438056 - DNA, 25 bp, Homo sapien
gtaatttttctagtcacatgaactg

SEQ ID NO: 438057 - DNA, 25 bp, Homo sapien
acatgaactgattggttccaggcaa

SEQ ID NO: 438058 - DNA, 25 bp, Homo sapien
ggttccaggcaattagaaaatggct

SEQ ID NO: 438059 - DNA, 25 bp, Homo sapien
tgggtcttcgttttcctattaggag

SEQ ID NO: 438060 - DNA, 25 bp, Homo sapien
ttaggagactgaactgaccacatgt

SEQ ID NO: 438061 - DNA, 25 bp, Homo sapien
tatcctgaatatatgggaacttctg

SEQ ID NO: 438062 - DNA, 25 bp, Homo sapien
atatgggaacttctgtgtttgggat

SEQ ID NO: 438063 - DNA, 25 bp, Homo sapien
gtttgggatgtcctactgtaagact

SEQ ID NO: 438064 - DNA, 25 bp, Homo sapien
gatgtcctactgtaagactgatgaa

SEQ ID NO: 438065 - DNA, 25 bp, Homo sapien
acagagttaatttcagggtacagtt

SEQ ID NO: 438066 - DNA, 25 bp, Homo sapien
cagggtacagttttgccttaatggt

SEQ ID NO: 438067 - DNA, 25 bp, Homo sapien
ttttctcttacattaattctcttca

SEQ ID NO: 438068 - DNA, 25 bp, Homo sapien
tttctcttacattaattctcttcac

SEQ ID NO: 438069 - DNA, 25 bp, Homo sapien
tctcttacattaattctcttcactg

SEQ ID NO: 438070 - DNA, 25 bp, Homo sapien
ctcttacattaattctcttcactga

SEQ ID NO: 438071 - DNA, 25 bp, Homo sapien
tcttacattaattctcttcactgaa

SEQ ID NO: 438072 - DNA, 25 bp, Homo sapien
cttacattaattctcttcactgaaa

SEQ ID NO: 438073 - DNA, 25 bp, Homo sapien
ttacattaattctcttcactgaaat

SEQ ID NO: 438074 - DNA, 25 bp, Homo sapien
acattaattctcttcactgaaatga

SEQ ID NO: 438075 - DNA, 25 bp, Homo sapien
attaattctcttcactgaaatgagg

SEQ ID NO: 438076 - DNA, 25 bp, Homo sapien
cactgaaatgaggacaaaagagtat

SEQ ID NO: 438077 - DNA, 25 bp, Homo sapien
aagagtatacaaggctgggtgcagt

SEQ ID NO: 438078 - DNA, 25 bp, Homo sapien
gaatgtgtatccatttcaactgcaa

SEQ ID NO: 438079 - DNA, 25 bp, Homo sapien
gtgtatccatttcaactgcaattat

SEQ ID NO: 438080 - DNA, 25 bp, Homo sapien
tgctttgcaacaggataaacccggt

SEQ ID NO: 438081 - DNA, 25 bp, Homo sapien
gataaacccggtggataaaagctga

SEQ ID NO: 438082 - DNA, 25 bp, Homo sapien
cgtggagttgatacagaaacactgc

SEQ ID NO: 438083 - DNA, 25 bp, Homo sapien
atacagaaacactgcaagggctggg

SEQ ID NO: 438084 - DNA, 25 bp, Homo sapien
ggacagggcttagttcgtggaatac

SEQ ID NO: 438085 - DNA, 25 bp, Homo sapien
cagggcttagttcgtggaatacaca

SEQ ID NO: 438086 - DNA, 25 bp, Homo sapien
agatgttacaacagtgttccatcaa

SEQ ID NO: 438087 - DNA, 25 bp, Homo sapien
tgttccatcaaataccacttttcca

SEQ ID NO: 438088 - DNA, 25 bp, Homo sapien
aaatcttaccaccagaatgtgtatc

SEQ ID NO: 438089 - DNA, 25 bp, Homo sapien
ttctctcaccggcttctaccagggt

SEQ ID NO: 438090 - DNA, 25 bp, Homo sapien
gcttctaccagggtccaggactaag

SEQ ID NO: 438091 - DNA, 25 bp, Homo sapien
ggactaaggcgtttttctccatagc

SEQ ID NO: 438092 - DNA, 25 bp, Homo sapien
ttctccatagcctcaacattttggg

SEQ ID NO: 438093 - DNA, 25 bp, Homo sapien
tgggaatcttcccttaatcaccctt

SEQ ID NO: 438094 - DNA, 25 bp, Homo sapien
taatcacccttgctcctcctgggtg

SEQ ID NO: 438095 - DNA, 25 bp, Homo sapien
gagacctctttgttgcgttttgtgc

SEQ ID NO: 438096 - DNA, 25 bp, Homo sapien
gcgttttgtgctttgatgccaggaa

SEQ ID NO: 438097 - DNA, 25 bp, Homo sapien
gatgccaggaatgccgcctagttta

SEQ ID NO: 438098 - DNA, 25 bp, Homo sapien
aggaatgccgcctagtttatgtccc

SEQ ID NO: 438099 - DNA, 25 bp, Homo sapien
gccgcctagtttatgtccccggtgg

SEQ ID NO: 438100 - DNA, 25 bp, Homo sapien
gggccccagcagtaggtcggaggtg

SEQ ID NO: 438101 - DNA, 25 bp, Homo sapien
ggccccagcagtaggtcggaggtga

SEQ ID NO: 438102 - DNA, 25 bp, Homo sapien
gccccagcagtaggtcggaggtgaa

SEQ ID NO: 438103 - DNA, 25 bp, Homo sapien
ccagcagtaggtcggaggtgaagtc

SEQ ID NO: 438104 - DNA, 25 bp, Homo sapien
gtaggtcggaggtgaagtcgggcca

SEQ ID NO: 438105 - DNA, 25 bp, Homo sapien
tcggaggtgaagtcgggccaggtgc

SEQ ID NO: 438106 - DNA, 25 bp, Homo sapien
tcttgggcaatacagcaaaaccgtg

SEQ ID NO: 438107 - DNA, 25 bp, Homo sapien
cttgggcaatacagcaaaaccgtgt

SEQ ID NO: 438108 - DNA, 25 bp, Homo sapien
ttgggcaatacagcaaaaccgtgtc

SEQ ID NO: 438109 - DNA, 25 bp, Homo sapien
ggcaatacagcaaaaccgtgtccaa

SEQ ID NO: 438110 - DNA, 25 bp, Homo sapien
tacagcaaaaccgtgtccaaaaatt

SEQ ID NO: 438111 - DNA, 25 bp, Homo sapien
tttggtctgcttctcgaaggttcaa

SEQ ID NO: 438112 - DNA, 25 bp, Homo sapien
ggttcaattcacagagcacttcata

SEQ ID NO: 438113 - DNA, 25 bp, Homo sapien
gttcctaaaacatccctgagttcac

SEQ ID NO: 438114 - DNA, 25 bp, Homo sapien
agaagttgttctgccagacccagtt

SEQ ID NO: 438115 - DNA, 25 bp, Homo sapien
gacccagttgaggagaccagacacc

SEQ ID NO: 438116 - DNA, 25 bp, Homo sapien
accagacaccatgcagaggtcgtga

SEQ ID NO: 438117 - DNA, 25 bp, Homo sapien
ggcagtatggcaggctctttgccgt

SEQ ID NO: 438118 - DNA, 25 bp, Homo sapien
tctttgccgtggtgcactttgccag

SEQ ID NO: 438119 - DNA, 25 bp, Homo sapien
gccagccgccagtggaaggtgacct

SEQ ID NO: 438120 - DNA, 25 bp, Homo sapien
ggtgacctctgaagacctgatctta

SEQ ID NO: 438121 - DNA, 25 bp, Homo sapien
ggaaatgaactagaccttgcgtgtg

SEQ ID NO: 438122 - DNA, 25 bp, Homo sapien
tttgctcctttaactttgaaaatat

SEQ ID NO: 438123 - DNA, 25 bp, Homo sapien
tacaatactataagaatggtgcttc

SEQ ID NO: 438124 - DNA, 25 bp, Homo sapien
ataagaatggtgcttctgccaggtg

SEQ ID NO: 438125 - DNA, 25 bp, Homo sapien
caacataacgagaccatgcctctaa

SEQ ID NO: 438126 - DNA, 25 bp, Homo sapien
ataacgagaccatgcctctaaaaaa

SEQ ID NO: 438127 - DNA, 25 bp, Homo sapien
gtgatgcacacctgtcatgccagtt

SEQ ID NO: 438128 - DNA, 25 bp, Homo sapien
tgatgcacacctgtcatgccagtta

SEQ ID NO: 438129 - DNA, 25 bp, Homo sapien
atgcacacctgtcatgccagttact

SEQ ID NO: 438130 - DNA, 25 bp, Homo sapien
gcacacctgtcatgccagttacttg

SEQ ID NO: 438131 - DNA, 25 bp, Homo sapien
ggattagtgagctgtgattctgcca

SEQ ID NO: 438132 - DNA, 25 bp, Homo sapien
gattagtgagctgtgattctgccac

SEQ ID NO: 438133 - DNA, 25 bp, Homo sapien
ccatatggactagaggcagatcttt

SEQ ID NO: 438134 - DNA, 25 bp, Homo sapien
tttgcatttgtctaaaacccatttg

SEQ ID NO: 438135 - DNA, 25 bp, Homo sapien
aaaacccatttggtcaaaagctgag

SEQ ID NO: 438136 - DNA, 25 bp, Homo sapien
gagacagattcattggctaacacac

SEQ ID NO: 438137 - DNA, 25 bp, Homo sapien
ggctaacacacaaatcacgttgatg

SEQ ID NO: 438138 - DNA, 25 bp, Homo sapien
cacgttgatgaatggctcttaatag

SEQ ID NO: 438139 - DNA, 25 bp, Homo sapien
gaagaagaccaattaatttcatgag

SEQ ID NO: 438140 - DNA, 25 bp, Homo sapien
agcaactttaagtagccatttctta

SEQ ID NO: 438141 - DNA, 25 bp, Homo sapien
cttaaactggcatattcctctgtaa

SEQ ID NO: 438142 - DNA, 25 bp, Homo sapien
tggcatattcctctgtaattttggg

SEQ ID NO: 438143 - DNA, 25 bp, Homo sapien
aatactagcactcaaaaagagccat

SEQ ID NO: 438144 - DNA, 25 bp, Homo sapien
aaatacataggcaaagggaagagaa

SEQ ID NO: 438145 - DNA, 25 bp, Homo sapien
ggaacttcctgagctctattgcatc

SEQ ID NO: 438146 - DNA, 25 bp, Homo sapien
aacttcctgagctctattgcatcaa

SEQ ID NO: 438147 - DNA, 25 bp, Homo sapien
cttcctgagctctattgcatcaagg

SEQ ID NO: 438148 - DNA, 25 bp, Homo sapien
ctgagctctattgcatcaaggaagt

SEQ ID NO: 438149 - DNA, 25 bp, Homo sapien
gctctattgcatcaaggaagtttat

SEQ ID NO: 438150 - DNA, 25 bp, Homo sapien
ggaagtttattcattacacaaagca

SEQ ID NO: 438151 - DNA, 25 bp, Homo sapien
attcattacacaaagcaggctgcac

SEQ ID NO: 438152 - DNA, 25 bp, Homo sapien
agcaggctgcacaacttcattcctt

SEQ ID NO: 438153 - DNA, 25 bp, Homo sapien
aggctgcacaacttcattccttctt

SEQ ID NO: 438154 - DNA, 25 bp, Homo sapien
aaagcagaatactagcctggaaaag

SEQ ID NO: 438155 - DNA, 25 bp, Homo sapien
ccccagatgaactgcaggtagacgt

SEQ ID NO: 438156 - DNA, 25 bp, Homo sapien
aactgcaggtagacgtttcttcctt

SEQ ID NO: 438157 - DNA, 25 bp, Homo sapien
tagacgtttcttccttgcttggagc

SEQ ID NO: 438158 - DNA, 25 bp, Homo sapien
ttggagccccagtttttgcatttca

SEQ ID NO: 438159 - DNA, 25 bp, Homo sapien
gccccagtttttgcatttcattttc

SEQ ID NO: 438160 - DNA, 25 bp, Homo sapien
ggttttggttctaaggagctctaca

SEQ ID NO: 438161 - DNA, 25 bp, Homo sapien
tctaaggagctctacagtttaacag

SEQ ID NO: 438162 - DNA, 25 bp, Homo sapien
cagtttaacagagagagggacctta

SEQ ID NO: 438163 - DNA, 25 bp, Homo sapien
gggcctaccaagtatctccactttt

SEQ ID NO: 438164 - DNA, 25 bp, Homo sapien
accaagtatctccacttttgaaaat

SEQ ID NO: 438165 - DNA, 25 bp, Homo sapien
aaaggcaggtttattgaagcataat

SEQ ID NO: 438166 - DNA, 25 bp, Homo sapien
cccctgctgtctgatgacatcttga

SEQ ID NO: 438167 - DNA, 25 bp, Homo sapien
ccctgctgtctgatgacatcttgaa

SEQ ID NO: 438168 - DNA, 25 bp, Homo sapien
tgctgtctgatgacatcttgaaatt

SEQ ID NO: 438169 - DNA, 25 bp, Homo sapien
gctgtctgatgacatcttgaaatta

SEQ ID NO: 438170 - DNA, 25 bp, Homo sapien
gtctgatgacatcttgaaattagaa

SEQ ID NO: 438171 - DNA, 25 bp, Homo sapien
gatgacatcttgaaattagaagctt

SEQ ID NO: 438172 - DNA, 25 bp, Homo sapien
gacatcttgaaattagaagcttagg

SEQ ID NO: 438173 - DNA, 25 bp, Homo sapien
atcttgaaattagaagcttaggccg

SEQ ID NO: 438174 - DNA, 25 bp, Homo sapien
tcttgaaattagaagcttaggccgg

SEQ ID NO: 438175 - DNA, 25 bp, Homo sapien
ttgaaattagaagcttaggccgggt

SEQ ID NO: 438176 - DNA, 25 bp, Homo sapien
aaattagaagcttaggccgggtgca

SEQ ID NO: 438177 - DNA, 25 bp, Homo sapien
gatgctttctaatataagactgatg

SEQ ID NO: 438178 - DNA, 25 bp, Homo sapien
gatgtgttgattttactgattgtac

SEQ ID NO: 438179 - DNA, 25 bp, Homo sapien
gttgattttactgattgtactgtac

SEQ ID NO: 438180 - DNA, 25 bp, Homo sapien
gtactgtacatctattaaagcctta

SEQ ID NO: 438181 - DNA, 25 bp, Homo sapien
aagccttagattattacattacggg

SEQ ID NO: 438182 - DNA, 25 bp, Homo sapien
tagattattacattacgggttggaa

SEQ ID NO: 438183 - DNA, 25 bp, Homo sapien
ggaacccataccaatgtaatttcaa

SEQ ID NO: 438184 - DNA, 25 bp, Homo sapien
accaatgtaatttcaatcgtgttaa

SEQ ID NO: 438185 - DNA, 25 bp, Homo sapien
aagaaagtaatggtgacttcacatg

SEQ ID NO: 438186 - DNA, 25 bp, Homo sapien
cttcacatgttattgtagttagtta

SEQ ID NO: 438187 - DNA, 25 bp, Homo sapien
tttcatttcctacatttattagatt

SEQ ID NO: 438188 - DNA, 25 bp, Homo sapien
tctgctcactttgccggtcaaaggt

SEQ ID NO: 438189 - DNA, 25 bp, Homo sapien
cactttgccggtcaaaggtgtgttt

SEQ ID NO: 438190 - DNA, 25 bp, Homo sapien
ggctcccgcttgtcacttctctgag

SEQ ID NO: 438191 - DNA, 25 bp, Homo sapien
gaattacatgttgtttccaccacct

SEQ ID NO: 438192 - DNA, 25 bp, Homo sapien
tccaccacctgagctttcaataatt

SEQ ID NO: 438193 - DNA, 25 bp, Homo sapien
ctttcaataattggagcttcttgga

SEQ ID NO: 438194 - DNA, 25 bp, Homo sapien
ggagcttcttggatcagaattcttc

SEQ ID NO: 438195 - DNA, 25 bp, Homo sapien
cttggatcagaattcttctttgttc

SEQ ID NO: 438196 - DNA, 25 bp, Homo sapien
gtttagatccttatctatagactaa

SEQ ID NO: 438197 - DNA, 25 bp, Homo sapien
gacgggagagactttctggtttatt

SEQ ID NO: 438198 - DNA, 25 bp, Homo sapien
gagactttctggtttattttagtgg

SEQ ID NO: 438199 - DNA, 25 bp, Homo sapien
ggcacagcaggactctagctgagta

SEQ ID NO: 438200 - DNA, 25 bp, Homo sapien
ggtactttattcacatgccagcctt

SEQ ID NO: 438201 - DNA, 25 bp, Homo sapien
attcacatgccagccttgcagaaaa

SEQ ID NO: 438202 - DNA, 25 bp, Homo sapien
ttgcagaaaaggctcccattgtgtt

SEQ ID NO: 438203 - DNA, 25 bp, Homo sapien
ctcaacctaccattcaactttttca

SEQ ID NO: 438204 - DNA, 25 bp, Homo sapien
gggtctttcagcttcatttcagctg

SEQ ID NO: 438205 - DNA, 25 bp, Homo sapien
atttcagctgctaagtccctgccaa

SEQ ID NO: 438206 - DNA, 25 bp, Homo sapien
aagtccctgccaagcagttctgttg

SEQ ID NO: 438207 - DNA, 25 bp, Homo sapien
caagcagttctgttgtaccagcaat

SEQ ID NO: 438208 - DNA, 25 bp, Homo sapien
gtaccagcaattttacatcctcaag

SEQ ID NO: 438209 - DNA, 25 bp, Homo sapien
tcaagagctgtctgcggcacagcag

SEQ ID NO: 438210 - DNA, 25 bp, Homo sapien
gaaaagcaagcttaggctacctgaa

SEQ ID NO: 438211 - DNA, 25 bp, Homo sapien
tccccttggaagtttagcgtatgtt

SEQ ID NO: 438212 - DNA, 25 bp, Homo sapien
aaattccctacatcagagactctag

SEQ ID NO: 438213 - DNA, 25 bp, Homo sapien
gagactctaggtgctatataatcca

SEQ ID NO: 438214 - DNA, 25 bp, Homo sapien
cacaacttttcagcctgtgctcatt

SEQ ID NO: 438215 - DNA, 25 bp, Homo sapien
attctgtcccatgctggccataata

SEQ ID NO: 438216 - DNA, 25 bp, Homo sapien
cataatacctagtcagcccattacc

SEQ ID NO: 438217 - DNA, 25 bp, Homo sapien
attacccttatctcgaattgctcca

SEQ ID NO: 438218 - DNA, 25 bp, Homo sapien
aattgctccatctcctggtgggact

SEQ ID NO: 438219 - DNA, 25 bp, Homo sapien
aaaatctttctctctagtctttctc

SEQ ID NO: 438220 - DNA, 25 bp, Homo sapien
gtagcaatgcaactcatcactctag

SEQ ID NO: 438221 - DNA, 25 bp, Homo sapien
aaagcacttataacagtctctgaca

SEQ ID NO: 438222 - DNA, 25 bp, Homo sapien
gtctctgacatgcatgatacacaca

SEQ ID NO: 438223 - DNA, 25 bp, Homo sapien
aatgaacacatcgtacctccaatta

SEQ ID NO: 438224 - DNA, 25 bp, Homo sapien
gtacctccaattatcatagccacaa

SEQ ID NO: 438225 - DNA, 25 bp, Homo sapien
atttcagtgtgttcctttcaagcct

SEQ ID NO: 438226 - DNA, 25 bp, Homo sapien
tcctttcaagcctcctttggaattg

SEQ ID NO: 438227 - DNA, 25 bp, Homo sapien
gcctcctttggaattgatgttattt

SEQ ID NO: 438228 - DNA, 25 bp, Homo sapien
gttatttctcatcgtctagactatg

SEQ ID NO: 438229 - DNA, 25 bp, Homo sapien
gaacaactgcgttcatcttttataa

SEQ ID NO: 438230 - DNA, 25 bp, Homo sapien
gcgttcatcttttataactctagaa

SEQ ID NO: 438231 - DNA, 25 bp, Homo sapien
gttgtgttcaatactatatctctct

SEQ ID NO: 438232 - DNA, 25 bp, Homo sapien
tggccttttgttccaggatctcaca

SEQ ID NO: 438233 - DNA, 25 bp, Homo sapien
ggatctcacactgcatttagctaaa

SEQ ID NO: 438234 - DNA, 25 bp, Homo sapien
tgcatttagctaaactgtcttcttt

SEQ ID NO: 438235 - DNA, 25 bp, Homo sapien
tttgtctcctccaatctgttgcagc

SEQ ID NO: 438236 - DNA, 25 bp, Homo sapien
tcaatctgtgtgtctttcataaact

SEQ ID NO: 438237 - DNA, 25 bp, Homo sapien
tttgaagcgctggtcactctgcaga

SEQ ID NO: 438238 - DNA, 25 bp, Homo sapien
tgcagagtgtctccccgtttgggtt

SEQ ID NO: 438239 - DNA, 25 bp, Homo sapien
tttgggttggtctcacgttttctca

SEQ ID NO: 438240 - DNA, 25 bp, Homo sapien
gtctcacgttttctcacgagtaggg

SEQ ID NO: 438241 - DNA, 25 bp, Homo sapien
cacgagtagggagttgcgcatcatt

SEQ ID NO: 438242 - DNA, 25 bp, Homo sapien
atgtcacggaagtcgtgcgcctcag

SEQ ID NO: 438243 - DNA, 25 bp, Homo sapien
atgaactcactttccattgacatat

SEQ ID NO: 438244 - DNA, 25 bp, Homo sapien
gggagttcaggcaataaattatggc

SEQ ID NO: 438245 - DNA, 25 bp, Homo sapien
ggcatatattgtctactgtatactg

SEQ ID NO: 438246 - DNA, 25 bp, Homo sapien
ataggaaaacatttcgattgctttt

SEQ ID NO: 438247 - DNA, 25 bp, Homo sapien
gattgctttttacccttttagtgag

SEQ ID NO: 438248 - DNA, 25 bp, Homo sapien
gactaatggacatttctttgtctga

SEQ ID NO: 438249 - DNA, 25 bp, Homo sapien
ctttgtctgaggatatatcttggca

SEQ ID NO: 438250 - DNA, 25 bp, Homo sapien
tatcttggcagtacaggatttcttc

SEQ ID NO: 438251 - DNA, 25 bp, Homo sapien
ggatttcttcagacgtggctcagga

SEQ ID NO: 438252 - DNA, 25 bp, Homo sapien
tgttgtttgctatatccacgttctg

SEQ ID NO: 438253 - DNA, 25 bp, Homo sapien
atatccacgttctgggagtgtcata

SEQ ID NO: 438254 - DNA, 25 bp, Homo sapien
agaccctggagtgtcctgcagccag

SEQ ID NO: 438255 - DNA, 25 bp, Homo sapien
ctgaggcttctgtggtttaagggac

SEQ ID NO: 438256 - DNA, 25 bp, Homo sapien
taggaacaggccttgaagcttctgc

SEQ ID NO: 438257 - DNA, 25 bp, Homo sapien
gaacaggccttgaagcttctgctgc

SEQ ID NO: 438258 - DNA, 25 bp, Homo sapien
aggccttgaagcttctgctgctaaa

SEQ ID NO: 438259 - DNA, 25 bp, Homo sapien
gccttgaagcttctgctgctaaaca

SEQ ID NO: 438260 - DNA, 25 bp, Homo sapien
gtcaggtgaacccactgccagctgt

SEQ ID NO: 438261 - DNA, 25 bp, Homo sapien
gccagctgtgcccagaagacagtcc

SEQ ID NO: 438262 - DNA, 25 bp, Homo sapien
ccaggctgagtcaaaagtggttcat

SEQ ID NO: 438263 - DNA, 25 bp, Homo sapien
caaaagtggttcataggccggtcat

SEQ ID NO: 438264 - DNA, 25 bp, Homo sapien
aagtggttcataggccggtcatggt

SEQ ID NO: 438265 - DNA, 25 bp, Homo sapien
attgttgcttccttcttcatattga

SEQ ID NO: 438266 - DNA, 25 bp, Homo sapien
gaacttcaaccccacagtgaactac

SEQ ID NO: 438267 - DNA, 25 bp, Homo sapien
cacagtgaactacatattgtccata

SEQ ID NO: 438268 - DNA, 25 bp, Homo sapien
tattgtccataagtgcttcatcagg

SEQ ID NO: 438269 - DNA, 25 bp, Homo sapien
taagtgcttcatcaggactcatcgc

SEQ ID NO: 438270 - DNA, 25 bp, Homo sapien
ctcctgtctactggctccaaataga

SEQ ID NO: 438271 - DNA, 25 bp, Homo sapien
ggctccaaatagaccatgtcagctt

SEQ ID NO: 438272 - DNA, 25 bp, Homo sapien
ccctggctttgtgtctatgggtggc

SEQ ID NO: 438273 - DNA, 25 bp, Homo sapien
tcagggtgggagacacaagatgttt

SEQ ID NO: 438274 - DNA, 25 bp, Homo sapien
gatgtttttatagtctagagccttt

SEQ ID NO: 438275 - DNA, 25 bp, Homo sapien
gtttattggctgttttttgacagat

SEQ ID NO: 438276 - DNA, 25 bp, Homo sapien
agataactgtcacccttttacccat

SEQ ID NO: 438277 - DNA, 25 bp, Homo sapien
cacccttttacccattgcttggaag

SEQ ID NO: 438278 - DNA, 25 bp, Homo sapien
ttgcttggaagtggattgtgatcct

SEQ ID NO: 438279 - DNA, 25 bp, Homo sapien
atccttgatgtgagagattctgact

SEQ ID NO: 438280 - DNA, 25 bp, Homo sapien
gtataatcagcttttatttactcat

SEQ ID NO: 438281 - DNA, 25 bp, Homo sapien
aattcttatgcattattggcattac

SEQ ID NO: 438282 - DNA, 25 bp, Homo sapien
tggcattactggttaattctgatac

SEQ ID NO: 438283 - DNA, 25 bp, Homo sapien
tggttaattctgatacttccaggta

SEQ ID NO: 438284 - DNA, 25 bp, Homo sapien
gctttgcactagagttatttgctca

SEQ ID NO: 438285 - DNA, 25 bp, Homo sapien
ttatttgctcagaaagagtatgctg

SEQ ID NO: 438286 - DNA, 25 bp, Homo sapien
gagtatgctgatattaacatgagga

SEQ ID NO: 438287 - DNA, 25 bp, Homo sapien
tttattgagcactatctgttagcac

SEQ ID NO: 438288 - DNA, 25 bp, Homo sapien
gagcactatctgttagcacttagca

SEQ ID NO: 438289 - DNA, 25 bp, Homo sapien
gcactatctgttagcacttagcata

SEQ ID NO: 438290 - DNA, 25 bp, Homo sapien
tatctgttagcacttagcatatgtt

SEQ ID NO: 438291 - DNA, 25 bp, Homo sapien
atgtatgttcatatccatctgacaa

SEQ ID NO: 438292 - DNA, 25 bp, Homo sapien
gataaacttctggttctaaaattca

SEQ ID NO: 438293 - DNA, 25 bp, Homo sapien
gagttattaactctttctacctcct

SEQ ID NO: 438294 - DNA, 25 bp, Homo sapien
gttattaactctttctacctcctca

SEQ ID NO: 438295 - DNA, 25 bp, Homo sapien
ccctcaaagttataacatctcccat

SEQ ID NO: 438296 - DNA, 25 bp, Homo sapien
tcagctcagaatggcagtgatgctt

SEQ ID NO: 438297 - DNA, 25 bp, Homo sapien
gaatggcagtgatgcttatggtttg

SEQ ID NO: 438298 - DNA, 25 bp, Homo sapien
catgcctggccagaacaaatgcctt

SEQ ID NO: 438299 - DNA, 25 bp, Homo sapien
atgcctggccagaacaaatgccttt

SEQ ID NO: 438300 - DNA, 25 bp, Homo sapien
tgcctggccagaacaaatgcctttt

SEQ ID NO: 438301 - DNA, 25 bp, Homo sapien
gcctggccagaacaaatgccttttt

SEQ ID NO: 438302 - DNA, 25 bp, Homo sapien
cctggccagaacaaatgccttttta

SEQ ID NO: 438303 - DNA, 25 bp, Homo sapien
ctggccagaacaaatgcctttttaa

SEQ ID NO: 438304 - DNA, 25 bp, Homo sapien
tgtctttttctatgtcaaatgtaac

SEQ ID NO: 438305 - DNA, 25 bp, Homo sapien
gtctttttctatgtcaaatgtaacg

SEQ ID NO: 438306 - DNA, 25 bp, Homo sapien
tctttttctatgtcaaatgtaacgt

SEQ ID NO: 438307 - DNA, 25 bp, Homo sapien
ttctatgtcaaatgtaacgtttatt

SEQ ID NO: 438308 - DNA, 25 bp, Homo sapien
tctatgtcaaatgtaacgtttattt

SEQ ID NO: 438309 - DNA, 25 bp, Homo sapien
attcaaagcctccacgactctgttt

SEQ ID NO: 438310 - DNA, 25 bp, Homo sapien
ttcaaagcctccacgactctgtttc

SEQ ID NO: 438311 - DNA, 25 bp, Homo sapien
tcaaagcctccacgactctgtttcc

SEQ ID NO: 438312 - DNA, 25 bp, Homo sapien
caaagcctccacgactctgtttccc

SEQ ID NO: 438313 - DNA, 25 bp, Homo sapien
agacggccttgagtctcagtacgag

SEQ ID NO: 438314 - DNA, 25 bp, Homo sapien
gacggccttgagtctcagtacgagt

SEQ ID NO: 438315 - DNA, 25 bp, Homo sapien
cttgagtctcagtacgagtgtgcgt

SEQ ID NO: 438316 - DNA, 25 bp, Homo sapien
ttgagtctcagtacgagtgtgcgtg

SEQ ID NO: 438317 - DNA, 25 bp, Homo sapien
tgagtctcagtacgagtgtgcgtga

SEQ ID NO: 438318 - DNA, 25 bp, Homo sapien
agtctcagtacgagtgtgcgtgagt

SEQ ID NO: 438319 - DNA, 25 bp, Homo sapien
tgtgagccaccttggcaagtgcctg

SEQ ID NO: 438320 - DNA, 25 bp, Homo sapien
aatggcaaaatcttaacgtgggtga

SEQ ID NO: 438321 - DNA, 25 bp, Homo sapien
gggtgaaagagcttccttttactag

SEQ ID NO: 438322 - DNA, 25 bp, Homo sapien
gagcttccttttactagtgaggttt

SEQ ID NO: 438323 - DNA, 25 bp, Homo sapien
atagcctggtggcagatgaatgcaa

SEQ ID NO: 438324 - DNA, 25 bp, Homo sapien
gaaaatgtatgctttggttaacacc

SEQ ID NO: 438325 - DNA, 25 bp, Homo sapien
gctttggttaacaccattgctgttg

SEQ ID NO: 438326 - DNA, 25 bp, Homo sapien
attgctgttgacttcatgcagattc

SEQ ID NO: 438327 - DNA, 25 bp, Homo sapien
gcagattctattaagcactctcatt

SEQ ID NO: 438328 - DNA, 25 bp, Homo sapien
aagcactctcatttcaggagccatt

SEQ ID NO: 438329 - DNA, 25 bp, Homo sapien
ggagccatttttcccacatagtata

SEQ ID NO: 438330 - DNA, 25 bp, Homo sapien
tattttaagcttagctccctttatt

SEQ ID NO: 438331 - DNA, 25 bp, Homo sapien
tgacttccaaagcaatcaagagagc

SEQ ID NO: 438332 - DNA, 25 bp, Homo sapien
tcaagagagccacgtctagcagact

SEQ ID NO: 438333 - DNA, 25 bp, Homo sapien
gagagccacgtctagcagactttac

SEQ ID NO: 438334 - DNA, 25 bp, Homo sapien
tgaaggactgtaattcctagcagtt

SEQ ID NO: 438335 - DNA, 25 bp, Homo sapien
cctagcagtttattgagaatttcac

SEQ ID NO: 438336 - DNA, 25 bp, Homo sapien
gagaatttcactggaaatggaccat

SEQ ID NO: 438337 - DNA, 25 bp, Homo sapien
gaaatggaccatgtgttgcaagact

SEQ ID NO: 438338 - DNA, 25 bp, Homo sapien
catgtgttgcaagactaattggcta

SEQ ID NO: 438339 - DNA, 25 bp, Homo sapien
ggctataattatatcctatcaaaga

SEQ ID NO: 438340 - DNA, 25 bp, Homo sapien
cgatacgtaatagcagattgtttta

SEQ ID NO: 438341 - DNA, 25 bp, Homo sapien
tattcattccattttgatggtgtta

SEQ ID NO: 438342 - DNA, 25 bp, Homo sapien
aaccttatcctttctatgattctga

SEQ ID NO: 438343 - DNA, 25 bp, Homo sapien
ctgactgtagttttgtttagcacat

SEQ ID NO: 438344 - DNA, 25 bp, Homo sapien
gcacattttctttgctcatgctgca

SEQ ID NO: 438345 - DNA, 25 bp, Homo sapien
ctcatgctgcaaggcatgtgtgctc

SEQ ID NO: 438346 - DNA, 25 bp, Homo sapien
atgtgtgctctgaccatcatttcct

SEQ ID NO: 438347 - DNA, 25 bp, Homo sapien
tttccttccccttttgcattactca

SEQ ID NO: 438348 - DNA, 25 bp, Homo sapien
ttgcattactcatttctcttgccct

SEQ ID NO: 438349 - DNA, 25 bp, Homo sapien
tctgattcacttgtctgcctaattt

SEQ ID NO: 438350 - DNA, 25 bp, Homo sapien
cttcttccacttctttggcattaca

SEQ ID NO: 438351 - DNA, 25 bp, Homo sapien
tgaataattgaatcactgcttgcta

SEQ ID NO: 438352 - DNA, 25 bp, Homo sapien
ctgcttgctaagtgaccacgtgttt

SEQ ID NO: 438353 - DNA, 25 bp, Homo sapien
ctctctggcagccactgaactgctt

SEQ ID NO: 438354 - DNA, 25 bp, Homo sapien
tttctgtccctgcagattcgtttgc

SEQ ID NO: 438355 - DNA, 25 bp, Homo sapien
ctgtccctgcagattcgtttgcatt

SEQ ID NO: 438356 - DNA, 25 bp, Homo sapien
ggaatcatagagtacgtgctcttct

SEQ ID NO: 438357 - DNA, 25 bp, Homo sapien
tagagtacgtgctcttcttttgtct

SEQ ID NO: 438358 - DNA, 25 bp, Homo sapien
agtacgtgctcttcttttgtctgtc

SEQ ID NO: 438359 - DNA, 25 bp, Homo sapien
tgctcttcttttgtctgtcttcttt

SEQ ID NO: 438360 - DNA, 25 bp, Homo sapien
gtgtcttgtgtgtgtcaattctttt

SEQ ID NO: 438361 - DNA, 25 bp, Homo sapien
gtttaatccattcacctgtcgatgg

SEQ ID NO: 438362 - DNA, 25 bp, Homo sapien
ttaatccattcacctgtcgatggac

SEQ ID NO: 438363 - DNA, 25 bp, Homo sapien
atggacatttggatcacttccaata

SEQ ID NO: 438364 - DNA, 25 bp, Homo sapien
attttggtaccccaggctatgggag

SEQ ID NO: 438365 - DNA, 25 bp, Homo sapien
ccaggctatgggagccctcacttca

SEQ ID NO: 438366 - DNA, 25 bp, Homo sapien
gctatgggagccctcacttcactgc

SEQ ID NO: 438367 - DNA, 25 bp, Homo sapien
acttcactgcactgtactcctcagt

SEQ ID NO: 438368 - DNA, 25 bp, Homo sapien
agtctccgtcatcactctgggctct

SEQ ID NO: 438369 - DNA, 25 bp, Homo sapien
tgggctctcccatgcattcaaactg

SEQ ID NO: 438370 - DNA, 25 bp, Homo sapien
atgcattcaaactgaggtgcctgcc

SEQ ID NO: 438371 - DNA, 25 bp, Homo sapien
attcaaactgaggtgcctgcccttc

SEQ ID NO: 438372 - DNA, 25 bp, Homo sapien
actgaggtgcctgcccttctaggaa

SEQ ID NO: 438373 - DNA, 25 bp, Homo sapien
taagttcttcattcactaaggaagg

SEQ ID NO: 438374 - DNA, 25 bp, Homo sapien
gttcttcattcactaaggaaggaat

SEQ ID NO: 438375 - DNA, 25 bp, Homo sapien
aggacttcccatcccagaagataaa

SEQ ID NO: 438376 - DNA, 25 bp, Homo sapien
ttcccatcccagaagataaaggtga

SEQ ID NO: 438377 - DNA, 25 bp, Homo sapien
gcagccacaggccagtattccagag

SEQ ID NO: 438378 - DNA, 25 bp, Homo sapien
aggccagtattccagagcagctttg

SEQ ID NO: 438379 - DNA, 25 bp, Homo sapien
agcagctttgggttcctgtcaagac

SEQ ID NO: 438380 - DNA, 25 bp, Homo sapien
gttcctgtcaagacctgctttgaga

SEQ ID NO: 438381 - DNA, 25 bp, Homo sapien
gtcaagacctgctttgagaaggagg

SEQ ID NO: 438382 - DNA, 25 bp, Homo sapien
gctgctggcagcacagcaatgaggc

SEQ ID NO: 438383 - DNA, 25 bp, Homo sapien
caatgaggcaacattgagaactgcg

SEQ ID NO: 438384 - DNA, 25 bp, Homo sapien
ggtagacagcctctaagatgcgccc

SEQ ID NO: 438385 - DNA, 25 bp, Homo sapien
aggcagagagaaagccactcaggac

SEQ ID NO: 438386 - DNA, 25 bp, Homo sapien
gaaccacctggtgaatgctgcacag

SEQ ID NO: 438387 - DNA, 25 bp, Homo sapien
cccttgttgtgacaaccaggttgag

SEQ ID NO: 438388 - DNA, 25 bp, Homo sapien
gaaaactcaaggcaccataccaata

SEQ ID NO: 438389 - DNA, 25 bp, Homo sapien
atgaatgtttggtgtggcaggcctc

SEQ ID NO: 438390 - DNA, 25 bp, Homo sapien
ggcaggcctcctgagaaaagtagct

SEQ ID NO: 438391 - DNA, 25 bp, Homo sapien
tagctgatttttctgacatggatta

SEQ ID NO: 438392 - DNA, 25 bp, Homo sapien
gattagatacttactcaaccgtccc

SEQ ID NO: 438393 - DNA, 25 bp, Homo sapien
tcaaccgtcccagaaacatctgagt

SEQ ID NO: 438394 - DNA, 25 bp, Homo sapien
ggaagctttctgctcattactgaag

SEQ ID NO: 438395 - DNA, 25 bp, Homo sapien
ttctgctcattactgaagtcaggca

SEQ ID NO: 438396 - DNA, 25 bp, Homo sapien
cccacattttctgctggctgtggaa

SEQ ID NO: 438397 - DNA, 25 bp, Homo sapien
taagttcttcattcactaaggaagg

SEQ ID NO: 438398 - DNA, 25 bp, Homo sapien
aagttcttcattcactaaggaagga

SEQ ID NO: 438399 - DNA, 25 bp, Homo sapien
agttcttcattcactaaggaaggaa

SEQ ID NO: 438400 - DNA, 25 bp, Homo sapien
gttcttcattcactaaggaaggaat

SEQ ID NO: 438401 - DNA, 25 bp, Homo sapien
ttcttcattcactaaggaaggaatt

SEQ ID NO: 438402 - DNA, 25 bp, Homo sapien
tcttcattcactaaggaaggaattg

SEQ ID NO: 438403 - DNA, 25 bp, Homo sapien
cttcattcactaaggaaggaattgg

SEQ ID NO: 438404 - DNA, 25 bp, Homo sapien
ttcattcactaaggaaggaattggg

SEQ ID NO: 438405 - DNA, 25 bp, Homo sapien
ctcggagtgagctgacggtgtctca

SEQ ID NO: 438406 - DNA, 25 bp, Homo sapien
gagctgacggtgtctcagcgagaaa

SEQ ID NO: 438407 - DNA, 25 bp, Homo sapien
tgtctcagcgagaaaagtcgggagc

SEQ ID NO: 438408 - DNA, 25 bp, Homo sapien
tcgggagcggcagcagactgctttt

SEQ ID NO: 438409 - DNA, 25 bp, Homo sapien
cagcagactgcttttttggagggca

SEQ ID NO: 438410 - DNA, 25 bp, Homo sapien
agactgcttttttggagggcaagag

SEQ ID NO: 438411 - DNA, 25 bp, Homo sapien
ggtaacataagagcccgaataaggg

SEQ ID NO: 438412 - DNA, 25 bp, Homo sapien
tcccctagccacagaaagcgctggg

SEQ ID NO: 438413 - DNA, 25 bp, Homo sapien
tagccacagaaagcgctgggcggaa

SEQ ID NO: 438414 - DNA, 25 bp, Homo sapien
agcgctgggcggaaatgaaccggcc

SEQ ID NO: 438415 - DNA, 25 bp, Homo sapien
gacaatgaacaggcgggctgctgcc

SEQ ID NO: 438416 - DNA, 25 bp, Homo sapien
aaagaccatgcacatactctccaaa

SEQ ID NO: 438417 - DNA, 25 bp, Homo sapien
atgcacatactctccaaagccaatt

SEQ ID NO: 438418 - DNA, 25 bp, Homo sapien
tcttccagcaaaaatgtctcatgtg

SEQ ID NO: 438419 - DNA, 25 bp, Homo sapien
catgtgtttcttagagttaatgctc

SEQ ID NO: 438420 - DNA, 25 bp, Homo sapien
cccttttctatcagttttctatctt

SEQ ID NO: 438421 - DNA, 25 bp, Homo sapien
gttttctatcttcttgttgttctac

SEQ ID NO: 438422 - DNA, 25 bp, Homo sapien
gttgttctacactgcaccattatag

SEQ ID NO: 438423 - DNA, 25 bp, Homo sapien
attataggtgcaaccatacactggg

SEQ ID NO: 438424 - DNA, 25 bp, Homo sapien
gggacgtataataacaaacagcctc

SEQ ID NO: 438425 - DNA, 25 bp, Homo sapien
acaaacagcctcactgacaaacata

SEQ ID NO: 438426 - DNA, 25 bp, Homo sapien
catatattcgacttatcctacagat

SEQ ID NO: 438427 - DNA, 25 bp, Homo sapien
tagtgttcagtctttgtgggcatgt

SEQ ID NO: 438428 - DNA, 25 bp, Homo sapien
gttcagtctttgtgggcatgttttt

SEQ ID NO: 438429 - DNA, 25 bp, Homo sapien
aaacagacctatctcaacccagtag

SEQ ID NO: 438430 - DNA, 25 bp, Homo sapien
gacctatctcaacccagtagcttag

SEQ ID NO: 438431 - DNA, 25 bp, Homo sapien
cttactgatgtgtgttaaattgttc

SEQ ID NO: 438432 - DNA, 25 bp, Homo sapien
atctcaacccagtagcttagcagtc

SEQ ID NO: 438433 - DNA, 25 bp, Homo sapien
aacccagtagcttagcagtcaggat

SEQ ID NO: 438434 - DNA, 25 bp, Homo sapien
cagtagcttagcagtcaggataatt

SEQ ID NO: 438435 - DNA, 25 bp, Homo sapien
agcttagcagtcaggataattattt

SEQ ID NO: 438436 - DNA, 25 bp, Homo sapien
ttattttgatgtggcatattgttgt

SEQ ID NO: 438437 - DNA, 25 bp, Homo sapien
attgttgttgttagtagactgaaaa

SEQ ID NO: 438438 - DNA, 25 bp, Homo sapien
caaagtaccccaaatttggtgacat

SEQ ID NO: 438439 - DNA, 25 bp, Homo sapien
aaacgagaaatttattctgcacagt

SEQ ID NO: 438440 - DNA, 25 bp, Homo sapien
tattctgcacagttcaggaggccag

SEQ ID NO: 438441 - DNA, 25 bp, Homo sapien
ttttctcttcctaccgctccagttt

SEQ ID NO: 438442 - DNA, 25 bp, Homo sapien
tgtggtcacactgccttttcttctc

SEQ ID NO: 438443 - DNA, 25 bp, Homo sapien
ttctctgtctctcctttgtacatct

SEQ ID NO: 438444 - DNA, 25 bp, Homo sapien
gtctctcctttgtacatctttcatt

SEQ ID NO: 438445 - DNA, 25 bp, Homo sapien
atctttcattatgaggacactgtca

SEQ ID NO: 438446 - DNA, 25 bp, Homo sapien
gacactgtcattggatttagagccc

SEQ ID NO: 438447 - DNA, 25 bp, Homo sapien
tagagcccacctggatagaccagat

SEQ ID NO: 438448 - DNA, 25 bp, Homo sapien
ggatagaccagatgatttaatctta

SEQ ID NO: 438449 - DNA, 25 bp, Homo sapien
agcctcaatagctacgaaccctaga

SEQ ID NO: 438450 - DNA, 25 bp, Homo sapien
gcagctagctggagctcatgtgcaa

SEQ ID NO: 438451 - DNA, 25 bp, Homo sapien
tcatgtgcaactcctgattctcagg

SEQ ID NO: 438452 - DNA, 25 bp, Homo sapien
taacccaaaattatgagtgagctgt

SEQ ID NO: 438453 - DNA, 25 bp, Homo sapien
tgttaactctaaaatgtacttggga

SEQ ID NO: 438454 - DNA, 25 bp, Homo sapien
caagcgagaggtcatgggccaacta

SEQ ID NO: 438455 - DNA, 25 bp, Homo sapien
gaggtcatgggccaactaagtgtta

SEQ ID NO: 438456 - DNA, 25 bp, Homo sapien
ccaactaagtgttatccagtagaaa

SEQ ID NO: 438457 - DNA, 25 bp, Homo sapien
aaaagacagtacactgcttttcttt

SEQ ID NO: 438458 - DNA, 25 bp, Homo sapien
tttcctttgctatatgttttgctat

SEQ ID NO: 438459 - DNA, 25 bp, Homo sapien
tgttttgctatttccttgtggctta

SEQ ID NO: 438460 - DNA, 25 bp, Homo sapien
atagccagtcagaattagcttagat

SEQ ID NO: 438461 - DNA, 25 bp, Homo sapien
tagccagtcagaattagcttagatt

SEQ ID NO: 438462 - DNA, 25 bp, Homo sapien
agccagtcagaattagcttagattg

SEQ ID NO: 438463 - DNA, 25 bp, Homo sapien
gccagtcagaattagcttagattgt

SEQ ID NO: 438464 - DNA, 25 bp, Homo sapien
ccagtcagaattagcttagattgtg

SEQ ID NO: 438465 - DNA, 25 bp, Homo sapien
cagtcagaattagcttagattgtgc

SEQ ID NO: 438466 - DNA, 25 bp, Homo sapien
agtcagaattagcttagattgtgcg

SEQ ID NO: 438467 - DNA, 25 bp, Homo sapien
tctcgccattgcaccatccatgaga

SEQ ID NO: 438468 - DNA, 25 bp, Homo sapien
gccattgcaccatccatgagacgca

SEQ ID NO: 438469 - DNA, 25 bp, Homo sapien
ttgcaccatccatgagacgcactct

SEQ ID NO: 438470 - DNA, 25 bp, Homo sapien
attcactggccctcggttaacaacg

SEQ ID NO: 438471 - DNA, 25 bp, Homo sapien
ttgtaaaatgttggcgtaaattagc

SEQ ID NO: 438472 - DNA, 25 bp, Homo sapien
taaaatgttggcgtaaattagccag

SEQ ID NO: 438473 - DNA, 25 bp, Homo sapien
aaatgttggcgtaaattagccaggt

SEQ ID NO: 438474 - DNA, 25 bp, Homo sapien
aatgttggcgtaaattagccaggtg

SEQ ID NO: 438475 - DNA, 25 bp, Homo sapien
gcacacaccttgcagtcccaagtta

SEQ ID NO: 438476 - DNA, 25 bp, Homo sapien
acacaccttgcagtcccaagttact

SEQ ID NO: 438477 - DNA, 25 bp, Homo sapien
agtcccaagttactccggagagctg

SEQ ID NO: 438478 - DNA, 25 bp, Homo sapien
gtcccaagttactccggagagctga

SEQ ID NO: 438479 - DNA, 25 bp, Homo sapien
tcccaagttactccggagagctgag

SEQ ID NO: 438480 - DNA, 25 bp, Homo sapien
caagttactccggagagctgagcca

SEQ ID NO: 438481 - DNA, 25 bp, Homo sapien
aagttactccggagagctgagccag

SEQ ID NO: 438482 - DNA, 25 bp, Homo sapien
gtgcacatcaaccaggccacgaatg

SEQ ID NO: 438483 - DNA, 25 bp, Homo sapien
catcaaccaggccacgaatggcggg

SEQ ID NO: 438484 - DNA, 25 bp, Homo sapien
atccgaaagcagtccaagcggcgct

SEQ ID NO: 438485 - DNA, 25 bp, Homo sapien
gaaagcagtccaagcggcgctccaa

SEQ ID NO: 438486 - DNA, 25 bp, Homo sapien
cgctccaacatcttcacgatatgtg

SEQ ID NO: 438487 - DNA, 25 bp, Homo sapien
acgatatgtgccactgtttccaact

SEQ ID NO: 438488 - DNA, 25 bp, Homo sapien
tatgtgccactgtttccaacttttc

SEQ ID NO: 438489 - DNA, 25 bp, Homo sapien
tttccaacttttcatcaacaaaaag

SEQ ID NO: 438490 - DNA, 25 bp, Homo sapien
tttccaactccttccaaattagaag

SEQ ID NO: 438491 - DNA, 25 bp, Homo sapien
aactccttccaaattagaagaccag

SEQ ID NO: 438492 - DNA, 25 bp, Homo sapien
aagaccagttggtgacacacagcac

SEQ ID NO: 438493 - DNA, 25 bp, Homo sapien
ctcacactctagcaacacatatggg

SEQ ID NO: 438494 - DNA, 25 bp, Homo sapien
ctagcaacacatatggggtttccat

SEQ ID NO: 438495 - DNA, 25 bp, Homo sapien
gggtttccatcaaagctctcctatc

SEQ ID NO: 438496 - DNA, 25 bp, Homo sapien
ggtttccatcaaagctctcctatca

SEQ ID NO: 438497 - DNA, 25 bp, Homo sapien
gtttccatcaaagctctcctatcag

SEQ ID NO: 438498 - DNA, 25 bp, Homo sapien
ttccatcaaagctctcctatcagct

SEQ ID NO: 438499 - DNA, 25 bp, Homo sapien
catcaaagctctcctatcagctggg

SEQ ID NO: 438500 - DNA, 25 bp, Homo sapien
atcaaagctctcctatcagctgggc

SEQ ID NO: 438501 - DNA, 25 bp, Homo sapien
tcaaagctctcctatcagctgggcg

SEQ ID NO: 438502 - DNA, 25 bp, Homo sapien
aaagctctcctatcagctgggcgtg

SEQ ID NO: 438503 - DNA, 25 bp, Homo sapien
acaagtacagaaattaggcaggcat

SEQ ID NO: 438504 - DNA, 25 bp, Homo sapien
aaatttttatcatgaccaagtagta

SEQ ID NO: 438505 - DNA, 25 bp, Homo sapien
tatcatgaccaagtagtaattttct

SEQ ID NO: 438506 - DNA, 25 bp, Homo sapien
catgaccaagtagtaattttctaaa

SEQ ID NO: 438507 - DNA, 25 bp, Homo sapien
taagcaaagtattatgtcatcctca

SEQ ID NO: 438508 - DNA, 25 bp, Homo sapien
gcaaagtattatgtcatcctcaaat

SEQ ID NO: 438509 - DNA, 25 bp, Homo sapien
gtattatgtcatcctcaaataaatt

SEQ ID NO: 438510 - DNA, 25 bp, Homo sapien
tgtcatcctcaaataaattagtatc

SEQ ID NO: 438511 - DNA, 25 bp, Homo sapien
attagtatctacaacatgatcaaag

SEQ ID NO: 438512 - DNA, 25 bp, Homo sapien
caacatgatcaaagaaattgtgact

SEQ ID NO: 438513 - DNA, 25 bp, Homo sapien
gaaattgtgactatacaggatattt

SEQ ID NO: 438514 - DNA, 25 bp, Homo sapien
tacaggatatttgcataaaagacca

SEQ ID NO: 438515 - DNA, 25 bp, Homo sapien
aggaacttaaaactccctgtgctca

SEQ ID NO: 438516 - DNA, 25 bp, Homo sapien
gaacttaaaactccctgtgctcaga

SEQ ID NO: 438517 - DNA, 25 bp, Homo sapien
cttaaaactccctgtgctcagacag

SEQ ID NO: 438518 - DNA, 25 bp, Homo sapien
tgtgctcagacagaaatgagactgt

SEQ ID NO: 438519 - DNA, 25 bp, Homo sapien
atgagactgttacagcctgcttctg

SEQ ID NO: 438520 - DNA, 25 bp, Homo sapien
gagactgttacagcctgcttctgtg

SEQ ID NO: 438521 - DNA, 25 bp, Homo sapien
tgttacagcctgcttctgtgctgtt

SEQ ID NO: 438522 - DNA, 25 bp, Homo sapien
atggatagggcttgagtgcccccag

SEQ ID NO: 438523 - DNA, 25 bp, Homo sapien
atgcctttaagatacagcctttccc

SEQ ID NO: 438524 - DNA, 25 bp, Homo sapien
ttaagatacagcctttcccatccta

SEQ ID NO: 438525 - DNA, 25 bp, Homo sapien
agcctttcccatcctaatctacaaa

SEQ ID NO: 438526 - DNA, 25 bp, Homo sapien
ttgtaaaatgttggcgtaaattagc

SEQ ID NO: 438527 - DNA, 25 bp, Homo sapien
aaatgttggcgtaaattagccaggt

SEQ ID NO: 438528 - DNA, 25 bp, Homo sapien
aatgttggcgtaaattagccaggtg

SEQ ID NO: 438529 - DNA, 25 bp, Homo sapien
gcacacaccttgcagtcccaagtta

SEQ ID NO: 438530 - DNA, 25 bp, Homo sapien
agtcccaagttactccggagagctg

SEQ ID NO: 438531 - DNA, 25 bp, Homo sapien
gtcccaagttactccggagagctga

SEQ ID NO: 438532 - DNA, 25 bp, Homo sapien
tcccaagttactccggagagctgag

SEQ ID NO: 438533 - DNA, 25 bp, Homo sapien
caagttactccggagagctgagcca

SEQ ID NO: 438534 - DNA, 25 bp, Homo sapien
aagttactccggagagctgagccag

SEQ ID NO: 438535 - DNA, 25 bp, Homo sapien
agttactccggagagctgagccagg

SEQ ID NO: 438536 - DNA, 25 bp, Homo sapien
gtttgccatgaagccgagattgtac

SEQ ID NO: 438537 - DNA, 25 bp, Homo sapien
tgacaagtgtgagccatagcaccca

SEQ ID NO: 438538 - DNA, 25 bp, Homo sapien
atagcacccaccctttatcatgtaa

SEQ ID NO: 438539 - DNA, 25 bp, Homo sapien
gcacccaccctttatcatgtaatta

SEQ ID NO: 438540 - DNA, 25 bp, Homo sapien
tattttgttacttccctcttgttca

SEQ ID NO: 438541 - DNA, 25 bp, Homo sapien
ctcttgttcactctctctacatata

SEQ ID NO: 438542 - DNA, 25 bp, Homo sapien
gttcactctctctacatatatctgg

SEQ ID NO: 438543 - DNA, 25 bp, Homo sapien
actctctctacatatatctggttgt

SEQ ID NO: 438544 - DNA, 25 bp, Homo sapien
atctggttgtatgtcttaagtctta

SEQ ID NO: 438545 - DNA, 25 bp, Homo sapien
gtcttaagtcttatactactagaaa

SEQ ID NO: 438546 - DNA, 25 bp, Homo sapien
aggagttaggttgatcagtatatac

SEQ ID NO: 438547 - DNA, 25 bp, Homo sapien
ataagttttggtgttctgttgtgta

SEQ ID NO: 438548 - DNA, 25 bp, Homo sapien
gggatgactgatgattctcaatcgt

SEQ ID NO: 438549 - DNA, 25 bp, Homo sapien
gattctcaatcgtgaagctgtgttt

SEQ ID NO: 438550 - DNA, 25 bp, Homo sapien
cgtgaagctgtgtttggtaccgaaa

SEQ ID NO: 438551 - DNA, 25 bp, Homo sapien
gtgtttggtaccgaaatgctcctaa

SEQ ID NO: 438552 - DNA, 25 bp, Homo sapien
ttggtaccgaaatgctcctaaaact

SEQ ID NO: 438553 - DNA, 25 bp, Homo sapien
aaaactcacccgctctgaactactt

SEQ ID NO: 438554 - DNA, 25 bp, Homo sapien
ccgctctgaactactttgggttagg

SEQ ID NO: 438555 - DNA, 25 bp, Homo sapien
ttcaaagggctcattcaggatcatt

SEQ ID NO: 438556 - DNA, 25 bp, Homo sapien
gaagagaggctgtttttccgaatca

SEQ ID NO: 438557 - DNA, 25 bp, Homo sapien
gtttttccgaatcatgatccctagt

SEQ ID NO: 438558 - DNA, 25 bp, Homo sapien
gatccctagtaatgactattggctt

SEQ ID NO: 438559 - DNA, 25 bp, Homo sapien
aaatgagagatatctgctccaaaaa

SEQ ID NO: 438560 - DNA, 25 bp, Homo sapien
aaatgtcagtagttcttgcctcagg

SEQ ID NO: 438561 - DNA, 25 bp, Homo sapien
ttatgaagacgtaagcccaccgtat

SEQ ID NO: 438562 - DNA, 25 bp, Homo sapien
aagcccaccgtattctgtctggaaa

SEQ ID NO: 438563 - DNA, 25 bp, Homo sapien
gggaaccttaactttacatgctcag

SEQ ID NO: 438564 - DNA, 25 bp, Homo sapien
acatgctcaggatatggagtccacc

SEQ ID NO: 438565 - DNA, 25 bp, Homo sapien
gatatggagtccaccagtctaccca

SEQ ID NO: 438566 - DNA, 25 bp, Homo sapien
agtctacccatcagctgcgtcgaaa

SEQ ID NO: 438567 - DNA, 25 bp, Homo sapien
cagctgcgtcgaaagggagtgattt

SEQ ID NO: 438568 - DNA, 25 bp, Homo sapien
aactgtctcttagcttcctgtttca

SEQ ID NO: 438569 - DNA, 25 bp, Homo sapien
tgtttcacgggtcttcttggccaac

SEQ ID NO: 438570 - DNA, 25 bp, Homo sapien
gtaattcttgtaaagcctgtggcta

SEQ ID NO: 438571 - DNA, 25 bp, Homo sapien
ctgtggctatcgaggcatgcttgac

SEQ ID NO: 438572 - DNA, 25 bp, Homo sapien
gaggcatgcttgacacacatcataa

SEQ ID NO: 438573 - DNA, 25 bp, Homo sapien
cacatcataaactctgcacattcat

SEQ ID NO: 438574 - DNA, 25 bp, Homo sapien
gcaaaggcgcttaatcggcctccaa

SEQ ID NO: 438575 - DNA, 25 bp, Homo sapien
ggagcacagacccagtttgatgtta

SEQ ID NO: 438576 - DNA, 25 bp, Homo sapien
acattgtcaatggatctcatgaggc

SEQ ID NO: 438577 - DNA, 25 bp, Homo sapien
atctcatgaggcgaataagctgcaa

SEQ ID NO: 438578 - DNA, 25 bp, Homo sapien
aagctgcaagacatgttggatggat

SEQ ID NO: 438579 - DNA, 25 bp, Homo sapien
aaaaaatttgttctctgtcctgaat

SEQ ID NO: 438580 - DNA, 25 bp, Homo sapien
gaaacagatttgcatgtcaatccaa

SEQ ID NO: 438581 - DNA, 25 bp, Homo sapien
gctgcttgttacaacaaccatcaga

SEQ ID NO: 438582 - DNA, 25 bp, Homo sapien
agagatgagctgtgttttactggcc

SEQ ID NO: 438583 - DNA, 25 bp, Homo sapien
tttactggccactttcattcaggat

SEQ ID NO: 438584 - DNA, 25 bp, Homo sapien
actttcattcaggatttggcacaga

SEQ ID NO: 438585 - DNA, 25 bp, Homo sapien
ttggcacagactccaggtcaagcgg

SEQ ID NO: 438586 - DNA, 25 bp, Homo sapien
gtcaagcggaaaaccagccttacca

SEQ ID NO: 438587 - DNA, 25 bp, Homo sapien
caagactatcttgagctggctaaca

SEQ ID NO: 438588 - DNA, 25 bp, Homo sapien
taacagatttcctcagcaggcctgg

SEQ ID NO: 438589 - DNA, 25 bp, Homo sapien
agcaggcctgggaagaagctcgaca

SEQ ID NO: 438590 - DNA, 25 bp, Homo sapien
gaagctcgacagtttttcttgaaaa

SEQ ID NO: 438591 - DNA, 25 bp, Homo sapien
tctgtatttgagtacccttgttaat

SEQ ID NO: 438592 - DNA, 25 bp, Homo sapien
gcagctattttctagcatttgccag

SEQ ID NO: 438593 - DNA, 25 bp, Homo sapien
ttgtttttctccctgtgccatttac

SEQ ID NO: 438594 - DNA, 25 bp, Homo sapien
tgccttctaccacccttggatgaat

SEQ ID NO: 438595 - DNA, 25 bp, Homo sapien
ctaccacccttggatgaatggattt

SEQ ID NO: 438596 - DNA, 25 bp, Homo sapien
ggattttgtaattctagctgttgta

SEQ ID NO: 438597 - DNA, 25 bp, Homo sapien
aggtaaaggagtgtcccagttgctc

SEQ ID NO: 438598 - DNA, 25 bp, Homo sapien
agtgtcccagttgctcctggtcact

SEQ ID NO: 438599 - DNA, 25 bp, Homo sapien
tggtcactccctttatagccattac

SEQ ID NO: 438600 - DNA, 25 bp, Homo sapien
tttatagccattactgtcttgtttc

SEQ ID NO: 438601 - DNA, 25 bp, Homo sapien
gtcttgtttcttgtaactcaggtta

SEQ ID NO: 438602 - DNA, 25 bp, Homo sapien
taactcaggttaggttttggtctct

SEQ ID NO: 438603 - DNA, 25 bp, Homo sapien
gtctttaggagagtagaaaacacaa

SEQ ID NO: 438604 - DNA, 25 bp, Homo sapien
attaactaaaaagcagggacatctg

SEQ ID NO: 438605 - DNA, 25 bp, Homo sapien
cagggacatctgaaagagacgtatt

SEQ ID NO: 438606 - DNA, 25 bp, Homo sapien
gtatcaggtaaaggacaagttgtaa

SEQ ID NO: 438607 - DNA, 25 bp, Homo sapien
aagcttggatttttaggtctagcaa

SEQ ID NO: 438608 - DNA, 25 bp, Homo sapien
ttaggtctagcaatacactgtttac

SEQ ID NO: 438609 - DNA, 25 bp, Homo sapien
cactgtttacaagagcatcacctaa

SEQ ID NO: 438610 - DNA, 25 bp, Homo sapien
agagcatcacctaaaatgtgacaaa

SEQ ID NO: 438611 - DNA, 25 bp, Homo sapien
ggtatagtagacatacactaaccaa

SEQ ID NO: 438612 - DNA, 25 bp, Homo sapien
aaaaatgtagctctttgaatctcag

SEQ ID NO: 438613 - DNA, 25 bp, Homo sapien
gtagctctttgaatctcagaaaaaa

SEQ ID NO: 438614 - DNA, 25 bp, Homo sapien
tttagacacatccaagcggttgccg

SEQ ID NO: 438615 - DNA, 25 bp, Homo sapien
ttgccgacggccctcacgatgaaaa

SEQ ID NO: 438616 - DNA, 25 bp, Homo sapien
atgaaaactgctgtccgttggtgaa

SEQ ID NO: 438617 - DNA, 25 bp, Homo sapien
ttcctgaggcggacctacctgtgga

SEQ ID NO: 438618 - DNA, 25 bp, Homo sapien
ggacctacctgtggaggcataccag

SEQ ID NO: 438619 - DNA, 25 bp, Homo sapien
ggaggcataccaggaaccagacgat

SEQ ID NO: 438620 - DNA, 25 bp, Homo sapien
gttgggtctttgaggagagctacta

SEQ ID NO: 438621 - DNA, 25 bp, Homo sapien
gagctactaacttgggttcctggta

SEQ ID NO: 438622 - DNA, 25 bp, Homo sapien
tggtacaccctctacatgcagtggt

SEQ ID NO: 438623 - DNA, 25 bp, Homo sapien
catgcagtggtgaagcttatctaac

SEQ ID NO: 438624 - DNA, 25 bp, Homo sapien
gaagcttatctaacagtcattcata

SEQ ID NO: 438625 - DNA, 25 bp, Homo sapien
ttttctcttacattaattctcttca

SEQ ID NO: 438626 - DNA, 25 bp, Homo sapien
tttctcttacattaattctcttcac

SEQ ID NO: 438627 - DNA, 25 bp, Homo sapien
tctcttacattaattctcttcactg

SEQ ID NO: 438628 - DNA, 25 bp, Homo sapien
ctcttacattaattctcttcactga

SEQ ID NO: 438629 - DNA, 25 bp, Homo sapien
tcttacattaattctcttcactgaa

SEQ ID NO: 438630 - DNA, 25 bp, Homo sapien
cttacattaattctcttcactgaaa

SEQ ID NO: 438631 - DNA, 25 bp, Homo sapien
ttacattaattctcttcactgaaat

SEQ ID NO: 438632 - DNA, 25 bp, Homo sapien
tacattaattctcttcactgaaatg

SEQ ID NO: 438633 - DNA, 25 bp, Homo sapien
acattaattctcttcactgaaatga

SEQ ID NO: 438634 - DNA, 25 bp, Homo sapien
attaattctcttcactgaaatgagg

SEQ ID NO: 438635 - DNA, 25 bp, Homo sapien
cactgaaatgaggacaaaagagtat

SEQ ID NO: 438636 - DNA, 25 bp, Homo sapien
agctccagggccgagtggcacagct

SEQ ID NO: 438637 - DNA, 25 bp, Homo sapien
gcccgcctggcagagcaattgcgag

SEQ ID NO: 438638 - DNA, 25 bp, Homo sapien
gcctggcagagcaattgcgagcaga

SEQ ID NO: 438639 - DNA, 25 bp, Homo sapien
attgcgagcagaggcagaactgtgt

SEQ ID NO: 438640 - DNA, 25 bp, Homo sapien
cagcccgcaagcaggagctggagct

SEQ ID NO: 438641 - DNA, 25 bp, Homo sapien
cagagctggaggctcgcgtgggcga

SEQ ID NO: 438642 - DNA, 25 bp, Homo sapien
aggagtgcagccgtcaaatgcaaac

SEQ ID NO: 438643 - DNA, 25 bp, Homo sapien
cagccgtcaaatgcaaaccgagaag

SEQ ID NO: 438644 - DNA, 25 bp, Homo sapien
aaaccgagaagaagaggctacagca

SEQ ID NO: 438645 - DNA, 25 bp, Homo sapien
ggctacagcagcacatacaggagct

SEQ ID NO: 438646 - DNA, 25 bp, Homo sapien
acaggagctagaggcccaccttgag

SEQ ID NO: 438647 - DNA, 25 bp, Homo sapien
acagagcaacagtccccatgagaga

SEQ ID NO: 438648 - DNA, 25 bp, Homo sapien
agtccccatgagagagccgtggaga

SEQ ID NO: 438649 - DNA, 25 bp, Homo sapien
cccttcctcttgtgacaaaccaagg

SEQ ID NO: 438650 - DNA, 25 bp, Homo sapien
tgtgacaaaccaagggtccctggcg

SEQ ID NO: 438651 - DNA, 25 bp, Homo sapien
aggctcctgcagcttctcgaggtga

SEQ ID NO: 438652 - DNA, 25 bp, Homo sapien
tgcagcttctcgaggtgactgagac

SEQ ID NO: 438653 - DNA, 25 bp, Homo sapien
tgactgagaccgatgggcggcggct

SEQ ID NO: 438654 - DNA, 25 bp, Homo sapien
caggttcggcggttcctcggccact

SEQ ID NO: 438655 - DNA, 25 bp, Homo sapien
ccactctgctcttaaataaggtgat

SEQ ID NO: 438656 - DNA, 25 bp, Homo sapien
acgtcccggatgacgtcggtcaggc

SEQ ID NO: 438657 - DNA, 25 bp, Homo sapien
atgacgtcggtcaggccctcgtgga

SEQ ID NO: 438658 - DNA, 25 bp, Homo sapien
cacactccgtgactgtacttaagag

SEQ ID NO: 438659 - DNA, 25 bp, Homo sapien
acactccgtgactgtacttaagaga

SEQ ID NO: 438660 - DNA, 25 bp, Homo sapien
actccgtgactgtacttaagagaac

SEQ ID NO: 438661 - DNA, 25 bp, Homo sapien
gtgactgtacttaagagaacacatt

SEQ ID NO: 438662 - DNA, 25 bp, Homo sapien
gtacttaagagaacacattctggct

SEQ ID NO: 438663 - DNA, 25 bp, Homo sapien
aagagaacacattctggctgggcac

SEQ ID NO: 438664 - DNA, 25 bp, Homo sapien
ctgatgcaggtggattgactgagct

SEQ ID NO: 438665 - DNA, 25 bp, Homo sapien
ggcatggctgtttgtccctgcagtc

SEQ ID NO: 438666 - DNA, 25 bp, Homo sapien
atggctgtttgtccctgcagtccca

SEQ ID NO: 438667 - DNA, 25 bp, Homo sapien
gctgtttgtccctgcagtcccagct

SEQ ID NO: 438668 - DNA, 25 bp, Homo sapien
ctgagtaggagaactgcctgaaccc

SEQ ID NO: 438669 - DNA, 25 bp, Homo sapien
gtttttcaggggtcacttcacattt

SEQ ID NO: 438670 - DNA, 25 bp, Homo sapien
ttttcaggggtcacttcacatttct

SEQ ID NO: 438671 - DNA, 25 bp, Homo sapien
ttcaggggtcacttcacatttctaa

SEQ ID NO: 438672 - DNA, 25 bp, Homo sapien
tcaggggtcacttcacatttctaaa

SEQ ID NO: 438673 - DNA, 25 bp, Homo sapien
aggggtcacttcacatttctaaaga

SEQ ID NO: 438674 - DNA, 25 bp, Homo sapien
ggggtcacttcacatttctaaagaa

SEQ ID NO: 438675 - DNA, 25 bp, Homo sapien
tcacttcacatttctaaagaaagag

SEQ ID NO: 438676 - DNA, 25 bp, Homo sapien
aaagaaagagtgaataggctgggca

SEQ ID NO: 438677 - DNA, 25 bp, Homo sapien
ctcaagcctctaatctcaacgcttt

SEQ ID NO: 438678 - DNA, 25 bp, Homo sapien
aagcctctaatctcaacgctttggg

SEQ ID NO: 438679 - DNA, 25 bp, Homo sapien
cagctactcgaaaggctaagactgg

SEQ ID NO: 438680 - DNA, 25 bp, Homo sapien
cattcctgcatgttcgaaagcgtaa

SEQ ID NO: 438681 - DNA, 25 bp, Homo sapien
attcctgcatgttcgaaagcgtaaa

SEQ ID NO: 438682 - DNA, 25 bp, Homo sapien
ttcctgcatgttcgaaagcgtaaat

SEQ ID NO: 438683 - DNA, 25 bp, Homo sapien
tcctgcatgttcgaaagcgtaaatt

SEQ ID NO: 438684 - DNA, 25 bp, Homo sapien
cctgcatgttcgaaagcgtaaattg

SEQ ID NO: 438685 - DNA, 25 bp, Homo sapien
gcatgttcgaaagcgtaaattgcaa

SEQ ID NO: 438686 - DNA, 25 bp, Homo sapien
tgttcgaaagcgtaaattgcaaagc

SEQ ID NO: 438687 - DNA, 25 bp, Homo sapien
tcgaaagcgtaaattgcaaagcaca

SEQ ID NO: 438688 - DNA, 25 bp, Homo sapien
atccagttgtagattgtggccggga

SEQ ID NO: 438689 - DNA, 25 bp, Homo sapien
cagttgtagattgtggccgggagca

SEQ ID NO: 438690 - DNA, 25 bp, Homo sapien
gttgtagattgtggccgggagcagt

SEQ ID NO: 438691 - DNA, 25 bp, Homo sapien
tgggaaattctttcgtcgtggttca

SEQ ID NO: 438692 - DNA, 25 bp, Homo sapien
gaaattctttcgtcgtggttcaaat

SEQ ID NO: 438693 - DNA, 25 bp, Homo sapien
aattctttcgtcgtggttcaaatct

SEQ ID NO: 438694 - DNA, 25 bp, Homo sapien
aatcttaatcaacatcgaagtattc

SEQ ID NO: 438695 - DNA, 25 bp, Homo sapien
gaaagcctttcgacttcatatgcac

SEQ ID NO: 438696 - DNA, 25 bp, Homo sapien
aagcctttcgacttcatatgcacct

SEQ ID NO: 438697 - DNA, 25 bp, Homo sapien
gcctttcgacttcatatgcacctta

SEQ ID NO: 438698 - DNA, 25 bp, Homo sapien
ctttcgacttcatatgcaccttatt

SEQ ID NO: 438699 - DNA, 25 bp, Homo sapien
gacttcatatgcaccttattcgaca

SEQ ID NO: 438700 - DNA, 25 bp, Homo sapien
cttcatatgcaccttattcgacatc

SEQ ID NO: 438701 - DNA, 25 bp, Homo sapien
ggaaagcctttcgacttcatatgca

SEQ ID NO: 438702 - DNA, 25 bp, Homo sapien
atcaagatggcctgacccagagtca

SEQ ID NO: 438703 - DNA, 25 bp, Homo sapien
gagtcacctaagagaactcttccaa

SEQ ID NO: 438704 - DNA, 25 bp, Homo sapien
ttccaacttaaatgactagggtgtg

SEQ ID NO: 438705 - DNA, 25 bp, Homo sapien
actagggtgtgtaatcagttgcttc

SEQ ID NO: 438706 - DNA, 25 bp, Homo sapien
cagttgcttcttattctgtgtctca

SEQ ID NO: 438707 - DNA, 25 bp, Homo sapien
gtgtctcagatttcctagtccatga

SEQ ID NO: 438708 - DNA, 25 bp, Homo sapien
tagtatttggcccttggaaacaaag

SEQ ID NO: 438709 - DNA, 25 bp, Homo sapien
aaagttaaataccatgtcactcaga

SEQ ID NO: 438710 - DNA, 25 bp, Homo sapien
gtcactcagaagactctcaaagttt

SEQ ID NO: 438711 - DNA, 25 bp, Homo sapien
atccattcacatcattcttgagttg

SEQ ID NO: 438712 - DNA, 25 bp, Homo sapien
gagttgtgcaaatacacttggcttt

SEQ ID NO: 438713 - DNA, 25 bp, Homo sapien
ctgcggacggaggtgaggttggagc

SEQ ID NO: 438714 - DNA, 25 bp, Homo sapien
gaggttggagcgagcgctggcggaa

SEQ ID NO: 438715 - DNA, 25 bp, Homo sapien
ctggcggaagagaggctcagcgcag

SEQ ID NO: 438716 - DNA, 25 bp, Homo sapien
cagagccggcgctggccaatatgcg

SEQ ID NO: 438717 - DNA, 25 bp, Homo sapien
cgctggccaatatgcgccgcatgtg

SEQ ID NO: 438718 - DNA, 25 bp, Homo sapien
atatgcgccgcatgtgatacctttg

SEQ ID NO: 438719 - DNA, 25 bp, Homo sapien
atgcgccgcatgtgatacctttgag

SEQ ID NO: 438720 - DNA, 25 bp, Homo sapien
gcgccgcatgtgatacctttgaggg

SEQ ID NO: 438721 - DNA, 25 bp, Homo sapien
catgtgatacctttgagggcgcggc

SEQ ID NO: 438722 - DNA, 25 bp, Homo sapien
gatgggcgccctttggctgcgggag

SEQ ID NO: 438723 - DNA, 25 bp, Homo sapien
gctgcgggagcgagtggaggatgct

SEQ ID NO: 438724 - DNA, 25 bp, Homo sapien
aacttgaattcatgtccgtctggca

SEQ ID NO: 438725 - DNA, 25 bp, Homo sapien
aattcatgtccgtctggcagcttga

SEQ ID NO: 438726 - DNA, 25 bp, Homo sapien
tgtccgtctggcagcttgatggtca

SEQ ID NO: 438727 - DNA, 25 bp, Homo sapien
cagcttgatggtcaggtcagcctgg

SEQ ID NO: 438728 - DNA, 25 bp, Homo sapien
gtcagcctggtcaaaggtgatgcac

SEQ ID NO: 438729 - DNA, 25 bp, Homo sapien
ggtgatgcacacctctgtgatgctc

SEQ ID NO: 438730 - DNA, 25 bp, Homo sapien
cctctgtgatgctcccgggctggaa

SEQ ID NO: 438731 - DNA, 25 bp, Homo sapien
tggctggcttcactcaaaggccacg

SEQ ID NO: 438732 - DNA, 25 bp, Homo sapien
aaggccacgcactttaatcttgaag

SEQ ID NO: 438733 - DNA, 25 bp, Homo sapien
tttaatcttgaagtctccatccgcc

SEQ ID NO: 438734 - DNA, 25 bp, Homo sapien
tccatccgccgccatgtagttgatg

SEQ ID NO: 438735 - DNA, 25 bp, Homo sapien
cgacggaccactgccatgatcatgg

SEQ ID NO: 438736 - DNA, 25 bp, Homo sapien
atgtcatgtcatctgtgtagctccc

SEQ ID NO: 438737 - DNA, 25 bp, Homo sapien
gagtttgctacacatgcttggctgc

SEQ ID NO: 438738 - DNA, 25 bp, Homo sapien
gccctggattatccacaggaacttg

SEQ ID NO: 438739 - DNA, 25 bp, Homo sapien
atccacaggaacttgattctagaaa

SEQ ID NO: 438740 - DNA, 25 bp, Homo sapien
aaataccaaagcactgttgtttcac

SEQ ID NO: 438741 - DNA, 25 bp, Homo sapien
tgttgtttcacagcagcccgacgag

SEQ ID NO: 438742 - DNA, 25 bp, Homo sapien
agcccgacgagtaggccctgcatgg

SEQ ID NO: 438743 - DNA, 25 bp, Homo sapien
aggccctgcatggaatgaggctttt

SEQ ID NO: 438744 - DNA, 25 bp, Homo sapien
gaggcttttgctatgtcttcctgca

SEQ ID NO: 438745 - DNA, 25 bp, Homo sapien
ttgctatgtcttcctgcatggtcac

SEQ ID NO: 438746 - DNA, 25 bp, Homo sapien
gtggattaagtttgactacccttat

SEQ ID NO: 438747 - DNA, 25 bp, Homo sapien
tgactacccttatgttagccacatc

SEQ ID NO: 438748 - DNA, 25 bp, Homo sapien
ttatgttagccacatctggatgaga

SEQ ID NO: 438749 - DNA, 25 bp, Homo sapien
gtctctaagttgatttgtacccagt

SEQ ID NO: 438750 - DNA, 25 bp, Homo sapien
tacccagtgggtcaacttctgcaaa

SEQ ID NO: 438751 - DNA, 25 bp, Homo sapien
caaaattccgtaatggtgtattagt

SEQ ID NO: 438752 - DNA, 25 bp, Homo sapien
tgtatacttattatcttgctcagta

SEQ ID NO: 438753 - DNA, 25 bp, Homo sapien
gtattttatctcacttgttctagaa

SEQ ID NO: 438754 - DNA, 25 bp, Homo sapien
ctagaattttctgtaaaccctgcta

SEQ ID NO: 438755 - DNA, 25 bp, Homo sapien
cctgctactgggtttgaagagtttt

SEQ ID NO: 438756 - DNA, 25 bp, Homo sapien
gaagagttttagtcatcctttaaca

SEQ ID NO: 438757 - DNA, 25 bp, Homo sapien
gcccaacgattggaaatggttaagt

SEQ ID NO: 438758 - DNA, 25 bp, Homo sapien
aaattttggtgtattgctagtgcta

SEQ ID NO: 438759 - DNA, 25 bp, Homo sapien
ttggtgtattgctagtgctatcaca

SEQ ID NO: 438760 - DNA, 25 bp, Homo sapien
ggtgtattgctagtgctatcacaga

SEQ ID NO: 438761 - DNA, 25 bp, Homo sapien
gtattgctagtgctatcacagaatg

SEQ ID NO: 438762 - DNA, 25 bp, Homo sapien
ttgctagtgctatcacagaatgtta

SEQ ID NO: 438763 - DNA, 25 bp, Homo sapien
gctagtgctatcacagaatgttata

SEQ ID NO: 438764 - DNA, 25 bp, Homo sapien
attgtgtttactgatacatgtgaaa

SEQ ID NO: 438765 - DNA, 25 bp, Homo sapien
gtgtttactgatacatgtgaaaatt

SEQ ID NO: 438766 - DNA, 25 bp, Homo sapien
gaaaatttaggtctacattgaaaag

SEQ ID NO: 438767 - DNA, 25 bp, Homo sapien
catgtaattcagtttaacattaggg

SEQ ID NO: 438768 - DNA, 25 bp, Homo sapien
aattctttctcattctccatttatc

SEQ ID NO: 438769 - DNA, 25 bp, Homo sapien
atttatctgaaggttcttttgccct

SEQ ID NO: 438770 - DNA, 25 bp, Homo sapien
tcttttgcccttattaacctctcaa

SEQ ID NO: 438771 - DNA, 25 bp, Homo sapien
taacctctcaacttttattgctgta

SEQ ID NO: 438772 - DNA, 25 bp, Homo sapien
agaccagaacatacttccactacat

SEQ ID NO: 438773 - DNA, 25 bp, Homo sapien
agttacttggcatcatttcacctca

SEQ ID NO: 438774 - DNA, 25 bp, Homo sapien
ttcacctcagtttattattgccaaa

SEQ ID NO: 438775 - DNA, 25 bp, Homo sapien
gtgtcagcattttcaactatggtta

SEQ ID NO: 438776 - DNA, 25 bp, Homo sapien
tatggttattcatccaacccttgga

SEQ ID NO: 438777 - DNA, 25 bp, Homo sapien
aacccttggatctctttgagtctac

SEQ ID NO: 438778 - DNA, 25 bp, Homo sapien
gagtctactgataatctccactgga

SEQ ID NO: 438779 - DNA, 25 bp, Homo sapien
tgtgatttctgaaccaagctattcc

SEQ ID NO: 438780 - DNA, 25 bp, Homo sapien
aaccaagctattcctaggcctgagt

SEQ ID NO: 438781 - DNA, 25 bp, Homo sapien
aagctattcctaggcctgagtttta

SEQ ID NO: 438782 - DNA, 25 bp, Homo sapien
gttttattttgttgacacagaaata

SEQ ID NO: 438783 - DNA, 25 bp, Homo sapien
gaaataaattagaaggccaagcgtg

SEQ ID NO: 438784 - DNA, 25 bp, Homo sapien
atctgatgatgaacttaatgtttcc

SEQ ID NO: 438785 - DNA, 25 bp, Homo sapien
tgatgaacttaatgtttccatttgt

SEQ ID NO: 438786 - DNA, 25 bp, Homo sapien
taatggaatactaagtccctctgtg

SEQ ID NO: 438787 - DNA, 25 bp, Homo sapien
ggaatactaagtccctctgtgattt

SEQ ID NO: 438788 - DNA, 25 bp, Homo sapien
atactaagtccctctgtgatttctg

SEQ ID NO: 438789 - DNA, 25 bp, Homo sapien
actaagtccctctgtgatttctgaa

SEQ ID NO: 438790 - DNA, 25 bp, Homo sapien
ggaacttaaaactccctgtgctcag

SEQ ID NO: 438791 - DNA, 25 bp, Homo sapien
cttaaaactccctgtgctcagacag

SEQ ID NO: 438792 - DNA, 25 bp, Homo sapien
tgtgctcagacagaaatgagactgt

SEQ ID NO: 438793 - DNA, 25 bp, Homo sapien
atgagactgttacagcctgcttctg

SEQ ID NO: 438794 - DNA, 25 bp, Homo sapien
tgttacagcctgcttctgtgctgtt

SEQ ID NO: 438795 - DNA, 25 bp, Homo sapien
ccttcttgcctctaacttgtaaaca

SEQ ID NO: 438796 - DNA, 25 bp, Homo sapien
tggaaagtcacaaaccgctgggttt

SEQ ID NO: 438797 - DNA, 25 bp, Homo sapien
atggatagggcttgagtgcccccag

SEQ ID NO: 438798 - DNA, 25 bp, Homo sapien
atgcctttaagatacagcctttccc

SEQ ID NO: 438799 - DNA, 25 bp, Homo sapien
ttaagatacagcctttcccatccta

SEQ ID NO: 438800 - DNA, 25 bp, Homo sapien
agcctttcccatcctaatctacaaa

SEQ ID NO: 438801 - DNA, 25 bp, Homo sapien
ccaagacaaaagtaaggcagtgaat

SEQ ID NO: 438802 - DNA, 25 bp, Homo sapien
gtaaggcagtgaataaagtcaataa

SEQ ID NO: 438803 - DNA, 25 bp, Homo sapien
tcaataaatctctggactaggcgct

SEQ ID NO: 438804 - DNA, 25 bp, Homo sapien
aataaatctctggactaggcgctgt

SEQ ID NO: 438805 - DNA, 25 bp, Homo sapien
ataaatctctggactaggcgctgtg

SEQ ID NO: 438806 - DNA, 25 bp, Homo sapien
taaatctctggactaggcgctgtgg

SEQ ID NO: 438807 - DNA, 25 bp, Homo sapien
aaatctctggactaggcgctgtggc

SEQ ID NO: 438808 - DNA, 25 bp, Homo sapien
aatctctggactaggcgctgtggct

SEQ ID NO: 438809 - DNA, 25 bp, Homo sapien
atctctggactaggcgctgtggctc

SEQ ID NO: 438810 - DNA, 25 bp, Homo sapien
catagcgagacgttgtctctccaaa

SEQ ID NO: 438811 - DNA, 25 bp, Homo sapien
tagcgagacgttgtctctccaaaaa

SEQ ID NO: 438812 - DNA, 25 bp, Homo sapien
gccctggagtggctcgcactcattt

SEQ ID NO: 438813 - DNA, 25 bp, Homo sapien
gtggctcgcactcatttattgggat

SEQ ID NO: 438814 - DNA, 25 bp, Homo sapien
gctcgcactcatttattgggatgat

SEQ ID NO: 438815 - DNA, 25 bp, Homo sapien
tattgggatgatgataagcgctaca

SEQ ID NO: 438816 - DNA, 25 bp, Homo sapien
atgataagcgctacagtccatctcc

SEQ ID NO: 438817 - DNA, 25 bp, Homo sapien
agcgctacagtccatctccgaagag

SEQ ID NO: 438818 - DNA, 25 bp, Homo sapien
tacagtccatctccgaagagcaggc

SEQ ID NO: 438819 - DNA, 25 bp, Homo sapien
agtccatctccgaagagcaggctca

SEQ ID NO: 438820 - DNA, 25 bp, Homo sapien
aagagcaggctcaccatcaccaagg

SEQ ID NO: 438821 - DNA, 25 bp, Homo sapien
caaaaaccaggtggtccttagaatg

SEQ ID NO: 438822 - DNA, 25 bp, Homo sapien
ccaggtggtccttagaatgaccaac

SEQ ID NO: 438823 - DNA, 25 bp, Homo sapien
gctgcagactttcgcgatttcatct

SEQ ID NO: 438824 - DNA, 25 bp, Homo sapien
agactttcgcgatttcatctctctc

SEQ ID NO: 438825 - DNA, 25 bp, Homo sapien
atcctgtattcttcggaccatgata

SEQ ID NO: 438826 - DNA, 25 bp, Homo sapien
gtattcttcggaccatgataaaatt

SEQ ID NO: 438827 - DNA, 25 bp, Homo sapien
gataaaattccagactctcggtagt

SEQ ID NO: 438828 - DNA, 25 bp, Homo sapien
attccagactctcggtagtttttgc

SEQ ID NO: 438829 - DNA, 25 bp, Homo sapien
gactctcggtagtttttgcgttcca

SEQ ID NO: 438830 - DNA, 25 bp, Homo sapien
tcggtagtttttgcgttccaagaag

SEQ ID NO: 438831 - DNA, 25 bp, Homo sapien
gcgttccaagaagtagagcctagag

SEQ ID NO: 438832 - DNA, 25 bp, Homo sapien
gagcctagagtggtggcctataatt

SEQ ID NO: 438833 - DNA, 25 bp, Homo sapien
ggtggcctataattacagttactca

SEQ ID NO: 438834 - DNA, 25 bp, Homo sapien
ctgcattatatgatgagcttacata

SEQ ID NO: 438835 - DNA, 25 bp, Homo sapien
tgatgagcttacatataatagcaat

SEQ ID NO: 438836 - DNA, 25 bp, Homo sapien
atgagcttacatataatagcaataa

SEQ ID NO: 438837 - DNA, 25 bp, Homo sapien
atagcaataatagaccagaagcggt

SEQ ID NO: 438838 - DNA, 25 bp, Homo sapien
gcaataatagaccagaagcggtggc

SEQ ID NO: 438839 - DNA, 25 bp, Homo sapien
aataatagaccagaagcggtggctc

SEQ ID NO: 438840 - DNA, 25 bp, Homo sapien
ataatagaccagaagcggtggctca

SEQ ID NO: 438841 - DNA, 25 bp, Homo sapien
taatagaccagaagcggtggctcac

SEQ ID NO: 438842 - DNA, 25 bp, Homo sapien
tagaccagaagcggtggctcacaca

SEQ ID NO: 438843 - DNA, 25 bp, Homo sapien
gcagattgcttgagttcatgtgttc

SEQ ID NO: 438844 - DNA, 25 bp, Homo sapien
agattgcttgagttcatgtgttcaa

SEQ ID NO: 438845 - DNA, 25 bp, Homo sapien
aattccagtcttggagtagtctaac

SEQ ID NO: 438846 - DNA, 25 bp, Homo sapien
attccagtcttggagtagtctaaca

SEQ ID NO: 438847 - DNA, 25 bp, Homo sapien
ttccagtcttggagtagtctaacag

SEQ ID NO: 438848 - DNA, 25 bp, Homo sapien
tccagtcttggagtagtctaacaga

SEQ ID NO: 438849 - DNA, 25 bp, Homo sapien
ccagtcttggagtagtctaacagaa

SEQ ID NO: 438850 - DNA, 25 bp, Homo sapien
cagtcttggagtagtctaacagaag

SEQ ID NO: 438851 - DNA, 25 bp, Homo sapien
gtcttggagtagtctaacagaagaa

SEQ ID NO: 438852 - DNA, 25 bp, Homo sapien
ttatcatgatgggtcacatatagac

SEQ ID NO: 438853 - DNA, 25 bp, Homo sapien
atcatgatgggtcacatatagacat

SEQ ID NO: 438854 - DNA, 25 bp, Homo sapien
catgatgggtcacatatagacatat

SEQ ID NO: 438855 - DNA, 25 bp, Homo sapien
tgatgggtcacatatagacatatgt

SEQ ID NO: 438856 - DNA, 25 bp, Homo sapien
gtggccttcctgcgcagcactctgt

SEQ ID NO: 438857 - DNA, 25 bp, Homo sapien
tgcagtgcccgtggctaacagagga

SEQ ID NO: 438858 - DNA, 25 bp, Homo sapien
gtggctaacagaggagggcccggcc

SEQ ID NO: 438859 - DNA, 25 bp, Homo sapien
ggctgcgcgtcttcgtgcgcaatcg

SEQ ID NO: 438860 - DNA, 25 bp, Homo sapien
cgtcttcgtgcgcaatcgcgagaag

SEQ ID NO: 438861 - DNA, 25 bp, Homo sapien
atcgcgagaagagacgcgcgctgct

SEQ ID NO: 438862 - DNA, 25 bp, Homo sapien
aagagacgcgcgctgctgtacaaga

SEQ ID NO: 438863 - DNA, 25 bp, Homo sapien
gacgcgcgctgctgtacaagaggca

SEQ ID NO: 438864 - DNA, 25 bp, Homo sapien
gcgcgctgctgtacaagaggcacaa

SEQ ID NO: 438865 - DNA, 25 bp, Homo sapien
cgctgctgtacaagaggcacaacct

SEQ ID NO: 438866 - DNA, 25 bp, Homo sapien
aacctggcccaggtgcgctgagggt

SEQ ID NO: 438867 - DNA, 25 bp, Homo sapien
gttgctgaatattgaagtggttgta

SEQ ID NO: 438868 - DNA, 25 bp, Homo sapien
ttgaagtggttgtaacaatttctta

SEQ ID NO: 438869 - DNA, 25 bp, Homo sapien
acgaaagatttcagtgtaccatgcg

SEQ ID NO: 438870 - DNA, 25 bp, Homo sapien
gaaagatttcagtgtaccatgcgat

SEQ ID NO: 438871 - DNA, 25 bp, Homo sapien
aagatttcagtgtaccatgcgatac

SEQ ID NO: 438872 - DNA, 25 bp, Homo sapien
gatttcagtgtaccatgcgatactg

SEQ ID NO: 438873 - DNA, 25 bp, Homo sapien
ttcagtgtaccatgcgatactgttt

SEQ ID NO: 438874 - DNA, 25 bp, Homo sapien
agtgtaccatgcgatactgtttgat

SEQ ID NO: 438875 - DNA, 25 bp, Homo sapien
gtgtaccatgcgatactgtttgata

SEQ ID NO: 438876 - DNA, 25 bp, Homo sapien
gtaccatgcgatactgtttgataag

SEQ ID NO: 438877 - DNA, 25 bp, Homo sapien
taccatgcgatactgtttgataagc

SEQ ID NO: 438878 - DNA, 25 bp, Homo sapien
aaacttttccaatatgagcatccat

SEQ ID NO: 438879 - DNA, 25 bp, Homo sapien
gcatccattggatattctagataaa

SEQ ID NO: 438880 - DNA, 25 bp, Homo sapien
tacagatataactagcatcctttaa

SEQ ID NO: 438881 - DNA, 25 bp, Homo sapien
tttgtggttggtatagtttggataa

SEQ ID NO: 438882 - DNA, 25 bp, Homo sapien
tagtttggataagggagagccatca

SEQ ID NO: 438883 - DNA, 25 bp, Homo sapien
gggagagccatcagttttggcaatt

SEQ ID NO: 438884 - DNA, 25 bp, Homo sapien
cagttttggcaattgagtggcttga

SEQ ID NO: 438885 - DNA, 25 bp, Homo sapien
gtggcttgaatattcttgttcaccc

SEQ ID NO: 438886 - DNA, 25 bp, Homo sapien
gagatgtggctttgcaactctgcaa

SEQ ID NO: 438887 - DNA, 25 bp, Homo sapien
tgtggctttgcaactctgcaaggta

SEQ ID NO: 438888 - DNA, 25 bp, Homo sapien
ttgcaactctgcaaggtagtgtatt

SEQ ID NO: 438889 - DNA, 25 bp, Homo sapien
tttgttgtactttaatacctggtgt

SEQ ID NO: 438890 - DNA, 25 bp, Homo sapien
gttgtactttaatacctggtgtaca

SEQ ID NO: 438891 - DNA, 25 bp, Homo sapien
tacctggtgtacagttccagaaata

SEQ ID NO: 438892 - DNA, 25 bp, Homo sapien
tggtgtacagttccagaaataaaaa

SEQ ID NO: 438893 - DNA, 25 bp, Homo sapien
gtagatattaatattcctcttagat

SEQ ID NO: 438894 - DNA, 25 bp, Homo sapien
attaatattcctcttagatgaccag

SEQ ID NO: 438895 - DNA, 25 bp, Homo sapien
taatattcctcttagatgaccagtg

SEQ ID NO: 438896 - DNA, 25 bp, Homo sapien
aatattcctcttagatgaccagtga

SEQ ID NO: 438897 - DNA, 25 bp, Homo sapien
tattcctcttagatgaccagtgatt

SEQ ID NO: 438898 - DNA, 25 bp, Homo sapien
accagtgattccaattgtcccagtt

SEQ ID NO: 438899 - DNA, 25 bp, Homo sapien
taaattagtgacaatcagaacaagt

SEQ ID NO: 438900 - DNA, 25 bp, Homo sapien
atgaggataatgatacctacttttg

SEQ ID NO: 438901 - DNA, 25 bp, Homo sapien
tgaggataatgatacctacttttgg

SEQ ID NO: 438902 - DNA, 25 bp, Homo sapien
gaggataatgatacctacttttggc

SEQ ID NO: 438903 - DNA, 25 bp, Homo sapien
aggataatgatacctacttttggcg

SEQ ID NO: 438904 - DNA, 25 bp, Homo sapien
ggataatgatacctacttttggcgg

SEQ ID NO: 438905 - DNA, 25 bp, Homo sapien
gataatgatacctacttttggcggg

SEQ ID NO: 438906 - DNA, 25 bp, Homo sapien
ataatgatacctacttttggcgggg

SEQ ID NO: 438907 - DNA, 25 bp, Homo sapien
aatgatacctacttttggcggggtg

SEQ ID NO: 438908 - DNA, 25 bp, Homo sapien
atgatacctacttttggcggggtgc

SEQ ID NO: 438909 - DNA, 25 bp, Homo sapien
gatacctacttttggcggggtgcag

SEQ ID NO: 438910 - DNA, 25 bp, Homo sapien
atacctacttttggcggggtgcagg

SEQ ID NO: 438911 - DNA, 25 bp, Homo sapien
tcttttttatgtaagggacagcttt

SEQ ID NO: 438912 - DNA, 25 bp, Homo sapien
agagtcctttctgctggtgaggaca

SEQ ID NO: 438913 - DNA, 25 bp, Homo sapien
agcagggctttgttctctatgtgca

SEQ ID NO: 438914 - DNA, 25 bp, Homo sapien
gttctctatgtgcattaggactttt

SEQ ID NO: 438915 - DNA, 25 bp, Homo sapien
taggacttttatcatgcccttgttc

SEQ ID NO: 438916 - DNA, 25 bp, Homo sapien
atcatgcccttgttctgtgtgtagt

SEQ ID NO: 438917 - DNA, 25 bp, Homo sapien
ttctgtgtgtagttacttgacagca

SEQ ID NO: 438918 - DNA, 25 bp, Homo sapien
atcaaatgccgcctcttcctaatgt

SEQ ID NO: 438919 - DNA, 25 bp, Homo sapien
caagttttcatgaactagcaacccc

SEQ ID NO: 438920 - DNA, 25 bp, Homo sapien
gcctgattttgctgtgactcccaga

SEQ ID NO: 438921 - DNA, 25 bp, Homo sapien
tgtaacaggccattaaagctcccca

SEQ ID NO: 438922 - DNA, 25 bp, Homo sapien
tgaagcatgatggtttatccacagg

SEQ ID NO: 438923 - DNA, 25 bp, Homo sapien
gcatgatggtttatccacaggtcca

SEQ ID NO: 438924 - DNA, 25 bp, Homo sapien
gatggtttatccacaggtccatttt

SEQ ID NO: 438925 - DNA, 25 bp, Homo sapien
gtttatccacaggtccattttctca

SEQ ID NO: 438926 - DNA, 25 bp, Homo sapien
tatccacaggtccattttctcaggg

SEQ ID NO: 438927 - DNA, 25 bp, Homo sapien
ccacaggtccattttctcagggaat

SEQ ID NO: 438928 - DNA, 25 bp, Homo sapien
aggtccattttctcagggaatgcat

SEQ ID NO: 438929 - DNA, 25 bp, Homo sapien
gatggagtgcgcctgttagtcccag

SEQ ID NO: 438930 - DNA, 25 bp, Homo sapien
aggtgagggtactgcttgagcctga

SEQ ID NO: 438931 - DNA, 25 bp, Homo sapien
ttgagcctgagttttaggttgcagt

SEQ ID NO: 438932 - DNA, 25 bp, Homo sapien
gcctgagttttaggttgcagtgaga

SEQ ID NO: 438933 - DNA, 25 bp, Homo sapien
aatgtgccagtgtcttatgtgcttc

SEQ ID NO: 438934 - DNA, 25 bp, Homo sapien
atgtgccagtgtcttatgtgcttcc

SEQ ID NO: 438935 - DNA, 25 bp, Homo sapien
gtgccagtgtcttatgtgcttcctg

SEQ ID NO: 438936 - DNA, 25 bp, Homo sapien
gccagtgtcttatgtgcttcctgta

SEQ ID NO: 438937 - DNA, 25 bp, Homo sapien
cagtgtcttatgtgcttcctgtata

SEQ ID NO: 438938 - DNA, 25 bp, Homo sapien
gtgtcttatgtgcttcctgtatata

SEQ ID NO: 438939 - DNA, 25 bp, Homo sapien
gtcttatgtgcttcctgtatataat

SEQ ID NO: 438940 - DNA, 25 bp, Homo sapien
tatgtgcttcctgtatataatctca

SEQ ID NO: 438941 - DNA, 25 bp, Homo sapien
gtgcttcctgtatataatctcactt

SEQ ID NO: 438942 - DNA, 25 bp, Homo sapien
gcttcctgtatataatctcacttaa

SEQ ID NO: 438943 - DNA, 25 bp, Homo sapien
ttcctgtatataatctcacttaata

SEQ ID NO: 438944 - DNA, 25 bp, Homo sapien
gagcaagaagattctctttagacca

SEQ ID NO: 438945 - DNA, 25 bp, Homo sapien
gcaagaagattctctttagaccaaa

SEQ ID NO: 438946 - DNA, 25 bp, Homo sapien
gaagattctctttagaccaaattct

SEQ ID NO: 438947 - DNA, 25 bp, Homo sapien
gattctctttagaccaaattctcgt

SEQ ID NO: 438948 - DNA, 25 bp, Homo sapien
ttctctttagaccaaattctcgtgc

SEQ ID NO: 438949 - DNA, 25 bp, Homo sapien
tctctttagaccaaattctcgtgca

SEQ ID NO: 438950 - DNA, 25 bp, Homo sapien
tctttagaccaaattctcgtgcatt

SEQ ID NO: 438951 - DNA, 25 bp, Homo sapien
ctttagaccaaattctcgtgcattg

SEQ ID NO: 438952 - DNA, 25 bp, Homo sapien
attctcgtgcattggtcttgaactt

SEQ ID NO: 438953 - DNA, 25 bp, Homo sapien
ttctcgtgcattggtcttgaacttc

SEQ ID NO: 438954 - DNA, 25 bp, Homo sapien
cctccagaaccctgcgtgagctgcc

SEQ ID NO: 438955 - DNA, 25 bp, Homo sapien
atgctattgcaaattgtccgcagga

SEQ ID NO: 438956 - DNA, 25 bp, Homo sapien
gtccgcaggaagcaaaatgccagat

SEQ ID NO: 438957 - DNA, 25 bp, Homo sapien
aatgccagatggttaagtgtagctc

SEQ ID NO: 438958 - DNA, 25 bp, Homo sapien
aaacaattctatttagcatctgaga

SEQ ID NO: 438959 - DNA, 25 bp, Homo sapien
gataggtctatattaggcaatttca

SEQ ID NO: 438960 - DNA, 25 bp, Homo sapien
atattaggcaatttcatgtttacat

SEQ ID NO: 438961 - DNA, 25 bp, Homo sapien
gaaaggtttaatggcaaatattcct

SEQ ID NO: 438962 - DNA, 25 bp, Homo sapien
tattccttatattctaacttgctac

SEQ ID NO: 438963 - DNA, 25 bp, Homo sapien
aacttgctacttggagaatatggat

SEQ ID NO: 438964 - DNA, 25 bp, Homo sapien
ttctagaacactgtgcaggactaat

SEQ ID NO: 438965 - DNA, 25 bp, Homo sapien
gaacactgtgcaggactaatttttt

SEQ ID NO: 438966 - DNA, 25 bp, Homo sapien
cacactccgtgactgtacttaagag

SEQ ID NO: 438967 - DNA, 25 bp, Homo sapien
acactccgtgactgtacttaagaga

SEQ ID NO: 438968 - DNA, 25 bp, Homo sapien
cactccgtgactgtacttaagagaa

SEQ ID NO: 438969 - DNA, 25 bp, Homo sapien
ctccgtgactgtacttaagagaaca

SEQ ID NO: 438970 - DNA, 25 bp, Homo sapien
gtgactgtacttaagagaacacatt

SEQ ID NO: 438971 - DNA, 25 bp, Homo sapien
gactgtacttaagagaacacattct

SEQ ID NO: 438972 - DNA, 25 bp, Homo sapien
gtacttaagagaacacattctggct

SEQ ID NO: 438973 - DNA, 25 bp, Homo sapien
ggcatggctgtttgtccctgcagtc

SEQ ID NO: 438974 - DNA, 25 bp, Homo sapien
gcatggctgtttgtccctgcagtcc

SEQ ID NO: 438975 - DNA, 25 bp, Homo sapien
atggctgtttgtccctgcagtccca

SEQ ID NO: 438976 - DNA, 25 bp, Homo sapien
gctgtttgtccctgcagtcccagct

SEQ ID NO: 438977 - DNA, 25 bp, Homo sapien
atggacagcggcttcggctcggatt

SEQ ID NO: 438978 - DNA, 25 bp, Homo sapien
gcttcggctcggattttggcggcac

SEQ ID NO: 438979 - DNA, 25 bp, Homo sapien
cttcggctcggattttggcggcacg

SEQ ID NO: 438980 - DNA, 25 bp, Homo sapien
ggctcggattttggcggcacgggtg

SEQ ID NO: 438981 - DNA, 25 bp, Homo sapien
tgaaagtgcagatcgccgtggccaa

SEQ ID NO: 438982 - DNA, 25 bp, Homo sapien
gagctgctccagagaatgacggaca

SEQ ID NO: 438983 - DNA, 25 bp, Homo sapien
tgtttccggaagtgcatcgggaagc

SEQ ID NO: 438984 - DNA, 25 bp, Homo sapien
ttccggaagtgcatcgggaagcccg

SEQ ID NO: 438985 - DNA, 25 bp, Homo sapien
gggctccttggataactcggagcag

SEQ ID NO: 438986 - DNA, 25 bp, Homo sapien
tccttggataactcggagcagaaat

SEQ ID NO: 438987 - DNA, 25 bp, Homo sapien
taactcggagcagaaatgcatcgcc

SEQ ID NO: 438988 - DNA, 25 bp, Homo sapien
gttaaggctaatacaatgacagact

SEQ ID NO: 438989 - DNA, 25 bp, Homo sapien
agagttagcactccataccccttca

SEQ ID NO: 438990 - DNA, 25 bp, Homo sapien
cataccccttcaaacatgttgcttt

SEQ ID NO: 438991 - DNA, 25 bp, Homo sapien
atgttgctttgctttcttgtggaca

SEQ ID NO: 438992 - DNA, 25 bp, Homo sapien
tttgctttcttgtggacagcttgta

SEQ ID NO: 438993 - DNA, 25 bp, Homo sapien
gacagcttgtagtttgccaggattt

SEQ ID NO: 438994 - DNA, 25 bp, Homo sapien
cagctggaaagatacgccatccttt

SEQ ID NO: 438995 - DNA, 25 bp, Homo sapien
catcctttcaaaccctcatgactga

SEQ ID NO: 438996 - DNA, 25 bp, Homo sapien
tcatgactgacaaaaactccatggg

SEQ ID NO: 438997 - DNA, 25 bp, Homo sapien
aatctgcctgaagatcattaccaaa

SEQ ID NO: 438998 - DNA, 25 bp, Homo sapien
gcaggtacttctaccattaaggtga

SEQ ID NO: 438999 - DNA, 25 bp, Homo sapien
tgtgatttctgaaccaagctattcc

SEQ ID NO: 439000 - DNA, 25 bp, Homo sapien
aaccaagctattcctaggcctgagt

SEQ ID NO: 439001 - DNA, 25 bp, Homo sapien
aagctattcctaggcctgagtttta

SEQ ID NO: 439002 - DNA, 25 bp, Homo sapien
gagttttattttgttgacacagaaa

SEQ ID NO: 439003 - DNA, 25 bp, Homo sapien
gaaataaattagaaggccaagcgtg

SEQ ID NO: 439004 - DNA, 25 bp, Homo sapien
tgtagtcctagttgctgaggtaaga

SEQ ID NO: 439005 - DNA, 25 bp, Homo sapien
ctgcagcaagctttgattgcgccac

SEQ ID NO: 439006 - DNA, 25 bp, Homo sapien
gatgatgaacttaatgtttccattt

SEQ ID NO: 439007 - DNA, 25 bp, Homo sapien
taatggaatactaagtccctctgtg

SEQ ID NO: 439008 - DNA, 25 bp, Homo sapien
ggaatactaagtccctctgtgattt

SEQ ID NO: 439009 - DNA, 25 bp, Homo sapien
actaagtccctctgtgatttctgaa

SEQ ID NO: 439010 - DNA, 25 bp, Homo sapien
gacacttcagaatttctcgaactta

SEQ ID NO: 439011 - DNA, 25 bp, Homo sapien
acttacctaaactgatcatatattt

SEQ ID NO: 439012 - DNA, 25 bp, Homo sapien
cttacctaaactgatcatatattta

SEQ ID NO: 439013 - DNA, 25 bp, Homo sapien
tacctaaactgatcatatatttaag

SEQ ID NO: 439014 - DNA, 25 bp, Homo sapien
aaactgatcatatatttaaggcaag

SEQ ID NO: 439015 - DNA, 25 bp, Homo sapien
aactgatcatatatttaaggcaagt

SEQ ID NO: 439016 - DNA, 25 bp, Homo sapien
actgatcatatatttaaggcaagtc

SEQ ID NO: 439017 - DNA, 25 bp, Homo sapien
ctgatcatatatttaaggcaagtct

SEQ ID NO: 439018 - DNA, 25 bp, Homo sapien
tgatcatatatttaaggcaagtctc

SEQ ID NO: 439019 - DNA, 25 bp, Homo sapien
gatcatatatttaaggcaagtctct

SEQ ID NO: 439020 - DNA, 25 bp, Homo sapien
atcatatatttaaggcaagtctcta

SEQ ID NO: 439021 - DNA, 25 bp, Homo sapien
aactgggcctccatacagtcagttg

SEQ ID NO: 439022 - DNA, 25 bp, Homo sapien
cagtcagttggtgggcttattgtac

SEQ ID NO: 439023 - DNA, 25 bp, Homo sapien
gcttattgtactgtggtgctttgca

SEQ ID NO: 439024 - DNA, 25 bp, Homo sapien
ggtgctttgcaatgcaaccctgcaa

SEQ ID NO: 439025 - DNA, 25 bp, Homo sapien
aaaggttctttctctatgtctcctc

SEQ ID NO: 439026 - DNA, 25 bp, Homo sapien
tttctagttcttcacggttccaaag

SEQ ID NO: 439027 - DNA, 25 bp, Homo sapien
ttcttcacggttccaaagctttact

SEQ ID NO: 439028 - DNA, 25 bp, Homo sapien
aagctttactatgaacctgggcatg

SEQ ID NO: 439029 - DNA, 25 bp, Homo sapien
acctgggcatgttggcaatgcagac

SEQ ID NO: 439030 - DNA, 25 bp, Homo sapien
gcgcaattccttaccgaattttctc

SEQ ID NO: 439031 - DNA, 25 bp, Homo sapien
gaattttctcagatatacctcatag

SEQ ID NO: 439032 - DNA, 25 bp, Homo sapien
gggcactgccagtgtcttccagagc

SEQ ID NO: 439033 - DNA, 25 bp, Homo sapien
ggatgggaacccaaggctgtccaca

SEQ ID NO: 439034 - DNA, 25 bp, Homo sapien
ggaacccaaggctgtccacatctgg

SEQ ID NO: 439035 - DNA, 25 bp, Homo sapien
cacatctggcttttgtgggactcag

SEQ ID NO: 439036 - DNA, 25 bp, Homo sapien
gaactgagggctgggatattcctca

SEQ ID NO: 439037 - DNA, 25 bp, Homo sapien
gggatattcctcatggtggcagcgc

SEQ ID NO: 439038 - DNA, 25 bp, Homo sapien
ctcatggtggcagcgctcatagcga

SEQ ID NO: 439039 - DNA, 25 bp, Homo sapien
agcgctcatagcgaaagcctactgt

SEQ ID NO: 439040 - DNA, 25 bp, Homo sapien
aagcctactgtaatatgcacccatc

SEQ ID NO: 439041 - DNA, 25 bp, Homo sapien
tactgtaatatgcacccatctcatc

SEQ ID NO: 439042 - DNA, 25 bp, Homo sapien
acccatctcatccacgtagtaaagt

SEQ ID NO: 439043 - DNA, 25 bp, Homo sapien
aaaatatagtattttaccaggcagg

SEQ ID NO: 439044 - DNA, 25 bp, Homo sapien
tataagtaattcttgctcaccaaac

SEQ ID NO: 439045 - DNA, 25 bp, Homo sapien
ttgctcaccaaacaaagggctatgt

SEQ ID NO: 439046 - DNA, 25 bp, Homo sapien
gggctatgtctcttttaagcaaatg

SEQ ID NO: 439047 - DNA, 25 bp, Homo sapien
aatgtttttgatgcatatcttttta

SEQ ID NO: 439048 - DNA, 25 bp, Homo sapien
ttaaattaaccctctgcagcaaggg

SEQ ID NO: 439049 - DNA, 25 bp, Homo sapien
cctctgcagcaagggtacgaaatac

SEQ ID NO: 439050 - DNA, 25 bp, Homo sapien
agatcagatgggaatgggtactata

SEQ ID NO: 439051 - DNA, 25 bp, Homo sapien
atagcaacagctactccttttacca

SEQ ID NO: 439052 - DNA, 25 bp, Homo sapien
gctactccttttaccattactagtg

SEQ ID NO: 439053 - DNA, 25 bp, Homo sapien
ttttaccattactagtgtgttttca

SEQ ID NO: 439054 - DNA, 25 bp, Homo sapien
ttcttctttgtgaccgttcctttag

SEQ ID NO: 439055 - DNA, 25 bp, Homo sapien
tgaccgttcctttagtccttcaatg

SEQ ID NO: 439056 - DNA, 25 bp, Homo sapien
agtccttcaatgtttcttatcctct

SEQ ID NO: 439057 - DNA, 25 bp, Homo sapien
atgtttcttatcctcttccttcgtt

SEQ ID NO: 439058 - DNA, 25 bp, Homo sapien
tttcctgcacaatatttatcaccat

SEQ ID NO: 439059 - DNA, 25 bp, Homo sapien
atatttatcaccatcagacagatct

SEQ ID NO: 439060 - DNA, 25 bp, Homo sapien
tgtattaatttatcagtctgctgcc

SEQ ID NO: 439061 - DNA, 25 bp, Homo sapien
gtctccctgtcccataggatgtaat

SEQ ID NO: 439062 - DNA, 25 bp, Homo sapien
aggatgtaatctctgttaccacagg

SEQ ID NO: 439063 - DNA, 25 bp, Homo sapien
ctgttaccacaggaaataatttttg

SEQ ID NO: 439064 - DNA, 25 bp, Homo sapien
gtttaatattgttcacagccagcct

SEQ ID NO: 439065 - DNA, 25 bp, Homo sapien
tttttacccttattctaagagcaag

SEQ ID NO: 439066 - DNA, 25 bp, Homo sapien
agttgaactgaatcttccttgtctt

SEQ ID NO: 439067 - DNA, 25 bp, Homo sapien
gaatcttccttgtcttagtaacaat

SEQ ID NO: 439068 - DNA, 25 bp, Homo sapien
gtggcttttctgtacaaaaggttgt

SEQ ID NO: 439069 - DNA, 25 bp, Homo sapien
aaaggttgtaatgcctcctgatgga

SEQ ID NO: 439070 - DNA, 25 bp, Homo sapien
atgcctcctgatggatataattttg

SEQ ID NO: 439071 - DNA, 25 bp, Homo sapien
gaataaatcacaccagcttcctgaa

SEQ ID NO: 439072 - DNA, 25 bp, Homo sapien
ccagcttcctgaaaatgttcataat

SEQ ID NO: 439073 - DNA, 25 bp, Homo sapien
tcataatgcatcttttggaaaacaa

SEQ ID NO: 439074 - DNA, 25 bp, Homo sapien
acaaatacatgcctactttgtgcat

SEQ ID NO: 439075 - DNA, 25 bp, Homo sapien
acatgcctactttgtgcatatttgc

SEQ ID NO: 439076 - DNA, 25 bp, Homo sapien
gagtcgagatcgtgctactactgcc

SEQ ID NO: 439077 - DNA, 25 bp, Homo sapien
atcgtgctactactgcctgggtggc

SEQ ID NO: 439078 - DNA, 25 bp, Homo sapien
ctactactgcctgggtggcaagggt

SEQ ID NO: 439079 - DNA, 25 bp, Homo sapien
gccagaccatagtttgactggtggc

SEQ ID NO: 439080 - DNA, 25 bp, Homo sapien
cagaccatagtttgactggtggcat

SEQ ID NO: 439081 - DNA, 25 bp, Homo sapien
accatagtttgactggtggcatgga

SEQ ID NO: 439082 - DNA, 25 bp, Homo sapien
atagtttgactggtggcatggaatt

SEQ ID NO: 439083 - DNA, 25 bp, Homo sapien
ctggtggcatggaatttgtgtatca

SEQ ID NO: 439084 - DNA, 25 bp, Homo sapien
ggtggcatggaatttgtgtatcaaa

SEQ ID NO: 439085 - DNA, 25 bp, Homo sapien
gtgtatcaaataaatgcatttgctt

SEQ ID NO: 439086 - DNA, 25 bp, Homo sapien
aaataaatgcatttgcttatttgac

SEQ ID NO: 439087 - DNA, 25 bp, Homo sapien
gtaagggacagctttctccacagag

SEQ ID NO: 439088 - DNA, 25 bp, Homo sapien
taagggacagctttctccacagagt

SEQ ID NO: 439089 - DNA, 25 bp, Homo sapien
aagggacagctttctccacagagtc

SEQ ID NO: 439090 - DNA, 25 bp, Homo sapien
agggacagctttctccacagagtcc

SEQ ID NO: 439091 - DNA, 25 bp, Homo sapien
gggacagctttctccacagagtcct

SEQ ID NO: 439092 - DNA, 25 bp, Homo sapien
ggacagctttctccacagagtcctt

SEQ ID NO: 439093 - DNA, 25 bp, Homo sapien
ttccaccatggttctgggcgcctga

SEQ ID NO: 439094 - DNA, 25 bp, Homo sapien
tccaccatggttctgggcgcctgat

SEQ ID NO: 439095 - DNA, 25 bp, Homo sapien
ccaccatggttctgggcgcctgatt

SEQ ID NO: 439096 - DNA, 25 bp, Homo sapien
caccatggttctgggcgcctgattt

SEQ ID NO: 439097 - DNA, 25 bp, Homo sapien
atggttctgggcgcctgattttgct

SEQ ID NO: 439098 - DNA, 25 bp, Homo sapien
tctagatggccaactcctatcacta

SEQ ID NO: 439099 - DNA, 25 bp, Homo sapien
atggccaactcctatcactagcgta

SEQ ID NO: 439100 - DNA, 25 bp, Homo sapien
aactcctatcactagcgtaccttta

SEQ ID NO: 439101 - DNA, 25 bp, Homo sapien
atcactagcgtacctttaatcttca

SEQ ID NO: 439102 - DNA, 25 bp, Homo sapien
gcgtacctttaatcttcatttgact

SEQ ID NO: 439103 - DNA, 25 bp, Homo sapien
gaaattatttcaccacttgctactg

SEQ ID NO: 439104 - DNA, 25 bp, Homo sapien
accacttgctactggcattattttt

SEQ ID NO: 439105 - DNA, 25 bp, Homo sapien
cttgctactggcattatttttaaca

SEQ ID NO: 439106 - DNA, 25 bp, Homo sapien
aagctaaaaaatgcatactgtgaga

SEQ ID NO: 439107 - DNA, 25 bp, Homo sapien
atcctgctcaaatttgtacgctcca

SEQ ID NO: 439108 - DNA, 25 bp, Homo sapien
aaatttgtacgctccacctccagtg

SEQ ID NO: 439109 - DNA, 25 bp, Homo sapien
gagaagggacacatccactcttgga

SEQ ID NO: 439110 - DNA, 25 bp, Homo sapien
ggacacatccactcttggaggaata

SEQ ID NO: 439111 - DNA, 25 bp, Homo sapien
atttactcaataatggcaccttaca

SEQ ID NO: 439112 - DNA, 25 bp, Homo sapien
gtaacagttgtctaataacgtttct

SEQ ID NO: 439113 - DNA, 25 bp, Homo sapien
tcatcttgctgttgattgttagatt

SEQ ID NO: 439114 - DNA, 25 bp, Homo sapien
gattgttagattgttgatgcattct

SEQ ID NO: 439115 - DNA, 25 bp, Homo sapien
gatgcattctaaccaactcacacat

SEQ ID NO: 439116 - DNA, 25 bp, Homo sapien
ggagaagagaattagcgtttgcagc

SEQ ID NO: 439117 - DNA, 25 bp, Homo sapien
gcgtttgcagcagtgtatcatctac

SEQ ID NO: 439118 - DNA, 25 bp, Homo sapien
aattaaactaatgttgctgcttcat

SEQ ID NO: 439119 - DNA, 25 bp, Homo sapien
gttgctgcttcattagttggtggga

SEQ ID NO: 439120 - DNA, 25 bp, Homo sapien
gtccagggtatctcattctgatcaa

SEQ ID NO: 439121 - DNA, 25 bp, Homo sapien
gatcaaaccgaattggccatccata

SEQ ID NO: 439122 - DNA, 25 bp, Homo sapien
ccatccatactgagaagtggctatt

SEQ ID NO: 439123 - DNA, 25 bp, Homo sapien
ggaaacacctttgtagctaccagat

SEQ ID NO: 439124 - DNA, 25 bp, Homo sapien
gctaccagattatgtattctctttt

SEQ ID NO: 439125 - DNA, 25 bp, Homo sapien
gcctcatggaaaacactgctgtgct

SEQ ID NO: 439126 - DNA, 25 bp, Homo sapien
aacactgctgtgctgtcttccagct

SEQ ID NO: 439127 - DNA, 25 bp, Homo sapien
tcttccagcttccaggtttcacgaa

SEQ ID NO: 439128 - DNA, 25 bp, Homo sapien
aggtttcacgaaggcacatctctca

SEQ ID NO: 439129 - DNA, 25 bp, Homo sapien
gaaggcacatctctcaactagtaat

SEQ ID NO: 439130 - DNA, 25 bp, Homo sapien
actagtaatatgttctgttttcaga

SEQ ID NO: 439131 - DNA, 25 bp, Homo sapien
gctgccgctgcttcctaggaggccg

SEQ ID NO: 439132 - DNA, 25 bp, Homo sapien
agacggcggcgcaggccaggtcgtt

SEQ ID NO: 439133 - DNA, 25 bp, Homo sapien
tcccgcggcgggacgtgcaagtcct

SEQ ID NO: 439134 - DNA, 25 bp, Homo sapien
caggccaggtcgttcagggactgcg

SEQ ID NO: 439135 - DNA, 25 bp, Homo sapien
gacgtgcaagtcctggatgacctcg

SEQ ID NO: 439136 - DNA, 25 bp, Homo sapien
gtgcaagtcctggatgacctcgtag

SEQ ID NO: 439137 - DNA, 25 bp, Homo sapien
agtcctggatgacctcgtagacgtt

SEQ ID NO: 439138 - DNA, 25 bp, Homo sapien
gtcctggatgacctcgtagacgttc

SEQ ID NO: 439139 - DNA, 25 bp, Homo sapien
gtagacgttctctgagtcgctgcgc

SEQ ID NO: 439140 - DNA, 25 bp, Homo sapien
gtcgctgcgcgccagaggccgcggg

SEQ ID NO: 439141 - DNA, 25 bp, Homo sapien
agaggccgcgggcacacccaggagc

SEQ ID NO: 439142 - DNA, 25 bp, Homo sapien
aaaatcctgctcaaatttgtacgct

SEQ ID NO: 439143 - DNA, 25 bp, Homo sapien
aaatcctgctcaaatttgtacgctc

SEQ ID NO: 439144 - DNA, 25 bp, Homo sapien
aatcctgctcaaatttgtacgctcc

SEQ ID NO: 439145 - DNA, 25 bp, Homo sapien
atcctgctcaaatttgtacgctcca

SEQ ID NO: 439146 - DNA, 25 bp, Homo sapien
tcctgctcaaatttgtacgctccac

SEQ ID NO: 439147 - DNA, 25 bp, Homo sapien
tgctcaaatttgtacgctccacctc

SEQ ID NO: 439148 - DNA, 25 bp, Homo sapien
aaatttgtacgctccacctccagtg

SEQ ID NO: 439149 - DNA, 25 bp, Homo sapien
aatttgtacgctccacctccagtgg

SEQ ID NO: 439150 - DNA, 25 bp, Homo sapien
tttgtacgctccacctccagtggca

SEQ ID NO: 439151 - DNA, 25 bp, Homo sapien
gctccacctccagtggcacaaaaga

SEQ ID NO: 439152 - DNA, 25 bp, Homo sapien
tccacctccagtggcacaaaagaca

SEQ ID NO: 439153 - DNA, 25 bp, Homo sapien
gtttatgaaagacacacagattgag

SEQ ID NO: 439154 - DNA, 25 bp, Homo sapien
gacagtttagctaaatgcagtgtga

SEQ ID NO: 439155 - DNA, 25 bp, Homo sapien
atgcagtgtgagatcctggaacaaa

SEQ ID NO: 439156 - DNA, 25 bp, Homo sapien
tgtgagatcctggaacaaaaggcca

SEQ ID NO: 439157 - DNA, 25 bp, Homo sapien
ggccaggaatggaaaaactcgtgat

SEQ ID NO: 439158 - DNA, 25 bp, Homo sapien
aactcgtgatgttcaaattagggta

SEQ ID NO: 439159 - DNA, 25 bp, Homo sapien
atttagttaatggtagtgtatcgaa

SEQ ID NO: 439160 - DNA, 25 bp, Homo sapien
gtgtatcgaagttaaccttctgggt

SEQ ID NO: 439161 - DNA, 25 bp, Homo sapien
aaccttctgggtttgatcattgaac

SEQ ID NO: 439162 - DNA, 25 bp, Homo sapien
gatcattgaactatggagccgggca

SEQ ID NO: 439163 - DNA, 25 bp, Homo sapien
cattgaactatggagccgggcatgg

SEQ ID NO: 439164 - DNA, 25 bp, Homo sapien
agtcaagaattaccgatgggtctta

SEQ ID NO: 439165 - DNA, 25 bp, Homo sapien
ccgatgggtcttaggtaactgagta

SEQ ID NO: 439166 - DNA, 25 bp, Homo sapien
ctgagtaggtggtagtgtcgtttac

SEQ ID NO: 439167 - DNA, 25 bp, Homo sapien
gtggtagtgtcgtttaccgagatta

SEQ ID NO: 439168 - DNA, 25 bp, Homo sapien
tgaaatgcctttgggatgtcaaagc

SEQ ID NO: 439169 - DNA, 25 bp, Homo sapien
gggatgtcaaagcaacttgttcact

SEQ ID NO: 439170 - DNA, 25 bp, Homo sapien
agcaacttgttcactaggcaattaa

SEQ ID NO: 439171 - DNA, 25 bp, Homo sapien
atctggagtccaggaacatgaccta

SEQ ID NO: 439172 - DNA, 25 bp, Homo sapien
atacctatcagcatacacccagtaa

SEQ ID NO: 439173 - DNA, 25 bp, Homo sapien
tatcagcatacacccagtaatgact

SEQ ID NO: 439174 - DNA, 25 bp, Homo sapien
gtaatgactggtatcccgcaaggcc

SEQ ID NO: 439175 - DNA, 25 bp, Homo sapien
agtctgtatctaaatcccaggttta

SEQ ID NO: 439176 - DNA, 25 bp, Homo sapien
gatgtgtgacctatatgttccttta

SEQ ID NO: 439177 - DNA, 25 bp, Homo sapien
tcctttatcttggtatctccttaga

SEQ ID NO: 439178 - DNA, 25 bp, Homo sapien
tatctccttagatgctatcccttag

SEQ ID NO: 439179 - DNA, 25 bp, Homo sapien
agatgctatcccttaggagacattc

SEQ ID NO: 439180 - DNA, 25 bp, Homo sapien
tcaataaagataatccgacccttcc

SEQ ID NO: 439181 - DNA, 25 bp, Homo sapien
gaaaacacacctccacggagtgcgt

SEQ ID NO: 439182 - DNA, 25 bp, Homo sapien
aaatttcacattcatcagcctaaat

SEQ ID NO: 439183 - DNA, 25 bp, Homo sapien
atcagcctaaatgcaccaaacaaag

SEQ ID NO: 439184 - DNA, 25 bp, Homo sapien
ttcctccatgaaaacggatctcagg

SEQ ID NO: 439185 - DNA, 25 bp, Homo sapien
acggatctcaggataaaaacgcagc

SEQ ID NO: 439186 - DNA, 25 bp, Homo sapien
tttaaggtcttcttttggtcctgag

SEQ ID NO: 439187 - DNA, 25 bp, Homo sapien
aggtcttcttttggtcctgagttct

SEQ ID NO: 439188 - DNA, 25 bp, Homo sapien
gaaacgtgatcaattcttgctctgt

SEQ ID NO: 439189 - DNA, 25 bp, Homo sapien
cgtgatcaattcttgctctgtggtg

SEQ ID NO: 439190 - DNA, 25 bp, Homo sapien
attcttgctctgtggtgttaaacat

SEQ ID NO: 439191 - DNA, 25 bp, Homo sapien
gaacagtcattaagaattaagtcac

SEQ ID NO: 439192 - DNA, 25 bp, Homo sapien
gaattaagtcactgtttgccataaa

SEQ ID NO: 439193 - DNA, 25 bp, Homo sapien
gtcactgtttgccataaacaaggtt

SEQ ID NO: 439194 - DNA, 25 bp, Homo sapien
acaaggttgatgttctttttgttgt

SEQ ID NO: 439195 - DNA, 25 bp, Homo sapien
ctagggctcggctttactcttgatt

SEQ ID NO: 439196 - DNA, 25 bp, Homo sapien
ggctcggctttactcttgattaata

SEQ ID NO: 439197 - DNA, 25 bp, Homo sapien
agacgccgtacgtgccagatggtgt

SEQ ID NO: 439198 - DNA, 25 bp, Homo sapien
cgccgtacgtgccagatggtgttac

SEQ ID NO: 439199 - DNA, 25 bp, Homo sapien
gtacaaaaggaacttgcacatttcg

SEQ ID NO: 439200 - DNA, 25 bp, Homo sapien
aaaggaacttgcacatttcgcaaaa

SEQ ID NO: 439201 - DNA, 25 bp, Homo sapien
cgtacgtgccagatggtgttacctg

SEQ ID NO: 439202 - DNA, 25 bp, Homo sapien
gcacatttcgcaaaaagcatttcac

SEQ ID NO: 439203 - DNA, 25 bp, Homo sapien
atttcgcaaaaagcatttcacttga

SEQ ID NO: 439204 - DNA, 25 bp, Homo sapien
tgccagatggtgttacctggagctt

SEQ ID NO: 439205 - DNA, 25 bp, Homo sapien
gatggtgttacctggagcttaaaaa

SEQ ID NO: 439206 - DNA, 25 bp, Homo sapien
tggtgttacctggagcttaaaaagc

SEQ ID NO: 439207 - DNA, 25 bp, Homo sapien
tgttacctggagcttaaaaagctgc

SEQ ID NO: 439208 - DNA, 25 bp, Homo sapien
aagcgaattgggtatataaatcagt

SEQ ID NO: 439209 - DNA, 25 bp, Homo sapien
gcgaattgggtatataaatcagtta

SEQ ID NO: 439210 - DNA, 25 bp, Homo sapien
aaatcagttatttctatctagtgaa

SEQ ID NO: 439211 - DNA, 25 bp, Homo sapien
tatctagtgaaatggtacagagaca

SEQ ID NO: 439212 - DNA, 25 bp, Homo sapien
tgaaatggtacagagacactaaaaa

SEQ ID NO: 439213 - DNA, 25 bp, Homo sapien
aatggtacagagacactaaaaaaga

SEQ ID NO: 439214 - DNA, 25 bp, Homo sapien
aaaaagaaggcgatcagccaggcat

SEQ ID NO: 439215 - DNA, 25 bp, Homo sapien
aaaagaaggcgatcagccaggcatg

SEQ ID NO: 439216 - DNA, 25 bp, Homo sapien
atgcctttgggaggcatgagcaccc

SEQ ID NO: 439217 - DNA, 25 bp, Homo sapien
gcctttgggaggcatgagcacccaa

SEQ ID NO: 439218 - DNA, 25 bp, Homo sapien
ttgggaggcatgagcacccaaaggt

SEQ ID NO: 439219 - DNA, 25 bp, Homo sapien
caacataacgagaccatgcctctaa

SEQ ID NO: 439220 - DNA, 25 bp, Homo sapien
acataacgagaccatgcctctaaaa

SEQ ID NO: 439221 - DNA, 25 bp, Homo sapien
ataacgagaccatgcctctaaaaaa

SEQ ID NO: 439222 - DNA, 25 bp, Homo sapien
gtgatgcacacctgtcatgccagtt

SEQ ID NO: 439223 - DNA, 25 bp, Homo sapien
tgatgcacacctgtcatgccagtta

SEQ ID NO: 439224 - DNA, 25 bp, Homo sapien
gatgcacacctgtcatgccagttac

SEQ ID NO: 439225 - DNA, 25 bp, Homo sapien
atgcacacctgtcatgccagttact

SEQ ID NO: 439226 - DNA, 25 bp, Homo sapien
gcacacctgtcatgccagttacttg

SEQ ID NO: 439227 - DNA, 25 bp, Homo sapien
acctgtcatgccagttacttggggg

SEQ ID NO: 439228 - DNA, 25 bp, Homo sapien
ggattagtgagctgtgattctgcca

SEQ ID NO: 439229 - DNA, 25 bp, Homo sapien
gattagtgagctgtgattctgccac

SEQ ID NO: 439230 - DNA, 25 bp, Homo sapien
gaagaagctatctactgagaataat

SEQ ID NO: 439231 - DNA, 25 bp, Homo sapien
ataattcactaagcacatgtgtggt

SEQ ID NO: 439232 - DNA, 25 bp, Homo sapien
atttatctcactttataatgctgtg

SEQ ID NO: 439233 - DNA, 25 bp, Homo sapien
gaaactttgatcagagaagggactc

SEQ ID NO: 439234 - DNA, 25 bp, Homo sapien
gagacttggattctactttcggctt

SEQ ID NO: 439235 - DNA, 25 bp, Homo sapien
actttcggcttgttgtgtgatcact

SEQ ID NO: 439236 - DNA, 25 bp, Homo sapien
tgtgtgatcactgccaaaccattta

SEQ ID NO: 439237 - DNA, 25 bp, Homo sapien
actgccaaaccatttaacttctctg

SEQ ID NO: 439238 - DNA, 25 bp, Homo sapien
atcattctgttgtcaatataactta

SEQ ID NO: 439239 - DNA, 25 bp, Homo sapien
atgttatttccattctgtagccaaa

SEQ ID NO: 439240 - DNA, 25 bp, Homo sapien
atttccattctgtagccaaactgaa

SEQ ID NO: 439241 - DNA, 25 bp, Homo sapien
tgctttctcttcttactgtcccaca

SEQ ID NO: 439242 - DNA, 25 bp, Homo sapien
tactgtcccacagcttggtttcatg

SEQ ID NO: 439243 - DNA, 25 bp, Homo sapien
gtcccacagcttggtttcatgttac

SEQ ID NO: 439244 - DNA, 25 bp, Homo sapien
ttacaaacagaaaagctcgaggctc

SEQ ID NO: 439245 - DNA, 25 bp, Homo sapien
aacagaaaagctcgaggctcccacc

SEQ ID NO: 439246 - DNA, 25 bp, Homo sapien
caccacaaagttgccacaggttttc

SEQ ID NO: 439247 - DNA, 25 bp, Homo sapien
aagttgccacaggttttctttgtat

SEQ ID NO: 439248 - DNA, 25 bp, Homo sapien
gccacaggttttctttgtatagaat

SEQ ID NO: 439249 - DNA, 25 bp, Homo sapien
tattttgaagctctattttaatagt

SEQ ID NO: 439250 - DNA, 25 bp, Homo sapien
agaaagtctactattgtaagagttc

SEQ ID NO: 439251 - DNA, 25 bp, Homo sapien
aaaaactgaatgtactgatttagaa

SEQ ID NO: 439252 - DNA, 25 bp, Homo sapien
agagatggtatatagaattcatatc

SEQ ID NO: 439253 - DNA, 25 bp, Homo sapien
gtgagcttatcaaatttgttctggc

SEQ ID NO: 439254 - DNA, 25 bp, Homo sapien
gcttatcaaatttgttctggctttt

SEQ ID NO: 439255 - DNA, 25 bp, Homo sapien
gttctggcttttttggcactaaggc

SEQ ID NO: 439256 - DNA, 25 bp, Homo sapien
tctggcttttttggcactaaggcaa

SEQ ID NO: 439257 - DNA, 25 bp, Homo sapien
gcactaaggcaaaaacatgttaacc

SEQ ID NO: 439258 - DNA, 25 bp, Homo sapien
ttacacttatgttcctttgcttata

SEQ ID NO: 439259 - DNA, 25 bp, Homo sapien
ttatgttcctttgcttataacccaa

SEQ ID NO: 439260 - DNA, 25 bp, Homo sapien
tgttcctttgcttataacccaattt

SEQ ID NO: 439261 - DNA, 25 bp, Homo sapien
tcctttgcttataacccaatttctt

SEQ ID NO: 439262 - DNA, 25 bp, Homo sapien
gttacttaagcaaatatcaattatg

SEQ ID NO: 439263 - DNA, 25 bp, Homo sapien
tataaggagtttccccttacacttg

SEQ ID NO: 439264 - DNA, 25 bp, Homo sapien
ggagtttccccttacacttggctct

SEQ ID NO: 439265 - DNA, 25 bp, Homo sapien
attctcccttgcctgcagccatgta

SEQ ID NO: 439266 - DNA, 25 bp, Homo sapien
tgcagccatgtaagacaggcctttc

SEQ ID NO: 439267 - DNA, 25 bp, Homo sapien
ggactaatacaacataattgacact

SEQ ID NO: 439268 - DNA, 25 bp, Homo sapien
gacacttcagaatttctcgaactta

SEQ ID NO: 439269 - DNA, 25 bp, Homo sapien
gaatttctcgaacttacctaaactg

SEQ ID NO: 439270 - DNA, 25 bp, Homo sapien
acttacctaaactgatcatatattt

SEQ ID NO: 439271 - DNA, 25 bp, Homo sapien
ctgatcatatatttaaggcaagtct

SEQ ID NO: 439272 - DNA, 25 bp, Homo sapien
gatcatatatttaaggcaagtctct

SEQ ID NO: 439273 - DNA, 25 bp, Homo sapien
atcatatatttaaggcaagtctcta

SEQ ID NO: 439274 - DNA, 25 bp, Homo sapien
actttctactttatctgatatggat

SEQ ID NO: 439275 - DNA, 25 bp, Homo sapien
atggatatcgtctacttcctcattc

SEQ ID NO: 439276 - DNA, 25 bp, Homo sapien
ttcctcattcctttatgctcactta

SEQ ID NO: 439277 - DNA, 25 bp, Homo sapien
atgctcacttatggagtagttacat

SEQ ID NO: 439278 - DNA, 25 bp, Homo sapien
gaaatataactcttggtggtactgt

SEQ ID NO: 439279 - DNA, 25 bp, Homo sapien
taactcttggtggtactgtatttta

SEQ ID NO: 439280 - DNA, 25 bp, Homo sapien
gtacatgtacaggacaccattcaaa

SEQ ID NO: 439281 - DNA, 25 bp, Homo sapien
ggacaccattcaaaatggcttgaaa

SEQ ID NO: 439282 - DNA, 25 bp, Homo sapien
aatattcagcatgtttgttatttgc

SEQ ID NO: 439283 - DNA, 25 bp, Homo sapien
gaatttctccttccttgagatcaat

SEQ ID NO: 439284 - DNA, 25 bp, Homo sapien
ccttgagatcaattaaacagcagaa

SEQ ID NO: 439285 - DNA, 25 bp, Homo sapien
ttctgacagccccttaaatttgaag

SEQ ID NO: 439286 - DNA, 25 bp, Homo sapien
gttaaggttatcacatccctgccaa

SEQ ID NO: 439287 - DNA, 25 bp, Homo sapien
tcacatccctgccaattttactaga

SEQ ID NO: 439288 - DNA, 25 bp, Homo sapien
gccaattttactagattttttcaga

SEQ ID NO: 439289 - DNA, 25 bp, Homo sapien
tttcagagacaagcattcagcatgg

SEQ ID NO: 439290 - DNA, 25 bp, Homo sapien
agcattcagcatggcattagtaatg

SEQ ID NO: 439291 - DNA, 25 bp, Homo sapien
gatggtttaaactaggtgcagaact

SEQ ID NO: 439292 - DNA, 25 bp, Homo sapien
actaggtgcagaactgtcccatgaa

SEQ ID NO: 439293 - DNA, 25 bp, Homo sapien
gacaatgtatggtttatagtgattc

SEQ ID NO: 439294 - DNA, 25 bp, Homo sapien
agtgattcattttaagattgctgta

SEQ ID NO: 439295 - DNA, 25 bp, Homo sapien
aagattgctgtattttgattttgtg

SEQ ID NO: 439296 - DNA, 25 bp, Homo sapien
cccctgctgtctgatgacatcttga

SEQ ID NO: 439297 - DNA, 25 bp, Homo sapien
ccctgctgtctgatgacatcttgaa

SEQ ID NO: 439298 - DNA, 25 bp, Homo sapien
tgctgtctgatgacatcttgaaatt

SEQ ID NO: 439299 - DNA, 25 bp, Homo sapien
gctgtctgatgacatcttgaaatta

SEQ ID NO: 439300 - DNA, 25 bp, Homo sapien
ctgtctgatgacatcttgaaattag

SEQ ID NO: 439301 - DNA, 25 bp, Homo sapien
gtctgatgacatcttgaaattagaa

SEQ ID NO: 439302 - DNA, 25 bp, Homo sapien
gatgacatcttgaaattagaagctt

SEQ ID NO: 439303 - DNA, 25 bp, Homo sapien
gacatcttgaaattagaagcttagg

SEQ ID NO: 439304 - DNA, 25 bp, Homo sapien
atcttgaaattagaagcttaggccg

SEQ ID NO: 439305 - DNA, 25 bp, Homo sapien
tcttgaaattagaagcttaggccgg

SEQ ID NO: 439306 - DNA, 25 bp, Homo sapien
ttgaaattagaagcttaggccgggt

SEQ ID NO: 439307 - DNA, 25 bp, Homo sapien
tttaattgacatactgtgcctacag

SEQ ID NO: 439308 - DNA, 25 bp, Homo sapien
cctacagtgatgtgtgaggctacaa

SEQ ID NO: 439309 - DNA, 25 bp, Homo sapien
gggacccatgttttaataatgcttt

SEQ ID NO: 439310 - DNA, 25 bp, Homo sapien
gctacaaagattcaacaacctggtt

SEQ ID NO: 439311 - DNA, 25 bp, Homo sapien
acctggttcagctatgttattacta

SEQ ID NO: 439312 - DNA, 25 bp, Homo sapien
gttattactattgctcctcttgatt

SEQ ID NO: 439313 - DNA, 25 bp, Homo sapien
attgatgcaatgtttcactgctttc

SEQ ID NO: 439314 - DNA, 25 bp, Homo sapien
atgtttcactgctttcacagcttga

SEQ ID NO: 439315 - DNA, 25 bp, Homo sapien
actgctttcacagcttgagtgagat

SEQ ID NO: 439316 - DNA, 25 bp, Homo sapien
gaaaactaacaaaagctaccctgat

SEQ ID NO: 439317 - DNA, 25 bp, Homo sapien
agaatatcttcattattttaccaag

SEQ ID NO: 439318 - DNA, 25 bp, Homo sapien
ggaacttcctgagctctattgcatc

SEQ ID NO: 439319 - DNA, 25 bp, Homo sapien
acttcctgagctctattgcatcaag

SEQ ID NO: 439320 - DNA, 25 bp, Homo sapien
ctgagctctattgcatcaaggaagt

SEQ ID NO: 439321 - DNA, 25 bp, Homo sapien
gctctattgcatcaaggaagtttat

SEQ ID NO: 439322 - DNA, 25 bp, Homo sapien
ggaagtttattcattacacaaagca

SEQ ID NO: 439323 - DNA, 25 bp, Homo sapien
attcattacacaaagcaggctgcac

SEQ ID NO: 439324 - DNA, 25 bp, Homo sapien
agcaggctgcacaacttcattcctt

SEQ ID NO: 439325 - DNA, 25 bp, Homo sapien
aggctgcacaacttcattccttctt

SEQ ID NO: 439326 - DNA, 25 bp, Homo sapien
acaacttcattccttcttttcatgt

SEQ ID NO: 439327 - DNA, 25 bp, Homo sapien
aaagcagaatactagcctggaaaag

SEQ ID NO: 439328 - DNA, 25 bp, Homo sapien
ttagccgcgagtggtgttgtacacc

SEQ ID NO: 439329 - DNA, 25 bp, Homo sapien
gtcctgagccaatccgtggaaggta

SEQ ID NO: 439330 - DNA, 25 bp, Homo sapien
aatccgtggaaggtaaaagctgctt

SEQ ID NO: 439331 - DNA, 25 bp, Homo sapien
aagctgcttcctgttgggacacgag

SEQ ID NO: 439332 - DNA, 25 bp, Homo sapien
cgccaaacctttagctcaagtctta

SEQ ID NO: 439333 - DNA, 25 bp, Homo sapien
agtcttaatgactgtcctctctgtg

SEQ ID NO: 439334 - DNA, 25 bp, Homo sapien
atgactgtcctctctgtggttctaa

SEQ ID NO: 439335 - DNA, 25 bp, Homo sapien
tctgtggttctaatccgagctccag

SEQ ID NO: 439336 - DNA, 25 bp, Homo sapien
gcacgttcgaggagggctaagccca

SEQ ID NO: 439337 - DNA, 25 bp, Homo sapien
gctaagcccagcgtgaggctcgttg

SEQ ID NO: 439338 - DNA, 25 bp, Homo sapien
aggctcgttggctcgacagaggcac

SEQ ID NO: 439339 - DNA, 25 bp, Homo sapien
ggcacgtgacgggtcctgagccaat

SEQ ID NO: 439340 - DNA, 25 bp, Homo sapien
atttcatgtcatgtcacagtgtaca

SEQ ID NO: 439341 - DNA, 25 bp, Homo sapien
atgtcacagtgtacaagctaccctc

SEQ ID NO: 439342 - DNA, 25 bp, Homo sapien
gtacaagctaccctctaattcagaa

SEQ ID NO: 439343 - DNA, 25 bp, Homo sapien
agaagagcattttgcacagagaaaa

SEQ ID NO: 439344 - DNA, 25 bp, Homo sapien
tcagttggctgatgttggaattttt

SEQ ID NO: 439345 - DNA, 25 bp, Homo sapien
tgaacttgtaaaccaatcttgccaa

SEQ ID NO: 439346 - DNA, 25 bp, Homo sapien
tttggtttttcactacaatgacctc

SEQ ID NO: 439347 - DNA, 25 bp, Homo sapien
ttcctcctgtcttgactgctgacgt

SEQ ID NO: 439348 - DNA, 25 bp, Homo sapien
ctgctgacgttcctcaatgattcta

SEQ ID NO: 439349 - DNA, 25 bp, Homo sapien
attgtctattttatgggaagcagcc

SEQ ID NO: 439350 - DNA, 25 bp, Homo sapien
aagcagccttcccataggtttcctt

SEQ ID NO: 439351 - DNA, 25 bp, Homo sapien
ctaatgttgcttggataaagctcaa

SEQ ID NO: 439352 - DNA, 25 bp, Homo sapien
gctcaaatttttccatatgaaccat

SEQ ID NO: 439353 - DNA, 25 bp, Homo sapien
ttccatatttattagttcagcacca

SEQ ID NO: 439354 - DNA, 25 bp, Homo sapien
gcaccaagtatataataggccctca

SEQ ID NO: 439355 - DNA, 25 bp, Homo sapien
ggccctcattaaataatagccctgt

SEQ ID NO: 439356 - DNA, 25 bp, Homo sapien
tagccctgtttggttttcctatatt

SEQ ID NO: 439357 - DNA, 25 bp, Homo sapien
gtaggcttatagattattaacgttg

SEQ ID NO: 439358 - DNA, 25 bp, Homo sapien
attaacgttgaaatagctctatgtt

SEQ ID NO: 439359 - DNA, 25 bp, Homo sapien
aatagctctatgttcaatgataaaa

SEQ ID NO: 439360 - DNA, 25 bp, Homo sapien
aatacacttccagctttccacattt

SEQ ID NO: 439361 - DNA, 25 bp, Homo sapien
ttccagctttccacatttacttttg

SEQ ID NO: 439362 - DNA, 25 bp, Homo sapien
ggtaggtaactttccaggccccatg

SEQ ID NO: 439363 - DNA, 25 bp, Homo sapien
ggtaactttccaggccccatggaag

SEQ ID NO: 439364 - DNA, 25 bp, Homo sapien
caggccccatggaagaaccctaaag

SEQ ID NO: 439365 - DNA, 25 bp, Homo sapien
tggaagaaccctaaagcctgtttgg

SEQ ID NO: 439366 - DNA, 25 bp, Homo sapien
aagcctgtttggaaacgagggtatg

SEQ ID NO: 439367 - DNA, 25 bp, Homo sapien
gtatgagtggattatgttttcagta

SEQ ID NO: 439368 - DNA, 25 bp, Homo sapien
agtagctcaaccaagacctcaaatc

SEQ ID NO: 439369 - DNA, 25 bp, Homo sapien
agacctcaaatcaaaacaagctatg

SEQ ID NO: 439370 - DNA, 25 bp, Homo sapien
aaaatgtctgtcatgggagggctgt

SEQ ID NO: 439371 - DNA, 25 bp, Homo sapien
gaaacatattctaaatgtcctgtga

SEQ ID NO: 439372 - DNA, 25 bp, Homo sapien
tgtcctgtgaagtgggaaattctat

SEQ ID NO: 439373 - DNA, 25 bp, Homo sapien
gaaaaactttatacgcaaacacaat

SEQ ID NO: 439374 - DNA, 25 bp, Homo sapien
gattgccatctgaaaatagatatcg

SEQ ID NO: 439375 - DNA, 25 bp, Homo sapien
aatggatctggacttgcaattgata

SEQ ID NO: 439376 - DNA, 25 bp, Homo sapien
ctggacttgcaattgatagaataat

SEQ ID NO: 439377 - DNA, 25 bp, Homo sapien
ttttagaacagtatcaaacagaatc

SEQ ID NO: 439378 - DNA, 25 bp, Homo sapien
aatctggttatattgaaattccgga

SEQ ID NO: 439379 - DNA, 25 bp, Homo sapien
gaaattccggaagtattaattccat

SEQ ID NO: 439380 - DNA, 25 bp, Homo sapien
aatagatatcgtgaagtatcttcaa

SEQ ID NO: 439381 - DNA, 25 bp, Homo sapien
gtatcttcaatttctatttgtggtg

SEQ ID NO: 439382 - DNA, 25 bp, Homo sapien
tctatttgtggtgattttcaagcac

SEQ ID NO: 439383 - DNA, 25 bp, Homo sapien
agcacaaagaatgaaacttcgttat

SEQ ID NO: 439384 - DNA, 25 bp, Homo sapien
ggaaattgcttctggaaaatactag

SEQ ID NO: 439385 - DNA, 25 bp, Homo sapien
aatcactcaggaattcaagcaaact

SEQ ID NO: 439386 - DNA, 25 bp, Homo sapien
atatgttttgtttgtctgctctctt

SEQ ID NO: 439387 - DNA, 25 bp, Homo sapien
ttgtttgtctgctctcttaaataaa

SEQ ID NO: 439388 - DNA, 25 bp, Homo sapien
agaactagccattaagactgttaag

SEQ ID NO: 439389 - DNA, 25 bp, Homo sapien
agactgttaagttctcaattataaa

SEQ ID NO: 439390 - DNA, 25 bp, Homo sapien
ggaggatttatttgcccttgcttat

SEQ ID NO: 439391 - DNA, 25 bp, Homo sapien
atttgcccttgcttatatgaactgc

SEQ ID NO: 439392 - DNA, 25 bp, Homo sapien
gcaaactggatgttttaaccactgt

SEQ ID NO: 439393 - DNA, 25 bp, Homo sapien
ggatgttttaaccactgttcagctt

SEQ ID NO: 439394 - DNA, 25 bp, Homo sapien
actgttcagctttcttatggaatga

SEQ ID NO: 439395 - DNA, 25 bp, Homo sapien
attcaaagcctccacgactctgttt

SEQ ID NO: 439396 - DNA, 25 bp, Homo sapien
ttcaaagcctccacgactctgtttc

SEQ ID NO: 439397 - DNA, 25 bp, Homo sapien
tcaaagcctccacgactctgtttcc

SEQ ID NO: 439398 - DNA, 25 bp, Homo sapien
caaagcctccacgactctgtttccc

SEQ ID NO: 439399 - DNA, 25 bp, Homo sapien
cttgagtctcagtacgagtgtgcgt

SEQ ID NO: 439400 - DNA, 25 bp, Homo sapien
ttgagtctcagtacgagtgtgcgtg

SEQ ID NO: 439401 - DNA, 25 bp, Homo sapien
tgagtctcagtacgagtgtgcgtga

SEQ ID NO: 439402 - DNA, 25 bp, Homo sapien
gagtctcagtacgagtgtgcgtgag

SEQ ID NO: 439403 - DNA, 25 bp, Homo sapien
agtctcagtacgagtgtgcgtgagt

SEQ ID NO: 439404 - DNA, 25 bp, Homo sapien
tgtgagccaccttggcaagtgcctg

SEQ ID NO: 439405 - DNA, 25 bp, Homo sapien
ggagatcacagtttgcaaaactttt

SEQ ID NO: 439406 - DNA, 25 bp, Homo sapien
gcaaaacttttatgtggaccttggt

SEQ ID NO: 439407 - DNA, 25 bp, Homo sapien
ggaccttggtactgggatcttgaga

SEQ ID NO: 439408 - DNA, 25 bp, Homo sapien
gatcttgagatcctttgccatggag

SEQ ID NO: 439409 - DNA, 25 bp, Homo sapien
ttgccatggaggtgcatcttcttga

SEQ ID NO: 439410 - DNA, 25 bp, Homo sapien
atcttcttgagatgtttacacagag

SEQ ID NO: 439411 - DNA, 25 bp, Homo sapien
gtttacacagagaacagactaacag

SEQ ID NO: 439412 - DNA, 25 bp, Homo sapien
gaaaagatatcagggttacagtaaa

SEQ ID NO: 439413 - DNA, 25 bp, Homo sapien
agaacagctgaatccaatagcttgg

SEQ ID NO: 439414 - DNA, 25 bp, Homo sapien
gcttggcagaacatgaagacaggtt

SEQ ID NO: 439415 - DNA, 25 bp, Homo sapien
tgttttccagattcttaaaactcca

SEQ ID NO: 439416 - DNA, 25 bp, Homo sapien
catgggcatccctgcttgttttgga

SEQ ID NO: 439417 - DNA, 25 bp, Homo sapien
atccctgcttgttttggagccatgg

SEQ ID NO: 439418 - DNA, 25 bp, Homo sapien
tgggaggaccccagctctccgactg

SEQ ID NO: 439419 - DNA, 25 bp, Homo sapien
tctccgactggtgtttgcttctctg

SEQ ID NO: 439420 - DNA, 25 bp, Homo sapien
tgcttctctgccatcagggtcggga

SEQ ID NO: 439421 - DNA, 25 bp, Homo sapien
catcagggtcgggaggccatgccaa

SEQ ID NO: 439422 - DNA, 25 bp, Homo sapien
ttgtgatttgcagagtccatgagac

SEQ ID NO: 439423 - DNA, 25 bp, Homo sapien
atgagacaggaacactcccaccaca

SEQ ID NO: 439424 - DNA, 25 bp, Homo sapien
agccagaatgtagctgactcctttc

SEQ ID NO: 439425 - DNA, 25 bp, Homo sapien
gaatgtagctgactcctttcttctc

SEQ ID NO: 439426 - DNA, 25 bp, Homo sapien
ttgcatgcttccaagccttcaaaac

SEQ ID NO: 439427 - DNA, 25 bp, Homo sapien
ccagctggctaggagtcatatgatg

SEQ ID NO: 439428 - DNA, 25 bp, Homo sapien
aggagtcatatgatgctcctttaat

SEQ ID NO: 439429 - DNA, 25 bp, Homo sapien
aatgtatccttgaagtcacagaatc

SEQ ID NO: 439430 - DNA, 25 bp, Homo sapien
aacccaggactctctggtttccaag

SEQ ID NO: 439431 - DNA, 25 bp, Homo sapien
tccaaggcctttttaatttcacttg

SEQ ID NO: 439432 - DNA, 25 bp, Homo sapien
ttttaatttcacttgaccccacatg

SEQ ID NO: 439433 - DNA, 25 bp, Homo sapien
acttgaccccacatgactaacattg

SEQ ID NO: 439434 - DNA, 25 bp, Homo sapien
ggaatgcttacatcatctgttttca

SEQ ID NO: 439435 - DNA, 25 bp, Homo sapien
tgggagatatcttagaccatatgaa

SEQ ID NO: 439436 - DNA, 25 bp, Homo sapien
gaccatatgaagaatagcccatgtt

SEQ ID NO: 439437 - DNA, 25 bp, Homo sapien
tgtgaacatcttttaaggttccaga

SEQ ID NO: 439438 - DNA, 25 bp, Homo sapien
tgggctgggctctggtgccctcttc

SEQ ID NO: 439439 - DNA, 25 bp, Homo sapien
ggctgggctctggtgccctcttccc

SEQ ID NO: 439440 - DNA, 25 bp, Homo sapien
tcctgattcccttggcaccttgtct

SEQ ID NO: 439441 - DNA, 25 bp, Homo sapien
tgattcccttggcaccttgtctttc

SEQ ID NO: 439442 - DNA, 25 bp, Homo sapien
gattcccttggcaccttgtctttct

SEQ ID NO: 439443 - DNA, 25 bp, Homo sapien
tgcatcttttgcagcccactctgac

SEQ ID NO: 439444 - DNA, 25 bp, Homo sapien
ttttgcagcccactctgacttccat

SEQ ID NO: 439445 - DNA, 25 bp, Homo sapien
tttgcagcccactctgacttccatc

SEQ ID NO: 439446 - DNA, 25 bp, Homo sapien
ctctgacttccatctgggggctgag

SEQ ID NO: 439447 - DNA, 25 bp, Homo sapien
tgacttccatctgggggctgagacc

SEQ ID NO: 439448 - DNA, 25 bp, Homo sapien
acttccatctgggggctgagaccac

SEQ ID NO: 439449 - DNA, 25 bp, Homo sapien
gcgctaagtaaacaggctaccctga

SEQ ID NO: 439450 - DNA, 25 bp, Homo sapien
ggctaccctgagaggaatctacatg

SEQ ID NO: 439451 - DNA, 25 bp, Homo sapien
tacatgcagagaagttcaggagact

SEQ ID NO: 439452 - DNA, 25 bp, Homo sapien
tcaggagactgaactaacggaacgt

SEQ ID NO: 439453 - DNA, 25 bp, Homo sapien
taacggaacgtcaggaagcgctgcg

SEQ ID NO: 439454 - DNA, 25 bp, Homo sapien
tgaaacttctcagcaggcgcatcta

SEQ ID NO: 439455 - DNA, 25 bp, Homo sapien
aggcgcatctacactagtgacctga

SEQ ID NO: 439456 - DNA, 25 bp, Homo sapien
ctagtgacctgaggagagaaaccta

SEQ ID NO: 439457 - DNA, 25 bp, Homo sapien
taagcccacaatggtgcatcttctc

SEQ ID NO: 439458 - DNA, 25 bp, Homo sapien
tggtgcatcttctctgaagacgaga

SEQ ID NO: 439459 - DNA, 25 bp, Homo sapien
gaagacgagactgatgctcatcttt

SEQ ID NO: 439460 - DNA, 25 bp, Homo sapien
tagatatacctacttgctgtgaaat

SEQ ID NO: 439461 - DNA, 25 bp, Homo sapien
ttttctgtgcattacattagccatg

SEQ ID NO: 439462 - DNA, 25 bp, Homo sapien
gaaggtttattatgagattcccata

SEQ ID NO: 439463 - DNA, 25 bp, Homo sapien
gagattcccatatttggctcaaggt

SEQ ID NO: 439464 - DNA, 25 bp, Homo sapien
tttggctcaaggttttatacaactt

SEQ ID NO: 439465 - DNA, 25 bp, Homo sapien
atacaacttgatatgctacctacta

SEQ ID NO: 439466 - DNA, 25 bp, Homo sapien
gctacctactactagtcttccagtt

SEQ ID NO: 439467 - DNA, 25 bp, Homo sapien
cttccagttccactattgcaactag

SEQ ID NO: 439468 - DNA, 25 bp, Homo sapien
atacattgtacttattgtgtgccag

SEQ ID NO: 439469 - DNA, 25 bp, Homo sapien
caggctctgttctgactgctttata

SEQ ID NO: 439470 - DNA, 25 bp, Homo sapien
ctgactgctttatatgtatctactc

SEQ ID NO: 439471 - DNA, 25 bp, Homo sapien
agactggactgccccgatcgggcac

SEQ ID NO: 439472 - DNA, 25 bp, Homo sapien
acatcctacctctgaggcgcttcct

SEQ ID NO: 439473 - DNA, 25 bp, Homo sapien
cgcgccagaagttgccacccttttg

SEQ ID NO: 439474 - DNA, 25 bp, Homo sapien
agttgccacccttttgccagcaggg

SEQ ID NO: 439475 - DNA, 25 bp, Homo sapien
atgcagggactcgtgagtaccgaga

SEQ ID NO: 439476 - DNA, 25 bp, Homo sapien
gggactcgtgagtaccgagagcctt

SEQ ID NO: 439477 - DNA, 25 bp, Homo sapien
gagcaggctcctgcgggactatgcc

SEQ ID NO: 439478 - DNA, 25 bp, Homo sapien
acaggcaggcgcctggaggacagca

SEQ ID NO: 439479 - DNA, 25 bp, Homo sapien
tggaggacagcagccagcagcttgg

SEQ ID NO: 439480 - DNA, 25 bp, Homo sapien
agcagcttggcgaccaagagccact

SEQ ID NO: 439481 - DNA, 25 bp, Homo sapien
tggcgaccaagagccactaggttcc

SEQ ID NO: 439482 - DNA, 25 bp, Homo sapien
gctgccgctgcttcctaggaggccg

SEQ ID NO: 439483 - DNA, 25 bp, Homo sapien
agacggcggcgcaggccaggtcgtt

SEQ ID NO: 439484 - DNA, 25 bp, Homo sapien
gacggcggcgcaggccaggtcgttc

SEQ ID NO: 439485 - DNA, 25 bp, Homo sapien
cggcggcgcaggccaggtcgttcag

SEQ ID NO: 439486 - DNA, 25 bp, Homo sapien
tcccgcggcgggacgtgcaagtcct

SEQ ID NO: 439487 - DNA, 25 bp, Homo sapien
gcggcgggacgtgcaagtcctggat

SEQ ID NO: 439488 - DNA, 25 bp, Homo sapien
ggcgggacgtgcaagtcctggatga

SEQ ID NO: 439489 - DNA, 25 bp, Homo sapien
agtcctggatgacctcgtagacgtt

SEQ ID NO: 439490 - DNA, 25 bp, Homo sapien
gtcctggatgacctcgtagacgttc

SEQ ID NO: 439491 - DNA, 25 bp, Homo sapien
gtcgctgcgcgccagaggccgcggg

SEQ ID NO: 439492 - DNA, 25 bp, Homo sapien
agaggccgcgggcacacccaggagc

SEQ ID NO: 439493 - DNA, 25 bp, Homo sapien
aacttgagaatcatgttgaagctaa

SEQ ID NO: 439494 - DNA, 25 bp, Homo sapien
ccatatgcaaagaccatgcgccgga

SEQ ID NO: 439495 - DNA, 25 bp, Homo sapien
atgcaaagaccatgcgccggaacac

SEQ ID NO: 439496 - DNA, 25 bp, Homo sapien
ggaacaccattcttcgccaggccag

SEQ ID NO: 439497 - DNA, 25 bp, Homo sapien
tcttcgccaggccaggaatcacaag

SEQ ID NO: 439498 - DNA, 25 bp, Homo sapien
tgcagcagcggcactacaagccaaa

SEQ ID NO: 439499 - DNA, 25 bp, Homo sapien
gcggcactacaagccaaatcagatg

SEQ ID NO: 439500 - DNA, 25 bp, Homo sapien
tacaatcttcccatgcacaagatga

SEQ ID NO: 439501 - DNA, 25 bp, Homo sapien
atacagatcttagcagaatcttgaa

SEQ ID NO: 439502 - DNA, 25 bp, Homo sapien
agcagaatcttgaaaagcccagaga

SEQ ID NO: 439503 - DNA, 25 bp, Homo sapien
tgaaaagcccagagatccaaagagc

SEQ ID NO: 439504 - DNA, 25 bp, Homo sapien
taaaaaacaactatggatcagaata

SEQ ID NO: 439505 - DNA, 25 bp, Homo sapien
aaaaacaactatggatcagaatagc

SEQ ID NO: 439506 - DNA, 25 bp, Homo sapien
actttttgttatcagtcaatatttt

SEQ ID NO: 439507 - DNA, 25 bp, Homo sapien
tttacaactgcctcgacacacataa

SEQ ID NO: 439508 - DNA, 25 bp, Homo sapien
ttacaactgcctcgacacacataaa

SEQ ID NO: 439509 - DNA, 25 bp, Homo sapien
tacaactgcctcgacacacataaac

SEQ ID NO: 439510 - DNA, 25 bp, Homo sapien
aactgcctcgacacacataaacctt

SEQ ID NO: 439511 - DNA, 25 bp, Homo sapien
actgcctcgacacacataaaccttt

SEQ ID NO: 439512 - DNA, 25 bp, Homo sapien
ctgcctcgacacacataaacctttt

SEQ ID NO: 439513 - DNA, 25 bp, Homo sapien
tgcctcgacacacataaaccttttt

SEQ ID NO: 439514 - DNA, 25 bp, Homo sapien
gcctcgacacacataaaccttttta

SEQ ID NO: 439515 - DNA, 25 bp, Homo sapien
agattatagatatgagcctctgcac

SEQ ID NO: 439516 - DNA, 25 bp, Homo sapien
atagatatgagcctctgcactcagc

SEQ ID NO: 439517 - DNA, 25 bp, Homo sapien
cttggtatgtgtcgtaacagaacac

SEQ ID NO: 439518 - DNA, 25 bp, Homo sapien
gtcgtaacagaacacactaggagca

SEQ ID NO: 439519 - DNA, 25 bp, Homo sapien
gaacacactaggagcaagtaagaat

SEQ ID NO: 439520 - DNA, 25 bp, Homo sapien
agcctagttggtgatatgatatggt

SEQ ID NO: 439521 - DNA, 25 bp, Homo sapien
ggtgatatgatatggttggcctaag

SEQ ID NO: 439522 - DNA, 25 bp, Homo sapien
tatggttggcctaaggttagaggat

SEQ ID NO: 439523 - DNA, 25 bp, Homo sapien
tggtcccaaactttttgccccatgt

SEQ ID NO: 439524 - DNA, 25 bp, Homo sapien
tcccaaactttttgccccatgtgat

SEQ ID NO: 439525 - DNA, 25 bp, Homo sapien
caaactttttgccccatgtgatttt

SEQ ID NO: 439526 - DNA, 25 bp, Homo sapien
atatattatcttattttactatttg

SEQ ID NO: 439527 - DNA, 25 bp, Homo sapien
ttactatttgatgttataattgtta

SEQ ID NO: 439528 - DNA, 25 bp, Homo sapien
tatatatttttccatacttcctcat

SEQ ID NO: 439529 - DNA, 25 bp, Homo sapien
atatatttttccatacttcctcata

SEQ ID NO: 439530 - DNA, 25 bp, Homo sapien
tatatttttccatacttcctcatac

SEQ ID NO: 439531 - DNA, 25 bp, Homo sapien
atatttttccatacttcctcatact

SEQ ID NO: 439532 - DNA, 25 bp, Homo sapien
tatttttccatacttcctcatactg

SEQ ID NO: 439533 - DNA, 25 bp, Homo sapien
atttttccatacttcctcatactgc

SEQ ID NO: 439534 - DNA, 25 bp, Homo sapien
tttttccatacttcctcatactgct

SEQ ID NO: 439535 - DNA, 25 bp, Homo sapien
ttttccatacttcctcatactgctt

SEQ ID NO: 439536 - DNA, 25 bp, Homo sapien
cctcatactgcttatctcttactta

SEQ ID NO: 439537 - DNA, 25 bp, Homo sapien
gagggctgtggcttagcgcctaccc

SEQ ID NO: 439538 - DNA, 25 bp, Homo sapien
aacagagagcctgccaatggcacca

SEQ ID NO: 439539 - DNA, 25 bp, Homo sapien
agagagcctgccaatggcaccaacc

SEQ ID NO: 439540 - DNA, 25 bp, Homo sapien
tctgctgagctgcaccgtagtccta

SEQ ID NO: 439541 - DNA, 25 bp, Homo sapien
accgtagtcctagcctcctataagg

SEQ ID NO: 439542 - DNA, 25 bp, Homo sapien
tcctagcctcctataaggcccagga

SEQ ID NO: 439543 - DNA, 25 bp, Homo sapien
ccagaaggactccatggcccaaaga

SEQ ID NO: 439544 - DNA, 25 bp, Homo sapien
agaaggactccatggcccaaagacc

SEQ ID NO: 439545 - DNA, 25 bp, Homo sapien
tgcaggcactgtgggaacagacaca

SEQ ID NO: 439546 - DNA, 25 bp, Homo sapien
ctgagaggacgaagccaaggaaatt

SEQ ID NO: 439547 - DNA, 25 bp, Homo sapien
ccaaggaaattagggaggagagtca

SEQ ID NO: 439548 - DNA, 25 bp, Homo sapien
gtaaattcaacctcaataaagtata

SEQ ID NO: 439549 - DNA, 25 bp, Homo sapien
taaattcaacctcaataaagtatat

SEQ ID NO: 439550 - DNA, 25 bp, Homo sapien
aaattcaacctcaataaagtatatt

SEQ ID NO: 439551 - DNA, 25 bp, Homo sapien
aattcaacctcaataaagtatattt

SEQ ID NO: 439552 - DNA, 25 bp, Homo sapien
attcaacctcaataaagtatatttg

SEQ ID NO: 439553 - DNA, 25 bp, Homo sapien
ttcaacctcaataaagtatatttga

SEQ ID NO: 439554 - DNA, 25 bp, Homo sapien
tcaacctcaataaagtatatttgaa

SEQ ID NO: 439555 - DNA, 25 bp, Homo sapien
caacctcaataaagtatatttgaaa

SEQ ID NO: 439556 - DNA, 25 bp, Homo sapien
atcattgacctctgtgctttcattc

SEQ ID NO: 439557 - DNA, 25 bp, Homo sapien
gacctctgtgctttcattcctagag

SEQ ID NO: 439558 - DNA, 25 bp, Homo sapien
gagatgttttatagttacatgagca

SEQ ID NO: 439559 - DNA, 25 bp, Homo sapien
acatgagcaaaagctgttgccccaa

SEQ ID NO: 439560 - DNA, 25 bp, Homo sapien
agctgttgccccaaagtgatggccc

SEQ ID NO: 439561 - DNA, 25 bp, Homo sapien
gaaatgccgctgtgaagtcttaaag

SEQ ID NO: 439562 - DNA, 25 bp, Homo sapien
gccgctgtgaagtcttaaagcactt

SEQ ID NO: 439563 - DNA, 25 bp, Homo sapien
gaagtcttaaagcacttctgcttaa

SEQ ID NO: 439564 - DNA, 25 bp, Homo sapien
tccttttggcaaatatacactgtaa

SEQ ID NO: 439565 - DNA, 25 bp, Homo sapien
tatacactgtaatcttgagtctaaa

SEQ ID NO: 439566 - DNA, 25 bp, Homo sapien
tatgttgaaatgctaccttttttaa

SEQ ID NO: 439567 - DNA, 25 bp, Homo sapien
gggccccagcagtaggtcggaggtg

SEQ ID NO: 439568 - DNA, 25 bp, Homo sapien
ggccccagcagtaggtcggaggtga

SEQ ID NO: 439569 - DNA, 25 bp, Homo sapien
gccccagcagtaggtcggaggtgaa

SEQ ID NO: 439570 - DNA, 25 bp, Homo sapien
cccagcagtaggtcggaggtgaagt

SEQ ID NO: 439571 - DNA, 25 bp, Homo sapien
ccagcagtaggtcggaggtgaagtc

SEQ ID NO: 439572 - DNA, 25 bp, Homo sapien
gtaggtcggaggtgaagtcgggcca

SEQ ID NO: 439573 - DNA, 25 bp, Homo sapien
taggtcggaggtgaagtcgggccag

SEQ ID NO: 439574 - DNA, 25 bp, Homo sapien
tcggaggtgaagtcgggccaggtgc

SEQ ID NO: 439575 - DNA, 25 bp, Homo sapien
tcttgggcaatacagcaaaaccgtg

SEQ ID NO: 439576 - DNA, 25 bp, Homo sapien
cttgggcaatacagcaaaaccgtgt

SEQ ID NO: 439577 - DNA, 25 bp, Homo sapien
ttgggcaatacagcaaaaccgtgtc

SEQ ID NO: 439578 - DNA, 25 bp, Homo sapien
gaccatcaagctgccagacggacat

SEQ ID NO: 439579 - DNA, 25 bp, Homo sapien
agctgccagacggacatgaattcaa

SEQ ID NO: 439580 - DNA, 25 bp, Homo sapien
catcaactacatggcggcggatgga

SEQ ID NO: 439581 - DNA, 25 bp, Homo sapien
acatggcggcggatggagacttcaa

SEQ ID NO: 439582 - DNA, 25 bp, Homo sapien
gcggcggatggagacttcaagatta

SEQ ID NO: 439583 - DNA, 25 bp, Homo sapien
gagacttcaagattaaagtgcgtgg

SEQ ID NO: 439584 - DNA, 25 bp, Homo sapien
ttccagcccgggagcatcacagagg

SEQ ID NO: 439585 - DNA, 25 bp, Homo sapien
cagcccgggagcatcacagaggtgt

SEQ ID NO: 439586 - DNA, 25 bp, Homo sapien
gggagcatcacagaggtgtgcatca

SEQ ID NO: 439587 - DNA, 25 bp, Homo sapien
gcatcacctttgaccaggctgacct

SEQ ID NO: 439588 - DNA, 25 bp, Homo sapien
caggctgacctgaccatcaagctgc

SEQ ID NO: 439589 - DNA, 25 bp, Homo sapien
atggacagcggcttcggctcggatt

SEQ ID NO: 439590 - DNA, 25 bp, Homo sapien
tggacagcggcttcggctcggattt

SEQ ID NO: 439591 - DNA, 25 bp, Homo sapien
gcttcggctcggattttggcggcac

SEQ ID NO: 439592 - DNA, 25 bp, Homo sapien
cttcggctcggattttggcggcacg

SEQ ID NO: 439593 - DNA, 25 bp, Homo sapien
ggctcggattttggcggcacgggtg

SEQ ID NO: 439594 - DNA, 25 bp, Homo sapien
tgtttccggaagtgcatcgggaagc

SEQ ID NO: 439595 - DNA, 25 bp, Homo sapien
ttccggaagtgcatcgggaagcccg

SEQ ID NO: 439596 - DNA, 25 bp, Homo sapien
gggctccttggataactcggagcag

SEQ ID NO: 439597 - DNA, 25 bp, Homo sapien
tccttggataactcggagcagaaat

SEQ ID NO: 439598 - DNA, 25 bp, Homo sapien
taactcggagcagaaatgcatcgcc

SEQ ID NO: 439599 - DNA, 25 bp, Homo sapien
ccgcgcctacaactctcgactgcag

SEQ ID NO: 439600 - DNA, 25 bp, Homo sapien
gctttaatgacagagctttctacag

SEQ ID NO: 439601 - DNA, 25 bp, Homo sapien
gacagagctttctacagtaaaggac

SEQ ID NO: 439602 - DNA, 25 bp, Homo sapien
actatcaaaagtttctgattctttg

SEQ ID NO: 439603 - DNA, 25 bp, Homo sapien
gaatcagaaaggaaaagccgctata

SEQ ID NO: 439604 - DNA, 25 bp, Homo sapien
aaagccgctatattagacttggaaa

SEQ ID NO: 439605 - DNA, 25 bp, Homo sapien
gaattaaagcatcaacttcaagtgc

SEQ ID NO: 439606 - DNA, 25 bp, Homo sapien
agatggaaaacacacttaaggaaca

SEQ ID NO: 439607 - DNA, 25 bp, Homo sapien
agaaggaggcttctcatcagttgaa

SEQ ID NO: 439608 - DNA, 25 bp, Homo sapien
tctcatcagttgaaattggaactca

SEQ ID NO: 439609 - DNA, 25 bp, Homo sapien
ttggaactcaattcaatgcaggaac

SEQ ID NO: 439610 - DNA, 25 bp, Homo sapien
aggaacaacttatacaggcccagaa

SEQ ID NO: 439611 - DNA, 25 bp, Homo sapien
tacccacgcagatttattccagtga

SEQ ID NO: 439612 - DNA, 25 bp, Homo sapien
tggaacttcaagtaactcctcccag

SEQ ID NO: 439613 - DNA, 25 bp, Homo sapien
gagtacttccaactctgggttggcc

SEQ ID NO: 439614 - DNA, 25 bp, Homo sapien
tgggttggccccaaatccaactaat

SEQ ID NO: 439615 - DNA, 25 bp, Homo sapien
aaatccaactaatgccaccaccaag

SEQ ID NO: 439616 - DNA, 25 bp, Homo sapien
ctggtggtgccctgcagtcaacagc

SEQ ID NO: 439617 - DNA, 25 bp, Homo sapien
agtcaacagccagtctcttcgtggt

SEQ ID NO: 439618 - DNA, 25 bp, Homo sapien
gcatctctactcttaagagactcag

SEQ ID NO: 439619 - DNA, 25 bp, Homo sapien
gactcaggccaagaaacgtcttcta

SEQ ID NO: 439620 - DNA, 25 bp, Homo sapien
tcttctaaatttccccatcttctaa

SEQ ID NO: 439621 - DNA, 25 bp, Homo sapien
taaacccaatccaaatggcgtctgg

SEQ ID NO: 439622 - DNA, 25 bp, Homo sapien
gtttttcaggggtcacttcacattt

SEQ ID NO: 439623 - DNA, 25 bp, Homo sapien
tttttcaggggtcacttcacatttc

SEQ ID NO: 439624 - DNA, 25 bp, Homo sapien
ttttcaggggtcacttcacatttct

SEQ ID NO: 439625 - DNA, 25 bp, Homo sapien
tttcaggggtcacttcacatttcta

SEQ ID NO: 439626 - DNA, 25 bp, Homo sapien
ttcaggggtcacttcacatttctaa

SEQ ID NO: 439627 - DNA, 25 bp, Homo sapien
tcaggggtcacttcacatttctaaa

SEQ ID NO: 439628 - DNA, 25 bp, Homo sapien
caggggtcacttcacatttctaaag

SEQ ID NO: 439629 - DNA, 25 bp, Homo sapien
aggggtcacttcacatttctaaaga

SEQ ID NO: 439630 - DNA, 25 bp, Homo sapien
ggggtcacttcacatttctaaagaa

SEQ ID NO: 439631 - DNA, 25 bp, Homo sapien
tcacttcacatttctaaagaaagag

SEQ ID NO: 439632 - DNA, 25 bp, Homo sapien
aaagaaagagtgaataggctgggca

SEQ ID NO: 439633 - DNA, 25 bp, Homo sapien
tggcccttccccttggaggcgagaa

SEQ ID NO: 439634 - DNA, 25 bp, Homo sapien
agagaatgtgctgtctatcttcctg

SEQ ID NO: 439635 - DNA, 25 bp, Homo sapien
ggttttcagtccacagagtcggtag

SEQ ID NO: 439636 - DNA, 25 bp, Homo sapien
gggaaaatctcacatctccttgtct

SEQ ID NO: 439637 - DNA, 25 bp, Homo sapien
ctcacatctccttgtctgaaaacat

SEQ ID NO: 439638 - DNA, 25 bp, Homo sapien
tgctgttctctttctaacatgttgt

SEQ ID NO: 439639 - DNA, 25 bp, Homo sapien
catgttgtggtaaatctgttcagat

SEQ ID NO: 439640 - DNA, 25 bp, Homo sapien
gttcagatactgctcatctgactgt

SEQ ID NO: 439641 - DNA, 25 bp, Homo sapien
atctgactgttttgtacatgtgaca

SEQ ID NO: 439642 - DNA, 25 bp, Homo sapien
acatgtgacaattgccttaaaacct

SEQ ID NO: 439643 - DNA, 25 bp, Homo sapien
cttaaaacctagcacagtcctcaga

SEQ ID NO: 439644 - DNA, 25 bp, Homo sapien
agtcaggagttcaccgtcaggagat

SEQ ID NO: 439645 - DNA, 25 bp, Homo sapien
gtcaggagttcaccgtcaggagatc

SEQ ID NO: 439646 - DNA, 25 bp, Homo sapien
caggagttcaccgtcaggagatcac

SEQ ID NO: 439647 - DNA, 25 bp, Homo sapien
aggagttcaccgtcaggagatcaca

SEQ ID NO: 439648 - DNA, 25 bp, Homo sapien
ggagttcaccgtcaggagatcacag

SEQ ID NO: 439649 - DNA, 25 bp, Homo sapien
gagttcaccgtcaggagatcacagg

SEQ ID NO: 439650 - DNA, 25 bp, Homo sapien
agttcaccgtcaggagatcacagga

SEQ ID NO: 439651 - DNA, 25 bp, Homo sapien
gttcaccgtcaggagatcacaggag

SEQ ID NO: 439652 - DNA, 25 bp, Homo sapien
ttcaccgtcaggagatcacaggagg

SEQ ID NO: 439653 - DNA, 25 bp, Homo sapien
tcaccgtcaggagatcacaggaggt

SEQ ID NO: 439654 - DNA, 25 bp, Homo sapien
caccgtcaggagatcacaggaggtg

SEQ ID NO: 439655 - DNA, 25 bp, Homo sapien
tgtacagcaaactgcccgtttagag

SEQ ID NO: 439656 - DNA, 25 bp, Homo sapien
ctgcccgtttagagtcctgttaata

SEQ ID NO: 439657 - DNA, 25 bp, Homo sapien
gagtcctgttaatattgatgtccta

SEQ ID NO: 439658 - DNA, 25 bp, Homo sapien
aatattgatgtcctaacactgggtc

SEQ ID NO: 439659 - DNA, 25 bp, Homo sapien
ctaacactgggtctgcttatgctag

SEQ ID NO: 439660 - DNA, 25 bp, Homo sapien
gggtctgcttatgctagttcagtat

SEQ ID NO: 439661 - DNA, 25 bp, Homo sapien
agttcagtatttggtctaggcttca

SEQ ID NO: 439662 - DNA, 25 bp, Homo sapien
tttggtctaggcttcattttgatat

SEQ ID NO: 439663 - DNA, 25 bp, Homo sapien
cattagggtttacttggttgtggca

SEQ ID NO: 439664 - DNA, 25 bp, Homo sapien
aaactttcatcgttcttagcctaca

SEQ ID NO: 439665 - DNA, 25 bp, Homo sapien
tcatcgttcttagcctacattgtca

SEQ ID NO: 439666 - DNA, 25 bp, Homo sapien
tcatccattgcattggaaactgctt

SEQ ID NO: 439667 - DNA, 25 bp, Homo sapien
aactgctttatgctgctgcagtctg

SEQ ID NO: 439668 - DNA, 25 bp, Homo sapien
ctgcagtctgcaaagtctagagctt

SEQ ID NO: 439669 - DNA, 25 bp, Homo sapien
caaagtctagagcttttatcaggcc

SEQ ID NO: 439670 - DNA, 25 bp, Homo sapien
ttatcaggccatgtcatacccaaga

SEQ ID NO: 439671 - DNA, 25 bp, Homo sapien
gtcatacccaagaaagcacctattt

SEQ ID NO: 439672 - DNA, 25 bp, Homo sapien
gaaaaaacaattccctgagctctca

SEQ ID NO: 439673 - DNA, 25 bp, Homo sapien
aactccaagttgtagatttggtgtc

SEQ ID NO: 439674 - DNA, 25 bp, Homo sapien
tttctgcctgtatttgtatgcaaaa

SEQ ID NO: 439675 - DNA, 25 bp, Homo sapien
caaaatgtcctctatctgctattaa

SEQ ID NO: 439676 - DNA, 25 bp, Homo sapien
aacactacattgtaaccttctaagt

SEQ ID NO: 439677 - DNA, 25 bp, Homo sapien
tggtgaccctgctgtgaacttcctc

SEQ ID NO: 439678 - DNA, 25 bp, Homo sapien
tcctcttttaaatgaacagctccct

SEQ ID NO: 439679 - DNA, 25 bp, Homo sapien
tttaaatgaacagctccctagagca

SEQ ID NO: 439680 - DNA, 25 bp, Homo sapien
cctagagcatccttggctgagctta

SEQ ID NO: 439681 - DNA, 25 bp, Homo sapien
gcatccttggctgagcttagcaaca

SEQ ID NO: 439682 - DNA, 25 bp, Homo sapien
ccccgttatcatgtcagtgcaatca

SEQ ID NO: 439683 - DNA, 25 bp, Homo sapien
atcatgtcagtgcaatcactgggaa

SEQ ID NO: 439684 - DNA, 25 bp, Homo sapien
caatcactgggaattatggttgagg

SEQ ID NO: 439685 - DNA, 25 bp, Homo sapien
atggttgaggattaagagtcacttg

SEQ ID NO: 439686 - DNA, 25 bp, Homo sapien
aggctggagagggaaacacacacaa

SEQ ID NO: 439687 - DNA, 25 bp, Homo sapien
cacacactcacaacataaacagatt

SEQ ID NO: 439688 - DNA, 25 bp, Homo sapien
gagaatgactattttacgtggagca

SEQ ID NO: 439689 - DNA, 25 bp, Homo sapien
tttacgtggagcatcattgtgtgac

SEQ ID NO: 439690 - DNA, 25 bp, Homo sapien
ttgtgtgactgttgacctggacagt

SEQ ID NO: 439691 - DNA, 25 bp, Homo sapien
ggacagtcccaagggctatgcagat

SEQ ID NO: 439692 - DNA, 25 bp, Homo sapien
gggctatgcagatggactccattgg

SEQ ID NO: 439693 - DNA, 25 bp, Homo sapien
cagatggactccattggcacaggga

SEQ ID NO: 439694 - DNA, 25 bp, Homo sapien
ggcacagggaggtttgacctcttcc

SEQ ID NO: 439695 - DNA, 25 bp, Homo sapien
tcccaactgtacagatttgtttgtt

SEQ ID NO: 439696 - DNA, 25 bp, Homo sapien
gtagtttatgtacttcttgatactg

SEQ ID NO: 439697 - DNA, 25 bp, Homo sapien
tggaaggcaaagcatcacatgtatt

SEQ ID NO: 439698 - DNA, 25 bp, Homo sapien
gcatcacatgtattaaattcttctg

SEQ ID NO: 439699 - DNA, 25 bp, Homo sapien
aggctctgggcgaaaagacttcgat

SEQ ID NO: 439700 - DNA, 25 bp, Homo sapien
gaaaagacttcgatgtgaagcacat

SEQ ID NO: 439701 - DNA, 25 bp, Homo sapien
atgtgaagcacattctgcgactccg

SEQ ID NO: 439702 - DNA, 25 bp, Homo sapien
acattctgcgactccgctggaaact

SEQ ID NO: 439703 - DNA, 25 bp, Homo sapien
ctgcgactccgctggaaactcttca

SEQ ID NO: 439704 - DNA, 25 bp, Homo sapien
aggctgcctgcaacaggacggcagt

SEQ ID NO: 439705 - DNA, 25 bp, Homo sapien
gcaacaggacggcagtggcagcttt

SEQ ID NO: 439706 - DNA, 25 bp, Homo sapien
agagtcgcctgctcaaaagccaaga

SEQ ID NO: 439707 - DNA, 25 bp, Homo sapien
gtcgcctgctcaaaagccaagagag

SEQ ID NO: 439708 - DNA, 25 bp, Homo sapien
tgccttctgtgcgtaaagcatgtca

SEQ ID NO: 439709 - DNA, 25 bp, Homo sapien
gcgtaaagcatgtcaggctctgggc

SEQ ID NO: 439710 - DNA, 25 bp, Homo sapien
atatattatcttattttactatttg

SEQ ID NO: 439711 - DNA, 25 bp, Homo sapien
tttactatttgatgttataattgtt

SEQ ID NO: 439712 - DNA, 25 bp, Homo sapien
ttactatttgatgttataattgtta

SEQ ID NO: 439713 - DNA, 25 bp, Homo sapien
tatatatttttccatacttcctcat

SEQ ID NO: 439714 - DNA, 25 bp, Homo sapien
atatatttttccatacttcctcata

SEQ ID NO: 439715 - DNA, 25 bp, Homo sapien
tatatttttccatacttcctcatac

SEQ ID NO: 439716 - DNA, 25 bp, Homo sapien
atatttttccatacttcctcatact

SEQ ID NO: 439717 - DNA, 25 bp, Homo sapien
tatttttccatacttcctcatactg

SEQ ID NO: 439718 - DNA, 25 bp, Homo sapien
atttttccatacttcctcatactgc

SEQ ID NO: 439719 - DNA, 25 bp, Homo sapien
tttttccatacttcctcatactgct

SEQ ID NO: 439720 - DNA, 25 bp, Homo sapien
cctcatactgcttatctcttactta

SEQ ID NO: 439721 - DNA, 25 bp, Homo sapien
atatttactcagttgaaaacgtggg

SEQ ID NO: 439722 - DNA, 25 bp, Homo sapien
ggtggcttcgtggtctcttcgccag

SEQ ID NO: 439723 - DNA, 25 bp, Homo sapien
tcttcgccagccaaatcgcgtggaa

SEQ ID NO: 439724 - DNA, 25 bp, Homo sapien
aatcgcgtggaaaaccacgacctca

SEQ ID NO: 439725 - DNA, 25 bp, Homo sapien
accacgacctcaatttttacaacag

SEQ ID NO: 439726 - DNA, 25 bp, Homo sapien
ttttacaacagcacgaagacttaca

SEQ ID NO: 439727 - DNA, 25 bp, Homo sapien
gcacgaagacttacaagtgagcgta

SEQ ID NO: 439728 - DNA, 25 bp, Homo sapien
tcccaaggactaggaagcctctgaa

SEQ ID NO: 439729 - DNA, 25 bp, Homo sapien
agcctctgaaatgggcttggaagtt

SEQ ID NO: 439730 - DNA, 25 bp, Homo sapien
taatcccaaagacttcgaacccagg

SEQ ID NO: 439731 - DNA, 25 bp, Homo sapien
acccaggatctggatagcaagcaaa

SEQ ID NO: 439732 - DNA, 25 bp, Homo sapien
gggactgctcggatgatctttctta

SEQ ID NO: 439733 - DNA, 25 bp, Homo sapien
ggatgatctttcttagtgctacttc

SEQ ID NO: 439734 - DNA, 25 bp, Homo sapien
ttagtgctacttctttcagctgtcc

SEQ ID NO: 439735 - DNA, 25 bp, Homo sapien
gctgtccctgtagcgacaggtctaa

SEQ ID NO: 439736 - DNA, 25 bp, Homo sapien
acaggtctaagatctgactgcctcc

SEQ ID NO: 439737 - DNA, 25 bp, Homo sapien
tcttctcttcagctaggctagctgg

SEQ ID NO: 439738 - DNA, 25 bp, Homo sapien
ctaggctagctggtttggagtagaa

SEQ ID NO: 439739 - DNA, 25 bp, Homo sapien
aagccagaattacggctagcaccta

SEQ ID NO: 439740 - DNA, 25 bp, Homo sapien
ggctagcacctagcatttcagcaga

SEQ ID NO: 439741 - DNA, 25 bp, Homo sapien
tagcatttcagcagagggaccattt

SEQ ID NO: 439742 - DNA, 25 bp, Homo sapien
gcagagggaccattttagaccaaaa

SEQ ID NO: 439743 - DNA, 25 bp, Homo sapien
gaaaaggacagtggattcatttaga

SEQ ID NO: 439744 - DNA, 25 bp, Homo sapien
ttcatttagaagtgtaactggtgct

SEQ ID NO: 439745 - DNA, 25 bp, Homo sapien
gaagtgtaactggtgctgtgattat

SEQ ID NO: 439746 - DNA, 25 bp, Homo sapien
gtaactggtgctgtgattatagcaa

SEQ ID NO: 439747 - DNA, 25 bp, Homo sapien
gctgtgattatagcaatacatttgt

SEQ ID NO: 439748 - DNA, 25 bp, Homo sapien
gttagttgtacttcatctttttcat

SEQ ID NO: 439749 - DNA, 25 bp, Homo sapien
gtacttcatctttttcatgctagct

SEQ ID NO: 439750 - DNA, 25 bp, Homo sapien
catctttttcatgctagctttttaa

SEQ ID NO: 439751 - DNA, 25 bp, Homo sapien
ctcttgtcatggtcagctgctgaat

SEQ ID NO: 439752 - DNA, 25 bp, Homo sapien
ggtcagctgctgaatttacttgaag

SEQ ID NO: 439753 - DNA, 25 bp, Homo sapien
attagatcaaagaattgtgcaatca

SEQ ID NO: 439754 - DNA, 25 bp, Homo sapien
agctctggccctgcgacaatagagt

SEQ ID NO: 439755 - DNA, 25 bp, Homo sapien
ggccctgcgacaatagagtccggaa

SEQ ID NO: 439756 - DNA, 25 bp, Homo sapien
tagagtccggaagtgcaggcaaagc

SEQ ID NO: 439757 - DNA, 25 bp, Homo sapien
agagtttcggttctcttttctgtga

SEQ ID NO: 439758 - DNA, 25 bp, Homo sapien
ggtcctgcgcgggatcagcgagggc

SEQ ID NO: 439759 - DNA, 25 bp, Homo sapien
atggctgcagtgctggctctcaggg

SEQ ID NO: 439760 - DNA, 25 bp, Homo sapien
ggttctcttttctgtgatcgtatta

SEQ ID NO: 439761 - DNA, 25 bp, Homo sapien
ttctgtgatcgtattacttatgcaa

SEQ ID NO: 439762 - DNA, 25 bp, Homo sapien
ttatgcaaaacgagcccagtcactt

SEQ ID NO: 439763 - DNA, 25 bp, Homo sapien
aaaacgagcccagtcacttgcgcgg

SEQ ID NO: 439764 - DNA, 25 bp, Homo sapien
agcccagtcacttgcgcggccagag

SEQ ID NO: 439765 - DNA, 25 bp, Homo sapien
acatttaaatatcccactgtaacct

SEQ ID NO: 439766 - DNA, 25 bp, Homo sapien
tatcccactgtaacctaaaacatag

SEQ ID NO: 439767 - DNA, 25 bp, Homo sapien
ctaaaacatagcttcctttgttaat

SEQ ID NO: 439768 - DNA, 25 bp, Homo sapien
cgaagaaaagtattattcctcagta

SEQ ID NO: 439769 - DNA, 25 bp, Homo sapien
ttattcctcagtaatttgggctcaa

SEQ ID NO: 439770 - DNA, 25 bp, Homo sapien
attcctcagtaatttgggctcaaaa

SEQ ID NO: 439771 - DNA, 25 bp, Homo sapien
gggctcaaaatattaccctaatctt

SEQ ID NO: 439772 - DNA, 25 bp, Homo sapien
aatattaccctaatctttgactcct

SEQ ID NO: 439773 - DNA, 25 bp, Homo sapien
cctcagtcccaagacacatcaaagg

SEQ ID NO: 439774 - DNA, 25 bp, Homo sapien
aagacacatcaaaggctgatcaaag

SEQ ID NO: 439775 - DNA, 25 bp, Homo sapien
aaaggctgatcaaagttagccgggc

SEQ ID NO: 439776 - DNA, 25 bp, Homo sapien
agtctccaacacaaaggccaggcag

SEQ ID NO: 439777 - DNA, 25 bp, Homo sapien
tctccaacacaaaggccaggcaggg

SEQ ID NO: 439778 - DNA, 25 bp, Homo sapien
gagtgagagctgtttaccagagaga

SEQ ID NO: 439779 - DNA, 25 bp, Homo sapien
gctgtttaccagagagaaatgatgc

SEQ ID NO: 439780 - DNA, 25 bp, Homo sapien
agtgagaaaggaccttccctcagca

SEQ ID NO: 439781 - DNA, 25 bp, Homo sapien
tgagaaaggaccttccctcagcaca

SEQ ID NO: 439782 - DNA, 25 bp, Homo sapien
atccagctgcccatgactctgctga

SEQ ID NO: 439783 - DNA, 25 bp, Homo sapien
gactctgctgactcagctctgggag

SEQ ID NO: 439784 - DNA, 25 bp, Homo sapien
tcagctctgggaggtgccaagccct

SEQ ID NO: 439785 - DNA, 25 bp, Homo sapien
gggaggtgccaagccctcacactgg

SEQ ID NO: 439786 - DNA, 25 bp, Homo sapien
tcccaatgcacactatccatctgca

SEQ ID NO: 439787 - DNA, 25 bp, Homo sapien
gtgagttgccaaaggtctacaccaa

SEQ ID NO: 439788 - DNA, 25 bp, Homo sapien
aaggtctacaccaacttactggcag

SEQ ID NO: 439789 - DNA, 25 bp, Homo sapien
ctacaccaacttactggcagatttg

SEQ ID NO: 439790 - DNA, 25 bp, Homo sapien
atggtactcaaatttattaggctct

SEQ ID NO: 439791 - DNA, 25 bp, Homo sapien
attaggctctacaacattgtatcag

SEQ ID NO: 439792 - DNA, 25 bp, Homo sapien
aacattgtatcagcactatggtaac

SEQ ID NO: 439793 - DNA, 25 bp, Homo sapien
gtatcagcactatggtaactaaaaa

SEQ ID NO: 439794 - DNA, 25 bp, Homo sapien
tttgtttgacatccacactcaaccg

SEQ ID NO: 439795 - DNA, 25 bp, Homo sapien
tgacatccacactcaaccggattgt

SEQ ID NO: 439796 - DNA, 25 bp, Homo sapien
acactcaaccggattgttcattcag

SEQ ID NO: 439797 - DNA, 25 bp, Homo sapien
accggattgttcattcaggtcaatt

SEQ ID NO: 439798 - DNA, 25 bp, Homo sapien
tattccttatcttaaagcctgtcat

SEQ ID NO: 439799 - DNA, 25 bp, Homo sapien
gcctgtcattacttaggatgcactt

SEQ ID NO: 439800 - DNA, 25 bp, Homo sapien
ttataggatctgaaaagctcacttt

SEQ ID NO: 439801 - DNA, 25 bp, Homo sapien
agctcactttaaactcatactacat

SEQ ID NO: 439802 - DNA, 25 bp, Homo sapien
agtacaaggtccaagctggctttca

SEQ ID NO: 439803 - DNA, 25 bp, Homo sapien
agaagggatttattccacccctgca

SEQ ID NO: 439804 - DNA, 25 bp, Homo sapien
tattccacccctgcaagggtagagt

SEQ ID NO: 439805 - DNA, 25 bp, Homo sapien
tagagtcaggtgagagtcccttggt

SEQ ID NO: 439806 - DNA, 25 bp, Homo sapien
gtcccttggtgagtcatttgtacat

SEQ ID NO: 439807 - DNA, 25 bp, Homo sapien
gagtcatttgtacatcagtgtcatt

SEQ ID NO: 439808 - DNA, 25 bp, Homo sapien
agtgtcatttcttcttaacctctga

SEQ ID NO: 439809 - DNA, 25 bp, Homo sapien
tctagatggccaactcctatcacta

SEQ ID NO: 439810 - DNA, 25 bp, Homo sapien
atggccaactcctatcactagcgta

SEQ ID NO: 439811 - DNA, 25 bp, Homo sapien
aactcctatcactagcgtaccttta

SEQ ID NO: 439812 - DNA, 25 bp, Homo sapien
cctatcactagcgtacctttaatct

SEQ ID NO: 439813 - DNA, 25 bp, Homo sapien
atcactagcgtacctttaatcttca

SEQ ID NO: 439814 - DNA, 25 bp, Homo sapien
agcgtacctttaatcttcatttgac

SEQ ID NO: 439815 - DNA, 25 bp, Homo sapien
cgtacctttaatcttcatttgactc

SEQ ID NO: 439816 - DNA, 25 bp, Homo sapien
gaaattatttcaccacttgctactg

SEQ ID NO: 439817 - DNA, 25 bp, Homo sapien
accacttgctactggcattattttt

SEQ ID NO: 439818 - DNA, 25 bp, Homo sapien
cttgctactggcattatttttaaca

SEQ ID NO: 439819 - DNA, 25 bp, Homo sapien
aagctaaaaaatgcatactgtgaga

SEQ ID NO: 439820 - DNA, 25 bp, Homo sapien
ttatgtcttcatgagtttaatgata

SEQ ID NO: 439821 - DNA, 25 bp, Homo sapien
tagcatttgcatttgactgatttac

SEQ ID NO: 439822 - DNA, 25 bp, Homo sapien
gcatttgactgatttactggcagac

SEQ ID NO: 439823 - DNA, 25 bp, Homo sapien
gactgatttactggcagacatttaa

SEQ ID NO: 439824 - DNA, 25 bp, Homo sapien
taaacccaaagtcgtctgaaaagct

SEQ ID NO: 439825 - DNA, 25 bp, Homo sapien
agctaacaagcttgagtgtgtaaaa

SEQ ID NO: 439826 - DNA, 25 bp, Homo sapien
taaaaatattatactgcgaggcaca

SEQ ID NO: 439827 - DNA, 25 bp, Homo sapien
tattatactgcgaggcacagcatat

SEQ ID NO: 439828 - DNA, 25 bp, Homo sapien
tgcgaggcacagcatattgagtacc

SEQ ID NO: 439829 - DNA, 25 bp, Homo sapien
agccctaggctaccatattataact

SEQ ID NO: 439830 - DNA, 25 bp, Homo sapien
ccatattataactttatgagggctg

SEQ ID NO: 439831 - DNA, 25 bp, Homo sapien
aagaactgtctctaccagggtcaag

SEQ ID NO: 439832 - DNA, 25 bp, Homo sapien
gggtcaagagcatgaacgcatcaat

SEQ ID NO: 439833 - DNA, 25 bp, Homo sapien
aacgcatcaatagaaagaactcggg

SEQ ID NO: 439834 - DNA, 25 bp, Homo sapien
gggaaacatcccatcaacaggacta

SEQ ID NO: 439835 - DNA, 25 bp, Homo sapien
atacattcttgagaacactgcaatg

SEQ ID NO: 439836 - DNA, 25 bp, Homo sapien
gtgaaaatcacgtttgctatttata

SEQ ID NO: 439837 - DNA, 25 bp, Homo sapien
aaacttgtccttagattaatgtgtc

SEQ ID NO: 439838 - DNA, 25 bp, Homo sapien
gtgggagtaagtgattcttctaaga

SEQ ID NO: 439839 - DNA, 25 bp, Homo sapien
attagatacttgtcactgcctatac

SEQ ID NO: 439840 - DNA, 25 bp, Homo sapien
agctgaactgaatggtacttcgtat

SEQ ID NO: 439841 - DNA, 25 bp, Homo sapien
gtacttcgtatgttaatagttgttc

SEQ ID NO: 439842 - DNA, 25 bp, Homo sapien
ttaggaacaggccttgaagcttctg

SEQ ID NO: 439843 - DNA, 25 bp, Homo sapien
ggaacaggccttgaagcttctgctg

SEQ ID NO: 439844 - DNA, 25 bp, Homo sapien
aacaggccttgaagcttctgctgct

SEQ ID NO: 439845 - DNA, 25 bp, Homo sapien
aggccttgaagcttctgctgctaaa

SEQ ID NO: 439846 - DNA, 25 bp, Homo sapien
gccttgaagcttctgctgctaaaca

SEQ ID NO: 439847 - DNA, 25 bp, Homo sapien
gtcaggtgaacccactgccagctgt

SEQ ID NO: 439848 - DNA, 25 bp, Homo sapien
gccagctgtgcccagaagacagtcc

SEQ ID NO: 439849 - DNA, 25 bp, Homo sapien
ccaggctgagtcaaaagtggttcat

SEQ ID NO: 439850 - DNA, 25 bp, Homo sapien
gtcaaaagtggttcataggccggtc

SEQ ID NO: 439851 - DNA, 25 bp, Homo sapien
aaaagtggttcataggccggtcatg

SEQ ID NO: 439852 - DNA, 25 bp, Homo sapien
aagtggttcataggccggtcatggt

SEQ ID NO: 439853 - DNA, 25 bp, Homo sapien
tgacttcacatctgatgctccttca

SEQ ID NO: 439854 - DNA, 25 bp, Homo sapien
atctgcttttgttcttaccacttga

SEQ ID NO: 439855 - DNA, 25 bp, Homo sapien
taccacttgacagctctggtttcat

SEQ ID NO: 439856 - DNA, 25 bp, Homo sapien
ggtttcatctggattatgggcttta

SEQ ID NO: 439857 - DNA, 25 bp, Homo sapien
ggctttaggaatgttaccccacctg

SEQ ID NO: 439858 - DNA, 25 bp, Homo sapien
gttaccccacctgtcataatttata

SEQ ID NO: 439859 - DNA, 25 bp, Homo sapien
ttttgattcatgactctgggttagc

SEQ ID NO: 439860 - DNA, 25 bp, Homo sapien
gggttagcattccagagtagagtaa

SEQ ID NO: 439861 - DNA, 25 bp, Homo sapien
gacaagcataagatggtcccctaac

SEQ ID NO: 439862 - DNA, 25 bp, Homo sapien
tggtcccctaacctcatggaaatag

SEQ ID NO: 439863 - DNA, 25 bp, Homo sapien
tagagctgagggagtctgacttcac

SEQ ID NO: 439864 - DNA, 25 bp, Homo sapien
tcattaactggaattctgtaggaga

SEQ ID NO: 439865 - DNA, 25 bp, Homo sapien
attctgtaggagatactggtgacct

SEQ ID NO: 439866 - DNA, 25 bp, Homo sapien
ggtgacctaagctaagttgcactca

SEQ ID NO: 439867 - DNA, 25 bp, Homo sapien
gttgcactcagcatactcagtgtca

SEQ ID NO: 439868 - DNA, 25 bp, Homo sapien
cagtgtcaagctaatgaggttctat

SEQ ID NO: 439869 - DNA, 25 bp, Homo sapien
gaggttctattataaaggttctact

SEQ ID NO: 439870 - DNA, 25 bp, Homo sapien
taaaggttctacttttaatctgagg

SEQ ID NO: 439871 - DNA, 25 bp, Homo sapien
gaaaacatgttcagggcttctagaa

SEQ ID NO: 439872 - DNA, 25 bp, Homo sapien
tttggcttaaaccagtgttcagtct

SEQ ID NO: 439873 - DNA, 25 bp, Homo sapien
gaactttgttcacaggttatcctaa

SEQ ID NO: 439874 - DNA, 25 bp, Homo sapien
ggttatcctaatagagtaattcttc

SEQ ID NO: 439875 - DNA, 25 bp, Homo sapien
gcccgcctggcagagcaattgcgag

SEQ ID NO: 439876 - DNA, 25 bp, Homo sapien
gcctggcagagcaattgcgagcaga

SEQ ID NO: 439877 - DNA, 25 bp, Homo sapien
attgcgagcagaggcagaactgtgt

SEQ ID NO: 439878 - DNA, 25 bp, Homo sapien
cagagctggaggctcgcgtgggcga

SEQ ID NO: 439879 - DNA, 25 bp, Homo sapien
aggagtgcagccgtcaaatgcaaac

SEQ ID NO: 439880 - DNA, 25 bp, Homo sapien
agtgcagccgtcaaatgcaaaccga

SEQ ID NO: 439881 - DNA, 25 bp, Homo sapien
agccgtcaaatgcaaaccgagaaga

SEQ ID NO: 439882 - DNA, 25 bp, Homo sapien
aaaccgagaagaagaggctacagca

SEQ ID NO: 439883 - DNA, 25 bp, Homo sapien
ggctacagcagcacatacaggagct

SEQ ID NO: 439884 - DNA, 25 bp, Homo sapien
acaggagctagaggcccaccttgag

SEQ ID NO: 439885 - DNA, 25 bp, Homo sapien
aggctgaggagggtgcgcggcagaa

SEQ ID NO: 439886 - DNA, 25 bp, Homo sapien
tttcaaacacttaagggaggagctg

SEQ ID NO: 439887 - DNA, 25 bp, Homo sapien
gcttttgtgcggaagaggaaactct

SEQ ID NO: 439888 - DNA, 25 bp, Homo sapien
aaaggcttttctggcttagtgtcta

SEQ ID NO: 439889 - DNA, 25 bp, Homo sapien
tagtgtctagccctggtcggcttag

SEQ ID NO: 439890 - DNA, 25 bp, Homo sapien
ctggtcggcttagtaaagggcaatt

SEQ ID NO: 439891 - DNA, 25 bp, Homo sapien
gttgaaggttgtgcgtccacaccta

SEQ ID NO: 439892 - DNA, 25 bp, Homo sapien
cacacctacttagtggctcagtgga

SEQ ID NO: 439893 - DNA, 25 bp, Homo sapien
ggctcagtggaaagcacgtcgcatt

SEQ ID NO: 439894 - DNA, 25 bp, Homo sapien
gcacgtcgcattatttaaatcctct

SEQ ID NO: 439895 - DNA, 25 bp, Homo sapien
ataactggaacaacgtttgacggtg

SEQ ID NO: 439896 - DNA, 25 bp, Homo sapien
gctgtacattggctgataacactta

SEQ ID NO: 439897 - DNA, 25 bp, Homo sapien
tttctgtccctgttaggagacccct

SEQ ID NO: 439898 - DNA, 25 bp, Homo sapien
agagacagtgcagctagtcccagca

SEQ ID NO: 439899 - DNA, 25 bp, Homo sapien
tcacctggtgactaggtcttctcag

SEQ ID NO: 439900 - DNA, 25 bp, Homo sapien
gtcttctcagccagatcagttcatg

SEQ ID NO: 439901 - DNA, 25 bp, Homo sapien
agttcatgtgctctggtgtttttga

SEQ ID NO: 439902 - DNA, 25 bp, Homo sapien
tctggtgtttttgagcttctggcta

SEQ ID NO: 439903 - DNA, 25 bp, Homo sapien
ttctggctagtcctcagtttctcag

SEQ ID NO: 439904 - DNA, 25 bp, Homo sapien
gtttctcagacctggttaatcacag

SEQ ID NO: 439905 - DNA, 25 bp, Homo sapien
cacagtgtggagtcatttttcataa

SEQ ID NO: 439906 - DNA, 25 bp, Homo sapien
taactgtgcacctcacttgtttgat

SEQ ID NO: 439907 - DNA, 25 bp, Homo sapien
acctcacttgtttgatgcatggcaa

SEQ ID NO: 439908 - DNA, 25 bp, Homo sapien
ttggtagaaagttttcagcagccag

SEQ ID NO: 439909 - DNA, 25 bp, Homo sapien
ggtggctggtggcatggtagtaccc

SEQ ID NO: 439910 - DNA, 25 bp, Homo sapien
tggctggtggcatggtagtaccctt

SEQ ID NO: 439911 - DNA, 25 bp, Homo sapien
ggctggtggcatggtagtacccttg

SEQ ID NO: 439912 - DNA, 25 bp, Homo sapien
gctggtggcatggtagtacccttgg

SEQ ID NO: 439913 - DNA, 25 bp, Homo sapien
ctggtggcatggtagtacccttggg

SEQ ID NO: 439914 - DNA, 25 bp, Homo sapien
tggtggcatggtagtacccttggga

SEQ ID NO: 439915 - DNA, 25 bp, Homo sapien
ggtggcatggtagtacccttgggag

SEQ ID NO: 439916 - DNA, 25 bp, Homo sapien
gtggcatggtagtacccttgggagg

SEQ ID NO: 439917 - DNA, 25 bp, Homo sapien
tggcatggtagtacccttgggaggc

SEQ ID NO: 439918 - DNA, 25 bp, Homo sapien
ggcatggtagtacccttgggaggct

SEQ ID NO: 439919 - DNA, 25 bp, Homo sapien
gtaagaactagtgggcagaatcatc

SEQ ID NO: 439920 - DNA, 25 bp, Homo sapien
tcactgtcacatcgcccttgtgagg

SEQ ID NO: 439921 - DNA, 25 bp, Homo sapien
atcgcccttgtgaggcactcagaaa

SEQ ID NO: 439922 - DNA, 25 bp, Homo sapien
gaggcactcagaaaagctacagcag

SEQ ID NO: 439923 - DNA, 25 bp, Homo sapien
aaagctacagcagtcacttacatga

SEQ ID NO: 439924 - DNA, 25 bp, Homo sapien
caactttcaatgtattggttcacat

SEQ ID NO: 439925 - DNA, 25 bp, Homo sapien
ttgacgggccattgttagaacgaat

SEQ ID NO: 439926 - DNA, 25 bp, Homo sapien
tttaattacatcttggtccctaaag

SEQ ID NO: 439927 - DNA, 25 bp, Homo sapien
ggtccctaaagaagcctgcagccag

SEQ ID NO: 439928 - DNA, 25 bp, Homo sapien
ccagcaaacagacccaggcacgaaa

SEQ ID NO: 439929 - DNA, 25 bp, Homo sapien
aactgctctgctaaaccaaagaaac

SEQ ID NO: 439930 - DNA, 25 bp, Homo sapien
aatgaaacataatggacgatgtggt

SEQ ID NO: 439931 - DNA, 25 bp, Homo sapien
atgaaacataatggacgatgtggtg

SEQ ID NO: 439932 - DNA, 25 bp, Homo sapien
tgaaacataatggacgatgtggtgg

SEQ ID NO: 439933 - DNA, 25 bp, Homo sapien
gaaacataatggacgatgtggtggc

SEQ ID NO: 439934 - DNA, 25 bp, Homo sapien
aaacataatggacgatgtggtggct

SEQ ID NO: 439935 - DNA, 25 bp, Homo sapien
aacataatggacgatgtggtggctc

SEQ ID NO: 439936 - DNA, 25 bp, Homo sapien
acataatggacgatgtggtggctca

SEQ ID NO: 439937 - DNA, 25 bp, Homo sapien
cataatggacgatgtggtggctcac

SEQ ID NO: 439938 - DNA, 25 bp, Homo sapien
taatggacgatgtggtggctcacgc

SEQ ID NO: 439939 - DNA, 25 bp, Homo sapien
cgcctgtaatctttgggaagctgag

SEQ ID NO: 439940 - DNA, 25 bp, Homo sapien
gcgagactctctcaaaaattaataa

SEQ ID NO: 439941 - DNA, 25 bp, Homo sapien
aaaaataaaaagccaggtgcagtgg

SEQ ID NO: 439942 - DNA, 25 bp, Homo sapien
gcgtggtggcgagcacctgtaaacc

SEQ ID NO: 439943 - DNA, 25 bp, Homo sapien
cgtggtggcgagcacctgtaaaccc

SEQ ID NO: 439944 - DNA, 25 bp, Homo sapien
gtggtggcgagcacctgtaaaccca

SEQ ID NO: 439945 - DNA, 25 bp, Homo sapien
tggtggcgagcacctgtaaacccag

SEQ ID NO: 439946 - DNA, 25 bp, Homo sapien
ggtggcgagcacctgtaaacccagc

SEQ ID NO: 439947 - DNA, 25 bp, Homo sapien
gtggcgagcacctgtaaacccagct

SEQ ID NO: 439948 - DNA, 25 bp, Homo sapien
tggcgagcacctgtaaacccagcta

SEQ ID NO: 439949 - DNA, 25 bp, Homo sapien
cagagcttcctgtacacagttgcat

SEQ ID NO: 439950 - DNA, 25 bp, Homo sapien
cacagttgcatgtactgcattatgc

SEQ ID NO: 439951 - DNA, 25 bp, Homo sapien
atattttatgtaacctgtccactgt

SEQ ID NO: 439952 - DNA, 25 bp, Homo sapien
gtccactgttggtaggcacttgagt

SEQ ID NO: 439953 - DNA, 25 bp, Homo sapien
gagttgttttagtcttttgctatca

SEQ ID NO: 439954 - DNA, 25 bp, Homo sapien
ttttgctatcaaacagttctgggat

SEQ ID NO: 439955 - DNA, 25 bp, Homo sapien
gttctgggatgattaaccctgattt

SEQ ID NO: 439956 - DNA, 25 bp, Homo sapien
aaattgctctgctattctgctggaa

SEQ ID NO: 439957 - DNA, 25 bp, Homo sapien
tccagtcactcttgggctagactca

SEQ ID NO: 439958 - DNA, 25 bp, Homo sapien
cttgggctagactcaacgttcttaa

SEQ ID NO: 439959 - DNA, 25 bp, Homo sapien
gttcttaaaaactatgtggccatca

SEQ ID NO: 439960 - DNA, 25 bp, Homo sapien
aggtgcagtgacttatgcctataat

SEQ ID NO: 439961 - DNA, 25 bp, Homo sapien
aacctcatctctacacacacacaca

SEQ ID NO: 439962 - DNA, 25 bp, Homo sapien
acacacacaaagccaggtgtgatgg

SEQ ID NO: 439963 - DNA, 25 bp, Homo sapien
cacacacaaagccaggtgtgatggc

SEQ ID NO: 439964 - DNA, 25 bp, Homo sapien
gtgtgatggcatacatctctagtcc

SEQ ID NO: 439965 - DNA, 25 bp, Homo sapien
tgtgatggcatacatctctagtccc

SEQ ID NO: 439966 - DNA, 25 bp, Homo sapien
gtgatggcatacatctctagtccca

SEQ ID NO: 439967 - DNA, 25 bp, Homo sapien
tgatggcatacatctctagtcccag

SEQ ID NO: 439968 - DNA, 25 bp, Homo sapien
gatggcatacatctctagtcccagc

SEQ ID NO: 439969 - DNA, 25 bp, Homo sapien
atggcatacatctctagtcccagct

SEQ ID NO: 439970 - DNA, 25 bp, Homo sapien
tggcatacatctctagtcccagcta

SEQ ID NO: 439971 - DNA, 25 bp, Homo sapien
ggggctattccctgaagctgcagtt

SEQ ID NO: 439972 - DNA, 25 bp, Homo sapien
gcagtttgccaaacttgccggcatg

SEQ ID NO: 439973 - DNA, 25 bp, Homo sapien
aacttgccggcatggaattctagaa

SEQ ID NO: 439974 - DNA, 25 bp, Homo sapien
tgccggcatggaattctagaatcac

SEQ ID NO: 439975 - DNA, 25 bp, Homo sapien
tctagaatcaccttagaaactctaa

SEQ ID NO: 439976 - DNA, 25 bp, Homo sapien
gaaactctaaggtccgaagagaagt

SEQ ID NO: 439977 - DNA, 25 bp, Homo sapien
aagagaagttgttctccaagaccct

SEQ ID NO: 439978 - DNA, 25 bp, Homo sapien
aagaccctccgtatggatgcgctgg

SEQ ID NO: 439979 - DNA, 25 bp, Homo sapien
tcattttactggctcgatggcctgt

SEQ ID NO: 439980 - DNA, 25 bp, Homo sapien
atggcctgtgcaggaagaacagctg

SEQ ID NO: 439981 - DNA, 25 bp, Homo sapien
aggcgaagtcacttgcctgaggtcc

SEQ ID NO: 439982 - DNA, 25 bp, Homo sapien
gcagcagcacgcagagctggttgca

SEQ ID NO: 439983 - DNA, 25 bp, Homo sapien
cagcagcacgcagagctggttgcaa

SEQ ID NO: 439984 - DNA, 25 bp, Homo sapien
agcagcacgcagagctggttgcaaa

SEQ ID NO: 439985 - DNA, 25 bp, Homo sapien
gcagcacgcagagctggttgcaaag

SEQ ID NO: 439986 - DNA, 25 bp, Homo sapien
agcacgcagagctggttgcaaagga

SEQ ID NO: 439987 - DNA, 25 bp, Homo sapien
gcacgcagagctggttgcaaaggag

SEQ ID NO: 439988 - DNA, 25 bp, Homo sapien
acgcagagctggttgcaaaggaggg

SEQ ID NO: 439989 - DNA, 25 bp, Homo sapien
gggctgacatatattaagagttgag

SEQ ID NO: 439990 - DNA, 25 bp, Homo sapien
atatattaagagttgaggccgggcg

SEQ ID NO: 439991 - DNA, 25 bp, Homo sapien
tatattaagagttgaggccgggcgt

SEQ ID NO: 439992 - DNA, 25 bp, Homo sapien
atattaagagttgaggccgggcgtg

SEQ ID NO: 439993 - DNA, 25 bp, Homo sapien
actggaaaggaaaggctgccgagca

SEQ ID NO: 439994 - DNA, 25 bp, Homo sapien
aaaggctgccgagcatcttggcctg

SEQ ID NO: 439995 - DNA, 25 bp, Homo sapien
gctgccgagcatcttggcctgctgt

SEQ ID NO: 439996 - DNA, 25 bp, Homo sapien
tgtacccctcttccttcaaaggagg

SEQ ID NO: 439997 - DNA, 25 bp, Homo sapien
ttcaaaggagggtgtggccacgtcc

SEQ ID NO: 439998 - DNA, 25 bp, Homo sapien
gccacgtccgacagcagagttgaat

SEQ ID NO: 439999 - DNA, 25 bp, Homo sapien
gaatgaagcctgcatgcttgcacaa

SEQ ID NO: 440000 - DNA, 25 bp, Homo sapien
agcctgcatgcttgcacaacatcag

SEQ ID NO: 440001 - DNA, 25 bp, Homo sapien
tgcacaacatcagaactgtcagaat

SEQ ID NO: 440002 - DNA, 25 bp, Homo sapien
aatgtcaagatggaatactttcaat

SEQ ID NO: 440003 - DNA, 25 bp, Homo sapien
ggaatactttcaattgagttttaca

SEQ ID NO: 440004 - DNA, 25 bp, Homo sapien
gggaccttcaggctgtctccagatt

SEQ ID NO: 440005 - DNA, 25 bp, Homo sapien
gtctccagatttctgctgttataaa

SEQ ID NO: 440006 - DNA, 25 bp, Homo sapien
atgttcttgtcatccgcattttcca

SEQ ID NO: 440007 - DNA, 25 bp, Homo sapien
gtcatccgcattttccaaacggagt

SEQ ID NO: 440008 - DNA, 25 bp, Homo sapien
ttttccaaacggagtatgaagccca

SEQ ID NO: 440009 - DNA, 25 bp, Homo sapien
gaagccaaggtaccggtgcccggct

SEQ ID NO: 440010 - DNA, 25 bp, Homo sapien
tttctcaccgctggccttgagtgga

SEQ ID NO: 440011 - DNA, 25 bp, Homo sapien
accgctggccttgagtggagaaaca

SEQ ID NO: 440012 - DNA, 25 bp, Homo sapien
tggccttgagtggagaaacagatgt

SEQ ID NO: 440013 - DNA, 25 bp, Homo sapien
aacagatgtgctcattacccttcct

SEQ ID NO: 440014 - DNA, 25 bp, Homo sapien
tgctcattacccttccttggtctca

SEQ ID NO: 440015 - DNA, 25 bp, Homo sapien
cactgatgcttctgtacttaagaag

SEQ ID NO: 440016 - DNA, 25 bp, Homo sapien
actgatgcttctgtacttaagaagt

SEQ ID NO: 440017 - DNA, 25 bp, Homo sapien
ctgatgcttctgtacttaagaagta

SEQ ID NO: 440018 - DNA, 25 bp, Homo sapien
gatgcttctgtacttaagaagtaat

SEQ ID NO: 440019 - DNA, 25 bp, Homo sapien
tacttaagaagtaatgtcccttggc

SEQ ID NO: 440020 - DNA, 25 bp, Homo sapien
acttaagaagtaatgtcccttggct

SEQ ID NO: 440021 - DNA, 25 bp, Homo sapien
cttaagaagtaatgtcccttggctg

SEQ ID NO: 440022 - DNA, 25 bp, Homo sapien
ttaagaagtaatgtcccttggctgg

SEQ ID NO: 440023 - DNA, 25 bp, Homo sapien
taagaagtaatgtcccttggctggg

SEQ ID NO: 440024 - DNA, 25 bp, Homo sapien
aagaagtaatgtcccttggctgggc

SEQ ID NO: 440025 - DNA, 25 bp, Homo sapien
gaagtaatgtcccttggctgggcgc

SEQ ID NO: 440026 - DNA, 25 bp, Homo sapien
gtccccgagtgtggctggcgacact

SEQ ID NO: 440027 - DNA, 25 bp, Homo sapien
gcgacactgggcatgctgacgttgt

SEQ ID NO: 440028 - DNA, 25 bp, Homo sapien
gcatgctgacgttgttcctgtggat

SEQ ID NO: 440029 - DNA, 25 bp, Homo sapien
gctgacgttgttcctgtggatgtac

SEQ ID NO: 440030 - DNA, 25 bp, Homo sapien
tgtggatgtacttgagaaacacctc

SEQ ID NO: 440031 - DNA, 25 bp, Homo sapien
ttgagaaacacctcagcattccgcc

SEQ ID NO: 440032 - DNA, 25 bp, Homo sapien
agcattccgccgagccagggtgcag

SEQ ID NO: 440033 - DNA, 25 bp, Homo sapien
gtgcaggcctgcgaaagacaaagct

SEQ ID NO: 440034 - DNA, 25 bp, Homo sapien
aaagacaaagctgtgaggcccctgt

SEQ ID NO: 440035 - DNA, 25 bp, Homo sapien
gtcccagcaggtgtatggaatccaa

SEQ ID NO: 440036 - DNA, 25 bp, Homo sapien
aatggagaaggcataccctccttcc

SEQ ID NO: 440037 - DNA, 25 bp, Homo sapien
gatgaacggttgctattatatcaag

SEQ ID NO: 440038 - DNA, 25 bp, Homo sapien
agaaatggttgaaagctctctatgc

SEQ ID NO: 440039 - DNA, 25 bp, Homo sapien
gaaagctctctatgcttcataatga

SEQ ID NO: 440040 - DNA, 25 bp, Homo sapien
tatgcttcataatgattctttttcc

SEQ ID NO: 440041 - DNA, 25 bp, Homo sapien
ggttttactattaagagccaagatc

SEQ ID NO: 440042 - DNA, 25 bp, Homo sapien
atcatgcttggacagatcttttaag

SEQ ID NO: 440043 - DNA, 25 bp, Homo sapien
aacttactgagatttattgatttga

SEQ ID NO: 440044 - DNA, 25 bp, Homo sapien
gatgaatggtaaaacacactcttaa

SEQ ID NO: 440045 - DNA, 25 bp, Homo sapien
aaaacacactcttaatactgattac

SEQ ID NO: 440046 - DNA, 25 bp, Homo sapien
actgattacatggattggacttgaa

SEQ ID NO: 440047 - DNA, 25 bp, Homo sapien
gttacaattaaactgataccactga

SEQ ID NO: 440048 - DNA, 25 bp, Homo sapien
gttgatttgtttctgggccctgaca

SEQ ID NO: 440049 - DNA, 25 bp, Homo sapien
tttctgggccctgacagattagcag

SEQ ID NO: 440050 - DNA, 25 bp, Homo sapien
gaatgtttccagaaggcagggctca

SEQ ID NO: 440051 - DNA, 25 bp, Homo sapien
gaaggcagggctcatcagtccttga

SEQ ID NO: 440052 - DNA, 25 bp, Homo sapien
agggctcatcagtccttgacaaaaa

SEQ ID NO: 440053 - DNA, 25 bp, Homo sapien
tcagtccttgacaaaaaggctgatg

SEQ ID NO: 440054 - DNA, 25 bp, Homo sapien
aaaatggagttgagtgcagccgatc

SEQ ID NO: 440055 - DNA, 25 bp, Homo sapien
gagtgcagccgatcacctcaataat

SEQ ID NO: 440056 - DNA, 25 bp, Homo sapien
atcacttaagtcccggattttgagg

SEQ ID NO: 440057 - DNA, 25 bp, Homo sapien
attttgaggttgtagtgcgctgtga

SEQ ID NO: 440058 - DNA, 25 bp, Homo sapien
ttgtagtgcgctgtgatcacaacac

SEQ ID NO: 440059 - DNA, 25 bp, Homo sapien
tctgcatgaaacaacgaatccaaat

SEQ ID NO: 440060 - DNA, 25 bp, Homo sapien
gagacaagggtttatttctctgtca

SEQ ID NO: 440061 - DNA, 25 bp, Homo sapien
atacagagataaggaacccagggct

SEQ ID NO: 440062 - DNA, 25 bp, Homo sapien
gtaccattgtgaatcagggaatcca

SEQ ID NO: 440063 - DNA, 25 bp, Homo sapien
agctctttctagctttctgctcctt

SEQ ID NO: 440064 - DNA, 25 bp, Homo sapien
tgccactttcatgttctctagacgt

SEQ ID NO: 440065 - DNA, 25 bp, Homo sapien
tttcatgttctctagacgtgctgga

SEQ ID NO: 440066 - DNA, 25 bp, Homo sapien
ttctctagacgtgctggaactccag

SEQ ID NO: 440067 - DNA, 25 bp, Homo sapien
gtgctggaactccagccaccatgtt

SEQ ID NO: 440068 - DNA, 25 bp, Homo sapien
agccaccatgtttacatttcaggca

SEQ ID NO: 440069 - DNA, 25 bp, Homo sapien
accatgtttacatttcaggcaggaa

SEQ ID NO: 440070 - DNA, 25 bp, Homo sapien
ggaaaatagatgttggatagcaaaa

SEQ ID NO: 440071 - DNA, 25 bp, Homo sapien
gaaaatagatgttggatagcaaaag

SEQ ID NO: 440072 - DNA, 25 bp, Homo sapien
aaatagatgttggatagcaaaagtc

SEQ ID NO: 440073 - DNA, 25 bp, Homo sapien
aatagatgttggatagcaaaagtcc

SEQ ID NO: 440074 - DNA, 25 bp, Homo sapien
ccatgtccaggccaggcgctgtggc

SEQ ID NO: 440075 - DNA, 25 bp, Homo sapien
catgtccaggccaggcgctgtggct

SEQ ID NO: 440076 - DNA, 25 bp, Homo sapien
atgtccaggccaggcgctgtggctc

SEQ ID NO: 440077 - DNA, 25 bp, Homo sapien
agccgggtgtgctggcgtgcacctg

SEQ ID NO: 440078 - DNA, 25 bp, Homo sapien
gccgggtgtgctggcgtgcacctgt

SEQ ID NO: 440079 - DNA, 25 bp, Homo sapien
ccgggtgtgctggcgtgcacctgta

SEQ ID NO: 440080 - DNA, 25 bp, Homo sapien
cgggtgtgctggcgtgcacctgtag

SEQ ID NO: 440081 - DNA, 25 bp, Homo sapien
gtgttttctatcatgtagcacaatt

SEQ ID NO: 440082 - DNA, 25 bp, Homo sapien
acaatttctgacacacaaaacatac

SEQ ID NO: 440083 - DNA, 25 bp, Homo sapien
gtgttaatttttctatcaaagtcag

SEQ ID NO: 440084 - DNA, 25 bp, Homo sapien
ggtgtactaagcttgtttatgggtt

SEQ ID NO: 440085 - DNA, 25 bp, Homo sapien
tgtttatgggttaagtgatatagcc

SEQ ID NO: 440086 - DNA, 25 bp, Homo sapien
atgtcagtctagaaatatctcagat

SEQ ID NO: 440087 - DNA, 25 bp, Homo sapien
aaacatatcacttcttagttccaat

SEQ ID NO: 440088 - DNA, 25 bp, Homo sapien
atcacttcttagttccaattagata

SEQ ID NO: 440089 - DNA, 25 bp, Homo sapien
tcttttataataatgccaggattgc

SEQ ID NO: 440090 - DNA, 25 bp, Homo sapien
atgccaggattgctataatctgata

SEQ ID NO: 440091 - DNA, 25 bp, Homo sapien
aatctgataggagacaacaatttca

SEQ ID NO: 440092 - DNA, 25 bp, Homo sapien
acaaagcacttcaggtgggcctcgc

SEQ ID NO: 440093 - DNA, 25 bp, Homo sapien
tgggcctcgccttcgctcaggaagg

SEQ ID NO: 440094 - DNA, 25 bp, Homo sapien
agagccgcggctgttgttttaatgc

SEQ ID NO: 440095 - DNA, 25 bp, Homo sapien
tgttttaatgccctcttctttcgtc

SEQ ID NO: 440096 - DNA, 25 bp, Homo sapien
ttcgtccagtcttctcagggaatta

SEQ ID NO: 440097 - DNA, 25 bp, Homo sapien
aattaggagattctgtttgtgagcc

SEQ ID NO: 440098 - DNA, 25 bp, Homo sapien
ctgtttgtgagcctgggaaattatt

SEQ ID NO: 440099 - DNA, 25 bp, Homo sapien
aaacttactgtacccagcagtcatc

SEQ ID NO: 440100 - DNA, 25 bp, Homo sapien
gtacccagcagtcatctactaaaat

SEQ ID NO: 440101 - DNA, 25 bp, Homo sapien
cagttttcactgaacagctctcatc

SEQ ID NO: 440102 - DNA, 25 bp, Homo sapien
gccacagcagctctgtaattaaatg

SEQ ID NO: 440103 - DNA, 25 bp, Homo sapien
taaacatcacaggaataatcagagt

SEQ ID NO: 440104 - DNA, 25 bp, Homo sapien
gagatttgtatacaaggctgcctat

SEQ ID NO: 440105 - DNA, 25 bp, Homo sapien
gatttgtatacaaggctgcctatgt

SEQ ID NO: 440106 - DNA, 25 bp, Homo sapien
gctgcctatgtctgtgtttttataa

SEQ ID NO: 440107 - DNA, 25 bp, Homo sapien
atggcgaaatattagaatcagctta

SEQ ID NO: 440108 - DNA, 25 bp, Homo sapien
gaatcagcttaaacattgacaaata

SEQ ID NO: 440109 - DNA, 25 bp, Homo sapien
gtaaattacagcatatcttgaggga

SEQ ID NO: 440110 - DNA, 25 bp, Homo sapien
acagcatatcttgagggaagagcat

SEQ ID NO: 440111 - DNA, 25 bp, Homo sapien
tcttgagggaagagcattagtgcaa

SEQ ID NO: 440112 - DNA, 25 bp, Homo sapien
taaaattttgttgttcacgaatgat

SEQ ID NO: 440113 - DNA, 25 bp, Homo sapien
tttgttgttcacgaatgattgtggg

SEQ ID NO: 440114 - DNA, 25 bp, Homo sapien
tagacttccgtcattcaataaacat

SEQ ID NO: 440115 - DNA, 25 bp, Homo sapien
gtaatgtgcacatccagttctcagc

SEQ ID NO: 440116 - DNA, 25 bp, Homo sapien
ctcagcaggtggttctaagcaggat

SEQ ID NO: 440117 - DNA, 25 bp, Homo sapien
caagctgctaacctatcaagggtag

SEQ ID NO: 440118 - DNA, 25 bp, Homo sapien
tagcccatgtggttctgagggcacc

SEQ ID NO: 440119 - DNA, 25 bp, Homo sapien
tgagggcaccgtgctgatgagcacc

SEQ ID NO: 440120 - DNA, 25 bp, Homo sapien
atgagcacccactgtggttctgatt

SEQ ID NO: 440121 - DNA, 25 bp, Homo sapien
tggttctgattttggcagccacggc

SEQ ID NO: 440122 - DNA, 25 bp, Homo sapien
agccacggctgaatcaagtctttga

SEQ ID NO: 440123 - DNA, 25 bp, Homo sapien
gatctttggagtgacttctgccaca

SEQ ID NO: 440124 - DNA, 25 bp, Homo sapien
gcatatctgtttgttttgcccctcc

SEQ ID NO: 440125 - DNA, 25 bp, Homo sapien
gagcctatgttcttaatttcaccaa

SEQ ID NO: 440126 - DNA, 25 bp, Homo sapien
ttaatttcaccaaaatatctcctcc

SEQ ID NO: 440127 - DNA, 25 bp, Homo sapien
ctcccaaattatacataccctttca

SEQ ID NO: 440128 - DNA, 25 bp, Homo sapien
tatacataccctttcaaacctacct

SEQ ID NO: 440129 - DNA, 25 bp, Homo sapien
taccttcctctcttagtaattaatg

SEQ ID NO: 440130 - DNA, 25 bp, Homo sapien
gtaattaatgataccgtctttcaat

SEQ ID NO: 440131 - DNA, 25 bp, Homo sapien
tgataccgtctttcaatttacatga

SEQ ID NO: 440132 - DNA, 25 bp, Homo sapien
tacatgaatcagtatcactattagt

SEQ ID NO: 440133 - DNA, 25 bp, Homo sapien
gtattttatgccattatataacaga

SEQ ID NO: 440134 - DNA, 25 bp, Homo sapien
tatttattctgtactctactgtgat

SEQ ID NO: 440135 - DNA, 25 bp, Homo sapien
ttctgtactctactgtgatattttc

SEQ ID NO: 440136 - DNA, 25 bp, Homo sapien
tgaggacaagcccagactttcgtca

SEQ ID NO: 440137 - DNA, 25 bp, Homo sapien
aagcccagactttcgtcacagggac

SEQ ID NO: 440138 - DNA, 25 bp, Homo sapien
tcgtcacagggacagaccaacgtgt

SEQ ID NO: 440139 - DNA, 25 bp, Homo sapien
gggacagaccaacgtgttaacacaa

SEQ ID NO: 440140 - DNA, 25 bp, Homo sapien
gggagaacacgggagcatcctgcac

SEQ ID NO: 440141 - DNA, 25 bp, Homo sapien
ggagcatcctgcaccgtgcatttca

SEQ ID NO: 440142 - DNA, 25 bp, Homo sapien
tgcaccgtgcatttcagccacagat

SEQ ID NO: 440143 - DNA, 25 bp, Homo sapien
caactgcggacatgctgggtggatc

SEQ ID NO: 440144 - DNA, 25 bp, Homo sapien
acatgctgggtggatccggatcgca

SEQ ID NO: 440145 - DNA, 25 bp, Homo sapien
ccggatcgcatggaagacgcagcct

SEQ ID NO: 440146 - DNA, 25 bp, Homo sapien
atggaagacgcagcctggccgcgct

SEQ ID NO: 440147 - DNA, 25 bp, Homo sapien
gaagagggcatacttaaccttctag

SEQ ID NO: 440148 - DNA, 25 bp, Homo sapien
gagggcatacttaaccttctagaga

SEQ ID NO: 440149 - DNA, 25 bp, Homo sapien
gggcatacttaaccttctagagagc

SEQ ID NO: 440150 - DNA, 25 bp, Homo sapien
gcatacttaaccttctagagagcct

SEQ ID NO: 440151 - DNA, 25 bp, Homo sapien
ttaaccttctagagagcctgaagta

SEQ ID NO: 440152 - DNA, 25 bp, Homo sapien
gagagcctgaagtagctcctgatca

SEQ ID NO: 440153 - DNA, 25 bp, Homo sapien
agcctgaagtagctcctgatcacac

SEQ ID NO: 440154 - DNA, 25 bp, Homo sapien
tgaagtagctcctgatcacaccttt

SEQ ID NO: 440155 - DNA, 25 bp, Homo sapien
aagtagctcctgatcacaccttttc

SEQ ID NO: 440156 - DNA, 25 bp, Homo sapien
caaggtaaagtgaagagcatgaaat

SEQ ID NO: 440157 - DNA, 25 bp, Homo sapien
attatttatcaattagccgggtgtg

SEQ ID NO: 440158 - DNA, 25 bp, Homo sapien
gaaggtctcagcctttttgtcttcc

SEQ ID NO: 440159 - DNA, 25 bp, Homo sapien
tttgtcttcccagttaggatggtcc

SEQ ID NO: 440160 - DNA, 25 bp, Homo sapien
ttaggatggtcccatgcccctgtta

SEQ ID NO: 440161 - DNA, 25 bp, Homo sapien
ccatcagacttggtaagtttcccga

SEQ ID NO: 440162 - DNA, 25 bp, Homo sapien
ggtaagtttcccgaggagactctgc

SEQ ID NO: 440163 - DNA, 25 bp, Homo sapien
gagactctgcaagaggcactgttct

SEQ ID NO: 440164 - DNA, 25 bp, Homo sapien
tgcaagaggcactgttctggatggt

SEQ ID NO: 440165 - DNA, 25 bp, Homo sapien
agagactagttgttctgctctcctg

SEQ ID NO: 440166 - DNA, 25 bp, Homo sapien
ttctgctctcctggccacagtgggt

SEQ ID NO: 440167 - DNA, 25 bp, Homo sapien
agcctacgaccagcacctgtgggag

SEQ ID NO: 440168 - DNA, 25 bp, Homo sapien
agcacctgtgggaggtggatattca

SEQ ID NO: 440169 - DNA, 25 bp, Homo sapien
taactcgagacagtgcaggaaaaat

SEQ ID NO: 440170 - DNA, 25 bp, Homo sapien
aactcgagacagtgcaggaaaaata

SEQ ID NO: 440171 - DNA, 25 bp, Homo sapien
actcgagacagtgcaggaaaaatat

SEQ ID NO: 440172 - DNA, 25 bp, Homo sapien
atatcatttaaaacctaaccttgag

SEQ ID NO: 440173 - DNA, 25 bp, Homo sapien
tatcatttaaaacctaaccttgagg

SEQ ID NO: 440174 - DNA, 25 bp, Homo sapien
tcatttaaaacctaaccttgaggct

SEQ ID NO: 440175 - DNA, 25 bp, Homo sapien
catttaaaacctaaccttgaggctg

SEQ ID NO: 440176 - DNA, 25 bp, Homo sapien
taaaacctaaccttgaggctgggcg

SEQ ID NO: 440177 - DNA, 25 bp, Homo sapien
acctaaccttgaggctgggcgtact

SEQ ID NO: 440178 - DNA, 25 bp, Homo sapien
cctaaccttgaggctgggcgtactg

SEQ ID NO: 440179 - DNA, 25 bp, Homo sapien
acttgcacgccgtgacctggacgtg

SEQ ID NO: 440180 - DNA, 25 bp, Homo sapien
acctggacgtgctgtttctggacaa

SEQ ID NO: 440181 - DNA, 25 bp, Homo sapien
gggaatggcactcccttctcagcga

SEQ ID NO: 440182 - DNA, 25 bp, Homo sapien
tcagcgaccggctactcctgttggg

SEQ ID NO: 440183 - DNA, 25 bp, Homo sapien
tgttgggacccagtagctgccagtc

SEQ ID NO: 440184 - DNA, 25 bp, Homo sapien
agctgccagtccgtactggaattgt

SEQ ID NO: 440185 - DNA, 25 bp, Homo sapien
aagccactggtcctgggcccataga

SEQ ID NO: 440186 - DNA, 25 bp, Homo sapien
ggtcctgggcccatagagactctgt

SEQ ID NO: 440187 - DNA, 25 bp, Homo sapien
gtctccctttctggagtcagacagt

SEQ ID NO: 440188 - DNA, 25 bp, Homo sapien
agcccctccagatctgtttctttaa

SEQ ID NO: 440189 - DNA, 25 bp, Homo sapien
gtttctttaactgagagcgggacac

SEQ ID NO: 440190 - DNA, 25 bp, Homo sapien
gcagtgaaaaattttcagccaggtg

SEQ ID NO: 440191 - DNA, 25 bp, Homo sapien
tatgcacctgtagtcgtggccactc

SEQ ID NO: 440192 - DNA, 25 bp, Homo sapien
tgcacctgtagtcgtggccactcag

SEQ ID NO: 440193 - DNA, 25 bp, Homo sapien
gcttgaacctgcaaggttgagacta

SEQ ID NO: 440194 - DNA, 25 bp, Homo sapien
cttgaacctgcaaggttgagactac

SEQ ID NO: 440195 - DNA, 25 bp, Homo sapien
ttgaacctgcaaggttgagactaca

SEQ ID NO: 440196 - DNA, 25 bp, Homo sapien
tgaacctgcaaggttgagactacag

SEQ ID NO: 440197 - DNA, 25 bp, Homo sapien
aacctgcaaggttgagactacagtg

SEQ ID NO: 440198 - DNA, 25 bp, Homo sapien
cctgcaaggttgagactacagtgag

SEQ ID NO: 440199 - DNA, 25 bp, Homo sapien
gagctgtgatcccactgctgtaccc

SEQ ID NO: 440200 - DNA, 25 bp, Homo sapien
gctgtgatcccactgctgtacccca

SEQ ID NO: 440201 - DNA, 25 bp, Homo sapien
gaaaatgtaagtattgccaggcgcg

SEQ ID NO: 440202 - DNA, 25 bp, Homo sapien
aaaatgtaagtattgccaggcgcgg

SEQ ID NO: 440203 - DNA, 25 bp, Homo sapien
aaatgtaagtattgccaggcgcggt

SEQ ID NO: 440204 - DNA, 25 bp, Homo sapien
aatgtaagtattgccaggcgcggtg

SEQ ID NO: 440205 - DNA, 25 bp, Homo sapien
atgtaagtattgccaggcgcggtgg

SEQ ID NO: 440206 - DNA, 25 bp, Homo sapien
tgtaagtattgccaggcgcggtggc

SEQ ID NO: 440207 - DNA, 25 bp, Homo sapien
aggctgaagaatcacttgaatacag

SEQ ID NO: 440208 - DNA, 25 bp, Homo sapien
ggctgaagaatcacttgaatacagg

SEQ ID NO: 440209 - DNA, 25 bp, Homo sapien
gctgaagaatcacttgaatacagga

SEQ ID NO: 440210 - DNA, 25 bp, Homo sapien
ctgaagaatcacttgaatacaggag

SEQ ID NO: 440211 - DNA, 25 bp, Homo sapien
tgaagaatcacttgaatacaggagg

SEQ ID NO: 440212 - DNA, 25 bp, Homo sapien
aaagatgttatagggcagagtgtgt

SEQ ID NO: 440213 - DNA, 25 bp, Homo sapien
tatagggcagagtgtgttaagagat

SEQ ID NO: 440214 - DNA, 25 bp, Homo sapien
tgtgttaagagatgagccgggcata

SEQ ID NO: 440215 - DNA, 25 bp, Homo sapien
tgttaagagatgagccgggcataat

SEQ ID NO: 440216 - DNA, 25 bp, Homo sapien
gatgagccgggcataatggctcatg

SEQ ID NO: 440217 - DNA, 25 bp, Homo sapien
tggtggtgggtatctgtaaacagcc

SEQ ID NO: 440218 - DNA, 25 bp, Homo sapien
gtggtgggtatctgtaaacagcctg

SEQ ID NO: 440219 - DNA, 25 bp, Homo sapien
ggtgggtatctgtaaacagcctggc

SEQ ID NO: 440220 - DNA, 25 bp, Homo sapien
gtgggtatctgtaaacagcctggct

SEQ ID NO: 440221 - DNA, 25 bp, Homo sapien
gggtatctgtaaacagcctggctaa

SEQ ID NO: 440222 - DNA, 25 bp, Homo sapien
agcctggctaacttgcaaggctgag

SEQ ID NO: 440223 - DNA, 25 bp, Homo sapien
cccaaggctgtacactggctgaggt

SEQ ID NO: 440224 - DNA, 25 bp, Homo sapien
gtggcactaagatgagaccgcagca

SEQ ID NO: 440225 - DNA, 25 bp, Homo sapien
tgagaccgcagcacctgaggagaca

SEQ ID NO: 440226 - DNA, 25 bp, Homo sapien
cagggttctggttcctagagcgcct

SEQ ID NO: 440227 - DNA, 25 bp, Homo sapien
tagagcgcctggagcctcggagcaa

SEQ ID NO: 440228 - DNA, 25 bp, Homo sapien
gagcctcggagcaactttcctgaga

SEQ ID NO: 440229 - DNA, 25 bp, Homo sapien
ctctctcggccataatgggctcaat

SEQ ID NO: 440230 - DNA, 25 bp, Homo sapien
taatgggctcaatcctgaactcagg

SEQ ID NO: 440231 - DNA, 25 bp, Homo sapien
tgaactcaggtatgctgatgctctg

SEQ ID NO: 440232 - DNA, 25 bp, Homo sapien
tgatgctctgggattgtccaggcca

SEQ ID NO: 440233 - DNA, 25 bp, Homo sapien
tcttccgagttcttggccccaggag

SEQ ID NO: 440234 - DNA, 25 bp, Homo sapien
tagggaacctatataagcattacag

SEQ ID NO: 440235 - DNA, 25 bp, Homo sapien
ggaacctatataagcattacagatt

SEQ ID NO: 440236 - DNA, 25 bp, Homo sapien
tataagcattacagattcatgatct

SEQ ID NO: 440237 - DNA, 25 bp, Homo sapien
cagattcatgatctgatcacagcta

SEQ ID NO: 440238 - DNA, 25 bp, Homo sapien
tcatgatctgatcacagctaaatgc

SEQ ID NO: 440239 - DNA, 25 bp, Homo sapien
atctgatcacagctaaatgcaatgt

SEQ ID NO: 440240 - DNA, 25 bp, Homo sapien
gctaaatgcaatgtgctaccctgga

SEQ ID NO: 440241 - DNA, 25 bp, Homo sapien
taaatgcaatgtgctaccctggatt

SEQ ID NO: 440242 - DNA, 25 bp, Homo sapien
aatgcaatgtgctaccctggattgg

SEQ ID NO: 440243 - DNA, 25 bp, Homo sapien
tgcaatgtgctaccctggattggat

SEQ ID NO: 440244 - DNA, 25 bp, Homo sapien
aatgtgctaccctggattggatcct

SEQ ID NO: 440245 - DNA, 25 bp, Homo sapien
aactcttatcatcccatatgttttc

SEQ ID NO: 440246 - DNA, 25 bp, Homo sapien
ttatcatcccatatgttttcctacc

SEQ ID NO: 440247 - DNA, 25 bp, Homo sapien
tatcatcccatatgttttcctacca

SEQ ID NO: 440248 - DNA, 25 bp, Homo sapien
tcatcccatatgttttcctaccact

SEQ ID NO: 440249 - DNA, 25 bp, Homo sapien
atcccatatgttttcctaccactgt

SEQ ID NO: 440250 - DNA, 25 bp, Homo sapien
ccatatgttttcctaccactgttaa

SEQ ID NO: 440251 - DNA, 25 bp, Homo sapien
atatgttttcctaccactgttaaag

SEQ ID NO: 440252 - DNA, 25 bp, Homo sapien
tatgttttcctaccactgttaaaga

SEQ ID NO: 440253 - DNA, 25 bp, Homo sapien
tgttttcctaccactgttaaagaca

SEQ ID NO: 440254 - DNA, 25 bp, Homo sapien
ttcctaccactgttaaagacaagta

SEQ ID NO: 440255 - DNA, 25 bp, Homo sapien
taaagacaagtatagccaggcacag

SEQ ID NO: 440256 - DNA, 25 bp, Homo sapien
tcctctagagttctgcaagtcgaga

SEQ ID NO: 440257 - DNA, 25 bp, Homo sapien
aagactgcggagaatgccaccagtg

SEQ ID NO: 440258 - DNA, 25 bp, Homo sapien
tccgatggatgtggtggagtgcacc

SEQ ID NO: 440259 - DNA, 25 bp, Homo sapien
ggtggagtgcaccaaacatagactg

SEQ ID NO: 440260 - DNA, 25 bp, Homo sapien
tggagtgcaccaaacatagactgct

SEQ ID NO: 440261 - DNA, 25 bp, Homo sapien
gagtgcaccaaacatagactgctgc

SEQ ID NO: 440262 - DNA, 25 bp, Homo sapien
gtgcaccaaacatagactgctgcaa

SEQ ID NO: 440263 - DNA, 25 bp, Homo sapien
caaacatagactgctgcaaccgttt

SEQ ID NO: 440264 - DNA, 25 bp, Homo sapien
aacatagactgctgcaaccgtttaa

SEQ ID NO: 440265 - DNA, 25 bp, Homo sapien
acatagactgctgcaaccgtttaat

SEQ ID NO: 440266 - DNA, 25 bp, Homo sapien
catagactgctgcaaccgtttaatg

SEQ ID NO: 440267 - DNA, 25 bp, Homo sapien
aaccatggtaaagctgtcaatctca

SEQ ID NO: 440268 - DNA, 25 bp, Homo sapien
tctcagctatttgtggagggttagt

SEQ ID NO: 440269 - DNA, 25 bp, Homo sapien
gagggttagttgatggtatttccta

SEQ ID NO: 440270 - DNA, 25 bp, Homo sapien
tgatggtatttcctagagaaactgt

SEQ ID NO: 440271 - DNA, 25 bp, Homo sapien
tgtgctctaaaatttcctactttgg

SEQ ID NO: 440272 - DNA, 25 bp, Homo sapien
ttcctactttggtcggtagcagcta

SEQ ID NO: 440273 - DNA, 25 bp, Homo sapien
ggtagcagctatagatgcccctttc

SEQ ID NO: 440274 - DNA, 25 bp, Homo sapien
tatagatgcccctttctgacatttg

SEQ ID NO: 440275 - DNA, 25 bp, Homo sapien
ttctgacatttgtagttctgaaaag

SEQ ID NO: 440276 - DNA, 25 bp, Homo sapien
acacataccaatagttatccctcac

SEQ ID NO: 440277 - DNA, 25 bp, Homo sapien
ttatccctcacactcatacctaagt

SEQ ID NO: 440278 - DNA, 25 bp, Homo sapien
agagggtgacaaggtgcatctatac

SEQ ID NO: 440279 - DNA, 25 bp, Homo sapien
gacaaggtgcatctatacctggcca

SEQ ID NO: 440280 - DNA, 25 bp, Homo sapien
aaggtgcatctatacctggccagtg

SEQ ID NO: 440281 - DNA, 25 bp, Homo sapien
atacctggccagtgatgtcagcact

SEQ ID NO: 440282 - DNA, 25 bp, Homo sapien
acctggccagtgatgtcagcacttc

SEQ ID NO: 440283 - DNA, 25 bp, Homo sapien
ttgtgcccacctttcctagggaggg

SEQ ID NO: 440284 - DNA, 25 bp, Homo sapien
gaggggctgcactgaattgaaacag

SEQ ID NO: 440285 - DNA, 25 bp, Homo sapien
tgaaacagtgccagctgggaaatga

SEQ ID NO: 440286 - DNA, 25 bp, Homo sapien
tgagaaggcttatcaacaagtcttt

SEQ ID NO: 440287 - DNA, 25 bp, Homo sapien
ttatcaacaagtctttccttggagg

SEQ ID NO: 440288 - DNA, 25 bp, Homo sapien
gcaagaaagagctcgagggccgggc

SEQ ID NO: 440289 - DNA, 25 bp, Homo sapien
ttatcaaccttgtaggatcattatt

SEQ ID NO: 440290 - DNA, 25 bp, Homo sapien
aaccttgtaggatcattattattat

SEQ ID NO: 440291 - DNA, 25 bp, Homo sapien
ttttaaaattcaaagcccacattca

SEQ ID NO: 440292 - DNA, 25 bp, Homo sapien
gcccacattcattatcatagctact

SEQ ID NO: 440293 - DNA, 25 bp, Homo sapien
atagctactttatatctttccactg

SEQ ID NO: 440294 - DNA, 25 bp, Homo sapien
gctactttatatctttccactggga

SEQ ID NO: 440295 - DNA, 25 bp, Homo sapien
tatatctttccactgggataacagg

SEQ ID NO: 440296 - DNA, 25 bp, Homo sapien
actgggataacaggacatgcctaat

SEQ ID NO: 440297 - DNA, 25 bp, Homo sapien
gataacaggacatgcctaattggct

SEQ ID NO: 440298 - DNA, 25 bp, Homo sapien
acaggacatgcctaattggcttttt

SEQ ID NO: 440299 - DNA, 25 bp, Homo sapien
acatgcctaattggctttttaaatt

SEQ ID NO: 440300 - DNA, 25 bp, Homo sapien
taagttgtggtagtttagtgatttt

SEQ ID NO: 440301 - DNA, 25 bp, Homo sapien
aaagatgtgtgaaatgttctctgca

SEQ ID NO: 440302 - DNA, 25 bp, Homo sapien
aagatgtgtgaaatgttctctgcaa

SEQ ID NO: 440303 - DNA, 25 bp, Homo sapien
agatgtgtgaaatgttctctgcaaa

SEQ ID NO: 440304 - DNA, 25 bp, Homo sapien
tgtgaaatgttctctgcaaaataat

SEQ ID NO: 440305 - DNA, 25 bp, Homo sapien
gaaatgttctctgcaaaataattca

SEQ ID NO: 440306 - DNA, 25 bp, Homo sapien
gttctctgcaaaataattcaggcca

SEQ ID NO: 440307 - DNA, 25 bp, Homo sapien
tctgcaaaataattcaggccactgt

SEQ ID NO: 440308 - DNA, 25 bp, Homo sapien
ctgcaaaataattcaggccactgtc

SEQ ID NO: 440309 - DNA, 25 bp, Homo sapien
attatttgcaaaggtaagttacagc

SEQ ID NO: 440310 - DNA, 25 bp, Homo sapien
tttgcaaaggtaagttacagcttgt

SEQ ID NO: 440311 - DNA, 25 bp, Homo sapien
gacattaagtctgcaatattggaat

SEQ ID NO: 440312 - DNA, 25 bp, Homo sapien
aagtctgcaatattggaataggcaa

SEQ ID NO: 440313 - DNA, 25 bp, Homo sapien
gtctgcaatattggaataggcaaat

SEQ ID NO: 440314 - DNA, 25 bp, Homo sapien
tgcaatattggaataggcaaatctg

SEQ ID NO: 440315 - DNA, 25 bp, Homo sapien
gcaaatctgtagagaaaggaatgtg

SEQ ID NO: 440316 - DNA, 25 bp, Homo sapien
aaggaatgtgggtgagtggtgggct

SEQ ID NO: 440317 - DNA, 25 bp, Homo sapien
tggctaacgggcacaggctttcttt

SEQ ID NO: 440318 - DNA, 25 bp, Homo sapien
ggctaacgggcacaggctttctttt

SEQ ID NO: 440319 - DNA, 25 bp, Homo sapien
gctaacgggcacaggctttcttttt

SEQ ID NO: 440320 - DNA, 25 bp, Homo sapien
taacgggcacaggctttcttttttg

SEQ ID NO: 440321 - DNA, 25 bp, Homo sapien
gtatggtatttgaatttcacctcaa

SEQ ID NO: 440322 - DNA, 25 bp, Homo sapien
gctcagctgtcttgtgtcacccaaa

SEQ ID NO: 440323 - DNA, 25 bp, Homo sapien
ctcagctgtcttgtgtcacccaaag

SEQ ID NO: 440324 - DNA, 25 bp, Homo sapien
tcagctgtcttgtgtcacccaaagt

SEQ ID NO: 440325 - DNA, 25 bp, Homo sapien
cagctgtcttgtgtcacccaaagtc

SEQ ID NO: 440326 - DNA, 25 bp, Homo sapien
tgtcacccaaagtcagctagaaatg

SEQ ID NO: 440327 - DNA, 25 bp, Homo sapien
gtcacccaaagtcagctagaaatgg

SEQ ID NO: 440328 - DNA, 25 bp, Homo sapien
tcacccaaagtcagctagaaatggg

SEQ ID NO: 440329 - DNA, 25 bp, Homo sapien
cacccaaagtcagctagaaatggga

SEQ ID NO: 440330 - DNA, 25 bp, Homo sapien
gctcattaaaagtaacacaaggccg

SEQ ID NO: 440331 - DNA, 25 bp, Homo sapien
ctcattaaaagtaacacaaggccgg

SEQ ID NO: 440332 - DNA, 25 bp, Homo sapien
tcattaaaagtaacacaaggccggg

SEQ ID NO: 440333 - DNA, 25 bp, Homo sapien
taaaagtaacacaaggccgggcgcg

SEQ ID NO: 440334 - DNA, 25 bp, Homo sapien
gaggtatcagggaaccgagatcgca

SEQ ID NO: 440335 - DNA, 25 bp, Homo sapien
aggtatcagggaaccgagatcgcac

SEQ ID NO: 440336 - DNA, 25 bp, Homo sapien
ggtatcagggaaccgagatcgcacc

SEQ ID NO: 440337 - DNA, 25 bp, Homo sapien
tatcagggaaccgagatcgcaccgc

SEQ ID NO: 440338 - DNA, 25 bp, Homo sapien
atcagggaaccgagatcgcaccgct

SEQ ID NO: 440339 - DNA, 25 bp, Homo sapien
tcagggaaccgagatcgcaccgctg

SEQ ID NO: 440340 - DNA, 25 bp, Homo sapien
gggaaccgagatcgcaccgctgtac

SEQ ID NO: 440341 - DNA, 25 bp, Homo sapien
tcagctcagtagaggattgtctcct

SEQ ID NO: 440342 - DNA, 25 bp, Homo sapien
gtagaggattgtctcctccctgcta

SEQ ID NO: 440343 - DNA, 25 bp, Homo sapien
cctattgcccttttcaggagatctg

SEQ ID NO: 440344 - DNA, 25 bp, Homo sapien
aggagatctgggtgcacatgcctct

SEQ ID NO: 440345 - DNA, 25 bp, Homo sapien
atgcctctacgtttccacttggctt

SEQ ID NO: 440346 - DNA, 25 bp, Homo sapien
atacgattttgccaaattgagtcaa

SEQ ID NO: 440347 - DNA, 25 bp, Homo sapien
gtcaaagttcctgttagtagctctc

SEQ ID NO: 440348 - DNA, 25 bp, Homo sapien
tgttagtagctctcatacccgtggg

SEQ ID NO: 440349 - DNA, 25 bp, Homo sapien
gtgggcccatctgtagctccacttg

SEQ ID NO: 440350 - DNA, 25 bp, Homo sapien
atctgtagctccacttgccactaac

SEQ ID NO: 440351 - DNA, 25 bp, Homo sapien
taacaaccctgtcatcaacatcatc

SEQ ID NO: 440352 - DNA, 25 bp, Homo sapien
gataggtcaccttgagatagtttca

SEQ ID NO: 440353 - DNA, 25 bp, Homo sapien
tcaagggatgttttggatgcttaca

SEQ ID NO: 440354 - DNA, 25 bp, Homo sapien
ggatgcttacagaagaagtcattag

SEQ ID NO: 440355 - DNA, 25 bp, Homo sapien
agtggcgataaattctttgctgctc

SEQ ID NO: 440356 - DNA, 25 bp, Homo sapien
gataaattctttgctgctcctctca

SEQ ID NO: 440357 - DNA, 25 bp, Homo sapien
gaatcgatttcctcagtgcaaacct

SEQ ID NO: 440358 - DNA, 25 bp, Homo sapien
aagcctcaggactcagttgcactaa

SEQ ID NO: 440359 - DNA, 25 bp, Homo sapien
ggactcagttgcactaatagaacac

SEQ ID NO: 440360 - DNA, 25 bp, Homo sapien
aggtgacttctgagtgagacttcaa

SEQ ID NO: 440361 - DNA, 25 bp, Homo sapien
gagacttcaaagaccagacagcatc

SEQ ID NO: 440362 - DNA, 25 bp, Homo sapien
aaagaccagacagcatccactcttg

SEQ ID NO: 440363 - DNA, 25 bp, Homo sapien
actggttttatttctatagtagcct

SEQ ID NO: 440364 - DNA, 25 bp, Homo sapien
gtagcctaatgatttgaggtaccac

SEQ ID NO: 440365 - DNA, 25 bp, Homo sapien
gaggtaccacaacttgagtcatttc

SEQ ID NO: 440366 - DNA, 25 bp, Homo sapien
gagtcatttctatcatgtttcacta

SEQ ID NO: 440367 - DNA, 25 bp, Homo sapien
tgtttcactattatacatttgtatg

SEQ ID NO: 440368 - DNA, 25 bp, Homo sapien
catttgtatgtggatacttgctttc

SEQ ID NO: 440369 - DNA, 25 bp, Homo sapien
tgctttctgatttctttaccctgaa

SEQ ID NO: 440370 - DNA, 25 bp, Homo sapien
ccttgttaatggcttccagcacttt

SEQ ID NO: 440371 - DNA, 25 bp, Homo sapien
aatggcttccagcacttttatggct

SEQ ID NO: 440372 - DNA, 25 bp, Homo sapien
tccagcacttttatggctttgataa

SEQ ID NO: 440373 - DNA, 25 bp, Homo sapien
tggctttgataaaggactttcctgt

SEQ ID NO: 440374 - DNA, 25 bp, Homo sapien
gaactagagatgtgtttgcctgctg

SEQ ID NO: 440375 - DNA, 25 bp, Homo sapien
aactagagatgtgtttgcctgctgg

SEQ ID NO: 440376 - DNA, 25 bp, Homo sapien
actagagatgtgtttgcctgctggg

SEQ ID NO: 440377 - DNA, 25 bp, Homo sapien
ctagagatgtgtttgcctgctgggc

SEQ ID NO: 440378 - DNA, 25 bp, Homo sapien
tagagatgtgtttgcctgctgggca

SEQ ID NO: 440379 - DNA, 25 bp, Homo sapien
agagatgtgtttgcctgctgggcat

SEQ ID NO: 440380 - DNA, 25 bp, Homo sapien
agatgtgtttgcctgctgggcatgg

SEQ ID NO: 440381 - DNA, 25 bp, Homo sapien
atgtgtttgcctgctgggcatggtg

SEQ ID NO: 440382 - DNA, 25 bp, Homo sapien
tcagcctgggggataatccgattga

SEQ ID NO: 440383 - DNA, 25 bp, Homo sapien
agcctgggggataatccgattgaga

SEQ ID NO: 440384 - DNA, 25 bp, Homo sapien
ctgggggataatccgattgagactc

SEQ ID NO: 440385 - DNA, 25 bp, Homo sapien
cagccactaaaagtgcgttaatgtc

SEQ ID NO: 440386 - DNA, 25 bp, Homo sapien
agccactaaaagtgcgttaatgtca

SEQ ID NO: 440387 - DNA, 25 bp, Homo sapien
gccactaaaagtgcgttaatgtcac

SEQ ID NO: 440388 - DNA, 25 bp, Homo sapien
ccactaaaagtgcgttaatgtcacg

SEQ ID NO: 440389 - DNA, 25 bp, Homo sapien
cactaaaagtgcgttaatgtcacgc

SEQ ID NO: 440390 - DNA, 25 bp, Homo sapien
actaaaagtgcgttaatgtcacgcc

SEQ ID NO: 440391 - DNA, 25 bp, Homo sapien
ctaaaagtgcgttaatgtcacgcct

SEQ ID NO: 440392 - DNA, 25 bp, Homo sapien
taaaagtgcgttaatgtcacgcctg

SEQ ID NO: 440393 - DNA, 25 bp, Homo sapien
aaaagtgcgttaatgtcacgcctgt

SEQ ID NO: 440394 - DNA, 25 bp, Homo sapien
aaagtgcgttaatgtcacgcctgta

SEQ ID NO: 440395 - DNA, 25 bp, Homo sapien
tcatctggagataactgctgctccc

SEQ ID NO: 440396 - DNA, 25 bp, Homo sapien
tgctgctcccatttttctgtacttt

SEQ ID NO: 440397 - DNA, 25 bp, Homo sapien
ttttctttttccattcacaccaaca

SEQ ID NO: 440398 - DNA, 25 bp, Homo sapien
ttctttttccattcacaccaacaaa

SEQ ID NO: 440399 - DNA, 25 bp, Homo sapien
tttcactttaagtgtcagtgggatt

SEQ ID NO: 440400 - DNA, 25 bp, Homo sapien
gtgtcagtgggattatattgtatat

SEQ ID NO: 440401 - DNA, 25 bp, Homo sapien
atatacagtttttgattcctcccct

SEQ ID NO: 440402 - DNA, 25 bp, Homo sapien
gaaaaatgtctctaattgctacata

SEQ ID NO: 440403 - DNA, 25 bp, Homo sapien
gctacataatattcccttgttttga

SEQ ID NO: 440404 - DNA, 25 bp, Homo sapien
tgaccattcaaatatcttgccagct

SEQ ID NO: 440405 - DNA, 25 bp, Homo sapien
cattcaaatatcttgccagctttta

SEQ ID NO: 440406 - DNA, 25 bp, Homo sapien
tgacaaattctctcagcctctgttt

SEQ ID NO: 440407 - DNA, 25 bp, Homo sapien
acagtatatctgtctggcccataaa

SEQ ID NO: 440408 - DNA, 25 bp, Homo sapien
atttagacagggttgaaatgcatca

SEQ ID NO: 440409 - DNA, 25 bp, Homo sapien
gcatcaaattaagtcctgtctccac

SEQ ID NO: 440410 - DNA, 25 bp, Homo sapien
aattaagtcctgtctccacaaagaa

SEQ ID NO: 440411 - DNA, 25 bp, Homo sapien
gaaaacacttttgtacttctgtgaa

SEQ ID NO: 440412 - DNA, 25 bp, Homo sapien
aaaaggctgcagagacgtggtgact

SEQ ID NO: 440413 - DNA, 25 bp, Homo sapien
tggtgactggccatgagtcagccca

SEQ ID NO: 440414 - DNA, 25 bp, Homo sapien
ggccatgagtcagcccaggactgtg

SEQ ID NO: 440415 - DNA, 25 bp, Homo sapien
actgtggtgcagctgtggtccttaa

SEQ ID NO: 440416 - DNA, 25 bp, Homo sapien
gtgcagctgtggtccttaatccctg

SEQ ID NO: 440417 - DNA, 25 bp, Homo sapien
cctgacccctagttgagtgcacact

SEQ ID NO: 440418 - DNA, 25 bp, Homo sapien
gttgagtgcacacttccaaccaggc

SEQ ID NO: 440419 - DNA, 25 bp, Homo sapien
tttatctcccacctaaatggcagct

SEQ ID NO: 440420 - DNA, 25 bp, Homo sapien
tgctcctcagagaccaagtgctaac

SEQ ID NO: 440421 - DNA, 25 bp, Homo sapien
aagtgctaacagctcccctgttgac

SEQ ID NO: 440422 - DNA, 25 bp, Homo sapien
ccctgttgacactatggaagccatg

SEQ ID NO: 440423 - DNA, 25 bp, Homo sapien
ggaagccatggagtgatctaattga

SEQ ID NO: 440424 - DNA, 25 bp, Homo sapien
acaggttgctataagtcagaggtca

SEQ ID NO: 440425 - DNA, 25 bp, Homo sapien
tcagaggtcaggtgtcctagggtaa

SEQ ID NO: 440426 - DNA, 25 bp, Homo sapien
gagtccctggagcaaagtcttctct

SEQ ID NO: 440427 - DNA, 25 bp, Homo sapien
tgtggctgatgctccctgcagggaa

SEQ ID NO: 440428 - DNA, 25 bp, Homo sapien
gactcacaggagaaaattattagat

SEQ ID NO: 440429 - DNA, 25 bp, Homo sapien
gaaaattattagatcctagcaacag

SEQ ID NO: 440430 - DNA, 25 bp, Homo sapien
aaaattattagatcctagcaacagg

SEQ ID NO: 440431 - DNA, 25 bp, Homo sapien
ttattagatcctagcaacaggtacc

SEQ ID NO: 440432 - DNA, 25 bp, Homo sapien
tattagatcctagcaacaggtacct

SEQ ID NO: 440433 - DNA, 25 bp, Homo sapien
attagatcctagcaacaggtacctg

SEQ ID NO: 440434 - DNA, 25 bp, Homo sapien
ttagatcctagcaacaggtacctgt

SEQ ID NO: 440435 - DNA, 25 bp, Homo sapien
tagatcctagcaacaggtacctgta

SEQ ID NO: 440436 - DNA, 25 bp, Homo sapien
agatcctagcaacaggtacctgtaa

SEQ ID NO: 440437 - DNA, 25 bp, Homo sapien
gatcctagcaacaggtacctgtaat

SEQ ID NO: 440438 - DNA, 25 bp, Homo sapien
atcctagcaacaggtacctgtaatc

SEQ ID NO: 440439 - DNA, 25 bp, Homo sapien
cacatgtattacacatatgtcacat

SEQ ID NO: 440440 - DNA, 25 bp, Homo sapien
gtcacatatatgtaaccgattctgg

SEQ ID NO: 440441 - DNA, 25 bp, Homo sapien
atatatgtaaccgattctggccagg

SEQ ID NO: 440442 - DNA, 25 bp, Homo sapien
atatgtaaccgattctggccaggca

SEQ ID NO: 440443 - DNA, 25 bp, Homo sapien
tatgtaaccgattctggccaggcac

SEQ ID NO: 440444 - DNA, 25 bp, Homo sapien
gagaccagcccagttaacgtagtga

SEQ ID NO: 440445 - DNA, 25 bp, Homo sapien
agaccagcccagttaacgtagtgag

SEQ ID NO: 440446 - DNA, 25 bp, Homo sapien
accagcccagttaacgtagtgagac

SEQ ID NO: 440447 - DNA, 25 bp, Homo sapien
cagcccagttaacgtagtgagaccc

SEQ ID NO: 440448 - DNA, 25 bp, Homo sapien
gaggctacagtgacgcagtgagcca

SEQ ID NO: 440449 - DNA, 25 bp, Homo sapien
gctacagtgacgcagtgagccatga

SEQ ID NO: 440450 - DNA, 25 bp, Homo sapien
aaacagggttcaccatccttaccag

SEQ ID NO: 440451 - DNA, 25 bp, Homo sapien
tccttaccagcattgggataaactg

SEQ ID NO: 440452 - DNA, 25 bp, Homo sapien
gggtgctctcaaaaaggacgctggt

SEQ ID NO: 440453 - DNA, 25 bp, Homo sapien
aaaggacgctggtggcaccattgca

SEQ ID NO: 440454 - DNA, 25 bp, Homo sapien
gcaccattgcagagaggcccataca

SEQ ID NO: 440455 - DNA, 25 bp, Homo sapien
agaggcccatacaccacgtagctgt

SEQ ID NO: 440456 - DNA, 25 bp, Homo sapien
acgtagctgtgtcctgtaatccaac

SEQ ID NO: 440457 - DNA, 25 bp, Homo sapien
tgtaatccaaccgatgtcggccaca

SEQ ID NO: 440458 - DNA, 25 bp, Homo sapien
gccacacagccaaagatgtcacctg

SEQ ID NO: 440459 - DNA, 25 bp, Homo sapien
cctggctggtggtcaaacacaagct

SEQ ID NO: 440460 - DNA, 25 bp, Homo sapien
gtcaaacacaagctgcagagacagg

SEQ ID NO: 440461 - DNA, 25 bp, Homo sapien
cattgttccctataggccttggtga

SEQ ID NO: 440462 - DNA, 25 bp, Homo sapien
ttgttccctataggccttggtgaca

SEQ ID NO: 440463 - DNA, 25 bp, Homo sapien
ttccctataggccttggtgacacgg

SEQ ID NO: 440464 - DNA, 25 bp, Homo sapien
cctataggccttggtgacacggaca

SEQ ID NO: 440465 - DNA, 25 bp, Homo sapien
taggccttggtgacacggacatcca

SEQ ID NO: 440466 - DNA, 25 bp, Homo sapien
ttggtgacacggacatccacccagt

SEQ ID NO: 440467 - DNA, 25 bp, Homo sapien
ggtgacacggacatccacccagtct

SEQ ID NO: 440468 - DNA, 25 bp, Homo sapien
ccagtctcctgcagccatggctgaa

SEQ ID NO: 440469 - DNA, 25 bp, Homo sapien
agccatggctgaaccacgtccctct

SEQ ID NO: 440470 - DNA, 25 bp, Homo sapien
tcagcccgtgcagagcgtcctgtag

SEQ ID NO: 440471 - DNA, 25 bp, Homo sapien
cgtgcagagcgtcctgtaggcctta

SEQ ID NO: 440472 - DNA, 25 bp, Homo sapien
acattgtcttataggagtgcattta

SEQ ID NO: 440473 - DNA, 25 bp, Homo sapien
cattgtcttataggagtgcatttag

SEQ ID NO: 440474 - DNA, 25 bp, Homo sapien
attgtcttataggagtgcatttagg

SEQ ID NO: 440475 - DNA, 25 bp, Homo sapien
ttgtcttataggagtgcatttaggc

SEQ ID NO: 440476 - DNA, 25 bp, Homo sapien
tgtcttataggagtgcatttaggcc

SEQ ID NO: 440477 - DNA, 25 bp, Homo sapien
gtcttataggagtgcatttaggcca

SEQ ID NO: 440478 - DNA, 25 bp, Homo sapien
tcttataggagtgcatttaggccag

SEQ ID NO: 440479 - DNA, 25 bp, Homo sapien
cttataggagtgcatttaggccagg

SEQ ID NO: 440480 - DNA, 25 bp, Homo sapien
attagctggacctagtggtgggcgt

SEQ ID NO: 440481 - DNA, 25 bp, Homo sapien
tagctggacctagtggtgggcgtct

SEQ ID NO: 440482 - DNA, 25 bp, Homo sapien
gctggacctagtggtgggcgtctgt

SEQ ID NO: 440483 - DNA, 25 bp, Homo sapien
tccagcctcggcaataaagcgaaaa

SEQ ID NO: 440484 - DNA, 25 bp, Homo sapien
ataccttatccctgagcgttgtaat

SEQ ID NO: 440485 - DNA, 25 bp, Homo sapien
agcgttgtaattttctatggccagg

SEQ ID NO: 440486 - DNA, 25 bp, Homo sapien
attttctatggccaggtctctcaat

SEQ ID NO: 440487 - DNA, 25 bp, Homo sapien
gtctctcaatctgcactggcttttt

SEQ ID NO: 440488 - DNA, 25 bp, Homo sapien
ttttttgcaccagctaactctcatt

SEQ ID NO: 440489 - DNA, 25 bp, Homo sapien
aggtaattctttttattcgccgatg

SEQ ID NO: 440490 - DNA, 25 bp, Homo sapien
tttattcgccgatgtttgtgctctt

SEQ ID NO: 440491 - DNA, 25 bp, Homo sapien
gccgatgtttgtgctcttgtaagta

SEQ ID NO: 440492 - DNA, 25 bp, Homo sapien
agtaattcttaagcatctactatgt

SEQ ID NO: 440493 - DNA, 25 bp, Homo sapien
atgtgcctggaaatgctatagttgt

SEQ ID NO: 440494 - DNA, 25 bp, Homo sapien
aggaaccaaggagggtgtctggaag

SEQ ID NO: 440495 - DNA, 25 bp, Homo sapien
ccaaggagggtgtctggaagtacct

SEQ ID NO: 440496 - DNA, 25 bp, Homo sapien
agggtgtctggaagtacctggaagg

SEQ ID NO: 440497 - DNA, 25 bp, Homo sapien
ctggaagtacctggaaggggtcact

SEQ ID NO: 440498 - DNA, 25 bp, Homo sapien
ggtcactgggagaagccccaagaaa

SEQ ID NO: 440499 - DNA, 25 bp, Homo sapien
gtcactgggagaagccccaagaaag

SEQ ID NO: 440500 - DNA, 25 bp, Homo sapien
ccccaagaaagatgcagcctcaggc

SEQ ID NO: 440501 - DNA, 25 bp, Homo sapien
cccaagaaagatgcagcctcaggct

SEQ ID NO: 440502 - DNA, 25 bp, Homo sapien
ccaagaaagatgcagcctcaggctg

SEQ ID NO: 440503 - DNA, 25 bp, Homo sapien
aaagatgcagcctcaggctgggtgc

SEQ ID NO: 440504 - DNA, 25 bp, Homo sapien
gggtaatggcacgtgcctgcaatcc

SEQ ID NO: 440505 - DNA, 25 bp, Homo sapien
ccaaaaggccatcgactgcattctt

SEQ ID NO: 440506 - DNA, 25 bp, Homo sapien
aaaaggccatcgactgcattcttcc

SEQ ID NO: 440507 - DNA, 25 bp, Homo sapien
tgttaagaattcagccccaagataa

SEQ ID NO: 440508 - DNA, 25 bp, Homo sapien
acaaaccctggcaactcttttggtg

SEQ ID NO: 440509 - DNA, 25 bp, Homo sapien
caaaccctggcaactcttttggtga

SEQ ID NO: 440510 - DNA, 25 bp, Homo sapien
aagcagccttacatccctaagatgg

SEQ ID NO: 440511 - DNA, 25 bp, Homo sapien
agccttacatccctaagatggccaa

SEQ ID NO: 440512 - DNA, 25 bp, Homo sapien
catccctaagatggccaagctgaag

SEQ ID NO: 440513 - DNA, 25 bp, Homo sapien
agaagaatgctgctgactataagtt

SEQ ID NO: 440514 - DNA, 25 bp, Homo sapien
gaatgctgctgactataagtttcaa

SEQ ID NO: 440515 - DNA, 25 bp, Homo sapien
tgctgctgactataagtttcaagga

SEQ ID NO: 440516 - DNA, 25 bp, Homo sapien
tgccctttcaaaagtcaaaggcacg

SEQ ID NO: 440517 - DNA, 25 bp, Homo sapien
gccctttcaaaagtcaaaggcacgc

SEQ ID NO: 440518 - DNA, 25 bp, Homo sapien
cctttcaaaagtcaaaggcacgccg

SEQ ID NO: 440519 - DNA, 25 bp, Homo sapien
ctttcaaaagtcaaaggcacgccgg

SEQ ID NO: 440520 - DNA, 25 bp, Homo sapien
tttcaaaagtcaaaggcacgccggg

SEQ ID NO: 440521 - DNA, 25 bp, Homo sapien
ttcaaaagtcaaaggcacgccgggc

SEQ ID NO: 440522 - DNA, 25 bp, Homo sapien
tcaaaagtcaaaggcacgccgggca

SEQ ID NO: 440523 - DNA, 25 bp, Homo sapien
aaaagtcaaaggcacgccgggcaca

SEQ ID NO: 440524 - DNA, 25 bp, Homo sapien
aaagtcaaaggcacgccgggcacag

SEQ ID NO: 440525 - DNA, 25 bp, Homo sapien
aagtcaaaggcacgccgggcacagt

SEQ ID NO: 440526 - DNA, 25 bp, Homo sapien
agtcaaaggcacgccgggcacagtg

SEQ ID NO: 440527 - DNA, 25 bp, Homo sapien
ccctcatgacatttaatccgttgag

SEQ ID NO: 440528 - DNA, 25 bp, Homo sapien
aatccgttgagtcgtcagaatccca

SEQ ID NO: 440529 - DNA, 25 bp, Homo sapien
gttgagtcgtcagaatcccactcac

SEQ ID NO: 440530 - DNA, 25 bp, Homo sapien
agaatcccactcactcaagacattc

SEQ ID NO: 440531 - DNA, 25 bp, Homo sapien
aagacattccccctagatttgtatt

SEQ ID NO: 440532 - DNA, 25 bp, Homo sapien
gatttgtatttctcaaagctttttt

SEQ ID NO: 440533 - DNA, 25 bp, Homo sapien
gtaatacatggatacactcttgtga

SEQ ID NO: 440534 - DNA, 25 bp, Homo sapien
acatggatacactcttgtgaaaaga

SEQ ID NO: 440535 - DNA, 25 bp, Homo sapien
gaaattggagcattgtacttaaagc

SEQ ID NO: 440536 - DNA, 25 bp, Homo sapien
gcattgtacttaaagctgatgtcct

SEQ ID NO: 440537 - DNA, 25 bp, Homo sapien
ttaaagctgatgtccttaggagctg

SEQ ID NO: 440538 - DNA, 25 bp, Homo sapien
tttttaaaaaatctggccaggcaca

SEQ ID NO: 440539 - DNA, 25 bp, Homo sapien
ttttaaaaaatctggccaggcacag

SEQ ID NO: 440540 - DNA, 25 bp, Homo sapien
ttaaaaaatctggccaggcacagta

SEQ ID NO: 440541 - DNA, 25 bp, Homo sapien
taaaaaatctggccaggcacagtag

SEQ ID NO: 440542 - DNA, 25 bp, Homo sapien
aaaaaatctggccaggcacagtagc

SEQ ID NO: 440543 - DNA, 25 bp, Homo sapien
aaaaatctggccaggcacagtagct

SEQ ID NO: 440544 - DNA, 25 bp, Homo sapien
aaaatctggccaggcacagtagctc

SEQ ID NO: 440545 - DNA, 25 bp, Homo sapien
aatctggccaggcacagtagctcat

SEQ ID NO: 440546 - DNA, 25 bp, Homo sapien
atctggccaggcacagtagctcatg

SEQ ID NO: 440547 - DNA, 25 bp, Homo sapien
tctggccaggcacagtagctcatgc

SEQ ID NO: 440548 - DNA, 25 bp, Homo sapien
ctggccaggcacagtagctcatgcc

SEQ ID NO: 440549 - DNA, 25 bp, Homo sapien
catgtttattatatggtagtttgaa

SEQ ID NO: 440550 - DNA, 25 bp, Homo sapien
atgtttattatatggtagtttgaaa

SEQ ID NO: 440551 - DNA, 25 bp, Homo sapien
aaaaagagtaaatcatggccggacg

SEQ ID NO: 440552 - DNA, 25 bp, Homo sapien
aaaagagtaaatcatggccggacgc

SEQ ID NO: 440553 - DNA, 25 bp, Homo sapien
aaagagtaaatcatggccggacgcg

SEQ ID NO: 440554 - DNA, 25 bp, Homo sapien
aagagtaaatcatggccggacgcgg

SEQ ID NO: 440555 - DNA, 25 bp, Homo sapien
agagtaaatcatggccggacgcggt

SEQ ID NO: 440556 - DNA, 25 bp, Homo sapien
gagtaaatcatggccggacgcggtg

SEQ ID NO: 440557 - DNA, 25 bp, Homo sapien
gggtgtggtgctgggcctgtagccc

SEQ ID NO: 440558 - DNA, 25 bp, Homo sapien
tggtgctgggcctgtagcccagcta

SEQ ID NO: 440559 - DNA, 25 bp, Homo sapien
gtgctgggcctgtagcccagctact

SEQ ID NO: 440560 - DNA, 25 bp, Homo sapien
taaaacttatttggagtcctctccg

SEQ ID NO: 440561 - DNA, 25 bp, Homo sapien
cttatttggagtcctctccgtttct

SEQ ID NO: 440562 - DNA, 25 bp, Homo sapien
ttatttggagtcctctccgtttctt

SEQ ID NO: 440563 - DNA, 25 bp, Homo sapien
tatttggagtcctctccgtttcttt

SEQ ID NO: 440564 - DNA, 25 bp, Homo sapien
ttggagtcctctccgtttcttttct

SEQ ID NO: 440565 - DNA, 25 bp, Homo sapien
tggagtcctctccgtttcttttctc

SEQ ID NO: 440566 - DNA, 25 bp, Homo sapien
tctccgtttcttttctctgtaggtt

SEQ ID NO: 440567 - DNA, 25 bp, Homo sapien
tcttttctctgtaggtttacccaag

SEQ ID NO: 440568 - DNA, 25 bp, Homo sapien
ttttctctgtaggtttacccaagag

SEQ ID NO: 440569 - DNA, 25 bp, Homo sapien
tttctctgtaggtttacccaagaga

SEQ ID NO: 440570 - DNA, 25 bp, Homo sapien
gatgatttgtagagatactggtaga

SEQ ID NO: 440571 - DNA, 25 bp, Homo sapien
caataaatgggatggttctgaatga

SEQ ID NO: 440572 - DNA, 25 bp, Homo sapien
ggttctgaatgaaagtgggcacaca

SEQ ID NO: 440573 - DNA, 25 bp, Homo sapien
ctgaatgaaagtgggcacacaggag

SEQ ID NO: 440574 - DNA, 25 bp, Homo sapien
aaaatccaagccactcactgcatat

SEQ ID NO: 440575 - DNA, 25 bp, Homo sapien
aatccaagccactcactgcatatgt

SEQ ID NO: 440576 - DNA, 25 bp, Homo sapien
atccaagccactcactgcatatgtg

SEQ ID NO: 440577 - DNA, 25 bp, Homo sapien
actgcatatgtgtcttctttaagaa

SEQ ID NO: 440578 - DNA, 25 bp, Homo sapien
gtcttctttaagaatcccctactga

SEQ ID NO: 440579 - DNA, 25 bp, Homo sapien
ttctttaagaatcccctactgaggc

SEQ ID NO: 440580 - DNA, 25 bp, Homo sapien
ctttaagaatcccctactgaggcca

SEQ ID NO: 440581 - DNA, 25 bp, Homo sapien
aagaccaagacataattagaggatt

SEQ ID NO: 440582 - DNA, 25 bp, Homo sapien
gactttcagccctaacctatggaga

SEQ ID NO: 440583 - DNA, 25 bp, Homo sapien
gcctatgcaatgaagccaccataaa

SEQ ID NO: 440584 - DNA, 25 bp, Homo sapien
tttggaacagcttctgggtagctga

SEQ ID NO: 440585 - DNA, 25 bp, Homo sapien
gcttctgggtagctgaacatgtgaa

SEQ ID NO: 440586 - DNA, 25 bp, Homo sapien
atgtgccagtgagagcatgaaagct

SEQ ID NO: 440587 - DNA, 25 bp, Homo sapien
gaaagctccatgtcccttcttccat

SEQ ID NO: 440588 - DNA, 25 bp, Homo sapien
gtcccttcttccatactttaatcta

SEQ ID NO: 440589 - DNA, 25 bp, Homo sapien
tttaatctatacacttttccatctg

SEQ ID NO: 440590 - DNA, 25 bp, Homo sapien
acttttccatctggttgttcatctg

SEQ ID NO: 440591 - DNA, 25 bp, Homo sapien
catctggttgttcatctgtattttt

SEQ ID NO: 440592 - DNA, 25 bp, Homo sapien
aggcccagaaacgacttccatttct

SEQ ID NO: 440593 - DNA, 25 bp, Homo sapien
tttcttgctaccctgaagtgggaaa

SEQ ID NO: 440594 - DNA, 25 bp, Homo sapien
aatgggctaacagggaagattctcc

SEQ ID NO: 440595 - DNA, 25 bp, Homo sapien
gaggtccgaagaggcaaatccaaca

SEQ ID NO: 440596 - DNA, 25 bp, Homo sapien
caacaggagttcgtccaccctggaa

SEQ ID NO: 440597 - DNA, 25 bp, Homo sapien
tgagctccaggaatggcaaaatcta

SEQ ID NO: 440598 - DNA, 25 bp, Homo sapien
aaatctagggcagctttgtccaggc

SEQ ID NO: 440599 - DNA, 25 bp, Homo sapien
gcagctttgtccaggcagtgagttc

SEQ ID NO: 440600 - DNA, 25 bp, Homo sapien
gtgagttccagcacactgagcacac

SEQ ID NO: 440601 - DNA, 25 bp, Homo sapien
tgagcacacacgtagtccaggtgag

SEQ ID NO: 440602 - DNA, 25 bp, Homo sapien
aggtgaggcagtcccctttcagtgt

SEQ ID NO: 440603 - DNA, 25 bp, Homo sapien
gggaggcatagcattaggacaatac

SEQ ID NO: 440604 - DNA, 25 bp, Homo sapien
ggaggcatagcattaggacaatacc

SEQ ID NO: 440605 - DNA, 25 bp, Homo sapien
gaggcatagcattaggacaataccc

SEQ ID NO: 440606 - DNA, 25 bp, Homo sapien
ggcatagcattaggacaatacccat

SEQ ID NO: 440607 - DNA, 25 bp, Homo sapien
gcatagcattaggacaatacccatg

SEQ ID NO: 440608 - DNA, 25 bp, Homo sapien
tagcattaggacaatacccatgcat

SEQ ID NO: 440609 - DNA, 25 bp, Homo sapien
cattaggacaatacccatgcatctg

SEQ ID NO: 440610 - DNA, 25 bp, Homo sapien
attaggacaatacccatgcatctgg

SEQ ID NO: 440611 - DNA, 25 bp, Homo sapien
atacccatgcatctggggcttataa

SEQ ID NO: 440612 - DNA, 25 bp, Homo sapien
gggcttataacgagatgacaggttg

SEQ ID NO: 440613 - DNA, 25 bp, Homo sapien
gcttataacgagatgacaggttgat

SEQ ID NO: 440614 - DNA, 25 bp, Homo sapien
atcagggagataaattcaacccagt

SEQ ID NO: 440615 - DNA, 25 bp, Homo sapien
ttggtagaaagttttcagcagccag

SEQ ID NO: 440616 - DNA, 25 bp, Homo sapien
tttcagcagccagttgcagtggcac

SEQ ID NO: 440617 - DNA, 25 bp, Homo sapien
tcagcagccagttgcagtggcacat

SEQ ID NO: 440618 - DNA, 25 bp, Homo sapien
agcagccagttgcagtggcacatgc

SEQ ID NO: 440619 - DNA, 25 bp, Homo sapien
tggctggtggcatggtagtaccctt

SEQ ID NO: 440620 - DNA, 25 bp, Homo sapien
ggctggtggcatggtagtacccttg

SEQ ID NO: 440621 - DNA, 25 bp, Homo sapien
gctggtggcatggtagtacccttgg

SEQ ID NO: 440622 - DNA, 25 bp, Homo sapien
tggtggcatggtagtacccttggga

SEQ ID NO: 440623 - DNA, 25 bp, Homo sapien
tggcatggtagtacccttgggaggc

SEQ ID NO: 440624 - DNA, 25 bp, Homo sapien
ggcatggtagtacccttgggaggct

SEQ ID NO: 440625 - DNA, 25 bp, Homo sapien
atatatttagcattgctgagctttt

SEQ ID NO: 440626 - DNA, 25 bp, Homo sapien
cattgctgagctttttagatgccta

SEQ ID NO: 440627 - DNA, 25 bp, Homo sapien
ttgctgagctttttagatgcctatt

SEQ ID NO: 440628 - DNA, 25 bp, Homo sapien
gctgagctttttagatgcctattgt

SEQ ID NO: 440629 - DNA, 25 bp, Homo sapien
gagctttttagatgcctattgtgta

SEQ ID NO: 440630 - DNA, 25 bp, Homo sapien
agctttttagatgcctattgtgtat

SEQ ID NO: 440631 - DNA, 25 bp, Homo sapien
ctttttagatgcctattgtgtatct

SEQ ID NO: 440632 - DNA, 25 bp, Homo sapien
ctcattggttcatagtctttatttt

SEQ ID NO: 440633 - DNA, 25 bp, Homo sapien
attggttcatagtctttattttgtc

SEQ ID NO: 440634 - DNA, 25 bp, Homo sapien
ggttcatagtctttattttgtcctt

SEQ ID NO: 440635 - DNA, 25 bp, Homo sapien
tattttgtcctttgaataaacatta

SEQ ID NO: 440636 - DNA, 25 bp, Homo sapien
gtaaattcaacctcaataaagtata

SEQ ID NO: 440637 - DNA, 25 bp, Homo sapien
taaattcaacctcaataaagtatat

SEQ ID NO: 440638 - DNA, 25 bp, Homo sapien
aaattcaacctcaataaagtatatt

SEQ ID NO: 440639 - DNA, 25 bp, Homo sapien
aattcaacctcaataaagtatattt

SEQ ID NO: 440640 - DNA, 25 bp, Homo sapien
attcaacctcaataaagtatatttg

SEQ ID NO: 440641 - DNA, 25 bp, Homo sapien
ttcaacctcaataaagtatatttga

SEQ ID NO: 440642 - DNA, 25 bp, Homo sapien
tcaacctcaataaagtatatttgaa

SEQ ID NO: 440643 - DNA, 25 bp, Homo sapien
caacctcaataaagtatatttgaaa

SEQ ID NO: 440644 - DNA, 25 bp, Homo sapien
tatttgaaaaattttgctgggtgcg

SEQ ID NO: 440645 - DNA, 25 bp, Homo sapien
atttgaaaaattttgctgggtgcgg

SEQ ID NO: 440646 - DNA, 25 bp, Homo sapien
ttgaaaaattttgctgggtgcggtg

SEQ ID NO: 440647 - DNA, 25 bp, Homo sapien
taagtctccccattatgttctctga

SEQ ID NO: 440648 - DNA, 25 bp, Homo sapien
ttatgttctctgagcatccagggct

SEQ ID NO: 440649 - DNA, 25 bp, Homo sapien
agcatccagggcttctcttggtagc

SEQ ID NO: 440650 - DNA, 25 bp, Homo sapien
tcttggtagcttttgttacaattaa

SEQ ID NO: 440651 - DNA, 25 bp, Homo sapien
atctgcttgttgttgagtccgtttt

SEQ ID NO: 440652 - DNA, 25 bp, Homo sapien
gttttaaaccccaagaggacagatg

SEQ ID NO: 440653 - DNA, 25 bp, Homo sapien
agccctgcacttggctcagagtggg

SEQ ID NO: 440654 - DNA, 25 bp, Homo sapien
gtgggtactccgtaaagacttgtgg

SEQ ID NO: 440655 - DNA, 25 bp, Homo sapien
tggccacatcatatcatttaagcac

SEQ ID NO: 440656 - DNA, 25 bp, Homo sapien
tatcatttaagcacccacataattg

SEQ ID NO: 440657 - DNA, 25 bp, Homo sapien
ttgcttatgaataacagctctcttt

SEQ ID NO: 440658 - DNA, 25 bp, Homo sapien
tcaaatgtgtgaatgctgtggttaa

SEQ ID NO: 440659 - DNA, 25 bp, Homo sapien
gctgtggttaaagtatttccattat

SEQ ID NO: 440660 - DNA, 25 bp, Homo sapien
ttttttgtctcaggttccattctac

SEQ ID NO: 440661 - DNA, 25 bp, Homo sapien
gtctcaggttccattctacatcaaa

SEQ ID NO: 440662 - DNA, 25 bp, Homo sapien
aaatgtctttcactgtatgtgtaca

SEQ ID NO: 440663 - DNA, 25 bp, Homo sapien
atggagaaccataacctataattgt

SEQ ID NO: 440664 - DNA, 25 bp, Homo sapien
gaaacttgcagacacatattaacag

SEQ ID NO: 440665 - DNA, 25 bp, Homo sapien
acagttggtgacttatcgccagttg

SEQ ID NO: 440666 - DNA, 25 bp, Homo sapien
atcgccagttggtgacttacttacc

SEQ ID NO: 440667 - DNA, 25 bp, Homo sapien
ttggtgacttacttacctacccctg

SEQ ID NO: 440668 - DNA, 25 bp, Homo sapien
ccctgcctctcaaatcttgttataa

SEQ ID NO: 440669 - DNA, 25 bp, Homo sapien
ggcacaataagagataagcaggctg

SEQ ID NO: 440670 - DNA, 25 bp, Homo sapien
gcacaataagagataagcaggctgg

SEQ ID NO: 440671 - DNA, 25 bp, Homo sapien
cacaataagagataagcaggctgga

SEQ ID NO: 440672 - DNA, 25 bp, Homo sapien
acaataagagataagcaggctggac

SEQ ID NO: 440673 - DNA, 25 bp, Homo sapien
aataagagataagcaggctggacgt

SEQ ID NO: 440674 - DNA, 25 bp, Homo sapien
taagagataagcaggctggacgtgc

SEQ ID NO: 440675 - DNA, 25 bp, Homo sapien
aagagataagcaggctggacgtgct

SEQ ID NO: 440676 - DNA, 25 bp, Homo sapien
ataagcaggctggacgtgctggctc

SEQ ID NO: 440677 - DNA, 25 bp, Homo sapien
taagcaggctggacgtgctggctca

SEQ ID NO: 440678 - DNA, 25 bp, Homo sapien
aagcaggctggacgtgctggctcac

SEQ ID NO: 440679 - DNA, 25 bp, Homo sapien
aaaaatgtggaaattaatcaggtgt

SEQ ID NO: 440680 - DNA, 25 bp, Homo sapien
tgtgtgtccccttaaggcaatgttg

SEQ ID NO: 440681 - DNA, 25 bp, Homo sapien
gttgattcaaatctgctcgagatgc

SEQ ID NO: 440682 - DNA, 25 bp, Homo sapien
gctcgagatgcagtgttgcacagct

SEQ ID NO: 440683 - DNA, 25 bp, Homo sapien
gttgcacagctaagcatcttcttga

SEQ ID NO: 440684 - DNA, 25 bp, Homo sapien
atcttcttgattacaatccgccaca

SEQ ID NO: 440685 - DNA, 25 bp, Homo sapien
cactgccacggatactttgtcaaca

SEQ ID NO: 440686 - DNA, 25 bp, Homo sapien
gtcaacagtcaaattacaccacgct

SEQ ID NO: 440687 - DNA, 25 bp, Homo sapien
ttacaccacgctgataacaatgcat

SEQ ID NO: 440688 - DNA, 25 bp, Homo sapien
aatgcataatggtgttcctcctcca

SEQ ID NO: 440689 - DNA, 25 bp, Homo sapien
gatgttttcttctcaactgtatcta

SEQ ID NO: 440690 - DNA, 25 bp, Homo sapien
gtttgtatgaccaggtccccagtca

SEQ ID NO: 440691 - DNA, 25 bp, Homo sapien
ttacacacacatacctgtttaaatg

SEQ ID NO: 440692 - DNA, 25 bp, Homo sapien
gaagattttaatgacagggcactct

SEQ ID NO: 440693 - DNA, 25 bp, Homo sapien
aatgacagggcactcttttggccaa

SEQ ID NO: 440694 - DNA, 25 bp, Homo sapien
agcagtggaatttcctaagcagcaa

SEQ ID NO: 440695 - DNA, 25 bp, Homo sapien
ggtaatagtgctggtaggatctgta

SEQ ID NO: 440696 - DNA, 25 bp, Homo sapien
aggatctgtatgtgtaagctgttac

SEQ ID NO: 440697 - DNA, 25 bp, Homo sapien
gtaagctgttacacaagctgaggat

SEQ ID NO: 440698 - DNA, 25 bp, Homo sapien
caagctgaggatcaaagtgccaatt

SEQ ID NO: 440699 - DNA, 25 bp, Homo sapien
gaaatgaaagtctctgatctgtgtt

SEQ ID NO: 440700 - DNA, 25 bp, Homo sapien
tctgatctgtgttgtatgccctaat

SEQ ID NO: 440701 - DNA, 25 bp, Homo sapien
gccctaatacaacaacagcaagaag

SEQ ID NO: 440702 - DNA, 25 bp, Homo sapien
gcttggacatgaatactggcccttc

SEQ ID NO: 440703 - DNA, 25 bp, Homo sapien
ggacatgaatactggcccttcactt

SEQ ID NO: 440704 - DNA, 25 bp, Homo sapien
tcatagtctgcctctctcatagtaa

SEQ ID NO: 440705 - DNA, 25 bp, Homo sapien
agtctgcctctctcatagtaaataa

SEQ ID NO: 440706 - DNA, 25 bp, Homo sapien
cagattatacttattatcaggccaa

SEQ ID NO: 440707 - DNA, 25 bp, Homo sapien
atcaggccaaaattgtgaccacagt

SEQ ID NO: 440708 - DNA, 25 bp, Homo sapien
aaattgtgaccacagtgtgggacat

SEQ ID NO: 440709 - DNA, 25 bp, Homo sapien
tgctctaaccagcaagaagcttggg

SEQ ID NO: 440710 - DNA, 25 bp, Homo sapien
agcaagaagcttgggtatcagcttt

SEQ ID NO: 440711 - DNA, 25 bp, Homo sapien
tgtgtcacctcttgaatcaaatgtg

SEQ ID NO: 440712 - DNA, 25 bp, Homo sapien
gcagcctccctaaacggatacagta

SEQ ID NO: 440713 - DNA, 25 bp, Homo sapien
aaatcaaaatgcttctctttacaaa

SEQ ID NO: 440714 - DNA, 25 bp, Homo sapien
aaatgcttctctttacaaagactgt

SEQ ID NO: 440715 - DNA, 25 bp, Homo sapien
gcttctctttacaaagactgtgtat

SEQ ID NO: 440716 - DNA, 25 bp, Homo sapien
gactgtgtattcaataccttaaacg

SEQ ID NO: 440717 - DNA, 25 bp, Homo sapien
gtattcaataccttaaacgaacttg

SEQ ID NO: 440718 - DNA, 25 bp, Homo sapien
taccttaaacgaacttgaagtggag

SEQ ID NO: 440719 - DNA, 25 bp, Homo sapien
ttaaacgaacttgaagtggagcttt

SEQ ID NO: 440720 - DNA, 25 bp, Homo sapien
ttttgaaatttgtgtccgaagtgca

SEQ ID NO: 440721 - DNA, 25 bp, Homo sapien
cagtggcagtaacctcaagcttcga

SEQ ID NO: 440722 - DNA, 25 bp, Homo sapien
gcttcgaaggtcagagatgcctgca

SEQ ID NO: 440723 - DNA, 25 bp, Homo sapien
ctgcagatccataccatgtcacaat

SEQ ID NO: 440724 - DNA, 25 bp, Homo sapien
gtggccctttgacctctggtggaaa

SEQ ID NO: 440725 - DNA, 25 bp, Homo sapien
acctctggtggaaaatcagcatcta

SEQ ID NO: 440726 - DNA, 25 bp, Homo sapien
ggtggaaaatcagcatctagtcatg

SEQ ID NO: 440727 - DNA, 25 bp, Homo sapien
cagcatctagtcatggagctccata

SEQ ID NO: 440728 - DNA, 25 bp, Homo sapien
gagctccataaatcaatctgtcttt

SEQ ID NO: 440729 - DNA, 25 bp, Homo sapien
ataaatcaatctgtctttctcactg

SEQ ID NO: 440730 - DNA, 25 bp, Homo sapien
ttccaaagcaacatggcattcacgc

SEQ ID NO: 440731 - DNA, 25 bp, Homo sapien
aagcaacatggcattcacgcagggc

SEQ ID NO: 440732 - DNA, 25 bp, Homo sapien
atggcattcacgcagggcctggtaa

SEQ ID NO: 440733 - DNA, 25 bp, Homo sapien
cacgcagggcctggtaatgaaatga

SEQ ID NO: 440734 - DNA, 25 bp, Homo sapien
cagggcctggtaatgaaatgagatt

SEQ ID NO: 440735 - DNA, 25 bp, Homo sapien
atcatttgaggtcggtagttcagga

SEQ ID NO: 440736 - DNA, 25 bp, Homo sapien
tcatttgaggtcggtagttcaggac

SEQ ID NO: 440737 - DNA, 25 bp, Homo sapien
catttgaggtcggtagttcaggacc

SEQ ID NO: 440738 - DNA, 25 bp, Homo sapien
cctggcctatgtggtgaaaccgcat

SEQ ID NO: 440739 - DNA, 25 bp, Homo sapien
ctggcctatgtggtgaaaccgcatc

SEQ ID NO: 440740 - DNA, 25 bp, Homo sapien
tggcctatgtggtgaaaccgcatct

SEQ ID NO: 440741 - DNA, 25 bp, Homo sapien
ggcctatgtggtgaaaccgcatctc

SEQ ID NO: 440742 - DNA, 25 bp, Homo sapien
gcctatgtggtgaaaccgcatctct

SEQ ID NO: 440743 - DNA, 25 bp, Homo sapien
ccgcatctctactacaagtacaaaa

SEQ ID NO: 440744 - DNA, 25 bp, Homo sapien
gaggctgagaatcacttgaccctgg

SEQ ID NO: 440745 - DNA, 25 bp, Homo sapien
ggctgagaatcacttgaccctggga

SEQ ID NO: 440746 - DNA, 25 bp, Homo sapien
acccatggtcttcagccatgtggag

SEQ ID NO: 440747 - DNA, 25 bp, Homo sapien
tggagcttcagcgagggcttctact

SEQ ID NO: 440748 - DNA, 25 bp, Homo sapien
ggcttctactttgctttcatcactc

SEQ ID NO: 440749 - DNA, 25 bp, Homo sapien
tttcatcactctcagcaccattggc

SEQ ID NO: 440750 - DNA, 25 bp, Homo sapien
gttgttggcacagaccccagcaagc

SEQ ID NO: 440751 - DNA, 25 bp, Homo sapien
gaccccagcaagcattatatctcag

SEQ ID NO: 440752 - DNA, 25 bp, Homo sapien
atatctcagtgtatcggagcctggc

SEQ ID NO: 440753 - DNA, 25 bp, Homo sapien
gtgtatcggagcctggcagccatct

SEQ ID NO: 440754 - DNA, 25 bp, Homo sapien
tggcagccatctggatcctcctggg

SEQ ID NO: 440755 - DNA, 25 bp, Homo sapien
tgcttctgcacagatgctgccagct

SEQ ID NO: 440756 - DNA, 25 bp, Homo sapien
gggcagcctctgaccccagtgggct

SEQ ID NO: 440757 - DNA, 25 bp, Homo sapien
ggattatagaagttgacccttttgc

SEQ ID NO: 440758 - DNA, 25 bp, Homo sapien
attatagaagttgacccttttgcag

SEQ ID NO: 440759 - DNA, 25 bp, Homo sapien
tatagaagttgacccttttgcagtt

SEQ ID NO: 440760 - DNA, 25 bp, Homo sapien
tagaagttgacccttttgcagttaa

SEQ ID NO: 440761 - DNA, 25 bp, Homo sapien
gaagttgacccttttgcagttaaag

SEQ ID NO: 440762 - DNA, 25 bp, Homo sapien
gttgacccttttgcagttaaagctg

SEQ ID NO: 440763 - DNA, 25 bp, Homo sapien
gacccttttgcagttaaagctggaa

SEQ ID NO: 440764 - DNA, 25 bp, Homo sapien
ccttttgcagttaaagctggaaact

SEQ ID NO: 440765 - DNA, 25 bp, Homo sapien
tgcagttaaagctggaaacttactt

SEQ ID NO: 440766 - DNA, 25 bp, Homo sapien
gctggaaacttacttgttttatccg

SEQ ID NO: 440767 - DNA, 25 bp, Homo sapien
tggaaacttacttgttttatccgag

SEQ ID NO: 440768 - DNA, 25 bp, Homo sapien
attaagcatcttaactggagtagga

SEQ ID NO: 440769 - DNA, 25 bp, Homo sapien
ggaatgatgagctctgacatccttt

SEQ ID NO: 440770 - DNA, 25 bp, Homo sapien
atgagctctgacatcctttttccag

SEQ ID NO: 440771 - DNA, 25 bp, Homo sapien
gaaagacagtcattggtcacaggaa

SEQ ID NO: 440772 - DNA, 25 bp, Homo sapien
attgagaggccaatggtaagctgtg

SEQ ID NO: 440773 - DNA, 25 bp, Homo sapien
gggatggtgactagaccttctcact

SEQ ID NO: 440774 - DNA, 25 bp, Homo sapien
tgactagaccttctcactgacatgc

SEQ ID NO: 440775 - DNA, 25 bp, Homo sapien
acatgcctggagactattacctctc

SEQ ID NO: 440776 - DNA, 25 bp, Homo sapien
gagactattacctctcaattcccag

SEQ ID NO: 440777 - DNA, 25 bp, Homo sapien
ctctcaattcccagtacgagtaaat

SEQ ID NO: 440778 - DNA, 25 bp, Homo sapien
ggataagatatcttccttggacaag

SEQ ID NO: 440779 - DNA, 25 bp, Homo sapien
atctcccaggttctcattggaaagg

SEQ ID NO: 440780 - DNA, 25 bp, Homo sapien
tctcccaggttctcattggaaaggc

SEQ ID NO: 440781 - DNA, 25 bp, Homo sapien
ctcccaggttctcattggaaaggca

SEQ ID NO: 440782 - DNA, 25 bp, Homo sapien
tcccaggttctcattggaaaggcag

SEQ ID NO: 440783 - DNA, 25 bp, Homo sapien
cccaggttctcattggaaaggcagg

SEQ ID NO: 440784 - DNA, 25 bp, Homo sapien
ccaggttctcattggaaaggcaggg

SEQ ID NO: 440785 - DNA, 25 bp, Homo sapien
caggttctcattggaaaggcagggt

SEQ ID NO: 440786 - DNA, 25 bp, Homo sapien
ggttctcattggaaaggcagggtta

SEQ ID NO: 440787 - DNA, 25 bp, Homo sapien
ttctcattggaaaggcagggttaaa

SEQ ID NO: 440788 - DNA, 25 bp, Homo sapien
tctcattggaaaggcagggttaaaa

SEQ ID NO: 440789 - DNA, 25 bp, Homo sapien
taaaaggaaatggaccaggccaggt

SEQ ID NO: 440790 - DNA, 25 bp, Homo sapien
tgcgcgatggtcacgcggcccagca

SEQ ID NO: 440791 - DNA, 25 bp, Homo sapien
gaaaagagcctttatgtccatcaaa

SEQ ID NO: 440792 - DNA, 25 bp, Homo sapien
aagagcctttatgtccatcaaaggg

SEQ ID NO: 440793 - DNA, 25 bp, Homo sapien
ccaggatctcggcagtcaagtactc

SEQ ID NO: 440794 - DNA, 25 bp, Homo sapien
aggatctcggcagtcaagtactcga

SEQ ID NO: 440795 - DNA, 25 bp, Homo sapien
tcggcagtcaagtactcgagcaccg

SEQ ID NO: 440796 - DNA, 25 bp, Homo sapien
gcagtcaagtactcgagcaccgcgg

SEQ ID NO: 440797 - DNA, 25 bp, Homo sapien
agtactcgagcaccgcggccagata

SEQ ID NO: 440798 - DNA, 25 bp, Homo sapien
ggcgggcggcctcacttgcccttgg

SEQ ID NO: 440799 - DNA, 25 bp, Homo sapien
tggtggctctccgtcttcttgggca

SEQ ID NO: 440800 - DNA, 25 bp, Homo sapien
gtggctctccgtcttcttgggcagc

SEQ ID NO: 440801 - DNA, 25 bp, Homo sapien
gatcttcccaacttcttcaaattca

SEQ ID NO: 440802 - DNA, 25 bp, Homo sapien
gaatgacagtcttatttcagcactt

SEQ ID NO: 440803 - DNA, 25 bp, Homo sapien
cacttactgctatcacctattactt

SEQ ID NO: 440804 - DNA, 25 bp, Homo sapien
attacttttatgtgtgtcttaccta

SEQ ID NO: 440805 - DNA, 25 bp, Homo sapien
gtgtcttacctatttgagatgccag

SEQ ID NO: 440806 - DNA, 25 bp, Homo sapien
ttgagatgccagattccttggaagt

SEQ ID NO: 440807 - DNA, 25 bp, Homo sapien
ttccttggaagtagagaccgtgtct

SEQ ID NO: 440808 - DNA, 25 bp, Homo sapien
gaccgtgtctgaatcatcattgtat

SEQ ID NO: 440809 - DNA, 25 bp, Homo sapien
tcattgtattaaaccgctcatcctt

SEQ ID NO: 440810 - DNA, 25 bp, Homo sapien
gctcatccttaacaaatgcccaagc

SEQ ID NO: 440811 - DNA, 25 bp, Homo sapien
ggcagaaatgtcattctcttccata

SEQ ID NO: 440812 - DNA, 25 bp, Homo sapien
ggtagtactgtaatgtaggattcac

SEQ ID NO: 440813 - DNA, 25 bp, Homo sapien
gtagtactgtaatgtaggattcacg

SEQ ID NO: 440814 - DNA, 25 bp, Homo sapien
tagtactgtaatgtaggattcacgt

SEQ ID NO: 440815 - DNA, 25 bp, Homo sapien
agtactgtaatgtaggattcacgta

SEQ ID NO: 440816 - DNA, 25 bp, Homo sapien
gtactgtaatgtaggattcacgtaa

SEQ ID NO: 440817 - DNA, 25 bp, Homo sapien
tactgtaatgtaggattcacgtaaa

SEQ ID NO: 440818 - DNA, 25 bp, Homo sapien
tgtaatgtaggattcacgtaaaatt

SEQ ID NO: 440819 - DNA, 25 bp, Homo sapien
aatgtaggattcacgtaaaattgga

SEQ ID NO: 440820 - DNA, 25 bp, Homo sapien
tgtaggattcacgtaaaattggatt

SEQ ID NO: 440821 - DNA, 25 bp, Homo sapien
taggattcacgtaaaattggatttc

SEQ ID NO: 440822 - DNA, 25 bp, Homo sapien
gattcacgtaaaattggatttcccg

SEQ ID NO: 440823 - DNA, 25 bp, Homo sapien
tcgacctgggatgggaagctcgacc

SEQ ID NO: 440824 - DNA, 25 bp, Homo sapien
cccaggatgggaagcctactttgtg

SEQ ID NO: 440825 - DNA, 25 bp, Homo sapien
atgggaagcctactttgtgttgaac

SEQ ID NO: 440826 - DNA, 25 bp, Homo sapien
gaagcctactttgtgttgaacttcc

SEQ ID NO: 440827 - DNA, 25 bp, Homo sapien
ttcctattttgtcactctctgcagg

SEQ ID NO: 440828 - DNA, 25 bp, Homo sapien
tctgcaggcccaatgaccagagaat

SEQ ID NO: 440829 - DNA, 25 bp, Homo sapien
tctctgccctttctggcaagattag

SEQ ID NO: 440830 - DNA, 25 bp, Homo sapien
tggcaagattagtggcttcccctca

SEQ ID NO: 440831 - DNA, 25 bp, Homo sapien
ttcttcccgccagtccagagagggt

SEQ ID NO: 440832 - DNA, 25 bp, Homo sapien
cgccagtccagagagggttcctaat

SEQ ID NO: 440833 - DNA, 25 bp, Homo sapien
cagagagggttcctaattggctttc

SEQ ID NO: 440834 - DNA, 25 bp, Homo sapien
gtcaagtctgcaagtacatttcaag

SEQ ID NO: 440835 - DNA, 25 bp, Homo sapien
gtctgcaagtacatttcaaggccct

SEQ ID NO: 440836 - DNA, 25 bp, Homo sapien
gcaagtacatttcaaggccctgctt

SEQ ID NO: 440837 - DNA, 25 bp, Homo sapien
aagtacatttcaaggccctgcttgt

SEQ ID NO: 440838 - DNA, 25 bp, Homo sapien
atctgttaacaactcatttgctaaa

SEQ ID NO: 440839 - DNA, 25 bp, Homo sapien
tgttaacaactcatttgctaaagca

SEQ ID NO: 440840 - DNA, 25 bp, Homo sapien
agcaagttatgtagctaagccagag

SEQ ID NO: 440841 - DNA, 25 bp, Homo sapien
gttatgtagctaagccagagatcag

SEQ ID NO: 440842 - DNA, 25 bp, Homo sapien
gagtgagcaactgtacttgcctctt

SEQ ID NO: 440843 - DNA, 25 bp, Homo sapien
agcaactgtacttgcctctttggga

SEQ ID NO: 440844 - DNA, 25 bp, Homo sapien
taaaggcttagatacagggaagggt

SEQ ID NO: 440845 - DNA, 25 bp, Homo sapien
aaattgtaggagtccagatgagaca

SEQ ID NO: 440846 - DNA, 25 bp, Homo sapien
tccagatgagacagaagccaccttt

SEQ ID NO: 440847 - DNA, 25 bp, Homo sapien
ccagatgagacagaagccacctttt

SEQ ID NO: 440848 - DNA, 25 bp, Homo sapien
tatccacattccataaaattcaccc

SEQ ID NO: 440849 - DNA, 25 bp, Homo sapien
atattcacaagtttgtttaatcctt

SEQ ID NO: 440850 - DNA, 25 bp, Homo sapien
tttaatccttaccactgtctaattc

SEQ ID NO: 440851 - DNA, 25 bp, Homo sapien
aatccttaccactgtctaattcaag

SEQ ID NO: 440852 - DNA, 25 bp, Homo sapien
cttaccactgtctaattcaagagta

SEQ ID NO: 440853 - DNA, 25 bp, Homo sapien
accactgtctaattcaagagtatta

SEQ ID NO: 440854 - DNA, 25 bp, Homo sapien
taattcaagagtattatcattaccc

SEQ ID NO: 440855 - DNA, 25 bp, Homo sapien
ctgagatggcgtcaccgcactcctg

SEQ ID NO: 440856 - DNA, 25 bp, Homo sapien
atggaaaacgctaagcccagtgact

SEQ ID NO: 440857 - DNA, 25 bp, Homo sapien
gctaagcccagtgactagaactaat

SEQ ID NO: 440858 - DNA, 25 bp, Homo sapien
ttccactcccataagctcaagggta

SEQ ID NO: 440859 - DNA, 25 bp, Homo sapien
tcccataagctcaagggtattacta

SEQ ID NO: 440860 - DNA, 25 bp, Homo sapien
ttactaaaaatgattgcctggccag

SEQ ID NO: 440861 - DNA, 25 bp, Homo sapien
tgcctggccagaattcctggcttaa

SEQ ID NO: 440862 - DNA, 25 bp, Homo sapien
cctggcttaaacttgtaactttctg

SEQ ID NO: 440863 - DNA, 25 bp, Homo sapien
atacatccacccctgcattcttaag

SEQ ID NO: 440864 - DNA, 25 bp, Homo sapien
aaaagaggtgacacattctttcctt

SEQ ID NO: 440865 - DNA, 25 bp, Homo sapien
ttctttccttttgctagactcatgt

SEQ ID NO: 440866 - DNA, 25 bp, Homo sapien
ttgctagactcatgtaaaagttgcc

SEQ ID NO: 440867 - DNA, 25 bp, Homo sapien
ccagtgttctcacccactgtttcca

SEQ ID NO: 440868 - DNA, 25 bp, Homo sapien
actgtttccatgatcactctcacaa

SEQ ID NO: 440869 - DNA, 25 bp, Homo sapien
tttccatgatcactctcacaacaga

SEQ ID NO: 440870 - DNA, 25 bp, Homo sapien
atgatcactctcacaacagaaaaat

SEQ ID NO: 440871 - DNA, 25 bp, Homo sapien
aaaattactcaagaataaggctggg

SEQ ID NO: 440872 - DNA, 25 bp, Homo sapien
gctcgcgcctgtaatgctggcattc

SEQ ID NO: 440873 - DNA, 25 bp, Homo sapien
cgcctgtaatgctggcattctggga

SEQ ID NO: 440874 - DNA, 25 bp, Homo sapien
gtggtggagtgcatctgtagtctaa

SEQ ID NO: 440875 - DNA, 25 bp, Homo sapien
gtggagtgcatctgtagtctaagat

SEQ ID NO: 440876 - DNA, 25 bp, Homo sapien
gtgcatctgtagtctaagatacttg

SEQ ID NO: 440877 - DNA, 25 bp, Homo sapien
tctaagatacttgggaggtcaacgc

SEQ ID NO: 440878 - DNA, 25 bp, Homo sapien
attgttgtttttacgcatttgactt

SEQ ID NO: 440879 - DNA, 25 bp, Homo sapien
gcatttgacttgatttcacccttca

SEQ ID NO: 440880 - DNA, 25 bp, Homo sapien
gacttgatttcacccttcaggctca

SEQ ID NO: 440881 - DNA, 25 bp, Homo sapien
tgtgaggcctttccactgcattcag

SEQ ID NO: 440882 - DNA, 25 bp, Homo sapien
ctttccactgcattcagttgttctt

SEQ ID NO: 440883 - DNA, 25 bp, Homo sapien
agttgttctttcttgaatgttagag

SEQ ID NO: 440884 - DNA, 25 bp, Homo sapien
gggaactgaacacaccgcacgcagc

SEQ ID NO: 440885 - DNA, 25 bp, Homo sapien
tgacccacgcagcacaaatcactag

SEQ ID NO: 440886 - DNA, 25 bp, Homo sapien
aaatcactagttccagcggcgacaa

SEQ ID NO: 440887 - DNA, 25 bp, Homo sapien
agcggcgacaacactaacatttata

SEQ ID NO: 440888 - DNA, 25 bp, Homo sapien
acatcatgcaagttgtagtctttta

SEQ ID NO: 440889 - DNA, 25 bp, Homo sapien
ctctcccagtgagtcctcatttcgc

SEQ ID NO: 440890 - DNA, 25 bp, Homo sapien
tctcccagtgagtcctcatttcgcc

SEQ ID NO: 440891 - DNA, 25 bp, Homo sapien
ctcccagtgagtcctcatttcgcct

SEQ ID NO: 440892 - DNA, 25 bp, Homo sapien
ccagtgagtcctcatttcgcctctt

SEQ ID NO: 440893 - DNA, 25 bp, Homo sapien
cagtgagtcctcatttcgcctcttt

SEQ ID NO: 440894 - DNA, 25 bp, Homo sapien
agtgagtcctcatttcgcctctttg

SEQ ID NO: 440895 - DNA, 25 bp, Homo sapien
gtgagtcctcatttcgcctctttgg

SEQ ID NO: 440896 - DNA, 25 bp, Homo sapien
tgagtcctcatttcgcctctttggt

SEQ ID NO: 440897 - DNA, 25 bp, Homo sapien
gagtcctcatttcgcctctttggtt

SEQ ID NO: 440898 - DNA, 25 bp, Homo sapien
agtcctcatttcgcctctttggttt

SEQ ID NO: 440899 - DNA, 25 bp, Homo sapien
tcctcatttcgcctctttggttttt

SEQ ID NO: 440900 - DNA, 25 bp, Homo sapien
catacatcctaatatctggtaggta

SEQ ID NO: 440901 - DNA, 25 bp, Homo sapien
gaaactgtaggcaattaatggtagt

SEQ ID NO: 440902 - DNA, 25 bp, Homo sapien
gtagtgccaatgtatgaattctttc

SEQ ID NO: 440903 - DNA, 25 bp, Homo sapien
tacacaattttacgaaagtagggct

SEQ ID NO: 440904 - DNA, 25 bp, Homo sapien
gagtaatgatgcctgtggtatagta

SEQ ID NO: 440905 - DNA, 25 bp, Homo sapien
cctgtggtatagtagtgtggcttgt

SEQ ID NO: 440906 - DNA, 25 bp, Homo sapien
tggcttgtaattacactgtgtttag

SEQ ID NO: 440907 - DNA, 25 bp, Homo sapien
actgtgtttagcctgactctccatt

SEQ ID NO: 440908 - DNA, 25 bp, Homo sapien
tgtttagcctgactctccatttcac

SEQ ID NO: 440909 - DNA, 25 bp, Homo sapien
tccatttcactcttttgggtttaat

SEQ ID NO: 440910 - DNA, 25 bp, Homo sapien
tatactctccatttggagaccaagg

SEQ ID NO: 440911 - DNA, 25 bp, Homo sapien
gagcaacactactgggtgaccctga

SEQ ID NO: 440912 - DNA, 25 bp, Homo sapien
tgggtgaccctgaaccgactaaaag

SEQ ID NO: 440913 - DNA, 25 bp, Homo sapien
aaggtgctacaccaaacgctggctg

SEQ ID NO: 440914 - DNA, 25 bp, Homo sapien
aatgttcgagccattaagccgctac

SEQ ID NO: 440915 - DNA, 25 bp, Homo sapien
taagccgctacgtcgaagacatctg

SEQ ID NO: 440916 - DNA, 25 bp, Homo sapien
agacatctgcgtatacggaccagga

SEQ ID NO: 440917 - DNA, 25 bp, Homo sapien
aggagacctgccgtggctcattcag

SEQ ID NO: 440918 - DNA, 25 bp, Homo sapien
tttgccaacaaattcgaaccctcga

SEQ ID NO: 440919 - DNA, 25 bp, Homo sapien
agacccgcttgtggttacctgctta

SEQ ID NO: 440920 - DNA, 25 bp, Homo sapien
ttacctgcttagagcggcggcacag

SEQ ID NO: 440921 - DNA, 25 bp, Homo sapien
gcagaagttcctatagagccacact

SEQ ID NO: 440922 - DNA, 25 bp, Homo sapien
tatttttctgctttctatggggggg

SEQ ID NO: 440923 - DNA, 25 bp, Homo sapien
agaatttgggccaggaactgtggct

SEQ ID NO: 440924 - DNA, 25 bp, Homo sapien
gaatttgggccaggaactgtggctc

SEQ ID NO: 440925 - DNA, 25 bp, Homo sapien
aatttgggccaggaactgtggctca

SEQ ID NO: 440926 - DNA, 25 bp, Homo sapien
atttgggccaggaactgtggctcat

SEQ ID NO: 440927 - DNA, 25 bp, Homo sapien
ttgggccaggaactgtggctcatgc

SEQ ID NO: 440928 - DNA, 25 bp, Homo sapien
cgtgcctgtggttcctgttacttgg

SEQ ID NO: 440929 - DNA, 25 bp, Homo sapien
gtgcctgtggttcctgttacttggg

SEQ ID NO: 440930 - DNA, 25 bp, Homo sapien
tgcctgtggttcctgttacttggga

SEQ ID NO: 440931 - DNA, 25 bp, Homo sapien
gcctgtggttcctgttacttgggag

SEQ ID NO: 440932 - DNA, 25 bp, Homo sapien
tgtggttcctgttacttgggaggct

SEQ ID NO: 440933 - DNA, 25 bp, Homo sapien
cctgggtaatgtggcgaaacctcat

SEQ ID NO: 440934 - DNA, 25 bp, Homo sapien
ttcagtgagccgtgggaagattgcc

SEQ ID NO: 440935 - DNA, 25 bp, Homo sapien
gtgagccgtgggaagattgcctgag

SEQ ID NO: 440936 - DNA, 25 bp, Homo sapien
ttgtatcactgcacaactgttgcct

SEQ ID NO: 440937 - DNA, 25 bp, Homo sapien
tgtatcactgcacaactgttgcctg

SEQ ID NO: 440938 - DNA, 25 bp, Homo sapien
gtatcactgcacaactgttgcctgg

SEQ ID NO: 440939 - DNA, 25 bp, Homo sapien
tatcactgcacaactgttgcctggg

SEQ ID NO: 440940 - DNA, 25 bp, Homo sapien
atcactgcacaactgttgcctgggc

SEQ ID NO: 440941 - DNA, 25 bp, Homo sapien
tcactgcacaactgttgcctgggca

SEQ ID NO: 440942 - DNA, 25 bp, Homo sapien
cactgcacaactgttgcctgggcaa

SEQ ID NO: 440943 - DNA, 25 bp, Homo sapien
actgcacaactgttgcctgggcaac

SEQ ID NO: 440944 - DNA, 25 bp, Homo sapien
gggagagagatgttcagccaagaaa

SEQ ID NO: 440945 - DNA, 25 bp, Homo sapien
gagagatgttcagccaagaaagtct

SEQ ID NO: 440946 - DNA, 25 bp, Homo sapien
gatgttcagccaagaaagtctaaaa

SEQ ID NO: 440947 - DNA, 25 bp, Homo sapien
gggaatgttcagttataacaaaaca

SEQ ID NO: 440948 - DNA, 25 bp, Homo sapien
atttttgtaattagagtgctgggtt

SEQ ID NO: 440949 - DNA, 25 bp, Homo sapien
aattagagtgctgggttgtgctcag

SEQ ID NO: 440950 - DNA, 25 bp, Homo sapien
gagtgctgggttgtgctcagcatca

SEQ ID NO: 440951 - DNA, 25 bp, Homo sapien
gtgctgggttgtgctcagcatcatt

SEQ ID NO: 440952 - DNA, 25 bp, Homo sapien
ctgggttgtgctcagcatcattgga

SEQ ID NO: 440953 - DNA, 25 bp, Homo sapien
gttgtgctcagcatcattggagtta

SEQ ID NO: 440954 - DNA, 25 bp, Homo sapien
tgtgctcagcatcattggagttaaa

SEQ ID NO: 440955 - DNA, 25 bp, Homo sapien
agctttcaaccatccgcagcttcct

SEQ ID NO: 440956 - DNA, 25 bp, Homo sapien
tggcttcctggacctcacagagcag

SEQ ID NO: 440957 - DNA, 25 bp, Homo sapien
ttcctggacctcacagagcaggagt

SEQ ID NO: 440958 - DNA, 25 bp, Homo sapien
cctggacctcacagagcaggagttc

SEQ ID NO: 440959 - DNA, 25 bp, Homo sapien
ttcagtcagcctcagaggttgactt

SEQ ID NO: 440960 - DNA, 25 bp, Homo sapien
tcagcctcagaggttgacttctaca

SEQ ID NO: 440961 - DNA, 25 bp, Homo sapien
gcctcagaggttgacttctacattg

SEQ ID NO: 440962 - DNA, 25 bp, Homo sapien
cagaggttgacttctacattgataa

SEQ ID NO: 440963 - DNA, 25 bp, Homo sapien
ggttgacttctacattgataaggac

SEQ ID NO: 440964 - DNA, 25 bp, Homo sapien
gacttctacattgataaggacatga

SEQ ID NO: 440965 - DNA, 25 bp, Homo sapien
cattgataaggacatgatccacatc

SEQ ID NO: 440966 - DNA, 25 bp, Homo sapien
gctttctgtaagtcatgccattgtg

SEQ ID NO: 440967 - DNA, 25 bp, Homo sapien
agtcatgccattgtgtagtcttaat

SEQ ID NO: 440968 - DNA, 25 bp, Homo sapien
gtagtcttaattgctttctctcacc

SEQ ID NO: 440969 - DNA, 25 bp, Homo sapien
tgctttctctcaccagggaaggtgt

SEQ ID NO: 440970 - DNA, 25 bp, Homo sapien
ggacttgtgaaatacatattcgagg

SEQ ID NO: 440971 - DNA, 25 bp, Homo sapien
gaggaaaaactatgcacaaggccgt

SEQ ID NO: 440972 - DNA, 25 bp, Homo sapien
gcacaaggccgtgcatttaaaaata

SEQ ID NO: 440973 - DNA, 25 bp, Homo sapien
ggtgaaacctgctacggtctgcgca

SEQ ID NO: 440974 - DNA, 25 bp, Homo sapien
tacggtctgcgcaagttgactgtta

SEQ ID NO: 440975 - DNA, 25 bp, Homo sapien
atgaatttgattctcaggtgtgagt

SEQ ID NO: 440976 - DNA, 25 bp, Homo sapien
gaacactgatcatgtcattttcttt

SEQ ID NO: 440977 - DNA, 25 bp, Homo sapien
caacttaaggatattgagggtcaga

SEQ ID NO: 440978 - DNA, 25 bp, Homo sapien
gagggtcagagaagtaaggtttatt

SEQ ID NO: 440979 - DNA, 25 bp, Homo sapien
atgttttctggaatttatagggtgt

SEQ ID NO: 440980 - DNA, 25 bp, Homo sapien
gggttacctaatgagccattcttct

SEQ ID NO: 440981 - DNA, 25 bp, Homo sapien
gccattcttctaggctctgtaaggt

SEQ ID NO: 440982 - DNA, 25 bp, Homo sapien
taggctctgtaaggtatgccctttt

SEQ ID NO: 440983 - DNA, 25 bp, Homo sapien
taaggtatgcccttttggctaggat

SEQ ID NO: 440984 - DNA, 25 bp, Homo sapien
atgcccttttggctaggatatttta

SEQ ID NO: 440985 - DNA, 25 bp, Homo sapien
gcttttaatattgtgctttgtagaa

SEQ ID NO: 440986 - DNA, 25 bp, Homo sapien
gtgctttgtagaaatttacgatttt

SEQ ID NO: 440987 - DNA, 25 bp, Homo sapien
atttgcaattgatagattacactta

SEQ ID NO: 440988 - DNA, 25 bp, Homo sapien
atgccggtcagattcaatctcccaa

SEQ ID NO: 440989 - DNA, 25 bp, Homo sapien
aatctcccaactatccggatgacta

SEQ ID NO: 440990 - DNA, 25 bp, Homo sapien
ggatgactacagaccttccaaggaa

SEQ ID NO: 440991 - DNA, 25 bp, Homo sapien
ggacttaccttccaagcttttgaga

SEQ ID NO: 440992 - DNA, 25 bp, Homo sapien
acagctgtgcatatgactacctgga

SEQ ID NO: 440993 - DNA, 25 bp, Homo sapien
gactacctggaagtccgggatggcc

SEQ ID NO: 440994 - DNA, 25 bp, Homo sapien
gaagagagtgccctgatcggccact

SEQ ID NO: 440995 - DNA, 25 bp, Homo sapien
gatcggccacttttgtggctatgag

SEQ ID NO: 440996 - DNA, 25 bp, Homo sapien
gtgaaatcgagctccaacagactgt

SEQ ID NO: 440997 - DNA, 25 bp, Homo sapien
gatgaagtttgtgtccgatggctct

SEQ ID NO: 440998 - DNA, 25 bp, Homo sapien
gtgtccgatggctctatcaataaag

SEQ ID NO: 440999 - DNA, 25 bp, Homo sapien
aattcgtgcaatgttcttcatcctc

SEQ ID NO: 441000 - DNA, 25 bp, Homo sapien
ttcatcctcagtctccgaataattc

SEQ ID NO: 441001 - DNA, 25 bp, Homo sapien
caggcaaggttgcaaagttccattt

SEQ ID NO: 441002 - DNA, 25 bp, Homo sapien
aaatattttccatcttcctctccag

SEQ ID NO: 441003 - DNA, 25 bp, Homo sapien
cttcctctccagtaaacattctttt

SEQ ID NO: 441004 - DNA, 25 bp, Homo sapien
ttcttttgtcatcacagtctgtctc

SEQ ID NO: 441005 - DNA, 25 bp, Homo sapien
tgtctctgacaccttcgttaaagag

SEQ ID NO: 441006 - DNA, 25 bp, Homo sapien
ttgaactttggtcagtgtgggcccc

SEQ ID NO: 441007 - DNA, 25 bp, Homo sapien
cctgcaagtctttgtcagtccatct

SEQ ID NO: 441008 - DNA, 25 bp, Homo sapien
gtcagtccatctcaagacctgtgcc

SEQ ID NO: 441009 - DNA, 25 bp, Homo sapien
gacctgtgcctgtcagatttcacaa

SEQ ID NO: 441010 - DNA, 25 bp, Homo sapien
gtgtagggtcactcgtctgggaaca

SEQ ID NO: 441011 - DNA, 25 bp, Homo sapien
tagggtcactcgtctgggaacacag

SEQ ID NO: 441012 - DNA, 25 bp, Homo sapien
gggtcactcgtctgggaacacagta

SEQ ID NO: 441013 - DNA, 25 bp, Homo sapien
actcgtctgggaacacagtagtgaa

SEQ ID NO: 441014 - DNA, 25 bp, Homo sapien
acacagtagtgaactaagaaagccc

SEQ ID NO: 441015 - DNA, 25 bp, Homo sapien
agcccttgagttcaagaaacttagt

SEQ ID NO: 441016 - DNA, 25 bp, Homo sapien
agttcaagaaacttagttgcacggg

SEQ ID NO: 441017 - DNA, 25 bp, Homo sapien
gggaatcctttcagctatgtattaa

SEQ ID NO: 441018 - DNA, 25 bp, Homo sapien
agctatgtattaagtatgcaatgcc

SEQ ID NO: 441019 - DNA, 25 bp, Homo sapien
gtatgcaatgccagttagtcatgtg

SEQ ID NO: 441020 - DNA, 25 bp, Homo sapien
cagttagtcatgtgtgtggaaaaga

SEQ ID NO: 441021 - DNA, 25 bp, Homo sapien
cgtgtagtcaggcttggcacatatt

SEQ ID NO: 441022 - DNA, 25 bp, Homo sapien
agtcaggcttggcacatattggttg

SEQ ID NO: 441023 - DNA, 25 bp, Homo sapien
aggcttggcacatattggttgctgt

SEQ ID NO: 441024 - DNA, 25 bp, Homo sapien
ttggcacatattggttgctgtggtt

SEQ ID NO: 441025 - DNA, 25 bp, Homo sapien
ttgctgtggttagcagcctggtgat

SEQ ID NO: 441026 - DNA, 25 bp, Homo sapien
cagcctggtgatggcccatacagac

SEQ ID NO: 441027 - DNA, 25 bp, Homo sapien
cccctaacccctagtctgggcagtg

SEQ ID NO: 441028 - DNA, 25 bp, Homo sapien
agcactgccagcctacagatgtgtt

SEQ ID NO: 441029 - DNA, 25 bp, Homo sapien
actgccagcctacagatgtgtttat

SEQ ID NO: 441030 - DNA, 25 bp, Homo sapien
cttacatttaagtgagttgccaaca

SEQ ID NO: 441031 - DNA, 25 bp, Homo sapien
taagtgagttgccaacattttaaaa

SEQ ID NO: 441032 - DNA, 25 bp, Homo sapien
taactcgagacagtgcaggaaaaat

SEQ ID NO: 441033 - DNA, 25 bp, Homo sapien
actcgagacagtgcaggaaaaatat

SEQ ID NO: 441034 - DNA, 25 bp, Homo sapien
atatcatttaaaacctaaccttgag

SEQ ID NO: 441035 - DNA, 25 bp, Homo sapien
tatcatttaaaacctaaccttgagg

SEQ ID NO: 441036 - DNA, 25 bp, Homo sapien
tcatttaaaacctaaccttgaggct

SEQ ID NO: 441037 - DNA, 25 bp, Homo sapien
catttaaaacctaaccttgaggctg

SEQ ID NO: 441038 - DNA, 25 bp, Homo sapien
taaaacctaaccttgaggctgggcg

SEQ ID NO: 441039 - DNA, 25 bp, Homo sapien
acctaaccttgaggctgggcgtact

SEQ ID NO: 441040 - DNA, 25 bp, Homo sapien
cctaaccttgaggctgggcgtactg

SEQ ID NO: 441041 - DNA, 25 bp, Homo sapien
aaccttgaggctgggcgtactggct

SEQ ID NO: 441042 - DNA, 25 bp, Homo sapien
gaggctgggcgtactggctcaggcc

SEQ ID NO: 441043 - DNA, 25 bp, Homo sapien
ctttagaattctattacagcgatca

SEQ ID NO: 441044 - DNA, 25 bp, Homo sapien
gaattctattacagcgatcaaactt

SEQ ID NO: 441045 - DNA, 25 bp, Homo sapien
tacagcgatcaaacttttgtgccaa

SEQ ID NO: 441046 - DNA, 25 bp, Homo sapien
gcgatcaaacttttgtgccaaagca

SEQ ID NO: 441047 - DNA, 25 bp, Homo sapien
ttgtgccaaagcagggacccaaaat

SEQ ID NO: 441048 - DNA, 25 bp, Homo sapien
agcagggacccaaaatgtgtaattt

SEQ ID NO: 441049 - DNA, 25 bp, Homo sapien
aaaatgtgtaattttaatgcactac

SEQ ID NO: 441050 - DNA, 25 bp, Homo sapien
aatgtttgtgccttgcctcacccca
